United States Patent 7,618,814 (MICRORNA-RELATED NUCLEIC ACIDS AND USES THEREOF) - sequence listing, part 3

SEQ ID NO: 73907 - RNA, 32 nt, Human
auuguacauaacugguauaugugcacaagcau

SEQ ID NO: 73908 - RNA, 32 nt, Human
auuguacauccuuuucuuuucuccccuugggu

SEQ ID NO: 73909 - RNA, 32 nt, Human
auuguacauugggcacauaucuccucuugggc

SEQ ID NO: 73910 - RNA, 32 nt, Human
auuguaccacugcacuccaaccuggguuacag

SEQ ID NO: 73911 - RNA, 32 nt, Human
auuguaccacugcacuccagccugggcaacag

SEQ ID NO: 73912 - RNA, 32 nt, Human
auuguaccacugcacuccagccugggcgacag

SEQ ID NO: 73913 - RNA, 32 nt, Human
auuguaccacugcacuccagccugggugacag

SEQ ID NO: 73914 - RNA, 32 nt, Human
auuguaccacugcacuccagccuggucaaugg

SEQ ID NO: 73915 - RNA, 32 nt, Human
auuguaccacugcacuccagcucggggaacag

SEQ ID NO: 73916 - RNA, 32 nt, Human
auuguaccacugcacuccagucugggcaacag

SEQ ID NO: 73917 - RNA, 32 nt, Human
auuguaccacugcacuccaguuuggcaacaga

SEQ ID NO: 73918 - RNA, 32 nt, Human
auuguaccacugcgcuccaaacugggugacau

SEQ ID NO: 73919 - RNA, 32 nt, Human
auuguaccacuguacuccagccugggcuggac

SEQ ID NO: 73920 - RNA, 32 nt, Human
auuguaccacuguauuccagccuggacgacug

SEQ ID NO: 73921 - RNA, 32 nt, Human
auuguaccaugcacuccagccuggguaacaga

SEQ ID NO: 73922 - RNA, 32 nt, Human
auuguaccauggcacuccagccuggacaacaa

SEQ ID NO: 73923 - RNA, 32 nt, Human
auuguaccauugcacuccagccugggcaacaa

SEQ ID NO: 73924 - RNA, 32 nt, Human
auuguaccauugcacuccagccugggcaacag

SEQ ID NO: 73925 - RNA, 32 nt, Human
auuguacccaacucuauuucucuccauacuga

SEQ ID NO: 73926 - RNA, 32 nt, Human
auuguaccuaaaggagaguaacuaaugguaac

SEQ ID NO: 73927 - RNA, 32 nt, Human
auuguacugcaaccucagcuggcaucauggac

SEQ ID NO: 73928 - RNA, 32 nt, Human
auuguacuguaucugauuucugugccagucau

SEQ ID NO: 73929 - RNA, 32 nt, Human
auuguacuuuuccuugauguucuuaaaaggua

SEQ ID NO: 73930 - RNA, 32 nt, Human
auuguagaaauagcuuaacccuuucauuuacc

SEQ ID NO: 73931 - RNA, 32 nt, Human
auuguagacacagggucucacuauguugccca

SEQ ID NO: 73932 - RNA, 32 nt, Human
auuguagaccucuauuacuuuugucugcucag

SEQ ID NO: 73933 - RNA, 32 nt, Human
auuguagagacggagucucccuauguugccua

SEQ ID NO: 73934 - RNA, 32 nt, Human
auuguagagcuugguggcugagcuuggcccua

SEQ ID NO: 73935 - RNA, 32 nt, Human
auuguagauuuucugcagucacccauacuuaa

SEQ ID NO: 73936 - RNA, 32 nt, Human
auuguagccagccucagcacucagugaguuca

SEQ ID NO: 73937 - RNA, 32 nt, Human
auuguagcccaggaguuugagaacagccuggg

SEQ ID NO: 73938 - RNA, 32 nt, Human
auuguagccucaaccucccaggcuccaagcag

SEQ ID NO: 73939 - RNA, 32 nt, Human
auuguagccuccauacaguggggucuucucug

SEQ ID NO: 73940 - RNA, 32 nt, Human
auuguagcucacugcagccuccaacuccaugg

SEQ ID NO: 73941 - RNA, 32 nt, Human
auuguagcucacugcagucuucagccucccca

SEQ ID NO: 73942 - RNA, 32 nt, Human
auuguagcugccauuccaucuguucuagggag

SEQ ID NO: 73943 - RNA, 32 nt, Human
auuguagugauaccuuaaaucauguauucagg

SEQ ID NO: 73944 - RNA, 22 nt, Human
auuguaguuuugcugcucaucc

SEQ ID NO: 73945 - RNA, 32 nt, Human
auuguauaaguccugauuaaauccagggcuua

SEQ ID NO: 73946 - RNA, 32 nt, Human
auuguauaccuaaacagagauagcucaucuuu

SEQ ID NO: 73947 - RNA, 32 nt, Human
auuguauagauuucacaacacaaaaaggacau

SEQ ID NO: 73948 - RNA, 32 nt, Human
auuguaucacauagaaauauggccaggaagga

SEQ ID NO: 73949 - RNA, 32 nt, Human
auuguaucuccauccagaugguggaguaccgc

SEQ ID NO: 73950 - RNA, 32 nt, Human
auuguaugaaguuucacaugcuagaaauacuc

SEQ ID NO: 73951 - RNA, 32 nt, Human
auuguaugacugcacuccagccugggugacag

SEQ ID NO: 73952 - RNA, 32 nt, Human
auuguauggaaaggaaaaugcaggaaauggga

SEQ ID NO: 73953 - RNA, 32 nt, Human
auuguauguguaugcacaugaucaugugugua

SEQ ID NO: 73954 - RNA, 32 nt, Human
auuguauguguauuuauauguuuuuaaucauu

SEQ ID NO: 73955 - RNA, 32 nt, Human
auuguauucaaaugcuguaucuuucaugaaag

SEQ ID NO: 73956 - RNA, 32 nt, Human
auuguauugaccaccaguacuucuauaauggu

SEQ ID NO: 73957 - RNA, 32 nt, Human
auuguauugcuguccaacagggguugggaggg

SEQ ID NO: 73958 - RNA, 32 nt, Human
auuguauuugaauuugugccucuuuguuuuuc

SEQ ID NO: 73959 - RNA, 32 nt, Human
auugucaaagccuaggaagaccaguuuaagaa

SEQ ID NO: 73960 - RNA, 32 nt, Human
auugucaaccugaagaacaagcagaaagaggc

SEQ ID NO: 73961 - RNA, 32 nt, Human
auugucaaggcaugcauauucuaaagaauuaa

SEQ ID NO: 73962 - RNA, 32 nt, Human
auugucaaugaucuuaaaugucugaagacaau

SEQ ID NO: 73963 - RNA, 32 nt, Human
auugucacaauauaauagaaauguuagcaacc

SEQ ID NO: 73964 - RNA, 32 nt, Human
auugucacaucgauucacucuccugggaggcc

SEQ ID NO: 73965 - RNA, 25 nt, Human
auugucaccaggcuggagugcagug

SEQ ID NO: 73966 - RNA, 32 nt, Human
auugucaccauggcuuucccaacucuccaagc

SEQ ID NO: 73967 - RNA, 25 nt, Human
auugucacccaggcuggagugcagu

SEQ ID NO: 73968 - RNA, 32 nt, Human
auugucacucugauguucaugugaacugguug

SEQ ID NO: 73969 - RNA, 32 nt, Human
auugucagaacagguggcugcuguguggugcc

SEQ ID NO: 73970 - RNA, 32 nt, Human
auugucagagacuggugggaggaagccugggg

SEQ ID NO: 73971 - RNA, 24 nt, Human
auugucagauucaccaagguugaa

SEQ ID NO: 73972 - RNA, 24 nt, Human
auugucagauucauugaaguugaa

SEQ ID NO: 73973 - RNA, 32 nt, Human
auugucagcaucauuuucaucuguaagucacu

SEQ ID NO: 73974 - RNA, 32 nt, Human
auugucagguaauacucuaugguucuauuucu

SEQ ID NO: 73975 - RNA, 32 nt, Human
auugucagguauagggccacuuggagaugcag

SEQ ID NO: 73976 - RNA, 32 nt, Human
auugucagugcccuaagguauccauugguucc

SEQ ID NO: 73977 - RNA, 32 nt, Human
auugucauaaacaucugcccccgugugguucu

SEQ ID NO: 73978 - RNA, 32 nt, Human
auugucauagugaccuugaaaaccacuggcuu

SEQ ID NO: 73979 - RNA, 24 nt, Human
auugucaugaaaaauugggguuga

SEQ ID NO: 73980 - RNA, 32 nt, Human
auugucauuccacuccagguccuggcaaaugu

SEQ ID NO: 73981 - RNA, 32 nt, Human
auugucauuuggagaaacaauaaaagauuucu

SEQ ID NO: 73982 - RNA, 32 nt, Human
auugucauuuguaaaagugauacaugacuguu

SEQ ID NO: 73983 - RNA, 32 nt, Human
auuguccacuuccugagaguaaggcugacuug

SEQ ID NO: 73984 - RNA, 32 nt, Human
auuguccaggcuggauucaaacuccugggcuc

SEQ ID NO: 73985 - RNA, 32 nt, Human
auugucccaagcagaaaaauaauggcuauuag

SEQ ID NO: 73986 - RNA, 32 nt, Human
auugucccaucuucacccccauuccagagcag

SEQ ID NO: 73987 - RNA, 32 nt, Human
auugucccccaccaccuucuucuauaaaugca

SEQ ID NO: 73988 - RNA, 32 nt, Human
auuguccccuccauucuaggauuucaucguca

SEQ ID NO: 73989 - RNA, 32 nt, Human
auugucccuugccaucucuugcuuuuucccuu

SEQ ID NO: 73990 - RNA, 32 nt, Human
auuguccggcuucucaucuguuucccagaguu

SEQ ID NO: 73991 - RNA, 32 nt, Human
auuguccuccaacauccucccaccucuuugac

SEQ ID NO: 73992 - RNA, 32 nt, Human
auuguccugccuccucaacuuccugacuacag

SEQ ID NO: 73993 - RNA, 32 nt, Human
auuguccugccuguguuccagcaugcuuauuu

SEQ ID NO: 73994 - RNA, 32 nt, Human
auuguccugucuaguuugaauauuucaagaac

SEQ ID NO: 73995 - RNA, 32 nt, Human
auuguccuugcucacaugcugccaucauguca

SEQ ID NO: 73996 - RNA, 32 nt, Human
auuguccuuggggcggggugguugcaguagug

SEQ ID NO: 73997 - RNA, 32 nt, Human
auuguccuuuucucccauuucuugcuagcuau

SEQ ID NO: 73998 - RNA, 32 nt, Human
auugucgaauacugacaguuuuccaaagugca

SEQ ID NO: 73999 - RNA, 22 nt, Human
auugucgugaaauagguuagaa

SEQ ID NO: 74000 - RNA, 32 nt, Human
auugucuacuuucuucuccauccugcuuuaaa

SEQ ID NO: 74001 - RNA, 32 nt, Human
auugucuagaagccuaaggacagcaauuucuc

SEQ ID NO: 74002 - RNA, 32 nt, Human
auugucuauagggcagggccaagagcaggaac

SEQ ID NO: 74003 - RNA, 32 nt, Human
auugucucaccuuuugccuggguggcugccug

SEQ ID NO: 74004 - RNA, 32 nt, Human
auugucucauuuucccagggggugggucaugg

SEQ ID NO: 74005 - RNA, 32 nt, Human
auugucucauuuuucaaugucacaaaccacgg

SEQ ID NO: 74006 - RNA, 32 nt, Human
auugucuccauuucucuuucuccagagcuccu

SEQ ID NO: 74007 - RNA, 32 nt, Human
auugucucugacugcagguuugaauaaguuga

SEQ ID NO: 74008 - RNA, 32 nt, Human
auugucugaggaccccaagagcagugauucag

SEQ ID NO: 74009 - RNA, 32 nt, Human
auugucugagucugugcacguacuuuuagaua

SEQ ID NO: 74010 - RNA, 32 nt, Human
auugucugcuuugcaauagcaaagacuuggaa

SEQ ID NO: 74011 - RNA, 32 nt, Human
auugucugguugacaccagguccugguuuugu

SEQ ID NO: 74012 - RNA, 32 nt, Human
auugucuuauaccuugacauuuuucuacucgu

SEQ ID NO: 74013 - RNA, 32 nt, Human
auugucuuaucaaaguaguguucuaacuuuaa

SEQ ID NO: 74014 - RNA, 32 nt, Human
auugucuucccaggagauggaaaaagacgcca

SEQ ID NO: 74015 - RNA, 32 nt, Human
auugugaaaccagcuucaauuucugaggaaga

SEQ ID NO: 74016 - RNA, 32 nt, Human
auugugaaccuccugaaugccugagacucuag

SEQ ID NO: 74017 - RNA, 32 nt, Human
auugugaaccuguguacgcacacacacauaua

SEQ ID NO: 74018 - RNA, 32 nt, Human
auugugaacucuccaccauacccaguaccguc

SEQ ID NO: 74019 - RNA, 32 nt, Human
auugugaauacaugcuguuaccagcuuccuua

SEQ ID NO: 74020 - RNA, 32 nt, Human
auugugaaucaggcagucacacuggacaacau

SEQ ID NO: 74021 - RNA, 32 nt, Human
auugugacacugcacuccagccugggcaacag

SEQ ID NO: 74022 - RNA, 32 nt, Human
auugugacacugcccuccagccugggugacag

SEQ ID NO: 74023 - RNA, 32 nt, Human
auugugaccacaggcugguguguaggugguaa

SEQ ID NO: 74024 - RNA, 25 nt, Human
auugugacgcuuuuggccuggcugg

SEQ ID NO: 74025 - RNA, 32 nt, Human
auugugacugaucaugauuuauuugaagaugg

SEQ ID NO: 74026 - RNA, 32 nt, Human
auugugagaaccagauauuacucaacagaaag

SEQ ID NO: 74027 - RNA, 32 nt, Human
auugugagaucacaaguggaggcuccaaccag

SEQ ID NO: 74028 - RNA, 32 nt, Human
auugugagcacacauaguaccuaguuacaucu

SEQ ID NO: 74029 - RNA, 32 nt, Human
auugugagccucuauguuuucuguuaggugag

SEQ ID NO: 74030 - RNA, 32 nt, Human
auugugagccuggagaaguagcauuuaguugg

SEQ ID NO: 74031 - RNA, 22 nt, Human
auugugaggaccacccaagaaa

SEQ ID NO: 74032 - RNA, 32 nt, Human
auugugagggggaccauaaaaggauggaaacu

SEQ ID NO: 74033 - RNA, 32 nt, Human
auugugagucacugacuuuucccccugggaaa

SEQ ID NO: 74034 - RNA, 32 nt, Human
auugugagucagucucaguagccaucagccug

SEQ ID NO: 74035 - RNA, 32 nt, Human
auugugauaugaaaacagcuauagacaaucau

SEQ ID NO: 74036 - RNA, 32 nt, Human
auugugaugccggcaggcagagcagcuacuga

SEQ ID NO: 74037 - RNA, 32 nt, Human
auugugcaaaauggcauaccugucuuucuccc

SEQ ID NO: 74038 - RNA, 32 nt, Human
auugugcaaagucaccugcccaauaaagcuug

SEQ ID NO: 74039 - RNA, 32 nt, Human
auugugcaaugcauuaagaaacccauccagcu

SEQ ID NO: 74040 - RNA, 32 nt, Human
auugugcacaacuuccuccaccuuucccuugg

SEQ ID NO: 74041 - RNA, 32 nt, Human
auugugcacugcacucuagccugggggaagag

SEQ ID NO: 74042 - RNA, 32 nt, Human
auugugcagacaagguagaguguguggucccu

SEQ ID NO: 74043 - RNA, 32 nt, Human
auugugcagauggggaaacugagguuugcggg

SEQ ID NO: 74044 - RNA, 32 nt, Human
auugugcauugcacuccagccugagcaacagg

SEQ ID NO: 74045 - RNA, 32 nt, Human
auugugccacacacuccagccuggguggcaaa

SEQ ID NO: 74046 - RNA, 32 nt, Human
auugugccaccacacuccagccugggcgacag

SEQ ID NO: 74047 - RNA, 32 nt, Human
auugugccaccgcacuccagcaugggugacag

SEQ ID NO: 74048 - RNA, 32 nt, Human
auugugccaccuucauuaagagucauuacaau

SEQ ID NO: 74049 - RNA, 32 nt, Human
auugugccacggcacuccagccugggcagcag

SEQ ID NO: 74050 - RNA, 32 nt, Human
auugugccacuacacuccagccuggccacaga

SEQ ID NO: 74051 - RNA, 32 nt, Human
auugugccacuacacuccagccuggccgacag

SEQ ID NO: 74052 - RNA, 32 nt, Human
auugugccacuacacuccagccugggagacag

SEQ ID NO: 74053 - RNA, 32 nt, Human
auugugccacuacacuccagccugggcaacac

SEQ ID NO: 74054 - RNA, 32 nt, Human
auugugccacuacacuccagccugggcaacag

SEQ ID NO: 74055 - RNA, 32 nt, Human
auugugccacuacacuccagccugggugacaa

SEQ ID NO: 74056 - RNA, 32 nt, Human
auugugccacuaguacuccagccugggugaca

SEQ ID NO: 74057 - RNA, 32 nt, Human
auugugccacugcacaccagccuggacaacag

SEQ ID NO: 74058 - RNA, 32 nt, Human
auugugccacugcacaccggccugggugacag

SEQ ID NO: 74059 - RNA, 32 nt, Human
auugugccacugcacacuccaaucugggugaa

SEQ ID NO: 74060 - RNA, 32 nt, Human
auugugccacugcaccccagccuuggcaacag

SEQ ID NO: 74061 - RNA, 32 nt, Human
auugugccacugcacgcacuccagccugggcg

SEQ ID NO: 74062 - RNA, 32 nt, Human
auugugccacugcacucaagccugggugacga

SEQ ID NO: 74063 - RNA, 32 nt, Human
auugugccacugcacucauccuggaagacaga

SEQ ID NO: 74064 - RNA, 32 nt, Human
auugugccacugcacuccaaccugggugacag

SEQ ID NO: 74065 - RNA, 32 nt, Human
auugugccacugcacuccacccugggcaacag

SEQ ID NO: 74066 - RNA, 32 nt, Human
auugugccacugcacuccagacugggugacac

SEQ ID NO: 74067 - RNA, 23 nt, Human
auugugccacugcacuccagcca

SEQ ID NO: 74068 - RNA, 32 nt, Human
auugugccacugcacuccagccagagugacag

SEQ ID NO: 74069 - RNA, 32 nt, Human
auugugccacugcacuccagccggggugacag

SEQ ID NO: 74070 - RNA, 32 nt, Human
auugugccacugcacuccagccuaggcaacag

SEQ ID NO: 74071 - RNA, 32 nt, Human
auugugccacugcacuccagccuaggcgacag

SEQ ID NO: 74072 - RNA, 32 nt, Human
auugugccacugcacuccagccugagcaacaa

SEQ ID NO: 74073 - RNA, 32 nt, Human
auugugccacugcacuccagccuggacgacag

SEQ ID NO: 74074 - RNA, 32 nt, Human
auugugccacugcacuccagccuggcaacaga

SEQ ID NO: 74075 - RNA, 32 nt, Human
auugugccacugcacuccagccugggagacag

SEQ ID NO: 74076 - RNA, 32 nt, Human
auugugccacugcacuccagccugggcaacaa

SEQ ID NO: 74077 - RNA, 32 nt, Human
auugugccacugcacuccagccugggcaacac

SEQ ID NO: 74078 - RNA, 32 nt, Human
auugugccacugcacuccagccugggcaacag

SEQ ID NO: 74079 - RNA, 32 nt, Human
auugugccacugcacuccagccugggcaacug

SEQ ID NO: 74080 - RNA, 32 nt, Human
auugugccacugcacuccagccugggcaauag

SEQ ID NO: 74081 - RNA, 32 nt, Human
auugugccacugcacuccagccugggcaccaa

SEQ ID NO: 74082 - RNA, 32 nt, Human
auugugccacugcacuccagccugggccacag

SEQ ID NO: 74083 - RNA, 32 nt, Human
auugugccacugcacuccagccugggcgacag

SEQ ID NO: 74084 - RNA, 32 nt, Human
auugugccacugcacuccagccugggcgauag

SEQ ID NO: 74085 - RNA, 32 nt, Human
auugugccacugcacuccagccuggguaacag

SEQ ID NO: 74086 - RNA, 32 nt, Human
auugugccacugcacuccagccugggugaaag

SEQ ID NO: 74087 - RNA, 32 nt, Human
auugugccacugcacuccagccugggugacag

SEQ ID NO: 74088 - RNA, 32 nt, Human
auugugccacugcacuccagccugggugacug

SEQ ID NO: 74089 - RNA, 32 nt, Human
auugugccacugcacuccagccuggguggcag

SEQ ID NO: 74090 - RNA, 32 nt, Human
auugugccacugcacuccagccuggguuacag

SEQ ID NO: 74091 - RNA, 32 nt, Human
auugugccacugcacuccagccuuggcaacaa

SEQ ID NO: 74092 - RNA, 32 nt, Human
auugugccacugcacuccagccuuggcaacac

SEQ ID NO: 74093 - RNA, 32 nt, Human
auugugccacugcacuccagcgugggcaacgg

SEQ ID NO: 74094 - RNA, 32 nt, Human
auugugccacugcacuccagcuggguggcaga

SEQ ID NO: 74095 - RNA, 32 nt, Human
auugugccacugcacuccagcuuggugacaga

SEQ ID NO: 74096 - RNA, 32 nt, Human
auugugccacugcacuccagucuggacaacag

SEQ ID NO: 74097 - RNA, 32 nt, Human
auugugccacugcacucccgccugggcgacag

SEQ ID NO: 74098 - RNA, 32 nt, Human
auugugccacugcacucgagccugggugacag

SEQ ID NO: 74099 - RNA, 32 nt, Human
auugugccacugcacucuagccuagguggcug

SEQ ID NO: 74100 - RNA, 32 nt, Human
auugugccacugcacucuagccucggugacag

SEQ ID NO: 74101 - RNA, 32 nt, Human
auugugccacugcacucuagccuggacagcag

SEQ ID NO: 74102 - RNA, 32 nt, Human
auugugccacugcacucuagccugggcaauaa

SEQ ID NO: 74103 - RNA, 32 nt, Human
auugugccacugcacucuagccugggugacaa

SEQ ID NO: 74104 - RNA, 32 nt, Human
auugugccacugcacucuagccugggugacag

SEQ ID NO: 74105 - RNA, 32 nt, Human
auugugccacugcacugcagccugggcgacaa

SEQ ID NO: 74106 - RNA, 32 nt, Human
auugugccacugcacugcaggcugggugacag

SEQ ID NO: 74107 - RNA, 32 nt, Human
auugugccacugcacuucagccugggcgacag

SEQ ID NO: 74108 - RNA, 32 nt, Human
auugugccacugcacuucagcuugggugacag

SEQ ID NO: 74109 - RNA, 32 nt, Human
auugugccacugcacuuuucagccugggugcc

SEQ ID NO: 74110 - RNA, 32 nt, Human
auugugccacugcauaccagccuaggugacag

SEQ ID NO: 74111 - RNA, 32 nt, Human
auugugccacugcauucuagccugggcgauag

SEQ ID NO: 74112 - RNA, 32 nt, Human
auugugccacugcccuccagccugggugacag

SEQ ID NO: 74113 - RNA, 32 nt, Human
auugugccacugccuccggccugggcgagagu

SEQ ID NO: 74114 - RNA, 32 nt, Human
auugugccacugcgcuccagccugggcgacag

SEQ ID NO: 74115 - RNA, 32 nt, Human
auugugccacugcucuccagccugggaggcac

SEQ ID NO: 74116 - RNA, 32 nt, Human
auugugccacuguacaccagccugggugacag

SEQ ID NO: 74117 - RNA, 32 nt, Human
auugugccacuguacuccagccuggaagacaa

SEQ ID NO: 74118 - RNA, 32 nt, Human
auugugccacuguacuccagccugggagauag

SEQ ID NO: 74119 - RNA, 32 nt, Human
auugugccacuguacuccagccugggcgacag

SEQ ID NO: 74120 - RNA, 32 nt, Human
auugugccacuguacuccagccugggugacag

SEQ ID NO: 74121 - RNA, 32 nt, Human
auugugccacuguacuccagccuggugacaga

SEQ ID NO: 74122 - RNA, 32 nt, Human
auugugccacuguacugcagccugggugacag

SEQ ID NO: 74123 - RNA, 32 nt, Human
auugugccacuguuuuccagccugggcaauac

SEQ ID NO: 74124 - RNA, 32 nt, Human
auugugccacuucacuccagccugggugacaa

SEQ ID NO: 74125 - RNA, 32 nt, Human
auugugccacuucauuccagccugggcgacag

SEQ ID NO: 74126 - RNA, 32 nt, Human
auugugccaggucagcugucccuuccucuggc

SEQ ID NO: 74127 - RNA, 32 nt, Human
auugugccagugcacuccaggcuggacgacag

SEQ ID NO: 74128 - RNA, 32 nt, Human
auugugccagugcacuccggccugggugacag

SEQ ID NO: 74129 - RNA, 32 nt, Human
auugugccauugcacuacagccuggucaacag

SEQ ID NO: 74130 - RNA, 32 nt, Human
auugugccauugcacuccaaccugggcaacaa

SEQ ID NO: 74131 - RNA, 32 nt, Human
auugugccauugcacuccagccuggacaacaa

SEQ ID NO: 74132 - RNA, 32 nt, Human
auugugccauugcacuccagccugggcaacaa

SEQ ID NO: 74133 - RNA, 32 nt, Human
auugugccauugcacuccagccugggcaacag

SEQ ID NO: 74134 - RNA, 32 nt, Human
auugugccauugcacuccagccugggcaacga

SEQ ID NO: 74135 - RNA, 32 nt, Human
auugugccauugcacuccagccugggcgacaa

SEQ ID NO: 74136 - RNA, 32 nt, Human
auugugccauugcacuccagccugggcgacag

SEQ ID NO: 74137 - RNA, 32 nt, Human
auugugccauugcacuccagccugggcuacaa

SEQ ID NO: 74138 - RNA, 32 nt, Human
auugugccauugcacuccagccugggugacag

SEQ ID NO: 74139 - RNA, 32 nt, Human
auugugccauugcacuccagccugggugauaa

SEQ ID NO: 74140 - RNA, 32 nt, Human
auugugccauugcacugcagccuggaugacag

SEQ ID NO: 74141 - RNA, 32 nt, Human
auugugccauuguacuccagccugggcgacaa

SEQ ID NO: 74142 - RNA, 32 nt, Human
auugugccauuuauggaaaaacucuccccacu

SEQ ID NO: 74143 - RNA, 32 nt, Human
auugugccgcugcacuccagccuggcgacaaa

SEQ ID NO: 74144 - RNA, 32 nt, Human
auugugccucgaggccccgaucgggcuaggcc

SEQ ID NO: 74145 - RNA, 32 nt, Human
auugugcuacugcacucuagauugggugacag

SEQ ID NO: 74146 - RNA, 32 nt, Human
auugugcuauugcacuccagccugggugacag

SEQ ID NO: 74147 - RNA, 32 nt, Human
auugugcuauuugcacucuagccugggugaca

SEQ ID NO: 74148 - RNA, 32 nt, Human
auugugcuccaauaaugucauaguuuuaagag

SEQ ID NO: 74149 - RNA, 32 nt, Human
auugugcuccagccugggcaacagagugagac

SEQ ID NO: 74150 - RNA, 32 nt, Human
auugugcugcugcacuccagccugggagacag

SEQ ID NO: 74151 - RNA, 32 nt, Human
auugugcugcugcacuccagccugggugaaaa

SEQ ID NO: 74152 - RNA, 32 nt, Human
auugugcuucuuuggagauguuauguuuccuu

SEQ ID NO: 74153 - RNA, 32 nt, Human
auugugcuuuaaaagacauauaaagaauuggg

SEQ ID NO: 74154 - RNA, 32 nt, Human
auuguggaaagaggggaccaggguggcugggg

SEQ ID NO: 74155 - RNA, 32 nt, Human
auuguggaauguaaagcuuuaagaacuuaaac

SEQ ID NO: 74156 - RNA, 32 nt, Human
auuguggacccgagaagcagagagcgagaggg

SEQ ID NO: 74157 - RNA, 32 nt, Human
auuguggagcguccccuuccaucaagcagccu

SEQ ID NO: 74158 - RNA, 32 nt, Human
auuguggcaaagcguuuacuucacauucacac

SEQ ID NO: 74159 - RNA, 32 nt, Human
auuguggcaccucuugggcacagcauuuccug

SEQ ID NO: 74160 - RNA, 32 nt, Human
auuguggcacugcacuccagucugggugacag

SEQ ID NO: 74161 - RNA, 32 nt, Human
auuguggcauugcacuccagccugggugguag

SEQ ID NO: 74162 - RNA, 32 nt, Human
auuguggccaguauccacuguguccuuaggcu

SEQ ID NO: 74163 - RNA, 32 nt, Human
auuguggcucacugcaaacuccacuucccuag

SEQ ID NO: 74164 - RNA, 31 nt, Human
auuguggcugagagagaugauuacugcuuug

SEQ ID NO: 74165 - RNA, 32 nt, Human
auuguggcuggcucucgagucucuucugauau

SEQ ID NO: 74166 - RNA, 32 nt, Human
auuguggcuguaacagaguccaguuccaugug

SEQ ID NO: 74167 - RNA, 32 nt, Human
auuguggcuucucaguggcuugacagcaucuu

SEQ ID NO: 74168 - RNA, 32 nt, Human
auugugggaaauuacuuaaccucuucaagccc

SEQ ID NO: 74169 - RNA, 32 nt, Human
auugugggaccccagaggcuguccuguccacu

SEQ ID NO: 74170 - RNA, 32 nt, Human
auugugggcaguguccagacagaagaagagac

SEQ ID NO: 74171 - RNA, 22 nt, Human
auugugggcucaaacuggacag

SEQ ID NO: 74172 - RNA, 20 nt, Human
auugugggcucucugcuucc

SEQ ID NO: 74173 - RNA, 32 nt, Human
auugugggcucuggaaaccacauggcuucacc

SEQ ID NO: 74174 - RNA, 21 nt, Human
auuguggggaggcauggccag

SEQ ID NO: 74175 - RNA, 32 nt, Human
auuguggggcagaggccucucugcucuuguuu

SEQ ID NO: 74176 - RNA, 32 nt, Human
auugugggugugagccaccgcgcucagucuug

SEQ ID NO: 74177 - RNA, 23 nt, Human
auuguggguuucuucugugcuag

SEQ ID NO: 74178 - RNA, 32 nt, Human
auugugguaguggcagaagucacauuacgguu

SEQ ID NO: 74179 - RNA, 32 nt, Human
auuguggucugggcaguaaauccacagccaac

SEQ ID NO: 74180 - RNA, 32 nt, Human
auuguggugauggcuacguaacugugcauauu

SEQ ID NO: 74181 - RNA, 32 nt, Human
auuguggugucugucuaggaaggaagggguga

SEQ ID NO: 74182 - RNA, 32 nt, Human
auugugguguggcaggauggguugguggggag

SEQ ID NO: 74183 - RNA, 32 nt, Human
auugugguuucugccacuaucaaaguuccagc

SEQ ID NO: 74184 - RNA, 32 nt, Human
auuguguacuuggugguucugucccucugccu

SEQ ID NO: 74185 - RNA, 32 nt, Human
auuguguagugugcucagaaccacugaucucc

SEQ ID NO: 74186 - RNA, 32 nt, Human
auugugucacugcacuccagccugggcaacag

SEQ ID NO: 74187 - RNA, 32 nt, Human
auugugucacugcacuccagcuugggugacag

SEQ ID NO: 74188 - RNA, 32 nt, Human
auugugucaggucacuguggauaaaggcaaag

SEQ ID NO: 74189 - RNA, 32 nt, Human
auugugucaguuucagauccugaucuuaagag

SEQ ID NO: 74190 - RNA, 32 nt, Human
auugugucauugcacuccagccugggcaacaa

SEQ ID NO: 74191 - RNA, 32 nt, Human
auuguguccaggggagggugggcccugcucac

SEQ ID NO: 74192 - RNA, 32 nt, Human
auugugucuuccuucacuaucugaccugaaaa

SEQ ID NO: 74193 - RNA, 32 nt, Human
auugugugaccauacuaagcuucuggguguaa

SEQ ID NO: 74194 - RNA, 32 nt, Human
auugugugagaccaaagcauagagacuagaua

SEQ ID NO: 74195 - RNA, 22 nt, Human
auuguguggaugaccacauaag

SEQ ID NO: 74196 - RNA, 32 nt, Human
auuguguguaugaccucagaacugaaauugau

SEQ ID NO: 74197 - RNA, 32 nt, Human
auuguguguuaacaccuguucuuuguaauugg

SEQ ID NO: 74198 - RNA, 32 nt, Human
auuguguuaccuggguaugagaguguuggaag

SEQ ID NO: 74199 - RNA, 32 nt, Human
auuguguuccccaggcugaagugcaguggcau

SEQ ID NO: 74200 - RNA, 32 nt, Human
auuguguugagugaaguuuggagauuuuucau

SEQ ID NO: 74201 - RNA, 32 nt, Human
auuguguugucaaaucaagaaugggugugcau

SEQ ID NO: 74202 - RNA, 32 nt, Human
auuguguugugaggcgcacuguuccuggcaga

SEQ ID NO: 74203 - RNA, 32 nt, Human
auuguguuucccagccucuccacucccccgcc

SEQ ID NO: 74204 - RNA, 32 nt, Human
auuguguuugaucuucuucugaacaacuuagg

SEQ ID NO: 74205 - RNA, 32 nt, Human
auuguguuuucagguuuuguuuuuaguaggug

SEQ ID NO: 74206 - RNA, 32 nt, Human
auuguguuuugacugcagcuggaucuuggcuu

SEQ ID NO: 74207 - RNA, 32 nt, Human
auuguuaaagugacaggaguuguaggguuacc

SEQ ID NO: 74208 - RNA, 32 nt, Human
auuguuaacauaccaaacacacaugguaauag

SEQ ID NO: 74209 - RNA, 32 nt, Human
auuguuaauauuugugaggaaaagugaaacaa

SEQ ID NO: 74210 - RNA, 32 nt, Human
auuguuaauucccacuacaaguuuauaacgac

SEQ ID NO: 74211 - RNA, 32 nt, Human
auuguuacgucacuuuucuauaguuuugagag

SEQ ID NO: 74212 - RNA, 32 nt, Human
auuguuacuuacugcuccaggcauuuuauuaa

SEQ ID NO: 74213 - RNA, 32 nt, Human
auuguuacuuuacugccuagcugccaaccagu

SEQ ID NO: 74214 - RNA, 32 nt, Human
auuguuagagccucugacugggguucaccaua

SEQ ID NO: 74215 - RNA, 32 nt, Human
auuguuaggaauaugaagguugacggugaaau

SEQ ID NO: 74216 - RNA, 32 nt, Human
auuguuaguaaguggccaagagacuugaggaa

SEQ ID NO: 74217 - RNA, 32 nt, Human
auuguuaugaucuacucauuugcugacacauc

SEQ ID NO: 74218 - RNA, 32 nt, Human
auuguucacccagcagaacugggaggugcaaa

SEQ ID NO: 74219 - RNA, 32 nt, Human
auuguucacuggcuccaucgcacuccucccug

SEQ ID NO: 74220 - RNA, 32 nt, Human
auuguucagagagguuuaauccuaugugguag

SEQ ID NO: 74221 - RNA, 32 nt, Human
auuguucagaugucaagccaugcccaauuuuc

SEQ ID NO: 74222 - RNA, 32 nt, Human
auuguucagcaacgauuucuguacaucaccaa

SEQ ID NO: 74223 - RNA, 32 nt, Human
auuguucaguucaagggaaugaagaauucaga

SEQ ID NO: 74224 - RNA, 32 nt, Human
auuguucauagaagauauuauguacauuuauu

SEQ ID NO: 74225 - RNA, 32 nt, Human
auuguucauccagcaaccaggaugaucuuguu

SEQ ID NO: 74226 - RNA, 32 nt, Human
auuguuccacagacugaaugcuguguucguau

SEQ ID NO: 74227 - RNA, 32 nt, Human
auuguucccaggggccugcccaccccagugcc

SEQ ID NO: 74228 - RNA, 32 nt, Human
auuguucccgauggucucucucccucugucuu

SEQ ID NO: 74229 - RNA, 32 nt, Human
auuguuccuccaccgucccacacuuuaggggg

SEQ ID NO: 74230 - RNA, 32 nt, Human
auuguuccugccuccuccgccaccuccgcccc

SEQ ID NO: 74231 - RNA, 31 nt, Human
auuguucuaaauaaauacauguuuuugaaua

SEQ ID NO: 74232 - RNA, 32 nt, Human
auuguucuauuuaaaauauuccuugaauuaaa

SEQ ID NO: 74233 - RNA, 32 nt, Human
auuguucucucccuguuuucauuucgggacca

SEQ ID NO: 74234 - RNA, 32 nt, Human
auuguucugcaguucucucuucuuuuccucag

SEQ ID NO: 74235 - RNA, 32 nt, Human
auuguucugcugucugggacuccugucuaggu

SEQ ID NO: 74236 - RNA, 32 nt, Human
auuguucuguauuuuuaaauugccaagaaaaa

SEQ ID NO: 74237 - RNA, 32 nt, Human
auuguugaacagcucugggcaguugauugugu

SEQ ID NO: 74238 - RNA, 32 nt, Human
auuguugaagauaauaaagaagaacaguauuc

SEQ ID NO: 74239 - RNA, 32 nt, Human
auuguugaagccuccuggaauguuugagucaa

SEQ ID NO: 74240 - RNA, 32 nt, Human
auuguugaaggagaggaacaagagugauagca

SEQ ID NO: 74241 - RNA, 32 nt, Human
auuguugauaacacuguucaucuacugaagca

SEQ ID NO: 74242 - RNA, 32 nt, Human
auuguugcaacuuuucuuggcguguuuaaauc

SEQ ID NO: 74243 - RNA, 32 nt, Human
auuguugcaagauggccgcgcccagugaugga

SEQ ID NO: 74244 - RNA, 32 nt, Human
auuguugcagagcaagugaugauagaccacuu

SEQ ID NO: 74245 - RNA, 32 nt, Human
auuguugcauugaaauggcagacgaagcaaga

SEQ ID NO: 74246 - RNA, 32 nt, Human
auuguuggcaaaacuuaaucaugauuguuuug

SEQ ID NO: 74247 - RNA, 32 nt, Human
auuguuggcagugucaucucugagaaacagau

SEQ ID NO: 74248 - RNA, 32 nt, Human
auuguugggagguggagggaaagaacuacuau

SEQ ID NO: 74249 - RNA, 32 nt, Human
auuguugggauuauaggcgugagccacugcac

SEQ ID NO: 74250 - RNA, 32 nt, Human
auuguugucucagucaugcuugcugauuacag

SEQ ID NO: 74251 - RNA, 32 nt, Human
auuguugugccauuaagcaauuuagcuaaucc

SEQ ID NO: 74252 - RNA, 32 nt, Human
auuguugugucugugcccuccaaagagccuuc

SEQ ID NO: 74253 - RNA, 32 nt, Human
auuguuuaaucaauggaauuuguaccagccuu

SEQ ID NO: 74254 - RNA, 32 nt, Human
auuguuuacaauauuuguacaucuaugcaaaa

SEQ ID NO: 74255 - RNA, 32 nt, Human
auuguuuacauccugagacuguucuacaguuu

SEQ ID NO: 74256 - RNA, 32 nt, Human
auuguuuacuaucccuuauuugacaaaaaguc

SEQ ID NO: 74257 - RNA, 32 nt, Human
auuguuuacucucuuauuuaccaacuucuggc

SEQ ID NO: 74258 - RNA, 32 nt, Human
auuguuucagugccauuuguuaaaaagacugu

SEQ ID NO: 74259 - RNA, 32 nt, Human
auuguuucauucuucucucuuccugucaccuu

SEQ ID NO: 74260 - RNA, 32 nt, Human
auuguuucccacauauuaagucaggguggaua

SEQ ID NO: 74261 - RNA, 32 nt, Human
auuguuuccuucugacuuaagcaauagagaga

SEQ ID NO: 74262 - RNA, 32 nt, Human
auuguuucucucucaaccacuuugccacuccu

SEQ ID NO: 74263 - RNA, 32 nt, Human
auuguuucugagaaguugggaaauuaccauua

SEQ ID NO: 74264 - RNA, 32 nt, Human
auuguuucuguaugugucugguguuuugcaca

SEQ ID NO: 74265 - RNA, 32 nt, Human
auuguuugaacagaugucagaugugaguaaug

SEQ ID NO: 74266 - RNA, 32 nt, Human
auuguuugaacccaggaggcacagguugcagu

SEQ ID NO: 74267 - RNA, 32 nt, Human
auuguuugaacccaggagguggaggcugcagu

SEQ ID NO: 74268 - RNA, 32 nt, Human
auuguuugaaccccggagauggagguugcagu

SEQ ID NO: 74269 - RNA, 32 nt, Human
auuguuugaaccccggaggcagagguuucagu

SEQ ID NO: 74270 - RNA, 32 nt, Human
auuguuugaacccgggaggcagagguugcagu

SEQ ID NO: 74271 - RNA, 32 nt, Human
auuguuugaacccgggaggcggagguugcagu

SEQ ID NO: 74272 - RNA, 32 nt, Human
auuguuugaacccggguggcagagguugcagu

SEQ ID NO: 74273 - RNA, 32 nt, Human
auuguuugaacccuggaggcagagguuguagu

SEQ ID NO: 74274 - RNA, 32 nt, Human
auuguuugaacccuggaggcggaaguugcagu

SEQ ID NO: 74275 - RNA, 32 nt, Human
auuguuugacucuguguccccacccagaucuc

SEQ ID NO: 74276 - RNA, 32 nt, Human
auuguuugagcccaggagguugaggcugcagu

SEQ ID NO: 74277 - RNA, 32 nt, Human
auuguuugagcccuggagguugaggcugcagu

SEQ ID NO: 74278 - RNA, 32 nt, Human
auuguuugaugaagccuaauuaugcuggacug

SEQ ID NO: 74279 - RNA, 32 nt, Human
auuguuugcaccugcuggguauggccuuuggg

SEQ ID NO: 74280 - RNA, 32 nt, Human
auuguuuggcaaggagacaggagaaacaagca

SEQ ID NO: 74281 - RNA, 32 nt, Human
auuguuuggucaauacacugaagauggagaau

SEQ ID NO: 74282 - RNA, 32 nt, Human
auuguuuuacuuuugucuuccucacuagugua

SEQ ID NO: 74283 - RNA, 32 nt, Human
auuguuuuauguucuagugauuuccuguauaa

SEQ ID NO: 74284 - RNA, 32 nt, Human
auuguuuuccagggcccuugaccaacaucggc

SEQ ID NO: 74285 - RNA, 32 nt, Human
auuguuuucccucacagacauuucucuuucau

SEQ ID NO: 74286 - RNA, 32 nt, Human
auuguuuuccgugcuguguccucugccauuua

SEQ ID NO: 74287 - RNA, 32 nt, Human
auuguuuucuacugcuaugugucacacuuugc

SEQ ID NO: 74288 - RNA, 32 nt, Human
auuguuuugaaggaauaaagaauggcuacucc

SEQ ID NO: 74289 - RNA, 32 nt, Human
auuguuuugaugucuagccccucccauuucca

SEQ ID NO: 74290 - RNA, 32 nt, Human
auuguuuugguuucuguucccuuucugacugc

SEQ ID NO: 74291 - RNA, 32 nt, Human
auuguuuugucaaucaacacagccugcacuga

SEQ ID NO: 74292 - RNA, 32 nt, Human
auuguuuuuaaugcagcgugggaggggaggau

SEQ ID NO: 74293 - RNA, 32 nt, Human
auuguuuuugacuaagugacuaagacauacac

SEQ ID NO: 74294 - RNA, 32 nt, Human
auuguuuuugacugaguaucuaggagagcagu

SEQ ID NO: 74295 - RNA, 32 nt, Human
auuuaaaaacaacuuuaauucuaagaugugua

SEQ ID NO: 74296 - RNA, 32 nt, Human
auuuaaaaacccacaacuaaaaauguauccac

SEQ ID NO: 74297 - RNA, 32 nt, Human
auuuaaaaaccugcagcaacaugggggaggag

SEQ ID NO: 74298 - RNA, 22 nt, Human
auuuaaaaacuagaauaacaga

SEQ ID NO: 74299 - RNA, 32 nt, Human
auuuaaaaauaaaauugugcaaaacuuauuug

SEQ ID NO: 74300 - RNA, 32 nt, Human
auuuaaaaauuagccuagcaugguggcacgcu

SEQ ID NO: 74301 - RNA, 32 nt, Human
auuuaaaaauuagcugagcaugguggcaugug

SEQ ID NO: 74302 - RNA, 32 nt, Human
auuuaaaaauuagcugggcaugguagcacaug

SEQ ID NO: 74303 - RNA, 32 nt, Human
auuuaaaaauuagcugggcaugguggcaugug

SEQ ID NO: 74304 - RNA, 32 nt, Human
auuuaaaaauuagcugggcaugguggcgcaug

SEQ ID NO: 74305 - RNA, 32 nt, Human
auuuaaaaauuagcugggcauggugguagugc

SEQ ID NO: 74306 - RNA, 32 nt, Human
auuuaaaacuuagcuggcauugguggcgcaug

SEQ ID NO: 74307 - RNA, 32 nt, Human
auuuaaaagaugaccugaccaaaaacuuuaca

SEQ ID NO: 74308 - RNA, 32 nt, Human
auuuaaaagcauucuuauuuugucauuaagac

SEQ ID NO: 74309 - RNA, 32 nt, Human
auuuaaaagcuauuauucuuagcauuaaccua

SEQ ID NO: 74310 - RNA, 32 nt, Human
auuuaaaauguucuucgggggagaagggagcu

SEQ ID NO: 74311 - RNA, 32 nt, Human
auuuaaacaauguuguuuuaaaauauucuaac

SEQ ID NO: 74312 - RNA, 32 nt, Human
auuuaaacagucaaguaaaaucaagcugggua

SEQ ID NO: 74313 - RNA, 32 nt, Human
auuuaaacccaggaggcagagguugcagugag

SEQ ID NO: 74314 - RNA, 32 nt, Human
auuuaaacugaacaaaucacuacuuuugggau

SEQ ID NO: 74315 - RNA, 32 nt, Human
auuuaaagacaccaaggaaaacuacaacuguc

SEQ ID NO: 74316 - RNA, 32 nt, Human
auuuaaagcacaugccuucugugccggcuuuc

SEQ ID NO: 74317 - RNA, 32 nt, Human
auuuaaagcuugggaaggaaggauggaaagcg

SEQ ID NO: 74318 - RNA, 32 nt, Human
auuuaaagguacccacuuuaccccgugcccac

SEQ ID NO: 74319 - RNA, 32 nt, Human
auuuaaagguccagagaggcaagugaauuguc

SEQ ID NO: 74320 - RNA, 32 nt, Human
auuuaaaguauucuccauccucccaggaaccg

SEQ ID NO: 74321 - RNA, 32 nt, Human
auuuaaagugaagaaugaaaaauauguaagag

SEQ ID NO: 74322 - RNA, 32 nt, Human
auuuaaaguuaggaagaucugggagauagggg

SEQ ID NO: 74323 - RNA, 30 nt, Human
auuuaaauaaagaacugcugugucugacuu

SEQ ID NO: 74324 - RNA, 32 nt, Human
auuuaaauagccacauuuaacuccagccuugg

SEQ ID NO: 74325 - RNA, 32 nt, Human
auuuaaauaugugaagcugaguuaauuuaugu

SEQ ID NO: 74326 - RNA, 32 nt, Human
auuuaaaucucccagggcuuccuccaagggcc

SEQ ID NO: 74327 - RNA, 32 nt, Human
auuuaaauugagauggauucuugcucugucgc

SEQ ID NO: 74328 - RNA, 32 nt, Human
auuuaacaaaccugaauguggccguguucaaa

SEQ ID NO: 74329 - RNA, 32 nt, Human
auuuaacaaccugaaauuuauucacauauauc

SEQ ID NO: 74330 - RNA, 32 nt, Human
auuuaacaacuuggccagccgugguggcucac

SEQ ID NO: 74331 - RNA, 32 nt, Human
auuuaacaaugccacaccugaagcacuuggau

SEQ ID NO: 74332 - RNA, 32 nt, Human
auuuaacacaaaggcagaugauacacuuauaa

SEQ ID NO: 74333 - RNA, 32 nt, Human
auuuaacagauagaguguggcuucauuugucc

SEQ ID NO: 74334 - RNA, 32 nt, Human
auuuaacaggcaggacgcugaggcucugauaa

SEQ ID NO: 74335 - RNA, 32 nt, Human
auuuaacaggcucacccucccuuuccuuuucc

SEQ ID NO: 74336 - RNA, 32 nt, Human
auuuaacagggaggggaagagggggcgaucgc

SEQ ID NO: 74337 - RNA, 32 nt, Human
auuuaacauuuccucuuuccaagaccaaccua

SEQ ID NO: 74338 - RNA, 32 nt, Human
auuuaaccacuccgcuauuaauagacauucau

SEQ ID NO: 74339 - RNA, 32 nt, Human
auuuaaccagcuuuuaaaucucucuuuucucu

SEQ ID NO: 74340 - RNA, 32 nt, Human
auuuaaccagugcuuggaaaaaucuugcuugg

SEQ ID NO: 74341 - RNA, 32 nt, Human
auuuaaccaugccaccuaugagugccagugac

SEQ ID NO: 74342 - RNA, 32 nt, Human
auuuaaccccuccacugcugggggugagcugu

SEQ ID NO: 74343 - RNA, 32 nt, Human
auuuaaccucucugaaccucagcuucucaucc

SEQ ID NO: 74344 - RNA, 32 nt, Human
auuuaaccuguaaaaugucaauagcaaaugaa

SEQ ID NO: 74345 - RNA, 32 nt, Human
auuuaacgaaaugcuucucuucuauagccagg

SEQ ID NO: 74346 - RNA, 32 nt, Human
auuuaacggcuucacuggacaguuuuccuuag

SEQ ID NO: 74347 - RNA, 32 nt, Human
auuuaacuagacuugccgaauauguuacuagc

SEQ ID NO: 74348 - RNA, 32 nt, Human
auuuaacucuuucacuacaguucuugcaagua

SEQ ID NO: 74349 - RNA, 32 nt, Human
auuuaacugaaaguagggccugcucugacagg

SEQ ID NO: 74350 - RNA, 32 nt, Human
auuuaacuucacugcaauucuguuucccucau

SEQ ID NO: 74351 - RNA, 32 nt, Human
auuuaagaaaagauaccaaaguagaagucaaa

SEQ ID NO: 74352 - RNA, 32 nt, Human
auuuaagaacuuugauuuccauuccauuuuca

SEQ ID NO: 74353 - RNA, 32 nt, Human
auuuaagaagcagcuccaauauuuuuaaaacg

SEQ ID NO: 74354 - RNA, 32 nt, Human
auuuaagaaguuauuuucacauguucugacac

SEQ ID NO: 74355 - RNA, 32 nt, Human
auuuaagaggaaauggacuggcauuuauggug

SEQ ID NO: 74356 - RNA, 32 nt, Human
auuuaagauugcaacagaagcacuuuucaaua

SEQ ID NO: 74357 - RNA, 32 nt, Human
auuuaagcaauuggcaacuacaaagacauuau

SEQ ID NO: 74358 - RNA, 32 nt, Human
auuuaagcacagaaaucccagaccuguuguuc

SEQ ID NO: 74359 - RNA, 32 nt, Human
auuuaagcagcccagagcuccagagaaaaaga

SEQ ID NO: 74360 - RNA, 32 nt, Human
auuuaagcagugagaggcagggaccagguuaa

SEQ ID NO: 74361 - RNA, 32 nt, Human
auuuaagcaguuuuaauguguaccuuuaccca

SEQ ID NO: 74362 - RNA, 32 nt, Human
auuuaagccaucuuuucauccuaaggaaaauu

SEQ ID NO: 74363 - RNA, 32 nt, Human
auuuaagcuaaaacagagcacauguauaugua

SEQ ID NO: 74364 - RNA, 32 nt, Human
auuuaagcuacugccaucaaccccacccccau

SEQ ID NO: 74365 - RNA, 32 nt, Human
auuuaaggcauaacagcacauucaucccuuug

SEQ ID NO: 74366 - RNA, 32 nt, Human
auuuaagggaagagagugacccagaugguagg

SEQ ID NO: 74367 - RNA, 32 nt, Human
auuuaagggcuauuuuugacacccuaaaugug

SEQ ID NO: 74368 - RNA, 32 nt, Human
auuuaaggguagggcuuucugaaggauuucug

SEQ ID NO: 74369 - RNA, 32 nt, Human
auuuaaguaauggagaagaauuaaacauugua

SEQ ID NO: 74370 - RNA, 32 nt, Human
auuuaaguauuuuuaaucaucagccaagcauu

SEQ ID NO: 74371 - RNA, 32 nt, Human
auuuaagucuucacugagggccacuuuacaaa

SEQ ID NO: 74372 - RNA, 32 nt, Human
auuuaagugcguguguagaguuaagaagcugu

SEQ ID NO: 74373 - RNA, 32 nt, Human
auuuaaguguuggacugcuaggagaacuugua

SEQ ID NO: 74374 - RNA, 32 nt, Human
auuuaaguuaacucaaagccaaugaguuaaau

SEQ ID NO: 74375 - RNA, 32 nt, Human
auuuaauaaauauuucaggauauuuuuccucu

SEQ ID NO: 74376 - RNA, 32 nt, Human
auuuaauaaccaaacuauuuuaauaguuuacc

SEQ ID NO: 74377 - RNA, 32 nt, Human
auuuaauaaguggcaauggguauugucccuag

SEQ ID NO: 74378 - RNA, 32 nt, Human
auuuaauaguguugggucucccauggaaaaca

SEQ ID NO: 74379 - RNA, 32 nt, Human
auuuaauauauguacacccauuauguuuucag

SEQ ID NO: 74380 - RNA, 32 nt, Human
auuuaauauuaaggcuguggguggugauugcu

SEQ ID NO: 74381 - RNA, 32 nt, Human
auuuaaucaacuuuauugucuuaguauuuaga

SEQ ID NO: 74382 - RNA, 32 nt, Human
auuuaaucaagaaacuaccuggaaccagugaa

SEQ ID NO: 74383 - RNA, 32 nt, Human
auuuaaucacauaaaagucaugaagaccagcc

SEQ ID NO: 74384 - RNA, 32 nt, Human
auuuaaucaucaccaccgguguuuccauauuu

SEQ ID NO: 74385 - RNA, 32 nt, Human
auuuaaucccaggaaagaggcaucaaagcuag

SEQ ID NO: 74386 - RNA, 32 nt, Human
auuuaaucucccacaguauucaugagaccauc

SEQ ID NO: 74387 - RNA, 32 nt, Human
auuuaaucuucuugcauuuauuucucaagaau

SEQ ID NO: 74388 - RNA, 32 nt, Human
auuuaaucuuuccuugcuuucuuuagccaacu

SEQ ID NO: 74389 - RNA, 32 nt, Human
auuuaaugagcccucuuucuuguggccguuuc

SEQ ID NO: 74390 - RNA, 32 nt, Human
auuuaaugauggcauaaaauucccagauacuu

SEQ ID NO: 74391 - RNA, 32 nt, Human
auuuaaugauuacacccuuucccuucauagau

SEQ ID NO: 74392 - RNA, 32 nt, Human
auuuaaugcaaagaaauucuguuacuuaaugu

SEQ ID NO: 74393 - RNA, 32 nt, Human
auuuaaugccauuuguguuucaugccauuuua

SEQ ID NO: 74394 - RNA, 32 nt, Human
auuuaauggaguugucagcaugaucaucaucu

SEQ ID NO: 74395 - RNA, 32 nt, Human
auuuaaugggaguauuuggaguauuuaacggg

SEQ ID NO: 74396 - RNA, 31 nt, Human
auuuaauguagaggaacugaccaucaugaau

SEQ ID NO: 74397 - RNA, 32 nt, Human
auuuaaugucagggaagauccuuagaaucgcg

SEQ ID NO: 74398 - RNA, 32 nt, Human
auuuaauguccugcuuucacauugaagggcag

SEQ ID NO: 74399 - RNA, 32 nt, Human
auuuaauguguacuugaaaacauugcuuuugu

SEQ ID NO: 74400 - RNA, 32 nt, Human
auuuaauguguauguguguauguguguaugug

SEQ ID NO: 74401 - RNA, 32 nt, Human
auuuaauuccaucagguccaguacaguacuag

SEQ ID NO: 74402 - RNA, 32 nt, Human
auuuaauucgcagcggggcacugacuuuacac

SEQ ID NO: 74403 - RNA, 32 nt, Human
auuuaauucuuaagauguguagaccuugaugg

SEQ ID NO: 74404 - RNA, 32 nt, Human
auuuaauuggaaguaguuuaaaugucucauug

SEQ ID NO: 74405 - RNA, 32 nt, Human
auuuaauuuacagccagcauuuugccacguuc

SEQ ID NO: 74406 - RNA, 32 nt, Human
auuuaauuucuucccuucuccccaccaguguu

SEQ ID NO: 74407 - RNA, 18 nt, Human
auuuacaacgcacaucga

SEQ ID NO: 74408 - RNA, 31 nt, Human
auuuacaacucaguuuuacauuuaaauucag

SEQ ID NO: 74409 - RNA, 32 nt, Human
auuuacaacugauuccugcgcaguggagaagu

SEQ ID NO: 74410 - RNA, 32 nt, Human
auuuacacaaauuauaaaaauuagucgggugu

SEQ ID NO: 74411 - RNA, 17 nt, Human
auuuacacaaccuugga

SEQ ID NO: 74412 - RNA, 20 nt, Human
auuuacacacagaagucaua

SEQ ID NO: 74413 - RNA, 17 nt, Human
auuuacacacagcugga

SEQ ID NO: 74414 - RNA, 17 nt, Human
auuuacacauaguuuga

SEQ ID NO: 74415 - RNA, 23 nt, Human
auuuacaccuguaaauuuauuca

SEQ ID NO: 74416 - RNA, 18 nt, Human
auuuacacuauauguucg

SEQ ID NO: 74417 - RNA, 32 nt, Human
auuuacacucacaacacccuaggcucacuaaa

SEQ ID NO: 74418 - RNA, 32 nt, Human
auuuacagaccagccagccaccauucugcuug

SEQ ID NO: 74419 - RNA, 32 nt, Human
auuuacagacuccagccccuuccucuguccgu

SEQ ID NO: 74420 - RNA, 32 nt, Human
auuuacagagucacagaucugucagccuggga

SEQ ID NO: 74421 - RNA, 32 nt, Human
auuuacagcuguccuugaacaaguaucaaugu

SEQ ID NO: 74422 - RNA, 32 nt, Human
auuuacaggugaggaaauggaggcucagagag

SEQ ID NO: 74423 - RNA, 32 nt, Human
auuuacaguccaagcacccaucagcugccaag

SEQ ID NO: 74424 - RNA, 32 nt, Human
auuuacaguguuucuuggagauauaauuuuac

SEQ ID NO: 74425 - RNA, 17 nt, Human
auuuacauacaccugga

SEQ ID NO: 74426 - RNA, 32 nt, Human
auuuacauccuuguaauggccaguuaagcuag

SEQ ID NO: 74427 - RNA, 32 nt, Human
auuuacauguuuaaauucaaagccugauccau

SEQ ID NO: 74428 - RNA, 32 nt, Human
auuuacauucccuagagaacacugugaggcaa

SEQ ID NO: 74429 - RNA, 32 nt, Human
auuuacauuucuaacaaguucccagguaaugc

SEQ ID NO: 74430 - RNA, 32 nt, Human
auuuaccaaucaccaagcaugcaccaaacacu

SEQ ID NO: 74431 - RNA, 32 nt, Human
auuuaccaaugagacaucuuccuaggaacugg

SEQ ID NO: 74432 - RNA, 21 nt, Human
auuuaccaauuaaauaacuga

SEQ ID NO: 74433 - RNA, 32 nt, Human
auuuaccagaaacaguccuuugucuagaugga

SEQ ID NO: 74434 - RNA, 32 nt, Human
auuuaccagaagccaagaugauguaggacccc

SEQ ID NO: 74435 - RNA, 32 nt, Human
auuuaccaggagaaagaguuuugugcuguauu

SEQ ID NO: 74436 - RNA, 32 nt, Human
auuuaccaggauucccguagggcguuuuguaa

SEQ ID NO: 74437 - RNA, 32 nt, Human
auuuaccagguaacagugguuacccaagaggc

SEQ ID NO: 74438 - RNA, 32 nt, Human
auuuaccaucuugcauauguauaguucauuuu

SEQ ID NO: 74439 - RNA, 28 nt, Human
auuuacccaaguguucagcuuauucacc

SEQ ID NO: 74440 - RNA, 32 nt, Human
auuuacccaaguguucagcuuauucaccccac

SEQ ID NO: 74441 - RNA, 32 nt, Human
auuuacccaauacugucacagaaaaaugaaac

SEQ ID NO: 74442 - RNA, 32 nt, Human
auuuacccagcacucugagauaaauaccauua

SEQ ID NO: 74443 - RNA, 32 nt, Human
auuuacccguuuccuuuuuccucuuccuuaau

SEQ ID NO: 74444 - RNA, 32 nt, Human
auuuacccuacaagacaccaaaauuagguuuu

SEQ ID NO: 74445 - RNA, 32 nt, Human
auuuacccuggacuucuccgggugccagcacc

SEQ ID NO: 74446 - RNA, 32 nt, Human
auuuacccuucaugaucuuuggcgauucucca

SEQ ID NO: 74447 - RNA, 23 nt, Human
auuuaccguucugcaacaacgga

SEQ ID NO: 74448 - RNA, 32 nt, Human
auuuaccuaaaaugugcuaguagcaucuugcc

SEQ ID NO: 74449 - RNA, 32 nt, Human
auuuaccuauuuuaaaaggaaggaauuguaag

SEQ ID NO: 74450 - RNA, 32 nt, Human
auuuaccucgaauuugauucccagaggaguug

SEQ ID NO: 74451 - RNA, 31 nt, Human
auuuaccuguuuucgcaccuaccaucaggga

SEQ ID NO: 74452 - RNA, 32 nt, Human
auuuacguaaaaagauauuucuaauuuacugu

SEQ ID NO: 74453 - RNA, 32 nt, Human
auuuacuaaaaauacaaaaacuuagccgggca

SEQ ID NO: 74454 - RNA, 32 nt, Human
auuuacuaauccugucuuauuucccacaaauc

SEQ ID NO: 74455 - RNA, 32 nt, Human
auuuacuacaauauguacauuucuaagucaaa

SEQ ID NO: 74456 - RNA, 32 nt, Human
auuuacuccaaagccuguuguucuuaacugca

SEQ ID NO: 74457 - RNA, 32 nt, Human
auuuacuccagaggaucaucucuuuguauuug

SEQ ID NO: 74458 - RNA, 32 nt, Human
auuuacucuaggguaagguaguacacauuugg

SEQ ID NO: 74459 - RNA, 32 nt, Human
auuuacucugcugcaaccucucuuucuccuac

SEQ ID NO: 74460 - RNA, 32 nt, Human
auuuacucuguaguaauugaugauuaacuugg

SEQ ID NO: 74461 - RNA, 32 nt, Human
auuuacugaacaaagccuccuuugccaaaggc

SEQ ID NO: 74462 - RNA, 32 nt, Human
auuuacuggaaauguauucauacugugaauug

SEQ ID NO: 74463 - RNA, 32 nt, Human
auuuacuggaagacuuggauuugguggaagac

SEQ ID NO: 74464 - RNA, 22 nt, Human
auuuacuuaagucaauaacaga

SEQ ID NO: 74465 - RNA, 32 nt, Human
auuuacuugccccacugcugugcaaugccuua

SEQ ID NO: 74466 - RNA, 32 nt, Human
auuuacuuguucuuuaucucccccuuuuucua

SEQ ID NO: 74467 - RNA, 32 nt, Human
auuuacuuuaugcuaccucucccacacugguu

SEQ ID NO: 74468 - RNA, 32 nt, Human
auuuacuuugaaugucaagucagauuggucug

SEQ ID NO: 74469 - RNA, 32 nt, Human
auuuacuuuugaaaagaaauuucuuuaacagg

SEQ ID NO: 74470 - RNA, 32 nt, Human
auuuagaaaauuccucuucguucaccuuggcu

SEQ ID NO: 74471 - RNA, 32 nt, Human
auuuagaaauuagcugggcaugguggcaccca

SEQ ID NO: 74472 - RNA, 32 nt, Human
auuuagaagaacagaaaacaaaacuauuacaa

SEQ ID NO: 74473 - RNA, 32 nt, Human
auuuagaagacagcauacuagauggaauaauc

SEQ ID NO: 74474 - RNA, 32 nt, Human
auuuagaagcuccucagaugauucuaguuuuc

SEQ ID NO: 74475 - RNA, 32 nt, Human
auuuagaauuauugcauuuucauuccaaagua

SEQ ID NO: 74476 - RNA, 32 nt, Human
auuuagacaaaacuccagccuuguugaccacc

SEQ ID NO: 74477 - RNA, 32 nt, Human
auuuagacaaugaaaauuaucaagagauaauu

SEQ ID NO: 74478 - RNA, 32 nt, Human
auuuagacuuguuuucccguuuccuugaauga

SEQ ID NO: 74479 - RNA, 32 nt, Human
auuuagagaaguuagucucucugggccuguuu

SEQ ID NO: 74480 - RNA, 32 nt, Human
auuuagagacagagucucacccuguuggccag

SEQ ID NO: 74481 - RNA, 32 nt, Human
auuuagagaugggguuuugccauguuggccag

SEQ ID NO: 74482 - RNA, 32 nt, Human
auuuagagcaaagccucagcuaagugacacau

SEQ ID NO: 74483 - RNA, 32 nt, Human
auuuagaggaauauuugugagcugccauuugu

SEQ ID NO: 74484 - RNA, 17 nt, Human
auuuagauaaccuuuga

SEQ ID NO: 74485 - RNA, 32 nt, Human
auuuagauaauagggcaggggaagcacccucu

SEQ ID NO: 74486 - RNA, 32 nt, Human
auuuagauaccaacccucccggcuguaucagu

SEQ ID NO: 74487 - RNA, 32 nt, Human
auuuagauaguaugucaguaguuguguuuuua

SEQ ID NO: 74488 - RNA, 31 nt, Human
auuuagauggaaagugauggcauucacaggc

SEQ ID NO: 74489 - RNA, 32 nt, Human
auuuagauuaucauuuaugugcuguugcacag

SEQ ID NO: 74490 - RNA, 32 nt, Human
auuuagauucacugugaugaaaagcacagccu

SEQ ID NO: 74491 - RNA, 32 nt, Human
auuuagauugauucuccccaaauguggaugaa

SEQ ID NO: 74492 - RNA, 32 nt, Human
auuuagcagccuuucaaauguauaugguucug

SEQ ID NO: 74493 - RNA, 32 nt, Human
auuuagcaggagcuauccugacuuaauaucca

SEQ ID NO: 74494 - RNA, 32 nt, Human
auuuagcagugaggcagcaaugcugaguaggu

SEQ ID NO: 74495 - RNA, 22 nt, Human
auuuagcaugguguguugaaau

SEQ ID NO: 74496 - RNA, 32 nt, Human
auuuagcgaugaggaaagugaagcucagagca

SEQ ID NO: 74497 - RNA, 32 nt, Human
auuuagcucacuguaacacaguuucacucucu

SEQ ID NO: 74498 - RNA, 32 nt, Human
auuuagcuccagaaagcaaagaaaacucgagu

SEQ ID NO: 74499 - RNA, 32 nt, Human
auuuagcuccaugccaaccacucccggcuugc

SEQ ID NO: 74500 - RNA, 32 nt, Human
auuuagcugcccacgcugcagugugaguaaug

SEQ ID NO: 74501 - RNA, 32 nt, Human
auuuagcugcugccaguucaagugaccugucc

SEQ ID NO: 74502 - RNA, 32 nt, Human
auuuagcugcugccuccagccucuggcuugag

SEQ ID NO: 74503 - RNA, 32 nt, Human
auuuaggaaaugauauggcaucagguaagccu

SEQ ID NO: 74504 - RNA, 32 nt, Human
auuuaggaccacugcauccugucuuaauccaa

SEQ ID NO: 74505 - RNA, 32 nt, Human
auuuaggagugccauuucagcaguucagugag

SEQ ID NO: 74506 - RNA, 32 nt, Human
auuuaggaguuucaauaauaaccauugcuuuu

SEQ ID NO: 74507 - RNA, 31 nt, Human
auuuaggauucuccuguuucaucugggucag

SEQ ID NO: 74508 - RNA, 32 nt, Human
auuuaggauuucagggaaaaguguccaagcuu

SEQ ID NO: 74509 - RNA, 32 nt, Human
auuuaggcaaaacuuacaguauuguucuggga

SEQ ID NO: 74510 - RNA, 19 nt, Human
auuuaggcugggugcagug

SEQ ID NO: 74511 - RNA, 32 nt, Human
auuuagggaaggugaaaggcauaccuuugugg

SEQ ID NO: 74512 - RNA, 32 nt, Human
auuuagggacaugcuacccacuaccuacucuu

SEQ ID NO: 74513 - RNA, 32 nt, Human
auuuagggaguuaccuguuuucaucucgaggu

SEQ ID NO: 74514 - RNA, 32 nt, Human
auuuagggaucucagauuuggaagaugacugc

SEQ ID NO: 74515 - RNA, 32 nt, Human
auuuagggcaaguugcuugagcucuuugggcc

SEQ ID NO: 74516 - RNA, 32 nt, Human
auuuagggccagaugagaacgacugggggcca

SEQ ID NO: 74517 - RNA, 32 nt, Human
auuuagggcuaugacaaaaauguuguuaaagc

SEQ ID NO: 74518 - RNA, 32 nt, Human
auuuaggggaugggaacaacaugucuucaccu

SEQ ID NO: 74519 - RNA, 32 nt, Human
auuuagggugcuguacaaaucaccuccgccua

SEQ ID NO: 74520 - RNA, 32 nt, Human
auuuagguagguugaagcuaggaggauuuucu

SEQ ID NO: 74521 - RNA, 32 nt, Human
auuuaggucccuuggucuguacaaauaauagc

SEQ ID NO: 74522 - RNA, 32 nt, Human
auuuaggugauaccuaaauccuucuuauguuu

SEQ ID NO: 74523 - RNA, 32 nt, Human
auuuagguugagucaugagaaccggucauugg

SEQ ID NO: 74524 - RNA, 32 nt, Human
auuuagguuguugccaauguuuuauuauaacg

SEQ ID NO: 74525 - RNA, 23 nt, Human
auuuaguaaaguguaucaaagua

SEQ ID NO: 74526 - RNA, 32 nt, Human
auuuaguacaguuuagaaagagcacuuauuuu

SEQ ID NO: 74527 - RNA, 32 nt, Human
auuuaguaguccauugauaaauuugccagcau

SEQ ID NO: 74528 - RNA, 22 nt, Human
auuuaguauaguguagaaaaua

SEQ ID NO: 74529 - RNA, 32 nt, Human
auuuagucacccagaggagccaguaaauguua

SEQ ID NO: 74530 - RNA, 32 nt, Human
auuuagucacccagaggagccaguaaguguua

SEQ ID NO: 74531 - RNA, 32 nt, Human
auuuagucauucuucuuuuaaauuuagaaacc

SEQ ID NO: 74532 - RNA, 32 nt, Human
auuuaguccuaaaaggauacuuuggaacuuaa

SEQ ID NO: 74533 - RNA, 32 nt, Human
auuuaguccugugcauacugugguguuuuuac

SEQ ID NO: 74534 - RNA, 32 nt, Human
auuuagucucugugucagcacaguguaaucuc

SEQ ID NO: 74535 - RNA, 32 nt, Human
auuuagugaaguugugcaacggccaggguugu

SEQ ID NO: 74536 - RNA, 32 nt, Human
auuuagugcccagggaguccagcgaaugacgu

SEQ ID NO: 74537 - RNA, 32 nt, Human
auuuagugcuaaacaaguaagaaaaauaagcu

SEQ ID NO: 74538 - RNA, 32 nt, Human
auuuagugggggaggcuggaucacgcugcagc

SEQ ID NO: 74539 - RNA, 31 nt, Human
auuuagugggugggaagaggcccugaugcug

SEQ ID NO: 74540 - RNA, 32 nt, Human
auuuagugugacugcacacaucugggcucuaa

SEQ ID NO: 74541 - RNA, 32 nt, Human
auuuaguguguaguuucugaaagcaaacugau

SEQ ID NO: 74542 - RNA, 32 nt, Human
auuuaguugccugccuguggcugguaagguaa

SEQ ID NO: 74543 - RNA, 32 nt, Human
auuuaguuuuuaaccccuaugaaaauuugacu

SEQ ID NO: 74544 - RNA, 32 nt, Human
auuuaguuuuuccacuuuaccuucaugauuua

SEQ ID NO: 74545 - RNA, 32 nt, Human
auuuauaaaagcagacucaccuaauaaaauca

SEQ ID NO: 74546 - RNA, 32 nt, Human
auuuauaaauaacauuuaauuuuaauuuauuu

SEQ ID NO: 74547 - RNA, 32 nt, Human
auuuauaacuaaaucucuauuuguucggauga

SEQ ID NO: 74548 - RNA, 32 nt, Human
auuuauaacucauaaucauuuagacauaaugc

SEQ ID NO: 74549 - RNA, 32 nt, Human
auuuauaacuggauagcauugcagugaaagca

SEQ ID NO: 74550 - RNA, 32 nt, Human
auuuauaagagcaguguuugagaccuccugug

SEQ ID NO: 74551 - RNA, 32 nt, Human
auuuauaaucuuguggcuaauuuguuaguccu

SEQ ID NO: 74552 - RNA, 32 nt, Human
auuuauacaauccauuucuguccucuuuaugg

SEQ ID NO: 74553 - RNA, 32 nt, Human
auuuauacacuucucccauuuuguaucaggug

SEQ ID NO: 74554 - RNA, 32 nt, Human
auuuauacaucuccauuuucugaccucuggac

SEQ ID NO: 74555 - RNA, 32 nt, Human
auuuauacauggcagaucuuacugucucuaca

SEQ ID NO: 74556 - RNA, 32 nt, Human
auuuauacugaucuuuuuccauccagcagugg

SEQ ID NO: 74557 - RNA, 32 nt, Human
auuuauagaccaccuccagccagugacgcucc

SEQ ID NO: 74558 - RNA, 32 nt, Human
auuuauagagaaacgcguguccccgaggcccg

SEQ ID NO: 74559 - RNA, 32 nt, Human
auuuauagaugaggcuuauaugaaaaggcuag

SEQ ID NO: 74560 - RNA, 32 nt, Human
auuuauagaugaugggauuauagguguuugcu

SEQ ID NO: 74561 - RNA, 32 nt, Human
auuuauaggaagaagguuuuugcucaguaccu

SEQ ID NO: 74562 - RNA, 32 nt, Human
auuuauaggaccacaggccagccugggagauu

SEQ ID NO: 74563 - RNA, 32 nt, Human
auuuauaggcuauuaaggcaagggauaucuua

SEQ ID NO: 74564 - RNA, 32 nt, Human
auuuauaguggagaugggguuucuccauauug

SEQ ID NO: 74565 - RNA, 32 nt, Human
auuuauauaacuguuuuguuauuugaaucuug

SEQ ID NO: 74566 - RNA, 20 nt, Human
auuuauaugaacaccuuuga

SEQ ID NO: 74567 - RNA, 32 nt, Human
auuuauaugccaccuugucuuucauaaaagcu

SEQ ID NO: 74568 - RNA, 32 nt, Human
auuuauaugucagagcuguucuaaauuuauca

SEQ ID NO: 74569 - RNA, 31 nt, Human
auuuauauguuacuggcaguuggaaaugcag

SEQ ID NO: 74570 - RNA, 32 nt, Human
auuuauauuucacauaauguaaaguucuacaa

SEQ ID NO: 74571 - RNA, 32 nt, Human
auuuaucagacauugaacuucugugauuaauc

SEQ ID NO: 74572 - RNA, 32 nt, Human
auuuaucagacuccugggagaacaccaacauc

SEQ ID NO: 74573 - RNA, 32 nt, Human
auuuaucauauguaaauuaaacaugaauacau

SEQ ID NO: 74574 - RNA, 32 nt, Human
auuuaucauccauccauccaucauccauccgu

SEQ ID NO: 74575 - RNA, 28 nt, Human
auuuauccaagugcuuucauuuuuccag

SEQ ID NO: 74576 - RNA, 32 nt, Human
auuuauccauucaguguuuccugggccucugc

SEQ ID NO: 74577 - RNA, 32 nt, Human
auuuauccccauccguucguauuuauauuaaa

SEQ ID NO: 74578 - RNA, 32 nt, Human
auuuauccucaagagucagcuggcaggaucuc

SEQ ID NO: 74579 - RNA, 32 nt, Human
auuuauccugaucugucguugccaucaccucc

SEQ ID NO: 74580 - RNA, 32 nt, Human
auuuauccuuuuccuuuccuuccccuaagaug

SEQ ID NO: 74581 - RNA, 32 nt, Human
auuuaucuaccuaucuguaucuccuugugaaa

SEQ ID NO: 74582 - RNA, 32 nt, Human
auuuaucucaaagcugcaaguuccugccaucu

SEQ ID NO: 74583 - RNA, 32 nt, Human
auuuaucuccaacuuccuaaaggcuuaugacu

SEQ ID NO: 74584 - RNA, 32 nt, Human
auuuaucuccaggauguuuuuguggcuguauu

SEQ ID NO: 74585 - RNA, 32 nt, Human
auuuaucugggauguggacaucagugggccag

SEQ ID NO: 74586 - RNA, 32 nt, Human
auuuaucugggcuuugcuguuagcauuagccu

SEQ ID NO: 74587 - RNA, 32 nt, Human
auuuaucugucugucccuuaguuuucucaccu

SEQ ID NO: 74588 - RNA, 32 nt, Human
auuuaucuucccuugucuuccugcuuugcauu

SEQ ID NO: 74589 - RNA, 32 nt, Human
auuuaucuucugcugcugcuuggaguuacauu

SEQ ID NO: 74590 - RNA, 32 nt, Human
auuuaucuugcuggguaaaugagggauaccca

SEQ ID NO: 74591 - RNA, 32 nt, Human
auuuaucuuggggaaaccucagaacuggucua

SEQ ID NO: 74592 - RNA, 32 nt, Human
auuuaugaaacugagcucucuuccauuuuacu

SEQ ID NO: 74593 - RNA, 32 nt, Human
auuuaugaaaucucaaagagaugagccaccuu

SEQ ID NO: 74594 - RNA, 32 nt, Human
auuuaugaaucuugcugccuuuuagcaccagg

SEQ ID NO: 74595 - RNA, 32 nt, Human
auuuaugacaagcuguaucacugccuucguuu

SEQ ID NO: 74596 - RNA, 32 nt, Human
auuuaugacucuguuaagcauaccguuugucu

SEQ ID NO: 74597 - RNA, 32 nt, Human
auuuaugagaauuauaaguaaagcuuucugua

SEQ ID NO: 74598 - RNA, 32 nt, Human
auuuaugcagcuauuuucauacauucccuguu

SEQ ID NO: 74599 - RNA, 32 nt, Human
auuuaugcaucaguguaagacaggaggauggg

SEQ ID NO: 74600 - RNA, 32 nt, Human
auuuaugccugagagauuccuugaaaaugcaa

SEQ ID NO: 74601 - RNA, 32 nt, Human
auuuaugccuuuucagcuuugcaccuggaacu

SEQ ID NO: 74602 - RNA, 32 nt, Human
auuuaugcucuaauaucaacguaacauaaaua

SEQ ID NO: 74603 - RNA, 32 nt, Human
auuuaugcucuuccuccacaucuucauuuggc

SEQ ID NO: 74604 - RNA, 32 nt, Human
auuuaugcuugggaggucgaggcugcagugag

SEQ ID NO: 74605 - RNA, 32 nt, Human
auuuaugcuuugagugaaucaucuguugaggu

SEQ ID NO: 74606 - RNA, 32 nt, Human
auuuauggaaagcacaacauaugcaauuauau

SEQ ID NO: 74607 - RNA, 32 nt, Human
auuuauggaaauagauauuugugcagcucaau

SEQ ID NO: 74608 - RNA, 31 nt, Human
auuuauggacuucucuuuugaaaagacacac

SEQ ID NO: 74609 - RNA, 32 nt, Human
auuuauggagugcuugcuaugugccccucaug

SEQ ID NO: 74610 - RNA, 32 nt, Human
auuuauggaucacacugaucugaauucagaca

SEQ ID NO: 74611 - RNA, 32 nt, Human
auuuaugggacugauagagaacuuuuauuauu

SEQ ID NO: 74612 - RNA, 32 nt, Human
auuuauggggagacagagagaaagaggagaca

SEQ ID NO: 74613 - RNA, 32 nt, Human
auuuaugggguggggugagggguggggauggg

SEQ ID NO: 74614 - RNA, 32 nt, Human
auuuauggguggauuuauccuuuugccuucug

SEQ ID NO: 74615 - RNA, 32 nt, Human
auuuauguacuuugcuuaauguaaucauucau

SEQ ID NO: 74616 - RNA, 32 nt, Human
auuuauguccccaaacuuggaaacaagaacuc

SEQ ID NO: 74617 - RNA, 32 nt, Human
auuuauguucaugggcugaccccacauuggac

SEQ ID NO: 74618 - RNA, 32 nt, Human
auuuauguucauguccuguaaauuuuuaagua

SEQ ID NO: 74619 - RNA, 32 nt, Human
auuuauguugcggaaagguaaccacaaaguua

SEQ ID NO: 74620 - RNA, 31 nt, Human
auuuauuaauccucccugccugugucuauua

SEQ ID NO: 74621 - RNA, 32 nt, Human
auuuauuaauggcugcugucuccaguuucugg

SEQ ID NO: 74622 - RNA, 32 nt, Human
auuuauuacuaugacugcuccccagcccuggc

SEQ ID NO: 74623 - RNA, 32 nt, Human
auuuauuacucagagugccauucuucucauau

SEQ ID NO: 74624 - RNA, 32 nt, Human
auuuauuacuucuucuuuccaggaccugacag

SEQ ID NO: 74625 - RNA, 32 nt, Human
auuuauuagaaaaagaguauuucuccaaaaau

SEQ ID NO: 74626 - RNA, 32 nt, Human
auuuauuagaagacuuuuaaggaggguggaua

SEQ ID NO: 74627 - RNA, 32 nt, Human
auuuauuagauguuuugcuauauaaauuaccg

SEQ ID NO: 74628 - RNA, 32 nt, Human
auuuauuagcugguuggagagcuagaaccugg

SEQ ID NO: 74629 - RNA, 32 nt, Human
auuuauuaugcagccagaguuggcagcaagca

SEQ ID NO: 74630 - RNA, 32 nt, Human
auuuauuauuguaaaucaugugcugccaccag

SEQ ID NO: 74631 - RNA, 32 nt, Human
auuuauucacacuugaauugcauuugugauca

SEQ ID NO: 74632 - RNA, 32 nt, Human
auuuauucagcaccuguuauguaccaggcacu

SEQ ID NO: 74633 - RNA, 32 nt, Human
auuuauucauucugcagcagcuacaaucuaug

SEQ ID NO: 74634 - RNA, 32 nt, Human
auuuauucauucuuuuaauuuauguaaguuuu

SEQ ID NO: 74635 - RNA, 32 nt, Human
auuuauucauuucucuccucugccaaaucuac

SEQ ID NO: 74636 - RNA, 32 nt, Human
auuuauucccacaaaauguuggcauugcuuga

SEQ ID NO: 74637 - RNA, 32 nt, Human
auuuauuccccaaauacuuauuagcugacacc

SEQ ID NO: 74638 - RNA, 32 nt, Human
auuuauucccuucuauucaaggccaguuagga

SEQ ID NO: 74639 - RNA, 32 nt, Human
auuuauuccgcuccgcccccucccucucccuu

SEQ ID NO: 74640 - RNA, 32 nt, Human
auuuauuccuuauuucucuuucaucaaaacaa

SEQ ID NO: 74641 - RNA, 32 nt, Human
auuuauuccuuuccuuucuauccuuuuauauu

SEQ ID NO: 74642 - RNA, 32 nt, Human
auuuauucuccuaugugucauaugaaaggcca

SEQ ID NO: 74643 - RNA, 32 nt, Human
auuuauucuguaaccugacacucaucuggccc

SEQ ID NO: 74644 - RNA, 31 nt, Human
auuuauugacuucucauguucuagagaguag

SEQ ID NO: 74645 - RNA, 32 nt, Human
auuuauugcuaccuucugugaaugcuuagcuc

SEQ ID NO: 74646 - RNA, 32 nt, Human
auuuauugcuaucugaggccacuagugagauu

SEQ ID NO: 74647 - RNA, 32 nt, Human
auuuauugucugagucuuuguucaguccuugc

SEQ ID NO: 74648 - RNA, 32 nt, Human
auuuauugugagaauggcuacacuucuuuagg

SEQ ID NO: 74649 - RNA, 32 nt, Human
auuuauugugcaaaugcugguauuucuuacau

SEQ ID NO: 74650 - RNA, 32 nt, Human
auuuauuguuuauacggaugacugggaggcac

SEQ ID NO: 74651 - RNA, 32 nt, Human
auuuauuucccugacuguugccucacuuccuu

SEQ ID NO: 74652 - RNA, 32 nt, Human
auuuauuucuggaugucccauacaugaaaaau

SEQ ID NO: 74653 - RNA, 32 nt, Human
auuuauuucuguaguugugccagggacagacu

SEQ ID NO: 74654 - RNA, 32 nt, Human
auuuauuucuuuccucaccuguucccugacug

SEQ ID NO: 74655 - RNA, 32 nt, Human
auuuauuugaaaggaaugaggauccugcacuc

SEQ ID NO: 74656 - RNA, 32 nt, Human
auuuauuugggccauccgccacccugccagug

SEQ ID NO: 74657 - RNA, 32 nt, Human
auuuauuugguguuucgggcguggccucugga

SEQ ID NO: 74658 - RNA, 32 nt, Human
auuuauuugguguuugcuugaaugcugguacu

SEQ ID NO: 74659 - RNA, 32 nt, Human
auuuauuuguguugaccuuacuuucuuuaagc

SEQ ID NO: 74660 - RNA, 32 nt, Human
auuuauuuuacuucuguguccuaaggguaauu

SEQ ID NO: 74661 - RNA, 32 nt, Human
auuuauuuucauaaaucuuuuguccuggcuuc

SEQ ID NO: 74662 - RNA, 32 nt, Human
auuuauuuucauuguuggcccacgguuagucc

SEQ ID NO: 74663 - RNA, 32 nt, Human
auuuauuuugagauagagccuugcucugucac

SEQ ID NO: 74664 - RNA, 32 nt, Human
auuuauuuugagauggaguuucacucuuguug

SEQ ID NO: 74665 - RNA, 32 nt, Human
auuuauuuugcuauacaggauguaauagguca

SEQ ID NO: 74666 - RNA, 32 nt, Human
auuuauuuuggauucaaauuguauuuacauau

SEQ ID NO: 74667 - RNA, 32 nt, Human
auuuauuuuuaaacuccuuucagauuauuuua

SEQ ID NO: 74668 - RNA, 32 nt, Human
auuuauuuuuagauaaaggauaugaaaacucu

SEQ ID NO: 74669 - RNA, 32 nt, Human
auuuauuuuuagauggagucuugcuccgucgc

SEQ ID NO: 74670 - RNA, 32 nt, Human
auuuauuuuugucaaaaaucaauguuuugaca

SEQ ID NO: 74671 - RNA, 32 nt, Human
auuucaaaaggauauuuggugcaaagcaauuu

SEQ ID NO: 74672 - RNA, 32 nt, Human
auuucaaaaggcugcugauguaguucccgggu

SEQ ID NO: 74673 - RNA, 32 nt, Human
auuucaaaaucacccaaaacuuuuggcaaaua

SEQ ID NO: 74674 - RNA, 32 nt, Human
auuucaaaaugugcuugacaccugccuuaaau

SEQ ID NO: 74675 - RNA, 32 nt, Human
auuucaaacugaucaccuggggaugagagcaa

SEQ ID NO: 74676 - RNA, 32 nt, Human
auuucaaagacucauguuucugcuaugaccau

SEQ ID NO: 74677 - RNA, 32 nt, Human
auuucaaagagauuuaaaugaauuuguuuuau

SEQ ID NO: 74678 - RNA, 32 nt, Human
auuucaaauaaaccacaaaucaucauuuucca

SEQ ID NO: 74679 - RNA, 32 nt, Human
auuucaaauccugcacucaggccuggugguga

SEQ ID NO: 74680 - RNA, 32 nt, Human
auuucaaaucucuccuccucccccucucuccu

SEQ ID NO: 74681 - RNA, 32 nt, Human
auuucaaaucuuuccaauuuacccuggaauca

SEQ ID NO: 74682 - RNA, 32 nt, Human
auuucaaauucacauuagcuuugcuaccacua

SEQ ID NO: 74683 - RNA, 32 nt, Human
auuucaacacauuuagugccucuuucauuucu

SEQ ID NO: 74684 - RNA, 32 nt, Human
auuucaacacugagggccuggagaccucggcu

SEQ ID NO: 74685 - RNA, 32 nt, Human
auuucaacccaggaggcagacguugcagcgag

SEQ ID NO: 74686 - RNA, 18 nt, Human
auuucaacuagcuucuga

SEQ ID NO: 74687 - RNA, 32 nt, Human
auuucaacuguucuguugaaucaucugccuga

SEQ ID NO: 74688 - RNA, 32 nt, Human
auuucaagaaaaugcauauuuuccaauaauuu

SEQ ID NO: 74689 - RNA, 32 nt, Human
auuucaagaaugacacucuacacaugcuccug

SEQ ID NO: 74690 - RNA, 32 nt, Human
auuucaagauauugguacauuuuauagguauc

SEQ ID NO: 74691 - RNA, 32 nt, Human
auuucaagccacuggggaaacugaggcaaaac

SEQ ID NO: 74692 - RNA, 32 nt, Human
auuucaagcccacagucugucacuuugaagua

SEQ ID NO: 74693 - RNA, 32 nt, Human
auuucaagcgagaacucgucuaugaugacguc

SEQ ID NO: 74694 - RNA, 31 nt, Human
auuucaaggcuaagagagaaagacugccucu

SEQ ID NO: 74695 - RNA, 32 nt, Human
auuucaaggguaggaagauggaagaaauaggg

SEQ ID NO: 74696 - RNA, 32 nt, Human
auuucaaguaaauauaugcacugguagaaaug

SEQ ID NO: 74697 - RNA, 32 nt, Human
auuucaagugauuugggggugcaaugauaaug

SEQ ID NO: 74698 - RNA, 32 nt, Human
auuucaaguuaauuacaaacaguuuuguaacu

SEQ ID NO: 74699 - RNA, 32 nt, Human
auuucaaugacuuuuaagaacaacagcccuuc

SEQ ID NO: 74700 - RNA, 32 nt, Human
auuucaauuggcugagaaggcagagagcuagc

SEQ ID NO: 74701 - RNA, 32 nt, Human
auuucacaaacaucaggcaauuuccaggguug

SEQ ID NO: 74702 - RNA, 32 nt, Human
auuucacaaagggggaaauugaggcacagagg

SEQ ID NO: 74703 - RNA, 24 nt, Human
auuucacaaauaucucuagacuca

SEQ ID NO: 74704 - RNA, 32 nt, Human
auuucacaaaucagaagaacaucagcaaucca

SEQ ID NO: 74705 - RNA, 32 nt, Human
auuucacaacacaaaaaggacauuuguggaug

SEQ ID NO: 74706 - RNA, 32 nt, Human
auuucacaacuaaagcuuugucauagacuuca

SEQ ID NO: 74707 - RNA, 32 nt, Human
auuucacacagcauuuugaaacuggcuacaau

SEQ ID NO: 74708 - RNA, 32 nt, Human
auuucacacagggagaagcugaggcuuaaggu

SEQ ID NO: 74709 - RNA, 32 nt, Human
auuucacacuccuccaccugucucaaacucua

SEQ ID NO: 74710 - RNA, 32 nt, Human
auuucacagcuuucacauagcacagauaacuc

SEQ ID NO: 74711 - RNA, 32 nt, Human
auuucacaggcagagaggugccaucaguucgc

SEQ ID NO: 74712 - RNA, 32 nt, Human
auuucacaggccaggguucaguucugcuccuc

SEQ ID NO: 74713 - RNA, 32 nt, Human
auuucacaggcgauuuugaccaugcuucuaca

SEQ ID NO: 74714 - RNA, 32 nt, Human
auuucacagggugggaguggcccgagcagugg

SEQ ID NO: 74715 - RNA, 32 nt, Human
auuucacagguaaaagucaguaggauggaaca

SEQ ID NO: 74716 - RNA, 32 nt, Human
auuucacagguaguguuucagacucugaaagc

SEQ ID NO: 74717 - RNA, 32 nt, Human
auuucacauaaauauauuuucaauuguguaca

SEQ ID NO: 74718 - RNA, 31 nt, Human
auuucacauacuuuucuuaugucauuagaua

SEQ ID NO: 74719 - RNA, 32 nt, Human
auuucacauuuuauuuggagauauuuaaauga

SEQ ID NO: 74720 - RNA, 32 nt, Human
auuucaccacacgucagcaucuaaucccaaga

SEQ ID NO: 74721 - RNA, 32 nt, Human
auuucaccaccacuccagccugggugagaaag

SEQ ID NO: 74722 - RNA, 32 nt, Human
auuucaccacugcauucuagccugggcaacag

SEQ ID NO: 74723 - RNA, 32 nt, Human
auuucaccagugcacuccagccugggugacag

SEQ ID NO: 74724 - RNA, 20 nt, Human
auuucaccaugaggacacuu

SEQ ID NO: 74725 - RNA, 32 nt, Human
auuucacccacaguucagcuggcuguugauuu

SEQ ID NO: 74726 - RNA, 32 nt, Human
auuucacccuugcauuccagccugugaaauaa

SEQ ID NO: 74727 - RNA, 32 nt, Human
auuucaccgccuggcccugggcuccaggagag

SEQ ID NO: 74728 - RNA, 32 nt, Human
auuucaccggcuccaccaaauuagugccucuu

SEQ ID NO: 74729 - RNA, 32 nt, Human
auuucaccucaaguggagaaucgcugaccuug

SEQ ID NO: 74730 - RNA, 32 nt, Human
auuucaccucacuccagccugggugacagcgu

SEQ ID NO: 74731 - RNA, 32 nt, Human
auuucaccugcucuacuuuugcugcauuaauu

SEQ ID NO: 74732 - RNA, 32 nt, Human
auuucacguuuugaacagcagcaguuugaagg

SEQ ID NO: 74733 - RNA, 32 nt, Human
auuucacucacacuccaguuuguaauaaaaug

SEQ ID NO: 74734 - RNA, 32 nt, Human
auuucacucugccugugggaguccugugaauc

SEQ ID NO: 74735 - RNA, 32 nt, Human
auuucacugauuauaaaauacagauuuuucac

SEQ ID NO: 74736 - RNA, 32 nt, Human
auuucacugcaaucccccguaucauccauggg

SEQ ID NO: 74737 - RNA, 32 nt, Human
auuucacugucaccccucuuuguggacagaag

SEQ ID NO: 74738 - RNA, 32 nt, Human
auuucacuuuauaacuaaccaguccuacauau

SEQ ID NO: 74739 - RNA, 32 nt, Human
auuucacuuuccucuuccaggggcaaaggcug

SEQ ID NO: 74740 - RNA, 32 nt, Human
auuucacuuuuaauuugcugguguuuuaauaa

SEQ ID NO: 74741 - RNA, 32 nt, Human
auuucacuuuugauccuuccagcuccaggguc

SEQ ID NO: 74742 - RNA, 22 nt, Human
auuucagaaauaaaaugaaaug

SEQ ID NO: 74743 - RNA, 32 nt, Human
auuucagaaauccaguaucacagggugauccu

SEQ ID NO: 74744 - RNA, 32 nt, Human
auuucagaacuccuaauuaagcccuggauacu

SEQ ID NO: 74745 - RNA, 22 nt, Human
auuucagaauaggaaguaaaug

SEQ ID NO: 74746 - RNA, 32 nt, Human
auuucagaaucugccuuucagcccuuccuucu

SEQ ID NO: 74747 - RNA, 32 nt, Human
auuucagagaaacugaggcaccagagaugcuu

SEQ ID NO: 74748 - RNA, 32 nt, Human
auuucagagagggagcuggcuggagagaaagg

SEQ ID NO: 74749 - RNA, 32 nt, Human
auuucagaguguuggagaagaaucuguagcuu

SEQ ID NO: 74750 - RNA, 32 nt, Human
auuucagauaaucuaucuacuuaaacauguuu

SEQ ID NO: 74751 - RNA, 24 nt, Human
auuucagauacuuuaagugaauug

SEQ ID NO: 74752 - RNA, 32 nt, Human
auuucagauccaccccacccccagacucaucc

SEQ ID NO: 74753 - RNA, 32 nt, Human
auuucagaugaugacuguccaagugccuccaa

SEQ ID NO: 74754 - RNA, 32 nt, Human
auuucagaugccccugcccucuugucugccac

SEQ ID NO: 74755 - RNA, 23 nt, Human
auuucagcacaaucuuagacuca

SEQ ID NO: 74756 - RNA, 32 nt, Human
auuucagcacauugggucuuucugccacaggc

SEQ ID NO: 74757 - RNA, 32 nt, Human
auuucagcagggccaggcaggaccuggguuuc

SEQ ID NO: 74758 - RNA, 24 nt, Human
auuucagcagugugaagguaaaug

SEQ ID NO: 74759 - RNA, 32 nt, Human
auuucagccacuucuagcagaucaugccaugg

SEQ ID NO: 74760 - RNA, 32 nt, Human
auuucagccagcccuugcgcccuguuugugcc

SEQ ID NO: 74761 - RNA, 32 nt, Human
auuucagccagccuuuaucauuccucuuacuu

SEQ ID NO: 74762 - RNA, 32 nt, Human
auuucagcccaggagguuguggauacagugag

SEQ ID NO: 74763 - RNA, 32 nt, Human
auuucagccguauuaaaagaaaggacacugug

SEQ ID NO: 74764 - RNA, 32 nt, Human
auuucagcucacggcuaccucugccucccggg

SEQ ID NO: 74765 - RNA, 32 nt, Human
auuucagcucacuacaaccuccugcuccuggg

SEQ ID NO: 74766 - RNA, 32 nt, Human
auuucagcucacuacaaccucugccuccgggu

SEQ ID NO: 74767 - RNA, 32 nt, Human
auuucagcucacugaaccucugccucccaggu

SEQ ID NO: 74768 - RNA, 22 nt, Human
auuucagcucacugcaaccucc

SEQ ID NO: 74769 - RNA, 32 nt, Human
auuucagcucacugcaaccuccaccucccagg

SEQ ID NO: 74770 - RNA, 32 nt, Human
auuucagcucacugcaaccucugccucccagg

SEQ ID NO: 74771 - RNA, 32 nt, Human
auuucagcucacugcaaccucugccucccggg

SEQ ID NO: 74772 - RNA, 32 nt, Human
auuucagcucacugcaaccuucgccaccuggg

SEQ ID NO: 74773 - RNA, 32 nt, Human
auuucagcucacugcaaccuucgccucccagc

SEQ ID NO: 74774 - RNA, 32 nt, Human
auuucagcucacugcaaucucugccacccaga

SEQ ID NO: 74775 - RNA, 32 nt, Human
auuucagcuguggaggaguuuuuagccucaag

SEQ ID NO: 74776 - RNA, 32 nt, Human
auuucaggagcaggggugggaggcagguggac

SEQ ID NO: 74777 - RNA, 32 nt, Human
auuucaggcgugagccaccacacccggccaaa

SEQ ID NO: 74778 - RNA, 32 nt, Human
auuucagguauuuaauacgaaauguggaaggg

SEQ ID NO: 74779 - RNA, 32 nt, Human
auuucaggucucaggauguuuagaaagcuaaa

SEQ ID NO: 74780 - RNA, 23 nt, Human
auuucagguguggcuguggaaug

SEQ ID NO: 74781 - RNA, 32 nt, Human
auuucagguucccagcugcagcucucuggguc

SEQ ID NO: 74782 - RNA, 32 nt, Human
auuucaguaaacaaugaauaguuuuucauugu

SEQ ID NO: 74783 - RNA, 32 nt, Human
auuucaguagaaucacuuacucauccuaaaag

SEQ ID NO: 74784 - RNA, 24 nt, Human
auuucagucacaggaaauggggug

SEQ ID NO: 74785 - RNA, 32 nt, Human
auuucagucaucuucagggaccagucugaugu

SEQ ID NO: 74786 - RNA, 32 nt, Human
auuucagugaagauagacuagcaugcuaaacu

SEQ ID NO: 74787 - RNA, 32 nt, Human
auuucagugacaguuucuuuugcaauuuugug

SEQ ID NO: 74788 - RNA, 32 nt, Human
auuucagugauguuuauaccaaucuguauaua

SEQ ID NO: 74789 - RNA, 32 nt, Human
auuucaguucacugcaaccuccaccucccagg

SEQ ID NO: 74790 - RNA, 32 nt, Human
auuucaguucacugcagccucgaccucccagg

SEQ ID NO: 74791 - RNA, 17 nt, Human
auuucauacacccucga

SEQ ID NO: 74792 - RNA, 32 nt, Human
auuucauagauacuucauuuguauuuacagua

SEQ ID NO: 74793 - RNA, 32 nt, Human
auuucauagcacuuuacagugugcaaaugcuu

SEQ ID NO: 74794 - RNA, 32 nt, Human
auuucauaucaacuuuuguauccacaguagac

SEQ ID NO: 74795 - RNA, 32 nt, Human
auuucaucacaagaaaccuacucuucugucau

SEQ ID NO: 74796 - RNA, 32 nt, Human
auuucaucacccagguauuaagcccaauaccc

SEQ ID NO: 74797 - RNA, 32 nt, Human
auuucaucacccagguauuaagcccagugccu

SEQ ID NO: 74798 - RNA, 32 nt, Human
auuucaucaucugccuucugcuuuucaagacc

SEQ ID NO: 74799 - RNA, 32 nt, Human
auuucaucaucuuuaccaaccaguggcuuuuc

SEQ ID NO: 74800 - RNA, 32 nt, Human
auuucauccaugucccuacaaaggacaugaac

SEQ ID NO: 74801 - RNA, 32 nt, Human
auuucauccaugucccuacaaaggauaugaac

SEQ ID NO: 74802 - RNA, 32 nt, Human
auuucaucccuaauuucuuccuccaccaugcc

SEQ ID NO: 74803 - RNA, 32 nt, Human
auuucaucuagcaauucucuuugacuuagucg

SEQ ID NO: 74804 - RNA, 32 nt, Human
auuucaucugcucuccuuccuggagcccagag

SEQ ID NO: 74805 - RNA, 32 nt, Human
auuucaucuuuguccuaacaugagugcuugua

SEQ ID NO: 74806 - RNA, 32 nt, Human
auuucaugaaaugcaaaacaauaggacagcug

SEQ ID NO: 74807 - RNA, 32 nt, Human
auuucaugaagauuuuagaucaagagagcuac

SEQ ID NO: 74808 - RNA, 32 nt, Human
auuucaugagucuaguaguucuuugauuuaua

SEQ ID NO: 74809 - RNA, 32 nt, Human
auuucaugaucuggggcaucaugucgguagcu

SEQ ID NO: 74810 - RNA, 32 nt, Human
auuucaugauugguggaagcucucaagcucca

SEQ ID NO: 74811 - RNA, 32 nt, Human
auuucaugcccugugcuguuacagaggagaac

SEQ ID NO: 74812 - RNA, 32 nt, Human
auuucaugcuccacuauaauuuuccuggaaac

SEQ ID NO: 74813 - RNA, 32 nt, Human
auuucaugcuuauuuuuccuuuaucagagaga

SEQ ID NO: 74814 - RNA, 32 nt, Human
auuucauggaaccuggaggcugggcuucaggc

SEQ ID NO: 74815 - RNA, 32 nt, Human
auuucaugucuuucagcagguggaccuugugu

SEQ ID NO: 74816 - RNA, 26 nt, Human
auuucauguggggaacccucaaggcc

SEQ ID NO: 74817 - RNA, 32 nt, Human
auuucauuaccuccuacuugccauucacccau

SEQ ID NO: 74818 - RNA, 32 nt, Human
auuucauucagaaccauuuuaguguuuuccua

SEQ ID NO: 74819 - RNA, 32 nt, Human
auuucauuccaaaggaaauaccagcuugucca

SEQ ID NO: 74820 - RNA, 32 nt, Human
auuucauucucuuccugauuguugcaccccua

SEQ ID NO: 74821 - RNA, 32 nt, Human
auuucauuuacuacugaauuuuauugcuaagu

SEQ ID NO: 74822 - RNA, 32 nt, Human
auuucauuucccuccucucucccaggguaccu

SEQ ID NO: 74823 - RNA, 19 nt, Human
auuucauuuuucacuauuu

SEQ ID NO: 74824 - RNA, 32 nt, Human
auuuccaaacgugcucucagacaguggauaau

SEQ ID NO: 74825 - RNA, 32 nt, Human
auuuccaaagacuugggggagugaaggcagag

SEQ ID NO: 74826 - RNA, 32 nt, Human
auuuccaaaggaagaagcuaagagugagaaaa

SEQ ID NO: 74827 - RNA, 32 nt, Human
auuuccaaaggcugcuggccccaggcacacuc

SEQ ID NO: 74828 - RNA, 32 nt, Human
auuuccaagaggagagaaaaaguggagucaug

SEQ ID NO: 74829 - RNA, 32 nt, Human
auuuccacaaccucuaaccacauucaguccag

SEQ ID NO: 74830 - RNA, 32 nt, Human
auuuccacaagaaaauuaauucauuccaauau

SEQ ID NO: 74831 - RNA, 32 nt, Human
auuuccacagaauucacaggagcaugguuccu

SEQ ID NO: 74832 - RNA, 32 nt, Human
auuuccacagcaccugcuaaguuuguauuuaa

SEQ ID NO: 74833 - RNA, 32 nt, Human
auuuccacagccguacaugugaucccagugac

SEQ ID NO: 74834 - RNA, 32 nt, Human
auuuccacaguggcugaacuaauuuacauucc

SEQ ID NO: 74835 - RNA, 32 nt, Human
auuuccaccaugggcauucaggcucuccacac

SEQ ID NO: 74836 - RNA, 32 nt, Human
auuuccacccagccccaggauuuccagagcgc

SEQ ID NO: 74837 - RNA, 32 nt, Human
auuuccaccugggaauuucuggugccaugcca

SEQ ID NO: 74838 - RNA, 32 nt, Human
auuuccacucaacaucaagauaagcugcucua

SEQ ID NO: 74839 - RNA, 32 nt, Human
auuuccacucuucugugagccuggugacaaua

SEQ ID NO: 74840 - RNA, 32 nt, Human
auuuccacuguuggacgaauucugagcgccca

SEQ ID NO: 74841 - RNA, 32 nt, Human
auuuccacuucuggguggaauaccaaaauaau

SEQ ID NO: 74842 - RNA, 32 nt, Human
auuuccacuuuaugcagaauuaauacucaauu

SEQ ID NO: 74843 - RNA, 32 nt, Human
auuuccagagacccagcuacaguucccuggcu

SEQ ID NO: 74844 - RNA, 21 nt, Human
auuuccagagccagggucagg

SEQ ID NO: 74845 - RNA, 32 nt, Human
auuuccagcagcccucauccucagccuugcgg

SEQ ID NO: 74846 - RNA, 32 nt, Human
auuuccagccugaacagauguugaguacaagc

SEQ ID NO: 74847 - RNA, 32 nt, Human
auuuccagccuuggacggacagcugggaacgu

SEQ ID NO: 74848 - RNA, 32 nt, Human
auuuccagcugcugccagccuuccugcaguau

SEQ ID NO: 74849 - RNA, 32 nt, Human
auuuccagguuagaaccuguggauuguuucaa

SEQ ID NO: 74850 - RNA, 32 nt, Human
auuuccagucaauucagaagcauuuuaccagu

SEQ ID NO: 74851 - RNA, 32 nt, Human
auuuccagucucugcugagugucccagacccu

SEQ ID NO: 74852 - RNA, 32 nt, Human
auuuccagugcacacauuucaucaccaggugg

SEQ ID NO: 74853 - RNA, 25 nt, Human
auuuccagugucccaacuacuguca

SEQ ID NO: 74854 - RNA, 32 nt, Human
auuuccaguucuguagaguuuauugucaauug

SEQ ID NO: 74855 - RNA, 32 nt, Human
auuuccauaaaauaaacaaagcacuuaaauca

SEQ ID NO: 74856 - RNA, 32 nt, Human
auuuccauagcuuuuggcugggggcgggggac

SEQ ID NO: 74857 - RNA, 32 nt, Human
auuuccaucagcaguaaacaaagacauuccug

SEQ ID NO: 74858 - RNA, 32 nt, Human
auuuccauccaauauuuaaagacuugaauuuu

SEQ ID NO: 74859 - RNA, 32 nt, Human
auuuccauccauaggaaaauggauagacaaac

SEQ ID NO: 74860 - RNA, 32 nt, Human
auuuccaugucucugcuuagcugugcuggcag

SEQ ID NO: 74861 - RNA, 32 nt, Human
auuuccauuucaggugguuuucuaagugcucc

SEQ ID NO: 74862 - RNA, 20 nt, Human
auuucccaaaaguaugcucc

SEQ ID NO: 74863 - RNA, 32 nt, Human
auuucccaaaauucuaagagcagcagcauaug

SEQ ID NO: 74864 - RNA, 22 nt, Human
auuucccaaacacuccgcucca

SEQ ID NO: 74865 - RNA, 32 nt, Human
auuucccaaacaguccacaggucccaugccca

SEQ ID NO: 74866 - RNA, 24 nt, Human
auuucccaaaguccucugcuccag

SEQ ID NO: 74867 - RNA, 21 nt, Human
auuucccaagaagcacuucag

SEQ ID NO: 74868 - RNA, 32 nt, Human
auuucccaagaagcacuucaguuuaucagucu

SEQ ID NO: 74869 - RNA, 21 nt, Human
auuucccaagagaagagccag

SEQ ID NO: 74870 - RNA, 20 nt, Human
auuucccaccccugcuccag

SEQ ID NO: 74871 - RNA, 32 nt, Human
auuucccaccccugcuccagccucgauuuggu

SEQ ID NO: 74872 - RNA, 32 nt, Human
auuucccacugcacuccagccugagugacaga

SEQ ID NO: 74873 - RNA, 32 nt, Human
auuucccagaggacuagcaggaggcagccuug

SEQ ID NO: 74874 - RNA, 32 nt, Human
auuucccagaggagggacuaaaagagagggca

SEQ ID NO: 74875 - RNA, 32 nt, Human
auuucccaggagaaggauaauugggucaaaag

SEQ ID NO: 74876 - RNA, 32 nt, Human
auuucccaggagagggauaauugggucaaaag

SEQ ID NO: 74877 - RNA, 32 nt, Human
auuucccaggagcugggcagugguaaaauuaa

SEQ ID NO: 74878 - RNA, 21 nt, Human
auuucccagggacuccagggu

SEQ ID NO: 74879 - RNA, 32 nt, Human
auuucccauaggaagagaucugccagacgcga

SEQ ID NO: 74880 - RNA, 32 nt, Human
auuucccauauuucaggugaauaauuuaauuu

SEQ ID NO: 74881 - RNA, 32 nt, Human
auuucccaucccccaucuccucaaccaccagg

SEQ ID NO: 74882 - RNA, 32 nt, Human
auuuccccaacccagcuccaucaucacagaca

SEQ ID NO: 74883 - RNA, 32 nt, Human
auuuccccagaaccugcgccgcgcgagaagga

SEQ ID NO: 74884 - RNA, 32 nt, Human
auuuccccagcgucgauugagcucucggcccu

SEQ ID NO: 74885 - RNA, 32 nt, Human
auuuccccaggccuuguuaaaacaaagaaagc

SEQ ID NO: 74886 - RNA, 32 nt, Human
auuucccccaaucccugcugggcugcugaauc

SEQ ID NO: 74887 - RNA, 32 nt, Human
auuucccccauccuccuuccucucccacagcu

SEQ ID NO: 74888 - RNA, 32 nt, Human
auuucccccauguugucuuucccuuggcugau

SEQ ID NO: 74889 - RNA, 32 nt, Human
auuucccccuacucccucccucuccugcaccc

SEQ ID NO: 74890 - RNA, 32 nt, Human
auuucccccucucauaacuucuccccauccca

SEQ ID NO: 74891 - RNA, 32 nt, Human
auuucccccugcugcuggcccagcacaauugu

SEQ ID NO: 74892 - RNA, 32 nt, Human
auuucccccuuuaguuuccaaccuucucccca

SEQ ID NO: 74893 - RNA, 32 nt, Human
auuuccccucauucuaccucucuaaggcuaug

SEQ ID NO: 74894 - RNA, 32 nt, Human
auuuccccugguuugucucauucuucuugguu

SEQ ID NO: 74895 - RNA, 32 nt, Human
auuucccgccuccauuugauguuuccagguuu

SEQ ID NO: 74896 - RNA, 32 nt, Human
auuucccggggugggaacgccgggaggcggga

SEQ ID NO: 74897 - RNA, 32 nt, Human
auuucccuaauagagaccuaaccagagggcca

SEQ ID NO: 74898 - RNA, 32 nt, Human
auuucccuagccucuuccuuuuucauuagccc

SEQ ID NO: 74899 - RNA, 32 nt, Human
auuucccucacacacuaccaugaugaccaguc

SEQ ID NO: 74900 - RNA, 32 nt, Human
auuucccucagguucuauuuucuuaaaccaac

SEQ ID NO: 74901 - RNA, 32 nt, Human
auuucccucccucccucugguuguucuguuga

SEQ ID NO: 74902 - RNA, 32 nt, Human
auuucccucgcucuccccucccugcuuggccc

SEQ ID NO: 74903 - RNA, 32 nt, Human
auuucccucuacugccucuuccugccucuccc

SEQ ID NO: 74904 - RNA, 32 nt, Human
auuucccugauccccaggcuuggggcaauugg

SEQ ID NO: 74905 - RNA, 32 nt, Human
auuucccugcagaugguacagauguuccugcc

SEQ ID NO: 74906 - RNA, 32 nt, Human
auuucccugccugcucuuuaggccuuuggcac

SEQ ID NO: 74907 - RNA, 32 nt, Human
auuucccuggaugguuucuugccugcacugcu

SEQ ID NO: 74908 - RNA, 32 nt, Human
auuucccuucauuucucugcuugccacccuug

SEQ ID NO: 74909 - RNA, 32 nt, Human
auuucccuuuuucaauuuacauagaagcauag

SEQ ID NO: 74910 - RNA, 32 nt, Human
auuuccgagaaagcuucagacaugcuuauaag

SEQ ID NO: 74911 - RNA, 32 nt, Human
auuuccgccacccugaauuuaguagagcuagu

SEQ ID NO: 74912 - RNA, 32 nt, Human
auuuccgcucacugcaaccuccgccucccagg

SEQ ID NO: 74913 - RNA, 32 nt, Human
auuuccguagggcuucccagcaugggggauuu

SEQ ID NO: 74914 - RNA, 32 nt, Human
auuuccguaguaguagagauaauaugagaaau

SEQ ID NO: 74915 - RNA, 32 nt, Human
auuuccuaacaacagagagauucucuuauguc

SEQ ID NO: 74916 - RNA, 32 nt, Human
auuuccuaagcuacauauggccaucuugacag

SEQ ID NO: 74917 - RNA, 32 nt, Human
auuuccuaauaacaaaacuuucuguguucuua

SEQ ID NO: 74918 - RNA, 32 nt, Human
auuuccuaaucgcccucaccucuggcuucagg

SEQ ID NO: 74919 - RNA, 32 nt, Human
auuuccuaccuaagcaucucccgagaaaaaua

SEQ ID NO: 74920 - RNA, 32 nt, Human
auuuccuaguacuagagugagccccgacuuag

SEQ ID NO: 74921 - RNA, 32 nt, Human
auuuccuauccagcagaaccugcagcaagcuc

SEQ ID NO: 74922 - RNA, 28 nt, Human
auuuccuauggcuauuaauucuuagggu

SEQ ID NO: 74923 - RNA, 32 nt, Human
auuuccuauguugaaacccaaucccuaguaug

SEQ ID NO: 74924 - RNA, 32 nt, Human
auuuccucaaaaagauuuccccauuuagguuu

SEQ ID NO: 74925 - RNA, 32 nt, Human
auuuccucagucuuuucuuuuguacuccuauc

SEQ ID NO: 74926 - RNA, 32 nt, Human
auuuccucaucugcccacaccuuccggugggc

SEQ ID NO: 74927 - RNA, 32 nt, Human
auuuccucauguugcugaccaggugcccauau

SEQ ID NO: 74928 - RNA, 32 nt, Human
auuuccucauuucaguuccuucugcagccugu

SEQ ID NO: 74929 - RNA, 32 nt, Human
auuuccucauuuuuauaaugucccuucacaaa

SEQ ID NO: 74930 - RNA, 32 nt, Human
auuuccucuccuccuguagccauacuuugauu

SEQ ID NO: 74931 - RNA, 32 nt, Human
auuuccucuggcccauauuugaauuuauugga

SEQ ID NO: 74932 - RNA, 32 nt, Human
auuuccucuguucaauaaauacugaaggucac

SEQ ID NO: 74933 - RNA, 32 nt, Human
auuuccucuuagcucaaauaauucuguuuuuc

SEQ ID NO: 74934 - RNA, 32 nt, Human
auuuccucuucgcucuauuuuagcaguuggau

SEQ ID NO: 74935 - RNA, 32 nt, Human
auuuccugauuccuggaacucagucccaggau

SEQ ID NO: 74936 - RNA, 32 nt, Human
auuuccugccaagaaggugaacgcuggagacc

SEQ ID NO: 74937 - RNA, 20 nt, Human
auuuccugccccuuucaggg

SEQ ID NO: 74938 - RNA, 32 nt, Human
auuuccugcugucccucagccuccaggcuuca

SEQ ID NO: 74939 - RNA, 32 nt, Human
auuuccuggcaaucacggguaaggaggauuag

SEQ ID NO: 74940 - RNA, 32 nt, Human
auuuccuggucacaucauuaacugcuaauucu

SEQ ID NO: 74941 - RNA, 32 nt, Human
auuuccuguccuuuuaaauugcccacccuuua

SEQ ID NO: 74942 - RNA, 32 nt, Human
auuuccugugaaccucgucuggaguugaagag

SEQ ID NO: 74943 - RNA, 32 nt, Human
auuuccuguucucccagcuccagguccaccuc

SEQ ID NO: 74944 - RNA, 32 nt, Human
auuuccuuaccucuagccagucacuuccuuuu

SEQ ID NO: 74945 - RNA, 32 nt, Human
auuuccuucucccuuucccugcccacccuguc

SEQ ID NO: 74946 - RNA, 32 nt, Human
auuuccuugggauagagguuguguuggggaau

SEQ ID NO: 74947 - RNA, 32 nt, Human
auuuccuuguccccucuuccccaaaaccucug

SEQ ID NO: 74948 - RNA, 32 nt, Human
auuuccuuucuagccccugcaucuccaacaag

SEQ ID NO: 74949 - RNA, 32 nt, Human
auuuccuuucuuuuuaagaacaggguugggac

SEQ ID NO: 74950 - RNA, 32 nt, Human
auuuccuuuuaagcugcccuguugauucuacu

SEQ ID NO: 74951 - RNA, 32 nt, Human
auuuccuuuucccaccucuccccugaccccca

SEQ ID NO: 74952 - RNA, 32 nt, Human
auuucgaagaggagguggcaaagugggagaaa

SEQ ID NO: 74953 - RNA, 32 nt, Human
auuucgacucacugcaaccucugccucccagg

SEQ ID NO: 74954 - RNA, 32 nt, Human
auuucgagaaaguugugcuggugaggauggag

SEQ ID NO: 74955 - RNA, 32 nt, Human
auuucgagggcagaacucugggaaggaaagaa

SEQ ID NO: 74956 - RNA, 32 nt, Human
auuucgauggccagcauuacccuuuaccugug

SEQ ID NO: 74957 - RNA, 32 nt, Human
auuucgcaacuggcuccucaaugacauaccau

SEQ ID NO: 74958 - RNA, 32 nt, Human
auuucgcuccaauguaaauucucugauguuga

SEQ ID NO: 74959 - RNA, 32 nt, Human
auuucgcucugucacccagacuggagugcaau

SEQ ID NO: 74960 - RNA, 32 nt, Human
auuucggacccugcaacuccuauuauaucgcc

SEQ ID NO: 74961 - RNA, 32 nt, Human
auuucggagcacggaagcacacacaagcucuu

SEQ ID NO: 74962 - RNA, 32 nt, Human
auuucggaggagagaagaaagugcaacguggg

SEQ ID NO: 74963 - RNA, 22 nt, Human
auuucggcucacugcaaccucc

SEQ ID NO: 74964 - RNA, 32 nt, Human
auuucggcucacugcaaccuccaccuccuggg

SEQ ID NO: 74965 - RNA, 32 nt, Human
auuucggcucacugcaaccuccuccucccaga

SEQ ID NO: 74966 - RNA, 32 nt, Human
auuucggcucacugcaaccucugccucccaag

SEQ ID NO: 74967 - RNA, 32 nt, Human
auuucggcucacugcaaccucugucuccuggg

SEQ ID NO: 74968 - RNA, 32 nt, Human
auuucggcucacugcaacuucugccucccggg

SEQ ID NO: 74969 - RNA, 24 nt, Human
auuucggcucacuucaaacuccgc

SEQ ID NO: 74970 - RNA, 32 nt, Human
auuucguacaaaccugaaaaacacacugauuu

SEQ ID NO: 74971 - RNA, 32 nt, Human
auuucguacaauauuauuguuuuacuuuucag

SEQ ID NO: 74972 - RNA, 32 nt, Human
auuucguacagcacaguggcuuauaaggaacc

SEQ ID NO: 74973 - RNA, 32 nt, Human
auuucguccucuuccguucuucaccccuacac

SEQ ID NO: 74974 - RNA, 32 nt, Human
auuucgucguuaugguaaguggagauuauucc

SEQ ID NO: 74975 - RNA, 32 nt, Human
auuucgugcuggaguggagcagccucuagaac

SEQ ID NO: 74976 - RNA, 32 nt, Human
auuucgugcuucaccuccauuuacuuacaagc

SEQ ID NO: 74977 - RNA, 32 nt, Human
auuucuaaaauggcagcuucaguucuagagaa

SEQ ID NO: 74978 - RNA, 32 nt, Human
auuucuaaagaauguguucuaaaacagcagaa

SEQ ID NO: 74979 - RNA, 32 nt, Human
auuucuaaagcagcagcaauaguguucuuuua

SEQ ID NO: 74980 - RNA, 32 nt, Human
auuucuaagagugguugagggaagggaguagg

SEQ ID NO: 74981 - RNA, 32 nt, Human
auuucuaagcaagauaggaagggagcacuuuc

SEQ ID NO: 74982 - RNA, 32 nt, Human
auuucuaagcaguugaaugacacagucagauu

SEQ ID NO: 74983 - RNA, 32 nt, Human
auuucuacaaaaugcaaaaauuagcugggcau

SEQ ID NO: 74984 - RNA, 32 nt, Human
auuucuacacguugcccaucaucccuucuucc

SEQ ID NO: 74985 - RNA, 32 nt, Human
auuucuacaguaaacacucaaaaccaagcaaa

SEQ ID NO: 74986 - RNA, 32 nt, Human
auuucuacagucuuuuagaugaugccaacucc

SEQ ID NO: 74987 - RNA, 32 nt, Human
auuucuaccaacaacauccaacuuccaacaaa

SEQ ID NO: 74988 - RNA, 32 nt, Human
auuucuaccucuuuccuggcaauugaaaugaa

SEQ ID NO: 74989 - RNA, 32 nt, Human
auuucuaccucuuuccuggcaauugaaaugga

SEQ ID NO: 74990 - RNA, 32 nt, Human
auuucuaccugaaggccagaagugugccugaa

SEQ ID NO: 74991 - RNA, 32 nt, Human
auuucuacucacaauuugaucaucacacacac

SEQ ID NO: 74992 - RNA, 32 nt, Human
auuucuacugcuuuucuuucugcuucaaacac

SEQ ID NO: 74993 - RNA, 32 nt, Human
auuucuagaaugcugaaaagcuuuccugaccc

SEQ ID NO: 74994 - RNA, 32 nt, Human
auuucuagcaaguuuccaggugaugcuguugu

SEQ ID NO: 74995 - RNA, 32 nt, Human
auuucuagcaugggggcuguguuuguaugaga

SEQ ID NO: 74996 - RNA, 32 nt, Human
auuucuaggcucugaaauagccacuuuaagaa

SEQ ID NO: 74997 - RNA, 32 nt, Human
auuucuaguagagaugggguuucuccauggug

SEQ ID NO: 74998 - RNA, 32 nt, Human
auuucuaguagagaugggguuucuccauguug

SEQ ID NO: 74999 - RNA, 32 nt, Human
auuucuaguagaguuagaguuucuccauauug

SEQ ID NO: 75000 - RNA, 32 nt, Human
auuucuagugucacccucccucuccuucaugg

SEQ ID NO: 75001 - RNA, 32 nt, Human
auuucuaucucuucccgaaagagaggguaugu

SEQ ID NO: 75002 - RNA, 32 nt, Human
auuucuaugcagcccccgacccagagccgagc

SEQ ID NO: 75003 - RNA, 22 nt, Human
auuucuauggcuuucaaagcua

SEQ ID NO: 75004 - RNA, 32 nt, Human
auuucuauuaccugcagauaguaagaaggaug

SEQ ID NO: 75005 - RNA, 32 nt, Human
auuucuauuaugcaguuuguugaccauggcua

SEQ ID NO: 75006 - RNA, 32 nt, Human
auuucucaagaaggaagacuccccugccuccc

SEQ ID NO: 75007 - RNA, 32 nt, Human
auuucucaaugggcuggaaggaaggagagaaa

SEQ ID NO: 75008 - RNA, 32 nt, Human
auuucucacuccugcccuucuuccacagcgua

SEQ ID NO: 75009 - RNA, 32 nt, Human
auuucucagcacaccaugccaucuguuuauca

SEQ ID NO: 75010 - RNA, 32 nt, Human
auuucucaggagaccagaacugaucugccagc

SEQ ID NO: 75011 - RNA, 21 nt, Human
auuucucagucuguuuccuca

SEQ ID NO: 75012 - RNA, 32 nt, Human
auuucucagugaauuucaauguaucugccucu

SEQ ID NO: 75013 - RNA, 32 nt, Human
auuucucaguggcuucuccauccucauuugca

SEQ ID NO: 75014 - RNA, 32 nt, Human
auuucucaucagaacaaagcacgagauggaau

SEQ ID NO: 75015 - RNA, 32 nt, Human
auuucucaugccauuagcucucuacaaaauaa

SEQ ID NO: 75016 - RNA, 32 nt, Human
auuucucauuuaagggcagaauggagggauga

SEQ ID NO: 75017 - RNA, 32 nt, Human
auuucuccaagaggagaguggggaagguuccc

SEQ ID NO: 75018 - RNA, 32 nt, Human
auuucuccaccugugucaacacuuguuauuuu

SEQ ID NO: 75019 - RNA, 32 nt, Human
auuucuccacuugccaguuuaauuccagccuu

SEQ ID NO: 75020 - RNA, 32 nt, Human
auuucucccaaccaaauccucuuaaagacccu

SEQ ID NO: 75021 - RNA, 32 nt, Human
auuucucccaaugcuaaugaacagcucauaag

SEQ ID NO: 75022 - RNA, 32 nt, Human
auuucucccagagggagcugcuggcccgcucu

SEQ ID NO: 75023 - RNA, 32 nt, Human
auuucucccugccugcuuugugccaacuagca

SEQ ID NO: 75024 - RNA, 32 nt, Human
auuucuccuacuuuucuuuucuacuguugucu

SEQ ID NO: 75025 - RNA, 32 nt, Human
auuucuccuccuaaucugggccucuugucaug

SEQ ID NO: 75026 - RNA, 32 nt, Human
auuucuccuccuccugugcccucuucgccccc

SEQ ID NO: 75027 - RNA, 32 nt, Human
auuucuccuggcuguuguccagggcucuccuc

SEQ ID NO: 75028 - RNA, 32 nt, Human
auuucuccugucucagcuucucaaagugcugg

SEQ ID NO: 75029 - RNA, 32 nt, Human
auuucuccuuugaggcagagguuuaaguguag

SEQ ID NO: 75030 - RNA, 32 nt, Human
auuucuccuuuggaggaggaggaggaggagga

SEQ ID NO: 75031 - RNA, 23 nt, Human
auuucucggacacuucucagugu

SEQ ID NO: 75032 - RNA, 32 nt, Human
auuucucguuugccuuucuauuuccuuccaaa

SEQ ID NO: 75033 - RNA, 32 nt, Human
auuucucuacauccucuccagcaucuguuguu

SEQ ID NO: 75034 - RNA, 18 nt, Human
auuucucuacguuuucuc

SEQ ID NO: 75035 - RNA, 32 nt, Human
caaagguucucaaauucccugaaaauaugcaa

SEQ ID NO: 75036 - RNA, 19 nt, Human
caaagguugccugcaaagg

SEQ ID NO: 75037 - RNA, 32 nt, Human
caaagguuucucugcaacccuucccuaagcau

SEQ ID NO: 75038 - RNA, 32 nt, Human
caaaguaaaagcuuucuuggagccuuucucuu

SEQ ID NO: 75039 - RNA, 32 nt, Human
caaaguaagccucaccuuugccuuccaacugc

SEQ ID NO: 75040 - RNA, 32 nt, Human
caaaguacguccucccuccuugcugccucuuc

SEQ ID NO: 75041 - RNA, 23 nt, Human
caaaguacugggacuacaggcgu

SEQ ID NO: 75042 - RNA, 23 nt, Human
caaaguacugggauuacaaacau

SEQ ID NO: 75043 - RNA, 21 nt, Human
caaaguacugggauuacaggc

SEQ ID NO: 75044 - RNA, 23 nt, Human
caaaguacugggauuacaggcau

SEQ ID NO: 75045 - RNA, 23 nt, Human
caaaguacugggauuacaggcgu

SEQ ID NO: 75046 - RNA, 32 nt, Human
caaaguagcaagaaaaauacgacauuggugua

SEQ ID NO: 75047 - RNA, 32 nt, Human
caaaguagcuagcuaaaggaguagccuuaaau

SEQ ID NO: 75048 - RNA, 23 nt, Human
caaaguagcugggauuacaggca

SEQ ID NO: 75049 - RNA, 24 nt, Human
caaaguagcugggauuacaggcau

SEQ ID NO: 75050 - RNA, 32 nt, Human
caaaguaggaagggagagccauuugaaaggca

SEQ ID NO: 75051 - RNA, 32 nt, Human
caaaguaggagaagaaauggggaggacucggg

SEQ ID NO: 75052 - RNA, 32 nt, Human
caaaguaggagacagauaacagguacauccau

SEQ ID NO: 75053 - RNA, 32 nt, Human
caaaguaggagagaggcccagaggaaagccca

SEQ ID NO: 75054 - RNA, 21 nt, Human
caaaguagggagggcauccaa

SEQ ID NO: 75055 - RNA, 32 nt, Human
caaaguauaaaggaauuggaccaaauaauuua

SEQ ID NO: 75056 - RNA, 32 nt, Human
caaaguaugguugagaaauuguggcagaaaga

SEQ ID NO: 75057 - RNA, 23 nt, Human
caaaguauugggacuacaggcgu

SEQ ID NO: 75058 - RNA, 32 nt, Human
caaagucaacaaaaacaagugauggggaaagg

SEQ ID NO: 75059 - RNA, 23 nt, Human
caaagucagauccccaucucuac

SEQ ID NO: 75060 - RNA, 32 nt, Human
caaagucagcaacucuccuguugguucauuau

SEQ ID NO: 75061 - RNA, 32 nt, Human
caaagucaggaguucaagaccagccgggccag

SEQ ID NO: 75062 - RNA, 32 nt, Human
caaagucaggaguucaagaccagccuggccaa

SEQ ID NO: 75063 - RNA, 32 nt, Human
caaagucauagagagaauauggcauuugaaag

SEQ ID NO: 75064 - RNA, 32 nt, Human
caaagucaucccucuguucacagagauggaug

SEQ ID NO: 75065 - RNA, 32 nt, Human
caaagucauggacugaagccugaggccaucug

SEQ ID NO: 75066 - RNA, 32 nt, Human
caaagucaugucugcuuccucugccuccagcu

SEQ ID NO: 75067 - RNA, 20 nt, Human
caaagucauguguccacaca

SEQ ID NO: 75068 - RNA, 32 nt, Human
caaagucauguuuaaacuuggaaaagaggaug

SEQ ID NO: 75069 - RNA, 32 nt, Human
caaaguccagcuccccagaacacugcucgaca

SEQ ID NO: 75070 - RNA, 32 nt, Human
caaaguccggggauggcggcagagggggacca

SEQ ID NO: 75071 - RNA, 32 nt, Human
caaaguccuaucucaugccaaaggacagugag

SEQ ID NO: 75072 - RNA, 21 nt, Human
caaaguccugggauuacaggc

SEQ ID NO: 75073 - RNA, 32 nt, Human
caaaguccuuggaucauagaacugagugcuga

SEQ ID NO: 75074 - RNA, 32 nt, Human
caaaguccuuucucacacuccacugcccaaua

SEQ ID NO: 75075 - RNA, 32 nt, Human
caaaguccuuucucuccuggccccuuuucacg

SEQ ID NO: 75076 - RNA, 32 nt, Human
caaagucgggagaucaagaccauccuggcuaa

SEQ ID NO: 75077 - RNA, 32 nt, Human
caaagucuaaaaugguggggcaguagggaccu

SEQ ID NO: 75078 - RNA, 32 nt, Human
caaagucuaugaaggaucuucugcaagaggcu

SEQ ID NO: 75079 - RNA, 32 nt, Human
caaagucucaacaaccaucuuccgcuugacga

SEQ ID NO: 75080 - RNA, 32 nt, Human
caaagucucagucaguuccugaggcagaagag

SEQ ID NO: 75081 - RNA, 32 nt, Human
caaagucucauagcuuuggaggagccaucugc

SEQ ID NO: 75082 - RNA, 32 nt, Human
caaagucucuuuaaaagaagcuagggcauuuc

SEQ ID NO: 75083 - RNA, 32 nt, Human
caaagucugaggcuuuuuccaucaguaaucag

SEQ ID NO: 75084 - RNA, 32 nt, Human
caaagucugcaaccuugauguucaggucaagu

SEQ ID NO: 75085 - RNA, 32 nt, Human
caaagucuuuuuccuucucuccuuccuaugcu

SEQ ID NO: 75086 - RNA, 32 nt, Human
caaagugaaagccagccacuggagucgcagcc

SEQ ID NO: 75087 - RNA, 31 nt, Human
caaagugaagagagagauaggaagcugccuc

SEQ ID NO: 75088 - RNA, 32 nt, Human
caaagugaaugugguuuguauccauuuaugca

SEQ ID NO: 75089 - RNA, 23 nt, Human
caaagugagacccccaucucuac

SEQ ID NO: 75090 - RNA, 22 nt, Human
caaagugagacuccaucucuau

SEQ ID NO: 75091 - RNA, 25 nt, Human
caaagugagagccugucucuacaaa

SEQ ID NO: 75092 - RNA, 25 nt, Human
caaagugauacccugucucuacaaa

SEQ ID NO: 75093 - RNA, 32 nt, Human
caaagugauccuccaacgucagccucucgagu

SEQ ID NO: 75094 - RNA, 32 nt, Human
caaagugauggacaggaaggggcagagugagu

SEQ ID NO: 75095 - RNA, 23 nt, Human
caaagugaugggauuacaggcau

SEQ ID NO: 75096 - RNA, 22 nt, Human
caaagugcagggauuacaggca

SEQ ID NO: 75097 - RNA, 23 nt, Human
caaagugcagggauuacaggcau

SEQ ID NO: 75098 - RNA, 19 nt, Human
caaagugccagcagauuca

SEQ ID NO: 75099 - RNA, 23 nt, Human
caaagugccaggauuacaggcau

SEQ ID NO: 75100 - RNA, 32 nt, Human
caaagugccaggauuacaggcaugagccacug

SEQ ID NO: 75101 - RNA, 23 nt, Human
caaagugccgggaugacaggcau

SEQ ID NO: 75102 - RNA, 23 nt, Human
caaagugccgggauuacaggcau

SEQ ID NO: 75103 - RNA, 23 nt, Human
caaagugccgggauuacaggcgu

SEQ ID NO: 75104 - RNA, 32 nt, Human
caaagugcggaguguggagcuggaccagcugc

SEQ ID NO: 75105 - RNA, 22 nt, Human
caaagugcgggauuacaagcgu

SEQ ID NO: 75106 - RNA, 23 nt, Human
caaagugcuaggauuacagacau

SEQ ID NO: 75107 - RNA, 20 nt, Human
caaagugcuaggauuacagg

SEQ ID NO: 75108 - RNA, 21 nt, Human
caaagugcuaggauuacaggc

SEQ ID NO: 75109 - RNA, 22 nt, Human
caaagugcuaggauuacaggca

SEQ ID NO: 75110 - RNA, 23 nt, Human
caaagugcuaggauuacaggcau

SEQ ID NO: 75111 - RNA, 23 nt, Human
caaagugcuaggauuacaggcgu

SEQ ID NO: 75112 - RNA, 23 nt, Human
caaagugcuaggauuacagguau

SEQ ID NO: 75113 - RNA, 23 nt, Human
caaagugcuaggauuauaggcau

SEQ ID NO: 75114 - RNA, 23 nt, Human
caaagugcuaggguuacagacau

SEQ ID NO: 75115 - RNA, 23 nt, Human
caaagugcuaggguuacaggcau

SEQ ID NO: 75116 - RNA, 23 nt, Human
caaagugcuagguuuacaggcau

SEQ ID NO: 75117 - RNA, 24 nt, Human
caaagugcucaggauuacaggcgu

SEQ ID NO: 75118 - RNA, 32 nt, Human
caaagugcucccuucccagaggaggggcccca

SEQ ID NO: 75119 - RNA, 23 nt, Human
caaagugcucggauuacagacau

SEQ ID NO: 75120 - RNA, 23 nt, Human
caaagugcugaaauuacaggcau

SEQ ID NO: 75121 - RNA, 23 nt, Human
caaagugcugagauuacaagcgu

SEQ ID NO: 75122 - RNA, 23 nt, Human
caaagugcugagauuacagacau

SEQ ID NO: 75123 - RNA, 23 nt, Human
caaagugcugagauuacagacgu

SEQ ID NO: 75124 - RNA, 21 nt, Human
caaagugcugagauuacaggc

SEQ ID NO: 75125 - RNA, 23 nt, Human
caaagugcugagauuacaggcau

SEQ ID NO: 75126 - RNA, 23 nt, Human
caaagugcugagauuacaggcgu

SEQ ID NO: 75127 - RNA, 22 nt, Human
caaagugcugagauuauaggca

SEQ ID NO: 75128 - RNA, 23 nt, Human
caaagugcugagauuauaggcau

SEQ ID NO: 75129 - RNA, 23 nt, Human
caaagugcugauauuacaggcau

SEQ ID NO: 75130 - RNA, 23 nt, Human
caaagugcugcgauuacagacau

SEQ ID NO: 75131 - RNA, 23 nt, Human
caaagugcugcgauuacaggcau

SEQ ID NO: 75132 - RNA, 21 nt, Human
caaagugcuggaauuacaggc

SEQ ID NO: 75133 - RNA, 23 nt, Human
caaagugcuggaauuacaggcau

SEQ ID NO: 75134 - RNA, 23 nt, Human
caaagugcuggaauuacaggcgu

SEQ ID NO: 75135 - RNA, 23 nt, Human
caaagugcuggaauuacagucau

SEQ ID NO: 75136 - RNA, 31 nt, Human
caaagugcuggaauuacaugggugagcuacc

SEQ ID NO: 75137 - RNA, 23 nt, Human
caaagugcuggaauuacuggcau

SEQ ID NO: 75138 - RNA, 23 nt, Human
caaagugcuggaauuauaggcau

SEQ ID NO: 75139 - RNA, 23 nt, Human
caaagugcuggaauugcaggcau

SEQ ID NO: 75140 - RNA, 22 nt, Human
caaagugcuggauuacaggcau

SEQ ID NO: 75141 - RNA, 23 nt, Human
caaagugcuggcacuacaggcau

SEQ ID NO: 75142 - RNA, 32 nt, Human
caaagugcuggcauuacaggugggagcuaccg

SEQ ID NO: 75143 - RNA, 23 nt, Human
caaagugcugggaauacaggcau

SEQ ID NO: 75144 - RNA, 24 nt, Human
caaagugcugggaauuacaggcgu

SEQ ID NO: 75145 - RNA, 21 nt, Human
caaagugcugggacuacaggc

SEQ ID NO: 75146 - RNA, 32 nt, Human
caaagugcugggacuacaggcaggagccaccg

SEQ ID NO: 75147 - RNA, 23 nt, Human
caaagugcugggaucacagacgu

SEQ ID NO: 75148 - RNA, 23 nt, Human
caaagugcugggaucacaggcau

SEQ ID NO: 75149 - RNA, 22 nt, Human
caaagugcugggaucacaggcg

SEQ ID NO: 75150 - RNA, 23 nt, Human
caaagugcugggaucacaggcgu

SEQ ID NO: 75151 - RNA, 23 nt, Human
caaagugcugggaugacaggcau

SEQ ID NO: 75152 - RNA, 23 nt, Human
caaagugcugggauuacaagcau

SEQ ID NO: 75153 - RNA, 23 nt, Human
caaagugcugggauuacaagcgu

SEQ ID NO: 75154 - RNA, 19 nt, Human
caaagugcugggauuacag

SEQ ID NO: 75155 - RNA, 22 nt, Human
caaagugcugggauuacagaca

SEQ ID NO: 75156 - RNA, 23 nt, Human
caaagugcugggauuacagacau

SEQ ID NO: 75157 - RNA, 23 nt, Human
caaagugcugggauuacagacgu

SEQ ID NO: 75158 - RNA, 22 nt, Human
caaagugcugggauuacagcca

SEQ ID NO: 75159 - RNA, 21 nt, Human
caaagugcugggauuacaggc

SEQ ID NO: 75160 - RNA, 22 nt, Human
caaagugcugggauuacaggca

SEQ ID NO: 75161 - RNA, 23 nt, Human
caaagugcugggauuacaggcau

SEQ ID NO: 75162 - RNA, 22 nt, Human
caaagugcugggauuacaggcg

SEQ ID NO: 75163 - RNA, 23 nt, Human
caaagugcugggauuacaggcgu

SEQ ID NO: 75164 - RNA, 32 nt, Human
caaagugcugggauuacaggcgugggccacug

SEQ ID NO: 75165 - RNA, 32 nt, Human
caaagugcugggauuacaggcgugggccgccg

SEQ ID NO: 75166 - RNA, 23 nt, Human
caaagugcugggauuacagggau

SEQ ID NO: 75167 - RNA, 32 nt, Human
caaagugcugggauuacagggauaagccacca

SEQ ID NO: 75168 - RNA, 22 nt, Human
caaagugcugggauuacaggua

SEQ ID NO: 75169 - RNA, 23 nt, Human
caaagugcugggauuacagguau

SEQ ID NO: 75170 - RNA, 32 nt, Human
caaagugcugggauuacaggugugggagccac

SEQ ID NO: 75171 - RNA, 23 nt, Human
caaagugcugggauuacagucau

SEQ ID NO: 75172 - RNA, 23 nt, Human
caaagugcugggauuaccagcau

SEQ ID NO: 75173 - RNA, 23 nt, Human
caaagugcugggauuaccggcau

SEQ ID NO: 75174 - RNA, 23 nt, Human
caaagugcugggauuacgggcau

SEQ ID NO: 75175 - RNA, 23 nt, Human
caaagugcugggauuacgggcgu

SEQ ID NO: 75176 - RNA, 23 nt, Human
caaagugcugggauuacuggcau

SEQ ID NO: 75177 - RNA, 23 nt, Human
caaagugcugggauuagaggcau

SEQ ID NO: 75178 - RNA, 23 nt, Human
caaagugcugggauuauagacau

SEQ ID NO: 75179 - RNA, 22 nt, Human
caaagugcugggauuauaggca

SEQ ID NO: 75180 - RNA, 23 nt, Human
caaagugcugggauuauaggcau

SEQ ID NO: 75181 - RNA, 23 nt, Human
caaagugcugggauugcaggcau

SEQ ID NO: 75182 - RNA, 23 nt, Human
caaagugcuguaauuacaggcau

SEQ ID NO: 75183 - RNA, 23 nt, Human
caaagugcuuggauuacaggcau

SEQ ID NO: 75184 - RNA, 32 nt, Human
caaaguggagcuugugaguaagaaugcagaua

SEQ ID NO: 75185 - RNA, 32 nt, Human
caaaguggagugaugcgcuaagcggagugacc

SEQ ID NO: 75186 - RNA, 32 nt, Human
caaaguggcaucugcauaacuuucaaguacaa

SEQ ID NO: 75187 - RNA, 32 nt, Human
caaaguggcccacuuucuguggcucugaucag

SEQ ID NO: 75188 - RNA, 32 nt, Human
caaaguggccugcuuuucccaucccaggagcu

SEQ ID NO: 75189 - RNA, 32 nt, Human
caaaguggcugcagauaucucaaaauaguauu

SEQ ID NO: 75190 - RNA, 19 nt, Human
caaaguggcugccaccacu

SEQ ID NO: 75191 - RNA, 21 nt, Human
caaaguggcuuggaaggagug

SEQ ID NO: 75192 - RNA, 32 nt, Human
caaagugggagaaucacuugagcccaggaguu

SEQ ID NO: 75193 - RNA, 32 nt, Human
caaagugggaggaggaguggggauucuaugag

SEQ ID NO: 75194 - RNA, 32 nt, Human
caaagugggaggauugcuugagcucaggaguu

SEQ ID NO: 75195 - RNA, 32 nt, Human
caaagugggaggauugcuuggcucaagacaag

SEQ ID NO: 75196 - RNA, 32 nt, Human
caaagugggccgaucaccugagcucaggaauu

SEQ ID NO: 75197 - RNA, 32 nt, Human
caaagugggccuucccugggcugugcugcagg

SEQ ID NO: 75198 - RNA, 32 nt, Human
caaaguggggaccugucccaaggacuggccca

SEQ ID NO: 75199 - RNA, 32 nt, Human
caaaguggggauagcucucugagccaccucgg

SEQ ID NO: 75200 - RNA, 32 nt, Human
caaagugggggaggggagcuagaggcccagaa

SEQ ID NO: 75201 - RNA, 32 nt, Human
caaaguggguggaucacuugaggaguucaaga

SEQ ID NO: 75202 - RNA, 23 nt, Human
caaaguggugggaucacaggcgu

SEQ ID NO: 75203 - RNA, 23 nt, Human
caaagugguuucagcaauauuua

SEQ ID NO: 75204 - RNA, 32 nt, Human
caaagugucagcaacuuugaggagggcaccag

SEQ ID NO: 75205 - RNA, 32 nt, Human
caaagugugauuucacacuguuuuuaaaucua

SEQ ID NO: 75206 - RNA, 32 nt, Human
caaagugugcagcuguaacugcucacgccaaa

SEQ ID NO: 75207 - RNA, 32 nt, Human
caaaguguggaagccagggcccagggaaggca

SEQ ID NO: 75208 - RNA, 32 nt, Human
caaaguguggaagguuggaggaaaugcacaaa

SEQ ID NO: 75209 - RNA, 32 nt, Human
caaaguguggugaccuagaugucaucuuugaa

SEQ ID NO: 75210 - RNA, 32 nt, Human
caaaguguguaaaagauuguuuugaaacguac

SEQ ID NO: 75211 - RNA, 32 nt, Human
caaaguguguggugugagagaggugugacagg

SEQ ID NO: 75212 - RNA, 23 nt, Human
caaaguguuaggauuacaggcau

SEQ ID NO: 75213 - RNA, 23 nt, Human
caaaguguuaggauuacaggcgu

SEQ ID NO: 75214 - RNA, 32 nt, Human
caaaguguuauuuuguuuuuccuuccaauguc

SEQ ID NO: 75215 - RNA, 32 nt, Human
caaaguguugacuguauggcauucaaagggau

SEQ ID NO: 75216 - RNA, 21 nt, Human
caaaguguugagacuacaggc

SEQ ID NO: 75217 - RNA, 23 nt, Human
caaaguguugagaucacaggcgu

SEQ ID NO: 75218 - RNA, 23 nt, Human
caaaguguugagauuacaggcau

SEQ ID NO: 75219 - RNA, 23 nt, Human
caaaguguugagauuacaggcgu

SEQ ID NO: 75220 - RNA, 23 nt, Human
caaaguguugcuuucuuacauuu

SEQ ID NO: 75221 - RNA, 23 nt, Human
caaaguguuggaauuacaggcgu

SEQ ID NO: 75222 - RNA, 23 nt, Human
caaaguguugggauuacagacau

SEQ ID NO: 75223 - RNA, 23 nt, Human
caaaguguugggauuacaggcau

SEQ ID NO: 75224 - RNA, 23 nt, Human
caaaguguugggauuacaggcgu

SEQ ID NO: 75225 - RNA, 23 nt, Human
caaaguguugggauuauaggcau

SEQ ID NO: 75226 - RNA, 23 nt, Human
caaaguguugggauugcaggcau

SEQ ID NO: 75227 - RNA, 32 nt, Human
caaaguguuguugcuggcccugggcuugugug

SEQ ID NO: 75228 - RNA, 32 nt, Human
caaaguguuuauguaguaguucuguccuuuug

SEQ ID NO: 75229 - RNA, 32 nt, Human
caaaguuaaauaccccaucuuccuuggcugug

SEQ ID NO: 75230 - RNA, 32 nt, Human
caaaguuaaucaggacccaagucugcuucugu

SEQ ID NO: 75231 - RNA, 32 nt, Human
caaaguuaaucaggagccaagucugcuucugu

SEQ ID NO: 75232 - RNA, 32 nt, Human
caaaguuauuguggcuucuggugaggggaagu

SEQ ID NO: 75233 - RNA, 32 nt, Human
caaaguucagggacucuggaccauuuucccaa

SEQ ID NO: 75234 - RNA, 23 nt, Human
caaaguucagggauuacaggcau

SEQ ID NO: 75235 - RNA, 32 nt, Human
caaaguucagggauuacaggcaugagccacca

SEQ ID NO: 75236 - RNA, 32 nt, Human
caaaguuccccgauggcggcccaggggugcgc

SEQ ID NO: 75237 - RNA, 32 nt, Human
caaaguucuauugugcugaauaaaugccccuu

SEQ ID NO: 75238 - RNA, 21 nt, Human
caaaguucugggauuacaggc

SEQ ID NO: 75239 - RNA, 23 nt, Human
caaaguucugggauuacaggcau

SEQ ID NO: 75240 - RNA, 23 nt, Human
caaaguucugggauuacaggcgu

SEQ ID NO: 75241 - RNA, 32 nt, Human
caaaguugaagggacaaggcacugugagggga

SEQ ID NO: 75242 - RNA, 32 nt, Human
caaaguugccaagaacguacacugggggaaag

SEQ ID NO: 75243 - RNA, 16 nt, Human
caaaguugcuggcaga

SEQ ID NO: 75244 - RNA, 32 nt, Human
caaaguuggacagcuacugagauaggguauug

SEQ ID NO: 75245 - RNA, 32 nt, Human
caaaguuggaccugggcuugagcuuacagaca

SEQ ID NO: 75246 - RNA, 15 nt, Human
caaaguuguccagug

SEQ ID NO: 75247 - RNA, 32 nt, Human
caaaguugugcaaaacugguaacgucugcuuc

SEQ ID NO: 75248 - RNA, 32 nt, Human
caaaguuucauggaggccaggagaucuucugu

SEQ ID NO: 75249 - RNA, 32 nt, Human
caaaguuuccuuccuuucuucucuuucuucau

SEQ ID NO: 75250 - RNA, 32 nt, Human
caaaguuucugaguuauucuguggggaauuug

SEQ ID NO: 75251 - RNA, 32 nt, Human
caaaguuugaggcuauuucuccuaauucagga

SEQ ID NO: 75252 - RNA, 32 nt, Human
caaaguuuguugaauaaagcaacuuuuguaga

SEQ ID NO: 75253 - RNA, 29 nt, Human
caaauaaaaagcuuucuuugcacaaccca

SEQ ID NO: 75254 - RNA, 32 nt, Human
caaauaaaacucaaaugagagucaguucuuug

SEQ ID NO: 75255 - RNA, 32 nt, Human
caaauaaacccagcaaaggaacuagcagagcu

SEQ ID NO: 75256 - RNA, 22 nt, Human
caaauaaaccccuggacccccu

SEQ ID NO: 75257 - RNA, 32 nt, Human
caaauaaagaagcagacacuuaggcugggaaa

SEQ ID NO: 75258 - RNA, 32 nt, Human
caaauaaagcacugcauuuccaccauagacuu

SEQ ID NO: 75259 - RNA, 32 nt, Human
caaauaaaggcauuccucugagaguauaccua

SEQ ID NO: 75260 - RNA, 32 nt, Human
caaauaaauggcuucaaaauuguaugcuuuuu

SEQ ID NO: 75261 - RNA, 32 nt, Human
caaauaaccaccaguaucuccaccccacgaag

SEQ ID NO: 75262 - RNA, 32 nt, Human
caaauaaccauuuaacacuaguauuuguuaaa

SEQ ID NO: 75263 - RNA, 32 nt, Human
caaauaaccuaaaaaucaaucacuugaaagug

SEQ ID NO: 75264 - RNA, 32 nt, Human
caaauaagagccucuuauaaacuccauucuug

SEQ ID NO: 75265 - RNA, 32 nt, Human
caaauaagcauucuauuuccagcaaaacuauc

SEQ ID NO: 75266 - RNA, 32 nt, Human
caaauaagccgugcuacaguacuuucaugacc

SEQ ID NO: 75267 - RNA, 32 nt, Human
caaauaaggaagggggaagggggaugugaguu

SEQ ID NO: 75268 - RNA, 32 nt, Human
caaauaaggcacuggggcaugggguaggggug

SEQ ID NO: 75269 - RNA, 32 nt, Human
caaauaagggcugaggcgccuggaggucuuug

SEQ ID NO: 75270 - RNA, 31 nt, Human
caaauaaggguccccuccucacuggagacua

SEQ ID NO: 75271 - RNA, 32 nt, Human
caaauaagucucacauccagccauuccccuga

SEQ ID NO: 75272 - RNA, 32 nt, Human
caaauaaguuuccugagggcuggaauuaugcc

SEQ ID NO: 75273 - RNA, 32 nt, Human
caaauaauaacaaagcauuaccaccuuguguc

SEQ ID NO: 75274 - RNA, 24 nt, Human
caaauaauauguuuccuucccuca

SEQ ID NO: 75275 - RNA, 24 nt, Human
caaauaaugaagaucucuccuuca

SEQ ID NO: 75276 - RNA, 32 nt, Human
caaauaaugcacagaaaaaugcagccuauaau

SEQ ID NO: 75277 - RNA, 32 nt, Human
caaauaauggauuccugagagcucaggaagua

SEQ ID NO: 75278 - RNA, 32 nt, Human
caaauaauuucuaagauaaaagccugaauuug

SEQ ID NO: 75279 - RNA, 32 nt, Human
caaauaauuuucuccccuugcucuuccuggcc

SEQ ID NO: 75280 - RNA, 32 nt, Human
caaauacaacagcauggaagaugccaaagucu

SEQ ID NO: 75281 - RNA, 32 nt, Human
caaauacaagagguucauauaaaagggcaaau

SEQ ID NO: 75282 - RNA, 32 nt, Human
caaauacaagaugccagcguggccaauggggc

SEQ ID NO: 75283 - RNA, 32 nt, Human
caaauacagauaaaugguaauucuuagaauga

SEQ ID NO: 75284 - RNA, 32 nt, Human
caaauacauccacuccccaugccacugacauc

SEQ ID NO: 75285 - RNA, 32 nt, Human
caaauacauuuuauaaaugauuuuggaauuag

SEQ ID NO: 75286 - RNA, 32 nt, Human
caaauaccagcuacugugccagaagagaucau

SEQ ID NO: 75287 - RNA, 32 nt, Human
caaauaccaguggcuccagcccagucauucau

SEQ ID NO: 75288 - RNA, 32 nt, Human
caaauacccaagcuugaaaccugugacuuauu

SEQ ID NO: 75289 - RNA, 32 nt, Human
caaauaccccucuguacaguuaaucuaacagg

SEQ ID NO: 75290 - RNA, 25 nt, Human
caaauacgggcauuuacacuuucag

SEQ ID NO: 75291 - RNA, 32 nt, Human
caaauacuaauguauuugcuuccccuucauaa

SEQ ID NO: 75292 - RNA, 32 nt, Human
caaauacuacagccaccaaggccauagccugu

SEQ ID NO: 75293 - RNA, 32 nt, Human
caaauacuacaggcccuuaaagcacagucuga

SEQ ID NO: 75294 - RNA, 32 nt, Human
caaauacugugugaucucguauauggaaccua

SEQ ID NO: 75295 - RNA, 32 nt, Human
caaauacuuaaucucaauuuauuugagauuuu

SEQ ID NO: 75296 - RNA, 32 nt, Human
caaauacuucaugagcuuagcagccugggcuc

SEQ ID NO: 75297 - RNA, 32 nt, Human
caaauacuucccuuacccauguuaucauuucc

SEQ ID NO: 75298 - RNA, 32 nt, Human
caaauacuucuuggcccuggcccugugcugcc

SEQ ID NO: 75299 - RNA, 32 nt, Human
caaauacuugauacaagauuuaauuucauuau

SEQ ID NO: 75300 - RNA, 32 nt, Human
caaauacuugcaaguuagaggcuggcaggggg

SEQ ID NO: 75301 - RNA, 21 nt, Human
caaauacuuucacucccuuca

SEQ ID NO: 75302 - RNA, 32 nt, Human
caaauagagugacccguaaaaucuaggauuuu

SEQ ID NO: 75303 - RNA, 32 nt, Human
caaauagcagcaaagucaaaagcagauguagc

SEQ ID NO: 75304 - RNA, 32 nt, Human
caaauagcaucagcaacaacaaauagaauaau

SEQ ID NO: 75305 - RNA, 32 nt, Human
caaauagccaggcccucucucccucaagaaau

SEQ ID NO: 75306 - RNA, 32 nt, Human
caaauagccugaggaagcaggagaguuccugg

SEQ ID NO: 75307 - RNA, 32 nt, Human
caaauagcucuuccccaccuccucauuuuagu

SEQ ID NO: 75308 - RNA, 32 nt, Human
caaauagcuggcuuucguugcuuguugaauga

SEQ ID NO: 75309 - RNA, 19 nt, Human
caaauaggaaccucugaug

SEQ ID NO: 75310 - RNA, 32 nt, Human
caaauaggaacuuaauucucagcacugaacau

SEQ ID NO: 75311 - RNA, 32 nt, Human
caaauaggcaugccucacacacacaguccaaa

SEQ ID NO: 75312 - RNA, 32 nt, Human
caaauaggucagcuccaccuggagugcgaauu

SEQ ID NO: 75313 - RNA, 32 nt, Human
caaauaguaaagggaaaaagccaaaauucaga

SEQ ID NO: 75314 - RNA, 32 nt, Human
caaauaguccugguucauucccagaagggcac

SEQ ID NO: 75315 - RNA, 32 nt, Human
caaauagugccaucugccccaguagaagauag

SEQ ID NO: 75316 - RNA, 32 nt, Human
caaauaguguuuuggcaucauggaacguguag

SEQ ID NO: 75317 - RNA, 22 nt, Human
caaauaguugggauuacaggca

SEQ ID NO: 75318 - RNA, 32 nt, Human
caaauauacaguaucugcuauuauaggaaaca

SEQ ID NO: 75319 - RNA, 32 nt, Human
caaauauacaugcacauacauacacagaaugc

SEQ ID NO: 75320 - RNA, 32 nt, Human
caaauaucaguagcuuaauuuaauauugcacg

SEQ ID NO: 75321 - RNA, 32 nt, Human
caaauauccuaucacugccagcaauaauuuau

SEQ ID NO: 75322 - RNA, 32 nt, Human
caaauaucgugccuuaacaauguggcuguccu

SEQ ID NO: 75323 - RNA, 32 nt, Human
caaauaucucuagacucacccagaucccagcu

SEQ ID NO: 75324 - RNA, 32 nt, Human
caaauaugcccuuuccagagcuacccagacca

SEQ ID NO: 75325 - RNA, 32 nt, Human
caaauauggaaacugagaaucccuaaggauua

SEQ ID NO: 75326 - RNA, 32 nt, Human
caaauauguggaauuaccacacucugcuuagu

SEQ ID NO: 75327 - RNA, 32 nt, Human
caaauaugugggguguaaauauuuugugguuc

SEQ ID NO: 75328 - RNA, 32 nt, Human
caaauauuaugugccugcugugugcugacuau

SEQ ID NO: 75329 - RNA, 32 nt, Human
caaauauucucccauaugaaugugauauuuuu

SEQ ID NO: 75330 - RNA, 32 nt, Human
caaauauuuaaugcccucagugggaaauuugu

SEQ ID NO: 75331 - RNA, 32 nt, Human
caaauauuucacccuuucuuccuugcccugcu

SEQ ID NO: 75332 - RNA, 32 nt, Human
caaauauuugagcucuggaguuugagaccagc

SEQ ID NO: 75333 - RNA, 32 nt, Human
caaauauuuucucaaguucuauagguugccuu

SEQ ID NO: 75334 - RNA, 32 nt, Human
caaauauuuuucuccccuugcucuuccuggcc

SEQ ID NO: 75335 - RNA, 32 nt, Human
caaaucaaacuaagaagaccuuagaaauaagc

SEQ ID NO: 75336 - RNA, 32 nt, Human
caaaucaacuguugaagaaggggugaguuuuc

SEQ ID NO: 75337 - RNA, 32 nt, Human
caaaucaagaccaccuuucuucaacggucacu

SEQ ID NO: 75338 - RNA, 32 nt, Human
caaaucacaaaggagaugguguggcuuagcaa

SEQ ID NO: 75339 - RNA, 23 nt, Human
caaaucacugggauuauaggcau

SEQ ID NO: 75340 - RNA, 32 nt, Human
caaaucagcgaagauucugaaaggacuggugg

SEQ ID NO: 75341 - RNA, 32 nt, Human
caaaucaggccugccuccugaauuuguaaaua

SEQ ID NO: 75342 - RNA, 32 nt, Human
caaaucaguuuuucucuuucuuacucccucuc

SEQ ID NO: 75343 - RNA, 32 nt, Human
caaaucauauaucagucugcucaguugaaacc

SEQ ID NO: 75344 - RNA, 32 nt, Human
caaaucaucauuucucccaggaauggggugcc

SEQ ID NO: 75345 - RNA, 32 nt, Human
caaaucaucugucauaugaggcugccaccucg

SEQ ID NO: 75346 - RNA, 32 nt, Human
caaaucaucugucuucuggaaaaucauggauu

SEQ ID NO: 75347 - RNA, 32 nt, Human
caaaucaugucaccaagcuucaagccauggag

SEQ ID NO: 75348 - RNA, 32 nt, Human
caaaucauugacuugcugugaugugacuaauu

SEQ ID NO: 75349 - RNA, 32 nt, Human
caaauccaagcacccagagaucaauugggauc

SEQ ID NO: 75350 - RNA, 32 nt, Human
caaauccacugcagauuaggggugauagucac

SEQ ID NO: 75351 - RNA, 32 nt, Human
caaauccagaagcaaagagauaguaggaccca

SEQ ID NO: 75352 - RNA, 32 nt, Human
caaauccagacuccaggcuccucccacugcca

SEQ ID NO: 75353 - RNA, 32 nt, Human
caaauccagagcagccuguggccuguaaagca

SEQ ID NO: 75354 - RNA, 32 nt, Human
caaauccagcucccugcuuguuuuuauaaaua

SEQ ID NO: 75355 - RNA, 32 nt, Human
caaauccagcuccuuguccuagcagguucuca

SEQ ID NO: 75356 - RNA, 20 nt, Human
caaauccaguccugcaggcu

SEQ ID NO: 75357 - RNA, 32 nt, Human
caaauccaguguuaacacauauuucuggcuga

SEQ ID NO: 75358 - RNA, 32 nt, Human
caaauccauacagugaggaaucagaguguuua

SEQ ID NO: 75359 - RNA, 32 nt, Human
caaauccaucagcauaaugacuguguguucug

SEQ ID NO: 75360 - RNA, 32 nt, Human
caaauccaucccucucucccucacaguuccag

SEQ ID NO: 75361 - RNA, 32 nt, Human
caaauccauuccugccuucuggcucucagaau

SEQ ID NO: 75362 - RNA, 32 nt, Human
caaaucccaaguggcgauggcauguaaccaca

SEQ ID NO: 75363 - RNA, 28 nt, Human
caaaucccaaguguugacacagccaucu

SEQ ID NO: 75364 - RNA, 32 nt, Human
caaaucccaaguguugacacagccaucuuguc

SEQ ID NO: 75365 - RNA, 32 nt, Human
caaaucccauugucaccuaacucugaagaucu

SEQ ID NO: 75366 - RNA, 32 nt, Human
caaaucccgcagcugccacggucccuccuguc

SEQ ID NO: 75367 - RNA, 32 nt, Human
caaaucccugcucucacgggaucucuggagau

SEQ ID NO: 75368 - RNA, 32 nt, Human
caaaucccuuugguuuuccaugggaucuggaa

SEQ ID NO: 75369 - RNA, 32 nt, Human
caaauccuccugcccauaccgugcacccuuag

SEQ ID NO: 75370 - RNA, 32 nt, Human
caaauccugauuuugaccccaguggcccagcc

SEQ ID NO: 75371 - RNA, 32 nt, Human
caaauccugccaggcugccuggcaucccuggg

SEQ ID NO: 75372 - RNA, 32 nt, Human
caaauccugccccguuggcacagggccacagg

SEQ ID NO: 75373 - RNA, 32 nt, Human
caaauccugccugugcuccuugacugucucuc

SEQ ID NO: 75374 - RNA, 32 nt, Human
caaauccuuccagagggaaaguucuuuguuua

SEQ ID NO: 75375 - RNA, 32 nt, Human
caaauccuuccuuccucccagcaccccucgug

SEQ ID NO: 75376 - RNA, 32 nt, Human
caaauccuuuccuagugccuucagagggagug

SEQ ID NO: 75377 - RNA, 32 nt, Human
caaaucggggcagaggcugcacuugugccccc

SEQ ID NO: 75378 - RNA, 32 nt, Human
caaaucuacugaaccacuauucuacauauagu

SEQ ID NO: 75379 - RNA, 32 nt, Human
caaaucucccaaaacguugggauaugcuuacu

SEQ ID NO: 75380 - RNA, 32 nt, Human
caaaucuccuccuuccacaccugcugccaguc

SEQ ID NO: 75381 - RNA, 32 nt, Human
caaaucuccuuuuucuccuuuugccuucucug

SEQ ID NO: 75382 - RNA, 32 nt, Human
caaaucucuccucugccuucuccuuaucagac

SEQ ID NO: 75383 - RNA, 32 nt, Human
caaaucucugauccucccuuuccauugcuucu

SEQ ID NO: 75384 - RNA, 32 nt, Human
caaaucugaacccauguccucacuucaagguu

SEQ ID NO: 75385 - RNA, 32 nt, Human
caaaucugauguuaauguuugcucuuagaagu

SEQ ID NO: 75386 - RNA, 32 nt, Human
caaaucugccuacuucugucaauucaucaauc

SEQ ID NO: 75387 - RNA, 32 nt, Human
caaaucugccuguaauaaauauuuuuaaucua

SEQ ID NO: 75388 - RNA, 32 nt, Human
caaaucuggggugggaggggcuaggcugaccc

SEQ ID NO: 75389 - RNA, 32 nt, Human
caaaucuggugccucucucuugcuuacaaaug

SEQ ID NO: 75390 - RNA, 32 nt, Human
caaaucuguaaauacuacacugcucuuaagac

SEQ ID NO: 75391 - RNA, 32 nt, Human
caaaucugugcuggacaagcugugggaagcgu

SEQ ID NO: 75392 - RNA, 32 nt, Human
caaaucuuaccucuuuaggucacugaugguca

SEQ ID NO: 75393 - RNA, 32 nt, Human
caaaucuuccuuacugucucucuugucacaug

SEQ ID NO: 75394 - RNA, 32 nt, Human
caaaucuucuauggcucucuuuuuaauauaua

SEQ ID NO: 75395 - RNA, 32 nt, Human
caaaucuuucccuuauuucaaggcuuaguuca

SEQ ID NO: 75396 - RNA, 32 nt, Human
caaaugaaaacaauccagcacucugguuaaau

SEQ ID NO: 75397 - RNA, 32 nt, Human
caaaugaaaccugagaccagagacucauuuuc

SEQ ID NO: 75398 - RNA, 25 nt, Human
caaaugaaagcuauggaucuucuca

SEQ ID NO: 75399 - RNA, 32 nt, Human
caaaugaagguggggcggggcagugaggggug

SEQ ID NO: 75400 - RNA, 32 nt, Human
caaaugaaguggagauucaggagcagcaaugg

SEQ ID NO: 75401 - RNA, 32 nt, Human
caaaugaaugaacugcuuucugggcaaacagc

SEQ ID NO: 75402 - RNA, 32 nt, Human
caaaugaaugcagaauuuuagagucuugcuua

SEQ ID NO: 75403 - RNA, 32 nt, Human
caaaugacaacgugucuguccaggucuguccc

SEQ ID NO: 75404 - RNA, 32 nt, Human
caaaugacagaagugaucuugaauuauuuacu

SEQ ID NO: 75405 - RNA, 32 nt, Human
caaaugaccuuuggacagggaagggaggcagu

SEQ ID NO: 75406 - RNA, 32 nt, Human
caaaugacuauccugaacaggguggaggggug

SEQ ID NO: 75407 - RNA, 32 nt, Human
caaaugacuugucauuggcacuuucagucuuu

SEQ ID NO: 75408 - RNA, 32 nt, Human
caaaugagaauagaaggcaacaacauauagag

SEQ ID NO: 75409 - RNA, 32 nt, Human
caaaugagagaaagcaaagacccuaaggauga

SEQ ID NO: 75410 - RNA, 32 nt, Human
caaaugagagccugggcuuggugucgagggag

SEQ ID NO: 75411 - RNA, 32 nt, Human
caaaugagcaacaaaccaauacccauaaagac

SEQ ID NO: 75412 - RNA, 32 nt, Human
caaaugagcauucuaucuuuuggcuuucagag

SEQ ID NO: 75413 - RNA, 20 nt, Human
caaaugaggaaacugaggcu

SEQ ID NO: 75414 - RNA, 32 nt, Human
caaaugaggagagagaagaugagguuggacaa

SEQ ID NO: 75415 - RNA, 32 nt, Human
caaaugaggguuuggcaugcagcucgucaucu

SEQ ID NO: 75416 - RNA, 32 nt, Human
caaaugaggucagugugccucacuacagagcu

SEQ ID NO: 75417 - RNA, 32 nt, Human
caaaugagugccugaucaucaacucaggaaag

SEQ ID NO: 75418 - RNA, 32 nt, Human
caaaugauaguagucacauacacuacacacac

SEQ ID NO: 75419 - RNA, 32 nt, Human
caaaugaucagucucugucuccugggcccugc

SEQ ID NO: 75420 - RNA, 32 nt, Human
caaaugaucguucucacacucauauuagcuca

SEQ ID NO: 75421 - RNA, 19 nt, Human
caaaugaugccacuuccca

SEQ ID NO: 75422 - RNA, 32 nt, Human
caaaugaugguuccuaauacuucacauuagaa

SEQ ID NO: 75423 - RNA, 32 nt, Human
caaaugcaaaugcacacaaacccaugcauaca

SEQ ID NO: 75424 - RNA, 17 nt, Human
caaaugcaagcaucuuc

SEQ ID NO: 75425 - RNA, 32 nt, Human
caaaugcacacaaacccaugcauacacaagca

SEQ ID NO: 75426 - RNA, 32 nt, Human
caaaugcagaacuuggucuuuucauguuaaaa

SEQ ID NO: 75427 - RNA, 32 nt, Human
caaaugcaggcagaucugagaggggcuccagg

SEQ ID NO: 75428 - RNA, 32 nt, Human
caaaugcagggaggggaggcagauggagccca

SEQ ID NO: 75429 - RNA, 32 nt, Human
caaaugcaucauugcacuccagccugggugac

SEQ ID NO: 75430 - RNA, 32 nt, Human
caaaugcauuaccucacacgguugucauuuuu

SEQ ID NO: 75431 - RNA, 32 nt, Human
caaaugccaccuggugcugcgccccauccccg

SEQ ID NO: 75432 - RNA, 32 nt, Human
caaaugccacugccuggacugaaggccuuuca

SEQ ID NO: 75433 - RNA, 32 nt, Human
caaaugccaguucugccacugaagagcuggau

SEQ ID NO: 75434 - RNA, 32 nt, Human
caaaugcccaggaaauugacuuugcaguguca

SEQ ID NO: 75435 - RNA, 32 nt, Human
caaaugcccauguuggccuuuuacagcagugc

SEQ ID NO: 75436 - RNA, 32 nt, Human
caaaugccccugagagagcagcaguauacugg

SEQ ID NO: 75437 - RNA, 32 nt, Human
caaaugcccugagacgguucucuguucgauuu

SEQ ID NO: 75438 - RNA, 32 nt, Human
caaaugccugaggggcucaucgacgccuguga

SEQ ID NO: 75439 - RNA, 32 nt, Human
caaaugccuguaaucccagcacuuugggaggc

SEQ ID NO: 75440 - RNA, 32 nt, Human
caaaugccuguaaucccaguacuuugggaggc

SEQ ID NO: 75441 - RNA, 32 nt, Human
caaaugcuaguuccagcuaaaaacaaguacuu

SEQ ID NO: 75442 - RNA, 32 nt, Human
caaaugcuauguuugcaaaauguggcaucugu

SEQ ID NO: 75443 - RNA, 19 nt, Human
caaaugcucugugcucucu

SEQ ID NO: 75444 - RNA, 32 nt, Human
caaaugcugauggggaggcuggaagacggcag

SEQ ID NO: 75445 - RNA, 32 nt, Human
caaaugcuuagccaaucucuggagccgacaca

SEQ ID NO: 75446 - RNA, 32 nt, Human
caaaugcuuauuuugacuuacaacaagcuuac

SEQ ID NO: 75447 - RNA, 32 nt, Human
caaaugcuuccuggcccccaugcagcaacugc

SEQ ID NO: 75448 - RNA, 32 nt, Human
caaauggaagagagaaagugacacccagcccu

SEQ ID NO: 75449 - RNA, 32 nt, Human
caaauggaagugaaacaauaacaccucuauua

SEQ ID NO: 75450 - RNA, 32 nt, Human
caaauggacacacauaccuggccacgaaccca

SEQ ID NO: 75451 - RNA, 32 nt, Human
caaauggaccaauguccauuugcuuauuggag

SEQ ID NO: 75452 - RNA, 32 nt, Human
caaauggagcagaagaagucaaacaaagaaga

SEQ ID NO: 75453 - RNA, 32 nt, Human
caaauggaucagugacuacgcagacucugugc

SEQ ID NO: 75454 - RNA, 32 nt, Human
caaauggcaaggagcggucuugcuucaggcug

SEQ ID NO: 75455 - RNA, 32 nt, Human
caaauggcaagugggaggauuguuugagccca

SEQ ID NO: 75456 - RNA, 32 nt, Human
caaauggcagggagcugcugggggacugaccc

SEQ ID NO: 75457 - RNA, 32 nt, Human
caaauggcugagauggagguuuccuuuuggaa

SEQ ID NO: 75458 - RNA, 32 nt, Human
caaaugggagguguucuccuuuauauuguguu

SEQ ID NO: 75459 - RNA, 32 nt, Human
caaauggggauggugaucccugcccuuucuac

SEQ ID NO: 75460 - RNA, 32 nt, Human
caaauggggccagauccagccuggggucugga

SEQ ID NO: 75461 - RNA, 32 nt, Human
caaauggggcugggacuucucauuggccaacc

SEQ ID NO: 75462 - RNA, 32 nt, Human
caaauggggguuuauaaacaccuaccucgcag

SEQ ID NO: 75463 - RNA, 32 nt, Human
caaaugggguccaggucaccagccugacugca

SEQ ID NO: 75464 - RNA, 32 nt, Human
caaauggguggccuguguugaauggcuggccu

SEQ ID NO: 75465 - RNA, 32 nt, Human
caaaugguacuuuuccacaguguaccauuaaa

SEQ ID NO: 75466 - RNA, 32 nt, Human
caaaugguccuccugccucagccuucugaguc

SEQ ID NO: 75467 - RNA, 32 nt, Human
caaauggugaaugcucauccugccuggauuca

SEQ ID NO: 75468 - RNA, 32 nt, Human
caaauggugcacaaauuuuucuaggguuugua

SEQ ID NO: 75469 - RNA, 32 nt, Human
caaauggugggaccucaccuguucugaugggg

SEQ ID NO: 75470 - RNA, 31 nt, Human
caaaugguuaugucucccuucgagagaaaga

SEQ ID NO: 75471 - RNA, 32 nt, Human
caaaugguucauguggacacacaaaggcaaac

SEQ ID NO: 75472 - RNA, 32 nt, Human
caaaugguuguucaaaagauguauuaccauau

SEQ ID NO: 75473 - RNA, 32 nt, Human
caaauguacugaggcuggagccugugugaaca

SEQ ID NO: 75474 - RNA, 32 nt, Human
caaauguauaccuuugagaacagugccuucuc

SEQ ID NO: 75475 - RNA, 32 nt, Human
caaaugucaacagcaccgagguugagaacucu

SEQ ID NO: 75476 - RNA, 32 nt, Human
caaaugucaagaaggaugucagcugugaaugg

SEQ ID NO: 75477 - RNA, 32 nt, Human
caaaugucauuucccucuacugccucuuccug

SEQ ID NO: 75478 - RNA, 32 nt, Human
caaauguccaugucuaagaugaauauuuaacu

SEQ ID NO: 75479 - RNA, 32 nt, Human
caaauguccccaaagcaugucauuuuaguaau

SEQ ID NO: 75480 - RNA, 32 nt, Human
caaaugucccuaacuucauuuguuuucuaggc

SEQ ID NO: 75481 - RNA, 32 nt, Human
caaaugugaaacacuagggccaaucugagaug

SEQ ID NO: 75482 - RNA, 32 nt, Human
caaaugugaaguauuaauauuaucgcaguauu

SEQ ID NO: 75483 - RNA, 19 nt, Human
caaaugugaggggcugcuu

SEQ ID NO: 75484 - RNA, 32 nt, Human
caaaugugaguuuggaaagaaacuggacugga

SEQ ID NO: 75485 - RNA, 32 nt, Human
caaaugugaugcaugauccaggauauucuuuu

SEQ ID NO: 75486 - RNA, 30 nt, Human
caaaugugccucuccagacugcuccugcac

SEQ ID NO: 75487 - RNA, 32 nt, Human
caaauguguaccuguaaggaauuuguacuuuu

SEQ ID NO: 75488 - RNA, 28 nt, Human
caaauguguuuaaacacagaauggguug

SEQ ID NO: 75489 - RNA, 32 nt, Human
caaauguuaaaauaaaggaauaguuuauugcu

SEQ ID NO: 75490 - RNA, 32 nt, Human
caaauguucaggaagcacagggauggaaaccu

SEQ ID NO: 75491 - RNA, 28 nt, Human
caaauguuccagguauuuaagccacaug

SEQ ID NO: 75492 - RNA, 32 nt, Human
caaauguugggauuugaacccagguaguuggg

SEQ ID NO: 75493 - RNA, 32 nt, Human
caaauguuguuuuacuuccucacugucagccu

SEQ ID NO: 75494 - RNA, 32 nt, Human
caaauguuucaggcguacauacauaggcagaa

SEQ ID NO: 75495 - RNA, 32 nt, Human
caaauguuucugcaguagucucugugcuuuga

SEQ ID NO: 75496 - RNA, 32 nt, Human
caaauguuugcugacuccuacucugcgugacu

SEQ ID NO: 75497 - RNA, 32 nt, Human
caaauuaaaaccacaaugaggccaggcacagc

SEQ ID NO: 75498 - RNA, 32 nt, Human
caaauuaaaauguuaagcugcuggaagccuca

SEQ ID NO: 75499 - RNA, 32 nt, Human
caaauuaaacuggaaaaguauccagagucuca

SEQ ID NO: 75500 - RNA, 32 nt, Human
caaauuaaaggcagugaaacagaccuucaacc

SEQ ID NO: 75501 - RNA, 32 nt, Human
caaauuaaccucauacccagaaacccaucauc

SEQ ID NO: 75502 - RNA, 32 nt, Human
caaauuaacucauguaucauacuuuuaugucu

SEQ ID NO: 75503 - RNA, 32 nt, Human
caaauuacccauucucuuuuucuucagauuuu

SEQ ID NO: 75504 - RNA, 32 nt, Human
caaauuaccugacacagagcagacauucaaua

SEQ ID NO: 75505 - RNA, 32 nt, Human
caaauuacuggacugagguguccuccugccuc

SEQ ID NO: 75506 - RNA, 32 nt, Human
caaauuagaagugcuugagaugugacaugacc

SEQ ID NO: 75507 - RNA, 32 nt, Human
caaauuauaacugcaguuauuuuugcauggua

SEQ ID NO: 75508 - RNA, 32 nt, Human
caaauuauaggcagauuaccagguucuuauaa

SEQ ID NO: 75509 - RNA, 32 nt, Human
caaauuaugccuguuuuucuguaucuugcguu

SEQ ID NO: 75510 - RNA, 32 nt, Human
caaauuauuuuuccuuuuuccuuucuuucuug

SEQ ID NO: 75511 - RNA, 32 nt, Human
caaauucacagaagccuggagccuauauacca

SEQ ID NO: 75512 - RNA, 32 nt, Human
caaauucacagcuggugggccagacugguguu

SEQ ID NO: 75513 - RNA, 32 nt, Human
caaauucacccccauucuccacugcuuuucau

SEQ ID NO: 75514 - RNA, 32 nt, Human
caaauucagacucuugaggugaaaccaggaau

SEQ ID NO: 75515 - RNA, 32 nt, Human
caaauucccagcuccccacugagguguuguga

SEQ ID NO: 75516 - RNA, 32 nt, Human
caaauucccaggaguagaccagcaucucuggu

SEQ ID NO: 75517 - RNA, 32 nt, Human
caaauuccuaagccuccugggcacagagauca

SEQ ID NO: 75518 - RNA, 32 nt, Human
caaauuccugacuuacauuugcacuggcuucu

SEQ ID NO: 75519 - RNA, 32 nt, Human
caaauuccuggcucacugagcaucaaaagggg

SEQ ID NO: 75520 - RNA, 32 nt, Human
caaauucuccuugggccucaggcaaauaguuu

SEQ ID NO: 75521 - RNA, 32 nt, Human
caaauucugcagcugucugcugcucuaaagag

SEQ ID NO: 75522 - RNA, 32 nt, Human
caaauucugccacuccagcuccuggguuaggg

SEQ ID NO: 75523 - RNA, 32 nt, Human
caaauucuggcugcgggucucagaaccgagug

SEQ ID NO: 75524 - RNA, 32 nt, Human
caaauucugguuccuuucaccuauguaaccgc

SEQ ID NO: 75525 - RNA, 32 nt, Human
caaauucuuugaucuucucuuccaccucucug

SEQ ID NO: 75526 - RNA, 21 nt, Human
caaauugagaaaaagucacag

SEQ ID NO: 75527 - RNA, 32 nt, Human
caaauugagauuguugccacugugguuugcca

SEQ ID NO: 75528 - RNA, 32 nt, Human
caaauugagguggaggugggcgguucaguauc

SEQ ID NO: 75529 - RNA, 32 nt, Human
caaauugcagggaggggagggagcgagggcca

SEQ ID NO: 75530 - RNA, 32 nt, Human
caaauugccagucaccucuuugucucucucuu

SEQ ID NO: 75531 - RNA, 32 nt, Human
caaauugccauccugagggguucaacagggaa

SEQ ID NO: 75532 - RNA, 32 nt, Human
caaauugcccaagguuacacagcuggucagua

SEQ ID NO: 75533 - RNA, 32 nt, Human
caaauugcccuuuaacugcaccugaauccuuu

SEQ ID NO: 75534 - RNA, 23 nt, Human
caaauugccgggauuacaggcau

SEQ ID NO: 75535 - RNA, 23 nt, Human
caaauugcugggauuacaggcau

SEQ ID NO: 75536 - RNA, 23 nt, Human
caaauugcugggauuccaggcau

SEQ ID NO: 75537 - RNA, 24 nt, Human
caaauugcugggauuuacaggcau

SEQ ID NO: 75538 - RNA, 32 nt, Human
caaauuggaaaccauguugaagagcuccaguu

SEQ ID NO: 75539 - RNA, 32 nt, Human
caaauugggaaugacuuaaugucaauuuguuu

SEQ ID NO: 75540 - RNA, 32 nt, Human
caaauuguccccaagccuauauguauuaaaau

SEQ ID NO: 75541 - RNA, 32 nt, Human
caaauugucugucauucaaauuauaacugcag

SEQ ID NO: 75542 - RNA, 32 nt, Human
caaauugugaagaucaaauguguguuaagaaa

SEQ ID NO: 75543 - RNA, 32 nt, Human
caaauugugcuuaaaaggaagcuacuaauaag

SEQ ID NO: 75544 - RNA, 32 nt, Human
caaauuguuuuucucaugaaugacaucuacuu

SEQ ID NO: 75545 - RNA, 32 nt, Human
caaauuuaaagauaucuuucuccucuugauca

SEQ ID NO: 75546 - RNA, 32 nt, Human
caaauuuauaaauauuugcuuacaguuuuccu

SEQ ID NO: 75547 - RNA, 32 nt, Human
caaauuuauuggcauuuaauauuggacaucug

SEQ ID NO: 75548 - RNA, 23 nt, Human
caaauuucagaucguguuuccaa

SEQ ID NO: 75549 - RNA, 32 nt, Human
caaauuucauacaaucauauuucccaguacuu

SEQ ID NO: 75550 - RNA, 32 nt, Human
caaauuucauuucccauucuguugcuugccuu

SEQ ID NO: 75551 - RNA, 16 nt, Human
caaauuucugauguca

SEQ ID NO: 75552 - RNA, 32 nt, Human
caaauuucuguucuacaagcauguuguguggc

SEQ ID NO: 75553 - RNA, 32 nt, Human
caaauuugaauggauuaaauggcaccuguaua

SEQ ID NO: 75554 - RNA, 31 nt, Human
caaauuugacuucuuugcagaaaagggaggg

SEQ ID NO: 75555 - RNA, 32 nt, Human
caaauuugcaucccggagguugaaguuggagu

SEQ ID NO: 75556 - RNA, 32 nt, Human
caaauuugcgccacugcauucuagccugagug

SEQ ID NO: 75557 - RNA, 32 nt, Human
caaauuugcuugauuauaauagaacuguagaa

SEQ ID NO: 75558 - RNA, 32 nt, Human
caaauuuggaccugccaccagcuccagagcuu

SEQ ID NO: 75559 - RNA, 32 nt, Human
caaauuuggugucuggugaggguccucuuccu

SEQ ID NO: 75560 - RNA, 32 nt, Human
caaauuugguuaguccuuggaucagagccugu

SEQ ID NO: 75561 - RNA, 32 nt, Human
caaauuuguaaugguugucacaugucacaugc

SEQ ID NO: 75562 - RNA, 32 nt, Human
caaauuuuaaaacugugucuguuguagucuau

SEQ ID NO: 75563 - RNA, 32 nt, Human
caaauuuuauuacuuugccaaaauuagcaaaa

SEQ ID NO: 75564 - RNA, 32 nt, Human
caaauuuucuaugcaaacuugccuccugcugu

SEQ ID NO: 75565 - RNA, 18 nt, Human
caaauuuuguagauaaca

SEQ ID NO: 75566 - RNA, 32 nt, Human
caaauuuuugcuucuagaauuuccuugggguc

SEQ ID NO: 75567 - RNA, 32 nt, Human
caacaaaaagaguguuucaaagcugcucaaug

SEQ ID NO: 75568 - RNA, 32 nt, Human
caacaaaaaggaggcaugagauucaggaagca

SEQ ID NO: 75569 - RNA, 32 nt, Human
caacaaaacuccugugauaccaugaagucuuc

SEQ ID NO: 75570 - RNA, 32 nt, Human
caacaaaagcagguugagauggggaagaugac

SEQ ID NO: 75571 - RNA, 32 nt, Human
caacaaaauacuagguaagucacugcagaccg

SEQ ID NO: 75572 - RNA, 32 nt, Human
caacaaacaaaugagcaacaaaccaauaccca

SEQ ID NO: 75573 - RNA, 32 nt, Human
caacaaacagcuacagacucaguggcuuccac

SEQ ID NO: 75574 - RNA, 32 nt, Human
caacaaacagcuacagacucaguggcuuccau

SEQ ID NO: 75575 - RNA, 32 nt, Human
caacaaacagggaaguaaaggaagagacacau

SEQ ID NO: 75576 - RNA, 32 nt, Human
caacaaacccugaagaguacugaagauuuaga

SEQ ID NO: 75577 - RNA, 32 nt, Human
caacaaaggauuauguccgaguauuuauuuuc

SEQ ID NO: 75578 - RNA, 32 nt, Human
caacaaaggcaaaugcugucaagaaguaggcu

SEQ ID NO: 75579 - RNA, 32 nt, Human
caacaaaggcuugaugcaccaggccugacuuu

SEQ ID NO: 75580 - RNA, 32 nt, Human
caacaaagguggcagcaguugaaggaagagau

SEQ ID NO: 75581 - RNA, 32 nt, Human
caacaaauagagucaaaagaagagaggcacag

SEQ ID NO: 75582 - RNA, 32 nt, Human
caacaaauagccacagaacguaggugugacac

SEQ ID NO: 75583 - RNA, 32 nt, Human
caacaaauccaagguccaacagccuggauuau

SEQ ID NO: 75584 - RNA, 32 nt, Human
caacaaauggugagcuggaacaugcccugucu

SEQ ID NO: 75585 - RNA, 32 nt, Human
caacaaauguuuguugagugacugagugaccc

SEQ ID NO: 75586 - RNA, 32 nt, Human
caacaaauuguacagcugcacacagaacaccu

SEQ ID NO: 75587 - RNA, 32 nt, Human
caacaacaacaacaaaacaauguucuugguuu

SEQ ID NO: 75588 - RNA, 32 nt, Human
caacaacaacaacaacaaaacaauguucuugg

SEQ ID NO: 75589 - RNA, 32 nt, Human
caacaacacacacgcacacacgcacacacaca

SEQ ID NO: 75590 - RNA, 32 nt, Human
caacaacagcagaguuguuaagaaaaaugaag

SEQ ID NO: 75591 - RNA, 32 nt, Human
caacaacagccgacccuccccgccccaccccc

SEQ ID NO: 75592 - RNA, 32 nt, Human
caacaacaggcacacaccaccaugcucaacua

SEQ ID NO: 75593 - RNA, 32 nt, Human
caacaaccaccacuacaccacacaugcuuaua

SEQ ID NO: 75594 - RNA, 32 nt, Human
caacaacccaagagaaucaacaggcagggauu

SEQ ID NO: 75595 - RNA, 32 nt, Human
caacaaccccgcacgagugcacugugagaccu

SEQ ID NO: 75596 - RNA, 32 nt, Human
caacaaccccuaaacaauuuauacauugaagc

SEQ ID NO: 75597 - RNA, 32 nt, Human
caacaaccucuuuggacucagcuccugccucu

SEQ ID NO: 75598 - RNA, 32 nt, Human
caacaacuauuuuuauuucauuuuucaugcac

SEQ ID NO: 75599 - RNA, 23 nt, Human
caacaacugaguuugcugucuca

SEQ ID NO: 75600 - RNA, 32 nt, Human
caacaacugcacuuuagaauaccagcagugaa

SEQ ID NO: 75601 - RNA, 32 nt, Human
caacaacugcagccaggcugggcagagcacuc

SEQ ID NO: 75602 - RNA, 32 nt, Human
caacaacugcagcucccaccagccugccaggc

SEQ ID NO: 75603 - RNA, 19 nt, Human
caacaacuugaagaccuca

SEQ ID NO: 75604 - RNA, 32 nt, Human
caacaacuuguccauggaggaggaauuucuca

SEQ ID NO: 75605 - RNA, 21 nt, Human
caacaacuuuuuugcccuccc

SEQ ID NO: 75606 - RNA, 32 nt, Human
caacaagaaauaccaauaacacacacagaaca

SEQ ID NO: 75607 - RNA, 32 nt, Human
caacaagaagaagaagaagucaggucagcaga

SEQ ID NO: 75608 - RNA, 32 nt, Human
caacaagaauacugcuguugacacuccagugg

SEQ ID NO: 75609 - RNA, 32 nt, Human
caacaagacccccagccuacauuucucagcuc

SEQ ID NO: 75610 - RNA, 32 nt, Human
caacaagauccuuaaugcagagcuagaggacu

SEQ ID NO: 75611 - RNA, 32 nt, Human
caacaagcacaguucugaucacuucuccagag

SEQ ID NO: 75612 - RNA, 22 nt, Human
caacaagcauugcuucccaaag

SEQ ID NO: 75613 - RNA, 32 nt, Human
caacaagcauuguucuaggaaccagggauacg

SEQ ID NO: 75614 - RNA, 32 nt, Human
caacaagcccuugagcccccagaaggagaccg

SEQ ID NO: 75615 - RNA, 32 nt, Human
caacaagcugucccucagggacccucaccugc

SEQ ID NO: 75616 - RNA, 32 nt, Human
caacaagcuugcugaagaagcugcauguagau

SEQ ID NO: 75617 - RNA, 32 nt, Human
caacaaggaacucaaggaaaauuuguaccugc

SEQ ID NO: 75618 - RNA, 32 nt, Human
caacaaggagagagucuguuuuucuuccuaaa

SEQ ID NO: 75619 - RNA, 32 nt, Human
caacaaggaucucauguuuugugggucagaga

SEQ ID NO: 75620 - RNA, 32 nt, Human
caacaaggcugugccugagcccaaagccacac

SEQ ID NO: 75621 - RNA, 32 nt, Human
caacaagggaaacuuuauuguucccguggggc

SEQ ID NO: 75622 - RNA, 19 nt, Human
caacaagggacaagacagg

SEQ ID NO: 75623 - RNA, 32 nt, Human
caacaaguacugcaagaaggagcucaguuacg

SEQ ID NO: 75624 - RNA, 32 nt, Human
caacaagucuccgggcaacaguguggucaaaa

SEQ ID NO: 75625 - RNA, 32 nt, Human
caacaaguggcgucugaacacgggacuucgac

SEQ ID NO: 75626 - RNA, 32 nt, Human
caacaaguuccucaucuucaucugaggccacc

SEQ ID NO: 75627 - RNA, 32 nt, Human
caacaaguuggcucuugagaauggcaguaaac

SEQ ID NO: 75628 - RNA, 32 nt, Human
caacaauacagaaacaaugucuucuuacuggc

SEQ ID NO: 75629 - RNA, 32 nt, Human
caacaauacuaccucacuacuacaucugugau

SEQ ID NO: 75630 - RNA, 32 nt, Human
caacaauagcaccuugaaaaucugcccuaaaa

SEQ ID NO: 75631 - RNA, 32 nt, Human
caacaauaggguggggagcuaaggggcaacag

SEQ ID NO: 75632 - RNA, 22 nt, Human
caacaaucagucaucaugggug

SEQ ID NO: 75633 - RNA, 32 nt, Human
caacaauccuuccagccaccugccucaacugc

SEQ ID NO: 75634 - RNA, 32 nt, Human
caacaaucuagaccuggugaucauucgagagc

SEQ ID NO: 75635 - RNA, 32 nt, Human
caacaaucuucauuguaaguucuguccuacag

SEQ ID NO: 75636 - RNA, 32 nt, Human
caacaaugaguaagccaucacacagaagaggg

SEQ ID NO: 75637 - RNA, 32 nt, Human
caacaaugauguccagugugugcugcugagug

SEQ ID NO: 75638 - RNA, 32 nt, Human
caacaaugcacaaggcaugcaucauuauucuc

SEQ ID NO: 75639 - RNA, 32 nt, Human
caacaauggacaccuccagagccuccagggga

SEQ ID NO: 75640 - RNA, 30 nt, Human
caacaauggccgcuccacagagucgcccca

SEQ ID NO: 75641 - RNA, 30 nt, Human
caacaaugggaauggaaaagacucauauca

SEQ ID NO: 75642 - RNA, 32 nt, Human
caacaauguccauuacucccccaaaccuccug

SEQ ID NO: 75643 - RNA, 32 nt, Human
caacaauuuaacauccagauuuuuaucuuaug

SEQ ID NO: 75644 - RNA, 32 nt, Human
caacaauuugggaggccaaggcaagcaaauca

SEQ ID NO: 75645 - RNA, 32 nt, Human
caacaauuugggaggcugaggcaggcagauca

SEQ ID NO: 75646 - RNA, 32 nt, Human
caacacaaagacacaggaagaaugggcugcag

SEQ ID NO: 75647 - RNA, 32 nt, Human
caacacaaccagcagagugacacauacuaucu

SEQ ID NO: 75648 - RNA, 32 nt, Human
caacacaaccagcagagugcacauacuaucua

SEQ ID NO: 75649 - RNA, 32 nt, Human
caacacaacccauggagauguccccuucucac

SEQ ID NO: 75650 - RNA, 32 nt, Human
caacacacacagacaaacacagccacacgcgc

SEQ ID NO: 75651 - RNA, 32 nt, Human
caacacacagaauuucagggaagaguucuccc

SEQ ID NO: 75652 - RNA, 32 nt, Human
caacacaccagugcaacaaagacucagcugcc

SEQ ID NO: 75653 - RNA, 32 nt, Human
caacacacccgacuaauuuuuguauuuuuagu

SEQ ID NO: 75654 - RNA, 32 nt, Human
caacacacccggcuaauuuuuguauuuguaga

SEQ ID NO: 75655 - RNA, 32 nt, Human
caacacacccggcuaauuuuuguauuuuuagu

SEQ ID NO: 75656 - RNA, 32 nt, Human
caacacaccuugcccaugcacaaggaaugaau

SEQ ID NO: 75657 - RNA, 16 nt, Human
caacacacgguccaca

SEQ ID NO: 75658 - RNA, 32 nt, Human
caacacagaaaaguccucugaagucacugaau

SEQ ID NO: 75659 - RNA, 32 nt, Human
caacacagacacacauaucccuucaaaaacuu

SEQ ID NO: 75660 - RNA, 32 nt, Human
caacacagaugguagcugcacagcuugcauca

SEQ ID NO: 75661 - RNA, 32 nt, Human
caacacagccugggccccagcucgcgggaccc

SEQ ID NO: 75662 - RNA, 32 nt, Human
caacacagcugaugcuggagccaggauuaaaa

SEQ ID NO: 75663 - RNA, 24 nt, Human
caacacaggagauuucuauaguua

SEQ ID NO: 75664 - RNA, 18 nt, Human
caacacaggagcgugccu

SEQ ID NO: 75665 - RNA, 32 nt, Human
caacacaggaggaucacuugagacuggaguuu

SEQ ID NO: 75666 - RNA, 32 nt, Human
caacacaggccacauuaacaccuucugcuaug

SEQ ID NO: 75667 - RNA, 32 nt, Human
caacacaggcugggcgcgguggcucacaccua

SEQ ID NO: 75668 - RNA, 32 nt, Human
caacacagggcuggagguucuacaacaggaaa

SEQ ID NO: 75669 - RNA, 32 nt, Human
caacacaguaagcccugcucccuucccugcuc

SEQ ID NO: 75670 - RNA, 32 nt, Human
caacacaguuugaacguggugaaacagggugu

SEQ ID NO: 75671 - RNA, 32 nt, Human
caacacauaauccucuccaacuggauuauaaa

SEQ ID NO: 75672 - RNA, 32 nt, Human
caacacauauacaaucaucucccaccucccaa

SEQ ID NO: 75673 - RNA, 32 nt, Human
caacacauggaccacacuuuauauagcacugu

SEQ ID NO: 75674 - RNA, 32 nt, Human
caacacauucucauuccugucauuaucaguug

SEQ ID NO: 75675 - RNA, 32 nt, Human
caacacauuugguguucacacuucuucaguaa

SEQ ID NO: 75676 - RNA, 19 nt, Human
caacaccaaaugcuggagg

SEQ ID NO: 75677 - RNA, 22 nt, Human
caacaccaacaccuccucucca

SEQ ID NO: 75678 - RNA, 32 nt, Human
caacaccaaugccccaaccuucccccacagcu

SEQ ID NO: 75679 - RNA, 32 nt, Human
caacaccacccucacacacuggcuccagcugc

SEQ ID NO: 75680 - RNA, 32 nt, Human
caacaccaccgccaccaccucccacaucccug

SEQ ID NO: 75681 - RNA, 32 nt, Human
caacaccacugccaccaccccucuuuuuaucc

SEQ ID NO: 75682 - RNA, 22 nt, Human
caacaccagagaccaggaucca

SEQ ID NO: 75683 - RNA, 32 nt, Human
caacaccagcagcagcagcagccccggcggcg

SEQ ID NO: 75684 - RNA, 32 nt, Human
caacaccaggaucagcuuugagaaccgggagg

SEQ ID NO: 75685 - RNA, 21 nt, Human
caacaccaggaugagguccca

SEQ ID NO: 75686 - RNA, 32 nt, Human
caacaccaucugccugggaguccuccugggcc

SEQ ID NO: 75687 - RNA, 32 nt, Human
caacaccauggacugaacacccacugggcuaa

SEQ ID NO: 75688 - RNA, 32 nt, Human
caacaccauggacugaacaccugcugggcucc

SEQ ID NO: 75689 - RNA, 32 nt, Human
caacacccaacaacaggaagaaaucucaaaau

SEQ ID NO: 75690 - RNA, 31 nt, Human
caacacccaaugucugcuccauaccaggacc

SEQ ID NO: 75691 - RNA, 32 nt, Human
caacaccccaccccucugccaaccgggguaug

SEQ ID NO: 75692 - RNA, 32 nt, Human
caacaccccagcaagguacacagccauccagg

SEQ ID NO: 75693 - RNA, 32 nt, Human
caacaccccgggcuguuucacaagcaaguggu

SEQ ID NO: 75694 - RNA, 32 nt, Human
caacaccccugcccaugcgcgggaggcugcag

SEQ ID NO: 75695 - RNA, 32 nt, Human
caacaccccugcccggccccugagcugccucc

SEQ ID NO: 75696 - RNA, 32 nt, Human
caacaccccugggaacggacucgcgucuccgc

SEQ ID NO: 75697 - RNA, 32 nt, Human
caacacccuccaccuuccccuccaugccaaua

SEQ ID NO: 75698 - RNA, 32 nt, Human
caacacccuccccacccagucuccccgccccc

SEQ ID NO: 75699 - RNA, 32 nt, Human
caacacccucuuuuggcccagcuccugcccag

SEQ ID NO: 75700 - RNA, 32 nt, Human
caacacccugcacuccugcuugcgccggcagc

SEQ ID NO: 75701 - RNA, 32 nt, Human
caacacccugcuggccucuuguggagccagau

SEQ ID NO: 75702 - RNA, 32 nt, Human
caacaccgcucuccacauuguacagagcuuca

SEQ ID NO: 75703 - RNA, 32 nt, Human
caacaccucacagauuauaauagaaaaagaaa

SEQ ID NO: 75704 - RNA, 32 nt, Human
caacaccuggcuuauuuuuguauuuuuagcag

SEQ ID NO: 75705 - RNA, 32 nt, Human
caacaccugggugacagagcaagaccccaucu

SEQ ID NO: 75706 - RNA, 32 nt, Human
caacaccuguaaucccagcaccuugcgaggcc

SEQ ID NO: 75707 - RNA, 21 nt, Human
caacaccuucccuccaucccu

SEQ ID NO: 75708 - RNA, 32 nt, Human
caacaccuuccuccaccaccauccuuacccag

SEQ ID NO: 75709 - RNA, 32 nt, Human
caacaccuugauguuggaugugaacugugagg

SEQ ID NO: 75710 - RNA, 32 nt, Human
caacaccuugggaggccaaggcaggcagauca

SEQ ID NO: 75711 - RNA, 32 nt, Human
caacacgaucacagcgcccggagaccugcgga

SEQ ID NO: 75712 - RNA, 32 nt, Human
caacacgcccccucuccauuguuuccacacuc

SEQ ID NO: 75713 - RNA, 32 nt, Human
caacacgcccggcuaauuuuucguauuuuuag

SEQ ID NO: 75714 - RNA, 32 nt, Human
caacacggugaaacccugucacuacuaaaauu

SEQ ID NO: 75715 - RNA, 32 nt, Human
caacacgugggagaggaggcgagcccacgggg

SEQ ID NO: 75716 - RNA, 32 nt, Human
caacacguguuucugugugcagcagaggccgu

SEQ ID NO: 75717 - RNA, 32 nt, Human
caacacguuuuccucucugagucccagcuaug

SEQ ID NO: 75718 - RNA, 32 nt, Human
caacacuaagcccaauuuaaacuguuauuuua

SEQ ID NO: 75719 - RNA, 32 nt, Human
caacacuacacuccagccugggcgacagagca

SEQ ID NO: 75720 - RNA, 32 nt, Human
caacacuccaucuucaaaugcuuagcgauaca

SEQ ID NO: 75721 - RNA, 32 nt, Human
caacacuccccagccuugcuucugccuaaccc

SEQ ID NO: 75722 - RNA, 32 nt, Human
caacacucuccgcuucccccagcacacacaca

SEQ ID NO: 75723 - RNA, 32 nt, Human
caacacucugaucagcaugcaggcgaggggca

SEQ ID NO: 75724 - RNA, 32 nt, Human
caacacucugugggucucuggcauuucuacac

SEQ ID NO: 75725 - RNA, 32 nt, Human
caacacugaaaccuccagaacaaaggcuguca

SEQ ID NO: 75726 - RNA, 23 nt, Human
caacacugacccgaugcugggug

SEQ ID NO: 75727 - RNA, 32 nt, Human
caacacugagcagaucuguucuuugagcuaaa

SEQ ID NO: 75728 - RNA, 22 nt, Human
caacacugagcaggcacucggu

SEQ ID NO: 75729 - RNA, 32 nt, Human
caacacugagcugagcugaggggugccaugga

SEQ ID NO: 75730 - RNA, 32 nt, Human
caacacugcacuccagccugggcgacagagca

SEQ ID NO: 75731 - RNA, 32 nt, Human
caacacugcacuccagccugggcgacagagug

SEQ ID NO: 75732 - RNA, 24 nt, Human
caacacugcacuccagccugggug

SEQ ID NO: 75733 - RNA, 32 nt, Human
caacacugcacuccagccugggugacagaguc

SEQ ID NO: 75734 - RNA, 32 nt, Human
caacacugccacuccagccugggugacagagc

SEQ ID NO: 75735 - RNA, 32 nt, Human
caacacugcucaccacacuauaacuccggagg

SEQ ID NO: 75736 - RNA, 32 nt, Human
caacacugcucaccacaguauagcuccagagg

SEQ ID NO: 75737 - RNA, 32 nt, Human
caacacugcucuucaugaugcugucuaugaua

SEQ ID NO: 75738 - RNA, 32 nt, Human
caacacugcugcccccuuuccucccagacucu

SEQ ID NO: 75739 - RNA, 32 nt, Human
caacacuggcucuugccucacucugaggauca

SEQ ID NO: 75740 - RNA, 32 nt, Human
caacacuguacuccagccugggcaacagaggg

SEQ ID NO: 75741 - RNA, 32 nt, Human
caacacuuacaagcucuacacagucugugagu

SEQ ID NO: 75742 - RNA, 32 nt, Human
caacacuucacagccucauuccugccuuuucu

SEQ ID NO: 75743 - RNA, 32 nt, Human
caacacuuccacugcuauaaccaccaagccac

SEQ ID NO: 75744 - RNA, 32 nt, Human
caacacuuucacccaaauggcuuaauguaaua

SEQ ID NO: 75745 - RNA, 32 nt, Human
caacacuuuccucugccauggcuuggaugccc

SEQ ID NO: 75746 - RNA, 32 nt, Human
caacacuuugggaagccaagggaggaggauca

SEQ ID NO: 75747 - RNA, 32 nt, Human
caacacuuugggaggacaggacagaucacuug

SEQ ID NO: 75748 - RNA, 32 nt, Human
caacacuuugggaggccaaggcaggcagaucg

SEQ ID NO: 75749 - RNA, 32 nt, Human
caacacuuugggaggccaaggcagguagauca

SEQ ID NO: 75750 - RNA, 32 nt, Human
caacacuuugggaggccgaggcaggcagguca

SEQ ID NO: 75751 - RNA, 32 nt, Human
caacacuuugggaggccgaggcaggcggagca

SEQ ID NO: 75752 - RNA, 32 nt, Human
caacacuuugggaggccgaggcaggcggauca

SEQ ID NO: 75753 - RNA, 32 nt, Human
caacacuuugggaggccgaggcaggcggauua

SEQ ID NO: 75754 - RNA, 32 nt, Human
caacacuuugggaggccgaggcgagcagauca

SEQ ID NO: 75755 - RNA, 32 nt, Human
caacacuuugggaggccgaggcgggcggauca

SEQ ID NO: 75756 - RNA, 32 nt, Human
caacacuuugggaggccgaggugggcggauca

SEQ ID NO: 75757 - RNA, 32 nt, Human
caacacuuugggaggcugaagcaggcagauug

SEQ ID NO: 75758 - RNA, 32 nt, Human
caacacuuugggaggcugagacaggagcaucu

SEQ ID NO: 75759 - RNA, 32 nt, Human
caacacuuugggaggcugaggaaggggcauca

SEQ ID NO: 75760 - RNA, 32 nt, Human
caacacuuugggaggcugaggcaggcagauca

SEQ ID NO: 75761 - RNA, 32 nt, Human
caacacuuugggaggcugaggcgggcagauca

SEQ ID NO: 75762 - RNA, 32 nt, Human
caacacuuugggaggcugaggugggcagauca

SEQ ID NO: 75763 - RNA, 32 nt, Human
caacacuuugggagguggaggcagguggauca

SEQ ID NO: 75764 - RNA, 32 nt, Human
caacagaaaguguggaggagaaacucuuggcc

SEQ ID NO: 75765 - RNA, 32 nt, Human
caacagaaaguuaaggaaggaaauggaaaaac

SEQ ID NO: 75766 - RNA, 32 nt, Human
caacagaaaugcaugaguaugugcaccaacag

SEQ ID NO: 75767 - RNA, 32 nt, Human
caacagaaauuauauuuuaauuucucauguga

SEQ ID NO: 75768 - RNA, 32 nt, Human
caacagaaauuuguuucucacaguucuggagg

SEQ ID NO: 75769 - RNA, 32 nt, Human
caacagaacuucacagugacacuggaccaggu

SEQ ID NO: 75770 - RNA, 32 nt, Human
caacagaagcaguugagucgucaucacuuuuc

SEQ ID NO: 75771 - RNA, 18 nt, Human
caacagaagcggcggcgg

SEQ ID NO: 75772 - RNA, 32 nt, Human
caacagaauggguuuccugaaacggauuugca

SEQ ID NO: 75773 - RNA, 32 nt, Human
caacagacaccaccugucaaagcugccuuuca

SEQ ID NO: 75774 - RNA, 32 nt, Human
caacagacagaaguacuuuguagagauugacu

SEQ ID NO: 75775 - RNA, 32 nt, Human
caacagacauccuccacauugugcacacuggu

SEQ ID NO: 75776 - RNA, 32 nt, Human
caacagaccauuauuccucuugaaguuaguuu

SEQ ID NO: 75777 - RNA, 32 nt, Human
caacagacgcagcugcaccugggacagcagac

SEQ ID NO: 75778 - RNA, 32 nt, Human
caacagacgugagccauuuucccagccuguuu

SEQ ID NO: 75779 - RNA, 32 nt, Human
caacagacuggacuucucaacugccauucugg

SEQ ID NO: 75780 - RNA, 32 nt, Human
caacagagagggagaaaccccagugcagcugc

SEQ ID NO: 75781 - RNA, 32 nt, Human
caacagagaucaugagacugaaauuggucaga

SEQ ID NO: 75782 - RNA, 32 nt, Human
caacagagaugaaaguguggcuuuuuaguuuu

SEQ ID NO: 75783 - RNA, 32 nt, Human
caacagagcagcaggggcuggggucuucuccu

SEQ ID NO: 75784 - RNA, 32 nt, Human
caacagagcuccugcugcuucugggugaaccu

SEQ ID NO: 75785 - RNA, 32 nt, Human
caacagaggacugucuuauuccacucuucggc

SEQ ID NO: 75786 - RNA, 32 nt, Human
caacagaggagccacaaaauguucuuuguucu

SEQ ID NO: 75787 - RNA, 32 nt, Human
caacagaggcaauaaaagcugcagugaaauug

SEQ ID NO: 75788 - RNA, 32 nt, Human
caacagagucagugcuaaucuagccaaauuac

SEQ ID NO: 75789 - RNA, 32 nt, Human
caacagagucuaggcuggguucaugacaugau

SEQ ID NO: 75790 - RNA, 32 nt, Human
caacagaugaagacagaugcaccaacgaggcu

SEQ ID NO: 75791 - RNA, 32 nt, Human
caacagaugaagacagaugcaccaacgagggu

SEQ ID NO: 75792 - RNA, 32 nt, Human
caacagaugcagaaccugggaaugacaucacc

SEQ ID NO: 75793 - RNA, 32 nt, Human
caacagaugccauucuggauggcucccuagga

SEQ ID NO: 75794 - RNA, 32 nt, Human
caacagaugcuggcgagguugcgaagaaauag

SEQ ID NO: 75795 - RNA, 32 nt, Human
caacagaugggcugggcugggcuguggugggg

SEQ ID NO: 75796 - RNA, 32 nt, Human
caacagauuuccaucagcaggaugugggggcu

SEQ ID NO: 75797 - RNA, 32 nt, Human
caacagcaacauacagaagauauguucacuca

SEQ ID NO: 75798 - RNA, 31 nt, Human
caacagcacagcuaaauuuccaagucgcaua

SEQ ID NO: 75799 - RNA, 32 nt, Human
caacagcacauccaacuuuuauuuaggaagac

SEQ ID NO: 75800 - RNA, 32 nt, Human
caacagcacccucuccagaugcagccccaucu

SEQ ID NO: 75801 - RNA, 32 nt, Human
caacagcacccugaagaaccuggaccugacag

SEQ ID NO: 75802 - RNA, 32 nt, Human
caacagcacugcccucugaggcugccaugauu

SEQ ID NO: 75803 - RNA, 32 nt, Human
caacagcagcuauuuuggggagcagcuguggc

SEQ ID NO: 75804 - RNA, 32 nt, Human
caacagcagggguaguggaggaagugugggcc

SEQ ID NO: 75805 - RNA, 32 nt, Human
caacagcagugguguccaugggcucuggagac

SEQ ID NO: 75806 - RNA, 31 nt, Human
caacagcaguuucauggaaccucucuuagcu

SEQ ID NO: 75807 - RNA, 32 nt, Human
caacagcauauguaauaugggaauguuuugua

SEQ ID NO: 75808 - RNA, 32 nt, Human
caacagcaucuuagaagaaauguagccaaauu

SEQ ID NO: 75809 - RNA, 32 nt, Human
caacagccaccugggccuggccuccccacugg

SEQ ID NO: 75810 - RNA, 32 nt, Human
caacagccacuugcccgccacauucaaggucu

SEQ ID NO: 75811 - RNA, 20 nt, Human
caacagccaggagcuuccug

SEQ ID NO: 75812 - RNA, 32 nt, Human
caacagccagggcuggaguccaggccacuuuc

SEQ ID NO: 75813 - RNA, 32 nt, Human
caacagccaucaggaguguuucuugaaugccc

SEQ ID NO: 75814 - RNA, 32 nt, Human
caacagccaucuuuucagcaguugccaaccug

SEQ ID NO: 75815 - RNA, 32 nt, Human
caacagccauguccgccugccuggugaacgag

SEQ ID NO: 75816 - RNA, 32 nt, Human
caacagccccacugcaagccugggauauccag

SEQ ID NO: 75817 - RNA, 32 nt, Human
caacagccccagcugugacccccaggcuucca

SEQ ID NO: 75818 - RNA, 32 nt, Human
caacagccccugugcguguccuccuucccgca

SEQ ID NO: 75819 - RNA, 32 nt, Human
caacagcccugccucuguucccucccaguuag

SEQ ID NO: 75820 - RNA, 32 nt, Human
caacagcccuguccacugugagcucugguguu

SEQ ID NO: 75821 - RNA, 32 nt, Human
caacagccuccaccgccaacucaacaaacuuc

SEQ ID NO: 75822 - RNA, 32 nt, Human
caacagccucuauccucauuugucccuuccuc

SEQ ID NO: 75823 - RNA, 32 nt, Human
caacagccucuggaggugaggcgggagcaugc

SEQ ID NO: 75824 - RNA, 32 nt, Human
caacagccugacagaagguucagucuauggag

SEQ ID NO: 75825 - RNA, 32 nt, Human
caacagccuuucagacuauucuucauauguuu

SEQ ID NO: 75826 - RNA, 32 nt, Human
caacagcguuuauugagcaccugcucugugcc

SEQ ID NO: 75827 - RNA, 32 nt, Human
caacagcucagcucuucauccugggcugcaca

SEQ ID NO: 75828 - RNA, 32 nt, Human
caacagcucaucugugaccaacagggcaacug

SEQ ID NO: 75829 - RNA, 32 nt, Human
caacagcucggagcagucccagaagggagggc

SEQ ID NO: 75830 - RNA, 21 nt, Human
caacagcucggccgccccucc

SEQ ID NO: 75831 - RNA, 32 nt, Human
caacagcugauagaagagaacagagacgcaca

SEQ ID NO: 75832 - RNA, 32 nt, Human
caacagcugcaaaauacacauucuucuccuag

SEQ ID NO: 75833 - RNA, 32 nt, Human
caacagcugcaugggccagcuguuucggaucu

SEQ ID NO: 75834 - RNA, 32 nt, Human
caacagcugccuggacccacucaucugcugcu

SEQ ID NO: 75835 - RNA, 32 nt, Human
caacagcugcugcagcugagggagcugagcug

SEQ ID NO: 75836 - RNA, 32 nt, Human
caacagcugggcuggagaguuggugcuggcaa

SEQ ID NO: 75837 - RNA, 32 nt, Human
caacagcuguaacccuuuccugagggccccga

SEQ ID NO: 75838 - RNA, 32 nt, Human
caacagcuucuuugaggacccaguggguaugg

SEQ ID NO: 75839 - RNA, 32 nt, Human
caacaggaagugaaccuuaaggaagagagaau

SEQ ID NO: 75840 - RNA, 32 nt, Human
caacaggaagugagacggauccagaucugugu

SEQ ID NO: 75841 - RNA, 32 nt, Human
caacaggaaugaggaaagaagaaaacuggagu

SEQ ID NO: 75842 - RNA, 32 nt, Human
caacaggaauugaaaaugaaucagaacacuac

SEQ ID NO: 75843 - RNA, 32 nt, Human
caacaggagaaugggguuccugcuguggggcg

SEQ ID NO: 75844 - RNA, 32 nt, Human
caacaggagaggaggaagcccgggaggcaacg

SEQ ID NO: 75845 - RNA, 32 nt, Human
caacaggaggaaaugaaggcagagaaauauag

SEQ ID NO: 75846 - RNA, 32 nt, Human
caacaggaucacaagcuggagaugccuuuaag

SEQ ID NO: 75847 - RNA, 32 nt, Human
caacaggaucugucacccaccucucucuucuc

SEQ ID NO: 75848 - RNA, 32 nt, Human
caacaggaugagagugccugagcugugacggg

SEQ ID NO: 75849 - RNA, 32 nt, Human
caacaggauuugucugcagcagccucugguac

SEQ ID NO: 75850 - RNA, 32 nt, Human
caacaggcaaauucagggaggauagguuucag

SEQ ID NO: 75851 - RNA, 32 nt, Human
caacaggcacccacugacuccagccucaugga

SEQ ID NO: 75852 - RNA, 32 nt, Human
caacaggccugacccagggcacugccucccca

SEQ ID NO: 75853 - RNA, 32 nt, Human
caacaggcuggagggagagggaagcaagacca

SEQ ID NO: 75854 - RNA, 18 nt, Human
caacagggaaacucuuca

SEQ ID NO: 75855 - RNA, 19 nt, Human
caacagggaaggcucuguc

SEQ ID NO: 75856 - RNA, 32 nt, Human
caacagggacggaaggagagaacuuaccccuu

SEQ ID NO: 75857 - RNA, 32 nt, Human
caacagggagcuaggccauugguucucaaacu

SEQ ID NO: 75858 - RNA, 31 nt, Human
caacagggcaaaggaagcaaucagcuaugca

SEQ ID NO: 75859 - RNA, 22 nt, Human
caacagggccccugcccuccug

SEQ ID NO: 75860 - RNA, 32 nt, Human
caacagggcgggaaucagaccuacuccccuag

SEQ ID NO: 75861 - RNA, 16 nt, Human
caacaggggucuguca

SEQ ID NO: 75862 - RNA, 32 nt, Human
caacagggucaccaagcagacagggagcccgc

SEQ ID NO: 75863 - RNA, 21 nt, Human
caacagggucaguuuugugca

SEQ ID NO: 75864 - RNA, 32 nt, Human
caacaggguuagcauggccagcacagaucgcu

SEQ ID NO: 75865 - RNA, 32 nt, Human
caacagguauaugaaaaagugcucaacaucac

SEQ ID NO: 75866 - RNA, 32 nt, Human
caacaggucaccagccuuguucaaguuacagc

SEQ ID NO: 75867 - RNA, 32 nt, Human
caacaggugcaggacugccagggaucggagug

SEQ ID NO: 75868 - RNA, 32 nt, Human
caacagguggagaaggaaagggagcuagagcu

SEQ ID NO: 75869 - RNA, 32 nt, Human
caacagguggugagaaaaauuauguuuuuauu

SEQ ID NO: 75870 - RNA, 32 nt, Human
caacagguuuuacuggucaaaaugacugcuga

SEQ ID NO: 75871 - RNA, 32 nt, Human
caacaguacaggugcacucacagcaugauggc

SEQ ID NO: 75872 - RNA, 32 nt, Human
caacagucaccucacaaaccugaauggucuga

SEQ ID NO: 75873 - RNA, 32 nt, Human
caacaguccuacuccgauguuaucuuucugau

SEQ ID NO: 75874 - RNA, 32 nt, Human
caacagucugcuccucagccugagauguucuu

SEQ ID NO: 75875 - RNA, 32 nt, Human
caacagucuucugguggcaguaguggcaugga

SEQ ID NO: 75876 - RNA, 32 nt, Human
caacagugaccuuccgaaacagccuucugaau

SEQ ID NO: 75877 - RNA, 32 nt, Human
caacagugaccuucugaaacagccuucugaau

SEQ ID NO: 75878 - RNA, 22 nt, Human
caacagugccuugcauguaaca

SEQ ID NO: 75879 - RNA, 31 nt, Human
caacagugcuguuucugacacuucagacauc

SEQ ID NO: 75880 - RNA, 32 nt, Human
caacaguggaauccauguaaaacucucugugc

SEQ ID NO: 75881 - RNA, 32 nt, Human
caacaguggggcagugccuccccgccgcgcug

SEQ ID NO: 75882 - RNA, 32 nt, Human
caacaguuaguggccagcauccuccugcugca

SEQ ID NO: 75883 - RNA, 32 nt, Human
caacaguuaucagcacucagacaugcgaaugu

SEQ ID NO: 75884 - RNA, 32 nt, Human
caacaguuccauggagccaagagggugcaggu

SEQ ID NO: 75885 - RNA, 32 nt, Human
caacaguuuccuuuuuguuuuccuuuauaauu

SEQ ID NO: 75886 - RNA, 32 nt, Human
caacaguuuuccuaugcuuugaaacagaaaaa

SEQ ID NO: 75887 - RNA, 32 nt, Human
caacauaaauccuccccaguugcccagguugu

SEQ ID NO: 75888 - RNA, 32 nt, Human
caacauaaguggauuagaagcccagggaagaa

SEQ ID NO: 75889 - RNA, 18 nt, Human
caacauacaguugggccu

SEQ ID NO: 75890 - RNA, 32 nt, Human
caacauacuggcuucguauuuuauuuaucuuu

SEQ ID NO: 75891 - RNA, 32 nt, Human
caacauagaagagggaaggaaagagagaagga

SEQ ID NO: 75892 - RNA, 32 nt, Human
caacauagguggugagccuggaggaagacuug

SEQ ID NO: 75893 - RNA, 32 nt, Human
caacauaguggcugucauuccucaaauggcaa

SEQ ID NO: 75894 - RNA, 32 nt, Human
caacauaguggcuuugaucucugugaugacac

SEQ ID NO: 75895 - RNA, 32 nt, Human
caacauaucucagguugucuaaguguuuuuau

SEQ ID NO: 75896 - RNA, 24 nt, Human
caacauaugcacuuuuuacauuua

SEQ ID NO: 75897 - RNA, 31 nt, Human
caacauaugcacuuuuuacauuuagaaacac

SEQ ID NO: 75898 - RNA, 32 nt, Human
caacauauuauccaggcuggugucgaauuccu

SEQ ID NO: 75899 - RNA, 32 nt, Human
caacaucaaaacccaaguccaggaguugcuaa

SEQ ID NO: 75900 - RNA, 32 nt, Human
caacaucaagccuggggcagguggaagguggu

SEQ ID NO: 75901 - RNA, 32 nt, Human
caacaucaaggccaccacagugaccacuaagc

SEQ ID NO: 75902 - RNA, 32 nt, Human
caacaucacacagcaaccaagggcagagucag

SEQ ID NO: 75903 - RNA, 32 nt, Human
caacaucacaccauugcacuccagccugggca

SEQ ID NO: 75904 - RNA, 32 nt, Human
caacaucacacugggcugugagauagggauuc

SEQ ID NO: 75905 - RNA, 32 nt, Human
caacaucacaugcacgcaugcccuuucacaca

SEQ ID NO: 75906 - RNA, 32 nt, Human
caacaucagacggguaugcagaaggauguucu

SEQ ID NO: 75907 - RNA, 32 nt, Human
caacaucaucacacuggcagacauuguaaaag

SEQ ID NO: 75908 - RNA, 32 nt, Human
caacaucaucuaagggcucucacggagggccu

SEQ ID NO: 75909 - RNA, 32 nt, Human
caacaucaucuugggagagaggcacagaccug

SEQ ID NO: 75910 - RNA, 32 nt, Human
caacauccaaguccaaacccuuuuuagguuau

SEQ ID NO: 75911 - RNA, 32 nt, Human
caacauccacacaggcugguacagucagauca

SEQ ID NO: 75912 - RNA, 32 nt, Human
caacauccauuucagcacuguaaagaacaaag

SEQ ID NO: 75913 - RNA, 31 nt, Human
caacaucccagcuagaagccugcugaacuag

SEQ ID NO: 75914 - RNA, 32 nt, Human
caacaucccuuuguuuucacagaggagaacaa

SEQ ID NO: 75915 - RNA, 21 nt, Human
caacauccugccagccccaca

SEQ ID NO: 75916 - RNA, 32 nt, Human
caacauccuggcuuaguauugugugcaaaauc

SEQ ID NO: 75917 - RNA, 32 nt, Human
caacaucuauccagcagcccugaccuccugcu

SEQ ID NO: 75918 - RNA, 31 nt, Human
caacaucucaauaaaacuuugaaagcaaaaa

SEQ ID NO: 75919 - RNA, 32 nt, Human
caacaucucgcaagcgcugcuguaacgacuuc

SEQ ID NO: 75920 - RNA, 32 nt, Human
caacaucucuaucaucccaaaaaguucucuug

SEQ ID NO: 75921 - RNA, 32 nt, Human
caacaucucugaguuggauugaugaaaauugu

SEQ ID NO: 75922 - RNA, 32 nt, Human
caacaucugaaggguauguugcaugcauuaaa

SEQ ID NO: 75923 - RNA, 32 nt, Human
caacaucugaaggguauguugcaugcauuuuu

SEQ ID NO: 75924 - RNA, 32 nt, Human
caacaucugaaucaugccaugugcccagagga

SEQ ID NO: 75925 - RNA, 32 nt, Human
caacaucugccagcaacgcgagaggccaagac

SEQ ID NO: 75926 - RNA, 32 nt, Human
caacaucugguaccagcacuccgcggcggggc

SEQ ID NO: 75927 - RNA, 32 nt, Human
caacaucuguaacucuuacaugaguguccaga

SEQ ID NO: 75928 - RNA, 20 nt, Human
caacaucugugcugauccug

SEQ ID NO: 75929 - RNA, 32 nt, Human
caacaucuucuccgaguccugcagccagccuc

SEQ ID NO: 75930 - RNA, 24 nt, Human
caacaugaaaccccgucucuacua

SEQ ID NO: 75931 - RNA, 21 nt, Human
caacaugaaccuaggcuguga

SEQ ID NO: 75932 - RNA, 32 nt, Human
caacaugaucaagguguuaguucuccaccaca

SEQ ID NO: 75933 - RNA, 32 nt, Human
caacaugaucacuguccuugccuuccugguuc

SEQ ID NO: 75934 - RNA, 22 nt, Human
caacaugauguacuugcugcuc

SEQ ID NO: 75935 - RNA, 32 nt, Human
caacaugcccagcuaauuuuuguauuuuuagu

SEQ ID NO: 75936 - RNA, 32 nt, Human
caacaugccuggcuaauuuuuguacuuuuagu

SEQ ID NO: 75937 - RNA, 32 nt, Human
caacaugccuggcucauuuuuguauuuuuagu

SEQ ID NO: 75938 - RNA, 32 nt, Human
caacaugccuuguuaauguccucugcccugaa

SEQ ID NO: 75939 - RNA, 32 nt, Human
caacaugcuagaaaauccucacugcacuccag

SEQ ID NO: 75940 - RNA, 32 nt, Human
caacauggcaaaaacccaccucuacaaaaagu

SEQ ID NO: 75941 - RNA, 19 nt, Human
caacauggcaaaacccugu

SEQ ID NO: 75942 - RNA, 32 nt, Human
caacauggcaaaacccugucucuacaaaauac

SEQ ID NO: 75943 - RNA, 19 nt, Human
caacauggcgaaacccugu

SEQ ID NO: 75944 - RNA, 32 nt, Human
caacauggcucugccaaaggaagccugugauc

SEQ ID NO: 75945 - RNA, 29 nt, Human
caacaugggaaagaaacggacaaagggaa

SEQ ID NO: 75946 - RNA, 32 nt, Human
caacaugggaggcugaacaggagaaucgcuug

SEQ ID NO: 75947 - RNA, 29 nt, Human
caacaugggccaggaagaggagcugcuga

SEQ ID NO: 75948 - RNA, 19 nt, Human
caacaugguaaaacccugu

SEQ ID NO: 75949 - RNA, 19 nt, Human
caacauggugaaacccugu

SEQ ID NO: 75950 - RNA, 19 nt, Human
caacauggugaaaccuugu

SEQ ID NO: 75951 - RNA, 32 nt, Human
caacauggugaaaucuugucucuaguaaaaau

SEQ ID NO: 75952 - RNA, 32 nt, Human
caacauggugaaaugaaaccccaucucaacua

SEQ ID NO: 75953 - RNA, 18 nt, Human
caacauggugaaccuugu

SEQ ID NO: 75954 - RNA, 32 nt, Human
caacauggugagaccaauugacuguagggcuu

SEQ ID NO: 75955 - RNA, 32 nt, Human
caacauguaggaucccuucacugugucacaug

SEQ ID NO: 75956 - RNA, 32 nt, Human
caacaugucuggcaccugucauguccuccaca

SEQ ID NO: 75957 - RNA, 32 nt, Human
caacaugucuggcuaauuuuuguauuuuuagu

SEQ ID NO: 75958 - RNA, 32 nt, Human
caacaugugcgaaacugagacagcauuagaaa

SEQ ID NO: 75959 - RNA, 32 nt, Human
caacauguuuucuccagcucuauuccaccaug

SEQ ID NO: 75960 - RNA, 32 nt, Human
caacauguuuugcuguaccuugcaguguuccg

SEQ ID NO: 75961 - RNA, 32 nt, Human
caacauuaaccagcaucccaguucucaggaga

SEQ ID NO: 75962 - RNA, 32 nt, Human
caacauuaauccauuaaagcuaaccuauuuuu

SEQ ID NO: 75963 - RNA, 31 nt, Human
caacauuacaaaggaaggaggagggaagaga

SEQ ID NO: 75964 - RNA, 32 nt, Human
caacauuacaggaagagaggagagaaagguag

SEQ ID NO: 75965 - RNA, 28 nt, Human
caacauucaaauucugccucaucuggag

SEQ ID NO: 75966 - RNA, 32 nt, Human
caacauucacgugccucuugcuuucuuucuga

SEQ ID NO: 75967 - RNA, 32 nt, Human
caacauucagcaaaacggaaacaaauaaauac

SEQ ID NO: 75968 - RNA, 32 nt, Human
caacauuccccaguauccccagcuucugcugc

SEQ ID NO: 75969 - RNA, 32 nt, Human
caacauuccgggacagggagaucauguuucac

SEQ ID NO: 75970 - RNA, 32 nt, Human
caacauuccuugcuugugcccugggccaaaac

SEQ ID NO: 75971 - RNA, 24 nt, Human
caacauucuguguucacaugugug

SEQ ID NO: 75972 - RNA, 32 nt, Human
caacauugaacccaggaggcggagcuugcagu

SEQ ID NO: 75973 - RNA, 32 nt, Human
caacauugcacuucagccuggugacaugagca

SEQ ID NO: 75974 - RNA, 28 nt, Human
caacauuggccaaagcugccucccagug

SEQ ID NO: 75975 - RNA, 32 nt, Human
caacauuggcuugaugugaucaucaucucaua

SEQ ID NO: 75976 - RNA, 32 nt, Human
caacauugugcaaccacuaccaaaaagugugu

SEQ ID NO: 75977 - RNA, 32 nt, Human
caacauuucccccugcugcuggcccagcacaa

SEQ ID NO: 75978 - RNA, 32 nt, Human
caacauuucucuaguagccacugcuugcggga

SEQ ID NO: 75979 - RNA, 32 nt, Human
caacauuuggacucaagcaucaacaccaaauu

SEQ ID NO: 75980 - RNA, 32 nt, Human
caacauuuggggagagauaaugaggcaacuca

SEQ ID NO: 75981 - RNA, 32 nt, Human
caacauuuguguucuuucuacuuuugggcuau

SEQ ID NO: 75982 - RNA, 32 nt, Human
caacauuuucacccucuucccccacccccauc

SEQ ID NO: 75983 - RNA, 32 nt, Human
caacauuuucugagagcaacagaguauuugcc

SEQ ID NO: 75984 - RNA, 32 nt, Human
caacauuuugggaggccaaggugggaggauug

SEQ ID NO: 75985 - RNA, 32 nt, Human
caaccaaaaugaccucauuugaaaugcccagg

SEQ ID NO: 75986 - RNA, 32 nt, Human
caaccaaaccaagcccuguugugcucacuggu

SEQ ID NO: 75987 - RNA, 16 nt, Human
caaccaaaccaaucaa

SEQ ID NO: 75988 - RNA, 32 nt, Human
caaccaaagcaggguuggggaaucccgaaugg

SEQ ID NO: 75989 - RNA, 31 nt, Human
caaccaaaguaaaugcugcuuuuagaacugu

SEQ ID NO: 75990 - RNA, 32 nt, Human
caaccaaauaacuuuuucuucccugcugcucc

SEQ ID NO: 75991 - RNA, 32 nt, Human
caaccaaauuauauacauuguuacaguacaag

SEQ ID NO: 75992 - RNA, 32 nt, Human
caaccaacaaaugcacagaaagacagcuucuc

SEQ ID NO: 75993 - RNA, 32 nt, Human
caaccaacagcaauaaaagaugagccgauuuu

SEQ ID NO: 75994 - RNA, 32 nt, Human
caaccaacagcuacagacucaguggcuuccau

SEQ ID NO: 75995 - RNA, 32 nt, Human
caaccaacauggugaaaccccgucucuccuaa

SEQ ID NO: 75996 - RNA, 32 nt, Human
caaccaaccaacaaacaaacacagacaaagaa

SEQ ID NO: 75997 - RNA, 32 nt, Human
caaccaaccagcagcaagaaccuauugccuag

SEQ ID NO: 75998 - RNA, 32 nt, Human
caaccaaccagcugcugacaggggaccuggcc

SEQ ID NO: 75999 - RNA, 32 nt, Human
caaccaaccagcuggcccuuggucuccucucu

SEQ ID NO: 76000 - RNA, 32 nt, Human
caaccaaccccauuucacaggcuagaaaaaua

SEQ ID NO: 76001 - RNA, 32 nt, Human
caaccaacugccucucugaggaggagguggcc

SEQ ID NO: 76002 - RNA, 32 nt, Human
caaccaagaaaauccauucuauuuucuuaucu

SEQ ID NO: 76003 - RNA, 32 nt, Human
caaccaagaagagcagugaagccagauccugu

SEQ ID NO: 76004 - RNA, 21 nt, Human
caaccaagaggaccuguuuca

SEQ ID NO: 76005 - RNA, 32 nt, Human
caaccaaggccuuuccaggcaacagcagacau

SEQ ID NO: 76006 - RNA, 32 nt, Human
caaccaagguaguuuguaucauuuucaaaagu

SEQ ID NO: 76007 - RNA, 22 nt, Human
caaccaaguccuccccugcuuu

SEQ ID NO: 76008 - RNA, 20 nt, Human
caaccaauccucccaccuca

SEQ ID NO: 76009 - RNA, 32 nt, Human
caaccaaucuggguaaugcaaugugaacaagu

SEQ ID NO: 76010 - RNA, 32 nt, Human
caaccaaugccaaucauguucuggaagugaua

SEQ ID NO: 76011 - RNA, 32 nt, Human
caaccacaaggcaacuuccuggcuuuuuacaa

SEQ ID NO: 76012 - RNA, 32 nt, Human
caaccacacacugcaugcacacacauacacca

SEQ ID NO: 76013 - RNA, 32 nt, Human
caaccacacaucauccaucucuccagacucug

SEQ ID NO: 76014 - RNA, 21 nt, Human
caaccacacccugccguccag

SEQ ID NO: 76015 - RNA, 32 nt, Human
caaccacacucuuggaccacagugccauaaaa

SEQ ID NO: 76016 - RNA, 19 nt, Human
caaccacacuuaaauccag

SEQ ID NO: 76017 - RNA, 32 nt, Human
caaccacagcaacugucaccucacagcaggag

SEQ ID NO: 76018 - RNA, 32 nt, Human
caaccacagcagagacuagcagcggggccacc

SEQ ID NO: 76019 - RNA, 21 nt, Human
caaccacagcagaugcuuccu

SEQ ID NO: 76020 - RNA, 32 nt, Human
caaccacagccuguuucugcugaguuucuuau

SEQ ID NO: 76021 - RNA, 32 nt, Human
caaccacaggagcugccaguauccagcaguau

SEQ ID NO: 76022 - RNA, 32 nt, Human
caaccacagggccacagagcuggagcuggauc

SEQ ID NO: 76023 - RNA, 19 nt, Human
caaccacagucaccuugca

SEQ ID NO: 76024 - RNA, 32 nt, Human
caaccacagugccaccaagcucacaccugucc

SEQ ID NO: 76025 - RNA, 32 nt, Human
caaccaccaaucuaucuauuugcccacccauc

SEQ ID NO: 76026 - RNA, 32 nt, Human
caaccaccccgaggaccuucaggcugcaaacc

SEQ ID NO: 76027 - RNA, 32 nt, Human
caaccaccccucuuuccuccagguuggcaggg

SEQ ID NO: 76028 - RNA, 21 nt, Human
caaccacccucccuucccaaa

SEQ ID NO: 76029 - RNA, 32 nt, Human
caaccacccugggcccagaaacagaggccugc

SEQ ID NO: 76030 - RNA, 32 nt, Human
caaccaccuccaccuuucucucugaaucucuc

SEQ ID NO: 76031 - RNA, 32 nt, Human
caaccaccucugaauccccaccaggcgccuuc

SEQ ID NO: 76032 - RNA, 32 nt, Human
caaccaccuggccuccauucucuugggggagu

SEQ ID NO: 76033 - RNA, 32 nt, Human
caaccaccuugccggguguccucagccaccgu

SEQ ID NO: 76034 - RNA, 32 nt, Human
caaccacgaagcuagagagagagccagaggag

SEQ ID NO: 76035 - RNA, 32 nt, Human
caaccacgcccggcugauggugguggaggaac

SEQ ID NO: 76036 - RNA, 32 nt, Human
caaccacggcaugccuguacuggcacuuuggu

SEQ ID NO: 76037 - RNA, 32 nt, Human
caaccacguccaccuggugauccugagagcac

SEQ ID NO: 76038 - RNA, 32 nt, Human
caaccacuacuaaugucccuuccucuucugcc

SEQ ID NO: 76039 - RNA, 32 nt, Human
caaccacucugggcaccugccuggugauaucc

SEQ ID NO: 76040 - RNA, 32 nt, Human
caaccacugacagcccagaagaacaaagaacg

SEQ ID NO: 76041 - RNA, 32 nt, Human
caaccacugauuacuuuucaggaauuuaauua

SEQ ID NO: 76042 - RNA, 32 nt, Human
caaccacugcacuccacuaagcaacuggcaca

SEQ ID NO: 76043 - RNA, 32 nt, Human
caaccacugcagauuccuccccuggccagcac

SEQ ID NO: 76044 - RNA, 24 nt, Human
caaccacugccucccaggcucaag

SEQ ID NO: 76045 - RNA, 24 nt, Human
caaccacugccucccagguucaag

SEQ ID NO: 76046 - RNA, 25 nt, Human
caaccacugucuacccgggaugccu

SEQ ID NO: 76047 - RNA, 32 nt, Human
caaccagaaggagcugaguuuggcaacaaccc

SEQ ID NO: 76048 - RNA, 32 nt, Human
caaccagaaggccaagaagaagaaggagaggc

SEQ ID NO: 76049 - RNA, 32 nt, Human
caaccagaaguacacauuuacaauagauagau

SEQ ID NO: 76050 - RNA, 32 nt, Human
caaccagaauuagagccagacagggaaaguga

SEQ ID NO: 76051 - RNA, 32 nt, Human
caaccagagaagguauaagucucuuaaccagu

SEQ ID NO: 76052 - RNA, 32 nt, Human
caaccagagacacaacuuucuggcagacagac

SEQ ID NO: 76053 - RNA, 32 nt, Human
caaccagaggggagaggagagagccuggacag

SEQ ID NO: 76054 - RNA, 32 nt, Human
caaccagaucaaagcuagaaaauggauuccuu

SEQ ID NO: 76055 - RNA, 32 nt, Human
caaccagauuagcuauggcaaaggcugccaac

SEQ ID NO: 76056 - RNA, 32 nt, Human
caaccagcaccaugcccaugacacugggguac

SEQ ID NO: 76057 - RNA, 32 nt, Human
caaccagcaccaugcccaugauacugggguac

SEQ ID NO: 76058 - RNA, 32 nt, Human
caaccagcagcucuaggcgcugcucuugucua

SEQ ID NO: 76059 - RNA, 32 nt, Human
caaccagcaucucugucuaguuccaaauauuu

SEQ ID NO: 76060 - RNA, 18 nt, Human
caaccagccccucuccca

SEQ ID NO: 76061 - RNA, 17 nt, Human
caaccagcccuuccuug

SEQ ID NO: 76062 - RNA, 32 nt, Human
caaccagccugaccaacauggagaaaccccgu

SEQ ID NO: 76063 - RNA, 32 nt, Human
caaccagccuggggcugagauccugggcagaa

SEQ ID NO: 76064 - RNA, 32 nt, Human
caaccagcgcuccagauaccucagggaaccag

SEQ ID NO: 76065 - RNA, 32 nt, Human
caaccagcuacucaggaggcugggcaggagaa

SEQ ID NO: 76066 - RNA, 32 nt, Human
caaccagcucacuccucugggccucuccuccu

SEQ ID NO: 76067 - RNA, 32 nt, Human
caaccagcucacugcagccuugaccuccuggg

SEQ ID NO: 76068 - RNA, 32 nt, Human
caaccagcucuaccugacuccugcugcaacau

SEQ ID NO: 76069 - RNA, 32 nt, Human
caaccagcuggcccuuggucuccucucuuucc

SEQ ID NO: 76070 - RNA, 32 nt, Human
caaccaggaacauguugcuucucagguccuag

SEQ ID NO: 76071 - RNA, 32 nt, Human
caaccaggaagggaucaacccaggaagggaug

SEQ ID NO: 76072 - RNA, 32 nt, Human
caaccaggacagaaagcauggacaagggauga

SEQ ID NO: 76073 - RNA, 32 nt, Human
caaccaggacgcucuccaggaggcgggcacau

SEQ ID NO: 76074 - RNA, 32 nt, Human
caaccaggagcuuauuauaggaaaggcugaac

SEQ ID NO: 76075 - RNA, 32 nt, Human
caaccaggaugaggaugucaccaacugaauua

SEQ ID NO: 76076 - RNA, 32 nt, Human
caaccagggagauuucuccauuuuccucuugu

SEQ ID NO: 76077 - RNA, 32 nt, Human
caaccagggaggcagagguugcagugagccga

SEQ ID NO: 76078 - RNA, 32 nt, Human
caaccaggguuucuuuaguggccaucagcucc

SEQ ID NO: 76079 - RNA, 32 nt, Human
caaccaggucaucuccccguugccaagugggu

SEQ ID NO: 76080 - RNA, 32 nt, Human
caaccaggucguccagcuccugcugagccugu

SEQ ID NO: 76081 - RNA, 17 nt, Human
caaccaguacucuguca

SEQ ID NO: 76082 - RNA, 32 nt, Human
caaccaguaguccuuucuggauuuuuguuuuu

SEQ ID NO: 76083 - RNA, 32 nt, Human
caaccagucuucacuucaagagggccacacug

SEQ ID NO: 76084 - RNA, 32 nt, Human
caaccauacaccuuguacaccuaguggaugcu

SEQ ID NO: 76085 - RNA, 32 nt, Human
caaccauagccacaccacaggauuuccugaaa

SEQ ID NO: 76086 - RNA, 32 nt, Human
caaccauccccauuuggcuucuccuuaaaaca

SEQ ID NO: 76087 - RNA, 32 nt, Human
caaccauccugaccacagauccagaaagccca

SEQ ID NO: 76088 - RNA, 32 nt, Human
caaccauccuuguccuccuugguaccguauca

SEQ ID NO: 76089 - RNA, 32 nt, Human
caaccaucuccaccauccaucuccagaaugac

SEQ ID NO: 76090 - RNA, 32 nt, Human
caaccaugcaguuccuggugagggucagaagg

SEQ ID NO: 76091 - RNA, 32 nt, Human
caaccauggcucuucccagccuaggggaagcc

SEQ ID NO: 76092 - RNA, 32 nt, Human
caaccaugggguauguaguaugaccaacugca

SEQ ID NO: 76093 - RNA, 30 nt, Human
caaccauggugcccagcuuccucucccuga

SEQ ID NO: 76094 - RNA, 32 nt, Human
caaccaugguuccacacacagcucugcacccc

SEQ ID NO: 76095 - RNA, 32 nt, Human
caaccauguuaacuguauugacacauccucaa

SEQ ID NO: 76096 - RNA, 32 nt, Human
caaccauuaccaccauccaucuccauaacucu

SEQ ID NO: 76097 - RNA, 32 nt, Human
caaccauucacugcaaugccuauuccaaacuu

SEQ ID NO: 76098 - RNA, 32 nt, Human
caaccauuccucacgccaccgccacaucagag

SEQ ID NO: 76099 - RNA, 32 nt, Human
caaccauucuguaccccuuccccagccugggc

SEQ ID NO: 76100 - RNA, 32 nt, Human
caaccauugagacaagagucucgcucugucac

SEQ ID NO: 76101 - RNA, 32 nt, Human
caaccauuguguagcugggacuacaggcgucc

SEQ ID NO: 76102 - RNA, 32 nt, Human
caaccauuuagaggccuuggaaaaagaagagg

SEQ ID NO: 76103 - RNA, 32 nt, Human
caaccauuuguggucaugagagcugggguggg

SEQ ID NO: 76104 - RNA, 32 nt, Human
caacccaaagcccugcacagugccucacccac

SEQ ID NO: 76105 - RNA, 24 nt, Human
caacccaaaugucaccccccacca

SEQ ID NO: 76106 - RNA, 32 nt, Human
caacccaacuggaggguagguuagaagaaaaa

SEQ ID NO: 76107 - RNA, 20 nt, Human
caacccacaacaccucugcc

SEQ ID NO: 76108 - RNA, 32 nt, Human
caacccacuacccugaagucauccaccgugua

SEQ ID NO: 76109 - RNA, 32 nt, Human
caacccacugagcaccuugagaaggaaacagu

SEQ ID NO: 76110 - RNA, 32 nt, Human
caacccagaagagggcccuaaccagaaaguug

SEQ ID NO: 76111 - RNA, 32 nt, Human
caacccagacaauggcccaggucucucaacuu

SEQ ID NO: 76112 - RNA, 32 nt, Human
caacccagacacacagacccacagcuacaucc

SEQ ID NO: 76113 - RNA, 32 nt, Human
caacccagacagguccaggcauggacuccagg

SEQ ID NO: 76114 - RNA, 32 nt, Human
caacccagagagagcagcuucccuuggcucug

SEQ ID NO: 76115 - RNA, 32 nt, Human
caacccagaggacaggauucccuggaggccac

SEQ ID NO: 76116 - RNA, 32 nt, Human
caacccagaggacccauggcuagcagggaagg

SEQ ID NO: 76117 - RNA, 32 nt, Human
caacccagcaggagaaguggacaugagguugg

SEQ ID NO: 76118 - RNA, 32 nt, Human
caacccagcaugagcgccgccacccacucgcc

SEQ ID NO: 76119 - RNA, 32 nt, Human
caacccagccugggugacagagcgagacuuug

SEQ ID NO: 76120 - RNA, 22 nt, Human
caacccagccuuuccgugcugc

SEQ ID NO: 76121 - RNA, 20 nt, Human
caacccagcggacccuccca

SEQ ID NO: 76122 - RNA, 32 nt, Human
caacccaggaggcagacguugcagcgagccaa

SEQ ID NO: 76123 - RNA, 32 nt, Human
caacccaggaggcagaggcuacagugagcuga

SEQ ID NO: 76124 - RNA, 32 nt, Human
caacccagggaccugaaccccaaggagcccag

SEQ ID NO: 76125 - RNA, 32 nt, Human
caacccagguucuuuuccuuccuuccuuccuu

SEQ ID NO: 76126 - RNA, 20 nt, Human
caacccagugcccccuccca

SEQ ID NO: 76127 - RNA, 32 nt, Human
caacccagugccuggugccaacccggaccugc

SEQ ID NO: 76128 - RNA, 32 nt, Human
caacccaucccccacccagcucccggccgucc

SEQ ID NO: 76129 - RNA, 23 nt, Human
caacccaucucccuaaccccaca

SEQ ID NO: 76130 - RNA, 21 nt, Human
caacccaucuuccuaguguuu

SEQ ID NO: 76131 - RNA, 32 nt, Human
caaccccaagagucuucacaccaaucugcacc

SEQ ID NO: 76132 - RNA, 32 nt, Human
caaccccaccauaaccuccuacucagcacaca

SEQ ID NO: 76133 - RNA, 32 nt, Human
caaccccaccugccuccugaagugcugcugac

SEQ ID NO: 76134 - RNA, 32 nt, Human
caaccccacuccauggguuugucuccugguac

SEQ ID NO: 76135 - RNA, 32 nt, Human
caaccccacugaggccugcugcacaggucaau

SEQ ID NO: 76136 - RNA, 32 nt, Human
caaccccacugcacagcagaucaugcagcugc

SEQ ID NO: 76137 - RNA, 32 nt, Human
caaccccacugcacagcagauccagcagcugc

SEQ ID NO: 76138 - RNA, 32 nt, Human
caaccccagcagaaagacaccgcgggcggccc

SEQ ID NO: 76139 - RNA, 32 nt, Human
caaccccagcuaucuggaucugaaguggauau

SEQ ID NO: 76140 - RNA, 32 nt, Human
caaccccagcuccacuccagccuggcguccag

SEQ ID NO: 76141 - RNA, 32 nt, Human
caaccccagggugguuuucaggaguccgaggu

SEQ ID NO: 76142 - RNA, 32 nt, Human
caaccccaguuuaggggaagguagcacagggc

SEQ ID NO: 76143 - RNA, 32 nt, Human
caaccccaucucagagcucagaggguacaagc

SEQ ID NO: 76144 - RNA, 24 nt, Human
caacccccacaucccggguucaag

SEQ ID NO: 76145 - RNA, 24 nt, Human
caacccccaccucccagguucaag

SEQ ID NO: 76146 - RNA, 32 nt, Human
caacccccagcacccgggcucagggaccacag

SEQ ID NO: 76147 - RNA, 32 nt, Human
caacccccagcccaggaggagacuugacucgc

SEQ ID NO: 76148 - RNA, 24 nt, Human
caacccccaucucccagguucaag

SEQ ID NO: 76149 - RNA, 17 nt, Human
caaccccccaccuccca

SEQ ID NO: 76150 - RNA, 32 nt, Human
caacccccgacuucaucccaaaggacagccgc

SEQ ID NO: 76151 - RNA, 24 nt, Human
caacccccgccaccuagguucaag

SEQ ID NO: 76152 - RNA, 24 nt, Human
caacccccgccccccggguucaag

SEQ ID NO: 76153 - RNA, 24 nt, Human
caacccccgcuucccggguucaag

SEQ ID NO: 76154 - RNA, 24 nt, Human
caacccccgucucccggguucaag

SEQ ID NO: 76155 - RNA, 32 nt, Human
caacccccuacccgcuucgucucccuccgccg

SEQ ID NO: 76156 - RNA, 32 nt, Human
caacccccuccaggcucagaccuggggacacc

SEQ ID NO: 76157 - RNA, 32 nt, Human
caaccccgaucagcacagcagagaagucuccu

SEQ ID NO: 76158 - RNA, 23 nt, Human
caaccccgccucccagguucaag

SEQ ID NO: 76159 - RNA, 32 nt, Human
caaccccggcgccgcggcaaggacucggaggg

SEQ ID NO: 76160 - RNA, 32 nt, Human
caaccccucacaggagcuuacuggcaaacaug

SEQ ID NO: 76161 - RNA, 32 nt, Human
caaccccuccaaugcuguuaucccugccuggu

SEQ ID NO: 76162 - RNA, 32 nt, Human
caaccccuccacccucggucaccccaaccucu

SEQ ID NO: 76163 - RNA, 16 nt, Human
caaccccucccuccca

SEQ ID NO: 76164 - RNA, 32 nt, Human
caaccccucuacucuccaccucagcccccacc

SEQ ID NO: 76165 - RNA, 32 nt, Human
caaccccugcagcuccucugccuuugugcucu

SEQ ID NO: 76166 - RNA, 32 nt, Human
caaccccugcccacagaaccagcugauggccc

SEQ ID NO: 76167 - RNA, 32 nt, Human
caaccccuguuuuccccugccuuccuugcaga

SEQ ID NO: 76168 - RNA, 32 nt, Human
caaccccuucaaggacugagccucaagcugcc

SEQ ID NO: 76169 - RNA, 32 nt, Human
caaccccuucuccagaccgugucagccagaga

SEQ ID NO: 76170 - RNA, 32 nt, Human
caaccccuuucuccucauugccuguguaccuc

SEQ ID NO: 76171 - RNA, 22 nt, Human
caacccgccgcugcccccuccc

SEQ ID NO: 76172 - RNA, 22 nt, Human
caacccgcugccuucaugcugc

SEQ ID NO: 76173 - RNA, 32 nt, Human
caacccggccuucuggucaccuccugccugga

SEQ ID NO: 76174 - RNA, 32 nt, Human
caacccgggaggcggagcuugcagugagccga

SEQ ID NO: 76175 - RNA, 32 nt, Human
caacccgggaggcugagguugcagugagugga

SEQ ID NO: 76176 - RNA, 19 nt, Human
caacccuacagcugccaaa

SEQ ID NO: 76177 - RNA, 19 nt, Human
caacccuagccuucuccca

SEQ ID NO: 76178 - RNA, 18 nt, Human
caacccuagucagcaaga

SEQ ID NO: 76179 - RNA, 32 nt, Human
caacccuauaaaggagggagcucguggcgagg

SEQ ID NO: 76180 - RNA, 32 nt, Human
caacccucagccccaaggagccacugucacuu

SEQ ID NO: 76181 - RNA, 32 nt, Human
caacccucagccccaaggagccgcugucacuu

SEQ ID NO: 76182 - RNA, 32 nt, Human
caacccucaugaaguacaaccagcauaugcua

SEQ ID NO: 76183 - RNA, 32 nt, Human
caacccuccaguaacccagcaggacggggaag

SEQ ID NO: 76184 - RNA, 21 nt, Human
caacccucccccaagcuccca

SEQ ID NO: 76185 - RNA, 23 nt, Human
caacccuccccccacgcccccca

SEQ ID NO: 76186 - RNA, 32 nt, Human
caacccuccccuggcccucugauuuguucugu

SEQ ID NO: 76187 - RNA, 22 nt, Human
caacccuccucugcagcccaca

SEQ ID NO: 76188 - RNA, 32 nt, Human
caacccucucucuccagcuagacuuuucucuu

SEQ ID NO: 76189 - RNA, 32 nt, Human
caacccucucugcugcuguuuccauggcccag

SEQ ID NO: 76190 - RNA, 32 nt, Human
caacccucugcucccguuucucccucugguuc

SEQ ID NO: 76191 - RNA, 32 nt, Human
caacccugaacacucugcuccagccaaggugg

SEQ ID NO: 76192 - RNA, 23 nt, Human
caacccugaccuucccccuccca

SEQ ID NO: 76193 - RNA, 32 nt, Human
caacccugaccuuccuggaaguuguuuccuua

SEQ ID NO: 76194 - RNA, 32 nt, Human
caacccugagauuggcccaaucugccagaacc

SEQ ID NO: 76195 - RNA, 32 nt, Human
caacccugagcgagccuguccucuguggcagg

SEQ ID NO: 76196 - RNA, 32 nt, Human
caacccugaucucaaaccuccuucccucugcc

SEQ ID NO: 76197 - RNA, 32 nt, Human
caacccugcacccacccuccuccagggaucau

SEQ ID NO: 76198 - RNA, 32 nt, Human
caacccugcaggugcucacccugcugcugaac

SEQ ID NO: 76199 - RNA, 32 nt, Human
caacccugccgagacaccuugaucucagacuu

SEQ ID NO: 76200 - RNA, 22 nt, Human
caacccugccugccgcugcacc

SEQ ID NO: 76201 - RNA, 24 nt, Human
caacccugcggcaggcacugagug

SEQ ID NO: 76202 - RNA, 21 nt, Human
caacccugcuccagccccuca

SEQ ID NO: 76203 - RNA, 32 nt, Human
caacccugcuuucccugguagauauuugccag

SEQ ID NO: 76204 - RNA, 32 nt, Human
caacccuggacaguuggcucuaccucaguaac

SEQ ID NO: 76205 - RNA, 32 nt, Human
caacccuggcaauuauagcuacucccaucccu

SEQ ID NO: 76206 - RNA, 32 nt, Human
caacccugggcuggggaggaggagagaguccc

SEQ ID NO: 76207 - RNA, 32 nt, Human
caacccuguccucugcugggcccccagcaaac

SEQ ID NO: 76208 - RNA, 32 nt, Human
caacccugucugcugcuccggagcuccgagca

SEQ ID NO: 76209 - RNA, 32 nt, Human
caacccuguggaccacgacagggcagaaggag

SEQ ID NO: 76210 - RNA, 32 nt, Human
caacccugugggcuguaagcaagcucaggcua

SEQ ID NO: 76211 - RNA, 23 nt, Human
caacccuuauccccagguuuaag

SEQ ID NO: 76212 - RNA, 32 nt, Human
caacccuuccucuuuucucucaucucaccucu

SEQ ID NO: 76213 - RNA, 32 nt, Human
caacccuucucuguuggucugccuucugcuga

SEQ ID NO: 76214 - RNA, 21 nt, Human
caacccuugcccaaccccacg

SEQ ID NO: 76215 - RNA, 32 nt, Human
caacccuugccugccucccuccagucuugcag

SEQ ID NO: 76216 - RNA, 32 nt, Human
caacccuugucucccucuucucuccuuugcaa

SEQ ID NO: 76217 - RNA, 32 nt, Human
caaccgaaggcucggucuuaauucccccaccu

SEQ ID NO: 76218 - RNA, 32 nt, Human
caaccgaaguugaguaaguucccacacugcug

SEQ ID NO: 76219 - RNA, 32 nt, Human
caaccgacaggcccuggcugagggcagcugcg

SEQ ID NO: 76220 - RNA, 32 nt, Human
caaccgaccuuucggguuucacggugaagaag

SEQ ID NO: 76221 - RNA, 32 nt, Human
caaccgaggcggaccgcggagugugcgaacga

SEQ ID NO: 76222 - RNA, 32 nt, Human
caaccgagggcugagcaaugcagagagagagg

SEQ ID NO: 76223 - RNA, 32 nt, Human
caaccgauaaccaaagagaugcugcaguccag

SEQ ID NO: 76224 - RNA, 21 nt, Human
caaccgcacccugaccucccu

SEQ ID NO: 76225 - RNA, 32 nt, Human
caaccgcagucugcaagaggcugagcugagga

SEQ ID NO: 76226 - RNA, 32 nt, Human
caaccgccuccuggugacggacuacuugccug

SEQ ID NO: 76227 - RNA, 32 nt, Human
caaccggaccuccacccccaacuuccuccagc

SEQ ID NO: 76228 - RNA, 32 nt, Human
caaccggcaccggcgcuguccagaccgaggcc

SEQ ID NO: 76229 - RNA, 32 nt, Human
caaccggcagaagcugagagacagggaacagg

SEQ ID NO: 76230 - RNA, 32 nt, Human
caaccggcagaggaucuacucacuggagcagc

SEQ ID NO: 76231 - RNA, 32 nt, Human
caaccggccuuacugccugcuuucacugacca

SEQ ID NO: 76232 - RNA, 32 nt, Human
caaccggcugaccacacacaguccucacuccc

SEQ ID NO: 76233 - RNA, 20 nt, Human
caaccgggcuggagugcagu

SEQ ID NO: 76234 - RNA, 32 nt, Human
caaccgguucccuacccucugccauuaugaac

SEQ ID NO: 76235 - RNA, 32 nt, Human
caaccguacccaggcccugccuccccugccau

SEQ ID NO: 76236 - RNA, 32 nt, Human
caaccguccagcaaagccagcacagcagagau

SEQ ID NO: 76237 - RNA, 32 nt, Human
caaccguccugcuccccaccucccccaggaaa

SEQ ID NO: 76238 - RNA, 32 nt, Human
caaccgugcugggcaggggcccuucagcaacu

SEQ ID NO: 76239 - RNA, 32 nt, Human
caaccuaaacaguaucacacagcuaaugagga

SEQ ID NO: 76240 - RNA, 32 nt, Human
caaccuaacaccacucccucugcagguagcuc

SEQ ID NO: 76241 - RNA, 32 nt, Human
caaccuaccaagguagacagacauauagacaa

SEQ ID NO: 76242 - RNA, 32 nt, Human
caaccuaccccucucucuccagccucuuuaug

SEQ ID NO: 76243 - RNA, 23 nt, Human
caaccuagaacccaggccucaag

SEQ ID NO: 76244 - RNA, 32 nt, Human
caaccuagagaaucuccucuuacagggggaug

SEQ ID NO: 76245 - RNA, 32 nt, Human
caaccuaggaaaaaggagagcuuucuuacaug

SEQ ID NO: 76246 - RNA, 22 nt, Human
caaccuaggugacagagcaaga

SEQ ID NO: 76247 - RNA, 32 nt, Human
caaccuauccuuacucagagcugcgggcugag

SEQ ID NO: 76248 - RNA, 32 nt, Human
caaccuauuuauccucuccaugugucuucguu

SEQ ID NO: 76249 - RNA, 32 nt, Human
caaccuauuuguagcucgcacuuuaaaagaug

SEQ ID NO: 76250 - RNA, 24 nt, Human
caaccucaaacuccugggcucaag

SEQ ID NO: 76251 - RNA, 22 nt, Human
caaccucaaagaucaguuucaa

SEQ ID NO: 76252 - RNA, 32 nt, Human
caaccucacauccuacuagucuuccaagagga

SEQ ID NO: 76253 - RNA, 23 nt, Human
caaccucaccucccggguucaag

SEQ ID NO: 76254 - RNA, 24 nt, Human
caaccucagccucccagguucaag

SEQ ID NO: 76255 - RNA, 32 nt, Human
caaccucagccuggccuucaugacuucucuac

SEQ ID NO: 76256 - RNA, 32 nt, Human
caaccucagcucucuuccccagccuuuauccg

SEQ ID NO: 76257 - RNA, 32 nt, Human
caaccucaguucuucuuggagaaucuacgacc

SEQ ID NO: 76258 - RNA, 24 nt, Human
caaccuccaacucccagguucaag

SEQ ID NO: 76259 - RNA, 24 nt, Human
caaccuccaccccccagguucaag

SEQ ID NO: 76260 - RNA, 24 nt, Human
caaccuccaccucacagguucaag

SEQ ID NO: 76261 - RNA, 23 nt, Human
caaccuccaccuccagguucaag

SEQ ID NO: 76262 - RNA, 24 nt, Human
caaccuccaccucccaggaucaag

SEQ ID NO: 76263 - RNA, 24 nt, Human
caaccuccaccucccaggcucaag

SEQ ID NO: 76264 - RNA, 24 nt, Human
caaccuccaccucccagguccaag

SEQ ID NO: 76265 - RNA, 24 nt, Human
caaccuccaccucccaggugcaag

SEQ ID NO: 76266 - RNA, 22 nt, Human
caaccuccaccucccagguuca

SEQ ID NO: 76267 - RNA, 24 nt, Human
caaccuccaccucccagguucaag

SEQ ID NO: 76268 - RNA, 23 nt, Human
caaccuccaccucccagguucag

SEQ ID NO: 76269 - RNA, 24 nt, Human
caaccuccaccuccccggguucaa

SEQ ID NO: 76270 - RNA, 24 nt, Human
caaccuccaccucccgggcucaag

SEQ ID NO: 76271 - RNA, 22 nt, Human
caaccuccaccucccggguuca

SEQ ID NO: 76272 - RNA, 24 nt, Human
caaccuccaccucccggguucaag

SEQ ID NO: 76273 - RNA, 24 nt, Human
caaccuccaccucccugguucaag

SEQ ID NO: 76274 - RNA, 24 nt, Human
caaccuccaccuccuagguucaag

SEQ ID NO: 76275 - RNA, 21 nt, Human
caaccuccaccuccuggguuc

SEQ ID NO: 76276 - RNA, 22 nt, Human
caaccuccaccuccuggguuca

SEQ ID NO: 76277 - RNA, 21 nt, Human
caaccuccaccuccuggguuu

SEQ ID NO: 76278 - RNA, 22 nt, Human
caaccuccaccuccuggguuua

SEQ ID NO: 76279 - RNA, 24 nt, Human
caaccuccaccucgcagguucaag

SEQ ID NO: 76280 - RNA, 24 nt, Human
caaccuccaccucucagauucaag

SEQ ID NO: 76281 - RNA, 24 nt, Human
caaccuccaccucucagguucaag

SEQ ID NO: 76282 - RNA, 24 nt, Human
caaccuccaccuuccagguucaag

SEQ ID NO: 76283 - RNA, 32 nt, Human
caaccuccaccuugcgugucucagccuccuga

SEQ ID NO: 76284 - RNA, 21 nt, Human
caaccuccacuucccagguuc

SEQ ID NO: 76285 - RNA, 24 nt, Human
caaccuccacuucccagguucaag

SEQ ID NO: 76286 - RNA, 24 nt, Human
caaccuccacuuccuagguucaag

SEQ ID NO: 76287 - RNA, 24 nt, Human
caaccuccacuucucagguucaag

SEQ ID NO: 76288 - RNA, 32 nt, Human
caaccuccagaaagaguauggagagaaaaaga

SEQ ID NO: 76289 - RNA, 24 nt, Human
caaccuccaggucccagguuaaag

SEQ ID NO: 76290 - RNA, 21 nt, Human
caaccuccaguguugacucua

SEQ ID NO: 76291 - RNA, 24 nt, Human
caaccuccaucucccagguucaag

SEQ ID NO: 76292 - RNA, 32 nt, Human
caaccucccaggacuguguucuuucuggaguu

SEQ ID NO: 76293 - RNA, 32 nt, Human
caaccuccccuucaccuucuccuccaccugcu

SEQ ID NO: 76294 - RNA, 24 nt, Human
caaccucccucucccggguucaag

SEQ ID NO: 76295 - RNA, 32 nt, Human
caaccucccugggguccugccuguuuccuccc

SEQ ID NO: 76296 - RNA, 24 nt, Human
caaccuccgacucccagguucaag

SEQ ID NO: 76297 - RNA, 24 nt, Human
caaccuccgacucccugguucaag

SEQ ID NO: 76298 - RNA, 24 nt, Human
caaccuccgcaucccggguucaag

SEQ ID NO: 76299 - RNA, 24 nt, Human
caaccuccgcauccuagguucaag

SEQ ID NO: 76300 - RNA, 24 nt, Human
caaccuccgcccccaagguucaag

SEQ ID NO: 76301 - RNA, 23 nt, Human
caaccuccgccuccagguucaag

SEQ ID NO: 76302 - RNA, 22 nt, Human
caaccuccgccucccagguuca

SEQ ID NO: 76303 - RNA, 23 nt, Human
caaccuccgccucccagguucaa

SEQ ID NO: 76304 - RNA, 24 nt, Human
caaccuccgccucccagguucaag

SEQ ID NO: 76305 - RNA, 24 nt, Human
caaccuccgccucccagguucagg

SEQ ID NO: 76306 - RNA, 24 nt, Human
caaccuccgccucccaguuucaag

SEQ ID NO: 76307 - RNA, 24 nt, Human
caaccuccgccucccgggcccaag

SEQ ID NO: 76308 - RNA, 24 nt, Human
caaccuccgccucccggguucaag

SEQ ID NO: 76309 - RNA, 23 nt, Human
caaccuccgccucccgguucaag

SEQ ID NO: 76310 - RNA, 24 nt, Human
caaccuccgccucccugguucaag

SEQ ID NO: 76311 - RNA, 22 nt, Human
caaccuccgccuccugggucca

SEQ ID NO: 76312 - RNA, 22 nt, Human
caaccuccgccuccuggguuca

SEQ ID NO: 76313 - RNA, 24 nt, Human
caaccuccgccucucagguucaag

SEQ ID NO: 76314 - RNA, 24 nt, Human
caaccuccgccuuccagguucaag

SEQ ID NO: 76315 - RNA, 24 nt, Human
caaccuccgucucccagguucaag

SEQ ID NO: 76316 - RNA, 32 nt, Human
caaccuccuccacccccuuccccuacucuagg

SEQ ID NO: 76317 - RNA, 32 nt, Human
caaccuccuccacuucacucgggaccgccuga

SEQ ID NO: 76318 - RNA, 32 nt, Human
caaccuccuccaggaaccauguuuggagcuuc

SEQ ID NO: 76319 - RNA, 32 nt, Human
caaccuccuccaggaacgauguuuggagcuuc

SEQ ID NO: 76320 - RNA, 24 nt, Human
caaccuccuccucccagguucaag

SEQ ID NO: 76321 - RNA, 24 nt, Human
caaccuccuccucccggguucaag

SEQ ID NO: 76322 - RNA, 32 nt, Human
caaccuccuccucccugcccagccucuuucuc

SEQ ID NO: 76323 - RNA, 32 nt, Human
caaccuccugggcuuccuagaggacagccuug

SEQ ID NO: 76324 - RNA, 32 nt, Human
caaccuccuuaucugcuaacucuguuauucuu

SEQ ID NO: 76325 - RNA, 24 nt, Human
caaccuccuucucccagguucaag

SEQ ID NO: 76326 - RNA, 22 nt, Human
caaccucgaccuccuggguuca

SEQ ID NO: 76327 - RNA, 32 nt, Human
caaccucgacuucucagccuccugggguuccg

SEQ ID NO: 76328 - RNA, 32 nt, Human
caaccucgccuagcuuuuccucccuuugugaa

SEQ ID NO: 76329 - RNA, 23 nt, Human
caaccucgccucccugguucaag

SEQ ID NO: 76330 - RNA, 32 nt, Human
caaccucggaggcggagguugcagugagccaa

SEQ ID NO: 76331 - RNA, 23 nt, Human
caaccucgucucccggguucaag

SEQ ID NO: 76332 - RNA, 32 nt, Human
caaccucuaaccuccugaccucaugcuaauaa

SEQ ID NO: 76333 - RNA, 23 nt, Human
caaccucuaccucccagguucaa

SEQ ID NO: 76334 - RNA, 24 nt, Human
caaccucuaccucccagguucaag

SEQ ID NO: 76335 - RNA, 21 nt, Human
caaccucuccacgcgcacuca

SEQ ID NO: 76336 - RNA, 32 nt, Human
caaccucucuccagcccacucuuccaaaauaa

SEQ ID NO: 76337 - RNA, 24 nt, Human
caaccucucucucccggguucaag

SEQ ID NO: 76338 - RNA, 19 nt, Human
caaccucugacugcaauga

SEQ ID NO: 76339 - RNA, 24 nt, Human
caaccucugccacccggguucaag

SEQ ID NO: 76340 - RNA, 24 nt, Human
caaccucugccccccggguucaag

SEQ ID NO: 76341 - RNA, 24 nt, Human
caaccucugcccuccagguucaag

SEQ ID NO: 76342 - RNA, 23 nt, Human
caaccucugccuccagguucaag

SEQ ID NO: 76343 - RNA, 24 nt, Human
caaccucugccucccaggaucaag

SEQ ID NO: 76344 - RNA, 22 nt, Human
caaccucugccucccaggucaa

SEQ ID NO: 76345 - RNA, 22 nt, Human
caaccucugccucccagguuca

SEQ ID NO: 76346 - RNA, 24 nt, Human
caaccucugccucccagguucaag

SEQ ID NO: 76347 - RNA, 24 nt, Human
caaccucugccucccagguucagg

SEQ ID NO: 76348 - RNA, 24 nt, Human
caaccucugccucccagguuccag

SEQ ID NO: 76349 - RNA, 24 nt, Human
caaccucugccucccagguugaag

SEQ ID NO: 76350 - RNA, 24 nt, Human
caaccucugccucccagguuuaag

SEQ ID NO: 76351 - RNA, 24 nt, Human
caaccucugccucccggguccaag

SEQ ID NO: 76352 - RNA, 23 nt, Human
caaccucugccucccggguucaa

SEQ ID NO: 76353 - RNA, 24 nt, Human
caaccucugccucccggguucaag

SEQ ID NO: 76354 - RNA, 24 nt, Human
caaccucugccucccugguucaag

SEQ ID NO: 76355 - RNA, 22 nt, Human
caaccucugccuccuggguuca

SEQ ID NO: 76356 - RNA, 32 nt, Human
caaccucugcucccugccucgccucccgcgcg

SEQ ID NO: 76357 - RNA, 32 nt, Human
caaccucugcuguaucagagggggccuucgcc

SEQ ID NO: 76358 - RNA, 24 nt, Human
caaccucugcuucccagguucaag

SEQ ID NO: 76359 - RNA, 24 nt, Human
caaccucugcuucccagguuuaag

SEQ ID NO: 76360 - RNA, 23 nt, Human
caaccucugcuucccggguucaa

SEQ ID NO: 76361 - RNA, 24 nt, Human
caaccucugcuucccggguucaag

SEQ ID NO: 76362 - RNA, 24 nt, Human
caaccucugcuuccuagguucaag

SEQ ID NO: 76363 - RNA, 32 nt, Human
caaccucuggccccagcaccccaccaggacug

SEQ ID NO: 76364 - RNA, 32 nt, Human
caaccucugggcuggaguagaggacucuggug

SEQ ID NO: 76365 - RNA, 24 nt, Human
caaccucugucucccagguucagg

SEQ ID NO: 76366 - RNA, 24 nt, Human
caaccucugucucccggguucaag

SEQ ID NO: 76367 - RNA, 24 nt, Human
caaccucuuccucccagguucaag

SEQ ID NO: 76368 - RNA, 32 nt, Human
caaccucuucuccaagauucucaggcaaucaa

SEQ ID NO: 76369 - RNA, 25 nt, Human
caaccucuugccucccagguucaag

SEQ ID NO: 76370 - RNA, 32 nt, Human
caaccucuugggccuggaagucagacaaguac

SEQ ID NO: 76371 - RNA, 32 nt, Human
caaccucuuucugauagauuuccucuuucauu

SEQ ID NO: 76372 - RNA, 32 nt, Human
caaccucuuugagacguccuuucccuacucca

SEQ ID NO: 76373 - RNA, 32 nt, Human
caaccugaaccuuucccaccccaguucuucuu

SEQ ID NO: 76374 - RNA, 32 nt, Human
caaccugaauuaaagucuacacugccuuugug

SEQ ID NO: 76375 - RNA, 32 nt, Human
caaccugaauucugccucccuguuauaguccc

SEQ ID NO: 76376 - RNA, 32 nt, Human
caaccugaccaacauggagaaacccgucucua

SEQ ID NO: 76377 - RNA, 32 nt, Human
caaccugaccaacauggagaaacccugucucu

SEQ ID NO: 76378 - RNA, 32 nt, Human
caaccugacuaacauggugaaaccccaucucu

SEQ ID NO: 76379 - RNA, 32 nt, Human
caaccugacucaggccagugugucucugaaac

SEQ ID NO: 76380 - RNA, 32 nt, Human
caaccugagcaacauggcgaaaccccgucugu

SEQ ID NO: 76381 - RNA, 32 nt, Human
caaccugagcgagugggugugugugcaaagau

SEQ ID NO: 76382 - RNA, 32 nt, Human
caaccugauccuggcccuuucuucuucuccau

SEQ ID NO: 76383 - RNA, 32 nt, Human
caaccugaucucuucccucucucccagcacuu

SEQ ID NO: 76384 - RNA, 32 nt, Human
caaccugcacuccagccugggugacagagcga

SEQ ID NO: 76385 - RNA, 32 nt, Human
caaccugcacuuccuaggcagcuaccugacac

SEQ ID NO: 76386 - RNA, 32 nt, Human
caaccugccaacaccuacugacacucacucau

SEQ ID NO: 76387 - RNA, 32 nt, Human
caaccugcugcuggugacaucguucccuucug

SEQ ID NO: 76388 - RNA, 32 nt, Human
caaccugcuuagccagcagcaggcuugggccu

SEQ ID NO: 76389 - RNA, 32 nt, Human
caaccuggaagaggucccucaccagaucccaa

SEQ ID NO: 76390 - RNA, 32 nt, Human
caaccuggagggcuccuacaccugccagugcc

SEQ ID NO: 76391 - RNA, 32 nt, Human
caaccuggagguuucugaaccccuggccuguu

SEQ ID NO: 76392 - RNA, 32 nt, Human
caaccuggauggaguuggagaucauuauucua

SEQ ID NO: 76393 - RNA, 32 nt, Human
caaccuggccaacauacugaaaccccgucucu

SEQ ID NO: 76394 - RNA, 32 nt, Human
caaccuggccaacaugauaaaaccccaacucu

SEQ ID NO: 76395 - RNA, 32 nt, Human
caaccuggccaacaugguaaaacccuguuucu

SEQ ID NO: 76396 - RNA, 32 nt, Human
caaccuggccaacauggugaaacccugugccu

SEQ ID NO: 76397 - RNA, 32 nt, Human
caaccuggccaacauggugaaaccuugucucu

SEQ ID NO: 76398 - RNA, 32 nt, Human
caaccuggccaacauguugaaaccucgucugu

SEQ ID NO: 76399 - RNA, 32 nt, Human
caaccuggccaacguggggaaaccccaucucu

SEQ ID NO: 76400 - RNA, 32 nt, Human
caaccuggccugggugugcagggagggguucc

SEQ ID NO: 76401 - RNA, 18 nt, Human
caaccuggcucccuccca

SEQ ID NO: 76402 - RNA, 32 nt, Human
caaccugggagauggagguugcagugagccga

SEQ ID NO: 76403 - RNA, 32 nt, Human
caaccugggaggcagagguugcagugagccaa

SEQ ID NO: 76404 - RNA, 32 nt, Human
caaccugggaggcagagguugcagugagccga

SEQ ID NO: 76405 - RNA, 32 nt, Human
caaccugggaggcggagguugcagugagcuua

SEQ ID NO: 76406 - RNA, 32 nt, Human
caaccugggagguagagguugcagugagccga

SEQ ID NO: 76407 - RNA, 32 nt, Human
caaccugggagguugaggcugcagugagcugu

SEQ ID NO: 76408 - RNA, 32 nt, Human
caaccugggcaacagaacaagaacccaucuca

SEQ ID NO: 76409 - RNA, 21 nt, Human
caaccugggcaacagaguaag

SEQ ID NO: 76410 - RNA, 32 nt, Human
caaccugggcaacauggugaaaccccugucuc

SEQ ID NO: 76411 - RNA, 21 nt, Human
caaccugggcagcagagcaag

SEQ ID NO: 76412 - RNA, 21 nt, Human
caaccugggcgacagagcaag

SEQ ID NO: 76413 - RNA, 22 nt, Human
caaccugggcggcagagugaga

SEQ ID NO: 76414 - RNA, 22 nt, Human
caaccuggguaacagagugaga

SEQ ID NO: 76415 - RNA, 21 nt, Human
caaccuggguaacagggcaag

SEQ ID NO: 76416 - RNA, 22 nt, Human
caaccugggugacagaacaaga

SEQ ID NO: 76417 - RNA, 22 nt, Human
caaccugggugacagaccgaga

SEQ ID NO: 76418 - RNA, 22 nt, Human
caaccugggugacagagcaaga

SEQ ID NO: 76419 - RNA, 22 nt, Human
caaccugggugacagagcgaga

SEQ ID NO: 76420 - RNA, 22 nt, Human
caaccugggugacagagugaga

SEQ ID NO: 76421 - RNA, 21 nt, Human
caaccugggugacgagugaga

SEQ ID NO: 76422 - RNA, 22 nt, Human
caaccugggugagagagcgaga

SEQ ID NO: 76423 - RNA, 32 nt, Human
caaccuggucuacauggugaaaccccaucuca

SEQ ID NO: 76424 - RNA, 32 nt, Human
caaccuguaacacauuaaagcuguaauuagca

SEQ ID NO: 76425 - RNA, 32 nt, Human
caaccugucuucaguguaguacaaaggcagag

SEQ ID NO: 76426 - RNA, 32 nt, Human
caaccugugaaaagcugaacagguccaauucu

SEQ ID NO: 76427 - RNA, 32 nt, Human
caaccugugcucagaaggaccccacauuaggu

SEQ ID NO: 76428 - RNA, 32 nt, Human
caaccuguuacagugaggagaucacagugugu

SEQ ID NO: 76429 - RNA, 22 nt, Human
caaccuuauuccaugcugucuu

SEQ ID NO: 76430 - RNA, 23 nt, Human
caaccuucaccuccagguucaag

SEQ ID NO: 76431 - RNA, 24 nt, Human
caaccuucaccuccccgguucaag

SEQ ID NO: 76432 - RNA, 31 nt, Human
caaccuucaguguccaagcagaagaccagug

SEQ ID NO: 76433 - RNA, 32 nt, Human
caaccuucaucccuucuguggcaguuaggaga

SEQ ID NO: 76434 - RNA, 32 nt, Human
caaccuucaucugcacugggcccugugccccu

SEQ ID NO: 76435 - RNA, 32 nt, Human
caaccuuccauguaucuccauccuccccugcu

SEQ ID NO: 76436 - RNA, 32 nt, Human
caaccuucccaauuugugugucaagaaaaugu

SEQ ID NO: 76437 - RNA, 32 nt, Human
caaccuuccccuugaagaccuggaagacccag

SEQ ID NO: 76438 - RNA, 32 nt, Human
caaccuuccucgcccacccccuucccggagaa

SEQ ID NO: 76439 - RNA, 24 nt, Human
caaccuuccucucccagguucaag

SEQ ID NO: 76440 - RNA, 32 nt, Human
caaccuuccuucuuccucauuguggacuugga

SEQ ID NO: 76441 - RNA, 24 nt, Human
caaccuucgccucccagguucaag

SEQ ID NO: 76442 - RNA, 24 nt, Human
caaccuucgccucccggguucaag

SEQ ID NO: 76443 - RNA, 32 nt, Human
caaccuucucauucuccuauccagggauuuaa

SEQ ID NO: 76444 - RNA, 32 nt, Human
caaccuucucuccuugccacccaaaccaaaga

SEQ ID NO: 76445 - RNA, 32 nt, Human
caaccuucugaggaccaggaaauucaaauccc

SEQ ID NO: 76446 - RNA, 21 nt, Human
caaccuucuuuaggagcugcu

SEQ ID NO: 76447 - RNA, 24 nt, Human
caaccuugaacucccaggcucaag

SEQ ID NO: 76448 - RNA, 22 nt, Human
caaccuugaccucccaggcuca

SEQ ID NO: 76449 - RNA, 24 nt, Human
caaccuugaccucccaggcucagg

SEQ ID NO: 76450 - RNA, 24 nt, Human
caaccuugacgucccagguucaag

SEQ ID NO: 76451 - RNA, 24 nt, Human
caaccuuggccuccuagguucaag

SEQ ID NO: 76452 - RNA, 32 nt, Human
caaccuugggcaacauagcaagaccccauuuc

SEQ ID NO: 76453 - RNA, 32 nt, Human
caaccuuggggccagcaucucccacugccucc

SEQ ID NO: 76454 - RNA, 32 nt, Human
caaccuugugcuugacuguccuuucccucugc

SEQ ID NO: 76455 - RNA, 32 nt, Human
caaccuuguggucacaucagaggucaacagca

SEQ ID NO: 76456 - RNA, 32 nt, Human
caaccuuucauuuccuacuucauuccagcagg

SEQ ID NO: 76457 - RNA, 32 nt, Human
caaccuuucccagccccucuucagagggccug

SEQ ID NO: 76458 - RNA, 32 nt, Human
caaccuuucuaccuuaauaucuccccaaaaau

SEQ ID NO: 76459 - RNA, 32 nt, Human
caaccuuucucuucucacgggucugcaguguu

SEQ ID NO: 76460 - RNA, 32 nt, Human
caaccuuugcacuccacugugcaaugcuggcc

SEQ ID NO: 76461 - RNA, 21 nt, Human
caaccuuugccaguauucccu

SEQ ID NO: 76462 - RNA, 24 nt, Human
caaccuuugccucccagguuuaag

SEQ ID NO: 76463 - RNA, 24 nt, Human
caaccuuugccuccuagguucaag

SEQ ID NO: 76464 - RNA, 24 nt, Human
caaccuuugucucccgggcucaag

SEQ ID NO: 76465 - RNA, 32 nt, Human
caacgaagaaaaccuaucuucaguccccaccc

SEQ ID NO: 76466 - RNA, 32 nt, Human
caacgaauagcuccucuacccaagauucuaug

SEQ ID NO: 76467 - RNA, 32 nt, Human
caacgaaugcugcugaagaggagggaggccuc

SEQ ID NO: 76468 - RNA, 32 nt, Human
caacgaauggaaugugugcagauauguauguc

SEQ ID NO: 76469 - RNA, 24 nt, Human
caacgaccauccggcccuagccug

SEQ ID NO: 76470 - RNA, 32 nt, Human
caacgacccucagaugggguagaugccauugc

SEQ ID NO: 76471 - RNA, 32 nt, Human
caacgacgcccuuuuuccuuuuuauacuaaag

SEQ ID NO: 76472 - RNA, 32 nt, Human
caacgacugccucagaaaugggcagagagcau

SEQ ID NO: 76473 - RNA, 32 nt, Human
caacgagccaccacagccaccagucccagaac

SEQ ID NO: 76474 - RNA, 32 nt, Human
caacgaggccugggugccgugugagggccggg

SEQ ID NO: 76475 - RNA, 32 nt, Human
caacgaggguggaucacuugagcccaggaauu

SEQ ID NO: 76476 - RNA, 31 nt, Human
caacgauggguggaaauggcugugggagaag

SEQ ID NO: 76477 - RNA, 32 nt, Human
caacgcaaccgcuuccaccaccaugguguuug

SEQ ID NO: 76478 - RNA, 32 nt, Human
caacgcagcagacuccugggccugaugugcua

SEQ ID NO: 76479 - RNA, 32 nt, Human
caacgcaggaauaaauuccaagauacugaacu

SEQ ID NO: 76480 - RNA, 28 nt, Human
caacgcagugagagacccccaucucuac

SEQ ID NO: 76481 - RNA, 32 nt, Human
caacgcauaaagaaaaauggccgggccagguc

SEQ ID NO: 76482 - RNA, 27 nt, Human
caacgcaucacuggggcugggagcagg

SEQ ID NO: 76483 - RNA, 32 nt, Human
caacgccaaggagaugacccaucuuuugcagu

SEQ ID NO: 76484 - RNA, 32 nt, Human
caacgccauggguucaggcugauccaggagau

SEQ ID NO: 76485 - RNA, 32 nt, Human
caacgccccuccaaaccuccagccucccuguc

SEQ ID NO: 76486 - RNA, 22 nt, Human
caacgccugccucucaggcuca

SEQ ID NO: 76487 - RNA, 32 nt, Human
caacgccugcgaggagcucaggaccagucuuc

SEQ ID NO: 76488 - RNA, 32 nt, Human
caacgcgcuagagaggccgucucaccuccaaa

SEQ ID NO: 76489 - RNA, 32 nt, Human
caacgcgggcacaguggacuucagagaagcau

SEQ ID NO: 76490 - RNA, 32 nt, Human
caacgcggguggauugcuugagcccaggaguu

SEQ ID NO: 76491 - RNA, 32 nt, Human
caacgcggucugguuuuccagccugggagugg

SEQ ID NO: 76492 - RNA, 32 nt, Human
caacgcgucacuuugggcagcguauucccugg

SEQ ID NO: 76493 - RNA, 32 nt, Human
caacgcguuugcaaauauuccccugguagccu

SEQ ID NO: 76494 - RNA, 32 nt, Human
caacgcucagccaacggauucuuuucaagcug

SEQ ID NO: 76495 - RNA, 32 nt, Human
caacgcugaagugccugugaaacacagcccag

SEQ ID NO: 76496 - RNA, 32 nt, Human
caacgcugagccaccuugggaaccuagcugau

SEQ ID NO: 76497 - RNA, 32 nt, Human
caacgcuggugcuugauacacugugaagugaa

SEQ ID NO: 76498 - RNA, 32 nt, Human
caacgcugucggcagagcugacuugccuguac

SEQ ID NO: 76499 - RNA, 32 nt, Human
caacgcuuaccucucuccaacugcuucagcau

SEQ ID NO: 76500 - RNA, 22 nt, Human
caacggaaacuuuuagcuccac

SEQ ID NO: 76501 - RNA, 31 nt, Human
caacggaagagaccucccgcuggggccgggc

SEQ ID NO: 76502 - RNA, 32 nt, Human
caacggaagcaaccucccaacccagaggaggc

SEQ ID NO: 76503 - RNA, 32 nt, Human
caacggaccuaucgaugucuauuugugagaag

SEQ ID NO: 76504 - RNA, 32 nt, Human
caacggagagcgccugccccucccagaacaca

SEQ ID NO: 76505 - RNA, 32 nt, Human
caacggaugccaccagcucuccugcagagccu

SEQ ID NO: 76506 - RNA, 32 nt, Human
caacggaugccugugauucccugguauuuaua

SEQ ID NO: 76507 - RNA, 32 nt, Human
caacggcagagggagugagcaggggagaaaua

SEQ ID NO: 76508 - RNA, 32 nt, Human
caacggccaaguguucagcagugggauaucaa

SEQ ID NO: 76509 - RNA, 32 nt, Human
caacggccacaggacuccagcuccaagugggu

SEQ ID NO: 76510 - RNA, 32 nt, Human
caacggccugcaggacucggcccagcugggua

SEQ ID NO: 76511 - RNA, 32 nt, Human
caacggcuacauuccucccccagggccaaggg

SEQ ID NO: 76512 - RNA, 32 nt, Human
caacggcugacugccuggagcugguguuuuuc

SEQ ID NO: 76513 - RNA, 32 nt, Human
caacggcuggcaagacucaggguccucagugg

SEQ ID NO: 76514 - RNA, 32 nt, Human
caacgggcagaaagaaauccacacagcccggu

SEQ ID NO: 76515 - RNA, 32 nt, Human
caacgggcccuccuccccuccuugcaccggcc

SEQ ID NO: 76516 - RNA, 32 nt, Human
caacggggacaacuccagaaggucauuccaga

SEQ ID NO: 76517 - RNA, 32 nt, Human
caacggggacacaaggaggcagaggagcuaac

SEQ ID NO: 76518 - RNA, 32 nt, Human
caacgggggcggaucacuugaggucagaaguu

SEQ ID NO: 76519 - RNA, 32 nt, Human
caacgggugcccaugggacaccagccugcgag

SEQ ID NO: 76520 - RNA, 32 nt, Human
caacggguguagccacuggugcuuugaagccu

SEQ ID NO: 76521 - RNA, 32 nt, Human
caacggguuccugaggccccuccuggccaggc

SEQ ID NO: 76522 - RNA, 32 nt, Human
caacggucuggcagggcagcaggaggcuuucu

SEQ ID NO: 76523 - RNA, 32 nt, Human
caacgguggcuccggcgguggggaugggaccg

SEQ ID NO: 76524 - RNA, 20 nt, Human
caacguaagauguccuccuu

SEQ ID NO: 76525 - RNA, 32 nt, Human
caacguagcuacucaggaggcugaggugggag

SEQ ID NO: 76526 - RNA, 32 nt, Human
caacguaggaggaucacuugaguucaauacca

SEQ ID NO: 76527 - RNA, 32 nt, Human
caacguaggccuaaucacagcacuuugggagg

SEQ ID NO: 76528 - RNA, 32 nt, Human
caacguauuuuccuacauucucuaauaaaucu

SEQ ID NO: 76529 - RNA, 32 nt, Human
caacgucacugaagggcugaaggaagccaacg

SEQ ID NO: 76530 - RNA, 32 nt, Human
caacgucaggauucagagguaggcucuggagc

SEQ ID NO: 76531 - RNA, 24 nt, Human
caacguccgccucccagguucaag

SEQ ID NO: 76532 - RNA, 32 nt, Human
caacguccucaaggaugccguagccgucaaga

SEQ ID NO: 76533 - RNA, 32 nt, Human
caacgugagccgcgggaacacguccggcgugc

SEQ ID NO: 76534 - RNA, 32 nt, Human
caacgugagggaaggugggaaaugucuugagu

SEQ ID NO: 76535 - RNA, 21 nt, Human
caacgugcgccuccccucccg

SEQ ID NO: 76536 - RNA, 23 nt, Human
caacgugcugggauuacaggcau

SEQ ID NO: 76537 - RNA, 32 nt, Human
caacguggaaaugggcagaggcuggaagaauu

SEQ ID NO: 76538 - RNA, 32 nt, Human
caacguggacacacccgguuccucacaaagcc

SEQ ID NO: 76539 - RNA, 32 nt, Human
caacguggacuugccuccugguguguuuuaaa

SEQ ID NO: 76540 - RNA, 17 nt, Human
caacguggagcccuuga

SEQ ID NO: 76541 - RNA, 32 nt, Human
caacguggcugcugcccugcccaacacucggc

SEQ ID NO: 76542 - RNA, 32 nt, Human
caacguggggcccugacaccacguuaucaaac

SEQ ID NO: 76543 - RNA, 19 nt, Human
caacgugguaaaacccugu

SEQ ID NO: 76544 - RNA, 32 nt, Human
caacguguuagccaggauggucucagucucca

SEQ ID NO: 76545 - RNA, 32 nt, Human
caacguuccucuccaccugcauuauguacuac

SEQ ID NO: 76546 - RNA, 32 nt, Human
caacguuugccucccagccugacucccucggc

SEQ ID NO: 76547 - RNA, 32 nt, Human
caacguuuugcacugauaaacaugagaaucug

SEQ ID NO: 76548 - RNA, 32 nt, Human
caacuaaaaauacaaaaauuagccagguguga

SEQ ID NO: 76549 - RNA, 32 nt, Human
caacuaaaaauauaaaaauuagccaggcgugg

SEQ ID NO: 76550 - RNA, 32 nt, Human
caacuaaaauuuaaaagaagaggaagacucag

SEQ ID NO: 76551 - RNA, 32 nt, Human
caacuaaagagcccucugggccuguguugcug

SEQ ID NO: 76552 - RNA, 32 nt, Human
caacuaaauuuguuuaguacacauuaaagguc

SEQ ID NO: 76553 - RNA, 32 nt, Human
caacuaagccugcuggucagggcuggcuuuca

SEQ ID NO: 76554 - RNA, 32 nt, Human
caacuaauaauacaaaauuagccaggcguggu

SEQ ID NO: 76555 - RNA, 32 nt, Human
caacuaaucaaauaaaugaaugaaugaugaau

SEQ ID NO: 76556 - RNA, 32 nt, Human
caacuacaaaaaguaaggcagcugcagccacc

SEQ ID NO: 76557 - RNA, 32 nt, Human
caacuacaaccagcaaaaagaccagucaugca

SEQ ID NO: 76558 - RNA, 21 nt, Human
caacuacaacucaccggugcc

SEQ ID NO: 76559 - RNA, 21 nt, Human
caacuacaacuuugagauccc

SEQ ID NO: 76560 - RNA, 32 nt, Human
caacuacacaaagcaggcuugcccaguacauu

SEQ ID NO: 76561 - RNA, 30 nt, Human
caacuacagcuccaaucagaaacccugcgc

SEQ ID NO: 76562 - RNA, 32 nt, Human
caacuacccaggaggcugaggcaugagaaucg

SEQ ID NO: 76563 - RNA, 22 nt, Human
caacuaccccuucuucccagag

SEQ ID NO: 76564 - RNA, 32 nt, Human
caacuaccucaaaguuuuguuaucucugcuug

SEQ ID NO: 76565 - RNA, 32 nt, Human
caacuacuacaauuccgccuaggccacaaggc

SEQ ID NO: 76566 - RNA, 32 nt, Human
caacuacuaccuuggugccucaguuuacccau

SEQ ID NO: 76567 - RNA, 22 nt, Human
caacuacucaacucugcucugg

SEQ ID NO: 76568 - RNA, 32 nt, Human
caacuacucaggaggcugcgacaggaaaauug

SEQ ID NO: 76569 - RNA, 32 nt, Human
caacuacuccuggaugcauccuagagaagugc

SEQ ID NO: 76570 - RNA, 32 nt, Human
caacuacuuccgcuagcccaucauggcucagg

SEQ ID NO: 76571 - RNA, 32 nt, Human
caacuacuugggaggcugaggugggaggauug

SEQ ID NO: 76572 - RNA, 32 nt, Human
caacuagaccucuccugccucucccauggcuu

SEQ ID NO: 76573 - RNA, 32 nt, Human
caacuagaggcaguaaccugucauuccagagg

SEQ ID NO: 76574 - RNA, 32 nt, Human
caacuagcggccaugcaguuccucacugacaa

SEQ ID NO: 76575 - RNA, 32 nt, Human
caacuaggcuguagaagagaaauguucaccau

SEQ ID NO: 76576 - RNA, 32 nt, Human
caacuaggggaggagagagggucuccaguguu

SEQ ID NO: 76577 - RNA, 32 nt, Human
caacuauaagcacaaagaagagauaacuucca

SEQ ID NO: 76578 - RNA, 32 nt, Human
caacuauacacaaaccuugaacauuuuacaag

SEQ ID NO: 76579 - RNA, 32 nt, Human
caacuauacuucagaagaauuuuuacuugcaa

SEQ ID NO: 76580 - RNA, 32 nt, Human
caacuauaucuuccugugcauuccgauggaau

SEQ ID NO: 76581 - RNA, 19 nt, Human
caacuaucaucaccaccaa

SEQ ID NO: 76582 - RNA, 31 nt, Human
caacuauccgucucgaauaccagggcagggc

SEQ ID NO: 76583 - RNA, 32 nt, Human
caacuauggaaagaggcagaguuugcuugccc

SEQ ID NO: 76584 - RNA, 32 nt, Human
caacuauggaagggagcugagcuccaguauuu

SEQ ID NO: 76585 - RNA, 32 nt, Human
caacuauguuauaccuggacauuuuagauguu

SEQ ID NO: 76586 - RNA, 32 nt, Human
caacucaacaauauuaguugcauuccuuuaua

SEQ ID NO: 76587 - RNA, 32 nt, Human
caacucaacauggcagaaccauuuuugagaug

SEQ ID NO: 76588 - RNA, 32 nt, Human
caacucaacgcaugcagccacuguagaaaagu

SEQ ID NO: 76589 - RNA, 32 nt, Human
caacucacaacaggcuggauggguggguggua

SEQ ID NO: 76590 - RNA, 32 nt, Human
caacucacagaaggggacugacagugggcaac

SEQ ID NO: 76591 - RNA, 32 nt, Human
caacucacccagcuaauuuuguauuuuuagua

SEQ ID NO: 76592 - RNA, 32 nt, Human
caacucaccgcaaccuccgccucccggguuca

SEQ ID NO: 76593 - RNA, 32 nt, Human
caacucaccgcaaccuccuccucuuggguuca

SEQ ID NO: 76594 - RNA, 32 nt, Human
caacucacgccagggaccuggccaagacaccu

SEQ ID NO: 76595 - RNA, 29 nt, Human
caacucacuaccuggagagaacuuaguaa

SEQ ID NO: 76596 - RNA, 32 nt, Human
caacucacugauuuacuucuagcaauagcaug

SEQ ID NO: 76597 - RNA, 32 nt, Human
caacucacugcaaccccugcucucagguucaa

SEQ ID NO: 76598 - RNA, 32 nt, Human
caacucacugcaaccuccacccgccggguccc

SEQ ID NO: 76599 - RNA, 32 nt, Human
caacucacugcaaccuccgcucccgguuugag

SEQ ID NO: 76600 - RNA, 32 nt, Human
caacucacugcaaccucugcccuucagguuca

SEQ ID NO: 76601 - RNA, 32 nt, Human
caacucacugcaagcuccgccuccuggguuca

SEQ ID NO: 76602 - RNA, 32 nt, Human
caacucacugccugcuggaagcucugugggaa

SEQ ID NO: 76603 - RNA, 32 nt, Human
caacucacuugggguggggaaaggagguaaag

SEQ ID NO: 76604 - RNA, 32 nt, Human
caacucacuuucucccuguuugcuggcccaga

SEQ ID NO: 76605 - RNA, 32 nt, Human
caacucagcccuucaccugugcaccugugacu

SEQ ID NO: 76606 - RNA, 32 nt, Human
caacucagcgaaaaacucagaagguuugggua

SEQ ID NO: 76607 - RNA, 32 nt, Human
caacucagcugguuccacacccuggcaauugu

SEQ ID NO: 76608 - RNA, 32 nt, Human
caacucagcuguucuuucuagcucugaaauag

SEQ ID NO: 76609 - RNA, 32 nt, Human
caacucaggaggcugaggcaggagaaucacuu

SEQ ID NO: 76610 - RNA, 32 nt, Human
caacucaggaggcugaggcaggagaauggcuu

SEQ ID NO: 76611 - RNA, 32 nt, Human
caacucagggcuaaagucauccagugaaacuu

SEQ ID NO: 76612 - RNA, 32 nt, Human
caacucagggcuccagaccucagcuaaaaaga

SEQ ID NO: 76613 - RNA, 32 nt, Human
caacucagggguggagacugaggccucaggag

SEQ ID NO: 76614 - RNA, 32 nt, Human
caacucagucagauggcagacagguggagccc

SEQ ID NO: 76615 - RNA, 32 nt, Human
caacucauauccacguuaucuagcaaaaguca

SEQ ID NO: 76616 - RNA, 32 nt, Human
caacucaugggcucaacucauccuccuaucuu

SEQ ID NO: 76617 - RNA, 32 nt, Human
caacucauugauuucagagauagggaagcuga

SEQ ID NO: 76618 - RNA, 32 nt, Human
caacucauugcaaccuccaccugccggguccc

SEQ ID NO: 76619 - RNA, 32 nt, Human
caacucauuucuuauaucauauuguuaaauaa

SEQ ID NO: 76620 - RNA, 32 nt, Human
caacuccaaauacaucucucccuucuugaaau

SEQ ID NO: 76621 - RNA, 24 nt, Human
caacuccagaucucaggugaucua

SEQ ID NO: 76622 - RNA, 32 nt, Human
caacuccagggccuuuccagggccagacaggu

SEQ ID NO: 76623 - RNA, 32 nt, Human
caacuccaggguuaaagaaaggcagagauugg

SEQ ID NO: 76624 - RNA, 32 nt, Human
caacuccaggugcucagacugccuguggcagc

SEQ ID NO: 76625 - RNA, 32 nt, Human
caacuccagguuaugaaaacaguacuuggaaa

SEQ ID NO: 76626 - RNA, 32 nt, Human
caacuccaucauucacacuggaggauuagagg

SEQ ID NO: 76627 - RNA, 32 nt, Human
caacuccaucccucaccacaguugucuaggaa

SEQ ID NO: 76628 - RNA, 32 nt, Human
caacuccaugaccaggccaccaucuguacccu

SEQ ID NO: 76629 - RNA, 21 nt, Human
caacucccaggccacacacag

SEQ ID NO: 76630 - RNA, 32 nt, Human
caacucccaggccucagaugcaggggcccaga

SEQ ID NO: 76631 - RNA, 23 nt, Human
caacucccauucaugcccaccag

SEQ ID NO: 76632 - RNA, 19 nt, Human
caacucccccaggcucccu

SEQ ID NO: 76633 - RNA, 32 nt, Human
caacuccccugcccucuguuugcaggcacagg

SEQ ID NO: 76634 - RNA, 32 nt, Human
caacuccccuucuaguucccaaaggcgauguc

SEQ ID NO: 76635 - RNA, 32 nt, Human
caacucccuuaaggucuccaaaccagacggug

SEQ ID NO: 76636 - RNA, 32 nt, Human
caacucccuuccccaucucugcucaccaugug

SEQ ID NO: 76637 - RNA, 32 nt, Human
caacuccggagccagccgaccccacauggauu

SEQ ID NO: 76638 - RNA, 32 nt, Human
caacuccuaccuccuccucuugcuucgaucag

SEQ ID NO: 76639 - RNA, 23 nt, Human
caacuccuagccucaagugaucc

SEQ ID NO: 76640 - RNA, 32 nt, Human
caacuccuagugagacagcaggcggaaagauu

SEQ ID NO: 76641 - RNA, 32 nt, Human
caacuccuccuccuccuccuccucuccugcug

SEQ ID NO: 76642 - RNA, 24 nt, Human
caacuccugaccucagauggucca

SEQ ID NO: 76643 - RNA, 24 nt, Human
caacuccugaccucaggcgaucca

SEQ ID NO: 76644 - RNA, 23 nt, Human
caacuccugaccucaggcgaucu

SEQ ID NO: 76645 - RNA, 23 nt, Human
caacuccugaccucagguaaucc

SEQ ID NO: 76646 - RNA, 24 nt, Human
caacuccugaccucaggugaucca

SEQ ID NO: 76647 - RNA, 23 nt, Human
caacuccugaccucaggugaucu

SEQ ID NO: 76648 - RNA, 22 nt, Human
caacuccugacuucaugaucca

SEQ ID NO: 76649 - RNA, 24 nt, Human
caacuccugagcucaggugaucca

SEQ ID NO: 76650 - RNA, 32 nt, Human
caacuccugaggaaagugcuauucuugucucc

SEQ ID NO: 76651 - RNA, 32 nt, Human
caacuccugaugccucauuugagcaccuggau

SEQ ID NO: 76652 - RNA, 23 nt, Human
caacuccugcccucaagugaucc

SEQ ID NO: 76653 - RNA, 23 nt, Human
caacuccuggacucaagugaucc

SEQ ID NO: 76654 - RNA, 32 nt, Human
caacuccuggccucaaaugaucagcccgcuuc

SEQ ID NO: 76655 - RNA, 23 nt, Human
caacuccuggcucagggaaucca

SEQ ID NO: 76656 - RNA, 32 nt, Human
caacuccugggcucaauacucuugccucagcc

SEQ ID NO: 76657 - RNA, 32 nt, Human
caacuccuguaauccauguaacugcuuugagu

SEQ ID NO: 76658 - RNA, 32 nt, Human
caacucgaacugcuuucguccauguuucucac

SEQ ID NO: 76659 - RNA, 32 nt, Human
caacucgaagccaggagggggcuuccagguca

SEQ ID NO: 76660 - RNA, 32 nt, Human
caacucgacucucauuucuucccugcugguaa

SEQ ID NO: 76661 - RNA, 32 nt, Human
caacucgcuccaaguugugcagccgggaccgc

SEQ ID NO: 76662 - RNA, 32 nt, Human
caacucggaagaggaaagaaaggaagucagga

SEQ ID NO: 76663 - RNA, 32 nt, Human
caacucgggaggcugaggcaggagaauggcgu

SEQ ID NO: 76664 - RNA, 32 nt, Human
caacucgucacacccaagcugcuggccuccag

SEQ ID NO: 76665 - RNA, 32 nt, Human
caacucuaaagugcuaauaauaaucucaguua

SEQ ID NO: 76666 - RNA, 32 nt, Human
caacucuacuaaaaauacaaaaauuagggccg

SEQ ID NO: 76667 - RNA, 32 nt, Human
caacucuacuaaaaauauaaaaauuagugagg

SEQ ID NO: 76668 - RNA, 32 nt, Human
caacucuagaaaugcaaaauguuaacagguac

SEQ ID NO: 76669 - RNA, 32 nt, Human
caacucuagaauucaggauguuccuucuauug

SEQ ID NO: 76670 - RNA, 32 nt, Human
caacucuagugugccagcacaggccagacaua

SEQ ID NO: 76671 - RNA, 32 nt, Human
caacucucagaaacuccagcugcccgaaaacu

SEQ ID NO: 76672 - RNA, 32 nt, Human
caacucucaguauuuuggauuauucaagugua

SEQ ID NO: 76673 - RNA, 32 nt, Human
caacucucaguucugaaggaacaaugagaaac

SEQ ID NO: 76674 - RNA, 32 nt, Human
caacucuccagccgaagcugcaggggcaggag

SEQ ID NO: 76675 - RNA, 32 nt, Human
caacucuccuacccucuccucuuccuucuccu

SEQ ID NO: 76676 - RNA, 32 nt, Human
caacucuccugccucagccucccuaguagcug

SEQ ID NO: 76677 - RNA, 32 nt, Human
caacucucuccagcaauagcugcccagcuuug

SEQ ID NO: 76678 - RNA, 32 nt, Human
caacucucucuccccuccucccacucucuucc

SEQ ID NO: 76679 - RNA, 32 nt, Human
caacucucugcugccuuacaaguauuaaauau

SEQ ID NO: 76680 - RNA, 32 nt, Human
caacucugaaaaccuugaacacggccaaaauc

SEQ ID NO: 76681 - RNA, 32 nt, Human
caacucugcagggcuucucucccugccaccac

SEQ ID NO: 76682 - RNA, 32 nt, Human
caacucugcauggccgucuucuuuccccaaac

SEQ ID NO: 76683 - RNA, 32 nt, Human
caacucugccagcccccaccugccaggacguu

SEQ ID NO: 76684 - RNA, 32 nt, Human
caacucugcccacaccugcugcaacacuaaug

SEQ ID NO: 76685 - RNA, 32 nt, Human
caacucugccuugccagaacugaccagugugu

SEQ ID NO: 76686 - RNA, 32 nt, Human
caacucuggaguggcauaguaaaguggcaaag

SEQ ID NO: 76687 - RNA, 32 nt, Human
caacucuggcugcuaaagcggcugccaccugc

SEQ ID NO: 76688 - RNA, 32 nt, Human
caacucuguccccaggaaguugugugacccua

SEQ ID NO: 76689 - RNA, 32 nt, Human
caacucugugcucacagaaacaugcgcuguaa

SEQ ID NO: 76690 - RNA, 32 nt, Human
caacucuguguaccaagaaccccuagcaucag

SEQ ID NO: 76691 - RNA, 32 nt, Human
caacucuguucugaucagugggugggugaggu

SEQ ID NO: 76692 - RNA, 21 nt, Human
caacucuuagagggcacauca

SEQ ID NO: 76693 - RNA, 22 nt, Human
caacucuuauuucacaaacuca

SEQ ID NO: 76694 - RNA, 32 nt, Human
caacucuucagcccccucccccugcacaccug

SEQ ID NO: 76695 - RNA, 32 nt, Human
caacucuucugccucagcaucccaaguagcug

SEQ ID NO: 76696 - RNA, 23 nt, Human
caacucuuggccucaagugaucc

SEQ ID NO: 76697 - RNA, 32 nt, Human
caacucuuucuguucuuucuggcagcuaucuu

SEQ ID NO: 76698 - RNA, 32 nt, Human
caacucuuuucaucccucuccugggucugcgc

SEQ ID NO: 76699 - RNA, 32 nt, Human
caacugaaaaugugaaaguaaccauaucugac

SEQ ID NO: 76700 - RNA, 32 nt, Human
caacugaaagaguuccuucaagaaguuccucu

SEQ ID NO: 76701 - RNA, 32 nt, Human
caacugaaaggaugaaaucacugacuuggauc

SEQ ID NO: 76702 - RNA, 32 nt, Human
caacugaaaugaacucacguguccucacaacu

SEQ ID NO: 76703 - RNA, 32 nt, Human
caacugaacacaaucaguuuuaucacagguau

SEQ ID NO: 76704 - RNA, 21 nt, Human
caacugaaggcauggcggcgg

SEQ ID NO: 76705 - RNA, 32 nt, Human
caacugaaguucugaguuuuuauagggaauuu

SEQ ID NO: 76706 - RNA, 32 nt, Human
caacugaccugcgcuggagcugcucuuaucua

SEQ ID NO: 76707 - RNA, 32 nt, Human
caacugagcagccucuggagaggggccauuaa

SEQ ID NO: 76708 - RNA, 32 nt, Human
caacugagggaaaauuacaaaaacugggcaca

SEQ ID NO: 76709 - RNA, 32 nt, Human
caacugagguccacugaccagaaacaacacca

SEQ ID NO: 76710 - RNA, 32 nt, Human
caacugagucauuugcaagaugagcuaaaaau

SEQ ID NO: 76711 - RNA, 32 nt, Human
caacugauaccauuuucuguugcucagcgccc

SEQ ID NO: 76712 - RNA, 32 nt, Human
caacugauggggccuggagugcaggaggggca

SEQ ID NO: 76713 - RNA, 32 nt, Human
caacugauuuccaugagacaaugacagaaacc

SEQ ID NO: 76714 - RNA, 32 nt, Human
caacugcaacagcaacagcugccaggaccugg

SEQ ID NO: 76715 - RNA, 32 nt, Human
caacugcaacuauuuauuugcaaagaaugcua

SEQ ID NO: 76716 - RNA, 32 nt, Human
caacugcaaugccauccucgccauauaccaaa

SEQ ID NO: 76717 - RNA, 32 nt, Human
caacugcacagagcccugccccaguuucagga

SEQ ID NO: 76718 - RNA, 20 nt, Human
caacugcacagccaccaaca

SEQ ID NO: 76719 - RNA, 32 nt, Human
caacugcacuaggauuucuguaaggaguaauu

SEQ ID NO: 76720 - RNA, 30 nt, Human
caacugcagcucuccaucagcuccugucuc

SEQ ID NO: 76721 - RNA, 32 nt, Human
caacugcauacauagcuccuagcacagugccu

SEQ ID NO: 76722 - RNA, 32 nt, Human
caacugcauggagcugcacucuaggagaagga

SEQ ID NO: 76723 - RNA, 32 nt, Human
caacugcauuuaaaauguuauuagucaguaua

SEQ ID NO: 76724 - RNA, 32 nt, Human
caacugccaagugcuauauucaaagcaggaug

SEQ ID NO: 76725 - RNA, 32 nt, Human
caacugccaccaguccccagcugcagaccuuc

SEQ ID NO: 76726 - RNA, 32 nt, Human
caacugcccgcuggaccccagacucagucugu

SEQ ID NO: 76727 - RNA, 32 nt, Human
caacugcccugccugccucuagcucccagcau

SEQ ID NO: 76728 - RNA, 32 nt, Human
caacugccuuccugccucuccccuuccuccuc

SEQ ID NO: 76729 - RNA, 32 nt, Human
caacugcgagcugcuccacuucucagcucucc

SEQ ID NO: 76730 - RNA, 32 nt, Human
caacugcguuggacaccauaagccacagccuc

SEQ ID NO: 76731 - RNA, 32 nt, Human
caacugcuauugguucuuccacacagcgccug

SEQ ID NO: 76732 - RNA, 32 nt, Human
caacugcucacaugagucaaaauacagcucau

SEQ ID NO: 76733 - RNA, 32 nt, Human
caacugcucggccucuugggccaggcugugcc

SEQ ID NO: 76734 - RNA, 32 nt, Human
caacugcugagucugugggauuaaggggauua

SEQ ID NO: 76735 - RNA, 32 nt, Human
caacugcugcagcucucggcuuccgcccaaca

SEQ ID NO: 76736 - RNA, 32 nt, Human
caacugcugcuguggccuccagcuuggcuggu

SEQ ID NO: 76737 - RNA, 32 nt, Human
caacugcugcuuccacccccuucaccuugacu

SEQ ID NO: 76738 - RNA, 32 nt, Human
caacugcuggguuagcuuuccacagacauaaa

SEQ ID NO: 76739 - RNA, 32 nt, Human
caacugcuucaggaaugggccugagaucccau

SEQ ID NO: 76740 - RNA, 32 nt, Human
caacugcuucaucucugccaacacuaauuuuu

SEQ ID NO: 76741 - RNA, 22 nt, Human
caacugcuuccgucucagagua

SEQ ID NO: 76742 - RNA, 32 nt, Human
caacugcuugccaaauguugguuuacuaugcu

SEQ ID NO: 76743 - RNA, 32 nt, Human
caacugcuuguagauaucauuuuugcagugua

SEQ ID NO: 76744 - RNA, 32 nt, Human
caacugcuuugcaacaguugcugguauauuua

SEQ ID NO: 76745 - RNA, 32 nt, Human
caacuggaaauuccaggaaccaaaaagagcau

SEQ ID NO: 76746 - RNA, 32 nt, Human
caacuggaagcaaagaggguugcucaacgccc

SEQ ID NO: 76747 - RNA, 32 nt, Human
caacuggagccagcaaccagcuauccaucagc

SEQ ID NO: 76748 - RNA, 32 nt, Human
caacuggauucaucauuuuccacauacuuuac

SEQ ID NO: 76749 - RNA, 32 nt, Human
caacuggauugagagacugugaaggaacucgg

SEQ ID NO: 76750 - RNA, 32 nt, Human
caacuggcaaaagcuucuuuucugccuaucuu

SEQ ID NO: 76751 - RNA, 32 nt, Human
caacuggcaaagugcuuucaugcuuuggagau

SEQ ID NO: 76752 - RNA, 32 nt, Human
caacuggccagaccugcacacgccgagggccc

SEQ ID NO: 76753 - RNA, 21 nt, Human
caacuggccggcuuccuggcc

SEQ ID NO: 76754 - RNA, 32 nt, Human
caacuggccuccagggggcauuguuggaauau

SEQ ID NO: 76755 - RNA, 32 nt, Human
caacuggccucgacccucccagcucccuuaga

SEQ ID NO: 76756 - RNA, 32 nt, Human
caacuggcucuuccuccccucacuaagaagac

SEQ ID NO: 76757 - RNA, 32 nt, Human
caacuggcuucucaccagaacauccagugggc

SEQ ID NO: 76758 - RNA, 32 nt, Human
caacugggagggaguccuccgugccucacuua

SEQ ID NO: 76759 - RNA, 32 nt, Human
caacugggaugagauuguugauaacuuugaug

SEQ ID NO: 76760 - RNA, 32 nt, Human
caacugggauuuggggagcuguggagggugca

SEQ ID NO: 76761 - RNA, 32 nt, Human
caacugggcuuuaacaguuucaaucuaugaaa

SEQ ID NO: 76762 - RNA, 32 nt, Human
caacuggggaccccugcauggccacagcucag

SEQ ID NO: 76763 - RNA, 32 nt, Human
caacuggggaccugggcagcaagcuucacacc

SEQ ID NO: 76764 - RNA, 32 nt, Human
caacugggucuugggacacccuccaguaccug

SEQ ID NO: 76765 - RNA, 32 nt, Human
caacugggugacaagggugaggaugagaagug

SEQ ID NO: 76766 - RNA, 32 nt, Human
caacuggguuaauucuccagccacuuuuggug

SEQ ID NO: 76767 - RNA, 32 nt, Human
caacugguaauccagucaguaggcaacugcag

SEQ ID NO: 76768 - RNA, 32 nt, Human
caacuggucuccaccaguauuugucacuuuau

SEQ ID NO: 76769 - RNA, 32 nt, Human
caacugguucugccugucgccuugccacggag

SEQ ID NO: 76770 - RNA, 32 nt, Human
caacugguuuacuugucugucuucuauuaguu

SEQ ID NO: 76771 - RNA, 32 nt, Human
caacuguaaagauguaucaguuuuauuaaaau

SEQ ID NO: 76772 - RNA, 32 nt, Human
caacuguaaauacauggauauauuucugcugu

SEQ ID NO: 76773 - RNA, 32 nt, Human
caacuguaacugacaguggcugccuucucugg

SEQ ID NO: 76774 - RNA, 32 nt, Human
caacuguaugaggaggaggaggaggaggaugu

SEQ ID NO: 76775 - RNA, 32 nt, Human
caacugucaauccagauuugaccucauuugca

SEQ ID NO: 76776 - RNA, 21 nt, Human
caacugucagcucucagggug

SEQ ID NO: 76777 - RNA, 32 nt, Human
caacugucauuucuuuuuccuuaaaacauaug

SEQ ID NO: 76778 - RNA, 32 nt, Human
caacuguccuuucucaauuacacaaaugcugu

SEQ ID NO: 76779 - RNA, 32 nt, Human
caacugucuuaagucccuuccugcugcuguaa

SEQ ID NO: 76780 - RNA, 32 nt, Human
caacugugacuagggcugggggagagguuagg

SEQ ID NO: 76781 - RNA, 32 nt, Human
caacugugaggggagagcagcauggccagguc

SEQ ID NO: 76782 - RNA, 32 nt, Human
caacugugaucacuuuauuacucugaaugccu

SEQ ID NO: 76783 - RNA, 32 nt, Human
caacugugauuucccauguccaaaguggcucu

SEQ ID NO: 76784 - RNA, 32 nt, Human
caacugugcacuccucccuugguggcacccua

SEQ ID NO: 76785 - RNA, 32 nt, Human
caacugugccuggcccaaaaccagaccguuaa

SEQ ID NO: 76786 - RNA, 32 nt, Human
caacuguguaccugugcaauguuuacagaugg

SEQ ID NO: 76787 - RNA, 32 nt, Human
caacugugugugagcugcacuggccucacagc

SEQ ID NO: 76788 - RNA, 32 nt, Human
caacuguuaccuuuguuauaagggaacuacga

SEQ ID NO: 76789 - RNA, 31 nt, Human
caacuguucacugagcugcuguugaauaggg

SEQ ID NO: 76790 - RNA, 22 nt, Human
caacuguucugcggguuggaga

SEQ ID NO: 76791 - RNA, 32 nt, Human
caacuguucugguaugaucuaaaacaaguuua

SEQ ID NO: 76792 - RNA, 32 nt, Human
caacuguugaguugaucacauacauccaaaag

SEQ ID NO: 76793 - RNA, 32 nt, Human
caacuguuggaccugcacugccuuuccagcag

SEQ ID NO: 76794 - RNA, 32 nt, Human
caacuguuuaaucccuucugucuuucuguucu

SEQ ID NO: 76795 - RNA, 32 nt, Human
caacuguuuucagcaccuuuuauauguaagga

SEQ ID NO: 76796 - RNA, 32 nt, Human
caacuuaccaugucggugccguagacgggaga

SEQ ID NO: 76797 - RNA, 32 nt, Human
caacuuagagguggggagcagagaauucucuu

SEQ ID NO: 76798 - RNA, 31 nt, Human
caacuuagccacgucuggccuguguccuugg

SEQ ID NO: 76799 - RNA, 20 nt, Human
caacuuauccccaacaggug

SEQ ID NO: 76800 - RNA, 25 nt, Human
caacuuaucccccaccuccaucccu

SEQ ID NO: 76801 - RNA, 32 nt, Human
caacuucaaguuucagcaacuaccuacaaaag

SEQ ID NO: 76802 - RNA, 32 nt, Human
caacuucacuucucaacuuccugcuuuuuauu

SEQ ID NO: 76803 - RNA, 32 nt, Human
caacuucaggagaccugugagcacacauuagc

SEQ ID NO: 76804 - RNA, 32 nt, Human
caacuucaguccgggcuggaggccgugcacaa

SEQ ID NO: 76805 - RNA, 32 nt, Human
caacuucaguugaaaagagguggauucauguc

SEQ ID NO: 76806 - RNA, 32 nt, Human
caacuucaguugagagggugcaguccagacag

SEQ ID NO: 76807 - RNA, 32 nt, Human
caacuucaugcaguuagaaagacccggaggcc

SEQ ID NO: 76808 - RNA, 32 nt, Human
caacuucauuagcuccagucuguggcuccugg

SEQ ID NO: 76809 - RNA, 32 nt, Human
caacuucauuagcuucugugaugacucaagau

SEQ ID NO: 76810 - RNA, 32 nt, Human
caacuucauuagcuucuguggugacucaagau

SEQ ID NO: 76811 - RNA, 32 nt, Human
caacuucauugaauguaauuguccucaaauca

SEQ ID NO: 76812 - RNA, 32 nt, Human
caacuucauugaauguaauuguccucaaauua

SEQ ID NO: 76813 - RNA, 24 nt, Human
caacuuccaccucccagguucaag

SEQ ID NO: 76814 - RNA, 32 nt, Human
caacuucccacaucauuuuguaugcauaaccu

SEQ ID NO: 76815 - RNA, 32 nt, Human
caacuucccagcggcuuucucuuucugauggg

SEQ ID NO: 76816 - RNA, 24 nt, Human
caacuuccgcaucccagguucaag

SEQ ID NO: 76817 - RNA, 24 nt, Human
caacuuccgcuucccagguucaag

SEQ ID NO: 76818 - RNA, 32 nt, Human
caacuuccuccaccuuucccuuggauucaagu

SEQ ID NO: 76819 - RNA, 32 nt, Human
caacuuccucccuuacagagcauacaacagag

SEQ ID NO: 76820 - RNA, 32 nt, Human
caacuuccucucccacuagggcccugccuuca

SEQ ID NO: 76821 - RNA, 32 nt, Human
caacuuccugcugcucagcuacuuuguccaca

SEQ ID NO: 76822 - RNA, 32 nt, Human
caacuuccuuuccuuucaguucugccaaaugc

SEQ ID NO: 76823 - RNA, 32 nt, Human
caacuucggcugcacccagccccagccccauc

SEQ ID NO: 76824 - RNA, 32 nt, Human
caacuucuccauccuuucugccucucaacauc

SEQ ID NO: 76825 - RNA, 32 nt, Human
caacuucucccauccgagucaccugggccaga

SEQ ID NO: 76826 - RNA, 32 nt, Human
caacuucucgcaauuacuucgauaauucgcaa

SEQ ID NO: 76827 - RNA, 32 nt, Human
caacuucucuugauuugaccucagugcuuuga

SEQ ID NO: 76828 - RNA, 32 nt, Human
caacuucugccaccucucccugggcaauacug

SEQ ID NO: 76829 - RNA, 24 nt, Human
caacuucugccucccaggcucaag

SEQ ID NO: 76830 - RNA, 32 nt, Human
caacuucuggggguugggcaugguggcucgcg

SEQ ID NO: 76831 - RNA, 32 nt, Human
caacuucuucaauuccagaguuucugagaaca

SEQ ID NO: 76832 - RNA, 32 nt, Human
caacuugaagaaaggagcuguugaagauguga

SEQ ID NO: 76833 - RNA, 32 nt, Human
caacuugcaagguggagguuacagugagcuga

SEQ ID NO: 76834 - RNA, 32 nt, Human
caacuugcacuuagaauuucucuagcaguaaa

SEQ ID NO: 76835 - RNA, 32 nt, Human
caacuugcaggcgugcacacacaugcccacau

SEQ ID NO: 76836 - RNA, 32 nt, Human
caacuugccaaaacagauauacucgaaucaga

SEQ ID NO: 76837 - RNA, 32 nt, Human
caacuugccuggggcugucucugucccucggg

SEQ ID NO: 76838 - RNA, 32 nt, Human
caacuuggaagaggaaagaaaagaagucagga

SEQ ID NO: 76839 - RNA, 32 nt, Human
caacuuggagccaaguccccacagcuggauca

SEQ ID NO: 76840 - RNA, 32 nt, Human
caacuuggagugaagucuguggauaagaaggu

SEQ ID NO: 76841 - RNA, 32 nt, Human
caacuuggccaacauggugaaacccugugccu

SEQ ID NO: 76842 - RNA, 32 nt, Human
caacuuggccacugucuuugcagagcugggca

SEQ ID NO: 76843 - RNA, 32 nt, Human
caacuuggcugcaggaaucuuuaaaagaugcu

SEQ ID NO: 76844 - RNA, 32 nt, Human
caacuugggauuccuuuccuuuuuccugccua

SEQ ID NO: 76845 - RNA, 32 nt, Human
caacuuggggccccucuccuccccagcccuuc

SEQ ID NO: 76846 - RNA, 32 nt, Human
caacuuggggcgaaaaguuaaagcgaugccau

SEQ ID NO: 76847 - RNA, 32 nt, Human
caacuuggucucacacaacaaaccucauucga

SEQ ID NO: 76848 - RNA, 19 nt, Human
caacuuggugaaaccuugu

SEQ ID NO: 76849 - RNA, 32 nt, Human
caacuugguggggccuccuuuaaggaugagcc

SEQ ID NO: 76850 - RNA, 32 nt, Human
caacuugucugacuccagccauagugagauuu

SEQ ID NO: 76851 - RNA, 32 nt, Human
caacuugucuuaggcuccacagcugggaacaa

SEQ ID NO: 76852 - RNA, 32 nt, Human
caacuugugugucuuugggagcccugggucuu

SEQ ID NO: 76853 - RNA, 32 nt, Human
caacuuguucacaauucuucugauuucuuggg

SEQ ID NO: 76854 - RNA, 32 nt, Human
caacuuguugguguggaucuauuggcugaucu

SEQ ID NO: 76855 - RNA, 32 nt, Human
caacuuguuuccuccccucaaaguucugccua

SEQ ID NO: 76856 - RNA, 32 nt, Human
caacuuuacucauaucucaaauacaguacauu

SEQ ID NO: 76857 - RNA, 32 nt, Human
caacuuuacugagacaauguagaaagaaguuu

SEQ ID NO: 76858 - RNA, 32 nt, Human
caacuuuaugccacuaagucauagccucaguu

SEQ ID NO: 76859 - RNA, 32 nt, Human
caacuuucauucuuucuuugcacguucauaaa

SEQ ID NO: 76860 - RNA, 32 nt, Human
caacuuuccugccaccuucauccuugccuccc

SEQ ID NO: 76861 - RNA, 32 nt, Human
caacuuuccuuuccuggagcuucuuccuugua

SEQ ID NO: 76862 - RNA, 32 nt, Human
caacuuucuauccuccccuccugcccuguguc

SEQ ID NO: 76863 - RNA, 31 nt, Human
caacuuugacuucuuuugacaaaggacuuua

SEQ ID NO: 76864 - RNA, 32 nt, Human
caacuuugagccugaguggugaaaggaagcaa

SEQ ID NO: 76865 - RNA, 32 nt, Human
caacuuugccaguuuuagagccagucuuugca

SEQ ID NO: 76866 - RNA, 32 nt, Human
caacuuugguuguguguggaaaaggcuuuagc

SEQ ID NO: 76867 - RNA, 32 nt, Human
caacuuugugagagccaccuaagcugaagauu

SEQ ID NO: 76868 - RNA, 32 nt, Human
caacuuuguuuugcacaacacaugaucguaau

SEQ ID NO: 76869 - RNA, 32 nt, Human
caacuuuuaauuauucuccuguccugcaauau

SEQ ID NO: 76870 - RNA, 32 nt, Human
caacuuuucaaagcccaccaauccacauuuuc

SEQ ID NO: 76871 - RNA, 32 nt, Human
caacuuuucccagugguggagugaggacaggg

SEQ ID NO: 76872 - RNA, 32 nt, Human
caacuuuucuaagugagcuuagcaaugagaag

SEQ ID NO: 76873 - RNA, 32 nt, Human
caacuuuucucauguugaagccacugccuuca

SEQ ID NO: 76874 - RNA, 32 nt, Human
caacuuuugaaaacuucacacuuguuaccauu

SEQ ID NO: 76875 - RNA, 32 nt, Human
caacuuuugauagucaugagagaaucaaauaa

SEQ ID NO: 76876 - RNA, 32 nt, Human
caagaaaaauagauguggcaagagaaaaauac

SEQ ID NO: 76877 - RNA, 32 nt, Human
caagaaaacacacgcccugcccugccaccucc

SEQ ID NO: 76878 - RNA, 24 nt, Human
caagaaaacagaaauggcaugcuu

SEQ ID NO: 76879 - RNA, 23 nt, Human
caagaaaacaggugaaggcaugc

SEQ ID NO: 76880 - RNA, 32 nt, Human
caagaaaacauugucuaugaccccagaucaag

SEQ ID NO: 76881 - RNA, 32 nt, Human
caagaaaaccagcaacccagacuuccacuggc

SEQ ID NO: 76882 - RNA, 32 nt, Human
caagaaaagcaguuugcagcaagggcaugugg

SEQ ID NO: 76883 - RNA, 32 nt, Human
caagaaaagcaguuugcaggaaggucaugugg

SEQ ID NO: 76884 - RNA, 32 nt, Human
caagaaaaggaagcuccgucccuucccgcuca

SEQ ID NO: 76885 - RNA, 32 nt, Human
caagaaaccacaucugguucagaagaguguca

SEQ ID NO: 76886 - RNA, 32 nt, Human
caagaaaccuaaaagggaaacaaacucugaca

SEQ ID NO: 76887 - RNA, 32 nt, Human
caagaaacguggacuccagucuggccccuugu

SEQ ID NO: 76888 - RNA, 32 nt, Human
caagaaagaaaagauuguuaugcaagauuucu

SEQ ID NO: 76889 - RNA, 32 nt, Human
caagaaagaagucacugucacagaggcaagcg

SEQ ID NO: 76890 - RNA, 32 nt, Human
caagaaagaaguuaaaaaggagagguggaacc

SEQ ID NO: 76891 - RNA, 32 nt, Human
caagaaagagguuaaaggagaccuggaaaaug

SEQ ID NO: 76892 - RNA, 32 nt, Human
caagaaagaugguacugucacugcagggaaug

SEQ ID NO: 76893 - RNA, 32 nt, Human
caagaaagauucugaauggaagaguggaacaa

SEQ ID NO: 76894 - RNA, 32 nt, Human
caagaaagauuucaucucccaccccagccuca

SEQ ID NO: 76895 - RNA, 22 nt, Human
caagaaaggacccuucagcaag

SEQ ID NO: 76896 - RNA, 32 nt, Human
caagaaagggaguggaggugcagcgaaggacc

SEQ ID NO: 76897 - RNA, 32 nt, Human
caagaaaggggcacuugugauccagacaaugg

SEQ ID NO: 76898 - RNA, 32 nt, Human
caagaaagucagaccuguuucuuguaacuggg

SEQ ID NO: 76899 - RNA, 25 nt, Human
caagaaagugaaaccauccaugcua

SEQ ID NO: 76900 - RNA, 19 nt, Human
caagaaauccucaccagca

SEQ ID NO: 76901 - RNA, 32 nt, Human
caagaaaucugagccaaaacuugacauugugg

SEQ ID NO: 76902 - RNA, 32 nt, Human
caagaaaugaaaccaggaagguuuucagauca

SEQ ID NO: 76903 - RNA, 24 nt, Human
caagaaaugauaccccuucagcaa

SEQ ID NO: 76904 - RNA, 18 nt, Human
caagaaauggaaauucua

SEQ ID NO: 76905 - RNA, 19 nt, Human
caagaaaugggcagacguc

SEQ ID NO: 76906 - RNA, 21 nt, Human
caagaaauggggaaaggauuc

SEQ ID NO: 76907 - RNA, 32 nt, Human
caagaaauguaaugcaaaggacucauuuuaca

SEQ ID NO: 76908 - RNA, 20 nt, Human
caagaaauuagucagggcga

SEQ ID NO: 76909 - RNA, 32 nt, Human
caagaaauucuccuuuggcuuuguuuuucuga

SEQ ID NO: 76910 - RNA, 32 nt, Human
caagaaauuguauguucccacucuccacuucc

SEQ ID NO: 76911 - RNA, 32 nt, Human
caagaacaaagccacugacugagauggaguga

SEQ ID NO: 76912 - RNA, 32 nt, Human
caagaacaagauggugaaaguauaccugagaa

SEQ ID NO: 76913 - RNA, 30 nt, Human
caagaacaaucagagaaaaaugauaccacc

SEQ ID NO: 76914 - RNA, 32 nt, Human
caagaacaccccacagcaccaaccagcagggc

SEQ ID NO: 76915 - RNA, 32 nt, Human
caagaacacuuucugcccucccuuggaucucc

SEQ ID NO: 76916 - RNA, 32 nt, Human
caagaacagaauaacgaucacagggaaaggac

SEQ ID NO: 76917 - RNA, 32 nt, Human
caagaacagauguguuagggagaggggcuuca

SEQ ID NO: 76918 - RNA, 32 nt, Human
caagaaccaccacaccuggccuugggagcugc

SEQ ID NO: 76919 - RNA, 32 nt, Human
caagaaccagaacuuacaucacugccuccgag

SEQ ID NO: 76920 - RNA, 32 nt, Human
caagaacccaggcugaucccagacaugcagcu

SEQ ID NO: 76921 - RNA, 32 nt, Human
caagaacccaucucaaacaaacaaacaaacaa

SEQ ID NO: 76922 - RNA, 32 nt, Human
caagaaccugaacuccugcuggcugauggaag

SEQ ID NO: 76923 - RNA, 32 nt, Human
caagaaccuggccagguguugauuaccuuuua

SEQ ID NO: 76924 - RNA, 32 nt, Human
caagaaccugggaggcggagcuugcagugagc

SEQ ID NO: 76925 - RNA, 32 nt, Human
caagaaccugugccccuccuuccuaaccugag

SEQ ID NO: 76926 - RNA, 32 nt, Human
caagaacgugacguucgugauguccugcccgc

SEQ ID NO: 76927 - RNA, 32 nt, Human
caagaacuaggugaaucaggaauugauugcau

SEQ ID NO: 76928 - RNA, 32 nt, Human
caagaacuauacuugcaacucuuuuugaaucc

SEQ ID NO: 76929 - RNA, 19 nt, Human
caagaacucaacuggcaag

SEQ ID NO: 76930 - RNA, 32 nt, Human
caagaacuccagaaaucaggagacggagacau

SEQ ID NO: 76931 - RNA, 32 nt, Human
caagaacugcaacaggcucuccuggguccugc

SEQ ID NO: 76932 - RNA, 32 nt, Human
caagaacugcagcugcacaucgcccgcccgcc

SEQ ID NO: 76933 - RNA, 32 nt, Human
caagaacugcagcuucaaaucagugccaaugu

SEQ ID NO: 76934 - RNA, 32 nt, Human
caagaacugggcuggaauuagcagaaaguuag

SEQ ID NO: 76935 - RNA, 32 nt, Human
caagaagaaagccaagggcaaggccaagggca

SEQ ID NO: 76936 - RNA, 32 nt, Human
caagaagaaaggcaagccagcaagcaugguga

SEQ ID NO: 76937 - RNA, 32 nt, Human
caagaagaaauaccaauaacacacacagaaca

SEQ ID NO: 76938 - RNA, 32 nt, Human
caagaagaaauccaucaugucaccuuagacuu

SEQ ID NO: 76939 - RNA, 32 nt, Human
caagaagaagaagaagucaggucagcagaaaa

SEQ ID NO: 76940 - RNA, 32 nt, Human
caagaagaagcugccaagaagugacccuugcc

SEQ ID NO: 76941 - RNA, 32 nt, Human
caagaagaagcugccaagaagugcccuugccc

SEQ ID NO: 76942 - RNA, 32 nt, Human
caagaagaaggugaugaugacaagagagcguc

SEQ ID NO: 76943 - RNA, 32 nt, Human
caagaagaauccuuaccacuguuuccagagcc

SEQ ID NO: 76944 - RNA, 20 nt, Human
caagaagaccuugggaaaug

SEQ ID NO: 76945 - RNA, 31 nt, Human
caagaagagaaacugcccugaauguucaaua

SEQ ID NO: 76946 - RNA, 32 nt, Human
caagaagagacagcgugaugccucccacaguc

SEQ ID NO: 76947 - RNA, 32 nt, Human
caagaagagagaaucacuugagcucaggaguu

SEQ ID NO: 76948 - RNA, 32 nt, Human
caagaagaugcugaaaaauuaggauuuuccga

SEQ ID NO: 76949 - RNA, 24 nt, Human
caagaagaugggcagcagcuccau

SEQ ID NO: 76950 - RNA, 32 nt, Human
caagaagcaacaacucuguugaucagaaccug

SEQ ID NO: 76951 - RNA, 32 nt, Human
caagaagcaauacaguguaacaugucacuugu

SEQ ID NO: 76952 - RNA, 32 nt, Human
caagaagcagaggcuaguucacccacucuggg

SEQ ID NO: 76953 - RNA, 32 nt, Human
caagaagcagaggcucaggcuccaucccaagc

SEQ ID NO: 76954 - RNA, 32 nt, Human
caagaagcaggagugcuucagucaucccagca

SEQ ID NO: 76955 - RNA, 32 nt, Human
caagaagccaugcuguuaacaguuuaucucaa

SEQ ID NO: 76956 - RNA, 32 nt, Human
caagaagcggaaggcgccuccaccucccgcca

SEQ ID NO: 76957 - RNA, 20 nt, Human
caagaagcugagcuggcaga

SEQ ID NO: 76958 - RNA, 23 nt, Human
caagaagcugggauuacaggcau

SEQ ID NO: 76959 - RNA, 32 nt, Human
caagaagcugucacagaugauggaagaaaacc

SEQ ID NO: 76960 - RNA, 32 nt, Human
caagaagcuuuuccaggacagggucaugucuu

SEQ ID NO: 76961 - RNA, 32 nt, Human
caagaaggaaagcaccagaagugauuuggaag

SEQ ID NO: 76962 - RNA, 32 nt, Human
caagaaggaagcucuaaugugugcuuuguauc

SEQ ID NO: 76963 - RNA, 32 nt, Human
caagaaggaaggaggcagacugauggcgauuc

SEQ ID NO: 76964 - RNA, 32 nt, Human
caagaaggagaaccuacucuccacucuuugca

SEQ ID NO: 76965 - RNA, 32 nt, Human
caagaaggagagaagcgaaggaguggggacuu

SEQ ID NO: 76966 - RNA, 32 nt, Human
caagaaggagaggugaagguggcguguggugg

SEQ ID NO: 76967 - RNA, 32 nt, Human
caagaaggaggaagacaagaaguggacuggag

SEQ ID NO: 76968 - RNA, 32 nt, Human
caagaaggaggaggaggagagaaaggcggcuc

SEQ ID NO: 76969 - RNA, 32 nt, Human
caagaaggaggaggggacggggagcugagacc

SEQ ID NO: 76970 - RNA, 32 nt, Human
caagaaggaguuguguuugagguggggucugg

SEQ ID NO: 76971 - RNA, 32 nt, Human
caagaaggaucagcccuuucugugccagccuc

SEQ ID NO: 76972 - RNA, 22 nt, Human
caagaaggauguccaagggaug

SEQ ID NO: 76973 - RNA, 32 nt, Human
caagaaggcccaguugccacagauuauacaac

SEQ ID NO: 76974 - RNA, 32 nt, Human
caagaaggcuuaguagcucagucuuuaacaag

SEQ ID NO: 76975 - RNA, 20 nt, Human
caagaagggaccgggcgaug

SEQ ID NO: 76976 - RNA, 32 nt, Human
caagaagggagagagaguggaugccagggaca

SEQ ID NO: 76977 - RNA, 32 nt, Human
caagaaggggaaacugaggcccagggaggaga

SEQ ID NO: 76978 - RNA, 32 nt, Human
caagaaggggagggagcgggagagggaggaga

SEQ ID NO: 76979 - RNA, 32 nt, Human
caagaaggggcgcagacaggaguccugagaug

SEQ ID NO: 76980 - RNA, 32 nt, Human
caagaagguauuucaaaaaugggaaaugcuau

SEQ ID NO: 76981 - RNA, 32 nt, Human
caagaagguauuuucugcugaccugauagauc

SEQ ID NO: 76982 - RNA, 32 nt, Human
caagaaguaccugaggaguggaggagugagaa

SEQ ID NO: 76983 - RNA, 32 nt, Human
caagaaguagagcacagaagcaaagauuuuaa

SEQ ID NO: 76984 - RNA, 32 nt, Human
caagaagucccaugcuggacugcuccauugcu

SEQ ID NO: 76985 - RNA, 32 nt, Human
caagaaguccccagcagcacacacacauuucc

SEQ ID NO: 76986 - RNA, 32 nt, Human
caagaagugcaaggaucaguagccaggaccag

SEQ ID NO: 76987 - RNA, 32 nt, Human
caagaaguggccuggcugccucacugcuucaa

SEQ ID NO: 76988 - RNA, 32 nt, Human
caagaagugggugcccuugguagcagccuggg

SEQ ID NO: 76989 - RNA, 32 nt, Human
caagaaguuugcgcccucauagcagcgaccuu

SEQ ID NO: 76990 - RNA, 32 nt, Human
caagaauagcacaaauugaacuuuuacauucu

SEQ ID NO: 76991 - RNA, 32 nt, Human
caagaaucauuuucucaguucucuucuuucuu

SEQ ID NO: 76992 - RNA, 32 nt, Human
caagaaucggcucccagacaccugccacucgu

SEQ ID NO: 76993 - RNA, 32 nt, Human
caagaaucugcagcuaacuuauuuuccccuag

SEQ ID NO: 76994 - RNA, 32 nt, Human
caagaaucuugguuugccuuccagaaaacaaa

SEQ ID NO: 76995 - RNA, 32 nt, Human
caagaaucuuugguucaaggagcaccaguucc

SEQ ID NO: 76996 - RNA, 32 nt, Human
caagaaugagccaccgugccuggccuauuuua

SEQ ID NO: 76997 - RNA, 32 nt, Human
caagaaugcaccacugcaguccagccuaggca

SEQ ID NO: 76998 - RNA, 30 nt, Human
caagaaugcagguggggaaggaagagaagc

SEQ ID NO: 76999 - RNA, 32 nt, Human
caagaauggcaacuauugauugcauucaaacg

SEQ ID NO: 77000 - RNA, 32 nt, Human
caagaaugggacaauccuuccuuguaucaaaa

SEQ ID NO: 77001 - RNA, 32 nt, Human
caagaauggucuuucugaauugcacaugugag

SEQ ID NO: 77002 - RNA, 20 nt, Human
caagaaugugcagaagaaau

SEQ ID NO: 77003 - RNA, 32 nt, Human
caagaauguuuugcuagagcuaacagacauag

SEQ ID NO: 77004 - RNA, 32 nt, Human
caagaauucaugccauggauugggccaauguu

SEQ ID NO: 77005 - RNA, 32 nt, Human
caagaauugcagcccuuccucuuugggcuguu

SEQ ID NO: 77006 - RNA, 32 nt, Human
caagaauuggagcaugcaaagaaugggacuug

SEQ ID NO: 77007 - RNA, 18 nt, Human
caagaauugggguuugga

SEQ ID NO: 77008 - RNA, 32 nt, Human
caagaauuucuggaagaaaggcuguggaaggg

SEQ ID NO: 77009 - RNA, 21 nt, Human
caagaauuugggaaacacaga

SEQ ID NO: 77010 - RNA, 27 nt, Human
caagaauuuuaauuuauucaucuugcu

SEQ ID NO: 77011 - RNA, 32 nt, Human
caagacaaaacugaaacccucuuuccaggacc

SEQ ID NO: 77012 - RNA, 32 nt, Human
caagacaaacauguuagauaacaaaacacuuc

SEQ ID NO: 77013 - RNA, 32 nt, Human
caagacaaagccucccaccagacuuggagauu

SEQ ID NO: 77014 - RNA, 16 nt, Human
caagacaacuggcaag

SEQ ID NO: 77015 - RNA, 24 nt, Human
caagacaagccacuccgacaaggu

SEQ ID NO: 77016 - RNA, 32 nt, Human
caagacaaggucuugcuauguugcccaggcug

SEQ ID NO: 77017 - RNA, 32 nt, Human
caagacacaugagacauagauuagaaaacaug

SEQ ID NO: 77018 - RNA, 17 nt, Human
caagacacccuggcaaa

SEQ ID NO: 77019 - RNA, 22 nt, Human
caagacaccugugaucuggaaa

SEQ ID NO: 77020 - RNA, 32 nt, Human
caagacacggcccagacagggagcagguucug

SEQ ID NO: 77021 - RNA, 32 nt, Human
caagacagagucuugcucugucacccaggcua

SEQ ID NO: 77022 - RNA, 32 nt, Human
caagacagagucuugcucugucgcccaggcug

SEQ ID NO: 77023 - RNA, 32 nt, Human
caagacagagucuugcucuguugcccaagcug

SEQ ID NO: 77024 - RNA, 32 nt, Human
caagacagcaccacugcacuccagccugggug

SEQ ID NO: 77025 - RNA, 32 nt, Human
caagacagcaccauugcaccccagccugagca

SEQ ID NO: 77026 - RNA, 21 nt, Human
caagacagcagccugccugua

SEQ ID NO: 77027 - RNA, 19 nt, Human
caagacagcagcuccgagg

SEQ ID NO: 77028 - RNA, 32 nt, Human
caagacagcucugagcagcugugggcaaagag

SEQ ID NO: 77029 - RNA, 32 nt, Human
caagacaggaagggaaaagcaaauuucuaauu

SEQ ID NO: 77030 - RNA, 32 nt, Human
caagacaggaggaucacuucaggccaggaguu

SEQ ID NO: 77031 - RNA, 32 nt, Human
caagacaggaggaucacuugaggccaggaguc

SEQ ID NO: 77032 - RNA, 32 nt, Human
caagacaggaggaucacuuuaggcccagaguu

SEQ ID NO: 77033 - RNA, 32 nt, Human
caagacaggagguuugcguccugauggcuuug

SEQ ID NO: 77034 - RNA, 32 nt, Human
caagacaggaugcacagcugaauuggaggaga

SEQ ID NO: 77035 - RNA, 32 nt, Human
caagacaggccugccagagcagcagggguggg

SEQ ID NO: 77036 - RNA, 32 nt, Human
caagacagguagaucacuugagaucaggaguu

SEQ ID NO: 77037 - RNA, 32 nt, Human
caagacagguggaucucuugagcccaggaguu

SEQ ID NO: 77038 - RNA, 32 nt, Human
caagacagugagacagucuggaaagugauguc

SEQ ID NO: 77039 - RNA, 32 nt, Human
caagacagugccauugcacuccagccugcaca

SEQ ID NO: 77040 - RNA, 32 nt, Human
caagacaguggcacuaaaauguuuaauucauu

SEQ ID NO: 77041 - RNA, 32 nt, Human
caagacaguggcagggagagccugaacuuuau

SEQ ID NO: 77042 - RNA, 32 nt, Human
caagacagugucuugucuuucugugauuugua

SEQ ID NO: 77043 - RNA, 24 nt, Human
caagacauagcccugugacaaggu

SEQ ID NO: 77044 - RNA, 32 nt, Human
caagacaucagacacacccaacccaaaggcgu

SEQ ID NO: 77045 - RNA, 32 nt, Human
caagacaucucuggguucugcagcagcacgca

SEQ ID NO: 77046 - RNA, 32 nt, Human
caagacaugaaaagcugccauucuucuuaacc

SEQ ID NO: 77047 - RNA, 31 nt, Human
caagacaugagugaaagccaggaugaaguuc

SEQ ID NO: 77048 - RNA, 24 nt, Human
caagacaugauauugcugcuuuua

SEQ ID NO: 77049 - RNA, 32 nt, Human
caagacaugccccuugaggcucagccauaaga

SEQ ID NO: 77050 - RNA, 32 nt, Human
caagacauggggacuuugcagugagcaauggg

SEQ ID NO: 77051 - RNA, 32 nt, Human
caagacauuuauacauuaauugcugucaaaga

SEQ ID NO: 77052 - RNA, 32 nt, Human
caagaccaaacagauaucuaaacacuacaacc

SEQ ID NO: 77053 - RNA, 32 nt, Human
caagaccaaagaaggaaggaagguggacggug

SEQ ID NO: 77054 - RNA, 32 nt, Human
caagaccaacugaccuucuccuaggcagcucc

SEQ ID NO: 77055 - RNA, 32 nt, Human
caagaccaagcccagaaaaccccugcagagug

SEQ ID NO: 77056 - RNA, 32 nt, Human
caagaccaagcccagacaaccccugcagagug

SEQ ID NO: 77057 - RNA, 32 nt, Human
caagaccaagcccagacaacccuugcagagcg

SEQ ID NO: 77058 - RNA, 32 nt, Human
caagaccaagcccagauaacccuugcagagug

SEQ ID NO: 77059 - RNA, 32 nt, Human
caagaccaaugccccagagcagugcagccacc

SEQ ID NO: 77060 - RNA, 32 nt, Human
caagaccacagcucugugauccuuccggugga

SEQ ID NO: 77061 - RNA, 32 nt, Human
caagaccacggaugcuuugucucagcucggau

SEQ ID NO: 77062 - RNA, 32 nt, Human
caagaccagcagaagagugggcaaacaugaaa

SEQ ID NO: 77063 - RNA, 32 nt, Human
caagaccagccuagccaagauggugaaacccc

SEQ ID NO: 77064 - RNA, 32 nt, Human
caagaccagccuggacaacacagcagaccccg

SEQ ID NO: 77065 - RNA, 32 nt, Human
caagaccagccuggacagcuuagugagauccc

SEQ ID NO: 77066 - RNA, 32 nt, Human
caagaccagccuggccaaacauggugaaaccc

SEQ ID NO: 77067 - RNA, 22 nt, Human
caagaccagccuggccaacaug

SEQ ID NO: 77068 - RNA, 32 nt, Human
caagaccagccuggccaacauggugaacccca

SEQ ID NO: 77069 - RNA, 32 nt, Human
caagaccagccuggccaagauggugaaacccc

SEQ ID NO: 77070 - RNA, 32 nt, Human
caagaccagccuggccaagauggugaaauccc

SEQ ID NO: 77071 - RNA, 32 nt, Human
caagaccagccuggccaagauggugaaauccu

SEQ ID NO: 77072 - RNA, 22 nt, Human
caagaccagccuggccaaugug

SEQ ID NO: 77073 - RNA, 32 nt, Human
caagaccagccuggccacauggugcaaccccg

SEQ ID NO: 77074 - RNA, 32 nt, Human
caagaccagccuggccagcauagugaaacccu

SEQ ID NO: 77075 - RNA, 18 nt, Human
caagaccagccuggcgaa

SEQ ID NO: 77076 - RNA, 22 nt, Human
caagaccagccugggcaacaug

SEQ ID NO: 77077 - RNA, 32 nt, Human
caagaccagcuugggcaucacagcgagacccc

SEQ ID NO: 77078 - RNA, 32 nt, Human
caagaccaggguggggaucagguuuggccagg

SEQ ID NO: 77079 - RNA, 32 nt, Human
caagaccagucacucccucugccuucaggcuu

SEQ ID NO: 77080 - RNA, 32 nt, Human
caagaccaucagagagcaaaccacauguucug

SEQ ID NO: 77081 - RNA, 32 nt, Human
caagacccacccgccucagcccagcccaggca

SEQ ID NO: 77082 - RNA, 32 nt, Human
caagacccagaccaccccaggucuccuucgug

SEQ ID NO: 77083 - RNA, 32 nt, Human
caagacccaggacaaggaacagcaagcucagg

SEQ ID NO: 77084 - RNA, 32 nt, Human
caagacccaguucauucugccaaagggaaaag

SEQ ID NO: 77085 - RNA, 32 nt, Human
caagacccaucucuacaagaaauuuaaaaacu

SEQ ID NO: 77086 - RNA, 32 nt, Human
caagaccccaucucagcaaaacaauaaaaauu

SEQ ID NO: 77087 - RNA, 32 nt, Human
caagacccccaagaaacccugaugucuggcug

SEQ ID NO: 77088 - RNA, 32 nt, Human
caagaccccuaguggaugccugaaaccucaga

SEQ ID NO: 77089 - RNA, 32 nt, Human
caagaccccuggcaaacugggcacuuggccua

SEQ ID NO: 77090 - RNA, 32 nt, Human
caagacccucuacgaacauucuuugggccucc

SEQ ID NO: 77091 - RNA, 32 nt, Human
caagacccugcaggagucgagcuuugaggaca

SEQ ID NO: 77092 - RNA, 32 nt, Human
caagacccugucucuuuaaaaauaacaaaaau

SEQ ID NO: 77093 - RNA, 32 nt, Human
caagaccgcaccacugcacuccagccugggcg

SEQ ID NO: 77094 - RNA, 32 nt, Human
caagaccgccauuggcucagugcagugggaau

SEQ ID NO: 77095 - RNA, 19 nt, Human
caagaccggccacauccca

SEQ ID NO: 77096 - RNA, 32 nt, Human
caagaccucagcccaggcagaagcugcucuag

SEQ ID NO: 77097 - RNA, 32 nt, Human
caagaccucuucccucugggccuguucucuug

SEQ ID NO: 77098 - RNA, 32 nt, Human
caagaccugaagcccugggucugggugugaau

SEQ ID NO: 77099 - RNA, 32 nt, Human
caagaccugcagcugcugaaaaucagcuuugc

SEQ ID NO: 77100 - RNA, 32 nt, Human
caagacgcaggucagguugccgucgagcccgg

SEQ ID NO: 77101 - RNA, 32 nt, Human
caagacgccaggagaggcucaggccugggagu

SEQ ID NO: 77102 - RNA, 32 nt, Human
caagacgccauugcaccccagccugggcaaug

SEQ ID NO: 77103 - RNA, 32 nt, Human
caagacgcugcaacagcucagcgcggcuccca

SEQ ID NO: 77104 - RNA, 32 nt, Human
caagacggaguuucaccauguuggccaggcug

SEQ ID NO: 77105 - RNA, 32 nt, Human
caagacgggaugauugcuugagcucaggaguu

SEQ ID NO: 77106 - RNA, 32 nt, Human
caagacggguggaucacuugaggucaggaguu

SEQ ID NO: 77107 - RNA, 18 nt, Human
caagacuacagcugcagg

SEQ ID NO: 77108 - RNA, 32 nt, Human
caagacuacgccacugcacuccagccuggagg

SEQ ID NO: 77109 - RNA, 32 nt, Human
caagacuagccuggccaacauguuguaaaccc

SEQ ID NO: 77110 - RNA, 32 nt, Human
caagacuauagacugaacuguaauuuuuacca

SEQ ID NO: 77111 - RNA, 32 nt, Human
caagacuaucagaagaaauauuuaaauuucca

SEQ ID NO: 77112 - RNA, 32 nt, Human
caagacuaugccacugcacucccgccugggug

SEQ ID NO: 77113 - RNA, 32 nt, Human
caagacucacacacaggaccacagcagcauca

SEQ ID NO: 77114 - RNA, 32 nt, Human
caagacucaccucccuuccccucugcaggccg

SEQ ID NO: 77115 - RNA, 32 nt, Human
caagacucagucucaaaacaaaaacaaaaaca

SEQ ID NO: 77116 - RNA, 32 nt, Human
caagacucauacacacugccaguggggagcua

SEQ ID NO: 77117 - RNA, 32 nt, Human
caagacuccaucucaaaaacaaaaacaaaaca

SEQ ID NO: 77118 - RNA, 32 nt, Human
caagacuccaucucaaaaacaaacaaacaaaa

SEQ ID NO: 77119 - RNA, 32 nt, Human
caagacuccaucucaacaacaacaacaacaaa

SEQ ID NO: 77120 - RNA, 32 nt, Human
caagacuccaucucagaaaagaagcagaaagc

SEQ ID NO: 77121 - RNA, 28 nt, Human
caagacucccaugcugccucauuuguau

SEQ ID NO: 77122 - RNA, 32 nt, Human
caagacuccucacuugcccagaaagcuccuug

SEQ ID NO: 77123 - RNA, 32 nt, Human
caagacucugcucuccucgggcccuguggugc

SEQ ID NO: 77124 - RNA, 32 nt, Human
caagacucugucucaaaaacaaacaaacaaac

SEQ ID NO: 77125 - RNA, 32 nt, Human
caagacucugucucaaaaacaagcaaacagac

SEQ ID NO: 77126 - RNA, 32 nt, Human
caagacucugucucaaaacaaaacaaaacaaa

SEQ ID NO: 77127 - RNA, 32 nt, Human
caagacucugucucaaaacaaacacaaauaca

SEQ ID NO: 77128 - RNA, 32 nt, Human
caagacucugucucaaaacaaguuauauuucu

SEQ ID NO: 77129 - RNA, 32 nt, Human
caagacucuguggaguuuguucagugguacgg

SEQ ID NO: 77130 - RNA, 32 nt, Human
caagacucuuccucucgggagaucuuguaaua

SEQ ID NO: 77131 - RNA, 32 nt, Human
caagacucuuguugccuuucuuccaagccaug

SEQ ID NO: 77132 - RNA, 32 nt, Human
caagacugaaagucauuacugcccuuuuccug

SEQ ID NO: 77133 - RNA, 32 nt, Human
caagacugaacucagcacacuccugggaaucu

SEQ ID NO: 77134 - RNA, 32 nt, Human
caagacugaccacagguuucaugagaaggucc

SEQ ID NO: 77135 - RNA, 32 nt, Human
caagacugagucuagaugauuucuuggguacc

SEQ ID NO: 77136 - RNA, 32 nt, Human
caagacugauucuguuuggaacaguuuccuau

SEQ ID NO: 77137 - RNA, 32 nt, Human
caagacugcaccacugcacuccagccugggca

SEQ ID NO: 77138 - RNA, 32 nt, Human
caagacugcagaucagcaccucucugcccaga

SEQ ID NO: 77139 - RNA, 32 nt, Human
caagacugcgccacugcacuccagccugggca

SEQ ID NO: 77140 - RNA, 32 nt, Human
caagacugcgccaggugacaccagagcauuuc

SEQ ID NO: 77141 - RNA, 32 nt, Human
caagacugcgccaggugacaccagaguguuuc

SEQ ID NO: 77142 - RNA, 32 nt, Human
caagacugcgccauugcacuccagcccgggca

SEQ ID NO: 77143 - RNA, 23 nt, Human
caagacugcuuuuccacugcacu

SEQ ID NO: 77144 - RNA, 32 nt, Human
caagacuggacucagcacacuccugggaaucu

SEQ ID NO: 77145 - RNA, 32 nt, Human
caagacuggcccuucccaggcaggagaaagga

SEQ ID NO: 77146 - RNA, 32 nt, Human
caagacugggcuguaggggagcuggacuacuu

SEQ ID NO: 77147 - RNA, 32 nt, Human
caagacuggugccccuugcugaucugagcgcu

SEQ ID NO: 77148 - RNA, 32 nt, Human
caagacugugccacugcacuccagccugggug

SEQ ID NO: 77149 - RNA, 32 nt, Human
caagacuguucacaucaucucucuaacauugc

SEQ ID NO: 77150 - RNA, 32 nt, Human
caagacuguugaugccuuagccuugcacucca

SEQ ID NO: 77151 - RNA, 32 nt, Human
caagacuuagaggaacugacugggggaaacgu

SEQ ID NO: 77152 - RNA, 19 nt, Human
caagacuucugcuggcaag

SEQ ID NO: 77153 - RNA, 32 nt, Human
caagacuucuuuaauggauaguaucauuuacu

SEQ ID NO: 77154 - RNA, 32 nt, Human
caagacuugaggccauugaagcugcaggaagc

SEQ ID NO: 77155 - RNA, 32 nt, Human
caagacuugggacuucagugaugcacuugugc

SEQ ID NO: 77156 - RNA, 32 nt, Human
caagacuuguguuccucaacuuucuuggguuu

SEQ ID NO: 77157 - RNA, 32 nt, Human
caagagaaaaacaaacauaaauuuauuagcgg

SEQ ID NO: 77158 - RNA, 32 nt, Human
caagagaaaagccaucauauuacuugggaucu

SEQ ID NO: 77159 - RNA, 32 nt, Human
caagagaaaguuguaacucucuggucuucaua

SEQ ID NO: 77160 - RNA, 32 nt, Human
caagagaagauaaggaagacaagaucucaacc

SEQ ID NO: 77161 - RNA, 32 nt, Human
caagagaaggcagccaacaugaaggaaaaugu

SEQ ID NO: 77162 - RNA, 32 nt, Human
caagagaaggcuuuaagaaagacgguauuaau

SEQ ID NO: 77163 - RNA, 32 nt, Human
caagagaauaauugcauuuuaaacccauauua

SEQ ID NO: 77164 - RNA, 32 nt, Human
caagagaauaauugcauuuuaaacccauguua

SEQ ID NO: 77165 - RNA, 32 nt, Human
caagagaaugaccagugaccuugcuuccuucc

SEQ ID NO: 77166 - RNA, 32 nt, Human
caagagaauuguaaaauguuguggaaaaugau

SEQ ID NO: 77167 - RNA, 32 nt, Human
caagagacaagguuucuccuaucagggucggg

SEQ ID NO: 77168 - RNA, 32 nt, Human
caagagacacagcucaccuaccgucgacaggu

SEQ ID NO: 77169 - RNA, 32 nt, Human
caagagaccacucaaggacaaugggagccacu

SEQ ID NO: 77170 - RNA, 32 nt, Human
caagagaccagccuggccaguauggugaaacc

SEQ ID NO: 77171 - RNA, 32 nt, Human
caagagaccuuauccugauccugaagacgaga

SEQ ID NO: 77172 - RNA, 32 nt, Human
caagagacgugacagcugcugccaccaggccu

SEQ ID NO: 77173 - RNA, 32 nt, Human
caagagacugaaucacuuuucucauugauuaa

SEQ ID NO: 77174 - RNA, 32 nt, Human
caagagacugggagccacuucuccccagaaag

SEQ ID NO: 77175 - RNA, 32 nt, Human
caagagacuuaacuaugagggacguuauguga

SEQ ID NO: 77176 - RNA, 32 nt, Human
caagagagaaccacuaugaauguaaugaaugu

SEQ ID NO: 77177 - RNA, 32 nt, Human
caagagagaagaggaggagaagggagggggug

SEQ ID NO: 77178 - RNA, 32 nt, Human
caagagagacagagcgcacaauggagcaggaa

SEQ ID NO: 77179 - RNA, 32 nt, Human
caagagagacauugccuccaccucuccuugga

SEQ ID NO: 77180 - RNA, 22 nt, Human
caagagagcacgcauccuaaug

SEQ ID NO: 77181 - RNA, 32 nt, Human
caagagagcgcagccuuaguaggagaggaacg

SEQ ID NO: 77182 - RNA, 32 nt, Human
caagagaggaagcagagggaggcggaagcgug

SEQ ID NO: 77183 - RNA, 32 nt, Human
caagagagggaguaacaugucuucucauugcc

SEQ ID NO: 77184 - RNA, 32 nt, Human
caagagaguaaaccaggacugcugcccgcaca

SEQ ID NO: 77185 - RNA, 32 nt, Human
caagagaguucugcuggucagcccugcuccag

SEQ ID NO: 77186 - RNA, 32 nt, Human
caagagaucagccuggcaguuacauguguuuu

SEQ ID NO: 77187 - RNA, 24 nt, Human
caagagauccauccucccaccuca

SEQ ID NO: 77188 - RNA, 32 nt, Human
caagagaucuuucuuuccaaaacauuucugga

SEQ ID NO: 77189 - RNA, 32 nt, Human
caagagaugcacuccccucagccucccaaagu

SEQ ID NO: 77190 - RNA, 32 nt, Human
caagagauuugaaguguuggcuuuugcuaugu

SEQ ID NO: 77191 - RNA, 32 nt, Human
caagagauuuggagacaggagucaggccaggu

SEQ ID NO: 77192 - RNA, 32 nt, Human
caagagauuuggcaugacauguucuguauguu

SEQ ID NO: 77193 - RNA, 32 nt, Human
caagagcaaagucacagaaugaaagagauggu

SEQ ID NO: 77194 - RNA, 32 nt, Human
caagagcaaagugccauuguuugccuuuaauu

SEQ ID NO: 77195 - RNA, 19 nt, Human
caagagcaaauccugccug

SEQ ID NO: 77196 - RNA, 32 nt, Human
caagagcaaguggcugugacuuccauagcauc

SEQ ID NO: 77197 - RNA, 32 nt, Human
caagagcaccaggcagcucagucaccuuguca

SEQ ID NO: 77198 - RNA, 20 nt, Human
caagagcaccuaggauucaa

SEQ ID NO: 77199 - RNA, 32 nt, Human
caagagcacugagacacccugguccucccgga

SEQ ID NO: 77200 - RNA, 32 nt, Human
caagagcagccuguggcaucuuugccuugggc

SEQ ID NO: 77201 - RNA, 32 nt, Human
caagagcaggaagagguugcuggagcaagagg

SEQ ID NO: 77202 - RNA, 32 nt, Human
caagagcagggcugugugugggaggcugcagc

SEQ ID NO: 77203 - RNA, 32 nt, Human
caagagcagugcuucuccauuuguuuugcaga

SEQ ID NO: 77204 - RNA, 32 nt, Human
caagagcaguuugacaaaaaguuuaaaaauag

SEQ ID NO: 77205 - RNA, 32 nt, Human
caagagcaucuccuggguucuuccuguuagaa

SEQ ID NO: 77206 - RNA, 32 nt, Human
caagagcaugaagcacucuuggaguugugggu

SEQ ID NO: 77207 - RNA, 32 nt, Human
caagagccaagagggguggaaaggaagagagc

SEQ ID NO: 77208 - RNA, 32 nt, Human
caagagccacagggcggccucuccccaaccag

SEQ ID NO: 77209 - RNA, 32 nt, Human
caagagccacauuuccuggccucccaggcugc

SEQ ID NO: 77210 - RNA, 32 nt, Human
caagagccacugcacaacagccaaggaacuuu

SEQ ID NO: 77211 - RNA, 32 nt, Human
caagagccagguauagucucccuucccagaau

SEQ ID NO: 77212 - RNA, 32 nt, Human
caagagcccacugucaccuucuagaccacaug

SEQ ID NO: 77213 - RNA, 32 nt, Human
caagagcccugaccacagggugagacagcagg

SEQ ID NO: 77214 - RNA, 32 nt, Human
caagagccggagguggcccccuuguccugcag

SEQ ID NO: 77215 - RNA, 32 nt, Human
caagagccuaagccgccuccauggccccagga

SEQ ID NO: 77216 - RNA, 32 nt, Human
caagagccugccacccucccccuucaaugcac

SEQ ID NO: 77217 - RNA, 32 nt, Human
caagagccuugccuccccugccuccccuccuu

SEQ ID NO: 77218 - RNA, 32 nt, Human
caagagcgagcacagccucuccccagcagacc

SEQ ID NO: 77219 - RNA, 32 nt, Human
caagagcgcaccauugcacuccagccuugggc

SEQ ID NO: 77220 - RNA, 32 nt, Human
caagagcgcugucaggccuggugaagggugug

SEQ ID NO: 77221 - RNA, 32 nt, Human
caagagcgggcaggaacagcagcuggccugaa

SEQ ID NO: 77222 - RNA, 32 nt, Human
caagagcggggaggaggagaggucggaauguc

SEQ ID NO: 77223 - RNA, 32 nt, Human
caagagcgugcucagcagccagguguguguac

SEQ ID NO: 77224 - RNA, 32 nt, Human
caagagcuaccugggcagaagcuccaggcccu

SEQ ID NO: 77225 - RNA, 32 nt, Human
caagagcucaagguacaaaugagagauuugcu

SEQ ID NO: 77226 - RNA, 32 nt, Human
caagagcucacugucuccccugucuccacagu

SEQ ID NO: 77227 - RNA, 21 nt, Human
caagagcucagaggggagagg

SEQ ID NO: 77228 - RNA, 32 nt, Human
caagagcuccaguucccuggaaccugagucgg

SEQ ID NO: 77229 - RNA, 32 nt, Human
caagagcucucaaggcugggucugccaccacu

SEQ ID NO: 77230 - RNA, 18 nt, Human
caagagcucugauggaga

SEQ ID NO: 77231 - RNA, 32 nt, Human
caagagcucugggagguggaagcauggggugg

SEQ ID NO: 77232 - RNA, 20 nt, Human
caagagcuggagacuggagg

SEQ ID NO: 77233 - RNA, 32 nt, Human
caagagcuggaggugaacggaggcaguggaga

SEQ ID NO: 77234 - RNA, 32 nt, Human
caagagcugucaucuucaauucuauuaugcaa

SEQ ID NO: 77235 - RNA, 21 nt, Human
caagagcuucugggacagaga

SEQ ID NO: 77236 - RNA, 32 nt, Human
caagagcuugcugggcuucuacaugaaggugu

SEQ ID NO: 77237 - RNA, 32 nt, Human
caagagcuuggcauuuugcugcaugggugcug

SEQ ID NO: 77238 - RNA, 19 nt, Human
caagagcuugggcacugga

SEQ ID NO: 77239 - RNA, 19 nt, Human
caagagcuuggugguagga

SEQ ID NO: 77240 - RNA, 32 nt, Human
caagagcuugugacuggacuccagccugggca

SEQ ID NO: 77241 - RNA, 20 nt, Human
caagagcuuugugugggaga

SEQ ID NO: 77242 - RNA, 32 nt, Human
caagagcuuuuggaguaugaugaaccucaguu

SEQ ID NO: 77243 - RNA, 32 nt, Human
caagaggaaagagaaagaaagagguauuaccg

SEQ ID NO: 77244 - RNA, 32 nt, Human
caagaggaaaucuggauuuccaccuaccgcuu

SEQ ID NO: 77245 - RNA, 32 nt, Human
caagaggaagaagaagagggaggacucaggag

SEQ ID NO: 77246 - RNA, 32 nt, Human
caagaggaagaauugcuuuucucuuaccagua

SEQ ID NO: 77247 - RNA, 32 nt, Human
caagaggaagcugaagcccagggccuucaucc

SEQ ID NO: 77248 - RNA, 32 nt, Human
caagaggaauguguucagaagcugcugccuga

SEQ ID NO: 77249 - RNA, 32 nt, Human
caagaggaccacacuccagcccaggacaaaag

SEQ ID NO: 77250 - RNA, 32 nt, Human
caagaggaccacacuccagcccaggacaaaug

SEQ ID NO: 77251 - RNA, 20 nt, Human
caagaggacccaaggggaug

SEQ ID NO: 77252 - RNA, 32 nt, Human
caagaggagacauacaugcagccaacaaucau

SEQ ID NO: 77253 - RNA, 32 nt, Human
caagaggagcugguagagaugcuaacaacgcu

SEQ ID NO: 77254 - RNA, 32 nt, Human
caagaggagguggcggcggugguagugguggg

SEQ ID NO: 77255 - RNA, 32 nt, Human
caagaggauccaaacuuccugcaacauuuucu

SEQ ID NO: 77256 - RNA, 32 nt, Human
caagaggauggaggccucaagugugggaacuu

SEQ ID NO: 77257 - RNA, 32 nt, Human
caagaggcacccccuuccccagccucucgccu

SEQ ID NO: 77258 - RNA, 32 nt, Human
caagaggcaggagggggacugacacugauuuu

SEQ ID NO: 77259 - RNA, 32 nt, Human
caagaggcauagagggagaggaagcacacugc

SEQ ID NO: 77260 - RNA, 32 nt, Human
caagaggcauuugugcacacacacagggcucu

SEQ ID NO: 77261 - RNA, 32 nt, Human
caagaggccaggcauggacacaagcaccucuc

SEQ ID NO: 77262 - RNA, 32 nt, Human
caagaggcccaggcagccaccagcacagagaa

SEQ ID NO: 77263 - RNA, 22 nt, Human
caagaggccgagguugcaguga

SEQ ID NO: 77264 - RNA, 32 nt, Human
caagaggcucagaaauggagaucucggagcug

SEQ ID NO: 77265 - RNA, 32 nt, Human
caagaggcugaggcaggagaauuguuugaacc

SEQ ID NO: 77266 - RNA, 32 nt, Human
caagaggcugcacgugagcuccagaaaaugaa

SEQ ID NO: 77267 - RNA, 32 nt, Human
caagaggcugcugccacugaccugcuccauuc

SEQ ID NO: 77268 - RNA, 32 nt, Human
caagagggagagaggcuucagaaccaguccuc

SEQ ID NO: 77269 - RNA, 32 nt, Human
caagagggagggccgggccaggagaaucuccg

SEQ ID NO: 77270 - RNA, 32 nt, Human
caagagggagguggaggcaggcacugaauaag

SEQ ID NO: 77271 - RNA, 32 nt, Human
caagagggagguugagguggggcuagaguggc

SEQ ID NO: 77272 - RNA, 32 nt, Human
caagagggaguguggagcgagagaaaggccag

SEQ ID NO: 77273 - RNA, 32 nt, Human
caagagggccugauuuuauagaagccccuuga

SEQ ID NO: 77274 - RNA, 32 nt, Human
caagagggccugucccuguccccguccccagg

SEQ ID NO: 77275 - RNA, 32 nt, Human
caagagggcgcucucccucccugagacccuga

SEQ ID NO: 77276 - RNA, 32 nt, Human
caagagggcucugccaggggcccugccuccca

SEQ ID NO: 77277 - RNA, 32 nt, Human
caagaggggaccccuccacccccaguacccug

SEQ ID NO: 77278 - RNA, 32 nt, Human
caagagggucucucuguccuuugcugugguca

SEQ ID NO: 77279 - RNA, 32 nt, Human
caagaggucaaggcuucacaagacccugucuc

SEQ ID NO: 77280 - RNA, 32 nt, Human
caagaggucacgacuucccuccugccugcagc

SEQ ID NO: 77281 - RNA, 32 nt, Human
caagaggucccaagggagcaaaccugaaagcc

SEQ ID NO: 77282 - RNA, 32 nt, Human
caagagguccccaaggauugggagcaugggag

SEQ ID NO: 77283 - RNA, 32 nt, Human
caagaggucuguucuuuucacccugggucugu

SEQ ID NO: 77284 - RNA, 32 nt, Human
caagaggugaagaaggcaggagagagacacaa

SEQ ID NO: 77285 - RNA, 32 nt, Human
caagaggugaagcugcagccuggccagguucu

SEQ ID NO: 77286 - RNA, 32 nt, Human
caagaggugacaaggacauuuaccugguacaa

SEQ ID NO: 77287 - RNA, 32 nt, Human
caagaggugcggcagagagaggaaggcaggga

SEQ ID NO: 77288 - RNA, 20 nt, Human
caagaggugguagguuggag

SEQ ID NO: 77289 - RNA, 22 nt, Human
caagagguugaggcugcaguga

SEQ ID NO: 77290 - RNA, 32 nt, Human
caagagguugcaucucaguacacaguggugca

SEQ ID NO: 77291 - RNA, 32 nt, Human
caagagguuuacuguugaugcuuagggucguc

SEQ ID NO: 77292 - RNA, 32 nt, Human
caagaguaacucuucagcaccauggagagguc

SEQ ID NO: 77293 - RNA, 32 nt, Human
caagaguaugaggcuccugcucugauuuccuc

SEQ ID NO: 77294 - RNA, 32 nt, Human
caagagucaguguugcuguggauuugacgugu

SEQ ID NO: 77295 - RNA, 17 nt, Human
caagaguccagguucuc

SEQ ID NO: 77296 - RNA, 32 nt, Human
caagagucccgucagucacagcaacaggaggu

SEQ ID NO: 77297 - RNA, 32 nt, Human
caagagucucacucucacacccaggcuggagu

SEQ ID NO: 77298 - RNA, 32 nt, Human
caagagucucccaggcucacauuaaaccaggg

SEQ ID NO: 77299 - RNA, 32 nt, Human
caagagugaacaaaggcaacacauccacaugc

SEQ ID NO: 77300 - RNA, 32 nt, Human
caagagugaagcagaggagagcaagcguggug

SEQ ID NO: 77301 - RNA, 32 nt, Human
caagagugcaucucccccuagaguugccugcc

SEQ ID NO: 77302 - RNA, 32 nt, Human
caagaguggccccaccuggcccucucugaagg

SEQ ID NO: 77303 - RNA, 32 nt, Human
caagagugggccugcaacccacccacuugccu

SEQ ID NO: 77304 - RNA, 32 nt, Human
caagaguguccccagggcugggcugucccugu

SEQ ID NO: 77305 - RNA, 21 nt, Human
caagaguguggggguuggaga

SEQ ID NO: 77306 - RNA, 32 nt, Human
caagaguuaacucugccuucugggccaaauuc

SEQ ID NO: 77307 - RNA, 32 nt, Human
caagaguuacaugagcauguuguggauaaaug

SEQ ID NO: 77308 - RNA, 32 nt, Human
caagaguuccacagcaaaacaggugugcccag

SEQ ID NO: 77309 - RNA, 32 nt, Human
caagaguuccaguucccuggaaccugagucgg

SEQ ID NO: 77310 - RNA, 32 nt, Human
caagaguucucaccagccuuaguuuccuacac

SEQ ID NO: 77311 - RNA, 32 nt, Human
caagaguugcaggagacccaggaaagggaguu

SEQ ID NO: 77312 - RNA, 32 nt, Human
caagaguuuguaggucuggauucaccuaagau

SEQ ID NO: 77313 - RNA, 32 nt, Human
caagaguuuuggauuucuuucugccguguaua

SEQ ID NO: 77314 - RNA, 32 nt, Human
  misc_feature (6)..(6): n is a, c, g or u
caaganacuuaauguugggcaugggaagggug

SEQ ID NO: 77315 - RNA, 32 nt, Human
caagauaacuagaauuagaagcagagccugaa

SEQ ID NO: 77316 - RNA, 32 nt, Human
caagauaaggaguuccucucuccagcaucugu

SEQ ID NO: 77317 - RNA, 32 nt, Human
caagauaaucagcuauaugaagaaucucagcu

SEQ ID NO: 77318 - RNA, 32 nt, Human
caagauaaugugccuuguuuccagccauauua

SEQ ID NO: 77319 - RNA, 32 nt, Human
caagauacucacugccucucugggugagcaca

SEQ ID NO: 77320 - RNA, 32 nt, Human
caagauacugagccucucaccucccagcccuc

SEQ ID NO: 77321 - RNA, 32 nt, Human
caagauagaauuaauuuaaagccuuaaacaaa

SEQ ID NO: 77322 - RNA, 32 nt, Human
caagauagcaccacugcacuccagccugggag

SEQ ID NO: 77323 - RNA, 32 nt, Human
caagauagcaccacugcacuccaggcugggug

SEQ ID NO: 77324 - RNA, 32 nt, Human
caagauagcaccacugcacuuuagccugggcg

SEQ ID NO: 77325 - RNA, 32 nt, Human
caagauagugaucucucugugaaaaugcuaaa

SEQ ID NO: 77326 - RNA, 32 nt, Human
caagauagugccacugcacuccagccugggca

SEQ ID NO: 77327 - RNA, 32 nt, Human
caagauagugccacugcacuucagccugggug

SEQ ID NO: 77328 - RNA, 32 nt, Human
caagauaugcacuuggccugagaaaugugcua

SEQ ID NO: 77329 - RNA, 32 nt, Human
caagauauggugaguauguaucggugagguag

SEQ ID NO: 77330 - RNA, 23 nt, Human
caagauauuuacucaugcauuua

SEQ ID NO: 77331 - RNA, 32 nt, Human
caagaucaaagugccagcagauucagugucau

SEQ ID NO: 77332 - RNA, 32 nt, Human
caagaucaaggugccagcaggucuaguguuug

SEQ ID NO: 77333 - RNA, 32 nt, Human
caagaucacaccacuccacuccagucuggaca

SEQ ID NO: 77334 - RNA, 32 nt, Human
caagaucacaccacugaccucuagccuggugg

SEQ ID NO: 77335 - RNA, 32 nt, Human
caagaucacaccacugcacuccaaccuggaca

SEQ ID NO: 77336 - RNA, 32 nt, Human
caagaucacaccacugcacuccagccuaggca

SEQ ID NO: 77337 - RNA, 32 nt, Human
caagaucacaccacugcacuccagccuggcaa

SEQ ID NO: 77338 - RNA, 32 nt, Human
caagaucacaccacugcacuccagccugggca

SEQ ID NO: 77339 - RNA, 32 nt, Human
caagaucacaccacugcacuccagccugggcg

SEQ ID NO: 77340 - RNA, 32 nt, Human
caagaucacaccacugcacuccagccugggug

SEQ ID NO: 77341 - RNA, 32 nt, Human
caagaucacaccacugcacuccagccuuggcg

SEQ ID NO: 77342 - RNA, 32 nt, Human
caagaucacaccacugcgcucuagccugggca

SEQ ID NO: 77343 - RNA, 32 nt, Human
caagaucacaccacuggcacuccagccugggc

SEQ ID NO: 77344 - RNA, 32 nt, Human
caagaucacaccacuguaccacagccugagca

SEQ ID NO: 77345 - RNA, 32 nt, Human
caagaucacaccagugcacuccagccugggcg

SEQ ID NO: 77346 - RNA, 32 nt, Human
caagaucacaccauugcacuccagccuagaua

SEQ ID NO: 77347 - RNA, 32 nt, Human
caagaucacaccauugcacuccagccuaggca

SEQ ID NO: 77348 - RNA, 32 nt, Human
caagaucacaccauugcacuccagccugagca

SEQ ID NO: 77349 - RNA, 32 nt, Human
caagaucacaccauugcacuccagccugggaa

SEQ ID NO: 77350 - RNA, 32 nt, Human
caagaucacaccauugcacuccagccugggca

SEQ ID NO: 77351 - RNA, 32 nt, Human
caagaucacaccauugcacuccagccugggcg

SEQ ID NO: 77352 - RNA, 32 nt, Human
caagaucacaccauugcacuucaaccugguca

SEQ ID NO: 77353 - RNA, 32 nt, Human
caagaucacacuacugcacuccagccugggca

SEQ ID NO: 77354 - RNA, 32 nt, Human
caagaucacacuauugcacuccagccugggcg

SEQ ID NO: 77355 - RNA, 21 nt, Human
caagaucacauagcugguaaa

SEQ ID NO: 77356 - RNA, 32 nt, Human
caagaucaccauuagcaaauggaaauuacauu

SEQ ID NO: 77357 - RNA, 32 nt, Human
caagaucacgacacugcacuccagccugggca

SEQ ID NO: 77358 - RNA, 32 nt, Human
caagaucacgccacuacacuccagccugggcg

SEQ ID NO: 77359 - RNA, 32 nt, Human
caagaucacgccacugcacuccagccucggug

SEQ ID NO: 77360 - RNA, 32 nt, Human
caagaucacgccacugcacuccagccuggaca

SEQ ID NO: 77361 - RNA, 32 nt, Human
caagaucacgccacugcacuccagccugggca

SEQ ID NO: 77362 - RNA, 32 nt, Human
caagaucacgccacugcacuccagccugggcc

SEQ ID NO: 77363 - RNA, 32 nt, Human
caagaucacgccacugcacuccagccugggcg

SEQ ID NO: 77364 - RNA, 32 nt, Human
caagaucacgccacugcacuccagccugggug

SEQ ID NO: 77365 - RNA, 32 nt, Human
caagaucacgccacugcacuccagccugguga

SEQ ID NO: 77366 - RNA, 32 nt, Human
caagaucacgccacugcacuccagcuggagug

SEQ ID NO: 77367 - RNA, 32 nt, Human
caagaucacgccacugcacucuagccugggca

SEQ ID NO: 77368 - RNA, 32 nt, Human
caagaucacgccacugcauuccagccugguga

SEQ ID NO: 77369 - RNA, 32 nt, Human
caagaucacgccauugcacuccagccuaggca

SEQ ID NO: 77370 - RNA, 32 nt, Human
caagaucacgccauugcacuccagccugggca

SEQ ID NO: 77371 - RNA, 32 nt, Human
caagaucacgccauugcacuccagccuggggg

SEQ ID NO: 77372 - RNA, 32 nt, Human
caagaucacgccauugcacuccagccugggug

SEQ ID NO: 77373 - RNA, 32 nt, Human
caagaucacggcacugcgcugcagccugggca

SEQ ID NO: 77374 - RNA, 32 nt, Human
caagaucacgucauugcacuccagccugguca

SEQ ID NO: 77375 - RNA, 32 nt, Human
caagaucacuccacugcacuccagccugggcg

SEQ ID NO: 77376 - RNA, 32 nt, Human
caagaucagagcaugugccuacaccuugugcc

SEQ ID NO: 77377 - RNA, 22 nt, Human
caagaucagccuggccaacaug

SEQ ID NO: 77378 - RNA, 32 nt, Human
caagaucaggaguucaagaccaggcugggcaa

SEQ ID NO: 77379 - RNA, 31 nt, Human
caagaucaguagagagaaagucaaagauuac

SEQ ID NO: 77380 - RNA, 32 nt, Human
caagaucagucugucugugaucagccugugug

SEQ ID NO: 77381 - RNA, 32 nt, Human
caagaucauaccacggcacuccagccugggug

SEQ ID NO: 77382 - RNA, 32 nt, Human
caagaucauaccacugcacugcagccugagug

SEQ ID NO: 77383 - RNA, 32 nt, Human
caagaucauaccauugcacuccagccugggca

SEQ ID NO: 77384 - RNA, 32 nt, Human
caagaucauacuacugcacuccagccugggcg

SEQ ID NO: 77385 - RNA, 32 nt, Human
caagaucauaucacugcacuccagccuggcug

SEQ ID NO: 77386 - RNA, 32 nt, Human
caagaucaugaggagaauauuugaaggaauau

SEQ ID NO: 77387 - RNA, 32 nt, Human
caagaucaugccacaucacuccaaccugggca

SEQ ID NO: 77388 - RNA, 32 nt, Human
caagaucaugccacaucacuccagccugggca

SEQ ID NO: 77389 - RNA, 32 nt, Human
caagaucaugccacuccacuccagucugggcg

SEQ ID NO: 77390 - RNA, 32 nt, Human
caagaucaugccacugaacuccagccugggug

SEQ ID NO: 77391 - RNA, 32 nt, Human
caagaucaugccacugcaccccagccugggca

SEQ ID NO: 77392 - RNA, 32 nt, Human
caagaucaugccacugcacuccagccugggca

SEQ ID NO: 77393 - RNA, 32 nt, Human
caagaucaugccacugcacuccagccugggcg

SEQ ID NO: 77394 - RNA, 32 nt, Human
caagaucaugccacugcacuccagccugggug

SEQ ID NO: 77395 - RNA, 32 nt, Human
caagaucaugccacugcacugcagcccgggcg

SEQ ID NO: 77396 - RNA, 32 nt, Human
caagaucaugccacuggacuccagccugggug

SEQ ID NO: 77397 - RNA, 32 nt, Human
caagaucaugccacuuuacuccagucugagca

SEQ ID NO: 77398 - RNA, 32 nt, Human
caagaucaugccauuauacuccagccugggug

SEQ ID NO: 77399 - RNA, 32 nt, Human
caagaucaugccauugcacagcagccugggug

SEQ ID NO: 77400 - RNA, 32 nt, Human
caagaucaugccauugcacuccagcccggguu

SEQ ID NO: 77401 - RNA, 32 nt, Human
caagaucaugccauugcacuccagccugggca

SEQ ID NO: 77402 - RNA, 32 nt, Human
caagaucaugccauugcacuccagccugggcg

SEQ ID NO: 77403 - RNA, 32 nt, Human
caagaucaugccauugcacuccagccugggug

SEQ ID NO: 77404 - RNA, 32 nt, Human
caagaucaugcguuuucucuuguucuuaacca

SEQ ID NO: 77405 - RNA, 32 nt, Human
caagaucaugcuacugcacuccagccugggug

SEQ ID NO: 77406 - RNA, 32 nt, Human
caagaucaugcuacugcacuccagcuuaggug

SEQ ID NO: 77407 - RNA, 32 nt, Human
caagaucaugucauugcacucuagucugggug

SEQ ID NO: 77408 - RNA, 32 nt, Human
caagauccaggcaauugugugcuguugguugu

SEQ ID NO: 77409 - RNA, 32 nt, Human
caagaucccagccaggaaggcuggggcccuac

SEQ ID NO: 77410 - RNA, 32 nt, Human
caagauccccaagggauauguaugcucauaaa

SEQ ID NO: 77411 - RNA, 32 nt, Human
caagauccccgccuccccuuaagcaccgcgag

SEQ ID NO: 77412 - RNA, 32 nt, Human
caagauccugccacugcacuccagccugggca

SEQ ID NO: 77413 - RNA, 32 nt, Human
caagauccugcuacccagagggugaaugggua

SEQ ID NO: 77414 - RNA, 32 nt, Human
caagauccuguaggaacaccuaccuuaagcac

SEQ ID NO: 77415 - RNA, 32 nt, Human
caagauccuugaagccccuccguucagcauuc

SEQ ID NO: 77416 - RNA, 32 nt, Human
caagaucgagccauugcacuccagccugggca

SEQ ID NO: 77417 - RNA, 32 nt, Human
caagaucgaguuggccgaggauggaugauugu

SEQ ID NO: 77418 - RNA, 32 nt, Human
caagaucgcaacauugcacuccaggcugggca

SEQ ID NO: 77419 - RNA, 32 nt, Human
caagaucgcaccacugcacucaagccugggcg

SEQ ID NO: 77420 - RNA, 32 nt, Human
caagaucgcaccacugcacuccaaccugggca

SEQ ID NO: 77421 - RNA, 32 nt, Human
caagaucgcaccacugcacuccagccuggaag

SEQ ID NO: 77422 - RNA, 32 nt, Human
caagaucgcaccacugcacuccagccugggag

SEQ ID NO: 77423 - RNA, 32 nt, Human
caagaucgcaccacugcacuccagccugggca

SEQ ID NO: 77424 - RNA, 32 nt, Human
caagaucgcaccacugcacuccagccugggcg

SEQ ID NO: 77425 - RNA, 32 nt, Human
caagaucgcaccacugcacuccagccugggug

SEQ ID NO: 77426 - RNA, 32 nt, Human
caagaucgcaccacugcacuccagccuggucg

SEQ ID NO: 77427 - RNA, 32 nt, Human
caagaucgcaccacugcauuccagccuaagca

SEQ ID NO: 77428 - RNA, 32 nt, Human
caagaucgcaccacugcucuccagccuggcga

SEQ ID NO: 77429 - RNA, 32 nt, Human
caagaucgcaccacuguacuccagccugggca

SEQ ID NO: 77430 - RNA, 32 nt, Human
caagaucgcaccacuugcacugcagccugaga

SEQ ID NO: 77431 - RNA, 32 nt, Human
caagaucgcaccauugcaaccccaccugggca

SEQ ID NO: 77432 - RNA, 32 nt, Human
caagaucgcaccauugcacaccaaccugggug

SEQ ID NO: 77433 - RNA, 32 nt, Human
caagaucgcaccauugcacccgagccuaggca

SEQ ID NO: 77434 - RNA, 32 nt, Human
caagaucgcaccauugcacuccagccuaggca

SEQ ID NO: 77435 - RNA, 32 nt, Human
caagaucgcaccauugcacuccagccuggaug

SEQ ID NO: 77436 - RNA, 32 nt, Human
caagaucgcaccauugcacuccagccugggca

SEQ ID NO: 77437 - RNA, 32 nt, Human
caagaucgcaccauugcacuccagccugugca

SEQ ID NO: 77438 - RNA, 32 nt, Human
caagaucgcaccauugcacuccagcugggaga

SEQ ID NO: 77439 - RNA, 32 nt, Human
caagaucgcaccauuguacuccagccugggca

SEQ ID NO: 77440 - RNA, 32 nt, Human
caagaucgcaccgcugcacuccagccugggug

SEQ ID NO: 77441 - RNA, 32 nt, Human
caagaucgcacuacugcacuccagccugggug

SEQ ID NO: 77442 - RNA, 32 nt, Human
caagaucgcccacugcacuccagguugggcua

SEQ ID NO: 77443 - RNA, 32 nt, Human
caagaucgccccacugcacuccagccuggcaa

SEQ ID NO: 77444 - RNA, 32 nt, Human
caagaucgccccacugcacuccagccugggcg

SEQ ID NO: 77445 - RNA, 32 nt, Human
caagaucgcccugcugcacuccagccugggca

SEQ ID NO: 77446 - RNA, 32 nt, Human
caagaucgcgccacugcacuccacccugggua

SEQ ID NO: 77447 - RNA, 32 nt, Human
caagaucgcgccacugcacuccagccucagca

SEQ ID NO: 77448 - RNA, 32 nt, Human
caagaucgcgccacugcacuccagccucggca

SEQ ID NO: 77449 - RNA, 32 nt, Human
caagaucgcgccacugcacuccagccuggcga

SEQ ID NO: 77450 - RNA, 32 nt, Human
caagaucgcgccacugcacuccagccugggca

SEQ ID NO: 77451 - RNA, 32 nt, Human
caagaucgcgccacugcacuccagccugggcg

SEQ ID NO: 77452 - RNA, 32 nt, Human
caagaucgcgccacugcacuccagccugggug

SEQ ID NO: 77453 - RNA, 32 nt, Human
caagaucgcgccacugcacuccagccugguga

SEQ ID NO: 77454 - RNA, 32 nt, Human
caagaucgcgccacugcacuccagucugggca

SEQ ID NO: 77455 - RNA, 32 nt, Human
caagaucgcgccacugcacuccggccugauga

SEQ ID NO: 77456 - RNA, 32 nt, Human
caagaucgcgccauugcacuccaaccuggacg

SEQ ID NO: 77457 - RNA, 32 nt, Human
caagaucgcgccauugcacuccagccuggaca

SEQ ID NO: 77458 - RNA, 32 nt, Human
caagaucgcgccauugcacuccagccugggca

SEQ ID NO: 77459 - RNA, 32 nt, Human
caagaucgcgccauugcacuccagccuggggg

SEQ ID NO: 77460 - RNA, 32 nt, Human
caagaucgcgccauugcacucuagccuaggug

SEQ ID NO: 77461 - RNA, 32 nt, Human
caagaucgcgccccugcacuccagccugggug

SEQ ID NO: 77462 - RNA, 32 nt, Human
caagaucgcgccguugcacuccagccugggca

SEQ ID NO: 77463 - RNA, 32 nt, Human
caagaucgcgcuacugcacuccagccugggcg

SEQ ID NO: 77464 - RNA, 32 nt, Human
caagaucgcgcuauugcacuccagccugggug

SEQ ID NO: 77465 - RNA, 32 nt, Human
caagaucgcggcauugcacuucagccugggcg

SEQ ID NO: 77466 - RNA, 32 nt, Human
caagaucgcggcgcugcacucuagccugggug

SEQ ID NO: 77467 - RNA, 32 nt, Human
caagaucgcuccauugcacuccagccugggug

SEQ ID NO: 77468 - RNA, 32 nt, Human
caagaucgggccacugcacuccagcuugggug

SEQ ID NO: 77469 - RNA, 32 nt, Human
caagaucgggccgcugcacuccagccuggggg

SEQ ID NO: 77470 - RNA, 32 nt, Human
caagaucguaccacugcacuccagccugggcg

SEQ ID NO: 77471 - RNA, 32 nt, Human
caagaucguaccacugcacuccagccugggug

SEQ ID NO: 77472 - RNA, 32 nt, Human
caagaucguaccacugcacuccagucugggcg

SEQ ID NO: 77473 - RNA, 32 nt, Human
caagaucguaccacugcacucuggccugggca

SEQ ID NO: 77474 - RNA, 32 nt, Human
caagaucgugacacugcacuccagccugggcg

SEQ ID NO: 77475 - RNA, 32 nt, Human
caagaucgugccaaugcacuccauccugggca

SEQ ID NO: 77476 - RNA, 32 nt, Human
caagaucgugccacuacacuccagccugggca

SEQ ID NO: 77477 - RNA, 32 nt, Human
caagaucgugccacuacacuccagccuggggg

SEQ ID NO: 77478 - RNA, 32 nt, Human
caagaucgugccacugcaccguagccugggug

SEQ ID NO: 77479 - RNA, 32 nt, Human
caagaucgugccacugcacuccagacuggggg

SEQ ID NO: 77480 - RNA, 32 nt, Human
caagaucgugccacugcacuccagccuggcga

SEQ ID NO: 77481 - RNA, 32 nt, Human
caagaucgugccacugcacuccagccugggag

SEQ ID NO: 77482 - RNA, 32 nt, Human
caagaucgugccacugcacuccagccugggcg

SEQ ID NO: 77483 - RNA, 32 nt, Human
caagaucgugccacugcacuccagccugggcu

SEQ ID NO: 77484 - RNA, 32 nt, Human
caagaucgugccacugcacuccagccugggga

SEQ ID NO: 77485 - RNA, 32 nt, Human
caagaucgugccacugcacuccagccugggug

SEQ ID NO: 77486 - RNA, 32 nt, Human
caagaucgugccacugcacuccagccugguug

SEQ ID NO: 77487 - RNA, 32 nt, Human
caagaucgugccacugcacuccagccuugaga

SEQ ID NO: 77488 - RNA, 32 nt, Human
caagaucgugccacugcacuccagccuuggug

SEQ ID NO: 77489 - RNA, 32 nt, Human
caagaucgugccacugcacuccagucugggug

SEQ ID NO: 77490 - RNA, 32 nt, Human
caagaucgugccacugcacucuagccugggcg

SEQ ID NO: 77491 - RNA, 32 nt, Human
caagaucgugccacugcacucuagccugggug

SEQ ID NO: 77492 - RNA, 32 nt, Human
caagaucgugccacugcacucuauccugggua

SEQ ID NO: 77493 - RNA, 32 nt, Human
caagaucgugccacugcacuucagccugggug

SEQ ID NO: 77494 - RNA, 32 nt, Human
caagaucgugccacugcauuccagccugggcg

SEQ ID NO: 77495 - RNA, 32 nt, Human
caagaucgugccagugcacuccagccugggug

SEQ ID NO: 77496 - RNA, 32 nt, Human
caagaucgugccauugcacuccagccuaggca

SEQ ID NO: 77497 - RNA, 32 nt, Human
caagaucgugccauugcacuccagccuggcga

SEQ ID NO: 77498 - RNA, 32 nt, Human
caagaucgugccauugcacuccagccugggca

SEQ ID NO: 77499 - RNA, 32 nt, Human
caagaucgugccauugcacuccagccugggug

SEQ ID NO: 77500 - RNA, 32 nt, Human
caagaucgugcuacugcacuccagccccagcu

SEQ ID NO: 77501 - RNA, 32 nt, Human
caagaucgugucacugcacuccagccugguga

SEQ ID NO: 77502 - RNA, 32 nt, Human
caagaucuacaucauggaggugaugacaucag

SEQ ID NO: 77503 - RNA, 32 nt, Human
caagaucuagaucccagacagaaacaacacau

SEQ ID NO: 77504 - RNA, 32 nt, Human
caagaucuaggaagaggaaggggagggaugug

SEQ ID NO: 77505 - RNA, 32 nt, Human
caagaucuccaccccagucaugcugauggggc

SEQ ID NO: 77506 - RNA, 32 nt, Human
caagaucucgccacugcacuccaggcugggcg

SEQ ID NO: 77507 - RNA, 32 nt, Human
caagaucugugcagccccgccuccaggccaca

SEQ ID NO: 77508 - RNA, 32 nt, Human
caagaugaaauacaaaaauuauguuuaagggu

SEQ ID NO: 77509 - RNA, 32 nt, Human
caagaugaaccaauaccucaaaaaccucaguc

SEQ ID NO: 77510 - RNA, 32 nt, Human
caagaugaagaagccaacacagaugaccuuac

SEQ ID NO: 77511 - RNA, 32 nt, Human
caagaugacacaacugcacuccagcuugggca

SEQ ID NO: 77512 - RNA, 32 nt, Human
caagaugagccucugcaauauucuggcaauuu

SEQ ID NO: 77513 - RNA, 32 nt, Human
caagaugauaaauggugagauuugaaugugau

SEQ ID NO: 77514 - RNA, 32 nt, Human
caagaugaugccacugcacuccagccugggcu

SEQ ID NO: 77515 - RNA, 32 nt, Human
caagaugaugccauugcacuccagccugggca

SEQ ID NO: 77516 - RNA, 32 nt, Human
caagaugauguucacuccaaauacacuacaga

SEQ ID NO: 77517 - RNA, 32 nt, Human
caagaugcaacaguauucuggcuuugccuuuc

SEQ ID NO: 77518 - RNA, 32 nt, Human
caagaugcaacaguuugucuucacauuggaag

SEQ ID NO: 77519 - RNA, 32 nt, Human
caagaugcaccacugcaccccagccugggcga

SEQ ID NO: 77520 - RNA, 32 nt, Human
caagaugcauaccucaugaauucaacuauuuu

SEQ ID NO: 77521 - RNA, 32 nt, Human
caagaugcauucucauaccugcccacagcucc

SEQ ID NO: 77522 - RNA, 32 nt, Human
caagaugccauuucugcaucucccagaaggga

SEQ ID NO: 77523 - RNA, 32 nt, Human
caagaugcccacacaacaggcuuauuuucugu

SEQ ID NO: 77524 - RNA, 29 nt, Human
caagaugccuagcagaacugcccgcuaug

SEQ ID NO: 77525 - RNA, 32 nt, Human
caagaugccucuucuggcaucugacaagcuga

SEQ ID NO: 77526 - RNA, 16 nt, Human
caagaugccuggcaaa

SEQ ID NO: 77527 - RNA, 32 nt, Human
caagaugccuggcaaaaccaccucccugugcc

SEQ ID NO: 77528 - RNA, 32 nt, Human
caagaugcggaagaggaugugggaccaggacc

SEQ ID NO: 77529 - RNA, 32 nt, Human
caagauggaacaagaagguggagccagacgua

SEQ ID NO: 77530 - RNA, 32 nt, Human
caagauggaacacauggugaaugcauacagca

SEQ ID NO: 77531 - RNA, 32 nt, Human
caagauggaaggcaggugaggaugucaggaug

SEQ ID NO: 77532 - RNA, 32 nt, Human
caagauggaggccacagacuggcuggcccaga

SEQ ID NO: 77533 - RNA, 32 nt, Human
caagauggaggcuguggagcagcauuucccgu

SEQ ID NO: 77534 - RNA, 32 nt, Human
caagauggagucucgcucugucacccaggcug

SEQ ID NO: 77535 - RNA, 32 nt, Human
caagauggagucuugcucugucgcccaggcug

SEQ ID NO: 77536 - RNA, 32 nt, Human
caagauggaguuuugcucugucacccaggcug

SEQ ID NO: 77537 - RNA, 32 nt, Human
caagauggaucacaccuguaaucccagcacuu

SEQ ID NO: 77538 - RNA, 32 nt, Human
caagauggcaaaagcuugcugagugguacagc

SEQ ID NO: 77539 - RNA, 25 nt, Human
caagauggcaagaccuuguuucugu

SEQ ID NO: 77540 - RNA, 32 nt, Human
caagauggcaccacuacauuucagccugggcg

SEQ ID NO: 77541 - RNA, 32 nt, Human
caagauggcaccacugcacuccagccuaggug

SEQ ID NO: 77542 - RNA, 32 nt, Human
caagauggcaccacugcacuccauccugggug

SEQ ID NO: 77543 - RNA, 32 nt, Human
caagauggcaccauugcacccuagccugggca

SEQ ID NO: 77544 - RNA, 29 nt, Human
caagauggcagaaguagagcagaagaaga

SEQ ID NO: 77545 - RNA, 32 nt, Human
caagauggccuguaaucccagcacuuugggag

SEQ ID NO: 77546 - RNA, 32 nt, Human
caagauggcgacaagagugaccucuggucguc

SEQ ID NO: 77547 - RNA, 32 nt, Human
caagauggcgacgggaacgggcaaacacaagc

SEQ ID NO: 77548 - RNA, 32 nt, Human
caagauggcgccacuacacuccagccugggca

SEQ ID NO: 77549 - RNA, 32 nt, Human
caauucuccugccucagccucccaaauagcug

SEQ ID NO: 77550 - RNA, 32 nt, Human
caauucuccugccucagccucccagauagcug

SEQ ID NO: 77551 - RNA, 32 nt, Human
caauucuccugccucagccucccagguggcug

SEQ ID NO: 77552 - RNA, 32 nt, Human
caauucuccugccucagccuccccaguagcug

SEQ ID NO: 77553 - RNA, 32 nt, Human
caauucuccugccucagccucccccgcagcua

SEQ ID NO: 77554 - RNA, 32 nt, Human
caauucuccugccucagccucccgaguagcug

SEQ ID NO: 77555 - RNA, 32 nt, Human
caauucuccugccucagccucccgauuagcug

SEQ ID NO: 77556 - RNA, 32 nt, Human
caauucuccugccucagccucccggguagcug

SEQ ID NO: 77557 - RNA, 32 nt, Human
caauucuccugccucagccucccuaguagcug

SEQ ID NO: 77558 - RNA, 32 nt, Human
caauucuccugccucagccuccuaaguagcug

SEQ ID NO: 77559 - RNA, 32 nt, Human
caauucuccugccucagccuccugaauagccg

SEQ ID NO: 77560 - RNA, 32 nt, Human
caauucuccugccucagccuccugagcagcug

SEQ ID NO: 77561 - RNA, 32 nt, Human
caauucuccugccucagccuccugaguagcug

SEQ ID NO: 77562 - RNA, 32 nt, Human
caauucuccugccucagccuucggaguggcug

SEQ ID NO: 77563 - RNA, 32 nt, Human
caauucuccugccucagcuccugaguagcugg

SEQ ID NO: 77564 - RNA, 32 nt, Human
caauucuccugccucagcucugaguagcuggg

SEQ ID NO: 77565 - RNA, 32 nt, Human
caauucuccugccucaggcuccugaguagcug

SEQ ID NO: 77566 - RNA, 32 nt, Human
caauucuccugccucaggcuccuggguggcug

SEQ ID NO: 77567 - RNA, 32 nt, Human
caauucuccugccucagucuccugaguagcug

SEQ ID NO: 77568 - RNA, 32 nt, Human
caauucuccugccuuugccuccagaagcacug

SEQ ID NO: 77569 - RNA, 32 nt, Human
caauucugagaaacaaaaacacacacgcagaa

SEQ ID NO: 77570 - RNA, 32 nt, Human
caauucuguaugcuuggcauugugguaagcac

SEQ ID NO: 77571 - RNA, 32 nt, Human
caauucuguccacuuuuaucaccuugugucua

SEQ ID NO: 77572 - RNA, 32 nt, Human
caauucugugaagaaagucaucgguagcuuga

SEQ ID NO: 77573 - RNA, 32 nt, Human
caauucuucauugagcuaguuuucucuaagcc

SEQ ID NO: 77574 - RNA, 32 nt, Human
caauucuucuuccaauguggcucagggaagcc

SEQ ID NO: 77575 - RNA, 32 nt, Human
caauucuugaagcaccagcucccugccccacc

SEQ ID NO: 77576 - RNA, 32 nt, Human
caauucuuuacauuccuugaauuuucauagau

SEQ ID NO: 77577 - RNA, 32 nt, Human
caauucuuuguugcuuaaucuagagcuaugca

SEQ ID NO: 77578 - RNA, 32 nt, Human
caauugaagaugugucuggagacacuguaccu

SEQ ID NO: 77579 - RNA, 32 nt, Human
caauugacugaauggaucucaccagauuuugu

SEQ ID NO: 77580 - RNA, 32 nt, Human
caauugacugcaaccucugcuucccaggcuca

SEQ ID NO: 77581 - RNA, 32 nt, Human
caauugagagaacugagaaaaauauucacgac

SEQ ID NO: 77582 - RNA, 32 nt, Human
caauugagaguuuucauuuugugucuuuuaaa

SEQ ID NO: 77583 - RNA, 32 nt, Human
caauugagauuugccuuucaaacccucagguu

SEQ ID NO: 77584 - RNA, 32 nt, Human
caauugagcaagaagacaggagcuggggacau

SEQ ID NO: 77585 - RNA, 32 nt, Human
caauugagcucauggacacagaguagaacgac

SEQ ID NO: 77586 - RNA, 32 nt, Human
caauugaugagaggagcagagaggaaggagaa

SEQ ID NO: 77587 - RNA, 32 nt, Human
caauugaugcauauuuguuuauccugaugaau

SEQ ID NO: 77588 - RNA, 32 nt, Human
caauugcaacuccggcuggagccccggaccug

SEQ ID NO: 77589 - RNA, 32 nt, Human
caauugcaagcucauuccucuaccucauacuu

SEQ ID NO: 77590 - RNA, 32 nt, Human
caauugcaccacugcacuccagccugggugac

SEQ ID NO: 77591 - RNA, 32 nt, Human
caauugcagaagcaggcagcggcagagaggga

SEQ ID NO: 77592 - RNA, 32 nt, Human
caauugcagcuuuauucagaaauauaaaagug

SEQ ID NO: 77593 - RNA, 32 nt, Human
caauugcaggaaagaaggccuugaguggagag

SEQ ID NO: 77594 - RNA, 32 nt, Human
caauugcaguggauuccucggggauagaccaa

SEQ ID NO: 77595 - RNA, 32 nt, Human
caauugcauuccacuggacacaauucauuugc

SEQ ID NO: 77596 - RNA, 32 nt, Human
caauugccaaaaacuagaagccacuugcacgg

SEQ ID NO: 77597 - RNA, 32 nt, Human
caauugccagcaaccucugcuuguccggaaaa

SEQ ID NO: 77598 - RNA, 32 nt, Human
caauugcuaucuuuugaaaggcaccaguaugu

SEQ ID NO: 77599 - RNA, 32 nt, Human
caauugcucccuuaagcaacagauucauauuu

SEQ ID NO: 77600 - RNA, 31 nt, Human
caauugcugcccaucuggccugugugcccau

SEQ ID NO: 77601 - RNA, 32 nt, Human
caauugcugcucccuuuacuuucucuaccugu

SEQ ID NO: 77602 - RNA, 32 nt, Human
caauugcuguacauacccuccuuuccuucuac

SEQ ID NO: 77603 - RNA, 32 nt, Human
caauuggacaaccucaguuccaaccaauucuu

SEQ ID NO: 77604 - RNA, 32 nt, Human
caauuggagaugccggggacccuucagcuauu

SEQ ID NO: 77605 - RNA, 32 nt, Human
caauuggagauggacucaagcaguucagcaua

SEQ ID NO: 77606 - RNA, 32 nt, Human
caauuggcuguugaugugccucagcugucacu

SEQ ID NO: 77607 - RNA, 32 nt, Human
caauugggagcuugguggaccaucucuugguu

SEQ ID NO: 77608 - RNA, 32 nt, Human
caauugggagggcggagggaggcaguguccuu

SEQ ID NO: 77609 - RNA, 32 nt, Human
caauuggggaaaauaguuacuucacuaguaau

SEQ ID NO: 77610 - RNA, 32 nt, Human
caauuggggcuguuaagucugaccauacauca

SEQ ID NO: 77611 - RNA, 32 nt, Human
caauuggguuuugaucucagcauccuggaaau

SEQ ID NO: 77612 - RNA, 32 nt, Human
caauugguuucaccucaugucucccucccuac

SEQ ID NO: 77613 - RNA, 32 nt, Human
caauuguaaaacugaggcacgagcaaagugaa

SEQ ID NO: 77614 - RNA, 32 nt, Human
caauuguaaagugaaauucaaggagaaggaau

SEQ ID NO: 77615 - RNA, 32 nt, Human
caauuguacuaaaaauacaaaauuagccgggc

SEQ ID NO: 77616 - RNA, 32 nt, Human
caauuguagaagugaggaccuugaguggagaa

SEQ ID NO: 77617 - RNA, 32 nt, Human
caauuguagggccggggauagaggguacuuga

SEQ ID NO: 77618 - RNA, 32 nt, Human
caauugucagucaggauaauucuguuugcuaa

SEQ ID NO: 77619 - RNA, 32 nt, Human
caauuguccugccuccucaacuuccugacuac

SEQ ID NO: 77620 - RNA, 32 nt, Human
caauugucugaacacuuggguucaguugaaau

SEQ ID NO: 77621 - RNA, 17 nt, Human
caauugucuggaguuua

SEQ ID NO: 77622 - RNA, 32 nt, Human
caauugugauuuuucuuuagccagaaugaaug

SEQ ID NO: 77623 - RNA, 32 nt, Human
caauugugggucccugaagcugaggggaugau

SEQ ID NO: 77624 - RNA, 32 nt, Human
caauugugugacacaggaagcccaaguguugg

SEQ ID NO: 77625 - RNA, 32 nt, Human
caauuguguuaacugcuggaagggacagaugc

SEQ ID NO: 77626 - RNA, 32 nt, Human
caauuguuacugaucaugaauguuaguuagaa

SEQ ID NO: 77627 - RNA, 32 nt, Human
caauuguucucuucucuguuagccuucccuaa

SEQ ID NO: 77628 - RNA, 32 nt, Human
caauuguuuugagagagauggcuggucaugcc

SEQ ID NO: 77629 - RNA, 32 nt, Human
caauuuaaaaggagacccacagagcuaauguu

SEQ ID NO: 77630 - RNA, 32 nt, Human
caauuuaaauagagacccacagagcuaauguu

SEQ ID NO: 77631 - RNA, 32 nt, Human
caauuuacaaagugccuggcggugggcccuga

SEQ ID NO: 77632 - RNA, 32 nt, Human
caauuuacaaaugaucuuugcaaauagugguc

SEQ ID NO: 77633 - RNA, 32 nt, Human
caauuuacaacagcaaccacacugccugucau

SEQ ID NO: 77634 - RNA, 32 nt, Human
caauuuaccugguacuaaacccgcaccccagu

SEQ ID NO: 77635 - RNA, 32 nt, Human
caauuuagacaggcagaccauggcagaguucu

SEQ ID NO: 77636 - RNA, 32 nt, Human
caauuuaggaggccaaggugggaagaucacuu

SEQ ID NO: 77637 - RNA, 32 nt, Human
caauuuaggcaggaaccacacacugcuaugac

SEQ ID NO: 77638 - RNA, 32 nt, Human
caauuuagugauuuuccuuuucugacauucaa

SEQ ID NO: 77639 - RNA, 32 nt, Human
caauuuaguggaagauaaugaggcucacugua

SEQ ID NO: 77640 - RNA, 32 nt, Human
caauuuauaagugucccauggggcagacacuc

SEQ ID NO: 77641 - RNA, 32 nt, Human
caauuuaugcuuuuaacuuauuuucuaccugg

SEQ ID NO: 77642 - RNA, 32 nt, Human
caauuuauugcagacguuccugggcugggaga

SEQ ID NO: 77643 - RNA, 32 nt, Human
caauuucaagguccucaccacuccuucauuug

SEQ ID NO: 77644 - RNA, 32 nt, Human
caauuucacuuugucugcuccucucugcaaug

SEQ ID NO: 77645 - RNA, 32 nt, Human
caauuucagcuccaccccaucaacaucugggg

SEQ ID NO: 77646 - RNA, 32 nt, Human
caauuucagcuguacauuucucauccaaguug

SEQ ID NO: 77647 - RNA, 32 nt, Human
caauuucaugaucuggggcaucaugucgguag

SEQ ID NO: 77648 - RNA, 32 nt, Human
caauuuccaaacgugucaccccggcgccgacg

SEQ ID NO: 77649 - RNA, 32 nt, Human
caauuuccauauuuccagccacuugaggacug

SEQ ID NO: 77650 - RNA, 32 nt, Human
caauuuccauuuuauuuacuuaccucauuaua

SEQ ID NO: 77651 - RNA, 32 nt, Human
caauuucccggagguugugaggcccuuugagg

SEQ ID NO: 77652 - RNA, 32 nt, Human
caauuucccugacuccucuaagccacucuucc

SEQ ID NO: 77653 - RNA, 32 nt, Human
caauuuccucaccuuuaaacuggggaucaugc

SEQ ID NO: 77654 - RNA, 32 nt, Human
caauuuccucuucuuuuuccucugaccucugu

SEQ ID NO: 77655 - RNA, 32 nt, Human
caauuucucaugucucuccugagauguuuuau

SEQ ID NO: 77656 - RNA, 32 nt, Human
caauuucuccaagcaauuuugccuccuguaug

SEQ ID NO: 77657 - RNA, 32 nt, Human
caauuucucccauuuggcaugacuguauguac

SEQ ID NO: 77658 - RNA, 32 nt, Human
caauuucugcuggcuggacugaacugaagauc

SEQ ID NO: 77659 - RNA, 32 nt, Human
caauuucuuacagccauuuaacuuucuguugg

SEQ ID NO: 77660 - RNA, 32 nt, Human
caauuucuuaggcuggagugcaguggcacgau

SEQ ID NO: 77661 - RNA, 32 nt, Human
caauuugaaggaggaggaaugaugggauuuca

SEQ ID NO: 77662 - RNA, 32 nt, Human
caauuugagacaggguuucgcuguguugcucc

SEQ ID NO: 77663 - RNA, 32 nt, Human
caauuugagacaggguuucucuguguugcucu

SEQ ID NO: 77664 - RNA, 32 nt, Human
caauuugagauggagacagugauuggguuuuu

SEQ ID NO: 77665 - RNA, 32 nt, Human
caauuugccccaccaccaccuccucgggcuuc

SEQ ID NO: 77666 - RNA, 32 nt, Human
caauuugcuagaagcuuaauguaggcaagcca

SEQ ID NO: 77667 - RNA, 32 nt, Human
caauuugcuuucuccuccucaaggguuaagaa

SEQ ID NO: 77668 - RNA, 32 nt, Human
caauuuggacuugccuuugucuugguuccugc

SEQ ID NO: 77669 - RNA, 32 nt, Human
caauuuggcuggucucgacuccuggcuggucu

SEQ ID NO: 77670 - RNA, 32 nt, Human
caauuuggcuucccuaacuuaacauugcauca

SEQ ID NO: 77671 - RNA, 32 nt, Human
caauuugggaggccaaggugggcagaucacuu

SEQ ID NO: 77672 - RNA, 32 nt, Human
caauuugggaggccgagguaaauggaugaccu

SEQ ID NO: 77673 - RNA, 32 nt, Human
caauuugggaggcugagaagggcagaucuucu

SEQ ID NO: 77674 - RNA, 32 nt, Human
caauuugggaggcugaggcgggaggaucacuu

SEQ ID NO: 77675 - RNA, 32 nt, Human
caauuugggaggcugaggugggcagaucacuu

SEQ ID NO: 77676 - RNA, 32 nt, Human
caauuugggaguccgaggcgggcggaucacuc

SEQ ID NO: 77677 - RNA, 32 nt, Human
caauuuggucucgggguagggggagacggggu

SEQ ID NO: 77678 - RNA, 32 nt, Human
caauuuguaagcucaauuucucugacagccaa

SEQ ID NO: 77679 - RNA, 32 nt, Human
caauuugucaaauuaugcagaagagacagagg

SEQ ID NO: 77680 - RNA, 32 nt, Human
caauuugugcucaugggaagcucuuuaagcac

SEQ ID NO: 77681 - RNA, 32 nt, Human
caauuugugggaacaggaggggagaggaaaca

SEQ ID NO: 77682 - RNA, 32 nt, Human
caauuuuauauguaugcuauuuguuguauuua

SEQ ID NO: 77683 - RNA, 32 nt, Human
caauuuuauuaaaaauccaaagauaagucuuu

SEQ ID NO: 77684 - RNA, 32 nt, Human
caauuuuauucuguaugagcaauaugauucaa

SEQ ID NO: 77685 - RNA, 32 nt, Human
caauuuuauuuucuucuuucucagaccucagu

SEQ ID NO: 77686 - RNA, 20 nt, Human
caauuuucauguguaaggua

SEQ ID NO: 77687 - RNA, 32 nt, Human
caauuuucauucuguuuucugacuuucaaguu

SEQ ID NO: 77688 - RNA, 32 nt, Human
caauuuuccagacucagccucugggaucucac

SEQ ID NO: 77689 - RNA, 32 nt, Human
caauuuucucaccucuguaaauuuuagucuca

SEQ ID NO: 77690 - RNA, 32 nt, Human
caauuuucuccaaaacaaaccccaccgggcaa

SEQ ID NO: 77691 - RNA, 32 nt, Human
caauuuucucuagcugccugaugucaacugcu

SEQ ID NO: 77692 - RNA, 32 nt, Human
caauuuucugcagccucuuuuugccugagcaa

SEQ ID NO: 77693 - RNA, 32 nt, Human
caauuuugaaacuugauauaaaaugaggaggg

SEQ ID NO: 77694 - RNA, 32 nt, Human
caauuuugcuggacuucaaccuggguagaaga

SEQ ID NO: 77695 - RNA, 32 nt, Human
caauuuuggcauuuugccuucugugauaauag

SEQ ID NO: 77696 - RNA, 32 nt, Human
caauuuugggaauaccugcuacugcaauucag

SEQ ID NO: 77697 - RNA, 31 nt, Human
caauuuugugagagaaagacuguacuccaua

SEQ ID NO: 77698 - RNA, 32 nt, Human
caauuuuuacauaggaggaaacggcucagaga

SEQ ID NO: 77699 - RNA, 32 nt, Human
caauuuuucuucuucuuccuucugucccuccu

SEQ ID NO: 77700 - RNA, 32 nt, Human
caauuuuugauugcuuugacuuuugguguguc

SEQ ID NO: 77701 - RNA, 32 nt, Human
caauuuuugugcauucccaacaugcucuaaug

SEQ ID NO: 77702 - RNA, 21 nt, Human
cacaaaaacuggguggcuugg

SEQ ID NO: 77703 - RNA, 32 nt, Human
cacaaaaagaagcaguuggacucgggaagcug

SEQ ID NO: 77704 - RNA, 23 nt, Human
cacaaaaagagaaggcuuuggua

SEQ ID NO: 77705 - RNA, 32 nt, Human
cacaaaaagauaagaaagauucaaagaauucc

SEQ ID NO: 77706 - RNA, 32 nt, Human
cacaaaaaggaaaguuugggaagggaugggag

SEQ ID NO: 77707 - RNA, 32 nt, Human
cacaaaaaggcagagagagaaggauuaaaugg

SEQ ID NO: 77708 - RNA, 32 nt, Human
cacaaaaaggccugggacagggucaguacaag

SEQ ID NO: 77709 - RNA, 32 nt, Human
cacaaaaagggccugcugacucccagaagacc

SEQ ID NO: 77710 - RNA, 32 nt, Human
cacaaaaauaaagacuagagcaaaauaaugca

SEQ ID NO: 77711 - RNA, 32 nt, Human
cacaaaaauguaccugagaacaauuagaaagu

SEQ ID NO: 77712 - RNA, 24 nt, Human
cacaaaaauuagccagauguggug

SEQ ID NO: 77713 - RNA, 24 nt, Human
cacaaaaauuagccaggcauggug

SEQ ID NO: 77714 - RNA, 24 nt, Human
cacaaaaauuagccaggcguggug

SEQ ID NO: 77715 - RNA, 24 nt, Human
cacaaaaauuagccagguauggug

SEQ ID NO: 77716 - RNA, 22 nt, Human
cacaaaaauuagccaggugugg

SEQ ID NO: 77717 - RNA, 24 nt, Human
cacaaaaauuagccggacguggug

SEQ ID NO: 77718 - RNA, 24 nt, Human
cacaaaaauuagccgggcggggug

SEQ ID NO: 77719 - RNA, 24 nt, Human
cacaaaaauuagccgggcguggug

SEQ ID NO: 77720 - RNA, 24 nt, Human
cacaaaaauuagcuaggcauggug

SEQ ID NO: 77721 - RNA, 24 nt, Human
cacaaaaauuagcugagcauggug

SEQ ID NO: 77722 - RNA, 24 nt, Human
cacaaaaauuagcugggcauggug

SEQ ID NO: 77723 - RNA, 24 nt, Human
cacaaaaauuagcuggguguggug

SEQ ID NO: 77724 - RNA, 24 nt, Human
cacaaaaauuagucaggcguggua

SEQ ID NO: 77725 - RNA, 32 nt, Human
cacaaaaccacuuuuuccuccugggccucugg

SEQ ID NO: 77726 - RNA, 32 nt, Human
cacaaaaccagagcggaaggagggacuuccca

SEQ ID NO: 77727 - RNA, 32 nt, Human
cacaaaaccauccuuguaccaccaugaauagu

SEQ ID NO: 77728 - RNA, 32 nt, Human
cacaaaacccucagugcuggagaagagucagu

SEQ ID NO: 77729 - RNA, 32 nt, Human
cacaaaaccgggaaaggaaggaaaggacagcg

SEQ ID NO: 77730 - RNA, 32 nt, Human
cacaaaacggucagcacccaaccugacucgca

SEQ ID NO: 77731 - RNA, 32 nt, Human
cacaaaacucaagauugggagcucuuugugau

SEQ ID NO: 77732 - RNA, 32 nt, Human
cacaaaacugauuuuaaaaucaaguuaaugug

SEQ ID NO: 77733 - RNA, 32 nt, Human
cacaaaacuuuugggaauuccucuuugcaccc

SEQ ID NO: 77734 - RNA, 32 nt, Human
cacaaaagaauauguugugagcaucuuuccau

SEQ ID NO: 77735 - RNA, 32 nt, Human
cacaaaagaccaccuuucuccccugagaggag

SEQ ID NO: 77736 - RNA, 32 nt, Human
cacaaaagcagagguuugggaauuccagaagg

SEQ ID NO: 77737 - RNA, 32 nt, Human
cacaaaagcccugcuugcuuuugcagcuggga

SEQ ID NO: 77738 - RNA, 32 nt, Human
cacaaaaggaauagaucuaugauugacccuga

SEQ ID NO: 77739 - RNA, 32 nt, Human
cacaaaagggccugauggugauaugacuccac

SEQ ID NO: 77740 - RNA, 32 nt, Human
cacaaaagugccacuaaaacagccuaaggaga

SEQ ID NO: 77741 - RNA, 32 nt, Human
cacaaaagugccacuaaaacagccucaggaga

SEQ ID NO: 77742 - RNA, 32 nt, Human
cacaaaauaaguaugcauaaauaaaugagugg

SEQ ID NO: 77743 - RNA, 32 nt, Human
cacaaaaucacugaggcugugacaggagggga

SEQ ID NO: 77744 - RNA, 32 nt, Human
cacaaaaucccugcccuuaacaagcucacauu

SEQ ID NO: 77745 - RNA, 32 nt, Human
cacaaaauguacaaauguaaacuugcucauuu

SEQ ID NO: 77746 - RNA, 23 nt, Human
cacaaaauuagcugggcguggua

SEQ ID NO: 77747 - RNA, 32 nt, Human
cacaaacaaaggcuuagaauuccacaugaaag

SEQ ID NO: 77748 - RNA, 32 nt, Human
cacaaacacagcccuggaaacauacaguggcg

SEQ ID NO: 77749 - RNA, 32 nt, Human
cacaaacacagggaaagagggcaaacuagaca

SEQ ID NO: 77750 - RNA, 32 nt, Human
cacaaacaccaaggaguggaggucagaguguc

SEQ ID NO: 77751 - RNA, 32 nt, Human
cacaaacagccccucuggacacagccccaugu

SEQ ID NO: 77752 - RNA, 32 nt, Human
cacaaacaggaccugcauccugucucacaaau

SEQ ID NO: 77753 - RNA, 32 nt, Human
cacaaacaggcagagagggacguguagggaga

SEQ ID NO: 77754 - RNA, 32 nt, Human
cacaaacagugaggcccccacccgagagaggg

SEQ ID NO: 77755 - RNA, 32 nt, Human
cacaaacaugcacacacacauaugcauaucuu

SEQ ID NO: 77756 - RNA, 21 nt, Human
cacaaacaugggugguaacaa

SEQ ID NO: 77757 - RNA, 32 nt, Human
cacaaaccaauacugucauugcuaaucugaac

SEQ ID NO: 77758 - RNA, 32 nt, Human
cacaaaccaggaugcggacgggggaagcgcca

SEQ ID NO: 77759 - RNA, 32 nt, Human
cacaaacccacccugugcccacccucccauca

SEQ ID NO: 77760 - RNA, 32 nt, Human
cacaaacccuggggacucugcuuggcuguccc

SEQ ID NO: 77761 - RNA, 32 nt, Human
cacaaacccuuuccuucaucaucacucccugc

SEQ ID NO: 77762 - RNA, 32 nt, Human
cacaaaccugcucugccacuuucaaccugcag

SEQ ID NO: 77763 - RNA, 32 nt, Human
cacaaaccuuaccccacccccaccuccgaguc

SEQ ID NO: 77764 - RNA, 32 nt, Human
cacaaacuaaccagcugggauuacagguauga

SEQ ID NO: 77765 - RNA, 32 nt, Human
cacaaacuacagccugcaggccaaagccagcc

SEQ ID NO: 77766 - RNA, 32 nt, Human
cacaaacuccuccaaaccccaaaccccaaacg

SEQ ID NO: 77767 - RNA, 22 nt, Human
cacaaacucuucccagguaguu

SEQ ID NO: 77768 - RNA, 32 nt, Human
cacaaacugggugauagggcggacuuaccugg

SEQ ID NO: 77769 - RNA, 32 nt, Human
cacaaacuuaaacaaaagccugggaacacaaa

SEQ ID NO: 77770 - RNA, 19 nt, Human
cacaaacuucaccuggaga

SEQ ID NO: 77771 - RNA, 32 nt, Human
cacaaacuugcagccuaaggcagaaucugaag

SEQ ID NO: 77772 - RNA, 32 nt, Human
cacaaagaaggaagaaaagaaggaguggagga

SEQ ID NO: 77773 - RNA, 32 nt, Human
cacaaagaaggaggaggaaaaggugagaaaga

SEQ ID NO: 77774 - RNA, 32 nt, Human
cacaaagacaaacuggcuugugagguguucuc

SEQ ID NO: 77775 - RNA, 21 nt, Human
cacaaagacacccucuccaga

SEQ ID NO: 77776 - RNA, 32 nt, Human
cacaaagacucagccaagaguucucuuuauuc

SEQ ID NO: 77777 - RNA, 32 nt, Human
cacaaagacugaagaucaaggaagagagugag

SEQ ID NO: 77778 - RNA, 32 nt, Human
cacaaagacugucaagugaagaaugguggaga

SEQ ID NO: 77779 - RNA, 32 nt, Human
cacaaagaugccuguuuccugucuucucgguu

SEQ ID NO: 77780 - RNA, 32 nt, Human
cacaaagauggauguaaugcacuuugggaggc

SEQ ID NO: 77781 - RNA, 32 nt, Human
cacaaagcaaacugagugaugaaggaagacuu

SEQ ID NO: 77782 - RNA, 32 nt, Human
cacaaagcaguuaauuaggcagccuggagaaa

SEQ ID NO: 77783 - RNA, 32 nt, Human
cacaaagccacuguagccagacugccucucua

SEQ ID NO: 77784 - RNA, 26 nt, Human
cacaaagccaggcacugccaagugga

SEQ ID NO: 77785 - RNA, 32 nt, Human
cacaaagcuacuggucagcugggcagcucagc

SEQ ID NO: 77786 - RNA, 32 nt, Human
cacaaagcuauuuuaaagaagaugcuauguug

SEQ ID NO: 77787 - RNA, 32 nt, Human
cacaaagcuccaugcugucauggaugcuguuu

SEQ ID NO: 77788 - RNA, 32 nt, Human
cacaaagcucuagcccacugaaccucugccgg

SEQ ID NO: 77789 - RNA, 32 nt, Human
cacaaaggagcaccuccaaauggccaagaagc

SEQ ID NO: 77790 - RNA, 21 nt, Human
cacaaaggagucgcccacugg

SEQ ID NO: 77791 - RNA, 22 nt, Human
cacaaaggcagcgcugcugggg

SEQ ID NO: 77792 - RNA, 32 nt, Human
cacaaaggccucgaaaagaggucuccagcaaa

SEQ ID NO: 77793 - RNA, 32 nt, Human
cacaaaggcuccugggacucugggcagaguca

SEQ ID NO: 77794 - RNA, 32 nt, Human
cacaaaggcucuucagcuccccucccugcuuc

SEQ ID NO: 77795 - RNA, 32 nt, Human
cacaaagggaacaaaugaagaacauaaaauga

SEQ ID NO: 77796 - RNA, 32 nt, Human
cacaaagggagaggagagaacagggcaagacg

SEQ ID NO: 77797 - RNA, 32 nt, Human
cacaaaggggcagaaggagggagccacgggcc

SEQ ID NO: 77798 - RNA, 32 nt, Human
cacaaagggguggucacccugcccucaccuug

SEQ ID NO: 77799 - RNA, 32 nt, Human
cacaaagguggaccugagaucacuggagccaa

SEQ ID NO: 77800 - RNA, 32 nt, Human
cacaaaggugggaggauguggggaagggggaa

SEQ ID NO: 77801 - RNA, 32 nt, Human
cacaaaguagacauauacacacacauauaugu

SEQ ID NO: 77802 - RNA, 32 nt, Human
cacaaaguagcagaaauaggaugauguuugug

SEQ ID NO: 77803 - RNA, 32 nt, Human
cacaaagucagcuccucucccaccacaggcuc

SEQ ID NO: 77804 - RNA, 32 nt, Human
cacaaagucucaagugacagcaaccagacaga

SEQ ID NO: 77805 - RNA, 32 nt, Human
cacaaagugaacggaucacuggggaaggcaga

SEQ ID NO: 77806 - RNA, 32 nt, Human
cacaaaguggagauagcaguagcaccaacucc

SEQ ID NO: 77807 - RNA, 32 nt, Human
cacaaaguucaauggacuugaaccacgcgucc

SEQ ID NO: 77808 - RNA, 32 nt, Human
cacaaaguugugugaagcagaagagaaaagcu

SEQ ID NO: 77809 - RNA, 28 nt, Human
cacaaaguuguguuucuuuuguguccuu

SEQ ID NO: 77810 - RNA, 32 nt, Human
cacaaauaguacaugugaaauuuccaagcauu

SEQ ID NO: 77811 - RNA, 32 nt, Human
cacaaauauacaugcacauacauacacagaau

SEQ ID NO: 77812 - RNA, 32 nt, Human
cacaaauauggugaaacccaauuucuuacauc

SEQ ID NO: 77813 - RNA, 32 nt, Human
cacaaaucaggccggacaggagagggaggggu

SEQ ID NO: 77814 - RNA, 32 nt, Human
cacaaaucauacccuugucugcuccaauucag

SEQ ID NO: 77815 - RNA, 32 nt, Human
cacaaauccuuuaaccguuucuccccaagagg

SEQ ID NO: 77816 - RNA, 32 nt, Human
cacaaauccuuuaacuguuucuccccaacagg

SEQ ID NO: 77817 - RNA, 32 nt, Human
cacaaaugcacacacaugcacacacacauuuc

SEQ ID NO: 77818 - RNA, 32 nt, Human
cacaaaugcaguauuaucauugacauaccucu

SEQ ID NO: 77819 - RNA, 32 nt, Human
cacaaaugcaucauugcacuccagccugggug

SEQ ID NO: 77820 - RNA, 32 nt, Human
cacaaaugcucuggacacagacagauccuggg

SEQ ID NO: 77821 - RNA, 32 nt, Human
cacaaaugcuuacaggguuuccucccgaguaa

SEQ ID NO: 77822 - RNA, 32 nt, Human
cacaaauguacagcuacauuagcaacaggaaa

SEQ ID NO: 77823 - RNA, 32 nt, Human
cacaaaugugccagaagguucuauaucucaag

SEQ ID NO: 77824 - RNA, 32 nt, Human
cacaaauguuccauacaagacaucauugagga

SEQ ID NO: 77825 - RNA, 32 nt, Human
cacaaauuggccugagcauaagaagaaaaagu

SEQ ID NO: 77826 - RNA, 32 nt, Human
cacaaauuuaacauugccagguucuagugauu

SEQ ID NO: 77827 - RNA, 22 nt, Human
cacaacaaacccuggguucuag

SEQ ID NO: 77828 - RNA, 32 nt, Human
cacaacaaagaacuccacuguggggaugaagc

SEQ ID NO: 77829 - RNA, 32 nt, Human
cacaacaaagagaggccucuuuuguggcuggu

SEQ ID NO: 77830 - RNA, 32 nt, Human
cacaacaacaacaacaaaaagcuuccccaacu

SEQ ID NO: 77831 - RNA, 32 nt, Human
cacaacaauuacccaaacccaagaggcggagg

SEQ ID NO: 77832 - RNA, 32 nt, Human
cacaacacacaccacaccugggacuguuuuua

SEQ ID NO: 77833 - RNA, 32 nt, Human
cacaacacacagauuugagcucagcccuggug

SEQ ID NO: 77834 - RNA, 32 nt, Human
cacaacacagcccaggugugggaacaguaggc

SEQ ID NO: 77835 - RNA, 32 nt, Human
cacaacaccuccuaccaaaaggaagagcaagu

SEQ ID NO: 77836 - RNA, 32 nt, Human
cacaacaccuggcuuauuuuuguauuuuuagc

SEQ ID NO: 77837 - RNA, 32 nt, Human
cacaacacugaaccucuggcuagaggacauau

SEQ ID NO: 77838 - RNA, 32 nt, Human
cacaacacugccuaguugugggcugccuuugu

SEQ ID NO: 77839 - RNA, 32 nt, Human
cacaacacuggguguuggagaaagggagagau

SEQ ID NO: 77840 - RNA, 32 nt, Human
cacaacacuuggcuaauuuguguauuuuuagu

SEQ ID NO: 77841 - RNA, 32 nt, Human
cacaacagaagaccucaccuccacucggagcg

SEQ ID NO: 77842 - RNA, 20 nt, Human
cacaacagauaauguggaga

SEQ ID NO: 77843 - RNA, 32 nt, Human
cacaacaggaacaggcccauuuggaucacgcu

SEQ ID NO: 77844 - RNA, 32 nt, Human
cacaacaggaauauacugaagaacuagagugu

SEQ ID NO: 77845 - RNA, 32 nt, Human
cacaacaggcuacgaagaaccuggugccucag

SEQ ID NO: 77846 - RNA, 32 nt, Human
cacaacagguggcagugguggugacugauagg

SEQ ID NO: 77847 - RNA, 32 nt, Human
cacaacaguccccagagugugauguuccccuu

SEQ ID NO: 77848 - RNA, 24 nt, Human
cacaacauaccagaaucucuggga

SEQ ID NO: 77849 - RNA, 32 nt, Human
cacaacaucagcucugugccaccucccaagag

SEQ ID NO: 77850 - RNA, 32 nt, Human
cacaacaucaucacagggacccugccuccuuc

SEQ ID NO: 77851 - RNA, 32 nt, Human
cacaacaugccaccucaugccccuauauccug

SEQ ID NO: 77852 - RNA, 32 nt, Human
cacaacauuacacacauauacacacagccuga

SEQ ID NO: 77853 - RNA, 32 nt, Human
cacaacauugcacuucagccuggugacaugag

SEQ ID NO: 77854 - RNA, 32 nt, Human
cacaaccaaggaggugguuggacagcuggagg

SEQ ID NO: 77855 - RNA, 32 nt, Human
cacaaccaaggcagacagcaugggugaccagc

SEQ ID NO: 77856 - RNA, 32 nt, Human
cacaaccacauuuguucauuauacaaaauuag

SEQ ID NO: 77857 - RNA, 32 nt, Human
cacaaccacucacugagaguugcccuucuuaa

SEQ ID NO: 77858 - RNA, 32 nt, Human
cacaaccagaugacccauuuuacccuauucac

SEQ ID NO: 77859 - RNA, 32 nt, Human
cacaaccagcagcuccugccauggacaggugg

SEQ ID NO: 77860 - RNA, 23 nt, Human
cacaaccagccaggcagguccac

SEQ ID NO: 77861 - RNA, 19 nt, Human
cacaaccagguaucugcuu

SEQ ID NO: 77862 - RNA, 25 nt, Human
cacaaccaggugugcacuguucacu

SEQ ID NO: 77863 - RNA, 32 nt, Human
cacaaccagugcacuccugccuuuucacucac

SEQ ID NO: 77864 - RNA, 32 nt, Human
cacaaccaucugccuggaagaccugggcuucu

SEQ ID NO: 77865 - RNA, 21 nt, Human
cacaaccaugacgcacugcuc

SEQ ID NO: 77866 - RNA, 32 nt, Human
cacaaccaugcauaaaugacccugccauccua

SEQ ID NO: 77867 - RNA, 32 nt, Human
cacaaccauuccagagaucuccuuggagccac

SEQ ID NO: 77868 - RNA, 32 nt, Human
cacaacccagaaguaaccaccuuuaaaaagca

SEQ ID NO: 77869 - RNA, 32 nt, Human
cacaaccccagcagguguauguugcugcaaaa

SEQ ID NO: 77870 - RNA, 32 nt, Human
cacaacccccagccaaucaggacuuuccagac

SEQ ID NO: 77871 - RNA, 32 nt, Human
cacaacccccuuccucuguggccuccuuuucc

SEQ ID NO: 77872 - RNA, 32 nt, Human
cacaaccccuaggccccucaggagcuuugcag

SEQ ID NO: 77873 - RNA, 32 nt, Human
cacaaccccuuuaugaaccaguuuucacccga

SEQ ID NO: 77874 - RNA, 32 nt, Human
cacaacccuccagaacugacguuggcaggaag

SEQ ID NO: 77875 - RNA, 32 nt, Human
cacaacccuccccuggcccucugauuuguucu

SEQ ID NO: 77876 - RNA, 32 nt, Human
cacaaccgcacacccauacacaacuacaaggg

SEQ ID NO: 77877 - RNA, 32 nt, Human
cacaaccguccagcaaagccagcacagcagag

SEQ ID NO: 77878 - RNA, 32 nt, Human
cacaaccuacagccaccgccgcccggccguuu

SEQ ID NO: 77879 - RNA, 24 nt, Human
cacaaccuaucaagaccucuggga

SEQ ID NO: 77880 - RNA, 32 nt, Human
cacaaccuccagccucccuuuucagagcacag

SEQ ID NO: 77881 - RNA, 32 nt, Human
cacaaccucugccuccccgguucaagugauuc

SEQ ID NO: 77882 - RNA, 32 nt, Human
cacaaccugaaagaccuagaacccagugucgg

SEQ ID NO: 77883 - RNA, 32 nt, Human
cacaaccugcaaaccaggagagagggacaggu

SEQ ID NO: 77884 - RNA, 32 nt, Human
cacaaccuugccacaccucuuggcauggggug

SEQ ID NO: 77885 - RNA, 26 nt, Human
cacaaccuuuuccucaccagucccau

SEQ ID NO: 77886 - RNA, 32 nt, Human
cacaacgaaucuccuucaaggaaccacacauu

SEQ ID NO: 77887 - RNA, 32 nt, Human
cacaacgcccagcuaauuuuuagguuuuucuu

SEQ ID NO: 77888 - RNA, 32 nt, Human
cacaacgcccggcuaauuguuguauuuuuagu

SEQ ID NO: 77889 - RNA, 32 nt, Human
cacaacgccuggcuaaguuuuuguauuuuuag

SEQ ID NO: 77890 - RNA, 32 nt, Human
cacaacgccuggcuaauuuuguauuuuuagua

SEQ ID NO: 77891 - RNA, 32 nt, Human
cacaacggcgcccgacccugcccgcgccucgc

SEQ ID NO: 77892 - RNA, 32 nt, Human
cacaacuacauguauguguggcauuuuuguua

SEQ ID NO: 77893 - RNA, 32 nt, Human
cacaacuaggagagaaagggcagcucccucuu

SEQ ID NO: 77894 - RNA, 32 nt, Human
cacaacuauacagcuauaggguaggaggcuuc

SEQ ID NO: 77895 - RNA, 32 nt, Human
cacaacucaccucguguggaugacuuugugua

SEQ ID NO: 77896 - RNA, 32 nt, Human
cacaacucacugcagccuggaccuccuagccu

SEQ ID NO: 77897 - RNA, 32 nt, Human
cacaacuccaggagagguuccugagcugaguc

SEQ ID NO: 77898 - RNA, 32 nt, Human
cacaacucccaaaccagggauuccuuuauacc

SEQ ID NO: 77899 - RNA, 32 nt, Human
cacaacuccuuggcuuaaacagcuccaccggu

SEQ ID NO: 77900 - RNA, 32 nt, Human
cacaacugaaccagaagagagugaagacuccc

SEQ ID NO: 77901 - RNA, 21 nt, Human
cacaacugacucucuuuuuca

SEQ ID NO: 77902 - RNA, 32 nt, Human
cacaacugagucaucucaaguacucuuuaagg

SEQ ID NO: 77903 - RNA, 32 nt, Human
cacaacugcacuccagccugggcaacagaaca

SEQ ID NO: 77904 - RNA, 32 nt, Human
cacaacugcacuccagcuugggcaacagggcg

SEQ ID NO: 77905 - RNA, 32 nt, Human
cacaacugccugguccgcgagaacaagaaugu

SEQ ID NO: 77906 - RNA, 31 nt, Human
cacaacugggagaaaccucagauucuacuug

SEQ ID NO: 77907 - RNA, 32 nt, Human
cacaacuguggucccagcuacaggggaggcug

SEQ ID NO: 77908 - RNA, 32 nt, Human
cacaacuugcgaguguagugacuuuaggacug

SEQ ID NO: 77909 - RNA, 32 nt, Human
cacaacuuuggacaccccaggcugccaccccu

SEQ ID NO: 77910 - RNA, 32 nt, Human
cacaagaaaccagcugaacaauuucagucauu

SEQ ID NO: 77911 - RNA, 32 nt, Human
cacaagaaaccaguuucuucaucugaaaccga

SEQ ID NO: 77912 - RNA, 32 nt, Human
cacaagaaauuagcugggcgugguggcgcgug

SEQ ID NO: 77913 - RNA, 32 nt, Human
cacaagaacacacacauauacacgaauagaca

SEQ ID NO: 77914 - RNA, 32 nt, Human
cacaagaacagcuuuggaaauggcuguugagc

SEQ ID NO: 77915 - RNA, 32 nt, Human
cacaagaagcagcugcagcugauggggagcuc

SEQ ID NO: 77916 - RNA, 32 nt, Human
cacaagaagcagcugccuggagagaguggcug

SEQ ID NO: 77917 - RNA, 32 nt, Human
cacaagacaagucagggcuaaauaugacagau

SEQ ID NO: 77918 - RNA, 32 nt, Human
cacaagacaucagagaacacacacagggaaaa

SEQ ID NO: 77919 - RNA, 32 nt, Human
cacaagacauucagcacaccaccuccuccugu

SEQ ID NO: 77920 - RNA, 32 nt, Human
cacaagaccacgacuaggggaagcccggaggg

SEQ ID NO: 77921 - RNA, 32 nt, Human
cacaagacccagcuaauuuuuguguuuuuagu

SEQ ID NO: 77922 - RNA, 32 nt, Human
cacaagacccuccccauaagcaggggaccagc

SEQ ID NO: 77923 - RNA, 32 nt, Human
cacaagacuaucauuuuuaaugaccaagagcc

SEQ ID NO: 77924 - RNA, 32 nt, Human
cacaagacucacuccugccccgccaccuccug

SEQ ID NO: 77925 - RNA, 32 nt, Human
cacaagacuguaucuccagcccaaugggaccc

SEQ ID NO: 77926 - RNA, 32 nt, Human
cacaagacuucagacaccagccacaaaugggg

SEQ ID NO: 77927 - RNA, 32 nt, Human
cacaagagagacugaggaaggccuggaggcag

SEQ ID NO: 77928 - RNA, 32 nt, Human
cacaagagagcaagaaaaugugucacaucuau

SEQ ID NO: 77929 - RNA, 32 nt, Human
cacaagagagguggcuuugaguggguuuccuu

SEQ ID NO: 77930 - RNA, 32 nt, Human
cacaagagccacugcacaacagccaaggaacu

SEQ ID NO: 77931 - RNA, 32 nt, Human
cacaagaucauggcuaaagacagagcaauuca

SEQ ID NO: 77932 - RNA, 32 nt, Human
cacaagcaaagcuuuggacaauggcacagcuc

SEQ ID NO: 77933 - RNA, 32 nt, Human
cacaagcaagaucucaggguagggaaaaacca

SEQ ID NO: 77934 - RNA, 32 nt, Human
cacaagcacagaggcccugcggcaggaacaug

SEQ ID NO: 77935 - RNA, 32 nt, Human
cacaagcacuugcacacauguggacuccuaac

SEQ ID NO: 77936 - RNA, 32 nt, Human
cacaagcagaaggaguuggagcacagguuguc

SEQ ID NO: 77937 - RNA, 32 nt, Human
cacaagcagacacacacauauauacauacgca

SEQ ID NO: 77938 - RNA, 32 nt, Human
cacaagcauaugcauacacacauauauacaug

SEQ ID NO: 77939 - RNA, 32 nt, Human
cacaagccagccagggcccaggaagauggggc

SEQ ID NO: 77940 - RNA, 21 nt, Human
cacaagcccuuugcugaggug

SEQ ID NO: 77941 - RNA, 32 nt, Human
cacaagccucaccuguaucuuccuggcucgga

SEQ ID NO: 77942 - RNA, 32 nt, Human
cacaagccuccucuccccagucugccccacuu

SEQ ID NO: 77943 - RNA, 32 nt, Human
cacaagccuccugggugacccugggcuagaau

SEQ ID NO: 77944 - RNA, 32 nt, Human
cacaagccucgaggugccuucuucagggccug

SEQ ID NO: 77945 - RNA, 32 nt, Human
cacaagccuguaaucucugcacuuugggaugc

SEQ ID NO: 77946 - RNA, 32 nt, Human
cacaagccuuucuugcugcugugcuucaagac

SEQ ID NO: 77947 - RNA, 22 nt, Human
cacaagcgccagcugcaggucc

SEQ ID NO: 77948 - RNA, 32 nt, Human
cacaagcuacccacgcccacaggcugacccag

SEQ ID NO: 77949 - RNA, 32 nt, Human
cacaagcucuaggaguucugaacggaaggcag

SEQ ID NO: 77950 - RNA, 32 nt, Human
cacaagcucugccuucccucccugguccucuu

SEQ ID NO: 77951 - RNA, 32 nt, Human
cacaagcugaaggucaaaaaugauuuaaaaca

SEQ ID NO: 77952 - RNA, 32 nt, Human
cacaagcugccucugacagcagccugugaggg

SEQ ID NO: 77953 - RNA, 32 nt, Human
cacaagcuuuuguucucucaguacuuguuacc

SEQ ID NO: 77954 - RNA, 32 nt, Human
cacaaggacagugugugcaauggcuuggacca

SEQ ID NO: 77955 - RNA, 32 nt, Human
cacaaggacgggucaggaaggaaggagaggcu

SEQ ID NO: 77956 - RNA, 32 nt, Human
cacaaggagcagaucuggugggcaggggccau

SEQ ID NO: 77957 - RNA, 32 nt, Human
cacaaggagccuccagccugcccuguggcaca

SEQ ID NO: 77958 - RNA, 32 nt, Human
cacaaggaggaacccugucccagugcuuccau

SEQ ID NO: 77959 - RNA, 32 nt, Human
cacaaggagguuaaguaacuugugcaagauca

SEQ ID NO: 77960 - RNA, 32 nt, Human
cacaaggagugucccuucuuccccagcagagc

SEQ ID NO: 77961 - RNA, 32 nt, Human
cacaaggauuuuaaauaacuugcucaauagua

SEQ ID NO: 77962 - RNA, 32 nt, Human
cacaaggccaggaguucgagaccagccuggcc

SEQ ID NO: 77963 - RNA, 31 nt, Human
cacaaggcucagaugaagaggugaauugaac

SEQ ID NO: 77964 - RNA, 32 nt, Human
cacaagggaacugacucaggaggcagagaaga

SEQ ID NO: 77965 - RNA, 32 nt, Human
cacaagggagcacucauugucuacacacccua

SEQ ID NO: 77966 - RNA, 23 nt, Human
cacaagggccacccugaggccca

SEQ ID NO: 77967 - RNA, 32 nt, Human
cacaagggcucacgccuguaaucucagcacuu

SEQ ID NO: 77968 - RNA, 32 nt, Human
cacaaggggaagaaugaacacagcuuuuuauu

SEQ ID NO: 77969 - RNA, 32 nt, Human
cacaaggggccagugaggacaacucuggugga

SEQ ID NO: 77970 - RNA, 32 nt, Human
cacaagggggccugagugcaguggcucacguc

SEQ ID NO: 77971 - RNA, 32 nt, Human
cacaagguaacacuuauuaugcaccuguuaac

SEQ ID NO: 77972 - RNA, 32 nt, Human
cacaaggucacauagcuuuuaagugacagggc

SEQ ID NO: 77973 - RNA, 32 nt, Human
cacaaggucaggaguugagaccagccuggcca

SEQ ID NO: 77974 - RNA, 32 nt, Human
cacaaggugcugcuuuucagauccacuaugca

SEQ ID NO: 77975 - RNA, 32 nt, Human
cacaaggugggggaggcccugggcaggauguu

SEQ ID NO: 77976 - RNA, 32 nt, Human
cacaaguacagacacuucacuuagccuagggg

SEQ ID NO: 77977 - RNA, 22 nt, Human
cacaaguacauacaugcacaug

SEQ ID NO: 77978 - RNA, 32 nt, Human
cacaaguacgaacuuagcaacacuauauugag

SEQ ID NO: 77979 - RNA, 22 nt, Human
cacaaguacucccagcacaaua

SEQ ID NO: 77980 - RNA, 32 nt, Human
cacaaguaugcugguaguagccucuuuaaaua

SEQ ID NO: 77981 - RNA, 32 nt, Human
cacaagucagaacuuccaccaagggcauuacu

SEQ ID NO: 77982 - RNA, 19 nt, Human
cacaagucagcagugcaga

SEQ ID NO: 77983 - RNA, 32 nt, Human
cacaagucaggagcuagagaccagccugguca

SEQ ID NO: 77984 - RNA, 32 nt, Human
cacaagucaggaguucgagaccagccugggca

SEQ ID NO: 77985 - RNA, 32 nt, Human
cacaagucaugcugaguuuugcagccucugug

SEQ ID NO: 77986 - RNA, 23 nt, Human
cacaagucucugauuucagaaga

SEQ ID NO: 77987 - RNA, 32 nt, Human
cacaagucuguaaucccagcacuuugggaggc

SEQ ID NO: 77988 - RNA, 32 nt, Human
cacaagucuuaugggcaccacagggaacaucc

SEQ ID NO: 77989 - RNA, 32 nt, Human
cacaagucuuuccuuaguaaccugggcgauag

SEQ ID NO: 77990 - RNA, 32 nt, Human
cacaagugaaguguuuuguucuuucuggaguc

SEQ ID NO: 77991 - RNA, 32 nt, Human
cacaagugauccucccaucucugccuugagua

SEQ ID NO: 77992 - RNA, 32 nt, Human
cacaagugauuggaguagaacaugucacugcu

SEQ ID NO: 77993 - RNA, 32 nt, Human
cacaagugcccaggcaaggugcuuggcagaac

SEQ ID NO: 77994 - RNA, 32 nt, Human
cacaagugcgcgggccuguccucccaggggcc

SEQ ID NO: 77995 - RNA, 21 nt, Human
cacaagugcucucccaaaaca

SEQ ID NO: 77996 - RNA, 32 nt, Human
cacaagugggccagggcuggagggagguggga

SEQ ID NO: 77997 - RNA, 32 nt, Human
cacaaguggggacucauugaauuccccugcuc

SEQ ID NO: 77998 - RNA, 31 nt, Human
cacaaguggguggugagaccauugaaagccu

SEQ ID NO: 77999 - RNA, 32 nt, Human
cacaaguggucuggacaugaggguacaguuuc

SEQ ID NO: 78000 - RNA, 32 nt, Human
cacaaguuaaugaaacugagaaggucugacug

SEQ ID NO: 78001 - RNA, 32 nt, Human
cacaaguuaaugauuauuaaaucuauaucaaa

SEQ ID NO: 78002 - RNA, 32 nt, Human
cacaaguuagggaggaagaggcaggcgaugag

SEQ ID NO: 78003 - RNA, 32 nt, Human
cacaaguuugauacaaaauguuuuuaucguac

SEQ ID NO: 78004 - RNA, 32 nt, Human
cacaaguuugccagccuccaccuucuaacccu

SEQ ID NO: 78005 - RNA, 32 nt, Human
cacaauaauucuccagcaacagauccaaugaa

SEQ ID NO: 78006 - RNA, 32 nt, Human
cacaauacagagucauuccuagugcagcccaa

SEQ ID NO: 78007 - RNA, 32 nt, Human
cacaauacaguacucaggcagugcaguacuca

SEQ ID NO: 78008 - RNA, 32 nt, Human
cacaauacauuggauuauuuuauaguaaggaa

SEQ ID NO: 78009 - RNA, 32 nt, Human
cacaauaccaccuuucuuuuguucccagacag

SEQ ID NO: 78010 - RNA, 32 nt, Human
cacaauaccugagacaaaggccagcagaaaca

SEQ ID NO: 78011 - RNA, 32 nt, Human
cacaauagacaggccaagaaacccggugcuuc

SEQ ID NO: 78012 - RNA, 22 nt, Human
cacaauagggacucuauggaaa

SEQ ID NO: 78013 - RNA, 32 nt, Human
cacaauauaacuuuacauucuuugccaauauu

SEQ ID NO: 78014 - RNA, 32 nt, Human
cacaauaucaccaggcuucuucugccucccuu

SEQ ID NO: 78015 - RNA, 32 nt, Human
cacaauaucuguauuuugaauggcuauggcgu

SEQ ID NO: 78016 - RNA, 32 nt, Human
cacaauaugccugacacacaaacugcuuaaua

SEQ ID NO: 78017 - RNA, 32 nt, Human
cacaauauuaaaggagcuacagaaggaaggga

SEQ ID NO: 78018 - RNA, 32 nt, Human
cacaauauuuggaauaccaaaagaugacucag

SEQ ID NO: 78019 - RNA, 32 nt, Human
cacaaucaaaggacuguauggaaaaugaguga

SEQ ID NO: 78020 - RNA, 32 nt, Human
cacaaucaacaucaaagugaagcuggauuucu

SEQ ID NO: 78021 - RNA, 32 nt, Human
cacaaucaaggcucacugcagccucaaccuuc

SEQ ID NO: 78022 - RNA, 32 nt, Human
cacaaucacaauauacaauauaagcuuuagaa

SEQ ID NO: 78023 - RNA, 32 nt, Human
cacaaucagcacaacuggagagaggcauuaaa

SEQ ID NO: 78024 - RNA, 32 nt, Human
cacaaucagcgcggaccgcagcgcggcccagc

SEQ ID NO: 78025 - RNA, 32 nt, Human
cacaaucagugcaguuugaggauacguagacc

SEQ ID NO: 78026 - RNA, 32 nt, Human
cacaaucauagcucacugcagcuuugaccucc

SEQ ID NO: 78027 - RNA, 32 nt, Human
cacaaucauauacagggaacccugccacugug

SEQ ID NO: 78028 - RNA, 32 nt, Human
cacaaucaucuucucccaagacugcucccuuu

SEQ ID NO: 78029 - RNA, 20 nt, Human
cacaauccccagcugaggag

SEQ ID NO: 78030 - RNA, 23 nt, Human
cacaaucccuccuacagggccug

SEQ ID NO: 78031 - RNA, 32 nt, Human
cacaauccuccuccuccucuccaggggccugg

SEQ ID NO: 78032 - RNA, 23 nt, Human
cacaaucgcugcaggacaggaag

SEQ ID NO: 78033 - RNA, 32 nt, Human
cacaaucguagacacggucacacuccaguauc

SEQ ID NO: 78034 - RNA, 32 nt, Human
cacaaucguuuuucuaugugugagagggauuu

SEQ ID NO: 78035 - RNA, 32 nt, Human
cacaaucucaacucacuacagccucgaacucc

SEQ ID NO: 78036 - RNA, 32 nt, Human
cacaaucucauggucuuucaggucccugguua

SEQ ID NO: 78037 - RNA, 32 nt, Human
cacaaucugcagccuccaccaggccuugagua

SEQ ID NO: 78038 - RNA, 32 nt, Human
cacaaugacacacacaucacacacacaucaca

SEQ ID NO: 78039 - RNA, 32 nt, Human
cacaaugacucacgccuguaaucccagcacuu

SEQ ID NO: 78040 - RNA, 32 nt, Human
cacaaugagcaucuuuguaaagaauugauuaa

SEQ ID NO: 78041 - RNA, 32 nt, Human
cacaaugagccgcuaaaugggagcucaauuga

SEQ ID NO: 78042 - RNA, 32 nt, Human
cacaaugaucaaguuggauuuagaugauguuc

SEQ ID NO: 78043 - RNA, 32 nt, Human
cacaaugauuucagaggagacucugcaaaauc

SEQ ID NO: 78044 - RNA, 32 nt, Human
cacaaugcaagaaccuaacuaacgugaugaua

SEQ ID NO: 78045 - RNA, 32 nt, Human
cacaaugcagugccuuucuucucuccagugca

SEQ ID NO: 78046 - RNA, 32 nt, Human
cacaaugccuggcaaauuuuccuauuuuugua

SEQ ID NO: 78047 - RNA, 22 nt, Human
cacaauggaauuaugcuggaag

SEQ ID NO: 78048 - RNA, 20 nt, Human
cacaauggacaauucugcuu

SEQ ID NO: 78049 - RNA, 29 nt, Human
cacaauggaccgggcguccgagcugcucu

SEQ ID NO: 78050 - RNA, 32 nt, Human
cacaauggagaaaaggccuuaggaguguggca

SEQ ID NO: 78051 - RNA, 32 nt, Human
cacaauggauucacuucuuuagggagacaagg

SEQ ID NO: 78052 - RNA, 32 nt, Human
cacaauggauuuauuuucucucucagucucca

SEQ ID NO: 78053 - RNA, 32 nt, Human
cacaauggcacaugccuguaauccuagcaggu

SEQ ID NO: 78054 - RNA, 32 nt, Human
cacaauggcaugucuuucuuuuucugccagaa

SEQ ID NO: 78055 - RNA, 32 nt, Human
cacaauggccugggaaguugaggucacuuuuu

SEQ ID NO: 78056 - RNA, 21 nt, Human
cacaauggcuaaauaucuguu

SEQ ID NO: 78057 - RNA, 32 nt, Human
cacaauggcuaacaccuguaaucccagcacuu

SEQ ID NO: 78058 - RNA, 32 nt, Human
cacaauggcucacaccuguaaugccagcccuu

SEQ ID NO: 78059 - RNA, 32 nt, Human
cacaauggcucaugccuauaaucccagcacuu

SEQ ID NO: 78060 - RNA, 23 nt, Human
cacaauggcucaugcuuguaauc

SEQ ID NO: 78061 - RNA, 32 nt, Human
cacaauggcucaugcuuguaaucccaacacuu

SEQ ID NO: 78062 - RNA, 32 nt, Human
cacaauggcucgugcuuguaaucccagcacuu

SEQ ID NO: 78063 - RNA, 21 nt, Human
cacaauggcuuuguuuugcuu

SEQ ID NO: 78064 - RNA, 32 nt, Human
cacaaugggaccugggcgggcguuacacagaa

SEQ ID NO: 78065 - RNA, 23 nt, Human
cacaaugggagguuugguggaag

SEQ ID NO: 78066 - RNA, 32 nt, Human
cacaaugggcaauucugacuucucccaucuag

SEQ ID NO: 78067 - RNA, 19 nt, Human
cacaauggggugccugcuu

SEQ ID NO: 78068 - RNA, 32 nt, Human
cacaauggguagcuggguggccuugcauucug

SEQ ID NO: 78069 - RNA, 32 nt, Human
cacaauggucaaguuggauuuagaugauguuc

SEQ ID NO: 78070 - RNA, 32 nt, Human
cacaauggucucagccuaggcccucaugauuu

SEQ ID NO: 78071 - RNA, 31 nt, Human
cacaauggugcuaccccuugcccaggcaagg

SEQ ID NO: 78072 - RNA, 32 nt, Human
cacaaugguuuuguuucuuuccuucugaucug

SEQ ID NO: 78073 - RNA, 32 nt, Human
cacaauguccccacccacaggguuagaaccuc

SEQ ID NO: 78074 - RNA, 32 nt, Human
cacaaugucccgugccccuuccucacucguuu

SEQ ID NO: 78075 - RNA, 32 nt, Human
cacaaugugaagcugugggugcaguggcgcca

SEQ ID NO: 78076 - RNA, 29 nt, Human
cacaauguuccaccaggugagaagaguga

SEQ ID NO: 78077 - RNA, 32 nt, Human
cacaauguucucucccagcagcccuggacagu

SEQ ID NO: 78078 - RNA, 32 nt, Human
cacaauguuggccaggcuggucucaaacuccu

SEQ ID NO: 78079 - RNA, 32 nt, Human
cacaauuaaagguacaaagcccagaggaagug

SEQ ID NO: 78080 - RNA, 32 nt, Human
cacaauuacucauguaacagucuuucauuaac

SEQ ID NO: 78081 - RNA, 32 nt, Human
cacaauuagaagaaaaguugaaauccagaaua

SEQ ID NO: 78082 - RNA, 32 nt, Human
cacaauucaguuucagcucuggauuacuucag

SEQ ID NO: 78083 - RNA, 32 nt, Human
cacaauucuaauucuacugacuauccuagaaa

SEQ ID NO: 78084 - RNA, 32 nt, Human
cacaauucucagggcucagcagugaugggaga

SEQ ID NO: 78085 - RNA, 32 nt, Human
cacaauugcaguccagccugggcagcaagagu

SEQ ID NO: 78086 - RNA, 32 nt, Human
cacaauuggaaagaaacagauuuucaaauaau

SEQ ID NO: 78087 - RNA, 22 nt, Human
cacaauugucacucacaacaca

SEQ ID NO: 78088 - RNA, 32 nt, Human
cacaauugugauuuucucaaaugcagacaauu

SEQ ID NO: 78089 - RNA, 32 nt, Human
cacaauuuauuuccuccucccgugccagcccu

SEQ ID NO: 78090 - RNA, 32 nt, Human
cacaauuucaaaaguggaaguuaccguggccu

SEQ ID NO: 78091 - RNA, 32 nt, Human
cacaauuucagggcaucugaauguuugaugug

SEQ ID NO: 78092 - RNA, 32 nt, Human
cacaauuucucagugauccucugcaucucugc

SEQ ID NO: 78093 - RNA, 32 nt, Human
cacaauuugagcaauucauuucacuuuaaagu

SEQ ID NO: 78094 - RNA, 32 nt, Human
cacacaaaaaccaaacacucugcccugggaaa

SEQ ID NO: 78095 - RNA, 32 nt, Human
cacacaaaacaaacaaacacaugggggagaga

SEQ ID NO: 78096 - RNA, 32 nt, Human
cacacaaaacauuuaacuaugguauuuaugga

SEQ ID NO: 78097 - RNA, 32 nt, Human
cacacaaaauuagcugggcaugguggccugug

SEQ ID NO: 78098 - RNA, 19 nt, Human
cacacaaacacagaaccac

SEQ ID NO: 78099 - RNA, 32 nt, Human
cacacaaacaugcacacacacauaugcauauc

SEQ ID NO: 78100 - RNA, 32 nt, Human
cacacaaacaugcacacacgcaugcacacaca

SEQ ID NO: 78101 - RNA, 32 nt, Human
cacacaaacaugcacacauacagaguugguug

SEQ ID NO: 78102 - RNA, 22 nt, Human
cacacaaacccagccuggggag

SEQ ID NO: 78103 - RNA, 22 nt, Human
cacacaaacucagagacacaga

SEQ ID NO: 78104 - RNA, 32 nt, Human
cacacaaacuuaaauuacuguuggcaaaacaa

SEQ ID NO: 78105 - RNA, 32 nt, Human
cacacaaaggcagaggcaucgcagaaggaugc

SEQ ID NO: 78106 - RNA, 32 nt, Human
cacacaaauauggugaaacccaauuucuuaca

SEQ ID NO: 78107 - RNA, 21 nt, Human
cacacaaaugggggcaaccac

SEQ ID NO: 78108 - RNA, 18 nt, Human
cacacaaauguuggcaaa

SEQ ID NO: 78109 - RNA, 32 nt, Human
cacacaaauuauugcaguuacauacagaauug

SEQ ID NO: 78110 - RNA, 32 nt, Human
cacacaacaaaauggaaacauacauguacaac

SEQ ID NO: 78111 - RNA, 32 nt, Human
cacacaacacaccacaccccacaccgcacugc

SEQ ID NO: 78112 - RNA, 32 nt, Human
cacacaacagauggacagagaggaagagcgcu

SEQ ID NO: 78113 - RNA, 32 nt, Human
cacacaacccagaaaggagcugauggggcaga

SEQ ID NO: 78114 - RNA, 32 nt, Human
cacacaaccccuguggacugcagccucgcucu

SEQ ID NO: 78115 - RNA, 32 nt, Human
cacacaacugcacuccagccugggcaacagaa

SEQ ID NO: 78116 - RNA, 32 nt, Human
cacacaacuguggaaaugaaacugcaauacaa

SEQ ID NO: 78117 - RNA, 32 nt, Human
cacacaacuucuguuuccuucucuuguguuau

SEQ ID NO: 78118 - RNA, 32 nt, Human
cacacaagacaucagagaacacacacagggaa

SEQ ID NO: 78119 - RNA, 32 nt, Human
cacacaagaugguauaggccugaacaguguag

SEQ ID NO: 78120 - RNA, 32 nt, Human
cacacaagcacuugcacauacauacaaacaca

SEQ ID NO: 78121 - RNA, 31 nt, Human
cacacaagccuuuucugcaggcaggaguuuc

SEQ ID NO: 78122 - RNA, 32 nt, Human
cacacaaggaggaggaagaggaaauggugacc

SEQ ID NO: 78123 - RNA, 32 nt, Human
cacacaaggccugggucugccuuggggcccag

SEQ ID NO: 78124 - RNA, 32 nt, Human
cacacaaggggcaggggugagggugggggugg

SEQ ID NO: 78125 - RNA, 24 nt, Human
cacacaauacaugcaugcacugua

SEQ ID NO: 78126 - RNA, 24 nt, Human
cacacaauacaugcaugcauugua

SEQ ID NO: 78127 - RNA, 32 nt, Human
cacacaauccgugaaaugaauccaucagcaag

SEQ ID NO: 78128 - RNA, 32 nt, Human
cacacaauccuucgcaacugugccagcacuuc

SEQ ID NO: 78129 - RNA, 17 nt, Human
cacacaaugccagugaa

SEQ ID NO: 78130 - RNA, 32 nt, Human
cacacaauugcaguccagccugggcagcaaga

SEQ ID NO: 78131 - RNA, 18 nt, Human
cacacacaaacacacaga

SEQ ID NO: 78132 - RNA, 32 nt, Human
cacacacaaaccugcucacgcagcugugaugc

SEQ ID NO: 78133 - RNA, 32 nt, Human
cacacacaaauacaaauugacaggucaaaauc

SEQ ID NO: 78134 - RNA, 32 nt, Human
cacacacaacacgcaagcacgccuuaaacaca

SEQ ID NO: 78135 - RNA, 32 nt, Human
cacacacaacaugcaagcacgccuuaaacaca

SEQ ID NO: 78136 - RNA, 32 nt, Human
cacacacaaccagggagugccacgccaguguc

SEQ ID NO: 78137 - RNA, 32 nt, Human
cacacacaagcauaugcauacacacauauaua

SEQ ID NO: 78138 - RNA, 32 nt, Human
cacacacaaguaagauggcuucagagagggag

SEQ ID NO: 78139 - RNA, 32 nt, Human
cacacacaaucacuccccagggacggcccgga

SEQ ID NO: 78140 - RNA, 23 nt, Human
cacacacacaaaaucugcaugua

SEQ ID NO: 78141 - RNA, 32 nt, Human
cacacacacaaaccccaacaacucuuuaggug

SEQ ID NO: 78142 - RNA, 32 nt, Human
cacacacacaacaauuaacagucuucaggcaa

SEQ ID NO: 78143 - RNA, 32 nt, Human
cacacacacaagcacacaugcacagagcuucu

SEQ ID NO: 78144 - RNA, 32 nt, Human
cacacacacagacacacauacacccaugaugu

SEQ ID NO: 78145 - RNA, 32 nt, Human
cacacacacagacucauccacacuucaaauug

SEQ ID NO: 78146 - RNA, 32 nt, Human
cacacacacagagauaugcacacacacggaug

SEQ ID NO: 78147 - RNA, 32 nt, Human
cacacacacagucuaucauacauguacauacu

SEQ ID NO: 78148 - RNA, 32 nt, Human
cacacacacauacacacacauaccauuuaugu

SEQ ID NO: 78149 - RNA, 32 nt, Human
cacacacacauacacacauaugcacaauuugu

SEQ ID NO: 78150 - RNA, 32 nt, Human
cacacacacauacauccugcuuucccucccca

SEQ ID NO: 78151 - RNA, 32 nt, Human
cacacacacaugcacaagucaugugcgaacag

SEQ ID NO: 78152 - RNA, 32 nt, Human
cacacacacaugcacacaaauggacuucucug

SEQ ID NO: 78153 - RNA, 32 nt, Human
cacacacacaugcacacauacacgugcacaca

SEQ ID NO: 78154 - RNA, 32 nt, Human
cacacacacaugcacacauaccgcacuucaua

SEQ ID NO: 78155 - RNA, 32 nt, Human
cacacacacaugcacacauauaugcacaggca

SEQ ID NO: 78156 - RNA, 32 nt, Human
cacacacacaugcaccgcacacauauccaugc

SEQ ID NO: 78157 - RNA, 32 nt, Human
cacacacacaugcagucauacacacucccuga

SEQ ID NO: 78158 - RNA, 32 nt, Human
cacacacacaugcauacacacauacgacacac

SEQ ID NO: 78159 - RNA, 32 nt, Human
cacacacacaugcaugcuacauauguguacgc

SEQ ID NO: 78160 - RNA, 32 nt, Human
cacacacacaugccacacagacacacaugcgc

SEQ ID NO: 78161 - RNA, 32 nt, Human
cacacacacaugcuagcccacugaugcaccca

SEQ ID NO: 78162 - RNA, 23 nt, Human
cacacacacauggcaugcaugua

SEQ ID NO: 78163 - RNA, 32 nt, Human
cacacacacauuaagaugaauguaauuauuau

SEQ ID NO: 78164 - RNA, 32 nt, Human
cacacacacccacaccccugauccuugccaac

SEQ ID NO: 78165 - RNA, 32 nt, Human
cacacacaccccuaccccacacugacugucua

SEQ ID NO: 78166 - RNA, 32 nt, Human
cacacacaccugccuaaagacagggauggcug

SEQ ID NO: 78167 - RNA, 32 nt, Human
cacacacacgcacacacauauguauauacaca

SEQ ID NO: 78168 - RNA, 32 nt, Human
cacacacacgcuuguucacacucagaacccag

SEQ ID NO: 78169 - RNA, 32 nt, Human
cacacacacgugcucacauacauguccgcaua

SEQ ID NO: 78170 - RNA, 25 nt, Human
cacacacacuaccuggaugcaugua

SEQ ID NO: 78171 - RNA, 32 nt, Human
cacacacacucaaacauguacacacacgugcc

SEQ ID NO: 78172 - RNA, 18 nt, Human
cacacacacucacacaga

SEQ ID NO: 78173 - RNA, 32 nt, Human
cacacacacucauccucacacccagcuauacc

SEQ ID NO: 78174 - RNA, 32 nt, Human
cacacacacuggcuccagcuguccucaggguc

SEQ ID NO: 78175 - RNA, 32 nt, Human
cacacacacuugggcccaugcacacacucaca

SEQ ID NO: 78176 - RNA, 32 nt, Human
cacacacacuugugcccaugcacacacucaca

SEQ ID NO: 78177 - RNA, 32 nt, Human
cacacacagaagccucuggggccugagguucu

SEQ ID NO: 78178 - RNA, 32 nt, Human
cacacacagacacacauacacccaugauguga

SEQ ID NO: 78179 - RNA, 32 nt, Human
cacacacagacaugccaguacaugcacacaca

SEQ ID NO: 78180 - RNA, 32 nt, Human
cacacacagagcacugcugcugugcuggggga

SEQ ID NO: 78181 - RNA, 32 nt, Human
cacacacagaugcacacacagauauacacaug

SEQ ID NO: 78182 - RNA, 32 nt, Human
cacacacagaugcacacacagaugcacacaca

SEQ ID NO: 78183 - RNA, 32 nt, Human
cacacacagcacagccaccauccucaacccuc

SEQ ID NO: 78184 - RNA, 32 nt, Human
cacacacagcagcuccaaccuggaggcuggac

SEQ ID NO: 78185 - RNA, 32 nt, Human
cacacacagccauacggucacagagcuuucaa

SEQ ID NO: 78186 - RNA, 32 nt, Human
cacacacagccccuauagcacugagcucacau

SEQ ID NO: 78187 - RNA, 32 nt, Human
cacacacagcuccuuucacuccugccugacug

SEQ ID NO: 78188 - RNA, 32 nt, Human
cacacacaggaagaguguguagaaguggaaau

SEQ ID NO: 78189 - RNA, 32 nt, Human
cacacacaggacccgcauccugggugaugaag

SEQ ID NO: 78190 - RNA, 32 nt, Human
cacacacaggcacagaugcacacacacgcaga

SEQ ID NO: 78191 - RNA, 32 nt, Human
cacacacaggcauccauacaccccagaagacu

SEQ ID NO: 78192 - RNA, 32 nt, Human
cacacacaggugcacacacacgaugccgaaca

SEQ ID NO: 78193 - RNA, 32 nt, Human
cacacacagugaucaccuuaauggagcaaaga

SEQ ID NO: 78194 - RNA, 24 nt, Human
cacacacauacacagaauccucag

SEQ ID NO: 78195 - RNA, 32 nt, Human
cacacacauaugcacacacaugugcaaacaua

SEQ ID NO: 78196 - RNA, 32 nt, Human
cacacacauauguacaugcacauagaugagau

SEQ ID NO: 78197 - RNA, 32 nt, Human
cacacacauauguauaucuauacacacaugug

SEQ ID NO: 78198 - RNA, 24 nt, Human
cacacacauauguguauauaugua

SEQ ID NO: 78199 - RNA, 32 nt, Human
cacacacaucacacccucaaacacccagcuca

SEQ ID NO: 78200 - RNA, 32 nt, Human
cacacacaucacuugcccaucuggcacuaaag

SEQ ID NO: 78201 - RNA, 32 nt, Human
cacacacaucuaagggccaggcugguuccgca

SEQ ID NO: 78202 - RNA, 32 nt, Human
cacacacaucuucccuuccaaagggcuuuuuc

SEQ ID NO: 78203 - RNA, 32 nt, Human
cacacacaugcacacacacauaugcacccaca

SEQ ID NO: 78204 - RNA, 32 nt, Human
cacacacaugcauacacacauacgacacacac

SEQ ID NO: 78205 - RNA, 32 nt, Human
cacacacaugcgcgcacacgugcucccugaag

SEQ ID NO: 78206 - RNA, 32 nt, Human
cacacaccacacacauacacacacgcauuauu

SEQ ID NO: 78207 - RNA, 32 nt, Human
cacacaccaccccugcagcccaagaagagucc

SEQ ID NO: 78208 - RNA, 32 nt, Human
cacacaccaguaaaauguacagugcaugcuuu

SEQ ID NO: 78209 - RNA, 32 nt, Human
cacacacccaagaauaaacuggacaaauggca

SEQ ID NO: 78210 - RNA, 32 nt, Human
cacacacccagcccugcccugggccaaguggc

SEQ ID NO: 78211 - RNA, 32 nt, Human
cacacacccagccugugaaaccuacagcccuc

SEQ ID NO: 78212 - RNA, 32 nt, Human
cacacacccaggcuggagagacacugcgcuca

SEQ ID NO: 78213 - RNA, 32 nt, Human
cacacacccaucugcucacucacccuggcaca

SEQ ID NO: 78214 - RNA, 32 nt, Human
cacacaccccuuccugucauccuuccuggccc

SEQ ID NO: 78215 - RNA, 32 nt, Human
cacacacccguaguuccagcuacuugggaggc

SEQ ID NO: 78216 - RNA, 32 nt, Human
cacacacccugcguuucucccucccaggcuag

SEQ ID NO: 78217 - RNA, 32 nt, Human
cacacaccgccagugucauaccaaagagcuga

SEQ ID NO: 78218 - RNA, 32 nt, Human
cacacaccgcucggugcugaauguuucgagga

SEQ ID NO: 78219 - RNA, 32 nt, Human
cacacaccuauaaucucagcacuuugggaggc

SEQ ID NO: 78220 - RNA, 32 nt, Human
cacacaccuggaacacacagugccccacaccu

SEQ ID NO: 78221 - RNA, 32 nt, Human
cacacaccuguaaucccagcuacucuggaggc

SEQ ID NO: 78222 - RNA, 32 nt, Human
cacacaccuguaaucccagcuauuugggaggc

SEQ ID NO: 78223 - RNA, 32 nt, Human
cacacaccuguaaucccaguuacuugggaggc

SEQ ID NO: 78224 - RNA, 32 nt, Human
cacacaccuuuucucugcugugaauggagauu

SEQ ID NO: 78225 - RNA, 32 nt, Human
cacacacgaauccacagcaauccaucagauau

SEQ ID NO: 78226 - RNA, 32 nt, Human
cacacacgacaaagucacagacauccugcacc

SEQ ID NO: 78227 - RNA, 32 nt, Human
cacacacgcacacacacauaucacaguuuugu

SEQ ID NO: 78228 - RNA, 32 nt, Human
cacacacgcacacacaugcacacacgcacacg

SEQ ID NO: 78229 - RNA, 32 nt, Human
cacacacgcacgugcacacacgcacgcacgcg

SEQ ID NO: 78230 - RNA, 32 nt, Human
cacacacgcacucuccccgcucaggggccugg

SEQ ID NO: 78231 - RNA, 32 nt, Human
cacacacgcaugcacagauaugcuguccggac

SEQ ID NO: 78232 - RNA, 32 nt, Human
cacacacgccgcgaccuacagcucuuucucag

SEQ ID NO: 78233 - RNA, 32 nt, Human
cacacacggaugcacacacagauggucacaca

SEQ ID NO: 78234 - RNA, 21 nt, Human
cacacacgugcccaucugcug

SEQ ID NO: 78235 - RNA, 32 nt, Human
cacacacgugugcacacacaaugcacacaacu

SEQ ID NO: 78236 - RNA, 32 nt, Human
cacacacuacaggggagcaugagggagguugg

SEQ ID NO: 78237 - RNA, 32 nt, Human
cacacacucacacacauccacacacaagcaua

SEQ ID NO: 78238 - RNA, 32 nt, Human
cacacacucacacucacacacacucacacaca

SEQ ID NO: 78239 - RNA, 32 nt, Human
cacacacucauuuugaggaccccagguucaaa

SEQ ID NO: 78240 - RNA, 32 nt, Human
cacacacuccccucagcugcccagccauuccc

SEQ ID NO: 78241 - RNA, 32 nt, Human
cacacacucucacacacauacauguauguuua

SEQ ID NO: 78242 - RNA, 32 nt, Human
cacacacucugccaugcacacaggaggagagc

SEQ ID NO: 78243 - RNA, 32 nt, Human
cacacacugcagccacacucaucagcuguggu

SEQ ID NO: 78244 - RNA, 32 nt, Human
cacacacugccgcuucaaucuccugggcucaa

SEQ ID NO: 78245 - RNA, 32 nt, Human
cacacacuggacugaccugcccugagcgggga

SEQ ID NO: 78246 - RNA, 32 nt, Human
cacacacugucacacucacacacucacauaca

SEQ ID NO: 78247 - RNA, 32 nt, Human
cacacacuguuccagcccaucugucucacccu

SEQ ID NO: 78248 - RNA, 32 nt, Human
cacacacuugaguccccuugggccacaaaggc

SEQ ID NO: 78249 - RNA, 32 nt, Human
cacacacuugggcccaugcacacacucacagg

SEQ ID NO: 78250 - RNA, 32 nt, Human
cacacacuuuguaucaugcaggccacacucag

SEQ ID NO: 78251 - RNA, 32 nt, Human
cacacagaaaacagcagccugcguacuuucaa

SEQ ID NO: 78252 - RNA, 32 nt, Human
cacacagaaagcauacaugcaaaaagaaauga

SEQ ID NO: 78253 - RNA, 32 nt, Human
cacacagaaagccaaagcgaucggugcuccca

SEQ ID NO: 78254 - RNA, 32 nt, Human
cacacagaaagccaggauugaagcggugcuca

SEQ ID NO: 78255 - RNA, 32 nt, Human
cacacagaagagacccugccacaggaggagug

SEQ ID NO: 78256 - RNA, 32 nt, Human
cacacagaagggagaccccgccuagcauagau

SEQ ID NO: 78257 - RNA, 32 nt, Human
cacacagaauacucugccucugcuucauguag

SEQ ID NO: 78258 - RNA, 21 nt, Human
cacacagacaacagcaggcag

SEQ ID NO: 78259 - RNA, 25 nt, Human
cacacagacacacaagcagacacac

SEQ ID NO: 78260 - RNA, 32 nt, Human
cacacagacacacauacacccaugaugugagc

SEQ ID NO: 78261 - RNA, 32 nt, Human
cacacagacagcccgcuuuguucuuucauuuc

SEQ ID NO: 78262 - RNA, 22 nt, Human
cacacagacccacugcagcucu

SEQ ID NO: 78263 - RNA, 23 nt, Human
cacacagaccuggaugccccaga

SEQ ID NO: 78264 - RNA, 32 nt, Human
cacacagacgcagagcaggacucucucugcug

SEQ ID NO: 78265 - RNA, 23 nt, Human
cacacagacucaccaacuuugca

SEQ ID NO: 78266 - RNA, 32 nt, Human
cacacagagaugcacacgugacucauaacaca

SEQ ID NO: 78267 - RNA, 32 nt, Human
cacacagagcccagccguggcaggcucagccg

SEQ ID NO: 78268 - RNA, 32 nt, Human
cacacagagccugagcuccugccuugccagcc

SEQ ID NO: 78269 - RNA, 32 nt, Human
cacacagaggccaggccuuagcgcggcucagc

SEQ ID NO: 78270 - RNA, 18 nt, Human
cacacagaggccugcaug

SEQ ID NO: 78271 - RNA, 32 nt, Human
cacacagauaugcacacacauggaugagcaca

SEQ ID NO: 78272 - RNA, 32 nt, Human
cacacagauucuggggacagagcuguuaccug

SEQ ID NO: 78273 - RNA, 32 nt, Human
cacacagcaaagaugaugaaacuuacaaccac

SEQ ID NO: 78274 - RNA, 32 nt, Human
cacacagcaacucagaugaaacucaaggaaau

SEQ ID NO: 78275 - RNA, 32 nt, Human
cacacagcaagaauccuaagaaacccggggug

SEQ ID NO: 78276 - RNA, 22 nt, Human
cacacagcaagaccccaucucu

SEQ ID NO: 78277 - RNA, 32 nt, Human
cacacagcacacacaagugcacagagcacacu

SEQ ID NO: 78278 - RNA, 32 nt, Human
cacacagcacagccaccauccucaacccucga

SEQ ID NO: 78279 - RNA, 32 nt, Human
cacacagcacucucuaaaucuuccuugugagg

SEQ ID NO: 78280 - RNA, 32 nt, Human
cacacagcaggaggggccugcccaggcccagu

SEQ ID NO: 78281 - RNA, 19 nt, Human
cacacagcagggcugagcu

SEQ ID NO: 78282 - RNA, 32 nt, Human
cacacagcauggcuuccagccugaagugacug

SEQ ID NO: 78283 - RNA, 24 nt, Human
cacacagcccagcaaaagccucuc

SEQ ID NO: 78284 - RNA, 22 nt, Human
cacacagcccagcaaacagcag

SEQ ID NO: 78285 - RNA, 32 nt, Human
cacacagcccccacaucacccaaccaaccagc

SEQ ID NO: 78286 - RNA, 32 nt, Human
cacacagcccccgcaucacccaaccaaccagc

SEQ ID NO: 78287 - RNA, 24 nt, Human
cacacagccccugcugcauucucu

SEQ ID NO: 78288 - RNA, 32 nt, Human
cacacagcccugcuuggccagcacugccugca

SEQ ID NO: 78289 - RNA, 32 nt, Human
cacacagcccugggacacugcccuggcccucc

SEQ ID NO: 78290 - RNA, 21 nt, Human
cacacagccuagcacagcagc

SEQ ID NO: 78291 - RNA, 23 nt, Human
cacacagccucaccuucaccucu

SEQ ID NO: 78292 - RNA, 32 nt, Human
cacacagccucaccuucaccucuuggguauuu

SEQ ID NO: 78293 - RNA, 32 nt, Human
cacacagccuccaauccucauccaccagugcc

SEQ ID NO: 78294 - RNA, 24 nt, Human
cacacagccucucugcccaccucu

SEQ ID NO: 78295 - RNA, 24 nt, Human
cacacagcgagcuuucccucugga

SEQ ID NO: 78296 - RNA, 21 nt, Human
cacacagcgggagaacgcagu

SEQ ID NO: 78297 - RNA, 32 nt, Human
cacacagcgucacucacucccacacacacccc

SEQ ID NO: 78298 - RNA, 32 nt, Human
cacacagcucacucgaccuugggaggccuccc

SEQ ID NO: 78299 - RNA, 32 nt, Human
cacacagcucacucguauguccugcacuggua

SEQ ID NO: 78300 - RNA, 32 nt, Human
cacacagcucacugcagccuugauuucccggg

SEQ ID NO: 78301 - RNA, 32 nt, Human
cacacagcugcuauauagaggaacagaaggug

SEQ ID NO: 78302 - RNA, 31 nt, Human
cacacagcugcucagcaccauuucauucugg

SEQ ID NO: 78303 - RNA, 23 nt, Human
cacacagcuuggaagugauucuu

SEQ ID NO: 78304 - RNA, 32 nt, Human
cacacaggacacaccuccucccucuucuccuc

SEQ ID NO: 78305 - RNA, 21 nt, Human
cacacaggacagcagaagauc

SEQ ID NO: 78306 - RNA, 32 nt, Human
cacacaggaccaggcugcgagaacagcaucau

SEQ ID NO: 78307 - RNA, 32 nt, Human
cacacaggacggcaggggcacugugaggcuuu

SEQ ID NO: 78308 - RNA, 32 nt, Human
cacacaggaggcugccagcagcauuuucccca

SEQ ID NO: 78309 - RNA, 32 nt, Human
cacacaggagugaggccaggggcuaggaguuc

SEQ ID NO: 78310 - RNA, 32 nt, Human
cacacaggagugggugacagaggagacugcag

SEQ ID NO: 78311 - RNA, 32 nt, Human
cacacaggcaaugauuuuaugacaacuugaug

SEQ ID NO: 78312 - RNA, 32 nt, Human
cacacaggcaggcuggagaggaguggcaagaa

SEQ ID NO: 78313 - RNA, 32 nt, Human
cacacaggcccagguguguaggccacagcagc

SEQ ID NO: 78314 - RNA, 32 nt, Human
cacacaggcguuccaccagcaggauguggagc

SEQ ID NO: 78315 - RNA, 32 nt, Human
cacacagggaaacuuagaguucagagaggggg

SEQ ID NO: 78316 - RNA, 32 nt, Human
cacacagggaaaggaagacagucucacagagg

SEQ ID NO: 78317 - RNA, 32 nt, Human
cacacagggaguaaguggcagagccaggaucu

SEQ ID NO: 78318 - RNA, 32 nt, Human
cacacaggguauuccucucccuucucugaugu

SEQ ID NO: 78319 - RNA, 32 nt, Human
cacacagggucugcaaggucuuugguucagcu

SEQ ID NO: 78320 - RNA, 32 nt, Human
cacacaggucaccuagaaauucgugucaccgc

SEQ ID NO: 78321 - RNA, 32 nt, Human
cacacagguuggaaaagaguuuaagaacagaa

SEQ ID NO: 78322 - RNA, 32 nt, Human
cacacaguaggcccgcaauaaaagcaacaccc

SEQ ID NO: 78323 - RNA, 20 nt, Human
cacacaguccaguuugcaug

SEQ ID NO: 78324 - RNA, 32 nt, Human
cacacagugaagggaaaagagucugugaaggu

SEQ ID NO: 78325 - RNA, 32 nt, Human
cacacagugcacguccacagugccauaccacg

SEQ ID NO: 78326 - RNA, 32 nt, Human
cacacagugccuccucugccaguuccuuuauu

SEQ ID NO: 78327 - RNA, 32 nt, Human
cacacagugccuguaaaucucauuuguauuuu

SEQ ID NO: 78328 - RNA, 32 nt, Human
cacacagugcuguacugcacacaccacagaau

SEQ ID NO: 78329 - RNA, 32 nt, Human
cacacagugggauacuaaguguuugcguugca

SEQ ID NO: 78330 - RNA, 32 nt, Human
cacacaguggggaagacacagggcuaagacug

SEQ ID NO: 78331 - RNA, 32 nt, Human
cacacagugggguugagggagcuaggcuguuu

SEQ ID NO: 78332 - RNA, 16 nt, Human
cacacaguggugggga

SEQ ID NO: 78333 - RNA, 32 nt, Human
cacacaguuaccugguucacagauagcugcuu

SEQ ID NO: 78334 - RNA, 32 nt, Human
cacacaguuguucaccaacagaccagaccucc

SEQ ID NO: 78335 - RNA, 32 nt, Human
cacacaguuuuguuuaugcauuuccuuaaaau

SEQ ID NO: 78336 - RNA, 24 nt, Human
cacacaguuuuuuguuuuguuuuu

SEQ ID NO: 78337 - RNA, 32 nt, Human
cacacauaaaaauugauuuaaguggaucauag

SEQ ID NO: 78338 - RNA, 32 nt, Human
cacacauaauagacacaucccuaacggcgugu

SEQ ID NO: 78339 - RNA, 32 nt, Human
cacacauaauuuaaagagagaaggcucuugau

SEQ ID NO: 78340 - RNA, 32 nt, Human
cacacauacaaaaccuuuaaauuuugggaucu

SEQ ID NO: 78341 - RNA, 18 nt, Human
cacacauacacacacaga

SEQ ID NO: 78342 - RNA, 19 nt, Human
cacacauacacacgucugu

SEQ ID NO: 78343 - RNA, 32 nt, Human
cacacauacacacugucaugcacucaacuaua

SEQ ID NO: 78344 - RNA, 32 nt, Human
cacacauacacucacacauacacaacccggca

SEQ ID NO: 78345 - RNA, 32 nt, Human
cacacauacaugcccacacauagugacaugcu

SEQ ID NO: 78346 - RNA, 18 nt, Human
cacacauacaugugcaca

SEQ ID NO: 78347 - RNA, 32 nt, Human
cacacauacccuacccucaccugaugauaauu

SEQ ID NO: 78348 - RNA, 32 nt, Human
cacacauaccuguaaucccagcuacuuuggug

SEQ ID NO: 78349 - RNA, 20 nt, Human
cacacauagaacacuugcug

SEQ ID NO: 78350 - RNA, 32 nt, Human
cacacauagguaaacuguuacaaauccagaau

SEQ ID NO: 78351 - RNA, 32 nt, Human
cacacauauaaacaucacacacacagacagac

SEQ ID NO: 78352 - RNA, 18 nt, Human
cacacauauacacacaga

SEQ ID NO: 78353 - RNA, 32 nt, Human
cacacauauauguacagacauguacucucaca

SEQ ID NO: 78354 - RNA, 32 nt, Human
cacacauauguauauacacauaucauuuuaag

SEQ ID NO: 78355 - RNA, 22 nt, Human
cacacauauugauggagucugc

SEQ ID NO: 78356 - RNA, 22 nt, Human
cacacauauuugcaguuuacug

SEQ ID NO: 78357 - RNA, 32 nt, Human
cacacaucacacucuggggacucaggaaccau

SEQ ID NO: 78358 - RNA, 32 nt, Human
cacacaucauucuggcuggagagugcaaugug

SEQ ID NO: 78359 - RNA, 32 nt, Human
cacacauccaucucaagaggaacauuuauacc

SEQ ID NO: 78360 - RNA, 32 nt, Human
cacacaucccucaucaaugguugacugcaaag

SEQ ID NO: 78361 - RNA, 19 nt, Human
cacacaucccuugauuccu

SEQ ID NO: 78362 - RNA, 32 nt, Human
cacacaucgucagcauaaggcaucuaaagauu

SEQ ID NO: 78363 - RNA, 32 nt, Human
cacacaucucccacccaccugagcgccaugug

SEQ ID NO: 78364 - RNA, 32 nt, Human
cacacaucuggccccaccugcucaguacuacu

SEQ ID NO: 78365 - RNA, 32 nt, Human
cacacaucuguaauccuagcuacuuggcaggc

SEQ ID NO: 78366 - RNA, 32 nt, Human
cacacaucuguauuccagccugggcaauagag

SEQ ID NO: 78367 - RNA, 21 nt, Human
cacacaucuucccaguucuca

SEQ ID NO: 78368 - RNA, 32 nt, Human
cacacaugcacacacacauaugcacccacaca

SEQ ID NO: 78369 - RNA, 32 nt, Human
cacacaugcacacccucucacguccuccagag

SEQ ID NO: 78370 - RNA, 32 nt, Human
cacacaugcacgcacacacacauauggggacc

SEQ ID NO: 78371 - RNA, 32 nt, Human
cacacaugcacgcacgcacacgcacacccagu

SEQ ID NO: 78372 - RNA, 32 nt, Human
cacacaugcacgcauaugucuucaagaugacc

SEQ ID NO: 78373 - RNA, 32 nt, Human
cacacaugcaggcacacacagccugugcacac

SEQ ID NO: 78374 - RNA, 32 nt, Human
cacacaugcauacacacauacgacacacaccu

SEQ ID NO: 78375 - RNA, 32 nt, Human
cacacaugcaugcacacaaacaucacugcagc

SEQ ID NO: 78376 - RNA, 32 nt, Human
cacacaugcaugcacacaaacguguacacaag

SEQ ID NO: 78377 - RNA, 32 nt, Human
cacacaugcaugcacacacaugcacacauaca

SEQ ID NO: 78378 - RNA, 32 nt, Human
cacacaugcaugcacacauacacaugcacaca

SEQ ID NO: 78379 - RNA, 32 nt, Human
cacacaugccauuccaugaagacagaggauca

SEQ ID NO: 78380 - RNA, 32 nt, Human
cacacaugcguauagacauacauacauguaca

SEQ ID NO: 78381 - RNA, 32 nt, Human
cacacaugcgugcacacauagacgcaugcacu

SEQ ID NO: 78382 - RNA, 32 nt, Human
cacacaugcucugggccgugcgaggcucagcu

SEQ ID NO: 78383 - RNA, 32 nt, Human
cacacaugcuguggagauugcagugugucuga

SEQ ID NO: 78384 - RNA, 32 nt, Human
cacacaugcuguggagcacacaugcuguggag

SEQ ID NO: 78385 - RNA, 32 nt, Human
cacacauggaaggugaugggggcaugggugga

SEQ ID NO: 78386 - RNA, 32 nt, Human
cacacauggccucauuggcucucagucccgag

SEQ ID NO: 78387 - RNA, 32 nt, Human
cacacauggcugaugucacauugaaaauguga

SEQ ID NO: 78388 - RNA, 32 nt, Human
cacacauggcuguucuggagagggccucugag

SEQ ID NO: 78389 - RNA, 32 nt, Human
cacacaugggaagagaagguacagaggcaagg

SEQ ID NO: 78390 - RNA, 32 nt, Human
cacacauggggugccuaccacagaccacccuu

SEQ ID NO: 78391 - RNA, 32 nt, Human
cacacaugguauccuucuuggccaacagaugg

SEQ ID NO: 78392 - RNA, 32 nt, Human
cacacauguaugcacacacacaugcaccgcac

SEQ ID NO: 78393 - RNA, 32 nt, Human
cacacauuagccucgcugcggcgcccagacuc

SEQ ID NO: 78394 - RNA, 32 nt, Human
cacacauuccccagccucucugcccaguaugc

SEQ ID NO: 78395 - RNA, 32 nt, Human
cacacauuccucacguagcuucugcucccagg

SEQ ID NO: 78396 - RNA, 32 nt, Human
cacacauuguuuccaggaccuccugagaagcc

SEQ ID NO: 78397 - RNA, 32 nt, Human
cacacauuuacacgguaacagcucuuauuaag

SEQ ID NO: 78398 - RNA, 32 nt, Human
cacacauuucuagaucuugcacugucgaaaag

SEQ ID NO: 78399 - RNA, 32 nt, Human
cacaccaaccaguguaggagaccucauggcuc

SEQ ID NO: 78400 - RNA, 32 nt, Human
cacaccaaccugggugacagagcaagauugca

SEQ ID NO: 78401 - RNA, 32 nt, Human
cacaccaacuccaggaaacucauucugggcca

SEQ ID NO: 78402 - RNA, 32 nt, Human
cacaccaagaacagcuuuugagucguauccuc

SEQ ID NO: 78403 - RNA, 32 nt, Human
cacaccaagccccuagcuggggcacagccugg

SEQ ID NO: 78404 - RNA, 32 nt, Human
cacaccaaucuugagguguugugccauucucu

SEQ ID NO: 78405 - RNA, 32 nt, Human
cacaccacagccgcugaaugaggcuuccaggc

SEQ ID NO: 78406 - RNA, 32 nt, Human
cacaccacagcugcgcacacagcugcuugcuc

SEQ ID NO: 78407 - RNA, 19 nt, Human
cacaccacaggccucgaag

SEQ ID NO: 78408 - RNA, 32 nt, Human
cacaccacaguacuccagccuaggugacagag

SEQ ID NO: 78409 - RNA, 32 nt, Human
cacaccaccacacuccagccugagcagcagag

SEQ ID NO: 78410 - RNA, 32 nt, Human
cacaccaccacuccagccugggcgagagcgag

SEQ ID NO: 78411 - RNA, 32 nt, Human
cacaccaccauccuguuugcagccgaaguguu

SEQ ID NO: 78412 - RNA, 32 nt, Human
cacaccacccaggccuccaccuccccagggag

SEQ ID NO: 78413 - RNA, 32 nt, Human
cacaccacccuccugccaaccccacaccccuc

SEQ ID NO: 78414 - RNA, 32 nt, Human
cacaccaccucacuccagccugggcaacauag

SEQ ID NO: 78415 - RNA, 32 nt, Human
cacaccacgguccugcugaccugcacugucca

SEQ ID NO: 78416 - RNA, 32 nt, Human
cacaccacuacacuccagccaaagcaacaaga

SEQ ID NO: 78417 - RNA, 32 nt, Human
cacaccacuacacuccagccuaggcaacagag

SEQ ID NO: 78418 - RNA, 32 nt, Human
cacaccacuacacuccagccuggacaacagaa

SEQ ID NO: 78419 - RNA, 32 nt, Human
cacaccacuacacuccagccugggcgacagag

SEQ ID NO: 78420 - RNA, 32 nt, Human
cacaccacuacacuccagccugggcgagacgg

SEQ ID NO: 78421 - RNA, 32 nt, Human
cacaccacuacucuccaaccugggugacagac

SEQ ID NO: 78422 - RNA, 32 nt, Human
cacaccacucaccacacauacauacacaugca

SEQ ID NO: 78423 - RNA, 32 nt, Human
cacaccacuccacuccagucuggacaacagag

SEQ ID NO: 78424 - RNA, 32 nt, Human
cacaccacugaccucuagccugguggcagagu

SEQ ID NO: 78425 - RNA, 32 nt, Human
cacaccacugauuggccuuuucuuucacguga

SEQ ID NO: 78426 - RNA, 32 nt, Human
cacaccacugcaauccagccucgguaacacag

SEQ ID NO: 78427 - RNA, 32 nt, Human
cacaccacugcaauccagccugggcgacaaag

SEQ ID NO: 78428 - RNA, 32 nt, Human
cacaccacugcaccccagccugggugacagcg

SEQ ID NO: 78429 - RNA, 32 nt, Human
cacaccacugcacuacagccucggcaauagag

SEQ ID NO: 78430 - RNA, 32 nt, Human
cacaccacugcacucagccugggugacagagc

SEQ ID NO: 78431 - RNA, 32 nt, Human
cacaccacugcacuccaaccuggacaacagag

SEQ ID NO: 78432 - RNA, 32 nt, Human
cacaccacugcacuccaaccugggaaacgcag

SEQ ID NO: 78433 - RNA, 20 nt, Human
cacaccacugcacuccagcc

SEQ ID NO: 78434 - RNA, 32 nt, Human
cacaccacugcacuccagccagggcaacagug

SEQ ID NO: 78435 - RNA, 32 nt, Human
cacaccacugcacuccagcccaggugacagag

SEQ ID NO: 78436 - RNA, 32 nt, Human
cacaccacugcacuccagccuaggcaacagag

SEQ ID NO: 78437 - RNA, 32 nt, Human
cacaccacugcacuccagccuggacaacagag

SEQ ID NO: 78438 - RNA, 32 nt, Human
cacaccacugcacuccagccuggacgacagag

SEQ ID NO: 78439 - RNA, 32 nt, Human
cacaccacugcacuccagccuggcaacagagc

SEQ ID NO: 78440 - RNA, 32 nt, Human
cacaccacugcacuccagccuggcgacagaga

SEQ ID NO: 78441 - RNA, 32 nt, Human
cacaccacugcacuccagccugggagagagag

SEQ ID NO: 78442 - RNA, 32 nt, Human
cacaccacugcacuccagccugggcaacaaag

SEQ ID NO: 78443 - RNA, 32 nt, Human
cacaccacugcacuccagccugggcaacaaga

SEQ ID NO: 78444 - RNA, 32 nt, Human
cacaccacugcacuccagccugggcaacagaa

SEQ ID NO: 78445 - RNA, 32 nt, Human
cacaccacugcacuccagccugggcaacagag

SEQ ID NO: 78446 - RNA, 32 nt, Human
cacaccacugcacuccagccugggcaacugag

SEQ ID NO: 78447 - RNA, 32 nt, Human
cacaccacugcacuccagccugggcaauagag

SEQ ID NO: 78448 - RNA, 32 nt, Human
cacaccacugcacuccagccugggcgacagaa

SEQ ID NO: 78449 - RNA, 32 nt, Human
cacaccacugcacuccagccugggcgacagag

SEQ ID NO: 78450 - RNA, 32 nt, Human
cacaccacugcacuccagccugggcgacagug

SEQ ID NO: 78451 - RNA, 32 nt, Human
cacaccacugcacuccagccugggcggcagag

SEQ ID NO: 78452 - RNA, 32 nt, Human
cacaccacugcacuccagccugggcuacagag

SEQ ID NO: 78453 - RNA, 32 nt, Human
cacaccacugcacuccagccugggggacagag

SEQ ID NO: 78454 - RNA, 32 nt, Human
cacaccacugcacuccagccuggggugauaga

SEQ ID NO: 78455 - RNA, 32 nt, Human
cacaccacugcacuccagccugggugacagag

SEQ ID NO: 78456 - RNA, 32 nt, Human
cacaccacugcacuccagccugggugacagau

SEQ ID NO: 78457 - RNA, 32 nt, Human
cacaccacugcacuccagccugggugacagca

SEQ ID NO: 78458 - RNA, 32 nt, Human
cacaccacugcacuccagccugggugauagag

SEQ ID NO: 78459 - RNA, 32 nt, Human
cacaccacugcacuccagccuggguggcagag

SEQ ID NO: 78460 - RNA, 32 nt, Human
cacaccacugcacuccagccugggugucagag

SEQ ID NO: 78461 - RNA, 32 nt, Human
cacaccacugcacuccagccuggucaacagag

SEQ ID NO: 78462 - RNA, 32 nt, Human
cacaccacugcacuccagccuggugacagagc

SEQ ID NO: 78463 - RNA, 32 nt, Human
cacaccacugcacuccagccugugcgacagag

SEQ ID NO: 78464 - RNA, 32 nt, Human
cacaccacugcacuccagccuuggcgacaaac

SEQ ID NO: 78465 - RNA, 32 nt, Human
cacaccacugcacuccagccuuggcgacagag

SEQ ID NO: 78466 - RNA, 32 nt, Human
cacaccacugcacuccagccuuggugacagag

SEQ ID NO: 78467 - RNA, 32 nt, Human
cacaccacugcacuccagcuugggggauagag

SEQ ID NO: 78468 - RNA, 32 nt, Human
cacaccacugcacuccagucugggcaacagug

SEQ ID NO: 78469 - RNA, 32 nt, Human
cacaccacugcacuccagucugggcaccagag

SEQ ID NO: 78470 - RNA, 32 nt, Human
cacaccacugcacuccagugugagcaacagaa

SEQ ID NO: 78471 - RNA, 32 nt, Human
cacaccacugcacuccauccagccugggugac

SEQ ID NO: 78472 - RNA, 32 nt, Human
cacaccacugcacuccauccugggcaacagag

SEQ ID NO: 78473 - RNA, 32 nt, Human
cacaccacugcacuccggccugggcgacagag

SEQ ID NO: 78474 - RNA, 32 nt, Human
cacaccacugcacuccugccugggcaauagag

SEQ ID NO: 78475 - RNA, 32 nt, Human
cacaccacugcacucuagccugggcaacagag

SEQ ID NO: 78476 - RNA, 32 nt, Human
cacaccacugcacucuagccugggugacagag

SEQ ID NO: 78477 - RNA, 32 nt, Human
cacaccacugcacucuggccugcaugcacucu

SEQ ID NO: 78478 - RNA, 32 nt, Human
cacaccacugcacuucagccuggaugacagag

SEQ ID NO: 78479 - RNA, 32 nt, Human
cacaccacugcacuucagccugggcaacagag

SEQ ID NO: 78480 - RNA, 32 nt, Human
cacaccacugcacuucauccuaggcaacagag

SEQ ID NO: 78481 - RNA, 32 nt, Human
cacaccacugcauuccagccugggcacuagag

SEQ ID NO: 78482 - RNA, 32 nt, Human
cacaccacugcauuccagccugggugacagag

SEQ ID NO: 78483 - RNA, 32 nt, Human
cacaccacugcauucccgccugggcagcagag

SEQ ID NO: 78484 - RNA, 32 nt, Human
cacaccacugcauucuggccugggugacagag

SEQ ID NO: 78485 - RNA, 32 nt, Human
cacaccacugccauuuccuccugggcaacaga

SEQ ID NO: 78486 - RNA, 32 nt, Human
cacaccacugcgcucuagccuggacaacaaga

SEQ ID NO: 78487 - RNA, 32 nt, Human
cacaccacugcgcucuagccugggcaacaaga

SEQ ID NO: 78488 - RNA, 32 nt, Human
cacaccacuggcacuccagccugggcaacaga

SEQ ID NO: 78489 - RNA, 32 nt, Human
cacaccacuguacuccagcccggcacuccagc

SEQ ID NO: 78490 - RNA, 32 nt, Human
cacaccacuguacuccagccugagugacaaag

SEQ ID NO: 78491 - RNA, 32 nt, Human
cacaccacuguacuccagccuggaugacagag

SEQ ID NO: 78492 - RNA, 32 nt, Human
cacaccacuguacuccagccugggcaacagag

SEQ ID NO: 78493 - RNA, 32 nt, Human
cacaccacuguacuccagccugggugacaaag

SEQ ID NO: 78494 - RNA, 32 nt, Human
cacaccacuguacuccagccuggugacagagc

SEQ ID NO: 78495 - RNA, 32 nt, Human
cacaccacuguauuccagccugggugacagag

SEQ ID NO: 78496 - RNA, 32 nt, Human
cacaccacuguauuccagccugggugacugag

SEQ ID NO: 78497 - RNA, 32 nt, Human
cacaccacugugcucuagccuggacaacaaga

SEQ ID NO: 78498 - RNA, 32 nt, Human
cacaccacugugcucuagccugggugacaaag

SEQ ID NO: 78499 - RNA, 32 nt, Human
cacaccacuugugagcugacccccaggaacag

SEQ ID NO: 78500 - RNA, 32 nt, Human
cacaccagaaauggacauuuucauaugcaaug

SEQ ID NO: 78501 - RNA, 32 nt, Human
cacaccagaagcacgaggcccuugagaacugu

SEQ ID NO: 78502 - RNA, 32 nt, Human
cacaccagagcgugggagacggugggccuugu

SEQ ID NO: 78503 - RNA, 32 nt, Human
cacaccagcaggucgccuccagccugaccagc

SEQ ID NO: 78504 - RNA, 27 nt, Human
cacaccagccaugcagccagcaggucc

SEQ ID NO: 78505 - RNA, 32 nt, Human
cacaccagcccagcccagcccagcucucgaua

SEQ ID NO: 78506 - RNA, 21 nt, Human
cacaccagccgcugcaggucc

SEQ ID NO: 78507 - RNA, 32 nt, Human
cacaccagccuccugggggauacgguggagaa

SEQ ID NO: 78508 - RNA, 32 nt, Human
cacaccagccuggacaacagagcgagacucug

SEQ ID NO: 78509 - RNA, 32 nt, Human
cacaccagccugggcaacacagcaagacaccg

SEQ ID NO: 78510 - RNA, 32 nt, Human
cacaccagccugggcaacacagcaagacucug

SEQ ID NO: 78511 - RNA, 31 nt, Human
cacaccagccugggugacagagcgagacucc

SEQ ID NO: 78512 - RNA, 32 nt, Human
cacaccagccugggugacagugugagacccag

SEQ ID NO: 78513 - RNA, 32 nt, Human
cacaccagcgaccaggccuggagcucacacuu

SEQ ID NO: 78514 - RNA, 32 nt, Human
cacaccagcucagccacagcagagccaaucac

SEQ ID NO: 78515 - RNA, 32 nt, Human
cacaccagggcuugcauagaaaagcuucgguu

SEQ ID NO: 78516 - RNA, 32 nt, Human
cacaccagucugggugacagagaaagacccug

SEQ ID NO: 78517 - RNA, 32 nt, Human
cacaccagugcacuccagccugggcgacagag

SEQ ID NO: 78518 - RNA, 32 nt, Human
cacaccaguguucaucagucuguccucugcac

SEQ ID NO: 78519 - RNA, 32 nt, Human
cacaccaguucugcagcagucgcuauuagaug

SEQ ID NO: 78520 - RNA, 32 nt, Human
cacaccauaaggagauuucuguuuuucuuuuu

SEQ ID NO: 78521 - RNA, 32 nt, Human
cacaccauaucaggugcugaagauucacgggu

SEQ ID NO: 78522 - RNA, 32 nt, Human
cacaccauccaccuggccgccuccauggaccc

SEQ ID NO: 78523 - RNA, 32 nt, Human
cacaccauccuggaugacagagcaagacucca

SEQ ID NO: 78524 - RNA, 32 nt, Human
cacaccaucgcacuccagccuaggcaacaaga

SEQ ID NO: 78525 - RNA, 32 nt, Human
cacaccaugccuggcccuuagaagugcucaau

SEQ ID NO: 78526 - RNA, 32 nt, Human
cacaccauggaauacuaugcagccauaaaaag

SEQ ID NO: 78527 - RNA, 32 nt, Human
cacaccauggaggcccaaagccccagaucaug

SEQ ID NO: 78528 - RNA, 32 nt, Human
cacaccauucccaggcugcagaugcagaaacu

SEQ ID NO: 78529 - RNA, 32 nt, Human
cacaccauugcacuccaaccugggcaacaaga

SEQ ID NO: 78530 - RNA, 32 nt, Human
cacaccauugcacuccaaccugggcgacaggg

SEQ ID NO: 78531 - RNA, 32 nt, Human
cacaccauugcacuccagccuaggcaacaaga

SEQ ID NO: 78532 - RNA, 32 nt, Human
cacaccauugcacuccagccuaggcaugguga

SEQ ID NO: 78533 - RNA, 32 nt, Human
cacaccauugcacuccagccugagcaacagag

SEQ ID NO: 78534 - RNA, 32 nt, Human
cacaccauugcacuccagccugggaaacaaga

SEQ ID NO: 78535 - RNA, 32 nt, Human
cacaccauugcacuccagccugggcaaaaaga

SEQ ID NO: 78536 - RNA, 32 nt, Human
cacaccauugcacuccagccugggcaacaaga

SEQ ID NO: 78537 - RNA, 32 nt, Human
cacaccauugcacuccagccugggcaacagag

SEQ ID NO: 78538 - RNA, 32 nt, Human
cacaccauugcacuccagccugggcgacaaga

SEQ ID NO: 78539 - RNA, 32 nt, Human
cacaccauugcacuccagccugggcgacagag

SEQ ID NO: 78540 - RNA, 32 nt, Human
cacaccauugcacuccagccugggcgacaggg

SEQ ID NO: 78541 - RNA, 32 nt, Human
cacaccauugcacuccagcuugggcaacaaua

SEQ ID NO: 78542 - RNA, 32 nt, Human
cacaccauugcacucuugucugggugacagag

SEQ ID NO: 78543 - RNA, 32 nt, Human
cacaccauugcacugcagccugggugaagaaa

SEQ ID NO: 78544 - RNA, 32 nt, Human
cacaccauugcacuucagccugggcgacacag

SEQ ID NO: 78545 - RNA, 32 nt, Human
cacaccauugcauuccaaccuggggaacagag

SEQ ID NO: 78546 - RNA, 32 nt, Human
cacaccauugcccuccagccugggugacagag

SEQ ID NO: 78547 - RNA, 32 nt, Human
cacaccauugcgcuucagccugggcaacaaga

SEQ ID NO: 78548 - RNA, 32 nt, Human
cacaccauugcuguccagccugggugacagag

SEQ ID NO: 78549 - RNA, 21 nt, Human
cacaccauuucuucccugcuc

SEQ ID NO: 78550 - RNA, 32 nt, Human
cacacccaacuugguuuugcuacauaauuauc

SEQ ID NO: 78551 - RNA, 32 nt, Human
cacacccaaggcugcuuuccagaaagcccgug

SEQ ID NO: 78552 - RNA, 32 nt, Human
cacacccaauccagcgcgguucuaccccacga

SEQ ID NO: 78553 - RNA, 19 nt, Human
cacacccacccacacacca

SEQ ID NO: 78554 - RNA, 22 nt, Human
cacacccacccagagcacgcca

SEQ ID NO: 78555 - RNA, 32 nt, Human
cacacccacccuccuggcucuuccuguuuuua

SEQ ID NO: 78556 - RNA, 32 nt, Human
cacacccaccgcaaccucauccccucagcacu

SEQ ID NO: 78557 - RNA, 32 nt, Human
cacacccacuggcuucuaagcccucuuuccag

SEQ ID NO: 78558 - RNA, 32 nt, Human
cacacccagaacugaggcuuggauaucuucuu

SEQ ID NO: 78559 - RNA, 32 nt, Human
cacacccagaagacgucaggugacuucagucc

SEQ ID NO: 78560 - RNA, 32 nt, Human
cacacccagaagucuuuggacccauuugguuu

SEQ ID NO: 78561 - RNA, 32 nt, Human
cacacccagcacggaggugugcagcccccgcu

SEQ ID NO: 78562 - RNA, 32 nt, Human
cacacccagcacuuugggaggccgaggcaggc

SEQ ID NO: 78563 - RNA, 32 nt, Human
cacacccagccaauuagggcugucuuacaaaa

SEQ ID NO: 78564 - RNA, 32 nt, Human
cacacccagccugcugcuucugacccugcaug

SEQ ID NO: 78565 - RNA, 32 nt, Human
cacacccagccuggaacccuagccagcucagc

SEQ ID NO: 78566 - RNA, 32 nt, Human
cacacccagccugucuugcucauucaugcagc

SEQ ID NO: 78567 - RNA, 32 nt, Human
cacaccccaagaaaacuacuguucaaauuuuu

SEQ ID NO: 78568 - RNA, 19 nt, Human
cacaccccacacaaccuca

SEQ ID NO: 78569 - RNA, 32 nt, Human
cacaccccacuccugcuaucaguuucuuauaa

SEQ ID NO: 78570 - RNA, 25 nt, Human
cacaccccagacacgggugggcaca

SEQ ID NO: 78571 - RNA, 32 nt, Human
cacaccccagaggcgaacuguggugaguguaa

SEQ ID NO: 78572 - RNA, 32 nt, Human
cacaccccagcaccuggcacuuaccacacucu

SEQ ID NO: 78573 - RNA, 32 nt, Human
cacaccccaggaaauguugaugacuaggaaag

SEQ ID NO: 78574 - RNA, 26 nt, Human
cacaccccagggugacagccugggag

SEQ ID NO: 78575 - RNA, 32 nt, Human
cacaccccauccagcucccagcaucuucaucu

SEQ ID NO: 78576 - RNA, 32 nt, Human
cacaccccauuuccuccucuuucccucucccc

SEQ ID NO: 78577 - RNA, 32 nt, Human
cacacccccacacccauugcagcuguggcgcc

SEQ ID NO: 78578 - RNA, 19 nt, Human
cacacccccacccagcccc

SEQ ID NO: 78579 - RNA, 21 nt, Human
cacacccccaggaugucagug

SEQ ID NO: 78580 - RNA, 20 nt, Human
cacaccccccgcccacccca

SEQ ID NO: 78581 - RNA, 22 nt, Human
cacacccccugccccaucccau

SEQ ID NO: 78582 - RNA, 32 nt, Human
cacacccccugccuuaucucugccugcacgcc

SEQ ID NO: 78583 - RNA, 32 nt, Human
cacacccccuuucagagggccacuggguuagg

SEQ ID NO: 78584 - RNA, 32 nt, Human
cacaccccgaaaaagacuaccugggaggugga

SEQ ID NO: 78585 - RNA, 22 nt, Human
cacaccccgagggccugaggag

SEQ ID NO: 78586 - RNA, 32 nt, Human
cacaccccgccuggccaagaugacugcuucag

SEQ ID NO: 78587 - RNA, 17 nt, Human
cacaccccgcgcgcuca

SEQ ID NO: 78588 - RNA, 20 nt, Human
cacaccccuccaaagcccca

SEQ ID NO: 78589 - RNA, 32 nt, Human
cacaccccuccccagucuucuucaagaccugg

SEQ ID NO: 78590 - RNA, 22 nt, Human
cacaccccuccccugccauccc

SEQ ID NO: 78591 - RNA, 32 nt, Human
cacaccccuccccugccaucccuccccggacu

SEQ ID NO: 78592 - RNA, 21 nt, Human
cacaccccuccccuucuccca

SEQ ID NO: 78593 - RNA, 20 nt, Human
cacaccccuccuccagacca

SEQ ID NO: 78594 - RNA, 21 nt, Human
cacaccccuccugcucccccc

SEQ ID NO: 78595 - RNA, 32 nt, Human
cacaccccuccuugcuggaaugugucuggccc

SEQ ID NO: 78596 - RNA, 32 nt, Human
cacaccccugcacuccagccugggugacagcu

SEQ ID NO: 78597 - RNA, 32 nt, Human
cacaccccugcagagccccagcugguucuuag

SEQ ID NO: 78598 - RNA, 22 nt, Human
cacaccccugcccccaccccau

SEQ ID NO: 78599 - RNA, 32 nt, Human
cacaccccugcucuuccuccugacccugcugc

SEQ ID NO: 78600 - RNA, 32 nt, Human
cacaccccuucccuuuccuguccuguccuuuc

SEQ ID NO: 78601 - RNA, 32 nt, Human
cacaccccuugaccacacagcauccacucucc

SEQ ID NO: 78602 - RNA, 19 nt, Human
cacacccgcaccgccccga

SEQ ID NO: 78603 - RNA, 32 nt, Human
cacacccggacuccgccgacuaggcaaccucc

SEQ ID NO: 78604 - RNA, 32 nt, Human
cacacccggcagacuucaagagucucagacug

SEQ ID NO: 78605 - RNA, 32 nt, Human
cacacccggcucccccugcuucucagccccgg

SEQ ID NO: 78606 - RNA, 24 nt, Human
cacacccuagauccagccucagga

SEQ ID NO: 78607 - RNA, 32 nt, Human
cacacccuagcuuccguguuccuugccuugug

SEQ ID NO: 78608 - RNA, 22 nt, Human
cacacccuauauagacacuucc

SEQ ID NO: 78609 - RNA, 32 nt, Human
cacacccucauuugacagggggagaaacagaa

SEQ ID NO: 78610 - RNA, 32 nt, Human
cacacccuccacacaccagccucugcaaccag

SEQ ID NO: 78611 - RNA, 32 nt, Human
cacacccuccacucaccucuagcucccuuucg

SEQ ID NO: 78612 - RNA, 20 nt, Human
cacacccugaauugaguggu

SEQ ID NO: 78613 - RNA, 32 nt, Human
cacacccugagucagacgccacaugccaacaa

SEQ ID NO: 78614 - RNA, 32 nt, Human
cacacccugccugccaucacccuugccccugc

SEQ ID NO: 78615 - RNA, 32 nt, Human
cacacccugccugcucaguccugggguccgag

SEQ ID NO: 78616 - RNA, 20 nt, Human
cacacccuggacaccugcac

SEQ ID NO: 78617 - RNA, 19 nt, Human
cacacccugggccuggccc

SEQ ID NO: 78618 - RNA, 32 nt, Human
cacacccugggugacaggccccugggaggccu

SEQ ID NO: 78619 - RNA, 32 nt, Human
cacacccuguaaucccagcacuuugggaggcu

SEQ ID NO: 78620 - RNA, 32 nt, Human
cacacccugucuagcugagguucauggaagag

SEQ ID NO: 78621 - RNA, 32 nt, Human
cacacccuuagaaggauggcucugguggccgg

SEQ ID NO: 78622 - RNA, 32 nt, Human
cacacccuuaucugcccaucugugcuacugua

SEQ ID NO: 78623 - RNA, 32 nt, Human
cacacccuucacccucuguguccugguccuuc

SEQ ID NO: 78624 - RNA, 32 nt, Human
cacacccuucacugcugggcuucuagggcauu

SEQ ID NO: 78625 - RNA, 32 nt, Human
cacacccuucaggcugcacccgggcaggccuc

SEQ ID NO: 78626 - RNA, 22 nt, Human
cacacccuucccaauugccaca

SEQ ID NO: 78627 - RNA, 32 nt, Human
cacacccuuccuccuuccccugcccacagagg

SEQ ID NO: 78628 - RNA, 32 nt, Human
cacaccgacaccaacaugaacggacagcucaa

SEQ ID NO: 78629 - RNA, 32 nt, Human
cacaccgaguagggcuauguagagaggaguca

SEQ ID NO: 78630 - RNA, 32 nt, Human
cacaccgauguacacacacagaugcacacaca

SEQ ID NO: 78631 - RNA, 32 nt, Human
cacaccgcugcacucaagccugggugacagug

SEQ ID NO: 78632 - RNA, 32 nt, Human
cacaccgcugcacucaagcuugggugacagag

SEQ ID NO: 78633 - RNA, 32 nt, Human
cacaccgcugcacuccagccugggcaacaaga

SEQ ID NO: 78634 - RNA, 32 nt, Human
cacaccggcccaggugccggagaugaaugagc

SEQ ID NO: 78635 - RNA, 32 nt, Human
cacaccggccccggcccccaggaagggagcac

SEQ ID NO: 78636 - RNA, 32 nt, Human
cacaccggccugggugacagcaugagaaccug

SEQ ID NO: 78637 - RNA, 32 nt, Human
cacaccguugcccaggcuggagggcagugacg

SEQ ID NO: 78638 - RNA, 32 nt, Human
cacaccuaaagucccagcuacuugggagguug

SEQ ID NO: 78639 - RNA, 32 nt, Human
cacaccuacacacccucugcauggcccugccu

SEQ ID NO: 78640 - RNA, 32 nt, Human
cacaccuacacucccgcguccaccucucccuc

SEQ ID NO: 78641 - RNA, 22 nt, Human
cacaccuacaguuccagcacuu

SEQ ID NO: 78642 - RNA, 21 nt, Human
cacaccuacauggaaauugaa

SEQ ID NO: 78643 - RNA, 32 nt, Human
cacaccuaccauuccuccucuccugaucccca

SEQ ID NO: 78644 - RNA, 32 nt, Human
cacaccuaccccuaccguccagccuggccucu

SEQ ID NO: 78645 - RNA, 32 nt, Human
cacaccuagauguguguuacuucaauuaaaau

SEQ ID NO: 78646 - RNA, 32 nt, Human
cacaccuauaaccccagcuaugcaagacaccg

SEQ ID NO: 78647 - RNA, 23 nt, Human
cacaccuauaaucucagcacuuu

SEQ ID NO: 78648 - RNA, 32 nt, Human
cacaccuauagucccagcauuuugggaaacca

SEQ ID NO: 78649 - RNA, 32 nt, Human
cacaccuauagucccagcuacuugggaggcug

SEQ ID NO: 78650 - RNA, 32 nt, Human
cacaccucacggcucauccucaagcuggaaga

SEQ ID NO: 78651 - RNA, 32 nt, Human
cacaccucacugcuugcuugggagaggccaga

SEQ ID NO: 78652 - RNA, 32 nt, Human
cacaccuccagccucacguucacuuaggcaca

SEQ ID NO: 78653 - RNA, 32 nt, Human
cacaccucccuagagggagggagggagggcag

SEQ ID NO: 78654 - RNA, 32 nt, Human
cacaccuccucccaggaagacugcccaggccu

SEQ ID NO: 78655 - RNA, 32 nt, Human
cacaccuccucucacuccccagccugggccca

SEQ ID NO: 78656 - RNA, 32 nt, Human
cacaccuccugccucuaccagcagggguugcc

SEQ ID NO: 78657 - RNA, 32 nt, Human
cacaccucgaccccucacccccuccucccggg

SEQ ID NO: 78658 - RNA, 32 nt, Human
cacaccucggcucugggguugauaccugagcc

SEQ ID NO: 78659 - RNA, 18 nt, Human
cacaccucuccacagggc

SEQ ID NO: 78660 - RNA, 32 nt, Human
cacaccucugucucccccagggcucgggaugu

SEQ ID NO: 78661 - RNA, 32 nt, Human
cacaccucuuugcuuuaccagugguguuugug

SEQ ID NO: 78662 - RNA, 32 nt, Human
cacaccugacugcacuccagccuggguggcaa

SEQ ID NO: 78663 - RNA, 22 nt, Human
cacaccugcaaucccaacacuu

SEQ ID NO: 78664 - RNA, 32 nt, Human
cacaccugcaaucccagcuacucgggaggcug

SEQ ID NO: 78665 - RNA, 32 nt, Human
cacaccugcacaccccugcacacaccugcaca

SEQ ID NO: 78666 - RNA, 32 nt, Human
cacaccugcagauucuaggaccuguguccuag

SEQ ID NO: 78667 - RNA, 32 nt, Human
cacaccugcauucccagcuacuugggaggcug

SEQ ID NO: 78668 - RNA, 32 nt, Human
cacaccugcauucccagcuacuugggagguug

SEQ ID NO: 78669 - RNA, 31 nt, Human
cacaccugccucucccgucgucucuucuggg

SEQ ID NO: 78670 - RNA, 32 nt, Human
cacaccugcucaucuuugccuguggggcgcuc

SEQ ID NO: 78671 - RNA, 32 nt, Human
cacaccugcuccugcaggcacacugggcuagg

SEQ ID NO: 78672 - RNA, 32 nt, Human
cacaccugcucucuccucucucccaggcaggc

SEQ ID NO: 78673 - RNA, 32 nt, Human
cacaccugcuggccugggggagcuccagccag

SEQ ID NO: 78674 - RNA, 32 nt, Human
cacaccuggaagggaggggcccagccugaacc

SEQ ID NO: 78675 - RNA, 31 nt, Human
cacaccuggacaaucucgugcuaccuacaua

SEQ ID NO: 78676 - RNA, 32 nt, Human
cacaccuggacugacccugcagguuguucaua

SEQ ID NO: 78677 - RNA, 32 nt, Human
cacaccuggcacaacauacuagaauucacacu

SEQ ID NO: 78678 - RNA, 32 nt, Human
cacaccuggcacaacauauuguaauucacacu

SEQ ID NO: 78679 - RNA, 32 nt, Human
cacaccugggcaacagagugaaaccugucccu

SEQ ID NO: 78680 - RNA, 32 nt, Human
cacaccuggucugccccuagauuucuccucaa

SEQ ID NO: 78681 - RNA, 32 nt, Human
cacaccuguaaacccagcacuuugggagacug

SEQ ID NO: 78682 - RNA, 32 nt, Human
cacaccuguaauaaucccagcacuuugggagg

SEQ ID NO: 78683 - RNA, 22 nt, Human
cacaccuguaaucccaacacuu

SEQ ID NO: 78684 - RNA, 22 nt, Human
cacaccuguaaucccagcacuu

SEQ ID NO: 78685 - RNA, 23 nt, Human
cacaccuguaaucccagcacuuu

SEQ ID NO: 78686 - RNA, 23 nt, Human
cacaccuguaaucccagcaguuu

SEQ ID NO: 78687 - RNA, 32 nt, Human
cacaccuguaaucccagcuaccggggaggcug

SEQ ID NO: 78688 - RNA, 32 nt, Human
cacaccuguaaucccagcuaccugggaggcug

SEQ ID NO: 78689 - RNA, 32 nt, Human
cacaccuguaaucccagcuacuagggaggaug

SEQ ID NO: 78690 - RNA, 32 nt, Human
cacaccuguaaucccagcuacucgggaggcgg

SEQ ID NO: 78691 - RNA, 32 nt, Human
cacaccuguaaucccagcuacucgggaggcug

SEQ ID NO: 78692 - RNA, 32 nt, Human
cacaccuguaaucccagcuacucugaagccug

SEQ ID NO: 78693 - RNA, 32 nt, Human
cacaccuguaaucccagcuacucuggaggcug

SEQ ID NO: 78694 - RNA, 32 nt, Human
cacaccuguaaucccagcuacuugagaggcag

SEQ ID NO: 78695 - RNA, 32 nt, Human
cacaccuguaaucccagcuacuugggagacug

SEQ ID NO: 78696 - RNA, 32 nt, Human
cacaccuguaaucccagcuacuugggaggccg

SEQ ID NO: 78697 - RNA, 32 nt, Human
cacaccuguaaucccagcuacuugggaggcug

SEQ ID NO: 78698 - RNA, 32 nt, Human
cacaccuguaaucccagcuauucaggagguug

SEQ ID NO: 78699 - RNA, 32 nt, Human
cacaccuguaaucccagcuauuugggaggcca

SEQ ID NO: 78700 - RNA, 32 nt, Human
cacaccuguaaucccagcucuuuggaggccga

SEQ ID NO: 78701 - RNA, 32 nt, Human
cacaccuguaaucccagcucuuugggaggccg

SEQ ID NO: 78702 - RNA, 32 nt, Human
cacaccuguaaucccagcuguuugggaggcug

SEQ ID NO: 78703 - RNA, 32 nt, Human
cacaccuguagucccagagcuuugggaggccg

SEQ ID NO: 78704 - RNA, 32 nt, Human
cacaccuguagucccagauacuugggaggcca

SEQ ID NO: 78705 - RNA, 32 nt, Human
cacaccuguagucccagcacuuuaggaggcug

SEQ ID NO: 78706 - RNA, 32 nt, Human
cacaccuguagucccagcuacaugggaggcug

SEQ ID NO: 78707 - RNA, 32 nt, Human
cacaccuguagucccagcuacucaggaggcug

SEQ ID NO: 78708 - RNA, 32 nt, Human
cacaccuguagucccagcuacucaggagguug

SEQ ID NO: 78709 - RNA, 32 nt, Human
cacaccuguagucccagcuacucagggggcug

SEQ ID NO: 78710 - RNA, 32 nt, Human
cacaccuguagucccagcuacuccggaggcug

SEQ ID NO: 78711 - RNA, 32 nt, Human
cacaccuguagucccagcuacucgggaagcua

SEQ ID NO: 78712 - RNA, 32 nt, Human
cacaccuguagucccagcuacucgggagccca

SEQ ID NO: 78713 - RNA, 32 nt, Human
cacaccuguagucccagcuacucgggaggcug

SEQ ID NO: 78714 - RNA, 32 nt, Human
cacaccuguagucccagcuacucuggaggcug

SEQ ID NO: 78715 - RNA, 32 nt, Human
cacaccuguagucccagcuacugggaaagcug

SEQ ID NO: 78716 - RNA, 32 nt, Human
cacaccuguagucccagcuacuggggaggcug

SEQ ID NO: 78717 - RNA, 32 nt, Human
cacaccuguagucccagcuacuuaggaggcug

SEQ ID NO: 78718 - RNA, 32 nt, Human
cacaccuguagucccagcuacuugagaggcug

SEQ ID NO: 78719 - RNA, 32 nt, Human
cacaccuguagucccagcuacuugggaggcug

SEQ ID NO: 78720 - RNA, 32 nt, Human
cacaccuguagucccagcugcucaggaggcua

SEQ ID NO: 78721 - RNA, 32 nt, Human
cacaccuguagucccagcugcucaggaggcug

SEQ ID NO: 78722 - RNA, 32 nt, Human
cacaccuguagucccagguacuugggaggcug

SEQ ID NO: 78723 - RNA, 32 nt, Human
cacaccuguauucccaacacuuuuggaggcug

SEQ ID NO: 78724 - RNA, 32 nt, Human
cacaccugugaucccagcuacuugggaggcug

SEQ ID NO: 78725 - RNA, 32 nt, Human
cacaccuguggucccagcuacuagggaggcug

SEQ ID NO: 78726 - RNA, 32 nt, Human
cacaccuguggucccagcuacucaggaggcug

SEQ ID NO: 78727 - RNA, 32 nt, Human
cacaccuguggucccagcuacucgggaggcug

SEQ ID NO: 78728 - RNA, 32 nt, Human
cacaccuguggucccagcucuuuggaaggccg

SEQ ID NO: 78729 - RNA, 32 nt, Human
cacaccuguggucccagcugcucgggaggcug

SEQ ID NO: 78730 - RNA, 32 nt, Human
cacaccuguguggagaccuccccugaagcaug

SEQ ID NO: 78731 - RNA, 32 nt, Human
cacaccugugugugucugaguacaugugcaca

SEQ ID NO: 78732 - RNA, 32 nt, Human
cacaccuguuaaucccagcacuucgggaggcc

SEQ ID NO: 78733 - RNA, 32 nt, Human
cacaccuguuaucgagggugugagaagcgccu

SEQ ID NO: 78734 - RNA, 32 nt, Human
cacaccuguucuugggugcauguggguuuucg

SEQ ID NO: 78735 - RNA, 32 nt, Human
cacaccuguugucccagcuauucaggaggcug

SEQ ID NO: 78736 - RNA, 23 nt, Human
cacaccuuaccuagcaugagaga

SEQ ID NO: 78737 - RNA, 32 nt, Human
cacaccuucucuaggcuuguucaccaaagccg

SEQ ID NO: 78738 - RNA, 32 nt, Human
cacaccuugccuggccacccuggaaaaacaag

SEQ ID NO: 78739 - RNA, 32 nt, Human
cacaccuuuuccaggaguucugaagcugacag

SEQ ID NO: 78740 - RNA, 32 nt, Human
cacaccuuuugaggaggacagaagggacugga

SEQ ID NO: 78741 - RNA, 32 nt, Human
cacacgacccuccuaguccauguaagagaaga

SEQ ID NO: 78742 - RNA, 32 nt, Human
cacacgacuagacugcagcuauccaaauuccu

SEQ ID NO: 78743 - RNA, 32 nt, Human
cacacgacugcauucuagccugggugacagag

SEQ ID NO: 78744 - RNA, 22 nt, Human
cacacgaguucauaauguggug

SEQ ID NO: 78745 - RNA, 32 nt, Human
cacacgaucucagggcuggugcugagcagccu

SEQ ID NO: 78746 - RNA, 32 nt, Human
cacacgcaacccagccucagcaucacagccgc

SEQ ID NO: 78747 - RNA, 22 nt, Human
cacacgcaagagcaaacaggag

SEQ ID NO: 78748 - RNA, 18 nt, Human
cacacgcacacacaauca

SEQ ID NO: 78749 - RNA, 32 nt, Human
cacacgcacacagugucuguguacauguacag

SEQ ID NO: 78750 - RNA, 32 nt, Human
cacacgcacaucugguguuuaugaagcagaua

SEQ ID NO: 78751 - RNA, 32 nt, Human
cacacgcacaugcaaaaauacacacaugcaca

SEQ ID NO: 78752 - RNA, 32 nt, Human
cacacgcacgugcacacacgcacgcacgcgug

SEQ ID NO: 78753 - RNA, 32 nt, Human
cacacgcagagugagagggacaugguggcagg

SEQ ID NO: 78754 - RNA, 32 nt, Human
cacacgcaggggcugacagcugugcuggugcu

SEQ ID NO: 78755 - RNA, 32 nt, Human
cacacgcagguggaggugguugugggugcagg

SEQ ID NO: 78756 - RNA, 32 nt, Human
cacacgcaucuguacacacaugcaugcucagc

SEQ ID NO: 78757 - RNA, 32 nt, Human
cacacgccaaugcacacacacagagauaugca

SEQ ID NO: 78758 - RNA, 32 nt, Human
cacacgccacugcacuccagccugggugacag

SEQ ID NO: 78759 - RNA, 32 nt, Human
cacacgccacugcccccgaggccagaguguaa

SEQ ID NO: 78760 - RNA, 19 nt, Human
cacacgccagccacagggg

SEQ ID NO: 78761 - RNA, 32 nt, Human
cacacgccuagacugagugugguuucgucgug

SEQ ID NO: 78762 - RNA, 32 nt, Human
cacacgccuauaauccuagcuacuagggcagc

SEQ ID NO: 78763 - RNA, 32 nt, Human
cacacgccugaagucccagcuacucaggaggc

SEQ ID NO: 78764 - RNA, 32 nt, Human
cacacgccuguaaucccagcacuuugggaggc

SEQ ID NO: 78765 - RNA, 32 nt, Human
cacacgccuguaaucccagcuacucuggaggc

SEQ ID NO: 78766 - RNA, 32 nt, Human
cacacgccuguaaucccagcuacuugggaggc

SEQ ID NO: 78767 - RNA, 32 nt, Human
cacacgccuguaaucccagcugcuugggaggc

SEQ ID NO: 78768 - RNA, 32 nt, Human
cacacgccuguaaucccagguacuuggaaggc

SEQ ID NO: 78769 - RNA, 32 nt, Human
cacacgccuguaaucccaguuacuugggaggc

SEQ ID NO: 78770 - RNA, 32 nt, Human
cacacgcgcuggaccuggaggcugaggaggag

SEQ ID NO: 78771 - RNA, 32 nt, Human
cacacgcguguguacacacggaccauguggua

SEQ ID NO: 78772 - RNA, 32 nt, Human
cacacgcuccgcuccgggccugggugccuaca

SEQ ID NO: 78773 - RNA, 32 nt, Human
cacacgcucgcagucugugggcccuccgggag

SEQ ID NO: 78774 - RNA, 32 nt, Human
cacacgcuuucugcaacccuaucccuugcauc

SEQ ID NO: 78775 - RNA, 32 nt, Human
cacacggaccuccaggagcagugagagguggc

SEQ ID NO: 78776 - RNA, 17 nt, Human
cacacggagaagcagug

SEQ ID NO: 78777 - RNA, 32 nt, Human
cacacggagaggagggaaaauaagcgaggcac

SEQ ID NO: 78778 - RNA, 32 nt, Human
cacacggagccauggggcgccauguugccacc

SEQ ID NO: 78779 - RNA, 32 nt, Human
cacacggaggcagagguggggaugagguaugu

SEQ ID NO: 78780 - RNA, 32 nt, Human
cacacggcacacacaagcggagcugagaagca

SEQ ID NO: 78781 - RNA, 32 nt, Human
cacacggccucaauccuugaaaagcuuacagu

SEQ ID NO: 78782 - RNA, 32 nt, Human
cacacggccucucgaguccacacccacucacc

SEQ ID NO: 78783 - RNA, 32 nt, Human
cacacggcuguaaucccagcacuuugggaggc

SEQ ID NO: 78784 - RNA, 32 nt, Human
cacacggcugucccucauggagaccucaugcc

SEQ ID NO: 78785 - RNA, 32 nt, Human
cacacgggaccaggcugggcgaagaacacuga

SEQ ID NO: 78786 - RNA, 32 nt, Human
cacacgggcuuuggagucagacuugcuggcua

SEQ ID NO: 78787 - RNA, 32 nt, Human
cacacggguuacugcuaggauguguucuuuuc

SEQ ID NO: 78788 - RNA, 18 nt, Human
cacacgguggagcugccu

SEQ ID NO: 78789 - RNA, 32 nt, Human
cacacgguggagcugccucuuccuuccccucc

SEQ ID NO: 78790 - RNA, 32 nt, Human
cacacguaaacacccacccaaccgcaagaaag

SEQ ID NO: 78791 - RNA, 32 nt, Human
cacacguccagcuucagccacauugaggccag

SEQ ID NO: 78792 - RNA, 32 nt, Human
cacacgucucccaccagaggcacgccauccaa

SEQ ID NO: 78793 - RNA, 32 nt, Human
cacacgugaagcaccaggcugggagaugaggu

SEQ ID NO: 78794 - RNA, 31 nt, Human
cacacgugacuucuuauuuccaagggaaaug

SEQ ID NO: 78795 - RNA, 32 nt, Human
cacacgugagauuuccuuuuaccaacagagaa

SEQ ID NO: 78796 - RNA, 32 nt, Human
cacacgugcacguacacacaugcaugcucgcu

SEQ ID NO: 78797 - RNA, 32 nt, Human
cacacgugcccagcaggaaaagcuucgucuuc

SEQ ID NO: 78798 - RNA, 32 nt, Human
cacacgugcccucccugccacccuccgucuag

SEQ ID NO: 78799 - RNA, 32 nt, Human
cacacgugcccuggccucuggagcucagcugc

SEQ ID NO: 78800 - RNA, 32 nt, Human
cacacgugccuguagcauuccagagcucacug

SEQ ID NO: 78801 - RNA, 32 nt, Human
cacacgugcuuccucucuugacaucaagggag

SEQ ID NO: 78802 - RNA, 32 nt, Human
cacacgugucuccuccuccucaucuuagcuuc

SEQ ID NO: 78803 - RNA, 32 nt, Human
cacacgugugcugcugaggugaggcaggucug

SEQ ID NO: 78804 - RNA, 32 nt, Human
cacacgugugugugcgcguguguauaaaacac

SEQ ID NO: 78805 - RNA, 32 nt, Human
cacacguguguucacagagcuacggccacaca

SEQ ID NO: 78806 - RNA, 24 nt, Human
cacacguuauaaucauuuaucaua

SEQ ID NO: 78807 - RNA, 32 nt, Human
cacacguuccuguucaaaaagcagaaacagau

SEQ ID NO: 78808 - RNA, 32 nt, Human
cacacguuggagcugguggcacuggacaguga

SEQ ID NO: 78809 - RNA, 32 nt, Human
cacacguuuaccuguguaaccugcacauccug

SEQ ID NO: 78810 - RNA, 32 nt, Human
  misc_feature (29)..(29): n is a, c, g or u
cacacuaaaauuauauuuuaaaaguuuanugc

SEQ ID NO: 78811 - RNA, 18 nt, Human
cacacuaacagccacacc

SEQ ID NO: 78812 - RNA, 32 nt, Human
cacacuaaccugggugacagaaugagacccug

SEQ ID NO: 78813 - RNA, 32 nt, Human
cacacuaagcucuucucucucaggggcagugg

SEQ ID NO: 78814 - RNA, 32 nt, Human
cacacuacccaggagcccaguggugcaccugc

SEQ ID NO: 78815 - RNA, 32 nt, Human
cacacuacugaaagacccucugccucacucua

SEQ ID NO: 78816 - RNA, 32 nt, Human
cacacuacugcacuccagccugggcaacagaa

SEQ ID NO: 78817 - RNA, 32 nt, Human
cacacuacugcacuccagccugggcgacaaag

SEQ ID NO: 78818 - RNA, 32 nt, Human
cacacuacugcacuccugcaugggcgacugag

SEQ ID NO: 78819 - RNA, 32 nt, Human
cacacuacugcauuccagccugagcaacagag

SEQ ID NO: 78820 - RNA, 30 nt, Human
cacacuagccucuguguucccguuagggac

SEQ ID NO: 78821 - RNA, 32 nt, Human
cacacuagcucucugaguauuuccuugauugc

SEQ ID NO: 78822 - RNA, 32 nt, Human
cacacuagcuugggugacagaggaagacuguc

SEQ ID NO: 78823 - RNA, 32 nt, Human
cacacuauauuacagaaugauguaauaccugg

SEQ ID NO: 78824 - RNA, 32 nt, Human
cacacuaucguguacacagcagucuucagccc

SEQ ID NO: 78825 - RNA, 19 nt, Human
cacacuaugacuucugcuc

SEQ ID NO: 78826 - RNA, 32 nt, Human
cacacuauugcacuccagccugggcgacaggg

SEQ ID NO: 78827 - RNA, 32 nt, Human
cacacucaaaugcucacaggagcuagugacua

SEQ ID NO: 78828 - RNA, 32 nt, Human
cacacucaacucugauacuccagcccuguggc

SEQ ID NO: 78829 - RNA, 32 nt, Human
cacacucaagaauuugucagcacacaauuaau

SEQ ID NO: 78830 - RNA, 32 nt, Human
cacacucacaaccgcagaccucggugaggaau

SEQ ID NO: 78831 - RNA, 32 nt, Human
cacacucacaagagauauggcugugauuugga

SEQ ID NO: 78832 - RNA, 32 nt, Human
cacacucacacacacucauccccuugaaucuu

SEQ ID NO: 78833 - RNA, 32 nt, Human
cacacucacaugcucucacucaccacacugga

SEQ ID NO: 78834 - RNA, 32 nt, Human
cacacucacccccacucccacacacauacaca

SEQ ID NO: 78835 - RNA, 32 nt, Human
cacacucacuauuucaaaguguguuauaaaca

SEQ ID NO: 78836 - RNA, 32 nt, Human
cacacucagagcaugucuggcuuuccuggugg

SEQ ID NO: 78837 - RNA, 32 nt, Human
cacacucagcaaccacacggaucugacagaca

SEQ ID NO: 78838 - RNA, 21 nt, Human
cacacucagcccuugcacuga

SEQ ID NO: 78839 - RNA, 17 nt, Human
cacacucagcugggccc

SEQ ID NO: 78840 - RNA, 32 nt, Human
cacacucaggaagccuugucuaccuuucccua

SEQ ID NO: 78841 - RNA, 32 nt, Human
cacacucaguagguucugcccccacaucauuu

SEQ ID NO: 78842 - RNA, 32 nt, Human
cacacucauccccucacuugccgcgucgcccu

SEQ ID NO: 78843 - RNA, 32 nt, Human
cacacucaugaagaaagaacacaggaguagcu

SEQ ID NO: 78844 - RNA, 32 nt, Human
cacacucaugaccauacucaucuguugguggu

SEQ ID NO: 78845 - RNA, 32 nt, Human
cacacucaugcuuucacauacauacacucacu

SEQ ID NO: 78846 - RNA, 32 nt, Human
cacacuccaaaccaauaaaguuuuauauuuug

SEQ ID NO: 78847 - RNA, 32 nt, Human
cacacuccagagcgggugugaggggcgccgau

SEQ ID NO: 78848 - RNA, 19 nt, Human
cacacuccagccugagcag

SEQ ID NO: 78849 - RNA, 32 nt, Human
cacacuccagccugagcagcagagcgggaccu

SEQ ID NO: 78850 - RNA, 32 nt, Human
cacacuccagccuggguaacagagugagacuc

SEQ ID NO: 78851 - RNA, 32 nt, Human
cacacuccagccuggguaacagugagaccaug

SEQ ID NO: 78852 - RNA, 32 nt, Human
cacacuccagccugggugacagagugaaaccc

SEQ ID NO: 78853 - RNA, 32 nt, Human
cacacuccagccuggguggcaaagugagacuc

SEQ ID NO: 78854 - RNA, 32 nt, Human
cacacuccagcugggaucacauguggacuuuu

SEQ ID NO: 78855 - RNA, 32 nt, Human
cacacuccagugcuuuuaagcagguuuucccc

SEQ ID NO: 78856 - RNA, 32 nt, Human
cacacuccauuuucccaugucugacuucgugg

SEQ ID NO: 78857 - RNA, 32 nt, Human
cacacucccacacuccagccuggguaacagug

SEQ ID NO: 78858 - RNA, 32 nt, Human
cacacuccccauacccuucagugcaguguacc

SEQ ID NO: 78859 - RNA, 32 nt, Human
cacacuccccuccauccucugagcucccugca

SEQ ID NO: 78860 - RNA, 32 nt, Human
cacacuccccuccuggguuuccacacucagga

SEQ ID NO: 78861 - RNA, 32 nt, Human
cacacucccuggguccaggaguguagaauaug

SEQ ID NO: 78862 - RNA, 32 nt, Human
cacacuccggggcagaucuuuccucuugucug

SEQ ID NO: 78863 - RNA, 32 nt, Human
cacacuccuauaauccuagcacuuugggaggc

SEQ ID NO: 78864 - RNA, 32 nt, Human
cacacuccuaucucugcacuucugcccuccau

SEQ ID NO: 78865 - RNA, 32 nt, Human
cacacuccuccaccugucucaaacucuaaggu

SEQ ID NO: 78866 - RNA, 19 nt, Human
cacacuccucuggagucuu

SEQ ID NO: 78867 - RNA, 32 nt, Human
cacacuccugaccuucuagaugaguaacaaaa

SEQ ID NO: 78868 - RNA, 32 nt, Human
cacacuccugcuguuccagccucugcagguga

SEQ ID NO: 78869 - RNA, 32 nt, Human
cacacuccuguaaucccagcuacuggggaggc

SEQ ID NO: 78870 - RNA, 32 nt, Human
cacacuccuguaaucccagcuacuuaggaggc

SEQ ID NO: 78871 - RNA, 32 nt, Human
cacacuccuucauuugaccacauggccuauuu

SEQ ID NO: 78872 - RNA, 32 nt, Human
cacacucuaccuuuagugcaagcuauuuguuu

SEQ ID NO: 78873 - RNA, 32 nt, Human
cacacucuagggaauaauuccacuccagagau

SEQ ID NO: 78874 - RNA, 32 nt, Human
cacacucuccaggcuggagugcaguggcacaa

SEQ ID NO: 78875 - RNA, 32 nt, Human
cacacucuccuccaaaagagccuccaucugua

SEQ ID NO: 78876 - RNA, 32 nt, Human
cacacucuccugugaacacuggagucuugcaa

SEQ ID NO: 78877 - RNA, 32 nt, Human
cacacucucugcagcccagccuagucagggca

SEQ ID NO: 78878 - RNA, 32 nt, Human
cacacucucugccaugcacacaggaggagagc

SEQ ID NO: 78879 - RNA, 32 nt, Human
cacacucucugccugacugaccccugccaggg

SEQ ID NO: 78880 - RNA, 32 nt, Human
cacacucuggcaccacacacauugucuccagc

SEQ ID NO: 78881 - RNA, 32 nt, Human
cacacucuggguuggaaaauguuugccuguug

SEQ ID NO: 78882 - RNA, 32 nt, Human
cacacucugucacccaggccaaguucaauggu

SEQ ID NO: 78883 - RNA, 24 nt, Human
cacacucuguucuuuaguguccuu

SEQ ID NO: 78884 - RNA, 32 nt, Human
cacacugaagccagaagcugugggcugugggg

SEQ ID NO: 78885 - RNA, 32 nt, Human
cacacugaauacaggugucaccaccuccugag

SEQ ID NO: 78886 - RNA, 32 nt, Human
cacacugacagugcugagcagagcaagguugg

SEQ ID NO: 78887 - RNA, 32 nt, Human
cacacugaccacacccugcccucuucggugac

SEQ ID NO: 78888 - RNA, 26 nt, Human
cacacugaccucaggugauccacccg

SEQ ID NO: 78889 - RNA, 32 nt, Human
cacacugacuaggguaguggggugcauuuggu

SEQ ID NO: 78890 - RNA, 32 nt, Human
cacacugacuccauacauaaccuccuugaaaa

SEQ ID NO: 78891 - RNA, 32 nt, Human
cacacugacuccaucugagggguccuugaggc

SEQ ID NO: 78892 - RNA, 32 nt, Human
cacacugagauagaauugugauuucauaauaa

SEQ ID NO: 78893 - RNA, 32 nt, Human
cacacugagauucuguguucuccucugagcau

SEQ ID NO: 78894 - RNA, 32 nt, Human
cacacugagcauggucagggcauuggucagag

SEQ ID NO: 78895 - RNA, 32 nt, Human
cacacugagcuucuuucuccucccuuaguaca

SEQ ID NO: 78896 - RNA, 32 nt, Human
cacacugaggcagggaguuggcucucuuggug

SEQ ID NO: 78897 - RNA, 32 nt, Human
cacacugaugcacacggaccuggacacagaca

SEQ ID NO: 78898 - RNA, 32 nt, Human
cacacugauucaggccuugagagucaagccca

SEQ ID NO: 78899 - RNA, 21 nt, Human
cacacugcacuauuaauucca

SEQ ID NO: 78900 - RNA, 32 nt, Human
cacacugcagcugcccuguaaauguucagcuc

SEQ ID NO: 78901 - RNA, 32 nt, Human
cacacugcaugcuugggggugccaagggauuc

SEQ ID NO: 78902 - RNA, 32 nt, Human
cacacugccacacugcucacacuguccacagg

SEQ ID NO: 78903 - RNA, 32 nt, Human
cacacugccaggggagccucacugugaagucu

SEQ ID NO: 78904 - RNA, 32 nt, Human
cacacugccccgggcccuuugcacuggcuguu

SEQ ID NO: 78905 - RNA, 32 nt, Human
cacacugcccguguucaaggggcugcucggag

SEQ ID NO: 78906 - RNA, 32 nt, Human
cacacugcccuaggagagguuccccaugaggg

SEQ ID NO: 78907 - RNA, 32 nt, Human
cacacugccgcuccagccuuccuggcaggcac

SEQ ID NO: 78908 - RNA, 32 nt, Human
cacacugccgcuucaaucuccugggcucaaau

SEQ ID NO: 78909 - RNA, 32 nt, Human
cacacugccugggacaguguccugcauccaca

SEQ ID NO: 78910 - RNA, 32 nt, Human
cacacugcggccaggccagcugagucccucca

SEQ ID NO: 78911 - RNA, 32 nt, Human
cacacugcggugucugcagcuccuggaaggug

SEQ ID NO: 78912 - RNA, 32 nt, Human
cacacugcuagagcccagaccuggugaggaca

SEQ ID NO: 78913 - RNA, 32 nt, Human
cacacugcucucuuccuuccagaagcuugguu

SEQ ID NO: 78914 - RNA, 32 nt, Human
cacacugcugcacuccagccugugcaacagag

SEQ ID NO: 78915 - RNA, 19 nt, Human
cacacugcuuuguguuuuu

SEQ ID NO: 78916 - RNA, 20 nt, Human
cacacuggaacuggcaggaa

SEQ ID NO: 78917 - RNA, 32 nt, Human
cacacuggaagggggaccugcgcccccacauc

SEQ ID NO: 78918 - RNA, 32 nt, Human
cacacuggagagaagccauaugaguguaagga

SEQ ID NO: 78919 - RNA, 32 nt, Human
cacacuggagaucaugaugaacuuuuggcuga

SEQ ID NO: 78920 - RNA, 32 nt, Human
cacacuggagcuacuuggacaagaccagcaug

SEQ ID NO: 78921 - RNA, 28 nt, Human
cacacuggagcugcagagacuguauuca

SEQ ID NO: 78922 - RNA, 31 nt, Human
cacacuggaguccaccauaccaaagcacgaa

SEQ ID NO: 78923 - RNA, 32 nt, Human
cacacuggcacacacacauacacacauaugca

SEQ ID NO: 78924 - RNA, 32 nt, Human
cacacuggccuacagaccuggggacagagucu

SEQ ID NO: 78925 - RNA, 31 nt, Human
cacacuggccucucuaggccgagguccuuuc

SEQ ID NO: 78926 - RNA, 32 nt, Human
cacacuggccugcucaugcacacaccugcaag

SEQ ID NO: 78927 - RNA, 32 nt, Human
cacacuggccuuucuguuccuuggacaugccu

SEQ ID NO: 78928 - RNA, 21 nt, Human
cacacuggcuccagacacaca

SEQ ID NO: 78929 - RNA, 32 nt, Human
cacacugggacccugcaagaggccaacagauu

SEQ ID NO: 78930 - RNA, 32 nt, Human
cacacugggaggccgaggcagguggaucacuc

SEQ ID NO: 78931 - RNA, 32 nt, Human
cacacugggcagccagccugccggcaggacuu

SEQ ID NO: 78932 - RNA, 32 nt, Human
cacacugggugaagaauggaaggguuaugugg

SEQ ID NO: 78933 - RNA, 32 nt, Human
cacacuggucucaaacuccugaccucaggcga

SEQ ID NO: 78934 - RNA, 32 nt, Human
cacacuggucucaaacuccugaccucagguga

SEQ ID NO: 78935 - RNA, 32 nt, Human
cacacuguauuccagaugauagaggcuaacuc

SEQ ID NO: 78936 - RNA, 32 nt, Human
cacacuguauuccagaugauagaggcuuacuc

SEQ ID NO: 78937 - RNA, 32 nt, Human
cacacugucacccaggcuggagugcaguguug

SEQ ID NO: 78938 - RNA, 32 nt, Human
cacacugucauuuagcucauguuaacaccuga

SEQ ID NO: 78939 - RNA, 32 nt, Human
cacacugucgccaggcuggagugcaguggugc

SEQ ID NO: 78940 - RNA, 32 nt, Human
cacacugucgccucauagcugcaagagagagg

SEQ ID NO: 78941 - RNA, 32 nt, Human
cacacuguuaaaaguuguguuuugaaauuuua

SEQ ID NO: 78942 - RNA, 32 nt, Human
cacacuguucucugcugguucccgaagcugau

SEQ ID NO: 78943 - RNA, 32 nt, Human
cacacuguugcccaggcuggagugcaguggcg

SEQ ID NO: 78944 - RNA, 16 nt, Human
cacacuguugucacuu

SEQ ID NO: 78945 - RNA, 32 nt, Human
cacacuuaagcccucgugcacacacacaaauu

SEQ ID NO: 78946 - RNA, 24 nt, Human
cacacuuagugagaaggagccaca

SEQ ID NO: 78947 - RNA, 32 nt, Human
cacacuuaugggccaagcccagcuuaauggcu

SEQ ID NO: 78948 - RNA, 32 nt, Human
cacacuucacacaacaggcuuaucagaaaccu

SEQ ID NO: 78949 - RNA, 32 nt, Human
cacacuucauccuauagagucaaccaccacag

SEQ ID NO: 78950 - RNA, 32 nt, Human
cacacuuccaagcaaggcccaggcuggcccag

SEQ ID NO: 78951 - RNA, 19 nt, Human
cacacuuccagcuggcaua

SEQ ID NO: 78952 - RNA, 32 nt, Human
cacacuucgauuggcagcaucuccucauucuu

SEQ ID NO: 78953 - RNA, 32 nt, Human
cacacuucuccagcaacacuccaucagcuuuu

SEQ ID NO: 78954 - RNA, 32 nt, Human
cacacuucugagaucuuucagaugguuuugcc

SEQ ID NO: 78955 - RNA, 32 nt, Human
cacacuucugcucuaagagucucccucccuuu

SEQ ID NO: 78956 - RNA, 32 nt, Human
cacacuugaagccagcaugucucugaaucuca

SEQ ID NO: 78957 - RNA, 32 nt, Human
cacacuugcacaugcauacacaugcacucaca

SEQ ID NO: 78958 - RNA, 32 nt, Human
cacacuugcacaugccuacacacucacugaca

SEQ ID NO: 78959 - RNA, 32 nt, Human
cacacuugcuguccccauccauggcccgaggg

SEQ ID NO: 78960 - RNA, 32 nt, Human
cacacuuggcuacucuuccucgucucagcaga

SEQ ID NO: 78961 - RNA, 32 nt, Human
cacacuugggaucacaguugcgucauugugua

SEQ ID NO: 78962 - RNA, 32 nt, Human
cacacuugucugcaggacuuacagauccugca

SEQ ID NO: 78963 - RNA, 22 nt, Human
cacacuugugaguauguauuca

SEQ ID NO: 78964 - RNA, 32 nt, Human
cacacuuuccaaaaugagccuuaaaaauugua

SEQ ID NO: 78965 - RNA, 32 nt, Human
cacacuuuccacccucaccugcccccucauac

SEQ ID NO: 78966 - RNA, 32 nt, Human
cacacuuuccaggcugagcauuuccuuuugug

SEQ ID NO: 78967 - RNA, 32 nt, Human
cacacuuugggcugggauggcaguggggcaua

SEQ ID NO: 78968 - RNA, 32 nt, Human
cacacuuuucaggagaaaccugagcaugauuu

SEQ ID NO: 78969 - RNA, 32 nt, Human
cacacuuuucccuuccuggcccaagagagcau

SEQ ID NO: 78970 - RNA, 32 nt, Human
cacagaaaaauggcauuccucucugucucucc

SEQ ID NO: 78971 - RNA, 32 nt, Human
cacagaaaacagcaaauauccccagcccuuga

SEQ ID NO: 78972 - RNA, 32 nt, Human
cacagaaaacccacagccagagccccugggcc

SEQ ID NO: 78973 - RNA, 16 nt, Human
cacagaaaauugcaga

SEQ ID NO: 78974 - RNA, 32 nt, Human
cacagaaacgcaauaaacacacacaaaauagu

SEQ ID NO: 78975 - RNA, 32 nt, Human
cacagaaagagccugauguccaugauccaggu

SEQ ID NO: 78976 - RNA, 32 nt, Human
cacagaaagaggaggagcaagugggauguuua

SEQ ID NO: 78977 - RNA, 32 nt, Human
cacagaaagauaagguaaacaagauauacuua

SEQ ID NO: 78978 - RNA, 32 nt, Human
cacagaaagaugggggaaggaggauacaggcu

SEQ ID NO: 78979 - RNA, 32 nt, Human
cacagaaaggcugcucccuaaugacugugggc

SEQ ID NO: 78980 - RNA, 24 nt, Human
cacagaaagucugccugucugcau

SEQ ID NO: 78981 - RNA, 32 nt, Human
cacagaaaucugaaaaauggccauguugucuu

SEQ ID NO: 78982 - RNA, 32 nt, Human
cacagaacaauccugaaccaggccugucaccu

SEQ ID NO: 78983 - RNA, 32 nt, Human
cacagaacaugcaaaaggccugugcauucuag

SEQ ID NO: 78984 - RNA, 22 nt, Human
cacagaacauguuggcaugaca

SEQ ID NO: 78985 - RNA, 32 nt, Human
cacagaacauuuguuuacaauucugugugacu

SEQ ID NO: 78986 - RNA, 32 nt, Human
cacagaaccaaagaagcaaguuauggaggagc

SEQ ID NO: 78987 - RNA, 32 nt, Human
cacagaaccacuugcaggaagaacucuagaga

SEQ ID NO: 78988 - RNA, 32 nt, Human
cacagaaccagccacaccccacggccacgaag

SEQ ID NO: 78989 - RNA, 32 nt, Human
cacagaaccagcugauggccccagugccugaa

SEQ ID NO: 78990 - RNA, 32 nt, Human
cacagaacgacacccgguaauccacaggguca

SEQ ID NO: 78991 - RNA, 32 nt, Human
cacagaacuaaaacuacuacuuacaucuaaca

SEQ ID NO: 78992 - RNA, 32 nt, Human
cacagaacuccaccagcaacuccacccgaccc

SEQ ID NO: 78993 - RNA, 32 nt, Human
cacagaacugauuagaagagaucagaguuuug

SEQ ID NO: 78994 - RNA, 32 nt, Human
cacagaagaaagaccuguguccuagagaguag

SEQ ID NO: 78995 - RNA, 20 nt, Human
cacagaagaacucaugcagg

SEQ ID NO: 78996 - RNA, 32 nt, Human
cacagaagaauuggaccaggucacuguacgua

SEQ ID NO: 78997 - RNA, 32 nt, Human
cacagaagacaccuacucccaccagcggaguu

SEQ ID NO: 78998 - RNA, 20 nt, Human
cacagaagccaauguuugga

SEQ ID NO: 78999 - RNA, 23 nt, Human
cacagaagccacaaacaggcuca

SEQ ID NO: 79000 - RNA, 23 nt, Human
cacagaagccacagcccaguaag

SEQ ID NO: 79001 - RNA, 23 nt, Human
cacagaagccagaaggcagugga

SEQ ID NO: 79002 - RNA, 19 nt, Human
cacagaagccagccaagug

SEQ ID NO: 79003 - RNA, 32 nt, Human
cacagaagccugcuggaagacaggucucucuc

SEQ ID NO: 79004 - RNA, 19 nt, Human
cacagaagccuuuuacgga

SEQ ID NO: 79005 - RNA, 20 nt, Human
cacagaagcucucaauuuca

SEQ ID NO: 79006 - RNA, 32 nt, Human
cacagaagcucucaauuucagaugauagguga

SEQ ID NO: 79007 - RNA, 32 nt, Human
cacagaaggaggaggaggagguuuaggucaag

SEQ ID NO: 79008 - RNA, 32 nt, Human
cacagaaggauucugcaaauagccugcggaga

SEQ ID NO: 79009 - RNA, 24 nt, Human
cacagaaggggcaggccaggugga

SEQ ID NO: 79010 - RNA, 32 nt, Human
cacagaagguggagguugcagugagccaagcu

SEQ ID NO: 79011 - RNA, 32 nt, Human
cacagaagugggaaggagaggggugggccagg

SEQ ID NO: 79012 - RNA, 32 nt, Human
cacagaauaaacuuucuuuagaugcuguucuu

SEQ ID NO: 79013 - RNA, 32 nt, Human
cacagaauaacccugcauccaaauuccaggaa

SEQ ID NO: 79014 - RNA, 22 nt, Human
cacagaauacagugaaaugaca

SEQ ID NO: 79015 - RNA, 32 nt, Human
cacagaaucuaaagggguauuagccagccucg

SEQ ID NO: 79016 - RNA, 32 nt, Human
cacagaaucuugucccuugggaguuuuugugu

SEQ ID NO: 79017 - RNA, 22 nt, Human
cacagaaugucuacaagaauua

SEQ ID NO: 79018 - RNA, 32 nt, Human
cacagaauugugcaaccaucaccacaaucuuu

SEQ ID NO: 79019 - RNA, 32 nt, Human
cacagacaaaggacuuccccgcagggaacugu

SEQ ID NO: 79020 - RNA, 32 nt, Human
cacagacaacaguugcacagugccucaagccc

SEQ ID NO: 79021 - RNA, 32 nt, Human
cacagacaagaccucagagaucaaaggaagag

SEQ ID NO: 79022 - RNA, 32 nt, Human
cacagacaaggcuucagcucuaggaaccccac

SEQ ID NO: 79023 - RNA, 32 nt, Human
cacagacaaugaccacuacccugggugugaua

SEQ ID NO: 79024 - RNA, 32 nt, Human
cacagacacacagacacauacgcacacacgug

SEQ ID NO: 79025 - RNA, 32 nt, Human
cacagacacagcauagcaggaguccuccccau

SEQ ID NO: 79026 - RNA, 21 nt, Human
cacagacacaguuucuggaau

SEQ ID NO: 79027 - RNA, 32 nt, Human
cacagacaccuccugggcugggcagagugaca

SEQ ID NO: 79028 - RNA, 32 nt, Human
cacagacacgcaugcacacacgcagaggugca

SEQ ID NO: 79029 - RNA, 32 nt, Human
cacagacagaagacugugucaugggucauggc

SEQ ID NO: 79030 - RNA, 32 nt, Human
cacagacagcaaggaccugcagcugcuccgcc

SEQ ID NO: 79031 - RNA, 32 nt, Human
cacagacagccagcagggggcgucggagaacu

SEQ ID NO: 79032 - RNA, 32 nt, Human
cacagacaggagagagucaguggcaaauagac

SEQ ID NO: 79033 - RNA, 32 nt, Human
cacagacaggcagaggauuacaacacaaggca

SEQ ID NO: 79034 - RNA, 32 nt, Human
cacagacagggcugccugugaccugcugugac

SEQ ID NO: 79035 - RNA, 32 nt, Human
cacagacaguugagcuuuucagcugggaagcc

SEQ ID NO: 79036 - RNA, 32 nt, Human
cacagacauggugaggacccuggcugugcacc

SEQ ID NO: 79037 - RNA, 32 nt, Human
cacagaccacccuucaugcuggggcucuggag

SEQ ID NO: 79038 - RNA, 32 nt, Human
cacagaccagcauccccacuuaccaggccucc

SEQ ID NO: 79039 - RNA, 32 nt, Human
cacagaccagcccagcauucaggcugguagag

SEQ ID NO: 79040 - RNA, 32 nt, Human
cacagaccauaagaaacaacaaaugagccacu

SEQ ID NO: 79041 - RNA, 32 nt, Human
cacagaccaucuuugaauagcaaggcucuaga

SEQ ID NO: 79042 - RNA, 16 nt, Human
cacagacccauccggc

SEQ ID NO: 79043 - RNA, 32 nt, Human
cacagaccccacuuggagaggaauucugggaa

SEQ ID NO: 79044 - RNA, 32 nt, Human
cacagacccccagcagguagcauuccccagcc

SEQ ID NO: 79045 - RNA, 32 nt, Human
cacagaccccuccacauuaugccacacacggc

SEQ ID NO: 79046 - RNA, 32 nt, Human
cacagaccccuccagaggucucgcucgcaggc

SEQ ID NO: 79047 - RNA, 21 nt, Human
cacagaccccucuccccugca

SEQ ID NO: 79048 - RNA, 32 nt, Human
cacagacccgcuggaccagccugcugcggguc

SEQ ID NO: 79049 - RNA, 24 nt, Human
cacagacccucugcagccccuggc

SEQ ID NO: 79050 - RNA, 32 nt, Human
cacagacccuggcccccuccccaaguccaucc

SEQ ID NO: 79051 - RNA, 22 nt, Human
cacagacccuucccaauuccau

SEQ ID NO: 79052 - RNA, 21 nt, Human
cacagacgcagagacgggggg

SEQ ID NO: 79053 - RNA, 32 nt, Human
cacagacggcaucacagacagucacagcacug

SEQ ID NO: 79054 - RNA, 32 nt, Human
cacagacggcggcauccuccagcccuggucac

SEQ ID NO: 79055 - RNA, 32 nt, Human
cacagacgugagccacugcguccgguccaucu

SEQ ID NO: 79056 - RNA, 23 nt, Human
cacagacguggaucgcaagugga

SEQ ID NO: 79057 - RNA, 32 nt, Human
cacagacguuuggacagagcaggcuccuaagg

SEQ ID NO: 79058 - RNA, 32 nt, Human
cacagacuagccuaggucucucuauuucuuga

SEQ ID NO: 79059 - RNA, 16 nt, Human
cacagacuaggucuug

SEQ ID NO: 79060 - RNA, 21 nt, Human
cacagacucagcauuuccaca

SEQ ID NO: 79061 - RNA, 32 nt, Human
cacagacuccaaaggcguagaaguuugugcca

SEQ ID NO: 79062 - RNA, 32 nt, Human
cacagacuccacccuccuacaggugcuguuca

SEQ ID NO: 79063 - RNA, 32 nt, Human
cacagacucucagcccacacaaugccccagug

SEQ ID NO: 79064 - RNA, 32 nt, Human
cacagacugggaccuccaccacaucuggcaga

SEQ ID NO: 79065 - RNA, 32 nt, Human
cacagacuguccacugcagagaccauggacgg

SEQ ID NO: 79066 - RNA, 32 nt, Human
cacagacugucuguauucaauggcuaucuuca

SEQ ID NO: 79067 - RNA, 32 nt, Human
cacagacugugggccuucccaugugcuguugg

SEQ ID NO: 79068 - RNA, 32 nt, Human
cacagacuuguggagcugggcgucuggaucaa

SEQ ID NO: 79069 - RNA, 32 nt, Human
cacagacuuuacagcacaucagaaauucuacc

SEQ ID NO: 79070 - RNA, 32 nt, Human
cacagacuuucagccuccaugcucugagacaa

SEQ ID NO: 79071 - RNA, 32 nt, Human
cacagacuuuguguccugcacacugagcucca

SEQ ID NO: 79072 - RNA, 32 nt, Human
cacagacuuuuaggcuggcccagauauucccc

SEQ ID NO: 79073 - RNA, 32 nt, Human
cacagagaaaaaucacucccccuucucagagg

SEQ ID NO: 79074 - RNA, 32 nt, Human
cacagagaaaaaucacucgcccuucucagagg

SEQ ID NO: 79075 - RNA, 32 nt, Human
cacagagaaaguuggcuuugaugucucuuaaa

SEQ ID NO: 79076 - RNA, 32 nt, Human
cacagagaaggcuagguaugagagggacagaa

SEQ ID NO: 79077 - RNA, 32 nt, Human
cacagagaaguuuacaugaaguagaagaaauc

SEQ ID NO: 79078 - RNA, 32 nt, Human
cacagagagacacgggcucaaggaacccaaga

SEQ ID NO: 79079 - RNA, 32 nt, Human
cacagagagacgagcccaggaggcugacugag

SEQ ID NO: 79080 - RNA, 32 nt, Human
cacagagagguuaaguaacuuguccaauguug

SEQ ID NO: 79081 - RNA, 32 nt, Human
cacagagauaugcacacacacggaugcacaca

SEQ ID NO: 79082 - RNA, 32 nt, Human
cacagagauaugcacacaccgaugugcgcaca

SEQ ID NO: 79083 - RNA, 32 nt, Human
cacagagauggaaggagauuccuuacccacac

SEQ ID NO: 79084 - RNA, 32 nt, Human
cacagagaugugaacagacaauggaaagcacu

SEQ ID NO: 79085 - RNA, 32 nt, Human
cacagagcacacugcacacaugcacacacaca

SEQ ID NO: 79086 - RNA, 32 nt, Human
cacagagcagaaaggcaccuggaaugcggcug

SEQ ID NO: 79087 - RNA, 32 nt, Human
cacagagcagagaagcagagauguuccuugaa

SEQ ID NO: 79088 - RNA, 32 nt, Human
cacagagcagcaggccccagaggcuucucugc

SEQ ID NO: 79089 - RNA, 22 nt, Human
cacagagcaggcugggcacggu

SEQ ID NO: 79090 - RNA, 32 nt, Human
cacagagcagggguccugaggaaagccuggcu

SEQ ID NO: 79091 - RNA, 21 nt, Human
cacagagcaguagugcgcagg

SEQ ID NO: 79092 - RNA, 32 nt, Human
cacagagcaguggcagggcccagcuagcaggc

SEQ ID NO: 79093 - RNA, 22 nt, Human
cacagagcauggccuccagagg

SEQ ID NO: 79094 - RNA, 26 nt, Human
cacagagccagcuguguaccacagag

SEQ ID NO: 79095 - RNA, 20 nt, Human
cacagagcccgggccgcagg

SEQ ID NO: 79096 - RNA, 32 nt, Human
cacagagcccugaggggcugggcugggcuggg

SEQ ID NO: 79097 - RNA, 24 nt, Human
cacagagcccuguccagcuccuag

SEQ ID NO: 79098 - RNA, 32 nt, Human
cacagagccgcuguuccucuccugccuuuaga

SEQ ID NO: 79099 - RNA, 32 nt, Human
cacagagccuuucaauucagcuuggggugagc

SEQ ID NO: 79100 - RNA, 24 nt, Human
cacagagccuuuuucacaauucca

SEQ ID NO: 79101 - RNA, 20 nt, Human
cacagagcgcacgugcacau

SEQ ID NO: 79102 - RNA, 32 nt, Human
cacagagcuauggagaaggcuggagaugaaag

SEQ ID NO: 79103 - RNA, 32 nt, Human
cacagagcucagcugcucgcaggcugugaaau

SEQ ID NO: 79104 - RNA, 32 nt, Human
cacagagcuccuggcccuggccagaagcagga

SEQ ID NO: 79105 - RNA, 19 nt, Human
cacagagcucuaaugucca

SEQ ID NO: 79106 - RNA, 20 nt, Human
cacagagcucuccagcucca

SEQ ID NO: 79107 - RNA, 20 nt, Human
cacagagcugcagaguccug

SEQ ID NO: 79108 - RNA, 21 nt, Human
cacagagcugccacgccagcc

SEQ ID NO: 79109 - RNA, 32 nt, Human
cacagagcuggacaggcuuugaacuccuggau

SEQ ID NO: 79110 - RNA, 32 nt, Human
cacagagcuggcacuggugcugagccucugcu

SEQ ID NO: 79111 - RNA, 23 nt, Human
cacagagcugguuucagcauggu

SEQ ID NO: 79112 - RNA, 32 nt, Human
cacagagcuguaaaccaggauuugaaugggug

SEQ ID NO: 79113 - RNA, 32 nt, Human
cacagagcugugguccucaggcuccaacaggc

SEQ ID NO: 79114 - RNA, 32 nt, Human
cacagagcuguucugagggugcauggaggagc

SEQ ID NO: 79115 - RNA, 24 nt, Human
cacagagcuucaccaaaucacaga

SEQ ID NO: 79116 - RNA, 32 nt, Human
cacagagcuugauccagaagugcacagguaag

SEQ ID NO: 79117 - RNA, 32 nt, Human
cacagagcuuugaguaacuucuugguugugca

SEQ ID NO: 79118 - RNA, 32 nt, Human
cacagaggaaagagcaucaccgugggagaggc

SEQ ID NO: 79119 - RNA, 24 nt, Human
cacagaggagcugugaacccgcuc

SEQ ID NO: 79120 - RNA, 32 nt, Human
cacagaggccaggccagggcuggaaggacagg

SEQ ID NO: 79121 - RNA, 32 nt, Human
cacagaggccugguuugcucagucuucugaac

SEQ ID NO: 79122 - RNA, 32 nt, Human
cacagaggcuugggggugaaaggguggguggu

SEQ ID NO: 79123 - RNA, 32 nt, Human
cacagagggaaagggagagccaccugguacuu

SEQ ID NO: 79124 - RNA, 32 nt, Human
cacagagggcagcagggacaggacuggaaggg

SEQ ID NO: 79125 - RNA, 20 nt, Human
cacagagggcccaggccccu

SEQ ID NO: 79126 - RNA, 32 nt, Human
cacagagggcuccuggcgcugacagaugggac

SEQ ID NO: 79127 - RNA, 32 nt, Human
cacagagggggagggggagggggaguggcagu

SEQ ID NO: 79128 - RNA, 32 nt, Human
cacagagguaguauaugaugaagagaagauua

SEQ ID NO: 79129 - RNA, 22 nt, Human
cacagagguccagaccuuggca

SEQ ID NO: 79130 - RNA, 32 nt, Human
cacagaggucggcaggcagcacacagagggac

SEQ ID NO: 79131 - RNA, 32 nt, Human
cacagagguggaagauugaucuugccaagagu

SEQ ID NO: 79132 - RNA, 32 nt, Human
cacagaggugucuugccuccugacuagaccag

SEQ ID NO: 79133 - RNA, 22 nt, Human
cacagaguagauuuuggucccg

SEQ ID NO: 79134 - RNA, 32 nt, Human
cacagagucagcugaugaguucuguaccaaac

SEQ ID NO: 79135 - RNA, 32 nt, Human
cacagagucuacugaggcaaggagagggugau

SEQ ID NO: 79136 - RNA, 32 nt, Human
cacagagucugucacagacagggacggagcug

SEQ ID NO: 79137 - RNA, 32 nt, Human
cacagagucuugaagccagagcagcgccagga

SEQ ID NO: 79138 - RNA, 32 nt, Human
cacagaguguggaggcagggaggucgagucag

SEQ ID NO: 79139 - RNA, 32 nt, Human
cacagaguuaaaaccugucacucaaaggcccc

SEQ ID NO: 79140 - RNA, 21 nt, Human
cacagaguugcuaccagggag

SEQ ID NO: 79141 - RNA, 22 nt, Human
cacagaguuguccaguccccag

SEQ ID NO: 79142 - RNA, 32 nt, Human
cacagauaccugcuguucucagcuccagcuuc

SEQ ID NO: 79143 - RNA, 32 nt, Human
cacagauacuaacaacuuaaacuuacuacuuu

SEQ ID NO: 79144 - RNA, 19 nt, Human
cacagauacuacaauucca

SEQ ID NO: 79145 - RNA, 32 nt, Human
cacagauauaugcacacgugugcugcugaggu

SEQ ID NO: 79146 - RNA, 32 nt, Human
cacagauaugagggguuguuuggauuaggggu

SEQ ID NO: 79147 - RNA, 32 nt, Human
cacagauauuuuaggcccccaagagguagucu

SEQ ID NO: 79148 - RNA, 32 nt, Human
cacagaucaaggugaugccuaccucuuuggag

SEQ ID NO: 79149 - RNA, 32 nt, Human
cacagaucacaccuccauccccaaagagguag

SEQ ID NO: 79150 - RNA, 32 nt, Human
cacagaucagaagaaagaaagacaacuuuccu

SEQ ID NO: 79151 - RNA, 32 nt, Human
cacagauccagcuaggccugaccugugccuca

SEQ ID NO: 79152 - RNA, 24 nt, Human
cacagauccccauggucuucagca

SEQ ID NO: 79153 - RNA, 21 nt, Human
cacagauccccgccuguggca

SEQ ID NO: 79154 - RNA, 32 nt, Human
cacagauccuccucaacaugagggugucaggg

SEQ ID NO: 79155 - RNA, 32 nt, Human
cacagauccuugucuucagcaccuuccaagga

SEQ ID NO: 79156 - RNA, 32 nt, Human
cacagaucgguguuugaaaauuugccauuuca

SEQ ID NO: 79157 - RNA, 32 nt, Human
cacagaugaaacugagcugggacuggaaagga

SEQ ID NO: 79158 - RNA, 21 nt, Human
cacagaugaacuaagaaaguc

SEQ ID NO: 79159 - RNA, 32 nt, Human
cacagaugagcagaguggaugguucggugggu

SEQ ID NO: 79160 - RNA, 32 nt, Human
cacagaugagcagaguggggugauguugguug

SEQ ID NO: 79161 - RNA, 21 nt, Human
cacagaugagccagaagaggg

SEQ ID NO: 79162 - RNA, 22 nt, Human
cacagaugcagaaacugaggua

SEQ ID NO: 79163 - RNA, 32 nt, Human
cacagaugcagccacaguaaggcuccaucagg

SEQ ID NO: 79164 - RNA, 32 nt, Human
cacagaugcccaggcaccuccagaucauucac

SEQ ID NO: 79165 - RNA, 32 nt, Human
cacagaugccucucacaacauggcaguuucuu

SEQ ID NO: 79166 - RNA, 31 nt, Human
cacagaugcuggagcagguguaggaggaagc

SEQ ID NO: 79167 - RNA, 32 nt, Human
cacagaugggagaaggccaugccagccacguc

SEQ ID NO: 79168 - RNA, 31 nt, Human
cacagaugggcagucucagccauacucuguu

SEQ ID NO: 79169 - RNA, 32 nt, Human
cacagaugucgagacaucucccauggauuugu

SEQ ID NO: 79170 - RNA, 32 nt, Human
cacagauguggacacauauccggaaacugcag

SEQ ID NO: 79171 - RNA, 32 nt, Human
cacagauguggacacuggcucagagaaguggu

SEQ ID NO: 79172 - RNA, 32 nt, Human
cacagaugugucugggagagccuggcaaggca

SEQ ID NO: 79173 - RNA, 32 nt, Human
cacagauuagagacucucccccuugucaguca

SEQ ID NO: 79174 - RNA, 32 nt, Human
cacagauucagcucuucucuccuuacauuuua

SEQ ID NO: 79175 - RNA, 32 nt, Human
cacagauugaugcugaaauggacucuacuccu

SEQ ID NO: 79176 - RNA, 32 nt, Human
cacagauuucauuugagagaacucagcccccu

SEQ ID NO: 79177 - RNA, 32 nt, Human
cacagauuugcuggauggaagcugcgugugug

SEQ ID NO: 79178 - RNA, 19 nt, Human
cacagauuuggacaggaag

SEQ ID NO: 79179 - RNA, 32 nt, Human
cacagcaaaccuguaacauauucacuguaaau

SEQ ID NO: 79180 - RNA, 31 nt, Human
cacagcaacaacagcaagaccaugggggagu

SEQ ID NO: 79181 - RNA, 31 nt, Human
cacagcaacugucaccucacagcaggagaca

SEQ ID NO: 79182 - RNA, 32 nt, Human
cacagcaagaccugggacauggcagugacugu

SEQ ID NO: 79183 - RNA, 21 nt, Human
cacagcaagaugcccagggag

SEQ ID NO: 79184 - RNA, 18 nt, Human
cacagcaagggugggaga

SEQ ID NO: 79185 - RNA, 32 nt, Human
cacagcaagggugggagacagcugggcacaaa

SEQ ID NO: 79186 - RNA, 32 nt, Human
cacagcaaucaggacucacagcucuucaagga

SEQ ID NO: 79187 - RNA, 32 nt, Human
cacagcacacggucaacuccgcgggacacgag

SEQ ID NO: 79188 - RNA, 32 nt, Human
cacagcacagaugccaucauuucccuuucccc

SEQ ID NO: 79189 - RNA, 32 nt, Human
cacagcacagguugaagagaccagcucucccc

SEQ ID NO: 79190 - RNA, 32 nt, Human
cacagcaccaacagaaggaagagggugaggaa

SEQ ID NO: 79191 - RNA, 32 nt, Human
cacagcacccaccaccugccgccuucagacuc

SEQ ID NO: 79192 - RNA, 32 nt, Human
cacagcaccccuuuccuuccucuccucccacc

SEQ ID NO: 79193 - RNA, 31 nt, Human
cacagcacccuuucaagccaugcagacagua

SEQ ID NO: 79194 - RNA, 32 nt, Human
cacagcacgcggccuccugauccggaagcacg

SEQ ID NO: 79195 - RNA, 32 nt, Human
cacagcacuaacuggccuucuuuccagauugg

SEQ ID NO: 79196 - RNA, 21 nt, Human
cacagcacuccagccugggca

SEQ ID NO: 79197 - RNA, 32 nt, Human
cacagcacuccccucagacacccucagagagu

SEQ ID NO: 79198 - RNA, 32 nt, Human
cacagcacugaucacacugagauggaagacuc

SEQ ID NO: 79199 - RNA, 32 nt, Human
cacagcacugcacugcagccugggugacaaag

SEQ ID NO: 79200 - RNA, 32 nt, Human
cacagcacugcacugcugccugggcgacagcg

SEQ ID NO: 79201 - RNA, 32 nt, Human
cacagcacugccugcuuuuuguuuuuguugcu

SEQ ID NO: 79202 - RNA, 32 nt, Human
cacagcacuggugcucaccucuaccuccuguc

SEQ ID NO: 79203 - RNA, 32 nt, Human
cacagcagaagcugaagaggagauccaggcac

SEQ ID NO: 79204 - RNA, 32 nt, Human
cacagcagaauggcuccugucacugcauucca

SEQ ID NO: 79205 - RNA, 22 nt, Human
cacagcagaauuuauauaggaa

SEQ ID NO: 79206 - RNA, 22 nt, Human
cacagcagaauuuauauaggga

SEQ ID NO: 79207 - RNA, 32 nt, Human
cacagcagacagcagcaugacaaggaugcaau

SEQ ID NO: 79208 - RNA, 32 nt, Human
cacagcagaccagccccacugucagcagcacc

SEQ ID NO: 79209 - RNA, 32 nt, Human
cacagcagagaggggcgcaggagcugccgcgg

SEQ ID NO: 79210 - RNA, 21 nt, Human
cacagcagagcaggcuggaga

SEQ ID NO: 79211 - RNA, 26 nt, Human
cacagcagagcuggacgcuguggaaa

SEQ ID NO: 79212 - RNA, 25 nt, Human
cacagcagaggaaaggacagggaaa

SEQ ID NO: 79213 - RNA, 23 nt, Human
cacagcagaggggacgcgggggg

SEQ ID NO: 79214 - RNA, 27 nt, Human
cacagcagaggucaaaggcaguggaga

SEQ ID NO: 79215 - RNA, 22 nt, Human
cacagcagaguucaacuggaga

SEQ ID NO: 79216 - RNA, 32 nt, Human
cacagcagcacgggccccacugugcugcucuu

SEQ ID NO: 79217 - RNA, 32 nt, Human
cacagcagcagaugucccucacacacaugccc

SEQ ID NO: 79218 - RNA, 23 nt, Human
cacagcagcagguaugugugaaa

SEQ ID NO: 79219 - RNA, 32 nt, Human
cacagcagcccacaguccacagucuuuuuggg

SEQ ID NO: 79220 - RNA, 32 nt, Human
cacagcagcccugccugugaagcucuuguuuc

SEQ ID NO: 79221 - RNA, 32 nt, Human
cacagcagccucuguccagccugcagguggcc

SEQ ID NO: 79222 - RNA, 32 nt, Human
cacagcagccugggugacagagcgagacucuu

SEQ ID NO: 79223 - RNA, 32 nt, Human
cacagcagcggauagagcaggagagcaccacc

SEQ ID NO: 79224 - RNA, 32 nt, Human
cacagcagcguccggcgagaugaaggcgcucg

SEQ ID NO: 79225 - RNA, 32 nt, Human
cacagcagcucacagcuguaaucccagcacuu

SEQ ID NO: 79226 - RNA, 32 nt, Human
cacagcagcucaugccuguaauccuagcacuu

SEQ ID NO: 79227 - RNA, 32 nt, Human
cacagcagcuguuccuggcugugcccaccacc

SEQ ID NO: 79228 - RNA, 32 nt, Human
cacagcagcuuucguuccuccuucccuuuccc

SEQ ID NO: 79229 - RNA, 32 nt, Human
cacagcaggagaacgagaaggcugccugauca

SEQ ID NO: 79230 - RNA, 24 nt, Human
cacagcaggagacucgcaugggag

SEQ ID NO: 79231 - RNA, 32 nt, Human
cacagcaggcagcugcaggagcagugggagga

SEQ ID NO: 79232 - RNA, 32 nt, Human
cacagcaggccugucaguucucucuuaccuuc

SEQ ID NO: 79233 - RNA, 32 nt, Human
cacagcaggcuggaguugguguuagauugcuu

SEQ ID NO: 79234 - RNA, 24 nt, Human
cacagcagggcguuuacauagaaa

SEQ ID NO: 79235 - RNA, 32 nt, Human
cacagcaggggaggcguggguccuccaaugac

SEQ ID NO: 79236 - RNA, 32 nt, Human
cacagcaggugcuuaauaaacagaucuugugg

SEQ ID NO: 79237 - RNA, 32 nt, Human
cacagcagucggucccugucauuguccaccca

SEQ ID NO: 79238 - RNA, 32 nt, Human
cacagcagugaacaaacccccacuccguugua

SEQ ID NO: 79239 - RNA, 32 nt, Human
cacagcauaaaagauaccaaaauaucauaugg

SEQ ID NO: 79240 - RNA, 32 nt, Human
cacagcauaaacugaggguguggggucuggcu

SEQ ID NO: 79241 - RNA, 32 nt, Human
cacagcauagucugggacuggaaaagagaugu

SEQ ID NO: 79242 - RNA, 32 nt, Human
cacagcauaucaauaaacacacagggcuaggg

SEQ ID NO: 79243 - RNA, 32 nt, Human
cacagcauauuuagagaaaagacuuggagcuu

SEQ ID NO: 79244 - RNA, 32 nt, Human
cacagcaucacugaaucacagagccuuugcgu

SEQ ID NO: 79245 - RNA, 32 nt, Human
cacagcaucacuucuaccacuuucuguugguc

SEQ ID NO: 79246 - RNA, 32 nt, Human
cacagcaucagagaguucauucauggaguccc

SEQ ID NO: 79247 - RNA, 20 nt, Human
cacagcaucggaaaauucau

SEQ ID NO: 79248 - RNA, 32 nt, Human
cacagcaucugccccugcuauauguggggaaa

SEQ ID NO: 79249 - RNA, 31 nt, Human
cacagcauggagagaggagaccaaccuaaga

SEQ ID NO: 79250 - RNA, 32 nt, Human
cacagcauggcccuuggcucuuccugcacugc

SEQ ID NO: 79251 - RNA, 22 nt, Human
cacagcauggcucugccucaca

SEQ ID NO: 79252 - RNA, 32 nt, Human
cacagcaugggcagugccuucccugccugugg

SEQ ID NO: 79253 - RNA, 23 nt, Human
cacagcauggucugacgcucaca

SEQ ID NO: 79254 - RNA, 23 nt, Human
cacagcaugugggaaugcccuca

SEQ ID NO: 79255 - RNA, 32 nt, Human
cacagcauuaaccuuccagucugggucccacu

SEQ ID NO: 79256 - RNA, 32 nt, Human
cacagcauuuuaucaauaaauauugcuuuauu

SEQ ID NO: 79257 - RNA, 32 nt, Human
cacagcauuuucaaagcuugugagugaagcug

SEQ ID NO: 79258 - RNA, 32 nt, Human
cacagcauuuugaaagcgaagcagaagccgua

SEQ ID NO: 79259 - RNA, 32 nt, Human
cacagccaacagccaccagcagccaggagaca

SEQ ID NO: 79260 - RNA, 32 nt, Human
cacagccaacccugcugcucucugccuccuuu

SEQ ID NO: 79261 - RNA, 32 nt, Human
cacagccaagaggugggguuccaugaccugcc

SEQ ID NO: 79262 - RNA, 32 nt, Human
cacagccaaucacugagagguccacuaucugg

SEQ ID NO: 79263 - RNA, 32 nt, Human
cacagccacaaaccagucaccaaauucccagc

SEQ ID NO: 79264 - RNA, 32 nt, Human
cacagccacagaacuaaucauauuuuauaucu

SEQ ID NO: 79265 - RNA, 32 nt, Human
cacagccacccaggcagggagcaaguggccug

SEQ ID NO: 79266 - RNA, 32 nt, Human
cacagccacuccaaguccugcccugccacccu

SEQ ID NO: 79267 - RNA, 32 nt, Human
cacagccacucccaagcccacacccacagggg

SEQ ID NO: 79268 - RNA, 32 nt, Human
cacagccacugcacuugcccuugccacacuug

SEQ ID NO: 79269 - RNA, 32 nt, Human
cacagccacuggcugguccuauucauuuccau

SEQ ID NO: 79270 - RNA, 32 nt, Human
cacagccagaacugccuuuggcccuacggaug

SEQ ID NO: 79271 - RNA, 32 nt, Human
cacagccagacgcauccugccacccacacagc

SEQ ID NO: 79272 - RNA, 32 nt, Human
cacagccagagcagaguggaaggguuggggga

SEQ ID NO: 79273 - RNA, 32 nt, Human
cacagccagcagaaacagaguggugauaaugg

SEQ ID NO: 79274 - RNA, 32 nt, Human
cacagccagcaugaacugggcauuucugcagg

SEQ ID NO: 79275 - RNA, 32 nt, Human
cacagccagcccagagagaaacuaucuucucc

SEQ ID NO: 79276 - RNA, 32 nt, Human
cacagccagccugucguguccagccugacgcc

SEQ ID NO: 79277 - RNA, 20 nt, Human
cacagccaggagcaggugca

SEQ ID NO: 79278 - RNA, 32 nt, Human
cacagccaggaugucagcagggccugagccag

SEQ ID NO: 79279 - RNA, 32 nt, Human
cacagccaggcaggagaaguugcgguggccau

SEQ ID NO: 79280 - RNA, 32 nt, Human
cacagccaggguggggaggggagcagcagagg

SEQ ID NO: 79281 - RNA, 32 nt, Human
cacagccagucaagaucucugagcaacuuaga

SEQ ID NO: 79282 - RNA, 32 nt, Human
cacagccagucaccacccuccuggaccauacu

SEQ ID NO: 79283 - RNA, 32 nt, Human
cacagccagugggaacugccagaggaagaucu

SEQ ID NO: 79284 - RNA, 21 nt, Human
cacagccauacagcuguccac

SEQ ID NO: 79285 - RNA, 32 nt, Human
cacagccauacagcuguccacacugaagaaca

SEQ ID NO: 79286 - RNA, 32 nt, Human
cacagccaugaagagaccagugggguggugca

SEQ ID NO: 79287 - RNA, 32 nt, Human
cacagccaugagcggccucuaagagcugagag

SEQ ID NO: 79288 - RNA, 31 nt, Human
cacagccaugccugccccaugccuagcguug

SEQ ID NO: 79289 - RNA, 32 nt, Human
cacagccaugccugccccaugccuagcguugg

SEQ ID NO: 79290 - RNA, 32 nt, Human
cacagcccaaagauuagcuucauguccauuau

SEQ ID NO: 79291 - RNA, 32 nt, Human
cacagcccagcaaagagcagcacacagcugaa

SEQ ID NO: 79292 - RNA, 32 nt, Human
cacagcccagcacuccucugggcugcucucaa

SEQ ID NO: 79293 - RNA, 32 nt, Human
cacagcccagguuccaggugcgugaccugccc

SEQ ID NO: 79294 - RNA, 32 nt, Human
cacagcccauuuugccaagaugucuagaguag

SEQ ID NO: 79295 - RNA, 32 nt, Human
cacagccccaggacagcggggucugagugguu

SEQ ID NO: 79296 - RNA, 32 nt, Human
cacagccccaggagaggaauuuggggccuagg

SEQ ID NO: 79297 - RNA, 32 nt, Human
cacagccccaguuucuggaggcagauggguaa

SEQ ID NO: 79298 - RNA, 32 nt, Human
cacagcccccgggcucuacccugggcacagca

SEQ ID NO: 79299 - RNA, 32 nt, Human
cacagccccucagcaccaagcagaagguggcc

SEQ ID NO: 79300 - RNA, 32 nt, Human
cacagccccugccccugcugcggcgcggcgag

SEQ ID NO: 79301 - RNA, 32 nt, Human
cacagccccugccccugggauccagcacucaa

SEQ ID NO: 79302 - RNA, 32 nt, Human
cacagccccugccuuggcggccacuacacugu

SEQ ID NO: 79303 - RNA, 19 nt, Human
cacagccccugcugggccc

SEQ ID NO: 79304 - RNA, 32 nt, Human
cacagccccuggcaacuguuggucucauccug

SEQ ID NO: 79305 - RNA, 32 nt, Human
cacagccccuggcuuugugcccacuuaggcag

SEQ ID NO: 79306 - RNA, 21 nt, Human
cacagccccuggucagucugc

SEQ ID NO: 79307 - RNA, 32 nt, Human
cacagccccuugccccuccucuaagggguuuu

SEQ ID NO: 79308 - RNA, 32 nt, Human
cacagcccgagggucucacugugucauccaga

SEQ ID NO: 79309 - RNA, 32 nt, Human
cacagcccuaaauccaugauaaagcuacucuu

SEQ ID NO: 79310 - RNA, 32 nt, Human
cacagcccuaaguagcaggcagugccacugug

SEQ ID NO: 79311 - RNA, 32 nt, Human
cacagcccuauaucagugcucuggacccacau

SEQ ID NO: 79312 - RNA, 32 nt, Human
cacagcccucacugcucucuaucuccaggugg

SEQ ID NO: 79313 - RNA, 32 nt, Human
cacagcccucaguccccaccccaggagaggcg

SEQ ID NO: 79314 - RNA, 32 nt, Human
cacagcccuccagcuggggucagguggcagcc

SEQ ID NO: 79315 - RNA, 32 nt, Human
cacagcccuccaggagauaucaaaggagguca

SEQ ID NO: 79316 - RNA, 32 nt, Human
cacagcccuccaggcccgccucaggaaggaau

SEQ ID NO: 79317 - RNA, 32 nt, Human
cacagcccuccaguguacugaggguacuggcc

SEQ ID NO: 79318 - RNA, 32 nt, Human
cacagcccuccugcugccaggaccugcuugaa

SEQ ID NO: 79319 - RNA, 32 nt, Human
cacagcccucgcccuccgccccggcuuuucuc

SEQ ID NO: 79320 - RNA, 32 nt, Human
cacagcccugacuugaacucugggugacccug

SEQ ID NO: 79321 - RNA, 32 nt, Human
cacagcccugagugacagagaggaaggaggag

SEQ ID NO: 79322 - RNA, 32 nt, Human
cacagcccugcagugcccuagacuggcugaaa

SEQ ID NO: 79323 - RNA, 32 nt, Human
cacagcccugcccuugucucugaggcugaaga

SEQ ID NO: 79324 - RNA, 32 nt, Human
cacagcccuggccucugcucaacuagcagaua

SEQ ID NO: 79325 - RNA, 32 nt, Human
cacagccgagagaccugaucucuggauucagu

SEQ ID NO: 79326 - RNA, 32 nt, Human
cacagccgcagcuguaaggcacgcuggaaggc

SEQ ID NO: 79327 - RNA, 32 nt, Human
cacagccgccaggagaaaaacuuaggccuccc

SEQ ID NO: 79328 - RNA, 30 nt, Human
cacagccgccucuccaggcuuccuugcaca

SEQ ID NO: 79329 - RNA, 32 nt, Human
cacagccggccgacaccacaccagccggggag

SEQ ID NO: 79330 - RNA, 32 nt, Human
cacagccgggaguaccccauggacagcugugg

SEQ ID NO: 79331 - RNA, 32 nt, Human
cacagccggggcugcagaaaaaugguugugug

SEQ ID NO: 79332 - RNA, 32 nt, Human
cacagccuacuuccccuuccccggggcugaga

SEQ ID NO: 79333 - RNA, 32 nt, Human
cacagccucacaccugaacgcuguccucccgc

SEQ ID NO: 79334 - RNA, 32 nt, Human
cacagccucacaggaagugggggugaggagcc

SEQ ID NO: 79335 - RNA, 31 nt, Human
cacagccucaccauacccuguugagguguga

SEQ ID NO: 79336 - RNA, 21 nt, Human
cacagccucagcugccugcau

SEQ ID NO: 79337 - RNA, 32 nt, Human
cacagccucauggguagggucagcaaaccaga

SEQ ID NO: 79338 - RNA, 32 nt, Human
cacagccuccaagucaggugggguggaguccc

SEQ ID NO: 79339 - RNA, 32 nt, Human
cacagccuccaggacguggcacgguuccccuc

SEQ ID NO: 79340 - RNA, 32 nt, Human
cacagccucccaggagggagacgcuggggugc

SEQ ID NO: 79341 - RNA, 22 nt, Human
cacagccucccugagccugcau

SEQ ID NO: 79342 - RNA, 32 nt, Human
cacagccuccuccuugcuguguaguuuugggu

SEQ ID NO: 79343 - RNA, 32 nt, Human
cacagccucgcaaugagcugccacaacugcuc

SEQ ID NO: 79344 - RNA, 32 nt, Human
cacagccucguucaugaaaccccagauacccg

SEQ ID NO: 79345 - RNA, 32 nt, Human
cacagccucuacuguacuuuagaaccugagau

SEQ ID NO: 79346 - RNA, 32 nt, Human
cacagccucugaccccuccucacuggccaucc

SEQ ID NO: 79347 - RNA, 23 nt, Human
cacagccucugccgagccugcau

SEQ ID NO: 79348 - RNA, 32 nt, Human
cacagccucugccucccguugcucugugaccu

SEQ ID NO: 79349 - RNA, 32 nt, Human
cacagccucugcugggacagggaauagaggga

SEQ ID NO: 79350 - RNA, 32 nt, Human
cacagccugagacucaucucgcuucgaccccg

SEQ ID NO: 79351 - RNA, 21 nt, Human
cacagccugagccuggcccag

SEQ ID NO: 79352 - RNA, 32 nt, Human
cacagccugaggggaauguggaagggauguuu

SEQ ID NO: 79353 - RNA, 32 nt, Human
cacagccugcauaggugacaaggggccgcugc

SEQ ID NO: 79354 - RNA, 32 nt, Human
cacagccugcucccagugcugugucaugaccu

SEQ ID NO: 79355 - RNA, 32 nt, Human
cacagccugcuucuccccugggcugcuguggg

SEQ ID NO: 79356 - RNA, 32 nt, Human
cacagccuggacuauucccaggcacagcugug

SEQ ID NO: 79357 - RNA, 32 nt, Human
cacagccuggauuuuuauuucugccaugaaac

SEQ ID NO: 79358 - RNA, 32 nt, Human
cacagccuggcgccagggcucacagcugcccc

SEQ ID NO: 79359 - RNA, 19 nt, Human
cacagccugggacaggaag

SEQ ID NO: 79360 - RNA, 32 nt, Human
cacagccugggaccugcaucugugcuggggcc

SEQ ID NO: 79361 - RNA, 28 nt, Human
cacagccugggaggcgccucauccagaa

SEQ ID NO: 79362 - RNA, 32 nt, Human
cacagccuguggcugggaagggagacagaggc

SEQ ID NO: 79363 - RNA, 21 nt, Human
cacagccuuaaaagcccgcuc

SEQ ID NO: 79364 - RNA, 19 nt, Human
cacagccuuaaacucaaug

SEQ ID NO: 79365 - RNA, 24 nt, Human
cacagccuuaaucucucuuuacau

SEQ ID NO: 79366 - RNA, 32 nt, Human
cacagccuuccuccccagaggacccggccgac

SEQ ID NO: 79367 - RNA, 32 nt, Human
cacagccuuccuuggggacucugaaggugucc

SEQ ID NO: 79368 - RNA, 32 nt, Human
cacagccuucuggcugggacugacuuggccau

SEQ ID NO: 79369 - RNA, 21 nt, Human
cacagccuuggucacagcgug

SEQ ID NO: 79370 - RNA, 32 nt, Human
cacagcgacuugcguugacaaaggaggaggaa

SEQ ID NO: 79371 - RNA, 18 nt, Human
cacagcgacuuucccagc

SEQ ID NO: 79372 - RNA, 32 nt, Human
cacagcgaggagcagacccaggcagggccgcc

SEQ ID NO: 79373 - RNA, 32 nt, Human
cacagcgaugggcugaaggcugugcaucccgc

SEQ ID NO: 79374 - RNA, 32 nt, Human
cacagcgauguccucagauguccuggacagcc

SEQ ID NO: 79375 - RNA, 32 nt, Human
cacagcgccagccucagacuggagggcaaggg

SEQ ID NO: 79376 - RNA, 19 nt, Human
cacagcgccuggcccagug

SEQ ID NO: 79377 - RNA, 32 nt, Human
cacagcgcgggggaacgggaggcugcaggaug

SEQ ID NO: 79378 - RNA, 32 nt, Human
cacagcggaaaguagagagggggcuccuugga

SEQ ID NO: 79379 - RNA, 25 nt, Human
cacagcggcggggaagucacagcug

SEQ ID NO: 79380 - RNA, 32 nt, Human
cacagcggcucacgucuguaaucccagcacuu

SEQ ID NO: 79381 - RNA, 19 nt, Human
cacagcgggcuccacagcg

SEQ ID NO: 79382 - RNA, 32 nt, Human
cacagcguaaacaaagccauggggaaguucca

SEQ ID NO: 79383 - RNA, 32 nt, Human
cacagcguccacccuguccacccagcccugcc

SEQ ID NO: 79384 - RNA, 32 nt, Human
cacagcguccuccuccucccuggagaagaucu

SEQ ID NO: 79385 - RNA, 32 nt, Human
cacagcgucuucagaacuuucagagaaaccag

SEQ ID NO: 79386 - RNA, 32 nt, Human
cacagcguggcauccagcagagaguuagaaau

SEQ ID NO: 79387 - RNA, 32 nt, Human
cacagcguuaugugucugccacauuaacuaca

SEQ ID NO: 79388 - RNA, 17 nt, Human
cacagcuaacacaaggc

SEQ ID NO: 79389 - RNA, 32 nt, Human
cacagcuaaggggagucaucacagggcuucag

SEQ ID NO: 79390 - RNA, 32 nt, Human
cacagcuacagcugcagggacugcuggcgucc

SEQ ID NO: 79391 - RNA, 32 nt, Human
cacagcuacaggcuuucuacuuaacuucuggg

SEQ ID NO: 79392 - RNA, 23 nt, Human
cacagcuaccugaggcugcucug

SEQ ID NO: 79393 - RNA, 32 nt, Human
cacagcuacucagggagguugaggcagcagga

SEQ ID NO: 79394 - RNA, 23 nt, Human
cacagcuacuugguuuguguucu

SEQ ID NO: 79395 - RNA, 32 nt, Human
cacagcucacugcaaccucaaacuccugggcu

SEQ ID NO: 79396 - RNA, 32 nt, Human
cacagcucacugcaaccucaauccugggcuca

SEQ ID NO: 79397 - RNA, 32 nt, Human
cacagcucacugcaaccucuacucccaggcuc

SEQ ID NO: 79398 - RNA, 32 nt, Human
cacagcucacugcaaccuuacuccuaggcuca

SEQ ID NO: 79399 - RNA, 32 nt, Human
cacagcucacugcagcccugaacuccugggcu

SEQ ID NO: 79400 - RNA, 32 nt, Human
cacagcucacugcagccucaaacuccugggcu

SEQ ID NO: 79401 - RNA, 32 nt, Human
cacagcucacugcagccuccaccuccugggcu

SEQ ID NO: 79402 - RNA, 32 nt, Human
cacagcucacugcagccuccaucuccuaggcu

SEQ ID NO: 79403 - RNA, 32 nt, Human
cacagcucacugcagccucgaccucccgggcu

SEQ ID NO: 79404 - RNA, 32 nt, Human
cacagcucacugcagccucgaccuccugcgcu

SEQ ID NO: 79405 - RNA, 32 nt, Human
cacagcucacugcagccucgaccuccuggacu

SEQ ID NO: 79406 - RNA, 32 nt, Human
cacagcucacugcagccucgaccuccugggcu

SEQ ID NO: 79407 - RNA, 32 nt, Human
cacagcucacugcagccuggaccuccuggccu

SEQ ID NO: 79408 - RNA, 32 nt, Human
cacagcucacugcagccuugaccuccuggguu

SEQ ID NO: 79409 - RNA, 32 nt, Human
cacagcucacugcagccuugagcuccugggcu

SEQ ID NO: 79410 - RNA, 32 nt, Human
cacagcucacugcagguucagccuucugaguu

SEQ ID NO: 79411 - RNA, 32 nt, Human
cacagcucacugcagucucgaacuccuggacu

SEQ ID NO: 79412 - RNA, 32 nt, Human
cacagcucagccacugacuuggguaucaguuu

SEQ ID NO: 79413 - RNA, 32 nt, Human
cacagcucagcccacagccuggacaugccagc

SEQ ID NO: 79414 - RNA, 32 nt, Human
cacagcucagcccagcccuggcacagagaaga

SEQ ID NO: 79415 - RNA, 32 nt, Human
cacagcucagccgccuccucugccaccagcug

SEQ ID NO: 79416 - RNA, 32 nt, Human
cacagcucauggagggugagaucauguuaggg

SEQ ID NO: 79417 - RNA, 32 nt, Human
cacagcucauugggggaaaaucagaggcuuca

SEQ ID NO: 79418 - RNA, 32 nt, Human
cacagcuccaagcacgugucccgugccucccc

SEQ ID NO: 79419 - RNA, 32 nt, Human
cacagcuccacucaccuaagggcagucuucua

SEQ ID NO: 79420 - RNA, 32 nt, Human
cacagcuccagccuuaguuuuuggagucaagu

SEQ ID NO: 79421 - RNA, 32 nt, Human
cacagcucccuacuggggcugcagccuuuaga

SEQ ID NO: 79422 - RNA, 18 nt, Human
cacagcuccuccaugccu

SEQ ID NO: 79423 - RNA, 32 nt, Human
cacagcuccucccgugcauccacucggccugg

SEQ ID NO: 79424 - RNA, 32 nt, Human
cacagcuccuugcuuugauuucauccuugaua

SEQ ID NO: 79425 - RNA, 32 nt, Human
cacagcucugauucuacagaaggaggccggac

SEQ ID NO: 79426 - RNA, 32 nt, Human
cacagcucugcagccugggcucugcccugccu

SEQ ID NO: 79427 - RNA, 32 nt, Human
cacagcucugcagccuguuuccuacaaccaga

SEQ ID NO: 79428 - RNA, 32 nt, Human
cacagcucuguggccuucauguuccgaaaguu

SEQ ID NO: 79429 - RNA, 32 nt, Human
cacagcugaacacucagcagugugugaguggc

SEQ ID NO: 79430 - RNA, 32 nt, Human
cacagcugacugcagccucaaccuuccaggcu

SEQ ID NO: 79431 - RNA, 32 nt, Human
cacagcugagugccccagggagggcaggcugg

SEQ ID NO: 79432 - RNA, 32 nt, Human
cacagcugaugaaugcuuuucucuccuuaugu

SEQ ID NO: 79433 - RNA, 32 nt, Human
cacagcugcacuccagccugugcugagaccuc

SEQ ID NO: 79434 - RNA, 32 nt, Human
cacagcugcagccgcaggcccugcacuacgcg

SEQ ID NO: 79435 - RNA, 32 nt, Human
cacagcugcaggaagaagucaggguggaaucc

SEQ ID NO: 79436 - RNA, 20 nt, Human
cacagcugccccccuccccu

SEQ ID NO: 79437 - RNA, 32 nt, Human
cacagcugccccucagccgcugagauccagug

SEQ ID NO: 79438 - RNA, 23 nt, Human
cacagcugccgcagcaucucaca

SEQ ID NO: 79439 - RNA, 22 nt, Human
cacagcugccgugaccagggag

SEQ ID NO: 79440 - RNA, 18 nt, Human
cacagcugccugcugucc

SEQ ID NO: 79441 - RNA, 32 nt, Human
cacagcugccuggcuggggaggcugugcuguu

SEQ ID NO: 79442 - RNA, 32 nt, Human
cacagcugcuuugggcaguagcugaagccgaa

SEQ ID NO: 79443 - RNA, 32 nt, Human
cacagcuggaaccuggaguuccacacgccugu

SEQ ID NO: 79444 - RNA, 32 nt, Human
cacagcuggaagcagaggccuucguaggugau

SEQ ID NO: 79445 - RNA, 32 nt, Human
cacagcuggcccugagcccuugguuugucaau

SEQ ID NO: 79446 - RNA, 32 nt, Human
cacagcuggcugacacaggacaggggcaacug

SEQ ID NO: 79447 - RNA, 32 nt, Human
cacagcuggcugcagaugugcagugccaggac

SEQ ID NO: 79448 - RNA, 29 nt, Human
cacagcuggcugcugucggacaccuuugg

SEQ ID NO: 79449 - RNA, 32 nt, Human
cacagcugggaacugaggcucacaguugcacu

SEQ ID NO: 79450 - RNA, 32 nt, Human
cacagcugggaggugggcaguggaggauggcu

SEQ ID NO: 79451 - RNA, 32 nt, Human
cacagcugggcccugcuggcauuguuaaugag

SEQ ID NO: 79452 - RNA, 32 nt, Human
cacagcugguaaucuggacuuaaggauugcug

SEQ ID NO: 79453 - RNA, 21 nt, Human
cacagcuguaaucccagcacu

SEQ ID NO: 79454 - RNA, 32 nt, Human
cacagcuguaccacauggcccacgugaaaucu

SEQ ID NO: 79455 - RNA, 32 nt, Human
cacagcugugugacugggucagcaagugcacu

SEQ ID NO: 79456 - RNA, 32 nt, Human
cacagcuuaggacagaacugggcccagggcaa

SEQ ID NO: 79457 - RNA, 32 nt, Human
cacagcuuauuuccucauuuuuauaauguccc

SEQ ID NO: 79458 - RNA, 32 nt, Human
cacagcuucagacugaggaucuagggcuggga

SEQ ID NO: 79459 - RNA, 32 nt, Human
cacagcuuccacccuuucacacaauucauguc

SEQ ID NO: 79460 - RNA, 21 nt, Human
cacagcuucccgagucauuca

SEQ ID NO: 79461 - RNA, 18 nt, Human
cacagcuucccgggucau

SEQ ID NO: 79462 - RNA, 21 nt, Human
cacagcuucccgggucauuca

SEQ ID NO: 79463 - RNA, 23 nt, Human
cacagcuuccuucuuugguuaga

SEQ ID NO: 79464 - RNA, 32 nt, Human
cacagcuuccuuggcucuuuuugcccauaugc

SEQ ID NO: 79465 - RNA, 32 nt, Human
cacagcuucucuggagacccuagaaggcggca

SEQ ID NO: 79466 - RNA, 19 nt, Human
cacagcuugauuucagagc

SEQ ID NO: 79467 - RNA, 32 nt, Human
cacagcuugggacugcugaggggcaggcggcu

SEQ ID NO: 79468 - RNA, 32 nt, Human
cacagcuuggggcugaagacucccaggccauu

SEQ ID NO: 79469 - RNA, 24 nt, Human
cacagcuuuauguacccuguccac

SEQ ID NO: 79470 - RNA, 32 nt, Human
cacagcuuucccuacccugccacucccaugca

SEQ ID NO: 79471 - RNA, 32 nt, Human
cacagcuuugcaugcugagcugugccaggcag

SEQ ID NO: 79472 - RNA, 32 nt, Human
cacagcuuugcuuuucugccucuucucucaag

SEQ ID NO: 79473 - RNA, 32 nt, Human
cacagcuuuuggaugaccucagcuugaguuuc

SEQ ID NO: 79474 - RNA, 32 nt, Human
cacagcuuuugggcuucucuggccugaaugcc

SEQ ID NO: 79475 - RNA, 32 nt, Human
cacaggaaaauggugcaugaauuuguaaacug

SEQ ID NO: 79476 - RNA, 32 nt, Human
cacaggaacccccaggacccagucgcugcugu

SEQ ID NO: 79477 - RNA, 32 nt, Human
cacaggaacccccgccccaacuuuuggauugu

SEQ ID NO: 79478 - RNA, 32 nt, Human
cacaggaacucugagguuuucccacugcugcc

SEQ ID NO: 79479 - RNA, 32 nt, Human
cacaggaagaaagaagaagcgcugcagguugc

SEQ ID NO: 79480 - RNA, 32 nt, Human
cacaggaagacccuuaaaugaagaaccuccua

SEQ ID NO: 79481 - RNA, 32 nt, Human
cacaggaagcagcuagacuaggggaguccuug

SEQ ID NO: 79482 - RNA, 32 nt, Human
cacaggaagcgcagcugaaaacaaauggacgc

SEQ ID NO: 79483 - RNA, 32 nt, Human
cacaggaagcugcaccugacagaagcuccagg

SEQ ID NO: 79484 - RNA, 32 nt, Human
cacaggaaggaggggugaccacugggaagggu

SEQ ID NO: 79485 - RNA, 32 nt, Human
cacaggaagggaaggcagggaggagaggaagc

SEQ ID NO: 79486 - RNA, 32 nt, Human
cacaggaaguggaggagccagaggugccuuug

SEQ ID NO: 79487 - RNA, 32 nt, Human
cacaggaccacucaguggggccugugugggcg

SEQ ID NO: 79488 - RNA, 32 nt, Human
cacaggaccagcugggaggacugguugugcug

SEQ ID NO: 79489 - RNA, 32 nt, Human
cacaggaccgugccucacagggcccacucccu

SEQ ID NO: 79490 - RNA, 32 nt, Human
cacaggaccugggcuucgucuccaggggacaa

SEQ ID NO: 79491 - RNA, 32 nt, Human
cacaggacgaagaaggcuucaaaaagucccaa

SEQ ID NO: 79492 - RNA, 32 nt, Human
cacaggacugacccuucuucagagauaaugac

SEQ ID NO: 79493 - RNA, 32 nt, Human
cacaggacugggcuccuaacucucaggaaaca

SEQ ID NO: 79494 - RNA, 32 nt, Human
cacaggacuguacuugcagccccugccaugag

SEQ ID NO: 79495 - RNA, 32 nt, Human
cacaggagaaaugauugaaggaagugugagug

SEQ ID NO: 79496 - RNA, 32 nt, Human
cacaggagaccacccccgagcuugccucaggg

SEQ ID NO: 79497 - RNA, 32 nt, Human
cacaggagaccagcucagggcggaaggucagg

SEQ ID NO: 79498 - RNA, 32 nt, Human
cacaggagagaugagggugagaauggagugcc

SEQ ID NO: 79499 - RNA, 32 nt, Human
cacaggagagcaagaaaaugugucacaucuau

SEQ ID NO: 79500 - RNA, 32 nt, Human
cacaggagcagaaacauggaacaccagacgcu

SEQ ID NO: 79501 - RNA, 32 nt, Human
cacaggagcagaaacauggaacaccagacucu

SEQ ID NO: 79502 - RNA, 32 nt, Human
cacaggagccacugcacuccagccugggugac

SEQ ID NO: 79503 - RNA, 32 nt, Human
cacaggagcgcacagacucagagccagacagc

SEQ ID NO: 79504 - RNA, 32 nt, Human
cacaggagcugccccggagcugaggggacggu

SEQ ID NO: 79505 - RNA, 32 nt, Human
cacaggaggaggaggaggacaugggguuugau

SEQ ID NO: 79506 - RNA, 32 nt, Human
cacaggaggcagagguugcagugagccgagag

SEQ ID NO: 79507 - RNA, 32 nt, Human
cacaggaggcuaaggugggaggaucccuugag

SEQ ID NO: 79508 - RNA, 32 nt, Human
cacaggagggagagagaggcaguguacuugcc

SEQ ID NO: 79509 - RNA, 32 nt, Human
cacaggagucagaggcuggagugcaauggcgu

SEQ ID NO: 79510 - RNA, 32 nt, Human
cacaggagucuucagacccagagaaggacggu

SEQ ID NO: 79511 - RNA, 32 nt, Human
cacaggaguucaaggcuucagugagcuauggg

SEQ ID NO: 79512 - RNA, 32 nt, Human
cacaggaucagaaggcaagggauaggcagugg

SEQ ID NO: 79513 - RNA, 32 nt, Human
cacaggaucauggagacgaacuaaaccaucau

SEQ ID NO: 79514 - RNA, 32 nt, Human
cacaggaucccaagagggagaucaugagccuu

SEQ ID NO: 79515 - RNA, 32 nt, Human
cacaggauccugacacuggagggcagcugucu

SEQ ID NO: 79516 - RNA, 32 nt, Human
cacaggaucguguguguaggugguguugugug

SEQ ID NO: 79517 - RNA, 32 nt, Human
cacaggaugaggaagauuaaggauaaucaauu

SEQ ID NO: 79518 - RNA, 32 nt, Human
cacaggauggcugcuuggcaguagggagugga

SEQ ID NO: 79519 - RNA, 32 nt, Human
cacaggaugggggcgccaggagaggggccccu

SEQ ID NO: 79520 - RNA, 32 nt, Human
cacaggauguuuauuguaucaaaagccuuauu

SEQ ID NO: 79521 - RNA, 32 nt, Human
cacaggcacaaacucccccacccaggacggcu

SEQ ID NO: 79522 - RNA, 18 nt, Human
cacaggcacacacaugca

SEQ ID NO: 79523 - RNA, 32 nt, Human
cacaggcacacagcagagccguccacagaccc

SEQ ID NO: 79524 - RNA, 20 nt, Human
cacaggcacacaugcaugca

SEQ ID NO: 79525 - RNA, 32 nt, Human
cacaggcacaugcacaggcacggugcugucug

SEQ ID NO: 79526 - RNA, 32 nt, Human
cacaggcacccgggggaagaggccguaggaga

SEQ ID NO: 79527 - RNA, 32 nt, Human
cacaggcaccugccuuccuagauuucccuggc

SEQ ID NO: 79528 - RNA, 32 nt, Human
cacaggcacgugccaccaugccuggcuauuuu

SEQ ID NO: 79529 - RNA, 32 nt, Human
cacaggcacgugccaccauguugcccaggcug

SEQ ID NO: 79530 - RNA, 32 nt, Human
cacaggcacuaacauggcacacacauacacuc

SEQ ID NO: 79531 - RNA, 25 nt, Human
cacaggcagagcgaacacgcacgga

SEQ ID NO: 79532 - RNA, 32 nt, Human
cacaggcagaguggucagggcugaagucggag

SEQ ID NO: 79533 - RNA, 32 nt, Human
cacaggcagcacuucgaggcuucgugacgaag

SEQ ID NO: 79534 - RNA, 32 nt, Human
cacaggcagcaggagagaggagagggcagaac

SEQ ID NO: 79535 - RNA, 32 nt, Human
cacaggcagccuggagaagcugggcaggacaa

SEQ ID NO: 79536 - RNA, 32 nt, Human
cacaggcagcgcuuuguaaacugugaagccau

SEQ ID NO: 79537 - RNA, 32 nt, Human
cacaggcaggcaggcccggugcaagaguggac

SEQ ID NO: 79538 - RNA, 32 nt, Human
cacaggcaucagaucugcucaggaaaaugugc

SEQ ID NO: 79539 - RNA, 32 nt, Human
cacaggcaucugcugcugcuccuggcugccac

SEQ ID NO: 79540 - RNA, 32 nt, Human
cacaggcaugagccaccgaacccagccuuauu

SEQ ID NO: 79541 - RNA, 32 nt, Human
cacaggcaugagccacugugcccagccacgag

SEQ ID NO: 79542 - RNA, 32 nt, Human
cacaggcaugagccacugugcccagccuaguu

SEQ ID NO: 79543 - RNA, 32 nt, Human
cacaggcaugcaccaccaugccuggcuaauuu

SEQ ID NO: 79544 - RNA, 32 nt, Human
cacaggcaugcgccaccaugcccugcuauuuu

SEQ ID NO: 79545 - RNA, 32 nt, Human
cacaggcaugcugcagugaauuuaacugaucc

SEQ ID NO: 79546 - RNA, 32 nt, Human
cacaggcaugugccaccaugccuagcuaauuu

SEQ ID NO: 79547 - RNA, 32 nt, Human
cacaggccaaagcaucagcaccagaacgcaca

SEQ ID NO: 79548 - RNA, 32 nt, Human
cacaggccaagcugcaugcaacaccuaugcuu

SEQ ID NO: 79549 - RNA, 32 nt, Human
cacaggccacaggcccuccaccucaccuccag

SEQ ID NO: 79550 - RNA, 32 nt, Human
cacaggccagaguugggcucuagcuccuggug

SEQ ID NO: 79551 - RNA, 31 nt, Human
cacaggccagcgcucugacaugcagaaggug

SEQ ID NO: 79552 - RNA, 22 nt, Human
cacaggccaggacgccauggca

SEQ ID NO: 79553 - RNA, 32 nt, Human
cacaggccaggcuucggugcuaccucagaggg

SEQ ID NO: 79554 - RNA, 32 nt, Human
cacaggccagugcugaaccguagguggaguag

SEQ ID NO: 79555 - RNA, 32 nt, Human
cacaggccaugcuggggccagaaccccagccc

SEQ ID NO: 79556 - RNA, 20 nt, Human
cacaggccauuccccucucc

SEQ ID NO: 79557 - RNA, 32 nt, Human
cacaggcccacacacccucacugacauacacu

SEQ ID NO: 79558 - RNA, 32 nt, Human
cacaggcccagccucugugcugucuccuccuc

SEQ ID NO: 79559 - RNA, 32 nt, Human
cacaggcccccaggggcauaaugaccagcuag

SEQ ID NO: 79560 - RNA, 32 nt, Human
cacaggcccccgcggcagugcggccgagucga

SEQ ID NO: 79561 - RNA, 32 nt, Human
cacaggcccuccugccugccaagcagcaagug

SEQ ID NO: 79562 - RNA, 21 nt, Human
cacaggcccucugcagaggua

SEQ ID NO: 79563 - RNA, 32 nt, Human
cacaggcccuuagagcaucgccaggugcagag

SEQ ID NO: 79564 - RNA, 32 nt, Human
cacaggccgacucccucucucccucacuuaac

SEQ ID NO: 79565 - RNA, 32 nt, Human
cacaggccucacugcaauuugauaugccugcu

SEQ ID NO: 79566 - RNA, 32 nt, Human
cacaggccuccccuguaacacaacaggacuga

SEQ ID NO: 79567 - RNA, 30 nt, Human
cacaggccucugcuccugcuccugccugca

SEQ ID NO: 79568 - RNA, 32 nt, Human
cacaggccugagccacugugcccagccuuguu

SEQ ID NO: 79569 - RNA, 19 nt, Human
cacaggccugcagcccaug

SEQ ID NO: 79570 - RNA, 32 nt, Human
cacaggccuggcaccucccugccuuguguccu

SEQ ID NO: 79571 - RNA, 32 nt, Human
cacaggccuggccugggggcugugggacuggc

SEQ ID NO: 79572 - RNA, 19 nt, Human
cacaggccugggaacugag

SEQ ID NO: 79573 - RNA, 32 nt, Human
cacaggccuggguggguggguugggggaagug

SEQ ID NO: 79574 - RNA, 23 nt, Human
cacaggccugugaacaagccagg

SEQ ID NO: 79575 - RNA, 20 nt, Human
cacaggccuguggcaaaagg

SEQ ID NO: 79576 - RNA, 22 nt, Human
cacaggccuuguugggcugagg

SEQ ID NO: 79577 - RNA, 32 nt, Human
cacaggcgaggccuggccaaggugugggcgca

SEQ ID NO: 79578 - RNA, 19 nt, Human
cacaggcgccagggcaggg

SEQ ID NO: 79579 - RNA, 23 nt, Human
cacaggcgccccuccugaugcug

SEQ ID NO: 79580 - RNA, 32 nt, Human
cacaggcgggaguucaaaacgaaacugggcuc

SEQ ID NO: 79581 - RNA, 32 nt, Human
cacaggcggggacuaagcuggggacagggcag

SEQ ID NO: 79582 - RNA, 32 nt, Human
cacaggcgggggagagacgaaaaagaaaagga

SEQ ID NO: 79583 - RNA, 32 nt, Human
cacaggcgugagccaaugcgacccgccuggaa

SEQ ID NO: 79584 - RNA, 32 nt, Human
cacaggcgugagccaccacauccagccuaauu

SEQ ID NO: 79585 - RNA, 32 nt, Human
cacaggcgugagccaccacugcuggccaguuu

SEQ ID NO: 79586 - RNA, 32 nt, Human
cacaggcgugagccaccgcacccagccuuuua

SEQ ID NO: 79587 - RNA, 32 nt, Human
cacaggcgugagccaccgcauccggccucaug

SEQ ID NO: 79588 - RNA, 32 nt, Human
cacaggcgugagccaccgugcccggccucccc

SEQ ID NO: 79589 - RNA, 32 nt, Human
cacaggcgugagccacugcacccgaccccuac

SEQ ID NO: 79590 - RNA, 32 nt, Human
cacaggcgugagccacugcgcccagcccacug

SEQ ID NO: 79591 - RNA, 32 nt, Human
cacaggcgugagcuaccaagcccggcccuauc

SEQ ID NO: 79592 - RNA, 32 nt, Human
cacaggcgugagcuaucacaccuggccccaga

SEQ ID NO: 79593 - RNA, 32 nt, Human
cacaggcgugcaccaccaugcauagcuaauuu

SEQ ID NO: 79594 - RNA, 32 nt, Human
cacaggcgugcaccaccaugcccaccuaauuu

SEQ ID NO: 79595 - RNA, 32 nt, Human
cacaggcguucgagaccagccugggcaacaua

SEQ ID NO: 79596 - RNA, 23 nt, Human
cacaggcucgcagcuccgcggcg

SEQ ID NO: 79597 - RNA, 32 nt, Human
cacaggcugacacuaggagcugcucuccuugg

SEQ ID NO: 79598 - RNA, 32 nt, Human
cacaggcugagggacagagcaaagaccccuga

SEQ ID NO: 79599 - RNA, 32 nt, Human
cacaggcugaguccccaaaccugcacuagagg

SEQ ID NO: 79600 - RNA, 32 nt, Human
cacaggcugcggggccuagaaaagaaucucau

SEQ ID NO: 79601 - RNA, 32 nt, Human
cacaggcugggcagaggcacagggcagugcag

SEQ ID NO: 79602 - RNA, 32 nt, Human
cacaggcuggugaaccccggugggaacagagg

SEQ ID NO: 79603 - RNA, 32 nt, Human
cacaggcugucugcagucucaggcuuccuagc

SEQ ID NO: 79604 - RNA, 32 nt, Human
cacaggcuguuggacgcagccuggguggcaga

SEQ ID NO: 79605 - RNA, 32 nt, Human
cacaggcuuuucauguaugcaggaugacucaa

SEQ ID NO: 79606 - RNA, 19 nt, Human
cacagggaagcaacugccu

SEQ ID NO: 79607 - RNA, 32 nt, Human
cacagggacacagggcaagaccagccuugcuu

SEQ ID NO: 79608 - RNA, 26 nt, Human
cacagggaccacaaacauggaggcca

SEQ ID NO: 79609 - RNA, 32 nt, Human
cacagggacccaggcaggguuggguguuguga

SEQ ID NO: 79610 - RNA, 32 nt, Human
cacagggacccugcacucgacccugggggcuc

SEQ ID NO: 79611 - RNA, 32 nt, Human
cacagggaccguuucuccccuaggagcagcgg

SEQ ID NO: 79612 - RNA, 32 nt, Human
cacagggaccucugccccagaaagccugggua

SEQ ID NO: 79613 - RNA, 32 nt, Human
cacagggacgagaugacagugggagccccacg

SEQ ID NO: 79614 - RNA, 22 nt, Human
cacagggagaaaaacugaggua

SEQ ID NO: 79615 - RNA, 32 nt, Human
cacagggagacgggggccuggagccagcccug

SEQ ID NO: 79616 - RNA, 32 nt, Human
cacagggagagacuugaugucuggccuuuuaa

SEQ ID NO: 79617 - RNA, 32 nt, Human
cacagggagagggcaggaagggacaggagcgg

SEQ ID NO: 79618 - RNA, 32 nt, Human
cacagggagaggggcaacaggaggcugggaaa

SEQ ID NO: 79619 - RNA, 32 nt, Human
cacagggagcaugaaccugagaucagaagcau

SEQ ID NO: 79620 - RNA, 32 nt, Human
cacagggagcuccgucagcuucucccaagccc

SEQ ID NO: 79621 - RNA, 32 nt, Human
cacagggaggcagaggcuuggguaaacucauu

SEQ ID NO: 79622 - RNA, 32 nt, Human
cacagggagggaggggagauggaggcccggug

SEQ ID NO: 79623 - RNA, 32 nt, Human
cacagggaggggcggaugcugccaccacccag

SEQ ID NO: 79624 - RNA, 32 nt, Human
cacagggagguggguuggggugaggccacaug

SEQ ID NO: 79625 - RNA, 32 nt, Human
cacagggagucagagcccucugcuccggaauu

SEQ ID NO: 79626 - RNA, 32 nt, Human
cacagggauacuuggcuugggaaaacuaaaua

SEQ ID NO: 79627 - RNA, 32 nt, Human
cacagggauggaaaccucuuccuggacaugcu

SEQ ID NO: 79628 - RNA, 32 nt, Human
cacagggauguugcugaauuucaaucaccgau

SEQ ID NO: 79629 - RNA, 21 nt, Human
cacagggauuuaucaguucca

SEQ ID NO: 79630 - RNA, 32 nt, Human
cacagggauuuguccugggggcugagggcccu

SEQ ID NO: 79631 - RNA, 32 nt, Human
cacagggcaaaguacuaugcucugaguucauu

SEQ ID NO: 79632 - RNA, 32 nt, Human
cacagggcaccugcuggggcucagggauguua

SEQ ID NO: 79633 - RNA, 32 nt, Human
cacagggcacuagaucccuggaguucaggaac

SEQ ID NO: 79634 - RNA, 32 nt, Human
cacagggcagaggcauccauggcuggcgucug

SEQ ID NO: 79635 - RNA, 32 nt, Human
cacagggcagcuuguuaggaaugagaaucuca

SEQ ID NO: 79636 - RNA, 32 nt, Human
cacagggcaggcugaggacacagccacgugau

SEQ ID NO: 79637 - RNA, 32 nt, Human
cacagggcagugagcucugucuucccccaccu

SEQ ID NO: 79638 - RNA, 32 nt, Human
cacagggcauacccuucggugccuggauuccu

SEQ ID NO: 79639 - RNA, 32 nt, Human
cacagggcauuaagccagggccccagaucagg

SEQ ID NO: 79640 - RNA, 22 nt, Human
cacagggccacaccaacacaag

SEQ ID NO: 79641 - RNA, 32 nt, Human
cacagggccacagagcuggagcuggaucuacc

SEQ ID NO: 79642 - RNA, 32 nt, Human
cacagggccaccuucuugcccggcggcugccg

SEQ ID NO: 79643 - RNA, 32 nt, Human
cacagggccucaguuucccuaucugcaaaaug

SEQ ID NO: 79644 - RNA, 22 nt, Human
cacagggccuggccucagcccc

SEQ ID NO: 79645 - RNA, 18 nt, Human
cacagggcucacagggca

SEQ ID NO: 79646 - RNA, 32 nt, Human
cacagggcucugcggaccugcagccaucugug

SEQ ID NO: 79647 - RNA, 19 nt, Human
cacagggcugacccucccc

SEQ ID NO: 79648 - RNA, 24 nt, Human
cacagggcugaggccagccccuag

SEQ ID NO: 79649 - RNA, 23 nt, Human
cacagggcuggaccucacgcaga

SEQ ID NO: 79650 - RNA, 32 nt, Human
cacagggcuggagaagaggagugaggagccuc

SEQ ID NO: 79651 - RNA, 32 nt, Human
cacagggcuggcacagaggaggccuagacaua

SEQ ID NO: 79652 - RNA, 32 nt, Human
cacagggcuguagggacugaugaaaagagaau

SEQ ID NO: 79653 - RNA, 32 nt, Human
cacagggcuucaagacuacaaucccagcaugc

SEQ ID NO: 79654 - RNA, 32 nt, Human
cacagggcuucucugcgggcagccaggcaccu

SEQ ID NO: 79655 - RNA, 32 nt, Human
cacagggcuuucuagcaaggagugacuuucuu

SEQ ID NO: 79656 - RNA, 32 nt, Human
cacaggggaaggucaagucgagcaagguagaa

SEQ ID NO: 79657 - RNA, 32 nt, Human
cacaggggaggcaggggaagaggcaggagggu

SEQ ID NO: 79658 - RNA, 32 nt, Human
cacaggggagugaagcagggcuuggagcagau

SEQ ID NO: 79659 - RNA, 32 nt, Human
cacaggggcagugucacccuggaaaauacagu

SEQ ID NO: 79660 - RNA, 21 nt, Human
cacaggggccaacuagggcca

SEQ ID NO: 79661 - RNA, 21 nt, Human
cacaggggcccugcaaccuca

SEQ ID NO: 79662 - RNA, 21 nt, Human
cacaggggcccugguaggcuc

SEQ ID NO: 79663 - RNA, 20 nt, Human
cacaggggccucccaggcuc

SEQ ID NO: 79664 - RNA, 32 nt, Human
cacaggggccugaggagcucacucugggccua

SEQ ID NO: 79665 - RNA, 22 nt, Human
cacaggggccuggggcaggaag

SEQ ID NO: 79666 - RNA, 32 nt, Human
cacaggggccuggguacuggagggagggauac

SEQ ID NO: 79667 - RNA, 32 nt, Human
cacagggggaugaaggagauggagaggaagga

SEQ ID NO: 79668 - RNA, 18 nt, Human
cacagggggaugagggug

SEQ ID NO: 79669 - RNA, 17 nt, Human
cacagggggcggugggg

SEQ ID NO: 79670 - RNA, 32 nt, Human
cacagggguaaucaucucaagugguauuugua

SEQ ID NO: 79671 - RNA, 32 nt, Human
cacagggguacccaucacacaccagcguuuug

SEQ ID NO: 79672 - RNA, 32 nt, Human
cacaggggugagccaccgcgcccagcccucuc

SEQ ID NO: 79673 - RNA, 32 nt, Human
cacaggguaaggaagagagagugggaggcaga

SEQ ID NO: 79674 - RNA, 32 nt, Human
cacaggguacgcucauggagagagggcgcaga

SEQ ID NO: 79675 - RNA, 32 nt, Human
cacagggucagagaucugucagaggaaaaugg

SEQ ID NO: 79676 - RNA, 22 nt, Human
cacaggguccaagaguucauca

SEQ ID NO: 79677 - RNA, 32 nt, Human
cacagggucccggagagccaggggaaugcuuc

SEQ ID NO: 79678 - RNA, 32 nt, Human
cacagggucugcacucuaacccuaggcaucac

SEQ ID NO: 79679 - RNA, 32 nt, Human
cacagggucugcucuuucucugccagugacag

SEQ ID NO: 79680 - RNA, 32 nt, Human
cacagggugacaggcugggcuggagaaacaga

SEQ ID NO: 79681 - RNA, 32 nt, Human
cacagggugagacagcagggcccaggggagug

SEQ ID NO: 79682 - RNA, 32 nt, Human
cacagggugagagugagccaggaacagcaagg

SEQ ID NO: 79683 - RNA, 32 nt, Human
cacagggugagguaggggguggccacagggau

SEQ ID NO: 79684 - RNA, 32 nt, Human
cacaggguguguggaaagcgcugugggggaag

SEQ ID NO: 79685 - RNA, 32 nt, Human
cacaggguguucugaugcauaaucagagcuga

SEQ ID NO: 79686 - RNA, 32 nt, Human
cacaggguucaagcaauucuccugccucagcc

SEQ ID NO: 79687 - RNA, 32 nt, Human
cacaggguuccuucuccagcugagcuccaagu

SEQ ID NO: 79688 - RNA, 32 nt, Human
cacaggguuucacagucugaugagacugugcc

SEQ ID NO: 79689 - RNA, 32 nt, Human
cacagguacagcaacaggaaucucagagacag

SEQ ID NO: 79690 - RNA, 32 nt, Human
cacaggucacugcagcccugaccuccugggcu

SEQ ID NO: 79691 - RNA, 32 nt, Human
cacaggucccgggguguggaggcuccauccuu

SEQ ID NO: 79692 - RNA, 32 nt, Human
cacaggucucagacugacaggagacuggguca

SEQ ID NO: 79693 - RNA, 17 nt, Human
cacaggucuugcugcuc

SEQ ID NO: 79694 - RNA, 32 nt, Human
cacaggugcaugccaccaugccuggcuaacuu

SEQ ID NO: 79695 - RNA, 24 nt, Human
cacaggugccucacgccuguaauc

SEQ ID NO: 79696 - RNA, 32 nt, Human
cacaggugcgugucaccaugcuuggcuaauuu

SEQ ID NO: 79697 - RNA, 32 nt, Human
cacagguggaagcuccuucacuccagggaugc

SEQ ID NO: 79698 - RNA, 32 nt, Human
cacagguggagggcugcuuccaccccaggugc

SEQ ID NO: 79699 - RNA, 32 nt, Human
cacagguggcagcaggcagcagggaacauuuu

SEQ ID NO: 79700 - RNA, 32 nt, Human
cacagguggccuggguugcuugcacuuggggc

SEQ ID NO: 79701 - RNA, 32 nt, Human
cacagguggccuuggcuccaggccucugacag

SEQ ID NO: 79702 - RNA, 32 nt, Human
cacagguggcgccuugccauuccuggggacca

SEQ ID NO: 79703 - RNA, 32 nt, Human
cacagguggcuccugggcuugggcugcagguu

SEQ ID NO: 79704 - RNA, 32 nt, Human
cacagguggcuucaggccauucacaagagucc

SEQ ID NO: 79705 - RNA, 32 nt, Human
cacaggugggcucugacugccagaucgcaggg

SEQ ID NO: 79706 - RNA, 32 nt, Human
cacaggugugagccaccacaccuggcuaauuu

SEQ ID NO: 79707 - RNA, 32 nt, Human
cacaggugugcaccaccaugcccagcuaauua

SEQ ID NO: 79708 - RNA, 32 nt, Human
cacagguguucaaggccagccugggcaacaua

SEQ ID NO: 79709 - RNA, 21 nt, Human
cacagguguucuccagugcca

SEQ ID NO: 79710 - RNA, 32 nt, Human
cacagguguugaguggggcacaggguacuguc

SEQ ID NO: 79711 - RNA, 20 nt, Human
cacagguucuauuaauucca

SEQ ID NO: 79712 - RNA, 32 nt, Human
cacagguugcagcagagaaacuacucagguau

SEQ ID NO: 79713 - RNA, 32 nt, Human
cacagguugcagcccuggccuucugugaaucc

SEQ ID NO: 79714 - RNA, 19 nt, Human
cacagguugccaaauugcu

SEQ ID NO: 79715 - RNA, 32 nt, Human
cacagguuguacacugcacagcucuaggcuac

SEQ ID NO: 79716 - RNA, 32 nt, Human
cacagguuuaucucccaggcucuguaucuacu

SEQ ID NO: 79717 - RNA, 32 nt, Human
cacagguuugaggaugcuggggagagggggag

SEQ ID NO: 79718 - RNA, 22 nt, Human
cacagguuuuagcauugucuug

SEQ ID NO: 79719 - RNA, 32 nt, Human
cacaguaaucccagcacccaucucuacuaaaa

SEQ ID NO: 79720 - RNA, 32 nt, Human
cacaguaauuuguagagcugagauugaaauuc

SEQ ID NO: 79721 - RNA, 32 nt, Human
cacaguacugaaggccaaucugggcaaggagc

SEQ ID NO: 79722 - RNA, 32 nt, Human
cacaguacugggaaauggaagcacauggcacu

SEQ ID NO: 79723 - RNA, 32 nt, Human
cacaguagcugcacaguuuuaagauuaugcca

SEQ ID NO: 79724 - RNA, 32 nt, Human
cacaguagcuuauaccuguaauccuagcacuu

SEQ ID NO: 79725 - RNA, 32 nt, Human
cacaguaggaaggcuucuuucccauuuaggcu

SEQ ID NO: 79726 - RNA, 32 nt, Human
cacaguaggagauucuuuuucuucucuuuuga

SEQ ID NO: 79727 - RNA, 17 nt, Human
cacaguaggaggggcca

SEQ ID NO: 79728 - RNA, 32 nt, Human
cacaguauaaaauacuacagcacucuguguua

SEQ ID NO: 79729 - RNA, 21 nt, Human
cacaguaugcacucagcccca

SEQ ID NO: 79730 - RNA, 32 nt, Human
cacagucaacacagcaggcuccccggccccgg

SEQ ID NO: 79731 - RNA, 32 nt, Human
cacagucacacagcaggcaguggcaggcagua

SEQ ID NO: 79732 - RNA, 32 nt, Human
cacagucacacagcuaauauaugccagagccc

SEQ ID NO: 79733 - RNA, 32 nt, Human
cacagucacagucacacacacauauguauuac

SEQ ID NO: 79734 - RNA, 32 nt, Human
cacagucacaugccacauuugaucuccuaacc

SEQ ID NO: 79735 - RNA, 32 nt, Human
cacagucacaugcccauucacaccacacagag

SEQ ID NO: 79736 - RNA, 32 nt, Human
cacagucaccaccacgcuggcucugaucuuca

SEQ ID NO: 79737 - RNA, 32 nt, Human
cacagucacccacaggcccccaccucgauacu

SEQ ID NO: 79738 - RNA, 32 nt, Human
cacagucaccugcggcagaggugugcagaggc

SEQ ID NO: 79739 - RNA, 32 nt, Human
cacagucacgccacugcauucuauccugggca

SEQ ID NO: 79740 - RNA, 32 nt, Human
cacagucacucuuugugccucaguuuacccac

SEQ ID NO: 79741 - RNA, 32 nt, Human
cacagucacugcaggcuucagcaacuuaucuu

SEQ ID NO: 79742 - RNA, 32 nt, Human
cacagucacuucugccuguugcucugacacca

SEQ ID NO: 79743 - RNA, 32 nt, Human
cacagucagaacagcagccucuacacauguug

SEQ ID NO: 79744 - RNA, 31 nt, Human
cacagucagauucagcaccugccucagaucu

SEQ ID NO: 79745 - RNA, 32 nt, Human
cacagucagauucagcaccugccucagaucuc

SEQ ID NO: 79746 - RNA, 32 nt, Human
cacagucagcugcagaaguccugcugaccacc

SEQ ID NO: 79747 - RNA, 32 nt, Human
cacagucaggcccgggcccagcgcggccagug

SEQ ID NO: 79748 - RNA, 32 nt, Human
cacaguccacccacccucucucugaucucccc

SEQ ID NO: 79749 - RNA, 32 nt, Human
cacagucccagagggauugaagaguuuuaaaa

SEQ ID NO: 79750 - RNA, 32 nt, Human
cacagucccaggccuccuccacgccuggcucc

SEQ ID NO: 79751 - RNA, 32 nt, Human
cacagucccccagagcccuggcucagacaccu

SEQ ID NO: 79752 - RNA, 32 nt, Human
cacagucccucugggagagcucugccuagucu

SEQ ID NO: 79753 - RNA, 32 nt, Human
cacagucccuggcagagccagagccucuccgc

SEQ ID NO: 79754 - RNA, 32 nt, Human
cacaguccuaucuccucaccaggcccaggagc

SEQ ID NO: 79755 - RNA, 32 nt, Human
cacaguccuccaggaggguccuaaggauaacu

SEQ ID NO: 79756 - RNA, 32 nt, Human
cacaguccuccagguggguccuaaggaucuua

SEQ ID NO: 79757 - RNA, 32 nt, Human
cacaguccucugcugucuccccacuaggauca

SEQ ID NO: 79758 - RNA, 32 nt, Human
cacaguccugcugcugccgcuggggacaagcc

SEQ ID NO: 79759 - RNA, 32 nt, Human
cacaguccugggaaaugggagcauaugcuggg

SEQ ID NO: 79760 - RNA, 32 nt, Human
cacaguccuuaagccacacacauuguugcugc

SEQ ID NO: 79761 - RNA, 32 nt, Human
cacaguccuugcagccuuugauuucuccaguu

SEQ ID NO: 79762 - RNA, 32 nt, Human
cacagucgccaucuuggugacuuugaauuuau

SEQ ID NO: 79763 - RNA, 32 nt, Human
cacagucgcucacaccuguaaucucagcacuu

SEQ ID NO: 79764 - RNA, 32 nt, Human
cacagucguacucugucaccccggcuggagug

SEQ ID NO: 79765 - RNA, 32 nt, Human
cacagucuacaaaaccccacagcuccugagaa

SEQ ID NO: 79766 - RNA, 32 nt, Human
cacagucuacagcagagccacagccagcagua

SEQ ID NO: 79767 - RNA, 32 nt, Human
cacagucucagcucacugcagcuuugaccuug

SEQ ID NO: 79768 - RNA, 32 nt, Human
cacagucucccagaaaugauguuuugaguccc

SEQ ID NO: 79769 - RNA, 32 nt, Human
cacagucuccggccucuccagccucagccccc

SEQ ID NO: 79770 - RNA, 32 nt, Human
cacagucucugacuuugcagggcucacagauu

SEQ ID NO: 79771 - RNA, 32 nt, Human
cacagucugccggccaaagccauuccaacauc

SEQ ID NO: 79772 - RNA, 32 nt, Human
cacagucuggaaagauuucccaauggaggaag

SEQ ID NO: 79773 - RNA, 32 nt, Human
cacagucugggacccguggcggugcuggcaac

SEQ ID NO: 79774 - RNA, 32 nt, Human
cacagucugggcgacagagcaagacccucucu

SEQ ID NO: 79775 - RNA, 32 nt, Human
cacagucuguauacaaauaacaugcaugagga

SEQ ID NO: 79776 - RNA, 32 nt, Human
cacagucugugagugggaagagacuggagugu

SEQ ID NO: 79777 - RNA, 19 nt, Human
cacagucuguucagaggca

SEQ ID NO: 79778 - RNA, 32 nt, Human
cacagucuuguccugcucagagauuucuggcc

SEQ ID NO: 79779 - RNA, 32 nt, Human
cacagugaacaaauccagggagcugauaauug

SEQ ID NO: 79780 - RNA, 32 nt, Human
cacagugaacuccggcguggcugaggaaggag

SEQ ID NO: 79781 - RNA, 32 nt, Human
cacagugaaggagccagcacucagggcucucu

SEQ ID NO: 79782 - RNA, 32 nt, Human
cacagugacagugucauggggagcugggcggg

SEQ ID NO: 79783 - RNA, 32 nt, Human
cacagugaccacacccucacuggcucggcccu

SEQ ID NO: 79784 - RNA, 32 nt, Human
cacagugaccccaucacucgggaccacauggg

SEQ ID NO: 79785 - RNA, 32 nt, Human
cacagugacgugguaucugaugaagaccugau

SEQ ID NO: 79786 - RNA, 23 nt, Human
cacagugacucacaccuguaauc

SEQ ID NO: 79787 - RNA, 32 nt, Human
cacagugacucacaccuguaaucucagcacgu

SEQ ID NO: 79788 - RNA, 32 nt, Human
cacagugacucacaccuguaauuccagcacuu

SEQ ID NO: 79789 - RNA, 23 nt, Human
cacagugacucacgccuguaauc

SEQ ID NO: 79790 - RNA, 32 nt, Human
cacagugacucacgccuguaaucccagcacuu

SEQ ID NO: 79791 - RNA, 32 nt, Human
cacagugacucaugccuguaaucccagcacuu

SEQ ID NO: 79792 - RNA, 32 nt, Human
cacagugacuccacucugagucccagagccaa

SEQ ID NO: 79793 - RNA, 32 nt, Human
cacagugacuccauuuaggaugcugucguuuu

SEQ ID NO: 79794 - RNA, 32 nt, Human
cacagugagaaguaguuccuguccuuaaggaa

SEQ ID NO: 79795 - RNA, 31 nt, Human
cacagugagagacugccucugcuucauagga

SEQ ID NO: 79796 - RNA, 32 nt, Human
cacagugagggugggagcagcggaacagggaa

SEQ ID NO: 79797 - RNA, 32 nt, Human
cacagugauagagaauugcuguggagaguuau

SEQ ID NO: 79798 - RNA, 32 nt, Human
cacagugaucgaugauucaggugcagaggaag

SEQ ID NO: 79799 - RNA, 18 nt, Human
cacagugaugccuacuga

SEQ ID NO: 79800 - RNA, 32 nt, Human
cacagugaugugcucaguugcugugaaaagca

SEQ ID NO: 79801 - RNA, 32 nt, Human
cacagugcacaggucagggcucggagggagcc

SEQ ID NO: 79802 - RNA, 32 nt, Human
cacagugcacugcugcgcgcugggcagugcgg

SEQ ID NO: 79803 - RNA, 18 nt, Human
cacagugcagacacagaa

SEQ ID NO: 79804 - RNA, 28 nt, Human
cacagugcagaggcucagggagcagcag

SEQ ID NO: 79805 - RNA, 21 nt, Human
cacagugcagcagggcugacu

SEQ ID NO: 79806 - RNA, 28 nt, Human
cacagugcagccggcuguggagcagcag

SEQ ID NO: 79807 - RNA, 32 nt, Human
cacagugccggggaggggcgggcaggucacaa

SEQ ID NO: 79808 - RNA, 32 nt, Human
cacagugccuggcccauucuugaguuuugaua

SEQ ID NO: 79809 - RNA, 21 nt, Human
cacagugccugggacagggag

SEQ ID NO: 79810 - RNA, 32 nt, Human
cacagugccuguaaaucucauuuguauuuuca

SEQ ID NO: 79811 - RNA, 28 nt, Human
cacagugcgagaggcuugggaacagcag

SEQ ID NO: 79812 - RNA, 32 nt, Human
cacagugcuccaaaugcacaugaacaacagug

SEQ ID NO: 79813 - RNA, 32 nt, Human
cacagugcugcuaauaucccagcuccagccag

SEQ ID NO: 79814 - RNA, 19 nt, Human
cacagugcuggcugggccc

SEQ ID NO: 79815 - RNA, 32 nt, Human
cacagugcuggcugggccccaaugcaccgucc

SEQ ID NO: 79816 - RNA, 21 nt, Human
cacagugcugggauuacaggc

SEQ ID NO: 79817 - RNA, 23 nt, Human
cacagugcugggauuacaggcau

SEQ ID NO: 79818 - RNA, 32 nt, Human
cacagugcugggauuacaggcaugggccacca

SEQ ID NO: 79819 - RNA, 23 nt, Human
cacagugcugggauuacaggcgu

SEQ ID NO: 79820 - RNA, 23 nt, Human
cacagugcugggauuagaggcau

SEQ ID NO: 79821 - RNA, 32 nt, Human
cacaguggaccggcgcccuagccugggaaucc

SEQ ID NO: 79822 - RNA, 32 nt, Human
cacaguggaccuucugccuccucccagaugcc

SEQ ID NO: 79823 - RNA, 32 nt, Human
cacaguggagagagcacaggacugggagucca

SEQ ID NO: 79824 - RNA, 32 nt, Human
cacaguggagggguguaaggggcaguuuguuu

SEQ ID NO: 79825 - RNA, 32 nt, Human
cacaguggcacacaccuguagucccagcugcu

SEQ ID NO: 79826 - RNA, 32 nt, Human
cacaguggcacaugccuguaaucccagcuacu

SEQ ID NO: 79827 - RNA, 32 nt, Human
cacaguggccaucaguugccagagaacaugaa

SEQ ID NO: 79828 - RNA, 32 nt, Human
cacaguggcccacgccuguaaucccagcacuu

SEQ ID NO: 79829 - RNA, 32 nt, Human
cacaguggcccaugccuauaaucccagcacuu

SEQ ID NO: 79830 - RNA, 23 nt, Human
cacaguggcccaugccuguaauc

SEQ ID NO: 79831 - RNA, 32 nt, Human
cacaguggcccaugccuguaaucccagcacuu

SEQ ID NO: 79832 - RNA, 32 nt, Human
cacaguggcccucagcccuccaccuccggcgg

SEQ ID NO: 79833 - RNA, 32 nt, Human
cacaguggcgcaugccuguaaucccagaacuu

SEQ ID NO: 79834 - RNA, 32 nt, Human
cacaguggcucacacccauaaucccagcacuu

SEQ ID NO: 79835 - RNA, 32 nt, Human
cacaguggcucacaccuaaucccagcacuuug

SEQ ID NO: 79836 - RNA, 32 nt, Human
cacaguggcucacaccuacgaucacagcacuu

SEQ ID NO: 79837 - RNA, 32 nt, Human
cacaguggcucacaccuauaaucccagcacuc

SEQ ID NO: 79838 - RNA, 23 nt, Human
cacaguggcucacaccugcaauc

SEQ ID NO: 79839 - RNA, 32 nt, Human
cacaguggcucacaccugcgaucccaccacuu

SEQ ID NO: 79840 - RNA, 32 nt, Human
cacaguggcucacaccuguaacccuagcacuu

SEQ ID NO: 79841 - RNA, 23 nt, Human
cacaguggcucacaccuguaauc

SEQ ID NO: 79842 - RNA, 32 nt, Human
cacaguggcucacaccuguaaucacagcacuu

SEQ ID NO: 79843 - RNA, 32 nt, Human
cacaguggcucacaccuguaaucccaacacuc

SEQ ID NO: 79844 - RNA, 32 nt, Human
cacaguggcucacaccuguaaucccaauacuu

SEQ ID NO: 79845 - RNA, 32 nt, Human
cacaguggcucacaccuguaaucccagcacua

SEQ ID NO: 79846 - RNA, 32 nt, Human
cacaguggcucacaccuguaaucccagcacuu

SEQ ID NO: 79847 - RNA, 32 nt, Human
cacaguggcucacaccuguaaucccagcgcuu

SEQ ID NO: 79848 - RNA, 32 nt, Human
cacaguggcucacaccuguaaucccaggacuu

SEQ ID NO: 79849 - RNA, 32 nt, Human
cacaguggcucacaccuguaauccgacuguaa

SEQ ID NO: 79850 - RNA, 32 nt, Human
cacaguggcucacaccuguaauccuaacacuu

SEQ ID NO: 79851 - RNA, 32 nt, Human
cacaguggcucacaccuguaauccuagcacuu

SEQ ID NO: 79852 - RNA, 32 nt, Human
cacaguggcucacaccuguaauccuugcauuu

SEQ ID NO: 79853 - RNA, 32 nt, Human
cacaguggcucacaccuguaaucucagcaacc

SEQ ID NO: 79854 - RNA, 32 nt, Human
cacaguggcucacaccuguaaucucagcacuu

SEQ ID NO: 79855 - RNA, 32 nt, Human
cacaguggcucacaccuguaaucugagcauuc

SEQ ID NO: 79856 - RNA, 32 nt, Human
cacaguggcucacaccuguaauuccagcacuu

SEQ ID NO: 79857 - RNA, 32 nt, Human
cacaguggcucacaccuguggucccagcucuu

SEQ ID NO: 79858 - RNA, 32 nt, Human
cacaguggcucacaucuguaaucccagcacuu

SEQ ID NO: 79859 - RNA, 32 nt, Human
cacaguggcucacgccaguaaucccagcacuu

SEQ ID NO: 79860 - RNA, 32 nt, Human
cacaguggcucacgccuauaaucccagcacuu

SEQ ID NO: 79861 - RNA, 32 nt, Human
cacaguggcucacgccuguaauaccagcaccu

SEQ ID NO: 79862 - RNA, 23 nt, Human
cacaguggcucacgccuguaauc

SEQ ID NO: 79863 - RNA, 32 nt, Human
cacaguggcucacgccuguaaucacaacacuu

SEQ ID NO: 79864 - RNA, 32 nt, Human
cacaguggcucacgccuguaaucacagcacuu

SEQ ID NO: 79865 - RNA, 32 nt, Human
cacaguggcucacgccuguaaucccaaagugc

SEQ ID NO: 79866 - RNA, 32 nt, Human
cacaguggcucacgccuguaaucccaacaccu

SEQ ID NO: 79867 - RNA, 32 nt, Human
cacaguggcucacgccuguaaucccaacacuu

SEQ ID NO: 79868 - RNA, 32 nt, Human
cacaguggcucacgccuguaaucccaccacuu

SEQ ID NO: 79869 - RNA, 32 nt, Human
cacaguggcucacgccuguaaucccagcacuu

SEQ ID NO: 79870 - RNA, 32 nt, Human
cacaguggcucacgccuguaauccuagcaguu

SEQ ID NO: 79871 - RNA, 32 nt, Human
cacaguggcucacgccuguaaucucagcacau

SEQ ID NO: 79872 - RNA, 32 nt, Human
cacaguggcucacgccuguaaucucggcacuu

SEQ ID NO: 79873 - RNA, 32 nt, Human
cacaguggcucacgucuguaaucuuugggagc

SEQ ID NO: 79874 - RNA, 23 nt, Human
cacaguggcucauaccuguaauc

SEQ ID NO: 79875 - RNA, 32 nt, Human
cacaguggcucauaccuguaaucccagcaguu

SEQ ID NO: 79876 - RNA, 32 nt, Human
cacaguggcucauaccuguaaugccagcacuu

SEQ ID NO: 79877 - RNA, 32 nt, Human
cacaguggcucaucccuguaauuccagcacuu

SEQ ID NO: 79878 - RNA, 32 nt, Human
cacaguggcucaugccgauaaucccagcaauu

SEQ ID NO: 79879 - RNA, 32 nt, Human
cacaguggcucaugccuauaaucccagcacuu

SEQ ID NO: 79880 - RNA, 32 nt, Human
cacaguggcucaugccuguaaucccaacacuc

SEQ ID NO: 79881 - RNA, 32 nt, Human
cacaguggcucaugccuguaaucccagaacuu

SEQ ID NO: 79882 - RNA, 32 nt, Human
cacaguggcucaugccuguaaucccagaauuu

SEQ ID NO: 79883 - RNA, 32 nt, Human
cacaguggcucaugccuguaaucccagcacuu

SEQ ID NO: 79884 - RNA, 32 nt, Human
cacaguggcucaugccuguaaucccagcauuu

SEQ ID NO: 79885 - RNA, 32 nt, Human
cacaguggcucaugccuguaauccuaacacuu

SEQ ID NO: 79886 - RNA, 32 nt, Human
cacaguggcucaugccuguaauccuagcacuu

SEQ ID NO: 79887 - RNA, 32 nt, Human
cacaguggcucaugccuguaaucucaacacuu

SEQ ID NO: 79888 - RNA, 32 nt, Human
cacaguggcucaugucugcaaucccagcgauu

SEQ ID NO: 79889 - RNA, 32 nt, Human
cacaguggcucauguuuguaaucccagcacuu

SEQ ID NO: 79890 - RNA, 32 nt, Human
cacaguggcucccgccuguaaucccauuacuu

SEQ ID NO: 79891 - RNA, 32 nt, Human
cacaguggcucuugucuguaaucccagcgcuc

SEQ ID NO: 79892 - RNA, 23 nt, Human
cacaguggcuuacaccuguaauc

SEQ ID NO: 79893 - RNA, 32 nt, Human
cacaguggcuuacaccuguaaucccaaugcuu

SEQ ID NO: 79894 - RNA, 32 nt, Human
cacaguggcuuacgccuguaaucccagcacuu

SEQ ID NO: 79895 - RNA, 32 nt, Human
cacaguggcuuaugccuguaaucccagcacuu

SEQ ID NO: 79896 - RNA, 32 nt, Human
cacaguggcuuaugccuguaauugcagcacuu

SEQ ID NO: 79897 - RNA, 32 nt, Human
cacaguggcuugcaccuguaaucccagcacuu

SEQ ID NO: 79898 - RNA, 32 nt, Human
cacaguggcuugugccuguaaucccagaacuu

SEQ ID NO: 79899 - RNA, 22 nt, Human
cacagugggacucaggcccggg

SEQ ID NO: 79900 - RNA, 32 nt, Human
cacagugggagagguuucaccaccgcauucug

SEQ ID NO: 79901 - RNA, 32 nt, Human
cacagugggagccagacugaauauagcgacau

SEQ ID NO: 79902 - RNA, 32 nt, Human
cacagugggaggaucgcuugagcccagaaggc

SEQ ID NO: 79903 - RNA, 32 nt, Human
cacagugggaggauugcuugagcccgggaguu

SEQ ID NO: 79904 - RNA, 32 nt, Human
cacagugggagguggugguggguggcgguggc

SEQ ID NO: 79905 - RNA, 32 nt, Human
cacagugggcaugcuauccacccuccgccccu

SEQ ID NO: 79906 - RNA, 32 nt, Human
cacagugggcucuccaggcccaccucuuccuc

SEQ ID NO: 79907 - RNA, 32 nt, Human
cacagugggcucuccaggcccaccucuuucuc

SEQ ID NO: 79908 - RNA, 32 nt, Human
cacaguggggaaggugucaauggggaguguca

SEQ ID NO: 79909 - RNA, 32 nt, Human
cacagugggucacaccuguaaucccagcacgu

SEQ ID NO: 79910 - RNA, 32 nt, Human
cacagugggugaggagauggggacaggugaau

SEQ ID NO: 79911 - RNA, 32 nt, Human
cacagugggugucugaaaggacagaucacucc

SEQ ID NO: 79912 - RNA, 32 nt, Human
cacaguggguuagccuggagaaaaugagaggc

SEQ ID NO: 79913 - RNA, 32 nt, Human
cacagugguacaugccuguaaucccagcuacu

SEQ ID NO: 79914 - RNA, 32 nt, Human
cacaguggucaagggugcagcucugcagcaca

SEQ ID NO: 79915 - RNA, 32 nt, Human
cacaguggucccauuuauaucugcuucuagcu

SEQ ID NO: 79916 - RNA, 23 nt, Human
cacagugguucacaccuguaauc

SEQ ID NO: 79917 - RNA, 32 nt, Human
cacagugguucacaccuguaaucccagcacuu

SEQ ID NO: 79918 - RNA, 32 nt, Human
cacagugguucacauuuguaaucccagcacuu

SEQ ID NO: 79919 - RNA, 32 nt, Human
cacagugguucacgccuguaauccagcacugu

SEQ ID NO: 79920 - RNA, 32 nt, Human
cacagugguucacgccuguaaucccaauacuu

SEQ ID NO: 79921 - RNA, 32 nt, Human
cacagugguuuaugccuguaaucccagcacug

SEQ ID NO: 79922 - RNA, 32 nt, Human
cacagugucccaggacccugcggugcaguaga

SEQ ID NO: 79923 - RNA, 32 nt, Human
cacagugucucaugccucuaaucccagcacuu

SEQ ID NO: 79924 - RNA, 32 nt, Human
cacagugugaaacccgcacccuagccaggccc

SEQ ID NO: 79925 - RNA, 32 nt, Human
cacaguguggcacccacccaagguuuccaugc

SEQ ID NO: 79926 - RNA, 32 nt, Human
cacaguguucugacacauuugaguguccaaaa

SEQ ID NO: 79927 - RNA, 32 nt, Human
cacaguguugcccaggcuggucucaaacuccu

SEQ ID NO: 79928 - RNA, 20 nt, Human
cacaguguuugucuuccaca

SEQ ID NO: 79929 - RNA, 31 nt, Human
cacaguuaaaucaaauaccuuugaacaaguu

SEQ ID NO: 79930 - RNA, 31 nt, Human
cacaguuacuuauggagcaccaaagcauuug

SEQ ID NO: 79931 - RNA, 32 nt, Human
cacaguuaugccgcuagauacaugcuuuuuaa

SEQ ID NO: 79932 - RNA, 32 nt, Human
cacaguucagccaggacugaccacagggcucu

SEQ ID NO: 79933 - RNA, 32 nt, Human
cacaguuccugagaaugaacagguaauuucau

SEQ ID NO: 79934 - RNA, 32 nt, Human
cacaguuccugggaacaucacauuccucugcc

SEQ ID NO: 79935 - RNA, 32 nt, Human
cacaguucucacuuaacuggugcuaugugaaa

SEQ ID NO: 79936 - RNA, 32 nt, Human
cacaguucucacuuaacuggugcuaugugaag

SEQ ID NO: 79937 - RNA, 32 nt, Human
cacaguucuccaagcaucgugauagcaaugcu

SEQ ID NO: 79938 - RNA, 32 nt, Human
cacaguucugcaggauguacaggaagcauagu

SEQ ID NO: 79939 - RNA, 31 nt, Human
cacaguugcguggaaaggaaguggaguggac

SEQ ID NO: 79940 - RNA, 32 nt, Human
cacaguuggccaccaccaucucuagaugggaa

SEQ ID NO: 79941 - RNA, 32 nt, Human
cacaguugggggcuggcuucugagggauuccu

SEQ ID NO: 79942 - RNA, 32 nt, Human
cacaguuguauagguucuuccacagccuucuc

SEQ ID NO: 79943 - RNA, 32 nt, Human
cacaguugucccauugaauuauuugagcaaaa

SEQ ID NO: 79944 - RNA, 21 nt, Human
cacaguuguuaccacaagaca

SEQ ID NO: 79945 - RNA, 32 nt, Human
cacaguuuccacccucaccugcccccucauac

SEQ ID NO: 79946 - RNA, 32 nt, Human
cacaguuuccucaucccuucaccuguggaugg

SEQ ID NO: 79947 - RNA, 32 nt, Human
cacaguuugauuaucacauucacuuuauuaau

SEQ ID NO: 79948 - RNA, 32 nt, Human
cacaguuuguaacaagaaaacagucucuccca

SEQ ID NO: 79949 - RNA, 19 nt, Human
cacaguuuguagcaaggca

SEQ ID NO: 79950 - RNA, 32 nt, Human
cacauaaacaucucaaagggacagaggacaga

SEQ ID NO: 79951 - RNA, 32 nt, Human
cacauaaauaguuauaucaaugucagccuauu

SEQ ID NO: 79952 - RNA, 32 nt, Human
cacauaaaugucccccugagaaaccaauccca

SEQ ID NO: 79953 - RNA, 32 nt, Human
cacauaaccaguagcuacuauacuaaucuggu

SEQ ID NO: 79954 - RNA, 32 nt, Human
cacauaaccccuccugugcuugaguguccaug

SEQ ID NO: 79955 - RNA, 32 nt, Human
cacauaaccucugggugcuggaaauggaguau

SEQ ID NO: 79956 - RNA, 32 nt, Human
cacauaacucacaaucuuccugcacucaacuu

SEQ ID NO: 79957 - RNA, 32 nt, Human
cacauaacucgagacagggacagcgggaggcu

SEQ ID NO: 79958 - RNA, 32 nt, Human
cacauaacuugucacuuuaaucuuuuucacug

SEQ ID NO: 79959 - RNA, 32 nt, Human
cacauaagccuggcaagccaaggauguucccg

SEQ ID NO: 79960 - RNA, 32 nt, Human
cacauaaugaaagcagucucucacccggcuau

SEQ ID NO: 79961 - RNA, 32 nt, Human
cacauaaugaaugcuauugaaaagguuaacag

SEQ ID NO: 79962 - RNA, 32 nt, Human
cacauaauucaugcuggacaaaaauccuacaa

SEQ ID NO: 79963 - RNA, 32 nt, Human
cacauaauuuuuguacaucccaaaggaugaga

SEQ ID NO: 79964 - RNA, 32 nt, Human
cacauacaaaaauaugaacauggcugggcgcg

SEQ ID NO: 79965 - RNA, 32 nt, Human
cacauacacaacaacauagggaguuguaugac

SEQ ID NO: 79966 - RNA, 32 nt, Human
cacauacacacacaaacauacauguauguaua

SEQ ID NO: 79967 - RNA, 28 nt, Human
cacauacacacacgcauuaauuuuugua

SEQ ID NO: 79968 - RNA, 21 nt, Human
cacauacacacacgugcaugu

SEQ ID NO: 79969 - RNA, 22 nt, Human
cacauacacacacgugcaugua

SEQ ID NO: 79970 - RNA, 18 nt, Human
cacauacacacauaugca

SEQ ID NO: 79971 - RNA, 20 nt, Human
cacauacacacauaugucau

SEQ ID NO: 79972 - RNA, 20 nt, Human
cacauacacacaugcgugca

SEQ ID NO: 79973 - RNA, 20 nt, Human
cacauacacacgcaucugua

SEQ ID NO: 79974 - RNA, 32 nt, Human
cacauacacacgcaucuguacacacaugcaug

SEQ ID NO: 79975 - RNA, 32 nt, Human
cacauacacacucggucucacacucaccugug

SEQ ID NO: 79976 - RNA, 20 nt, Human
cacauacacacugucaugca

SEQ ID NO: 79977 - RNA, 32 nt, Human
cacauacacagcaauugcucgacugugucaau

SEQ ID NO: 79978 - RNA, 32 nt, Human
cacauacacaggcacacaugcaugcacacaua

SEQ ID NO: 79979 - RNA, 25 nt, Human
cacauacacauauauuaugcaugug

SEQ ID NO: 79980 - RNA, 32 nt, Human
cacauacacaugcacacacacaugcacacaua

SEQ ID NO: 79981 - RNA, 18 nt, Human
cacauacacaugcaugca

SEQ ID NO: 79982 - RNA, 32 nt, Human
cacauacacaugcaugcacacauacacaggca

SEQ ID NO: 79983 - RNA, 32 nt, Human
cacauacacaugcaugugcacacacaaaccuc

SEQ ID NO: 79984 - RNA, 18 nt, Human
cacauacacgcacaugca

SEQ ID NO: 79985 - RNA, 32 nt, Human
cacauacacgcgcauacauacauauacagaga

SEQ ID NO: 79986 - RNA, 32 nt, Human
cacauacacgugcacacauacacaggcacaca

SEQ ID NO: 79987 - RNA, 20 nt, Human
cacauacagaaagaagcagu

SEQ ID NO: 79988 - RNA, 32 nt, Human
cacauacagaagcaggguggaggggaagggug

SEQ ID NO: 79989 - RNA, 32 nt, Human
cacauacagaauacuuacuauguuccaagcaa

SEQ ID NO: 79990 - RNA, 26 nt, Human
cacauacagacacacacauauaugua

SEQ ID NO: 79991 - RNA, 32 nt, Human
cacauacagacacacacauauauguacagaca

SEQ ID NO: 79992 - RNA, 32 nt, Human
cacauacaggugaaacauuaagccacaaauaa

SEQ ID NO: 79993 - RNA, 32 nt, Human
cacauacauaaauauaccacauauacaccuga

SEQ ID NO: 79994 - RNA, 32 nt, Human
cacauacauacacacauacaaaaccuuuaaau

SEQ ID NO: 79995 - RNA, 32 nt, Human
cacauacauacacauacauacauacauacaua

SEQ ID NO: 79996 - RNA, 18 nt, Human
cacauacauacacaugca

SEQ ID NO: 79997 - RNA, 18 nt, Human
cacauacauacauaugca

SEQ ID NO: 79998 - RNA, 19 nt, Human
cacauacauacauauguau

SEQ ID NO: 79999 - RNA, 32 nt, Human
cacauacauaugcacacaggcacacauggcaa

SEQ ID NO: 80000 - RNA, 32 nt, Human
cacauacauaugcacgcacacacacaugcaca

SEQ ID NO: 80001 - RNA, 32 nt, Human
cacauacaugcccacacauagugacaugcuca

SEQ ID NO: 80002 - RNA, 32 nt, Human
cacauacauggccaaaugcaauacugaagaga

SEQ ID NO: 80003 - RNA, 32 nt, Human
cacauaccacaucuucucacuuauagauggua

SEQ ID NO: 80004 - RNA, 32 nt, Human
cacauaccacaucuucuuacuuauagauggga

SEQ ID NO: 80005 - RNA, 32 nt, Human
cacauaccagcuguuuuucagucuccugcuca

SEQ ID NO: 80006 - RNA, 32 nt, Human
cacauaccucauucuuccuggacucaggacaa

SEQ ID NO: 80007 - RNA, 32 nt, Human
cacauaccuguaaucccagcuacuuggaauug

SEQ ID NO: 80008 - RNA, 32 nt, Human
cacauaccuguaaucccagcuacuuugguggc

SEQ ID NO: 80009 - RNA, 32 nt, Human
cacauacguuugcguauauguuauuuuaaaca

SEQ ID NO: 80010 - RNA, 32 nt, Human
cacauacucauucaaagaaguccuaggaaaua

SEQ ID NO: 80011 - RNA, 32 nt, Human
cacauacucccauaguguccuagguccagccg

SEQ ID NO: 80012 - RNA, 32 nt, Human
cacauacuccugggccagaggcuauaaaaccc

SEQ ID NO: 80013 - RNA, 32 nt, Human
cacauacucgucaucgcaucacuugggagaau

SEQ ID NO: 80014 - RNA, 32 nt, Human
cacauacucucaaggccaguagacucacccca

SEQ ID NO: 80015 - RNA, 23 nt, Human
cacauacugaaugcauauaugua

SEQ ID NO: 80016 - RNA, 32 nt, Human
cacauacugacagaugguaucugccagucucu

SEQ ID NO: 80017 - RNA, 32 nt, Human
cacauacuuaccaagcaaaaagcccaugaaaa

SEQ ID NO: 80018 - RNA, 20 nt, Human
cacauacuugguuucuggga

SEQ ID NO: 80019 - RNA, 32 nt, Human
cacauagaagcuguccuugagcuguccuaugg

SEQ ID NO: 80020 - RNA, 32 nt, Human
cacauagagauuggcuuuugucacucagcaca

SEQ ID NO: 80021 - RNA, 31 nt, Human
cacauagaggagagagaaaauggcugaguua

SEQ ID NO: 80022 - RNA, 32 nt, Human
cacauagagggugagaggggagagcuggacaa

SEQ ID NO: 80023 - RNA, 24 nt, Human
cacauagaucugcuuuguguuuuu

SEQ ID NO: 80024 - RNA, 32 nt, Human
cacauagaugucccuuucuuggccaguuaucc

SEQ ID NO: 80025 - RNA, 32 nt, Human
cacauagcacagccaccauccucaacccucga

SEQ ID NO: 80026 - RNA, 31 nt, Human
cacauagcacuuuuuauagcuuguagacucu

SEQ ID NO: 80027 - RNA, 32 nt, Human
cacauagcagagcucacucaguucucacagua

SEQ ID NO: 80028 - RNA, 32 nt, Human
cacauagcagagggacccugggccaggcccac

SEQ ID NO: 80029 - RNA, 32 nt, Human
cacauagcucucaccuccucuggccuuuuugc

SEQ ID NO: 80030 - RNA, 32 nt, Human
cacauaggcaguagccuccuccugggcuccag

SEQ ID NO: 80031 - RNA, 32 nt, Human
cacauagggaaacugaggcucagggguguuaa

SEQ ID NO: 80032 - RNA, 32 nt, Human
cacauaggggucugaaguugaaagaauacgac

SEQ ID NO: 80033 - RNA, 32 nt, Human
cacauaggugcacacauugucugcccagagag

SEQ ID NO: 80034 - RNA, 32 nt, Human
cacauaguauauguacauauuucuggcauaua

SEQ ID NO: 80035 - RNA, 32 nt, Human
cacauagucauugucccuuacugccagaccca

SEQ ID NO: 80036 - RNA, 32 nt, Human
cacauagugcuuuuuccugaaaagcuggacug

SEQ ID NO: 80037 - RNA, 32 nt, Human
cacauaguguuaggaaaacauuccuguguuuu

SEQ ID NO: 80038 - RNA, 24 nt, Human
cacauaguuuuuauuuuugugucu

SEQ ID NO: 80039 - RNA, 32 nt, Human
cacauauauaguuucauuuaaucauuucaaag

SEQ ID NO: 80040 - RNA, 32 nt, Human
cacauauaugauacaaaugcuuucaggcugcu

SEQ ID NO: 80041 - RNA, 32 nt, Human
cacauaucauuugaucuuuucaugucagcgag

SEQ ID NO: 80042 - RNA, 32 nt, Human
cacauaucauuuuaagaagcugaggaucacua

SEQ ID NO: 80043 - RNA, 32 nt, Human
cacauaugcagggaguauugcacugagaucuu

SEQ ID NO: 80044 - RNA, 18 nt, Human
cacccuucacucauugaa

SEQ ID NO: 80045 - RNA, 32 nt, Human
cacccuucagcagcgaccuccacucccgccac

SEQ ID NO: 80046 - RNA, 32 nt, Human
cacccuucauucuucuaaccagcccugacauu

SEQ ID NO: 80047 - RNA, 32 nt, Human
cacccuuccagccuuccaggcuuugggggcca

SEQ ID NO: 80048 - RNA, 32 nt, Human
cacccuucccagagccagggagcccuuagccu

SEQ ID NO: 80049 - RNA, 18 nt, Human
cacccuucccagcucuca

SEQ ID NO: 80050 - RNA, 32 nt, Human
cacccuuccccacucccugguccccgggagca

SEQ ID NO: 80051 - RNA, 21 nt, Human
cacccuucccuccuucugcca

SEQ ID NO: 80052 - RNA, 32 nt, Human
cacccuucccuucuucccuccaccccaaagaa

SEQ ID NO: 80053 - RNA, 32 nt, Human
cacccuuccuaaguccgcuucuggucuccggg

SEQ ID NO: 80054 - RNA, 32 nt, Human
cacccuuccuccugcgacagagcccaagaaga

SEQ ID NO: 80055 - RNA, 32 nt, Human
cacccuuccugccucaugucucaaggcagcag

SEQ ID NO: 80056 - RNA, 32 nt, Human
cacccuuccugccuccugccccacucaggguu

SEQ ID NO: 80057 - RNA, 32 nt, Human
cacccuucggcccccaagcuucccaggggcuu

SEQ ID NO: 80058 - RNA, 32 nt, Human
cacccuucuccccuccuucuucuucuuuuaac

SEQ ID NO: 80059 - RNA, 32 nt, Human
cacccuugaagucaucucaagaacaaaagaca

SEQ ID NO: 80060 - RNA, 32 nt, Human
cacccuugagaauccuuccucuccuuggaacg

SEQ ID NO: 80061 - RNA, 32 nt, Human
cacccuugcacauuuuguuacugugaaggacu

SEQ ID NO: 80062 - RNA, 32 nt, Human
cacccuugcaucuucugcuacagacugcuuuu

SEQ ID NO: 80063 - RNA, 32 nt, Human
cacccuugccacugccccagggcaugucucua

SEQ ID NO: 80064 - RNA, 32 nt, Human
cacccuugccccaucccucccacacacaggac

SEQ ID NO: 80065 - RNA, 32 nt, Human
cacccuugcugcaggcuagggagcugcagucc

SEQ ID NO: 80066 - RNA, 32 nt, Human
cacccuugcuguucuucucaaucucuugcucu

SEQ ID NO: 80067 - RNA, 32 nt, Human
cacccuugggggagcaugaugggcaggugagg

SEQ ID NO: 80068 - RNA, 32 nt, Human
cacccuuuccaaugcaucuucuacccugcuac

SEQ ID NO: 80069 - RNA, 19 nt, Human
cacccuuuccccaucaugg

SEQ ID NO: 80070 - RNA, 32 nt, Human
cacccuuucugaaagcaaacagugcugcucuu

SEQ ID NO: 80071 - RNA, 32 nt, Human
cacccuuugccacccagccuacccccgggagc

SEQ ID NO: 80072 - RNA, 23 nt, Human
cacccuuugucucccccuaccca

SEQ ID NO: 80073 - RNA, 32 nt, Human
caccgaagcugcccucaccccuccaucagggc

SEQ ID NO: 80074 - RNA, 32 nt, Human
caccgaaggaagcaucccagacaccgggaaga

SEQ ID NO: 80075 - RNA, 21 nt, Human
caccgaaguucaggacuccuc

SEQ ID NO: 80076 - RNA, 32 nt, Human
caccgaauccuucugucuucauggccugcugu

SEQ ID NO: 80077 - RNA, 32 nt, Human
caccgaaucuguacuaaggaccuguguucagc

SEQ ID NO: 80078 - RNA, 32 nt, Human
caccgacaauuuagaaacagaaaaacugugug

SEQ ID NO: 80079 - RNA, 32 nt, Human
caccgacacaaacuggagaauggucuggcugc

SEQ ID NO: 80080 - RNA, 32 nt, Human
caccgacacaggcacauguacaugcacaggug

SEQ ID NO: 80081 - RNA, 32 nt, Human
caccgacacugagggcuccuagccgcagcaga

SEQ ID NO: 80082 - RNA, 32 nt, Human
caccgaccucaaccccaacaagacccugcugc

SEQ ID NO: 80083 - RNA, 32 nt, Human
caccgaccuccccugaucucccuccucccacc

SEQ ID NO: 80084 - RNA, 32 nt, Human
caccgaccugcccaggaaugcaucacauuguu

SEQ ID NO: 80085 - RNA, 32 nt, Human
caccgacgcccaggacccuggccugcagagac

SEQ ID NO: 80086 - RNA, 32 nt, Human
caccgacgcggagcgaccagcccagccagacc

SEQ ID NO: 80087 - RNA, 32 nt, Human
caccgacucaccacagcccuucccagaccugg

SEQ ID NO: 80088 - RNA, 26 nt, Human
caccgacuugcuguguggaccuggga

SEQ ID NO: 80089 - RNA, 17 nt, Human
caccgagaagaggcggc

SEQ ID NO: 80090 - RNA, 32 nt, Human
caccgagaaguuaaggaacuugcucaagguca

SEQ ID NO: 80091 - RNA, 32 nt, Human
caccgagaggcaggucaagaucugguuccaga

SEQ ID NO: 80092 - RNA, 24 nt, Human
caccgagagggcuggagugcagug

SEQ ID NO: 80093 - RNA, 32 nt, Human
caccgagaucagccgcaagauccggagugcca

SEQ ID NO: 80094 - RNA, 32 nt, Human
caccgagcagaacagaccagagcccaccacac

SEQ ID NO: 80095 - RNA, 32 nt, Human
caccgagccacuggccaugcacaugggcgggg

SEQ ID NO: 80096 - RNA, 32 nt, Human
caccgagcccggcaaaugcgcacgaccuacau

SEQ ID NO: 80097 - RNA, 32 nt, Human
caccgagcccuccagcccccuugucuuggaag

SEQ ID NO: 80098 - RNA, 32 nt, Human
caccgagcggcuccgucuucugcuccucagag

SEQ ID NO: 80099 - RNA, 32 nt, Human
caccgagcuccggggccccacacccgcuacgg

SEQ ID NO: 80100 - RNA, 32 nt, Human
caccgaggaauguuuucaggcacuuuuuauua

SEQ ID NO: 80101 - RNA, 32 nt, Human
caccgaggcaccccucaggccugguggccacu

SEQ ID NO: 80102 - RNA, 32 nt, Human
caccgagggaggccucacaaaccacaggacgc

SEQ ID NO: 80103 - RNA, 32 nt, Human
caccgagggagguggagcuucaggaugccugc

SEQ ID NO: 80104 - RNA, 32 nt, Human
caccgaggugugccacccagcaggugcuggag

SEQ ID NO: 80105 - RNA, 32 nt, Human
caccgaguuaaaucuggcucuguuauauuuuu

SEQ ID NO: 80106 - RNA, 22 nt, Human
caccgaucacaggcuggcccag

SEQ ID NO: 80107 - RNA, 32 nt, Human
caccgaugugcgcacacacagauaugcacaca

SEQ ID NO: 80108 - RNA, 32 nt, Human
caccgauuuauggugcugacaucaguggcucc

SEQ ID NO: 80109 - RNA, 21 nt, Human
caccgcaaccucauccccuca

SEQ ID NO: 80110 - RNA, 25 nt, Human
caccgcaaccuccaccuuccugguu

SEQ ID NO: 80111 - RNA, 24 nt, Human
caccgcaaccucugcuuccuggcu

SEQ ID NO: 80112 - RNA, 32 nt, Human
caccgcaccaggcugcaagauguuuaagaaug

SEQ ID NO: 80113 - RNA, 32 nt, Human
caccgcacccagccagggggaauguucuauaa

SEQ ID NO: 80114 - RNA, 32 nt, Human
caccgcaccuggccagaccgcuucacuuguaa

SEQ ID NO: 80115 - RNA, 32 nt, Human
caccgcaccuggcuaauuuuuguauuuuuagu

SEQ ID NO: 80116 - RNA, 32 nt, Human
caccgcacgaccucacugaguccucacaacaa

SEQ ID NO: 80117 - RNA, 21 nt, Human
caccgcacuccagccugggca

SEQ ID NO: 80118 - RNA, 32 nt, Human
caccgcacugucugccccaaugucuaacaaag

SEQ ID NO: 80119 - RNA, 32 nt, Human
caccgcagacaggaccaggggauuuccaugau

SEQ ID NO: 80120 - RNA, 20 nt, Human
caccgcagaccacuagccca

SEQ ID NO: 80121 - RNA, 20 nt, Human
caccgcagagaagcugagcc

SEQ ID NO: 80122 - RNA, 20 nt, Human
caccgcagcccccuguggcu

SEQ ID NO: 80123 - RNA, 32 nt, Human
caccgcagcuacuccccuuucuuccaaacuuu

SEQ ID NO: 80124 - RNA, 32 nt, Human
caccgcagcuagugggccuggcugggggugca

SEQ ID NO: 80125 - RNA, 32 nt, Human
caccgcagcucgcggaggaucuucccgagccu

SEQ ID NO: 80126 - RNA, 32 nt, Human
caccgcagcucucagacgggcacugaaccugg

SEQ ID NO: 80127 - RNA, 21 nt, Human
caccgcaggagagggcaccug

SEQ ID NO: 80128 - RNA, 31 nt, Human
caccgcaggcacuucugaguaccauuccaug

SEQ ID NO: 80129 - RNA, 32 nt, Human
caccgcaggcagcaguuugcauuuugaaaggu

SEQ ID NO: 80130 - RNA, 32 nt, Human
caccgcaggcagcaguuugcguuuugaaaggu

SEQ ID NO: 80131 - RNA, 32 nt, Human
caccgcagggaucaccugaaguagaggaucuc

SEQ ID NO: 80132 - RNA, 32 nt, Human
caccgcagucaauuuuccgggauugggauaga

SEQ ID NO: 80133 - RNA, 32 nt, Human
caccgcagucaccaccacccgaaaugccacgu

SEQ ID NO: 80134 - RNA, 32 nt, Human
caccgcaugaguugaaucaaaauuuucagauc

SEQ ID NO: 80135 - RNA, 32 nt, Human
caccgcauuccaccugcaucccccacaucacc

SEQ ID NO: 80136 - RNA, 22 nt, Human
caccgcauugaccuccuuggcu

SEQ ID NO: 80137 - RNA, 32 nt, Human
caccgccaacccccugccccaggagcgggccu

SEQ ID NO: 80138 - RNA, 32 nt, Human
caccgccacaaggaggcagggaagaaacccac

SEQ ID NO: 80139 - RNA, 32 nt, Human
caccgccacaugcagucaucaucauguuacuu

SEQ ID NO: 80140 - RNA, 32 nt, Human
caccgccaccgccaccaccgccaccaccacca

SEQ ID NO: 80141 - RNA, 32 nt, Human
caccgccaccgccgccgccaccaggaaggcgg

SEQ ID NO: 80142 - RNA, 32 nt, Human
caccgccaccugcaccugggccuuuuccccaa

SEQ ID NO: 80143 - RNA, 32 nt, Human
caccgccagcaaccugcggccccggagaaggc

SEQ ID NO: 80144 - RNA, 32 nt, Human
caccgccagcaaccugcgggccccggagaagc

SEQ ID NO: 80145 - RNA, 32 nt, Human
caccgccagcaaccuguacggccuggacagga

SEQ ID NO: 80146 - RNA, 18 nt, Human
caccgccagcaagcccag

SEQ ID NO: 80147 - RNA, 32 nt, Human
caccgccagcagcugcuccuccagccacaccc

SEQ ID NO: 80148 - RNA, 32 nt, Human
caccgccagugcugcagagaucaaagaaaucc

SEQ ID NO: 80149 - RNA, 32 nt, Human
caccgccauccuucaccucucccucagccuca

SEQ ID NO: 80150 - RNA, 32 nt, Human
caccgcccagaaccuggcgggugaggucuccu

SEQ ID NO: 80151 - RNA, 19 nt, Human
caccgccccgcccgccguu

SEQ ID NO: 80152 - RNA, 32 nt, Human
caccgccccugccugugcucugccucgggcca

SEQ ID NO: 80153 - RNA, 18 nt, Human
caccgcccugagggcggc

SEQ ID NO: 80154 - RNA, 32 nt, Human
caccgcccugcacccuccacccggccaggccc

SEQ ID NO: 80155 - RNA, 32 nt, Human
caccgcccugcucuuccuaaggggccaggaag

SEQ ID NO: 80156 - RNA, 32 nt, Human
caccgccgagggcuggagcucgccgcccccau

SEQ ID NO: 80157 - RNA, 32 nt, Human
caccgccgccgccgccgccacagccauggccg

SEQ ID NO: 80158 - RNA, 32 nt, Human
caccgccgggucccccggggcugcaguagcag

SEQ ID NO: 80159 - RNA, 32 nt, Human
caccgccuauccugagaacacagucagugagg

SEQ ID NO: 80160 - RNA, 32 nt, Human
caccgccucaacuuguucacauggcauaaaug

SEQ ID NO: 80161 - RNA, 21 nt, Human
caccgccucaccugugucucc

SEQ ID NO: 80162 - RNA, 32 nt, Human
caccgccuccagcuaauuuuuguauuuuuagu

SEQ ID NO: 80163 - RNA, 32 nt, Human
caccgccucccagcgccugccugcuggggcug

SEQ ID NO: 80164 - RNA, 32 nt, Human
caccgccucccaggacaccaaccaugcccuuu

SEQ ID NO: 80165 - RNA, 19 nt, Human
caccgccuccccugccacc

SEQ ID NO: 80166 - RNA, 32 nt, Human
caccgccuccugccucucuccucucuccccag

SEQ ID NO: 80167 - RNA, 21 nt, Human
caccgccuccuucccagcccc

SEQ ID NO: 80168 - RNA, 32 nt, Human
caccgccucucauccucaugaugucccauggu

SEQ ID NO: 80169 - RNA, 32 nt, Human
caccgccugcggcugccugggcuggggcucgc

SEQ ID NO: 80170 - RNA, 32 nt, Human
caccgccugcuguugcccuccucucucggugg

SEQ ID NO: 80171 - RNA, 32 nt, Human
caccgccuggcguucgcuuguggcaguuacua

SEQ ID NO: 80172 - RNA, 21 nt, Human
caccgccuuccucacuccaua

SEQ ID NO: 80173 - RNA, 32 nt, Human
caccgccuugcacauacagaggcuccaggcug

SEQ ID NO: 80174 - RNA, 32 nt, Human
caccgcgaccggcccugcuguugcuucugagg

SEQ ID NO: 80175 - RNA, 32 nt, Human
caccgcgagaugguccccgagcuccccgagag

SEQ ID NO: 80176 - RNA, 32 nt, Human
caccgcgcaagggccccugccucccgggagac

SEQ ID NO: 80177 - RNA, 32 nt, Human
caccgcgcccagagcggccucuccccacgccc

SEQ ID NO: 80178 - RNA, 32 nt, Human
caccgcgcccagcuaauucuuguauuuuuggu

SEQ ID NO: 80179 - RNA, 32 nt, Human
caccgcgcccagcuaauuuuuguauuuuuagu

SEQ ID NO: 80180 - RNA, 32 nt, Human
caccgcgccccagggguuggaggaccuugucu

SEQ ID NO: 80181 - RNA, 32 nt, Human
caccgcgccuauaauccuagcacuuugggagg

SEQ ID NO: 80182 - RNA, 32 nt, Human
caccgcgccuggccaaaaggcauuucauucuu

SEQ ID NO: 80183 - RNA, 32 nt, Human
caccgcgccuggcuaauuuuguauuuuuagua

SEQ ID NO: 80184 - RNA, 32 nt, Human
caccgcgccuggcuaauuuuuguauuuuuagu

SEQ ID NO: 80185 - RNA, 32 nt, Human
caccgcgccuggcuaauuuuuguauuuuugua

SEQ ID NO: 80186 - RNA, 32 nt, Human
caccgcgcucggccagagcucuggguuuuaau

SEQ ID NO: 80187 - RNA, 32 nt, Human
caccgcgcuuuccccuccucagccugggcugu

SEQ ID NO: 80188 - RNA, 32 nt, Human
caccgcggagccggggacagggggagcagggc

SEQ ID NO: 80189 - RNA, 22 nt, Human
caccgcggccagcaggcaccug

SEQ ID NO: 80190 - RNA, 32 nt, Human
caccgcggcccgggacgacagccugggcucag

SEQ ID NO: 80191 - RNA, 32 nt, Human
caccgcggcucgcugggcccaggcuggcucug

SEQ ID NO: 80192 - RNA, 20 nt, Human
caccgcggcuugggggauag

SEQ ID NO: 80193 - RNA, 32 nt, Human
caccgcgggaggccagggugcugacugucaag

SEQ ID NO: 80194 - RNA, 32 nt, Human
caccgcggugggauuccagcugucugauuaau

SEQ ID NO: 80195 - RNA, 32 nt, Human
caccgcgucugccucgugcucuucuugccccu

SEQ ID NO: 80196 - RNA, 21 nt, Human
caccgcguggacaggaacacc

SEQ ID NO: 80197 - RNA, 32 nt, Human
caccgcuacacuccagccugggugacagagug

SEQ ID NO: 80198 - RNA, 32 nt, Human
caccgcuaccaccaccaccaccgccaccacua

SEQ ID NO: 80199 - RNA, 32 nt, Human
caccgcuaccucccucuccccguugaugucca

SEQ ID NO: 80200 - RNA, 32 nt, Human
caccgcuaucucagccacuuucagccuuaugc

SEQ ID NO: 80201 - RNA, 32 nt, Human
caccgcucacugcaagcacugccucccuccgg

SEQ ID NO: 80202 - RNA, 32 nt, Human
caccgcucagccagggugaugggcuggacuga

SEQ ID NO: 80203 - RNA, 23 nt, Human
caccgcucgguccagagggccug

SEQ ID NO: 80204 - RNA, 32 nt, Human
caccgcugacucugagccuuuuuggagucuuu

SEQ ID NO: 80205 - RNA, 32 nt, Human
caccgcugagagcagcugcaguagcugagcag

SEQ ID NO: 80206 - RNA, 32 nt, Human
caccgcugagccuguuucccuuuggagcacuu

SEQ ID NO: 80207 - RNA, 32 nt, Human
caccgcugcacucaagccugggugacagugag

SEQ ID NO: 80208 - RNA, 32 nt, Human
caccgcugcacucaagcuugggugacagagca

SEQ ID NO: 80209 - RNA, 32 nt, Human
caccgcugcacuccaaccugggcaacagagug

SEQ ID NO: 80210 - RNA, 32 nt, Human
caccgcugcacuccagccuggcaacagagcaa

SEQ ID NO: 80211 - RNA, 24 nt, Human
caccgcugcacuccagccugggca

SEQ ID NO: 80212 - RNA, 32 nt, Human
caccgcugcacuccagccugggcaacaagagu

SEQ ID NO: 80213 - RNA, 32 nt, Human
caccgcugcacuccagccugggcaacagagug

SEQ ID NO: 80214 - RNA, 32 nt, Human
caccgcugcacuccagccugggcaagagaaug

SEQ ID NO: 80215 - RNA, 32 nt, Human
caccgcugcacuccagccugggugacagaaug

SEQ ID NO: 80216 - RNA, 32 nt, Human
caccgcugcacuccagccugggugacagagcg

SEQ ID NO: 80217 - RNA, 32 nt, Human
caccgcugcacucgcggccggcgaugcgggac

SEQ ID NO: 80218 - RNA, 32 nt, Human
caccgcugccaccaccaccgccaccaccgcug

SEQ ID NO: 80219 - RNA, 32 nt, Human
caccgcugcccuccagccugggcaacaagagc

SEQ ID NO: 80220 - RNA, 21 nt, Human
caccgcugccuuuugcugcug

SEQ ID NO: 80221 - RNA, 32 nt, Human
caccgcugcucaucuugucccuuuucaauucc

SEQ ID NO: 80222 - RNA, 32 nt, Human
caccgcuggccacuccaaaacgccgccaagug

SEQ ID NO: 80223 - RNA, 32 nt, Human
caccgcuguacuccagccugggcaacagaggg

SEQ ID NO: 80224 - RNA, 32 nt, Human
caccgcuguaggaauccagaugcaggccaagu

SEQ ID NO: 80225 - RNA, 32 nt, Human
caccgcugucggcaccaugggcagugagcaga

SEQ ID NO: 80226 - RNA, 32 nt, Human
caccgcuuccuggggaaccccuucccacacuu

SEQ ID NO: 80227 - RNA, 32 nt, Human
caccggacagcaccuggcugcucaggacgaau

SEQ ID NO: 80228 - RNA, 20 nt, Human
caccggaccagccuggccca

SEQ ID NO: 80229 - RNA, 32 nt, Human
caccggaccuucuguggaacucccgugucggu

SEQ ID NO: 80230 - RNA, 32 nt, Human
caccggacugcagcccaagucuggaccuggcu

SEQ ID NO: 80231 - RNA, 32 nt, Human
caccggagagugagcaggcggagacuccaagc

SEQ ID NO: 80232 - RNA, 32 nt, Human
caccggagcauccugcacugcagggccggucu

SEQ ID NO: 80233 - RNA, 32 nt, Human
caccggagccuagacacauaccugccaaucgc

SEQ ID NO: 80234 - RNA, 32 nt, Human
caccggagccucccccucagaugaucucucca

SEQ ID NO: 80235 - RNA, 32 nt, Human
caccggagccuugccaccaucccaggacuuug

SEQ ID NO: 80236 - RNA, 32 nt, Human
caccggaggagaaagcggucacgcuccgcagc

SEQ ID NO: 80237 - RNA, 32 nt, Human
caccggagggaggaugggaugggcagggaagc

SEQ ID NO: 80238 - RNA, 32 nt, Human
caccggaugccccacugggcccagggaugcac

SEQ ID NO: 80239 - RNA, 32 nt, Human
caccggcagcaccauguugcucauggucguca

SEQ ID NO: 80240 - RNA, 32 nt, Human
caccggcagcccggcgccccagccucuacccg

SEQ ID NO: 80241 - RNA, 32 nt, Human
caccggccacagcugcuccccgugccacucag

SEQ ID NO: 80242 - RNA, 32 nt, Human
caccggccacugcagcccuggugagggcgggu

SEQ ID NO: 80243 - RNA, 32 nt, Human
caccggccacuucucccccguccaucugacca

SEQ ID NO: 80244 - RNA, 22 nt, Human
caccggccccucccucuaccca

SEQ ID NO: 80245 - RNA, 32 nt, Human
caccggcgcggaggcaggaggagcagucucau

SEQ ID NO: 80246 - RNA, 32 nt, Human
caccggcgugccccaccaugucagacgcagcc

SEQ ID NO: 80247 - RNA, 32 nt, Human
caccggcucccaccuggcugggaacaugggag

SEQ ID NO: 80248 - RNA, 32 nt, Human
caccggcuccccaagcccuccccaccaagggg

SEQ ID NO: 80249 - RNA, 32 nt, Human
caccggcuccuuuugcuucuccuuccugcagg

SEQ ID NO: 80250 - RNA, 32 nt, Human
caccggcugagggagaaggugaagcagcagaa

SEQ ID NO: 80251 - RNA, 32 nt, Human
caccggcugccucaugguucucagccacagag

SEQ ID NO: 80252 - RNA, 32 nt, Human
caccggcugcgaggagcagggagcuccucaaa

SEQ ID NO: 80253 - RNA, 32 nt, Human
caccggcuugccuggugguuugcacauuucag

SEQ ID NO: 80254 - RNA, 32 nt, Human
caccgggaucgggcugagcaggagaacaucac

SEQ ID NO: 80255 - RNA, 32 nt, Human
caccgggcaacaacugccauccagccugucgc

SEQ ID NO: 80256 - RNA, 32 nt, Human
caccgggcacaguggcucacacauguuaauuc

SEQ ID NO: 80257 - RNA, 32 nt, Human
caccgggcaggcgccucacagagcacagacgu

SEQ ID NO: 80258 - RNA, 32 nt, Human
caccgggccaggcugcgggugugcaggcgucu

SEQ ID NO: 80259 - RNA, 32 nt, Human
caccgggccauggacuccuguacuggaggaag

SEQ ID NO: 80260 - RNA, 32 nt, Human
caccgggcccugaugauuuuuguauuuuuagu

SEQ ID NO: 80261 - RNA, 32 nt, Human
caccgggccgcucuccuaccucccucucuaug

SEQ ID NO: 80262 - RNA, 32 nt, Human
caccgggcgcccacccuguccuccuccugcgg

SEQ ID NO: 80263 - RNA, 32 nt, Human
caccggggcaggcaaagugcagauguaggagc

SEQ ID NO: 80264 - RNA, 32 nt, Human
caccgggggaggaggaggaggagaagguggag

SEQ ID NO: 80265 - RNA, 21 nt, Human
caccgggucaguccccugcca

SEQ ID NO: 80266 - RNA, 22 nt, Human
caccgguaaucccagcuacuca

SEQ ID NO: 80267 - RNA, 32 nt, Human
caccgguacugaccagcucccguugggccagg

SEQ ID NO: 80268 - RNA, 32 nt, Human
caccgguauggccuggcccugcccucccgaag

SEQ ID NO: 80269 - RNA, 32 nt, Human
caccggucucugcugaggcucccagccucagu

SEQ ID NO: 80270 - RNA, 32 nt, Human
caccggucugcaucucccagcagaaggcgcag

SEQ ID NO: 80271 - RNA, 32 nt, Human
caccggugcagccaggaccacccgcuagguua

SEQ ID NO: 80272 - RNA, 32 nt, Human
caccggugccuccucuggggaagggaaccagc

SEQ ID NO: 80273 - RNA, 32 nt, Human
caccggugguaucuaccccagaugccugccuc

SEQ ID NO: 80274 - RNA, 32 nt, Human
caccgguuaacuguggccugugcccaggaaga

SEQ ID NO: 80275 - RNA, 32 nt, Human
caccgguuuccugcaagaucccuuggccuggc

SEQ ID NO: 80276 - RNA, 32 nt, Human
caccguacagcccaguccacgaagggcgccac

SEQ ID NO: 80277 - RNA, 32 nt, Human
caccguacccagcuaauuuuuguauuuuuagu

SEQ ID NO: 80278 - RNA, 32 nt, Human
caccguaccuggcuaauuuuuguauuuuuagu

SEQ ID NO: 80279 - RNA, 32 nt, Human
caccguagagguggggacaggggcaggggcag

SEQ ID NO: 80280 - RNA, 32 nt, Human
caccguagccugggugauaagagugagacucu

SEQ ID NO: 80281 - RNA, 22 nt, Human
caccguaugcauggccaucucc

SEQ ID NO: 80282 - RNA, 20 nt, Human
caccgucacccacaggggcc

SEQ ID NO: 80283 - RNA, 32 nt, Human
caccgucaccugcugguuggauuccggaaacc

SEQ ID NO: 80284 - RNA, 32 nt, Human
caccgucacugugcaacucaucgccucugcca

SEQ ID NO: 80285 - RNA, 32 nt, Human
caccgucagcucaccaccuccacuuuucucuc

SEQ ID NO: 80286 - RNA, 32 nt, Human
caccguccaacauuccuuguuuguaaguguug

SEQ ID NO: 80287 - RNA, 32 nt, Human
caccguccagagaggccugagggagggauucc

SEQ ID NO: 80288 - RNA, 32 nt, Human
caccgucccacacauugcuguggccccaaccu

SEQ ID NO: 80289 - RNA, 32 nt, Human
caccgucccagcugaagagaggcaugggacug

SEQ ID NO: 80290 - RNA, 32 nt, Human
caccgucccccaggcuggagugccguggcgug

SEQ ID NO: 80291 - RNA, 32 nt, Human
caccgucuacagcagcagcccaggcucaacug

SEQ ID NO: 80292 - RNA, 32 nt, Human
caccgucuagccacaggagaacuaaucuucua

SEQ ID NO: 80293 - RNA, 21 nt, Human
caccgucugucucuuccuuca

SEQ ID NO: 80294 - RNA, 32 nt, Human
caccgucuuaguuuacacaucugccaaagggg

SEQ ID NO: 80295 - RNA, 24 nt, Human
caccgugacacuccagccugggca

SEQ ID NO: 80296 - RNA, 32 nt, Human
caccgugacacuccagccugggcaacagaaga

SEQ ID NO: 80297 - RNA, 24 nt, Human
caccgugaggccaagauccccuca

SEQ ID NO: 80298 - RNA, 32 nt, Human
caccgugaggcucuuuggggaggccgggccag

SEQ ID NO: 80299 - RNA, 31 nt, Human
caccgugcacuucucccuuuccuuaaagaac

SEQ ID NO: 80300 - RNA, 32 nt, Human
caccgugcagcuuuggccugggcacagacccu

SEQ ID NO: 80301 - RNA, 32 nt, Human
caccgugcccagcuaauuuuuguauuuuuagu

SEQ ID NO: 80302 - RNA, 32 nt, Human
caccgugcccagcuaauuuuuguauuuuuguu

SEQ ID NO: 80303 - RNA, 20 nt, Human
caccgugcccggcccauucu

SEQ ID NO: 80304 - RNA, 32 nt, Human
caccgugcccggccuccccugugucauuuuaa

SEQ ID NO: 80305 - RNA, 32 nt, Human
caccgugcccggcuaauguuuguauuuuuagu

SEQ ID NO: 80306 - RNA, 32 nt, Human
caccgugccgaaggagcucugccagugggccu

SEQ ID NO: 80307 - RNA, 32 nt, Human
caccgugccuggccucauuugaguauuuuuau

SEQ ID NO: 80308 - RNA, 32 nt, Human
caccgugccuggccuuuuauuguuuguuuuug

SEQ ID NO: 80309 - RNA, 32 nt, Human
caccgugccugggcccccuccugcuccgcucu

SEQ ID NO: 80310 - RNA, 32 nt, Human
caccgugccuucagaggcuucuuccugccucu

SEQ ID NO: 80311 - RNA, 31 nt, Human
caccgugcuagaggaacuguaaugcuucaga

SEQ ID NO: 80312 - RNA, 32 nt, Human
caccgugcuccugguggggcccgugccagggg

SEQ ID NO: 80313 - RNA, 19 nt, Human
caccguggaccacaggccu

SEQ ID NO: 80314 - RNA, 32 nt, Human
caccguggaggaggaaggcaagagggggugga

SEQ ID NO: 80315 - RNA, 30 nt, Human
caccguggaggccacaggagcagaaacaug

SEQ ID NO: 80316 - RNA, 32 nt, Human
caccguggauguugaagaaggggguuacucaa

SEQ ID NO: 80317 - RNA, 32 nt, Human
caccguggauguuuucagaaguggccaucgag

SEQ ID NO: 80318 - RNA, 32 nt, Human
caccguggcuaccauugucacucguaggggau

SEQ ID NO: 80319 - RNA, 32 nt, Human
caccguggcucacgccuguaaucccagcacuu

SEQ ID NO: 80320 - RNA, 32 nt, Human
caccguggcucacgucuguaaucccagcgcuu

SEQ ID NO: 80321 - RNA, 32 nt, Human
caccguggcucacuccuguaaucccagcacuu

SEQ ID NO: 80322 - RNA, 32 nt, Human
caccguggcuucccuucucccuccaggccaaa

SEQ ID NO: 80323 - RNA, 32 nt, Human
caccgugggaacagcaggcuugggagugcagc

SEQ ID NO: 80324 - RNA, 32 nt, Human
caccgugggagcaauguggcccagguggacuc

SEQ ID NO: 80325 - RNA, 22 nt, Human
caccgugggaggcagaggccug

SEQ ID NO: 80326 - RNA, 32 nt, Human
caccgugggaggcagaggccugggcugcagca

SEQ ID NO: 80327 - RNA, 19 nt, Human
caccgugggcucuggagcc

SEQ ID NO: 80328 - RNA, 21 nt, Human
caccgugggcuggggggccug

SEQ ID NO: 80329 - RNA, 32 nt, Human
caccgugucacacuagcauaggaggcugcacg

SEQ ID NO: 80330 - RNA, 32 nt, Human
caccgugucaguuuuucugccuuucccugcuc

SEQ ID NO: 80331 - RNA, 22 nt, Human
caccgugugagcacagggccug

SEQ ID NO: 80332 - RNA, 32 nt, Human
caccgugugagugcugggcuccagauggcgcc

SEQ ID NO: 80333 - RNA, 32 nt, Human
caccgugugcaggacuccgcgcugggcagggg

SEQ ID NO: 80334 - RNA, 32 nt, Human
caccguguuagccaggcuggucucgaucugac

SEQ ID NO: 80335 - RNA, 32 nt, Human
caccguguugcccaggcuggucgcgaacuccu

SEQ ID NO: 80336 - RNA, 32 nt, Human
caccguguuggccaggcuggucucaaaacucc

SEQ ID NO: 80337 - RNA, 32 nt, Human
caccguguuggccaggcuggucuccaacuccu

SEQ ID NO: 80338 - RNA, 32 nt, Human
caccguguuggccaggcuggucucgaacuccu

SEQ ID NO: 80339 - RNA, 32 nt, Human
caccguguuggccaggcuggucuggaacuccu

SEQ ID NO: 80340 - RNA, 32 nt, Human
caccguuaguuggcaaaggauccugcuugagc

SEQ ID NO: 80341 - RNA, 32 nt, Human
caccguuauagaaugguucauguauguggugu

SEQ ID NO: 80342 - RNA, 32 nt, Human
caccguuauugcaucccugcuguggcucaccu

SEQ ID NO: 80343 - RNA, 32 nt, Human
caccguuccucagugugagcaagauuuggguc

SEQ ID NO: 80344 - RNA, 32 nt, Human
caccguugcccaggcuggagggcagugacgug

SEQ ID NO: 80345 - RNA, 32 nt, Human
caccguuguacuccagccuggugauagaacga

SEQ ID NO: 80346 - RNA, 32 nt, Human
caccguuuacaugucgggaggcugagguggga

SEQ ID NO: 80347 - RNA, 32 nt, Human
caccguuuaccucccucgcccugccccgcacc

SEQ ID NO: 80348 - RNA, 32 nt, Human
caccguuuucaucagucacucacaugugcuca

SEQ ID NO: 80349 - RNA, 32 nt, Human
caccguuuugcccaggcuggucucaaacuccu

SEQ ID NO: 80350 - RNA, 32 nt, Human
caccuaaaccaccagugcccaaagucugugug

SEQ ID NO: 80351 - RNA, 21 nt, Human
caccuaacccugacuccuuca

SEQ ID NO: 80352 - RNA, 18 nt, Human
caccuaacuagagacagu

SEQ ID NO: 80353 - RNA, 32 nt, Human
caccuaacucccuccuccuucuccuuuuuccu

SEQ ID NO: 80354 - RNA, 20 nt, Human
caccuaagagacggcugcgg

SEQ ID NO: 80355 - RNA, 32 nt, Human
caccuaaggcaaaucccuggccacuuuagucu

SEQ ID NO: 80356 - RNA, 32 nt, Human
caccuaaggcuggaugggaaagugcagucuug

SEQ ID NO: 80357 - RNA, 32 nt, Human
caccuaaggggacuuccuuacaacaccuugaa

SEQ ID NO: 80358 - RNA, 32 nt, Human
caccuaauaaggccauuagcucuggcuccuuc

SEQ ID NO: 80359 - RNA, 32 nt, Human
caccuaaucuguccucaaggacagaaccaugu

SEQ ID NO: 80360 - RNA, 32 nt, Human
caccuacaauaauuccaaaagguuugcacauu

SEQ ID NO: 80361 - RNA, 32 nt, Human
caccuacacagcaugaauuauucauaagucau

SEQ ID NO: 80362 - RNA, 32 nt, Human
caccuacaccugccuggcugagaaugccuugg

SEQ ID NO: 80363 - RNA, 32 nt, Human
caccuacagauuuuggguagaucuucucuucc

SEQ ID NO: 80364 - RNA, 32 nt, Human
caccuacaguccugcauguaguuggugcucac

SEQ ID NO: 80365 - RNA, 32 nt, Human
caccuacauacguaaccaaauuuucaggcuug

SEQ ID NO: 80366 - RNA, 32 nt, Human
caccuacauaugcccccaacacacgcgcacgg

SEQ ID NO: 80367 - RNA, 32 nt, Human
caccuaccaccagggccagcuaauuuuuguau

SEQ ID NO: 80368 - RNA, 21 nt, Human
caccuaccacccaaguccuca

SEQ ID NO: 80369 - RNA, 32 nt, Human
caccuaccccacugagaccaccucucagggug

SEQ ID NO: 80370 - RNA, 32 nt, Human
caccuacccugccucagccucggacuucucag

SEQ ID NO: 80371 - RNA, 32 nt, Human
caccuacgcugaggugaccaaugucuccaacu

SEQ ID NO: 80372 - RNA, 21 nt, Human
caccuacuacuccugcugcug

SEQ ID NO: 80373 - RNA, 32 nt, Human
caccuacucccaggaacagcagagguggaggc

SEQ ID NO: 80374 - RNA, 32 nt, Human
caccuacucuucugugaacaguagugacuuuu

SEQ ID NO: 80375 - RNA, 32 nt, Human
caccuacugacacucgauuuaggccagaccag

SEQ ID NO: 80376 - RNA, 32 nt, Human
caccuacugcaugcugugucccugcauacagg

SEQ ID NO: 80377 - RNA, 32 nt, Human
caccuacugugugcacagcacuacugguaaaa

SEQ ID NO: 80378 - RNA, 32 nt, Human
caccuacuuacaugcauuacugcaugcacuuc

SEQ ID NO: 80379 - RNA, 19 nt, Human
caccuacuucagcagguca

SEQ ID NO: 80380 - RNA, 32 nt, Human
caccuacuugcucaggcaggugcucuggucuc

SEQ ID NO: 80381 - RNA, 32 nt, Human
caccuacuuucagcuucaaccccaggcccuca

SEQ ID NO: 80382 - RNA, 32 nt, Human
caccuagaacugcagaagggcuugugguuuca

SEQ ID NO: 80383 - RNA, 19 nt, Human
caccuagacugccugcuga

SEQ ID NO: 80384 - RNA, 32 nt, Human
caccuagagauggaaacaggcaaguaacugac

SEQ ID NO: 80385 - RNA, 32 nt, Human
caccuagagcugucugugccucucugggagaa

SEQ ID NO: 80386 - RNA, 32 nt, Human
caccuagaguuuggacuuccagcuuccagaac

SEQ ID NO: 80387 - RNA, 32 nt, Human
caccuagauuacagccaggaacauugguuaag

SEQ ID NO: 80388 - RNA, 32 nt, Human
caccuagcccuaucaagccaaagauuccccuu

SEQ ID NO: 80389 - RNA, 32 nt, Human
caccuagcucgccagagagucuauguauggga

SEQ ID NO: 80390 - RNA, 32 nt, Human
caccuaggaagugguagaauuagauuucagau

SEQ ID NO: 80391 - RNA, 32 nt, Human
caccuaggacuugcccaagaccacagccaggu

SEQ ID NO: 80392 - RNA, 32 nt, Human
caccuaggcuggaguugcagugguuugaucuc

SEQ ID NO: 80393 - RNA, 32 nt, Human
caccuaggucaagaguuucaaaccagacgggc

SEQ ID NO: 80394 - RNA, 20 nt, Human
caccuagguuuggcuuagca

SEQ ID NO: 80395 - RNA, 32 nt, Human
caccuaguagcuuguuagaaagguagaaucuu

SEQ ID NO: 80396 - RNA, 32 nt, Human
caccuagucuccuaauuccuguccugcauagc

SEQ ID NO: 80397 - RNA, 32 nt, Human
caccuaguguauggcucaugcccagccuucca

SEQ ID NO: 80398 - RNA, 32 nt, Human
caccuaguuauccccaaagccuauuucuucug

SEQ ID NO: 80399 - RNA, 22 nt, Human
caccuauaaacccagcuacuca

SEQ ID NO: 80400 - RNA, 22 nt, Human
caccuauaaucucagcuacuca

SEQ ID NO: 80401 - RNA, 32 nt, Human
caccuauacucaccugccuuuauuaaccagca

SEQ ID NO: 80402 - RNA, 32 nt, Human
caccuauauucccugguuaagaggucaggggu

SEQ ID NO: 80403 - RNA, 32 nt, Human
caccuaucacccaggcuggaguggaguggcac

SEQ ID NO: 80404 - RNA, 32 nt, Human
caccuauccagcuucuggcuccugggaaaagu

SEQ ID NO: 80405 - RNA, 32 nt, Human
caccuauccaggcauccucugggccucuagcc

SEQ ID NO: 80406 - RNA, 32 nt, Human
caccuauccuucugaagagcugaaggcuaauu

SEQ ID NO: 80407 - RNA, 32 nt, Human
caccuaucuacuccugagcuuccccaacagga

SEQ ID NO: 80408 - RNA, 32 nt, Human
caccuaucuggaccaggugaagauccgcuuug

SEQ ID NO: 80409 - RNA, 32 nt, Human
caccuaucuucugcagggcccugagauggggu

SEQ ID NO: 80410 - RNA, 19 nt, Human
caccuaugacaagagcagu

SEQ ID NO: 80411 - RNA, 32 nt, Human
caccuaugacaggacgugggaaagcauuuugu

SEQ ID NO: 80412 - RNA, 32 nt, Human
caccuaugcggcgagccucgggccaagaccuc

SEQ ID NO: 80413 - RNA, 32 nt, Human
caccuaugcugaggugaccaauguuuccaacu

SEQ ID NO: 80414 - RNA, 20 nt, Human
caccuauggugaccugaacc

SEQ ID NO: 80415 - RNA, 32 nt, Human
caccuaugugccagggccuggugccauguugg

SEQ ID NO: 80416 - RNA, 32 nt, Human
caccucaagcccuauucacaggcaccaggaaa

SEQ ID NO: 80417 - RNA, 31 nt, Human
caccucaaggaucauugcacagcagaaguga

SEQ ID NO: 80418 - RNA, 32 nt, Human
caccucaagucccuccuggaagggagccagag

SEQ ID NO: 80419 - RNA, 32 nt, Human
caccucaaucuacaccagagcccagggagucc

SEQ ID NO: 80420 - RNA, 32 nt, Human
caccucaauguagguacauuacacucuuguug

SEQ ID NO: 80421 - RNA, 32 nt, Human
caccucacaggaacuguucaguucccacccuc

SEQ ID NO: 80422 - RNA, 32 nt, Human
caccucacaggguuguugugaggauccaauga

SEQ ID NO: 80423 - RNA, 25 nt, Human
caccucacauauguccaguuaaaca

SEQ ID NO: 80424 - RNA, 20 nt, Human
caccucaccauguuuacaaa

SEQ ID NO: 80425 - RNA, 32 nt, Human
caccucacccagcuaauuuuuguauuuucagu

SEQ ID NO: 80426 - RNA, 32 nt, Human
caccucacccuuuuccaacuugcccagggaag

SEQ ID NO: 80427 - RNA, 21 nt, Human
caccucaccucccccaggaca

SEQ ID NO: 80428 - RNA, 32 nt, Human
caccucaccucuccuuccccauugugccgccu

SEQ ID NO: 80429 - RNA, 32 nt, Human
caccucaccugagaccuccacuccacaucugc

SEQ ID NO: 80430 - RNA, 32 nt, Human
caccucaccugucgcacccacugugaaaguug

SEQ ID NO: 80431 - RNA, 32 nt, Human
caccucaccugugcugccacuuccuagugcac

SEQ ID NO: 80432 - RNA, 32 nt, Human
caccucacgcuggagcuggagugcgagguucu

SEQ ID NO: 80433 - RNA, 32 nt, Human
caccucacugagccaccuccauuucuucaucu

SEQ ID NO: 80434 - RNA, 32 nt, Human
caccucacugcaaccuccaccuccuagguuca

SEQ ID NO: 80435 - RNA, 32 nt, Human
caccucacugcaaccuccgccuccuggguuca

SEQ ID NO: 80436 - RNA, 32 nt, Human
caccucacugcaaccucugccucccgggucca

SEQ ID NO: 80437 - RNA, 32 nt, Human
caccucacugcaagcucugccucccgggcuca

SEQ ID NO: 80438 - RNA, 32 nt, Human
caccucacugcacgcuagccugggcaacagau

SEQ ID NO: 80439 - RNA, 32 nt, Human
caccucacuuuucacagccucugagggcagca

SEQ ID NO: 80440 - RNA, 32 nt, Human
caccucagaagcuuccugcccagagagccagc

SEQ ID NO: 80441 - RNA, 32 nt, Human
caccucagaauuuccuucagugccucagagau

SEQ ID NO: 80442 - RNA, 32 nt, Human
caccucagacacaccauuucaccucccuugcc

SEQ ID NO: 80443 - RNA, 32 nt, Human
caccucagaguagauuguagccugccaaagga

SEQ ID NO: 80444 - RNA, 32 nt, Human
caccucagaguguggcuguaccacauucggug

SEQ ID NO: 80445 - RNA, 32 nt, Human
caccucagccuccagaguagcuggaaauacag

SEQ ID NO: 80446 - RNA, 32 nt, Human
caccucagccucccaaagugcugguauuacag

SEQ ID NO: 80447 - RNA, 32 nt, Human
caccucagccucccaaagugcuuggaugacag

SEQ ID NO: 80448 - RNA, 32 nt, Human
caccucagccucccaaguagcuuggacuauag

SEQ ID NO: 80449 - RNA, 32 nt, Human
caccucagccucccgaguaguggaucuaggau

SEQ ID NO: 80450 - RNA, 32 nt, Human
caccucagccucccgaguugaguaacugggac

SEQ ID NO: 80451 - RNA, 32 nt, Human
caccucagccuccgcuccccgcccucuucccg

SEQ ID NO: 80452 - RNA, 32 nt, Human
caccucagccuccucucucuccuuccuccaac

SEQ ID NO: 80453 - RNA, 32 nt, Human
caccucagccuccugaguagcugagaccacag

SEQ ID NO: 80454 - RNA, 32 nt, Human
caccucagccuccugaguagcugggaccauag

SEQ ID NO: 80455 - RNA, 32 nt, Human
caccucagccuccugaguagcugggacuagag

SEQ ID NO: 80456 - RNA, 32 nt, Human
caccucagccuccugaguagcugggauuacag

SEQ ID NO: 80457 - RNA, 32 nt, Human
caccucagccuccugaguagcugggauuauag

SEQ ID NO: 80458 - RNA, 32 nt, Human
caccucagccuccugaguaggugggauuacag

SEQ ID NO: 80459 - RNA, 32 nt, Human
caccucagccucucaaguagcugggacuacag

SEQ ID NO: 80460 - RNA, 32 nt, Human
caccucagccuuccaaagugcugguauuacag

SEQ ID NO: 80461 - RNA, 32 nt, Human
caccucagcgggccagcagcccagggaacccc

SEQ ID NO: 80462 - RNA, 32 nt, Human
caccucagcuuccugaguaggugggacuacag

SEQ ID NO: 80463 - RNA, 32 nt, Human
caccucaggaaaggagggugaccagguugucu

SEQ ID NO: 80464 - RNA, 32 nt, Human
caccucaggaagggauugaggguugugaauag

SEQ ID NO: 80465 - RNA, 32 nt, Human
caccucaggaagugcugggauuacaggcgugu

SEQ ID NO: 80466 - RNA, 32 nt, Human
caccucaggaggcugaggcaggagaaucgcuu

SEQ ID NO: 80467 - RNA, 32 nt, Human
caccucaggaucuuguuaaaaugcagauucug

SEQ ID NO: 80468 - RNA, 32 nt, Human
caccucaggccccagccccugccucuccauua

SEQ ID NO: 80469 - RNA, 32 nt, Human
caccucaggccgcugcucagaugccucugcug

SEQ ID NO: 80470 - RNA, 32 nt, Human
caccucaggcuaaauggcaaaaccccaaucuc

SEQ ID NO: 80471 - RNA, 32 nt, Human
caccucaguccagccaaaauguuuagaaacac

SEQ ID NO: 80472 - RNA, 32 nt, Human
caccucagucuccugaguagcuaggacuacag

SEQ ID NO: 80473 - RNA, 32 nt, Human
caccucagucuccugaguagcugagacuacag

SEQ ID NO: 80474 - RNA, 32 nt, Human
caccucagugcugggcaggggcaucagaaggu

SEQ ID NO: 80475 - RNA, 19 nt, Human
caccucagugggauaggaa

SEQ ID NO: 80476 - RNA, 26 nt, Human
caccucaucagggaagucuguacaga

SEQ ID NO: 80477 - RNA, 32 nt, Human
caccucaucaugagccucaacugccuacaucu

SEQ ID NO: 80478 - RNA, 32 nt, Human
caccucauccuccacccaccagagagauggga

SEQ ID NO: 80479 - RNA, 32 nt, Human
caccucauccuggcucagccuggugauggaga

SEQ ID NO: 80480 - RNA, 32 nt, Human
caccucaucucuagguugaauuuauccaaggu

SEQ ID NO: 80481 - RNA, 32 nt, Human
caccucaucuuccccuccuggcuggaggcugg

SEQ ID NO: 80482 - RNA, 32 nt, Human
caccucaugcaggugaagccacuguggaaaca

SEQ ID NO: 80483 - RNA, 32 nt, Human
caccucaugccaccgccaacccccugccccag

SEQ ID NO: 80484 - RNA, 21 nt, Human
caccucaugccuuccauuaaa

SEQ ID NO: 80485 - RNA, 32 nt, Human
caccucaugcuagccucaauaaaccagaauaa

SEQ ID NO: 80486 - RNA, 19 nt, Human
caccucauuaacuuacaaa

SEQ ID NO: 80487 - RNA, 32 nt, Human
caccucauuaagaugcugggcagcaguauaac

SEQ ID NO: 80488 - RNA, 32 nt, Human
caccucauugcaaccuccgccucccggguucg

SEQ ID NO: 80489 - RNA, 32 nt, Human
caccucauuuccauuucagucuggggacccca

SEQ ID NO: 80490 - RNA, 32 nt, Human
caccucauuuguggaaaagccucuuuguuauc

SEQ ID NO: 80491 - RNA, 18 nt, Human
caccucauuuuuuacaaa

SEQ ID NO: 80492 - RNA, 31 nt, Human
caccuccaaauaaauugauguugaaauucug

SEQ ID NO: 80493 - RNA, 32 nt, Human
caccuccaaguuuuaccuccugugucuuccuc

SEQ ID NO: 80494 - RNA, 32 nt, Human
caccuccacaaacaaaacucuucggaaauggu

SEQ ID NO: 80495 - RNA, 32 nt, Human
caccuccacaaccaccaccacaagugcacuug

SEQ ID NO: 80496 - RNA, 24 nt, Human
caccuccacacucccaaccacuga

SEQ ID NO: 80497 - RNA, 32 nt, Human
caccuccacagugggagccagccagacaucuc

SEQ ID NO: 80498 - RNA, 32 nt, Human
caccuccacaugcuccgccuccaggucccgcu

SEQ ID NO: 80499 - RNA, 32 nt, Human
caccuccaccaccaccaccaccaccaccacca

SEQ ID NO: 80500 - RNA, 32 nt, Human
caccuccaccgccaccuccaccuccggcaccc

SEQ ID NO: 80501 - RNA, 32 nt, Human
caccuccacuccuaggcuuuucugccuagagc

SEQ ID NO: 80502 - RNA, 32 nt, Human
caccuccacugcacaacucgggcgggggugug

SEQ ID NO: 80503 - RNA, 32 nt, Human
caccuccacuuccugguaaugucucuccgagg

SEQ ID NO: 80504 - RNA, 32 nt, Human
caccuccaggagaugcaaaaggaauuagaacu

SEQ ID NO: 80505 - RNA, 31 nt, Human
caccuccaggcagacccaucacuggaagugg

SEQ ID NO: 80506 - RNA, 32 nt, Human
caccuccaggcaggccaggcugccucggacuc

SEQ ID NO: 80507 - RNA, 32 nt, Human
caccuccaggcaggcucugugcaguacucacc

SEQ ID NO: 80508 - RNA, 32 nt, Human
caccuccagggacaaagaggagcugcuguggg

SEQ ID NO: 80509 - RNA, 32 nt, Human
caccuccagggagcacccugcccaccaagaag

SEQ ID NO: 80510 - RNA, 32 nt, Human
caccuccagguggacugcuuggcagugcuagg

SEQ ID NO: 80511 - RNA, 32 nt, Human
caccuccaucgagggccggucuccugcuucuu

SEQ ID NO: 80512 - RNA, 32 nt, Human
caccuccaucuucuuugcagccuggguggcua

SEQ ID NO: 80513 - RNA, 32 nt, Human
caccuccaugccacugccagagcuggccuagc

SEQ ID NO: 80514 - RNA, 21 nt, Human
caccuccauguggacuuagga

SEQ ID NO: 80515 - RNA, 32 nt, Human
caccuccauuagcucuuuaccuuuugaggagg

SEQ ID NO: 80516 - RNA, 32 nt, Human
caccuccauucucuaccucccaugcagcauga

SEQ ID NO: 80517 - RNA, 32 nt, Human
caccuccauugagcuuccgggacaugcguggc

SEQ ID NO: 80518 - RNA, 32 nt, Human
caccuccauuggagggcaggacucuugauugu

SEQ ID NO: 80519 - RNA, 32 nt, Human
caccucccaaaaugcugagauuacagguguga

SEQ ID NO: 80520 - RNA, 32 nt, Human
caccucccaaacugcugggauuacagguguga

SEQ ID NO: 80521 - RNA, 32 nt, Human
caccucccaaaguacugggauuacaggcauga

SEQ ID NO: 80522 - RNA, 32 nt, Human
caccucccaaagugcuaggauuacaggcguga

SEQ ID NO: 80523 - RNA, 32 nt, Human
caccucccaaagugcugggauuacaggcguga

SEQ ID NO: 80524 - RNA, 32 nt, Human
caccucccaaaguguugugauuacaggcguga

SEQ ID NO: 80525 - RNA, 32 nt, Human
caccucccaaggugcugggauuacaggcauaa

SEQ ID NO: 80526 - RNA, 32 nt, Human
caccucccaagguguugggauuacaggcguga

SEQ ID NO: 80527 - RNA, 32 nt, Human
caccucccaccaaccaaccacacccggugggg

SEQ ID NO: 80528 - RNA, 32 nt, Human
caccucccaccaaccagccacacccagugggg

SEQ ID NO: 80529 - RNA, 32 nt, Human
caccucccaccaaccagccacacccggugggg

SEQ ID NO: 80530 - RNA, 20 nt, Human
caccucccacccaccacaga

SEQ ID NO: 80531 - RNA, 32 nt, Human
caccucccaccucucugagggcugaggugaga

SEQ ID NO: 80532 - RNA, 32 nt, Human
caccucccaccucuugccaccugcugcugcua

SEQ ID NO: 80533 - RNA, 32 nt, Human
caccucccaccugcauugcucucccucgugcu

SEQ ID NO: 80534 - RNA, 32 nt, Human
caccucccacgguggucaccaugccaaugaag

SEQ ID NO: 80535 - RNA, 32 nt, Human
caccucccagaaccccacggggacuuguucac

SEQ ID NO: 80536 - RNA, 21 nt, Human
caccucccagggcacgguggg

SEQ ID NO: 80537 - RNA, 32 nt, Human
caccucccagggugcugggauuacagguguga

SEQ ID NO: 80538 - RNA, 32 nt, Human
caccucccauaguauucauuuggcuucgcugu

SEQ ID NO: 80539 - RNA, 32 nt, Human
caccuccccacacccauugagucauucacagg

SEQ ID NO: 80540 - RNA, 32 nt, Human
caccuccccaguugucugcuguguggacuggg

SEQ ID NO: 80541 - RNA, 32 nt, Human
caccuccccauccccuguucucccucuguugc

SEQ ID NO: 80542 - RNA, 32 nt, Human
caccucccccacugcugcccuccugucgagaa

SEQ ID NO: 80543 - RNA, 21 nt, Human
caccucccccaggacauuugg

SEQ ID NO: 80544 - RNA, 32 nt, Human
caccucccccaggagaccguugcagucggcca

SEQ ID NO: 80545 - RNA, 18 nt, Human
caccuccccccaccacag

SEQ ID NO: 80546 - RNA, 19 nt, Human
caccucccccugccacaga

SEQ ID NO: 80547 - RNA, 21 nt, Human
caccucccccugcugcugcug

SEQ ID NO: 80548 - RNA, 32 nt, Human
caccuccccgggcugugcagcccccucccagg

SEQ ID NO: 80549 - RNA, 32 nt, Human
caccuccccuccccacagccuuccucacccuu

SEQ ID NO: 80550 - RNA, 32 nt, Human
caccuccccugccacagacucucccucuucug

SEQ ID NO: 80551 - RNA, 32 nt, Human
caccuccccuggcucagucacacagcugugug

SEQ ID NO: 80552 - RNA, 32 nt, Human
caccuccccuguaucugcagcacuuugagcua

SEQ ID NO: 80553 - RNA, 23 nt, Human
caccucccgacaccugcucacca

SEQ ID NO: 80554 - RNA, 32 nt, Human
caccucccgcagugcugggauuacaggcauga

SEQ ID NO: 80555 - RNA, 18 nt, Human
caccucccgcuaggccca

SEQ ID NO: 80556 - RNA, 32 nt, Human
caccucccuccaggagaucccagggugcaaag

SEQ ID NO: 80557 - RNA, 32 nt, Human
caccucccuccccacaccucccuacuccccug

SEQ ID NO: 80558 - RNA, 32 nt, Human
caccucccuccccuagagcuauucuccuuugg

SEQ ID NO: 80559 - RNA, 32 nt, Human
caccucccucucuuccugauccuucccaccca

SEQ ID NO: 80560 - RNA, 32 nt, Human
caccucccugaaccaucccugaugucugucug

SEQ ID NO: 80561 - RNA, 32 nt, Human
caccucccugcaccccuccccucuauagagca

SEQ ID NO: 80562 - RNA, 32 nt, Human
caccucccugcacuuguagucuaaaaaguaaa

SEQ ID NO: 80563 - RNA, 32 nt, Human
caccucccugcucagugcuugggcuccacggg

SEQ ID NO: 80564 - RNA, 32 nt, Human
caccucccugcucuucugcacuccuggacaca

SEQ ID NO: 80565 - RNA, 32 nt, Human
caccucccugcugccccucccucucucucccu

SEQ ID NO: 80566 - RNA, 32 nt, Human
caccuccguccggaacaccaccuccaccgggc

SEQ ID NO: 80567 - RNA, 32 nt, Human
caccuccgucugagcaggaggagcacucaagg

SEQ ID NO: 80568 - RNA, 32 nt, Human
caccuccgugcacuuguguccgaggagcgagg

SEQ ID NO: 80569 - RNA, 32 nt, Human
caccuccuacagccuuaagucccaggcccaug

SEQ ID NO: 80570 - RNA, 32 nt, Human
caccuccucauuguauccucagggggcagaaa

SEQ ID NO: 80571 - RNA, 32 nt, Human
caccuccuccagcuccgccaucuugcgugagg

SEQ ID NO: 80572 - RNA, 32 nt, Human
caccuccuccaggaaguccucuggauugacuc

SEQ ID NO: 80573 - RNA, 32 nt, Human
caccuccuccaggacaacacucucucuguggg

SEQ ID NO: 80574 - RNA, 32 nt, Human
caccuccuccaucuccggcuccugggcuuggg

SEQ ID NO: 80575 - RNA, 32 nt, Human
caccuccucccaggcuccugggaagcaccuga

SEQ ID NO: 80576 - RNA, 32 nt, Human
caccuccuccccuccccacuugagaccugcug

SEQ ID NO: 80577 - RNA, 32 nt, Human
caccuccucccuaucccaggccuguguaaacg

SEQ ID NO: 80578 - RNA, 32 nt, Human
caccuccucccuucccuccuccuuccucaucc

SEQ ID NO: 80579 - RNA, 32 nt, Human
caccuccuccuccuucugcauuuccuaucuuc

SEQ ID NO: 80580 - RNA, 32 nt, Human
caccuccucuacuuuaacugugcucucaggug

SEQ ID NO: 80581 - RNA, 32 nt, Human
caccuccucucaggccuaucuuuugcuguguu

SEQ ID NO: 80582 - RNA, 32 nt, Human
caccuccucugauaugcugaggccaguguugg

SEQ ID NO: 80583 - RNA, 17 nt, Human
caccuccucuguucuga

SEQ ID NO: 80584 - RNA, 32 nt, Human
caccuccugacaccuccauauaccccagcuau

SEQ ID NO: 80585 - RNA, 32 nt, Human
caccuccugaguagcugggacuacaguugugc

SEQ ID NO: 80586 - RNA, 32 nt, Human
caccuccugaucucagguucugaggcggcugu

SEQ ID NO: 80587 - RNA, 20 nt, Human
caccuccugcaacgaccuca

SEQ ID NO: 80588 - RNA, 32 nt, Human
caccuccugcagcguccagccacggcuccagg

SEQ ID NO: 80589 - RNA, 24 nt, Human
caccuccugccaccacagggccug

SEQ ID NO: 80590 - RNA, 32 nt, Human
caccuccugccuggaaucuugccaucagcaac

SEQ ID NO: 80591 - RNA, 32 nt, Human
caccuccugcggcagaacagcacccgugaccc

SEQ ID NO: 80592 - RNA, 32 nt, Human
caccuccugcuguguggcccgguuccuaacag

SEQ ID NO: 80593 - RNA, 32 nt, Human
caccuccuggaacacaagccuaggugaggccc

SEQ ID NO: 80594 - RNA, 32 nt, Human
caccuccuggaggucaagaagagcagaguccc

SEQ ID NO: 80595 - RNA, 32 nt, Human
caccuccugggagcaggcacgucuuuuggcuc

SEQ ID NO: 80596 - RNA, 32 nt, Human
caccuccugggagcaggugggucucugggacg

SEQ ID NO: 80597 - RNA, 18 nt, Human
caccuccuguauaggaag

SEQ ID NO: 80598 - RNA, 32 nt, Human
caccuccuguuuggcccuggagaauguagucc

SEQ ID NO: 80599 - RNA, 18 nt, Human
caccuccuuaccuacugg

SEQ ID NO: 80600 - RNA, 32 nt, Human
caccuccuuagcaacacugauuuucuguaucg

SEQ ID NO: 80601 - RNA, 32 nt, Human
caccuccuuccagguucuggcuccuuccagcc

SEQ ID NO: 80602 - RNA, 32 nt, Human
caccuccuucgccacuccaccagccuggaccu

SEQ ID NO: 80603 - RNA, 21 nt, Human
caccuccuucggagccacaga

SEQ ID NO: 80604 - RNA, 32 nt, Human
caccuccuugcucuccccagccugccaagccc

SEQ ID NO: 80605 - RNA, 19 nt, Human
caccuccuuggaaccacag

SEQ ID NO: 80606 - RNA, 32 nt, Human
caccuccuuuaucccucuccccagaaucauga

SEQ ID NO: 80607 - RNA, 32 nt, Human
caccuccuuuucucccccuucucucccuuucu

SEQ ID NO: 80608 - RNA, 32 nt, Human
caccucgagacaccucccagaccccacauccc

SEQ ID NO: 80609 - RNA, 32 nt, Human
caccucgagcuaugcaaccucuguucuuguau

SEQ ID NO: 80610 - RNA, 32 nt, Human
caccucgauuucuucuuggugaguccauggga

SEQ ID NO: 80611 - RNA, 32 nt, Human
caccucgcacacagcuaaggucaaaguucaaa

SEQ ID NO: 80612 - RNA, 32 nt, Human
caccucgcggagugccaggauuacagguggcg

SEQ ID NO: 80613 - RNA, 32 nt, Human
caccucgcugggcuaauuuuugauuuguaauu

SEQ ID NO: 80614 - RNA, 23 nt, Human
caccucgcuggggcaggggcacc

SEQ ID NO: 80615 - RNA, 32 nt, Human
caccucgcuugcagcacagggcuucugugagg

SEQ ID NO: 80616 - RNA, 18 nt, Human
caccucggaucccacuga

SEQ ID NO: 80617 - RNA, 32 nt, Human
caccucggccucccaaagugcuguaauuacag

SEQ ID NO: 80618 - RNA, 32 nt, Human
caccucggccuggguacggaugcgacuuggau

SEQ ID NO: 80619 - RNA, 32 nt, Human
caccucggcugccucccccacuccacugugca

SEQ ID NO: 80620 - RNA, 32 nt, Human
caccucgggcacaucgcaugcacucagagcac

SEQ ID NO: 80621 - RNA, 32 nt, Human
caccucgucucccuggugccucugugcacagu

SEQ ID NO: 80622 - RNA, 22 nt, Human
caccucgugauccgcccgccuc

SEQ ID NO: 80623 - RNA, 32 nt, Human
caccucguuagaaaauuccucccagucagggg

SEQ ID NO: 80624 - RNA, 32 nt, Human
caccucuaacuccuccuccuccucucuucucc

SEQ ID NO: 80625 - RNA, 32 nt, Human
caccucuaaucaugugcuccucuccuucccaa

SEQ ID NO: 80626 - RNA, 32 nt, Human
caccucuacaaaaaguacaaaaauuagucggg

SEQ ID NO: 80627 - RNA, 32 nt, Human
caccucuacuaaaaauacaaaaauuagccagg

SEQ ID NO: 80628 - RNA, 32 nt, Human
caccucuacuaaaaauacaaaaauuggucggg

SEQ ID NO: 80629 - RNA, 32 nt, Human
caccucuacuccacguaccccaaaaagauaag

SEQ ID NO: 80630 - RNA, 32 nt, Human
caccucuagauagcaaauagcucucagauggu

SEQ ID NO: 80631 - RNA, 23 nt, Human
caccucuaggaggcagccccuag

SEQ ID NO: 80632 - RNA, 23 nt, Human
caccucuaggccccaaccacgga

SEQ ID NO: 80633 - RNA, 32 nt, Human
caccucuagugacccaggcuggcugagagccu

SEQ ID NO: 80634 - RNA, 25 nt, Human
caccucuauaccuugccugugccuu

SEQ ID NO: 80635 - RNA, 32 nt, Human
caccucuauccaccccauaaggucccuacagc

SEQ ID NO: 80636 - RNA, 32 nt, Human
caccucuauuaaaaauacaaaaauuagccggg

SEQ ID NO: 80637 - RNA, 32 nt, Human
caccucucaauaggaggaaguaaaggaaauuu

SEQ ID NO: 80638 - RNA, 32 nt, Human
caccucucacaucuuauagaucuauaagauca

SEQ ID NO: 80639 - RNA, 32 nt, Human
caccucucagccagugccagcugggugggucu

SEQ ID NO: 80640 - RNA, 32 nt, Human
caccucucagccuccagaucccuuccugccca

SEQ ID NO: 80641 - RNA, 32 nt, Human
caccucucaggagaagccagaggcccuggcca

SEQ ID NO: 80642 - RNA, 32 nt, Human
caccucuccacagggccagcuccuuagggaua

SEQ ID NO: 80643 - RNA, 32 nt, Human
caccucuccaggcucugcucugcagcacaccc

SEQ ID NO: 80644 - RNA, 32 nt, Human
caccucuccaggcucugcucuguagcacaccc

SEQ ID NO: 80645 - RNA, 28 nt, Human
caccucuccagugcugccugcagucagc

SEQ ID NO: 80646 - RNA, 32 nt, Human
caccucuccauccuggggccaggacucuuaug

SEQ ID NO: 80647 - RNA, 19 nt, Human
caccucuccccagcccagg

SEQ ID NO: 80648 - RNA, 32 nt, Human
caccucucccuccccucuccucuccuccccuu

SEQ ID NO: 80649 - RNA, 32 nt, Human
caccucucccuuucucccuugucucccuugag

SEQ ID NO: 80650 - RNA, 32 nt, Human
caccucuccggcugccccugccucccaucaca

SEQ ID NO: 80651 - RNA, 32 nt, Human
caccucuccuccccucuccucaguuuugccga

SEQ ID NO: 80652 - RNA, 32 nt, Human
caccucuccucuguccuugcugccucagaguc

SEQ ID NO: 80653 - RNA, 32 nt, Human
caccucuccuuuggagccaccuugucccuggc

SEQ ID NO: 80654 - RNA, 32 nt, Human
caccucucuccagcaaaggacaccugcagaga

SEQ ID NO: 80655 - RNA, 32 nt, Human
caccucucuccaggaucucugcugucucuugg

SEQ ID NO: 80656 - RNA, 32 nt, Human
caccucucugcagcuccuucuccaaucucaug

SEQ ID NO: 80657 - RNA, 32 nt, Human
caccucucugucuuuuuccuuccugagaaacg

SEQ ID NO: 80658 - RNA, 32 nt, Human
caccucucuuccaggccuuccuaaguuuuugu

SEQ ID NO: 80659 - RNA, 32 nt, Human
caccucucuuucuccccuuuuaagccaugggu

SEQ ID NO: 80660 - RNA, 28 nt, Human
caccucugaagugcugcuugaaucuggc

SEQ ID NO: 80661 - RNA, 32 nt, Human
caccucugagccacccaucaccgccaaagugu

SEQ ID NO: 80662 - RNA, 22 nt, Human
caccucugagggcagcccccag

SEQ ID NO: 80663 - RNA, 32 nt, Human
caccucugcaaccugccaccuccugcuggcag

SEQ ID NO: 80664 - RNA, 18 nt, Human
caccucugcaccugcuga

SEQ ID NO: 80665 - RNA, 32 nt, Human
caccucugccaggugccagcuguacugugcac

SEQ ID NO: 80666 - RNA, 18 nt, Human
caccucugcccucuccca

SEQ ID NO: 80667 - RNA, 31 nt, Human
caccucugcuacuuccugccugugucaccug

SEQ ID NO: 80668 - RNA, 32 nt, Human
caccucugcucaccuuacuguucaccucauca

SEQ ID NO: 80669 - RNA, 32 nt, Human
caccucugcuccacaccugaccaguggccagc

SEQ ID NO: 80670 - RNA, 20 nt, Human
caccucugcugcccuggaga

SEQ ID NO: 80671 - RNA, 32 nt, Human
caccucugcuuggagaggacaagugcagccug

SEQ ID NO: 80672 - RNA, 32 nt, Human
caccucuggccaggcaggcaccagcucgcaug

SEQ ID NO: 80673 - RNA, 29 nt, Human
caccucuggcugcugcaggccucccaaga

SEQ ID NO: 80674 - RNA, 32 nt, Human
caccucugggcauagugggcucuggcuggcag

SEQ ID NO: 80675 - RNA, 32 nt, Human
caccucuggucaggagggucacccuggccugc

SEQ ID NO: 80676 - RNA, 32 nt, Human
caccucugucagaaaaccuaaauuuaagucac

SEQ ID NO: 80677 - RNA, 32 nt, Human
caccucuguccgaagacuucggauggcucccu

SEQ ID NO: 80678 - RNA, 32 nt, Human
caccucuguccugcguuccggagcugcguucc

SEQ ID NO: 80679 - RNA, 32 nt, Human
caccucugugucguguucucucuuguccccca

SEQ ID NO: 80680 - RNA, 32 nt, Human
caccucuucaaccaccuccggcuuccaggacc

SEQ ID NO: 80681 - RNA, 32 nt, Human
caccucuucaagaagcagcacagucucaggca

SEQ ID NO: 80682 - RNA, 32 nt, Human
caccucuucagagaccacuucucaggcugccc

SEQ ID NO: 80683 - RNA, 32 nt, Human
caccucuucccaagccuguuucccauaucaca

SEQ ID NO: 80684 - RNA, 32 nt, Human
caccucuucccugaggcuucugaagguugcug

SEQ ID NO: 80685 - RNA, 32 nt, Human
caccucuucuuucugugacaaagugcaucauu

SEQ ID NO: 80686 - RNA, 32 nt, Human
caccucuugaaauccagauguucauauuagac

SEQ ID NO: 80687 - RNA, 22 nt, Human
caccucuugccaccugcugcug

SEQ ID NO: 80688 - RNA, 32 nt, Human
caccucuugccaggcugcagagcuaugcaguc

SEQ ID NO: 80689 - RNA, 32 nt, Human
caccucuugccucaccauggccuccucugacc

SEQ ID NO: 80690 - RNA, 32 nt, Human
caccucuugccucugcuuuccugaucauucgu

SEQ ID NO: 80691 - RNA, 32 nt, Human
caccucuugccucuguaccuggucuuuguguu

SEQ ID NO: 80692 - RNA, 32 nt, Human
caccucuuucucaccguggccuccuggggcaa

SEQ ID NO: 80693 - RNA, 32 nt, Human
caccucuuugacuaggucccaggauccccuug

SEQ ID NO: 80694 - RNA, 32 nt, Human
caccucuuugggccuggcugggugggaaugug

SEQ ID NO: 80695 - RNA, 23 nt, Human
caccugaaaagcuugucuacuga

SEQ ID NO: 80696 - RNA, 32 nt, Human
caccugaaaagcuugucuacugaagaauuacu

SEQ ID NO: 80697 - RNA, 32 nt, Human
caccugaaacacacacaaacacacacaugucg

SEQ ID NO: 80698 - RNA, 20 nt, Human
caccugaaaucccagcuacu

SEQ ID NO: 80699 - RNA, 32 nt, Human
caccugaaccaauuaugagcagucuccuuacu

SEQ ID NO: 80700 - RNA, 32 nt, Human
caccugaagaagagaagcuuccggcaacccug

SEQ ID NO: 80701 - RNA, 32 nt, Human
caccugaagccaccugccccuccuuugugccc

SEQ ID NO: 80702 - RNA, 20 nt, Human
caccugaagggguccacagc

SEQ ID NO: 80703 - RNA, 32 nt, Human
caccugaaguagaacuuaagagaggggccaag

SEQ ID NO: 80704 - RNA, 20 nt, Human
caccugaaucagggcugugg

SEQ ID NO: 80705 - RNA, 32 nt, Human
caccugacagcugaccaggugaagagaggaua

SEQ ID NO: 80706 - RNA, 32 nt, Human
caccugacccaagaaaagaaacauggauucuu

SEQ ID NO: 80707 - RNA, 24 nt, Human
caccugacccagcuggccucggcc

SEQ ID NO: 80708 - RNA, 18 nt, Human
caccugacccaggcuggg

SEQ ID NO: 80709 - RNA, 32 nt, Human
caccugaccccugccaaggcccugggguuuua

SEQ ID NO: 80710 - RNA, 32 nt, Human
caccugacuccucuccccucguuuuuccuuca

SEQ ID NO: 80711 - RNA, 32 nt, Human
caccugacugcacuccagccuggguggcaaag

SEQ ID NO: 80712 - RNA, 32 nt, Human
caccugagaacuuguuaaaaaugcagauucuu

SEQ ID NO: 80713 - RNA, 18 nt, Human
caccugagacccuacuga

SEQ ID NO: 80714 - RNA, 32 nt, Human
caccugagacucacccuuagcacagcacaacc

SEQ ID NO: 80715 - RNA, 32 nt, Human
caccugagaguaguauaguagugcaaaaugga

SEQ ID NO: 80716 - RNA, 32 nt, Human
caccugagaucagcagagccacccuagaucag

SEQ ID NO: 80717 - RNA, 32 nt, Human
caccugagaucaggaguucaagacaaggcuga

SEQ ID NO: 80718 - RNA, 32 nt, Human
caccugagcaggaccucugaaacccuggacca

SEQ ID NO: 80719 - RNA, 32 nt, Human
caccugagcccaagcucauugcuucuuccuga

SEQ ID NO: 80720 - RNA, 32 nt, Human
caccugagccugacagaggagaagcagcggcu

SEQ ID NO: 80721 - RNA, 32 nt, Human
caccugagccugggaggcugaggcgggagaau

SEQ ID NO: 80722 - RNA, 32 nt, Human
caccugagccugggcaauagaacaagacucug

SEQ ID NO: 80723 - RNA, 32 nt, Human
caccugagcugagcccagcccagacccagcug

SEQ ID NO: 80724 - RNA, 32 nt, Human
caccugaggaaggaacuagagagaguggcagg

SEQ ID NO: 80725 - RNA, 32 nt, Human
caccugaggagaaggccuggggaggccacagu

SEQ ID NO: 80726 - RNA, 32 nt, Human
caccugaggagagugagcagccuggaccacaa

SEQ ID NO: 80727 - RNA, 32 nt, Human
caccugaggaggaguccugggucugggcacau

SEQ ID NO: 80728 - RNA, 32 nt, Human
caccugaggcagugugggaguugaacgacccu

SEQ ID NO: 80729 - RNA, 32 nt, Human
caccugaggucaguucaagaccagccuggcca

SEQ ID NO: 80730 - RNA, 32 nt, Human
caccugaggucaguucgagaccagcuuggcca

SEQ ID NO: 80731 - RNA, 32 nt, Human
caccugaggucaguuugagaccagccugggca

SEQ ID NO: 80732 - RNA, 32 nt, Human
caccugaggugagacuucguccagcuucuguc

SEQ ID NO: 80733 - RNA, 32 nt, Human
caccugagguuagaaguuugagaccagccugg

SEQ ID NO: 80734 - RNA, 32 nt, Human
caccugagguuaggaguuugagaccagccugg

SEQ ID NO: 80735 - RNA, 32 nt, Human
caccugaguagcagggauuacaggugugugcc

SEQ ID NO: 80736 - RNA, 32 nt, Human
caccugaguagcugggaguacaggcauguggc

SEQ ID NO: 80737 - RNA, 32 nt, Human
caccugaguagcugggauuacacgcacaugcc

SEQ ID NO: 80738 - RNA, 32 nt, Human
caccugaguccaggaauuugagaccagcaugg

SEQ ID NO: 80739 - RNA, 32 nt, Human
caccugaguucaaauaccagcacugcaggacu

SEQ ID NO: 80740 - RNA, 32 nt, Human
caccugaucccauccaggcgcugagaggcaag

SEQ ID NO: 80741 - RNA, 20 nt, Human
caccugaugaucgccuacug

SEQ ID NO: 80742 - RNA, 32 nt, Human
caccugaugugguugaggagaagccaggucuu

SEQ ID NO: 80743 - RNA, 32 nt, Human
caccugauugagcacagugacucuggggacac

SEQ ID NO: 80744 - RNA, 32 nt, Human
caccugcaacaagcucugauacuccaggggau

SEQ ID NO: 80745 - RNA, 23 nt, Human
caccugcaacagcuucugcugcu

SEQ ID NO: 80746 - RNA, 32 nt, Human
caccugcaagaggaggcucaggugcugacuga

SEQ ID NO: 80747 - RNA, 22 nt, Human
caccugcaaucccagcuacuca

SEQ ID NO: 80748 - RNA, 18 nt, Human
caccugcacaaccugcac

SEQ ID NO: 80749 - RNA, 22 nt, Human
caccugcaccccuucugggcug

SEQ ID NO: 80750 - RNA, 32 nt, Human
caccugcacccuccaggcagaguuguuugacc

SEQ ID NO: 80751 - RNA, 32 nt, Human
caccugcacucccagcuacucgggaggcucag

SEQ ID NO: 80752 - RNA, 21 nt, Human
caccugcacuuacaggccuug

SEQ ID NO: 80753 - RNA, 32 nt, Human
caccugcacuuucccccuacucguccacuagu

SEQ ID NO: 80754 - RNA, 25 nt, Human
caccugcagaggugccugugucuca

SEQ ID NO: 80755 - RNA, 31 nt, Human
caccugcagauucuaggaccuguguccuaga

SEQ ID NO: 80756 - RNA, 22 nt, Human
caccugcagauuucuugcugcu

SEQ ID NO: 80757 - RNA, 32 nt, Human
caccugcagcagagguggagugggggccaugu

SEQ ID NO: 80758 - RNA, 32 nt, Human
caccugcagcuuccgcaccuccugguccgcgu

SEQ ID NO: 80759 - RNA, 32 nt, Human
caccugcagcuuugccuuuugcugacacagcu

SEQ ID NO: 80760 - RNA, 32 nt, Human
caccugcaggaaggccagagguucugguggag

SEQ ID NO: 80761 - RNA, 32 nt, Human
caccugcaggaccccacacucacugcacuggc

SEQ ID NO: 80762 - RNA, 21 nt, Human
caccugcaggacccuguccug

SEQ ID NO: 80763 - RNA, 32 nt, Human
caccugcaggccuacuuuccagaaguaacucu

SEQ ID NO: 80764 - RNA, 32 nt, Human
caccugcagggaggcccuucccaagguguggu

SEQ ID NO: 80765 - RNA, 24 nt, Human
caccugcauaguaacuguguuuug

SEQ ID NO: 80766 - RNA, 32 nt, Human
caccugcaucacagguggaagcuccuucacuc

SEQ ID NO: 80767 - RNA, 20 nt, Human
caccugcaucccuaagucuu

SEQ ID NO: 80768 - RNA, 32 nt, Human
caccugcaucuucugaucaccuggcccagaag

SEQ ID NO: 80769 - RNA, 32 nt, Human
caccugcaugggcugagucccugggcucagac

SEQ ID NO: 80770 - RNA, 22 nt, Human
caccugcauggugcacggccug

SEQ ID NO: 80771 - RNA, 32 nt, Human
caccugcauggugcacggccugugcugccuuc

SEQ ID NO: 80772 - RNA, 24 nt, Human
caccugcauucucugucacugcug

SEQ ID NO: 80773 - RNA, 32 nt, Human
caccugccaaagugcugagauuacaggcguga

SEQ ID NO: 80774 - RNA, 32 nt, Human
caccugccaaccugaccauacugcuuucaaaa

SEQ ID NO: 80775 - RNA, 32 nt, Human
caccugccaaggaucccagcaggcuggaugag

SEQ ID NO: 80776 - RNA, 32 nt, Human
caccugccacacacagugacugugcagaauga

SEQ ID NO: 80777 - RNA, 32 nt, Human
caccugccacuuugcccugcccucugccucca

SEQ ID NO: 80778 - RNA, 32 nt, Human
caccugccagccccaacacccgacgggggccg

SEQ ID NO: 80779 - RNA, 32 nt, Human
caccugccauccugucuuccugacccccacuc

SEQ ID NO: 80780 - RNA, 32 nt, Human
caccugccauucauuugcuaauuuuuguggcg

SEQ ID NO: 80781 - RNA, 32 nt, Human
caccugccauuuccucccugccucccacccuc

SEQ ID NO: 80782 - RNA, 32 nt, Human
caccugcccaaaaccaaacgcagcaucuuccc

SEQ ID NO: 80783 - RNA, 32 nt, Human
caccugcccacccugcacucccauucuguuuc

SEQ ID NO: 80784 - RNA, 23 nt, Human
caccugcccacgccgacuuggga

SEQ ID NO: 80785 - RNA, 18 nt, Human
caccugcccaugguguca

SEQ ID NO: 80786 - RNA, 32 nt, Human
caccugccccacugcuucuucgcuucucucuu

SEQ ID NO: 80787 - RNA, 22 nt, Human
caccugcccccagcccggggag

SEQ ID NO: 80788 - RNA, 19 nt, Human
caccugcccccaucugcac

SEQ ID NO: 80789 - RNA, 32 nt, Human
caccugccccucuguucucuccccucacaucc

SEQ ID NO: 80790 - RNA, 32 nt, Human
caccugcccggagacagagggagcagcugagg

SEQ ID NO: 80791 - RNA, 32 nt, Human
caccugcccuccugcccuccuucaccagccaa

SEQ ID NO: 80792 - RNA, 32 nt, Human
caccugcccuccuugcagcccagcacaccugc

SEQ ID NO: 80793 - RNA, 32 nt, Human
caccugcccuucugcugacacuccugccugcu

SEQ ID NO: 80794 - RNA, 21 nt, Human
caccugccgcaagaccaacaa

SEQ ID NO: 80795 - RNA, 18 nt, Human
caccugccggccaagaaa

SEQ ID NO: 80796 - RNA, 32 nt, Human
caccugccggcucugggcuggcugcuccuaac

SEQ ID NO: 80797 - RNA, 32 nt, Human
caccugccguccugucuuccugacccccgcuu

SEQ ID NO: 80798 - RNA, 31 nt, Human
caccugccgugcucugggccaggucgcuggg

SEQ ID NO: 80799 - RNA, 32 nt, Human
caccugccuccaggugcccagaacagcccauc

SEQ ID NO: 80800 - RNA, 32 nt, Human
caccugccuccccagaaugaacaucagaaaag

SEQ ID NO: 80801 - RNA, 32 nt, Human
caccugccugaguauaaauacucucucuaccu

SEQ ID NO: 80802 - RNA, 32 nt, Human
caccugccugcaggcgcugcucccagguuaug

SEQ ID NO: 80803 - RNA, 18 nt, Human
caccugccugcugggccc

SEQ ID NO: 80804 - RNA, 32 nt, Human
caccugccuggaacugccuggagcgccauggu

SEQ ID NO: 80805 - RNA, 32 nt, Human
caccugccuggaccaccacuuccccacaggcu

SEQ ID NO: 80806 - RNA, 32 nt, Human
caccugccugggaacuuuccccugccaggacu

SEQ ID NO: 80807 - RNA, 32 nt, Human
caccugccuguaaucccagcuacuugggaggc

SEQ ID NO: 80808 - RNA, 32 nt, Human
caccugccuguauaccccagacuugccucugg

SEQ ID NO: 80809 - RNA, 32 nt, Human
caccugccuuuuuggcugcugcaccugaacag

SEQ ID NO: 80810 - RNA, 21 nt, Human
caccugcgccuccaacugcug

SEQ ID NO: 80811 - RNA, 32 nt, Human
caccugcgccuccaacugcugcaccugcuccu

SEQ ID NO: 80812 - RNA, 32 nt, Human
caccugcggcuacaagucccuccuggggccug

SEQ ID NO: 80813 - RNA, 32 nt, Human
caccugcgugagcccuaggauccagguccucu

SEQ ID NO: 80814 - RNA, 20 nt, Human
caccugcguguccugugcuu

SEQ ID NO: 80815 - RNA, 32 nt, Human
caccugcuacuucccuucacagacacaggaga

SEQ ID NO: 80816 - RNA, 23 nt, Human
caccugcuagcaggaggcaccug

SEQ ID NO: 80817 - RNA, 19 nt, Human
caccugcucaccaauucca

SEQ ID NO: 80818 - RNA, 32 nt, Human
caccugcucaccccacugccuguucuucucuc

SEQ ID NO: 80819 - RNA, 32 nt, Human
caccugcucagcugcccgucucuggccugggc

SEQ ID NO: 80820 - RNA, 32 nt, Human
caccugcucaguaugaugcuucugagcuaaaa

SEQ ID NO: 80821 - RNA, 32 nt, Human
caccugcuccauccucuaggguuccacaggcc

SEQ ID NO: 80822 - RNA, 32 nt, Human
caccugcucccaggacaccagccaugcccuuu

SEQ ID NO: 80823 - RNA, 21 nt, Human
caccugcuccuccagcugcug

SEQ ID NO: 80824 - RNA, 32 nt, Human
caccugcuccuccagcugcugcaccugccucu

SEQ ID NO: 80825 - RNA, 32 nt, Human
caccugcuccuccuccucugacucggaaccug

SEQ ID NO: 80826 - RNA, 32 nt, Human
caccugcucggcugcaggagaauggcuacuca

SEQ ID NO: 80827 - RNA, 32 nt, Human
caccugcucuccaccuggacucaggccgggcu

SEQ ID NO: 80828 - RNA, 32 nt, Human
caccugcucuuucugaagagcuacaucaguaa

SEQ ID NO: 80829 - RNA, 32 nt, Human
caccugcugcagcucuccaccuagcugcagau

SEQ ID NO: 80830 - RNA, 32 nt, Human
caccugcugcaucaccaggcugggugaacgga

SEQ ID NO: 80831 - RNA, 32 nt, Human
caccugcugccuggauccccggccugccuggg

SEQ ID NO: 80832 - RNA, 26 nt, Human
caccugcugcggucaccaugguggcg

SEQ ID NO: 80833 - RNA, 32 nt, Human
caccugcugcucaacaggaaacauacaauuag

SEQ ID NO: 80834 - RNA, 32 nt, Human
caccugcugcucaugguacccagugauucuug

SEQ ID NO: 80835 - RNA, 32 nt, Human
caccugcugcucccuccuuccucgcucccagc

SEQ ID NO: 80836 - RNA, 21 nt, Human
caccugcugcugcugcugcug

SEQ ID NO: 80837 - RNA, 32 nt, Human
caccugcuggaccaccucgccuucuccaucga

SEQ ID NO: 80838 - RNA, 32 nt, Human
caccugcugggcuccaagcccugggccaggcu

SEQ ID NO: 80839 - RNA, 32 nt, Human
caccugcuggggaggcagagacccugcaaugg

SEQ ID NO: 80840 - RNA, 32 nt, Human
caccugcugggugacuuggccaggauccccca

SEQ ID NO: 80841 - RNA, 32 nt, Human
caccugcugugguguguguccucuccucuccg

SEQ ID NO: 80842 - RNA, 32 nt, Human
caccugcuuaaaggcccugcauccugccaggu

SEQ ID NO: 80843 - RNA, 32 nt, Human
caccugcuuacagauaacagccaaagauagaa

SEQ ID NO: 80844 - RNA, 32 nt, Human
caccugcuucccaguccugccugaacagcccu

SEQ ID NO: 80845 - RNA, 32 nt, Human
caccugcuuccugauguucaccaggaaccuag

SEQ ID NO: 80846 - RNA, 32 nt, Human
caccugcuucuagcucaccugggaaauaacag

SEQ ID NO: 80847 - RNA, 32 nt, Human
caccugcuucuagcuucacuuuugggccagau

SEQ ID NO: 80848 - RNA, 32 nt, Human
caccugcuuuucucagcuuggcccuuccccgg

SEQ ID NO: 80849 - RNA, 19 nt, Human
caccuggaaaagccacugg

SEQ ID NO: 80850 - RNA, 21 nt, Human
caccuggaaaccugugccuug

SEQ ID NO: 80851 - RNA, 20 nt, Human
caccuggaaccagcuccuga

SEQ ID NO: 80852 - RNA, 32 nt, Human
caccuggaacccgaccucccagccucgcagcc

SEQ ID NO: 80853 - RNA, 32 nt, Human
caccuggaagcuuguuggaaaugcugaucuca

SEQ ID NO: 80854 - RNA, 19 nt, Human
caccuggaaucccugcuga

SEQ ID NO: 80855 - RNA, 32 nt, Human
caccuggacaguagacagggacuucagagauu

SEQ ID NO: 80856 - RNA, 32 nt, Human
caccuggacaucuaugaccacugccagucgag

SEQ ID NO: 80857 - RNA, 18 nt, Human
caccuggaccaccucuga

SEQ ID NO: 80858 - RNA, 22 nt, Human
caccuggaccaccugaccccuc

SEQ ID NO: 80859 - RNA, 32 nt, Human
caccuggaccagcugcucagcugucugaagac

SEQ ID NO: 80860 - RNA, 18 nt, Human
caccuggaccaggcuugc

SEQ ID NO: 80861 - RNA, 32 nt, Human
caccuggacgcagagcccugccagcgcccucc

SEQ ID NO: 80862 - RNA, 20 nt, Human
caccuggacuauuuuucuga

SEQ ID NO: 80863 - RNA, 18 nt, Human
caccuggacugacccugc

SEQ ID NO: 80864 - RNA, 18 nt, Human
caccuggacugacuucug

SEQ ID NO: 80865 - RNA, 20 nt, Human
caccuggacuggcucaguga

SEQ ID NO: 80866 - RNA, 20 nt, Human
caccuggacuuuucacuaga

SEQ ID NO: 80867 - RNA, 20 nt, Human
caccuggagaaaccacauga

SEQ ID NO: 80868 - RNA, 32 nt, Human
caccuggagacccaccucccaccccagugcac

SEQ ID NO: 80869 - RNA, 32 nt, Human
caccuggagaucuuggugaaaugcagacucug

SEQ ID NO: 80870 - RNA, 19 nt, Human
caccuggagcagccucuga

SEQ ID NO: 80871 - RNA, 32 nt, Human
caccuggagccccacccaggagcuggccgcgg

SEQ ID NO: 80872 - RNA, 32 nt, Human
caccuggaggcuggacacaagugucaccacuu

SEQ ID NO: 80873 - RNA, 32 nt, Human
caccuggaggggcgaugaggcuccacgcccgg

SEQ ID NO: 80874 - RNA, 24 nt, Human
caccuggaggucagaaccuggccu

SEQ ID NO: 80875 - RNA, 32 nt, Human
caccuggauaacucaggaugggggcugcucac

SEQ ID NO: 80876 - RNA, 32 nt, Human
caccuggauugcauuagaaugagacucacuac

SEQ ID NO: 80877 - RNA, 32 nt, Human
caccuggcaacagcagugugggcugcagggcu

SEQ ID NO: 80878 - RNA, 32 nt, Human
caccuggcaacagucuccccucauccugauuc

SEQ ID NO: 80879 - RNA, 32 nt, Human
caccuggcaaccccagccccagccucagcccu

SEQ ID NO: 80880 - RNA, 32 nt, Human
caccuggcaacugcuuaccagccuggcuggcc

SEQ ID NO: 80881 - RNA, 24 nt, Human
caccuggcacacagcagggaccca

SEQ ID NO: 80882 - RNA, 23 nt, Human
caccuggcaccccccugcugcug

SEQ ID NO: 80883 - RNA, 32 nt, Human
caccuggcacugaggagaaugguagagaggag

SEQ ID NO: 80884 - RNA, 32 nt, Human
caccuggcacuggccuuggccacccacuucuc

SEQ ID NO: 80885 - RNA, 32 nt, Human
caccuggcagccaaucgcaggucuccacugga

SEQ ID NO: 80886 - RNA, 32 nt, Human
caccuggcagggcucacacuccugggcucuga

SEQ ID NO: 80887 - RNA, 21 nt, Human
caccuggcagggcucccucca

SEQ ID NO: 80888 - RNA, 22 nt, Human
caccuggccacaaaauucuuua

SEQ ID NO: 80889 - RNA, 21 nt, Human
caccuggccacagccgccucu

SEQ ID NO: 80890 - RNA, 24 nt, Human
caccuggccacagccuccacacca

SEQ ID NO: 80891 - RNA, 24 nt, Human
caccuggccacaggugcacccuuc

SEQ ID NO: 80892 - RNA, 28 nt, Human
caccuggccacugcugccuuauccauuc

SEQ ID NO: 80893 - RNA, 21 nt, Human
caccuggcccagccccuuuca

SEQ ID NO: 80894 - RNA, 32 nt, Human
caccuggcccaggaugcaggcugcucuagaga

SEQ ID NO: 80895 - RNA, 32 nt, Human
caccuggcccaucugguggcugugccauggga

SEQ ID NO: 80896 - RNA, 21 nt, Human
caccuggccccacgcccuuca

SEQ ID NO: 80897 - RNA, 20 nt, Human
caccuggccgccagucgccu

SEQ ID NO: 80898 - RNA, 32 nt, Human
caccuggccuccaggagucgcuguguugggag

SEQ ID NO: 80899 - RNA, 19 nt, Human
caccuggccucccucaggg

SEQ ID NO: 80900 - RNA, 19 nt, Human
caccuggccuccugggccu

SEQ ID NO: 80901 - RNA, 32 nt, Human
caccuggccugggaaaguacuugccucauguu

SEQ ID NO: 80902 - RNA, 32 nt, Human
caccuggccugggaagcaccgucugcccgggc

SEQ ID NO: 80903 - RNA, 32 nt, Human
caccuggcuacccuuucaguuuuaagccauaa

SEQ ID NO: 80904 - RNA, 32 nt, Human
caccuggcucaauccuccuccaccaccagggg

SEQ ID NO: 80905 - RNA, 32 nt, Human
caccuggcucagagagggacagaagaaggagu

SEQ ID NO: 80906 - RNA, 32 nt, Human
caccugggaacuuguuagaaaugcagauuccc

SEQ ID NO: 80907 - RNA, 32 nt, Human
caccugggaacuuguuggaaaugcagccucuc

SEQ ID NO: 80908 - RNA, 32 nt, Human
caccugggaagugcccuggucuuacuuggguc

SEQ ID NO: 80909 - RNA, 32 nt, Human
caccugggaauucgcuggaaaugcaggcucaa

SEQ ID NO: 80910 - RNA, 21 nt, Human
caccugggaccuguguugcug

SEQ ID NO: 80911 - RNA, 32 nt, Human
caccugggacugguauccccucccagggucca

SEQ ID NO: 80912 - RNA, 32 nt, Human
caccugggagauuguuaggaaugcagauucuc

SEQ ID NO: 80913 - RNA, 32 nt, Human
caccugggagcacggcgccuggcucuuaccag

SEQ ID NO: 80914 - RNA, 32 nt, Human
caccugggagcuauuuacaaauguccaugugg

SEQ ID NO: 80915 - RNA, 32 nt, Human
caccugggagcuuguuaggaaugcagagucua

SEQ ID NO: 80916 - RNA, 32 nt, Human
caccugggaggaacguuccccuuugcaaggca

SEQ ID NO: 80917 - RNA, 32 nt, Human
caccugggaggucugggaggccaguccaucca

SEQ ID NO: 80918 - RNA, 32 nt, Human
caccugggccagcaaagaggagggguccagag

SEQ ID NO: 80919 - RNA, 32 nt, Human
caccugggccaucuugguuuuugcaagaaaaa

SEQ ID NO: 80920 - RNA, 18 nt, Human
caccugggccccugcuga

SEQ ID NO: 80921 - RNA, 20 nt, Human
caccugggcccugcaagcag

SEQ ID NO: 80922 - RNA, 23 nt, Human
caccugggcccugcggccagcag

SEQ ID NO: 80923 - RNA, 22 nt, Human
caccugggcccuggugaggcag

SEQ ID NO: 80924 - RNA, 17 nt, Human
caccugggccgggcugu

SEQ ID NO: 80925 - RNA, 32 nt, Human
caccugggccucccccugccacuccccucccu

SEQ ID NO: 80926 - RNA, 19 nt, Human
caccugggccucuccucgg

SEQ ID NO: 80927 - RNA, 31 nt, Human
caccugggccucucuguguuugguuccaagc

SEQ ID NO: 80928 - RNA, 23 nt, Human
caccugggccuuuuccccaagca

SEQ ID NO: 80929 - RNA, 20 nt, Human
caccugggcuccccuccuga

SEQ ID NO: 80930 - RNA, 32 nt, Human
caccugggcuccugccaguuucaugugugccc

SEQ ID NO: 80931 - RNA, 21 nt, Human
caccugggcuggagugcagug

SEQ ID NO: 80932 - RNA, 32 nt, Human
caccuggggaaacccccuuggcguggcuuguu

SEQ ID NO: 80933 - RNA, 32 nt, Human
caccuggggaauggggucccggccgggaggcu

SEQ ID NO: 80934 - RNA, 20 nt, Human
caccuggggacuccccacug

SEQ ID NO: 80935 - RNA, 32 nt, Human
caccuggggccaaugguguugauugcagacug

SEQ ID NO: 80936 - RNA, 32 nt, Human
caccuggggccugcugguguugcugguggaua

SEQ ID NO: 80937 - RNA, 32 nt, Human
caccuggggcuccagggagcaggcugggaacu

SEQ ID NO: 80938 - RNA, 32 nt, Human
caccuggggcuggggaucccacucuucuugca

SEQ ID NO: 80939 - RNA, 32 nt, Human
caccugggggacccucaaccccaaaguggauu

SEQ ID NO: 80940 - RNA, 21 nt, Human
caccuggguaccugaccccca

SEQ ID NO: 80941 - RNA, 18 nt, Human
caccugggugucuaccgg

SEQ ID NO: 80942 - RNA, 32 nt, Human
caccuggguucucugccaggggagagaguuau

SEQ ID NO: 80943 - RNA, 20 nt, Human
caccuggguuggggcggcgg

SEQ ID NO: 80944 - RNA, 24 nt, Human
caccugguacuguuccagcaucuu

SEQ ID NO: 80945 - RNA, 32 nt, Human
caccuggucucuggcccugguucuuauuuucu

SEQ ID NO: 80946 - RNA, 21 nt, Human
caccuggugacaccuccuuca

SEQ ID NO: 80947 - RNA, 32 nt, Human
caccuggugagugaggcuucaagggagaugcu

SEQ ID NO: 80948 - RNA, 32 nt, Human
caccuggugcaccacacugucuucauguuggc

SEQ ID NO: 80949 - RNA, 32 nt, Human
caccugguggcugaggcauucuugggccacau

SEQ ID NO: 80950 - RNA, 32 nt, Human
caccuggugggauggggaguguuaauaucucu

SEQ ID NO: 80951 - RNA, 32 nt, Human
caccuggugggcauagccagagcuguucgaac

SEQ ID NO: 80952 - RNA, 20 nt, Human
caccuggugucuccauugga

SEQ ID NO: 80953 - RNA, 22 nt, Human
caccugguguugaaccugcuga

SEQ ID NO: 80954 - RNA, 32 nt, Human
caccugguuaccacagucuccaugggucuuuu

SEQ ID NO: 80955 - RNA, 32 nt, Human
caccugguuacgcuucaccucuuguuuccugc

SEQ ID NO: 80956 - RNA, 32 nt, Human
caccugguuaugccuccuuucaucucaaagcc

SEQ ID NO: 80957 - RNA, 32 nt, Human
caccuguaaccccaucuucucugaguacagac

SEQ ID NO: 80958 - RNA, 32 nt, Human
caccuguaauaaucccagcacuuugggaggcc

SEQ ID NO: 80959 - RNA, 32 nt, Human
caccuguaaucacugcacuccaaccuggcaac

SEQ ID NO: 80960 - RNA, 20 nt, Human
caccuguaaucccaacacuu

SEQ ID NO: 80961 - RNA, 32 nt, Human
caccuguaaucccagcacuuagggaagacaag

SEQ ID NO: 80962 - RNA, 20 nt, Human
caccuguaaucccagcuacu

SEQ ID NO: 80963 - RNA, 21 nt, Human
caccuguaaucccagcuacuc

SEQ ID NO: 80964 - RNA, 22 nt, Human
caccuguaaucccagcuacuca

SEQ ID NO: 80965 - RNA, 22 nt, Human
caccuguaaucccagcuauuca

SEQ ID NO: 80966 - RNA, 22 nt, Human
caccuguaaucccagguacuca

SEQ ID NO: 80967 - RNA, 32 nt, Human
caccuguaaucccagugcuuugggaggccaag

SEQ ID NO: 80968 - RNA, 22 nt, Human
caccuguaaucccaguuacuca

SEQ ID NO: 80969 - RNA, 32 nt, Human
caccuguaaucccggcuacucgggaggcugag

SEQ ID NO: 80970 - RNA, 22 nt, Human
caccuguaaucucagcuacuca

SEQ ID NO: 80971 - RNA, 32 nt, Human
caccuguacaaucguauuuucuuucugucauu

SEQ ID NO: 80972 - RNA, 32 nt, Human
caccuguaccagggagcuuacaagaagcauuu

SEQ ID NO: 80973 - RNA, 32 nt, Human
caccuguaggcagaggcugccgagacagaccc

SEQ ID NO: 80974 - RNA, 32 nt, Human
caccuguaguaaucccagcuacucaggagguu

SEQ ID NO: 80975 - RNA, 32 nt, Human
caccuguaguagucccagcuacaugggaagcu

SEQ ID NO: 80976 - RNA, 22 nt, Human
caccuguagucccagcuacuca

SEQ ID NO: 80977 - RNA, 21 nt, Human
caccuguagucccagcuacug

SEQ ID NO: 80978 - RNA, 32 nt, Human
caccuguagucccaggcugaggugggaggauc

SEQ ID NO: 80979 - RNA, 32 nt, Human
caccuguagucccggcuacucgggaggcugag

SEQ ID NO: 80980 - RNA, 21 nt, Human
caccuguaguccuagcuacug

SEQ ID NO: 80981 - RNA, 32 nt, Human
caccuguaguccuaucauucagagauaaccac

SEQ ID NO: 80982 - RNA, 32 nt, Human
caccuguauuaaaaauacaauaauuagccgug

SEQ ID NO: 80983 - RNA, 32 nt, Human
caccuguauucccaacacuuuuggaggcugag

SEQ ID NO: 80984 - RNA, 32 nt, Human
caccuguauugaaucagaaugccuucaacuga

SEQ ID NO: 80985 - RNA, 32 nt, Human
caccugucacagccacucccaagcccacaccc

SEQ ID NO: 80986 - RNA, 32 nt, Human
caccugucacauuccucccuggccaggccuca

SEQ ID NO: 80987 - RNA, 32 nt, Human
caccugucacccugagagccacugaccaguuu

SEQ ID NO: 80988 - RNA, 32 nt, Human
caccugucaggaguuugggaccagccuggcca

SEQ ID NO: 80989 - RNA, 22 nt, Human
caccugucaucccagcuaccca

SEQ ID NO: 80990 - RNA, 22 nt, Human
caccugucaucccagcuacuca

SEQ ID NO: 80991 - RNA, 32 nt, Human
caccuguccaggcuuccuuagguacaucuucu

SEQ ID NO: 80992 - RNA, 32 nt, Human
caccugucccuggaugaagagcugucaccucu

SEQ ID NO: 80993 - RNA, 32 nt, Human
caccuguccuauaagcaggcugccucaaggaa

SEQ ID NO: 80994 - RNA, 31 nt, Human
caccuguccugcagugggccuguguggguua

SEQ ID NO: 80995 - RNA, 32 nt, Human
caccuguccugugcuucucuuuccuuacuucu

SEQ ID NO: 80996 - RNA, 18 nt, Human
caccugucucccuggaga

SEQ ID NO: 80997 - RNA, 32 nt, Human
caccugucucuggcuucugccaccacuuccag

SEQ ID NO: 80998 - RNA, 32 nt, Human
caccugucuguccagccacccuuccacagacu

SEQ ID NO: 80999 - RNA, 32 nt, Human
caccugucuucuucacagucacuggcaacaca

SEQ ID NO: 81000 - RNA, 32 nt, Human
caccugugaauaacugcacuccagccugggca

SEQ ID NO: 81001 - RNA, 32 nt, Human
caccugugacagccucaggagguccugacaac

SEQ ID NO: 81002 - RNA, 32 nt, Human
caccugugacgccguggagcaggaucuucauu

SEQ ID NO: 81003 - RNA, 32 nt, Human
caccugugacuccccaccccacugccugcucu

SEQ ID NO: 81004 - RNA, 32 nt, Human
caccugugagcagcaagacugccgcacguggg

SEQ ID NO: 81005 - RNA, 32 nt, Human
caccugugagccaacagguuaauuaguccauu

SEQ ID NO: 81006 - RNA, 32 nt, Human
caccugugaguggcucccagcacuuugagagg

SEQ ID NO: 81007 - RNA, 32 nt, Human
caccugugcccucaccaccacacuacacagca

SEQ ID NO: 81008 - RNA, 32 nt, Human
caccugugccuguagucccagauacuugggag

SEQ ID NO: 81009 - RNA, 32 nt, Human
caccugugcuccugacagcuccaugcacuaag

SEQ ID NO: 81010 - RNA, 32 nt, Human
caccugugcugcacuccagcugacccaaguag

SEQ ID NO: 81011 - RNA, 22 nt, Human
caccuguggccccagcuucuca

SEQ ID NO: 81012 - RNA, 32 nt, Human
caccuguggcuguagcuuaagacaaggcaaua

SEQ ID NO: 81013 - RNA, 32 nt, Human
caccugugggcagagggacaggucagacaccc

SEQ ID NO: 81014 - RNA, 32 nt, Human
caccugugggccccagugagagacugaacuua

SEQ ID NO: 81015 - RNA, 31 nt, Human
caccugugggugggggagggagagggcaguu

SEQ ID NO: 81016 - RNA, 20 nt, Human
caccuguggucccagcuacu

SEQ ID NO: 81017 - RNA, 21 nt, Human
caccuguggucccagcuacuc

SEQ ID NO: 81018 - RNA, 22 nt, Human
caccuguggucccagcuacuca

SEQ ID NO: 81019 - RNA, 32 nt, Human
caccuguguaggucucaccugugccaggugua

SEQ ID NO: 81020 - RNA, 32 nt, Human
caccuguguccaccccuucuguucgccacacc

SEQ ID NO: 81021 - RNA, 32 nt, Human
caccuguuacuaagucaggaguguaguuggau

SEQ ID NO: 81022 - RNA, 32 nt, Human
caccuguuaucccaacacuuuuggaggccgag

SEQ ID NO: 81023 - RNA, 22 nt, Human
caccuguuauccuagcuacuca

SEQ ID NO: 81024 - RNA, 32 nt, Human
caccuguuaucucuguccccagccucuaucug

SEQ ID NO: 81025 - RNA, 32 nt, Human
caccuguucccauccuccacagucucccaucc

SEQ ID NO: 81026 - RNA, 32 nt, Human
caccuguucgugcagcagcacacacacccuac

SEQ ID NO: 81027 - RNA, 24 nt, Human
caccuguugcagaacugagccacu

SEQ ID NO: 81028 - RNA, 32 nt, Human
caccuguuggcuuucucuucugcagcaacagg

SEQ ID NO: 81029 - RNA, 22 nt, Human
caccuguugucccagcuauuca

SEQ ID NO: 81030 - RNA, 32 nt, Human
caccuguuuaacucuguauuuauuucccaaua

SEQ ID NO: 81031 - RNA, 22 nt, Human
caccuguuuccaaaccuugaca

SEQ ID NO: 81032 - RNA, 32 nt, Human
caccuuaaaagagagaccuguauuggagaaua

SEQ ID NO: 81033 - RNA, 32 nt, Human
caccuuaaacugguuucuauggugcuucaucg

SEQ ID NO: 81034 - RNA, 32 nt, Human
caccuuaacagucaccacugugcucaaccaga

SEQ ID NO: 81035 - RNA, 23 nt, Human
caccuuaauauuuacaagaauua

SEQ ID NO: 81036 - RNA, 32 nt, Human
caccuuacaugacagaagugauucagggauuc

SEQ ID NO: 81037 - RNA, 32 nt, Human
caccuuacgccugguccauguccgugucauag

SEQ ID NO: 81038 - RNA, 32 nt, Human
caccuuacucagcucaucacgcaggccaagca

SEQ ID NO: 81039 - RNA, 32 nt, Human
caccuuacugcaaccaccacuuccuggguuca

SEQ ID NO: 81040 - RNA, 32 nt, Human
caccuuacugguaaccugcuauuccucuggug

SEQ ID NO: 81041 - RNA, 32 nt, Human
caccuuacugguaaccugcuauucuucuggug

SEQ ID NO: 81042 - RNA, 32 nt, Human
caccuuagaugaugcauauggccuaugccuuc

SEQ ID NO: 81043 - RNA, 32 nt, Human
caccuuagccagcagcccugggccacacuggg

SEQ ID NO: 81044 - RNA, 31 nt, Human
caccuuaggcacuucagacauuucaucucac

SEQ ID NO: 81045 - RNA, 32 nt, Human
caccuuaugucagggaaaccuaaacugagguc

SEQ ID NO: 81046 - RNA, 32 nt, Human
caccuuauucccaggcuggagugcaaugucgu

SEQ ID NO: 81047 - RNA, 32 nt, Human
caccuuauuccuccucuccauccagccccuac

SEQ ID NO: 81048 - RNA, 32 nt, Human
caccuuauuuggaaauaaaaggugauucccuu

SEQ ID NO: 81049 - RNA, 19 nt, Human
caccuucacaagccacaga

SEQ ID NO: 81050 - RNA, 18 nt, Human
caccuucaccaacccaga

SEQ ID NO: 81051 - RNA, 32 nt, Human
caccuucaccuccaucgugcccucucucucgg

SEQ ID NO: 81052 - RNA, 32 nt, Human
caccuucaccugccuuggucauggcucugcua

SEQ ID NO: 81053 - RNA, 32 nt, Human
caccuucacugaggugaccaauguuuccaacu

SEQ ID NO: 81054 - RNA, 32 nt, Human
caccuucacugugucccacccuuccuagcuuu

SEQ ID NO: 81055 - RNA, 19 nt, Human
caccuucagagccuuggca

SEQ ID NO: 81056 - RNA, 32 nt, Human
caccuucagcuuccucuaccuuccugaauggc

SEQ ID NO: 81057 - RNA, 32 nt, Human
caccuucauccaggcugggcgagguggcucac

SEQ ID NO: 81058 - RNA, 32 nt, Human
caccuucauuuuccugacaagaucccaaaaug

SEQ ID NO: 81059 - RNA, 17 nt, Human
caccuuccagaccacag

SEQ ID NO: 81060 - RNA, 32 nt, Human
caccuuccagcaccgccuggccugugugcagg

SEQ ID NO: 81061 - RNA, 32 nt, Human
caccuuccagcagcagcugcggagaguuugcc

SEQ ID NO: 81062 - RNA, 32 nt, Human
caccuuccagcuguggaaagaaaagaagaaac

SEQ ID NO: 81063 - RNA, 22 nt, Human
caccuuccagguucaagugauu

SEQ ID NO: 81064 - RNA, 32 nt, Human
caccuuccaugugcacuugcccaugggagacu

SEQ ID NO: 81065 - RNA, 32 nt, Human
caccuucccaagacccaggaucauguacccga

SEQ ID NO: 81066 - RNA, 32 nt, Human
caccuucccaaugugccuccuggaccacgucc

SEQ ID NO: 81067 - RNA, 20 nt, Human
caccuucccagucccacagg

SEQ ID NO: 81068 - RNA, 32 nt, Human
caccuucccccacccauaccccuccugugugu

SEQ ID NO: 81069 - RNA, 19 nt, Human
caccuucccccagccacag

SEQ ID NO: 81070 - RNA, 20 nt, Human
caccuuccccccaccugaga

SEQ ID NO: 81071 - RNA, 32 nt, Human
caccuuccccuccauuccccacuucucucucc

SEQ ID NO: 81072 - RNA, 20 nt, Human
caccuucccggugacccaga

SEQ ID NO: 81073 - RNA, 32 nt, Human
caccuucccucaucuuucaucaaucauuguac

SEQ ID NO: 81074 - RNA, 20 nt, Human
caccuucccuccacuacaga

SEQ ID NO: 81075 - RNA, 32 nt, Human
caccuucccuccucaugccuucccugagcuuu

SEQ ID NO: 81076 - RNA, 18 nt, Human
caccuucccugacucaga

SEQ ID NO: 81077 - RNA, 21 nt, Human
caccuucccugaggacacuca

SEQ ID NO: 81078 - RNA, 18 nt, Human
caccuucccugcccaaga

SEQ ID NO: 81079 - RNA, 32 nt, Human
caccuucccugccucacagauaccaauagaga

SEQ ID NO: 81080 - RNA, 32 nt, Human
caccuucccugccuuggugcugccagcagcag

SEQ ID NO: 81081 - RNA, 32 nt, Human
caccuucccuuucaauaaacagcugggaugga

SEQ ID NO: 81082 - RNA, 18 nt, Human
caccuucccuuucccaga

SEQ ID NO: 81083 - RNA, 22 nt, Human
caccuuccgggcucaagcgauu

SEQ ID NO: 81084 - RNA, 32 nt, Human
caccuuccuaagugcauguacagggaagcucu

SEQ ID NO: 81085 - RNA, 32 nt, Human
caccuuccuagccauggacacggaggaggggg

SEQ ID NO: 81086 - RNA, 20 nt, Human
caccuuccuaggccuggaga

SEQ ID NO: 81087 - RNA, 32 nt, Human
caccuuccucaccccuccucugacccacccau

SEQ ID NO: 81088 - RNA, 32 nt, Human
caccuuccuccaccaccauccuuacccagccc

SEQ ID NO: 81089 - RNA, 32 nt, Human
caccuuccuccacccuccacccugggcugcua

SEQ ID NO: 81090 - RNA, 32 nt, Human
caccuuccuccacuacagcccugaccauagac

SEQ ID NO: 81091 - RNA, 32 nt, Human
caccuuccuccacuacgugcuaggcccuucgc

SEQ ID NO: 81092 - RNA, 32 nt, Human
caccuuccucccacagaaacaguggugguauc

SEQ ID NO: 81093 - RNA, 32 nt, Human
caccuuccuggugcccuucagccagguccaga

SEQ ID NO: 81094 - RNA, 32 nt, Human
caccuuccugguucccugaggguccucagggu

SEQ ID NO: 81095 - RNA, 32 nt, Human
caccuuccuuucuccccugcuggccauuguuc

SEQ ID NO: 81096 - RNA, 32 nt, Human
caccuucgaggaggccauggaaaccccaacac

SEQ ID NO: 81097 - RNA, 32 nt, Human
caccuucgcuucucucaccaggaacauucgcu

SEQ ID NO: 81098 - RNA, 19 nt, Human
caccuucuaguuguacaaa

SEQ ID NO: 81099 - RNA, 32 nt, Human
caccuucuccaaucccugccugcugggagagg

SEQ ID NO: 81100 - RNA, 32 nt, Human
caccuucuccccacccuaccucaccucuucuc

SEQ ID NO: 81101 - RNA, 32 nt, Human
caccuucuccugccucuccacacuccagguuc

SEQ ID NO: 81102 - RNA, 32 nt, Human
caccuucucugccuccagucccccagccccug

SEQ ID NO: 81103 - RNA, 20 nt, Human
caccuucucuucaucacaga

SEQ ID NO: 81104 - RNA, 32 nt, Human
caccuucugaaccuucuucaaacaguaguaca

SEQ ID NO: 81105 - RNA, 32 nt, Human
caccuucugcaaggagcucugcugggccaccu

SEQ ID NO: 81106 - RNA, 32 nt, Human
caccuucugcacugcucaucugggcagaggaa

SEQ ID NO: 81107 - RNA, 32 nt, Human
caccuucugccaccaucuccugccgggccuca

SEQ ID NO: 81108 - RNA, 32 nt, Human
caccuucugcuaacauccagaaucucauacca

SEQ ID NO: 81109 - RNA, 32 nt, Human
caccuucuggagccagcucaucagcucagagc

SEQ ID NO: 81110 - RNA, 32 nt, Human
caccuucuugacccucucuccaucauucagcu

SEQ ID NO: 81111 - RNA, 23 nt, Human
caccuucuugagaggcuccuuca

SEQ ID NO: 81112 - RNA, 32 nt, Human
caccuucuuggucacugcacuucauagcccgg

SEQ ID NO: 81113 - RNA, 32 nt, Human
caccuugaagaaacuaaagagggaagauaaag

SEQ ID NO: 81114 - RNA, 32 nt, Human
caccuugaaggggaaggagauggggaaggccc

SEQ ID NO: 81115 - RNA, 32 nt, Human
caccuugaccaaaaucagcuuuguaacuguuu

SEQ ID NO: 81116 - RNA, 32 nt, Human
caccuugaccaccaaaggaacuaccuauccag

SEQ ID NO: 81117 - RNA, 32 nt, Human
caccuugacuccaagcccagcaguaaguccaa

SEQ ID NO: 81118 - RNA, 22 nt, Human
caccuugacugcaggcuuggga

SEQ ID NO: 81119 - RNA, 32 nt, Human
caccuugaugacuuccuauccauucugucuuc

SEQ ID NO: 81120 - RNA, 32 nt, Human
caccuugauguuggaugugaacugugaggacg

SEQ ID NO: 81121 - RNA, 32 nt, Human
caccuugauuuucugugauaccaaaaucucag

SEQ ID NO: 81122 - RNA, 32 nt, Human
caccuugcaacacacagacacacgcacacaca

SEQ ID NO: 81123 - RNA, 32 nt, Human
caccuugcagcucuccccuucucuguauuccu

SEQ ID NO: 81124 - RNA, 32 nt, Human
caccuugcccagcuaauuuuuguauuuuuagu

SEQ ID NO: 81125 - RNA, 32 nt, Human
caccuugccuuuccuucuugugggcaucuggg

SEQ ID NO: 81126 - RNA, 32 nt, Human
caccuugcuaucucugcucuucaaccauuguu

SEQ ID NO: 81127 - RNA, 22 nt, Human
caccuugcuccuccuucugcug

SEQ ID NO: 81128 - RNA, 32 nt, Human
caccuugcucuaauaggugaugcaugagcaaa

SEQ ID NO: 81129 - RNA, 32 nt, Human
caccuugcugcuguaucuccuggccucugcuu

SEQ ID NO: 81130 - RNA, 32 nt, Human
caccuugcuuccuaucugccucuuucgugguu

SEQ ID NO: 81131 - RNA, 32 nt, Human
caccuuggacauccuccucccacccggcugca

SEQ ID NO: 81132 - RNA, 32 nt, Human
caccuuggccuuucugaacuauuuccuuuaca

SEQ ID NO: 81133 - RNA, 32 nt, Human
caccuuggcucaugccuguaauccuagcacuu

SEQ ID NO: 81134 - RNA, 32 nt, Human
caccuuggcucucaaaggcuuccaguuagaug

SEQ ID NO: 81135 - RNA, 32 nt, Human
caccuuggcugcagggagucgaaaggacuugg

SEQ ID NO: 81136 - RNA, 32 nt, Human
caccuugggaggccaaggugggaggaucacug

SEQ ID NO: 81137 - RNA, 32 nt, Human
caccuugggaggccacuguaggaggaucaauu

SEQ ID NO: 81138 - RNA, 32 nt, Human
caccuugggaggccgaggcgggcggaucacuu

SEQ ID NO: 81139 - RNA, 32 nt, Human
caccuugggaggcugaggcagguggaucaccu

SEQ ID NO: 81140 - RNA, 32 nt, Human
caccuugggaggcugaggcgggcagaucauga

SEQ ID NO: 81141 - RNA, 32 nt, Human
caccuugggaggcugaggugggaggaucauuu

SEQ ID NO: 81142 - RNA, 32 nt, Human
caccuugggcacugaaucacaugagccgucga

SEQ ID NO: 81143 - RNA, 32 nt, Human
caccuuggugcugugggggccccuugccucuu

SEQ ID NO: 81144 - RNA, 32 nt, Human
caccuuguacaucagagaguucacacagguua

SEQ ID NO: 81145 - RNA, 32 nt, Human
caccuugucaccaacaggaugaugucaccaac

SEQ ID NO: 81146 - RNA, 32 nt, Human
caccuugucacccaggcuagagugcaguggca

SEQ ID NO: 81147 - RNA, 32 nt, Human
caccuuguccuuggcccugcuggucccugucg

SEQ ID NO: 81148 - RNA, 32 nt, Human
caccuuguguguggagaugcauuccaagaaug

SEQ ID NO: 81149 - RNA, 32 nt, Human
caccuuguucccaggcugugccgucuucuccu

SEQ ID NO: 81150 - RNA, 32 nt, Human
caccuuguucucuucugcucuagacagauggc

SEQ ID NO: 81151 - RNA, 32 nt, Human
caccuuguugcccaggcuggucucaaacuccu

SEQ ID NO: 81152 - RNA, 32 nt, Human
caccuuguuggccaggcuggucucaaacuucu

SEQ ID NO: 81153 - RNA, 32 nt, Human
caccuuguuggccaggcuggucucgaacuccu

SEQ ID NO: 81154 - RNA, 32 nt, Human
caccuuuacuccucuccagaacagggaaaugu

SEQ ID NO: 81155 - RNA, 32 nt, Human
caccuuuagaaaaccagucacuucuuuucaua

SEQ ID NO: 81156 - RNA, 19 nt, Human
caccuuuagauaagaauua

SEQ ID NO: 81157 - RNA, 32 nt, Human
caccuuuaguacaguccuugcauccauucuau

SEQ ID NO: 81158 - RNA, 32 nt, Human
caccuuucacagccccagcccucagagcaacc

SEQ ID NO: 81159 - RNA, 17 nt, Human
caccuuucaccccacag

SEQ ID NO: 81160 - RNA, 32 nt, Human
caccuuucauaaguuguuaucuagucaaugua

SEQ ID NO: 81161 - RNA, 32 nt, Human
caccuuuccagggagguggaaggacccugugc

SEQ ID NO: 81162 - RNA, 32 nt, Human
caccuuucccaauaggaaaccccaacagguaa

SEQ ID NO: 81163 - RNA, 32 nt, Human
caccuuucccaccucucuccccaaagugaucc

SEQ ID NO: 81164 - RNA, 32 nt, Human
caccuuucccagcucucagcaguuguacugca

SEQ ID NO: 81165 - RNA, 32 nt, Human
caccuuucccaugccuccucuggagccuucgc

SEQ ID NO: 81166 - RNA, 18 nt, Human
caccuuucccccauaaga

SEQ ID NO: 81167 - RNA, 20 nt, Human
caccuuuccccugcugcgga

SEQ ID NO: 81168 - RNA, 23 nt, Human
caccuuuccugcacuccacggcg

SEQ ID NO: 81169 - RNA, 32 nt, Human
caccuuuccugcacuccacggcggcagugaca

SEQ ID NO: 81170 - RNA, 32 nt, Human
caccuuuccuggugaugccuuuggcuccuuga

SEQ ID NO: 81171 - RNA, 32 nt, Human
caccuuuccuuuccuuccugugggcccucuuu

SEQ ID NO: 81172 - RNA, 32 nt, Human
caccuuucgguuacuaagcucugccuucuuga

SEQ ID NO: 81173 - RNA, 32 nt, Human
caccuuucuccccuccccucuuuccucacccu

SEQ ID NO: 81174 - RNA, 21 nt, Human
caccuuucugcuuugccuuca

SEQ ID NO: 81175 - RNA, 32 nt, Human
caccuuucuggucaccaugcuggugaggaaug

SEQ ID NO: 81176 - RNA, 32 nt, Human
caccuuucuguaguucagggcuggcaggaggg

SEQ ID NO: 81177 - RNA, 18 nt, Human
caccuuugaaaccacaga

SEQ ID NO: 81178 - RNA, 32 nt, Human
caccuuugauccuuuccugugugugucccuac

SEQ ID NO: 81179 - RNA, 18 nt, Human
caccuuugaucuuugaca

SEQ ID NO: 81180 - RNA, 32 nt, Human
caccuuugcccuuuuugaugccccuucugccu

SEQ ID NO: 81181 - RNA, 32 nt, Human
caccuuugcuuucucuacccuccugggcuggg

SEQ ID NO: 81182 - RNA, 32 nt, Human
caccuuuggagaggaauccuucccuccccugg

SEQ ID NO: 81183 - RNA, 32 nt, Human
caccuuuggcuaggagggaggggugacagcca

SEQ ID NO: 81184 - RNA, 32 nt, Human
caccuuugggcugcccuggcccccacucuccc

SEQ ID NO: 81185 - RNA, 24 nt, Human
caccuuuguacuccagccugggca

SEQ ID NO: 81186 - RNA, 32 nt, Human
caccuuuguacuccagccugggcaacgagcaa

SEQ ID NO: 81187 - RNA, 32 nt, Human
caccuuugugcaaaugcgaaccacaucucacc

SEQ ID NO: 81188 - RNA, 32 nt, Human
caccuuuguuucucccccauguucugucccuu

SEQ ID NO: 81189 - RNA, 32 nt, Human
caccuuuguuuuucauaccaguaccugaagua

SEQ ID NO: 81190 - RNA, 32 nt, Human
caccuuuuacucccaacgucuggcagagcuga

SEQ ID NO: 81191 - RNA, 18 nt, Human
caccuuuuauaccagaga

SEQ ID NO: 81192 - RNA, 20 nt, Human
caccuuuucaaucagaauua

SEQ ID NO: 81193 - RNA, 18 nt, Human
caccuuuucagccauaga

SEQ ID NO: 81194 - RNA, 32 nt, Human
caccuuuuccagauacaaacuugccuuauuuu

SEQ ID NO: 81195 - RNA, 20 nt, Human
caccuuuuccccaaagaaga

SEQ ID NO: 81196 - RNA, 21 nt, Human
caccuuuuccccaggagcaga

SEQ ID NO: 81197 - RNA, 23 nt, Human
caccuuuuccccccugacccaga

SEQ ID NO: 81198 - RNA, 32 nt, Human
caccuuuucccuuucauguucuuggaccuuuu

SEQ ID NO: 81199 - RNA, 20 nt, Human
caccuuuuccuucagcacag

SEQ ID NO: 81200 - RNA, 32 nt, Human
caccuuuucugggcaaggaacagccccuuuaa

SEQ ID NO: 81201 - RNA, 18 nt, Human
caccuuuucuugcauaga

SEQ ID NO: 81202 - RNA, 32 nt, Human
caccuuuugagcaacugagucaucucaagucc

SEQ ID NO: 81203 - RNA, 32 nt, Human
caccuuuugauagugacaggaggcagacaaau

SEQ ID NO: 81204 - RNA, 32 nt, Human
caccuuuugccacccccuccccaccagaggcc

SEQ ID NO: 81205 - RNA, 32 nt, Human
caccuuuugccuggucauccuguuagaguaca

SEQ ID NO: 81206 - RNA, 18 nt, Human
caccuuuugcuccacgga

SEQ ID NO: 81207 - RNA, 23 nt, Human
caccuuuuuagaaaaaagaauua

SEQ ID NO: 81208 - RNA, 21 nt, Human
caccuuuuucaacaagauuua

SEQ ID NO: 81209 - RNA, 32 nt, Human
cacgaaacccacuuauagagcagguucauaua

SEQ ID NO: 81210 - RNA, 32 nt, Human
cacgaaacugggccuuuccugcugagaggaag

SEQ ID NO: 81211 - RNA, 32 nt, Human
cacgaaagaccuacucuuucagaagcuugaag

SEQ ID NO: 81212 - RNA, 32 nt, Human
cacgaaaguucagaaaggggaagaaacuggcu

SEQ ID NO: 81213 - RNA, 22 nt, Human
cacgaaaugcuuaaaagcuaac

SEQ ID NO: 81214 - RNA, 32 nt, Human
cacgaacagcagagaggggcagcaggaugaau

SEQ ID NO: 81215 - RNA, 22 nt, Human
cacgaacccaccugcugagaga

SEQ ID NO: 81216 - RNA, 32 nt, Human
cacgaacuaaaaauaaaagugcacuaggggac

SEQ ID NO: 81217 - RNA, 32 nt, Human
cacgaacugcuaagcaaccccaccuccuaaac

SEQ ID NO: 81218 - RNA, 32 nt, Human
cacgaacuggaaggggguucacggucaaacug

SEQ ID NO: 81219 - RNA, 32 nt, Human
cacgaagaaagccagaagugaguaccugcaga

SEQ ID NO: 81220 - RNA, 32 nt, Human
cacgaagaaggaaguccucuucccgccuggag

SEQ ID NO: 81221 - RNA, 32 nt, Human
cacgaagcucugagaacauguuuguuucgaau

SEQ ID NO: 81222 - RNA, 32 nt, Human
cacgaagcuguggaucauaguucccagcguga

SEQ ID NO: 81223 - RNA, 32 nt, Human
cacgaaggagcagaaggagggagccacgggcc

SEQ ID NO: 81224 - RNA, 20 nt, Human
cacgaaggcccagggcgcca

SEQ ID NO: 81225 - RNA, 32 nt, Human
cacgaaggggcagaaggagggagccacgugcc

SEQ ID NO: 81226 - RNA, 32 nt, Human
cacgaagugaggagaagguggagaagagagaa

SEQ ID NO: 81227 - RNA, 32 nt, Human
cacgaaucacugcacccagccuauggaacauc

SEQ ID NO: 81228 - RNA, 32 nt, Human
cacgacacccagcuaauuuuuguauuuuuagu

SEQ ID NO: 81229 - RNA, 32 nt, Human
cacgacacccaucaccaccaccaccacgguga

SEQ ID NO: 81230 - RNA, 32 nt, Human
cacgacacccggccaauuuuuguauuuuuggu

SEQ ID NO: 81231 - RNA, 32 nt, Human
cacgacacugcacuccagccugggcaacggag

SEQ ID NO: 81232 - RNA, 32 nt, Human
cacgacagcagaccaacuccacccuaagaaag

SEQ ID NO: 81233 - RNA, 32 nt, Human
cacgacagccuggugcacagccgagaaaacaa

SEQ ID NO: 81234 - RNA, 32 nt, Human
cacgacagugcaugcacuccagccugggcaac

SEQ ID NO: 81235 - RNA, 32 nt, Human
cacgaccaccaccaccaccaccacucaccacc

SEQ ID NO: 81236 - RNA, 32 nt, Human
cacgaccacggaggaauccuugcuucagggac

SEQ ID NO: 81237 - RNA, 32 nt, Human
cacgacccagccuggccacacacuguggugcc

SEQ ID NO: 81238 - RNA, 32 nt, Human
cacgaccgcaaugcaaggaggggaagaaaguc

SEQ ID NO: 81239 - RNA, 32 nt, Human
cacgacgcccagcugauuuuuguguuuuuagu

SEQ ID NO: 81240 - RNA, 32 nt, Human
cacgacgcccuggaauuccugcucugguugcu

SEQ ID NO: 81241 - RNA, 32 nt, Human
cacgacgguccccauuccacccccucuuucuu

SEQ ID NO: 81242 - RNA, 32 nt, Human
cacgacuccagccaccacccacugacguuauu

SEQ ID NO: 81243 - RNA, 32 nt, Human
cacgacuccaggagucaaccccuggaucucgg

SEQ ID NO: 81244 - RNA, 32 nt, Human
cacgacugagaugucaucaguguugaauggca

SEQ ID NO: 81245 - RNA, 24 nt, Human
cacgacugcacuccagccugggca

SEQ ID NO: 81246 - RNA, 32 nt, Human
cacgacugcacuccagccugggcaauggagug

SEQ ID NO: 81247 - RNA, 32 nt, Human
cacgacugcauccuucaucugccaggcccugg

SEQ ID NO: 81248 - RNA, 32 nt, Human
cacgacugcauucuagccugggugacagagcg

SEQ ID NO: 81249 - RNA, 32 nt, Human
cacgacuuccuuggagccugggccuuugcggg

SEQ ID NO: 81250 - RNA, 21 nt, Human
cacgagaacagcauggaggua

SEQ ID NO: 81251 - RNA, 32 nt, Human
cacgagaacagcugucaccuagugcggaacaa

SEQ ID NO: 81252 - RNA, 32 nt, Human
cacgagaagacaggaggaagaaagggagagag

SEQ ID NO: 81253 - RNA, 32 nt, Human
cacgagaagagagaaggggacagaacagcgag

SEQ ID NO: 81254 - RNA, 32 nt, Human
cacgagaauacucuugagaauauuguucuugg

SEQ ID NO: 81255 - RNA, 32 nt, Human
cacgagaaugucccugagacccagaagggccu

SEQ ID NO: 81256 - RNA, 22 nt, Human
cacgagacaagcacgccagcca

SEQ ID NO: 81257 - RNA, 32 nt, Human
cacgagaccaggaguucaagaccagccugacc

SEQ ID NO: 81258 - RNA, 32 nt, Human
cacgagaccgaggagaaacugcagacaaaugg

SEQ ID NO: 81259 - RNA, 22 nt, Human
cacgagacuagucccaauucca

SEQ ID NO: 81260 - RNA, 31 nt, Human
cacgagagagacgaggucacuggaggauaaa

SEQ ID NO: 81261 - RNA, 32 nt, Human
cacgagagagacgaggucacuggaggauaaac

SEQ ID NO: 81262 - RNA, 32 nt, Human
cacgagaugcgcugcugaauucauggugggaa

SEQ ID NO: 81263 - RNA, 32 nt, Human
cacgagcaaagucgguggucacaagggagcag

SEQ ID NO: 81264 - RNA, 32 nt, Human
cacgagcaccugugaauccacagcagaacagc

SEQ ID NO: 81265 - RNA, 32 nt, Human
cacgagcacugagcgccuccugagagccagcc

SEQ ID NO: 81266 - RNA, 32 nt, Human
cacgagcagacacccuuggagcucugaguucc

SEQ ID NO: 81267 - RNA, 32 nt, Human
cacgagcaggcagagcacgaaggcgaacaccg

SEQ ID NO: 81268 - RNA, 32 nt, Human
cacgagcgcgugccaccauggagucugaccac

SEQ ID NO: 81269 - RNA, 32 nt, Human
cacgagcugggcagacagcaggaucugagcac

SEQ ID NO: 81270 - RNA, 32 nt, Human
cacgagcugugucuuccuucucuccgccgcga

SEQ ID NO: 81271 - RNA, 32 nt, Human
cacgagcuuacauaagugguuaggcaagcugg

SEQ ID NO: 81272 - RNA, 23 nt, Human
cacgaggaagaagugccuuucgc

SEQ ID NO: 81273 - RNA, 18 nt, Human
cacgaggaccaucggggg

SEQ ID NO: 81274 - RNA, 32 nt, Human
cacgaggagaucaagaccauccuggcuaacac

SEQ ID NO: 81275 - RNA, 19 nt, Human
cacgaggaggcgcccuccg

SEQ ID NO: 81276 - RNA, 24 nt, Human
cacgaggagggagcuacccuucgc

SEQ ID NO: 81277 - RNA, 32 nt, Human
cacgaggcacuuucucaaccccacagaugcuc

SEQ ID NO: 81278 - RNA, 32 nt, Human
cacgaggccaagaguuugaggguggguucggg

SEQ ID NO: 81279 - RNA, 32 nt, Human
cacgaggccaggaguucgagaccaucuuggcu

SEQ ID NO: 81280 - RNA, 32 nt, Human
cacgaggcccugagcauuuagcacuuggucga

SEQ ID NO: 81281 - RNA, 32 nt, Human
cacgaggcgcugcggcuccaccugccaguggg

SEQ ID NO: 81282 - RNA, 32 nt, Human
cacgaggcucaccauggugggccccgcgccgc

SEQ ID NO: 81283 - RNA, 16 nt, Human
cacgaggcucacugca

SEQ ID NO: 81284 - RNA, 32 nt, Human
cacgaggcucgccgcggacucaagauggcggc

SEQ ID NO: 81285 - RNA, 32 nt, Human
cacgaggcugggaccggaguggggagcgcggc

SEQ ID NO: 81286 - RNA, 32 nt, Human
cacgaggcuggucccuggcccaacaugauacu

SEQ ID NO: 81287 - RNA, 32 nt, Human
cacgagggaaagaagcuucaguuucucgcaug

SEQ ID NO: 81288 - RNA, 32 nt, Human
cacgagggcaucagggacgcagugaguguugc

SEQ ID NO: 81289 - RNA, 18 nt, Human
cacgagggccacccgcgc

SEQ ID NO: 81290 - RNA, 32 nt, Human
cacgagggcgugugucaguggcugugugcagg

SEQ ID NO: 81291 - RNA, 32 nt, Human
cacgaggggaggaggaggaggaggagaggagc

SEQ ID NO: 81292 - RNA, 32 nt, Human
cacgaggggaggcacggugcggagagcgucgc

SEQ ID NO: 81293 - RNA, 32 nt, Human
cacgaggggcagacagaggcgccagugcccuc

SEQ ID NO: 81294 - RNA, 32 nt, Human
cacgaggggcgcuggggcccugggcagcgcgg

SEQ ID NO: 81295 - RNA, 32 nt, Human
cacgaggggcggcggcagcuguggaagcucag

SEQ ID NO: 81296 - RNA, 22 nt, Human
cacgaggggcugcccccuccgc

SEQ ID NO: 81297 - RNA, 32 nt, Human
cacgaggggcuuguugggauccguugagugau

SEQ ID NO: 81298 - RNA, 32 nt, Human
cacgagggggcuuggagcaggauucagaaggg

SEQ ID NO: 81299 - RNA, 32 nt, Human
cacgaggugcgcccuccacccgcugggcuagg

SEQ ID NO: 81300 - RNA, 32 nt, Human
cacgagguucgagagcgcgcagaguccagacu

SEQ ID NO: 81301 - RNA, 24 nt, Human
cacgagucacagcacacacuggcg

SEQ ID NO: 81302 - RNA, 32 nt, Human
cacgagugagaaggaguuugccuagcaaagau

SEQ ID NO: 81303 - RNA, 32 nt, Human
cacgagugcuccagcugcagggccagggggug

SEQ ID NO: 81304 - RNA, 32 nt, Human
cacgagugucuccccagugcagacucaaguua

SEQ ID NO: 81305 - RNA, 32 nt, Human
cacgaguuuuagagaagaacauacuuuuuggc

SEQ ID NO: 81306 - RNA, 32 nt, Human
cacgauacgcacagcacaccacugucccuuca

SEQ ID NO: 81307 - RNA, 32 nt, Human
cacgauagcucacgccuauaaucccagcauuu

SEQ ID NO: 81308 - RNA, 32 nt, Human
cacgauaggaauagcuuuuauuuuugauagac

SEQ ID NO: 81309 - RNA, 32 nt, Human
cacgaucaaggcagggaaagauaggcaggagu

SEQ ID NO: 81310 - RNA, 32 nt, Human
cacgaucacaccacaguacuccagccuaggug

SEQ ID NO: 81311 - RNA, 32 nt, Human
cacgauccugcacuccagccugggcaacagag

SEQ ID NO: 81312 - RNA, 32 nt, Human
cacgauccuggaguaguuccuaccucaaaugu

SEQ ID NO: 81313 - RNA, 32 nt, Human
cacgaucguaccacuacacuccagccugggca

SEQ ID NO: 81314 - RNA, 32 nt, Human
cacgaucucggcucacugcauccucugccucc

SEQ ID NO: 81315 - RNA, 32 nt, Human
cacgaucugcaaacuccgccuccuggguucaa

SEQ ID NO: 81316 - RNA, 32 nt, Human
cacgaugacgccucuggaccucggugaugccu

SEQ ID NO: 81317 - RNA, 31 nt, Human
cacgaugcaauuucugggccugaaugucaug

SEQ ID NO: 81318 - RNA, 32 nt, Human
cacgauggacuggccagcuuugcccgcccgcc

SEQ ID NO: 81319 - RNA, 32 nt, Human
cacgauggagagagagcagggccagggucgga

SEQ ID NO: 81320 - RNA, 32 nt, Human
cacgauggaggcccaauaaaaacacuggacac

SEQ ID NO: 81321 - RNA, 32 nt, Human
cacgauggcucaaaccuguaaucccagcacuu

SEQ ID NO: 81322 - RNA, 32 nt, Human
cacgauggcucacaccuguaaucccagcacuu

SEQ ID NO: 81323 - RNA, 32 nt, Human
cacgauggcucacgccuguaaucccagacuuu

SEQ ID NO: 81324 - RNA, 32 nt, Human
cacgauggcucacgucuguaaucccagcacuu

SEQ ID NO: 81325 - RNA, 32 nt, Human
cacgaugggcugaggccaggggagacaucaca

SEQ ID NO: 81326 - RNA, 32 nt, Human
cacgauguucauccaggccaaagcaggguguc

SEQ ID NO: 81327 - RNA, 32 nt, Human
cacgauuaaauggcaaaaggacuuauaaaagg

SEQ ID NO: 81328 - RNA, 31 nt, Human
cacgauucaauaaauauuggaugaaauuaac

SEQ ID NO: 81329 - RNA, 32 nt, Human
cacgauucagcccggugguguuagcccccugg

SEQ ID NO: 81330 - RNA, 32 nt, Human
cacgauugcaaagccuccucucccagagaccc

SEQ ID NO: 81331 - RNA, 32 nt, Human
cacgauugcaccacuucaucccagccugggag

SEQ ID NO: 81332 - RNA, 32 nt, Human
cacgauugccauggccauagggccacagugcc

SEQ ID NO: 81333 - RNA, 32 nt, Human
cacgauuggggugggagaugagcaaaccugcu

SEQ ID NO: 81334 - RNA, 32 nt, Human
cacgauuucaggaucgcuuccuugugagccgc

SEQ ID NO: 81335 - RNA, 32 nt, Human
cacgcaaagucccccuugcccaggcucccuga

SEQ ID NO: 81336 - RNA, 32 nt, Human
cacgcaacucacaccuccuuuucuucuagcuu

SEQ ID NO: 81337 - RNA, 32 nt, Human
cacgcaaggaaagaaccaggagggagagugca

SEQ ID NO: 81338 - RNA, 32 nt, Human
cacgcaauagccaucaaggagaauuucuauua

SEQ ID NO: 81339 - RNA, 32 nt, Human
cacgcacaaacacacaugcccacacaaugcuc

SEQ ID NO: 81340 - RNA, 32 nt, Human
cacgcacacacaugcacacacgcacacgcaug

SEQ ID NO: 81341 - RNA, 32 nt, Human
cacgcacacacgcacacaaacaugcacacacg

SEQ ID NO: 81342 - RNA, 32 nt, Human
cacgcacacagccugguuuuguccucaugcac

SEQ ID NO: 81343 - RNA, 32 nt, Human
cacgcacacaucuccucgucugggugugcgca

SEQ ID NO: 81344 - RNA, 32 nt, Human
cacgcacacaugcacacacacgcaugugcgcg

SEQ ID NO: 81345 - RNA, 32 nt, Human
cacgcacacaugcacgcacacacacauauggg

SEQ ID NO: 81346 - RNA, 32 nt, Human
cacgcacacccaccccacagugcccggcucgg

SEQ ID NO: 81347 - RNA, 32 nt, Human
cacgcacaggagguucagcugugugccuguga

SEQ ID NO: 81348 - RNA, 32 nt, Human
cacgcaccccacugcuuccagagccuccacgc

SEQ ID NO: 81349 - RNA, 23 nt, Human
cacgcaccccagaccccaggugg

SEQ ID NO: 81350 - RNA, 32 nt, Human
cacgcaccccgcuuugcacaccacagagugcc

SEQ ID NO: 81351 - RNA, 32 nt, Human
cacgcacccguaguuccagcuacuugggaggc

SEQ ID NO: 81352 - RNA, 32 nt, Human
cacgcaccgacacacaugcacgcacgcacccc

SEQ ID NO: 81353 - RNA, 32 nt, Human
cacgcaccucaaggagcacaugcagacacacc

SEQ ID NO: 81354 - RNA, 32 nt, Human
cacgcaccugcucuccaccuggacucaggccg

SEQ ID NO: 81355 - RNA, 32 nt, Human
cacgcaccuguaaucccagcugcucuggaggc

SEQ ID NO: 81356 - RNA, 32 nt, Human
cacgcaccuuguaggcuccugcccucacccca

SEQ ID NO: 81357 - RNA, 32 nt, Human
cacgcacuggcacuaaauccacacugcccauc

SEQ ID NO: 81358 - RNA, 32 nt, Human
cacgcacuguggagguggagugcagcauuuga

SEQ ID NO: 81359 - RNA, 32 nt, Human
cacgcagaagccaccagaaucuugccugcccu

SEQ ID NO: 81360 - RNA, 21 nt, Human
cacgcagacagcuggaagggu

SEQ ID NO: 81361 - RNA, 32 nt, Human
cacgcagacaucuucagccgcugccaggccug

SEQ ID NO: 81362 - RNA, 32 nt, Human
cacgcagagaacauucuggcugagggagaggu

SEQ ID NO: 81363 - RNA, 32 nt, Human
cacgcagagccccaggcgcggagcugaggccg

SEQ ID NO: 81364 - RNA, 24 nt, Human
cacgcagaguucuagaaggagguu

SEQ ID NO: 81365 - RNA, 32 nt, Human
cacgcagauccugucugcgcucagcuuccugc

SEQ ID NO: 81366 - RNA, 32 nt, Human
cacgcagcagagggacaugggccauuccauga

SEQ ID NO: 81367 - RNA, 19 nt, Human
cacgcagcaguauuggggg

SEQ ID NO: 81368 - RNA, 32 nt, Human
cacgcagcaguauugggggugguucgggggag

SEQ ID NO: 81369 - RNA, 32 nt, Human
cacgcagcauguccccucaggucuccagucag

SEQ ID NO: 81370 - RNA, 32 nt, Human
cacgcagcauuuuccugccguucucucaggga

SEQ ID NO: 81371 - RNA, 32 nt, Human
cacgcagccccggcuccugccugcgccucucc

SEQ ID NO: 81372 - RNA, 32 nt, Human
cacgcagccuuauaaagcagguuuugguuucu

SEQ ID NO: 81373 - RNA, 24 nt, Human
cacgcagcuaauuuuuguauuuuu

SEQ ID NO: 81374 - RNA, 32 nt, Human
cacgcagcucaggccugccccaguggccacaa

SEQ ID NO: 81375 - RNA, 32 nt, Human
cacgcagcuccagcccaucuugcugaccuaau

SEQ ID NO: 81376 - RNA, 32 nt, Human
cacgcagcugccgcgccauguccugcuuggcc

SEQ ID NO: 81377 - RNA, 32 nt, Human
cacgcagcuguucccccacauggacagaugga

SEQ ID NO: 81378 - RNA, 32 nt, Human
cacgcaggaaaugucagaggcagcagucuggu

SEQ ID NO: 81379 - RNA, 32 nt, Human
cacgcaggacagauaccgcuccacacucugcu

SEQ ID NO: 81380 - RNA, 32 nt, Human
cacgcaggcacucacauucacacacauacaca

SEQ ID NO: 81381 - RNA, 32 nt, Human
cacgcaggggagggagucagugucggaaccug

SEQ ID NO: 81382 - RNA, 18 nt, Human
cacgcagucccuggucac

SEQ ID NO: 81383 - RNA, 32 nt, Human
cacgcauacacacaugaacacaugcacaugug

SEQ ID NO: 81384 - RNA, 32 nt, Human
cacgcauagauccacgaggcaccaaggccugg

SEQ ID NO: 81385 - RNA, 31 nt, Human
cacgcaucaauaaauaauuuugaaggccuca

SEQ ID NO: 81386 - RNA, 32 nt, Human
cacgcaugcacacacgcacacaugcacacaca

SEQ ID NO: 81387 - RNA, 24 nt, Human
cacgcaugcacgugcacacaugua

SEQ ID NO: 81388 - RNA, 32 nt, Human
cacgcaugccuuucugguuguuccucugaagc

SEQ ID NO: 81389 - RNA, 32 nt, Human
cacgccaaugcacacacacagagauaugcaca

SEQ ID NO: 81390 - RNA, 32 nt, Human
cacgccacacacaaccucuccacaugccucag

SEQ ID NO: 81391 - RNA, 32 nt, Human
cacgccacagcacuccagccugggcgacagag

SEQ ID NO: 81392 - RNA, 32 nt, Human
cacgccacuacacuccaaccugggugacagag

SEQ ID NO: 81393 - RNA, 32 nt, Human
cacgccacuacacuccagccugggcaacagag

SEQ ID NO: 81394 - RNA, 32 nt, Human
cacgccacuacacuccagccugggcgacagag

SEQ ID NO: 81395 - RNA, 20 nt, Human
cacgccacucuacuccagcc

SEQ ID NO: 81396 - RNA, 32 nt, Human
cacgccacugaacuccagccugggagacagca

SEQ ID NO: 81397 - RNA, 32 nt, Human
cacgccacugaacuccagccugggugacagag

SEQ ID NO: 81398 - RNA, 18 nt, Human
cacgccacugaccagcua

SEQ ID NO: 81399 - RNA, 32 nt, Human
cacgccacugcaacuccagcuugggugacaga

SEQ ID NO: 81400 - RNA, 32 nt, Human
cacgccacugcaccccagccugggugacagag

SEQ ID NO: 81401 - RNA, 32 nt, Human
cacgccacugcacuacagccuggacgacagag

SEQ ID NO: 81402 - RNA, 32 nt, Human
cacgccacugcacuauagccuaggugacagag

SEQ ID NO: 81403 - RNA, 32 nt, Human
cacgccacugcacucaagccugggcgacagag

SEQ ID NO: 81404 - RNA, 32 nt, Human
cacgccacugcacuccaaccugggugacagag

SEQ ID NO: 81405 - RNA, 32 nt, Human
cacgccacugcacuccaacuugggcaacagac

SEQ ID NO: 81406 - RNA, 32 nt, Human
cacgccacugcacuccaccugggcaacaagaa

SEQ ID NO: 81407 - RNA, 32 nt, Human
cacgccacugcacuccagcacccugggcgaca

SEQ ID NO: 81408 - RNA, 20 nt, Human
cacgccacugcacuccagcc

SEQ ID NO: 81409 - RNA, 32 nt, Human
cacgccacugcacuccagcccgggcgacaguu

SEQ ID NO: 81410 - RNA, 32 nt, Human
cacgccacugcacuccagcccgggcggcagag

SEQ ID NO: 81411 - RNA, 32 nt, Human
cacgccacugcacuccagcccggggacagagc

SEQ ID NO: 81412 - RNA, 32 nt, Human
cacgccacugcacuccagcccgggugacagag

SEQ ID NO: 81413 - RNA, 32 nt, Human
cacgccacugcacuccagccuaggcgacagag

SEQ ID NO: 81414 - RNA, 32 nt, Human
cacgccacugcacuccagccucggugacagag

SEQ ID NO: 81415 - RNA, 32 nt, Human
cacgccacugcacuccagccugagugacagag

SEQ ID NO: 81416 - RNA, 32 nt, Human
cacgccacugcacuccagccugcggacagacc

SEQ ID NO: 81417 - RNA, 32 nt, Human
cacgccacugcacuccagccuggacaacagag

SEQ ID NO: 81418 - RNA, 32 nt, Human
cacgccacugcacuccagccuggaugacagag

SEQ ID NO: 81419 - RNA, 32 nt, Human
cacgccacugcacuccagccuggcgacagagc

SEQ ID NO: 81420 - RNA, 32 nt, Human
cacgccacugcacuccagccugggagacagag

SEQ ID NO: 81421 - RNA, 32 nt, Human
cacgccacugcacuccagccugggcaacaaga

SEQ ID NO: 81422 - RNA, 32 nt, Human
cacgccacugcacuccagccugggcaacagag

SEQ ID NO: 81423 - RNA, 32 nt, Human
cacgccacugcacuccagccugggcaacagug

SEQ ID NO: 81424 - RNA, 32 nt, Human
cacgccacugcacuccagccugggcaacggau

SEQ ID NO: 81425 - RNA, 32 nt, Human
cacgccacugcacuccagccugggccacagaa

SEQ ID NO: 81426 - RNA, 32 nt, Human
cacgccacugcacuccagccugggcgacagaa

SEQ ID NO: 81427 - RNA, 32 nt, Human
cacgccacugcacuccagccugggcgacagag

SEQ ID NO: 81428 - RNA, 32 nt, Human
cacgccacugcacuccagccugggcgacagug

SEQ ID NO: 81429 - RNA, 32 nt, Human
cacgccacugcacuccagccugggcgauggag

SEQ ID NO: 81430 - RNA, 32 nt, Human
cacgccacugcacuccagccugggcugcaggg

SEQ ID NO: 81431 - RNA, 32 nt, Human
cacgccacugcacuccagccuggguaacaaga

SEQ ID NO: 81432 - RNA, 32 nt, Human
cacgccacugcacuccagccuggguaacagag

SEQ ID NO: 81433 - RNA, 32 nt, Human
cacgccacugcacuccagccugggugacagaa

SEQ ID NO: 81434 - RNA, 32 nt, Human
cacgccacugcacuccagccugggugacagag

SEQ ID NO: 81435 - RNA, 32 nt, Human
cacgccacugcacuccagccugggugacagug

SEQ ID NO: 81436 - RNA, 32 nt, Human
cacgccacugcacuccagccuggucaacagag

SEQ ID NO: 81437 - RNA, 32 nt, Human
cacgccacugcacuccagccuggugacagagc

SEQ ID NO: 81438 - RNA, 32 nt, Human
cacgccacugcacuccagccuggugacagcgu

SEQ ID NO: 81439 - RNA, 32 nt, Human
cacgccacugcacuccagccuguugacaaagc

SEQ ID NO: 81440 - RNA, 32 nt, Human
cacgccacugcacuccagcgugggcaacagag

SEQ ID NO: 81441 - RNA, 32 nt, Human
cacgccacugcacuccagcuggagugacagag

SEQ ID NO: 81442 - RNA, 32 nt, Human
cacgccacugcacuccagcuugggugacaaag

SEQ ID NO: 81443 - RNA, 32 nt, Human
cacgccacugcacuccagucugggugacagag

SEQ ID NO: 81444 - RNA, 32 nt, Human
cacgccacugcacuccauccagccugggugac

SEQ ID NO: 81445 - RNA, 32 nt, Human
cacgccacugcacucuagccuaggcgacagag

SEQ ID NO: 81446 - RNA, 32 nt, Human
cacgccacugcacucuagccugggauacagag

SEQ ID NO: 81447 - RNA, 32 nt, Human
cacgccacugcacucuagccugggcaacaaga

SEQ ID NO: 81448 - RNA, 32 nt, Human
cacgccacugcacucuagccugggcaauaaga

SEQ ID NO: 81449 - RNA, 32 nt, Human
cacgccacugcacuugagccugggcgacacag

SEQ ID NO: 81450 - RNA, 32 nt, Human
cacgccacugcauuacagccuggugcagagca

SEQ ID NO: 81451 - RNA, 32 nt, Human
cacgccacugcauuccagacugggcgacagag

SEQ ID NO: 81452 - RNA, 32 nt, Human
cacgccacugcauuccagccugggcgacagag

SEQ ID NO: 81453 - RNA, 32 nt, Human
cacgccacugcauuccagccuggugacagagc

SEQ ID NO: 81454 - RNA, 32 nt, Human
cacgccacugcauuccagccugugcgacagaa

SEQ ID NO: 81455 - RNA, 32 nt, Human
cacgccacugcauucuauccugggcaacagau

SEQ ID NO: 81456 - RNA, 32 nt, Human
cacgccacugcccuccagccuggggagacaga

SEQ ID NO: 81457 - RNA, 32 nt, Human
cacgccacugcgcuacagccugggcgacacag

SEQ ID NO: 81458 - RNA, 32 nt, Human
cacgccacugcgcuccagccugggcgaaagag

SEQ ID NO: 81459 - RNA, 32 nt, Human
cacgccacuguacuccagccuggaugacacag

SEQ ID NO: 81460 - RNA, 32 nt, Human
cacgccacuguacuccagccugggagacacag

SEQ ID NO: 81461 - RNA, 32 nt, Human
cacgccacuguacuucagccucagugacaaag

SEQ ID NO: 81462 - RNA, 32 nt, Human
cacgccacuguacuucuagccuggguuacaga

SEQ ID NO: 81463 - RNA, 32 nt, Human
cacgccacugugcuccagccugggcaacaaag

SEQ ID NO: 81464 - RNA, 32 nt, Human
cacgccagauccucugucccaccccaggccuu

SEQ ID NO: 81465 - RNA, 32 nt, Human
cacgccagccaugccccuccccaggacuccca

SEQ ID NO: 81466 - RNA, 32 nt, Human
cacgccagccugggcaacagagcaagacucug

SEQ ID NO: 81467 - RNA, 32 nt, Human
cacgccagccugggcgacagagcgagacuccg

SEQ ID NO: 81468 - RNA, 32 nt, Human
cacgccagccugggugaaagagugagacccug

SEQ ID NO: 81469 - RNA, 32 nt, Human
cacgccagugcacuccagccugagagacagag

SEQ ID NO: 81470 - RNA, 32 nt, Human
cacgccagugcuguuucccggccuccagacac

SEQ ID NO: 81471 - RNA, 32 nt, Human
cacgccauagcaauugcacuccggccugggca

SEQ ID NO: 81472 - RNA, 32 nt, Human
cacgccaucacacugcagccuaggugacagag

SEQ ID NO: 81473 - RNA, 32 nt, Human
cacgccauccucggagccccagccuuucaccc

SEQ ID NO: 81474 - RNA, 32 nt, Human
cacgccaucuccauccccaucuugaguccugg

SEQ ID NO: 81475 - RNA, 32 nt, Human
cacgccauuacacuccagccuggcugacagug

SEQ ID NO: 81476 - RNA, 32 nt, Human
cacgccauuacacuccagccugggcaacagag

SEQ ID NO: 81477 - RNA, 20 nt, Human
cacgccauucuuccaccuca

SEQ ID NO: 81478 - RNA, 32 nt, Human
cacgccauugcacuacagccugggugacagag

SEQ ID NO: 81479 - RNA, 32 nt, Human
cacgccauugcacucaagccugggcaauaaga

SEQ ID NO: 81480 - RNA, 32 nt, Human
cacgccauugcacuccaaccugggugacaaga

SEQ ID NO: 81481 - RNA, 32 nt, Human
cacgccauugcacuccagccuaggcaacgaga

SEQ ID NO: 81482 - RNA, 32 nt, Human
cacgccauugcacuccagccuaggcgacagag

SEQ ID NO: 81483 - RNA, 32 nt, Human
cacgccauugcacuccagccugggcaacaaga

SEQ ID NO: 81484 - RNA, 32 nt, Human
cacgccauugcacuccagccugggcaacaagc

SEQ ID NO: 81485 - RNA, 32 nt, Human
cacgccauugcacuccagccugggcaacagag

SEQ ID NO: 81486 - RNA, 32 nt, Human
cacgccauugcacuccagccugggcaacagug

SEQ ID NO: 81487 - RNA, 32 nt, Human
cacgccauugcacuccagccugggcaacgaga

SEQ ID NO: 81488 - RNA, 32 nt, Human
cacgccauugcacuccagccugggcaauaaga

SEQ ID NO: 81489 - RNA, 32 nt, Human
cacgccauugcacuccagccugggcgacagag

SEQ ID NO: 81490 - RNA, 32 nt, Human
cacgccauugcacuccagccugggggacagag

SEQ ID NO: 81491 - RNA, 32 nt, Human
cacgccauugcacuccagccugggugacaaga

SEQ ID NO: 81492 - RNA, 32 nt, Human
cacgccauugcacuccagccugggugacacag

SEQ ID NO: 81493 - RNA, 32 nt, Human
cacgccauugcacuccagccugggugacagaa

SEQ ID NO: 81494 - RNA, 32 nt, Human
cacgccauugcacuccagccugggugacagag

SEQ ID NO: 81495 - RNA, 32 nt, Human
cacgccauugcacuccagccugugcgacaaga

SEQ ID NO: 81496 - RNA, 32 nt, Human
cacgccauugcacuccagcuugggcaauaaga

SEQ ID NO: 81497 - RNA, 32 nt, Human
cacgccauugcacuccagucugagcaacaaga

SEQ ID NO: 81498 - RNA, 32 nt, Human
cacgccauugcacuccagucugguugacagag

SEQ ID NO: 81499 - RNA, 32 nt, Human
cacgccauuguacuccagccuggcaacagagc

SEQ ID NO: 81500 - RNA, 32 nt, Human
cacgccauuguacuccagccugggcaacaaga

SEQ ID NO: 81501 - RNA, 32 nt, Human
cacgccauuguacuccagccugggcgacagag

SEQ ID NO: 81502 - RNA, 32 nt, Human
cacgcccaagcccugcagagggaaggacugag

SEQ ID NO: 81503 - RNA, 32 nt, Human
cacgcccacacagcaccucugccaggccuagg

SEQ ID NO: 81504 - RNA, 18 nt, Human
cacgcccacccccuccca

SEQ ID NO: 81505 - RNA, 32 nt, Human
cacgcccacccugaacuccagcuggcccgcaa

SEQ ID NO: 81506 - RNA, 32 nt, Human
cacgcccacgcuaggcccugagcccaccucua

SEQ ID NO: 81507 - RNA, 32 nt, Human
cacgcccagcacagccuugggggaaguguaca

SEQ ID NO: 81508 - RNA, 32 nt, Human
cacgcccagccugccuugagaaaaagaagcca

SEQ ID NO: 81509 - RNA, 32 nt, Human
cacgcccagccuguggccagcacuuuagaugc

SEQ ID NO: 81510 - RNA, 32 nt, Human
cacgcccaucuucugccucauaguggucacuc

SEQ ID NO: 81511 - RNA, 32 nt, Human
cacgccccaggggaccagccaggccuggaaug

SEQ ID NO: 81512 - RNA, 32 nt, Human
cacgcccccuaccggcccauguuucuauuugc

SEQ ID NO: 81513 - RNA, 32 nt, Human
cacgcccccucccgucucuccgucucgacccc

SEQ ID NO: 81514 - RNA, 32 nt, Human
cacgcccccugauucuggaacucccccaacuu

SEQ ID NO: 81515 - RNA, 20 nt, Human
cacgccccgccccccucgcu

SEQ ID NO: 81516 - RNA, 32 nt, Human
cacgccccuaacccuaacggggaucccagucc

SEQ ID NO: 81517 - RNA, 24 nt, Human
cacgccccuccuucccagucccau

SEQ ID NO: 81518 - RNA, 32 nt, Human
cacgccccuuucuccccaugccccauccagca

SEQ ID NO: 81519 - RNA, 32 nt, Human
cacgcccgacucucuccaucagaaggguuuau

SEQ ID NO: 81520 - RNA, 32 nt, Human
cacgcccggcccagcccugccggccgcauugg

SEQ ID NO: 81521 - RNA, 32 nt, Human
cacgcccuagggcuuccagccuccucuucagu

SEQ ID NO: 81522 - RNA, 18 nt, Human
cacgcccuccaguccuca

SEQ ID NO: 81523 - RNA, 32 nt, Human
cacgcccucccuggcccccgccugggccuccu

SEQ ID NO: 81524 - RNA, 32 nt, Human
cacgcccuccuccucgcugccugcagcuccaa

SEQ ID NO: 81525 - RNA, 32 nt, Human
cacgcccugcacuccgggaccgucccugcgcg

SEQ ID NO: 81526 - RNA, 32 nt, Human
cacgcccugcacuguggagaagugaccugguc

SEQ ID NO: 81527 - RNA, 32 nt, Human
cacgcccugccugcccucccugcccagcugua

SEQ ID NO: 81528 - RNA, 32 nt, Human
cacgcccugccugguccgccauguuccaaaga

SEQ ID NO: 81529 - RNA, 32 nt, Human
cacgcccugcggagaggaaaugacaggcacgc

SEQ ID NO: 81530 - RNA, 32 nt, Human
cacgcccuggaccagccgcccagaucauggcg

SEQ ID NO: 81531 - RNA, 32 nt, Human
cacgcccugggcagguaggcgggagcuucccu

SEQ ID NO: 81532 - RNA, 32 nt, Human
cacgccgauauaagccauagccccaggcccgc

SEQ ID NO: 81533 - RNA, 32 nt, Human
cacgccgcagagccauggagaucggcaccgag

SEQ ID NO: 81534 - RNA, 32 nt, Human
cacgccgcuagugcucccaccccgcccuccug

SEQ ID NO: 81535 - RNA, 32 nt, Human
cacgccgcugcacuccagccugagcacagagc

SEQ ID NO: 81536 - RNA, 32 nt, Human
cacgccgcugcacuccagcuugaaugacagag

SEQ ID NO: 81537 - RNA, 32 nt, Human
cacgccggcaaggaaagcgcagcucugagccc

SEQ ID NO: 81538 - RNA, 32 nt, Human
cacgccggcccgcgcgugccucugccuacaag

SEQ ID NO: 81539 - RNA, 32 nt, Human
cacgccgggacaccauguucuccaucaagcua

SEQ ID NO: 81540 - RNA, 32 nt, Human
cacgccggggccuccaccgccugggccugagc

SEQ ID NO: 81541 - RNA, 32 nt, Human
cacgccgguauucagugccuggcgcggugcua

SEQ ID NO: 81542 - RNA, 32 nt, Human
cacgccguugcacuccagccugggcaacaaga

SEQ ID NO: 81543 - RNA, 32 nt, Human
cacgccuaccugagcagccucugacugcccuu

SEQ ID NO: 81544 - RNA, 32 nt, Human
cacgccuaucuucucucucugcuccuccuucc

SEQ ID NO: 81545 - RNA, 32 nt, Human
cacgccucagaggggcccucagccucuccuga

SEQ ID NO: 81546 - RNA, 32 nt, Human
cacgccucagugucuccucaggcacaggaagu

SEQ ID NO: 81547 - RNA, 32 nt, Human
cacgccucauuaggggcaucaaagacucaagu

SEQ ID NO: 81548 - RNA, 32 nt, Human
cacgccuccuguucuuucuuaaagcuguuagg

SEQ ID NO: 81549 - RNA, 23 nt, Human
cacgccucuaaucccagcacuuu

SEQ ID NO: 81550 - RNA, 32 nt, Human
cacgccucucccaggaccugcagcacaguggu

SEQ ID NO: 81551 - RNA, 32 nt, Human
cacgccucucccugcacucccuccuggagcuc

SEQ ID NO: 81552 - RNA, 32 nt, Human
cacgccucugcacuccagccugggcaacaaga

SEQ ID NO: 81553 - RNA, 32 nt, Human
cacgccucuggucccagcugcucgggaggccg

SEQ ID NO: 81554 - RNA, 32 nt, Human
cacgccugcaaacgcugccugcccguaaacac

SEQ ID NO: 81555 - RNA, 32 nt, Human
cacgccugcaaacgcugccugccgguaaacac

SEQ ID NO: 81556 - RNA, 32 nt, Human
cacgccugccucgauuguccagccucugccag

SEQ ID NO: 81557 - RNA, 32 nt, Human
cacgccugcuuuguggggcagggccaugcggc

SEQ ID NO: 81558 - RNA, 32 nt, Human
cacgccuggccuugauuuccuucuuaagcaga

SEQ ID NO: 81559 - RNA, 32 nt, Human
cacgccuggcuuuccuuggauacccacuguca

SEQ ID NO: 81560 - RNA, 17 nt, Human
cacgccugggacagaag

SEQ ID NO: 81561 - RNA, 32 nt, Human
cacgccugggcaacauggugaaacccugucuc

SEQ ID NO: 81562 - RNA, 32 nt, Human
cacgccuguaaacccagcuacucgggagguug

SEQ ID NO: 81563 - RNA, 32 nt, Human
cacgccuguaaucccaacacuuuucgaggccu

SEQ ID NO: 81564 - RNA, 22 nt, Human
cacgccuguaaucccagcacuu

SEQ ID NO: 81565 - RNA, 23 nt, Human
cacgccuguaaucccagcacuuu

SEQ ID NO: 81566 - RNA, 22 nt, Human
cacgccuguaaucccagcuacu

SEQ ID NO: 81567 - RNA, 32 nt, Human
cacgccuguaaucccagcuacucgggaagcug

SEQ ID NO: 81568 - RNA, 32 nt, Human
cacgccuguaaucccagcuacucgggaggcua

SEQ ID NO: 81569 - RNA, 32 nt, Human
cacgccuguaaucccagcuacucgggaggcug

SEQ ID NO: 81570 - RNA, 32 nt, Human
cacgccuguaaucccagcuacucuggaggcug

SEQ ID NO: 81571 - RNA, 23 nt, Human
cacgccuguaaucccagcuacuu

SEQ ID NO: 81572 - RNA, 32 nt, Human
cacgccuguaaucccagcuacuuggaaggcug

SEQ ID NO: 81573 - RNA, 32 nt, Human
cacgccuguaaucccagcuacuugggaggcug

SEQ ID NO: 81574 - RNA, 32 nt, Human
cacgccuguaaucccagcuccuugggaggcug

SEQ ID NO: 81575 - RNA, 32 nt, Human
cacgccuguaaucccagcucuuugggaggccg

SEQ ID NO: 81576 - RNA, 32 nt, Human
cacgccuguaaucccagcucuuugggaggcug

SEQ ID NO: 81577 - RNA, 32 nt, Human
cacgccuguaaucccagcucuuuguggggccg

SEQ ID NO: 81578 - RNA, 32 nt, Human
cacgccuguaaucccagcugcuugggaggcug

SEQ ID NO: 81579 - RNA, 32 nt, Human
cacgccuguaaucccagcuucuugggaggcug

SEQ ID NO: 81580 - RNA, 32 nt, Human
cacgccuguagucccaacacuuugggaggccg

SEQ ID NO: 81581 - RNA, 32 nt, Human
cacgccuguagucccagagcuuugggaggcug

SEQ ID NO: 81582 - RNA, 32 nt, Human
cacgccuguagucccagcacuuugagaggccg

SEQ ID NO: 81583 - RNA, 32 nt, Human
cacgccuguagucccagcacuuugggagcccg

SEQ ID NO: 81584 - RNA, 32 nt, Human
cacgccuguagucccagcacuuugggaggcag

SEQ ID NO: 81585 - RNA, 32 nt, Human
cacgccuguagucccagcacuuugggaggccg

SEQ ID NO: 81586 - RNA, 32 nt, Human
cacgccuguagucccagcauuuugggaggcug

SEQ ID NO: 81587 - RNA, 32 nt, Human
cacgccuguagucccagcuacccgggaggcug

SEQ ID NO: 81588 - RNA, 32 nt, Human
cacgccuguagucccagcuaccuaggaggcug

SEQ ID NO: 81589 - RNA, 32 nt, Human
cacgccuguagucccagcuacucaggaggcua

SEQ ID NO: 81590 - RNA, 32 nt, Human
cacgccuguagucccagcuacucaggaggcug

SEQ ID NO: 81591 - RNA, 32 nt, Human
cacgccuguagucccagcuacucgggagccug

SEQ ID NO: 81592 - RNA, 32 nt, Human
cacgccuguagucccagcuacucgggaggcug

SEQ ID NO: 81593 - RNA, 32 nt, Human
cacgccuguagucccagcuacuggggaggcug

SEQ ID NO: 81594 - RNA, 32 nt, Human
cacgccuguagucccagcuacuugggaggcug

SEQ ID NO: 81595 - RNA, 32 nt, Human
cacgccuguagucccagcuccucgggaggcag

SEQ ID NO: 81596 - RNA, 32 nt, Human
cacgccuguagucccagguacuugcgaggcua

SEQ ID NO: 81597 - RNA, 32 nt, Human
cacgccuguagucccagguacuugggagccug

SEQ ID NO: 81598 - RNA, 32 nt, Human
cacgccuguagucccagguucuugggaagcug

SEQ ID NO: 81599 - RNA, 32 nt, Human
cacgccuguagucccaguuacuugggaggcug

SEQ ID NO: 81600 - RNA, 32 nt, Human
cacgccuguaguuccagcuacucaggaggcug

SEQ ID NO: 81601 - RNA, 32 nt, Human
cacgccuguauucccagcuacuugggaggcug

SEQ ID NO: 81602 - RNA, 32 nt, Human
cacgccugugcuuacacacaugcacacacaaa

SEQ ID NO: 81603 - RNA, 32 nt, Human
cacgccuguggucccagcacuuugggaggccg

SEQ ID NO: 81604 - RNA, 32 nt, Human
cacgccuguggucccagcuacacaggaggcua

SEQ ID NO: 81605 - RNA, 32 nt, Human
cacgccuguggucccagcuacucgggaggcuu

SEQ ID NO: 81606 - RNA, 32 nt, Human
cacgccuguggucccagcuauucaggaggcug

SEQ ID NO: 81607 - RNA, 32 nt, Human
cacgccuguggucccagcugcuggggaggcug

SEQ ID NO: 81608 - RNA, 32 nt, Human
cacgccuuguaaucccagcacuuugggaggcc

SEQ ID NO: 81609 - RNA, 32 nt, Human
cacgccuuuaaucccagcuacucgggaggcug

SEQ ID NO: 81610 - RNA, 32 nt, Human
cacgcgaggcgcccgggaggugccaccacagg

SEQ ID NO: 81611 - RNA, 32 nt, Human
cacgcgcaggcccugaccucacugccugccuc

SEQ ID NO: 81612 - RNA, 32 nt, Human
cacgcgccagccaggcugugggcagggcgggg

SEQ ID NO: 81613 - RNA, 32 nt, Human
cacgcgcccagccuagacuagcauuuuugagu

SEQ ID NO: 81614 - RNA, 32 nt, Human
cacgcgccgcgccgcgaggcuugggggaggug

SEQ ID NO: 81615 - RNA, 32 nt, Human
cacgcgccuguaaucccagcuacuugggaggc

SEQ ID NO: 81616 - RNA, 32 nt, Human
cacgcggagaggaggagaggcugagggaggga

SEQ ID NO: 81617 - RNA, 32 nt, Human
cacgcggaugccgccucaagggucuucagggg

SEQ ID NO: 81618 - RNA, 32 nt, Human
cacgcggcagguuccaggugcccuggcuggag

SEQ ID NO: 81619 - RNA, 32 nt, Human
cacgcggccaggcagagaaggugcccggagcu

SEQ ID NO: 81620 - RNA, 21 nt, Human
cacgcggccucgggccucccu

SEQ ID NO: 81621 - RNA, 32 nt, Human
cacgcggcgugguccccagagcuaggccggag

SEQ ID NO: 81622 - RNA, 32 nt, Human
cacgcgggacccucugccacccucucugccac

SEQ ID NO: 81623 - RNA, 32 nt, Human
cacgcggggaagcacaucagagucgccggcug

SEQ ID NO: 81624 - RNA, 32 nt, Human
cacgcggggcaggccggggcugugagggggca

SEQ ID NO: 81625 - RNA, 32 nt, Human
cacgcggggcccgggagccaugguccgcuucg

SEQ ID NO: 81626 - RNA, 32 nt, Human
cacgcguccgcgagaaggaggacucgcaagcc

SEQ ID NO: 81627 - RNA, 32 nt, Human
cacgcguccgggggugcugggccuggcgggca

SEQ ID NO: 81628 - RNA, 32 nt, Human
cacgcgugagccacugugcccagccgaucuga

SEQ ID NO: 81629 - RNA, 32 nt, Human
cacgcuaacuagcugaccacagacuccacagu

SEQ ID NO: 81630 - RNA, 32 nt, Human
cacgcuacugcgcuccagccugagugauagag

SEQ ID NO: 81631 - RNA, 32 nt, Human
cacgcuagccugggcaacagauugagacuugu

SEQ ID NO: 81632 - RNA, 32 nt, Human
cacgcuagccugggugacacaggaagacucca

SEQ ID NO: 81633 - RNA, 32 nt, Human
cacgcuauggcgcacacacacagugcacgucc

SEQ ID NO: 81634 - RNA, 32 nt, Human
cacgcucaaacuguaugccugcuccagccugg

SEQ ID NO: 81635 - RNA, 32 nt, Human
cacgcucacccagucaccuccccacaucgcac

SEQ ID NO: 81636 - RNA, 32 nt, Human
cacgcucacucugcuuccuuguggguggccuu

SEQ ID NO: 81637 - RNA, 32 nt, Human
cacgcuccacgcacacacaccccagcccuguc

SEQ ID NO: 81638 - RNA, 32 nt, Human
cacgcuccagcccuucaucagccugggcaguc

SEQ ID NO: 81639 - RNA, 32 nt, Human
cacgcuccagccugacccuccagcauaccuau

SEQ ID NO: 81640 - RNA, 32 nt, Human
cacgcucccuggaagcuggaagacugugcaga

SEQ ID NO: 81641 - RNA, 32 nt, Human
cacgcucccuggggcucuuaguucagcugcug

SEQ ID NO: 81642 - RNA, 32 nt, Human
cacgcuccgcagccucaggucuuggcucucac

SEQ ID NO: 81643 - RNA, 21 nt, Human
cacgcucgacgcugcugcagg

SEQ ID NO: 81644 - RNA, 32 nt, Human
cacgcucucacugcugccuccugcuggccgcu

SEQ ID NO: 81645 - RNA, 32 nt, Human
cacgcucuccuccaccgaccaggugaccuuuu

SEQ ID NO: 81646 - RNA, 32 nt, Human
cacgcucucuccccacaucgucuucccaucug

SEQ ID NO: 81647 - RNA, 32 nt, Human
cacgcucucucuucucucccaggcucuggcuc

SEQ ID NO: 81648 - RNA, 32 nt, Human
cacgcucucugcucucuccauucccauuuuug

SEQ ID NO: 81649 - RNA, 32 nt, Human
cacgcucuggcgcgggaggcgccccuucgccu

SEQ ID NO: 81650 - RNA, 32 nt, Human
cacgcugacacacccacauucaccaaacccac

SEQ ID NO: 81651 - RNA, 32 nt, Human
cacgcugagagggacacgcagugacgagcggc

SEQ ID NO: 81652 - RNA, 32 nt, Human
cacgcugaguccuagacacagagccaggccgg

SEQ ID NO: 81653 - RNA, 32 nt, Human
cacgcugccuuccgcuccuccuggucuuuccc

SEQ ID NO: 81654 - RNA, 32 nt, Human
cacgcugcgcuagcacaaacacaaaguaggau

SEQ ID NO: 81655 - RNA, 32 nt, Human
cacgcugcggguaccggggcuugggggcgcuc

SEQ ID NO: 81656 - RNA, 32 nt, Human
cacgcugcuaauggcaucaucaccucuggcuc

SEQ ID NO: 81657 - RNA, 32 nt, Human
cacgcugcugccaguccuuguggaaguggggc

SEQ ID NO: 81658 - RNA, 32 nt, Human
cacgcugcuggcagagaugguuugagaacaca

SEQ ID NO: 81659 - RNA, 32 nt, Human
cacgcuggagccaacagaguuaagaggaagau

SEQ ID NO: 81660 - RNA, 32 nt, Human
cacgcuggagccagggaacacaggagagggga

SEQ ID NO: 81661 - RNA, 21 nt, Human
cacgcuggagugaccggcccu

SEQ ID NO: 81662 - RNA, 22 nt, Human
cacgcuggagugaccggcccuc

SEQ ID NO: 81663 - RNA, 32 nt, Human
cacgcuggccuccauggagacuccaggcagcc

SEQ ID NO: 81664 - RNA, 32 nt, Human
cacgcugggaggacacgggcugggcugagcag

SEQ ID NO: 81665 - RNA, 32 nt, Human
cacgcugggccgcggcugcccggcagcaacug

SEQ ID NO: 81666 - RNA, 32 nt, Human
cacgcugggcuguuuauuagguacaguaauaa

SEQ ID NO: 81667 - RNA, 32 nt, Human
cacgcugggcuucaaagacgagagaagaaaca

SEQ ID NO: 81668 - RNA, 32 nt, Human
cacgcuggucucaaacuccuggacucauggga

SEQ ID NO: 81669 - RNA, 32 nt, Human
cacgcuggucugggauaguugggcagggagac

SEQ ID NO: 81670 - RNA, 32 nt, Human
cacgcuggugcugggagcgccugccuucucuu

SEQ ID NO: 81671 - RNA, 32 nt, Human
cacgcuguagacauucccucuccuggucucug

SEQ ID NO: 81672 - RNA, 32 nt, Human
cacgcugucaccaggcuggagugcaguggcgc

SEQ ID NO: 81673 - RNA, 32 nt, Human
cacgcugugcagcagcagugaagccugaagca

SEQ ID NO: 81674 - RNA, 25 nt, Human
cacgcuuaccucaaccauccuggcu

SEQ ID NO: 81675 - RNA, 32 nt, Human
cacgcuuguagucccaguuacuugggaggcug

SEQ ID NO: 81676 - RNA, 32 nt, Human
cacgcuuucaugaauucugucauuucaaagac

SEQ ID NO: 81677 - RNA, 32 nt, Human
cacgcuuuugugauggagugcuguuuuguuau

SEQ ID NO: 81678 - RNA, 22 nt, Human
cacggaaaggaaucuaauucca

SEQ ID NO: 81679 - RNA, 32 nt, Human
cacggaacaugcugcaauucaggagucuggcu

SEQ ID NO: 81680 - RNA, 32 nt, Human
cacggaacucggcugcggcuccauggucugag

SEQ ID NO: 81681 - RNA, 19 nt, Human
cacggaacuugcaguucca

SEQ ID NO: 81682 - RNA, 32 nt, Human
cacggaagacaagagaguagccucuccaguuu

SEQ ID NO: 81683 - RNA, 32 nt, Human
cacggaagccuaucaacggaugccugugauuc

SEQ ID NO: 81684 - RNA, 32 nt, Human
cacggaagcucagcagacucggcagggcaagc

SEQ ID NO: 81685 - RNA, 32 nt, Human
cacggaaggaagggcacugugaagcagugagg

SEQ ID NO: 81686 - RNA, 32 nt, Human
cacggaaggucggccugggauguggccuggga

SEQ ID NO: 81687 - RNA, 32 nt, Human
cacggaauauagaagacauggcauuuuacuca

SEQ ID NO: 81688 - RNA, 32 nt, Human
cacggacauucuuccuccuucugguaccaucu

SEQ ID NO: 81689 - RNA, 32 nt, Human
cacggaccaggucacguauuguguacacccac

SEQ ID NO: 81690 - RNA, 32 nt, Human
cacggaccaucuuuagcaguuuccucagugau

SEQ ID NO: 81691 - RNA, 21 nt, Human
cacggacccagcgcgcggggg

SEQ ID NO: 81692 - RNA, 32 nt, Human
cacggaccugggacuuggaggauagcaaagaa

SEQ ID NO: 81693 - RNA, 32 nt, Human
cacggacgacaccaguucggugaccuccucug

SEQ ID NO: 81694 - RNA, 32 nt, Human
cacggacuacaauucuaucccucccagaggga

SEQ ID NO: 81695 - RNA, 32 nt, Human
cacggacucucuccaccugcacggugcuggag

SEQ ID NO: 81696 - RNA, 32 nt, Human
cacggacugcguuccgcagcuccugggugggg

SEQ ID NO: 81697 - RNA, 32 nt, Human
cacggacuucugcugcugccaccugcgccagc

SEQ ID NO: 81698 - RNA, 32 nt, Human
cacggagaggaagggaaggaaggagagggagg

SEQ ID NO: 81699 - RNA, 32 nt, Human
cacggagauccuaagcuggcugucuugugugc

SEQ ID NO: 81700 - RNA, 32 nt, Human
cacggagcaccugcacgcugugcucgacaccg

SEQ ID NO: 81701 - RNA, 32 nt, Human
cacggagcagaggucaucuguccccagcuugg

SEQ ID NO: 81702 - RNA, 32 nt, Human
cacggagcagaugagagagggucggggcuugc

SEQ ID NO: 81703 - RNA, 32 nt, Human
cacggagcccaagagguggggugucguggcuc

SEQ ID NO: 81704 - RNA, 20 nt, Human
cacggagccccgcgacccgc

SEQ ID NO: 81705 - RNA, 23 nt, Human
cacggagccggcagcggcgcggg

SEQ ID NO: 81706 - RNA, 18 nt, Human
cacggagccgucagucca

SEQ ID NO: 81707 - RNA, 32 nt, Human
cacggagccuggagggaugccacccagcaaca

SEQ ID NO: 81708 - RNA, 32 nt, Human
cacggagcgggccuguaggagcuguccaggcc

SEQ ID NO: 81709 - RNA, 32 nt, Human
cacggagcucacugcagacucgccauccccgu

SEQ ID NO: 81710 - RNA, 18 nt, Human
cacggagcuccagcuucu

SEQ ID NO: 81711 - RNA, 17 nt, Human
cacggagcucccagucc

SEQ ID NO: 81712 - RNA, 19 nt, Human
cacggagcucugccauucc

SEQ ID NO: 81713 - RNA, 20 nt, Human
cacggagcucuucaccacca

SEQ ID NO: 81714 - RNA, 32 nt, Human
cacggagcuuccugccucugcuccgacacccg

SEQ ID NO: 81715 - RNA, 32 nt, Human
cacggaggaaccugcagaauuuggauucugag

SEQ ID NO: 81716 - RNA, 32 nt, Human
cacggaggacggcgugggcagccugggccugg

SEQ ID NO: 81717 - RNA, 32 nt, Human
cacggaggaggugucauaggagcucagccuca

SEQ ID NO: 81718 - RNA, 32 nt, Human
cacggaggccaugcuccagaacauggaggcug

SEQ ID NO: 81719 - RNA, 32 nt, Human
cacggaggcucacgccuguaaucccagcacuu

SEQ ID NO: 81720 - RNA, 32 nt, Human
cacggaggcucaugccuguaaucccagcacuu

SEQ ID NO: 81721 - RNA, 32 nt, Human
cacggaggcucgugcauguaauccuagcacuu

SEQ ID NO: 81722 - RNA, 32 nt, Human
cacggagguaggaaggggcagacguagacuug

SEQ ID NO: 81723 - RNA, 32 nt, Human
cacggaguccaggccugguccugcugcucauu

SEQ ID NO: 81724 - RNA, 32 nt, Human
cacggagugaagaugggaggagcuguuagcaa

SEQ ID NO: 81725 - RNA, 32 nt, Human
cacggaguggccaguggcaugugaccucggag

SEQ ID NO: 81726 - RNA, 32 nt, Human
cacggaguuccagggaaaaggaacuugugaaa

SEQ ID NO: 81727 - RNA, 32 nt, Human
cacggaguugacugucuggugggggaggcugg

SEQ ID NO: 81728 - RNA, 25 nt, Human
cacggaucgugcugcucccuggcca

SEQ ID NO: 81729 - RNA, 32 nt, Human
cacggaucuaaguuauucuccccagccagagc

SEQ ID NO: 81730 - RNA, 32 nt, Human
cacggaugagcacaacccuggagcugcacagc

SEQ ID NO: 81731 - RNA, 21 nt, Human
cacggauucuugacagagaga

SEQ ID NO: 81732 - RNA, 32 nt, Human
cacggcaacagaagcaggagugucacuggccg

SEQ ID NO: 81733 - RNA, 20 nt, Human
cacggcacacaccuccagcc

SEQ ID NO: 81734 - RNA, 32 nt, Human
cacggcaccagccugggaugccagucccgccu

SEQ ID NO: 81735 - RNA, 21 nt, Human
cacggcacuccagccugggca

SEQ ID NO: 81736 - RNA, 32 nt, Human
cacggcacugcgcugcagccugggcaacacag

SEQ ID NO: 81737 - RNA, 32 nt, Human
cacggcacuggcagagacgcagaagggaaagu

SEQ ID NO: 81738 - RNA, 32 nt, Human
cacggcagcagcucagagcccaaccuggcacu

SEQ ID NO: 81739 - RNA, 32 nt, Human
cacggcagccuccugucuucuaggagcuauca

SEQ ID NO: 81740 - RNA, 32 nt, Human
cacggcagccuucccgaaacauaguauggauu

SEQ ID NO: 81741 - RNA, 32 nt, Human
cacggcaggaggaucacuuuaguucaggaguu

SEQ ID NO: 81742 - RNA, 22 nt, Human
cacggcagugcgugcggcugug

SEQ ID NO: 81743 - RNA, 32 nt, Human
cacggcauccacccucuccagccagccccgcc

SEQ ID NO: 81744 - RNA, 32 nt, Human
cacggcaugccuguacuggcacuuugguuuuu

SEQ ID NO: 81745 - RNA, 31 nt, Human
cacggcauggggcgagcggacacuccacgac

SEQ ID NO: 81746 - RNA, 32 nt, Human
cacggcauucaaaggucacagaacugccacua

SEQ ID NO: 81747 - RNA, 32 nt, Human
cacggccaagggccacgggaacuuggagaggg

SEQ ID NO: 81748 - RNA, 21 nt, Human
cacggccacaggggcgcacgg

SEQ ID NO: 81749 - RNA, 32 nt, Human
cacggccaccaccguccucaucaugucgucuu

SEQ ID NO: 81750 - RNA, 32 nt, Human
cacggccaggcagagaagggcaacucccaaga

SEQ ID NO: 81751 - RNA, 32 nt, Human
cacggccaggguggugucgggagcaggccuca

SEQ ID NO: 81752 - RNA, 32 nt, Human
cacggccaucccugcaagcacacacaccagga

SEQ ID NO: 81753 - RNA, 32 nt, Human
cacggccaucccuuugcucccagccuggcucc

SEQ ID NO: 81754 - RNA, 32 nt, Human
cacggccaugguuggcucuagaugcugcuggc

SEQ ID NO: 81755 - RNA, 32 nt, Human
cacggccauugcaagggcucagccuggcaggc

SEQ ID NO: 81756 - RNA, 32 nt, Human
cacggcccaccacccugccgcugcugauccca

SEQ ID NO: 81757 - RNA, 32 nt, Human
cacggcccaccggcggccagccccagagacca

SEQ ID NO: 81758 - RNA, 32 nt, Human
cacggcccagggccccgaagaucaauaacugc

SEQ ID NO: 81759 - RNA, 32 nt, Human
cacggccccacuguccacacacugccucccca

SEQ ID NO: 81760 - RNA, 32 nt, Human
cacggccccucgggccccggccugccgcccgg

SEQ ID NO: 81761 - RNA, 32 nt, Human
cacggccccugcccucuggucugccgugcauc

SEQ ID NO: 81762 - RNA, 32 nt, Human
cacggcccugcucuguucccugggacaccccc

SEQ ID NO: 81763 - RNA, 32 nt, Human
cacggcccugcugggugaccucaggccuaguc

SEQ ID NO: 81764 - RNA, 22 nt, Human
cacggcccuucacuacagcgug

SEQ ID NO: 81765 - RNA, 19 nt, Human
cacggccgaggcgguggga

SEQ ID NO: 81766 - RNA, 23 nt, Human
cacggccgcgaccgccccgcggg

SEQ ID NO: 81767 - RNA, 22 nt, Human
cacggccuaggaggugcacggg

SEQ ID NO: 81768 - RNA, 32 nt, Human
cacggccuccacaauagccacacccacaccug

SEQ ID NO: 81769 - RNA, 32 nt, Human
cacggccuccccuccgcccugcggucccgccg

SEQ ID NO: 81770 - RNA, 32 nt, Human
cacggccugagcagggugaggagcagcugcca

SEQ ID NO: 81771 - RNA, 32 nt, Human
cacggccugccugucgcauguuugugucugcc

SEQ ID NO: 81772 - RNA, 32 nt, Human
cacggccuggccuggcuucacacacauagccg

SEQ ID NO: 81773 - RNA, 32 nt, Human
cacggccuuguuuucagugauucaugugcccg

SEQ ID NO: 81774 - RNA, 32 nt, Human
cacggcgacacacagccucaguggugcaagau

SEQ ID NO: 81775 - RNA, 32 nt, Human
cacggcgacucacgccuguaaucccagcacau

SEQ ID NO: 81776 - RNA, 19 nt, Human
cacggcgcccaccgcagug

SEQ ID NO: 81777 - RNA, 32 nt, Human
cacggcgcccgugacagagcgagcuuaacgga

SEQ ID NO: 81778 - RNA, 19 nt, Human
cacggcgccuagcacagug

SEQ ID NO: 81779 - RNA, 32 nt, Human
cacggcggcucacgccuguaaucccagcacuu

SEQ ID NO: 81780 - RNA, 32 nt, Human
cacggcgggcagcagcggcggcggcggcggcu

SEQ ID NO: 81781 - RNA, 32 nt, Human
cacggcgguggaggggacauaggaggcggcca

SEQ ID NO: 81782 - RNA, 32 nt, Human
cacggcgguggucuugcgggaggcgugggcug

SEQ ID NO: 81783 - RNA, 32 nt, Human
cacggcucacugcaaccuccaccuccugaguu

SEQ ID NO: 81784 - RNA, 32 nt, Human
cacggcucacugcagccucaaacuccuaggcu

SEQ ID NO: 81785 - RNA, 32 nt, Human
cacggcucacugcagccucaaccuccuggacu

SEQ ID NO: 81786 - RNA, 32 nt, Human
cacggcucacugcagccucaaccuccugggcu

SEQ ID NO: 81787 - RNA, 32 nt, Human
cacggcucacugcagccucagcguccugggcu

SEQ ID NO: 81788 - RNA, 32 nt, Human
cacggcucacugcagccucgaccuccccagcu

SEQ ID NO: 81789 - RNA, 32 nt, Human
cacggcucacugcagccucuaccuccccaggc

SEQ ID NO: 81790 - RNA, 32 nt, Human
cacggcucacugcagcuucaaacuccugggcu

SEQ ID NO: 81791 - RNA, 32 nt, Human
cacggcucacugcagucucugccucccagaug

SEQ ID NO: 81792 - RNA, 32 nt, Human
cacggcucacugcaguuucaaguuccugggcu

SEQ ID NO: 81793 - RNA, 32 nt, Human
cacggcucacugcauccucaaccuccuggguu

SEQ ID NO: 81794 - RNA, 32 nt, Human
cacggcucccuuccucaccccagcccucccca

SEQ ID NO: 81795 - RNA, 32 nt, Human
cacggcucgcagcugccaccagagcugccccc

SEQ ID NO: 81796 - RNA, 32 nt, Human
cacggcucucauugcucgggguugguuggguu

SEQ ID NO: 81797 - RNA, 22 nt, Human
cacggcugccccgugugcagga

SEQ ID NO: 81798 - RNA, 32 nt, Human
cacggcugcgcgccugcacuuccccucggugc

SEQ ID NO: 81799 - RNA, 21 nt, Human
cacggcugcuacgugugcggg

SEQ ID NO: 81800 - RNA, 32 nt, Human
cacggcugcugacuucucagggcugcaagcag

SEQ ID NO: 81801 - RNA, 32 nt, Human
cacggcuggagaguucagcugugugugcauag

SEQ ID NO: 81802 - RNA, 32 nt, Human
cacggcuggaggugggauccacacagcucaga

SEQ ID NO: 81803 - RNA, 32 nt, Human
cacggcugucauuuuucaccuggucauucugu

SEQ ID NO: 81804 - RNA, 25 nt, Human
cacggcuguccggacgugccauggg

SEQ ID NO: 81805 - RNA, 32 nt, Human
cacggcuucccucuuggcucauuccaagcuug

SEQ ID NO: 81806 - RNA, 32 nt, Human
cacggcuucucaugcuauuucuaccucacuuu

SEQ ID NO: 81807 - RNA, 31 nt, Human
cacgggaaacucaaggagguggugaauuuuu

SEQ ID NO: 81808 - RNA, 32 nt, Human
cacgggacaaaaacucaagaagaaauaagagc

SEQ ID NO: 81809 - RNA, 32 nt, Human
cacgggacaucuugccuuugagugugcagagu

SEQ ID NO: 81810 - RNA, 32 nt, Human
cacgggacccucaggcgggcaggaugaacgac

SEQ ID NO: 81811 - RNA, 32 nt, Human
cacgggaccguggcuuccuuccucaccuggcu

SEQ ID NO: 81812 - RNA, 32 nt, Human
cacgggacgccaugggcacugcagggacaguc

SEQ ID NO: 81813 - RNA, 32 nt, Human
cacgggacucaauccgcgccucggccgucggg

SEQ ID NO: 81814 - RNA, 32 nt, Human
cacgggacucagaagugcgccgccaugcugcc

SEQ ID NO: 81815 - RNA, 32 nt, Human
cacgggagaggagaagagggagacccgccgcc

SEQ ID NO: 81816 - RNA, 32 nt, Human
cacgggagccaggaugggacuggucguguuug

SEQ ID NO: 81817 - RNA, 32 nt, Human
cacgggaggagaaucaagagugagccauggag

SEQ ID NO: 81818 - RNA, 32 nt, Human
cacgggaggcagagguugcagugagcagagau

SEQ ID NO: 81819 - RNA, 32 nt, Human
cacgggaucaccugccuuuuuggcugcugcac

SEQ ID NO: 81820 - RNA, 32 nt, Human
cacgggaucccugaagugacucagccaggcag

SEQ ID NO: 81821 - RNA, 32 nt, Human
cacgggcacagcugcugugccaggacugugac

SEQ ID NO: 81822 - RNA, 32 nt, Human
cacgggcacagggagagggacaacugcagcag

SEQ ID NO: 81823 - RNA, 32 nt, Human
cacgggcacagguguguggaggccguggucgg

SEQ ID NO: 81824 - RNA, 32 nt, Human
cacgggcaccgaagcugggacagcaggcuuag

SEQ ID NO: 81825 - RNA, 32 nt, Human
cacgggcacugacccacagccuccgggccagg

SEQ ID NO: 81826 - RNA, 32 nt, Human
cacgggcagccuggacauggcccugccugaaa

SEQ ID NO: 81827 - RNA, 32 nt, Human
cacgggcaggguggggagccgagugaccccuc

SEQ ID NO: 81828 - RNA, 32 nt, Human
cacgggcaugaggagggugauaaugacaaggg

SEQ ID NO: 81829 - RNA, 32 nt, Human
cacgggccagauggccagcugucgagagcagc

SEQ ID NO: 81830 - RNA, 32 nt, Human
cacgggccagccaggccagcacagaggcacca

SEQ ID NO: 81831 - RNA, 32 nt, Human
cacgggcccccuggcccaggcgcugccaacca

SEQ ID NO: 81832 - RNA, 32 nt, Human
cacgggcccggguugggucaccagacggggcu

SEQ ID NO: 81833 - RNA, 32 nt, Human
cacgggcccugggccucaagggcaccaucuga

SEQ ID NO: 81834 - RNA, 32 nt, Human
cacgggccggagagcugggagcacaggucccg

SEQ ID NO: 81835 - RNA, 32 nt, Human
cacgggcgcccaggacccuggccugcagagac

SEQ ID NO: 81836 - RNA, 21 nt, Human
cacgggcggcggcggcgugga

SEQ ID NO: 81837 - RNA, 32 nt, Human
cacgggcucugaggugcaugcagagaggagga

SEQ ID NO: 81838 - RNA, 32 nt, Human
cacgggcugcaaccggagccucggaccggcca

SEQ ID NO: 81839 - RNA, 32 nt, Human
cacgggcuggggcucagcuccuuggagagggc

SEQ ID NO: 81840 - RNA, 32 nt, Human
cacgggcuugggggaaagaugguggggaccaa

SEQ ID NO: 81841 - RNA, 32 nt, Human
cacggggaauggagaccaaaaagggaaaagaa

SEQ ID NO: 81842 - RNA, 32 nt, Human
cacggggaggagaaggaggaguggacccagcc

SEQ ID NO: 81843 - RNA, 32 nt, Human
cacggggaggcggaggcagcggcggcggcggc

SEQ ID NO: 81844 - RNA, 32 nt, Human
cacggggcaaagcugcugggccaguggcacuc

SEQ ID NO: 81845 - RNA, 17 nt, Human
cacggggcaccaaucca

SEQ ID NO: 81846 - RNA, 32 nt, Human
cacggggcacuggccugggcagguggcgggaa

SEQ ID NO: 81847 - RNA, 32 nt, Human
cacggggcaggcaccuggauguugagagugga

SEQ ID NO: 81848 - RNA, 32 nt, Human
cacggggccauccagauucaguggcggugccc

SEQ ID NO: 81849 - RNA, 32 nt, Human
cacggggccuguucgccaugcccagccagugc

SEQ ID NO: 81850 - RNA, 32 nt, Human
cacggggcggggugcuuagggugcaggaggcg

SEQ ID NO: 81851 - RNA, 32 nt, Human
cacgggggcaugcugagccacuggaguuccag

SEQ ID NO: 81852 - RNA, 32 nt, Human
cacgggggcccaggauggaggcgucuacaccu

SEQ ID NO: 81853 - RNA, 32 nt, Human
cacgggggcugcaguggauucacugugucagg

SEQ ID NO: 81854 - RNA, 32 nt, Human
cacgggggugcuggaagagaucgggaauaaua

SEQ ID NO: 81855 - RNA, 32 nt, Human
cacggggguggcuuuugcaaagaugaccggca

SEQ ID NO: 81856 - RNA, 21 nt, Human
cacgggguacaacagcagcca

SEQ ID NO: 81857 - RNA, 32 nt, Human
cacggggugaagccuauugccugagaucuugc

SEQ ID NO: 81858 - RNA, 32 nt, Human
cacggguaccuggaacuucagcucaaacauuu

SEQ ID NO: 81859 - RNA, 32 nt, Human
cacgggucggccgcaauccagccugggcggag

SEQ ID NO: 81860 - RNA, 32 nt, Human
cacgggucuaaugcagcccagaacagcuuuga

SEQ ID NO: 81861 - RNA, 32 nt, Human
cacgggucugaagugauguccaggcaaaaauu

SEQ ID NO: 81862 - RNA, 32 nt, Human
cacgggugcaggaauucacacagaaaagugga

SEQ ID NO: 81863 - RNA, 32 nt, Human
cacggguggcagcagauggcccagcccaggga

SEQ ID NO: 81864 - RNA, 32 nt, Human
cacggguggcaggggcaggauuugaacccagg

SEQ ID NO: 81865 - RNA, 32 nt, Human
cacgggugucgaggcaggaaggauuguuucug

SEQ ID NO: 81866 - RNA, 32 nt, Human
cacgggugugagccaccgcgcccagcuagcuc

SEQ ID NO: 81867 - RNA, 32 nt, Human
cacgguaaaauuauguugguuugaaaggagga

SEQ ID NO: 81868 - RNA, 32 nt, Human
cacgguaauguuggacucggugacacacagca

SEQ ID NO: 81869 - RNA, 32 nt, Human
cacgguaccucacaccuguaaucccagcacuu

SEQ ID NO: 81870 - RNA, 32 nt, Human
cacgguacugagaagccgaggucugggugcuc

SEQ ID NO: 81871 - RNA, 23 nt, Human
cacgguagcucacaccuguaauc

SEQ ID NO: 81872 - RNA, 32 nt, Human
cacgguagcucacaccuguaaucccagcacuu

SEQ ID NO: 81873 - RNA, 32 nt, Human
cacgguagcucacccuuguaaucccagcacuu

SEQ ID NO: 81874 - RNA, 32 nt, Human
cacgguagcucacgccuguaaucccaacacuu

SEQ ID NO: 81875 - RNA, 32 nt, Human
cacgguagcucgcuccuguaaucccagcacuu

SEQ ID NO: 81876 - RNA, 32 nt, Human
cacgguaucucaugccuauaaucccagcacuu

SEQ ID NO: 81877 - RNA, 31 nt, Human
cacgguaugaccccaggggcucugcugaugc

SEQ ID NO: 81878 - RNA, 32 nt, Human
cacggucaacuccgcgggacacgaggacacgg

SEQ ID NO: 81879 - RNA, 32 nt, Human
cacggucaagagaucaagaccauccuggccaa

SEQ ID NO: 81880 - RNA, 32 nt, Human
cacggucacaucugccccagugccuuuguccu

SEQ ID NO: 81881 - RNA, 21 nt, Human
cacggucacuuggcugaagga

SEQ ID NO: 81882 - RNA, 32 nt, Human
cacgguccaauccagccuucuucccccagggu

SEQ ID NO: 81883 - RNA, 32 nt, Human
cacggucccaccauguuacccagccuggucuc

SEQ ID NO: 81884 - RNA, 32 nt, Human
cacgguccucaccuggagcuguggccuggcug

SEQ ID NO: 81885 - RNA, 32 nt, Human
cacggucgcagggccgagggaggaccuguggg

SEQ ID NO: 81886 - RNA, 32 nt, Human
cacggucuagagccaugaaauaggcgaugcuc

SEQ ID NO: 81887 - RNA, 32 nt, Human
cacggucucugagauccugaaugcugggggau

SEQ ID NO: 81888 - RNA, 32 nt, Human
cacggucuuccaggaacggugcuccugcuucu

SEQ ID NO: 81889 - RNA, 32 nt, Human
cacggugaaagcaggagcaaggguugggggag

SEQ ID NO: 81890 - RNA, 32 nt, Human
cacggugacccaugcugcccagccuggaggua

SEQ ID NO: 81891 - RNA, 31 nt, Human
cacggugaccucuccgcuugccaaaauaacc

SEQ ID NO: 81892 - RNA, 32 nt, Human
cacggugacucacacuuguaaucccagcacuu

SEQ ID NO: 81893 - RNA, 32 nt, Human
cacggugacucacgccuguaaucccagcacuu

SEQ ID NO: 81894 - RNA, 32 nt, Human
cacggugaggaggcagagaguggugcaggcug

SEQ ID NO: 81895 - RNA, 32 nt, Human
cacggugaugcauaccuauaaucccagcacuu

SEQ ID NO: 81896 - RNA, 32 nt, Human
cacggugcaaagugaaugcugcugucuuggag

SEQ ID NO: 81897 - RNA, 32 nt, Human
cacggugcaggcauagcugccugcugcucugg

SEQ ID NO: 81898 - RNA, 32 nt, Human
cacggugccagccucugaucuggguccuugcu

SEQ ID NO: 81899 - RNA, 32 nt, Human
cacggugcccccgugaccuucacaguuggaug

SEQ ID NO: 81900 - RNA, 32 nt, Human
cacggugccucaugccuguaaucccagcacuu

SEQ ID NO: 81901 - RNA, 32 nt, Human
cacggugccucaugccuguaauccuagcaccu

SEQ ID NO: 81902 - RNA, 32 nt, Human
cacggugcucugcugcccccuccugggcacgu

SEQ ID NO: 81903 - RNA, 32 nt, Human
cacgguggaucaugccuguaaucccagcacuu

SEQ ID NO: 81904 - RNA, 22 nt, Human
cacgguggcagcuguguaugga

SEQ ID NO: 81905 - RNA, 32 nt, Human
cacgguggccacccccugagccucugcuggug

SEQ ID NO: 81906 - RNA, 32 nt, Human
cacgguggcccaugccuguaaucccagcacuu

SEQ ID NO: 81907 - RNA, 30 nt, Human
cacgguggccucuccaggcucagcuccugc

SEQ ID NO: 81908 - RNA, 32 nt, Human
cacgguggccucuccaggcucagcuccugccc

SEQ ID NO: 81909 - RNA, 32 nt, Human
cacgguggcgggcaccuguaaucccagcuacu

SEQ ID NO: 81910 - RNA, 32 nt, Human
cacgguggcgggcaccuguaguuccagcugcu

SEQ ID NO: 81911 - RNA, 32 nt, Human
cacgguggcuaacgccuguaaucccagcacuu

SEQ ID NO: 81912 - RNA, 32 nt, Human
cacgguggcucaagccuguaaucccagcacuu

SEQ ID NO: 81913 - RNA, 23 nt, Human
cacgguggcucacaccuauaauc

SEQ ID NO: 81914 - RNA, 32 nt, Human
cacgguggcucacaccuauaaucccagcacua

SEQ ID NO: 81915 - RNA, 32 nt, Human
cacgguggcucacaccuauaaucccagcacuu

SEQ ID NO: 81916 - RNA, 32 nt, Human
cacgguggcucacaccugcaaucccagcacuu

SEQ ID NO: 81917 - RNA, 21 nt, Human
cacgguggcucacaccuguaa

SEQ ID NO: 81918 - RNA, 32 nt, Human
cacgguggcucacaccuguaaccccagcacug

SEQ ID NO: 81919 - RNA, 23 nt, Human
cacgguggcucacaccuguaauc

SEQ ID NO: 81920 - RNA, 32 nt, Human
cacgguggcucacaccuguaaucccagcacuu

SEQ ID NO: 81921 - RNA, 32 nt, Human
cacgguggcucacaccuguaaucccagcccuu

SEQ ID NO: 81922 - RNA, 32 nt, Human
cacgguggcucacaccuguaaucccagcuguu

SEQ ID NO: 81923 - RNA, 32 nt, Human
cacgguggcucacaccuguaaucccaguacuu

SEQ ID NO: 81924 - RNA, 32 nt, Human
cacgguggcucacaccugugaucccaacacuc

SEQ ID NO: 81925 - RNA, 32 nt, Human
cacgguggcucacaccuguggugucagcuacu

SEQ ID NO: 81926 - RNA, 32 nt, Human
cacgguggcucacaccuguuaucccaacacuu

SEQ ID NO: 81927 - RNA, 32 nt, Human
cacgguggcucacacuuguaaucccagcauuu

SEQ ID NO: 81928 - RNA, 32 nt, Human
cacgguggcucacacuuguaauccuaguacuu

SEQ ID NO: 81929 - RNA, 23 nt, Human
cacgguggcucacagcuauaauc

SEQ ID NO: 81930 - RNA, 32 nt, Human
cacgguggcucacgccgguaaucccagcacuu

SEQ ID NO: 81931 - RNA, 32 nt, Human
cacgguggcucacgccuauaaucccagcacuu

SEQ ID NO: 81932 - RNA, 23 nt, Human
cacgguggcucacgccuguaauc

SEQ ID NO: 81933 - RNA, 32 nt, Human
cacgguggcucacgccuguaaucccaacacuu

SEQ ID NO: 81934 - RNA, 32 nt, Human
cacgguggcucacgccuguaaucccaccacuu

SEQ ID NO: 81935 - RNA, 32 nt, Human
cacgguggcucacgccuguaaucccagaacuu

SEQ ID NO: 81936 - RNA, 32 nt, Human
cacgguggcucacgccuguaaucccagcacac

SEQ ID NO: 81937 - RNA, 32 nt, Human
cacgguggcucacgccuguaaucccagcacug

SEQ ID NO: 81938 - RNA, 32 nt, Human
cacgguggcucacgccuguaaucccagcacuu

SEQ ID NO: 81939 - RNA, 32 nt, Human
cacgguggcucacgccuguaaucccagcaguu

SEQ ID NO: 81940 - RNA, 32 nt, Human
cacgguggcucacgccuguaaucccagcucuu

SEQ ID NO: 81941 - RNA, 32 nt, Human
cacgguggcucacgccuguaaucccagggugc

SEQ ID NO: 81942 - RNA, 32 nt, Human
cacgguggcucacgccuguaaucccaguacuu

SEQ ID NO: 81943 - RNA, 32 nt, Human
cacgguggcucacgccuguaaucccaguauuu

SEQ ID NO: 81944 - RNA, 32 nt, Human
cacgguggcucacgccuguaauccuagcaccu

SEQ ID NO: 81945 - RNA, 32 nt, Human
cacgguggcucacgccuguaauccuagcacuu

SEQ ID NO: 81946 - RNA, 32 nt, Human
cacgguggcucacgccuguaaucucaacacuu

SEQ ID NO: 81947 - RNA, 32 nt, Human
cacgguggcucacgccuguaauuccagcacuu

SEQ ID NO: 81948 - RNA, 32 nt, Human
cacgguggcucacgcuuguaaucccaacacuu

SEQ ID NO: 81949 - RNA, 32 nt, Human
cacgguggcucacgcuuguaaucccagcacuu

SEQ ID NO: 81950 - RNA, 32 nt, Human
cacgguggcucacgucuguaaucccagcaauu

SEQ ID NO: 81951 - RNA, 32 nt, Human
cacgguggcucacuccuguaaucccagcacuu

SEQ ID NO: 81952 - RNA, 32 nt, Human
cacgguggcucacuccuguaaucucaacaauu

SEQ ID NO: 81953 - RNA, 32 nt, Human
cacgguggcucacuccuguaauuccagcacuu

SEQ ID NO: 81954 - RNA, 32 nt, Human
cacgguggcucaggccuguaaucccagcacuu

SEQ ID NO: 81955 - RNA, 23 nt, Human
cacgguggcucauaccuguaauc

SEQ ID NO: 81956 - RNA, 32 nt, Human
cacgguggcucauaccuguaaucccagcacuu

SEQ ID NO: 81957 - RNA, 32 nt, Human
cacgguggcucaugccuauaaucccagcacuu

SEQ ID NO: 81958 - RNA, 32 nt, Human
cacgguggcucaugccucuaaucccagcacuu

SEQ ID NO: 81959 - RNA, 32 nt, Human
cacgguggcucaugccuguaaucccaacacuu

SEQ ID NO: 81960 - RNA, 32 nt, Human
cacgguggcucaugccuguaaucccagcacuu

SEQ ID NO: 81961 - RNA, 32 nt, Human
cacgguggcucaugccuguaaucccagcuacg

SEQ ID NO: 81962 - RNA, 32 nt, Human
cacgguggcucaugccuguaaucucagcacuu

SEQ ID NO: 81963 - RNA, 32 nt, Human
cacgguggcugacaccuguaaucccagcacuu

SEQ ID NO: 81964 - RNA, 32 nt, Human
cacgguggcugcaggucugagacaaggcugcu

SEQ ID NO: 81965 - RNA, 21 nt, Human
cacgguggcuuacaccuguaa

SEQ ID NO: 81966 - RNA, 32 nt, Human
cacgguggcuuacaccuguaacccuggcauuu

SEQ ID NO: 81967 - RNA, 32 nt, Human
cacgguggcuuacaccuguaaucccagcacuu

SEQ ID NO: 81968 - RNA, 23 nt, Human
cacgguggcuuacaucuguaauc

SEQ ID NO: 81969 - RNA, 32 nt, Human
cacgguggcuuacgccuguaaucccagcacuu

SEQ ID NO: 81970 - RNA, 32 nt, Human
cacggugggcacugcccagcaccgcaugccac

SEQ ID NO: 81971 - RNA, 32 nt, Human
cacggugggggaaucccuugagcccaggaguu

SEQ ID NO: 81972 - RNA, 32 nt, Human
cacggugguacacgccuguaaucccagcuacu

SEQ ID NO: 81973 - RNA, 23 nt, Human
cacgguggucagcgugcagcggg

SEQ ID NO: 81974 - RNA, 32 nt, Human
cacgguggugcaugaguguccaucaucugacu

SEQ ID NO: 81975 - RNA, 32 nt, Human
cacgguggugcaugccuguaaucccagcuacu

SEQ ID NO: 81976 - RNA, 32 nt, Human
cacgguggugcgcaccuguaaucccagcuacu

SEQ ID NO: 81977 - RNA, 32 nt, Human
cacgguggugggcgccuguaauuccagcuacu

SEQ ID NO: 81978 - RNA, 32 nt, Human
cacgguggugugggccuguaaucgcagcuacu

SEQ ID NO: 81979 - RNA, 32 nt, Human
cacggugguucacaccuguaaucccggcauuu

SEQ ID NO: 81980 - RNA, 32 nt, Human
cacggugguucacgccuguaaugccagcacuu

SEQ ID NO: 81981 - RNA, 32 nt, Human
cacggugguucaugccuguaaucccagcacuu

SEQ ID NO: 81982 - RNA, 32 nt, Human
cacgguguagggaagccagaaagaaaagacgg

SEQ ID NO: 81983 - RNA, 32 nt, Human
cacgguguguguggauugucagccuccagcua

SEQ ID NO: 81984 - RNA, 19 nt, Human
cacgguucagacaauggua

SEQ ID NO: 81985 - RNA, 32 nt, Human
cacgguucccacccucccucaccaguuuggac

SEQ ID NO: 81986 - RNA, 32 nt, Human
cacgguuccuuucugcuuuucugaaugcauca

SEQ ID NO: 81987 - RNA, 32 nt, Human
cacgguucugcaggcuuuacaggaagcauagc

SEQ ID NO: 81988 - RNA, 32 nt, Human
cacgguuguuuccaagcgccuccugggggaga

SEQ ID NO: 81989 - RNA, 32 nt, Human
cacgguuuccccaggcaggaugugccaggaga

SEQ ID NO: 81990 - RNA, 32 nt, Human
cacgguuuugcaggcuguacaggaagcauggu

SEQ ID NO: 81991 - RNA, 32 nt, Human
cacguaaacgcccgugcugggcccugugaagc

SEQ ID NO: 81992 - RNA, 32 nt, Human
cacguaaccugacuucucugugccucaauguc

SEQ ID NO: 81993 - RNA, 32 nt, Human
cacguaacugcaaugcagccuguacaggagga

SEQ ID NO: 81994 - RNA, 32 nt, Human
cacguaaugaaacuuggauuugcucagugucu

SEQ ID NO: 81995 - RNA, 32 nt, Human
cacguacaaacuaggcaagacagggucagugc

SEQ ID NO: 81996 - RNA, 32 nt, Human
cacguacacaugcacauguacgcaccacaaac

SEQ ID NO: 81997 - RNA, 32 nt, Human
cacguacacccacuccagggaucugccagcac

SEQ ID NO: 81998 - RNA, 32 nt, Human
cacguacaugugcacacacugucuacauacaa

SEQ ID NO: 81999 - RNA, 32 nt, Human
cacguaccauuuugcugaaagacagagcaccu

SEQ ID NO: 82000 - RNA, 32 nt, Human
cacguacccugcacuccgggaggaggccccaa

SEQ ID NO: 82001 - RNA, 32 nt, Human
cacguaccuggcugacagagugcagauggugu

SEQ ID NO: 82002 - RNA, 32 nt, Human
cacguacggccgccucuuccagaagcucugcu

SEQ ID NO: 82003 - RNA, 25 nt, Human
cacguacuuccccucccauucccau

SEQ ID NO: 82004 - RNA, 32 nt, Human
cacguacuugcaagaacucuugcucacaucag

SEQ ID NO: 82005 - RNA, 32 nt, Human
cacguagacuggcuucagaauucaugucuuua

SEQ ID NO: 82006 - RNA, 32 nt, Human
cacguagcaugggggcaagaggcgugggaugg

SEQ ID NO: 82007 - RNA, 32 nt, Human
cacguaggagcagaacgcucaugaaagugcuu

SEQ ID NO: 82008 - RNA, 32 nt, Human
cacguagguaccuugcaggguccuaggaggga

SEQ ID NO: 82009 - RNA, 32 nt, Human
cacguauaccccauuuccuuccagucagccca

SEQ ID NO: 82010 - RNA, 32 nt, Human
cacguauccugaggggcuugggccauacgggg

SEQ ID NO: 82011 - RNA, 32 nt, Human
cacguauguaugugugcacacuuguaugcaug

SEQ ID NO: 82012 - RNA, 32 nt, Human
cacgucaaacccugccuuuccuuuacuuuuac

SEQ ID NO: 82013 - RNA, 32 nt, Human
cacgucacacacacaugccaguguggagagcg

SEQ ID NO: 82014 - RNA, 32 nt, Human
cacgucacauaagaugauugcuaaaauauugu

SEQ ID NO: 82015 - RNA, 32 nt, Human
cacgucacugcacuccagcuugggcaacagag

SEQ ID NO: 82016 - RNA, 32 nt, Human
cacgucacugcacuccggccugggugacagag

SEQ ID NO: 82017 - RNA, 32 nt, Human
cacgucacugcacucuagccugggcaacagag

SEQ ID NO: 82018 - RNA, 32 nt, Human
cacgucacugcauuucagccugagcgacagag

SEQ ID NO: 82019 - RNA, 32 nt, Human
cacgucacuguacuccagccugggugacagag

SEQ ID NO: 82020 - RNA, 32 nt, Human
cacgucacuuguguuuauuuguucuguaaaug

SEQ ID NO: 82021 - RNA, 32 nt, Human
cacgucacuuuaccucucugugccucaguuuu

SEQ ID NO: 82022 - RNA, 32 nt, Human
cacgucagaagagguuggggcaaaacaaaaca

SEQ ID NO: 82023 - RNA, 32 nt, Human
cacgucauguugccuucucuuuucuuugugug

SEQ ID NO: 82024 - RNA, 32 nt, Human
cacgucauugcacuccagccuggucaacaaga

SEQ ID NO: 82025 - RNA, 32 nt, Human
cacgucauugcucuccagccugggcaacagag

SEQ ID NO: 82026 - RNA, 21 nt, Human
cacguccacccugggccucca

SEQ ID NO: 82027 - RNA, 32 nt, Human
cacguccacugagguccacagcucgcagaaga

SEQ ID NO: 82028 - RNA, 32 nt, Human
cacgucccaaccccucuccugugugucuguga

SEQ ID NO: 82029 - RNA, 32 nt, Human
cacgucccaucuuuuuggcucuuccccaaagc

SEQ ID NO: 82030 - RNA, 32 nt, Human
cacguccccugccaccucuagcucggagcggc

SEQ ID NO: 82031 - RNA, 18 nt, Human
cacgucccggcugggccc

SEQ ID NO: 82032 - RNA, 32 nt, Human
cacgucccuccccaggguguuccucccuguga

SEQ ID NO: 82033 - RNA, 32 nt, Human
cacgucccuugcaaagucuccgcaggugcugu

SEQ ID NO: 82034 - RNA, 32 nt, Human
cacguccgcagcuguggcuggguagcugcagc

SEQ ID NO: 82035 - RNA, 32 nt, Human
cacguccgucaucacaccucagggcagcgaga

SEQ ID NO: 82036 - RNA, 32 nt, Human
cacguccucaaagacuguaguauuccagauga

SEQ ID NO: 82037 - RNA, 32 nt, Human
cacguccuccggugcaugcacaaccacccagc

SEQ ID NO: 82038 - RNA, 18 nt, Human
cacguccugagacagaag

SEQ ID NO: 82039 - RNA, 32 nt, Human
cacguccugagccacugaccacggccagucuc

SEQ ID NO: 82040 - RNA, 32 nt, Human
cacguccugcugucagccuugucaucuugucu

SEQ ID NO: 82041 - RNA, 32 nt, Human
cacguccuggcccccaggcugaggugcaccca

SEQ ID NO: 82042 - RNA, 32 nt, Human
cacgucgugcugcugcuggaagccaacagccu

SEQ ID NO: 82043 - RNA, 32 nt, Human
cacgucuaugugcaugugcacacacacucaaa

SEQ ID NO: 82044 - RNA, 32 nt, Human
cacgucucacugcagccucaaccuccuggguu

SEQ ID NO: 82045 - RNA, 32 nt, Human
cacgucucagccacaguucuccacucgccucg

SEQ ID NO: 82046 - RNA, 32 nt, Human
cacgucucuagucucagcuacucaggaggcug

SEQ ID NO: 82047 - RNA, 32 nt, Human
cacgucucuccucucuguucccuuccccauuc

SEQ ID NO: 82048 - RNA, 31 nt, Human
cacgucucugucucugggccuuuguuccccu

SEQ ID NO: 82049 - RNA, 32 nt, Human
cacgucugagccucaucuccucccucucugca

SEQ ID NO: 82050 - RNA, 32 nt, Human
cacgucugaggcggcuguggccgcgucggugu

SEQ ID NO: 82051 - RNA, 32 nt, Human
cacgucugcuccaagguggcuugaaugaggca

SEQ ID NO: 82052 - RNA, 32 nt, Human
cacgucugcucuucagugaagaagcugguuua

SEQ ID NO: 82053 - RNA, 32 nt, Human
cacgucuguaaucuuugggagcacuuugggag

SEQ ID NO: 82054 - RNA, 32 nt, Human
cacgucuguagucccagcuacucaggaggcug

SEQ ID NO: 82055 - RNA, 32 nt, Human
cacgucugugaacccucagacggacauugacg

SEQ ID NO: 82056 - RNA, 21 nt, Human
cacgucugugggucucuuucg

SEQ ID NO: 82057 - RNA, 32 nt, Human
cacgucuuauuucucaccucguuccccaucaa

SEQ ID NO: 82058 - RNA, 32 nt, Human
cacgucuuccccacccuucucuccuuuccuca

SEQ ID NO: 82059 - RNA, 32 nt, Human
cacgugaaaaacauaggauacaaaacuuuaaa

SEQ ID NO: 82060 - RNA, 32 nt, Human
cacgugaaaaugugcaagaagaucgcccagcu

SEQ ID NO: 82061 - RNA, 32 nt, Human
cacgugaaaccagcaugugcuaguuacaaaag

SEQ ID NO: 82062 - RNA, 19 nt, Human
cacgugaagcucgcggucc

SEQ ID NO: 82063 - RNA, 32 nt, Human
cacgugaagcucgcgguccucccagggagcug

SEQ ID NO: 82064 - RNA, 32 nt, Human
cacgugaagucagcccacaccagccaaacccu

SEQ ID NO: 82065 - RNA, 20 nt, Human
cacgugacuccucaauucca

SEQ ID NO: 82066 - RNA, 32 nt, Human
cacgugacugggugcugaggggaguuaaagcc

SEQ ID NO: 82067 - RNA, 32 nt, Human
cacgugagagcugagcauugguggaggaggcc

SEQ ID NO: 82068 - RNA, 32 nt, Human
cacgugagagugagcucaaguggcagcagagg

SEQ ID NO: 82069 - RNA, 32 nt, Human
cacgugagcacuggcucccacggagggugcgc

SEQ ID NO: 82070 - RNA, 32 nt, Human
cacgugaggcuccgcaucagcagccaggggcg

SEQ ID NO: 82071 - RNA, 32 nt, Human
cacgugagggcagagagaaauguuaaaggagc

SEQ ID NO: 82072 - RNA, 23 nt, Human
cacgugaugcgcgagcagcucug

SEQ ID NO: 82073 - RNA, 31 nt, Human
cacgugaugggagaguuuuguaggagcugug

SEQ ID NO: 82074 - RNA, 32 nt, Human
cacgugccaccauguugcccaggcuggucuug

SEQ ID NO: 82075 - RNA, 16 nt, Human
cacgugcccagaguca

SEQ ID NO: 82076 - RNA, 32 nt, Human
cacgugcccaugggaugcuuccagguccccuu

SEQ ID NO: 82077 - RNA, 32 nt, Human
cacgugcccugugcugauucucugccuaggaa

SEQ ID NO: 82078 - RNA, 32 nt, Human
cacgugccuguaaucccaguuacuugggaggc

SEQ ID NO: 82079 - RNA, 32 nt, Human
cacgugccuguagucccagcuguccuggaggc

SEQ ID NO: 82080 - RNA, 32 nt, Human
cacgugcgcuggcguagccaggagcucugcuc

SEQ ID NO: 82081 - RNA, 32 nt, Human
cacgugcgcugggcacuucccugcugccugua

SEQ ID NO: 82082 - RNA, 32 nt, Human
cacgugcggaggccccucacugugcugucaaa

SEQ ID NO: 82083 - RNA, 32 nt, Human
cacgugcguguuuucugacugacaugaaaucg

SEQ ID NO: 82084 - RNA, 32 nt, Human
cacgugcucuugucccagcugccgagccucuu

SEQ ID NO: 82085 - RNA, 32 nt, Human
cacgugcuggaggaagcggaaaagagccaccc

SEQ ID NO: 82086 - RNA, 32 nt, Human
cacgugcugugagcuuccugggagcccagguu

SEQ ID NO: 82087 - RNA, 32 nt, Human
cacgugcuguuugcaaaccugccuguaccuga

SEQ ID NO: 82088 - RNA, 32 nt, Human
cacguggaagcggggugggucucacuugcgug

SEQ ID NO: 82089 - RNA, 32 nt, Human
cacguggacagagagaaagccagccucucggg

SEQ ID NO: 82090 - RNA, 32 nt, Human
cacguggacgcugguggauguccgcaggcccu

SEQ ID NO: 82091 - RNA, 32 nt, Human
cacguggacuucuucaggacuccagaggaggc

SEQ ID NO: 82092 - RNA, 32 nt, Human
cacguggcagaugaagaaggggaccaacaaca

SEQ ID NO: 82093 - RNA, 32 nt, Human
cacguggcagccgccugcaggagccgcaguuc

SEQ ID NO: 82094 - RNA, 32 nt, Human
cacguggccacaccucucgggauggccguggg

SEQ ID NO: 82095 - RNA, 22 nt, Human
cacguggccagcagcaccgggc

SEQ ID NO: 82096 - RNA, 32 nt, Human
cacguggcccuugcuucauccagcacagcucu

SEQ ID NO: 82097 - RNA, 32 nt, Human
cacguggcgcucuucagguucugccucuggga

SEQ ID NO: 82098 - RNA, 32 nt, Human
cacguggcgugccaugaguggggaagagcaac

SEQ ID NO: 82099 - RNA, 32 nt, Human
cacguggcuccugccacagauggucuuugugg

SEQ ID NO: 82100 - RNA, 21 nt, Human
cacguggcuccugugcucuag

SEQ ID NO: 82101 - RNA, 32 nt, Human
cacguggcuuccagauuugcaucugugcugca

SEQ ID NO: 82102 - RNA, 32 nt, Human
cacgugggacccugggcucuguacaggagaga

SEQ ID NO: 82103 - RNA, 32 nt, Human
cacgugggcccuugaggaccuggacuggguua

SEQ ID NO: 82104 - RNA, 32 nt, Human
cacgugggcucugccaugaccucugagaccug

SEQ ID NO: 82105 - RNA, 32 nt, Human
cacguggggagacagcccuucccacuggcucc

SEQ ID NO: 82106 - RNA, 32 nt, Human
cacguggggccagacagggacgcguuccgcau

SEQ ID NO: 82107 - RNA, 32 nt, Human
cacgugggggaaggcagugcucacuacuuaga

SEQ ID NO: 82108 - RNA, 32 nt, Human
cacgugggggagcugcggaagcgcggcgcugc

SEQ ID NO: 82109 - RNA, 32 nt, Human
cacguggggugcaggggccagguggagcccuc

SEQ ID NO: 82110 - RNA, 32 nt, Human
cacgugguagaugcccaccuccuccaugccuc

SEQ ID NO: 82111 - RNA, 32 nt, Human
cacgugguagccacuggcagccuugacugaaa

SEQ ID NO: 82112 - RNA, 32 nt, Human
cacguggucccauguugcaacagccccaacau

SEQ ID NO: 82113 - RNA, 32 nt, Human
cacguggucuguccuucaaggccuccuccgau

SEQ ID NO: 82114 - RNA, 32 nt, Human
cacgugguggcauccugacaggcacagugaga

SEQ ID NO: 82115 - RNA, 22 nt, Human
cacguguaaucccagcuacuca

SEQ ID NO: 82116 - RNA, 32 nt, Human
cacguguacuggcaccucagaagaccaaauca

SEQ ID NO: 82117 - RNA, 32 nt, Human
cacguguagcuuucuguuucucaaaucugaga

SEQ ID NO: 82118 - RNA, 32 nt, Human
cacgugucucagacugcauguaccauuugcau

SEQ ID NO: 82119 - RNA, 32 nt, Human
cacgugucuccuccuccucaucuuagcuucca

SEQ ID NO: 82120 - RNA, 32 nt, Human
cacgugucuguaaucccagcuacucuggagac

SEQ ID NO: 82121 - RNA, 32 nt, Human
cacgugugaacugcugcgcuacacaucagugu

SEQ ID NO: 82122 - RNA, 18 nt, Human
cacgugugagcugcuccu

SEQ ID NO: 82123 - RNA, 32 nt, Human
cacgugugagcugggccaggagcccugcccac

SEQ ID NO: 82124 - RNA, 32 nt, Human
cacgugugcagacuguggcugcagagaccuug

SEQ ID NO: 82125 - RNA, 32 nt, Human
cacguguggccuccgcuggcucugccugcucc

SEQ ID NO: 82126 - RNA, 19 nt, Human
cacgugugggccucgguca

SEQ ID NO: 82127 - RNA, 32 nt, Human
cacgugugucugcagugucugugcuaucuccc

SEQ ID NO: 82128 - RNA, 32 nt, Human
cacguguguucaggccucccuggaccagcagc

SEQ ID NO: 82129 - RNA, 32 nt, Human
cacguuaaaccugagcgccuuuaccuuuagau

SEQ ID NO: 82130 - RNA, 20 nt, Human
cacguuacgagcugcugcuc

SEQ ID NO: 82131 - RNA, 32 nt, Human
cacguuagcaucugcagagaucaaucuggagg

SEQ ID NO: 82132 - RNA, 32 nt, Human
cacguuagccccgggcucugauagagagguag

SEQ ID NO: 82133 - RNA, 32 nt, Human
cacguucagcccauguggauguuuugaagcuu

SEQ ID NO: 82134 - RNA, 32 nt, Human
cacguucauggacugaaggacucaauauuuua

SEQ ID NO: 82135 - RNA, 32 nt, Human
cacguucccuuuccuccucucccuccugugga

SEQ ID NO: 82136 - RNA, 32 nt, Human
cacguucgggcggggcgauugcagggaacggg

SEQ ID NO: 82137 - RNA, 32 nt, Human
cacguucuccacugcucacucccugcuguuca

SEQ ID NO: 82138 - RNA, 32 nt, Human
cacguucugcagcugcacagaagcauggcagc

SEQ ID NO: 82139 - RNA, 32 nt, Human
cacguugacauuuaaagacagaggggacuguc

SEQ ID NO: 82140 - RNA, 32 nt, Human
cacguugggaggccaaggcgggcagauuacau

SEQ ID NO: 82141 - RNA, 32 nt, Human
cacguugggaggccgaggcagguggaucacuu

SEQ ID NO: 82142 - RNA, 32 nt, Human
cacguugggaggcugaggcgggcggaucgguu

SEQ ID NO: 82143 - RNA, 32 nt, Human
cacguugucugccugggcucagcguggaccug

SEQ ID NO: 82144 - RNA, 21 nt, Human
cacguuuaaucccagcacuuu

SEQ ID NO: 82145 - RNA, 32 nt, Human
cacguuuauuccugccugcuccggccaggacu

SEQ ID NO: 82146 - RNA, 32 nt, Human
cacguuucaguagugaggcugugagugugagc

SEQ ID NO: 82147 - RNA, 32 nt, Human
cacguuugcauagacuacacacaugucaugcg

SEQ ID NO: 82148 - RNA, 32 nt, Human
cacguuugcgucuggggaggaauaaaaagaca

SEQ ID NO: 82149 - RNA, 32 nt, Human
cacguuuggugcuucucagauuucugaggaaa

SEQ ID NO: 82150 - RNA, 32 nt, Human
cacguuugugagcucccagccggcaggccugg

SEQ ID NO: 82151 - RNA, 32 nt, Human
cacguuuuauagagcaaagacagagcaguuac

SEQ ID NO: 82152 - RNA, 32 nt, Human
cacguuuucuggcuucugcuucauccugcucc

SEQ ID NO: 82153 - RNA, 32 nt, Human
cacguuuugccucaugaacacuggcugcaagu

SEQ ID NO: 82154 - RNA, 32 nt, Human
cacguuuugccucuccaaaaagagcuuccuuu

SEQ ID NO: 82155 - RNA, 32 nt, Human
cacuaaaagaagccacagaacaggaagcgguc

SEQ ID NO: 82156 - RNA, 32 nt, Human
cacuaaaagaggagaugguggagacggaggcu

SEQ ID NO: 82157 - RNA, 32 nt, Human
cacuaaacaaaauuagaaacaugugaaaucca

SEQ ID NO: 82158 - RNA, 16 nt, Human
cacuaaaccaagguca

SEQ ID NO: 82159 - RNA, 32 nt, Human
cacuaaaccacacucaccccagccucauugug

SEQ ID NO: 82160 - RNA, 32 nt, Human
cacuaaagaugccaggauauuggggcugaggg

SEQ ID NO: 82161 - RNA, 32 nt, Human
cacuaaaggaagcaucacagcaacuggcugga

SEQ ID NO: 82162 - RNA, 32 nt, Human
cacuaaaguagccgaauccacucucaugucuu

SEQ ID NO: 82163 - RNA, 32 nt, Human
cacuaaaguuauuaaaccaaacuccuguccaa

SEQ ID NO: 82164 - RNA, 32 nt, Human
cacuaaauagauuaaacagagcaggcuuguuu

SEQ ID NO: 82165 - RNA, 32 nt, Human
cacuaaaugcugauuauuuagagccauuagag

SEQ ID NO: 82166 - RNA, 24 nt, Human
cacuaacaacacugaggagcacaa

SEQ ID NO: 82167 - RNA, 32 nt, Human
cacuaacacaugcacacacaaagugcauaggc

SEQ ID NO: 82168 - RNA, 32 nt, Human
cacuaacacgucuccucucugggaaacguccc

SEQ ID NO: 82169 - RNA, 31 nt, Human
cacuaacaguuucagauguuacuuuaaagca

SEQ ID NO: 82170 - RNA, 32 nt, Human
cacuaacauggugaaacccccaucuacacuaa

SEQ ID NO: 82171 - RNA, 32 nt, Human
cacuaaccccucagugcugugauccuugcgga

SEQ ID NO: 82172 - RNA, 22 nt, Human
cacuaaccccugcccccacucu

SEQ ID NO: 82173 - RNA, 32 nt, Human
cacuaagagaaacaugccuacccaugaaggcg

SEQ ID NO: 82174 - RNA, 32 nt, Human
cacuaagauuccagagccaccuuggugacaua

SEQ ID NO: 82175 - RNA, 32 nt, Human
cacuaagcagaggaccuuggguucccaauaca

SEQ ID NO: 82176 - RNA, 32 nt, Human
cacuaagcagaggaggggccgcugccacccac

SEQ ID NO: 82177 - RNA, 32 nt, Human
cacuaagcaugcaguggacauagaagagaagg

SEQ ID NO: 82178 - RNA, 32 nt, Human
cacuaagcucagcuaauuuuuguauuuuuagu

SEQ ID NO: 82179 - RNA, 32 nt, Human
cacuaagcuccagcaagcagguucuggucucu

SEQ ID NO: 82180 - RNA, 32 nt, Human
cacuaagcucuucucucucaggggcaguggga

SEQ ID NO: 82181 - RNA, 32 nt, Human
cacuaagcuggccaccccacccccgacaugga

SEQ ID NO: 82182 - RNA, 32 nt, Human
cacuaaggagacugaggcgggaggauuacuug

SEQ ID NO: 82183 - RNA, 32 nt, Human
cacuaaggagagagggucaggagccagaguug

SEQ ID NO: 82184 - RNA, 32 nt, Human
cacuaaggagcuaugagugucacaucauaauc

SEQ ID NO: 82185 - RNA, 32 nt, Human
cacuaaggaggguguaaaggccaaggucagca

SEQ ID NO: 82186 - RNA, 32 nt, Human
cacuaagggcugugccugagaaugguagcauu

SEQ ID NO: 82187 - RNA, 32 nt, Human
cacuaagucucccugggcuuggggaguggcac

SEQ ID NO: 82188 - RNA, 32 nt, Human
cacuaaguguucugcuguguuucaggaucagg

SEQ ID NO: 82189 - RNA, 32 nt, Human
cacuaaucaaucccagcauuguuuccaaugag

SEQ ID NO: 82190 - RNA, 32 nt, Human
cacuaaucccaucaugggggcccauccucaug

SEQ ID NO: 82191 - RNA, 32 nt, Human
cacuaauccuuaaaaguuagucugguuauuuu

SEQ ID NO: 82192 - RNA, 32 nt, Human
cacuaaucucugcuuggucucuuccucuuugg

SEQ ID NO: 82193 - RNA, 32 nt, Human
cacuaaugauuucauguacacaguauucacuu

SEQ ID NO: 82194 - RNA, 32 nt, Human
cacuaauucugcaucugggcaggaugacuuua

SEQ ID NO: 82195 - RNA, 32 nt, Human
cacuaauucugucaguaggggcaugguauaag

SEQ ID NO: 82196 - RNA, 32 nt, Human
cacuaauugaccaauuuugucuugucuuuacu

SEQ ID NO: 82197 - RNA, 32 nt, Human
cacuaauugcugcaauggaugaaauugggugu

SEQ ID NO: 82198 - RNA, 32 nt, Human
cacuaauuuaaucccaacuacuacuccauuuu

SEQ ID NO: 82199 - RNA, 32 nt, Human
cacuaauuuacuaggcuaccuacuuucaugag

SEQ ID NO: 82200 - RNA, 32 nt, Human
cacuaauuuucaaaauuaaauaguuuaagcuc

SEQ ID NO: 82201 - RNA, 32 nt, Human
cacuaauuuucuuuguccaaaacauuuacucu

SEQ ID NO: 82202 - RNA, 32 nt, Human
cacuaauuuugcaugaguaaguuuacaaauau

SEQ ID NO: 82203 - RNA, 22 nt, Human
cacuacaaccucgaccuccugg

SEQ ID NO: 82204 - RNA, 32 nt, Human
cacuacaaccucgaccuccuggguucaagcga

SEQ ID NO: 82205 - RNA, 23 nt, Human
cacuacaccagcaacuccuggcu

SEQ ID NO: 82206 - RNA, 32 nt, Human
cacuacaccagcugccagaaacccuguucuag

SEQ ID NO: 82207 - RNA, 32 nt, Human
cacuacaccugacagagacauccucuacugaa

SEQ ID NO: 82208 - RNA, 32 nt, Human
cacuacaccuggcuaaguuuuuauauuuuagu

SEQ ID NO: 82209 - RNA, 32 nt, Human
cacuacaccuggcuaauuuuuguauuuuuagu

SEQ ID NO: 82210 - RNA, 32 nt, Human
cacuacacuccaggcugggugacagauuaagc

SEQ ID NO: 82211 - RNA, 32 nt, Human
cacuacacugaucuuaacuaccugaaacugag

SEQ ID NO: 82212 - RNA, 32 nt, Human
cacuacagaccagcaauacuucagagcccagu

SEQ ID NO: 82213 - RNA, 32 nt, Human
cacuacagaccucagccccaguuuucuccucc

SEQ ID NO: 82214 - RNA, 19 nt, Human
cacuacagcagccccagga

SEQ ID NO: 82215 - RNA, 32 nt, Human
cacuacagccucaccucccaccccugucacua

SEQ ID NO: 82216 - RNA, 23 nt, Human
cacuacagccucgaacuccuggu

SEQ ID NO: 82217 - RNA, 32 nt, Human
cacuacagccucggcaauagagcgagacucug

SEQ ID NO: 82218 - RNA, 31 nt, Human
cacuacagccucucugagucugccguccugg

SEQ ID NO: 82219 - RNA, 32 nt, Human
cacuacagccuggacgacagagcaagacucug

SEQ ID NO: 82220 - RNA, 32 nt, Human
cacuacagccuggaugacaagcaagacccucc

SEQ ID NO: 82221 - RNA, 32 nt, Human
cacuacagccugggcaacaagagcgaaacucc

SEQ ID NO: 82222 - RNA, 32 nt, Human
cacuacagccugggcgacaaagugggacuguc

SEQ ID NO: 82223 - RNA, 32 nt, Human
cacuacagccugggcgacagaacgagacccug

SEQ ID NO: 82224 - RNA, 32 nt, Human
cacuacagccugggugacagagcaagacuccg

SEQ ID NO: 82225 - RNA, 32 nt, Human
cacuacagccugggugcaaaaucagcaagaaa

SEQ ID NO: 82226 - RNA, 32 nt, Human
cacuacagccuggucaacagagcaagacucug

SEQ ID NO: 82227 - RNA, 32 nt, Human
cacuacagccuguaauacugcucucuuucaaa

SEQ ID NO: 82228 - RNA, 32 nt, Human
cacuacagcuugggugacagcgcgagacaccg

SEQ ID NO: 82229 - RNA, 21 nt, Human
cacuacaggccagggcugcgg

SEQ ID NO: 82230 - RNA, 32 nt, Human
cacuacaggccucacagaaacagagaucccau

SEQ ID NO: 82231 - RNA, 32 nt, Human
cacuacagggaagugcaucacaugucagcaua

SEQ ID NO: 82232 - RNA, 32 nt, Human
cacuacagugauauugacugcaucuuuaagaa

SEQ ID NO: 82233 - RNA, 32 nt, Human
cacuacagugcacacaaggauugagaagaguu

SEQ ID NO: 82234 - RNA, 22 nt, Human
cacuacaguugacauccuggcu

SEQ ID NO: 82235 - RNA, 22 nt, Human
cacuacauaggccuccaaggca

SEQ ID NO: 82236 - RNA, 23 nt, Human
cacuacauauucugaagaaccaa

SEQ ID NO: 82237 - RNA, 32 nt, Human
cacuacauggcagaggcugaggcgguguguga

SEQ ID NO: 82238 - RNA, 32 nt, Human
cacuacaugucgaaagaguuauuugaguucuc

SEQ ID NO: 82239 - RNA, 32 nt, Human
cacuaccaaaccuggcuaauuucuugaacucc

SEQ ID NO: 82240 - RNA, 32 nt, Human
cacuaccagcagcaaccaggacgucuguucuu

SEQ ID NO: 82241 - RNA, 32 nt, Human
cacuacccagauggcagggaggccgagagccc

SEQ ID NO: 82242 - RNA, 32 nt, Human
cacuacccucgaggaggaggcagcggcagccg

SEQ ID NO: 82243 - RNA, 20 nt, Human
cacuaccugcaccagagcca

SEQ ID NO: 82244 - RNA, 32 nt, Human
cacuaccuguucugcaggcggguccuggccuc

SEQ ID NO: 82245 - RNA, 32 nt, Human
cacuaccuuccaaagugcugggauuacaggcg

SEQ ID NO: 82246 - RNA, 32 nt, Human
cacuacgcccagcuaauuugugguauuuuuag

SEQ ID NO: 82247 - RNA, 32 nt, Human
cacuacgccuggcuaauuuuuguauuuuuagu

SEQ ID NO: 82248 - RNA, 32 nt, Human
cacuacgccuggcugauuuuuguaguuuuagu

SEQ ID NO: 82249 - RNA, 32 nt, Human
cacuacggaccgugccuucuccaccuuccccu

SEQ ID NO: 82250 - RNA, 32 nt, Human
cacuacggccucaccucccaccccugucacua

SEQ ID NO: 82251 - RNA, 32 nt, Human
cacuacggcuggcuaauuuuuguauuuuuagu

SEQ ID NO: 82252 - RNA, 32 nt, Human
cacuacggggcuuccuggcugcagaguugggg

SEQ ID NO: 82253 - RNA, 32 nt, Human
cacuacguuagccaggcuggucucaaacuccu

SEQ ID NO: 82254 - RNA, 32 nt, Human
cacuacuaaaaauacaaaaauuagaugggcgu

SEQ ID NO: 82255 - RNA, 32 nt, Human
cacuacuaaacauacaaaaauuagcugggcau

SEQ ID NO: 82256 - RNA, 32 nt, Human
cacuacuaaacauacaaaauuagccgggcaug

SEQ ID NO: 82257 - RNA, 32 nt, Human
cacuacuacacuccagccuggugacagaguga

SEQ ID NO: 82258 - RNA, 32 nt, Human
cacuacuaguaacuggcagcuccagggugagg

SEQ ID NO: 82259 - RNA, 24 nt, Human
cacuacucacccucucugcugcug

SEQ ID NO: 82260 - RNA, 32 nt, Human
cacuacucauagcagcuccugaggcagguaaa

SEQ ID NO: 82261 - RNA, 32 nt, Human
cacuacucucuuccuccacuucauuuuuccuu

SEQ ID NO: 82262 - RNA, 32 nt, Human
cacuacugcacuccagacuggugacggagcga

SEQ ID NO: 82263 - RNA, 24 nt, Human
cacuacugcacuccagccugggca

SEQ ID NO: 82264 - RNA, 32 nt, Human
cacuacugcacuccagccugggcaacagaaca

SEQ ID NO: 82265 - RNA, 32 nt, Human
cacuacugcacuccagccugggcgacaaagca

SEQ ID NO: 82266 - RNA, 32 nt, Human
cacuacugcacuccagccugggugacagagua

SEQ ID NO: 82267 - RNA, 32 nt, Human
cacuacugcacuccagccugggugacagagug

SEQ ID NO: 82268 - RNA, 32 nt, Human
cacuacugcauuccagccugagcaacagagca

SEQ ID NO: 82269 - RNA, 32 nt, Human
cacuacugcauuccagccugggugacagagug

SEQ ID NO: 82270 - RNA, 32 nt, Human
cacuacugcauuccagccugggugacauauca

SEQ ID NO: 82271 - RNA, 32 nt, Human
cacuacugcauuccagccuggguggacagaac

SEQ ID NO: 82272 - RNA, 32 nt, Human
cacuacuguacucuagccugggcagcagagug

SEQ ID NO: 82273 - RNA, 32 nt, Human
cacuacuucuuguucuuaugaaugacucuaga

SEQ ID NO: 82274 - RNA, 32 nt, Human
cacuacuuugggaggcugaggcuggagaaucg

SEQ ID NO: 82275 - RNA, 32 nt, Human
cacuacuuugggaggcugaggcuggagaauug

SEQ ID NO: 82276 - RNA, 32 nt, Human
cacuagaaaacacacuuccugcaccaacacca

SEQ ID NO: 82277 - RNA, 32 nt, Human
cacuagaagcacugagagaugcggcccccucg

SEQ ID NO: 82278 - RNA, 32 nt, Human
cacuagaaggcugaguuugacauguugauauu

SEQ ID NO: 82279 - RNA, 32 nt, Human
cacuagaagggaggauugucucaggcgagucu

SEQ ID NO: 82280 - RNA, 32 nt, Human
cacuagaauacaucagcuucaaacauucacaa

SEQ ID NO: 82281 - RNA, 32 nt, Human
cacuagaaucccaggaggagcuugaaauccug

SEQ ID NO: 82282 - RNA, 32 nt, Human
cacuagacuuguagcaggccugggcugcaggc

SEQ ID NO: 82283 - RNA, 32 nt, Human
cacuagagagggagggggaagagcagaaguua

SEQ ID NO: 82284 - RNA, 32 nt, Human
cacuagagccugggcaacagaccaagacucca

SEQ ID NO: 82285 - RNA, 32 nt, Human
cacuagaggaagcaucauagcaacuggcugga

SEQ ID NO: 82286 - RNA, 32 nt, Human
cacuagauucagccacugcaagcccugggccu

SEQ ID NO: 82287 - RNA, 32 nt, Human
cacuagauugaauggucacagaaucggaggac

SEQ ID NO: 82288 - RNA, 32 nt, Human
cacuagcaaguucuacccuccuggucugacac

SEQ ID NO: 82289 - RNA, 32 nt, Human
cacuagcacuuacaggaggcccaggugggaag

SEQ ID NO: 82290 - RNA, 32 nt, Human
cacuagcauaauauuuguggcauauccgugua

SEQ ID NO: 82291 - RNA, 32 nt, Human
cacuagcaucuucucuaccuucaagaaccagg

SEQ ID NO: 82292 - RNA, 32 nt, Human
cacuagccagaagagaggagugggacaguccu

SEQ ID NO: 82293 - RNA, 32 nt, Human
cacuagcccucacucaguuucugccucacaaa

SEQ ID NO: 82294 - RNA, 32 nt, Human
cacuagccucuagccacacagguuccauccca

SEQ ID NO: 82295 - RNA, 32 nt, Human
cacuagccugugaucccagcacuuugggaggc

SEQ ID NO: 82296 - RNA, 32 nt, Human
cacuagccuucugucccucccgcagaagacug

SEQ ID NO: 82297 - RNA, 32 nt, Human
cacuagcguggccgcgagccucggugagccgg

SEQ ID NO: 82298 - RNA, 32 nt, Human
cacuagcuccacggccccagacaccuucccug

SEQ ID NO: 82299 - RNA, 32 nt, Human
cacuagcucgacacagucugcaguccaggcgu

SEQ ID NO: 82300 - RNA, 32 nt, Human
cacuagcucgagacccggccugugcugcccug

SEQ ID NO: 82301 - RNA, 32 nt, Human
cacuagcucucauuauucagcucuuuucagcu

SEQ ID NO: 82302 - RNA, 32 nt, Human
cacuagcugggagccugggggcuccucuaagg

SEQ ID NO: 82303 - RNA, 32 nt, Human
cacuagcuggggaggucuuggaacccuccgag

SEQ ID NO: 82304 - RNA, 32 nt, Human
cacuagcuucuccaaauccucccauggcaaag

SEQ ID NO: 82305 - RNA, 22 nt, Human
cacuagcuuguuacagcugccu

SEQ ID NO: 82306 - RNA, 32 nt, Human
cacuaggacucugaggcucuuucugggccaag

SEQ ID NO: 82307 - RNA, 32 nt, Human
cacuaggaggcagagguugcagugagcaguua

SEQ ID NO: 82308 - RNA, 32 nt, Human
cacuaggagggcugagugaacacgcaagcuac

SEQ ID NO: 82309 - RNA, 32 nt, Human
cacuaggauauuuacuguggcuugauuuguag

SEQ ID NO: 82310 - RNA, 32 nt, Human
cacuaggauauuucuacccaugcaacggaaga

SEQ ID NO: 82311 - RNA, 32 nt, Human
cacuaggcaccgagauuacaguggaagaucag

SEQ ID NO: 82312 - RNA, 32 nt, Human
cacuaggcccaggaguaugaggcccugcugaa

SEQ ID NO: 82313 - RNA, 24 nt, Human
cacuaggcccccacccugcugcug

SEQ ID NO: 82314 - RNA, 32 nt, Human
cacuaggcuugggguggggaggucccguguuc

SEQ ID NO: 82315 - RNA, 32 nt, Human
cacuagggccugggguuaauugcucaaagggc

SEQ ID NO: 82316 - RNA, 32 nt, Human
cacuaggggcuggcccacuaggagggcuggcc

SEQ ID NO: 82317 - RNA, 32 nt, Human
cacuagggggugauggagaggaagggggccac

SEQ ID NO: 82318 - RNA, 32 nt, Human
cacuagguugcccaggcuggugucgaauuccu

SEQ ID NO: 82319 - RNA, 32 nt, Human
cacuagguuuacaaucucaguguccuuacaag

SEQ ID NO: 82320 - RNA, 32 nt, Human
cacuaguaaggaguucauuuuaugaagauauu

SEQ ID NO: 82321 - RNA, 32 nt, Human
cacuagucaggcuaguggagagaugaccaggu

SEQ ID NO: 82322 - RNA, 32 nt, Human
cacuagucuggcagccuccaccucuugacccu

SEQ ID NO: 82323 - RNA, 32 nt, Human
cacuagucuugaggcccagccuaggaugguag

SEQ ID NO: 82324 - RNA, 21 nt, Human
cacuagugcucuccagaaucu

SEQ ID NO: 82325 - RNA, 32 nt, Human
cacuagugcuguucugaccauucucuguguug

SEQ ID NO: 82326 - RNA, 32 nt, Human
cacuagugugccuugcaaauuguauuugucuu

SEQ ID NO: 82327 - RNA, 32 nt, Human
cacuaguugggguuugguggccauguuuucua

SEQ ID NO: 82328 - RNA, 24 nt, Human
cacuauaaccucgaacuccuggcu

SEQ ID NO: 82329 - RNA, 32 nt, Human
cacuauaauaaaagccagucugggaugcuaaa

SEQ ID NO: 82330 - RNA, 32 nt, Human
cacuauacccggcuaauuuuuguauuuuuagu

SEQ ID NO: 82331 - RNA, 20 nt, Human
cacuauacuccagccuggca

SEQ ID NO: 82332 - RNA, 21 nt, Human
cacuauacuccagccugggca

SEQ ID NO: 82333 - RNA, 20 nt, Human
cacuauagaagaugagccac

SEQ ID NO: 82334 - RNA, 32 nt, Human
cacuauagccuaggugacagagugagacucug

SEQ ID NO: 82335 - RNA, 32 nt, Human
cacuauaggcuucuuugauuuucuuucagaag

SEQ ID NO: 82336 - RNA, 19 nt, Human
cacuauauuccugccacca

SEQ ID NO: 82337 - RNA, 32 nt, Human
cacuaucacauaugaauucucauuagagggca

SEQ ID NO: 82338 - RNA, 32 nt, Human
cacuaucacauccugaauaucacucacagaau

SEQ ID NO: 82339 - RNA, 32 nt, Human
cacuaucacccaggcuagagggcaguggcaca

SEQ ID NO: 82340 - RNA, 32 nt, Human
cacuaucacccaggcuggagugcaguggcaua

SEQ ID NO: 82341 - RNA, 32 nt, Human
cacuaucacugcaaccuccgccuccuggguuc

SEQ ID NO: 82342 - RNA, 32 nt, Human
cacuaucaggcaggucacauuggugcagaucc

SEQ ID NO: 82343 - RNA, 32 nt, Human
cacuaucauggagacugagagcgagcagaacu

SEQ ID NO: 82344 - RNA, 32 nt, Human
cacuaucauuuucauuuggaauggguauuuuu

SEQ ID NO: 82345 - RNA, 32 nt, Human
cacuauccacuuccaucagucacgcagacccu

SEQ ID NO: 82346 - RNA, 32 nt, Human
cacuauccggcugaggucucccagagacaggc

SEQ ID NO: 82347 - RNA, 32 nt, Human
cacuauccucuucacauguaacuucugcagac

SEQ ID NO: 82348 - RNA, 32 nt, Human
cacuauccugggcaaauguuuuacccuguccu

SEQ ID NO: 82349 - RNA, 32 nt, Human
cacuaucgauacuguuucugugccuuauguuu

SEQ ID NO: 82350 - RNA, 32 nt, Human
cacuaucuacacauuuauuccccaaauacuua

SEQ ID NO: 82351 - RNA, 32 nt, Human
cacuaucucacccucccacuccuguuuuuaaa

SEQ ID NO: 82352 - RNA, 32 nt, Human
cacuaucugacuuccauuguguuuuauugcuu

SEQ ID NO: 82353 - RNA, 32 nt, Human
cacuaucuugauuguacucuccagaaaauuuu

SEQ ID NO: 82354 - RNA, 32 nt, Human
cacuaugaagcucaagcuaccaaaaagaaagu

SEQ ID NO: 82355 - RNA, 32 nt, Human
cacuaugcaauugagugcccaccagaagacac

SEQ ID NO: 82356 - RNA, 32 nt, Human
cacuaugcaugucucacucacccuccacagca

SEQ ID NO: 82357 - RNA, 32 nt, Human
cacuaugcauuuugaaacuuguucauccugga

SEQ ID NO: 82358 - RNA, 32 nt, Human
cacuaugccaagcuaauuuuuguauuuuuagu

SEQ ID NO: 82359 - RNA, 32 nt, Human
cacuaugcccagcuaauuuuguauuuuuagua

SEQ ID NO: 82360 - RNA, 32 nt, Human
cacuaugcccagcuaauuuuuguauuuucugu

SEQ ID NO: 82361 - RNA, 32 nt, Human
cacuaugcccucaaccugggagcaucuggcag

SEQ ID NO: 82362 - RNA, 32 nt, Human
cacuaugccgagcaagaaaaguggaucucagg

SEQ ID NO: 82363 - RNA, 32 nt, Human
cacuaugccuggcuaauuuuguauuuuuagua

SEQ ID NO: 82364 - RNA, 32 nt, Human
cacuaugccuggcuaauuuuuguauuuuuauu

SEQ ID NO: 82365 - RNA, 32 nt, Human
cacuaugccuggcuaauuuuuguguuuuuagu

SEQ ID NO: 82366 - RNA, 16 nt, Human
cacuaugcuaaaguca

SEQ ID NO: 82367 - RNA, 32 nt, Human
cacuauggagucugccucauguuucucaauca

SEQ ID NO: 82368 - RNA, 32 nt, Human
cacuauggcaugcuucccuccuggugggcccu

SEQ ID NO: 82369 - RNA, 32 nt, Human
cacuauggcucacaccuauaaucccagcacuu

SEQ ID NO: 82370 - RNA, 32 nt, Human
cacuaugggaaaggaaauuuaauuagcacugg

SEQ ID NO: 82371 - RNA, 32 nt, Human
cacuaugggaggccgcugcugcguggagcacu

SEQ ID NO: 82372 - RNA, 32 nt, Human
cacuaugggaggcugaggugagaggaucacuu

SEQ ID NO: 82373 - RNA, 32 nt, Human
cacuaugggaggcugaggugggcagaucuccu

SEQ ID NO: 82374 - RNA, 32 nt, Human
cacuauggugugaggcgcguguucgggcucuu

SEQ ID NO: 82375 - RNA, 32 nt, Human
cacuaugucacccuggcuggagugcaguagug

SEQ ID NO: 82376 - RNA, 32 nt, Human
cacuauguccugcuggauccuuccugcagugg

SEQ ID NO: 82377 - RNA, 32 nt, Human
cacuaugucuggcuaauuuuuguauguuuuuc

SEQ ID NO: 82378 - RNA, 32 nt, Human
cacuauguggcccaggcuggucucaaacuucu

SEQ ID NO: 82379 - RNA, 32 nt, Human
cacuauguggcccaggcuggucucgaacuccu

SEQ ID NO: 82380 - RNA, 32 nt, Human
cacuauguugcccaggcuagucucaaacuccu

SEQ ID NO: 82381 - RNA, 32 nt, Human
cacuauguugcccaggcuggagugcaguggug

SEQ ID NO: 82382 - RNA, 32 nt, Human
cacuauguugcccaggcuggccucaaacuccg

SEQ ID NO: 82383 - RNA, 32 nt, Human
cacuauguugcccaggcuggccucaagcaauc

SEQ ID NO: 82384 - RNA, 32 nt, Human
cacuauguugcccaggcuggucucaaacucca

SEQ ID NO: 82385 - RNA, 32 nt, Human
cacuauguugcccaggcuggucucaaacuccu

SEQ ID NO: 82386 - RNA, 32 nt, Human
cacuauguugcccaggcuggucucaaacucuu

SEQ ID NO: 82387 - RNA, 32 nt, Human
cacuauguugcccaggcuggucucaaguuccu

SEQ ID NO: 82388 - RNA, 32 nt, Human
cacuauguugcccaggcuggucuccaacucau

SEQ ID NO: 82389 - RNA, 32 nt, Human
cacuauguugcccaggcuggucuccaacuccu

SEQ ID NO: 82390 - RNA, 32 nt, Human
cacuauguugcccaggcuggucucgaacuccc

SEQ ID NO: 82391 - RNA, 32 nt, Human
cacuauguugcccaggcuggucucgaacuucg

SEQ ID NO: 82392 - RNA, 32 nt, Human
cacuauguugcccaggcuggucucgaacuucu

SEQ ID NO: 82393 - RNA, 32 nt, Human
cacuauguuggccaggcuggucucaaacuccu

SEQ ID NO: 82394 - RNA, 32 nt, Human
cacuauguuggccaggcuggucuccaacuccu

SEQ ID NO: 82395 - RNA, 32 nt, Human
cacuauguuggccaggcuggucucgaacaccu

SEQ ID NO: 82396 - RNA, 32 nt, Human
cacuauguuggccaggcuggucucgaacuccu

SEQ ID NO: 82397 - RNA, 32 nt, Human
cacuauguuggccaggcuggucuggaacgccu

SEQ ID NO: 82398 - RNA, 32 nt, Human
cacuauguuggccaggcugguuuucaacuccu

SEQ ID NO: 82399 - RNA, 32 nt, Human
cacuauguuggccagguuggucucaagcuccu

SEQ ID NO: 82400 - RNA, 32 nt, Human
cacuauuaaagcaguacuggggaauuuuguac

SEQ ID NO: 82401 - RNA, 32 nt, Human
cacuauucaguuaucuauugagaaauuauuuu

SEQ ID NO: 82402 - RNA, 32 nt, Human
cacuauucauuuggguuuuauuaaagagauag

SEQ ID NO: 82403 - RNA, 32 nt, Human
cacuauucccgacccaaagggugacuuuucau

SEQ ID NO: 82404 - RNA, 32 nt, Human
cacuauuccuaggaggaaaaagaaaugcauuc

SEQ ID NO: 82405 - RNA, 32 nt, Human
cacuauucugaugaaaaggcugguuuuguugu

SEQ ID NO: 82406 - RNA, 32 nt, Human
cacuauugaugcuggggcauuuacaggcagaa

SEQ ID NO: 82407 - RNA, 32 nt, Human
cacuauugauggacauuuggguuguuucccau

SEQ ID NO: 82408 - RNA, 24 nt, Human
cacuauugcacuccagccugggca

SEQ ID NO: 82409 - RNA, 32 nt, Human
cacuauugcacuccagccugggcaacaggagu

SEQ ID NO: 82410 - RNA, 32 nt, Human
cacuauugcacuccagccugggcgacagggca

SEQ ID NO: 82411 - RNA, 32 nt, Human
cacuauugccuuggcccugacagcuguuacca

SEQ ID NO: 82412 - RNA, 32 nt, Human
cacuauuucgcuuccugcauuagcaaauuuua

SEQ ID NO: 82413 - RNA, 32 nt, Human
cacuauuugcccagaagcuuggggcagagguc

SEQ ID NO: 82414 - RNA, 32 nt, Human
cacuauuuugcccaggcuggagugcgauggug

SEQ ID NO: 82415 - RNA, 32 nt, Human
cacuauuuugcccaggcuggucucaaacuccc

SEQ ID NO: 82416 - RNA, 32 nt, Human
cacucaaaaagaaggcugggugcaguggcucu

SEQ ID NO: 82417 - RNA, 32 nt, Human
cacucaaaacaugcauugggcuagcagaauau

SEQ ID NO: 82418 - RNA, 32 nt, Human
cacucaaaaccagcagugcugcuaucagauaa

SEQ ID NO: 82419 - RNA, 32 nt, Human
cacucaaaauggcuaacuugaauggaggaagu

SEQ ID NO: 82420 - RNA, 32 nt, Human
cacucaaacaccuuacaaagugcugaguaggu

SEQ ID NO: 82421 - RNA, 32 nt, Human
cacucaaaugccucugucucagcgguuguaga

SEQ ID NO: 82422 - RNA, 32 nt, Human
cacucaacagccaccguggauguggccugggc

SEQ ID NO: 82423 - RNA, 32 nt, Human
cacucaacccccaccuggaaggggcaaagaaa

SEQ ID NO: 82424 - RNA, 21 nt, Human
cacucaacucauggacuccuc

SEQ ID NO: 82425 - RNA, 32 nt, Human
cacucaacuccaagcacaucaaauaaagagcu

SEQ ID NO: 82426 - RNA, 32 nt, Human
cacucaagauacuugccagucucuccagugug

SEQ ID NO: 82427 - RNA, 32 nt, Human
cacucaagccugggcaacagagugagacccca

SEQ ID NO: 82428 - RNA, 32 nt, Human
cacucaagccugggcaauguagcaagauccug

SEQ ID NO: 82429 - RNA, 32 nt, Human
cacucaagccugggcgacagagcaaggcuuca

SEQ ID NO: 82430 - RNA, 32 nt, Human
cacucaagccugggcgacagagcgagacuccg

SEQ ID NO: 82431 - RNA, 32 nt, Human
cacucaagccugggcgacagagggagauuccg

SEQ ID NO: 82432 - RNA, 32 nt, Human
cacucaagccugggugacagagcaagacucca

SEQ ID NO: 82433 - RNA, 32 nt, Human
cacucaagccugggugacagagcgaaacuccg

SEQ ID NO: 82434 - RNA, 32 nt, Human
cacucaagccugggugacagugagacucuguc

SEQ ID NO: 82435 - RNA, 32 nt, Human
cacucaagccugggugacgagugaaacugucu

SEQ ID NO: 82436 - RNA, 32 nt, Human
cacucaagcuuggaugacagagcaagacuccg

SEQ ID NO: 82437 - RNA, 32 nt, Human
cacucaagcuugggugacagagcaagaccccg

SEQ ID NO: 82438 - RNA, 32 nt, Human
cacucaaggcauugacagcuuagcugugaggg

SEQ ID NO: 82439 - RNA, 32 nt, Human
cacucaaguuuggccaagggacuccacagcac

SEQ ID NO: 82440 - RNA, 28 nt, Human
cacucaauaauugcuuguuaaaggaagg

SEQ ID NO: 82441 - RNA, 32 nt, Human
cacucaauacaaaaaggccccucucuacaucu

SEQ ID NO: 82442 - RNA, 32 nt, Human
cacucaauacgcuggaguccacgugggccugg

SEQ ID NO: 82443 - RNA, 32 nt, Human
cacucacacaaguaacaccacagcagaccucg

SEQ ID NO: 82444 - RNA, 32 nt, Human
cacucacacacacucacacacacucauccccu

SEQ ID NO: 82445 - RNA, 32 nt, Human
cacucacacagaauuuuauuuuacauaguuuu

SEQ ID NO: 82446 - RNA, 32 nt, Human
cacucacacaguuuaggauuucagcuauggcu

SEQ ID NO: 82447 - RNA, 32 nt, Human
cacucacacaugcauacacacagacauacaca

SEQ ID NO: 82448 - RNA, 32 nt, Human
cacucacaccucuuugcuuuaccagugguguu

SEQ ID NO: 82449 - RNA, 32 nt, Human
cacucacacucaugugcugaaggacucacagc

SEQ ID NO: 82450 - RNA, 32 nt, Human
cacucacacugaggccuuggggacugaggccc

SEQ ID NO: 82451 - RNA, 32 nt, Human
cacucacacugcgguucacacccgcaggcgcu

SEQ ID NO: 82452 - RNA, 32 nt, Human
cacucacagcagagguggaaagcuggagacug

SEQ ID NO: 82453 - RNA, 32 nt, Human
cacucacauucacacacauacacacucauuga

SEQ ID NO: 82454 - RNA, 32 nt, Human
cacucaccaaacccucucaucugccggccuga

SEQ ID NO: 82455 - RNA, 32 nt, Human
cacucaccacaaccuccgccuccuggguucaa

SEQ ID NO: 82456 - RNA, 32 nt, Human
cacucaccaguucugcugccucaggucaggcc

SEQ ID NO: 82457 - RNA, 32 nt, Human
cacucaccauuuuaacacuggaagccacuuga

SEQ ID NO: 82458 - RNA, 32 nt, Human
cacucacccacugcuguccugucucauuccca

SEQ ID NO: 82459 - RNA, 32 nt, Human
cacucacccaggagcuggcugggccaggaccg

SEQ ID NO: 82460 - RNA, 32 nt, Human
cacucacccaucaauccucccacgcucccggu

SEQ ID NO: 82461 - RNA, 32 nt, Human
cacucacccuuucuuauugucuugcccugcau

SEQ ID NO: 82462 - RNA, 32 nt, Human
cacucaccggccgccuccggccgaguaccccc

SEQ ID NO: 82463 - RNA, 32 nt, Human
cacucaccucauucccauuguuuggaucaugc

SEQ ID NO: 82464 - RNA, 32 nt, Human
cacucaccuccaccuucacaggccauuugcac

SEQ ID NO: 82465 - RNA, 32 nt, Human
cacucaccugcucuuccugggcuggcugucuc

SEQ ID NO: 82466 - RNA, 32 nt, Human
cacucacgaggacccucagcugcuggaggcca

SEQ ID NO: 82467 - RNA, 32 nt, Human
cacucacggcagcgaugcacagggccacuuaa

SEQ ID NO: 82468 - RNA, 32 nt, Human
cacucacuacugcucuugcccuggacuauuca

SEQ ID NO: 82469 - RNA, 32 nt, Human
cacucacuccacccugccucugcaucccuuaa

SEQ ID NO: 82470 - RNA, 20 nt, Human
cacucacuccagccugggca

SEQ ID NO: 82471 - RNA, 32 nt, Human
cacucacucucccccuccucuucuggucuggc

SEQ ID NO: 82472 - RNA, 32 nt, Human
cacucacucuggucaugauaaauguucgucac

SEQ ID NO: 82473 - RNA, 32 nt, Human
cacucacugaacaccagcugcaguagagccga

SEQ ID NO: 82474 - RNA, 32 nt, Human
cacucacugcaacuggaucuucagccuccugu

SEQ ID NO: 82475 - RNA, 32 nt, Human
cacucacugcaacuuccgccuccuggggucaa

SEQ ID NO: 82476 - RNA, 32 nt, Human
cacucacugcagccuccgccucugggguucaa

SEQ ID NO: 82477 - RNA, 32 nt, Human
cacucacugcaggcuccgccucccggguuccc

SEQ ID NO: 82478 - RNA, 32 nt, Human
cacucacugccaaggucuucagcuucacuccu

SEQ ID NO: 82479 - RNA, 32 nt, Human
cacucacugcccucccucccuccugggcucca

SEQ ID NO: 82480 - RNA, 32 nt, Human
cacucacuuuuucagagacucaacagucucgu

SEQ ID NO: 82481 - RNA, 32 nt, Human
cacucagaaccucucuggaauuugugccugau

SEQ ID NO: 82482 - RNA, 32 nt, Human
cacucagacuccugcguagcugggaccacagg

SEQ ID NO: 82483 - RNA, 32 nt, Human
cacucagagacaccugcacuagaaauugcauu

SEQ ID NO: 82484 - RNA, 32 nt, Human
cacucagagacaugcagagauuggguuuuugg

SEQ ID NO: 82485 - RNA, 32 nt, Human
cacucagagcaagaugaguugcugcuauucuu

SEQ ID NO: 82486 - RNA, 32 nt, Human
cacucagagcagcuccaagacagaggcucugu

SEQ ID NO: 82487 - RNA, 32 nt, Human
cacucagaggcagagacugaguuaagucauag

SEQ ID NO: 82488 - RNA, 32 nt, Human
cacucagaucuagauccugcuuucauuucugg

SEQ ID NO: 82489 - RNA, 32 nt, Human
cacucagcacccccuucucugcccauucccca

SEQ ID NO: 82490 - RNA, 32 nt, Human
cacucagcacccuccccucagcagccuccacg

SEQ ID NO: 82491 - RNA, 32 nt, Human
cacucagcagaggcaauguuauuuauguacau

SEQ ID NO: 82492 - RNA, 32 nt, Human
cacucagcagccagagccucagagccagcagg

SEQ ID NO: 82493 - RNA, 32 nt, Human
cacucagcaggggccucgcagagaugcgugca

SEQ ID NO: 82494 - RNA, 32 nt, Human
cacucagcaucaccccuuccuggguggcaugu

SEQ ID NO: 82495 - RNA, 32 nt, Human
cacucagcauucucaguuuacucuucaguuug

SEQ ID NO: 82496 - RNA, 32 nt, Human
cacucagccaacugcucgcucacucaccuccc

SEQ ID NO: 82497 - RNA, 32 nt, Human
cacucagccacccugaguugcuuuucagcuga

SEQ ID NO: 82498 - RNA, 32 nt, Human
cacucagccauuucccccuccucagauggggc

SEQ ID NO: 82499 - RNA, 32 nt, Human
cacucagcccagggauagccaguguugggaga

SEQ ID NO: 82500 - RNA, 32 nt, Human
cacucagcccuugcacugaccugccuucugau

SEQ ID NO: 82501 - RNA, 32 nt, Human
cacucagcccuuuaaaccuuucccuggccuuu

SEQ ID NO: 82502 - RNA, 32 nt, Human
cacucagccggggcccucccaccuccaacgcc

SEQ ID NO: 82503 - RNA, 32 nt, Human
cacucagcuggauuccagaagcucagguggug

SEQ ID NO: 82504 - RNA, 32 nt, Human
cacucaggaacacccucccugccugugcaaag

SEQ ID NO: 82505 - RNA, 32 nt, Human
cacucaggaaccacuggcuccuccagugcaca

SEQ ID NO: 82506 - RNA, 32 nt, Human
cacucaggaggcugaggcagggaggauccauu

SEQ ID NO: 82507 - RNA, 32 nt, Human
cacucaggaguucucaucugacaagucaguug

SEQ ID NO: 82508 - RNA, 19 nt, Human
cacucaggauguccugcuc

SEQ ID NO: 82509 - RNA, 32 nt, Human
cacucaggccagugcaccccugggcagagccc

SEQ ID NO: 82510 - RNA, 32 nt, Human
cacucaggcggcagcauucccucccagccacu

SEQ ID NO: 82511 - RNA, 32 nt, Human
cacucaggcuaguuuguacuaguagaguuuug

SEQ ID NO: 82512 - RNA, 19 nt, Human
cacucaggcugcagugcag

SEQ ID NO: 82513 - RNA, 21 nt, Human
cacucaggcugcagugcagug

SEQ ID NO: 82514 - RNA, 21 nt, Human
cacucaggcuggaauguagug

SEQ ID NO: 82515 - RNA, 21 nt, Human
cacucaggcuggagugcagug

SEQ ID NO: 82516 - RNA, 32 nt, Human
cacucaggggcuggggcuucucucgcaccccc

SEQ ID NO: 82517 - RNA, 32 nt, Human
cacucagggucugaggcagcuaguagccggag

SEQ ID NO: 82518 - RNA, 32 nt, Human
cacucagggugggauuagggugaggcaaguga

SEQ ID NO: 82519 - RNA, 18 nt, Human
cacucaguaugugaggua

SEQ ID NO: 82520 - RNA, 32 nt, Human
cacucaguccuggccuugcucugaggguaaaa

SEQ ID NO: 82521 - RNA, 32 nt, Human
cacucagucgcccaggcuggagugcaguggca

SEQ ID NO: 82522 - RNA, 32 nt, Human
cacucagugaccucagucaccaaccuccucug

SEQ ID NO: 82523 - RNA, 22 nt, Human
cacucagugaggccgcccggca

SEQ ID NO: 82524 - RNA, 32 nt, Human
cacucagugcccggaguggcccagugagaagg

SEQ ID NO: 82525 - RNA, 32 nt, Human
cacucaguggguggagaggaagcauaugugga

SEQ ID NO: 82526 - RNA, 32 nt, Human
cacucaguguguguuucucuuccccuucuuag

SEQ ID NO: 82527 - RNA, 32 nt, Human
cacucaguugcccaggcuggauugcgguggcg

SEQ ID NO: 82528 - RNA, 32 nt, Human
cacucauacuccuugucagcaguccccaaccu

SEQ ID NO: 82529 - RNA, 32 nt, Human
cacucauacuucaucucauucucccuucugcc

SEQ ID NO: 82530 - RNA, 32 nt, Human
cacucauagggugcucugaggucaauaaagca

SEQ ID NO: 82531 - RNA, 32 nt, Human
cacucaucaaaccacaucuugaugcuaaguaa

SEQ ID NO: 82532 - RNA, 32 nt, Human
cacucaucaaucccagcccuaguguagcugau

SEQ ID NO: 82533 - RNA, 23 nt, Human
cacucaucaccucaucaccgagg

SEQ ID NO: 82534 - RNA, 32 nt, Human
cacucauccguccaggaggugggucucauggu

SEQ ID NO: 82535 - RNA, 32 nt, Human
cacucauccgugcaagcucuccagaagggaug

SEQ ID NO: 82536 - RNA, 32 nt, Human
cacucauccuccaccccucugccugcuucucc

SEQ ID NO: 82537 - RNA, 32 nt, Human
cacucaucuccuccucccacauuucuggagcu

SEQ ID NO: 82538 - RNA, 21 nt, Human
cacucaucuuuuuguguuuuu

SEQ ID NO: 82539 - RNA, 32 nt, Human
cacucaugaccauacucaucuguugguggugg

SEQ ID NO: 82540 - RNA, 32 nt, Human
cacucaugccuguaaacccagggcuuuagaag

SEQ ID NO: 82541 - RNA, 32 nt, Human
cacucauggacucacacauacacucacaugca

SEQ ID NO: 82542 - RNA, 32 nt, Human
cacucauggccuuccuauguuugggaaagcau

SEQ ID NO: 82543 - RNA, 32 nt, Human
cacucaugucaccgccauccuccugggcuucc

SEQ ID NO: 82544 - RNA, 32 nt, Human
cacucaugucuccuccacaugcgguccacaca

SEQ ID NO: 82545 - RNA, 31 nt, Human
cacucauuaaagugcaucacagccagagccu

SEQ ID NO: 82546 - RNA, 32 nt, Human
cacucauuccaaaauucaguauuuaauguaau

SEQ ID NO: 82547 - RNA, 17 nt, Human
cacucauucuccugcuc

SEQ ID NO: 82548 - RNA, 32 nt, Human
cacucauuucagacugauccagauuugccgcc

SEQ ID NO: 82549 - RNA, 32 nt, Human
cacuucuuccuggaucaucucuccccaucacu

SEQ ID NO: 82550 - RNA, 32 nt, Human
cacuucuuccuuggggagaccgucccacagcu

SEQ ID NO: 82551 - RNA, 32 nt, Human
cacuucuuccuuucucuuucucucuucccuca

SEQ ID NO: 82552 - RNA, 17 nt, Human
cacuucuucgacaggaa

SEQ ID NO: 82553 - RNA, 32 nt, Human
cacuucuucucagaaaagaggccagcucugca

SEQ ID NO: 82554 - RNA, 32 nt, Human
cacuucuucuccccucccccaccgcaucuggc

SEQ ID NO: 82555 - RNA, 32 nt, Human
cacuucuucucuucuguccccaccuccucuug

SEQ ID NO: 82556 - RNA, 32 nt, Human
cacuucuugcccaggcuggaguacaauggugc

SEQ ID NO: 82557 - RNA, 32 nt, Human
cacuucuugucaucuucucauccucugcgcca

SEQ ID NO: 82558 - RNA, 32 nt, Human
cacuucuuucaaagucugccagugauggucac

SEQ ID NO: 82559 - RNA, 32 nt, Human
cacuucuuucuaucacccucuucagucaccuc

SEQ ID NO: 82560 - RNA, 32 nt, Human
cacuucuuugguccucaucuuuacuuaaaaag

SEQ ID NO: 82561 - RNA, 32 nt, Human
cacuucuuuguugcuuucuuuucuauugaguc

SEQ ID NO: 82562 - RNA, 32 nt, Human
cacuucuuuucauaagcacugacagggcccag

SEQ ID NO: 82563 - RNA, 32 nt, Human
cacuugaacagccucaucaauauugccgucau

SEQ ID NO: 82564 - RNA, 32 nt, Human
cacuugaaccauggacaagacucucucaagau

SEQ ID NO: 82565 - RNA, 32 nt, Human
cacuugaacccagaagacagguugcagugagc

SEQ ID NO: 82566 - RNA, 32 nt, Human
cacuugaacccaggaauucaggcugcaguaag

SEQ ID NO: 82567 - RNA, 32 nt, Human
cacuugaacccaggagguguugcagugaacca

SEQ ID NO: 82568 - RNA, 32 nt, Human
cacuugaacccaggagguugaggcugcaguga

SEQ ID NO: 82569 - RNA, 32 nt, Human
cacuugaaggaagaagucuaagagugaaguag

SEQ ID NO: 82570 - RNA, 31 nt, Human
cacuugaauccuccagggccuguguccucac

SEQ ID NO: 82571 - RNA, 32 nt, Human
cacuugacacagaagcuggugggcacacaggg

SEQ ID NO: 82572 - RNA, 17 nt, Human
cacuugacauuauugga

SEQ ID NO: 82573 - RNA, 19 nt, Human
cacuugacauuccuuguca

SEQ ID NO: 82574 - RNA, 32 nt, Human
cacuugacccaggagguggaggucgcagugag

SEQ ID NO: 82575 - RNA, 32 nt, Human
cacuugaccgggagacagagguugcagugagc

SEQ ID NO: 82576 - RNA, 32 nt, Human
cacuugaccuuaaaagucucuucuggucuuug

SEQ ID NO: 82577 - RNA, 19 nt, Human
cacuugacggcacaggaag

SEQ ID NO: 82578 - RNA, 32 nt, Human
cacuugacuagagacaugcuuguguuuuggaa

SEQ ID NO: 82579 - RNA, 20 nt, Human
cacuugacuucaccagguga

SEQ ID NO: 82580 - RNA, 21 nt, Human
cacuugagaaccuccucagca

SEQ ID NO: 82581 - RNA, 32 nt, Human
cacuugagagaagauggaggagauguucauuc

SEQ ID NO: 82582 - RNA, 32 nt, Human
cacuugagauacccucuccuugcugaaguuuu

SEQ ID NO: 82583 - RNA, 32 nt, Human
cacuugagcccaauucaaagcugcagugagcu

SEQ ID NO: 82584 - RNA, 32 nt, Human
cacuugagcccaggagguugaggcugcaguga

SEQ ID NO: 82585 - RNA, 32 nt, Human
cacuugagccccggagguugagacugcagugc

SEQ ID NO: 82586 - RNA, 32 nt, Human
cacuugagcccgggagguugaggcugcagugg

SEQ ID NO: 82587 - RNA, 32 nt, Human
cacuugagccuaggagguuaaggcuauaguga

SEQ ID NO: 82588 - RNA, 32 nt, Human
cacuugagccuggaaaagguugcagugagcug

SEQ ID NO: 82589 - RNA, 32 nt, Human
cacuugagccugggagguugugguugcaguga

SEQ ID NO: 82590 - RNA, 32 nt, Human
cacuugagccugggcagcagagugagaccugu

SEQ ID NO: 82591 - RNA, 32 nt, Human
cacuugagccugggcgacacagcgagacucca

SEQ ID NO: 82592 - RNA, 32 nt, Human
cacuugaggagcagagguggcagcagaggauu

SEQ ID NO: 82593 - RNA, 32 nt, Human
cacuugaggcuuagcuuugcucugccaacuuc

SEQ ID NO: 82594 - RNA, 32 nt, Human
cacuugagguuaggaguuugagaccagccugg

SEQ ID NO: 82595 - RNA, 32 nt, Human
cacuugagguuaggaguuugagaucagcccgg

SEQ ID NO: 82596 - RNA, 32 nt, Human
cacuugaguucacuugaguuuacauuugaaau

SEQ ID NO: 82597 - RNA, 32 nt, Human
cacuugauauagaaacauacuuugcugucaaa

SEQ ID NO: 82598 - RNA, 32 nt, Human
cacuugaucacccaggcuagagugcaguggcg

SEQ ID NO: 82599 - RNA, 32 nt, Human
cacuugaugacccccaaccaaguggcucccac

SEQ ID NO: 82600 - RNA, 32 nt, Human
cacuugaugagagaugagagugucacauuaau

SEQ ID NO: 82601 - RNA, 32 nt, Human
cacuugauuaggagagagacagcaguguuuga

SEQ ID NO: 82602 - RNA, 32 nt, Human
cacuugauuguagguaagaauccauacugaag

SEQ ID NO: 82603 - RNA, 32 nt, Human
cacuugcacaugcauacacaugcacucacaug

SEQ ID NO: 82604 - RNA, 32 nt, Human
cacuugcaggcagaaugggaggaggacaugga

SEQ ID NO: 82605 - RNA, 31 nt, Human
cacuugcaguuuccuguucuccucauugccu

SEQ ID NO: 82606 - RNA, 32 nt, Human
cacuugcauccaacuccuggggcugggaccgu

SEQ ID NO: 82607 - RNA, 32 nt, Human
cacuugccaccugagucacauuuucagaagcc

SEQ ID NO: 82608 - RNA, 32 nt, Human
cacuugccaucuuucucuauaucuccaguaau

SEQ ID NO: 82609 - RNA, 32 nt, Human
cacuugcccagaggcccagcugcuagaggccc

SEQ ID NO: 82610 - RNA, 32 nt, Human
cacuugccccaaauugucuuugaagucgugug

SEQ ID NO: 82611 - RNA, 32 nt, Human
cacuugcccucaugugacacugggugacaguc

SEQ ID NO: 82612 - RNA, 32 nt, Human
cacuugcccuuucauaugucucuugucacuau

SEQ ID NO: 82613 - RNA, 32 nt, Human
cacuugccuaaucuccagcccagggccauugu

SEQ ID NO: 82614 - RNA, 32 nt, Human
cacuugccuaccaggcagcugugugacugagc

SEQ ID NO: 82615 - RNA, 32 nt, Human
cacuugccuaugcuuguucucccaggcagugg

SEQ ID NO: 82616 - RNA, 32 nt, Human
cacuugccucaaggcuuuauauuuggcugcuu

SEQ ID NO: 82617 - RNA, 18 nt, Human
cacuugccuccacaccuu

SEQ ID NO: 82618 - RNA, 32 nt, Human
cacuugccugcucugccccuuggagcugcauu

SEQ ID NO: 82619 - RNA, 32 nt, Human
cacuugccuuucucauucucuccugagcccac

SEQ ID NO: 82620 - RNA, 32 nt, Human
cacuugcggacucucccuuccuuccuucucag

SEQ ID NO: 82621 - RNA, 20 nt, Human
cacuugcucccgucuacuua

SEQ ID NO: 82622 - RNA, 32 nt, Human
cacuugcuccuaccagcuucugaaggcuccaa

SEQ ID NO: 82623 - RNA, 32 nt, Human
cacuugcuccucccucuacccucggcacccug

SEQ ID NO: 82624 - RNA, 32 nt, Human
cacuugcucucuuuacccuaguuucuuccucu

SEQ ID NO: 82625 - RNA, 32 nt, Human
cacuugcugagguguggcugaggcagaaucau

SEQ ID NO: 82626 - RNA, 32 nt, Human
cacuugcugccaccaccucuuccuggggcauc

SEQ ID NO: 82627 - RNA, 32 nt, Human
cacuugcugccagcaguuugugaauggugucu

SEQ ID NO: 82628 - RNA, 32 nt, Human
cacuugcuguagacuccugggugcuggaggag

SEQ ID NO: 82629 - RNA, 23 nt, Human
cacuugcuguucaggaccacuaa

SEQ ID NO: 82630 - RNA, 32 nt, Human
cacuugcuucuucaguucuuugcucagcuagg

SEQ ID NO: 82631 - RNA, 32 nt, Human
cacuugcuuggauuaggcaaggcuccacucau

SEQ ID NO: 82632 - RNA, 22 nt, Human
cacuuggaaauaaaccauugga

SEQ ID NO: 82633 - RNA, 32 nt, Human
cacuuggaaugagaaucagaggauggaaauag

SEQ ID NO: 82634 - RNA, 32 nt, Human
cacuuggacugaauagugacacucgguaagga

SEQ ID NO: 82635 - RNA, 32 nt, Human
cacuuggagcagugggaggaaaucuggguuug

SEQ ID NO: 82636 - RNA, 32 nt, Human
cacuuggagcagugucuguuguuccaggugua

SEQ ID NO: 82637 - RNA, 32 nt, Human
cacuuggaggaaaguugcagguggguugggca

SEQ ID NO: 82638 - RNA, 32 nt, Human
cacuuggaguaacaggcuuauuccacuuucca

SEQ ID NO: 82639 - RNA, 32 nt, Human
cacuuggauacugauuugaacaauguagaagu

SEQ ID NO: 82640 - RNA, 32 nt, Human
cacuuggcacauuauaacuaaaggaauccccu

SEQ ID NO: 82641 - RNA, 32 nt, Human
cacuuggcagaaacgugaugugucccacaaac

SEQ ID NO: 82642 - RNA, 32 nt, Human
cacuuggcaggcaggaggugcggucuccagag

SEQ ID NO: 82643 - RNA, 20 nt, Human
cacuuggcaugaagccucca

SEQ ID NO: 82644 - RNA, 32 nt, Human
cacuuggccacuugggguaaagccagugccag

SEQ ID NO: 82645 - RNA, 19 nt, Human
cacuuggccaucugcugaa

SEQ ID NO: 82646 - RNA, 32 nt, Human
cacuuggcccaggauguugaaagggugcaaau

SEQ ID NO: 82647 - RNA, 19 nt, Human
cacuuggccucaugcugga

SEQ ID NO: 82648 - RNA, 17 nt, Human
cacuuggccucccugag

SEQ ID NO: 82649 - RNA, 17 nt, Human
cacuuggccuccuugag

SEQ ID NO: 82650 - RNA, 18 nt, Human
cacuuggccuugcugcug

SEQ ID NO: 82651 - RNA, 18 nt, Human
cacuuggccuuucccugc

SEQ ID NO: 82652 - RNA, 19 nt, Human
cacuuggcgcccccuccca

SEQ ID NO: 82653 - RNA, 32 nt, Human
cacuuggcuaauucuucuccuccuucacauca

SEQ ID NO: 82654 - RNA, 18 nt, Human
cacuuggcuacaacugag

SEQ ID NO: 82655 - RNA, 32 nt, Human
cacuuggcuagaguucagagacaggaagugau

SEQ ID NO: 82656 - RNA, 32 nt, Human
cacuuggcucacugcagccucaacuucuuguc

SEQ ID NO: 82657 - RNA, 17 nt, Human
cacuuggcuccugugag

SEQ ID NO: 82658 - RNA, 18 nt, Human
cacuuggcuccuuaggaa

SEQ ID NO: 82659 - RNA, 19 nt, Human
cacuuggcucucucaugag

SEQ ID NO: 82660 - RNA, 32 nt, Human
cacuuggcucugaaccuacagucucaaagauu

SEQ ID NO: 82661 - RNA, 19 nt, Human
cacuuggcuggacaggaag

SEQ ID NO: 82662 - RNA, 32 nt, Human
cacuuggcugucaggcuuucugugcauguacu

SEQ ID NO: 82663 - RNA, 19 nt, Human
cacuuggcugugcuaugaa

SEQ ID NO: 82664 - RNA, 18 nt, Human
cacuuggcuucgccugga

SEQ ID NO: 82665 - RNA, 18 nt, Human
cacuuggcuugcagugag

SEQ ID NO: 82666 - RNA, 20 nt, Human
cacuuggcuuucaucaugaa

SEQ ID NO: 82667 - RNA, 20 nt, Human
cacuuggcuuuccuccugag

SEQ ID NO: 82668 - RNA, 18 nt, Human
cacuugggaaaugaagua

SEQ ID NO: 82669 - RNA, 32 nt, Human
cacuugggagcccugggggccucugcccuuuu

SEQ ID NO: 82670 - RNA, 32 nt, Human
cacuugggagcuuguuagaaaggcagcuucuc

SEQ ID NO: 82671 - RNA, 32 nt, Human
cacuugggaggcugaggcaggagaaucgcuug

SEQ ID NO: 82672 - RNA, 32 nt, Human
cacuugggaggcugaggcaggagaauugcuug

SEQ ID NO: 82673 - RNA, 32 nt, Human
cacuugggcccuccucugggagccgcacccac

SEQ ID NO: 82674 - RNA, 32 nt, Human
cacuugggcgcucugcccucccuggccucacg

SEQ ID NO: 82675 - RNA, 32 nt, Human
cacuuggggaagcugaggugggcagaucaguu

SEQ ID NO: 82676 - RNA, 32 nt, Human
cacuuggggagaacuaguuaggaggauggccu

SEQ ID NO: 82677 - RNA, 32 nt, Human
cacuuggggaggacaaugugggguggaucacg

SEQ ID NO: 82678 - RNA, 32 nt, Human
cacuuggggaggccaaggugggcagauugcuu

SEQ ID NO: 82679 - RNA, 32 nt, Human
cacuuggggaggccgaggcgggcagaucacga

SEQ ID NO: 82680 - RNA, 32 nt, Human
cacuuggggaggccgaggcggguggaucagga

SEQ ID NO: 82681 - RNA, 32 nt, Human
cacuuggggaggcugaggcgggcagaucacaa

SEQ ID NO: 82682 - RNA, 32 nt, Human
cacuuggggaggcugaggcgggcagaucacuu

SEQ ID NO: 82683 - RNA, 32 nt, Human
cacuugggguagaaaggcuuccccuacccugg

SEQ ID NO: 82684 - RNA, 32 nt, Human
cacuugguaacaggcauccuugccaagccucc

SEQ ID NO: 82685 - RNA, 32 nt, Human
cacuuggucaaggaggggucuaggagcucugu

SEQ ID NO: 82686 - RNA, 17 nt, Human
cacuuggucccuuugaa

SEQ ID NO: 82687 - RNA, 32 nt, Human
cacuuggucucuuaucuucagugagaagguga

SEQ ID NO: 82688 - RNA, 32 nt, Human
cacuuggugaugucuacuggguggaugguugu

SEQ ID NO: 82689 - RNA, 32 nt, Human
cacuuggugccugggguaguucuguucugugg

SEQ ID NO: 82690 - RNA, 32 nt, Human
cacuuggugcuccugcccacaccagccacuuu

SEQ ID NO: 82691 - RNA, 19 nt, Human
cacuuggugggaccaugaa

SEQ ID NO: 82692 - RNA, 32 nt, Human
cacuuggugggcuugggguugguucugggugg

SEQ ID NO: 82693 - RNA, 28 nt, Human
cacuugguguuucuaccacccccugcca

SEQ ID NO: 82694 - RNA, 32 nt, Human
cacuugguuccauccacugccucccagcaccu

SEQ ID NO: 82695 - RNA, 32 nt, Human
cacuugguuugucaucaggaacugagcagguc

SEQ ID NO: 82696 - RNA, 32 nt, Human
cacuuguaaagauuacuccaacccaguuuuua

SEQ ID NO: 82697 - RNA, 32 nt, Human
cacuuguaauccuagcacuuggaaaggcugag

SEQ ID NO: 82698 - RNA, 32 nt, Human
cacuuguauaaauacauggauauuuuuaugua

SEQ ID NO: 82699 - RNA, 32 nt, Human
cacuuguaucaacuuuacugccuuugucggca

SEQ ID NO: 82700 - RNA, 19 nt, Human
cacuugucaaaucauugaa

SEQ ID NO: 82701 - RNA, 32 nt, Human
cacuugucacccaggcuggagugcaauggugu

SEQ ID NO: 82702 - RNA, 32 nt, Human
cacuugucacccaggcuggagugcaguggcuc

SEQ ID NO: 82703 - RNA, 31 nt, Human
cacuugucacuuuucuucugugcugggaaaa

SEQ ID NO: 82704 - RNA, 20 nt, Human
cacuugucagggcacagggg

SEQ ID NO: 82705 - RNA, 32 nt, Human
cacuugucauuguuaccagcagucuccaaacu

SEQ ID NO: 82706 - RNA, 32 nt, Human
cacuugucccacgucaccauuucaucucauug

SEQ ID NO: 82707 - RNA, 32 nt, Human
cacuugucccucuccagcaagaggcuagcacu

SEQ ID NO: 82708 - RNA, 32 nt, Human
cacuugucucaugucugugaaacugguacaac

SEQ ID NO: 82709 - RNA, 32 nt, Human
cacuugucucugagagagacagaaguuagaaa

SEQ ID NO: 82710 - RNA, 32 nt, Human
cacuugucugugucugggaagggauggccaag

SEQ ID NO: 82711 - RNA, 32 nt, Human
cacuugucuuccuuaauuuugcccuaaaagca

SEQ ID NO: 82712 - RNA, 32 nt, Human
cacuugucuucuagaggucagaauuccauaau

SEQ ID NO: 82713 - RNA, 32 nt, Human
cacuugugaauuccuugaaccugggcauugca

SEQ ID NO: 82714 - RNA, 32 nt, Human
cacuugugaccagcuugcugaccgccaguccc

SEQ ID NO: 82715 - RNA, 32 nt, Human
cacuugugagcugacccccaggaacagcuugg

SEQ ID NO: 82716 - RNA, 32 nt, Human
cacuugugaguguguguggauuggcagggggu

SEQ ID NO: 82717 - RNA, 22 nt, Human
cacuuguggagcgccagcucug

SEQ ID NO: 82718 - RNA, 32 nt, Human
cacuuguggccaaauuauacuugacuguuaug

SEQ ID NO: 82719 - RNA, 32 nt, Human
cacuuguggguacucauuuucugccaguggga

SEQ ID NO: 82720 - RNA, 32 nt, Human
cacuuguugacugcuacauuuccccagccugg

SEQ ID NO: 82721 - RNA, 32 nt, Human
cacuuguugcccaggcuggagugcaaugguac

SEQ ID NO: 82722 - RNA, 32 nt, Human
cacuuguuucuccugcaccccagccugucacg

SEQ ID NO: 82723 - RNA, 32 nt, Human
cacuuguuugauaccuuuuucaugacagucuc

SEQ ID NO: 82724 - RNA, 32 nt, Human
cacuuguuuggcacucagcccagggccuggau

SEQ ID NO: 82725 - RNA, 32 nt, Human
cacuuguuuuaacuauuuauuuugccauguuu

SEQ ID NO: 82726 - RNA, 32 nt, Human
cacuuguuuuugauuuuacaggcucauaggcg

SEQ ID NO: 82727 - RNA, 32 nt, Human
cacuuuaaaacacacacauacacacacaaaac

SEQ ID NO: 82728 - RNA, 32 nt, Human
cacuuuaaaccugaacucuuuuaucgguaauu

SEQ ID NO: 82729 - RNA, 32 nt, Human
cacuuuaagaggccgaggcgggcagaucaccu

SEQ ID NO: 82730 - RNA, 32 nt, Human
cacuuuaauuuccugaaauaaauuuaaggaaa

SEQ ID NO: 82731 - RNA, 32 nt, Human
cacuuuacguuugaauuucugagcuaaagagu

SEQ ID NO: 82732 - RNA, 32 nt, Human
cacuuuacucuucauuugucaccaucuuuucc

SEQ ID NO: 82733 - RNA, 32 nt, Human
cacuuuagccugggcaacagaucaagacccug

SEQ ID NO: 82734 - RNA, 32 nt, Human
cacuuuagccugggcgacaagagcaagacucc

SEQ ID NO: 82735 - RNA, 32 nt, Human
cacuuuagccugggcgaccgagacuccgucuc

SEQ ID NO: 82736 - RNA, 32 nt, Human
cacuuuagccugggugaaaaagugagacccua

SEQ ID NO: 82737 - RNA, 32 nt, Human
cacuuuagccugggugacagagcgagacucug

SEQ ID NO: 82738 - RNA, 32 nt, Human
cacuuuaggaaacuagaaaaagaagagcaaau

SEQ ID NO: 82739 - RNA, 32 nt, Human
cacuuuaggaagggagagacgucguccuguuu

SEQ ID NO: 82740 - RNA, 32 nt, Human
cacuuuaggagaccaaggcgggcagaucacuu

SEQ ID NO: 82741 - RNA, 32 nt, Human
cacuuuaggaggccaaggagggcagaucaccu

SEQ ID NO: 82742 - RNA, 32 nt, Human
cacuuuaggaggccgaggcggguggaucauga

SEQ ID NO: 82743 - RNA, 32 nt, Human
cacuuuaggaggucaaggcaggaagaucccug

SEQ ID NO: 82744 - RNA, 32 nt, Human
cacuuuaggaggucaaggugggcagaucauga

SEQ ID NO: 82745 - RNA, 32 nt, Human
cacuuuaggaguccaaggcgggcggaucacuu

SEQ ID NO: 82746 - RNA, 19 nt, Human
cacuuuagguaucauugaa

SEQ ID NO: 82747 - RNA, 32 nt, Human
cacuuuagucugggugacagagcaagacccug

SEQ ID NO: 82748 - RNA, 32 nt, Human
cacuuuaucccaauuucuugauacuuuuccuu

SEQ ID NO: 82749 - RNA, 32 nt, Human
cacuuuauccuucacaaacauuucccccaaua

SEQ ID NO: 82750 - RNA, 32 nt, Human
cacuuucacagaccuaaucuuuguuugcaaac

SEQ ID NO: 82751 - RNA, 32 nt, Human
cacuuucacccagaaccaaugcgguguuucuu

SEQ ID NO: 82752 - RNA, 32 nt, Human
cacuuucaccuuuacugauuuccagaggaaag

SEQ ID NO: 82753 - RNA, 32 nt, Human
cacuuucacuuguucauuaucauuccaauuuu

SEQ ID NO: 82754 - RNA, 32 nt, Human
cacuuucagaggcuggggugggcagauugcuu

SEQ ID NO: 82755 - RNA, 32 nt, Human
cacuuucagccuucaaacuguguugaaugaaa

SEQ ID NO: 82756 - RNA, 32 nt, Human
cacuuucaggaagucaaccaagacugaggaug

SEQ ID NO: 82757 - RNA, 32 nt, Human
cacuuucauuguauuucauugaaagugcuuaa

SEQ ID NO: 82758 - RNA, 32 nt, Human
cacuuuccagauugaaggauuaaucaccagaa

SEQ ID NO: 82759 - RNA, 32 nt, Human
cacuuuccagcaccugaaagcuggggccucag

SEQ ID NO: 82760 - RNA, 32 nt, Human
cacuuuccaggugucagcaggugugaucaggg

SEQ ID NO: 82761 - RNA, 32 nt, Human
cacuuuccaucauggccugaacccuggaggaa

SEQ ID NO: 82762 - RNA, 32 nt, Human
cacuuuccauuuucucuuucaccucauuuugc

SEQ ID NO: 82763 - RNA, 32 nt, Human
cacuuucccuuagccccucugcuggguagaga

SEQ ID NO: 82764 - RNA, 32 nt, Human
cacuuuccuauauaccacaccucccuguccac

SEQ ID NO: 82765 - RNA, 32 nt, Human
cacuuuccuccaccucccacccugacccccuu

SEQ ID NO: 82766 - RNA, 32 nt, Human
cacuuuccuccacuuagcaccauaggcaaggg

SEQ ID NO: 82767 - RNA, 32 nt, Human
cacuuuccugaucauggcacacugccuacgcu

SEQ ID NO: 82768 - RNA, 32 nt, Human
cacuuuccugggucuugugcugugccuuuccu

SEQ ID NO: 82769 - RNA, 32 nt, Human
cacuuuccuucaugaacaucccccucccaaca

SEQ ID NO: 82770 - RNA, 32 nt, Human
cacuuuccuuuucccuccaccaugaagauggg

SEQ ID NO: 82771 - RNA, 32 nt, Human
cacuuucggaagcugaggugggcagauagcuu

SEQ ID NO: 82772 - RNA, 32 nt, Human
cacuuucggccuuccuucuucuccccuuccgc

SEQ ID NO: 82773 - RNA, 32 nt, Human
cacuuucuaacaucaaaugacucucaucauca

SEQ ID NO: 82774 - RNA, 32 nt, Human
cacuuucuagauauuucccccuugcuggagaa

SEQ ID NO: 82775 - RNA, 32 nt, Human
cacuuucuaguugcuuucauccuccuuuuguu

SEQ ID NO: 82776 - RNA, 32 nt, Human
cacuuucuccaauacuuguauuuuaugcuaca

SEQ ID NO: 82777 - RNA, 32 nt, Human
cacuuucuccaccuccugcagccucccuguug

SEQ ID NO: 82778 - RNA, 32 nt, Human
cacuuucucccaggcugagggcggguguucug

SEQ ID NO: 82779 - RNA, 32 nt, Human
cacuuucucccuguuugcuggcccagacaggc

SEQ ID NO: 82780 - RNA, 32 nt, Human
cacuuucuccugccuuccuuguggcugucagc

SEQ ID NO: 82781 - RNA, 32 nt, Human
cacuuucugacuccagccuugccagccugacu

SEQ ID NO: 82782 - RNA, 32 nt, Human
cacuuucugacugcaacuucugucccuuguuu

SEQ ID NO: 82783 - RNA, 32 nt, Human
cacuuucugcauuccaaacagcauccuaccug

SEQ ID NO: 82784 - RNA, 32 nt, Human
cacuuucuggucagacaccuuuagguugcucu

SEQ ID NO: 82785 - RNA, 32 nt, Human
cacuuucuuauuuucugacacaauaagauauu

SEQ ID NO: 82786 - RNA, 32 nt, Human
cacuuucuucaucucugcuccaagcagcagcg

SEQ ID NO: 82787 - RNA, 32 nt, Human
cacuuucuuuccuauuccccuugccugaaucu

SEQ ID NO: 82788 - RNA, 32 nt, Human
cacuuucuuuuguguuuacaucaugccagggg

SEQ ID NO: 82789 - RNA, 32 nt, Human
cacuuugaaaugcagaaauacaggcauaauac

SEQ ID NO: 82790 - RNA, 32 nt, Human
cacuuugacacccaggcuggagugcaguggug

SEQ ID NO: 82791 - RNA, 32 nt, Human
cacuuugacuucugacagcucuaccucaagcc

SEQ ID NO: 82792 - RNA, 32 nt, Human
cacuuugagacuuuggcaacuccugggccaca

SEQ ID NO: 82793 - RNA, 32 nt, Human
cacuuugagagaccgaggcgggcggaucacga

SEQ ID NO: 82794 - RNA, 32 nt, Human
cacuuugagaggcagaggcaggaggaucagga

SEQ ID NO: 82795 - RNA, 32 nt, Human
cacuuugagaggccaaggugggaggaucacuu

SEQ ID NO: 82796 - RNA, 32 nt, Human
cacuuugagaggccaaggugggcagaucacau

SEQ ID NO: 82797 - RNA, 32 nt, Human
cacuuugagaggccgaggcgggugggucaccu

SEQ ID NO: 82798 - RNA, 32 nt, Human
cacuuugagaggccgaggugggcagaucgccu

SEQ ID NO: 82799 - RNA, 32 nt, Human
cacuuugagaggcugaggcgggaggaucgcuu

SEQ ID NO: 82800 - RNA, 32 nt, Human
cacuuugagaggcugaggcgggcggaucaccu

SEQ ID NO: 82801 - RNA, 32 nt, Human
cacuuugagaggcugaggcgggcggaucacga

SEQ ID NO: 82802 - RNA, 32 nt, Human
cacuuugagaggcugaggcggguggaucaccu

SEQ ID NO: 82803 - RNA, 32 nt, Human
cacuuugagaggcugaggcggguggauggcuu

SEQ ID NO: 82804 - RNA, 32 nt, Human
cacuuugagaucugggcaccugcuggaaccug

SEQ ID NO: 82805 - RNA, 32 nt, Human
cacuuugagccuuuggaaguuaagguuuccuc

SEQ ID NO: 82806 - RNA, 32 nt, Human
cacuuugaggcugaggccauggcaggacagcu

SEQ ID NO: 82807 - RNA, 32 nt, Human
cacuuugcaaaagccucugcccuuccaucucg

SEQ ID NO: 82808 - RNA, 32 nt, Human
cacuuugcaaaccugcaccuugcacuuuuggg

SEQ ID NO: 82809 - RNA, 32 nt, Human
cacuuugcaauaaauaguccaguguuuccuuc

SEQ ID NO: 82810 - RNA, 32 nt, Human
cacuuugcauuauccauggucucuuaccagcg

SEQ ID NO: 82811 - RNA, 32 nt, Human
cacuuugccacagaggccucaggcuucuccaa

SEQ ID NO: 82812 - RNA, 32 nt, Human
cacuuugccaucauguggccucuggacacugu

SEQ ID NO: 82813 - RNA, 32 nt, Human
cacuuugccccuuccugccccaaaaggcuuuc

SEQ ID NO: 82814 - RNA, 32 nt, Human
cacuuugcccugcccucugccuccagggcucc

SEQ ID NO: 82815 - RNA, 24 nt, Human
cacuuugccgcaggccgccuggca

SEQ ID NO: 82816 - RNA, 32 nt, Human
cacuuugcgaggccaaggugggaggauugcuu

SEQ ID NO: 82817 - RNA, 32 nt, Human
cacuuugcgaggccgaggugggcagaucacuu

SEQ ID NO: 82818 - RNA, 32 nt, Human
cacuuugcucaaccuaaaugaauucaagguag

SEQ ID NO: 82819 - RNA, 32 nt, Human
cacuuugcucagcacgucuucccaggccuccc

SEQ ID NO: 82820 - RNA, 32 nt, Human
cacuuugcucccaggcuggaaugcaguggcua

SEQ ID NO: 82821 - RNA, 32 nt, Human
cacuuugcuuagcuauaaagugccaucagugg

SEQ ID NO: 82822 - RNA, 32 nt, Human
cacuuugcuucccaggcuggagugcaguggug

SEQ ID NO: 82823 - RNA, 32 nt, Human
cacuuugcuuuaauuucucugagcugcaagaa

SEQ ID NO: 82824 - RNA, 32 nt, Human
cacuuuggaagaccaaggcgggcagauugccu

SEQ ID NO: 82825 - RNA, 32 nt, Human
cacuuuggaaggccaaggcgggcggaucacga

SEQ ID NO: 82826 - RNA, 32 nt, Human
cacuuuggaaggccaaggugggaggaucgcuu

SEQ ID NO: 82827 - RNA, 32 nt, Human
cacuuuggaaggccgaggcgggcagaucacua

SEQ ID NO: 82828 - RNA, 32 nt, Human
cacuuuggaaggccgaggcgggcggaucauuu

SEQ ID NO: 82829 - RNA, 32 nt, Human
cacuuuggaaggccgaggcgggugggucaccu

SEQ ID NO: 82830 - RNA, 32 nt, Human
cacuuuggaaggccgaggugggcagaucaucu

SEQ ID NO: 82831 - RNA, 32 nt, Human
cacuuuggaaggcugaggcgggaggaucagua

SEQ ID NO: 82832 - RNA, 32 nt, Human
cacuuuggaaggcugaggcgggcagaucaucu

SEQ ID NO: 82833 - RNA, 32 nt, Human
cacuuuggaaggcugaggcgggcggaucaccu

SEQ ID NO: 82834 - RNA, 32 nt, Human
cacuuuggaaggcugaggcgggcggaucauga

SEQ ID NO: 82835 - RNA, 32 nt, Human
cacuuuggaaggcugaggcggguggaucacaa

SEQ ID NO: 82836 - RNA, 32 nt, Human
cacuuuggacugcugcuucucuuagcuccucu

SEQ ID NO: 82837 - RNA, 32 nt, Human
cacuuuggagccacugaagagccgacugugcc

SEQ ID NO: 82838 - RNA, 32 nt, Human
cacuuuggauucagguucuccacagcagucuu

SEQ ID NO: 82839 - RNA, 31 nt, Human
cacuuuggcacgauguuagccaacagcuccu

SEQ ID NO: 82840 - RNA, 32 nt, Human
cacuuuggcaggccgaggcggguggaucacuu

SEQ ID NO: 82841 - RNA, 32 nt, Human
cacuuugggaacaugucaaagcacacauugag

SEQ ID NO: 82842 - RNA, 32 nt, Human
cacuuugggaagcagagguggcaggaucauuc

SEQ ID NO: 82843 - RNA, 32 nt, Human
cacuuugggaagccaaggcgggcagaucauuu

SEQ ID NO: 82844 - RNA, 32 nt, Human
cacuuugggaagccaaggugggcagaucacga

SEQ ID NO: 82845 - RNA, 32 nt, Human
cacuuugggaagccgaggcgggcagaucaccu

SEQ ID NO: 82846 - RNA, 32 nt, Human
cacuuugggaagccgaggcgggcugaucgcuu

SEQ ID NO: 82847 - RNA, 32 nt, Human
cacuuugggaagccgaggcggguggaucacga

SEQ ID NO: 82848 - RNA, 32 nt, Human
cacuuugggaagccgaggugggcagaucacga

SEQ ID NO: 82849 - RNA, 32 nt, Human
cacuuugggaagccgaggugggcagaucauaa

SEQ ID NO: 82850 - RNA, 32 nt, Human
cacuuugggaagccgggguaggaggaucacca

SEQ ID NO: 82851 - RNA, 31 nt, Human
cacuuugggaagcugagauggguggaucacc

SEQ ID NO: 82852 - RNA, 32 nt, Human
cacuuugggaagcugaggugggcagauagcuu

SEQ ID NO: 82853 - RNA, 32 nt, Human
cacuuugggaagucaaggcagguggaucccuu

SEQ ID NO: 82854 - RNA, 32 nt, Human
cacuuugggagaccaaggcgggcggaucacuu

SEQ ID NO: 82855 - RNA, 32 nt, Human
cacuuugggagaccaaggugggaggaucacuu

SEQ ID NO: 82856 - RNA, 32 nt, Human
cacuuugggagaccaaggugggcagaucaccu

SEQ ID NO: 82857 - RNA, 32 nt, Human
cacuuugggagaccaaggugggcagaucacuu

SEQ ID NO: 82858 - RNA, 32 nt, Human
cacuuugggagaccgaggcgggcagauugccu

SEQ ID NO: 82859 - RNA, 32 nt, Human
cacuuugggagacugaagugggcagaucauuu

SEQ ID NO: 82860 - RNA, 32 nt, Human
cacuuugggagacugaggcgggcggaucauga

SEQ ID NO: 82861 - RNA, 32 nt, Human
cacuuugggagacugaggcggguggaucaccu

SEQ ID NO: 82862 - RNA, 32 nt, Human
cacuuugggagacugaggugggcagaucacuu

SEQ ID NO: 82863 - RNA, 32 nt, Human
cacuuugggagccccaggugggcagaucacga

SEQ ID NO: 82864 - RNA, 32 nt, Human
cacuuugggagcccgaggcgggcggaucacaa

SEQ ID NO: 82865 - RNA, 32 nt, Human
cacuuugggagcccgaggcggguggaucagcu

SEQ ID NO: 82866 - RNA, 32 nt, Human
cacuuugggagcccgaggugggcagaucacua

SEQ ID NO: 82867 - RNA, 32 nt, Human
cacuuugggaggacaagguggguggaucacuu

SEQ ID NO: 82868 - RNA, 32 nt, Human
cacuuugggaggacgaaacauguggaucaccu

SEQ ID NO: 82869 - RNA, 32 nt, Human
cacuuugggaggacgaagcgaguggaucacug

SEQ ID NO: 82870 - RNA, 32 nt, Human
cacuuugggaggacgaggcaggcggaucauga

SEQ ID NO: 82871 - RNA, 32 nt, Human
cacuuugggaggacgaggcauguggaucaccu

SEQ ID NO: 82872 - RNA, 32 nt, Human
cacuuugggaggaggccgagcugggcggaucg

SEQ ID NO: 82873 - RNA, 32 nt, Human
cacuuugggaggauagcuugaggccaagagau

SEQ ID NO: 82874 - RNA, 32 nt, Human
cacuuugggaggaucccuugagcccagguguu

SEQ ID NO: 82875 - RNA, 32 nt, Human
cacuuugggaggaugaggcggguggaucacau

SEQ ID NO: 82876 - RNA, 32 nt, Human
cacuuugggaggcaaaggcagguggaucaccu

SEQ ID NO: 82877 - RNA, 32 nt, Human
cacuuugggaggcaaaggcgggaggaucacuu

SEQ ID NO: 82878 - RNA, 32 nt, Human
cacuuugggaggcaaaggcgggcagaucaccu

SEQ ID NO: 82879 - RNA, 32 nt, Human
cacuuugggaggcaaaggcgggcggaucaccu

SEQ ID NO: 82880 - RNA, 32 nt, Human
cacuuugggaggcagagacagguggaucacga

SEQ ID NO: 82881 - RNA, 32 nt, Human
cacuuugggaggcagaggccgguggguugcuu

SEQ ID NO: 82882 - RNA, 32 nt, Human
cacuuugggaggcagaggcgggaggauugcuu

SEQ ID NO: 82883 - RNA, 32 nt, Human
cacuuugggaggcagaggcgggcagaucacuu

SEQ ID NO: 82884 - RNA, 32 nt, Human
cacuuugggaggcagaggcgggcggaucacuu

SEQ ID NO: 82885 - RNA, 32 nt, Human
cacuuugggaggcagaggugggaggauugcuu

SEQ ID NO: 82886 - RNA, 32 nt, Human
cacuuugggaggcagaggugggcagaucacuc

SEQ ID NO: 82887 - RNA, 32 nt, Human
cacuuugggaggccaagacgggcagaucacga

SEQ ID NO: 82888 - RNA, 31 nt, Human
cacuuugggaggccaagaugggaggagugcu

SEQ ID NO: 82889 - RNA, 31 nt, Human
cacuuugggaggccaagaugggaggaucgcu

SEQ ID NO: 82890 - RNA, 32 nt, Human
cacuuugggaggccaagaugggcagauugcuu

SEQ ID NO: 82891 - RNA, 31 nt, Human
cacuuugggaggccaagaugggcggaucacc

SEQ ID NO: 82892 - RNA, 31 nt, Human
cacuuugggaggccaagaugggcggaucacg

SEQ ID NO: 82893 - RNA, 31 nt, Human
cacuuugggaggccaagaugggcggaucaug

SEQ ID NO: 82894 - RNA, 31 nt, Human
cacuuugggaggccaagaugggcggauugcu

SEQ ID NO: 82895 - RNA, 31 nt, Human
cacuuugggaggccaagauggguggaucacc

SEQ ID NO: 82896 - RNA, 32 nt, Human
cacuuugggaggccaagcuugguggaucgcuu

SEQ ID NO: 82897 - RNA, 32 nt, Human
cacuuugggaggccaaggaaggaggacugcuu

SEQ ID NO: 82898 - RNA, 32 nt, Human
cacuuugggaggccaaggagggcagaucacuu

SEQ ID NO: 82899 - RNA, 32 nt, Human
cacuuugggaggccaaggagguaggaucgcuu

SEQ ID NO: 82900 - RNA, 32 nt, Human
cacuuugggaggccaaggcaggaggacugcuu

SEQ ID NO: 82901 - RNA, 32 nt, Human
cacuuugggaggccaaggcgggcagaccauga

SEQ ID NO: 82902 - RNA, 32 nt, Human
cacuuugggaggccaaggcgggcagaucaccu

SEQ ID NO: 82903 - RNA, 32 nt, Human
cacuuugggaggccaaggcgggcagaucacga

SEQ ID NO: 82904 - RNA, 32 nt, Human
cacuuugggaggccaaggcgggcagaucacuu

SEQ ID NO: 82905 - RNA, 27 nt, Human
cacuuugggaggccaaggcgggcggau

SEQ ID NO: 82906 - RNA, 32 nt, Human
cacuuugggaggccaaggcgggcggauaaccu

SEQ ID NO: 82907 - RNA, 32 nt, Human
cacuuugggaggccaaggcgggcggaucacaa

SEQ ID NO: 82908 - RNA, 32 nt, Human
cacuuugggaggccaaggcgggcggaucaccu

SEQ ID NO: 82909 - RNA, 32 nt, Human
cacuuugggaggccaaggcgggcggaucacga

SEQ ID NO: 82910 - RNA, 32 nt, Human
cacuuugggaggccaaggcgggcggaucacuu

SEQ ID NO: 82911 - RNA, 32 nt, Human
cacuuugggaggccaaggcgggcggaucauga

SEQ ID NO: 82912 - RNA, 32 nt, Human
cacuuugggaggccaaggcgggcggauuacuu

SEQ ID NO: 82913 - RNA, 32 nt, Human
cacuuugggaggccaaggcgggcggauugccu

SEQ ID NO: 82914 - RNA, 32 nt, Human
cacuuugggaggccaagguaggaggauggcuu

SEQ ID NO: 82915 - RNA, 32 nt, Human
cacuuugggaggccaagguaggaggauugcuu

SEQ ID NO: 82916 - RNA, 32 nt, Human
cacuuugggaggccaagguagguggauaccug

SEQ ID NO: 82917 - RNA, 32 nt, Human
cacuuugggaggccaaggugaguggaucaccu

SEQ ID NO: 82918 - RNA, 32 nt, Human
cacuuugggaggccaaggugggaagauugccu

SEQ ID NO: 82919 - RNA, 32 nt, Human
cacuuugggaggccaaggugggaggaccaccu

SEQ ID NO: 82920 - RNA, 32 nt, Human
cacuuugggaggccaaggugggaggaucaauu

SEQ ID NO: 82921 - RNA, 32 nt, Human
cacuuugggaggccaaggugggaggaucaccu

SEQ ID NO: 82922 - RNA, 32 nt, Human
cacuuugggaggccaaggugggaggaucacug

SEQ ID NO: 82923 - RNA, 32 nt, Human
cacuuugggaggccaaggugggaggaucacuu

SEQ ID NO: 82924 - RNA, 32 nt, Human
cacuuugggaggccaaggugggaggaucaguu

SEQ ID NO: 82925 - RNA, 32 nt, Human
cacuuugggaggccaaggugggaggaucguuu

SEQ ID NO: 82926 - RNA, 32 nt, Human
cacuuugggaggccaaggugggaggauuacuu

SEQ ID NO: 82927 - RNA, 32 nt, Human
cacuuugggaggccaaggugggaggauugcuu

SEQ ID NO: 82928 - RNA, 32 nt, Human
cacuuugggaggccaaggugggcagaucacga

SEQ ID NO: 82929 - RNA, 32 nt, Human
cacuuugggaggccaaggugggcagaucacug

SEQ ID NO: 82930 - RNA, 32 nt, Human
cacuuugggaggccaaggugggcagaucacuu

SEQ ID NO: 82931 - RNA, 32 nt, Human
cacuuugggaggccaaggugggcagaucagga

SEQ ID NO: 82932 - RNA, 32 nt, Human
cacuuugggaggccaaggugggcagaucauga

SEQ ID NO: 82933 - RNA, 32 nt, Human
cacuuugggaggccaaggugggcagaucgccu

SEQ ID NO: 82934 - RNA, 32 nt, Human
cacuuugggaggccaaggugggcagaucucaa

SEQ ID NO: 82935 - RNA, 31 nt, Human
cacuuugggaggccaaggugggugaaucacc

SEQ ID NO: 82936 - RNA, 32 nt, Human
cacuuugggaggccagggugggcagaucauga

SEQ ID NO: 82937 - RNA, 29 nt, Human
cacuuugggaggcccaggcgggcggauca

SEQ ID NO: 82938 - RNA, 32 nt, Human
cacuuugggaggcccaggcgggcggaucacaa

SEQ ID NO: 82939 - RNA, 32 nt, Human
cacuuugggaggcccaggcgggcggaucacga

SEQ ID NO: 82940 - RNA, 32 nt, Human
cacuuugggaggcccaggucaggggaucauua

SEQ ID NO: 82941 - RNA, 32 nt, Human
cacuuugggaggcccagguggggcgaucaccu

SEQ ID NO: 82942 - RNA, 32 nt, Human
cacuuugggaggccgaagugggcagaucacuu

SEQ ID NO: 82943 - RNA, 32 nt, Human
cacuuugggaggccgagacgggcagaucacga

SEQ ID NO: 82944 - RNA, 31 nt, Human
cacuuugggaggccgagaugggugaaucaug

SEQ ID NO: 82945 - RNA, 32 nt, Human
cacuuugggaggccgagaugggugaaucauga

SEQ ID NO: 82946 - RNA, 31 nt, Human
cacuuugggaggccgagauggguggaucacc

SEQ ID NO: 82947 - RNA, 31 nt, Human
cacuuugggaggccgagauggguggaucaug

SEQ ID NO: 82948 - RNA, 32 nt, Human
cacuuugggaggccgagauggguggaucauga

SEQ ID NO: 82949 - RNA, 32 nt, Human
cacuuugggaggccgaggagggcagagaucac

SEQ ID NO: 82950 - RNA, 32 nt, Human
cacuuugggaggccgaggagggcagaucacuu

SEQ ID NO: 82951 - RNA, 32 nt, Human
cacuuugggaggccgaggagggcagaucaucu

SEQ ID NO: 82952 - RNA, 32 nt, Human
cacuuugggaggccgaggagggugaaucauga

SEQ ID NO: 82953 - RNA, 32 nt, Human
cacuuugggaggccgaggcaggagaaucgcuu

SEQ ID NO: 82954 - RNA, 32 nt, Human
cacuuugggaggccgaggcaggaggaucacuu

SEQ ID NO: 82955 - RNA, 32 nt, Human
cacuuugggaggccgaggcaggaggaucgcuu

SEQ ID NO: 82956 - RNA, 32 nt, Human
cacuuugggaggccgaggcaggcugaucacga

SEQ ID NO: 82957 - RNA, 32 nt, Human
cacuuugggaggccgaggcagguggaucaaga

SEQ ID NO: 82958 - RNA, 32 nt, Human
cacuuugggaggccgaggcagguggaucacaa

SEQ ID NO: 82959 - RNA, 32 nt, Human
cacuuugggaggccgaggcagguggaucaccu

SEQ ID NO: 82960 - RNA, 32 nt, Human
cacuuugggaggccgaggcagguggaucacga

SEQ ID NO: 82961 - RNA, 32 nt, Human
cacuuugggaggccgaggcagguggaucacgu

SEQ ID NO: 82962 - RNA, 32 nt, Human
cacuuugggaggccgaggcagguggaucacuc

SEQ ID NO: 82963 - RNA, 32 nt, Human
cacuuugggaggccgaggcagguggaucacug

SEQ ID NO: 82964 - RNA, 32 nt, Human
cacuuugggaggccgaggcagguggaucacuu

SEQ ID NO: 82965 - RNA, 32 nt, Human
cacuuugggaggccgaggcagguggaucauag

SEQ ID NO: 82966 - RNA, 32 nt, Human
cacuuugggaggccgaggcagguggaucauga

SEQ ID NO: 82967 - RNA, 32 nt, Human
cacuuugggaggccgaggcagguggaucauuu

SEQ ID NO: 82968 - RNA, 32 nt, Human
cacuuugggaggccgaggcagguggaucgcuu

SEQ ID NO: 82969 - RNA, 32 nt, Human
cacuuugggaggccgaggcagguggaugacaa

SEQ ID NO: 82970 - RNA, 32 nt, Human
cacuuugggaggccgaggcagguggauugccu

SEQ ID NO: 82971 - RNA, 32 nt, Human
cacuuugggaggccgaggcaggugguucaucu

SEQ ID NO: 82972 - RNA, 32 nt, Human
cacuuugggaggccgaggcaguuggauuacuu

SEQ ID NO: 82973 - RNA, 32 nt, Human
cacuuugggaggccgaggccaguggaucaccu

SEQ ID NO: 82974 - RNA, 32 nt, Human
cacuuugggaggccgaggccggugauucacaa

SEQ ID NO: 82975 - RNA, 32 nt, Human
cacuuugggaggccgaggccgguggaucacuu

SEQ ID NO: 82976 - RNA, 32 nt, Human
cacuuugggaggccgaggcgaguggaucacga

SEQ ID NO: 82977 - RNA, 32 nt, Human
cacuuugggaggccgaggcgaguggauuuccu

SEQ ID NO: 82978 - RNA, 32 nt, Human
cacuuugggaggccgaggcggaaggaaggcuu

SEQ ID NO: 82979 - RNA, 32 nt, Human
cacuuugggaggccgaggcggacagaucacga

SEQ ID NO: 82980 - RNA, 32 nt, Human
cacuuugggaggccgaggcggacggaucacga

SEQ ID NO: 82981 - RNA, 32 nt, Human
cacuuugggaggccgaggcggccagaucacgg

SEQ ID NO: 82982 - RNA, 32 nt, Human
cacuuugggaggccgaggcggcugaaucacuu

SEQ ID NO: 82983 - RNA, 32 nt, Human
cacuuugggaggccgaggcgggaggaucaccu

SEQ ID NO: 82984 - RNA, 32 nt, Human
cacuuugggaggccgaggcgggaggaucacuu

SEQ ID NO: 82985 - RNA, 32 nt, Human
cacuuugggaggccgaggcgggcagaucacaa

SEQ ID NO: 82986 - RNA, 32 nt, Human
cacuuugggaggccgaggcgggcagaucaccu

SEQ ID NO: 82987 - RNA, 32 nt, Human
cacuuugggaggccgaggcgggcagaucacga

SEQ ID NO: 82988 - RNA, 32 nt, Human
cacuuugggaggccgaggcgggcagaucacuu

SEQ ID NO: 82989 - RNA, 32 nt, Human
cacuuugggaggccgaggcgggcagaucauga

SEQ ID NO: 82990 - RNA, 32 nt, Human
cacuuugggaggccgaggcgggcagaugaccu

SEQ ID NO: 82991 - RNA, 32 nt, Human
cacuuugggaggccgaggcgggccgaucacga

SEQ ID NO: 82992 - RNA, 32 nt, Human
cacuuugggaggccgaggcgggcggaucaacu

SEQ ID NO: 82993 - RNA, 32 nt, Human
cacuuugggaggccgaggcgggcggaucaaua

SEQ ID NO: 82994 - RNA, 32 nt, Human
cacuuugggaggccgaggcgggcggaucacaa

SEQ ID NO: 82995 - RNA, 32 nt, Human
cacuuugggaggccgaggcgggcggaucacac

SEQ ID NO: 82996 - RNA, 32 nt, Human
cacuuugggaggccgaggcgggcggaucaccg

SEQ ID NO: 82997 - RNA, 32 nt, Human
cacuuugggaggccgaggcgggcggaucaccu

SEQ ID NO: 82998 - RNA, 32 nt, Human
cacuuugggaggccgaggcgggcggaucacga

SEQ ID NO: 82999 - RNA, 32 nt, Human
cacuuugggaggccgaggcgggcggaucacua

SEQ ID NO: 83000 - RNA, 32 nt, Human
cacuuugggaggccgaggcgggcggaucacuu

SEQ ID NO: 83001 - RNA, 32 nt, Human
cacuuugggaggccgaggcgggcggaucagac

SEQ ID NO: 83002 - RNA, 32 nt, Human
cacuuugggaggccgaggcgggcggaucauga

SEQ ID NO: 83003 - RNA, 32 nt, Human
cacuuugggaggccgaggcgggcggaucgcuu

SEQ ID NO: 83004 - RNA, 32 nt, Human
cacuuugggaggccgaggcgggcggaucucga

SEQ ID NO: 83005 - RNA, 32 nt, Human
cacuuugggaggccgaggcgggcggaugaccu

SEQ ID NO: 83006 - RNA, 32 nt, Human
cacuuugggaggccgaggcgggcggaugaguu

SEQ ID NO: 83007 - RNA, 32 nt, Human
cacuuugggaggccgaggcgggcggcucacga

SEQ ID NO: 83008 - RNA, 32 nt, Human
cacuuugggaggccgaggcgggcgggucacga

SEQ ID NO: 83009 - RNA, 32 nt, Human
cacuuugggaggccgaggcggggagaucaccu

SEQ ID NO: 83010 - RNA, 32 nt, Human
cacuuugggaggccgaggcgggugaaucauga

SEQ ID NO: 83011 - RNA, 32 nt, Human
cacuuugggaggccgaggcgggugaucacuug

SEQ ID NO: 83012 - RNA, 32 nt, Human
cacuuugggaggccgaggcggguggaccaccu

SEQ ID NO: 83013 - RNA, 32 nt, Human
cacuuugggaggccgaggcggguggaucacaa

SEQ ID NO: 83014 - RNA, 32 nt, Human
cacuuugggaggccgaggcggguggaucaccu

SEQ ID NO: 83015 - RNA, 32 nt, Human
cacuuugggaggccgaggcggguggaucacga

SEQ ID NO: 83016 - RNA, 32 nt, Human
cacuuugggaggccgaggcggguggaucacuu

SEQ ID NO: 83017 - RNA, 32 nt, Human
cacuuugggaggccgaggcggguggaucagaa

SEQ ID NO: 83018 - RNA, 32 nt, Human
cacuuugggaggccgaggcggguggaucauga

SEQ ID NO: 83019 - RNA, 32 nt, Human
cacuuugggaggccgaggcggguggaucaugu

SEQ ID NO: 83020 - RNA, 32 nt, Human
cacuuugggaggccgaggcggguggaucauuu

SEQ ID NO: 83021 - RNA, 32 nt, Human
cacuuugggaggccgaggcggguggguuacuu

SEQ ID NO: 83022 - RNA, 32 nt, Human
cacuuugggaggccgaggcggucggaucacga

SEQ ID NO: 83023 - RNA, 32 nt, Human
cacuuugggaggccgaggcugggggauugcuu

SEQ ID NO: 83024 - RNA, 32 nt, Human
cacuuugggaggccgaggggaguggaucaccu

SEQ ID NO: 83025 - RNA, 32 nt, Human
cacuuugggaggccgaggggaguggaucacuu

SEQ ID NO: 83026 - RNA, 32 nt, Human
cacuuugggaggccgaggucaggaguuggaga

SEQ ID NO: 83027 - RNA, 32 nt, Human
cacuuugggaggccgaggugaaaggaucacuu

SEQ ID NO: 83028 - RNA, 32 nt, Human
cacuuugggaggccgaggugaguggaucaccu

SEQ ID NO: 83029 - RNA, 32 nt, Human
cacuuugggaggccgaggugcauggaucacuu

SEQ ID NO: 83030 - RNA, 32 nt, Human
cacuuugggaggccgagguggauggaucacga

SEQ ID NO: 83031 - RNA, 32 nt, Human
cacuuugggaggccgaggugggaggaucacuu

SEQ ID NO: 83032 - RNA, 32 nt, Human
cacuuugggaggccgaggugggaggaucgcuu

SEQ ID NO: 83033 - RNA, 32 nt, Human
cacuuugggaggccgaggugggaggauugcuu

SEQ ID NO: 83034 - RNA, 32 nt, Human
cacuuugggaggccgaggugggcagaucacaa

SEQ ID NO: 83035 - RNA, 32 nt, Human
cacuuugggaggccgaggugggcagaucaccg

SEQ ID NO: 83036 - RNA, 32 nt, Human
cacuuugggaggccgaggugggcagaucaccu

SEQ ID NO: 83037 - RNA, 32 nt, Human
cacuuugggaggccgaggugggcagaucacga

SEQ ID NO: 83038 - RNA, 32 nt, Human
cacuuugggaggccgaggugggcagaucacuu

SEQ ID NO: 83039 - RNA, 32 nt, Human
cacuuugggaggccgaggugggcagaucagcu

SEQ ID NO: 83040 - RNA, 32 nt, Human
cacuuugggaggccgaggugggcagaucagga

SEQ ID NO: 83041 - RNA, 32 nt, Human
cacuuugggaggccgaggugggcagaucauga

SEQ ID NO: 83042 - RNA, 32 nt, Human
cacuuugggaggccgaggugggcagaucaugg

SEQ ID NO: 83043 - RNA, 32 nt, Human
cacuuugggaggccgaggugggcugaucacga

SEQ ID NO: 83044 - RNA, 31 nt, Human
cacuuugggaggccgaggugggugaaucacc

SEQ ID NO: 83045 - RNA, 32 nt, Human
cacuuugggaggccgaggugggugaaucacca

SEQ ID NO: 83046 - RNA, 32 nt, Human
cacuuugggaggccgagguggguggauggauc

SEQ ID NO: 83047 - RNA, 32 nt, Human
cacuuugggaggccgagguuggaggaucacuu

SEQ ID NO: 83048 - RNA, 32 nt, Human
cacuuugggaggccgaguugggggcgaucacc

SEQ ID NO: 83049 - RNA, 32 nt, Human
cacuuugggaggccgaugugggcagaucacaa

SEQ ID NO: 83050 - RNA, 32 nt, Human
cacuuugggaggccgugaugggcagaucacuu

SEQ ID NO: 83051 - RNA, 32 nt, Human
cacuuugggaggccuaggcgggcagaucaccu

SEQ ID NO: 83052 - RNA, 32 nt, Human
cacuuugggaggccuaggcgggcggaucacga

SEQ ID NO: 83053 - RNA, 32 nt, Human
cacuuugggaggccuaggugggcagaucauga

SEQ ID NO: 83054 - RNA, 32 nt, Human
cacuuugggaggcggaggcaggaggaucucuu

SEQ ID NO: 83055 - RNA, 32 nt, Human
cacuuugggaggcggaggcggguggauccauu

SEQ ID NO: 83056 - RNA, 32 nt, Human
cacuuugggaggcggaggugagcagaucaccu

SEQ ID NO: 83057 - RNA, 32 nt, Human
cacuuugggaggcuaaggugggcagaucacuu

SEQ ID NO: 83058 - RNA, 31 nt, Human
cacuuugggaggcuacgauggguggaucacc

SEQ ID NO: 83059 - RNA, 32 nt, Human
cacuuugggaggcuacggugggcagaucaucu

SEQ ID NO: 83060 - RNA, 32 nt, Human
cacuuugggaggcugaagggggcagauuagcu

SEQ ID NO: 83061 - RNA, 32 nt, Human
cacuuugggaggcugaaguaggaggaucgucu

SEQ ID NO: 83062 - RNA, 32 nt, Human
cacuuugggaggcugaagugggcagaucacga

SEQ ID NO: 83063 - RNA, 32 nt, Human
cacuuugggaggcugaagugggcagauuacuu

SEQ ID NO: 83064 - RNA, 32 nt, Human
cacuuugggaggcugacgugggcagaucauga

SEQ ID NO: 83065 - RNA, 32 nt, Human
cacuuugggaggcugagacgggcagaucaccu

SEQ ID NO: 83066 - RNA, 32 nt, Human
cacuuugggaggcugagaugggcagaucacuu

SEQ ID NO: 83067 - RNA, 31 nt, Human
cacuuugggaggcugagauggguggauugcu

SEQ ID NO: 83068 - RNA, 32 nt, Human
cacuuugggaggcugagauggguggauugcuu

SEQ ID NO: 83069 - RNA, 32 nt, Human
cacuuugggaggcugaggaggaaggauagcuu

SEQ ID NO: 83070 - RNA, 32 nt, Human
cacuuugggaggcugaggagggcagaucacuu

SEQ ID NO: 83071 - RNA, 32 nt, Human
cacuuugggaggcugaggcaaguggaucacuu

SEQ ID NO: 83072 - RNA, 32 nt, Human
cacuuugggaggcugaggcaggaagcacacug

SEQ ID NO: 83073 - RNA, 32 nt, Human
cacuuugggaggcugaggcaggagaaucacuu

SEQ ID NO: 83074 - RNA, 32 nt, Human
cacuuugggaggcugaggcaggaggacuguuu

SEQ ID NO: 83075 - RNA, 32 nt, Human
cacuuugggaggcugaggcaggaggaggauaa

SEQ ID NO: 83076 - RNA, 32 nt, Human
cacuuugggaggcugaggcaggaggauagcuu

SEQ ID NO: 83077 - RNA, 32 nt, Human
cacuuugggaggcugaggcaggaggaucacuu

SEQ ID NO: 83078 - RNA, 32 nt, Human
cacuuugggaggcugaggcaggaggauuguuu

SEQ ID NO: 83079 - RNA, 32 nt, Human
cacuuugggaggcugaggcaggcugaucacuu

SEQ ID NO: 83080 - RNA, 32 nt, Human
cacuuugggaggcugaggcaggugaaucacuu

SEQ ID NO: 83081 - RNA, 32 nt, Human
cacuuugggaggcugaggcagguggaucacaa

SEQ ID NO: 83082 - RNA, 32 nt, Human
cacuuugggaggcugaggcagguggaucaccu

SEQ ID NO: 83083 - RNA, 32 nt, Human
cacuuugggaggcugaggcagguggaucacga

SEQ ID NO: 83084 - RNA, 32 nt, Human
cacuuugggaggcugaggcagguggaucacug

SEQ ID NO: 83085 - RNA, 32 nt, Human
cacuuugggaggcugaggcagguggaucacuu

SEQ ID NO: 83086 - RNA, 32 nt, Human
cacuuugggaggcugaggcagguggaucgccu

SEQ ID NO: 83087 - RNA, 32 nt, Human
cacuuugggaggcugaggcagguggauugccu

SEQ ID NO: 83088 - RNA, 32 nt, Human
cacuuugggaggcugaggcagguggauugcgu

SEQ ID NO: 83089 - RNA, 32 nt, Human
cacuuugggaggcugaggcagguggauugcuu

SEQ ID NO: 83090 - RNA, 32 nt, Human
cacuuugggaggcugaggcagguggcucacuu

SEQ ID NO: 83091 - RNA, 32 nt, Human
cacuuugggaggcugaggcaggugguucacug

SEQ ID NO: 83092 - RNA, 32 nt, Human
cacuuugggaggcugaggcaguugagaccagg

SEQ ID NO: 83093 - RNA, 32 nt, Human
cacuuugggaggcugaggccgguggaucaccu

SEQ ID NO: 83094 - RNA, 32 nt, Human
cacuuugggaggcugaggcgaguggaucacaa

SEQ ID NO: 83095 - RNA, 32 nt, Human
cacuuugggaggcugaggcgcguggaucaccu

SEQ ID NO: 83096 - RNA, 32 nt, Human
cacuuugggaggcugaggcggccggaucacaa

SEQ ID NO: 83097 - RNA, 32 nt, Human
cacuuugggaggcugaggcgggaggaucaauu

SEQ ID NO: 83098 - RNA, 32 nt, Human
cacuuugggaggcugaggcgggaggaucacaa

SEQ ID NO: 83099 - RNA, 32 nt, Human
cacuuugggaggcugaggcgggcagaucaacu

SEQ ID NO: 83100 - RNA, 32 nt, Human
cacuuugggaggcugaggcgggcagaucacaa

SEQ ID NO: 83101 - RNA, 32 nt, Human
cacuuugggaggcugaggcgggcagaucaccu

SEQ ID NO: 83102 - RNA, 32 nt, Human
cacuuugggaggcugaggcgggcagaucacga

SEQ ID NO: 83103 - RNA, 32 nt, Human
cacuuugggaggcugaggcgggcagaucauuc

SEQ ID NO: 83104 - RNA, 32 nt, Human
cacuuugggaggcugaggcgggcagaucgcga

SEQ ID NO: 83105 - RNA, 32 nt, Human
cacuuugggaggcugaggcgggcagauugcuu

SEQ ID NO: 83106 - RNA, 32 nt, Human
cacuuugggaggcugaggcgggcggaacaccu

SEQ ID NO: 83107 - RNA, 32 nt, Human
cacuuugggaggcugaggcgggcggauagcuu

SEQ ID NO: 83108 - RNA, 32 nt, Human
cacuuugggaggcugaggcgggcggaucacaa

SEQ ID NO: 83109 - RNA, 32 nt, Human
cacuuugggaggcugaggcgggcggaucaccu

SEQ ID NO: 83110 - RNA, 32 nt, Human
cacuuugggaggcugaggcgggcggaucacga

SEQ ID NO: 83111 - RNA, 32 nt, Human
cacuuugggaggcugaggcgggcggaucacua

SEQ ID NO: 83112 - RNA, 32 nt, Human
cacuuugggaggcugaggcgggcggaucauga

SEQ ID NO: 83113 - RNA, 32 nt, Human
cacuuugggaggcugaggcggggagaucacaa

SEQ ID NO: 83114 - RNA, 32 nt, Human
cacuuugggaggcugaggcggguagaucacaa

SEQ ID NO: 83115 - RNA, 32 nt, Human
cacuuugggaggcugaggcgggugaaucacga

SEQ ID NO: 83116 - RNA, 32 nt, Human
cacuuugggaggcugaggcgggugaaucauga

SEQ ID NO: 83117 - RNA, 32 nt, Human
cacuuugggaggcugaggcggguggaucaaga

SEQ ID NO: 83118 - RNA, 32 nt, Human
cacuuugggaggcugaggcggguggaucacaa

SEQ ID NO: 83119 - RNA, 32 nt, Human
cacuuugggaggcugaggcggguggaucaccu

SEQ ID NO: 83120 - RNA, 32 nt, Human
cacuuugggaggcugaggcggguggaucacga

SEQ ID NO: 83121 - RNA, 32 nt, Human
cacuuugggaggcugaggcggguggaucacua

SEQ ID NO: 83122 - RNA, 32 nt, Human
cacuuugggaggcugaggcggguggaucacuu

SEQ ID NO: 83123 - RNA, 32 nt, Human
cacuuugggaggcugaggcggguggaucaucu

SEQ ID NO: 83124 - RNA, 32 nt, Human
cacuuugggaggcugaggcggguggaucauga

SEQ ID NO: 83125 - RNA, 32 nt, Human
cacuuugggaggcugaggcggguggaucugcu

SEQ ID NO: 83126 - RNA, 32 nt, Human
cacuuugggaggcugaggcggguggauugcuu

SEQ ID NO: 83127 - RNA, 32 nt, Human
cacuuugggaggcugaggcgggugggucaccu

SEQ ID NO: 83128 - RNA, 32 nt, Human
cacuuugggaggcugaggcggguugaucaccu

SEQ ID NO: 83129 - RNA, 32 nt, Human
cacuuugggaggcugaggcuggaggacugcug

SEQ ID NO: 83130 - RNA, 32 nt, Human
cacuuugggaggcugaggcugggggaucaccu

SEQ ID NO: 83131 - RNA, 32 nt, Human
cacuuugggaggcugagguaggaggacugcuu

SEQ ID NO: 83132 - RNA, 32 nt, Human
cacuuugggaggcugagguaggaggaucacgu

SEQ ID NO: 83133 - RNA, 32 nt, Human
cacuuugggaggcugagguaggaggaucgcuu

SEQ ID NO: 83134 - RNA, 32 nt, Human
cacuuugggaggcugagguaggaggauugauu

SEQ ID NO: 83135 - RNA, 32 nt, Human
cacuuugggaggcugagguagguggaucauga

SEQ ID NO: 83136 - RNA, 32 nt, Human
cacuuugggaggcugaggucaggaguuugaga

SEQ ID NO: 83137 - RNA, 32 nt, Human
cacuuugggaggcugaggugagaggaucgcuu

SEQ ID NO: 83138 - RNA, 32 nt, Human
cacuuugggaggcugaggugaguggauuacaa

SEQ ID NO: 83139 - RNA, 32 nt, Human
cacuuugggaggcugagguggaaggaucgcuu

SEQ ID NO: 83140 - RNA, 32 nt, Human
cacuuugggaggcugaggugggaggaucgcuu

SEQ ID NO: 83141 - RNA, 32 nt, Human
cacuuugggaggcugaggugggcagaucaacu

SEQ ID NO: 83142 - RNA, 32 nt, Human
cacuuugggaggcugaggugggcagaucacaa

SEQ ID NO: 83143 - RNA, 32 nt, Human
cacuuugggaggcugaggugggcagaucaccu

SEQ ID NO: 83144 - RNA, 32 nt, Human
cacuuugggaggcugaggugggcagaucacga

SEQ ID NO: 83145 - RNA, 32 nt, Human
cacuuugggaggcugaggugggcagaucacuu

SEQ ID NO: 83146 - RNA, 32 nt, Human
cacuuugggaggcugaggugggcagaucauuu

SEQ ID NO: 83147 - RNA, 32 nt, Human
cacuuugggaggcugaggugggcagaucgcuu

SEQ ID NO: 83148 - RNA, 32 nt, Human
cacuuugggaggcugaggugggcugacugcuu

SEQ ID NO: 83149 - RNA, 32 nt, Human
cacuuugggaggcugaguugcuugagccugag

SEQ ID NO: 83150 - RNA, 31 nt, Human
cacuuugggaggucaagaugggaggauugcu

SEQ ID NO: 83151 - RNA, 32 nt, Human
cacuuugggaggucgaggcgggcagaucacuu

SEQ ID NO: 83152 - RNA, 32 nt, Human
cacuuugggaggucgaggcgggcagaucuccu

SEQ ID NO: 83153 - RNA, 32 nt, Human
cacuuugggaggucgaggugggcagaucaccu

SEQ ID NO: 83154 - RNA, 32 nt, Human
cacuuugggaggugcaggcaggcagauggcuu

SEQ ID NO: 83155 - RNA, 32 nt, Human
cacuuugggagguggaggcagguggaucacga

SEQ ID NO: 83156 - RNA, 32 nt, Human
cacuuugggagguggaggcggguggaucacaa

SEQ ID NO: 83157 - RNA, 32 nt, Human
cacuuugggagguugaggcgggcagauuaccu

SEQ ID NO: 83158 - RNA, 32 nt, Human
cacuuugggagguugaggugggcagaucgccu

SEQ ID NO: 83159 - RNA, 32 nt, Human
cacuuugggaugccauggcgggcagaucaccu

SEQ ID NO: 83160 - RNA, 32 nt, Human
cacuuugggaugcugaggcgggcggaucacuu

SEQ ID NO: 83161 - RNA, 32 nt, Human
cacuuugggauuccgaggcggguggaucacau

SEQ ID NO: 83162 - RNA, 32 nt, Human
cacuuuggggagcccaggcgggcagauugcuu

SEQ ID NO: 83163 - RNA, 32 nt, Human
cacuuuggggagcugaggcgggcggaucacga

SEQ ID NO: 83164 - RNA, 32 nt, Human
cacuuugggucugaggagccccuggcagaguc

SEQ ID NO: 83165 - RNA, 32 nt, Human
cacuuuggguggccaaggcgggcagaugacuu

SEQ ID NO: 83166 - RNA, 32 nt, Human
cacuuuggguggucaaggcaggaagauaccuc

SEQ ID NO: 83167 - RNA, 32 nt, Human
cacuuugguagaccgaagugggcagaucaccu

SEQ ID NO: 83168 - RNA, 32 nt, Human
cacuuugguaggcaaaggugggaggaucauuu

SEQ ID NO: 83169 - RNA, 32 nt, Human
cacuuugguaggccaagauggcuggaucaccu

SEQ ID NO: 83170 - RNA, 32 nt, Human
cacuuugguugggugaagcgggcagaucacuu

SEQ ID NO: 83171 - RNA, 32 nt, Human
cacuuuguaacccaggcuggaaugcaauggca

SEQ ID NO: 83172 - RNA, 32 nt, Human
cacuuuguaucuggaaaaucacuuuggggucc

SEQ ID NO: 83173 - RNA, 32 nt, Human
cacuuugucacccaggcuagagugcaguggca

SEQ ID NO: 83174 - RNA, 32 nt, Human
cacuuugucacccaggcuagagugcaguggug

SEQ ID NO: 83175 - RNA, 32 nt, Human
cacuuugucacccaggcuggaaugcaguggca

SEQ ID NO: 83176 - RNA, 32 nt, Human
cacuuugucacccaggcuggagugcaauggcg

SEQ ID NO: 83177 - RNA, 32 nt, Human
cacuuugucacccaggcuggagugcaguggca

SEQ ID NO: 83178 - RNA, 32 nt, Human
cacuuugucccccaggcuggagugcaguggua

SEQ ID NO: 83179 - RNA, 32 nt, Human
cacuuugucgcccaggccggagugcaguggug

SEQ ID NO: 83180 - RNA, 32 nt, Human
cacuuugucgcccaggcuggaguacaguggug

SEQ ID NO: 83181 - RNA, 32 nt, Human
cacuuugucgcccaggcuggagugcaguggca

SEQ ID NO: 83182 - RNA, 32 nt, Human
cacuuugucgcccaggcuggagugcaguggug

SEQ ID NO: 83183 - RNA, 32 nt, Human
cacuuugucgcccgggcaggagugcaguggcu

SEQ ID NO: 83184 - RNA, 32 nt, Human
cacuuugugaggcugaggugggcagaucacga

SEQ ID NO: 83185 - RNA, 32 nt, Human
cacuuugugagugcuuguucagugaguaagca

SEQ ID NO: 83186 - RNA, 32 nt, Human
cacuuugugccccuaucugcccaugaaaacag

SEQ ID NO: 83187 - RNA, 32 nt, Human
cacuuugugcccuagacuggagugcaauggcg

SEQ ID NO: 83188 - RNA, 32 nt, Human
cacuuuguggugugacuccggugccuccuggu

SEQ ID NO: 83189 - RNA, 32 nt, Human
cacuuuguuacccaggcuggagugcaguggca

SEQ ID NO: 83190 - RNA, 32 nt, Human
cacuuuguugcccaggcuagucucaaacuccu

SEQ ID NO: 83191 - RNA, 32 nt, Human
cacuuuguugcccaggcuggagcgcagugggg

SEQ ID NO: 83192 - RNA, 32 nt, Human
cacuuuguugcccaggcuggagugcagugguc

SEQ ID NO: 83193 - RNA, 32 nt, Human
cacuuuguugcccaggcuggagugcgguggcg

SEQ ID NO: 83194 - RNA, 32 nt, Human
cacuuuguuucaggcuggucugugccccguga

SEQ ID NO: 83195 - RNA, 32 nt, Human
cacuuuguuucuucaccuugauuugcacuuua

SEQ ID NO: 83196 - RNA, 32 nt, Human
cacuuuuaaacaguaaccaaaucuaaauuuaa

SEQ ID NO: 83197 - RNA, 32 nt, Human
cacuuuuaauacugcaacugcucccuuuugcc

SEQ ID NO: 83198 - RNA, 32 nt, Human
cacuuuuagaaacuguaucaucaaagauuuuc

SEQ ID NO: 83199 - RNA, 32 nt, Human
cacuuuuagaacuaugguacuacuuuuguuaa

SEQ ID NO: 83200 - RNA, 32 nt, Human
cacuuuuagaggcugaggcaggagaauugguu

SEQ ID NO: 83201 - RNA, 32 nt, Human
cacuuuuagcucuuugcaucuuccuucagugu

SEQ ID NO: 83202 - RNA, 32 nt, Human
cacuuuuauauacucuucuaguuucuauggcu

SEQ ID NO: 83203 - RNA, 32 nt, Human
cacuuuuauuuggggguguggacagcugcuuu

SEQ ID NO: 83204 - RNA, 32 nt, Human
cacuuuucauauucuuaaaauaaucuucacuu

SEQ ID NO: 83205 - RNA, 32 nt, Human
cacuuuucauuugcuccugugauacuaacaac

SEQ ID NO: 83206 - RNA, 32 nt, Human
cacuuuuccacuuuugauaagauguaaauauu

SEQ ID NO: 83207 - RNA, 31 nt, Human
cacuuuuccagagugaaauguaggagggagc

SEQ ID NO: 83208 - RNA, 32 nt, Human
cacuuuuccuuuucuauuccauaguacuaguu

SEQ ID NO: 83209 - RNA, 32 nt, Human
cacuuuucguggggcucucuggaggacuuuuc

SEQ ID NO: 83210 - RNA, 32 nt, Human
cacuuuucucucugacuuuguacaugucaccu

SEQ ID NO: 83211 - RNA, 32 nt, Human
cacuuuucuggcgcuggagugugcagggcgua

SEQ ID NO: 83212 - RNA, 32 nt, Human
cacuuuucuuguuccauucaaacaucugaaaa

SEQ ID NO: 83213 - RNA, 32 nt, Human
cacuuuucuuugccuuuccugagaguuuuauu

SEQ ID NO: 83214 - RNA, 32 nt, Human
cacuuuucuuuuucucaaccuucacauccagu

SEQ ID NO: 83215 - RNA, 32 nt, Human
cacuuuugagaccagcuggcuuuguagucacu

SEQ ID NO: 83216 - RNA, 32 nt, Human
cacuuuugcccaggcuggagugcaguggcgug

SEQ ID NO: 83217 - RNA, 32 nt, Human
cacuuuugcugguuccagucaaaucaauggca

SEQ ID NO: 83218 - RNA, 32 nt, Human
cacuuuugcuguucuugugaauguuagaucuu

SEQ ID NO: 83219 - RNA, 32 nt, Human
cacuuuuggaaauguaucgcagagaaguaacc

SEQ ID NO: 83220 - RNA, 32 nt, Human
cacuuuuggaggccaaggugggcagauccccu

SEQ ID NO: 83221 - RNA, 32 nt, Human
cacuuuuggaggcccaggcgggcggaucaccu

SEQ ID NO: 83222 - RNA, 31 nt, Human
cacuuuuggaggccgagauggguggaucauc

SEQ ID NO: 83223 - RNA, 32 nt, Human
cacuuuuggaggcugaggcgggcagaucacuu

SEQ ID NO: 83224 - RNA, 32 nt, Human
cacuuuuggaggcugaggcggguggauugcuu

SEQ ID NO: 83225 - RNA, 32 nt, Human
cacuuuugggggccgaggcggguggaucaccu

SEQ ID NO: 83226 - RNA, 32 nt, Human
cacuuuuuaaguuugaagagccauuuugguaa

SEQ ID NO: 83227 - RNA, 32 nt, Human
cacuuuuuacauauauguacauaguauuguuu

SEQ ID NO: 83228 - RNA, 32 nt, Human
cacuuuuuacauuuagaaacacugugauuaga

SEQ ID NO: 83229 - RNA, 32 nt, Human
cacuuuuuacucuguguuaccauuuugacugg

SEQ ID NO: 83230 - RNA, 32 nt, Human
cacuuuuuacuuucugcuaucucccaucuccc

SEQ ID NO: 83231 - RNA, 32 nt, Human
cacuuuuucacugcaugcuuacaauucccaaa

SEQ ID NO: 83232 - RNA, 32 nt, Human
cacuuuuugaaggacaaguauaugugggucua

SEQ ID NO: 83233 - RNA, 32 nt, Human
cacuuuuuggugggccagaaaagcagggacaa

SEQ ID NO: 83234 - RNA, 32 nt, Human
cacuuuuuguuaauguugcugccucauugacc

SEQ ID NO: 83235 - RNA, 20 nt, Human
cacuuuuuugaggcaggaag

SEQ ID NO: 83236 - RNA, 32 nt, Human
cagaaaaacauacaagacuccuucagccaaca

SEQ ID NO: 83237 - RNA, 32 nt, Human
cagaaaaagaguuuuucucuuguucagccugc

SEQ ID NO: 83238 - RNA, 32 nt, Human
cagaaaaagaugaguuguaacacugaucugcu

SEQ ID NO: 83239 - RNA, 23 nt, Human
cagaaaaauaauaaagcaaagaa

SEQ ID NO: 83240 - RNA, 22 nt, Human
cagaaaaauccugccuaaggca

SEQ ID NO: 83241 - RNA, 32 nt, Human
cagaaaaauggcagccgccgcuccggacucac

SEQ ID NO: 83242 - RNA, 19 nt, Human
cagaaaaauuaagugaaga

SEQ ID NO: 83243 - RNA, 32 nt, Human
cagaaaacaacagcucaagccccagggguggc

SEQ ID NO: 83244 - RNA, 32 nt, Human
cagaaaacacaaaugcaaagucaaguggaggg

SEQ ID NO: 83245 - RNA, 32 nt, Human
cagaaaacagacuuguaaaaagcuuagaucau

SEQ ID NO: 83246 - RNA, 20 nt, Human
cagaaaacagcuucacuccu

SEQ ID NO: 83247 - RNA, 32 nt, Human
cagaaaacaggaggcugccacucuccaucuuu

SEQ ID NO: 83248 - RNA, 23 nt, Human
cagaaaacauagccaccauuuug

SEQ ID NO: 83249 - RNA, 32 nt, Human
cagaaaacccugugagauggccagucuucaua

SEQ ID NO: 83250 - RNA, 32 nt, Human
cagaaaacccugugccagggacaggaaagaua

SEQ ID NO: 83251 - RNA, 32 nt, Human
cagaaaacccuucaaaaguucagucuagucug

SEQ ID NO: 83252 - RNA, 32 nt, Human
cagaaaaccuauauccuaugauacaacucuaa

SEQ ID NO: 83253 - RNA, 32 nt, Human
cagaaaaccuuccagucucugagcucuaagga

SEQ ID NO: 83254 - RNA, 32 nt, Human
cagaaaacuacccuuguuuuucaugucuuuca

SEQ ID NO: 83255 - RNA, 32 nt, Human
cagaaaacuauacuuuggucugcuucuacagu

SEQ ID NO: 83256 - RNA, 32 nt, Human
cagaaaacugggugguagcgugucugaaccaa

SEQ ID NO: 83257 - RNA, 32 nt, Human
cagaaaagaagaggcagaaauccaagcagaac

SEQ ID NO: 83258 - RNA, 32 nt, Human
cagaaaagaagugcuacagcucugugccuguc

SEQ ID NO: 83259 - RNA, 32 nt, Human
cagaaaagaauguuucaggccauguucagggg

SEQ ID NO: 83260 - RNA, 32 nt, Human
cagaaaagaggaagaggagaauggauguuggg

SEQ ID NO: 83261 - RNA, 32 nt, Human
cagaaaagaggaugcuuuucugcuuaccaugg

SEQ ID NO: 83262 - RNA, 32 nt, Human
cagaaaagagugggacagggacaagcauaucu

SEQ ID NO: 83263 - RNA, 32 nt, Human
cagaaaagcuacaacauggaaaacaggccucc

SEQ ID NO: 83264 - RNA, 32 nt, Human
cagaaaaggagagguugacagucauccacaag

SEQ ID NO: 83265 - RNA, 32 nt, Human
cagaaaaggcuucucuugauacaucaagcauu

SEQ ID NO: 83266 - RNA, 32 nt, Human
cagaaaaggugucacacggcugccuguaccuu

SEQ ID NO: 83267 - RNA, 32 nt, Human
cagaaaaguggaccuugggggcugguucugcu

SEQ ID NO: 83268 - RNA, 23 nt, Human
cagaaaagugggcagugguggca

SEQ ID NO: 83269 - RNA, 32 nt, Human
cagaaaaguugugucucccuuagaugagaucu

SEQ ID NO: 83270 - RNA, 21 nt, Human
cagaaaauaauaggcucauag

SEQ ID NO: 83271 - RNA, 24 nt, Human
cagaaaauaccuuagcuucacuca

SEQ ID NO: 83272 - RNA, 32 nt, Human
cagaaaauagacguauaaaugugcacaugcgu

SEQ ID NO: 83273 - RNA, 32 nt, Human
cagaaaaucaaggcaaagagggugggugaacc

SEQ ID NO: 83274 - RNA, 31 nt, Human
cagaaaaugaacacauugcaggucugcagac

SEQ ID NO: 83275 - RNA, 32 nt, Human
cagaaaaugaacacccuugugauagaauuacc

SEQ ID NO: 83276 - RNA, 32 nt, Human
cagaaaauguuuagaguguuuuaguuuucauu

SEQ ID NO: 83277 - RNA, 23 nt, Human
cagaaaauguuucuuuucuuuca

SEQ ID NO: 83278 - RNA, 32 nt, Human
cagaaaauuaaaaggcaaaacaauggacaucu

SEQ ID NO: 83279 - RNA, 22 nt, Human
cagaaaauuaaaauauacucca

SEQ ID NO: 83280 - RNA, 26 nt, Human
cagaaaauuagacagguaugguggca

SEQ ID NO: 83281 - RNA, 32 nt, Human
cagaaaauugaagaguacuggaaaugguaacu

SEQ ID NO: 83282 - RNA, 32 nt, Human
cagaaaauugcaaccuccaccagaccacaagg

SEQ ID NO: 83283 - RNA, 32 nt, Human
cagaaacaagggacagugaaacacccagagac

SEQ ID NO: 83284 - RNA, 32 nt, Human
cagaaacacaaacccguguggacuccgggagg

SEQ ID NO: 83285 - RNA, 32 nt, Human
cagaaacacaaccacucaccaguccuaguuuu

SEQ ID NO: 83286 - RNA, 20 nt, Human
cagaaacacaaucucaggga

SEQ ID NO: 83287 - RNA, 32 nt, Human
cagaaacacagccggugcgcgcagggcggcag

SEQ ID NO: 83288 - RNA, 32 nt, Human
cagaaacacccaggccgagcaggaugagcagg

SEQ ID NO: 83289 - RNA, 18 nt, Human
cagaaacacucccaggga

SEQ ID NO: 83290 - RNA, 32 nt, Human
cagaaacacuucagaagcaaugggggcagaga

SEQ ID NO: 83291 - RNA, 32 nt, Human
cagaaacagauggaaaaaggagccaucagcac

SEQ ID NO: 83292 - RNA, 32 nt, Human
cagaaacagcuuggccagcuuugugaaccuuu

SEQ ID NO: 83293 - RNA, 32 nt, Human
cagaaacaggagcacagaccucugcuguagcu

SEQ ID NO: 83294 - RNA, 32 nt, Human
cagaaacagggagccaguuacagaucuauccc

SEQ ID NO: 83295 - RNA, 21 nt, Human
cagaaacaguugauugacaca

SEQ ID NO: 83296 - RNA, 32 nt, Human
cagaaacaucccucagccccacaggcacgauc

SEQ ID NO: 83297 - RNA, 32 nt, Human
cagaaaccaaaucagucuucuauaaucugggg

SEQ ID NO: 83298 - RNA, 20 nt, Human
cagaaaccaaggcuaaggga

SEQ ID NO: 83299 - RNA, 28 nt, Human
cagaaaccaagugcucuagccucagccc

SEQ ID NO: 83300 - RNA, 32 nt, Human
cagaaaccaagugcucuagccucagcccuaaa

SEQ ID NO: 83301 - RNA, 32 nt, Human
cagaaaccacacacacuguugcuggaucuuga

SEQ ID NO: 83302 - RNA, 32 nt, Human
cagaaaccaccagguccggcacuuggagcccc

SEQ ID NO: 83303 - RNA, 32 nt, Human
cagaaaccaccugcguccacacccucacugca

SEQ ID NO: 83304 - RNA, 23 nt, Human
cagaaaccacuaccccucagggg

SEQ ID NO: 83305 - RNA, 32 nt, Human
cagaaaccagaagaacaaucaagacugcaaug

SEQ ID NO: 83306 - RNA, 26 nt, Human
cagaaaccaggggcagcgaugaggga

SEQ ID NO: 83307 - RNA, 32 nt, Human
cagaaaccaggugccuucagaggcucucugau

SEQ ID NO: 83308 - RNA, 32 nt, Human
cagaaaccauuguguguuuccucuuugaagca

SEQ ID NO: 83309 - RNA, 32 nt, Human
cagaaaccauuuucaccuucugucuccuccau

SEQ ID NO: 83310 - RNA, 20 nt, Human
cagaaacccacgucucugag

SEQ ID NO: 83311 - RNA, 21 nt, Human
cagaaacccacuuuguucuca

SEQ ID NO: 83312 - RNA, 21 nt, Human
cagaaacccaggguuugggga

SEQ ID NO: 83313 - RNA, 23 nt, Human
cagaaacccauggaccauguggg

SEQ ID NO: 83314 - RNA, 21 nt, Human
cagaaacccgggggccaaggg

SEQ ID NO: 83315 - RNA, 19 nt, Human
cagaaacccucacuuaggg

SEQ ID NO: 83316 - RNA, 32 nt, Human
cagaaacccucccaaauccucagacuguggag

SEQ ID NO: 83317 - RNA, 32 nt, Human
cagaaaccgaaagcucuauauaaaugcucaga

SEQ ID NO: 83318 - RNA, 32 nt, Human
cagaaaccgggcuugguuguugcagugggaag

SEQ ID NO: 83319 - RNA, 32 nt, Human
cagaaaccucauacuucucgggucagggaagg

SEQ ID NO: 83320 - RNA, 32 nt, Human
cagaaaccuggccacauuagaaagggguggug

SEQ ID NO: 83321 - RNA, 21 nt, Human
cagaaaccuggucucccuagg

SEQ ID NO: 83322 - RNA, 25 nt, Human
cagaaaccuugagcagauccaggga

SEQ ID NO: 83323 - RNA, 32 nt, Human
cagaaacggaccaagaaaaugagcgagagcaa

SEQ ID NO: 83324 - RNA, 32 nt, Human
cagaaacuagcccagaacucacucaguucuuc

SEQ ID NO: 83325 - RNA, 25 nt, Human
cagaaacuaugagcugugucaccug

SEQ ID NO: 83326 - RNA, 20 nt, Human
cagaaacuauugccuuggga

SEQ ID NO: 83327 - RNA, 21 nt, Human
cagaaacucaaagcuuggggg

SEQ ID NO: 83328 - RNA, 24 nt, Human
cagaaacucaagcaggcccaggga

SEQ ID NO: 83329 - RNA, 20 nt, Human
cagaaacucagcacugggga

SEQ ID NO: 83330 - RNA, 21 nt, Human
cagaaacuccauuccucgggg

SEQ ID NO: 83331 - RNA, 32 nt, Human
cagaaacugaagaugguacaguucuacaucug

SEQ ID NO: 83332 - RNA, 32 nt, Human
cagaaacugaaugacugcucagggagguguca

SEQ ID NO: 83333 - RNA, 20 nt, Human
cagaaacugaugccaagggg

SEQ ID NO: 83334 - RNA, 32 nt, Human
cagaaacugcucccuuugaacucucuuggcug

SEQ ID NO: 83335 - RNA, 32 nt, Human
cagaaacugguagguuucaucaggugguuaaa

SEQ ID NO: 83336 - RNA, 32 nt, Human
cagaaacuucaagcucucuaaauaaaaugaag

SEQ ID NO: 83337 - RNA, 32 nt, Human
cagaaacuugacucuaaaaugaucauugugga

SEQ ID NO: 83338 - RNA, 21 nt, Human
cagaaacuuggucucccuggg

SEQ ID NO: 83339 - RNA, 32 nt, Human
cagaaagaaagcaacuggauuuacagauuuau

SEQ ID NO: 83340 - RNA, 32 nt, Human
cagaaagaaauacuugguacuucuuucgcuga

SEQ ID NO: 83341 - RNA, 32 nt, Human
cagaaagaaauaguacaacugugugaaaugug

SEQ ID NO: 83342 - RNA, 32 nt, Human
cagaaagaacaagagugcuagagcuuuugugc

SEQ ID NO: 83343 - RNA, 32 nt, Human
cagaaagaacagccucugucaccccgccgcca

SEQ ID NO: 83344 - RNA, 32 nt, Human
cagaaagaagcccaugguaacccagguguauu

SEQ ID NO: 83345 - RNA, 32 nt, Human
cagaaagaaguuagucaguagcaguaggagga

SEQ ID NO: 83346 - RNA, 32 nt, Human
cagaaagacaacagguacaaagcccuaaggau

SEQ ID NO: 83347 - RNA, 32 nt, Human
cagaaagacaaggggagcauuggacaacacag

SEQ ID NO: 83348 - RNA, 32 nt, Human
cagaaagacaguacacaagaugagucaaguca

SEQ ID NO: 83349 - RNA, 32 nt, Human
cagaaagacccccauucuuccuuuggggguau

SEQ ID NO: 83350 - RNA, 32 nt, Human
cagaaagacccugaaggcaggcugcaaaugac

SEQ ID NO: 83351 - RNA, 32 nt, Human
cagaaagagaagguggucaaccuuaacaacau

SEQ ID NO: 83352 - RNA, 32 nt, Human
cagaaagagagagaggagagaaaccgcauuca

SEQ ID NO: 83353 - RNA, 24 nt, Human
cagaaagagccagauggaccugag

SEQ ID NO: 83354 - RNA, 32 nt, Human
cagaaagaguauggagagaaaaagaggcacac

SEQ ID NO: 83355 - RNA, 21 nt, Human
cagaaagaguccuuaccuugg

SEQ ID NO: 83356 - RNA, 32 nt, Human
cagaaagauggaaaggcacccaugcagcucac

SEQ ID NO: 83357 - RNA, 32 nt, Human
cagaaagauuccaggacagagaugacagaggc

SEQ ID NO: 83358 - RNA, 19 nt, Human
cagaaagauugcuugagcc

SEQ ID NO: 83359 - RNA, 32 nt, Human
cagaaagcagaugucacguuuguuaaagagaa

SEQ ID NO: 83360 - RNA, 32 nt, Human
cagaaagcagcauuuuuaaauguccguguuaa

SEQ ID NO: 83361 - RNA, 22 nt, Human
cagaaagcagccacaggcccug

SEQ ID NO: 83362 - RNA, 32 nt, Human
cagaaagcaguccuaucuucaguggcuacagg

SEQ ID NO: 83363 - RNA, 22 nt, Human
cagaaagcagugacaaaagggg

SEQ ID NO: 83364 - RNA, 32 nt, Human
cagaaagcaguggagguggggguugcuguuga

SEQ ID NO: 83365 - RNA, 32 nt, Human
cagaaagccagccugccuuuuagcacuuggau

SEQ ID NO: 83366 - RNA, 32 nt, Human
cagaaagccagggaacccacagagucaccaac

SEQ ID NO: 83367 - RNA, 32 nt, Human
cagaaagcccaggguccacugaagggacccug

SEQ ID NO: 83368 - RNA, 32 nt, Human
cagaaagcccaguguuuuugcaaagaaugaaa

SEQ ID NO: 83369 - RNA, 32 nt, Human
cagaaagccccaggcacagcucagggaggagg

SEQ ID NO: 83370 - RNA, 32 nt, Human
cagaaagccuccaggacagccugugggagcug

SEQ ID NO: 83371 - RNA, 32 nt, Human
cagaaagccugaggcgugcccagagcacaaga

SEQ ID NO: 83372 - RNA, 22 nt, Human
cagaaagcuccaggaaucggga

SEQ ID NO: 83373 - RNA, 32 nt, Human
cagaaagcugaggagugugggcuggcagagag

SEQ ID NO: 83374 - RNA, 32 nt, Human
cagaaagcugcaggaggcuccagauuuaaauc

SEQ ID NO: 83375 - RNA, 25 nt, Human
cagaaagcugggaggcaaccucgag

SEQ ID NO: 83376 - RNA, 32 nt, Human
cagaaaggaaucgagaacaacauaucaaguca

SEQ ID NO: 83377 - RNA, 32 nt, Human
cagaaaggacucugcuccacugccaaaaauuu

SEQ ID NO: 83378 - RNA, 32 nt, Human
cagaaaggacugucccagccucgggagcaaga

SEQ ID NO: 83379 - RNA, 32 nt, Human
cagaaaggagcuucaaauggcugugauaagga

SEQ ID NO: 83380 - RNA, 32 nt, Human
cagaaaggaggcagcacacagagaaagaugca

SEQ ID NO: 83381 - RNA, 32 nt, Human
cagaaaggagguuuaggauugcagagaagaug

SEQ ID NO: 83382 - RNA, 32 nt, Human
cagaaaggauccccuuucuccaguuugugcug

SEQ ID NO: 83383 - RNA, 32 nt, Human
cagaaaggauguagggagagacugccugugca

SEQ ID NO: 83384 - RNA, 32 nt, Human
cagaaaggccguagcaguuugacgauaggugg

SEQ ID NO: 83385 - RNA, 32 nt, Human
cagaaaggcugggagcagcccagacccuccug

SEQ ID NO: 83386 - RNA, 22 nt, Human
cagaaaggcuugggugaccagg

SEQ ID NO: 83387 - RNA, 32 nt, Human
cagaaagggaaacugagguccaaggaauagga

SEQ ID NO: 83388 - RNA, 32 nt, Human
cagaaagggaagcacaggguaaggagaccugg

SEQ ID NO: 83389 - RNA, 32 nt, Human
cagaaagggaagcagaacugagggcugggaua

SEQ ID NO: 83390 - RNA, 32 nt, Human
cagaaagggcccucugcuguggucugaacccc

SEQ ID NO: 83391 - RNA, 32 nt, Human
cagaaaggggcuggguaccucuucugguugcu

SEQ ID NO: 83392 - RNA, 32 nt, Human
cagaaaggugugaccauggaggcugguggccu

SEQ ID NO: 83393 - RNA, 32 nt, Human
cagaaaguaaacuagccuugcugagagauucu

SEQ ID NO: 83394 - RNA, 32 nt, Human
cagaaaguagaaagguggcugcugggggcuag

SEQ ID NO: 83395 - RNA, 32 nt, Human
cagaaaguaggaggguguccagugagucacuc

SEQ ID NO: 83396 - RNA, 32 nt, Human
cagaaaguaggcaggggaggagaggguaaggg

SEQ ID NO: 83397 - RNA, 32 nt, Human
cagaaagucaacaagcaaaaugccuugagugu

SEQ ID NO: 83398 - RNA, 32 nt, Human
cagaaagucauucaagacugaguuuauagaaa

SEQ ID NO: 83399 - RNA, 23 nt, Human
cagaaaguccagacucaagagua

SEQ ID NO: 83400 - RNA, 32 nt, Human
cagaaagucuaugagaaugaaaaggccagggg

SEQ ID NO: 83401 - RNA, 32 nt, Human
cagaaagugcugagccaagagcuccuagcugc

SEQ ID NO: 83402 - RNA, 21 nt, Human
cagaaaguguggcagaggcac

SEQ ID NO: 83403 - RNA, 32 nt, Human
cagaaaguuaacaucaauacacuugaucauuu

SEQ ID NO: 83404 - RNA, 32 nt, Human
cagaaaguucauguuugguaaauucuguuacu

SEQ ID NO: 83405 - RNA, 32 nt, Human
cagaaaguugaggaagaaagaacucaaguaca

SEQ ID NO: 83406 - RNA, 32 nt, Human
cagaaaguuggcuauuauaaagaugaaaauuc

SEQ ID NO: 83407 - RNA, 32 nt, Human
cagaaaguuucuggaucccaggcucaucucca

SEQ ID NO: 83408 - RNA, 19 nt, Human
cagaaauaaaauuuuugca

SEQ ID NO: 83409 - RNA, 32 nt, Human
cagaaauaaagaaaggaaggaaggacggaagg

SEQ ID NO: 83410 - RNA, 32 nt, Human
cagaaauaaccagcuggauuuaggccagcuca

SEQ ID NO: 83411 - RNA, 32 nt, Human
cagaaauaagaccuguggcugaaggaagccuu

SEQ ID NO: 83412 - RNA, 28 nt, Human
cagaaauagaaaccuaguuuuuaaggug

SEQ ID NO: 83413 - RNA, 32 nt, Human
cagaaauaggagaguggaugauagaugcaaaa

SEQ ID NO: 83414 - RNA, 32 nt, Human
cagaaaucaacugacaaauggcagauucauag

SEQ ID NO: 83415 - RNA, 22 nt, Human
cagaaaucaagaaccucugccu

SEQ ID NO: 83416 - RNA, 32 nt, Human
cagaaaucaagaaccucugccuccgagacagg

SEQ ID NO: 83417 - RNA, 23 nt, Human
cagaaaucccagcgcaccugggg

SEQ ID NO: 83418 - RNA, 32 nt, Human
cagaaauccuggaauuagaggguuuaauauug

SEQ ID NO: 83419 - RNA, 32 nt, Human
cagaaauccuugauuucucagguuagcgacgg

SEQ ID NO: 83420 - RNA, 32 nt, Human
cagaaaucuauuucuauucucuggaagagcuu

SEQ ID NO: 83421 - RNA, 26 nt, Human
cagaaaucugacucuuuacccaggga

SEQ ID NO: 83422 - RNA, 23 nt, Human
cagaaaugaaccugacccagggg

SEQ ID NO: 83423 - RNA, 32 nt, Human
cagaaaugaaguauaugguucauuagcuuaaa

SEQ ID NO: 83424 - RNA, 32 nt, Human
cagaaaugaaugaacugugaaagcuccuguuu

SEQ ID NO: 83425 - RNA, 32 nt, Human
cagaaaugacccaacucucucacuuuucccuc

SEQ ID NO: 83426 - RNA, 32 nt, Human
cagaaaugacccuuccuccaccacaccccucc

SEQ ID NO: 83427 - RNA, 32 nt, Human
cagaaaugcaaagaucaaacugugcaaauauu

SEQ ID NO: 83428 - RNA, 32 nt, Human
cagaaaugcccccauucucccagucucugucg

SEQ ID NO: 83429 - RNA, 21 nt, Human
cagaaaugcucucuccaggga

SEQ ID NO: 83430 - RNA, 31 nt, Human
cagaaaugcuuuauuucuccugugucaguag

SEQ ID NO: 83431 - RNA, 32 nt, Human
cagaaauggauggauucuggaaauauuuugaa

SEQ ID NO: 83432 - RNA, 32 nt, Human
cagaaaugggccgugagcucucacaggcucag

SEQ ID NO: 83433 - RNA, 32 nt, Human
cagaaauguauuggcucagagcucuggaggcu

SEQ ID NO: 83434 - RNA, 32 nt, Human
cagaaaugucuggagcaauggaagaaccacug

SEQ ID NO: 83435 - RNA, 32 nt, Human
cagaaauuaaagaaauuucugaauaaauuugc

SEQ ID NO: 83436 - RNA, 18 nt, Human
cagaaauuaagugcauug

SEQ ID NO: 83437 - RNA, 32 nt, Human
cagaaauuagccaggcgugguggugcacaccu

SEQ ID NO: 83438 - RNA, 32 nt, Human
cagaaauugagcuucagaagauugaggauagc

SEQ ID NO: 83439 - RNA, 32 nt, Human
cagaaauugagguccccgcugccuucugagga

SEQ ID NO: 83440 - RNA, 20 nt, Human
cagaaauuucauccagagga

SEQ ID NO: 83441 - RNA, 32 nt, Human
cagaaauuucuacaaccuacugggguaaaauc

SEQ ID NO: 83442 - RNA, 24 nt, Human
cagaacaaaacauacgagcuggua

SEQ ID NO: 83443 - RNA, 32 nt, Human
cagaacaacagggugaaaccccaucucuaaua

SEQ ID NO: 83444 - RNA, 32 nt, Human
cagaacaaccagcuggaucaguucucacagga

SEQ ID NO: 83445 - RNA, 32 nt, Human
cagaacaacuccauguuacacugaguucaugc

SEQ ID NO: 83446 - RNA, 32 nt, Human
cagaacaaggucugcguggagccccagcagcu

SEQ ID NO: 83447 - RNA, 32 nt, Human
cagaacacagcaauuccucaggcuaagcugcc

SEQ ID NO: 83448 - RNA, 32 nt, Human
cagaacacaggcagucuccacuauugauacca

SEQ ID NO: 83449 - RNA, 20 nt, Human
cagaacacagguuccaggag

SEQ ID NO: 83450 - RNA, 32 nt, Human
cagaacaccagagaccucaaauuacuuuacaa

SEQ ID NO: 83451 - RNA, 23 nt, Human
cagaacaccauuccuuccaggag

SEQ ID NO: 83452 - RNA, 32 nt, Human
cagaacacguagacaggcuguaauauucaaac

SEQ ID NO: 83453 - RNA, 32 nt, Human
cagaacacugcacuccaauuuccucgggcagc

SEQ ID NO: 83454 - RNA, 32 nt, Human
cagaacacugccacccacccaguuuuauaauc

SEQ ID NO: 83455 - RNA, 32 nt, Human
cagaacagaagugccugggacgcccagauccu

SEQ ID NO: 83456 - RNA, 32 nt, Human
cagaacagacugcgcugcgagccccgggcuuc

SEQ ID NO: 83457 - RNA, 32 nt, Human
cagaacagcguccucagacuuaaccuucugca

SEQ ID NO: 83458 - RNA, 32 nt, Human
cagaacaggaggugguagagggcauggauauc

SEQ ID NO: 83459 - RNA, 32 nt, Human
cagaacagggaagccagcaggggaagaaaaag

SEQ ID NO: 83460 - RNA, 32 nt, Human
cagaacaggggcacccuccaaacacugggcuc

SEQ ID NO: 83461 - RNA, 32 nt, Human
cagaacagguucuccaaggauccccucgagac

SEQ ID NO: 83462 - RNA, 32 nt, Human
cagaacaguccucccuguaagagccuaaccau

SEQ ID NO: 83463 - RNA, 31 nt, Human
cagaacagugagaguggggaaaagaccgagg

SEQ ID NO: 83464 - RNA, 32 nt, Human
cagaacagugccugugacaccggaggggauug

SEQ ID NO: 83465 - RNA, 32 nt, Human
cagaacagugcuuguggagggccugacugucc

SEQ ID NO: 83466 - RNA, 32 nt, Human
cagaacaguuccaagaauugaagagagcuaag

SEQ ID NO: 83467 - RNA, 32 nt, Human
cagaacauagccacccuuuuucaucagugacc

SEQ ID NO: 83468 - RNA, 32 nt, Human
cagaacauauguugcaagacccucccaugggg

SEQ ID NO: 83469 - RNA, 32 nt, Human
cagaacaugaauucagguaaccuggugucugu

SEQ ID NO: 83470 - RNA, 32 nt, Human
cagaacaugcagcagaaaagcugugaaggaag

SEQ ID NO: 83471 - RNA, 32 nt, Human
cagaacauucugaccucugucuugcucugcuc

SEQ ID NO: 83472 - RNA, 32 nt, Human
cagaaccaaaacugauacagugaaacaauuaa

SEQ ID NO: 83473 - RNA, 32 nt, Human
cagaaccaauaacauaaguauucaaaguuaug

SEQ ID NO: 83474 - RNA, 32 nt, Human
cagaaccacagcaagaaaccugacaauauugu

SEQ ID NO: 83475 - RNA, 32 nt, Human
cagaaccacagcaagaaaccugacaauauuuu

SEQ ID NO: 83476 - RNA, 32 nt, Human
cagaaccacagcaagaaaucugacaauauuuu

SEQ ID NO: 83477 - RNA, 32 nt, Human
cagaaccacauccugaggagucucagcuuauc

SEQ ID NO: 83478 - RNA, 32 nt, Human
cagaaccacccacuccugaagugggucagcaa

SEQ ID NO: 83479 - RNA, 20 nt, Human
cagaaccacuccuccaggag

SEQ ID NO: 83480 - RNA, 32 nt, Human
cagaaccagcaacaggcuuuuauuaaacauac

SEQ ID NO: 83481 - RNA, 32 nt, Human
cagaaccagccugucaggaugcgccugaucuc

SEQ ID NO: 83482 - RNA, 32 nt, Human
cagaaccaguaucugucauggaacugaacauu

SEQ ID NO: 83483 - RNA, 32 nt, Human
cagaaccagugucugaaccacccuggaaauuc

SEQ ID NO: 83484 - RNA, 32 nt, Human
cagaaccaugaguggccagagaggaggagaag

SEQ ID NO: 83485 - RNA, 32 nt, Human
cagaaccauggugggagagaacagacuuggcg

SEQ ID NO: 83486 - RNA, 32 nt, Human
cagaaccaugucccaagacaacugguuaguga

SEQ ID NO: 83487 - RNA, 32 nt, Human
cagaaccauuuggccuuaauuccaaugugaga

SEQ ID NO: 83488 - RNA, 15 nt, Human
cagaacccaccugca

SEQ ID NO: 83489 - RNA, 32 nt, Human
cagaacccagcaaucugugcuuucuuucacaa

SEQ ID NO: 83490 - RNA, 32 nt, Human
cagaacccagcccagaucggaggacaaguucc

SEQ ID NO: 83491 - RNA, 32 nt, Human
cagaacccaggaggcagagcuugcagugagcc

SEQ ID NO: 83492 - RNA, 21 nt, Human
cagaacccagggauccaggag

SEQ ID NO: 83493 - RNA, 32 nt, Human
cagaacccccuuccucugcuccuccaugaaug

SEQ ID NO: 83494 - RNA, 20 nt, Human
cagaaccccgcucugaggaa

SEQ ID NO: 83495 - RNA, 19 nt, Human
cagaacccgacccuccgca

SEQ ID NO: 83496 - RNA, 32 nt, Human
cagaacccgcagaguccucccugcugcugugu

SEQ ID NO: 83497 - RNA, 32 nt, Human
cagaacccgcaggcuccugaagacuggccacg

SEQ ID NO: 83498 - RNA, 32 nt, Human
cagaacccucaucuggccaccugcugcuuuuu

SEQ ID NO: 83499 - RNA, 32 nt, Human
cagaacccuccaccccuacccccaacccucag

SEQ ID NO: 83500 - RNA, 32 nt, Human
cagaacccucgggcaccuggagagauguuuug

SEQ ID NO: 83501 - RNA, 20 nt, Human
cagaacccugggugggcagg

SEQ ID NO: 83502 - RNA, 32 nt, Human
cagaaccgcuacugcugcuucggucucuccuu

SEQ ID NO: 83503 - RNA, 31 nt, Human
cagaaccgcuuacucccuuguuaagggggcu

SEQ ID NO: 83504 - RNA, 32 nt, Human
cagaaccggucccagccugggcuccucugcau

SEQ ID NO: 83505 - RNA, 32 nt, Human
cagaaccucacugcguccuccuccuccaaaac

SEQ ID NO: 83506 - RNA, 32 nt, Human
cagaaccuccacccucccccacaccaaagaca

SEQ ID NO: 83507 - RNA, 32 nt, Human
cagaaccuccacccucugacaccauggucaac

SEQ ID NO: 83508 - RNA, 32 nt, Human
cagaaccuccacccucugacaccauggucagc

SEQ ID NO: 83509 - RNA, 32 nt, Human
cagaaccucccaccuuccccaguucaccaugu

SEQ ID NO: 83510 - RNA, 32 nt, Human
cagaaccucccaggagacccugggaucggaag

SEQ ID NO: 83511 - RNA, 32 nt, Human
cagaaccugaaacagauggcagaaggaaugga

SEQ ID NO: 83512 - RNA, 32 nt, Human
cagaaccugccugguaugaccucuccaccuua

SEQ ID NO: 83513 - RNA, 32 nt, Human
cagaaccugccugugucccagcuuggaggccu

SEQ ID NO: 83514 - RNA, 32 nt, Human
cagaaccugcuggugcaagcugggcagguccu

SEQ ID NO: 83515 - RNA, 32 nt, Human
cagaaccuggacccuaaagaacagugacugca

SEQ ID NO: 83516 - RNA, 32 nt, Human
cagaaccugggaacauguaggguggggaguau

SEQ ID NO: 83517 - RNA, 32 nt, Human
cagaaccugguggcuccugccugcuccuucac

SEQ ID NO: 83518 - RNA, 32 nt, Human
cagaaccuuaaacauguggauauuuuugccaa

SEQ ID NO: 83519 - RNA, 32 nt, Human
cagaaccuucgacugacccccuugucuuuaug

SEQ ID NO: 83520 - RNA, 32 nt, Human
cagaaccuucuaaaauagagaaugguacgaca

SEQ ID NO: 83521 - RNA, 32 nt, Human
cagaaccuucuccgccacucuuccugcaauca

SEQ ID NO: 83522 - RNA, 32 nt, Human
cagaaccuuuccccugcuaucucccuuccugc

SEQ ID NO: 83523 - RNA, 21 nt, Human
cagaaccuuugauucugcaca

SEQ ID NO: 83524 - RNA, 32 nt, Human
cagaaccuuugguguuucaggugguauuauag

SEQ ID NO: 83525 - RNA, 32 nt, Human
cagaacgagacccuguacucugucuuaaaggc

SEQ ID NO: 83526 - RNA, 32 nt, Human
cagaacgcacacuggcugucacuaggaagcgc

SEQ ID NO: 83527 - RNA, 32 nt, Human
cagaacgccuucuguucuuccacaacacaggg

SEQ ID NO: 83528 - RNA, 32 nt, Human
cagaacgcggccagggcagaaagcggcggcag

SEQ ID NO: 83529 - RNA, 32 nt, Human
cagaacgcucaggacaucccggccuggguuua

SEQ ID NO: 83530 - RNA, 21 nt, Human
cagaacgggcagcccaucgug

SEQ ID NO: 83531 - RNA, 32 nt, Human
cagaacgguuuuuggaucuggcauugaaaugc

SEQ ID NO: 83532 - RNA, 32 nt, Human
cagaacgugggaugcuggaggcaugccugcag

SEQ ID NO: 83533 - RNA, 32 nt, Human
cagaacguggugaguacagcucagcucagcac

SEQ ID NO: 83534 - RNA, 32 nt, Human
cagaacuaaacuuuuauuuauauguugugggg

SEQ ID NO: 83535 - RNA, 32 nt, Human
cagaacuaagacauugugaagcacuuguuagu

SEQ ID NO: 83536 - RNA, 32 nt, Human
cagaacuacaaagaugagaaauuaccagaagc

SEQ ID NO: 83537 - RNA, 32 nt, Human
cagaacuacuaaaaauaaagaaaucagccaug

SEQ ID NO: 83538 - RNA, 32 nt, Human
cagaacuauaugcacaaacuauaacuuggaug

SEQ ID NO: 83539 - RNA, 32 nt, Human
cagaacuaugaggguccucucuggcacuagcc

SEQ ID NO: 83540 - RNA, 19 nt, Human
cagaacucaaaauauucca

SEQ ID NO: 83541 - RNA, 18 nt, Human
cagaacucaaacaggcuc

SEQ ID NO: 83542 - RNA, 22 nt, Human
cagaacucaaagccaagcucca

SEQ ID NO: 83543 - RNA, 18 nt, Human
cagaacucaagaaagcca

SEQ ID NO: 83544 - RNA, 19 nt, Human
cagaacucaagcccaucca

SEQ ID NO: 83545 - RNA, 32 nt, Human
cagaacucaaguagggcagaagguggaaggcu

SEQ ID NO: 83546 - RNA, 18 nt, Human
cagaacucagcgugcucc

SEQ ID NO: 83547 - RNA, 20 nt, Human
cagaacucaggcugccucca

SEQ ID NO: 83548 - RNA, 22 nt, Human
cagaacuccaggccucaggaaa

SEQ ID NO: 83549 - RNA, 32 nt, Human
cagaacucccaaucguccaccuccagcucuuc

SEQ ID NO: 83550 - RNA, 32 nt, Human
cagaacucccaggucacaugcacguaugucca

SEQ ID NO: 83551 - RNA, 22 nt, Human
cagaacucucccugcuggacuc

SEQ ID NO: 83552 - RNA, 32 nt, Human
cagaacucugaacaacaauaagucucucugag

SEQ ID NO: 83553 - RNA, 32 nt, Human
cagaacucuguggcuggcagccacuauucuca

SEQ ID NO: 83554 - RNA, 32 nt, Human
cagaacucugugguuuaugagaacaagaaguu

SEQ ID NO: 83555 - RNA, 32 nt, Human
cagaacucuucucuccccaucaugggccacag

SEQ ID NO: 83556 - RNA, 32 nt, Human
cagaacugaagggaauauugaggcucaaugaa

SEQ ID NO: 83557 - RNA, 32 nt, Human
cagaacugagccacaggcugcucuggccagga

SEQ ID NO: 83558 - RNA, 32 nt, Human
cagaacugauucuccagcccugguagcauuug

SEQ ID NO: 83559 - RNA, 21 nt, Human
cagaacugcacucuucaggaa

SEQ ID NO: 83560 - RNA, 17 nt, Human
cagaacugcagaccucu

SEQ ID NO: 83561 - RNA, 32 nt, Human
cagaacugcaguugucuugucuucucggagug

SEQ ID NO: 83562 - RNA, 32 nt, Human
cagaacugcccagguguuaacagggcugucug

SEQ ID NO: 83563 - RNA, 17 nt, Human
cagaacugcgcacgcuc

SEQ ID NO: 83564 - RNA, 20 nt, Human
cagaacugcuguggcugcca

SEQ ID NO: 83565 - RNA, 20 nt, Human
cagaacuggucccugccuca

SEQ ID NO: 83566 - RNA, 32 nt, Human
cagaacuguguggccccugccugugccagcca

SEQ ID NO: 83567 - RNA, 32 nt, Human
cagaacuguuaauaaaaguuaaaggaauuuaa

SEQ ID NO: 83568 - RNA, 32 nt, Human
cagaacuuagcaauuuccgccuggugaugcgc

SEQ ID NO: 83569 - RNA, 32 nt, Human
cagaacuuagggucagggucucagggaacccu

SEQ ID NO: 83570 - RNA, 32 nt, Human
cagaacuuccagccccaggagacuauuagucc

SEQ ID NO: 83571 - RNA, 32 nt, Human
cagaacuuccauucuuuagucauuccaggugg

SEQ ID NO: 83572 - RNA, 32 nt, Human
cagaacuucuccccaccugacccagggcugug

SEQ ID NO: 83573 - RNA, 19 nt, Human
cagaacuugauccuccgca

SEQ ID NO: 83574 - RNA, 32 nt, Human
cagaacuugccugaaacccaguagguguucaa

SEQ ID NO: 83575 - RNA, 32 nt, Human
cagaacuugugucacagggcugcaggacuacc

SEQ ID NO: 83576 - RNA, 32 nt, Human
cagaacuuguguuuuucucaucuuuaaaauac

SEQ ID NO: 83577 - RNA, 32 nt, Human
cagaacuuugggaggccgagacgggcagauca

SEQ ID NO: 83578 - RNA, 32 nt, Human
cagaacuuugggaggccgaggugggaggagcg

SEQ ID NO: 83579 - RNA, 32 nt, Human
cagaacuuugugcccauugaccuagacgagug

SEQ ID NO: 83580 - RNA, 32 nt, Human
cagaagaaaauccaaggcuuuagccaggagcg

SEQ ID NO: 83581 - RNA, 32 nt, Human
cagaagaaacaaaaugguaauuacagaauuag

SEQ ID NO: 83582 - RNA, 32 nt, Human
cagaagaaacaaacuccagacgcaccaccuua

SEQ ID NO: 83583 - RNA, 27 nt, Human
cagaagaaauauaucucuaucucucua

SEQ ID NO: 83584 - RNA, 32 nt, Human
cagaagaacuaucaacuuguggcugggcacgg

SEQ ID NO: 83585 - RNA, 32 nt, Human
cagaagaagaagcagugacggggacacaaauu

SEQ ID NO: 83586 - RNA, 31 nt, Human
cagaagaagagaccugcaacugugagagucc

SEQ ID NO: 83587 - RNA, 32 nt, Human
cagaagaagcuggagugcauagugcggacccu

SEQ ID NO: 83588 - RNA, 22 nt, Human
cagaagaaggcagcagguggca

SEQ ID NO: 83589 - RNA, 32 nt, Human
cagaagaaucccuccuccucacccuaacuucu

SEQ ID NO: 83590 - RNA, 31 nt, Human
cagaagaaugagagagaggaagacugcuggc

SEQ ID NO: 83591 - RNA, 32 nt, Human
cagaagaauggcuugaaccuggaacgcggagg

SEQ ID NO: 83592 - RNA, 32 nt, Human
cagaagacaaaaauggcaucacagacuccuga

SEQ ID NO: 83593 - RNA, 32 nt, Human
cagaagacaaccacuucucuccuuuuagaaag

SEQ ID NO: 83594 - RNA, 32 nt, Human
cagaagacaacgcgagucacaugugaacugua

SEQ ID NO: 83595 - RNA, 32 nt, Human
cagaagacaauuagcagucucugccucccuug

SEQ ID NO: 83596 - RNA, 32 nt, Human
cagaagacacccuucaacccugggaugaccac

SEQ ID NO: 83597 - RNA, 32 nt, Human
cagaagacacuccuggccaucuguggauuugu

SEQ ID NO: 83598 - RNA, 32 nt, Human
cagaagacacuggccuggggaugagacucggg

SEQ ID NO: 83599 - RNA, 32 nt, Human
cagaagacagaagggaaaggaaaagcucaaug

SEQ ID NO: 83600 - RNA, 23 nt, Human
cagaagacagcugcugggucagg

SEQ ID NO: 83601 - RNA, 32 nt, Human
cagaagacagugacagauguguuugcaaggcu

SEQ ID NO: 83602 - RNA, 32 nt, Human
cagaagacaugaucauuagccauaagaaacuc

SEQ ID NO: 83603 - RNA, 32 nt, Human
cagaagaccagaaagcaccuaccucccuaagc

SEQ ID NO: 83604 - RNA, 32 nt, Human
cagaagaccagcccaggccagcugcuguuucu

SEQ ID NO: 83605 - RNA, 24 nt, Human
cagaagaccugggcuuuugucgaa

SEQ ID NO: 83606 - RNA, 21 nt, Human
cagaagacuacaaaaaugaag

SEQ ID NO: 83607 - RNA, 32 nt, Human
cagaagacuggcagaugggaggagggaagaag

SEQ ID NO: 83608 - RNA, 32 nt, Human
cagaagagaaggaggagggggcagcuggcuau

SEQ ID NO: 83609 - RNA, 19 nt, Human
cagaagagacaugcagcag

SEQ ID NO: 83610 - RNA, 32 nt, Human
cagaagagacuagagaccuuaggccaggagau

SEQ ID NO: 83611 - RNA, 32 nt, Human
cagaagagacuauauuggaauauuuacagcuu

SEQ ID NO: 83612 - RNA, 32 nt, Human
cagaagagaggacugugugccuuuaacgagag

SEQ ID NO: 83613 - RNA, 22 nt, Human
cagaagagaggccgggcugcug

SEQ ID NO: 83614 - RNA, 21 nt, Human
cagaagagaggcugccgggac

SEQ ID NO: 83615 - RNA, 32 nt, Human
cagaagagaugauggcaaugcaccuugcaggu

SEQ ID NO: 83616 - RNA, 32 nt, Human
cagaagagccaacugacuuuuccuucaaucuc

SEQ ID NO: 83617 - RNA, 32 nt, Human
cagaagagcccaacuccuucucauagcugacc

SEQ ID NO: 83618 - RNA, 22 nt, Human
cagaagagccucuguccagccc

SEQ ID NO: 83619 - RNA, 24 nt, Human
cagaagagcggaccagggcugcug

SEQ ID NO: 83620 - RNA, 22 nt, Human
cagaagagcucacuggaucaga

SEQ ID NO: 83621 - RNA, 32 nt, Human
cagaagagcugcaguugcuggagcugggcuga

SEQ ID NO: 83622 - RNA, 32 nt, Human
cagaagaggaaaaucacuguuuuugucaagga

SEQ ID NO: 83623 - RNA, 32 nt, Human
cagaagaggaagagaacuucguguggccugca

SEQ ID NO: 83624 - RNA, 32 nt, Human
cagaagaggaagagaugagggaaggccuggcu

SEQ ID NO: 83625 - RNA, 32 nt, Human
cagaagaggaaggcagggaucccacuacgagc

SEQ ID NO: 83626 - RNA, 32 nt, Human
cagaagaggagucugaggauaacuaaacuuca

SEQ ID NO: 83627 - RNA, 32 nt, Human
cagaagaggagugggagccagcucagagaagg

SEQ ID NO: 83628 - RNA, 21 nt, Human
cagaagaggcaguggcugcug

SEQ ID NO: 83629 - RNA, 32 nt, Human
cagaagaggccaugugucucagagcuguuaag

SEQ ID NO: 83630 - RNA, 32 nt, Human
cagaagaggccuuucccaucuggagagaagcu

SEQ ID NO: 83631 - RNA, 32 nt, Human
cagaagagggaagcccgagggagcuggcauug

SEQ ID NO: 83632 - RNA, 32 nt, Human
cagaagagggaggcuuccugacugacacaggc

SEQ ID NO: 83633 - RNA, 31 nt, Human
cagaagaggguggaagaugaaaugaaagcua

SEQ ID NO: 83634 - RNA, 32 nt, Human
cagaagagucgaugaucaccaagcaggaaagg

SEQ ID NO: 83635 - RNA, 29 nt, Human
cagaagagucuaauugugccuggauuucu

SEQ ID NO: 83636 - RNA, 32 nt, Human
cagaagaguuugggccucacacaaaggcugug

SEQ ID NO: 83637 - RNA, 21 nt, Human
cagaagauaagaguucacuga

SEQ ID NO: 83638 - RNA, 32 nt, Human
cagaagauacaaaaauuggcugggcguugugg

SEQ ID NO: 83639 - RNA, 22 nt, Human
cagaagauaguaggaucacaga

SEQ ID NO: 83640 - RNA, 32 nt, Human
cagaagaucaugcagucaucagucccacggag

SEQ ID NO: 83641 - RNA, 19 nt, Human
cagaagaucgcgggccagg

SEQ ID NO: 83642 - RNA, 32 nt, Human
cagaagaucugaagacauuuaagacccaaucc

SEQ ID NO: 83643 - RNA, 32 nt, Human
cagaagauggaagaaugggcucaccugaugcu

SEQ ID NO: 83644 - RNA, 32 nt, Human
cagaagauggcagacuacucaaacaaacucua

SEQ ID NO: 83645 - RNA, 32 nt, Human
cagaagauggccagguccaucccgcugccccu

SEQ ID NO: 83646 - RNA, 32 nt, Human
cagaagcaaccuuuuucccucuucccagaaaa

SEQ ID NO: 83647 - RNA, 20 nt, Human
cagaagcaagugcucaggga

SEQ ID NO: 83648 - RNA, 32 nt, Human
cagaagcaaucagaaggaaacuuccucagacu

SEQ ID NO: 83649 - RNA, 32 nt, Human
cagaagcacaagugccuucagagggcaguuga

SEQ ID NO: 83650 - RNA, 32 nt, Human
cagaagcacaugcaccuacccauacacccccu

SEQ ID NO: 83651 - RNA, 21 nt, Human
cagaagcaccagcggcugcug

SEQ ID NO: 83652 - RNA, 32 nt, Human
cagaagcacccuguccccuccuccccaggccu

SEQ ID NO: 83653 - RNA, 27 nt, Human
cagaagcaccuaugaaucuguccccca

SEQ ID NO: 83654 - RNA, 32 nt, Human
cagaagcaccuuggcauagagcacccaggcau

SEQ ID NO: 83655 - RNA, 19 nt, Human
cagaagcacggcgcccagg

SEQ ID NO: 83656 - RNA, 32 nt, Human
cagaagcacuagaccaggacgaccuccagcgc

SEQ ID NO: 83657 - RNA, 32 nt, Human
cagaagcacucauagcucuuuuaggcagaaga

SEQ ID NO: 83658 - RNA, 32 nt, Human
cagaagcagaacuugaagguuaaaccacuagc

SEQ ID NO: 83659 - RNA, 32 nt, Human
cagaagcagacaccuccagugaacuagcaaag

SEQ ID NO: 83660 - RNA, 32 nt, Human
cagaagcagagcugugguuuugaagauuuucc

SEQ ID NO: 83661 - RNA, 32 nt, Human
cagaagcagagcuuuguuuuggagguucuguc

SEQ ID NO: 83662 - RNA, 22 nt, Human
cagaagcagagguagaaucagg

SEQ ID NO: 83663 - RNA, 32 nt, Human
cagaagcagcauccuccacuuguucagggcuu

SEQ ID NO: 83664 - RNA, 32 nt, Human
cagaagcagcauggacaagaaggcuggggcug

SEQ ID NO: 83665 - RNA, 21 nt, Human
cagaagcagccgggggcgcug

SEQ ID NO: 83666 - RNA, 21 nt, Human
cagaagcagcuguggucccug

SEQ ID NO: 83667 - RNA, 32 nt, Human
cagaagcaggguggaggggaagggugggucuc

SEQ ID NO: 83668 - RNA, 32 nt, Human
cagaagcaguaugaccuuuacccugugacccg

SEQ ID NO: 83669 - RNA, 32 nt, Human
cagaagcaguggcagaagcaguagaagaccag

SEQ ID NO: 83670 - RNA, 23 nt, Human
cagaagcagugugagcagggcug

SEQ ID NO: 83671 - RNA, 32 nt, Human
cagaagcauacuuaauguuaaagagauacugc

SEQ ID NO: 83672 - RNA, 32 nt, Human
cagaagcauagcguguaccgaaaaugaagacu

SEQ ID NO: 83673 - RNA, 32 nt, Human
cagaagcaucacugcagugaaagucucugcuu

SEQ ID NO: 83674 - RNA, 32 nt, Human
cagaagcaugcgcuggugucuccuccugaucu

SEQ ID NO: 83675 - RNA, 22 nt, Human
cagaagcauucaggcacugcca

SEQ ID NO: 83676 - RNA, 32 nt, Human
cagaagccaacgaggggacuguuucucuucca

SEQ ID NO: 83677 - RNA, 32 nt, Human
cagaagccagagccaugggccaggagguccug

SEQ ID NO: 83678 - RNA, 32 nt, Human
cagaagccagaggcggguuugguaguggcuaa

SEQ ID NO: 83679 - RNA, 21 nt, Human
cagaagccagagggccaggga

SEQ ID NO: 83680 - RNA, 32 nt, Human
cagaagccaugacuccccaacucugccuguau

SEQ ID NO: 83681 - RNA, 22 nt, Human
cagaagccauucagcucaggga

SEQ ID NO: 83682 - RNA, 20 nt, Human
cagaagcccagaccugggga

SEQ ID NO: 83683 - RNA, 32 nt, Human
cagaagcccagagggggccugggaccuggcag

SEQ ID NO: 83684 - RNA, 22 nt, Human
cagaagcccaggcggcccgggg

SEQ ID NO: 83685 - RNA, 23 nt, Human
cagaagcccaggcgggcccgggg

SEQ ID NO: 83686 - RNA, 20 nt, Human
cagaagcccaggggcucagg

SEQ ID NO: 83687 - RNA, 23 nt, Human
cagaagcccaucuuaguuagggg

SEQ ID NO: 83688 - RNA, 19 nt, Human
cagaagcccaugggcaggg

SEQ ID NO: 83689 - RNA, 32 nt, Human
cagaagccccagcacugugcagaugcucuugg

SEQ ID NO: 83690 - RNA, 18 nt, Human
cagaagccccaggccucc

SEQ ID NO: 83691 - RNA, 32 nt, Human
cagaagcccccacaugggggcucuaggaaugc

SEQ ID NO: 83692 - RNA, 21 nt, Human
cagaagccccugcccacggga

SEQ ID NO: 83693 - RNA, 20 nt, Human
cagaagccccugcccaguga

SEQ ID NO: 83694 - RNA, 20 nt, Human
cagaagcccggggccaggga

SEQ ID NO: 83695 - RNA, 20 nt, Human
cagaagcccguuuccuuccc

SEQ ID NO: 83696 - RNA, 22 nt, Human
cagaagcccuaggucccagagg

SEQ ID NO: 83697 - RNA, 32 nt, Human
cagaagcccucgggaggcucggucacaaucuc

SEQ ID NO: 83698 - RNA, 20 nt, Human
cagaagcccugaccuaagga

SEQ ID NO: 83699 - RNA, 26 nt, Human
cagaagcccugauguguccucaggga

SEQ ID NO: 83700 - RNA, 32 nt, Human
cagaagcccugcacguggccagcuggggagau

SEQ ID NO: 83701 - RNA, 32 nt, Human
cagaagcccugcugucugucugugcccaagcc

SEQ ID NO: 83702 - RNA, 32 nt, Human
cagaagcccuggcugcgcaucgaugccagaca

SEQ ID NO: 83703 - RNA, 32 nt, Human
cagaagcccuucuccccgcugggcugacagac

SEQ ID NO: 83704 - RNA, 21 nt, Human
cagaagccgcaguuucagggg

SEQ ID NO: 83705 - RNA, 24 nt, Human
cagaagccgcgaggcccucaggga

SEQ ID NO: 83706 - RNA, 32 nt, Human
cagaagccgcuuccucuccacugaagagcuau

SEQ ID NO: 83707 - RNA, 31 nt, Human
cagaagccguuucucaucaugccaagccaac

SEQ ID NO: 83708 - RNA, 32 nt, Human
cagaagccucacugggcugcuaugucucugua

SEQ ID NO: 83709 - RNA, 21 nt, Human
cagaagccugcgaccuuggga

SEQ ID NO: 83710 - RNA, 26 nt, Human
cagaagccugcggacccgcccaggga

SEQ ID NO: 83711 - RNA, 19 nt, Human
cagaagccugggcuuaggg

SEQ ID NO: 83712 - RNA, 32 nt, Human
cagaagccugggugccuggcuggcugagggca

SEQ ID NO: 83713 - RNA, 23 nt, Human
cagaagccuggucugugccuagg

SEQ ID NO: 83714 - RNA, 32 nt, Human
cagaagccuggugcccuggcgacacuggaccu

SEQ ID NO: 83715 - RNA, 32 nt, Human
cagaagccuuuacccauccugagacucaguuc

SEQ ID NO: 83716 - RNA, 31 nt, Human
cagaagcggcagccaccgaggagggagcagu

SEQ ID NO: 83717 - RNA, 24 nt, Human
cagaagcggcguuugcggccgcug

SEQ ID NO: 83718 - RNA, 22 nt, Human
cagaagcggcuaguggcggcug

SEQ ID NO: 83719 - RNA, 21 nt, Human
cagaagcggcugccagcucug

SEQ ID NO: 83720 - RNA, 19 nt, Human
cagaagcggcuuugcugcu

SEQ ID NO: 83721 - RNA, 32 nt, Human
cagaagcggggugggagggugugcaugcuagu

SEQ ID NO: 83722 - RNA, 21 nt, Human
cagaagcguccugugacucug

SEQ ID NO: 83723 - RNA, 32 nt, Human
cagaagcguggaggaaagauuaugaaaggaac

SEQ ID NO: 83724 - RNA, 23 nt, Human
cagaagcgugguccugcggcugc

SEQ ID NO: 83725 - RNA, 24 nt, Human
cagaagcucacucuuuuccaggga

SEQ ID NO: 83726 - RNA, 32 nt, Human
cagaagcucacugcuuuggcccccuuacucuu

SEQ ID NO: 83727 - RNA, 24 nt, Human
cagaagcuccagcauuugcccagg

SEQ ID NO: 83728 - RNA, 32 nt, Human
cagaagcucccagggaauaaugguggcgaguu

SEQ ID NO: 83729 - RNA, 32 nt, Human
cagaagcuccccaggcucuagugcaggaggag

SEQ ID NO: 83730 - RNA, 18 nt, Human
cagaagcuccuucaggaa

SEQ ID NO: 83731 - RNA, 32 nt, Human
cagaagcuccuugguuuaaccagcacagagaa

SEQ ID NO: 83732 - RNA, 20 nt, Human
cagaagcucggcgcgaggga

SEQ ID NO: 83733 - RNA, 32 nt, Human
cagaagcucugcccuucuguauccuauguaug

SEQ ID NO: 83734 - RNA, 22 nt, Human
cagaagcugaagacaacaccug

SEQ ID NO: 83735 - RNA, 20 nt, Human
cagaagcugagcaccagggg

SEQ ID NO: 83736 - RNA, 32 nt, Human
cagaagcugcauuuugccaagaucccagggaa

SEQ ID NO: 83737 - RNA, 24 nt, Human
cagaagcugccuguugccugugga

SEQ ID NO: 83738 - RNA, 26 nt, Human
cagaagcugcuaggcugaggcugcug

SEQ ID NO: 83739 - RNA, 32 nt, Human
cagaagcugcucuaggaguuccuggccaguca

SEQ ID NO: 83740 - RNA, 32 nt, Human
cagaagcuggacugcaguccacggcaccacuc

SEQ ID NO: 83741 - RNA, 27 nt, Human
cagaagcuggacuuccgccugcagcag

SEQ ID NO: 83742 - RNA, 32 nt, Human
cagaagcugggaaggaccaagccucagcaccc

SEQ ID NO: 83743 - RNA, 32 nt, Human
cagaagcugggccuuccgccucccuuggaugg

SEQ ID NO: 83744 - RNA, 32 nt, Human
cagaagcuggggaggugagagugcagaaagga

SEQ ID NO: 83745 - RNA, 32 nt, Human
cagaagcuggggaggugagagugcuagaaagg

SEQ ID NO: 83746 - RNA, 21 nt, Human
cagaagcuggggcccagcgga

SEQ ID NO: 83747 - RNA, 32 nt, Human
cagaagcugugugcucaauggaagaggaugac

SEQ ID NO: 83748 - RNA, 32 nt, Human
cagaagcuguuuugcucagagcuggauuagga

SEQ ID NO: 83749 - RNA, 32 nt, Human
cagaagcuucaaaaucugaaucuuuuugagca

SEQ ID NO: 83750 - RNA, 32 nt, Human
cagaagcuuccucugggcucagacucaggcug

SEQ ID NO: 83751 - RNA, 22 nt, Human
cagaagcuucgaggcccagcga

SEQ ID NO: 83752 - RNA, 32 nt, Human
cagaagcuuggacagcaagugggagucagcag

SEQ ID NO: 83753 - RNA, 32 nt, Human
cagaagcuuuagagguaugaggcugcagaacc

SEQ ID NO: 83754 - RNA, 32 nt, Human
cagaagcuuuuugacagaaacucucucccagu

SEQ ID NO: 83755 - RNA, 20 nt, Human
cagaaggaacccuccagucc

SEQ ID NO: 83756 - RNA, 32 nt, Human
cagaaggaacucagaggagucaaguggucaaa

SEQ ID NO: 83757 - RNA, 32 nt, Human
cagaaggaagcaacaaagacagcaacugaaca

SEQ ID NO: 83758 - RNA, 32 nt, Human
cagaaggaagguuuagaaagaaaagaacacuu

SEQ ID NO: 83759 - RNA, 23 nt, Human
cagaaggaaucuauucucagcag

SEQ ID NO: 83760 - RNA, 18 nt, Human
cagaaggaaucugugcag

SEQ ID NO: 83761 - RNA, 32 nt, Human
cagaaggaaugcugggggcagucaugucccag

SEQ ID NO: 83762 - RNA, 18 nt, Human
cagaaggaauggguccag

SEQ ID NO: 83763 - RNA, 32 nt, Human
cagaaggacagacggacccaggagggagggca

SEQ ID NO: 83764 - RNA, 32 nt, Human
cagaaggacaggcuguguuuggguauauguac

SEQ ID NO: 83765 - RNA, 31 nt, Human
cagaaggaccuacuggagcagauguggccga

SEQ ID NO: 83766 - RNA, 32 nt, Human
cagaaggacggcaggaguguccuggcugugaa

SEQ ID NO: 83767 - RNA, 32 nt, Human
cagaaggagauggagagcaagagacugcggcu

SEQ ID NO: 83768 - RNA, 21 nt, Human
cagaaggagcaauggcaccug

SEQ ID NO: 83769 - RNA, 32 nt, Human
cagaaggagcacccaccucccucccucuguga

SEQ ID NO: 83770 - RNA, 21 nt, Human
cagaaggagccagggcugcug

SEQ ID NO: 83771 - RNA, 32 nt, Human
cagaaggagccugaggcugagguggaggcugg

SEQ ID NO: 83772 - RNA, 32 nt, Human
cagaaggagcuacaaaaccuacccucaaugag

SEQ ID NO: 83773 - RNA, 21 nt, Human
cagaaggagcuuuugaaaagg

SEQ ID NO: 83774 - RNA, 32 nt, Human
cagaaggaggauugaauuaaagggaaaguguc

SEQ ID NO: 83775 - RNA, 32 nt, Human
cagaaggagucagaggaggaguuagaggagga

SEQ ID NO: 83776 - RNA, 32 nt, Human
cagaaggaugucucagaugaggauguggcucg

SEQ ID NO: 83777 - RNA, 19 nt, Human
cagaaggauugcuggagcc

SEQ ID NO: 83778 - RNA, 19 nt, Human
cagaaggauugcuugagcc

SEQ ID NO: 83779 - RNA, 21 nt, Human
cagaaggauugcuuggaccca

SEQ ID NO: 83780 - RNA, 21 nt, Human
cagaaggauugcuuggagguc

SEQ ID NO: 83781 - RNA, 32 nt, Human
cagaaggcaaaaagacauuaccaugaguaaua

SEQ ID NO: 83782 - RNA, 32 nt, Human
cagaaggcaaagccccagacagcaaauaggga

SEQ ID NO: 83783 - RNA, 32 nt, Human
cagaaggcaaaguuuccauguggccuugagca

SEQ ID NO: 83784 - RNA, 32 nt, Human
cagaaggcaagcaccaggcucacagcuggaac

SEQ ID NO: 83785 - RNA, 32 nt, Human
cagaaggcacaggagcugggccugguggagcu

SEQ ID NO: 83786 - RNA, 18 nt, Human
cagaaggcacccuaggca

SEQ ID NO: 83787 - RNA, 32 nt, Human
cagaaggcacccuggccaugcacaggcaucgc

SEQ ID NO: 83788 - RNA, 32 nt, Human
cagaaggcacugacugaagacaggauggauca

SEQ ID NO: 83789 - RNA, 22 nt, Human
cagaaggcagagguugcagugg

SEQ ID NO: 83790 - RNA, 32 nt, Human
cagaaggcagggucugcuugggcaguugagag

SEQ ID NO: 83791 - RNA, 32 nt, Human
cagaaggcaggugagagaauucuuaggggcug

SEQ ID NO: 83792 - RNA, 32 nt, Human
cagaaggcagugugauuguaacaaaaacaaug

SEQ ID NO: 83793 - RNA, 32 nt, Human
cagaaggcaucauuuauaagacaguauggcag

SEQ ID NO: 83794 - RNA, 32 nt, Human
cagaaggcaucuucucacugugcugcaaaucu

SEQ ID NO: 83795 - RNA, 32 nt, Human
cagaaggccaagcaggacauggccugcaugcu

SEQ ID NO: 83796 - RNA, 32 nt, Human
cagaaggccaaggcccgauguggugugcagag

SEQ ID NO: 83797 - RNA, 32 nt, Human
cagaaggcccauuccucccaccacggggccac

SEQ ID NO: 83798 - RNA, 21 nt, Human
cagaaggccccggccugagga

SEQ ID NO: 83799 - RNA, 20 nt, Human
cagaaggccguggggagugg

SEQ ID NO: 83800 - RNA, 27 nt, Human
cagaaggcgaagaagaaagaaagggga

SEQ ID NO: 83801 - RNA, 32 nt, Human
cagaaggcgcggaccuggaggaggcgccccag

SEQ ID NO: 83802 - RNA, 22 nt, Human
cagaaggcggaggcugcaguga

SEQ ID NO: 83803 - RNA, 32 nt, Human
cagaaggcuacaaccuaguucuggacucggac

SEQ ID NO: 83804 - RNA, 32 nt, Human
cagaaggcucugagacauagcagcaguauccu

SEQ ID NO: 83805 - RNA, 32 nt, Human
cagaaggcuugcuccaaugccacugagcccug

SEQ ID NO: 83806 - RNA, 32 nt, Human
cagaagggaaacugaggcucggcaagcauagg

SEQ ID NO: 83807 - RNA, 32 nt, Human
cagaagggaagguagccagugccugagaagac

SEQ ID NO: 83808 - RNA, 32 nt, Human
cagaagggagagaggcagcaagucagaaaguu

SEQ ID NO: 83809 - RNA, 32 nt, Human
cagaagggagagagggagggcgcaaggggagg

SEQ ID NO: 83810 - RNA, 32 nt, Human
cagaagggagagaguccuuacucccuuccaau

SEQ ID NO: 83811 - RNA, 32 nt, Human
cagaagggaggggaggaaagagacugagggcc

SEQ ID NO: 83812 - RNA, 32 nt, Human
cagaagggaucucuuuagcuuauguguggauu

SEQ ID NO: 83813 - RNA, 24 nt, Human
cagaagggccuggagagaggggga

SEQ ID NO: 83814 - RNA, 32 nt, Human
cagaagggccuggagagagggggaacgggcag

SEQ ID NO: 83815 - RNA, 32 nt, Human
cagaaggggaaagggaauauugcaaaagggag

SEQ ID NO: 83816 - RNA, 32 nt, Human
cagaaggggagaagaaugacccaaguggaagg

SEQ ID NO: 83817 - RNA, 32 nt, Human
cagaaggggcaggccagguggaaaggagccag

SEQ ID NO: 83818 - RNA, 22 nt, Human
cagaaggggcauggccaccucc

SEQ ID NO: 83819 - RNA, 22 nt, Human
cagaaggggcccacugagccca

SEQ ID NO: 83820 - RNA, 32 nt, Human
cagaagggggcagacggugacuucugaagcug

SEQ ID NO: 83821 - RNA, 25 nt, Human
cagaaggggucugagcagagacauu

SEQ ID NO: 83822 - RNA, 21 nt, Human
cagaagggguucugggccuag

SEQ ID NO: 83823 - RNA, 32 nt, Human
cagaaggguaagagagggcaagagugagcaag

SEQ ID NO: 83824 - RNA, 32 nt, Human
cagaaggguuccaucuuguggucagcggggug

SEQ ID NO: 83825 - RNA, 32 nt, Human
cagaagguaggaaaauccuagcuuuccauuug

SEQ ID NO: 83826 - RNA, 32 nt, Human
cagaagguauauuauugugaauucugggaugg

SEQ ID NO: 83827 - RNA, 32 nt, Human
cagaaggucaccagagagcuuucagcugaggg

SEQ ID NO: 83828 - RNA, 32 nt, Human
cagaaggucaggaauuuuuggagaccuuucuc

SEQ ID NO: 83829 - RNA, 32 nt, Human
cagaaggugaagacaucuagaaacauuacacc

SEQ ID NO: 83830 - RNA, 32 nt, Human
cagaaggugagcuguuguuuuucuaaaccucu

SEQ ID NO: 83831 - RNA, 32 nt, Human
cagaagguggagguggcagugagccgagauca

SEQ ID NO: 83832 - RNA, 22 nt, Human
cagaagguggagguugcaguga

SEQ ID NO: 83833 - RNA, 32 nt, Human
cagaaggugggccgcuuccuguggaagaggga

SEQ ID NO: 83834 - RNA, 24 nt, Human
cagaaggugggcggcaggaucaga

SEQ ID NO: 83835 - RNA, 19 nt, Human
cagaagguuccugcagcag

SEQ ID NO: 83836 - RNA, 32 nt, Human
cagaagguuuggagugacagcuccuuucuucu

SEQ ID NO: 83837 - RNA, 32 nt, Human
cagaaguaaauacauuugacccuugagcaaca

SEQ ID NO: 83838 - RNA, 21 nt, Human
cagaaguaacacaggcaccug

SEQ ID NO: 83839 - RNA, 32 nt, Human
cagaaguaacacaggcaccuggagaauacaca

SEQ ID NO: 83840 - RNA, 32 nt, Human
cagaaguaagcaagguuuccugccgggagaaa

SEQ ID NO: 83841 - RNA, 32 nt, Human
cagaaguaccuuugcacuccugguuuucagug

SEQ ID NO: 83842 - RNA, 20 nt, Human
cagaaguacuuccccaggga

SEQ ID NO: 83843 - RNA, 32 nt, Human
cagaaguagcuucaggacagaagauugcugua

SEQ ID NO: 83844 - RNA, 32 nt, Human
cagaaguaguaggaagugagcuguucagaggc

SEQ ID NO: 83845 - RNA, 31 nt, Human
cagaaguagugagucaguguggaagagaggu

SEQ ID NO: 83846 - RNA, 32 nt, Human
cagaaguauauugagucagugccggcugcguu

SEQ ID NO: 83847 - RNA, 32 nt, Human
cagaagucaaauaccagccauaucaguagagc

SEQ ID NO: 83848 - RNA, 32 nt, Human
cagaagucaaugauuguugaagcagaaugguu

SEQ ID NO: 83849 - RNA, 23 nt, Human
cagaagucacgagggccucugcc

SEQ ID NO: 83850 - RNA, 32 nt, Human
cagaagucagcagcagaaacgacaaggcacuu

SEQ ID NO: 83851 - RNA, 32 nt, Human
cagaagucagccgcaauccaggcacaggacga

SEQ ID NO: 83852 - RNA, 32 nt, Human
cagaagucaguggcugcucaccagagaggggc

SEQ ID NO: 83853 - RNA, 32 nt, Human
cagaagucauuuucagccuuaauucucaucau

SEQ ID NO: 83854 - RNA, 32 nt, Human
cagaaguccaagaauacagcuguagggucauu

SEQ ID NO: 83855 - RNA, 32 nt, Human
cagaaguccauuggaauauuaagcccaggagu

SEQ ID NO: 83856 - RNA, 32 nt, Human
cagaaguccucgggguuccuucucacaacucu

SEQ ID NO: 83857 - RNA, 32 nt, Human
cagaaguccugucacuugccccugcuguuagg

SEQ ID NO: 83858 - RNA, 20 nt, Human
cagaagucuaggcccaggga

SEQ ID NO: 83859 - RNA, 20 nt, Human
cagaagucucagaggcaccu

SEQ ID NO: 83860 - RNA, 32 nt, Human
cagaagucuccuccuccaugaucacuuuggaa

SEQ ID NO: 83861 - RNA, 23 nt, Human
cagaagugaacuaugggcugcug

SEQ ID NO: 83862 - RNA, 25 nt, Human
cagaagugaagagaaaagaggagga

SEQ ID NO: 83863 - RNA, 32 nt, Human
cagaagugaauuaguuuccaccagggaccccu

SEQ ID NO: 83864 - RNA, 32 nt, Human
cagaagugagagaacugaagauuccuggugcu

SEQ ID NO: 83865 - RNA, 32 nt, Human
cagaagugagccacuguaccuggccuuuugga

SEQ ID NO: 83866 - RNA, 32 nt, Human
cagaagugagccacuguguccugccuaaaaug

SEQ ID NO: 83867 - RNA, 32 nt, Human
cagaagugaggcagcugccucccucccaaccu

SEQ ID NO: 83868 - RNA, 32 nt, Human
cagaagugcaccaccacacccgguuaauuuuu

SEQ ID NO: 83869 - RNA, 32 nt, Human
cagaagugcagaacugcagucacugcacguuu

SEQ ID NO: 83870 - RNA, 21 nt, Human
cagaagugcauggcccaucgu

SEQ ID NO: 83871 - RNA, 20 nt, Human
cagaagugccagccugggga

SEQ ID NO: 83872 - RNA, 32 nt, Human
cagaagugcuggcuaggaggucucagccucgg

SEQ ID NO: 83873 - RNA, 20 nt, Human
cagaaguggagaggaccaga

SEQ ID NO: 83874 - RNA, 21 nt, Human
cagaaguggagcugcagcugc

SEQ ID NO: 83875 - RNA, 32 nt, Human
cagaaguggaucaccugcugguggaaaugugg

SEQ ID NO: 83876 - RNA, 21 nt, Human
cagaaguggcacaaaaccccu

SEQ ID NO: 83877 - RNA, 29 nt, Human
cagaaguggcugcuagaucucucuccuuu

SEQ ID NO: 83878 - RNA, 32 nt, Human
cagaagugggggaaaauuuuuagaagaaaagc

SEQ ID NO: 83879 - RNA, 32 nt, Human
cagaagugguggaaauuggcagcugggguacu

SEQ ID NO: 83880 - RNA, 32 nt, Human
cagaaguucaggaauuuuuggacaccuuucuc

SEQ ID NO: 83881 - RNA, 32 nt, Human
cagaaguuccacugcacuccagccuggguuac

SEQ ID NO: 83882 - RNA, 32 nt, Human
cagaaguuccaggacugguuuuccaguacauc

SEQ ID NO: 83883 - RNA, 32 nt, Human
cagaaguugccuggcuuggcacucucugcggu

SEQ ID NO: 83884 - RNA, 32 nt, Human
cagaaguuguguuguuguuuugcuguuuaucu

SEQ ID NO: 83885 - RNA, 32 nt, Human
cagaaguuuccuguagcccuugagugacuuug

SEQ ID NO: 83886 - RNA, 32 nt, Human
cagaaguuucucagcucccaaggcucugagca

SEQ ID NO: 83887 - RNA, 32 nt, Human
cagaaguuugagaccagccuaggcaacauugc

SEQ ID NO: 83888 - RNA, 32 nt, Human
cagaaguuuuaucacccacuuuauggacggaa

SEQ ID NO: 83889 - RNA, 21 nt, Human
cagaauaaaggaagaagggga

SEQ ID NO: 83890 - RNA, 19 nt, Human
cagaauaaauacuuuuaua

SEQ ID NO: 83891 - RNA, 19 nt, Human
cagaauaacuuuccaggaa

SEQ ID NO: 83892 - RNA, 32 nt, Human
cagaauaagaguacugacuaagcugccugaaa

SEQ ID NO: 83893 - RNA, 32 nt, Human
cagaauaagucuaaaggcagagccccagccuc

SEQ ID NO: 83894 - RNA, 32 nt, Human
cagaauacagcagauggcccuucugaacaugu

SEQ ID NO: 83895 - RNA, 32 nt, Human
cagaauagcagucccuggauggcagucugccu

SEQ ID NO: 83896 - RNA, 32 nt, Human
cagaauagcuaggaguaggaguagcugggacu

SEQ ID NO: 83897 - RNA, 18 nt, Human
cagaauagcugggcccag

SEQ ID NO: 83898 - RNA, 32 nt, Human
cagaauaggaacagguguuugcucuccuaaga

SEQ ID NO: 83899 - RNA, 32 nt, Human
cagaauaggaagagaggaagaacuuacaaaga

SEQ ID NO: 83900 - RNA, 32 nt, Human
cagaauagggagaaggaggagaggggaggcug

SEQ ID NO: 83901 - RNA, 32 nt, Human
cagaauagggcuggggcagcucccagagaaug

SEQ ID NO: 83902 - RNA, 21 nt, Human
cagaauaguaccuuacauuug

SEQ ID NO: 83903 - RNA, 32 nt, Human
cagaauauacagaaagcaacaaacuucguaaa

SEQ ID NO: 83904 - RNA, 32 nt, Human
cagaauaucuuuccaaggauguuugcauagug

SEQ ID NO: 83905 - RNA, 32 nt, Human
cagaauaugcuuguuggagauccuucaggcag

SEQ ID NO: 83906 - RNA, 32 nt, Human
cagaauaugucuucugugucaugguggcauuu

SEQ ID NO: 83907 - RNA, 21 nt, Human
cagaaucaaaacucucugccu

SEQ ID NO: 83908 - RNA, 32 nt, Human
cagaaucaagugagcccaggaguucagggcca

SEQ ID NO: 83909 - RNA, 32 nt, Human
cagaaucaaugugagacaacacuacugggugu

SEQ ID NO: 83910 - RNA, 19 nt, Human
cagaaucaggagaaagaug

SEQ ID NO: 83911 - RNA, 23 nt, Human
cagaaucagguucauccagagga

SEQ ID NO: 83912 - RNA, 32 nt, Human
cagaaucagugccuagccugugcccagcaaau

SEQ ID NO: 83913 - RNA, 21 nt, Human
cagaaucauacucuccaggaa

SEQ ID NO: 83914 - RNA, 32 nt, Human
cagaaucaucaccagagacaccugccggcuga

SEQ ID NO: 83915 - RNA, 32 nt, Human
cagaaucaucaucugcaucuggagauuuccac

SEQ ID NO: 83916 - RNA, 32 nt, Human
cagaaucaucaucugugaugaugguguccuuu

SEQ ID NO: 83917 - RNA, 32 nt, Human
cagaaucaugcuguucucuuugcugacacugu

SEQ ID NO: 83918 - RNA, 32 nt, Human
cagaaucauggagaaaaugggcggggguggug

SEQ ID NO: 83919 - RNA, 32 nt, Human
cagaaucauggugggaggcaaaagacacuucu

SEQ ID NO: 83920 - RNA, 23 nt, Human
cagaaucauuauaaaucccagua

SEQ ID NO: 83921 - RNA, 23 nt, Human
cagaauccaagaucugccaggaa

SEQ ID NO: 83922 - RNA, 32 nt, Human
cagaauccaggguucaccuaagcugcacaguu

SEQ ID NO: 83923 - RNA, 32 nt, Human
cagaauccauggcuggaagagguaguaaggcc

SEQ ID NO: 83924 - RNA, 22 nt, Human
cagaaucccagaauucuaggaa

SEQ ID NO: 83925 - RNA, 21 nt, Human
cagaaucccuauacaauguga

SEQ ID NO: 83926 - RNA, 32 nt, Human
cagaaucccuggaagagaaggaaggcagggug

SEQ ID NO: 83927 - RNA, 24 nt, Human
cagaaucccuuguaucuccuuucu

SEQ ID NO: 83928 - RNA, 19 nt, Human
cagaauccggcuccaggaa

SEQ ID NO: 83929 - RNA, 32 nt, Human
cagaauccucucucccccucccaagcugggga

SEQ ID NO: 83930 - RNA, 32 nt, Human
cagaauccuuuuccucuuuuccuuccuccucu

SEQ ID NO: 83931 - RNA, 32 nt, Human
cagaaucgaacucugcacuucucucuccuuua

SEQ ID NO: 83932 - RNA, 24 nt, Human
cagaaucgauuauuccucagguga

SEQ ID NO: 83933 - RNA, 32 nt, Human
cagaaucgcccaggccaggcuguggcagauga

SEQ ID NO: 83934 - RNA, 32 nt, Human
cagaaucuaaaucaaguauuuugaaggaagca

SEQ ID NO: 83935 - RNA, 17 nt, Human
cagaaucuaagcaggaa

SEQ ID NO: 83936 - RNA, 18 nt, Human
cagaaucuacccaaagga

SEQ ID NO: 83937 - RNA, 21 nt, Human
cagaaucuauauccucaggaa

SEQ ID NO: 83938 - RNA, 32 nt, Human
cagaaucucaaggagcugcuggccgucagggc

SEQ ID NO: 83939 - RNA, 32 nt, Human
cagaaucucacuccagccugggcaacagaaug

SEQ ID NO: 83940 - RNA, 32 nt, Human
cagaaucucagggcuuauccuagaagguggug

SEQ ID NO: 83941 - RNA, 32 nt, Human
cagaaucuccagaacaaggaggagguggugau

SEQ ID NO: 83942 - RNA, 19 nt, Human
cagaaucuccaucccugaa

SEQ ID NO: 83943 - RNA, 32 nt, Human
cagaaucuccaucccugaaauuucucauuagu

SEQ ID NO: 83944 - RNA, 19 nt, Human
cagaaucuccuucuuuccu

SEQ ID NO: 83945 - RNA, 19 nt, Human
cagaaucucugcccaggag

SEQ ID NO: 83946 - RNA, 19 nt, Human
cagaaucugaacccaggaa

SEQ ID NO: 83947 - RNA, 32 nt, Human
cagaaucugcauuuuaacaagauccccaggug

SEQ ID NO: 83948 - RNA, 32 nt, Human
cagaaucugcauuuuaacaagaugccugggug

SEQ ID NO: 83949 - RNA, 32 nt, Human
cagaaucugcccuuccccaaccuugguuucuc

SEQ ID NO: 83950 - RNA, 32 nt, Human
cagaaucugccgccccuccaucuucuaccucu

SEQ ID NO: 83951 - RNA, 32 nt, Human
cagaaucugccuggcgggcgcuggagccugcg

SEQ ID NO: 83952 - RNA, 32 nt, Human
cagaaucugcuaccugaggcuccagggccuug

SEQ ID NO: 83953 - RNA, 32 nt, Human
cagaaucuggaacugggcuucugugauucaaa

SEQ ID NO: 83954 - RNA, 32 nt, Human
cagaaucugucacccaggcuggagugcagugg

SEQ ID NO: 83955 - RNA, 18 nt, Human
cagaaucuucacuccagg

SEQ ID NO: 83956 - RNA, 21 nt, Human
cagaaucuucuugcucaggaa

SEQ ID NO: 83957 - RNA, 19 nt, Human
cagaaucuugacccaggga

SEQ ID NO: 83958 - RNA, 32 nt, Human
cagaaucuuugcuggucccuuuaaugcugauu

SEQ ID NO: 83959 - RNA, 32 nt, Human
cagaaugaaaccucuuuuccauccagaagcac

SEQ ID NO: 83960 - RNA, 31 nt, Human
cagaaugaacguuucgccugccaaagauaug

SEQ ID NO: 83961 - RNA, 32 nt, Human
cagaaugaagaaagucagggggacugcaaagg

SEQ ID NO: 83962 - RNA, 32 nt, Human
cagaaugacagagagagaaaaugauucucugc

SEQ ID NO: 83963 - RNA, 32 nt, Human
cagaaugagacacaggaggagccacagccugc

SEQ ID NO: 83964 - RNA, 32 nt, Human
cagaaugagcagagccagcagaacugauggag

SEQ ID NO: 83965 - RNA, 32 nt, Human
cagaaugagcagcugcuacucagccccaaccu

SEQ ID NO: 83966 - RNA, 32 nt, Human
cagaaugagggggacaauuccacccacucgag

SEQ ID NO: 83967 - RNA, 17 nt, Human
cagaaugagugucauug

SEQ ID NO: 83968 - RNA, 32 nt, Human
cagaaugaugagugagacucaggaggcacgac

SEQ ID NO: 83969 - RNA, 18 nt, Human
cagaaugaugccuccaua

SEQ ID NO: 83970 - RNA, 32 nt, Human
cagaaugauuuguuuuauucauugacuuuucc

SEQ ID NO: 83971 - RNA, 32 nt, Human
cagaaugcaaaauaaaacuugcagugaaugaa

SEQ ID NO: 83972 - RNA, 32 nt, Human
cagaaugcaaggccgaaggccauucggagcug

SEQ ID NO: 83973 - RNA, 32 nt, Human
cagaaugcaguggugugcaccuguaauccccg

SEQ ID NO: 83974 - RNA, 32 nt, Human
cagaaugccaccaaugccccaggacaggccca

SEQ ID NO: 83975 - RNA, 29 nt, Human
cagaaugcccgugccagccuccuggcccc

SEQ ID NO: 83976 - RNA, 32 nt, Human
cagaaugccggaggggcgcagagcagauccag

SEQ ID NO: 83977 - RNA, 17 nt, Human
cagaaugccucccagga

SEQ ID NO: 83978 - RNA, 18 nt, Human
cagaaugcggcugcggcu

SEQ ID NO: 83979 - RNA, 32 nt, Human
cagaaugcucacugcaccacguucaagccuga

SEQ ID NO: 83980 - RNA, 32 nt, Human
cagaaugcuccugagugguguaggugggggug

SEQ ID NO: 83981 - RNA, 32 nt, Human
cagaaugcugcaacuucucuucucucuggacu

SEQ ID NO: 83982 - RNA, 32 nt, Human
cagaaugcuggguuuauagaugugagccagca

SEQ ID NO: 83983 - RNA, 18 nt, Human
cagaaugcuucacggcug

SEQ ID NO: 83984 - RNA, 32 nt, Human
cagaauggaaacagugggccuggaucaaaguu

SEQ ID NO: 83985 - RNA, 32 nt, Human
cagaauggaaagccagagggaaccugagaauc

SEQ ID NO: 83986 - RNA, 32 nt, Human
cagaauggaagcccugaagucaacacuccaug

SEQ ID NO: 83987 - RNA, 32 nt, Human
cagaauggaccugcccuuucugcuccagacuu

SEQ ID NO: 83988 - RNA, 32 nt, Human
cagaauggaggaggcagguuuagggucuggca

SEQ ID NO: 83989 - RNA, 32 nt, Human
cagaauggcaucaucaaaggcacacaguccaa

SEQ ID NO: 83990 - RNA, 20 nt, Human
cagaauggcauucugucccu

SEQ ID NO: 83991 - RNA, 32 nt, Human
cagaauggcgugaacccaggaggcggagguug

SEQ ID NO: 83992 - RNA, 29 nt, Human
cagaauggcuuccuuuggguggaagagga

SEQ ID NO: 83993 - RNA, 32 nt, Human
cagaaugggaaagacagagguuacagaggagc

SEQ ID NO: 83994 - RNA, 32 nt, Human
cagaaugggaggaggacauggagcugauggag

SEQ ID NO: 83995 - RNA, 32 nt, Human
cagaaugggccagggagguugagugacugaag

SEQ ID NO: 83996 - RNA, 32 nt, Human
cagaauggggguccaccaugagcaacagauuu

SEQ ID NO: 83997 - RNA, 32 nt, Human
cagaaugggugcaguuugaggggccugugugg

SEQ ID NO: 83998 - RNA, 32 nt, Human
cagaaugguagaaaccaggcugugcauaaaaa

SEQ ID NO: 83999 - RNA, 32 nt, Human
cagaauguaacaccccuccccaagcccuuccc

SEQ ID NO: 84000 - RNA, 19 nt, Human
cagaauguccgugccauug

SEQ ID NO: 84001 - RNA, 32 nt, Human
cagaauguccugagacagagaucgugaaagaa

SEQ ID NO: 84002 - RNA, 32 nt, Human
cagaaugucugcuuugggugcgguuuuguacu

SEQ ID NO: 84003 - RNA, 32 nt, Human
cagaaugugaagauguuuaauguuacaguguu

SEQ ID NO: 84004 - RNA, 32 nt, Human
cagaauguucucaaacauguggccucacagga

SEQ ID NO: 84005 - RNA, 32 nt, Human
cagaauguugacuguuaguuuguauagcuuuu

SEQ ID NO: 84006 - RNA, 32 nt, Human
cagaauguuuuuaaaacuuuuugccguguaug

SEQ ID NO: 84007 - RNA, 32 nt, Human
cagaauuaaagacaccagaaguagcagagaag

SEQ ID NO: 84008 - RNA, 32 nt, Human
cagaauuaacagaccucuucuccucaugguac

SEQ ID NO: 84009 - RNA, 32 nt, Human
cagaauuaauugaccauggugauacguuguaa

SEQ ID NO: 84010 - RNA, 19 nt, Human
cagaauuagcuuugcuuca

SEQ ID NO: 84011 - RNA, 32 nt, Human
cagaauuagggaaugcugguuuugaagagcaa

SEQ ID NO: 84012 - RNA, 32 nt, Human
cagaauuaggguaauggaagauggaaagaaga

SEQ ID NO: 84013 - RNA, 32 nt, Human
cagaauuauacuuuaaccccucccagauaugg

SEQ ID NO: 84014 - RNA, 32 nt, Human
cagaauucaaaaccaggcugaguccagcagua

SEQ ID NO: 84015 - RNA, 32 nt, Human
cagaauucaaguuucacaaaucccaaugcugu

SEQ ID NO: 84016 - RNA, 32 nt, Human
cagaauucagcacuacuuaauaguuuauaaau

SEQ ID NO: 84017 - RNA, 22 nt, Human
cagaauuccauggucucaauga

SEQ ID NO: 84018 - RNA, 32 nt, Human
cagaauucccgcaucugcaccugcacucccaa

SEQ ID NO: 84019 - RNA, 32 nt, Human
cagaauuccuucaggauccuucuugcugccag

SEQ ID NO: 84020 - RNA, 32 nt, Human
cagaauucuucaccuucucuuccccuuuccau

SEQ ID NO: 84021 - RNA, 32 nt, Human
cagaauugaggaaaugcaaagugaagaauucu

SEQ ID NO: 84022 - RNA, 32 nt, Human
cagaauugcaagggaggaaggcugggguuaga

SEQ ID NO: 84023 - RNA, 32 nt, Human
cagaauugcuugaacccaggaggcagaggguu

SEQ ID NO: 84024 - RNA, 32 nt, Human
cagaauugcuugaacccagggggcagagguug

SEQ ID NO: 84025 - RNA, 32 nt, Human
cagaauugcuugaacccgggaggcagagauag

SEQ ID NO: 84026 - RNA, 32 nt, Human
cagaauugggcugggaccucucuccccaacug

SEQ ID NO: 84027 - RNA, 32 nt, Human
cagaauuggguauuuaaaguaaauugaggaca

SEQ ID NO: 84028 - RNA, 20 nt, Human
cagaauugucacgucucccu

SEQ ID NO: 84029 - RNA, 32 nt, Human
cagaauuuaggaggcccagugaaaugcaaaug

SEQ ID NO: 84030 - RNA, 32 nt, Human
cagaauuuauauaggaaugugauguuagagaa

SEQ ID NO: 84031 - RNA, 32 nt, Human
cagaauuucuucuuccagggaaacaguuuuug

SEQ ID NO: 84032 - RNA, 19 nt, Human
cagaauuugacacacucca

SEQ ID NO: 84033 - RNA, 32 nt, Human
cagaauuuuccacgaagugcucugagaggugg

SEQ ID NO: 84034 - RNA, 24 nt, Human
cagaauuuuccugggccacugggg

SEQ ID NO: 84035 - RNA, 18 nt, Human
cagaauuuuuaccaggaa

SEQ ID NO: 84036 - RNA, 32 nt, Human
cagacaaaaacuauaacauauuagcugcccua

SEQ ID NO: 84037 - RNA, 22 nt, Human
cagacaaaagguggcacagaca

SEQ ID NO: 84038 - RNA, 32 nt, Human
cagacaaacacuccuauggaaauuuaaaggag

SEQ ID NO: 84039 - RNA, 32 nt, Human
cagacaaagaugaggauccggaccgcuugaaa

SEQ ID NO: 84040 - RNA, 32 nt, Human
cagacaaagcauaccagaucucaccagagagu

SEQ ID NO: 84041 - RNA, 32 nt, Human
cagacaaagucccgugcccuguuuccaaugcc

SEQ ID NO: 84042 - RNA, 24 nt, Human
cagacaaaucgcuccaccaacuaa

SEQ ID NO: 84043 - RNA, 32 nt, Human
cagacaacaugcuggaguacaagucuuggcug

SEQ ID NO: 84044 - RNA, 32 nt, Human
cagacaaccaaaacauauucaaagcagcagcc

SEQ ID NO: 84045 - RNA, 32 nt, Human
cagacaaccacgaccaacuagucccagauaac

SEQ ID NO: 84046 - RNA, 32 nt, Human
cagacaaccaggguccaucaguagagggaacc

SEQ ID NO: 84047 - RNA, 32 nt, Human
cagacaacuccacagcccagagcccaaacuca

SEQ ID NO: 84048 - RNA, 32 nt, Human
cagacaacuucuguuucuucucuuggugaaau

SEQ ID NO: 84049 - RNA, 32 nt, Human
cagacaagaugaacguagaacaugagagauau

SEQ ID NO: 84050 - RNA, 32 nt, Human
cagacaagcacacccaucacauuaauacaaac

SEQ ID NO: 84051 - RNA, 32 nt, Human
cagacaagccaaaaacagagacagggaagaac

SEQ ID NO: 84052 - RNA, 32 nt, Human
cagacaagggaaugccugugggaaggcugcac

SEQ ID NO: 84053 - RNA, 32 nt, Human
cagacaaguuuccaagaguggaacaugguguc

SEQ ID NO: 84054 - RNA, 32 nt, Human
cagacaauacacacccacucgcacaagcuucc

SEQ ID NO: 84055 - RNA, 32 nt, Human
cagacaauggcccaggucucucaacuucauca

SEQ ID NO: 84056 - RNA, 32 nt, Human
cagacaauguuguguuuggauuuguaacuguu

SEQ ID NO: 84057 - RNA, 32 nt, Human
cagacacaacuggccacuggguggugcacaag

SEQ ID NO: 84058 - RNA, 32 nt, Human
cagacacaacuucuuccugcugcuccagucgu

SEQ ID NO: 84059 - RNA, 32 nt, Human
cagacacaagcgcgcacacaggcuccgcacac

SEQ ID NO: 84060 - RNA, 32 nt, Human
cagacacaaugguucaugcccaaaaggaacag

SEQ ID NO: 84061 - RNA, 32 nt, Human
cagacacacaaaccccagcucauccaguccug

SEQ ID NO: 84062 - RNA, 32 nt, Human
cagacacacggguggacaggaggcagagcucg

SEQ ID NO: 84063 - RNA, 32 nt, Human
cagacacagaacauaucaucacugcagauagu

SEQ ID NO: 84064 - RNA, 19 nt, Human
cagacacagcaaguuccuu

SEQ ID NO: 84065 - RNA, 32 nt, Human
cagacacaggugccucacgccuguaaucccag

SEQ ID NO: 84066 - RNA, 32 nt, Human
cagacacauacgcacacacgugcacacaugua

SEQ ID NO: 84067 - RNA, 32 nt, Human
cagacacauagaugcucaccagccuggcuuag

SEQ ID NO: 84068 - RNA, 32 nt, Human
cagacacauuggugcaugcacacacaccccac

SEQ ID NO: 84069 - RNA, 32 nt, Human
cagacaccaaggugaagagcuacugaaucuug

SEQ ID NO: 84070 - RNA, 32 nt, Human
cagacaccaccaaguucucugccugcaaaacc

SEQ ID NO: 84071 - RNA, 32 nt, Human
cagacaccaggauaaacuccugauggggaaga

SEQ ID NO: 84072 - RNA, 32 nt, Human
cagacaccaggccaggcuugagagacagaacu

SEQ ID NO: 84073 - RNA, 32 nt, Human
cagacacccacugccugucucacuucugucag

SEQ ID NO: 84074 - RNA, 32 nt, Human
cagacacccacuugaugccacagccaugccau

SEQ ID NO: 84075 - RNA, 32 nt, Human
cagacacccccaccccugccuccuccagaccc

SEQ ID NO: 84076 - RNA, 32 nt, Human
cagacaccccuucacguguauccccacacaaa

SEQ ID NO: 84077 - RNA, 32 nt, Human
cagacacccugagauggacccuuguccagggg

SEQ ID NO: 84078 - RNA, 27 nt, Human
cagacaccuaaccccagggcacugcca

SEQ ID NO: 84079 - RNA, 32 nt, Human
cagacaccuauuacagagccaggaugaaaugu

SEQ ID NO: 84080 - RNA, 32 nt, Human
cagacaccucucuucagggaagaugagucuga

SEQ ID NO: 84081 - RNA, 32 nt, Human
cagacacgcagggagaaggcagccgugugaag

SEQ ID NO: 84082 - RNA, 32 nt, Human
cagacacgcaugcacacacgcagaggugcaga

SEQ ID NO: 84083 - RNA, 32 nt, Human
cagacacguggguuucaucacucugaggggcc

SEQ ID NO: 84084 - RNA, 19 nt, Human
cagacacuaaguuauagua

SEQ ID NO: 84085 - RNA, 32 nt, Human
cagacacuaugcugccucccauggcccugccc

SEQ ID NO: 84086 - RNA, 19 nt, Human
cagacacucagcccucccc

SEQ ID NO: 84087 - RNA, 31 nt, Human
cagacacucaguaaauagcuguugaaugaau

SEQ ID NO: 84088 - RNA, 19 nt, Human
cagacacucccuucuccca

SEQ ID NO: 84089 - RNA, 32 nt, Human
cagacacucucuuucagccucuuuugcaggua

SEQ ID NO: 84090 - RNA, 32 nt, Human
cagacacucuuguuuagcaccauggagagcuc

SEQ ID NO: 84091 - RNA, 32 nt, Human
cagacacugagccuggugccccggcugcauug

SEQ ID NO: 84092 - RNA, 32 nt, Human
cagacacugcaacagaugccuccuagaaaaug

SEQ ID NO: 84093 - RNA, 32 nt, Human
cagacacugccgggccucccucccgggggcac

SEQ ID NO: 84094 - RNA, 32 nt, Human
cagacacugccucuggucagcccugucuuggc

SEQ ID NO: 84095 - RNA, 31 nt, Human
cagacacuggguucugugacagcagagcaug

SEQ ID NO: 84096 - RNA, 32 nt, Human
cagacacugguucugaggaacuguuguuucgg

SEQ ID NO: 84097 - RNA, 32 nt, Human
cagacacuuuggaaguuuguguucuguuuguu

SEQ ID NO: 84098 - RNA, 32 nt, Human
cagacacuuuguccuagcaucuuucuggaauc

SEQ ID NO: 84099 - RNA, 32 nt, Human
cagacagaacugcugccuuagccugacaaccg

SEQ ID NO: 84100 - RNA, 32 nt, Human
cagacagaagcagaggaaagccaagaacagcc

SEQ ID NO: 84101 - RNA, 32 nt, Human
cagacagacagaggggcggaugcagccuaccu

SEQ ID NO: 84102 - RNA, 32 nt, Human
cagacagaccuguaggcccaggccugugcuag

SEQ ID NO: 84103 - RNA, 32 nt, Human
cagacagacucaugugagagggcucaucaguc

SEQ ID NO: 84104 - RNA, 32 nt, Human
cagacagagaaagaaagagaggagcaagugac

SEQ ID NO: 84105 - RNA, 22 nt, Human
cagacagagagacaggcagaca

SEQ ID NO: 84106 - RNA, 32 nt, Human
cagacagagagggagcggcugcaagagguaau

SEQ ID NO: 84107 - RNA, 32 nt, Human
cagacagagcagcuacccucagcucuagcuga

SEQ ID NO: 84108 - RNA, 32 nt, Human
cagacagagcccaggcaugggagcacucuggg

SEQ ID NO: 84109 - RNA, 32 nt, Human
cagacagagucgggucuugcucucucacccag

SEQ ID NO: 84110 - RNA, 32 nt, Human
cagacagauacauacacauacaccccauccuc

SEQ ID NO: 84111 - RNA, 32 nt, Human
cagacagauccaggauaggaugggcagcccag

SEQ ID NO: 84112 - RNA, 32 nt, Human
cagacagauggaccaccaaccuggacagacag

SEQ ID NO: 84113 - RNA, 32 nt, Human
cagacagauguugggaggauacagaggagaug

SEQ ID NO: 84114 - RNA, 32 nt, Human
cagacagauuucagucauuagaugauguuuuu

SEQ ID NO: 84115 - RNA, 32 nt, Human
cagacagauuuuguuucccucuguaaaguugg

SEQ ID NO: 84116 - RNA, 32 nt, Human
cagacagcacagaacuccagccccgcuacuua

SEQ ID NO: 84117 - RNA, 32 nt, Human
cagacagcacccagagugagcuggaguggguc

SEQ ID NO: 84118 - RNA, 32 nt, Human
cagacagcagcaccuccucuucuagcagccag

SEQ ID NO: 84119 - RNA, 32 nt, Human
cagacagcaguggcaucaacuugucaggcuuu

SEQ ID NO: 84120 - RNA, 32 nt, Human
cagacagcaugcugcuagaccucgagaggacc

SEQ ID NO: 84121 - RNA, 32 nt, Human
cagacagccaagccccuuccacaucuacaggg

SEQ ID NO: 84122 - RNA, 32 nt, Human
cagacagccacuucuggugguugccagccacc

SEQ ID NO: 84123 - RNA, 32 nt, Human
cagacagcccccugccccgcaggccugccuuc

SEQ ID NO: 84124 - RNA, 32 nt, Human
cagacagcccuccacuccagcucugagacccu

SEQ ID NO: 84125 - RNA, 32 nt, Human
cagacagccugagacuguucucacggaaacac

SEQ ID NO: 84126 - RNA, 32 nt, Human
cagacagccugggcugguaaaaguagguccuu

SEQ ID NO: 84127 - RNA, 32 nt, Human
cagacagcgaagacuguuguguuuguaaaagc

SEQ ID NO: 84128 - RNA, 18 nt, Human
cagacagcugaccagaca

SEQ ID NO: 84129 - RNA, 32 nt, Human
cagacagcuugaggccccuccugcugccuggc

SEQ ID NO: 84130 - RNA, 22 nt, Human
cagacagcuugcccgcacacuc

SEQ ID NO: 84131 - RNA, 20 nt, Human
cagacaggcagggcucugcc

SEQ ID NO: 84132 - RNA, 32 nt, Human
cagacaggccaugcucucgugguagcaaggug

SEQ ID NO: 84133 - RNA, 21 nt, Human
cagacagggaaggcacagaca

SEQ ID NO: 84134 - RNA, 19 nt, Human
cagacagggaagguggcug

SEQ ID NO: 84135 - RNA, 22 nt, Human
cagacagggagucacacagaca

SEQ ID NO: 84136 - RNA, 32 nt, Human
cagacagggccuuccaucuagagcccagcacc

SEQ ID NO: 84137 - RNA, 32 nt, Human
cagacaggggccacagccugcccaggcagccc

SEQ ID NO: 84138 - RNA, 31 nt, Human
cagacaggggcgcugcugcagaugcuccagg

SEQ ID NO: 84139 - RNA, 32 nt, Human
cagacaggguggccaggcagaggugcuccuca

SEQ ID NO: 84140 - RNA, 32 nt, Human
cagacaggguuuugaggccacccugauuauug

SEQ ID NO: 84141 - RNA, 32 nt, Human
cagacagucaagcagaacccacagccuuauua

SEQ ID NO: 84142 - RNA, 32 nt, Human
cagacagucccaaagugccaugagagaagcuc

SEQ ID NO: 84143 - RNA, 32 nt, Human
cagacaguggacugaaacuaugccauaggcuc

SEQ ID NO: 84144 - RNA, 32 nt, Human
cagacagugguagaacaacccagggcuuggaa

SEQ ID NO: 84145 - RNA, 32 nt, Human
cagacaguugcuuucauucuuccucaaaguau

SEQ ID NO: 84146 - RNA, 32 nt, Human
cagacaguugcuuugauucuuccucaaacuac

SEQ ID NO: 84147 - RNA, 32 nt, Human
cagacauaaggaggccagaggcugcaaggagc

SEQ ID NO: 84148 - RNA, 32 nt, Human
cagacauaccugcagcuuuggcucuuugguau

SEQ ID NO: 84149 - RNA, 32 nt, Human
cagacauauagaacagcgcauucuucuguaga

SEQ ID NO: 84150 - RNA, 21 nt, Human
cagacaucacccuuugccuua

SEQ ID NO: 84151 - RNA, 32 nt, Human
cagacaucagcaggucugugugccucagcccu

SEQ ID NO: 84152 - RNA, 23 nt, Human
cagacaucagccuccuucuuuca

SEQ ID NO: 84153 - RNA, 21 nt, Human
cagacaucaggggccgaugaa

SEQ ID NO: 84154 - RNA, 32 nt, Human
cagacaucauucucuggacuacuuuggcacua

SEQ ID NO: 84155 - RNA, 32 nt, Human
cagacauccaggaagaugcagccagcagacaa

SEQ ID NO: 84156 - RNA, 32 nt, Human
cagacaucccaucuuccuuucucccucaccca

SEQ ID NO: 84157 - RNA, 32 nt, Human
cagacaucuccucaccccagugccugucugga

SEQ ID NO: 84158 - RNA, 32 nt, Human
cagacaucuguaauguuuuugcacuggugaca

SEQ ID NO: 84159 - RNA, 32 nt, Human
cagacaucuuucuccagcuucagacuuguaga

SEQ ID NO: 84160 - RNA, 32 nt, Human
cagacaugaagcugcacacauacacccgucug

SEQ ID NO: 84161 - RNA, 32 nt, Human
cagacaugacucugacagcuucccaggaaccu

SEQ ID NO: 84162 - RNA, 32 nt, Human
cagacaugagccaccacgcuuggccgggauag

SEQ ID NO: 84163 - RNA, 32 nt, Human
cagacaugagccaccaugcccggccaagaauu

SEQ ID NO: 84164 - RNA, 32 nt, Human
cagacaugagccacuacgccuggccagguuuc

SEQ ID NO: 84165 - RNA, 32 nt, Human
cagacaugagccacugcaccuggccugaaaca

SEQ ID NO: 84166 - RNA, 32 nt, Human
cagacaugcaccaccacaccuggcuaauuuuu

SEQ ID NO: 84167 - RNA, 32 nt, Human
cagacaugcaccaccacaccugguuaauuuuu

SEQ ID NO: 84168 - RNA, 32 nt, Human
cagacaugccccucccccgcagacacacccca

SEQ ID NO: 84169 - RNA, 30 nt, Human
cagacaugcuggggcccugcaugcugcugc

SEQ ID NO: 84170 - RNA, 32 nt, Human
cagacauggcuauagggaaaaguuugccuugu

SEQ ID NO: 84171 - RNA, 21 nt, Human
cagacauggcuguccccugua

SEQ ID NO: 84172 - RNA, 32 nt, Human
cagacaugggagggagaugacaugaagaccca

SEQ ID NO: 84173 - RNA, 32 nt, Human
cagacaugggcuaggucauaugugguuucuau

SEQ ID NO: 84174 - RNA, 32 nt, Human
cagacauggucccauuugcaggaaaagugcag

SEQ ID NO: 84175 - RNA, 22 nt, Human
cagacaugguggcaugcaccug

SEQ ID NO: 84176 - RNA, 24 nt, Human
cagacaugguggcucacaccugua

SEQ ID NO: 84177 - RNA, 32 nt, Human
cagacauguggacucuggggagguacuggggg

SEQ ID NO: 84178 - RNA, 32 nt, Human
cagacaugugggcuccccgaagcccagccaga

SEQ ID NO: 84179 - RNA, 32 nt, Human
cagacauuaggggaucaguuguauuuauugua

SEQ ID NO: 84180 - RNA, 32 nt, Human
cagacauugcaacuggcccugccugugggucc

SEQ ID NO: 84181 - RNA, 32 nt, Human
cagacauugccccucaugagucaaguggcuau

SEQ ID NO: 84182 - RNA, 32 nt, Human
cagacauugcugucuggugcuccucucucagu

SEQ ID NO: 84183 - RNA, 32 nt, Human
cagacauuggagguggcagugaaggauacagu

SEQ ID NO: 84184 - RNA, 32 nt, Human
cagacauugguguuucugcugugucccuugug

SEQ ID NO: 84185 - RNA, 32 nt, Human
cagacauuucccaaaggaagacauauacaugg

SEQ ID NO: 84186 - RNA, 32 nt, Human
cagaccaaacauauuuaauaagcacaauaaau

SEQ ID NO: 84187 - RNA, 21 nt, Human
cagaccaaacauugucuggcu

SEQ ID NO: 84188 - RNA, 25 nt, Human
cagaccaacauuuuucucuuccuca

SEQ ID NO: 84189 - RNA, 24 nt, Human
cagaccaacguuacucagggcucc

SEQ ID NO: 84190 - RNA, 32 nt, Human
cagaccaacuaggcuacaucugugaugagcag

SEQ ID NO: 84191 - RNA, 22 nt, Human
cagaccaagagccucaacauuu

SEQ ID NO: 84192 - RNA, 32 nt, Human
cagaccaagccuugcccucaggacggcugccc

SEQ ID NO: 84193 - RNA, 32 nt, Human
cagaccaaguauacaugcauugaagugucuac

SEQ ID NO: 84194 - RNA, 32 nt, Human
cagaccaauauggugaaaccccaucucuacua

SEQ ID NO: 84195 - RNA, 32 nt, Human
cagaccaauuaaauccaggucucuagggguga

SEQ ID NO: 84196 - RNA, 32 nt, Human
cagaccacaauccauuuccuucugcuagccuc

SEQ ID NO: 84197 - RNA, 20 nt, Human
cagaccacaccaccucuacc

SEQ ID NO: 84198 - RNA, 22 nt, Human
cagaccacacccauacccaagc

SEQ ID NO: 84199 - RNA, 32 nt, Human
cagaccacauagcacacaugugcacugaccac

SEQ ID NO: 84200 - RNA, 22 nt, Human
cagaccacaucgacgccugccu

SEQ ID NO: 84201 - RNA, 32 nt, Human
cagaccacauucuauaaucuuugaacaugcug

SEQ ID NO: 84202 - RNA, 32 nt, Human
cagaccaccaccauccauagccuggaugacug

SEQ ID NO: 84203 - RNA, 32 nt, Human
cagaccaccauggugaaggcuucuuuccccac

SEQ ID NO: 84204 - RNA, 27 nt, Human
cagaccacggagcacagggccucugcu

SEQ ID NO: 84205 - RNA, 32 nt, Human
cagaccacgucacuacauuucuaugcaagggg

SEQ ID NO: 84206 - RNA, 32 nt, Human
cagaccacugcccuccagccugggcaauagag

SEQ ID NO: 84207 - RNA, 32 nt, Human
cagaccagaaaugacucacaccaccuuauagc

SEQ ID NO: 84208 - RNA, 32 nt, Human
cagaccagaaauuacccacccaaccaggcuca

SEQ ID NO: 84209 - RNA, 32 nt, Human
cagaccagaccagaccagagggaucggaggcu

SEQ ID NO: 84210 - RNA, 32 nt, Human
cagaccagaccagagggaucggaggcucaggc

SEQ ID NO: 84211 - RNA, 32 nt, Human
cagaccagacuacccaccuagguagggcacac

SEQ ID NO: 84212 - RNA, 21 nt, Human
cagaccagagcugucugaacu

SEQ ID NO: 84213 - RNA, 32 nt, Human
cagaccagcagcuucaucauugucaugugagg

SEQ ID NO: 84214 - RNA, 22 nt, Human
cagaccagccaggccgccugcc

SEQ ID NO: 84215 - RNA, 32 nt, Human
cagaccagccuaccccaaaaagcugcgucuuu

SEQ ID NO: 84216 - RNA, 21 nt, Human
cagaccagccuggccaacaug

SEQ ID NO: 84217 - RNA, 32 nt, Human
cagaccagccuggccaccuuagugagaucccu

SEQ ID NO: 84218 - RNA, 32 nt, Human
cagaccagccugggcaacacagcgggaccccg

SEQ ID NO: 84219 - RNA, 32 nt, Human
cagaccagccugggcaacauagccagaccucg

SEQ ID NO: 84220 - RNA, 32 nt, Human
cagaccagccugggcaacauagugagacucuu

SEQ ID NO: 84221 - RNA, 32 nt, Human
cagaccagccugggcaacauagugagauccug

SEQ ID NO: 84222 - RNA, 32 nt, Human
cagaccagccugggcaacaugcgagaccccug

SEQ ID NO: 84223 - RNA, 32 nt, Human
cagaccagccugggcaauacagcgagaaccca

SEQ ID NO: 84224 - RNA, 32 nt, Human
cagaccagccugggcaauguagcaagacgcug

SEQ ID NO: 84225 - RNA, 32 nt, Human
cagaccagccugggcagcaucgugagaccccc

SEQ ID NO: 84226 - RNA, 32 nt, Human
cagaccagccuggguaacauagugagaccuug

SEQ ID NO: 84227 - RNA, 32 nt, Human
cagaccagccuggguaauguagcgagacccug

SEQ ID NO: 84228 - RNA, 32 nt, Human
cagaccagcugccgcccugcccgaugcuuccc

SEQ ID NO: 84229 - RNA, 32 nt, Human
cagaccaggcauugcccagccugggaaucuuu

SEQ ID NO: 84230 - RNA, 32 nt, Human
cagaccaggccuuccccuagccccacaaguug

SEQ ID NO: 84231 - RNA, 32 nt, Human
cagaccagggcaggggacaggucucaaguccu

SEQ ID NO: 84232 - RNA, 32 nt, Human
cagaccagguuuuccuggucucagaccuauga

SEQ ID NO: 84233 - RNA, 32 nt, Human
cagaccaucccucugcuguuucacucuuugau

SEQ ID NO: 84234 - RNA, 21 nt, Human
cagaccaucugugcucugccc

SEQ ID NO: 84235 - RNA, 16 nt, Human
cagaccaucuuccaca

SEQ ID NO: 84236 - RNA, 32 nt, Human
cagaccaucuuccuccuuccaagucaucaaag

SEQ ID NO: 84237 - RNA, 32 nt, Human
cagaccaugauguuugucucagagguuaaaac

SEQ ID NO: 84238 - RNA, 32 nt, Human
cagaccaugcugaugaccucaaguagcacuga

SEQ ID NO: 84239 - RNA, 31 nt, Human
cagaccauggcagaguucucccagaaacggg

SEQ ID NO: 84240 - RNA, 32 nt, Human
cagaccaugggagcugucugggauguugaucc

SEQ ID NO: 84241 - RNA, 32 nt, Human
cagaccauuuggacugcacagagcagcugccg

SEQ ID NO: 84242 - RNA, 32 nt, Human
cagacccaagcccacgucaggagaggagcgug

SEQ ID NO: 84243 - RNA, 21 nt, Human
cagacccaagccccccacugc

SEQ ID NO: 84244 - RNA, 32 nt, Human
cagacccaagugauccucccaccucagccucc

SEQ ID NO: 84245 - RNA, 32 nt, Human
cagacccaaucacuguggccagggugguggaa

SEQ ID NO: 84246 - RNA, 32 nt, Human
cagacccaaucagaaucacagaaaaauccugc

SEQ ID NO: 84247 - RNA, 32 nt, Human
cagacccacagcucagcccagcccuggcacag

SEQ ID NO: 84248 - RNA, 20 nt, Human
cagacccaccagacaccaca

SEQ ID NO: 84249 - RNA, 32 nt, Human
cagacccaccagacaccacacagcagacaaua

SEQ ID NO: 84250 - RNA, 32 nt, Human
cagacccaccuggccccagagccucaugccag

SEQ ID NO: 84251 - RNA, 32 nt, Human
cagacccacucuguaacuuucagcuagauuca

SEQ ID NO: 84252 - RNA, 32 nt, Human
cagacccagaggcagcugguugggguuugucg

SEQ ID NO: 84253 - RNA, 32 nt, Human
cagacccagccuugcacuccaaggcugcgcac

SEQ ID NO: 84254 - RNA, 21 nt, Human
cagacccagcugcggcugcug

SEQ ID NO: 84255 - RNA, 32 nt, Human
cagacccagcugguucuggaguucuaggacau

SEQ ID NO: 84256 - RNA, 32 nt, Human
cagacccaggaaaauuuccauaguaccuuaau

SEQ ID NO: 84257 - RNA, 32 nt, Human
cagacccaggauggcugcaggccagguuuggg

SEQ ID NO: 84258 - RNA, 32 nt, Human
cagacccaggcacacguguccucagccaaggu

SEQ ID NO: 84259 - RNA, 32 nt, Human
cagacccaucucucccuuacccaucuugcuuc

SEQ ID NO: 84260 - RNA, 32 nt, Human
cagacccaugacaacagagagcaucuagccau

SEQ ID NO: 84261 - RNA, 32 nt, Human
cagacccaugcaggaagagccaggcagggugg

SEQ ID NO: 84262 - RNA, 24 nt, Human
cagacccauucucaaagaccacca

SEQ ID NO: 84263 - RNA, 32 nt, Human
cagaccccaaccacgacacccaucaccaccac

SEQ ID NO: 84264 - RNA, 32 nt, Human
cagaccccaaccacgguacucaucaccaccac

SEQ ID NO: 84265 - RNA, 21 nt, Human
cagaccccaagccauugagca

SEQ ID NO: 84266 - RNA, 32 nt, Human
cagaccccacaacuucaggagcucuuucccgg

SEQ ID NO: 84267 - RNA, 32 nt, Human
cagaccccagagcuuggcuuuugaaacacaac

SEQ ID NO: 84268 - RNA, 32 nt, Human
cagaccccagcaccgagugcucauaagcaucu

SEQ ID NO: 84269 - RNA, 32 nt, Human
cagaccccaugucuauuaacauuucaguccua

SEQ ID NO: 84270 - RNA, 32 nt, Human
cagacccccaccccuuccccacugccugccca

SEQ ID NO: 84271 - RNA, 19 nt, Human
cagacccccagcugggccc

SEQ ID NO: 84272 - RNA, 32 nt, Human
cagacccccaggaaacggaggcucggauugug

SEQ ID NO: 84273 - RNA, 32 nt, Human
cagacccccugccauccucugcugcuacccac

SEQ ID NO: 84274 - RNA, 18 nt, Human
cagaccccgauccuccac

SEQ ID NO: 84275 - RNA, 32 nt, Human
cagaccccucacugcgguaucugcccaguggc

SEQ ID NO: 84276 - RNA, 32 nt, Human
cagaccccuccagaggcccgccaggugggcau

SEQ ID NO: 84277 - RNA, 32 nt, Human
cagaccccucccguuaggcuucaccuccaaca

SEQ ID NO: 84278 - RNA, 24 nt, Human
cagaccccuccuucccagucccau

SEQ ID NO: 84279 - RNA, 32 nt, Human
cagaccccucuaccuccuccaggcugggagac

SEQ ID NO: 84280 - RNA, 32 nt, Human
cagaccccucuauucugcuccaggacagcagg

SEQ ID NO: 84281 - RNA, 19 nt, Human
cagaccccugacucgggga

SEQ ID NO: 84282 - RNA, 32 nt, Human
cagaccccugcaggggacacucacccuucuga

SEQ ID NO: 84283 - RNA, 32 nt, Human
cagaccccuuggcuuuuccuuggcagagagga

SEQ ID NO: 84284 - RNA, 32 nt, Human
cagacccgcugguagacggguuuuaggagcag

SEQ ID NO: 84285 - RNA, 23 nt, Human
cagacccggaguuuccucuuuca

SEQ ID NO: 84286 - RNA, 32 nt, Human
cagacccuaugauguguccacucuggaggcuc

SEQ ID NO: 84287 - RNA, 32 nt, Human
cagacccucacaccagcaccccuccucaccac

SEQ ID NO: 84288 - RNA, 32 nt, Human
cagacccucaccgaccaccuguccugggacca

SEQ ID NO: 84289 - RNA, 32 nt, Human
cagacccuccaggggcccugaggucuguuccu

SEQ ID NO: 84290 - RNA, 32 nt, Human
cagacccuccccugcugccccugcugccccug

SEQ ID NO: 84291 - RNA, 32 nt, Human
cagacccuccuggagcuguccaaaggaaagcc

SEQ ID NO: 84292 - RNA, 32 nt, Human
cagacccucugagauguggcucaggccugagc

SEQ ID NO: 84293 - RNA, 19 nt, Human
cagacccugaccgugggga

SEQ ID NO: 84294 - RNA, 32 nt, Human
cagacccugcagcuggugaaagccagccccug

SEQ ID NO: 84295 - RNA, 32 nt, Human
cagacccugccaucccucccacccccgaccaa

SEQ ID NO: 84296 - RNA, 32 nt, Human
cagacccugccuggcaggccugagcacaacag

SEQ ID NO: 84297 - RNA, 22 nt, Human
cagacccugcugcaugggaagg

SEQ ID NO: 84298 - RNA, 32 nt, Human
cagacccuggcacgccccagcacacgaguucc

SEQ ID NO: 84299 - RNA, 32 nt, Human
cagacccuggcagaaggggcacggggcagggu

SEQ ID NO: 84300 - RNA, 32 nt, Human
cagacccugggagcauuacaguggaaaccaau

SEQ ID NO: 84301 - RNA, 32 nt, Human
cagacccuggugucccuggaccucaccgggcc

SEQ ID NO: 84302 - RNA, 32 nt, Human
cagacccuguauuuccauucgcacuuggcgcu

SEQ ID NO: 84303 - RNA, 24 nt, Human
cagacccugugauccgcccgccuc

SEQ ID NO: 84304 - RNA, 32 nt, Human
cagacccuucacaagcaaaaucagccagcacu

SEQ ID NO: 84305 - RNA, 19 nt, Human
cagacccuucccaauucca

SEQ ID NO: 84306 - RNA, 28 nt, Human
cagaccgaaggugcugccuucauccucc

SEQ ID NO: 84307 - RNA, 24 nt, Human
cagaccgagacgaacacucugccu

SEQ ID NO: 84308 - RNA, 32 nt, Human
cagaccgagagcugcccuugccuaccuucgau

SEQ ID NO: 84309 - RNA, 32 nt, Human
cagaccgagggugggaguugaggacuuugauc

SEQ ID NO: 84310 - RNA, 31 nt, Human
cagaccgguuugcagcaccugccgcaacagc

SEQ ID NO: 84311 - RNA, 22 nt, Human
cagaccgucggagggcuccgcc

SEQ ID NO: 84312 - RNA, 32 nt, Human
cagaccgucuuccuccaaccccucuauguagu

SEQ ID NO: 84313 - RNA, 32 nt, Human
cagaccuaagcucagacccugccuuguccugg

SEQ ID NO: 84314 - RNA, 32 nt, Human
cagaccuacacucgcucuuucucuccgguaca

SEQ ID NO: 84315 - RNA, 32 nt, Human
cagaccuacagcugaggguccugucuguuaga

SEQ ID NO: 84316 - RNA, 32 nt, Human
cagaccuacccaggccacuggagugagucuag

SEQ ID NO: 84317 - RNA, 19 nt, Human
cagaccucacaccuggggg

SEQ ID NO: 84318 - RNA, 32 nt, Human
cagaccucacagucccucagguucuacuggga

SEQ ID NO: 84319 - RNA, 32 nt, Human
cagaccucacuggccuggcuggaccaguacug

SEQ ID NO: 84320 - RNA, 32 nt, Human
cagaccucagcagcuguaaggccaguccaggg

SEQ ID NO: 84321 - RNA, 32 nt, Human
cagaccucagccagggccacagaggucccaac

SEQ ID NO: 84322 - RNA, 32 nt, Human
cagaccucaggugauccgcccaccucggccuc

SEQ ID NO: 84323 - RNA, 32 nt, Human
cagaccucaugccaccugcuguagccacuggg

SEQ ID NO: 84324 - RNA, 32 nt, Human
cagaccucaugcccucuuccuccucuuuccug

SEQ ID NO: 84325 - RNA, 32 nt, Human
cagaccuccaaucugggcucugaccccauaau

SEQ ID NO: 84326 - RNA, 32 nt, Human
cagaccuccaggagagaccaggcccaggaugc

SEQ ID NO: 84327 - RNA, 32 nt, Human
cagaccucccccacuuuccccaucucaucaca

SEQ ID NO: 84328 - RNA, 32 nt, Human
cagaccucgcagguggucaucaugcccaggga

SEQ ID NO: 84329 - RNA, 32 nt, Human
cagaccucuagaguguccuagauuuuguggca

SEQ ID NO: 84330 - RNA, 32 nt, Human
cagaccucucagggaugguauuggcucauuua

SEQ ID NO: 84331 - RNA, 32 nt, Human
cagaccucuccaucucggcucuuccaggcguc

SEQ ID NO: 84332 - RNA, 32 nt, Human
cagaccucugggagguagggaguucccuggca

SEQ ID NO: 84333 - RNA, 32 nt, Human
cagaccucuguuccugagcagagaagcagaaa

SEQ ID NO: 84334 - RNA, 32 nt, Human
cagaccucuuugcuuuaccagugguguuugug

SEQ ID NO: 84335 - RNA, 21 nt, Human
cagaccugagaccacugcuca

SEQ ID NO: 84336 - RNA, 21 nt, Human
cagaccugagaugaagauuca

SEQ ID NO: 84337 - RNA, 32 nt, Human
cagaccugagccaccacaccugggcaacagag

SEQ ID NO: 84338 - RNA, 32 nt, Human
cagaccugagcuggcuuggacccauuugagga

SEQ ID NO: 84339 - RNA, 15 nt, Human
cagaccugaguucca

SEQ ID NO: 84340 - RNA, 31 nt, Human
cagaccugcaacagaaguggcauucaguccc

SEQ ID NO: 84341 - RNA, 18 nt, Human
cagaccugcaccaccacg

SEQ ID NO: 84342 - RNA, 26 nt, Human
cagaccugcucucaaggacucugccu

SEQ ID NO: 84343 - RNA, 32 nt, Human
cagaccuggagguuugggggauggcagaagua

SEQ ID NO: 84344 - RNA, 20 nt, Human
cagaccuggaguccucuuca

SEQ ID NO: 84345 - RNA, 32 nt, Human
cagaccuggcaaguggacagugcaguguggag

SEQ ID NO: 84346 - RNA, 32 nt, Human
cagaccuggcagagccugguguggggucugag

SEQ ID NO: 84347 - RNA, 24 nt, Human
cagaccuggccucucuucauuuca

SEQ ID NO: 84348 - RNA, 32 nt, Human
cagaccuggcuccucggcagagcugccucccg

SEQ ID NO: 84349 - RNA, 32 nt, Human
cagaccuggguugcucagaggcugcaggaccc

SEQ ID NO: 84350 - RNA, 22 nt, Human
cagaccuguccccagacaguga

SEQ ID NO: 84351 - RNA, 22 nt, Human
cagaccuguucuccagagcuca

SEQ ID NO: 84352 - RNA, 32 nt, Human
cagaccuguuuccuuuuugucucaucaacgcc

SEQ ID NO: 84353 - RNA, 32 nt, Human
cagaccuuaggaggaggaaggcgagggcgggg

SEQ ID NO: 84354 - RNA, 18 nt, Human
cagaccuucauuucccca

SEQ ID NO: 84355 - RNA, 32 nt, Human
cagaccuuccuaggaguaaaagacugauguga

SEQ ID NO: 84356 - RNA, 32 nt, Human
cagaccuuccuaggcuuugcaaugcugggaua

SEQ ID NO: 84357 - RNA, 24 nt, Human
cagaccuucucccugaacuuaaga

SEQ ID NO: 84358 - RNA, 32 nt, Human
cagaccuucugccucuggcucugccuacucau

SEQ ID NO: 84359 - RNA, 32 nt, Human
cagaccuuguccacaccuuccugggcaacccc

SEQ ID NO: 84360 - RNA, 32 nt, Human
cagaccuuguuucucuugccacguuguuuuuc

SEQ ID NO: 84361 - RNA, 19 nt, Human
cagaccuuucaucuuucac

SEQ ID NO: 84362 - RNA, 32 nt, Human
cagaccuuuccucuucuggugcccgagggaaa

SEQ ID NO: 84363 - RNA, 32 nt, Human
cagacgacccccgcagcauuucccucggaccc

SEQ ID NO: 84364 - RNA, 32 nt, Human
cagacgaggcagagacaaaacacugagaaaga

SEQ ID NO: 84365 - RNA, 32 nt, Human
cagacgaucugguucagacucuaccucaucac

SEQ ID NO: 84366 - RNA, 32 nt, Human
cagacgauguggaguugggugccugagcucaa

SEQ ID NO: 84367 - RNA, 21 nt, Human
cagacgcacaaggccucugcu

SEQ ID NO: 84368 - RNA, 32 nt, Human
cagacgcagcugcaccugggacagcagacaca

SEQ ID NO: 84369 - RNA, 32 nt, Human
cagacgcagugcugagcacacagcuaccggac

SEQ ID NO: 84370 - RNA, 18 nt, Human
cagacgcauggaugcacc

SEQ ID NO: 84371 - RNA, 18 nt, Human
cagacgcccaccaccacg

SEQ ID NO: 84372 - RNA, 21 nt, Human
cagacgcccaccugugccuca

SEQ ID NO: 84373 - RNA, 32 nt, Human
cagacgcccacuggccccagaucucauccugc

SEQ ID NO: 84374 - RNA, 32 nt, Human
cagacgccucuccggaaucucccgggccucug

SEQ ID NO: 84375 - RNA, 32 nt, Human
cagacgccuguaaucccagcuacuugggaggc

SEQ ID NO: 84376 - RNA, 22 nt, Human
cagacgccuuuuugccugcuca

SEQ ID NO: 84377 - RNA, 32 nt, Human
cagacgcgcugcagccuccagcccgcggcaag

SEQ ID NO: 84378 - RNA, 18 nt, Human
cagacgcggucgcgccca

SEQ ID NO: 84379 - RNA, 32 nt, Human
cagacgcucagccugugcaacccgaagcugcu

SEQ ID NO: 84380 - RNA, 32 nt, Human
cagacgcucgccgacaaccuggccggcggcac

SEQ ID NO: 84381 - RNA, 32 nt, Human
cagacgcugcgggagcacugcugggcuggagg

SEQ ID NO: 84382 - RNA, 32 nt, Human
cagacgcuggagcuccagccuccuggcggccc

SEQ ID NO: 84383 - RNA, 32 nt, Human
cagacgcugguucugaggaacuguuguuucgg

SEQ ID NO: 84384 - RNA, 32 nt, Human
cagacgcuucauguaaauaaaaacuaaaaaua

SEQ ID NO: 84385 - RNA, 32 nt, Human
cagacggaggaggacuuagugaucuuguccaa

SEQ ID NO: 84386 - RNA, 32 nt, Human
cagacggaguuucgcucuuguugcccaggcug

SEQ ID NO: 84387 - RNA, 20 nt, Human
cagacggcccagggcucuau

SEQ ID NO: 84388 - RNA, 32 nt, Human
cagacggccggcagaggaagggagagaggcgg

SEQ ID NO: 84389 - RNA, 23 nt, Human
cagacggcggcauccuccagccc

SEQ ID NO: 84390 - RNA, 32 nt, Human
cagacggcuguggggucagggaaggagcaugg

SEQ ID NO: 84391 - RNA, 32 nt, Human
cagacgggccaacauggugaaaccccaucucu

SEQ ID NO: 84392 - RNA, 20 nt, Human
cagacgggcuucucccaccc

SEQ ID NO: 84393 - RNA, 32 nt, Human
cagacggggcuggagugugaggguccugcagc

SEQ ID NO: 84394 - RNA, 31 nt, Human
cagacggggucucagggaccuguguccuucc

SEQ ID NO: 84395 - RNA, 32 nt, Human
cagacgucaaggucauugggaaagcaccaaca

SEQ ID NO: 84396 - RNA, 21 nt, Human
cagacgucauccuuuggcuca

SEQ ID NO: 84397 - RNA, 32 nt, Human
cagacgucuguaaucccagcuauucaggaggc

SEQ ID NO: 84398 - RNA, 32 nt, Human
cagacgugagccaccacccccggccacuuguu

SEQ ID NO: 84399 - RNA, 32 nt, Human
cagacgugagccaccacgcccugccaauaaaa

SEQ ID NO: 84400 - RNA, 32 nt, Human
cagacgugagccaccaugcccagccaaguuuu

SEQ ID NO: 84401 - RNA, 32 nt, Human
cagacgugagccaccgugcccggccaauccug

SEQ ID NO: 84402 - RNA, 32 nt, Human
cagacgugagccaccgugcccggccaguucua

SEQ ID NO: 84403 - RNA, 32 nt, Human
cagacgugagccaccgugccuggccuggaauu

SEQ ID NO: 84404 - RNA, 32 nt, Human
cagacgugagccacugcguccgguccaucuga

SEQ ID NO: 84405 - RNA, 32 nt, Human
cagacgugagccacugcguccugccuaaaaug

SEQ ID NO: 84406 - RNA, 32 nt, Human
cagacgugagccacugugccuggccaagauag

SEQ ID NO: 84407 - RNA, 32 nt, Human
cagacgugagccacuguguccugccuaaaaug

SEQ ID NO: 84408 - RNA, 32 nt, Human
cagacgugcaccaccacgccaggcuaauuuuu

SEQ ID NO: 84409 - RNA, 32 nt, Human
cagacgugcagugccauaaggugccccagucc

SEQ ID NO: 84410 - RNA, 32 nt, Human
cagacgugcuccugcugaccuucugcggcucc

SEQ ID NO: 84411 - RNA, 32 nt, Human
cagacguggggaggguggaggggugacagugg

SEQ ID NO: 84412 - RNA, 25 nt, Human
cagacgugguaccagacaccagagc

SEQ ID NO: 84413 - RNA, 24 nt, Human
cagacgugguagcucacaccugua

SEQ ID NO: 84414 - RNA, 32 nt, Human
cagacguucccaggagguccugguuaugcagg

SEQ ID NO: 84415 - RNA, 32 nt, Human
cagacguucucccauccaccaugucugagcuu

SEQ ID NO: 84416 - RNA, 32 nt, Human
cagacguuugccugagugaacaaaucuaagug

SEQ ID NO: 84417 - RNA, 32 nt, Human
cagacuaaaggucuggccaaugucuugcccca

SEQ ID NO: 84418 - RNA, 32 nt, Human
cagacuaaggaagaagucugaggcagacggug

SEQ ID NO: 84419 - RNA, 32 nt, Human
cagacuacugccagacugagaaacccagaagc

SEQ ID NO: 84420 - RNA, 32 nt, Human
cagacuacuucuuccccagauagcuggcuggg

SEQ ID NO: 84421 - RNA, 32 nt, Human
cagacuagccugggcaacauagagagacccua

SEQ ID NO: 84422 - RNA, 32 nt, Human
cagacuagucucaaacuccugaccucaaguga

SEQ ID NO: 84423 - RNA, 32 nt, Human
cagacuaguuaaaucccacaaagugaauaucu

SEQ ID NO: 84424 - RNA, 32 nt, Human
cagacuaugcuguucagccacaugugggcacg

SEQ ID NO: 84425 - RNA, 32 nt, Human
cagacuauugaauguagcuguaguuuauucau

SEQ ID NO: 84426 - RNA, 32 nt, Human
cagacucaacacugggacucugaguuccugag

SEQ ID NO: 84427 - RNA, 32 nt, Human
cagacucaagccauccucccaccucaaccucc

SEQ ID NO: 84428 - RNA, 32 nt, Human
cagacucaagccucuagacucuuggaugaaac

SEQ ID NO: 84429 - RNA, 24 nt, Human
cagacucaagugauccucccaccu

SEQ ID NO: 84430 - RNA, 25 nt, Human
cagacucaauaccagacacuacagc

SEQ ID NO: 84431 - RNA, 31 nt, Human
cagacucacagcuugauacccuaacaaagca

SEQ ID NO: 84432 - RNA, 32 nt, Human
cagacucacauccugaccuugcacaaacagcc

SEQ ID NO: 84433 - RNA, 32 nt, Human
cagacucacaugcacaucaaaugcacaaccau

SEQ ID NO: 84434 - RNA, 18 nt, Human
cagacucaccccaucugc

SEQ ID NO: 84435 - RNA, 19 nt, Human
cagacucacuccccucugc

SEQ ID NO: 84436 - RNA, 21 nt, Human
cagacucagacccuccugccu

SEQ ID NO: 84437 - RNA, 32 nt, Human
cagacucagcaggguaaccacaugggcaagca

SEQ ID NO: 84438 - RNA, 32 nt, Human
cagacucagcuaccacguucacugccuuccuc

SEQ ID NO: 84439 - RNA, 32 nt, Human
cagacucaggggcuccaccaaugccaucccaa

SEQ ID NO: 84440 - RNA, 32 nt, Human
cagacucagucuccaaagaaggcaacacaaau

SEQ ID NO: 84441 - RNA, 22 nt, Human
cagacucaucccacucucuccc

SEQ ID NO: 84442 - RNA, 32 nt, Human
cagacucaucgccucccacacgccugggcugu

SEQ ID NO: 84443 - RNA, 32 nt, Human
cagacuccaaagcauugggauuacaggcauca

SEQ ID NO: 84444 - RNA, 18 nt, Human
cagacuccacaguggggg

SEQ ID NO: 84445 - RNA, 32 nt, Human
cagacuccaccaacuucuaguccuggggccug

SEQ ID NO: 84446 - RNA, 32 nt, Human
cagacuccacucaucaugcuguguggcacaaa

SEQ ID NO: 84447 - RNA, 20 nt, Human
cagacuccagcccaggccgg

SEQ ID NO: 84448 - RNA, 32 nt, Human
cagacuccagugggccugguuucugcagaaug

SEQ ID NO: 84449 - RNA, 22 nt, Human
cagacuccaucccccaccccca

SEQ ID NO: 84450 - RNA, 32 nt, Human
cagacuccaugcuuuuuaaagacagagauaau

SEQ ID NO: 84451 - RNA, 32 nt, Human
cagacuccauguaaucuagucuuuggccaccu

SEQ ID NO: 84452 - RNA, 21 nt, Human
cagacucccagagaaccagca

SEQ ID NO: 84453 - RNA, 32 nt, Human
cagacucccagagagaaaauaaccucgccaag

SEQ ID NO: 84454 - RNA, 32 nt, Human
cagacucccagaggaggcagggguaggaaagc

SEQ ID NO: 84455 - RNA, 32 nt, Human
cagacucccccgagaccugccagccccggcau

SEQ ID NO: 84456 - RNA, 32 nt, Human
cagacuccucaccaagaugggcuaugaguuug

SEQ ID NO: 84457 - RNA, 32 nt, Human
cagacuccugcaaauccaacccauaucaggcu

SEQ ID NO: 84458 - RNA, 23 nt, Human
cagacuccuggaagaggggggca

SEQ ID NO: 84459 - RNA, 32 nt, Human
cagacuccuguagacccagccucuaucuccug

SEQ ID NO: 84460 - RNA, 32 nt, Human
cagacuccuuuccacuccagcccccuuuccac

SEQ ID NO: 84461 - RNA, 32 nt, Human
cagacucgagcagucucuggaacacgcugcgg

SEQ ID NO: 84462 - RNA, 32 nt, Human
cagacucgccaacauggugaaaccguaucucu

SEQ ID NO: 84463 - RNA, 32 nt, Human
cagacucggcagaggcggcgggcagaaccgcg

SEQ ID NO: 84464 - RNA, 32 nt, Human
cagacucggccuguucccagacucggccuuca

SEQ ID NO: 84465 - RNA, 32 nt, Human
cagacucuaggguuuuccaaugugacuaauga

SEQ ID NO: 84466 - RNA, 19 nt, Human
cagacucucagacugagga

SEQ ID NO: 84467 - RNA, 32 nt, Human
cagacucuccaucuccauuauuuuagccuuga

SEQ ID NO: 84468 - RNA, 32 nt, Human
cagacucucccaaauaaauccccacacgaaca

SEQ ID NO: 84469 - RNA, 31 nt, Human
cagacucucccagcuggcaccaaagccuucc

SEQ ID NO: 84470 - RNA, 32 nt, Human
cagacucuccuaggacagcucuccccgggugc

SEQ ID NO: 84471 - RNA, 32 nt, Human
cagacucucuucuagggcuucccaccaucagc

SEQ ID NO: 84472 - RNA, 32 nt, Human
cagacucugccuccugguuuccuuucucauuu

SEQ ID NO: 84473 - RNA, 32 nt, Human
cagacucuggcccuucagcugcagaaugccga

SEQ ID NO: 84474 - RNA, 32 nt, Human
cagacucugucuccaaaacaaaacaaacaaac

SEQ ID NO: 84475 - RNA, 32 nt, Human
cagacucuguuacagaaacagagggcuguuuc

SEQ ID NO: 84476 - RNA, 32 nt, Human
cagacucuuccuagccuuucuaaaccaaaguu

SEQ ID NO: 84477 - RNA, 32 nt, Human
cagacucuugcagcccauaaagaucaagucau

SEQ ID NO: 84478 - RNA, 32 nt, Human
cagacugaaagccaggacaucugaguaccuau

SEQ ID NO: 84479 - RNA, 32 nt, Human
cagacugaacaauacagcacuuugccaaaaau

SEQ ID NO: 84480 - RNA, 32 nt, Human
cagacugaacucagagguagacaggucaccuu

SEQ ID NO: 84481 - RNA, 32 nt, Human
cagacugaagacagaggucguuugauuucaaa

SEQ ID NO: 84482 - RNA, 32 nt, Human
cagacugaagaucauaaaccaguuuuaucaga

SEQ ID NO: 84483 - RNA, 32 nt, Human
cagacugaagugcaguggcacaaucauagcuc

SEQ ID NO: 84484 - RNA, 32 nt, Human
cagacugaccaacauggagaaaccccaucucu

SEQ ID NO: 84485 - RNA, 32 nt, Human
cagacugaccuugaugagcugugcacaaagug

SEQ ID NO: 84486 - RNA, 32 nt, Human
cagacugacuccauccccugacuuucccuuug

SEQ ID NO: 84487 - RNA, 32 nt, Human
cagacugagagggaggugccggagccagggac

SEQ ID NO: 84488 - RNA, 32 nt, Human
cagacugagcuuccugccugccuguaccccgc

SEQ ID NO: 84489 - RNA, 32 nt, Human
cagacugaggcucuggggugaggucccuaucc

SEQ ID NO: 84490 - RNA, 32 nt, Human
cagacugaguuacugccugucuuaucaggaug

SEQ ID NO: 84491 - RNA, 32 nt, Human
cagacugauaccaccuccaccgcugagcagug

SEQ ID NO: 84492 - RNA, 24 nt, Human
cagacugauaguuucuuucuuuca

SEQ ID NO: 84493 - RNA, 20 nt, Human
cagacugaucaucuuccaca

SEQ ID NO: 84494 - RNA, 32 nt, Human
cagacugcaaaguguaguuguuugagcaaaca

SEQ ID NO: 84495 - RNA, 32 nt, Human
cagacugcaagaggaggcgaggcggagccagc

SEQ ID NO: 84496 - RNA, 32 nt, Human
cagacugcaggcccauuuggugacacaggaca

SEQ ID NO: 84497 - RNA, 32 nt, Human
cagacugcagugagcugaccuggcagggcaga

SEQ ID NO: 84498 - RNA, 32 nt, Human
cagacugcaguucccuccccacccucuaccca

SEQ ID NO: 84499 - RNA, 24 nt, Human
cagacugcauaaagggugguggca

SEQ ID NO: 84500 - RNA, 21 nt, Human
cagacugccaaagaagccuug

SEQ ID NO: 84501 - RNA, 32 nt, Human
cagacugccagcccugacgggacagagccagg

SEQ ID NO: 84502 - RNA, 32 nt, Human
cagacugccagccugugccagucugaccugga

SEQ ID NO: 84503 - RNA, 32 nt, Human
cagacugccaggcuccaggaauaaguagcucu

SEQ ID NO: 84504 - RNA, 32 nt, Human
cagacugcccguggcccugcugucgggcccca

SEQ ID NO: 84505 - RNA, 32 nt, Human
cagacugccugggagcccugagacucccugac

SEQ ID NO: 84506 - RNA, 32 nt, Human
cagacugcgaccuucacgucucagccucaggg

SEQ ID NO: 84507 - RNA, 31 nt, Human
cagacugcgugagagaaaacagcugugauuu

SEQ ID NO: 84508 - RNA, 32 nt, Human
cagacugcuagagagagauggcaagaaggaag

SEQ ID NO: 84509 - RNA, 32 nt, Human
cagacugcugguagcgugcaugcagcuuugcc

SEQ ID NO: 84510 - RNA, 19 nt, Human
cagacugcuggucuccaca

SEQ ID NO: 84511 - RNA, 32 nt, Human
cagacugcugugcuuaguaagcaagugagaag

SEQ ID NO: 84512 - RNA, 32 nt, Human
cagacuggacugcaguggcacaaucauagcuc

SEQ ID NO: 84513 - RNA, 21 nt, Human
cagacuggagugcaguggugu

SEQ ID NO: 84514 - RNA, 32 nt, Human
cagacuggauuugcucugagaggggcacuggg

SEQ ID NO: 84515 - RNA, 32 nt, Human
cagacuggccaacauggagaaaccccaucucu

SEQ ID NO: 84516 - RNA, 32 nt, Human
cagacuggccaacauggagaaaccccgucucu

SEQ ID NO: 84517 - RNA, 32 nt, Human
cagacuggcuagcauaguaaaaccccaucucu

SEQ ID NO: 84518 - RNA, 32 nt, Human
cagacuggcugcagggacagaagacaccaagg

SEQ ID NO: 84519 - RNA, 21 nt, Human
cagacugggaaauacugagca

SEQ ID NO: 84520 - RNA, 32 nt, Human
cagacugggcgccggcccugccuccauuucag

SEQ ID NO: 84521 - RNA, 32 nt, Human
cagacugggggacuccgggaagaggcuuucuu

SEQ ID NO: 84522 - RNA, 32 nt, Human
cagacuggucucaaacaccugggcucaaauga

SEQ ID NO: 84523 - RNA, 32 nt, Human
cagacuggucucaaacuccuaaccuugugauc

SEQ ID NO: 84524 - RNA, 32 nt, Human
cagacuggucucaaacuccugaccucagauga

SEQ ID NO: 84525 - RNA, 32 nt, Human
cagacuggucucaaacuccugaccucaggcga

SEQ ID NO: 84526 - RNA, 32 nt, Human
cagacuggucucaaacuccuggccucaagcaa

SEQ ID NO: 84527 - RNA, 32 nt, Human
cagacuggucucaaacuccuggccucgaguca

SEQ ID NO: 84528 - RNA, 32 nt, Human
cagacuggucucaaacuccugggcucaagcga

SEQ ID NO: 84529 - RNA, 32 nt, Human
cagacuggucucaaacuccugggcugaaacaa

SEQ ID NO: 84530 - RNA, 32 nt, Human
cagacuggucucaaacuccuggguucaagaga

SEQ ID NO: 84531 - RNA, 32 nt, Human
cagacuggucucaaacuuaccggcucaagcaa

SEQ ID NO: 84532 - RNA, 32 nt, Human
cagacuggucucaaacuucugaccucaaguga

SEQ ID NO: 84533 - RNA, 32 nt, Human
cagacuggugugaacccgggagguggagcuug

SEQ ID NO: 84534 - RNA, 32 nt, Human
cagacugguuccuguggcugggaugacugcau

SEQ ID NO: 84535 - RNA, 32 nt, Human
cagacuguaaagccucaugagggcaggggccc

SEQ ID NO: 84536 - RNA, 32 nt, Human
cagacuguacuccuauguuuaagauaauuuuu

SEQ ID NO: 84537 - RNA, 32 nt, Human
cagacuguauacccuucucuucucuuaucuuc

SEQ ID NO: 84538 - RNA, 25 nt, Human
cagacugucaagaagaggaaaggga

SEQ ID NO: 84539 - RNA, 32 nt, Human
cagacuguccaggacaucuuaucugcagccau

SEQ ID NO: 84540 - RNA, 32 nt, Human
cagacuguccccacgccgggaaccaagcagga

SEQ ID NO: 84541 - RNA, 32 nt, Human
cagacugucugggcccaauccccagcuuugua

SEQ ID NO: 84542 - RNA, 32 nt, Human
cagacugugagcuccaugagggcagggaccgu

SEQ ID NO: 84543 - RNA, 32 nt, Human
cagacugugagcuccuugagggcagggacugu

SEQ ID NO: 84544 - RNA, 22 nt, Human
cagacugugcauguugggaagg

SEQ ID NO: 84545 - RNA, 32 nt, Human
cagacuguggcuagaacggugggaucagagca

SEQ ID NO: 84546 - RNA, 32 nt, Human
cagacuguggcuccuuccuccuuccugugauu

SEQ ID NO: 84547 - RNA, 32 nt, Human
cagacuguggugaggaggagacgcucacuuuc

SEQ ID NO: 84548 - RNA, 32 nt, Human
cagacugugugugacuuucguccauuugacuu

SEQ ID NO: 84549 - RNA, 32 nt, Human
cagacuguuucucaguuauuuccagagaccca

SEQ ID NO: 84550 - RNA, 32 nt, Human
cagacuuaacacuuguuguauguaugucaagc

SEQ ID NO: 84551 - RNA, 20 nt, Human
cagacuuagaaccugagguc

SEQ ID NO: 84552 - RNA, 32 nt, Human
cagacuucaagaccauccuggacuguggccac

SEQ ID NO: 84553 - RNA, 32 nt, Human
cagacuucagccccuggcagucugcccaccug

SEQ ID NO: 84554 - RNA, 32 nt, Human
cagacuucagccuccagaacugcgcggugaug

SEQ ID NO: 84555 - RNA, 32 nt, Human
cagacuucaugucucugcucaucagcacuguc

SEQ ID NO: 84556 - RNA, 32 nt, Human
cagacuucauuucuuucugcaucuucccccaa

SEQ ID NO: 84557 - RNA, 32 nt, Human
cagacuuccacagaagcuagacugaccaggcg

SEQ ID NO: 84558 - RNA, 32 nt, Human
cagacuuccucuccagugguuacccuccacug

SEQ ID NO: 84559 - RNA, 29 nt, Human
cagacuucgcccacccaucccuccccucg

SEQ ID NO: 84560 - RNA, 32 nt, Human
cagacuucuccaggaacccagaaacgggaugg

SEQ ID NO: 84561 - RNA, 19 nt, Human
cagacuucugaccuccaca

SEQ ID NO: 84562 - RNA, 32 nt, Human
cagacuugagccacagugcccagccucacuuc

SEQ ID NO: 84563 - RNA, 32 nt, Human
cagacuugaggaaccccucucccuuccauaau

SEQ ID NO: 84564 - RNA, 32 nt, Human
cagacuugcaugauuaaccaguuguuacacuu

SEQ ID NO: 84565 - RNA, 32 nt, Human
cagacuugccagaggggucucuccccauagcc

SEQ ID NO: 84566 - RNA, 32 nt, Human
cagacuugcccagauuuguguauuguacuuau

SEQ ID NO: 84567 - RNA, 32 nt, Human
cagacuugcccagcagcaugaguagugaagug

SEQ ID NO: 84568 - RNA, 32 nt, Human
cagacuugggguccuuaagguggcaaguccuu

SEQ ID NO: 84569 - RNA, 18 nt, Human
cagacuugguccuuuuca

SEQ ID NO: 84570 - RNA, 32 nt, Human
cagacuuggugcccugcaucccagcugcucca

SEQ ID NO: 84571 - RNA, 32 nt, Human
cagacuuggugccugagcgcagcuccagggaa

SEQ ID NO: 84572 - RNA, 32 nt, Human
cagacuuguucauagguguggggccugauugg

SEQ ID NO: 84573 - RNA, 32 nt, Human
cagacuuuaguccccucccaggaaaggaaucu

SEQ ID NO: 84574 - RNA, 32 nt, Human
cagacuuuccaaagcucagcugcuuuauaaug

SEQ ID NO: 84575 - RNA, 32 nt, Human
cagacuuuccguuuccaacgagaagagguucc

SEQ ID NO: 84576 - RNA, 32 nt, Human
cagacuuucuacaccuguuucaccucaggcug

SEQ ID NO: 84577 - RNA, 32 nt, Human
cagacuuucucauagaauguucuugaaaggug

SEQ ID NO: 84578 - RNA, 32 nt, Human
cagacuuucuccccaccccuccccgaccccca

SEQ ID NO: 84579 - RNA, 32 nt, Human
cagacuuuuaagcauuaaacauaaauaacuuc

SEQ ID NO: 84580 - RNA, 32 nt, Human
cagacuuuuaagcuuaaaaccuaaaugucaua

SEQ ID NO: 84581 - RNA, 32 nt, Human
cagacuuuuagcaggacuuuguguacaguuaa

SEQ ID NO: 84582 - RNA, 32 nt, Human
cagacuuuucccagaaggccucuccuuuucag

SEQ ID NO: 84583 - RNA, 32 nt, Human
cagacuuuuggggaacuggguacugaugaacc

SEQ ID NO: 84584 - RNA, 32 nt, Human
cagagaaaaucaggaucaauaucugcuuuggg

SEQ ID NO: 84585 - RNA, 32 nt, Human
cagagaaacagcccugguguuccagcaggagc

SEQ ID NO: 84586 - RNA, 22 nt, Human
cagagaaaccucagcuucauca

SEQ ID NO: 84587 - RNA, 32 nt, Human
cagagaaaccugagucuagccaugaggggcuu

SEQ ID NO: 84588 - RNA, 32 nt, Human
cagagaaacucacuccaagagcaagaagccaa

SEQ ID NO: 84589 - RNA, 22 nt, Human
cagagaaagaugaagaggagga

SEQ ID NO: 84590 - RNA, 32 nt, Human
cagagaaaggaagugaaaagauuuacaauuau

SEQ ID NO: 84591 - RNA, 32 nt, Human
cagagaaaggcagagggagaggggacccaguu

SEQ ID NO: 84592 - RNA, 32 nt, Human
cagagaaaggggccguggucagcugggaucuu

SEQ ID NO: 84593 - RNA, 32 nt, Human
cagagaaaggggcuguggucagcugggaucuu

SEQ ID NO: 84594 - RNA, 21 nt, Human
cagagaaauuguccucaggga

SEQ ID NO: 84595 - RNA, 32 nt, Human
cagagaaauuuccuuguucccuaggcugacug

SEQ ID NO: 84596 - RNA, 32 nt, Human
cagagaacaaggacagaggccaggcacugagg

SEQ ID NO: 84597 - RNA, 32 nt, Human
cagagaacacaaacgcuucaggagaaauucaa

SEQ ID NO: 84598 - RNA, 32 nt, Human
cagagaacacaaauguacacucccagguguca

SEQ ID NO: 84599 - RNA, 32 nt, Human
cagagaacacagaagccagcaagcagcaggga

SEQ ID NO: 84600 - RNA, 32 nt, Human
cagagaacacccucuaggggcuuuggggacau

SEQ ID NO: 84601 - RNA, 32 nt, Human
cagagaacacuggcuucacagaggacuuugug

SEQ ID NO: 84602 - RNA, 32 nt, Human
cagagaacagucugcaaaaucacugcaccuug

SEQ ID NO: 84603 - RNA, 32 nt, Human
cagagaacaugagcuucuaccuccagaugugc

SEQ ID NO: 84604 - RNA, 32 nt, Human
cagagaaccagccuggcuccuggcgcgcaccu

SEQ ID NO: 84605 - RNA, 32 nt, Human
cagagaaccuguucagauacaggccaguuucu

SEQ ID NO: 84606 - RNA, 32 nt, Human
cagagaaccuucuccccaccucugaguuauuc

SEQ ID NO: 84607 - RNA, 32 nt, Human
cagagaacgcagccacaccacaccugcacuuc

SEQ ID NO: 84608 - RNA, 19 nt, Human
cagagaacugaacugugga

SEQ ID NO: 84609 - RNA, 32 nt, Human
cagagaacuggacucgaggauccagagaggua

SEQ ID NO: 84610 - RNA, 32 nt, Human
cagagaacuguggggaacgcugugcuguuugu

SEQ ID NO: 84611 - RNA, 32 nt, Human
cagagaagaaagggaaaggaguccaugggguu

SEQ ID NO: 84612 - RNA, 32 nt, Human
cagagaagaaaugcagucugcacuuuuuaugu

SEQ ID NO: 84613 - RNA, 32 nt, Human
cagagaagacaacaugcugagaccagaggcuu

SEQ ID NO: 84614 - RNA, 21 nt, Human
cagagaagacagaagguggca

SEQ ID NO: 84615 - RNA, 23 nt, Human
cagagaagagaugaagaggggga

SEQ ID NO: 84616 - RNA, 32 nt, Human
cagagaagagccaugaaaagauacaagcaucu

SEQ ID NO: 84617 - RNA, 32 nt, Human
cagagaagagucauguugaaaacgaaacgcag

SEQ ID NO: 84618 - RNA, 32 nt, Human
cagagaagaguccagaaagaagaauggaagga

SEQ ID NO: 84619 - RNA, 32 nt, Human
cagagaagauauauuuaugauauuucugcaga

SEQ ID NO: 84620 - RNA, 32 nt, Human
cagagaagcaggaggaggauggagagaaugug

SEQ ID NO: 84621 - RNA, 24 nt, Human
cagagaagccaugcguuccagccu

SEQ ID NO: 84622 - RNA, 23 nt, Human
cagagaagccccauccuaagcca

SEQ ID NO: 84623 - RNA, 32 nt, Human
cagagaagccuaaagugauucaauacccagga

SEQ ID NO: 84624 - RNA, 32 nt, Human
cagagaagccuccaccugaggauggggaggac

SEQ ID NO: 84625 - RNA, 22 nt, Human
cagagaagcuauaguuccagcc

SEQ ID NO: 84626 - RNA, 32 nt, Human
cagagaagcugcagguuugcagccagcggagg

SEQ ID NO: 84627 - RNA, 32 nt, Human
cagagaaggaagcagagacuggagggaugccc

SEQ ID NO: 84628 - RNA, 32 nt, Human
cagagaaggagagaggcagagagggagagagg

SEQ ID NO: 84629 - RNA, 32 nt, Human
cagagaaggagagcccauaaggggacucuuuu

SEQ ID NO: 84630 - RNA, 32 nt, Human
cagagaaggagccggggaccagcuugaagacu

SEQ ID NO: 84631 - RNA, 32 nt, Human
cagagaaggcagaaagcaagagaaaggaaugc

SEQ ID NO: 84632 - RNA, 22 nt, Human
cagagaaggcaggaccaugaca

SEQ ID NO: 84633 - RNA, 32 nt, Human
cagagaaggggccagcucccuccuggggaccc

SEQ ID NO: 84634 - RNA, 18 nt, Human
cagagaaggguccagcuc

SEQ ID NO: 84635 - RNA, 32 nt, Human
cagagaaggucaccauguaccacacaccaaag

SEQ ID NO: 84636 - RNA, 32 nt, Human
cagagaaguaaugggucaauaaucuugaccuu

SEQ ID NO: 84637 - RNA, 32 nt, Human
cagagaagucauggcuucuccguccaaaggca

SEQ ID NO: 84638 - RNA, 32 nt, Human
cagagaagugcagcugcugugccuguguccgg

SEQ ID NO: 84639 - RNA, 18 nt, Human
cagagaaguuccccaccc

SEQ ID NO: 84640 - RNA, 19 nt, Human
cagagaauauuuccagccc

SEQ ID NO: 84641 - RNA, 32 nt, Human
cagagaaucugaauacugggucacguugcagu

SEQ ID NO: 84642 - RNA, 32 nt, Human
cagagaaucuguccuucaaggccaaagcucug

SEQ ID NO: 84643 - RNA, 32 nt, Human
cagagaauggcugagcaggacagugggagacc

SEQ ID NO: 84644 - RNA, 20 nt, Human
cagagaauggcugggucagg

SEQ ID NO: 84645 - RNA, 32 nt, Human
cagagaauggggcugugaaggucugggagaua

SEQ ID NO: 84646 - RNA, 32 nt, Human
cagagaauucauacuggagaaaagccauauaa

SEQ ID NO: 84647 - RNA, 32 nt, Human
cagagaauucccguguacccuucaccaagcuu

SEQ ID NO: 84648 - RNA, 32 nt, Human
cagagacaagcaacagugaguccuccucacag

SEQ ID NO: 84649 - RNA, 32 nt, Human
cagagacacaagccuucggcgccuuaaggaug

SEQ ID NO: 84650 - RNA, 32 nt, Human
cagagacacaccuggcccucagggggcugagc

SEQ ID NO: 84651 - RNA, 32 nt, Human
cagagacacccacuuagaaaguuaacuguuug

SEQ ID NO: 84652 - RNA, 22 nt, Human
cagagacacccuccuugccuca

SEQ ID NO: 84653 - RNA, 32 nt, Human
cagagacaccugccggcugacaaggacagcuu

SEQ ID NO: 84654 - RNA, 32 nt, Human
cagagacagaaagaguuaagcugcugacccga

SEQ ID NO: 84655 - RNA, 32 nt, Human
cagagacagaacugguccaucauguuugaguc

SEQ ID NO: 84656 - RNA, 32 nt, Human
cagagacagaagcagauaaugcaagugucauc

SEQ ID NO: 84657 - RNA, 32 nt, Human
cagagacagcaacucccucccguaacucaggc

SEQ ID NO: 84658 - RNA, 32 nt, Human
cagagacagcuuccagcaccuucuucaguguu

SEQ ID NO: 84659 - RNA, 23 nt, Human
cagagacaggaagucuucaggga

SEQ ID NO: 84660 - RNA, 32 nt, Human
cagagacaggaggcggcggcagcagcggcggc

SEQ ID NO: 84661 - RNA, 32 nt, Human
cagagacaggcaggaguagacacccggacacc

SEQ ID NO: 84662 - RNA, 32 nt, Human
cagagacaugcaacaacaacacacacgcacac

SEQ ID NO: 84663 - RNA, 32 nt, Human
cagagacaugccagaacauacaaggacaugcu

SEQ ID NO: 84664 - RNA, 22 nt, Human
cagagaccaagagggagagagg

SEQ ID NO: 84665 - RNA, 24 nt, Human
cagagaccaagagguguggaagga

SEQ ID NO: 84666 - RNA, 32 nt, Human
cagagaccaagcuagauccuuuuucucaccuu

SEQ ID NO: 84667 - RNA, 32 nt, Human
cagagaccaagugcccacuuagccgugaaaaa

SEQ ID NO: 84668 - RNA, 32 nt, Human
cagagaccacugcacuccagccugggcaacag

SEQ ID NO: 84669 - RNA, 32 nt, Human
cagagaccagacgugccugggcccugugcuga

SEQ ID NO: 84670 - RNA, 32 nt, Human
cagagaccagagggacugggcggcuuguccca

SEQ ID NO: 84671 - RNA, 32 nt, Human
cagagaccaggaucgccccaggcagggaaaaa

SEQ ID NO: 84672 - RNA, 32 nt, Human
cagagaccagggaaguggcagcagcauggggc

SEQ ID NO: 84673 - RNA, 32 nt, Human
cagagaccauccuggccaacacggugaaaccc

SEQ ID NO: 84674 - RNA, 23 nt, Human
cagagacccaacgcccccagagg

SEQ ID NO: 84675 - RNA, 21 nt, Human
cagagacccaccgagcggcgg

SEQ ID NO: 84676 - RNA, 32 nt, Human
cagagacccacugucguuccccgugugucccc

SEQ ID NO: 84677 - RNA, 32 nt, Human
cagagacccagaggcuggaaguagaaggucca

SEQ ID NO: 84678 - RNA, 21 nt, Human
cagagacccagaucucaugga

SEQ ID NO: 84679 - RNA, 20 nt, Human
cagagacccaggaguuggga

SEQ ID NO: 84680 - RNA, 32 nt, Human
cagagacccagugcccucaacaguaagacuuu

SEQ ID NO: 84681 - RNA, 23 nt, Human
cagagaccccaagaccuuaggga

SEQ ID NO: 84682 - RNA, 32 nt, Human
cagagaccccagcaccuggcccaggaugcagg

SEQ ID NO: 84683 - RNA, 32 nt, Human
cagagaccccagcagaggaggacaguggcucu

SEQ ID NO: 84684 - RNA, 20 nt, Human
cagagaccccagccugggga

SEQ ID NO: 84685 - RNA, 26 nt, Human
cagagaccccccacuguguccaggga

SEQ ID NO: 84686 - RNA, 22 nt, Human
cagagacccccgacugcaggga

SEQ ID NO: 84687 - RNA, 21 nt, Human
cagagacccgcacgggcacgg

SEQ ID NO: 84688 - RNA, 19 nt, Human
cagagacccgcagccggga

SEQ ID NO: 84689 - RNA, 23 nt, Human
cagagacccugaaagaggaggga

SEQ ID NO: 84690 - RNA, 32 nt, Human
cagagacccugccucuguuugaccccgcacug

SEQ ID NO: 84691 - RNA, 32 nt, Human
cagagacccuggaaguggagguggcugugugc

SEQ ID NO: 84692 - RNA, 32 nt, Human
cagagacccuucagugcuguguguuuuuccuu

SEQ ID NO: 84693 - RNA, 21 nt, Human
cagagaccucacucccgggga

SEQ ID NO: 84694 - RNA, 23 nt, Human
cagagaccucaucagccuuggga

SEQ ID NO: 84695 - RNA, 32 nt, Human
cagagaccuccagguggcuccggucggaggug

SEQ ID NO: 84696 - RNA, 32 nt, Human
cagagaccucugcccuccucacccucagggac

SEQ ID NO: 84697 - RNA, 20 nt, Human
cagagaccugugcccagaga

SEQ ID NO: 84698 - RNA, 32 nt, Human
cagagaccuucucuuucaacugaagcccucug

SEQ ID NO: 84699 - RNA, 32 nt, Human
cagagaccuugugauauucacacacauucagg

SEQ ID NO: 84700 - RNA, 26 nt, Human
cagagacgagcugaggacgaggggga

SEQ ID NO: 84701 - RNA, 22 nt, Human
cagagacgccagaggugcagcu

SEQ ID NO: 84702 - RNA, 22 nt, Human
cagagacgggcacacccaggga

SEQ ID NO: 84703 - RNA, 32 nt, Human
cagagacguggagagacacagagagacuugga

SEQ ID NO: 84704 - RNA, 22 nt, Human
cagagacucagggagagggaga

SEQ ID NO: 84705 - RNA, 23 nt, Human
cagagacucauccagccggagga

SEQ ID NO: 84706 - RNA, 22 nt, Human
cagagacuccagaggccaggga

SEQ ID NO: 84707 - RNA, 32 nt, Human
cagagacuccagaggccagggaaggagaucaa

SEQ ID NO: 84708 - RNA, 32 nt, Human
cagagacuccugggggaagggugaguuuacag

SEQ ID NO: 84709 - RNA, 21 nt, Human
cagagacucuucugucaggga

SEQ ID NO: 84710 - RNA, 32 nt, Human
cagagacugaaugacaugcaacaggugaaggu

SEQ ID NO: 84711 - RNA, 32 nt, Human
cagagacugccagcauccccuccagggaaggg

SEQ ID NO: 84712 - RNA, 32 nt, Human
cagagacugccuggucgccagcgcucaccaug

SEQ ID NO: 84713 - RNA, 32 nt, Human
cagagacuggaggugacccuugcccuuuucca

SEQ ID NO: 84714 - RNA, 20 nt, Human
cagagacuggcagccaggga

SEQ ID NO: 84715 - RNA, 32 nt, Human
cagagacuuuaaucacugcugaagaugccccu

SEQ ID NO: 84716 - RNA, 32 nt, Human
cagagagaaaaauaacagugaaugugcuccug

SEQ ID NO: 84717 - RNA, 32 nt, Human
cagagagaaagagagagaaagaguaugugguc

SEQ ID NO: 84718 - RNA, 32 nt, Human
cagagagaaggagaaagagggagggagagaga

SEQ ID NO: 84719 - RNA, 32 nt, Human
cagagagaaguggccagagaggcccaggggac

SEQ ID NO: 84720 - RNA, 32 nt, Human
cagagagaagugugcauguacacacaccacac

SEQ ID NO: 84721 - RNA, 32 nt, Human
cagagagaauaaccuccaucuccuggguccca

SEQ ID NO: 84722 - RNA, 32 nt, Human
cagagagacaagagagcuuguucuccaaucuc

SEQ ID NO: 84723 - RNA, 32 nt, Human
cagagagacagagccugaguaauugaaucaug

SEQ ID NO: 84724 - RNA, 32 nt, Human
cagagagacagggagagucagccuccacauuc

SEQ ID NO: 84725 - RNA, 32 nt, Human
cagagagaccacgccgauugcugagaggaacu

SEQ ID NO: 84726 - RNA, 32 nt, Human
cagagagacgcaucuguuuaccugccacccac

SEQ ID NO: 84727 - RNA, 32 nt, Human
cagagagacuaggacaguuacugcagagcucc

SEQ ID NO: 84728 - RNA, 22 nt, Human
cagagagagaggaagauggaga

SEQ ID NO: 84729 - RNA, 24 nt, Human
cagagagagcacuggagcuggagg

SEQ ID NO: 84730 - RNA, 32 nt, Human
cagagagagcagagacagguggaccaacagac

SEQ ID NO: 84731 - RNA, 32 nt, Human
cagagagagcaucugcuuuggacccaacaccu

SEQ ID NO: 84732 - RNA, 32 nt, Human
cagagagaggcguccugggugaaggaagguac

SEQ ID NO: 84733 - RNA, 32 nt, Human
cagagagaggcuucccucccagccucaguuua

SEQ ID NO: 84734 - RNA, 32 nt, Human
cagagagagggagggagaagagagauaguggg

SEQ ID NO: 84735 - RNA, 32 nt, Human
cagagagaguuguuuuaauaacuuaucuauaa

SEQ ID NO: 84736 - RNA, 32 nt, Human
cagagagauaaagcuguugcccaaugagccuu

SEQ ID NO: 84737 - RNA, 32 nt, Human
cagagagauccagagcccuacacuccacgacc

SEQ ID NO: 84738 - RNA, 22 nt, Human
cagagagaugcugaaagagggg

SEQ ID NO: 84739 - RNA, 32 nt, Human
cagagagaugcugaguuaggccugucaggucu

SEQ ID NO: 84740 - RNA, 32 nt, Human
cagagagauguucuuguuucugguguugucac

SEQ ID NO: 84741 - RNA, 32 nt, Human
cagagagcacgggagcuucuccaccucgccug

SEQ ID NO: 84742 - RNA, 32 nt, Human
cagagagcagaaagcagcccucaccagacgcu

SEQ ID NO: 84743 - RNA, 32 nt, Human
cagagagcagaagaaaagcagaagcgaagcuc

SEQ ID NO: 84744 - RNA, 32 nt, Human
cagagagcagagggggucaugcagugaguggg

SEQ ID NO: 84745 - RNA, 32 nt, Human
cagagagcagagguucuucaguccacgcaacg

SEQ ID NO: 84746 - RNA, 20 nt, Human
cagagagcagcggcugggca

SEQ ID NO: 84747 - RNA, 32 nt, Human
cagagagcagggauaugucaccaggacuccug

SEQ ID NO: 84748 - RNA, 21 nt, Human
cagagagcauuugagaagagg

SEQ ID NO: 84749 - RNA, 32 nt, Human
cagagagccacacccauccacaccgccaccac

SEQ ID NO: 84750 - RNA, 32 nt, Human
cagagagccaccaugaccucucagccucucag

SEQ ID NO: 84751 - RNA, 32 nt, Human
cagagagccauaacucuucuucaauacaguau

SEQ ID NO: 84752 - RNA, 24 nt, Human
cagagagccccaagcaaaaguggg

SEQ ID NO: 84753 - RNA, 32 nt, Human
cagagagccugaugcucucugauagcugugcc

SEQ ID NO: 84754 - RNA, 19 nt, Human
cagagagccugggagagcc

SEQ ID NO: 84755 - RNA, 23 nt, Human
cagagagccuugcugagaagggg

SEQ ID NO: 84756 - RNA, 20 nt, Human
cagagagcgcccuccaggga

SEQ ID NO: 84757 - RNA, 19 nt, Human
cagagagcuccuccagccu

SEQ ID NO: 84758 - RNA, 32 nt, Human
cagagagcucucacgcccuuuccaccauguga

SEQ ID NO: 84759 - RNA, 32 nt, Human
cagagagcucugcgacgcugcagccgcaggga

SEQ ID NO: 84760 - RNA, 21 nt, Human
cagagagcugaagaaaggggg

SEQ ID NO: 84761 - RNA, 22 nt, Human
cagagagcugaagaaaggggga

SEQ ID NO: 84762 - RNA, 32 nt, Human
cagagagcugaagugaaggcuugaggggaugc

SEQ ID NO: 84763 - RNA, 25 nt, Human
cagagagcuguauaaaaucauacca

SEQ ID NO: 84764 - RNA, 22 nt, Human
cagagagcuuagaggaaaaagg

SEQ ID NO: 84765 - RNA, 32 nt, Human
cagagagcuugaugcuuucugccuucugucuc

SEQ ID NO: 84766 - RNA, 32 nt, Human
cagagaggaaggagguggagcagcuggggcug

SEQ ID NO: 84767 - RNA, 32 nt, Human
cagagaggaagugcaggucuaaccaaggaaac

SEQ ID NO: 84768 - RNA, 32 nt, Human
cagagaggacgaucagugagaucuggccucgu

SEQ ID NO: 84769 - RNA, 32 nt, Human
cagagaggagagauuugcuggggcaaaaggcc

SEQ ID NO: 84770 - RNA, 32 nt, Human
cagagaggagguggcuaugucuucuuaagccu

SEQ ID NO: 84771 - RNA, 30 nt, Human
cagagaggaugccacagggaaaguaugaaa

SEQ ID NO: 84772 - RNA, 32 nt, Human
cagagaggcaggcagcccagcccaggggaccc

SEQ ID NO: 84773 - RNA, 32 nt, Human
cagagaggcauuccuuucuccuccucucaucc

SEQ ID NO: 84774 - RNA, 19 nt, Human
cagagaggcccaggggaca

SEQ ID NO: 84775 - RNA, 32 nt, Human
cagagaggcccgcagaggucugaggaggggcu

SEQ ID NO: 84776 - RNA, 32 nt, Human
cagagaggccugauacaagcaaguuuguuuac

SEQ ID NO: 84777 - RNA, 32 nt, Human
cagagagggaaaaacggagagugaaggagcga

SEQ ID NO: 84778 - RNA, 32 nt, Human
cagagagggaagagauucagccagcacacucc

SEQ ID NO: 84779 - RNA, 32 nt, Human
cagagagggaagggaaagccugaggccggcau

SEQ ID NO: 84780 - RNA, 32 nt, Human
cagagagggagacaggcaggcaggcagguggu

SEQ ID NO: 84781 - RNA, 32 nt, Human
cagagagggagagaggcagagagggagagagg

SEQ ID NO: 84782 - RNA, 32 nt, Human
cagagagggagagagggagagugacagcagcg

SEQ ID NO: 84783 - RNA, 32 nt, Human
cagagagggagauuugaagaugcugcacuucu

SEQ ID NO: 84784 - RNA, 32 nt, Human
cagagagggcccuccccucugcccuggacuuu

SEQ ID NO: 84785 - RNA, 19 nt, Human
cagagagggcccugagaga

SEQ ID NO: 84786 - RNA, 22 nt, Human
cagagagggcuccuguggcugc

SEQ ID NO: 84787 - RNA, 32 nt, Human
cagagaggggccugguguaucacuggaggaaa

SEQ ID NO: 84788 - RNA, 32 nt, Human
cagagaggggcugcucuccagaaagcuaaaau

SEQ ID NO: 84789 - RNA, 32 nt, Human
cagagagggguuuugcaaccagccucuggcug

SEQ ID NO: 84790 - RNA, 32 nt, Human
cagagaggguaacaggaggagucggggauaaa

SEQ ID NO: 84791 - RNA, 32 nt, Human
cagagaggguggugaccucugccugaagucac

SEQ ID NO: 84792 - RNA, 32 nt, Human
cagagaggucaugguuguacccaagggaagug

SEQ ID NO: 84793 - RNA, 32 nt, Human
cagagaguccuugugcucagugcacuggcuga

SEQ ID NO: 84794 - RNA, 32 nt, Human
cagagagugcacaaacuacccagcacagcccc

SEQ ID NO: 84795 - RNA, 32 nt, Human
cagagagugguucauccauacucucauucccu

SEQ ID NO: 84796 - RNA, 32 nt, Human
cagagaguucucucaauuuguaaguuauuuuu

SEQ ID NO: 84797 - RNA, 32 nt, Human
cagagauaacaaguguugaacugaccuugcca

SEQ ID NO: 84798 - RNA, 26 nt, Human
cagagauaagucauggagaggacauu

SEQ ID NO: 84799 - RNA, 32 nt, Human
cagagauagagcugaggaguccuguguucccc

SEQ ID NO: 84800 - RNA, 32 nt, Human
cagagauagagugcagggcauggcauuggagg

SEQ ID NO: 84801 - RNA, 32 nt, Human
cagagauaugugaccuuccagacagagaauuc

SEQ ID NO: 84802 - RNA, 32 nt, Human
cagagaucaagcaucuggcaucagggaucuuc

SEQ ID NO: 84803 - RNA, 32 nt, Human
cagagaucacaaaacuaacagcucuuucugca

SEQ ID NO: 84804 - RNA, 32 nt, Human
cagagaucacauuucaacuagauucuuaggaa

SEQ ID NO: 84805 - RNA, 32 nt, Human
cagagaucacuugaggccaggagcuggugugc

SEQ ID NO: 84806 - RNA, 32 nt, Human
cagagaucaggugggcagaggcuggcagugcu

SEQ ID NO: 84807 - RNA, 23 nt, Human
cagagauccaacauguuguggga

SEQ ID NO: 84808 - RNA, 32 nt, Human
cagagauccacaugacaggcccaaugugccuc

SEQ ID NO: 84809 - RNA, 23 nt, Human
cagagauccauugccaucaguga

SEQ ID NO: 84810 - RNA, 24 nt, Human
cagagauccccagagccccagggg

SEQ ID NO: 84811 - RNA, 32 nt, Human
cagagauccccuagguccuggcccaggccugc

SEQ ID NO: 84812 - RNA, 32 nt, Human
cagagaucgcuguggggucugugugaccauca

SEQ ID NO: 84813 - RNA, 32 nt, Human
cagagaucuccaguccacaccugugugcuccg

SEQ ID NO: 84814 - RNA, 32 nt, Human
cagagaucuugcucauacaaugaaucacgcaa

SEQ ID NO: 84815 - RNA, 32 nt, Human
cagagaugacagcagaguccucgagcaccugg

SEQ ID NO: 84816 - RNA, 32 nt, Human
cagagaugcauuccagagaugcacuccgcucu

SEQ ID NO: 84817 - RNA, 32 nt, Human
cagagaugccccaggguggagggggugggaau

SEQ ID NO: 84818 - RNA, 32 nt, Human
cagagaugcccugaggauggugguuaaggaaa

SEQ ID NO: 84819 - RNA, 30 nt, Human
cagagaugccugcccacagccuggugauga

SEQ ID NO: 84820 - RNA, 32 nt, Human
cagagaugccuguaauggugagacuuuggauc

SEQ ID NO: 84821 - RNA, 32 nt, Human
cagagaugcuggggucgagaccccagggagaa

SEQ ID NO: 84822 - RNA, 20 nt, Human
cagagauggacagaggcacc

SEQ ID NO: 84823 - RNA, 32 nt, Human
cagagauggacgaugcucauccagccacaccc

SEQ ID NO: 84824 - RNA, 32 nt, Human
cagagauggacuguggccaggcuuccacauuc

SEQ ID NO: 84825 - RNA, 30 nt, Human
cagagauggagcaacuacuaggaauaaaac

SEQ ID NO: 84826 - RNA, 32 nt, Human
cagagauggaguuucaccacguuggccaagcu

SEQ ID NO: 84827 - RNA, 32 nt, Human
cagagauggaguuucaccauauugcccaggcu

SEQ ID NO: 84828 - RNA, 30 nt, Human
cagagaugggcagugagaaggagcagaguc

SEQ ID NO: 84829 - RNA, 32 nt, Human
cagagauggggaacaggauggagcagcuggaa

SEQ ID NO: 84830 - RNA, 17 nt, Human
cagagauggguccccaa

SEQ ID NO: 84831 - RNA, 30 nt, Human
cagagauggguggaggggcuggggaaaggc

SEQ ID NO: 84832 - RNA, 32 nt, Human
cagagauggugaggcaggacucacagggcccc

SEQ ID NO: 84833 - RNA, 32 nt, Human
cagagauggugggcgucuuugggaucuggccu

SEQ ID NO: 84834 - RNA, 32 nt, Human
cagagauguaacaagcucauaggguaucaaua

SEQ ID NO: 84835 - RNA, 32 nt, Human
cagagaugucucacagcacauauguacuuuac

SEQ ID NO: 84836 - RNA, 32 nt, Human
cagagaugugaugcaggaaaccuucacgaacc

SEQ ID NO: 84837 - RNA, 32 nt, Human
cagagaugugaugcaggaaaccuucaggaacc

SEQ ID NO: 84838 - RNA, 32 nt, Human
cagagaugugcuuuggagauuuggaaagcagg

SEQ ID NO: 84839 - RNA, 32 nt, Human
cagagauguuccuccccucaucugcccggguu

SEQ ID NO: 84840 - RNA, 32 nt, Human
cagagauguuucagaauacaaaauuaguauau

SEQ ID NO: 84841 - RNA, 22 nt, Human
cagagauuaaacauuguccuuu

SEQ ID NO: 84842 - RNA, 32 nt, Human
cagagauucauggaucaggcagcuccaaacua

SEQ ID NO: 84843 - RNA, 32 nt, Human
cagagauucauggaucaggcagcuccaaacug

SEQ ID NO: 84844 - RNA, 32 nt, Human
cagagauucccugagugucuguccucacccaa

SEQ ID NO: 84845 - RNA, 32 nt, Human
cagagauucuagaugaagacagcugcccuuuu

SEQ ID NO: 84846 - RNA, 32 nt, Human
cagagauuggaacaguuuggaggacuuagaau

SEQ ID NO: 84847 - RNA, 32 nt, Human
cagagauuucaaaucauugaacacugaaguau

SEQ ID NO: 84848 - RNA, 32 nt, Human
cagagauuucaucauggucucccaggcccuca

SEQ ID NO: 84849 - RNA, 32 nt, Human
cagagauuugcugccaggaaucaauuuugagg

SEQ ID NO: 84850 - RNA, 32 nt, Human
cagagauuuggauucccuuggcggccguggag

SEQ ID NO: 84851 - RNA, 32 nt, Human
cagagauuugguuaagcucacacagcuaacaa

SEQ ID NO: 84852 - RNA, 32 nt, Human
cagagcaaaaggggaagggaagaggcagucag

SEQ ID NO: 84853 - RNA, 21 nt, Human
cagagcaaagaagauggggga

SEQ ID NO: 84854 - RNA, 32 nt, Human
cagagcaaauaagggaccuggccuaguucaca

SEQ ID NO: 84855 - RNA, 32 nt, Human
cagagcaaccccuggaccccagccucaaaucc

SEQ ID NO: 84856 - RNA, 32 nt, Human
cagagcaagaccacagcuggugaacaguccag

SEQ ID NO: 84857 - RNA, 20 nt, Human
cagagcaagaccgugucuca

SEQ ID NO: 84858 - RNA, 32 nt, Human
cagagcaagcuucucccacuucuugaaaggcu

SEQ ID NO: 84859 - RNA, 32 nt, Human
cagagcaaggcccucagggagggucauccucc

SEQ ID NO: 84860 - RNA, 32 nt, Human
cagagcaagggccugucucagcaaaacaaaac

SEQ ID NO: 84861 - RNA, 32 nt, Human
cagagcaagguuggguucgcuccucuggcaga

SEQ ID NO: 84862 - RNA, 22 nt, Human
cagagcaaguaugaaggugaug

SEQ ID NO: 84863 - RNA, 32 nt, Human
cagagcaagugauccuggagcugcagccugcc

SEQ ID NO: 84864 - RNA, 24 nt, Human
cagagcacaaccacagugaccgga

SEQ ID NO: 84865 - RNA, 32 nt, Human
cagagcacacgcaacccagccucagcaucaca

SEQ ID NO: 84866 - RNA, 32 nt, Human
cagagcacagccgagccgagcggcccgggcgg

SEQ ID NO: 84867 - RNA, 32 nt, Human
cagagcacaggcaguugugugccuugggccca

SEQ ID NO: 84868 - RNA, 32 nt, Human
cagagcacaucagcuaugugccccagcucuca

SEQ ID NO: 84869 - RNA, 32 nt, Human
cagagcaccagagacgucagcaucucaagggc

SEQ ID NO: 84870 - RNA, 32 nt, Human
cagagcaccauccugggucagaaggucucaug

SEQ ID NO: 84871 - RNA, 21 nt, Human
cagagcaccuggcgugggcca

SEQ ID NO: 84872 - RNA, 24 nt, Human
cagagcacgguggccacccccuga

SEQ ID NO: 84873 - RNA, 32 nt, Human
cagagcacuaagcugcugggaacccaucugug

SEQ ID NO: 84874 - RNA, 32 nt, Human
cagagcacuacagccuuuuauugaguggggca

SEQ ID NO: 84875 - RNA, 32 nt, Human
cagagcacucauuccuucccacccccaguccu

SEQ ID NO: 84876 - RNA, 32 nt, Human
cagagcacugcgauguucaggggugagucagg

SEQ ID NO: 84877 - RNA, 32 nt, Human
cagagcacugggugagagggagaagaccuugg

SEQ ID NO: 84878 - RNA, 32 nt, Human
cagagcacuuguuaacuuaguccuccugcaua

SEQ ID NO: 84879 - RNA, 32 nt, Human
cagagcagacacaaggcucugccugcaccagg

SEQ ID NO: 84880 - RNA, 32 nt, Human
cagagcagacacugcgaugacaacggacgaca

SEQ ID NO: 84881 - RNA, 22 nt, Human
cagagcagacugcucuguccuu

SEQ ID NO: 84882 - RNA, 32 nt, Human
cagagcagagaggcccagggaggggccaggug

SEQ ID NO: 84883 - RNA, 32 nt, Human
cagagcagagcugauggagaaggaaggcucca

SEQ ID NO: 84884 - RNA, 32 nt, Human
cagagcagagcugauggcaugagugagggcug

SEQ ID NO: 84885 - RNA, 32 nt, Human
cagagcagaggccaggguggccagcaguggcu

SEQ ID NO: 84886 - RNA, 32 nt, Human
cagagcagaggcugaggcacggggagccagcc

SEQ ID NO: 84887 - RNA, 32 nt, Human
cagagcagauucaagaaagaagaucaggaagg

SEQ ID NO: 84888 - RNA, 20 nt, Human
cagagcagcagcuacgggca

SEQ ID NO: 84889 - RNA, 24 nt, Human
cagagcagccaggaccaccccuga

SEQ ID NO: 84890 - RNA, 32 nt, Human
cagagcagccaguguccgggaggcagaagaug

SEQ ID NO: 84891 - RNA, 21 nt, Human
cagagcagcccccacccggga

SEQ ID NO: 84892 - RNA, 32 nt, Human
cagagcagcccgagggccagccugagccccug

SEQ ID NO: 84893 - RNA, 21 nt, Human
cagagcagccggaguuugcug

SEQ ID NO: 84894 - RNA, 32 nt, Human
cagagcagccugcggccuccaagccuuccugg

SEQ ID NO: 84895 - RNA, 32 nt, Human
cagagcagccuggccaccauagugagaucccu

SEQ ID NO: 84896 - RNA, 21 nt, Human
cagagcagccugggcaacaug

SEQ ID NO: 84897 - RNA, 32 nt, Human
cagagcagccugggcaacgcagugagagaccc

SEQ ID NO: 84898 - RNA, 21 nt, Human
cagagcagcggagcugccccg

SEQ ID NO: 84899 - RNA, 32 nt, Human
cagagcagcugcaggccuugggagaggaccca

SEQ ID NO: 84900 - RNA, 32 nt, Human
cagagcaggaagcacaccugugccauuucugg

SEQ ID NO: 84901 - RNA, 32 nt, Human
cagagcaggacuggaaauguccuggccgcgcc

SEQ ID NO: 84902 - RNA, 32 nt, Human
cagagcaggagaagacacgagagcagaaagaa

SEQ ID NO: 84903 - RNA, 32 nt, Human
cagagcaggaggcagagcccgcgggaagcucg

SEQ ID NO: 84904 - RNA, 32 nt, Human
cagagcaggccaguguacccagagccauggca

SEQ ID NO: 84905 - RNA, 32 nt, Human
cagagcaggccuggcccccagcugugagggcc

SEQ ID NO: 84906 - RNA, 32 nt, Human
cagagcaggcucggcgcuuccaccccagugca

SEQ ID NO: 84907 - RNA, 32 nt, Human
cagagcaggcuucaucugcucugccauccagc

SEQ ID NO: 84908 - RNA, 32 nt, Human
cagagcaggcuuugugagagaggaccuccaug

SEQ ID NO: 84909 - RNA, 32 nt, Human
cagagcaggggaucagaggagacugaagcaga

SEQ ID NO: 84910 - RNA, 32 nt, Human
cagagcagggggaggcagcccagaucccugcu

SEQ ID NO: 84911 - RNA, 32 nt, Human
cagagcagggggcugagccagguuggagccua

SEQ ID NO: 84912 - RNA, 32 nt, Human
cagagcaggguggagagggcggugggaggcgu

SEQ ID NO: 84913 - RNA, 32 nt, Human
cagagcagguauagacuccugaaagacaauau

SEQ ID NO: 84914 - RNA, 32 nt, Human
cagagcagguggggaaaaagaggagaagaaaa

SEQ ID NO: 84915 - RNA, 32 nt, Human
cagagcagucggugacaggacagagcagucgg

SEQ ID NO: 84916 - RNA, 32 nt, Human
cagagcagugcacuccagucugcagguacugc

SEQ ID NO: 84917 - RNA, 32 nt, Human
cagagcagugcuagucgggcuuggggguggcu

SEQ ID NO: 84918 - RNA, 32 nt, Human
cagagcaguggugacguggccugggaggaggu

SEQ ID NO: 84919 - RNA, 21 nt, Human
cagagcaguuugcuuugaaaa

SEQ ID NO: 84920 - RNA, 32 nt, Human
cagagcauacacaccacgucuacuucucagcg

SEQ ID NO: 84921 - RNA, 32 nt, Human
cagagcauagaugaaaauggcaaguucccugg

SEQ ID NO: 84922 - RNA, 22 nt, Human
cagagcauccagagccucuguc

SEQ ID NO: 84923 - RNA, 32 nt, Human
cagagcaucuacugggacuacaggugcacugu

SEQ ID NO: 84924 - RNA, 32 nt, Human
cagagcaucuccaggagggggaaagggucacc

SEQ ID NO: 84925 - RNA, 24 nt, Human
cagagcaucucgaggcaacuguua

SEQ ID NO: 84926 - RNA, 32 nt, Human
cagagcaugacaaagaugacgcucaaaaguaa

SEQ ID NO: 84927 - RNA, 32 nt, Human
cagagcaugccgaacccaggagucugucucac

SEQ ID NO: 84928 - RNA, 32 nt, Human
cagagcauggaaagggggucagcucuggucug

SEQ ID NO: 84929 - RNA, 32 nt, Human
cagagcauggaaaucacuuucauuuccggauu

SEQ ID NO: 84930 - RNA, 32 nt, Human
cagagcaugggcugggccugggcacaggagga

SEQ ID NO: 84931 - RNA, 32 nt, Human
cagagcauggggcagagccaggacuagagcuc

SEQ ID NO: 84932 - RNA, 32 nt, Human
cagagcaugggggcgggggcucuggaguggug

SEQ ID NO: 84933 - RNA, 32 nt, Human
cagagcaugguggcaggcgccuguaaucccag

SEQ ID NO: 84934 - RNA, 22 nt, Human
cagagcauugcuacggcugcug

SEQ ID NO: 84935 - RNA, 32 nt, Human
cagagcauuuucugccuguuuggaagguuuga

SEQ ID NO: 84936 - RNA, 32 nt, Human
cagagccaaacagacaagcaaccaaaauaaaa

SEQ ID NO: 84937 - RNA, 32 nt, Human
cagagccaaacagagcuggccugaaccuccag

SEQ ID NO: 84938 - RNA, 18 nt, Human
cagagccaacaggaugaa

SEQ ID NO: 84939 - RNA, 32 nt, Human
cagagccaaccaggacacuaauacagcucaga

SEQ ID NO: 84940 - RNA, 22 nt, Human
cagagccaagaccagaacccag

SEQ ID NO: 84941 - RNA, 32 nt, Human
cagagccaaggagcugcuucucucuucuccca

SEQ ID NO: 84942 - RNA, 32 nt, Human
cagagccaaucacagacccaccacacagccca

SEQ ID NO: 84943 - RNA, 32 nt, Human
cagagccaaugcccgccccaucgugucauggc

SEQ ID NO: 84944 - RNA, 32 nt, Human
cagagccacaagcaaaguuugcacugggccca

SEQ ID NO: 84945 - RNA, 32 nt, Human
cagagccacagcugggagaccugcacuguccc

SEQ ID NO: 84946 - RNA, 32 nt, Human
cagagccacccaaugaacagugcaaugugaag

SEQ ID NO: 84947 - RNA, 21 nt, Human
cagagccacguguggcugcug

SEQ ID NO: 84948 - RNA, 32 nt, Human
cagagccacguuugaacccagaagaacaccag

SEQ ID NO: 84949 - RNA, 32 nt, Human
cagagccacugcagaggaccagacugggaaaa

SEQ ID NO: 84950 - RNA, 32 nt, Human
cagagccacugcaguccccgcucggaggaugu

SEQ ID NO: 84951 - RNA, 32 nt, Human
cagagccacugcauucaucccauauccuucug

SEQ ID NO: 84952 - RNA, 32 nt, Human
cagagccacuuuuaggcauaaggaaggcagcc

SEQ ID NO: 84953 - RNA, 32 nt, Human
cagagccagaacuagagacgggcacccaggcu

SEQ ID NO: 84954 - RNA, 32 nt, Human
cagagccagaacugagcccagugagagcgcac

SEQ ID NO: 84955 - RNA, 32 nt, Human
cagagccagaagccagagggccagggauauga

SEQ ID NO: 84956 - RNA, 32 nt, Human
cagagccagacagcaggcuccuggucccaguc

SEQ ID NO: 84957 - RNA, 32 nt, Human
cagagccagagagaaagaggaagagacugagu

SEQ ID NO: 84958 - RNA, 32 nt, Human
cagagccagcagcugccaugcccuccugcucc

SEQ ID NO: 84959 - RNA, 23 nt, Human
cagagccagccagauuugagaag

SEQ ID NO: 84960 - RNA, 20 nt, Human
cagagccagccaucuggaag

SEQ ID NO: 84961 - RNA, 20 nt, Human
cagagccagccggcuaugaa

SEQ ID NO: 84962 - RNA, 32 nt, Human
cagagccagccgggauuccagugagaugggug

SEQ ID NO: 84963 - RNA, 32 nt, Human
cagagccagcugacgcccucccugccucccag

SEQ ID NO: 84964 - RNA, 32 nt, Human
cagagccaggagagguugggugacacccacug

SEQ ID NO: 84965 - RNA, 32 nt, Human
cagagccaggagcccacccaagagagaucagg

SEQ ID NO: 84966 - RNA, 32 nt, Human
cagagccaggaggcaguggggcugugggcuca

SEQ ID NO: 84967 - RNA, 32 nt, Human
cagagccagggaagccgaaggggaagaggcgg

SEQ ID NO: 84968 - RNA, 32 nt, Human
cagagccagggcugugaugccaggaaguggaa

SEQ ID NO: 84969 - RNA, 32 nt, Human
cagagccauaugcaagcacaugaagccgaggg

SEQ ID NO: 84970 - RNA, 32 nt, Human
cagagccauaugcaagcacaugagccgagcgu

SEQ ID NO: 84971 - RNA, 24 nt, Human
cagagccauauuucucuucuuuca

SEQ ID NO: 84972 - RNA, 32 nt, Human
cagagccaugaagaagaaguuaguggugcugg

SEQ ID NO: 84973 - RNA, 32 nt, Human
cagagccaugccacaucuguauauagaugggg

SEQ ID NO: 84974 - RNA, 32 nt, Human
cagagcccaagaaaucacuggugaugagaugg

SEQ ID NO: 84975 - RNA, 32 nt, Human
cagagcccaagaggcaggggaaaggcggcaau

SEQ ID NO: 84976 - RNA, 32 nt, Human
cagagcccaagcagcacucaggagaggggaga

SEQ ID NO: 84977 - RNA, 32 nt, Human
cagagcccaagucaggaggucaagugugcaug

SEQ ID NO: 84978 - RNA, 20 nt, Human
cagagcccacagcuuccaag

SEQ ID NO: 84979 - RNA, 32 nt, Human
cagagcccacccgucuguccucggugacggcc

SEQ ID NO: 84980 - RNA, 32 nt, Human
cagagcccacccucccaagcucaggggcaucc

SEQ ID NO: 84981 - RNA, 32 nt, Human
cagagcccagaacucacgccgggggaggccga

SEQ ID NO: 84982 - RNA, 32 nt, Human
cagagcccagggcaauggugucuguccagccc

SEQ ID NO: 84983 - RNA, 32 nt, Human
cagagcccaguuaauucuccgcaccucgguug

SEQ ID NO: 84984 - RNA, 32 nt, Human
cagagccccacauuauuaugugaauaacaaug

SEQ ID NO: 84985 - RNA, 32 nt, Human
cagagccccaggacugggccagagcacuuagg

SEQ ID NO: 84986 - RNA, 21 nt, Human
cagagcccccaagccucugcc

SEQ ID NO: 84987 - RNA, 32 nt, Human
cagagcccccacccucucucccucaccccucu

SEQ ID NO: 84988 - RNA, 32 nt, Human
cagagcccccaccuucaagucucuccagugug

SEQ ID NO: 84989 - RNA, 32 nt, Human
cagagcccccuccccagcccucaggcccuccc

SEQ ID NO: 84990 - RNA, 22 nt, Human
cagagcccccuccccugcagag

SEQ ID NO: 84991 - RNA, 32 nt, Human
cagagcccccuugagccccucugccuaugucc

SEQ ID NO: 84992 - RNA, 32 nt, Human
cagagccccgcuguccuugccccuggugguuc

SEQ ID NO: 84993 - RNA, 32 nt, Human
cagagccccuccacagucggccucaugacugu

SEQ ID NO: 84994 - RNA, 32 nt, Human
cagagccccuccccaucuuccucucucuaaaa

SEQ ID NO: 84995 - RNA, 32 nt, Human
cagagccccucggaggacaaugcgcccggcgc

SEQ ID NO: 84996 - RNA, 32 nt, Human
cagagccccuggcagauggaggcuccacccug

SEQ ID NO: 84997 - RNA, 32 nt, Human
cagagccccuucccgggccucucccccaaggc

SEQ ID NO: 84998 - RNA, 32 nt, Human
cagagcccuccaggagcguggggugggggcca

SEQ ID NO: 84999 - RNA, 25 nt, Human
cagagcccuccguggugcccgggga

SEQ ID NO: 85000 - RNA, 32 nt, Human
cagagcccuccugcucacacagcugcugagac

SEQ ID NO: 85001 - RNA, 32 nt, Human
cagagcccugcaaccagcaguccagggagaag

SEQ ID NO: 85002 - RNA, 22 nt, Human
cagagcccugcucccuccgggu

SEQ ID NO: 85003 - RNA, 32 nt, Human
cagagcccugcucuuugccuggaugguucacc

SEQ ID NO: 85004 - RNA, 32 nt, Human
cagagcccuuggaguguugguggagaucagag

SEQ ID NO: 85005 - RNA, 32 nt, Human
cagagccgagccgacagagagcagggaaccgg

SEQ ID NO: 85006 - RNA, 32 nt, Human
cagagccgagccgacccuucucucccgggcug

SEQ ID NO: 85007 - RNA, 32 nt, Human
cagagccgaguggcgcacgcugggcaguggcc

SEQ ID NO: 85008 - RNA, 32 nt, Human
cagagccgcaggacggagacugggggcagccc

SEQ ID NO: 85009 - RNA, 32 nt, Human
cagagccgcaucccuuccccagccccuguguu

SEQ ID NO: 85010 - RNA, 32 nt, Human
cagagccgcgaggagcaggcugugcugcuugu

SEQ ID NO: 85011 - RNA, 32 nt, Human
cagagccgcuccccucuccucgccccgccacc

SEQ ID NO: 85012 - RNA, 32 nt, Human
cagagccgcuguuccucuccugccuuuagaga

SEQ ID NO: 85013 - RNA, 32 nt, Human
cagagccggaguuggggagacuguggcugaaa

SEQ ID NO: 85014 - RNA, 32 nt, Human
cagagccgggagcuggagguucugcgggagca

SEQ ID NO: 85015 - RNA, 32 nt, Human
cagagccguggccaggagaaccccuugccacc

SEQ ID NO: 85016 - RNA, 17 nt, Human
cagagccucagcacugu

SEQ ID NO: 85017 - RNA, 32 nt, Human
cagagccucaggaguaaaugaaguuacuaggg

SEQ ID NO: 85018 - RNA, 32 nt, Human
cagagccucaugaaugggauuaaugcccuuau

SEQ ID NO: 85019 - RNA, 32 nt, Human
cagagccucccucccugggcuccuugccagcu

SEQ ID NO: 85020 - RNA, 20 nt, Human
cagagccuccucccagggca

SEQ ID NO: 85021 - RNA, 32 nt, Human
cagagccucuacuucugucucaaaauggcucc

SEQ ID NO: 85022 - RNA, 32 nt, Human
cagagccucuccucaaagaugcuacaaaacuu

SEQ ID NO: 85023 - RNA, 32 nt, Human
cagagccucucuggaagagaaaggaagagcca

SEQ ID NO: 85024 - RNA, 32 nt, Human
cagagccucugccucuuccucugucuccugug

SEQ ID NO: 85025 - RNA, 32 nt, Human
cagagccucugcuggaaggggcagcaggagga

SEQ ID NO: 85026 - RNA, 32 nt, Human
cagagccucuggaaggaguauggcccugccua

SEQ ID NO: 85027 - RNA, 32 nt, Human
cagagccucuuaccuccagaucuuucagggua

SEQ ID NO: 85028 - RNA, 32 nt, Human
cagagccucuugggggcaaaaacaacugcuca

SEQ ID NO: 85029 - RNA, 32 nt, Human
cagagccugagcugcugcugugguguggccca

SEQ ID NO: 85030 - RNA, 32 nt, Human
cagagccugcaagcuagaacuugugggcagcc

SEQ ID NO: 85031 - RNA, 32 nt, Human
cagagccugcauucccgacaccuggugcccua

SEQ ID NO: 85032 - RNA, 32 nt, Human
cagagccugcggcuguggcaaggccuguuucu

SEQ ID NO: 85033 - RNA, 32 nt, Human
cagagccugcuccccgcccucucugcucgcug

SEQ ID NO: 85034 - RNA, 32 nt, Human
cagagccuggagcugagcucuuggugacuggu

SEQ ID NO: 85035 - RNA, 32 nt, Human
cagagccuggcaacagccuggccugcagaaga

SEQ ID NO: 85036 - RNA, 32 nt, Human
cagagccugggacaagcuaggucuccauaacu

SEQ ID NO: 85037 - RNA, 32 nt, Human
cagagccugggagcugcaggaacugucugaga

SEQ ID NO: 85038 - RNA, 32 nt, Human
cagagccugggcagguccuuguauucuggcaa

SEQ ID NO: 85039 - RNA, 32 nt, Human
cagagccugggcgacagagcgagacuccaucu

SEQ ID NO: 85040 - RNA, 32 nt, Human
cagagccuggggaggccaggguagaggcugac

SEQ ID NO: 85041 - RNA, 32 nt, Human
cagagccuggggccuccagccugggacugcug

SEQ ID NO: 85042 - RNA, 32 nt, Human
cagagccugguuugcggaggggagaggcagac

SEQ ID NO: 85043 - RNA, 32 nt, Human
cagagccuguccucacaguggagggguguaag

SEQ ID NO: 85044 - RNA, 32 nt, Human
cagagccuguuuguuucucucuaccugauuuc

SEQ ID NO: 85045 - RNA, 32 nt, Human
cagagccuucuaggagcucaagggcuguuuga

SEQ ID NO: 85046 - RNA, 32 nt, Human
cagagccuucucaucucucccuucgcccaguu

SEQ ID NO: 85047 - RNA, 32 nt, Human
cagagcgacagagcaguugagaggacacuccc

SEQ ID NO: 85048 - RNA, 20 nt, Human
cagagcgagacuuugucuca

SEQ ID NO: 85049 - RNA, 32 nt, Human
cagagcgagagggaagugcagggagccuggcc

SEQ ID NO: 85050 - RNA, 32 nt, Human
cagagcgagcagcguggagcucagugacagca

SEQ ID NO: 85051 - RNA, 32 nt, Human
cagagcgagcuuccccuccucccugcucuccc

SEQ ID NO: 85052 - RNA, 32 nt, Human
cagagcgaggcggggcagugaggacuccgcga

SEQ ID NO: 85053 - RNA, 32 nt, Human
cagagcgccugggacagcuuguccgccaggcu

SEQ ID NO: 85054 - RNA, 32 nt, Human
cagagcgcuagugcccuuggguccuugcgggu

SEQ ID NO: 85055 - RNA, 32 nt, Human
cagagcgcugggauucagcaggagugccagga

SEQ ID NO: 85056 - RNA, 24 nt, Human
cagagcggaggcggaggcgggcgc

SEQ ID NO: 85057 - RNA, 32 nt, Human
cagagcggaucugccacuggcccaggucugga

SEQ ID NO: 85058 - RNA, 32 nt, Human
cagagcggccugggugccuggcggacagaacu

SEQ ID NO: 85059 - RNA, 32 nt, Human
cagagcggcuccgcgagcuucucuccacuuuc

SEQ ID NO: 85060 - RNA, 32 nt, Human
cagagcgggggugggaggggaaugccacagug

SEQ ID NO: 85061 - RNA, 32 nt, Human
cagagcgguuuggcuuuuuaaauuacuguuau

SEQ ID NO: 85062 - RNA, 32 nt, Human
cagagcguaccguggcccagacugauccucga

SEQ ID NO: 85063 - RNA, 32 nt, Human
cagagcgugccgcuacacuccagccugaugac

SEQ ID NO: 85064 - RNA, 25 nt, Human
cagagcgugucccagacaucacagc

SEQ ID NO: 85065 - RNA, 19 nt, Human
cagagcuaaacuccuuccu

SEQ ID NO: 85066 - RNA, 24 nt, Human
cagagcuaaggguuucccugagga

SEQ ID NO: 85067 - RNA, 19 nt, Human
cagagcuaauguacaugcu

SEQ ID NO: 85068 - RNA, 32 nt, Human
cagccagaguucccugaagugggaagucagag

SEQ ID NO: 85069 - RNA, 32 nt, Human
cagccagaucacuuguaugcacaaagcugcug

SEQ ID NO: 85070 - RNA, 32 nt, Human
cagccagauggacuccagccugccuggcaggc

SEQ ID NO: 85071 - RNA, 32 nt, Human
cagccagaugggcugaaaguggaacucaaggg

SEQ ID NO: 85072 - RNA, 32 nt, Human
cagccagaugucuucccacaaaggaucugugg

SEQ ID NO: 85073 - RNA, 32 nt, Human
cagccagauuccauccugaggaagcaaaugaa

SEQ ID NO: 85074 - RNA, 32 nt, Human
cagccagauuccauccuggggaagcaaaugaa

SEQ ID NO: 85075 - RNA, 32 nt, Human
cagccagcacccugggcucucagggacugagg

SEQ ID NO: 85076 - RNA, 32 nt, Human
cagccagcaccucugccuucucagggacaaga

SEQ ID NO: 85077 - RNA, 31 nt, Human
cagccagcacucaagggggagagaagcacau

SEQ ID NO: 85078 - RNA, 32 nt, Human
cagccagcacucacucugcugugugaccugag

SEQ ID NO: 85079 - RNA, 32 nt, Human
cagccagcagagccacguuccuuaugagcacc

SEQ ID NO: 85080 - RNA, 16 nt, Human
cagccagcagcagugg

SEQ ID NO: 85081 - RNA, 32 nt, Human
cagccagcagcgcucaggcuguguggcugccg

SEQ ID NO: 85082 - RNA, 22 nt, Human
cagccagcagcucccacuggug

SEQ ID NO: 85083 - RNA, 17 nt, Human
cagccagcaggcagcca

SEQ ID NO: 85084 - RNA, 32 nt, Human
cagccagcaggcugggggagcagugagggcag

SEQ ID NO: 85085 - RNA, 32 nt, Human
cagccagcagggccaggugacagugaagcuca

SEQ ID NO: 85086 - RNA, 23 nt, Human
cagccagcaucccagacuccaca

SEQ ID NO: 85087 - RNA, 18 nt, Human
cagccagcauccugagcc

SEQ ID NO: 85088 - RNA, 32 nt, Human
cagccagcaucugggagcccggcgagagcggu

SEQ ID NO: 85089 - RNA, 32 nt, Human
cagccagccaaggugguuccugcuucacccac

SEQ ID NO: 85090 - RNA, 32 nt, Human
cagccagccacagguacagagcacaggacccc

SEQ ID NO: 85091 - RNA, 21 nt, Human
cagccagccacucuaccagug

SEQ ID NO: 85092 - RNA, 19 nt, Human
cagccagccagccaacugg

SEQ ID NO: 85093 - RNA, 32 nt, Human
cagccagccagcccauccacuucuuccacucc

SEQ ID NO: 85094 - RNA, 32 nt, Human
cagccagccagcgaagucaccugcucucugcc

SEQ ID NO: 85095 - RNA, 22 nt, Human
cagccagccagcuccgugggug

SEQ ID NO: 85096 - RNA, 20 nt, Human
cagccagccagcuguccugg

SEQ ID NO: 85097 - RNA, 32 nt, Human
cagccagccagggcccaggcagcuuugacugc

SEQ ID NO: 85098 - RNA, 32 nt, Human
cagccagccagggcccugcccagcuucaauuu

SEQ ID NO: 85099 - RNA, 32 nt, Human
cagccagcccaauuucagaagcgcugucucag

SEQ ID NO: 85100 - RNA, 32 nt, Human
cagccagccccaagaucucaggagcuuuaggg

SEQ ID NO: 85101 - RNA, 17 nt, Human
cagccagcccccgccca

SEQ ID NO: 85102 - RNA, 32 nt, Human
cagccagcccgguacagccugugugacuucuc

SEQ ID NO: 85103 - RNA, 32 nt, Human
cagccagcccucaaaacacaaaggaacaaaga

SEQ ID NO: 85104 - RNA, 32 nt, Human
cagccagcccugaaggauggcugccauauugg

SEQ ID NO: 85105 - RNA, 32 nt, Human
cagccagccgagugauuggcgagcccacgagu

SEQ ID NO: 85106 - RNA, 26 nt, Human
cagccagccggcaaaggaaggaggug

SEQ ID NO: 85107 - RNA, 32 nt, Human
cagccagccggcgguccagccuggugccucug

SEQ ID NO: 85108 - RNA, 16 nt, Human
cagccagccgugggcc

SEQ ID NO: 85109 - RNA, 32 nt, Human
cagccagccuccagaaugggacagaagaacca

SEQ ID NO: 85110 - RNA, 32 nt, Human
cagccagccugagcucuccugcaagacagagc

SEQ ID NO: 85111 - RNA, 32 nt, Human
cagccagccugccugccugccugccugcccgc

SEQ ID NO: 85112 - RNA, 32 nt, Human
cagccagcgccucaguagagaccuaagggcgc

SEQ ID NO: 85113 - RNA, 18 nt, Human
cagccagcgcggggccac

SEQ ID NO: 85114 - RNA, 18 nt, Human
cagccagcgcuuccaggc

SEQ ID NO: 85115 - RNA, 22 nt, Human
cagccagcgcuuccaggcccac

SEQ ID NO: 85116 - RNA, 32 nt, Human
cagccagcgugcgggaacgggcaggcagccuc

SEQ ID NO: 85117 - RNA, 21 nt, Human
cagccagcuagcccauaacug

SEQ ID NO: 85118 - RNA, 17 nt, Human
cagccagcucccaggcc

SEQ ID NO: 85119 - RNA, 32 nt, Human
cagccagcuccgaaagcagaagaaggaggcgg

SEQ ID NO: 85120 - RNA, 32 nt, Human
cagccagcucuuaccuccuccugguugcuuuu

SEQ ID NO: 85121 - RNA, 24 nt, Human
cagccagcugcaagccccacagug

SEQ ID NO: 85122 - RNA, 32 nt, Human
cagccagcugcacucugcugcgggcacgggca

SEQ ID NO: 85123 - RNA, 17 nt, Human
cagccagcugcagggcc

SEQ ID NO: 85124 - RNA, 20 nt, Human
cagccagcugcccccuucca

SEQ ID NO: 85125 - RNA, 32 nt, Human
cagccagcuguugccaugucaucugcuguggc

SEQ ID NO: 85126 - RNA, 18 nt, Human
cagccagcuucagggguc

SEQ ID NO: 85127 - RNA, 23 nt, Human
cagccagcuugccagggccacug

SEQ ID NO: 85128 - RNA, 22 nt, Human
cagccagcuugggaaggggaug

SEQ ID NO: 85129 - RNA, 18 nt, Human
cagccaggacacuauaga

SEQ ID NO: 85130 - RNA, 32 nt, Human
cagccaggacaggcaggagcaguggaauagcu

SEQ ID NO: 85131 - RNA, 22 nt, Human
cagccaggacauuaggaccacu

SEQ ID NO: 85132 - RNA, 32 nt, Human
cagccaggacccuugauucagaccauggaccc

SEQ ID NO: 85133 - RNA, 22 nt, Human
cagccaggacgcccggggccac

SEQ ID NO: 85134 - RNA, 32 nt, Human
cagccaggacgcccggggccaccagcucagcu

SEQ ID NO: 85135 - RNA, 32 nt, Human
cagccaggagagaccuuuucugccuggagaga

SEQ ID NO: 85136 - RNA, 32 nt, Human
cagccaggagaggccguuccugccuggagaga

SEQ ID NO: 85137 - RNA, 32 nt, Human
cagccaggagagucacuggcugccuuuggugg

SEQ ID NO: 85138 - RNA, 32 nt, Human
cagccaggagccgcuguugccucccagccccu

SEQ ID NO: 85139 - RNA, 22 nt, Human
cagccaggagcucuccauggcc

SEQ ID NO: 85140 - RNA, 32 nt, Human
cagccaggagcugggagccacaggaagcaaaa

SEQ ID NO: 85141 - RNA, 19 nt, Human
cagccaggagggcaggggg

SEQ ID NO: 85142 - RNA, 32 nt, Human
cagccaggaguccccguuggaaaagaacaaug

SEQ ID NO: 85143 - RNA, 22 nt, Human
cagccaggaugacagagcaaga

SEQ ID NO: 85144 - RNA, 32 nt, Human
cagccaggcagagugggagagcacaggccccu

SEQ ID NO: 85145 - RNA, 21 nt, Human
cagccaggcagcggagcccua

SEQ ID NO: 85146 - RNA, 32 nt, Human
cagccaggccaacauggugaaaacuccucucu

SEQ ID NO: 85147 - RNA, 32 nt, Human
cagccaggccaacauggugaaaccccgucucu

SEQ ID NO: 85148 - RNA, 32 nt, Human
cagccaggccaacauggugaaacccugucucu

SEQ ID NO: 85149 - RNA, 32 nt, Human
cagccaggccaacauggugaaacuucaucucu

SEQ ID NO: 85150 - RNA, 32 nt, Human
cagccaggccaacuuggcaaaaccccaucucu

SEQ ID NO: 85151 - RNA, 21 nt, Human
cagccaggccacggagagcag

SEQ ID NO: 85152 - RNA, 32 nt, Human
cagccaggcccacauggagcccucccagccac

SEQ ID NO: 85153 - RNA, 32 nt, Human
cagccaggcccaccaccucucacagucagugc

SEQ ID NO: 85154 - RNA, 23 nt, Human
cagccaggcccagccacccagga

SEQ ID NO: 85155 - RNA, 32 nt, Human
cagccaggcccuggagggugauccugccagca

SEQ ID NO: 85156 - RNA, 32 nt, Human
cagccaggccggagacaaguugcagucccggg

SEQ ID NO: 85157 - RNA, 32 nt, Human
cagccaggccugauuuggccaaaucaucaugc

SEQ ID NO: 85158 - RNA, 32 nt, Human
cagccaggccuggcucucagcagcucugcagg

SEQ ID NO: 85159 - RNA, 32 nt, Human
cagccaggccugggcagugaccucuuucucuu

SEQ ID NO: 85160 - RNA, 32 nt, Human
cagccaggccuuuccugcaagcugcugugcuu

SEQ ID NO: 85161 - RNA, 32 nt, Human
cagccaggcucugugcugacccuccuguugcg

SEQ ID NO: 85162 - RNA, 32 nt, Human
cagccaggcugauggccagggccgcagugccc

SEQ ID NO: 85163 - RNA, 19 nt, Human
cagccaggcuggagucagu

SEQ ID NO: 85164 - RNA, 20 nt, Human
cagccaggcuggagucagug

SEQ ID NO: 85165 - RNA, 20 nt, Human
cagccaggcuggagugcagu

SEQ ID NO: 85166 - RNA, 32 nt, Human
cagccaggcuggcuucccguggucucagcgcc

SEQ ID NO: 85167 - RNA, 32 nt, Human
cagccaggcuguucccacagacgcccaccacc

SEQ ID NO: 85168 - RNA, 17 nt, Human
cagccaggcuucuguca

SEQ ID NO: 85169 - RNA, 32 nt, Human
cagccagggaaugccaaggacugcugggagcc

SEQ ID NO: 85170 - RNA, 32 nt, Human
cagccagggagagaguaccauggauggcauca

SEQ ID NO: 85171 - RNA, 32 nt, Human
cagccagggagaggacucagauuuccuggagg

SEQ ID NO: 85172 - RNA, 32 nt, Human
cagccagggagcugucccucugugaagggugg

SEQ ID NO: 85173 - RNA, 32 nt, Human
cagccagggaggcagcagaggcuggaacccag

SEQ ID NO: 85174 - RNA, 32 nt, Human
cagccagggaggggcagcugcagugaccaggc

SEQ ID NO: 85175 - RNA, 22 nt, Human
cagccagggcaacagagugaga

SEQ ID NO: 85176 - RNA, 32 nt, Human
cagccagggcaacauggugaaaccccaucucu

SEQ ID NO: 85177 - RNA, 32 nt, Human
cagccagggcaacauggugagaccucaucucu

SEQ ID NO: 85178 - RNA, 31 nt, Human
cagccagggcacuucccuuuccuccuccuug

SEQ ID NO: 85179 - RNA, 32 nt, Human
cagccagggcagcuccaggugaggcgggacag

SEQ ID NO: 85180 - RNA, 32 nt, Human
cagccagggccugcuugguggaccggccaagg

SEQ ID NO: 85181 - RNA, 32 nt, Human
cagccagggcucuuacuugcugcagcaucggc

SEQ ID NO: 85182 - RNA, 32 nt, Human
cagccagggcuggaccucaacccugaggaguc

SEQ ID NO: 85183 - RNA, 32 nt, Human
cagccagggcuggcugcuccagcucuugcuuc

SEQ ID NO: 85184 - RNA, 32 nt, Human
cagccaggggcuguggggagacagugugggag

SEQ ID NO: 85185 - RNA, 32 nt, Human
cagccagggggagcugggaugcagugggagag

SEQ ID NO: 85186 - RNA, 32 nt, Human
cagccagggggccagucccugaggcagguccc

SEQ ID NO: 85187 - RNA, 32 nt, Human
cagccaggggguauuuccaucuugcuggggcu

SEQ ID NO: 85188 - RNA, 32 nt, Human
cagccaggggugaaccccaggggaagcuggga

SEQ ID NO: 85189 - RNA, 22 nt, Human
cagccagggugacagagugaga

SEQ ID NO: 85190 - RNA, 32 nt, Human
cagccagguacccgcgcaaggcaccugcuggc

SEQ ID NO: 85191 - RNA, 32 nt, Human
cagccagguacccgcgcaaggcacuugcuggc

SEQ ID NO: 85192 - RNA, 23 nt, Human
cagccaggucgccugcuccgccc

SEQ ID NO: 85193 - RNA, 16 nt, Human
cagccaggucuucaca

SEQ ID NO: 85194 - RNA, 32 nt, Human
cagccaggugcaaaaugccgugucauugggag

SEQ ID NO: 85195 - RNA, 32 nt, Human
cagccaggugcuggucuugggccaguucuccc

SEQ ID NO: 85196 - RNA, 32 nt, Human
cagccaggugugguggcucaggccuguaaucc

SEQ ID NO: 85197 - RNA, 22 nt, Human
cagccaguagcucagagagaug

SEQ ID NO: 85198 - RNA, 32 nt, Human
cagccagucaccacccuccuggaccauacuca

SEQ ID NO: 85199 - RNA, 18 nt, Human
cagccagucaggggucac

SEQ ID NO: 85200 - RNA, 31 nt, Human
cagccaguccagagagaauagagccugccca

SEQ ID NO: 85201 - RNA, 32 nt, Human
cagccagucccaggagcccaguaauggagagc

SEQ ID NO: 85202 - RNA, 32 nt, Human
cagccagucccuacagcauacagggucuccuu

SEQ ID NO: 85203 - RNA, 22 nt, Human
cagccagucccugcagcuccac

SEQ ID NO: 85204 - RNA, 16 nt, Human
cagccaguccuccaca

SEQ ID NO: 85205 - RNA, 18 nt, Human
cagccagucugugaaaug

SEQ ID NO: 85206 - RNA, 19 nt, Human
cagccagugacagaggaga

SEQ ID NO: 85207 - RNA, 32 nt, Human
cagccagugcaaaggcccagagacaggaauaa

SEQ ID NO: 85208 - RNA, 32 nt, Human
cagccagugcacccaaacccugaggagcucug

SEQ ID NO: 85209 - RNA, 32 nt, Human
cagccagugcaggaguugguguaauauuaagg

SEQ ID NO: 85210 - RNA, 32 nt, Human
cagccagugccuuuggaguacugaggcgcgca

SEQ ID NO: 85211 - RNA, 19 nt, Human
cagccaguggcacaggaga

SEQ ID NO: 85212 - RNA, 23 nt, Human
cagccaguggcuucuucaugaug

SEQ ID NO: 85213 - RNA, 23 nt, Human
cagccaguggcuucuugaugaug

SEQ ID NO: 85214 - RNA, 19 nt, Human
cagccagugguccuuucca

SEQ ID NO: 85215 - RNA, 32 nt, Human
cagccaguguccaagcaaaauggagcugggga

SEQ ID NO: 85216 - RNA, 17 nt, Human
cagccaguguccuggcc

SEQ ID NO: 85217 - RNA, 32 nt, Human
cagccagugugccuaguguaaggagaaaggcc

SEQ ID NO: 85218 - RNA, 23 nt, Human
cagccaguuauuugggaaggaga

SEQ ID NO: 85219 - RNA, 32 nt, Human
cagccaguucugaauguugguggaggguguag

SEQ ID NO: 85220 - RNA, 23 nt, Human
cagccaguugcuguggaaggaga

SEQ ID NO: 85221 - RNA, 32 nt, Human
cagccauauucccaugugauuucccacuggau

SEQ ID NO: 85222 - RNA, 32 nt, Human
cagccauauugucaccucagcacuguggacac

SEQ ID NO: 85223 - RNA, 32 nt, Human
cagccaucaagaacccacacagacggcaggga

SEQ ID NO: 85224 - RNA, 32 nt, Human
cagccaucacaaacucacagaccagcacaucc

SEQ ID NO: 85225 - RNA, 32 nt, Human
cagccaucaccaccauccaucuccagaacuuu

SEQ ID NO: 85226 - RNA, 32 nt, Human
cagccaucacucacugccaccugggccaucaa

SEQ ID NO: 85227 - RNA, 32 nt, Human
cagccaucacugcuggcagccugggcaaaccg

SEQ ID NO: 85228 - RNA, 32 nt, Human
cagccaucagcaacugugucccauuaccugug

SEQ ID NO: 85229 - RNA, 32 nt, Human
cagccaucagcaccagccaaguuuuaacucag

SEQ ID NO: 85230 - RNA, 32 nt, Human
cagccaucagccaggguuggccuaggguggca

SEQ ID NO: 85231 - RNA, 32 nt, Human
cagccauccacacaaaggagguuauucauaaa

SEQ ID NO: 85232 - RNA, 32 nt, Human
cagccauccacacaucuggccccaccugcuca

SEQ ID NO: 85233 - RNA, 32 nt, Human
cagccauccagccugucucuacugggccccac

SEQ ID NO: 85234 - RNA, 32 nt, Human
cagccauccauagcccugggaauuccaccugc

SEQ ID NO: 85235 - RNA, 32 nt, Human
cagccaucccacaccagcuccuaggcacugag

SEQ ID NO: 85236 - RNA, 32 nt, Human
cagccaucccccucguccagccgccgggccaa

SEQ ID NO: 85237 - RNA, 30 nt, Human
cagccaucccucuccaugcccugugugcuc

SEQ ID NO: 85238 - RNA, 22 nt, Human
cagccaucccuuauagcuccac

SEQ ID NO: 85239 - RNA, 32 nt, Human
cagccauccuacccucucccugccuggcacau

SEQ ID NO: 85240 - RNA, 22 nt, Human
cagccauccuccuccuauggcc

SEQ ID NO: 85241 - RNA, 32 nt, Human
cagccauccugggccugcugagcucugauuca

SEQ ID NO: 85242 - RNA, 32 nt, Human
cagccaucgcgggcugcaucaucccccagcca

SEQ ID NO: 85243 - RNA, 32 nt, Human
cagccaucggccuguugacaaggcacuggcag

SEQ ID NO: 85244 - RNA, 32 nt, Human
cagccaucuacccuugauuaucuagaaagacu

SEQ ID NO: 85245 - RNA, 32 nt, Human
cagccaucugcugagccucugcucugugccgg

SEQ ID NO: 85246 - RNA, 32 nt, Human
cagccaucugcuuuaccagucucauuuccugc

SEQ ID NO: 85247 - RNA, 32 nt, Human
cagccaucugugccaaggagagaggcuaucac

SEQ ID NO: 85248 - RNA, 32 nt, Human
cagccaucuugcaaccucaccucacagcaugg

SEQ ID NO: 85249 - RNA, 32 nt, Human
cagccaugaacauguugagugagcaugcugga

SEQ ID NO: 85250 - RNA, 32 nt, Human
cagccaugaacggauggaugugaugccugcua

SEQ ID NO: 85251 - RNA, 32 nt, Human
cagccaugaccugaagaaggaggucgaccuuc

SEQ ID NO: 85252 - RNA, 32 nt, Human
cagccaugacugacggccccuugugcaagcuc

SEQ ID NO: 85253 - RNA, 32 nt, Human
cagccaugagccaccaugcccggccaaacuuc

SEQ ID NO: 85254 - RNA, 30 nt, Human
cagccaugagccugguggccugugagugcc

SEQ ID NO: 85255 - RNA, 30 nt, Human
cagccaugagggaaggacaggagauggggc

SEQ ID NO: 85256 - RNA, 18 nt, Human
cagccaugaucuuuagca

SEQ ID NO: 85257 - RNA, 32 nt, Human
cagccaugcaccaccacaccuggcuaauuuuu

SEQ ID NO: 85258 - RNA, 20 nt, Human
cagccaugccuccccuccca

SEQ ID NO: 85259 - RNA, 32 nt, Human
cagccaugcuagucuccugcugugcauagauc

SEQ ID NO: 85260 - RNA, 20 nt, Human
cagccaugcuggggccgcua

SEQ ID NO: 85261 - RNA, 30 nt, Human
cagccauggacacaccccugcccagaccuc

SEQ ID NO: 85262 - RNA, 19 nt, Human
cagccauggagucuuccac

SEQ ID NO: 85263 - RNA, 32 nt, Human
cagccauggaugcagugucuggaguuggaccc

SEQ ID NO: 85264 - RNA, 32 nt, Human
cagccauggcugagccccaucuguagacaggc

SEQ ID NO: 85265 - RNA, 32 nt, Human
cagccauggcuggagcagcugggacacagggc

SEQ ID NO: 85266 - RNA, 32 nt, Human
cagccauggguggucagaugguggggugggcc

SEQ ID NO: 85267 - RNA, 32 nt, Human
cagccaugucgugccccgaugaagagcaauuc

SEQ ID NO: 85268 - RNA, 32 nt, Human
cagccaugugaagauucgaaacuucgaguucu

SEQ ID NO: 85269 - RNA, 32 nt, Human
cagccauuaaagagggugaggaagggaaaagg

SEQ ID NO: 85270 - RNA, 32 nt, Human
cagccauuaaagaugaccuacagugcugugua

SEQ ID NO: 85271 - RNA, 32 nt, Human
cagccauucacacccauccacucaccucccau

SEQ ID NO: 85272 - RNA, 18 nt, Human
cagccauuccaauccagu

SEQ ID NO: 85273 - RNA, 16 nt, Human
cagccauuccguggcc

SEQ ID NO: 85274 - RNA, 32 nt, Human
cagccauuccugaaggaagacagugguagcca

SEQ ID NO: 85275 - RNA, 32 nt, Human
cagccauugacauuucuuucugcuuccacuau

SEQ ID NO: 85276 - RNA, 32 nt, Human
cagccauugaguagcugggaugacaggcacau

SEQ ID NO: 85277 - RNA, 32 nt, Human
cagccauugcacuccagccugggcaacagagc

SEQ ID NO: 85278 - RNA, 32 nt, Human
cagccauuuagauauaacauccuucacuuaaa

SEQ ID NO: 85279 - RNA, 32 nt, Human
cagccauuucguucucccuuccuugcugacaa

SEQ ID NO: 85280 - RNA, 32 nt, Human
cagccauuuggugugucucagcaaaucccgcu

SEQ ID NO: 85281 - RNA, 32 nt, Human
cagcccaaaccccgcugcuaccugccaagcug

SEQ ID NO: 85282 - RNA, 32 nt, Human
cagcccaaaccugggaaggccagccuuguaca

SEQ ID NO: 85283 - RNA, 32 nt, Human
cagcccaaacugcacagccccaaccagguucc

SEQ ID NO: 85284 - RNA, 32 nt, Human
cagcccaaacuguauacauuacaaucauuaaa

SEQ ID NO: 85285 - RNA, 21 nt, Human
cagcccaaagcuccucugccc

SEQ ID NO: 85286 - RNA, 21 nt, Human
cagcccaacaggaggccgggg

SEQ ID NO: 85287 - RNA, 32 nt, Human
cagcccaacccucuccccaggugaaccuugcu

SEQ ID NO: 85288 - RNA, 32 nt, Human
cagcccaaccucugggaacaggcagcuccuau

SEQ ID NO: 85289 - RNA, 16 nt, Human
cagcccaaccuuccca

SEQ ID NO: 85290 - RNA, 22 nt, Human
cagcccaagagacucuucuaca

SEQ ID NO: 85291 - RNA, 16 nt, Human
cagcccaagcccccuc

SEQ ID NO: 85292 - RNA, 16 nt, Human
cagcccaagccccucc

SEQ ID NO: 85293 - RNA, 32 nt, Human
cagcccaagcgagcgcagcagcgcggcggcag

SEQ ID NO: 85294 - RNA, 32 nt, Human
cagcccaagcuccggugauuaccagguaauuc

SEQ ID NO: 85295 - RNA, 32 nt, Human
cagcccaaggcagagcuggcagggacccugcc

SEQ ID NO: 85296 - RNA, 32 nt, Human
cagcccaaggguggagagggggccaagggcuc

SEQ ID NO: 85297 - RNA, 32 nt, Human
cagcccaagucccaccaccgagcccacuacga

SEQ ID NO: 85298 - RNA, 22 nt, Human
cagcccaagucugcagcaccag

SEQ ID NO: 85299 - RNA, 20 nt, Human
cagcccaaucucuccuucag

SEQ ID NO: 85300 - RNA, 22 nt, Human
cagcccaaucuucuggguccag

SEQ ID NO: 85301 - RNA, 20 nt, Human
cagcccaauugccaucaaga

SEQ ID NO: 85302 - RNA, 32 nt, Human
cagcccacaacaaccuagacauguggggugcu

SEQ ID NO: 85303 - RNA, 32 nt, Human
cagcccacaaggacuccagccugcuggcuggu

SEQ ID NO: 85304 - RNA, 32 nt, Human
cagcccacacccuucccagagccagggagccc

SEQ ID NO: 85305 - RNA, 32 nt, Human
cagcccacaccuggcccuguucacggcuguuc

SEQ ID NO: 85306 - RNA, 32 nt, Human
cagcccacacuggcuugauggaucacccccag

SEQ ID NO: 85307 - RNA, 32 nt, Human
cagcccacagcagucucaaccucucgggcuca

SEQ ID NO: 85308 - RNA, 32 nt, Human
cagcccacagggcuugaagugaaggaacagag

SEQ ID NO: 85309 - RNA, 21 nt, Human
cagcccaccagcccucugccc

SEQ ID NO: 85310 - RNA, 32 nt, Human
cagcccacccaccuccccugccacagacucuc

SEQ ID NO: 85311 - RNA, 32 nt, Human
cagcccacccauguucagcuucagugaucaca

SEQ ID NO: 85312 - RNA, 32 nt, Human
cagcccacccuccaugucccacguugggaugg

SEQ ID NO: 85313 - RNA, 32 nt, Human
cagcccacccucuguguucaugaaccugggcu

SEQ ID NO: 85314 - RNA, 32 nt, Human
cagcccaccuagcgucuucuggcucuaggggu

SEQ ID NO: 85315 - RNA, 17 nt, Human
cagcccaccucccuccc

SEQ ID NO: 85316 - RNA, 32 nt, Human
cagcccaccugaacuccagccaugccauuuua

SEQ ID NO: 85317 - RNA, 32 nt, Human
cagcccaccugaacuccagccaugccauuuug

SEQ ID NO: 85318 - RNA, 19 nt, Human
cagcccaccugcccucccc

SEQ ID NO: 85319 - RNA, 32 nt, Human
cagcccaccuggcuggaggugugcuggcucuc

SEQ ID NO: 85320 - RNA, 24 nt, Human
cagcccacgcacuuccggccucgg

SEQ ID NO: 85321 - RNA, 23 nt, Human
cagcccacgggcccggcccggcc

SEQ ID NO: 85322 - RNA, 24 nt, Human
cagcccacggucuggaggccgagg

SEQ ID NO: 85323 - RNA, 19 nt, Human
cagcccacguucaggcuua

SEQ ID NO: 85324 - RNA, 21 nt, Human
cagcccacuacucugaaccag

SEQ ID NO: 85325 - RNA, 32 nt, Human
cagcccacugcacucuccacucugccagaaag

SEQ ID NO: 85326 - RNA, 32 nt, Human
cagcccacugcccaccaccagcccaaagaacc

SEQ ID NO: 85327 - RNA, 32 nt, Human
cagcccacugccuccugccugggguggccugg

SEQ ID NO: 85328 - RNA, 21 nt, Human
cagcccacuggaccagaacug

SEQ ID NO: 85329 - RNA, 19 nt, Human
cagcccacuggucccgggc

SEQ ID NO: 85330 - RNA, 23 nt, Human
cagcccagaaaccuuuggccaca

SEQ ID NO: 85331 - RNA, 27 nt, Human
cagcccagaaacucuaccucauccaca

SEQ ID NO: 85332 - RNA, 32 nt, Human
cagcccagaauagcuuugaauguggccccaac

SEQ ID NO: 85333 - RNA, 22 nt, Human
cagcccagacaacagagugaga

SEQ ID NO: 85334 - RNA, 19 nt, Human
cagcccagacccuccccca

SEQ ID NO: 85335 - RNA, 32 nt, Human
cagcccagacccuucuccuuagaaguggaagu

SEQ ID NO: 85336 - RNA, 32 nt, Human
cagcccagagcuugcaaccuagccucacccaa

SEQ ID NO: 85337 - RNA, 32 nt, Human
cagcccagagucagggucuaacucagaaagaa

SEQ ID NO: 85338 - RNA, 32 nt, Human
cagcccagcaccacagccuuuccccagccagg

SEQ ID NO: 85339 - RNA, 32 nt, Human
cagcccagcacuaugccggggacuguggcaac

SEQ ID NO: 85340 - RNA, 18 nt, Human
cagcccagcagucccucc

SEQ ID NO: 85341 - RNA, 32 nt, Human
cagcccagcaguguggagacccugccacagcc

SEQ ID NO: 85342 - RNA, 32 nt, Human
cagcccagccaacauggcaaaaccccaucucu

SEQ ID NO: 85343 - RNA, 32 nt, Human
cagcccagccagugguuccagguccagcccug

SEQ ID NO: 85344 - RNA, 17 nt, Human
cagcccagcccacuccc

SEQ ID NO: 85345 - RNA, 17 nt, Human
cagcccagcccagccca

SEQ ID NO: 85346 - RNA, 32 nt, Human
cagcccagcccaggcagcgggguggugguugu

SEQ ID NO: 85347 - RNA, 17 nt, Human
cagcccagcccaucuca

SEQ ID NO: 85348 - RNA, 17 nt, Human
cagcccagccccaccca

SEQ ID NO: 85349 - RNA, 20 nt, Human
cagcccagccccgcccuccc

SEQ ID NO: 85350 - RNA, 32 nt, Human
cagcccagccccggacagcuccaggauccgug

SEQ ID NO: 85351 - RNA, 22 nt, Human
cagcccagccccgguuccuccc

SEQ ID NO: 85352 - RNA, 32 nt, Human
cagcccagccccucccccagagcccaggcucu

SEQ ID NO: 85353 - RNA, 19 nt, Human
cagcccagccccugcuccc

SEQ ID NO: 85354 - RNA, 22 nt, Human
cagcccagcccuacucccuccc

SEQ ID NO: 85355 - RNA, 19 nt, Human
cagcccagcccugccuccc

SEQ ID NO: 85356 - RNA, 32 nt, Human
cagcccagccuccagccuggccuuuccuccuu

SEQ ID NO: 85357 - RNA, 18 nt, Human
cagcccagccugcccccu

SEQ ID NO: 85358 - RNA, 32 nt, Human
cagcccagccugggcgacagagcgagacucug

SEQ ID NO: 85359 - RNA, 22 nt, Human
cagcccagccuguucucuccca

SEQ ID NO: 85360 - RNA, 20 nt, Human
cagcccagcucaugccuccc

SEQ ID NO: 85361 - RNA, 18 nt, Human
cagcccagcuccagcucc

SEQ ID NO: 85362 - RNA, 32 nt, Human
cagcccagcucccuggggguugggggcugugu

SEQ ID NO: 85363 - RNA, 19 nt, Human
cagcccagcucuccccucc

SEQ ID NO: 85364 - RNA, 32 nt, Human
cagcccagcucuccccuccacacuguuggcuc

SEQ ID NO: 85365 - RNA, 32 nt, Human
cagcccagcugcagguguggguguaagggugg

SEQ ID NO: 85366 - RNA, 32 nt, Human
cagcccagcugcaugcuaccacuuugguuuga

SEQ ID NO: 85367 - RNA, 20 nt, Human
cagcccagcugcucugccca

SEQ ID NO: 85368 - RNA, 20 nt, Human
cagcccagcuggccuggccc

SEQ ID NO: 85369 - RNA, 18 nt, Human
cagcccagcuguuccccu

SEQ ID NO: 85370 - RNA, 32 nt, Human
cagcccaggaaccaggcuuugcugggugcugc

SEQ ID NO: 85371 - RNA, 32 nt, Human
cagcccaggaauuggcagaggaaguagguguc

SEQ ID NO: 85372 - RNA, 32 nt, Human
cagcccaggacuaggggcaggacucuugccug

SEQ ID NO: 85373 - RNA, 32 nt, Human
cagcccaggacuucgaggcugcaaugagcuau

SEQ ID NO: 85374 - RNA, 32 nt, Human
cagcccaggagaacuaagagcuuccuaaauua

SEQ ID NO: 85375 - RNA, 32 nt, Human
cagcccaggagaagggucagggagggaagggg

SEQ ID NO: 85376 - RNA, 32 nt, Human
cagcccaggagguggagguugcagugagcgga

SEQ ID NO: 85377 - RNA, 32 nt, Human
cagcccaggagguuguggauacagugaguuau

SEQ ID NO: 85378 - RNA, 32 nt, Human
cagcccaggaguucaagaccagccugggcaac

SEQ ID NO: 85379 - RNA, 32 nt, Human
cagcccaggaguucgagaccagccugggcaac

SEQ ID NO: 85380 - RNA, 32 nt, Human
cagcccaggaguuuaaggcugcagugagcuau

SEQ ID NO: 85381 - RNA, 32 nt, Human
cagcccaggaguuugaggcugcaaugagccau

SEQ ID NO: 85382 - RNA, 32 nt, Human
cagcccaggaugccuuugaauguggcccaaca

SEQ ID NO: 85383 - RNA, 22 nt, Human
cagcccaggcaacagagugaga

SEQ ID NO: 85384 - RNA, 32 nt, Human
cagcccaggcaacauggugaaaccccaucucu

SEQ ID NO: 85385 - RNA, 17 nt, Human
cagcccaggcacccucc

SEQ ID NO: 85386 - RNA, 21 nt, Human
cagcccaggcaccuccuccca

SEQ ID NO: 85387 - RNA, 32 nt, Human
cagcccaggcagcgggguggugguugugggag

SEQ ID NO: 85388 - RNA, 24 nt, Human
cagcccaggccccucaaagccuga

SEQ ID NO: 85389 - RNA, 16 nt, Human
cagcccaggccuccca

SEQ ID NO: 85390 - RNA, 32 nt, Human
cagcccaggccucuggcagcagcucuuugccc

SEQ ID NO: 85391 - RNA, 17 nt, Human
cagcccagggcccuccc

SEQ ID NO: 85392 - RNA, 32 nt, Human
cagcccaggggacccguuccucuugaaccagu

SEQ ID NO: 85393 - RNA, 32 nt, Human
cagcccaggggcccugacucgucacacuuccc

SEQ ID NO: 85394 - RNA, 32 nt, Human
cagcccagggugacagagccaaauggggcugc

SEQ ID NO: 85395 - RNA, 20 nt, Human
cagcccaggguggacuuaga

SEQ ID NO: 85396 - RNA, 22 nt, Human
cagcccagguaacagagugaga

SEQ ID NO: 85397 - RNA, 22 nt, Human
cagcccaggugacagagcgaga

SEQ ID NO: 85398 - RNA, 22 nt, Human
cagcccaggugacagagggaga

SEQ ID NO: 85399 - RNA, 22 nt, Human
cagcccaggugacagagugaga

SEQ ID NO: 85400 - RNA, 32 nt, Human
cagcccagucagggguguggccgccgccaccg

SEQ ID NO: 85401 - RNA, 25 nt, Human
cagcccaguccaacccggcccagcc

SEQ ID NO: 85402 - RNA, 32 nt, Human
cagcccaguccaggaccuggcuggaugcuucc

SEQ ID NO: 85403 - RNA, 19 nt, Human
cagcccaguccugaggaug

SEQ ID NO: 85404 - RNA, 32 nt, Human
cagcccagucucuucugguuuaaucauuaugu

SEQ ID NO: 85405 - RNA, 32 nt, Human
cagcccauagguuagucauuguccuaaccaau

SEQ ID NO: 85406 - RNA, 32 nt, Human
cagcccaucuccuguauuacugccgaguggac

SEQ ID NO: 85407 - RNA, 32 nt, Human
cagcccaucugcauggcucaagaguucgugaa

SEQ ID NO: 85408 - RNA, 23 nt, Human
cagcccaugagcccuccccuggu

SEQ ID NO: 85409 - RNA, 19 nt, Human
cagcccaugcaccccuccc

SEQ ID NO: 85410 - RNA, 32 nt, Human
cagcccaugccaccuguuuucaugcuaucuca

SEQ ID NO: 85411 - RNA, 32 nt, Human
cagcccaugucaggggaacagccuggaacaga

SEQ ID NO: 85412 - RNA, 22 nt, Human
cagcccauuaaguucccuggua

SEQ ID NO: 85413 - RNA, 32 nt, Human
cagcccauuaggauguguaaagagaugggauu

SEQ ID NO: 85414 - RNA, 32 nt, Human
cagcccauucugcuguugauagcaggaaacca

SEQ ID NO: 85415 - RNA, 32 nt, Human
cagcccauuugauggagggagcagggacauag

SEQ ID NO: 85416 - RNA, 32 nt, Human
cagcccauuugggcagagaggcugugguuugg

SEQ ID NO: 85417 - RNA, 32 nt, Human
cagccccaaacuggaaagaagaugcuaauuaa

SEQ ID NO: 85418 - RNA, 32 nt, Human
cagccccaaagaaugaguuaacuccuacuaac

SEQ ID NO: 85419 - RNA, 20 nt, Human
cagccccaaaucuccugccu

SEQ ID NO: 85420 - RNA, 32 nt, Human
cagccccaaaugcccuggauuauaugauuuuu

SEQ ID NO: 85421 - RNA, 20 nt, Human
cagccccaacacccuuccca

SEQ ID NO: 85422 - RNA, 32 nt, Human
cagccccaacauuucacuccagccuggcccca

SEQ ID NO: 85423 - RNA, 24 nt, Human
cagccccaaccccaaccccagccg

SEQ ID NO: 85424 - RNA, 23 nt, Human
cagccccaacccccucccugcca

SEQ ID NO: 85425 - RNA, 32 nt, Human
cagccccaagaugccuacagcccccaggcccc

SEQ ID NO: 85426 - RNA, 21 nt, Human
cagccccaagcugggccgagg

SEQ ID NO: 85427 - RNA, 32 nt, Human
cagccccaaggcugccuuccagagcugcacuu

SEQ ID NO: 85428 - RNA, 32 nt, Human
cagccccaaguggccgcaggcagauggauaug

SEQ ID NO: 85429 - RNA, 32 nt, Human
cagccccaauccagagaagcgcuguugcccgc

SEQ ID NO: 85430 - RNA, 21 nt, Human
cagccccaaugauucuuaaca

SEQ ID NO: 85431 - RNA, 21 nt, Human
cagccccaauuucuggcccag

SEQ ID NO: 85432 - RNA, 32 nt, Human
cagccccacaugcaugcacacgcaugcacaca

SEQ ID NO: 85433 - RNA, 21 nt, Human
cagccccacccaggagcaggg

SEQ ID NO: 85434 - RNA, 32 nt, Human
cagccccacccagucugugcucucagccgcug

SEQ ID NO: 85435 - RNA, 32 nt, Human
cagccccacccccagguuuuugcccauccucc

SEQ ID NO: 85436 - RNA, 24 nt, Human
cagccccacccuugggcugagagg

SEQ ID NO: 85437 - RNA, 32 nt, Human
cagccccaccucucugcugcuuugcugauucc

SEQ ID NO: 85438 - RNA, 32 nt, Human
cagccccaccugccaaagucccagguuuacaa

SEQ ID NO: 85439 - RNA, 20 nt, Human
cagccccaccuggacagagg

SEQ ID NO: 85440 - RNA, 32 nt, Human
cagccccacuacuuccuucccugccucccagc

SEQ ID NO: 85441 - RNA, 24 nt, Human
cagccccacucccucaggguccag

SEQ ID NO: 85442 - RNA, 23 nt, Human
cagccccacucugccuccugcuc

SEQ ID NO: 85443 - RNA, 32 nt, Human
cagccccacugcaagccugggauauccagagg

SEQ ID NO: 85444 - RNA, 32 nt, Human
cagccccacugcaggccccaccauggcgccgu

SEQ ID NO: 85445 - RNA, 32 nt, Human
cagccccacugcugguccaaguguguggaggg

SEQ ID NO: 85446 - RNA, 32 nt, Human
cagccccacugucucuaaccacuccugggcua

SEQ ID NO: 85447 - RNA, 22 nt, Human
cagccccacugugucuuccgca

SEQ ID NO: 85448 - RNA, 32 nt, Human
cagccccagaagcagagggcagucaaggucaa

SEQ ID NO: 85449 - RNA, 32 nt, Human
cagccccagacgcccaccugugccucagggca

SEQ ID NO: 85450 - RNA, 32 nt, Human
cagccccagacuccaaagcauccccaagaggu

SEQ ID NO: 85451 - RNA, 32 nt, Human
cagccccagagggaguggcgagcccagcugcc

SEQ ID NO: 85452 - RNA, 32 nt, Human
cagccccagaguagcuggaauuacaggcacac

SEQ ID NO: 85453 - RNA, 32 nt, Human
cagccccagagucacggggcugagggggcggg

SEQ ID NO: 85454 - RNA, 21 nt, Human
cagccccagaguucuuccaca

SEQ ID NO: 85455 - RNA, 32 nt, Human
cagccccagauucacagguggcugaggaggga

SEQ ID NO: 85456 - RNA, 32 nt, Human
cagccccagcagagacuggagagccagaggcc

SEQ ID NO: 85457 - RNA, 32 nt, Human
cagccccagccaaagacuuuucucccaauucu

SEQ ID NO: 85458 - RNA, 24 nt, Human
cagccccagccagaucccgcguca

SEQ ID NO: 85459 - RNA, 24 nt, Human
cagccccagcccagaucuacuuca

SEQ ID NO: 85460 - RNA, 23 nt, Human
cagccccagcccagauggcacuc

SEQ ID NO: 85461 - RNA, 22 nt, Human
cagccccagcccagcccagcug

SEQ ID NO: 85462 - RNA, 32 nt, Human
cagccccagcccagcccagcugcucugcccag

SEQ ID NO: 85463 - RNA, 21 nt, Human
cagccccagcccagcccgccg

SEQ ID NO: 85464 - RNA, 21 nt, Human
cagccccagcccaggcagccc

SEQ ID NO: 85465 - RNA, 24 nt, Human
cagccccagcccaggugggccgcc

SEQ ID NO: 85466 - RNA, 21 nt, Human
cagccccagccccacccaccg

SEQ ID NO: 85467 - RNA, 23 nt, Human
cagccccagccccagccccgccg

SEQ ID NO: 85468 - RNA, 32 nt, Human
cagccccagccccagguguggaccucaugcug

SEQ ID NO: 85469 - RNA, 21 nt, Human
cagccccagcccccguccguc

SEQ ID NO: 85470 - RNA, 24 nt, Human
cagccccagccccgccgggccccg

SEQ ID NO: 85471 - RNA, 20 nt, Human
cagccccagccccgcugccc

SEQ ID NO: 85472 - RNA, 23 nt, Human
cagccccagccccggccacagcc

SEQ ID NO: 85473 - RNA, 19 nt, Human
cagccccagccccggcccc

SEQ ID NO: 85474 - RNA, 18 nt, Human
cagccccagcccggcccc

SEQ ID NO: 85475 - RNA, 22 nt, Human
cagccccagcccggccccagcc

SEQ ID NO: 85476 - RNA, 32 nt, Human
cagccccagcccugacaggcccugcgugugcc

SEQ ID NO: 85477 - RNA, 32 nt, Human
cagccccagccgcgggagcgagcgcgcccgcc

SEQ ID NO: 85478 - RNA, 32 nt, Human
cagccccagccuggcccgcugcaaugccuagg

SEQ ID NO: 85479 - RNA, 32 nt, Human
cagccccagccuggccuuccuggugcccacuc

SEQ ID NO: 85480 - RNA, 32 nt, Human
cagccccagcuacucgggaggcugagauggga

SEQ ID NO: 85481 - RNA, 32 nt, Human
cagccccagcuccagcccugaggacagcucug

SEQ ID NO: 85482 - RNA, 32 nt, Human
cagccccagcugggugacagagugagacacug

SEQ ID NO: 85483 - RNA, 20 nt, Human
cagccccagcuucucugccc

SEQ ID NO: 85484 - RNA, 23 nt, Human
cagccccaggacucugagugcag

SEQ ID NO: 85485 - RNA, 32 nt, Human
cagccccaggagaaggggcuuugugaccagaa

SEQ ID NO: 85486 - RNA, 32 nt, Human
cagccccaggagaguccugagaugauuuugcc

SEQ ID NO: 85487 - RNA, 32 nt, Human
cagccccaggcacccagcuggccggcagcuga

SEQ ID NO: 85488 - RNA, 21 nt, Human
cagccccaggcagcccuguca

SEQ ID NO: 85489 - RNA, 32 nt, Human
cagccccagggagggcagggagagcaaggggc

SEQ ID NO: 85490 - RNA, 32 nt, Human
cagccccagggaguggaccagcaaagaccgca

SEQ ID NO: 85491 - RNA, 32 nt, Human
cagccccagggcccugaccugcgcaccuagcu

SEQ ID NO: 85492 - RNA, 32 nt, Human
cagccccaggggcagaagagacccaaccacuu

SEQ ID NO: 85493 - RNA, 32 nt, Human
cagccccaguacacucuucucuggaccagauc

SEQ ID NO: 85494 - RNA, 32 nt, Human
cagccccaguaggaggagagcaggcagagcuu

SEQ ID NO: 85495 - RNA, 20 nt, Human
cagccccagucagaaccucu

SEQ ID NO: 85496 - RNA, 19 nt, Human
cagccccagugcuggggcg

SEQ ID NO: 85497 - RNA, 32 nt, Human
cagccccagugcuuggcgaugcauuuacagau

SEQ ID NO: 85498 - RNA, 32 nt, Human
cagccccaguucuuuuaucccugggcccaacc

SEQ ID NO: 85499 - RNA, 32 nt, Human
cagccccauaaaggagaaucuacgcugguccu

SEQ ID NO: 85500 - RNA, 32 nt, Human
cagccccauagcagcuaugaucccgcugcugc

SEQ ID NO: 85501 - RNA, 32 nt, Human
cagccccaucaccagcuucuugcucagggaga

SEQ ID NO: 85502 - RNA, 20 nt, Human
cagccccauccccucuccca

SEQ ID NO: 85503 - RNA, 23 nt, Human
cagccccaucuccuccuccuccc

SEQ ID NO: 85504 - RNA, 32 nt, Human
cagccccaugcagucaccucagcucugccuga

SEQ ID NO: 85505 - RNA, 32 nt, Human
cagccccauugccuuuucccuucaggcucugu

SEQ ID NO: 85506 - RNA, 21 nt, Human
cagcccccaaggaaccggccg

SEQ ID NO: 85507 - RNA, 32 nt, Human
cagcccccaaguguccagccuggcacuuccca

SEQ ID NO: 85508 - RNA, 32 nt, Human
cagcccccacaccacaguucccugccaccucc

SEQ ID NO: 85509 - RNA, 32 nt, Human
cagcccccaccaggggaaggaaggagggcaca

SEQ ID NO: 85510 - RNA, 32 nt, Human
cagcccccacuccuguuccuugugcacccacu

SEQ ID NO: 85511 - RNA, 20 nt, Human
cagcccccagaccugccccu

SEQ ID NO: 85512 - RNA, 32 nt, Human
cagcccccagagguuggggugggguggcugaa

SEQ ID NO: 85513 - RNA, 32 nt, Human
cagcccccagccccacaaacuuccugcagccu

SEQ ID NO: 85514 - RNA, 32 nt, Human
cagcccccagcccggccagcagucccuucuga

SEQ ID NO: 85515 - RNA, 32 nt, Human
cagcccccagccgcccagacacauggccccag

SEQ ID NO: 85516 - RNA, 20 nt, Human
cagcccccaggauccuccca

SEQ ID NO: 85517 - RNA, 32 nt, Human
cagcccccaggcagugccuuaccuguggugcc

SEQ ID NO: 85518 - RNA, 21 nt, Human
cagcccccaggcccucuccca

SEQ ID NO: 85519 - RNA, 32 nt, Human
cagcccccaggcccucucccaccuacagagac

SEQ ID NO: 85520 - RNA, 22 nt, Human
cagcccccagguccuccugacc

SEQ ID NO: 85521 - RNA, 21 nt, Human
cagcccccaguuccuccccca

SEQ ID NO: 85522 - RNA, 32 nt, Human
cagcccccaguucugcucaaggacagagaaaa

SEQ ID NO: 85523 - RNA, 25 nt, Human
cagccccccaacacuucuccugccc

SEQ ID NO: 85524 - RNA, 20 nt, Human
cagccccccaacccccgacc

SEQ ID NO: 85525 - RNA, 24 nt, Human
cagccccccagccccacagccuga

SEQ ID NO: 85526 - RNA, 22 nt, Human
cagccccccagcucgcccgacc

SEQ ID NO: 85527 - RNA, 23 nt, Human
cagccccccagcuucgcccaccg

SEQ ID NO: 85528 - RNA, 22 nt, Human
cagccccccucccccagacuaa

SEQ ID NO: 85529 - RNA, 23 nt, Human
cagccccccucucuggcccaccc

SEQ ID NO: 85530 - RNA, 17 nt, Human
cagccccccugcugcug

SEQ ID NO: 85531 - RNA, 21 nt, Human
cagccccccuuaccuucacuc

SEQ ID NO: 85532 - RNA, 26 nt, Human
cagccccccuucagcccagcccagcc

SEQ ID NO: 85533 - RNA, 32 nt, Human
cagcccccgagagggguuuggaaccuuagcac

SEQ ID NO: 85534 - RNA, 19 nt, Human
cagcccccgcccgagcuca

SEQ ID NO: 85535 - RNA, 20 nt, Human
cagcccccgccggccccgcc

SEQ ID NO: 85536 - RNA, 24 nt, Human
cagcccccgcuagaggcccggucg

SEQ ID NO: 85537 - RNA, 25 nt, Human
cagcccccgcuccugccccacccca

SEQ ID NO: 85538 - RNA, 20 nt, Human
cagcccccgcucgcggcugg

SEQ ID NO: 85539 - RNA, 18 nt, Human
cagcccccgcugaguuca

SEQ ID NO: 85540 - RNA, 32 nt, Human
cagcccccgcugugucggauacacacucgaau

SEQ ID NO: 85541 - RNA, 32 nt, Human
cagcccccuaaccugccucuggccccaguucg

SEQ ID NO: 85542 - RNA, 32 nt, Human
cagcccccucaauccauuggcugaggccgcug

SEQ ID NO: 85543 - RNA, 32 nt, Human
cagcccccucccccaucucagucccucugccc

SEQ ID NO: 85544 - RNA, 32 nt, Human
cagcccccuccccucugcucaacaccuccgcg

SEQ ID NO: 85545 - RNA, 32 nt, Human
cagcccccuccccuuaggcuccgucccugacc

SEQ ID NO: 85546 - RNA, 18 nt, Human
cagcccccucuccuccca

SEQ ID NO: 85547 - RNA, 23 nt, Human
cagcccccugaaccaaccagccg

SEQ ID NO: 85548 - RNA, 26 nt, Human
cagcccccugaagacucuggucccag

SEQ ID NO: 85549 - RNA, 32 nt, Human
cagcccccugacucccugugggccccuccagg

SEQ ID NO: 85550 - RNA, 21 nt, Human
cagcccccugccuagcuccac

SEQ ID NO: 85551 - RNA, 32 nt, Human
cagcccccugucuccccucagcagucugagug

SEQ ID NO: 85552 - RNA, 32 nt, Human
cagcccccuucccacacucuucauguguuaac

SEQ ID NO: 85553 - RNA, 32 nt, Human
cagcccccuucccucccucccagguaccacca

SEQ ID NO: 85554 - RNA, 32 nt, Human
cagcccccuucccucccucccagguaccauga

SEQ ID NO: 85555 - RNA, 20 nt, Human
cagccccgaagguccugccu

SEQ ID NO: 85556 - RNA, 32 nt, Human
cagccccgagcuagcuggggacaagggcugcc

SEQ ID NO: 85557 - RNA, 23 nt, Human
cagccccgagcuguggcuggcca

SEQ ID NO: 85558 - RNA, 32 nt, Human
cagccccgaggaggaggaggaggaggaggaag

SEQ ID NO: 85559 - RNA, 21 nt, Human
cagccccgaugauucuuaaca

SEQ ID NO: 85560 - RNA, 32 nt, Human
cagccccgaugcugcugacgcuggccgggggc

SEQ ID NO: 85561 - RNA, 24 nt, Human
cagccccgcagcccggcccgggcg

SEQ ID NO: 85562 - RNA, 25 nt, Human
cagccccgcagcuggugcucugccc

SEQ ID NO: 85563 - RNA, 20 nt, Human
cagccccgcauccucccgca

SEQ ID NO: 85564 - RNA, 32 nt, Human
cagccccgccccugccgaucuacuggaccgca

SEQ ID NO: 85565 - RNA, 22 nt, Human
cagccccgcgccuacccggccg

SEQ ID NO: 85566 - RNA, 22 nt, Human
cagccccgcgcgcgcccggccg

SEQ ID NO: 85567 - RNA, 32 nt, Human
cagccccgcgcggaccagacacaaagccgauc

SEQ ID NO: 85568 - RNA, 24 nt, Human
cagccccgcguacuguggauccag

SEQ ID NO: 85569 - RNA, 32 nt, Human
cagccccggagaggguccugaccugggggcuu

SEQ ID NO: 85570 - RNA, 22 nt, Human
cagccccggagccauuccuccc

SEQ ID NO: 85571 - RNA, 25 nt, Human
cagccccggagccgccuccugcacc

SEQ ID NO: 85572 - RNA, 32 nt, Human
cagccccggaggugaaugccaugccaugauuc

SEQ ID NO: 85573 - RNA, 22 nt, Human
cagccccggaguucagccuccc

SEQ ID NO: 85574 - RNA, 24 nt, Human
cagccccggcaacucuggcuccag

SEQ ID NO: 85575 - RNA, 32 nt, Human
cagccccggccccagccauggaagagcucacg

SEQ ID NO: 85576 - RNA, 21 nt, Human
cagccccggccucugugccca

SEQ ID NO: 85577 - RNA, 32 nt, Human
cagccccggcgccggcggcgggaccgcggacc

SEQ ID NO: 85578 - RNA, 32 nt, Human
cagccccggcugcacucuagccgccugggugu

SEQ ID NO: 85579 - RNA, 32 nt, Human
cagccccgggccucugcgggccuaggcuucug

SEQ ID NO: 85580 - RNA, 23 nt, Human
cagccccggguccccgcgcccac

SEQ ID NO: 85581 - RNA, 27 nt, Human
cagccccggugagcccccauccugccc

SEQ ID NO: 85582 - RNA, 23 nt, Human
cagccccguaccacagccugccc

SEQ ID NO: 85583 - RNA, 32 nt, Human
cagccccguagcacaggcggagugcagcggag

SEQ ID NO: 85584 - RNA, 32 nt, Human
cagccccgugucccccuccaaacauccagucc

SEQ ID NO: 85585 - RNA, 32 nt, Human
cagccccuacagccacaaccuccuuuacaguu

SEQ ID NO: 85586 - RNA, 32 nt, Human
cagccccuacccugcugugcucccuauuucaa

SEQ ID NO: 85587 - RNA, 18 nt, Human
cagccccuaccuaccccu

SEQ ID NO: 85588 - RNA, 22 nt, Human
cagccccucacaguggccucaa

SEQ ID NO: 85589 - RNA, 23 nt, Human
cagccccucagcccucccagccc

SEQ ID NO: 85590 - RNA, 32 nt, Human
cagccccuccaaaggucugaugucuccacuuu

SEQ ID NO: 85591 - RNA, 32 nt, Human
cagccccuccacacaucucccuaagucagagu

SEQ ID NO: 85592 - RNA, 32 nt, Human
cagccccuccaccccagccugccugcugccuc

SEQ ID NO: 85593 - RNA, 32 nt, Human
cagccccuccaccccucccuucauccuguuau

SEQ ID NO: 85594 - RNA, 32 nt, Human
cagccccuccaccccuucuucaugcacagcug

SEQ ID NO: 85595 - RNA, 32 nt, Human
cagccccuccaccgcaccguccugggccggug

SEQ ID NO: 85596 - RNA, 32 nt, Human
cagccccucccaucacaggcucagggaccugg

SEQ ID NO: 85597 - RNA, 16 nt, Human
cagccccuccccuccc

SEQ ID NO: 85598 - RNA, 32 nt, Human
cagccccuccccuccccauaccaaagugcuga

SEQ ID NO: 85599 - RNA, 17 nt, Human
cagccccuccuccacuc

SEQ ID NO: 85600 - RNA, 32 nt, Human
cagccccuccucuuguuucuucauucauucaa

SEQ ID NO: 85601 - RNA, 26 nt, Human
cagccccuccugccccagcccacccg

SEQ ID NO: 85602 - RNA, 32 nt, Human
cagccccuccuucauccccugccuccuucacc

SEQ ID NO: 85603 - RNA, 32 nt, Human
cagccccucgcucucccggugaccugcuggag

SEQ ID NO: 85604 - RNA, 20 nt, Human
cagccccucggaccuucaca

SEQ ID NO: 85605 - RNA, 21 nt, Human
cagccccucggccgcccacuu

SEQ ID NO: 85606 - RNA, 32 nt, Human
cagccccucuacuccugacuucugggcaacag

SEQ ID NO: 85607 - RNA, 32 nt, Human
cagccccucugcucuguacccuuuuuccuuuu

SEQ ID NO: 85608 - RNA, 24 nt, Human
cagccccucuggucgcuccugccc

SEQ ID NO: 85609 - RNA, 32 nt, Human
cagccccucuguaggaaugagaccaagccaca

SEQ ID NO: 85610 - RNA, 21 nt, Human
cagccccugaaacaucuuggg

SEQ ID NO: 85611 - RNA, 22 nt, Human
cagccccugaagguccugggga

SEQ ID NO: 85612 - RNA, 32 nt, Human
cagccccugaucucccugguggugaccccuca

SEQ ID NO: 85613 - RNA, 32 nt, Human
cagccccugaugcccaggcugggugcaggcuc

SEQ ID NO: 85614 - RNA, 32 nt, Human
cagccccugcaacccaggcugcugcuuaauuu

SEQ ID NO: 85615 - RNA, 32 nt, Human
cagccccugcagcacugggcagacaugcuggc

SEQ ID NO: 85616 - RNA, 32 nt, Human
cagccccugccaccccagagggcggccacgac

SEQ ID NO: 85617 - RNA, 32 nt, Human
cagccccugcccgcuggacuccaggcccggcc

SEQ ID NO: 85618 - RNA, 32 nt, Human
cagccccugccucuggggcucugugguguagg

SEQ ID NO: 85619 - RNA, 32 nt, Human
cagccccugccugugugucugguguugagggg

SEQ ID NO: 85620 - RNA, 24 nt, Human
cagccccugcgcccggcccgaacg

SEQ ID NO: 85621 - RNA, 23 nt, Human
cagccccugcucagccccuccca

SEQ ID NO: 85622 - RNA, 20 nt, Human
cagccccugcuccuccuccc

SEQ ID NO: 85623 - RNA, 21 nt, Human
cagccccugcuccuccuccca

SEQ ID NO: 85624 - RNA, 31 nt, Human
cagccccugcugccccagccugugucuguuc

SEQ ID NO: 85625 - RNA, 23 nt, Human
cagccccugcuuggccccuccca

SEQ ID NO: 85626 - RNA, 18 nt, Human
cagccccuggccacaccu

SEQ ID NO: 85627 - RNA, 32 nt, Human
cagccccuggccuugcccucuuccuuuaggca

SEQ ID NO: 85628 - RNA, 19 nt, Human
cagccccugggagcaccca

SEQ ID NO: 85629 - RNA, 32 nt, Human
cagccccugggcaggcaucggagcuuccagcc

SEQ ID NO: 85630 - RNA, 32 nt, Human
cagccccuggggagggaggagaggacccagga

SEQ ID NO: 85631 - RNA, 32 nt, Human
cagccccuguacuggauuacagcauauucuca

SEQ ID NO: 85632 - RNA, 23 nt, Human
cagccccuguccccagcccgucc

SEQ ID NO: 85633 - RNA, 32 nt, Human
cagccccugugcguguccuccuucccgcagcc

SEQ ID NO: 85634 - RNA, 32 nt, Human
cagccccuguucugcugagugcggcugaaagc

SEQ ID NO: 85635 - RNA, 32 nt, Human
cagccccuuagcccaggaaccugccuuaaguu

SEQ ID NO: 85636 - RNA, 32 nt, Human
cagccccuuagguuugggaagggacgagccug

SEQ ID NO: 85637 - RNA, 17 nt, Human
cagccccuuccaccccu

SEQ ID NO: 85638 - RNA, 32 nt, Human
cagccccuuccaggcggggaaccugcuuccug

SEQ ID NO: 85639 - RNA, 32 nt, Human
cagccccuuccccucauguuacaccucuugcu

SEQ ID NO: 85640 - RNA, 21 nt, Human
cagccccuuccuccuccuccc

SEQ ID NO: 85641 - RNA, 24 nt, Human
cagccccuuccugcuccucugccc

SEQ ID NO: 85642 - RNA, 23 nt, Human
cagccccuucucccaggguccag

SEQ ID NO: 85643 - RNA, 32 nt, Human
cagccccuugacuccagccucgaccgccagcc

SEQ ID NO: 85644 - RNA, 32 nt, Human
cagccccuuggcccucuccugucugcccuagg

SEQ ID NO: 85645 - RNA, 22 nt, Human
cagccccuuucacacucugucc

SEQ ID NO: 85646 - RNA, 24 nt, Human
cagcccgacucccuccuccuuccc

SEQ ID NO: 85647 - RNA, 32 nt, Human
cagcccgagccgcgguagccgcagcgggaugg

SEQ ID NO: 85648 - RNA, 22 nt, Human
cagcccgagccggucccagccg

SEQ ID NO: 85649 - RNA, 32 nt, Human
cagcccgaggaaccacggguucuggagcuagg

SEQ ID NO: 85650 - RNA, 19 nt, Human
cagcccgaggaggcacuca

SEQ ID NO: 85651 - RNA, 32 nt, Human
cagcccgaguggaggcccaguaugucuagucc

SEQ ID NO: 85652 - RNA, 32 nt, Human
cagcccgaguugcugggaugacaggcacacgc

SEQ ID NO: 85653 - RNA, 32 nt, Human
cagcccgauacuugagccuccucuuuaaaagg

SEQ ID NO: 85654 - RNA, 19 nt, Human
cagcccgauccuccccugg

SEQ ID NO: 85655 - RNA, 32 nt, Human
cagcccgcaagaugcuugccccgcuaguggca

SEQ ID NO: 85656 - RNA, 19 nt, Human
cagcccgcagcccccuccc

SEQ ID NO: 85657 - RNA, 32 nt, Human
cagcccgcagccgccagccucccccggccgug

SEQ ID NO: 85658 - RNA, 32 nt, Human
cagcccgccaaaagcugggauccaaaccagcu

SEQ ID NO: 85659 - RNA, 23 nt, Human
cagcccgcccuucccuacuggug

SEQ ID NO: 85660 - RNA, 20 nt, Human
cagcccgcgaccuccuccca

SEQ ID NO: 85661 - RNA, 32 nt, Human
cagcccgcgccagacagcccacggauccguuc

SEQ ID NO: 85662 - RNA, 32 nt, Human
cagcccgcgggccugucgggcccagccgaggu

SEQ ID NO: 85663 - RNA, 22 nt, Human
cagcccgcuccagcccggcccg

SEQ ID NO: 85664 - RNA, 32 nt, Human
cagcccgcugaggaggcggggaccgagcuaca

SEQ ID NO: 85665 - RNA, 32 nt, Human
cagcccgcugccgcucggcccucggcaccgcu

SEQ ID NO: 85666 - RNA, 32 nt, Human
cagcccggaaccugggaugagaaacgacaggu

SEQ ID NO: 85667 - RNA, 32 nt, Human
cagcccggacaacauggcgaaaccucaucucu

SEQ ID NO: 85668 - RNA, 32 nt, Human
cagcccggacccgggggcuggcccagggcccu

SEQ ID NO: 85669 - RNA, 32 nt, Human
cagcccggaccgcagcacuccaguuccgcccc

SEQ ID NO: 85670 - RNA, 32 nt, Human
cagcccggagagaacagagggaaggagccgcg

SEQ ID NO: 85671 - RNA, 32 nt, Human
cagcccggagcugggugcuggggaaggcgggg

SEQ ID NO: 85672 - RNA, 32 nt, Human
cagcccggaggaggaggaggaggaggaggagg

SEQ ID NO: 85673 - RNA, 32 nt, Human
cagcccggaguccccguucacacugaggaacg

SEQ ID NO: 85674 - RNA, 32 nt, Human
cagcccggaugggccggcagggccgggaguaa

SEQ ID NO: 85675 - RNA, 32 nt, Human
cagcccggcacacccacgcgcaccgccgugua

SEQ ID NO: 85676 - RNA, 32 nt, Human
cagcccggcagugucuucucagugucuucacc

SEQ ID NO: 85677 - RNA, 32 nt, Human
cagcccggccaacauggugaaaccccaucucu

SEQ ID NO: 85678 - RNA, 26 nt, Human
cagcccggcccagcccggcccggccg

SEQ ID NO: 85679 - RNA, 32 nt, Human
cagcccggcccaggcagcaaugggguuccugc

SEQ ID NO: 85680 - RNA, 32 nt, Human
cagcccggccuacauggugaaaccccgucucu

SEQ ID NO: 85681 - RNA, 32 nt, Human
cagcccgggaggcaggcuccaggccucagcag

SEQ ID NO: 85682 - RNA, 32 nt, Human
cagcccgggaggucaggagcgcggcgggcgag

SEQ ID NO: 85683 - RNA, 32 nt, Human
cagcccgggagguggagguugcagugagccaa

SEQ ID NO: 85684 - RNA, 32 nt, Human
cagcccgggagguggaugaaugugggagaaaa

SEQ ID NO: 85685 - RNA, 23 nt, Human
cagcccgggcaacaagagcgaga

SEQ ID NO: 85686 - RNA, 32 nt, Human
cagcccgggcaacauggugaaaccccgucucu

SEQ ID NO: 85687 - RNA, 19 nt, Human
cagcccgggccggggccac

SEQ ID NO: 85688 - RNA, 21 nt, Human
cagcccgggcgacagagcaag

SEQ ID NO: 85689 - RNA, 21 nt, Human
cagcccgggcgacagagcgag

SEQ ID NO: 85690 - RNA, 22 nt, Human
cagcccgggcgacagagugaga

SEQ ID NO: 85691 - RNA, 32 nt, Human
cagcccggggacagagcaagacacugucucaa

SEQ ID NO: 85692 - RNA, 32 nt, Human
cagcccggggagaaccucuagcacaggcgggc

SEQ ID NO: 85693 - RNA, 32 nt, Human
cagcccggggaggaacugggugacuggaggcc

SEQ ID NO: 85694 - RNA, 18 nt, Human
cagcccgggggugggagg

SEQ ID NO: 85695 - RNA, 23 nt, Human
cagcccggggucuggagccggug

SEQ ID NO: 85696 - RNA, 32 nt, Human
cagcccgggucaucuguaccucugccuccuuu

SEQ ID NO: 85697 - RNA, 22 nt, Human
cagcccgggugacagagcaaga

SEQ ID NO: 85698 - RNA, 22 nt, Human
cagcccgggugacagagcgaga

SEQ ID NO: 85699 - RNA, 20 nt, Human
cagcccgggugacagaguga

SEQ ID NO: 85700 - RNA, 19 nt, Human
cagcccggugccuggggcg

SEQ ID NO: 85701 - RNA, 32 nt, Human
cagcccggugcgccccuccaccuccugcucgg

SEQ ID NO: 85702 - RNA, 21 nt, Human
cagcccguccuccuccaaccc

SEQ ID NO: 85703 - RNA, 32 nt, Human
cagcccguccuccucuaccucucuccucuccg

SEQ ID NO: 85704 - RNA, 32 nt, Human
cagcccgucuuauggacucugccuugcuuugc

SEQ ID NO: 85705 - RNA, 32 nt, Human
cagcccgugcagcugcucuacuccaggaaugg

SEQ ID NO: 85706 - RNA, 21 nt, Human
cagcccgugcgccucuccaca

SEQ ID NO: 85707 - RNA, 32 nt, Human
cagcccguggaggaggaaggaggaucacugug

SEQ ID NO: 85708 - RNA, 18 nt, Human
cagcccguggcccuccca

SEQ ID NO: 85709 - RNA, 32 nt, Human
cagcccgugggcugcccccugccuccccaccc

SEQ ID NO: 85710 - RNA, 32 nt, Human
cagcccguuuuggggugcuuucuugagccccc

SEQ ID NO: 85711 - RNA, 32 nt, Human
cagcccuaaagcccccagcccuagagagggga

SEQ ID NO: 85712 - RNA, 32 nt, Human
cagcccuaccaucagcugaaugcagcuaagug

SEQ ID NO: 85713 - RNA, 32 nt, Human
cagcccuacccugaauuccucagugcgccgac

SEQ ID NO: 85714 - RNA, 22 nt, Human
cagcccuaccugcgcucugccc

SEQ ID NO: 85715 - RNA, 21 nt, Human
cagcccuacuucuugcacuga

SEQ ID NO: 85716 - RNA, 32 nt, Human
cagcccuagggcacugugccacccucauuccu

SEQ ID NO: 85717 - RNA, 32 nt, Human
cagcccuaucccaggcucuccccaaccccagg

SEQ ID NO: 85718 - RNA, 32 nt, Human
cagcccuauuuuacgucauucuaaauucagcc

SEQ ID NO: 85719 - RNA, 26 nt, Human
cagcccucacaggggaggccgagggg

SEQ ID NO: 85720 - RNA, 20 nt, Human
cagcccucaccuuccugccc

SEQ ID NO: 85721 - RNA, 32 nt, Human
cagcccucacuccuccgcuccuggugacgcca

SEQ ID NO: 85722 - RNA, 32 nt, Human
cagcccucagaacuuuaguaacagcacaacaa

SEQ ID NO: 85723 - RNA, 32 nt, Human
cagcccucagagagacagcagaaagggaggga

SEQ ID NO: 85724 - RNA, 32 nt, Human
cagcccucaguguggcuuugugauugcugccc

SEQ ID NO: 85725 - RNA, 32 nt, Human
cagcccucauuucuuauaauacccugauccca

SEQ ID NO: 85726 - RNA, 32 nt, Human
cagcccuccaaggagccaguggucucagaccu

SEQ ID NO: 85727 - RNA, 32 nt, Human
cagcccuccacuccagauggauauccagugau

SEQ ID NO: 85728 - RNA, 32 nt, Human
cagcccuccacuucugguauaauuguguagcc

SEQ ID NO: 85729 - RNA, 32 nt, Human
cagcccuccaucuaaacugcccccucugcccu

SEQ ID NO: 85730 - RNA, 32 nt, Human
cagcccuccaugguccugucuguccuucugaa

SEQ ID NO: 85731 - RNA, 32 nt, Human
cagcccucccaaccucccuuccagggggcuua

SEQ ID NO: 85732 - RNA, 19 nt, Human
cagcccucccagagugcua

SEQ ID NO: 85733 - RNA, 18 nt, Human
cagcccuccccagcugcc

SEQ ID NO: 85734 - RNA, 32 nt, Human
cagcccuccccagcugcccaggaagagcccca

SEQ ID NO: 85735 - RNA, 17 nt, Human
cagcccucccccaccca

SEQ ID NO: 85736 - RNA, 17 nt, Human
cagcccuccccuuccca

SEQ ID NO: 85737 - RNA, 32 nt, Human
cagcccucccucccaguauuucaucaaggaca

SEQ ID NO: 85738 - RNA, 32 nt, Human
cagcccucccuguccuccucggaucaccgaga

SEQ ID NO: 85739 - RNA, 32 nt, Human
cagcccuccucuuccuccuccuccuccuccug

SEQ ID NO: 85740 - RNA, 22 nt, Human
cagcccuccuugacccugaaag

SEQ ID NO: 85741 - RNA, 32 nt, Human
cagcccucgcgcccucuccuucuugugccuug

SEQ ID NO: 85742 - RNA, 32 nt, Human
cagcccucggaugcauaagcaaggucagcucc

SEQ ID NO: 85743 - RNA, 32 nt, Human
cagcccucuaacucaugugauuucccaugcau

SEQ ID NO: 85744 - RNA, 19 nt, Human
cagcccucucacccuggua

SEQ ID NO: 85745 - RNA, 32 nt, Human
cagcccucuccacgccaucugccugcaccagu

SEQ ID NO: 85746 - RNA, 32 nt, Human
cagcccucuccuccuguuccuccuguagcauc

SEQ ID NO: 85747 - RNA, 32 nt, Human
cagcccucucgcuucuaacacagggcaccugc

SEQ ID NO: 85748 - RNA, 20 nt, Human
cagcccucugccccugccca

SEQ ID NO: 85749 - RNA, 22 nt, Human
cagcccucugcuccucccggcc

SEQ ID NO: 85750 - RNA, 32 nt, Human
cagcccucugguucacauucagcuccagugca

SEQ ID NO: 85751 - RNA, 32 nt, Human
cagcccucuugccaggcaugcauaugugagau

SEQ ID NO: 85752 - RNA, 32 nt, Human
cagcccucuuucuucagcccucccuuuacucc

SEQ ID NO: 85753 - RNA, 32 nt, Human
cagcccugaacccacaaccagcagaggcagug

SEQ ID NO: 85754 - RNA, 32 nt, Human
cagcccugacaccugcccuuugucccccaggc

SEQ ID NO: 85755 - RNA, 32 nt, Human
cagcccugacaguguugggggaugugaaugag

SEQ ID NO: 85756 - RNA, 32 nt, Human
cagcccugacucugggccuccucaaacucagu

SEQ ID NO: 85757 - RNA, 32 nt, Human
cagcccugacuucauccucccuucucugucca

SEQ ID NO: 85758 - RNA, 17 nt, Human
cagcccugacuuucaua

SEQ ID NO: 85759 - RNA, 20 nt, Human
cagcccugagcccaugagau

SEQ ID NO: 85760 - RNA, 32 nt, Human
cagcccugaggaagaugguugcagaggaagga

SEQ ID NO: 85761 - RNA, 21 nt, Human
cagcccugaggcaggaaacua

SEQ ID NO: 85762 - RNA, 32 nt, Human
cagcccugagggcugaguucugcacccaguca

SEQ ID NO: 85763 - RNA, 32 nt, Human
cagcccugauggaaagcucccgccugaaagag

SEQ ID NO: 85764 - RNA, 18 nt, Human
cagcccugauguuuucuc

SEQ ID NO: 85765 - RNA, 24 nt, Human
cagcccugcaacuugacccaggua

SEQ ID NO: 85766 - RNA, 32 nt, Human
cagcccugcaccugccugccacuuccccaccg

SEQ ID NO: 85767 - RNA, 32 nt, Human
cagcccugcacuccacgcuggccaagaaggcc

SEQ ID NO: 85768 - RNA, 32 nt, Human
cagcccugcaggugccugggcacugauggaau

SEQ ID NO: 85769 - RNA, 32 nt, Human
cagcccugcauccuccgugcccuagaccugcu

SEQ ID NO: 85770 - RNA, 32 nt, Human
cagcccugccaacuuccaucgugggcucagcu

SEQ ID NO: 85771 - RNA, 32 nt, Human
cagcccugccacccucugcugucaucagcuga

SEQ ID NO: 85772 - RNA, 32 nt, Human
cagcccugccagcccagcccaggcuggcccag

SEQ ID NO: 85773 - RNA, 21 nt, Human
cagcccugcccagcccugccc

SEQ ID NO: 85774 - RNA, 32 nt, Human
cagcccugcccagccggcuuugcucacccacu

SEQ ID NO: 85775 - RNA, 22 nt, Human
cagcccugccccacccuccaca

SEQ ID NO: 85776 - RNA, 32 nt, Human
cagcccugccccacccuccacaggcaggugac

SEQ ID NO: 85777 - RNA, 20 nt, Human
cagcccugccucaugggaug

SEQ ID NO: 85778 - RNA, 16 nt, Human
cagcccugccuccaca

SEQ ID NO: 85779 - RNA, 32 nt, Human
cagcccugccuccagcccucaccucucucacc

SEQ ID NO: 85780 - RNA, 32 nt, Human
cagcccugccuccagggcuccugggcugccag

SEQ ID NO: 85781 - RNA, 32 nt, Human
cagcccugccuucugcccucugcccugcaugg

SEQ ID NO: 85782 - RNA, 32 nt, Human
cagcccugcucaccuuucuuaccucucuggcc

SEQ ID NO: 85783 - RNA, 32 nt, Human
cagcccugcuccagacaccuugggcauggagg

SEQ ID NO: 85784 - RNA, 19 nt, Human
cagcccugcuccucccgcc

SEQ ID NO: 85785 - RNA, 20 nt, Human
cagcccugcuccuccugccu

SEQ ID NO: 85786 - RNA, 32 nt, Human
cagcccugcuccugauggccauggaaggaaca

SEQ ID NO: 85787 - RNA, 17 nt, Human
cagcccugcuucccgca

SEQ ID NO: 85788 - RNA, 32 nt, Human
cagcccuggaaagaaaagcaaaaagaaaaggc

SEQ ID NO: 85789 - RNA, 32 nt, Human
cagcccuggaagguggaaaaagaaaaguugac

SEQ ID NO: 85790 - RNA, 18 nt, Human
cagcccuggacuuccaga

SEQ ID NO: 85791 - RNA, 32 nt, Human
cagcccuggagaggaggaagggacugacuacg

SEQ ID NO: 85792 - RNA, 32 nt, Human
cagcccuggagaggagggcagggcugcgggga

SEQ ID NO: 85793 - RNA, 32 nt, Human
cagcccuggauaugccuccacuguggagggaa

SEQ ID NO: 85794 - RNA, 18 nt, Human
cagcccuggauucuccca

SEQ ID NO: 85795 - RNA, 18 nt, Human
cagcccuggcccuuccca

SEQ ID NO: 85796 - RNA, 32 nt, Human
cagcccuggccuggccgccagccgccaggagg

SEQ ID NO: 85797 - RNA, 32 nt, Human
cagcccuggccuuggugaccuggcucugcugc

SEQ ID NO: 85798 - RNA, 22 nt, Human
cagcccuggcgacagagugaga

SEQ ID NO: 85799 - RNA, 19 nt, Human
cagcccuggcguccuccac

SEQ ID NO: 85800 - RNA, 32 nt, Human
cagcccuggcucuuccaugcucugccccuuuc

SEQ ID NO: 85801 - RNA, 29 nt, Human
cagcccuggcugcugcucgccccacccuc

SEQ ID NO: 85802 - RNA, 32 nt, Human
cagcccugggcaaaggggaccagcaaguuguc

SEQ ID NO: 85803 - RNA, 32 nt, Human
cagcccugggcaacauagugagaccccugucu

SEQ ID NO: 85804 - RNA, 32 nt, Human
cagcccuggggugcaggagucccucuggaagg

SEQ ID NO: 85805 - RNA, 18 nt, Human
cagcccuggguccuccca

SEQ ID NO: 85806 - RNA, 19 nt, Human
cagcccuggguccucccac

SEQ ID NO: 85807 - RNA, 32 nt, Human
cagcccuggguccucccacccucucuccuccc

SEQ ID NO: 85808 - RNA, 19 nt, Human
cagcccuggguucuccuca

SEQ ID NO: 85809 - RNA, 32 nt, Human
cagcccugguauggcgggugacccucacgucu

SEQ ID NO: 85810 - RNA, 21 nt, Human
cagcccuggugacagaggaga

SEQ ID NO: 85811 - RNA, 31 nt, Human
cagcccuguaccucugggccuggucucgugu

SEQ ID NO: 85812 - RNA, 32 nt, Human
cagcccuguccaccccaaccugugggccucua

SEQ ID NO: 85813 - RNA, 32 nt, Human
cagcccuguccucucgacuuccuuccuuagcu

SEQ ID NO: 85814 - RNA, 32 nt, Human
cagcccugugagacgccgggugcucugguaau

SEQ ID NO: 85815 - RNA, 32 nt, Human
cagcccugugcccccugcccacugaccuguga

SEQ ID NO: 85816 - RNA, 22 nt, Human
cagcccugugcuccucccuccc

SEQ ID NO: 85817 - RNA, 32 nt, Human
cagcccuguucucaacaacagggaggucaugg

SEQ ID NO: 85818 - RNA, 32 nt, Human
cagcccuguugggaagaaaggaagaaaacagg

SEQ ID NO: 85819 - RNA, 32 nt, Human
cagcccuuaaaucccuucccugugggaaguca

SEQ ID NO: 85820 - RNA, 32 nt, Human
cagcccuuaauuagggcuucagugacuuagaa

SEQ ID NO: 85821 - RNA, 21 nt, Human
cagcccuuacaguuucacuca

SEQ ID NO: 85822 - RNA, 18 nt, Human
cagcccuucccaccccca

SEQ ID NO: 85823 - RNA, 18 nt, Human
cagcccuucccagcacuu

SEQ ID NO: 85824 - RNA, 19 nt, Human
cagcccuucccagggcuca

SEQ ID NO: 85825 - RNA, 18 nt, Human
cagcccuucccagucuca

SEQ ID NO: 85826 - RNA, 19 nt, Human
cagcccuucccagucucau

SEQ ID NO: 85827 - RNA, 17 nt, Human
cagcccuucccccuccc

SEQ ID NO: 85828 - RNA, 24 nt, Human
cagcccuucccggagcuacagggg

SEQ ID NO: 85829 - RNA, 21 nt, Human
cagcccuucccgugcucuccc

SEQ ID NO: 85830 - RNA, 32 nt, Human
cagcccuucccuggccccgccggauguauaaa

SEQ ID NO: 85831 - RNA, 32 nt, Human
cagcccuucccuguguggcugcacugaggugg

SEQ ID NO: 85832 - RNA, 32 nt, Human
cagcccuuccuccgugcgcccugccgggcggc

SEQ ID NO: 85833 - RNA, 18 nt, Human
cagcccuuccucucacuc

SEQ ID NO: 85834 - RNA, 32 nt, Human
cagcccuuccuugccacuggucucaaagcugg

SEQ ID NO: 85835 - RNA, 32 nt, Human
cagcccuuccuugggcgucucccccagagugc

SEQ ID NO: 85836 - RNA, 21 nt, Human
cagcccuucgagcccccuccc

SEQ ID NO: 85837 - RNA, 32 nt, Human
cagcccuucucccucccucccuuccucccucu

SEQ ID NO: 85838 - RNA, 32 nt, Human
cagcccuucuccugugugccugccuccugccg

SEQ ID NO: 85839 - RNA, 32 nt, Human
cagcccuucucuucccuuugggcucuugccaa

SEQ ID NO: 85840 - RNA, 32 nt, Human
cagcccuucugaacuccugggcucaagccauc

SEQ ID NO: 85841 - RNA, 19 nt, Human
cagcccuucuguggccuca

SEQ ID NO: 85842 - RNA, 32 nt, Human
cagcccuugaggcagaggugccgagugacugc

SEQ ID NO: 85843 - RNA, 32 nt, Human
cagcccuugcagccucccuucuccuggcaccc

SEQ ID NO: 85844 - RNA, 32 nt, Human
cagcccuugcuuguugggauuccugacccagg

SEQ ID NO: 85845 - RNA, 32 nt, Human
cagcccuuggcuggaggcgugaccucaacccc

SEQ ID NO: 85846 - RNA, 32 nt, Human
cagcccuugggaacagugagagguugaagguc

SEQ ID NO: 85847 - RNA, 32 nt, Human
cagcccuuggugguggccagggagaggcgccc

SEQ ID NO: 85848 - RNA, 32 nt, Human
cagcccuugugacuccaaccagccucacaaga

SEQ ID NO: 85849 - RNA, 19 nt, Human
cagcccuugugcuuuuaua

SEQ ID NO: 85850 - RNA, 32 nt, Human
cagcccuuguguucccgugccccacacuuucc

SEQ ID NO: 85851 - RNA, 32 nt, Human
cagcccuuguucugccagcuggagccaagaag

SEQ ID NO: 85852 - RNA, 32 nt, Human
cagcccuuuagaguuccugaaggaggcagguu

SEQ ID NO: 85853 - RNA, 18 nt, Human
cagcccuuuauccucaca

SEQ ID NO: 85854 - RNA, 19 nt, Human
cagcccuuuauccucacac

SEQ ID NO: 85855 - RNA, 32 nt, Human
cagcccuuuauuccucuccauuuucacuccuu

SEQ ID NO: 85856 - RNA, 26 nt, Human
cagcccuuuccuaacccaacccaacc

SEQ ID NO: 85857 - RNA, 25 nt, Human
cagcccuuuccucugcccccaccca

SEQ ID NO: 85858 - RNA, 32 nt, Human
cagcccuuugcagcacugcucucaaggccagu

SEQ ID NO: 85859 - RNA, 32 nt, Human
cagcccuuuggcagaggcugaggagggagaug

SEQ ID NO: 85860 - RNA, 23 nt, Human
cagcccuuugggaggccgaaugg

SEQ ID NO: 85861 - RNA, 21 nt, Human
cagcccuuugggaggccgagg

SEQ ID NO: 85862 - RNA, 32 nt, Human
cagcccuuugggaggccgaggcgggcggauca

SEQ ID NO: 85863 - RNA, 32 nt, Human
cagcccuuugggaggccgaggugggcagauca

SEQ ID NO: 85864 - RNA, 32 nt, Human
cagcccuuugggaggcugaggcgggcagauca

SEQ ID NO: 85865 - RNA, 23 nt, Human
cagcccuuuuucccauccugccc

SEQ ID NO: 85866 - RNA, 32 nt, Human
cagccgaaaagcuuuugaggggcugacuucaa

SEQ ID NO: 85867 - RNA, 22 nt, Human
cagccgaaagagcaagugggug

SEQ ID NO: 85868 - RNA, 32 nt, Human
cagccgaagcacuccaucccagauuuguuguc

SEQ ID NO: 85869 - RNA, 32 nt, Human
cagccgacccaccaacagcugcaccugcgccu

SEQ ID NO: 85870 - RNA, 32 nt, Human
cagccgaccuguggccucuugcucugaagcca

SEQ ID NO: 85871 - RNA, 32 nt, Human
cagccgacgcgcagauagcagagccauccuug

SEQ ID NO: 85872 - RNA, 32 nt, Human
cagccgagaagauuccuugagaaucaagcauu

SEQ ID NO: 85873 - RNA, 32 nt, Human
cagccgagcagccuggcaacggcgguggcgcc

SEQ ID NO: 85874 - RNA, 24 nt, Human
cagccgagccccaggagcccguca

SEQ ID NO: 85875 - RNA, 32 nt, Human
cagccgagcggagcccaggagagcagagagcg

SEQ ID NO: 85876 - RNA, 32 nt, Human
cagccgaggaggcgcggcggagaggggacugc

SEQ ID NO: 85877 - RNA, 32 nt, Human
cagccgagggcugccugaauuucugacucaca

SEQ ID NO: 85878 - RNA, 32 nt, Human
cagccgaggugggagcacgggcaggcucaggc

SEQ ID NO: 85879 - RNA, 32 nt, Human
cagccgagucacuacugccugccugccugccu

SEQ ID NO: 85880 - RNA, 19 nt, Human
cagccgagugaccuccaua

SEQ ID NO: 85881 - RNA, 32 nt, Human
cagccgaugccccagcccugcacgccacccac

SEQ ID NO: 85882 - RNA, 32 nt, Human
cagccgauggacuuggcuucaagcucagauuu

SEQ ID NO: 85883 - RNA, 18 nt, Human
cagccgcacaauggggug

SEQ ID NO: 85884 - RNA, 20 nt, Human
cagccgcacagcaggaggug

SEQ ID NO: 85885 - RNA, 32 nt, Human
cagccgcacccaggccccaaugcuugugugug

SEQ ID NO: 85886 - RNA, 32 nt, Human
cagccgcaccgccuauuccagccuuuggagau

SEQ ID NO: 85887 - RNA, 32 nt, Human
cagccgcaccuugcuggaugcuucuccaguag

SEQ ID NO: 85888 - RNA, 32 nt, Human
cagccgcaucccucccgcagcgacggcggccc

SEQ ID NO: 85889 - RNA, 19 nt, Human
cagccgcaucugugaggug

SEQ ID NO: 85890 - RNA, 32 nt, Human
cagccgccaaccuaacaccacucccucugcag

SEQ ID NO: 85891 - RNA, 22 nt, Human
cagccgcccacccccaccccca

SEQ ID NO: 85892 - RNA, 32 nt, Human
cagccgccccucuccuccugggcugcagagcc

SEQ ID NO: 85893 - RNA, 32 nt, Human
cagccgccccugcuuuugccuuccuagaccuu

SEQ ID NO: 85894 - RNA, 32 nt, Human
cagccgcccgccucaggcucucucugccagcc

SEQ ID NO: 85895 - RNA, 23 nt, Human
cagccgccgucaauguucacaga

SEQ ID NO: 85896 - RNA, 32 nt, Human
cagccgccuccaccaugccgccaaaguucgac

SEQ ID NO: 85897 - RNA, 32 nt, Human
cagccgccuccacccgccccacaccacaaucg

SEQ ID NO: 85898 - RNA, 32 nt, Human
cagccgccucccccacgcucuucaccacguuc

SEQ ID NO: 85899 - RNA, 31 nt, Human
cagccgcgacuucuccuuuugccuuaggccu

SEQ ID NO: 85900 - RNA, 19 nt, Human
cagccgcgagguccuucac

SEQ ID NO: 85901 - RNA, 32 nt, Human
cagccgcgagguggacggggcgguggggccug

SEQ ID NO: 85902 - RNA, 32 nt, Human
cagccgcgccgccccaagucagccuggacaca

SEQ ID NO: 85903 - RNA, 32 nt, Human
cagccgcggagcccgcguuccacccucugugc

SEQ ID NO: 85904 - RNA, 32 nt, Human
cagccgcggccgaagccggagcaggggccgga

SEQ ID NO: 85905 - RNA, 23 nt, Human
cagccgcggcugcucggccacug

SEQ ID NO: 85906 - RNA, 32 nt, Human
cagccgcgugcucgggacuaugggaugccaga

SEQ ID NO: 85907 - RNA, 18 nt, Human
cagccgcuaggccaggga

SEQ ID NO: 85908 - RNA, 32 nt, Human
cagccgcucacuccuccagggcauuuuuagga

SEQ ID NO: 85909 - RNA, 32 nt, Human
cagccgcucugacugcuccggcugcccgcccg

SEQ ID NO: 85910 - RNA, 32 nt, Human
cagccgcugagcugugguggccuagaugcccg

SEQ ID NO: 85911 - RNA, 21 nt, Human
cagccgcugcagcagcggaga

SEQ ID NO: 85912 - RNA, 32 nt, Human
cagccgcugcccaggggaguggcuguggggag

SEQ ID NO: 85913 - RNA, 32 nt, Human
cagccgcugcucccuuucucccucucuuccuc

SEQ ID NO: 85914 - RNA, 18 nt, Human
cagccgcuggacuguaga

SEQ ID NO: 85915 - RNA, 32 nt, Human
cagccgcugggagcgcgaggccauguaacccg

SEQ ID NO: 85916 - RNA, 32 nt, Human
cagccgcuggugucucuucacacagaggcaca

SEQ ID NO: 85917 - RNA, 24 nt, Human
cagccgcugugggcagggggugug

SEQ ID NO: 85918 - RNA, 22 nt, Human
cagccggacccauggccugccc

SEQ ID NO: 85919 - RNA, 32 nt, Human
cagccggagauggaguggaaacuggagcgcac

SEQ ID NO: 85920 - RNA, 32 nt, Human
cagccggagcagucccggagcagaagcagcag

SEQ ID NO: 85921 - RNA, 17 nt, Human
cagccggagccuccaca

SEQ ID NO: 85922 - RNA, 17 nt, Human
cagccggagccuccgca

SEQ ID NO: 85923 - RNA, 32 nt, Human
cagccggagcugggacuguucagucacuggga

SEQ ID NO: 85924 - RNA, 32 nt, Human
cagccggcacgguggagaacgggagcuuaacu

SEQ ID NO: 85925 - RNA, 32 nt, Human
cagccggcaggcggagugaggaggaagcggag

SEQ ID NO: 85926 - RNA, 32 nt, Human
cagccggcccaggauaggcagcagcaggccua

SEQ ID NO: 85927 - RNA, 21 nt, Human
cagccggcgccgucucugccc

SEQ ID NO: 85928 - RNA, 32 nt, Human
cagccggcugcguuccucucuccauccguccg

SEQ ID NO: 85929 - RNA, 32 nt, Human
cagccgggacagcaaguggaggggacggcuca

SEQ ID NO: 85930 - RNA, 22 nt, Human
cagccgggauuccagugagaug

SEQ ID NO: 85931 - RNA, 32 nt, Human
cagccgggccaacacugagaaacccugccucu

SEQ ID NO: 85932 - RNA, 32 nt, Human
cagccgggccaacauggugaaaccccaucucu

SEQ ID NO: 85933 - RNA, 32 nt, Human
cagccgggccagcauggugaaaccccgucucu

SEQ ID NO: 85934 - RNA, 32 nt, Human
cagccgggccccugccuugugccucagcucuc

SEQ ID NO: 85935 - RNA, 32 nt, Human
cagccgggcuucuuagaggaggucaguugucc

SEQ ID NO: 85936 - RNA, 32 nt, Human
cagccggggaaaaggggagggugcagggagag

SEQ ID NO: 85937 - RNA, 22 nt, Human
cagccggggccuuggcagguga

SEQ ID NO: 85938 - RNA, 32 nt, Human
cagccggggcugggaucggggccuccucuguc

SEQ ID NO: 85939 - RNA, 18 nt, Human
cagccgggggccguggcc

SEQ ID NO: 85940 - RNA, 32 nt, Human
cagccgggguccacucucagggcacaggugga

SEQ ID NO: 85941 - RNA, 21 nt, Human
cagccggggugacagaagaga

SEQ ID NO: 85942 - RNA, 22 nt, Human
cagccggggugacagagugaga

SEQ ID NO: 85943 - RNA, 32 nt, Human
cagccggggugagugccccgggcgaggccggc

SEQ ID NO: 85944 - RNA, 32 nt, Human
cagccgggucacugcagcugccuggaccugcu

SEQ ID NO: 85945 - RNA, 32 nt, Human
cagccggguguuguggaccccaaaggggugac

SEQ ID NO: 85946 - RNA, 32 nt, Human
cagccggguuggaagugucucuccacagucac

SEQ ID NO: 85947 - RNA, 32 nt, Human
cagccgguccuggggucccacccuggugcccu

SEQ ID NO: 85948 - RNA, 32 nt, Human
cagccggugguuuugcuucuccuuuguguucc

SEQ ID NO: 85949 - RNA, 32 nt, Human
cagccggugugaggacacgauaugcugggguu

SEQ ID NO: 85950 - RNA, 32 nt, Human
cagccguauuaaaagaaaggacacugugagca

SEQ ID NO: 85951 - RNA, 32 nt, Human
cagccguccggaccccagagcaguacuaccag

SEQ ID NO: 85952 - RNA, 32 nt, Human
cagccguccucaccagagauggaccagggagg

SEQ ID NO: 85953 - RNA, 32 nt, Human
cagccgucuccacagcucuuacccagguaggc

SEQ ID NO: 85954 - RNA, 32 nt, Human
cagccgugacugcccguggcucugcugccgcc

SEQ ID NO: 85955 - RNA, 32 nt, Human
cagccgugagccaccacgcccagccugcuuuc

SEQ ID NO: 85956 - RNA, 32 nt, Human
cagccgugagccugguagccgugaccuugacu

SEQ ID NO: 85957 - RNA, 32 nt, Human
cagccgugaggaacucuucaggcuccagaagc

SEQ ID NO: 85958 - RNA, 18 nt, Human
cagccgugaucacaggug

SEQ ID NO: 85959 - RNA, 32 nt, Human
cagccgugcaccacuacauccagcuguauaug

SEQ ID NO: 85960 - RNA, 16 nt, Human
cagccgugccgcgaug

SEQ ID NO: 85961 - RNA, 32 nt, Human
cagccguggcaccacacaccucccagcucugc

SEQ ID NO: 85962 - RNA, 18 nt, Human
cagccguggcaggaaaug

SEQ ID NO: 85963 - RNA, 25 nt, Human
cagccguggccagaggcucgagggg

SEQ ID NO: 85964 - RNA, 32 nt, Human
cagccgugggcaaugacuuugcugcaaucuua

SEQ ID NO: 85965 - RNA, 32 nt, Human
cagccgugggugggggcccugaggugaagagu

SEQ ID NO: 85966 - RNA, 17 nt, Human
cagccgugguggaggug

SEQ ID NO: 85967 - RNA, 16 nt, Human
cagccgugguuaggug

SEQ ID NO: 85968 - RNA, 21 nt, Human
cagccguuucucccuacggug

SEQ ID NO: 85969 - RNA, 32 nt, Human
cagccuaaaaagcuguaacauacacauaaugg

SEQ ID NO: 85970 - RNA, 32 nt, Human
cagccuaaccaacauggagaaacccugucucu

SEQ ID NO: 85971 - RNA, 32 nt, Human
cagccuaaccaacauggugaaaccccgucucu

SEQ ID NO: 85972 - RNA, 32 nt, Human
cagccuaacccuccuucucuucuucuccucuc

SEQ ID NO: 85973 - RNA, 32 nt, Human
cagccuaagaagaaggccagagagggaaaagg

SEQ ID NO: 85974 - RNA, 21 nt, Human
cagccuaagcaacagagcaag

SEQ ID NO: 85975 - RNA, 21 nt, Human
cagccuaagcaauagagcgag

SEQ ID NO: 85976 - RNA, 26 nt, Human
cagccuaagggagugggaaggaaaug

SEQ ID NO: 85977 - RNA, 32 nt, Human
cagccuaagggagugggaaggaaauggggugu

SEQ ID NO: 85978 - RNA, 22 nt, Human
cagccuacacccagccccgagu

SEQ ID NO: 85979 - RNA, 32 nt, Human
cagccuacacguauuuguuaauaucuaacaua

SEQ ID NO: 85980 - RNA, 32 nt, Human
cagccuacacugcacccuggcuggcaggggug

SEQ ID NO: 85981 - RNA, 32 nt, Human
cagccuacagaaugcucucuggcucccggcuu

SEQ ID NO: 85982 - RNA, 32 nt, Human
cagccuacagcaguguggucucuuacauggcc

SEQ ID NO: 85983 - RNA, 32 nt, Human
cagccuacagccgccugcaucuguauccagcg

SEQ ID NO: 85984 - RNA, 25 nt, Human
cagccuacaucuuucucccaugcug

SEQ ID NO: 85985 - RNA, 32 nt, Human
cagccuaccagcucggagugcaguuccugguu

SEQ ID NO: 85986 - RNA, 32 nt, Human
cagccuacccaacauggugaaaccccaucucu

SEQ ID NO: 85987 - RNA, 32 nt, Human
cagccuacccacccuccccaucuuugcugagc

SEQ ID NO: 85988 - RNA, 24 nt, Human
cagccuaccccuccugcgcugccc

SEQ ID NO: 85989 - RNA, 20 nt, Human
cagccuacccguaaacugcc

SEQ ID NO: 85990 - RNA, 21 nt, Human
cagccuaccgcuggcccugcc

SEQ ID NO: 85991 - RNA, 24 nt, Human
cagccuaccugguguccccuaccc

SEQ ID NO: 85992 - RNA, 32 nt, Human
cagccuacuccaccuguuacuacuucuuuuug

SEQ ID NO: 85993 - RNA, 24 nt, Human
cagccuacuggaccucccgagcug

SEQ ID NO: 85994 - RNA, 32 nt, Human
cagccuacuuuccaagcggagccaugucuggu

SEQ ID NO: 85995 - RNA, 22 nt, Human
cagccuagacaacagagcaaga

SEQ ID NO: 85996 - RNA, 22 nt, Human
cagccuagacaacagggcaagg

SEQ ID NO: 85997 - RNA, 16 nt, Human
cagccuagaccuccca

SEQ ID NO: 85998 - RNA, 22 nt, Human
cagccuagaugacagaaugaga

SEQ ID NO: 85999 - RNA, 32 nt, Human
cagccuagcacaggcuggcaguugguacugaa

SEQ ID NO: 86000 - RNA, 26 nt, Human
cagccuagcaugcaaccaguggugug

SEQ ID NO: 86001 - RNA, 32 nt, Human
cagccuagccaacaugcugaaacuccaucucu

SEQ ID NO: 86002 - RNA, 22 nt, Human
cagccuagccaacauggugaaa

SEQ ID NO: 86003 - RNA, 32 nt, Human
cagccuagccaacauggugaaaucccaucucu

SEQ ID NO: 86004 - RNA, 32 nt, Human
cagccuagccaacauggugaacuaccaucucu

SEQ ID NO: 86005 - RNA, 32 nt, Human
cagccuagccaagauggugaaaccccaucucu

SEQ ID NO: 86006 - RNA, 20 nt, Human
cagccuagcgacagagcaag

SEQ ID NO: 86007 - RNA, 21 nt, Human
cagccuagcgacagagcaaga

SEQ ID NO: 86008 - RNA, 32 nt, Human
cagccuagcuaacauggcaaaaccccauugcu

SEQ ID NO: 86009 - RNA, 32 nt, Human
cagccuaggacguugaggcugcagugagcugu

SEQ ID NO: 86010 - RNA, 32 nt, Human
cagccuaggagggucagauuccuguauuaauu

SEQ ID NO: 86011 - RNA, 21 nt, Human
cagccuaggcaacagagcaag

SEQ ID NO: 86012 - RNA, 22 nt, Human
cagccuaggcaacagagcaaga

SEQ ID NO: 86013 - RNA, 21 nt, Human
cagccuaggcaacagagcgag

SEQ ID NO: 86014 - RNA, 22 nt, Human
cagccuaggcaacagagcgaga

SEQ ID NO: 86015 - RNA, 22 nt, Human
cagccuaggcaacagagggaga

SEQ ID NO: 86016 - RNA, 22 nt, Human
cagccuaggcaacagagugaga

SEQ ID NO: 86017 - RNA, 22 nt, Human
cagccuaggcaacauagugaga

SEQ ID NO: 86018 - RNA, 32 nt, Human
cagccuaggcaacauggagaaaccccgucucu

SEQ ID NO: 86019 - RNA, 32 nt, Human
cagccuaggcaacauggcaaaaccccaucucg

SEQ ID NO: 86020 - RNA, 32 nt, Human
cagccuaggcaacauggcgaaacccugucucu

SEQ ID NO: 86021 - RNA, 32 nt, Human
cagccuaggcaacauggugaaacccuaucuuu

SEQ ID NO: 86022 - RNA, 19 nt, Human
cagccuaggcauggugaga

SEQ ID NO: 86023 - RNA, 32 nt, Human
cagccuaggccagauggugaaaccccaucucu

SEQ ID NO: 86024 - RNA, 22 nt, Human
cagccuaggcgacagagcaaga

SEQ ID NO: 86025 - RNA, 21 nt, Human
cagccuaggcgacagagcgag

SEQ ID NO: 86026 - RNA, 22 nt, Human
cagccuaggcgacagagcgaga

SEQ ID NO: 86027 - RNA, 22 nt, Human
cagccuaggcgacagagugaga

SEQ ID NO: 86028 - RNA, 22 nt, Human
cagccuaggcgacggggcaaga

SEQ ID NO: 86029 - RNA, 21 nt, Human
cagccuaggcuguggccacua

SEQ ID NO: 86030 - RNA, 22 nt, Human
cagccuaggguggggaagugag

SEQ ID NO: 86031 - RNA, 22 nt, Human
cagccuagguaacauagugaga

SEQ ID NO: 86032 - RNA, 22 nt, Human
cagccuaggugacagaaugaga

SEQ ID NO: 86033 - RNA, 22 nt, Human
cagccuaggugacagagcaaga

SEQ ID NO: 86034 - RNA, 22 nt, Human
cagccuaggugacagagcgaga

SEQ ID NO: 86035 - RNA, 22 nt, Human
cagccuaggugacagagugaga

SEQ ID NO: 86036 - RNA, 22 nt, Human
cagccuaggugacagggcaaga

SEQ ID NO: 86037 - RNA, 22 nt, Human
cagccuaggugacauagugaga

SEQ ID NO: 86038 - RNA, 22 nt, Human
cagccuaggugauagagcaaga

SEQ ID NO: 86039 - RNA, 21 nt, Human
cagccuagugggaaggaggug

SEQ ID NO: 86040 - RNA, 32 nt, Human
cagccuauacauguuauuuacaucauuucuca

SEQ ID NO: 86041 - RNA, 20 nt, Human
cagccuauagcucccgaagc

SEQ ID NO: 86042 - RNA, 32 nt, Human
cagccuauaguagaguccccugaccccaagcc

SEQ ID NO: 86043 - RNA, 26 nt, Human
cagccuauauuuuaggcagaaaauua

SEQ ID NO: 86044 - RNA, 21 nt, Human
cagccuaucucccccaagcug

SEQ ID NO: 86045 - RNA, 32 nt, Human
cagccuauuaacugugucuuagcaauguugua

SEQ ID NO: 86046 - RNA, 32 nt, Human
cagccuauuccaaugacugaaacccuucuugg

SEQ ID NO: 86047 - RNA, 21 nt, Human
cagccuauugucuuucuccgc

SEQ ID NO: 86048 - RNA, 20 nt, Human
cagccucaaccucccaggcu

SEQ ID NO: 86049 - RNA, 20 nt, Human
cagccucaaccucccuggcu

SEQ ID NO: 86050 - RNA, 22 nt, Human
cagccucaaccuuccaggcuga

SEQ ID NO: 86051 - RNA, 18 nt, Human
cagccucaacuucucagg

SEQ ID NO: 86052 - RNA, 32 nt, Human
cagccucaaucccggcugcugcauuuaggugg

SEQ ID NO: 86053 - RNA, 32 nt, Human
cagccucaauuuaaaaauaaagagcauaauug

SEQ ID NO: 86054 - RNA, 31 nt, Human
cagccucacagcuuacaucacagcuuaaugu

SEQ ID NO: 86055 - RNA, 32 nt, Human
cagccucacaggaagugggggugaggagccug

SEQ ID NO: 86056 - RNA, 32 nt, Human
cagccucaccaaaguguugggauuacuggugu

SEQ ID NO: 86057 - RNA, 32 nt, Human
cagccucaccaacauggagaaaucccaucucu

SEQ ID NO: 86058 - RNA, 24 nt, Human
cagccucaccaccaggccaggagg

SEQ ID NO: 86059 - RNA, 24 nt, Human
cagccucaccaccaucccagagcu

SEQ ID NO: 86060 - RNA, 23 nt, Human
cagccucaccccucccaccccca

SEQ ID NO: 86061 - RNA, 17 nt, Human
cagccucaccugcacca

SEQ ID NO: 86062 - RNA, 22 nt, Human
cagccucaccuggggugggagg

SEQ ID NO: 86063 - RNA, 32 nt, Human
cagccucaccuugcuguccucugacacugcca

SEQ ID NO: 86064 - RNA, 32 nt, Human
cagccucacgucuuauuucucaccucguuccc

SEQ ID NO: 86065 - RNA, 32 nt, Human
cagccucacuccccaucccaaccagagauggc

SEQ ID NO: 86066 - RNA, 32 nt, Human
cagccucacugcaucuuucucuucccaugcaa

SEQ ID NO: 86067 - RNA, 32 nt, Human
cagccucagagacaucagcccuuggggguccu

SEQ ID NO: 86068 - RNA, 22 nt, Human
cagccucagagccuacccagga

SEQ ID NO: 86069 - RNA, 22 nt, Human
cagccucagagggccaaugggg

SEQ ID NO: 86070 - RNA, 19 nt, Human
cagccucagauggaggcag

SEQ ID NO: 86071 - RNA, 22 nt, Human
cagccucagcaauagagugaga

SEQ ID NO: 86072 - RNA, 19 nt, Human
cagccucagcccccugcuu

SEQ ID NO: 86073 - RNA, 20 nt, Human
cagccucagccucccaaagu

SEQ ID NO: 86074 - RNA, 23 nt, Human
cagccucagccucccaaguagcu

SEQ ID NO: 86075 - RNA, 23 nt, Human
cagccucagccucccagugugcu

SEQ ID NO: 86076 - RNA, 19 nt, Human
cagccucagccucccuagu

SEQ ID NO: 86077 - RNA, 18 nt, Human
cagccucaggacuaugga

SEQ ID NO: 86078 - RNA, 18 nt, Human
cagccucaggaucuucca

SEQ ID NO: 86079 - RNA, 32 nt, Human
cagccucaggcagaccggaugggaaccaggau

SEQ ID NO: 86080 - RNA, 32 nt, Human
cagccucaggcagccugucagggcaguggugu

SEQ ID NO: 86081 - RNA, 18 nt, Human
cagccucagggccuggcu

SEQ ID NO: 86082 - RNA, 32 nt, Human
cagccucauaagggcuggagugcuguggugcc

SEQ ID NO: 86083 - RNA, 32 nt, Human
cagccucauagcugccuucugcggccagcgac

SEQ ID NO: 86084 - RNA, 32 nt, Human
cagccucaucacagacaugaaacucacugccg

SEQ ID NO: 86085 - RNA, 32 nt, Human
cagccucaucauuucccaucuggaccugguac

SEQ ID NO: 86086 - RNA, 32 nt, Human
cagccucauccagacagcaaagcaaggaggga

SEQ ID NO: 86087 - RNA, 32 nt, Human
cagccucaucccuccagguacaaacaagaaca

SEQ ID NO: 86088 - RNA, 32 nt, Human
cagccucauccuccccaggaccccuguccagg

SEQ ID NO: 86089 - RNA, 19 nt, Human
cagccucaugauccuuuua

SEQ ID NO: 86090 - RNA, 18 nt, Human
cagccucauuccuucaca

SEQ ID NO: 86091 - RNA, 32 nt, Human
cagccuccaacuagcugggauuacaggcacaa

SEQ ID NO: 86092 - RNA, 22 nt, Human
cagccuccaacuccugggcuca

SEQ ID NO: 86093 - RNA, 22 nt, Human
cagccuccaacucuugggcuca

SEQ ID NO: 86094 - RNA, 32 nt, Human
cagccuccaaguagcugggacuacaggcgcgu

SEQ ID NO: 86095 - RNA, 32 nt, Human
cagccuccaaguagcugggacuauaggcacgc

SEQ ID NO: 86096 - RNA, 32 nt, Human
cagccuccaaguaucugggauugcaggugcac

SEQ ID NO: 86097 - RNA, 32 nt, Human
cagccuccaagucaccuggccugggaaaguac

SEQ ID NO: 86098 - RNA, 32 nt, Human
cagccuccacccccacuccagccucagcgggg

SEQ ID NO: 86099 - RNA, 22 nt, Human
cagccuccaccucccaguuuca

SEQ ID NO: 86100 - RNA, 22 nt, Human
cagccuccaccuccuggauuca

SEQ ID NO: 86101 - RNA, 21 nt, Human
cagccuccaccuucagguuca

SEQ ID NO: 86102 - RNA, 24 nt, Human
cagccuccacugggcagaaaacua

SEQ ID NO: 86103 - RNA, 32 nt, Human
cagccuccagaguacugggauuacaagagccc

SEQ ID NO: 86104 - RNA, 32 nt, Human
cagccuccagaguacugguauuacaggauuuc

SEQ ID NO: 86105 - RNA, 32 nt, Human
cagccuccagaucccuuccugcccaucccuuc

SEQ ID NO: 86106 - RNA, 32 nt, Human
cagccuccagccucucccuccagcacaaccug

SEQ ID NO: 86107 - RNA, 32 nt, Human
cagccuccaucucccggggcucaggugauuuu

SEQ ID NO: 86108 - RNA, 20 nt, Human
cagccuccaugccagaaaac

SEQ ID NO: 86109 - RNA, 32 nt, Human
cagccuccaugcugggucuggagggccccugc

SEQ ID NO: 86110 - RNA, 32 nt, Human
cagccuccaugggggauucaguccccagagca

SEQ ID NO: 86111 - RNA, 32 nt, Human
cagccuccauguccagaccuagucagccucuc

SEQ ID NO: 86112 - RNA, 32 nt, Human
cagccucccaaaagcugggauuacaggcguga

SEQ ID NO: 86113 - RNA, 26 nt, Human
cagccucccaaaaggacagagaacua

SEQ ID NO: 86114 - RNA, 32 nt, Human
cagccucccaaagugcuggauuacaggcguga

SEQ ID NO: 86115 - RNA, 32 nt, Human
cagccucccaaauuugcugggauuccaggguu

SEQ ID NO: 86116 - RNA, 32 nt, Human
cagccucccaagaagcuagaaccacauguaca

SEQ ID NO: 86117 - RNA, 32 nt, Human
cagccucccaagcaacugggauucauccuuuc

SEQ ID NO: 86118 - RNA, 32 nt, Human
cagccucccaaggugcuggauuacaggcauga

SEQ ID NO: 86119 - RNA, 32 nt, Human
cagccucccaaguacugggauuacagcuucca

SEQ ID NO: 86120 - RNA, 32 nt, Human
cagccucccaaguacugggauuacaggugccc

SEQ ID NO: 86121 - RNA, 32 nt, Human
cagccucccaaguagcuggauuacaggugcau

SEQ ID NO: 86122 - RNA, 32 nt, Human
cagccucccaagugcugggauuacaggcguga

SEQ ID NO: 86123 - RNA, 21 nt, Human
cagccucccacaggaucggga

SEQ ID NO: 86124 - RNA, 32 nt, Human
cagccucccaccuucagcccggcugugaacgu

SEQ ID NO: 86125 - RNA, 32 nt, Human
cagccucccagaagcucucuucugcuucaaaa

SEQ ID NO: 86126 - RNA, 23 nt, Human
cagccucccagaguagaaaacua

SEQ ID NO: 86127 - RNA, 32 nt, Human
cagccucccaggcuggauggcauggacuguuu

SEQ ID NO: 86128 - RNA, 32 nt, Human
cagccucccaggugcugggauuauaggcguga

SEQ ID NO: 86129 - RNA, 32 nt, Human
cagccucccaguagcugggauuagaggcaugu

SEQ ID NO: 86130 - RNA, 18 nt, Human
cagccuccccaccaccac

SEQ ID NO: 86131 - RNA, 32 nt, Human
cagccuccccaccaccaccagcauaugucaag

SEQ ID NO: 86132 - RNA, 32 nt, Human
cagccuccccagcucuccucugccagccaccc

SEQ ID NO: 86133 - RNA, 32 nt, Human
cagccuccccuccaggcagccucaccagcagc

SEQ ID NO: 86134 - RNA, 32 nt, Human
cagccuccccucccccagggccccacccagug

SEQ ID NO: 86135 - RNA, 32 nt, Human
cagccucccgaguagcugggauuacgggcgcc

SEQ ID NO: 86136 - RNA, 32 nt, Human
cagccucccggaccgcccugagcugcugcgcc

SEQ ID NO: 86137 - RNA, 32 nt, Human
cagccucccggcgcccccuccgggcccagcuc

SEQ ID NO: 86138 - RNA, 32 nt, Human
cagccucccuccccucuccacccuucagugcu

SEQ ID NO: 86139 - RNA, 32 nt, Human
cagccucccucggacacauggcugcuuggccu

SEQ ID NO: 86140 - RNA, 32 nt, Human
cagccucccucucccaccucugucugcccgcu

SEQ ID NO: 86141 - RNA, 21 nt, Human
cagccucccugacccuccaca

SEQ ID NO: 86142 - RNA, 21 nt, Human
cagccucccugguccucccca

SEQ ID NO: 86143 - RNA, 32 nt, Human
cagccucccuuccaugccccaggaucacucuc

SEQ ID NO: 86144 - RNA, 32 nt, Human
cagccuccgaaagcauccuuugcucucuuucc

SEQ ID NO: 86145 - RNA, 32 nt, Human
cagccuccgacagcccucccaccaagcaagag

SEQ ID NO: 86146 - RNA, 32 nt, Human
cagccuccgaccuccugaccucugcccuggcc

SEQ ID NO: 86147 - RNA, 32 nt, Human
cagccuccgaguagcugggaccacaggggccc

SEQ ID NO: 86148 - RNA, 32 nt, Human
cagccuccgaguagcugggacuacaggugcac

SEQ ID NO: 86149 - RNA, 32 nt, Human
cagccuccgagucgcugggauugcagauaagg

SEQ ID NO: 86150 - RNA, 22 nt, Human
cagccuccgccuccugggcuca

SEQ ID NO: 86151 - RNA, 22 nt, Human
cagccuccgcggacugggguca

SEQ ID NO: 86152 - RNA, 32 nt, Human
cagccuccggagaacugggauuacaggcaugc

SEQ ID NO: 86153 - RNA, 32 nt, Human
cagccuccuaaaugcugggauuacaggcguga

SEQ ID NO: 86154 - RNA, 32 nt, Human
cagccuccuaagggcugggauuacaggaauga

SEQ ID NO: 86155 - RNA, 32 nt, Human
cagccuccuaagugcugggauuacagacguga

SEQ ID NO: 86156 - RNA, 20 nt, Human
cagccuccuacucugggucc

SEQ ID NO: 86157 - RNA, 21 nt, Human
cagccuccuagcauaaaacua

SEQ ID NO: 86158 - RNA, 32 nt, Human
cagccuccuaucucuguauggccugguguuuc

SEQ ID NO: 86159 - RNA, 32 nt, Human
cagccuccuccaccauucccuucaucauucau

SEQ ID NO: 86160 - RNA, 32 nt, Human
cagccuccuccagggcccaggugggcggcuuc

SEQ ID NO: 86161 - RNA, 32 nt, Human
cagccuccuccagggcugcccaaggcaggguu

SEQ ID NO: 86162 - RNA, 19 nt, Human
cagccuccucccgggcuca

SEQ ID NO: 86163 - RNA, 23 nt, Human
cagccuccucccgggcucaggau

SEQ ID NO: 86164 - RNA, 32 nt, Human
cagccuccuccugggccagcucuugugcuaca

SEQ ID NO: 86165 - RNA, 18 nt, Human
cagccuccucucuccgca

SEQ ID NO: 86166 - RNA, 32 nt, Human
cagccuccucugaggcuccccugcugccuccc

SEQ ID NO: 86167 - RNA, 32 nt, Human
cagccuccugaaggcucagcacggugaggccu

SEQ ID NO: 86168 - RNA, 32 nt, Human
cagccuccugagagcugggacuacaggcgccu

SEQ ID NO: 86169 - RNA, 32 nt, Human
cagccuccugaguagcuggauuacaggcaugu

SEQ ID NO: 86170 - RNA, 32 nt, Human
cagccuccugaguagcuggauuacagggccug

SEQ ID NO: 86171 - RNA, 32 nt, Human
cagccuccugaguggggauuacaggccacagc

SEQ ID NO: 86172 - RNA, 22 nt, Human
cagccuccugccuuccuuuaua

SEQ ID NO: 86173 - RNA, 32 nt, Human
cagccuccugccuugcacuugcagccugaagc

SEQ ID NO: 86174 - RNA, 32 nt, Human
cagccuccugcuagagugacuuguacaugagc

SEQ ID NO: 86175 - RNA, 31 nt, Human
cagccuccuggauaauaugccaacacccuuc

SEQ ID NO: 86176 - RNA, 32 nt, Human
cagccuccugggaauccagucuacccucagac

SEQ ID NO: 86177 - RNA, 32 nt, Human
cagccuccugggggauacgguggagaagaucg

SEQ ID NO: 86178 - RNA, 21 nt, Human
cagccuccuggggggaccagg

SEQ ID NO: 86179 - RNA, 32 nt, Human
cagccuccugguagcugagacuacaggugcuc

SEQ ID NO: 86180 - RNA, 32 nt, Human
cagccuccugguagcugggacuacagcuuccu

SEQ ID NO: 86181 - RNA, 32 nt, Human
cagccuccugguagcuggggcuacagaacucu

SEQ ID NO: 86182 - RNA, 32 nt, Human
cagccuccuguaaucccagcuacuugggaggc

SEQ ID NO: 86183 - RNA, 32 nt, Human
cagccuccuguacucauuacuacuuuuagcau

SEQ ID NO: 86184 - RNA, 32 nt, Human
cagccuccuuaguagugggauuacaggugccc

SEQ ID NO: 86185 - RNA, 32 nt, Human
cagccuccuuagucuccucauccugcuucaca

SEQ ID NO: 86186 - RNA, 19 nt, Human
cagccuccuucaccaccaa

SEQ ID NO: 86187 - RNA, 32 nt, Human
cagccuccuugcagacuggugcucuguguucu

SEQ ID NO: 86188 - RNA, 32 nt, Human
cagccuccuugcugcccucugcucugugugcc

SEQ ID NO: 86189 - RNA, 18 nt, Human
cagccuccuugugggcuc

SEQ ID NO: 86190 - RNA, 32 nt, Human
cagccucgaacuccuggucucuugcgguccuc

SEQ ID NO: 86191 - RNA, 16 nt, Human
cagccucgaccuccca

SEQ ID NO: 86192 - RNA, 18 nt, Human
cagccucgaccuggucac

SEQ ID NO: 86193 - RNA, 21 nt, Human
cagccucgaggacacuagggg

SEQ ID NO: 86194 - RNA, 18 nt, Human
cagccucgaucuucccca

SEQ ID NO: 86195 - RNA, 32 nt, Human
cagccucgcaugccagagccuggggcauccca

SEQ ID NO: 86196 - RNA, 32 nt, Human
cagccucgccaacauggcgaaaccccaucucu

SEQ ID NO: 86197 - RNA, 32 nt, Human
cagccucgccaacauggugaaaccccaucucu

SEQ ID NO: 86198 - RNA, 17 nt, Human
cagccucgcccccuccc

SEQ ID NO: 86199 - RNA, 32 nt, Human
cagccucggacccagcccggagcgcagggcgg

SEQ ID NO: 86200 - RNA, 32 nt, Human
cagccucggacccccauccguauccagcagcg

SEQ ID NO: 86201 - RNA, 20 nt, Human
cagccucggagaccuucaca

SEQ ID NO: 86202 - RNA, 32 nt, Human
cagccucggagugguccagcugcccggccugu

SEQ ID NO: 86203 - RNA, 21 nt, Human
cagccucggccucccgaggug

SEQ ID NO: 86204 - RNA, 32 nt, Human
cagccucggcugagcagaugcacagaggggau

SEQ ID NO: 86205 - RNA, 32 nt, Human
cagccucgggcagcaacuccccaacccgcagu

SEQ ID NO: 86206 - RNA, 18 nt, Human
cagccucgguccuucuca

SEQ ID NO: 86207 - RNA, 22 nt, Human
cagccucggugacagagcaaga

SEQ ID NO: 86208 - RNA, 32 nt, Human
cagccucguuggagagcagcaggugcugugcg

SEQ ID NO: 86209 - RNA, 32 nt, Human
cagccucguuuccuccacccuacuuugauuuc

SEQ ID NO: 86210 - RNA, 20 nt, Human
cagccucuaauaccuucaca

SEQ ID NO: 86211 - RNA, 32 nt, Human
cagccucuacccucagcauccuggccacaagu

SEQ ID NO: 86212 - RNA, 32 nt, Human
cagccucuacuuguaagucagcuaaaggaaug

SEQ ID NO: 86213 - RNA, 32 nt, Human
cagccucuagagcagacuacagcuggggugca

SEQ ID NO: 86214 - RNA, 32 nt, Human
cagccucuagcuucaggcugggcacgguggcu

SEQ ID NO: 86215 - RNA, 32 nt, Human
cagccucuaggccaguucagcagccacaacau

SEQ ID NO: 86216 - RNA, 32 nt, Human
cagccucucaccccaggguccaugucccaggc

SEQ ID NO: 86217 - RNA, 26 nt, Human
cagccucucacucucaguuccacuca

SEQ ID NO: 86218 - RNA, 32 nt, Human
cagccucuccaaugccucagccacagagucac

SEQ ID NO: 86219 - RNA, 32 nt, Human
cagccucuccaccgucacuguccgcugcuggc

SEQ ID NO: 86220 - RNA, 32 nt, Human
cagccucuccaccuucugagccugcgcccaca

SEQ ID NO: 86221 - RNA, 32 nt, Human
cagccucucccccagucccugucuccgaggcc

SEQ ID NO: 86222 - RNA, 32 nt, Human
cagccucuccccugccugcccuggugacauca

SEQ ID NO: 86223 - RNA, 32 nt, Human
cagccucucgagugcugagauuacacacguga

SEQ ID NO: 86224 - RNA, 32 nt, Human
cagccucucgggagucaagggauccgccuuca

SEQ ID NO: 86225 - RNA, 21 nt, Human
cagccucucucuccuuccaua

SEQ ID NO: 86226 - RNA, 32 nt, Human
cagccucucucuucugucucagaagcucugug

SEQ ID NO: 86227 - RNA, 20 nt, Human
cagccucucucuuuucuaca

SEQ ID NO: 86228 - RNA, 32 nt, Human
cagccucucuggcaaggcuuucuugagccccg

SEQ ID NO: 86229 - RNA, 32 nt, Human
cagccucucugugcacuugcugucugcggagc

SEQ ID NO: 86230 - RNA, 22 nt, Human
cagccucucuuucuccuccaca

SEQ ID NO: 86231 - RNA, 32 nt, Human
cagccucugaaagacccaugcucucuuuggau

SEQ ID NO: 86232 - RNA, 32 nt, Human
cagccucugaaaucauagcucuccaguggcuu

SEQ ID NO: 86233 - RNA, 18 nt, Human
cagccucugacucaccac

SEQ ID NO: 86234 - RNA, 32 nt, Human
cagccucugagcuggcucacacgugccauccc

SEQ ID NO: 86235 - RNA, 32 nt, Human
cagccucugaguagcugggacuacaagugcau

SEQ ID NO: 86236 - RNA, 32 nt, Human
cagccucugaguagcugggauuacaggcacac

SEQ ID NO: 86237 - RNA, 32 nt, Human
cagccucugauuauugagcuuccucuuaaaaa

SEQ ID NO: 86238 - RNA, 32 nt, Human
cagccucugcagcccaaggcucaggccggggc

SEQ ID NO: 86239 - RNA, 20 nt, Human
cagccucugcagcugcacuu

SEQ ID NO: 86240 - RNA, 32 nt, Human
cagccucugcaggcccugcucuugccucccag

SEQ ID NO: 86241 - RNA, 32 nt, Human
cagccucugcaggcccugcucuugccucuuag

SEQ ID NO: 86242 - RNA, 32 nt, Human
cagccucugcagggccugcucuugccucccag

SEQ ID NO: 86243 - RNA, 32 nt, Human
cagccucugccacccuccaccuccucggucag

SEQ ID NO: 86244 - RNA, 32 nt, Human
cagccucugccggcuccccuaggcaaccccuu

SEQ ID NO: 86245 - RNA, 22 nt, Human
cagccucugccucccagguuca

SEQ ID NO: 86246 - RNA, 32 nt, Human
cagccucugccugcucugccgccgaggcccgg

SEQ ID NO: 86247 - RNA, 32 nt, Human
cagccucugccuggaaccuggcucgugcugug

SEQ ID NO: 86248 - RNA, 19 nt, Human
cagccucugccuuuccaca

SEQ ID NO: 86249 - RNA, 32 nt, Human
cagccucugcucauggcacugggccuccaguu

SEQ ID NO: 86250 - RNA, 32 nt, Human
cagccucugcugcaggugaggguugggggcag

SEQ ID NO: 86251 - RNA, 19 nt, Human
cagccucugcugccucugg

SEQ ID NO: 86252 - RNA, 30 nt, Human
cagccucugcugcuccugcuccuggguuug

SEQ ID NO: 86253 - RNA, 32 nt, Human
cagccucugcugcuccugcuccuggguuugaa

SEQ ID NO: 86254 - RNA, 32 nt, Human
cagccucuggaaggaaaggcagcgcugacuuc

SEQ ID NO: 86255 - RNA, 20 nt, Human
cagccucuggauucucuuca

SEQ ID NO: 86256 - RNA, 32 nt, Human
cagccucuggggcacccagcuccugggcuuug

SEQ ID NO: 86257 - RNA, 32 nt, Human
cagccucuggggccuuggcacacacacauucg

SEQ ID NO: 86258 - RNA, 32 nt, Human
cagccucuggucagaggauguggccaccugac

SEQ ID NO: 86259 - RNA, 25 nt, Human
cagccucugucauaaugcucugccc

SEQ ID NO: 86260 - RNA, 32 nt, Human
cagccucuguccccuccaccucugaggagcgu

SEQ ID NO: 86261 - RNA, 32 nt, Human
cagccucugugacuccguuaucugcagguauu

SEQ ID NO: 86262 - RNA, 32 nt, Human
cagccucuguuagcugggugggugucaucagc

SEQ ID NO: 86263 - RNA, 32 nt, Human
cagccucuucagacugugcaucuuuucagcag

SEQ ID NO: 86264 - RNA, 16 nt, Human
cagccucuucuccaca

SEQ ID NO: 86265 - RNA, 21 nt, Human
cagccucuucuggcagaaagc

SEQ ID NO: 86266 - RNA, 32 nt, Human
cagccucuucuggguucacugcaguccaaccg

SEQ ID NO: 86267 - RNA, 32 nt, Human
cagccucuucuuuguggagccucucagugugg

SEQ ID NO: 86268 - RNA, 20 nt, Human
cagccucuugauucuuugua

SEQ ID NO: 86269 - RNA, 32 nt, Human
cagccucuuggcuucuaauuuguuuaucuuuu

SEQ ID NO: 86270 - RNA, 20 nt, Human
cagccucuugguccccccac

SEQ ID NO: 86271 - RNA, 32 nt, Human
cagccucuuuacaaccuccuggauccacagcc

SEQ ID NO: 86272 - RNA, 32 nt, Human
cagccucuuuaccaccuccccacuuacacugc

SEQ ID NO: 86273 - RNA, 32 nt, Human
cagccucuuuagcugggauuacaggcacccac

SEQ ID NO: 86274 - RNA, 32 nt, Human
cagccucuuuguuugaaagcaguggauaggca

SEQ ID NO: 86275 - RNA, 32 nt, Human
cagccucuuuugccccucuucuugccuuucac

SEQ ID NO: 86276 - RNA, 23 nt, Human
cagccugaaauuaccuuuauuca

SEQ ID NO: 86277 - RNA, 32 nt, Human
cagccugaacaacauggugaaacccugucugu

SEQ ID NO: 86278 - RNA, 17 nt, Human
cagccugaaccuccgca

SEQ ID NO: 86279 - RNA, 32 nt, Human
cagccugaagaaaagaggccacugugacuaca

SEQ ID NO: 86280 - RNA, 32 nt, Human
cagccugaagagaccagugagcucacugugac

SEQ ID NO: 86281 - RNA, 32 nt, Human
cagccugaagagcgagacucugucucaauaau

SEQ ID NO: 86282 - RNA, 32 nt, Human
cagccugaaggaugagaugggcaaccucagga

SEQ ID NO: 86283 - RNA, 23 nt, Human
cagccugaagucgugaucugccc

SEQ ID NO: 86284 - RNA, 32 nt, Human
cagccugaauacugugcccucuugcuuugggg

SEQ ID NO: 86285 - RNA, 32 nt, Human
cagccugacaaacauggagaaaccccaucucu

SEQ ID NO: 86286 - RNA, 32 nt, Human
cagccugacauggugaaaccccaucucuacga

SEQ ID NO: 86287 - RNA, 32 nt, Human
cagccugaccaaaauggagaaaccccaucucu

SEQ ID NO: 86288 - RNA, 32 nt, Human
cagccugaccaaaauggugaaaccccgucucu

SEQ ID NO: 86289 - RNA, 32 nt, Human
cagccugaccaacacggagaaaccccgucucu

SEQ ID NO: 86290 - RNA, 32 nt, Human
cagccugaccaacacggagaaacccuaucucu

SEQ ID NO: 86291 - RNA, 32 nt, Human
cagccugaccaacacggugaaaccccgucucu

SEQ ID NO: 86292 - RNA, 32 nt, Human
cagccugaccaacacugagaaaccccaucucu

SEQ ID NO: 86293 - RNA, 32 nt, Human
cagccugaccaacauagagaaaccucgucucu

SEQ ID NO: 86294 - RNA, 32 nt, Human
cagccugaccaacauagugaaaccccaucucu

SEQ ID NO: 86295 - RNA, 32 nt, Human
cagccugaccaacauagugaaacccccgucuc

SEQ ID NO: 86296 - RNA, 32 nt, Human
cagccugaccaacauaguuucaccccaucucu

SEQ ID NO: 86297 - RNA, 32 nt, Human
cagccugaccaacaugaagaaaccccaucucu

SEQ ID NO: 86298 - RNA, 32 nt, Human
cagccugaccaacaugaagaaacccugucugu

SEQ ID NO: 86299 - RNA, 32 nt, Human
cagccugaccaacaugacaaaaccccgucucu

SEQ ID NO: 86300 - RNA, 32 nt, Human
cagccugaccaacaugacgaaaccccgucucu

SEQ ID NO: 86301 - RNA, 32 nt, Human
cagccugaccaacaugaugaaacccccgucuc

SEQ ID NO: 86302 - RNA, 32 nt, Human
cagccugaccaacaugaugaaaccccguugcu

SEQ ID NO: 86303 - RNA, 32 nt, Human
cagccugaccaacaugaugaaaugccaucucc

SEQ ID NO: 86304 - RNA, 32 nt, Human
cagccugaccaacauggaaaaaccccgucucu

SEQ ID NO: 86305 - RNA, 32 nt, Human
cagccugaccaacauggacaaaccccgucucu

SEQ ID NO: 86306 - RNA, 32 nt, Human
cagccugaccaacauggagaaacccaaucucu

SEQ ID NO: 86307 - RNA, 32 nt, Human
cagccugaccaacauggagaaacccagucucu

SEQ ID NO: 86308 - RNA, 32 nt, Human
cagccugaccaacauggagaaaccccaauugu

SEQ ID NO: 86309 - RNA, 32 nt, Human
cagccugaccaacauggagaaaccccaucucc

SEQ ID NO: 86310 - RNA, 32 nt, Human
cagccugaccaacauggagaaaccccaucucu

SEQ ID NO: 86311 - RNA, 32 nt, Human
cagccugaccaacauggagaaaccccaucugu

SEQ ID NO: 86312 - RNA, 32 nt, Human
cagccugaccaacauggagaaaccccauuucu

SEQ ID NO: 86313 - RNA, 32 nt, Human
cagccugaccaacauggagaaacccccaucuc

SEQ ID NO: 86314 - RNA, 32 nt, Human
cagccugaccaacauggagaaaccccgucccu

SEQ ID NO: 86315 - RNA, 32 nt, Human
cagccugaccaacauggagaaaccccgucucu

SEQ ID NO: 86316 - RNA, 32 nt, Human
cagccugaccaacauggagaaaccccgugucu

SEQ ID NO: 86317 - RNA, 32 nt, Human
cagccugaccaacauggagaaaccccugucuc

SEQ ID NO: 86318 - RNA, 32 nt, Human
cagccugaccaacauggagaaacccuacuaaa

SEQ ID NO: 86319 - RNA, 32 nt, Human
cagccugaccaacauggagaaacccuaucucu

SEQ ID NO: 86320 - RNA, 32 nt, Human
cagccugaccaacauggagaaacccugccucu

SEQ ID NO: 86321 - RNA, 32 nt, Human
cagccugaccaacauggagaaacccugucuca

SEQ ID NO: 86322 - RNA, 32 nt, Human
cagccugaccaacauggagaaacccugucucc

SEQ ID NO: 86323 - RNA, 32 nt, Human
cagccugaccaacauggagaaacccugucucu

SEQ ID NO: 86324 - RNA, 32 nt, Human
cagccugaccaacauggagaaaccucgucucu

SEQ ID NO: 86325 - RNA, 32 nt, Human
cagccugaccaacauggagaaacgccaucucu

SEQ ID NO: 86326 - RNA, 32 nt, Human
cagccugaccaacauggagaaacuccaucucu

SEQ ID NO: 86327 - RNA, 32 nt, Human
cagccugaccaacauggagaaacuccgucucu

SEQ ID NO: 86328 - RNA, 32 nt, Human
cagccugaccaacauggagaaaugccaucucu

SEQ ID NO: 86329 - RNA, 32 nt, Human
cagccugaccaacauggagaagccccgucucu

SEQ ID NO: 86330 - RNA, 32 nt, Human
cagccugaccaacauggagauauccugucucu

SEQ ID NO: 86331 - RNA, 32 nt, Human
cagccugaccaacauggauaaaucccaucucu

SEQ ID NO: 86332 - RNA, 32 nt, Human
cagccugaccaacauggauuaacccugucucu

SEQ ID NO: 86333 - RNA, 32 nt, Human
cagccugaccaacauggcaaaaccccgucugu

SEQ ID NO: 86334 - RNA, 32 nt, Human
cagccugaccaacauggcaaaacccugucucu

SEQ ID NO: 86335 - RNA, 32 nt, Human
cagccugaccaacauggcgaaaccccaucucu

SEQ ID NO: 86336 - RNA, 32 nt, Human
cagccugaccaacauggcgaaaccccauuucu

SEQ ID NO: 86337 - RNA, 32 nt, Human
cagccugaccaacauggcgaaaccccgucucu

SEQ ID NO: 86338 - RNA, 32 nt, Human
cagccugaccaacauggggauaccccgucucu

SEQ ID NO: 86339 - RNA, 32 nt, Human
cagccugaccaacaugguaaaaccacaucucu

SEQ ID NO: 86340 - RNA, 32 nt, Human
cagccugaccaacauggugaaaaccccaucuc

SEQ ID NO: 86341 - RNA, 32 nt, Human
cagccugaccaacauggugaaacaccaucucu

SEQ ID NO: 86342 - RNA, 32 nt, Human
cagccugaccaacauggugaaacacugucucu

SEQ ID NO: 86343 - RNA, 32 nt, Human
cagccugaccaacauggugaaaccccaucucu

SEQ ID NO: 86344 - RNA, 32 nt, Human
cagccugaccaacauggugaaaccccaucugu

SEQ ID NO: 86345 - RNA, 32 nt, Human
cagccugaccaacauggugaaaccccauuucu

SEQ ID NO: 86346 - RNA, 32 nt, Human
cagccugaccaacauggugaaaccccgucucu

SEQ ID NO: 86347 - RNA, 32 nt, Human
cagccugaccaacauggugaaaccccgucuuu

SEQ ID NO: 86348 - RNA, 32 nt, Human
cagccugaccaacauggugaaaccccgugucu

SEQ ID NO: 86349 - RNA, 32 nt, Human
cagccugaccaacauggugaaaccccguuucu

SEQ ID NO: 86350 - RNA, 32 nt, Human
cagccugaccaacauggugaaaccccuucucu

SEQ ID NO: 86351 - RNA, 32 nt, Human
cagccugaccaacauggugaaacccuacuaaa

SEQ ID NO: 86352 - RNA, 32 nt, Human
cagccugaccaacauggugaaacccugucucu

SEQ ID NO: 86353 - RNA, 32 nt, Human
cagccugaccaacauggugaaacccuguuucu

SEQ ID NO: 86354 - RNA, 32 nt, Human
cagccugaccaacauggugaaaccucaacucu

SEQ ID NO: 86355 - RNA, 32 nt, Human
cagccugaccaacauggugaaaccucaucucu

SEQ ID NO: 86356 - RNA, 32 nt, Human
cagccugaccaacauggugaaaccucgucucu

SEQ ID NO: 86357 - RNA, 32 nt, Human
cagccugaccaacauggugaaacgccaucucu

SEQ ID NO: 86358 - RNA, 32 nt, Human
cagccugaccaacauggugaaacuccaucucu

SEQ ID NO: 86359 - RNA, 32 nt, Human
cagccugaccaacauggugaaagcccguuucu

SEQ ID NO: 86360 - RNA, 32 nt, Human
cagccugaccaacauggugaaauauacaaaaa

SEQ ID NO: 86361 - RNA, 32 nt, Human
cagccugaccaacauggugaaauccagucucu

SEQ ID NO: 86362 - RNA, 32 nt, Human
cagccugaccaacauggugaaaucccgucucu

SEQ ID NO: 86363 - RNA, 32 nt, Human
cagccugaccaacauggugaaauccugucucu

SEQ ID NO: 86364 - RNA, 32 nt, Human
cagccugaccaacauggugaaaugaaacccca

SEQ ID NO: 86365 - RNA, 32 nt, Human
cagccugaccaacauggugagacccugucucu

SEQ ID NO: 86366 - RNA, 32 nt, Human
cagccugaccaacaugucgaaaucccgucucu

SEQ ID NO: 86367 - RNA, 32 nt, Human
cagccugaccaaccuggagaaaccccgucucu

SEQ ID NO: 86368 - RNA, 32 nt, Human
cagccugaccaacguggagaaacacuaucucu

SEQ ID NO: 86369 - RNA, 32 nt, Human
cagccugaccaacguggagaaaccccaucucu

SEQ ID NO: 86370 - RNA, 32 nt, Human
cagccugaccaacguggagaaaccccgucucu

SEQ ID NO: 86371 - RNA, 32 nt, Human
cagccugaccaacguggagaaaccucgucucu

SEQ ID NO: 86372 - RNA, 32 nt, Human
cagccugaccaacguggagaaacuccgucucc

SEQ ID NO: 86373 - RNA, 32 nt, Human
cagccugaccaacguggagaaaugccaucucu

SEQ ID NO: 86374 - RNA, 32 nt, Human
cagccugaccaacguggcgaaaccucgucucu

SEQ ID NO: 86375 - RNA, 32 nt, Human
cagccugaccaacguggugaaaccccaucucu

SEQ ID NO: 86376 - RNA, 32 nt, Human
cagccugaccaacguggugaaaccccgucucu

SEQ ID NO: 86377 - RNA, 32 nt, Human
cagccugaccaacguggugaaacccugucucu

SEQ ID NO: 86378 - RNA, 32 nt, Human
cagccugaccaacguggugaaacuccgucucu

SEQ ID NO: 86379 - RNA, 32 nt, Human
cagccugaccaagguggugaaaccccaucucu

SEQ ID NO: 86380 - RNA, 32 nt, Human
cagccugaccaauaugaugaaaccccgucucu

SEQ ID NO: 86381 - RNA, 32 nt, Human
cagccugaccaauauggagaaaucucgccuuu

SEQ ID NO: 86382 - RNA, 32 nt, Human
cagccugaccaauauggugaaaccccaucucu

SEQ ID NO: 86383 - RNA, 32 nt, Human
cagccugaccaauauggugaaaccccgucucu

SEQ ID NO: 86384 - RNA, 32 nt, Human
cagccugaccaauauggugaaaccccuucucu

SEQ ID NO: 86385 - RNA, 32 nt, Human
cagccugaccaccauggagaaaccccgucucu

SEQ ID NO: 86386 - RNA, 32 nt, Human
cagccugaccagcguggagaaacucugucucu

SEQ ID NO: 86387 - RNA, 32 nt, Human
cagccugacccacauggagaaacgccaucucu

SEQ ID NO: 86388 - RNA, 32 nt, Human
cagccugaccgacauggagaaaccccaucucu

SEQ ID NO: 86389 - RNA, 32 nt, Human
cagccugaccgacauggagaaaccucgucucu

SEQ ID NO: 86390 - RNA, 32 nt, Human
cagccugacgaacauggugaaaccccaccugu

SEQ ID NO: 86391 - RNA, 20 nt, Human
cagccugacgacaaagcgag

SEQ ID NO: 86392 - RNA, 32 nt, Human
cagccugacuaacacagugaaaccccgacucu

SEQ ID NO: 86393 - RNA, 32 nt, Human
cagccugacuaacauggagaaacccugucucu

SEQ ID NO: 86394 - RNA, 32 nt, Human
cagccugacuccugccuguagcuccugugucc

SEQ ID NO: 86395 - RNA, 17 nt, Human
cagccugacucuccaca

SEQ ID NO: 86396 - RNA, 32 nt, Human
cagccugacucuucccuuccccucucucauuc

SEQ ID NO: 86397 - RNA, 31 nt, Human
cagccugacugucucccuuucucuaccagac

SEQ ID NO: 86398 - RNA, 32 nt, Human
cagccugagaaccucaaggaggaccuggucua

SEQ ID NO: 86399 - RNA, 21 nt, Human
cagccugagcaacaaaagcaa

SEQ ID NO: 86400 - RNA, 21 nt, Human
cagccugagcaacaaagcaag

SEQ ID NO: 86401 - RNA, 21 nt, Human
cagccugagcaacaagagcga

SEQ ID NO: 86402 - RNA, 20 nt, Human
cagccugagcaacagagcaa

SEQ ID NO: 86403 - RNA, 21 nt, Human
cagccugagcaacagagcaag

SEQ ID NO: 86404 - RNA, 21 nt, Human
cagccugagcaacagagccgg

SEQ ID NO: 86405 - RNA, 21 nt, Human
cagccugagcaacagagcgag

SEQ ID NO: 86406 - RNA, 20 nt, Human
cagccugagcaacagaguga

SEQ ID NO: 86407 - RNA, 21 nt, Human
cagccugagcaacagagugag

SEQ ID NO: 86408 - RNA, 22 nt, Human
cagccugagcaacagagugaga

SEQ ID NO: 86409 - RNA, 20 nt, Human
cagccugagcaacauagcaa

SEQ ID NO: 86410 - RNA, 32 nt, Human
cagccugagcaacauaucaaaaccccaucucu

SEQ ID NO: 86411 - RNA, 32 nt, Human
cagccugagcaacauggcgaaaccccgucucu

SEQ ID NO: 86412 - RNA, 32 nt, Human
cagccugagcaacauggcgaaaccucauaucu

SEQ ID NO: 86413 - RNA, 32 nt, Human
cagccugagcaacaugguaaaaccccaucucu

SEQ ID NO: 86414 - RNA, 32 nt, Human
cagccugagcaacauggugaaacccugucucu

SEQ ID NO: 86415 - RNA, 19 nt, Human
cagccugagcaauggcagg

SEQ ID NO: 86416 - RNA, 32 nt, Human
cagccugagcaauguggugaaaccccaucucu

SEQ ID NO: 86417 - RNA, 32 nt, Human
cagccugagcaugagaggaagaggucagccuc

SEQ ID NO: 86418 - RNA, 32 nt, Human
cagccugagccagucccagcugugcuuggagu

SEQ ID NO: 86419 - RNA, 32 nt, Human
cagccugagccccagcccacaugccacucagg

SEQ ID NO: 86420 - RNA, 19 nt, Human
cagccugagccucuucgca

SEQ ID NO: 86421 - RNA, 32 nt, Human
cagccugagccuggcccagccucggcugccag

SEQ ID NO: 86422 - RNA, 21 nt, Human
cagccugagcgacagagcaag

SEQ ID NO: 86423 - RNA, 21 nt, Human
cagccugagcgacagaguaag

SEQ ID NO: 86424 - RNA, 22 nt, Human
cagccugagcgacagagugaga

SEQ ID NO: 86425 - RNA, 21 nt, Human
cagccugagcggcugugcuca

SEQ ID NO: 86426 - RNA, 21 nt, Human
cagccugagcuacagagcaag

SEQ ID NO: 86427 - RNA, 32 nt, Human
cagccugagcuugcugcccuccaguagagaca

SEQ ID NO: 86428 - RNA, 19 nt, Human
cagccugaggaggccgggg

SEQ ID NO: 86429 - RNA, 20 nt, Human
cagccugaggucuccuucgc

SEQ ID NO: 86430 - RNA, 32 nt, Human
cagccugagguguguccugggcuccucagagc

SEQ ID NO: 86431 - RNA, 32 nt, Human
cagccugaguagcugggacuacaggugugugc

SEQ ID NO: 86432 - RNA, 32 nt, Human
cagccugaguagcugggaugggacuacagaug

SEQ ID NO: 86433 - RNA, 22 nt, Human
cagccugagugacagaacaagg

SEQ ID NO: 86434 - RNA, 22 nt, Human
cagccugagugacagaaugaga

SEQ ID NO: 86435 - RNA, 21 nt, Human
cagccugagugacagagcgag

SEQ ID NO: 86436 - RNA, 22 nt, Human
cagccugagugacagagcgaga

SEQ ID NO: 86437 - RNA, 22 nt, Human
cagccugagugacagagugaga

SEQ ID NO: 86438 - RNA, 22 nt, Human
cagccugagugauagagugaga

SEQ ID NO: 86439 - RNA, 32 nt, Human
cagccugagugcaaccugacucucugcaucug

SEQ ID NO: 86440 - RNA, 32 nt, Human
cagccugauaagaggagacuugagagcuugcu

SEQ ID NO: 86441 - RNA, 32 nt, Human
cagccugaucaacauggugaaaccccgucucu

SEQ ID NO: 86442 - RNA, 32 nt, Human
cagccugaucaacauggugaaaccccgucuuu

SEQ ID NO: 86443 - RNA, 32 nt, Human
cagccugaucggcauggugaaaccccguuucu

SEQ ID NO: 86444 - RNA, 32 nt, Human
cagccugaucugcaccugcuccagggagagag

SEQ ID NO: 86445 - RNA, 32 nt, Human
cagccugaugaacauggagaaaccccgucucu

SEQ ID NO: 86446 - RNA, 20 nt, Human
cagccugaugacagagcaag

SEQ ID NO: 86447 - RNA, 32 nt, Human
cagccugcacacaccugccugcagagcaggaa

SEQ ID NO: 86448 - RNA, 32 nt, Human
cagccugcacaguagagugaggcugccucucc

SEQ ID NO: 86449 - RNA, 32 nt, Human
cagccugcacccucuucucuucuggcuucccu

SEQ ID NO: 86450 - RNA, 32 nt, Human
cagccugcagagccacagucagccugcccaca

SEQ ID NO: 86451 - RNA, 32 nt, Human
cagccugcagaggauacagcuuuccauguggc

SEQ ID NO: 86452 - RNA, 32 nt, Human
cagccugcagcacaccccacagccaaguagag

SEQ ID NO: 86453 - RNA, 32 nt, Human
cagccugcagcagaggagggcacggcagcaga

SEQ ID NO: 86454 - RNA, 32 nt, Human
cagccugcaggcuggggacccugggugcaggu

SEQ ID NO: 86455 - RNA, 32 nt, Human
cagccugcaguaccucuaccuccaggagaaca

SEQ ID NO: 86456 - RNA, 32 nt, Human
cagccugcagugagcggugacgccgccuggcu

SEQ ID NO: 86457 - RNA, 24 nt, Human
cagccugcauagccucuguccuca

SEQ ID NO: 86458 - RNA, 32 nt, Human
cagccugcaucccuucgccugcagccuacuuu

SEQ ID NO: 86459 - RNA, 32 nt, Human
cagccugccaaguagcuggauuacaggcacgu

SEQ ID NO: 86460 - RNA, 32 nt, Human
cagccugccacuucuggcauuuccuguaaguc

SEQ ID NO: 86461 - RNA, 32 nt, Human
cagccugccagacccucuuacagacaagguua

SEQ ID NO: 86462 - RNA, 32 nt, Human
cagccugccagcucuggcuggucagagacaag

SEQ ID NO: 86463 - RNA, 17 nt, Human
cagccugccaggccagg

SEQ ID NO: 86464 - RNA, 32 nt, Human
cagccugccagucugucauugucagggaccag

SEQ ID NO: 86465 - RNA, 32 nt, Human
cagccugcccaacauggugaaaccccaucugg

SEQ ID NO: 86466 - RNA, 32 nt, Human
cagccugcccaacauggugaaacccugucucu

SEQ ID NO: 86467 - RNA, 32 nt, Human
cagccugcccaacauggugaaaccucgucucu

SEQ ID NO: 86468 - RNA, 32 nt, Human
cagccugcccacuacauccagccuguggcuuu

SEQ ID NO: 86469 - RNA, 32 nt, Human
cagccugccccaauucccccagccccugcucc

SEQ ID NO: 86470 - RNA, 32 nt, Human
cagccugccccugagccuucugcuccaaggaa

SEQ ID NO: 86471 - RNA, 23 nt, Human
cagccugcccgcgccucccgccc

SEQ ID NO: 86472 - RNA, 22 nt, Human
cagccugcccucaagccaagga

SEQ ID NO: 86473 - RNA, 32 nt, Human
cagccugcccuucacaauuccccuugugcaca

SEQ ID NO: 86474 - RNA, 19 nt, Human
cagccugcccuucauccuc

SEQ ID NO: 86475 - RNA, 32 nt, Human
cagccugcccuugccagugccugggccgcugg

SEQ ID NO: 86476 - RNA, 32 nt, Human
cagccugcccuuggggagaugagggagcccug

SEQ ID NO: 86477 - RNA, 25 nt, Human
cagccugccgcccagcaugcaggug

SEQ ID NO: 86478 - RNA, 32 nt, Human
cagccugccgcccagcaugcagguggccucgc

SEQ ID NO: 86479 - RNA, 32 nt, Human
cagccugccgcugccagcaaccucccacugcu

SEQ ID NO: 86480 - RNA, 19 nt, Human
cagccugccggccaggcga

SEQ ID NO: 86481 - RNA, 19 nt, Human
cagccugccucaccaggga

SEQ ID NO: 86482 - RNA, 21 nt, Human
cagccugccucccuccugccc

SEQ ID NO: 86483 - RNA, 24 nt, Human
cagccugccuccuggccucaggau

SEQ ID NO: 86484 - RNA, 32 nt, Human
cagccugccugaggcuucucuccuggggcagg

SEQ ID NO: 86485 - RNA, 32 nt, Human
cagccugccugccugccugccugcccgcccag

SEQ ID NO: 86486 - RNA, 18 nt, Human
cagccugccuggcaggcu

SEQ ID NO: 86487 - RNA, 20 nt, Human
cagccugccugggccagccu

SEQ ID NO: 86488 - RNA, 21 nt, Human
cagccugccuguucccccgca

SEQ ID NO: 86489 - RNA, 21 nt, Human
cagccugcgcaacagagcgag

SEQ ID NO: 86490 - RNA, 21 nt, Human
cagccugcgcgcgccgcgccc

SEQ ID NO: 86491 - RNA, 32 nt, Human
cagccugcggaggcggggacuugggugucggc

SEQ ID NO: 86492 - RNA, 17 nt, Human
cagccugcggccagggg

SEQ ID NO: 86493 - RNA, 22 nt, Human
cagccugcgggacagagugaga

SEQ ID NO: 86494 - RNA, 32 nt, Human
cagccugcuaggggcugaauucugacucagcc

SEQ ID NO: 86495 - RNA, 32 nt, Human
cagccugcucagaauuuguuagcaauaauuaa

SEQ ID NO: 86496 - RNA, 21 nt, Human
cagccugcucccccauccaca

SEQ ID NO: 86497 - RNA, 32 nt, Human
cagccugcugugcccacacacacccacuaagg

SEQ ID NO: 86498 - RNA, 32 nt, Human
cagccugcuguuaacaacacaggccaguauug

SEQ ID NO: 86499 - RNA, 32 nt, Human
cagccugcuucuuccccucugcggcuuucacu

SEQ ID NO: 86500 - RNA, 32 nt, Human
cagccugcuugugugggcucuggccuggccug

SEQ ID NO: 86501 - RNA, 22 nt, Human
cagccuggaaaacggagugaga

SEQ ID NO: 86502 - RNA, 32 nt, Human
cagccuggaaagcagaaaacucucaugauuuc

SEQ ID NO: 86503 - RNA, 24 nt, Human
cagccuggaagaccgugccugccc

SEQ ID NO: 86504 - RNA, 32 nt, Human
cagccuggaagccacagccauggcaggccccc

SEQ ID NO: 86505 - RNA, 32 nt, Human
cagccuggaagccacaggcauccggccuugcc

SEQ ID NO: 86506 - RNA, 32 nt, Human
cagccuggaaggagagggugagugggggaugg

SEQ ID NO: 86507 - RNA, 32 nt, Human
cagccuggaaucgggaggaggggccggcaccc

SEQ ID NO: 86508 - RNA, 22 nt, Human
cagccuggacaacaagagcaag

SEQ ID NO: 86509 - RNA, 21 nt, Human
cagccuggacaacagagcaag

SEQ ID NO: 86510 - RNA, 21 nt, Human
cagccuggacaacagagcgag

SEQ ID NO: 86511 - RNA, 22 nt, Human
cagccuggacaacagagcgaga

SEQ ID NO: 86512 - RNA, 21 nt, Human
cagccuggacaacagagcuag

SEQ ID NO: 86513 - RNA, 22 nt, Human
cagccuggacaacagagggaga

SEQ ID NO: 86514 - RNA, 22 nt, Human
cagccuggacaacagagugaga

SEQ ID NO: 86515 - RNA, 22 nt, Human
cagccuggacaacagaguggga

SEQ ID NO: 86516 - RNA, 32 nt, Human
cagccuggacaacauggugaaaccccaucucu

SEQ ID NO: 86517 - RNA, 32 nt, Human
cagccuggacaacauggugaaaccccgucucu

SEQ ID NO: 86518 - RNA, 32 nt, Human
cagccuggacaacauggugaaaccccuucucu

SEQ ID NO: 86519 - RNA, 32 nt, Human
cagccuggacaacauggugaaacccuaucucu

SEQ ID NO: 86520 - RNA, 22 nt, Human
cagccuggacaacggagugaga

SEQ ID NO: 86521 - RNA, 32 nt, Human
cagccuggacaaucuggcgaaaccccauuucc

SEQ ID NO: 86522 - RNA, 32 nt, Human
cagccuggacagcccucuaaacucccuuacag

SEQ ID NO: 86523 - RNA, 32 nt, Human
cagccuggaccugccaagcugccugugcacug

SEQ ID NO: 86524 - RNA, 32 nt, Human
cagccuggaccuggcccggguuguggagggga

SEQ ID NO: 86525 - RNA, 21 nt, Human
cagccuggacgacagagcaag

SEQ ID NO: 86526 - RNA, 22 nt, Human
cagccuggacgacagagcaaga

SEQ ID NO: 86527 - RNA, 22 nt, Human
cagccuggacgacagagugaga

SEQ ID NO: 86528 - RNA, 22 nt, Human
cagccuggacgacugagugaga

SEQ ID NO: 86529 - RNA, 32 nt, Human
cagccuggacggccauggcaggaagcuuuuag

SEQ ID NO: 86530 - RNA, 32 nt, Human
cagccuggagaugucagcgcucuggggccuac

SEQ ID NO: 86531 - RNA, 23 nt, Human
cagccuggagcccuggcccagcc

SEQ ID NO: 86532 - RNA, 22 nt, Human
cagccuggaggccagagugaga

SEQ ID NO: 86533 - RNA, 32 nt, Human
cagccuggaguuuccggcugugccugcagcug

SEQ ID NO: 86534 - RNA, 21 nt, Human
cagccuggauaacagagcgag

SEQ ID NO: 86535 - RNA, 22 nt, Human
cagccuggauaacagagcgaga

SEQ ID NO: 86536 - RNA, 22 nt, Human
cagccuggauaauagagugaga

SEQ ID NO: 86537 - RNA, 22 nt, Human
cagccuggauccugcuuucaca

SEQ ID NO: 86538 - RNA, 23 nt, Human
cagccuggaugaaaucaucccca

SEQ ID NO: 86539 - RNA, 21 nt, Human
cagccuggaugacaagcaaga

SEQ ID NO: 86540 - RNA, 22 nt, Human
cagccuggaugacagagcgaga

SEQ ID NO: 86541 - RNA, 20 nt, Human
cagccuggaugacagaguga

SEQ ID NO: 86542 - RNA, 22 nt, Human
cagccuggaugacagagugaga

SEQ ID NO: 86543 - RNA, 32 nt, Human
cagccuggauggacaggagagguuucucuuuu

SEQ ID NO: 86544 - RNA, 22 nt, Human
cagccuggauggccaucccaca

SEQ ID NO: 86545 - RNA, 32 nt, Human
cagccuggcaaacauggcgaaaccccaucuua

SEQ ID NO: 86546 - RNA, 32 nt, Human
cagccuggcaaacauggugaaaccccgucugu

SEQ ID NO: 86547 - RNA, 20 nt, Human
cagccuggcaacagagcaag

SEQ ID NO: 86548 - RNA, 21 nt, Human
cagccuggcaacagagcaagg

SEQ ID NO: 86549 - RNA, 20 nt, Human
cagccuggcaacagagcgag

SEQ ID NO: 86550 - RNA, 21 nt, Human
cagccuggcaacagagcgaga

SEQ ID NO: 86551 - RNA, 21 nt, Human
cagccuggcaacagagugaga

SEQ ID NO: 86552 - RNA, 23 nt, Human
cagccuggcacaggcuacagggg

SEQ ID NO: 86553 - RNA, 20 nt, Human
cagccuggcaccaggagcag

SEQ ID NO: 86554 - RNA, 32 nt, Human
cagccuggcagccucuggacagagaggaagga

SEQ ID NO: 86555 - RNA, 32 nt, Human
cagccuggcaggagugggaagcaacacgcagg

SEQ ID NO: 86556 - RNA, 18 nt, Human
cagccuggcagguggccu

SEQ ID NO: 86557 - RNA, 32 nt, Human
cagccuggccaacaaggugaaaccccaucucu

SEQ ID NO: 86558 - RNA, 32 nt, Human
cagccuggccaacaaggugaaaccccgucucu

SEQ ID NO: 86559 - RNA, 32 nt, Human
cagccuggccaacacagugaaaccccaucucu

SEQ ID NO: 86560 - RNA, 32 nt, Human
cagccuggccaacacgaugaaaccccgucucu

SEQ ID NO: 86561 - RNA, 19 nt, Human
cagccuggccaacacggug

SEQ ID NO: 86562 - RNA, 22 nt, Human
cagccuggccaacacggugaaa

SEQ ID NO: 86563 - RNA, 32 nt, Human
cagccuggccaacacggugaaaccccaucucu

SEQ ID NO: 86564 - RNA, 32 nt, Human
cagccuggccaacacggugaaaccccgacucu

SEQ ID NO: 86565 - RNA, 32 nt, Human
cagccuggccaacacggugaaaccccgccucu

SEQ ID NO: 86566 - RNA, 32 nt, Human
cagccuggccaacacggugaaaccccgucacu

SEQ ID NO: 86567 - RNA, 32 nt, Human
cagccuggccaacacggugaaaccccgucucu

SEQ ID NO: 86568 - RNA, 32 nt, Human
cagccuggccaacagggugaaaccccgucucu

SEQ ID NO: 86569 - RNA, 32 nt, Human
cagccuggccaacauaaugaaaccccaucucu

SEQ ID NO: 86570 - RNA, 32 nt, Human
cagccuggccaacauagcaaaaccccaucucu

SEQ ID NO: 86571 - RNA, 32 nt, Human
cagccuggccaacauagugaaaccccaucucu

SEQ ID NO: 86572 - RNA, 32 nt, Human
cagccuggccaacauagugaaacccccucucu

SEQ ID NO: 86573 - RNA, 32 nt, Human
cagccuggccaacauagugaaaccccgccucu

SEQ ID NO: 86574 - RNA, 32 nt, Human
cagccuggccaacauagugaaaccccgucucu

SEQ ID NO: 86575 - RNA, 32 nt, Human
cagccuggccaacauagugaaaccccgugucu

SEQ ID NO: 86576 - RNA, 32 nt, Human
cagccuggccaacauagugaaaccccuucucu

SEQ ID NO: 86577 - RNA, 32 nt, Human
cagccuggccaacaugacaaaaccccgucucu

SEQ ID NO: 86578 - RNA, 32 nt, Human
cagccuggccaacaugacgaaaccccaucucu

SEQ ID NO: 86579 - RNA, 32 nt, Human
cagccuggccaacaugacgaaacccggucucu

SEQ ID NO: 86580 - RNA, 22 nt, Human
cagccuggccaacaugaugaaa

SEQ ID NO: 86581 - RNA, 32 nt, Human
cagccuggccaacaugaugaaaccccaucucc

SEQ ID NO: 86582 - RNA, 32 nt, Human
cagccuggccaacaugaugaaaccccaucucu

SEQ ID NO: 86583 - RNA, 32 nt, Human
cagccuggccaacaugaugaaaccccgucucu

SEQ ID NO: 86584 - RNA, 32 nt, Human
cagccuggccaacaugaugaaaccccguuucu

SEQ ID NO: 86585 - RNA, 32 nt, Human
cagccuggccaacaugaugaaacccugucucu

SEQ ID NO: 86586 - RNA, 32 nt, Human
cagccuggccaacaugaugaaacccuguucuc

SEQ ID NO: 86587 - RNA, 32 nt, Human
cagccuggccaacaugaugaaacccuugucuc

SEQ ID NO: 86588 - RNA, 32 nt, Human
cagccuggccaacaugaugaaaccuuaucucu

SEQ ID NO: 86589 - RNA, 32 nt, Human
cagccuggccaacaugaugagaccuccgucuc

SEQ ID NO: 86590 - RNA, 32 nt, Human
cagccuggccaacaugcaaaaccccgucucca

SEQ ID NO: 86591 - RNA, 32 nt, Human
cagccuggccaacaugccgaaacccugucugu

SEQ ID NO: 86592 - RNA, 32 nt, Human
cagccuggccaacaugcugaaacccugucugu

SEQ ID NO: 86593 - RNA, 32 nt, Human
cagccuggccaacaugcugaaaccucgucucu

SEQ ID NO: 86594 - RNA, 32 nt, Human
cagccuggccaacauggaaaaacccugucucu

SEQ ID NO: 86595 - RNA, 32 nt, Human
cagccuggccaacauggagaaaccccaucucu

SEQ ID NO: 86596 - RNA, 32 nt, Human
cagccuggccaacauggagaaaccccaucuuu

SEQ ID NO: 86597 - RNA, 32 nt, Human
cagccuggccaacauggagaaaccccgucucu

SEQ ID NO: 86598 - RNA, 32 nt, Human
cagccuggccaacauggagaaaccccgugacu

SEQ ID NO: 86599 - RNA, 32 nt, Human
cagccuggccaacauggagaaaccccuaaaaa

SEQ ID NO: 86600 - RNA, 32 nt, Human
cagccuggccaacauggagaaacccugucuca

SEQ ID NO: 86601 - RNA, 32 nt, Human
cagccuggccaacauggcaaaaccacaucucu

SEQ ID NO: 86602 - RNA, 32 nt, Human
cagccuggccaacauggcaaaaccccaucacu

SEQ ID NO: 86603 - RNA, 32 nt, Human
cagccuggccaacauggcaaaaccccaucucu

SEQ ID NO: 86604 - RNA, 32 nt, Human
cagccuggccaacauggcaaaaccccaucugu

SEQ ID NO: 86605 - RNA, 32 nt, Human
cagccuggccaacauggcaaaaccccaucuuu

SEQ ID NO: 86606 - RNA, 32 nt, Human
cagccuggccaacauggcaaaacccccgucuc

SEQ ID NO: 86607 - RNA, 32 nt, Human
cagccuggccaacauggcaaaaccccgucucu

SEQ ID NO: 86608 - RNA, 32 nt, Human
cagccuggccaacauggcaaaaccccgucugu

SEQ ID NO: 86609 - RNA, 32 nt, Human
cagccuggccaacauggcaaaaccccuuauuu

SEQ ID NO: 86610 - RNA, 32 nt, Human
cagccuggccaacauggcaaaaccccuucucu

SEQ ID NO: 86611 - RNA, 32 nt, Human
cagccuggccaacauggcaaaacccgucucua

SEQ ID NO: 86612 - RNA, 32 nt, Human
cagccuggccaacauggcaaaacccuaucucu

SEQ ID NO: 86613 - RNA, 32 nt, Human
cagccuggccaacauggcaaaacccugccucu

SEQ ID NO: 86614 - RNA, 32 nt, Human
cagccuggccaacauggcaaaacccuguaucu

SEQ ID NO: 86615 - RNA, 32 nt, Human
cagccuggccaacauggcaaaacccugucgcu

SEQ ID NO: 86616 - RNA, 32 nt, Human
cagccuggccaacauggcaaaacccugucuac

SEQ ID NO: 86617 - RNA, 32 nt, Human
cagccuggccaacauggcaaaacccugucucu

SEQ ID NO: 86618 - RNA, 32 nt, Human
cagccuggccaacauggcaaaaccucaucucu

SEQ ID NO: 86619 - RNA, 32 nt, Human
cagccuggccaacauggcaaaaucccaucucu

SEQ ID NO: 86620 - RNA, 32 nt, Human
cagccuggccaacauggcaaaaucccgucucu

SEQ ID NO: 86621 - RNA, 32 nt, Human
cagccuggccaacauggcaagaccccaucucu

SEQ ID NO: 86622 - RNA, 32 nt, Human
cagccuggccaacauggcagaaaccccaucuc

SEQ ID NO: 86623 - RNA, 32 nt, Human
cagccuggccaacauggcgaaaacccaucucu

SEQ ID NO: 86624 - RNA, 32 nt, Human
cagccuggccaacauggcgaaacaccugucuc

SEQ ID NO: 86625 - RNA, 32 nt, Human
cagccuggccaacauggcgaaaccccaucucu

SEQ ID NO: 86626 - RNA, 32 nt, Human
cagccuggccaacauggcgaaaccccauuucu

SEQ ID NO: 86627 - RNA, 32 nt, Human
cagccuggccaacauggcgaaaccccgucucu

SEQ ID NO: 86628 - RNA, 32 nt, Human
cagccuggccaacauggcgaaaccccucucua

SEQ ID NO: 86629 - RNA, 32 nt, Human
cagccuggccaacauggcgaaaccccuucucu

SEQ ID NO: 86630 - RNA, 32 nt, Human
cagccuggccaacauggcgaaacccuaucucu

SEQ ID NO: 86631 - RNA, 32 nt, Human
cagccuggccaacauggcgaaacccugucucu

SEQ ID NO: 86632 - RNA, 32 nt, Human
cagccuggccaacauggcgaaacccugucugu

SEQ ID NO: 86633 - RNA, 32 nt, Human
cagccuggccaacauggcgaaaccucaucucu

SEQ ID NO: 86634 - RNA, 32 nt, Human
cagccuggccaacauggcgaaaccucgccucu

SEQ ID NO: 86635 - RNA, 32 nt, Human
cagccuggccaacauggcgaaaccucuucucu

SEQ ID NO: 86636 - RNA, 32 nt, Human
cagccuggccaacauggcgaaacuccgucacu

SEQ ID NO: 86637 - RNA, 32 nt, Human
cagccuggccaacauggcgaaaucccgucuuu

SEQ ID NO: 86638 - RNA, 32 nt, Human
cagccuggccaacauggcgaaauuccaucucu

SEQ ID NO: 86639 - RNA, 32 nt, Human
cagccuggccaacauggcgagaccccaucucu

SEQ ID NO: 86640 - RNA, 32 nt, Human
cagccuggccaacauggcggaaccccaucucc

SEQ ID NO: 86641 - RNA, 32 nt, Human
cagccuggccaacauggcggaacccugucucu

SEQ ID NO: 86642 - RNA, 32 nt, Human
cagccuggccaacauggggaaaccccaucucu

SEQ ID NO: 86643 - RNA, 32 nt, Human
cagccuggccaacauggggaaaccccgucucu

SEQ ID NO: 86644 - RNA, 32 nt, Human
cagccuggccaacauggggaaacccugucuuu

SEQ ID NO: 86645 - RNA, 32 nt, Human
cagccuggccaacauggggaaaucccaucucu

SEQ ID NO: 86646 - RNA, 32 nt, Human
cagccuggccaacaugguaaaaccccaucucu

SEQ ID NO: 86647 - RNA, 32 nt, Human
cagccuggccaacaugguaaaaccccauuucu

SEQ ID NO: 86648 - RNA, 32 nt, Human
cagccuggccaacaugguaaaaccccgucucu

SEQ ID NO: 86649 - RNA, 32 nt, Human
cagccuggccaacaugguaaaacccugucucu

SEQ ID NO: 86650 - RNA, 32 nt, Human
cagccuggccaacaugguaaaacuccauuucu

SEQ ID NO: 86651 - RNA, 32 nt, Human
cagccuggccaacaugguaaaaucccgucucu

SEQ ID NO: 86652 - RNA, 22 nt, Human
cagccuggccaacauggugaaa

SEQ ID NO: 86653 - RNA, 32 nt, Human
cagccuggccaacauggugaaaacccaucucu

SEQ ID NO: 86654 - RNA, 23 nt, Human
cagccuggccaacauggugaaac

SEQ ID NO: 86655 - RNA, 32 nt, Human
cagccuggccaacauggugaaacaccgucucc

SEQ ID NO: 86656 - RNA, 32 nt, Human
cagccuggccaacauggugaaacccagucucu

SEQ ID NO: 86657 - RNA, 32 nt, Human
cagccuggccaacauggugaaacccagucuuu

SEQ ID NO: 86658 - RNA, 32 nt, Human
cagccuggccaacauggugaaaccccaccucu

SEQ ID NO: 86659 - RNA, 32 nt, Human
cagccuggccaacauggugaaaccccauaucc

SEQ ID NO: 86660 - RNA, 32 nt, Human
cagccuggccaacauggugaaaccccauccuu

SEQ ID NO: 86661 - RNA, 32 nt, Human
cagccuggccaacauggugaaaccccaucgcu

SEQ ID NO: 86662 - RNA, 32 nt, Human
cagccuggccaacauggugaaaccccaucucc

SEQ ID NO: 86663 - RNA, 32 nt, Human
cagccuggccaacauggugaaaccccaucucu

SEQ ID NO: 86664 - RNA, 32 nt, Human
cagccuggccaacauggugaaaccccaucugu

SEQ ID NO: 86665 - RNA, 32 nt, Human
cagccuggccaacauggugaaaccccaucuuu

SEQ ID NO: 86666 - RNA, 32 nt, Human
cagccuggccaacauggugaaaccccauuucu

SEQ ID NO: 86667 - RNA, 32 nt, Human
cagccuggccaacauggugaaacccccaucuc

SEQ ID NO: 86668 - RNA, 32 nt, Human
cagccuggccaacauggugaaacccccucucu

SEQ ID NO: 86669 - RNA, 32 nt, Human
cagccuggccaacauggugaaaccccgucacu

SEQ ID NO: 86670 - RNA, 32 nt, Human
cagccuggccaacauggugaaaccccgucuau

SEQ ID NO: 86671 - RNA, 32 nt, Human
cagccuggccaacauggugaaaccccgucucc

SEQ ID NO: 86672 - RNA, 32 nt, Human
cagccuggccaacauggugaaaccccgucucu

SEQ ID NO: 86673 - RNA, 32 nt, Human
cagccuggccaacauggugaaaccccguuucu

SEQ ID NO: 86674 - RNA, 32 nt, Human
cagccuggccaacauggugaaaccccuucucu

SEQ ID NO: 86675 - RNA, 32 nt, Human
cagccuggccaacauggugaaacccgcugucu

SEQ ID NO: 86676 - RNA, 32 nt, Human
cagccuggccaacauggugaaacccggucucu

SEQ ID NO: 86677 - RNA, 32 nt, Human
cagccuggccaacauggugaaacccgucucua

SEQ ID NO: 86678 - RNA, 32 nt, Human
cagccuggccaacauggugaaacccuaucucc

SEQ ID NO: 86679 - RNA, 32 nt, Human
cagccuggccaacauggugaaacccuaucucu

SEQ ID NO: 86680 - RNA, 32 nt, Human
cagccuggccaacauggugaaacccucaucuc

SEQ ID NO: 86681 - RNA, 32 nt, Human
cagccuggccaacauggugaaacccugaaaua

SEQ ID NO: 86682 - RNA, 32 nt, Human
cagccuggccaacauggugaaacccuggcucu

SEQ ID NO: 86683 - RNA, 32 nt, Human
cagccuggccaacauggugaaacccuguaucu

SEQ ID NO: 86684 - RNA, 32 nt, Human
cagccuggccaacauggugaaacccugucgac

SEQ ID NO: 86685 - RNA, 32 nt, Human
cagccuggccaacauggugaaacccugucuac

SEQ ID NO: 86686 - RNA, 32 nt, Human
cagccuggccaacauggugaaacccugucucu

SEQ ID NO: 86687 - RNA, 32 nt, Human
cagccuggccaacauggugaaacccugucugc

SEQ ID NO: 86688 - RNA, 32 nt, Human
cagccuggccaacauggugaaacccugucugu

SEQ ID NO: 86689 - RNA, 32 nt, Human
cagccuggccaacauggugaaacccugucuuu

SEQ ID NO: 86690 - RNA, 32 nt, Human
cagccuggccaacauggugaaacccugugucu

SEQ ID NO: 86691 - RNA, 32 nt, Human
cagccuggccaacauggugaaacccuguugcu

SEQ ID NO: 86692 - RNA, 32 nt, Human
cagccuggccaacauggugaaacccuguuucu

SEQ ID NO: 86693 - RNA, 32 nt, Human
cagccuggccaacauggugaaacccuucucua

SEQ ID NO: 86694 - RNA, 32 nt, Human
cagccuggccaacauggugaaacccuuucucu

SEQ ID NO: 86695 - RNA, 32 nt, Human
cagccuggccaacauggugaaaccgcaucucu

SEQ ID NO: 86696 - RNA, 32 nt, Human
cagccuggccaacauggugaaaccucaucucu

SEQ ID NO: 86697 - RNA, 32 nt, Human
cagccuggccaacauggugaaaccucauuucu

SEQ ID NO: 86698 - RNA, 32 nt, Human
cagccuggccaacauggugaaaccuccgucuc

SEQ ID NO: 86699 - RNA, 32 nt, Human
cagccuggccaacauggugaaaccucgucucu

SEQ ID NO: 86700 - RNA, 32 nt, Human
cagccuggccaacauggugaaaccucgucugu

SEQ ID NO: 86701 - RNA, 32 nt, Human
cagccuggccaacauggugaaaccucgucuuu

SEQ ID NO: 86702 - RNA, 32 nt, Human
cagccuggccaacauggugaaaccuggccucu

SEQ ID NO: 86703 - RNA, 32 nt, Human
cagccuggccaacauggugaaaccuugucucu

SEQ ID NO: 86704 - RNA, 32 nt, Human
cagccuggccaacauggugaaacgccaucucu

SEQ ID NO: 86705 - RNA, 32 nt, Human
cagccuggccaacauggugaaacuccaucucu

SEQ ID NO: 86706 - RNA, 32 nt, Human
cagccuggccaacauggugaaacuccgucucu

SEQ ID NO: 86707 - RNA, 32 nt, Human
cagccuggccaacauggugaaacugcaucucu

SEQ ID NO: 86708 - RNA, 32 nt, Human
cagccuggccaacauggugaaaucccaucucu

SEQ ID NO: 86709 - RNA, 32 nt, Human
cagccuggccaacauggugaaauccccucucu

SEQ ID NO: 86710 - RNA, 32 nt, Human
cagccuggccaacauggugaaaucccgucucu

SEQ ID NO: 86711 - RNA, 32 nt, Human
cagccuggccaacauggugaaauccugucucu

SEQ ID NO: 86712 - RNA, 32 nt, Human
cagccuggccaacauggugaaaucucaucugu

SEQ ID NO: 86713 - RNA, 32 nt, Human
cagccuggccaacauggugaaauucugucucu

SEQ ID NO: 86714 - RNA, 32 nt, Human
cagccuggccaacauggugaaccccaucucua

SEQ ID NO: 86715 - RNA, 32 nt, Human
cagccuggccaacauggugaacccucagcucu

SEQ ID NO: 86716 - RNA, 32 nt, Human
cagccuggccaacauggugaagcccugucucu

SEQ ID NO: 86717 - RNA, 32 nt, Human
cagccuggccaacauggugaagcuccgucucu

SEQ ID NO: 86718 - RNA, 32 nt, Human
cagccuggccaacauggugaauccccgucucu

SEQ ID NO: 86719 - RNA, 32 nt, Human
cagccuggccaacauggugaauuaucucuacu

SEQ ID NO: 86720 - RNA, 32 nt, Human
cagccuggccaacauggugagacaccgucucu

SEQ ID NO: 86721 - RNA, 32 nt, Human
cagccuggccaacauggugagaccccaucucu

SEQ ID NO: 86722 - RNA, 32 nt, Human
cagccuggccaacauggugagacccugucucu

SEQ ID NO: 86723 - RNA, 32 nt, Human
cagccuggccaacaugguggaacccaaucucu

SEQ ID NO: 86724 - RNA, 32 nt, Human
cagccuggccaacaugguggaacccagucucu

SEQ ID NO: 86725 - RNA, 32 nt, Human
cagccuggccaacaugguggaacccuaucucu

SEQ ID NO: 86726 - RNA, 32 nt, Human
cagccuggccaacaugguguaaccucaucucu

SEQ ID NO: 86727 - RNA, 32 nt, Human
cagccuggccaacauggugugagaccccgucu

SEQ ID NO: 86728 - RNA, 32 nt, Human
cagccuggccaacaugguuaaaccccgucucu

SEQ ID NO: 86729 - RNA, 32 nt, Human
cagccuggccaacaugucagaacuacuaaaaa

SEQ ID NO: 86730 - RNA, 32 nt, Human
cagccuggccaacaugucgaacuccaccucua

SEQ ID NO: 86731 - RNA, 32 nt, Human
cagccuggccaacaugucgaagugccaucucu

SEQ ID NO: 86732 - RNA, 32 nt, Human
cagccuggccaacaugugaaaccccgucucca

SEQ ID NO: 86733 - RNA, 32 nt, Human
cagccuggccaacauugugaaaccccaucucu

SEQ ID NO: 86734 - RNA, 32 nt, Human
cagccuggccaacguagugaaaccccgucucu

SEQ ID NO: 86735 - RNA, 22 nt, Human
cagccuggccaacgugaugaaa

SEQ ID NO: 86736 - RNA, 32 nt, Human
cagccuggccaacgugaugaaaccccaucugu

SEQ ID NO: 86737 - RNA, 32 nt, Human
cagccuggccaacguggagaaacccugucccu

SEQ ID NO: 86738 - RNA, 32 nt, Human
cagccuggccaacguggcaaaaccccaucucu

SEQ ID NO: 86739 - RNA, 32 nt, Human
cagccuggccaacguggugaaaccccaucucu

SEQ ID NO: 86740 - RNA, 32 nt, Human
cagccuggccaacguggugaaaccccaucuuc

SEQ ID NO: 86741 - RNA, 32 nt, Human
cagccuggccaacguggugaaacccccucucu

SEQ ID NO: 86742 - RNA, 32 nt, Human
cagccuggccaacguggugaaaccccgucucc

SEQ ID NO: 86743 - RNA, 32 nt, Human
cagccuggccaacguggugaaaccccguguac

SEQ ID NO: 86744 - RNA, 21 nt, Human
cagccuggccaacugccugaa

SEQ ID NO: 86745 - RNA, 32 nt, Human
cagccuggccaacugccugaaaccccaucucu

SEQ ID NO: 86746 - RNA, 32 nt, Human
cagccuggccaacuugaugaaaccccaucucu

SEQ ID NO: 86747 - RNA, 32 nt, Human
cagccuggccaacuuggagaaaccccagcucu

SEQ ID NO: 86748 - RNA, 32 nt, Human
cagccuggccaacuuggugaaaccccaucucu

SEQ ID NO: 86749 - RNA, 32 nt, Human
cagccuggccaacuuggugaaaccccgucuuu

SEQ ID NO: 86750 - RNA, 22 nt, Human
cagccuggccaagauggugaaa

SEQ ID NO: 86751 - RNA, 32 nt, Human
cagccuggccaagauggugaaaccccaucucu

SEQ ID NO: 86752 - RNA, 32 nt, Human
cagccuggccaagauggugaaaccccgucucc

SEQ ID NO: 86753 - RNA, 32 nt, Human
cagccuggccaagauggugaaaccccgucucu

SEQ ID NO: 86754 - RNA, 32 nt, Human
cagccuggccaaggcggcaaaaccccaucucu

SEQ ID NO: 86755 - RNA, 32 nt, Human
cagccuggccaauaugaugaaaccccaucucu

SEQ ID NO: 86756 - RNA, 32 nt, Human
cagccuggccaauauggcaaaaccccaucucu

SEQ ID NO: 86757 - RNA, 32 nt, Human
cagccuggccaauauggcgaaaccccaucucu

SEQ ID NO: 86758 - RNA, 32 nt, Human
cagccuggccaauauggugaaaccccaucucu

SEQ ID NO: 86759 - RNA, 32 nt, Human
cagccuggccaauauggugaaaccccaugucu

SEQ ID NO: 86760 - RNA, 32 nt, Human
cagccuggccaauauggugaaaccccgacucu

SEQ ID NO: 86761 - RNA, 32 nt, Human
cagccuggccaauauggugaaaccccgucucu

SEQ ID NO: 86762 - RNA, 32 nt, Human
cagccuggccaaugugaugaaaccccgucucu

SEQ ID NO: 86763 - RNA, 32 nt, Human
cagccuggccaauguggugaaaccccaccucu

SEQ ID NO: 86764 - RNA, 32 nt, Human
cagccuggccaauguggugaaaccccaucucu

SEQ ID NO: 86765 - RNA, 20 nt, Human
cagccuggccacagagcgag

SEQ ID NO: 86766 - RNA, 21 nt, Human
cagccuggccacagagcgaga

SEQ ID NO: 86767 - RNA, 32 nt, Human
cagccuggccacugccuagcuggaaugggagg

SEQ ID NO: 86768 - RNA, 17 nt, Human
cagccuggccagacaag

SEQ ID NO: 86769 - RNA, 32 nt, Human
cagccuggccagcaaggugaaaccccaucucu

SEQ ID NO: 86770 - RNA, 32 nt, Human
cagccuggccagcacggugaaaccccgucucu

SEQ ID NO: 86771 - RNA, 32 nt, Human
cagccuggccagcauagugaaaccccaucucu

SEQ ID NO: 86772 - RNA, 32 nt, Human
cagccuggccagcauggugaaaccccaucucu

SEQ ID NO: 86773 - RNA, 32 nt, Human
cagccuggccagcauggugaaaccccgucucu

SEQ ID NO: 86774 - RNA, 32 nt, Human
cagccuggccagcugcucagaccagcuugcag

SEQ ID NO: 86775 - RNA, 32 nt, Human
cagccuggccagguucuccacauggugaauga

SEQ ID NO: 86776 - RNA, 32 nt, Human
cagccuggccaucauggugaaaccccaucucu

SEQ ID NO: 86777 - RNA, 32 nt, Human
cagccuggccauuauggugaaaccccgucucu

SEQ ID NO: 86778 - RNA, 22 nt, Human
cagccuggcccacagagugaga

SEQ ID NO: 86779 - RNA, 32 nt, Human
cagccuggcccacauggugaaaccccaucuuu

SEQ ID NO: 86780 - RNA, 32 nt, Human
cagccuggcccagggugaaggaagaggcacgu

SEQ ID NO: 86781 - RNA, 32 nt, Human
cagccuggccgacauggcgaaacccccuaaaa

SEQ ID NO: 86782 - RNA, 32 nt, Human
cagccuggccgggguggugaaaccccaucucu

SEQ ID NO: 86783 - RNA, 32 nt, Human
cagccuggccucuugggaauucucccacaggg

SEQ ID NO: 86784 - RNA, 32 nt, Human
cagccuggccuggucugugccugcccagcaug

SEQ ID NO: 86785 - RNA, 32 nt, Human
cagccuggccuuuccuccuuccccucugaacc

SEQ ID NO: 86786 - RNA, 20 nt, Human
cagccuggcgacaaagcgag

SEQ ID NO: 86787 - RNA, 22 nt, Human
cagccuggcgacaagagcgaga

SEQ ID NO: 86788 - RNA, 22 nt, Human
cagccuggcgacaagagugaga

SEQ ID NO: 86789 - RNA, 21 nt, Human
cagccuggcgacacagugaga

SEQ ID NO: 86790 - RNA, 21 nt, Human
cagccuggcgacagagagaga

SEQ ID NO: 86791 - RNA, 20 nt, Human
cagccuggcgacagagcaag

SEQ ID NO: 86792 - RNA, 21 nt, Human
cagccuggcgacagagcaaga

SEQ ID NO: 86793 - RNA, 20 nt, Human
cagccuggcgacagagcgag

SEQ ID NO: 86794 - RNA, 21 nt, Human
cagccuggcgacagagcgaga

SEQ ID NO: 86795 - RNA, 20 nt, Human
cagccuggcgacagagcuag

SEQ ID NO: 86796 - RNA, 21 nt, Human
cagccuggcgacagagcuaga

SEQ ID NO: 86797 - RNA, 21 nt, Human
cagccuggcgacagagggaga

SEQ ID NO: 86798 - RNA, 21 nt, Human
cagccuggcgacagagugaga

SEQ ID NO: 86799 - RNA, 21 nt, Human
cagccuggcgacugagcgaga

SEQ ID NO: 86800 - RNA, 32 nt, Human
cagccuggcgggugggagaugcggcggccacc

SEQ ID NO: 86801 - RNA, 22 nt, Human
cagccuggcuaacacggugaaa

SEQ ID NO: 86802 - RNA, 32 nt, Human
cagccuggcuaacacggugaaaccccgucucu

SEQ ID NO: 86803 - RNA, 32 nt, Human
cagccuggcuaacacggugaaaccccgucuuu

SEQ ID NO: 86804 - RNA, 32 nt, Human
cagccuggcuaacauggcaaaaccccaucucu

SEQ ID NO: 86805 - RNA, 32 nt, Human
cagccuggcuaacauggcgaaaccccgucucu

SEQ ID NO: 86806 - RNA, 32 nt, Human
cagccuggcuaacauggugaaaccccaucucu

SEQ ID NO: 86807 - RNA, 32 nt, Human
cagccuggcuaauauggugaaaccccgucucu

SEQ ID NO: 86808 - RNA, 21 nt, Human
cagccuggcuacagagugaga

SEQ ID NO: 86809 - RNA, 32 nt, Human
cagccuggcucccuucccuggagcggcagggc

SEQ ID NO: 86810 - RNA, 21 nt, Human
cagccuggcugacagagcaag

SEQ ID NO: 86811 - RNA, 22 nt, Human
cagccuggcugacagagcaaga

SEQ ID NO: 86812 - RNA, 31 nt, Human
cagccuggcugacagagcaagacucagucuc

SEQ ID NO: 86813 - RNA, 21 nt, Human
cagccuggcugacagagcgag

SEQ ID NO: 86814 - RNA, 22 nt, Human
cagccuggcugacagagcgaga

SEQ ID NO: 86815 - RNA, 20 nt, Human
cagccuggcugguccuccca

SEQ ID NO: 86816 - RNA, 32 nt, Human
cagccuggcuuacauggugaaaccccaucucu

SEQ ID NO: 86817 - RNA, 22 nt, Human
cagccuggcuuccucugguuca

SEQ ID NO: 86818 - RNA, 32 nt, Human
cagccugggaaacauggcaaacucccaccauu

SEQ ID NO: 86819 - RNA, 22 nt, Human
cagccugggaagcagagugaga

SEQ ID NO: 86820 - RNA, 32 nt, Human
cagccugggaagcaucuuuucgcucagcaagu

SEQ ID NO: 86821 - RNA, 22 nt, Human
cagccugggagacacagcgaga

SEQ ID NO: 86822 - RNA, 21 nt, Human
cagccugggagacagagcaag

SEQ ID NO: 86823 - RNA, 22 nt, Human
cagccugggagacagagcaaga

SEQ ID NO: 86824 - RNA, 21 nt, Human
cagccugggagacagagcgag

SEQ ID NO: 86825 - RNA, 22 nt, Human
cagccugggagacagagcgaga

SEQ ID NO: 86826 - RNA, 22 nt, Human
cagccugggagacagagugaga

SEQ ID NO: 86827 - RNA, 22 nt, Human
cagccugggagacagaguuaga

SEQ ID NO: 86828 - RNA, 21 nt, Human
cagccugggagauagagcaag

SEQ ID NO: 86829 - RNA, 22 nt, Human
cagccugggagauagagcaaga

SEQ ID NO: 86830 - RNA, 32 nt, Human
cagccugggaggcccagguguagcgguccgag

SEQ ID NO: 86831 - RNA, 32 nt, Human
cagccugggagggagaaggaguuggagcucaa

SEQ ID NO: 86832 - RNA, 32 nt, Human
cagccugggaggucaaggcugcagugagcugu

SEQ ID NO: 86833 - RNA, 32 nt, Human
cagccugggagucccggaggccaggcugcaca

SEQ ID NO: 86834 - RNA, 32 nt, Human
cagccugggauccggugauggucugggcagag

SEQ ID NO: 86835 - RNA, 20 nt, Human
cagccugggcaaaagagcaa

SEQ ID NO: 86836 - RNA, 21 nt, Human
cagccugggcaacaaagcaag

SEQ ID NO: 86837 - RNA, 22 nt, Human
cagccugggcaacaaagugaga

SEQ ID NO: 86838 - RNA, 32 nt, Human
cagccugggcaacaagaaugaaacuccgucuc

SEQ ID NO: 86839 - RNA, 22 nt, Human
cagccugggcaacaagagcaag

SEQ ID NO: 86840 - RNA, 21 nt, Human
cagccugggcaacaagagcga

SEQ ID NO: 86841 - RNA, 23 nt, Human
cagccugggcaacaagagcgaaa

SEQ ID NO: 86842 - RNA, 23 nt, Human
cagccugggcaacaagagugaga

SEQ ID NO: 86843 - RNA, 32 nt, Human
cagccugggcaacacaagacccugucucuaca

SEQ ID NO: 86844 - RNA, 21 nt, Human
cagccugggcaacacagcaag

SEQ ID NO: 86845 - RNA, 22 nt, Human
cagccugggcaacacagugaga

SEQ ID NO: 86846 - RNA, 32 nt, Human
cagccugggcaacacggugaaaccccaucucu

SEQ ID NO: 86847 - RNA, 20 nt, Human
cagccugggcaacagaacaa

SEQ ID NO: 86848 - RNA, 21 nt, Human
cagccugggcaacagaacaag

SEQ ID NO: 86849 - RNA, 32 nt, Human
cagccugggcaacagaacaagaacccaucuca

SEQ ID NO: 86850 - RNA, 32 nt, Human
cagccugggcaacagaacaagacucaucucua

SEQ ID NO: 86851 - RNA, 32 nt, Human
cagccugggcaacagaacaagauucugucuca

SEQ ID NO: 86852 - RNA, 32 nt, Human
cagccugggcaacagaacaggacucggucuaa

SEQ ID NO: 86853 - RNA, 21 nt, Human
cagccugggcaacagaacgag

SEQ ID NO: 86854 - RNA, 21 nt, Human
cagccugggcaacagaagaag

SEQ ID NO: 86855 - RNA, 22 nt, Human
cagccugggcaacagaaugaga

SEQ ID NO: 86856 - RNA, 26 nt, Human
cagccugggcaacagacagagugaga

SEQ ID NO: 86857 - RNA, 22 nt, Human
cagccugggcaacagagagaga

SEQ ID NO: 86858 - RNA, 20 nt, Human
cagccugggcaacagagcaa

SEQ ID NO: 86859 - RNA, 21 nt, Human
cagccugggcaacagagcaag

SEQ ID NO: 86860 - RNA, 22 nt, Human
cagccugggcaacagagcaaga

SEQ ID NO: 86861 - RNA, 22 nt, Human
cagccugggcaacagagcaagg

SEQ ID NO: 86862 - RNA, 21 nt, Human
cagccugggcaacagagccag

SEQ ID NO: 86863 - RNA, 22 nt, Human
cagccugggcaacagagccagg

SEQ ID NO: 86864 - RNA, 21 nt, Human
cagccugggcaacagagcgag

SEQ ID NO: 86865 - RNA, 22 nt, Human
cagccugggcaacagagcgaga

SEQ ID NO: 86866 - RNA, 22 nt, Human
cagccugggcaacagagcgagg

SEQ ID NO: 86867 - RNA, 21 nt, Human
cagccugggcaacagagcuag

SEQ ID NO: 86868 - RNA, 22 nt, Human
cagccugggcaacagagggaga

SEQ ID NO: 86869 - RNA, 18 nt, Human
cagccugggcaacagagu

SEQ ID NO: 86870 - RNA, 20 nt, Human
cagccugggcaacagaguaa

SEQ ID NO: 86871 - RNA, 21 nt, Human
cagccugggcaacagaguaag

SEQ ID NO: 86872 - RNA, 22 nt, Human
cagccugggcaacagaguaaga

SEQ ID NO: 86873 - RNA, 21 nt, Human
cagccugggcaacagagugag

SEQ ID NO: 86874 - RNA, 22 nt, Human
cagccugggcaacagagugaga

SEQ ID NO: 86875 - RNA, 22 nt, Human
cagccugggcaacagagugagg

SEQ ID NO: 86876 - RNA, 22 nt, Human
cagccugggcaacagaguggga

SEQ ID NO: 86877 - RNA, 22 nt, Human
cagccugggcaacagcgugaga

SEQ ID NO: 86878 - RNA, 21 nt, Human
cagccugggcaacagggcaag

SEQ ID NO: 86879 - RNA, 18 nt, Human
cagccugggcaacagggu

SEQ ID NO: 86880 - RNA, 21 nt, Human
cagccugggcaacaggugaga

SEQ ID NO: 86881 - RNA, 32 nt, Human
cagccugggcaacagugacacucuuaucucca

SEQ ID NO: 86882 - RNA, 20 nt, Human
cagccugggcaacagugaga

SEQ ID NO: 86883 - RNA, 22 nt, Human
cagccugggcaacagugugaga

SEQ ID NO: 86884 - RNA, 20 nt, Human
cagccugggcaacauagcaa

SEQ ID NO: 86885 - RNA, 21 nt, Human
cagccugggcaacauagcaag

SEQ ID NO: 86886 - RNA, 22 nt, Human
cagccugggcaacauagugaga

SEQ ID NO: 86887 - RNA, 32 nt, Human
cagccugggcaacauggagaaaccccguuucu

SEQ ID NO: 86888 - RNA, 32 nt, Human
cagccugggcaacauggagagaccccuguucu

SEQ ID NO: 86889 - RNA, 32 nt, Human
cagccugggcaacauggagagaccccuucucu

SEQ ID NO: 86890 - RNA, 32 nt, Human
cagccugggcaacauggcaaaaccccaucucu

SEQ ID NO: 86891 - RNA, 32 nt, Human
cagccugggcaacauggcaaaaccccauuucu

SEQ ID NO: 86892 - RNA, 32 nt, Human
cagccugggcaacauggcaagaccccaucuau

SEQ ID NO: 86893 - RNA, 32 nt, Human
cagccugggcaacauggcgaaaacccaucucu

SEQ ID NO: 86894 - RNA, 32 nt, Human
cagccugggcaacauggcgaaaccccauuucu

SEQ ID NO: 86895 - RNA, 32 nt, Human
cagccugggcaacauggcgagaccccaucucu

SEQ ID NO: 86896 - RNA, 32 nt, Human
cagccugggcaacauggggaaacuccaucucu

SEQ ID NO: 86897 - RNA, 22 nt, Human
cagccugggcaacauggugaaa

SEQ ID NO: 86898 - RNA, 32 nt, Human
cagccugggcaacauggugaaaccccaucucu

SEQ ID NO: 86899 - RNA, 32 nt, Human
cagccugggcaacauggugaaaccccgucccc

SEQ ID NO: 86900 - RNA, 32 nt, Human
cagccugggcaacauggugaaaccccgucucu

SEQ ID NO: 86901 - RNA, 32 nt, Human
cagccugggcaacauggugaaacccuaucucc

SEQ ID NO: 86902 - RNA, 32 nt, Human
cagccugggcaacauggugaaaccucaucucu

SEQ ID NO: 86903 - RNA, 32 nt, Human
cagccugggcaacauggugaaaucccaugucu

SEQ ID NO: 86904 - RNA, 32 nt, Human
cagccugggcaacauggugaagccccaucucu

SEQ ID NO: 86905 - RNA, 32 nt, Human
cagccugggcaacauggugaagccucauaucu

SEQ ID NO: 86906 - RNA, 32 nt, Human
cagccugggcaacauggugagaccccaucucu

SEQ ID NO: 86907 - RNA, 32 nt, Human
cagccugggcaacauggugagaccccgucucu

SEQ ID NO: 86908 - RNA, 19 nt, Human
cagccugggcaacgagcaa

SEQ ID NO: 86909 - RNA, 20 nt, Human
cagccugggcaacgagcaag

SEQ ID NO: 86910 - RNA, 21 nt, Human
cagccugggcaacggagcaag

SEQ ID NO: 86911 - RNA, 18 nt, Human
cagccugggcaacggagu

SEQ ID NO: 86912 - RNA, 22 nt, Human
cagccugggcaacggagugaga

SEQ ID NO: 86913 - RNA, 32 nt, Human
cagccugggcaacgugacgaaaccccaucucu

SEQ ID NO: 86914 - RNA, 32 nt, Human
cagccugggcaacguggugaaaccccaucucu

SEQ ID NO: 86915 - RNA, 20 nt, Human
cagccugggcaacugagcaa

SEQ ID NO: 86916 - RNA, 21 nt, Human
cagccugggcaacugagcaag

SEQ ID NO: 86917 - RNA, 32 nt, Human
cagccugggcaagauggugaaaccccaucucu

SEQ ID NO: 86918 - RNA, 21 nt, Human
cagccugggcaauagagcaag

SEQ ID NO: 86919 - RNA, 18 nt, Human
cagccugggcaauagagu

SEQ ID NO: 86920 - RNA, 22 nt, Human
cagccugggcaauagaguaaga

SEQ ID NO: 86921 - RNA, 22 nt, Human
cagccugggcaauagagugaga

SEQ ID NO: 86922 - RNA, 32 nt, Human
cagccugggcaauauagugaaaccccaucucu

SEQ ID NO: 86923 - RNA, 32 nt, Human
cagccugggcaaugugauaaaaccccaucucu

SEQ ID NO: 86924 - RNA, 21 nt, Human
cagccugggcaccacagcaag

SEQ ID NO: 86925 - RNA, 24 nt, Human
cagccugggcaccacagcaagacu

SEQ ID NO: 86926 - RNA, 21 nt, Human
cagccugggcaccagagcgag

SEQ ID NO: 86927 - RNA, 22 nt, Human
cagccugggcaccagagcgaga

SEQ ID NO: 86928 - RNA, 32 nt, Human
cagccugggcaccaucuucucauucaucucca

SEQ ID NO: 86929 - RNA, 22 nt, Human
cagccugggcacuagagugaga

SEQ ID NO: 86930 - RNA, 20 nt, Human
cagccugggcagcagagcaa

SEQ ID NO: 86931 - RNA, 21 nt, Human
cagccugggcagcagagcaag

SEQ ID NO: 86932 - RNA, 21 nt, Human
cagccugggcagcagagcgag

SEQ ID NO: 86933 - RNA, 22 nt, Human
cagccugggcagcagagcgaga

SEQ ID NO: 86934 - RNA, 21 nt, Human
cagccugggcagcagaggaag

SEQ ID NO: 86935 - RNA, 22 nt, Human
cagccugggcagcagagugaga

SEQ ID NO: 86936 - RNA, 32 nt, Human
cagccugggcagcagcaagaacuauuuauuaa

SEQ ID NO: 86937 - RNA, 32 nt, Human
cagccugggcagcauagugugagacccugucu

SEQ ID NO: 86938 - RNA, 22 nt, Human
cagccugggccacagaaugaga

SEQ ID NO: 86939 - RNA, 22 nt, Human
cagccugggccacagagugaga

SEQ ID NO: 86940 - RNA, 21 nt, Human
cagccugggccacagugcaag

SEQ ID NO: 86941 - RNA, 21 nt, Human
cagccugggccacauagcaag

SEQ ID NO: 86942 - RNA, 21 nt, Human
cagccugggccccagcccaca

SEQ ID NO: 86943 - RNA, 21 nt, Human
cagccugggcgacaaagcaag

SEQ ID NO: 86944 - RNA, 21 nt, Human
cagccugggcgacaaagcgag

SEQ ID NO: 86945 - RNA, 22 nt, Human
cagccugggcgacaaagcgaga

SEQ ID NO: 86946 - RNA, 22 nt, Human
cagccugggcgacaaagugaga

SEQ ID NO: 86947 - RNA, 22 nt, Human
cagccugggcgacaaaguggga

SEQ ID NO: 86948 - RNA, 22 nt, Human
cagccugggcgacaagagcaag

SEQ ID NO: 86949 - RNA, 21 nt, Human
cagccugggcgacacagcaag

SEQ ID NO: 86950 - RNA, 22 nt, Human
cagccugggcgacacagcgaga

SEQ ID NO: 86951 - RNA, 21 nt, Human
cagccugggcgacagaacaag

SEQ ID NO: 86952 - RNA, 21 nt, Human
cagccugggcgacagaacgag

SEQ ID NO: 86953 - RNA, 22 nt, Human
cagccugggcgacagaacgaga

SEQ ID NO: 86954 - RNA, 32 nt, Human
cagccugggcgacagaacgagaccccaucuca

SEQ ID NO: 86955 - RNA, 22 nt, Human
cagccugggcgacagaaugaga

SEQ ID NO: 86956 - RNA, 22 nt, Human
cagccugggcgacagaccgaga

SEQ ID NO: 86957 - RNA, 22 nt, Human
cagccugggcgacagagagaga

SEQ ID NO: 86958 - RNA, 20 nt, Human
cagccugggcgacagagcaa

SEQ ID NO: 86959 - RNA, 21 nt, Human
cagccugggcgacagagcaag

SEQ ID NO: 86960 - RNA, 22 nt, Human
cagccugggcgacagagcaaga

SEQ ID NO: 86961 - RNA, 22 nt, Human
cagccugggcgacagagcaagg

SEQ ID NO: 86962 - RNA, 21 nt, Human
cagccugggcgacagagcagg

SEQ ID NO: 86963 - RNA, 22 nt, Human
cagccugggcgacagagcagga

SEQ ID NO: 86964 - RNA, 21 nt, Human
cagccugggcgacagagccag

SEQ ID NO: 86965 - RNA, 22 nt, Human
cagccugggcgacagagccaga

SEQ ID NO: 86966 - RNA, 20 nt, Human
cagccugggcgacagagcga

SEQ ID NO: 86967 - RNA, 21 nt, Human
cagccugggcgacagagcgag

SEQ ID NO: 86968 - RNA, 22 nt, Human
cagccugggcgacagagcgaga

SEQ ID NO: 86969 - RNA, 21 nt, Human
cagccugggcgacagagcuag

SEQ ID NO: 86970 - RNA, 22 nt, Human
cagccugggcgacagagcuaga

SEQ ID NO: 86971 - RNA, 22 nt, Human
cagccugggcgacagagggaga

SEQ ID NO: 86972 - RNA, 18 nt, Human
cagccugggcgacagagu

SEQ ID NO: 86973 - RNA, 21 nt, Human
cagccugggcgacagaguaag

SEQ ID NO: 86974 - RNA, 22 nt, Human
cagccugggcgacagaguaaga

SEQ ID NO: 86975 - RNA, 22 nt, Human
cagccugggcgacagagugaga

SEQ ID NO: 86976 - RNA, 22 nt, Human
cagccugggcgacagagugagg

SEQ ID NO: 86977 - RNA, 19 nt, Human
cagccugggcgacagcaag

SEQ ID NO: 86978 - RNA, 21 nt, Human
cagccugggcgacagggcaag

SEQ ID NO: 86979 - RNA, 22 nt, Human
cagccugggcgacagggcaaga

SEQ ID NO: 86980 - RNA, 22 nt, Human
cagccugggcgacagggugaga

SEQ ID NO: 86981 - RNA, 21 nt, Human
cagccugggcgacagugcaag

SEQ ID NO: 86982 - RNA, 19 nt, Human
cagccugggcgacgagcaa

SEQ ID NO: 86983 - RNA, 22 nt, Human
cagccugggcgacggagcgaga

SEQ ID NO: 86984 - RNA, 22 nt, Human
cagccugggcgacggagugaga

SEQ ID NO: 86985 - RNA, 22 nt, Human
cagccugggcgauagagcaaga

SEQ ID NO: 86986 - RNA, 22 nt, Human
cagccugggcgauagagugaga

SEQ ID NO: 86987 - RNA, 19 nt, Human
cagccugggcgaugagcaa

SEQ ID NO: 86988 - RNA, 20 nt, Human
cagccugggcggcagagcaa

SEQ ID NO: 86989 - RNA, 21 nt, Human
cagccugggcggcagagcaag

SEQ ID NO: 86990 - RNA, 22 nt, Human
cagccugggcggcagagcaaga

SEQ ID NO: 86991 - RNA, 22 nt, Human
cagccugggcggcagagugaga

SEQ ID NO: 86992 - RNA, 22 nt, Human
cagccugggcgucagagugaga

SEQ ID NO: 86993 - RNA, 32 nt, Human
cagccugggcuacagagagcaagacucugucu

SEQ ID NO: 86994 - RNA, 21 nt, Human
cagccugggcuacagagcaag

SEQ ID NO: 86995 - RNA, 21 nt, Human
cagccugggcuacagagcgag

SEQ ID NO: 86996 - RNA, 22 nt, Human
cagccugggcuacagagcgaga

SEQ ID NO: 86997 - RNA, 22 nt, Human
cagccugggcuacagagugaga

SEQ ID NO: 86998 - RNA, 32 nt, Human
cagccugggcucugcccugccucagccgccuc

SEQ ID NO: 86999 - RNA, 32 nt, Human
cagccugggcucugggagacuugccuguguga

SEQ ID NO: 87000 - RNA, 32 nt, Human
cagccugggcuggggcuacaggucugucacua

SEQ ID NO: 87001 - RNA, 21 nt, Human
cagccuggggaacagagcaag

SEQ ID NO: 87002 - RNA, 22 nt, Human
cagccuggggaacagagcaaga

SEQ ID NO: 87003 - RNA, 20 nt, Human
cagccuggggacagagcaag

SEQ ID NO: 87004 - RNA, 21 nt, Human
cagccuggggacagagcaaga

SEQ ID NO: 87005 - RNA, 22 nt, Human
cagccuggggagacagagcgag

SEQ ID NO: 87006 - RNA, 32 nt, Human
cagccuggggcauuuaguguuuucccugguga

SEQ ID NO: 87007 - RNA, 32 nt, Human
cagccuggggccuggcagggaggucaggcccu

SEQ ID NO: 87008 - RNA, 23 nt, Human
cagccuggggcugacagagcaag

SEQ ID NO: 87009 - RNA, 24 nt, Human
cagccuggggcugacagagcaaga

SEQ ID NO: 87010 - RNA, 32 nt, Human
cagccuggggcugacagagcaagacacugucu

SEQ ID NO: 87011 - RNA, 32 nt, Human
cagccugggggaaggagcuuaauugcugagac

SEQ ID NO: 87012 - RNA, 23 nt, Human
cagccugggggacaagagugaga

SEQ ID NO: 87013 - RNA, 22 nt, Human
cagccugggggacagaaagaga

SEQ ID NO: 87014 - RNA, 21 nt, Human
cagccugggggacagagcaag

SEQ ID NO: 87015 - RNA, 22 nt, Human
cagccugggggacagagcaaga

SEQ ID NO: 87016 - RNA, 22 nt, Human
cagccugggggacagagcaagg

SEQ ID NO: 87017 - RNA, 21 nt, Human
cagccugggggacagagcgag

SEQ ID NO: 87018 - RNA, 22 nt, Human
cagccugggggacagagcgaga

SEQ ID NO: 87019 - RNA, 31 nt, Human
cagccugggggacagagcuacacuccauccc

SEQ ID NO: 87020 - RNA, 22 nt, Human
cagccugggggacagagugaga

SEQ ID NO: 87021 - RNA, 22 nt, Human
cagccuggggugacagagcaag

SEQ ID NO: 87022 - RNA, 22 nt, Human
cagccuggguaaaagagugaga

SEQ ID NO: 87023 - RNA, 22 nt, Human
cagccuggguaacaaagugaga

SEQ ID NO: 87024 - RNA, 21 nt, Human
cagccuggguaacagagcaag

SEQ ID NO: 87025 - RNA, 22 nt, Human
cagccuggguaacagagcaaga

SEQ ID NO: 87026 - RNA, 21 nt, Human
cagccuggguaacagagcgag

SEQ ID NO: 87027 - RNA, 22 nt, Human
cagccuggguaacagagcgaga

SEQ ID NO: 87028 - RNA, 21 nt, Human
cagccuggguaacagagcuag

SEQ ID NO: 87029 - RNA, 22 nt, Human
cagccuggguaacagagcuaga

SEQ ID NO: 87030 - RNA, 22 nt, Human
cagccuggguaacagagugaga

SEQ ID NO: 87031 - RNA, 32 nt, Human
cagccuggguaauauggcaaaaccccaucucu

SEQ ID NO: 87032 - RNA, 22 nt, Human
cagccugggugacaaagcaaga

SEQ ID NO: 87033 - RNA, 21 nt, Human
cagccugggugacaaaggaga

SEQ ID NO: 87034 - RNA, 22 nt, Human
cagccugggugacaaaguaaga

SEQ ID NO: 87035 - RNA, 22 nt, Human
cagccugggugacaaagucaga

SEQ ID NO: 87036 - RNA, 22 nt, Human
cagccugggugacaaagugaga

SEQ ID NO: 87037 - RNA, 22 nt, Human
cagccugggugacaagagcaag

SEQ ID NO: 87038 - RNA, 23 nt, Human
cagccugggugacaagagugaga

SEQ ID NO: 87039 - RNA, 22 nt, Human
cagccugggugacacagcgaga

SEQ ID NO: 87040 - RNA, 22 nt, Human
cagccugggugacacagugaga

SEQ ID NO: 87041 - RNA, 32 nt, Human
cagccugggugacacuccagccugggugacaa

SEQ ID NO: 87042 - RNA, 22 nt, Human
cagccugggugacagaacaaga

SEQ ID NO: 87043 - RNA, 32 nt, Human
cagccugggugacagaacaagacucugucuca

SEQ ID NO: 87044 - RNA, 32 nt, Human
cagccugggugacagaacaagacugucucaaa

SEQ ID NO: 87045 - RNA, 22 nt, Human
cagccugggugacagaacgaga

SEQ ID NO: 87046 - RNA, 32 nt, Human
cagccugggugacagaacgagacuccaccuca

SEQ ID NO: 87047 - RNA, 22 nt, Human
cagccugggugacagaauaaga

SEQ ID NO: 87048 - RNA, 20 nt, Human
cagccugggugacagaauga

SEQ ID NO: 87049 - RNA, 22 nt, Human
cagccugggugacagaaugaga

SEQ ID NO: 87050 - RNA, 22 nt, Human
cagccugggugacagaccgaga

SEQ ID NO: 87051 - RNA, 22 nt, Human
cagccugggugacagacuaaga

SEQ ID NO: 87052 - RNA, 22 nt, Human
cagccugggugacagagagaga

SEQ ID NO: 87053 - RNA, 21 nt, Human
cagccugggugacagagcaag

SEQ ID NO: 87054 - RNA, 22 nt, Human
cagccugggugacagagcaaga

SEQ ID NO: 87055 - RNA, 22 nt, Human
cagccugggugacagagcaagg

SEQ ID NO: 87056 - RNA, 32 nt, Human
cagccugggugacagagcaaggcucccaucuc

SEQ ID NO: 87057 - RNA, 21 nt, Human
cagccugggugacagagcagg

SEQ ID NO: 87058 - RNA, 22 nt, Human
cagccugggugacagagcagga

SEQ ID NO: 87059 - RNA, 22 nt, Human
cagccugggugacagagccaga

SEQ ID NO: 87060 - RNA, 21 nt, Human
cagccugggugacagagcgag

SEQ ID NO: 87061 - RNA, 22 nt, Human
cagccugggugacagagcgaga

SEQ ID NO: 87062 - RNA, 22 nt, Human
cagccugggugacagagcgagg

SEQ ID NO: 87063 - RNA, 22 nt, Human
cagccugggugacagagcguga

SEQ ID NO: 87064 - RNA, 22 nt, Human
cagccugggugacagagcuaga

SEQ ID NO: 87065 - RNA, 20 nt, Human
cagccugggugacagaggga

SEQ ID NO: 87066 - RNA, 22 nt, Human
cagccugggugacagagggaga

SEQ ID NO: 87067 - RNA, 21 nt, Human
cagccugggugacagaguaag

SEQ ID NO: 87068 - RNA, 22 nt, Human
cagccugggugacagaguaaga

SEQ ID NO: 87069 - RNA, 22 nt, Human
cagccugggugacagagucaga

SEQ ID NO: 87070 - RNA, 20 nt, Human
cagccugggugacagaguga

SEQ ID NO: 87071 - RNA, 21 nt, Human
cagccugggugacagagugag

SEQ ID NO: 87072 - RNA, 22 nt, Human
cagccugggugacagagugaga

SEQ ID NO: 87073 - RNA, 22 nt, Human
cagccugggugacagagugagg

SEQ ID NO: 87074 - RNA, 22 nt, Human
cagccugggugacagaguggga

SEQ ID NO: 87075 - RNA, 22 nt, Human
cagccugggugacagauugaga

SEQ ID NO: 87076 - RNA, 22 nt, Human
cagccugggugacagcacgaga

SEQ ID NO: 87077 - RNA, 22 nt, Human
cagccugggugacagcgcgaga

SEQ ID NO: 87078 - RNA, 22 nt, Human
cagccugggugacagcguaaga

SEQ ID NO: 87079 - RNA, 21 nt, Human
cagccugggugacagggcaag

SEQ ID NO: 87080 - RNA, 22 nt, Human
cagccugggugacagggcaaga

SEQ ID NO: 87081 - RNA, 22 nt, Human
cagccugggugacagggcgaga

SEQ ID NO: 87082 - RNA, 20 nt, Human
cagccugggugacaggguga

SEQ ID NO: 87083 - RNA, 22 nt, Human
cagccugggugacagggugaga

SEQ ID NO: 87084 - RNA, 20 nt, Human
cagccugggugacaguguga

SEQ ID NO: 87085 - RNA, 22 nt, Human
cagccugggugacauagcaaga

SEQ ID NO: 87086 - RNA, 22 nt, Human
cagccugggugaccaaacgaga

SEQ ID NO: 87087 - RNA, 22 nt, Human
cagccugggugaccgagugaga

SEQ ID NO: 87088 - RNA, 19 nt, Human
cagccugggugacgaguga

SEQ ID NO: 87089 - RNA, 22 nt, Human
cagccugggugacggagugaga

SEQ ID NO: 87090 - RNA, 22 nt, Human
cagccugggugacugagcaaga

SEQ ID NO: 87091 - RNA, 22 nt, Human
cagccugggugacugagcgaga

SEQ ID NO: 87092 - RNA, 32 nt, Human
cagccugggugagaagagcgaaacuccgucuc

SEQ ID NO: 87093 - RNA, 22 nt, Human
cagccugggugagagagugaga

SEQ ID NO: 87094 - RNA, 32 nt, Human
cagccugggugaggagagcgagacucuuucug

SEQ ID NO: 87095 - RNA, 22 nt, Human
cagccugggugauagagcaaga

SEQ ID NO: 87096 - RNA, 22 nt, Human
cagccugggugauagagugaga

SEQ ID NO: 87097 - RNA, 32 nt, Human
cagccugggugauccuggagaguuucccaggg

SEQ ID NO: 87098 - RNA, 22 nt, Human
cagccuggguggcagagcgaga

SEQ ID NO: 87099 - RNA, 22 nt, Human
cagccuggguggcagagugaga

SEQ ID NO: 87100 - RNA, 22 nt, Human
cagccugggugucagagcgaga

SEQ ID NO: 87101 - RNA, 21 nt, Human
cagccuggguuacagagcgag

SEQ ID NO: 87102 - RNA, 22 nt, Human
cagccuggguuacagagcgaga

SEQ ID NO: 87103 - RNA, 19 nt, Human
cagccuggguucuuccaca

SEQ ID NO: 87104 - RNA, 32 nt, Human
cagccugguagaauugggaagcugggggaagg

SEQ ID NO: 87105 - RNA, 32 nt, Human
cagccugguaucagggaaauugagacuuauuu

SEQ ID NO: 87106 - RNA, 21 nt, Human
cagccuggucaacaaagcaag

SEQ ID NO: 87107 - RNA, 21 nt, Human
cagccuggucaacagagcaag

SEQ ID NO: 87108 - RNA, 22 nt, Human
cagccuggucaacagagugaga

SEQ ID NO: 87109 - RNA, 22 nt, Human
cagccuggucaacauagugaaa

SEQ ID NO: 87110 - RNA, 32 nt, Human
cagccuggucaacauggcaaaagcccaucucu

SEQ ID NO: 87111 - RNA, 32 nt, Human
cagccuggucaacauggcgaaaccccaucucu

SEQ ID NO: 87112 - RNA, 32 nt, Human
cagccuggucaacaugguaaaaccccauuucu

SEQ ID NO: 87113 - RNA, 22 nt, Human
cagccuggucaacauggugaaa

SEQ ID NO: 87114 - RNA, 32 nt, Human
cagccuggucaacauggugaaaccccaucucc

SEQ ID NO: 87115 - RNA, 32 nt, Human
cagccuggucaacauggugaaaccccaucucu

SEQ ID NO: 87116 - RNA, 32 nt, Human
cagccuggucaacauggugaaacccccuaucu

SEQ ID NO: 87117 - RNA, 32 nt, Human
cagccuggucaacauggugaaaccccgucucu

SEQ ID NO: 87118 - RNA, 32 nt, Human
cagccuggucaacauggugaaaccccuucucu

SEQ ID NO: 87119 - RNA, 32 nt, Human
cagccuggucaagauggugaaaccccaucucu

SEQ ID NO: 87120 - RNA, 32 nt, Human
cagccuggucaauauggugaaaccccaucucu

SEQ ID NO: 87121 - RNA, 32 nt, Human
cagccugguccacauggcaaaaccccaucugu

SEQ ID NO: 87122 - RNA, 22 nt, Human
cagccuggucgacagagugaga

SEQ ID NO: 87123 - RNA, 32 nt, Human
cagccuggucucaaacuccccagcuaaagcag

SEQ ID NO: 87124 - RNA, 32 nt, Human
cagccuggucucaaacuccugaccucaaguga

SEQ ID NO: 87125 - RNA, 32 nt, Human
cagccuggucucaaacuccuguccucaaguga

SEQ ID NO: 87126 - RNA, 32 nt, Human
cagccuggucucaaauuccuggccucaagcaa

SEQ ID NO: 87127 - RNA, 20 nt, Human
cagccuggugacagagcaag

SEQ ID NO: 87128 - RNA, 21 nt, Human
cagccuggugacagagcaaga

SEQ ID NO: 87129 - RNA, 20 nt, Human
cagccuggugacagagcgag

SEQ ID NO: 87130 - RNA, 21 nt, Human
cagccuggugacagagcgaga

SEQ ID NO: 87131 - RNA, 21 nt, Human
cagccuggugacagagugaga

SEQ ID NO: 87132 - RNA, 32 nt, Human
cagccuggugacagagugagacuccaucucaa

SEQ ID NO: 87133 - RNA, 32 nt, Human
cagccuggugacagagugagacuccgucucaa

SEQ ID NO: 87134 - RNA, 32 nt, Human
cagccuggugacagagugagacucuguuucaa

SEQ ID NO: 87135 - RNA, 21 nt, Human
cagccuggugacagcgugaga

SEQ ID NO: 87136 - RNA, 21 nt, Human
cagccuggugauagaacgaga

SEQ ID NO: 87137 - RNA, 21 nt, Human
cagccuggugcccagugcuca

SEQ ID NO: 87138 - RNA, 32 nt, Human
cagccuggugugcugaggguaguuggauuuca

SEQ ID NO: 87139 - RNA, 20 nt, Human
cagccugguuacagagcgag

SEQ ID NO: 87140 - RNA, 21 nt, Human
cagccugguuacagagcgaga

SEQ ID NO: 87141 - RNA, 32 nt, Human
cagccugguuagguggauaccugcccugacau

SEQ ID NO: 87142 - RNA, 21 nt, Human
cagccugguugacagagcaag

SEQ ID NO: 87143 - RNA, 22 nt, Human
cagccugguugacagagcaaga

SEQ ID NO: 87144 - RNA, 22 nt, Human
cagccugguugacagagugaga

SEQ ID NO: 87145 - RNA, 20 nt, Human
cagccuguaaguucuccaca

SEQ ID NO: 87146 - RNA, 16 nt, Human
cagccuguacuggaug

SEQ ID NO: 87147 - RNA, 32 nt, Human
cagccuguaggaaaccaaagaugggaaguggc

SEQ ID NO: 87148 - RNA, 32 nt, Human
cagccuguccaacauggugaaacccccaucuc

SEQ ID NO: 87149 - RNA, 32 nt, Human
cagccuguccaacguggugaaaccccgucugu

SEQ ID NO: 87150 - RNA, 32 nt, Human
cagccuguccacuaacuugucuuugagaacaa

SEQ ID NO: 87151 - RNA, 32 nt, Human
cagccuguccgcagccuggugccgugaaaauc

SEQ ID NO: 87152 - RNA, 18 nt, Human
cagccuguccugggccca

SEQ ID NO: 87153 - RNA, 32 nt, Human
cagccuguccuguugcccacugagcuucaggc

SEQ ID NO: 87154 - RNA, 32 nt, Human
cagccuguccuuuccccagcuccuauaccucu

SEQ ID NO: 87155 - RNA, 21 nt, Human
cagccugucgcggcccggccg

SEQ ID NO: 87156 - RNA, 32 nt, Human
cagccugucugcucucuccuugcucaacaagg

SEQ ID NO: 87157 - RNA, 19 nt, Human
cagccugugaaucuccaca

SEQ ID NO: 87158 - RNA, 21 nt, Human
cagccugugcaacagagccag

SEQ ID NO: 87159 - RNA, 22 nt, Human
cagccugugcaacagagcgagg

SEQ ID NO: 87160 - RNA, 32 nt, Human
cagccugugcuccccucagaagcucugcucuu

SEQ ID NO: 87161 - RNA, 32 nt, Human
cagccugugcuggcugcaauacuguggugcuu

SEQ ID NO: 87162 - RNA, 18 nt, Human
cagccuguggccuccaca

SEQ ID NO: 87163 - RNA, 32 nt, Human
cagccuguguaguccagcugugcucaaaugga

SEQ ID NO: 87164 - RNA, 22 nt, Human
cagccugugugacagaaugaga

SEQ ID NO: 87165 - RNA, 21 nt, Human
cagccugugugacagagcaag

SEQ ID NO: 87166 - RNA, 22 nt, Human
cagccugugugacagagcaaga

SEQ ID NO: 87167 - RNA, 32 nt, Human
cagccugugugggucaugaggcuggggcccag

SEQ ID NO: 87168 - RNA, 32 nt, Human
cagccuguucaacauggcgaaaccccauucua

SEQ ID NO: 87169 - RNA, 32 nt, Human
cagccuguuccugcacuccacccugcuggccc

SEQ ID NO: 87170 - RNA, 32 nt, Human
cagccuguugcuggcccucgcuuugcgcaaca

SEQ ID NO: 87171 - RNA, 32 nt, Human
cagccuguuugggaagcagcagucucuccuuc

SEQ ID NO: 87172 - RNA, 19 nt, Human
cagccuuaaauccuuuaca

SEQ ID NO: 87173 - RNA, 18 nt, Human
cagccuuaauaccugcca

SEQ ID NO: 87174 - RNA, 17 nt, Human
cagccuuaaucuacaua

SEQ ID NO: 87175 - RNA, 21 nt, Human
cagccuuaaucucucuuuaca

SEQ ID NO: 87176 - RNA, 22 nt, Human
cagccuuaccaacaugaugaaa

SEQ ID NO: 87177 - RNA, 32 nt, Human
cagccuuaccaacauggagaaaccccaucucu

SEQ ID NO: 87178 - RNA, 32 nt, Human
cagccuuagggaacccagaaaguaguggggag

SEQ ID NO: 87179 - RNA, 32 nt, Human
cagccuuaucacuucccucccuuuagaaacuc

SEQ ID NO: 87180 - RNA, 32 nt, Human
cagccuuaucuaggaagugucuugccagguca

SEQ ID NO: 87181 - RNA, 32 nt, Human
cagccuucaagcauuccauuacgccccaucuc

SEQ ID NO: 87182 - RNA, 32 nt, Human
cagccuucacuuuucugaguucuugaagcauu

SEQ ID NO: 87183 - RNA, 23 nt, Human
cagccuucagaccaaggccacua

SEQ ID NO: 87184 - RNA, 32 nt, Human
cagccuucagcagcagcucacacccuaccuuc

SEQ ID NO: 87185 - RNA, 32 nt, Human
cagccuucagccaggaaaauucuacagcuuuc

SEQ ID NO: 87186 - RNA, 32 nt, Human
cagccuucaguuagagcucacaucuuugucuc

SEQ ID NO: 87187 - RNA, 21 nt, Human
cagccuucaguucccuuccac

SEQ ID NO: 87188 - RNA, 32 nt, Human
cagccuucaugccuuccccacccuccagcucc

SEQ ID NO: 87189 - RNA, 23 nt, Human
cagccuucauuaggaggccgagg

SEQ ID NO: 87190 - RNA, 32 nt, Human
cagccuuccaaaagugcugggauuacaggcgu

SEQ ID NO: 87191 - RNA, 21 nt, Human
cagccuuccaggggaacacuc

SEQ ID NO: 87192 - RNA, 32 nt, Human
cagccuuccauggcagugcaaagggaaccuuc

SEQ ID NO: 87193 - RNA, 32 nt, Human
cagccuucccaacauggugaaaccccaucucu

SEQ ID NO: 87194 - RNA, 32 nt, Human
cagccuucccacauaaaaccccuugagauggc

SEQ ID NO: 87195 - RNA, 32 nt, Human
cagccuucccaccccauaccucccucccgauc

SEQ ID NO: 87196 - RNA, 32 nt, Human
cagccuucccaggucuccugauuucaaguaca

SEQ ID NO: 87197 - RNA, 23 nt, Human
cagccuucccccgggcuccacca

SEQ ID NO: 87198 - RNA, 17 nt, Human
cagccuucccccuccca

SEQ ID NO: 87199 - RNA, 17 nt, Human
cagccuuccccucuaca

SEQ ID NO: 87200 - RNA, 32 nt, Human
cagccuuccuccccaucucccauucuccaucc

SEQ ID NO: 87201 - RNA, 32 nt, Human
cagccuuccuccgccuccgccucucucuccuc

SEQ ID NO: 87202 - RNA, 25 nt, Human
cagccuuccugaccuccuccugccc

SEQ ID NO: 87203 - RNA, 32 nt, Human
cagccuuccugccucagcuccccugcugucuc

SEQ ID NO: 87204 - RNA, 20 nt, Human
cagccuuccugccuucacuc

SEQ ID NO: 87205 - RNA, 30 nt, Human
cagccuuccuggcagugagaaagacagaca

SEQ ID NO: 87206 - RNA, 32 nt, Human
cagccuuccugucaacagcgacaggaaaucuc

SEQ ID NO: 87207 - RNA, 32 nt, Human
cagccuuccuucccucuccuugucucauguug

SEQ ID NO: 87208 - RNA, 32 nt, Human
cagccuuccuuguaucucuccagacucggaca

SEQ ID NO: 87209 - RNA, 32 nt, Human
cagccuucuccaccaugagccucagacuugau

SEQ ID NO: 87210 - RNA, 32 nt, Human
cagccuucuccacugucucauuuccuuuuccc

SEQ ID NO: 87211 - RNA, 32 nt, Human
cagccuucuccaggacaaccugcuggaacgca

SEQ ID NO: 87212 - RNA, 32 nt, Human
cagccuucuccccaaccaggauguuggccugg

SEQ ID NO: 87213 - RNA, 32 nt, Human
cagccuucuccccagugagaacaguuucucug

SEQ ID NO: 87214 - RNA, 32 nt, Human
cagccuucucugcagucccuucugcccugccg

SEQ ID NO: 87215 - RNA, 32 nt, Human
cagccuucugcugcagcagaggcucacccagc

SEQ ID NO: 87216 - RNA, 32 nt, Human
cagccuucuggcacugcaggccuagguuggag

SEQ ID NO: 87217 - RNA, 32 nt, Human
cagccuucugguguguucuaagagcaggcucc

SEQ ID NO: 87218 - RNA, 32 nt, Human
cagccuucuucugaccagcuuccucuucugau

SEQ ID NO: 87219 - RNA, 32 nt, Human
cagccuucuugcugcuaucaacucccaagaga

SEQ ID NO: 87220 - RNA, 21 nt, Human
cagccuucuuuuucuuccaua

SEQ ID NO: 87221 - RNA, 32 nt, Human
cagccuugaaggcagcagggugcccaggugaa

SEQ ID NO: 87222 - RNA, 32 nt, Human
cagccuugacaacauggugaaaccccaucucu

SEQ ID NO: 87223 - RNA, 20 nt, Human
cagccuugaccauucuccac

SEQ ID NO: 87224 - RNA, 18 nt, Human
cagccuugacccccgaca

SEQ ID NO: 87225 - RNA, 16 nt, Human
cagccuugaccuccca

SEQ ID NO: 87226 - RNA, 19 nt, Human
cagccuugaccucccggcu

SEQ ID NO: 87227 - RNA, 32 nt, Human
cagccuugaccuuccagccugccaaguagcug

SEQ ID NO: 87228 - RNA, 17 nt, Human
cagccuugaccuuccca

SEQ ID NO: 87229 - RNA, 16 nt, Human
cagccuugacugcaca

SEQ ID NO: 87230 - RNA, 18 nt, Human
cagccuugagaacuccac

SEQ ID NO: 87231 - RNA, 19 nt, Human
cagccuugagaugcuucac

SEQ ID NO: 87232 - RNA, 19 nt, Human
cagccuugagccccuccac

SEQ ID NO: 87233 - RNA, 17 nt, Human
cagccuugagccgccca

SEQ ID NO: 87234 - RNA, 32 nt, Human
cagccuugagguuggcccuccucaaggucagc

SEQ ID NO: 87235 - RNA, 17 nt, Human
cagccuugaguugcaua

SEQ ID NO: 87236 - RNA, 16 nt, Human
cagccuugaucgcaca

SEQ ID NO: 87237 - RNA, 18 nt, Human
cagccuugaucugucugc

SEQ ID NO: 87238 - RNA, 16 nt, Human
cagccuugaugccaua

SEQ ID NO: 87239 - RNA, 21 nt, Human
cagccuugauggcugucggca

SEQ ID NO: 87240 - RNA, 17 nt, Human
cagccuugauuaccaua

SEQ ID NO: 87241 - RNA, 15 nt, Human
cagccuugauuuaca

SEQ ID NO: 87242 - RNA, 18 nt, Human
cagccuugcacuuccaca

SEQ ID NO: 87243 - RNA, 19 nt, Human
cagccuugcccauucucua

SEQ ID NO: 87244 - RNA, 18 nt, Human
cagccuugccccucccca

SEQ ID NO: 87245 - RNA, 20 nt, Human
cagccuugccccuccugcuc

SEQ ID NO: 87246 - RNA, 16 nt, Human
cagccuugccgccaca

SEQ ID NO: 87247 - RNA, 21 nt, Human
cagccuugccuccuccugucc

SEQ ID NO: 87248 - RNA, 18 nt, Human
cagccuugcgcuguccca

SEQ ID NO: 87249 - RNA, 18 nt, Human
cagccuugcguuuccaca

SEQ ID NO: 87250 - RNA, 16 nt, Human
cagccuugcugccaca

SEQ ID NO: 87251 - RNA, 18 nt, Human
cagccuuggaacuaccac

SEQ ID NO: 87252 - RNA, 18 nt, Human
cagccuuggaacuccuca

SEQ ID NO: 87253 - RNA, 32 nt, Human
cagccuuggaacuccucaagaaccugaagauu

SEQ ID NO: 87254 - RNA, 32 nt, Human
cagccuuggagacacccaggaggaaggccgug

SEQ ID NO: 87255 - RNA, 32 nt, Human
cagccuuggcaacacagugugagacccugucu

SEQ ID NO: 87256 - RNA, 22 nt, Human
cagccuuggcaacagagugaga

SEQ ID NO: 87257 - RNA, 32 nt, Human
cagccuuggcaacauggugaaaccccaucucc

SEQ ID NO: 87258 - RNA, 18 nt, Human
cagccuuggcaccuccca

SEQ ID NO: 87259 - RNA, 20 nt, Human
cagccuuggcccugcugcug

SEQ ID NO: 87260 - RNA, 21 nt, Human
cagccuuggcgacagagcgag

SEQ ID NO: 87261 - RNA, 32 nt, Human
cagccuuggcuccugguauaggccgcuuuccu

SEQ ID NO: 87262 - RNA, 32 nt, Human
cagccuuggcuuuuccucuccugggugcucug

SEQ ID NO: 87263 - RNA, 32 nt, Human
cagccuugggcccuuccaggagucauggucug

SEQ ID NO: 87264 - RNA, 32 nt, Human
cagccuuggggauggacuugcccacaccucca

SEQ ID NO: 87265 - RNA, 21 nt, Human
cagccuugggguccccgccca

SEQ ID NO: 87266 - RNA, 18 nt, Human
cagccuugggguuuccca

SEQ ID NO: 87267 - RNA, 27 nt, Human
cagccuuggucucaagaggccgagagg

SEQ ID NO: 87268 - RNA, 22 nt, Human
cagccuuggugacagagugaga

SEQ ID NO: 87269 - RNA, 16 nt, Human
cagccuuggugaggug

SEQ ID NO: 87270 - RNA, 32 nt, Human
cagccuugguuuccugcugagcuccaguauuu

SEQ ID NO: 87271 - RNA, 18 nt, Human
cagccuuguauuggccac

SEQ ID NO: 87272 - RNA, 16 nt, Human
cagccuuguccacaca

SEQ ID NO: 87273 - RNA, 19 nt, Human
cagccuugugcuuacccca

SEQ ID NO: 87274 - RNA, 32 nt, Human
cagccuuguggcuagaguacagugggguagac

SEQ ID NO: 87275 - RNA, 19 nt, Human
cagccuuguguuuucugua

SEQ ID NO: 87276 - RNA, 32 nt, Human
cagccuuguguuuucuguaaccccuguuugug

SEQ ID NO: 87277 - RNA, 18 nt, Human
cagccuuguuccucagca

SEQ ID NO: 87278 - RNA, 32 nt, Human
cagccuuguuuguacuguaugccuucagcauu

SEQ ID NO: 87279 - RNA, 32 nt, Human
cagccuuuaccaugcgcugagugagaagcuga

SEQ ID NO: 87280 - RNA, 32 nt, Human
cagccuuuacucauucacauacaccaucacac

SEQ ID NO: 87281 - RNA, 20 nt, Human
cagccuuuacuccucugccc

SEQ ID NO: 87282 - RNA, 32 nt, Human
cagccuuuauccugauaccaagccagcucugc

SEQ ID NO: 87283 - RNA, 32 nt, Human
cagccuuucaagcagaggacagaaggguccuu

SEQ ID NO: 87284 - RNA, 21 nt, Human
cagccuuuccacccucaucca

SEQ ID NO: 87285 - RNA, 15 nt, Human
cagccuuuccaggcc

SEQ ID NO: 87286 - RNA, 32 nt, Human
cagccuuuccaggguuaaccacugugguggug

SEQ ID NO: 87287 - RNA, 32 nt, Human
cagccuuuccagugccagcccaucaaaagcaa

SEQ ID NO: 87288 - RNA, 22 nt, Human
cagccuuucccaugcucugccc

SEQ ID NO: 87289 - RNA, 32 nt, Human
cagccuuuccccagccaggagagaccaccuaa

SEQ ID NO: 87290 - RNA, 32 nt, Human
cagccuuuccccaggcaggaguugggguuggg

SEQ ID NO: 87291 - RNA, 32 nt, Human
cagccuuucgggaggcugagacaggagaaucg

SEQ ID NO: 87292 - RNA, 18 nt, Human
cagccuuucggucuucua

SEQ ID NO: 87293 - RNA, 32 nt, Human
cagccuuucuccaggugggagugcaguggcau

SEQ ID NO: 87294 - RNA, 32 nt, Human
cagccuuucucccauuucaguaagcaucauca

SEQ ID NO: 87295 - RNA, 20 nt, Human
cagccuuucucugcagccau

SEQ ID NO: 87296 - RNA, 21 nt, Human
cagccuuugaggauuuucuau

SEQ ID NO: 87297 - RNA, 18 nt, Human
cagccuuugauuucucca

SEQ ID NO: 87298 - RNA, 32 nt, Human
cagccuuugccaucggaacugccuuauuaaag

SEQ ID NO: 87299 - RNA, 32 nt, Human
cagccuuuggccacagcaccaccagcugcugu

SEQ ID NO: 87300 - RNA, 32 nt, Human
cagccuuuguuguggaacaugacuucaucaug

SEQ ID NO: 87301 - RNA, 32 nt, Human
cagccuuuuacccucuugccuccugccuccgc

SEQ ID NO: 87302 - RNA, 32 nt, Human
cagccuuuuugaaggggacacagucuaggagg

SEQ ID NO: 87303 - RNA, 32 nt, Human
cagcgaaauggaggggugugugucuaaccuaa

SEQ ID NO: 87304 - RNA, 32 nt, Human
cagcgaacacacacagguguccugccguugga

SEQ ID NO: 87305 - RNA, 32 nt, Human
cagcgaagagagagagcuguaggccagcugcc

SEQ ID NO: 87306 - RNA, 32 nt, Human
cagcgaagcaggcaggaaaggcucaagugauc

SEQ ID NO: 87307 - RNA, 32 nt, Human
cagcgaagcuguugguugaaucauaaugccuu

SEQ ID NO: 87308 - RNA, 32 nt, Human
cagcgaagcuguugguugaaucauaauuaaug

SEQ ID NO: 87309 - RNA, 32 nt, Human
cagcgaagucaccugcucucugccacucuguc

SEQ ID NO: 87310 - RNA, 32 nt, Human
cagcgacaacagcaccagagccaggcagucac

SEQ ID NO: 87311 - RNA, 32 nt, Human
cagcgacaaucaguggauggugcugucuaugc

SEQ ID NO: 87312 - RNA, 20 nt, Human
cagcgacagaccuaucugaa

SEQ ID NO: 87313 - RNA, 32 nt, Human
cagcgaccccuuccccagcccgacaggugagc

SEQ ID NO: 87314 - RNA, 32 nt, Human
cagcgaccucaaguguccugaaagcuuacauu

SEQ ID NO: 87315 - RNA, 21 nt, Human
cagcgaccucccuuccagccc

SEQ ID NO: 87316 - RNA, 32 nt, Human
cagcgacggggccggggugauggugcaggugc

SEQ ID NO: 87317 - RNA, 32 nt, Human
cagcgacuuccuggaaccucaaacaauguggg

SEQ ID NO: 87318 - RNA, 32 nt, Human
cagcgacuugggaggcugagguggagaauugc

SEQ ID NO: 87319 - RNA, 32 nt, Human
cagcgacuugggaggcugaggugggaggauug

SEQ ID NO: 87320 - RNA, 23 nt, Human
cagcgagaacaucccagcuccac

SEQ ID NO: 87321 - RNA, 32 nt, Human
cagcgagacuccgucucaaaaagaaaaaguuu

SEQ ID NO: 87322 - RNA, 32 nt, Human
cagcgagaggcagagaaagaagagacaggagg

SEQ ID NO: 87323 - RNA, 32 nt, Human
cagcgagaggcagaggcggcggcggcggggag

SEQ ID NO: 87324 - RNA, 32 nt, Human
cagcgagauccagggacagagucucagccucg

SEQ ID NO: 87325 - RNA, 32 nt, Human
cagcgagccaccacagccaccagucccagaac

SEQ ID NO: 87326 - RNA, 32 nt, Human
cagcgagccagcccuguauuucuagcccagca

SEQ ID NO: 87327 - RNA, 32 nt, Human
cagcgagcccagagggauuuugccgcugcuuc

SEQ ID NO: 87328 - RNA, 32 nt, Human
cagcgagccccugguggcagugggagcugccu

SEQ ID NO: 87329 - RNA, 32 nt, Human
cagcgagcccgggaguuggugccgcaagaccu

SEQ ID NO: 87330 - RNA, 17 nt, Human
cagcgagccgugagaug

SEQ ID NO: 87331 - RNA, 32 nt, Human
cagcgagccugccccuuuucuucaagggacug

SEQ ID NO: 87332 - RNA, 32 nt, Human
cagcgagcggcccugaugcaggccaucaaguu

SEQ ID NO: 87333 - RNA, 32 nt, Human
cagcgaggagugaagcugagccuggccucaca

SEQ ID NO: 87334 - RNA, 32 nt, Human
cagcgaggaguucuuccgggaggacgacggug

SEQ ID NO: 87335 - RNA, 32 nt, Human
cagcgaggccaccacaucucaggaugaggcuc

SEQ ID NO: 87336 - RNA, 32 nt, Human
cagcgaggcgaagagggaaggaagguggauuu

SEQ ID NO: 87337 - RNA, 32 nt, Human
cagcgaggcgaggcugccucugggugaguggc

SEQ ID NO: 87338 - RNA, 20 nt, Human
cagcgaggcugggcuggcca

SEQ ID NO: 87339 - RNA, 32 nt, Human
cagcgaggcuuccucuggggaagacagugagc

SEQ ID NO: 87340 - RNA, 32 nt, Human
cagcgagggacacugaguggcccuucauguac

SEQ ID NO: 87341 - RNA, 32 nt, Human
cagcgagggcaaccuccagauccaucacgugg

SEQ ID NO: 87342 - RNA, 32 nt, Human
cagcgagggccacuacacuccagccuggguga

SEQ ID NO: 87343 - RNA, 22 nt, Human
cagcgagguucuccaggaccuu

SEQ ID NO: 87344 - RNA, 32 nt, Human
cagcgagugcagauugcucccccgcggccgca

SEQ ID NO: 87345 - RNA, 32 nt, Human
cagcgaucggagccucacggggaaacaaggga

SEQ ID NO: 87346 - RNA, 32 nt, Human
cagcgaugauggcugcugucauucaagcccau

SEQ ID NO: 87347 - RNA, 32 nt, Human
cagcgaugcucccagcccaagagcccaugggu

SEQ ID NO: 87348 - RNA, 32 nt, Human
cagcgauggugacuugaccuugccaagaccug

SEQ ID NO: 87349 - RNA, 30 nt, Human
cagcgaugucuccaccaccgcugcugcaac

SEQ ID NO: 87350 - RNA, 32 nt, Human
cagcgauucuccugccucccugccucagccug

SEQ ID NO: 87351 - RNA, 32 nt, Human
cagcgcaacauggcaggagcuggaggagggaa

SEQ ID NO: 87352 - RNA, 32 nt, Human
cagcgcaaggguuucugguuugccaagaagaa

SEQ ID NO: 87353 - RNA, 32 nt, Human
cagcgcacagccguugcaccaggguacugcag

SEQ ID NO: 87354 - RNA, 32 nt, Human
cagcgcacagccugggcagcucagccugucag

SEQ ID NO: 87355 - RNA, 32 nt, Human
cagcgcacagucaggaagggcguggaccaggg

SEQ ID NO: 87356 - RNA, 32 nt, Human
cagcgcacugcaaccuggaccuccugggcuca

SEQ ID NO: 87357 - RNA, 32 nt, Human
cagcgcagaggacuguucuauauacauacaau

SEQ ID NO: 87358 - RNA, 32 nt, Human
cagcgcagaggcuuuggaggcugcagugucuc

SEQ ID NO: 87359 - RNA, 24 nt, Human
cagcgcagcauuuauuuuaugaua

SEQ ID NO: 87360 - RNA, 32 nt, Human
cagcgcaggcugccacccaccugggcgaccuc

SEQ ID NO: 87361 - RNA, 32 nt, Human
cagcgcagggggaacccagggagcgcgauggg

SEQ ID NO: 87362 - RNA, 32 nt, Human
cagcgcaggucugaggagcugagaagggaggc

SEQ ID NO: 87363 - RNA, 32 nt, Human
cagcgcaguucccagcugucucccugcuccuc

SEQ ID NO: 87364 - RNA, 32 nt, Human
cagcgccaacagcaacgcggaccacgaaggau

SEQ ID NO: 87365 - RNA, 32 nt, Human
cagcgccaccucuugucagugcucggcuguaa

SEQ ID NO: 87366 - RNA, 23 nt, Human
cagcgccagccucuucgcuccgu

SEQ ID NO: 87367 - RNA, 32 nt, Human
cagcgccaggagggggagcugggcaugggcac

SEQ ID NO: 87368 - RNA, 32 nt, Human
cagcgccaggagguggaccccagagugugagu

SEQ ID NO: 87369 - RNA, 32 nt, Human
cagcgccauggagccgggggaggugaaggacc

SEQ ID NO: 87370 - RNA, 32 nt, Human
cagcgcccacacccuucuagcaccuccugaca

SEQ ID NO: 87371 - RNA, 32 nt, Human
cagcgcccacagauuccagagugcuuacagaa

SEQ ID NO: 87372 - RNA, 32 nt, Human
cagcgcccagccuggccccaagcauggaaacg

SEQ ID NO: 87373 - RNA, 32 nt, Human
cagcgcccccagaacauacacugugaacucaa

SEQ ID NO: 87374 - RNA, 32 nt, Human
cagcgccccucacuugcucuggcuucagaagu

SEQ ID NO: 87375 - RNA, 32 nt, Human
cagcgccccuccugcccgccccuagacggccu

SEQ ID NO: 87376 - RNA, 22 nt, Human
cagcgccccuggacgggccggg

SEQ ID NO: 87377 - RNA, 32 nt, Human
cagcgccccuggccuguggacgcccugccugc

SEQ ID NO: 87378 - RNA, 32 nt, Human
cagcgcccggccaaucuggagcuguuucuguu

SEQ ID NO: 87379 - RNA, 32 nt, Human
cagcgcccggcugggacagucucuccauaccc

SEQ ID NO: 87380 - RNA, 32 nt, Human
cagcgcccuccagaguuaccuggggaggaccg

SEQ ID NO: 87381 - RNA, 32 nt, Human
cagcgcccuccucugcuguugcagcugcaagg

SEQ ID NO: 87382 - RNA, 32 nt, Human
cagcgcccuggaccaugcaguucggcggccgc

SEQ ID NO: 87383 - RNA, 19 nt, Human
cagcgccgacguccugccc

SEQ ID NO: 87384 - RNA, 32 nt, Human
cagcgccgagcccagcccugaagucguuucgg

SEQ ID NO: 87385 - RNA, 19 nt, Human
cagcgccgcccuccugcuc

SEQ ID NO: 87386 - RNA, 19 nt, Human
cagcgccgccgacacccac

SEQ ID NO: 87387 - RNA, 20 nt, Human
cagcgccgccgccugccccg

SEQ ID NO: 87388 - RNA, 20 nt, Human
cagcgccgccuccccgcccg

SEQ ID NO: 87389 - RNA, 32 nt, Human
cagcgccgcggcgacgaacccagggagaaaag

SEQ ID NO: 87390 - RNA, 20 nt, Human
cagcgccgcugcagcuggcc

SEQ ID NO: 87391 - RNA, 32 nt, Human
cagcgccggucgggagcgcagcgcggcgcagc

SEQ ID NO: 87392 - RNA, 21 nt, Human
cagcgccuaggcgaccuggag

SEQ ID NO: 87393 - RNA, 32 nt, Human
cagcgccuccccucaccgacuuuggccuuuuu

SEQ ID NO: 87394 - RNA, 32 nt, Human
cagcgccuccugacucagcccaggaccggcuu

SEQ ID NO: 87395 - RNA, 32 nt, Human
cagcgccugccuccucccuccugggucuuccc

SEQ ID NO: 87396 - RNA, 32 nt, Human
cagcgccugccugcuggggcugccugcaugcc

SEQ ID NO: 87397 - RNA, 32 nt, Human
cagcgccugugcagaccucccugcaggccgca

SEQ ID NO: 87398 - RNA, 32 nt, Human
cagcgcgagggcccugggcaaggcccgacaga

SEQ ID NO: 87399 - RNA, 32 nt, Human
cagcgcgcagagacugcagccucccaaucgug

SEQ ID NO: 87400 - RNA, 32 nt, Human
cagcgcggagggagcagagggaguccauggag

SEQ ID NO: 87401 - RNA, 32 nt, Human
cagcgcgggaggcggcgaagggcgcaggagca

SEQ ID NO: 87402 - RNA, 32 nt, Human
cagcgcgguucacacugagacccagcccucuc

SEQ ID NO: 87403 - RNA, 23 nt, Human
cagcgcguuugcacuuugugaua

SEQ ID NO: 87404 - RNA, 32 nt, Human
cagcgcucauuuccagcugagccacgccugcc

SEQ ID NO: 87405 - RNA, 32 nt, Human
cagcgcuccagccuggucgacagagugagacu

SEQ ID NO: 87406 - RNA, 22 nt, Human
cagcgcuccucccccugcuccg

SEQ ID NO: 87407 - RNA, 32 nt, Human
cagcgcucgcagcuguccggggcuucucuggc

SEQ ID NO: 87408 - RNA, 32 nt, Human
cagcgcucgcuccuccguuucuucccaccggc

SEQ ID NO: 87409 - RNA, 32 nt, Human
cagcgcucuuggaggccugcaaaggaagagca

SEQ ID NO: 87410 - RNA, 18 nt, Human
cagcgcugacguuuucuc

SEQ ID NO: 87411 - RNA, 32 nt, Human
cagcgcugagauuuuucuugcagauccaucag

SEQ ID NO: 87412 - RNA, 32 nt, Human
cagcgcugccguguggcccauggaugccccag

SEQ ID NO: 87413 - RNA, 32 nt, Human
cagcgcugccugggcauuguuggugcucaggu

SEQ ID NO: 87414 - RNA, 32 nt, Human
cagcgcugcugguagccaggggaggggucugc

SEQ ID NO: 87415 - RNA, 32 nt, Human
cagcgcugcuguggcuaacaccacuguguaug

SEQ ID NO: 87416 - RNA, 32 nt, Human
cagcgcuguaacugcaggauggggaagcagaa

SEQ ID NO: 87417 - RNA, 32 nt, Human
cagcgcuugguggagcuccggcacuguccaca

SEQ ID NO: 87418 - RNA, 32 nt, Human
cagcgcuuugggaggcagaggcagguggauca

SEQ ID NO: 87419 - RNA, 32 nt, Human
cagcgcuuugggaggccgaggcaggcagauca

SEQ ID NO: 87420 - RNA, 32 nt, Human
cagcgcuuugggaggccgaggcaggcggacca

SEQ ID NO: 87421 - RNA, 32 nt, Human
cagcgcuuugggaggccgaggcgggcggaucg

SEQ ID NO: 87422 - RNA, 32 nt, Human
cagcgcuuugggaggccgaggugggcagauca

SEQ ID NO: 87423 - RNA, 32 nt, Human
cagcgcuuugggaggccgaggugggcggauca

SEQ ID NO: 87424 - RNA, 32 nt, Human
cagcgcuuugggaggcuaaggcaggcagauca

SEQ ID NO: 87425 - RNA, 32 nt, Human
cagcgcuuugggaggcugagguggacagaucg

SEQ ID NO: 87426 - RNA, 32 nt, Human
cagcggaaagggacgugagcugagcgcggggg

SEQ ID NO: 87427 - RNA, 32 nt, Human
cagcggaacgaacagcugucugccuuguugug

SEQ ID NO: 87428 - RNA, 32 nt, Human
cagcggaaucccccgucuaccucucuccuugg

SEQ ID NO: 87429 - RNA, 32 nt, Human
cagcggaccaggcagacgggcugaaguggggu

SEQ ID NO: 87430 - RNA, 32 nt, Human
cagcggacucgauaaucugccugcugauguuc

SEQ ID NO: 87431 - RNA, 32 nt, Human
cagcggagaagacugagguccaaaaaggaaaa

SEQ ID NO: 87432 - RNA, 32 nt, Human
cagcggagacuuauguaggagggaccuucccu

SEQ ID NO: 87433 - RNA, 32 nt, Human
cagcggagauccgagagcagggggauggggca

SEQ ID NO: 87434 - RNA, 32 nt, Human
cagcggagccccgggaguguccaagacagccu

SEQ ID NO: 87435 - RNA, 32 nt, Human
cagcggaggagaaggaggaggaggcgaaccca

SEQ ID NO: 87436 - RNA, 32 nt, Human
cagcggaggagucgugucgugccugagagcgc

SEQ ID NO: 87437 - RNA, 32 nt, Human
cagcggaggccaagggaggggagcagccuagu

SEQ ID NO: 87438 - RNA, 22 nt, Human
cagcggagucaacauucacaga

SEQ ID NO: 87439 - RNA, 18 nt, Human
cagcggagucuucagaua

SEQ ID NO: 87440 - RNA, 22 nt, Human
cagcggaucaucugaggucagg

SEQ ID NO: 87441 - RNA, 32 nt, Human
cagcggaucccuccccgccuccauccucguuc

SEQ ID NO: 87442 - RNA, 32 nt, Human
cagcggauccuccugaguaugguugaaaaugg

SEQ ID NO: 87443 - RNA, 32 nt, Human
cagcggauccugggugcaggggaggggcggga

SEQ ID NO: 87444 - RNA, 32 nt, Human
cagcggcaacggcagagacagcaacgugcccg

SEQ ID NO: 87445 - RNA, 32 nt, Human
cagcggcaccauggcuuuccucuggcuccucu

SEQ ID NO: 87446 - RNA, 17 nt, Human
cagcggcagcgcagggg

SEQ ID NO: 87447 - RNA, 18 nt, Human
cagcggcagcuccacuca

SEQ ID NO: 87448 - RNA, 32 nt, Human
cagcggcagggggagcgccuggaacaugcagc

SEQ ID NO: 87449 - RNA, 32 nt, Human
cagcggcagggugucccaggagcccugauccg

SEQ ID NO: 87450 - RNA, 32 nt, Human
cagcggcaugaucacaccucacugcagccuca

SEQ ID NO: 87451 - RNA, 26 nt, Human
cagcggccaauacuaugauuugcugc

SEQ ID NO: 87452 - RNA, 20 nt, Human
cagcggccacauggugcugg

SEQ ID NO: 87453 - RNA, 32 nt, Human
cagcggcccaacuggccggcagccuggugagc

SEQ ID NO: 87454 - RNA, 32 nt, Human
cagcggcccagcacuugugcgcauagaagcua

SEQ ID NO: 87455 - RNA, 32 nt, Human
cagcggccccggcuccagcccagccagcacuc

SEQ ID NO: 87456 - RNA, 32 nt, Human
cagcggccccucccacacacacccacacacuc

SEQ ID NO: 87457 - RNA, 32 nt, Human
cagcggccccuggaggaggaggcggaggagga

SEQ ID NO: 87458 - RNA, 32 nt, Human
cagcggccgcagucuucaccucuccacacuca

SEQ ID NO: 87459 - RNA, 20 nt, Human
cagcggccgggcgggccggg

SEQ ID NO: 87460 - RNA, 32 nt, Human
cagcggccguggagguggcguuggggacuguu

SEQ ID NO: 87461 - RNA, 32 nt, Human
cagcggccucgggacugggacuagggaggggg

SEQ ID NO: 87462 - RNA, 32 nt, Human
cagcggccuggcagagguuucagcgcugagga

SEQ ID NO: 87463 - RNA, 18 nt, Human
cagcggcgacagagcaag

SEQ ID NO: 87464 - RNA, 32 nt, Human
cagcggcgaggaggaggaagaggaggcggagg

SEQ ID NO: 87465 - RNA, 32 nt, Human
cagcggcgcagcgcuccagccaugucgcgcgg

SEQ ID NO: 87466 - RNA, 32 nt, Human
cagcggcgcuggggccagaggggccaggcggg

SEQ ID NO: 87467 - RNA, 21 nt, Human
cagcggcggcagcagcaccag

SEQ ID NO: 87468 - RNA, 32 nt, Human
cagcggcggcagcagcagcggcagcgacccca

SEQ ID NO: 87469 - RNA, 32 nt, Human
cagcggcggccgcggcagcgauagcggcacua

SEQ ID NO: 87470 - RNA, 32 nt, Human
cagcggcggccgcggcgcgugcgucugugccu

SEQ ID NO: 87471 - RNA, 32 nt, Human
cagcggcggcuggagccuccugauuggguuuc

SEQ ID NO: 87472 - RNA, 32 nt, Human
cagcggcgggcaggugccacgaccucuggacg

SEQ ID NO: 87473 - RNA, 32 nt, Human
cagcggcgggccugaggcgaaggagcggccgg

SEQ ID NO: 87474 - RNA, 20 nt, Human
cagcggcggggugggccagg

SEQ ID NO: 87475 - RNA, 32 nt, Human
cagcggcgguggcagccgaggugcaggaugca

SEQ ID NO: 87476 - RNA, 32 nt, Human
cagcggcgucugcagcucgcuucaagauggcc

SEQ ID NO: 87477 - RNA, 23 nt, Human
cagcggcucaaauguucauccca

SEQ ID NO: 87478 - RNA, 19 nt, Human
cagcggcucaacucaccuu

SEQ ID NO: 87479 - RNA, 32 nt, Human
cagcggcucacccgugugcacacucacgugcc

SEQ ID NO: 87480 - RNA, 24 nt, Human
cagcggcucacgccuguaauccca

SEQ ID NO: 87481 - RNA, 24 nt, Human
cagcggcucaugccuguaaccuca

SEQ ID NO: 87482 - RNA, 24 nt, Human
cagcggcucaugccuguaagccca

SEQ ID NO: 87483 - RNA, 24 nt, Human
cagcggcucaugccuguaauccca

SEQ ID NO: 87484 - RNA, 32 nt, Human
cagcggcuccccuccgcuucucaucccaaccu

SEQ ID NO: 87485 - RNA, 24 nt, Human
cagcggcucccgcucauuccccca

SEQ ID NO: 87486 - RNA, 21 nt, Human
cagcggcucgcaucccccuca

SEQ ID NO: 87487 - RNA, 24 nt, Human
cagcggcucucgccuguaauccca

SEQ ID NO: 87488 - RNA, 19 nt, Human
cagcggcugagcaagggcu

SEQ ID NO: 87489 - RNA, 32 nt, Human
cagcggcugcaggacuucaccaagggacccug

SEQ ID NO: 87490 - RNA, 32 nt, Human
cagcggcuguuacacuguucuuugccacugug

SEQ ID NO: 87491 - RNA, 32 nt, Human
cagcggcuucuccagcaccccuagagagggca

SEQ ID NO: 87492 - RNA, 32 nt, Human
cagcggcuuucucuuucugaugggagguguua

SEQ ID NO: 87493 - RNA, 32 nt, Human
cagcgggaaggcugcugggaacagguggcaga

SEQ ID NO: 87494 - RNA, 32 nt, Human
cagcgggaccaacauggugaaaccccgucucu

SEQ ID NO: 87495 - RNA, 32 nt, Human
cagcgggaccauuauuacuggugcaaaaugag

SEQ ID NO: 87496 - RNA, 32 nt, Human
cagcgggacucuucucauccuuccucauuugc

SEQ ID NO: 87497 - RNA, 32 nt, Human
cagcgggagcagagcaccaccauggccuccau

SEQ ID NO: 87498 - RNA, 32 nt, Human
cagcgggauaaaagggugaauuuggagcugac

SEQ ID NO: 87499 - RNA, 32 nt, Human
cagcgggauggcaucuccgacacucccguggg

SEQ ID NO: 87500 - RNA, 32 nt, Human
cagcgggauuccgacuggcaagauggugccca

SEQ ID NO: 87501 - RNA, 32 nt, Human
cagcgggcaggcaugggguguuugggcggcaa

SEQ ID NO: 87502 - RNA, 19 nt, Human
cagcgggcgccuccuccca

SEQ ID NO: 87503 - RNA, 20 nt, Human
cagcgggcgggcgggccggg

SEQ ID NO: 87504 - RNA, 32 nt, Human
cagcgggcgugaguugggggaggacggguugc

SEQ ID NO: 87505 - RNA, 32 nt, Human
cagcgggcugagcaggcggcagaggaaaagaa

SEQ ID NO: 87506 - RNA, 32 nt, Human
cagcgggcugggauggagcacagccaugaacc

SEQ ID NO: 87507 - RNA, 32 nt, Human
cagcgggcuuguagguguccggcuuugcuggc

SEQ ID NO: 87508 - RNA, 32 nt, Human
cagcggggaaacugaggcucgggguggagcgc

SEQ ID NO: 87509 - RNA, 32 nt, Human
cagcggggacaguggggacagcagggacagcg

SEQ ID NO: 87510 - RNA, 32 nt, Human
cagcggggagcacgggugcugccuuccgugcg

SEQ ID NO: 87511 - RNA, 32 nt, Human
cagcggggccuggcgguggaagcgccuccagu

SEQ ID NO: 87512 - RNA, 32 nt, Human
cagcggggcgaggcggcugggcccugcgcguc

SEQ ID NO: 87513 - RNA, 32 nt, Human
cagcggggcuccugccucccggccuggucccc

SEQ ID NO: 87514 - RNA, 32 nt, Human
cagcggggcugcagcuaacgggguacagguag

SEQ ID NO: 87515 - RNA, 27 nt, Human
cagcgggggauuugagcuuacaggauu

SEQ ID NO: 87516 - RNA, 32 nt, Human
cagcgggggccagacuccugccggccucagag

SEQ ID NO: 87517 - RNA, 32 nt, Human
cagcgggggcugauggaagugcagugggggcu

SEQ ID NO: 87518 - RNA, 31 nt, Human
cagcggggguguugagaaaaagcuggaugca

SEQ ID NO: 87519 - RNA, 32 nt, Human
cagcggggugugccccuccugcugacgagggu

SEQ ID NO: 87520 - RNA, 32 nt, Human
cagcgggucugaguccagccucgggagccccu

SEQ ID NO: 87521 - RNA, 32 nt, Human
cagcgggugcgugcgcucuuagagaaacuuuc

SEQ ID NO: 87522 - RNA, 25 nt, Human
cagcgguagcggcucgcucgccuca

SEQ ID NO: 87523 - RNA, 32 nt, Human
cagcgguagcucagcaguuccagauggcaguu

SEQ ID NO: 87524 - RNA, 32 nt, Human
cagcggucugugguagagaacucucuuccuuc

SEQ ID NO: 87525 - RNA, 32 nt, Human
cagcgguucaaauccggcaucuggucgcugag

SEQ ID NO: 87526 - RNA, 32 nt, Human
cagcgguucagcccuggcuggggcugcagggg

SEQ ID NO: 87527 - RNA, 32 nt, Human
cagcgguuccauccuacacuuggauucaguaa

SEQ ID NO: 87528 - RNA, 23 nt, Human
cagcgguuccgccuguaauccca

SEQ ID NO: 87529 - RNA, 32 nt, Human
cagcgguuccugucaagggggcagcaggucca

SEQ ID NO: 87530 - RNA, 32 nt, Human
cagcgguugaagccugauggccuggcucugug

SEQ ID NO: 87531 - RNA, 32 nt, Human
cagcguaacuacccuaaaagcauaucacuagc

SEQ ID NO: 87532 - RNA, 32 nt, Human
cagcguagagcuccaccuccccuuuccccagu

SEQ ID NO: 87533 - RNA, 23 nt, Human
cagcguaggccaacagagugaga

SEQ ID NO: 87534 - RNA, 32 nt, Human
cagcguauccaagaggauggacuuagugaugg

SEQ ID NO: 87535 - RNA, 17 nt, Human
cagcgucauaugagaug

SEQ ID NO: 87536 - RNA, 32 nt, Human
cagcguccacaccuaagaacagcagcuccacc

SEQ ID NO: 87537 - RNA, 32 nt, Human
cagcguccagugcccugccaguagcuccuaga

SEQ ID NO: 87538 - RNA, 32 nt, Human
cagcguccauucgccagguuacccaggagaac

SEQ ID NO: 87539 - RNA, 18 nt, Human
cagcguccccuccuuccc

SEQ ID NO: 87540 - RNA, 32 nt, Human
cagcgucggucaggacugucucgaggccacac

SEQ ID NO: 87541 - RNA, 32 nt, Human
cagcgucuccggaaguggaggcgggagcggca

SEQ ID NO: 87542 - RNA, 32 nt, Human
cagcgucucggaacugcugguccucauuccuu

SEQ ID NO: 87543 - RNA, 31 nt, Human
cagcgucucggucacagaguuggagaaauag

SEQ ID NO: 87544 - RNA, 32 nt, Human
cagcgucugacgggaagccugaucuggaaccu

SEQ ID NO: 87545 - RNA, 32 nt, Human
cagcgucugaggagaaggaggaaagguuucag

SEQ ID NO: 87546 - RNA, 32 nt, Human
cagcgucugccggaacccguucccagggcagg

SEQ ID NO: 87547 - RNA, 32 nt, Human
cagcgucuugcacuaccagcaggcucucacca

SEQ ID NO: 87548 - RNA, 32 nt, Human
cagcgugaagcuggugaagaccugccaggagg

SEQ ID NO: 87549 - RNA, 19 nt, Human
cagcgugacaggagugaga

SEQ ID NO: 87550 - RNA, 32 nt, Human
cagcgugaccaacguggagaaacccccgucuc

SEQ ID NO: 87551 - RNA, 32 nt, Human
cagcgugaccuugucugccucuccaauuauau

SEQ ID NO: 87552 - RNA, 32 nt, Human
cagcgugagcggaaugaaugcugaauaaauaa

SEQ ID NO: 87553 - RNA, 32 nt, Human
cagcgugaggagcgaucucagcaggccuauaa

SEQ ID NO: 87554 - RNA, 32 nt, Human
cagcgugcagugagcuggccugccuggaccuu

SEQ ID NO: 87555 - RNA, 32 nt, Human
cagcgugcaugcugggggugacagagugcuga

SEQ ID NO: 87556 - RNA, 32 nt, Human
cagcgugccggaccccucccuuccauccuccu

SEQ ID NO: 87557 - RNA, 32 nt, Human
cagcgugcugacuggccuagggccccugcccc

SEQ ID NO: 87558 - RNA, 32 nt, Human
cagcgugcuggaaucagauauuggacaaggag

SEQ ID NO: 87559 - RNA, 23 nt, Human
cagcgugcugggauuauaggcau

SEQ ID NO: 87560 - RNA, 32 nt, Human
cagcgugcuguggaaguggaagugccugaagu

SEQ ID NO: 87561 - RNA, 32 nt, Human
cagcguggaggaaggcgcgccgccccgagcug

SEQ ID NO: 87562 - RNA, 32 nt, Human
cagcguggccugauugucccaggaccugaagg

SEQ ID NO: 87563 - RNA, 32 nt, Human
cagcguggcuaacacggugaaaccccgucucu

SEQ ID NO: 87564 - RNA, 22 nt, Human
cagcgugggcaacagagugaga

SEQ ID NO: 87565 - RNA, 21 nt, Human
cagcgugggcgacagagcaag

SEQ ID NO: 87566 - RNA, 32 nt, Human
cagcguggggaagggcccuggagaagcccuca

SEQ ID NO: 87567 - RNA, 32 nt, Human
cagcgugggguggaggagaaguggaguuugga

SEQ ID NO: 87568 - RNA, 22 nt, Human
cagcgugggucaggccuccaca

SEQ ID NO: 87569 - RNA, 22 nt, Human
cagcgugggugacagagugaga

SEQ ID NO: 87570 - RNA, 32 nt, Human
cagcguggguucuuggaagagguggaguuugg

SEQ ID NO: 87571 - RNA, 32 nt, Human
cagcguggucaacaugguguaaccccaucucu

SEQ ID NO: 87572 - RNA, 32 nt, Human
cagcgugucuacaacgucucccagaagcucua

SEQ ID NO: 87573 - RNA, 32 nt, Human
cagcgugugggcuggcucaaugcugaauaaag

SEQ ID NO: 87574 - RNA, 23 nt, Human
cagcguuauucauaauagccuaa

SEQ ID NO: 87575 - RNA, 32 nt, Human
cagcguucaagacacaucauuuauacacaggc

SEQ ID NO: 87576 - RNA, 23 nt, Human
cagcguucagcacacuccugggc

SEQ ID NO: 87577 - RNA, 32 nt, Human
cagcguucccugccuccugcaggaugacuuag

SEQ ID NO: 87578 - RNA, 32 nt, Human
cagcguucgaggaccagagggagcucggccac

SEQ ID NO: 87579 - RNA, 32 nt, Human
cagcguugguacccugcaucacugccaugguu

SEQ ID NO: 87580 - RNA, 32 nt, Human
cagcguuucuaggacagaggggccucccaguc

SEQ ID NO: 87581 - RNA, 32 nt, Human
cagcuaaaaagguguuucugaagagaaaccuc

SEQ ID NO: 87582 - RNA, 32 nt, Human
cagcuaaaccugugucggucagugcaggaauu

SEQ ID NO: 87583 - RNA, 32 nt, Human
cagcuaaacgagccuggaauaaacaugcaguu

SEQ ID NO: 87584 - RNA, 32 nt, Human
cagcuaaagccugucagagaaaguggagcugg

SEQ ID NO: 87585 - RNA, 32 nt, Human
cagcuaaaggaggcugagguugcagugagcug

SEQ ID NO: 87586 - RNA, 20 nt, Human
cagcuaaagguggacuauag

SEQ ID NO: 87587 - RNA, 24 nt, Human
cagcuaaauaguuugaauuauaga

SEQ ID NO: 87588 - RNA, 32 nt, Human
cagcuaagaaaagauuuuaagucaaguugaau

SEQ ID NO: 87589 - RNA, 32 nt, Human
cagcuaagcuccacaaagccuaggugaguggg

SEQ ID NO: 87590 - RNA, 31 nt, Human
cagcuaaggagaccuggacucuggguguggg

SEQ ID NO: 87591 - RNA, 32 nt, Human
cagcuaagggaggacgccugcccacgccuggg

SEQ ID NO: 87592 - RNA, 32 nt, Human
cagcuaagucauacauucauuuugacuccuuu

SEQ ID NO: 87593 - RNA, 31 nt, Human
cagcuaaguucuaagcccuggagguuauauu

SEQ ID NO: 87594 - RNA, 32 nt, Human
cagcuaauacccagagcacccagaucagacuc

SEQ ID NO: 87595 - RNA, 32 nt, Human
cagcuaaucaucagcaccacacgaugaaccaa

SEQ ID NO: 87596 - RNA, 32 nt, Human
cagcuaaucaugucaaguucacugccugucag

SEQ ID NO: 87597 - RNA, 32 nt, Human
cagcuaauuucugcuccccugagauucguccu

SEQ ID NO: 87598 - RNA, 32 nt, Human
cagcuaauuugaugaaugucucugugcgcauu

SEQ ID NO: 87599 - RNA, 32 nt, Human
cagcuacaaaggaaagacaacuggggaaagaa

SEQ ID NO: 87600 - RNA, 32 nt, Human
cagcuacaacaacagcugagaucacuuaauaa

SEQ ID NO: 87601 - RNA, 19 nt, Human
cagcuacacccugccuggc

SEQ ID NO: 87602 - RNA, 32 nt, Human
cagcuacacucagaccaacagauggccagccc

SEQ ID NO: 87603 - RNA, 32 nt, Human
cagcuacacucggaguaaaaacaaaugaagca

SEQ ID NO: 87604 - RNA, 32 nt, Human
cagcuacagacccagaggauaagccacugggc

SEQ ID NO: 87605 - RNA, 32 nt, Human
cagcuacagguguggcuacauccagguccuaa

SEQ ID NO: 87606 - RNA, 24 nt, Human
cagcuacccacuuguugccaccag

SEQ ID NO: 87607 - RNA, 32 nt, Human
cagcuacccaggaaggcugaggcggcagaauc

SEQ ID NO: 87608 - RNA, 32 nt, Human
cagcuacccaggaggcugagacaggagaaucg

SEQ ID NO: 87609 - RNA, 32 nt, Human
cagcuacccaggaggcugaggcaagagaauca

SEQ ID NO: 87610 - RNA, 32 nt, Human
cagcuacccaggaggcugaggcaggagaaucg

SEQ ID NO: 87611 - RNA, 32 nt, Human
cagcuacccaggaggcugaggcaggagaauug

SEQ ID NO: 87612 - RNA, 32 nt, Human
cagcuacccaggaggcugaggugggaggauca

SEQ ID NO: 87613 - RNA, 32 nt, Human
cagcuacccgggaggcaguggcugcagugagc

SEQ ID NO: 87614 - RNA, 32 nt, Human
cagcuacccgggaggcugaggcaggagaauca

SEQ ID NO: 87615 - RNA, 32 nt, Human
cagcuacccgggaggcugaggcaggagaaucg

SEQ ID NO: 87616 - RNA, 32 nt, Human
cagcuacccgggaggcugaggcaggagaaugg

SEQ ID NO: 87617 - RNA, 32 nt, Human
cagcuacccgggaggcugaggcaggagaauug

SEQ ID NO: 87618 - RNA, 32 nt, Human
cagcuacccuccuaugagaguccgaaggauac

SEQ ID NO: 87619 - RNA, 32 nt, Human
cagcuacccuggaaugguggcguguccugcug

SEQ ID NO: 87620 - RNA, 32 nt, Human
cagcuaccuccucugcagaucaagagugugcc

SEQ ID NO: 87621 - RNA, 32 nt, Human
cagcuaccucggaggcagggcgcgcaggcggg

SEQ ID NO: 87622 - RNA, 32 nt, Human
cagcuaccugggaggcugaggugggagaauug

SEQ ID NO: 87623 - RNA, 16 nt, Human
cagcuacgaugggaug

SEQ ID NO: 87624 - RNA, 32 nt, Human
cagcuacgugggaggcugaggcagcagacugg

SEQ ID NO: 87625 - RNA, 32 nt, Human
cagcuacgugggaggcugaggugggagaauug

SEQ ID NO: 87626 - RNA, 32 nt, Human
cagcuacucaacaggcugagguugggaggauc

SEQ ID NO: 87627 - RNA, 32 nt, Human
cagcuacucagaucugcacuccugucucuugg

SEQ ID NO: 87628 - RNA, 32 nt, Human
cagcuacucaggaggcagagaaucacuugaac

SEQ ID NO: 87629 - RNA, 32 nt, Human
cagcuacucaggaggcugagacaggagaauca

SEQ ID NO: 87630 - RNA, 32 nt, Human
cagcuacucaggaggcugagacaggagaaucg

SEQ ID NO: 87631 - RNA, 32 nt, Human
cagcuacucaggaggcugagacaggagagucg

SEQ ID NO: 87632 - RNA, 32 nt, Human
cagcuacucaggaggcugagacaggaggauug

SEQ ID NO: 87633 - RNA, 32 nt, Human
cagcuacucaggaggcugagacagggggaucc

SEQ ID NO: 87634 - RNA, 32 nt, Human
cagcuacucaggagguugagacaggagaaucg

SEQ ID NO: 87635 - RNA, 32 nt, Human
cagcuacucaggcugaggcaggagaaucgcuu

SEQ ID NO: 87636 - RNA, 32 nt, Human
cagcuacucaggcuggggugggaggauggcuu

SEQ ID NO: 87637 - RNA, 32 nt, Human
cagcuacucccagcuauucaggaggcugaggc

SEQ ID NO: 87638 - RNA, 32 nt, Human
cagcuacucccagcuuucccauguauguuguu

SEQ ID NO: 87639 - RNA, 21 nt, Human
cagcuacuccggaggccgagg

SEQ ID NO: 87640 - RNA, 22 nt, Human
cagcuacuccggaggcugaggg

SEQ ID NO: 87641 - RNA, 32 nt, Human
cagcuacuccuggcuggggguggggccuuggg

SEQ ID NO: 87642 - RNA, 32 nt, Human
cagcuacucggaggcaggagaauugcuugaac

SEQ ID NO: 87643 - RNA, 32 nt, Human
cagcuacucgggaggcugagacaggaaaauag

SEQ ID NO: 87644 - RNA, 32 nt, Human
cagcuacucgggaggcugagacaggagaauca

SEQ ID NO: 87645 - RNA, 32 nt, Human
cagcuacucgggaggcugagacaggagaaucg

SEQ ID NO: 87646 - RNA, 32 nt, Human
cagcuacucgggaggcugagacaggagaaucu

SEQ ID NO: 87647 - RNA, 32 nt, Human
cagcuacucgggaggcugagacaggagaauug

SEQ ID NO: 87648 - RNA, 32 nt, Human
cagcuacucgggaggcugagacaggagauuug

SEQ ID NO: 87649 - RNA, 32 nt, Human
cagcuacucgggaggugaggcaggagaauggc

SEQ ID NO: 87650 - RNA, 32 nt, Human
cagcuacucgggagguggagguugcagugagc

SEQ ID NO: 87651 - RNA, 32 nt, Human
cagcuacucgggagguugaggcaggagaauca

SEQ ID NO: 87652 - RNA, 32 nt, Human
cagcuacucgggagguugaggcaggagaaucg

SEQ ID NO: 87653 - RNA, 32 nt, Human
cagcuacucgggagguugaggcaggagaaugg

SEQ ID NO: 87654 - RNA, 32 nt, Human
cagcuacucgggagguugaggcaggagaauug

SEQ ID NO: 87655 - RNA, 32 nt, Human
cagcuacucgggagguuuaggcaggagaaucg

SEQ ID NO: 87656 - RNA, 32 nt, Human
cagcuacucgggcagcugagacaggagaauca

SEQ ID NO: 87657 - RNA, 32 nt, Human
cagcuacucuggaggcugagacaggagaaucg

SEQ ID NO: 87658 - RNA, 32 nt, Human
cagcuacugcaagcuggccuccuaggggcugu

SEQ ID NO: 87659 - RNA, 31 nt, Human
cagcuacuggagaucucagccacaacugggc

SEQ ID NO: 87660 - RNA, 32 nt, Human
cagcuacuucucaccugcuccagcgcagugca

SEQ ID NO: 87661 - RNA, 32 nt, Human
cagcuacuuggaaggcugagacaggagaaucg

SEQ ID NO: 87662 - RNA, 32 nt, Human
cagcuacuuggaaggcugagacaggagaaugg

SEQ ID NO: 87663 - RNA, 32 nt, Human
cagcuacuuggagggcagaggugggaggaugg

SEQ ID NO: 87664 - RNA, 32 nt, Human
cagcuacuuggcuggcugagacaggagaagaa

SEQ ID NO: 87665 - RNA, 32 nt, Human
cagcuacuugggaagcagaggcuggaggauca

SEQ ID NO: 87666 - RNA, 32 nt, Human
cagcuacuugggaagcugagacaggagaauug

SEQ ID NO: 87667 - RNA, 32 nt, Human
cagcuacuugggaggcagagaaucacuugaac

SEQ ID NO: 87668 - RNA, 32 nt, Human
cagcuacuugggaggcagaggugggaagaugg

SEQ ID NO: 87669 - RNA, 32 nt, Human
cagcuacuugggaggcagcggcuggagaauug

SEQ ID NO: 87670 - RNA, 32 nt, Human
cagcuacuugggaggcuaagacaggagaauca

SEQ ID NO: 87671 - RNA, 32 nt, Human
cagcuacuugggaggcuaaggcaggagcaucg

SEQ ID NO: 87672 - RNA, 32 nt, Human
cagcuacuugggaggcugagacaggacaaucg

SEQ ID NO: 87673 - RNA, 32 nt, Human
cagcuacuugggaggcugagacaggagaauca

SEQ ID NO: 87674 - RNA, 32 nt, Human
cagcuacuugggaggcugagacaggagaaucc

SEQ ID NO: 87675 - RNA, 32 nt, Human
cagcuacuugggaggcugagacaggagaaucg

SEQ ID NO: 87676 - RNA, 32 nt, Human
cagcuacuugggaggcugagacaggagaauug

SEQ ID NO: 87677 - RNA, 32 nt, Human
cagcuacuugggaggcugagacaggagacuug

SEQ ID NO: 87678 - RNA, 32 nt, Human
cagcuacuugggaggcugagacaggcgaauug

SEQ ID NO: 87679 - RNA, 32 nt, Human
cagcuacuugggaggcugagaugggagaauca

SEQ ID NO: 87680 - RNA, 32 nt, Human
cagcuacuugggaggcugagaugggaggagca

SEQ ID NO: 87681 - RNA, 32 nt, Human
cagcuacuugggaggcugagaugugagaauca

SEQ ID NO: 87682 - RNA, 32 nt, Human
cagcuacuugggaggcugagcccuggaggucg

SEQ ID NO: 87683 - RNA, 32 nt, Human
cagcuacuugggaggcugaggcaagugaauca

SEQ ID NO: 87684 - RNA, 32 nt, Human
cagcuacuugggaggcugaggcagaauugcuu

SEQ ID NO: 87685 - RNA, 32 nt, Human
cagcuacuugggaggcugaggcagagcugcuu

SEQ ID NO: 87686 - RNA, 32 nt, Human
cagcuacuugggaggcugaggcagcagaagca

SEQ ID NO: 87687 - RNA, 32 nt, Human
cagcuacuugggaggcugaggcagcauugcuu

SEQ ID NO: 87688 - RNA, 32 nt, Human
cagcuacuugggaggcugaggcauggagaauc

SEQ ID NO: 87689 - RNA, 32 nt, Human
cagcuacuugggaggcugaggcggcaggauca

SEQ ID NO: 87690 - RNA, 32 nt, Human
cagcuacuugggaggcugaggcuggagaaucg

SEQ ID NO: 87691 - RNA, 32 nt, Human
cagcuacuugggaggcugagggcaggagaaug

SEQ ID NO: 87692 - RNA, 32 nt, Human
cagcuacuugggaggcugagggcaggagaauu

SEQ ID NO: 87693 - RNA, 32 nt, Human
cagcuacuugggaggcugaggucagaggaugg

SEQ ID NO: 87694 - RNA, 32 nt, Human
cagcuacuugggaggcugaggugggaaaauga

SEQ ID NO: 87695 - RNA, 32 nt, Human
cagcuacuugggaggcugaggugggagaauug

SEQ ID NO: 87696 - RNA, 32 nt, Human
cagcuacuugggaggcugaggugggagccugg

SEQ ID NO: 87697 - RNA, 32 nt, Human
caggcacuugcaagggaggacauuccaggcaa

SEQ ID NO: 87698 - RNA, 32 nt, Human
caggcacuugccucucuccuguccuggagccc

SEQ ID NO: 87699 - RNA, 32 nt, Human
caggcacuuuggaaggugcuaagugacugccc

SEQ ID NO: 87700 - RNA, 32 nt, Human
caggcagaaagagagacaaagacagaaauaga

SEQ ID NO: 87701 - RNA, 32 nt, Human
caggcagaaagagcuccaggcucuugugucgc

SEQ ID NO: 87702 - RNA, 32 nt, Human
caggcagaacuccgcuccccugcuccaaacug

SEQ ID NO: 87703 - RNA, 32 nt, Human
caggcagaagaaaaggcagcugugguguguga

SEQ ID NO: 87704 - RNA, 32 nt, Human
caggcagacaagauuauggaagagaaauguau

SEQ ID NO: 87705 - RNA, 32 nt, Human
caggcagacacagagcacaaugcugggguucu

SEQ ID NO: 87706 - RNA, 21 nt, Human
caggcagaccacgaggucagg

SEQ ID NO: 87707 - RNA, 32 nt, Human
caggcagacccugucccuucacacuacagugg

SEQ ID NO: 87708 - RNA, 32 nt, Human
caggcagacucuucccaccuucucccacugaa

SEQ ID NO: 87709 - RNA, 32 nt, Human
caggcagagaaaaccugcauccucugggcuug

SEQ ID NO: 87710 - RNA, 32 nt, Human
caggcagagagggacguguagggagaguucuu

SEQ ID NO: 87711 - RNA, 32 nt, Human
caggcagagcugcuccccucugcacggaccau

SEQ ID NO: 87712 - RNA, 32 nt, Human
caggcagaggaaaugaagcacuggugcaggag

SEQ ID NO: 87713 - RNA, 32 nt, Human
caggcagaggaagggcuacacaggugucacug

SEQ ID NO: 87714 - RNA, 32 nt, Human
caggcagagggugggggaccuggcgggagccc

SEQ ID NO: 87715 - RNA, 32 nt, Human
caggcagagguggucagggagaaggugggacu

SEQ ID NO: 87716 - RNA, 19 nt, Human
caggcagagguugcaguga

SEQ ID NO: 87717 - RNA, 20 nt, Human
caggcagagguugcagugag

SEQ ID NO: 87718 - RNA, 32 nt, Human
caggcagaguaguugaucucacacaacgggug

SEQ ID NO: 87719 - RNA, 32 nt, Human
caggcagaguccgccgaggccuggggugggag

SEQ ID NO: 87720 - RNA, 32 nt, Human
caggcagauauguagcaguguucuccacugga

SEQ ID NO: 87721 - RNA, 21 nt, Human
caggcagaucacaaggucagg

SEQ ID NO: 87722 - RNA, 23 nt, Human
caggcagaucaccugagcucagg

SEQ ID NO: 87723 - RNA, 21 nt, Human
caggcagaucacgaggucagg

SEQ ID NO: 87724 - RNA, 20 nt, Human
caggcagaucacugauccag

SEQ ID NO: 87725 - RNA, 23 nt, Human
caggcagaucacuugaggucagg

SEQ ID NO: 87726 - RNA, 32 nt, Human
caggcagaucacuuuaggucaggaguucaacg

SEQ ID NO: 87727 - RNA, 32 nt, Human
caggcagaucagacugucagcacuccaggaug

SEQ ID NO: 87728 - RNA, 32 nt, Human
caggcagaucucaaacuccugaccucgugaug

SEQ ID NO: 87729 - RNA, 32 nt, Human
caggcagaucucaaacuucugaccucgugaug

SEQ ID NO: 87730 - RNA, 32 nt, Human
caggcagauucauggagaccagucccaguagc

SEQ ID NO: 87731 - RNA, 19 nt, Human
caggcagauugcaggcagg

SEQ ID NO: 87732 - RNA, 23 nt, Human
caggcagauugcccgagcucagg

SEQ ID NO: 87733 - RNA, 23 nt, Human
caggcagauugcuugagcccagg

SEQ ID NO: 87734 - RNA, 21 nt, Human
caggcagauugcuugaggcca

SEQ ID NO: 87735 - RNA, 32 nt, Human
caggcagcacagaacagcuugcugcuccuccu

SEQ ID NO: 87736 - RNA, 32 nt, Human
caggcagcacaucacagcgggaggagcugucc

SEQ ID NO: 87737 - RNA, 32 nt, Human
caggcagcaccaaagguuuuugucuugggaag

SEQ ID NO: 87738 - RNA, 19 nt, Human
caggcagcaccagggcucc

SEQ ID NO: 87739 - RNA, 21 nt, Human
caggcagcacuuuuggccagg

SEQ ID NO: 87740 - RNA, 32 nt, Human
caggcagcaggcagcaggcgggcgcgcugugg

SEQ ID NO: 87741 - RNA, 32 nt, Human
caggcagcagggccuuccugaccaacagccag

SEQ ID NO: 87742 - RNA, 32 nt, Human
caggcagcaguuagcccgccgcccgccugugu

SEQ ID NO: 87743 - RNA, 32 nt, Human
caggcagccacagcaggcugccuuaccccaga

SEQ ID NO: 87744 - RNA, 32 nt, Human
caggcagccaggggcuguggggagacagugug

SEQ ID NO: 87745 - RNA, 32 nt, Human
caggcagccaugagcuccagccaccccgagcc

SEQ ID NO: 87746 - RNA, 32 nt, Human
caggcagccccgacgguuuccacagcgagcgc

SEQ ID NO: 87747 - RNA, 32 nt, Human
caggcagcccugggcuaaacaaaagcuugaac

SEQ ID NO: 87748 - RNA, 32 nt, Human
caggcagccgacccccuuccucuucacgcucu

SEQ ID NO: 87749 - RNA, 20 nt, Human
caggcagccuccaccugugc

SEQ ID NO: 87750 - RNA, 32 nt, Human
caggcagccuccucgggcacacggugaaggcg

SEQ ID NO: 87751 - RNA, 32 nt, Human
caggcagccugagauugcuucuagagaucuuu

SEQ ID NO: 87752 - RNA, 32 nt, Human
caggcagccugcugggccacacuguccuguug

SEQ ID NO: 87753 - RNA, 32 nt, Human
caggcagccuguccuccuccuccaggcagccu

SEQ ID NO: 87754 - RNA, 32 nt, Human
caggcagcguaugaacucuggagaggggcugc

SEQ ID NO: 87755 - RNA, 32 nt, Human
caggcagcucaagcugaauaaauagcugcaga

SEQ ID NO: 87756 - RNA, 32 nt, Human
caggcagcuccagcuguuaccugagauacuga

SEQ ID NO: 87757 - RNA, 32 nt, Human
caggcagcucgaggcccccgaccaacacuugc

SEQ ID NO: 87758 - RNA, 32 nt, Human
caggcagcucgggcuccugguggaggagggaa

SEQ ID NO: 87759 - RNA, 32 nt, Human
caggcagcuguguggacccagggacagacauu

SEQ ID NO: 87760 - RNA, 32 nt, Human
caggcagcuugauccugauuugguugaggccc

SEQ ID NO: 87761 - RNA, 32 nt, Human
caggcagcuuugccuucucuccccugucauuu

SEQ ID NO: 87762 - RNA, 32 nt, Human
caggcaggaagcggguuuguuuuggaaagggc

SEQ ID NO: 87763 - RNA, 32 nt, Human
caggcaggaaggacccaggauuugaacccagc

SEQ ID NO: 87764 - RNA, 32 nt, Human
caggcaggaagggaggaggagagccaggugag

SEQ ID NO: 87765 - RNA, 32 nt, Human
caggcaggaaggggaggggcagugagguuggc

SEQ ID NO: 87766 - RNA, 32 nt, Human
caggcaggaagugcccagcccgagaggcuggg

SEQ ID NO: 87767 - RNA, 32 nt, Human
caggcaggaaugcagcagagaggacucgccau

SEQ ID NO: 87768 - RNA, 32 nt, Human
caggcaggaaugcgguugggaggcaggucggg

SEQ ID NO: 87769 - RNA, 32 nt, Human
caggcaggacaaggagaaagcagggcagaaug

SEQ ID NO: 87770 - RNA, 32 nt, Human
caggcaggacagccaugagguggggcugcagc

SEQ ID NO: 87771 - RNA, 32 nt, Human
caggcaggagagggaaaggcagcagcggcggc

SEQ ID NO: 87772 - RNA, 32 nt, Human
caggcaggagccaagcacagcaggagcuuccg

SEQ ID NO: 87773 - RNA, 32 nt, Human
caggcaggaggaacucuacaaccugaguuugc

SEQ ID NO: 87774 - RNA, 32 nt, Human
caggcaggaggaucacuugagcuuaggaguuu

SEQ ID NO: 87775 - RNA, 32 nt, Human
caggcaggaguuucagacccuauccugagaau

SEQ ID NO: 87776 - RNA, 19 nt, Human
caggcaggaugcuccuuga

SEQ ID NO: 87777 - RNA, 32 nt, Human
caggcaggauggggcuuuccccaaagcaauug

SEQ ID NO: 87778 - RNA, 32 nt, Human
caggcaggaugucuguuuucugccuguauuuc

SEQ ID NO: 87779 - RNA, 18 nt, Human
caggcaggauuccuccuu

SEQ ID NO: 87780 - RNA, 32 nt, Human
caggcaggccuuggaccuugaugcauugugug

SEQ ID NO: 87781 - RNA, 19 nt, Human
caggcaggcgccccgggca

SEQ ID NO: 87782 - RNA, 32 nt, Human
caggcaggcgccuaccaccacaccugacuaau

SEQ ID NO: 87783 - RNA, 32 nt, Human
caggcaggcgggcgcgggagaccccgccgggg

SEQ ID NO: 87784 - RNA, 32 nt, Human
caggcagggaaacugggggcucgcccuucucc

SEQ ID NO: 87785 - RNA, 32 nt, Human
caggcagggacacgucuggugccagaacacgc

SEQ ID NO: 87786 - RNA, 24 nt, Human
caggcagggaccuccugggcccag

SEQ ID NO: 87787 - RNA, 32 nt, Human
caggcagggagagacaaagauccaggaaagga

SEQ ID NO: 87788 - RNA, 28 nt, Human
caggcagggagcugcugugaguccagcu

SEQ ID NO: 87789 - RNA, 32 nt, Human
caggcagggaggaugggggcagcucucuucuc

SEQ ID NO: 87790 - RNA, 32 nt, Human
caggcagggauacaaggcagucuggaaagaag

SEQ ID NO: 87791 - RNA, 32 nt, Human
caggcagggcccugcuuuucuaggaauugacu

SEQ ID NO: 87792 - RNA, 32 nt, Human
caggcagggcccuucaggucagcccggagcag

SEQ ID NO: 87793 - RNA, 15 nt, Human
caggcagggcugggg

SEQ ID NO: 87794 - RNA, 32 nt, Human
caggcaggggcugagccacauggccaucugcu

SEQ ID NO: 87795 - RNA, 19 nt, Human
caggcaggggcuguggggu

SEQ ID NO: 87796 - RNA, 32 nt, Human
caggcagggggagggcaagugagggaacauga

SEQ ID NO: 87797 - RNA, 32 nt, Human
caggcagggugcaggccauugcaggccgucca

SEQ ID NO: 87798 - RNA, 32 nt, Human
caggcagguaacaccugucauccuggcugguc

SEQ ID NO: 87799 - RNA, 30 nt, Human
caggcagguccccacagggcacgguccucu

SEQ ID NO: 87800 - RNA, 32 nt, Human
caggcaggucucaaaguccugaccucagguga

SEQ ID NO: 87801 - RNA, 32 nt, Human
caggcaggucuuguccugguccuggccacaug

SEQ ID NO: 87802 - RNA, 19 nt, Human
caggcaggugaccuggagg

SEQ ID NO: 87803 - RNA, 18 nt, Human
caggcaggugccaggagc

SEQ ID NO: 87804 - RNA, 32 nt, Human
caggcaggugccaggagccaggaugcaaggau

SEQ ID NO: 87805 - RNA, 32 nt, Human
caggcagguggugagagccagagaugggagca

SEQ ID NO: 87806 - RNA, 21 nt, Human
caggcaguacagcagcugcau

SEQ ID NO: 87807 - RNA, 17 nt, Human
caggcaguccaccugca

SEQ ID NO: 87808 - RNA, 32 nt, Human
caggcaguccuccauccagucuugacuuuggc

SEQ ID NO: 87809 - RNA, 32 nt, Human
caggcagucucgaacuccugaccucaggugau

SEQ ID NO: 87810 - RNA, 20 nt, Human
caggcagugcagagcggaga

SEQ ID NO: 87811 - RNA, 22 nt, Human
caggcagugcgacgaggucagg

SEQ ID NO: 87812 - RNA, 32 nt, Human
caggcagugcggagcuggccgugggcugccua

SEQ ID NO: 87813 - RNA, 20 nt, Human
caggcagugggugggucagg

SEQ ID NO: 87814 - RNA, 32 nt, Human
caggcaguuaacugagaauuggagaggacagg

SEQ ID NO: 87815 - RNA, 32 nt, Human
caggcaguucacagguguuguugcagaggucu

SEQ ID NO: 87816 - RNA, 32 nt, Human
caggcaguugguccuugauuuuucccuuagcu

SEQ ID NO: 87817 - RNA, 32 nt, Human
caggcauaagccacugcgccuggccuugaugu

SEQ ID NO: 87818 - RNA, 32 nt, Human
caggcauaagccacugugccuggccuuaaagu

SEQ ID NO: 87819 - RNA, 32 nt, Human
caggcauaccccgagaugaagagggguuuggg

SEQ ID NO: 87820 - RNA, 32 nt, Human
caggcauaggagaucaaggaagcaucuuuuua

SEQ ID NO: 87821 - RNA, 32 nt, Human
caggcauagggaggcaggagggaaggaagcuu

SEQ ID NO: 87822 - RNA, 32 nt, Human
caggcaucaccugaauaucuuaccuccccuca

SEQ ID NO: 87823 - RNA, 32 nt, Human
caggcaucagccaccacacccagccaacuuaa

SEQ ID NO: 87824 - RNA, 32 nt, Human
caggcaucagccaccgugaccggcucagacug

SEQ ID NO: 87825 - RNA, 32 nt, Human
caggcaucaggacagucaggagaggggccgag

SEQ ID NO: 87826 - RNA, 32 nt, Human
caggcaucauggcucacaccuguaaucccagc

SEQ ID NO: 87827 - RNA, 32 nt, Human
caggcauccccgagcagcaccaugcuugguga

SEQ ID NO: 87828 - RNA, 32 nt, Human
caggcauccugccucacugcccccaggccauu

SEQ ID NO: 87829 - RNA, 32 nt, Human
caggcaucggaggugggcgggguugcagugac

SEQ ID NO: 87830 - RNA, 23 nt, Human
caggcaucucgcucaccccugua

SEQ ID NO: 87831 - RNA, 32 nt, Human
caggcaucugaggauaaaucacugugaaacag

SEQ ID NO: 87832 - RNA, 32 nt, Human
caggcaucugcacuccuccgagcccgguggag

SEQ ID NO: 87833 - RNA, 32 nt, Human
caggcaucuuugccugcccugccuugcuuggc

SEQ ID NO: 87834 - RNA, 32 nt, Human
caggcaugaaccacagcgcccggccaaucugg

SEQ ID NO: 87835 - RNA, 32 nt, Human
caggcaugagccacagugcccggccaaguauu

SEQ ID NO: 87836 - RNA, 32 nt, Human
caggcaugagccaccaaacccagcccagaagu

SEQ ID NO: 87837 - RNA, 32 nt, Human
caggcaugagccaccacaaccgucccacuauu

SEQ ID NO: 87838 - RNA, 32 nt, Human
caggcaugagccaccacaacuggccugaaauu

SEQ ID NO: 87839 - RNA, 32 nt, Human
caggcaugagccaccacacccacacaagacua

SEQ ID NO: 87840 - RNA, 32 nt, Human
caggcaugagccaccacacccagccccuuucc

SEQ ID NO: 87841 - RNA, 32 nt, Human
caggcaugagccaccacacccagcccggacag

SEQ ID NO: 87842 - RNA, 32 nt, Human
caggcaugagccaccacacccagccuucagcu

SEQ ID NO: 87843 - RNA, 32 nt, Human
caggcaugagccaccacacccagccuuuauug

SEQ ID NO: 87844 - RNA, 32 nt, Human
caggcaugagccaccacacccggccaaucagu

SEQ ID NO: 87845 - RNA, 32 nt, Human
caggcaugagccaccacaccuggauugccaua

SEQ ID NO: 87846 - RNA, 32 nt, Human
caggcaugagccaccacaccuggccccauuuu

SEQ ID NO: 87847 - RNA, 32 nt, Human
caggcaugagccaccacaccuugccacaaaug

SEQ ID NO: 87848 - RNA, 32 nt, Human
caggcaugagccaccacaucuggccuaggacc

SEQ ID NO: 87849 - RNA, 32 nt, Human
caggcaugagccaccacgcccagccaaaauau

SEQ ID NO: 87850 - RNA, 32 nt, Human
caggcaugagccaccacgcccagccauugagu

SEQ ID NO: 87851 - RNA, 32 nt, Human
caggcaugagccaccacgcccagccuguuuuu

SEQ ID NO: 87852 - RNA, 32 nt, Human
caggcaugagccaccacgcccggaccaugaug

SEQ ID NO: 87853 - RNA, 30 nt, Human
caggcaugagccaccacgcccggccaaauu

SEQ ID NO: 87854 - RNA, 32 nt, Human
caggcaugagccaccacgcccggcuagacuuu

SEQ ID NO: 87855 - RNA, 32 nt, Human
caggcaugagccaccacgccuggccaagcuuu

SEQ ID NO: 87856 - RNA, 32 nt, Human
caggcaugagccaccacgccuggccaaggcgg

SEQ ID NO: 87857 - RNA, 32 nt, Human
caggcaugagccaccacgccuggccaguuucu

SEQ ID NO: 87858 - RNA, 32 nt, Human
caggcaugagccaccacgccuggccgagagac

SEQ ID NO: 87859 - RNA, 32 nt, Human
caggcaugagccaccacgccuggccuccucuu

SEQ ID NO: 87860 - RNA, 32 nt, Human
caggcaugagccaccacgccuggcuggaauuc

SEQ ID NO: 87861 - RNA, 32 nt, Human
caggcaugagccaccacgccuggucuaugaac

SEQ ID NO: 87862 - RNA, 32 nt, Human
caggcaugagccaccacgccuguccgguuauu

SEQ ID NO: 87863 - RNA, 32 nt, Human
caggcaugagccaccacggccagcccacaaug

SEQ ID NO: 87864 - RNA, 32 nt, Human
caggcaugagccaccacggcccgccaaaaggc

SEQ ID NO: 87865 - RNA, 32 nt, Human
caggcaugagccaccacuccuggccaggaguu

SEQ ID NO: 87866 - RNA, 32 nt, Human
caggcaugagccaccacuccuggccccagaaa

SEQ ID NO: 87867 - RNA, 32 nt, Human
caggcaugagccaccaucuucagccagaugau

SEQ ID NO: 87868 - RNA, 32 nt, Human
caggcaugagccaccaugccagacuucccauu

SEQ ID NO: 87869 - RNA, 32 nt, Human
caggcaugagccaccaugcccaacccaagaau

SEQ ID NO: 87870 - RNA, 32 nt, Human
caggcaugagccaccaugcccagccaaagauc

SEQ ID NO: 87871 - RNA, 32 nt, Human
caggcaugagccaccaugcccagccaauguaa

SEQ ID NO: 87872 - RNA, 32 nt, Human
caggcaugagccaccaugcccagcccacugug

SEQ ID NO: 87873 - RNA, 32 nt, Human
caggcaugagccaccaugcccagcccucaaau

SEQ ID NO: 87874 - RNA, 32 nt, Human
caggcaugagccaccaugcccagccuccuucu

SEQ ID NO: 87875 - RNA, 32 nt, Human
caggcaugagccaccaugcccagcugacaaga

SEQ ID NO: 87876 - RNA, 32 nt, Human
caggcaugagccaccaugcccagcugcuccuu

SEQ ID NO: 87877 - RNA, 32 nt, Human
caggcaugagccaccaugcccagucgauaucu

SEQ ID NO: 87878 - RNA, 32 nt, Human
caggcaugagccaccaugccuagccagcaagc

SEQ ID NO: 87879 - RNA, 32 nt, Human
caggcaugagccaccaugccuagcccagaaau

SEQ ID NO: 87880 - RNA, 32 nt, Human
caggcaugagccaccaugccuggcaacauaac

SEQ ID NO: 87881 - RNA, 32 nt, Human
caggcaugagccaccaugccuggccaacucac

SEQ ID NO: 87882 - RNA, 32 nt, Human
caggcaugagccaccaugccuggccagaauaa

SEQ ID NO: 87883 - RNA, 32 nt, Human
caggcaugagccaccaugccuggccaggacau

SEQ ID NO: 87884 - RNA, 32 nt, Human
caggcaugagccaccaugccuggccaugauuc

SEQ ID NO: 87885 - RNA, 32 nt, Human
caggcaugagccaccaugccuggcccaguguu

SEQ ID NO: 87886 - RNA, 32 nt, Human
caggcaugagccaccaugccuggccccacaua

SEQ ID NO: 87887 - RNA, 32 nt, Human
caggcaugagccaccaugccuggccucugugg

SEQ ID NO: 87888 - RNA, 32 nt, Human
caggcaugagccaccaugccuggcucaaaucc

SEQ ID NO: 87889 - RNA, 32 nt, Human
caggcaugagccaccaugucuugccaguuuug

SEQ ID NO: 87890 - RNA, 32 nt, Human
caggcaugagccaccccgccuggccaguuagu

SEQ ID NO: 87891 - RNA, 32 nt, Human
caggcaugagccaccgcacccagccugcauuc

SEQ ID NO: 87892 - RNA, 32 nt, Human
caggcaugagccaccgcacccagccugguuau

SEQ ID NO: 87893 - RNA, 32 nt, Human
caggcaugagccaccgcaccuggcccuucuaa

SEQ ID NO: 87894 - RNA, 32 nt, Human
caggcaugagccaccgcaccuggccuucccug

SEQ ID NO: 87895 - RNA, 32 nt, Human
caggcaugagccaccgcaccuggucugaucaa

SEQ ID NO: 87896 - RNA, 32 nt, Human
caggcaugagccaccgcacucggccaggagcu

SEQ ID NO: 87897 - RNA, 32 nt, Human
caggcaugagccaccgcgccaggccaaggcgg

SEQ ID NO: 87898 - RNA, 32 nt, Human
caggcaugagccaccgcgcccagccaaggaaa

SEQ ID NO: 87899 - RNA, 32 nt, Human
caggcaugagccaccgcgcccagccagaaagc

SEQ ID NO: 87900 - RNA, 32 nt, Human
caggcaugagccaccgcgcccggccacgugua

SEQ ID NO: 87901 - RNA, 32 nt, Human
caggcaugagccaccgcgcccggccagauucu

SEQ ID NO: 87902 - RNA, 32 nt, Human
caggcaugagccaccgcgccugaccacauugc

SEQ ID NO: 87903 - RNA, 32 nt, Human
caggcaugagccaccgcgccuggccaaugccu

SEQ ID NO: 87904 - RNA, 32 nt, Human
caggcaugagccaccgcgccuggccccuucuu

SEQ ID NO: 87905 - RNA, 32 nt, Human
caggcaugagccaccgcgccuggccgcuuucg

SEQ ID NO: 87906 - RNA, 32 nt, Human
caggcaugagccaccgcgccuggccuaguucc

SEQ ID NO: 87907 - RNA, 32 nt, Human
caggcaugagccaccgcgccuggccucugcuu

SEQ ID NO: 87908 - RNA, 32 nt, Human
caggcaugagccaccgcgcuuggccagacugc

SEQ ID NO: 87909 - RNA, 32 nt, Human
caggcaugagccaccgcuccuggccggguuug

SEQ ID NO: 87910 - RNA, 32 nt, Human
caggcaugagccaccgugccaggccaacagag

SEQ ID NO: 87911 - RNA, 32 nt, Human
caggcaugagccaccgugcccagccaaauguu

SEQ ID NO: 87912 - RNA, 32 nt, Human
caggcaugagccaccgugcccagccaagaaca

SEQ ID NO: 87913 - RNA, 32 nt, Human
caggcaugagccaccgugcccagccaggcauu

SEQ ID NO: 87914 - RNA, 32 nt, Human
caggcaugagccaccgugcccagcccaaaacu

SEQ ID NO: 87915 - RNA, 32 nt, Human
caggcaugagccaccgugcccagccuacugag

SEQ ID NO: 87916 - RNA, 32 nt, Human
caggcaugagccaccgugcccagccuaucaug

SEQ ID NO: 87917 - RNA, 32 nt, Human
caggcaugagccaccgugcccagccucaaaaa

SEQ ID NO: 87918 - RNA, 32 nt, Human
caggcaugagccaccgugcccggccgguccug

SEQ ID NO: 87919 - RNA, 32 nt, Human
caggcaugagccaccgugccuggccaacauuu

SEQ ID NO: 87920 - RNA, 32 nt, Human
caggcaugagccaccgugccuggcccucuccu

SEQ ID NO: 87921 - RNA, 32 nt, Human
caggcaugagccaccgugccuggccucauuug

SEQ ID NO: 87922 - RNA, 32 nt, Human
caggcaugagccaccgugccuggcuuugcugu

SEQ ID NO: 87923 - RNA, 32 nt, Human
caggcaugagccaccgugccuguccuagaacc

SEQ ID NO: 87924 - RNA, 32 nt, Human
caggcaugagccaccguggccggccaagauuu

SEQ ID NO: 87925 - RNA, 32 nt, Human
caggcaugagccaccucacuuggcccaauuuu

SEQ ID NO: 87926 - RNA, 32 nt, Human
caggcaugagccaccucgccuagcccaccgag

SEQ ID NO: 87927 - RNA, 32 nt, Human
caggcaugagccaccucgccuggccagaugcu

SEQ ID NO: 87928 - RNA, 32 nt, Human
caggcaugagccaccugcccagccauguuugg

SEQ ID NO: 87929 - RNA, 32 nt, Human
caggcaugagccacgacgcccagccacaaguu

SEQ ID NO: 87930 - RNA, 32 nt, Human
caggcaugagccacuacacccagccgauuuuu

SEQ ID NO: 87931 - RNA, 32 nt, Human
caggcaugagccacuacgccuggccaaguauu

SEQ ID NO: 87932 - RNA, 32 nt, Human
caggcaugagccacugcacccagacuagaauu

SEQ ID NO: 87933 - RNA, 32 nt, Human
caggcaugagccacugcacccagccaagugau

SEQ ID NO: 87934 - RNA, 32 nt, Human
caggcaugagccacugcacccagccgauagga

SEQ ID NO: 87935 - RNA, 32 nt, Human
caggcaugagccacugcacccagccucuuaac

SEQ ID NO: 87936 - RNA, 32 nt, Human
caggcaugagccacugcacccagccuuggcgg

SEQ ID NO: 87937 - RNA, 32 nt, Human
caggcaugagccacugcacccggccaagucuu

SEQ ID NO: 87938 - RNA, 32 nt, Human
caggcaugagccacugcacccggccuuucuca

SEQ ID NO: 87939 - RNA, 32 nt, Human
caggcaugagccacugcacccggcgcauguuu

SEQ ID NO: 87940 - RNA, 32 nt, Human
caggcaugagccacugcacccggcuugaauca

SEQ ID NO: 87941 - RNA, 32 nt, Human
caggcaugagccacugcaccugaccugcugaa

SEQ ID NO: 87942 - RNA, 32 nt, Human
caggcaugagccacugcaccuggcccacuuua

SEQ ID NO: 87943 - RNA, 32 nt, Human
caggcaugagccacugcaccuggcccuuuuau

SEQ ID NO: 87944 - RNA, 32 nt, Human
caggcaugagccacugcaccuggccgguuauu

SEQ ID NO: 87945 - RNA, 32 nt, Human
caggcaugagccacugcaccuggccuacguau

SEQ ID NO: 87946 - RNA, 32 nt, Human
caggcaugagccacugcaccuggccuaggacu

SEQ ID NO: 87947 - RNA, 32 nt, Human
caggcaugagccacugcacucaaccuuaagac

SEQ ID NO: 87948 - RNA, 32 nt, Human
caggcaugagccacugcauccggccuguuaag

SEQ ID NO: 87949 - RNA, 32 nt, Human
caggcaugagccacugcgccagccuaaagugu

SEQ ID NO: 87950 - RNA, 32 nt, Human
caggcaugagccacugcgcccggccaagaaag

SEQ ID NO: 87951 - RNA, 32 nt, Human
caggcaugagccacugcgcccggccaauuuuu

SEQ ID NO: 87952 - RNA, 32 nt, Human
caggcaugagccacugcgcccggccauggacc

SEQ ID NO: 87953 - RNA, 32 nt, Human
caggcaugagccacugcgccuggccagcaaau

SEQ ID NO: 87954 - RNA, 32 nt, Human
caggcaugagccacugcgccuggccggacaau

SEQ ID NO: 87955 - RNA, 32 nt, Human
caggcaugagccacugcgccuggccuaaucca

SEQ ID NO: 87956 - RNA, 32 nt, Human
caggcaugagccacugcgccuggccucaaauu

SEQ ID NO: 87957 - RNA, 32 nt, Human
caggcaugagccacugcgccuggccucagaau

SEQ ID NO: 87958 - RNA, 32 nt, Human
caggcaugagccacugcuccugaccaauucac

SEQ ID NO: 87959 - RNA, 32 nt, Human
caggcaugagccacugggcgcggccagauaag

SEQ ID NO: 87960 - RNA, 32 nt, Human
caggcaugagccacuguacccagccaaaauug

SEQ ID NO: 87961 - RNA, 32 nt, Human
caggcaugagccacuguaccuggcgaaaaaca

SEQ ID NO: 87962 - RNA, 32 nt, Human
caggcaugagccacugugcccagccacgagcu

SEQ ID NO: 87963 - RNA, 32 nt, Human
caggcaugagccacugugcccagccagagguu

SEQ ID NO: 87964 - RNA, 32 nt, Human
caggcaugagccacugugcccagcccaggcuc

SEQ ID NO: 87965 - RNA, 32 nt, Human
caggcaugagccacugugcccagcccuuuugc

SEQ ID NO: 87966 - RNA, 32 nt, Human
caggcaugagccacugugcccagccuaguuuc

SEQ ID NO: 87967 - RNA, 32 nt, Human
caggcaugagccacugugcccagccuguucua

SEQ ID NO: 87968 - RNA, 32 nt, Human
caggcaugagccacugugcccagucaggaugu

SEQ ID NO: 87969 - RNA, 30 nt, Human
caggcaugagccacugugcccggccacuuu

SEQ ID NO: 87970 - RNA, 32 nt, Human
caggcaugagccacugugcccggccaguuguu

SEQ ID NO: 87971 - RNA, 32 nt, Human
caggcaugagccacugugccuggccaacauaa

SEQ ID NO: 87972 - RNA, 32 nt, Human
caggcaugagccacugugccuggccagaaauu

SEQ ID NO: 87973 - RNA, 32 nt, Human
caggcaugagccacugugccuggccccuuccu

SEQ ID NO: 87974 - RNA, 32 nt, Human
caggcaugagccacugugccuggccugagggc

SEQ ID NO: 87975 - RNA, 32 nt, Human
caggcaugagccacugugccuggcuauucuau

SEQ ID NO: 87976 - RNA, 32 nt, Human
caggcaugagccacugugccuguccaagaaaa

SEQ ID NO: 87977 - RNA, 32 nt, Human
caggcaugagccacugugcucagccuucaugu

SEQ ID NO: 87978 - RNA, 32 nt, Human
caggcaugagccacugugcuuggccuguuauu

SEQ ID NO: 87979 - RNA, 32 nt, Human
caggcaugagccacuguguucaguuggccaua

SEQ ID NO: 87980 - RNA, 32 nt, Human
caggcaugagccacuucgccuagccaagccug

SEQ ID NO: 87981 - RNA, 32 nt, Human
caggcaugagccauugcacccagccuuaagcu

SEQ ID NO: 87982 - RNA, 32 nt, Human
caggcaugaucuuccccaucaggcugggcucu

SEQ ID NO: 87983 - RNA, 32 nt, Human
caggcaugcaccaccacaccaggcuaauuuug

SEQ ID NO: 87984 - RNA, 32 nt, Human
caggcaugcaccaccacacccggcuaauuuuu

SEQ ID NO: 87985 - RNA, 32 nt, Human
caggcaugcaccaccacaccuggcuaauuuuu

SEQ ID NO: 87986 - RNA, 32 nt, Human
caggcaugcaccaccacaccuggcuaguuuuu

SEQ ID NO: 87987 - RNA, 32 nt, Human
caggcaugcaccaccacauccggcuaauguuu

SEQ ID NO: 87988 - RNA, 32 nt, Human
caggcaugcaccaccacgccaggcuaauuuuu

SEQ ID NO: 87989 - RNA, 32 nt, Human
caggcaugcaccaccacgcccggcuaauuuug

SEQ ID NO: 87990 - RNA, 32 nt, Human
caggcaugcaccaccacgcccggcuaauuuuu

SEQ ID NO: 87991 - RNA, 32 nt, Human
caggcaugcaccaccacgccuggcuaauuuuu

SEQ ID NO: 87992 - RNA, 32 nt, Human
caggcaugcaccaccacgucuggcuaauuuug

SEQ ID NO: 87993 - RNA, 32 nt, Human
caggcaugcaccaccacuccuggcuaauuuuu

SEQ ID NO: 87994 - RNA, 32 nt, Human
caggcaugcaccaccaugcccggcuaauuuug

SEQ ID NO: 87995 - RNA, 32 nt, Human
caggcaugcaccaccaugcccggcuaauuuuu

SEQ ID NO: 87996 - RNA, 32 nt, Human
caggcaugcaccaccaugccuggcuaauuuaa

SEQ ID NO: 87997 - RNA, 32 nt, Human
caggcaugcaccaccaugccuggcuaauuuuc

SEQ ID NO: 87998 - RNA, 32 nt, Human
caggcaugcaccaccaugccuggcuaauuuug

SEQ ID NO: 87999 - RNA, 32 nt, Human
caggcaugcaccaccaugccuggcuaauuuuu

SEQ ID NO: 88000 - RNA, 32 nt, Human
caggcaugcaccaccaugccuggcuacuuuuu

SEQ ID NO: 88001 - RNA, 32 nt, Human
caggcaugcaugcacauacgcagauguacagu

SEQ ID NO: 88002 - RNA, 32 nt, Human
caggcaugccuaggcggugugggggcuugaaa

SEQ ID NO: 88003 - RNA, 32 nt, Human
caggcaugccuggguccugccucugccuggca

SEQ ID NO: 88004 - RNA, 32 nt, Human
caggcaugcgccaccaggcccggcuaauuuuu

SEQ ID NO: 88005 - RNA, 21 nt, Human
caggcaugcugccacuugugc

SEQ ID NO: 88006 - RNA, 30 nt, Human
caggcauggccagaugggccugcucugggc

SEQ ID NO: 88007 - RNA, 21 nt, Human
caggcauggcuggugccugaa

SEQ ID NO: 88008 - RNA, 32 nt, Human
caggcaugggaggcggcuugugcuuugccuuc

SEQ ID NO: 88009 - RNA, 32 nt, Human
caggcaugggguccccuggguggacgaggccg

SEQ ID NO: 88010 - RNA, 32 nt, Human
caggcauggucuggugcguucucccuguggcc

SEQ ID NO: 88011 - RNA, 29 nt, Human
caggcaugguggugggugccuggaguccc

SEQ ID NO: 88012 - RNA, 32 nt, Human
caggcauguccuaggcucugggugcaguagug

SEQ ID NO: 88013 - RNA, 32 nt, Human
caggcaugugccaccaggccuggcuaauuuuu

SEQ ID NO: 88014 - RNA, 32 nt, Human
caggcauguggugagaggaugagggggaggga

SEQ ID NO: 88015 - RNA, 32 nt, Human
caggcauguuuggagaugagagaggcuucgag

SEQ ID NO: 88016 - RNA, 29 nt, Human
caggcauguuugugugugccugugguccc

SEQ ID NO: 88017 - RNA, 32 nt, Human
caggcauuaaagggaaagagggcucugcuuga

SEQ ID NO: 88018 - RNA, 32 nt, Human
caggcauuagauucucauaaggagugugcaau

SEQ ID NO: 88019 - RNA, 32 nt, Human
caggcauuagauucucauaaggaguucacagc

SEQ ID NO: 88020 - RNA, 32 nt, Human
caggcauuagcaaaggagagaccuucuguauu

SEQ ID NO: 88021 - RNA, 32 nt, Human
caggcauucuuagcugagacaccaagaggugg

SEQ ID NO: 88022 - RNA, 32 nt, Human
caggcauugacccccucuaccuggcuuuuccu

SEQ ID NO: 88023 - RNA, 32 nt, Human
caggcauugugguuugugccuccuaguguugg

SEQ ID NO: 88024 - RNA, 32 nt, Human
caggcauuguuuguucuugucuuggauuuaug

SEQ ID NO: 88025 - RNA, 32 nt, Human
caggcauuuaacuguugacuccuuugugagcu

SEQ ID NO: 88026 - RNA, 32 nt, Human
caggcauuucaaggaagaaguacugaaaugau

SEQ ID NO: 88027 - RNA, 32 nt, Human
caggcauuuguauucauguauucaguuagcca

SEQ ID NO: 88028 - RNA, 23 nt, Human
caggccaaaagcccagggcucca

SEQ ID NO: 88029 - RNA, 25 nt, Human
caggccaaagggcugccccuaagcu

SEQ ID NO: 88030 - RNA, 32 nt, Human
caggccaaaggggaccuggaagggaggugggc

SEQ ID NO: 88031 - RNA, 32 nt, Human
caggccaaauuucugccugccugccagcagcc

SEQ ID NO: 88032 - RNA, 32 nt, Human
caggccaacauggugaaaacuccucucuacua

SEQ ID NO: 88033 - RNA, 32 nt, Human
caggccaacauggugaaaccccgucucuacua

SEQ ID NO: 88034 - RNA, 32 nt, Human
caggccaacauggugaaacccugucucuacua

SEQ ID NO: 88035 - RNA, 32 nt, Human
caggccaacauggugaaacuucaucucuacua

SEQ ID NO: 88036 - RNA, 32 nt, Human
caggccaaccuugccgggcuguuucccgaggc

SEQ ID NO: 88037 - RNA, 32 nt, Human
caggccaacugccccgcgucuucagcuguuuc

SEQ ID NO: 88038 - RNA, 23 nt, Human
caggccaacuuggcaaaacccca

SEQ ID NO: 88039 - RNA, 32 nt, Human
caggccaagagccgaaggcgggggaggaagau

SEQ ID NO: 88040 - RNA, 32 nt, Human
caggccaaggaaguggcugacaaggacugaaa

SEQ ID NO: 88041 - RNA, 32 nt, Human
caggccaaggagaguccuuccucuccccuuuu

SEQ ID NO: 88042 - RNA, 21 nt, Human
caggccaaguaggggucuagc

SEQ ID NO: 88043 - RNA, 24 nt, Human
caggccaauaaagaugugugagcu

SEQ ID NO: 88044 - RNA, 32 nt, Human
caggccacacacacugcaucacugaccaccca

SEQ ID NO: 88045 - RNA, 32 nt, Human
caggccacacagauucuccucaagagagcccu

SEQ ID NO: 88046 - RNA, 32 nt, Human
caggccacacugcugccaccucucacacgccc

SEQ ID NO: 88047 - RNA, 21 nt, Human
caggccacagccagggcucca

SEQ ID NO: 88048 - RNA, 23 nt, Human
caggccacagccagggguccggc

SEQ ID NO: 88049 - RNA, 32 nt, Human
caggccacaggacauagccaccugaagagcca

SEQ ID NO: 88050 - RNA, 21 nt, Human
caggccacaggcccuccaccu

SEQ ID NO: 88051 - RNA, 32 nt, Human
caggccacaucugccccaagagcaugagcucg

SEQ ID NO: 88052 - RNA, 32 nt, Human
caggccaccaaagauggguggacuggaggcag

SEQ ID NO: 88053 - RNA, 28 nt, Human
caggccaccagugcugccucaggguguc

SEQ ID NO: 88054 - RNA, 32 nt, Human
caggccacccuccacgaggugugacuaacuau

SEQ ID NO: 88055 - RNA, 17 nt, Human
caggccacccucuccca

SEQ ID NO: 88056 - RNA, 32 nt, Human
caggccaccgaggccgccgccgucuagcgccc

SEQ ID NO: 88057 - RNA, 32 nt, Human
caggccacgaaucugccugccucccaggcagc

SEQ ID NO: 88058 - RNA, 32 nt, Human
caggccacgaaucugccugccucccaggcagg

SEQ ID NO: 88059 - RNA, 32 nt, Human
caggccacugcacuccagccugaacaacaaag

SEQ ID NO: 88060 - RNA, 32 nt, Human
caggccacugcacuccagccugggcaacagag

SEQ ID NO: 88061 - RNA, 32 nt, Human
caggccacugcacuccagccuggguaacagac

SEQ ID NO: 88062 - RNA, 23 nt, Human
caggccacugcgcagcccuggug

SEQ ID NO: 88063 - RNA, 32 nt, Human
caggccagaacugccuucuucauuuccaccca

SEQ ID NO: 88064 - RNA, 32 nt, Human
caggccagaagcaaaccaaauuuaccagguuu

SEQ ID NO: 88065 - RNA, 32 nt, Human
caggccagagagagagggcagauggacucugc

SEQ ID NO: 88066 - RNA, 32 nt, Human
caggccagaggcagcuuccagccugggggcug

SEQ ID NO: 88067 - RNA, 32 nt, Human
caggccagagguuuccaaucagccuugccugc

SEQ ID NO: 88068 - RNA, 32 nt, Human
caggccagagucccagcuguccuggacucugc

SEQ ID NO: 88069 - RNA, 21 nt, Human
caggccagagugcaguggugu

SEQ ID NO: 88070 - RNA, 22 nt, Human
caggccagcagcggguucagcu

SEQ ID NO: 88071 - RNA, 32 nt, Human
caggccagcauccccagcagguucugggaggc

SEQ ID NO: 88072 - RNA, 32 nt, Human
caggccagccagaugggacugccuugucugga

SEQ ID NO: 88073 - RNA, 32 nt, Human
caggccagcccaaacuacccugcaucccaacc

SEQ ID NO: 88074 - RNA, 22 nt, Human
caggccagcccucuugggaagg

SEQ ID NO: 88075 - RNA, 32 nt, Human
caggccagccugcagugacagugagacauggc

SEQ ID NO: 88076 - RNA, 32 nt, Human
caggccagccugggacuggccagagcugggcc

SEQ ID NO: 88077 - RNA, 32 nt, Human
caggccagccuuggugggagguuucuaggauu

SEQ ID NO: 88078 - RNA, 32 nt, Human
caggccagcuccucugcccacaugucauacaa

SEQ ID NO: 88079 - RNA, 32 nt, Human
caggccaggacaucugcugacaagggcagugu

SEQ ID NO: 88080 - RNA, 32 nt, Human
caggccaggagccaggaguggggaagggaggg

SEQ ID NO: 88081 - RNA, 32 nt, Human
caggccaggcagcccggaggcuggguggggcc

SEQ ID NO: 88082 - RNA, 18 nt, Human
caggccaggccugggcca

SEQ ID NO: 88083 - RNA, 32 nt, Human
caggccaggcuggcuacccuguguacaaguau

SEQ ID NO: 88084 - RNA, 32 nt, Human
caggccagggagaggcgcaggagccuuugcag

SEQ ID NO: 88085 - RNA, 32 nt, Human
caggccaggggcacucgugauccagaggccgc

SEQ ID NO: 88086 - RNA, 32 nt, Human
caggccagucucaaacuccugaccucagguga

SEQ ID NO: 88087 - RNA, 32 nt, Human
caggccagucucaaacuccuggccucauguga

SEQ ID NO: 88088 - RNA, 32 nt, Human
caggccagucucaacccucccccaggugggca

SEQ ID NO: 88089 - RNA, 32 nt, Human
caggccauaccaggguaucccuugucccuuca

SEQ ID NO: 88090 - RNA, 32 nt, Human
caggccaucaccacagcugcagccaaccccau

SEQ ID NO: 88091 - RNA, 32 nt, Human
caggccaucccaccaccucuaccugcucaugc

SEQ ID NO: 88092 - RNA, 32 nt, Human
caggccaucccucuguugccaucagcuugauu

SEQ ID NO: 88093 - RNA, 32 nt, Human
caggccauccuagaccagccagcuccagcuga

SEQ ID NO: 88094 - RNA, 32 nt, Human
caggccauccuuccugcuguucuagguacugg

SEQ ID NO: 88095 - RNA, 32 nt, Human
caggccauccuucugcccuucagccuccucca

SEQ ID NO: 88096 - RNA, 24 nt, Human
caggccaugaggacccacugggca

SEQ ID NO: 88097 - RNA, 32 nt, Human
caggccaugcaccggggcucagccugaguucc

SEQ ID NO: 88098 - RNA, 21 nt, Human
caggccaugcagcagucacgc

SEQ ID NO: 88099 - RNA, 32 nt, Human
caggccaugccaccggcuucucugauucucca

SEQ ID NO: 88100 - RNA, 21 nt, Human
caggccaugggccacacagca

SEQ ID NO: 88101 - RNA, 32 nt, Human
caggccaugggcgggagcagagacaccgcgga

SEQ ID NO: 88102 - RNA, 32 nt, Human
caggccauguguuugcuucugggaacaauuua

SEQ ID NO: 88103 - RNA, 32 nt, Human
caggccauuagugccauccaggcgcugcgcuc

SEQ ID NO: 88104 - RNA, 32 nt, Human
caggccauuaucagugccucaucugugcagaa

SEQ ID NO: 88105 - RNA, 23 nt, Human
caggccauuauguuuuucauggc

SEQ ID NO: 88106 - RNA, 32 nt, Human
caggccauuccauugcccuccuggugcugggu

SEQ ID NO: 88107 - RNA, 32 nt, Human
caggccauugcacuccagccugggcaauaggg

SEQ ID NO: 88108 - RNA, 32 nt, Human
caggccauugcacuucagccugggugacagag

SEQ ID NO: 88109 - RNA, 21 nt, Human
caggcccaaaggcacugaggg

SEQ ID NO: 88110 - RNA, 22 nt, Human
caggcccaaaugaggucuugcu

SEQ ID NO: 88111 - RNA, 20 nt, Human
caggcccaacccccacccca

SEQ ID NO: 88112 - RNA, 21 nt, Human
caggcccaacccugugcuggu

SEQ ID NO: 88113 - RNA, 21 nt, Human
caggcccaacucuguccggua

SEQ ID NO: 88114 - RNA, 32 nt, Human
caggcccaagagauuuggagacaggagucagg

SEQ ID NO: 88115 - RNA, 32 nt, Human
caggcccaagagccuguacucuaagaaagaaa

SEQ ID NO: 88116 - RNA, 32 nt, Human
caggcccaagcagagaaacuggaccuugaagc

SEQ ID NO: 88117 - RNA, 32 nt, Human
caggcccaagcgcagccaggugaccuccccgc

SEQ ID NO: 88118 - RNA, 32 nt, Human
caggcccaaggcugcgggcgccaaguucgcuc

SEQ ID NO: 88119 - RNA, 32 nt, Human
caggcccaaugugccucauugagaacacuaau

SEQ ID NO: 88120 - RNA, 21 nt, Human
caggcccaccagccacacagg

SEQ ID NO: 88121 - RNA, 18 nt, Human
caggcccaccccugagga

SEQ ID NO: 88122 - RNA, 22 nt, Human
caggcccacccugcagcucagg

SEQ ID NO: 88123 - RNA, 32 nt, Human
caggcccaccgagguaucccagaggugacaga

SEQ ID NO: 88124 - RNA, 32 nt, Human
caggcccaccucuuccucuuggcugggucuac

SEQ ID NO: 88125 - RNA, 28 nt, Human
caggcccacgaugcugccucucccgugg

SEQ ID NO: 88126 - RNA, 32 nt, Human
caggcccacuccucaugcagcagugugcuggg

SEQ ID NO: 88127 - RNA, 32 nt, Human
caggcccacuguagcugggaagaugcggugcc

SEQ ID NO: 88128 - RNA, 31 nt, Human
caggcccagagagugugucucaggagaauuc

SEQ ID NO: 88129 - RNA, 32 nt, Human
caggcccagcacccaguuccuccucacauggc

SEQ ID NO: 88130 - RNA, 32 nt, Human
caggcccagcacugccccagacucgcuggcac

SEQ ID NO: 88131 - RNA, 32 nt, Human
caggcccagcacuguggcuggacugccgcgcc

SEQ ID NO: 88132 - RNA, 32 nt, Human
caggcccagcucccauggcccccacacccccu

SEQ ID NO: 88133 - RNA, 21 nt, Human
caggcccagcuccuccugccu

SEQ ID NO: 88134 - RNA, 17 nt, Human
caggcccagcuccugcc

SEQ ID NO: 88135 - RNA, 32 nt, Human
caggcccagcugaccaccuccugcugcagcuc

SEQ ID NO: 88136 - RNA, 32 nt, Human
caggcccagcugggaccauaauuuguacagaa

SEQ ID NO: 88137 - RNA, 23 nt, Human
caggcccagcuucucuccugccu

SEQ ID NO: 88138 - RNA, 32 nt, Human
caggcccaggauccucagaggaagauggagag

SEQ ID NO: 88139 - RNA, 32 nt, Human
caggcccaggcagagcugacgggaggccccag

SEQ ID NO: 88140 - RNA, 18 nt, Human
caggcccaggccaggcca

SEQ ID NO: 88141 - RNA, 32 nt, Human
caggcccagggacugcagccugagcuccccga

SEQ ID NO: 88142 - RNA, 32 nt, Human
caggcccaucggugcuccucagagguaggugc

SEQ ID NO: 88143 - RNA, 32 nt, Human
caggcccaugggaggcuggaguuggggcagag

SEQ ID NO: 88144 - RNA, 32 nt, Human
caggcccauugcaccccucugccuccucucga

SEQ ID NO: 88145 - RNA, 21 nt, Human
caggccccacaggagcuggcu

SEQ ID NO: 88146 - RNA, 20 nt, Human
caggccccaccgaguccagc

SEQ ID NO: 88147 - RNA, 32 nt, Human
caggccccaccuagggcugcaggcagucuggc

SEQ ID NO: 88148 - RNA, 21 nt, Human
caggccccagcaagguucacu

SEQ ID NO: 88149 - RNA, 32 nt, Human
caggccccagcgucuucuccccagccccgucc

SEQ ID NO: 88150 - RNA, 32 nt, Human
caggccccagggaaaccagggaaaagaaaaag

SEQ ID NO: 88151 - RNA, 21 nt, Human
caggccccagugaagucugcu

SEQ ID NO: 88152 - RNA, 22 nt, Human
caggccccagugagguuccguu

SEQ ID NO: 88153 - RNA, 32 nt, Human
caggccccaucuggauguccaugccaggagag

SEQ ID NO: 88154 - RNA, 21 nt, Human
caggccccaugaagucugacu

SEQ ID NO: 88155 - RNA, 32 nt, Human
caggccccaugccucuccucccucucuggcag

SEQ ID NO: 88156 - RNA, 32 nt, Human
caggcccccaccccuucucccccuucagccac

SEQ ID NO: 88157 - RNA, 32 nt, Human
caggcccccaccgcccagcacccggccccuac

SEQ ID NO: 88158 - RNA, 32 nt, Human
caggcccccacucuucucaaucuuugagaccc

SEQ ID NO: 88159 - RNA, 18 nt, Human
caggcccccagauggaga

SEQ ID NO: 88160 - RNA, 32 nt, Human
caggcccccagguccacuuaggaaaagggggu

SEQ ID NO: 88161 - RNA, 20 nt, Human
caggcccccguccuaucagu

SEQ ID NO: 88162 - RNA, 32 nt, Human
caggcccccucucuccccaucucuggucucaa

SEQ ID NO: 88163 - RNA, 32 nt, Human
caggcccccugccccuuccccacaaacugggu

SEQ ID NO: 88164 - RNA, 32 nt, Human
caggcccccugcccugcccaccucaggccccc

SEQ ID NO: 88165 - RNA, 32 nt, Human
caggcccccuggcgaggcuucaccucacugug

SEQ ID NO: 88166 - RNA, 32 nt, Human
caggccccgaggacccagacccaguggggagg

SEQ ID NO: 88167 - RNA, 32 nt, Human
caggccccgccacacgcucacacacaaaccug

SEQ ID NO: 88168 - RNA, 32 nt, Human
caggccccgccuggcccaggcccgcagccugu

SEQ ID NO: 88169 - RNA, 32 nt, Human
caggccccgcgcuccucacuccugccucucca

SEQ ID NO: 88170 - RNA, 32 nt, Human
caggccccgggaccgcacugacaggaaaccuu

SEQ ID NO: 88171 - RNA, 32 nt, Human
caggccccggggaccccagcacgugggucuaa

SEQ ID NO: 88172 - RNA, 32 nt, Human
caggccccguccaccgccuccacgccgcaccu

SEQ ID NO: 88173 - RNA, 32 nt, Human
caggccccuacaauugggcuccagaaacuacc

SEQ ID NO: 88174 - RNA, 32 nt, Human
caggccccuccagcugccugggcugggugucu

SEQ ID NO: 88175 - RNA, 32 nt, Human
caggccccuccaggcccaccagcccgguuccc

SEQ ID NO: 88176 - RNA, 32 nt, Human
caggccccuccugacuccaucucccugcacca

SEQ ID NO: 88177 - RNA, 32 nt, Human
caggccccuccuguccuccugcucugagcccc

SEQ ID NO: 88178 - RNA, 32 nt, Human
caggccccucugcuccugucugugucuugcgu

SEQ ID NO: 88179 - RNA, 22 nt, Human
caggccccucugugccuacuua

SEQ ID NO: 88180 - RNA, 32 nt, Human
caggccccugcccuccccuuccucccauccuu

SEQ ID NO: 88181 - RNA, 32 nt, Human
caggccccugcucggcucuccacagggcuagg

SEQ ID NO: 88182 - RNA, 18 nt, Human
caggccccugcuguacag

SEQ ID NO: 88183 - RNA, 32 nt, Human
caggccccuggaacacacucaggcuucccuga

SEQ ID NO: 88184 - RNA, 32 nt, Human
caggccccuggaacacacucaggcuuccguga

SEQ ID NO: 88185 - RNA, 21 nt, Human
caggccccuguaaucccagcu

SEQ ID NO: 88186 - RNA, 32 nt, Human
caggccccuguaaucccagcuaauugggaggc

SEQ ID NO: 88187 - RNA, 21 nt, Human
caggccccugugaucccaguu

SEQ ID NO: 88188 - RNA, 32 nt, Human
caggccccuguguucagccucaggccuauagc

SEQ ID NO: 88189 - RNA, 22 nt, Human
caggccccuucccaaucuccau

SEQ ID NO: 88190 - RNA, 21 nt, Human
caggccccuugcagaccggcu

SEQ ID NO: 88191 - RNA, 32 nt, Human
caggccccuuucucacccucugccucacuccc

SEQ ID NO: 88192 - RNA, 32 nt, Human
caggcccgcacccaguugucagccucugacuc

SEQ ID NO: 88193 - RNA, 32 nt, Human
caggcccggaaagacacguaggggaaaccauc

SEQ ID NO: 88194 - RNA, 32 nt, Human
caggcccgggccuguuggcaagcuucgaucuc

SEQ ID NO: 88195 - RNA, 32 nt, Human
caggcccgucucccggcccguggcagucgggg

SEQ ID NO: 88196 - RNA, 32 nt, Human
caggcccgucuccuccccuugggggcuucucc

SEQ ID NO: 88197 - RNA, 32 nt, Human
caggcccguguccagucauaccuagagauuug

SEQ ID NO: 88198 - RNA, 21 nt, Human
caggcccuaaacaagucugcu

SEQ ID NO: 88199 - RNA, 32 nt, Human
caggcccuaugggcuguccagcucuuugcaca

SEQ ID NO: 88200 - RNA, 20 nt, Human
caggcccucacccaguucag

SEQ ID NO: 88201 - RNA, 23 nt, Human
caggcccucagugaaguuuggcu

SEQ ID NO: 88202 - RNA, 32 nt, Human
caggcccuccacucuccuguagauccuguugu

SEQ ID NO: 88203 - RNA, 32 nt, Human
caggcccuccacugugacucuccuacuggugc

SEQ ID NO: 88204 - RNA, 32 nt, Human
caggcccuccagcugcuggccacagaggcucc

SEQ ID NO: 88205 - RNA, 22 nt, Human
caggcccucccacagcuugugc

SEQ ID NO: 88206 - RNA, 32 nt, Human
caggcccuccccucccaugcaggccgaugaca

SEQ ID NO: 88207 - RNA, 19 nt, Human
caggcccucccgcaucuca

SEQ ID NO: 88208 - RNA, 32 nt, Human
caggcccucccggguccugaccagccucugau

SEQ ID NO: 88209 - RNA, 32 nt, Human
caggcccucccggguccugaccagccucuggu

SEQ ID NO: 88210 - RNA, 31 nt, Human
caggcccuccucucugggccccuggugugua

SEQ ID NO: 88211 - RNA, 32 nt, Human
caggcccucggaggagcuucgcggugccagcc

SEQ ID NO: 88212 - RNA, 32 nt, Human
caggcccucucuauuugagacugugcccgccg

SEQ ID NO: 88213 - RNA, 32 nt, Human
caggcccugaagaugaggcagccagaggugag

SEQ ID NO: 88214 - RNA, 32 nt, Human
caggcccugaagccgguccugcucugagcuga

SEQ ID NO: 88215 - RNA, 32 nt, Human
caggcccugaaggauggggagguuuuggacag

SEQ ID NO: 88216 - RNA, 32 nt, Human
caggcccugaauuccgcguucaucuuauccug

SEQ ID NO: 88217 - RNA, 32 nt, Human
caggcccugacucccaugacugcccagcucug

SEQ ID NO: 88218 - RNA, 22 nt, Human
caggcccugagaggucucagcu

SEQ ID NO: 88219 - RNA, 20 nt, Human
caggcccugaggugggccgg

SEQ ID NO: 88220 - RNA, 32 nt, Human
caggcccugcagauguggaagccagacccaca

SEQ ID NO: 88221 - RNA, 32 nt, Human
caggcccugcagccacaguguucuguuggaga

SEQ ID NO: 88222 - RNA, 19 nt, Human
caggcccugcccccuccca

SEQ ID NO: 88223 - RNA, 22 nt, Human
caggcccugcccucugggaagg

SEQ ID NO: 88224 - RNA, 32 nt, Human
caggcccugccugccacccuaggcagggaaag

SEQ ID NO: 88225 - RNA, 32 nt, Human
caggcccugcucccccuaccuccuugccaggg

SEQ ID NO: 88226 - RNA, 32 nt, Human
caggcccuggagagcgcccuggagcugcaaaa

SEQ ID NO: 88227 - RNA, 32 nt, Human
caggcccuggagcuccuucaccaggaggcucc

SEQ ID NO: 88228 - RNA, 32 nt, Human
caggcccugggacugcuucuccagccaggcug

SEQ ID NO: 88229 - RNA, 32 nt, Human
caggcccugggagggaguuuagaaagacaguc

SEQ ID NO: 88230 - RNA, 32 nt, Human
caggcccugggcuaggggcagagcaggccccg

SEQ ID NO: 88231 - RNA, 32 nt, Human
caggcccugggcuggccccugaggcagccuca

SEQ ID NO: 88232 - RNA, 32 nt, Human
caggcccuggggacccgggugggguauuuucc

SEQ ID NO: 88233 - RNA, 32 nt, Human
caggcccugguggaaaggcugggagccgcaca

SEQ ID NO: 88234 - RNA, 32 nt, Human
caggcccugugcaggagugcgauccgggcugg

SEQ ID NO: 88235 - RNA, 32 nt, Human
caggcccugugccuggacuuuggggcuggcag

SEQ ID NO: 88236 - RNA, 32 nt, Human
caggcccugugugccagaggccaggucucucc

SEQ ID NO: 88237 - RNA, 32 nt, Human
caggcccuguucucccuggggucccccguuua

SEQ ID NO: 88238 - RNA, 32 nt, Human
caggcccuguuuguuugcacauaauaaucuug

SEQ ID NO: 88239 - RNA, 32 nt, Human
caggcccuucacuucuauucuggauuuuauuc

SEQ ID NO: 88240 - RNA, 32 nt, Human
caggcccuucccucuccgccugccucauuccc

SEQ ID NO: 88241 - RNA, 21 nt, Human
caggcccuugaagccacguca

SEQ ID NO: 88242 - RNA, 23 nt, Human
caggcccuugguggggucugucu

SEQ ID NO: 88243 - RNA, 24 nt, Human
caggcccuugucaagcacucugcu

SEQ ID NO: 88244 - RNA, 32 nt, Human
caggcccuuugugcagugaacagcccuggcug

SEQ ID NO: 88245 - RNA, 24 nt, Human
caggccgacugcagcaguccagcu

SEQ ID NO: 88246 - RNA, 32 nt, Human
caggccgagauuagggcaggagagugggcaag

SEQ ID NO: 88247 - RNA, 32 nt, Human
caggccgcauguggcuucauuauacugagcca

SEQ ID NO: 88248 - RNA, 32 nt, Human
caggccgccagccucggagugggcgcgggaca

SEQ ID NO: 88249 - RNA, 32 nt, Human
caggccgccgccugccccacgggccuaccuag

SEQ ID NO: 88250 - RNA, 18 nt, Human
caggccgcgcgggcggca

SEQ ID NO: 88251 - RNA, 32 nt, Human
caggccgcggagacccgggagccacccgccgg

SEQ ID NO: 88252 - RNA, 32 nt, Human
caggccgcggaggaggaggagguggaguugcu

SEQ ID NO: 88253 - RNA, 32 nt, Human
caggccgcgguggcugaugccuguaaucccag

SEQ ID NO: 88254 - RNA, 32 nt, Human
caggccgcuggcggagggcucagggggagcgc

SEQ ID NO: 88255 - RNA, 20 nt, Human
caggccggcagcccuugcca

SEQ ID NO: 88256 - RNA, 25 nt, Human
caggccggccccgcggggcggucgc

SEQ ID NO: 88257 - RNA, 32 nt, Human
caggccggcccuccagccugcugcugcauggg

SEQ ID NO: 88258 - RNA, 32 nt, Human
caggccggcucccaguggggcaggccucgcug

SEQ ID NO: 88259 - RNA, 32 nt, Human
caggccgggagguagaggcaggcugauggggg

SEQ ID NO: 88260 - RNA, 32 nt, Human
caggccgggcagcagugggcagugcuggaggc

SEQ ID NO: 88261 - RNA, 32 nt, Human
caggccgggccugcugucaccucgcugggcuc

SEQ ID NO: 88262 - RNA, 19 nt, Human
caggccgggcugcaucucu

SEQ ID NO: 88263 - RNA, 32 nt, Human
caggccgggcuugggcccugcacagauauuuc

SEQ ID NO: 88264 - RNA, 22 nt, Human
caggccgggguggcggcagcuu

SEQ ID NO: 88265 - RNA, 32 nt, Human
caggccggguucccacgcagaggggaggcugc

SEQ ID NO: 88266 - RNA, 32 nt, Human
caggccggucucaaacuccugaccucagguga

SEQ ID NO: 88267 - RNA, 32 nt, Human
caggccgugauccacccuccccaaguccacca

SEQ ID NO: 88268 - RNA, 20 nt, Human
caggccgugugguugggaag

SEQ ID NO: 88269 - RNA, 32 nt, Human
caggccguguucucgauagcuuuccggaagaa

SEQ ID NO: 88270 - RNA, 32 nt, Human
caggccuaccaucugcuacacaggcaccaggc

SEQ ID NO: 88271 - RNA, 32 nt, Human
caggccuacuucugaagagacagccuuuuauc

SEQ ID NO: 88272 - RNA, 32 nt, Human
caggccuagaccaccucgacccaaacccacac

SEQ ID NO: 88273 - RNA, 18 nt, Human
caggccuagcucauguca

SEQ ID NO: 88274 - RNA, 32 nt, Human
caggccuagcuccaaccaagagugugcuccag

SEQ ID NO: 88275 - RNA, 32 nt, Human
caggccuaguucccuuggaggcuguggcaagu

SEQ ID NO: 88276 - RNA, 32 nt, Human
caggccucaaaccuccaccaccugccagcugg

SEQ ID NO: 88277 - RNA, 32 nt, Human
caggccucaagaaccaccuccagguggggagg

SEQ ID NO: 88278 - RNA, 32 nt, Human
caggccucacacacaaugugucugagagauuc

SEQ ID NO: 88279 - RNA, 32 nt, Human
caggccucacugcaauuugauaugccugcuga

SEQ ID NO: 88280 - RNA, 24 nt, Human
caggccucagaaaggaagccaguu

SEQ ID NO: 88281 - RNA, 32 nt, Human
caggccucagcaggugcggagccgucacugca

SEQ ID NO: 88282 - RNA, 21 nt, Human
caggccucagccaccaugccc

SEQ ID NO: 88283 - RNA, 32 nt, Human
caggccucagcccgacuguccaacuuuggccc

SEQ ID NO: 88284 - RNA, 32 nt, Human
caggccucaucugccccacccugggccacugc

SEQ ID NO: 88285 - RNA, 32 nt, Human
caggccucauuuccuuccucugccaccauccc

SEQ ID NO: 88286 - RNA, 32 nt, Human
caggccuccaccuccagcccagguggcugacc

SEQ ID NO: 88287 - RNA, 21 nt, Human
caggccuccagcucgguccag

SEQ ID NO: 88288 - RNA, 32 nt, Human
caggccuccaucugggccacccccucuccccu

SEQ ID NO: 88289 - RNA, 32 nt, Human
caggccucccaaagugcugggauuaaaggugu

SEQ ID NO: 88290 - RNA, 32 nt, Human
caggccucccaggauggcgagcuccaguaaga

SEQ ID NO: 88291 - RNA, 32 nt, Human
caggccuccccaugggcucuggaggggcucaa

SEQ ID NO: 88292 - RNA, 19 nt, Human
caggccuccccgguggcca

SEQ ID NO: 88293 - RNA, 21 nt, Human
caggccuccccgguggccaga

SEQ ID NO: 88294 - RNA, 19 nt, Human
caggccucccgcaggcagg

SEQ ID NO: 88295 - RNA, 32 nt, Human
caggccucccuccuccccuccuacucccuuuu

SEQ ID NO: 88296 - RNA, 24 nt, Human
caggccucccuggacugggccagg

SEQ ID NO: 88297 - RNA, 20 nt, Human
caggccuccgucuucccagc

SEQ ID NO: 88298 - RNA, 23 nt, Human
caggccuccucauggugaugcca

SEQ ID NO: 88299 - RNA, 32 nt, Human
caggccuccucuuccucuaagacccuccccgc

SEQ ID NO: 88300 - RNA, 32 nt, Human
caggccuccugucaccagcugugugacuuugc

SEQ ID NO: 88301 - RNA, 23 nt, Human
caggccucgcagguuacuaggca

SEQ ID NO: 88302 - RNA, 32 nt, Human
caggccucggcuguggggccagggacaccaug

SEQ ID NO: 88303 - RNA, 27 nt, Human
caggccucgggccccagaggucccgcu

SEQ ID NO: 88304 - RNA, 21 nt, Human
caggccucuacuaggucugcu

SEQ ID NO: 88305 - RNA, 32 nt, Human
caggccucuauugacagcaucagucuggcucc

SEQ ID NO: 88306 - RNA, 21 nt, Human
caggccucuccaaggagacag

SEQ ID NO: 88307 - RNA, 32 nt, Human
caggccucuccucuuucccuggugucuucauu

SEQ ID NO: 88308 - RNA, 18 nt, Human
caggccucucugccugaa

SEQ ID NO: 88309 - RNA, 23 nt, Human
caggccucugagagggucuuguu

SEQ ID NO: 88310 - RNA, 23 nt, Human
caggccucugccagccucuggcu

SEQ ID NO: 88311 - RNA, 24 nt, Human
caggccucugccaguguccccagc

SEQ ID NO: 88312 - RNA, 24 nt, Human
caggccucugccggcggcuccagu

SEQ ID NO: 88313 - RNA, 32 nt, Human
caggccucugccugcugcccccucucuccucg

SEQ ID NO: 88314 - RNA, 32 nt, Human
caggccucuggccagccccgcccacugccagg

SEQ ID NO: 88315 - RNA, 21 nt, Human
caggccucuguauucccagcu

SEQ ID NO: 88316 - RNA, 19 nt, Human
caggccucuucgccugcca

SEQ ID NO: 88317 - RNA, 16 nt, Human
caggccucuugggcag

SEQ ID NO: 88318 - RNA, 20 nt, Human
caggccugaagccuagguca

SEQ ID NO: 88319 - RNA, 32 nt, Human
caggccugacaccucucccaagaugaagaggc

SEQ ID NO: 88320 - RNA, 22 nt, Human
caggccugaccacagauuccca

SEQ ID NO: 88321 - RNA, 32 nt, Human
caggccugacugcuguagcuguguaacuuccc

SEQ ID NO: 88322 - RNA, 32 nt, Human
caggccugagccaccaugcccagcugaauuug

SEQ ID NO: 88323 - RNA, 32 nt, Human
caggccugagccaccgcguccggccuccauaa

SEQ ID NO: 88324 - RNA, 32 nt, Human
caggccugagccaccguaucuggcccaaaaca

SEQ ID NO: 88325 - RNA, 32 nt, Human
caggccugagccaccgugcccagccaaaauaa

SEQ ID NO: 88326 - RNA, 32 nt, Human
caggccugagccaccgugccuggccccuaauc

SEQ ID NO: 88327 - RNA, 32 nt, Human
caggccugagccaccgugccuggccuuuuauu

SEQ ID NO: 88328 - RNA, 32 nt, Human
caggccugagccacugcgcccagccaauacca

SEQ ID NO: 88329 - RNA, 32 nt, Human
caggccugagccacugcgcccagccaggauuu

SEQ ID NO: 88330 - RNA, 32 nt, Human
caggccugagccacugugcccagccuuguuug

SEQ ID NO: 88331 - RNA, 18 nt, Human
caggccugaggaccaugu

SEQ ID NO: 88332 - RNA, 32 nt, Human
caggccugaggagaggcccucuggccgccuca

SEQ ID NO: 88333 - RNA, 21 nt, Human
caggccugaugugcccacuca

SEQ ID NO: 88334 - RNA, 17 nt, Human
caggccugcaccauguc

SEQ ID NO: 88335 - RNA, 32 nt, Human
caggccugcaucaggggcuaggcucuggcugg

SEQ ID NO: 88336 - RNA, 20 nt, Human
caggccugccaccuacugca

SEQ ID NO: 88337 - RNA, 32 nt, Human
caggccugcccagcaugugguuuuccaagucc

SEQ ID NO: 88338 - RNA, 32 nt, Human
caggccugcccaggaugugguuuuccaagucc

SEQ ID NO: 88339 - RNA, 32 nt, Human
caggccugcgacuccggccuuguccgcgcccg

SEQ ID NO: 88340 - RNA, 32 nt, Human
caggccugcucugggaagucggcuccaugcuc

SEQ ID NO: 88341 - RNA, 32 nt, Human
caggccugcuggcugcauccccuggucucugc

SEQ ID NO: 88342 - RNA, 20 nt, Human
caggccugcuuaccuccuca

SEQ ID NO: 88343 - RNA, 32 nt, Human
caggccugcuuugugugugucuucccacuuua

SEQ ID NO: 88344 - RNA, 19 nt, Human
caggccuggaaccgucuca

SEQ ID NO: 88345 - RNA, 19 nt, Human
caggccuggaauucuacca

SEQ ID NO: 88346 - RNA, 20 nt, Human
caggccuggacuccaucuca

SEQ ID NO: 88347 - RNA, 23 nt, Human
caggccuggagcuagggccuuca

SEQ ID NO: 88348 - RNA, 23 nt, Human
caggccuggagcuugccucuuca

SEQ ID NO: 88349 - RNA, 21 nt, Human
caggccuggaguaugagcuca

SEQ ID NO: 88350 - RNA, 32 nt, Human
caggccuggauaauauccagccucccacaaga

SEQ ID NO: 88351 - RNA, 22 nt, Human
caggccuggaugaucuagcuca

SEQ ID NO: 88352 - RNA, 32 nt, Human
caggccuggcaccucccugccuuguguccuga

SEQ ID NO: 88353 - RNA, 32 nt, Human
caggccuggcacgucaaagaggcuccagaaau

SEQ ID NO: 88354 - RNA, 26 nt, Human
caggccuggcagccacgcagcggcug

SEQ ID NO: 88355 - RNA, 22 nt, Human
caggccuggccgugcccgcuca

SEQ ID NO: 88356 - RNA, 32 nt, Human
caggccuggccuggccuggaaccuggaugccu

SEQ ID NO: 88357 - RNA, 24 nt, Human
caggccuggcuaagaaguccagcu

SEQ ID NO: 88358 - RNA, 32 nt, Human
caggccuggcugcguucucugccugugguccu

SEQ ID NO: 88359 - RNA, 22 nt, Human
caggccugggacccagagccaa

SEQ ID NO: 88360 - RNA, 32 nt, Human
caggccugggcaacauagaugugagcaccuau

SEQ ID NO: 88361 - RNA, 32 nt, Human
caggccugggcaauauggcgagaccucaucuc

SEQ ID NO: 88362 - RNA, 32 nt, Human
caggccugggcuggggcaguuggagguauggg

SEQ ID NO: 88363 - RNA, 32 nt, Human
caggccugggggcagccucuccccagccuccc

SEQ ID NO: 88364 - RNA, 20 nt, Human
caggccuggguccugcccuc

SEQ ID NO: 88365 - RNA, 23 nt, Human
caggccuggucauugccuccuca

SEQ ID NO: 88366 - RNA, 20 nt, Human
caggccugguccaccucuca

SEQ ID NO: 88367 - RNA, 21 nt, Human
caggccuggugcagcccacuc

SEQ ID NO: 88368 - RNA, 32 nt, Human
caggccuguaaucccagcuacuagggaggcgg

SEQ ID NO: 88369 - RNA, 32 nt, Human
caggccuguaaucccagcuacucgggaggcua

SEQ ID NO: 88370 - RNA, 32 nt, Human
caggccuguaaucccagcucuggaagcugaag

SEQ ID NO: 88371 - RNA, 32 nt, Human
caggccuguagucccagcuacuugggaggcug

SEQ ID NO: 88372 - RNA, 32 nt, Human
caggccuguccugcaggggauggucuugggca

SEQ ID NO: 88373 - RNA, 32 nt, Human
caggccugucugcagggccagagcggggcaga

SEQ ID NO: 88374 - RNA, 32 nt, Human
caggccugugccacuggugccagccuggaugc

SEQ ID NO: 88375 - RNA, 32 nt, Human
caggccuguggcuagcagcacuggggacagga

SEQ ID NO: 88376 - RNA, 23 nt, Human
caggccugugggaggcccucgug

SEQ ID NO: 88377 - RNA, 32 nt, Human
caggccugugugguggcucacaccugugaucc

SEQ ID NO: 88378 - RNA, 22 nt, Human
caggccuuaaucacccccauuc

SEQ ID NO: 88379 - RNA, 21 nt, Human
caggccuuagaggccaugcca

SEQ ID NO: 88380 - RNA, 32 nt, Human
caggccuucccaguagcugggauuacaggcac

SEQ ID NO: 88381 - RNA, 32 nt, Human
caggccuuccucccucucccaucagcagcccu

SEQ ID NO: 88382 - RNA, 32 nt, Human
caggccuuccuuagaaucagagaaggaagcgu

SEQ ID NO: 88383 - RNA, 32 nt, Human
caggccuucucccccuccccaguguccucucc

SEQ ID NO: 88384 - RNA, 18 nt, Human
caggccuucugacuguca

SEQ ID NO: 88385 - RNA, 18 nt, Human
caggccuucuuuauguca

SEQ ID NO: 88386 - RNA, 32 nt, Human
caggccuugagguggaaucccaguggcaacuc

SEQ ID NO: 88387 - RNA, 32 nt, Human
caggccuuggagaucgagcugcagucccagcu

SEQ ID NO: 88388 - RNA, 32 nt, Human
caggccuuggauucucauaagaagcacgcaac

SEQ ID NO: 88389 - RNA, 32 nt, Human
caggccuugggcaguggguuggggguagaagu

SEQ ID NO: 88390 - RNA, 18 nt, Human
caggccuuggucagguca

SEQ ID NO: 88391 - RNA, 19 nt, Human
caggccuuuaacuuccuca

SEQ ID NO: 88392 - RNA, 21 nt, Human
caggccuuucccaacaugcca

SEQ ID NO: 88393 - RNA, 21 nt, Human
caggccuuugagcucuuguca

SEQ ID NO: 88394 - RNA, 18 nt, Human
caggccuuugcuagugca

SEQ ID NO: 88395 - RNA, 19 nt, Human
caggccuuuggagcucuca

SEQ ID NO: 88396 - RNA, 20 nt, Human
caggccuuuguaaguuguca

SEQ ID NO: 88397 - RNA, 18 nt, Human
caggccuuuuggacuuca

SEQ ID NO: 88398 - RNA, 32 nt, Human
caggcgaagggcaggaggagcugcuuggcaga

SEQ ID NO: 88399 - RNA, 32 nt, Human
caggcgaccacugcucugcgggcggguggucu

SEQ ID NO: 88400 - RNA, 32 nt, Human
caggcgaccucaggacccugugauuggcgccu

SEQ ID NO: 88401 - RNA, 32 nt, Human
caggcgacuggaggcaggacuccugggucccu

SEQ ID NO: 88402 - RNA, 32 nt, Human
caggcgagcauguugugguaauucuggaacac

SEQ ID NO: 88403 - RNA, 20 nt, Human
caggcgagcccuccccagca

SEQ ID NO: 88404 - RNA, 32 nt, Human
caggcgagcugacauucugcagccuggacggc

SEQ ID NO: 88405 - RNA, 32 nt, Human
caggcgaggaagcuuaaguugaaggaauguua

SEQ ID NO: 88406 - RNA, 32 nt, Human
caggcgaggagcugugggcgcagggccugccg

SEQ ID NO: 88407 - RNA, 32 nt, Human
caggcgaggccgcggcgggagggccacgcccc

SEQ ID NO: 88408 - RNA, 32 nt, Human
caggcgaggggaugcccugcagcauccagccg

SEQ ID NO: 88409 - RNA, 32 nt, Human
caggcgauacuuccuguugccgggacgcuaua

SEQ ID NO: 88410 - RNA, 32 nt, Human
caggcgaugugcaaguguaugcacgugugcac

SEQ ID NO: 88411 - RNA, 18 nt, Human
caggcgauucuccugccu

SEQ ID NO: 88412 - RNA, 32 nt, Human
caggcgcaagccacuacaccugcccucuucau

SEQ ID NO: 88413 - RNA, 32 nt, Human
caggcgcacaccaccacacacagcuaauuuuu

SEQ ID NO: 88414 - RNA, 18 nt, Human
caggcgcacaucaccacg

SEQ ID NO: 88415 - RNA, 32 nt, Human
caggcgccaagugcuacgacagaggugugaau

SEQ ID NO: 88416 - RNA, 32 nt, Human
caggcgccagccaccaugccuggcuaauuuuu

SEQ ID NO: 88417 - RNA, 32 nt, Human
caggcgccaucuguaaagucuccucuggaaau

SEQ ID NO: 88418 - RNA, 16 nt, Human
caggcgccccaccacg

SEQ ID NO: 88419 - RNA, 32 nt, Human
caggcgcccgccaccaugccccggcuauuuuu

SEQ ID NO: 88420 - RNA, 32 nt, Human
caggcgcccgccaccugggauuacgggcgccc

SEQ ID NO: 88421 - RNA, 32 nt, Human
caggcgcccggcugcuccucacuugcucugag

SEQ ID NO: 88422 - RNA, 32 nt, Human
caggcgcccugggccacgugagcccagcggag

SEQ ID NO: 88423 - RNA, 32 nt, Human
caggcgccgaccgccucaugacccagcgcugc

SEQ ID NO: 88424 - RNA, 32 nt, Human
caggcgccggcagagggugaacgaguucaccu

SEQ ID NO: 88425 - RNA, 32 nt, Human
caggcgccggggagaagagacauggagccggc

SEQ ID NO: 88426 - RNA, 15 nt, Human
caggcgccggggcca

SEQ ID NO: 88427 - RNA, 24 nt, Human
caggcgccguagcucaccccugua

SEQ ID NO: 88428 - RNA, 32 nt, Human
caggcgccgugcgaaccgagcccagccagccg

SEQ ID NO: 88429 - RNA, 16 nt, Human
caggcgccuccugcca

SEQ ID NO: 88430 - RNA, 32 nt, Human
caggcgccuguaauccagcuacucgggaggcu

SEQ ID NO: 88431 - RNA, 32 nt, Human
caggcgccuguaaucccagcuacucaggaggc

SEQ ID NO: 88432 - RNA, 32 nt, Human
caggcgccuguaaucccagcuacucgggaggc

SEQ ID NO: 88433 - RNA, 32 nt, Human
caggcgccuguaaucccagcuacuggggaggc

SEQ ID NO: 88434 - RNA, 32 nt, Human
caggcgccuguaaucccagcuacuuggaaggc

SEQ ID NO: 88435 - RNA, 32 nt, Human
caggcgccuguaaucccagcuacuugggaggc

SEQ ID NO: 88436 - RNA, 32 nt, Human
caggcgccuguaaucccagcuauuugggaggc

SEQ ID NO: 88437 - RNA, 32 nt, Human
caggcgccuguagaaucccagcugcucgggag

SEQ ID NO: 88438 - RNA, 32 nt, Human
caggcgccuguagucccagcacuuugggaggc

SEQ ID NO: 88439 - RNA, 32 nt, Human
caggcgccuguaucccagcuacuugggaggca

SEQ ID NO: 88440 - RNA, 32 nt, Human
caggcgcgagccaccaugcccggccagugucc

SEQ ID NO: 88441 - RNA, 24 nt, Human
caggcgcgguggcucaccccugua

SEQ ID NO: 88442 - RNA, 32 nt, Human
caggcgcgguggcucuugccuguagucccggc

SEQ ID NO: 88443 - RNA, 32 nt, Human
caggcgcgguggcuucuguaaucccaggacuu

SEQ ID NO: 88444 - RNA, 22 nt, Human
caggcgcgugggcagggccagg

SEQ ID NO: 88445 - RNA, 32 nt, Human
caggcgcucaccgcggaggucucccugcugga

SEQ ID NO: 88446 - RNA, 32 nt, Human
caggcgcucaggaagggugagguggagcccug

SEQ ID NO: 88447 - RNA, 32 nt, Human
caggcgcucgcaggcaugcagcccgggagcag

SEQ ID NO: 88448 - RNA, 32 nt, Human
caggcgcucggaacccagcagcggcgcuccuc

SEQ ID NO: 88449 - RNA, 32 nt, Human
caggcgcucucagcucucuccccgguacguga

SEQ ID NO: 88450 - RNA, 32 nt, Human
caggcgcuuguaaucccagcuacuugggaggc

SEQ ID NO: 88451 - RNA, 32 nt, Human
caggcggacaggcgggcuuugcaaugaucccc

SEQ ID NO: 88452 - RNA, 32 nt, Human
caggcggagaggagcuugcagcauugagcgga

SEQ ID NO: 88453 - RNA, 32 nt, Human
caggcggagcugcuaagagccugcugacauga

SEQ ID NO: 88454 - RNA, 20 nt, Human
caggcggaggcggggccagg

SEQ ID NO: 88455 - RNA, 32 nt, Human
caggcggaggcugagggcgccgcuggccggcc

SEQ ID NO: 88456 - RNA, 20 nt, Human
caggcggagguugcagugag

SEQ ID NO: 88457 - RNA, 23 nt, Human
caggcggaucaccugaggucggg

SEQ ID NO: 88458 - RNA, 21 nt, Human
caggcggaucacgaggccagg

SEQ ID NO: 88459 - RNA, 19 nt, Human
caggcggaucacgagguca

SEQ ID NO: 88460 - RNA, 21 nt, Human
caggcggaucccgaggucagg

SEQ ID NO: 88461 - RNA, 32 nt, Human
caggcggcaaagcucuccauguaucacucacc

SEQ ID NO: 88462 - RNA, 32 nt, Human
caggcggcaccacugccgucauuucagcuucu

SEQ ID NO: 88463 - RNA, 32 nt, Human
caggcggccagaggccugggaacaucauccug

SEQ ID NO: 88464 - RNA, 20 nt, Human
caggcggcgcgcuccagccc

SEQ ID NO: 88465 - RNA, 32 nt, Human
caggcggcgcgggggcgcgcugggcgggggag

SEQ ID NO: 88466 - RNA, 32 nt, Human
caggcggcucccccacugcccugggccugccc

SEQ ID NO: 88467 - RNA, 22 nt, Human
caggcggcucucucccugagcu

SEQ ID NO: 88468 - RNA, 32 nt, Human
caggcggcugcccuccccuugcuguccucugg

SEQ ID NO: 88469 - RNA, 32 nt, Human
caggcgggagccaccaugauggccaacuuuug

SEQ ID NO: 88470 - RNA, 32 nt, Human
caggcgggagccaccaugccuggccagaacaa

SEQ ID NO: 88471 - RNA, 32 nt, Human
caggcgggaggaccccgcgcggcuggauggcg

SEQ ID NO: 88472 - RNA, 32 nt, Human
caggcgggauguguuggccacagggagaggcg

SEQ ID NO: 88473 - RNA, 32 nt, Human
caggcgggcagugggugaggggaccaggaggu

SEQ ID NO: 88474 - RNA, 32 nt, Human
caggcggggaggacggcgaggagguccgcuga

SEQ ID NO: 88475 - RNA, 32 nt, Human
caggcggggcugggcugcagaccucuggggac

SEQ ID NO: 88476 - RNA, 32 nt, Human
caggcggggucaaggccaggcagcggggcgcg

SEQ ID NO: 88477 - RNA, 32 nt, Human
caggcggguguucaccacugccuuuucuuccu

SEQ ID NO: 88478 - RNA, 32 nt, Human
caggcgguccccauccccaccagcucguuuuu

SEQ ID NO: 88479 - RNA, 32 nt, Human
caggcggugcggcauccuccuccugggauucc

SEQ ID NO: 88480 - RNA, 32 nt, Human
caggcgguggcagagggcucugggcugacauc

SEQ ID NO: 88481 - RNA, 17 nt, Human
caggcgguggggcggcu

SEQ ID NO: 88482 - RNA, 32 nt, Human
caggcguagcuggucccagggccccggggguc

SEQ ID NO: 88483 - RNA, 32 nt, Human
caggcguagggccagggcucuggcagguggcc

SEQ ID NO: 88484 - RNA, 20 nt, Human
caggcguaguugccuacuca

SEQ ID NO: 88485 - RNA, 32 nt, Human
caggcgucagccaccgugaccggcucagacug

SEQ ID NO: 88486 - RNA, 32 nt, Human
caggcgucauggcucacaccuguaaucccagc

SEQ ID NO: 88487 - RNA, 32 nt, Human
caggcgucgccaaggcaggacagccguguggu

SEQ ID NO: 88488 - RNA, 32 nt, Human
caggcgucugcugaaagauuuggaacagaaga

SEQ ID NO: 88489 - RNA, 32 nt, Human
caggcgucuguaaucccagcugcuugggaggc

SEQ ID NO: 88490 - RNA, 32 nt, Human
caggcgugaaccacugcacccagccuaucuuu

SEQ ID NO: 88491 - RNA, 32 nt, Human
caggcgugaaccacugcacccagccugcugau

SEQ ID NO: 88492 - RNA, 32 nt, Human
caggcgugagcaccccacccagcucauuaccc

SEQ ID NO: 88493 - RNA, 32 nt, Human
caggcgugagccaacacaccggaccuucauuu

SEQ ID NO: 88494 - RNA, 32 nt, Human
caggcgugagccacagugccuggccucuuccc

SEQ ID NO: 88495 - RNA, 32 nt, Human
caggcgugagccacagugccuggccugauuca

SEQ ID NO: 88496 - RNA, 32 nt, Human
caggcgugagccaccacaccaggcccgagaaa

SEQ ID NO: 88497 - RNA, 32 nt, Human
caggcgugagccaccacacccagccaaauuuu

SEQ ID NO: 88498 - RNA, 32 nt, Human
caggcgugagccaccacacccagccagugaac

SEQ ID NO: 88499 - RNA, 32 nt, Human
caggcgugagccaccacacccagccaguuuuc

SEQ ID NO: 88500 - RNA, 32 nt, Human
caggcgugagccaccacacccagcccuuucac

SEQ ID NO: 88501 - RNA, 32 nt, Human
caggcgugagccaccacacccagcucagggag

SEQ ID NO: 88502 - RNA, 32 nt, Human
caggcgugagccaccacacccggccaaaacug

SEQ ID NO: 88503 - RNA, 32 nt, Human
caggcgugagccaccacacccucccgagaucu

SEQ ID NO: 88504 - RNA, 32 nt, Human
caggcgugagccaccacaccuagcuggaagag

SEQ ID NO: 88505 - RNA, 32 nt, Human
caggcgugagccaccacaccuggccagcucag

SEQ ID NO: 88506 - RNA, 32 nt, Human
caggcgugagccaccacaccuggcccuaaauc

SEQ ID NO: 88507 - RNA, 32 nt, Human
caggcgugagccaccacaccuggccuguuuuu

SEQ ID NO: 88508 - RNA, 32 nt, Human
caggcgugagccaccacaccuggcuacccuuu

SEQ ID NO: 88509 - RNA, 32 nt, Human
caggcgugagccaccacacuuggccagacugu

SEQ ID NO: 88510 - RNA, 32 nt, Human
caggcgugagccaccacauccagccagugauc

SEQ ID NO: 88511 - RNA, 32 nt, Human
caggcgugagccaccacauccagccuaauuua

SEQ ID NO: 88512 - RNA, 32 nt, Human
caggcgugagccaccacauccggccagugcac

SEQ ID NO: 88513 - RNA, 32 nt, Human
caggcgugagccaccaccacacccagcccugg

SEQ ID NO: 88514 - RNA, 32 nt, Human
caggcgugagccaccacgcccagccguacauu

SEQ ID NO: 88515 - RNA, 32 nt, Human
caggcgugagccaccacgcccagccuauaccc

SEQ ID NO: 88516 - RNA, 32 nt, Human
caggcgugagccaccacgcccggccacuagcc

SEQ ID NO: 88517 - RNA, 32 nt, Human
caggcgugagccaccacgcccggccagcaaau

SEQ ID NO: 88518 - RNA, 32 nt, Human
caggcgugagccaccacgcccggccuggccuu

SEQ ID NO: 88519 - RNA, 32 nt, Human
caggcgugagccaccacgcccggucaccuuug

SEQ ID NO: 88520 - RNA, 32 nt, Human
caggcgugagccaccacgccuggccaauuaug

SEQ ID NO: 88521 - RNA, 32 nt, Human
caggcgugagccaccacgccuggccgaaaaac

SEQ ID NO: 88522 - RNA, 32 nt, Human
caggcgugagccaccacgccuggccucacuca

SEQ ID NO: 88523 - RNA, 32 nt, Human
caggcgugagccaccacgccuggcuggauccu

SEQ ID NO: 88524 - RNA, 32 nt, Human
caggcgugagccaccacguccaacugccuuau

SEQ ID NO: 88525 - RNA, 32 nt, Human
caggcgugagccaccacgucuggccuucuugu

SEQ ID NO: 88526 - RNA, 32 nt, Human
caggcgugagccaccacucccggcuaaguuag

SEQ ID NO: 88527 - RNA, 32 nt, Human
caggcgugagccaccacuccuggccuaugcca

SEQ ID NO: 88528 - RNA, 32 nt, Human
caggcgugagccaccacugcuggccaguuuuu

SEQ ID NO: 88529 - RNA, 32 nt, Human
caggcgugagccaccagccaggccaagcuauu

SEQ ID NO: 88530 - RNA, 32 nt, Human
caggcgugagccaccaggcccagccucgaguc

SEQ ID NO: 88531 - RNA, 32 nt, Human
caggcgugagccaccaggcccugccugguuuu

SEQ ID NO: 88532 - RNA, 32 nt, Human
caggcgugagccaccaggccuggcuccuuuuc

SEQ ID NO: 88533 - RNA, 32 nt, Human
caggcgugagccaccauacccggcccacucuu

SEQ ID NO: 88534 - RNA, 32 nt, Human
caggcgugagccaccauaccuggcgcaugcau

SEQ ID NO: 88535 - RNA, 32 nt, Human
caggcgugagccaccaugaccagcccuccauu

SEQ ID NO: 88536 - RNA, 32 nt, Human
caggcgugagccaccaugcccagccuaauaaa

SEQ ID NO: 88537 - RNA, 32 nt, Human
caggcgugagccaccaugcccagccuacucua

SEQ ID NO: 88538 - RNA, 32 nt, Human
caggcgugagccaccaugccccgccccagaug

SEQ ID NO: 88539 - RNA, 32 nt, Human
caggcgugagccaccaugcccggccagcuucu

SEQ ID NO: 88540 - RNA, 32 nt, Human
caggcgugagccaccaugcccggccaugguug

SEQ ID NO: 88541 - RNA, 32 nt, Human
caggcgugagccaccaugcccggcccaaauau

SEQ ID NO: 88542 - RNA, 32 nt, Human
caggcgugagccaccaugcccggccucuuucu

SEQ ID NO: 88543 - RNA, 32 nt, Human
caggcgugagccaccaugcccggcuaauuuuu

SEQ ID NO: 88544 - RNA, 32 nt, Human
caggcgugagccaccaugccuagcaacauaac

SEQ ID NO: 88545 - RNA, 32 nt, Human
caggcgugagccaccaugccugcccagcaaua

SEQ ID NO: 88546 - RNA, 32 nt, Human
caggcgugagccaccaugccuggcaacauaac

SEQ ID NO: 88547 - RNA, 32 nt, Human
caggcgugagccaccaugccuggccaaaacac

SEQ ID NO: 88548 - RNA, 32 nt, Human
caggcgugagccaccaugccuggccacaucua

SEQ ID NO: 88549 - RNA, 32 nt, Human
caggcgugagccaccaugccuggccagaaauc

SEQ ID NO: 88550 - RNA, 32 nt, Human
caggcgugagccaccaugccuggccagaagcu

SEQ ID NO: 88551 - RNA, 32 nt, Human
caggcgugagccaccaugccuggccaucagaa

SEQ ID NO: 88552 - RNA, 32 nt, Human
caggcgugagccaccaugccuggccuucauua

SEQ ID NO: 88553 - RNA, 32 nt, Human
caggcgugagccaccauguccagccaaaguug

SEQ ID NO: 88554 - RNA, 32 nt, Human
caggcgugagccaccauguccggcuuguguug

SEQ ID NO: 88555 - RNA, 32 nt, Human
caggcgugagccacccggccuggccuagaaug

SEQ ID NO: 88556 - RNA, 32 nt, Human
caggcgugagccaccgagccuggccgguuaac

SEQ ID NO: 88557 - RNA, 32 nt, Human
caggcgugagccaccgcacccagccaggggga

SEQ ID NO: 88558 - RNA, 32 nt, Human
caggcgugagccaccgcacccagcccaucuag

SEQ ID NO: 88559 - RNA, 32 nt, Human
caggcgugagccaccgcacccagcccguauuu

SEQ ID NO: 88560 - RNA, 32 nt, Human
caggcgugagccaccgcacccagccuuuuacc

SEQ ID NO: 88561 - RNA, 32 nt, Human
caggcgugagccaccgcacccggucagcuauu

SEQ ID NO: 88562 - RNA, 32 nt, Human
caggcgugagccaccgcaccuggccauuaugc

SEQ ID NO: 88563 - RNA, 32 nt, Human
caggcgugagccaccgcaccuggcccccuucc

SEQ ID NO: 88564 - RNA, 32 nt, Human
caggcgugagccaccgcaccuggccuaccugg

SEQ ID NO: 88565 - RNA, 32 nt, Human
caggcgugagccaccgcaucuggccacaauaa

SEQ ID NO: 88566 - RNA, 32 nt, Human
caggcgugagccaccgcgccaagccaaggucu

SEQ ID NO: 88567 - RNA, 32 nt, Human
caggcgugagccaccgcgcccagccaaaaaca

SEQ ID NO: 88568 - RNA, 32 nt, Human
caggcgugagccaccgcgcccagccaaaccuu

SEQ ID NO: 88569 - RNA, 32 nt, Human
caggcgugagccaccgcgcccagccagaacau

SEQ ID NO: 88570 - RNA, 32 nt, Human
caggcgugagccaccgcgcccagccggaauuu

SEQ ID NO: 88571 - RNA, 32 nt, Human
caggcgugagccaccgcgcccagccugauuuu

SEQ ID NO: 88572 - RNA, 32 nt, Human
caggcgugagccaccgcgcccggccaacguca

SEQ ID NO: 88573 - RNA, 32 nt, Human
caggcgugagccaccgcgcccggccaagcauc

SEQ ID NO: 88574 - RNA, 32 nt, Human
caggcgugagccaccgcgcccggccaauuuuu

SEQ ID NO: 88575 - RNA, 32 nt, Human
caggcgugagccaccgcgcccggccagguugu

SEQ ID NO: 88576 - RNA, 32 nt, Human
caggcgugagccaccgcgcccggccaguauug

SEQ ID NO: 88577 - RNA, 32 nt, Human
caggcgugagccaccgcgcccggccaguucaa

SEQ ID NO: 88578 - RNA, 32 nt, Human
caggcgugagccaccgcgcccggccauagggc

SEQ ID NO: 88579 - RNA, 32 nt, Human
caggcgugagccaccgcgcccggccaugauuc

SEQ ID NO: 88580 - RNA, 32 nt, Human
caggcgugagccaccgcgcccggccgaaucuu

SEQ ID NO: 88581 - RNA, 32 nt, Human
caggcgugagccaccgcgcccggccggcuugg

SEQ ID NO: 88582 - RNA, 32 nt, Human
caggcgugagccaccgcgccuggccaaaacaa

SEQ ID NO: 88583 - RNA, 32 nt, Human
caggcgugagccaccgcgccuggccaaaaugc

SEQ ID NO: 88584 - RNA, 32 nt, Human
caggcgugagccaccgcgccuggccaagauag

SEQ ID NO: 88585 - RNA, 32 nt, Human
caggcgugagccaccgcgccuggccacaucuc

SEQ ID NO: 88586 - RNA, 32 nt, Human
caggcgugagccaccgcgccuggccaggcugc

SEQ ID NO: 88587 - RNA, 32 nt, Human
caggcgugagccaccgcgccuggccagggacu

SEQ ID NO: 88588 - RNA, 32 nt, Human
caggcgugagccaccgcgccuggccgauggua

SEQ ID NO: 88589 - RNA, 32 nt, Human
caggcgugagccaccgcgccuggccgaugugg

SEQ ID NO: 88590 - RNA, 32 nt, Human
caggcgugagccaccgcgccuggccuaaaaug

SEQ ID NO: 88591 - RNA, 32 nt, Human
caggcgugagccaccgcgccuggccucagcca

SEQ ID NO: 88592 - RNA, 32 nt, Human
caggcgugagccaccgcgccuggccuucaguu

SEQ ID NO: 88593 - RNA, 32 nt, Human
caggcgugagccaccgcguccagccacauuug

SEQ ID NO: 88594 - RNA, 32 nt, Human
caggcgugagccaccgcguccggccucuuuuu

SEQ ID NO: 88595 - RNA, 32 nt, Human
caggcgugagccaccgcguccggcucaggacc

SEQ ID NO: 88596 - RNA, 32 nt, Human
caggcgugagccaccgcgucuggccucagcca

SEQ ID NO: 88597 - RNA, 32 nt, Human
caggcgugagccaccgcuccuggccuauucuu

SEQ ID NO: 88598 - RNA, 32 nt, Human
caggcgugagccaccgcuccuggccugacaga

SEQ ID NO: 88599 - RNA, 32 nt, Human
caggcgugagccaccguacccagccugguccc

SEQ ID NO: 88600 - RNA, 32 nt, Human
caggcgugagccaccgugcccaaccaugaaau

SEQ ID NO: 88601 - RNA, 32 nt, Human
caggcgugagccaccgugcccagccuccuuuu

SEQ ID NO: 88602 - RNA, 32 nt, Human
caggcgugagccaccgugcccagccuucuguu

SEQ ID NO: 88603 - RNA, 32 nt, Human
caggcgugagccaccgugcccagccuuucucc

SEQ ID NO: 88604 - RNA, 32 nt, Human
caggcgugagccaccgugcccauccaacuuaa

SEQ ID NO: 88605 - RNA, 32 nt, Human
caggcgugagccaccgugcccggcccaaacua

SEQ ID NO: 88606 - RNA, 32 nt, Human
caggcgugagccaccgugcccggcccaaaggg

SEQ ID NO: 88607 - RNA, 32 nt, Human
caggcgugagccaccgugcccggcccaacuau

SEQ ID NO: 88608 - RNA, 32 nt, Human
caggcgugagccaccgugcccggcccaggacu

SEQ ID NO: 88609 - RNA, 32 nt, Human
caggcgugagccaccgugcccggcccuaaaau

SEQ ID NO: 88610 - RNA, 32 nt, Human
caggcgugagccaccgugcccggcccuuuucc

SEQ ID NO: 88611 - RNA, 32 nt, Human
caggcgugagccaccgugcccggccuaaauaa

SEQ ID NO: 88612 - RNA, 32 nt, Human
caggcgugagccaccgugcccggccuacaaau

SEQ ID NO: 88613 - RNA, 32 nt, Human
caggcgugagccaccgugcccggccuccccug

SEQ ID NO: 88614 - RNA, 32 nt, Human
caggcgugagccaccgugcccggccucuccca

SEQ ID NO: 88615 - RNA, 32 nt, Human
caggcgugagccaccgugcccggccugauguu

SEQ ID NO: 88616 - RNA, 32 nt, Human
caggcgugagccaccgugcccggccugauucu

SEQ ID NO: 88617 - RNA, 32 nt, Human
caggcgugagccaccgugcccggccugugcuu

SEQ ID NO: 88618 - RNA, 32 nt, Human
caggcgugagccaccgugccugccccagaaug

SEQ ID NO: 88619 - RNA, 32 nt, Human
caggcgugagccaccgugccuggccaagaggc

SEQ ID NO: 88620 - RNA, 32 nt, Human
caggcgugagccaccgugccuggccacgccca

SEQ ID NO: 88621 - RNA, 32 nt, Human
caggcgugagccaccgugccuggccagaaacu

SEQ ID NO: 88622 - RNA, 32 nt, Human
caggcgugagccaccgugccuggccaggcccc

SEQ ID NO: 88623 - RNA, 32 nt, Human
caggcgugagccaccgugccuggcccugguuu

SEQ ID NO: 88624 - RNA, 32 nt, Human
caggcgugagccaccgugccuggccgauguca

SEQ ID NO: 88625 - RNA, 32 nt, Human
caggcgugagccaccgugccuggccgugauuu

SEQ ID NO: 88626 - RNA, 32 nt, Human
caggcgugagccaccgugccuggccuaaauaa

SEQ ID NO: 88627 - RNA, 32 nt, Human
caggcgugagccaccgugccuggcugagaaga

SEQ ID NO: 88628 - RNA, 32 nt, Human
caggcgugagccaccgugccuggcuguaguug

SEQ ID NO: 88629 - RNA, 32 nt, Human
caggcgugagccaccgugcucagccuaaauac

SEQ ID NO: 88630 - RNA, 32 nt, Human
caggcgugagccaccgugcugggccaaaaauc

SEQ ID NO: 88631 - RNA, 32 nt, Human
caggcgugagccaccucacccagccggcuaau

SEQ ID NO: 88632 - RNA, 32 nt, Human
caggcgugagccaccucaccuggccuuuucuu

SEQ ID NO: 88633 - RNA, 32 nt, Human
caggcgugagccaccucgcccggccaauccac

SEQ ID NO: 88634 - RNA, 32 nt, Human
caggcgugagccaccuugcccagcccacauca

SEQ ID NO: 88635 - RNA, 32 nt, Human
caggcgugagccaccuugccuagcccacauca

SEQ ID NO: 88636 - RNA, 32 nt, Human
caggcgugagccacggcacgcagccagcaagu

SEQ ID NO: 88637 - RNA, 32 nt, Human
caggcgugagccacggcgcccagccugugcuu

SEQ ID NO: 88638 - RNA, 32 nt, Human
caggcgugagccacuacacccagccaaucagu

SEQ ID NO: 88639 - RNA, 32 nt, Human
caggcgugagccacugagccagccagcauuag

SEQ ID NO: 88640 - RNA, 32 nt, Human
caggcgugagccacugcacccagccaaaaauu

SEQ ID NO: 88641 - RNA, 32 nt, Human
caggcgugagccacugcacccagccgagugag

SEQ ID NO: 88642 - RNA, 32 nt, Human
caggcgugagccacugcacccagccuagaauc

SEQ ID NO: 88643 - RNA, 32 nt, Human
caggcgugagccacugcacccagccuauucua

SEQ ID NO: 88644 - RNA, 32 nt, Human
caggcgugagccacugcacccagccucauguu

SEQ ID NO: 88645 - RNA, 32 nt, Human
caggcgugagccacugcacccagccucuuuuu

SEQ ID NO: 88646 - RNA, 32 nt, Human
caggcgugagccacugcacccagccugggaga

SEQ ID NO: 88647 - RNA, 32 nt, Human
caggcgugagccacugcacccggccuaauuuc

SEQ ID NO: 88648 - RNA, 32 nt, Human
caggcgugagccacugcacccggcucaccacu

SEQ ID NO: 88649 - RNA, 32 nt, Human
caggcgugagccacugcaccuggcccucgacu

SEQ ID NO: 88650 - RNA, 32 nt, Human
caggcgugagccacugcaccuggccucuguug

SEQ ID NO: 88651 - RNA, 32 nt, Human
caggcgugagccacugcaccuggccugacauu

SEQ ID NO: 88652 - RNA, 32 nt, Human
caggcgugagccacugcaccuggccuuauaaa

SEQ ID NO: 88653 - RNA, 32 nt, Human
caggcgugagccacugcagugggccaauuuuu

SEQ ID NO: 88654 - RNA, 32 nt, Human
caggcgugagccacugcccagcuauacuguau

SEQ ID NO: 88655 - RNA, 32 nt, Human
caggcgugagccacugcgcccagccaacacua

SEQ ID NO: 88656 - RNA, 32 nt, Human
caggcgugagccacugcgcccagccugaauuu

SEQ ID NO: 88657 - RNA, 32 nt, Human
caggcgugagccacugcgcccagccuguuccu

SEQ ID NO: 88658 - RNA, 32 nt, Human
caggcgugagccacugcgcccagccuuguauu

SEQ ID NO: 88659 - RNA, 32 nt, Human
caggcgugagccacugcgcccagcuaccuguc

SEQ ID NO: 88660 - RNA, 32 nt, Human
caggcgugagccacugcgcccggccaauaauu

SEQ ID NO: 88661 - RNA, 32 nt, Human
caggcgugagccacugcgcccggccaauuuua

SEQ ID NO: 88662 - RNA, 32 nt, Human
caggcgugagccacugcgcccggccacauuca

SEQ ID NO: 88663 - RNA, 32 nt, Human
caggcgugagccacugcgcccggccagcccug

SEQ ID NO: 88664 - RNA, 32 nt, Human
caggcgugagccacugcgcccugccuguuugu

SEQ ID NO: 88665 - RNA, 32 nt, Human
caggcgugagccacugcgccuggccaagaaug

SEQ ID NO: 88666 - RNA, 32 nt, Human
caggcgugagccacugcgccuggccagaccau

SEQ ID NO: 88667 - RNA, 32 nt, Human
caggcgugagccacugcgccuggccaucaggu

SEQ ID NO: 88668 - RNA, 32 nt, Human
caggcgugagccacugcgccuggccuaguuug

SEQ ID NO: 88669 - RNA, 32 nt, Human
caggcgugagccacugcggccagcacauuucc

SEQ ID NO: 88670 - RNA, 32 nt, Human
caggcgugagccacugcguccagccagaaucu

SEQ ID NO: 88671 - RNA, 32 nt, Human
caggcgugagccacugcucguggccaaaaguu

SEQ ID NO: 88672 - RNA, 32 nt, Human
caggcgugagccacugugcccagccaaaagag

SEQ ID NO: 88673 - RNA, 32 nt, Human
caggcgugagccacugugcccagccaccaaau

SEQ ID NO: 88674 - RNA, 32 nt, Human
caggcgugagccacugugcccagccgaugagc

SEQ ID NO: 88675 - RNA, 32 nt, Human
caggcgugagccacugugcccagccggaacag

SEQ ID NO: 88676 - RNA, 32 nt, Human
caggcgugagccacugugcccagccuaagcca

SEQ ID NO: 88677 - RNA, 32 nt, Human
caggcgugagccacugugcccggccaagaauu

SEQ ID NO: 88678 - RNA, 32 nt, Human
caggcgugagccacugugccuagccauucccu

SEQ ID NO: 88679 - RNA, 32 nt, Human
caggcgugagccacugugccucgccuaauuuu

SEQ ID NO: 88680 - RNA, 32 nt, Human
caggcgugagccacugugccugccccaaucuu

SEQ ID NO: 88681 - RNA, 32 nt, Human
caggcgugagccacugugccuggccgacaauu

SEQ ID NO: 88682 - RNA, 32 nt, Human
caggcgugagccacugugccuggccuaucuga

SEQ ID NO: 88683 - RNA, 32 nt, Human
caggcgugagccacugugccuggccuguagug

SEQ ID NO: 88684 - RNA, 32 nt, Human
caggcgugagccacugugccuggccuuaugua

SEQ ID NO: 88685 - RNA, 32 nt, Human
caggcgugagccacugugccuggcugaguuuu

SEQ ID NO: 88686 - RNA, 32 nt, Human
caggcgugagccacugugccuggcugguuauu

SEQ ID NO: 88687 - RNA, 32 nt, Human
caggcgugagccacugugccuggcuuccaucc

SEQ ID NO: 88688 - RNA, 32 nt, Human
caggcgugagccacuguggccaaccuaauuuu

SEQ ID NO: 88689 - RNA, 32 nt, Human
caggcgugagccagcacgcccagcuaauuuuu

SEQ ID NO: 88690 - RNA, 32 nt, Human
caggcgugagccagcgcgugccuggccaaaaa

SEQ ID NO: 88691 - RNA, 32 nt, Human
caggcgugagccaucgugcccagcuagacguc

SEQ ID NO: 88692 - RNA, 32 nt, Human
caggcgugagccauugcgccugggcagguauu

SEQ ID NO: 88693 - RNA, 32 nt, Human
caggcgugagggugugacggccgcgcauucgc

SEQ ID NO: 88694 - RNA, 32 nt, Human
caggcgugcaccaccacaccuggcuaacuuuu

SEQ ID NO: 88695 - RNA, 32 nt, Human
caggcgugcaccaccacgcccggcuaauguuu

SEQ ID NO: 88696 - RNA, 32 nt, Human
caggcgugcaccaccacgcccggcugguauug

SEQ ID NO: 88697 - RNA, 32 nt, Human
caggcgugcaccaccacgccugguuaauuguu

SEQ ID NO: 88698 - RNA, 32 nt, Human
caggcgugcaccaccaugccuggcuaaguuuu

SEQ ID NO: 88699 - RNA, 32 nt, Human
caggcgugcaccacugaguccagccuauauuc

SEQ ID NO: 88700 - RNA, 32 nt, Human
caggcgugcaccacugcgccuagcuccaguac

SEQ ID NO: 88701 - RNA, 32 nt, Human
caggcgugcaccacugugcccggcuaauuugu

SEQ ID NO: 88702 - RNA, 32 nt, Human
caggcgugcgccacugcacccggcccgugaag

SEQ ID NO: 88703 - RNA, 21 nt, Human
caggcgugcucgcagcggcug

SEQ ID NO: 88704 - RNA, 32 nt, Human
caggcgugggaagcggcgagauccucgggcug

SEQ ID NO: 88705 - RNA, 31 nt, Human
caggcguggguggccuagaagaugaggggag

SEQ ID NO: 88706 - RNA, 24 nt, Human
caggcgugguagcucacgccugua

SEQ ID NO: 88707 - RNA, 32 nt, Human
caggcgugugagccaccacgcccggccaugaa

SEQ ID NO: 88708 - RNA, 32 nt, Human
caggcgugugccaccaguccuggcuaauuuuu

SEQ ID NO: 88709 - RNA, 32 nt, Human
caggcguuaccuccuuuucuccaucucagcau

SEQ ID NO: 88710 - RNA, 32 nt, Human
caggcguucgagacuggcaugggaaacauggc

SEQ ID NO: 88711 - RNA, 32 nt, Human
caggcguucucuagauccuuuccucuguuucc

SEQ ID NO: 88712 - RNA, 32 nt, Human
caggcguuuugcugaaaacgugucggagggcu

SEQ ID NO: 88713 - RNA, 32 nt, Human
caggcuacagcacuccagccugggcaacaaga

SEQ ID NO: 88714 - RNA, 32 nt, Human
caggcuacaguauuggucccauggacaagaag

SEQ ID NO: 88715 - RNA, 32 nt, Human
caggcuaccagaggaagccuuugguccuaacg

SEQ ID NO: 88716 - RNA, 32 nt, Human
caggcuaccauggucuacaagacucucuucgc

SEQ ID NO: 88717 - RNA, 32 nt, Human
caggcuaccugucagcagucucacugcgaggc

SEQ ID NO: 88718 - RNA, 32 nt, Human
caggcuaccuuaaaacguuccuagucacuucu

SEQ ID NO: 88719 - RNA, 21 nt, Human
caggcuacgccguggcuggcc

SEQ ID NO: 88720 - RNA, 32 nt, Human
caggcuacucucaaacuccugaccucagguga

SEQ ID NO: 88721 - RNA, 32 nt, Human
caggcuacugcuuuacaaaaccagaacugauc

SEQ ID NO: 88722 - RNA, 18 nt, Human
caggcuagagugcagugg

SEQ ID NO: 88723 - RNA, 19 nt, Human
caggcuagagugcaguggc

SEQ ID NO: 88724 - RNA, 32 nt, Human
caggcuaggacaucugccaccaagagagggcu

SEQ ID NO: 88725 - RNA, 32 nt, Human
caggcuaggacgcucugagcugugcauguaca

SEQ ID NO: 88726 - RNA, 32 nt, Human
caggcuagucacgaacuccuaaccucagguga

SEQ ID NO: 88727 - RNA, 32 nt, Human
caggcuagucucaaaccccugaccuuaggugg

SEQ ID NO: 88728 - RNA, 32 nt, Human
caggcuagucucaaacucccgaccuuagguga

SEQ ID NO: 88729 - RNA, 32 nt, Human
caggcuagucucaaacuccugaccucagguga

SEQ ID NO: 88730 - RNA, 32 nt, Human
caggcuagucucaaacuccugaccucaggugc

SEQ ID NO: 88731 - RNA, 32 nt, Human
caggcuagucucaaacuccugggcucaagcaa

SEQ ID NO: 88732 - RNA, 32 nt, Human
caggcuagucucaaacuccugggcucaaguga

SEQ ID NO: 88733 - RNA, 32 nt, Human
caggcuaguugaggauucaguacuucaguuga

SEQ ID NO: 88734 - RNA, 32 nt, Human
caggcuaugccauggcagcugcagaggcccag

SEQ ID NO: 88735 - RNA, 32 nt, Human
caggcuauuguuggccagcccuggguggaggu

SEQ ID NO: 88736 - RNA, 24 nt, Human
caggcucaaacaauucuccugccu

SEQ ID NO: 88737 - RNA, 24 nt, Human
caggcucaaaucauccuccugccu

SEQ ID NO: 88738 - RNA, 32 nt, Human
caggcucaacaucacauggaagcugccaaugc

SEQ ID NO: 88739 - RNA, 32 nt, Human
caggcucaaccugcacuuccuaggcagcuacc

SEQ ID NO: 88740 - RNA, 32 nt, Human
caggcucaacucugguucugacugccugagac

SEQ ID NO: 88741 - RNA, 32 nt, Human
caggcucaagaaauccucccaccucagccucc

SEQ ID NO: 88742 - RNA, 24 nt, Human
caggcucaagcaauucuccuaccu

SEQ ID NO: 88743 - RNA, 24 nt, Human
caggcucaagcaauucuccugccu

SEQ ID NO: 88744 - RNA, 24 nt, Human
caggcucaagcaguucuccugccu

SEQ ID NO: 88745 - RNA, 24 nt, Human
caggcucaagcgacccucccaccu

SEQ ID NO: 88746 - RNA, 24 nt, Human
caggcucaagcgauccucccaccu

SEQ ID NO: 88747 - RNA, 32 nt, Human
caggcucaagcgauccucccaccucagcuccc

SEQ ID NO: 88748 - RNA, 24 nt, Human
caggcucaagcgauccucccagcu

SEQ ID NO: 88749 - RNA, 24 nt, Human
caggcucaagcgauccucccgccu

SEQ ID NO: 88750 - RNA, 24 nt, Human
caggcucaagcgauccuccugccu

SEQ ID NO: 88751 - RNA, 24 nt, Human
caggcucaagcgauccuucugccu

SEQ ID NO: 88752 - RNA, 24 nt, Human
caggcucaagcgauucucccaccu

SEQ ID NO: 88753 - RNA, 32 nt, Human
caggcucaagcgauucucccaccucagccauc

SEQ ID NO: 88754 - RNA, 24 nt, Human
caggcucaagcgauucucucacuu

SEQ ID NO: 88755 - RNA, 24 nt, Human
caggcucaagcgguccuucuaccu

SEQ ID NO: 88756 - RNA, 32 nt, Human
caggcucaagcuguccucccaccucagccucc

SEQ ID NO: 88757 - RNA, 32 nt, Human
caggcucaagugauccucccaccccagccucc

SEQ ID NO: 88758 - RNA, 24 nt, Human
caggcucaagugauccucccaccu

SEQ ID NO: 88759 - RNA, 32 nt, Human
caggcucaagugauccucccaccucagccccc

SEQ ID NO: 88760 - RNA, 32 nt, Human
caggcucaagugauccucccaccucagccucc

SEQ ID NO: 88761 - RNA, 32 nt, Human
caggcucaagugauccucccaccucagccucu

SEQ ID NO: 88762 - RNA, 32 nt, Human
caggcucaagugauccucccaccucagucucc

SEQ ID NO: 88763 - RNA, 32 nt, Human
caggcucaagugauccucccacuucagcuucc

SEQ ID NO: 88764 - RNA, 24 nt, Human
caggcucaagugauccucuuaccu

SEQ ID NO: 88765 - RNA, 24 nt, Human
caggcucaagugauucuccugccu

SEQ ID NO: 88766 - RNA, 31 nt, Human
caggcucacagcuggaacccuggugucuccu

SEQ ID NO: 88767 - RNA, 32 nt, Human
caggcucacaugcacaggaaugcuacaugaug

SEQ ID NO: 88768 - RNA, 32 nt, Human
caggcucacaugcaccaggaacugcauguguc

SEQ ID NO: 88769 - RNA, 32 nt, Human
caggcucaccauggugccgcaugccaucuugg

SEQ ID NO: 88770 - RNA, 32 nt, Human
caggcucacccaggcuggggucugagugucac

SEQ ID NO: 88771 - RNA, 32 nt, Human
caggcucaccuguggauggagagccguggggu

SEQ ID NO: 88772 - RNA, 32 nt, Human
caggcucaccuuaaaaucagcccuugauccca

SEQ ID NO: 88773 - RNA, 19 nt, Human
caggcucacugcagccuca

SEQ ID NO: 88774 - RNA, 19 nt, Human
caggcucagaagccaggga

SEQ ID NO: 88775 - RNA, 32 nt, Human
caggcucagagcagaccccgcccggcgaggag

SEQ ID NO: 88776 - RNA, 32 nt, Human
caggcucagaggcugaagcaggaggaaggaag

SEQ ID NO: 88777 - RNA, 32 nt, Human
caggcucagauuaaaagacagacggcaacacu

SEQ ID NO: 88778 - RNA, 32 nt, Human
caggcucagcaacccaggccucccgcaggcag

SEQ ID NO: 88779 - RNA, 32 nt, Human
caggcucagcagcgugcuguggaaguggaagu

SEQ ID NO: 88780 - RNA, 32 nt, Human
caggcucagcccaccccuccaccucucucucg

SEQ ID NO: 88781 - RNA, 32 nt, Human
caggcucagccccagcccucagcccagucaau

SEQ ID NO: 88782 - RNA, 32 nt, Human
caggcucagcugcugggucaccaggagaaugg

SEQ ID NO: 88783 - RNA, 32 nt, Human
caggcucaggaacugccagggagggaagauga

SEQ ID NO: 88784 - RNA, 32 nt, Human
caggcucaggcagaauugaguacggugcgucu

SEQ ID NO: 88785 - RNA, 24 nt, Human
caggcucaggugauccucccaccu

SEQ ID NO: 88786 - RNA, 32 nt, Human
caggcucaggugauccucccaccucagccucc

SEQ ID NO: 88787 - RNA, 24 nt, Human
caggcucagguggccuccuggccu

SEQ ID NO: 88788 - RNA, 32 nt, Human
caggcucagguguacagguuauucuggguuaa

SEQ ID NO: 88789 - RNA, 32 nt, Human
caggcucaguggcucaugccuauauuccagca

SEQ ID NO: 88790 - RNA, 32 nt, Human
caggcucaugccacugcgcccagcuaauuuuu

SEQ ID NO: 88791 - RNA, 32 nt, Human
caggcucaugguugggagcugagggaaggcug

SEQ ID NO: 88792 - RNA, 32 nt, Human
caggcucaugucuuuacaccuucacucagcca

SEQ ID NO: 88793 - RNA, 32 nt, Human
caggcucaugugauccucccaccucagccucc

SEQ ID NO: 88794 - RNA, 32 nt, Human
caggcuccaccucaguuuaucaacauuauaag

SEQ ID NO: 88795 - RNA, 23 nt, Human
caggcuccacuccugggcuccau

SEQ ID NO: 88796 - RNA, 32 nt, Human
caggcuccagaagaaagacagcagcucauggc

SEQ ID NO: 88797 - RNA, 32 nt, Human
caggcuccagggccacggcggagucaugguuc

SEQ ID NO: 88798 - RNA, 32 nt, Human
caggcuccaggucuuacuaugcagccugaagu

SEQ ID NO: 88799 - RNA, 22 nt, Human
caggcuccauucagguccugcu

SEQ ID NO: 88800 - RNA, 32 nt, Human
caggcuccauuucucugccuucccauuggaaa

SEQ ID NO: 88801 - RNA, 32 nt, Human
caggcucccaaagugugggauuauagugugag

SEQ ID NO: 88802 - RNA, 19 nt, Human
caggcucccaccacucuca

SEQ ID NO: 88803 - RNA, 32 nt, Human
caggcucccagauugauccagacuguguguga

SEQ ID NO: 88804 - RNA, 23 nt, Human
caggcucccccaucugcccagca

SEQ ID NO: 88805 - RNA, 20 nt, Human
caggcucccccggcccgggc

SEQ ID NO: 88806 - RNA, 23 nt, Human
caggcucccccuuccccaaggca

SEQ ID NO: 88807 - RNA, 32 nt, Human
caggcuccccuccucggcuuccuuccucucug

SEQ ID NO: 88808 - RNA, 21 nt, Human
caggcucccgccagcgucgcu

SEQ ID NO: 88809 - RNA, 23 nt, Human
caggcucccuacacaguccugcu

SEQ ID NO: 88810 - RNA, 32 nt, Human
caggcucccucaggaccccauccuuuccugcc

SEQ ID NO: 88811 - RNA, 23 nt, Human
caggcucccugaacaguccuguu

SEQ ID NO: 88812 - RNA, 32 nt, Human
caggcucccugagaagccggcaucugcccaac

SEQ ID NO: 88813 - RNA, 24 nt, Human
caggcucccugccccacccauuca

SEQ ID NO: 88814 - RNA, 22 nt, Human
caggcucccuggcuggccgguu

SEQ ID NO: 88815 - RNA, 18 nt, Human
caggcucccuguguccug

SEQ ID NO: 88816 - RNA, 19 nt, Human
caggcucccuuccugggga

SEQ ID NO: 88817 - RNA, 32 nt, Human
caggcucccuuucucuucuuccccagguccuu

SEQ ID NO: 88818 - RNA, 32 nt, Human
caggcuccggacgcagagguggcaguggcacc

SEQ ID NO: 88819 - RNA, 31 nt, Human
caggcuccuaaauaaaccagcaacucccucg

SEQ ID NO: 88820 - RNA, 32 nt, Human
caggcuccuccaggccucugguuuagcggagc

SEQ ID NO: 88821 - RNA, 32 nt, Human
caggcuccuccgagcaccucaugcauguccca

SEQ ID NO: 88822 - RNA, 32 nt, Human
caggcuccuccucuccccuugcggccuuucua

SEQ ID NO: 88823 - RNA, 23 nt, Human
caggcuccucggaacguccggcu

SEQ ID NO: 88824 - RNA, 32 nt, Human
caggcuccucuccucaaaucaagcccuggaca

SEQ ID NO: 88825 - RNA, 23 nt, Human
caggcuccugagaugucuagacu

SEQ ID NO: 88826 - RNA, 32 nt, Human
caggcuccugaggaccccucaggcccuggcac

SEQ ID NO: 88827 - RNA, 32 nt, Human
caggcuccugaggaggauugagggugaaaguc

SEQ ID NO: 88828 - RNA, 20 nt, Human
caggcuccugauuccucuuc

SEQ ID NO: 88829 - RNA, 21 nt, Human
caggcuccugcagucccagcu

SEQ ID NO: 88830 - RNA, 20 nt, Human
caggcuccugcugcaccgcu

SEQ ID NO: 88831 - RNA, 21 nt, Human
caggcuccuucucuucuccca

SEQ ID NO: 88832 - RNA, 17 nt, Human
caggcucgauccuccca

SEQ ID NO: 88833 - RNA, 32 nt, Human
caggcucgcugccucuccuccccaacugcagg

SEQ ID NO: 88834 - RNA, 32 nt, Human
caggcucgucucaaacuccugaccucagguga

SEQ ID NO: 88835 - RNA, 22 nt, Human
caggcucgugauccuccugccu

SEQ ID NO: 88836 - RNA, 22 nt, Human
caggcucuaagucauuuucucc

SEQ ID NO: 88837 - RNA, 32 nt, Human
caggcucuaggaucgauuccagaaggagccuu

SEQ ID NO: 88838 - RNA, 32 nt, Human
caggcucuccagaaaacuacuacaauggccaa

SEQ ID NO: 88839 - RNA, 32 nt, Human
caggcucuccgacccagcuaccgggaaugggg

SEQ ID NO: 88840 - RNA, 22 nt, Human
caggcucucgggguagcuagcu

SEQ ID NO: 88841 - RNA, 21 nt, Human
caggcucugagccacugagca

SEQ ID NO: 88842 - RNA, 32 nt, Human
caggcucugaguguccaguggcagccagaaca

SEQ ID NO: 88843 - RNA, 32 nt, Human
caggcucugaugcugagaggcuugccuccggg

SEQ ID NO: 88844 - RNA, 32 nt, Human
caggcucugcccaccaaggugcccucuccccg

SEQ ID NO: 88845 - RNA, 21 nt, Human
caggcucugccucacguccuc

SEQ ID NO: 88846 - RNA, 32 nt, Human
caggcucugcuacguccugccugugaagaauc

SEQ ID NO: 88847 - RNA, 32 nt, Human
caggcucugcuucacuguccagccuuggaacu

SEQ ID NO: 88848 - RNA, 32 nt, Human
caggcucugggcaguagccacagagacuuuag

SEQ ID NO: 88849 - RNA, 32 nt, Human
caggcucugggcucagguuggcacaucucacu

SEQ ID NO: 88850 - RNA, 23 nt, Human
caggcucugggucagguucugcu

SEQ ID NO: 88851 - RNA, 24 nt, Human
caggcucugugcuccuuccagccc

SEQ ID NO: 88852 - RNA, 32 nt, Human
caggcucugugcugaugaacagccuggcugag

SEQ ID NO: 88853 - RNA, 32 nt, Human
caggcucuguggcccaggcugagagcagcagg

SEQ ID NO: 88854 - RNA, 22 nt, Human
caggcucuuacagccacaggca

SEQ ID NO: 88855 - RNA, 23 nt, Human
caggcucuuccaaggggccagcu

SEQ ID NO: 88856 - RNA, 32 nt, Human
caggcucuucucuccggcuccagccugugauu

SEQ ID NO: 88857 - RNA, 22 nt, Human
caggcucuucuggucaccaggc

SEQ ID NO: 88858 - RNA, 23 nt, Human
caggcucuucuggucaccaggcu

SEQ ID NO: 88859 - RNA, 19 nt, Human
caggcucuucuuccagccu

SEQ ID NO: 88860 - RNA, 32 nt, Human
caggcucuucuuuccgcugaaucuuccuuccc

SEQ ID NO: 88861 - RNA, 32 nt, Human
caggcucuugcacuuccuuuguuuucuuucug

SEQ ID NO: 88862 - RNA, 19 nt, Human
caggcucuuucuccagccc

SEQ ID NO: 88863 - RNA, 32 nt, Human
caggcucuuugagggcagggauugugucuggu

SEQ ID NO: 88864 - RNA, 32 nt, Human
caggcugaagaaggugggaggggagggcggaa

SEQ ID NO: 88865 - RNA, 32 nt, Human
caggcugaagacagagaugauauguuagcuug

SEQ ID NO: 88866 - RNA, 32 nt, Human
caggcugaagagguccagcaggcagcagacgg

SEQ ID NO: 88867 - RNA, 32 nt, Human
caggcugaagcgauccucccaccucaaccucc

SEQ ID NO: 88868 - RNA, 32 nt, Human
caggcugaagucugucaugaaaccacuuauuu

SEQ ID NO: 88869 - RNA, 32 nt, Human
caggcugaagugaagggcaugugcacagaaac

SEQ ID NO: 88870 - RNA, 32 nt, Human
caggcugaagugcaguagugcaaucucagcuc

SEQ ID NO: 88871 - RNA, 32 nt, Human
caggcugacagggagggcaaagagugaaaagg

SEQ ID NO: 88872 - RNA, 20 nt, Human
caggcugacauggcuggcca

SEQ ID NO: 88873 - RNA, 32 nt, Human
caggcugaccaggaucaccaggaagcuccaga

SEQ ID NO: 88874 - RNA, 32 nt, Human
caggcugacccgaagcccugcagagccccauc

SEQ ID NO: 88875 - RNA, 32 nt, Human
caggcugaccuggccucccguggaccacucgc

SEQ ID NO: 88876 - RNA, 18 nt, Human
caggcugacguugccuga

SEQ ID NO: 88877 - RNA, 32 nt, Human
caggcugacuccaggcccuguaacaccgggaa

SEQ ID NO: 88878 - RNA, 32 nt, Human
caggcugacuucugucucugcaaagaggaccu

SEQ ID NO: 88879 - RNA, 32 nt, Human
caggcugagagaauugggcagggagagggcgg

SEQ ID NO: 88880 - RNA, 32 nt, Human
caggcugagauggaaaacaagcccuuuauuga

SEQ ID NO: 88881 - RNA, 32 nt, Human
caggcugagaugggaggauggcuugagcccag

SEQ ID NO: 88882 - RNA, 32 nt, Human
caggcugagcaaacauccaccuucccugucuu

SEQ ID NO: 88883 - RNA, 32 nt, Human
caggcugagccccgggaggagagaucaaagcu

SEQ ID NO: 88884 - RNA, 32 nt, Human
caggcugagccccuccuggaugccugcagacu

SEQ ID NO: 88885 - RNA, 32 nt, Human
caggcugagccgcgggccggcggggccgagcu

SEQ ID NO: 88886 - RNA, 32 nt, Human
caggcugaggcugagggucucaagggccagag

SEQ ID NO: 88887 - RNA, 32 nt, Human
caggcugaggcugcugguggccauguuccuac

SEQ ID NO: 88888 - RNA, 32 nt, Human
caggcugaggcuguggaggggacaagcacgcc

SEQ ID NO: 88889 - RNA, 32 nt, Human
caggcugaggggguucagaaccagccuggcca

SEQ ID NO: 88890 - RNA, 32 nt, Human
caggcugaggucuccgagcggcucgccauggc

SEQ ID NO: 88891 - RNA, 32 nt, Human
caggcugagguggggaaggagggacuuggcug

SEQ ID NO: 88892 - RNA, 32 nt, Human
caggcugaguccccaaaccugcacuagaggca

SEQ ID NO: 88893 - RNA, 32 nt, Human
caggcugauccagggacuuagagcuuguuacc

SEQ ID NO: 88894 - RNA, 32 nt, Human
caggcugaucucaaacaucugaccucaggaag

SEQ ID NO: 88895 - RNA, 32 nt, Human
caggcugaucucaaacuccuaggcuuaaguga

SEQ ID NO: 88896 - RNA, 32 nt, Human
caggcugaucucaaacuccugaccucaaguga

SEQ ID NO: 88897 - RNA, 32 nt, Human
caggcugaucucaaacuccugaccucaugauc

SEQ ID NO: 88898 - RNA, 32 nt, Human
caggcugaucucaaacuccuggacucaagcga

SEQ ID NO: 88899 - RNA, 32 nt, Human
caggcugaucucaaacuccuggccucaaguga

SEQ ID NO: 88900 - RNA, 32 nt, Human
caggcugaucucaaacuccuggcuucaaguga

SEQ ID NO: 88901 - RNA, 32 nt, Human
caggcugaucucaaacuucugaccucagguga

SEQ ID NO: 88902 - RNA, 32 nt, Human
caggcugaucucgaacuccuaaccucaaguga

SEQ ID NO: 88903 - RNA, 32 nt, Human
caggcugaucucguaucucaggaaccucaggc

SEQ ID NO: 88904 - RNA, 32 nt, Human
caggcugcaagaacagugcuggggugaguacc

SEQ ID NO: 88905 - RNA, 32 nt, Human
caggcugcaaugagccaagaucacgccacuga

SEQ ID NO: 88906 - RNA, 19 nt, Human
caggcugcacaaguggaag

SEQ ID NO: 88907 - RNA, 32 nt, Human
caggcugcacacacagagcgugucggagugca

SEQ ID NO: 88908 - RNA, 32 nt, Human
caggcugcacacauucuuauuaggauuccacc

SEQ ID NO: 88909 - RNA, 32 nt, Human
caggcugcacaucucaguauauguagggaccc

SEQ ID NO: 88910 - RNA, 32 nt, Human
caggcugcacgcggcggacugggcaggccggg

SEQ ID NO: 88911 - RNA, 23 nt, Human
caggcugcagaauggcaggaagg

SEQ ID NO: 88912 - RNA, 32 nt, Human
caggcugcagcccucuuggggcuccaggauuu

SEQ ID NO: 88913 - RNA, 32 nt, Human
caggcugcagcgcgcuaugaucgcgccugcga

SEQ ID NO: 88914 - RNA, 32 nt, Human
caggcugcagcguuucaggaaugaaaagccug

SEQ ID NO: 88915 - RNA, 32 nt, Human
caggcugcagcucgggugucuguggcuucuaa

SEQ ID NO: 88916 - RNA, 32 nt, Human
caggcugcaggaaaucugccuccaggagggga

SEQ ID NO: 88917 - RNA, 32 nt, Human
caggcugcagugagcucugaugguaccacugc

SEQ ID NO: 88918 - RNA, 32 nt, Human
caggcugcagugagcugugacugcaccacugc

SEQ ID NO: 88919 - RNA, 32 nt, Human
caggcugcagugagcugugaucauaccacugc

SEQ ID NO: 88920 - RNA, 32 nt, Human
caggcugcagugcaguggcaugaucauggcuc

SEQ ID NO: 88921 - RNA, 22 nt, Human
caggcugcaucucuuugaaagg

SEQ ID NO: 88922 - RNA, 32 nt, Human
caggcugccaagguccuguacagcagagaccc

SEQ ID NO: 88923 - RNA, 32 nt, Human
caggcugccagacagcugcccuggcguugccg

SEQ ID NO: 88924 - RNA, 32 nt, Human
caggcugccaggcuggaguggaguggcaugau

SEQ ID NO: 88925 - RNA, 32 nt, Human
caggcugccaggcuggcguacaguggcgcaau

SEQ ID NO: 88926 - RNA, 21 nt, Human
caggcugccauagcacaagug

SEQ ID NO: 88927 - RNA, 22 nt, Human
caggcugcccacuccucauuca

SEQ ID NO: 88928 - RNA, 32 nt, Human
caggcugcccccaggguuucugcacugguccc

SEQ ID NO: 88929 - RNA, 32 nt, Human
caggcugccccucgccccagcauccaaguccu

SEQ ID NO: 88930 - RNA, 32 nt, Human
caggcugccccucuccuuccccggcucgcagg

SEQ ID NO: 88931 - RNA, 20 nt, Human
caggcugcccucccuuggug

SEQ ID NO: 88932 - RNA, 23 nt, Human
caggcugcccugaugcuaggaag

SEQ ID NO: 88933 - RNA, 21 nt, Human
caggcugccgccgcugggagg

SEQ ID NO: 88934 - RNA, 32 nt, Human
caggcugccgcggggcaggggugcagugggug

SEQ ID NO: 88935 - RNA, 32 nt, Human
caggcugccucuucugccccggagcuggggug

SEQ ID NO: 88936 - RNA, 32 nt, Human
caggcugccugcuaacaucacacccagcaagu

SEQ ID NO: 88937 - RNA, 32 nt, Human
caggcugccugcuaugugaugccugagcacaa

SEQ ID NO: 88938 - RNA, 32 nt, Human
caggcugccuggucacugccccucucucagug

SEQ ID NO: 88939 - RNA, 32 nt, Human
caggcugccuuugagaagagcuuggcuauugu

SEQ ID NO: 88940 - RNA, 32 nt, Human
caggcugcgugccuccgucugccugugugcug

SEQ ID NO: 88941 - RNA, 32 nt, Human
caggcugcucacugcgggcccuaugacccuuu

SEQ ID NO: 88942 - RNA, 32 nt, Human
caggcugcucagacuccuggguggcuuccaga

SEQ ID NO: 88943 - RNA, 32 nt, Human
caggcugcucaggaugcaagauauugucaaga

SEQ ID NO: 88944 - RNA, 32 nt, Human
caggcugcucucaaaccccugaccucaaauga

SEQ ID NO: 88945 - RNA, 32 nt, Human
caggcugcucucaaacuccugaccucagguga

SEQ ID NO: 88946 - RNA, 32 nt, Human
caggcugcucucagacuccugaucucagguga

SEQ ID NO: 88947 - RNA, 22 nt, Human
caggcugcucuuuguuagaagg

SEQ ID NO: 88948 - RNA, 32 nt, Human
caggcugcugagccuguuccuuggcugggguc

SEQ ID NO: 88949 - RNA, 22 nt, Human
caggcugcugcuuuguggaaag

SEQ ID NO: 88950 - RNA, 32 nt, Human
caggcugcugucuccuccccagaaagaguccu

SEQ ID NO: 88951 - RNA, 22 nt, Human
caggcugcugugaguaggaagg

SEQ ID NO: 88952 - RNA, 32 nt, Human
caggcuggaaagugccuuuucugagaggauaa

SEQ ID NO: 88953 - RNA, 32 nt, Human
caggcuggaaccugggcugccccagaacacag

SEQ ID NO: 88954 - RNA, 32 nt, Human
caggcuggaagaaggcccucaccagaacccaa

SEQ ID NO: 88955 - RNA, 32 nt, Human
caggcuggaaugcagugcaguggcacaaucuc

SEQ ID NO: 88956 - RNA, 32 nt, Human
caggcuggaaugcaguggcacaaucauagcuc

SEQ ID NO: 88957 - RNA, 32 nt, Human
caggcuggaaugcaguggugugaacugggcuc

SEQ ID NO: 88958 - RNA, 31 nt, Human
caggcuggacaaugcccguugacuuggggca

SEQ ID NO: 88959 - RNA, 32 nt, Human
caggcuggaccccggcuccacacccacaucca

SEQ ID NO: 88960 - RNA, 32 nt, Human
caggcuggagaaaagaagcugccaccaugguu

SEQ ID NO: 88961 - RNA, 32 nt, Human
caggcuggagcagcagcugcauccugcauuuc

SEQ ID NO: 88962 - RNA, 32 nt, Human
caggcuggagcaguggcacgaucucgccucac

SEQ ID NO: 88963 - RNA, 32 nt, Human
caggcuggaguacaguggcacaaucauggcuc

SEQ ID NO: 88964 - RNA, 32 nt, Human
caggcuggaguacaguggcaugaucauagcuc

SEQ ID NO: 88965 - RNA, 32 nt, Human
caggcuggaguacaguggcaugaucauggcuc

SEQ ID NO: 88966 - RNA, 32 nt, Human
caggcuggaguauaguggcacaaacauggcuc

SEQ ID NO: 88967 - RNA, 32 nt, Human
caggcuggaguauaguggcaugaucauagauc

SEQ ID NO: 88968 - RNA, 32 nt, Human
caggcuggagugcaauagcgcgaucuuggcuc

SEQ ID NO: 88969 - RNA, 30 nt, Human
caggcuggagugcaaugggcacaauuauag

SEQ ID NO: 88970 - RNA, 32 nt, Human
caggcuggagugcaauggugcaaugaucucgg

SEQ ID NO: 88971 - RNA, 32 nt, Human
caggcuggagugcaguagugcaaucagggcuc

SEQ ID NO: 88972 - RNA, 18 nt, Human
caggcuggagugcagugg

SEQ ID NO: 88973 - RNA, 32 nt, Human
caggcuggagugcaguggcacaaucauggcuc

SEQ ID NO: 88974 - RNA, 20 nt, Human
caggcuggagugcaguggug

SEQ ID NO: 88975 - RNA, 21 nt, Human
caggcuggagugcaguggugu

SEQ ID NO: 88976 - RNA, 18 nt, Human
caggcuggagugcggugg

SEQ ID NO: 88977 - RNA, 32 nt, Human
caggcuggagugcgguggugugaucuuggcuc

SEQ ID NO: 88978 - RNA, 32 nt, Human
caggcuggagugguacaauggcgugucucggc

SEQ ID NO: 88979 - RNA, 23 nt, Human
caggcuggaguuucaggcacugc

SEQ ID NO: 88980 - RNA, 32 nt, Human
caggcuggauagagucccuuccuuugguccug

SEQ ID NO: 88981 - RNA, 32 nt, Human
caggcuggcaggcaucucggcuugcaggaggc

SEQ ID NO: 88982 - RNA, 32 nt, Human
caggcuggcaucucccccacccugugccccuu

SEQ ID NO: 88983 - RNA, 32 nt, Human
caggcuggccaacacggugaaaccccgucucu

SEQ ID NO: 88984 - RNA, 32 nt, Human
caggcuggccaacauggcaaaaccccaugucu

SEQ ID NO: 88985 - RNA, 32 nt, Human
caggcuggccaacaugguaaaacccugucucu

SEQ ID NO: 88986 - RNA, 32 nt, Human
caggcuggccaacauggugaaaccccaucucu

SEQ ID NO: 88987 - RNA, 32 nt, Human
caggcuggccagcauggugaaaccccgucugu

SEQ ID NO: 88988 - RNA, 32 nt, Human
caggcuggccgacauggugaaaccccaucucu

SEQ ID NO: 88989 - RNA, 32 nt, Human
caggcuggccucaaacuccggagcucaagcag

SEQ ID NO: 88990 - RNA, 32 nt, Human
caggcuggccucaaacuccugaccucagguga

SEQ ID NO: 88991 - RNA, 32 nt, Human
caggcuggccucaaacuccugggcucaagcaa

SEQ ID NO: 88992 - RNA, 32 nt, Human
caggcuggccucaaacuccugggcucaaguga

SEQ ID NO: 88993 - RNA, 32 nt, Human
caggcuggccugacauggaaggugaaacaagc

SEQ ID NO: 88994 - RNA, 32 nt, Human
caggcuggcugcuggcucuaccagguucugug

SEQ ID NO: 88995 - RNA, 32 nt, Human
caggcuggcuguagcgacucuggcucucucug

SEQ ID NO: 88996 - RNA, 32 nt, Human
caggcuggcugucucccaagccuguguuucuc

SEQ ID NO: 88997 - RNA, 32 nt, Human
caggcugggaaagauuccagcugaggagagcc

SEQ ID NO: 88998 - RNA, 32 nt, Human
caggcugggaacaccaggcuuggauguggugc

SEQ ID NO: 88999 - RNA, 30 nt, Human
caggcugggaggcagagggcacaaaccuua

SEQ ID NO: 89000 - RNA, 32 nt, Human
caggcugggaucauaggugugagccaccucac

SEQ ID NO: 89001 - RNA, 32 nt, Human
caggcugggauuacaggcgugagccacugcac

SEQ ID NO: 89002 - RNA, 22 nt, Human
caggcugggcaacagagugaga

SEQ ID NO: 89003 - RNA, 32 nt, Human
caggcugggcaacauggugaaaccccagcucu

SEQ ID NO: 89004 - RNA, 22 nt, Human
caggcugggcaacggagugaga

SEQ ID NO: 89005 - RNA, 22 nt, Human
caggcugggcgacagagugaga

SEQ ID NO: 89006 - RNA, 18 nt, Human
caggcugggcgggacaga

SEQ ID NO: 89007 - RNA, 32 nt, Human
caggcugggcuugguggucaggaacaggggca

SEQ ID NO: 89008 - RNA, 32 nt, Human
caggcuggggcaccuuugccuccugaggcgca

SEQ ID NO: 89009 - RNA, 32 nt, Human
caggcuggggcagugggcaugggcaggggcug

SEQ ID NO: 89010 - RNA, 32 nt, Human
caggcugggggccucaggagaggucacagccc

SEQ ID NO: 89011 - RNA, 32 nt, Human
caggcuggggucagccuacaguuguguugcuu

SEQ ID NO: 89012 - RNA, 32 nt, Human
caggcuggguguccucacaggagugagggcua

SEQ ID NO: 89013 - RNA, 32 nt, Human
caggcugguaggcagacaggcagagagaaggu

SEQ ID NO: 89014 - RNA, 32 nt, Human
caggcugguaucgaccuccugaccucaaguga

SEQ ID NO: 89015 - RNA, 32 nt, Human
caggcuggucaacauggcgaaaccccaucucu

SEQ ID NO: 89016 - RNA, 32 nt, Human
caggcuggucccuccucucgugccccagcggc

SEQ ID NO: 89017 - RNA, 32 nt, Human
caggcuggucucaaaacuccugaccucaagug

SEQ ID NO: 89018 - RNA, 32 nt, Human
caggcuggucucaaaacuccugaccucaggug

SEQ ID NO: 89019 - RNA, 32 nt, Human
caggcuggucucaaaacuccugagcucaagug

SEQ ID NO: 89020 - RNA, 32 nt, Human
caggcuggucucaaaauccugaccucaaguca

SEQ ID NO: 89021 - RNA, 32 nt, Human
caggcuggucucaaacaccugaccucagguga

SEQ ID NO: 89022 - RNA, 32 nt, Human
caggcuggucucaaacaccugaccugaaguga

SEQ ID NO: 89023 - RNA, 32 nt, Human
caggcuggucucaaacaccugaccuugugauc

SEQ ID NO: 89024 - RNA, 32 nt, Human
caggcuggucucaaacccccagccucaacuga

SEQ ID NO: 89025 - RNA, 32 nt, Human
caggcuggucucaaaccccggaccucagguga

SEQ ID NO: 89026 - RNA, 32 nt, Human
caggcuggucucaaaccccugaccucaggcaa

SEQ ID NO: 89027 - RNA, 32 nt, Human
caggcuggucucaaacgccagaccucagguga

SEQ ID NO: 89028 - RNA, 32 nt, Human
caggcuggucucaaacuccagagcucaagaga

SEQ ID NO: 89029 - RNA, 32 nt, Human
caggcuggucucaaacuccagggcucaagcag

SEQ ID NO: 89030 - RNA, 32 nt, Human
caggcuggucucaaacucccaaccucaaguga

SEQ ID NO: 89031 - RNA, 32 nt, Human
caggcuggucucaaacucccaaccucagguga

SEQ ID NO: 89032 - RNA, 32 nt, Human
caggcuggucucaaacucccagacucaaguca

SEQ ID NO: 89033 - RNA, 32 nt, Human
caggcuggucucaaacucccagccucaagcga

SEQ ID NO: 89034 - RNA, 32 nt, Human
caggcuggucucaaacucccgaccucaaguag

SEQ ID NO: 89035 - RNA, 32 nt, Human
caggcuggucucaaacucccgaccucaaguga

SEQ ID NO: 89036 - RNA, 32 nt, Human
caggcuggucucaaacucccgaccucagguga

SEQ ID NO: 89037 - RNA, 32 nt, Human
caggcuggucucaaacucccgacuucagguga

SEQ ID NO: 89038 - RNA, 32 nt, Human
caggcuggucucaaacuccuaaccucaaguga

SEQ ID NO: 89039 - RNA, 32 nt, Human
caggcuggucucaaacuccuaaccucgugauc

SEQ ID NO: 89040 - RNA, 32 nt, Human
caggcuggucucaaacuccuaaccuuaaguga

SEQ ID NO: 89041 - RNA, 32 nt, Human
caggcuggucucaaacuccuaaccuugugauu

SEQ ID NO: 89042 - RNA, 32 nt, Human
caggcuggucucaaacuccuagccucaagugu

SEQ ID NO: 89043 - RNA, 32 nt, Human
caggcuggucucaaacuccuagguucacuuug

SEQ ID NO: 89044 - RNA, 32 nt, Human
caggcuggucucaaacuccucgguucaagcaa

SEQ ID NO: 89045 - RNA, 32 nt, Human
caggcuggucucaaacuccugaacucaaguga

SEQ ID NO: 89046 - RNA, 32 nt, Human
caggcuggucucaaacuccugaccuagugauc

SEQ ID NO: 89047 - RNA, 32 nt, Human
caggcuggucucaaacuccugaccucaaauga

SEQ ID NO: 89048 - RNA, 32 nt, Human
caggcuggucucaaacuccugaccucaagcaa

SEQ ID NO: 89049 - RNA, 32 nt, Human
caggcuggucucaaacuccugaccucaagcga

SEQ ID NO: 89050 - RNA, 32 nt, Human
caggcuggucucaaacuccugaccucaaguaa

SEQ ID NO: 89051 - RNA, 32 nt, Human
caggcuggucucaaacuccugaccucaaguga

SEQ ID NO: 89052 - RNA, 32 nt, Human
caggcuggucucaaacuccugaccucagauga

SEQ ID NO: 89053 - RNA, 32 nt, Human
caggcuggucucaaacuccugaccucaggcaa

SEQ ID NO: 89054 - RNA, 32 nt, Human
caggcuggucucaaacuccugaccucagggga

SEQ ID NO: 89055 - RNA, 32 nt, Human
caggcuggucucaaacuccugaccucagguaa

SEQ ID NO: 89056 - RNA, 32 nt, Human
caggcuggucucaaacuccugaccucagguac

SEQ ID NO: 89057 - RNA, 32 nt, Human
caggcuggucucaaacuccugaccucagguga

SEQ ID NO: 89058 - RNA, 32 nt, Human
caggcuggucucaaacuccugaccucaggugu

SEQ ID NO: 89059 - RNA, 32 nt, Human
caggcuggucucaaacuccugaccucaugauc

SEQ ID NO: 89060 - RNA, 32 nt, Human
caggcuggucucaaacuccugaccucguaauc

SEQ ID NO: 89061 - RNA, 32 nt, Human
caggcuggucucaaacuccugaccucgugaua

SEQ ID NO: 89062 - RNA, 32 nt, Human
caggcuggucucaaacuccugaccucgugauc

SEQ ID NO: 89063 - RNA, 32 nt, Human
caggcuggucucaaacuccugaccuuaaguga

SEQ ID NO: 89064 - RNA, 32 nt, Human
caggcuggucucaaacuccugaccuugugauc

SEQ ID NO: 89065 - RNA, 32 nt, Human
caggcuggucucaaacuccugaccuugugguc

SEQ ID NO: 89066 - RNA, 32 nt, Human
caggcuggucucaaacuccugacucgaaguga

SEQ ID NO: 89067 - RNA, 32 nt, Human
caggcuggucucaaacuccugacuucaaauga

SEQ ID NO: 89068 - RNA, 32 nt, Human
caggcuggucucaaacuccugacuucaaguga

SEQ ID NO: 89069 - RNA, 32 nt, Human
caggcuggucucaaacuccugacuucagguga

SEQ ID NO: 89070 - RNA, 32 nt, Human
caggcuggucucaaacuccugacuucgugauc

SEQ ID NO: 89071 - RNA, 32 nt, Human
caggcuggucucaaacuccugagcucaagcaa

SEQ ID NO: 89072 - RNA, 32 nt, Human
caggcuggucucaaacuccugagcucaagcca

SEQ ID NO: 89073 - RNA, 32 nt, Human
caggcuggucucaaacuccugagcucaagcga

SEQ ID NO: 89074 - RNA, 32 nt, Human
caggcuggucucaaacuccugagcucaggcaa

SEQ ID NO: 89075 - RNA, 32 nt, Human
caggcuggucucaaacuccugagcucaggcag

SEQ ID NO: 89076 - RNA, 32 nt, Human
caggcuggucucaaacuccugagcucaggcca

SEQ ID NO: 89077 - RNA, 32 nt, Human
caggcuggucucaaacuccugaucucaagaga

SEQ ID NO: 89078 - RNA, 32 nt, Human
caggcuggucucaaacuccugcccucagguga

SEQ ID NO: 89079 - RNA, 32 nt, Human
caggcuggucucaaacuccuggacccaagcca

SEQ ID NO: 89080 - RNA, 32 nt, Human
caggcuggucucaaacuccuggacucaagcaa

SEQ ID NO: 89081 - RNA, 32 nt, Human
caggcuggucucaaacuccuggccucaagcaa

SEQ ID NO: 89082 - RNA, 32 nt, Human
caggcuggucucaaacuccuggccucaaguga

SEQ ID NO: 89083 - RNA, 32 nt, Human
caggcuggucucaaacuccuggccucagguga

SEQ ID NO: 89084 - RNA, 32 nt, Human
caggcuggucucaaacuccuggccugaaguga

SEQ ID NO: 89085 - RNA, 32 nt, Human
caggcuggucucaaacuccuggcuucaagcaa

SEQ ID NO: 89086 - RNA, 32 nt, Human
caggcuggucucaaacuccuggcuucaaguga

SEQ ID NO: 89087 - RNA, 32 nt, Human
caggcuggucucaaacuccugggcucaagcaa

SEQ ID NO: 89088 - RNA, 32 nt, Human
caggcuggucucaaacuccugggcucaagcga

SEQ ID NO: 89089 - RNA, 32 nt, Human
caggcuggucucaaacuccugggcucaaguga

SEQ ID NO: 89090 - RNA, 32 nt, Human
caggcuggucucaaacuccugggcucaggcga

SEQ ID NO: 89091 - RNA, 32 nt, Human
caggcuggucucaaacuccuggguucaagccu

SEQ ID NO: 89092 - RNA, 32 nt, Human
caggcuggucucaaacuccuggucacaaguaa

SEQ ID NO: 89093 - RNA, 32 nt, Human
caggcuggucucaaacuccugguuucaaguga

SEQ ID NO: 89094 - RNA, 32 nt, Human
caggcuggucucaaacucgugugcccaagcaa

SEQ ID NO: 89095 - RNA, 32 nt, Human
caggcuggucucaaacucuaacgucaagugau

SEQ ID NO: 89096 - RNA, 32 nt, Human
caggcuggucucaaacucucggccucagccuc

SEQ ID NO: 89097 - RNA, 32 nt, Human
caggcuggucucaaacucucgggcucaagcag

SEQ ID NO: 89098 - RNA, 32 nt, Human
caggcuggucucaaacucuugaccucagguga

SEQ ID NO: 89099 - RNA, 32 nt, Human
caggcuggucucaaacucuugaccugaaguca

SEQ ID NO: 89100 - RNA, 32 nt, Human
caggcuggucucaaacucuugacuucaaguga

SEQ ID NO: 89101 - RNA, 32 nt, Human
caggcuggucucaaacucuugacuucagauga

SEQ ID NO: 89102 - RNA, 32 nt, Human
caggcuggucucaaacucuugacuucagguaa

SEQ ID NO: 89103 - RNA, 32 nt, Human
caggcuggucucaaacucuugagcucaagccc

SEQ ID NO: 89104 - RNA, 32 nt, Human
caggcuggucucaaacucuugagcuuaagugu

SEQ ID NO: 89105 - RNA, 32 nt, Human
caggcuggucucaaacugcuaacaucaaguga

SEQ ID NO: 89106 - RNA, 32 nt, Human
caggcuggucucaaacugcugaccucaaguga

SEQ ID NO: 89107 - RNA, 32 nt, Human
caggcuggucucaaacugcugacuucagguga

SEQ ID NO: 89108 - RNA, 32 nt, Human
caggcuggucucaaacuucucacuucagguga

SEQ ID NO: 89109 - RNA, 32 nt, Human
caggcuggucucaaacuucugaccucaaauga

SEQ ID NO: 89110 - RNA, 32 nt, Human
caggcuggucucaaacuucugaccucaaguga

SEQ ID NO: 89111 - RNA, 32 nt, Human
caggcuggucucaaacuucugaccucagguga

SEQ ID NO: 89112 - RNA, 32 nt, Human
caggcuggucucaaacuucugaccucgugauc

SEQ ID NO: 89113 - RNA, 32 nt, Human
caggcuggucucaaacuucugaccuugugauc

SEQ ID NO: 89114 - RNA, 32 nt, Human
caggcuggucucaaacuucuggacucaaguga

SEQ ID NO: 89115 - RNA, 32 nt, Human
caggcuggucucaaacuucuggccuuaaguga

SEQ ID NO: 89116 - RNA, 32 nt, Human
caggcuggucucaaacuucuggcuucaugcaa

SEQ ID NO: 89117 - RNA, 32 nt, Human
caggcuggucucaaacuucugggcucaagcaa

SEQ ID NO: 89118 - RNA, 32 nt, Human
caggcuggucucaaacuugugagcucaagaaa

SEQ ID NO: 89119 - RNA, 32 nt, Human
caggcuggucucaaauuccugaccccagguga

SEQ ID NO: 89120 - RNA, 32 nt, Human
caggcuggucucaaauuccugaccucagguga

SEQ ID NO: 89121 - RNA, 32 nt, Human
caggcuggucucaaauuccugaccuuaaguga

SEQ ID NO: 89122 - RNA, 32 nt, Human
caggcuggucucaaauuccugggcccaaacaa

SEQ ID NO: 89123 - RNA, 32 nt, Human
caggcuggucucaaauucuugaucucaaguga

SEQ ID NO: 89124 - RNA, 32 nt, Human
caggcuggucucaaauuucugggcucagguga

SEQ ID NO: 89125 - RNA, 32 nt, Human
caggcuggucucaaauuuguggccucaagcaa

SEQ ID NO: 89126 - RNA, 32 nt, Human
caggcuggucucaaccuccugaccucaaguga

SEQ ID NO: 89127 - RNA, 32 nt, Human
caggcuggucucaaccuccugggcucaagcaa

SEQ ID NO: 89128 - RNA, 32 nt, Human
caggcuggucucaaccucuggaccucagguga

SEQ ID NO: 89129 - RNA, 32 nt, Human
caggcuggucucaacuccugaccucaggugau

SEQ ID NO: 89130 - RNA, 32 nt, Human
caggcuggucucaacuccugagcucaggcaau

SEQ ID NO: 89131 - RNA, 32 nt, Human
caggcuggucucaacuccugggcucaagcgau

SEQ ID NO: 89132 - RNA, 32 nt, Human
caggcuggucucaagcgccuggguucaaggga

SEQ ID NO: 89133 - RNA, 32 nt, Human
caggcuggucucaagcuccuuuccucaagcaa

SEQ ID NO: 89134 - RNA, 32 nt, Human
caggcuggucucacacuccugaccucagguga

SEQ ID NO: 89135 - RNA, 32 nt, Human
caggcuggucucacacuccuggccucaaguga

SEQ ID NO: 89136 - RNA, 32 nt, Human
caggcuggucucaggcuccugggcucagaugg

SEQ ID NO: 89137 - RNA, 32 nt, Human
caggcuggucuccaucaccugaucucagguga

SEQ ID NO: 89138 - RNA, 32 nt, Human
caggcuggucucgaacuccuaaccucagguga

SEQ ID NO: 89139 - RNA, 32 nt, Human
caggcuggucucgaacuccuaaccucggguga

SEQ ID NO: 89140 - RNA, 32 nt, Human
caggcuggucucgaacuccugaucucaugauc

SEQ ID NO: 89141 - RNA, 32 nt, Human
caggcuggucucgaacuccuguccucagguaa

SEQ ID NO: 89142 - RNA, 32 nt, Human
caggcuggucugagagagaacuccugaccucg

SEQ ID NO: 89143 - RNA, 32 nt, Human
caggcuggucuggaacuccuaaccucagguua

SEQ ID NO: 89144 - RNA, 32 nt, Human
caggcuggucuggaacuccugagcucaaguga

SEQ ID NO: 89145 - RNA, 32 nt, Human
caggcuggucuugaacuccuaaccucggguga

SEQ ID NO: 89146 - RNA, 32 nt, Human
caggcuggucuugacuccugaccucaugaccu

SEQ ID NO: 89147 - RNA, 32 nt, Human
caggcuggucuuuaauuccugggcucgagaga

SEQ ID NO: 89148 - RNA, 32 nt, Human
caggcugguggaguuccgaugacaacuuggac

SEQ ID NO: 89149 - RNA, 23 nt, Human
caggcugguguucugucugggcu

SEQ ID NO: 89150 - RNA, 32 nt, Human
caggcugguuggacaguggccuuaucauggga

SEQ ID NO: 89151 - RNA, 32 nt, Human
caggcugguuucaaccuccuggccucaaguga

SEQ ID NO: 89152 - RNA, 32 nt, Human
caggcugguuucgaacuccuaaccuccaguga

SEQ ID NO: 89153 - RNA, 32 nt, Human
caggcuguaggggaggagagccuggccggggg

SEQ ID NO: 89154 - RNA, 32 nt, Human
caggcuguccacccucuucuaucucuccuucc

SEQ ID NO: 89155 - RNA, 32 nt, Human
caggcuguccagaucaauuggcaccauccaag

SEQ ID NO: 89156 - RNA, 32 nt, Human
caggcugucucaaacuccuggccucaaguggu

SEQ ID NO: 89157 - RNA, 32 nt, Human
caggcugucucgaacuccuaacaucaggcgau

SEQ ID NO: 89158 - RNA, 21 nt, Human
caggcugugacucuucucuca

SEQ ID NO: 89159 - RNA, 32 nt, Human
caggcugugagcuccuugggggcaggcccuca

SEQ ID NO: 89160 - RNA, 32 nt, Human
caggcugugccacccgucccuccgacagcucc

SEQ ID NO: 89161 - RNA, 32 nt, Human
caggcuguggagaggaggcgggcggggccggu

SEQ ID NO: 89162 - RNA, 32 nt, Human
caggcuguggccuucucuccugaccagcagca

SEQ ID NO: 89163 - RNA, 32 nt, Human
caggcugugggaggcagcggagcaggcgauga

SEQ ID NO: 89164 - RNA, 32 nt, Human
caggcugugggcaccaggcagagugggagccu

SEQ ID NO: 89165 - RNA, 19 nt, Human
caggcuguggugggccagg

SEQ ID NO: 89166 - RNA, 32 nt, Human
caggcugugguugugagucugagcuugugagc

SEQ ID NO: 89167 - RNA, 32 nt, Human
caggcuguguagcacuucccacccucaggcau

SEQ ID NO: 89168 - RNA, 21 nt, Human
caggcugugugaccuugggaa

SEQ ID NO: 89169 - RNA, 32 nt, Human
caggcuguucucaaacuccuaagcucaaguga

SEQ ID NO: 89170 - RNA, 32 nt, Human
caggcuguucucaaacuccuggccucaggcga

SEQ ID NO: 89171 - RNA, 32 nt, Human
caggcuguucugagguccccguggggugagcc

SEQ ID NO: 89172 - RNA, 32 nt, Human
caggcuguucugcacugaaaagguucuucauc

SEQ ID NO: 89173 - RNA, 19 nt, Human
caggcuguucuguuggaag

SEQ ID NO: 89174 - RNA, 32 nt, Human
caggcuguuggcccaacuccucuuuucugugu

SEQ ID NO: 89175 - RNA, 32 nt, Human
caggcuguuguagaagcuccugggacaagccg

SEQ ID NO: 89176 - RNA, 32 nt, Human
caggcuguuuagcauggagaugacucucagaa

SEQ ID NO: 89177 - RNA, 22 nt, Human
caggcuguuucagccaggaagg

SEQ ID NO: 89178 - RNA, 32 nt, Human
caggcuguuuuauucccgccuccugaggccuu

SEQ ID NO: 89179 - RNA, 24 nt, Human
caggcuuaaacgauucucccaccu

SEQ ID NO: 89180 - RNA, 32 nt, Human
caggcuuaaacgauucucccaccucagccucu

SEQ ID NO: 89181 - RNA, 32 nt, Human
caggcuuaaaguacauuuuguuugauuugcag

SEQ ID NO: 89182 - RNA, 32 nt, Human
caggcuuaaccagcagccuucucaggggccug

SEQ ID NO: 89183 - RNA, 32 nt, Human
caggcuuacuacagccuccaccuucagguuca

SEQ ID NO: 89184 - RNA, 32 nt, Human
caggcuuaggcucucuuucggccucccacucg

SEQ ID NO: 89185 - RNA, 21 nt, Human
caggcuucaacuuaacauuua

SEQ ID NO: 89186 - RNA, 32 nt, Human
caggcuucacucuucgaaccuggaccacaguc

SEQ ID NO: 89187 - RNA, 32 nt, Human
caggcuucaggacacaugcacacgcauguaca

SEQ ID NO: 89188 - RNA, 32 nt, Human
caggcuucaguacaaacugguaacaccaaugu

SEQ ID NO: 89189 - RNA, 32 nt, Human
caggcuucaguuauauaauguaagcacaacua

SEQ ID NO: 89190 - RNA, 32 nt, Human
caggcuucauuucaaacaccguggcaccuccg

SEQ ID NO: 89191 - RNA, 23 nt, Human
caggcuuccaacuuuugcugccu

SEQ ID NO: 89192 - RNA, 26 nt, Human
caggcuuccacugcauccuggccagg

SEQ ID NO: 89193 - RNA, 32 nt, Human
caggcuuccagccuguuucagagaccacuagc

SEQ ID NO: 89194 - RNA, 32 nt, Human
caggcuuccccacaugguggucucaggauaac

SEQ ID NO: 89195 - RNA, 23 nt, Human
caggcuucccccacuuccccuca

SEQ ID NO: 89196 - RNA, 32 nt, Human
caggcuucccuccuaucuucugguuguuccuu

SEQ ID NO: 89197 - RNA, 32 nt, Human
caggcuuccuucuuccuuucccuuugguuaau

SEQ ID NO: 89198 - RNA, 23 nt, Human
caggcuucgccauguuggccagg

SEQ ID NO: 89199 - RNA, 32 nt, Human
caggcuucucagacuauaaguugcuaugaucu

SEQ ID NO: 89200 - RNA, 23 nt, Human
caggcuucuccuccucccgagga

SEQ ID NO: 89201 - RNA, 21 nt, Human
caggcuucucucccugccaca

SEQ ID NO: 89202 - RNA, 22 nt, Human
caggcuucugccacccccggcu

SEQ ID NO: 89203 - RNA, 22 nt, Human
caggcuucugcccucugcagcu

SEQ ID NO: 89204 - RNA, 32 nt, Human
caggcuucugcccucugcagcugggaccccuc

SEQ ID NO: 89205 - RNA, 32 nt, Human
caggcuucuggaugaagaaccuguuuucaaau

SEQ ID NO: 89206 - RNA, 32 nt, Human
caggcuucuguaaucccagcuacuugggaggc

SEQ ID NO: 89207 - RNA, 32 nt, Human
caggcuugaaagcaucaagauuccacucaauu

SEQ ID NO: 89208 - RNA, 32 nt, Human
caggcuugacccacugcgcccagccugcaucu

SEQ ID NO: 89209 - RNA, 32 nt, Human
caggcuugagccaccacgcccaguccaacauc

SEQ ID NO: 89210 - RNA, 32 nt, Human
caggcuugagccaccgcacccggccgagaaua

SEQ ID NO: 89211 - RNA, 32 nt, Human
caggcuugagccaccgcaccuggccuucccca

SEQ ID NO: 89212 - RNA, 32 nt, Human
caggcuugagccaccgcgcccggcuauauuuu

SEQ ID NO: 89213 - RNA, 32 nt, Human
caggcuugagccaccgugccaggccuguuuug

SEQ ID NO: 89214 - RNA, 32 nt, Human
caggcuugagccaccgugccuggccucaaacu

SEQ ID NO: 89215 - RNA, 32 nt, Human
caggcuugagccaccgugccuggccucaagcg

SEQ ID NO: 89216 - RNA, 32 nt, Human
caggcuugagccaccgugccuggucuguuuuu

SEQ ID NO: 89217 - RNA, 32 nt, Human
caggcuugagccacugcaccuagccucuauuu

SEQ ID NO: 89218 - RNA, 32 nt, Human
caggcuugagccacugcgccuggccuggucua

SEQ ID NO: 89219 - RNA, 32 nt, Human
caggcuugagccacugcuccuggccaacaucc

SEQ ID NO: 89220 - RNA, 32 nt, Human
caggcuugagccacugugccuggcuucaggcu

SEQ ID NO: 89221 - RNA, 32 nt, Human
caggcuugcaaucccagcuacuugggacgcug

SEQ ID NO: 89222 - RNA, 32 nt, Human
caggcuugcaccaccacacccggcuaauuuuu

SEQ ID NO: 89223 - RNA, 32 nt, Human
caggcuugccacgcucuccacccgauccuucc

SEQ ID NO: 89224 - RNA, 32 nt, Human
caggcuugcccaggaaaggggcugugcugucg

SEQ ID NO: 89225 - RNA, 32 nt, Human
caggcuugcccugcacaaaccacaacagaagu

SEQ ID NO: 89226 - RNA, 32 nt, Human
caggcuuggagacugacacugcaguaccuacg

SEQ ID NO: 89227 - RNA, 19 nt, Human
caggcuuggagugcagugg

SEQ ID NO: 89228 - RNA, 32 nt, Human
caggcuugggggaugggcucuucgccaugggg

SEQ ID NO: 89229 - RNA, 32 nt, Human
caggcuugggguccccgggagagcagagcuug

SEQ ID NO: 89230 - RNA, 32 nt, Human
caggcuugggucuggagguuugcuguggaagu

SEQ ID NO: 89231 - RNA, 32 nt, Human
caggcuugucucaaacuccuaaccucaacuga

SEQ ID NO: 89232 - RNA, 32 nt, Human
caggcuugucucaaacuccugaccucaaauca

SEQ ID NO: 89233 - RNA, 32 nt, Human
caggcuugucucaaacuccuggccuuaaguga

SEQ ID NO: 89234 - RNA, 32 nt, Human
caggcuugugugugugagaagggcggcagagg

SEQ ID NO: 89235 - RNA, 23 nt, Human
caggcuuucaagaagugccaguu

SEQ ID NO: 89236 - RNA, 32 nt, Human
caggcuuucacuucuguacugcacuguggcuu

SEQ ID NO: 89237 - RNA, 32 nt, Human
caggcuuuccagcagugagccuggggaaaucu

SEQ ID NO: 89238 - RNA, 19 nt, Human
caggcuuucccacuuccca

SEQ ID NO: 89239 - RNA, 32 nt, Human
caggcuuuccugggcaucaggggccugcaggg

SEQ ID NO: 89240 - RNA, 32 nt, Human
caggcuuuccuguagcccauguucgaccacau

SEQ ID NO: 89241 - RNA, 23 nt, Human
caggcuuuccugugguuggucag

SEQ ID NO: 89242 - RNA, 24 nt, Human
caggcuuucgcuguguuggccagg

SEQ ID NO: 89243 - RNA, 32 nt, Human
caggcuuucuguacccagagaggcggcagcag

SEQ ID NO: 89244 - RNA, 22 nt, Human
caggcuuucuguuccauccagg

SEQ ID NO: 89245 - RNA, 26 nt, Human
caggcuuucuucagucccuuggucag

SEQ ID NO: 89246 - RNA, 32 nt, Human
caggcuuucuuucaacagcagaugcuagcuca

SEQ ID NO: 89247 - RNA, 21 nt, Human
caggcuuucuuucccccauuc

SEQ ID NO: 89248 - RNA, 32 nt, Human
caggcuuugcaaacccagccucccagugcuca

SEQ ID NO: 89249 - RNA, 32 nt, Human
caggcuuugcauccuugggaacucagcaaacg

SEQ ID NO: 89250 - RNA, 20 nt, Human
caggcuuugcugaggcccug

SEQ ID NO: 89251 - RNA, 32 nt, Human
caggcuuuggagaaggucucucucccucggca

SEQ ID NO: 89252 - RNA, 32 nt, Human
caggcuuugguaucguaucgccucuguguccu

SEQ ID NO: 89253 - RNA, 24 nt, Human
caggcuuugucugcucccaauuca

SEQ ID NO: 89254 - RNA, 18 nt, Human
caggcuuuuguugcugaa

SEQ ID NO: 89255 - RNA, 32 nt, Human
cagggaaaagaaugccugggggucuguaauag

SEQ ID NO: 89256 - RNA, 32 nt, Human
cagggaaacggcgcuccagccaaggcacgggg

SEQ ID NO: 89257 - RNA, 31 nt, Human
cagggaaagagacccgguaauuggaggguga

SEQ ID NO: 89258 - RNA, 32 nt, Human
cagggaaagagaggagacugucccagagaccu

SEQ ID NO: 89259 - RNA, 32 nt, Human
cagggaaagccgagcggcccacggccaggucg

SEQ ID NO: 89260 - RNA, 32 nt, Human
cagggaaaggaaugccugggagugggggugca

SEQ ID NO: 89261 - RNA, 32 nt, Human
cagggaaauacagcuacagaggaaggagaggu

SEQ ID NO: 89262 - RNA, 32 nt, Human
cagggaaaugggccucuuccacugugaucucc

SEQ ID NO: 89263 - RNA, 20 nt, Human
cagggaaaugucuucagccc

SEQ ID NO: 89264 - RNA, 32 nt, Human
cagggaacaagaagacagaggcaggaggauga

SEQ ID NO: 89265 - RNA, 32 nt, Human
cagggaacacagguuguuccugcuuaacuggc

SEQ ID NO: 89266 - RNA, 32 nt, Human
cagggaacacccacuucucucucgcucucuuu

SEQ ID NO: 89267 - RNA, 32 nt, Human
cagggaacagcggggcaaacagugaguggggu

SEQ ID NO: 89268 - RNA, 32 nt, Human
cagggaaccaacacaaauaagcugacaacuug

SEQ ID NO: 89269 - RNA, 32 nt, Human
cagggaaccccaaacugguguugcuuuggggu

SEQ ID NO: 89270 - RNA, 32 nt, Human
cagggaaccguguuaagacccagcaccccuau

SEQ ID NO: 89271 - RNA, 19 nt, Human
cagggaacucgggcacagg

SEQ ID NO: 89272 - RNA, 32 nt, Human
cagggaagaaaacggcccugucuccauggcca

SEQ ID NO: 89273 - RNA, 32 nt, Human
cagggaagaacaguguauauucucuguagaug

SEQ ID NO: 89274 - RNA, 32 nt, Human
cagggaagaacccagagggagagcgggaauuc

SEQ ID NO: 89275 - RNA, 21 nt, Human
cagggaagaacuagucugaca

SEQ ID NO: 89276 - RNA, 23 nt, Human
cagggaagaauauggaaccuuca

SEQ ID NO: 89277 - RNA, 18 nt, Human
cagggaagaaucccaccc

SEQ ID NO: 89278 - RNA, 21 nt, Human
cagggaagaaucucacuugac

SEQ ID NO: 89279 - RNA, 32 nt, Human
cagggaagacaagaaggaaagauuuuguuguu

SEQ ID NO: 89280 - RNA, 32 nt, Human
cagggaagacucacagcagagcaggagggggc

SEQ ID NO: 89281 - RNA, 32 nt, Human
cagggaagagcaggcagagccuuggagugcug

SEQ ID NO: 89282 - RNA, 32 nt, Human
cagggaagaggcacuguagcagcugcugcugu

SEQ ID NO: 89283 - RNA, 32 nt, Human
cagggaagaggugggauuaaaguugaaacuug

SEQ ID NO: 89284 - RNA, 32 nt, Human
cagggaagagucaggugucagggcaggaauuc

SEQ ID NO: 89285 - RNA, 32 nt, Human
cagggaagaugggaggcgaggagaagccgauu

SEQ ID NO: 89286 - RNA, 32 nt, Human
cagggaagcacacccaaagaauuuucaaagga

SEQ ID NO: 89287 - RNA, 21 nt, Human
cagggaagcacugcccagccc

SEQ ID NO: 89288 - RNA, 32 nt, Human
cagggaagcagaggagcagcagggucagggug

SEQ ID NO: 89289 - RNA, 17 nt, Human
cagggaagcagcagccu

SEQ ID NO: 89290 - RNA, 21 nt, Human
cagggaagcaggggccaaccu

SEQ ID NO: 89291 - RNA, 31 nt, Human
cagggaagcaugucucucaugccaagaacca

SEQ ID NO: 89292 - RNA, 24 nt, Human
cagggaagccaggaaacucugaca

SEQ ID NO: 89293 - RNA, 20 nt, Human
cagggaagccccacaugucc

SEQ ID NO: 89294 - RNA, 17 nt, Human
cagggaagccccagccc

SEQ ID NO: 89295 - RNA, 20 nt, Human
cagggaagcccccucagccc

SEQ ID NO: 89296 - RNA, 19 nt, Human
cagggaagccccuccugcc

SEQ ID NO: 89297 - RNA, 21 nt, Human
cagggaagccgccaccggccc

SEQ ID NO: 89298 - RNA, 17 nt, Human
cagggaagccucccagc

SEQ ID NO: 89299 - RNA, 17 nt, Human
cagggaagccuccuccc

SEQ ID NO: 89300 - RNA, 18 nt, Human
cagggaagccugcauccc

SEQ ID NO: 89301 - RNA, 19 nt, Human
cagggaagccuggacaccc

SEQ ID NO: 89302 - RNA, 19 nt, Human
cagggaagccuguggaccc

SEQ ID NO: 89303 - RNA, 32 nt, Human
cagggaagcggacugagugcugggauccaagg

SEQ ID NO: 89304 - RNA, 18 nt, Human
cagggaagcgugcagccc

SEQ ID NO: 89305 - RNA, 32 nt, Human
cagggaagcuacagggcagacagcaugaggaa

SEQ ID NO: 89306 - RNA, 21 nt, Human
cagggaagcucaucaaagccc

SEQ ID NO: 89307 - RNA, 16 nt, Human
cagggaagcuccagcu

SEQ ID NO: 89308 - RNA, 21 nt, Human
cagggaagcuccuccucagcu

SEQ ID NO: 89309 - RNA, 21 nt, Human
cagggaagcuccugauuuccc

SEQ ID NO: 89310 - RNA, 21 nt, Human
cagggaagcucuuagaauccc

SEQ ID NO: 89311 - RNA, 19 nt, Human
cagggaagcucuuuaggcc

SEQ ID NO: 89312 - RNA, 32 nt, Human
cagggaagcuggccgaggguccuggcuccuga

SEQ ID NO: 89313 - RNA, 18 nt, Human
cagggaagcugggagucc

SEQ ID NO: 89314 - RNA, 18 nt, Human
cagggaagcuucaugccc

SEQ ID NO: 89315 - RNA, 20 nt, Human
cagggaagcuuccucggucu

SEQ ID NO: 89316 - RNA, 18 nt, Human
cagggaagcuuggggcuc

SEQ ID NO: 89317 - RNA, 21 nt, Human
cagggaaggaaggaaccugac

SEQ ID NO: 89318 - RNA, 32 nt, Human
cagggaaggagaaaacagagaacugacaccuu

SEQ ID NO: 89319 - RNA, 32 nt, Human
cagggaaggaggcagcuaggcuguagauggaa

SEQ ID NO: 89320 - RNA, 32 nt, Human
cagggaaggccugcucugccccacuggggugu

SEQ ID NO: 89321 - RNA, 32 nt, Human
cagggaagggaccagagggaucaaagaccagc

SEQ ID NO: 89322 - RNA, 21 nt, Human
cagggaagggacccuccaccc

SEQ ID NO: 89323 - RNA, 18 nt, Human
cagggaagggccaagccc

SEQ ID NO: 89324 - RNA, 22 nt, Human
cagggaagggcuuugccugaca

SEQ ID NO: 89325 - RNA, 32 nt, Human
cagggaagggcuuugccugacaacacccagcu

SEQ ID NO: 89326 - RNA, 32 nt, Human
cagggaaggggaagcaggaugcggagggccaa

SEQ ID NO: 89327 - RNA, 32 nt, Human
cagggaaggguccagacaggagauuuggauau

SEQ ID NO: 89328 - RNA, 32 nt, Human
cagggaagguagguuucucuggcugacugagu

SEQ ID NO: 89329 - RNA, 32 nt, Human
cagggaagguggaggaaggaagccaggaaggg

SEQ ID NO: 89330 - RNA, 32 nt, Human
cagggaagguuagcgccagcagggcugcacgc

SEQ ID NO: 89331 - RNA, 19 nt, Human
cagggaaguaguccaggcc

SEQ ID NO: 89332 - RNA, 32 nt, Human
cagggaagucauauccguggaccauuuguagg

SEQ ID NO: 89333 - RNA, 18 nt, Human
cagggaaguccccaggcc

SEQ ID NO: 89334 - RNA, 20 nt, Human
cagggaaguccuuccagccu

SEQ ID NO: 89335 - RNA, 32 nt, Human
cagggaagugaagugacuugcccagggucacu

SEQ ID NO: 89336 - RNA, 23 nt, Human
cagggaaguggagccuccagccc

SEQ ID NO: 89337 - RNA, 32 nt, Human
cagggaaguuuaaaaggggaaaauaauguguu

SEQ ID NO: 89338 - RNA, 32 nt, Human
cagggaauccccaagguuagccugcuuagggg

SEQ ID NO: 89339 - RNA, 18 nt, Human
cagggaaucccuucugca

SEQ ID NO: 89340 - RNA, 32 nt, Human
cagggaaucggaacccucagacccacagccgc

SEQ ID NO: 89341 - RNA, 32 nt, Human
cagggaaugaagcugguugaguguggggcagg

SEQ ID NO: 89342 - RNA, 32 nt, Human
cagggaauggcuuugccugacaacacccagcu

SEQ ID NO: 89343 - RNA, 32 nt, Human
cagggaaugucugaggcugggccugacccugc

SEQ ID NO: 89344 - RNA, 32 nt, Human
cagggaauuagucaaggggagcuguagugauc

SEQ ID NO: 89345 - RNA, 32 nt, Human
cagggaauuaugggagaagugggggcagccca

SEQ ID NO: 89346 - RNA, 32 nt, Human
cagggacacacacuugugcacaugugugcaca

SEQ ID NO: 89347 - RNA, 32 nt, Human
cagggacacaccauuacaccuggcuaauuguu

SEQ ID NO: 89348 - RNA, 32 nt, Human
cagggacacacgcagacacacgcacacucgcg

SEQ ID NO: 89349 - RNA, 32 nt, Human
cagggacacacgugagccacagggcuagaagc

SEQ ID NO: 89350 - RNA, 32 nt, Human
cagggacacaguacucggccacaccauggggc

SEQ ID NO: 89351 - RNA, 32 nt, Human
cagggacaccacucggcuccauggggagguuu

SEQ ID NO: 89352 - RNA, 32 nt, Human
cagggacaccacugcccaagcuggagaccacg

SEQ ID NO: 89353 - RNA, 32 nt, Human
cagggacacccacacagguggccaucacagcc

SEQ ID NO: 89354 - RNA, 32 nt, Human
cagggacaccccaucauuucacccucacauuc

SEQ ID NO: 89355 - RNA, 32 nt, Human
cagggacacuacuucaggaguccuccacagcg

SEQ ID NO: 89356 - RNA, 32 nt, Human
cagggacacuccgucagcccacccuggagcaa

SEQ ID NO: 89357 - RNA, 32 nt, Human
cagggacagagcugcgggcugagguuccuccg

SEQ ID NO: 89358 - RNA, 32 nt, Human
cagggacagcagagaagaaacuagccagcugu

SEQ ID NO: 89359 - RNA, 32 nt, Human
cagggacagcagagccaaaggcagagggggcc

SEQ ID NO: 89360 - RNA, 19 nt, Human
cagggacagccacauccug

SEQ ID NO: 89361 - RNA, 32 nt, Human
cagggacagcggcaucuucagccaauccagug

SEQ ID NO: 89362 - RNA, 32 nt, Human
cagggacaggcagacaugcagccagggcucca

SEQ ID NO: 89363 - RNA, 23 nt, Human
cagggacagggcaucauggggga

SEQ ID NO: 89364 - RNA, 32 nt, Human
cagggacagguguugcugugcacccagaaucu

SEQ ID NO: 89365 - RNA, 32 nt, Human
cagggacagugaucuggaaggaaggggcuuga

SEQ ID NO: 89366 - RNA, 32 nt, Human
cagggacaucaucucuuccaucuuuggguccu

SEQ ID NO: 89367 - RNA, 32 nt, Human
cagggaccaaaaacaaaagcagcucggagucu

SEQ ID NO: 89368 - RNA, 32 nt, Human
cagggaccacuucucccucuggcucccaucuu

SEQ ID NO: 89369 - RNA, 32 nt, Human
cagggaccagaggauccuaucuucucagcacc

SEQ ID NO: 89370 - RNA, 21 nt, Human
cagggaccagcuccccggggg

SEQ ID NO: 89371 - RNA, 32 nt, Human
cagggaccagcuuggggaaggaaaggagguuu

SEQ ID NO: 89372 - RNA, 32 nt, Human
cagggaccaguccaccaccaucuccuccacgu

SEQ ID NO: 89373 - RNA, 25 nt, Human
cagggacccaaucuggucacaggga

SEQ ID NO: 89374 - RNA, 28 nt, Human
cagggacccacugcugccucuuccagga

SEQ ID NO: 89375 - RNA, 32 nt, Human
cagggacccacugcugccucuuccaggagccc

SEQ ID NO: 89376 - RNA, 18 nt, Human
cagggacccagcaugcca

SEQ ID NO: 89377 - RNA, 32 nt, Human
cagggacccaggcaggaugauggcgcagcucu

SEQ ID NO: 89378 - RNA, 18 nt, Human
cagggacccaggcccaca

SEQ ID NO: 89379 - RNA, 24 nt, Human
cagggaccccaagguguccaggga

SEQ ID NO: 89380 - RNA, 32 nt, Human
cagggacccccaccccucccagccucacugcg

SEQ ID NO: 89381 - RNA, 32 nt, Human
cagggacccccaggaccaggaugugucucagc

SEQ ID NO: 89382 - RNA, 21 nt, Human
cagggaccccccacccagggg

SEQ ID NO: 89383 - RNA, 32 nt, Human
cagggaccccugccuuccccaggccaucugcu

SEQ ID NO: 89384 - RNA, 32 nt, Human
cagggacccgaggccaccccagccuggugugg

SEQ ID NO: 89385 - RNA, 21 nt, Human
cagggacccgcacccaguggg

SEQ ID NO: 89386 - RNA, 32 nt, Human
cagggacccgcccagcucuggccggcaaccgc

SEQ ID NO: 89387 - RNA, 32 nt, Human
cagggacccuccagaaacacaguguuucaaga

SEQ ID NO: 89388 - RNA, 32 nt, Human
cagggacccuccuacacuacagaggggccagg

SEQ ID NO: 89389 - RNA, 32 nt, Human
cagggacccugcacucgacccugggggcuccu

SEQ ID NO: 89390 - RNA, 20 nt, Human
cagggacccugucccagcga

SEQ ID NO: 89391 - RNA, 21 nt, Human
cagggaccgacagacuugaca

SEQ ID NO: 89392 - RNA, 32 nt, Human
cagggaccggauauuucuuauuucucauuugg

SEQ ID NO: 89393 - RNA, 32 nt, Human
cagggaccuaaaggggaaagaguccuggaucc

SEQ ID NO: 89394 - RNA, 23 nt, Human
cagggaccuaccccucccaggga

SEQ ID NO: 89395 - RNA, 32 nt, Human
cagggaccucaaggagcuaugaacauagaaac

SEQ ID NO: 89396 - RNA, 32 nt, Human
cagggaccucuucucccagaggauccuggagc

SEQ ID NO: 89397 - RNA, 32 nt, Human
cagggaccugucucccuuuacuucuuaccucc

SEQ ID NO: 89398 - RNA, 32 nt, Human
cagggaccuuucucuccucccaugcugaguuu

SEQ ID NO: 89399 - RNA, 22 nt, Human
cagggaccuuuuuggucaugga

SEQ ID NO: 89400 - RNA, 32 nt, Human
cagggacgacacagcagguggccggccaggga

SEQ ID NO: 89401 - RNA, 22 nt, Human
cagggacgacacucuccaggga

SEQ ID NO: 89402 - RNA, 32 nt, Human
cagggacgccaaagagagguugcagucagaac

SEQ ID NO: 89403 - RNA, 32 nt, Human
cagggacgccuccaccuuucagccugcccucg

SEQ ID NO: 89404 - RNA, 32 nt, Human
cagggacggagaggcaggugagagggaggugg

SEQ ID NO: 89405 - RNA, 32 nt, Human
cagggacggagggggagaaugggaggagacaa

SEQ ID NO: 89406 - RNA, 32 nt, Human
cagggacuacugcacccgcuucugccuuguuu

SEQ ID NO: 89407 - RNA, 21 nt, Human
cagggacuccgagccaaggga

SEQ ID NO: 89408 - RNA, 32 nt, Human
cagggacuccuggggauccugcuugcuguuug

SEQ ID NO: 89409 - RNA, 19 nt, Human
cagggacugacuccagccc

SEQ ID NO: 89410 - RNA, 32 nt, Human
cagggacugcagcugagcgcaacugccccauc

SEQ ID NO: 89411 - RNA, 32 nt, Human
cagggacugcagcugcaccagcaggugccauc

SEQ ID NO: 89412 - RNA, 32 nt, Human
cagggacugcagggaagagggaagcacgcaca

SEQ ID NO: 89413 - RNA, 32 nt, Human
cagggacugcccaggucuuuagggaaggggac

SEQ ID NO: 89414 - RNA, 32 nt, Human
cagggacugccuccucccggaauuccuaagau

SEQ ID NO: 89415 - RNA, 32 nt, Human
cagggacuggcccccaacucaccccgugcugg

SEQ ID NO: 89416 - RNA, 32 nt, Human
cagggacuggucacagggagggcucagaggag

SEQ ID NO: 89417 - RNA, 32 nt, Human
cagggacuuagaaacuugccugagauggugga

SEQ ID NO: 89418 - RNA, 32 nt, Human
cagggacuuccucgggcucccuaaggaccugc

SEQ ID NO: 89419 - RNA, 32 nt, Human
cagggacuugggggccccuggagcucaggggu

SEQ ID NO: 89420 - RNA, 32 nt, Human
cagggacuuuggagguggggcucugcagcugu

SEQ ID NO: 89421 - RNA, 32 nt, Human
cagggagaaaaacugagguacacagagguacc

SEQ ID NO: 89422 - RNA, 32 nt, Human
cagggagaagaaagauuccuccaccccaccac

SEQ ID NO: 89423 - RNA, 32 nt, Human
cagggagaagcaaggaggaugggcuuuggacu

SEQ ID NO: 89424 - RNA, 32 nt, Human
cagggagaagcacaaucaggaacagugagugc

SEQ ID NO: 89425 - RNA, 32 nt, Human
cagggagaagcagcaccacucucagcucuuuu

SEQ ID NO: 89426 - RNA, 32 nt, Human
cagggagaagggggugcaggaggcagagggug

SEQ ID NO: 89427 - RNA, 32 nt, Human
cagggagaaugagaggccaccuuacuggcagg

SEQ ID NO: 89428 - RNA, 32 nt, Human
cagggagacagacagagguugcagugagccga

SEQ ID NO: 89429 - RNA, 32 nt, Human
cagggagacaggccuccagauaacugcgggcg

SEQ ID NO: 89430 - RNA, 32 nt, Human
cagggagacccauuuccucucuggccucuuca

SEQ ID NO: 89431 - RNA, 32 nt, Human
cagggagaccucccucccgaucuucugugaau

SEQ ID NO: 89432 - RNA, 32 nt, Human
cagggagacgcacccucacaccgcccaugcau

SEQ ID NO: 89433 - RNA, 19 nt, Human
cagggagacggugggccgg

SEQ ID NO: 89434 - RNA, 32 nt, Human
cagggagacugcuuuccagacaccuccggccc

SEQ ID NO: 89435 - RNA, 32 nt, Human
cagggagagaagcagaaaggcacuucgccacu

SEQ ID NO: 89436 - RNA, 32 nt, Human
cagggagagagaacuggccaggguauaaaaag

SEQ ID NO: 89437 - RNA, 32 nt, Human
cagggagagcacagucuggcugugcugccaaa

SEQ ID NO: 89438 - RNA, 32 nt, Human
cagggagagcccugcauuuccucuacgcccag

SEQ ID NO: 89439 - RNA, 32 nt, Human
cagggagagccugaacuuuaugaggggagagg

SEQ ID NO: 89440 - RNA, 32 nt, Human
cagggagagccuucccaugacccccaugaaga

SEQ ID NO: 89441 - RNA, 32 nt, Human
cagggagagggggugggguggggugagagugu

SEQ ID NO: 89442 - RNA, 32 nt, Human
cagggagaguguggggacaggacagccugucu

SEQ ID NO: 89443 - RNA, 32 nt, Human
cagggagaugccugaccaacagguguguuggc

SEQ ID NO: 89444 - RNA, 32 nt, Human
cagggagauggaaaagaagagcccugcuuccc

SEQ ID NO: 89445 - RNA, 32 nt, Human
cagggagauggacccagagcugagagggagac

SEQ ID NO: 89446 - RNA, 32 nt, Human
cagggagcaccugucuggauuguuuuuaaacc

SEQ ID NO: 89447 - RNA, 32 nt, Human
cagggagcacugcugcuccaugcuccauucuc

SEQ ID NO: 89448 - RNA, 32 nt, Human
cagggagcagacccucugccucaugggguagg

SEQ ID NO: 89449 - RNA, 32 nt, Human
cagggagcagagggcuucucguucaugcaccc

SEQ ID NO: 89450 - RNA, 32 nt, Human
cagggagcagcagcaccuccagacuggaaaaa

SEQ ID NO: 89451 - RNA, 32 nt, Human
cagggagcaggcagagcugcagucagagacau

SEQ ID NO: 89452 - RNA, 32 nt, Human
cagggagcagggcaggggcugaaaggggcacu

SEQ ID NO: 89453 - RNA, 32 nt, Human
cagggagccaagaaugcaccacugcaguccag

SEQ ID NO: 89454 - RNA, 32 nt, Human
cagggagccacugcauccagcacauggggugc

SEQ ID NO: 89455 - RNA, 32 nt, Human
cagggagccagcuccuuccacccgacuguacu

SEQ ID NO: 89456 - RNA, 32 nt, Human
cagggagccaggacacagaggggcagagcaag

SEQ ID NO: 89457 - RNA, 21 nt, Human
cagggagcccaaacacccagc

SEQ ID NO: 89458 - RNA, 17 nt, Human
cagggagcccccagccc

SEQ ID NO: 89459 - RNA, 18 nt, Human
cagggagcccuccaggaa

SEQ ID NO: 89460 - RNA, 19 nt, Human
cagggagcccugacuccca

SEQ ID NO: 89461 - RNA, 22 nt, Human
cagggagccucuuccucaaccc

SEQ ID NO: 89462 - RNA, 32 nt, Human
cagggagccuggaauggcuuagauggucccuu

SEQ ID NO: 89463 - RNA, 32 nt, Human
cagggagcggaagaagucucgauccaggagua

SEQ ID NO: 89464 - RNA, 32 nt, Human
cagggagcggagauuccucauaggugagucca

SEQ ID NO: 89465 - RNA, 32 nt, Human
cagggagcgugggugaagcccuggagaaggga

SEQ ID NO: 89466 - RNA, 32 nt, Human
cagggagcuacugagaaaucaccugaagacaa

SEQ ID NO: 89467 - RNA, 32 nt, Human
cagggagcuagcaggacacuaggaccagucug

SEQ ID NO: 89468 - RNA, 32 nt, Human
cagggagcucacagcaacacccccuaccacca

SEQ ID NO: 89469 - RNA, 32 nt, Human
cagggagcucauucccuccacuggaugggcaa

SEQ ID NO: 89470 - RNA, 32 nt, Human
cagggagcuccaccuucucuggucuucagucc

SEQ ID NO: 89471 - RNA, 32 nt, Human
cagggagcuccaggagaccucaggacggcccc

SEQ ID NO: 89472 - RNA, 32 nt, Human
cagggagcugcccggcuggccuaggcaggcag

SEQ ID NO: 89473 - RNA, 32 nt, Human
cagggagcugccgagggacacgagccucagug

SEQ ID NO: 89474 - RNA, 32 nt, Human
cagggagcugcuggaugagaaagggccugaag

SEQ ID NO: 89475 - RNA, 32 nt, Human
cagggagcuggcacaguaugugaaaacaguaa

SEQ ID NO: 89476 - RNA, 32 nt, Human
cagggagcuggcuggucuguggugcaugugug

SEQ ID NO: 89477 - RNA, 32 nt, Human
cagggagcugguuccccucugcgacucgcccc

SEQ ID NO: 89478 - RNA, 32 nt, Human
cagggagcuguggucagugggggucagccagg

SEQ ID NO: 89479 - RNA, 32 nt, Human
cagggagcuucucagagaagugagcagagacu

SEQ ID NO: 89480 - RNA, 32 nt, Human
cagggaggaagaggcagcaggagcuguuggcc

SEQ ID NO: 89481 - RNA, 32 nt, Human
cagggaggacacgugaccugcacaggaucaca

SEQ ID NO: 89482 - RNA, 32 nt, Human
cagggaggagaaacaaacucagagaugggccc

SEQ ID NO: 89483 - RNA, 31 nt, Human
cagggaggagcugccuguucacugggaucag

SEQ ID NO: 89484 - RNA, 32 nt, Human
cagggaggagcugccuguucacugggaucagc

SEQ ID NO: 89485 - RNA, 32 nt, Human
cagggaggaggaagaggaaggugagaaugagu

SEQ ID NO: 89486 - RNA, 32 nt, Human
cagggaggaggaagaggagaggaggaagcaaa

SEQ ID NO: 89487 - RNA, 21 nt, Human
cagggaggagucggccucccg

SEQ ID NO: 89488 - RNA, 19 nt, Human
cagggaggauccgcagccc

SEQ ID NO: 89489 - RNA, 23 nt, Human
cagggaggcccagguggaccugg

SEQ ID NO: 89490 - RNA, 32 nt, Human
cagggaggcccuggacuggagccccucaccuc

SEQ ID NO: 89491 - RNA, 20 nt, Human
cagggaggcccuucccaccc

SEQ ID NO: 89492 - RNA, 32 nt, Human
cagggaggccucucaugucucagccuugaacc

SEQ ID NO: 89493 - RNA, 32 nt, Human
cagggaggccugauccugugacagcuggcugc

SEQ ID NO: 89494 - RNA, 23 nt, Human
cagggaggcggagguugcaguga

SEQ ID NO: 89495 - RNA, 23 nt, Human
cagggaggcuccugggcuaaggg

SEQ ID NO: 89496 - RNA, 32 nt, Human
cagggaggcugagugucccaggccuguugcca

SEQ ID NO: 89497 - RNA, 32 nt, Human
cagggaggcugcagagcaucguggagaccacu

SEQ ID NO: 89498 - RNA, 32 nt, Human
cagggaggcugcagagucagagucgcgggcug

SEQ ID NO: 89499 - RNA, 32 nt, Human
cagggagggaaagaugauggccaggggaaaga

SEQ ID NO: 89500 - RNA, 32 nt, Human
cagggagggaaaggaggagggagagagaugga

SEQ ID NO: 89501 - RNA, 32 nt, Human
cagggagggaacgcuggcuggggacgaucaca

SEQ ID NO: 89502 - RNA, 32 nt, Human
cagggagggaauggccuugugagagacuccag

SEQ ID NO: 89503 - RNA, 32 nt, Human
cagggagggaggacgagggagggccagcucag

SEQ ID NO: 89504 - RNA, 32 nt, Human
cagggagggaggaucuccagaggucaggaguu

SEQ ID NO: 89505 - RNA, 19 nt, Human
cagggagggaguccagccc

SEQ ID NO: 89506 - RNA, 32 nt, Human
cagggagggcaggcugggugagggacaggagg

SEQ ID NO: 89507 - RNA, 32 nt, Human
cagggagggccagaugccucucaggagccuug

SEQ ID NO: 89508 - RNA, 32 nt, Human
cagggagggccugggccccaguuguauuuauu

SEQ ID NO: 89509 - RNA, 32 nt, Human
cagggagggccuggucugaucucauuuuagag

SEQ ID NO: 89510 - RNA, 32 nt, Human
cagggagggcucagaggagccugacucgagug

SEQ ID NO: 89511 - RNA, 20 nt, Human
cagggagggcugcccagccc

SEQ ID NO: 89512 - RNA, 32 nt, Human
cagggaggggaggauugugaggugagggguua

SEQ ID NO: 89513 - RNA, 32 nt, Human
cagggaggggcaggugugaaguugcugagggc

SEQ ID NO: 89514 - RNA, 32 nt, Human
cagggaggggccugggccuggccagaccagag

SEQ ID NO: 89515 - RNA, 32 nt, Human
cagggaggggcggcgggggcgcacugaacauu

SEQ ID NO: 89516 - RNA, 20 nt, Human
cagggaggguccuccagcuc

SEQ ID NO: 89517 - RNA, 32 nt, Human
cagggaggguucccagcagcaggaguuagggg

SEQ ID NO: 89518 - RNA, 32 nt, Human
cagggagguaucuaauuuggucagucacaaau

SEQ ID NO: 89519 - RNA, 32 nt, Human
cagggaggucuagaccccaagagcagagaggc

SEQ ID NO: 89520 - RNA, 32 nt, Human
cagggaggugcagaaggcugaaguggcaaagu

SEQ ID NO: 89521 - RNA, 32 nt, Human
cagggagguggcaggaaaggcuuggaacagcu

SEQ ID NO: 89522 - RNA, 32 nt, Human
cagggagguguacccguaccccagcccccugc

SEQ ID NO: 89523 - RNA, 32 nt, Human
cagggaguccagggugccuggaagagguggcc

SEQ ID NO: 89524 - RNA, 32 nt, Human
cagggagucccaggacccagggagaguguggg

SEQ ID NO: 89525 - RNA, 32 nt, Human
cagggagucgcccaggcuggagagcgguggcg

SEQ ID NO: 89526 - RNA, 32 nt, Human
cagggagugaagccuuuguccccaagcaacag

SEQ ID NO: 89527 - RNA, 32 nt, Human
cagggagugacacucaaggggaccugccccag

SEQ ID NO: 89528 - RNA, 32 nt, Human
cagggagugcagccuggacaauggcaggccuu

SEQ ID NO: 89529 - RNA, 32 nt, Human
cagggagugcuggggagaaugagggguuccca

SEQ ID NO: 89530 - RNA, 32 nt, Human
cagggagugggcccugaguccacacugucccu

SEQ ID NO: 89531 - RNA, 32 nt, Human
cagggaguucuaagacgccagcucuuugagau

SEQ ID NO: 89532 - RNA, 32 nt, Human
cagggaguuggcucucuugguggagaugacuu

SEQ ID NO: 89533 - RNA, 32 nt, Human
cagggaguuuggagaacugguuucugucuaau

SEQ ID NO: 89534 - RNA, 31 nt, Human
cagggauaaagagcuuccucacuggauggga

SEQ ID NO: 89535 - RNA, 31 nt, Human
cagggauaccaaaauccucagaugcucaagu

SEQ ID NO: 89536 - RNA, 32 nt, Human
cagggauaccugaggcaggaggugcagcgugu

SEQ ID NO: 89537 - RNA, 32 nt, Human
cagggauagagagggagccagacggacagcca

SEQ ID NO: 89538 - RNA, 32 nt, Human
cagggaucaagaggucugcugugugaccuucu

SEQ ID NO: 89539 - RNA, 32 nt, Human
cagggaucacagaaaugcggaugcaaaacaac

SEQ ID NO: 89540 - RNA, 32 nt, Human
cagggaucacugcaaccucugccuccuggguu

SEQ ID NO: 89541 - RNA, 32 nt, Human
cagggaucaggagccuccagcagggaaccuuc

SEQ ID NO: 89542 - RNA, 32 nt, Human
cagggaucagugucauuuagggaugugacuau

SEQ ID NO: 89543 - RNA, 32 nt, Human
cagggauccaacauaacucagacauagcccag

SEQ ID NO: 89544 - RNA, 32 nt, Human
cagggauccccggcuuugccccggggcugggg

SEQ ID NO: 89545 - RNA, 32 nt, Human
cagggauccuaggugaaggggguggguaugaa

SEQ ID NO: 89546 - RNA, 32 nt, Human
cagggauccuccugccucuccucugccccugu

SEQ ID NO: 89547 - RNA, 32 nt, Human
cagggaucuccaggaggagccagaagcuggga

SEQ ID NO: 89548 - RNA, 32 nt, Human
cagggaucucuucucuccccuucaccauuacu

SEQ ID NO: 89549 - RNA, 32 nt, Human
cagggaucugccuggccagcagugagccugag

SEQ ID NO: 89550 - RNA, 32 nt, Human
cagggaucuuuuucugccccugcuccagucga

SEQ ID NO: 89551 - RNA, 32 nt, Human
cagggaugagaaacauacucucccuggcgucc

SEQ ID NO: 89552 - RNA, 32 nt, Human
cagggaugagccaccaugccuggcuggguauu

SEQ ID NO: 89553 - RNA, 32 nt, Human
cagggaugagggagguccucagugagugcacc

SEQ ID NO: 89554 - RNA, 32 nt, Human
cagggaugccuugccuuuucaggauuugagac

SEQ ID NO: 89555 - RNA, 32 nt, Human
cagggaugcucggcccuggcucugugccaggc

SEQ ID NO: 89556 - RNA, 30 nt, Human
cagggaugcugcacuccaugagccggcugu

SEQ ID NO: 89557 - RNA, 32 nt, Human
cagggaugcugcugggaguccauggcacaggc

SEQ ID NO: 89558 - RNA, 32 nt, Human
cagggaugcuuuccagccugcagcaacagaac

SEQ ID NO: 89559 - RNA, 19 nt, Human
cagggauggcccccagccc

SEQ ID NO: 89560 - RNA, 32 nt, Human
cagggauggcugcuuccugauacacgugaaca

SEQ ID NO: 89561 - RNA, 20 nt, Human
cagggaugggccuuccagcc

SEQ ID NO: 89562 - RNA, 32 nt, Human
cagggaugggcuuguaccugacagcacccacc

SEQ ID NO: 89563 - RNA, 32 nt, Human
cagggauggggacugccaggggcaguuggcaa

SEQ ID NO: 89564 - RNA, 31 nt, Human
cagggauggggagccucaugggugaaagagg

SEQ ID NO: 89565 - RNA, 32 nt, Human
cagggaugguagcuauuuuucugccaugagac

SEQ ID NO: 89566 - RNA, 32 nt, Human
cagggaugguguuaucuuuguugcccagugua

SEQ ID NO: 89567 - RNA, 32 nt, Human
cagggauguaccuggugagcugcugacccgca

SEQ ID NO: 89568 - RNA, 18 nt, Human
cagggaugucagagccag

SEQ ID NO: 89569 - RNA, 32 nt, Human
cagggauguggacaggguaagggcagcaagca

SEQ ID NO: 89570 - RNA, 18 nt, Human
cagggauguggcuauaga

SEQ ID NO: 89571 - RNA, 32 nt, Human
cagggauucauuacuuggaaaaugacagguca

SEQ ID NO: 89572 - RNA, 32 nt, Human
cagggauucccaggaagcagaacucuccagaa

SEQ ID NO: 89573 - RNA, 21 nt, Human
cagggauugguuucaggaccc

SEQ ID NO: 89574 - RNA, 32 nt, Human
cagggauuugagaucagccuaggcaacauggc

SEQ ID NO: 89575 - RNA, 32 nt, Human
cagggauuuucucauuagcacaggguuccaag

SEQ ID NO: 89576 - RNA, 32 nt, Human
cagggcaacauggugaaaccccaucucuacua

SEQ ID NO: 89577 - RNA, 32 nt, Human
cagggcaacauggugagaccucaucucuacaa

SEQ ID NO: 89578 - RNA, 32 nt, Human
cagggcaagacguuugguuucauuugucacca

SEQ ID NO: 89579 - RNA, 32 nt, Human
cagggcacagaagcaucugcaggaagagcagc

SEQ ID NO: 89580 - RNA, 32 nt, Human
cagggcacagcagagcaggcuggagaagcgag

SEQ ID NO: 89581 - RNA, 32 nt, Human
cagggcacagcccugacacagguguggcuacu

SEQ ID NO: 89582 - RNA, 32 nt, Human
cagggcacaguggcucauaccuguaaucccag

SEQ ID NO: 89583 - RNA, 19 nt, Human
cagggcacauugacagaaa

SEQ ID NO: 89584 - RNA, 32 nt, Human
cagggcaccaggcccacccaacugaaggcaug

SEQ ID NO: 89585 - RNA, 32 nt, Human
cagggcacccacugguucccaggcuggaacca

SEQ ID NO: 89586 - RNA, 19 nt, Human
cagggcacccaugaugaaa

SEQ ID NO: 89587 - RNA, 32 nt, Human
cagggcaccccagcugcccugguacugagguu

SEQ ID NO: 89588 - RNA, 32 nt, Human
cagggcacccccuucagagcuagggacgaaca

SEQ ID NO: 89589 - RNA, 21 nt, Human
cagggcaccgagcgcgugaaa

SEQ ID NO: 89590 - RNA, 32 nt, Human
cagggcaccguccucggcccugggcgagggaa

SEQ ID NO: 89591 - RNA, 20 nt, Human
cagggcacucuuuaaugaag

SEQ ID NO: 89592 - RNA, 32 nt, Human
cagggcacugaagaaguauagucccaguuauu

SEQ ID NO: 89593 - RNA, 32 nt, Human
cagggcacugacaggggcagcucugucacugu

SEQ ID NO: 89594 - RNA, 22 nt, Human
cagggcacugaggguaggucug

SEQ ID NO: 89595 - RNA, 32 nt, Human
cagggcacugcacuggaacacuggguguuccu

SEQ ID NO: 89596 - RNA, 32 nt, Human
cagggcacugcucuccuccuugcaccggugaa

SEQ ID NO: 89597 - RNA, 20 nt, Human
cagggcacuggucacagaaa

SEQ ID NO: 89598 - RNA, 20 nt, Human
cagggcacuguacccagaaa

SEQ ID NO: 89599 - RNA, 32 nt, Human
cagggcacugugccugagcucugacagugugg

SEQ ID NO: 89600 - RNA, 21 nt, Human
cagggcacuucaacucagaaa

SEQ ID NO: 89601 - RNA, 32 nt, Human
cagggcacuucuauuuguuuuuguggaaagac

SEQ ID NO: 89602 - RNA, 32 nt, Human
cagggcacuuguauuccagccucgcugcauuu

SEQ ID NO: 89603 - RNA, 32 nt, Human
cagggcagacagugccuggcacugaggggugc

SEQ ID NO: 89604 - RNA, 32 nt, Human
cagggcagacggacugaggugggagcucuguu

SEQ ID NO: 89605 - RNA, 32 nt, Human
cagggcagagcugccuuuuaauuuuuauucuc

SEQ ID NO: 89606 - RNA, 23 nt, Human
cagggcagaggggccaggucugc

SEQ ID NO: 89607 - RNA, 32 nt, Human
cagggcagcaugaaggagagcccugcguucug

SEQ ID NO: 89608 - RNA, 32 nt, Human
cagggcagcaugcagccagcugcucugcagcc

SEQ ID NO: 89609 - RNA, 32 nt, Human
cagggcagccuccaccuugcucuucuuucuga

SEQ ID NO: 89610 - RNA, 32 nt, Human
cagggcagccuccuccaaaucccuccuggagg

SEQ ID NO: 89611 - RNA, 32 nt, Human
cagggcagccuccucgacuccugaagaaaagg

SEQ ID NO: 89612 - RNA, 32 nt, Human
cagggcagccuccuggccaguuucucugcuca

SEQ ID NO: 89613 - RNA, 32 nt, Human
cagggcagccuggacaacaugaccugcauccu

SEQ ID NO: 89614 - RNA, 32 nt, Human
cagggcagccugguuacagagugagacuccgu

SEQ ID NO: 89615 - RNA, 32 nt, Human
cagggcagcgagcacagcuguucuccgacaug

SEQ ID NO: 89616 - RNA, 31 nt, Human
cagggcagcguucagcacacuccugggcaug

SEQ ID NO: 89617 - RNA, 32 nt, Human
cagggcagcucccuacagcuugggccaucugc

SEQ ID NO: 89618 - RNA, 30 nt, Human
cagggcagcugccaaucagaaaugcaaauu

SEQ ID NO: 89619 - RNA, 32 nt, Human
cagggcaggaaaccccucccaccuuuacacau

SEQ ID NO: 89620 - RNA, 32 nt, Human
cagggcaggaaggggaaacacagcugaugaac

SEQ ID NO: 89621 - RNA, 32 nt, Human
cagggcaggaaggggaggauccacuucugugc

SEQ ID NO: 89622 - RNA, 32 nt, Human
cagggcaggacacagauaagcccagggccgag

SEQ ID NO: 89623 - RNA, 32 nt, Human
cagggcaggacacagaugagcccagggccgag

SEQ ID NO: 89624 - RNA, 32 nt, Human
cagggcaggagagaauauaauugugaaggagu

SEQ ID NO: 89625 - RNA, 32 nt, Human
cagggcaggcagggguuggagugggcauagga

SEQ ID NO: 89626 - RNA, 32 nt, Human
cagggcagggaaagugcuuaguauuagcguga

SEQ ID NO: 89627 - RNA, 32 nt, Human
cagggcagggaggcuuccagccuguguucccc

SEQ ID NO: 89628 - RNA, 32 nt, Human
cagggcagggaugggacagaagaguuugggga

SEQ ID NO: 89629 - RNA, 32 nt, Human
cagggcagggccaccccacucuaccuccuuag

SEQ ID NO: 89630 - RNA, 32 nt, Human
cagggcaggggucugugucuccaccccaaggg

SEQ ID NO: 89631 - RNA, 32 nt, Human
cagggcaggugaggagcaggcuccacagacuc

SEQ ID NO: 89632 - RNA, 32 nt, Human
cagggcagguuugcuugaccucugccucaguu

SEQ ID NO: 89633 - RNA, 32 nt, Human
cagggcaguccuucuggcacugcuccagaauu

SEQ ID NO: 89634 - RNA, 19 nt, Human
cagggcagugaaaaugaaa

SEQ ID NO: 89635 - RNA, 32 nt, Human
cagggcaguuggaucacuugaggccaggaguu

SEQ ID NO: 89636 - RNA, 18 nt, Human
cagggcauccuccagcuc

SEQ ID NO: 89637 - RNA, 32 nt, Human
cagggcaugauggcucaugccuguaaugccag

SEQ ID NO: 89638 - RNA, 32 nt, Human
cagggcaugguggacaguaaugcugaguucug

SEQ ID NO: 89639 - RNA, 32 nt, Human
cagggcaugguggcgcaugccuguaaucccag

SEQ ID NO: 89640 - RNA, 32 nt, Human
cagggcaugugaguagagaaggacccagguca

SEQ ID NO: 89641 - RNA, 32 nt, Human
cagggcauguugcucccuucuguccucagcaa

SEQ ID NO: 89642 - RNA, 21 nt, Human
cagggcauuguccuccagccc

SEQ ID NO: 89643 - RNA, 24 nt, Human
cagggccaaaggaggcuuccugga

SEQ ID NO: 89644 - RNA, 32 nt, Human
cagggccaacagcagcccccgggccagguguc

SEQ ID NO: 89645 - RNA, 32 nt, Human
cagggccaaccuccucacugugcuucaagguu

SEQ ID NO: 89646 - RNA, 32 nt, Human
cagggccaacuccagggauuccuuccacgaca

SEQ ID NO: 89647 - RNA, 32 nt, Human
cagggccaaucaccagugaccagcuagacugu

SEQ ID NO: 89648 - RNA, 32 nt, Human
cagggccagaagcagagacggcggcuggggau

SEQ ID NO: 89649 - RNA, 32 nt, Human
cagggccagaaguagcuuugcacuuuucuaaa

SEQ ID NO: 89650 - RNA, 31 nt, Human
cagggccagagagccggagagaggagccccc

SEQ ID NO: 89651 - RNA, 32 nt, Human
cagggccagaggggacagaggcuggcggcaga

SEQ ID NO: 89652 - RNA, 32 nt, Human
cagggccagauggagccaaaggucagcucucu

SEQ ID NO: 89653 - RNA, 32 nt, Human
cagggccagcugagcagcacaggccaggaggc

SEQ ID NO: 89654 - RNA, 32 nt, Human
cagggccagcuugccauauuccaggcacacgu

SEQ ID NO: 89655 - RNA, 32 nt, Human
cagggccaggcagacuggggcagugacuggaa

SEQ ID NO: 89656 - RNA, 32 nt, Human
cagggccaggcagagagagaugcuggggacca

SEQ ID NO: 89657 - RNA, 17 nt, Human
cagggccaggccagaga

SEQ ID NO: 89658 - RNA, 32 nt, Human
cagggccaggcuaaggguggcucaguuccauc

SEQ ID NO: 89659 - RNA, 21 nt, Human
cagggccaggcuggcaggggc

SEQ ID NO: 89660 - RNA, 23 nt, Human
cagggccagggaaagcccuggga

SEQ ID NO: 89661 - RNA, 32 nt, Human
cagggccagggcagacaaaauaagagugagcu

SEQ ID NO: 89662 - RNA, 24 nt, Human
cagggccagggcugcagccugagg

SEQ ID NO: 89663 - RNA, 23 nt, Human
cagggccaggggcuucugugaga

SEQ ID NO: 89664 - RNA, 32 nt, Human
cagggccagggucccagccaggagagugcagc

SEQ ID NO: 89665 - RNA, 32 nt, Human
cagggccaggugagcuauggugcugcaccuac

SEQ ID NO: 89666 - RNA, 32 nt, Human
cagggccagguguggaggugugccccaaguga

SEQ ID NO: 89667 - RNA, 32 nt, Human
cagggccagugacuugcugggcuucguguuca

SEQ ID NO: 89668 - RNA, 32 nt, Human
cagggccauccagcuucccacccuccacugac

SEQ ID NO: 89669 - RNA, 32 nt, Human
cagggccaugggagauacaauuccaaguucuc

SEQ ID NO: 89670 - RNA, 19 nt, Human
cagggccauucuccuuccu

SEQ ID NO: 89671 - RNA, 32 nt, Human
cagggcccaagaaaucacuggugaugagaucg

SEQ ID NO: 89672 - RNA, 25 nt, Human
cagggcccaagcgauccuccugccu

SEQ ID NO: 89673 - RNA, 32 nt, Human
cagggcccacucugccaaccagucucaagcac

SEQ ID NO: 89674 - RNA, 32 nt, Human
cagggcccagagaguggguggagaagcucugc

SEQ ID NO: 89675 - RNA, 32 nt, Human
cagggcccaugucccacaaggcugcuuggccu

SEQ ID NO: 89676 - RNA, 32 nt, Human
cagggccccaccucucccagcugauggugagc

SEQ ID NO: 89677 - RNA, 32 nt, Human
cagggccccagccugauggggcugcccucagu

SEQ ID NO: 89678 - RNA, 19 nt, Human
cagggcccccuacuucuuc

SEQ ID NO: 89679 - RNA, 32 nt, Human
cagggcccccucucuguuggagcugaauacuc

SEQ ID NO: 89680 - RNA, 32 nt, Human
cagggccccgggcuuguuucuccucuuguuuu

SEQ ID NO: 89681 - RNA, 32 nt, Human
cagggccccgugggaagaccuaugcuuucaag

SEQ ID NO: 89682 - RNA, 32 nt, Human
cagggccccucgggcuuggcgggagcgacgac

SEQ ID NO: 89683 - RNA, 18 nt, Human
cagggccccugcccuccu

SEQ ID NO: 89684 - RNA, 32 nt, Human
cagggccccugccucugcuacggcagcccccg

SEQ ID NO: 89685 - RNA, 32 nt, Human
cagggcccggugcaguguccagccugguaucu

SEQ ID NO: 89686 - RNA, 32 nt, Human
cagggcccucaacuuccauccugcgggaggcc

SEQ ID NO: 89687 - RNA, 18 nt, Human
cagggcccucuucagccc

SEQ ID NO: 89688 - RNA, 19 nt, Human
cagggcccucuuccaacuc

SEQ ID NO: 89689 - RNA, 32 nt, Human
cagggcccuggagcugcuggggccaagccaag

SEQ ID NO: 89690 - RNA, 32 nt, Human
cagggcccuggccacguggagcaacacugacu

SEQ ID NO: 89691 - RNA, 32 nt, Human
cagggcccuguccucacuaucagucaguucag

SEQ ID NO: 89692 - RNA, 32 nt, Human
cagggcccuguuugggaccacucucucagucc

SEQ ID NO: 89693 - RNA, 22 nt, Human
cagggccgcagcugcccuggga

SEQ ID NO: 89694 - RNA, 32 nt, Human
cagggccgcuugcccagccuugaggaaggggg

SEQ ID NO: 89695 - RNA, 32 nt, Human
cagggccggagcugugggggaggccugcggag

SEQ ID NO: 89696 - RNA, 32 nt, Human
cagggccggcucccaaaaaccccaugugugua

SEQ ID NO: 89697 - RNA, 22 nt, Human
cagggccgggagcccuuuggga

SEQ ID NO: 89698 - RNA, 32 nt, Human
cagggccgggcagggggacagcagggaccggg

SEQ ID NO: 89699 - RNA, 32 nt, Human
cagggccgggccugggcucgguucccagguuu

SEQ ID NO: 89700 - RNA, 32 nt, Human
cagggccgggcggagccagagccagacgcgcc

SEQ ID NO: 89701 - RNA, 22 nt, Human
cagggccguggacccucugaga

SEQ ID NO: 89702 - RNA, 32 nt, Human
cagggccgugucauuuaagcauggccccaugg

SEQ ID NO: 89703 - RNA, 32 nt, Human
cagggccguuucuggcacugggaggcuggcag

SEQ ID NO: 89704 - RNA, 20 nt, Human
cagggccuaggccucuccuc

SEQ ID NO: 89705 - RNA, 22 nt, Human
cagggccucacaaggcagugua

SEQ ID NO: 89706 - RNA, 32 nt, Human
cagggccucaccucucugcccuucccugcccg

SEQ ID NO: 89707 - RNA, 18 nt, Human
cagggccucacucuguca

SEQ ID NO: 89708 - RNA, 32 nt, Human
cagggccucagggcacccuccccaccuagccc

SEQ ID NO: 89709 - RNA, 32 nt, Human
cagggccuccaggccugggucuggaguuaggu

SEQ ID NO: 89710 - RNA, 23 nt, Human
cagggccuccucccucccugcgu

SEQ ID NO: 89711 - RNA, 18 nt, Human
cagggccuccugcaacuc

SEQ ID NO: 89712 - RNA, 20 nt, Human
cagggccuccuuccagggca

SEQ ID NO: 89713 - RNA, 21 nt, Human
cagggccucgcccuccagccc

SEQ ID NO: 89714 - RNA, 19 nt, Human
cagggccucgcuuccccug

SEQ ID NO: 89715 - RNA, 19 nt, Human
cagggccucuaccauccuc

SEQ ID NO: 89716 - RNA, 32 nt, Human
cagggccucuagggcaguggggaggggguggc

SEQ ID NO: 89717 - RNA, 32 nt, Human
cagggccucucauguggcagccacauguggcg

SEQ ID NO: 89718 - RNA, 32 nt, Human
cagggccucuccaccccaaccccacagcccgc

SEQ ID NO: 89719 - RNA, 32 nt, Human
cagggccucugcuccucguggcugccaggggc

SEQ ID NO: 89720 - RNA, 22 nt, Human
cagggccucugcucuccuggga

SEQ ID NO: 89721 - RNA, 21 nt, Human
cagggccugaauuuucugcuc

SEQ ID NO: 89722 - RNA, 32 nt, Human
cagggccugacugaggcccacgcaggaaccga

SEQ ID NO: 89723 - RNA, 32 nt, Human
cagggccugagaugcugaccugccagugccga

SEQ ID NO: 89724 - RNA, 32 nt, Human
cagggccugagccuggccagccuacaaugggg

SEQ ID NO: 89725 - RNA, 32 nt, Human
cagggccugauugggcugggcuagugucuguc

SEQ ID NO: 89726 - RNA, 32 nt, Human
cagggccugcagcagugccccugccagccccg

SEQ ID NO: 89727 - RNA, 19 nt, Human
cagggccugccccaguggg

SEQ ID NO: 89728 - RNA, 22 nt, Human
cagggccugccccccugcaggu

SEQ ID NO: 89729 - RNA, 22 nt, Human
cagggccugcccuggauccugg

SEQ ID NO: 89730 - RNA, 21 nt, Human
cagggccugccuagcuugcgu

SEQ ID NO: 89731 - RNA, 19 nt, Human
cagggccugccuccucugg

SEQ ID NO: 89732 - RNA, 32 nt, Human
cagggccugccuggcaccucagguacugggcu

SEQ ID NO: 89733 - RNA, 32 nt, Human
cagggccugccuugcacguugcagccucucug

SEQ ID NO: 89734 - RNA, 32 nt, Human
cagggccugcuguguguccccugucauguccc

SEQ ID NO: 89735 - RNA, 32 nt, Human
cagggccugcuuccugaaucuccugggugugu

SEQ ID NO: 89736 - RNA, 32 nt, Human
cagggccuggacuccccaccccaggcuaccag

SEQ ID NO: 89737 - RNA, 32 nt, Human
cagggccuggacugcacucacagaggcaagug

SEQ ID NO: 89738 - RNA, 32 nt, Human
cagggccuggaguggagguucaggaccaaggg

SEQ ID NO: 89739 - RNA, 21 nt, Human
cagggccuggccucccagggu

SEQ ID NO: 89740 - RNA, 32 nt, Human
cagggccuggcugccuuggcucugaagugagu

SEQ ID NO: 89741 - RNA, 32 nt, Human
cagggccuggcugggccagcuucccucauggg

SEQ ID NO: 89742 - RNA, 32 nt, Human
cagggccugggccucauggcuuuugcuuuccc

SEQ ID NO: 89743 - RNA, 32 nt, Human
cagggccuggggaugcuggacgugggagaggg

SEQ ID NO: 89744 - RNA, 32 nt, Human
cagggccugggugaacucccuggaccuuuccu

SEQ ID NO: 89745 - RNA, 21 nt, Human
cagggccuggucuccccaggg

SEQ ID NO: 89746 - RNA, 32 nt, Human
cagggccuguaaucccagcauuuugggaggcc

SEQ ID NO: 89747 - RNA, 32 nt, Human
cagggccuguaggaaaacacagcaaacuagaa

SEQ ID NO: 89748 - RNA, 22 nt, Human
cagggccugucguuuccagggu

SEQ ID NO: 89749 - RNA, 24 nt, Human
cagggccugucucccuucuugggu

SEQ ID NO: 89750 - RNA, 21 nt, Human
cagggccugucucugacuagg

SEQ ID NO: 89751 - RNA, 21 nt, Human
cagggccugucuuuugccugg

SEQ ID NO: 89752 - RNA, 21 nt, Human
cagggccuguggcugccuggg

SEQ ID NO: 89753 - RNA, 32 nt, Human
cagggccugugguggagccagcagaaccacag

SEQ ID NO: 89754 - RNA, 18 nt, Human
cagggccuuaggacucuc

SEQ ID NO: 89755 - RNA, 22 nt, Human
cagggccuugaaaccucugggu

SEQ ID NO: 89756 - RNA, 32 nt, Human
cagggccuuuaggggcugcaggacggaauggc

SEQ ID NO: 89757 - RNA, 32 nt, Human
cagggccuuucguggcuggaaguggccaguuu

SEQ ID NO: 89758 - RNA, 32 nt, Human
cagggccuuuuccuccucugcgucuuccaucu

SEQ ID NO: 89759 - RNA, 32 nt, Human
cagggcgaacagcauccaucccugcuguuugc

SEQ ID NO: 89760 - RNA, 32 nt, Human
cagggcgagccgcggccccgcguggcgccucg

SEQ ID NO: 89761 - RNA, 32 nt, Human
cagggcgcagagccgggaggcaggccgcagaa

SEQ ID NO: 89762 - RNA, 22 nt, Human
cagggcgcagcucccccuggga

SEQ ID NO: 89763 - RNA, 32 nt, Human
cagggcgcaguggcucaccccuguaaucucag

SEQ ID NO: 89764 - RNA, 32 nt, Human
cagggcgcaguggcucacgccuguaaucccag

SEQ ID NO: 89765 - RNA, 32 nt, Human
cagggcgcccacccugcggcccugccaguggu

SEQ ID NO: 89766 - RNA, 19 nt, Human
cagggcgcccuuucagccc

SEQ ID NO: 89767 - RNA, 32 nt, Human
cagggcgccuggcugccaucuuuuccuccaga

SEQ ID NO: 89768 - RNA, 32 nt, Human
cagggcgcgguggcucacgccuguaaucccag

SEQ ID NO: 89769 - RNA, 32 nt, Human
cagggcggaaggggaagccaggaaggcaggag

SEQ ID NO: 89770 - RNA, 32 nt, Human
cagggcggcaggggugacagugggguccagga

SEQ ID NO: 89771 - RNA, 32 nt, Human
cagggcggccucuccccaaccagcccagcuuc

SEQ ID NO: 89772 - RNA, 32 nt, Human
cagggcggccucucccccaccccucagcccgg

SEQ ID NO: 89773 - RNA, 32 nt, Human
cagggcggcuguggagguguucgggaagcuga

SEQ ID NO: 89774 - RNA, 32 nt, Human
cagggcgggaggauugcuugggcucaagaguu

SEQ ID NO: 89775 - RNA, 32 nt, Human
cagggcgggaggcaggcuguguccucgguggg

SEQ ID NO: 89776 - RNA, 32 nt, Human
cagggcgggaggcgauggaggcugcccgcgcc

SEQ ID NO: 89777 - RNA, 32 nt, Human
cagggcgggaggcggcggcgcgugggggcggg

SEQ ID NO: 89778 - RNA, 32 nt, Human
cagggcgggccaguugggcaauggagcugcug

SEQ ID NO: 89779 - RNA, 32 nt, Human
cagggcggggcuccccaaaggagcaaagaaug

SEQ ID NO: 89780 - RNA, 18 nt, Human
cagggcguccuccagcuc

SEQ ID NO: 89781 - RNA, 19 nt, Human
cagggcguccuuggccuca

SEQ ID NO: 89782 - RNA, 32 nt, Human
cagggcgugaggaggaggaggaagggcaugag

SEQ ID NO: 89783 - RNA, 32 nt, Human
cagggcguggugagguaaggugagugccguag

SEQ ID NO: 89784 - RNA, 32 nt, Human
cagggcgugguggcucauaccuguaaucucag

SEQ ID NO: 89785 - RNA, 32 nt, Human
cagggcgugguggcucaugccuguaaucccag

SEQ ID NO: 89786 - RNA, 32 nt, Human
cagggcuaaugccaccaucuccccucaaaauu

SEQ ID NO: 89787 - RNA, 23 nt, Human
cagggcuacccucuguccagccc

SEQ ID NO: 89788 - RNA, 32 nt, Human
cagggcuacuaaagacuucaggauagaauucu

SEQ ID NO: 89789 - RNA, 32 nt, Human
cagggcuagagccgugagugucagccugggau

SEQ ID NO: 89790 - RNA, 32 nt, Human
cagggcuaggaggcaggggcugcaggcucagc

SEQ ID NO: 89791 - RNA, 25 nt, Human
cagggcuagggcuggaggggccagg

SEQ ID NO: 89792 - RNA, 32 nt, Human
cagggcucaaaugauccucccaucucggccuc

SEQ ID NO: 89793 - RNA, 32 nt, Human
cagggcucaagcaguccucccaccucagccuc

SEQ ID NO: 89794 - RNA, 24 nt, Human
cagggcucaaggauccuccugccu

SEQ ID NO: 89795 - RNA, 32 nt, Human
cagggcucaagggauccucccaccucagccuc

SEQ ID NO: 89796 - RNA, 23 nt, Human
cagggcucacaccuguaauccca

SEQ ID NO: 89797 - RNA, 22 nt, Human
cagggcucaccaggcacuggca

SEQ ID NO: 89798 - RNA, 32 nt, Human
cagggcucacugcagccucgaccuccugggcu

SEQ ID NO: 89799 - RNA, 32 nt, Human
cagggcucacugcagcuuugacuucccaggcu

SEQ ID NO: 89800 - RNA, 32 nt, Human
cagggcucagagggcuaggcacggagggaagg

SEQ ID NO: 89801 - RNA, 32 nt, Human
cagggcucagcaggcgcacguugguuucuugg

SEQ ID NO: 89802 - RNA, 32 nt, Human
cagggcucagcccagggcauccaggaacaggc

SEQ ID NO: 89803 - RNA, 32 nt, Human
cagggcucaggcucugagagcuucuugcugua

SEQ ID NO: 89804 - RNA, 32 nt, Human
cagggcucagggggcguuaggaagggaugguc

SEQ ID NO: 89805 - RNA, 32 nt, Human
cagggcucaggugauccucccaccucagccac

SEQ ID NO: 89806 - RNA, 32 nt, Human
cagggcucaguggcccaggaagugugcugggc

SEQ ID NO: 89807 - RNA, 32 nt, Human
cagggcuccagccgcaggcucggcgcagggcg

SEQ ID NO: 89808 - RNA, 32 nt, Human
cagggcuccaggagccucauccagccucagag

SEQ ID NO: 89809 - RNA, 32 nt, Human
cagggcuccaucuccgccucaggggcuucucc

SEQ ID NO: 89810 - RNA, 32 nt, Human
cagggcucccuccagccgagaccuuuugauuc

SEQ ID NO: 89811 - RNA, 19 nt, Human
cagggcucccucccuggug

SEQ ID NO: 89812 - RNA, 32 nt, Human
cagggcucccugggggcugguggaggggcccu

SEQ ID NO: 89813 - RNA, 32 nt, Human
cagggcuccucccuccuaccucaggccugauc

SEQ ID NO: 89814 - RNA, 32 nt, Human
cagggcuccuguagcucagggggcaggccuga

SEQ ID NO: 89815 - RNA, 32 nt, Human
cagggcucuacagggcagcagagcagagcaaa

SEQ ID NO: 89816 - RNA, 32 nt, Human
cagggcucuccauccaggauccagaagcauug

SEQ ID NO: 89817 - RNA, 32 nt, Human
cagggcucugcagcaccucaccugagaccucc

SEQ ID NO: 89818 - RNA, 32 nt, Human
cagggcucugccaugcccaucuugccuaccaa

SEQ ID NO: 89819 - RNA, 32 nt, Human
cagggcucugccccagaggccucucucuccgu

SEQ ID NO: 89820 - RNA, 32 nt, Human
cagggcucugcgcaccgcugggguucggggcc

SEQ ID NO: 89821 - RNA, 32 nt, Human
cagggcucugggcuaggaaggcagcggcgagg

SEQ ID NO: 89822 - RNA, 32 nt, Human
cagggcucuguauucugcaacagccuguuugg

SEQ ID NO: 89823 - RNA, 18 nt, Human
cagggcugaaaccauguc

SEQ ID NO: 89824 - RNA, 32 nt, Human
cagggcugacccaccagccucucacggaggcg

SEQ ID NO: 89825 - RNA, 19 nt, Human
cagggcugacucccucuca

SEQ ID NO: 89826 - RNA, 32 nt, Human
cagggcugacucccucucagguggaaggcagg

SEQ ID NO: 89827 - RNA, 32 nt, Human
cagggcugacucugcugccccaaccuuucaag

SEQ ID NO: 89828 - RNA, 32 nt, Human
cagggcugacugaacugucacugugagauauu

SEQ ID NO: 89829 - RNA, 22 nt, Human
cagggcugagaaagaaaguguc

SEQ ID NO: 89830 - RNA, 22 nt, Human
cagggcugagcauccuccugcc

SEQ ID NO: 89831 - RNA, 22 nt, Human
cagggcugaggagccuccggga

SEQ ID NO: 89832 - RNA, 32 nt, Human
cagggcugaggaugaggagaacccuggggacc

SEQ ID NO: 89833 - RNA, 22 nt, Human
cagggcugaggcaagucuggga

SEQ ID NO: 89834 - RNA, 32 nt, Human
cagggcugaggcaggagaauugcuugaacccg

SEQ ID NO: 89835 - RNA, 18 nt, Human
cagggcugagggcccugg

SEQ ID NO: 89836 - RNA, 19 nt, Human
cagggcugaggggaggcag

SEQ ID NO: 89837 - RNA, 22 nt, Human
cagggcugaggggaggcaggga

SEQ ID NO: 89838 - RNA, 32 nt, Human
cagggcugagucuauccaagaggcuuuguuua

SEQ ID NO: 89839 - RNA, 21 nt, Human
cagggcugagugcaccuggga

SEQ ID NO: 89840 - RNA, 32 nt, Human
cagggcugagugggcugggaucucguguccuc

SEQ ID NO: 89841 - RNA, 22 nt, Human
cagggcugauauucaccuggga

SEQ ID NO: 89842 - RNA, 32 nt, Human
cagggcugcaccugccaggaccuaauguucuu

SEQ ID NO: 89843 - RNA, 32 nt, Human
cagggcugcaccugccauccccggcucugcca

SEQ ID NO: 89844 - RNA, 32 nt, Human
cagggcugcaggcgggcggagguuccaggaga

SEQ ID NO: 89845 - RNA, 18 nt, Human
cagggcugccagagguuc

SEQ ID NO: 89846 - RNA, 22 nt, Human
cagggcugccaggaguucaguu

SEQ ID NO: 89847 - RNA, 32 nt, Human
cagggcugccaggccuggccccucucugggaa

SEQ ID NO: 89848 - RNA, 22 nt, Human
cagggcugccucccuccagccc

SEQ ID NO: 89849 - RNA, 32 nt, Human
cagggcugccuguagucccagcuacucagaag

SEQ ID NO: 89850 - RNA, 23 nt, Human
cagggcugcgcgcccaggucugc

SEQ ID NO: 89851 - RNA, 19 nt, Human
cagggcugcgguaggccag

SEQ ID NO: 89852 - RNA, 21 nt, Human
cagggcugcugaggggccagg

SEQ ID NO: 89853 - RNA, 32 nt, Human
cagggcugcuggaggccugcuccuggggcccg

SEQ ID NO: 89854 - RNA, 32 nt, Human
cagggcugcuuugcugugaugaugauugcauu

SEQ ID NO: 89855 - RNA, 23 nt, Human
cagggcuggaagcuggacugaga

SEQ ID NO: 89856 - RNA, 23 nt, Human
cagggcuggacugacccuaugga

SEQ ID NO: 89857 - RNA, 22 nt, Human
cagggcuggagacuuccucugg

SEQ ID NO: 89858 - RNA, 24 nt, Human
cagggcuggagaugcuucccaagg

SEQ ID NO: 89859 - RNA, 22 nt, Human
cagggcuggagcaccucugaga

SEQ ID NO: 89860 - RNA, 22 nt, Human
cagggcuggagcugggcuggga

SEQ ID NO: 89861 - RNA, 19 nt, Human
cagggcuggaggccuggga

SEQ ID NO: 89862 - RNA, 24 nt, Human
cagggcuggagggagaucuugaga

SEQ ID NO: 89863 - RNA, 32 nt, Human
cagggcuggagugcaguggcaugaucucagcu

SEQ ID NO: 89864 - RNA, 24 nt, Human
cagggcuggauccaccccugcgga

SEQ ID NO: 89865 - RNA, 23 nt, Human
cagggcuggcucuguccccuggg

SEQ ID NO: 89866 - RNA, 29 nt, Human
cagggcuggcugcagcaacucccugacac

SEQ ID NO: 89867 - RNA, 22 nt, Human
cagggcuggcugcugggcugcu

SEQ ID NO: 89868 - RNA, 20 nt, Human
cagggcugggacccccagga

SEQ ID NO: 89869 - RNA, 32 nt, Human
cagggcugggagacuaggaugucggacacgug

SEQ ID NO: 89870 - RNA, 24 nt, Human
cagggcugggccugccccccgggg

SEQ ID NO: 89871 - RNA, 22 nt, Human
cagggcuggggaggagcgggga

SEQ ID NO: 89872 - RNA, 21 nt, Human
cagggcugggggagagccggg

SEQ ID NO: 89873 - RNA, 32 nt, Human
cagggcugggugcagccagcuguccugcagcu

SEQ ID NO: 89874 - RNA, 23 nt, Human
cagggcuggugggcggggccagg

SEQ ID NO: 89875 - RNA, 32 nt, Human
cagggcugguuugguuaugagacgaucucgcu

SEQ ID NO: 89876 - RNA, 32 nt, Human
cagggcuguagcagagaggcuaguccaucuag

SEQ ID NO: 89877 - RNA, 32 nt, Human
cagggcugucccacagaaauagugugagccac

SEQ ID NO: 89878 - RNA, 32 nt, Human
cagggcugucucccccuccaucuggagcuccc

SEQ ID NO: 89879 - RNA, 32 nt, Human
cagggcugugacucuggcugagcccaggaaag

SEQ ID NO: 89880 - RNA, 32 nt, Human
cagggcuguggagacacgucucuccucucugu

SEQ ID NO: 89881 - RNA, 32 nt, Human
cagggcuguggagcagccucucuccuuggacc

SEQ ID NO: 89882 - RNA, 22 nt, Human
cagggcugugucuccccucaga

SEQ ID NO: 89883 - RNA, 32 nt, Human
cagggcuucagggcuggaauuccagugcugca

SEQ ID NO: 89884 - RNA, 32 nt, Human
cagggcuucaucccugugaaggcacagggccu

SEQ ID NO: 89885 - RNA, 32 nt, Human
cagggcuucccaagcucuuuccacagccacau

SEQ ID NO: 89886 - RNA, 32 nt, Human
cagggcuucccaaugcccuuuuccucccugcc

SEQ ID NO: 89887 - RNA, 21 nt, Human
cagggcuucccucuccagccc

SEQ ID NO: 89888 - RNA, 32 nt, Human
cagggcuucugagaugcaaagguuuggccuca

SEQ ID NO: 89889 - RNA, 32 nt, Human
cagggcuucugcugcaucugcagccaugucgg

SEQ ID NO: 89890 - RNA, 32 nt, Human
cagggcuucuggauccucgguuucugggcuac

SEQ ID NO: 89891 - RNA, 22 nt, Human
cagggcuucuucucgcagguca

SEQ ID NO: 89892 - RNA, 32 nt, Human
cagggcuuggauguaaggauuauaccaagagu

SEQ ID NO: 89893 - RNA, 32 nt, Human
cagggcuuggccuggcuccugagccagcgggg

SEQ ID NO: 89894 - RNA, 32 nt, Human
cagggcuugguggugguagcauuugggucuga

SEQ ID NO: 89895 - RNA, 20 nt, Human
cagggcuugucuccuccugg

SEQ ID NO: 89896 - RNA, 32 nt, Human
cagggcuuucucucccuccaccccuugcagcc

SEQ ID NO: 89897 - RNA, 32 nt, Human
cagggcuuuggauccaggucugggacgagccc

SEQ ID NO: 89898 - RNA, 19 nt, Human
cagggcuuuuccugagucc

SEQ ID NO: 89899 - RNA, 32 nt, Human
cagggcuuuugggcacugccuccuugggaagu

SEQ ID NO: 89900 - RNA, 23 nt, Human
caggggaaaacugguggaccugg

SEQ ID NO: 89901 - RNA, 32 nt, Human
caggggaaaacugguggaccuggacuuagcuc

SEQ ID NO: 89902 - RNA, 32 nt, Human
caggggaaagagagcccucaaaggccucuuuc

SEQ ID NO: 89903 - RNA, 32 nt, Human
caggggaaaguggucugcacaugcccuguuga

SEQ ID NO: 89904 - RNA, 32 nt, Human
caggggaacacaaaagcuaugucuauucccca

SEQ ID NO: 89905 - RNA, 32 nt, Human
caggggaacccccagcuaacuggucucucaga

SEQ ID NO: 89906 - RNA, 18 nt, Human
caggggaacuugggccag

SEQ ID NO: 89907 - RNA, 32 nt, Human
caggggaagagaacccaucagggacguuuguc

SEQ ID NO: 89908 - RNA, 32 nt, Human
caggggaaggcccugaggcggaggcugugcuc

SEQ ID NO: 89909 - RNA, 32 nt, Human
caggggaagggugggugguugcaggggaaguu

SEQ ID NO: 89910 - RNA, 32 nt, Human
caggggaauggaucccaagggcccagauaacg

SEQ ID NO: 89911 - RNA, 20 nt, Human
caggggaauugcuugaacca

SEQ ID NO: 89912 - RNA, 23 nt, Human
caggggaauuggugauuacagua

SEQ ID NO: 89913 - RNA, 22 nt, Human
caggggacaaaauggaccgagg

SEQ ID NO: 89914 - RNA, 19 nt, Human
caggggacagaagcuuuuu

SEQ ID NO: 89915 - RNA, 32 nt, Human
caggggacagaaugugcauggaguggagcaug

SEQ ID NO: 89916 - RNA, 32 nt, Human
caggggacagcaucugcagcaguugcugaggc

SEQ ID NO: 89917 - RNA, 21 nt, Human
caggggacagccagggacagg

SEQ ID NO: 89918 - RNA, 18 nt, Human
caggggacagggcucucu

SEQ ID NO: 89919 - RNA, 20 nt, Human
caggggacaugaugagccag

SEQ ID NO: 89920 - RNA, 22 nt, Human
caggggaccaagccaagcuagg

SEQ ID NO: 89921 - RNA, 21 nt, Human
caggggaccagccaggccugg

SEQ ID NO: 89922 - RNA, 21 nt, Human
caggggaccagguggaccagg

SEQ ID NO: 89923 - RNA, 20 nt, Human
caggggaccaucgugguucu

SEQ ID NO: 89924 - RNA, 32 nt, Human
caggggacccagccagggggugggcucuagag

SEQ ID NO: 89925 - RNA, 19 nt, Human
caggggacccauggcgagg

SEQ ID NO: 89926 - RNA, 22 nt, Human
caggggaccccauggggacagg

SEQ ID NO: 89927 - RNA, 22 nt, Human
caggggacccggaggagccugg

SEQ ID NO: 89928 - RNA, 32 nt, Human
caggggacccggaggcucccacccucaccucu

SEQ ID NO: 89929 - RNA, 20 nt, Human
caggggaccucagacccagg

SEQ ID NO: 89930 - RNA, 20 nt, Human
caggggaccugaguucuagg

SEQ ID NO: 89931 - RNA, 18 nt, Human
caggggaccuggaccagg

SEQ ID NO: 89932 - RNA, 21 nt, Human
caggggaccuggagagccggg

SEQ ID NO: 89933 - RNA, 21 nt, Human
caggggaccuggagcugccag

SEQ ID NO: 89934 - RNA, 18 nt, Human
caggggacggagggcgag

SEQ ID NO: 89935 - RNA, 32 nt, Human
caggggacugucugccagccucccaggcccau

SEQ ID NO: 89936 - RNA, 19 nt, Human
caggggacuugcaagcagg

SEQ ID NO: 89937 - RNA, 32 nt, Human
caggggagaagcaaacccccaggauugaaggc

SEQ ID NO: 89938 - RNA, 32 nt, Human
caggggagagagugagcgugagcuuggcauag

SEQ ID NO: 89939 - RNA, 32 nt, Human
caggggagagggaagcagccgugcugucaaca

SEQ ID NO: 89940 - RNA, 32 nt, Human
caggggagagugaaggccugcaggagggcagg

SEQ ID NO: 89941 - RNA, 32 nt, Human
caggggagaguguuccuuuuguucuuaacuag

SEQ ID NO: 89942 - RNA, 32 nt, Human
caggggagauggagguugcagugagcugagau

SEQ ID NO: 89943 - RNA, 32 nt, Human
caggggagcagaaggagaagaaaacugccugu

SEQ ID NO: 89944 - RNA, 18 nt, Human
caggggagcaggcuucuu

SEQ ID NO: 89945 - RNA, 17 nt, Human
caggggagcccccaccc

SEQ ID NO: 89946 - RNA, 32 nt, Human
caggggagccggcuggagugagcuggcuggaa

SEQ ID NO: 89947 - RNA, 17 nt, Human
caggggagcucccagcc

SEQ ID NO: 89948 - RNA, 32 nt, Human
caggggaggaaagacuggugggaagugagcag

SEQ ID NO: 89949 - RNA, 32 nt, Human
caggggaggaagagggauggggcugcaagcca

SEQ ID NO: 89950 - RNA, 32 nt, Human
caggggaggaagccgcagcccaaggaggucgu

SEQ ID NO: 89951 - RNA, 32 nt, Human
caggggaggaugggugccagagggugggagug

SEQ ID NO: 89952 - RNA, 32 nt, Human
caggggaggccuggguuucaggaacagguaac

SEQ ID NO: 89953 - RNA, 32 nt, Human
caggggagggccagggcucugaggagugggcg

SEQ ID NO: 89954 - RNA, 20 nt, Human
caggggaggucugggcaagg

SEQ ID NO: 89955 - RNA, 32 nt, Human
caggggaggugcgcagugaacugucaaggacu

SEQ ID NO: 89956 - RNA, 32 nt, Human
caggggaggugggguuugugucuuccaacuuc

SEQ ID NO: 89957 - RNA, 32 nt, Human
caggggagucggaagagcuuggaagagcuggg

SEQ ID NO: 89958 - RNA, 18 nt, Human
caggggagugugggucag

SEQ ID NO: 89959 - RNA, 20 nt, Human
caggggaucaaccugagaaa

SEQ ID NO: 89960 - RNA, 32 nt, Human
caggggaucacaccagccuaaccaacaugaug

SEQ ID NO: 89961 - RNA, 20 nt, Human
caggggaucacccugagaaa

SEQ ID NO: 89962 - RNA, 20 nt, Human
caggggaugaguggaccugg

SEQ ID NO: 89963 - RNA, 32 nt, Human
caggggaugaguggagguuaaggcugaggaaa

SEQ ID NO: 89964 - RNA, 32 nt, Human
caggggaugccaccucugcugcuccagucguc

SEQ ID NO: 89965 - RNA, 21 nt, Human
caggggauggucuugggcagg

SEQ ID NO: 89966 - RNA, 32 nt, Human
caggggcaaauguuuacuuguaauuuucuucc

SEQ ID NO: 89967 - RNA, 32 nt, Human
caggggcacaaucaccacacacugccgcuuca

SEQ ID NO: 89968 - RNA, 21 nt, Human
caggggcacaaucucagcuca

SEQ ID NO: 89969 - RNA, 32 nt, Human
caggggcacagaccucucccacccacaagaac

SEQ ID NO: 89970 - RNA, 32 nt, Human
caggggcacaggcuccagcaggcugccugucu

SEQ ID NO: 89971 - RNA, 32 nt, Human
caggggcaccuugucacugccgucugugcacu

SEQ ID NO: 89972 - RNA, 23 nt, Human
caggggcagcagccgacaggggg

SEQ ID NO: 89973 - RNA, 32 nt, Human
caggggcagcagggggcagggugcagggucca

SEQ ID NO: 89974 - RNA, 32 nt, Human
caggggcagccaggacccuugauucagaccau

SEQ ID NO: 89975 - RNA, 19 nt, Human
caggggcagccuccagucc

SEQ ID NO: 89976 - RNA, 32 nt, Human
caggggcaggagaggcugggcuggguggcaca

SEQ ID NO: 89977 - RNA, 32 nt, Human
caggggcaggaggcagucacugaccccgagac

SEQ ID NO: 89978 - RNA, 32 nt, Human
caggggcagggacaguggccaggcggcccgag

SEQ ID NO: 89979 - RNA, 32 nt, Human
caggggcagggcaagcuugaccucucacuguu

SEQ ID NO: 89980 - RNA, 32 nt, Human
caggggcaggggagagacucucuccccaccac

SEQ ID NO: 89981 - RNA, 32 nt, Human
caggggcaggggguggagguuggggucaccgg

SEQ ID NO: 89982 - RNA, 32 nt, Human
caggggcagggugggauggggaagaccaggag

SEQ ID NO: 89983 - RNA, 32 nt, Human
caggggcagucaaauuagcaccuacuggcucu

SEQ ID NO: 89984 - RNA, 32 nt, Human
caggggcauagaguggucagucugaaagggag

SEQ ID NO: 89985 - RNA, 32 nt, Human
caggggccacgcggaggcucacgaggaggccg

SEQ ID NO: 89986 - RNA, 22 nt, Human
caggggccacuuuucgagaccg

SEQ ID NO: 89987 - RNA, 32 nt, Human
caggggccagaacaguggcagggggcccgggg

SEQ ID NO: 89988 - RNA, 22 nt, Human
caggggccagcagugggccggg

SEQ ID NO: 89989 - RNA, 23 nt, Human
caggggccagccagugucugacc

SEQ ID NO: 89990 - RNA, 19 nt, Human
caggggccaggccaggcca

SEQ ID NO: 89991 - RNA, 22 nt, Human
caggggccauguuugcaaacug

SEQ ID NO: 89992 - RNA, 32 nt, Human
caggggcccaacuuccccuggagcucagaggu

SEQ ID NO: 89993 - RNA, 25 nt, Human
caggggcccacccucugcccaggga

SEQ ID NO: 89994 - RNA, 32 nt, Human
caggggcccagaugacaaccucuccuucgcuc

SEQ ID NO: 89995 - RNA, 21 nt, Human
caggggcccaggcagcacaga

SEQ ID NO: 89996 - RNA, 32 nt, Human
caggggcccaggccaagguggggugcaggagg

SEQ ID NO: 89997 - RNA, 32 nt, Human
caggggcccauggacucuucagucuggagggu

SEQ ID NO: 89998 - RNA, 24 nt, Human
caggggcccauucagucccaggga

SEQ ID NO: 89999 - RNA, 24 nt, Human
caggggccccccugugcccaggga

SEQ ID NO: 90000 - RNA, 24 nt, Human
caggggccccgccugacucaggga

SEQ ID NO: 90001 - RNA, 32 nt, Human
caggggcccggccaagaaggaggcccgccugu

SEQ ID NO: 90002 - RNA, 32 nt, Human
caggggcccggcccuggccggcagcggcaaag

SEQ ID NO: 90003 - RNA, 32 nt, Human
caggggcccgggcuggagaggaaggggcacca

SEQ ID NO: 90004 - RNA, 32 nt, Human
caggggcccugccucuuccugagcucaggaua

SEQ ID NO: 90005 - RNA, 32 nt, Human
caggggcccuggaaggguguggccaacaccaa

SEQ ID NO: 90006 - RNA, 22 nt, Human
caggggccgcacgccugggccc

SEQ ID NO: 90007 - RNA, 32 nt, Human
caggggccgcagggacgacacucuccagggag

SEQ ID NO: 90008 - RNA, 32 nt, Human
caggggccgccgggaucaucccgcccagucga

SEQ ID NO: 90009 - RNA, 32 nt, Human
caggggccgcgccgacugggaacucgccaggg

SEQ ID NO: 90010 - RNA, 32 nt, Human
caggggccgucagaggauguccacagaggcag

SEQ ID NO: 90011 - RNA, 32 nt, Human
caggggccuauugugcugucuuccugugacca

SEQ ID NO: 90012 - RNA, 32 nt, Human
caggggccuccaggacccggaggagaggcagg

SEQ ID NO: 90013 - RNA, 24 nt, Human
caggggccucgcuucccccagggg

SEQ ID NO: 90014 - RNA, 32 nt, Human
caggggccucuccuaagacugggcucugugug

SEQ ID NO: 90015 - RNA, 32 nt, Human
caggggccucuccugguaauccucugagccca

SEQ ID NO: 90016 - RNA, 32 nt, Human
caggggccugaccugggcacugugccagggca

SEQ ID NO: 90017 - RNA, 20 nt, Human
caggggccuggaggggccag

SEQ ID NO: 90018 - RNA, 32 nt, Human
caggggccugggagaugccaggaggaugagag

SEQ ID NO: 90019 - RNA, 32 nt, Human
caggggccuggggacccucucccuggcugccu

SEQ ID NO: 90020 - RNA, 20 nt, Human
caggggccugucaagccagg

SEQ ID NO: 90021 - RNA, 32 nt, Human
caggggccuuucucaccaccucccugcuccua

SEQ ID NO: 90022 - RNA, 20 nt, Human
caggggcgaggcggcugggg

SEQ ID NO: 90023 - RNA, 20 nt, Human
caggggcgaggcuagagggg

SEQ ID NO: 90024 - RNA, 22 nt, Human
caggggcgagugaggcagcagc

SEQ ID NO: 90025 - RNA, 32 nt, Human
caggggcgauggugccuggucucugaguaaga

SEQ ID NO: 90026 - RNA, 21 nt, Human
caggggcgcaaucucggcuca

SEQ ID NO: 90027 - RNA, 22 nt, Human
caggggcgcccggagcaggcgc

SEQ ID NO: 90028 - RNA, 21 nt, Human
caggggcgccgcgcagcccgc

SEQ ID NO: 90029 - RNA, 32 nt, Human
caggggcgcuggcugcacucaagacccucgag

SEQ ID NO: 90030 - RNA, 32 nt, Human
caggggcggaggcggaggcagagguggaggcg

SEQ ID NO: 90031 - RNA, 24 nt, Human
caggggcggcugcagaggcagugc

SEQ ID NO: 90032 - RNA, 32 nt, Human
caggggcggcugccucacucccuaccugagcc

SEQ ID NO: 90033 - RNA, 25 nt, Human
caggggcgggaccuggggcggggga

SEQ ID NO: 90034 - RNA, 22 nt, Human
caggggcgggacuggagagggg

SEQ ID NO: 90035 - RNA, 23 nt, Human
caggggcgggcggaggccgccgc

SEQ ID NO: 90036 - RNA, 25 nt, Human
caggggcgggcggggguacgaggga

SEQ ID NO: 90037 - RNA, 21 nt, Human
caggggcggggcagggccagg

SEQ ID NO: 90038 - RNA, 22 nt, Human
caggggcggggcagggccaggg

SEQ ID NO: 90039 - RNA, 20 nt, Human
caggggcggggcucgggggg

SEQ ID NO: 90040 - RNA, 24 nt, Human
caggggcggggcuugugggagggg

SEQ ID NO: 90041 - RNA, 32 nt, Human
caggggcggguggaucaccugaggucaggagu

SEQ ID NO: 90042 - RNA, 32 nt, Human
caggggcuagcagcagaggcuucaccgcauca

SEQ ID NO: 90043 - RNA, 21 nt, Human
caggggcuagcaugggcuagg

SEQ ID NO: 90044 - RNA, 19 nt, Human
caggggcucaagggccagg

SEQ ID NO: 90045 - RNA, 31 nt, Human
caggggcucaauaaaugcuuguugaacuuga

SEQ ID NO: 90046 - RNA, 32 nt, Human
caggggcucaggacagggaggaguugaggcca

SEQ ID NO: 90047 - RNA, 32 nt, Human
caggggcucaggagagaagggagcagcuggca

SEQ ID NO: 90048 - RNA, 32 nt, Human
caggggcuccaugcugggucugaggccccugc

SEQ ID NO: 90049 - RNA, 32 nt, Human
caggggcuccccacucaguccccagucaucua

SEQ ID NO: 90050 - RNA, 32 nt, Human
caggggcucccucccuccuucucuccuuccuu

SEQ ID NO: 90051 - RNA, 22 nt, Human
caggggcuccuagugggccagg

SEQ ID NO: 90052 - RNA, 24 nt, Human
caggggcucucagaaucccgcuua

SEQ ID NO: 90053 - RNA, 32 nt, Human
caggggcucugacgggcuuaccccugucccug

SEQ ID NO: 90054 - RNA, 32 nt, Human
caggggcucugccagccucggccucucccucc

SEQ ID NO: 90055 - RNA, 32 nt, Human
caggggcucuggagagaaacaauaaagagauu

SEQ ID NO: 90056 - RNA, 24 nt, Human
caggggcucuugggguucggcuca

SEQ ID NO: 90057 - RNA, 20 nt, Human
caggggcugaauggaccagg

SEQ ID NO: 90058 - RNA, 32 nt, Human
caggggcugacggaucggggagaggcugggug

SEQ ID NO: 90059 - RNA, 32 nt, Human
caggggcugaggaggaggagcagggggugcug

SEQ ID NO: 90060 - RNA, 19 nt, Human
caggggcugagggcacuga

SEQ ID NO: 90061 - RNA, 32 nt, Human
caggggcugauagggcaaaauaaaaugacaau

SEQ ID NO: 90062 - RNA, 32 nt, Human
caggggcugcaggagauaagagaaacgggcug

SEQ ID NO: 90063 - RNA, 32 nt, Human
caggggcugcaggauggaaccagcaagcugcu

SEQ ID NO: 90064 - RNA, 21 nt, Human
caggggcugccacacuccuga

SEQ ID NO: 90065 - RNA, 32 nt, Human
caggggcugccaugaagaucucugacauggug

SEQ ID NO: 90066 - RNA, 32 nt, Human
caggggcugccccggaaucagcuccccggggc

SEQ ID NO: 90067 - RNA, 32 nt, Human
caggggcugccuccugccuuuucuuuuguaaa

SEQ ID NO: 90068 - RNA, 32 nt, Human
caggggcugccucugaccccuccugugguggu

SEQ ID NO: 90069 - RNA, 32 nt, Human
caggggcugccugggccucuggugcacaugau

SEQ ID NO: 90070 - RNA, 22 nt, Human
caggggcugcugcuccacuuca

SEQ ID NO: 90071 - RNA, 32 nt, Human
caggggcuggaaggugcuccaggcucaaugcu

SEQ ID NO: 90072 - RNA, 20 nt, Human
caggggcuggaguuuggaga

SEQ ID NO: 90073 - RNA, 32 nt, Human
caggggcugggcagaggggaggaggaagcaca

SEQ ID NO: 90074 - RNA, 32 nt, Human
caggggcugggcagcugccagugacccaagcc

SEQ ID NO: 90075 - RNA, 20 nt, Human
caggggcugggcaggagaug

SEQ ID NO: 90076 - RNA, 32 nt, Human
caggggcugggcagggaugccaggugggccca

SEQ ID NO: 90077 - RNA, 17 nt, Human
caggggcuggggcuucu

SEQ ID NO: 90078 - RNA, 26 nt, Human
caggggcugugagguggcagcggcug

SEQ ID NO: 90079 - RNA, 22 nt, Human
caggggcugugcaggcagccca

SEQ ID NO: 90080 - RNA, 22 nt, Human
caggggcugugucuccucacuu

SEQ ID NO: 90081 - RNA, 23 nt, Human
caggggcuuccaaauuuagcuua

SEQ ID NO: 90082 - RNA, 32 nt, Human
caggggcuucccucagcuucccagagugcaca

SEQ ID NO: 90083 - RNA, 24 nt, Human
caggggcuuugucaguuuuguuca

SEQ ID NO: 90084 - RNA, 32 nt, Human
cagggggaaaacugcauuuucucuuccaaaaa

SEQ ID NO: 90085 - RNA, 32 nt, Human
cagggggaagaaaaggaaaagggagcgcagga

SEQ ID NO: 90086 - RNA, 32 nt, Human
cagggggacacaggggacaaggaggagcuauu

SEQ ID NO: 90087 - RNA, 32 nt, Human
cagggggacaguggacagggacucagaaaugu

SEQ ID NO: 90088 - RNA, 22 nt, Human
cagggggacaugcaaaaacaau

SEQ ID NO: 90089 - RNA, 20 nt, Human
cagggggacggcucgcgaua

SEQ ID NO: 90090 - RNA, 32 nt, Human
cagggggagagggagggaaggaaggugcggcu

SEQ ID NO: 90091 - RNA, 32 nt, Human
cagggggagcgaggaggaagggaaccgcggcc

SEQ ID NO: 90092 - RNA, 32 nt, Human
cagggggagcucuuccuggaccaagggaggag

SEQ ID NO: 90093 - RNA, 32 nt, Human
cagggggaggcagagauggcacagcaagagac

SEQ ID NO: 90094 - RNA, 32 nt, Human
cagggggagggggagagagcaaggagaucggu

SEQ ID NO: 90095 - RNA, 32 nt, Human
cagggggaugaaccgcgagggagcucccggga

SEQ ID NO: 90096 - RNA, 20 nt, Human
cagggggaugugucccagua

SEQ ID NO: 90097 - RNA, 32 nt, Human
cagggggcaacugccuugaucggccugccaug

SEQ ID NO: 90098 - RNA, 19 nt, Human
cagggggcaaggggccagg

SEQ ID NO: 90099 - RNA, 32 nt, Human
cagggggcaauucccugucauuuucagugacc

SEQ ID NO: 90100 - RNA, 32 nt, Human
cagggggcagaggucaggagaaucaucucaga

SEQ ID NO: 90101 - RNA, 19 nt, Human
cagggggcaggcaggcagg

SEQ ID NO: 90102 - RNA, 32 nt, Human
cagggggcagggaagcagugcuggguggaggc

SEQ ID NO: 90103 - RNA, 32 nt, Human
cagggggcagggaugcuuuccagccugcagca

SEQ ID NO: 90104 - RNA, 32 nt, Human
cagggggcagggggcagagagcagagaggagc

SEQ ID NO: 90105 - RNA, 20 nt, Human
cagggggcagguggacccgg

SEQ ID NO: 90106 - RNA, 32 nt, Human
cagggggcagugaggugccccugccuggagca

SEQ ID NO: 90107 - RNA, 22 nt, Human
cagggggcauuuguccccucca

SEQ ID NO: 90108 - RNA, 32 nt, Human
cagggggccauggagaagcugcagcgacuuua

SEQ ID NO: 90109 - RNA, 32 nt, Human
cagggggccauggugaccugagacaaguggac

SEQ ID NO: 90110 - RNA, 20 nt, Human
cagggggcccaaggagcagu

SEQ ID NO: 90111 - RNA, 32 nt, Human
cagggggccccaggcucgccugacugaagaca

SEQ ID NO: 90112 - RNA, 26 nt, Human
cagggggccgaggacaccaggucugu

SEQ ID NO: 90113 - RNA, 32 nt, Human
cagggggccgcggaccugaacggagguugcgg

SEQ ID NO: 90114 - RNA, 20 nt, Human
cagggggccggagggccagg

SEQ ID NO: 90115 - RNA, 32 nt, Human
cagggggccgggacagggagguugggaggggg

SEQ ID NO: 90116 - RNA, 22 nt, Human
cagggggccugagcgggacagg

SEQ ID NO: 90117 - RNA, 21 nt, Human
cagggggccugugucacagug

SEQ ID NO: 90118 - RNA, 22 nt, Human
cagggggcgccaaggagccagg

SEQ ID NO: 90119 - RNA, 32 nt, Human
cagggggcugagcucugaggggugggugcuca

SEQ ID NO: 90120 - RNA, 32 nt, Human
cagggggcugaggcacacagagaggccaacuu

SEQ ID NO: 90121 - RNA, 22 nt, Human
cagggggcugagggcaagcagg

SEQ ID NO: 90122 - RNA, 32 nt, Human
cagggggcugggaggcacagaugcaggcucag

SEQ ID NO: 90123 - RNA, 32 nt, Human
cagggggcugucacuccgugaccucaguauua

SEQ ID NO: 90124 - RNA, 19 nt, Human
cagggggcuguggggccag

SEQ ID NO: 90125 - RNA, 32 nt, Human
caggggguacagcuguuauacuuuaugaaccu

SEQ ID NO: 90126 - RNA, 32 nt, Human
caggggguagaacggcccugugcuuaagacac

SEQ ID NO: 90127 - RNA, 23 nt, Human
caggggguccagggcggaccugg

SEQ ID NO: 90128 - RNA, 20 nt, Human
caggggguccaggugggcca

SEQ ID NO: 90129 - RNA, 32 nt, Human
cagggggucugggagcuuggauggaauaaauu

SEQ ID NO: 90130 - RNA, 20 nt, Human
cagggggugagggggccagg

SEQ ID NO: 90131 - RNA, 32 nt, Human
cagggggugaugguuacagcccagacuuuacc

SEQ ID NO: 90132 - RNA, 32 nt, Human
cagggggugcagaugaugccugggcagaugug

SEQ ID NO: 90133 - RNA, 32 nt, Human
cagggggugcgcgucgggggaggcagaagcca

SEQ ID NO: 90134 - RNA, 22 nt, Human
caggggguggagguugcaguga

SEQ ID NO: 90135 - RNA, 32 nt, Human
caggggguggggaagagagacgucagcgggac

SEQ ID NO: 90136 - RNA, 18 nt, Human
caggggguggugggccag

SEQ ID NO: 90137 - RNA, 19 nt, Human
caggggguggugugccagg

SEQ ID NO: 90138 - RNA, 32 nt, Human
caggggguucacaauucucagcuucaucugag

SEQ ID NO: 90139 - RNA, 32 nt, Human
cagggguagaggcugggggcuccaccccagcc

SEQ ID NO: 90140 - RNA, 32 nt, Human
cagggguagagggagaagccuagagcagcgcu

SEQ ID NO: 90141 - RNA, 32 nt, Human
cagggguagcgagguugcaggagcuggcuggc

SEQ ID NO: 90142 - RNA, 32 nt, Human
cagggguaggcaggcacagagugcugucugcu

SEQ ID NO: 90143 - RNA, 32 nt, Human
caggggucaaaaccagacuaacaguuuuagaa

SEQ ID NO: 90144 - RNA, 32 nt, Human
caggggucaaagcauuugcucaccacaacuga

SEQ ID NO: 90145 - RNA, 23 nt, Human
caggggucacaccuguaauccca

SEQ ID NO: 90146 - RNA, 32 nt, Human
caggggucagccaccugccuuugagucaucaa

SEQ ID NO: 90147 - RNA, 32 nt, Human
caggggucaggugaggcuugagcuugaggagu

SEQ ID NO: 90148 - RNA, 32 nt, Human
caggggucaguguagcuucugagcuaccuuua

SEQ ID NO: 90149 - RNA, 21 nt, Human
cagggguccagggugcaguga

SEQ ID NO: 90150 - RNA, 32 nt, Human
cagggguccaggguguggguccugggcuguca

SEQ ID NO: 90151 - RNA, 32 nt, Human
cagggguccaggugccccagagucuggugcug

SEQ ID NO: 90152 - RNA, 32 nt, Human
cagggguccaugaugccgagcugcaaucguuc

SEQ ID NO: 90153 - RNA, 32 nt, Human
caggggucuagugcccugcauuccuuugaggc

SEQ ID NO: 90154 - RNA, 32 nt, Human
caggggucucacuauguugcccaaacuggccu

SEQ ID NO: 90155 - RNA, 32 nt, Human
caggggucugagacagcagccacugggguuga

SEQ ID NO: 90156 - RNA, 32 nt, Human
caggggucuggcaugagacaggucaguuuccc

SEQ ID NO: 90157 - RNA, 32 nt, Human
caggggucugggcuccagccauggagggugga

SEQ ID NO: 90158 - RNA, 32 nt, Human
caggggucugugugucccaguugcaugcacgu

SEQ ID NO: 90159 - RNA, 32 nt, Human
caggggugaacuguagcuugaugcaguaaucu

SEQ ID NO: 90160 - RNA, 32 nt, Human
caggggugagccaccacgcccagccccagcuu

SEQ ID NO: 90161 - RNA, 32 nt, Human
caggggugagccaccgugccuugcuauuaaug

SEQ ID NO: 90162 - RNA, 32 nt, Human
caggggugagccacugcgcccagccuaaaaua

SEQ ID NO: 90163 - RNA, 32 nt, Human
caggggugagccacugugcccggccauaauuu

SEQ ID NO: 90164 - RNA, 32 nt, Human
caggggugaggagggagcaggagaacggguaa

SEQ ID NO: 90165 - RNA, 32 nt, Human
caggggugaggagggagcaggagggcaggagu

SEQ ID NO: 90166 - RNA, 32 nt, Human
caggggugccaagagaggcauuccagaaggac

SEQ ID NO: 90167 - RNA, 32 nt, Human
caggggugcuaugacaugcaagugagaagcug

SEQ ID NO: 90168 - RNA, 19 nt, Human
cagggguggagugggccgg

SEQ ID NO: 90169 - RNA, 32 nt, Human
cagggguggccugaagccugggggccaggcug

SEQ ID NO: 90170 - RNA, 18 nt, Human
caggggugggagagccag

SEQ ID NO: 90171 - RNA, 23 nt, Human
caggggugggagcuguugccgaa

SEQ ID NO: 90172 - RNA, 21 nt, Human
caggggugggagggcggccgc

SEQ ID NO: 90173 - RNA, 32 nt, Human
caggggugggccgacaggauggggacccaggc

SEQ ID NO: 90174 - RNA, 19 nt, Human
cagggguggggacccagag

SEQ ID NO: 90175 - RNA, 32 nt, Human
cagggguggggcugagacugggcugacaucua

SEQ ID NO: 90176 - RNA, 32 nt, Human
cagggguggggcugggcugacucuggccggau

SEQ ID NO: 90177 - RNA, 32 nt, Human
cagggguggggugggaagccagcuggggaaau

SEQ ID NO: 90178 - RNA, 32 nt, Human
cagggguggguggagccugacccuggagggca

SEQ ID NO: 90179 - RNA, 31 nt, Human
cagggguggguggguggagggcacggaaggg

SEQ ID NO: 90180 - RNA, 32 nt, Human
cagggguguaauucagaaggaggcagacuggg

SEQ ID NO: 90181 - RNA, 21 nt, Human
caggggugugggcggaggcgg

SEQ ID NO: 90182 - RNA, 32 nt, Human
caggggugugggcuuggagggugaagaggaug

SEQ ID NO: 90183 - RNA, 32 nt, Human
cagggguguugagcgaugaugcucugauaugg

SEQ ID NO: 90184 - RNA, 18 nt, Human
cagggguucaucucccua

SEQ ID NO: 90185 - RNA, 21 nt, Human
cagggguucuagaccagcuua

SEQ ID NO: 90186 - RNA, 32 nt, Human
cagggguucucagcuguacccucugccgaugg

SEQ ID NO: 90187 - RNA, 32 nt, Human
cagggguuggauuggagggagagaacagaguu

SEQ ID NO: 90188 - RNA, 23 nt, Human
cagggguuggggacagggccagg

SEQ ID NO: 90189 - RNA, 32 nt, Human
cagggguuggguggggguugcaggacuccacu

SEQ ID NO: 90190 - RNA, 32 nt, Human
cagggguuuacccaaagaaaggguauuuuuga

SEQ ID NO: 90191 - RNA, 32 nt, Human
cagggguuucuagccccagaucuagccggguu

SEQ ID NO: 90192 - RNA, 32 nt, Human
cagggguuucugccuuugcuucucuugucauu

SEQ ID NO: 90193 - RNA, 32 nt, Human
cagggguuugcuuacagugaugccaugaagac

SEQ ID NO: 90194 - RNA, 32 nt, Human
cagggguuuucgccaugaaccuugccaugggu

SEQ ID NO: 90195 - RNA, 32 nt, Human
caggguaaggaagagagagugggaggcagagu

SEQ ID NO: 90196 - RNA, 32 nt, Human
caggguacagccucguucucaccaucugcuuc

SEQ ID NO: 90197 - RNA, 17 nt, Human
caggguaccaugugaug

SEQ ID NO: 90198 - RNA, 20 nt, Human
caggguacccacagaucugc

SEQ ID NO: 90199 - RNA, 32 nt, Human
caggguacccgccugagcuccugcugcggagg

SEQ ID NO: 90200 - RNA, 19 nt, Human
caggguacgcucauggaga

SEQ ID NO: 90201 - RNA, 32 nt, Human
caggguacuaggauuacuaguacucugaugga

SEQ ID NO: 90202 - RNA, 32 nt, Human
caggguagaagaggcugagggacacacagagg

SEQ ID NO: 90203 - RNA, 32 nt, Human
caggguagagaugccuacagggugguugcuug

SEQ ID NO: 90204 - RNA, 32 nt, Human
caggguagagggcuggccccuccucucaucuu

SEQ ID NO: 90205 - RNA, 32 nt, Human
caggguagauaaccuguacuucaaguuaaagu

SEQ ID NO: 90206 - RNA, 32 nt, Human
caggguagcugugugcagucacugcagcuugc

SEQ ID NO: 90207 - RNA, 32 nt, Human
caggguagguucucgggacugaaggaaggcca

SEQ ID NO: 90208 - RNA, 31 nt, Human
caggguaguagaccugucagauuggagguca

SEQ ID NO: 90209 - RNA, 21 nt, Human
caggguagugaggcaaggguu

SEQ ID NO: 90210 - RNA, 24 nt, Human
caggguauaacacaggcccuggug

SEQ ID NO: 90211 - RNA, 32 nt, Human
caggguaucacuggacaggccauggcuccacg

SEQ ID NO: 90212 - RNA, 32 nt, Human
caggguauuaaauuaugaaucagcugaaccug

SEQ ID NO: 90213 - RNA, 32 nt, Human
caggguauuaggaaggacaggaaaaguaggag

SEQ ID NO: 90214 - RNA, 32 nt, Human
cagggucaacagcaacucgaaggccaagcccg

SEQ ID NO: 90215 - RNA, 32 nt, Human
cagggucagcaguucaagaccagccuggccag

SEQ ID NO: 90216 - RNA, 20 nt, Human
cagggucagccuuccagcuc

SEQ ID NO: 90217 - RNA, 32 nt, Human
cagggucaggcucuuaccuccaccuccagggc

SEQ ID NO: 90218 - RNA, 32 nt, Human
cagggucagggaggaggaacgguggggguggg

SEQ ID NO: 90219 - RNA, 32 nt, Human
cagggucagggugagagagagcugggccaggg

SEQ ID NO: 90220 - RNA, 32 nt, Human
cagggucagucagcuaauguuacuguugauuc

SEQ ID NO: 90221 - RNA, 32 nt, Human
cagggucagugucacagccacaacuucagaaa

SEQ ID NO: 90222 - RNA, 32 nt, Human
cagggucaucacccucuagcaucagugccugc

SEQ ID NO: 90223 - RNA, 32 nt, Human
cagggucaucugcacuugaugacugcuccccg

SEQ ID NO: 90224 - RNA, 32 nt, Human
caggguccaaccacucuccagcagggagaccu

SEQ ID NO: 90225 - RNA, 32 nt, Human
caggguccaagaggaauggguguucuguggcc

SEQ ID NO: 90226 - RNA, 32 nt, Human
caggguccagcagcaaccuguaucagaagaac

SEQ ID NO: 90227 - RNA, 32 nt, Human
caggguccagugucauuugaggauguggcugu

SEQ ID NO: 90228 - RNA, 32 nt, Human
cagggucccaccguccucgccagccugcgucc

SEQ ID NO: 90229 - RNA, 32 nt, Human
cagggucccagccaggagagugcagcugagca

SEQ ID NO: 90230 - RNA, 32 nt, Human
cagggucccagccuggccaccagccucccuuu

SEQ ID NO: 90231 - RNA, 21 nt, Human
cagggucccagucacugggca

SEQ ID NO: 90232 - RNA, 32 nt, Human
cagggucccagugcccucuggacacuaugcca

SEQ ID NO: 90233 - RNA, 32 nt, Human
cagggucccuccuuccugucaugcucccucca

SEQ ID NO: 90234 - RNA, 25 nt, Human
cagggucccucugaguggggccagg

SEQ ID NO: 90235 - RNA, 32 nt, Human
cagggucccuuucugucugucuccuugcucug

SEQ ID NO: 90236 - RNA, 32 nt, Human
caggguccgccauggagccagagcagaugcug

SEQ ID NO: 90237 - RNA, 32 nt, Human
caggguccuagugggaaggacaaggaccuggu

SEQ ID NO: 90238 - RNA, 32 nt, Human
caggguccuccacccucccccugaccacauac

SEQ ID NO: 90239 - RNA, 32 nt, Human
caggguccuccuggauucuugcagcuuccggu

SEQ ID NO: 90240 - RNA, 32 nt, Human
caggguccucuucugccccgagcauccgacuc

SEQ ID NO: 90241 - RNA, 32 nt, Human
caggguccugcagcuuguccuuucuggcugga

SEQ ID NO: 90242 - RNA, 32 nt, Human
caggguccuuccuaaugcaggcugcuuucucu

SEQ ID NO: 90243 - RNA, 31 nt, Human
caggguccuuucaaggagguugaaugagaca

SEQ ID NO: 90244 - RNA, 32 nt, Human
cagugguuacccacgaggcaguacuuauuauc

SEQ ID NO: 90245 - RNA, 32 nt, Human
cagugguuacccacgaggcaguacuuuuuauc

SEQ ID NO: 90246 - RNA, 32 nt, Human
cagugguuacccacgaggcaguagugaguauc

SEQ ID NO: 90247 - RNA, 32 nt, Human
cagugguuagguugcauuucuaccccauccag

SEQ ID NO: 90248 - RNA, 21 nt, Human
cagugguucacaccuguaauc

SEQ ID NO: 90249 - RNA, 24 nt, Human
cagugguucacaccuguaauccca

SEQ ID NO: 90250 - RNA, 21 nt, Human
cagugguucacgccuguaauc

SEQ ID NO: 90251 - RNA, 22 nt, Human
cagugguucacgccuguaaucc

SEQ ID NO: 90252 - RNA, 24 nt, Human
cagugguucauaccuauaguccca

SEQ ID NO: 90253 - RNA, 24 nt, Human
cagugguucaugccaguaauccca

SEQ ID NO: 90254 - RNA, 24 nt, Human
cagugguucaugccuauaaucuca

SEQ ID NO: 90255 - RNA, 21 nt, Human
cagugguucaugccuguaauc

SEQ ID NO: 90256 - RNA, 22 nt, Human
cagugguucaugccuguaaucc

SEQ ID NO: 90257 - RNA, 24 nt, Human
cagugguucaugccuguaauccca

SEQ ID NO: 90258 - RNA, 23 nt, Human
cagugguucaugcuguaauccca

SEQ ID NO: 90259 - RNA, 24 nt, Human
cagugguucaugucuguaauccca

SEQ ID NO: 90260 - RNA, 32 nt, Human
cagugguuccccucaccuucugcagaagucuc

SEQ ID NO: 90261 - RNA, 32 nt, Human
cagugguuccucccucuccugaauccuuuucu

SEQ ID NO: 90262 - RNA, 32 nt, Human
cagugguucucccaaauaggagaccuggggcc

SEQ ID NO: 90263 - RNA, 32 nt, Human
cagugguuggaagaacagaaccccuaggaacc

SEQ ID NO: 90264 - RNA, 32 nt, Human
cagugguugucucacuucaucucuuauagauu

SEQ ID NO: 90265 - RNA, 21 nt, Human
cagugguuuauagcuguaauc

SEQ ID NO: 90266 - RNA, 24 nt, Human
cagugguuuauagcuguaauccca

SEQ ID NO: 90267 - RNA, 21 nt, Human
cagugguuuaugccuguaauc

SEQ ID NO: 90268 - RNA, 24 nt, Human
cagugguuuaugccuguaauccca

SEQ ID NO: 90269 - RNA, 32 nt, Human
caguguacaaaaccaguuuucugcaacauuca

SEQ ID NO: 90270 - RNA, 32 nt, Human
caguguacacgugcuuuuauuauauccauuuu

SEQ ID NO: 90271 - RNA, 32 nt, Human
caguguacgagcaacugucagcauuuuucugc

SEQ ID NO: 90272 - RNA, 32 nt, Human
caguguacguucucaccucuuaugcuuaguug

SEQ ID NO: 90273 - RNA, 32 nt, Human
caguguacucacuggucuccaucuuuaauaug

SEQ ID NO: 90274 - RNA, 32 nt, Human
caguguacuccuacuccagugcacccaggguu

SEQ ID NO: 90275 - RNA, 32 nt, Human
caguguacugaggguacuggccuagccaugug

SEQ ID NO: 90276 - RNA, 32 nt, Human
caguguagacaccucugucugccccacugucc

SEQ ID NO: 90277 - RNA, 32 nt, Human
caguguagaguggccagcagugaacagguuga

SEQ ID NO: 90278 - RNA, 32 nt, Human
caguguagcaauaaaaaucacaugucaguuca

SEQ ID NO: 90279 - RNA, 32 nt, Human
caguguagcuguuuuugguuucugagcuuaaa

SEQ ID NO: 90280 - RNA, 32 nt, Human
caguguaggaagcacagccagauccuauagga

SEQ ID NO: 90281 - RNA, 22 nt, Human
caguguaggcaacagagugaga

SEQ ID NO: 90282 - RNA, 32 nt, Human
caguguaguuccuggacacacagggaaauucu

SEQ ID NO: 90283 - RNA, 32 nt, Human
caguguauccaggguguuccaggugagcuggg

SEQ ID NO: 90284 - RNA, 32 nt, Human
caguguaugcaguaauuagaacaaagaagaaa

SEQ ID NO: 90285 - RNA, 32 nt, Human
caguguauguucuccugcucccuggacaaauc

SEQ ID NO: 90286 - RNA, 32 nt, Human
cagugucaacugccaugugcucugcuucaagg

SEQ ID NO: 90287 - RNA, 24 nt, Human
cagugucacaugccuguaaaccca

SEQ ID NO: 90288 - RNA, 32 nt, Human
cagugucacccagggugagugcaaaauaaaga

SEQ ID NO: 90289 - RNA, 32 nt, Human
cagugucaccucaguggaccagccugggggaa

SEQ ID NO: 90290 - RNA, 32 nt, Human
cagugucagcaacgcccuguccucagugccag

SEQ ID NO: 90291 - RNA, 32 nt, Human
cagugucagcaugacucucccacuuggaaaga

SEQ ID NO: 90292 - RNA, 32 nt, Human
cagugucaggccaccagcuuggacaggcagcu

SEQ ID NO: 90293 - RNA, 32 nt, Human
cagugucagguguggcugcugugggggcaggu

SEQ ID NO: 90294 - RNA, 32 nt, Human
cagugucaucacucagcuuacugggcugaggc

SEQ ID NO: 90295 - RNA, 32 nt, Human
cagugucauccagcccagaaaccaagaaggau

SEQ ID NO: 90296 - RNA, 32 nt, Human
cagugucaugcugucuuggggcagggugaaag

SEQ ID NO: 90297 - RNA, 32 nt, Human
caguguccaaaggcccccagaaugacacuuuu

SEQ ID NO: 90298 - RNA, 32 nt, Human
caguguccaccaacugaccaugaaauagagua

SEQ ID NO: 90299 - RNA, 27 nt, Human
caguguccacuugccagaauuucagcu

SEQ ID NO: 90300 - RNA, 32 nt, Human
caguguccagaagaagaccaaggacagaacag

SEQ ID NO: 90301 - RNA, 32 nt, Human
caguguccagccugguaucuggcaucccagua

SEQ ID NO: 90302 - RNA, 16 nt, Human
caguguccaggagaug

SEQ ID NO: 90303 - RNA, 32 nt, Human
caguguccagggaagcagaggcagcagcacag

SEQ ID NO: 90304 - RNA, 32 nt, Human
caguguccaguauaaugcagaauugcagagug

SEQ ID NO: 90305 - RNA, 32 nt, Human
cagugucccauucuaggauugucugaaggcca

SEQ ID NO: 90306 - RNA, 32 nt, Human
caguguccccuccaaacuucacacuucccugc

SEQ ID NO: 90307 - RNA, 32 nt, Human
caguguccccuccccuccaucucucuucccca

SEQ ID NO: 90308 - RNA, 32 nt, Human
cagugucccugccuggccaccaaagugccaac

SEQ ID NO: 90309 - RNA, 32 nt, Human
caguguccuaaguuccuuaacaaugcuuacca

SEQ ID NO: 90310 - RNA, 32 nt, Human
caguguccuagugcccaucgucuguuuccccg

SEQ ID NO: 90311 - RNA, 32 nt, Human
caguguccuccuccuucuccggccagacccag

SEQ ID NO: 90312 - RNA, 32 nt, Human
caguguccugagaagguggagcuagaguaugg

SEQ ID NO: 90313 - RNA, 32 nt, Human
caguguccuggaccccgcaggccuccgcucuc

SEQ ID NO: 90314 - RNA, 32 nt, Human
caguguccugugccagccuucaugcccagccc

SEQ ID NO: 90315 - RNA, 32 nt, Human
caguguccuuccuuucccagcagcagugcccu

SEQ ID NO: 90316 - RNA, 19 nt, Human
cagugucgcgccuguaauc

SEQ ID NO: 90317 - RNA, 22 nt, Human
cagugucgcgccuguaauccca

SEQ ID NO: 90318 - RNA, 32 nt, Human
cagugucuaagugcuucucuuguguccuguag

SEQ ID NO: 90319 - RNA, 32 nt, Human
cagugucuaggggugaguuucugugauuccca

SEQ ID NO: 90320 - RNA, 32 nt, Human
cagugucucaaggaaagguggaccuaggaacu

SEQ ID NO: 90321 - RNA, 21 nt, Human
cagugucucaugccucuaauc

SEQ ID NO: 90322 - RNA, 24 nt, Human
cagugucucaugccucuaauccca

SEQ ID NO: 90323 - RNA, 24 nt, Human
cagugucucaugccuguaauccca

SEQ ID NO: 90324 - RNA, 32 nt, Human
cagugucugcaggcguucagugcugcggagcc

SEQ ID NO: 90325 - RNA, 32 nt, Human
cagugucugcauucccaggagacccaggguga

SEQ ID NO: 90326 - RNA, 32 nt, Human
cagugucugcgucuaagagagcacuuuguugc

SEQ ID NO: 90327 - RNA, 32 nt, Human
cagugucugcuguauaucucucauuuuuccuc

SEQ ID NO: 90328 - RNA, 32 nt, Human
cagugucuggaucccagcaucuucuccacuuc

SEQ ID NO: 90329 - RNA, 32 nt, Human
cagugucugggagcaucuggcuuccucucccu

SEQ ID NO: 90330 - RNA, 32 nt, Human
cagugucuggguuuuucuugugguguaaagcu

SEQ ID NO: 90331 - RNA, 32 nt, Human
cagugucuguggggagcccaggaagcugcuca

SEQ ID NO: 90332 - RNA, 32 nt, Human
cagugucuguucucuggacauuucuuuucacc

SEQ ID NO: 90333 - RNA, 32 nt, Human
cagugucuuaccagccucucgcaccaugugau

SEQ ID NO: 90334 - RNA, 32 nt, Human
cagugucuucuaugaugagauggaugcccugu

SEQ ID NO: 90335 - RNA, 32 nt, Human
cagugucuugguguucacaaggccccagcaca

SEQ ID NO: 90336 - RNA, 32 nt, Human
cagugucuuucaaaugacuuucaucaaaugac

SEQ ID NO: 90337 - RNA, 24 nt, Human
cagugucuuucaccuguaauccca

SEQ ID NO: 90338 - RNA, 32 nt, Human
cagugugaacaacguggccaagcuucgacaau

SEQ ID NO: 90339 - RNA, 32 nt, Human
cagugugaacaagagaaaaacaggaauagaag

SEQ ID NO: 90340 - RNA, 17 nt, Human
cagugugacaugaggug

SEQ ID NO: 90341 - RNA, 32 nt, Human
cagugugaccucacccucuccagucaccccuc

SEQ ID NO: 90342 - RNA, 32 nt, Human
cagugugagccacucccuucuggcagaggccg

SEQ ID NO: 90343 - RNA, 32 nt, Human
cagugugaugcaggugacuacucugaaaguau

SEQ ID NO: 90344 - RNA, 32 nt, Human
cagugugauggaaacauucuccuuggcuuuac

SEQ ID NO: 90345 - RNA, 32 nt, Human
cagugugcaauggcugcacacagcagcuuccu

SEQ ID NO: 90346 - RNA, 32 nt, Human
cagugugcauucucuccagcugcaaacuuucu

SEQ ID NO: 90347 - RNA, 32 nt, Human
cagugugccaagaccucuccagcuucucauuc

SEQ ID NO: 90348 - RNA, 32 nt, Human
cagugugcccacuucuaagcagucuuugcuga

SEQ ID NO: 90349 - RNA, 32 nt, Human
cagugugcccaggauugaagguguaaauggga

SEQ ID NO: 90350 - RNA, 20 nt, Human
cagugugccccgugguguca

SEQ ID NO: 90351 - RNA, 32 nt, Human
cagugugccgggaaaagggaacgugguacuca

SEQ ID NO: 90352 - RNA, 32 nt, Human
cagugugccugggacagggcuuaccaccugcc

SEQ ID NO: 90353 - RNA, 32 nt, Human
cagugugcggacagaggagaccacucugcucc

SEQ ID NO: 90354 - RNA, 32 nt, Human
cagugugcuaucuccccacgacuaggucacua

SEQ ID NO: 90355 - RNA, 32 nt, Human
cagugugcugccuacaccuccaccuccuuccc

SEQ ID NO: 90356 - RNA, 23 nt, Human
cagugugcugggauuacaggcau

SEQ ID NO: 90357 - RNA, 23 nt, Human
cagugugcugggcuagccuguga

SEQ ID NO: 90358 - RNA, 32 nt, Human
cagugugcuguugcccuacacugccuuagaaa

SEQ ID NO: 90359 - RNA, 32 nt, Human
caguguggaagaacguguagaccccagaauga

SEQ ID NO: 90360 - RNA, 32 nt, Human
caguguggacggcgggagucuccucgcucccc

SEQ ID NO: 90361 - RNA, 31 nt, Human
caguguggcacaaucucagcucacugcaacc

SEQ ID NO: 90362 - RNA, 32 nt, Human
caguguggcacccacccaagguuuccaugcag

SEQ ID NO: 90363 - RNA, 32 nt, Human
caguguggccaacauggugaaaccccgucucu

SEQ ID NO: 90364 - RNA, 32 nt, Human
caguguggccaccacaccgcccugagcccucc

SEQ ID NO: 90365 - RNA, 32 nt, Human
caguguggccaugccagcuaguuggaccucac

SEQ ID NO: 90366 - RNA, 23 nt, Human
caguguggcccuggacgggacau

SEQ ID NO: 90367 - RNA, 32 nt, Human
caguguggccugccagacugagcccaggggug

SEQ ID NO: 90368 - RNA, 32 nt, Human
caguguggcugcaggcgguggugcagccuucc

SEQ ID NO: 90369 - RNA, 32 nt, Human
caguguggcuugggccuggugcugggaaccug

SEQ ID NO: 90370 - RNA, 32 nt, Human
cagugugggaccccugcugccaccucuccugg

SEQ ID NO: 90371 - RNA, 32 nt, Human
cagugugggccugaagcaggauuucccaaucu

SEQ ID NO: 90372 - RNA, 32 nt, Human
cagugugggccugggcucucuugggcuuuauc

SEQ ID NO: 90373 - RNA, 32 nt, Human
caguguggggaaaaggaagagagaucagauug

SEQ ID NO: 90374 - RNA, 32 nt, Human
cagugugggugcaggcgcaggugcaggcacag

SEQ ID NO: 90375 - RNA, 32 nt, Human
caguguggucucaaacuccugaccucaugauu

SEQ ID NO: 90376 - RNA, 32 nt, Human
cagugugguggaaucaguuuaaucagaaaaag

SEQ ID NO: 90377 - RNA, 32 nt, Human
cagugugguggcccugugucuccucaccucug

SEQ ID NO: 90378 - RNA, 18 nt, Human
cagugugguuacacagug

SEQ ID NO: 90379 - RNA, 32 nt, Human
cagugugguucacgccggggagcccagguuua

SEQ ID NO: 90380 - RNA, 19 nt, Human
cagugugguuugggaaaga

SEQ ID NO: 90381 - RNA, 20 nt, Human
caguguguaaagguguucaa

SEQ ID NO: 90382 - RNA, 32 nt, Human
caguguguaagaacaucuuuuugucuagguuu

SEQ ID NO: 90383 - RNA, 32 nt, Human
caguguguagcaaaguugaucucuccauguca

SEQ ID NO: 90384 - RNA, 32 nt, Human
caguguguaguuuguuucuguuguucacuugg

SEQ ID NO: 90385 - RNA, 32 nt, Human
caguguguccaccucagucacccuccagugug

SEQ ID NO: 90386 - RNA, 32 nt, Human
cagugugucccaaugacuuuccuuuacccucc

SEQ ID NO: 90387 - RNA, 16 nt, Human
caguguguccuccaca

SEQ ID NO: 90388 - RNA, 32 nt, Human
cagugugugagaggaggaggagagggagaauu

SEQ ID NO: 90389 - RNA, 32 nt, Human
cagugugugugagagaaagguagacagaaaag

SEQ ID NO: 90390 - RNA, 32 nt, Human
cagugugugugccgaagaaggcucccuggggc

SEQ ID NO: 90391 - RNA, 32 nt, Human
caguguguuucccuccugaucauaaagaugaa

SEQ ID NO: 90392 - RNA, 32 nt, Human
caguguguuugagcuggagugcugcgggcagc

SEQ ID NO: 90393 - RNA, 32 nt, Human
caguguuaacacagcagugauugucagcugcc

SEQ ID NO: 90394 - RNA, 32 nt, Human
caguguuacauuuggagagaagugugaaaucu

SEQ ID NO: 90395 - RNA, 32 nt, Human
caguguuaccccucaucaaccagcccagcagc

SEQ ID NO: 90396 - RNA, 32 nt, Human
caguguucaaaaccccagccaaugaccagcag

SEQ ID NO: 90397 - RNA, 32 nt, Human
caguguucaagaggauuaugggggaaagagau

SEQ ID NO: 90398 - RNA, 32 nt, Human
caguguuccccuuuagagagggugugugcugu

SEQ ID NO: 90399 - RNA, 23 nt, Human
caguguuccuagugugggccagg

SEQ ID NO: 90400 - RNA, 26 nt, Human
caguguuccuuauugacaguguucaa

SEQ ID NO: 90401 - RNA, 32 nt, Human
caguguucuacccaaaugcaaacgccucuccc

SEQ ID NO: 90402 - RNA, 32 nt, Human
caguguucucacccucuaggcccugugccugg

SEQ ID NO: 90403 - RNA, 32 nt, Human
caguguucuccucuggggccugauccaccucu

SEQ ID NO: 90404 - RNA, 18 nt, Human
caguguugccuccuccca

SEQ ID NO: 90405 - RNA, 32 nt, Human
caguguugcuaccagcaagaaugaagguugug

SEQ ID NO: 90406 - RNA, 32 nt, Human
caguguugcugcaaagugugugaccccagggu

SEQ ID NO: 90407 - RNA, 32 nt, Human
caguguuggaaccugcuuagaaccagguguga

SEQ ID NO: 90408 - RNA, 32 nt, Human
caguguuggagaugccauuuucaccuuuuuaa

SEQ ID NO: 90409 - RNA, 32 nt, Human
caguguuggugcuaaugaggccagggugcagg

SEQ ID NO: 90410 - RNA, 32 nt, Human
caguguuguaguuucugauacuuuaugucuuu

SEQ ID NO: 90411 - RNA, 32 nt, Human
caguguugugaguuggaagcuggggagcucgg

SEQ ID NO: 90412 - RNA, 32 nt, Human
caguguuguguccuccacucaggcuggggcuc

SEQ ID NO: 90413 - RNA, 32 nt, Human
caguguuuacuguaguguaucuuguacagaua

SEQ ID NO: 90414 - RNA, 32 nt, Human
caguguuuaugaaauugggaggaaggagaccc

SEQ ID NO: 90415 - RNA, 18 nt, Human
caguguuuccacggcugg

SEQ ID NO: 90416 - RNA, 32 nt, Human
caguguuucccuccccacuacuccuucuccuu

SEQ ID NO: 90417 - RNA, 32 nt, Human
caguguuucccugagucuuggcccaggagcug

SEQ ID NO: 90418 - RNA, 32 nt, Human
caguguuuccgucugcucaccugccacagagc

SEQ ID NO: 90419 - RNA, 32 nt, Human
caguguuugccucugugcuuccacuguggcuc

SEQ ID NO: 90420 - RNA, 32 nt, Human
caguguuugcugcccuugcugggggcggguag

SEQ ID NO: 90421 - RNA, 32 nt, Human
caguguuugcuucaggacuccaccuccucuac

SEQ ID NO: 90422 - RNA, 18 nt, Human
caguguuugucuuccaca

SEQ ID NO: 90423 - RNA, 32 nt, Human
caguguuugugucccuggguaguugagauuag

SEQ ID NO: 90424 - RNA, 21 nt, Human
caguguuuuaacuguguucaa

SEQ ID NO: 90425 - RNA, 32 nt, Human
caguguuuuagagauggcuuucccagugugug

SEQ ID NO: 90426 - RNA, 32 nt, Human
caguguuuuauaggagagauugggagaaauca

SEQ ID NO: 90427 - RNA, 22 nt, Human
caguguuuucuuuuuccagccc

SEQ ID NO: 90428 - RNA, 32 nt, Human
caguguuuugacuaugugaaccauauccaacu

SEQ ID NO: 90429 - RNA, 32 nt, Human
caguguuuuucagcagacggcugaugggacag

SEQ ID NO: 90430 - RNA, 24 nt, Human
caguguuuuucauauauguguuca

SEQ ID NO: 90431 - RNA, 32 nt, Human
caguuaaacaagcuuaggcuucucccaacuua

SEQ ID NO: 90432 - RNA, 32 nt, Human
caguuaacacaguuacaaagcuguaauggugu

SEQ ID NO: 90433 - RNA, 32 nt, Human
caguuaacucuaauucuuggcuguagcaucuu

SEQ ID NO: 90434 - RNA, 31 nt, Human
caguuaagaaugucucugccaagucgacaaa

SEQ ID NO: 90435 - RNA, 32 nt, Human
caguuaagagcagaugcaugcauuuugauaag

SEQ ID NO: 90436 - RNA, 32 nt, Human
caguuaagcagccgccacauccccgcuggcug

SEQ ID NO: 90437 - RNA, 21 nt, Human
caguuaagcugccugcagcag

SEQ ID NO: 90438 - RNA, 32 nt, Human
caguuaaggaugacacuucauucuguccccug

SEQ ID NO: 90439 - RNA, 32 nt, Human
caguuaaggccccauccaucugagcucugaau

SEQ ID NO: 90440 - RNA, 32 nt, Human
caguuaaggccucauccaucugagcucugaau

SEQ ID NO: 90441 - RNA, 32 nt, Human
caguuaaguguguuuagaagugaucagcuuga

SEQ ID NO: 90442 - RNA, 32 nt, Human
caguuaaguugggguuucuguuauuugcaacc

SEQ ID NO: 90443 - RNA, 32 nt, Human
caguuaauaacaguguaccacuauuggcucau

SEQ ID NO: 90444 - RNA, 32 nt, Human
caguuaaucucugaaaugcacaaaaccuagcu

SEQ ID NO: 90445 - RNA, 32 nt, Human
caguuaaugggguagaggagggcaugggaggg

SEQ ID NO: 90446 - RNA, 32 nt, Human
caguuaauuugcuagaguggcucacagaacuc

SEQ ID NO: 90447 - RNA, 32 nt, Human
caguuacaaccuagagagauuuugagccucau

SEQ ID NO: 90448 - RNA, 32 nt, Human
caguuacaagggcagagaagguaccagugcag

SEQ ID NO: 90449 - RNA, 32 nt, Human
caguuacaauuucgcugaaggcugaggcagga

SEQ ID NO: 90450 - RNA, 32 nt, Human
caguuacacauucgccuuuucuaggauugcau

SEQ ID NO: 90451 - RNA, 32 nt, Human
caguuacagaagcaggauuucuaggauuucua

SEQ ID NO: 90452 - RNA, 32 nt, Human
caguuacagagcagcgucuucuguguuuccuu

SEQ ID NO: 90453 - RNA, 32 nt, Human
caguuacaguguccuaagauacugcuaucauu

SEQ ID NO: 90454 - RNA, 32 nt, Human
caguuacauggcagaagagggagggagggagg

SEQ ID NO: 90455 - RNA, 32 nt, Human
caguuacccaacaaggacuguuucaaccucau

SEQ ID NO: 90456 - RNA, 32 nt, Human
caguuacccccaguaaccaacuccaggggcug

SEQ ID NO: 90457 - RNA, 32 nt, Human
caguuacccuugcagggggccagggagucaag

SEQ ID NO: 90458 - RNA, 32 nt, Human
caguuaccuaaccuauuucacaugggcguuuu

SEQ ID NO: 90459 - RNA, 32 nt, Human
caguuacucaguagcugaggcaggagaaucgc

SEQ ID NO: 90460 - RNA, 20 nt, Human
caguuacucaugucauugua

SEQ ID NO: 90461 - RNA, 31 nt, Human
caguuacucuuccggaagguuggagaagauu

SEQ ID NO: 90462 - RNA, 21 nt, Human
caguuacuggaggccgaaugg

SEQ ID NO: 90463 - RNA, 32 nt, Human
caguuacuggcaagagggagaaaggacgcugc

SEQ ID NO: 90464 - RNA, 32 nt, Human
caguuacuggcagaggaagaggaugaugauuu

SEQ ID NO: 90465 - RNA, 32 nt, Human
caguuacuuaccugcauguguuguacaauacc

SEQ ID NO: 90466 - RNA, 32 nt, Human
caguuacuugggaggcugagacaggauugcuu

SEQ ID NO: 90467 - RNA, 32 nt, Human
caguuagaaagaaaugcauucuagaaauaaca

SEQ ID NO: 90468 - RNA, 32 nt, Human
caguuagaggagaaaaaggaauggagcagagc

SEQ ID NO: 90469 - RNA, 32 nt, Human
caguuagccacugcaggcccucggugggacag

SEQ ID NO: 90470 - RNA, 32 nt, Human
caguuagccagcccacuccaacucucggaacc

SEQ ID NO: 90471 - RNA, 32 nt, Human
caguuagccaguuaguccccaggccuguggca

SEQ ID NO: 90472 - RNA, 32 nt, Human
caguuagcccggccaaggacacugaugggucc

SEQ ID NO: 90473 - RNA, 32 nt, Human
caguuagcuuuugcuguguaacaaaccauccc

SEQ ID NO: 90474 - RNA, 32 nt, Human
caguuaggcaguccugauguaucuguacauag

SEQ ID NO: 90475 - RNA, 32 nt, Human
caguuagucccuucucucuuccuugcuuucuc

SEQ ID NO: 90476 - RNA, 32 nt, Human
caguuaguuugauuacccugugcaaaaccuug

SEQ ID NO: 90477 - RNA, 32 nt, Human
caguuauaaagugaaucucagauagaaauuaa

SEQ ID NO: 90478 - RNA, 32 nt, Human
caguuauaagaaaggucagcauuggaaauuuc

SEQ ID NO: 90479 - RNA, 32 nt, Human
caguuauacacagaaacaaacacacacgcacg

SEQ ID NO: 90480 - RNA, 32 nt, Human
caguuaucaaaauugacuccagaagagagaaa

SEQ ID NO: 90481 - RNA, 32 nt, Human
caguuaucaaaauugacuccagaagagagaac

SEQ ID NO: 90482 - RNA, 32 nt, Human
caguuaucacagacuucacuggccuuaaugag

SEQ ID NO: 90483 - RNA, 32 nt, Human
caguuaucagggaaagagguugaugugaacuc

SEQ ID NO: 90484 - RNA, 32 nt, Human
caguuaucagguaaccaacaagaaaugcaagc

SEQ ID NO: 90485 - RNA, 32 nt, Human
caguuaugaaaugccaagaaauucuuuggcuu

SEQ ID NO: 90486 - RNA, 32 nt, Human
caguuaugaaguuuccccacaugugaagacag

SEQ ID NO: 90487 - RNA, 32 nt, Human
caguuaugauggugugggaugggagugcauag

SEQ ID NO: 90488 - RNA, 32 nt, Human
caguuaugcccaguucuucccgcuguggggac

SEQ ID NO: 90489 - RNA, 16 nt, Human
caguuauggagugcua

SEQ ID NO: 90490 - RNA, 32 nt, Human
caguuaugucccauuuuuaugaugccaaaagc

SEQ ID NO: 90491 - RNA, 32 nt, Human
caguuauuauauuuacaaaugggaaacaaaag

SEQ ID NO: 90492 - RNA, 32 nt, Human
caguucaaacgguuuuguuaaauaugaaacag

SEQ ID NO: 90493 - RNA, 32 nt, Human
caguucacaaaugaugcagagacagaguuaau

SEQ ID NO: 90494 - RNA, 32 nt, Human
caguucacagaauuaucugacuggcgaaguaa

SEQ ID NO: 90495 - RNA, 32 nt, Human
caguucacagagaauuuggggcucucuucaug

SEQ ID NO: 90496 - RNA, 32 nt, Human
caguucacaguuagacccacccccucugaaua

SEQ ID NO: 90497 - RNA, 32 nt, Human
caguucacccaauggacaaacucuuuuugauu

SEQ ID NO: 90498 - RNA, 32 nt, Human
caguucaccccucaccuccagccuggaggaga

SEQ ID NO: 90499 - RNA, 32 nt, Human
caguucacugcaaccuccacccugcagguuca

SEQ ID NO: 90500 - RNA, 32 nt, Human
caguucacugcaaccuccaccucccagguuca

SEQ ID NO: 90501 - RNA, 32 nt, Human
caguucacugcaaccuccacuuccuagguuca

SEQ ID NO: 90502 - RNA, 32 nt, Human
caguucacugcaaccucugccucccacguuca

SEQ ID NO: 90503 - RNA, 32 nt, Human
caguucacugcaaccucugccucccggguuca

SEQ ID NO: 90504 - RNA, 32 nt, Human
caguucacugcaaccucugccuccuaaguuca

SEQ ID NO: 90505 - RNA, 32 nt, Human
caguucacugcaaccucugccuccuggguuca

SEQ ID NO: 90506 - RNA, 32 nt, Human
caguucacugcaacuucugccucccgaguuca

SEQ ID NO: 90507 - RNA, 32 nt, Human
caguucacugcagccucgaccucccaggcuca

SEQ ID NO: 90508 - RNA, 32 nt, Human
caguucacugcagucucugccuccuugguuca

SEQ ID NO: 90509 - RNA, 32 nt, Human
caguucacugcugcuuucccuccugggcucaa

SEQ ID NO: 90510 - RNA, 32 nt, Human
caguucagaauccauugacucucugacuuacc

SEQ ID NO: 90511 - RNA, 32 nt, Human
caguucagagcugcccucuccugggcauggcc

SEQ ID NO: 90512 - RNA, 32 nt, Human
caguucagccuggaugaugagagugagacucc

SEQ ID NO: 90513 - RNA, 32 nt, Human
caguucaggaugggccacagggcgucaagcag

SEQ ID NO: 90514 - RNA, 32 nt, Human
caguucaggccuguugcuuaacuggggucacc

SEQ ID NO: 90515 - RNA, 32 nt, Human
caguucaggguucuuggauuugcucaagucca

SEQ ID NO: 90516 - RNA, 32 nt, Human
caguucagucuuuucaaaaugagggagaaaca

SEQ ID NO: 90517 - RNA, 32 nt, Human
caguucauccucagacauuguggagagcucaa

SEQ ID NO: 90518 - RNA, 32 nt, Human
caguucaugcaaccuccgccuccuggguucaa

SEQ ID NO: 90519 - RNA, 32 nt, Human
caguucaugccugugguuuuguguuuguuguu

SEQ ID NO: 90520 - RNA, 32 nt, Human
caguucauguuguacgugauggagauuugucu

SEQ ID NO: 90521 - RNA, 32 nt, Human
caguucauucauccuucucuccuuuccgcuca

SEQ ID NO: 90522 - RNA, 32 nt, Human
caguucauucccccaucuugcugccaagguac

SEQ ID NO: 90523 - RNA, 32 nt, Human
caguuccaacacaacaugaaggcaacaacaag

SEQ ID NO: 90524 - RNA, 32 nt, Human
caguuccaacuugugauuccugauagaacaga

SEQ ID NO: 90525 - RNA, 32 nt, Human
caguuccaauaacuaaccaacagguuauuaga

SEQ ID NO: 90526 - RNA, 32 nt, Human
caguuccaccccucagcuugaggaccaaugac

SEQ ID NO: 90527 - RNA, 32 nt, Human
caguuccaccugcugguagggguagguuggcu

SEQ ID NO: 90528 - RNA, 32 nt, Human
caguuccagaccacccuccaugcuccaccccc

SEQ ID NO: 90529 - RNA, 20 nt, Human
caguuccagagaccuggggg

SEQ ID NO: 90530 - RNA, 32 nt, Human
caguuccagccaaaggcuccucacaggcgcug

SEQ ID NO: 90531 - RNA, 32 nt, Human
caguuccagccuccucccuggucucaccagcu

SEQ ID NO: 90532 - RNA, 32 nt, Human
caguuccaggauucuuuguggccucuuccaca

SEQ ID NO: 90533 - RNA, 32 nt, Human
caguuccaggccagccagaaacuccugugucc

SEQ ID NO: 90534 - RNA, 32 nt, Human
caguuccaucuaggagggugccucuaggcccc

SEQ ID NO: 90535 - RNA, 32 nt, Human
caguuccauggacagguucuguuuucacuuuu

SEQ ID NO: 90536 - RNA, 32 nt, Human
caguuccauugugucaccacuaccucagcucc

SEQ ID NO: 90537 - RNA, 32 nt, Human
caguucccaaguguccaacaagaaggccuggu

SEQ ID NO: 90538 - RNA, 32 nt, Human
caguucccaggcugcaguugagggucuguccu

SEQ ID NO: 90539 - RNA, 32 nt, Human
caguucccagggacuguuuucaccucugcugu

SEQ ID NO: 90540 - RNA, 32 nt, Human
caguucccauuuuacagaugaaaacaagagga

SEQ ID NO: 90541 - RNA, 32 nt, Human
caguuccccaaagccuccuagagccucuggua

SEQ ID NO: 90542 - RNA, 32 nt, Human
caguucccccuccaagaagcaaguaccgaaac

SEQ ID NO: 90543 - RNA, 32 nt, Human
caguuccccugccucuugccccggcuaguuuc

SEQ ID NO: 90544 - RNA, 32 nt, Human
caguucccucauugcucuuuggacuaggcuga

SEQ ID NO: 90545 - RNA, 32 nt, Human
caguucccucgaggccaguguucagcaggauc

SEQ ID NO: 90546 - RNA, 22 nt, Human
caguucccugcacccagcaccu

SEQ ID NO: 90547 - RNA, 32 nt, Human
caguucccugcagccaaucaggcugaaaaugc

SEQ ID NO: 90548 - RNA, 32 nt, Human
caguucccugcugcaaccagcucuccgugaau

SEQ ID NO: 90549 - RNA, 18 nt, Human
caguucccuggggucccu

SEQ ID NO: 90550 - RNA, 32 nt, Human
caguucccuucccugcuguucuauuuccuuug

SEQ ID NO: 90551 - RNA, 32 nt, Human
caguucccuucucaggggcacacacauccaag

SEQ ID NO: 90552 - RNA, 32 nt, Human
caguucccuugacuucccuuuugagagcacac

SEQ ID NO: 90553 - RNA, 32 nt, Human
caguucccuugaucuuuucuucuugggggcug

SEQ ID NO: 90554 - RNA, 32 nt, Human
caguuccgaugccccuuccuggacaccguccc

SEQ ID NO: 90555 - RNA, 32 nt, Human
caguuccuacagcccuaggacccaagccaccc

SEQ ID NO: 90556 - RNA, 32 nt, Human
caguuccucaccccucucccugcuuucuuugu

SEQ ID NO: 90557 - RNA, 22 nt, Human
caguuccuccugacaccaggcu

SEQ ID NO: 90558 - RNA, 32 nt, Human
caguuccucgccucggugccaucagggaggag

SEQ ID NO: 90559 - RNA, 32 nt, Human
caguuccucuacugauucccuccaggcauaaa

SEQ ID NO: 90560 - RNA, 32 nt, Human
caguuccugcagccuggugcucugcccugcac

SEQ ID NO: 90561 - RNA, 32 nt, Human
caguuccugccuguugccucuugugagcucgg

SEQ ID NO: 90562 - RNA, 19 nt, Human
caguuccuggggcaagaag

SEQ ID NO: 90563 - RNA, 32 nt, Human
caguuccugugugaguucugucuucacagacu

SEQ ID NO: 90564 - RNA, 32 nt, Human
caguuccuucauuccuucuuccagaacaucug

SEQ ID NO: 90565 - RNA, 32 nt, Human
caguuccuucccacucagugcccacguuucag

SEQ ID NO: 90566 - RNA, 32 nt, Human
caguuccuuccucccuucaagagucagcuuag

SEQ ID NO: 90567 - RNA, 32 nt, Human
caguuccuucucuccauccuucgaccuucaca

SEQ ID NO: 90568 - RNA, 32 nt, Human
caguuccuuggguguggagcacuccccauuuc

SEQ ID NO: 90569 - RNA, 32 nt, Human
caguuccuuugcauguuucgggagagguuugu

SEQ ID NO: 90570 - RNA, 21 nt, Human
caguucgcacggccacagggg

SEQ ID NO: 90571 - RNA, 32 nt, Human
caguucgccguacuuccaucugcugggugccu

SEQ ID NO: 90572 - RNA, 32 nt, Human
caguucggcggccgcggcugggcccugcagga

SEQ ID NO: 90573 - RNA, 32 nt, Human
caguucgggaggcagaguuagguggaucaauu

SEQ ID NO: 90574 - RNA, 32 nt, Human
caguucuaacugcccuuccucccaggcccugg

SEQ ID NO: 90575 - RNA, 18 nt, Human
caguucuacagagugaga

SEQ ID NO: 90576 - RNA, 32 nt, Human
caguucucacauauggaaaggauacacacuuu

SEQ ID NO: 90577 - RNA, 32 nt, Human
caguucuccacugucucuucuggaccaggaau

SEQ ID NO: 90578 - RNA, 32 nt, Human
caguucucccucuauugcccaggcuggagugc

SEQ ID NO: 90579 - RNA, 32 nt, Human
caguucuccuccacaucucccaucccagaauc

SEQ ID NO: 90580 - RNA, 19 nt, Human
caguucuccuccccuagug

SEQ ID NO: 90581 - RNA, 32 nt, Human
caguucuccugccucaaccuccugaguagcug

SEQ ID NO: 90582 - RNA, 32 nt, Human
caguucuccugccucagccuccaaguagcugg

SEQ ID NO: 90583 - RNA, 32 nt, Human
caguucuccugccucagccucccaaauagcug

SEQ ID NO: 90584 - RNA, 32 nt, Human
caguucuccugccucagccucccgaguagcug

SEQ ID NO: 90585 - RNA, 32 nt, Human
caguucuccugccucagccuccugaguagcug

SEQ ID NO: 90586 - RNA, 32 nt, Human
caguucuccugccucagucuccugaguggcug

SEQ ID NO: 90587 - RNA, 32 nt, Human
caguucuccugggcuccagccuccugcaagga

SEQ ID NO: 90588 - RNA, 32 nt, Human
caguucucggccccggcuuucuuccaagaguu

SEQ ID NO: 90589 - RNA, 32 nt, Human
caguucucuaggggagaggccuggcauugcac

SEQ ID NO: 90590 - RNA, 32 nt, Human
caguucucuccucucggaagcugcagccauga

SEQ ID NO: 90591 - RNA, 32 nt, Human
caguucucuccugcaacccccacugcucagcc

SEQ ID NO: 90592 - RNA, 32 nt, Human
caguucucuugccucagccuccuggguagcug

SEQ ID NO: 90593 - RNA, 32 nt, Human
caguucugaaggagggugaggcggugggggau

SEQ ID NO: 90594 - RNA, 32 nt, Human
caguucugagccacagaugaggaaacucacau

SEQ ID NO: 90595 - RNA, 32 nt, Human
caguucugagccuccucgccucccggcucucc

SEQ ID NO: 90596 - RNA, 32 nt, Human
caguucugcauacauccaaccuuccguccuac

SEQ ID NO: 90597 - RNA, 17 nt, Human
caguucugcauggcugg

SEQ ID NO: 90598 - RNA, 18 nt, Human
caguucugccacccagga

SEQ ID NO: 90599 - RNA, 32 nt, Human
caguucugcgccuuggggccagccaguacuca

SEQ ID NO: 90600 - RNA, 32 nt, Human
caguucugcucauaaaccccuaccuggaguug

SEQ ID NO: 90601 - RNA, 32 nt, Human
caguucugcucucugcagcaacauaaguacaa

SEQ ID NO: 90602 - RNA, 32 nt, Human
caguucugcugcuguggcuucagcuuuggaag

SEQ ID NO: 90603 - RNA, 32 nt, Human
caguucuggaaccugggaaauccaaaggcaug

SEQ ID NO: 90604 - RNA, 32 nt, Human
caguucuggaggucaagagucugaaaugggcc

SEQ ID NO: 90605 - RNA, 30 nt, Human
caguucuggcccuuucagcuccuguuucag

SEQ ID NO: 90606 - RNA, 32 nt, Human
caguucugggagacaagaguugggccagguug

SEQ ID NO: 90607 - RNA, 32 nt, Human
caguucugggauuuggcccugggaagcagccc

SEQ ID NO: 90608 - RNA, 32 nt, Human
caguucuggggucccaaccuggguggaagguc

SEQ ID NO: 90609 - RNA, 32 nt, Human
caguucuguaggaacuaacgaacucccaagag

SEQ ID NO: 90610 - RNA, 32 nt, Human
caguucugucaucacugugaucuuuaaaaacc

SEQ ID NO: 90611 - RNA, 32 nt, Human
caguucuuaaccacugaauuucuaagacuguu

SEQ ID NO: 90612 - RNA, 22 nt, Human
caguucuuagcaaaugcaguua

SEQ ID NO: 90613 - RNA, 32 nt, Human
caguucuuaguguggcuguuuaaaguagaaaa

SEQ ID NO: 90614 - RNA, 32 nt, Human
caguucuuaucuuucaucuguuuccuagguaa

SEQ ID NO: 90615 - RNA, 32 nt, Human
caguucuucaauauauguucucuaauacuggc

SEQ ID NO: 90616 - RNA, 32 nt, Human
caguucuuccagcacagcgcuugagcucugcu

SEQ ID NO: 90617 - RNA, 32 nt, Human
caguucuuccuaucagcuucagugacccaggg

SEQ ID NO: 90618 - RNA, 32 nt, Human
caguucuucugucuccucuguuuggaagucca

SEQ ID NO: 90619 - RNA, 18 nt, Human
caguucuugcccuccaca

SEQ ID NO: 90620 - RNA, 32 nt, Human
caguucuuggcugccguccuguggcagcuuaa

SEQ ID NO: 90621 - RNA, 32 nt, Human
caguucuugguagguucugcugggcagaacau

SEQ ID NO: 90622 - RNA, 18 nt, Human
caguucuuuagggauaga

SEQ ID NO: 90623 - RNA, 32 nt, Human
caguucuuuucucugcugaaagaugucuugag

SEQ ID NO: 90624 - RNA, 32 nt, Human
caguucuuuuugaaaugaaaggugcuuuguuu

SEQ ID NO: 90625 - RNA, 32 nt, Human
caguugaacacagccaguuauucuuccauuau

SEQ ID NO: 90626 - RNA, 32 nt, Human
caguugaaccauuccacauucccaccagcaau

SEQ ID NO: 90627 - RNA, 32 nt, Human
caguugaagagauggggguagagaagacuuug

SEQ ID NO: 90628 - RNA, 32 nt, Human
caguugaaguggcuucuaaucccuggaucaua

SEQ ID NO: 90629 - RNA, 32 nt, Human
caguugaaugguuggagauugcuggcgaugug

SEQ ID NO: 90630 - RNA, 32 nt, Human
caguugacaagaaaauuuuauuauuuacagga

SEQ ID NO: 90631 - RNA, 18 nt, Human
caguugacagccuacaga

SEQ ID NO: 90632 - RNA, 32 nt, Human
caguugaccuucacagcaccugccccucacac

SEQ ID NO: 90633 - RNA, 32 nt, Human
caguugacuaaccaccaccaauggucaagaua

SEQ ID NO: 90634 - RNA, 32 nt, Human
caguugacucacuacagccucugccucccagg

SEQ ID NO: 90635 - RNA, 32 nt, Human
caguugacugguuuuguguccuguuugaacuu

SEQ ID NO: 90636 - RNA, 21 nt, Human
caguugacuugauuuugcaca

SEQ ID NO: 90637 - RNA, 32 nt, Human
caguugagaaacacuaagguuauggugaauaa

SEQ ID NO: 90638 - RNA, 32 nt, Human
caguugagagugagcgggguacaguaaggcag

SEQ ID NO: 90639 - RNA, 20 nt, Human
caguugagcugcgcuggcca

SEQ ID NO: 90640 - RNA, 32 nt, Human
caguugagcugcgcuggccagagaugccugcc

SEQ ID NO: 90641 - RNA, 32 nt, Human
caguugaggcaguagcuguguccucugagggu

SEQ ID NO: 90642 - RNA, 32 nt, Human
caguugauauuaucuuuacaaaugacuugacc

SEQ ID NO: 90643 - RNA, 32 nt, Human
caguugaugugguccuggauccagacaccgcu

SEQ ID NO: 90644 - RNA, 32 nt, Human
caguugauuuccccagguacauucauggugug

SEQ ID NO: 90645 - RNA, 32 nt, Human
caguugcacacguguacguaucagugggaagu

SEQ ID NO: 90646 - RNA, 32 nt, Human
caguugcacagugccucaagccccagaguggc

SEQ ID NO: 90647 - RNA, 32 nt, Human
caguugcaccaguuaacuguccuggccucagu

SEQ ID NO: 90648 - RNA, 32 nt, Human
caguugcagguguugggaggaagaugaaaucg

SEQ ID NO: 90649 - RNA, 24 nt, Human
caguugccaacaccuguaauccca

SEQ ID NO: 90650 - RNA, 32 nt, Human
caguugccaaccuguccuccacugcagccuca

SEQ ID NO: 90651 - RNA, 22 nt, Human
caguugccaaucuaaaagcaca

SEQ ID NO: 90652 - RNA, 32 nt, Human
caguugccacacauuccccaagcacaaaaggu

SEQ ID NO: 90653 - RNA, 32 nt, Human
caguugccagcccugcagcccccuuccccagg

SEQ ID NO: 90654 - RNA, 32 nt, Human
caguugccaugggguuuccuuccagauucgag

SEQ ID NO: 90655 - RNA, 32 nt, Human
caguugccauuuuucucucuaacugggcacca

SEQ ID NO: 90656 - RNA, 32 nt, Human
caguugcccaggcuggauugcgguggcgcugu

SEQ ID NO: 90657 - RNA, 32 nt, Human
caguugcccuggcaaacagaccuggcuggaag

SEQ ID NO: 90658 - RNA, 32 nt, Human
caguugccuacaguauucagugcaguaacaug

SEQ ID NO: 90659 - RNA, 32 nt, Human
caguugccuagacaacaggcccagggucagag

SEQ ID NO: 90660 - RNA, 32 nt, Human
caguugccuccagggccucuccuuggaagguc

SEQ ID NO: 90661 - RNA, 32 nt, Human
caguugccuguaauccuagcuacucaggaggc

SEQ ID NO: 90662 - RNA, 32 nt, Human
caguugccuuagggacagagacaaaggaaaug

SEQ ID NO: 90663 - RNA, 32 nt, Human
caguugccuuguuucugaucuuccugcaacua

SEQ ID NO: 90664 - RNA, 32 nt, Human
caguugccuuuuccucucacagaaggaagauu

SEQ ID NO: 90665 - RNA, 32 nt, Human
caguugccuuuuccuuucuuuagcuccuguuu

SEQ ID NO: 90666 - RNA, 24 nt, Human
caguugcucacaccgguaauccca

SEQ ID NO: 90667 - RNA, 21 nt, Human
caguugcucacgccuguaauc

SEQ ID NO: 90668 - RNA, 24 nt, Human
caguugcucacgccuguaauccca

SEQ ID NO: 90669 - RNA, 16 nt, Human
caguugcuccuucaca

SEQ ID NO: 90670 - RNA, 32 nt, Human
caguugcuccuucacauguucccacucucugu

SEQ ID NO: 90671 - RNA, 18 nt, Human
caguugcugggacggaag

SEQ ID NO: 90672 - RNA, 32 nt, Human
caguugcugucacaaaggagugagugaaacuc

SEQ ID NO: 90673 - RNA, 32 nt, Human
caguugcugucagucuugaccucugccuuugu

SEQ ID NO: 90674 - RNA, 32 nt, Human
caguugcuguguuucugccggaucagaugagc

SEQ ID NO: 90675 - RNA, 32 nt, Human
caguugcuuagguaugaauagggacuugcagu

SEQ ID NO: 90676 - RNA, 32 nt, Human
caguugcuucuaauuuuucuacaguuugcaca

SEQ ID NO: 90677 - RNA, 32 nt, Human
caguugcuucucagcucagcugugccaggauc

SEQ ID NO: 90678 - RNA, 32 nt, Human
caguugcuugcucuugugccuccugggcaagg

SEQ ID NO: 90679 - RNA, 32 nt, Human
caguuggaaaccagcuaauaguuucuuaaucu

SEQ ID NO: 90680 - RNA, 32 nt, Human
caguuggaaagcaggaggaaugcugacugguu

SEQ ID NO: 90681 - RNA, 32 nt, Human
caguuggaaaugcagaagggcacuugaguuuc

SEQ ID NO: 90682 - RNA, 32 nt, Human
caguuggaaccaggaacucugcugucagguug

SEQ ID NO: 90683 - RNA, 20 nt, Human
caguuggaaccuaugagaug

SEQ ID NO: 90684 - RNA, 32 nt, Human
caguuggagaaaauggaauugucuagccaaaa

SEQ ID NO: 90685 - RNA, 32 nt, Human
caguuggagagauuuuaaaaaugcaggaugag

SEQ ID NO: 90686 - RNA, 32 nt, Human
caguuggagagggggcuccaccagcuccacau

SEQ ID NO: 90687 - RNA, 32 nt, Human
caguuggaggcugcagugagcuaugauugugc

SEQ ID NO: 90688 - RNA, 32 nt, Human
caguuggagggaacuccaagucccacagugcc

SEQ ID NO: 90689 - RNA, 32 nt, Human
caguuggaggggcauggcuuccaauuuagaga

SEQ ID NO: 90690 - RNA, 32 nt, Human
caguuggauguucuugccucugacaguagcuu

SEQ ID NO: 90691 - RNA, 32 nt, Human
caguuggccauggcugaggaauuugugacccu

SEQ ID NO: 90692 - RNA, 32 nt, Human
caguuggccgacccgugucacucccuggcugu

SEQ ID NO: 90693 - RNA, 32 nt, Human
caguuggccucccugguucugcagagggccag

SEQ ID NO: 90694 - RNA, 32 nt, Human
caguugggaagauacaggcgugcgaggggcac

SEQ ID NO: 90695 - RNA, 25 nt, Human
caguugggcccagaacccucugggg

SEQ ID NO: 90696 - RNA, 32 nt, Human
caguugggcugaaucuccuuccucccacuggc

SEQ ID NO: 90697 - RNA, 32 nt, Human
caguuggggaacaccagaggcuacacaguagc

SEQ ID NO: 90698 - RNA, 32 nt, Human
caguugggguucacccuucaucccucacauuu

SEQ ID NO: 90699 - RNA, 32 nt, Human
caguugggucaccacuuaagucaacacaggcc

SEQ ID NO: 90700 - RNA, 32 nt, Human
caguugguuggcaaccccuuccucacucaccc

SEQ ID NO: 90701 - RNA, 32 nt, Human
caguuguaauagugccaagcaggccugauucu

SEQ ID NO: 90702 - RNA, 32 nt, Human
caguuguagcuugccagcucccaacacccuuc

SEQ ID NO: 90703 - RNA, 32 nt, Human
caguuguagucaugagugauccuucauauuuu

SEQ ID NO: 90704 - RNA, 32 nt, Human
caguugucaccaacagucuuucugcaaagggc

SEQ ID NO: 90705 - RNA, 32 nt, Human
caguugucacucacuccucucucccucccaag

SEQ ID NO: 90706 - RNA, 17 nt, Human
caguugucaggagucug

SEQ ID NO: 90707 - RNA, 32 nt, Human
caguugucauugccaugacaaggccucuaucu

SEQ ID NO: 90708 - RNA, 32 nt, Human
caguuguccuaucacaguuauauuagaaauaa

SEQ ID NO: 90709 - RNA, 32 nt, Human
caguuguccugaucuucucuugcagugucccu

SEQ ID NO: 90710 - RNA, 32 nt, Human
caguugugagccaagauuguaaccagagagca

SEQ ID NO: 90711 - RNA, 32 nt, Human
caguugugcauugggauggguggagaaagacg

SEQ ID NO: 90712 - RNA, 23 nt, Human
caguuguggaauucaguuuuuca

SEQ ID NO: 90713 - RNA, 18 nt, Human
caguuguggaccaugaga

SEQ ID NO: 90714 - RNA, 32 nt, Human
caguuguggccauuccagaggacucuuuaguc

SEQ ID NO: 90715 - RNA, 32 nt, Human
caguugugugcaaaggcaaggcuugcuuuucc

SEQ ID NO: 90716 - RNA, 32 nt, Human
caguuguguucugugagcuagcacuuuuuccu

SEQ ID NO: 90717 - RNA, 32 nt, Human
caguuguuccagggagcuucuaccuggaaaag

SEQ ID NO: 90718 - RNA, 32 nt, Human
caguuguuucaccguaaccucugccuccugac

SEQ ID NO: 90719 - RNA, 32 nt, Human
caguuguuuuugaaauuuaacuuuuguuugua

SEQ ID NO: 90720 - RNA, 32 nt, Human
caguuguuuuuguguggaaucuugucuuuccg

SEQ ID NO: 90721 - RNA, 19 nt, Human
caguuuaaagaccucuaua

SEQ ID NO: 90722 - RNA, 32 nt, Human
caguuuaagggugggagucuggagccagacag

SEQ ID NO: 90723 - RNA, 21 nt, Human
caguuuaagguauauggcugg

SEQ ID NO: 90724 - RNA, 31 nt, Human
caguuuacauuucugauacaugcagauagca

SEQ ID NO: 90725 - RNA, 32 nt, Human
caguuuacccuggcuuuccuuuaagcagaggg

SEQ ID NO: 90726 - RNA, 32 nt, Human
caguuuacugauuucucaaaagcugcaccuaa

SEQ ID NO: 90727 - RNA, 32 nt, Human
caguuuacuugguuucccuugugcagccuggg

SEQ ID NO: 90728 - RNA, 32 nt, Human
caguuuacuugucugccuuccuuuccaagacc

SEQ ID NO: 90729 - RNA, 32 nt, Human
caguuuagaacugcaggagcucccugcugccu

SEQ ID NO: 90730 - RNA, 32 nt, Human
caguuuagagucaggacagaaaagcuuccaua

SEQ ID NO: 90731 - RNA, 32 nt, Human
caguuuagcaggcugguguuaaggcuguagga

SEQ ID NO: 90732 - RNA, 21 nt, Human
caguuuagcuccugacuccca

SEQ ID NO: 90733 - RNA, 32 nt, Human
caguuuagggggaaugcccccgacccuugaug

SEQ ID NO: 90734 - RNA, 31 nt, Human
caguuuaguauaauuccucucacuuacugaa

SEQ ID NO: 90735 - RNA, 32 nt, Human
caguuuaguucagaauggaaacgaacguucug

SEQ ID NO: 90736 - RNA, 24 nt, Human
caguuuauacagcagacugaagaa

SEQ ID NO: 90737 - RNA, 32 nt, Human
caguuuaugagcugccccggcuugucuggaca

SEQ ID NO: 90738 - RNA, 32 nt, Human
caguuuaugcaacuucugccuccccagguuca

SEQ ID NO: 90739 - RNA, 32 nt, Human
caguuuauugauuucaaauugucugguacuau

SEQ ID NO: 90740 - RNA, 32 nt, Human
caguuucaaccucccagauuccagucauccuc

SEQ ID NO: 90741 - RNA, 32 nt, Human
caguuucaagaagauauacucagagaacacau

SEQ ID NO: 90742 - RNA, 24 nt, Human
caguuucaagcgauucuccugccu

SEQ ID NO: 90743 - RNA, 31 nt, Human
caguuucacagcuaccugcagaggcagagcg

SEQ ID NO: 90744 - RNA, 32 nt, Human
caguuucacaguagcugggaugcauggaugac

SEQ ID NO: 90745 - RNA, 32 nt, Human
caguuucaccucuuugcucccugaguucacuc

SEQ ID NO: 90746 - RNA, 32 nt, Human
caguuucacuaucuccaaagcauuugcaucau

SEQ ID NO: 90747 - RNA, 32 nt, Human
caguuucagauugaaugucugucuugcaggca

SEQ ID NO: 90748 - RNA, 32 nt, Human
caguuucagauuuacucugaaauguggagcau

SEQ ID NO: 90749 - RNA, 32 nt, Human
caguuucauccccuuucucuccuuccauggau

SEQ ID NO: 90750 - RNA, 32 nt, Human
caguuucaugcuguggaaagagggugaaaagg

SEQ ID NO: 90751 - RNA, 32 nt, Human
caguuucauucacuaccauuguuuccaaauua

SEQ ID NO: 90752 - RNA, 32 nt, Human
caguuucauuucugucuugcuggucuauuagu

SEQ ID NO: 90753 - RNA, 32 nt, Human
caguuuccacugcaguggcuggagagugaccu

SEQ ID NO: 90754 - RNA, 32 nt, Human
caguuuccagagagccagagagugagagagag

SEQ ID NO: 90755 - RNA, 32 nt, Human
caguuuccaggcagagagaagcagcucugggc

SEQ ID NO: 90756 - RNA, 22 nt, Human
caguuuccaguuucccuugcca

SEQ ID NO: 90757 - RNA, 17 nt, Human
caguuucccauggcugg

SEQ ID NO: 90758 - RNA, 32 nt, Human
caguuucccaugugcuuacaggccaguaagcu

SEQ ID NO: 90759 - RNA, 21 nt, Human
caguuuccccauuuuggccag

SEQ ID NO: 90760 - RNA, 32 nt, Human
caguuucccgagagauaugaccugaaacauga

SEQ ID NO: 90761 - RNA, 32 nt, Human
caguuucccuccugccacgaaagcucgagacu

SEQ ID NO: 90762 - RNA, 32 nt, Human
caguuucccuuuucucucugacuuguccuagg

SEQ ID NO: 90763 - RNA, 32 nt, Human
caguuuccuccaacuccugguucagccauugc

SEQ ID NO: 90764 - RNA, 17 nt, Human
caguuuccuccuccaca

SEQ ID NO: 90765 - RNA, 21 nt, Human
caguuucgacuccucucugca

SEQ ID NO: 90766 - RNA, 32 nt, Human
caguuucgugugccaccaugccuggcuaauuu

SEQ ID NO: 90767 - RNA, 32 nt, Human
caguuucuagcacaaaauaggcaccuaaucaa

SEQ ID NO: 90768 - RNA, 32 nt, Human
caguuucuauggugaaauggcagaagguaaca

SEQ ID NO: 90769 - RNA, 32 nt, Human
caguuucucaacagaugguuucaguggcucag

SEQ ID NO: 90770 - RNA, 32 nt, Human
caguuucucaccaaagugcaagccgcugaccu

SEQ ID NO: 90771 - RNA, 32 nt, Human
caguuucucauggccuguuuauguccaaauuu

SEQ ID NO: 90772 - RNA, 32 nt, Human
caguuucuccugcacuguuuucaccuuuggcc

SEQ ID NO: 90773 - RNA, 32 nt, Human
caguuucucugccuucuuccaggaucaggggu

SEQ ID NO: 90774 - RNA, 32 nt, Human
caguuucugaaauguaagcauuacaugacuau

SEQ ID NO: 90775 - RNA, 32 nt, Human
caguuucugagugacccaggaacagaucagaa

SEQ ID NO: 90776 - RNA, 32 nt, Human
caguuucugccaccccacucuccaggccaguu

SEQ ID NO: 90777 - RNA, 32 nt, Human
caguuucugccucuggaagccuaaaacugcuu

SEQ ID NO: 90778 - RNA, 32 nt, Human
caguuucugcucccuuccaucucucucccaua

SEQ ID NO: 90779 - RNA, 32 nt, Human
caguuucuggaaaaaguugaugcuaaugaggc

SEQ ID NO: 90780 - RNA, 18 nt, Human
caguuucuggacaggaag

SEQ ID NO: 90781 - RNA, 32 nt, Human
caguuucugggaagcaauugaaacacuauuaa

SEQ ID NO: 90782 - RNA, 32 nt, Human
caguuucuggggagcuuccaagagcacccacc

SEQ ID NO: 90783 - RNA, 32 nt, Human
caguuucuucauacuucugucacuuuuuccau

SEQ ID NO: 90784 - RNA, 32 nt, Human
caguuucuucuuuuaauucaucauugacacag

SEQ ID NO: 90785 - RNA, 32 nt, Human
caguuucuugaagcacuccuguccucaucccu

SEQ ID NO: 90786 - RNA, 32 nt, Human
caguuucuuggguaauggaaaacauuaccuag

SEQ ID NO: 90787 - RNA, 32 nt, Human
caguuucuuguccugggcccucaggucagccu

SEQ ID NO: 90788 - RNA, 32 nt, Human
caguuugaaaccauuucacucagguaaaaugc

SEQ ID NO: 90789 - RNA, 32 nt, Human
caguuugaacuuggcgggccagaugugggcgg

SEQ ID NO: 90790 - RNA, 18 nt, Human
caguuugacauccuccac

SEQ ID NO: 90791 - RNA, 32 nt, Human
caguuugacccccggaggcugcagugaggacg

SEQ ID NO: 90792 - RNA, 22 nt, Human
caguuugagaaaagcaucugca

SEQ ID NO: 90793 - RNA, 21 nt, Human
caguuugagcaacagaucaag

SEQ ID NO: 90794 - RNA, 32 nt, Human
caguuugagcugggaucucugaaugcaagggu

SEQ ID NO: 90795 - RNA, 32 nt, Human
caguuugaggccagagaggugaguggaccuga

SEQ ID NO: 90796 - RNA, 21 nt, Human
caguuugaggcuccccuggga

SEQ ID NO: 90797 - RNA, 32 nt, Human
caguuugauucuguaaugagcacagcaccuaa

SEQ ID NO: 90798 - RNA, 32 nt, Human
caguuugcaaccccaaaccacauuagaagucu

SEQ ID NO: 90799 - RNA, 32 nt, Human
caguuugcaagugccaucugcacuguggggga

SEQ ID NO: 90800 - RNA, 32 nt, Human
caguuugcacauagaaaaagcaucugagccac

SEQ ID NO: 90801 - RNA, 32 nt, Human
caguuugcaccccaggcaaagcagagagcaga

SEQ ID NO: 90802 - RNA, 32 nt, Human
caguuugcagaguaggggucugucuuuuaaac

SEQ ID NO: 90803 - RNA, 32 nt, Human
caguuugcaggaaggucauguggugugcaccu

SEQ ID NO: 90804 - RNA, 32 nt, Human
caguuugcagugagcugagaucacgccacugc

SEQ ID NO: 90805 - RNA, 32 nt, Human
caguuugcaugggcugaguuauaccagcuaga

SEQ ID NO: 90806 - RNA, 32 nt, Human
caguuugcccaggaacugggggaucauauaug

SEQ ID NO: 90807 - RNA, 32 nt, Human
caguuugcccccaucccucccagugcuggcuc

SEQ ID NO: 90808 - RNA, 32 nt, Human
caguuugcguaugugugguugcucugggaagc

SEQ ID NO: 90809 - RNA, 32 nt, Human
caguuugcucaccucuuggggcauuuuguaau

SEQ ID NO: 90810 - RNA, 32 nt, Human
caguuugcuccccuccugaugcccucugguaa

SEQ ID NO: 90811 - RNA, 20 nt, Human
caguuuggaaacuccggcgg

SEQ ID NO: 90812 - RNA, 32 nt, Human
caguuuggaagaccgaggcggguggaucacuu

SEQ ID NO: 90813 - RNA, 32 nt, Human
caguuuggacaaggagcuucaaaacucggcca

SEQ ID NO: 90814 - RNA, 32 nt, Human
caguuuggacaggguggcuggauuguauaucu

SEQ ID NO: 90815 - RNA, 22 nt, Human
caguuuggacuacagagugaga

SEQ ID NO: 90816 - RNA, 32 nt, Human
caguuuggagacagaaaaagacaaaaggucca

SEQ ID NO: 90817 - RNA, 32 nt, Human
caguuuggauccuacaagcaagcugaauggag

SEQ ID NO: 90818 - RNA, 19 nt, Human
caguuuggaucuggccugg

SEQ ID NO: 90819 - RNA, 18 nt, Human
caguuuggcaaacgcuua

SEQ ID NO: 90820 - RNA, 21 nt, Human
caguuuggcaacagagugaga

SEQ ID NO: 90821 - RNA, 18 nt, Human
caguuuggcagcuauaga

SEQ ID NO: 90822 - RNA, 32 nt, Human
caguuuggcaucugcaguacaccaagcacaug

SEQ ID NO: 90823 - RNA, 17 nt, Human
caguuuggccaggggug

SEQ ID NO: 90824 - RNA, 18 nt, Human
caguuuggcccagccugg

SEQ ID NO: 90825 - RNA, 32 nt, Human
caguuuggcggggacggggcuuggggguuuuc

SEQ ID NO: 90826 - RNA, 19 nt, Human
caguuuggcuuccggaagg

SEQ ID NO: 90827 - RNA, 16 nt, Human
caguuuggcuucucug

SEQ ID NO: 90828 - RNA, 18 nt, Human
caguuuggcuucuguuug

SEQ ID NO: 90829 - RNA, 19 nt, Human
caguuuggcuuugggauug

SEQ ID NO: 90830 - RNA, 32 nt, Human
caguuugggaaggugauggguauuaguggggg

SEQ ID NO: 90831 - RNA, 32 nt, Human
caguuugggaggccgaggcagguggaucaccu

SEQ ID NO: 90832 - RNA, 32 nt, Human
caguuugggaggcugaggcaggaggaucgcuu

SEQ ID NO: 90833 - RNA, 32 nt, Human
caguuugggaggcugaggcgggcggaucacca

SEQ ID NO: 90834 - RNA, 32 nt, Human
caguuugggaggcugaggcuaguggaucaugu

SEQ ID NO: 90835 - RNA, 32 nt, Human
caguuugggaggcugaguugggcagaucaccu

SEQ ID NO: 90836 - RNA, 32 nt, Human
caguuugggaucccaugagagagggguccuug

SEQ ID NO: 90837 - RNA, 16 nt, Human
caguuugggaugguug

SEQ ID NO: 90838 - RNA, 32 nt, Human
caguuugggcaacagaaugaggcuccaucuca

SEQ ID NO: 90839 - RNA, 32 nt, Human
caguuugggcucuccccuugccaccggcucug

SEQ ID NO: 90840 - RNA, 32 nt, Human
caguuugggggaucaaggcugagccauucuug

SEQ ID NO: 90841 - RNA, 18 nt, Human
caguuugggggcggccgg

SEQ ID NO: 90842 - RNA, 18 nt, Human
caguuuggguggggcugg

SEQ ID NO: 90843 - RNA, 32 nt, Human
caguuuggguggggcuggaggagcaggggugc

SEQ ID NO: 90844 - RNA, 18 nt, Human
caguuugguauaacgugg

SEQ ID NO: 90845 - RNA, 32 nt, Human
caguuuggucucagugacugaaaacucaaccc

SEQ ID NO: 90846 - RNA, 19 nt, Human
caguuugguggauuggugg

SEQ ID NO: 90847 - RNA, 20 nt, Human
caguuugguguguccuccgc

SEQ ID NO: 90848 - RNA, 32 nt, Human
caguuugguuacaggacuucugugcauuguaa

SEQ ID NO: 90849 - RNA, 32 nt, Human
caguuuguacaguaugaccuauaugugaccau

SEQ ID NO: 90850 - RNA, 32 nt, Human
caguuuguauacugacagguccuuccagucuc

SEQ ID NO: 90851 - RNA, 32 nt, Human
caguuuguauccaccugcuuucagaggaggaa

SEQ ID NO: 90852 - RNA, 32 nt, Human
caguuuguauuuuuauaaguaucuagaccaaa

SEQ ID NO: 90853 - RNA, 32 nt, Human
caguuugucacccaggcuggagugcaguggca

SEQ ID NO: 90854 - RNA, 32 nt, Human
caguuugucacccaggcuggagugcuguggug

SEQ ID NO: 90855 - RNA, 32 nt, Human
caguuuguccaauuaaagcuucagagguaaca

SEQ ID NO: 90856 - RNA, 18 nt, Human
caguuugugcaugaggug

SEQ ID NO: 90857 - RNA, 32 nt, Human
caguuugugcggcagauugcucugccaagaua

SEQ ID NO: 90858 - RNA, 32 nt, Human
caguuugugcuauuucauaucuguacuccagg

SEQ ID NO: 90859 - RNA, 32 nt, Human
caguuuguggaagucccaggcaaucacugugu

SEQ ID NO: 90860 - RNA, 32 nt, Human
caguuuguucucucagaacccagaaucuuuga

SEQ ID NO: 90861 - RNA, 32 nt, Human
caguuuguuggacauuuuacagcuucaccagg

SEQ ID NO: 90862 - RNA, 32 nt, Human
caguuuguuuuuaccucugccuccugguuuuc

SEQ ID NO: 90863 - RNA, 32 nt, Human
caguuuuaagcagguauagugcaggcuuguua

SEQ ID NO: 90864 - RNA, 21 nt, Human
caguuuuaauugaagcaugau

SEQ ID NO: 90865 - RNA, 32 nt, Human
caguuuuaccaaaagaaaaauuugaaaauuuc

SEQ ID NO: 90866 - RNA, 32 nt, Human
caguuuuaccucuucucucucaguucuacacu

SEQ ID NO: 90867 - RNA, 32 nt, Human
caguuuuacucaucacuucuucaugacaccaa

SEQ ID NO: 90868 - RNA, 32 nt, Human
caguuuuacugauguucugggugggggacaga

SEQ ID NO: 90869 - RNA, 32 nt, Human
caguuuuagaauaaggaggaggagggagaaga

SEQ ID NO: 90870 - RNA, 32 nt, Human
caguuuuagcuuauuuuucccucuuuuguuca

SEQ ID NO: 90871 - RNA, 32 nt, Human
caguuuuagucacugugaaauauuucacauuc

SEQ ID NO: 90872 - RNA, 20 nt, Human
caguuuuagugauucuccau

SEQ ID NO: 90873 - RNA, 18 nt, Human
caguuuuaguucuuuaua

SEQ ID NO: 90874 - RNA, 32 nt, Human
caguuuuaucugcuucaaaaugccauugauca

SEQ ID NO: 90875 - RNA, 32 nt, Human
caguuuucaaauuauaaucucauuucaauuua

SEQ ID NO: 90876 - RNA, 32 nt, Human
caguuuucacacugugcacacucuggaaaugu

SEQ ID NO: 90877 - RNA, 32 nt, Human
caguuuucacagugacuaccauuuccacccaa

SEQ ID NO: 90878 - RNA, 32 nt, Human
caguuuucagauuuuguaucaugccauccauc

SEQ ID NO: 90879 - RNA, 32 nt, Human
caguuuucaggcuaauacagaaaaagaugaac

SEQ ID NO: 90880 - RNA, 32 nt, Human
caguuuucauuugguucauuaauucuauaagg

SEQ ID NO: 90881 - RNA, 32 nt, Human
caguuuucuaguccuauaaauuuggggcuauc

SEQ ID NO: 90882 - RNA, 32 nt, Human
caguuuucucaaaucaacaaacagccuucucc

SEQ ID NO: 90883 - RNA, 32 nt, Human
caguuuucuccuaacacgugccaagcccagga

SEQ ID NO: 90884 - RNA, 32 nt, Human
caguuuucuccuccucacuaggcuguguuuuu

SEQ ID NO: 90885 - RNA, 32 nt, Human
caguuuucuccuccucacuagucuguggcuuu

SEQ ID NO: 90886 - RNA, 32 nt, Human
caguuuucuccucugcuucuuugccucccuca

SEQ ID NO: 90887 - RNA, 16 nt, Human
caguuuucucuccaca

SEQ ID NO: 90888 - RNA, 32 nt, Human
caguuuucuggcuuacuguguuacuugccuag

SEQ ID NO: 90889 - RNA, 32 nt, Human
caguuuucuguccaccccuccuguuccucugc

SEQ ID NO: 90890 - RNA, 32 nt, Human
caguuuucuuaccuuugccugcccugccuuuc

SEQ ID NO: 90891 - RNA, 32 nt, Human
caguuuugacagaauaauucuuggucuucccc

SEQ ID NO: 90892 - RNA, 18 nt, Human
caguuuugaccaaucgca

SEQ ID NO: 90893 - RNA, 17 nt, Human
caguuuugaccucuuca

SEQ ID NO: 90894 - RNA, 32 nt, Human
caguuuugagcagaggugaggcagaauccacu

SEQ ID NO: 90895 - RNA, 32 nt, Human
caguuuugagccuugccucaggccuggugagu

SEQ ID NO: 90896 - RNA, 19 nt, Human
caguuuugaguuuucuaca

SEQ ID NO: 90897 - RNA, 32 nt, Human
caguuuugcccagaugugcuagaauggggcug

SEQ ID NO: 90898 - RNA, 32 nt, Human
caguuuuggugaagcaggagaugcaccccaca

SEQ ID NO: 90899 - RNA, 32 nt, Human
caguuuugucucucauccauacacugggguuu

SEQ ID NO: 90900 - RNA, 32 nt, Human
caguuuugugguugaggggccuggagaaaauc

SEQ ID NO: 90901 - RNA, 32 nt, Human
caguuuugugugugugcguguguguaaaugug

SEQ ID NO: 90902 - RNA, 32 nt, Human
caguuuuguucacgccaagcagccuugguuag

SEQ ID NO: 90903 - RNA, 32 nt, Human
caguuuuguugacuuaaaaauaugagauacau

SEQ ID NO: 90904 - RNA, 21 nt, Human
caguuuuguuuccuuuuuaca

SEQ ID NO: 90905 - RNA, 22 nt, Human
caguuuuuaacuuaagccugau

SEQ ID NO: 90906 - RNA, 18 nt, Human
caguuuuuagccuuuaca

SEQ ID NO: 90907 - RNA, 32 nt, Human
caguuuuucagcaacuaaggugccucauguuc

SEQ ID NO: 90908 - RNA, 32 nt, Human
caguuuuucaucugcacugccaugucugagug

SEQ ID NO: 90909 - RNA, 32 nt, Human
caguuuuuccaaagucaagagucuuaaccuug

SEQ ID NO: 90910 - RNA, 32 nt, Human
caguuuuuccacggaugggugacaggggaugg

SEQ ID NO: 90911 - RNA, 32 nt, Human
caguuuuugacuuuuccaugugagaauaaggc

SEQ ID NO: 90912 - RNA, 32 nt, Human
caguuuuugauagcacaucuacaugcaucugc

SEQ ID NO: 90913 - RNA, 25 nt, Human
caguuuuuuaaacaaaugaguggaa

SEQ ID NO: 90914 - RNA, 20 nt, Human
caguuuuuuaaagcaacugu

SEQ ID NO: 90915 - RNA, 32 nt, Human
cauaaaaaccccacagugacacacacaaaaga

SEQ ID NO: 90916 - RNA, 32 nt, Human
cauaaaaagauaccuggucugccuuguacaag

SEQ ID NO: 90917 - RNA, 32 nt, Human
cauaaaaaggcagagcuggccaggcacagugg

SEQ ID NO: 90918 - RNA, 32 nt, Human
cauaaaaauuuucugagguuguccucauugau

SEQ ID NO: 90919 - RNA, 32 nt, Human
cauaaaacacuaacuuuuaaaaggaauaaacg

SEQ ID NO: 90920 - RNA, 32 nt, Human
cauaaaacagcauuugcguuuauugagagaga

SEQ ID NO: 90921 - RNA, 32 nt, Human
cauaaaacauaguguaucuaugcaguuuauau

SEQ ID NO: 90922 - RNA, 32 nt, Human
cauaaaacuucugauuucucuucagcuuugaa

SEQ ID NO: 90923 - RNA, 24 nt, Human
cauaaaagaaaauaaaaugacaua

SEQ ID NO: 90924 - RNA, 32 nt, Human
cauaaaagaagaggcgaguagggcacaacagg

SEQ ID NO: 90925 - RNA, 32 nt, Human
cauaaaagacaacuuggcuucugaggauggug

SEQ ID NO: 90926 - RNA, 32 nt, Human
cauaaaagacccagacucagcugcagugagga

SEQ ID NO: 90927 - RNA, 32 nt, Human
cauaaaagauggaaagaaaacacacaccgaag

SEQ ID NO: 90928 - RNA, 32 nt, Human
cauaaaaggcaaagaggagcuggcaugguggu

SEQ ID NO: 90929 - RNA, 32 nt, Human
cauaaaagugcucuccugccugggcagcaaca

SEQ ID NO: 90930 - RNA, 32 nt, Human
cauaaaaguugaaugaaagaagccaggccgaa

SEQ ID NO: 90931 - RNA, 22 nt, Human
cauaaaauaaaaguacauuuua

SEQ ID NO: 90932 - RNA, 32 nt, Human
cauaaaauaacccagacauacucucauauuuc

SEQ ID NO: 90933 - RNA, 32 nt, Human
cauaaaauacaaaaauuagcugggcguggugg

SEQ ID NO: 90934 - RNA, 32 nt, Human
cauaaaaucaccucgggucacauagcgagagu

SEQ ID NO: 90935 - RNA, 24 nt, Human
cauaaaaucuucgcucacucugca

SEQ ID NO: 90936 - RNA, 32 nt, Human
cauaaaaugcucauaguuugggagaggaaaga

SEQ ID NO: 90937 - RNA, 32 nt, Human
cauaaaauuaaagccuguggcauuuuuaaagu

SEQ ID NO: 90938 - RNA, 32 nt, Human
cauaaaauugugugugcacguucauguacaca

SEQ ID NO: 90939 - RNA, 22 nt, Human
cauaaaauuucccauuucugca

SEQ ID NO: 90940 - RNA, 32 nt, Human
cauaaaauuugcaugacuccucacuccuuucu

SEQ ID NO: 90941 - RNA, 32 nt, Human
cauaaacaagaguuccaguucccuggaaccug

SEQ ID NO: 90942 - RNA, 32 nt, Human
cauaaacacauacauugccaauuuuccagggc

SEQ ID NO: 90943 - RNA, 32 nt, Human
cauaaacacuucagaggcucagaguauguuuc

SEQ ID NO: 90944 - RNA, 32 nt, Human
cauaaacaggaguuugaaagaaguugauuuca

SEQ ID NO: 90945 - RNA, 32 nt, Human
cauaaacaggucagaagaaugauggaauguuu

SEQ ID NO: 90946 - RNA, 32 nt, Human
cauaaacauaaaggaggaugucccuggucugu

SEQ ID NO: 90947 - RNA, 32 nt, Human
cauaaacaucacauggcauguuuugucauugu

SEQ ID NO: 90948 - RNA, 32 nt, Human
cauaaacauccagaaaauggagcaggaaaaca

SEQ ID NO: 90949 - RNA, 32 nt, Human
cauaaacauucucuguugaggauguccaguca

SEQ ID NO: 90950 - RNA, 32 nt, Human
cauaaacauuuggugaccuuuuaccaaguggu

SEQ ID NO: 90951 - RNA, 32 nt, Human
cauaaaccaccucccaaaggcugucauuucau

SEQ ID NO: 90952 - RNA, 32 nt, Human
cauaaaccauauaucaaguuauuugaaaaaua

SEQ ID NO: 90953 - RNA, 32 nt, Human
cauaaacccgggagguggagcuugcagugagc

SEQ ID NO: 90954 - RNA, 32 nt, Human
cauaaacgagcugaauuugauauucacaggag

SEQ ID NO: 90955 - RNA, 32 nt, Human
cauaaacgauaucaagcuuacacuucauaugg

SEQ ID NO: 90956 - RNA, 32 nt, Human
cauaaacguacucaaaacacacgaagcauaau

SEQ ID NO: 90957 - RNA, 32 nt, Human
cauaaacuccaccccucuuccaccccauaacc

SEQ ID NO: 90958 - RNA, 32 nt, Human
cauaaacugcucaaggauuaguuuuccaggac

SEQ ID NO: 90959 - RNA, 32 nt, Human
cauaaacuguuauuccauugcuuucauccucc

SEQ ID NO: 90960 - RNA, 24 nt, Human
cauaaacuguuuacuguugaaaca

SEQ ID NO: 90961 - RNA, 32 nt, Human
cauaaagaaaauggucucccacagauucacag

SEQ ID NO: 90962 - RNA, 32 nt, Human
cauaaagaagaagacauacaugcugucucagg

SEQ ID NO: 90963 - RNA, 32 nt, Human
cauaaagauacagugccuacucugugaaauac

SEQ ID NO: 90964 - RNA, 32 nt, Human
cauaaagcaaacaacauaaagcacaauaaaaa

SEQ ID NO: 90965 - RNA, 32 nt, Human
cauaaagccuuaaaaagacacacacuaagaaa

SEQ ID NO: 90966 - RNA, 32 nt, Human
cauaaagcgcuaggcccuagaacuccagaaac

SEQ ID NO: 90967 - RNA, 20 nt, Human
cauaaaggaaacuaagugcc

SEQ ID NO: 90968 - RNA, 32 nt, Human
cauaaaggaagacauuagauccagccauugug

SEQ ID NO: 90969 - RNA, 32 nt, Human
cauaaaggagaagauuugggagagggagagga

SEQ ID NO: 90970 - RNA, 32 nt, Human
cauaaaggcaaauccugaggaacucacugaug

SEQ ID NO: 90971 - RNA, 32 nt, Human
cauaaaggcauguacaacacaaaucaugcuuc

SEQ ID NO: 90972 - RNA, 32 nt, Human
cauaaaggggcagagucuucuuucagacccaa

SEQ ID NO: 90973 - RNA, 24 nt, Human
cauaaaguccucaguggcuuugaa

SEQ ID NO: 90974 - RNA, 32 nt, Human
cauaaagugcuauacagauauaggggauuaau

SEQ ID NO: 90975 - RNA, 32 nt, Human
cauaaagugcuugcaauuucucuccacaauug

SEQ ID NO: 90976 - RNA, 32 nt, Human
cauaaaguuagaauugagcuaauagaguggua

SEQ ID NO: 90977 - RNA, 32 nt, Human
cauaaauauguucuuuacugagggagcuuaga

SEQ ID NO: 90978 - RNA, 32 nt, Human
cauaaaucaaagcucaucaguucccauaaaug

SEQ ID NO: 90979 - RNA, 32 nt, Human
cauaaaucuuugugaccuguuguuaggcaaug

SEQ ID NO: 90980 - RNA, 32 nt, Human
cauaaaugaaagucucauaaaauaucauaaag

SEQ ID NO: 90981 - RNA, 32 nt, Human
cauaaaugaauuagaacugauuuuaauaaaaa

SEQ ID NO: 90982 - RNA, 32 nt, Human
cauaaaugucuggagccaaccuuggcaguuau

SEQ ID NO: 90983 - RNA, 32 nt, Human
cauaaauuaaucagccccagagugcuuuaaaa

SEQ ID NO: 90984 - RNA, 32 nt, Human
cauaaauuaaucagccccagagugucuuuaaa

SEQ ID NO: 90985 - RNA, 32 nt, Human
cauaaauuacaaaucagagcugaguggggagg

SEQ ID NO: 90986 - RNA, 32 nt, Human
cauaaauuagccaggcgugguggugcaugccu

SEQ ID NO: 90987 - RNA, 32 nt, Human
cauaaauuuacguucucagcaacuguuauuuc

SEQ ID NO: 90988 - RNA, 32 nt, Human
cauaaauuuagugucaaaacaugggagauggc

SEQ ID NO: 90989 - RNA, 32 nt, Human
cauaacaaauaccgagagcacugcaaguggag

SEQ ID NO: 90990 - RNA, 32 nt, Human
cauaacaacuuugauauugaugaaguucagcu

SEQ ID NO: 90991 - RNA, 32 nt, Human
cauaacacaugaauauccuacucuucaugggc

SEQ ID NO: 90992 - RNA, 32 nt, Human
cauaacacggcuuccugugcucucccuccaga

SEQ ID NO: 90993 - RNA, 32 nt, Human
cauaacacugcacuccaggcuggacaacacag

SEQ ID NO: 90994 - RNA, 23 nt, Human
cauaacagagcccaugcuggaag

SEQ ID NO: 90995 - RNA, 32 nt, Human
cauaacagccucccaagguguuuaacauggag

SEQ ID NO: 90996 - RNA, 32 nt, Human
cauaacagccuccugaugccugggcuuggcug

SEQ ID NO: 90997 - RNA, 32 nt, Human
cauaacaggaagguaucauuggcucugaauua

SEQ ID NO: 90998 - RNA, 32 nt, Human
cauaacagugacugauguugguuguaaugguu

SEQ ID NO: 90999 - RNA, 32 nt, Human
cauaacagugguuacccacgaggcagaccuua

SEQ ID NO: 91000 - RNA, 21 nt, Human
cauaacaguguugcuuggaaa

SEQ ID NO: 91001 - RNA, 32 nt, Human
cauaacaugauuacagucaacucuccauuauc

SEQ ID NO: 91002 - RNA, 31 nt, Human
cauaacauuggagaaagcugggugaagacug

SEQ ID NO: 91003 - RNA, 32 nt, Human
cauaaccacaccauugcauuccaaccugggga

SEQ ID NO: 91004 - RNA, 32 nt, Human
cauaaccacagcaagacugacauccacuuagg

SEQ ID NO: 91005 - RNA, 32 nt, Human
cauaaccacaugcacacacacucacgcaugag

SEQ ID NO: 91006 - RNA, 32 nt, Human
cauaaccagcacuccagaaaucucucugccau

SEQ ID NO: 91007 - RNA, 32 nt, Human
cauaaccaggccucagauacccaagggugcua

SEQ ID NO: 91008 - RNA, 32 nt, Human
cauaaccaggguggugagggcacuaaucuugu

SEQ ID NO: 91009 - RNA, 20 nt, Human
cauaaccaugagcacuacuc

SEQ ID NO: 91010 - RNA, 32 nt, Human
cauaaccccuacuguagaacuaaaugcacugu

SEQ ID NO: 91011 - RNA, 32 nt, Human
cauaacccuggugucaucccagaguccacugu

SEQ ID NO: 91012 - RNA, 32 nt, Human
cauaaccuacauccuucucugauuucuucagc

SEQ ID NO: 91013 - RNA, 32 nt, Human
cauaaccuccagaugcaucauggaugcugaac

SEQ ID NO: 91014 - RNA, 32 nt, Human
cauaaccuguaaaucacagguguccaaacuuu

SEQ ID NO: 91015 - RNA, 32 nt, Human
cauaaccuucucuucccuugaugaccugggau

SEQ ID NO: 91016 - RNA, 32 nt, Human
cauaacgcacacacacgccacccagccucuug

SEQ ID NO: 91017 - RNA, 32 nt, Human
cauaacgguuaagaaagcacuuaaacagaagc

SEQ ID NO: 91018 - RNA, 32 nt, Human
cauaacuaaaacccacagcccaaccaaaccuu

SEQ ID NO: 91019 - RNA, 32 nt, Human
cauaacuacaccugacaccaggcucugcugga

SEQ ID NO: 91020 - RNA, 32 nt, Human
cauaacuaggacuuuaucagaaacucaaagcu

SEQ ID NO: 91021 - RNA, 32 nt, Human
cauaacuagguugaguuuucuccucugcuaag

SEQ ID NO: 91022 - RNA, 32 nt, Human
cauaacuauaaucccagcuacuugggaggcug

SEQ ID NO: 91023 - RNA, 32 nt, Human
cauaacucacugcagccucaaacuucuggccu

SEQ ID NO: 91024 - RNA, 32 nt, Human
cauaacucagcccuuugggcggccucugggcu

SEQ ID NO: 91025 - RNA, 32 nt, Human
cauaacucguggacuacaaagcacaaaggacc

SEQ ID NO: 91026 - RNA, 32 nt, Human
cauaacugcauaugaacacauaugccauauac

SEQ ID NO: 91027 - RNA, 32 nt, Human
cauaacugccagcugcucuccccgagugcuca

SEQ ID NO: 91028 - RNA, 32 nt, Human
cauaacuuacuuccuuuuugucugagcaaugu

SEQ ID NO: 91029 - RNA, 32 nt, Human
cauaacuuauaugugaauaaaauacauauaag

SEQ ID NO: 91030 - RNA, 32 nt, Human
cauaagaaucuuggaaauugauaaaaacaucc

SEQ ID NO: 91031 - RNA, 32 nt, Human
cauaagaauucccauugcccagccucagugca

SEQ ID NO: 91032 - RNA, 32 nt, Human
cauaagacaagaaauauucuuguccaagugac

SEQ ID NO: 91033 - RNA, 32 nt, Human
cauaagaccaggaugucucugaaauggauguc

SEQ ID NO: 91034 - RNA, 32 nt, Human
cauaagacuaucuccccgccaccuauaguuag

SEQ ID NO: 91035 - RNA, 32 nt, Human
cauaagagagagaccgaauucuguggcucagc

SEQ ID NO: 91036 - RNA, 25 nt, Human
cauaagauacugauagcauugaguc

SEQ ID NO: 91037 - RNA, 31 nt, Human
cauaagaugcuucccacucuagcuuccauac

SEQ ID NO: 91038 - RNA, 24 nt, Human
cauaagauuucagggugucuucca

SEQ ID NO: 91039 - RNA, 32 nt, Human
cauaagcaaauacccaacaucacaaagaugau

SEQ ID NO: 91040 - RNA, 32 nt, Human
cauaagcagaagaucaaaaugcuaaaacauga

SEQ ID NO: 91041 - RNA, 21 nt, Human
cauaagcaguagacucccaca

SEQ ID NO: 91042 - RNA, 32 nt, Human
cauaagcaugcaauaaauguuagccagcuuag

SEQ ID NO: 91043 - RNA, 32 nt, Human
cauaagcaugccacuauacuccagccugggca

SEQ ID NO: 91044 - RNA, 22 nt, Human
cauaagcauggucuuccaguug

SEQ ID NO: 91045 - RNA, 32 nt, Human
cauaagccaacaaccgcugacuccaggauugc

SEQ ID NO: 91046 - RNA, 32 nt, Human
cauaagccaacaagagaaaccaucucugacca

SEQ ID NO: 91047 - RNA, 32 nt, Human
cauaagccacugcacccagcugaaaguuggua

SEQ ID NO: 91048 - RNA, 32 nt, Human
cauaagccacugcgccuggccuugauguguga

SEQ ID NO: 91049 - RNA, 32 nt, Human
cauaagcccuggggcuuuccugguggccccac

SEQ ID NO: 91050 - RNA, 32 nt, Human
cauaagccuaaacucuccuucacugcaaugcc

SEQ ID NO: 91051 - RNA, 32 nt, Human
cauaagccucugcaguguccucuuguuaaugg

SEQ ID NO: 91052 - RNA, 32 nt, Human
cauaagcucugccccugcacacccucauguca

SEQ ID NO: 91053 - RNA, 32 nt, Human
cauaagcucuguucccuguccugcuugggucc

SEQ ID NO: 91054 - RNA, 32 nt, Human
cauaagcugggucucaggcugggcucagcaaa

SEQ ID NO: 91055 - RNA, 22 nt, Human
cauaaggaagcuggggcaguga

SEQ ID NO: 91056 - RNA, 32 nt, Human
cauaaggaaggcaaugauaaagagauaguaau

SEQ ID NO: 91057 - RNA, 21 nt, Human
cauaaggaaggcagccaugug

SEQ ID NO: 91058 - RNA, 32 nt, Human
cauaaggacaggccacaccacagcagagacca

SEQ ID NO: 91059 - RNA, 32 nt, Human
cauaaggcaagagcaagaggauccucaggauu

SEQ ID NO: 91060 - RNA, 32 nt, Human
cauaaggcacugcuccccuuccaucucuagca

SEQ ID NO: 91061 - RNA, 32 nt, Human
cauaaggccuccauucuguccgcucagauucu

SEQ ID NO: 91062 - RNA, 32 nt, Human
cauaaggcuaagcuaggggugaacagaaggcc

SEQ ID NO: 91063 - RNA, 32 nt, Human
cauaaggcugucuuggaucccaacaggcaccc

SEQ ID NO: 91064 - RNA, 32 nt, Human
cauaaggcuuuuccucccuucucugguuucaa

SEQ ID NO: 91065 - RNA, 32 nt, Human
cauaagggaacaaacagcaaccauaacaaaaa

SEQ ID NO: 91066 - RNA, 32 nt, Human
cauaagggcagcagagguggaguagggaggag

SEQ ID NO: 91067 - RNA, 32 nt, Human
cauaaggggugagucagacaggucugauuugg

SEQ ID NO: 91068 - RNA, 32 nt, Human
cauaagguaccugaggccagggaucuuguguc

SEQ ID NO: 91069 - RNA, 32 nt, Human
cauaaggucauguagcuccugggaagcccgca

SEQ ID NO: 91070 - RNA, 32 nt, Human
cauaagguucucaaaggucucagaccuacaaa

SEQ ID NO: 91071 - RNA, 23 nt, Human
cauaagguucucuugucugaguc

SEQ ID NO: 91072 - RNA, 32 nt, Human
cauaaguacucagaacucuuaagaugcagaug

SEQ ID NO: 91073 - RNA, 32 nt, Human
cauaagucccuucccuuccuuacuccucacuc

SEQ ID NO: 91074 - RNA, 32 nt, Human
cauaagucucagauaagaagugauggugauaa

SEQ ID NO: 91075 - RNA, 32 nt, Human
cauaagucuuccuauaucaaaauaacaaugug

SEQ ID NO: 91076 - RNA, 24 nt, Human
cauaagugaaaauaaaaugucaua

SEQ ID NO: 91077 - RNA, 32 nt, Human
cauaaguggaggugagguacaggcuaagcugc

SEQ ID NO: 91078 - RNA, 32 nt, Human
cauaaguguaaauaugcaaauguauguauaca

SEQ ID NO: 91079 - RNA, 32 nt, Human
cauaaguucagccucauacuuuuugcauugau

SEQ ID NO: 91080 - RNA, 32 nt, Human
cauaaguucugcauagcaucuaaugucaaaau

SEQ ID NO: 91081 - RNA, 32 nt, Human
cauaauaagccuugauaucuaguagacuaauc

SEQ ID NO: 91082 - RNA, 32 nt, Human
cauaauaauguuuuaaagacuuaguugucagu

SEQ ID NO: 91083 - RNA, 32 nt, Human
cauaauacauggcuaucaucaaaaguguauag

SEQ ID NO: 91084 - RNA, 22 nt, Human
cauaauagaaaacucauggaaa

SEQ ID NO: 91085 - RNA, 32 nt, Human
cauaauagaguuguuuuucaacucuauguuug

SEQ ID NO: 91086 - RNA, 25 nt, Human
cauaauagccugagugcuuggguua

SEQ ID NO: 91087 - RNA, 32 nt, Human
cauaauaggcccacauaauuuccucuuucuua

SEQ ID NO: 91088 - RNA, 32 nt, Human
cauaauaucaaauuacuccagugauugagaac

SEQ ID NO: 91089 - RNA, 32 nt, Human
cauaauaucaguaccuuguucuggucacuguu

SEQ ID NO: 91090 - RNA, 32 nt, Human
cauaauaucuucauguaagaaccaucuguuuc

SEQ ID NO: 91091 - RNA, 32 nt, Human
cauaaucaaccaggagcuuauuauaggaaagg

SEQ ID NO: 91092 - RNA, 32 nt, Human
cauaaucagcagagucauuuuucacaaaacga

SEQ ID NO: 91093 - RNA, 32 nt, Human
cauaaucaugccacugcauucuagcuuugaug

SEQ ID NO: 91094 - RNA, 32 nt, Human
cauaaucaugccacuguacuccagccugggug

SEQ ID NO: 91095 - RNA, 32 nt, Human
cauaaucucaugaagaaauaaugagguauuua

SEQ ID NO: 91096 - RNA, 32 nt, Human
cauaaucucaugggacuucagugggaguuaca

SEQ ID NO: 91097 - RNA, 32 nt, Human
cauaaucucggcucacugcaagcccugccucc

SEQ ID NO: 91098 - RNA, 32 nt, Human
cauaaucuucuuuccuguuaguccaguuugau

SEQ ID NO: 91099 - RNA, 32 nt, Human
cauaaucuuuacccuucuccccaaacaaaaua

SEQ ID NO: 91100 - RNA, 24 nt, Human
cauaaugaaaccccaucucuacua

SEQ ID NO: 91101 - RNA, 24 nt, Human
cauaaugaaacccugucucuacua

SEQ ID NO: 91102 - RNA, 32 nt, Human
cauaaugaagccugcaugugcccagcuucaau

SEQ ID NO: 91103 - RNA, 32 nt, Human
cauaaugacagaaauacugagaagguucugug

SEQ ID NO: 91104 - RNA, 32 nt, Human
cauaaugacuacugauaaggcaucagaaugga

SEQ ID NO: 91105 - RNA, 32 nt, Human
cauaaugacuguuuaaggauguuucacaaaau

SEQ ID NO: 91106 - RNA, 32 nt, Human
cauaaugacuuucuuuuuccuuaaguauaaaa

SEQ ID NO: 91107 - RNA, 24 nt, Human
cauaaugagaccccaucucuacua

SEQ ID NO: 91108 - RNA, 21 nt, Human
cauaaugagaccucaugucua

SEQ ID NO: 91109 - RNA, 21 nt, Human
cauaaugagaccuguccucua

SEQ ID NO: 91110 - RNA, 32 nt, Human
cauaaugagguccugaauauuuaauaucauca

SEQ ID NO: 91111 - RNA, 32 nt, Human
cauaaugaguauuggguguucaagaggagggg

SEQ ID NO: 91112 - RNA, 32 nt, Human
cauaaugcaguaauauugauaacugaagauac

SEQ ID NO: 91113 - RNA, 32 nt, Human
cauaaugccuuugagauucuucugcuuguauc

SEQ ID NO: 91114 - RNA, 32 nt, Human
cauaauggaacaaauggcaaugugaguagguu

SEQ ID NO: 91115 - RNA, 24 nt, Human
cauaauggcacacaccuguagucc

SEQ ID NO: 91116 - RNA, 32 nt, Human
cauaauggcacacaccuguagucccagcuacu

SEQ ID NO: 91117 - RNA, 32 nt, Human
cauaauggggcugugagcucagccgaaagccc

SEQ ID NO: 91118 - RNA, 32 nt, Human
cauaaugggggcggaggcgggagugagaggag

SEQ ID NO: 91119 - RNA, 32 nt, Human
cauaauggucuuucacuugucauucuacuuuc

SEQ ID NO: 91120 - RNA, 32 nt, Human
cauaauggugcagaauaaaacacacacaucug

SEQ ID NO: 91121 - RNA, 24 nt, Human
cauaauggugcaugccuguagucc

SEQ ID NO: 91122 - RNA, 32 nt, Human
cauaauggugugcaccuguagucccagcuguu

SEQ ID NO: 91123 - RNA, 32 nt, Human
cauaauguaauucaaugaaaacuguuggagaa

SEQ ID NO: 91124 - RNA, 32 nt, Human
cauaaugucaguaacauacauauuccaguggu

SEQ ID NO: 91125 - RNA, 32 nt, Human
cauaaugucuuucugcauuaguuccuugcacg

SEQ ID NO: 91126 - RNA, 32 nt, Human
cauaaugugcuuaaccacugccuuuuaaaacu

SEQ ID NO: 91127 - RNA, 32 nt, Human
cauaauguguuaaagcccucuguggcugccac

SEQ ID NO: 91128 - RNA, 32 nt, Human
cauaauguuccccaggcuggucuccaacuccu

SEQ ID NO: 91129 - RNA, 32 nt, Human
cauaauuaaaaugucucuacuaaaaauacaaa

SEQ ID NO: 91130 - RNA, 32 nt, Human
cauaauuauuaacauuuacuucugguauggaa

SEQ ID NO: 91131 - RNA, 32 nt, Human
cauaauuauugagcaaaagauaccagaaacac

SEQ ID NO: 91132 - RNA, 32 nt, Human
cauaauuccuucagccugccuccucuuuaauc

SEQ ID NO: 91133 - RNA, 32 nt, Human
cauaauugacccugaacguaggaggaggaaaa

SEQ ID NO: 91134 - RNA, 32 nt, Human
cauaauugagugugucuuuguucaugcacuaa

SEQ ID NO: 91135 - RNA, 32 nt, Human
cauaauuggaacacuguguuuucacacagaga

SEQ ID NO: 91136 - RNA, 32 nt, Human
cauaauuguaaguuuucugaggccuccucaga

SEQ ID NO: 91137 - RNA, 32 nt, Human
cauaauugugccacugcacugcagccugggcg

SEQ ID NO: 91138 - RNA, 32 nt, Human
cauaauuguggacaauuggaggcauuuauuuu

SEQ ID NO: 91139 - RNA, 32 nt, Human
cauaauuguuauuaaagagaaaacacgcccac

SEQ ID NO: 91140 - RNA, 32 nt, Human
cauaauuuaguaggggacaagaagucuguucu

SEQ ID NO: 91141 - RNA, 32 nt, Human
cauaauuuaucuguucuccaguccaguugaag

SEQ ID NO: 91142 - RNA, 32 nt, Human
cauaauuucagaaaucagccaggugugauggc

SEQ ID NO: 91143 - RNA, 32 nt, Human
cauaauuuccagggggugauuuuguuuuuaga

SEQ ID NO: 91144 - RNA, 32 nt, Human
cauaauuucuacaggcacuugggaaacuaacu

SEQ ID NO: 91145 - RNA, 32 nt, Human
cauaauuucugagccucgguuuccccaucuaa

SEQ ID NO: 91146 - RNA, 32 nt, Human
cauaauuuuugguuuaggccauucuuuauaac

SEQ ID NO: 91147 - RNA, 32 nt, Human
cauacaaaauuagccgggcaugguggcaaaug

SEQ ID NO: 91148 - RNA, 32 nt, Human
cauacaaaauuagcugggcacaguggcacaug

SEQ ID NO: 91149 - RNA, 32 nt, Human
cauacaaaauuagcugggcaugguggcaaaug

SEQ ID NO: 91150 - RNA, 32 nt, Human
cauacaaaccagcagagugcugagggacgaua

SEQ ID NO: 91151 - RNA, 32 nt, Human
cauacaaagacagggcuugcuccucugcaaaa

SEQ ID NO: 91152 - RNA, 32 nt, Human
cauacaaagauaaauaagaugcccuugaugau

SEQ ID NO: 91153 - RNA, 32 nt, Human
cauacaacucagggaugccagguggcuuaccc

SEQ ID NO: 91154 - RNA, 32 nt, Human
cauacaagagguuucuuucauugucaaauuaa

SEQ ID NO: 91155 - RNA, 32 nt, Human
cauacaagccccgcuacagacaacagaauugg

SEQ ID NO: 91156 - RNA, 32 nt, Human
cauacaaggaaaguuaaguaaaugucuuuaca

SEQ ID NO: 91157 - RNA, 32 nt, Human
cauacaaguuugccccauucucuggcuugggg

SEQ ID NO: 91158 - RNA, 32 nt, Human
cauacacaaaugcacacacaugcacacacaca

SEQ ID NO: 91159 - RNA, 32 nt, Human
cauacacacacaaacacauacacacaacacua

SEQ ID NO: 91160 - RNA, 32 nt, Human
cauacacacaugcacacccucucacguccucc

SEQ ID NO: 91161 - RNA, 32 nt, Human
cauacacacaugcaccuacacaaacauuuaca

SEQ ID NO: 91162 - RNA, 32 nt, Human
cauacacacaugcacgcacgcacacgcacacc

SEQ ID NO: 91163 - RNA, 32 nt, Human
cauacacaccaacacacauaugcacacucaca

SEQ ID NO: 91164 - RNA, 32 nt, Human
cauacacacucauugacauacauucauucaca

SEQ ID NO: 91165 - RNA, 32 nt, Human
cauacacaggcugcgggcacucucuagggugg

SEQ ID NO: 91166 - RNA, 32 nt, Human
cauacacagugaauugaaaccauugugcaaaa

SEQ ID NO: 91167 - RNA, 32 nt, Human
cauacacagugacuugauguucuuggaggauc

SEQ ID NO: 91168 - RNA, 32 nt, Human
cauacacauaugcagacacaugccagggcccc

SEQ ID NO: 91169 - RNA, 32 nt, Human
cauacacauauguauauacaggcugacuugau

SEQ ID NO: 91170 - RNA, 32 nt, Human
cauacacaugcacacacacaugcacacauaua

SEQ ID NO: 91171 - RNA, 32 nt, Human
cauacacaugcaugcacacauacacaggcaua

SEQ ID NO: 91172 - RNA, 32 nt, Human
cauacacaugugcacacacacgcacucucccc

SEQ ID NO: 91173 - RNA, 32 nt, Human
cauacaccaccaggaaaugccgaggucaccac

SEQ ID NO: 91174 - RNA, 32 nt, Human
cauacaccaccagguccuuuauguguuguucu

SEQ ID NO: 91175 - RNA, 32 nt, Human
cauacaccagaacuucuauccugcaucacuua

SEQ ID NO: 91176 - RNA, 32 nt, Human
cauacacgcaaauacacuccaguuuuuguuuu

SEQ ID NO: 91177 - RNA, 32 nt, Human
cauacacgcacaugcacacauacacaugcaug

SEQ ID NO: 91178 - RNA, 23 nt, Human
cauacacgucggccaugcagcag

SEQ ID NO: 91179 - RNA, 32 nt, Human
cauacacuauuuuaacacuuuuaaucugagaa

SEQ ID NO: 91180 - RNA, 32 nt, Human
cauacacucuagaccaaaauaaggcaucauaa

SEQ ID NO: 91181 - RNA, 17 nt, Human
cauacacugugaacuca

SEQ ID NO: 91182 - RNA, 32 nt, Human
cauacacugugaacucaaucuccagggcucca

SEQ ID NO: 91183 - RNA, 32 nt, Human
cauacagaauugcugacaggagcaggagacgc

SEQ ID NO: 91184 - RNA, 32 nt, Human
cauacagacucacauacagacacacacauaua

SEQ ID NO: 91185 - RNA, 31 nt, Human
cauacagauucuggucuacauuuagaaccuu

SEQ ID NO: 91186 - RNA, 32 nt, Human
cauacagcaaacaaaaaugcacaaagccugcu

SEQ ID NO: 91187 - RNA, 32 nt, Human
cauacagcagaggcauugaacacacaccacca

SEQ ID NO: 91188 - RNA, 32 nt, Human
cauacaggacaguccagcuggaugugauaaag

SEQ ID NO: 91189 - RNA, 32 nt, Human
cauacaggagccucgguuuuucagcaaaacgc

SEQ ID NO: 91190 - RNA, 32 nt, Human
cauacaggaguccuccuuucugagcuccagcc

SEQ ID NO: 91191 - RNA, 32 nt, Human
cauacaggccaauuccagggugcagugcagca

SEQ ID NO: 91192 - RNA, 32 nt, Human
cauacaggccaggaaagccaaaugaagucauu

SEQ ID NO: 91193 - RNA, 32 nt, Human
cauacagggucuccuuagcagcuguauucugg

SEQ ID NO: 91194 - RNA, 32 nt, Human
cauacagggucuccuuggcagcuguauucugg

SEQ ID NO: 91195 - RNA, 32 nt, Human
cauacaggugccagacacuguuugugcuuuug

SEQ ID NO: 91196 - RNA, 32 nt, Human
cauacaggugcugaagggaggacuuguugaag

SEQ ID NO: 91197 - RNA, 32 nt, Human
cauacagucccagcuacucaggaggcugaagc

SEQ ID NO: 91198 - RNA, 32 nt, Human
cauacauacacacauacauacauaugcacaca

SEQ ID NO: 91199 - RNA, 32 nt, Human
cauacauacacauacacacaugcacauauguc

SEQ ID NO: 91200 - RNA, 32 nt, Human
cauacauacauacauauguauacauuuccagu

SEQ ID NO: 91201 - RNA, 32 nt, Human
cauacauauauacacacauauguauauaaaau

SEQ ID NO: 91202 - RNA, 32 nt, Human
cauacaucaagccagagagcggggcuuaggga

SEQ ID NO: 91203 - RNA, 31 nt, Human
cauacaucacucaaguuugagaaccacugca

SEQ ID NO: 91204 - RNA, 21 nt, Human
cauacaucccagagcuugccc

SEQ ID NO: 91205 - RNA, 32 nt, Human
cauacaucccugcacuguguguuuucauuuuu

SEQ ID NO: 91206 - RNA, 32 nt, Human
cauacauccuaaaagcaccacagcagaggagg

SEQ ID NO: 91207 - RNA, 32 nt, Human
cauacaucggauaugugaaaagcacaacaaaa

SEQ ID NO: 91208 - RNA, 32 nt, Human
cauacaugcaugcacacauacauacauaugua

SEQ ID NO: 91209 - RNA, 32 nt, Human
cauacaugcaugcacacauacauaugcacgca

SEQ ID NO: 91210 - RNA, 32 nt, Human
cauacaugugcucggggcugggcgcgguggcu

SEQ ID NO: 91211 - RNA, 32 nt, Human
cauacauucauuuugacuccuuucaaugucac

SEQ ID NO: 91212 - RNA, 32 nt, Human
cauacauucugcaacaaccagggacuucacag

SEQ ID NO: 91213 - RNA, 32 nt, Human
cauacauuguccacaggugagaagauuaaauc

SEQ ID NO: 91214 - RNA, 31 nt, Human
cauacauuuaacuaggggguuggagggggcu

SEQ ID NO: 91215 - RNA, 32 nt, Human
cauacauuuuucucuucucuucuccugacguc

SEQ ID NO: 91216 - RNA, 32 nt, Human
cauacauuuuugaaaugaaaugugcuuaggaa

SEQ ID NO: 91217 - RNA, 32 nt, Human
cauaccaaaaucagggucacauguggguuucc

SEQ ID NO: 91218 - RNA, 32 nt, Human
cauaccaacaugcuccagccugagugagagag

SEQ ID NO: 91219 - RNA, 32 nt, Human
cauaccacacacauuaucauuguuaaacuuug

SEQ ID NO: 91220 - RNA, 32 nt, Human
cauaccacccccagucaaaagagugggagaaa

SEQ ID NO: 91221 - RNA, 32 nt, Human
cauaccaccgcacuccagccugagcaacagag

SEQ ID NO: 91222 - RNA, 32 nt, Human
cauaccacggcacuccagccugggugacagug

SEQ ID NO: 91223 - RNA, 32 nt, Human
cauaccacugcacuccagccuggcgacagagc

SEQ ID NO: 91224 - RNA, 32 nt, Human
cauaccacugcacuccagccugggcgacagag

SEQ ID NO: 91225 - RNA, 32 nt, Human
cauaccacugcacuccagccugggugacagag

SEQ ID NO: 91226 - RNA, 32 nt, Human
cauaccacugcacuccagucugggcaacagag

SEQ ID NO: 91227 - RNA, 32 nt, Human
cauaccacugcacugcagccugagugacacag

SEQ ID NO: 91228 - RNA, 32 nt, Human
cauaccacugcacuuaacuuggcaacagagca

SEQ ID NO: 91229 - RNA, 32 nt, Human
cauaccacugcauuccagccugggugacagag

SEQ ID NO: 91230 - RNA, 32 nt, Human
cauaccacuguacugcagucugggccacacag

SEQ ID NO: 91231 - RNA, 32 nt, Human
cauaccacuucauuccagccugggugacagag

SEQ ID NO: 91232 - RNA, 32 nt, Human
cauaccagagaaucauaaaaacaaaaaccuca

SEQ ID NO: 91233 - RNA, 32 nt, Human
cauaccagccuaggugacagaaugagacccug

SEQ ID NO: 91234 - RNA, 32 nt, Human
cauaccaggaaugaccaagggcaauuuggagg

SEQ ID NO: 91235 - RNA, 32 nt, Human
cauaccagggaugcucucuaacguaaucaagg

SEQ ID NO: 91236 - RNA, 32 nt, Human
cauaccagugaagggaaggggcucccauggac

SEQ ID NO: 91237 - RNA, 32 nt, Human
cauaccagugcacuccaggcgggugacagagc

SEQ ID NO: 91238 - RNA, 32 nt, Human
cauaccagugcauuccagccuggguacacagc

SEQ ID NO: 91239 - RNA, 32 nt, Human
cauaccauaagcauuuaaaaacauaugaaaua

SEQ ID NO: 91240 - RNA, 32 nt, Human
cauaccauuacgagugccucagccuggaaaag

SEQ ID NO: 91241 - RNA, 32 nt, Human
cauaccauucccauuuucucagccucuucucu

SEQ ID NO: 91242 - RNA, 32 nt, Human
cauaccauugcacuccagccuaggcaacaaga

SEQ ID NO: 91243 - RNA, 32 nt, Human
cauaccauugcacuccagccugggcaacaaga

SEQ ID NO: 91244 - RNA, 32 nt, Human
cauacccaaagugcaaucucacggccagguuc

SEQ ID NO: 91245 - RNA, 32 nt, Human
cauacccaccucugcccuccucaccuuccagu

SEQ ID NO: 91246 - RNA, 20 nt, Human
cauacccagcagccugcaga

SEQ ID NO: 91247 - RNA, 32 nt, Human
cauaccccacccagguuccugccugugauucc

SEQ ID NO: 91248 - RNA, 32 nt, Human
cauaccccaggcuuuaggaggcugaggugggg

SEQ ID NO: 91249 - RNA, 32 nt, Human
cauaccccaucuuaacucucuccagugagaac

SEQ ID NO: 91250 - RNA, 32 nt, Human
cauacccccgccccgagacuguuuccagugcc

SEQ ID NO: 91251 - RNA, 32 nt, Human
cauaccccucaccaucauuaccaccaucacca

SEQ ID NO: 91252 - RNA, 32 nt, Human
cauaccccuccagacaggaagcauggguuugc

SEQ ID NO: 91253 - RNA, 32 nt, Human
cauacccucagagucugggccuaucaucuucu

SEQ ID NO: 91254 - RNA, 32 nt, Human
cauacccucccucuccacaaccccugucacau

SEQ ID NO: 91255 - RNA, 32 nt, Human
cauacccugcagcucucagcuggcugcaguaa

SEQ ID NO: 91256 - RNA, 32 nt, Human
cauacccuggacacaucuaugggagcuuuuua

SEQ ID NO: 91257 - RNA, 32 nt, Human
cauacccuggggaccgggggagggcuggugcu

SEQ ID NO: 91258 - RNA, 32 nt, Human
cauaccguguacccuagguaugguggcuacac

SEQ ID NO: 91259 - RNA, 32 nt, Human
cauaccuauguacacacacaagauugcauuau

SEQ ID NO: 91260 - RNA, 32 nt, Human
cauaccucacugcagccucuugggcuuaugug

SEQ ID NO: 91261 - RNA, 32 nt, Human
cauaccucacugcagcuucaacuuccugggcu

SEQ ID NO: 91262 - RNA, 32 nt, Human
cauaccucacugcggccucaaacuccugggcu

SEQ ID NO: 91263 - RNA, 32 nt, Human
cauaccucccggggcuugcacacaccuucuuc

SEQ ID NO: 91264 - RNA, 32 nt, Human
cauaccucuagucauagcauaccauuuaucgg

SEQ ID NO: 91265 - RNA, 24 nt, Human
cauaccugggccagagugcagcgg

SEQ ID NO: 91266 - RNA, 31 nt, Human
cauaccugggugaugagaugaucugugcagc

SEQ ID NO: 91267 - RNA, 32 nt, Human
cauaccuguaaaucccagcacuuugggaggcc

SEQ ID NO: 91268 - RNA, 32 nt, Human
cauaccuguaaucccagcuacucgggaaccug

SEQ ID NO: 91269 - RNA, 32 nt, Human
cauaccuguaaucccagcuacucgggaggcug

SEQ ID NO: 91270 - RNA, 32 nt, Human
cauaccuguaaucccagcuacuuggaauugga

SEQ ID NO: 91271 - RNA, 32 nt, Human
cauaccuguaaucccagcuacuugggaggcug

SEQ ID NO: 91272 - RNA, 32 nt, Human
cauaccuguaaucucugcuauuugggagacug

SEQ ID NO: 91273 - RNA, 32 nt, Human
cauaccuguagucccagcuacgugagaggcug

SEQ ID NO: 91274 - RNA, 32 nt, Human
cauaccuguagucccagcuacucaggaggcug

SEQ ID NO: 91275 - RNA, 32 nt, Human
cauaccuguagucccagcuacucuggaggcug

SEQ ID NO: 91276 - RNA, 32 nt, Human
cauaccuguagucccagcuacuugggaggcua

SEQ ID NO: 91277 - RNA, 32 nt, Human
cauaccuguagucccagcuacuugggaggcug

SEQ ID NO: 91278 - RNA, 32 nt, Human
cauaccuguagucccagcuauucaggagcugu

SEQ ID NO: 91279 - RNA, 32 nt, Human
cauaccugucugcuucagcaacugcuuugcaa

SEQ ID NO: 91280 - RNA, 32 nt, Human
cauaccuguggcuccagaagcucuugggacca

SEQ ID NO: 91281 - RNA, 32 nt, Human
cauaccuguggucucagcuauucaggaggcca

SEQ ID NO: 91282 - RNA, 32 nt, Human
cauaccuucucccaggccucugccccaagagc

SEQ ID NO: 91283 - RNA, 32 nt, Human
cauaccuugcccauucccucugaauauuaggu

SEQ ID NO: 91284 - RNA, 32 nt, Human
cauacgacugaucuugauuuuuggaaaugaau

SEQ ID NO: 91285 - RNA, 23 nt, Human
cauacgcccgggccccaaggccc

SEQ ID NO: 91286 - RNA, 32 nt, Human
cauacgccucaaccuuuacacgcacggucacu

SEQ ID NO: 91287 - RNA, 32 nt, Human
cauacgccuguaauccuagcuacuugggaggc

SEQ ID NO: 91288 - RNA, 32 nt, Human
cauacgccuuucaucccuccuucuagggccua

SEQ ID NO: 91289 - RNA, 32 nt, Human
cauacggggagccaggguuugcaaugagucua

SEQ ID NO: 91290 - RNA, 32 nt, Human
cauacguccccuucauuuagguacauugugau

SEQ ID NO: 91291 - RNA, 32 nt, Human
cauacgucuuccagccucuccaggucaagcuc

SEQ ID NO: 91292 - RNA, 32 nt, Human
cauacgugcacacacacauacauauucauaca

SEQ ID NO: 91293 - RNA, 32 nt, Human
cauacgugcuggaaaugcugugaucugcccug

SEQ ID NO: 91294 - RNA, 32 nt, Human
cauacguguaccacaaagagugugagaaagaa

SEQ ID NO: 91295 - RNA, 32 nt, Human
cauacguuuuugucccccuaagguuccagauu

SEQ ID NO: 91296 - RNA, 32 nt, Human
cauacuacacagaucacucugggcucacuugc

SEQ ID NO: 91297 - RNA, 32 nt, Human
cauacuacugcacuccagccugggcgacaaga

SEQ ID NO: 91298 - RNA, 32 nt, Human
cauacuagaagggcauuggccauucuauugug

SEQ ID NO: 91299 - RNA, 31 nt, Human
cauacuaugacaaucuuauugucaacacuau

SEQ ID NO: 91300 - RNA, 32 nt, Human
cauacuauguguuugcaguaguguucaagugu

SEQ ID NO: 91301 - RNA, 32 nt, Human
cauacucaaguugcacggucagccugguggaa

SEQ ID NO: 91302 - RNA, 32 nt, Human
cauacucacucacucuccaccagccugggaaa

SEQ ID NO: 91303 - RNA, 32 nt, Human
cauacucacuccugacagcuuuccugcacugc

SEQ ID NO: 91304 - RNA, 32 nt, Human
cauacucaggagccuucuucaccagcuccuug

SEQ ID NO: 91305 - RNA, 32 nt, Human
cauacucaguggccuccagacaaacuccagac

SEQ ID NO: 91306 - RNA, 32 nt, Human
cauacucaucuccauguucugugaauuagcaa

SEQ ID NO: 91307 - RNA, 32 nt, Human
cauacuccaacuugguucugcaaagaauaccc

SEQ ID NO: 91308 - RNA, 32 nt, Human
cauacucccacauacuuacccacauguacaca

SEQ ID NO: 91309 - RNA, 32 nt, Human
cauacuccuaucuccuccucuuggcucucaau

SEQ ID NO: 91310 - RNA, 32 nt, Human
cauacuccucaaacuccuccuccucagccgug

SEQ ID NO: 91311 - RNA, 17 nt, Human
cauacuccuugaaccua

SEQ ID NO: 91312 - RNA, 20 nt, Human
cauacuccuuuuaagcagug

SEQ ID NO: 91313 - RNA, 22 nt, Human
cauacucuaucuuuccccacaa

SEQ ID NO: 91314 - RNA, 32 nt, Human
cauacucuccaaugcccaaaaauagcaaggug

SEQ ID NO: 91315 - RNA, 32 nt, Human
cauacucucucgcccaggcuggagugcagugg

SEQ ID NO: 91316 - RNA, 31 nt, Human
cauacucugacaaucuuauugucaacacuau

SEQ ID NO: 91317 - RNA, 32 nt, Human
cauacucugcucccuacuggcugucuuggggg

SEQ ID NO: 91318 - RNA, 32 nt, Human
cauacucuggcugccucuuugccuuccuaggg

SEQ ID NO: 91319 - RNA, 32 nt, Human
cauacucuuuuaaaucaaggaggcuguaguag

SEQ ID NO: 91320 - RNA, 32 nt, Human
cauacugaagacaaacuuguuucaaugauagu

SEQ ID NO: 91321 - RNA, 32 nt, Human
cauacugaagcuccagccagggggaugggucc

SEQ ID NO: 91322 - RNA, 32 nt, Human
cauacugacacugucagcucuccuggguggca

SEQ ID NO: 91323 - RNA, 32 nt, Human
cauacugacuucagugggacucggugagccgg

SEQ ID NO: 91324 - RNA, 32 nt, Human
cauacugauaaucagcuuuauuuuacaaaaga

SEQ ID NO: 91325 - RNA, 32 nt, Human
cauacugaucuuuagccaucagauugaucuuc

SEQ ID NO: 91326 - RNA, 32 nt, Human
cauacugaugccacugugcugcaucuuaauau

SEQ ID NO: 91327 - RNA, 26 nt, Human
cauacugauggcagggcuggccaggg

SEQ ID NO: 91328 - RNA, 32 nt, Human
cauacugcuaagucagcuacuuugccaagaaa

SEQ ID NO: 91329 - RNA, 32 nt, Human
cauacugcuuacgucuuagccauuccguccug

SEQ ID NO: 91330 - RNA, 32 nt, Human
cauacuggagacagccaagagcugaguauaua

SEQ ID NO: 91331 - RNA, 18 nt, Human
cauacuggagagaaaccu

SEQ ID NO: 91332 - RNA, 17 nt, Human
cauacuggagagagccu

SEQ ID NO: 91333 - RNA, 32 nt, Human
cauacuggcagauccuuguagggaaggagaga

SEQ ID NO: 91334 - RNA, 32 nt, Human
cauacuggccucuuuugggcccucucuuacac

SEQ ID NO: 91335 - RNA, 32 nt, Human
cauacuggcuaacacggugaaaccccgucucu

SEQ ID NO: 91336 - RNA, 32 nt, Human
cauacuuacauguguguauauguagauguaug

SEQ ID NO: 91337 - RNA, 32 nt, Human
cauacuuagauccuaacgugccagugagaccu

SEQ ID NO: 91338 - RNA, 32 nt, Human
cauacuuaucucucugugcuguggaagcaaca

SEQ ID NO: 91339 - RNA, 32 nt, Human
cauacuucaccuagagaagacaguauuggcaa

SEQ ID NO: 91340 - RNA, 32 nt, Human
cauacuucauuucuuuccuccucucuugcugu

SEQ ID NO: 91341 - RNA, 32 nt, Human
cauacuugaagucccagcuguuugggaggcug

SEQ ID NO: 91342 - RNA, 32 nt, Human
cauacuugacuagccuggacuccagucgacug

SEQ ID NO: 91343 - RNA, 20 nt, Human
cauacuugccuacugggccc

SEQ ID NO: 91344 - RNA, 24 nt, Human
cauacuugcucuuuuugucuucuu

SEQ ID NO: 91345 - RNA, 32 nt, Human
cauacuugcuguucuuucaggguuugcaauua

SEQ ID NO: 91346 - RNA, 32 nt, Human
cauacuugggcuguaguuuggagacaaaauau

SEQ ID NO: 91347 - RNA, 32 nt, Human
cauacuuggggugagagggagcugaggauguc

SEQ ID NO: 91348 - RNA, 32 nt, Human
cauacuuguaaucccagcuauugggaaggaug

SEQ ID NO: 91349 - RNA, 32 nt, Human
cauacuuguggauguaccuuucaaauauguuu

SEQ ID NO: 91350 - RNA, 32 nt, Human
cauacuuuaaaauguucagguagcagugagca

SEQ ID NO: 91351 - RNA, 32 nt, Human
cauacuuucccucauccaugcugugcuguguu

SEQ ID NO: 91352 - RNA, 32 nt, Human
cauagaaaccuacugacaaaaugaguauuuua

SEQ ID NO: 91353 - RNA, 32 nt, Human
cauagaaagacaugggcuaucagggaggaaga

SEQ ID NO: 91354 - RNA, 32 nt, Human
cauagaacaucuaggcagucuugacagucaac

SEQ ID NO: 91355 - RNA, 32 nt, Human
cauagaacgaguucuguaucccucaggccuga

SEQ ID NO: 91356 - RNA, 32 nt, Human
cauagaagaacagucugcauuugugauacacc

SEQ ID NO: 91357 - RNA, 32 nt, Human
cauagaagagcaucgacugugucacuuaaaau

SEQ ID NO: 91358 - RNA, 32 nt, Human
cauagaagaggcagugcgcugaagggacaggu

SEQ ID NO: 91359 - RNA, 32 nt, Human
cauagaagccauuggggaguucaguggaaguu

SEQ ID NO: 91360 - RNA, 32 nt, Human
cauagaaggaagcaaugccacggcuccagggu

SEQ ID NO: 91361 - RNA, 32 nt, Human
cauagaaggagagaauagaauggugguuauca

SEQ ID NO: 91362 - RNA, 32 nt, Human
cauagaaucugccuccuuugaccuuguucaau

SEQ ID NO: 91363 - RNA, 32 nt, Human
cauagaauucuagcuuucuuccuccuuucucu

SEQ ID NO: 91364 - RNA, 32 nt, Human
cauagaauuuuagguggggaagaggcauuuug

SEQ ID NO: 91365 - RNA, 32 nt, Human
cauagacaaccaggacacucuacacucuauuc

SEQ ID NO: 91366 - RNA, 32 nt, Human
cauagacacacacauauacagcucucucuugu

SEQ ID NO: 91367 - RNA, 32 nt, Human
cauagacaccucccaaaggucuucccaucagu

SEQ ID NO: 91368 - RNA, 32 nt, Human
cauagacagaugggcagaugcacccagagccc

SEQ ID NO: 91369 - RNA, 32 nt, Human
cauagaccccuaggcugcugugcggugggacu

SEQ ID NO: 91370 - RNA, 32 nt, Human
cauagacccugcccauauuuugcuagauugug

SEQ ID NO: 91371 - RNA, 32 nt, Human
cauagacucauggaacugaagggaccuuagca

SEQ ID NO: 91372 - RNA, 32 nt, Human
cauagacugaaccaaucuuuuugacuuuuugc

SEQ ID NO: 91373 - RNA, 32 nt, Human
cauagacuuagcaagucuugccuuaucuaugg

SEQ ID NO: 91374 - RNA, 32 nt, Human
cauagacuugacuuccuuaaaccgagaguuuu

SEQ ID NO: 91375 - RNA, 24 nt, Human
cauagagaaacacaauuagccacu

SEQ ID NO: 91376 - RNA, 32 nt, Human
cauagagaacaccaccaccauggccaggugga

SEQ ID NO: 91377 - RNA, 32 nt, Human
cauagagaagaguaagaauguagaccagcuua

SEQ ID NO: 91378 - RNA, 32 nt, Human
cauagagacuggguuucaccauguagaccagg

SEQ ID NO: 91379 - RNA, 32 nt, Human
cauagagauaugcacacacagaugcacacaca

SEQ ID NO: 91380 - RNA, 32 nt, Human
cauagagcacacaagaaccccaauauuaaugc

SEQ ID NO: 91381 - RNA, 32 nt, Human
cauagagcauacaauagcgccuacuucacgga

SEQ ID NO: 91382 - RNA, 32 nt, Human
cauagagccugcaaauggauccuccugugaga

SEQ ID NO: 91383 - RNA, 32 nt, Human
cauagagcuuucuccgcagcauccugccugcg

SEQ ID NO: 91384 - RNA, 23 nt, Human
cauagaggguaccauucugcgcu

SEQ ID NO: 91385 - RNA, 21 nt, Human
cauagagggucccagccuacu

SEQ ID NO: 91386 - RNA, 32 nt, Human
cauagaggucagaacuguuaauaaaaguuaaa

SEQ ID NO: 91387 - RNA, 32 nt, Human
cauagagucauuugcuuugauagucaucugac

SEQ ID NO: 91388 - RNA, 32 nt, Human
cauagaguccguggcuuacagugagaacuuau

SEQ ID NO: 91389 - RNA, 32 nt, Human
cauagaguccucucaaugggaaccugauugau

SEQ ID NO: 91390 - RNA, 23 nt, Human
cauagagugaaauauucaacuua

SEQ ID NO: 91391 - RNA, 32 nt, Human
cauagaguuagcaaccaugcuucucauucccu

SEQ ID NO: 91392 - RNA, 32 nt, Human
cauagauacaucuugcucugacuccagcugag

SEQ ID NO: 91393 - RNA, 32 nt, Human
cauagaucacugcagccucaaacuccugggcu

SEQ ID NO: 91394 - RNA, 32 nt, Human
cauagaucauaguccaauccccuagacccaaa

SEQ ID NO: 91395 - RNA, 32 nt, Human
cauagaucccauagugugcaucauguuccuua

SEQ ID NO: 91396 - RNA, 32 nt, Human
cauagauccucccuuauuuaacaucagaaaaa

SEQ ID NO: 91397 - RNA, 32 nt, Human
cauagaugagacaacgaaguucucucugucac

SEQ ID NO: 91398 - RNA, 32 nt, Human
cauagaugcagccuugcagccucuccagaugu

SEQ ID NO: 91399 - RNA, 32 nt, Human
cauagaugcccuuugaaaaccaucuaccuggu

SEQ ID NO: 91400 - RNA, 32 nt, Human
cauagaugcuagugaggcugcagagaaaagca

SEQ ID NO: 91401 - RNA, 32 nt, Human
cauagauggaaagacugcccuuuuccauuugc

SEQ ID NO: 91402 - RNA, 32 nt, Human
cauagaugucccuuucuuggccaguuaucccu

SEQ ID NO: 91403 - RNA, 32 nt, Human
cauagauucaacaaugccuaagaaugccucuu

SEQ ID NO: 91404 - RNA, 32 nt, Human
cauagauuuccucuuugagaacaucaaccuga

SEQ ID NO: 91405 - RNA, 32 nt, Human
cauagcaaaauggacuuugcagaugugauuaa

SEQ ID NO: 91406 - RNA, 32 nt, Human
cauagcaagguucacuccagccgugcuuucug

SEQ ID NO: 91407 - RNA, 32 nt, Human
cauagcaauugcacuccggccugggcaacaag

SEQ ID NO: 91408 - RNA, 32 nt, Human
cauagcacacugcuugaggcccugccaggcac

SEQ ID NO: 91409 - RNA, 32 nt, Human
cauagcaccaaaggaauccuccuguccccucu

SEQ ID NO: 91410 - RNA, 32 nt, Human
cauagcacuccagccuuagccugggcgacaga

SEQ ID NO: 91411 - RNA, 32 nt, Human
cauagcacuccccuccgcucccuucuuaggca

SEQ ID NO: 91412 - RNA, 32 nt, Human
cauagcacugccucuuuccaggggccucuggg

SEQ ID NO: 91413 - RNA, 32 nt, Human
cauagcacuggccauggucaggguuguuggaa

SEQ ID NO: 91414 - RNA, 32 nt, Human
cauagcaggaaaagccggagcccagggaggga

SEQ ID NO: 91415 - RNA, 31 nt, Human
cauagcaggaacuucuuucagcccuuuaggc

SEQ ID NO: 91416 - RNA, 32 nt, Human
cauagcagguaagaacauggaggcagagccag

SEQ ID NO: 91417 - RNA, 32 nt, Human
cauagcaguaaagguguuccuuccuggcagcg

SEQ ID NO: 91418 - RNA, 32 nt, Human
cauagcagugccuggcccagcggggacaacau

SEQ ID NO: 91419 - RNA, 32 nt, Human
cauagcaguggauuccaugaaaggagucauuu

SEQ ID NO: 91420 - RNA, 32 nt, Human
cauagcaguucagugccuuuguugguaguuuu

SEQ ID NO: 91421 - RNA, 32 nt, Human
cauagcaguuccucccacagggugggacacca

SEQ ID NO: 91422 - RNA, 32 nt, Human
cauagcaguucuguagcucaugagucuggcac

SEQ ID NO: 91423 - RNA, 32 nt, Human
cauagcaucccccucuauuuccaaugcuccuc

SEQ ID NO: 91424 - RNA, 32 nt, Human
cauagccacaguuugcaaaaagugcagcuauu

SEQ ID NO: 91425 - RNA, 32 nt, Human
cauagccaccuaggggaggaggccgugugaag

SEQ ID NO: 91426 - RNA, 32 nt, Human
cauagccagcaggccacuuuucacuaacagaa

SEQ ID NO: 91427 - RNA, 32 nt, Human
cauagccagcccacccaccuccccugccacag

SEQ ID NO: 91428 - RNA, 17 nt, Human
cauagccagcuccucua

SEQ ID NO: 91429 - RNA, 32 nt, Human
cauagcccaaccaugugagaagaaggagaagg

SEQ ID NO: 91430 - RNA, 32 nt, Human
cauagcccagguuccagguguccugggcagcc

SEQ ID NO: 91431 - RNA, 32 nt, Human
cauagccccagagauggcuggggacacagaag

SEQ ID NO: 91432 - RNA, 32 nt, Human
cauagcccccaucuauggacaggcugggacag

SEQ ID NO: 91433 - RNA, 32 nt, Human
cauagcccccuucuacuacuuucccucucgcc

SEQ ID NO: 91434 - RNA, 32 nt, Human
cauagccccuuguggcugccaggcagcacacc

SEQ ID NO: 91435 - RNA, 19 nt, Human
cauagcccugcugcugcca

SEQ ID NO: 91436 - RNA, 32 nt, Human
cauagcccugguacaugguacacacaccccca

SEQ ID NO: 91437 - RNA, 32 nt, Human
cauagccgaucuugccuucagaaugcucagaa

SEQ ID NO: 91438 - RNA, 23 nt, Human
cauagccgguagaaaaauuugaa

SEQ ID NO: 91439 - RNA, 15 nt, Human
cauagccuccugguc

SEQ ID NO: 91440 - RNA, 32 nt, Human
cauagccucuacuuuucagccaguuugcauuu

SEQ ID NO: 91441 - RNA, 32 nt, Human
cauagccugcagccucaucauuucccaucugg

SEQ ID NO: 91442 - RNA, 32 nt, Human
cauagccugccugucugcaugguccgccuaga

SEQ ID NO: 91443 - RNA, 32 nt, Human
cauagccugcugugaugagcuuccaggucgcu

SEQ ID NO: 91444 - RNA, 32 nt, Human
cauagccuguauaaauaccagauuagaacaua

SEQ ID NO: 91445 - RNA, 32 nt, Human
cauagccuugaggaggcuucucagccaccaaa

SEQ ID NO: 91446 - RNA, 32 nt, Human
cauagcgcugcacucagucggacugaacguag

SEQ ID NO: 91447 - RNA, 17 nt, Human
cauagcgggcgcugcca

SEQ ID NO: 91448 - RNA, 32 nt, Human
cauagcggugguggggcagggagccaguuucc

SEQ ID NO: 91449 - RNA, 32 nt, Human
cauagcuacuauaugcauaaacaacaguaccu

SEQ ID NO: 91450 - RNA, 32 nt, Human
cauagcucacugcaaccucaaacuccugggcu

SEQ ID NO: 91451 - RNA, 32 nt, Human
cauagcucacugcacccucaaccuccuggguu

SEQ ID NO: 91452 - RNA, 32 nt, Human
cauagcucacugcagacuccaacuccuggccu

SEQ ID NO: 91453 - RNA, 32 nt, Human
cauagcucacugcagcaucaaauuccuaggcu

SEQ ID NO: 91454 - RNA, 32 nt, Human
cauagcucacugcagccucaaacuccuggauu

SEQ ID NO: 91455 - RNA, 32 nt, Human
cauagcucacugcagccucaaacuccugggcu

SEQ ID NO: 91456 - RNA, 32 nt, Human
cauagcucacugcagccucaaacucuuuggcu

SEQ ID NO: 91457 - RNA, 32 nt, Human
cauagcucacugcagccucauacuccugggcu

SEQ ID NO: 91458 - RNA, 32 nt, Human
cauagcucacugcagccuccaacuccuggguu

SEQ ID NO: 91459 - RNA, 32 nt, Human
cauagcucacugcagccucgaacuccugggcu

SEQ ID NO: 91460 - RNA, 32 nt, Human
cauagcucacugcagccucgaacucuugggcu

SEQ ID NO: 91461 - RNA, 32 nt, Human
cauagcucacugcagccuggaacuccugggcu

SEQ ID NO: 91462 - RNA, 32 nt, Human
cauagcucacugcagccuggaacuccuuggcu

SEQ ID NO: 91463 - RNA, 32 nt, Human
cauagcucacugcagccuucaacuucugggcu

SEQ ID NO: 91464 - RNA, 32 nt, Human
cauagcucacugcagccuugaacuccuggacu

SEQ ID NO: 91465 - RNA, 32 nt, Human
cauagcucacugcagccuugaacuccugggau

SEQ ID NO: 91466 - RNA, 32 nt, Human
cauagcucacugcagccuugaauuccuaggcu

SEQ ID NO: 91467 - RNA, 32 nt, Human
cauagcucacugcagccuugagcuccuaggcu

SEQ ID NO: 91468 - RNA, 32 nt, Human
cauagcucacugcagccuugagcuccugggcu

SEQ ID NO: 91469 - RNA, 32 nt, Human
cauagcucacugcagcuucaaacucuugggcu

SEQ ID NO: 91470 - RNA, 32 nt, Human
cauagcucacugcagcuuugaccucccagacc

SEQ ID NO: 91471 - RNA, 32 nt, Human
cauagcucacugcagcuuugacuuccugggcu

SEQ ID NO: 91472 - RNA, 32 nt, Human
cauagcucacugcauccuccaguuccuggguu

SEQ ID NO: 91473 - RNA, 32 nt, Human
cauagcucaguuaugcuauguucaugaauaga

SEQ ID NO: 91474 - RNA, 32 nt, Human
cauagcuccucgggggagucagugccaggcug

SEQ ID NO: 91475 - RNA, 32 nt, Human
cauagcuccugcccccaggccuaggcaugcug

SEQ ID NO: 91476 - RNA, 32 nt, Human
cauagcuccuuagagauauaaccuauugucug

SEQ ID NO: 91477 - RNA, 17 nt, Human
cauagcucucgcugcca

SEQ ID NO: 91478 - RNA, 32 nt, Human
cauagcucugcggagguggaaguuggggagcu

SEQ ID NO: 91479 - RNA, 32 nt, Human
cauagcugacugcagccucaaccuucugggcu

SEQ ID NO: 91480 - RNA, 32 nt, Human
cauagcugauucaguaaccaguuucaugcugu

SEQ ID NO: 91481 - RNA, 32 nt, Human
cauagcugccugcacucugucucuccaaguac

SEQ ID NO: 91482 - RNA, 32 nt, Human
cauagcugccuuucuuaccauuuugguuugaa

SEQ ID NO: 91483 - RNA, 32 nt, Human
cauagcugugugaccuuggacagguggcucag

SEQ ID NO: 91484 - RNA, 32 nt, Human
cauagcuuaacaaggcacaggaagggaaggga

SEQ ID NO: 91485 - RNA, 32 nt, Human
cauagcuuccucaaauuccugggcucgaaugg

SEQ ID NO: 91486 - RNA, 32 nt, Human
cauaggaaaaggggaagagaggcugaguguca

SEQ ID NO: 91487 - RNA, 32 nt, Human
cauaggaaacagcagacacagggagagggcag

SEQ ID NO: 91488 - RNA, 32 nt, Human
cauaggaagacacacauaugcacacaaaacuc

SEQ ID NO: 91489 - RNA, 22 nt, Human
cauaggaagccagugacagaga

SEQ ID NO: 91490 - RNA, 19 nt, Human
cauaggacaggaaggaaug

SEQ ID NO: 91491 - RNA, 32 nt, Human
cauaggaccucaaaauacaaaauuagcagggc

SEQ ID NO: 91492 - RNA, 32 nt, Human
cauaggagaaacccugaauagaaacaaaacuu

SEQ ID NO: 91493 - RNA, 32 nt, Human
cauaggagagcugggggcaggagaauggggug

SEQ ID NO: 91494 - RNA, 32 nt, Human
cauaggaggcuucuguugacgucuccaacaga

SEQ ID NO: 91495 - RNA, 32 nt, Human
cauaggaguggccucaaggccacccagugcug

SEQ ID NO: 91496 - RNA, 32 nt, Human
cauaggagugucuuguacuaucuuuguaacuu

SEQ ID NO: 91497 - RNA, 32 nt, Human
cauaggcacaggcugugugaggguggacguga

SEQ ID NO: 91498 - RNA, 32 nt, Human
cauaggcagagagagaacuggguguuggagac

SEQ ID NO: 91499 - RNA, 32 nt, Human
cauaggcagcaaacuaagcugcagugauguug

SEQ ID NO: 91500 - RNA, 32 nt, Human
cauaggcagcacaggcaucaagauguccaacc

SEQ ID NO: 91501 - RNA, 32 nt, Human
cauaggcagugcuuuggccaggaggaucccuu

SEQ ID NO: 91502 - RNA, 32 nt, Human
cauaggcaguggcugcucaaagcccuccagca

SEQ ID NO: 91503 - RNA, 21 nt, Human
cauaggccacgugugccccac

SEQ ID NO: 91504 - RNA, 32 nt, Human
cauaggccagggccaacaaaguggagaggugg

SEQ ID NO: 91505 - RNA, 32 nt, Human
cauaggccucaggagucaucccagaagcagug

SEQ ID NO: 91506 - RNA, 32 nt, Human
cauaggccuccaggagcccucagugagaggga

SEQ ID NO: 91507 - RNA, 32 nt, Human
cauaggccuguaaucguagcgcuuugagaggc

SEQ ID NO: 91508 - RNA, 32 nt, Human
cauaggcgcccaggaucaaggucuccggcaca

SEQ ID NO: 91509 - RNA, 32 nt, Human
cauaggcgccuguaaucccagcuacucaggag

SEQ ID NO: 91510 - RNA, 32 nt, Human
cauaggcggcugagcaucggaguggaguucgu

SEQ ID NO: 91511 - RNA, 32 nt, Human
cauaggcucacagaaaaagaaaaagaaaauaa

SEQ ID NO: 91512 - RNA, 32 nt, Human
cauaggcugcaacccagcagagggcagcuaga

SEQ ID NO: 91513 - RNA, 32 nt, Human
cauagggaacaguaccuggccauggcgcagaa

SEQ ID NO: 91514 - RNA, 32 nt, Human
cauagggacguaucugcuaugaaaauccacaa

SEQ ID NO: 91515 - RNA, 32 nt, Human
cauagggagaagcucccucuccccuucaucuu

SEQ ID NO: 91516 - RNA, 32 nt, Human
cauagggaugaaaggaaccaagcguuucugug

SEQ ID NO: 91517 - RNA, 32 nt, Human
cauagggcagccgccucuggcccaggaggagg

SEQ ID NO: 91518 - RNA, 32 nt, Human
cauagggcccaggaaaaugcagaugcugacga

SEQ ID NO: 91519 - RNA, 32 nt, Human
cauagggcccccagacaccacacacaugcgcg

SEQ ID NO: 91520 - RNA, 32 nt, Human
cauagggcuucccagggaaggaagaagaggga

SEQ ID NO: 91521 - RNA, 32 nt, Human
cauaggguggagaagaggagguucagaguggu

SEQ ID NO: 91522 - RNA, 32 nt, Human
cauagggugugcaaggguggacagcaggcguu

SEQ ID NO: 91523 - RNA, 32 nt, Human
cauaggguuuggaagaaagagagaaggauucu

SEQ ID NO: 91524 - RNA, 32 nt, Human
cauaggugcaaaauccaucagagccauuguuu

SEQ ID NO: 91525 - RNA, 32 nt, Human
cauagguggccuaggaguagcagacaauucug

SEQ ID NO: 91526 - RNA, 32 nt, Human
cauagguggcugagcaucggaguggaguucgu

SEQ ID NO: 91527 - RNA, 32 nt, Human
cauaggugggaugucaagacccaucggaagug

SEQ ID NO: 91528 - RNA, 32 nt, Human
cauaggugugagccaccucacccggccuccaa

SEQ ID NO: 91529 - RNA, 32 nt, Human
cauaguaaggggaggaaagggaagcaccucca

SEQ ID NO: 91530 - RNA, 32 nt, Human
cauaguaagugcuuucuuucuuuuuaagcuac

SEQ ID NO: 91531 - RNA, 32 nt, Human
cauaguacacacacaacacgcuaucagcuugg

SEQ ID NO: 91532 - RNA, 32 nt, Human
cauaguacaguggauggaaggugcccgcacac

SEQ ID NO: 91533 - RNA, 21 nt, Human
cauaguaccucacaucacagu

SEQ ID NO: 91534 - RNA, 24 nt, Human
cauaguagcucaugccuguaaucc

SEQ ID NO: 91535 - RNA, 32 nt, Human
cauaguauaguccugaauauguacuuuuaaca

SEQ ID NO: 91536 - RNA, 32 nt, Human
cauaguaucauccugaauaguuugaaugcucu

SEQ ID NO: 91537 - RNA, 32 nt, Human
cauagucaaucagaaaaacaaugaucauucug

SEQ ID NO: 91538 - RNA, 32 nt, Human
cauaguccuuuuaucuccuuguggccuaugaa

SEQ ID NO: 91539 - RNA, 32 nt, Human
cauagucucuccccuucuuucccuuccacuuc

SEQ ID NO: 91540 - RNA, 32 nt, Human
cauagucugccgcuucccauucccaggguaga

SEQ ID NO: 91541 - RNA, 32 nt, Human
cauagucugcucccugucuucugucagccuca

SEQ ID NO: 91542 - RNA, 32 nt, Human
cauagucuucucucagcuuccacugccgucuc

SEQ ID NO: 91543 - RNA, 19 nt, Human
cauagucuuuaccucugga

SEQ ID NO: 91544 - RNA, 21 nt, Human
cauagugaaaccccaucucca

SEQ ID NO: 91545 - RNA, 22 nt, Human
cauagugaaaccccaucucuac

SEQ ID NO: 91546 - RNA, 24 nt, Human
cauagugaaaccccaucucuacua

SEQ ID NO: 91547 - RNA, 24 nt, Human
cauagugaaaccccaucucuacug

SEQ ID NO: 91548 - RNA, 25 nt, Human
cauagugaaacccccgucucuacua

SEQ ID NO: 91549 - RNA, 24 nt, Human
cauagugaaacccccucucuacua

SEQ ID NO: 91550 - RNA, 24 nt, Human
cauagugaaaccccgccucuacua

SEQ ID NO: 91551 - RNA, 24 nt, Human
cauagugaaaccccgucucuacua

SEQ ID NO: 91552 - RNA, 24 nt, Human
cauagugaaaccccgugucuacua

SEQ ID NO: 91553 - RNA, 24 nt, Human
cauagugaaaccccuucucuacua

SEQ ID NO: 91554 - RNA, 21 nt, Human
cauagugaaacccugucucua

SEQ ID NO: 91555 - RNA, 22 nt, Human
cauagugaaacccugucucuac

SEQ ID NO: 91556 - RNA, 24 nt, Human
cauagugaaacccugucucuacua

SEQ ID NO: 91557 - RNA, 24 nt, Human
cauagugaaacccugucuucacua

SEQ ID NO: 91558 - RNA, 20 nt, Human
cauagugaaaccgucuccac

SEQ ID NO: 91559 - RNA, 32 nt, Human
cauagugaaaguacauauacaauuguugcuaa

SEQ ID NO: 91560 - RNA, 24 nt, Human
cauagugaaaucccaucucuacua

SEQ ID NO: 91561 - RNA, 32 nt, Human
cauagugaacagcaucagggaagcuauauugg

SEQ ID NO: 91562 - RNA, 32 nt, Human
cauagugaagccuucuggaggagaaggugacg

SEQ ID NO: 91563 - RNA, 32 nt, Human
cauagugacagggggcuagggaagaacgggaa

SEQ ID NO: 91564 - RNA, 32 nt, Human
cauagugaccaacauagugaaaccccaucucu

SEQ ID NO: 91565 - RNA, 24 nt, Human
cauagugacugaugccuguaaucc

SEQ ID NO: 91566 - RNA, 32 nt, Human
cauagugaugaagaaagggaucagagucugac

SEQ ID NO: 91567 - RNA, 32 nt, Human
cauagugauggccacugguauagucaucgcuc

SEQ ID NO: 91568 - RNA, 32 nt, Human
cauagugcgccugcgaccacacggccggggcg

SEQ ID NO: 91569 - RNA, 32 nt, Human
cauagugcuuugugaagucuuuuacuugugga

SEQ ID NO: 91570 - RNA, 32 nt, Human
cauaguggaagaggagagcaugaagcaaagaa

SEQ ID NO: 91571 - RNA, 32 nt, Human
cauaguggagagacucaaggaggucaaguuga

SEQ ID NO: 91572 - RNA, 32 nt, Human
cauaguggauugagccaaggcugugcuguucc

SEQ ID NO: 91573 - RNA, 24 nt, Human
cauaguggcacacgccuguagucc

SEQ ID NO: 91574 - RNA, 32 nt, Human
cauaguggcacaugccuguaaucccagcuacu

SEQ ID NO: 91575 - RNA, 32 nt, Human
cauaguggcaggcaccuguaaucccagcuacu

SEQ ID NO: 91576 - RNA, 32 nt, Human
cauaguggcaggcaggagagagcaugugcagg

SEQ ID NO: 91577 - RNA, 32 nt, Human
cauaguggcggguaccuauaaucccagcuacu

SEQ ID NO: 91578 - RNA, 23 nt, Human
cauaguggcucacgccuguaauc

SEQ ID NO: 91579 - RNA, 32 nt, Human
cauaguggcucacuccuguaaucccagcacuu

SEQ ID NO: 91580 - RNA, 32 nt, Human
cauaguggcucaugccuguaaucccagcacuu

SEQ ID NO: 91581 - RNA, 24 nt, Human
cauaguggcucuugccuguaaucc

SEQ ID NO: 91582 - RNA, 32 nt, Human
cauaguggcucuugccuguaaucccagcacuu

SEQ ID NO: 91583 - RNA, 24 nt, Human
cauaguggcuuaugccuguaaucc

SEQ ID NO: 91584 - RNA, 32 nt, Human
cauaguggcuuaugccuguaaucccgguacuu

SEQ ID NO: 91585 - RNA, 32 nt, Human
cauagugggcagcccuggaggaacaaggggcu

SEQ ID NO: 91586 - RNA, 32 nt, Human
cauagugggcaguggugugugguuuugaaugg

SEQ ID NO: 91587 - RNA, 32 nt, Human
cauagugggucccaacccccucccucugcugg

SEQ ID NO: 91588 - RNA, 32 nt, Human
cauaguggguuaucccuguaauuccagggcuu

SEQ ID NO: 91589 - RNA, 32 nt, Human
cauagugguaauuggagguuacuguuaugaau

SEQ ID NO: 91590 - RNA, 32 nt, Human
cauaguggugcaugccaguaaucccagcuacu

SEQ ID NO: 91591 - RNA, 24 nt, Human
cauaguggugcaugccuguaaucc

SEQ ID NO: 91592 - RNA, 32 nt, Human
cauaguggugcaugccuguaaucccagcugcu

SEQ ID NO: 91593 - RNA, 24 nt, Human
cauaguggugcaugccuguagucc

SEQ ID NO: 91594 - RNA, 32 nt, Human
cauagugguggucaccuguaguccuagcuacu

SEQ ID NO: 91595 - RNA, 24 nt, Human
cauagugguguauaccuguagucc

SEQ ID NO: 91596 - RNA, 24 nt, Human
cauagugguucaugccuguaaucc

SEQ ID NO: 91597 - RNA, 32 nt, Human
cauagugguucaugccuguaaucccagcacuu

SEQ ID NO: 91598 - RNA, 32 nt, Human
cauagugguuggcaccuguagucccagcuacu

SEQ ID NO: 91599 - RNA, 32 nt, Human
cauaguguauggcaccagcagaucugccugug

SEQ ID NO: 91600 - RNA, 32 nt, Human
cauaguguauuuccucguauccuuucucccuu

SEQ ID NO: 91601 - RNA, 31 nt, Human
cauagugucacagaagacaaagacugcaaag

SEQ ID NO: 91602 - RNA, 32 nt, Human
cauagugucugcugcugccucccuggggacca

SEQ ID NO: 91603 - RNA, 32 nt, Human
cauagugucuucaugucgcguauaguugagcg

SEQ ID NO: 91604 - RNA, 32 nt, Human
cauagugucuuuccucuauuguggaccuaaag

SEQ ID NO: 91605 - RNA, 32 nt, Human
cauaguguuuugauuuggguggcagaugacuu

SEQ ID NO: 91606 - RNA, 31 nt, Human
cauaguuaaguucagcacuugucucauuuua

SEQ ID NO: 91607 - RNA, 32 nt, Human
cauaguuauugccgucauucuguggcuuguca

SEQ ID NO: 91608 - RNA, 32 nt, Human
cauaguucccagcgugaggaaaaugaagaaag

SEQ ID NO: 91609 - RNA, 32 nt, Human
cauaguucccaugagcaugagagaagaagcaa

SEQ ID NO: 91610 - RNA, 19 nt, Human
cauaguucuuccuuuucua

SEQ ID NO: 91611 - RNA, 32 nt, Human
cauaguugagcaguagcugguagaauuaggca

SEQ ID NO: 91612 - RNA, 32 nt, Human
cauaguugauaaaggaagaacauguaaggcaa

SEQ ID NO: 91613 - RNA, 32 nt, Human
cauaguuggaaauguaaucaucccaaagauca

SEQ ID NO: 91614 - RNA, 32 nt, Human
cauaguugugggcaccuguaaucccagcuacc

SEQ ID NO: 91615 - RNA, 31 nt, Human
cauaguuuaacuauucaccuguugaacaaca

SEQ ID NO: 91616 - RNA, 32 nt, Human
cauaguuuauaaacauucuauacaacagacuu

SEQ ID NO: 91617 - RNA, 32 nt, Human
cauaguuucuguccuaggaauauugucuuauc

SEQ ID NO: 91618 - RNA, 32 nt, Human
cauaguuuuaacugcaacugcuuuggcuacca

SEQ ID NO: 91619 - RNA, 32 nt, Human
cauaguuuuauaucugugugguguuuuguacc

SEQ ID NO: 91620 - RNA, 32 nt, Human
cauauaaauaagccuggaaaaccaacuacaac

SEQ ID NO: 91621 - RNA, 32 nt, Human
cauauaaccugacuccucaaaaacuuaauuag

SEQ ID NO: 91622 - RNA, 32 nt, Human
cauauaaguaauacuuuuuacuuucauguaca

SEQ ID NO: 91623 - RNA, 32 nt, Human
cauauaaugacuccagaagaaaaagaaagcuu

SEQ ID NO: 91624 - RNA, 31 nt, Human
cauauaaugugaaccaucacagugggagaca

SEQ ID NO: 91625 - RNA, 32 nt, Human
cauauaauguuuauauuaaaaaggacauuugu

SEQ ID NO: 91626 - RNA, 32 nt, Human
cauauaauuauacacacacauauguacauaua

SEQ ID NO: 91627 - RNA, 32 nt, Human
cauauaauugagaccaaaucugagaugaucaa

SEQ ID NO: 91628 - RNA, 32 nt, Human
cauauacaagggagcccuucacuguugauaca

SEQ ID NO: 91629 - RNA, 32 nt, Human
cauauacaaggucagggguggggaagaguauu

SEQ ID NO: 91630 - RNA, 22 nt, Human
cauauacacacaugcauacaug

SEQ ID NO: 91631 - RNA, 22 nt, Human
cauauacacugggugugaaaca

SEQ ID NO: 91632 - RNA, 32 nt, Human
cauauacauggcaucugccacagcagaaugga

SEQ ID NO: 91633 - RNA, 32 nt, Human
cauauaccuauguaacaaaacuacacauucug

SEQ ID NO: 91634 - RNA, 32 nt, Human
cauauaccuguaauccuagcuauucaaggggc

SEQ ID NO: 91635 - RNA, 32 nt, Human
cauauacuaaaaagcacuaacaagcacaaaug

SEQ ID NO: 91636 - RNA, 32 nt, Human
cauauacuauuuagucucagguucaaggcuac

SEQ ID NO: 91637 - RNA, 32 nt, Human
cauauacuuguaggaaguuguguuggugggcu

SEQ ID NO: 91638 - RNA, 32 nt, Human
cauauacuuucucugcaggguagguaagauag

SEQ ID NO: 91639 - RNA, 32 nt, Human
cauauagaaaaauguauagaugcuuggacaga

SEQ ID NO: 91640 - RNA, 32 nt, Human
cauauagaaaauucacuucuucuuucaagucc

SEQ ID NO: 91641 - RNA, 31 nt, Human
cauauagacaccaaggaggcggaggcgcucc

SEQ ID NO: 91642 - RNA, 32 nt, Human
cauauagacaggcuucugauagauugcaacug

SEQ ID NO: 91643 - RNA, 32 nt, Human
cauauagacaggcuucugauaguuugcaacug

SEQ ID NO: 91644 - RNA, 32 nt, Human
cauauagagacagaaccuggaccucaccaggg

SEQ ID NO: 91645 - RNA, 32 nt, Human
cauauagaugagacacaguacacacacuguga

SEQ ID NO: 91646 - RNA, 32 nt, Human
cauauagcacagaaguccuccacacugccugg

SEQ ID NO: 91647 - RNA, 32 nt, Human
cauauaggacaggacgcuagguuguuuaucuu

SEQ ID NO: 91648 - RNA, 32 nt, Human
cauauaggauuuugugcguaugugagugugcu

SEQ ID NO: 91649 - RNA, 32 nt, Human
cauauagguaugacacuuuauacuuguauagu

SEQ ID NO: 91650 - RNA, 32 nt, Human
cauauagucagugaaguaaauauuuuaaagga

SEQ ID NO: 91651 - RNA, 32 nt, Human
cauauagucccagcuacucaggaggcugaggc

SEQ ID NO: 91652 - RNA, 21 nt, Human
cauauauauacauacaugcau

SEQ ID NO: 91653 - RNA, 32 nt, Human
cauauaucaggaauuauauccaggaugcaaua

SEQ ID NO: 91654 - RNA, 32 nt, Human
cauauaugcuuaugacuaaacccuccacuccu

SEQ ID NO: 91655 - RNA, 32 nt, Human
cauauauguauccacacacauccuugugcaca

SEQ ID NO: 91656 - RNA, 32 nt, Human
cauauauguauguacauguacauguuuuugaa

SEQ ID NO: 91657 - RNA, 32 nt, Human
cauauauguauguauacacauauacacaugua

SEQ ID NO: 91658 - RNA, 32 nt, Human
cauauauuacuaaguugccucucccaguuuac

SEQ ID NO: 91659 - RNA, 31 nt, Human
cauauauucaauaaaaaccaauuugaagaca

SEQ ID NO: 91660 - RNA, 32 nt, Human
cauauauucuugauaaccucuccaacuuuaug

SEQ ID NO: 91661 - RNA, 32 nt, Human
cauaucaacaaauuggaacagcagagcaaggu

SEQ ID NO: 91662 - RNA, 32 nt, Human
cauaucaacauguaugaacuuaaaauauggag

SEQ ID NO: 91663 - RNA, 32 nt, Human
cauaucaaugcugaugaaccaagugcaaagcc

SEQ ID NO: 91664 - RNA, 32 nt, Human
cauaucacaagcauaggaagcuucugguucag

SEQ ID NO: 91665 - RNA, 32 nt, Human
cauaucacugcacuccagccuggcugacagag

SEQ ID NO: 91666 - RNA, 32 nt, Human
cauaucacugccuucucugggcuucagugucc

SEQ ID NO: 91667 - RNA, 32 nt, Human
cauaucagaugcucaaggcuggcagcuacccc

SEQ ID NO: 91668 - RNA, 32 nt, Human
cauaucagauuuacagucuuugucuuaucaag

SEQ ID NO: 91669 - RNA, 32 nt, Human
cauaucagcccucugcucucugaggcagccgc

SEQ ID NO: 91670 - RNA, 31 nt, Human
cauaucagccggagaggaaagacugcacugg

SEQ ID NO: 91671 - RNA, 32 nt, Human
cauaucaggaagagacugagccucucacaaag

SEQ ID NO: 91672 - RNA, 32 nt, Human
cauaucaggaagggcuuugggauagcaccuau

SEQ ID NO: 91673 - RNA, 32 nt, Human
cauaucaguccuuuguggguaguagguagcaa

SEQ ID NO: 91674 - RNA, 32 nt, Human
cauaucagugcugugucagcguucccagaaga

SEQ ID NO: 91675 - RNA, 32 nt, Human
cauaucaguuauaucugugaucaggaauggug

SEQ ID NO: 91676 - RNA, 32 nt, Human
cauaucaugaacccaggacaggcacagugggg

SEQ ID NO: 91677 - RNA, 32 nt, Human
cauaucaugcauucagguuauuuucuaauuuu

SEQ ID NO: 91678 - RNA, 32 nt, Human
cauaucauguacaguuuuauuuuauaacguga

SEQ ID NO: 91679 - RNA, 32 nt, Human
cauauccacccauugacucugccuucaucaag

SEQ ID NO: 91680 - RNA, 32 nt, Human
cauauccaucaucccucaaagugucacaaugc

SEQ ID NO: 91681 - RNA, 32 nt, Human
cauauccaugaucuugaguccauuugggggau

SEQ ID NO: 91682 - RNA, 32 nt, Human
cauauccaugccagaggcucuuguggggagau

SEQ ID NO: 91683 - RNA, 32 nt, Human
cauauccauuaaaaauauuuaaaaauuagcca

SEQ ID NO: 91684 - RNA, 32 nt, Human
cauaucccaccaaccuccagugucagggucca

SEQ ID NO: 91685 - RNA, 32 nt, Human
cauaucccagcccugcgagucuguucuagcca

SEQ ID NO: 91686 - RNA, 32 nt, Human
cauaucccauuuccagcugcaaauuacugcag

SEQ ID NO: 91687 - RNA, 32 nt, Human
cauauccccaccccuucccacggcguguccca

SEQ ID NO: 91688 - RNA, 32 nt, Human
cauaucccuccugugcuccaagguucugaaga

SEQ ID NO: 91689 - RNA, 32 nt, Human
cauaucccuuucucucuuguccaauggggcuu

SEQ ID NO: 91690 - RNA, 32 nt, Human
cauauccguacuuccaugagguguuuucugug

SEQ ID NO: 91691 - RNA, 32 nt, Human
cauauccucacucaggaacugaaaguucugug

SEQ ID NO: 91692 - RNA, 32 nt, Human
cauauccugcagcugcugcagcagggccaccu

SEQ ID NO: 91693 - RNA, 32 nt, Human
cauauccuggaggugaagguaccaccucaugg

SEQ ID NO: 91694 - RNA, 32 nt, Human
cauauccuguauguuuacuauguugccagaga

SEQ ID NO: 91695 - RNA, 32 nt, Human
cauauccuguucaaguuaaucaacaucaaaca

SEQ ID NO: 91696 - RNA, 32 nt, Human
cauaucggucaccaggcacccagggccaugcc

SEQ ID NO: 91697 - RNA, 32 nt, Human
cauaucuauuaggccuuucccugcugguaacu

SEQ ID NO: 91698 - RNA, 32 nt, Human
cauaucucaaauacaguacauuuacauuacug

SEQ ID NO: 91699 - RNA, 32 nt, Human
cauaucucacaccaggggaacaauuagcuaca

SEQ ID NO: 91700 - RNA, 27 nt, Human
cauaucucagucggcuuugcauuccca

SEQ ID NO: 91701 - RNA, 32 nt, Human
cauaucuccacuucucucuagcuguaucuaac

SEQ ID NO: 91702 - RNA, 22 nt, Human
cauaucucuccugucucuucca

SEQ ID NO: 91703 - RNA, 32 nt, Human
cauaucugaaaccauuuuagaagggagaaguc

SEQ ID NO: 91704 - RNA, 32 nt, Human
cauaucugaagauaaaaacauaccucaagcuu

SEQ ID NO: 91705 - RNA, 32 nt, Human
cauaucugcagucccagcacagugggacaaaa

SEQ ID NO: 91706 - RNA, 32 nt, Human
cauaucugccaaucuaaaugcaucuccauuuu

SEQ ID NO: 91707 - RNA, 21 nt, Human
cauaucugcgugcacuuccca

SEQ ID NO: 91708 - RNA, 32 nt, Human
cauaucuggaguggacagcccagguccagagc

SEQ ID NO: 91709 - RNA, 32 nt, Human
cauaucugggagaagcaggcggcuccgcgcuc

SEQ ID NO: 91710 - RNA, 31 nt, Human
cauaucugggagggaagaugggugcugggag

SEQ ID NO: 91711 - RNA, 31 nt, Human
cauaucuggguggagaaugggugaaaaguac

SEQ ID NO: 91712 - RNA, 32 nt, Human
cauaucuguagucccagcuaugugggaggcua

SEQ ID NO: 91713 - RNA, 22 nt, Human
cauaucuuaaucgacauuccca

SEQ ID NO: 91714 - RNA, 21 nt, Human
cauaucuuacuucucuuccca

SEQ ID NO: 91715 - RNA, 32 nt, Human
cauaucuuauguagcugaccucagucucucug

SEQ ID NO: 91716 - RNA, 32 nt, Human
cauaucuugcccuauuuuaauucugcuauaga

SEQ ID NO: 91717 - RNA, 32 nt, Human
cauaucuuugaguucccuugaacucugaucuc

SEQ ID NO: 91718 - RNA, 32 nt, Human
cauaugaaaauggcacaucauauacauguaaa

SEQ ID NO: 91719 - RNA, 32 nt, Human
cauaugaaagaaaguuuaugaagaacuggcuc

SEQ ID NO: 91720 - RNA, 32 nt, Human
cauaugaaagaguggauuuucagagacuuuaa

SEQ ID NO: 91721 - RNA, 32 nt, Human
cauaugaaccucaguucugaaauucauuacau

SEQ ID NO: 91722 - RNA, 32 nt, Human
cauaugaagaucauccaggaguacaacucgaa

SEQ ID NO: 91723 - RNA, 32 nt, Human
cauaugaaggagcaggaggagaggaagaaacu

SEQ ID NO: 91724 - RNA, 32 nt, Human
cauaugaauauagacaaaaagccauugagaua

SEQ ID NO: 91725 - RNA, 32 nt, Human
cauaugaauucgaggggacacaauucgacccg

SEQ ID NO: 91726 - RNA, 32 nt, Human
cauaugacauugugaguuugcuuucuuauaga

SEQ ID NO: 91727 - RNA, 32 nt, Human
cauaugaccucaugcaucuccaccugcuccca

SEQ ID NO: 91728 - RNA, 32 nt, Human
cauaugagacaggcacuggcugaagacaggca

SEQ ID NO: 91729 - RNA, 32 nt, Human
cauaugagauuauuaccaaugacaccguuaau

SEQ ID NO: 91730 - RNA, 32 nt, Human
cauaugaguacuaauacgugccaagccaugua

SEQ ID NO: 91731 - RNA, 32 nt, Human
cauaugagugauaugugaucaugauucauuuu

SEQ ID NO: 91732 - RNA, 32 nt, Human
cauaugauaucagccaagaguuuuccuguggu

SEQ ID NO: 91733 - RNA, 32 nt, Human
cauaugaucugucuguggcaaaaguuuaauca

SEQ ID NO: 91734 - RNA, 32 nt, Human
cauaugauggcaugucaggaauacuguuguaa

SEQ ID NO: 91735 - RNA, 32 nt, Human
cauaugcacaugcacacacauaccacuugaga

SEQ ID NO: 91736 - RNA, 32 nt, Human
cauaugcacgcacacacacaugcacacauaca

SEQ ID NO: 91737 - RNA, 32 nt, Human
cauaugcacgcacuuuucuuguugacaaagca

SEQ ID NO: 91738 - RNA, 32 nt, Human
cauaugcagacuucuggucuacugaggagcau

SEQ ID NO: 91739 - RNA, 32 nt, Human
cauaugcagauacuuauugcauuucuuuuauu

SEQ ID NO: 91740 - RNA, 32 nt, Human
cauaugcauaaaucaggauaccaucucauuaa

SEQ ID NO: 91741 - RNA, 32 nt, Human
cauaugcauaaauuauuaaaauuuucagaagu

SEQ ID NO: 91742 - RNA, 32 nt, Human
cauaugccagaggagacacagagccagaaaug

SEQ ID NO: 91743 - RNA, 32 nt, Human
cauaugcccacuguguaguaacaggccaaugc

SEQ ID NO: 91744 - RNA, 32 nt, Human
cauaugcccaggauuuugaagagccugguauc

SEQ ID NO: 91745 - RNA, 21 nt, Human
cauaugcccccaucaagcaga

SEQ ID NO: 91746 - RNA, 32 nt, Human
cauaugcccucagaaaagugacagugguccca

SEQ ID NO: 91747 - RNA, 32 nt, Human
cauaugccuauauucuagcuacucaggaggcu

SEQ ID NO: 91748 - RNA, 32 nt, Human
cauaugccugaccccuugcucccuucaaugcu

SEQ ID NO: 91749 - RNA, 32 nt, Human
cauaugcuauguuagaaguccaggcagagaca

SEQ ID NO: 91750 - RNA, 28 nt, Human
cauaugcucuuccugaaucuugccacug

SEQ ID NO: 91751 - RNA, 32 nt, Human
cauaugcugaggaccucagccauguggccgcu

SEQ ID NO: 91752 - RNA, 32 nt, Human
cauaugcugaggaccucagccauguggccucu

SEQ ID NO: 91753 - RNA, 32 nt, Human
cauaugcugcugcugcugcagccaccagagca

SEQ ID NO: 91754 - RNA, 32 nt, Human
cauaugcugcuugagauucaugggacuuccgg

SEQ ID NO: 91755 - RNA, 32 nt, Human
cauauggaaagcaaaccuguuuucccauuugu

SEQ ID NO: 91756 - RNA, 32 nt, Human
cauauggaauugugaaggaaaauaaauagguu

SEQ ID NO: 91757 - RNA, 32 nt, Human
cauauggacaaggacaggggaaagcacccccu

SEQ ID NO: 91758 - RNA, 32 nt, Human
cauauggaggcaugugaggguuuuguaagugc

SEQ ID NO: 91759 - RNA, 32 nt, Human
cauauggagggggugacccaccaucucagaac

SEQ ID NO: 91760 - RNA, 21 nt, Human
cauauggccaaguaucuacuu

SEQ ID NO: 91761 - RNA, 32 nt, Human
cauauggccauguguuuguccucugcuucucc

SEQ ID NO: 91762 - RNA, 32 nt, Human
cauaugggagagacucagugagccagcaaagg

SEQ ID NO: 91763 - RNA, 32 nt, Human
cauaugggcaggacuccagccuaugcagagcc

SEQ ID NO: 91764 - RNA, 18 nt, Human
cauauguacauaaauugc

SEQ ID NO: 91765 - RNA, 32 nt, Human
cauauguaccuacauacauacauaaauacaaa

SEQ ID NO: 91766 - RNA, 32 nt, Human
cauauguagauacaaaaggauauucuuaaaau

SEQ ID NO: 91767 - RNA, 32 nt, Human
cauauguagguaccagcucaaccccacgcaag

SEQ ID NO: 91768 - RNA, 32 nt, Human
cauauguauacacacacauaauuugaaaacug

SEQ ID NO: 91769 - RNA, 32 nt, Human
cauauguaugcaaggacacauauguacguaau

SEQ ID NO: 91770 - RNA, 32 nt, Human
cauaugucccugugcuccuuuuaaccaaauaa

SEQ ID NO: 91771 - RNA, 32 nt, Human
cauauguccuaccaaaugaaacccuguuucca

SEQ ID NO: 91772 - RNA, 32 nt, Human
cauaugucuguugagccuggacauuaaguauu

SEQ ID NO: 91773 - RNA, 32 nt, Human
cauaugugaacaauuaacaaauuggauuucaa

SEQ ID NO: 91774 - RNA, 32 nt, Human
cauaugugaguguguguggcuguaaccugcac

SEQ ID NO: 91775 - RNA, 32 nt, Human
cauaugugcaguauuuauauuggaucauacug

SEQ ID NO: 91776 - RNA, 32 nt, Human
cauaugugccuuucuguuagcucucuuugacu

SEQ ID NO: 91777 - RNA, 32 nt, Human
cauauguggcagagggucuauccaggccucgc

SEQ ID NO: 91778 - RNA, 32 nt, Human
cauauguggcagcagaggcagugagaguuuca

SEQ ID NO: 91779 - RNA, 32 nt, Human
cauaugugggugguggaggaaccggugcucag

SEQ ID NO: 91780 - RNA, 32 nt, Human
cauauguguaaauauauguacaaaaauuacug

SEQ ID NO: 91781 - RNA, 32 nt, Human
cauauguguauguaugcguauguauguaugua

SEQ ID NO: 91782 - RNA, 32 nt, Human
cauaugugugcuuucucuuuccuuuuaggaau

SEQ ID NO: 91783 - RNA, 32 nt, Human
cauauguguguauguguauuuauauguaugua

SEQ ID NO: 91784 - RNA, 32 nt, Human
cauauguugaucccaaacaugcaaugacaucc

SEQ ID NO: 91785 - RNA, 31 nt, Human
cauauguuuguucaauuacauuuagaguugg

SEQ ID NO: 91786 - RNA, 32 nt, Human
cauauuaaaccaugcagaauuggaguaacuuc

SEQ ID NO: 91787 - RNA, 32 nt, Human
cauauuaacaaaucugaaaauaugucaaauua

SEQ ID NO: 91788 - RNA, 32 nt, Human
cauauuacaagaaaacuacaggguccacacgg

SEQ ID NO: 91789 - RNA, 32 nt, Human
cauauuacaaguuugaaaauucagggcuggug

SEQ ID NO: 91790 - RNA, 32 nt, Human
cauauuacacauauguaaaaauuguuguuuua

SEQ ID NO: 91791 - RNA, 32 nt, Human
cauauuacuacuucuguuccauggugugcagg

SEQ ID NO: 91792 - RNA, 32 nt, Human
cauauuacuuuccauaauagcugugcuaauuu

SEQ ID NO: 91793 - RNA, 24 nt, Human
cauauuagauuacuaagucauuug

SEQ ID NO: 91794 - RNA, 32 nt, Human
cauauuauaggcagaacacaauggcuaaauau

SEQ ID NO: 91795 - RNA, 32 nt, Human
cauauuaugaucauacauauuuugaagaacag

SEQ ID NO: 91796 - RNA, 32 nt, Human
cauauuauugauuugugcauuuggugcaaaau

SEQ ID NO: 91797 - RNA, 32 nt, Human
cauauucaggcaggugugcauuugugcaugcc

SEQ ID NO: 91798 - RNA, 32 nt, Human
cauauucauaaauauacugucaaucuaucagc

SEQ ID NO: 91799 - RNA, 32 nt, Human
cauauucaucuuuaccaucacugucacuguaa

SEQ ID NO: 91800 - RNA, 32 nt, Human
cauauuccaaagugauaacagcacuuaaguuc

SEQ ID NO: 91801 - RNA, 32 nt, Human
cauauuccugccuuucuuccaucagcucucug

SEQ ID NO: 91802 - RNA, 32 nt, Human
cauauuccuuccagaugccucagugcuacacc

SEQ ID NO: 91803 - RNA, 31 nt, Human
cauauucggagggaauuucagaugcuuuacc

SEQ ID NO: 91804 - RNA, 32 nt, Human
cauauucucaccagcacaucugaaugaggcuu

SEQ ID NO: 91805 - RNA, 32 nt, Human
cauauucucaguccuccucuggucuacaaagc

SEQ ID NO: 91806 - RNA, 32 nt, Human
cauauucucucccuuuccccucccaguuaccu

SEQ ID NO: 91807 - RNA, 32 nt, Human
cauauucuuguauucaaagaaaacaggaaaaa

SEQ ID NO: 91808 - RNA, 32 nt, Human
cauauugcagaacagcucugagagcaacaguu

SEQ ID NO: 91809 - RNA, 32 nt, Human
cauauugcaugcugcucagaccccaagucaga

SEQ ID NO: 91810 - RNA, 32 nt, Human
cauauugccaacuggaaagucaaaauuuucua

SEQ ID NO: 91811 - RNA, 32 nt, Human
cauauugccaccaagacuuuccaggcucuucg

SEQ ID NO: 91812 - RNA, 32 nt, Human
cauauugcuggcccagcuccugaggcucuuug

SEQ ID NO: 91813 - RNA, 32 nt, Human
cauauuggauucagaaaagaaaaagaaugaug

SEQ ID NO: 91814 - RNA, 32 nt, Human
cauauuggcacaucugcuguccauuggggguu

SEQ ID NO: 91815 - RNA, 32 nt, Human
cauauugggcugggguaagcacuagacccaag

SEQ ID NO: 91816 - RNA, 32 nt, Human
cauauuggguacaguguacacugcuccaguga

SEQ ID NO: 91817 - RNA, 32 nt, Human
cauauugguauagagagcagaagaguagcuag

SEQ ID NO: 91818 - RNA, 32 nt, Human
cauauuguaggaugccuuucuauuucaauugg

SEQ ID NO: 91819 - RNA, 32 nt, Human
cauauuguauacuaucuuuaacugguuuuuca

SEQ ID NO: 91820 - RNA, 32 nt, Human
cauauuuaaugagccagaacaaggaaacacag

SEQ ID NO: 91821 - RNA, 32 nt, Human
cauauuuauguguuucuugcugggugagcacu

SEQ ID NO: 91822 - RNA, 32 nt, Human
cauauuucagcaguuugccacugugacugucu

SEQ ID NO: 91823 - RNA, 32 nt, Human
cauauuuccuguucauguccauuacagguaaa

SEQ ID NO: 91824 - RNA, 32 nt, Human
cauauuucuaaugaggaagauuaaugaaagaa

SEQ ID NO: 91825 - RNA, 32 nt, Human
cauauuucucagaaagauugccgggaagauga

SEQ ID NO: 91826 - RNA, 32 nt, Human
cauauuucucccaguuuggcacugugacacag

SEQ ID NO: 91827 - RNA, 32 nt, Human
cauauuucucugccucuauucuucuauacugc

SEQ ID NO: 91828 - RNA, 32 nt, Human
cauauuucugagagaaauguaugguucuuucu

SEQ ID NO: 91829 - RNA, 32 nt, Human
cauauuugaaguauucccuguauuuccauuau

SEQ ID NO: 91830 - RNA, 32 nt, Human
cauauuugaccagcauguuuuaaaagcucuug

SEQ ID NO: 91831 - RNA, 32 nt, Human
cauauuugagugugugcaugugugcaugacuu

SEQ ID NO: 91832 - RNA, 32 nt, Human
cauauuugcccguggaucacugaagauuccug

SEQ ID NO: 91833 - RNA, 32 nt, Human
cauauuugugcuccuucacgggagggcaggga

SEQ ID NO: 91834 - RNA, 32 nt, Human
cauauuuuacucucuucuccaggaugacaugg

SEQ ID NO: 91835 - RNA, 32 nt, Human
cauauuuucauuguuuuagagggagacagagu

SEQ ID NO: 91836 - RNA, 32 nt, Human
cauauuuucucaugaccauugccagugaccaa

SEQ ID NO: 91837 - RNA, 32 nt, Human
cauauuuucucccugcuguucccaccaugccc

SEQ ID NO: 91838 - RNA, 32 nt, Human
cauauuuucugcaaaugggagcauggauaaug

SEQ ID NO: 91839 - RNA, 32 nt, Human
cauauuuucuggacuuaaauguuauuacaaau

SEQ ID NO: 91840 - RNA, 32 nt, Human
cauauuuuguaaaaauaccaaaauuagcggug

SEQ ID NO: 91841 - RNA, 32 nt, Human
cauauuuuguaacuuccaugugaggguuuuca

SEQ ID NO: 91842 - RNA, 32 nt, Human
cauauuuuguauccuaaaaugaauguaugaua

SEQ ID NO: 91843 - RNA, 32 nt, Human
cauauuuugugguggugacauuacaggaggug

SEQ ID NO: 91844 - RNA, 32 nt, Human
cauauuuuugggaggcagagaggggcaggcuu

SEQ ID NO: 91845 - RNA, 32 nt, Human
cauauuuuuguuguuuccaggaauuuauuuga

SEQ ID NO: 91846 - RNA, 32 nt, Human
caucaaaacagugcuucagccaaauuccauau

SEQ ID NO: 91847 - RNA, 32 nt, Human
caucaaaaccuacauauuagccuuuggcuuua

SEQ ID NO: 91848 - RNA, 32 nt, Human
caucaaaagacuguuucucggugugaaucaag

SEQ ID NO: 91849 - RNA, 32 nt, Human
caucaaaaugauuuaucuucacuuuaccuauu

SEQ ID NO: 91850 - RNA, 32 nt, Human
caucaaaauggugaugaaccuggcaaaacgac

SEQ ID NO: 91851 - RNA, 32 nt, Human
caucaaacaaaggcauuggauuuggauccguc

SEQ ID NO: 91852 - RNA, 32 nt, Human
caucaaacauguugggacaaugcccauaggaa

SEQ ID NO: 91853 - RNA, 32 nt, Human
caucaaaccaaaucaacguugcugcuaauaca

SEQ ID NO: 91854 - RNA, 32 nt, Human
caucaaacccagaucugcacuugguaaugacu

SEQ ID NO: 91855 - RNA, 32 nt, Human
caucaaagaaaaugcugucaccugccauuguu

SEQ ID NO: 91856 - RNA, 32 nt, Human
caucaaagaagcuuuugaguaccaccuguuaa

SEQ ID NO: 91857 - RNA, 32 nt, Human
caucaaagauucacuccaaaaaguaauaccaa

SEQ ID NO: 91858 - RNA, 32 nt, Human
caucaaagcccucccugucugucugucucucu

SEQ ID NO: 91859 - RNA, 18 nt, Human
caucaaagccuugucaag

SEQ ID NO: 91860 - RNA, 32 nt, Human
caucaaaggaacauuugcuucacugggugaua

SEQ ID NO: 91861 - RNA, 32 nt, Human
caucaaaggagauucgggcuguggaaggcucc

SEQ ID NO: 91862 - RNA, 32 nt, Human
caucaaaggagggauuauguggcugcuaaagc

SEQ ID NO: 91863 - RNA, 31 nt, Human
caucaaagugagaggaaaggaaaagcaucug

SEQ ID NO: 91864 - RNA, 32 nt, Human
caucaaaugagacuauuugaggggacuauuug

SEQ ID NO: 91865 - RNA, 32 nt, Human
caucaaaugcuacuguucagcaggugccugac

SEQ ID NO: 91866 - RNA, 32 nt, Human
caucaaauguacaaaguugaguaucucuuuac

SEQ ID NO: 91867 - RNA, 32 nt, Human
caucaaauguacugagaauagacuagcauuug

SEQ ID NO: 91868 - RNA, 32 nt, Human
caucaaaugugcugugguucugggugauuuau

SEQ ID NO: 91869 - RNA, 32 nt, Human
caucaaauuguugccuuuuaccaaaaugcaaa

SEQ ID NO: 91870 - RNA, 32 nt, Human
caucaacaaacaacauggcacuuaguguuuuu

SEQ ID NO: 91871 - RNA, 32 nt, Human
caucaacaaauauuguuaugugcaaaaguauu

SEQ ID NO: 91872 - RNA, 32 nt, Human
caucaacaagccccauuaaaaagaaaaagaaa

SEQ ID NO: 91873 - RNA, 32 nt, Human
caucaacacagcauggaauuuccagggagguc

SEQ ID NO: 91874 - RNA, 32 nt, Human
caucaacacaggcgaagauggucuccaagcgc

SEQ ID NO: 91875 - RNA, 32 nt, Human
caucaacacggugggaggcagcgggggcuuca

SEQ ID NO: 91876 - RNA, 32 nt, Human
caucaacacuugcuauuaucugucuuuuugcu

SEQ ID NO: 91877 - RNA, 32 nt, Human
caucaacagacugggagggauuacgugggguc

SEQ ID NO: 91878 - RNA, 32 nt, Human
caucaacaggaaagcuugggaaagacaauacu

SEQ ID NO: 91879 - RNA, 32 nt, Human
caucaacauagugagaccccaucucuauuaaa

SEQ ID NO: 91880 - RNA, 32 nt, Human
caucaacaugcuuuuauuccagcacugugguu

SEQ ID NO: 91881 - RNA, 32 nt, Human
caucaacauggaaacuuggcuccucacguagg

SEQ ID NO: 91882 - RNA, 32 nt, Human
caucaacauuccugccccagauggcuuuguga

SEQ ID NO: 91883 - RNA, 31 nt, Human
caucaaccgggagaggaaaaagaaaacuggg

SEQ ID NO: 91884 - RNA, 32 nt, Human
caucaaccugggaggcggagguugcagugagc

SEQ ID NO: 91885 - RNA, 32 nt, Human
caucaacugccucugcuggacgcugcccagag

SEQ ID NO: 91886 - RNA, 32 nt, Human
caucaacuuuuacaagaaaaucucugucucuu

SEQ ID NO: 91887 - RNA, 32 nt, Human
caucaagaacaaggagggcauggaugcuaagu

SEQ ID NO: 91888 - RNA, 25 nt, Human
caucaagaacacaguccccauguug

SEQ ID NO: 91889 - RNA, 32 nt, Human
caucaagaaccaccaucacuucucacaccauu

SEQ ID NO: 91890 - RNA, 32 nt, Human
caucaagaagccccagccaggaggggccaggc

SEQ ID NO: 91891 - RNA, 32 nt, Human
caucaagaccuccaaguacaauauucucaccu

SEQ ID NO: 91892 - RNA, 32 nt, Human
caucaagacuggacuugaacuccugggcucaa

SEQ ID NO: 91893 - RNA, 32 nt, Human
caucaagagcaccagcccugggccagggaaga

SEQ ID NO: 91894 - RNA, 19 nt, Human
caucaagagcuuggagagu

SEQ ID NO: 91895 - RNA, 32 nt, Human
caucaagcaauauuuccacuucaacuuccacu

SEQ ID NO: 91896 - RNA, 31 nt, Human
caucaagcacuuguaccaaagcaugaggaag

SEQ ID NO: 91897 - RNA, 32 nt, Human
caucaagcagccugccccagcccugccagcca

SEQ ID NO: 91898 - RNA, 32 nt, Human
caucaagccagccugaccaacauggugaaacc

SEQ ID NO: 91899 - RNA, 32 nt, Human
caucaagcccuagaagcuggguuucuuuaaau

SEQ ID NO: 91900 - RNA, 17 nt, Human
caucaagccuuguuaaa

SEQ ID NO: 91901 - RNA, 32 nt, Human
caucaagcugauuuuauuggucaugagaacaa

SEQ ID NO: 91902 - RNA, 32 nt, Human
caucaaggaauaaacuguccucgccaugagag

SEQ ID NO: 91903 - RNA, 32 nt, Human
caucaaggaccuugccucucuggaaucuguca

SEQ ID NO: 91904 - RNA, 32 nt, Human
caucaaggaguccagagcaggagccaggccag

SEQ ID NO: 91905 - RNA, 32 nt, Human
caucaaggcuacucgggggauagcacuuuaca

SEQ ID NO: 91906 - RNA, 32 nt, Human
caucaaggcucacugcagccuggaccuccugg

SEQ ID NO: 91907 - RNA, 32 nt, Human
caucaaggugcugaagcuguacgccugggagc

SEQ ID NO: 91908 - RNA, 32 nt, Human
caucaaguacagaaccugccugguaugaccuc

SEQ ID NO: 91909 - RNA, 32 nt, Human
caucaagucaacaguuaucagcacucagacau

SEQ ID NO: 91910 - RNA, 32 nt, Human
caucaagucccucacagccauuucuguuccca

SEQ ID NO: 91911 - RNA, 32 nt, Human
caucaagucccuggggcagagauuugugaggg

SEQ ID NO: 91912 - RNA, 32 nt, Human
caucaagugaucuuccugccuccgcuucccaa

SEQ ID NO: 91913 - RNA, 32 nt, Human
caucaagugcagucgggaccucccaggacaag

SEQ ID NO: 91914 - RNA, 32 nt, Human
caucaaguggugagucaggccagggccuucca

SEQ ID NO: 91915 - RNA, 32 nt, Human
caucaaguuucuccgaauuucuguauaauaca

SEQ ID NO: 91916 - RNA, 32 nt, Human
caucaauaacauccuuccccagcacauccagc

SEQ ID NO: 91917 - RNA, 32 nt, Human
caucaauaugcuggugacauaugauggcaugu

SEQ ID NO: 91918 - RNA, 32 nt, Human
caucaauauuuuuauuuuaggagguguacuug

SEQ ID NO: 91919 - RNA, 32 nt, Human
caucaaucagaaguccuccuccccagcacauu

SEQ ID NO: 91920 - RNA, 32 nt, Human
caucaaucccccaguacaaugagacgguccuc

SEQ ID NO: 91921 - RNA, 19 nt, Human
caucaauccccuugucgaa

SEQ ID NO: 91922 - RNA, 32 nt, Human
caucaaucuagagaaagagaaggacgacccaa

SEQ ID NO: 91923 - RNA, 32 nt, Human
caucaaucuguucaucauaagacagaguaaga

SEQ ID NO: 91924 - RNA, 32 nt, Human
caucaaucuuuaaaccaauugcugcuacuuau

SEQ ID NO: 91925 - RNA, 32 nt, Human
caucaaugacucaugguguugaguggcaugcu

SEQ ID NO: 91926 - RNA, 24 nt, Human
caucaaugcuuguuuuuccuggug

SEQ ID NO: 91927 - RNA, 32 nt, Human
caucaaugucuguccuguggccaugucccuca

SEQ ID NO: 91928 - RNA, 21 nt, Human
caucaauuugaugaaauugau

SEQ ID NO: 91929 - RNA, 32 nt, Human
caucacaaaccugguaccuguugcuucccaga

SEQ ID NO: 91930 - RNA, 32 nt, Human
caucacaaacugugguguucugaccaccugug

SEQ ID NO: 91931 - RNA, 32 nt, Human
caucacaaaguagacauauacacacacauaua

SEQ ID NO: 91932 - RNA, 32 nt, Human
caucacaaugggucugaucugcauuucacuuc

SEQ ID NO: 91933 - RNA, 32 nt, Human
caucacacaccagccaagguuuacggagcccc

SEQ ID NO: 91934 - RNA, 32 nt, Human
caucacacagcaaaggagggaguggaagagag

SEQ ID NO: 91935 - RNA, 32 nt, Human
caucacaccagcuggcccucuuugcuuccuuu

SEQ ID NO: 91936 - RNA, 32 nt, Human
caucacaccaguacacuccaggcuaggucaca

SEQ ID NO: 91937 - RNA, 32 nt, Human
caucacaccauugcacuccagccugggcaaca

SEQ ID NO: 91938 - RNA, 32 nt, Human
caucacacccggcuaauuuuuguauuuuuagu

SEQ ID NO: 91939 - RNA, 32 nt, Human
caucacaccuggcuaauuuuuguauuuuuagu

SEQ ID NO: 91940 - RNA, 32 nt, Human
caucacaccuguaaucccagcacuuugggagg

SEQ ID NO: 91941 - RNA, 32 nt, Human
caucacacucuccauguuaguaauggcagagc

SEQ ID NO: 91942 - RNA, 32 nt, Human
caucacacuggcagacauuguaaaagacccug

SEQ ID NO: 91943 - RNA, 32 nt, Human
caucacagacacauagaugcucaccagccugg

SEQ ID NO: 91944 - RNA, 22 nt, Human
caucacagagcccuucuuggua

SEQ ID NO: 91945 - RNA, 32 nt, Human
caucacagaguguacacacaugguauacaccc

SEQ ID NO: 91946 - RNA, 32 nt, Human
caucacagccaagaggugggguuccaugaccu

SEQ ID NO: 91947 - RNA, 32 nt, Human
caucacagccaagcauugccacuuaccaugag

SEQ ID NO: 91948 - RNA, 32 nt, Human
caucacagccaggguggccucugggugucaga

SEQ ID NO: 91949 - RNA, 32 nt, Human
caucacagcgccagggcagcugugccugggac

SEQ ID NO: 91950 - RNA, 32 nt, Human
caucacagcucucugugaccucacuccuuuga

SEQ ID NO: 91951 - RNA, 22 nt, Human
caucacagcugcgugccugggg

SEQ ID NO: 91952 - RNA, 32 nt, Human
caucacagcuggcuaauuuuuguauuuuuagu

SEQ ID NO: 91953 - RNA, 32 nt, Human
caucacaggaacagagacugaaucugccucag

SEQ ID NO: 91954 - RNA, 32 nt, Human
caucacaggcuagagaggugagcuuggaaaag

SEQ ID NO: 91955 - RNA, 19 nt, Human
caucacaggcuggccgagg

SEQ ID NO: 91956 - RNA, 32 nt, Human
caucacaguacgcuuagggucuugucacucgg

SEQ ID NO: 91957 - RNA, 18 nt, Human
caucacagugacaaugaa

SEQ ID NO: 91958 - RNA, 32 nt, Human
caucacaguggaccuucugccuccucccagau

SEQ ID NO: 91959 - RNA, 32 nt, Human
caucacaguguugcugucaucaggcaaaagug

SEQ ID NO: 91960 - RNA, 32 nt, Human
caucacaucauccugagguuccagaacucaug

SEQ ID NO: 91961 - RNA, 32 nt, Human
caucacaucccucuccucuccuccucugugcu

SEQ ID NO: 91962 - RNA, 32 nt, Human
caucacauccuccguguccucaucuguuauuc

SEQ ID NO: 91963 - RNA, 32 nt, Human
caucacauccugcaguaucuccagaagcagca

SEQ ID NO: 91964 - RNA, 32 nt, Human
caucacaucuggcuaguuuuuguauuuuuagu

SEQ ID NO: 91965 - RNA, 32 nt, Human
caucacaugaagccuauugggguuaaguuugu

SEQ ID NO: 91966 - RNA, 23 nt, Human
caucacaugccaaaaacggggga

SEQ ID NO: 91967 - RNA, 32 nt, Human
caucacaugugcauccacuucuuuucauccau

SEQ ID NO: 91968 - RNA, 32 nt, Human
caucacauuuguaaaugucuuuucaaaaggau

SEQ ID NO: 91969 - RNA, 32 nt, Human
caucaccaacuugauuuucuuccauagcaaaa

SEQ ID NO: 91970 - RNA, 32 nt, Human
caucaccaaugucugucaugcugagcaagagg

SEQ ID NO: 91971 - RNA, 32 nt, Human
caucaccacaguuuaauaccacagcuuuuuac

SEQ ID NO: 91972 - RNA, 32 nt, Human
caucaccacaugcacuguggccauucagcauc

SEQ ID NO: 91973 - RNA, 32 nt, Human
caucaccaccaccaccaccaccaccaucacca

SEQ ID NO: 91974 - RNA, 32 nt, Human
caucaccaccaccaccaccaucaccaccacca

SEQ ID NO: 91975 - RNA, 32 nt, Human
caucaccaccaucaccaccaccaucaccacca

SEQ ID NO: 91976 - RNA, 32 nt, Human
caucaccaccauccaucuccagaacuuuuuca

SEQ ID NO: 91977 - RNA, 32 nt, Human
caucaccacucgggggcaccgggccgcccacc

SEQ ID NO: 91978 - RNA, 32 nt, Human
caucaccacugcaguuccaucccaagucacag

SEQ ID NO: 91979 - RNA, 32 nt, Human
caucaccagcucccagauuuuggaccaguuga

SEQ ID NO: 91980 - RNA, 32 nt, Human
caucaccaggaauugccuucucucauggugaa

SEQ ID NO: 91981 - RNA, 32 nt, Human
caucaccaggacugccugggccuguguucauu

SEQ ID NO: 91982 - RNA, 32 nt, Human
caucaccagguaaugaucagagaggcaauaga

SEQ ID NO: 91983 - RNA, 32 nt, Human
caucaccaucaccaccaccaccaccaucacca

SEQ ID NO: 91984 - RNA, 32 nt, Human
caucaccaucaccaccaccaccaucaucauca

SEQ ID NO: 91985 - RNA, 32 nt, Human
caucaccaucaucaucacugucauugucauua

SEQ ID NO: 91986 - RNA, 32 nt, Human
caucaccauccagcccagcacccuggacuuca

SEQ ID NO: 91987 - RNA, 32 nt, Human
caucaccaugccacaucccugcucccuacuuc

SEQ ID NO: 91988 - RNA, 32 nt, Human
caucaccaugccccagccccagccuggcccgc

SEQ ID NO: 91989 - RNA, 31 nt, Human
caucaccauugcuagaauacuggcaugauuc

SEQ ID NO: 91990 - RNA, 28 nt, Human
caucacccaagugccugaugccucaggu

SEQ ID NO: 91991 - RNA, 32 nt, Human
caucacccaccagggugcacagucucuccugc

SEQ ID NO: 91992 - RNA, 32 nt, Human
caucacccagauauuucccacaguucggccug

SEQ ID NO: 91993 - RNA, 32 nt, Human
caucaccccuggcuauuuuuguauuuuuagua

SEQ ID NO: 91994 - RNA, 23 nt, Human
caucacccucauuccuccggaga

SEQ ID NO: 91995 - RNA, 32 nt, Human
caucacccucauuccuccggagaaagccgggu

SEQ ID NO: 91996 - RNA, 32 nt, Human
caucacccuccccuccccuccccuccccuccc

SEQ ID NO: 91997 - RNA, 32 nt, Human
caucaccgacacugagcaguggaaaggggcua

SEQ ID NO: 91998 - RNA, 32 nt, Human
caucaccgagauccucccugaauucagcccac

SEQ ID NO: 91999 - RNA, 23 nt, Human
caucaccgucaccgucaucauca

SEQ ID NO: 92000 - RNA, 32 nt, Human
caucaccuaucacagcuggcugccuucgugcu

SEQ ID NO: 92001 - RNA, 18 nt, Human
caucaccuauuccugcga

SEQ ID NO: 92002 - RNA, 32 nt, Human
caucaccuccaggaacaccgcucaggccugac

SEQ ID NO: 92003 - RNA, 32 nt, Human
caucaccucuacugucuccucccugggcuaag

SEQ ID NO: 92004 - RNA, 32 nt, Human
caucaccugcaacuuaaaugaacaagcuuaca

SEQ ID NO: 92005 - RNA, 19 nt, Human
caucaccugccccaugcaa

SEQ ID NO: 92006 - RNA, 23 nt, Human
caucaccugcucugcucuuacaa

SEQ ID NO: 92007 - RNA, 32 nt, Human
caucaccuuccuccucugcucugggugguaag

SEQ ID NO: 92008 - RNA, 32 nt, Human
caucaccuuccugaauucuuuaaauaugaaau

SEQ ID NO: 92009 - RNA, 32 nt, Human
caucaccuuggcugcaacugcugagugcuggu

SEQ ID NO: 92010 - RNA, 32 nt, Human
caucaccuuuucccuuucauguucuuggaccu

SEQ ID NO: 92011 - RNA, 32 nt, Human
caucacgaccucaaacuggcuccuaaucucca

SEQ ID NO: 92012 - RNA, 32 nt, Human
caucacgacugauccccaccuccucaggguca

SEQ ID NO: 92013 - RNA, 32 nt, Human
caucacgagccacuuccacuccuggguggccu

SEQ ID NO: 92014 - RNA, 32 nt, Human
caucacgaucaaagcagcaggugcuguggucu

SEQ ID NO: 92015 - RNA, 32 nt, Human
caucacgccaagcuaauuuuuguauuuuugua

SEQ ID NO: 92016 - RNA, 32 nt, Human
caucacgcccagcuaauuuuuguauuuuuagu

SEQ ID NO: 92017 - RNA, 32 nt, Human
caucacgcccagcuaauuuuuguauuuuuggu

SEQ ID NO: 92018 - RNA, 32 nt, Human
caucacgcccggcuaauuuuguuuucguauuu

SEQ ID NO: 92019 - RNA, 32 nt, Human
caucacgcccggcuaauuuuuguauuuucagu

SEQ ID NO: 92020 - RNA, 32 nt, Human
caucacgccuggcuaauuuuuguauuuuuagu

SEQ ID NO: 92021 - RNA, 32 nt, Human
caucacgccugugcaguggcccccacagaaag

SEQ ID NO: 92022 - RNA, 32 nt, Human
caucacggcacucugggacaggcacggaggac

SEQ ID NO: 92023 - RNA, 32 nt, Human
caucacggugcuccagccggcccugcagcagu

SEQ ID NO: 92024 - RNA, 32 nt, Human
caucacguaugucgcagcagcauuucaccccu

SEQ ID NO: 92025 - RNA, 32 nt, Human
caucacuacaucuuuucuuccggaucuucauc

SEQ ID NO: 92026 - RNA, 32 nt, Human
caucacuacgaaugucuuacauugaagcacag

SEQ ID NO: 92027 - RNA, 32 nt, Human
caucacuacuaaacauacaaaauuagccgggc

SEQ ID NO: 92028 - RNA, 32 nt, Human
caucacuacuggcugugcggcccccgcugcuu

SEQ ID NO: 92029 - RNA, 32 nt, Human
caucacuacuguuucuaaccagauaucucgaa

SEQ ID NO: 92030 - RNA, 32 nt, Human
caucacucaauacuggugcucuugucacaggu

SEQ ID NO: 92031 - RNA, 32 nt, Human
caucacuccagccugggcaacagaacaagaac

SEQ ID NO: 92032 - RNA, 32 nt, Human
caucacucccccugccaagacaaaggguccag

SEQ ID NO: 92033 - RNA, 32 nt, Human
caucacuccccucccuugcuggccagcauccc

SEQ ID NO: 92034 - RNA, 32 nt, Human
caucacuccccuccucucccuuccuguguggc

SEQ ID NO: 92035 - RNA, 32 nt, Human
caucacucuccucaguguugaugucaacaugc

SEQ ID NO: 92036 - RNA, 32 nt, Human
caucacucuggccucugccuucaucucaugcc

SEQ ID NO: 92037 - RNA, 32 nt, Human
caucacucuguacaaagcuaaaauguggagcu

SEQ ID NO: 92038 - RNA, 32 nt, Human
caucacucuuuucuccacauacagugcagaga

SEQ ID NO: 92039 - RNA, 32 nt, Human
caucacugacucaaguggcuguucugauuccc

SEQ ID NO: 92040 - RNA, 32 nt, Human
caucacugaggcaccugguuacgcuucaccuc

SEQ ID NO: 92041 - RNA, 32 nt, Human
caucacugagucagcacucaccuggccugggg

SEQ ID NO: 92042 - RNA, 24 nt, Human
caucacugcacuccaaccugggca

SEQ ID NO: 92043 - RNA, 32 nt, Human
caucacugcacuccaaccugggcaacagagua

SEQ ID NO: 92044 - RNA, 24 nt, Human
caucacugcacuccagccugggca

SEQ ID NO: 92045 - RNA, 32 nt, Human
caucacugcacuccagccugggcagcagagug

SEQ ID NO: 92046 - RNA, 32 nt, Human
caucacugcacuccagccugggcgauggagca

SEQ ID NO: 92047 - RNA, 32 nt, Human
caucacugcacuccagccugggugacagagcg

SEQ ID NO: 92048 - RNA, 32 nt, Human
caucacugcacuccagcuugggugacagagca

SEQ ID NO: 92049 - RNA, 32 nt, Human
caucacugcacuccauccugggugacagagag

SEQ ID NO: 92050 - RNA, 32 nt, Human
caucacugcaguccagccuggaugacagagug

SEQ ID NO: 92051 - RNA, 32 nt, Human
caucacugcaguccagccugggugacagagca

SEQ ID NO: 92052 - RNA, 20 nt, Human
caucacuggaacuuguuaaa

SEQ ID NO: 92053 - RNA, 32 nt, Human
caucacugggcuuggauuugcauuacauugac

SEQ ID NO: 92054 - RNA, 32 nt, Human
caucacuguggcuggcaggcaucggacagccu

SEQ ID NO: 92055 - RNA, 32 nt, Human
caucacuucccaugccccaucucgacucccau

SEQ ID NO: 92056 - RNA, 21 nt, Human
caucacuuccuccuugucaaa

SEQ ID NO: 92057 - RNA, 32 nt, Human
caucacuucuuugccaaaugcauuuccaaaca

SEQ ID NO: 92058 - RNA, 32 nt, Human
caucacuuugggaggccgaggcgggcggaucg

SEQ ID NO: 92059 - RNA, 32 nt, Human
caucacuuugggaggcugaggugggagguuug

SEQ ID NO: 92060 - RNA, 32 nt, Human
caucagaaaaauucuauugucuucccaaucuc

SEQ ID NO: 92061 - RNA, 32 nt, Human
caucagaaaccagcaacugauucagugugauu

SEQ ID NO: 92062 - RNA, 32 nt, Human
caucagaaaugucuuccuuaaguggaaaaguc

SEQ ID NO: 92063 - RNA, 32 nt, Human
caucagaacagccugcccugggcaccaggugg

SEQ ID NO: 92064 - RNA, 21 nt, Human
caucagaacccugccugccca

SEQ ID NO: 92065 - RNA, 32 nt, Human
caucagaaccgccaccaugacggugggcaaga

SEQ ID NO: 92066 - RNA, 32 nt, Human
caucagaacgcaucccucaucuggacuccagc

SEQ ID NO: 92067 - RNA, 32 nt, Human
caucagaacgccaugguuuugaggcagcuagu

SEQ ID NO: 92068 - RNA, 32 nt, Human
caucagaacuuugccauuugucuacagaagac

SEQ ID NO: 92069 - RNA, 32 nt, Human
caucagaagagccccgugucucccacaaauag

SEQ ID NO: 92070 - RNA, 32 nt, Human
caucagaagagggaggaggagcccaggcgucu

SEQ ID NO: 92071 - RNA, 32 nt, Human
caucagaauugccuggagugugcacugaaacu

SEQ ID NO: 92072 - RNA, 22 nt, Human
caucagacacagcccccaagau

SEQ ID NO: 92073 - RNA, 32 nt, Human
caucagacaccagaggacacacacagugcugu

SEQ ID NO: 92074 - RNA, 32 nt, Human
caucagacaguuucaagacacacccagucacu

SEQ ID NO: 92075 - RNA, 32 nt, Human
caucagacauguccguggugggcacagugccu

SEQ ID NO: 92076 - RNA, 32 nt, Human
caucagaccuaguguucucacacugaccaccc

SEQ ID NO: 92077 - RNA, 32 nt, Human
caucagagagguggcaguggagguuuguuauc

SEQ ID NO: 92078 - RNA, 32 nt, Human
caucagagagguuuauuucacacuuacaggca

SEQ ID NO: 92079 - RNA, 32 nt, Human
caucagagauuucauacuuaauaaaagcauua

SEQ ID NO: 92080 - RNA, 20 nt, Human
caucagagcaaccacaguga

SEQ ID NO: 92081 - RNA, 32 nt, Human
caucagagcugaacuucuuaagaaaagcacag

SEQ ID NO: 92082 - RNA, 32 nt, Human
caucagagcuggugccuucgggccagaaagac

SEQ ID NO: 92083 - RNA, 32 nt, Human
caucagaggaccccagaaaacuacccaaauga

SEQ ID NO: 92084 - RNA, 32 nt, Human
caucagaggcuagaagagaggcaaggaaaaau

SEQ ID NO: 92085 - RNA, 32 nt, Human
caucagaggcugggcuuggcagaggggagggg

SEQ ID NO: 92086 - RNA, 32 nt, Human
caucagaggugccaccaccaaagcacucuucc

SEQ ID NO: 92087 - RNA, 32 nt, Human
caucagaggugcuguuccgugguucugcauua

SEQ ID NO: 92088 - RNA, 32 nt, Human
caucagauugagugaaaaguugucagauucug

SEQ ID NO: 92089 - RNA, 32 nt, Human
caucagauugcccagaaguauggucuuaagag

SEQ ID NO: 92090 - RNA, 32 nt, Human
caucagcaaccaugacugaugacugggcccua

SEQ ID NO: 92091 - RNA, 23 nt, Human
caucagcaccacgugccaaggag

SEQ ID NO: 92092 - RNA, 32 nt, Human
caucagcaccuuucugagagcugcaguaugac

SEQ ID NO: 92093 - RNA, 32 nt, Human
caucagcagacguucccgugcaccacugugug

SEQ ID NO: 92094 - RNA, 32 nt, Human
caucagcagagcccagaugagcacgggccgcg

SEQ ID NO: 92095 - RNA, 32 nt, Human
caucagcagcaaucaucaaccaaccaaccaau

SEQ ID NO: 92096 - RNA, 32 nt, Human
caucagcagcccuguaacaagugccuugugag

SEQ ID NO: 92097 - RNA, 32 nt, Human
caucagcagccucaccagcugugagccugcua

SEQ ID NO: 92098 - RNA, 32 nt, Human
caucagcaggacaaaccaacagguacuccgca

SEQ ID NO: 92099 - RNA, 32 nt, Human
caucagcaucaucuuucacauguucauuauca

SEQ ID NO: 92100 - RNA, 32 nt, Human
caucagccacuuacuggcgcaguggcucaugc

SEQ ID NO: 92101 - RNA, 32 nt, Human
caucagccagaacaugagagggagaacuaacu

SEQ ID NO: 92102 - RNA, 32 nt, Human
caucagccauaccuaagaccugcaccuaagug

SEQ ID NO: 92103 - RNA, 32 nt, Human
caucagccccuaguucuugagagagaagggca

SEQ ID NO: 92104 - RNA, 32 nt, Human
caucagcccucaauuugugauccggaauuuug

SEQ ID NO: 92105 - RNA, 32 nt, Human
caucagcccugaguaguaacugguuagcuucu

SEQ ID NO: 92106 - RNA, 32 nt, Human
caucagccuccugccagcaguucuugaagcuu

SEQ ID NO: 92107 - RNA, 32 nt, Human
caucagccugucuuagccugagcugcuuugaa

SEQ ID NO: 92108 - RNA, 32 nt, Human
caucagcgucgacuugccuuucccgggguugu

SEQ ID NO: 92109 - RNA, 19 nt, Human
caucagcuaacucuacaga

SEQ ID NO: 92110 - RNA, 32 nt, Human
caucagcuacagccaauuugucagucacguga

SEQ ID NO: 92111 - RNA, 32 nt, Human
caucagcucaacugcacuugccucgcagaggc

SEQ ID NO: 92112 - RNA, 32 nt, Human
caucagcuccacuguugccaaacuuugucgca

SEQ ID NO: 92113 - RNA, 32 nt, Human
caucagcucuaaagcugaccugugguuccguc

SEQ ID NO: 92114 - RNA, 32 nt, Human
caucagcucuuuaagcaucucucuccaaggaa

SEQ ID NO: 92115 - RNA, 32 nt, Human
caucagcugacuaauagaccucagccucaaaa

SEQ ID NO: 92116 - RNA, 32 nt, Human
caucagcugcagcucccagcaugcuacugcca

SEQ ID NO: 92117 - RNA, 32 nt, Human
caucagcugcagcucugcaccaggccgguccc

SEQ ID NO: 92118 - RNA, 32 nt, Human
caucagcugggaggaaaggcagaguugggaaa

SEQ ID NO: 92119 - RNA, 32 nt, Human
caucagcuggguugugggaucucagacaucua

SEQ ID NO: 92120 - RNA, 32 nt, Human
caucagcugugaccaacagagcuggagcccuc

SEQ ID NO: 92121 - RNA, 32 nt, Human
caucagcuucacuuucuugcaguguuguugca

SEQ ID NO: 92122 - RNA, 32 nt, Human
caucaggaaaggagaaaggcagagggagagcg

SEQ ID NO: 92123 - RNA, 17 nt, Human
caucaggaauugucaaa

SEQ ID NO: 92124 - RNA, 32 nt, Human
caucaggacagcuucaccuccuugaggauuaa

SEQ ID NO: 92125 - RNA, 32 nt, Human
caucaggacuggacgguucccgcuggacuaua

SEQ ID NO: 92126 - RNA, 21 nt, Human
caucaggagaaaggcuggguc

SEQ ID NO: 92127 - RNA, 32 nt, Human
caucaggagugaccuccagaagcuccgggacc

SEQ ID NO: 92128 - RNA, 32 nt, Human
caucaggcaagacagacugaaugcaggagugg

SEQ ID NO: 92129 - RNA, 32 nt, Human
caucaggcccuuccagcuccccaggcucccug

SEQ ID NO: 92130 - RNA, 32 nt, Human
caucaggccucaagugggcaugggggcaggga

SEQ ID NO: 92131 - RNA, 32 nt, Human
caucaggccugggacacugcucuccuuccccg

SEQ ID NO: 92132 - RNA, 32 nt, Human
caucaggcgcagggccccagacagcuucccag

SEQ ID NO: 92133 - RNA, 32 nt, Human
caucaggcgggguggaggugcgcgcugagccc

SEQ ID NO: 92134 - RNA, 32 nt, Human
caucaggcuggggcagaggcauagcuauuguc

SEQ ID NO: 92135 - RNA, 32 nt, Human
caucagggaaagcagguguaucagggcuagga

SEQ ID NO: 92136 - RNA, 32 nt, Human
caucagggagccaggacacagaggggcagagc

SEQ ID NO: 92137 - RNA, 32 nt, Human
caucagggagugacaauccagcaagaaauccc

SEQ ID NO: 92138 - RNA, 32 nt, Human
caucagggccuggagacccagcaaggaguugc

SEQ ID NO: 92139 - RNA, 32 nt, Human
caucagggcuuguagggcacuaauagggacaa

SEQ ID NO: 92140 - RNA, 32 nt, Human
caucagggggaagggaggcugagccacgagag

SEQ ID NO: 92141 - RNA, 32 nt, Human
caucagggguagcgagguugcaggagcuggcu

SEQ ID NO: 92142 - RNA, 32 nt, Human
caucaggguaggcuaucuucucugccuucaau

SEQ ID NO: 92143 - RNA, 32 nt, Human
caucaggguccccagccucugggcuccuguuu

SEQ ID NO: 92144 - RNA, 32 nt, Human
caucaggguggggagagcacucucagcaggga

SEQ ID NO: 92145 - RNA, 32 nt, Human
caucagguaccuccucccuuucaucucagcaa

SEQ ID NO: 92146 - RNA, 32 nt, Human
caucaggucaggguugccacaaaagccuccau

SEQ ID NO: 92147 - RNA, 32 nt, Human
caucaggucauugcaguuuuaguucuguguaa

SEQ ID NO: 92148 - RNA, 32 nt, Human
caucagguccuagacgugggagaaggagccua

SEQ ID NO: 92149 - RNA, 32 nt, Human
caucaggugauggauaggagcaacccuguaaa

SEQ ID NO: 92150 - RNA, 32 nt, Human
caucagguuguuagaugcuggcaucucugcag

SEQ ID NO: 92151 - RNA, 32 nt, Human
caucaguaaagaccccaucugccuuguccaug

SEQ ID NO: 92152 - RNA, 23 nt, Human
caucaguaauacgauacagugaa

SEQ ID NO: 92153 - RNA, 32 nt, Human
caucaguaccaucacaguugcuguaaugacag

SEQ ID NO: 92154 - RNA, 32 nt, Human
caucaguacuaccaccaccaccaacaacauca

SEQ ID NO: 92155 - RNA, 32 nt, Human
caucaguaguccuccagccugggcagcugucc

SEQ ID NO: 92156 - RNA, 32 nt, Human
caucaguauguuaaaacuggggagugauuugu

SEQ ID NO: 92157 - RNA, 32 nt, Human
caucagucaagugugcccagugcuuucucuca

SEQ ID NO: 92158 - RNA, 18 nt, Human
caucagucacagucuucc

SEQ ID NO: 92159 - RNA, 32 nt, Human
caucagucaccaccaauuccuuauuaaguuaa

SEQ ID NO: 92160 - RNA, 23 nt, Human
caucagucacgcagacccugcug

SEQ ID NO: 92161 - RNA, 32 nt, Human
caucagucacgcaggaggacugacuugacaga

SEQ ID NO: 92162 - RNA, 22 nt, Human
caucagucaucucuuuauggug

SEQ ID NO: 92163 - RNA, 21 nt, Human
caucagucauguagcuagcug

SEQ ID NO: 92164 - RNA, 32 nt, Human
caucaguccacuccagccugagcaacagagcg

SEQ ID NO: 92165 - RNA, 21 nt, Human
caucagucccccucuguccug

SEQ ID NO: 92166 - RNA, 24 nt, Human
caucaguccugcauuucuuuggug

SEQ ID NO: 92167 - RNA, 32 nt, Human
caucagucugaauccaggucgugggggcuguc

SEQ ID NO: 92168 - RNA, 32 nt, Human
caucagugaagagaugcaagacuuucaacuga

SEQ ID NO: 92169 - RNA, 32 nt, Human
caucagugauggacauuuggguuguuuccucu

SEQ ID NO: 92170 - RNA, 32 nt, Human
caucaguggcaguuuggggagguggaggaggg

SEQ ID NO: 92171 - RNA, 32 nt, Human
caucagugucaaggaagaacuggauggcugag

SEQ ID NO: 92172 - RNA, 29 nt, Human
caucagugucuguggguaguuggaaucuu

SEQ ID NO: 92173 - RNA, 32 nt, Human
caucaguguuaacucccuacagauuacacucu

SEQ ID NO: 92174 - RNA, 32 nt, Human
caucaguuaccaacuaaaucagggcauggugu

SEQ ID NO: 92175 - RNA, 22 nt, Human
caucaguuacugguuucaguug

SEQ ID NO: 92176 - RNA, 32 nt, Human
caucaguucaccuuuaaagacacacauuccuu

SEQ ID NO: 92177 - RNA, 23 nt, Human
caucaguucacugcugcauguug

SEQ ID NO: 92178 - RNA, 22 nt, Human
caucaguucacuguuguuggag

SEQ ID NO: 92179 - RNA, 32 nt, Human
caucaguugcuuuuacucaguguuuucaaaua

SEQ ID NO: 92180 - RNA, 32 nt, Human
caucaguuuucuuuaaaaaccuacaaauggga

SEQ ID NO: 92181 - RNA, 32 nt, Human
caucaguuuuuauugcagcacuguccauauuc

SEQ ID NO: 92182 - RNA, 32 nt, Human
caucauaaauguggugcugcuauucgacaaac

SEQ ID NO: 92183 - RNA, 32 nt, Human
caucauaagucgugcugccggccagguuacuu

SEQ ID NO: 92184 - RNA, 20 nt, Human
caucauaaugguagauccac

SEQ ID NO: 92185 - RNA, 32 nt, Human
caucauaauguauucaccacuggagcuucacu

SEQ ID NO: 92186 - RNA, 32 nt, Human
caucauaccaggggccagaggcgauggcuugc

SEQ ID NO: 92187 - RNA, 32 nt, Human
caucauacccggcuaguuuuuguauuuuuagu

SEQ ID NO: 92188 - RNA, 32 nt, Human
caucauacucacugcagccuugaccgccuggg

SEQ ID NO: 92189 - RNA, 21 nt, Human
caucauacucaggaagaagau

SEQ ID NO: 92190 - RNA, 32 nt, Human
caucauacuguugucauauguugagccugugg

SEQ ID NO: 92191 - RNA, 32 nt, Human
caucauagacuucauacgggagagaaaccuua

SEQ ID NO: 92192 - RNA, 32 nt, Human
caucauagacuucauacugcagagaaaccaua

SEQ ID NO: 92193 - RNA, 32 nt, Human
caucauagacuucauaguggagagaaacccua

SEQ ID NO: 92194 - RNA, 32 nt, Human
caucauagacuucauaguggagagaaaccuua

SEQ ID NO: 92195 - RNA, 32 nt, Human
caucauagacuucauaguggagagaaaccuug

SEQ ID NO: 92196 - RNA, 32 nt, Human
caucauagaucauuuuuccauaugacacuggu

SEQ ID NO: 92197 - RNA, 32 nt, Human
caucauaggagaaaagaagauagcuccacuga

SEQ ID NO: 92198 - RNA, 18 nt, Human
caucaucacacacagaga

SEQ ID NO: 92199 - RNA, 32 nt, Human
caucaucacaccacuccgcugccugggguuuu

SEQ ID NO: 92200 - RNA, 22 nt, Human
caucaucaccaucucuuucuca

SEQ ID NO: 92201 - RNA, 32 nt, Human
caucaucacugaacccagaagagaggguggug

SEQ ID NO: 92202 - RNA, 32 nt, Human
caucaucagaguauccuacacaaaguugucuc

SEQ ID NO: 92203 - RNA, 32 nt, Human
caucaucagcaacuccaaaccccagccacuuc

SEQ ID NO: 92204 - RNA, 32 nt, Human
caucaucaggcagauacagagcacugcagcaa

SEQ ID NO: 92205 - RNA, 32 nt, Human
caucaucaggcuauuaaauaaaauuuauagga

SEQ ID NO: 92206 - RNA, 20 nt, Human
caucaucaguacuccuuguu

SEQ ID NO: 92207 - RNA, 32 nt, Human
caucaucagugacaccaccaggaccaccguca

SEQ ID NO: 92208 - RNA, 23 nt, Human
caucaucaucaccaccaucauca

SEQ ID NO: 92209 - RNA, 23 nt, Human
caucaucaucaucaucauccuca

SEQ ID NO: 92210 - RNA, 32 nt, Human
caucaucaucaucucugcuacagucauguuuc

SEQ ID NO: 92211 - RNA, 32 nt, Human
caucaucauccagagccuaaggacugacaggc

SEQ ID NO: 92212 - RNA, 32 nt, Human
caucaucaucccagcuggagucauggagccuc

SEQ ID NO: 92213 - RNA, 32 nt, Human
caucaucauggagacccaaaaggaugaagcug

SEQ ID NO: 92214 - RNA, 19 nt, Human
caucauccaucucuccaga

SEQ ID NO: 92215 - RNA, 32 nt, Human
caucauccccaccaccaccaccaccaccauca

SEQ ID NO: 92216 - RNA, 32 nt, Human
caucaucccuuucccuuggugcccuccuuuuu

SEQ ID NO: 92217 - RNA, 25 nt, Human
caucauccucccuuccucaucauca

SEQ ID NO: 92218 - RNA, 32 nt, Human
caucauccuugcagguggggguugcuguguaa

SEQ ID NO: 92219 - RNA, 32 nt, Human
caucaucggugacugguuaucacaccaucgcu

SEQ ID NO: 92220 - RNA, 32 nt, Human
caucaucucacaguggucucucuuuucacuaa

SEQ ID NO: 92221 - RNA, 32 nt, Human
caucaucucccaggauccaugagguccagugu

SEQ ID NO: 92222 - RNA, 32 nt, Human
caucaucucccuucucuuucucgcauaacucc

SEQ ID NO: 92223 - RNA, 32 nt, Human
caucaucucugaaggaguuacagggaaguggu

SEQ ID NO: 92224 - RNA, 32 nt, Human
caucaucugggaugugaggagccccucugccu

SEQ ID NO: 92225 - RNA, 32 nt, Human
caucaucugggaugugaggagcgccucugucu

SEQ ID NO: 92226 - RNA, 21 nt, Human
caucaucuguaaaaccaucua

SEQ ID NO: 92227 - RNA, 23 nt, Human
caucaucuuaaguucuucaugcu

SEQ ID NO: 92228 - RNA, 32 nt, Human
caucaucuuccuaggcagucucuuccccaaag

SEQ ID NO: 92229 - RNA, 32 nt, Human
caucaucuucuuuccucuuucuucccacauuu

SEQ ID NO: 92230 - RNA, 32 nt, Human
caucaucuuuggugggucuuuucuuugcuucu

SEQ ID NO: 92231 - RNA, 32 nt, Human
caucaucuuugucaccuccacccccauaaaac

SEQ ID NO: 92232 - RNA, 32 nt, Human
caucaugaagagcggcuggagugacugcccua

SEQ ID NO: 92233 - RNA, 32 nt, Human
caucaugauaagaggaaugaacgugucugcaa

SEQ ID NO: 92234 - RNA, 32 nt, Human
caucaugaucaggcacagaguccagauacacu

SEQ ID NO: 92235 - RNA, 29 nt, Human
caucaugaugcagggaaacacaugucaca

SEQ ID NO: 92236 - RNA, 32 nt, Human
caucaugauguuaucauaucuuauucccuuuu

SEQ ID NO: 92237 - RNA, 32 nt, Human
caucaugcagcucaacuuucuguuggauucca

SEQ ID NO: 92238 - RNA, 32 nt, Human
caucaugcaucacucucccuucugccuccuuc

SEQ ID NO: 92239 - RNA, 32 nt, Human
caucaugccacugcacuccagccuggggcuga

SEQ ID NO: 92240 - RNA, 32 nt, Human
caucaugccacugcacuuccagccugggugac

SEQ ID NO: 92241 - RNA, 20 nt, Human
caucaugccagcuuugucaa

SEQ ID NO: 92242 - RNA, 19 nt, Human
caucaugcccaccagggug

SEQ ID NO: 92243 - RNA, 32 nt, Human
caucaugcccagcuaauuuuuguauuuuagua

SEQ ID NO: 92244 - RNA, 32 nt, Human
caucaugcccagcuaauuuuuguauuuuggua

SEQ ID NO: 92245 - RNA, 32 nt, Human
caucaugcccagcugauuuuuguauuuuuagu

SEQ ID NO: 92246 - RNA, 32 nt, Human
caucaugcccggcuaauuuuuguauuuuuagu

SEQ ID NO: 92247 - RNA, 32 nt, Human
caucaugcccggcuacuuuuuguauuuuuagu

SEQ ID NO: 92248 - RNA, 32 nt, Human
caucaugccugacuaauuuuguauuuuuagua

SEQ ID NO: 92249 - RNA, 32 nt, Human
caucaugccugacuaauuuuuguauuuuuagu

SEQ ID NO: 92250 - RNA, 32 nt, Human
caucaugccuggcuaauuuuuguauuuuuagu

SEQ ID NO: 92251 - RNA, 19 nt, Human
caucaugccuugaguguuc

SEQ ID NO: 92252 - RNA, 23 nt, Human
caucaugcgcagggcccgggacg

SEQ ID NO: 92253 - RNA, 32 nt, Human
caucaugcucuaacuucaguauaccaauaaaa

SEQ ID NO: 92254 - RNA, 32 nt, Human
caucaugcucugagcccauuccuugaaaacua

SEQ ID NO: 92255 - RNA, 32 nt, Human
caucaugcuuggcuaauuuuuguauuuuuagu

SEQ ID NO: 92256 - RNA, 32 nt, Human
caucaugcuuuuccagcucaucacaccccgcc

SEQ ID NO: 92257 - RNA, 32 nt, Human
caucaugcuuuuccucucacacucuugaagag

SEQ ID NO: 92258 - RNA, 18 nt, Human
caucauggauugcucaga

SEQ ID NO: 92259 - RNA, 32 nt, Human
caucauggcacacaccuguagucccagcuacu

SEQ ID NO: 92260 - RNA, 29 nt, Human
caucauggccaugaagaucauggagaaga

SEQ ID NO: 92261 - RNA, 32 nt, Human
caucauggcccagggaggcgggugaaagcucc

SEQ ID NO: 92262 - RNA, 17 nt, Human
caucauggcccaguuaa

SEQ ID NO: 92263 - RNA, 32 nt, Human
caucauggcucacaccuguaaucccagcacuu

SEQ ID NO: 92264 - RNA, 32 nt, Human
caucaugggagacauccagauggcacaccaga

SEQ ID NO: 92265 - RNA, 29 nt, Human
caucaugggcaguggcaaagaagauuaca

SEQ ID NO: 92266 - RNA, 32 nt, Human
caucauggggaccaggauagaaggcuucuucc

SEQ ID NO: 92267 - RNA, 21 nt, Human
caucauggguguuuuugucaa

SEQ ID NO: 92268 - RNA, 21 nt, Human
caucauggucaucuaucauca

SEQ ID NO: 92269 - RNA, 18 nt, Human
caucaugguccccccaaa

SEQ ID NO: 92270 - RNA, 18 nt, Human
caucauggugcucuuaaa

SEQ ID NO: 92271 - RNA, 32 nt, Human
caucauggugucaggaaggcugagauguauug

SEQ ID NO: 92272 - RNA, 15 nt, Human
caucaugguuuucaa

SEQ ID NO: 92273 - RNA, 32 nt, Human
caucauguauuuuaaaugccaccuacauaaau

SEQ ID NO: 92274 - RNA, 19 nt, Human
caucaugucugccagggug

SEQ ID NO: 92275 - RNA, 32 nt, Human
caucaugucuuugucagugccauguccacagu

SEQ ID NO: 92276 - RNA, 32 nt, Human
caucauguggccucuggacacuguggucaguc

SEQ ID NO: 92277 - RNA, 32 nt, Human
caucauguugcccaggcuggucucaaauuccu

SEQ ID NO: 92278 - RNA, 32 nt, Human
caucauguuggccaggcuggucucaaacuccu

SEQ ID NO: 92279 - RNA, 32 nt, Human
caucauguuggccaggcuggucucgaacuccu

SEQ ID NO: 92280 - RNA, 32 nt, Human
caucauguuggccaggcuggucuggaacuccu

SEQ ID NO: 92281 - RNA, 32 nt, Human
caucauguuguccaggcuggugucaaacuccu

SEQ ID NO: 92282 - RNA, 32 nt, Human
caucauguuucccaggcuggucucaaacuccu

SEQ ID NO: 92283 - RNA, 32 nt, Human
caucauuaacauccuucuuuucuauugcuugg

SEQ ID NO: 92284 - RNA, 32 nt, Human
caucauuaacuuuucuccagaaguacugcagg

SEQ ID NO: 92285 - RNA, 32 nt, Human
caucauuacuaaaaacacaaaaauuagccagg

SEQ ID NO: 92286 - RNA, 32 nt, Human
caucauuaucaauuuccacaugaaaaaggugg

SEQ ID NO: 92287 - RNA, 32 nt, Human
caucauucaucuuucucacugcagggccuugc

SEQ ID NO: 92288 - RNA, 32 nt, Human
caucauuccagccugggcaacaagagugaaac

SEQ ID NO: 92289 - RNA, 32 nt, Human
caucauuccuucacucuucucuuuuucccgcc

SEQ ID NO: 92290 - RNA, 32 nt, Human
caucauuccuuuguuguugauaaugggcuuug

SEQ ID NO: 92291 - RNA, 32 nt, Human
caucauucucacuucuaaagccaucaacagag

SEQ ID NO: 92292 - RNA, 32 nt, Human
caucauucuccucugcugacaaccucugccgc

SEQ ID NO: 92293 - RNA, 32 nt, Human
caucauugcaccugcaggcuuagguccucacu

SEQ ID NO: 92294 - RNA, 32 nt, Human
caucauugcacuccagccugggcaacaagagc

SEQ ID NO: 92295 - RNA, 32 nt, Human
caucauugcacuccagccugggcaacagagac

SEQ ID NO: 92296 - RNA, 32 nt, Human
caucauugcacuccagccugggugacagagug

SEQ ID NO: 92297 - RNA, 32 nt, Human
caucauugcacucuagccugggccacagggcg

SEQ ID NO: 92298 - RNA, 32 nt, Human
caucauugcaucuauuuuccauauagucauca

SEQ ID NO: 92299 - RNA, 32 nt, Human
caucauuggaauacaggaaguagcccugcacc

SEQ ID NO: 92300 - RNA, 32 nt, Human
caucauuuauuuuccauugucugucuucgguc

SEQ ID NO: 92301 - RNA, 32 nt, Human
caucauuucacaauccacauuccccagcuugg

SEQ ID NO: 92302 - RNA, 32 nt, Human
caucauuucacucuggucugagugguggccug

SEQ ID NO: 92303 - RNA, 32 nt, Human
caucauuucacuugucaggagugugugugagu

SEQ ID NO: 92304 - RNA, 32 nt, Human
caucauuucagcuucuggccacugggaggcgc

SEQ ID NO: 92305 - RNA, 32 nt, Human
caucauuucaguuccguaggucaguguugcgg

SEQ ID NO: 92306 - RNA, 32 nt, Human
caucauuucuauggccuagccuaggcaguuuc

SEQ ID NO: 92307 - RNA, 32 nt, Human
caucauuucuuaaggcugccuuccucucugag

SEQ ID NO: 92308 - RNA, 32 nt, Human
caucauuugacaguguucucucauuucuuaaa

SEQ ID NO: 92309 - RNA, 32 nt, Human
caucauuuuccuucaagaaugacagggucagc

SEQ ID NO: 92310 - RNA, 32 nt, Human
caucauuuugagcucaaagaauucugagacuu

SEQ ID NO: 92311 - RNA, 32 nt, Human
caucauuuuggagaacaacauggauuucacag

SEQ ID NO: 92312 - RNA, 32 nt, Human
cauccaaaaccuucccagaauccaucagcaag

SEQ ID NO: 92313 - RNA, 32 nt, Human
cauccaaaaguggaccuugggagcaguggggg

SEQ ID NO: 92314 - RNA, 24 nt, Human
cauccaaauagcugggaccacagg

SEQ ID NO: 92315 - RNA, 32 nt, Human
cauccaacagaaucaugagacagacuuugccu

SEQ ID NO: 92316 - RNA, 32 nt, Human
cauccaacauggugaagccccgucucuacuaa

SEQ ID NO: 92317 - RNA, 32 nt, Human
cauccaacuugcaaauaaaaacucagugaugc

SEQ ID NO: 92318 - RNA, 32 nt, Human
cauccaagaagaggagaaaacacugacaaaga

SEQ ID NO: 92319 - RNA, 32 nt, Human
cauccaagacaggcaauaaugagcagaguuua

SEQ ID NO: 92320 - RNA, 19 nt, Human
cauccaagcacaccuggau

SEQ ID NO: 92321 - RNA, 32 nt, Human
cauccaagcuacucaagagacugaggcaggag

SEQ ID NO: 92322 - RNA, 18 nt, Human
cauccaaggaccccugcc

SEQ ID NO: 92323 - RNA, 32 nt, Human
cauccaaggagagugugggcagcuggagccag

SEQ ID NO: 92324 - RNA, 32 nt, Human
cauccaagggagcuggaauugaguaccuaaau

SEQ ID NO: 92325 - RNA, 22 nt, Human
cauccaaggggccuggaaguua

SEQ ID NO: 92326 - RNA, 32 nt, Human
cauccaaguggcauuccuaguaaguuggguag

SEQ ID NO: 92327 - RNA, 32 nt, Human
cauccaaguuguggauggcaggcaggagcaug

SEQ ID NO: 92328 - RNA, 24 nt, Human
cauccaauagggggcuuugagggg

SEQ ID NO: 92329 - RNA, 19 nt, Human
cauccaaugacucugaggg

SEQ ID NO: 92330 - RNA, 32 nt, Human
cauccaauucagacuucuuuuggugcuuguga

SEQ ID NO: 92331 - RNA, 32 nt, Human
cauccacacaaacccacggcucccaguugaca

SEQ ID NO: 92332 - RNA, 32 nt, Human
cauccacacacacaggcacccacccacaccag

SEQ ID NO: 92333 - RNA, 32 nt, Human
cauccacaccaagaggguguugugaugaggug

SEQ ID NO: 92334 - RNA, 32 nt, Human
cauccacaccacucuucgccacccggcuggga

SEQ ID NO: 92335 - RNA, 21 nt, Human
cauccacacccugcguccaca

SEQ ID NO: 92336 - RNA, 32 nt, Human
cauccacaccgccaccaccaagcagccgcuga

SEQ ID NO: 92337 - RNA, 32 nt, Human
cauccacagcaaaagaaaccucuuaaggucaa

SEQ ID NO: 92338 - RNA, 22 nt, Human
cauccacagcacugugcaugca

SEQ ID NO: 92339 - RNA, 22 nt, Human
cauccacagcccacccaucaca

SEQ ID NO: 92340 - RNA, 32 nt, Human
cauccacagccuucccugucaccggcuccucu

SEQ ID NO: 92341 - RNA, 19 nt, Human
cauccacagcuggugcuca

SEQ ID NO: 92342 - RNA, 32 nt, Human
cauccacaucaggacaucccagcuggaguuca

SEQ ID NO: 92343 - RNA, 32 nt, Human
cauccacaucugcucggcaaagaaggaaggca

SEQ ID NO: 92344 - RNA, 17 nt, Human
cauccacauuccacccu

SEQ ID NO: 92345 - RNA, 32 nt, Human
cauccacauuuaagucaccaggccucguuguu

SEQ ID NO: 92346 - RNA, 22 nt, Human
cauccaccaaugaacugaaagg

SEQ ID NO: 92347 - RNA, 18 nt, Human
cauccaccaccagugcug

SEQ ID NO: 92348 - RNA, 32 nt, Human
cauccacccaugaagccaaagccaucaucucu

SEQ ID NO: 92349 - RNA, 32 nt, Human
cauccaccccuucucuucauccuucccuauuc

SEQ ID NO: 92350 - RNA, 32 nt, Human
cauccaccuccaccucccaaggugcugggauu

SEQ ID NO: 92351 - RNA, 32 nt, Human
cauccaccucuuccauaccuuuacaggccucu

SEQ ID NO: 92352 - RNA, 32 nt, Human
cauccaccugcuuaugcauuuaucucuuuugu

SEQ ID NO: 92353 - RNA, 30 nt, Human
cauccacggugacuugcaggucauggagag

SEQ ID NO: 92354 - RNA, 22 nt, Human
cauccacucagggcagccagug

SEQ ID NO: 92355 - RNA, 32 nt, Human
cauccacucaggucuuccucuggaccugcaua

SEQ ID NO: 92356 - RNA, 32 nt, Human
cauccacuccaaagcagagaauuucugaaaaa

SEQ ID NO: 92357 - RNA, 32 nt, Human
cauccacuccaggacagcugagcgucuggaug

SEQ ID NO: 92358 - RNA, 19 nt, Human
cauccacuccugcagucca

SEQ ID NO: 92359 - RNA, 32 nt, Human
cauccacucucccuuguccucccgggggugua

SEQ ID NO: 92360 - RNA, 24 nt, Human
cauccacugaacaaauccauggca

SEQ ID NO: 92361 - RNA, 32 nt, Human
cauccacugaguaccuaccaugugccaaauac

SEQ ID NO: 92362 - RNA, 32 nt, Human
cauccacugcagcucugggcuccauuucccuu

SEQ ID NO: 92363 - RNA, 32 nt, Human
cauccacuggccacccucacucccaggucccc

SEQ ID NO: 92364 - RNA, 32 nt, Human
cauccacuuauuccaaggcuaagaauaggagu

SEQ ID NO: 92365 - RNA, 32 nt, Human
cauccacuucucucuccuucucccucugucaa

SEQ ID NO: 92366 - RNA, 32 nt, Human
cauccacuuggagugcugcggggaagaaauca

SEQ ID NO: 92367 - RNA, 32 nt, Human
cauccacuuuuaucucuuuccaaucacuuguu

SEQ ID NO: 92368 - RNA, 32 nt, Human
cauccagaaacaugacaacgugagcauccugu

SEQ ID NO: 92369 - RNA, 32 nt, Human
cauccagaaagccaugaaagagggacgcuaca

SEQ ID NO: 92370 - RNA, 32 nt, Human
cauccagaaagcuucccugcaaucuugggguu

SEQ ID NO: 92371 - RNA, 32 nt, Human
cauccagaaagugcccagaagaaacuuccugc

SEQ ID NO: 92372 - RNA, 31 nt, Human
cauccagacagcaaagcaaggagggagcgug

SEQ ID NO: 92373 - RNA, 32 nt, Human
cauccagacagcccagggugacuuugaugcca

SEQ ID NO: 92374 - RNA, 17 nt, Human
cauccagacccccugcc

SEQ ID NO: 92375 - RNA, 16 nt, Human
cauccagaccccugcc

SEQ ID NO: 92376 - RNA, 32 nt, Human
cauccagacuguucccuucgcauccugcagaa

SEQ ID NO: 92377 - RNA, 32 nt, Human
cauccagagagggcauggaggcuccauacaac

SEQ ID NO: 92378 - RNA, 32 nt, Human
cauccagagcagccaguguccgggaggcagaa

SEQ ID NO: 92379 - RNA, 32 nt, Human
cauccagagccagcgagcaggagcgcugcguc

SEQ ID NO: 92380 - RNA, 32 nt, Human
cauccagagccucuguccugcccacgcuagcc

SEQ ID NO: 92381 - RNA, 32 nt, Human
cauccagagcugcaucauuccuuggggcaaaa

SEQ ID NO: 92382 - RNA, 20 nt, Human
cauccagagcuggagugcag

SEQ ID NO: 92383 - RNA, 32 nt, Human
cauccagagcuggagugcagcggcacagucau

SEQ ID NO: 92384 - RNA, 32 nt, Human
cauccagauuacuucuucagugccucaggagu

SEQ ID NO: 92385 - RNA, 32 nt, Human
cauccagcacuugccuccgccauggucacucg

SEQ ID NO: 92386 - RNA, 32 nt, Human
cauccagcagcaaacugucguggugccggcac

SEQ ID NO: 92387 - RNA, 32 nt, Human
cauccagccucgcgguucagagcccagcucug

SEQ ID NO: 92388 - RNA, 32 nt, Human
cauccagccucugucuguuacuccugacccac

SEQ ID NO: 92389 - RNA, 32 nt, Human
cauccagcugaucuaggucacaccuggcucuu

SEQ ID NO: 92390 - RNA, 32 nt, Human
cauccagcuggggccaguggaggucaagccug

SEQ ID NO: 92391 - RNA, 32 nt, Human
cauccagcugucacacugacaaaaagaaaaga

SEQ ID NO: 92392 - RNA, 32 nt, Human
cauccagcuucaaccaaugccuggaccugucc

SEQ ID NO: 92393 - RNA, 32 nt, Human
cauccagcuucccacccuccacugacugccau

SEQ ID NO: 92394 - RNA, 32 nt, Human
cauccagcuuggugucaagugggcuguugcug

SEQ ID NO: 92395 - RNA, 32 nt, Human
cauccaggagaaaaaggcaggagcagcaagug

SEQ ID NO: 92396 - RNA, 32 nt, Human
cauccaggagauagaaguugcagugagcugag

SEQ ID NO: 92397 - RNA, 21 nt, Human
cauccaggcuggagugcggug

SEQ ID NO: 92398 - RNA, 32 nt, Human
cauccagggacaguuucgucucccugucaaug

SEQ ID NO: 92399 - RNA, 32 nt, Human
cauccagggccugcacagcuuagagaggcuca

SEQ ID NO: 92400 - RNA, 32 nt, Human
cauccagguaccacaggacagccuggggcagg

SEQ ID NO: 92401 - RNA, 32 nt, Human
cauccaggucaacaccaguagugguaagucgu

SEQ ID NO: 92402 - RNA, 32 nt, Human
cauccaguaugggggaaugauaccucacgucu

SEQ ID NO: 92403 - RNA, 32 nt, Human
cauccaguuaccaccuccugccucagaggcca

SEQ ID NO: 92404 - RNA, 32 nt, Human
cauccaguuagaagccucgguuuggaacagug

SEQ ID NO: 92405 - RNA, 32 nt, Human
cauccaguugcagaaaaacaagcuuaacacgc

SEQ ID NO: 92406 - RNA, 32 nt, Human
cauccauaacauccuuccacagcucccuuccc

SEQ ID NO: 92407 - RNA, 32 nt, Human
cauccauacaaaccaacacagcaucaucuaaa

SEQ ID NO: 92408 - RNA, 22 nt, Human
cauccauacauccaccugccuc

SEQ ID NO: 92409 - RNA, 22 nt, Human
cauccauaccucugccucccca

SEQ ID NO: 92410 - RNA, 32 nt, Human
cauccauaugugugaggaguuaagucuguuuc

SEQ ID NO: 92411 - RNA, 32 nt, Human
cauccaucauaaccaccccagccugggaagga

SEQ ID NO: 92412 - RNA, 32 nt, Human
cauccauccaacaaucauagaauuguucugag

SEQ ID NO: 92413 - RNA, 19 nt, Human
cauccauccuccuaccuca

SEQ ID NO: 92414 - RNA, 32 nt, Human
cauccauccuuuccuagcuccauccuuccguc

SEQ ID NO: 92415 - RNA, 32 nt, Human
cauccaucuacccaacugucaccaucuuugca

SEQ ID NO: 92416 - RNA, 32 nt, Human
cauccaucucuccagacucugccuccuacgag

SEQ ID NO: 92417 - RNA, 32 nt, Human
cauccaucuuucuccacuucccccaggucuug

SEQ ID NO: 92418 - RNA, 20 nt, Human
cauccaugaaauuggcugaa

SEQ ID NO: 92419 - RNA, 20 nt, Human
cauccaugaagagcugaagg

SEQ ID NO: 92420 - RNA, 22 nt, Human
cauccaugauccuccugccuca

SEQ ID NO: 92421 - RNA, 32 nt, Human
cauccaugcacacaccaggaugcagcugccaa

SEQ ID NO: 92422 - RNA, 32 nt, Human
cauccaugcauucuauucccaguaucaggggu

SEQ ID NO: 92423 - RNA, 32 nt, Human
cauccaugcugcuagaauccaaaaagaaucac

SEQ ID NO: 92424 - RNA, 32 nt, Human
cauccaugguggagagcucugaagggguugug

SEQ ID NO: 92425 - RNA, 32 nt, Human
cauccaugucccucguguuggacacuagagcu

SEQ ID NO: 92426 - RNA, 32 nt, Human
cauccauguggaggacagucugagggagccac

SEQ ID NO: 92427 - RNA, 32 nt, Human
cauccauuagccucaugguuuugcuucaaguc

SEQ ID NO: 92428 - RNA, 32 nt, Human
cauccauucacuguucagcuguacugugauuu

SEQ ID NO: 92429 - RNA, 32 nt, Human
cauccauugagcaucucucaugugccagcugc

SEQ ID NO: 92430 - RNA, 32 nt, Human
cauccauugaucugccuaucccuucuuuuuac

SEQ ID NO: 92431 - RNA, 32 nt, Human
cauccauuggcuucucuucucuccuuagaaau

SEQ ID NO: 92432 - RNA, 32 nt, Human
cauccauuuuccagacgucuacucaugucuga

SEQ ID NO: 92433 - RNA, 20 nt, Human
caucccaaaacccacagcac

SEQ ID NO: 92434 - RNA, 19 nt, Human
caucccaaaagaagcacca

SEQ ID NO: 92435 - RNA, 17 nt, Human
caucccaaacggcauca

SEQ ID NO: 92436 - RNA, 32 nt, Human
caucccaaagugcugggauuacagcaucccag

SEQ ID NO: 92437 - RNA, 32 nt, Human
caucccaaagugcugggauuacaggcaugagc

SEQ ID NO: 92438 - RNA, 32 nt, Human
caucccaaaguguugggauuauaggcacgagc

SEQ ID NO: 92439 - RNA, 19 nt, Human
caucccaaauaccaccacc

SEQ ID NO: 92440 - RNA, 32 nt, Human
caucccaaauaccaccaccaaccaccuucuuc

SEQ ID NO: 92441 - RNA, 24 nt, Human
caucccaaauucaaucaguccaua

SEQ ID NO: 92442 - RNA, 17 nt, Human
caucccaaccaggcacc

SEQ ID NO: 92443 - RNA, 17 nt, Human
caucccaaccccauugc

SEQ ID NO: 92444 - RNA, 32 nt, Human
caucccaacccccacacuccccauccuccaac

SEQ ID NO: 92445 - RNA, 20 nt, Human
caucccaaccccugcaccac

SEQ ID NO: 92446 - RNA, 19 nt, Human
caucccaaccgggcaucac

SEQ ID NO: 92447 - RNA, 16 nt, Human
caucccaacgggcacc

SEQ ID NO: 92448 - RNA, 32 nt, Human
caucccaagaugucuuuucugccuuucuuuug

SEQ ID NO: 92449 - RNA, 32 nt, Human
caucccaagcaaggagccccagucucccgagc

SEQ ID NO: 92450 - RNA, 30 nt, Human
caucccaagccccucaugcuccugccuucc

SEQ ID NO: 92451 - RNA, 25 nt, Human
caucccaaguagcugggauuacagg

SEQ ID NO: 92452 - RNA, 32 nt, Human
caucccaaguagcugggauuacaggcacccac

SEQ ID NO: 92453 - RNA, 17 nt, Human
caucccaccacagugaa

SEQ ID NO: 92454 - RNA, 32 nt, Human
caucccaccagccucuccaaggguggugacca

SEQ ID NO: 92455 - RNA, 32 nt, Human
caucccaccagccugcaccacaggcuccccug

SEQ ID NO: 92456 - RNA, 32 nt, Human
caucccacccaccucugucccuccaagggcag

SEQ ID NO: 92457 - RNA, 32 nt, Human
caucccacccagacgguguccucuucuugucg

SEQ ID NO: 92458 - RNA, 32 nt, Human
caucccacccccagguuuccugcaguuguugu

SEQ ID NO: 92459 - RNA, 18 nt, Human
caucccacccuccuccca

SEQ ID NO: 92460 - RNA, 22 nt, Human
caucccacucccagggugucac

SEQ ID NO: 92461 - RNA, 32 nt, Human
caucccacucgcuacccuguccgauggggaaa

SEQ ID NO: 92462 - RNA, 32 nt, Human
caucccacugggugugaaggaaggaaaugacc

SEQ ID NO: 92463 - RNA, 32 nt, Human
caucccacugguuaagaugagagaggcuagag

SEQ ID NO: 92464 - RNA, 23 nt, Human
caucccacuuccaccagcaccau

SEQ ID NO: 92465 - RNA, 32 nt, Human
caucccacuuccaccagcaccauagaagaaua

SEQ ID NO: 92466 - RNA, 32 nt, Human
caucccacuugccugucccaaguuuuguucca

SEQ ID NO: 92467 - RNA, 32 nt, Human
caucccagaaucuggauguggcccaggcagaa

SEQ ID NO: 92468 - RNA, 21 nt, Human
caucccagacgccacaccugc

SEQ ID NO: 92469 - RNA, 32 nt, Human
caucccagagaagggaaauccucuugcucgug

SEQ ID NO: 92470 - RNA, 32 nt, Human
caucccagagagagcugggcccauccucagcc

SEQ ID NO: 92471 - RNA, 19 nt, Human
caucccagagccuggggag

SEQ ID NO: 92472 - RNA, 32 nt, Human
caucccagaugauuaccucugccccuuccagu

SEQ ID NO: 92473 - RNA, 32 nt, Human
caucccagcauugcaauggagaaaaaugggaa

SEQ ID NO: 92474 - RNA, 18 nt, Human
caucccagccagagcacc

SEQ ID NO: 92475 - RNA, 32 nt, Human
caucccagccucguguugagguuccagacuua

SEQ ID NO: 92476 - RNA, 32 nt, Human
caucccagccugaccaauguccacagccaggg

SEQ ID NO: 92477 - RNA, 17 nt, Human
caucccagccugaggug

SEQ ID NO: 92478 - RNA, 32 nt, Human
caucccagccugggagacagagugagacccug

SEQ ID NO: 92479 - RNA, 32 nt, Human
caucccagccugggggccaguggggaacugag

SEQ ID NO: 92480 - RNA, 32 nt, Human
caucccagccugugguuacagugcagacaggc

SEQ ID NO: 92481 - RNA, 32 nt, Human
caucccagcuacucagguaguugaggcacaac

SEQ ID NO: 92482 - RNA, 32 nt, Human
caucccagcuacuccagaggcugagaugggag

SEQ ID NO: 92483 - RNA, 32 nt, Human
caucccagcuacuccaggggcugaggugacag

SEQ ID NO: 92484 - RNA, 32 nt, Human
caucccagcuacucgggaggcugaggcaggag

SEQ ID NO: 92485 - RNA, 32 nt, Human
caucccagcuacucgggaggcugaggugggag

SEQ ID NO: 92486 - RNA, 32 nt, Human
caucccagcuacucgguaggcugaggcaggaa

SEQ ID NO: 92487 - RNA, 32 nt, Human
caucccagcuacuugagaggcugaagcagaag

SEQ ID NO: 92488 - RNA, 32 nt, Human
caucccagcuacuugggaggcugaggcaggag

SEQ ID NO: 92489 - RNA, 19 nt, Human
caucccagcucugcauggc

SEQ ID NO: 92490 - RNA, 32 nt, Human
caucccaggagggagagaggagcugccgagua

SEQ ID NO: 92491 - RNA, 20 nt, Human
caucccaggcagagcaccac

SEQ ID NO: 92492 - RNA, 20 nt, Human
caucccaggcugagcaccgc

SEQ ID NO: 92493 - RNA, 18 nt, Human
caucccagggagcuccac

SEQ ID NO: 92494 - RNA, 19 nt, Human
caucccagggccuggagag

SEQ ID NO: 92495 - RNA, 21 nt, Human
caucccagguguugggcgggg

SEQ ID NO: 92496 - RNA, 32 nt, Human
caucccaguaggggcggccgggcagaggcgcc

SEQ ID NO: 92497 - RNA, 32 nt, Human
caucccaguaguuucuccucugagacacaugg

SEQ ID NO: 92498 - RNA, 32 nt, Human
caucccagucaugguacccuguggaggaaugc

SEQ ID NO: 92499 - RNA, 32 nt, Human
caucccaguggaggggaaaggggauaaguguu

SEQ ID NO: 92500 - RNA, 32 nt, Human
caucccaguggaggggaaaggggauguuucaa

SEQ ID NO: 92501 - RNA, 20 nt, Human
caucccaguguccagcacca

SEQ ID NO: 92502 - RNA, 32 nt, Human
caucccaguuccucuucaaagccaaacagaca

SEQ ID NO: 92503 - RNA, 32 nt, Human
caucccaguugguuuucucauggacaucucuu

SEQ ID NO: 92504 - RNA, 32 nt, Human
caucccauccagcuaauuuuuguauuuuuaau

SEQ ID NO: 92505 - RNA, 23 nt, Human
caucccaucuaaaaacucuucaa

SEQ ID NO: 92506 - RNA, 32 nt, Human
caucccaucuggcggacuccucuuccucucuc

SEQ ID NO: 92507 - RNA, 32 nt, Human
caucccaucugugcugcuggguccccaggcgc

SEQ ID NO: 92508 - RNA, 32 nt, Human
caucccaugaaacccaggcuguagagaggauu

SEQ ID NO: 92509 - RNA, 32 nt, Human
caucccauggccagggcgggccacugugcucc

SEQ ID NO: 92510 - RNA, 31 nt, Human
caucccauggcccaucaccugccugcagcca

SEQ ID NO: 92511 - RNA, 22 nt, Human
caucccaugguaaaauauucaa

SEQ ID NO: 92512 - RNA, 32 nt, Human
caucccaugguggcaggugcagcgguggggag

SEQ ID NO: 92513 - RNA, 32 nt, Human
caucccaugugggauggagcagaacugcauua

SEQ ID NO: 92514 - RNA, 32 nt, Human
cauccccaaaaccaaacacacuccugcucaaa

SEQ ID NO: 92515 - RNA, 32 nt, Human
cauccccaagccccagagagugacagagcccc

SEQ ID NO: 92516 - RNA, 22 nt, Human
cauccccacaaacauuuugaaa

SEQ ID NO: 92517 - RNA, 32 nt, Human
cauccccacaaaccagguaaugccaguuugcc

SEQ ID NO: 92518 - RNA, 32 nt, Human
cauccccacaccauugccugcuccucccaugg

SEQ ID NO: 92519 - RNA, 21 nt, Human
cauccccaccaccaccaccac

SEQ ID NO: 92520 - RNA, 32 nt, Human
cauccccaccaccaccaccaccaccaucagca

SEQ ID NO: 92521 - RNA, 32 nt, Human
cauccccaccccuucugccagacugccuuuga

SEQ ID NO: 92522 - RNA, 32 nt, Human
cauccccaccucagugccugcggggcccugag

SEQ ID NO: 92523 - RNA, 25 nt, Human
cauccccagacccaccagacaccac

SEQ ID NO: 92524 - RNA, 32 nt, Human
cauccccagcagauggggguggcaagggggag

SEQ ID NO: 92525 - RNA, 32 nt, Human
cauccccaggagacucaggcaguggccuggag

SEQ ID NO: 92526 - RNA, 32 nt, Human
cauccccaggccuugcuggggugcagggguau

SEQ ID NO: 92527 - RNA, 25 nt, Human
cauccccaguacugccgggaagugu

SEQ ID NO: 92528 - RNA, 32 nt, Human
cauccccagucgcuuccaguuggagcagcugc

SEQ ID NO: 92529 - RNA, 32 nt, Human
caucccccaacccucccugggcgugggggugu

SEQ ID NO: 92530 - RNA, 25 nt, Human
caucccccaagucacuacagcaucu

SEQ ID NO: 92531 - RNA, 32 nt, Human
caucccccaagugaugggaacaagggcccgcc

SEQ ID NO: 92532 - RNA, 28 nt, Human
caucccccaagugccucaccaguccccc

SEQ ID NO: 92533 - RNA, 32 nt, Human
caucccccaagugccucaccagucccccagac

SEQ ID NO: 92534 - RNA, 24 nt, Human
caucccccacagggucccugauaa

SEQ ID NO: 92535 - RNA, 18 nt, Human
caucccccaccugcccca

SEQ ID NO: 92536 - RNA, 32 nt, Human
caucccccagaagagcgcaagcacagaagcca

SEQ ID NO: 92537 - RNA, 32 nt, Human
caucccccagcugcucccaucuugcuggaauu

SEQ ID NO: 92538 - RNA, 32 nt, Human
caucccccaguagaggccacugugcuguguau

SEQ ID NO: 92539 - RNA, 32 nt, Human
caucccccuccccgcccuggcauccacccucu

SEQ ID NO: 92540 - RNA, 32 nt, Human
caucccccugcaccgacgcgccggagacaucc

SEQ ID NO: 92541 - RNA, 32 nt, Human
caucccccugccugcugccucagucugcaacc

SEQ ID NO: 92542 - RNA, 32 nt, Human
cauccccgcagugugcacuaaggggcccggcc

SEQ ID NO: 92543 - RNA, 30 nt, Human
cauccccgccucucccugcccugugauauc

SEQ ID NO: 92544 - RNA, 32 nt, Human
cauccccuccccuccgcaccacugaccucuug

SEQ ID NO: 92545 - RNA, 32 nt, Human
cauccccucccgccucuggcguagcaggagca

SEQ ID NO: 92546 - RNA, 20 nt, Human
cauccccuccugugggagug

SEQ ID NO: 92547 - RNA, 31 nt, Human
cauccccuccuucucacuugccaaagagauu

SEQ ID NO: 92548 - RNA, 32 nt, Human
cauccccugaaugacaagucacaaggguauca

SEQ ID NO: 92549 - RNA, 18 nt, Human
cauccccugagcacacua

SEQ ID NO: 92550 - RNA, 32 nt, Human
cauccccugaguguccauggccucugugcucc

SEQ ID NO: 92551 - RNA, 19 nt, Human
cauccccugcccccuccca

SEQ ID NO: 92552 - RNA, 32 nt, Human
cauccccugccuccuucaccagccuggcuuuu

SEQ ID NO: 92553 - RNA, 32 nt, Human
cauccccugccugccaccugccccucggcugc

SEQ ID NO: 92554 - RNA, 32 nt, Human
cauccccuggcccuuguuuucucccaugugga

SEQ ID NO: 92555 - RNA, 32 nt, Human
cauccccuguccagaucccucacaucaggguc

SEQ ID NO: 92556 - RNA, 32 nt, Human
cauccccuucaguucacaaaagcugacauuuu

SEQ ID NO: 92557 - RNA, 21 nt, Human
cauccccuugaauaucccagg

SEQ ID NO: 92558 - RNA, 32 nt, Human
cauccccuuggcccauugugugcaguaagccu

SEQ ID NO: 92559 - RNA, 25 nt, Human
caucccgaguagcugggacuacagg

SEQ ID NO: 92560 - RNA, 32 nt, Human
caucccgaguagcugggacuacaggugcacgc

SEQ ID NO: 92561 - RNA, 32 nt, Human
caucccgcagaugagaccaaagccacauuaug

SEQ ID NO: 92562 - RNA, 32 nt, Human
caucccgcagggugccugggcggagaugucuu

SEQ ID NO: 92563 - RNA, 22 nt, Human
caucccgccgccgccgccgccg

SEQ ID NO: 92564 - RNA, 32 nt, Human
caucccgcggaggagcgcgcagccccggggag

SEQ ID NO: 92565 - RNA, 32 nt, Human
caucccggcaagggaggaagggacgcccgagc

SEQ ID NO: 92566 - RNA, 32 nt, Human
caucccggcuaacacggugaaaccccgucucu

SEQ ID NO: 92567 - RNA, 32 nt, Human
caucccgggacgcucccuucucccacccagga

SEQ ID NO: 92568 - RNA, 32 nt, Human
caucccgguacuggcuggagucuguguucgag

SEQ ID NO: 92569 - RNA, 32 nt, Human
caucccgguggagagcgcgcccauguucuccg

SEQ ID NO: 92570 - RNA, 32 nt, Human
caucccguguucuccuuuuccucucucccgga

SEQ ID NO: 92571 - RNA, 18 nt, Human
caucccuaccacccagga

SEQ ID NO: 92572 - RNA, 32 nt, Human
caucccuacuaaggauacaaaaauuggccggg

SEQ ID NO: 92573 - RNA, 32 nt, Human
caucccuacugccaguuauuggcuccucucuu

SEQ ID NO: 92574 - RNA, 25 nt, Human
caucccucagcuacccuggaucuuu

SEQ ID NO: 92575 - RNA, 32 nt, Human
caucccucauuuccucccucucauucuucuuu

SEQ ID NO: 92576 - RNA, 32 nt, Human
caucccuccagccugggaucucacugcucugc

SEQ ID NO: 92577 - RNA, 18 nt, Human
caucccucccagcaccac

SEQ ID NO: 92578 - RNA, 23 nt, Human
caucccuccccgggccuggggcg

SEQ ID NO: 92579 - RNA, 32 nt, Human
caucccucccuuccucuucucuccuucccucc

SEQ ID NO: 92580 - RNA, 32 nt, Human
caucccuccucucccaccuccuggcacuucca

SEQ ID NO: 92581 - RNA, 32 nt, Human
caucccuccucugcucuccaucauaacugcua

SEQ ID NO: 92582 - RNA, 32 nt, Human
caucccuccugccucagccuccccaguagcug

SEQ ID NO: 92583 - RNA, 32 nt, Human
caucccucgcccccagccugaggugaucuuuc

SEQ ID NO: 92584 - RNA, 32 nt, Human
caucccucuccucuccuccucugugcuccugu

SEQ ID NO: 92585 - RNA, 32 nt, Human
caucccucugcagccugucaucccugucugug

SEQ ID NO: 92586 - RNA, 32 nt, Human
caucccugaaguuuucagcuaaacuugguuuc

SEQ ID NO: 92587 - RNA, 18 nt, Human
caucccugacccuucaca

SEQ ID NO: 92588 - RNA, 32 nt, Human
caucccugaggcuggacuccagaucugcaccg

SEQ ID NO: 92589 - RNA, 32 nt, Human
caucccugcaccuccggggugucuccgcucgc

SEQ ID NO: 92590 - RNA, 32 nt, Human
caucccugcagccccuuccucuuccuacaccc

SEQ ID NO: 92591 - RNA, 32 nt, Human
caucccugcagcugaacccagcacuuuuuaug

SEQ ID NO: 92592 - RNA, 32 nt, Human
caucccugcccugccuccagccuugguggcuc

SEQ ID NO: 92593 - RNA, 32 nt, Human
caucccugcuccagcccauucugagacucagu

SEQ ID NO: 92594 - RNA, 32 nt, Human
caucccugcugcacucagugguuggcggaaac

SEQ ID NO: 92595 - RNA, 32 nt, Human
caucccuggcccuguagcacagacacauacaa

SEQ ID NO: 92596 - RNA, 32 nt, Human
caucccugggaggagagaguagugacacucag

SEQ ID NO: 92597 - RNA, 32 nt, Human
caucccugggcuguugggaggaacagaugaga

SEQ ID NO: 92598 - RNA, 32 nt, Human
caucccuggggagggggcuggggugcagaaaa

SEQ ID NO: 92599 - RNA, 19 nt, Human
caucccuggggcagacgug

SEQ ID NO: 92600 - RNA, 32 nt, Human
caucccuggguuuaugaugcagcaggugcuuu

SEQ ID NO: 92601 - RNA, 22 nt, Human
caucccugguccuuugaagguu

SEQ ID NO: 92602 - RNA, 32 nt, Human
caucccuggucucccgccuccugggcaagcuc

SEQ ID NO: 92603 - RNA, 23 nt, Human
caucccuguagggaucccagagc

SEQ ID NO: 92604 - RNA, 32 nt, Human
caucccugugagaagcaggaggggaauucuca

SEQ ID NO: 92605 - RNA, 32 nt, Human
caucccugugcauggugaucaccaucuauuau

SEQ ID NO: 92606 - RNA, 32 nt, Human
caucccuguggccauggagcuccugggugagc

SEQ ID NO: 92607 - RNA, 32 nt, Human
caucccugugggcagcccugcccccgcuccug

SEQ ID NO: 92608 - RNA, 32 nt, Human
caucccuguggggagugcagggccagaugggg

SEQ ID NO: 92609 - RNA, 32 nt, Human
caucccuguuggcaguaaaucuucccacaggc

SEQ ID NO: 92610 - RNA, 32 nt, Human
caucccuuaagccuccagaagggacauagccc

SEQ ID NO: 92611 - RNA, 32 nt, Human
caucccuucacuucugcauuccuguaacuuuu

SEQ ID NO: 92612 - RNA, 32 nt, Human
caucccuucucccaccuccuccccucucccuc

SEQ ID NO: 92613 - RNA, 32 nt, Human
caucccuucucccauaccuugcucuacacauc

SEQ ID NO: 92614 - RNA, 32 nt, Human
caucccuugauaccugcuggguauugguucca

SEQ ID NO: 92615 - RNA, 32 nt, Human
caucccuugccaggagcucagggcugagcuag

SEQ ID NO: 92616 - RNA, 32 nt, Human
caucccuugguauacuccagggauugguuuca

SEQ ID NO: 92617 - RNA, 32 nt, Human
caucccuugguauccauggggaauugguucca

SEQ ID NO: 92618 - RNA, 32 nt, Human
caucccuuguaacccgguaugggcgccccugc

SEQ ID NO: 92619 - RNA, 32 nt, Human
caucccuuguaaggugaguucagucuacguug

SEQ ID NO: 92620 - RNA, 32 nt, Human
caucccuugucuggccccaggcugccaucacu

SEQ ID NO: 92621 - RNA, 32 nt, Human
caucccuuuaaaucugugccuuuuucuucuug

SEQ ID NO: 92622 - RNA, 32 nt, Human
caucccuuuaguacaaauuaagcuauuaaaaa

SEQ ID NO: 92623 - RNA, 32 nt, Human
caucccuuuccuuacuacuugccugcacuucu

SEQ ID NO: 92624 - RNA, 32 nt, Human
caucccuuugcuuguggcaggagauggcuuaa

SEQ ID NO: 92625 - RNA, 32 nt, Human
caucccuuugcuuguggcgggagauggcuuaa

SEQ ID NO: 92626 - RNA, 32 nt, Human
caucccuuuuugagcgugacuuguuuuggccc

SEQ ID NO: 92627 - RNA, 32 nt, Human
cauccgaaaccagcaucugcaccuaaacccau

SEQ ID NO: 92628 - RNA, 18 nt, Human
cauccgaacagauccuca

SEQ ID NO: 92629 - RNA, 32 nt, Human
cauccgagggcaccugugaccugcacucacaa

SEQ ID NO: 92630 - RNA, 32 nt, Human
cauccgauguccugcacucggccuggauccuc

SEQ ID NO: 92631 - RNA, 32 nt, Human
cauccgcacagaaucgaccuuugcaugcaaug

SEQ ID NO: 92632 - RNA, 32 nt, Human
cauccgcaggagggucccuugcagugacagca

SEQ ID NO: 92633 - RNA, 32 nt, Human
cauccgcauccagcaucagauggcuuugcauc

SEQ ID NO: 92634 - RNA, 32 nt, Human
cauccgccaagcuucgguucucagccucagau

SEQ ID NO: 92635 - RNA, 32 nt, Human
cauccgccacgugaagagacagaaggaggaug

SEQ ID NO: 92636 - RNA, 32 nt, Human
cauccgccagugccuugccagugugcacgguc

SEQ ID NO: 92637 - RNA, 32 nt, Human
cauccgccauguccuucagugccaccauucuc

SEQ ID NO: 92638 - RNA, 32 nt, Human
cauccgccccuccugcuccaucacugcugagc

SEQ ID NO: 92639 - RNA, 32 nt, Human
cauccgcccuacuucccaucccacacaaaccc

SEQ ID NO: 92640 - RNA, 32 nt, Human
cauccgccucagccucccaacaugcugggauu

SEQ ID NO: 92641 - RNA, 23 nt, Human
cauccgccucugccgcugccuca

SEQ ID NO: 92642 - RNA, 32 nt, Human
cauccgccucugccgcugccucaggcuaccca

SEQ ID NO: 92643 - RNA, 32 nt, Human
cauccgccuucccauccacacugccuuuagug

SEQ ID NO: 92644 - RNA, 32 nt, Human
cauccgcucccuccccagcaggcacagacauc

SEQ ID NO: 92645 - RNA, 32 nt, Human
cauccgcugcagcuggccacacugagggcccu

SEQ ID NO: 92646 - RNA, 32 nt, Human
cauccgcuugaaugcuguguacacacucaccg

SEQ ID NO: 92647 - RNA, 31 nt, Human
cauccggaggcagggaccaugccaggaggag

SEQ ID NO: 92648 - RNA, 32 nt, Human
cauccggcacugaagcccugguguuccugguc

SEQ ID NO: 92649 - RNA, 32 nt, Human
cauccggcagcuuucacuuugacuaugagguu

SEQ ID NO: 92650 - RNA, 32 nt, Human
cauccggccugugcugggcauggguggugaca

SEQ ID NO: 92651 - RNA, 32 nt, Human
cauccggggaggacuugcggggcagaggaggg

SEQ ID NO: 92652 - RNA, 32 nt, Human
cauccggucaccagaagugaaaaggcugccuc

SEQ ID NO: 92653 - RNA, 22 nt, Human
cauccgguuaacugucucuuuc

SEQ ID NO: 92654 - RNA, 32 nt, Human
cauccgguuccucuucuucccaggugugccaa

SEQ ID NO: 92655 - RNA, 32 nt, Human
cauccguacccgggccacagagcugcugaccc

SEQ ID NO: 92656 - RNA, 32 nt, Human
cauccguaccuugccuagccucucccucuccc

SEQ ID NO: 92657 - RNA, 32 nt, Human
cauccgucacugcacucaugccucccucuguu

SEQ ID NO: 92658 - RNA, 32 nt, Human
cauccguccuccaggaucuggggagaaagagc

SEQ ID NO: 92659 - RNA, 32 nt, Human
cauccgucuccucugcagcaucuuuccucccc

SEQ ID NO: 92660 - RNA, 32 nt, Human
cauccgucuccucugcggcaucuuuccucccc

SEQ ID NO: 92661 - RNA, 32 nt, Human
cauccgugagccacacaaaguuccccacccca

SEQ ID NO: 92662 - RNA, 32 nt, Human
cauccgugaugcucaguguucaaaaccacagc

SEQ ID NO: 92663 - RNA, 32 nt, Human
cauccguggcagguacgccacagcagacacaa

SEQ ID NO: 92664 - RNA, 32 nt, Human
cauccgugucaacccagccauggggaagauca

SEQ ID NO: 92665 - RNA, 32 nt, Human
cauccgugucaagaagccugaccuaacacguu

SEQ ID NO: 92666 - RNA, 32 nt, Human
cauccgugugccggcccugcagugccugccca

SEQ ID NO: 92667 - RNA, 32 nt, Human
cauccguucucccagucccaaggguccacgau

SEQ ID NO: 92668 - RNA, 32 nt, Human
cauccuaaagugcugggauuacaggcgugagc

SEQ ID NO: 92669 - RNA, 32 nt, Human
cauccuaagaucuuugcagauuaucuguggaa

SEQ ID NO: 92670 - RNA, 32 nt, Human
cauccuaauucaguaaguucucaggcuuccaa

SEQ ID NO: 92671 - RNA, 32 nt, Human
cauccuaccccagaugcuaaagugauucaagg

SEQ ID NO: 92672 - RNA, 32 nt, Human
cauccuacuaaauagcccauguucuucauuug

SEQ ID NO: 92673 - RNA, 32 nt, Human
cauccuacugggaacgacacaccagcuccugg

SEQ ID NO: 92674 - RNA, 32 nt, Human
cauccuagacacccucccuguuguucacagag

SEQ ID NO: 92675 - RNA, 32 nt, Human
cauccuagacaggcccuuauaaucuugcuuca

SEQ ID NO: 92676 - RNA, 32 nt, Human
cauccuagccaacaucgugaaaccccaucucu

SEQ ID NO: 92677 - RNA, 32 nt, Human
cauccuagccaacauggugaaaacccaucugu

SEQ ID NO: 92678 - RNA, 32 nt, Human
cauccuagccaacauggugaaaccccaucugu

SEQ ID NO: 92679 - RNA, 32 nt, Human
cauccuagccaccccucccugccuugugccug

SEQ ID NO: 92680 - RNA, 22 nt, Human
cauccuaggcaacagagugaga

SEQ ID NO: 92681 - RNA, 32 nt, Human
cauccuagucugggcgacagagccagacucca

SEQ ID NO: 92682 - RNA, 32 nt, Human
cauccuauaauguguacuugcuuuguuuuguu

SEQ ID NO: 92683 - RNA, 32 nt, Human
cauccuaugaacugaaagagcagccgccgccg

SEQ ID NO: 92684 - RNA, 32 nt, Human
cauccuauuuucuccucuccaagucucagauu

SEQ ID NO: 92685 - RNA, 20 nt, Human
cauccucaaaaggcacgggg

SEQ ID NO: 92686 - RNA, 32 nt, Human
cauccucaacacuaguauuaagugagaguucc

SEQ ID NO: 92687 - RNA, 32 nt, Human
cauccucaaccugcuguccuccagaaagcacc

SEQ ID NO: 92688 - RNA, 32 nt, Human
cauccucaacuuccuguaccucuggaagucuu

SEQ ID NO: 92689 - RNA, 32 nt, Human
cauccucaagaaaacucacugccuuuaccuac

SEQ ID NO: 92690 - RNA, 32 nt, Human
cauccucacacacucagccucugccucaggug

SEQ ID NO: 92691 - RNA, 31 nt, Human
cauccucacagcugcagggccaggugcaugg

SEQ ID NO: 92692 - RNA, 18 nt, Human
cauccucacccagcaccc

SEQ ID NO: 92693 - RNA, 32 nt, Human
cauccucacuguggaguaaugagggggaggag

SEQ ID NO: 92694 - RNA, 32 nt, Human
cauccucagccccucugccaccaccuuaaaua

SEQ ID NO: 92695 - RNA, 32 nt, Human
cauccucagcuccccuccuugcuuccucgagu

SEQ ID NO: 92696 - RNA, 31 nt, Human
cauccucagcuguccauccaggcccagaagg

SEQ ID NO: 92697 - RNA, 18 nt, Human
cauccucaguuguuggag

SEQ ID NO: 92698 - RNA, 32 nt, Human
cauccucauacccacccccacccaagggccug

SEQ ID NO: 92699 - RNA, 32 nt, Human
cauccucauccuggcacuccuccaggguguca

SEQ ID NO: 92700 - RNA, 32 nt, Human
cauccuccacaguggcugccuccucauuuggc

SEQ ID NO: 92701 - RNA, 32 nt, Human
cauccucccaccucagcuuuccaaguagcuga

SEQ ID NO: 92702 - RNA, 32 nt, Human
cauccucccauggcuuccccugcccucacucc

SEQ ID NO: 92703 - RNA, 19 nt, Human
cauccuccccaaccaccga

SEQ ID NO: 92704 - RNA, 32 nt, Human
cauccuccccuccggguuuucacacugggcga

SEQ ID NO: 92705 - RNA, 32 nt, Human
cauccucccgcgcccagccccugcugcucugg

SEQ ID NO: 92706 - RNA, 32 nt, Human
cauccucccugcucacagagggcacugugguc

SEQ ID NO: 92707 - RNA, 32 nt, Human
cauccuccgcagccacaccccaggcgcauuga

SEQ ID NO: 92708 - RNA, 16 nt, Human
cauccuccgccacuaa

SEQ ID NO: 92709 - RNA, 32 nt, Human
cauccuccguccacuugagcucugccucuucc

SEQ ID NO: 92710 - RNA, 32 nt, Human
cauccuccucccacccggcugcagaggccaga

SEQ ID NO: 92711 - RNA, 32 nt, Human
cauccuccucucccccaccauucgauuugauc

SEQ ID NO: 92712 - RNA, 23 nt, Human
cauccuccucugucauacuggag

SEQ ID NO: 92713 - RNA, 32 nt, Human
cauccuccugcccccaccccaggcugggcugu

SEQ ID NO: 92714 - RNA, 32 nt, Human
cauccuccuuguuggucuacucaggcccagcc

SEQ ID NO: 92715 - RNA, 32 nt, Human
cauccucgccaacagggugaaaccccaccucu

SEQ ID NO: 92716 - RNA, 21 nt, Human
cauccucggcaucagcaccac

SEQ ID NO: 92717 - RNA, 32 nt, Human
cauccucguuguugcugucaucauguucacug

SEQ ID NO: 92718 - RNA, 32 nt, Human
cauccucuaagcuugaagaagggagacgaaaa

SEQ ID NO: 92719 - RNA, 32 nt, Human
cauccucuaccagcagagaagagaguggccca

SEQ ID NO: 92720 - RNA, 32 nt, Human
cauccucuaggguuccacaggccccugaccgc

SEQ ID NO: 92721 - RNA, 32 nt, Human
cauccucucacggccagcaucuugucccccac

SEQ ID NO: 92722 - RNA, 32 nt, Human
cauccucuccaaaguuggagcuucuauugcca

SEQ ID NO: 92723 - RNA, 32 nt, Human
cauccucuccacccucugggccucagugucuu

SEQ ID NO: 92724 - RNA, 32 nt, Human
cauccucuccacccugcauuccaaaugcugcu

SEQ ID NO: 92725 - RNA, 32 nt, Human
cauccucuccccuccuuccuccccugggucac

SEQ ID NO: 92726 - RNA, 32 nt, Human
cauccucucucugugcccuccugcaauggcag

SEQ ID NO: 92727 - RNA, 32 nt, Human
cauccucucuggggaugguggguggggguguc

SEQ ID NO: 92728 - RNA, 32 nt, Human
cauccucugaaccccaaucccccagccccacu

SEQ ID NO: 92729 - RNA, 32 nt, Human
cauccucugacugcuucccccucucucugucu

SEQ ID NO: 92730 - RNA, 32 nt, Human
cauccucugaugacccauccugggugagugga

SEQ ID NO: 92731 - RNA, 32 nt, Human
cauccucugcacuguugaaucacuggacuuac

SEQ ID NO: 92732 - RNA, 32 nt, Human
cauccucugcugcagcugggagagcugaguuc

SEQ ID NO: 92733 - RNA, 32 nt, Human
cauccucugcuggcucuccuguggucaucuug

SEQ ID NO: 92734 - RNA, 32 nt, Human
cauccucugcuuguggcaaaugaugcauaaau

SEQ ID NO: 92735 - RNA, 32 nt, Human
cauccucugucucuggggcucaucuuacuagu

SEQ ID NO: 92736 - RNA, 32 nt, Human
cauccucuucacccugcccugccugcaguuga

SEQ ID NO: 92737 - RNA, 32 nt, Human
cauccucuucauuccucucagccaaaaagacc

SEQ ID NO: 92738 - RNA, 32 nt, Human
cauccucuugguuggcccccuugucaguccca

SEQ ID NO: 92739 - RNA, 32 nt, Human
cauccugaagucagcccaggcgcccugagcau

SEQ ID NO: 92740 - RNA, 32 nt, Human
cauccugaccuucaucucugggcuuguuccgg

SEQ ID NO: 92741 - RNA, 32 nt, Human
cauccugacuccgucauuuaauaaagaaggaa

SEQ ID NO: 92742 - RNA, 32 nt, Human
cauccugacuccuugaaauuuaccuuuuguua

SEQ ID NO: 92743 - RNA, 32 nt, Human
cauccugagaagaaauaaugauggaaacaugu

SEQ ID NO: 92744 - RNA, 32 nt, Human
cauccugagacaccucagggcugcauucagcu

SEQ ID NO: 92745 - RNA, 32 nt, Human
cauccugagcucugucuccugccccuccugcu

SEQ ID NO: 92746 - RNA, 32 nt, Human
cauccugaguaacauggugaaaccccaucucu

SEQ ID NO: 92747 - RNA, 32 nt, Human
cauccugauucuggacuuuucauuauaauucu

SEQ ID NO: 92748 - RNA, 32 nt, Human
cauggccugcaaccccagggucaagggugaag

SEQ ID NO: 92749 - RNA, 32 nt, Human
cauggccugccugccuuuuggcuuuguuucaa

SEQ ID NO: 92750 - RNA, 32 nt, Human
cauggccugucacuacagccuagggauuuuaa

SEQ ID NO: 92751 - RNA, 32 nt, Human
cauggccuguccccacauccagcacuugccuc

SEQ ID NO: 92752 - RNA, 32 nt, Human
cauggccugugcagugaggggaccuggguccu

SEQ ID NO: 92753 - RNA, 20 nt, Human
cauggccuuggaaauggggc

SEQ ID NO: 92754 - RNA, 24 nt, Human
cauggcgaaaacccaucucuacua

SEQ ID NO: 92755 - RNA, 25 nt, Human
cauggcgaaacaccugucucuacua

SEQ ID NO: 92756 - RNA, 24 nt, Human
cauggcgaaaccaugccucuacua

SEQ ID NO: 92757 - RNA, 24 nt, Human
cauggcgaaaccaugucucuacua

SEQ ID NO: 92758 - RNA, 24 nt, Human
cauggcgaaacccagucucuacua

SEQ ID NO: 92759 - RNA, 22 nt, Human
cauggcgaaaccccaucucuac

SEQ ID NO: 92760 - RNA, 23 nt, Human
cauggcgaaaccccaucucuacu

SEQ ID NO: 92761 - RNA, 24 nt, Human
cauggcgaaaccccaucucuacua

SEQ ID NO: 92762 - RNA, 24 nt, Human
cauggcgaaaccccaucucuacug

SEQ ID NO: 92763 - RNA, 28 nt, Human
cauggcgaaaccccaucucucucuacua

SEQ ID NO: 92764 - RNA, 24 nt, Human
cauggcgaaaccccaucucugcua

SEQ ID NO: 92765 - RNA, 24 nt, Human
cauggcgaaaccccauuucuacua

SEQ ID NO: 92766 - RNA, 24 nt, Human
cauggcgaaaccccgucucuacua

SEQ ID NO: 92767 - RNA, 23 nt, Human
cauggcgaaaccccucucuacua

SEQ ID NO: 92768 - RNA, 24 nt, Human
cauggcgaaacccuaccucuacua

SEQ ID NO: 92769 - RNA, 22 nt, Human
cauggcgaaacccuaucucuac

SEQ ID NO: 92770 - RNA, 24 nt, Human
cauggcgaaacccuaucucuacua

SEQ ID NO: 92771 - RNA, 24 nt, Human
cauggcgaaacccuaucucuccua

SEQ ID NO: 92772 - RNA, 21 nt, Human
cauggcgaaacccugucucua

SEQ ID NO: 92773 - RNA, 24 nt, Human
cauggcgaaacccugucucuacua

SEQ ID NO: 92774 - RNA, 24 nt, Human
cauggcgaaaccucaucucuacua

SEQ ID NO: 92775 - RNA, 24 nt, Human
cauggcgaaaccucgccucuacua

SEQ ID NO: 92776 - RNA, 24 nt, Human
cauggcgaaaccucgucucuacua

SEQ ID NO: 92777 - RNA, 24 nt, Human
cauggcgaaaccucuucucuacua

SEQ ID NO: 92778 - RNA, 24 nt, Human
cauggcgagaccccaucucuacua

SEQ ID NO: 92779 - RNA, 32 nt, Human
cauggcgauaauucaugcugaagaggaacucu

SEQ ID NO: 92780 - RNA, 32 nt, Human
cauggcgcaacaacuggggagguggagguagg

SEQ ID NO: 92781 - RNA, 32 nt, Human
cauggcgccacggccacuuccugcugcccugg

SEQ ID NO: 92782 - RNA, 32 nt, Human
cauggcgcggcgcugacuggccuggcccggcc

SEQ ID NO: 92783 - RNA, 32 nt, Human
cauggcgcuucucagggcauucagcagcagcg

SEQ ID NO: 92784 - RNA, 26 nt, Human
cauggcggaggcggcggcugcagcgg

SEQ ID NO: 92785 - RNA, 32 nt, Human
cauggcggcacacaucuguaauccuagcuacu

SEQ ID NO: 92786 - RNA, 32 nt, Human
cauggcggcgcaugccugcaaucccagcuacu

SEQ ID NO: 92787 - RNA, 32 nt, Human
cauggcggcggaacggcgcuguggaaguaugc

SEQ ID NO: 92788 - RNA, 32 nt, Human
cauggcggcgugugucuguaaucccagcuacu

SEQ ID NO: 92789 - RNA, 32 nt, Human
cauggcggcucacgccuguaaucccagaacuu

SEQ ID NO: 92790 - RNA, 32 nt, Human
cauggcggcuggcaccuauaaucccaguuacu

SEQ ID NO: 92791 - RNA, 32 nt, Human
cauggcgggaccccaaggacacuuggcacagg

SEQ ID NO: 92792 - RNA, 32 nt, Human
cauggcgggucaacccuguaauuccagcacuu

SEQ ID NO: 92793 - RNA, 32 nt, Human
cauggcgguucaugccuguaaucccaguacuu

SEQ ID NO: 92794 - RNA, 32 nt, Human
cauggcguggaggaggagggaggccgggcggu

SEQ ID NO: 92795 - RNA, 32 nt, Human
cauggcgugggccuggaaggaggagagaggca

SEQ ID NO: 92796 - RNA, 32 nt, Human
cauggcguucgccgggcuggagcgaguacauu

SEQ ID NO: 92797 - RNA, 32 nt, Human
cauggcguucucugucucacuguaaacuagug

SEQ ID NO: 92798 - RNA, 32 nt, Human
cauggcuacauugccaaaccucugacugccac

SEQ ID NO: 92799 - RNA, 32 nt, Human
cauggcuaggcccagaaacacaggguccaacc

SEQ ID NO: 92800 - RNA, 32 nt, Human
cauggcuauuuccuaguuguaaaguucugcau

SEQ ID NO: 92801 - RNA, 32 nt, Human
cauggcucaccgcauugaccuccuuggcucaa

SEQ ID NO: 92802 - RNA, 32 nt, Human
cauggcucacugcaaccuccaccuccuggguu

SEQ ID NO: 92803 - RNA, 32 nt, Human
cauggcucacugcaaccucugccucccgguuu

SEQ ID NO: 92804 - RNA, 32 nt, Human
cauggcucacugcagccccaaccuucagggcu

SEQ ID NO: 92805 - RNA, 32 nt, Human
cauggcucacugcagccucaaccugcugggcu

SEQ ID NO: 92806 - RNA, 32 nt, Human
cauggcucacugcagccuccaccucccaggcu

SEQ ID NO: 92807 - RNA, 32 nt, Human
cauggcucacugcagccuccaccuccuugacu

SEQ ID NO: 92808 - RNA, 32 nt, Human
cauggcucacugcagccucgaacuccugggcu

SEQ ID NO: 92809 - RNA, 32 nt, Human
cauggcucacugcagccucgaccucccaggcu

SEQ ID NO: 92810 - RNA, 32 nt, Human
cauggcucacugcagccucgaccuccugggcu

SEQ ID NO: 92811 - RNA, 32 nt, Human
cauggcucacugcagccucgagcuccugagcu

SEQ ID NO: 92812 - RNA, 32 nt, Human
cauggcucacugcagccuggagcuccugggca

SEQ ID NO: 92813 - RNA, 32 nt, Human
cauggcucacugcagccuugaacuccugagcu

SEQ ID NO: 92814 - RNA, 32 nt, Human
cauggcucacugcagccuugaacuccuggccu

SEQ ID NO: 92815 - RNA, 32 nt, Human
cauggcucacugcagucucugccucccaggcu

SEQ ID NO: 92816 - RNA, 32 nt, Human
cauggcucacuguaaccucugccucccaggcu

SEQ ID NO: 92817 - RNA, 32 nt, Human
cauggcucauggcgggcacaugcggcugccag

SEQ ID NO: 92818 - RNA, 32 nt, Human
cauggcucauucaccuggaauaaugccuuuua

SEQ ID NO: 92819 - RNA, 32 nt, Human
cauggcuccgccucucugagccucugucucug

SEQ ID NO: 92820 - RNA, 32 nt, Human
cauggcuccucuucugcucuuuccaucuuuuu

SEQ ID NO: 92821 - RNA, 19 nt, Human
cauggcucucucuguucua

SEQ ID NO: 92822 - RNA, 32 nt, Human
cauggcucugcaggcuuuacaggaagcauggu

SEQ ID NO: 92823 - RNA, 32 nt, Human
cauggcucugguaauauguaggaagcuuuaua

SEQ ID NO: 92824 - RNA, 18 nt, Human
cauggcugacgccugcca

SEQ ID NO: 92825 - RNA, 32 nt, Human
cauggcugagacugaggggagccuuuuacagc

SEQ ID NO: 92826 - RNA, 32 nt, Human
cauggcugauccuggugacugaacuucugggc

SEQ ID NO: 92827 - RNA, 32 nt, Human
cauggcugauucugaaugaugaugguucgccg

SEQ ID NO: 92828 - RNA, 32 nt, Human
cauggcugcacucuagccugggugacagugug

SEQ ID NO: 92829 - RNA, 16 nt, Human
cauggcugcacugcua

SEQ ID NO: 92830 - RNA, 22 nt, Human
cauggcugcagacacguuuggg

SEQ ID NO: 92831 - RNA, 21 nt, Human
cauggcugcagcaggaaugga

SEQ ID NO: 92832 - RNA, 25 nt, Human
cauggcugcagucuggcugcagggg

SEQ ID NO: 92833 - RNA, 31 nt, Human
cauggcugccucugaaggcagugucuauuuu

SEQ ID NO: 92834 - RNA, 32 nt, Human
cauggcugccuguaaucccagcacuuugggag

SEQ ID NO: 92835 - RNA, 21 nt, Human
cauggcugcgugaccgcggga

SEQ ID NO: 92836 - RNA, 32 nt, Human
cauggcugcuaaaaucaucuuucccaagcauu

SEQ ID NO: 92837 - RNA, 32 nt, Human
cauggcugcucccuucacacuggguaacagug

SEQ ID NO: 92838 - RNA, 24 nt, Human
cauggcugcugacgugggcauggg

SEQ ID NO: 92839 - RNA, 32 nt, Human
cauggcugcugacgugggcauggguggauuua

SEQ ID NO: 92840 - RNA, 32 nt, Human
cauggcugcuuugcugcuuccuucuccaaagu

SEQ ID NO: 92841 - RNA, 32 nt, Human
cauggcuggacuccagccaggaggacacacgg

SEQ ID NO: 92842 - RNA, 32 nt, Human
cauggcuggagaggcaggcauaggcagggaac

SEQ ID NO: 92843 - RNA, 32 nt, Human
cauggcuggagcagcugggacacagggcacca

SEQ ID NO: 92844 - RNA, 32 nt, Human
cauggcugggcgugcuagagguugcagcauga

SEQ ID NO: 92845 - RNA, 32 nt, Human
cauggcugggguggggguggggagaccugguu

SEQ ID NO: 92846 - RNA, 24 nt, Human
cauggcugguguuaaauggagcua

SEQ ID NO: 92847 - RNA, 32 nt, Human
cauggcuguaggacugagguucccaaguccuu

SEQ ID NO: 92848 - RNA, 16 nt, Human
cauggcugucacugcc

SEQ ID NO: 92849 - RNA, 32 nt, Human
cauggcugucugcagugugccucucacggaua

SEQ ID NO: 92850 - RNA, 32 nt, Human
cauggcuguggaccccucgucaucaggugcau

SEQ ID NO: 92851 - RNA, 32 nt, Human
cauggcugugggaguugagcaaacccugggug

SEQ ID NO: 92852 - RNA, 32 nt, Human
cauggcuguguguguccaugucugcaagcagu

SEQ ID NO: 92853 - RNA, 16 nt, Human
cauggcuguuacugcc

SEQ ID NO: 92854 - RNA, 23 nt, Human
cauggcuguugcuccccccuuug

SEQ ID NO: 92855 - RNA, 32 nt, Human
cauggcuguuucauagcccucuguaccacauc

SEQ ID NO: 92856 - RNA, 26 nt, Human
cauggcuuccagaggacgagaucaua

SEQ ID NO: 92857 - RNA, 32 nt, Human
cauggcuuccagccugaagugacuguaaaaug

SEQ ID NO: 92858 - RNA, 32 nt, Human
cauggcuucugaaagcaggaugaauuuucugc

SEQ ID NO: 92859 - RNA, 32 nt, Human
cauggcuugaaaccucugccugauguggcucc

SEQ ID NO: 92860 - RNA, 32 nt, Human
cauggcuugcaggagcaagagccagacaggac

SEQ ID NO: 92861 - RNA, 32 nt, Human
cauggcuuucaucagaaguuacacagaccaca

SEQ ID NO: 92862 - RNA, 18 nt, Human
cauggcuuuggcuggcca

SEQ ID NO: 92863 - RNA, 22 nt, Human
caugggaaaaccccaucucuac

SEQ ID NO: 92864 - RNA, 20 nt, Human
caugggaaacauaaagcaga

SEQ ID NO: 92865 - RNA, 19 nt, Human
caugggaaagcaaagcaga

SEQ ID NO: 92866 - RNA, 32 nt, Human
caugggaacaaauacugugcagauguuuguaa

SEQ ID NO: 92867 - RNA, 19 nt, Human
caugggaagacacagaaga

SEQ ID NO: 92868 - RNA, 20 nt, Human
caugggaagaucugcagcag

SEQ ID NO: 92869 - RNA, 32 nt, Human
caugggaagcaacuuaagugccaucuguggga

SEQ ID NO: 92870 - RNA, 32 nt, Human
caugggaagcaggauggcagagcugugccaau

SEQ ID NO: 92871 - RNA, 22 nt, Human
caugggaagccauguguaacag

SEQ ID NO: 92872 - RNA, 32 nt, Human
caugggaagccuggcuuggucucaggucaggg

SEQ ID NO: 92873 - RNA, 22 nt, Human
caugggaagcugaggcaggaga

SEQ ID NO: 92874 - RNA, 22 nt, Human
caugggaaggugggaaagcaga

SEQ ID NO: 92875 - RNA, 32 nt, Human
caugggaaguaaauaaagugacaacuucugga

SEQ ID NO: 92876 - RNA, 20 nt, Human
caugggaaucccagcacucc

SEQ ID NO: 92877 - RNA, 32 nt, Human
caugggaaugcacaccugaguagggaggcugg

SEQ ID NO: 92878 - RNA, 32 nt, Human
caugggaauucugggagauacaauucaaguug

SEQ ID NO: 92879 - RNA, 32 nt, Human
caugggaauugugggaguuacaauucaagaug

SEQ ID NO: 92880 - RNA, 25 nt, Human
caugggacaggaaaccucccaggca

SEQ ID NO: 92881 - RNA, 21 nt, Human
caugggaccaauugagaguca

SEQ ID NO: 92882 - RNA, 32 nt, Human
caugggacccacgucagagguguuuacucagc

SEQ ID NO: 92883 - RNA, 32 nt, Human
caugggaccuuggagaaaacugaacuguuaca

SEQ ID NO: 92884 - RNA, 32 nt, Human
caugggacugacaccauguucaagcagaccaa

SEQ ID NO: 92885 - RNA, 32 nt, Human
caugggacugcacuccagccugggugacagag

SEQ ID NO: 92886 - RNA, 32 nt, Human
caugggacuuacucucuccucuccuuugagag

SEQ ID NO: 92887 - RNA, 32 nt, Human
caugggacuuugagaagagggaggacagaggc

SEQ ID NO: 92888 - RNA, 32 nt, Human
caugggagaagagggguauaggacaaggggug

SEQ ID NO: 92889 - RNA, 32 nt, Human
caugggagagaagggaggaggugggcacaggu

SEQ ID NO: 92890 - RNA, 32 nt, Human
caugggagaggaaacguguaggacccgcugag

SEQ ID NO: 92891 - RNA, 20 nt, Human
caugggagagggacagcaga

SEQ ID NO: 92892 - RNA, 19 nt, Human
caugggagagggcaggaca

SEQ ID NO: 92893 - RNA, 32 nt, Human
caugggagaggggaggugucacacaacuugga

SEQ ID NO: 92894 - RNA, 32 nt, Human
caugggagauaggcgguucggagccaguucug

SEQ ID NO: 92895 - RNA, 20 nt, Human
caugggagccuuccuuccua

SEQ ID NO: 92896 - RNA, 32 nt, Human
caugggaggaggaggaagaagaggaggaggag

SEQ ID NO: 92897 - RNA, 32 nt, Human
caugggaggcagagguugcagugagccaagau

SEQ ID NO: 92898 - RNA, 32 nt, Human
caugggaggccuggccugaucuggccucugcc

SEQ ID NO: 92899 - RNA, 32 nt, Human
caugggaggcggagguugcagugagccgagau

SEQ ID NO: 92900 - RNA, 32 nt, Human
caugggaggcguagcuugcagugagcugagau

SEQ ID NO: 92901 - RNA, 32 nt, Human
caugggaggcuaaggugggaggaucacuugag

SEQ ID NO: 92902 - RNA, 26 nt, Human
caugggaggcugaacaggagaaucgc

SEQ ID NO: 92903 - RNA, 32 nt, Human
caugggaggcugaacaggagaaucgcuugaac

SEQ ID NO: 92904 - RNA, 32 nt, Human
caugggaggcugagcaggaggauggcucgaag

SEQ ID NO: 92905 - RNA, 21 nt, Human
caugggaggcugcacagaaga

SEQ ID NO: 92906 - RNA, 32 nt, Human
caugggaggggcugcacaguggcccgagguca

SEQ ID NO: 92907 - RNA, 19 nt, Human
caugggagggggacacaga

SEQ ID NO: 92908 - RNA, 32 nt, Human
caugggagggugagcaggagcaaggcugugcu

SEQ ID NO: 92909 - RNA, 26 nt, Human
caugggaggugagcucuucucuggcc

SEQ ID NO: 92910 - RNA, 32 nt, Human
caugggaggugggcccagaaaggggcuuccca

SEQ ID NO: 92911 - RNA, 21 nt, Human
caugggagugggaccagcaga

SEQ ID NO: 92912 - RNA, 32 nt, Human
caugggaucccaaagcugcugagggauagagc

SEQ ID NO: 92913 - RNA, 32 nt, Human
caugggaugcacugcacaauguucuuuccucu

SEQ ID NO: 92914 - RNA, 32 nt, Human
caugggauggccaccugggcugagggaugaag

SEQ ID NO: 92915 - RNA, 32 nt, Human
caugggauggccuuccugauguggcucuccaa

SEQ ID NO: 92916 - RNA, 32 nt, Human
caugggaugguacagcggccugggcaggggcg

SEQ ID NO: 92917 - RNA, 32 nt, Human
caugggauuauuuucuuuaaaaugacuaugga

SEQ ID NO: 92918 - RNA, 32 nt, Human
caugggauucaagagggacagccccagcuuug

SEQ ID NO: 92919 - RNA, 32 nt, Human
caugggcaagaagcacaagaagcacaagucgg

SEQ ID NO: 92920 - RNA, 32 nt, Human
caugggcaaggcagucucucucccagguauuc

SEQ ID NO: 92921 - RNA, 32 nt, Human
caugggcaauucccuuucucucugucacugcu

SEQ ID NO: 92922 - RNA, 18 nt, Human
caugggcaccugcugucu

SEQ ID NO: 92923 - RNA, 32 nt, Human
caugggcagccagcuggacuaggagugggaag

SEQ ID NO: 92924 - RNA, 21 nt, Human
caugggcagggccacagcaga

SEQ ID NO: 92925 - RNA, 32 nt, Human
caugggcaggguggguggagggacugaugcga

SEQ ID NO: 92926 - RNA, 32 nt, Human
caugggcaugaugucagccaaggaacucgcgg

SEQ ID NO: 92927 - RNA, 32 nt, Human
caugggcauggugaccccaguuuugcccgucu

SEQ ID NO: 92928 - RNA, 32 nt, Human
caugggccaagaccaggaaggaagggccaccu

SEQ ID NO: 92929 - RNA, 32 nt, Human
caugggccaccugcucugugcccgcuccugaa

SEQ ID NO: 92930 - RNA, 32 nt, Human
caugggccauuuguagcccaaccuucucuucc

SEQ ID NO: 92931 - RNA, 32 nt, Human
caugggcccacacaucugcuuuggcuuugccg

SEQ ID NO: 92932 - RNA, 32 nt, Human
caugggcccaggcugagugugagugagcaugu

SEQ ID NO: 92933 - RNA, 23 nt, Human
caugggcccggggccugacccca

SEQ ID NO: 92934 - RNA, 32 nt, Human
caugggcccugaggccccuccugccuggcccu

SEQ ID NO: 92935 - RNA, 32 nt, Human
caugggcccuucaccaccugcccaggaucuca

SEQ ID NO: 92936 - RNA, 32 nt, Human
caugggccucaaagcagggggcuuggaaauag

SEQ ID NO: 92937 - RNA, 32 nt, Human
caugggccucgaggggacugcuuucauagaga

SEQ ID NO: 92938 - RNA, 18 nt, Human
caugggccuggaugcaga

SEQ ID NO: 92939 - RNA, 32 nt, Human
caugggccugggaaggagggugcuguggaggg

SEQ ID NO: 92940 - RNA, 32 nt, Human
caugggcgcccagcaggcccugggcagagaga

SEQ ID NO: 92941 - RNA, 32 nt, Human
caugggcguucaggaacuugcccaggucaggc

SEQ ID NO: 92942 - RNA, 32 nt, Human
caugggcguuuucuuugugcauugauuugcau

SEQ ID NO: 92943 - RNA, 32 nt, Human
caugggcucagcaacauggacuuccacucacc

SEQ ID NO: 92944 - RNA, 32 nt, Human
caugggcucccaggggcuccaggcaugcacag

SEQ ID NO: 92945 - RNA, 32 nt, Human
caugggcucuaagcugcucuucugucugucug

SEQ ID NO: 92946 - RNA, 32 nt, Human
caugggcucugagccaaagaaggaggcauggu

SEQ ID NO: 92947 - RNA, 32 nt, Human
caugggcugagaagcuggaccggcaccaaagg

SEQ ID NO: 92948 - RNA, 32 nt, Human
caugggcugcugcugucacucccucuccacuu

SEQ ID NO: 92949 - RNA, 32 nt, Human
caugggcugcuggaugcagggcucccagggcu

SEQ ID NO: 92950 - RNA, 18 nt, Human
caugggcugggugcagug

SEQ ID NO: 92951 - RNA, 32 nt, Human
caugggcugugcuccccucuuccuacugucag

SEQ ID NO: 92952 - RNA, 32 nt, Human
caugggcuguguccuaaggcccauuugagaag

SEQ ID NO: 92953 - RNA, 32 nt, Human
cauggggaagauggagcaaaccuagcccccaa

SEQ ID NO: 92954 - RNA, 32 nt, Human
cauggggaaggccauguugcagcugcugauca

SEQ ID NO: 92955 - RNA, 32 nt, Human
cauggggaagggaggaaggaagggaugggagg

SEQ ID NO: 92956 - RNA, 32 nt, Human
cauggggaagggauauauaagauggaagcuuc

SEQ ID NO: 92957 - RNA, 32 nt, Human
cauggggaaugcaccuuacgaggcagagcagg

SEQ ID NO: 92958 - RNA, 22 nt, Human
cauggggacaaaaggaaaccuc

SEQ ID NO: 92959 - RNA, 20 nt, Human
cauggggaccaucggugcca

SEQ ID NO: 92960 - RNA, 32 nt, Human
cauggggacugagggagggauggggaagugua

SEQ ID NO: 92961 - RNA, 32 nt, Human
cauggggagaacugagggguagguggggaggg

SEQ ID NO: 92962 - RNA, 32 nt, Human
cauggggagcaagugugcucuccuggggcgcc

SEQ ID NO: 92963 - RNA, 32 nt, Human
cauggggagcagaggcuucuccccagcucugu

SEQ ID NO: 92964 - RNA, 32 nt, Human
cauggggagcucccccucagaucugacccuuu

SEQ ID NO: 92965 - RNA, 32 nt, Human
cauggggagcuuccauaucucauggcuccuug

SEQ ID NO: 92966 - RNA, 32 nt, Human
cauggggaggacuucacucagcagcaaagaga

SEQ ID NO: 92967 - RNA, 32 nt, Human
cauggggaggaggcugaaguggggcugaggac

SEQ ID NO: 92968 - RNA, 32 nt, Human
cauggggaggauugggggaggagaagcagugc

SEQ ID NO: 92969 - RNA, 21 nt, Human
cauggggaggcagagagucac

SEQ ID NO: 92970 - RNA, 32 nt, Human
cauggggaggcaggaguaggacugcagcagag

SEQ ID NO: 92971 - RNA, 32 nt, Human
cauggggagggaaggcuggggugcagggcucc

SEQ ID NO: 92972 - RNA, 32 nt, Human
cauggggagggagaguucggagccaaauuaaa

SEQ ID NO: 92973 - RNA, 32 nt, Human
cauggggaggggccauggcuuggcauguccaa

SEQ ID NO: 92974 - RNA, 32 nt, Human
cauggggagugugaggacauggagggugggag

SEQ ID NO: 92975 - RNA, 20 nt, Human
cauggggaugacagagcaga

SEQ ID NO: 92976 - RNA, 32 nt, Human
cauggggauggacccuuccugccugcaccccg

SEQ ID NO: 92977 - RNA, 32 nt, Human
cauggggcagaaacaguggcuccugggagcag

SEQ ID NO: 92978 - RNA, 32 nt, Human
cauggggcauuuucacaaagcagcccucuuuc

SEQ ID NO: 92979 - RNA, 32 nt, Human
cauggggcccaggaguuggggaaacacaauaa

SEQ ID NO: 92980 - RNA, 25 nt, Human
cauggggcccuccugggcacugggu

SEQ ID NO: 92981 - RNA, 32 nt, Human
cauggggcucagaggcuguaagaacugggauc

SEQ ID NO: 92982 - RNA, 32 nt, Human
cauggggcucaggacagagggagcuagcagcu

SEQ ID NO: 92983 - RNA, 32 nt, Human
cauggggcugugcagcuggagccaaaaaggca

SEQ ID NO: 92984 - RNA, 32 nt, Human
caugggggaaacugaggcacaggaggcaagcu

SEQ ID NO: 92985 - RNA, 32 nt, Human
caugggggaggcacagaaugcuggagagaugc

SEQ ID NO: 92986 - RNA, 32 nt, Human
caugggggagggguguguuaaagggaaggaag

SEQ ID NO: 92987 - RNA, 32 nt, Human
caugggggcacacaccgguaaucccagcuacu

SEQ ID NO: 92988 - RNA, 32 nt, Human
caugggggccaaccccuggccugcugcugugc

SEQ ID NO: 92989 - RNA, 32 nt, Human
caugggggcgcgcaccuguaguuccagcuacu

SEQ ID NO: 92990 - RNA, 32 nt, Human
caugggggcucacaccuguaaucccagcacuu

SEQ ID NO: 92991 - RNA, 32 nt, Human
caugggggcucugccaagacccucaucucugg

SEQ ID NO: 92992 - RNA, 32 nt, Human
caugggggcugaggcagaacccaggagcucca

SEQ ID NO: 92993 - RNA, 16 nt, Human
caugggggucgcugcc

SEQ ID NO: 92994 - RNA, 32 nt, Human
caugggggugauuaccccaugcugcuguucuc

SEQ ID NO: 92995 - RNA, 25 nt, Human
caugggguaugccgggcacugggca

SEQ ID NO: 92996 - RNA, 32 nt, Human
caugggguccccacugugggcagcccugcauu

SEQ ID NO: 92997 - RNA, 32 nt, Human
cauggggucccccuuggggccccacaccccgu

SEQ ID NO: 92998 - RNA, 32 nt, Human
cauggggucugggagcagaggcagguggcaag

SEQ ID NO: 92999 - RNA, 32 nt, Human
cauggggugaagccaccaugggcuggggguga

SEQ ID NO: 93000 - RNA, 32 nt, Human
cauggggugguggaggcagccuucagugagca

SEQ ID NO: 93001 - RNA, 32 nt, Human
cauggguaaggcauggaagaacucuugaaugu

SEQ ID NO: 93002 - RNA, 32 nt, Human
cauggguagaugauuugugcagaucugaauuu

SEQ ID NO: 93003 - RNA, 32 nt, Human
cauggguaggaugagaucuuuggcagaaaggu

SEQ ID NO: 93004 - RNA, 32 nt, Human
caugggucagcucuuucugccaccuccgccuu

SEQ ID NO: 93005 - RNA, 32 nt, Human
caugggucagggugugucugugcugcccccuc

SEQ ID NO: 93006 - RNA, 32 nt, Human
caugggucccacugccuguccagccuggcucc

SEQ ID NO: 93007 - RNA, 19 nt, Human
caugggucccuccauccuu

SEQ ID NO: 93008 - RNA, 17 nt, Human
caugggucccugaucua

SEQ ID NO: 93009 - RNA, 32 nt, Human
caugggucuucaggcucuguuuucacuuugga

SEQ ID NO: 93010 - RNA, 32 nt, Human
caugggugaccagcaacuguacaagaccaacc

SEQ ID NO: 93011 - RNA, 31 nt, Human
caugggugacuucugacuuucuaaggaaaug

SEQ ID NO: 93012 - RNA, 32 nt, Human
caugggugcaaucuuuagccccagggagguca

SEQ ID NO: 93013 - RNA, 18 nt, Human
caugggugcugcacccca

SEQ ID NO: 93014 - RNA, 32 nt, Human
caugggugcugguggcagggaucuaucuaaug

SEQ ID NO: 93015 - RNA, 31 nt, Human
cauggguggguggggagucagucaugucacu

SEQ ID NO: 93016 - RNA, 32 nt, Human
caugggugguacauugaggaguauuuacauuu

SEQ ID NO: 93017 - RNA, 32 nt, Human
cauggguuaccuuugcaccagcuucaguguua

SEQ ID NO: 93018 - RNA, 32 nt, Human
cauggguucccugcaagaccacuggaaccaac

SEQ ID NO: 93019 - RNA, 32 nt, Human
cauggguugaaugcugaaaacaugcacagcca

SEQ ID NO: 93020 - RNA, 32 nt, Human
cauggguugaguguggccaccugcaggaugug

SEQ ID NO: 93021 - RNA, 21 nt, Human
cauggguuucagcacagcaga

SEQ ID NO: 93022 - RNA, 32 nt, Human
cauggguuucagugcugagugaaaaucuauac

SEQ ID NO: 93023 - RNA, 32 nt, Human
cauggguuucuagaagacaaguuuucaacugc

SEQ ID NO: 93024 - RNA, 22 nt, Human
caugguaaaaccccaucucuac

SEQ ID NO: 93025 - RNA, 24 nt, Human
caugguaaaaccccaucucuacua

SEQ ID NO: 93026 - RNA, 24 nt, Human
caugguaaaaccccauuucuacua

SEQ ID NO: 93027 - RNA, 24 nt, Human
caugguaaaaccccauuucugcua

SEQ ID NO: 93028 - RNA, 24 nt, Human
caugguaaaaccccgucucuacua

SEQ ID NO: 93029 - RNA, 21 nt, Human
caugguaaaacccugucucua

SEQ ID NO: 93030 - RNA, 24 nt, Human
caugguaaaacccugucucuacua

SEQ ID NO: 93031 - RNA, 24 nt, Human
caugguaaaacgccgucucuacua

SEQ ID NO: 93032 - RNA, 24 nt, Human
caugguaaaacucugucucuacua

SEQ ID NO: 93033 - RNA, 32 nt, Human
caugguaaccuacuguuugccagccuguaaaa

SEQ ID NO: 93034 - RNA, 32 nt, Human
caugguaacucacaccuguaaaccuaacacuu

SEQ ID NO: 93035 - RNA, 23 nt, Human
caugguaacucacgccuguaauc

SEQ ID NO: 93036 - RNA, 32 nt, Human
caugguaacuugugccuguaauuccagcugcu

SEQ ID NO: 93037 - RNA, 32 nt, Human
caugguaauuauuggaaaguauucaaauaaau

SEQ ID NO: 93038 - RNA, 32 nt, Human
caugguacauacugcauuugcaucaaacuagc

SEQ ID NO: 93039 - RNA, 32 nt, Human
caugguagaaguggagagagucccggacaugc

SEQ ID NO: 93040 - RNA, 24 nt, Human
caugguagacagagguugcaguga

SEQ ID NO: 93041 - RNA, 24 nt, Human
caugguagcacacaccuguagucc

SEQ ID NO: 93042 - RNA, 32 nt, Human
caugguagcacacaccuguagucccagauacu

SEQ ID NO: 93043 - RNA, 32 nt, Human
caugguagcaggagccuguaaucccagcuguu

SEQ ID NO: 93044 - RNA, 32 nt, Human
caugguagcaggcaccuguaaccccagcuacu

SEQ ID NO: 93045 - RNA, 32 nt, Human
caugguagcaggcgcuuguaaucccagcuacu

SEQ ID NO: 93046 - RNA, 32 nt, Human
caugguagcaggugccuguaaucccagcuacu

SEQ ID NO: 93047 - RNA, 30 nt, Human
caugguagccucuucugguuuugcucuugc

SEQ ID NO: 93048 - RNA, 32 nt, Human
caugguagcgcacaccuguaauuccagcuacu

SEQ ID NO: 93049 - RNA, 32 nt, Human
caugguagcucaagccuauaaucccagcaugu

SEQ ID NO: 93050 - RNA, 32 nt, Human
caugguagcucacacuuguaaucccgacacuu

SEQ ID NO: 93051 - RNA, 23 nt, Human
caugguagcucacgccuguaauc

SEQ ID NO: 93052 - RNA, 32 nt, Human
caugguagcucacgccuguaaucccagcacuu

SEQ ID NO: 93053 - RNA, 32 nt, Human
caugguagcucacgccuguaauccuagcaauu

SEQ ID NO: 93054 - RNA, 24 nt, Human
caugguagcucaugccuguaaccc

SEQ ID NO: 93055 - RNA, 24 nt, Human
caugguagcucaugccuguaaucc

SEQ ID NO: 93056 - RNA, 32 nt, Human
caugguagcucaugucuguaaucccagcacuu

SEQ ID NO: 93057 - RNA, 32 nt, Human
caugguagcucucgccuguaaucccagcacuu

SEQ ID NO: 93058 - RNA, 32 nt, Human
caugguagcugccgccuguaaucccagcuucu

SEQ ID NO: 93059 - RNA, 32 nt, Human
caugguagcuuacgccuguaaucccagcacuu

SEQ ID NO: 93060 - RNA, 24 nt, Human
caugguaguccaugccuguagucc

SEQ ID NO: 93061 - RNA, 32 nt, Human
caugguagugcacgccuguaaucccagcuacu

SEQ ID NO: 93062 - RNA, 32 nt, Human
caugguagugcaugccucuaaucccagcuacu

SEQ ID NO: 93063 - RNA, 24 nt, Human
caugguagugcaugccuguagucc

SEQ ID NO: 93064 - RNA, 32 nt, Human
caugguagugggugccuguaaucccagcuacu

SEQ ID NO: 93065 - RNA, 24 nt, Human
caugguaguucacaccuguagucc

SEQ ID NO: 93066 - RNA, 32 nt, Human
caugguauugaccaguagccuauuuaucaaag

SEQ ID NO: 93067 - RNA, 32 nt, Human
caugguauuuuugaaggagcuaaugaaacacu

SEQ ID NO: 93068 - RNA, 32 nt, Human
cauggucaagccuguaguauuaaaaugauuuu

SEQ ID NO: 93069 - RNA, 32 nt, Human
cauggucacagccaagaggagccugagaagac

SEQ ID NO: 93070 - RNA, 31 nt, Human
cauggucacagcugcugccccagcucuggaa

SEQ ID NO: 93071 - RNA, 32 nt, Human
cauggucacagcugcugccccagcucuggaac

SEQ ID NO: 93072 - RNA, 32 nt, Human
cauggucagagcaguggagacuggagcccugu

SEQ ID NO: 93073 - RNA, 32 nt, Human
cauggucagcagcagagagagcaacgggaagg

SEQ ID NO: 93074 - RNA, 32 nt, Human
cauggucagccaagcuuacccuucacacugag

SEQ ID NO: 93075 - RNA, 31 nt, Human
cauggucagccugucugacauccagguugug

SEQ ID NO: 93076 - RNA, 32 nt, Human
cauggucauaggcgccuguaaucccagcuacu

SEQ ID NO: 93077 - RNA, 32 nt, Human
cauggucaugauuauaaacaucagccccuuuu

SEQ ID NO: 93078 - RNA, 22 nt, Human
caugguccacacugcuggggga

SEQ ID NO: 93079 - RNA, 32 nt, Human
caugguccacagugguucaauaucucaugcag

SEQ ID NO: 93080 - RNA, 32 nt, Human
caugguccaugugacugcuguccuuugaauug

SEQ ID NO: 93081 - RNA, 32 nt, Human
caugguccucaggcauggacaggcuggcauuc

SEQ ID NO: 93082 - RNA, 32 nt, Human
caugguccuccacccuuccugccauucugccc

SEQ ID NO: 93083 - RNA, 32 nt, Human
caugguccugccccagcaucuugcuggguugg

SEQ ID NO: 93084 - RNA, 32 nt, Human
caugguccuuggugaagaccugcaccccugga

SEQ ID NO: 93085 - RNA, 24 nt, Human
cauggucgcucaugccuguggucc

SEQ ID NO: 93086 - RNA, 32 nt, Human
cauggucggagggaucucgccccgggagaaaa

SEQ ID NO: 93087 - RNA, 32 nt, Human
cauggucgugcaugcuuguaaucccagcuacu

SEQ ID NO: 93088 - RNA, 32 nt, Human
cauggucuaggguagugcuggugaggagauaa

SEQ ID NO: 93089 - RNA, 32 nt, Human
cauggucucagggaacagccugcuucccacca

SEQ ID NO: 93090 - RNA, 32 nt, Human
cauggucuccaccacucaccaucacccugcug

SEQ ID NO: 93091 - RNA, 32 nt, Human
cauggucuccuugccugcuccaaggcacagga

SEQ ID NO: 93092 - RNA, 32 nt, Human
cauggucugaaaggauuccugcucuggugaga

SEQ ID NO: 93093 - RNA, 32 nt, Human
cauggucugccuggaccuagccaggcucacug

SEQ ID NO: 93094 - RNA, 32 nt, Human
cauggucugcuagguugcaggcuguaguuuac

SEQ ID NO: 93095 - RNA, 32 nt, Human
cauggucuugcuucaguguugauggcuacuga

SEQ ID NO: 93096 - RNA, 32 nt, Human
cauggucuuucucugcaguccccagccaauac

SEQ ID NO: 93097 - RNA, 25 nt, Human
cauggugaaaaccccaucucuacua

SEQ ID NO: 93098 - RNA, 24 nt, Human
cauggugaaaaccuaucucuacua

SEQ ID NO: 93099 - RNA, 24 nt, Human
cauggugaaacaccaucucuacua

SEQ ID NO: 93100 - RNA, 24 nt, Human
cauggugaaacaccgucuccacua

SEQ ID NO: 93101 - RNA, 24 nt, Human
cauggugaaacaccgucucuacua

SEQ ID NO: 93102 - RNA, 24 nt, Human
cauggugaaacacuaucucuacua

SEQ ID NO: 93103 - RNA, 24 nt, Human
cauggugaaacacugucucuacua

SEQ ID NO: 93104 - RNA, 21 nt, Human
cauggugaaacccagucucua

SEQ ID NO: 93105 - RNA, 23 nt, Human
cauggugaaacccaucucuacua

SEQ ID NO: 93106 - RNA, 23 nt, Human
cauggugaaacccaugucuacua

SEQ ID NO: 93107 - RNA, 20 nt, Human
cauggugaaaccccaccucu

SEQ ID NO: 93108 - RNA, 22 nt, Human
cauggugaaaccccaccucuac

SEQ ID NO: 93109 - RNA, 24 nt, Human
cauggugaaaccccaccucuacua

SEQ ID NO: 93110 - RNA, 24 nt, Human
cauggugaaaccccauauccauua

SEQ ID NO: 93111 - RNA, 24 nt, Human
cauggugaaaccccaucgcuacua

SEQ ID NO: 93112 - RNA, 24 nt, Human
cauggugaaaccccaucucaacua

SEQ ID NO: 93113 - RNA, 22 nt, Human
cauggugaaaccccaucuccac

SEQ ID NO: 93114 - RNA, 24 nt, Human
cauggugaaaccccaucuccacua

SEQ ID NO: 93115 - RNA, 20 nt, Human
cauggugaaaccccaucucu

SEQ ID NO: 93116 - RNA, 22 nt, Human
cauggugaaaccccaucucuac

SEQ ID NO: 93117 - RNA, 23 nt, Human
cauggugaaaccccaucucuacu

SEQ ID NO: 93118 - RNA, 24 nt, Human
cauggugaaaccccaucucuacua

SEQ ID NO: 93119 - RNA, 24 nt, Human
cauggugaaaccccaucucuagua

SEQ ID NO: 93120 - RNA, 22 nt, Human
cauggugaaaccccaucucuau

SEQ ID NO: 93121 - RNA, 24 nt, Human
cauggugaaaccccaucucugcua

SEQ ID NO: 93122 - RNA, 24 nt, Human
cauggugaaaccccaucucuggua

SEQ ID NO: 93123 - RNA, 24 nt, Human
cauggugaaaccccaucucuucua

SEQ ID NO: 93124 - RNA, 24 nt, Human
cauggugaaaccccaucuguacua

SEQ ID NO: 93125 - RNA, 24 nt, Human
cauggugaaaccccaucuuuacug

SEQ ID NO: 93126 - RNA, 24 nt, Human
cauggugaaaccccaugucuacua

SEQ ID NO: 93127 - RNA, 23 nt, Human
cauggugaaaccccauuucuacu

SEQ ID NO: 93128 - RNA, 24 nt, Human
cauggugaaaccccauuucuacua

SEQ ID NO: 93129 - RNA, 25 nt, Human
cauggugaaacccccaucucuacua

SEQ ID NO: 93130 - RNA, 32 nt, Human
cauggugaaacccccaucucuccugggcaugu

SEQ ID NO: 93131 - RNA, 22 nt, Human
cauggugaaaccccccucucua

SEQ ID NO: 93132 - RNA, 22 nt, Human
cauggugaaacccccgucucua

SEQ ID NO: 93133 - RNA, 25 nt, Human
cauggugaaacccccgucucuacua

SEQ ID NO: 93134 - RNA, 24 nt, Human
cauggugaaacccccuaucuacua

SEQ ID NO: 93135 - RNA, 21 nt, Human
cauggugaaaccccgccucua

SEQ ID NO: 93136 - RNA, 21 nt, Human
cauggugaaaccccgucacua

SEQ ID NO: 93137 - RNA, 24 nt, Human
cauggugaaaccccgucuccacua

SEQ ID NO: 93138 - RNA, 24 nt, Human
cauggugaaaccccgucuccauua

SEQ ID NO: 93139 - RNA, 21 nt, Human
cauggugaaaccccgucucua

SEQ ID NO: 93140 - RNA, 22 nt, Human
cauggugaaaccccgucucuac

SEQ ID NO: 93141 - RNA, 24 nt, Human
cauggugaaaccccgucucuacua

SEQ ID NO: 93142 - RNA, 22 nt, Human
cauggugaaaccccguuucuac

SEQ ID NO: 93143 - RNA, 24 nt, Human
cauggugaaaccccguuucuacua

SEQ ID NO: 93144 - RNA, 21 nt, Human
cauggugaaaccccuucucua

SEQ ID NO: 93145 - RNA, 24 nt, Human
cauggugaaaccccuucucuacua

SEQ ID NO: 93146 - RNA, 24 nt, Human
cauggugaaacccgcugucuacua

SEQ ID NO: 93147 - RNA, 24 nt, Human
cauggugaaacccggucucuacua

SEQ ID NO: 93148 - RNA, 21 nt, Human
cauggugaaacccgucucuac

SEQ ID NO: 93149 - RNA, 23 nt, Human
cauggugaaacccgucucuacua

SEQ ID NO: 93150 - RNA, 21 nt, Human
cauggugaaacccuaucuccg

SEQ ID NO: 93151 - RNA, 24 nt, Human
cauggugaaacccuaucucuacua

SEQ ID NO: 93152 - RNA, 24 nt, Human
cauggugaaacccuggcucuacua

SEQ ID NO: 93153 - RNA, 21 nt, Human
cauggugaaacccuguaucua

SEQ ID NO: 93154 - RNA, 24 nt, Human
cauggugaaacccuguaucuacua

SEQ ID NO: 93155 - RNA, 24 nt, Human
cauggugaaacccugucccuacua

SEQ ID NO: 93156 - RNA, 22 nt, Human
cauggugaaacccugucuacua

SEQ ID NO: 93157 - RNA, 21 nt, Human
cauggugaaacccugucucua

SEQ ID NO: 93158 - RNA, 22 nt, Human
cauggugaaacccugucucuac

SEQ ID NO: 93159 - RNA, 24 nt, Human
cauggugaaacccugucucuacua

SEQ ID NO: 93160 - RNA, 24 nt, Human
cauggugaaacccugugccuacua

SEQ ID NO: 93161 - RNA, 24 nt, Human
cauggugaaacccuguugcuacua

SEQ ID NO: 93162 - RNA, 24 nt, Human
cauggugaaacccuguuucuacua

SEQ ID NO: 93163 - RNA, 24 nt, Human
cauggugaaaccucaacucuacua

SEQ ID NO: 93164 - RNA, 23 nt, Human
cauggugaaaccucaucccucua

SEQ ID NO: 93165 - RNA, 23 nt, Human
cauggugaaaccucaucuccacu

SEQ ID NO: 93166 - RNA, 24 nt, Human
cauggugaaaccucaucuccgcua

SEQ ID NO: 93167 - RNA, 24 nt, Human
cauggugaaaccucaucucuacua

SEQ ID NO: 93168 - RNA, 24 nt, Human
cauggugaaaccucgccucuacua

SEQ ID NO: 93169 - RNA, 24 nt, Human
cauggugaaaccucgucucuacua

SEQ ID NO: 93170 - RNA, 24 nt, Human
cauggugaaaccucgugucuacua

SEQ ID NO: 93171 - RNA, 23 nt, Human
cauggugaaaccugucucuacua

SEQ ID NO: 93172 - RNA, 22 nt, Human
cauggugaaaccuugucucuac

SEQ ID NO: 93173 - RNA, 24 nt, Human
cauggugaaaccuugucucuacua

SEQ ID NO: 93174 - RNA, 24 nt, Human
cauggugaaacgccaucccuacua

SEQ ID NO: 93175 - RNA, 24 nt, Human
cauggugaaacgccaucucuacua

SEQ ID NO: 93176 - RNA, 24 nt, Human
cauggugaaacgcuaucucuacua

SEQ ID NO: 93177 - RNA, 24 nt, Human
cauggugaaacuaugucucuacua

SEQ ID NO: 93178 - RNA, 24 nt, Human
cauggugaaacuccaucccuacua

SEQ ID NO: 93179 - RNA, 24 nt, Human
cauggugaaacuccaucucuacua

SEQ ID NO: 93180 - RNA, 24 nt, Human
cauggugaaacuccgucucuacua

SEQ ID NO: 93181 - RNA, 24 nt, Human
cauggugaaacuccuuccccacua

SEQ ID NO: 93182 - RNA, 24 nt, Human
cauggugaaacucugucucuacua

SEQ ID NO: 93183 - RNA, 24 nt, Human
cauggugaaacuucaucucuacua

SEQ ID NO: 93184 - RNA, 22 nt, Human
cauggugaaauccuaucucuac

SEQ ID NO: 93185 - RNA, 24 nt, Human
cauggugaaauccugucuccacua

SEQ ID NO: 93186 - RNA, 24 nt, Human
cauggugaaauucugucucuacua

SEQ ID NO: 93187 - RNA, 23 nt, Human
cauggugacacacaccuguaauc

SEQ ID NO: 93188 - RNA, 24 nt, Human
cauggugacacaugccuguagucc

SEQ ID NO: 93189 - RNA, 32 nt, Human
cauggugacagaauaccuauuguuaagcagac

SEQ ID NO: 93190 - RNA, 32 nt, Human
cauggugacaggcaccuauaaucccagcuaca

SEQ ID NO: 93191 - RNA, 32 nt, Human
cauggugaccaacucucagaaacuccagcugc

SEQ ID NO: 93192 - RNA, 32 nt, Human
cauggugaccaccaggggcaagcacagcccgg

SEQ ID NO: 93193 - RNA, 23 nt, Human
cauggugacccacaccuguaauc

SEQ ID NO: 93194 - RNA, 32 nt, Human
cauggugacccacaccuguaaucccagcacuu

SEQ ID NO: 93195 - RNA, 32 nt, Human
cauggugacgcaugccuguaaucccagcuacu

SEQ ID NO: 93196 - RNA, 32 nt, Human
cauggugacgggcaccuguagucccagcuacu

SEQ ID NO: 93197 - RNA, 23 nt, Human
cauggugacucacaucuguaauc

SEQ ID NO: 93198 - RNA, 32 nt, Human
cauggugacucacaucuguaaucccagcacuu

SEQ ID NO: 93199 - RNA, 32 nt, Human
cauggugacucacgccuguaaucccccagcaa

SEQ ID NO: 93200 - RNA, 32 nt, Human
cauggugacucaggccuguaaucccagcacuu

SEQ ID NO: 93201 - RNA, 32 nt, Human
cauggugacucauaccuguaaucccaacaauu

SEQ ID NO: 93202 - RNA, 32 nt, Human
cauggugacucaugccuauaaucccagcacuu

SEQ ID NO: 93203 - RNA, 24 nt, Human
cauggugacucaugccuguaaucc

SEQ ID NO: 93204 - RNA, 32 nt, Human
cauggugacugaggacagagacccagagugac

SEQ ID NO: 93205 - RNA, 32 nt, Human
cauggugacuugugccugaaaucccagcuauc

SEQ ID NO: 93206 - RNA, 23 nt, Human
cauggugagacccaucucuacua

SEQ ID NO: 93207 - RNA, 24 nt, Human
cauggugagaccccaucucuacua

SEQ ID NO: 93208 - RNA, 18 nt, Human
cauggugagagcacagca

SEQ ID NO: 93209 - RNA, 32 nt, Human
cauggugagguuucaucugauugagaaggggg

SEQ ID NO: 93210 - RNA, 32 nt, Human
cauggugagucacaccuauagucccagcauuu

SEQ ID NO: 93211 - RNA, 32 nt, Human
cauggugagucacaccuauagucucagcauuu

SEQ ID NO: 93212 - RNA, 32 nt, Human
cauggugagugcucugugccuccugcucaccu

SEQ ID NO: 93213 - RNA, 32 nt, Human
cauggugaguuggcuuccagagcuguggguag

SEQ ID NO: 93214 - RNA, 32 nt, Human
cauggugauagccugaagagcuuuccucacua

SEQ ID NO: 93215 - RNA, 32 nt, Human
cauggugaugcacaccuguaaucccagcuacu

SEQ ID NO: 93216 - RNA, 32 nt, Human
cauggugaugcacaccuguaaucccagcuauu

SEQ ID NO: 93217 - RNA, 24 nt, Human
cauggugaugcaugccuguaaucc

SEQ ID NO: 93218 - RNA, 32 nt, Human
cauggugaugcaugccuguaaucccagcuacu

SEQ ID NO: 93219 - RNA, 32 nt, Human
cauggugcaguaguguggaguggaugaguguu

SEQ ID NO: 93220 - RNA, 32 nt, Human
cauggugcaugagugaucucagccuagcgaug

SEQ ID NO: 93221 - RNA, 32 nt, Human
cauggugccgcauaacuauaaucccagcuacu

SEQ ID NO: 93222 - RNA, 32 nt, Human
cauggugccgugcgccuguaaucccagcuacc

SEQ ID NO: 93223 - RNA, 32 nt, Human
cauggugcgucacaccuauaaucccagcacuu

SEQ ID NO: 93224 - RNA, 32 nt, Human
cauggugcuagugcccucucucugggcccagg

SEQ ID NO: 93225 - RNA, 31 nt, Human
cauggugcuuuucaggggccuguguguacac

SEQ ID NO: 93226 - RNA, 32 nt, Human
caugguggaacacaccugcaaucccagcuacu

SEQ ID NO: 93227 - RNA, 24 nt, Human
caugguggaaccccaucucuacua

SEQ ID NO: 93228 - RNA, 25 nt, Human
caugguggaacccccaucucuacua

SEQ ID NO: 93229 - RNA, 24 nt, Human
caugguggaacccuaucucuacua

SEQ ID NO: 93230 - RNA, 32 nt, Human
caugguggacuuuuguuucugaucuuguuuuc

SEQ ID NO: 93231 - RNA, 32 nt, Human
caugguggagaagggaucagauagcuccucag

SEQ ID NO: 93232 - RNA, 32 nt, Human
caugguggcaaacgccuguaaucccaacuacu

SEQ ID NO: 93233 - RNA, 32 nt, Human
caugguggcaaaugccuguaauaccagcuacu

SEQ ID NO: 93234 - RNA, 32 nt, Human
caugguggcaagagccuguaaucucagcuacu

SEQ ID NO: 93235 - RNA, 32 nt, Human
caugguggcaagcaccuguagucccaguuacu

SEQ ID NO: 93236 - RNA, 32 nt, Human
caugguggcacacaccugcauucccagcuacu

SEQ ID NO: 93237 - RNA, 23 nt, Human
caugguggcacacaccuguaauc

SEQ ID NO: 93238 - RNA, 24 nt, Human
caugguggcacacaccuguaaucc

SEQ ID NO: 93239 - RNA, 32 nt, Human
caugguggcacacaccuguaaucccagcuacu

SEQ ID NO: 93240 - RNA, 32 nt, Human
caugguggcacacaccuguaaucguagcugag

SEQ ID NO: 93241 - RNA, 24 nt, Human
caugguggcacacaccuguagucc

SEQ ID NO: 93242 - RNA, 32 nt, Human
caugguggcacacaccuguagucccagcuacu

SEQ ID NO: 93243 - RNA, 32 nt, Human
caugguggcacacaccuguagucccaggcuga

SEQ ID NO: 93244 - RNA, 32 nt, Human
caugguggcacacaccuguagucccaguuacu

SEQ ID NO: 93245 - RNA, 32 nt, Human
caugguggcacacaccuguggucccagcuacu

SEQ ID NO: 93246 - RNA, 24 nt, Human
caugguggcacacgccugcagucc

SEQ ID NO: 93247 - RNA, 24 nt, Human
caugguggcacacgccuguaaucc

SEQ ID NO: 93248 - RNA, 32 nt, Human
caugguggcacacgccuguaaucccagcuaca

SEQ ID NO: 93249 - RNA, 32 nt, Human
caugguggcacacgccuguaaucccagcuacu

SEQ ID NO: 93250 - RNA, 32 nt, Human
caugguggcacacgccuguaaucccagguacu

SEQ ID NO: 93251 - RNA, 32 nt, Human
caugguggcacacgccuguaaucucagcuacu

SEQ ID NO: 93252 - RNA, 24 nt, Human
caugguggcacacgccuguagucc

SEQ ID NO: 93253 - RNA, 32 nt, Human
caugguggcacauaccuguaaucccagcuacu

SEQ ID NO: 93254 - RNA, 24 nt, Human
caugguggcacaugccuauagucc

SEQ ID NO: 93255 - RNA, 24 nt, Human
caugguggcacaugccuguaaucc

SEQ ID NO: 93256 - RNA, 32 nt, Human
caugguggcacaugccuguaaucccagcuacg

SEQ ID NO: 93257 - RNA, 32 nt, Human
caugguggcacaugccuguaaucccagcuacu

SEQ ID NO: 93258 - RNA, 32 nt, Human
caugguggcacaugccuguaaucccgguauuu

SEQ ID NO: 93259 - RNA, 32 nt, Human
caugguggcacaugccuguaauccuagcuacu

SEQ ID NO: 93260 - RNA, 32 nt, Human
caugguggcacaugccuguaaucucagcuacu

SEQ ID NO: 93261 - RNA, 24 nt, Human
caugguggcacaugccuguagucc

SEQ ID NO: 93262 - RNA, 32 nt, Human
caugguggcacaugcuuguaaucccagcuacu

SEQ ID NO: 93263 - RNA, 32 nt, Human
caugguggcacaugucuguaaucccagcuacu

SEQ ID NO: 93264 - RNA, 32 nt, Human
caugguggcacaugucuguaauccuagcacuu

SEQ ID NO: 93265 - RNA, 32 nt, Human
caugguggcaccugccuauaaucccagcuauu

SEQ ID NO: 93266 - RNA, 32 nt, Human
caugguggcaccugccuguaaucccagcuacu

SEQ ID NO: 93267 - RNA, 32 nt, Human
caugguggcacgcgccuguaauaccagcuacu

SEQ ID NO: 93268 - RNA, 32 nt, Human
caugguggcacgcgccuguaaucccagcuacu

SEQ ID NO: 93269 - RNA, 23 nt, Human
caugguggcacgcucuguaaucc

SEQ ID NO: 93270 - RNA, 32 nt, Human
caugguggcacgugccuguaaucccagcuacu

SEQ ID NO: 93271 - RNA, 32 nt, Human
caugguggcacgugccuguaaucucagcuacu

SEQ ID NO: 93272 - RNA, 32 nt, Human
caugguggcagacaccuguagucccagcuacu

SEQ ID NO: 93273 - RNA, 32 nt, Human
caugguggcaggcaccuguaaucccagcuacu

SEQ ID NO: 93274 - RNA, 32 nt, Human
caugguggcaggcaccuguaaucccagguacu

SEQ ID NO: 93275 - RNA, 32 nt, Human
caugguggcaggcaccuguaaucccaguuacu

SEQ ID NO: 93276 - RNA, 32 nt, Human
caugguggcaggcaccuguagucccagccagu

SEQ ID NO: 93277 - RNA, 32 nt, Human
caugguggcaggcaccuguagucccagcuacu

SEQ ID NO: 93278 - RNA, 32 nt, Human
caugguggcaggcgccguggcagggauccugg

SEQ ID NO: 93279 - RNA, 32 nt, Human
caugguggcaggcgccuauaaucccagcuacu

SEQ ID NO: 93280 - RNA, 32 nt, Human
caugguggcaggcgccuguaaucccagcuaaa

SEQ ID NO: 93281 - RNA, 32 nt, Human
caugguggcaggcgccuguaaucccagcuacu

SEQ ID NO: 93282 - RNA, 32 nt, Human
caugguggcaggcgccuguaaucccagcuauu

SEQ ID NO: 93283 - RNA, 32 nt, Human
caugguggcaggugccuguaaucccagcuacu

SEQ ID NO: 93284 - RNA, 32 nt, Human
caugguggcaggugcuuguaaucccagcuacu

SEQ ID NO: 93285 - RNA, 32 nt, Human
caugguggcagucaccuguaaucccagcuacu

SEQ ID NO: 93286 - RNA, 32 nt, Human
caugguggcaguugccuguaauccuagcuacu

SEQ ID NO: 93287 - RNA, 32 nt, Human
caugguggcauaaaugagaaauugccuguagc

SEQ ID NO: 93288 - RNA, 24 nt, Human
caugguggcauacaccuguagucc

SEQ ID NO: 93289 - RNA, 32 nt, Human
caugguggcauacaccuguagucccagcuacu

SEQ ID NO: 93290 - RNA, 24 nt, Human
caugguggcauauaccuguaaccc

SEQ ID NO: 93291 - RNA, 24 nt, Human
caugguggcauaugccuguagucc

SEQ ID NO: 93292 - RNA, 32 nt, Human
caugguggcaugcaccugcaaucccagcuacu

SEQ ID NO: 93293 - RNA, 32 nt, Human
caugguggcaugcaccuguaaacccagcuacu

SEQ ID NO: 93294 - RNA, 32 nt, Human
caugguggcaugcaccuguaaucccaacuacu

SEQ ID NO: 93295 - RNA, 32 nt, Human
caugguggcaugcaccuguagucccagcuacu

SEQ ID NO: 93296 - RNA, 32 nt, Human
caugguggcaugcaccuguaguccgagguacu

SEQ ID NO: 93297 - RNA, 32 nt, Human
caugguggcaugcgccuguaaucccagcuacc

SEQ ID NO: 93298 - RNA, 32 nt, Human
caugguggcaugcgccuguaaucccagcuacu

SEQ ID NO: 93299 - RNA, 32 nt, Human
caugguggcaugugccugcaaucccagcuacu

SEQ ID NO: 93300 - RNA, 32 nt, Human
caugguggcaugugccuguaaucccagcuacu

SEQ ID NO: 93301 - RNA, 32 nt, Human
caugguggcaugugccuguaaucccaguuacu

SEQ ID NO: 93302 - RNA, 32 nt, Human
caugguggcauucgucuguaaucccagcuacu

SEQ ID NO: 93303 - RNA, 32 nt, Human
caugguggccagcaccuguaaucccagcuacu

SEQ ID NO: 93304 - RNA, 24 nt, Human
caugguggcccacaccuguggucc

SEQ ID NO: 93305 - RNA, 32 nt, Human
caugguggcccacaccuguggucccagcuacu

SEQ ID NO: 93306 - RNA, 23 nt, Human
caugguggcccacgccuguaauc

SEQ ID NO: 93307 - RNA, 24 nt, Human
caugguggcccacgccuguaaucc

SEQ ID NO: 93308 - RNA, 32 nt, Human
caugguggcccacgccuguaaucccagcuacu

SEQ ID NO: 93309 - RNA, 32 nt, Human
caugguggcccaggucuucaggcugcaacagg

SEQ ID NO: 93310 - RNA, 32 nt, Human
caugguggcccaugccuguaaucccagcacuu

SEQ ID NO: 93311 - RNA, 23 nt, Human
caugguggcccaugccuguagcc

SEQ ID NO: 93312 - RNA, 18 nt, Human
caugguggcccuguucug

SEQ ID NO: 93313 - RNA, 32 nt, Human
caugguggccggcgccuguaaucccagcuacu

SEQ ID NO: 93314 - RNA, 24 nt, Human
caugguggccugcaccuguagucc

SEQ ID NO: 93315 - RNA, 24 nt, Human
caugguggccugugccuauagucc

SEQ ID NO: 93316 - RNA, 32 nt, Human
caugguggcgaaugacuguaaucccagcuacu

SEQ ID NO: 93317 - RNA, 19 nt, Human
caugguggcgagcacagca

SEQ ID NO: 93318 - RNA, 32 nt, Human
caugguggcgagcaccuguaaucccagcuucu

SEQ ID NO: 93319 - RNA, 32 nt, Human
caugguggcgagcaccuguagucccagcuacu

SEQ ID NO: 93320 - RNA, 32 nt, Human
caugguggcgcaagccuguaaucccagcuacu

SEQ ID NO: 93321 - RNA, 23 nt, Human
caugguggcgcacaccuauaauc

SEQ ID NO: 93322 - RNA, 23 nt, Human
caugguggcgcacaccuguaauc

SEQ ID NO: 93323 - RNA, 24 nt, Human
caugguggcgcacaccuguaaucc

SEQ ID NO: 93324 - RNA, 32 nt, Human
caugguggcgcacaccuguaauccuagcuacu

SEQ ID NO: 93325 - RNA, 32 nt, Human
caugguggcgcacaccuguaaucucagcuacu

SEQ ID NO: 93326 - RNA, 24 nt, Human
caugguggcgcacaccuguagucc

SEQ ID NO: 93327 - RNA, 32 nt, Human
caugguggcgcacaccuguagucccagcuacu

SEQ ID NO: 93328 - RNA, 32 nt, Human
caugguggcgcacgccuguaaugccagcuacu

SEQ ID NO: 93329 - RNA, 24 nt, Human
caugguggcgcacgccuguagucc

SEQ ID NO: 93330 - RNA, 24 nt, Human
caugguggcgcauaccuguaaucc

SEQ ID NO: 93331 - RNA, 32 nt, Human
caugguggcgcauaccuguaaucccagcuacu

SEQ ID NO: 93332 - RNA, 24 nt, Human
caugguggcgcauaccuguagucc

SEQ ID NO: 93333 - RNA, 24 nt, Human
caugguggcgcaugccuguaaucc

SEQ ID NO: 93334 - RNA, 32 nt, Human
caugguggcgcaugccuguaaucccagcuacu

SEQ ID NO: 93335 - RNA, 32 nt, Human
caugguggcgcaugccuguaaucccagcuauu

SEQ ID NO: 93336 - RNA, 32 nt, Human
caugguggcgcaugccuguaauccuagcuauu

SEQ ID NO: 93337 - RNA, 32 nt, Human
caugguggcgcaugccuguaaucucagcuacu

SEQ ID NO: 93338 - RNA, 32 nt, Human
caugguggcgcgcaccuguaaucccagcuacu

SEQ ID NO: 93339 - RNA, 32 nt, Human
caugguggcgcgugccuguaaucccagcuacu

SEQ ID NO: 93340 - RNA, 32 nt, Human
caugguggcgcucaccuguaaucccggcuacu

SEQ ID NO: 93341 - RNA, 32 nt, Human
caugguggcggacaucuguaaucccagcuacu

SEQ ID NO: 93342 - RNA, 32 nt, Human
caugguggcgggcaccuguaaucccagcuacu

SEQ ID NO: 93343 - RNA, 32 nt, Human
caugguggcgggcaccuguagucacgguuacu

SEQ ID NO: 93344 - RNA, 32 nt, Human
caugguggcgggcaccuguagucccagccacc

SEQ ID NO: 93345 - RNA, 32 nt, Human
caugguggcgggcaccuguagucccagcuacu

SEQ ID NO: 93346 - RNA, 32 nt, Human
caugguggcgggcaccuguauucccagcuacu

SEQ ID NO: 93347 - RNA, 32 nt, Human
caugguggcgggcgccuaaaaucccagcuacu

SEQ ID NO: 93348 - RNA, 32 nt, Human
caugguggcgggcgccuguaaucccagcuacu

SEQ ID NO: 93349 - RNA, 32 nt, Human
caugguggcgggcgcugguaaucccagcuacu

SEQ ID NO: 93350 - RNA, 32 nt, Human
caugguggcgggugccuguaaucccagcuacu

SEQ ID NO: 93351 - RNA, 24 nt, Human
caugguggcguacgccuguagucc

SEQ ID NO: 93352 - RNA, 24 nt, Human
caugguggcguaugccuguaaucc

SEQ ID NO: 93353 - RNA, 32 nt, Human
caugguggcguaugccuguaaucccagcuacu

SEQ ID NO: 93354 - RNA, 32 nt, Human
caugguggcgugcaccuguaaucccagcuacu

SEQ ID NO: 93355 - RNA, 32 nt, Human
caugguggcgugcaccuguagucccagcuucu

SEQ ID NO: 93356 - RNA, 32 nt, Human
caugguggcgugugccuguaaucucagcuacu

SEQ ID NO: 93357 - RNA, 32 nt, Human
caugguggcuaccaagcaggccaugagcccug

SEQ ID NO: 93358 - RNA, 24 nt, Human
caugguggcucaagccuauaaucc

SEQ ID NO: 93359 - RNA, 24 nt, Human
caugguggcucaagccuguaaucc

SEQ ID NO: 93360 - RNA, 32 nt, Human
caugguggcucaagccuguaaucccagcacuu

SEQ ID NO: 93361 - RNA, 32 nt, Human
caugguggcucacaccaguaaucccaacccuu

SEQ ID NO: 93362 - RNA, 32 nt, Human
caugguggcucacaccuauaaccccagcacuu

SEQ ID NO: 93363 - RNA, 23 nt, Human
caugguggcucacaccuauaauc

SEQ ID NO: 93364 - RNA, 32 nt, Human
caugguggcucacaccuauaaucccaacacuu

SEQ ID NO: 93365 - RNA, 32 nt, Human
caugguggcucacaccuauaaucccagcacuu

SEQ ID NO: 93366 - RNA, 32 nt, Human
caugguggcucacaccuauaauuuuagagcuu

SEQ ID NO: 93367 - RNA, 32 nt, Human
caugguggcucacaccucuaauccuagugaga

SEQ ID NO: 93368 - RNA, 32 nt, Human
caugguggcucacaccugagaucccagcacuu

SEQ ID NO: 93369 - RNA, 32 nt, Human
caugguggcucacaccuguaacccccagcacu

SEQ ID NO: 93370 - RNA, 23 nt, Human
caugguggcucacaccuguaauc

SEQ ID NO: 93371 - RNA, 32 nt, Human
caugguggcucacaccuguaaucacugcacuc

SEQ ID NO: 93372 - RNA, 24 nt, Human
caugguggcucacaccuguaaucc

SEQ ID NO: 93373 - RNA, 32 nt, Human
caugguggcucacaccuguaaucccaacacuu

SEQ ID NO: 93374 - RNA, 32 nt, Human
caugguggcucacaccuguaaucccaacccuu

SEQ ID NO: 93375 - RNA, 32 nt, Human
caugguggcucacaccuguaaucccaauacug

SEQ ID NO: 93376 - RNA, 32 nt, Human
caugguggcucacaccuguaaucccagcacuu

SEQ ID NO: 93377 - RNA, 32 nt, Human
caugguggcucacaccuguaaucccagcauuu

SEQ ID NO: 93378 - RNA, 32 nt, Human
caugguggcucacaccuguaaucccaguacuu

SEQ ID NO: 93379 - RNA, 32 nt, Human
caugguggcucacaccuguaauccuagcacgu

SEQ ID NO: 93380 - RNA, 32 nt, Human
caugguggcucacaccuguaaucucagcacuc

SEQ ID NO: 93381 - RNA, 32 nt, Human
caugguggcucacaccuguaauuccagcacuu

SEQ ID NO: 93382 - RNA, 32 nt, Human
caugguggcucacaccuguaauucuagcacuu

SEQ ID NO: 93383 - RNA, 32 nt, Human
caugguggcucacaccuguaauuucagcaccu

SEQ ID NO: 93384 - RNA, 23 nt, Human
caugguggcucacaccugugauc

SEQ ID NO: 93385 - RNA, 32 nt, Human
caugguggcucacaccugugaucucagcaccu

SEQ ID NO: 93386 - RNA, 32 nt, Human
caugguggcucacaccugugcucccagcacuu

SEQ ID NO: 93387 - RNA, 32 nt, Human
caugguggcucacaccuguggucucagccucc

SEQ ID NO: 93388 - RNA, 23 nt, Human
caugguggcucacacguguaauc

SEQ ID NO: 93389 - RNA, 32 nt, Human
caugguggcucacacguguaaucccaacacuu

SEQ ID NO: 93390 - RNA, 23 nt, Human
caugguggcucacacuuauaauc

SEQ ID NO: 93391 - RNA, 32 nt, Human
caugguggcucacacuuauaaucccagcacuu

SEQ ID NO: 93392 - RNA, 32 nt, Human
caugguggcucacaucuguaaucccagcacuu

SEQ ID NO: 93393 - RNA, 20 nt, Human
caugguggcucaccccugua

SEQ ID NO: 93394 - RNA, 21 nt, Human
caugguggcucaccccuguaa

SEQ ID NO: 93395 - RNA, 24 nt, Human
caugguggcucaccccuguaaccc

SEQ ID NO: 93396 - RNA, 23 nt, Human
caugguggcucacgcccguaauc

SEQ ID NO: 93397 - RNA, 24 nt, Human
caugguggcucacgcccguaaucc

SEQ ID NO: 93398 - RNA, 32 nt, Human
caugguggcucacgcccguaaucccagggcuu

SEQ ID NO: 93399 - RNA, 32 nt, Human
caugguggcucacgccuauaaucccagcacuu

SEQ ID NO: 93400 - RNA, 24 nt, Human
caugguggcucacgccugaaaucc

SEQ ID NO: 93401 - RNA, 32 nt, Human
caugguggcucacgccugaaaucccagcacuu

SEQ ID NO: 93402 - RNA, 21 nt, Human
caugguggcucacgccuguaa

SEQ ID NO: 93403 - RNA, 24 nt, Human
caugguggcucacgccuguaaccc

SEQ ID NO: 93404 - RNA, 23 nt, Human
caugguggcucacgccuguaauc

SEQ ID NO: 93405 - RNA, 32 nt, Human
caugguggcucacgccuguaaucacagcacuu

SEQ ID NO: 93406 - RNA, 24 nt, Human
caugguggcucacgccuguaaucc

SEQ ID NO: 93407 - RNA, 32 nt, Human
caugguggcucacgccuguaaucccaacacuu

SEQ ID NO: 93408 - RNA, 32 nt, Human
caugguggcucacgccuguaaucccagaacua

SEQ ID NO: 93409 - RNA, 32 nt, Human
caugguggcucacgccuguaaucccagcacug

SEQ ID NO: 93410 - RNA, 32 nt, Human
caugguggcucacgccuguaaucccagcacuu

SEQ ID NO: 93411 - RNA, 32 nt, Human
caugguggcucacgccuguaaucccagcuacu

SEQ ID NO: 93412 - RNA, 32 nt, Human
caugguggcucacgccuguaaucccaguacuu

SEQ ID NO: 93413 - RNA, 32 nt, Human
caugguggcucacgccuguaaucccuuagcua

SEQ ID NO: 93414 - RNA, 32 nt, Human
caugguggcucacgccuguaauccuagcacuu

SEQ ID NO: 93415 - RNA, 32 nt, Human
caugguggcucacgccuguaauccuagcauuu

SEQ ID NO: 93416 - RNA, 32 nt, Human
caugguggcucacgccuguaauccuagcccuu

SEQ ID NO: 93417 - RNA, 32 nt, Human
caugguggcucacgccuguaauccuggcacuu

SEQ ID NO: 93418 - RNA, 24 nt, Human
caugguggcucacgccuguaaucu

SEQ ID NO: 93419 - RNA, 32 nt, Human
caugguggcucacgccuguaaucucagcacuu

SEQ ID NO: 93420 - RNA, 32 nt, Human
caugguggcucacgccuguaauuccagugcuu

SEQ ID NO: 93421 - RNA, 24 nt, Human
caugguggcucacgccuguagucc

SEQ ID NO: 93422 - RNA, 24 nt, Human
caugguggcucacgccugugaucc

SEQ ID NO: 93423 - RNA, 24 nt, Human
caugguggcucacgccuguggucc

SEQ ID NO: 93424 - RNA, 24 nt, Human
caugguggcucacgcuuguaaucc

SEQ ID NO: 93425 - RNA, 32 nt, Human
caugguggcucacgcuuguaaucccagcacuu

SEQ ID NO: 93426 - RNA, 32 nt, Human
caugguggcucacgcuuguaaucccagcuacu

SEQ ID NO: 93427 - RNA, 32 nt, Human
caugguggcucacggcuguaaucccagcacuu

SEQ ID NO: 93428 - RNA, 32 nt, Human
caugguggcucacgucuguaaucccaggacuu

SEQ ID NO: 93429 - RNA, 24 nt, Human
caugguggcucacuccuguagucc

SEQ ID NO: 93430 - RNA, 24 nt, Human
caugguggcucaggccuguaaucc

SEQ ID NO: 93431 - RNA, 32 nt, Human
caugguggcucaggccuguaaucccagcauuu

SEQ ID NO: 93432 - RNA, 32 nt, Human
caugguggcucaggccuguaaucccagcuacu

SEQ ID NO: 93433 - RNA, 24 nt, Human
caugguggcucauaccuguaaucc

SEQ ID NO: 93434 - RNA, 32 nt, Human
caugguggcucauaccuguaaucccagcaauu

SEQ ID NO: 93435 - RNA, 32 nt, Human
caugguggcucauaccuguaaucccagcacuu

SEQ ID NO: 93436 - RNA, 32 nt, Human
caugguggcucauaccuguaauccuagcacuc

SEQ ID NO: 93437 - RNA, 24 nt, Human
caugguggcucauaccuguacucc

SEQ ID NO: 93438 - RNA, 24 nt, Human
caugguggcucaugccuauaaucc

SEQ ID NO: 93439 - RNA, 32 nt, Human
caugguggcucaugccuauaaucccagcacuu

SEQ ID NO: 93440 - RNA, 32 nt, Human
caugguggcucaugccuauaaucccagugcuu

SEQ ID NO: 93441 - RNA, 24 nt, Human
caugguggcucaugccuauauucc

SEQ ID NO: 93442 - RNA, 24 nt, Human
caugguggcucaugccuauuaucc

SEQ ID NO: 93443 - RNA, 24 nt, Human
caugguggcucaugccuccaaucc

SEQ ID NO: 93444 - RNA, 24 nt, Human
caugguggcucaugccuguaaacc

SEQ ID NO: 93445 - RNA, 24 nt, Human
caugguggcucaugccuguaaucc

SEQ ID NO: 93446 - RNA, 32 nt, Human
caugguggcucaugccuguaaucccaacacuu

SEQ ID NO: 93447 - RNA, 32 nt, Human
caugguggcucaugccuguaaucccaccacuu

SEQ ID NO: 93448 - RNA, 32 nt, Human
caugguggcucaugccuguaaucccagcacau

SEQ ID NO: 93449 - RNA, 32 nt, Human
caugguggcucaugccuguaaucccagcacuc

SEQ ID NO: 93450 - RNA, 32 nt, Human
caugguggcucaugccuguaaucccagcacuu

SEQ ID NO: 93451 - RNA, 32 nt, Human
caugguggcucaugccuguaaucccagcauuu

SEQ ID NO: 93452 - RNA, 32 nt, Human
caugguggcucaugccuguaaucccaguacuu

SEQ ID NO: 93453 - RNA, 32 nt, Human
caugguggcucaugccuguaauccuagcacuu

SEQ ID NO: 93454 - RNA, 32 nt, Human
caugguggcucaugccuguaauccuagcaggu

SEQ ID NO: 93455 - RNA, 24 nt, Human
caugguggcucaugccuguaaucu

SEQ ID NO: 93456 - RNA, 32 nt, Human
caugguggcucaugccuguaaucucagcacuu

SEQ ID NO: 93457 - RNA, 32 nt, Human
caugguggcucaugccuguaauuccagcacuu

SEQ ID NO: 93458 - RNA, 32 nt, Human
caugguggcucaugccuguaauuccggcacuu

SEQ ID NO: 93459 - RNA, 24 nt, Human
caugguggcucaugccuguagucc

SEQ ID NO: 93460 - RNA, 24 nt, Human
caugguggcucaugccugugaucc

SEQ ID NO: 93461 - RNA, 24 nt, Human
caugguggcucaugccuguggucc

SEQ ID NO: 93462 - RNA, 24 nt, Human
caugguggcucaugcuuguaaucc

SEQ ID NO: 93463 - RNA, 32 nt, Human
caugguggcucauguuuguaauccuagcacuu

SEQ ID NO: 93464 - RNA, 24 nt, Human
caugguggcucccgccuguaaucc

SEQ ID NO: 93465 - RNA, 32 nt, Human
caugguggcucccgccuguaaucccaguacuu

SEQ ID NO: 93466 - RNA, 24 nt, Human
caugguggcucgugccuguaaucc

SEQ ID NO: 93467 - RNA, 24 nt, Human
caugguggcugacgccuguaaucc

SEQ ID NO: 93468 - RNA, 32 nt, Human
caugguggcugacgccuguaaucccagcacuu

SEQ ID NO: 93469 - RNA, 32 nt, Human
caugguggcuggugucuguaaucccagcugug

SEQ ID NO: 93470 - RNA, 23 nt, Human
caugguggcuuacaccuguaauc

SEQ ID NO: 93471 - RNA, 24 nt, Human
caugguggcuuacaccuguaaucc

SEQ ID NO: 93472 - RNA, 24 nt, Human
caugguggcuuacaucuguaaucc

SEQ ID NO: 93473 - RNA, 32 nt, Human
caugguggcuuacaucuguaaucccagcacuu

SEQ ID NO: 93474 - RNA, 24 nt, Human
caugguggcuuacgccuguaaucc

SEQ ID NO: 93475 - RNA, 32 nt, Human
caugguggcuuacgccuguaaucccagcacuu

SEQ ID NO: 93476 - RNA, 32 nt, Human
caugguggcuuacgccuguaaucccaggacuu

SEQ ID NO: 93477 - RNA, 32 nt, Human
caugguggcuuacgccuguaauccuagcacuu

SEQ ID NO: 93478 - RNA, 24 nt, Human
caugguggcuuaugccuguaaucc

SEQ ID NO: 93479 - RNA, 32 nt, Human
caugguggcuuaugccuguaaucccagcacuu

SEQ ID NO: 93480 - RNA, 24 nt, Human
caugguggcuugcaccuguaaucc

SEQ ID NO: 93481 - RNA, 32 nt, Human
caugguggcuugcaccuguaaucccagcacuu

SEQ ID NO: 93482 - RNA, 32 nt, Human
cauggugggaggauggguugagcacaggaguc

SEQ ID NO: 93483 - RNA, 32 nt, Human
cauggugggaggcaccuguaaucccagcuacu

SEQ ID NO: 93484 - RNA, 32 nt, Human
cauggugggcacugaggcacagaggaggccaa

SEQ ID NO: 93485 - RNA, 32 nt, Human
cauggugggcuugugguggcugcuccaugagg

SEQ ID NO: 93486 - RNA, 32 nt, Human
caugguggguugugccuguaaucccagcuacu

SEQ ID NO: 93487 - RNA, 24 nt, Human
cauggugguacacaccuguaaucc

SEQ ID NO: 93488 - RNA, 24 nt, Human
cauggugguacacaccuguagucc

SEQ ID NO: 93489 - RNA, 24 nt, Human
cauggugguacacgccuguagucc

SEQ ID NO: 93490 - RNA, 32 nt, Human
cauggugguagaugccuguaauuccagcuacu

SEQ ID NO: 93491 - RNA, 32 nt, Human
cauggugguaggugccuguaaucccagcuacu

SEQ ID NO: 93492 - RNA, 32 nt, Human
cauggugguccacaccugcagucccaguuacc

SEQ ID NO: 93493 - RNA, 32 nt, Human
caugguggugagcaccuguaaucccagcuacu

SEQ ID NO: 93494 - RNA, 32 nt, Human
caugguggugagccccuguaaucccagcuacu

SEQ ID NO: 93495 - RNA, 32 nt, Human
caugguggugagugccuguaaucccagcuacu

SEQ ID NO: 93496 - RNA, 32 nt, Human
caugguggugagugccuguaaucucaguuacu

SEQ ID NO: 93497 - RNA, 21 nt, Human
caugguggugauguccaaaag

SEQ ID NO: 93498 - RNA, 32 nt, Human
caugguggugcacaccugcauucccagcuacu

SEQ ID NO: 93499 - RNA, 24 nt, Human
caugguggugcacaccuguaaucc

SEQ ID NO: 93500 - RNA, 32 nt, Human
caugguggugcacaccuguaaucccaguuacu

SEQ ID NO: 93501 - RNA, 32 nt, Human
caugguggugcacaccuguacucccagcuacu

SEQ ID NO: 93502 - RNA, 24 nt, Human
caugguggugcacaccuguagucc

SEQ ID NO: 93503 - RNA, 32 nt, Human
caugguggugcacaccuguaguccuagcuucu

SEQ ID NO: 93504 - RNA, 32 nt, Human
caugguggugcacaccuguugucccagcuauu

SEQ ID NO: 93505 - RNA, 24 nt, Human
caugguggugcacgccuauagucc

SEQ ID NO: 93506 - RNA, 24 nt, Human
caugguggugcacgccuguagucc

SEQ ID NO: 93507 - RNA, 24 nt, Human
caugguggugcauaccuguagucc

SEQ ID NO: 93508 - RNA, 32 nt, Human
caugguggugcaugccuauaaucccagcuacu

SEQ ID NO: 93509 - RNA, 32 nt, Human
caugguggugcaugccugcaaucccagcuacu

SEQ ID NO: 93510 - RNA, 24 nt, Human
caugguggugcaugccuguaaucc

SEQ ID NO: 93511 - RNA, 32 nt, Human
caugguggugcaugccuguaaucccagcuacu

SEQ ID NO: 93512 - RNA, 32 nt, Human
caugguggugcaugccuguaaucccagcuauu

SEQ ID NO: 93513 - RNA, 32 nt, Human
caugguggugcaugccuguaaucccagcugcu

SEQ ID NO: 93514 - RNA, 32 nt, Human
caugguggugcaugccuguaaucucagcuacu

SEQ ID NO: 93515 - RNA, 32 nt, Human
caugguggugcaugccuguaaucucagcugcu

SEQ ID NO: 93516 - RNA, 32 nt, Human
caugguggugcaugccuguaauuccagcggcu

SEQ ID NO: 93517 - RNA, 24 nt, Human
caugguggugcaugccuguagucc

SEQ ID NO: 93518 - RNA, 32 nt, Human
caugguggugcgagccuguaauuccagcuacu

SEQ ID NO: 93519 - RNA, 32 nt, Human
caugguggugcgcguguguaaucccagcuacu

SEQ ID NO: 93520 - RNA, 32 nt, Human
caugguggugcgugccuguaaucccagcuacu

SEQ ID NO: 93521 - RNA, 32 nt, Human
caugguggugcucgccuguaaucccagcuacu

SEQ ID NO: 93522 - RNA, 32 nt, Human
cauggugguggacaccuguaaucccagcuacu

SEQ ID NO: 93523 - RNA, 32 nt, Human
cauggugguggacgccuguaaucccagcuacu

SEQ ID NO: 93524 - RNA, 32 nt, Human
cauggugguggaugccuauaaucccagcuacu

SEQ ID NO: 93525 - RNA, 32 nt, Human
caugguggugggcaccuguaaucccagcuacu

SEQ ID NO: 93526 - RNA, 32 nt, Human
caugguggugggcgccuauaaucccagcuauu

SEQ ID NO: 93527 - RNA, 32 nt, Human
caugguggugggcgccuguaaucccagcuacu

SEQ ID NO: 93528 - RNA, 32 nt, Human
caugguggugggcgccuguaaucccaguuacu

SEQ ID NO: 93529 - RNA, 32 nt, Human
caugguggugggcgccuguaauuccagcuacu

SEQ ID NO: 93530 - RNA, 32 nt, Human
cauggugguggguaccuauaaucccagcuacu

SEQ ID NO: 93531 - RNA, 32 nt, Human
cauggugguggguaccuguaaucccagcuacu

SEQ ID NO: 93532 - RNA, 32 nt, Human
cauggugguggguaccuguaaucccaguuacu

SEQ ID NO: 93533 - RNA, 32 nt, Human
caugguggugggugccuguaaucccagcuacu

SEQ ID NO: 93534 - RNA, 32 nt, Human
caugguggugggugccuguaaucccagcuucu

SEQ ID NO: 93535 - RNA, 24 nt, Human
cauggugguguacgccuguaaucc

SEQ ID NO: 93536 - RNA, 32 nt, Human
cauggugguguacgccuguaaucccagugacu

SEQ ID NO: 93537 - RNA, 24 nt, Human
cauggugguguaugccuguagucc

SEQ ID NO: 93538 - RNA, 32 nt, Human
caugguggugucuggccugaccccagaagaau

SEQ ID NO: 93539 - RNA, 32 nt, Human
caugguggugugagucuguggucccagcuauc

SEQ ID NO: 93540 - RNA, 32 nt, Human
caugguggugugcaccuguaaucccagcuacu

SEQ ID NO: 93541 - RNA, 32 nt, Human
caugguggugugcaccuguagucccagcuacu

SEQ ID NO: 93542 - RNA, 32 nt, Human
caugguggugugcaccuguagucccaguuagg

SEQ ID NO: 93543 - RNA, 32 nt, Human
caugguggugugcgcaccuguagucccagcua

SEQ ID NO: 93544 - RNA, 32 nt, Human
caugguggugugcgccuguaaucccagcuacu

SEQ ID NO: 93545 - RNA, 32 nt, Human
caugguggugugugccuguaaucccagcuacu

SEQ ID NO: 93546 - RNA, 32 nt, Human
caugguggugugugccuguaaucccggcuacu

SEQ ID NO: 93547 - RNA, 32 nt, Human
caugguggugugugccuguaaugccagcuacu

SEQ ID NO: 93548 - RNA, 32 nt, Human
cauggugguucacaccucuaaucccugcacuu

SEQ ID NO: 93549 - RNA, 32 nt, Human
cauggugguucacaccuguaaucccggcacuu

SEQ ID NO: 93550 - RNA, 32 nt, Human
cauggugguucacaccuguaauccuagcaguu

SEQ ID NO: 93551 - RNA, 24 nt, Human
cauggugguucaugccuguaaucc

SEQ ID NO: 93552 - RNA, 32 nt, Human
cauggugguucaugccuguaaucccagcacuu

SEQ ID NO: 93553 - RNA, 24 nt, Human
cauggugguuuacaccuauaaucc

SEQ ID NO: 93554 - RNA, 32 nt, Human
cauggugguuuacgccuauaaucccagcauuu

SEQ ID NO: 93555 - RNA, 24 nt, Human
caugguguaaccccaucucuacua

SEQ ID NO: 93556 - RNA, 32 nt, Human
caugguguauaugugccacauugucuuuaucc

SEQ ID NO: 93557 - RNA, 32 nt, Human
caugguguauaugugccacauuuucuuuaucc

SEQ ID NO: 93558 - RNA, 32 nt, Human
cauggugucgcugugugccuguaucauuuggc

SEQ ID NO: 93559 - RNA, 32 nt, Human
cauggugucucacacguuuaaucccagcacuu

SEQ ID NO: 93560 - RNA, 32 nt, Human
cauggugugcuggcuuaaaauguaauuaaucu

SEQ ID NO: 93561 - RNA, 32 nt, Human
cauggugugugauggcacggcccacacugggu

SEQ ID NO: 93562 - RNA, 32 nt, Human
caugguguuaauucuccuccaggcagauaucu

SEQ ID NO: 93563 - RNA, 32 nt, Human
caugguguuagaaaucauagcugcggagaagc

SEQ ID NO: 93564 - RNA, 32 nt, Human
caugguuacauacuaauugcugcagcucugug

SEQ ID NO: 93565 - RNA, 32 nt, Human
caugguucacugcaaucucgacuuccaguuuc

SEQ ID NO: 93566 - RNA, 26 nt, Human
caugguucacugcagccucagccucc

SEQ ID NO: 93567 - RNA, 32 nt, Human
caugguucacugcagucuugaccucccaggcu

SEQ ID NO: 93568 - RNA, 32 nt, Human
caugguucacugcagucuugaccuuuugggcu

SEQ ID NO: 93569 - RNA, 32 nt, Human
caugguucauaacauugcaugccauuauuagc

SEQ ID NO: 93570 - RNA, 32 nt, Human
caugguucccacccuccacguuauuuucccuu

SEQ ID NO: 93571 - RNA, 32 nt, Human
caugguuccccaggcuguacaggaagcaugac

SEQ ID NO: 93572 - RNA, 32 nt, Human
caugguuccuccaggcccucuucagucaugac

SEQ ID NO: 93573 - RNA, 32 nt, Human
caugguuccuuucuuaaagaaaucuuccaugu

SEQ ID NO: 93574 - RNA, 32 nt, Human
caugguucugcaggcuguacaggaagcauaau

SEQ ID NO: 93575 - RNA, 32 nt, Human
caugguucuuagaagccaccccuuccccaggc

SEQ ID NO: 93576 - RNA, 25 nt, Human
caugguugaaaccccaucucuacua

SEQ ID NO: 93577 - RNA, 32 nt, Human
caugguugaaucugaaacccuccuucuguggc

SEQ ID NO: 93578 - RNA, 32 nt, Human
caugguugcaccacuacacuguagccugggug

SEQ ID NO: 93579 - RNA, 32 nt, Human
caugguugcaccacugcucuccaggcuugagu

SEQ ID NO: 93580 - RNA, 17 nt, Human
caugguugcagcugcca

SEQ ID NO: 93581 - RNA, 32 nt, Human
caugguugcucacaccuguaucccagcacuuu

SEQ ID NO: 93582 - RNA, 32 nt, Human
caugguuggucugcuucccucacucgggcucc

SEQ ID NO: 93583 - RNA, 32 nt, Human
caugguuguaaaacauaauaaaaccucccacg

SEQ ID NO: 93584 - RNA, 32 nt, Human
caugguuguaaguuuccugaggccucccaguc

SEQ ID NO: 93585 - RNA, 23 nt, Human
caugguuguagcaagugugagga

SEQ ID NO: 93586 - RNA, 32 nt, Human
caugguuguccacccuggggguuuuuccucug

SEQ ID NO: 93587 - RNA, 23 nt, Human
caugguuuccagugcagcgcgga

SEQ ID NO: 93588 - RNA, 32 nt, Human
caugguuugcauccugcacaggcacaagcagc

SEQ ID NO: 93589 - RNA, 32 nt, Human
caugguuuuauugcuuguuucucuccaggaua

SEQ ID NO: 93590 - RNA, 32 nt, Human
caugguuuuuccugccaaaccagaggcaccuu

SEQ ID NO: 93591 - RNA, 32 nt, Human
cauguaaaaauaugugcacauauggauguaug

SEQ ID NO: 93592 - RNA, 32 nt, Human
cauguaaaacuaauguaucaaaauuagcauau

SEQ ID NO: 93593 - RNA, 32 nt, Human
cauguaaacaaagacaugggauuuucugacgu

SEQ ID NO: 93594 - RNA, 32 nt, Human
cauguaaacuauugaaacuauuguaauccauu

SEQ ID NO: 93595 - RNA, 32 nt, Human
cauguaaagcacaaaguauguuucaguuuaaa

SEQ ID NO: 93596 - RNA, 32 nt, Human
cauguaaaguuuccuuucauccugccuagcca

SEQ ID NO: 93597 - RNA, 29 nt, Human
cauguaaauaaauacauucuuggaggagc

SEQ ID NO: 93598 - RNA, 32 nt, Human
cauguaaauuucccagaaguuguugagcucaa

SEQ ID NO: 93599 - RNA, 32 nt, Human
cauguaacaaaccugcacaugugggcugggcg

SEQ ID NO: 93600 - RNA, 32 nt, Human
cauguaacaaaccugugcauguaccccuugaa

SEQ ID NO: 93601 - RNA, 32 nt, Human
cauguaacaaauucaggccaaagagaggcaau

SEQ ID NO: 93602 - RNA, 32 nt, Human
cauguaacagaacagacccaggacagggaaaa

SEQ ID NO: 93603 - RNA, 32 nt, Human
cauguaaccauggugaaggccacugggggauu

SEQ ID NO: 93604 - RNA, 32 nt, Human
cauguaacuaaccugcacauugugcacaugua

SEQ ID NO: 93605 - RNA, 19 nt, Human
cauguaacucugcuucgaa

SEQ ID NO: 93606 - RNA, 32 nt, Human
cauguaagaagugccuuucaucuccugccaug

SEQ ID NO: 93607 - RNA, 32 nt, Human
cauguaagaagugccuuucgccuucagccaug

SEQ ID NO: 93608 - RNA, 32 nt, Human
cauguaagagugagacuggauggagagacugg

SEQ ID NO: 93609 - RNA, 32 nt, Human
cauguaagagugagggagggaaggaaggaacu

SEQ ID NO: 93610 - RNA, 32 nt, Human
cauguaaguacauacacacaugcgccugcagc

SEQ ID NO: 93611 - RNA, 32 nt, Human
cauguaaucacugggcugggugcaguggcuca

SEQ ID NO: 93612 - RNA, 32 nt, Human
cauguaaucccaccuacucagaagacugaggc

SEQ ID NO: 93613 - RNA, 32 nt, Human
cauguaaucccagcuacucgggaggcugaggc

SEQ ID NO: 93614 - RNA, 32 nt, Human
cauguaaucccagcuacuugggaggcugaggu

SEQ ID NO: 93615 - RNA, 32 nt, Human
cauguaaucucccaacaccccaugaagcaagg

SEQ ID NO: 93616 - RNA, 32 nt, Human
cauguaauguauuauauggggucugggcucca

SEQ ID NO: 93617 - RNA, 32 nt, Human
cauguaauucagguaccacguauuccagggag

SEQ ID NO: 93618 - RNA, 32 nt, Human
cauguaauucuuccucuauaaagaauagguau

SEQ ID NO: 93619 - RNA, 32 nt, Human
cauguacaaagaagacagggcaugaagguguc

SEQ ID NO: 93620 - RNA, 32 nt, Human
cauguacaacagcauccaacauaucugucuug

SEQ ID NO: 93621 - RNA, 32 nt, Human
cauguacagaacuuugucuacagcacaaauua

SEQ ID NO: 93622 - RNA, 32 nt, Human
cauguacagagguuuuucugugguuguaaaug

SEQ ID NO: 93623 - RNA, 32 nt, Human
cauguaccaagaagaaggaggaggaggcaccu

SEQ ID NO: 93624 - RNA, 32 nt, Human
cauguaccacagguuccugaauaauuccugca

SEQ ID NO: 93625 - RNA, 32 nt, Human
cauguaccauguuuuuauuauuucuauuuuua

SEQ ID NO: 93626 - RNA, 32 nt, Human
cauguacccuggggcacccucuuguacuucac

SEQ ID NO: 93627 - RNA, 32 nt, Human
cauguaccugcucuucuguuugcacacccagc

SEQ ID NO: 93628 - RNA, 32 nt, Human
cauguaccuucauuugcuuagcuauuugagua

SEQ ID NO: 93629 - RNA, 32 nt, Human
cauguacgcaccacaaacacaugcgcaggcuc

SEQ ID NO: 93630 - RNA, 32 nt, Human
cauguacuacugcacuugagcaugaaugggua

SEQ ID NO: 93631 - RNA, 32 nt, Human
cauguacuccagccucccuugagacaacauuu

SEQ ID NO: 93632 - RNA, 32 nt, Human
cauguacuguauauuaccuggugauaguugcu

SEQ ID NO: 93633 - RNA, 32 nt, Human
cauguacuugacuucuugacgcauggcugacc

SEQ ID NO: 93634 - RNA, 32 nt, Human
cauguagaagagggagaaggagaggcucugaa

SEQ ID NO: 93635 - RNA, 32 nt, Human
cauguagacacaaacauauacacagacgugua

SEQ ID NO: 93636 - RNA, 19 nt, Human
cauguagauagcacaagua

SEQ ID NO: 93637 - RNA, 32 nt, Human
cauguagaucaauuugaugaaagcacuaggua

SEQ ID NO: 93638 - RNA, 32 nt, Human
cauguagaugagcgcaguccugggcuuucggu

SEQ ID NO: 93639 - RNA, 32 nt, Human
cauguagauguggaggaggggaagggaagacc

SEQ ID NO: 93640 - RNA, 20 nt, Human
cauguagccccuugcugcca

SEQ ID NO: 93641 - RNA, 32 nt, Human
cauguagcccuaucgaggagaugauguagggg

SEQ ID NO: 93642 - RNA, 32 nt, Human
cauguagcccucucauuugauugacaguauuu

SEQ ID NO: 93643 - RNA, 32 nt, Human
cauguagccgcugagaccugcuguuucugcug

SEQ ID NO: 93644 - RNA, 32 nt, Human
cauguagcugugcagcucugcagaucuaaaau

SEQ ID NO: 93645 - RNA, 32 nt, Human
cauguaggaaagaagacacaggcugagccccg

SEQ ID NO: 93646 - RNA, 32 nt, Human
cauguaggacucaagugacuaccagucccugu

SEQ ID NO: 93647 - RNA, 32 nt, Human
cauguaggcugugcgcugcauaacuccaggga

SEQ ID NO: 93648 - RNA, 32 nt, Human
cauguagggcaggccuucuauaagugcgggca

SEQ ID NO: 93649 - RNA, 32 nt, Human
cauguagggucuucaugucuuuucucugacuu

SEQ ID NO: 93650 - RNA, 32 nt, Human
cauguaggugugugugcaugcauacauaugcc

SEQ ID NO: 93651 - RNA, 32 nt, Human
cauguagucccaccuacucaggaggcugagga

SEQ ID NO: 93652 - RNA, 32 nt, Human
cauguagucccagcuacucgggaggcugaggc

SEQ ID NO: 93653 - RNA, 32 nt, Human
cauguaguccuagcuacucggaaggcugaggc

SEQ ID NO: 93654 - RNA, 32 nt, Human
cauguaguuaacuccauugauuuuccuaucuu

SEQ ID NO: 93655 - RNA, 32 nt, Human
cauguaguuccagcuacucaggaggcugaggc

SEQ ID NO: 93656 - RNA, 32 nt, Human
cauguaguugaauuucaguccuuacggguaaa

SEQ ID NO: 93657 - RNA, 32 nt, Human
cauguauaaugugccccaaaugcagcuucauu

SEQ ID NO: 93658 - RNA, 32 nt, Human
cauguauacauuuugaaaauauacaaaacaac

SEQ ID NO: 93659 - RNA, 32 nt, Human
cauguauaugugcacacacauguauauguaua

SEQ ID NO: 93660 - RNA, 32 nt, Human
cauguauauuuccacauuuuugugcuuggaua

SEQ ID NO: 93661 - RNA, 32 nt, Human
cauguaucaccacuucugugauuucaucaauc

SEQ ID NO: 93662 - RNA, 32 nt, Human
cauguaucuaugcauuuucuggacccguucaa

SEQ ID NO: 93663 - RNA, 32 nt, Human
cauguaucugcgcagcucugguacccucugug

SEQ ID NO: 93664 - RNA, 32 nt, Human
cauguaucuguaagaucagccuuucccaaggu

SEQ ID NO: 93665 - RNA, 32 nt, Human
cauguaugcaugcacaaacauguguguacaug

SEQ ID NO: 93666 - RNA, 19 nt, Human
cauguaugcucaucgggga

SEQ ID NO: 93667 - RNA, 32 nt, Human
cauguaugggcaggaggaaaggugggaggggg

SEQ ID NO: 93668 - RNA, 30 nt, Human
cauguauggggugggacugcagaaggacca

SEQ ID NO: 93669 - RNA, 32 nt, Human
cauguauuaccugaauuuuggcugugucuccc

SEQ ID NO: 93670 - RNA, 32 nt, Human
cauguauuauuucauuauguaaaauguuuuag

SEQ ID NO: 93671 - RNA, 23 nt, Human
cauguauuuaaaucauugcuaua

SEQ ID NO: 93672 - RNA, 32 nt, Human
cauguauuuucaacuugucuucccugguauau

SEQ ID NO: 93673 - RNA, 18 nt, Human
caugucaaguagcaggug

SEQ ID NO: 93674 - RNA, 32 nt, Human
caugucaaguccagccccagacugacuuucug

SEQ ID NO: 93675 - RNA, 32 nt, Human
caugucacaaauuuaguaaguuacauguguua

SEQ ID NO: 93676 - RNA, 32 nt, Human
caugucacaagaggagcacaggcagggguguu

SEQ ID NO: 93677 - RNA, 32 nt, Human
caugucaccacugcccucacagucgaggccuu

SEQ ID NO: 93678 - RNA, 32 nt, Human
caugucacccacccagccuuuuacaccuggga

SEQ ID NO: 93679 - RNA, 32 nt, Human
caugucaccgcuucugaaacaugugaauauua

SEQ ID NO: 93680 - RNA, 32 nt, Human
caugucaccucacuccaaaugccaggcuuuuc

SEQ ID NO: 93681 - RNA, 32 nt, Human
caugucacgauuccgucgcauccucugccauu

SEQ ID NO: 93682 - RNA, 32 nt, Human
caugucacggcaaccuccgccucccagguuca

SEQ ID NO: 93683 - RNA, 32 nt, Human
caugucacugauugcauuccagccugggugac

SEQ ID NO: 93684 - RNA, 32 nt, Human
caugucacugcacuccagccugggugacagag

SEQ ID NO: 93685 - RNA, 32 nt, Human
caugucacugcacucuagcuugggagacagag

SEQ ID NO: 93686 - RNA, 32 nt, Human
caugucacuguacuccagccugggcaacagag

SEQ ID NO: 93687 - RNA, 32 nt, Human
caugucacuguguacagcuggccacacacagg

SEQ ID NO: 93688 - RNA, 32 nt, Human
caugucagaggaccccagggugguuagaggaa

SEQ ID NO: 93689 - RNA, 32 nt, Human
caugucagagguggggcucagcaggaaguggg

SEQ ID NO: 93690 - RNA, 32 nt, Human
caugucagcagaguggcgccugccugugcugg

SEQ ID NO: 93691 - RNA, 32 nt, Human
caugucagccuccugaguagcuggaaccacag

SEQ ID NO: 93692 - RNA, 32 nt, Human
caugucaggaggacuccucugcacaacaucac

SEQ ID NO: 93693 - RNA, 19 nt, Human
caugucagucccuguucug

SEQ ID NO: 93694 - RNA, 32 nt, Human
caugucagugaaaaauaauuacccacaaaugc

SEQ ID NO: 93695 - RNA, 32 nt, Human
caugucaguguguguauucuguauguaaauau

SEQ ID NO: 93696 - RNA, 19 nt, Human
caugucaguuugucacuca

SEQ ID NO: 93697 - RNA, 32 nt, Human
caugucaucgacagcacagaagggcuguccug

SEQ ID NO: 93698 - RNA, 32 nt, Human
caugucauggaugccugugccaccccaggcaa

SEQ ID NO: 93699 - RNA, 31 nt, Human
caugucauggccgccuccauggcccggggag

SEQ ID NO: 93700 - RNA, 32 nt, Human
caugucauugcacucuagucugggugacaaga

SEQ ID NO: 93701 - RNA, 26 nt, Human
cauguccacauccccagugcuugcgg

SEQ ID NO: 93702 - RNA, 32 nt, Human
cauguccacuggccugccagcauccgccagug

SEQ ID NO: 93703 - RNA, 32 nt, Human
cauguccagcauaggcaggauugcucgguggu

SEQ ID NO: 93704 - RNA, 32 nt, Human
cauguccagggggaugauggagagcuguccaa

SEQ ID NO: 93705 - RNA, 32 nt, Human
cauguccaucuagaaccugggaaugugacuuu

SEQ ID NO: 93706 - RNA, 32 nt, Human
cauguccaucuucuauuaccagcacuuacaag

SEQ ID NO: 93707 - RNA, 32 nt, Human
cauguccaugaggaaauggggagaagaauaua

SEQ ID NO: 93708 - RNA, 32 nt, Human
caugucccacucuuggauuagcaggggugggu

SEQ ID NO: 93709 - RNA, 32 nt, Human
caugucccagaacuuagccuuuaccugugaag

SEQ ID NO: 93710 - RNA, 32 nt, Human
caugucccaucacguguacuggcuccucugug

SEQ ID NO: 93711 - RNA, 32 nt, Human
caugucccaucuucagcaucccucccaccaac

SEQ ID NO: 93712 - RNA, 32 nt, Human
cauguccccaggaauggaaguggacccuaguu

SEQ ID NO: 93713 - RNA, 32 nt, Human
cauguccccgccggcccugccccugcccucug

SEQ ID NO: 93714 - RNA, 32 nt, Human
cauguccccuccacuuccacugccaaacagcu

SEQ ID NO: 93715 - RNA, 19 nt, Human
cauguccccuuccuguucu

SEQ ID NO: 93716 - RNA, 32 nt, Human
cauguccccuuccuguucuuccuuccuagaag

SEQ ID NO: 93717 - RNA, 32 nt, Human
caugucccuccaggccucagccaccugcccgc

SEQ ID NO: 93718 - RNA, 32 nt, Human
caugucccuccagggggaccccacagccuggc

SEQ ID NO: 93719 - RNA, 32 nt, Human
caugucccuccuggauggcuucuuccagcaca

SEQ ID NO: 93720 - RNA, 32 nt, Human
caugucccugcaaaggacgugaucucauuucu

SEQ ID NO: 93721 - RNA, 32 nt, Human
caugucccugcacucuguuuugcaagaugcca

SEQ ID NO: 93722 - RNA, 32 nt, Human
caugucccuguuccucuuccccuggccagggc

SEQ ID NO: 93723 - RNA, 32 nt, Human
caugucccuuccccucucuggcccucaguuuc

SEQ ID NO: 93724 - RNA, 32 nt, Human
caugucccuuucuccucuccccucaaccucuu

SEQ ID NO: 93725 - RNA, 32 nt, Human
cauguccuaaagcacuggcugaaggaagccaa

SEQ ID NO: 93726 - RNA, 32 nt, Human
cauguccuaagcugaggcaggcggcaggcgug

SEQ ID NO: 93727 - RNA, 32 nt, Human
cauguccuauugaucagugacacugccagagg

SEQ ID NO: 93728 - RNA, 32 nt, Human
cauguccucccucgagaaacagugccgccggu

SEQ ID NO: 93729 - RNA, 32 nt, Human
cauguccucuacuugccuccggccuugaaauc

SEQ ID NO: 93730 - RNA, 32 nt, Human
cauguccucugccuucucccucuucucuugcc

SEQ ID NO: 93731 - RNA, 32 nt, Human
cauguccucuuuuaugaaacauggggauucuc

SEQ ID NO: 93732 - RNA, 21 nt, Human
cauguccugagggccuugcag

SEQ ID NO: 93733 - RNA, 32 nt, Human
cauguccugcagcugccccacuucuccuuuac

SEQ ID NO: 93734 - RNA, 32 nt, Human
cauguccuggaggugacugcagguuguuggau

SEQ ID NO: 93735 - RNA, 32 nt, Human
cauguccugggugacaugggaugugacuuucg

SEQ ID NO: 93736 - RNA, 32 nt, Human
cauguccuguaauacuucaccuccaggaacug

SEQ ID NO: 93737 - RNA, 32 nt, Human
cauguccuucaaugcccaccucaaaagguacc

SEQ ID NO: 93738 - RNA, 32 nt, Human
caugucgacccaggcucccuugugacuggagg

SEQ ID NO: 93739 - RNA, 26 nt, Human
caugucgcccucuggucgccuguguc

SEQ ID NO: 93740 - RNA, 26 nt, Human
caugucggaggccuccucugaggacc

SEQ ID NO: 93741 - RNA, 32 nt, Human
caugucgggaggcugaggugggaggaucgcuu

SEQ ID NO: 93742 - RNA, 32 nt, Human
caugucuacagcuguuugugggauguuggaaa

SEQ ID NO: 93743 - RNA, 32 nt, Human
caugucuacaucauaccuguggcuccagaagc

SEQ ID NO: 93744 - RNA, 32 nt, Human
caugucuacuaaaaauacaaaaauuaacuggg

SEQ ID NO: 93745 - RNA, 32 nt, Human
caugucuacuaaaaauacaaaaauuagcuggg

SEQ ID NO: 93746 - RNA, 32 nt, Human
caugucuacuaaaaauacaaaauuagcugggc

SEQ ID NO: 93747 - RNA, 19 nt, Human
caugucuacucugcugcca

SEQ ID NO: 93748 - RNA, 32 nt, Human
caugucuaucugucugucugucggucuguguc

SEQ ID NO: 93749 - RNA, 32 nt, Human
caugucuaugaagaagacccucgggaagcagu

SEQ ID NO: 93750 - RNA, 32 nt, Human
caugucuaugaucccagcuacuggagaggcug

SEQ ID NO: 93751 - RNA, 32 nt, Human
caugucucaaacuccugaccucaggcgaucca

SEQ ID NO: 93752 - RNA, 32 nt, Human
caugucucaccacuggcagcugggcagaagcc

SEQ ID NO: 93753 - RNA, 32 nt, Human
caugucucagccagggcuuccuuccucggcuc

SEQ ID NO: 93754 - RNA, 32 nt, Human
caugucucauucuccucaaauauuccauuugc

SEQ ID NO: 93755 - RNA, 32 nt, Human
caugucuccagccacaauauccuugcaggaca

SEQ ID NO: 93756 - RNA, 32 nt, Human
caugucuccuucuggcugccuggaaggcacau

SEQ ID NO: 93757 - RNA, 32 nt, Human
caugucuccuuucaaggucuucugggcccuga

SEQ ID NO: 93758 - RNA, 20 nt, Human
caugucucggcucacuguag

SEQ ID NO: 93759 - RNA, 24 nt, Human
caugucucuacuaaaaauacaaaa

SEQ ID NO: 93760 - RNA, 32 nt, Human
caugucucucagaauucuucagguggaaaaac

SEQ ID NO: 93761 - RNA, 32 nt, Human
caugucucucugagaaauguguuggcccaauu

SEQ ID NO: 93762 - RNA, 32 nt, Human
caugucucugcaaaugauaugaucucauuccu

SEQ ID NO: 93763 - RNA, 32 nt, Human
caugucucuugggccucuuccucucucaagau

SEQ ID NO: 93764 - RNA, 32 nt, Human
caugucugaagcuauuauauccuugaacuuuu

SEQ ID NO: 93765 - RNA, 32 nt, Human
caugucugcaaacccagcuacucgggaggcug

SEQ ID NO: 93766 - RNA, 32 nt, Human
caugucugcagccccagcuacucgggaggcug

SEQ ID NO: 93767 - RNA, 32 nt, Human
caugucugcauccccuuuccaaggcugcuucc

SEQ ID NO: 93768 - RNA, 32 nt, Human
caugucugcauggcagaagcgucucccuuggc

SEQ ID NO: 93769 - RNA, 32 nt, Human
caugucugcccagggggacugcgaguuccugg

SEQ ID NO: 93770 - RNA, 32 nt, Human
caugucugccuggagugcugugcuguguuuaa

SEQ ID NO: 93771 - RNA, 32 nt, Human
caugucugccuucacacgcugccuuauggcuu

SEQ ID NO: 93772 - RNA, 32 nt, Human
caugucugcugaugcuaucauagcucccaaca

SEQ ID NO: 93773 - RNA, 32 nt, Human
caugucuggugucugucaugccaaccuagaca

SEQ ID NO: 93774 - RNA, 22 nt, Human
caugucuguaaucccagcacuu

SEQ ID NO: 93775 - RNA, 32 nt, Human
caugucuguaaucccagcuacucgggaggcug

SEQ ID NO: 93776 - RNA, 32 nt, Human
caugucuguaaucccagcuacuggggaagcug

SEQ ID NO: 93777 - RNA, 32 nt, Human
caugucuguaaucccagcuacuggggaggcug

SEQ ID NO: 93778 - RNA, 32 nt, Human
caugucuguagucccagcuacuugggcacacg

SEQ ID NO: 93779 - RNA, 32 nt, Human
caugucuguccucagagcaggggccagaugau

SEQ ID NO: 93780 - RNA, 32 nt, Human
caugucugugaaccuggggcucuugggcagca

SEQ ID NO: 93781 - RNA, 32 nt, Human
caugucugugagcugcggaggcugcggccccc

SEQ ID NO: 93782 - RNA, 21 nt, Human
caugucuguuacucacuuuca

SEQ ID NO: 93783 - RNA, 32 nt, Human
caugucuuacauggguugcuguauuuagaauu

SEQ ID NO: 93784 - RNA, 32 nt, Human
caugucuucaagugagggaccuggagauguuc

SEQ ID NO: 93785 - RNA, 32 nt, Human
caugucuucacauuuauugucauucuaacuug

SEQ ID NO: 93786 - RNA, 32 nt, Human
caugucuuccaaaauaccagcuguuacuuauc

SEQ ID NO: 93787 - RNA, 32 nt, Human
caugucuuccuugggccaaggucucauggggg

SEQ ID NO: 93788 - RNA, 32 nt, Human
caugucuucuggcuccagcucagcuuccuaga

SEQ ID NO: 93789 - RNA, 32 nt, Human
caugucuugccgcccuuccuccauguguuugu

SEQ ID NO: 93790 - RNA, 32 nt, Human
caugucuuguucagaagacacaggggagcagg

SEQ ID NO: 93791 - RNA, 32 nt, Human
caugucuuucuccaaagccauccagaggguug

SEQ ID NO: 93792 - RNA, 32 nt, Human
caugucuuugcuguuagucaagcacaggauuu

SEQ ID NO: 93793 - RNA, 32 nt, Human
caugucuuuuaugcuauaaucauuccaaauuu

SEQ ID NO: 93794 - RNA, 32 nt, Human
caugugaaaagggugacugcuccauacaaaua

SEQ ID NO: 93795 - RNA, 32 nt, Human
caugugaaagagugauagggagagggagcgag

SEQ ID NO: 93796 - RNA, 32 nt, Human
caugugaaaugagugauaguggaagucaagug

SEQ ID NO: 93797 - RNA, 32 nt, Human
caugugaacccagcaggcuuggaaccagcuca

SEQ ID NO: 93798 - RNA, 32 nt, Human
caugugaagagggagaagcaugaaaaagcagc

SEQ ID NO: 93799 - RNA, 32 nt, Human
caugugaaggagcagaggcuggcgcuggcccu

SEQ ID NO: 93800 - RNA, 32 nt, Human
caugugaaggaggcagggguugggacaagugc

SEQ ID NO: 93801 - RNA, 32 nt, Human
caugugaauaagaagccaggaaaggaaagaug

SEQ ID NO: 93802 - RNA, 32 nt, Human
caugugaauggcuuccuaacuaaaaauacaug

SEQ ID NO: 93803 - RNA, 32 nt, Human
caugugaauuuccugauucucaggugacuaaa

SEQ ID NO: 93804 - RNA, 32 nt, Human
caugugacacucaggcuggaguggugguaagg

SEQ ID NO: 93805 - RNA, 32 nt, Human
caugugacccugagcaagucucucuccuuccc

SEQ ID NO: 93806 - RNA, 32 nt, Human
caugugaccuucaggccuucugcucuaaacug

SEQ ID NO: 93807 - RNA, 32 nt, Human
caugugacgaggacacagcagugagcagcugc

SEQ ID NO: 93808 - RNA, 32 nt, Human
caugugacugaacuuuagacagugagauauaa

SEQ ID NO: 93809 - RNA, 32 nt, Human
caugugacuggcauuuuaacagaccuuccaga

SEQ ID NO: 93810 - RNA, 32 nt, Human
caugugagacaacugcacuccagugugggcgu

SEQ ID NO: 93811 - RNA, 17 nt, Human
caugugagcugcugcca

SEQ ID NO: 93812 - RNA, 32 nt, Human
caugugaggagcccauggaaugugccuggcuu

SEQ ID NO: 93813 - RNA, 32 nt, Human
caugugaggaugugucagaaaugcagaaccuc

SEQ ID NO: 93814 - RNA, 32 nt, Human
caugugauacauuuaagccacuggaaaaaccc

SEQ ID NO: 93815 - RNA, 32 nt, Human
caugugaucccucccuccuucugaccucuuag

SEQ ID NO: 93816 - RNA, 32 nt, Human
caugugaugcagagaccagagagugaaggccc

SEQ ID NO: 93817 - RNA, 32 nt, Human
caugugauguggugcgugugaaucugugggcg

SEQ ID NO: 93818 - RNA, 32 nt, Human
caugugauuacaucaucuuucugacaucauug

SEQ ID NO: 93819 - RNA, 32 nt, Human
caugugauucacugccuuccucucucuaccag

SEQ ID NO: 93820 - RNA, 32 nt, Human
caugugauuggcuuuucuacccauagagggcc

SEQ ID NO: 93821 - RNA, 32 nt, Human
caugugauuucugcuuucuucuuuagcaagau

SEQ ID NO: 93822 - RNA, 32 nt, Human
caugugcacaugcacacacaugcaugcacaca

SEQ ID NO: 93823 - RNA, 32 nt, Human
caugugcacaugcacgugugugcacguacaca

SEQ ID NO: 93824 - RNA, 32 nt, Human
caugugcacaugcuuccagccccaccuuccaa

SEQ ID NO: 93825 - RNA, 32 nt, Human
caugugcacccuucucccuccagccugggcua

SEQ ID NO: 93826 - RNA, 32 nt, Human
caugugcagcacucuucccaauugccagggac

SEQ ID NO: 93827 - RNA, 32 nt, Human
caugugcagcuuugcauauacacacaugcaua

SEQ ID NO: 93828 - RNA, 32 nt, Human
caugugcagggugggcuggugaaggccccucu

SEQ ID NO: 93829 - RNA, 32 nt, Human
caugugcagguaaacucgugacaaggggguuu

SEQ ID NO: 93830 - RNA, 31 nt, Human
caugugcaggugagaaguugggugaaaggac

SEQ ID NO: 93831 - RNA, 32 nt, Human
caugugcauaaccacaugcacacacacucacg

SEQ ID NO: 93832 - RNA, 32 nt, Human
caugugccaggaguuugaggcugcagugcacu

SEQ ID NO: 93833 - RNA, 32 nt, Human
caugugccauucuauacugucauuccaaauuc

SEQ ID NO: 93834 - RNA, 32 nt, Human
caugugccauuuuguccucagagggcgcuuac

SEQ ID NO: 93835 - RNA, 32 nt, Human
caugugcccccuacccuccaccccacugccca

SEQ ID NO: 93836 - RNA, 32 nt, Human
caugugccccucugcccucuaguucuccaagu

SEQ ID NO: 93837 - RNA, 32 nt, Human
caugugccuauaucccagcuacugggagguug

SEQ ID NO: 93838 - RNA, 32 nt, Human
caugugccuauguauaccuauguaacauggug

SEQ ID NO: 93839 - RNA, 32 nt, Human
caugugccucaaauuccugccuuuccucaaga

SEQ ID NO: 93840 - RNA, 32 nt, Human
caugugccucaggacuagagugagcaaucaua

SEQ ID NO: 93841 - RNA, 32 nt, Human
caugugccugcagggagcaggcgcugugguua

SEQ ID NO: 93842 - RNA, 32 nt, Human
caugugccuguaaucccagcuauuuggcaggc

SEQ ID NO: 93843 - RNA, 32 nt, Human
caugugccugugggguggggaggcguaggggu

SEQ ID NO: 93844 - RNA, 32 nt, Human
caugugcgaaacugagacagcauuagaaaggc

SEQ ID NO: 93845 - RNA, 32 nt, Human
caugugcgcaugcucagagcccugcugcccac

SEQ ID NO: 93846 - RNA, 32 nt, Human
caugugcggcugaacugagaaggcaggccucc

SEQ ID NO: 93847 - RNA, 32 nt, Human
caugugcguggaaguguuccugucucaauagc

SEQ ID NO: 93848 - RNA, 32 nt, Human
caugugcucccagaaacauucuuuuugucugc

SEQ ID NO: 93849 - RNA, 32 nt, Human
caugugcuggagcuacacgacuggaugugcac

SEQ ID NO: 93850 - RNA, 32 nt, Human
caugugcuguaagucccuaggugcaagcuuuu

SEQ ID NO: 93851 - RNA, 32 nt, Human
caugugcuguagcuucuugagaaucaggcaca

SEQ ID NO: 93852 - RNA, 32 nt, Human
caugugcugugugugugcaugugugcaugacg

SEQ ID NO: 93853 - RNA, 32 nt, Human
caugugcuguucugcugccccacucagcuccu

SEQ ID NO: 93854 - RNA, 32 nt, Human
caugugcuucuucugaauacugaaugugacug

SEQ ID NO: 93855 - RNA, 32 nt, Human
caugugcuuguaaucccagcuacucuggaggc

SEQ ID NO: 93856 - RNA, 32 nt, Human
caugugcuuuuuaauuucugcuugaauguuug

SEQ ID NO: 93857 - RNA, 32 nt, Human
cauguggaagaaaagagccuuggagaaguuuu

SEQ ID NO: 93858 - RNA, 32 nt, Human
cauguggaagaaggaaaaagacaaaaaggaag

SEQ ID NO: 93859 - RNA, 32 nt, Human
cauguggacacacugcugugacugccucuugu

SEQ ID NO: 93860 - RNA, 32 nt, Human
cauguggacagacauagcccaaggaggcacca

SEQ ID NO: 93861 - RNA, 32 nt, Human
cauguggaccaugggaagucagucucuugcgu

SEQ ID NO: 93862 - RNA, 32 nt, Human
cauguggacccacccuuccucuauaaguacca

SEQ ID NO: 93863 - RNA, 32 nt, Human
cauguggacccuuuauugucuaacugauaaga

SEQ ID NO: 93864 - RNA, 32 nt, Human
cauguggacgugccuccuuccucuucaccuug

SEQ ID NO: 93865 - RNA, 32 nt, Human
cauguggagccacgaacauccuuucccugcag

SEQ ID NO: 93866 - RNA, 32 nt, Human
cauguggaggggccagaggcuugccagacccc

SEQ ID NO: 93867 - RNA, 32 nt, Human
cauguggagggucucucugaagaggcuaucau

SEQ ID NO: 93868 - RNA, 32 nt, Human
cauguggaggugggaaaggugacagaguagca

SEQ ID NO: 93869 - RNA, 32 nt, Human
cauguggaugcacacgggugugcggugaagau

SEQ ID NO: 93870 - RNA, 32 nt, Human
cauguggcagaggcccaggcucccacucagac

SEQ ID NO: 93871 - RNA, 32 nt, Human
cauguggcagcuccuguggaaguuuccaguuc

SEQ ID NO: 93872 - RNA, 32 nt, Human
cauguggcagcuuugcauagggagaggauagc

SEQ ID NO: 93873 - RNA, 32 nt, Human
cauguggcaggcaguggggccucuucaucagc

SEQ ID NO: 93874 - RNA, 32 nt, Human
cauguggcaucauguagaaccugcuuugacau

SEQ ID NO: 93875 - RNA, 32 nt, Human
cauguggcaugccuguguauguguguaacaga

SEQ ID NO: 93876 - RNA, 32 nt, Human
cauguggcauugccuccaguucuggccacacu

SEQ ID NO: 93877 - RNA, 32 nt, Human
cauguggccaagggcuccagggccagggugug

SEQ ID NO: 93878 - RNA, 32 nt, Human
cauguggccgaaggggacaagggagguugcug

SEQ ID NO: 93879 - RNA, 32 nt, Human
cauguggcucagugccuuccucucucuaccag

SEQ ID NO: 93880 - RNA, 32 nt, Human
cauguggcugcaauuggagcuggaugaucuaa

SEQ ID NO: 93881 - RNA, 16 nt, Human
cauguggcugcugcca

SEQ ID NO: 93882 - RNA, 32 nt, Human
cauguggcuggauuugaugagcaaagagguga

SEQ ID NO: 93883 - RNA, 32 nt, Human
caugugggaagugggcaugaccagaggcagag

SEQ ID NO: 93884 - RNA, 32 nt, Human
caugugggcuuggaagacaugucacucauggg

SEQ ID NO: 93885 - RNA, 32 nt, Human
cauguggggaagcacacccggaagccaccgau

SEQ ID NO: 93886 - RNA, 32 nt, Human
caugugggucaguggcuccugauguucugucu

SEQ ID NO: 93887 - RNA, 32 nt, Human
cauguggguggacagugguggagagucacugg

SEQ ID NO: 93888 - RNA, 32 nt, Human
cauguggguuuuguuucuuuccuuccuuccuu

SEQ ID NO: 93889 - RNA, 32 nt, Human
caugugguacagaggcaagagcagagccugag

SEQ ID NO: 93890 - RNA, 32 nt, Human
caugugguaggcaggguugggggacggcagga

SEQ ID NO: 93891 - RNA, 32 nt, Human
cauguggucccagcuacucuggaagcugaggu

SEQ ID NO: 93892 - RNA, 32 nt, Human
cauguggucugacagaauuggcuucaaagaag

SEQ ID NO: 93893 - RNA, 32 nt, Human
caugugguuuucuccuuccuggccuuggcugg

SEQ ID NO: 93894 - RNA, 21 nt, Human
cauguguaaucccagcauuuu

SEQ ID NO: 93895 - RNA, 32 nt, Human
cauguguaccuacagagcagccagguggaggu

SEQ ID NO: 93896 - RNA, 29 nt, Human
cauguguagcugcuauguccccuggggcg

SEQ ID NO: 93897 - RNA, 32 nt, Human
cauguguagugaaacaaaauguaacaccuugg

SEQ ID NO: 93898 - RNA, 32 nt, Human
cauguguaugcaucugcaggaaacauagccug

SEQ ID NO: 93899 - RNA, 20 nt, Human
cauguguccugugguuauag

SEQ ID NO: 93900 - RNA, 32 nt, Human
caugugucuccaagacagcuuaugaauaucua

SEQ ID NO: 93901 - RNA, 31 nt, Human
caugugucuggcgggggauggguggacugua

SEQ ID NO: 93902 - RNA, 29 nt, Human
caugugucuguguguguggaacuuuugua

SEQ ID NO: 93903 - RNA, 32 nt, Human
caugugugagccaccgccccuggccucuguag

SEQ ID NO: 93904 - RNA, 32 nt, Human
caugugugagccgcccuacucccuucaccugg

SEQ ID NO: 93905 - RNA, 24 nt, Human
caugugugaggcgcugcagugcau

SEQ ID NO: 93906 - RNA, 32 nt, Human
caugugugcacauacacacaugcaccuacaca

SEQ ID NO: 93907 - RNA, 32 nt, Human
caugugugcaguauuauaaguuaucauggaac

SEQ ID NO: 93908 - RNA, 32 nt, Human
caugugugcagucugagcuuaggcacacacag

SEQ ID NO: 93909 - RNA, 32 nt, Human
caugugugccuguaguccaagcuacuugaagg

SEQ ID NO: 93910 - RNA, 32 nt, Human
cauguguggacgagaugcagaagauuacaauu

SEQ ID NO: 93911 - RNA, 32 nt, Human
caugugugggggcagagguuaugugggaaauc

SEQ ID NO: 93912 - RNA, 29 nt, Human
caugugugggugugugugggcacaggugu

SEQ ID NO: 93913 - RNA, 32 nt, Human
cauguguguauguauacauguauauacauaua

SEQ ID NO: 93914 - RNA, 29 nt, Human
caugugugucuguaugucucuguggggag

SEQ ID NO: 93915 - RNA, 32 nt, Human
caugugugugcaugaguccaucucugcgcgug

SEQ ID NO: 93916 - RNA, 29 nt, Human
caugugugugccugugugcccgggucugu

SEQ ID NO: 93917 - RNA, 32 nt, Human
caugugugugguuccugcgaguugcugaugac

SEQ ID NO: 93918 - RNA, 32 nt, Human
cauguguguguauguauguguauguguuccau

SEQ ID NO: 93919 - RNA, 18 nt, Human
cauguguucaucaucuua

SEQ ID NO: 93920 - RNA, 32 nt, Human
cauguguuuugguggucuuggcugcugauggg

SEQ ID NO: 93921 - RNA, 32 nt, Human
cauguguuuuuguugaaaugauccuaccagug

SEQ ID NO: 93922 - RNA, 32 nt, Human
cauguuaaaaguaaggaugaccaaaugcaaau

SEQ ID NO: 93923 - RNA, 32 nt, Human
cauguuaaagaaugaugguuagcagaagcugu

SEQ ID NO: 93924 - RNA, 32 nt, Human
cauguuaacaccuugcuacuaccaaggcauaa

SEQ ID NO: 93925 - RNA, 32 nt, Human
cauguuaacucuccucccagguaaacaguuca

SEQ ID NO: 93926 - RNA, 32 nt, Human
cauguuaaggugagauuuugguggggacacag

SEQ ID NO: 93927 - RNA, 32 nt, Human
cauguuaauagaggaucagagcagaguuggga

SEQ ID NO: 93928 - RNA, 32 nt, Human
cauguuacaguugcucacgccuguaaucccag

SEQ ID NO: 93929 - RNA, 32 nt, Human
cauguuacaugguuaccacaagccacaauaaa

SEQ ID NO: 93930 - RNA, 32 nt, Human
cauguuacccagacuuguguucucuugcgucc

SEQ ID NO: 93931 - RNA, 32 nt, Human
cauguuacgcuggugguuaaggccagggccuc

SEQ ID NO: 93932 - RNA, 32 nt, Human
cauguuacuuuccguagcucaauauggcuguu

SEQ ID NO: 93933 - RNA, 32 nt, Human
cauguuaggacuagaagaaaaugcacaauuug

SEQ ID NO: 93934 - RNA, 32 nt, Human
cauguuaggcucacacaugcaucagcacugca

SEQ ID NO: 93935 - RNA, 32 nt, Human
cauguuagucaggcuggucuccaccucaggug

SEQ ID NO: 93936 - RNA, 32 nt, Human
cauguuagucguggcuggucuccaacuccuga

SEQ ID NO: 93937 - RNA, 32 nt, Human
cauguuagucuuauuuaaaacuuucucagcaa

SEQ ID NO: 93938 - RNA, 32 nt, Human
cauguuauauagguggaaagggucagacuacu

SEQ ID NO: 93939 - RNA, 32 nt, Human
cauguucaacuugcuuuuccacuccugaggaa

SEQ ID NO: 93940 - RNA, 24 nt, Human
cauguucaagcgauucuccugccu

SEQ ID NO: 93941 - RNA, 32 nt, Human
cauguucacucaggaaccacuggcuccuccag

SEQ ID NO: 93942 - RNA, 32 nt, Human
cauguucagccgagacaagugaacgggaaggu

SEQ ID NO: 93943 - RNA, 20 nt, Human
cauguucaucugcugucuug

SEQ ID NO: 93944 - RNA, 32 nt, Human
cauguucaugacacugcacuccagccugggug

SEQ ID NO: 93945 - RNA, 32 nt, Human
cauguuccaguauauuucucuuacagagugaa

SEQ ID NO: 93946 - RNA, 32 nt, Human
cauguucccaggagggaggccggaggcccaug

SEQ ID NO: 93947 - RNA, 17 nt, Human
cauguuccccuguuuua

SEQ ID NO: 93948 - RNA, 32 nt, Human
cauguucccuagcugaggaugacagagggaug

SEQ ID NO: 93949 - RNA, 17 nt, Human
cauguuccuccuuucua

SEQ ID NO: 93950 - RNA, 19 nt, Human
cauguuccucuuccuguuc

SEQ ID NO: 93951 - RNA, 32 nt, Human
cauguuccucuuccuguuccuguugacauguc

SEQ ID NO: 93952 - RNA, 32 nt, Human
cauguuccugggacaguguccacaaauaccgu

SEQ ID NO: 93953 - RNA, 32 nt, Human
cauguuccugggucccagaaacagacaucugu

SEQ ID NO: 93954 - RNA, 32 nt, Human
cauguucuccaucgucuccccguuccaccuug

SEQ ID NO: 93955 - RNA, 32 nt, Human
cauguucucugccuccccuucauguucuguga

SEQ ID NO: 93956 - RNA, 32 nt, Human
cauguucucugcucccacaccuaagccaagac

SEQ ID NO: 93957 - RNA, 32 nt, Human
cauguucucugucugcuccugccuccuccagg

SEQ ID NO: 93958 - RNA, 32 nt, Human
cauguucuggugguuugauuguuuacaggaua

SEQ ID NO: 93959 - RNA, 32 nt, Human
cauguucuuauauuuauuauuuugccauguuu

SEQ ID NO: 93960 - RNA, 32 nt, Human
cauguucuucuggagcaggaguuacaaauugg

SEQ ID NO: 93961 - RNA, 32 nt, Human
cauguucuuuaccaucugugcaguuauugcuc

SEQ ID NO: 93962 - RNA, 32 nt, Human
cauguugaaauguuuaacauuuuaagauugga

SEQ ID NO: 93963 - RNA, 32 nt, Human
cauguugaacaucuugggagcugcugauaaug

SEQ ID NO: 93964 - RNA, 32 nt, Human
cauguugaagucagaauggccuguauucacua

SEQ ID NO: 93965 - RNA, 32 nt, Human
cauguugacagccuugcacuuccacaggcuac

SEQ ID NO: 93966 - RNA, 32 nt, Human
cauguugacaucuucugacuguccccugcuug

SEQ ID NO: 93967 - RNA, 26 nt, Human
cauguugaccgagcuggagaaagccu

SEQ ID NO: 93968 - RNA, 32 nt, Human
cauguugaccuuguuuagucacauuaacgcac

SEQ ID NO: 93969 - RNA, 32 nt, Human
cauguugagaggcugaggugggcagaucauuu

SEQ ID NO: 93970 - RNA, 32 nt, Human
cauguugcagacuuaagccauuuuugauauag

SEQ ID NO: 93971 - RNA, 23 nt, Human
cauguugcagcagcuauuuugcc

SEQ ID NO: 93972 - RNA, 32 nt, Human
cauguugcagccagggccagugggaggggguc

SEQ ID NO: 93973 - RNA, 32 nt, Human
cauguugcagugagcugagauugcaccacuac

SEQ ID NO: 93974 - RNA, 32 nt, Human
cauguugccaacgugcuucuggggccccuguc

SEQ ID NO: 93975 - RNA, 23 nt, Human
cauguugccauaauguguaugga

SEQ ID NO: 93976 - RNA, 32 nt, Human
cauguugccuugcccaagccaaagaggaaggu

SEQ ID NO: 93977 - RNA, 32 nt, Human
cauguugcgucuuguugagggagggagagcag

SEQ ID NO: 93978 - RNA, 32 nt, Human
cauguugcuacaccauccugucuucucagcau

SEQ ID NO: 93979 - RNA, 32 nt, Human
cauguugcugcaaaagacauuaucucauuuuu

SEQ ID NO: 93980 - RNA, 32 nt, Human
cauguugcuguacugaauacucuaagcaauua

SEQ ID NO: 93981 - RNA, 32 nt, Human
cauguuggcacaugccuguaaucucagcuacu

SEQ ID NO: 93982 - RNA, 32 nt, Human
cauguuggcaugcaccuguaaucccagcuacu

SEQ ID NO: 93983 - RNA, 32 nt, Human
cauguuggccagacuggucuugaacucuugac

SEQ ID NO: 93984 - RNA, 32 nt, Human
cauguuggccagacuggucuugaacucuuggc

SEQ ID NO: 93985 - RNA, 32 nt, Human
cauguuggcucacaccuguauucccaguacuu

SEQ ID NO: 93986 - RNA, 32 nt, Human
cauguuggcucacaccugugagcacaguacug

SEQ ID NO: 93987 - RNA, 32 nt, Human
cauguuggcucccgccuguaaucccagcacuu

SEQ ID NO: 93988 - RNA, 32 nt, Human
cauguuggcugugcucucaggcuggcaccaug

SEQ ID NO: 93989 - RNA, 32 nt, Human
cauguugggaaagagauggauguuggggagga

SEQ ID NO: 93990 - RNA, 32 nt, Human
cauguugggaacaggcugucuaccccguacag

SEQ ID NO: 93991 - RNA, 32 nt, Human
cauguugggaaguacagucucugcccauuacc

SEQ ID NO: 93992 - RNA, 32 nt, Human
cauguugggcauaagggaugaaaacuuggccg

SEQ ID NO: 93993 - RNA, 32 nt, Human
cauguuggucucaaacuccugaccucagguaa

SEQ ID NO: 93994 - RNA, 32 nt, Human
cauguuggucucagcugccaucucaaugguuu

SEQ ID NO: 93995 - RNA, 32 nt, Human
cauguuggugcacgcuuguaaucccagcuacu

SEQ ID NO: 93996 - RNA, 32 nt, Human
cauguuggugugcaccuguaaucccagcuacu

SEQ ID NO: 93997 - RNA, 32 nt, Human
cauguuguccuuucuggcuucccugauggugu

SEQ ID NO: 93998 - RNA, 32 nt, Human
cauguugucgggcaccuguagucccagcuacu

SEQ ID NO: 93999 - RNA, 32 nt, Human
cauguugucuggcugaggagcuacuagaaaag

SEQ ID NO: 94000 - RNA, 32 nt, Human
cauguugugauuucuuccacuguccaucaagg

SEQ ID NO: 94001 - RNA, 32 nt, Human
cauguuuaaaaagaaggaauuuggacaaaggc

SEQ ID NO: 94002 - RNA, 32 nt, Human
cauguuuaaguauguugauugcuuucuaauua

SEQ ID NO: 94003 - RNA, 32 nt, Human
cauguuuagaaaucaagguucaggagaaucuu

SEQ ID NO: 94004 - RNA, 32 nt, Human
cauguuuaggagggagccgagccuucucccgg

SEQ ID NO: 94005 - RNA, 32 nt, Human
cauguuuauccugaauuuuuacuuaauaauuu

SEQ ID NO: 94006 - RNA, 32 nt, Human
cauguuuauuaugauacuuucucuccaaagga

SEQ ID NO: 94007 - RNA, 32 nt, Human
cauguuuauuucaaaaacauucacaaauauag

SEQ ID NO: 94008 - RNA, 32 nt, Human
cauguuucaggucauaggggccuugggcucag

SEQ ID NO: 94009 - RNA, 32 nt, Human
cauguuuccuuccuucaacuguguucucccug

SEQ ID NO: 94010 - RNA, 18 nt, Human
cauguuucucugcugcca

SEQ ID NO: 94011 - RNA, 32 nt, Human
cauguuucugcgcuccuagccugggugacaga

SEQ ID NO: 94012 - RNA, 32 nt, Human
cauguuugaccaggacugagucuggaaucucc

SEQ ID NO: 94013 - RNA, 32 nt, Human
cauguuugcagcauugcacuccagccugggug

SEQ ID NO: 94014 - RNA, 32 nt, Human
cauguuugcgucuguuuccucccucucuggcc

SEQ ID NO: 94015 - RNA, 32 nt, Human
cauguuuggaaagagaauaaauauaugaagag

SEQ ID NO: 94016 - RNA, 32 nt, Human
cauguuuggaaaugcaauaucuuggggagacg

SEQ ID NO: 94017 - RNA, 32 nt, Human
cauguuuggugcaugguuuuugaggagggcuu

SEQ ID NO: 94018 - RNA, 32 nt, Human
cauguuuguaaaucccagcacuuugggaaggc

SEQ ID NO: 94019 - RNA, 32 nt, Human
cauguuugugugugcgugcauauguguaugug

SEQ ID NO: 94020 - RNA, 32 nt, Human
cauguuuguuucacagauguaaaguucucagu

SEQ ID NO: 94021 - RNA, 32 nt, Human
cauguuuuaacuuauuguugcugaaaacucua

SEQ ID NO: 94022 - RNA, 32 nt, Human
cauguuuuaagcugcaaugcaguagucacggg

SEQ ID NO: 94023 - RNA, 32 nt, Human
cauguuuuccugcugacucucuccccacuauu

SEQ ID NO: 94024 - RNA, 32 nt, Human
cauguuuuccuugaauuuugcaaagaaagaaa

SEQ ID NO: 94025 - RNA, 32 nt, Human
cauguuuugaagcagcagguccaggucacuuu

SEQ ID NO: 94026 - RNA, 32 nt, Human
cauguuuugagccuuguuccagaaagcugagg

SEQ ID NO: 94027 - RNA, 32 nt, Human
cauguuuuggcaguguacucuguccauuccca

SEQ ID NO: 94028 - RNA, 22 nt, Human
cauguuuuuauguuuguacaaa

SEQ ID NO: 94029 - RNA, 32 nt, Human
cauguuuuucauuuucugcauugacugcauuu

SEQ ID NO: 94030 - RNA, 32 nt, Human
cauguuuuucuucucccucagucuggcccuuc

SEQ ID NO: 94031 - RNA, 32 nt, Human
cauguuuuuguaucgggaggugccaucggcac

SEQ ID NO: 94032 - RNA, 21 nt, Human
cauuaaaaauuccaaaggcau

SEQ ID NO: 94033 - RNA, 32 nt, Human
cauuaaaagaacugauucaugaagacguuuuc

SEQ ID NO: 94034 - RNA, 32 nt, Human
cauuaaaagaagaaugaaugcauuuuaaguuu

SEQ ID NO: 94035 - RNA, 32 nt, Human
cauuaaaauaccagagauaauggagauauuuu

SEQ ID NO: 94036 - RNA, 32 nt, Human
cauuaaacaacaacucuccauucucuuauccc

SEQ ID NO: 94037 - RNA, 32 nt, Human
cauuaaacauggucuugcugcaucaacuccag

SEQ ID NO: 94038 - RNA, 32 nt, Human
cauuaaacccugaucaggauguuagucagugg

SEQ ID NO: 94039 - RNA, 32 nt, Human
cauuaaagacaaauguuuuuauacaaaugaau

SEQ ID NO: 94040 - RNA, 32 nt, Human
cauuaaagagggugaggaagggaaaaggaaua

SEQ ID NO: 94041 - RNA, 32 nt, Human
cauuaaagcgugcucuuacagagcagaaguca

SEQ ID NO: 94042 - RNA, 32 nt, Human
cauuaaaggagcaucagagaagaggcagccau

SEQ ID NO: 94043 - RNA, 32 nt, Human
cauuaaaguugaggguuuuacauugcuguauu

SEQ ID NO: 94044 - RNA, 32 nt, Human
cauuaaaucaaauuuuguaaacaguggcagga

SEQ ID NO: 94045 - RNA, 32 nt, Human
cauuaaaucagcugcccgcggaaaacaugucc

SEQ ID NO: 94046 - RNA, 32 nt, Human
cauuaacaaccaguacuccuucgugugagcca

SEQ ID NO: 94047 - RNA, 32 nt, Human
cauuaacaauugcucagccacaauucucggau

SEQ ID NO: 94048 - RNA, 32 nt, Human
cauuaacagauggaaaaacugaggcuuagaga

SEQ ID NO: 94049 - RNA, 32 nt, Human
cauuaacaugcugucucuaaggguggccccuc

SEQ ID NO: 94050 - RNA, 32 nt, Human
cauuaaccaauacuggaacugguaucuagcua

SEQ ID NO: 94051 - RNA, 28 nt, Human
cauuaacccugugcugccacaucuggcu

SEQ ID NO: 94052 - RNA, 32 nt, Human
cauuaaccugcucuccuuugucaccugggcug

SEQ ID NO: 94053 - RNA, 32 nt, Human
cauuaaccuuccccaucucccugccagccccu

SEQ ID NO: 94054 - RNA, 32 nt, Human
cauuaacugagcuccaagggugugugggcaga

SEQ ID NO: 94055 - RNA, 32 nt, Human
cauuaacuggauuuuaaaaucauuucaaagca

SEQ ID NO: 94056 - RNA, 32 nt, Human
cauuaacuugagugaccugugugagagacaga

SEQ ID NO: 94057 - RNA, 32 nt, Human
cauuaacuugcaaucuggacaggaaguugacg

SEQ ID NO: 94058 - RNA, 32 nt, Human
cauuaagaaagcugcgguggucugagcaacau

SEQ ID NO: 94059 - RNA, 32 nt, Human
cauuaagauacagaauaccuggauucugguuu

SEQ ID NO: 94060 - RNA, 32 nt, Human
cauuaagcagaggcuggcacggcuacagcugu

SEQ ID NO: 94061 - RNA, 32 nt, Human
cauuaagcauuuuaaaaugcuuagccuuuauc

SEQ ID NO: 94062 - RNA, 32 nt, Human
cauuaagcguagguuaggagguuuccgggagg

SEQ ID NO: 94063 - RNA, 32 nt, Human
cauuaaggaacugucuucaucaucauacaugu

SEQ ID NO: 94064 - RNA, 32 nt, Human
cauuaaggaaugaacucuuucaaggagaggaa

SEQ ID NO: 94065 - RNA, 32 nt, Human
cauuaagguaggucagcgucauuugucucugu

SEQ ID NO: 94066 - RNA, 32 nt, Human
cauuaagguggacacuuccagacuggagcacc

SEQ ID NO: 94067 - RNA, 32 nt, Human
cauuaagucaucugacauuaaaucauuuagcc

SEQ ID NO: 94068 - RNA, 29 nt, Human
cauuaaguccuguguguguuugggcaggc

SEQ ID NO: 94069 - RNA, 32 nt, Human
cauuaagugcaucuguguauccugguuuaaaa

SEQ ID NO: 94070 - RNA, 32 nt, Human
cauuaaguuccaauucuacacccacagccaga

SEQ ID NO: 94071 - RNA, 32 nt, Human
cauuaaguucucuaugaaugccuuggauuuag

SEQ ID NO: 94072 - RNA, 32 nt, Human
cauuaauccugcauuacuuagaucccauauga

SEQ ID NO: 94073 - RNA, 32 nt, Human
cauuaaucugggcacuuugauuacaggcaaug

SEQ ID NO: 94074 - RNA, 32 nt, Human
cauuaaucugugacuccaccucuugcaucaaa

SEQ ID NO: 94075 - RNA, 32 nt, Human
cauuaaugagauguuauuacuguuuugggccu

SEQ ID NO: 94076 - RNA, 32 nt, Human
cauuaaugcagcaacauaauacucacuuuagg

SEQ ID NO: 94077 - RNA, 32 nt, Human
cauuaaugcauuuuucccucaucaagcauaua

SEQ ID NO: 94078 - RNA, 32 nt, Human
cauuaauggagcuuucugguucuuggacuuuu

SEQ ID NO: 94079 - RNA, 32 nt, Human
cauuaauggucauaccccuucuguaccuggca

SEQ ID NO: 94080 - RNA, 32 nt, Human
cauuaauuuagauacaaaccugguugaugacc

SEQ ID NO: 94081 - RNA, 32 nt, Human
cauuaauuuguaaaguaccuugaguguaauuu

SEQ ID NO: 94082 - RNA, 32 nt, Human
cauuaauuuuugaagguaauuuaguuuugugg

SEQ ID NO: 94083 - RNA, 32 nt, Human
cauuacaaaggccaccaucacaggaucggauu

SEQ ID NO: 94084 - RNA, 32 nt, Human
cauuacaaaucucugaggccauuaggggaaaa

SEQ ID NO: 94085 - RNA, 32 nt, Human
cauuacaagucaccuggaacagacucaaagaa

SEQ ID NO: 94086 - RNA, 32 nt, Human
cauuacacagucuuuuugaccucuuuugaagg

SEQ ID NO: 94087 - RNA, 32 nt, Human
cauuacaccaugguuuuuagacauuucugauu

SEQ ID NO: 94088 - RNA, 32 nt, Human
cauuacaccuggcuaauuguuguauuuuagua

SEQ ID NO: 94089 - RNA, 21 nt, Human
cauuacacuccagccugggca

SEQ ID NO: 94090 - RNA, 32 nt, Human
cauuacagagcagacagcucuaugauguuuac

SEQ ID NO: 94091 - RNA, 32 nt, Human
cauuacagagcuugugaaaagugcagaaaccu

SEQ ID NO: 94092 - RNA, 32 nt, Human
cauuacagcccgaagaacaagagggugaaacu

SEQ ID NO: 94093 - RNA, 32 nt, Human
cauuacagccuggugcagagcaagacucuguc

SEQ ID NO: 94094 - RNA, 32 nt, Human
cauuacaggcuggaauguaauuguggugaaag

SEQ ID NO: 94095 - RNA, 32 nt, Human
cauuacaugagcuucuccuguucuuccacuuu

SEQ ID NO: 94096 - RNA, 32 nt, Human
cauuacauggcuucaucuaccuccaggcuucu

SEQ ID NO: 94097 - RNA, 32 nt, Human
cauuacauguuacugaguaggcagcuagaaaa

SEQ ID NO: 94098 - RNA, 32 nt, Human
cauuaccaaaacacagacaaaccaaagguaac

SEQ ID NO: 94099 - RNA, 32 nt, Human
cauuaccaagggcagggggccccuuugcugac

SEQ ID NO: 94100 - RNA, 32 nt, Human
cauuaccaaguagagucaggaugaacuaugug

SEQ ID NO: 94101 - RNA, 32 nt, Human
cauuaccaauuucugucaacuaccaugagaug

SEQ ID NO: 94102 - RNA, 32 nt, Human
cauuaccacagcugccuuuguguguuuguguc

SEQ ID NO: 94103 - RNA, 32 nt, Human
cauuaccaccaccacgugaccuggucuuacga

SEQ ID NO: 94104 - RNA, 32 nt, Human
cauuaccaccauccaucuccauaacucuguuc

SEQ ID NO: 94105 - RNA, 18 nt, Human
cauuaccagaaacguuaa

SEQ ID NO: 94106 - RNA, 32 nt, Human
cauuacccaaaccauauugcacuuuuaguucc

SEQ ID NO: 94107 - RNA, 32 nt, Human
cauuacccucaccucucccuaguucauaaaua

SEQ ID NO: 94108 - RNA, 32 nt, Human
cauuaccucuucugcaggcucugccaugcacg

SEQ ID NO: 94109 - RNA, 28 nt, Human
cauuaccugaaggacgccucaucauuuc

SEQ ID NO: 94110 - RNA, 32 nt, Human
cauuaccuggaggcgcucuaggcccuugucuu

SEQ ID NO: 94111 - RNA, 32 nt, Human
cauuaccuugaaccacacagaccugguucccu

SEQ ID NO: 94112 - RNA, 32 nt, Human
cauuaccuuuuuagcuauuuuuaauagucuuc

SEQ ID NO: 94113 - RNA, 32 nt, Human
cauuacgagugccucagccuggaaaagcuaac

SEQ ID NO: 94114 - RNA, 32 nt, Human
cauuacggccuugccuagcuggcagggacagc

SEQ ID NO: 94115 - RNA, 32 nt, Human
cauuacguaucuguguguuacugcuguguuau

SEQ ID NO: 94116 - RNA, 32 nt, Human
cauuacguguuacuguaguuuauuggaaucug

SEQ ID NO: 94117 - RNA, 32 nt, Human
cauuacuacuaaaauaauacugaaguuggaua

SEQ ID NO: 94118 - RNA, 32 nt, Human
cauuacucaaauacccaaaucccauuccaagu

SEQ ID NO: 94119 - RNA, 32 nt, Human
cauuacucaaauuaaucguucugcacuucagc

SEQ ID NO: 94120 - RNA, 32 nt, Human
cauuacucauuugaguuugcaucauugaauuu

SEQ ID NO: 94121 - RNA, 32 nt, Human
cauuacugcccagguaaggagugcuagaauca

SEQ ID NO: 94122 - RNA, 32 nt, Human
cauuacuggaaccgggauaugaaguggagcca

SEQ ID NO: 94123 - RNA, 32 nt, Human
cauuacugggagguggagguggaaaacgugau

SEQ ID NO: 94124 - RNA, 32 nt, Human
cauuacugggagugcuaucuacucacaagugu

SEQ ID NO: 94125 - RNA, 18 nt, Human
cauuacuggggugaagga

SEQ ID NO: 94126 - RNA, 32 nt, Human
cauuacuguagaguuacaacaagaggguaaag

SEQ ID NO: 94127 - RNA, 32 nt, Human
cauuacuguaugucuucugccuccacacuugc

SEQ ID NO: 94128 - RNA, 32 nt, Human
cauuacugucuuccguggauguuucaguuaca

SEQ ID NO: 94129 - RNA, 32 nt, Human
cauuacuguguugucucugugccagauguggc

SEQ ID NO: 94130 - RNA, 32 nt, Human
cauuacuuaaaauguugguacuagccauuaac

SEQ ID NO: 94131 - RNA, 32 nt, Human
cauuacuuagugggggccagcugugaucggcc

SEQ ID NO: 94132 - RNA, 32 nt, Human
cauuacuuccacugcuaacaacaggacugccu

SEQ ID NO: 94133 - RNA, 32 nt, Human
cauuacuucuaagacaucaucagucugcaacu

SEQ ID NO: 94134 - RNA, 32 nt, Human
cauuacuugguauaacguuuuucauuuccuuu

SEQ ID NO: 94135 - RNA, 32 nt, Human
cauuacuuuagcauuuuagcauguuugggguc

SEQ ID NO: 94136 - RNA, 32 nt, Human
cauuacuuuuccuucccacucucuccaacauc

SEQ ID NO: 94137 - RNA, 32 nt, Human
cauuagaaaccagucuccucccaauugucugg

SEQ ID NO: 94138 - RNA, 32 nt, Human
cauuagaaagcagcagauuuccagcgagaaaa

SEQ ID NO: 94139 - RNA, 20 nt, Human
cauuagaaaucuguggggca

SEQ ID NO: 94140 - RNA, 32 nt, Human
cauuagaaauuugcaccucaucaugccccaga

SEQ ID NO: 94141 - RNA, 21 nt, Human
cauuagaagauaagauggcau

SEQ ID NO: 94142 - RNA, 32 nt, Human
cauuagaagauaagauggcauaaugaaagaua

SEQ ID NO: 94143 - RNA, 32 nt, Human
cauuagaagccuggccuccugaugcugugcuc

SEQ ID NO: 94144 - RNA, 32 nt, Human
cauuagaaguuccugagggcuggagaacacug

SEQ ID NO: 94145 - RNA, 32 nt, Human
cauuagacaccugcuccuccaagccuggucuu

SEQ ID NO: 94146 - RNA, 32 nt, Human
cauuagacccucaacccaaaggagcaggagau

SEQ ID NO: 94147 - RNA, 19 nt, Human
cauuagacuucuuguucua

SEQ ID NO: 94148 - RNA, 32 nt, Human
cauuagagaccagacagaaggaaggugggauu

SEQ ID NO: 94149 - RNA, 32 nt, Human
cauuagagaugggguuucaccacguuggccag

SEQ ID NO: 94150 - RNA, 32 nt, Human
cauuagaggaagaaaaccagcgcaaggaaucc

SEQ ID NO: 94151 - RNA, 32 nt, Human
cauuagaggugcaaucuacauugggcaucugg

SEQ ID NO: 94152 - RNA, 32 nt, Human
cauuagauccugcuggguguucucaguccuug

SEQ ID NO: 94153 - RNA, 32 nt, Human
cauuagauucuaguuuucuccuuuagaauacc

SEQ ID NO: 94154 - RNA, 32 nt, Human
cauuagcacauacuguccauuagcauaucugg

SEQ ID NO: 94155 - RNA, 22 nt, Human
cauuagcagggaagaauuugga

SEQ ID NO: 94156 - RNA, 32 nt, Human
cauuagcaucaggaaagccugaaaugccuuaa

SEQ ID NO: 94157 - RNA, 31 nt, Human
cauuagcauuagcagcaccuaaguccucauu

SEQ ID NO: 94158 - RNA, 32 nt, Human
cauuagccaccaugccuggccuggagaucagu

SEQ ID NO: 94159 - RNA, 32 nt, Human
cauuagccaccugugccuguccccgccuuggc

SEQ ID NO: 94160 - RNA, 32 nt, Human
cauuagccacucaauuuccaguaccauccugg

SEQ ID NO: 94161 - RNA, 32 nt, Human
cauuagcuagagagcaaaccccagaaagccua

SEQ ID NO: 94162 - RNA, 32 nt, Human
cauuagcucacugcagucuccaccuccugagc

SEQ ID NO: 94163 - RNA, 32 nt, Human
cauuagcucauaggagaaugaacauuuggcaa

SEQ ID NO: 94164 - RNA, 32 nt, Human
cauuagcugaguguagagaagugcaucuuaug

SEQ ID NO: 94165 - RNA, 32 nt, Human
cauuagcugcagaaaaacccccagacagagcc

SEQ ID NO: 94166 - RNA, 32 nt, Human
cauuagcuuauaguccuggggaucagaauucc

SEQ ID NO: 94167 - RNA, 32 nt, Human
cauuaggaaaucuagagaucuaaaggguugaa

SEQ ID NO: 94168 - RNA, 31 nt, Human
cauuaggagagaccugucguuaaggauuugu

SEQ ID NO: 94169 - RNA, 32 nt, Human
cauuaggauugcaugaguccaggaguucgaga

SEQ ID NO: 94170 - RNA, 32 nt, Human
cauuaggauuugccccuuuggaauucugcacu

SEQ ID NO: 94171 - RNA, 32 nt, Human
cauuaggcaacuuccaaacacaaauucauaca

SEQ ID NO: 94172 - RNA, 31 nt, Human
cauuaggcacuuuucuguuuauuuaagaguc

SEQ ID NO: 94173 - RNA, 32 nt, Human
cauuaggcuguaguucuaauauugaguucaac

SEQ ID NO: 94174 - RNA, 32 nt, Human
cauuagggccaccuccauggccccagacagac

SEQ ID NO: 94175 - RNA, 32 nt, Human
cauuaguaaacccaauaagccaaguugaaggu

SEQ ID NO: 94176 - RNA, 32 nt, Human
cauuaguaauguucaacuuuucacaaagauga

SEQ ID NO: 94177 - RNA, 32 nt, Human
cauuaguacaagccccucccaacacccuuaau

SEQ ID NO: 94178 - RNA, 32 nt, Human
cauuaguauuuuaaggagcacugugagagaaa

SEQ ID NO: 94179 - RNA, 32 nt, Human
cauuagugaugacucugaaagcauugaagaaa

SEQ ID NO: 94180 - RNA, 32 nt, Human
cauuagugccuuggacaguugaggaccacucc

SEQ ID NO: 94181 - RNA, 32 nt, Human
cauuagugguguucugugagccucccacccac

SEQ ID NO: 94182 - RNA, 32 nt, Human
cauuaguugucucuccccagcuagauuguaag

SEQ ID NO: 94183 - RNA, 32 nt, Human
cauuaguuuagaucaacucaaggaguauuuau

SEQ ID NO: 94184 - RNA, 32 nt, Human
cauuaguuuuaggguagggaagggauacuaau

SEQ ID NO: 94185 - RNA, 32 nt, Human
cauuaguuuuaguucugucuguuuucauucau

SEQ ID NO: 94186 - RNA, 32 nt, Human
cauuauacagaacccacaggagcuaguuaccu

SEQ ID NO: 94187 - RNA, 32 nt, Human
cauuauaccugaaacuauaggaaagguuaauu

SEQ ID NO: 94188 - RNA, 32 nt, Human
cauuauagcagacauaaguaacaggaaaaugg

SEQ ID NO: 94189 - RNA, 32 nt, Human
cauuauauuaacaucacaauugucaucuauau

SEQ ID NO: 94190 - RNA, 32 nt, Human
cauuaucaaugaaauuacugucaaaagaucuu

SEQ ID NO: 94191 - RNA, 32 nt, Human
cauuaucagccuguuugggaugucugagauca

SEQ ID NO: 94192 - RNA, 32 nt, Human
cauuaucagugaauuuucaguggguaggaugu

SEQ ID NO: 94193 - RNA, 32 nt, Human
cauuaucaucugcaguuacuguuuacaagacu

SEQ ID NO: 94194 - RNA, 32 nt, Human
cauuauccugaauuccccuugccaccccaccc

SEQ ID NO: 94195 - RNA, 32 nt, Human
cauuauccuuucucccuccuguauccucaguu

SEQ ID NO: 94196 - RNA, 32 nt, Human
cauuaucuaccaugacugucucucagccucac

SEQ ID NO: 94197 - RNA, 32 nt, Human
cauuaucuaucuucuucucccuucccucgccc

SEQ ID NO: 94198 - RNA, 32 nt, Human
cauuaucucauucuuuuuccacagagugagcg

SEQ ID NO: 94199 - RNA, 32 nt, Human
cauuaucucuauucuuaaaauuaaacauguug

SEQ ID NO: 94200 - RNA, 32 nt, Human
cauuaucugccauacauucauuacauuauaag

SEQ ID NO: 94201 - RNA, 32 nt, Human
cauuaucugcuccuugucuacuucucuacucu

SEQ ID NO: 94202 - RNA, 32 nt, Human
cauuaugaaauuaguauuuucucugacaucuc

SEQ ID NO: 94203 - RNA, 32 nt, Human
cauuaugaagaauguugucagaaguagggagu

SEQ ID NO: 94204 - RNA, 32 nt, Human
cauuaugacugugguguacagcucccaagugc

SEQ ID NO: 94205 - RNA, 32 nt, Human
cauuaugccuggcuaauuuuuguauuuuuagu

SEQ ID NO: 94206 - RNA, 32 nt, Human
cauuaugccuuacaaacuuacacagugcuuug

SEQ ID NO: 94207 - RNA, 32 nt, Human
cauuauggagagccccgcgacucucauggcau

SEQ ID NO: 94208 - RNA, 32 nt, Human
cauuauggcaggcaccuguaaucccagcuacc

SEQ ID NO: 94209 - RNA, 32 nt, Human
cauuaugggaaaccaaggugggcagauugccu

SEQ ID NO: 94210 - RNA, 32 nt, Human
cauuaugggagaccaaggugggcagauugccu

SEQ ID NO: 94211 - RNA, 32 nt, Human
cauuaugggaggcugaggcgggcagaucauga

SEQ ID NO: 94212 - RNA, 32 nt, Human
cauuauguaauauuccucucagucucugguca

SEQ ID NO: 94213 - RNA, 32 nt, Human
cauuaugugagcccuuauuugagagcuucaug

SEQ ID NO: 94214 - RNA, 32 nt, Human
cauuauguggauguuuacaauggugggaaauu

SEQ ID NO: 94215 - RNA, 32 nt, Human
cauuauguucacugcacucugauuuucuguag

SEQ ID NO: 94216 - RNA, 32 nt, Human
cauuauguuggccaggcuggucuccaacuccu

SEQ ID NO: 94217 - RNA, 32 nt, Human
cauuauguuggccaggcuggucucgaacuccu

SEQ ID NO: 94218 - RNA, 23 nt, Human
cauuauguuugaauuuccugaua

SEQ ID NO: 94219 - RNA, 32 nt, Human
cauuauuaaagaguucaggcaaguuuguggaa

SEQ ID NO: 94220 - RNA, 32 nt, Human
cauuauuacagcaaugaaagaaagaaugaaga

SEQ ID NO: 94221 - RNA, 31 nt, Human
cauuauuauacuucuuauguuuggaccugcu

SEQ ID NO: 94222 - RNA, 31 nt, Human
cauuauuauagcuagaauauaaaaguuuuau

SEQ ID NO: 94223 - RNA, 32 nt, Human
cauuauuaugaaacauuauggcuguuuaugua

SEQ ID NO: 94224 - RNA, 32 nt, Human
cauuauuauuagcucaucucuuaaguagaaag

SEQ ID NO: 94225 - RNA, 24 nt, Human
cauuauucauguuucuuuaugcug

SEQ ID NO: 94226 - RNA, 32 nt, Human
cauuauuccagaagaaagauggaaauucugaa

SEQ ID NO: 94227 - RNA, 32 nt, Human
cauuauuccuacucccuucauccugcacauac

SEQ ID NO: 94228 - RNA, 32 nt, Human
cauuauucuugguuaaggaaugaaucaacgaa

SEQ ID NO: 94229 - RNA, 21 nt, Human
cauuauucuuugauuccagcu

SEQ ID NO: 94230 - RNA, 32 nt, Human
cauuauugaaggaaaggggaugaggacaacug

SEQ ID NO: 94231 - RNA, 32 nt, Human
cauuauugauucacccuuccccuuccuccccu

SEQ ID NO: 94232 - RNA, 18 nt, Human
cauuauugguacaaggaa

SEQ ID NO: 94233 - RNA, 23 nt, Human
cauuauuuaaacagaaaaagaug

SEQ ID NO: 94234 - RNA, 32 nt, Human
cauuauuuagauacuuucuuccuucacucacc

SEQ ID NO: 94235 - RNA, 32 nt, Human
cauuauuucuaaugcuacaagaaugcuguaaa

SEQ ID NO: 94236 - RNA, 32 nt, Human
cauuauuucucuacuuuuccuuccagcaaacc

SEQ ID NO: 94237 - RNA, 32 nt, Human
cauuauuugaaguuuggagaagaaagggauuu

SEQ ID NO: 94238 - RNA, 32 nt, Human
cauuauuugagacuguccugugccugauuauu

SEQ ID NO: 94239 - RNA, 32 nt, Human
cauuauuuguuucauagagaugugauggguga

SEQ ID NO: 94240 - RNA, 32 nt, Human
cauuauuuuaucugcauguuccauaaagcagc

SEQ ID NO: 94241 - RNA, 32 nt, Human
cauuauuuuccucaucagcagaauuuauaaca

SEQ ID NO: 94242 - RNA, 32 nt, Human
cauuauuuuguauuauauuuuaauaguuuauu

SEQ ID NO: 94243 - RNA, 32 nt, Human
cauuauuuuuauauacauuugcaccugcaccu

SEQ ID NO: 94244 - RNA, 32 nt, Human
cauucaaaaaccugguuccuguccucaaaaua

SEQ ID NO: 94245 - RNA, 32 nt, Human
cauucaaaauuucaaacucuuuugccagugac

SEQ ID NO: 94246 - RNA, 32 nt, Human
cauucaaacaggucgagcugugcucgggugcu

SEQ ID NO: 94247 - RNA, 32 nt, Human
cauucaaagagcaaaucguggucuuuggcaga

SEQ ID NO: 94248 - RNA, 32 nt, Human
cauucaacaagagcacuacauucuuuuagcua

SEQ ID NO: 94249 - RNA, 32 nt, Human
cauucaaccacuucuguguguauguacauauu

SEQ ID NO: 94250 - RNA, 32 nt, Human
cauucaacugcaauucugcaggagaguguaau

SEQ ID NO: 94251 - RNA, 32 nt, Human
cauucaacuuguuuuaaaauuaugacucaaga

SEQ ID NO: 94252 - RNA, 32 nt, Human
cauucaagaggaagauggaaggggcuguuuag

SEQ ID NO: 94253 - RNA, 32 nt, Human
cauucaaggagaguugagauacagugaaauga

SEQ ID NO: 94254 - RNA, 32 nt, Human
cauucaaggauccaggaugccaaaaauaugug

SEQ ID NO: 94255 - RNA, 32 nt, Human
cauucaagucagaguuggaagggucauacagg

SEQ ID NO: 94256 - RNA, 32 nt, Human
cauucaagucuagaugacagagcaagacccug

SEQ ID NO: 94257 - RNA, 32 nt, Human
cauucaauaagaauuucuggccaggcguggug

SEQ ID NO: 94258 - RNA, 22 nt, Human
cauucaaucaaggcaaacuuuu

SEQ ID NO: 94259 - RNA, 32 nt, Human
cauucacacacacauauguacaugcacauaga

SEQ ID NO: 94260 - RNA, 32 nt, Human
cauucacacagcaggacucuucucacaugauu

SEQ ID NO: 94261 - RNA, 32 nt, Human
cauucacacaugcauacacacugacauucaca

SEQ ID NO: 94262 - RNA, 32 nt, Human
cauucacacaugcgugcacacauagacgcaug

SEQ ID NO: 94263 - RNA, 32 nt, Human
cauucacacccccauuccuccuggcuccuuau

SEQ ID NO: 94264 - RNA, 32 nt, Human
cauucacacuccuuaagauuuggucagaauuu

SEQ ID NO: 94265 - RNA, 32 nt, Human
cauucacaggcauucuguuccacagcaggcca

SEQ ID NO: 94266 - RNA, 32 nt, Human
cauucacauacuaacccuucuucaagaugggg

SEQ ID NO: 94267 - RNA, 22 nt, Human
cauucacaucugcaugauuaca

SEQ ID NO: 94268 - RNA, 32 nt, Human
cauucaccaccuggucccagacgugcuucagu

SEQ ID NO: 94269 - RNA, 32 nt, Human
cauucaccaggcuccacugcacuggcucauuc

SEQ ID NO: 94270 - RNA, 25 nt, Human
cauucaccaucucuacaccuaaaug

SEQ ID NO: 94271 - RNA, 32 nt, Human
cauucacccacuggccuuucccaccucugcuc

SEQ ID NO: 94272 - RNA, 20 nt, Human
cauucacccagugacuucuu

SEQ ID NO: 94273 - RNA, 24 nt, Human
cauucaccuauugaaagacuucuu

SEQ ID NO: 94274 - RNA, 32 nt, Human
cauucaccucccugccuccucuccuuucuacc

SEQ ID NO: 94275 - RNA, 20 nt, Human
cauucaccugccccaacucu

SEQ ID NO: 94276 - RNA, 32 nt, Human
cauucaccuguauuugugaguguguagucaau

SEQ ID NO: 94277 - RNA, 32 nt, Human
cauucacgcacaccuauucauucacuuccugc

SEQ ID NO: 94278 - RNA, 32 nt, Human
cauucacugagugccuacucuuugccaauccc

SEQ ID NO: 94279 - RNA, 32 nt, Human
cauucacuuccagagaggaccuaucccaaaug

SEQ ID NO: 94280 - RNA, 32 nt, Human
cauucacuuuuagaaucuuguauuuaaguaag

SEQ ID NO: 94281 - RNA, 32 nt, Human
cauucagaaaggagucugaaaggguggccaca

SEQ ID NO: 94282 - RNA, 32 nt, Human
cauucagaacaagacuggaugcuucuguugag

SEQ ID NO: 94283 - RNA, 32 nt, Human
cauucagaaccugaacauccaugugaaaacug

SEQ ID NO: 94284 - RNA, 32 nt, Human
cauucagaaggggaaaauugaaaacaacaaaa

SEQ ID NO: 94285 - RNA, 32 nt, Human
cauucagacucugccaccuauuagcuuucuug

SEQ ID NO: 94286 - RNA, 32 nt, Human
cauucagacugaaacaauacagcuccaugcuc

SEQ ID NO: 94287 - RNA, 32 nt, Human
cauucagagaggagggagaggaggaagaggaa

SEQ ID NO: 94288 - RNA, 32 nt, Human
cauucagaggaaaauauucaaaagccauucag

SEQ ID NO: 94289 - RNA, 32 nt, Human
cauucagauaaauggcaguacuuuaggacaca

SEQ ID NO: 94290 - RNA, 32 nt, Human
cauucagauacuuggucauuuacuuaccaaau

SEQ ID NO: 94291 - RNA, 32 nt, Human
cauucagcaaacaugauuagggaccgaggcug

SEQ ID NO: 94292 - RNA, 32 nt, Human
cauucagcacacaaugucgucuccauuuuaca

SEQ ID NO: 94293 - RNA, 32 nt, Human
cauucagcacacugugaaaauguauuugugca

SEQ ID NO: 94294 - RNA, 32 nt, Human
cauucagcccuagaagcaugaauugcuucaaa

SEQ ID NO: 94295 - RNA, 32 nt, Human
cauucagccuagucaacaacaaacaaagaaaa

SEQ ID NO: 94296 - RNA, 32 nt, Human
cauucagcuuguggauuguaaguggcugacgg

SEQ ID NO: 94297 - RNA, 21 nt, Human
cauucaggagcuccgcguagc

SEQ ID NO: 94298 - RNA, 32 nt, Human
cauucaggaugaggugaaacaggcuggcccug

SEQ ID NO: 94299 - RNA, 32 nt, Human
cauucagggccugggucuccagcucuguaacc

SEQ ID NO: 94300 - RNA, 32 nt, Human
cauucagggcugggggacacgggcacucacug

SEQ ID NO: 94301 - RNA, 32 nt, Human
cauucaggguucccuggcaggggaagcugaga

SEQ ID NO: 94302 - RNA, 32 nt, Human
cauucagguggaggucccgagugggcggggca

SEQ ID NO: 94303 - RNA, 32 nt, Human
cauucaguaaaaucacccuuuuuagugucuag

SEQ ID NO: 94304 - RNA, 32 nt, Human
cauucaguaccugacagagaacaucugggcgu

SEQ ID NO: 94305 - RNA, 32 nt, Human
cauucaguccauaacaccaagcugcggauccu

SEQ ID NO: 94306 - RNA, 32 nt, Human
cauucagucucucugccucugccugccuccug

SEQ ID NO: 94307 - RNA, 32 nt, Human
cauucaguguaugcuggcacugugcauccccu

SEQ ID NO: 94308 - RNA, 31 nt, Human
cauucaguguuuccugggccucugcucagag

SEQ ID NO: 94309 - RNA, 32 nt, Human
cauucaguuagccagccucuuuucuaacacuc

SEQ ID NO: 94310 - RNA, 32 nt, Human
cauucaguuuccuuccaacccuucccaccuuu

SEQ ID NO: 94311 - RNA, 32 nt, Human
cauucauaauaaggccugucagacaagggaga

SEQ ID NO: 94312 - RNA, 32 nt, Human
cauucauaccucuccaaagaccagcuuuuccc

SEQ ID NO: 94313 - RNA, 32 nt, Human
cauucauacuggagagaaauguuacaagugua

SEQ ID NO: 94314 - RNA, 32 nt, Human
cauucauagaggggacacugaaugguucagug

SEQ ID NO: 94315 - RNA, 32 nt, Human
cauucauauaaagguugaaaacaacaaauuga

SEQ ID NO: 94316 - RNA, 32 nt, Human
cauucauaucuacucaccuaacagcaacacug

SEQ ID NO: 94317 - RNA, 32 nt, Human
cauucauaucuacucaccuaauagcaacacug

SEQ ID NO: 94318 - RNA, 32 nt, Human
cauucauauguacaacaaacuacuuucuucuu

SEQ ID NO: 94319 - RNA, 32 nt, Human
cauucauauuccugccuuucuuccaucagcuc

SEQ ID NO: 94320 - RNA, 32 nt, Human
cauucaucacauaugugaugagcacauacaga

SEQ ID NO: 94321 - RNA, 32 nt, Human
cauucaucaguuacuuguauucuuuguaugaa

SEQ ID NO: 94322 - RNA, 21 nt, Human
cauucaucauuaaauauccua

SEQ ID NO: 94323 - RNA, 31 nt, Human
cauucaucuaucaaggaguuuugggauacuu

SEQ ID NO: 94324 - RNA, 32 nt, Human
cauucaugacuaaucaggagcagcgggcucac

SEQ ID NO: 94325 - RNA, 32 nt, Human
cauucaugcuacugccaaccuggggagccagg

SEQ ID NO: 94326 - RNA, 32 nt, Human
cauucauguucacucacuguacacucaucucu

SEQ ID NO: 94327 - RNA, 32 nt, Human
cauucauucacuucucccauguuuucaucugu

SEQ ID NO: 94328 - RNA, 32 nt, Human
cauucauucauucccucacuccugccuuucuc

SEQ ID NO: 94329 - RNA, 32 nt, Human
cauucauucguguuaagccaagauccuggauc

SEQ ID NO: 94330 - RNA, 32 nt, Human
cauucauugaauacuuacuaugugucaggcac

SEQ ID NO: 94331 - RNA, 32 nt, Human
cauucauugcccccacaauccuagccuacccg

SEQ ID NO: 94332 - RNA, 32 nt, Human
cauucauuuggauaaguugugauuugacgacu

SEQ ID NO: 94333 - RNA, 32 nt, Human
cauuccaaaacguucaagaccgucagcacuga

SEQ ID NO: 94334 - RNA, 32 nt, Human
cauuccaaaaugucaugggauaaauaugaaau

SEQ ID NO: 94335 - RNA, 32 nt, Human
cauuccaaaccugaguccucccaccaaugcag

SEQ ID NO: 94336 - RNA, 32 nt, Human
cauuccaaagagagaauaaaacuccugaucca

SEQ ID NO: 94337 - RNA, 32 nt, Human
cauuccaaagugcugggauuacaggugugagc

SEQ ID NO: 94338 - RNA, 32 nt, Human
cauuccaaauccagcacugcuguuuaccuugc

SEQ ID NO: 94339 - RNA, 32 nt, Human
cauuccaaccaaagcauugcugacagcuuccu

SEQ ID NO: 94340 - RNA, 23 nt, Human
cauuccaacuaucucauuuccaa

SEQ ID NO: 94341 - RNA, 32 nt, Human
cauuccaacugcugccccucugucugccuggc

SEQ ID NO: 94342 - RNA, 32 nt, Human
cauuccaacuuaggcuacagaaugagacucug

SEQ ID NO: 94343 - RNA, 28 nt, Human
cauuccaagaaugaagccucaucuugcu

SEQ ID NO: 94344 - RNA, 32 nt, Human
cauuccaaggaggugcaggagaacagcucugu

SEQ ID NO: 94345 - RNA, 32 nt, Human
cauuccacauccggaggagaagaaggaaauga

SEQ ID NO: 94346 - RNA, 32 nt, Human
cauuccacaugugcccuggccacauuugcagc

SEQ ID NO: 94347 - RNA, 32 nt, Human
cauuccaccagcuggcccggccacgucucgaa

SEQ ID NO: 94348 - RNA, 32 nt, Human
cauuccacuauacaauucaguacugauuauuc

SEQ ID NO: 94349 - RNA, 21 nt, Human
cauuccacuccagccugggca

SEQ ID NO: 94350 - RNA, 32 nt, Human
cauuccacugacuaacuuugguguuuuguuuc

SEQ ID NO: 94351 - RNA, 32 nt, Human
cauuccacugcauuucagccugggggauacag

SEQ ID NO: 94352 - RNA, 32 nt, Human
cauuccagacacugcaugugucagccucauga

SEQ ID NO: 94353 - RNA, 32 nt, Human
cauuccagacugggcgacagagcaagacucug

SEQ ID NO: 94354 - RNA, 32 nt, Human
cauuccagacuuuguaccuuaaaguuagagca

SEQ ID NO: 94355 - RNA, 32 nt, Human
cauuccagagaaggaggaaaugcauucucaga

SEQ ID NO: 94356 - RNA, 32 nt, Human
cauuccagagcagaagaaggggguuccucccc

SEQ ID NO: 94357 - RNA, 32 nt, Human
cauuccagagcccucuuguggccaggccuucc

SEQ ID NO: 94358 - RNA, 32 nt, Human
cauuccagaggcuucucagaguucaacauaug

SEQ ID NO: 94359 - RNA, 18 nt, Human
cauuccagaugugugaga

SEQ ID NO: 94360 - RNA, 32 nt, Human
cauuccagccaagugugcuguaaacuguauau

SEQ ID NO: 94361 - RNA, 32 nt, Human
cauuccagccaggaugacagagcaagacugca

SEQ ID NO: 94362 - RNA, 18 nt, Human
cauuccagccaggcccag

SEQ ID NO: 94363 - RNA, 32 nt, Human
cauuccagccagggugacagagugagaccaug

SEQ ID NO: 94364 - RNA, 32 nt, Human
cauuccagccuaagcaauagagcgagacuccc

SEQ ID NO: 94365 - RNA, 32 nt, Human
cauuccagccuggacgacagagcgagacuccg

SEQ ID NO: 94366 - RNA, 32 nt, Human
cauuccagccuggauaauagagugagacccua

SEQ ID NO: 94367 - RNA, 32 nt, Human
cauuccagccuggaugauggagcgagacucug

SEQ ID NO: 94368 - RNA, 32 nt, Human
cauuccagccuggcgacagagcaagacuccau

SEQ ID NO: 94369 - RNA, 32 nt, Human
cauuccagccuggcgacagagugagacuccau

SEQ ID NO: 94370 - RNA, 32 nt, Human
cauuccagccugggagacggagcaagacucca

SEQ ID NO: 94371 - RNA, 32 nt, Human
cauuccagccugggcaacaagagcgaaacucc

SEQ ID NO: 94372 - RNA, 32 nt, Human
cauuccagccugggcaacaagagcgaaacucu

SEQ ID NO: 94373 - RNA, 32 nt, Human
cauuccagccugggcaacacgagcgaaacucc

SEQ ID NO: 94374 - RNA, 32 nt, Human
cauuccagccugggcaacagagcaagacccug

SEQ ID NO: 94375 - RNA, 32 nt, Human
cauuccagccugggcaacagagcaagaccucg

SEQ ID NO: 94376 - RNA, 32 nt, Human
cauuccagccugggcaacagagcaagacuguc

SEQ ID NO: 94377 - RNA, 32 nt, Human
cauuccagccugggcaacagagcgagacucca

SEQ ID NO: 94378 - RNA, 32 nt, Human
cauuccagccugggcaacagagugaggcugug

SEQ ID NO: 94379 - RNA, 32 nt, Human
cauuccagccugggcaacagcgugagacuuca

SEQ ID NO: 94380 - RNA, 32 nt, Human
cauuccagccugggcacuagagugagacucug

SEQ ID NO: 94381 - RNA, 32 nt, Human
cauuccagccugggcgaaagagaaagaccgug

SEQ ID NO: 94382 - RNA, 32 nt, Human
cauuccagccugggcgacagagcaagacucca

SEQ ID NO: 94383 - RNA, 32 nt, Human
cauuccagccugggcgacagagcaagacucug

SEQ ID NO: 94384 - RNA, 32 nt, Human
cauuccagccugggcgacagagugagacccag

SEQ ID NO: 94385 - RNA, 32 nt, Human
cauuccagccugggcgauggagugagaccuca

SEQ ID NO: 94386 - RNA, 32 nt, Human
cauuccagccuggguacacagcgagacccugu

SEQ ID NO: 94387 - RNA, 32 nt, Human
cauuccagccugggugacagaaugaaacucca

SEQ ID NO: 94388 - RNA, 32 nt, Human
cauuccagccugggugacagaaugaaauccug

SEQ ID NO: 94389 - RNA, 32 nt, Human
cauuccagccugggugacagagcaagacucug

SEQ ID NO: 94390 - RNA, 32 nt, Human
cauuccagccugggugacagagccagacuccg

SEQ ID NO: 94391 - RNA, 32 nt, Human
cauuccagccugggugacagagcgagaccaug

SEQ ID NO: 94392 - RNA, 32 nt, Human
cauuccagccugggugacagagcgagacccug

SEQ ID NO: 94393 - RNA, 32 nt, Human
cauuccagccugggugacagagcgagacucca

SEQ ID NO: 94394 - RNA, 32 nt, Human
cauuccagccugggugacagagcgagacuccg

SEQ ID NO: 94395 - RNA, 32 nt, Human
cauuccagccugggugacagagcgagacuguc

SEQ ID NO: 94396 - RNA, 32 nt, Human
cauuccagccugggugacagagcuagacucug

SEQ ID NO: 94397 - RNA, 32 nt, Human
cauuccagccugggugacagagugagacccug

SEQ ID NO: 94398 - RNA, 32 nt, Human
cauuccagccugggugacagagugagacucca

SEQ ID NO: 94399 - RNA, 32 nt, Human
cauuccagccugggugacagagugagauccug

SEQ ID NO: 94400 - RNA, 32 nt, Human
cauuccagccugggugacauaucaagaccugu

SEQ ID NO: 94401 - RNA, 32 nt, Human
cauuccagccugggugacugagcgagacucug

SEQ ID NO: 94402 - RNA, 32 nt, Human
cauuccagccuggugacagagcgagacucagu

SEQ ID NO: 94403 - RNA, 32 nt, Human
cauuccagccugguugacagagugagacuccg

SEQ ID NO: 94404 - RNA, 32 nt, Human
cauuccagccuuggcgacagagcgagacucca

SEQ ID NO: 94405 - RNA, 32 nt, Human
cauuccagccuuggugacagagcaagacccug

SEQ ID NO: 94406 - RNA, 31 nt, Human
cauuccagcggagacuuauguaggagggacc

SEQ ID NO: 94407 - RNA, 32 nt, Human
cauuccagcuucccugucucuuccugccugug

SEQ ID NO: 94408 - RNA, 32 nt, Human
cauuccagcuugggcgacagagcgagacccag

SEQ ID NO: 94409 - RNA, 32 nt, Human
cauuccaggagacuuguagcucagccacacac

SEQ ID NO: 94410 - RNA, 32 nt, Human
cauuccaggaguggccugugccucccaccucu

SEQ ID NO: 94411 - RNA, 32 nt, Human
cauuccaggcagagaaggagcagaggcucucc

SEQ ID NO: 94412 - RNA, 32 nt, Human
cauuccaggugggugcuggcagcucugaaggu

SEQ ID NO: 94413 - RNA, 32 nt, Human
cauuccaguagaaaacucucucugcaaguccu

SEQ ID NO: 94414 - RNA, 32 nt, Human
cauuccagucagagaaggaaacaggggaucgg

SEQ ID NO: 94415 - RNA, 32 nt, Human
cauuccagucucagucaucaugcggccuccuc

SEQ ID NO: 94416 - RNA, 32 nt, Human
cauuccagugguggaggcgcuguggauggcug

SEQ ID NO: 94417 - RNA, 32 nt, Human
cauuccaguucauaaguauuuguauaugucuu

SEQ ID NO: 94418 - RNA, 32 nt, Human
cauuccauaaugacugaaucaaggaggaaaau

SEQ ID NO: 94419 - RNA, 32 nt, Human
cauuccauacaaaaucucacgacuggcaaaag

SEQ ID NO: 94420 - RNA, 32 nt, Human
cauuccaucccaagcuucucccuuacccacac

SEQ ID NO: 94421 - RNA, 32 nt, Human
cauuccauccccaguccagccugggcaacccc

SEQ ID NO: 94422 - RNA, 32 nt, Human
cauuccaugccagcaccucugcagccugcugg

SEQ ID NO: 94423 - RNA, 32 nt, Human
cauuccauggagaaagcuguguuccaaugaau

SEQ ID NO: 94424 - RNA, 32 nt, Human
cauuccauguacaucuguacgcaugucagagu

SEQ ID NO: 94425 - RNA, 32 nt, Human
cauuccauuacacuccagccugggcaccagga

SEQ ID NO: 94426 - RNA, 32 nt, Human
cauucccaacaacauccucugccacacacaac

SEQ ID NO: 94427 - RNA, 32 nt, Human
cauucccaacaguguaaaagcauucauguuuc

SEQ ID NO: 94428 - RNA, 31 nt, Human
cauucccaacuagacauuaccaaagugaccu

SEQ ID NO: 94429 - RNA, 32 nt, Human
cauucccaaugccauccccaaccacaaccaca

SEQ ID NO: 94430 - RNA, 32 nt, Human
cauucccacagcuuugauuuuauuugcauuua

SEQ ID NO: 94431 - RNA, 32 nt, Human
cauucccacauacauucacuauuuucacacac

SEQ ID NO: 94432 - RNA, 23 nt, Human
cauucccaccucccucuagggca

SEQ ID NO: 94433 - RNA, 32 nt, Human
cauucccacgucuucuugcugcagccugcccc

SEQ ID NO: 94434 - RNA, 32 nt, Human
cauucccacugaggaugaggcccuggggaccc

SEQ ID NO: 94435 - RNA, 32 nt, Human
cauucccacugaggcccgcgcucccugggagg

SEQ ID NO: 94436 - RNA, 32 nt, Human
cauucccacugcacuuggugcugcuuuggcug

SEQ ID NO: 94437 - RNA, 32 nt, Human
cauucccacuucaccuuccuccauucagucug

SEQ ID NO: 94438 - RNA, 32 nt, Human
cauucccagcuacuugggaggcugaggcagga

SEQ ID NO: 94439 - RNA, 32 nt, Human
cauucccaggagacccagggugauuaaaauuu

SEQ ID NO: 94440 - RNA, 32 nt, Human
cauucccaggagggggagcuuggagcgaguca

SEQ ID NO: 94441 - RNA, 32 nt, Human
cauucccagucaugaaauguagaagacuggaa

SEQ ID NO: 94442 - RNA, 32 nt, Human
cauucccaucacggugcuccagccggcccugc

SEQ ID NO: 94443 - RNA, 32 nt, Human
cauucccauccuccccugauaggccccuccuc

SEQ ID NO: 94444 - RNA, 32 nt, Human
cauucccauccuuccugguacugcagucaacc

SEQ ID NO: 94445 - RNA, 32 nt, Human
cauucccaugcauccugauccuuaagauuaug

SEQ ID NO: 94446 - RNA, 24 nt, Human
cauucccauuaauguccucauuca

SEQ ID NO: 94447 - RNA, 32 nt, Human
cauucccauuggccaaacccaaagagaaguca

SEQ ID NO: 94448 - RNA, 22 nt, Human
cauuccccacuuuugcuaugcu

SEQ ID NO: 94449 - RNA, 32 nt, Human
cauuccccaugagucccccacacccaccccau

SEQ ID NO: 94450 - RNA, 32 nt, Human
cauucccccacugccucacagccucagucacc

SEQ ID NO: 94451 - RNA, 32 nt, Human
cauucccccuaaaaacagagugaccuggaagu

SEQ ID NO: 94452 - RNA, 32 nt, Human
cauucccccuggcacugcgggggccuggccag

SEQ ID NO: 94453 - RNA, 32 nt, Human
cauuccccgagcacuccagccuggcagucagc

SEQ ID NO: 94454 - RNA, 32 nt, Human
cauuccccgucucugguuccuccccuccuccu

SEQ ID NO: 94455 - RNA, 32 nt, Human
cauuccccugaauauuuuugcauucauauuuu

SEQ ID NO: 94456 - RNA, 32 nt, Human
cauuccccugcucccccugucccuuccccauc

SEQ ID NO: 94457 - RNA, 32 nt, Human
cauucccgccugggcagcagagcgagacuccg

SEQ ID NO: 94458 - RNA, 32 nt, Human
cauucccgggguggcgggguuagaugagcggc

SEQ ID NO: 94459 - RNA, 32 nt, Human
cauucccuacuucauccuugcugagcuaaauu

SEQ ID NO: 94460 - RNA, 32 nt, Human
cauucccucagugcuucucuucugaccugcau

SEQ ID NO: 94461 - RNA, 32 nt, Human
cauucccuccacccacuugccugucaccccag

SEQ ID NO: 94462 - RNA, 32 nt, Human
cauucccuccauacagcuucugugcuuauaua

SEQ ID NO: 94463 - RNA, 32 nt, Human
cauucccucccagccuuugaggccgggugcag

SEQ ID NO: 94464 - RNA, 17 nt, Human
cauucccuccccuccca

SEQ ID NO: 94465 - RNA, 32 nt, Human
cauucccuccuuuuguucuuccuuccugccuu

SEQ ID NO: 94466 - RNA, 32 nt, Human
cauucccucuauaaggcguuacuacauuuaug

SEQ ID NO: 94467 - RNA, 32 nt, Human
cauucccucuccccucucuauccaaccccauu

SEQ ID NO: 94468 - RNA, 32 nt, Human
cauucccugagucaccaggaauguuaaaguca

SEQ ID NO: 94469 - RNA, 21 nt, Human
cauucccugcacaugaacaug

SEQ ID NO: 94470 - RNA, 17 nt, Human
cauucccugcagaguca

SEQ ID NO: 94471 - RNA, 32 nt, Human
cauucccugcugcaccuggucugcaggggugc

SEQ ID NO: 94472 - RNA, 32 nt, Human
cauucccugcuggucaugcagugucuguauau

SEQ ID NO: 94473 - RNA, 32 nt, Human
cauucccugcuuguaucaaaacaucucaugua

SEQ ID NO: 94474 - RNA, 32 nt, Human
cauucccuggagggugacuggggaagaauugc

SEQ ID NO: 94475 - RNA, 32 nt, Human
cauucccuggaguuugggggaaggggaaucau

SEQ ID NO: 94476 - RNA, 21 nt, Human
cauucccuggccucugccaua

SEQ ID NO: 94477 - RNA, 19 nt, Human
cauucccugugcaacauca

SEQ ID NO: 94478 - RNA, 20 nt, Human
cauucccugugcuugaguca

SEQ ID NO: 94479 - RNA, 21 nt, Human
cauucccuuccacagcucaua

SEQ ID NO: 94480 - RNA, 21 nt, Human
cauucccuugacaauguuaua

SEQ ID NO: 94481 - RNA, 32 nt, Human
cauucccuugauaucaguccccuucacugcag

SEQ ID NO: 94482 - RNA, 19 nt, Human
cauucccuuggaaugcaua

SEQ ID NO: 94483 - RNA, 32 nt, Human
cauucccuugggcccaggcuuaugaccugcac

SEQ ID NO: 94484 - RNA, 21 nt, Human
cauucccuugugugacucaua

SEQ ID NO: 94485 - RNA, 32 nt, Human
cauucccuuugccuucucugaguguuuaggga

SEQ ID NO: 94486 - RNA, 32 nt, Human
cauucccuuuucuccccacuccuccagaaggc

SEQ ID NO: 94487 - RNA, 32 nt, Human
cauuccgaaaucaagaaacucauguucuuaac

SEQ ID NO: 94488 - RNA, 32 nt, Human
cauuccgacuucagaaaaucgaagcagcuggc

SEQ ID NO: 94489 - RNA, 32 nt, Human
cauuccgccccagcuacugagggaggggacag

SEQ ID NO: 94490 - RNA, 32 nt, Human
cauuccgcccccgccucaacgcccagcacagu

SEQ ID NO: 94491 - RNA, 32 nt, Human
cauuccgccugucucccuaacccuccauugcc

SEQ ID NO: 94492 - RNA, 32 nt, Human
cauuccggcccaccucccucuggccggacaga

SEQ ID NO: 94493 - RNA, 32 nt, Human
cauuccggccugggcgacagagcgagacucug

SEQ ID NO: 94494 - RNA, 32 nt, Human
cauuccguuuccacuccagccuguuguguugu

SEQ ID NO: 94495 - RNA, 32 nt, Human
cauuccuaccggagcaucccagaccugcucca

SEQ ID NO: 94496 - RNA, 20 nt, Human
cauuccuaccuagugucaua

SEQ ID NO: 94497 - RNA, 32 nt, Human
cauuccuaccuagugucauaaaagcaaaauac

SEQ ID NO: 94498 - RNA, 32 nt, Human
cauuccuauguaaaugcccuccauaaaaaccc

SEQ ID NO: 94499 - RNA, 32 nt, Human
cauuccuauuucagaagauuguuaaagcaaaa

SEQ ID NO: 94500 - RNA, 32 nt, Human
cauuccuccagcccuagacucccaagccccag

SEQ ID NO: 94501 - RNA, 32 nt, Human
cauuccuccagccuccccuccccuggggacgc

SEQ ID NO: 94502 - RNA, 32 nt, Human
cauuccuccauuugguuaaaauacucagugca

SEQ ID NO: 94503 - RNA, 32 nt, Human
cauuccucccaagguggcaaaaauuagcuaua

SEQ ID NO: 94504 - RNA, 32 nt, Human
cauuccucccacagaucuugccccuuaccaca

SEQ ID NO: 94505 - RNA, 32 nt, Human
cauuccucccauucaagauucccacuccccag

SEQ ID NO: 94506 - RNA, 22 nt, Human
cauuccuccccuccaagaggua

SEQ ID NO: 94507 - RNA, 16 nt, Human
cauuccuccccuccca

SEQ ID NO: 94508 - RNA, 32 nt, Human
cauuccuccuaaggagcuggugucuucaucca

SEQ ID NO: 94509 - RNA, 31 nt, Human
cauuccuccuccccugggccucucucccuuu

SEQ ID NO: 94510 - RNA, 32 nt, Human
cauuccuccuggcaacagccagagccugggcg

SEQ ID NO: 94511 - RNA, 32 nt, Human
cauuccuccuggguuuuaguggcauugccuuc

SEQ ID NO: 94512 - RNA, 32 nt, Human
cauuccucguuucucacacuuaggaccccucc

SEQ ID NO: 94513 - RNA, 32 nt, Human
cauuccucuagccucugcuggagugcagugag

SEQ ID NO: 94514 - RNA, 32 nt, Human
cauuccucuccucuucacuagccucucugaag

SEQ ID NO: 94515 - RNA, 32 nt, Human
cauuccucucucuguguaucugugccagaugu

SEQ ID NO: 94516 - RNA, 32 nt, Human
cauuccucucugcuucucagcagcuguccuac

SEQ ID NO: 94517 - RNA, 32 nt, Human
cauuccucugauagaacaaagcgaaaugcagg

SEQ ID NO: 94518 - RNA, 32 nt, Human
cauuccucugcaggcaacuaggagaaccuaac

SEQ ID NO: 94519 - RNA, 32 nt, Human
cauuccucugcucuccucuauucuccaugucg

SEQ ID NO: 94520 - RNA, 32 nt, Human
cauuccugaagggugauaugaaaguuaacccc

SEQ ID NO: 94521 - RNA, 32 nt, Human
cauuccugaggggcccagaaauggcggcguug

SEQ ID NO: 94522 - RNA, 32 nt, Human
cauuccugccgcugccgucccugcugccucau

SEQ ID NO: 94523 - RNA, 18 nt, Human
cauuccugcgcauggugc

SEQ ID NO: 94524 - RNA, 32 nt, Human
cauuccugcuucucaagggacacaguggccug

SEQ ID NO: 94525 - RNA, 32 nt, Human
cauuccugcuucucuggggacacagugggccc

SEQ ID NO: 94526 - RNA, 32 nt, Human
cauuccuggacacccucaccacccaacaguga

SEQ ID NO: 94527 - RNA, 19 nt, Human
cauuccuggacuccuccca

SEQ ID NO: 94528 - RNA, 32 nt, Human
cauuccuggagugcugcugaggagcgagggcc

SEQ ID NO: 94529 - RNA, 19 nt, Human
cauuccuggcuacggggag

SEQ ID NO: 94530 - RNA, 32 nt, Human
cauuccuguaaucccagcuacucgggaggcug

SEQ ID NO: 94531 - RNA, 32 nt, Human
cauuccuguaaucccagcucuuugggaggcug

SEQ ID NO: 94532 - RNA, 32 nt, Human
cauuccuguauucacccguccagaccuuguuc

SEQ ID NO: 94533 - RNA, 32 nt, Human
cauuccugucugggugaagaggagacguguua

SEQ ID NO: 94534 - RNA, 32 nt, Human
cauuccuguuuuguugaagcagccacuggucc

SEQ ID NO: 94535 - RNA, 22 nt, Human
cauuccuguuuuucuuggcagg

SEQ ID NO: 94536 - RNA, 32 nt, Human
cauuccuuauuccacuuggauuuccuauagca

SEQ ID NO: 94537 - RNA, 32 nt, Human
cauuccuucacucauccauccuacguauauuu

SEQ ID NO: 94538 - RNA, 32 nt, Human
cauuccuucauuccucaccuuuauccuguuau

SEQ ID NO: 94539 - RNA, 32 nt, Human
cauuccuuccugaacauauucugcaccucguc

SEQ ID NO: 94540 - RNA, 32 nt, Human
cauuccuuccuucucccaucuggauuccuaag

SEQ ID NO: 94541 - RNA, 32 nt, Human
cauuccuuccuuucuuucccgacuucuuuaau

SEQ ID NO: 94542 - RNA, 32 nt, Human
cauuccuucuggaguuuguuuuugaaacuccu

SEQ ID NO: 94543 - RNA, 32 nt, Human
cauuccuucuguccuuggaggccagaggggac

SEQ ID NO: 94544 - RNA, 32 nt, Human
cauuccuuggaguuauacuaacuaauaaugaa

SEQ ID NO: 94545 - RNA, 32 nt, Human
cauuccuuggcugucagugcugcccagauuca

SEQ ID NO: 94546 - RNA, 32 nt, Human
cauuccuuggcuuguagaugcaucaccccagu

SEQ ID NO: 94547 - RNA, 21 nt, Human
cauuccuuuacacaugaucua

SEQ ID NO: 94548 - RNA, 32 nt, Human
cauuccuuucccagcuccagccuggagggaag

SEQ ID NO: 94549 - RNA, 20 nt, Human
cauuccuuuccucccuuccc

SEQ ID NO: 94550 - RNA, 32 nt, Human
cauuccuuuccucccuucccccuggcagguag

SEQ ID NO: 94551 - RNA, 32 nt, Human
cauuccuuuguggagccuacaucuucauaagc

SEQ ID NO: 94552 - RNA, 32 nt, Human
cauuccuuuguuguugauaaugggcuuuguua

SEQ ID NO: 94553 - RNA, 32 nt, Human
cauucgaagaaacccuugcugcuuuagucccg

SEQ ID NO: 94554 - RNA, 32 nt, Human
cauucgacaauacaucuugacuguuucuucaa

SEQ ID NO: 94555 - RNA, 32 nt, Human
cauucgaucaacauacucagaaauaucacccc

SEQ ID NO: 94556 - RNA, 32 nt, Human
cauucgccagugccacuguuggaagcugcuug

SEQ ID NO: 94557 - RNA, 19 nt, Human
cauucgcugcagacccugg

SEQ ID NO: 94558 - RNA, 21 nt, Human
cauucgcuuucaaacaugauc

SEQ ID NO: 94559 - RNA, 32 nt, Human
cauucggagcagugugggugggggcgcucugg

SEQ ID NO: 94560 - RNA, 32 nt, Human
cauucggaggcugguguccagggucucagcgc

SEQ ID NO: 94561 - RNA, 19 nt, Human
cauucggcauacucacuca

SEQ ID NO: 94562 - RNA, 32 nt, Human
cauucggggagaaagaagagaccccgcacuug

SEQ ID NO: 94563 - RNA, 32 nt, Human
cauucgucauuuccucaucugcacagucagcu

SEQ ID NO: 94564 - RNA, 31 nt, Human
cauucgugacuucuccacccaaggacacucc

SEQ ID NO: 94565 - RNA, 32 nt, Human
cauucuaaaggaggguuugugauugucaccau

SEQ ID NO: 94566 - RNA, 32 nt, Human
cauucuaaccuucacagacagacuggaggcug

SEQ ID NO: 94567 - RNA, 32 nt, Human
cauucuaacucauauguucccaauuaccaagg

SEQ ID NO: 94568 - RNA, 32 nt, Human
cauucuaagcuuaaccuccuggucucauggca

SEQ ID NO: 94569 - RNA, 31 nt, Human
cauucuacuugcuuauuacauuuaaacccuu

SEQ ID NO: 94570 - RNA, 32 nt, Human
cauucuagaaauaacaaaaauccugauaaagc

SEQ ID NO: 94571 - RNA, 32 nt, Human
cauucuagaccagccaauuggugggacagcgu

SEQ ID NO: 94572 - RNA, 32 nt, Human
cauucuagaccagcucaaagauuccaugaguu

SEQ ID NO: 94573 - RNA, 32 nt, Human
cauucuagauuacuuuucuuacucugaaacau

SEQ ID NO: 94574 - RNA, 18 nt, Human
cauucuagcagugucaua

SEQ ID NO: 94575 - RNA, 32 nt, Human
cauucuagccuggaugacagagcaagacucug

SEQ ID NO: 94576 - RNA, 32 nt, Human
cauucuagccugggcaacagaguaagacuccg

SEQ ID NO: 94577 - RNA, 32 nt, Human
cauucuagccugggcaacagagugagauccug

SEQ ID NO: 94578 - RNA, 32 nt, Human
cauucuagccugggcgauagagugagacuccg

SEQ ID NO: 94579 - RNA, 32 nt, Human
cauucuagccugggugacagagcgagacucug

SEQ ID NO: 94580 - RNA, 32 nt, Human
cauucuagccugggugacagugagacugucuc

SEQ ID NO: 94581 - RNA, 21 nt, Human
cauucuagcuuccucaccuca

SEQ ID NO: 94582 - RNA, 32 nt, Human
cauucuaggcaauccacccacccaugagggga

SEQ ID NO: 94583 - RNA, 32 nt, Human
cauucuaggcuggauucuacugaaguagaggc

SEQ ID NO: 94584 - RNA, 31 nt, Human
cauucuaggugagcuuacacauuccuuccaa

SEQ ID NO: 94585 - RNA, 31 nt, Human
cauucuaguuuauauuuucauuuaaaauccu

SEQ ID NO: 94586 - RNA, 32 nt, Human
cauucuauagugacaucaucccagacugccuu

SEQ ID NO: 94587 - RNA, 32 nt, Human
cauucuaucacccaggcuggaguggaguggua

SEQ ID NO: 94588 - RNA, 32 nt, Human
cauucuaucgcccaggcuggagugcaauggca

SEQ ID NO: 94589 - RNA, 32 nt, Human
cauucuaugaccaccgcccccaaccagcugcc

SEQ ID NO: 94590 - RNA, 32 nt, Human
cauucuauguagccaugucacugugaauaacg

SEQ ID NO: 94591 - RNA, 32 nt, Human
cauucuauucucauuccuuucucuccaaugag

SEQ ID NO: 94592 - RNA, 32 nt, Human
cauucucacagcccugcuggaccaaggcaucu

SEQ ID NO: 94593 - RNA, 32 nt, Human
cauucucaccuaucuucucucuugcuccaucu

SEQ ID NO: 94594 - RNA, 32 nt, Human
cauucucacgugaaauauaaaaagcaagucuu

SEQ ID NO: 94595 - RNA, 32 nt, Human
cauucucagaacaaagacagcaaccaaugagc

SEQ ID NO: 94596 - RNA, 32 nt, Human
cauucucagauuugcuuaguugugcauuugua

SEQ ID NO: 94597 - RNA, 32 nt, Human
cauucucaggccacugcauuuagccugggcga

SEQ ID NO: 94598 - RNA, 32 nt, Human
cauucucauagguccaguuuaagaucucauuc

SEQ ID NO: 94599 - RNA, 32 nt, Human
cauucucaucgauacuuccuggacauauuuug

SEQ ID NO: 94600 - RNA, 23 nt, Human
cauucucaugucagacugaaagg

SEQ ID NO: 94601 - RNA, 32 nt, Human
cauucuccaaauugcuaaucucuauccagucu

SEQ ID NO: 94602 - RNA, 32 nt, Human
cauucuccagucccucagucccuucccgcgcg

SEQ ID NO: 94603 - RNA, 32 nt, Human
cauucucccacaggauggugaggcugggagga

SEQ ID NO: 94604 - RNA, 32 nt, Human
cauucucccccucuuugggcagugccauggau

SEQ ID NO: 94605 - RNA, 32 nt, Human
cauucuccccucuccuaggagcucuuuugucu

SEQ ID NO: 94606 - RNA, 32 nt, Human
cauucucccugagaugaugucuucaguaauga

SEQ ID NO: 94607 - RNA, 32 nt, Human
cauucuccgagaugcugaggcagaaguacuuu

SEQ ID NO: 94608 - RNA, 21 nt, Human
cauucuccuaguccucaccca

SEQ ID NO: 94609 - RNA, 32 nt, Human
cauucuccuccuccucccuccucacucccuag

SEQ ID NO: 94610 - RNA, 32 nt, Human
cauucuccugcaguuggauauuuagguuguuu

SEQ ID NO: 94611 - RNA, 32 nt, Human
cauucuccugccucagccuccccagcagcugg

SEQ ID NO: 94612 - RNA, 32 nt, Human
cauucuccugccucagcuacucaggaggcuga

SEQ ID NO: 94613 - RNA, 32 nt, Human
cauucuccugccucagcuucccgaguagcugg

SEQ ID NO: 94614 - RNA, 32 nt, Human
cauucuccugccucagcuuccugaguagcugg

SEQ ID NO: 94615 - RNA, 32 nt, Human
cauucuccuugccucuuagcauguuugauuua

SEQ ID NO: 94616 - RNA, 32 nt, Human
cauucucgcccucccuuuuccucucuccuccu

SEQ ID NO: 94617 - RNA, 32 nt, Human
cauucucuagaucuauugucuccuuuacguau

SEQ ID NO: 94618 - RNA, 32 nt, Human
cauucucucacauuccacaugauauagagggc

SEQ ID NO: 94619 - RNA, 32 nt, Human
cauucucuccaacucuucaucucccugaucuu

SEQ ID NO: 94620 - RNA, 32 nt, Human
cauucucuccaucccuuccaucccaggcaauc

SEQ ID NO: 94621 - RNA, 32 nt, Human
cauucucucccaugacacccagaaggggcaga

SEQ ID NO: 94622 - RNA, 32 nt, Human
cauucucuccccaccacucucuucucguggcc

SEQ ID NO: 94623 - RNA, 17 nt, Human
cauucucucuccuccca

SEQ ID NO: 94624 - RNA, 32 nt, Human
cauucucucuccuuuuccaucuggaccaccca

SEQ ID NO: 94625 - RNA, 32 nt, Human
cauucucugaagaguggguuucacaagugaaa

SEQ ID NO: 94626 - RNA, 32 nt, Human
cauucucugcccacuuugccuuccaggaaaug

SEQ ID NO: 94627 - RNA, 32 nt, Human
cauucucugccucugccucauauucuuguuag

SEQ ID NO: 94628 - RNA, 32 nt, Human
cauucucuguaaccugugcggugugguuccug

SEQ ID NO: 94629 - RNA, 23 nt, Human
cauucucuucaaucucucacuca

SEQ ID NO: 94630 - RNA, 32 nt, Human
cauucucuuccacagcccugaggucuuacgaa

SEQ ID NO: 94631 - RNA, 32 nt, Human
cauucucuugagagacaggggagaagaaaauu

SEQ ID NO: 94632 - RNA, 32 nt, Human
cauucucuuuggccacaauggcagccucagcu

SEQ ID NO: 94633 - RNA, 23 nt, Human
cauucugaauaaagucuucuaca

SEQ ID NO: 94634 - RNA, 32 nt, Human
cauucugacagcugagcaggaggcagagguga

SEQ ID NO: 94635 - RNA, 32 nt, Human
cauucugagaguugccccacccuaccugccuu

SEQ ID NO: 94636 - RNA, 32 nt, Human
cauucugaguagauuuaagagaacaaaagaca

SEQ ID NO: 94637 - RNA, 32 nt, Human
cauucugauaaaugugucauuaggcaauugca

SEQ ID NO: 94638 - RNA, 32 nt, Human
cauucugauauuucuccucaauucuaggcaug

SEQ ID NO: 94639 - RNA, 32 nt, Human
cauucugauuucucucaccaaagacuggaaaa

SEQ ID NO: 94640 - RNA, 32 nt, Human
cauucugcaacaaccagggacuucacaggagc

SEQ ID NO: 94641 - RNA, 32 nt, Human
cauucugcacacagucucugcaugaacucagg

SEQ ID NO: 94642 - RNA, 32 nt, Human
cauucugcaguuggugccagaacucuggaucc

SEQ ID NO: 94643 - RNA, 32 nt, Human
cauucugcauucccauuuuucucuccacgugu

SEQ ID NO: 94644 - RNA, 32 nt, Human
cauucugcccccgcccuuccuccccuuauuug

SEQ ID NO: 94645 - RNA, 32 nt, Human
cauucugcccuccugggccccucucucccuga

SEQ ID NO: 94646 - RNA, 32 nt, Human
cauucugccgugagccacugcgcccggccucc

SEQ ID NO: 94647 - RNA, 32 nt, Human
cauucugccuccauucugaccauuucaggggu

SEQ ID NO: 94648 - RNA, 21 nt, Human
cauucugccucuacauuucuu

SEQ ID NO: 94649 - RNA, 32 nt, Human
cauucugcugguggcuuccugcgucuuucugc

SEQ ID NO: 94650 - RNA, 32 nt, Human
cauucuggaggugggagugggagagcugccug

SEQ ID NO: 94651 - RNA, 32 nt, Human
cauucuggccaacauagugaaaccccaucucu

SEQ ID NO: 94652 - RNA, 32 nt, Human
cauucuggccaacauagugaaaccccgucucu

SEQ ID NO: 94653 - RNA, 32 nt, Human
cauucuggccaacauggugaaaccccuucucu

SEQ ID NO: 94654 - RNA, 32 nt, Human
cauucuggccaacauggugaaacccuguuucu

SEQ ID NO: 94655 - RNA, 32 nt, Human
cauucuggccugggugacagaguuagacugug

SEQ ID NO: 94656 - RNA, 32 nt, Human
cauucugggaggccgaggcgggcagaucacuu

SEQ ID NO: 94657 - RNA, 32 nt, Human
cauucugggaugcagcagcuacugcccacaga

SEQ ID NO: 94658 - RNA, 32 nt, Human
cauucugggcuuugcuguaucuaucuagugcc

SEQ ID NO: 94659 - RNA, 32 nt, Human
cauucuggggcagauguuugggccgggaacaa

SEQ ID NO: 94660 - RNA, 32 nt, Human
cauucugggguuucuugaaucuuguccaaaaa

SEQ ID NO: 94661 - RNA, 32 nt, Human
cauucuggugcuguccucacucgccccuggcc

SEQ ID NO: 94662 - RNA, 32 nt, Human
cauucuguaccccuuccccagccugggccuug

SEQ ID NO: 94663 - RNA, 32 nt, Human
cauucugucacccagacuggagugcagugcca

SEQ ID NO: 94664 - RNA, 32 nt, Human
cauucugucacccaggccggagugcaguggug

SEQ ID NO: 94665 - RNA, 32 nt, Human
cauucugucacccaggcuagagcgcaguggca

SEQ ID NO: 94666 - RNA, 32 nt, Human
cauucugucacccaggcuagaguacaguggga

SEQ ID NO: 94667 - RNA, 32 nt, Human
cauucugucacccaggcuggaguccaaugggg

SEQ ID NO: 94668 - RNA, 32 nt, Human
cauucugucacccaggcuggagugcaaaggug

SEQ ID NO: 94669 - RNA, 32 nt, Human
cauucugucacccaggcuggagugcaguggcg

SEQ ID NO: 94670 - RNA, 32 nt, Human
cauucugucacccaggcuggagugcaguggug

SEQ ID NO: 94671 - RNA, 32 nt, Human
cauucugucacccgggcuggagugcaguggcg

SEQ ID NO: 94672 - RNA, 32 nt, Human
cauucugucacucaggcuggagugcaguggcg

SEQ ID NO: 94673 - RNA, 18 nt, Human
cauucuguccccuuccca

SEQ ID NO: 94674 - RNA, 32 nt, Human
cauucugucgcccaggcuggaguguagugacg

SEQ ID NO: 94675 - RNA, 32 nt, Human
cauucugucgcccuggcuggagugcaauggug

SEQ ID NO: 94676 - RNA, 32 nt, Human
cauucugucucugcuuggcuuccccuccaccc

SEQ ID NO: 94677 - RNA, 32 nt, Human
cauucugucuucaugaggucucacagucgacg

SEQ ID NO: 94678 - RNA, 32 nt, Human
cauucugugagauuugacagauggugacaaua

SEQ ID NO: 94679 - RNA, 32 nt, Human
cauucuguggucucugaaugugccuucccccu

SEQ ID NO: 94680 - RNA, 32 nt, Human
cauucugugguguuucgugcugucuuaaauaa

SEQ ID NO: 94681 - RNA, 32 nt, Human
cauucuguugcccaaguuggagugcaguggca

SEQ ID NO: 94682 - RNA, 32 nt, Human
cauucuguugcccaggcuggagugcaauggca

SEQ ID NO: 94683 - RNA, 32 nt, Human
cauucuguugcccaggcuggagugcaguggcg

SEQ ID NO: 94684 - RNA, 32 nt, Human
cauucuguugcccaggcuggagugcaguggug

SEQ ID NO: 94685 - RNA, 32 nt, Human
cauucuguugcccaugcuggagugcaguggcg

SEQ ID NO: 94686 - RNA, 32 nt, Human
cauucuguugccuaggcuggagugcaguggcg

SEQ ID NO: 94687 - RNA, 32 nt, Human
cauucuuaacauuugggcugugcaaaaacagc

SEQ ID NO: 94688 - RNA, 32 nt, Human
cauucuuagaacuuacacaucuagaacagcuu

SEQ ID NO: 94689 - RNA, 32 nt, Human
cauucuuaggguuuuuccaucccugggguuug

SEQ ID NO: 94690 - RNA, 31 nt, Human
cauucuuagucauaggagguuggcaggacgg

SEQ ID NO: 94691 - RNA, 23 nt, Human
cauucuucacauguuugcuguua

SEQ ID NO: 94692 - RNA, 32 nt, Human
cauucuucacugagugcugcugacuucaacgu

SEQ ID NO: 94693 - RNA, 32 nt, Human
cauucuuccaccucauugaauugcaugcugua

SEQ ID NO: 94694 - RNA, 32 nt, Human
cauucuucccuuuggagaccagucuaggggug

SEQ ID NO: 94695 - RNA, 32 nt, Human
cauucuuccuaacagcugggguugugaggaau

SEQ ID NO: 94696 - RNA, 32 nt, Human
cauucuucuaaccagcccugacauucucauga

SEQ ID NO: 94697 - RNA, 32 nt, Human
cauucuucuacaggaauggaaaaagaguuggg

SEQ ID NO: 94698 - RNA, 32 nt, Human
cauucuucugcucuccugacuuagagaaaugg

SEQ ID NO: 94699 - RNA, 32 nt, Human
cauucuucuggcuuucucucugucgaggacuu

SEQ ID NO: 94700 - RNA, 32 nt, Human
cauucuucuucacgucaauacacuucauauua

SEQ ID NO: 94701 - RNA, 32 nt, Human
cauucuucuuuaccuggucuccuuccuucguc

SEQ ID NO: 94702 - RNA, 32 nt, Human
cauucuugaagucagggagaccaagaacccac

SEQ ID NO: 94703 - RNA, 32 nt, Human
cauucuugagcuccagccuggcuaucucuuuc

SEQ ID NO: 94704 - RNA, 32 nt, Human
cauucuugaggugacaaaauuauugaaaugaa

SEQ ID NO: 94705 - RNA, 32 nt, Human
cauucuugcaaagaaauaccugagacugggua

SEQ ID NO: 94706 - RNA, 18 nt, Human
cauucuugcagcuuggac

SEQ ID NO: 94707 - RNA, 31 nt, Human
cauucuugccucucccuuugucacaguguug

SEQ ID NO: 94708 - RNA, 32 nt, Human
cauucuugcucccauuccugaagcuacagauu

SEQ ID NO: 94709 - RNA, 19 nt, Human
cauucuugcugucaucuca

SEQ ID NO: 94710 - RNA, 21 nt, Human
cauucuugcuucccugacuca

SEQ ID NO: 94711 - RNA, 22 nt, Human
cauucuuggaauaaauucacuc

SEQ ID NO: 94712 - RNA, 32 nt, Human
cauucuuggacaacuuucucuguucuaguuca

SEQ ID NO: 94713 - RNA, 19 nt, Human
cauucuuggauuuaacuua

SEQ ID NO: 94714 - RNA, 32 nt, Human
cauucuuggcauugcaaccuccauuucuagcu

SEQ ID NO: 94715 - RNA, 32 nt, Human
cauucuuguaaucuucuaugguguuuuguggc

SEQ ID NO: 94716 - RNA, 21 nt, Human
cauucuuguguugucccacca

SEQ ID NO: 94717 - RNA, 32 nt, Human
cauucuuguuucaucccugcuucuggacuugg

SEQ ID NO: 94718 - RNA, 21 nt, Human
cauucuuguuuuuucaucuca

SEQ ID NO: 94719 - RNA, 32 nt, Human
cauucuuucccaccauccuuuuugacuguuga

SEQ ID NO: 94720 - RNA, 32 nt, Human
cauucuuuguaccugaggaacauagauucucu

SEQ ID NO: 94721 - RNA, 21 nt, Human
cauucuuuuaguaaugucaua

SEQ ID NO: 94722 - RNA, 32 nt, Human
cauucuuuucucuuggaaagguaggaggcugc

SEQ ID NO: 94723 - RNA, 32 nt, Human
cauucuuuugaaaauauccaugaaagccuauu

SEQ ID NO: 94724 - RNA, 32 nt, Human
cauucuuuugcccaggcuggagugcaguggca

SEQ ID NO: 94725 - RNA, 20 nt, Human
cauucuuuugugauauguua

SEQ ID NO: 94726 - RNA, 32 nt, Human
cauugaaaaccagauuccuccuccaggcaaau

SEQ ID NO: 94727 - RNA, 32 nt, Human
cauugaaaacucaagagcuucgagagccagug

SEQ ID NO: 94728 - RNA, 32 nt, Human
cauugaacaguuacagaucugggacagucccu

SEQ ID NO: 94729 - RNA, 32 nt, Human
cauugaacccaggaggcggagcuugcagugag

SEQ ID NO: 94730 - RNA, 32 nt, Human
cauugaaccucuuggguucaagugauucuugu

SEQ ID NO: 94731 - RNA, 32 nt, Human
cauugaacuagugcuggaauaagaacuaauag

SEQ ID NO: 94732 - RNA, 32 nt, Human
cauugaacuuagagugcuggcucugcuauaug

SEQ ID NO: 94733 - RNA, 32 nt, Human
cauugaagacuaccuaugauagaggcaauguu

SEQ ID NO: 94734 - RNA, 32 nt, Human
cauugaagauucacuuacaaaggaauguuuca

SEQ ID NO: 94735 - RNA, 32 nt, Human
cauugaaggggaccagccgcugaagggauucu

SEQ ID NO: 94736 - RNA, 31 nt, Human
cauugaaguuuaguaguaaaagacugguuaa

SEQ ID NO: 94737 - RNA, 32 nt, Human
cauugaauauauagugguagcagguguacaaa

SEQ ID NO: 94738 - RNA, 32 nt, Human
cauugaaugauggcuaagguguuccaaguauu

SEQ ID NO: 94739 - RNA, 27 nt, Human
cauugaaugugaauggcccucagaaaa

SEQ ID NO: 94740 - RNA, 32 nt, Human
cauugaauuaccacuccugauacagggcuuua

SEQ ID NO: 94741 - RNA, 32 nt, Human
cauugacaaucagccaugucauccaggccucu

SEQ ID NO: 94742 - RNA, 32 nt, Human
cauugacaauggcuccagcacaugcaaagcug

SEQ ID NO: 94743 - RNA, 32 nt, Human
cauugacacauggacucugccugggcauguua

SEQ ID NO: 94744 - RNA, 32 nt, Human
cauugacagaggcuguauguuuggaaagagaa

SEQ ID NO: 94745 - RNA, 32 nt, Human
cauugacagauggagaaacugaggcccaggcc

SEQ ID NO: 94746 - RNA, 32 nt, Human
cauugacagccauguguguggggccuggaagu

SEQ ID NO: 94747 - RNA, 32 nt, Human
cauugacaguguucuaucaccaaugcaaauaa

SEQ ID NO: 94748 - RNA, 32 nt, Human
cauugacauguccugugcuaaauaugaauuca

SEQ ID NO: 94749 - RNA, 32 nt, Human
cauugaccaggaugaucacauggaaggcggcg

SEQ ID NO: 94750 - RNA, 32 nt, Human
cauugaccauggggcuccaucuaggcucugaa

SEQ ID NO: 94751 - RNA, 32 nt, Human
cauugacggagggaggaggaggaggaagaggu

SEQ ID NO: 94752 - RNA, 32 nt, Human
cauugacuccaggacuccacagaauggagcaa

SEQ ID NO: 94753 - RNA, 32 nt, Human
cauugacuuauucacagaugccaucaagcuga

SEQ ID NO: 94754 - RNA, 32 nt, Human
cauugacuuguuugaaccuuagugccuuaccc

SEQ ID NO: 94755 - RNA, 32 nt, Human
cauugacuuuucccaucucuguuaacccacga

SEQ ID NO: 94756 - RNA, 32 nt, Human
cauugagaaaguuauggaagcaacugucacuc

SEQ ID NO: 94757 - RNA, 32 nt, Human
cauugagaacacaagcagcagcaacaucaaca

SEQ ID NO: 94758 - RNA, 32 nt, Human
cauugagaccaggagaucaaggcugcagcgag

SEQ ID NO: 94759 - RNA, 32 nt, Human
cauugagagccuuccauuggucuuccauccgu

SEQ ID NO: 94760 - RNA, 32 nt, Human
cauugagcaaagcaguucuuucagaucugcaa

SEQ ID NO: 94761 - RNA, 32 nt, Human
cauugagcagcugaagcuaacucaugacucug

SEQ ID NO: 94762 - RNA, 17 nt, Human
cauugagcccaaaguca

SEQ ID NO: 94763 - RNA, 32 nt, Human
cauugagcccaggaguccagccugggcaaaau

SEQ ID NO: 94764 - RNA, 21 nt, Human
cauugagcucaccagcgccac

SEQ ID NO: 94765 - RNA, 32 nt, Human
cauugagcucugggacaggacaccuuggguuu

SEQ ID NO: 94766 - RNA, 32 nt, Human
cauugagcugccuccagccugguggcccagcu

SEQ ID NO: 94767 - RNA, 32 nt, Human
cauugagcuuccugccugacccuagagcuccc

SEQ ID NO: 94768 - RNA, 32 nt, Human
cauugaggacaacagccccagcucuuuuucuu

SEQ ID NO: 94769 - RNA, 32 nt, Human
cauugagggcagaguccucauagccuaaucac

SEQ ID NO: 94770 - RNA, 32 nt, Human
cauugagguauggcagagaagacacauauucc

SEQ ID NO: 94771 - RNA, 32 nt, Human
cauugaggucucgguggaugugucugcgccga

SEQ ID NO: 94772 - RNA, 32 nt, Human
cauugagguucacuuccuggauccuuacugcu

SEQ ID NO: 94773 - RNA, 32 nt, Human
cauugagucaucaggaaaacugaagaucuccc

SEQ ID NO: 94774 - RNA, 32 nt, Human
cauugaguuccucaaggaagcuucugucauga

SEQ ID NO: 94775 - RNA, 32 nt, Human
cauugaguuccugcugcugucucccaacaggu

SEQ ID NO: 94776 - RNA, 32 nt, Human
cauugauagucuugugugucucacauaucagc

SEQ ID NO: 94777 - RNA, 32 nt, Human
cauugauauguucaccaaccaggaugcuucac

SEQ ID NO: 94778 - RNA, 32 nt, Human
cauugauauuauccucugaaugcaguuaaggc

SEQ ID NO: 94779 - RNA, 32 nt, Human
cauugaucccuauuucccucuggaucaugacu

SEQ ID NO: 94780 - RNA, 32 nt, Human
cauugaucguguccugugcugaagauguuucc

SEQ ID NO: 94781 - RNA, 32 nt, Human
cauugaucugcuuuuccuaaucaugucaguga

SEQ ID NO: 94782 - RNA, 32 nt, Human
cauugaugacuggagcucugaggucugaggga

SEQ ID NO: 94783 - RNA, 32 nt, Human
cauugauggagcaccugcugcccacagcgucu

SEQ ID NO: 94784 - RNA, 32 nt, Human
cauugaugggaggccauggucguggcuguggc

SEQ ID NO: 94785 - RNA, 32 nt, Human
cauugauguugauguuccaccagaaacaccuu

SEQ ID NO: 94786 - RNA, 32 nt, Human
cauugauugagggaggaggaggaggaagaggu

SEQ ID NO: 94787 - RNA, 32 nt, Human
cauugauuuuuaacaugguucccaccauguaa

SEQ ID NO: 94788 - RNA, 32 nt, Human
cauugauuuuucuccccgugcucccccguucu

SEQ ID NO: 94789 - RNA, 32 nt, Human
cauugcaaagcccucacucaccuucuggucuc

SEQ ID NO: 94790 - RNA, 32 nt, Human
cauugcaaccuccaccuuccagauucucuugc

SEQ ID NO: 94791 - RNA, 32 nt, Human
cauugcaaccuccgccucccucccagguucaa

SEQ ID NO: 94792 - RNA, 32 nt, Human
cauugcacaagaagagccgcugccaaccaucc

SEQ ID NO: 94793 - RNA, 32 nt, Human
cauugcacaaggcagaaaacagcucuggcagg

SEQ ID NO: 94794 - RNA, 32 nt, Human
cauugcacacaugaggaggguaaguggccagc

SEQ ID NO: 94795 - RNA, 32 nt, Human
cauugcacagaagggaaaggucucaaggaaga

SEQ ID NO: 94796 - RNA, 21 nt, Human
cauugcaccccagccugggca

SEQ ID NO: 94797 - RNA, 21 nt, Human
cauugcacuccaaccugggca

SEQ ID NO: 94798 - RNA, 21 nt, Human
cauugcacuccagcccaggua

SEQ ID NO: 94799 - RNA, 20 nt, Human
cauugcacuccagccuaggc

SEQ ID NO: 94800 - RNA, 21 nt, Human
cauugcacuccagccuaggca

SEQ ID NO: 94801 - RNA, 21 nt, Human
cauugcacuccagccucagca

SEQ ID NO: 94802 - RNA, 21 nt, Human
cauugcacuccagccuggaca

SEQ ID NO: 94803 - RNA, 21 nt, Human
cauugcacuccagccugggca

SEQ ID NO: 94804 - RNA, 21 nt, Human
cauugcacuccagcucaggca

SEQ ID NO: 94805 - RNA, 32 nt, Human
cauugcacugcaccugggcaacaagagugaaa

SEQ ID NO: 94806 - RNA, 32 nt, Human
cauugcacugguuaguuuugcggugucugccu

SEQ ID NO: 94807 - RNA, 32 nt, Human
cauugcagagcgggaggccaggaggacucguc

SEQ ID NO: 94808 - RNA, 32 nt, Human
cauugcagauagcgugaaauuaaagauuacag

SEQ ID NO: 94809 - RNA, 32 nt, Human
cauugcagcaaccuuccuucucagccagccua

SEQ ID NO: 94810 - RNA, 24 nt, Human
cauugcagccucaaccucccaggc

SEQ ID NO: 94811 - RNA, 32 nt, Human
cauugcagccucaaccucccaggcucaaucga

SEQ ID NO: 94812 - RNA, 24 nt, Human
cauugcagccucgaccucccaggu

SEQ ID NO: 94813 - RNA, 32 nt, Human
cauugcagccuggugacagagugagacuccau

SEQ ID NO: 94814 - RNA, 32 nt, Human
cauugcagcuacauacuugagauguacucuug

SEQ ID NO: 94815 - RNA, 32 nt, Human
cauugcagcuuggaaucuauuuuaugucacca

SEQ ID NO: 94816 - RNA, 32 nt, Human
cauugcagcuuugaccuccugggcuuagguga

SEQ ID NO: 94817 - RNA, 32 nt, Human
cauugcaggagagaaucugaagggaugaugga

SEQ ID NO: 94818 - RNA, 31 nt, Human
cauugcagugcggcggcccuaccucggcccu

SEQ ID NO: 94819 - RNA, 32 nt, Human
cauugcaucuguguccuguugucauuuauguu

SEQ ID NO: 94820 - RNA, 32 nt, Human
cauugcaugaggaaaauuuuuccagaacaaca

SEQ ID NO: 94821 - RNA, 21 nt, Human
cauugcauuccagccuaggca

SEQ ID NO: 94822 - RNA, 32 nt, Human
cauugcauugcacuccagcuugagcaacagag

SEQ ID NO: 94823 - RNA, 32 nt, Human
cauugcauuguacccauaggcagaaaauuaag

SEQ ID NO: 94824 - RNA, 32 nt, Human
cauugccaaccauauuggaucugcuugcuguc

SEQ ID NO: 94825 - RNA, 32 nt, Human
cauugccaaccucacugacacagggucauagu

SEQ ID NO: 94826 - RNA, 32 nt, Human
cauugccaaugagcauggcaagaaaaugcucg

SEQ ID NO: 94827 - RNA, 32 nt, Human
cauugccacacgccccgacgacugccugaugu

SEQ ID NO: 94828 - RNA, 32 nt, Human
cauugccacagucaacuauuuguacuucuaga

SEQ ID NO: 94829 - RNA, 32 nt, Human
cauugccaggcaacaggacuaaacuaccucca

SEQ ID NO: 94830 - RNA, 32 nt, Human
cauugccauaaauuuugccuuguacucagaga

SEQ ID NO: 94831 - RNA, 32 nt, Human
cauugccauccuguugcacugcagcuugugua

SEQ ID NO: 94832 - RNA, 32 nt, Human
cauugccaugguacucaaagguagaagagccu

SEQ ID NO: 94833 - RNA, 32 nt, Human
cauugcccaagagagagggcagggaacaggcu

SEQ ID NO: 94834 - RNA, 32 nt, Human
cauugcccaaguuccagcauccuucccaugaa

SEQ ID NO: 94835 - RNA, 32 nt, Human
cauugcccaccuggcccuggcuugaugggcuc

SEQ ID NO: 94836 - RNA, 32 nt, Human
cauugcccaccuggcccuggcuugaugggcuu

SEQ ID NO: 94837 - RNA, 32 nt, Human
cauugcccaggcuggagugcagugagcuauua

SEQ ID NO: 94838 - RNA, 32 nt, Human
cauugcccagugagcccugcucuucucucccc

SEQ ID NO: 94839 - RNA, 32 nt, Human
cauugcccccuccacccacccccacgacccca

SEQ ID NO: 94840 - RNA, 32 nt, Human
cauugcccccucucuaccugagaacuagacuc

SEQ ID NO: 94841 - RNA, 32 nt, Human
cauugcccuaagaaucagaaguaaagauaauc

SEQ ID NO: 94842 - RNA, 32 nt, Human
cauugcccugcaguggacaggucuauagaucu

SEQ ID NO: 94843 - RNA, 32 nt, Human
cauugcccuucgggcuggagaugcuuugccgg

SEQ ID NO: 94844 - RNA, 32 nt, Human
cauugccucugccuugccccuaugccugcccg

SEQ ID NO: 94845 - RNA, 22 nt, Human
cauugccucuuuucucaucaca

SEQ ID NO: 94846 - RNA, 32 nt, Human
cauugccugaguaaaauuagguuuuuaggucu

SEQ ID NO: 94847 - RNA, 32 nt, Human
cauugccugcaagccuccaaagcuugucuuug

SEQ ID NO: 94848 - RNA, 32 nt, Human
cauugccugcagcagcuuguacugccuuuugg

SEQ ID NO: 94849 - RNA, 32 nt, Human
cauugccuguaagcagcacagaauuggugcca

SEQ ID NO: 94850 - RNA, 32 nt, Human
cauugccuguaaucccagcacuuugggaggcc

SEQ ID NO: 94851 - RNA, 32 nt, Human
cauugccuguaaucccagcuacuagggaggcu

SEQ ID NO: 94852 - RNA, 32 nt, Human
cauugccuguagucccagcuacuugggaggcu

SEQ ID NO: 94853 - RNA, 32 nt, Human
cauugccuguccccaucucaucccaggucacc

SEQ ID NO: 94854 - RNA, 32 nt, Human
cauugccugucucauuucccucccucccucug

SEQ ID NO: 94855 - RNA, 32 nt, Human
cauugcgaucagaauggagaagaaccauuugu

SEQ ID NO: 94856 - RNA, 32 nt, Human
cauugcgcacuuccaggacaacuuacauucgg

SEQ ID NO: 94857 - RNA, 32 nt, Human
cauugcgccacugcaaaccagccugggcaaua

SEQ ID NO: 94858 - RNA, 32 nt, Human
cauugcgccacugcacuccagcgcggaagaca

SEQ ID NO: 94859 - RNA, 32 nt, Human
cauugcgccuggcuaauuuuuguauuuuuagu

SEQ ID NO: 94860 - RNA, 32 nt, Human
cauugcuaccaaacuccuccugcacggucuug

SEQ ID NO: 94861 - RNA, 32 nt, Human
cauugcuaccucagugcuccuggaaacuuagc

SEQ ID NO: 94862 - RNA, 32 nt, Human
cauugcuacuaaaaauacaaaaauuacccggg

SEQ ID NO: 94863 - RNA, 32 nt, Human
cauugcuagaagcagcaggaauuggcaaauug

SEQ ID NO: 94864 - RNA, 32 nt, Human
cauugcuagggaggcaaaggaggagcaaaguc

SEQ ID NO: 94865 - RNA, 32 nt, Human
cauugcuagucuuaugacagagggagaagaca

SEQ ID NO: 94866 - RNA, 32 nt, Human
cauugcucagcucucccuugaguggcacuuag

SEQ ID NO: 94867 - RNA, 32 nt, Human
cauugcucucccacugcagaacauggccucua

SEQ ID NO: 94868 - RNA, 32 nt, Human
cauugcucuccuauucccacgccuuaacacag

SEQ ID NO: 94869 - RNA, 32 nt, Human
cauugcucugggggcugggauuccuggcuaag

SEQ ID NO: 94870 - RNA, 32 nt, Human
cauugcugaaguuuauucucagaucugccagg

SEQ ID NO: 94871 - RNA, 32 nt, Human
cauugcugaccagcugaguccuggagggcagu

SEQ ID NO: 94872 - RNA, 32 nt, Human
cauugcugagcacacaguugcagcucaauaaa

SEQ ID NO: 94873 - RNA, 32 nt, Human
cauugcugaggagaguggaggccaggcugggg

SEQ ID NO: 94874 - RNA, 32 nt, Human
cauugcugccauauucagcagucuguuccuuc

SEQ ID NO: 94875 - RNA, 32 nt, Human
cauugcugccuccccaucgagccuccuuggca

SEQ ID NO: 94876 - RNA, 32 nt, Human
cauugcugcucaucugugccuuuguccaucua

SEQ ID NO: 94877 - RNA, 32 nt, Human
cauugcugcugcuaccugcuuuccagagccuu

SEQ ID NO: 94878 - RNA, 32 nt, Human
cauugcugggccagcuugaagggaaggcccgu

SEQ ID NO: 94879 - RNA, 32 nt, Human
cauugcugguguuaacuuauugccaaauucuu

SEQ ID NO: 94880 - RNA, 32 nt, Human
cauugcuguaccacaucugcucuagggaaucu

SEQ ID NO: 94881 - RNA, 24 nt, Human
cauugcuuaugucaaauggagcug

SEQ ID NO: 94882 - RNA, 32 nt, Human
cauugcuucucccucacuucuuuccucaaaga

SEQ ID NO: 94883 - RNA, 32 nt, Human
cauugcuucuuggccuucuggcuaagaucaug

SEQ ID NO: 94884 - RNA, 24 nt, Human
cauugcuuguuugcaaaugcucua

SEQ ID NO: 94885 - RNA, 32 nt, Human
cauugcuuugggcuggggccaugggaagaaac

SEQ ID NO: 94886 - RNA, 32 nt, Human
cauuggaaacccuauuuccccaccccagcuca

SEQ ID NO: 94887 - RNA, 32 nt, Human
cauuggaaaugcugggcacauugcagucagug

SEQ ID NO: 94888 - RNA, 32 nt, Human
cauuggaacauacacuuuauuauguuacaaaa

SEQ ID NO: 94889 - RNA, 32 nt, Human
cauuggaaccguaucaggcuuggggcuauuca

SEQ ID NO: 94890 - RNA, 32 nt, Human
cauuggaacuucugaucuucaagcagggauuc

SEQ ID NO: 94891 - RNA, 32 nt, Human
cauuggaagaggaaaaugaugagacaucuagg

SEQ ID NO: 94892 - RNA, 32 nt, Human
cauuggaagcccuucuaaguaccauuuucauu

SEQ ID NO: 94893 - RNA, 32 nt, Human
cauuggaauagaagaaaauguacaggacacau

SEQ ID NO: 94894 - RNA, 32 nt, Human
cauuggaaugugauggugcucacuuugggcau

SEQ ID NO: 94895 - RNA, 32 nt, Human
cauuggacaacaugagcacauuccagucaauc

SEQ ID NO: 94896 - RNA, 32 nt, Human
cauuggaggaagggacagcugcuuggguucua

SEQ ID NO: 94897 - RNA, 32 nt, Human
cauuggaggaucucucuuuucucuuccaccuc

SEQ ID NO: 94898 - RNA, 32 nt, Human
cauuggaggcagacugcucucaggagacuacu

SEQ ID NO: 94899 - RNA, 32 nt, Human
cauuggagggcaggacucuugauuguguaauu

SEQ ID NO: 94900 - RNA, 32 nt, Human
cauuggaggugcuugaguaacugugaauacag

SEQ ID NO: 94901 - RNA, 32 nt, Human
cauuggaucacaaaagcuguauucuucccccu

SEQ ID NO: 94902 - RNA, 32 nt, Human
cauuggauucugagagcugugcaucagcuaga

SEQ ID NO: 94903 - RNA, 32 nt, Human
cauuggauuuggugacugucucauugugccau

SEQ ID NO: 94904 - RNA, 32 nt, Human
cauuggcacugaggccagauggccuuggguuu

SEQ ID NO: 94905 - RNA, 32 nt, Human
cauuggcaggacuucagaaugccgugggcucc

SEQ ID NO: 94906 - RNA, 32 nt, Human
cauuggcauucagaggaugcuggacauuaacu

SEQ ID NO: 94907 - RNA, 32 nt, Human
cauuggccaguggcagcagccuccucauccuc

SEQ ID NO: 94908 - RNA, 32 nt, Human
cauuggccauggccauggcaacaugcucaguu

SEQ ID NO: 94909 - RNA, 20 nt, Human
cauuggcccagcaggcccag

SEQ ID NO: 94910 - RNA, 32 nt, Human
cauuggccgggccuggccagcagugcacagug

SEQ ID NO: 94911 - RNA, 32 nt, Human
cauuggccuagacgcaaaccagcauuuugcag

SEQ ID NO: 94912 - RNA, 31 nt, Human
cauuggccucugcaggcuugccaaaguagga

SEQ ID NO: 94913 - RNA, 32 nt, Human
cauuggccuggcuuccccuugagacuggggau

SEQ ID NO: 94914 - RNA, 32 nt, Human
cauuggccugggccaguucuccacuccuaggg

SEQ ID NO: 94915 - RNA, 32 nt, Human
cauuggccuucccaggcucacaguucugucuu

SEQ ID NO: 94916 - RNA, 32 nt, Human
cauuggcgagaacacaggacguggugguuccu

SEQ ID NO: 94917 - RNA, 32 nt, Human
cauuggcgagaucacagcucacugcagccuug

SEQ ID NO: 94918 - RNA, 32 nt, Human
cauuggcucacugcagccuagaccucccagcu

SEQ ID NO: 94919 - RNA, 32 nt, Human
cauuggcuccauccuccugguugugcucugca

SEQ ID NO: 94920 - RNA, 22 nt, Human
cauuggcucuucacacccaaau

SEQ ID NO: 94921 - RNA, 32 nt, Human
cauuggcugggauuccuguuccugggugcgcc

SEQ ID NO: 94922 - RNA, 21 nt, Human
cauuggcugggcagcgugagu

SEQ ID NO: 94923 - RNA, 32 nt, Human
cauuggcugggcagcgugaguccuucggucgg

SEQ ID NO: 94924 - RNA, 18 nt, Human
cauuggcugggugcagug

SEQ ID NO: 94925 - RNA, 32 nt, Human
cauugggaaauauuuaaagcaacagacaggcu

SEQ ID NO: 94926 - RNA, 32 nt, Human
cauugggaaauggcugaugaguucacauuuag

SEQ ID NO: 94927 - RNA, 32 nt, Human
cauugggagagagguucuaacacacugaaggc

SEQ ID NO: 94928 - RNA, 32 nt, Human
cauugggagauggguuucuuauucugccuuua

SEQ ID NO: 94929 - RNA, 32 nt, Human
cauugggagcagagaagaagcaaccaggggcc

SEQ ID NO: 94930 - RNA, 32 nt, Human
cauugggaggccaaggcaggcagaucacgagg

SEQ ID NO: 94931 - RNA, 32 nt, Human
cauugggaggcugaggugggcggaucaccuga

SEQ ID NO: 94932 - RNA, 32 nt, Human
cauugggauuacaggcaucagccaccacaccu

SEQ ID NO: 94933 - RNA, 32 nt, Human
cauugggcagcaaaagcagggugggguccagc

SEQ ID NO: 94934 - RNA, 32 nt, Human
cauugggccacugcagucgagccugggcgaca

SEQ ID NO: 94935 - RNA, 32 nt, Human
cauugggccacuuccuaaugcccuauguguau

SEQ ID NO: 94936 - RNA, 32 nt, Human
cauugggccuuuccacgccccuggguggcggc

SEQ ID NO: 94937 - RNA, 32 nt, Human
cauugggcuaauaucugcugugcuucucugac

SEQ ID NO: 94938 - RNA, 32 nt, Human
cauugggcugagugugguggcucaugccugua

SEQ ID NO: 94939 - RNA, 32 nt, Human
cauuggggaaaaggaaaggaucagacauuucg

SEQ ID NO: 94940 - RNA, 32 nt, Human
cauuggggaaacggggugaacuucagguggau

SEQ ID NO: 94941 - RNA, 32 nt, Human
cauuggggcagcugucacaagcuguucacaca

SEQ ID NO: 94942 - RNA, 32 nt, Human
cauuggggcaggcagggccgggaagggaagua

SEQ ID NO: 94943 - RNA, 32 nt, Human
cauuggggccccuuaaggaaacccaggccucc

SEQ ID NO: 94944 - RNA, 32 nt, Human
cauuggggcucagguaucacuaccucagggaa

SEQ ID NO: 94945 - RNA, 32 nt, Human
cauugggggaagggaggcgaaggccugagguu

SEQ ID NO: 94946 - RNA, 31 nt, Human
cauuggguaucauucauuacauucuugaguu

SEQ ID NO: 94947 - RNA, 32 nt, Human
cauuggguauuuucacugccucauagagucua

SEQ ID NO: 94948 - RNA, 32 nt, Human
cauugggucucgaccaauugccuaauuauaag

SEQ ID NO: 94949 - RNA, 32 nt, Human
cauugggucuuucugccacaggcccuugcaca

SEQ ID NO: 94950 - RNA, 32 nt, Human
cauugggugaacacacaggcuggcugcucugg

SEQ ID NO: 94951 - RNA, 32 nt, Human
cauuggguggagacucucacuuauguuaaugc

SEQ ID NO: 94952 - RNA, 32 nt, Human
cauuggguuaggggacacugaacugcuuuuua

SEQ ID NO: 94953 - RNA, 32 nt, Human
cauugguaauccaggcugcaccuacaaguacc

SEQ ID NO: 94954 - RNA, 32 nt, Human
cauuggucugacuugcugugaagaccuuaagc

SEQ ID NO: 94955 - RNA, 32 nt, Human
cauuggugcuuugaugaaaaggucaguuggcu

SEQ ID NO: 94956 - RNA, 32 nt, Human
cauugguggggcuggcacgaauccagaucugg

SEQ ID NO: 94957 - RNA, 32 nt, Human
cauugguguguucuuuaacuugcuacuuggag

SEQ ID NO: 94958 - RNA, 32 nt, Human
cauugguuauuacccuguguaccuugucccuc

SEQ ID NO: 94959 - RNA, 32 nt, Human
cauugguucucuucccccagcacccugaaacg

SEQ ID NO: 94960 - RNA, 32 nt, Human
cauugguuucuucucagguuaaagcuguauuu

SEQ ID NO: 94961 - RNA, 32 nt, Human
cauugguuuguagcauuuaacauaacuaguau

SEQ ID NO: 94962 - RNA, 24 nt, Human
cauuguaaaaccccaucucuacua

SEQ ID NO: 94963 - RNA, 32 nt, Human
cauuguaaacaacagacuuacguuaaacuuca

SEQ ID NO: 94964 - RNA, 32 nt, Human
cauuguaaaggugggcaaagccuaguagagaa

SEQ ID NO: 94965 - RNA, 32 nt, Human
cauuguaaccucaggaaacaguuuauuuuggg

SEQ ID NO: 94966 - RNA, 32 nt, Human
cauuguaagaagagcauguaguugggagauau

SEQ ID NO: 94967 - RNA, 32 nt, Human
cauuguaagaagcagguaggcaaugugggagu

SEQ ID NO: 94968 - RNA, 32 nt, Human
cauuguaagaguuccacagagcucugggcacu

SEQ ID NO: 94969 - RNA, 32 nt, Human
cauuguaagauccaucuacacagucguugucc

SEQ ID NO: 94970 - RNA, 32 nt, Human
cauuguaauugugugccuucucaguuauuggg

SEQ ID NO: 94971 - RNA, 32 nt, Human
cauuguaauuuaaaaugcauugucuauuaaua

SEQ ID NO: 94972 - RNA, 32 nt, Human
cauuguaccagccacuuguccuagccaaaugu

SEQ ID NO: 94973 - RNA, 32 nt, Human
cauuguagaauagaacuggaauuccauucuuu

SEQ ID NO: 94974 - RNA, 32 nt, Human
cauuguagauucaagaaauuaguuuucaguuu

SEQ ID NO: 94975 - RNA, 30 nt, Human
cauuguagccucuuuauggucucugagaaa

SEQ ID NO: 94976 - RNA, 32 nt, Human
cauuguagccugggcaacagagcaagacccug

SEQ ID NO: 94977 - RNA, 32 nt, Human
cauuguagcuucaaccuccugagcucaagcaa

SEQ ID NO: 94978 - RNA, 32 nt, Human
cauuguaggagguacucaaggguuugggggca

SEQ ID NO: 94979 - RNA, 32 nt, Human
cauuguagggaaggggacacugaggggcagag

SEQ ID NO: 94980 - RNA, 32 nt, Human
cauuguagguggcugugucuguugcaucauca

SEQ ID NO: 94981 - RNA, 32 nt, Human
cauuguauaaaugacucuggccuguguguacu

SEQ ID NO: 94982 - RNA, 32 nt, Human
cauuguauuaagaguccagucacuguauaugg

SEQ ID NO: 94983 - RNA, 32 nt, Human
cauuguauucacaaccaugugucuucauuuau

SEQ ID NO: 94984 - RNA, 32 nt, Human
cauugucaacuauguccgccucauagacaggg

SEQ ID NO: 94985 - RNA, 32 nt, Human
cauugucaagauuuguucugugguguagguau

SEQ ID NO: 94986 - RNA, 32 nt, Human
cauugucaagugagccugagggaggcugaggg

SEQ ID NO: 94987 - RNA, 32 nt, Human
cauugucacaccaauuccugcuuuaauuaaug

SEQ ID NO: 94988 - RNA, 31 nt, Human
cauugucacagcuaccaaagugugguuugca

SEQ ID NO: 94989 - RNA, 32 nt, Human
cauugucacccaggcuggaguacaguggcaug

SEQ ID NO: 94990 - RNA, 32 nt, Human
cauugucacugcaaaucgacaccuauuaaugg

SEQ ID NO: 94991 - RNA, 32 nt, Human
cauugucagcacagccuaggagggucagauuc

SEQ ID NO: 94992 - RNA, 32 nt, Human
cauugucaggcacugcugccuuccugccuccc

SEQ ID NO: 94993 - RNA, 32 nt, Human
cauugucagggguucuggaaugggaccagggg

SEQ ID NO: 94994 - RNA, 32 nt, Human
cauugucauggugaaugccccgcuguagcucc

SEQ ID NO: 94995 - RNA, 32 nt, Human
cauuguccaaaaagaaauugcauuucaagcag

SEQ ID NO: 94996 - RNA, 32 nt, Human
cauuguccaaauauagucacauacauuugacc

SEQ ID NO: 94997 - RNA, 32 nt, Human
cauuguccacuucauugcugugguguugggca

SEQ ID NO: 94998 - RNA, 32 nt, Human
cauuguccgaauauagucacauacauuugaac

SEQ ID NO: 94999 - RNA, 32 nt, Human
cauuguccucaaguccuucgcagacagugcac

SEQ ID NO: 95000 - RNA, 32 nt, Human
cauuguccuguauuuaucacaguuucuguuga

SEQ ID NO: 95001 - RNA, 32 nt, Human
cauuguccuuucuccaguuuuuguuccagaau

SEQ ID NO: 95002 - RNA, 32 nt, Human
cauugucuacccacacaaauccucaggaaacc

SEQ ID NO: 95003 - RNA, 32 nt, Human
cauugucucuuuauuuguuagcauuaaacaaa

SEQ ID NO: 95004 - RNA, 32 nt, Human
cauugucugccucaucaggaacuaucuguaga

SEQ ID NO: 95005 - RNA, 32 nt, Human
cauugucugggaugugaggagcgccucugccc

SEQ ID NO: 95006 - RNA, 32 nt, Human
cauugucuucaccaaucuucugaacccgugaa

SEQ ID NO: 95007 - RNA, 16 nt, Human
cauugucuugcugcca

SEQ ID NO: 95008 - RNA, 22 nt, Human
cauugucuugggauuucagucu

SEQ ID NO: 95009 - RNA, 32 nt, Human
cauugucuuucuugugccuuuuccuuggugag

SEQ ID NO: 95010 - RNA, 32 nt, Human
cauugucuuugucuuugagagcagcaguuuga

SEQ ID NO: 95011 - RNA, 22 nt, Human
cauugugaaaccccaucucugc

SEQ ID NO: 95012 - RNA, 32 nt, Human
cauugugaaagaguguuuccugccuccauuaa

SEQ ID NO: 95013 - RNA, 32 nt, Human
cauugugaauguguauguaaaauaugaagaca

SEQ ID NO: 95014 - RNA, 32 nt, Human
cauugugagcuucaguuucuucaucugcaaaa

SEQ ID NO: 95015 - RNA, 32 nt, Human
cauugugaggcaggucccaaaagggaaggcug

SEQ ID NO: 95016 - RNA, 21 nt, Human
cauugugauggccaucugccc

SEQ ID NO: 95017 - RNA, 32 nt, Human
cauugugcaacaucgguggauuuucuaaaaau

SEQ ID NO: 95018 - RNA, 32 nt, Human
cauugugcagcuuugcuagggaagaaaguggu

SEQ ID NO: 95019 - RNA, 32 nt, Human
cauugugccaucuucagcuccaguggcuuuag

SEQ ID NO: 95020 - RNA, 32 nt, Human
cauugugccccagugaugaaguugcuggacac

SEQ ID NO: 95021 - RNA, 32 nt, Human
cauugugccuuaaaaugagucauacaucuuuu

SEQ ID NO: 95022 - RNA, 32 nt, Human
cauugugcucuguagccuuggaaauguuuuug

SEQ ID NO: 95023 - RNA, 32 nt, Human
cauuguggagcacaggcuuacacccuucgugg

SEQ ID NO: 95024 - RNA, 32 nt, Human
cauuguggagccaacuccagggcuggggguca

SEQ ID NO: 95025 - RNA, 20 nt, Human
cauuguggagccagugaaug

SEQ ID NO: 95026 - RNA, 32 nt, Human
cauuguggaggccuggaagcugcggggccccc

SEQ ID NO: 95027 - RNA, 32 nt, Human
cauuguggcacaugccugcaaucccagcuacu

SEQ ID NO: 95028 - RNA, 32 nt, Human
cauuguggcagggagagaagccagacaugagu

SEQ ID NO: 95029 - RNA, 32 nt, Human
cauuguggcgcacaccuguauucccaucuagu

SEQ ID NO: 95030 - RNA, 32 nt, Human
cauuguggcuccugccacccuggcagaugacu

SEQ ID NO: 95031 - RNA, 32 nt, Human
cauuguggcuugacugaauuucucuaaugagu

SEQ ID NO: 95032 - RNA, 32 nt, Human
cauugugggagacggaauagagccaaguaagu

SEQ ID NO: 95033 - RNA, 31 nt, Human
cauugugggcccucugggcuccugccucaga

SEQ ID NO: 95034 - RNA, 32 nt, Human
cauuguggggaaaacuaaucccagggaaaaga

SEQ ID NO: 95035 - RNA, 32 nt, Human
cauuguggucaucagcuucaugacauuuuacc

SEQ ID NO: 95036 - RNA, 32 nt, Human
cauuguggugaguaccuguaagucccagcuac

SEQ ID NO: 95037 - RNA, 32 nt, Human
cauuguggugggcaccuguaaucccagcuacu

SEQ ID NO: 95038 - RNA, 32 nt, Human
cauugugguggucaccuguagucccagcugcu

SEQ ID NO: 95039 - RNA, 32 nt, Human
cauugugguguuugucuaccugacuguggaaa

SEQ ID NO: 95040 - RNA, 32 nt, Human
cauuguguaggugagagaaagagggaggagug

SEQ ID NO: 95041 - RNA, 32 nt, Human
cauuguguauaugugcuacauuuucuuuaucg

SEQ ID NO: 95042 - RNA, 32 nt, Human
cauuguguaucuauacauauggcucuugagga

SEQ ID NO: 95043 - RNA, 32 nt, Human
cauugugucgggcuacuccacccuguccacca

SEQ ID NO: 95044 - RNA, 25 nt, Human
cauugugucugagcagagcuggguc

SEQ ID NO: 95045 - RNA, 32 nt, Human
cauuguguggaugguggguugugcccacuucc

SEQ ID NO: 95046 - RNA, 25 nt, Human
cauuguguguguuccuuucuugaua

SEQ ID NO: 95047 - RNA, 32 nt, Human
cauuguguguuuuguguacuccugugggacuc

SEQ ID NO: 95048 - RNA, 32 nt, Human
cauuguguuaacuuaugucucuuguuaaauga

SEQ ID NO: 95049 - RNA, 32 nt, Human
cauuguguuccccaggcugaagugcaguggca

SEQ ID NO: 95050 - RNA, 32 nt, Human
cauuguuaaacauguugaguuuuaaaggaaga

SEQ ID NO: 95051 - RNA, 31 nt, Human
cauuguuaaagaaauaaaguaagcaauuugu

SEQ ID NO: 95052 - RNA, 32 nt, Human
cauuguuaagacaaaaaguggccaggcacagu

SEQ ID NO: 95053 - RNA, 32 nt, Human
cauuguuaaugcuuugaugaaaaggcuuuaua

SEQ ID NO: 95054 - RNA, 32 nt, Human
cauuguuauaacagaguaucacagacuggaua

SEQ ID NO: 95055 - RNA, 32 nt, Human
cauuguuauauuacaaacagacuugcaugauu

SEQ ID NO: 95056 - RNA, 32 nt, Human
cauuguuaucgugguugcugauggggguggaa

SEQ ID NO: 95057 - RNA, 32 nt, Human
cauuguucaaaccaacacuugcaccuuucucu

SEQ ID NO: 95058 - RNA, 32 nt, Human
cauuguucagcucugugcuuucuuggauuccc

SEQ ID NO: 95059 - RNA, 32 nt, Human
cauuguucagucaaaacauaccacagaauggg

SEQ ID NO: 95060 - RNA, 32 nt, Human
cauuguucauucuucuuucuugaaaucccaaa

SEQ ID NO: 95061 - RNA, 32 nt, Human
cauuguucugagaauuaaauauggcugcuuac

SEQ ID NO: 95062 - RNA, 32 nt, Human
cauuguugcccaggaagagacggaggaugcaa

SEQ ID NO: 95063 - RNA, 21 nt, Human
cauuguugccucuaucuaguc

SEQ ID NO: 95064 - RNA, 32 nt, Human
cauuguugcuguucugcucaguacuuugauga

SEQ ID NO: 95065 - RNA, 32 nt, Human
cauuguugucugcaguagaugcagaaaauaua

SEQ ID NO: 95066 - RNA, 32 nt, Human
cauuguuuccacccccuggugccugcaggcca

SEQ ID NO: 95067 - RNA, 32 nt, Human
cauuguuuccaggaccuccugagaagccugau

SEQ ID NO: 95068 - RNA, 24 nt, Human
cauuguuugagguuucucaaaaag

SEQ ID NO: 95069 - RNA, 32 nt, Human
cauuguuugucugucuucauagcagauuuuaa

SEQ ID NO: 95070 - RNA, 32 nt, Human
cauuguuuugacuaagcacaauuagaugacaa

SEQ ID NO: 95071 - RNA, 32 nt, Human
cauuguuuuuguggcagcaagcugaaugacag

SEQ ID NO: 95072 - RNA, 32 nt, Human
cauuuaaaaauguccuguggggaagccauuuc

SEQ ID NO: 95073 - RNA, 32 nt, Human
cauuuaaaaauuacuguuuaauauuguuugac

SEQ ID NO: 95074 - RNA, 32 nt, Human
cauuuaaaacucuuuauguaaagcuuuauauc

SEQ ID NO: 95075 - RNA, 32 nt, Human
cauuuaaaaggauuuggacugcauuuaauugu

SEQ ID NO: 95076 - RNA, 32 nt, Human
cauuuaaaauuagccaggcaugguggugugcg

SEQ ID NO: 95077 - RNA, 32 nt, Human
cauuuaaacuggugcuuuauguacaugagaug

SEQ ID NO: 95078 - RNA, 32 nt, Human
cauuuaacagauaaggaaacugagggaacuaa

SEQ ID NO: 95079 - RNA, 32 nt, Human
cauuuaacugcuggcauaauuugcaacuguug

SEQ ID NO: 95080 - RNA, 32 nt, Human
cauuuaagggucuuuuacaaauaugucuaaau

SEQ ID NO: 95081 - RNA, 32 nt, Human
cauuuaagguaaaacugcucugccuuuugcuu

SEQ ID NO: 95082 - RNA, 31 nt, Human
cauuuaaguuuaguaguaaaagacugguuaa

SEQ ID NO: 95083 - RNA, 32 nt, Human
cauuuaaucuuucauagaaacuccugaagaag

SEQ ID NO: 95084 - RNA, 32 nt, Human
cauuuaaugccauucaagaucuacuaagcauc

SEQ ID NO: 95085 - RNA, 32 nt, Human
cauuuaauggggugcaccuguccaauaggcgu

SEQ ID NO: 95086 - RNA, 32 nt, Human
cauuuaaugucuugaacauucuaaauuacuuc

SEQ ID NO: 95087 - RNA, 32 nt, Human
cauuuaauguuagggguauuuaauguauuuuu

SEQ ID NO: 95088 - RNA, 32 nt, Human
cauuuaauugaaucguguguccugauaggugg

SEQ ID NO: 95089 - RNA, 32 nt, Human
cauuuacacaaaaacagaaaaguacccagaug

SEQ ID NO: 95090 - RNA, 32 nt, Human
cauuuacacagugcuuuccagccuuuggugcu

SEQ ID NO: 95091 - RNA, 32 nt, Human
cauuuacauacaguuuugcucuucuauacaga

SEQ ID NO: 95092 - RNA, 32 nt, Human
cauuuacaucaagcucagccugggcggcacag

SEQ ID NO: 95093 - RNA, 32 nt, Human
cauuuaccacuugcacaccagaccuuauaauu

SEQ ID NO: 95094 - RNA, 32 nt, Human
cauuuacccuuuugacauuagucacguggaac

SEQ ID NO: 95095 - RNA, 32 nt, Human
cauuuaccuauguaacaaaccugcacauccug

SEQ ID NO: 95096 - RNA, 32 nt, Human
cauuuacuacaguuggcuucuaaugcuucaga

SEQ ID NO: 95097 - RNA, 32 nt, Human
cauuuacuaguucuguaaaaucaaagauacua

SEQ ID NO: 95098 - RNA, 32 nt, Human
cauuuacuccaaguccucuccccagcuaccac

SEQ ID NO: 95099 - RNA, 32 nt, Human
cauuuacuccauccuuuauagugaugcuacag

SEQ ID NO: 95100 - RNA, 32 nt, Human
cauuuacucugcugcaaccucucuuucuccua

SEQ ID NO: 95101 - RNA, 32 nt, Human
cauuuacucuggagauagauaggagaacuccu

SEQ ID NO: 95102 - RNA, 32 nt, Human
cauuuacucugggaauccuacugugaaaucau

SEQ ID NO: 95103 - RNA, 32 nt, Human
cauuuacugaacaccuacugugugccaggccc

SEQ ID NO: 95104 - RNA, 32 nt, Human
cauuuagauuaggaagguuuuuaagauccgca

SEQ ID NO: 95105 - RNA, 32 nt, Human
cauuuagcagcaaauuaaaguaaccaguccuu

SEQ ID NO: 95106 - RNA, 32 nt, Human
cauuuagcuuaucccuuggccaaaaaguguau

SEQ ID NO: 95107 - RNA, 32 nt, Human
cauuuaggaaggugcaguauguuucagaguag

SEQ ID NO: 95108 - RNA, 32 nt, Human
cauuuaggacuguauuuccaaauuacugauau

SEQ ID NO: 95109 - RNA, 32 nt, Human
cauuuaggaucuccaugagaaaugggcuucuu

SEQ ID NO: 95110 - RNA, 32 nt, Human
cauuuaggaugaagaucagaaaauucucucca

SEQ ID NO: 95111 - RNA, 32 nt, Human
cauuuaggcuucaguuccacucccaggaacuu

SEQ ID NO: 95112 - RNA, 22 nt, Human
cauuuagggaggcagugucaua

SEQ ID NO: 95113 - RNA, 32 nt, Human
cauuuagggcuaccaucccccaaaaaggcuua

SEQ ID NO: 95114 - RNA, 32 nt, Human
cauuuagggguaauaaauacuuggcuuggaaa

SEQ ID NO: 95115 - RNA, 32 nt, Human
cauuuaggucucaaccuagccaucacuuuuuc

SEQ ID NO: 95116 - RNA, 32 nt, Human
cauuuagucauuguuuaucaaccaaacuaggu

SEQ ID NO: 95117 - RNA, 32 nt, Human
cauuuagugaagcagauggagggaaguugacc

SEQ ID NO: 95118 - RNA, 32 nt, Human
cauuuaguguguuccuuuuacuuuuugauacu

SEQ ID NO: 95119 - RNA, 32 nt, Human
cauuuaguucacaagcauaauuuggaggugug

SEQ ID NO: 95120 - RNA, 32 nt, Human
cauuuaguucacaagcauagugaaagugaccu

SEQ ID NO: 95121 - RNA, 32 nt, Human
cauuuauaaaaauuaagagguuaagagguuau

SEQ ID NO: 95122 - RNA, 32 nt, Human
cauuuauagaugggggaaagcaaagcacagag

SEQ ID NO: 95123 - RNA, 32 nt, Human
cauuuauaguucuugcuaguugcagugguaau

SEQ ID NO: 95124 - RNA, 32 nt, Human
cauuuauaugaacaccuuugaggugcuacuua

SEQ ID NO: 95125 - RNA, 31 nt, Human
cauuuauauugcccaucuccugugucuucaa

SEQ ID NO: 95126 - RNA, 32 nt, Human
cauuuauauuugagaaaaauuguagaaauaua

SEQ ID NO: 95127 - RNA, 19 nt, Human
cauuuaucaaggagauacc

SEQ ID NO: 95128 - RNA, 31 nt, Human
cauuuaucaauaaaagccuuugaaaauacuu

SEQ ID NO: 95129 - RNA, 32 nt, Human
cauuuaucagaaacuuaaaauauuucauaccg

SEQ ID NO: 95130 - RNA, 32 nt, Human
cauuuaucagcccucuuugugcugcuccuugc

SEQ ID NO: 95131 - RNA, 21 nt, Human
cauuuaucuucaaauacccua

SEQ ID NO: 95132 - RNA, 32 nt, Human
cauuuaugagccaccagaggcuccuaccccaa

SEQ ID NO: 95133 - RNA, 32 nt, Human
cauuuaugcacuuuguaucacccuccgaacuc

SEQ ID NO: 95134 - RNA, 32 nt, Human
cauuuauggacgcuuagcagggcccagauauu

SEQ ID NO: 95135 - RNA, 32 nt, Human
cauuuaugguacucuuugccuaugcauccccu

SEQ ID NO: 95136 - RNA, 32 nt, Human
cauuuauguaauuuuauuuacauucuugcuaa

SEQ ID NO: 95137 - RNA, 21 nt, Human
cauuuaugugcuuaugauuac

SEQ ID NO: 95138 - RNA, 32 nt, Human
cauuuauguuuugucugugguugcuuuccaca

SEQ ID NO: 95139 - RNA, 32 nt, Human
cauuuauuaacuguuagaacacuugcuuuaug

SEQ ID NO: 95140 - RNA, 32 nt, Human
cauuuauuaaggacucucugcuccagccucuc

SEQ ID NO: 95141 - RNA, 32 nt, Human
cauuuauuacguuacagaguucauggagguuc

SEQ ID NO: 95142 - RNA, 19 nt, Human
cauuuauuagguucacuca

SEQ ID NO: 95143 - RNA, 32 nt, Human
cauuuauugugcaccuacuaugugccaggcua

SEQ ID NO: 95144 - RNA, 32 nt, Human
cauuuauugugcaccuacuauguggcgggcau

SEQ ID NO: 95145 - RNA, 32 nt, Human
cauuuauugugucucacaccagccucauuucc

SEQ ID NO: 95146 - RNA, 32 nt, Human
cauuuauuucauuuacaaaagauuuauuguaa

SEQ ID NO: 95147 - RNA, 32 nt, Human
cauuuauuucauuuuauuuggggccugcaauu

SEQ ID NO: 95148 - RNA, 32 nt, Human
cauuuauuugcaccucagaagaagccagggcu

SEQ ID NO: 95149 - RNA, 32 nt, Human
cauuuauuuucuucagccugugcaaaacaaag

SEQ ID NO: 95150 - RNA, 32 nt, Human
cauuucaaauccugcacucaggccugguggug

SEQ ID NO: 95151 - RNA, 32 nt, Human
cauuucacaaggucaguaaugcugcaggaaaa

SEQ ID NO: 95152 - RNA, 32 nt, Human
cauuucacacguggauuuugucugcauuuaca

SEQ ID NO: 95153 - RNA, 32 nt, Human
cauuucacagaugagaaauggaagcagagggu

SEQ ID NO: 95154 - RNA, 32 nt, Human
cauuucaccauguuggccaggcuggucucgaa

SEQ ID NO: 95155 - RNA, 32 nt, Human
cauuucaccucacuccagccugggugacagcg

SEQ ID NO: 95156 - RNA, 32 nt, Human
cauuucaccugucccgcagacaacagcaccau

SEQ ID NO: 95157 - RNA, 32 nt, Human
cauuucacgaacuguucacacugcagagacua

SEQ ID NO: 95158 - RNA, 32 nt, Human
cauuucacgaguacccauaacuacccaucguu

SEQ ID NO: 95159 - RNA, 32 nt, Human
cauuucacuaguuuggauucagcaguaaguga

SEQ ID NO: 95160 - RNA, 32 nt, Human
cauuucacuguagccuaaacuccaguccgagg

SEQ ID NO: 95161 - RNA, 32 nt, Human
cauuucacuuccucuuccucuccuccagcauu

SEQ ID NO: 95162 - RNA, 32 nt, Human
cauuucacuugucaggagugugugugagugug

SEQ ID NO: 95163 - RNA, 30 nt, Human
cauuucagaaaauaaaaauuucaaaucaug

SEQ ID NO: 95164 - RNA, 24 nt, Human
cauuucagacacuauuaaauacua

SEQ ID NO: 95165 - RNA, 32 nt, Human
cauuucagacugguuuuaacuuaucccagcuu

SEQ ID NO: 95166 - RNA, 21 nt, Human
cauuucagauuugaaauacug

SEQ ID NO: 95167 - RNA, 32 nt, Human
cauuucagccugggcgaaaguaagacucuguc

SEQ ID NO: 95168 - RNA, 32 nt, Human
cauuucagccugggggauacagugagaccuug

SEQ ID NO: 95169 - RNA, 32 nt, Human
cauuucagccugucugucucagggugcagccu

SEQ ID NO: 95170 - RNA, 32 nt, Human
cauuucagcugcagcugaggaaaaugaaaugu

SEQ ID NO: 95171 - RNA, 32 nt, Human
cauuucagcuggcgcugcagcugcugcacaga

SEQ ID NO: 95172 - RNA, 32 nt, Human
cauuucagcuugaaccugcuuccuggcucaca

SEQ ID NO: 95173 - RNA, 32 nt, Human
cauuucaggaaggccacccugggaucugggca

SEQ ID NO: 95174 - RNA, 32 nt, Human
cauuucaggacgauccuuuuuccuucagcagc

SEQ ID NO: 95175 - RNA, 22 nt, Human
cauuucaggcacaacgauacua

SEQ ID NO: 95176 - RNA, 32 nt, Human
cauuucaggcucaaccaaagaggaucaaacag

SEQ ID NO: 95177 - RNA, 32 nt, Human
cauuucagggggccaccauggagcagccguua

SEQ ID NO: 95178 - RNA, 32 nt, Human
cauuucaguacccgcuggcagcuccucccacu

SEQ ID NO: 95179 - RNA, 32 nt, Human
cauuucagucucuucauuuugucauacggccu

SEQ ID NO: 95180 - RNA, 23 nt, Human
cauuucaguuggaugaauuacua

SEQ ID NO: 95181 - RNA, 32 nt, Human
cauuucaguuuuacaagaugaagagaguuuug

SEQ ID NO: 95182 - RNA, 31 nt, Human
cauuucauauagcuuuuucauuuaaaacaag

SEQ ID NO: 95183 - RNA, 32 nt, Human
cauuucaugucuguggcucaccagcuuuuccc

SEQ ID NO: 95184 - RNA, 32 nt, Human
cauuucauuuguauuuuuguccagaaauuucc

SEQ ID NO: 95185 - RNA, 32 nt, Human
cauuuccaaauuccuagaaaaguuuguuuuac

SEQ ID NO: 95186 - RNA, 32 nt, Human
cauuuccaacagcaacacagccacuaaaacac

SEQ ID NO: 95187 - RNA, 32 nt, Human
cauuuccaacaucacuuugcugcccagguaug

SEQ ID NO: 95188 - RNA, 32 nt, Human
cauuuccaacuacugcugcagcauuuugguaa

SEQ ID NO: 95189 - RNA, 32 nt, Human
cauuuccacuuacauaaugaaaaacaauucau

SEQ ID NO: 95190 - RNA, 32 nt, Human
cauuuccagaacuuaauccaugagcauuggau

SEQ ID NO: 95191 - RNA, 32 nt, Human
cauuuccagcacauccaggucugcacccccug

SEQ ID NO: 95192 - RNA, 18 nt, Human
cauuuccagcugcugcca

SEQ ID NO: 95193 - RNA, 32 nt, Human
cauuuccaggaggagaagcaagcagaugagag

SEQ ID NO: 95194 - RNA, 32 nt, Human
cauuuccaggccuagugccugccucguggcug

SEQ ID NO: 95195 - RNA, 32 nt, Human
cauuuccagguuuucugggggagugcaggggg

SEQ ID NO: 95196 - RNA, 32 nt, Human
cauuuccauccagccugaaaggccaggagagu

SEQ ID NO: 95197 - RNA, 32 nt, Human
cauuuccaucccccaaauccuucaagaugacc

SEQ ID NO: 95198 - RNA, 32 nt, Human
cauuuccauucaaccguggccccucuucagaa

SEQ ID NO: 95199 - RNA, 32 nt, Human
cauuuccauuugaugaaacagaacuacaagga

SEQ ID NO: 95200 - RNA, 19 nt, Human
cauuuccauuuuaagcagc

SEQ ID NO: 95201 - RNA, 32 nt, Human
cauuucccaagugcuauugcaauaacaguuga

SEQ ID NO: 95202 - RNA, 32 nt, Human
cauuucccaagugcuucauguuagccagcaaa

SEQ ID NO: 95203 - RNA, 32 nt, Human
cauuucccaauggguaaggaacagucugugaa

SEQ ID NO: 95204 - RNA, 24 nt, Human
cauuucccacauuccccacacuua

SEQ ID NO: 95205 - RNA, 32 nt, Human
cauuucccagcaucccuugcugcuagauguga

SEQ ID NO: 95206 - RNA, 32 nt, Human
cauuucccaggcuggcggagaauaaacugcca

SEQ ID NO: 95207 - RNA, 32 nt, Human
cauuucccaggucucagagcagccugggaaag

SEQ ID NO: 95208 - RNA, 32 nt, Human
cauuucccauaaacuucugucaagccagacca

SEQ ID NO: 95209 - RNA, 32 nt, Human
cauuucccauguccuggaaccccucaguccaa

SEQ ID NO: 95210 - RNA, 32 nt, Human
cauuucccuccccuuuuaauuuauuucccuga

SEQ ID NO: 95211 - RNA, 32 nt, Human
cauuucccuccccuuuuaauuuauuucccugc

SEQ ID NO: 95212 - RNA, 32 nt, Human
cauuucccuccucccucccucccuucaucucc

SEQ ID NO: 95213 - RNA, 21 nt, Human
cauuucccugcagcuaaugcu

SEQ ID NO: 95214 - RNA, 32 nt, Human
cauuucccugggaacagagcaacagucuuucu

SEQ ID NO: 95215 - RNA, 32 nt, Human
cauuucccuuccacacugcccuaggagagguu

SEQ ID NO: 95216 - RNA, 32 nt, Human
cauuucccuuccacuccuccuuucuggagucu

SEQ ID NO: 95217 - RNA, 32 nt, Human
cauuuccgccacaucccucucugcuggacguc

SEQ ID NO: 95218 - RNA, 32 nt, Human
cauuuccguauguauguauauguauacauuuc

SEQ ID NO: 95219 - RNA, 32 nt, Human
cauuuccgucagugacacucuccucguauugg

SEQ ID NO: 95220 - RNA, 32 nt, Human
cauuuccucagaagucaaacagggauggggau

SEQ ID NO: 95221 - RNA, 32 nt, Human
cauuuccuccacucuuuauggcccaucacuua

SEQ ID NO: 95222 - RNA, 32 nt, Human
cauuuccuccucuccugccugugaaagcagag

SEQ ID NO: 95223 - RNA, 32 nt, Human
cauuuccuggguggcuacucugugccagagcc

SEQ ID NO: 95224 - RNA, 32 nt, Human
cauuuccuguuguacacacaagggccaggcuc

SEQ ID NO: 95225 - RNA, 32 nt, Human
cauuuccuucaagucugcucaaaugucuaccu

SEQ ID NO: 95226 - RNA, 32 nt, Human
cauuuccuuccuagagguaaucccagaacaaa

SEQ ID NO: 95227 - RNA, 32 nt, Human
cauuuccuucgcucccccucccucuccacucu

SEQ ID NO: 95228 - RNA, 32 nt, Human
cauuuccuucuuucuucuggcuuuggaaaaau

SEQ ID NO: 95229 - RNA, 20 nt, Human
cauuuccuugcaacuugauc

SEQ ID NO: 95230 - RNA, 32 nt, Human
cauuuccuuugagaacuuuuccucuggcaugg

SEQ ID NO: 95231 - RNA, 32 nt, Human
cauuuccuuugucccaauuuccauuuuauaag

SEQ ID NO: 95232 - RNA, 32 nt, Human
cauuucgaagauuuuuauacauguuuucuauu

SEQ ID NO: 95233 - RNA, 32 nt, Human
cauuucgacuuacauaaugaaaaccaauucau

SEQ ID NO: 95234 - RNA, 32 nt, Human
cauuucgcagaggaggaaagugaggcccaggg

SEQ ID NO: 95235 - RNA, 32 nt, Human
cauuucggagaccuggaggaaguggcccauuu

SEQ ID NO: 95236 - RNA, 32 nt, Human
cauuucgggaggcugaggcaggaggaucauuu

SEQ ID NO: 95237 - RNA, 32 nt, Human
cauuucuaaaccaaguggcagagggguuggaa

SEQ ID NO: 95238 - RNA, 19 nt, Human
cauuucuaaggacaggaag

SEQ ID NO: 95239 - RNA, 32 nt, Human
cauuucuacaauuuguaaaaguccaaucugug

SEQ ID NO: 95240 - RNA, 32 nt, Human
cauuucuacuaaaaauaacaacaauuaguuag

SEQ ID NO: 95241 - RNA, 32 nt, Human
cauuucuacuaaaaauacaaaaaguagcuagg

SEQ ID NO: 95242 - RNA, 32 nt, Human
cauuucuacuaaaaauacaaaaauuagccggg

SEQ ID NO: 95243 - RNA, 32 nt, Human
cauuucuacuaaaaauacaaaaauuagcuagg

SEQ ID NO: 95244 - RNA, 32 nt, Human
cauuucuacuaaaaauacaaaaauuagcuggg

SEQ ID NO: 95245 - RNA, 32 nt, Human
cauuucuacuaaaaauacaaaauuagcugggc

SEQ ID NO: 95246 - RNA, 32 nt, Human
cauuucuacuaaaaguacacaauuagcuaggc

SEQ ID NO: 95247 - RNA, 32 nt, Human
cauuucuacuaaaaguacagaaauuagcuggg

SEQ ID NO: 95248 - RNA, 32 nt, Human
cauuucuagaugcaaauaacuccuucaccagg

SEQ ID NO: 95249 - RNA, 32 nt, Human
cauuucuaguaagcagugagguuguuugacau

SEQ ID NO: 95250 - RNA, 32 nt, Human
cauuucuauagccgaacuuguauaugugguug

SEQ ID NO: 95251 - RNA, 31 nt, Human
cauuucuaugcaggcagcacagcagacuagu

SEQ ID NO: 95252 - RNA, 32 nt, Human
cauuucuauguucauuccacuuuguauaucuu

SEQ ID NO: 95253 - RNA, 32 nt, Human
cauuucucaaaacaccaugucucuccaauuuu

SEQ ID NO: 95254 - RNA, 32 nt, Human
cauuucucaaagauuuuugagguuguauuugc

SEQ ID NO: 95255 - RNA, 32 nt, Human
ccaaguccuagcuccuccuccugggcuauauu

SEQ ID NO: 95256 - RNA, 32 nt, Human
ccaaguccuccacccgcugcccccgccauguc

SEQ ID NO: 95257 - RNA, 32 nt, Human
ccaaguccucucacuccuccagccuggaaugu

SEQ ID NO: 95258 - RNA, 32 nt, Human
ccaaguccugggagagaagugggugcgguccg

SEQ ID NO: 95259 - RNA, 32 nt, Human
ccaaguccuguuuccuuagaauuugugauagc

SEQ ID NO: 95260 - RNA, 22 nt, Human
ccaagucgagaacacuugaaca

SEQ ID NO: 95261 - RNA, 32 nt, Human
ccaagucuauuucauuuuuccacacugagcaa

SEQ ID NO: 95262 - RNA, 32 nt, Human
ccaagucucacaccucccuuagucccacucuu

SEQ ID NO: 95263 - RNA, 32 nt, Human
ccaagucuccaccccuuucuagaccaauaaag

SEQ ID NO: 95264 - RNA, 32 nt, Human
ccaagucuccuggccuggugcuuacuucaaau

SEQ ID NO: 95265 - RNA, 32 nt, Human
ccaagucugccuggcugccucuuaggauauga

SEQ ID NO: 95266 - RNA, 21 nt, Human
ccaagucugcgaauccagggu

SEQ ID NO: 95267 - RNA, 20 nt, Human
ccaagucugcuucugugaua

SEQ ID NO: 95268 - RNA, 32 nt, Human
ccaagucugggggcagaaccugaguguggaug

SEQ ID NO: 95269 - RNA, 32 nt, Human
ccaagucugucugcuucaggagcuucguacug

SEQ ID NO: 95270 - RNA, 32 nt, Human
ccaagucuguuccgucagagcuucuggcugcu

SEQ ID NO: 95271 - RNA, 32 nt, Human
ccaagugaaaagcaggcaaaagacuugaauag

SEQ ID NO: 95272 - RNA, 32 nt, Human
ccaagugaaacgucucacaggcccaggacuua

SEQ ID NO: 95273 - RNA, 32 nt, Human
ccaagugaaauuccuucuccagucacaguguc

SEQ ID NO: 95274 - RNA, 32 nt, Human
ccaagugacuuagccacauuuccuucagugca

SEQ ID NO: 95275 - RNA, 32 nt, Human
ccaagugagugaggaggaggaggaggagaagg

SEQ ID NO: 95276 - RNA, 21 nt, Human
ccaagugauccucccaccuca

SEQ ID NO: 95277 - RNA, 32 nt, Human
ccaagugauccucccaccucagccucucaagu

SEQ ID NO: 95278 - RNA, 32 nt, Human
ccaagugaugcccuccugccacuccccugcga

SEQ ID NO: 95279 - RNA, 32 nt, Human
ccaagugauggaagagguuggaagugaauaau

SEQ ID NO: 95280 - RNA, 32 nt, Human
ccaagugauucuguucuucuccauuuuuggca

SEQ ID NO: 95281 - RNA, 32 nt, Human
ccaagugcagcaacccagcccauggagauugc

SEQ ID NO: 95282 - RNA, 32 nt, Human
ccaagugcaucuagccuggccuggagggcaag

SEQ ID NO: 95283 - RNA, 20 nt, Human
ccaagugccacaucuugcca

SEQ ID NO: 95284 - RNA, 32 nt, Human
ccaagugccaucauccuucaccucagcagccc

SEQ ID NO: 95285 - RNA, 32 nt, Human
ccaagugccaugacccaggagccauucagaga

SEQ ID NO: 95286 - RNA, 32 nt, Human
ccaagugccauggcuuacaccuguaagcccag

SEQ ID NO: 95287 - RNA, 32 nt, Human
ccaagugcccccacugagcaggccaacaugcu

SEQ ID NO: 95288 - RNA, 32 nt, Human
ccaagugccccugcugggccagucccagagag

SEQ ID NO: 95289 - RNA, 31 nt, Human
ccaagugcccucucugaaccucaguuuccuc

SEQ ID NO: 95290 - RNA, 32 nt, Human
ccaagugccuccagcugaccucuggcuccugu

SEQ ID NO: 95291 - RNA, 19 nt, Human
ccaagugccuggacccaga

SEQ ID NO: 95292 - RNA, 32 nt, Human
ccaagugccuucccucaugccugggccggcug

SEQ ID NO: 95293 - RNA, 23 nt, Human
ccaagugcggacaucacuugaga

SEQ ID NO: 95294 - RNA, 32 nt, Human
ccaagugcggacaucacuugagaccaggaguu

SEQ ID NO: 95295 - RNA, 28 nt, Human
ccaagugcgugccgugugagugugacag

SEQ ID NO: 95296 - RNA, 21 nt, Human
ccaagugcuaggauuacaggc

SEQ ID NO: 95297 - RNA, 23 nt, Human
ccaagugcuaggauuacaggcgu

SEQ ID NO: 95298 - RNA, 23 nt, Human
ccaagugcuggaauuacaggcgu

SEQ ID NO: 95299 - RNA, 23 nt, Human
ccaagugcuggaauuacaggugu

SEQ ID NO: 95300 - RNA, 21 nt, Human
ccaagugcugggauuacaggc

SEQ ID NO: 95301 - RNA, 22 nt, Human
ccaagugcugggauuacaggca

SEQ ID NO: 95302 - RNA, 22 nt, Human
ccaagugcugggauuacaggcg

SEQ ID NO: 95303 - RNA, 23 nt, Human
ccaagugcugggauuacaggcgu

SEQ ID NO: 95304 - RNA, 21 nt, Human
ccaagugcugggauuauaggc

SEQ ID NO: 95305 - RNA, 23 nt, Human
ccaagugcuuaaacacaaggaua

SEQ ID NO: 95306 - RNA, 21 nt, Human
ccaagugcuuagcccagggcc

SEQ ID NO: 95307 - RNA, 32 nt, Human
ccaaguggaaaggccuccagagacaggagaca

SEQ ID NO: 95308 - RNA, 32 nt, Human
ccaaguggacugucaggcuaacaggaauaagu

SEQ ID NO: 95309 - RNA, 32 nt, Human
ccaaguggagcuuugagagaaaaacagaaggg

SEQ ID NO: 95310 - RNA, 32 nt, Human
ccaaguggccauccuaauucagaaagaagcua

SEQ ID NO: 95311 - RNA, 32 nt, Human
ccaaguggccucucgcugcaguaacaguuccg

SEQ ID NO: 95312 - RNA, 23 nt, Human
ccaaguggcugggauuacaggcg

SEQ ID NO: 95313 - RNA, 21 nt, Human
ccaaguggcugggauugcagg

SEQ ID NO: 95314 - RNA, 22 nt, Human
ccaaguggcugggauugcaggc

SEQ ID NO: 95315 - RNA, 32 nt, Human
ccaagugggccggcgcccaccaugcuccuggg

SEQ ID NO: 95316 - RNA, 32 nt, Human
ccaagugggucugcaagacuguaccucugccc

SEQ ID NO: 95317 - RNA, 32 nt, Human
ccaagugguaggagggagaguagcagagcaug

SEQ ID NO: 95318 - RNA, 32 nt, Human
ccaaguggugcuuucagagaauugauucagcc

SEQ ID NO: 95319 - RNA, 32 nt, Human
ccaaguguauauguuuacauguuuuuauccug

SEQ ID NO: 95320 - RNA, 22 nt, Human
ccaagugucugggauuacaggc

SEQ ID NO: 95321 - RNA, 32 nt, Human
ccaagugucuguuccaggcuucuggccugagg

SEQ ID NO: 95322 - RNA, 32 nt, Human
ccaagugugauggcacauaccuguaaucccag

SEQ ID NO: 95323 - RNA, 32 nt, Human
ccaagugugcccucuucccucucuccagauca

SEQ ID NO: 95324 - RNA, 32 nt, Human
ccaagugugguggcucacgccuguaaucccag

SEQ ID NO: 95325 - RNA, 32 nt, Human
ccaagugugguggcucaugccuguaaucccag

SEQ ID NO: 95326 - RNA, 32 nt, Human
ccaagugugguggcuuacaccuguaauccuag

SEQ ID NO: 95327 - RNA, 19 nt, Human
ccaagugugguggugcaca

SEQ ID NO: 95328 - RNA, 32 nt, Human
ccaaguguuaaggagaacaaaaauucaguauu

SEQ ID NO: 95329 - RNA, 32 nt, Human
ccaaguguuacccagaugguggaggaugugaa

SEQ ID NO: 95330 - RNA, 23 nt, Human
ccaaguguugggauuacaggcgu

SEQ ID NO: 95331 - RNA, 32 nt, Human
ccaaguuaaauauugauagccuaaagacaaau

SEQ ID NO: 95332 - RNA, 32 nt, Human
ccaaguuaaauauugauagccuaaagacaagu

SEQ ID NO: 95333 - RNA, 32 nt, Human
ccaaguuaaguguuuccuucccucucucaaua

SEQ ID NO: 95334 - RNA, 32 nt, Human
ccaaguuaugaggaaaagagggcugagggccu

SEQ ID NO: 95335 - RNA, 32 nt, Human
ccaaguuaugccaguuggggagggaaggacua

SEQ ID NO: 95336 - RNA, 32 nt, Human
ccaaguuauugauuauugguugcccagcuguc

SEQ ID NO: 95337 - RNA, 32 nt, Human
ccaaguucaacugauucuucugccucagccuc

SEQ ID NO: 95338 - RNA, 32 nt, Human
ccaaguucaagcaauucuccugccucagccuc

SEQ ID NO: 95339 - RNA, 32 nt, Human
ccaaguucaaguaauucuccagccucagccuc

SEQ ID NO: 95340 - RNA, 32 nt, Human
ccaaguucacaccauucuccugccucagccuc

SEQ ID NO: 95341 - RNA, 32 nt, Human
ccaaguucacgccauucuccugccucagccuc

SEQ ID NO: 95342 - RNA, 32 nt, Human
ccaaguucagacuccauucuugugcaguggga

SEQ ID NO: 95343 - RNA, 32 nt, Human
ccaaguucagcccagcuauggcccaggagaag

SEQ ID NO: 95344 - RNA, 32 nt, Human
ccaaguucagccgccaccggcacggccaggcc

SEQ ID NO: 95345 - RNA, 32 nt, Human
ccaaguucaggcaauucuccugccccagccuc

SEQ ID NO: 95346 - RNA, 32 nt, Human
ccaaguucagggauuggcucaggccccuaaug

SEQ ID NO: 95347 - RNA, 32 nt, Human
ccaaguucaguaaagacuugggugacagucaa

SEQ ID NO: 95348 - RNA, 32 nt, Human
ccaaguucaguguggauuuuucuuggugcucu

SEQ ID NO: 95349 - RNA, 32 nt, Human
ccaaguucaugccauucuccugccucagccuc

SEQ ID NO: 95350 - RNA, 19 nt, Human
ccaaguucccccugggguc

SEQ ID NO: 95351 - RNA, 32 nt, Human
ccaaguucgaggacgccuucacccucaaggug

SEQ ID NO: 95352 - RNA, 32 nt, Human
ccaaguucuccacuagcuauggugucauaggc

SEQ ID NO: 95353 - RNA, 18 nt, Human
ccaaguucucccaagggc

SEQ ID NO: 95354 - RNA, 32 nt, Human
ccaaguucugcuguuugggugacagugcuuug

SEQ ID NO: 95355 - RNA, 18 nt, Human
ccaaguugaagacuguug

SEQ ID NO: 95356 - RNA, 32 nt, Human
ccaaguugagccccaaaccaaagagagccaag

SEQ ID NO: 95357 - RNA, 32 nt, Human
ccaaguugcacgcgcuuagaacggaguacuuu

SEQ ID NO: 95358 - RNA, 32 nt, Human
ccaaguugcacgcgcuuagaacggagucuacg

SEQ ID NO: 95359 - RNA, 32 nt, Human
ccaaguugccagcccguguuucucagacuuua

SEQ ID NO: 95360 - RNA, 23 nt, Human
ccaaguugcugggacuacaggug

SEQ ID NO: 95361 - RNA, 24 nt, Human
ccaaguuggaaaacacucuucagg

SEQ ID NO: 95362 - RNA, 19 nt, Human
ccaaguuguggugcugaca

SEQ ID NO: 95363 - RNA, 21 nt, Human
ccaaguuuccuucuccacuga

SEQ ID NO: 95364 - RNA, 32 nt, Human
ccaaguuucgggaauacaaagccauugaaacc

SEQ ID NO: 95365 - RNA, 18 nt, Human
ccaaguuucuuugaggcc

SEQ ID NO: 95366 - RNA, 32 nt, Human
ccaauaaacccaggcuccaggccgugggggcu

SEQ ID NO: 95367 - RNA, 32 nt, Human
ccaauaaagacuguuaauuccucaugcguugc

SEQ ID NO: 95368 - RNA, 18 nt, Human
ccaauaaaguguugcaca

SEQ ID NO: 95369 - RNA, 32 nt, Human
ccaauaaauagcucaccauucccuucagagaa

SEQ ID NO: 95370 - RNA, 32 nt, Human
ccaauaacacccaggcugagagucaaaccaag

SEQ ID NO: 95371 - RNA, 32 nt, Human
ccaauaacucgugcucaucugcagccuccucu

SEQ ID NO: 95372 - RNA, 32 nt, Human
ccaauaacugcacuucaccuguaaagacauau

SEQ ID NO: 95373 - RNA, 32 nt, Human
ccaauaauaaaaugaaaugaccucuggucccu

SEQ ID NO: 95374 - RNA, 21 nt, Human
ccaauaauggucccucuuccc

SEQ ID NO: 95375 - RNA, 21 nt, Human
ccaauacacaacccccuuccc

SEQ ID NO: 95376 - RNA, 19 nt, Human
ccaauacccaggugaggaa

SEQ ID NO: 95377 - RNA, 32 nt, Human
ccaauacccuccucccaaaaacugaaauuggc

SEQ ID NO: 95378 - RNA, 32 nt, Human
ccaauacccuuucaaaagaguugucugcaaca

SEQ ID NO: 95379 - RNA, 32 nt, Human
ccaauacuccacugcucauauuuuuaucuaau

SEQ ID NO: 95380 - RNA, 32 nt, Human
ccaauagaguugaccuguuauuggauuuccug

SEQ ID NO: 95381 - RNA, 32 nt, Human
ccaauagcccaggagcuugggugugcugacga

SEQ ID NO: 95382 - RNA, 32 nt, Human
ccaauagcccaggcuggagugcaguggcagag

SEQ ID NO: 95383 - RNA, 32 nt, Human
ccaauagcucacucccuagagccugacgccgg

SEQ ID NO: 95384 - RNA, 32 nt, Human
ccaauaggugaucuuaauuacuuucagaauau

SEQ ID NO: 95385 - RNA, 32 nt, Human
ccaauagguugccaccagccacauaaggcuau

SEQ ID NO: 95386 - RNA, 32 nt, Human
ccaauagucauaugugaagacagagcagauca

SEQ ID NO: 95387 - RNA, 32 nt, Human
ccaauaguccccaucagcaccauggaggcagg

SEQ ID NO: 95388 - RNA, 32 nt, Human
ccaauagucuccaucacuuauuagccauguga

SEQ ID NO: 95389 - RNA, 32 nt, Human
ccaauagucugcaaacccgcagagccaugaag

SEQ ID NO: 95390 - RNA, 32 nt, Human
ccaauaguuaucucaugcaccucugagugccu

SEQ ID NO: 95391 - RNA, 32 nt, Human
ccaauauauucugccaagaauaugccuugaua

SEQ ID NO: 95392 - RNA, 18 nt, Human
ccaauaugaugcauuuua

SEQ ID NO: 95393 - RNA, 32 nt, Human
ccaauaugcacaauauuaacuaaugccaagac

SEQ ID NO: 95394 - RNA, 20 nt, Human
ccaauaugguaaaaccccgu

SEQ ID NO: 95395 - RNA, 20 nt, Human
ccaauauggugaaaccacgu

SEQ ID NO: 95396 - RNA, 20 nt, Human
ccaauauggugaaacccagu

SEQ ID NO: 95397 - RNA, 32 nt, Human
ccaauauggugaaaccccaugucuacuaaaaa

SEQ ID NO: 95398 - RNA, 20 nt, Human
ccaauauggugaaaccccgu

SEQ ID NO: 95399 - RNA, 20 nt, Human
ccaauauggugaaacccguc

SEQ ID NO: 95400 - RNA, 20 nt, Human
ccaauauggugaaacccugu

SEQ ID NO: 95401 - RNA, 20 nt, Human
ccaauauggugaaacuccgu

SEQ ID NO: 95402 - RNA, 20 nt, Human
ccaauaugucuagacucaga

SEQ ID NO: 95403 - RNA, 32 nt, Human
ccaauauugauggcaacagucaagauggugug

SEQ ID NO: 95404 - RNA, 32 nt, Human
ccaauauugguucauugucaucaaucaugguu

SEQ ID NO: 95405 - RNA, 32 nt, Human
ccaauauuguaauccuagcacuuugggaggcc

SEQ ID NO: 95406 - RNA, 32 nt, Human
ccaauauuucugcuuucuuugauucuccuuuu

SEQ ID NO: 95407 - RNA, 32 nt, Human
ccaauauuuggaccuuauuuugagguugucug

SEQ ID NO: 95408 - RNA, 32 nt, Human
ccaaucaagguugaggaguggggcuggggaga

SEQ ID NO: 95409 - RNA, 32 nt, Human
ccaaucacacuaagggucucucuauuucuucu

SEQ ID NO: 95410 - RNA, 32 nt, Human
ccaaucacagccgaggggcccagaagagagca

SEQ ID NO: 95411 - RNA, 32 nt, Human
ccaaucaccacugcccuccaagaccgguacac

SEQ ID NO: 95412 - RNA, 32 nt, Human
ccaaucaccccaaacaaauggaagagaagaga

SEQ ID NO: 95413 - RNA, 32 nt, Human
ccaaucaccuugggcccaaaauagcugaugau

SEQ ID NO: 95414 - RNA, 32 nt, Human
ccaaucacguugcuggcaaggcauuuuagagu

SEQ ID NO: 95415 - RNA, 32 nt, Human
ccaaucagagagagcucgcccccguuuucuuc

SEQ ID NO: 95416 - RNA, 32 nt, Human
ccaaucagccaccaaauggcauuaccuagguc

SEQ ID NO: 95417 - RNA, 32 nt, Human
ccaaucagcccaacccagcccagacugggcuu

SEQ ID NO: 95418 - RNA, 32 nt, Human
ccaaucagccuugccugcuuucaucucuccca

SEQ ID NO: 95419 - RNA, 32 nt, Human
ccaaucaggagaaggguucugccucccauccc

SEQ ID NO: 95420 - RNA, 18 nt, Human
ccaaucauccacccaucc

SEQ ID NO: 95421 - RNA, 32 nt, Human
ccaaucaucuguuuuuaaacaaucguuuuuga

SEQ ID NO: 95422 - RNA, 32 nt, Human
ccaaucauucaccucugugcccaaacccaagu

SEQ ID NO: 95423 - RNA, 32 nt, Human
ccaauccaagcccacugcagccuuguggauuu

SEQ ID NO: 95424 - RNA, 32 nt, Human
ccaauccagaugugaucccccugugaucuacu

SEQ ID NO: 95425 - RNA, 32 nt, Human
ccaauccaggcccggugaggccaagguuuccc

SEQ ID NO: 95426 - RNA, 32 nt, Human
ccaaucccagaacacauggagggaaucggaca

SEQ ID NO: 95427 - RNA, 32 nt, Human
ccaaucccagagcagaggucugaagacaggag

SEQ ID NO: 95428 - RNA, 32 nt, Human
ccaaucccagugcuacaccugagguucuggag

SEQ ID NO: 95429 - RNA, 32 nt, Human
ccaauccccacagacacacacauugauccucc

SEQ ID NO: 95430 - RNA, 21 nt, Human
ccaaucccccgccacuucccu

SEQ ID NO: 95431 - RNA, 32 nt, Human
ccaaucccucaugaguugaagcauuaauagau

SEQ ID NO: 95432 - RNA, 32 nt, Human
ccaaucccuguugccgcauggagcuccucagc

SEQ ID NO: 95433 - RNA, 22 nt, Human
ccaauccuccccgcucugccgc

SEQ ID NO: 95434 - RNA, 32 nt, Human
ccaauccugaagagacugagagucuagcauug

SEQ ID NO: 95435 - RNA, 32 nt, Human
ccaauccugaguuucucagacuuggcaauggg

SEQ ID NO: 95436 - RNA, 32 nt, Human
ccaauccugcuggcuucagccuggagaaggga

SEQ ID NO: 95437 - RNA, 32 nt, Human
ccaauccuguguagacaccaugacccaguugu

SEQ ID NO: 95438 - RNA, 32 nt, Human
ccaauccuuaucaauucucaccaccccauaaa

SEQ ID NO: 95439 - RNA, 32 nt, Human
ccaaucgacaagaagcuggaaaagaaugaugu

SEQ ID NO: 95440 - RNA, 32 nt, Human
ccaaucggacugccaaauucuccgguuugccc

SEQ ID NO: 95441 - RNA, 32 nt, Human
ccaaucgggagggagagacagagacagagccg

SEQ ID NO: 95442 - RNA, 32 nt, Human
ccaaucuaucuauuugcccacccauccaucca

SEQ ID NO: 95443 - RNA, 32 nt, Human
ccaaucucauuagcagguguagaaagguuuug

SEQ ID NO: 95444 - RNA, 32 nt, Human
ccaaucucccgcagcucuccugccccuggggg

SEQ ID NO: 95445 - RNA, 32 nt, Human
ccaaucucuauguuauguuuaauuuuauuuug

SEQ ID NO: 95446 - RNA, 32 nt, Human
ccaaucucucauuuugaaauuuugccaauggu

SEQ ID NO: 95447 - RNA, 32 nt, Human
ccaaucucuccucaggacugagucaacccccu

SEQ ID NO: 95448 - RNA, 32 nt, Human
ccaaucucuccucucuguuuucacccagaagu

SEQ ID NO: 95449 - RNA, 32 nt, Human
ccaaucucugauguuauugagcuccugcauga

SEQ ID NO: 95450 - RNA, 32 nt, Human
ccaaucucugcccuccccacccauggugguac

SEQ ID NO: 95451 - RNA, 32 nt, Human
ccaaucucuguggccaagcuccagccaaaaag

SEQ ID NO: 95452 - RNA, 32 nt, Human
ccaaucugauucugcugcccgaguuccuauuu

SEQ ID NO: 95453 - RNA, 32 nt, Human
ccaaucugggcaacagagagaccccaucucuu

SEQ ID NO: 95454 - RNA, 32 nt, Human
ccaaucugggcaacauagcaagauucugucuc

SEQ ID NO: 95455 - RNA, 32 nt, Human
ccaaucugggcaacauggggaaaccccagcuc

SEQ ID NO: 95456 - RNA, 22 nt, Human
ccaaucugguacaguuuguuaa

SEQ ID NO: 95457 - RNA, 32 nt, Human
ccaaucuguauuggcagaugcuauaggaauug

SEQ ID NO: 95458 - RNA, 32 nt, Human
ccaaucuuuuugacuuuuugcuuaaaauguuu

SEQ ID NO: 95459 - RNA, 32 nt, Human
ccaaugaaaaggaagagaaaauaaaguguguu

SEQ ID NO: 95460 - RNA, 32 nt, Human
ccaaugaaagguugccgacugaucagaccacg

SEQ ID NO: 95461 - RNA, 32 nt, Human
ccaaugaagccuuuaaaaagcagauggagagu

SEQ ID NO: 95462 - RNA, 32 nt, Human
ccaaugaagcuaagugguuaucccagaaacuu

SEQ ID NO: 95463 - RNA, 32 nt, Human
ccaaugaaggacugcaguauuugugugcccga

SEQ ID NO: 95464 - RNA, 32 nt, Human
ccaaugacaggguagggagaugacaguggugc

SEQ ID NO: 95465 - RNA, 19 nt, Human
ccaaugagacagucccuga

SEQ ID NO: 95466 - RNA, 20 nt, Human
ccaaugagaggaggggcagg

SEQ ID NO: 95467 - RNA, 32 nt, Human
ccaaugagcuacccacagccugggcaacgcag

SEQ ID NO: 95468 - RNA, 32 nt, Human
ccaaugagcugugaggacgugagcacaggucc

SEQ ID NO: 95469 - RNA, 31 nt, Human
ccaaugaggcacuucucuugguccuaguaga

SEQ ID NO: 95470 - RNA, 24 nt, Human
ccaaugaggcagagguugcaguga

SEQ ID NO: 95471 - RNA, 25 nt, Human
ccaaugaggcagagguugcagugag

SEQ ID NO: 95472 - RNA, 32 nt, Human
ccaaugaggcagagguugcagugagcugagau

SEQ ID NO: 95473 - RNA, 32 nt, Human
ccaaugagggcaggggaagaccaccuggcaug

SEQ ID NO: 95474 - RNA, 32 nt, Human
ccaaugagggggcacagcucugaaaagcacug

SEQ ID NO: 95475 - RNA, 21 nt, Human
ccaaugaggucugcugccagg

SEQ ID NO: 95476 - RNA, 32 nt, Human
ccaaugagguggccgaaucuuccuucaggaua

SEQ ID NO: 95477 - RNA, 32 nt, Human
ccaaugaguuggaggcugcagugagcuauaau

SEQ ID NO: 95478 - RNA, 32 nt, Human
ccaaugauacaacaguaguuuaaucacgugua

SEQ ID NO: 95479 - RNA, 32 nt, Human
ccaaugaugaaggcuaggaugggggaugcggu

SEQ ID NO: 95480 - RNA, 32 nt, Human
ccaaugauuaaauucauaaucauuucaucuuc

SEQ ID NO: 95481 - RNA, 32 nt, Human
ccaaugcacccccgccucacacacgcacuccu

SEQ ID NO: 95482 - RNA, 22 nt, Human
ccaaugcagaacacugcacuga

SEQ ID NO: 95483 - RNA, 32 nt, Human
ccaaugcaggaggaugguugagcucaggaguu

SEQ ID NO: 95484 - RNA, 31 nt, Human
ccaaugcaguuucaccugcagagcucacccc

SEQ ID NO: 95485 - RNA, 32 nt, Human
ccaaugcaucuucuacccugcuaccucaguga

SEQ ID NO: 95486 - RNA, 32 nt, Human
ccaaugcauguggaucaccugaggucaggagu

SEQ ID NO: 95487 - RNA, 32 nt, Human
ccaaugccaagacaguggagugggacuggaaa

SEQ ID NO: 95488 - RNA, 21 nt, Human
ccaaugccaagauaauucacu

SEQ ID NO: 95489 - RNA, 22 nt, Human
ccaaugccagaccacauccacu

SEQ ID NO: 95490 - RNA, 32 nt, Human
ccaaugccauuuuugagaacuaaccuaacagu

SEQ ID NO: 95491 - RNA, 32 nt, Human
ccaaugcccagcaaucacccuccucacuuccu

SEQ ID NO: 95492 - RNA, 32 nt, Human
ccaaugccccacaggccuuccugggccuggcc

SEQ ID NO: 95493 - RNA, 32 nt, Human
ccaaugccccgccccugcuccaaaucaagguc

SEQ ID NO: 95494 - RNA, 32 nt, Human
ccaaugccucacccaccucuggccagaggacu

SEQ ID NO: 95495 - RNA, 17 nt, Human
ccaaugccuccaccucu

SEQ ID NO: 95496 - RNA, 16 nt, Human
ccaaugccuucuggua

SEQ ID NO: 95497 - RNA, 19 nt, Human
ccaaugcgcucuggucccu

SEQ ID NO: 95498 - RNA, 32 nt, Human
ccaaugcggagcuggggcugagaugcuccagg

SEQ ID NO: 95499 - RNA, 32 nt, Human
ccaaugcuacugucagcuaaagaccugcagua

SEQ ID NO: 95500 - RNA, 25 nt, Human
ccaaugcucaccagccccagaguca

SEQ ID NO: 95501 - RNA, 32 nt, Human
ccaaugcucuuguucuaaucucuaauagguua

SEQ ID NO: 95502 - RNA, 32 nt, Human
ccaaugcugcuccacccucccccagacacagc

SEQ ID NO: 95503 - RNA, 32 nt, Human
ccaaugcuggcagccccuccccuggcauggca

SEQ ID NO: 95504 - RNA, 32 nt, Human
ccaaugcuuaccuuguccccaaaggggugggu

SEQ ID NO: 95505 - RNA, 32 nt, Human
ccaauggaauugugccauuuuguaucacugga

SEQ ID NO: 95506 - RNA, 32 nt, Human
ccaauggacuccugccagcccaucgcagaguu

SEQ ID NO: 95507 - RNA, 28 nt, Human
ccaauggagggaaagagaggagagcaaa

SEQ ID NO: 95508 - RNA, 32 nt, Human
ccaauggcaaacauuagugccaaauguauaau

SEQ ID NO: 95509 - RNA, 32 nt, Human
ccaauggcagcgguggcaguggcagcaguggc

SEQ ID NO: 95510 - RNA, 32 nt, Human
ccaauggcagucucaagaaauguacucgggcg

SEQ ID NO: 95511 - RNA, 32 nt, Human
ccaauggcuacaccagcauguacucggccaug

SEQ ID NO: 95512 - RNA, 32 nt, Human
ccaauggcuccaccauucccccagggagcccu

SEQ ID NO: 95513 - RNA, 32 nt, Human
ccaauggcugcacugccuuugucagagggggu

SEQ ID NO: 95514 - RNA, 32 nt, Human
ccaauggcuuugcaagaagaugacauuucaga

SEQ ID NO: 95515 - RNA, 32 nt, Human
ccaaugggaaggaggugaggggaaaugucagu

SEQ ID NO: 95516 - RNA, 32 nt, Human
ccaaugggaauccugcuuguucggcccaguug

SEQ ID NO: 95517 - RNA, 32 nt, Human
ccaaugggaccacccuccuggguccccuggug

SEQ ID NO: 95518 - RNA, 32 nt, Human
ccaaugggagagccgaggcggggaggugcggc

SEQ ID NO: 95519 - RNA, 32 nt, Human
ccaaugggaggcaccaagagaagaugaaaaac

SEQ ID NO: 95520 - RNA, 32 nt, Human
ccaaugggcaagcccaguggaggcaggauggg

SEQ ID NO: 95521 - RNA, 18 nt, Human
ccaaugggcugggccgug

SEQ ID NO: 95522 - RNA, 32 nt, Human
ccaauggggaaaggacacagaaacaggaacug

SEQ ID NO: 95523 - RNA, 32 nt, Human
ccaauggggagccuccagccacaaguucccug

SEQ ID NO: 95524 - RNA, 32 nt, Human
ccaauggggaggcggccucuccccuguugcug

SEQ ID NO: 95525 - RNA, 32 nt, Human
ccaauggggugaggauggcuucaagcccuaau

SEQ ID NO: 95526 - RNA, 32 nt, Human
ccaaugguaggagguagagaagaaaagcaaaa

SEQ ID NO: 95527 - RNA, 32 nt, Human
ccaaugguauugagccuuccugugcugguucc

SEQ ID NO: 95528 - RNA, 32 nt, Human
ccaauggucagcacuuuugguuugaguuaucu

SEQ ID NO: 95529 - RNA, 32 nt, Human
ccaauggugacugcucccgccugguggccgau

SEQ ID NO: 95530 - RNA, 32 nt, Human
ccaauguaaaaauguucuuuuaucucaaauuu

SEQ ID NO: 95531 - RNA, 32 nt, Human
ccaauguagaucuccugugaagcagaaccaac

SEQ ID NO: 95532 - RNA, 20 nt, Human
ccaauguagugaaaccccgu

SEQ ID NO: 95533 - RNA, 32 nt, Human
ccaauguauuuuagcuauuuuaguaguauuug

SEQ ID NO: 95534 - RNA, 32 nt, Human
ccaaugucacacuuugauuggcagugagaaac

SEQ ID NO: 95535 - RNA, 20 nt, Human
ccaaugucaugaaaguggua

SEQ ID NO: 95536 - RNA, 32 nt, Human
ccaauguccugagacaugaacccaaaaagaga

SEQ ID NO: 95537 - RNA, 32 nt, Human
ccaaugucguaguucaucagccuccgaaagca

SEQ ID NO: 95538 - RNA, 32 nt, Human
ccaaugucugcuguuuccaacacuggugauuu

SEQ ID NO: 95539 - RNA, 32 nt, Human
ccaaugucuuuugacaggugccuguccuugaa

SEQ ID NO: 95540 - RNA, 20 nt, Human
ccaaugugaugaaaccccgu

SEQ ID NO: 95541 - RNA, 32 nt, Human
ccaaugugcuggaauuacagguauggcuaccg

SEQ ID NO: 95542 - RNA, 22 nt, Human
ccaaugugcugggauuacaggc

SEQ ID NO: 95543 - RNA, 32 nt, Human
ccaauguggaacaaauggagugaucuguuauc

SEQ ID NO: 95544 - RNA, 32 nt, Human
ccaauguggguggaucaccugaggucaggagu

SEQ ID NO: 95545 - RNA, 20 nt, Human
ccaauguggugaaacccugu

SEQ ID NO: 95546 - RNA, 32 nt, Human
ccaaugugucuuccuaggcagccccugaggag

SEQ ID NO: 95547 - RNA, 32 nt, Human
ccaaugugugaaauuagugaaaucuuaguacc

SEQ ID NO: 95548 - RNA, 32 nt, Human
ccaauguugugugcaugaaaaggauuccuugg

SEQ ID NO: 95549 - RNA, 32 nt, Human
ccaauuagagcugguaagacagcuguacuguu

SEQ ID NO: 95550 - RNA, 20 nt, Human
ccaauuagcauuuuguaaua

SEQ ID NO: 95551 - RNA, 24 nt, Human
ccaauuagcugggacugcaggcgu

SEQ ID NO: 95552 - RNA, 32 nt, Human
ccaauuaggcccagagagacaaagacagaucu

SEQ ID NO: 95553 - RNA, 26 nt, Human
ccaauuaggggaaggcagaucaccaa

SEQ ID NO: 95554 - RNA, 32 nt, Human
ccaauuauguccuaauuguauuuuggggaaug

SEQ ID NO: 95555 - RNA, 32 nt, Human
ccaauucaaccuucugucugguugugccagga

SEQ ID NO: 95556 - RNA, 32 nt, Human
ccaauucaagcuuauuuuagggaagccuugaa

SEQ ID NO: 95557 - RNA, 23 nt, Human
ccaauucaaggacugggguccuu

SEQ ID NO: 95558 - RNA, 32 nt, Human
ccaauucacccacuguguaucuucaugaaugg

SEQ ID NO: 95559 - RNA, 32 nt, Human
ccaauucagcuccucuggaguggagcuuucug

SEQ ID NO: 95560 - RNA, 32 nt, Human
ccaauucaugaagugaauuaaugaugaggauc

SEQ ID NO: 95561 - RNA, 32 nt, Human
ccaauuccacuuccugccccaacugcaggaau

SEQ ID NO: 95562 - RNA, 32 nt, Human
ccaauuccagauugacuguagauacagauugg

SEQ ID NO: 95563 - RNA, 32 nt, Human
ccaauuccaggacuuccucacauggcuccuac

SEQ ID NO: 95564 - RNA, 32 nt, Human
ccaauuccucaaggcuaucggccagccccucc

SEQ ID NO: 95565 - RNA, 32 nt, Human
ccaauuccugcagcuguuuguguuggagggaa

SEQ ID NO: 95566 - RNA, 32 nt, Human
ccaauuccuggccuuggagcucaaaucuuucc

SEQ ID NO: 95567 - RNA, 32 nt, Human
ccaauuccuuuagccucuccccaccuguccaa

SEQ ID NO: 95568 - RNA, 32 nt, Human
ccaauucuacugaauggggguggaccuggcau

SEQ ID NO: 95569 - RNA, 18 nt, Human
ccaauucucaguguggua

SEQ ID NO: 95570 - RNA, 19 nt, Human
ccaauucugcagagagaug

SEQ ID NO: 95571 - RNA, 20 nt, Human
ccaauucugcauugcugaga

SEQ ID NO: 95572 - RNA, 23 nt, Human
ccaauucugccugccuccucccu

SEQ ID NO: 95573 - RNA, 32 nt, Human
ccaauucugggagugcucugaggccucugggg

SEQ ID NO: 95574 - RNA, 32 nt, Human
ccaauugaaggacuggcucuguacugacacuu

SEQ ID NO: 95575 - RNA, 32 nt, Human
ccaauugagcuccagcccugguuuuccuaccc

SEQ ID NO: 95576 - RNA, 32 nt, Human
ccaauugauuuucccagcucccagcccuggau

SEQ ID NO: 95577 - RNA, 32 nt, Human
ccaauugcaagcucauuccucuaccucauacu

SEQ ID NO: 95578 - RNA, 32 nt, Human
ccaauugcacacauaagcaaaaaggcauuuuc

SEQ ID NO: 95579 - RNA, 32 nt, Human
ccaauugcagagaacucgcuucccaggcuucu

SEQ ID NO: 95580 - RNA, 32 nt, Human
ccaauugcagaggcagaguuuuacagacaggu

SEQ ID NO: 95581 - RNA, 32 nt, Human
ccaauugcgauggcucacgccuguaaucccag

SEQ ID NO: 95582 - RNA, 31 nt, Human
ccaauugcuaccgagaagguuggaggugggg

SEQ ID NO: 95583 - RNA, 32 nt, Human
ccaauuggauuucaaguuauaugaugaaauuc

SEQ ID NO: 95584 - RNA, 22 nt, Human
ccaauugggauucucauucgcc

SEQ ID NO: 95585 - RNA, 32 nt, Human
ccaauuggucagaaaggaaagaaggccuccua

SEQ ID NO: 95586 - RNA, 18 nt, Human
ccaauuggugacgcugca

SEQ ID NO: 95587 - RNA, 32 nt, Human
ccaauuguacuaaaaauacaaaauuagccggg

SEQ ID NO: 95588 - RNA, 32 nt, Human
ccaauuguccaaccuccauuacaggggucuuc

SEQ ID NO: 95589 - RNA, 32 nt, Human
ccaauuuauccaaacagaacuguggugucaau

SEQ ID NO: 95590 - RNA, 31 nt, Human
ccaauuucacucaaauguuuugagaacugug

SEQ ID NO: 95591 - RNA, 32 nt, Human
ccaauuucauuucagaauaaaaagcuagcauc

SEQ ID NO: 95592 - RNA, 32 nt, Human
ccaauuuccagaaccugccaccagggggaggu

SEQ ID NO: 95593 - RNA, 32 nt, Human
ccaauuuccagagccacuaucucugcugucca

SEQ ID NO: 95594 - RNA, 32 nt, Human
ccaauuuccauagaugcaaauggcaguuacag

SEQ ID NO: 95595 - RNA, 18 nt, Human
ccaauuuccugcuugcca

SEQ ID NO: 95596 - RNA, 32 nt, Human
ccaauuucucaugucucuccugagauguuuua

SEQ ID NO: 95597 - RNA, 32 nt, Human
ccaauuucuggcccagcagguuucucuuugua

SEQ ID NO: 95598 - RNA, 32 nt, Human
ccaauuucuugaaggagagcaagguagaacgu

SEQ ID NO: 95599 - RNA, 32 nt, Human
ccaauuugccuuuuucuuuuucuugccuuauu

SEQ ID NO: 95600 - RNA, 32 nt, Human
ccaauuuggccgucgcagaacaggaggcaucu

SEQ ID NO: 95601 - RNA, 32 nt, Human
ccaauuuuccagauggagucucgcuuuguugc

SEQ ID NO: 95602 - RNA, 32 nt, Human
ccaauuuuuagaguggcuaguaguuucuucau

SEQ ID NO: 95603 - RNA, 32 nt, Human
ccaauuuuucucauuucuaugccuccuauauu

SEQ ID NO: 95604 - RNA, 23 nt, Human
ccacaaaaacaaaagcagaggaa

SEQ ID NO: 95605 - RNA, 32 nt, Human
ccacaaaaacauuuaauuuauggauccugccu

SEQ ID NO: 95606 - RNA, 32 nt, Human
ccacaaaacaccuucaguagagccuugauuaa

SEQ ID NO: 95607 - RNA, 32 nt, Human
ccacaaaacucaucuggaguucucaaagaccu

SEQ ID NO: 95608 - RNA, 32 nt, Human
ccacaaaagaucccagcugucaguggucucau

SEQ ID NO: 95609 - RNA, 32 nt, Human
ccacaaaagccacaccugugauucaaagacac

SEQ ID NO: 95610 - RNA, 20 nt, Human
ccacaaaagggaacauccca

SEQ ID NO: 95611 - RNA, 32 nt, Human
ccacaaaauuauuugaguacugugaaggauua

SEQ ID NO: 95612 - RNA, 32 nt, Human
ccacaaacaacaaaggcuacccuuugaccaaa

SEQ ID NO: 95613 - RNA, 32 nt, Human
ccacaaacaacaacaagacauucauucccaac

SEQ ID NO: 95614 - RNA, 25 nt, Human
ccacaaacaagaaaacccagaggaa

SEQ ID NO: 95615 - RNA, 32 nt, Human
ccacaaacacagaucacaggggccuuacaaag

SEQ ID NO: 95616 - RNA, 20 nt, Human
ccacaaacacagcacuucgg

SEQ ID NO: 95617 - RNA, 32 nt, Human
ccacaaaccccacucccucaagaagggccagg

SEQ ID NO: 95618 - RNA, 21 nt, Human
ccacaaacccugccucugagg

SEQ ID NO: 95619 - RNA, 32 nt, Human
ccacaaacucaccuuauguuacuccaaaguaa

SEQ ID NO: 95620 - RNA, 20 nt, Human
ccacaaacuccauccuccaa

SEQ ID NO: 95621 - RNA, 32 nt, Human
ccacaaacucgccuuauguuacuccaaaguaa

SEQ ID NO: 95622 - RNA, 30 nt, Human
ccacaaagaaaaucaacuugcuacuacaug

SEQ ID NO: 95623 - RNA, 32 nt, Human
ccacaaagagaugucauggguuuugaggaggc

SEQ ID NO: 95624 - RNA, 19 nt, Human
ccacaaagagcccauccaa

SEQ ID NO: 95625 - RNA, 32 nt, Human
ccacaaagauaggaacccaggagcagcagugu

SEQ ID NO: 95626 - RNA, 32 nt, Human
ccacaaagcaccagagguaggagaccuggauu

SEQ ID NO: 95627 - RNA, 32 nt, Human
ccacaaagccuuaucaagugucuuccaucaug

SEQ ID NO: 95628 - RNA, 32 nt, Human
ccacaaaggagagaaaggguggaggagggcag

SEQ ID NO: 95629 - RNA, 24 nt, Human
ccacaaauaguguaguuuuagaua

SEQ ID NO: 95630 - RNA, 32 nt, Human
ccacaaaucaugguuaauaaaagagaguaguu

SEQ ID NO: 95631 - RNA, 32 nt, Human
ccacaaaucuggugccugucucuugcuuacca

SEQ ID NO: 95632 - RNA, 25 nt, Human
ccacaaaugcauucaguggcaguga

SEQ ID NO: 95633 - RNA, 32 nt, Human
ccacaaaugggguccccaggugacccacacuu

SEQ ID NO: 95634 - RNA, 32 nt, Human
ccacaacaacccugugggcacugaauggcggu

SEQ ID NO: 95635 - RNA, 32 nt, Human
ccacaacaacuccgggcggaagcagcaggucu

SEQ ID NO: 95636 - RNA, 32 nt, Human
ccacaacacagccacagcaguggcagcccugg

SEQ ID NO: 95637 - RNA, 25 nt, Human
ccacaacagucaaucucaaacaagg

SEQ ID NO: 95638 - RNA, 32 nt, Human
ccacaacauacucaaaggaacggagagaaccg

SEQ ID NO: 95639 - RNA, 32 nt, Human
ccacaaccacagcccuagaaagaaggaugaac

SEQ ID NO: 95640 - RNA, 21 nt, Human
ccacaaccaccaccagugcua

SEQ ID NO: 95641 - RNA, 32 nt, Human
ccacaaccaccuccagccugggagauaggccu

SEQ ID NO: 95642 - RNA, 32 nt, Human
ccacaacccaacccuucucacucuccucagug

SEQ ID NO: 95643 - RNA, 32 nt, Human
ccacaacccacauuaagaaauacauuucauac

SEQ ID NO: 95644 - RNA, 32 nt, Human
ccacaaccccaaccccagaggaaaagcccccu

SEQ ID NO: 95645 - RNA, 32 nt, Human
ccacaacccggcgaucgaaaagauucuuagga

SEQ ID NO: 95646 - RNA, 32 nt, Human
ccacaaccuguauagugauagccauauauuua

SEQ ID NO: 95647 - RNA, 32 nt, Human
ccacaaccugucccuggcuggcuccagcgucc

SEQ ID NO: 95648 - RNA, 32 nt, Human
ccacaacgccuggcuaauuuuguauuuuuagu

SEQ ID NO: 95649 - RNA, 32 nt, Human
ccacaacugcagccgggcccucugccuauggg

SEQ ID NO: 95650 - RNA, 32 nt, Human
ccacaacugcagucccauccucuugucagggc

SEQ ID NO: 95651 - RNA, 32 nt, Human
ccacaacugccacugcucaccaggacaagcug

SEQ ID NO: 95652 - RNA, 32 nt, Human
ccacaacugccuuuacacuugcucuggguaug

SEQ ID NO: 95653 - RNA, 32 nt, Human
ccacaacugucucuguuucaacuuuaagccca

SEQ ID NO: 95654 - RNA, 32 nt, Human
ccacaacuuccuucuggccaggcccagacaug

SEQ ID NO: 95655 - RNA, 24 nt, Human
ccacaacuucugaccucccagggu

SEQ ID NO: 95656 - RNA, 19 nt, Human
ccacaagaaaauaauccca

SEQ ID NO: 95657 - RNA, 20 nt, Human
ccacaagaacguggaugcca

SEQ ID NO: 95658 - RNA, 32 nt, Human
ccacaagaacucccuucuccccucagccaaug

SEQ ID NO: 95659 - RNA, 21 nt, Human
ccacaagaaugguucugccca

SEQ ID NO: 95660 - RNA, 32 nt, Human
ccacaagcacagaggccagcgugucccgcgug

SEQ ID NO: 95661 - RNA, 32 nt, Human
ccacaagcaggcugugcagugccugaaggguc

SEQ ID NO: 95662 - RNA, 32 nt, Human
ccacaagccaaucaguuggauauuucauucau

SEQ ID NO: 95663 - RNA, 32 nt, Human
ccacaagccugagggaaaggccagcacucgcu

SEQ ID NO: 95664 - RNA, 19 nt, Human
ccacaagccugccucgccu

SEQ ID NO: 95665 - RNA, 32 nt, Human
ccacaagccugccucgccuuguguuacgauau

SEQ ID NO: 95666 - RNA, 32 nt, Human
ccacaagcuacaaaugcuaaagacaguggcug

SEQ ID NO: 95667 - RNA, 32 nt, Human
ccacaagcugcacugugaaccugggcacuccg

SEQ ID NO: 95668 - RNA, 32 nt, Human
ccacaagcuucagagcacuggccacacacuca

SEQ ID NO: 95669 - RNA, 32 nt, Human
ccacaaggacuuugccucugaaggccaguggc

SEQ ID NO: 95670 - RNA, 32 nt, Human
ccacaagggaaaggggagagggggagaaaacu

SEQ ID NO: 95671 - RNA, 32 nt, Human
ccacaagggaggcuagggcaauggagcaggcc

SEQ ID NO: 95672 - RNA, 32 nt, Human
ccacaagggcugggagcagacaucauucccug

SEQ ID NO: 95673 - RNA, 32 nt, Human
ccacaaguacuauuugccuuugcccacauuuu

SEQ ID NO: 95674 - RNA, 32 nt, Human
ccacaaguccacagucgacagaugcucagccu

SEQ ID NO: 95675 - RNA, 32 nt, Human
ccacaaguccuagugaggaaacauguugggaa

SEQ ID NO: 95676 - RNA, 32 nt, Human
ccacaagucucaucucuaacguucuaugcaau

SEQ ID NO: 95677 - RNA, 32 nt, Human
ccacaagugcuucucauauugccccaggacag

SEQ ID NO: 95678 - RNA, 32 nt, Human
ccacaagugggucuucuguggaagaugcagaa

SEQ ID NO: 95679 - RNA, 32 nt, Human
ccacaaguggguggugagaccauugaaagccu

SEQ ID NO: 95680 - RNA, 22 nt, Human
ccacaaguguuggagcugcaga

SEQ ID NO: 95681 - RNA, 32 nt, Human
ccacaaguuugagaccagccugggcaacaugg

SEQ ID NO: 95682 - RNA, 32 nt, Human
ccacaauaaaggcugagcucuuaucuugcugc

SEQ ID NO: 95683 - RNA, 32 nt, Human
ccacaauaagccaugugcaaggugaggagcaa

SEQ ID NO: 95684 - RNA, 32 nt, Human
ccacaauaagggagaugaucagaggaaucugu

SEQ ID NO: 95685 - RNA, 32 nt, Human
ccacaauagcaguucuggaaugaagcuaggaa

SEQ ID NO: 95686 - RNA, 32 nt, Human
ccacaauauccagcaaaaugucuccugagcac

SEQ ID NO: 95687 - RNA, 26 nt, Human
ccacaauauuucuucuuccucaggga

SEQ ID NO: 95688 - RNA, 32 nt, Human
ccacaaucagcauuuucacaugaaaggaaacu

SEQ ID NO: 95689 - RNA, 32 nt, Human
ccacaaucagccacugcgggcgaggagggcac

SEQ ID NO: 95690 - RNA, 19 nt, Human
ccacaauccagggggccau

SEQ ID NO: 95691 - RNA, 32 nt, Human
ccacaaucccagagaaaugcuagacagaacca

SEQ ID NO: 95692 - RNA, 32 nt, Human
ccacaaucccuccugguccuaaaugaucagag

SEQ ID NO: 95693 - RNA, 32 nt, Human
ccacaauccugagacuuucccccgggaggcac

SEQ ID NO: 95694 - RNA, 32 nt, Human
ccacaaucuaaugaggaauguacuggaaaaau

SEQ ID NO: 95695 - RNA, 32 nt, Human
ccacaaucucagcucacagcaaccuccgccuc

SEQ ID NO: 95696 - RNA, 32 nt, Human
ccacaaucugcagccaucaacugccucugcug

SEQ ID NO: 95697 - RNA, 32 nt, Human
ccacaaucugcagccuccaccaggccuugagu

SEQ ID NO: 95698 - RNA, 32 nt, Human
ccacaaugaaggccacgagcagcagcagcagg

SEQ ID NO: 95699 - RNA, 32 nt, Human
ccacaaugaauagcaucucacaccagucagaa

SEQ ID NO: 95700 - RNA, 32 nt, Human
ccacaaugcuccaauuuccugucuccuuuaga

SEQ ID NO: 95701 - RNA, 32 nt, Human
ccacaaugcugaauauacagcaggugcucaau

SEQ ID NO: 95702 - RNA, 24 nt, Human
ccacaaugcuggaauuacaggugu

SEQ ID NO: 95703 - RNA, 32 nt, Human
ccacaauggcccugcuccuuccuccucuaggc

SEQ ID NO: 95704 - RNA, 32 nt, Human
ccacaaugucugcagugugaaggcagguucau

SEQ ID NO: 95705 - RNA, 32 nt, Human
ccacaaugugggaggcaggaugcagggauggg

SEQ ID NO: 95706 - RNA, 28 nt, Human
ccacaauuaaagauuauucuugucaguc

SEQ ID NO: 95707 - RNA, 32 nt, Human
ccacaauuacuuuuguaccaaccuaauaacaa

SEQ ID NO: 95708 - RNA, 19 nt, Human
ccacacaaaagccugcaug

SEQ ID NO: 95709 - RNA, 32 nt, Human
ccacacaaccauauugcauagaacagcacuug

SEQ ID NO: 95710 - RNA, 22 nt, Human
ccacacaaggaggaggaagagg

SEQ ID NO: 95711 - RNA, 19 nt, Human
ccacacacacaggcaccca

SEQ ID NO: 95712 - RNA, 32 nt, Human
ccacacacaccugucugugcagaugcuuugcc

SEQ ID NO: 95713 - RNA, 32 nt, Human
ccacacacagcagcuccaaccuggaggcugga

SEQ ID NO: 95714 - RNA, 32 nt, Human
ccacacacagccggcugcccuugacccgggag

SEQ ID NO: 95715 - RNA, 32 nt, Human
ccacacacagccugccccagcgucccugcccc

SEQ ID NO: 95716 - RNA, 32 nt, Human
ccacacacaguuacagagugaacacucuacua

SEQ ID NO: 95717 - RNA, 22 nt, Human
ccacacacccacacaugccaga

SEQ ID NO: 95718 - RNA, 19 nt, Human
ccacacaccuacaugcagg

SEQ ID NO: 95719 - RNA, 32 nt, Human
ccacacaccucucuacugagugcuccagaguc

SEQ ID NO: 95720 - RNA, 32 nt, Human
ccacacacugcacaucuuuuggugaucggggu

SEQ ID NO: 95721 - RNA, 32 nt, Human
ccacacacugcacccccacuccuggggcaggg

SEQ ID NO: 95722 - RNA, 19 nt, Human
ccacacagaaccaagcacu

SEQ ID NO: 95723 - RNA, 32 nt, Human
ccacacagacaggguuucaccauguuggccag

SEQ ID NO: 95724 - RNA, 32 nt, Human
ccacacagaccugguucccugccucuguauuc

SEQ ID NO: 95725 - RNA, 32 nt, Human
ccacacagagacaaggucggucucugucgccc

SEQ ID NO: 95726 - RNA, 32 nt, Human
ccacacagaugaccucaccauccacacucaga

SEQ ID NO: 95727 - RNA, 32 nt, Human
ccacacagccuccugcugcaggugcuuuggaa

SEQ ID NO: 95728 - RNA, 32 nt, Human
ccacacagcuggucauccugcccucagagccc

SEQ ID NO: 95729 - RNA, 32 nt, Human
ccacacagcugucccuuccuguccuuggcuac

SEQ ID NO: 95730 - RNA, 32 nt, Human
ccacacagcuuccucugggagaagcaggcgcu

SEQ ID NO: 95731 - RNA, 32 nt, Human
ccacacaggaugccggagagacagccccuugu

SEQ ID NO: 95732 - RNA, 22 nt, Human
ccacacaggccauuccccucuc

SEQ ID NO: 95733 - RNA, 22 nt, Human
ccacacaggcccacacacccuc

SEQ ID NO: 95734 - RNA, 20 nt, Human
ccacacaggcccacugcagg

SEQ ID NO: 95735 - RNA, 32 nt, Human
ccacacagggcgggagcccaggccuguuccug

SEQ ID NO: 95736 - RNA, 32 nt, Human
ccacacaguccuggaggcagagaugcaguuac

SEQ ID NO: 95737 - RNA, 31 nt, Human
ccacacagugaggucuggugggugaaaggac

SEQ ID NO: 95738 - RNA, 32 nt, Human
ccacacagugcaggggauggagacaggugcug

SEQ ID NO: 95739 - RNA, 32 nt, Human
ccacacaguuuacaaacccaguaucaugucug

SEQ ID NO: 95740 - RNA, 32 nt, Human
ccacacauccauaguucugccuccccagcuuc

SEQ ID NO: 95741 - RNA, 32 nt, Human
ccacacaucuucccaguucucacauagguuca

SEQ ID NO: 95742 - RNA, 32 nt, Human
ccacacaugcuccagacccuggggcaagguag

SEQ ID NO: 95743 - RNA, 32 nt, Human
ccacaccaaccauaccagcacuugcugccauc

SEQ ID NO: 95744 - RNA, 18 nt, Human
ccacaccacaccccaggg

SEQ ID NO: 95745 - RNA, 32 nt, Human
ccacaccacagcccuuugggcaaaaucagccc

SEQ ID NO: 95746 - RNA, 32 nt, Human
ccacaccacagcugcgcacacagcugcuugcu

SEQ ID NO: 95747 - RNA, 20 nt, Human
ccacaccacaucccagggaa

SEQ ID NO: 95748 - RNA, 32 nt, Human
ccacaccaccucuaccauuauuuucuguccga

SEQ ID NO: 95749 - RNA, 19 nt, Human
ccacaccacgaaagaucca

SEQ ID NO: 95750 - RNA, 32 nt, Human
ccacaccacuaccgcccccaaccacagcagag

SEQ ID NO: 95751 - RNA, 32 nt, Human
ccacaccacugcacuccauccugggcaacaga

SEQ ID NO: 95752 - RNA, 32 nt, Human
ccacaccacugcacuccugccugggcaauaga

SEQ ID NO: 95753 - RNA, 32 nt, Human
ccacaccacugcacuucacuuccacuucagac

SEQ ID NO: 95754 - RNA, 32 nt, Human
ccacaccacugcagcuggcaugcuuggcugug

SEQ ID NO: 95755 - RNA, 32 nt, Human
ccacaccacugcaggcagguggauagaagugc

SEQ ID NO: 95756 - RNA, 32 nt, Human
ccacaccacuggccuucccuuccccagggccc

SEQ ID NO: 95757 - RNA, 32 nt, Human
ccacaccagcagaggaugcgaggacgaugaca

SEQ ID NO: 95758 - RNA, 32 nt, Human
ccacaccagcuggguugcacacuguugauaug

SEQ ID NO: 95759 - RNA, 32 nt, Human
ccacaccaggaucgggugggaccuggagcuag

SEQ ID NO: 95760 - RNA, 32 nt, Human
ccacaccaggcaggaggagguguggacaguga

SEQ ID NO: 95761 - RNA, 32 nt, Human
ccacaccaggcugguuuucuuguauuuuuagu

SEQ ID NO: 95762 - RNA, 32 nt, Human
ccacaccagggauccuuagcacccaaccgguc

SEQ ID NO: 95763 - RNA, 19 nt, Human
ccacaccagggcuugcaua

SEQ ID NO: 95764 - RNA, 32 nt, Human
ccacaccagguggugguaggcggugugacugc

SEQ ID NO: 95765 - RNA, 21 nt, Human
ccacaccagugccugauuucu

SEQ ID NO: 95766 - RNA, 21 nt, Human
ccacaccaguugaacugcagg

SEQ ID NO: 95767 - RNA, 32 nt, Human
ccacaccaucacccucugggcagcugucaugg

SEQ ID NO: 95768 - RNA, 32 nt, Human
ccacaccauugcacuccagccugggcaacaag

SEQ ID NO: 95769 - RNA, 32 nt, Human
ccacaccauugcauuccaaccuggggaacaga

SEQ ID NO: 95770 - RNA, 32 nt, Human
ccacacccaauacuuuagagaucuggguuugg

SEQ ID NO: 95771 - RNA, 25 nt, Human
ccacacccacaaacaagccacagcu

SEQ ID NO: 95772 - RNA, 32 nt, Human
ccacacccaccagggucccgaggaaacagccg

SEQ ID NO: 95773 - RNA, 32 nt, Human
ccacacccacggcugcauaccugcacuuucag

SEQ ID NO: 95774 - RNA, 32 nt, Human
ccacacccagccacuaccucccagcuuggaga

SEQ ID NO: 95775 - RNA, 32 nt, Human
ccacacccagcccaggcucauucuuuuaacag

SEQ ID NO: 95776 - RNA, 32 nt, Human
ccacacccagccuggaacccuagccagcucag

SEQ ID NO: 95777 - RNA, 18 nt, Human
ccacacccagcucaggga

SEQ ID NO: 95778 - RNA, 32 nt, Human
ccacacccaggagccauccucagugucugugg

SEQ ID NO: 95779 - RNA, 32 nt, Human
ccacacccaggcccuauccugaacaggagacu

SEQ ID NO: 95780 - RNA, 21 nt, Human
ccacacccaggggccaggcuc

SEQ ID NO: 95781 - RNA, 32 nt, Human
ccacacccauuuauuuccuuccuuccuuccuu

SEQ ID NO: 95782 - RNA, 24 nt, Human
ccacaccccaccuggucaugggca

SEQ ID NO: 95783 - RNA, 32 nt, Human
ccacaccccagccuaacuccuccuggggccug

SEQ ID NO: 95784 - RNA, 32 nt, Human
ccacaccccagccucugacuugcuguguuguc

SEQ ID NO: 95785 - RNA, 22 nt, Human
ccacaccccagcucacacagca

SEQ ID NO: 95786 - RNA, 23 nt, Human
ccacacccccagggacgccgcuu

SEQ ID NO: 95787 - RNA, 32 nt, Human
ccacacccccaucccacccaaccacaggcccc

SEQ ID NO: 95788 - RNA, 23 nt, Human
ccacacccccauuccgugccuca

SEQ ID NO: 95789 - RNA, 17 nt, Human
ccacaccccccacccca

SEQ ID NO: 95790 - RNA, 20 nt, Human
ccacacccccgccucgggcc

SEQ ID NO: 95791 - RNA, 18 nt, Human
ccacaccccgccuggcca

SEQ ID NO: 95792 - RNA, 18 nt, Human
ccacaccccggacaccca

SEQ ID NO: 95793 - RNA, 32 nt, Human
ccacaccccgggagcugagugauugcagaaac

SEQ ID NO: 95794 - RNA, 32 nt, Human
ccacaccccugcacgaugaacacacaccgggc

SEQ ID NO: 95795 - RNA, 19 nt, Human
ccacacccgaggccgggcc

SEQ ID NO: 95796 - RNA, 18 nt, Human
ccacacccgccccggguc

SEQ ID NO: 95797 - RNA, 23 nt, Human
ccacacccucacuggcucggccc

SEQ ID NO: 95798 - RNA, 32 nt, Human
ccacacccucagcacugaccacugugaugggg

SEQ ID NO: 95799 - RNA, 22 nt, Human
ccacacccucaggcucaugccc

SEQ ID NO: 95800 - RNA, 32 nt, Human
ccacacccuccugcgcucaggguggcuugcag

SEQ ID NO: 95801 - RNA, 21 nt, Human
ccacacccucucuccccagca

SEQ ID NO: 95802 - RNA, 32 nt, Human
ccacacccucuggccuucugccuugagcuggg

SEQ ID NO: 95803 - RNA, 22 nt, Human
ccacacccucuucccaaggccc

SEQ ID NO: 95804 - RNA, 19 nt, Human
ccacacccucuuucaggga

SEQ ID NO: 95805 - RNA, 32 nt, Human
ccacacccugacugaagggcugguccaagccu

SEQ ID NO: 95806 - RNA, 32 nt, Human
ccacacccugcagcccgccccauggucuggcc

SEQ ID NO: 95807 - RNA, 24 nt, Human
ccacacccugcgucuggccggucc

SEQ ID NO: 95808 - RNA, 22 nt, Human
ccacacccuggggccacccauc

SEQ ID NO: 95809 - RNA, 25 nt, Human
ccacacccuuacccuucaccaucuu

SEQ ID NO: 95810 - RNA, 21 nt, Human
ccacacccuuguguugcgccc

SEQ ID NO: 95811 - RNA, 32 nt, Human
ccacaccgacgguaccaugaaggacgagguag

SEQ ID NO: 95812 - RNA, 32 nt, Human
ccacaccgcagugccucugccccucgggggac

SEQ ID NO: 95813 - RNA, 32 nt, Human
ccacaccgccuuucuuucuuuucuuucuguuu

SEQ ID NO: 95814 - RNA, 22 nt, Human
ccacaccgcggccgcccaagcc

SEQ ID NO: 95815 - RNA, 20 nt, Human
ccacaccggcagauugcaga

SEQ ID NO: 95816 - RNA, 19 nt, Human
ccacaccggcaucagagga

SEQ ID NO: 95817 - RNA, 32 nt, Human
ccacaccggcccugcuccuuccuccucuaggu

SEQ ID NO: 95818 - RNA, 32 nt, Human
ccacaccggcccugcuccuuccuccucugggc

SEQ ID NO: 95819 - RNA, 32 nt, Human
ccacaccguacuccagccugggcgacaucuag

SEQ ID NO: 95820 - RNA, 32 nt, Human
ccacaccgugacccucugucccuucccuccug

SEQ ID NO: 95821 - RNA, 32 nt, Human
ccacaccgugucccagggagcccagccuauuc

SEQ ID NO: 95822 - RNA, 32 nt, Human
ccacaccuagcauuccuucacaucuguauuca

SEQ ID NO: 95823 - RNA, 25 nt, Human
ccacaccucaagaccaucccacugc

SEQ ID NO: 95824 - RNA, 32 nt, Human
ccacaccucacacacacauacucccacuugca

SEQ ID NO: 95825 - RNA, 32 nt, Human
ccacaccuccaaugcugccugggagccagggu

SEQ ID NO: 95826 - RNA, 32 nt, Human
ccacaccuccacuuugcuucugaaggcccauu

SEQ ID NO: 95827 - RNA, 32 nt, Human
ccacaccucccaggauccagugcucccucuca

SEQ ID NO: 95828 - RNA, 21 nt, Human
ccacaccucccccugcugcug

SEQ ID NO: 95829 - RNA, 19 nt, Human
ccacaccucccugaacuuc

SEQ ID NO: 95830 - RNA, 32 nt, Human
ccacaccucuagaccuggggccuccggaaccc

SEQ ID NO: 95831 - RNA, 32 nt, Human
ccacaccucugccugccucaugccccuucccc

SEQ ID NO: 95832 - RNA, 32 nt, Human
ccacaccugaagccugcaggugcugaggccac

SEQ ID NO: 95833 - RNA, 32 nt, Human
ccacaccugcacuucugccucacuuucuugcu

SEQ ID NO: 95834 - RNA, 32 nt, Human
ccacaccugcagcucuccccuuggccacagca

SEQ ID NO: 95835 - RNA, 20 nt, Human
ccacaccugccacucaggga

SEQ ID NO: 95836 - RNA, 32 nt, Human
ccacaccugccugggaaccugggcugugaguc

SEQ ID NO: 95837 - RNA, 21 nt, Human
ccacaccugcuccucuagaga

SEQ ID NO: 95838 - RNA, 23 nt, Human
ccacaccugcugcggccgugccc

SEQ ID NO: 95839 - RNA, 32 nt, Human
ccacaccuggagugaggaagggggccuggcac

SEQ ID NO: 95840 - RNA, 32 nt, Human
ccacaccuggcuuauuuuaguuauuuuaguag

SEQ ID NO: 95841 - RNA, 18 nt, Human
ccacaccuggguccucca

SEQ ID NO: 95842 - RNA, 32 nt, Human
ccacaccuguaaccccaucuucucugaguaca

SEQ ID NO: 95843 - RNA, 32 nt, Human
ccacaccuguaaucccagcacuuugggaggcc

SEQ ID NO: 95844 - RNA, 32 nt, Human
ccacaccuguaaucucagcacuuuaggaggcc

SEQ ID NO: 95845 - RNA, 32 nt, Human
ccacaccuguauagaccaugcacaguacacau

SEQ ID NO: 95846 - RNA, 32 nt, Human
ccacaccuguggucccagcuacucaggaggcu

SEQ ID NO: 95847 - RNA, 32 nt, Human
ccacaccuuccagggcccuaggccccuccuag

SEQ ID NO: 95848 - RNA, 32 nt, Human
ccacaccuuccugggcaacccccaccaugaac

SEQ ID NO: 95849 - RNA, 32 nt, Human
ccacaccuuccuuccccacccccaccaccucc

SEQ ID NO: 95850 - RNA, 32 nt, Human
ccacaccuuccuugcugauuuguauuuuuggu

SEQ ID NO: 95851 - RNA, 32 nt, Human
ccacaccuuuguccuccaguuuaguuucucca

SEQ ID NO: 95852 - RNA, 32 nt, Human
ccacaccuuuugaggaggacagaagggacugg

SEQ ID NO: 95853 - RNA, 32 nt, Human
ccacacgacagcccucgagaauucuuucaagu

SEQ ID NO: 95854 - RNA, 19 nt, Human
ccacacgacuagacugcag

SEQ ID NO: 95855 - RNA, 32 nt, Human
ccacacgagugucccucacacucgcccagaaa

SEQ ID NO: 95856 - RNA, 32 nt, Human
ccacacgcacacuccacaugcccagcagagug

SEQ ID NO: 95857 - RNA, 17 nt, Human
ccacacgcagacgcaga

SEQ ID NO: 95858 - RNA, 32 nt, Human
ccacacgcaggccucccugccucagcugcauc

SEQ ID NO: 95859 - RNA, 32 nt, Human
ccacacgcaguuugaccccacgcccagcccuu

SEQ ID NO: 95860 - RNA, 18 nt, Human
ccacacgccagccacagg

SEQ ID NO: 95861 - RNA, 32 nt, Human
ccacacgcccccacaggcucugaccagcagcc

SEQ ID NO: 95862 - RNA, 15 nt, Human
ccacacgccucugca

SEQ ID NO: 95863 - RNA, 18 nt, Human
ccacacgccuggagccga

SEQ ID NO: 95864 - RNA, 16 nt, Human
ccacacgccugucaga

SEQ ID NO: 95865 - RNA, 18 nt, Human
ccacacgccuucccugca

SEQ ID NO: 95866 - RNA, 32 nt, Human
ccacacgcggcagaggagagcuggcaggagga

SEQ ID NO: 95867 - RNA, 16 nt, Human
ccacacgcuuucugca

SEQ ID NO: 95868 - RNA, 17 nt, Human
ccacacggagcugcaga

SEQ ID NO: 95869 - RNA, 32 nt, Human
ccacacgggugccacagcccaggucggagugg

SEQ ID NO: 95870 - RNA, 32 nt, Human
ccacacgugccuguagcauuccagagcucacu

SEQ ID NO: 95871 - RNA, 23 nt, Human
ccacacgugcucacccacccgca

SEQ ID NO: 95872 - RNA, 18 nt, Human
ccacacgugcugcgcaga

SEQ ID NO: 95873 - RNA, 32 nt, Human
ccacacguuugucuguugagugcagcgacaag

SEQ ID NO: 95874 - RNA, 32 nt, Human
ccacacuaacuugcccugucccaaucccagaa

SEQ ID NO: 95875 - RNA, 20 nt, Human
ccacacuaggaagcugcaga

SEQ ID NO: 95876 - RNA, 21 nt, Human
ccacacuauguguguuguucc

SEQ ID NO: 95877 - RNA, 32 nt, Human
ccacacuauugguggcaccuggaggacaugca

SEQ ID NO: 95878 - RNA, 32 nt, Human
ccacacucacucuugcagagccugugucuuua

SEQ ID NO: 95879 - RNA, 19 nt, Human
ccacacucacugccuguca

SEQ ID NO: 95880 - RNA, 32 nt, Human
ccacacucacuuuuuaucugguguuuuuacuu

SEQ ID NO: 95881 - RNA, 32 nt, Human
ccacacucaucaccauuucacacccaccuccc

SEQ ID NO: 95882 - RNA, 18 nt, Human
ccacacucauucauccuu

SEQ ID NO: 95883 - RNA, 32 nt, Human
ccacacuccacauucauauguugaagcccuaa

SEQ ID NO: 95884 - RNA, 32 nt, Human
ccacacuccagccugagcaacaagagcgaaac

SEQ ID NO: 95885 - RNA, 32 nt, Human
ccacacuccagccugagcagcagagcgggacc

SEQ ID NO: 95886 - RNA, 32 nt, Human
ccacacuccagccuggguaacagugagaccau

SEQ ID NO: 95887 - RNA, 32 nt, Human
ccacacuccagccugggugacagagcgagacu

SEQ ID NO: 95888 - RNA, 32 nt, Human
ccacacuccagccugggugacagagugaaacc

SEQ ID NO: 95889 - RNA, 32 nt, Human
ccacacuccauccugggucacagagugagacc

SEQ ID NO: 95890 - RNA, 32 nt, Human
ccacacucccacacuccagccuggguaacagu

SEQ ID NO: 95891 - RNA, 32 nt, Human
ccacacucccagcugcucuucuacagaugcca

SEQ ID NO: 95892 - RNA, 32 nt, Human
ccacacuccugacagaaugaaugcccucgaug

SEQ ID NO: 95893 - RNA, 20 nt, Human
ccacacucgauugggcccca

SEQ ID NO: 95894 - RNA, 23 nt, Human
ccacacucgccucccgggcccca

SEQ ID NO: 95895 - RNA, 32 nt, Human
ccacacucuccaagcacauuacaggggaccug

SEQ ID NO: 95896 - RNA, 18 nt, Human
ccacacucuuuucuccca

SEQ ID NO: 95897 - RNA, 32 nt, Human
ccacacugaaaccucuucgguugucuugaaac

SEQ ID NO: 95898 - RNA, 31 nt, Human
ccacacugacuucuucccuggggcugcaagu

SEQ ID NO: 95899 - RNA, 17 nt, Human
ccacacugaggccaggu

SEQ ID NO: 95900 - RNA, 32 nt, Human
ccacacugagguagccgagccucucaagcaga

SEQ ID NO: 95901 - RNA, 32 nt, Human
ccacacugaguguggggaauaaggacacuagc

SEQ ID NO: 95902 - RNA, 32 nt, Human
ccacacugcaaguccagagagcagggaacuac

SEQ ID NO: 95903 - RNA, 32 nt, Human
ccacacugcacaauaacuccucccaggguuuu

SEQ ID NO: 95904 - RNA, 24 nt, Human
ccacacugcacacagugacuuccu

SEQ ID NO: 95905 - RNA, 22 nt, Human
ccacacugccacaaagcugcuu

SEQ ID NO: 95906 - RNA, 32 nt, Human
ccacacugcccgccucucccacaugccacccc

SEQ ID NO: 95907 - RNA, 23 nt, Human
ccacacugcugccaccucucaca

SEQ ID NO: 95908 - RNA, 32 nt, Human
ccacacugcugcccuggcgggggccauggggg

SEQ ID NO: 95909 - RNA, 32 nt, Human
ccacacugcuuuguaaauaucuugacuguuuc

SEQ ID NO: 95910 - RNA, 32 nt, Human
ccacacuggagagagaccauagggugaugagu

SEQ ID NO: 95911 - RNA, 21 nt, Human
ccacacuggcccaucugcucc

SEQ ID NO: 95912 - RNA, 32 nt, Human
ccacacugggacucguguggccuguguggugc

SEQ ID NO: 95913 - RNA, 32 nt, Human
ccacacugggccaaaguggcaaccugggaaug

SEQ ID NO: 95914 - RNA, 32 nt, Human
ccacacuggggcccuccuccugggccugacca

SEQ ID NO: 95915 - RNA, 18 nt, Human
ccacacugucuggacuca

SEQ ID NO: 95916 - RNA, 32 nt, Human
ccacacugugaaaugaacuaugugccaguuug

SEQ ID NO: 95917 - RNA, 32 nt, Human
ccacacuguggcccaacgaccuuccuguuacc

SEQ ID NO: 95918 - RNA, 22 nt, Human
ccacacuguggccccugagucc

SEQ ID NO: 95919 - RNA, 32 nt, Human
ccacacuguggcuacagguggagggaagagga

SEQ ID NO: 95920 - RNA, 32 nt, Human
ccacacuuacugucuuccuuuaucucugugga

SEQ ID NO: 95921 - RNA, 32 nt, Human
ccacacuuagagagaguggagauguuuauuuc

SEQ ID NO: 95922 - RNA, 19 nt, Human
ccacacuucauccuccuca

SEQ ID NO: 95923 - RNA, 32 nt, Human
ccacacuuccuacuuggucucuggagguuuua

SEQ ID NO: 95924 - RNA, 32 nt, Human
ccacacuucucccuucaggggcuucggaggag

SEQ ID NO: 95925 - RNA, 25 nt, Human
ccacacuucucccuugcucccugaa

SEQ ID NO: 95926 - RNA, 32 nt, Human
ccacacuucuugaaacagccugggugacgguc

SEQ ID NO: 95927 - RNA, 32 nt, Human
ccacacuugccuuccccugaggucgcaggcug

SEQ ID NO: 95928 - RNA, 21 nt, Human
ccacacuuggaaggacugcag

SEQ ID NO: 95929 - RNA, 21 nt, Human
ccacacuuggccagacugcag

SEQ ID NO: 95930 - RNA, 32 nt, Human
ccacacuuguaaucccagcacuuugggaggcc

SEQ ID NO: 95931 - RNA, 32 nt, Human
ccacacuuguugcugcucaacaggacugcacu

SEQ ID NO: 95932 - RNA, 32 nt, Human
ccacacuuucaaguaaccaggugguggagacc

SEQ ID NO: 95933 - RNA, 32 nt, Human
ccacacuuugggcuuaguauuucucaggaaga

SEQ ID NO: 95934 - RNA, 32 nt, Human
ccacagaaacauuuucauuuuaggaaaucccu

SEQ ID NO: 95935 - RNA, 21 nt, Human
ccacagaaagaaaggaggcuu

SEQ ID NO: 95936 - RNA, 32 nt, Human
ccacagaaaggaagcaggacagcagggccccu

SEQ ID NO: 95937 - RNA, 22 nt, Human
ccacagaacauugucuuucugg

SEQ ID NO: 95938 - RNA, 19 nt, Human
ccacagaacccguuucggg

SEQ ID NO: 95939 - RNA, 32 nt, Human
ccacagaagagggggcuuuccaucccacccug

SEQ ID NO: 95940 - RNA, 32 nt, Human
ccacagaagauguauaauguuuggaaaaagac

SEQ ID NO: 95941 - RNA, 32 nt, Human
ccacagaaggaggaaguggaagggacaggagc

SEQ ID NO: 95942 - RNA, 32 nt, Human
ccacagaaggcuuaccucugaaagagucgggg

SEQ ID NO: 95943 - RNA, 32 nt, Human
ccacagaauggagcaagaaugagaggaaaaag

SEQ ID NO: 95944 - RNA, 32 nt, Human
ccacagacacgcgugugcaugcuccuacacaa

SEQ ID NO: 95945 - RNA, 32 nt, Human
ccacagacacuacccaaagcaguccuucacua

SEQ ID NO: 95946 - RNA, 32 nt, Human
ccacagacacuacccaaagcagugcuucacua

SEQ ID NO: 95947 - RNA, 32 nt, Human
ccacagacacugguggggagaccauggcucag

SEQ ID NO: 95948 - RNA, 32 nt, Human
ccacagacaggaacagaagagcacaguggagg

SEQ ID NO: 95949 - RNA, 32 nt, Human
ccacagacauagagggcagcugccaucaccac

SEQ ID NO: 95950 - RNA, 32 nt, Human
ccacagaccaaggcacauggguuuccacuugg

SEQ ID NO: 95951 - RNA, 20 nt, Human
ccacagacccaguccuccaa

SEQ ID NO: 95952 - RNA, 32 nt, Human
ccacagacccccagcagguagcauuccccagc

SEQ ID NO: 95953 - RNA, 32 nt, Human
ccacagaccccugggagcuuccgcuuugaaag

SEQ ID NO: 95954 - RNA, 32 nt, Human
ccacagaccgagguacagaacgagagacaacc

SEQ ID NO: 95955 - RNA, 21 nt, Human
ccacagacgccuugucuccau

SEQ ID NO: 95956 - RNA, 32 nt, Human
ccacagacgggguggaguggucaguggagcca

SEQ ID NO: 95957 - RNA, 32 nt, Human
ccacagacgugucuguagcauccucugucaca

SEQ ID NO: 95958 - RNA, 22 nt, Human
ccacagacuugguguuauggua

SEQ ID NO: 95959 - RNA, 21 nt, Human
ccacagagaagacccccggga

SEQ ID NO: 95960 - RNA, 32 nt, Human
ccacagagacacacucaggaggccagaagccg

SEQ ID NO: 95961 - RNA, 32 nt, Human
ccacagagccaacuugugaagcacacagcucu

SEQ ID NO: 95962 - RNA, 22 nt, Human
ccacagagccugggcugggccc

SEQ ID NO: 95963 - RNA, 32 nt, Human
ccacagagcuaaagugacuuuucccaaggucg

SEQ ID NO: 95964 - RNA, 32 nt, Human
ccacagagcuguugccuuccagaaccuccucc

SEQ ID NO: 95965 - RNA, 32 nt, Human
ccacagagcuuggacuuccuggaggacaagga

SEQ ID NO: 95966 - RNA, 21 nt, Human
ccacagaggagcggaggggcc

SEQ ID NO: 95967 - RNA, 32 nt, Human
ccacagaggagggagcaguuugcagugcccag

SEQ ID NO: 95968 - RNA, 32 nt, Human
ccacagaggccaagagcgcuacccacauugaa

SEQ ID NO: 95969 - RNA, 32 nt, Human
ccacagaggcccccaggagcacugccuuucag

SEQ ID NO: 95970 - RNA, 32 nt, Human
ccacagaggccugcuuccauccuaauugagca

SEQ ID NO: 95971 - RNA, 32 nt, Human
ccacagaggccuggggagcauuugacauucuc

SEQ ID NO: 95972 - RNA, 32 nt, Human
ccacagagggccugagcaugagggcucacacc

SEQ ID NO: 95973 - RNA, 32 nt, Human
ccacagagggguagcugggaucaugcuaguca

SEQ ID NO: 95974 - RNA, 32 nt, Human
ccacagaggucccuuggcuuguuuccacacug

SEQ ID NO: 95975 - RNA, 29 nt, Human
ccacagagucuguguguagccaggaagcc

SEQ ID NO: 95976 - RNA, 32 nt, Human
ccacagagugccaucccugagagaccagaccg

SEQ ID NO: 95977 - RNA, 32 nt, Human
ccacagauagaaaaggaaauaguggagaaagc

SEQ ID NO: 95978 - RNA, 32 nt, Human
ccacagaucagaggagucccagaagagggcga

SEQ ID NO: 95979 - RNA, 32 nt, Human
ccacagaucaggccggggcagcuguaggggcg

SEQ ID NO: 95980 - RNA, 32 nt, Human
ccacagaugacuggaggaaggaggggaaaugu

SEQ ID NO: 95981 - RNA, 32 nt, Human
ccacagaugaggcucaucagaacuagaucuug

SEQ ID NO: 95982 - RNA, 26 nt, Human
ccacagaugccaccccugguccucac

SEQ ID NO: 95983 - RNA, 22 nt, Human
ccacagaugcguguugcuccca

SEQ ID NO: 95984 - RNA, 32 nt, Human
ccacagauggagaagguggagaggaggauggg

SEQ ID NO: 95985 - RNA, 32 nt, Human
ccacagauucuccuuugaugucagaggccuca

SEQ ID NO: 95986 - RNA, 21 nt, Human
ccacagcaaagacauuucauc

SEQ ID NO: 95987 - RNA, 32 nt, Human
ccacagcaaaggaccuggugugggaugggaga

SEQ ID NO: 95988 - RNA, 32 nt, Human
ccacagcaacugucaccucacagcaggagaca

SEQ ID NO: 95989 - RNA, 24 nt, Human
ccacagcaagacugacauccacuu

SEQ ID NO: 95990 - RNA, 32 nt, Human
ccacagcaagagguacacaugcuguggacacc

SEQ ID NO: 95991 - RNA, 32 nt, Human
ccacagcacagccuggucaguccugcgcacua

SEQ ID NO: 95992 - RNA, 32 nt, Human
ccacagcacuccguucaaggucaucuccuggg

SEQ ID NO: 95993 - RNA, 32 nt, Human
ccacagcacuggcggagccagaaggacuuggc

SEQ ID NO: 95994 - RNA, 32 nt, Human
ccacagcacuggggcucaccucuugguugauc

SEQ ID NO: 95995 - RNA, 19 nt, Human
ccacagcagaauuccagca

SEQ ID NO: 95996 - RNA, 32 nt, Human
ccacagcagagcuggacgcuguggaaauggcu

SEQ ID NO: 95997 - RNA, 32 nt, Human
ccacagcagcauauuuuagaggcacauacaaa

SEQ ID NO: 95998 - RNA, 19 nt, Human
ccacagcagcugcaugcag

SEQ ID NO: 95999 - RNA, 32 nt, Human
ccacagcagcuuugcucagugauacccacaug

SEQ ID NO: 96000 - RNA, 32 nt, Human
ccacagcaggaggagguaggggcugggcaugc

SEQ ID NO: 96001 - RNA, 32 nt, Human
ccacagcaggugaguggaggcaggagccacgg

SEQ ID NO: 96002 - RNA, 22 nt, Human
ccacagcagguggaguuuucag

SEQ ID NO: 96003 - RNA, 24 nt, Human
ccacagcagguggcuggacugcug

SEQ ID NO: 96004 - RNA, 32 nt, Human
ccacagcauucagcccugcagccugggaccuu

SEQ ID NO: 96005 - RNA, 20 nt, Human
ccacagccaaacucuggugg

SEQ ID NO: 96006 - RNA, 32 nt, Human
ccacagccaagaggagucagagaugagguggg

SEQ ID NO: 96007 - RNA, 19 nt, Human
ccacagccaagcacugcca

SEQ ID NO: 96008 - RNA, 24 nt, Human
ccacagccaauucaaacuguucaa

SEQ ID NO: 96009 - RNA, 19 nt, Human
ccacagccacaccaugagc

SEQ ID NO: 96010 - RNA, 32 nt, Human
ccacagccacagaacucagucugaaucuggaa

SEQ ID NO: 96011 - RNA, 32 nt, Human
ccacagccacagcagccgccacugcaguuaga

SEQ ID NO: 96012 - RNA, 32 nt, Human
ccacagccacagccacagccccaggcauagcc

SEQ ID NO: 96013 - RNA, 32 nt, Human
ccacagccacccaggcagggagcaaguggccu

SEQ ID NO: 96014 - RNA, 32 nt, Human
ccacagccaccuggaaaccacaaggcauuuga

SEQ ID NO: 96015 - RNA, 32 nt, Human
ccacagccacgauggguuuguuucuguuuucu

SEQ ID NO: 96016 - RNA, 32 nt, Human
ccacagccacgcagcgcccacacccaccggga

SEQ ID NO: 96017 - RNA, 18 nt, Human
ccacagccacuccugcag

SEQ ID NO: 96018 - RNA, 32 nt, Human
ccacagccacuucuucacugagauaggagaug

SEQ ID NO: 96019 - RNA, 32 nt, Human
ccacagccagacgcccucagacagcaaagccu

SEQ ID NO: 96020 - RNA, 32 nt, Human
ccacagccagagaggcagaggcaagagcagag

SEQ ID NO: 96021 - RNA, 19 nt, Human
ccacagccagagcuggugg

SEQ ID NO: 96022 - RNA, 32 nt, Human
ccacagccagaggagccugugauuggcagaaa

SEQ ID NO: 96023 - RNA, 21 nt, Human
ccacagccagcagaacaucgc

SEQ ID NO: 96024 - RNA, 32 nt, Human
ccacagccaguucugcaucaccacacacagcc

SEQ ID NO: 96025 - RNA, 32 nt, Human
ccacagccaucuagggcccugaaggaggggca

SEQ ID NO: 96026 - RNA, 32 nt, Human
ccacagccaugaacagacguuggggcuaagag

SEQ ID NO: 96027 - RNA, 32 nt, Human
ccacagccauuuuucucucggguucuacccac

SEQ ID NO: 96028 - RNA, 32 nt, Human
ccacagcccaccuggaggccacccuggaggag

SEQ ID NO: 96029 - RNA, 23 nt, Human
ccacagcccacucucagcuccau

SEQ ID NO: 96030 - RNA, 32 nt, Human
ccacagccccagccccagccccuggagauugc

SEQ ID NO: 96031 - RNA, 16 nt, Human
ccacagcccccagggu

SEQ ID NO: 96032 - RNA, 18 nt, Human
ccacagccccccagcccc

SEQ ID NO: 96033 - RNA, 32 nt, Human
ccacagccccgccucccugccuggagcacacu

SEQ ID NO: 96034 - RNA, 32 nt, Human
ccacagccccuccauggcccagaaggaagagg

SEQ ID NO: 96035 - RNA, 32 nt, Human
ccacagccccugcuugggcugccuggcacccu

SEQ ID NO: 96036 - RNA, 23 nt, Human
ccacagcccguggucccccucca

SEQ ID NO: 96037 - RNA, 19 nt, Human
ccacagcccuaagugccac

SEQ ID NO: 96038 - RNA, 23 nt, Human
ccacagcccuccagguccuccag

SEQ ID NO: 96039 - RNA, 32 nt, Human
ccacagcccugagaugggccggcccccuuccu

SEQ ID NO: 96040 - RNA, 32 nt, Human
ccacagcccugagucuaagcaaaagcccaugg

SEQ ID NO: 96041 - RNA, 32 nt, Human
ccacagcccugccuuugguuccuggacauuug

SEQ ID NO: 96042 - RNA, 32 nt, Human
ccacagcccuuacacccgcugccuuagaagag

SEQ ID NO: 96043 - RNA, 32 nt, Human
ccacagccgcacccugccugugccugcacccu

SEQ ID NO: 96044 - RNA, 24 nt, Human
ccacagccgcugcagccggggcag

SEQ ID NO: 96045 - RNA, 32 nt, Human
ccacagccgucacaugguccuccugaaguugg

SEQ ID NO: 96046 - RNA, 32 nt, Human
ccacagccucaacuucucaggcuccagccauc

SEQ ID NO: 96047 - RNA, 18 nt, Human
ccacagccucaaggccac

SEQ ID NO: 96048 - RNA, 32 nt, Human
ccacagccucaaggccacccuaccgucauaua

SEQ ID NO: 96049 - RNA, 32 nt, Human
ccacagccuccaacuccugggcucaaggcauc

SEQ ID NO: 96050 - RNA, 32 nt, Human
ccacagccuccaccccugacccccauccucuu

SEQ ID NO: 96051 - RNA, 32 nt, Human
ccacagccuccccagauagcugugugccugug

SEQ ID NO: 96052 - RNA, 32 nt, Human
ccacagccugggcaucaccaggauucuaaacc

SEQ ID NO: 96053 - RNA, 22 nt, Human
ccacagccugggccucccggga

SEQ ID NO: 96054 - RNA, 22 nt, Human
ccacagccugucccugucuccu

SEQ ID NO: 96055 - RNA, 32 nt, Human
ccacagccuguggcugggaagggagacagagg

SEQ ID NO: 96056 - RNA, 22 nt, Human
ccacagccuuacacuaggcaca

SEQ ID NO: 96057 - RNA, 32 nt, Human
ccacagccuucucaaguccuuccugcagaggg

SEQ ID NO: 96058 - RNA, 23 nt, Human
ccacagccuucucagguccggga

SEQ ID NO: 96059 - RNA, 32 nt, Human
ccacagccuucuccagccugugugauacaagu

SEQ ID NO: 96060 - RNA, 32 nt, Human
ccacagccuugaauaauggcuuccugccuccu

SEQ ID NO: 96061 - RNA, 32 nt, Human
ccacagccuuguggcuagaguacaguggggua

SEQ ID NO: 96062 - RNA, 32 nt, Human
ccacagccuuucucccugccaccacucccuua

SEQ ID NO: 96063 - RNA, 20 nt, Human
ccacagccuuuugguaguga

SEQ ID NO: 96064 - RNA, 32 nt, Human
ccacagcgccgaguacuccagccgggacgcac

SEQ ID NO: 96065 - RNA, 32 nt, Human
ccacagcgcucugggccaggggucggggcucu

SEQ ID NO: 96066 - RNA, 32 nt, Human
ccacagcgggcagcacaaacagccugggagcc

SEQ ID NO: 96067 - RNA, 32 nt, Human
ccacagcgggcuccccagcuuagggaggucug

SEQ ID NO: 96068 - RNA, 32 nt, Human
ccacagcgugugagccuccagcucggggcuuc

SEQ ID NO: 96069 - RNA, 32 nt, Human
ccacagcuaauucccagcaggugaagauguga

SEQ ID NO: 96070 - RNA, 32 nt, Human
ccacagcuacccacuuguugccaccagguugg

SEQ ID NO: 96071 - RNA, 18 nt, Human
ccacagcuagacugcagg

SEQ ID NO: 96072 - RNA, 32 nt, Human
ccacagcucacgaccagaugcaccagcaggag

SEQ ID NO: 96073 - RNA, 32 nt, Human
ccacagcucacugugaccuugaccuucuggac

SEQ ID NO: 96074 - RNA, 32 nt, Human
ccacagcucaggcugggcuguggugccagcau

SEQ ID NO: 96075 - RNA, 32 nt, Human
ccacagcucauccucggaggcaaucccggaaa

SEQ ID NO: 96076 - RNA, 32 nt, Human
ccacagcuccaggacaccgcuguccuggcauu

SEQ ID NO: 96077 - RNA, 32 nt, Human
ccacagcuccuaagaauucucucaccugccuu

SEQ ID NO: 96078 - RNA, 32 nt, Human
ccacagcucucaggaaagugaccuaaguugga

SEQ ID NO: 96079 - RNA, 32 nt, Human
ccacagcucuccaaggaggaagaugguccagg

SEQ ID NO: 96080 - RNA, 21 nt, Human
ccacagcucuggagggcucug

SEQ ID NO: 96081 - RNA, 24 nt, Human
ccacagcucugggccucuuuuugc

SEQ ID NO: 96082 - RNA, 23 nt, Human
ccacagcugauacggcauccugc

SEQ ID NO: 96083 - RNA, 32 nt, Human
ccacagcugauagugauugccuugaauaaauu

SEQ ID NO: 96084 - RNA, 32 nt, Human
ccacagcugcacaggccagggcgcaggcacau

SEQ ID NO: 96085 - RNA, 32 nt, Human
ccacagcugcaccggcagcccaaggggaagga

SEQ ID NO: 96086 - RNA, 32 nt, Human
ccacagcugcagcugauccauaggacuaccgc

SEQ ID NO: 96087 - RNA, 32 nt, Human
ccacagcugcauucaaacucaaaucuguggga

SEQ ID NO: 96088 - RNA, 32 nt, Human
ccacagcugcccuucaggaggcuggcacggag

SEQ ID NO: 96089 - RNA, 32 nt, Human
ccacagcugccuccauuuccuuaaggaagggu

SEQ ID NO: 96090 - RNA, 32 nt, Human
ccacagcugccuccugagcugccugagccugg

SEQ ID NO: 96091 - RNA, 19 nt, Human
ccacagcugcugcucacuu

SEQ ID NO: 96092 - RNA, 32 nt, Human
ccacagcuggagaguccuggcugagccuuggg

SEQ ID NO: 96093 - RNA, 32 nt, Human
ccacagcugggaacaaguggggcugggaagcu

SEQ ID NO: 96094 - RNA, 32 nt, Human
ccacagcuguaugauucccagccagacacagc

SEQ ID NO: 96095 - RNA, 32 nt, Human
ccacagcuguggggcuucagcagccacaccag

SEQ ID NO: 96096 - RNA, 32 nt, Human
ccacagcuucccaccuccuccccaccaaaccg

SEQ ID NO: 96097 - RNA, 19 nt, Human
ccacagcuucccgggucau

SEQ ID NO: 96098 - RNA, 23 nt, Human
ccacagcuuccgccacauccugc

SEQ ID NO: 96099 - RNA, 32 nt, Human
ccacagcuuccuguccccaucugucggccuac

SEQ ID NO: 96100 - RNA, 20 nt, Human
ccacagcuucgggguccugu

SEQ ID NO: 96101 - RNA, 23 nt, Human
ccacagcuuucaucuacuucugu

SEQ ID NO: 96102 - RNA, 24 nt, Human
ccacagcuuuccucccgcuccugc

SEQ ID NO: 96103 - RNA, 25 nt, Human
ccacagcuuuggcgggcacuucugc

SEQ ID NO: 96104 - RNA, 32 nt, Human
ccacaggaaccccgggccugaguggaggcuga

SEQ ID NO: 96105 - RNA, 32 nt, Human
ccacaggaaggaggggagagacaggcagccca

SEQ ID NO: 96106 - RNA, 32 nt, Human
ccacaggaaggcuuugcaaacugugaagugca

SEQ ID NO: 96107 - RNA, 31 nt, Human
ccacaggaaguguccagacaggagaggaaga

SEQ ID NO: 96108 - RNA, 32 nt, Human
ccacaggaauagaauggagggagcuccagaaa

SEQ ID NO: 96109 - RNA, 32 nt, Human
ccacaggaccaccagaagggagagggaaccag

SEQ ID NO: 96110 - RNA, 32 nt, Human
ccacaggaccaccagagaggagagggaaccag

SEQ ID NO: 96111 - RNA, 32 nt, Human
ccacaggacucaugucucaaugcccacaguga

SEQ ID NO: 96112 - RNA, 32 nt, Human
ccacaggagagggagagauuccagcucacugc

SEQ ID NO: 96113 - RNA, 32 nt, Human
ccacaggagcguacucacucagccuggucagc

SEQ ID NO: 96114 - RNA, 32 nt, Human
ccacaggagcugggaccugccugccccugucu

SEQ ID NO: 96115 - RNA, 32 nt, Human
ccacaggaggcugaagcggguugggggaucug

SEQ ID NO: 96116 - RNA, 32 nt, Human
ccacaggaggcugccaccuguaggucacuugg

SEQ ID NO: 96117 - RNA, 32 nt, Human
ccacaggaggcuguuuccuccccugguggauu

SEQ ID NO: 96118 - RNA, 32 nt, Human
ccacaggcaccagaagaaggggacuuucuaag

SEQ ID NO: 96119 - RNA, 19 nt, Human
ccacaggcagacagcccag

SEQ ID NO: 96120 - RNA, 32 nt, Human
ccacaggcagaggccaggaggagcaguaugug

SEQ ID NO: 96121 - RNA, 32 nt, Human
ccacaggcagcagaagucugggcagaguucau

SEQ ID NO: 96122 - RNA, 19 nt, Human
ccacaggcagcuucuccac

SEQ ID NO: 96123 - RNA, 32 nt, Human
ccacaggcaggaggagaagcaugaagagaaaa

SEQ ID NO: 96124 - RNA, 21 nt, Human
ccacaggcaggugcaggcgca

SEQ ID NO: 96125 - RNA, 32 nt, Human
ccacaggccaacacccuuuggucucaugaaua

SEQ ID NO: 96126 - RNA, 32 nt, Human
ccacaggccacuggcccuggguggcucuguca

SEQ ID NO: 96127 - RNA, 32 nt, Human
ccacaggccagccagugaaccuccugggcuuu

SEQ ID NO: 96128 - RNA, 32 nt, Human
ccacaggccagccugcacaggucuccacggug

SEQ ID NO: 96129 - RNA, 24 nt, Human
ccacaggccuacagcuucuccuca

SEQ ID NO: 96130 - RNA, 32 nt, Human
ccacaggccuagaacaguuaaagggaacauaa

SEQ ID NO: 96131 - RNA, 19 nt, Human
ccacaggccugccccaggc

SEQ ID NO: 96132 - RNA, 32 nt, Human
ccacaggccuggaggaguuuccuggccuguca

SEQ ID NO: 96133 - RNA, 32 nt, Human
ccacaggccuggccuggagaaacccacagccu

SEQ ID NO: 96134 - RNA, 32 nt, Human
ccacaggcgacugccaccacacccagcuaauu

SEQ ID NO: 96135 - RNA, 32 nt, Human
ccacaggcgcccccaccauguccggcuaauuu

SEQ ID NO: 96136 - RNA, 32 nt, Human
ccacaggcgccuuccucuguccuuccugcucu

SEQ ID NO: 96137 - RNA, 32 nt, Human
ccacaggcucaaccugcacuuccuaggcagcu

SEQ ID NO: 96138 - RNA, 32 nt, Human
ccacaggcugccauagcacaagugagaauuuc

SEQ ID NO: 96139 - RNA, 21 nt, Human
ccacaggcuggaguacagugg

SEQ ID NO: 96140 - RNA, 22 nt, Human
ccacaggcuggaguacaguggc

SEQ ID NO: 96141 - RNA, 32 nt, Human
ccacaggcuggcugugugaucuugggcaaguu

SEQ ID NO: 96142 - RNA, 32 nt, Human
ccacaggcuggggcugggggagagggaaggua

SEQ ID NO: 96143 - RNA, 25 nt, Human
ccacaggcuggggggcuccgguucc

SEQ ID NO: 96144 - RNA, 32 nt, Human
ccacaggcuuucugaccauccauucguugggu

SEQ ID NO: 96145 - RNA, 32 nt, Human
ccacagggaaaccucuugucccucuggaaacu

SEQ ID NO: 96146 - RNA, 20 nt, Human
ccacagggaacagggcagcu

SEQ ID NO: 96147 - RNA, 32 nt, Human
ccacagggaacaucuauuugggcuuugauguu

SEQ ID NO: 96148 - RNA, 18 nt, Human
ccacagggaagcugcaga

SEQ ID NO: 96149 - RNA, 32 nt, Human
ccacagggaccccagccuggguggucacuaga

SEQ ID NO: 96150 - RNA, 32 nt, Human
ccacagggacccugcacucgacccugggggcu

SEQ ID NO: 96151 - RNA, 32 nt, Human
ccacagggcagaccccgcugcacucacaggga

SEQ ID NO: 96152 - RNA, 32 nt, Human
ccacagggcccagccccucuccccugcccaag

SEQ ID NO: 96153 - RNA, 32 nt, Human
ccacagggcuuagugggucccccaggcugagg

SEQ ID NO: 96154 - RNA, 32 nt, Human
ccacagggcuucuaggcagggaaagggcacac

SEQ ID NO: 96155 - RNA, 23 nt, Human
ccacaggggaggccucagccagg

SEQ ID NO: 96156 - RNA, 22 nt, Human
ccacaggggcuccuggcuccug

SEQ ID NO: 96157 - RNA, 32 nt, Human
ccacaggguagaggccaggugccugaggacag

SEQ ID NO: 96158 - RNA, 18 nt, Human
ccacaggguccucagggg

SEQ ID NO: 96159 - RNA, 32 nt, Human
ccacaggguccugcaggcuccaucagucaccg

SEQ ID NO: 96160 - RNA, 32 nt, Human
ccacagggugagcacucuggggugggaggguc

SEQ ID NO: 96161 - RNA, 24 nt, Human
ccacaggguggacuggcugggccc

SEQ ID NO: 96162 - RNA, 32 nt, Human
ccacaggguuguugcugcccaggcucuagauc

SEQ ID NO: 96163 - RNA, 32 nt, Human
ccacagguaguuaaugcugggggaagaggggg

SEQ ID NO: 96164 - RNA, 32 nt, Human
ccacagguaugcaccaccacgcccagcuaauu

SEQ ID NO: 96165 - RNA, 32 nt, Human
ccacaggucagguggaggguggggcgugggca

SEQ ID NO: 96166 - RNA, 32 nt, Human
ccacaggucucagacugacaggagacuggguc

SEQ ID NO: 96167 - RNA, 32 nt, Human
ccacaggugccaugugcacacuccugguuuuc

SEQ ID NO: 96168 - RNA, 32 nt, Human
ccacaggugcccgccaccacacccaacuaauu

SEQ ID NO: 96169 - RNA, 32 nt, Human
ccacaggugccuggaggagcugugcugccgga

SEQ ID NO: 96170 - RNA, 32 nt, Human
ccacagguguuuauacagcucagcuuuuuguc

SEQ ID NO: 96171 - RNA, 32 nt, Human
ccacagguucauauccagaggaauggcagauc

SEQ ID NO: 96172 - RNA, 32 nt, Human
ccacagguucuacucauccuagcaaguuccuu

SEQ ID NO: 96173 - RNA, 32 nt, Human
ccacaguacacacgugcuuccucucuugacau

SEQ ID NO: 96174 - RNA, 32 nt, Human
ccacaguaccccagccucacacaugcacuccu

SEQ ID NO: 96175 - RNA, 32 nt, Human
ccacaguacuccuggucuuucuuucugcuaug

SEQ ID NO: 96176 - RNA, 32 nt, Human
ccacagucaaagaaggauggcaccuaaaccac

SEQ ID NO: 96177 - RNA, 32 nt, Human
ccacagucagaccugucccauggcuuagucca

SEQ ID NO: 96178 - RNA, 32 nt, Human
ccacagucagauucagcaccugccucagaucu

SEQ ID NO: 96179 - RNA, 32 nt, Human
ccacagucagggaaggacucucacuuauuugu

SEQ ID NO: 96180 - RNA, 32 nt, Human
ccacagucauauaugggagaccucaaguugcu

SEQ ID NO: 96181 - RNA, 19 nt, Human
ccacaguccagacacaggc

SEQ ID NO: 96182 - RNA, 32 nt, Human
ccacagucccuuuaaagaaacaugguuugacu

SEQ ID NO: 96183 - RNA, 32 nt, Human
ccacaguccuccagcagugaaggauccaguga

SEQ ID NO: 96184 - RNA, 32 nt, Human
ccacaguccuccaggcgccagugggaucaaga

SEQ ID NO: 96185 - RNA, 32 nt, Human
ccacaguccucuucagggccugggcagcccca

SEQ ID NO: 96186 - RNA, 32 nt, Human
ccacagucggacugcauugcuuggguccccau

SEQ ID NO: 96187 - RNA, 32 nt, Human
ccacagucuagacugugucagaguucacccca

SEQ ID NO: 96188 - RNA, 32 nt, Human
ccacagucuccagccugaagcggaaguggagg

SEQ ID NO: 96189 - RNA, 21 nt, Human
ccacagugcaccagagcacag

SEQ ID NO: 96190 - RNA, 32 nt, Human
ccacagugcauucaugcagcugacaguuauau

SEQ ID NO: 96191 - RNA, 32 nt, Human
ccacagugccacucuggcugggcaggggcuuc

SEQ ID NO: 96192 - RNA, 32 nt, Human
ccacagugcccaccugcucuccaggccccagg

SEQ ID NO: 96193 - RNA, 32 nt, Human
ccacagugcccauuuuucauccagggagaacc

SEQ ID NO: 96194 - RNA, 24 nt, Human
ccacagugcugggauuacaggagu

SEQ ID NO: 96195 - RNA, 22 nt, Human
ccacagugcugggauuacaggc

SEQ ID NO: 96196 - RNA, 24 nt, Human
ccacagugcugggauuacaggcgu

SEQ ID NO: 96197 - RNA, 24 nt, Human
ccacagugcugggauuaccggcgu

SEQ ID NO: 96198 - RNA, 22 nt, Human
ccacagugcugggauuagaggc

SEQ ID NO: 96199 - RNA, 25 nt, Human
ccacagugcugggcggcaucccugc

SEQ ID NO: 96200 - RNA, 17 nt, Human
ccacaguggaagcuguc

SEQ ID NO: 96201 - RNA, 32 nt, Human
ccacagugggagguggugguggguggcggugg

SEQ ID NO: 96202 - RNA, 32 nt, Human
ccacaguggggugaccacccugagcuuacagc

SEQ ID NO: 96203 - RNA, 20 nt, Human
ccacaguuaagauccagccu

SEQ ID NO: 96204 - RNA, 32 nt, Human
ccacaguuacagccacaagccugccuccuccc

SEQ ID NO: 96205 - RNA, 22 nt, Human
ccacaguucacauuaugcaucu

SEQ ID NO: 96206 - RNA, 32 nt, Human
ccacaguucagaaaucaucccacaguguugcu

SEQ ID NO: 96207 - RNA, 20 nt, Human
ccacaguucauggcggcucu

SEQ ID NO: 96208 - RNA, 32 nt, Human
ccacaguucccaggcuggggaugcuuugccuu

SEQ ID NO: 96209 - RNA, 22 nt, Human
ccacaguucucaaggaagggcc

SEQ ID NO: 96210 - RNA, 22 nt, Human
ccacaguucuccagggacccau

SEQ ID NO: 96211 - RNA, 25 nt, Human
ccacaguugagaagcggaggggcca

SEQ ID NO: 96212 - RNA, 32 nt, Human
ccacaguugcacugccccaauugucuaccuuu

SEQ ID NO: 96213 - RNA, 32 nt, Human
ccacaguugcagccaacgguucuugaaagcuc

SEQ ID NO: 96214 - RNA, 32 nt, Human
ccacaguugccagcuuuauuugccuucuacag

SEQ ID NO: 96215 - RNA, 32 nt, Human
ccacaguugcucuaacacagaccuuugaggau

SEQ ID NO: 96216 - RNA, 32 nt, Human
ccacaguugucuuugccggagcugcagucgcg

SEQ ID NO: 96217 - RNA, 19 nt, Human
ccacaguuuuacuggggcc

SEQ ID NO: 96218 - RNA, 32 nt, Human
ccacaguuuuucccugccuucuggacccucag

SEQ ID NO: 96219 - RNA, 32 nt, Human
ccacauaaagagagcuucucagagccugacug

SEQ ID NO: 96220 - RNA, 32 nt, Human
ccacauacagauggaugaaacuacuuacugau

SEQ ID NO: 96221 - RNA, 32 nt, Human
ccacauacuauugugaguucucagagcaugaa

SEQ ID NO: 96222 - RNA, 32 nt, Human
ccacauacucuacuccuccugucccuccaagg

SEQ ID NO: 96223 - RNA, 32 nt, Human
ccacauacuuaccaagcaaaaagcccaugaaa

SEQ ID NO: 96224 - RNA, 32 nt, Human
ccacauacuuucagaagagcucagcagggccc

SEQ ID NO: 96225 - RNA, 32 nt, Human
ccacauagcagacccccgccauccucgcagag

SEQ ID NO: 96226 - RNA, 32 nt, Human
ccacauagcccucguaguaacagccauucuca

SEQ ID NO: 96227 - RNA, 32 nt, Human
ccacauaggaauagccugacugagggggaagg

SEQ ID NO: 96228 - RNA, 32 nt, Human
ccacauauaaauguacuuuuccuuccagaaaa

SEQ ID NO: 96229 - RNA, 19 nt, Human
ccacauaugcagggggugc

SEQ ID NO: 96230 - RNA, 32 nt, Human
ccacauauuaucuuacagauguuuccagaaau

SEQ ID NO: 96231 - RNA, 32 nt, Human
ccacaucaaaacaguguguccaccucagucac

SEQ ID NO: 96232 - RNA, 32 nt, Human
ccacaucaauaaacaugacacucugaagugaa

SEQ ID NO: 96233 - RNA, 32 nt, Human
ccacaucaccagaaggauuucuuaggaaaugu

SEQ ID NO: 96234 - RNA, 32 nt, Human
ccacaucacucccccgaguucccaccaccagc

SEQ ID NO: 96235 - RNA, 32 nt, Human
ccacaucacugcacccugaaacagagcaugcu

SEQ ID NO: 96236 - RNA, 32 nt, Human
ccacaucacuuuaacuaaucuaauuacugaag

SEQ ID NO: 96237 - RNA, 32 nt, Human
ccacaucagaaucgucugagggacuuguucac

SEQ ID NO: 96238 - RNA, 32 nt, Human
ccacaucagcacauggccugaccaggaacuac

SEQ ID NO: 96239 - RNA, 18 nt, Human
ccacaucagccccagggu

SEQ ID NO: 96240 - RNA, 32 nt, Human
ccacaucagcuccuugagcuucucccaagugg

SEQ ID NO: 96241 - RNA, 32 nt, Human
ccacaucagggggcuaccaccaugauuccgcu

SEQ ID NO: 96242 - RNA, 32 nt, Human
ccacaucagugagggaaaugugggcaugcaug

SEQ ID NO: 96243 - RNA, 32 nt, Human
ccacaucaucaaguugcagcucagggacuacg

SEQ ID NO: 96244 - RNA, 32 nt, Human
ccacauccaaaggauguggagcucuuuaaaaa

SEQ ID NO: 96245 - RNA, 17 nt, Human
ccacauccacacacgca

SEQ ID NO: 96246 - RNA, 32 nt, Human
ccacauccaggugcacagagugcgagugcacu

SEQ ID NO: 96247 - RNA, 32 nt, Human
ccacaucccacacucccacugccuggcuccaa

SEQ ID NO: 96248 - RNA, 32 nt, Human
ccacaucccaggaggccgaggcggcuugcccc

SEQ ID NO: 96249 - RNA, 21 nt, Human
ccacauccccaauauccuaga

SEQ ID NO: 96250 - RNA, 21 nt, Human
ccacauccccacuguacugga

SEQ ID NO: 96251 - RNA, 32 nt, Human
ccacauccccaggcauaacaccaccuucccac

SEQ ID NO: 96252 - RNA, 32 nt, Human
ccacaucccgcauccggcaucccagcggccgg

SEQ ID NO: 96253 - RNA, 32 nt, Human
ccacaucccuaaaaucuuggaggggcagacca

SEQ ID NO: 96254 - RNA, 22 nt, Human
ccacaucccugaagcugucaga

SEQ ID NO: 96255 - RNA, 32 nt, Human
ccacaucccugauuccuguuguuauggaaacu

SEQ ID NO: 96256 - RNA, 32 nt, Human
ccacaucccugcuggaugcaggacccguccaa

SEQ ID NO: 96257 - RNA, 32 nt, Human
ccacaucccuuuccuuacuacuugccugcacu

SEQ ID NO: 96258 - RNA, 32 nt, Human
ccacauccgaaucuguggcaccacagaggagc

SEQ ID NO: 96259 - RNA, 32 nt, Human
ccacauccgcugucugcugcugccucuuuccu

SEQ ID NO: 96260 - RNA, 32 nt, Human
ccacauccguaaauaaacuuccuucacuacaa

SEQ ID NO: 96261 - RNA, 32 nt, Human
ccacauccguccucccccuucccaggcccgga

SEQ ID NO: 96262 - RNA, 24 nt, Human
ccacauccguggauucacccaacu

SEQ ID NO: 96263 - RNA, 18 nt, Human
ccacauccucacacauug

SEQ ID NO: 96264 - RNA, 32 nt, Human
ccacauccucccccucccuuuccucaugaacc

SEQ ID NO: 96265 - RNA, 24 nt, Human
ccacauccucgguccccaaccacu

SEQ ID NO: 96266 - RNA, 32 nt, Human
ccacauccugggaacacuuucauguaaccccu

SEQ ID NO: 96267 - RNA, 32 nt, Human
ccacauccuguccuaucucccccaaaccauac

SEQ ID NO: 96268 - RNA, 32 nt, Human
ccacauccugucuuagccgcagucuccagaac

SEQ ID NO: 96269 - RNA, 32 nt, Human
ccacauccuucucuuccauuagaagaagcccu

SEQ ID NO: 96270 - RNA, 23 nt, Human
ccacaucggcaacuucagccugg

SEQ ID NO: 96271 - RNA, 32 nt, Human
ccacaucggucugccuucgaccuucuucccag

SEQ ID NO: 96272 - RNA, 32 nt, Human
ccacaucuaaaguucaagaaacuagucuguca

SEQ ID NO: 96273 - RNA, 32 nt, Human
ccacaucuacaucagugaaagcuaucuaccua

SEQ ID NO: 96274 - RNA, 32 nt, Human
ccacaucuagauagaugugagcuuuuucuucu

SEQ ID NO: 96275 - RNA, 32 nt, Human
ccacaucuagcuuccucccucuccucugcuuc

SEQ ID NO: 96276 - RNA, 32 nt, Human
ccacaucucaauccugaacaucuaggcuggaa

SEQ ID NO: 96277 - RNA, 32 nt, Human
ccacaucuccuccaaacacacacaggaccuca

SEQ ID NO: 96278 - RNA, 32 nt, Human
ccacaucucugaaagcacaggagacacugugc

SEQ ID NO: 96279 - RNA, 32 nt, Human
ccacaucugccucuggcugccugcguccucuc

SEQ ID NO: 96280 - RNA, 32 nt, Human
ccacaucuguaaucccagcacuuugggaggcu

SEQ ID NO: 96281 - RNA, 32 nt, Human
ccacaucugugaaugggaauuaagcuuccccu

SEQ ID NO: 96282 - RNA, 23 nt, Human
ccacaucuguggauucaaccaac

SEQ ID NO: 96283 - RNA, 24 nt, Human
ccacaucuguggauucaaccaacu

SEQ ID NO: 96284 - RNA, 32 nt, Human
ccacaucuucacauugguucugaucugagacc

SEQ ID NO: 96285 - RNA, 32 nt, Human
ccacaucuucacucaagccaggagagggaaag

SEQ ID NO: 96286 - RNA, 32 nt, Human
ccacaucuuguccuacuggaagguuuucaggg

SEQ ID NO: 96287 - RNA, 20 nt, Human
ccacaugaacuggacugaga

SEQ ID NO: 96288 - RNA, 32 nt, Human
ccacaugacucugccucccaaagugcugccau

SEQ ID NO: 96289 - RNA, 32 nt, Human
ccacaugaggggaugaauuuuuccaguccccu

SEQ ID NO: 96290 - RNA, 24 nt, Human
ccacaugcaacacuguguccagca

SEQ ID NO: 96291 - RNA, 18 nt, Human
ccacaugcaacuauugca

SEQ ID NO: 96292 - RNA, 32 nt, Human
ccacaugcacacacacucacgcaugagcaaac

SEQ ID NO: 96293 - RNA, 20 nt, Human
ccacaugcagacaggaggaa

SEQ ID NO: 96294 - RNA, 32 nt, Human
ccacaugcaugucugccuaugcacugaagagc

SEQ ID NO: 96295 - RNA, 21 nt, Human
ccacaugccacuggaagggaa

SEQ ID NO: 96296 - RNA, 32 nt, Human
ccacaugccacuggaagggaagugggugucca

SEQ ID NO: 96297 - RNA, 32 nt, Human
ccacaugccagaaugucccugcccuucucucc

SEQ ID NO: 96298 - RNA, 19 nt, Human
ccacaugccagugaaggaa

SEQ ID NO: 96299 - RNA, 32 nt, Human
ccacaugccuguaauuccagcuacuugggagg

SEQ ID NO: 96300 - RNA, 32 nt, Human
ccacaugccuguagucccagcuacuugggaag

SEQ ID NO: 96301 - RNA, 32 nt, Human
ccacaugcgaaggacagccugcagugaccaga

SEQ ID NO: 96302 - RNA, 19 nt, Human
ccacaugcgaggcggcugg

SEQ ID NO: 96303 - RNA, 32 nt, Human
ccacaugcgguggcucaugccuguaaucccag

SEQ ID NO: 96304 - RNA, 32 nt, Human
ccacaugcuccaagccacagguccccaaauag

SEQ ID NO: 96305 - RNA, 32 nt, Human
ccacaugcucuagacuagucugggcaacauag

SEQ ID NO: 96306 - RNA, 32 nt, Human
ccacaugcugacacagacucacucagagaccc

SEQ ID NO: 96307 - RNA, 19 nt, Human
ccacaugcugguccgcaga

SEQ ID NO: 96308 - RNA, 32 nt, Human
ccacaugcuuuucucacuugacauguagauga

SEQ ID NO: 96309 - RNA, 32 nt, Human
ccacauggaaacagaguguggcccugaaguug

SEQ ID NO: 96310 - RNA, 32 nt, Human
ccacauggacuggggugcaaugggacagcugc

SEQ ID NO: 96311 - RNA, 32 nt, Human
ccacauggagaaagagaggccacauggaguaa

SEQ ID NO: 96312 - RNA, 32 nt, Human
ccacauggcaggcaugaagauucagccugugg

SEQ ID NO: 96313 - RNA, 19 nt, Human
ccacauggccaucugcucc

SEQ ID NO: 96314 - RNA, 32 nt, Human
ccacauggcuggacuccagccaggaggacaca

SEQ ID NO: 96315 - RNA, 32 nt, Human
ccacaugggagggugagcaggagcaaggcugu

SEQ ID NO: 96316 - RNA, 32 nt, Human
ccacauggggcugcucuugcuucuacuaaaag

SEQ ID NO: 96317 - RNA, 32 nt, Human
ccacaugguaccccuuugguaaguaggcuuca

SEQ ID NO: 96318 - RNA, 18 nt, Human
ccacauggugaaacccau

SEQ ID NO: 96319 - RNA, 19 nt, Human
ccacauggugaaacccugu

SEQ ID NO: 96320 - RNA, 19 nt, Human
ccacauggugcaaccccgu

SEQ ID NO: 96321 - RNA, 32 nt, Human
ccacaugguggaggcagcgaugagaccuggag

SEQ ID NO: 96322 - RNA, 23 nt, Human
ccacaugucacccacccaccgca

SEQ ID NO: 96323 - RNA, 32 nt, Human
ccacaugucuucacggaggcuuccagcggugc

SEQ ID NO: 96324 - RNA, 32 nt, Human
ccacaugugcuggcacuuaccuguagucccag

SEQ ID NO: 96325 - RNA, 32 nt, Human
ccacauguggacccucagccuggguggguucu

SEQ ID NO: 96326 - RNA, 21 nt, Human
ccacauguggccaucugcucc

SEQ ID NO: 96327 - RNA, 20 nt, Human
ccacauguggggacuggaga

SEQ ID NO: 96328 - RNA, 20 nt, Human
ccacauguuaucuaaaggaa

SEQ ID NO: 96329 - RNA, 18 nt, Human
ccacauguucucaaggcc

SEQ ID NO: 96330 - RNA, 32 nt, Human
ccacauguuggccaggcuggucucgaauuccu

SEQ ID NO: 96331 - RNA, 32 nt, Human
ccacauuacuaaggagaaugaaaagcacugag

SEQ ID NO: 96332 - RNA, 32 nt, Human
ccacauucaaaccuguuaauucgcuguuauca

SEQ ID NO: 96333 - RNA, 18 nt, Human
ccacauuccaucagugaa

SEQ ID NO: 96334 - RNA, 32 nt, Human
ccacauucccaaguuuaggugcacugagccau

SEQ ID NO: 96335 - RNA, 23 nt, Human
ccacauucccacuagugggucuu

SEQ ID NO: 96336 - RNA, 24 nt, Human
ccacauuccccagugagaauucuu

SEQ ID NO: 96337 - RNA, 32 nt, Human
ccacauuccccugccuugccccugagcacuuc

SEQ ID NO: 96338 - RNA, 32 nt, Human
ccacauuccucuacuguuuucuuucugauacu

SEQ ID NO: 96339 - RNA, 20 nt, Human
ccacauuccuggccacaccc

SEQ ID NO: 96340 - RNA, 32 nt, Human
ccacauuccuggggagggugguucuccuguau

SEQ ID NO: 96341 - RNA, 23 nt, Human
ccacauuccuuuaacggaggucu

SEQ ID NO: 96342 - RNA, 32 nt, Human
ccacauucuaguuggaacacaggacagugaaa

SEQ ID NO: 96343 - RNA, 32 nt, Human
ccacauucuccacugcguguggucaaaguucc

SEQ ID NO: 96344 - RNA, 32 nt, Human
ccacauucucucucacucacauuuucucagug

SEQ ID NO: 96345 - RNA, 20 nt, Human
ccacauucucuucagggucu

SEQ ID NO: 96346 - RNA, 32 nt, Human
ccacauucugcaccuccuuccugcuuuccuag

SEQ ID NO: 96347 - RNA, 20 nt, Human
ccacauucuggccccuggca

SEQ ID NO: 96348 - RNA, 32 nt, Human
ccacauucuuaaagaaacuuucccuuccuuua

SEQ ID NO: 96349 - RNA, 25 nt, Human
ccacauugcacucugacuugccugg

SEQ ID NO: 96350 - RNA, 32 nt, Human
ccacauugcaguguagcaggugccauccuuca

SEQ ID NO: 96351 - RNA, 22 nt, Human
ccacauugcccaggcuggucuc

SEQ ID NO: 96352 - RNA, 23 nt, Human
ccacauuggccaggcuggucuca

SEQ ID NO: 96353 - RNA, 32 nt, Human
ccacauuggccaggcuggucucaaaugacccu

SEQ ID NO: 96354 - RNA, 23 nt, Human
ccacauuggucaggcuggucuca

SEQ ID NO: 96355 - RNA, 32 nt, Human
ccacauugguuucugauuuuguucugucacuc

SEQ ID NO: 96356 - RNA, 32 nt, Human
ccacauuguggaguggcaagugcugcugccag

SEQ ID NO: 96357 - RNA, 32 nt, Human
ccacauuuaacuuauucacuuacagaacuaug

SEQ ID NO: 96358 - RNA, 32 nt, Human
ccacauuuacagccagaaucaacauucccugg

SEQ ID NO: 96359 - RNA, 32 nt, Human
ccacauuuacauaggaaccaaaucaaugaauu

SEQ ID NO: 96360 - RNA, 21 nt, Human
ccacauuuagauccaaccagc

SEQ ID NO: 96361 - RNA, 32 nt, Human
ccacauuucauugucuuagucaaagcaggauu

SEQ ID NO: 96362 - RNA, 32 nt, Human
ccacauuucuaauaccaccaccccugugcuuc

SEQ ID NO: 96363 - RNA, 32 nt, Human
ccacauuugcaaccuuggccaucuguccagaa

SEQ ID NO: 96364 - RNA, 32 nt, Human
ccacauuugccacccucugagcccaccagucc

SEQ ID NO: 96365 - RNA, 32 nt, Human
ccacauuugcccggcccccuggagcugggucu

SEQ ID NO: 96366 - RNA, 32 nt, Human
ccacauuugcuagagggagggagcagccacgg

SEQ ID NO: 96367 - RNA, 32 nt, Human
ccacauuugcugcuuugcagggagaguuggcc

SEQ ID NO: 96368 - RNA, 32 nt, Human
ccacauuuggaaggcacugccuucagcugagu

SEQ ID NO: 96369 - RNA, 32 nt, Human
ccacauuuggccauuucccagaagggccccac

SEQ ID NO: 96370 - RNA, 32 nt, Human
ccacauuuguuuugccaauuugcacauuaaau

SEQ ID NO: 96371 - RNA, 32 nt, Human
ccacauuuguuuuuaacccagaauuucugaaa

SEQ ID NO: 96372 - RNA, 32 nt, Human
ccacauuuuaacaguaccugugccugagaauu

SEQ ID NO: 96373 - RNA, 32 nt, Human
ccacauuuuacuacaguaaauggcaguguuuu

SEQ ID NO: 96374 - RNA, 17 nt, Human
ccacauuuucuccucag

SEQ ID NO: 96375 - RNA, 32 nt, Human
ccacauuuuucuuccgcacugcccuagcagag

SEQ ID NO: 96376 - RNA, 22 nt, Human
ccaccaaaccaugguccuuuaa

SEQ ID NO: 96377 - RNA, 32 nt, Human
ccaccaaacuccugcacaaccaccucaagaau

SEQ ID NO: 96378 - RNA, 19 nt, Human
ccaccaaagagucuccuga

SEQ ID NO: 96379 - RNA, 32 nt, Human
ccaccaaagccccagggauggagcccaguggc

SEQ ID NO: 96380 - RNA, 32 nt, Human
ccaccaaagcuacaaaccuaaaaugcugcugc

SEQ ID NO: 96381 - RNA, 32 nt, Human
ccaccaaaggaacagguuuagguggagacaac

SEQ ID NO: 96382 - RNA, 32 nt, Human
ccaccaaagggaggcuagggacaggaaagcca

SEQ ID NO: 96383 - RNA, 21 nt, Human
ccaccaaagggccucugcucc

SEQ ID NO: 96384 - RNA, 32 nt, Human
ccaccaaagugaugcagugguuaccaugacac

SEQ ID NO: 96385 - RNA, 32 nt, Human
ccaccaacaagaaacauuccuucucccggaca

SEQ ID NO: 96386 - RNA, 32 nt, Human
ccaccaacacaaaaucagucagauuuguuaaa

SEQ ID NO: 96387 - RNA, 32 nt, Human
ccaccaacacccacuccagacucuguaggggg

SEQ ID NO: 96388 - RNA, 32 nt, Human
ccaccaacagcaguuguaggcugcccuggagg

SEQ ID NO: 96389 - RNA, 19 nt, Human
ccaccaacagugucuccau

SEQ ID NO: 96390 - RNA, 16 nt, Human
ccaccaacauccaucc

SEQ ID NO: 96391 - RNA, 32 nt, Human
ccaccaacaugguccagcgcaaucagaagagg

SEQ ID NO: 96392 - RNA, 32 nt, Human
ccaccaaccccaaagaacugggaugaaagcag

SEQ ID NO: 96393 - RNA, 32 nt, Human
ccaccaaccccaucaggauuuccccaggggaa

SEQ ID NO: 96394 - RNA, 32 nt, Human
ccaccaacuccuccuccugcugcugcccuucc

SEQ ID NO: 96395 - RNA, 32 nt, Human
ccaccaagacacagcaggacaggccaggggag

SEQ ID NO: 96396 - RNA, 32 nt, Human
ccaccaagacugaaagaaacuaauuuauuucu

SEQ ID NO: 96397 - RNA, 32 nt, Human
ccaccaagagagcaaugggcagggaaggaagg

SEQ ID NO: 96398 - RNA, 32 nt, Human
ccaccaagcccagcuaauuguauuuuuaguag

SEQ ID NO: 96399 - RNA, 32 nt, Human
ccaccaagccugacagaaggaacacugcuuga

SEQ ID NO: 96400 - RNA, 32 nt, Human
ccaccaagcucacaccuguccuucucaggcug

SEQ ID NO: 96401 - RNA, 32 nt, Human
ccaccaaggaagaagagagaggagaagaggag

SEQ ID NO: 96402 - RNA, 32 nt, Human
ccaccaaggagagcccggacggagcagcgagg

SEQ ID NO: 96403 - RNA, 32 nt, Human
ccaccaaggaugaagaaaggaggacuuuuaaa

SEQ ID NO: 96404 - RNA, 32 nt, Human
ccaccaaggaugaccuguggacugccaucgga

SEQ ID NO: 96405 - RNA, 22 nt, Human
ccaccaaggcuuucccaucuug

SEQ ID NO: 96406 - RNA, 18 nt, Human
ccaccaagggcccugcga

SEQ ID NO: 96407 - RNA, 32 nt, Human
ccaccaaggucggcgcgucugaagagcguuuu

SEQ ID NO: 96408 - RNA, 24 nt, Human
ccaccaagguggacgcugggcccc

SEQ ID NO: 96409 - RNA, 32 nt, Human
ccaccaaguauuuuaaaagugugccaccuuuu

SEQ ID NO: 96410 - RNA, 32 nt, Human
ccaccaagucgcagguccucagccuggggcau

SEQ ID NO: 96411 - RNA, 32 nt, Human
ccaccaaguguaucuccagucugaucaccaua

SEQ ID NO: 96412 - RNA, 32 nt, Human
ccaccaaguugcccauugaugggugagccucc

SEQ ID NO: 96413 - RNA, 32 nt, Human
ccaccaaugagcugcacguuggaggggaagug

SEQ ID NO: 96414 - RNA, 32 nt, Human
ccaccaaugucuuaaucccacauuuucuucac

SEQ ID NO: 96415 - RNA, 32 nt, Human
ccaccacaacagcauguggucugacagaauug

SEQ ID NO: 96416 - RNA, 32 nt, Human
ccaccacaaugacagaaaugacaacaaggccc

SEQ ID NO: 96417 - RNA, 32 nt, Human
ccaccacaccaccacaaaauggccuuuagugu

SEQ ID NO: 96418 - RNA, 32 nt, Human
ccaccacaccacuggauauuccugggagucac

SEQ ID NO: 96419 - RNA, 32 nt, Human
ccaccacaccagcuaauuuuuguauuuuuagu

SEQ ID NO: 96420 - RNA, 22 nt, Human
ccaccacaccaggccagagcua

SEQ ID NO: 96421 - RNA, 32 nt, Human
ccaccacaccaggcuaauuuuguauuuuuagu

SEQ ID NO: 96422 - RNA, 32 nt, Human
ccaccacacccagcuaauuuuguauuuuuagu

SEQ ID NO: 96423 - RNA, 32 nt, Human
ccaccacacccagcuaauuuuguauuuuuggu

SEQ ID NO: 96424 - RNA, 32 nt, Human
ccaccacacccggcuaauuuuguauuuuuagu

SEQ ID NO: 96425 - RNA, 32 nt, Human
ccaccacacccggcuaauuuuguauuuuucag

SEQ ID NO: 96426 - RNA, 32 nt, Human
ccaccacaccuagcuaauuuuguauuuuuagu

SEQ ID NO: 96427 - RNA, 32 nt, Human
ccaccacaccuggccuauguguguuuuaugau

SEQ ID NO: 96428 - RNA, 32 nt, Human
ccaccacaccuggcuaauuuuguauuuuuagu

SEQ ID NO: 96429 - RNA, 32 nt, Human
ccaccacaccuggcugauuuuguauuuuuagu

SEQ ID NO: 96430 - RNA, 32 nt, Human
ccaccacaccuguuaacacacgcagacgcaca

SEQ ID NO: 96431 - RNA, 32 nt, Human
ccaccacacucccacacuccagccuggguaac

SEQ ID NO: 96432 - RNA, 32 nt, Human
ccaccacacugccaccacccugcacacagucu

SEQ ID NO: 96433 - RNA, 32 nt, Human
ccaccacacuggcuaauuuuuguauuuuuagu

SEQ ID NO: 96434 - RNA, 32 nt, Human
ccaccacacuucggcuccgcugaccccugcga

SEQ ID NO: 96435 - RNA, 32 nt, Human
ccaccacagcacaccggugcuggccacaccag

SEQ ID NO: 96436 - RNA, 32 nt, Human
ccaccacagcacagcaaagccgcuauagccag

SEQ ID NO: 96437 - RNA, 32 nt, Human
ccaccacagcagugccuucucgucgaagcggg

SEQ ID NO: 96438 - RNA, 32 nt, Human
ccaccacagccauccugucccucauuggcucu

SEQ ID NO: 96439 - RNA, 32 nt, Human
ccaccacagccauguaaaaccugcagugccug

SEQ ID NO: 96440 - RNA, 32 nt, Human
ccaccacagcuggcccccuucuguuuuauguu

SEQ ID NO: 96441 - RNA, 32 nt, Human
ccaccacaggcaggggucgacauggcagagac

SEQ ID NO: 96442 - RNA, 32 nt, Human
ccaccacaggccugccccaggcaccuggggcu

SEQ ID NO: 96443 - RNA, 32 nt, Human
ccaccacagggucuggaagugugugugacgcc

SEQ ID NO: 96444 - RNA, 32 nt, Human
ccaccacagguaugcaccaccauaccuggcug

SEQ ID NO: 96445 - RNA, 32 nt, Human
ccaccacaucgccccagaggcuuuuccagcac

SEQ ID NO: 96446 - RNA, 32 nt, Human
ccaccacauuuggaaauccacagcugacaagu

SEQ ID NO: 96447 - RNA, 32 nt, Human
ccaccaccaaaagcaaaagaugauuucccauu

SEQ ID NO: 96448 - RNA, 18 nt, Human
ccaccaccaaagagcuga

SEQ ID NO: 96449 - RNA, 32 nt, Human
ccaccaccacagacaguacaagcaacaguucc

SEQ ID NO: 96450 - RNA, 32 nt, Human
ccaccaccaccaccaucaccaccaccauggac

SEQ ID NO: 96451 - RNA, 32 nt, Human
ccaccaccaccacugagauccggcuugcuaca

SEQ ID NO: 96452 - RNA, 32 nt, Human
ccaccaccaccagucccggcacggcaagagga

SEQ ID NO: 96453 - RNA, 19 nt, Human
ccaccaccacccccagcuc

SEQ ID NO: 96454 - RNA, 32 nt, Human
ccaccaccacugucccuaccacugagcccuug

SEQ ID NO: 96455 - RNA, 22 nt, Human
ccaccaccacuuaccacucgug

SEQ ID NO: 96456 - RNA, 32 nt, Human
ccaccaccagccccaacuguaggcaaggcaca

SEQ ID NO: 96457 - RNA, 21 nt, Human
ccaccaccaugaauggucuga

SEQ ID NO: 96458 - RNA, 32 nt, Human
ccaccaccauguucuaacauguggacccuuua

SEQ ID NO: 96459 - RNA, 32 nt, Human
ccaccaccauuccuuuccucccuucccccugg

SEQ ID NO: 96460 - RNA, 32 nt, Human
ccaccacccaauccucgccucccuucugcucc

SEQ ID NO: 96461 - RNA, 32 nt, Human
ccaccacccacugcaccguggucucgggcuca

SEQ ID NO: 96462 - RNA, 32 nt, Human
ccaccacccacuguguaugaacaagucugaag

SEQ ID NO: 96463 - RNA, 32 nt, Human
ccaccacccaggagcucagagaucuaagcugc

SEQ ID NO: 96464 - RNA, 18 nt, Human
ccaccacccauacugcca

SEQ ID NO: 96465 - RNA, 32 nt, Human
ccaccacccaucaccaauuucucagcuuuagc

SEQ ID NO: 96466 - RNA, 22 nt, Human
ccaccaccccagcugcuccccu

SEQ ID NO: 96467 - RNA, 32 nt, Human
ccaccacccccagcuccugaggugcuggccag

SEQ ID NO: 96468 - RNA, 32 nt, Human
ccaccaccccucuaccucuucagagcuaaugg

SEQ ID NO: 96469 - RNA, 32 nt, Human
ccaccaccccuggcuaaauuuguauuuucagu

SEQ ID NO: 96470 - RNA, 22 nt, Human
ccaccacccucuuucuguacuu

SEQ ID NO: 96471 - RNA, 32 nt, Human
ccaccaccgcagccucgggcucccagggcgga

SEQ ID NO: 96472 - RNA, 32 nt, Human
ccaccaccuccaccaccaccaccaccaccacc

SEQ ID NO: 96473 - RNA, 32 nt, Human
ccaccaccuccaccgccgccucggaacccagg

SEQ ID NO: 96474 - RNA, 32 nt, Human
ccaccaccuccaucggcacccaagcgggcauc

SEQ ID NO: 96475 - RNA, 32 nt, Human
ccaccaccuccuccuccuccuggcccugcugc

SEQ ID NO: 96476 - RNA, 32 nt, Human
ccaccaccucucuuccaugaaggagcaccuua

SEQ ID NO: 96477 - RNA, 32 nt, Human
ccaccaccugcagcuugagauguuaacuauua

SEQ ID NO: 96478 - RNA, 32 nt, Human
ccaccaccuggcaugcccuccuggggccaaga

SEQ ID NO: 96479 - RNA, 32 nt, Human
ccaccaccuggcgucuccgcucccagagccca

SEQ ID NO: 96480 - RNA, 23 nt, Human
ccaccaccugugugaaacugcag

SEQ ID NO: 96481 - RNA, 32 nt, Human
ccaccaccuucucuucucuugucacuaggggg

SEQ ID NO: 96482 - RNA, 23 nt, Human
ccaccacgaaacucagcccagua

SEQ ID NO: 96483 - RNA, 32 nt, Human
ccaccacgcaggcccuugcuucucccaucaac

SEQ ID NO: 96484 - RNA, 32 nt, Human
ccaccacgccagcuaauuuuuguauuuuuagu

SEQ ID NO: 96485 - RNA, 32 nt, Human
ccaccacgccaggcuaauuuuguauuuuuagu

SEQ ID NO: 96486 - RNA, 32 nt, Human
ccaccacgccaggcuaauuuuguauuuuuggu

SEQ ID NO: 96487 - RNA, 32 nt, Human
ccaccacgcccaacuaauuuuguauuuuuagu

SEQ ID NO: 96488 - RNA, 32 nt, Human
ccaccacgcccagcaauuuuuguauuuuuagu

SEQ ID NO: 96489 - RNA, 32 nt, Human
ccaccacgcccagccagaaauugcuucccaag

SEQ ID NO: 96490 - RNA, 32 nt, Human
ccaccacgcccagccuagaaaugauucuuaga

SEQ ID NO: 96491 - RNA, 32 nt, Human
ccaccacgcccagccuguggccagcacuuuag

SEQ ID NO: 96492 - RNA, 32 nt, Human
ccaccacgcccagcuaauuuuguauuuuuagu

SEQ ID NO: 96493 - RNA, 32 nt, Human
ccaccacgcccagcuauuuuuguauuuuuagu

SEQ ID NO: 96494 - RNA, 32 nt, Human
ccaccacgcccagcuuauuuuguauuuuuagu

SEQ ID NO: 96495 - RNA, 32 nt, Human
ccaccacgcccggcuaauuuuguauuucuagu

SEQ ID NO: 96496 - RNA, 32 nt, Human
ccaccacgcccggcuaauuuuguauuuucagu

SEQ ID NO: 96497 - RNA, 32 nt, Human
ccaccacgcccggcuaauuuuguauuuuuaag

SEQ ID NO: 96498 - RNA, 32 nt, Human
ccaccacgcccggcuaauuuuguauuuuuagu

SEQ ID NO: 96499 - RNA, 32 nt, Human
ccaccacgcccggcuaauuuuguauuuuucau

SEQ ID NO: 96500 - RNA, 32 nt, Human
ccaccacgccgacuaauuuuuguauuuuuagu

SEQ ID NO: 96501 - RNA, 32 nt, Human
ccaccacgccugacuaauuuuguauuuuuagu

SEQ ID NO: 96502 - RNA, 32 nt, Human
ccaccacgccuggccaauuuuguauuuuagua

SEQ ID NO: 96503 - RNA, 32 nt, Human
ccaccacgccuggcuaauguuguauuuuagua

SEQ ID NO: 96504 - RNA, 32 nt, Human
ccaccacgccuggcuaauuuuguauuuuuagu

SEQ ID NO: 96505 - RNA, 32 nt, Human
ccaccacgccuggcuggaauacuuacucuugu

SEQ ID NO: 96506 - RNA, 32 nt, Human
ccaccacgccuggcuggaauucugugucauuc

SEQ ID NO: 96507 - RNA, 32 nt, Human
ccaccacgcuggcuaauuuuuguauuuuuagu

SEQ ID NO: 96508 - RNA, 21 nt, Human
ccaccacggggggagagccag

SEQ ID NO: 96509 - RNA, 32 nt, Human
ccaccacgucuggcuaauuuuguauuuuuagu

SEQ ID NO: 96510 - RNA, 32 nt, Human
ccaccacguggugcaagaguucugagggaccg

SEQ ID NO: 96511 - RNA, 32 nt, Human
ccaccacuacaccacacaugcuuauaacaggc

SEQ ID NO: 96512 - RNA, 32 nt, Human
ccaccacuaccaccaccacccaacuggggcua

SEQ ID NO: 96513 - RNA, 32 nt, Human
ccaccacuauuccucucucuugcccauugugg

SEQ ID NO: 96514 - RNA, 20 nt, Human
ccaccacucaccucuugguu

SEQ ID NO: 96515 - RNA, 32 nt, Human
ccaccacuccacugggcucgcacaacgccaag

SEQ ID NO: 96516 - RNA, 32 nt, Human
ccaccacucccauccccaccugucccccuggg

SEQ ID NO: 96517 - RNA, 23 nt, Human
ccaccacucccgccaucugcugc

SEQ ID NO: 96518 - RNA, 32 nt, Human
ccaccacucccuuagucuuucccaggcuuacu

SEQ ID NO: 96519 - RNA, 32 nt, Human
ccaccacucucccaucaccugcucugcucuua

SEQ ID NO: 96520 - RNA, 32 nt, Human
ccaccacucuggguuccauuugugggagggag

SEQ ID NO: 96521 - RNA, 32 nt, Human
ccaccacugcaacuuuuguauucacaggcauc

SEQ ID NO: 96522 - RNA, 32 nt, Human
ccaccacugcacuccagccuggaugacagagu

SEQ ID NO: 96523 - RNA, 32 nt, Human
ccaccacugcacuccagccugggaagcagagu

SEQ ID NO: 96524 - RNA, 32 nt, Human
ccaccacugcacuccagccugggcaacagagu

SEQ ID NO: 96525 - RNA, 32 nt, Human
ccaccacugcacuccagccugggcgacacagc

SEQ ID NO: 96526 - RNA, 32 nt, Human
ccaccacugcacuccagccugggcgacagagc

SEQ ID NO: 96527 - RNA, 32 nt, Human
ccaccacugcacuccagccugggugacagagu

SEQ ID NO: 96528 - RNA, 24 nt, Human
ccaccacugccccaccacccagag

SEQ ID NO: 96529 - RNA, 32 nt, Human
ccaccacugcccccuuuccuuuucugaccucc

SEQ ID NO: 96530 - RNA, 32 nt, Human
ccaccacugccuggaacauccuuguucucugc

SEQ ID NO: 96531 - RNA, 32 nt, Human
ccaccacuggacugggcuggcccagccccugu

SEQ ID NO: 96532 - RNA, 32 nt, Human
ccaccacugggacccuccccagccuggagagu

SEQ ID NO: 96533 - RNA, 32 nt, Human
ccaccacugggcagaggcuggacagcacggac

SEQ ID NO: 96534 - RNA, 32 nt, Human
ccaccacuuagcaaugggcugaucucuccuug

SEQ ID NO: 96535 - RNA, 32 nt, Human
ccaccacuuccucugcugggcaugcuccaaaa

SEQ ID NO: 96536 - RNA, 18 nt, Human
ccaccacuugugucucca

SEQ ID NO: 96537 - RNA, 22 nt, Human
ccaccagaagaagcaccaagaa

SEQ ID NO: 96538 - RNA, 32 nt, Human
ccaccagaagagcagggccagccccggucagc

SEQ ID NO: 96539 - RNA, 32 nt, Human
ccaccagaagcuccgggacuucucccgcagca

SEQ ID NO: 96540 - RNA, 32 nt, Human
ccaccagacagugccggccagcagagaagcag

SEQ ID NO: 96541 - RNA, 21 nt, Human
ccaccagacaucuucaacaga

SEQ ID NO: 96542 - RNA, 32 nt, Human
ccaccagacugcuuccugccagccugugcuug

SEQ ID NO: 96543 - RNA, 23 nt, Human
ccaccagacuuccuccuggaaaa

SEQ ID NO: 96544 - RNA, 23 nt, Human
ccaccagagaccacagcugcccc

SEQ ID NO: 96545 - RNA, 32 nt, Human
ccaccagagcccccugccagacugucugccuc

SEQ ID NO: 96546 - RNA, 32 nt, Human
ccaccagaggcagaggccaugagacugucuuu

SEQ ID NO: 96547 - RNA, 17 nt, Human
ccaccagaggccccgcg

SEQ ID NO: 96548 - RNA, 32 nt, Human
ccaccagaggcugaaguguauuuccugugcau

SEQ ID NO: 96549 - RNA, 18 nt, Human
ccaccagagggggcacag

SEQ ID NO: 96550 - RNA, 32 nt, Human
ccaccagaguccauuucaaaacccaaacgaga

SEQ ID NO: 96551 - RNA, 19 nt, Human
ccaccagaucuccauucuu

SEQ ID NO: 96552 - RNA, 32 nt, Human
ccaccagcaccaccagcaccuacccagcauuc

SEQ ID NO: 96553 - RNA, 21 nt, Human
ccaccagcaccaccagcccca

SEQ ID NO: 96554 - RNA, 21 nt, Human
ccaccagcaccacgggcucca

SEQ ID NO: 96555 - RNA, 24 nt, Human
ccaccagcacccccauagggcccc

SEQ ID NO: 96556 - RNA, 32 nt, Human
ccaccagcacugacuccugggcucugaagaau

SEQ ID NO: 96557 - RNA, 32 nt, Human
ccaccagcagccccacucacagcugcugcacc

SEQ ID NO: 96558 - RNA, 23 nt, Human
ccaccagcagccgccuugccugg

SEQ ID NO: 96559 - RNA, 18 nt, Human
ccaccagcagggggcgca

SEQ ID NO: 96560 - RNA, 32 nt, Human
ccaccagcaggugcagaggugccguugcagca

SEQ ID NO: 96561 - RNA, 32 nt, Human
ccaccagccacugcuuccuccugggcccucgg

SEQ ID NO: 96562 - RNA, 32 nt, Human
ccaccagccacugucauguuaaccccuuccca

SEQ ID NO: 96563 - RNA, 32 nt, Human
ccaccagccagcucugugauccuggccgaugg

SEQ ID NO: 96564 - RNA, 32 nt, Human
ccaccagccaggaagcggaaggugcagaaaua

SEQ ID NO: 96565 - RNA, 32 nt, Human
ccaccagccauggcagugcaucugccacagug

SEQ ID NO: 96566 - RNA, 32 nt, Human
ccaccagcccagcuaauuuuuguauuuuuagu

SEQ ID NO: 96567 - RNA, 23 nt, Human
ccaccagcccagguuaaucccca

SEQ ID NO: 96568 - RNA, 32 nt, Human
ccaccagccccagcugccaucagauucaagcc

SEQ ID NO: 96569 - RNA, 32 nt, Human
ccaccagccccagggcccuaccuccuggaaug

SEQ ID NO: 96570 - RNA, 19 nt, Human
ccaccagccccugagcccc

SEQ ID NO: 96571 - RNA, 32 nt, Human
ccaccagccccugagcccccagccccugagcc

SEQ ID NO: 96572 - RNA, 32 nt, Human
ccaccagccccuucuucuugugaaggaaaucc

SEQ ID NO: 96573 - RNA, 32 nt, Human
ccaccagcccuccaguccuucucccuccaggc

SEQ ID NO: 96574 - RNA, 32 nt, Human
ccaccagcccuggagaggaggaagggacugac

SEQ ID NO: 96575 - RNA, 32 nt, Human
ccaccagccgcacuaaccgccgaccaaccgcc

SEQ ID NO: 96576 - RNA, 20 nt, Human
ccaccagccgugccaucucu

SEQ ID NO: 96577 - RNA, 22 nt, Human
ccaccagccuaaguccagcaga

SEQ ID NO: 96578 - RNA, 32 nt, Human
ccaccagccuccaguaacugugggaaacuggc

SEQ ID NO: 96579 - RNA, 32 nt, Human
ccaccagccuccucaggaaggcgggugagguu

SEQ ID NO: 96580 - RNA, 32 nt, Human
ccaccagcgcacugccccaagcuugccuaggu

SEQ ID NO: 96581 - RNA, 20 nt, Human
ccaccagcgccccagccccg

SEQ ID NO: 96582 - RNA, 32 nt, Human
ccaccagcgccccagccccgaggcucagaagc

SEQ ID NO: 96583 - RNA, 20 nt, Human
ccaccagcggacucggcccc

SEQ ID NO: 96584 - RNA, 32 nt, Human
ccaccagcucagacagcacccaccggccccac

SEQ ID NO: 96585 - RNA, 15 nt, Human
ccaccagcuccacgc

SEQ ID NO: 96586 - RNA, 32 nt, Human
ccaccagcucguuccccuccagccuggugcug

SEQ ID NO: 96587 - RNA, 32 nt, Human
ccaccagcucuauucuuugccuuagcuuugca

SEQ ID NO: 96588 - RNA, 32 nt, Human
ccaccagcugcaggcugucaggguaucacuga

SEQ ID NO: 96589 - RNA, 24 nt, Human
ccaccagcugccaguggcucccag

SEQ ID NO: 96590 - RNA, 32 nt, Human
ccaccagcugcugcuagccucugugguuguac

SEQ ID NO: 96591 - RNA, 32 nt, Human
ccaccagcuggcacaggugcacagauucauaa

SEQ ID NO: 96592 - RNA, 32 nt, Human
ccaccagcuguguaggaaugccagcagaggcc

SEQ ID NO: 96593 - RNA, 32 nt, Human
ccaccagcuucguuccagcccaugaaggggaa

SEQ ID NO: 96594 - RNA, 22 nt, Human
ccaccagcuuuggugaacccca

SEQ ID NO: 96595 - RNA, 32 nt, Human
ccaccaggaaggcggaggacgcaggagccaag

SEQ ID NO: 96596 - RNA, 32 nt, Human
ccaccaggaagguguggcugagccccagagcc

SEQ ID NO: 96597 - RNA, 21 nt, Human
ccaccaggacagcugccaccu

SEQ ID NO: 96598 - RNA, 32 nt, Human
ccaccaggacauccugggaacucugggacuca

SEQ ID NO: 96599 - RNA, 16 nt, Human
ccaccaggaccagcug

SEQ ID NO: 96600 - RNA, 32 nt, Human
ccaccaggagaagggaccagcaccucagaugg

SEQ ID NO: 96601 - RNA, 32 nt, Human
ccaccaggcaauagacaggagagaggugagaa

SEQ ID NO: 96602 - RNA, 21 nt, Human
ccaccaggcaggaccccagga

SEQ ID NO: 96603 - RNA, 32 nt, Human
ccaccaggcccagccaaccagcauuucuuaag

SEQ ID NO: 96604 - RNA, 19 nt, Human
ccaccaggcuucuggaaaa

SEQ ID NO: 96605 - RNA, 22 nt, Human
ccaccagggaagccgggcccca

SEQ ID NO: 96606 - RNA, 32 nt, Human
ccaccagggacaccucgcccuucagcccacca

SEQ ID NO: 96607 - RNA, 23 nt, Human
ccaccagggagcagcugcccccu

SEQ ID NO: 96608 - RNA, 32 nt, Human
ccaccagggaguggggauccugagggaagggg

SEQ ID NO: 96609 - RNA, 19 nt, Human
ccaccagggcugacuuccc

SEQ ID NO: 96610 - RNA, 32 nt, Human
ccaccaggggaggugggguuuggugagagacg

SEQ ID NO: 96611 - RNA, 32 nt, Human
ccaccaggggccugaggaugaagccaagucug

SEQ ID NO: 96612 - RNA, 18 nt, Human
ccaccaggggcucugaac

SEQ ID NO: 96613 - RNA, 32 nt, Human
ccaccagggucugaggcccaaauccuuccuca

SEQ ID NO: 96614 - RNA, 32 nt, Human
ccaccagggucugaguucuagcaggguccugg

SEQ ID NO: 96615 - RNA, 32 nt, Human
ccaccaggucugaugggcaaagguuccuccuc

SEQ ID NO: 96616 - RNA, 32 nt, Human
ccaccaggugugcaggcugggaagagacaucu

SEQ ID NO: 96617 - RNA, 18 nt, Human
ccaccaguacacacgcgu

SEQ ID NO: 96618 - RNA, 32 nt, Human
ccaccaguaccaccaccacuacccacaucacc

SEQ ID NO: 96619 - RNA, 32 nt, Human
ccaccagucuucaccuccacacccucaucacc

SEQ ID NO: 96620 - RNA, 32 nt, Human
ccaccagugaugaaaauuacugugggccacuc

SEQ ID NO: 96621 - RNA, 32 nt, Human
ccaccagugugaagcagaaggaugacuuugcu

SEQ ID NO: 96622 - RNA, 32 nt, Human
ccaccaguuccccagagcagagcuggagcuga

SEQ ID NO: 96623 - RNA, 32 nt, Human
ccaccaguugguggaggcuucagggaagacca

SEQ ID NO: 96624 - RNA, 16 nt, Human
ccaccauaauccaucc

SEQ ID NO: 96625 - RNA, 19 nt, Human
ccaccauaugcucauccuu

SEQ ID NO: 96626 - RNA, 22 nt, Human
ccaccaucacacugccacccug

SEQ ID NO: 96627 - RNA, 32 nt, Human
ccaccaucacacugggguuucuggaugggaaa

SEQ ID NO: 96628 - RNA, 21 nt, Human
ccaccaucaccaccaccaugg

SEQ ID NO: 96629 - RNA, 24 nt, Human
ccaccaucaccucccucaccucgg

SEQ ID NO: 96630 - RNA, 23 nt, Human
ccaccaucacuucauuuagcugg

SEQ ID NO: 96631 - RNA, 32 nt, Human
ccaccaucacuucauuuagcugggcaacaagg

SEQ ID NO: 96632 - RNA, 20 nt, Human
ccaccaucagcccugccugg

SEQ ID NO: 96633 - RNA, 32 nt, Human
ccaccauccauccuggugaaaccagaaaacuc

SEQ ID NO: 96634 - RNA, 32 nt, Human
ccaccaucccacccuggggcccuuucagugac

SEQ ID NO: 96635 - RNA, 32 nt, Human
ccaccaucccagagaagaagugaggggcuaug

SEQ ID NO: 96636 - RNA, 32 nt, Human
ccaccauccuugucugugcuacugucugcugc

SEQ ID NO: 96637 - RNA, 24 nt, Human
ccaccaucggccgcacccaccugg

SEQ ID NO: 96638 - RNA, 32 nt, Human
ccaccaucuaagccaaggguguccaaucuuuu

SEQ ID NO: 96639 - RNA, 32 nt, Human
ccaccaucuccucugugccaacuccuugugga

SEQ ID NO: 96640 - RNA, 32 nt, Human
ccaccaucugaagauuuaggccagucccuugg

SEQ ID NO: 96641 - RNA, 22 nt, Human
ccaccaucugaugcccagccug

SEQ ID NO: 96642 - RNA, 19 nt, Human
ccaccaucugccgccaugg

SEQ ID NO: 96643 - RNA, 32 nt, Human
ccaccaucugcgacuccugccugccgccucuc

SEQ ID NO: 96644 - RNA, 32 nt, Human
ccaccaugacugagucuucucaguugacaaug

SEQ ID NO: 96645 - RNA, 30 nt, Human
ccaccaugagcaccaagcagaucacuugca

SEQ ID NO: 96646 - RNA, 32 nt, Human
ccaccaugagcacucccacaauacuggucgca

SEQ ID NO: 96647 - RNA, 30 nt, Human
ccaccaugagccucagugaggagcaggccc

SEQ ID NO: 96648 - RNA, 32 nt, Human
ccaccaugcaacuuccuuugacuuucugugua

SEQ ID NO: 96649 - RNA, 30 nt, Human
ccaccaugccacugcacuccagccugggug

SEQ ID NO: 96650 - RNA, 32 nt, Human
ccaccaugcccagccagagaugcucaauuccu

SEQ ID NO: 96651 - RNA, 21 nt, Human
ccaccaugcccagcccuggag

SEQ ID NO: 96652 - RNA, 32 nt, Human
ccaccaugcccagccuccuacccuuuucuuug

SEQ ID NO: 96653 - RNA, 32 nt, Human
ccaccaugcccagcuaauuuuguauuuuuagu

SEQ ID NO: 96654 - RNA, 32 nt, Human
ccaccaugcccagcuaauuuuguauuuuuauu

SEQ ID NO: 96655 - RNA, 32 nt, Human
ccaccaugcccggcuaauuuuguauuuuuagu

SEQ ID NO: 96656 - RNA, 32 nt, Human
ccaccaugcccguuaguuuuuguauuuuuagu

SEQ ID NO: 96657 - RNA, 32 nt, Human
ccaccaugccuggccagaaaucuauguuuucu

SEQ ID NO: 96658 - RNA, 32 nt, Human
ccaccaugccuggcuaauuuuguauauuuagu

SEQ ID NO: 96659 - RNA, 32 nt, Human
ccaccaugccuggcuaauuuuguauuucuagu

SEQ ID NO: 96660 - RNA, 32 nt, Human
ccaccaugccuggcuaauuuuguauuuuuagu

SEQ ID NO: 96661 - RNA, 32 nt, Human
ccaccaugccugucuaauuuuuguacuuuucg

SEQ ID NO: 96662 - RNA, 32 nt, Human
ccaccaugccugucugcugucccuguacucca

SEQ ID NO: 96663 - RNA, 32 nt, Human
ccaccaugccuguggccucagccacuuugugc

SEQ ID NO: 96664 - RNA, 32 nt, Human
ccaccaugccuguguuacagcagcuccaugau

SEQ ID NO: 96665 - RNA, 32 nt, Human
ccaccaugcuggcuaauuuuucaauauuuagu

SEQ ID NO: 96666 - RNA, 30 nt, Human
ccaccauggaugacaugggccugguggcca

SEQ ID NO: 96667 - RNA, 32 nt, Human
ccaccauggcacacugcuucuccagucaagga

SEQ ID NO: 96668 - RNA, 24 nt, Human
ccaccauggccagacgcccccgga

SEQ ID NO: 96669 - RNA, 21 nt, Human
ccaccauggcugcuugccugg

SEQ ID NO: 96670 - RNA, 22 nt, Human
ccaccaugggccagagcuucag

SEQ ID NO: 96671 - RNA, 20 nt, Human
ccaccauggugagaccccgu

SEQ ID NO: 96672 - RNA, 30 nt, Human
ccaccaugguguuuggugaguuuuuccauc

SEQ ID NO: 96673 - RNA, 32 nt, Human
ccaccaugucauuugaaaacaguuucaucggg

SEQ ID NO: 96674 - RNA, 30 nt, Human
ccaccaugucgagcaaaagaacaaagacca

SEQ ID NO: 96675 - RNA, 32 nt, Human
ccaccaugugccagguggcaucugccuuacug

SEQ ID NO: 96676 - RNA, 21 nt, Human
ccaccauguucaccuugccug

SEQ ID NO: 96677 - RNA, 32 nt, Human
ccaccauguugccccaccaggagcucagcucu

SEQ ID NO: 96678 - RNA, 32 nt, Human
ccaccauucccaggacucugccauguggagcc

SEQ ID NO: 96679 - RNA, 32 nt, Human
ccaccauucucaggacccucgccaugaaagcc

SEQ ID NO: 96680 - RNA, 32 nt, Human
ccaccauugcacuccagccugggcaacagagu

SEQ ID NO: 96681 - RNA, 32 nt, Human
ccaccauugcacuccaguccgggaaacaagaa

SEQ ID NO: 96682 - RNA, 32 nt, Human
ccaccauugcacuccagucugggcaacagagc

SEQ ID NO: 96683 - RNA, 32 nt, Human
ccaccauugggcacugccaugcagagacgugg

SEQ ID NO: 96684 - RNA, 32 nt, Human
ccaccauuuauaauuaauucaggccccacuuc

SEQ ID NO: 96685 - RNA, 21 nt, Human
ccaccauuucuccucaccugg

SEQ ID NO: 96686 - RNA, 32 nt, Human
ccaccauuuucagcauggagcuucugggaucu

SEQ ID NO: 96687 - RNA, 32 nt, Human
ccaccauuuugggcugacaucaccauagcauc

SEQ ID NO: 96688 - RNA, 32 nt, Human
ccacccaaaccccagacugagauacugcuccc

SEQ ID NO: 96689 - RNA, 32 nt, Human
ccacccaaagugcuaggauuacagguaugagc

SEQ ID NO: 96690 - RNA, 32 nt, Human
ccacccaaagugcuaggguuacaggcaugagc

SEQ ID NO: 96691 - RNA, 32 nt, Human
ccacccaaagugcugggauuacaggcgugaac

SEQ ID NO: 96692 - RNA, 32 nt, Human
ccacccaaaguguugggauuacaggcaugagc

SEQ ID NO: 96693 - RNA, 32 nt, Human
ccacccaaaguguugggauuauaggcaugagc

SEQ ID NO: 96694 - RNA, 19 nt, Human
ccacccaaauccagaggaa

SEQ ID NO: 96695 - RNA, 32 nt, Human
ccacccaaccaggcucagguuggggguccugg

SEQ ID NO: 96696 - RNA, 32 nt, Human
ccacccaacccccacccugccucuauccuaag

SEQ ID NO: 96697 - RNA, 32 nt, Human
ccacccaagagcaaccuggaacuaaguuauuc

SEQ ID NO: 96698 - RNA, 22 nt, Human
ccacccaagaucuuaucagaga

SEQ ID NO: 96699 - RNA, 23 nt, Human
ccacccaagcuggagugcagugg

SEQ ID NO: 96700 - RNA, 17 nt, Human
ccacccaaggagcagcc

SEQ ID NO: 96701 - RNA, 32 nt, Human
ccacccaaguagcuggaauuacaggcaccugc

SEQ ID NO: 96702 - RNA, 31 nt, Human
ccacccaagugccaagacacagcagggccaa

SEQ ID NO: 96703 - RNA, 18 nt, Human
ccacccaaguggcuggga

SEQ ID NO: 96704 - RNA, 32 nt, Human
ccacccaaguuaggccugcucuggccuaaugg

SEQ ID NO: 96705 - RNA, 24 nt, Human
ccacccacacagcagccuccagga

SEQ ID NO: 96706 - RNA, 32 nt, Human
ccacccacacucaaccucccucugaccucaua

SEQ ID NO: 96707 - RNA, 32 nt, Human
ccacccacagccgcagccaugcugugccuccu

SEQ ID NO: 96708 - RNA, 32 nt, Human
ccacccacaggcucccuggccugggugcugua

SEQ ID NO: 96709 - RNA, 32 nt, Human
ccacccacagugcugcacuccuccugccccug

SEQ ID NO: 96710 - RNA, 32 nt, Human
ccacccaccagaggaguucugguccccaaacc

SEQ ID NO: 96711 - RNA, 32 nt, Human
ccacccacccccagaacaggcagagacagggc

SEQ ID NO: 96712 - RNA, 32 nt, Human
ccacccacccgcaaccuccuuccccgagccuu

SEQ ID NO: 96713 - RNA, 32 nt, Human
ccacccacccgcugcuugccccaucuauuuau

SEQ ID NO: 96714 - RNA, 18 nt, Human
ccacccacccggcuccca

SEQ ID NO: 96715 - RNA, 32 nt, Human
ccacccacccucucucugaucucccccuuccu

SEQ ID NO: 96716 - RNA, 21 nt, Human
ccacccaccgccgccgccgcc

SEQ ID NO: 96717 - RNA, 32 nt, Human
ccacccaccuccuccaucacuggaccagcuca

SEQ ID NO: 96718 - RNA, 24 nt, Human
ccacccaccucgcgguccccagga

SEQ ID NO: 96719 - RNA, 23 nt, Human
ccacccaccugagcccagcuaga

SEQ ID NO: 96720 - RNA, 32 nt, Human
ccacccaccugccccauguccacugggcugcc

SEQ ID NO: 96721 - RNA, 32 nt, Human
ccacccaccuucuugcucuaccaguucgcgcu

SEQ ID NO: 96722 - RNA, 21 nt, Human
ccacccacggaaucgagaaag

SEQ ID NO: 96723 - RNA, 21 nt, Human
ccacccacgggugucccugcc

SEQ ID NO: 96724 - RNA, 32 nt, Human
ccacccacucgagggcugcccccucuuccuua

SEQ ID NO: 96725 - RNA, 32 nt, Human
ccacccacucuucugcacuucuugcaagguaa

SEQ ID NO: 96726 - RNA, 32 nt, Human
ccacccacugccucccucuggccugggagagc

SEQ ID NO: 96727 - RNA, 32 nt, Human
ccacccacugcgccuggcugggugccggccac

SEQ ID NO: 96728 - RNA, 32 nt, Human
ccacccacuuauggaaccucaggagaggaggg

SEQ ID NO: 96729 - RNA, 32 nt, Human
ccacccagaaauaaaaggacacucugaguuau

SEQ ID NO: 96730 - RNA, 32 nt, Human
ccacccagaaggcuuucauuuguacucugcug

SEQ ID NO: 96731 - RNA, 32 nt, Human
ccacccagaccacccuuuaccucgaguccuua

SEQ ID NO: 96732 - RNA, 32 nt, Human
ccacccagaccccaaaaauaaauggauccaug

SEQ ID NO: 96733 - RNA, 32 nt, Human
ccacccagaccugccaaccacucccgcggccc

SEQ ID NO: 96734 - RNA, 32 nt, Human
ccacccagacguccccaccgagcccagcacgg

SEQ ID NO: 96735 - RNA, 32 nt, Human
ccacccagacugaagugcaguggugcgaucuc

SEQ ID NO: 96736 - RNA, 32 nt, Human
ccacccagagcucagacccaagggagggugga

SEQ ID NO: 96737 - RNA, 32 nt, Human
ccacccagagcugggccagggaggacacgcuc

SEQ ID NO: 96738 - RNA, 32 nt, Human
ccacccagaggacgcuguuccaccuccuaaaa

SEQ ID NO: 96739 - RNA, 32 nt, Human
ccacccagcaaagaacuggcacaauugguuug

SEQ ID NO: 96740 - RNA, 32 nt, Human
ccacccagcaggcagaguggcguggccucccc

SEQ ID NO: 96741 - RNA, 32 nt, Human
ccacccagcaggccugagccccucucugcugc

SEQ ID NO: 96742 - RNA, 19 nt, Human
ccacccagccagggcacuc

SEQ ID NO: 96743 - RNA, 32 nt, Human
ccacccagccagugacucuguccucuguacag

SEQ ID NO: 96744 - RNA, 32 nt, Human
ccacccagcccagcuucuuuccauuccuugau

SEQ ID NO: 96745 - RNA, 32 nt, Human
ccacccagcccccucuggaguugccguuguug

SEQ ID NO: 96746 - RNA, 17 nt, Human
ccacccagccccugugg

SEQ ID NO: 96747 - RNA, 32 nt, Human
ccacccagcccgcuccugacccuuaucuuccc

SEQ ID NO: 96748 - RNA, 32 nt, Human
ccacccagccuacccccgggagcccagagccc

SEQ ID NO: 96749 - RNA, 32 nt, Human
ccacccagccugggauaggggcagaggaggcg

SEQ ID NO: 96750 - RNA, 32 nt, Human
ccacccagccuucucuuuauuuucagugcuuu

SEQ ID NO: 96751 - RNA, 21 nt, Human
ccacccagcggcugccuggga

SEQ ID NO: 96752 - RNA, 32 nt, Human
ccacccagcgucuccccugcugcuguccacgu

SEQ ID NO: 96753 - RNA, 32 nt, Human
ccacccagcuacuggggaggcugagucaggag

SEQ ID NO: 96754 - RNA, 22 nt, Human
ccacccagcucugcccaugccu

SEQ ID NO: 96755 - RNA, 32 nt, Human
ccacccagcugcccagccuuugcccacucggg

SEQ ID NO: 96756 - RNA, 32 nt, Human
ccacccagcugccucugugcccuggccucuuu

SEQ ID NO: 96757 - RNA, 18 nt, Human
ccacccagcugccugcca

SEQ ID NO: 96758 - RNA, 32 nt, Human
ccacccagcuuuuuggaaaaagcuccaacugg

SEQ ID NO: 96759 - RNA, 23 nt, Human
ccacccaggaaccucgccaucca

SEQ ID NO: 96760 - RNA, 32 nt, Human
ccacccaggaagcacaugcacaacugacccau

SEQ ID NO: 96761 - RNA, 32 nt, Human
ccacccaggaaggaagcacagagcugggggcu

SEQ ID NO: 96762 - RNA, 32 nt, Human
ccacccaggacacuggugugaaugacacaaca

SEQ ID NO: 96763 - RNA, 32 nt, Human
ccacccaggaccuagugcaugccagcagcuau

SEQ ID NO: 96764 - RNA, 32 nt, Human
ccacccaggcagcagccacagcggggagugcg

SEQ ID NO: 96765 - RNA, 32 nt, Human
ccacccaggcuaaggauuugaggguucugaca

SEQ ID NO: 96766 - RNA, 23 nt, Human
ccacccaggcuggaguacagugg

SEQ ID NO: 96767 - RNA, 32 nt, Human
ccacccaggcuggaguccaguggcgugaucau

SEQ ID NO: 96768 - RNA, 32 nt, Human
ccacccaggcuggagugcaguggugcaaucuu

SEQ ID NO: 96769 - RNA, 32 nt, Human
ccacccaggcuggagugcaguggugugaucuc

SEQ ID NO: 96770 - RNA, 32 nt, Human
ccacccagggagaguccauuaagccuucccug

SEQ ID NO: 96771 - RNA, 32 nt, Human
ccacccagggagugcuugcagacucugcauag

SEQ ID NO: 96772 - RNA, 32 nt, Human
ccacccagggauggcggggaucagggccagcc

SEQ ID NO: 96773 - RNA, 32 nt, Human
ccacccaggggcccuggguguggaugccagug

SEQ ID NO: 96774 - RNA, 20 nt, Human
ccacccaguccauucacccu

SEQ ID NO: 96775 - RNA, 21 nt, Human
ccacccagucugccccugguc

SEQ ID NO: 96776 - RNA, 19 nt, Human
ccacccagugacaugagga

SEQ ID NO: 96777 - RNA, 20 nt, Human
ccacccagugacuggcaggg

SEQ ID NO: 96778 - RNA, 25 nt, Human
ccacccagugcuucugcccaugccu

SEQ ID NO: 96779 - RNA, 32 nt, Human
ccacccaguggccaggaugacaaggcagagga

SEQ ID NO: 96780 - RNA, 21 nt, Human
ccacccaguuuguggaagcac

SEQ ID NO: 96781 - RNA, 21 nt, Human
ccacccauagcccugcugcug

SEQ ID NO: 96782 - RNA, 24 nt, Human
ccacccauaggcccuguccauacc

SEQ ID NO: 96783 - RNA, 21 nt, Human
ccacccaucaaaucagagaga

SEQ ID NO: 96784 - RNA, 17 nt, Human
ccacccauccauaaucc

SEQ ID NO: 96785 - RNA, 22 nt, Human
ccacccauccaugccagcacuu

SEQ ID NO: 96786 - RNA, 18 nt, Human
ccacccauccgucccucc

SEQ ID NO: 96787 - RNA, 22 nt, Human
ccacccauccuuugccuuaucu

SEQ ID NO: 96788 - RNA, 18 nt, Human
ccacccaucuguccaucc

SEQ ID NO: 96789 - RNA, 32 nt, Human
ccacccaugccuggcuaauuuuuguacuuuuu

SEQ ID NO: 96790 - RNA, 32 nt, Human
ccacccaugccuuuuaguagagacgggguuuc

SEQ ID NO: 96791 - RNA, 23 nt, Human
ccacccauugaguacugcugcua

SEQ ID NO: 96792 - RNA, 26 nt, Human
ccaccccaaaagcagcuccaacagaa

SEQ ID NO: 96793 - RNA, 20 nt, Human
ccaccccaaauuaaaauguu

SEQ ID NO: 96794 - RNA, 25 nt, Human
ccaccccaacaugcucagggaggca

SEQ ID NO: 96795 - RNA, 20 nt, Human
ccaccccaaccugcucaggc

SEQ ID NO: 96796 - RNA, 32 nt, Human
ccaccccaacuaccaccucuuuucaggcacag

SEQ ID NO: 96797 - RNA, 18 nt, Human
ccaccccaacucaguguc

SEQ ID NO: 96798 - RNA, 18 nt, Human
ccaccccaacugcagguc

SEQ ID NO: 96799 - RNA, 32 nt, Human
ccaccccacaauuccuccucuggccacaucuc

SEQ ID NO: 96800 - RNA, 32 nt, Human
ccaccccacaccaucacuccccucccuugcug

SEQ ID NO: 96801 - RNA, 22 nt, Human
ccaccccacacccuguguccau

SEQ ID NO: 96802 - RNA, 32 nt, Human
ccaccccacagcuuagguuuuucugucauccu

SEQ ID NO: 96803 - RNA, 32 nt, Human
ccaccccacaggcccuuuccuggaccauggag

SEQ ID NO: 96804 - RNA, 17 nt, Human
ccaccccaccaaagugu

SEQ ID NO: 96805 - RNA, 20 nt, Human
ccaccccaccaaguguacug

SEQ ID NO: 96806 - RNA, 32 nt, Human
ccaccccacccaaggaagcccagcacagacca

SEQ ID NO: 96807 - RNA, 21 nt, Human
ccaccccaccccaccccagga

SEQ ID NO: 96808 - RNA, 32 nt, Human
ccaccccaccccucccucagaaacucggacug

SEQ ID NO: 96809 - RNA, 17 nt, Human
ccaccccacccucaggu

SEQ ID NO: 96810 - RNA, 32 nt, Human
ccaccccacccugugagaaccugcagcccccu

SEQ ID NO: 96811 - RNA, 22 nt, Human
ccaccccaccucccucacuuca

SEQ ID NO: 96812 - RNA, 20 nt, Human
ccaccccaccuucugcccuc

SEQ ID NO: 96813 - RNA, 32 nt, Human
ccaccccacugucgugguggccccagaucucu

SEQ ID NO: 96814 - RNA, 32 nt, Human
ccaccccacuugcugccagccugucagugacc

SEQ ID NO: 96815 - RNA, 25 nt, Human
ccaccccacuugguggccuccagga

SEQ ID NO: 96816 - RNA, 32 nt, Human
ccaccccagaugcaggagucacccagcuuccu

SEQ ID NO: 96817 - RNA, 21 nt, Human
ccaccccagccagcagcagca

SEQ ID NO: 96818 - RNA, 21 nt, Human
ccaccccagccagggcucccu

SEQ ID NO: 96819 - RNA, 24 nt, Human
ccaccccagccaggugucccuccu

SEQ ID NO: 96820 - RNA, 21 nt, Human
ccaccccagccccacugcccu

SEQ ID NO: 96821 - RNA, 28 nt, Human
ccaccccagcccccucacccuccucccu

SEQ ID NO: 96822 - RNA, 22 nt, Human
ccaccccagcccgccaacuagu

SEQ ID NO: 96823 - RNA, 32 nt, Human
ccaccccagcccuacacagcagucuggccuga

SEQ ID NO: 96824 - RNA, 19 nt, Human
ccaccccagcccucugguc

SEQ ID NO: 96825 - RNA, 22 nt, Human
ccaccccagccucagaucuccc

SEQ ID NO: 96826 - RNA, 19 nt, Human
ccaccccagccucccaggu

SEQ ID NO: 96827 - RNA, 21 nt, Human
ccaccccagccucgccuuccc

SEQ ID NO: 96828 - RNA, 21 nt, Human
ccaccccagccucuguucccc

SEQ ID NO: 96829 - RNA, 23 nt, Human
ccaccccagccugccugcugccu

SEQ ID NO: 96830 - RNA, 21 nt, Human
ccaccccagccuggggucucu

SEQ ID NO: 96831 - RNA, 23 nt, Human
ccaccccagccuucugcccgccc

SEQ ID NO: 96832 - RNA, 21 nt, Human
ccaccccagcucaugcccccu

SEQ ID NO: 96833 - RNA, 24 nt, Human
ccaccccagcucccacccugcccu

SEQ ID NO: 96834 - RNA, 23 nt, Human
ccaccccagcugcuccccucccu

SEQ ID NO: 96835 - RNA, 19 nt, Human
ccaccccaggcaccuguga

SEQ ID NO: 96836 - RNA, 32 nt, Human
ccaccccaggguggauccaggauggaucucug

SEQ ID NO: 96837 - RNA, 23 nt, Human
ccaccccaggucucagccucccu

SEQ ID NO: 96838 - RNA, 22 nt, Human
ccaccccagucccaaauccagu

SEQ ID NO: 96839 - RNA, 19 nt, Human
ccaccccagugcccacagg

SEQ ID NO: 96840 - RNA, 32 nt, Human
ccaccccaguggguaugucugaggucagccau

SEQ ID NO: 96841 - RNA, 32 nt, Human
ccaccccauaauuucucccagagaccaucuau

SEQ ID NO: 96842 - RNA, 32 nt, Human
ccaccccaucaggucagcucaggcuggagcag

SEQ ID NO: 96843 - RNA, 32 nt, Human
ccaccccauccucuaccugccacaccucagag

SEQ ID NO: 96844 - RNA, 32 nt, Human
ccaccccaucugcauuguggcugcagcacugg

SEQ ID NO: 96845 - RNA, 22 nt, Human
ccaccccaucugccuucagguc

SEQ ID NO: 96846 - RNA, 32 nt, Human
ccaccccaugucaccggauccuggguggucug

SEQ ID NO: 96847 - RNA, 32 nt, Human
ccaccccauuacuguaccucuggagucacuac

SEQ ID NO: 96848 - RNA, 32 nt, Human
ccaccccauucucugcuaccacauaucguagc

SEQ ID NO: 96849 - RNA, 20 nt, Human
ccaccccauuguccauccuu

SEQ ID NO: 96850 - RNA, 32 nt, Human
ccaccccauuuccagguuggcagcccuagccc

SEQ ID NO: 96851 - RNA, 23 nt, Human
ccacccccaacccagacccccag

SEQ ID NO: 96852 - RNA, 20 nt, Human
ccacccccaacccucagguc

SEQ ID NO: 96853 - RNA, 28 nt, Human
ccacccccaagugcaugucuccaucacu

SEQ ID NO: 96854 - RNA, 28 nt, Human
ccacccccaagugccgacuuguuucucc

SEQ ID NO: 96855 - RNA, 20 nt, Human
ccacccccaagugcucccca

SEQ ID NO: 96856 - RNA, 32 nt, Human
ccacccccaccaaacccaaaacaaacaagaaa

SEQ ID NO: 96857 - RNA, 19 nt, Human
ccacccccaccagccccag

SEQ ID NO: 96858 - RNA, 21 nt, Human
ccacccccacccagccuccag

SEQ ID NO: 96859 - RNA, 22 nt, Human
ccacccccacccaucugggccc

SEQ ID NO: 96860 - RNA, 24 nt, Human
ccacccccacccuacagccccagg

SEQ ID NO: 96861 - RNA, 21 nt, Human
ccacccccaccuucgcucaga

SEQ ID NO: 96862 - RNA, 32 nt, Human
ccacccccagccccacaguuuauuaaauguuu

SEQ ID NO: 96863 - RNA, 32 nt, Human
ccacccccagcccuagcauaggaaaagcuucc

SEQ ID NO: 96864 - RNA, 32 nt, Human
ccacccccagcugaccagggaggcagaggaca

SEQ ID NO: 96865 - RNA, 32 nt, Human
ccacccccaggccuccuaggggaagggggugc

SEQ ID NO: 96866 - RNA, 32 nt, Human
ccacccccaggucacaaaucagcagcuccacu

SEQ ID NO: 96867 - RNA, 24 nt, Human
ccacccccaggugcagccccaggg

SEQ ID NO: 96868 - RNA, 32 nt, Human
ccacccccaguugacaucaagccucggcagcc

SEQ ID NO: 96869 - RNA, 32 nt, Human
ccacccccaucuccaccccaucauguuuacag

SEQ ID NO: 96870 - RNA, 22 nt, Human
ccaccccccaacuuuccucccu

SEQ ID NO: 96871 - RNA, 22 nt, Human
ccaccccccaccacugcccccu

SEQ ID NO: 96872 - RNA, 21 nt, Human
ccaccccccaccuccaugccu

SEQ ID NO: 96873 - RNA, 24 nt, Human
ccaccccccaucacacgugcuccu

SEQ ID NO: 96874 - RNA, 22 nt, Human
ccaccccccgccagcccgagga

SEQ ID NO: 96875 - RNA, 17 nt, Human
ccaccccccuccauccu

SEQ ID NO: 96876 - RNA, 23 nt, Human
ccaccccccuccaucuguuccca

SEQ ID NO: 96877 - RNA, 16 nt, Human
ccacccccgccucagg

SEQ ID NO: 96878 - RNA, 32 nt, Human
ccacccccgcuaccuuucccagccucugguaa

SEQ ID NO: 96879 - RNA, 18 nt, Human
ccacccccggccccaggg

SEQ ID NO: 96880 - RNA, 32 nt, Human
ccacccccgugcagaggcagcugguggacauc

SEQ ID NO: 96881 - RNA, 19 nt, Human
ccacccccucaagccccag

SEQ ID NO: 96882 - RNA, 32 nt, Human
ccacccccucagcagggccggagaccuagaug

SEQ ID NO: 96883 - RNA, 32 nt, Human
ccacccccucauuccucccucgccuucacccc

SEQ ID NO: 96884 - RNA, 32 nt, Human
ccacccccuccccacuagcucgaucuaguaua

SEQ ID NO: 96885 - RNA, 32 nt, Human
ccacccccucccccgacccuuuuccccucccc

SEQ ID NO: 96886 - RNA, 32 nt, Human
ccacccccucccccugucucccucucugaacc

SEQ ID NO: 96887 - RNA, 32 nt, Human
ccacccccuccccucaccgccucccagguggc

SEQ ID NO: 96888 - RNA, 21 nt, Human
ccacccccuccguccugcccu

SEQ ID NO: 96889 - RNA, 19 nt, Human
ccacccccuccugcuccug

SEQ ID NO: 96890 - RNA, 32 nt, Human
ccacccccugccaacuacucagucccacccaa

SEQ ID NO: 96891 - RNA, 24 nt, Human
ccacccccugccccagacccagga

SEQ ID NO: 96892 - RNA, 32 nt, Human
ccacccccugcccucugcugccauaaucacac

SEQ ID NO: 96893 - RNA, 32 nt, Human
ccacccccugccugcccagccugggcccugca

SEQ ID NO: 96894 - RNA, 32 nt, Human
ccacccccugcucccgcccaccugaccccugc

SEQ ID NO: 96895 - RNA, 32 nt, Human
ccacccccugcucuugccagcuggccccugcu

SEQ ID NO: 96896 - RNA, 21 nt, Human
ccacccccuucaucggcugcc

SEQ ID NO: 96897 - RNA, 19 nt, Human
ccacccccuuccaccucca

SEQ ID NO: 96898 - RNA, 26 nt, Human
ccacccccuucccuuuaauccugcca

SEQ ID NO: 96899 - RNA, 32 nt, Human
ccacccccuuccuggcagccagugccaaacag

SEQ ID NO: 96900 - RNA, 20 nt, Human
ccacccccuucucugcucca

SEQ ID NO: 96901 - RNA, 32 nt, Human
ccacccccuugagcaagaaugccauccccucu

SEQ ID NO: 96902 - RNA, 32 nt, Human
ccaccccgacuucguaaguccuggagaacucc

SEQ ID NO: 96903 - RNA, 32 nt, Human
ccaccccgaggaccuucaggcugcaaaccggu

SEQ ID NO: 96904 - RNA, 32 nt, Human
ccaccccgcgcaggccacugagacggugggac

SEQ ID NO: 96905 - RNA, 32 nt, Human
ccaccccgcgcucccugaacugcugugcgucg

SEQ ID NO: 96906 - RNA, 18 nt, Human
ccaccccgcgcuguccau

SEQ ID NO: 96907 - RNA, 32 nt, Human
ccaccccgcugaggcccagagcucgggagaug

SEQ ID NO: 96908 - RNA, 25 nt, Human
ccaccccggccgcuggaagcagggg

SEQ ID NO: 96909 - RNA, 25 nt, Human
ccaccccggcgcugccgucccgccc

SEQ ID NO: 96910 - RNA, 22 nt, Human
ccaccccgguuccacccaaguc

SEQ ID NO: 96911 - RNA, 32 nt, Human
ccaccccgucggucaccuuuucagcgcagguc

SEQ ID NO: 96912 - RNA, 22 nt, Human
ccaccccguuagcuguccuccu

SEQ ID NO: 96913 - RNA, 32 nt, Human
ccaccccguucccuccccagcuuccugcccaa

SEQ ID NO: 96914 - RNA, 21 nt, Human
ccaccccguucuggccucccu

SEQ ID NO: 96915 - RNA, 32 nt, Human
ccaccccuagccaccaguguccuccaagugcc

SEQ ID NO: 96916 - RNA, 21 nt, Human
ccaccccuagucugcccuccc

SEQ ID NO: 96917 - RNA, 31 nt, Human
ccaccccucaauaagauuuggugaauuguaa

SEQ ID NO: 96918 - RNA, 32 nt, Human
ccaccccucacacagccaaaccccagaucauc

SEQ ID NO: 96919 - RNA, 21 nt, Human
ccaccccucacagccccaggg

SEQ ID NO: 96920 - RNA, 32 nt, Human
ccaccccucaccccagcugccugcugcuucug

SEQ ID NO: 96921 - RNA, 32 nt, Human
ccaccccucacucaggucguguuuucaggagc

SEQ ID NO: 96922 - RNA, 32 nt, Human
ccaccccucacuccacccugagggccccaucc

SEQ ID NO: 96923 - RNA, 32 nt, Human
ccaccccucacugcaaaagcaucuccuuaagu

SEQ ID NO: 96924 - RNA, 32 nt, Human
ccaccccucaucucaaaugagaggagcagaag

SEQ ID NO: 96925 - RNA, 32 nt, Human
ccaccccuccacccccacccccaagugccuuc

SEQ ID NO: 96926 - RNA, 32 nt, Human
ccaccccuccaggacagucccucucuguggag

SEQ ID NO: 96927 - RNA, 32 nt, Human
ccaccccucccaggacaccuggcugagccgga

SEQ ID NO: 96928 - RNA, 32 nt, Human
ccaccccucccccugucugccugcccucccca

SEQ ID NO: 96929 - RNA, 22 nt, Human
ccaccccucccuccuugcuucc

SEQ ID NO: 96930 - RNA, 32 nt, Human
ccaccccuccuggaccuagccacccagccugu

SEQ ID NO: 96931 - RNA, 32 nt, Human
ccaccccuccuggucuguauccugggccucag

SEQ ID NO: 96932 - RNA, 32 nt, Human
ccaccccuccugugugucagagcuaggguggg

SEQ ID NO: 96933 - RNA, 24 nt, Human
ccaccccuccuuuuucgguuuccu

SEQ ID NO: 96934 - RNA, 32 nt, Human
ccaccccucggccauucccuccaccuccaaga

SEQ ID NO: 96935 - RNA, 32 nt, Human
ccaccccucuacuccucacccucagcacaacg

SEQ ID NO: 96936 - RNA, 32 nt, Human
ccaccccucuacugcucuccauggagaauccg

SEQ ID NO: 96937 - RNA, 32 nt, Human
ccaccccucucccauuauccuuuagcuuuagg

SEQ ID NO: 96938 - RNA, 32 nt, Human
ccaccccucugcggacucugcagcuccgcggc

SEQ ID NO: 96939 - RNA, 32 nt, Human
ccaccccugcacagcagcugggcacagaggag

SEQ ID NO: 96940 - RNA, 32 nt, Human
ccaccccugcaggacaugcucugccugggagg

SEQ ID NO: 96941 - RNA, 23 nt, Human
ccaccccugccccagccucagga

SEQ ID NO: 96942 - RNA, 23 nt, Human
ccaccccugccccagcuccagga

SEQ ID NO: 96943 - RNA, 19 nt, Human
ccaccccugccccuuggaa

SEQ ID NO: 96944 - RNA, 32 nt, Human
ccaccccugccccuuuuccuuccagguucugu

SEQ ID NO: 96945 - RNA, 32 nt, Human
ccaccccugccggucagccugccugugcgugg

SEQ ID NO: 96946 - RNA, 32 nt, Human
ccaccccugccucuccuccacccgcccaggag

SEQ ID NO: 96947 - RNA, 32 nt, Human
ccaccccugccugccugcccggcccugcacaa

SEQ ID NO: 96948 - RNA, 32 nt, Human
ccaccccugccugccuuguuugauuuggcucu

SEQ ID NO: 96949 - RNA, 32 nt, Human
ccaccccugggaugcgaagccagcaagcuuuu

SEQ ID NO: 96950 - RNA, 19 nt, Human
ccaccccugggccuuucca

SEQ ID NO: 96951 - RNA, 18 nt, Human
ccaccccugggcugcaga

SEQ ID NO: 96952 - RNA, 32 nt, Human
ccaccccugggugucaguccaaaugacuguau

SEQ ID NO: 96953 - RNA, 25 nt, Human
ccaccccugugccucgucgagcccc

SEQ ID NO: 96954 - RNA, 21 nt, Human
ccaccccuguuacccccagga

SEQ ID NO: 96955 - RNA, 32 nt, Human
ccaccccuuccaguuaagaccugccuagcaga

SEQ ID NO: 96956 - RNA, 22 nt, Human
ccaccccuucgacaugcugcca

SEQ ID NO: 96957 - RNA, 18 nt, Human
ccaccccuugacaacuuu

SEQ ID NO: 96958 - RNA, 19 nt, Human
ccaccccuugcuccagguc

SEQ ID NO: 96959 - RNA, 32 nt, Human
ccaccccuuggaggagagagaccccgcacccg

SEQ ID NO: 96960 - RNA, 32 nt, Human
ccacccgaagccccuguugcaagugaggacaa

SEQ ID NO: 96961 - RNA, 32 nt, Human
ccacccgacccaguauugcaggccagcaggcc

SEQ ID NO: 96962 - RNA, 32 nt, Human
ccacccgacucggccucccaaagugcugggau

SEQ ID NO: 96963 - RNA, 32 nt, Human
ccacccgagagaggguugaggagcaggcuggg

SEQ ID NO: 96964 - RNA, 32 nt, Human
ccacccgaggcgccaccccacccuuugagagc

SEQ ID NO: 96965 - RNA, 32 nt, Human
ccacccgaguagcugagauuacaggccucugc

SEQ ID NO: 96966 - RNA, 17 nt, Human
ccacccgcaccuugccu

SEQ ID NO: 96967 - RNA, 22 nt, Human
ccacccgcccaccgccacuauc

SEQ ID NO: 96968 - RNA, 21 nt, Human
ccacccgccccgccggcccca

SEQ ID NO: 96969 - RNA, 32 nt, Human
ccacccgccccucugggccugccuguggcucu

SEQ ID NO: 96970 - RNA, 32 nt, Human
ccacccgccucagucucccaaagugcugagau

SEQ ID NO: 96971 - RNA, 32 nt, Human
ccacccgccuccgccucccaaagugcugggau

SEQ ID NO: 96972 - RNA, 32 nt, Human
ccacccgccucggccuuuauuuacuuauuuuu

SEQ ID NO: 96973 - RNA, 32 nt, Human
ccacccgccucggucucccaaagugcugggau

SEQ ID NO: 96974 - RNA, 32 nt, Human
ccacccgccugugcuugccucccagguacccc

SEQ ID NO: 96975 - RNA, 19 nt, Human
ccacccgccuuaggacucc

SEQ ID NO: 96976 - RNA, 22 nt, Human
ccacccgcgcgcacgggccguc

SEQ ID NO: 96977 - RNA, 21 nt, Human
ccacccgcuucuguggaccau

SEQ ID NO: 96978 - RNA, 32 nt, Human
ccacccggccggcagagagagccuggauacga

SEQ ID NO: 96979 - RNA, 32 nt, Human
ccacccgggagcugaggaggggugggggccgu

SEQ ID NO: 96980 - RNA, 19 nt, Human
ccacccggguccugugcug

SEQ ID NO: 96981 - RNA, 32 nt, Human
ccacccgggucugcaaggucagugaccuucau

SEQ ID NO: 96982 - RNA, 32 nt, Human
ccacccggguuuaguucagccauuucaagaag

SEQ ID NO: 96983 - RNA, 32 nt, Human
ccacccggucgcauucuuugacaugcagauug

SEQ ID NO: 96984 - RNA, 32 nt, Human
ccacccgguggggcccuuggccccagaggacc

SEQ ID NO: 96985 - RNA, 18 nt, Human
ccacccgucaccaccucc

SEQ ID NO: 96986 - RNA, 32 nt, Human
ccacccgucacuuagccccugccuccuucccc

SEQ ID NO: 96987 - RNA, 32 nt, Human
ccacccguguuccuuggcucauggcccccucc

SEQ ID NO: 96988 - RNA, 20 nt, Human
ccacccuacagccccagguc

SEQ ID NO: 96989 - RNA, 32 nt, Human
ccacccuaccccagacacacccucucuccucg

SEQ ID NO: 96990 - RNA, 32 nt, Human
ccacccuaccugcccugccugccugcugcccc

SEQ ID NO: 96991 - RNA, 26 nt, Human
ccacccuacucaccgcucuccucccu

SEQ ID NO: 96992 - RNA, 19 nt, Human
ccacccuaucuaaaguguu

SEQ ID NO: 96993 - RNA, 32 nt, Human
ccacccuaucuucacuggcuucaccuucuccu

SEQ ID NO: 96994 - RNA, 32 nt, Human
ccacccucaaagcauuaauagccaguuggaga

SEQ ID NO: 96995 - RNA, 32 nt, Human
ccacccucaaagccgucugcccaggccccauc

SEQ ID NO: 96996 - RNA, 32 nt, Human
ccacccucacaaggagcugccauccuguuugg

SEQ ID NO: 96997 - RNA, 32 nt, Human
ccacccucacuguccuccagcccaggaugggc

SEQ ID NO: 96998 - RNA, 19 nt, Human
ccacccucagccagagcca

SEQ ID NO: 96999 - RNA, 32 nt, Human
ccacccucagcccugugacuggaaugugugcc

SEQ ID NO: 97000 - RNA, 25 nt, Human
ccacccucagcucuuccuugccugg

SEQ ID NO: 97001 - RNA, 19 nt, Human
ccacccucagcuucucuca

SEQ ID NO: 97002 - RNA, 32 nt, Human
ccacccucaucucucuacccuaccccucccau

SEQ ID NO: 97003 - RNA, 32 nt, Human
ccacccuccaccugcccagaggccaacucugu

SEQ ID NO: 97004 - RNA, 32 nt, Human
ccacccuccacucccuuccuuguguucuccuu

SEQ ID NO: 97005 - RNA, 32 nt, Human
ccacccuccagcccaggacucucucugccccu

SEQ ID NO: 97006 - RNA, 32 nt, Human
ccacccuccauuccuccuccccugggccucuc

SEQ ID NO: 97007 - RNA, 17 nt, Human
ccacccucccacugcca

SEQ ID NO: 97008 - RNA, 32 nt, Human
ccacccucccccaacagcagggaugggucagg

SEQ ID NO: 97009 - RNA, 32 nt, Human
ccacccuccccucccaacccacggccaggagc

SEQ ID NO: 97010 - RNA, 32 nt, Human
ccacccucccgaguagcugggauuacaggcgc

SEQ ID NO: 97011 - RNA, 22 nt, Human
ccacccucccuccccacugcug

SEQ ID NO: 97012 - RNA, 32 nt, Human
ccacccucccucucccccucugccccacaucu

SEQ ID NO: 97013 - RNA, 32 nt, Human
ccacccuccgccccacuccagccagugugggg

SEQ ID NO: 97014 - RNA, 21 nt, Human
ccacccuccgccgcccgggcc

SEQ ID NO: 97015 - RNA, 32 nt, Human
ccacccuccuacagcuaggaggaacuaccacu

SEQ ID NO: 97016 - RNA, 32 nt, Human
ccacccuccuuuccuuccucccucgcuccacu

SEQ ID NO: 97017 - RNA, 32 nt, Human
ccacccuccuuuuucagccucugcauaaggcc

SEQ ID NO: 97018 - RNA, 19 nt, Human
ccacccucgcuccaucuuu

SEQ ID NO: 97019 - RNA, 32 nt, Human
ccacccucggcccucccugucacugcagggca

SEQ ID NO: 97020 - RNA, 32 nt, Human
ccacccucgugggucuccuccguccagggccg

SEQ ID NO: 97021 - RNA, 32 nt, Human
ccacccucuaccccauuccuuccugucagccc

SEQ ID NO: 97022 - RNA, 32 nt, Human
ccacccucucaguggucauuucugagcaucuu

SEQ ID NO: 97023 - RNA, 32 nt, Human
ccacccucuccaaaaccaaccccacccgcugg

SEQ ID NO: 97024 - RNA, 21 nt, Human
ccacccucuccgcuugccugg

SEQ ID NO: 97025 - RNA, 32 nt, Human
ccacccucucucccucaccccucucucuggga

SEQ ID NO: 97026 - RNA, 32 nt, Human
ccacccucucuccuccccaacccuucaggaac

SEQ ID NO: 97027 - RNA, 32 nt, Human
ccacccucucuggcccaggccugcugaguggc

SEQ ID NO: 97028 - RNA, 32 nt, Human
ccacccucugagagcuccucaggcuuagauag

SEQ ID NO: 97029 - RNA, 32 nt, Human
ccacccucugauugauaagacauaucauuuug

SEQ ID NO: 97030 - RNA, 32 nt, Human
ccacccucugccccaccaugauccagccucug

SEQ ID NO: 97031 - RNA, 25 nt, Human
ccacccucuggacacagccccagga

SEQ ID NO: 97032 - RNA, 32 nt, Human
ccacccucuggccuaggcuggcuccagugugc

SEQ ID NO: 97033 - RNA, 32 nt, Human
ccacccucuggccuccugcuucccaggcuccc

SEQ ID NO: 97034 - RNA, 20 nt, Human
ccacccucuucccugauucc

SEQ ID NO: 97035 - RNA, 32 nt, Human
ccacccucuugugcccuuaagcauuacuuuaa

SEQ ID NO: 97036 - RNA, 32 nt, Human
ccacccugaacuccagcuggcccgcaagcgcc

SEQ ID NO: 97037 - RNA, 32 nt, Human
ccacccugaauccucucaggguguacaguuua

SEQ ID NO: 97038 - RNA, 21 nt, Human
ccacccugacagccccaagga

SEQ ID NO: 97039 - RNA, 21 nt, Human
ccacccugaccccacggcugg

SEQ ID NO: 97040 - RNA, 23 nt, Human
ccacccugagaacaccuucucca

SEQ ID NO: 97041 - RNA, 32 nt, Human
ccacccugagccugacgagggugaggagugac

SEQ ID NO: 97042 - RNA, 32 nt, Human
ccacccugcagccgcugccuccugggccccgg

SEQ ID NO: 97043 - RNA, 32 nt, Human
ccacccugcccagccgucaaaagagucuuaau

SEQ ID NO: 97044 - RNA, 24 nt, Human
ccacccugcccagcguccccagga

SEQ ID NO: 97045 - RNA, 31 nt, Human
ccacccugccucucaggggucuguguuggga

SEQ ID NO: 97046 - RNA, 23 nt, Human
ccacccugcuagccugccuggga

SEQ ID NO: 97047 - RNA, 32 nt, Human
ccacccugcucaccccugaagcuucucugggu

SEQ ID NO: 97048 - RNA, 32 nt, Human
ccacccugcucagagcuuuccacccacaggga

SEQ ID NO: 97049 - RNA, 23 nt, Human
ccacccugcugcugcuccucccu

SEQ ID NO: 97050 - RNA, 32 nt, Human
ccacccuggaaugccaaugucagcaucaagcc

SEQ ID NO: 97051 - RNA, 22 nt, Human
ccacccuggaauggggcagggg

SEQ ID NO: 97052 - RNA, 32 nt, Human
ccacccuggaauggggcaggggaagggcacac

SEQ ID NO: 97053 - RNA, 32 nt, Human
ccacccuggccaacauggugaaaccuugucuc

SEQ ID NO: 97054 - RNA, 32 nt, Human
ccacccuggcccugcguccuucccucuccagc

SEQ ID NO: 97055 - RNA, 24 nt, Human
ccacccuggcgaguggagcagggg

SEQ ID NO: 97056 - RNA, 29 nt, Human
ccacccuggcugccacugccccucuggga

SEQ ID NO: 97057 - RNA, 32 nt, Human
ccacccugggcaacacagugagacuucaucuc

SEQ ID NO: 97058 - RNA, 32 nt, Human
ccacccugggcaacagagcaagaccccaucuc

SEQ ID NO: 97059 - RNA, 32 nt, Human
ccacccugggcaacauagcgagacuaccucua

SEQ ID NO: 97060 - RNA, 32 nt, Human
ccacccugggcaacauggugaaaccccuucuc

SEQ ID NO: 97061 - RNA, 32 nt, Human
ccacccugggcaacauggugaaauccugccuc

SEQ ID NO: 97062 - RNA, 32 nt, Human
ccacccugggcaauguagugagaccucaucuc

SEQ ID NO: 97063 - RNA, 32 nt, Human
ccacccugggcagagguggaggagacacugaa

SEQ ID NO: 97064 - RNA, 15 nt, Human
ccacccuggggcccu

SEQ ID NO: 97065 - RNA, 32 nt, Human
ccacccugucaugguaugugaggugugggugu

SEQ ID NO: 97066 - RNA, 32 nt, Human
ccacccuguccacccagcccugcccacaccug

SEQ ID NO: 97067 - RNA, 32 nt, Human
ccacccugucccugcacucccuugguugccaa

SEQ ID NO: 97068 - RNA, 32 nt, Human
ccacccugucccuguaucucccauggaagaug

SEQ ID NO: 97069 - RNA, 32 nt, Human
ccacccugucuucuccccuaggugguuccuga

SEQ ID NO: 97070 - RNA, 32 nt, Human
ccacccugugcccugggcugggcacacccccg

SEQ ID NO: 97071 - RNA, 32 nt, Human
ccacccugugcccugggcugggcacagcccca

SEQ ID NO: 97072 - RNA, 32 nt, Human
ccacccugugcggggcacacccccaggaaggg

SEQ ID NO: 97073 - RNA, 32 nt, Human
ccacccugugcugaggccugaggccucuuccu

SEQ ID NO: 97074 - RNA, 32 nt, Human
ccacccuguguguguuuaugucauaguuacau

SEQ ID NO: 97075 - RNA, 32 nt, Human
ccacccuguucuggcugugugugaaggaugug

SEQ ID NO: 97076 - RNA, 32 nt, Human
ccacccuuaagcuuccucugacgguuacccuc

SEQ ID NO: 97077 - RNA, 23 nt, Human
ccacccuuacucaucaccuugca

SEQ ID NO: 97078 - RNA, 32 nt, Human
ccacccuuacuuccuggccucuucugggcuac

SEQ ID NO: 97079 - RNA, 24 nt, Human
ccacccuuagacccugugauccau

SEQ ID NO: 97080 - RNA, 32 nt, Human
ccacccuucacagauaaaauaugaugcuggca

SEQ ID NO: 97081 - RNA, 32 nt, Human
ccacccuucaccacacccuccugcgcucaggg

SEQ ID NO: 97082 - RNA, 32 nt, Human
ccacccuucaggaguuuccagagaccaagaau

SEQ ID NO: 97083 - RNA, 32 nt, Human
ccacccuucauggcuugccuccugccucugga

SEQ ID NO: 97084 - RNA, 32 nt, Human
ccacccuucauguuugcuucagcagcugguag

SEQ ID NO: 97085 - RNA, 32 nt, Human
ccacccuuccagccuuccaggcuuugggggcc

SEQ ID NO: 97086 - RNA, 32 nt, Human
ccacccuuccaucagcgggucuccucccagcg

SEQ ID NO: 97087 - RNA, 20 nt, Human
ccacccuuccauccauaccu

SEQ ID NO: 97088 - RNA, 32 nt, Human
ccacccuucccaagccuucugcacucccaaaa

SEQ ID NO: 97089 - RNA, 32 nt, Human
ccacccuucccuuccccucucccuucugccuu

SEQ ID NO: 97090 - RNA, 32 nt, Human
ccacccuuccuguuacuuuacuucucuagccu

SEQ ID NO: 97091 - RNA, 32 nt, Human
ccacccuuccuucccuucccuguccuggguca

SEQ ID NO: 97092 - RNA, 19 nt, Human
ccacccuucucagggaccc

SEQ ID NO: 97093 - RNA, 21 nt, Human
ccacccuucucuccucuccuc

SEQ ID NO: 97094 - RNA, 22 nt, Human
ccacccuucucuccuuuccuca

SEQ ID NO: 97095 - RNA, 32 nt, Human
ccacccuucugauugucguucuacuguauaua

SEQ ID NO: 97096 - RNA, 20 nt, Human
ccacccuugcccacuucucc

SEQ ID NO: 97097 - RNA, 32 nt, Human
ccacccuugcccacuucuccuucgcuuuccug

SEQ ID NO: 97098 - RNA, 32 nt, Human
ccacccuugcccagccccugcuuggccccucc

SEQ ID NO: 97099 - RNA, 21 nt, Human
ccacccuugguguccacgccu

SEQ ID NO: 97100 - RNA, 25 nt, Human
ccacccuugugcacucacaugaaag

SEQ ID NO: 97101 - RNA, 32 nt, Human
ccacccuuugucucugccccagaguugagaaa

SEQ ID NO: 97102 - RNA, 32 nt, Human
ccacccuuuuucccucccuccugugcugcugc

SEQ ID NO: 97103 - RNA, 32 nt, Human
ccaccgagaaguccuucccacugcacucccca

SEQ ID NO: 97104 - RNA, 32 nt, Human
ccaccgagaucugcauuccgacugccuaugaa

SEQ ID NO: 97105 - RNA, 25 nt, Human
ccaccgagcccuuugaccuucucca

SEQ ID NO: 97106 - RNA, 32 nt, Human
ccaccgagcggcggcggagggagcagcgccgg

SEQ ID NO: 97107 - RNA, 32 nt, Human
ccaccgaggcagcacuggcugcagcugggauu

SEQ ID NO: 97108 - RNA, 32 nt, Human
ccaccgagguccaagccgcacuugcugcccca

SEQ ID NO: 97109 - RNA, 32 nt, Human
ccaccgagucugagccacucgaggucagggcc

SEQ ID NO: 97110 - RNA, 32 nt, Human
ccaccgaugcacuuggccaucugcugaacagu

SEQ ID NO: 97111 - RNA, 32 nt, Human
ccaccgcaacagcagagccugccauccccaac

SEQ ID NO: 97112 - RNA, 32 nt, Human
ccaccgcaacguggaacaacagcuuuaaaacg

SEQ ID NO: 97113 - RNA, 32 nt, Human
ccaccgcacacgugcacacacgccaacaggca

SEQ ID NO: 97114 - RNA, 32 nt, Human
ccaccgcaccccgcccagccuggcagauuuua

SEQ ID NO: 97115 - RNA, 32 nt, Human
ccaccgcacccggucagcuauuuucuacaugc

SEQ ID NO: 97116 - RNA, 32 nt, Human
ccaccgcaccugccucacauuuucuuucucac

SEQ ID NO: 97117 - RNA, 21 nt, Human
ccaccgcacuccacccuggga

SEQ ID NO: 97118 - RNA, 32 nt, Human
ccaccgcacuccucacuagagccugggguggg

SEQ ID NO: 97119 - RNA, 32 nt, Human
ccaccgcagccccugagggaacagugccgucu

SEQ ID NO: 97120 - RNA, 17 nt, Human
ccaccgcauuccacccu

SEQ ID NO: 97121 - RNA, 32 nt, Human
ccaccgcauucggcuauuuuuguauuuuuagu

SEQ ID NO: 97122 - RNA, 32 nt, Human
ccaccgcauuucucaggccaggcacauugagc

SEQ ID NO: 97123 - RNA, 18 nt, Human
ccaccgccaagcagagcc

SEQ ID NO: 97124 - RNA, 32 nt, Human
ccaccgccaggggaugaggaagugggggccgc

SEQ ID NO: 97125 - RNA, 22 nt, Human
ccaccgcccacucuccaccuca

SEQ ID NO: 97126 - RNA, 20 nt, Human
ccaccgcccccgaucgccuu

SEQ ID NO: 97127 - RNA, 32 nt, Human
ccaccgcccugcacccuccacccggccaggcc

SEQ ID NO: 97128 - RNA, 32 nt, Human
ccaccgcccugccucuuccgguuggaggcucu

SEQ ID NO: 97129 - RNA, 19 nt, Human
ccaccgccgccgccgccac

SEQ ID NO: 97130 - RNA, 18 nt, Human
ccaccgccgccgccucca

SEQ ID NO: 97131 - RNA, 32 nt, Human
ccaccgccuccuccaucucccggagcuggagc

SEQ ID NO: 97132 - RNA, 32 nt, Human
ccaccgccugccacaccacuccugccuggugc

SEQ ID NO: 97133 - RNA, 32 nt, Human
ccaccgccuggccucuugccuggguuggaauu

SEQ ID NO: 97134 - RNA, 32 nt, Human
ccaccgcgcccagccaccuuucucuuuagagc

SEQ ID NO: 97135 - RNA, 32 nt, Human
ccaccgcgcccagccagaacaucuguuuuuac

SEQ ID NO: 97136 - RNA, 32 nt, Human
ccaccgcgcccgcucugcuccgacaccgcgcc

SEQ ID NO: 97137 - RNA, 32 nt, Human
ccaccgcgcccggccuagaggauucuuuuaua

SEQ ID NO: 97138 - RNA, 32 nt, Human
ccaccgcgccuggcuaauuuuguauuuuuagu

SEQ ID NO: 97139 - RNA, 32 nt, Human
ccaccgcggcaccugacccuuggcgcuugcgu

SEQ ID NO: 97140 - RNA, 25 nt, Human
ccaccgcggccagccuaugauccau

SEQ ID NO: 97141 - RNA, 32 nt, Human
ccaccgcucacugcaagcacugccucccuccg

SEQ ID NO: 97142 - RNA, 32 nt, Human
ccaccgcucuacuucuaaccagggacacggau

SEQ ID NO: 97143 - RNA, 32 nt, Human
ccaccgcugcccucagcuccgaguccagggcg

SEQ ID NO: 97144 - RNA, 32 nt, Human
ccaccgcugccucuuuccggcugugacccucc

SEQ ID NO: 97145 - RNA, 32 nt, Human
ccaccgcugggacugcuccuagauggaucuca

SEQ ID NO: 97146 - RNA, 32 nt, Human
ccaccgcuguguccucucugcccagccuggcu

SEQ ID NO: 97147 - RNA, 18 nt, Human
ccaccgcuucccugggcu

SEQ ID NO: 97148 - RNA, 32 nt, Human
ccaccgcuucuuucuugauccucuuuccuuaa

SEQ ID NO: 97149 - RNA, 32 nt, Human
ccaccggcacugccaagaucagaauguuccag

SEQ ID NO: 97150 - RNA, 19 nt, Human
ccaccggcagcagcagcag

SEQ ID NO: 97151 - RNA, 32 nt, Human
ccaccggcaucuuuucuuagguauuguauuuc

SEQ ID NO: 97152 - RNA, 19 nt, Human
ccaccggccccacccauca

SEQ ID NO: 97153 - RNA, 32 nt, Human
ccaccggccccauggacaacagccuggcgacc

SEQ ID NO: 97154 - RNA, 32 nt, Human
ccaccggccugugggucucugaagggaccccc

SEQ ID NO: 97155 - RNA, 32 nt, Human
ccaccggcuucagggcagccuggacaacauga

SEQ ID NO: 97156 - RNA, 32 nt, Human
ccaccgggaaccugucggcgagcugcgggagc

SEQ ID NO: 97157 - RNA, 32 nt, Human
ccaccgggagaggcuuccuuuguuacagcugg

SEQ ID NO: 97158 - RNA, 32 nt, Human
ccaccgggcgggaguggggaagggugggcgca

SEQ ID NO: 97159 - RNA, 32 nt, Human
ccaccgggcugacuuccaccucccagugguga

SEQ ID NO: 97160 - RNA, 32 nt, Human
ccaccggggaucggggcugagcggucgguucc

SEQ ID NO: 97161 - RNA, 32 nt, Human
ccaccgggggaggaggaggaggagaaggugga

SEQ ID NO: 97162 - RNA, 22 nt, Human
ccaccgguccagcgccccagga

SEQ ID NO: 97163 - RNA, 32 nt, Human
ccaccggucucgaccucuccucucagcccuuc

SEQ ID NO: 97164 - RNA, 32 nt, Human
ccaccggugggaaaguugccuguggaagggag

SEQ ID NO: 97165 - RNA, 21 nt, Human
ccaccggugucuccuucuaca

SEQ ID NO: 97166 - RNA, 32 nt, Human
ccaccgucacaggccaccaccacgccgucaau

SEQ ID NO: 97167 - RNA, 32 nt, Human
ccaccgucaccagagccagcugcagcacuggg

SEQ ID NO: 97168 - RNA, 32 nt, Human
ccaccguccuccagagaaugcgccccuccugg

SEQ ID NO: 97169 - RNA, 19 nt, Human
ccaccgucgggcagaggca

SEQ ID NO: 97170 - RNA, 24 nt, Human
ccaccgucgggccugccccagguc

SEQ ID NO: 97171 - RNA, 32 nt, Human
ccaccgucugcacuuggcaucugaagucgggg

SEQ ID NO: 97172 - RNA, 32 nt, Human
ccaccgugcccagcccaaaacugugcuuuuua

SEQ ID NO: 97173 - RNA, 32 nt, Human
ccaccgugccuggccgaugucacccacguuuc

SEQ ID NO: 97174 - RNA, 32 nt, Human
ccaccguggaggaggaaggcaagagggggugg

SEQ ID NO: 97175 - RNA, 32 nt, Human
ccaccuaagacugaacaagcacuaaaggacag

SEQ ID NO: 97176 - RNA, 32 nt, Human
ccaccuaagacugaacaagcacuaaaggaccg

SEQ ID NO: 97177 - RNA, 32 nt, Human
ccaccuaagacugaacaagcacuaaaggacug

SEQ ID NO: 97178 - RNA, 32 nt, Human
ccaccuaagccccaggaggucgaggcugcagu

SEQ ID NO: 97179 - RNA, 32 nt, Human
ccaccuacacaaaagcaaacugcauuuuuaaa

SEQ ID NO: 97180 - RNA, 32 nt, Human
ccaccuacacuccagccugggugacagagcaa

SEQ ID NO: 97181 - RNA, 32 nt, Human
ccaccuacagcccucaugccugggcccagcug

SEQ ID NO: 97182 - RNA, 26 nt, Human
ccaccuaccucucaagacugcugcac

SEQ ID NO: 97183 - RNA, 32 nt, Human
ccaccuaccucuggccucaggcugugggcagc

SEQ ID NO: 97184 - RNA, 32 nt, Human
ccaccuacgcccuggucaucucagccaagaag

SEQ ID NO: 97185 - RNA, 32 nt, Human
ccaccuagaccacccuccaugucagguacuga

SEQ ID NO: 97186 - RNA, 32 nt, Human
ccaccuagcaaauauuaugugccugcugugug

SEQ ID NO: 97187 - RNA, 20 nt, Human
ccaccuagcagacgugggga

SEQ ID NO: 97188 - RNA, 32 nt, Human
ccaccuagcugcagauagcucccaaagagaaa

SEQ ID NO: 97189 - RNA, 32 nt, Human
ccaccuaggacccccacccccgacccucgcga

SEQ ID NO: 97190 - RNA, 21 nt, Human
ccaccuaggaggagaugccac

SEQ ID NO: 97191 - RNA, 18 nt, Human
ccaccuaggcgcgugaga

SEQ ID NO: 97192 - RNA, 19 nt, Human
ccaccuaggcugccaggga

SEQ ID NO: 97193 - RNA, 18 nt, Human
ccaccuagggccugggga

SEQ ID NO: 97194 - RNA, 26 nt, Human
ccaccuagggguucaguaaagaaaga

SEQ ID NO: 97195 - RNA, 19 nt, Human
ccaccuagggugccuggga

SEQ ID NO: 97196 - RNA, 20 nt, Human
ccaccuagguuuguguaagu

SEQ ID NO: 97197 - RNA, 32 nt, Human
ccaccuaguacaacaucuuacgggaagagcau

SEQ ID NO: 97198 - RNA, 20 nt, Human
ccaccuaguagcagugguga

SEQ ID NO: 97199 - RNA, 18 nt, Human
ccaccuagugccucuggg

SEQ ID NO: 97200 - RNA, 21 nt, Human
ccaccuaguggagcuuugaga

SEQ ID NO: 97201 - RNA, 19 nt, Human
ccaccuaguggcccaggga

SEQ ID NO: 97202 - RNA, 21 nt, Human
ccaccuagugguaucucuggg

SEQ ID NO: 97203 - RNA, 21 nt, Human
ccaccuaguuuccccugugga

SEQ ID NO: 97204 - RNA, 18 nt, Human
ccaccuauaagcuugggg

SEQ ID NO: 97205 - RNA, 32 nt, Human
ccaccuaugagugccagugacuuauuuuacuu

SEQ ID NO: 97206 - RNA, 32 nt, Human
ccaccuaugccacagugccuaagggcuaggcc

SEQ ID NO: 97207 - RNA, 32 nt, Human
ccaccuauuagcccugggccuggaccucccug

SEQ ID NO: 97208 - RNA, 18 nt, Human
ccaccuauuuccauucuu

SEQ ID NO: 97209 - RNA, 32 nt, Human
ccaccucaaccuuugguaauaacccuuggcac

SEQ ID NO: 97210 - RNA, 32 nt, Human
ccaccucaagacuuucccagugccccagccug

SEQ ID NO: 97211 - RNA, 32 nt, Human
ccaccucacacguguacagcugcagucuuugu

SEQ ID NO: 97212 - RNA, 32 nt, Human
ccaccucacaggcuguugugaggacuaagggu

SEQ ID NO: 97213 - RNA, 17 nt, Human
ccaccucaccagaacca

SEQ ID NO: 97214 - RNA, 32 nt, Human
ccaccucacccaggucucagcggcagugggca

SEQ ID NO: 97215 - RNA, 32 nt, Human
ccaccucaccccucaguucuggguugguucag

SEQ ID NO: 97216 - RNA, 19 nt, Human
ccaccucacccugugcucc

SEQ ID NO: 97217 - RNA, 18 nt, Human
ccaccucaccgccuggga

SEQ ID NO: 97218 - RNA, 32 nt, Human
ccaccucaccucuggcaccucugagcauccac

SEQ ID NO: 97219 - RNA, 32 nt, Human
ccaccucaccuugcaaaaguguuuauccaaau

SEQ ID NO: 97220 - RNA, 32 nt, Human
ccaccucacuguuccccaugcgcacacacaua

SEQ ID NO: 97221 - RNA, 24 nt, Human
ccaccucagccuccuaaagugcca

SEQ ID NO: 97222 - RNA, 32 nt, Human
ccaccucagccuggagcugucuucccacacuc

SEQ ID NO: 97223 - RNA, 32 nt, Human
ccaccucagccuuucaaagugcuggaauuaca

SEQ ID NO: 97224 - RNA, 32 nt, Human
ccaccucagcgggccagcagcccagggaaccc

SEQ ID NO: 97225 - RNA, 32 nt, Human
ccaccucaggaagcuaguauucaugcccagga

SEQ ID NO: 97226 - RNA, 32 nt, Human
ccaccucaggguggggcgggcaggaccccguc

SEQ ID NO: 97227 - RNA, 18 nt, Human
ccaccucaguccauccuu

SEQ ID NO: 97228 - RNA, 32 nt, Human
ccaccucagucucccuaguagguggaacuaca

SEQ ID NO: 97229 - RNA, 22 nt, Human
ccaccucauccuggcucagccu

SEQ ID NO: 97230 - RNA, 32 nt, Human
ccaccucauccuggcucagccuggugauggag

SEQ ID NO: 97231 - RNA, 32 nt, Human
ccaccucaucucuguguugugaauugcaguuc

SEQ ID NO: 97232 - RNA, 32 nt, Human
ccaccuccaagccaaggagguccuggagcaga

SEQ ID NO: 97233 - RNA, 32 nt, Human
ccaccuccaccugagcccucauccucuguucc

SEQ ID NO: 97234 - RNA, 22 nt, Human
ccaccuccacgucugucuugua

SEQ ID NO: 97235 - RNA, 32 nt, Human
ccaccuccacucccaccucacccggccucuuc

SEQ ID NO: 97236 - RNA, 32 nt, Human
ccaccuccagaagagaugggaaaaggucauca

SEQ ID NO: 97237 - RNA, 32 nt, Human
ccaccuccagaggcuuggaagggaacagggca

SEQ ID NO: 97238 - RNA, 19 nt, Human
ccaccuccagcccaucaga

SEQ ID NO: 97239 - RNA, 32 nt, Human
ccaccuccaggcagacccaucacuggaagugg

SEQ ID NO: 97240 - RNA, 32 nt, Human
ccaccuccaggcuggcuucagucucccauccc

SEQ ID NO: 97241 - RNA, 32 nt, Human
ccaccuccaggcugggucuguccugcucugcu

SEQ ID NO: 97242 - RNA, 19 nt, Human
ccaccuccagucagucucg

SEQ ID NO: 97243 - RNA, 32 nt, Human
ccaccuccauccccucucccaaccaugacuuc

SEQ ID NO: 97244 - RNA, 32 nt, Human
ccaccuccaugggacugacaccauguucaagc

SEQ ID NO: 97245 - RNA, 32 nt, Human
ccaccucccacaucccugagguuggcgacugu

SEQ ID NO: 97246 - RNA, 19 nt, Human
ccaccucccaccucucuga

SEQ ID NO: 97247 - RNA, 32 nt, Human
ccaccucccacucugucauggcgggauuuuug

SEQ ID NO: 97248 - RNA, 32 nt, Human
ccaccucccagcccucuccucauucucugaac

SEQ ID NO: 97249 - RNA, 32 nt, Human
ccaccuccccauccccuguucucccucuguug

SEQ ID NO: 97250 - RNA, 20 nt, Human
ccaccucccccucugugagg

SEQ ID NO: 97251 - RNA, 32 nt, Human
ccaccuccccuccccacagccuuccucacccu

SEQ ID NO: 97252 - RNA, 32 nt, Human
ccaccucccucaaaccuugagauaggcugggu

SEQ ID NO: 97253 - RNA, 32 nt, Human
ccaccucccuccagacuccuuugaccccagga

SEQ ID NO: 97254 - RNA, 32 nt, Human
ccaccucccuccucccuccacaguccuccagc

SEQ ID NO: 97255 - RNA, 18 nt, Human
ccaccucccucucucuga

SEQ ID NO: 97256 - RNA, 32 nt, Human
ccaccucccugcacauggcacuacccagacug

SEQ ID NO: 97257 - RNA, 32 nt, Human
ccaccucccuggcccugccccugcacucaggc

SEQ ID NO: 97258 - RNA, 32 nt, Human
ccaccuccgcagccacuguccaaagggcaggg

SEQ ID NO: 97259 - RNA, 32 nt, Human
ccaccuccgggaccccugacucaggccugagg

SEQ ID NO: 97260 - RNA, 32 nt, Human
ccaccuccgugcagcugaccugcccuccagcc

SEQ ID NO: 97261 - RNA, 25 nt, Human
ccaccuccguucccucugggcccca

SEQ ID NO: 97262 - RNA, 19 nt, Human
ccaccuccuauccaucguu

SEQ ID NO: 97263 - RNA, 19 nt, Human
ccaccuccucaggcugccu

SEQ ID NO: 97264 - RNA, 32 nt, Human
ccaccuccuccaaagcacugagguccuggcag

SEQ ID NO: 97265 - RNA, 32 nt, Human
ccaccuccuccaggaaccauguuuggagcuuc

SEQ ID NO: 97266 - RNA, 32 nt, Human
ccaccuccuccaggaagccuuccuuuauccau

SEQ ID NO: 97267 - RNA, 32 nt, Human
ccaccuccuccaucuccggcuccugggcuugg

SEQ ID NO: 97268 - RNA, 32 nt, Human
ccaccuccuccccuucauuccugcugcuaccc

SEQ ID NO: 97269 - RNA, 32 nt, Human
ccaccuccuccuccuccuccucuccuccugga

SEQ ID NO: 97270 - RNA, 32 nt, Human
ccaccuccuccuccuccuggcccugcugcugc

SEQ ID NO: 97271 - RNA, 32 nt, Human
ccaccuccuccugugcccugagcugcugagac

SEQ ID NO: 97272 - RNA, 32 nt, Human
ccaccuccucgggcuucauuuucucuauuuag

SEQ ID NO: 97273 - RNA, 20 nt, Human
ccaccuccucugccucaagg

SEQ ID NO: 97274 - RNA, 32 nt, Human
ccaccuccugcagccucccuguuguuucuaga

SEQ ID NO: 97275 - RNA, 32 nt, Human
ccaccuccuggaaggcagccaggcuggcagau

SEQ ID NO: 97276 - RNA, 32 nt, Human
ccaccuccuggcugguuuaccugcugcugccc

SEQ ID NO: 97277 - RNA, 32 nt, Human
ccaccuccuuccccuucucccucaggcaaccc

SEQ ID NO: 97278 - RNA, 32 nt, Human
ccaccuccuuucagcugcuccugggccucagc

SEQ ID NO: 97279 - RNA, 32 nt, Human
ccaccuccuuucucuguccucuccugagguuc

SEQ ID NO: 97280 - RNA, 32 nt, Human
ccaccucguaggguuguagaaagaccaaguga

SEQ ID NO: 97281 - RNA, 32 nt, Human
ccaccucuacaaauggcguagccuucaugggu

SEQ ID NO: 97282 - RNA, 18 nt, Human
ccaccucuaccacugcca

SEQ ID NO: 97283 - RNA, 32 nt, Human
ccaccucuauauacauguacacaaagccacac

SEQ ID NO: 97284 - RNA, 32 nt, Human
ccaccucucaagggccuuggauuccugggacc

SEQ ID NO: 97285 - RNA, 19 nt, Human
ccaccucucacuuugcugu

SEQ ID NO: 97286 - RNA, 32 nt, Human
ccaccucuccauccccuaggcuuucagcaggg

SEQ ID NO: 97287 - RNA, 32 nt, Human
ccaccucucccacccaacacucccucuuaucu

SEQ ID NO: 97288 - RNA, 19 nt, Human
ccaccucucccugcuuggg

SEQ ID NO: 97289 - RNA, 32 nt, Human
ccaccucucccuugauggucugggagccuggc

SEQ ID NO: 97290 - RNA, 32 nt, Human
ccaccucuccgaagaggaaagccacguagagu

SEQ ID NO: 97291 - RNA, 32 nt, Human
ccaccucuccuccuugggagguuccagugggu

SEQ ID NO: 97292 - RNA, 32 nt, Human
ccaccucuccuuucccccuccuucuccauccc

SEQ ID NO: 97293 - RNA, 32 nt, Human
ccaccucucuaaaagacacaggaggaugacac

SEQ ID NO: 97294 - RNA, 32 nt, Human
ccaccucucucucacagguacacacacaacca

SEQ ID NO: 97295 - RNA, 32 nt, Human
ccaccucugaagaugcugggggaggcagcugg

SEQ ID NO: 97296 - RNA, 32 nt, Human
ccaccucugagcccaaggaagaauggucaccc

SEQ ID NO: 97297 - RNA, 26 nt, Human
ccaccucugagucucagcuuugcuuc

SEQ ID NO: 97298 - RNA, 32 nt, Human
ccaccucugagugcucugaggaaaacauggca

SEQ ID NO: 97299 - RNA, 32 nt, Human
ccaccucugaugucugugcugcugucaccagg

SEQ ID NO: 97300 - RNA, 32 nt, Human
ccaccucugcaaccugccaccuccugcuggca

SEQ ID NO: 97301 - RNA, 32 nt, Human
ccaccucugccacccuccgauggggccgcuac

SEQ ID NO: 97302 - RNA, 32 nt, Human
ccaccucugcuugcuuucuuucccuccccucc

SEQ ID NO: 97303 - RNA, 32 nt, Human
ccaccucugggagcuggaguccacuggggugg

SEQ ID NO: 97304 - RNA, 32 nt, Human
ccaccucugggccucugcuccuggccagcagu

SEQ ID NO: 97305 - RNA, 32 nt, Human
ccaccucuguccagggcaguaagaagggcugc

SEQ ID NO: 97306 - RNA, 32 nt, Human
ccaccucugugcucccuccugccugcaugcaa

SEQ ID NO: 97307 - RNA, 32 nt, Human
ccaccucuucccgcacccagcaugcagcucug

SEQ ID NO: 97308 - RNA, 32 nt, Human
ccaccucuuccugcccugcucuccuccagagg

SEQ ID NO: 97309 - RNA, 32 nt, Human
ccaccucuuccugcucccuccucuuuuggcuc

SEQ ID NO: 97310 - RNA, 32 nt, Human
ccaccucuucuaaaccaugauguggcacauuu

SEQ ID NO: 97311 - RNA, 32 nt, Human
ccaccucuugcacucucgcuuuuggagcaagu

SEQ ID NO: 97312 - RNA, 32 nt, Human
ccaccucuugccuuguugaggcuuuuuccuuu

SEQ ID NO: 97313 - RNA, 17 nt, Human
ccaccucuugcuugggg

SEQ ID NO: 97314 - RNA, 32 nt, Human
ccaccucuuuucucccaaucggacuccggcca

SEQ ID NO: 97315 - RNA, 32 nt, Human
ccaccugaaacacacacaaacacacacauguc

SEQ ID NO: 97316 - RNA, 26 nt, Human
ccaccugaaagcucuguaaaagaaag

SEQ ID NO: 97317 - RNA, 32 nt, Human
ccaccugaaagucacugugguuaaagauauug

SEQ ID NO: 97318 - RNA, 32 nt, Human
ccaccugaacaacuggagcaaccuuuagucuc

SEQ ID NO: 97319 - RNA, 32 nt, Human
ccaccugacuagcugggauugcagccugcacc

SEQ ID NO: 97320 - RNA, 32 nt, Human
ccaccugacuucaucuacgccucggcaccacg

SEQ ID NO: 97321 - RNA, 32 nt, Human
ccaccugagacgagcacagggucuccacgagg

SEQ ID NO: 97322 - RNA, 32 nt, Human
ccaccugagcagcugggauugcaggugcaugc

SEQ ID NO: 97323 - RNA, 32 nt, Human
ccaccugagccaagcaaagaggguucaccugc

SEQ ID NO: 97324 - RNA, 32 nt, Human
ccaccugagcccagcuagagucaguggggaag

SEQ ID NO: 97325 - RNA, 32 nt, Human
ccaccugaggacugggugcacaguugucuuug

SEQ ID NO: 97326 - RNA, 32 nt, Human
ccaccugagggccauggcugugacccauaccc

SEQ ID NO: 97327 - RNA, 32 nt, Human
ccaccugaguagcagggauuacaggugugugc

SEQ ID NO: 97328 - RNA, 32 nt, Human
ccaccugaguagcugggaguacaggcaugugg

SEQ ID NO: 97329 - RNA, 32 nt, Human
ccaccugaguagcugggauuacacgcacaugc

SEQ ID NO: 97330 - RNA, 32 nt, Human
ccaccugcaaacucuccgccuucugcaccugc

SEQ ID NO: 97331 - RNA, 32 nt, Human
ccaccugcaacaagcuggaggaaccauugugc

SEQ ID NO: 97332 - RNA, 21 nt, Human
ccaccugcaacagcugccccu

SEQ ID NO: 97333 - RNA, 32 nt, Human
ccaccugcaauuucccaccuccugcccauccc

SEQ ID NO: 97334 - RNA, 32 nt, Human
ccaccugcacacaagcaggugccuuagagcca

SEQ ID NO: 97335 - RNA, 32 nt, Human
ccaccugcaggaccuccuccugcuggccacca

SEQ ID NO: 97336 - RNA, 32 nt, Human
ccaccugcagucucacaggccaugcccugggu

SEQ ID NO: 97337 - RNA, 21 nt, Human
ccaccugccaaagcuuggcac

SEQ ID NO: 97338 - RNA, 32 nt, Human
ccaccugccaugagcagcauccugagcccggg

SEQ ID NO: 97339 - RNA, 22 nt, Human
ccaccugcccacacccagcaga

SEQ ID NO: 97340 - RNA, 32 nt, Human
ccaccugcccacucccuuaacaagaguuuuau

SEQ ID NO: 97341 - RNA, 32 nt, Human
ccaccugccccagccccugccucugcccaagu

SEQ ID NO: 97342 - RNA, 32 nt, Human
ccaccugcccucucccccaaagcuguauuuuu

SEQ ID NO: 97343 - RNA, 32 nt, Human
ccaccugcccucucuucccugccugaucaccg

SEQ ID NO: 97344 - RNA, 32 nt, Human
ccaccugccgccaccacucgcuucgcugauga

SEQ ID NO: 97345 - RNA, 32 nt, Human
ccaccugccgccuucagacucucggggcuggu

SEQ ID NO: 97346 - RNA, 20 nt, Human
ccaccugccgguggcuccug

SEQ ID NO: 97347 - RNA, 32 nt, Human
ccaccugccuccugaagugcugcugacaugca

SEQ ID NO: 97348 - RNA, 32 nt, Human
ccaccugccugagagcccugaggugacaauaa

SEQ ID NO: 97349 - RNA, 32 nt, Human
ccaccugccugggagucucccugccucacucc

SEQ ID NO: 97350 - RNA, 32 nt, Human
ccaccugccuugcauaugcagaccaugacaau

SEQ ID NO: 97351 - RNA, 32 nt, Human
ccaccugcgcggcugcagccggcggaucccuc

SEQ ID NO: 97352 - RNA, 32 nt, Human
ccaccugcggugcuaucucccccagccccauc

SEQ ID NO: 97353 - RNA, 32 nt, Human
ccaccugcgugucccuuccuccccgagucagg

SEQ ID NO: 97354 - RNA, 21 nt, Human
ccaccugcuccggagcugggg

SEQ ID NO: 97355 - RNA, 32 nt, Human
ccaccugcuccucaucuuaggagucuccuuuu

SEQ ID NO: 97356 - RNA, 32 nt, Human
ccaccugcugcucucacccugggguccccagc

SEQ ID NO: 97357 - RNA, 32 nt, Human
ccaccugcuggcagccgaugggggcacucgga

SEQ ID NO: 97358 - RNA, 32 nt, Human
ccaccugcugggagguguguuugcaggacagg

SEQ ID NO: 97359 - RNA, 32 nt, Human
ccaccugcuggugagaggugcaaagaggcaga

SEQ ID NO: 97360 - RNA, 18 nt, Human
ccaccugcuguccuccuu

SEQ ID NO: 97361 - RNA, 32 nt, Human
ccaccugcuucaggagugccucacauagauag

SEQ ID NO: 97362 - RNA, 32 nt, Human
ccaccugcuuccugauguucaccaggaaccua

SEQ ID NO: 97363 - RNA, 21 nt, Human
ccaccuggacaauaauugaug

SEQ ID NO: 97364 - RNA, 21 nt, Human
ccaccuggacuggcucaguga

SEQ ID NO: 97365 - RNA, 32 nt, Human
ccaccuggagcccuccccugcccacccgcccc

SEQ ID NO: 97366 - RNA, 32 nt, Human
ccaccuggagggagagcagaccugcggcugag

SEQ ID NO: 97367 - RNA, 32 nt, Human
ccaccuggauagggacaaacaggagcuggggg

SEQ ID NO: 97368 - RNA, 32 nt, Human
ccaccuggcaacugcuuaccagccuggcuggc

SEQ ID NO: 97369 - RNA, 32 nt, Human
ccaccuggccaacauggugaaaccccaucucu

SEQ ID NO: 97370 - RNA, 32 nt, Human
ccaccuggccaacauggugaaaccccgucucu

SEQ ID NO: 97371 - RNA, 32 nt, Human
ccaccuggccagccacagcacgugugucaccu

SEQ ID NO: 97372 - RNA, 23 nt, Human
ccaccuggccaugcaugcugcca

SEQ ID NO: 97373 - RNA, 32 nt, Human
ccaccuggccugcaaaguuugcaggagggcca

SEQ ID NO: 97374 - RNA, 18 nt, Human
ccaccuggccugcuggga

SEQ ID NO: 97375 - RNA, 32 nt, Human
ccaccuggcuaaaucucuuuuuaacuuuugua

SEQ ID NO: 97376 - RNA, 32 nt, Human
ccaccuggcucucagccacuaguguuugugua

SEQ ID NO: 97377 - RNA, 32 nt, Human
ccaccuggcucucagucacuaucguuugugua

SEQ ID NO: 97378 - RNA, 32 nt, Human
ccaccugggaaaggagggaucagcaauagcug

SEQ ID NO: 97379 - RNA, 19 nt, Human
ccaccugggacccuugaga

SEQ ID NO: 97380 - RNA, 32 nt, Human
ccaccugggacggcagugaggaugagcaccuc

SEQ ID NO: 97381 - RNA, 32 nt, Human
ccaccugggaggcugaggcaggagaaucucuu

SEQ ID NO: 97382 - RNA, 32 nt, Human
ccaccugggaggcugaggcaggagaauggugu

SEQ ID NO: 97383 - RNA, 32 nt, Human
ccaccugggcaacaagaaggaaacucugucuc

SEQ ID NO: 97384 - RNA, 32 nt, Human
ccaccuggggacccaaaagagaaggccuagga

SEQ ID NO: 97385 - RNA, 32 nt, Human
ccaccuggggaggaggcgggagagggagcugc

SEQ ID NO: 97386 - RNA, 32 nt, Human
ccaccuggggcagucaccugcccagaucccag

SEQ ID NO: 97387 - RNA, 22 nt, Human
ccaccuggggccccauuaaaga

SEQ ID NO: 97388 - RNA, 32 nt, Human
ccaccugguacaugauacaugaccccagguuc

SEQ ID NO: 97389 - RNA, 21 nt, Human
ccaccugguacugacccagga

SEQ ID NO: 97390 - RNA, 32 nt, Human
ccaccuggucucugcacgcacacacuggucag

SEQ ID NO: 97391 - RNA, 18 nt, Human
ccaccuggugccguggga

SEQ ID NO: 97392 - RNA, 20 nt, Human
ccaccugguggccucugccc

SEQ ID NO: 97393 - RNA, 32 nt, Human
ccaccuguaccugacacagaagcuggggagcc

SEQ ID NO: 97394 - RNA, 32 nt, Human
ccaccuguagcugaauccacagacccaaagcc

SEQ ID NO: 97395 - RNA, 21 nt, Human
ccaccugucaaaaggcaggug

SEQ ID NO: 97396 - RNA, 21 nt, Human
ccaccugucaaucacuucaga

SEQ ID NO: 97397 - RNA, 21 nt, Human
ccaccugucagaaggugggug

SEQ ID NO: 97398 - RNA, 20 nt, Human
ccaccugucagacuugggug

SEQ ID NO: 97399 - RNA, 18 nt, Human
ccaccuguccugccuggg

SEQ ID NO: 97400 - RNA, 32 nt, Human
ccaccuguccuggaagucaaggccagucacgg

SEQ ID NO: 97401 - RNA, 32 nt, Human
ccaccugucguuuacccagcccuagacaugcu

SEQ ID NO: 97402 - RNA, 32 nt, Human
ccaccugucugccucaagcucccagagcaccu

SEQ ID NO: 97403 - RNA, 32 nt, Human
ccaccugucuggucagagucucucugcugugg

SEQ ID NO: 97404 - RNA, 32 nt, Human
ccaccugugacagccaggcuugaggguggacg

SEQ ID NO: 97405 - RNA, 32 nt, Human
ccaccugugcugcugcaccaaccucacugccc

SEQ ID NO: 97406 - RNA, 32 nt, Human
ccaccuguggccugggugcccucuggaggccg

SEQ ID NO: 97407 - RNA, 17 nt, Human
ccaccuguguccucccu

SEQ ID NO: 97408 - RNA, 32 nt, Human
ccaccuguuagaagcuauguguuugaaggaau

SEQ ID NO: 97409 - RNA, 32 nt, Human
ccaccuguucgggaguuggagaugugcaccua

SEQ ID NO: 97410 - RNA, 22 nt, Human
ccaccuguuucccccaagaaag

SEQ ID NO: 97411 - RNA, 32 nt, Human
ccaccuuaacccagugaucaaaguuaaccucc

SEQ ID NO: 97412 - RNA, 32 nt, Human
ccaccuuagcuucccaauuccccuggcugucc

SEQ ID NO: 97413 - RNA, 32 nt, Human
ccaccuuauuuuugagcuugguguuuugucuu

SEQ ID NO: 97414 - RNA, 32 nt, Human
ccaccuucaccuuugucgcugggucagugcug

SEQ ID NO: 97415 - RNA, 32 nt, Human
ccaccuucagccagagaggcugggaggccgaa

SEQ ID NO: 97416 - RNA, 19 nt, Human
ccaccuucaggccccgccc

SEQ ID NO: 97417 - RNA, 32 nt, Human
ccaccuucaggggugacacaucagcccaggcc

SEQ ID NO: 97418 - RNA, 32 nt, Human
ccaccuuccaaagcuuccgcaaucucaccguc

SEQ ID NO: 97419 - RNA, 22 nt, Human
ccaccuuccaaaggugguacuu

SEQ ID NO: 97420 - RNA, 32 nt, Human
ccaccuuccaggguccagcacaggugcaugcc

SEQ ID NO: 97421 - RNA, 32 nt, Human
ccaccuuccccaccaucuguggcuccauauac

SEQ ID NO: 97422 - RNA, 18 nt, Human
ccaccuucccccucucug

SEQ ID NO: 97423 - RNA, 19 nt, Human
ccaccuuccuaacacccuu

SEQ ID NO: 97424 - RNA, 32 nt, Human
ccaccuuccugccuccccuccugcuccucauc

SEQ ID NO: 97425 - RNA, 32 nt, Human
ccaccuuccuucaagccuucagccccuccagc

SEQ ID NO: 97426 - RNA, 32 nt, Human
ccaccuuccuucagagcuucgugcuuuauggu

SEQ ID NO: 97427 - RNA, 32 nt, Human
ccaccuuccuuccuccaagauaccaucuccuc

SEQ ID NO: 97428 - RNA, 32 nt, Human
ccaccuuccuuucuccccugcuggccauuguu

SEQ ID NO: 97429 - RNA, 32 nt, Human
ccaccuucuaggcguuuuuggaacccuuacug

SEQ ID NO: 97430 - RNA, 32 nt, Human
ccaccuucucagggcaaaagaaaaagaaggug

SEQ ID NO: 97431 - RNA, 32 nt, Human
ccaccuucucaguucuugugucuguuauugga

SEQ ID NO: 97432 - RNA, 32 nt, Human
ccaccuucucccacugaagcaccaagaggcuu

SEQ ID NO: 97433 - RNA, 32 nt, Human
ccaccuucucuccccuccucucugcuuuaauu

SEQ ID NO: 97434 - RNA, 29 nt, Human
ccaccuucucuggaugugccugggcuugg

SEQ ID NO: 97435 - RNA, 32 nt, Human
ccaccuucucuuuuucucaaauauaguugcag

SEQ ID NO: 97436 - RNA, 32 nt, Human
ccaccuucuucacuauaauaaaagccagucug

SEQ ID NO: 97437 - RNA, 23 nt, Human
ccaccuucuuuggagcaaggaga

SEQ ID NO: 97438 - RNA, 20 nt, Human
ccaccuugccacccauucuu

SEQ ID NO: 97439 - RNA, 32 nt, Human
ccaccuugcccugcugauuuuguauuuuuagu

SEQ ID NO: 97440 - RNA, 32 nt, Human
ccaccuugcgugucucagccuccugagcagcu

SEQ ID NO: 97441 - RNA, 32 nt, Human
ccaccuugcuguccuccgccgccuuccgggug

SEQ ID NO: 97442 - RNA, 32 nt, Human
ccaccuuggacagugggaugugguguuccaca

SEQ ID NO: 97443 - RNA, 20 nt, Human
ccaccuuggcaccaggagga

SEQ ID NO: 97444 - RNA, 21 nt, Human
ccaccuuggccugauggagga

SEQ ID NO: 97445 - RNA, 24 nt, Human
ccaccuuggcgccuacacgggaga

SEQ ID NO: 97446 - RNA, 22 nt, Human
ccaccuuggcuggcaagggaga

SEQ ID NO: 97447 - RNA, 32 nt, Human
ccaccuuggcugggaagacuauggugcugccu

SEQ ID NO: 97448 - RNA, 32 nt, Human
ccaccuugggcaacauaacgagaccccgucuc

SEQ ID NO: 97449 - RNA, 23 nt, Human
ccaccuugguuucccaaaguguu

SEQ ID NO: 97450 - RNA, 32 nt, Human
ccaccuugugacccaggguggggacaggggcu

SEQ ID NO: 97451 - RNA, 32 nt, Human
ccaccuuguuucucccugcucaugaggucgca

SEQ ID NO: 97452 - RNA, 32 nt, Human
ccaccuuucccuucagcauucccuuucaugac

SEQ ID NO: 97453 - RNA, 32 nt, Human
ccaccuuucgagaucaggaccaaccuggaaaa

SEQ ID NO: 97454 - RNA, 32 nt, Human
ccaccuuucucagcaucaggacgggguugccc

SEQ ID NO: 97455 - RNA, 32 nt, Human
ccaccuuucuguaguucagggcuggcaggagg

SEQ ID NO: 97456 - RNA, 22 nt, Human
ccaccuuucuuaaagcagcgua

SEQ ID NO: 97457 - RNA, 18 nt, Human
ccaccuuucuuucguuca

SEQ ID NO: 97458 - RNA, 32 nt, Human
ccaccuuugcccauggacccucuccuugcugc

SEQ ID NO: 97459 - RNA, 32 nt, Human
ccaccuuuguguccuagagcucagcgucugca

SEQ ID NO: 97460 - RNA, 32 nt, Human
ccaccuuuuccagaggaaccuguucuacggcc

SEQ ID NO: 97461 - RNA, 19 nt, Human
ccaccuuuucccuuaaagg

SEQ ID NO: 97462 - RNA, 32 nt, Human
ccacgaaacuuugcccauagcagcgggcgggc

SEQ ID NO: 97463 - RNA, 32 nt, Human
ccacgaaagaggagugugagaggugaguccaa

SEQ ID NO: 97464 - RNA, 32 nt, Human
ccacgaaaggacugggugcaccccagaacgag

SEQ ID NO: 97465 - RNA, 32 nt, Human
ccacgaacaccuucucaagcacuuugagugac

SEQ ID NO: 97466 - RNA, 32 nt, Human
ccacgaaccagaaaauuggcccuuaccagaca

SEQ ID NO: 97467 - RNA, 18 nt, Human
ccacgaacuccgcucuca

SEQ ID NO: 97468 - RNA, 32 nt, Human
ccacgaacuccuccuccauuuccuuuuuggga

SEQ ID NO: 97469 - RNA, 32 nt, Human
ccacgaacuuuugucauucagccugggagacc

SEQ ID NO: 97470 - RNA, 32 nt, Human
ccacgaagcaggacaggcagagcccaggguac

SEQ ID NO: 97471 - RNA, 32 nt, Human
ccacgaaggccaccacgacaagggccaccagu

SEQ ID NO: 97472 - RNA, 32 nt, Human
ccacgaaggcuguuucuuccacacagcacuuu

SEQ ID NO: 97473 - RNA, 32 nt, Human
ccacgacagaacugcacuuguagccggagaca

SEQ ID NO: 97474 - RNA, 32 nt, Human
ccacgacaggguggagagaagcagggaccauu

SEQ ID NO: 97475 - RNA, 32 nt, Human
ccacgacagugcaugcacuccagccugggcaa

SEQ ID NO: 97476 - RNA, 32 nt, Human
ccacgaccaaccauauggcaaaugaccaagcc

SEQ ID NO: 97477 - RNA, 32 nt, Human
ccacgacccaggcuggacgaaugccuggucag

SEQ ID NO: 97478 - RNA, 26 nt, Human
ccacgaccgggucgaccccccagggg

SEQ ID NO: 97479 - RNA, 32 nt, Human
ccacgaccugggagcagcaggucccaggucgc

SEQ ID NO: 97480 - RNA, 32 nt, Human
ccacgaccuugccauuuggggugggcucuuca

SEQ ID NO: 97481 - RNA, 22 nt, Human
ccacgacgcgggccgccggguc

SEQ ID NO: 97482 - RNA, 28 nt, Human
ccacgacggagugccaggagcacuaaca

SEQ ID NO: 97483 - RNA, 32 nt, Human
ccacgacggugacacgcuucccuggauuggca

SEQ ID NO: 97484 - RNA, 32 nt, Human
ccacgacggugaucauggcagagaaucacgcc

SEQ ID NO: 97485 - RNA, 32 nt, Human
ccacgacuuauucgaaaagcacuagaauuuau

SEQ ID NO: 97486 - RNA, 32 nt, Human
ccacgagaaccaggagaucuaccagaaggccu

SEQ ID NO: 97487 - RNA, 32 nt, Human
ccacgagagccuucugggcucccaccagagac

SEQ ID NO: 97488 - RNA, 32 nt, Human
ccacgagccccagccucacaguguccacucaa

SEQ ID NO: 97489 - RNA, 32 nt, Human
ccacgagccuccauccguucugguucggguuu

SEQ ID NO: 97490 - RNA, 32 nt, Human
ccacgagcgcggagcuuggggaggcgcaggcg

SEQ ID NO: 97491 - RNA, 32 nt, Human
ccacgagcuccaccagcccauuggagaaaagu

SEQ ID NO: 97492 - RNA, 32 nt, Human
ccacgaggagaccccgcucccgcaggaggccg

SEQ ID NO: 97493 - RNA, 32 nt, Human
ccacgaggagcgcacagccagagcaggugcug

SEQ ID NO: 97494 - RNA, 32 nt, Human
ccacgaggcaacacauuauccaccagguaaca

SEQ ID NO: 97495 - RNA, 32 nt, Human
ccacgaggcaacauuugauauccagcagauaa

SEQ ID NO: 97496 - RNA, 32 nt, Human
ccacgaggcucccuccaggcuuggggccgugg

SEQ ID NO: 97497 - RNA, 32 nt, Human
ccacgagggggccgagcagggugcggcggcgg

SEQ ID NO: 97498 - RNA, 25 nt, Human
ccacgagucguccguuuccccaggg

SEQ ID NO: 97499 - RNA, 32 nt, Human
ccacgaguuuaagaccagccugggcaacaugg

SEQ ID NO: 97500 - RNA, 32 nt, Human
ccacgaucacccagcaggagucguggcagaac

SEQ ID NO: 97501 - RNA, 32 nt, Human
ccacgauuccuuccucuucacuggcucgaggu

SEQ ID NO: 97502 - RNA, 22 nt, Human
ccacgauuuaaaccaucagaga

SEQ ID NO: 97503 - RNA, 32 nt, Human
ccacgcaaacacccucccuccuggggaccucu

SEQ ID NO: 97504 - RNA, 32 nt, Human
ccacgcacacucgccugucccuccagggauca

SEQ ID NO: 97505 - RNA, 32 nt, Human
ccacgcacaucaccacccauugucaggugcuc

SEQ ID NO: 97506 - RNA, 20 nt, Human
ccacgcacugacacugccca

SEQ ID NO: 97507 - RNA, 32 nt, Human
ccacgcacugcaaccugggugacagagcgaga

SEQ ID NO: 97508 - RNA, 32 nt, Human
ccacgcacuggccuucccuccugccccacucc

SEQ ID NO: 97509 - RNA, 32 nt, Human
ccacgcagaggggaggcugcuccaccccuacu

SEQ ID NO: 97510 - RNA, 32 nt, Human
ccacgcagcagucaggggagaaaaugguggcu

SEQ ID NO: 97511 - RNA, 32 nt, Human
ccacgcagcucuccaacacuccguuaaacaaa

SEQ ID NO: 97512 - RNA, 32 nt, Human
ccacgcagcuggcagagagcacagugaucacc

SEQ ID NO: 97513 - RNA, 32 nt, Human
ccacgcaggagguggugggcucgcaggaaggu

SEQ ID NO: 97514 - RNA, 32 nt, Human
ccacgcaggcacucacauucacacacauacac

SEQ ID NO: 97515 - RNA, 31 nt, Human
ccacgcaucaauaaauaauuuugaaggccuc

SEQ ID NO: 97516 - RNA, 20 nt, Human
ccacgcauccauccacccuu

SEQ ID NO: 97517 - RNA, 32 nt, Human
ccacgcaucgccagggcaguuggggcaguggg

SEQ ID NO: 97518 - RNA, 32 nt, Human
ccacgcauggugaugcacaccuguaaucccag

SEQ ID NO: 97519 - RNA, 32 nt, Human
ccacgcaugguggcucacgccuguaaucccag

SEQ ID NO: 97520 - RNA, 31 nt, Human
ccacgcauugucacagcuaccaaaguguggu

SEQ ID NO: 97521 - RNA, 32 nt, Human
ccacgccaccgccucugccuccaggccgcccg

SEQ ID NO: 97522 - RNA, 32 nt, Human
ccacgccacugcacuccagcccgggugacaga

SEQ ID NO: 97523 - RNA, 32 nt, Human
ccacgccacugcacuccagccugggugacagu

SEQ ID NO: 97524 - RNA, 32 nt, Human
ccacgccacugcacuccagcgugggcaacaga

SEQ ID NO: 97525 - RNA, 32 nt, Human
ccacgccagaguucacaggaucuucaucaugg

SEQ ID NO: 97526 - RNA, 32 nt, Human
ccacgccagccuugguaucuacuuuuuauaca

SEQ ID NO: 97527 - RNA, 32 nt, Human
ccacgccagggagucugucaccugggaggugg

SEQ ID NO: 97528 - RNA, 32 nt, Human
ccacgccauugcacuccagccugggugacaag

SEQ ID NO: 97529 - RNA, 32 nt, Human
ccacgccauugcacuccagcuugggcaauaag

SEQ ID NO: 97530 - RNA, 21 nt, Human
ccacgcccacagcccccuugg

SEQ ID NO: 97531 - RNA, 32 nt, Human
ccacgcccacaggcugacccagaucuccguga

SEQ ID NO: 97532 - RNA, 32 nt, Human
ccacgcccacccugaacuccagcuggcccgca

SEQ ID NO: 97533 - RNA, 18 nt, Human
ccacgcccaccucagcuc

SEQ ID NO: 97534 - RNA, 32 nt, Human
ccacgcccagaggaggggaggcacuggccccc

SEQ ID NO: 97535 - RNA, 32 nt, Human
ccacgcccagccuguggccagcacuuuagaug

SEQ ID NO: 97536 - RNA, 32 nt, Human
ccacgcccagcuaauuguuuuguauuuuuagu

SEQ ID NO: 97537 - RNA, 32 nt, Human
ccacgcccagcuccccaccugcccugcacucu

SEQ ID NO: 97538 - RNA, 32 nt, Human
ccacgcccagggcgcggaaggccaugcugccc

SEQ ID NO: 97539 - RNA, 32 nt, Human
ccacgcccaguucuaccagugccacagccuuc

SEQ ID NO: 97540 - RNA, 32 nt, Human
ccacgccccagccacuuugcucccucucaccu

SEQ ID NO: 97541 - RNA, 32 nt, Human
ccacgcccccuagcucagacccgcacacaaga

SEQ ID NO: 97542 - RNA, 32 nt, Human
ccacgcccccuucagauccuuugcuccggaga

SEQ ID NO: 97543 - RNA, 23 nt, Human
ccacgccccucgcuggcgcccca

SEQ ID NO: 97544 - RNA, 32 nt, Human
ccacgccccugcagauccaggucuccaggccu

SEQ ID NO: 97545 - RNA, 19 nt, Human
ccacgcccggcggccgcga

SEQ ID NO: 97546 - RNA, 32 nt, Human
ccacgcccggcugauggugguggaggaacgau

SEQ ID NO: 97547 - RNA, 32 nt, Human
ccacgcccuccccaucucccagucucccugcc

SEQ ID NO: 97548 - RNA, 18 nt, Human
ccacgccggcccgcgcgu

SEQ ID NO: 97549 - RNA, 32 nt, Human
ccacgccuagccccaccgcgcucccggcgcgg

SEQ ID NO: 97550 - RNA, 32 nt, Human
ccacgccuagccucacgcuccuuucugaucuu

SEQ ID NO: 97551 - RNA, 32 nt, Human
ccacgccuagcuaauuucuuuguauuuuuggu

SEQ ID NO: 97552 - RNA, 32 nt, Human
ccacgccucuaaucccagcacuuugggaggcu

SEQ ID NO: 97553 - RNA, 32 nt, Human
ccacgccugccugggccugugcugucagaccc

SEQ ID NO: 97554 - RNA, 24 nt, Human
ccacgccugcgcucuccgcuccca

SEQ ID NO: 97555 - RNA, 18 nt, Human
ccacgccugcuucuccca

SEQ ID NO: 97556 - RNA, 32 nt, Human
ccacgccuggaucccuugcccccacuauuuaa

SEQ ID NO: 97557 - RNA, 22 nt, Human
ccacgccuggcccguguugcug

SEQ ID NO: 97558 - RNA, 32 nt, Human
ccacgccuggccuccauaccucccagguccug

SEQ ID NO: 97559 - RNA, 32 nt, Human
ccacgccuguaaucccagcacuuugggagacg

SEQ ID NO: 97560 - RNA, 32 nt, Human
ccacgccuguaaucccagcacuuugggaggcc

SEQ ID NO: 97561 - RNA, 32 nt, Human
ccacgccuguaaucccagcuacucgggaggcu

SEQ ID NO: 97562 - RNA, 32 nt, Human
ccacgccuguaaucccagcuacuuggaaggcu

SEQ ID NO: 97563 - RNA, 32 nt, Human
ccacgcgaaagccaacggacaggaggguggcc

SEQ ID NO: 97564 - RNA, 32 nt, Human
ccacgcgaagccccuguugcaagugaggacaa

SEQ ID NO: 97565 - RNA, 22 nt, Human
ccacgcgccacccccgggcgcc

SEQ ID NO: 97566 - RNA, 19 nt, Human
ccacgcgcccuccugcccg

SEQ ID NO: 97567 - RNA, 31 nt, Human
ccacgcgccgagucucccaugacgcccgagc

SEQ ID NO: 97568 - RNA, 32 nt, Human
ccacgcgcucagacaugauaugcggcuaugcc

SEQ ID NO: 97569 - RNA, 32 nt, Human
ccacgcgcucugcaugcuccucugccugugcc

SEQ ID NO: 97570 - RNA, 32 nt, Human
ccacgcgcuggcuccauaaaggccagcuuugg

SEQ ID NO: 97571 - RNA, 32 nt, Human
ccacgcggcugguccuuccugggcugggcuga

SEQ ID NO: 97572 - RNA, 32 nt, Human
ccacgcgggccgcggcuccggcauggccggga

SEQ ID NO: 97573 - RNA, 20 nt, Human
ccacgcggugccaggcccag

SEQ ID NO: 97574 - RNA, 32 nt, Human
ccacgcguccgccagccuagcagaagggagcu

SEQ ID NO: 97575 - RNA, 32 nt, Human
ccacgcguggcuaauguuuuuguauuuuuagu

SEQ ID NO: 97576 - RNA, 32 nt, Human
ccacgcuacggccauguacccccagcccggcc

SEQ ID NO: 97577 - RNA, 32 nt, Human
ccacgcuaucccucugcagccugggcccuccc

SEQ ID NO: 97578 - RNA, 32 nt, Human
ccacgcucacugccuggcuuggaaaaguuaag

SEQ ID NO: 97579 - RNA, 20 nt, Human
ccacgcucagcccugaguua

SEQ ID NO: 97580 - RNA, 32 nt, Human
ccacgcucaguggcugaacagcauucccacag

SEQ ID NO: 97581 - RNA, 32 nt, Human
ccacgcucauuucuaucauucucccccaugac

SEQ ID NO: 97582 - RNA, 21 nt, Human
ccacgcuccaaaccccagggu

SEQ ID NO: 97583 - RNA, 32 nt, Human
ccacgcuccagccugacccuccagcauaccua

SEQ ID NO: 97584 - RNA, 32 nt, Human
ccacgcucugcagccuugggggcaagagccuc

SEQ ID NO: 97585 - RNA, 32 nt, Human
ccacgcucuucccugccuaucuccuccgcccg

SEQ ID NO: 97586 - RNA, 32 nt, Human
ccacgcugauguugaacuugacgugaggccuc

SEQ ID NO: 97587 - RNA, 32 nt, Human
ccacgcugcagcagcucacaccucucugcggu

SEQ ID NO: 97588 - RNA, 22 nt, Human
ccacgcugcaggacccgcgccg

SEQ ID NO: 97589 - RNA, 18 nt, Human
ccacgcugcccugggcca

SEQ ID NO: 97590 - RNA, 17 nt, Human
ccacgcugcgcuccgcc

SEQ ID NO: 97591 - RNA, 22 nt, Human
ccacgcuggcccucuccuuccc

SEQ ID NO: 97592 - RNA, 20 nt, Human
ccacgcuggcccuucuccca

SEQ ID NO: 97593 - RNA, 29 nt, Human
ccacgcuggcugcucagagcuccucgcuu

SEQ ID NO: 97594 - RNA, 32 nt, Human
ccacgcugugcuguuuggaugggagccccaca

SEQ ID NO: 97595 - RNA, 32 nt, Human
ccacggaagggaccugaacacgauggcacgag

SEQ ID NO: 97596 - RNA, 26 nt, Human
ccacggacccgcagcucagggcgccu

SEQ ID NO: 97597 - RNA, 32 nt, Human
ccacggaccugugcaggggcccccacucuucu

SEQ ID NO: 97598 - RNA, 32 nt, Human
ccacggacggcccagacccgggcuggggcgcg

SEQ ID NO: 97599 - RNA, 32 nt, Human
ccacggacgggccccuccuggagcccauaccc

SEQ ID NO: 97600 - RNA, 32 nt, Human
ccacggagaggagccccaugcccagccuggcu

SEQ ID NO: 97601 - RNA, 32 nt, Human
ccacggaggaggcagaauggccagucgagggg

SEQ ID NO: 97602 - RNA, 32 nt, Human
ccacggagggcgucugcagagaggccugccuu

SEQ ID NO: 97603 - RNA, 31 nt, Human
ccacggaggguggaagaggagaggguggaag

SEQ ID NO: 97604 - RNA, 32 nt, Human
ccacggcaagccccgcccucucuaagcuccgc

SEQ ID NO: 97605 - RNA, 32 nt, Human
ccacggcacauccugcuuuguucaccacuggg

SEQ ID NO: 97606 - RNA, 21 nt, Human
ccacggcaccucccugagcca

SEQ ID NO: 97607 - RNA, 20 nt, Human
ccacggcaccuggcugggcc

SEQ ID NO: 97608 - RNA, 31 nt, Human
ccacggcaggauccaaucacagccgaggggc

SEQ ID NO: 97609 - RNA, 32 nt, Human
ccacggcagggcugggaaguucagugccugga

SEQ ID NO: 97610 - RNA, 32 nt, Human
ccacggcagguggaucaucugaggucaggagu

SEQ ID NO: 97611 - RNA, 32 nt, Human
ccacggcauccccuccccaucuccccuuuguc

SEQ ID NO: 97612 - RNA, 32 nt, Human
ccacggcaucuucucccgagaccacaaacacc

SEQ ID NO: 97613 - RNA, 32 nt, Human
ccacggcaugccuguacuggcacuuugguuuu

SEQ ID NO: 97614 - RNA, 32 nt, Human
ccacggccacaggcaaggggguugcaguggcc

SEQ ID NO: 97615 - RNA, 24 nt, Human
ccacggccaccacugcagccgggg

SEQ ID NO: 97616 - RNA, 32 nt, Human
ccacggccacuuccugcugcccuggaccccgc

SEQ ID NO: 97617 - RNA, 21 nt, Human
ccacggcccacccuggucagg

SEQ ID NO: 97618 - RNA, 19 nt, Human
ccacggcccagcccugcca

SEQ ID NO: 97619 - RNA, 22 nt, Human
ccacggcccugcgcuggcccca

SEQ ID NO: 97620 - RNA, 21 nt, Human
ccacggcccuugccacugucu

SEQ ID NO: 97621 - RNA, 22 nt, Human
ccacggccgagccucuggccgg

SEQ ID NO: 97622 - RNA, 32 nt, Human
ccacggccgaggaggaggaggaugaggaguau

SEQ ID NO: 97623 - RNA, 20 nt, Human
ccacggccgcaggagucggg

SEQ ID NO: 97624 - RNA, 21 nt, Human
ccacggccgcugcugccucca

SEQ ID NO: 97625 - RNA, 22 nt, Human
ccacggccgugucuguucagga

SEQ ID NO: 97626 - RNA, 32 nt, Human
ccacggccuccagggcggcuggcuggaaagcc

SEQ ID NO: 97627 - RNA, 32 nt, Human
ccacggccuccuggcuccagaggcagcugggc

SEQ ID NO: 97628 - RNA, 32 nt, Human
ccacggccucgccaccaccagccccaccuggc

SEQ ID NO: 97629 - RNA, 18 nt, Human
ccacggccucugccuccc

SEQ ID NO: 97630 - RNA, 32 nt, Human
ccacggccugcuguugcuucagccuggccugg

SEQ ID NO: 97631 - RNA, 32 nt, Human
ccacggccuggaggagggagguugugguugga

SEQ ID NO: 97632 - RNA, 20 nt, Human
ccacggccuggcugguggga

SEQ ID NO: 97633 - RNA, 32 nt, Human
ccacggccuuucuagccuggcuauguccuaau

SEQ ID NO: 97634 - RNA, 32 nt, Human
ccacggcgcacacccagcccacauaucccaca

SEQ ID NO: 97635 - RNA, 18 nt, Human
ccacggcgcccagcccag

SEQ ID NO: 97636 - RNA, 32 nt, Human
ccacggcgcccagcccaggaagaguuuuuaaa

SEQ ID NO: 97637 - RNA, 20 nt, Human
ccacggcgccguggucccag

SEQ ID NO: 97638 - RNA, 18 nt, Human
ccacggcggagccuucca

SEQ ID NO: 97639 - RNA, 32 nt, Human
ccacggcucacugcagccucagcguccugggc

SEQ ID NO: 97640 - RNA, 18 nt, Human
ccacggcuccucccugcc

SEQ ID NO: 97641 - RNA, 20 nt, Human
ccacggcuccugcuucugcc

SEQ ID NO: 97642 - RNA, 22 nt, Human
ccacggcugaaacgcgcggcuu

SEQ ID NO: 97643 - RNA, 19 nt, Human
ccacggcugcaccuccucc

SEQ ID NO: 97644 - RNA, 32 nt, Human
ccacggcugcaggaggugggggagacacaaag

SEQ ID NO: 97645 - RNA, 19 nt, Human
ccacggcugcccggucggg

SEQ ID NO: 97646 - RNA, 23 nt, Human
ccacggcuucagucagggccagg

SEQ ID NO: 97647 - RNA, 32 nt, Human
ccacggcuucccugcugacuuggccacggaaa

SEQ ID NO: 97648 - RNA, 32 nt, Human
ccacgggacugccacagacugagccuuccgga

SEQ ID NO: 97649 - RNA, 32 nt, Human
ccacgggagagcaggccuccagcuggaaaggc

SEQ ID NO: 97650 - RNA, 32 nt, Human
ccacgggagaggggagagggacgcacagcacu

SEQ ID NO: 97651 - RNA, 32 nt, Human
ccacgggaggguggggcggcugggaagcuggc

SEQ ID NO: 97652 - RNA, 32 nt, Human
ccacgggauaccuuugcugugcccuguggccu

SEQ ID NO: 97653 - RNA, 32 nt, Human
ccacgggaugcugagagaggaggcccgagagg

SEQ ID NO: 97654 - RNA, 32 nt, Human
ccacgggccaacaauggacagcaggacggucc

SEQ ID NO: 97655 - RNA, 32 nt, Human
ccacgggcccucccccaaccucucucugaucc

SEQ ID NO: 97656 - RNA, 32 nt, Human
ccacgggcgaggacgugaagccucccgaacac

SEQ ID NO: 97657 - RNA, 32 nt, Human
ccacgggcuccaggaccccuuugcuggccauc

SEQ ID NO: 97658 - RNA, 18 nt, Human
ccacgggcucccugcucc

SEQ ID NO: 97659 - RNA, 32 nt, Human
ccacggggagcuuggaugccaaagggaggacg

SEQ ID NO: 97660 - RNA, 32 nt, Human
ccacggggaggagaggaggagccgagagagcu

SEQ ID NO: 97661 - RNA, 32 nt, Human
ccacgggggaaugggauccaggccagguugcu

SEQ ID NO: 97662 - RNA, 32 nt, Human
ccacgggggcaggaccccucucugagucacag

SEQ ID NO: 97663 - RNA, 32 nt, Human
ccacgggggcccugagacugaguggucccuau

SEQ ID NO: 97664 - RNA, 32 nt, Human
ccacgggggcgugggagccagugugggcaugg

SEQ ID NO: 97665 - RNA, 18 nt, Human
ccacgggggcugcagugg

SEQ ID NO: 97666 - RNA, 32 nt, Human
ccacgggggcugggagggcauccuggcuguuu

SEQ ID NO: 97667 - RNA, 32 nt, Human
ccacgggguggugggcugggccuggaccccac

SEQ ID NO: 97668 - RNA, 32 nt, Human
ccacggguagugcgaccucgguucugugggcu

SEQ ID NO: 97669 - RNA, 21 nt, Human
ccacgggucccucggucgggg

SEQ ID NO: 97670 - RNA, 32 nt, Human
ccacgggugagugaggagaguuggugggccag

SEQ ID NO: 97671 - RNA, 32 nt, Human
ccacgguaucuccuggccaggcugcugggaca

SEQ ID NO: 97672 - RNA, 23 nt, Human
ccacgguccuucaucaaacugcu

SEQ ID NO: 97673 - RNA, 32 nt, Human
ccacggucucacucucacccaggcuggagugc

SEQ ID NO: 97674 - RNA, 24 nt, Human
ccacggugcugagacuacaggugu

SEQ ID NO: 97675 - RNA, 24 nt, Human
ccacgguggcuuacaccuguaauc

SEQ ID NO: 97676 - RNA, 32 nt, Human
ccacgguggguggaucaccugaggucaggaau

SEQ ID NO: 97677 - RNA, 19 nt, Human
ccacguaacuggcugcaga

SEQ ID NO: 97678 - RNA, 32 nt, Human
ccacguaccaacacuuuauacccaggggaaug

SEQ ID NO: 97679 - RNA, 32 nt, Human
ccacguagcccggcccggauuggacguuggcg

SEQ ID NO: 97680 - RNA, 19 nt, Human
ccacguaggggcacuccug

SEQ ID NO: 97681 - RNA, 32 nt, Human
ccacguaugguggcucaugucuauaaucccag

SEQ ID NO: 97682 - RNA, 32 nt, Human
ccacguaugugaaacacacauggacauguguc

SEQ ID NO: 97683 - RNA, 32 nt, Human
ccacguauugcccccuugccacugccugagug

SEQ ID NO: 97684 - RNA, 32 nt, Human
ccacgucaacuucucccaccugaccacaaagg

SEQ ID NO: 97685 - RNA, 32 nt, Human
ccacgucacagaguccaacagggacaucacuc

SEQ ID NO: 97686 - RNA, 20 nt, Human
ccacgucacuggcucaggcu

SEQ ID NO: 97687 - RNA, 32 nt, Human
ccacguccagguggcagggaaagccgagcggc

SEQ ID NO: 97688 - RNA, 32 nt, Human
ccacguccauuguuuccaucuuuugggcuguu

SEQ ID NO: 97689 - RNA, 32 nt, Human
ccacgucccaugucacaggcucuuugagcugc

SEQ ID NO: 97690 - RNA, 18 nt, Human
ccacgucccgacuggcca

SEQ ID NO: 97691 - RNA, 32 nt, Human
ccacguccgagcugcccacacaccgccuuaug

SEQ ID NO: 97692 - RNA, 32 nt, Human
ccacguccucaccgcauuugcugcuaucugug

SEQ ID NO: 97693 - RNA, 32 nt, Human
ccacguccugcacugcaauaccagucuaauga

SEQ ID NO: 97694 - RNA, 32 nt, Human
ccacgucuaucucugggggucgcacguugcgg

SEQ ID NO: 97695 - RNA, 32 nt, Human
ccacgucuccaggacaucagccugagccucuu

SEQ ID NO: 97696 - RNA, 32 nt, Human
ccacgucugagcuugcuuuucccucuggacac

SEQ ID NO: 97697 - RNA, 32 nt, Human
ccacgucuguaaucccugcacuuugggaggcc

SEQ ID NO: 97698 - RNA, 32 nt, Human
ccacgugaacaccaccaccagcgccacacaua

SEQ ID NO: 97699 - RNA, 32 nt, Human
ccacgugaaguugucgcugccuuagagagggg

SEQ ID NO: 97700 - RNA, 32 nt, Human
ccacgugaccccuccuagccucaggcucccuc

SEQ ID NO: 97701 - RNA, 32 nt, Human
ccacgugagcagucagcaccaguucugcacca

SEQ ID NO: 97702 - RNA, 32 nt, Human
ccacgugcacacucggugaaccacaguccaga

SEQ ID NO: 97703 - RNA, 32 nt, Human
ccacgugccaucucacacagaggucaaccgau

SEQ ID NO: 97704 - RNA, 32 nt, Human
ccacgugcgguggcucaugccuguaaucccgg

SEQ ID NO: 97705 - RNA, 32 nt, Human
ccacgugcucucaccagaacugcagcaaaacu

SEQ ID NO: 97706 - RNA, 32 nt, Human
ccacguggagaaaggggccgcuuuggcccuuc

SEQ ID NO: 97707 - RNA, 32 nt, Human
ccacguggccugggcugccauccugccguccu

SEQ ID NO: 97708 - RNA, 32 nt, Human
ccacgugggaacagccugcagugagcggugac

SEQ ID NO: 97709 - RNA, 32 nt, Human
ccacgugggcacagaguggcccccugggcaga

SEQ ID NO: 97710 - RNA, 22 nt, Human
ccacguggguccucuucaagua

SEQ ID NO: 97711 - RNA, 32 nt, Human
ccacgugguggcuuucucacgcuagcccucuu

SEQ ID NO: 97712 - RNA, 32 nt, Human
ccacguguaggugaugugcacauaucaagaag

SEQ ID NO: 97713 - RNA, 32 nt, Human
ccacguguaguggcucaugccuguaaucccaa

SEQ ID NO: 97714 - RNA, 32 nt, Human
ccacguguccacccuccugcucaugcagaggg

SEQ ID NO: 97715 - RNA, 20 nt, Human
ccacguguccguccacccuu

SEQ ID NO: 97716 - RNA, 32 nt, Human
ccacguuaauuuaaaagaacauuaugaggauu

SEQ ID NO: 97717 - RNA, 32 nt, Human
ccacguuaucuagcaaaagucauaagaaucua

SEQ ID NO: 97718 - RNA, 32 nt, Human
ccacguucaagcgauccuccugccucagccuc

SEQ ID NO: 97719 - RNA, 23 nt, Human
ccacguuggccaggcuggucuca

SEQ ID NO: 97720 - RNA, 32 nt, Human
ccacguuggccaggcuggucuuaaaugacccu

SEQ ID NO: 97721 - RNA, 32 nt, Human
ccacguuguucccagccucccuuccuuccacc

SEQ ID NO: 97722 - RNA, 32 nt, Human
ccacguuuauagaaccaagcuugagugcauuu

SEQ ID NO: 97723 - RNA, 32 nt, Human
ccacguuucaguagugaggcugugagugugag

SEQ ID NO: 97724 - RNA, 32 nt, Human
ccacguuuucuuucuuuuccugguagauagga

SEQ ID NO: 97725 - RNA, 32 nt, Human
ccacuaaaaagaaaauguggauuuuuaaaaua

SEQ ID NO: 97726 - RNA, 32 nt, Human
ccacuaaaaauacaaaaauuagccaggcauga

SEQ ID NO: 97727 - RNA, 32 nt, Human
ccacuaaaaauacaaaaauuagccaggcgugg

SEQ ID NO: 97728 - RNA, 32 nt, Human
ccacuaaaaauacaaaaauuagccaggugugg

SEQ ID NO: 97729 - RNA, 32 nt, Human
ccacuaaaaauacaaaaauuagccgggcguga

SEQ ID NO: 97730 - RNA, 32 nt, Human
ccacuaaaaauacaaaaauuagccgggugugg

SEQ ID NO: 97731 - RNA, 32 nt, Human
ccacuaaaaauacaaaaauuagcugggcgugg

SEQ ID NO: 97732 - RNA, 32 nt, Human
ccacuaaaaauacaaaaauuaguugggcaugg

SEQ ID NO: 97733 - RNA, 32 nt, Human
ccacuaaaaauacaaaaguuagucgggcaugg

SEQ ID NO: 97734 - RNA, 32 nt, Human
ccacuaaaaauacaaaauuagccgggcauggu

SEQ ID NO: 97735 - RNA, 32 nt, Human
ccacuaaaaauacaaaauuagccggguguggu

SEQ ID NO: 97736 - RNA, 32 nt, Human
ccacuaaaaauacaaaauuagcugggcguggu

SEQ ID NO: 97737 - RNA, 32 nt, Human
ccacuaaaaauacaaaauuagcuggguguggu

SEQ ID NO: 97738 - RNA, 32 nt, Human
ccacuaaaaauacaacaguuagucgggcaugg

SEQ ID NO: 97739 - RNA, 32 nt, Human
ccacuaaaaauagaaaaauuagccgggcaugg

SEQ ID NO: 97740 - RNA, 32 nt, Human
ccacuaaaaauagcugggcgugguggcaggca

SEQ ID NO: 97741 - RNA, 32 nt, Human
ccacuaaaaauauaaaaauuagccaggcaugg

SEQ ID NO: 97742 - RNA, 21 nt, Human
ccacuaaaagaguaauugaug

SEQ ID NO: 97743 - RNA, 32 nt, Human
ccacuaaaaguacaaaaauuagcugggcgugg

SEQ ID NO: 97744 - RNA, 23 nt, Human
ccacuaaaccacagcuguccccu

SEQ ID NO: 97745 - RNA, 32 nt, Human
ccacuaaagugccuauugaaacucuuaucauu

SEQ ID NO: 97746 - RNA, 32 nt, Human
ccacuaacaaauggccaguagaugcuggacac

SEQ ID NO: 97747 - RNA, 32 nt, Human
ccacuaacauauccaagaaucuuuguaggaca

SEQ ID NO: 97748 - RNA, 22 nt, Human
ccacuaacucaggggucaggaa

SEQ ID NO: 97749 - RNA, 32 nt, Human
ccacuaacucugugcucccuucccucuccugg

SEQ ID NO: 97750 - RNA, 32 nt, Human
ccacuaacuuguucugcauguguagagucucc

SEQ ID NO: 97751 - RNA, 32 nt, Human
ccacuaagagaaggcagagaggucccuagugg

SEQ ID NO: 97752 - RNA, 32 nt, Human
ccacuaagcugugucuuguucaugcccccugc

SEQ ID NO: 97753 - RNA, 32 nt, Human
ccacuaaggagaaagaaguugauuccuucauu

SEQ ID NO: 97754 - RNA, 32 nt, Human
ccacuaaggagagagguuaagauggagucaca

SEQ ID NO: 97755 - RNA, 32 nt, Human
ccacuaagugccucuuugcauagcaccagucc

SEQ ID NO: 97756 - RNA, 32 nt, Human
ccacuacaaggacugugcaucuaaguaauaau

SEQ ID NO: 97757 - RNA, 32 nt, Human
ccacuacaauccagaggucaccacccuuccca

SEQ ID NO: 97758 - RNA, 31 nt, Human
ccacuacacagcuaguaucaugacagcagcu

SEQ ID NO: 97759 - RNA, 32 nt, Human
ccacuacaccagggccaggagcucuucugaaa

SEQ ID NO: 97760 - RNA, 22 nt, Human
ccacuacacuccagccugagca

SEQ ID NO: 97761 - RNA, 22 nt, Human
ccacuacacuccagccugggca

SEQ ID NO: 97762 - RNA, 18 nt, Human
ccacuacagggcugcaga

SEQ ID NO: 97763 - RNA, 32 nt, Human
ccacuacauuuugguuggcuguauuuauuacc

SEQ ID NO: 97764 - RNA, 32 nt, Human
ccacuaccccauccacuguccucccaaggugc

SEQ ID NO: 97765 - RNA, 32 nt, Human
ccacuaccgccuuuauuucucuauuucccuug

SEQ ID NO: 97766 - RNA, 21 nt, Human
ccacuaccgcugccaacacca

SEQ ID NO: 97767 - RNA, 32 nt, Human
ccacuaccugcuagagccuacugugaaaucac

SEQ ID NO: 97768 - RNA, 32 nt, Human
ccacuaccuucccagaccauauaucuccccuu

SEQ ID NO: 97769 - RNA, 23 nt, Human
ccacuaccuuguacccccaucaa

SEQ ID NO: 97770 - RNA, 32 nt, Human
ccacuaccuuuguccaggccugggugguauag

SEQ ID NO: 97771 - RNA, 32 nt, Human
ccacuacggccaccccaaaggaccccgacgcc

SEQ ID NO: 97772 - RNA, 32 nt, Human
ccacuacucauccccauugguuucccagggga

SEQ ID NO: 97773 - RNA, 19 nt, Human
ccacuacuccagcccagaa

SEQ ID NO: 97774 - RNA, 32 nt, Human
ccacuacugcauucacggggaucccaggcuag

SEQ ID NO: 97775 - RNA, 21 nt, Human
ccacuacuggugacucuucaa

SEQ ID NO: 97776 - RNA, 32 nt, Human
ccacuagagcccagagggaugagaggagagag

SEQ ID NO: 97777 - RNA, 32 nt, Human
ccacuagaggcugaggugggaggaucacugga

SEQ ID NO: 97778 - RNA, 32 nt, Human
ccacuagauagaaacauuauuaaccacauuau

SEQ ID NO: 97779 - RNA, 32 nt, Human
ccacuagcaaaauucuugcuuccucuucccgc

SEQ ID NO: 97780 - RNA, 32 nt, Human
ccacuagcagcccccagcaucucccacccacc

SEQ ID NO: 97781 - RNA, 32 nt, Human
ccacuagccaggcucuuugagggcagggauug

SEQ ID NO: 97782 - RNA, 18 nt, Human
ccacuagcccuccauccu

SEQ ID NO: 97783 - RNA, 32 nt, Human
ccacuagccuaauagaccagcacggucaacua

SEQ ID NO: 97784 - RNA, 32 nt, Human
ccacuaggacccucggcgucccuuccccuccc

SEQ ID NO: 97785 - RNA, 32 nt, Human
ccacuaggaggcacgcccagugugggagagau

SEQ ID NO: 97786 - RNA, 32 nt, Human
ccacuaggaucuacugucugcacuguuuucuu

SEQ ID NO: 97787 - RNA, 32 nt, Human
ccacuagggcccugccuucagcuggugcuugc

SEQ ID NO: 97788 - RNA, 32 nt, Human
ccacuagguugccucagaagcccuaagacuga

SEQ ID NO: 97789 - RNA, 32 nt, Human
ccacuaguacuccagccugggugacagagcaa

SEQ ID NO: 97790 - RNA, 32 nt, Human
ccacuauauuuuacuucuuugccaucagcaag

SEQ ID NO: 97791 - RNA, 32 nt, Human
ccacuaucaacaccagcugcugcccagcuacu

SEQ ID NO: 97792 - RNA, 32 nt, Human
ccacuaucaguauuucugugcuuuauaaacua

SEQ ID NO: 97793 - RNA, 32 nt, Human
ccacuaucugucagauccuugccaucugucag

SEQ ID NO: 97794 - RNA, 30 nt, Human
ccacuaugcccagcccaagagcucuuugcc

SEQ ID NO: 97795 - RNA, 32 nt, Human
ccacuaugcccagcuaauuuuguauuuuuagu

SEQ ID NO: 97796 - RNA, 32 nt, Human
ccacuaugccuggcuaauuuuguauuuuuagu

SEQ ID NO: 97797 - RNA, 32 nt, Human
ccacuaugugccaagcacugugcucagggcuu

SEQ ID NO: 97798 - RNA, 32 nt, Human
ccacuauuacuuuugcaccaaccuaauaggcc

SEQ ID NO: 97799 - RNA, 32 nt, Human
ccacuauuucugagucucuucccacugagcag

SEQ ID NO: 97800 - RNA, 21 nt, Human
ccacucaagagucccagcaga

SEQ ID NO: 97801 - RNA, 32 nt, Human
ccacucaaugugaacucuacuaccacgaccuc

SEQ ID NO: 97802 - RNA, 32 nt, Human
ccacucaccacaaccuccgccuccuggguuca

SEQ ID NO: 97803 - RNA, 22 nt, Human
ccacucacccuggcagagcaga

SEQ ID NO: 97804 - RNA, 23 nt, Human
ccacucacccuuugagcuacaga

SEQ ID NO: 97805 - RNA, 22 nt, Human
ccacucacuccagcccaacaga

SEQ ID NO: 97806 - RNA, 32 nt, Human
ccacucacucugcaauccccggcaccuaacuc

SEQ ID NO: 97807 - RNA, 32 nt, Human
ccacucacucugcugccuccagcaggacccaa

SEQ ID NO: 97808 - RNA, 32 nt, Human
ccacucacugaacaccagcugcaguagagccg

SEQ ID NO: 97809 - RNA, 32 nt, Human
ccacucacugcaacuuccgccuccugggguca

SEQ ID NO: 97810 - RNA, 32 nt, Human
ccacucacugcaggaaucccuucuacaauucc

SEQ ID NO: 97811 - RNA, 32 nt, Human
ccacucacugccuccuuccuccugguguugcc

SEQ ID NO: 97812 - RNA, 32 nt, Human
ccacucacugguguccugucucuugucguccu

SEQ ID NO: 97813 - RNA, 32 nt, Human
ccacucacuuccaucuugacugggugacaagu

SEQ ID NO: 97814 - RNA, 32 nt, Human
ccacucagcagagucaaguuucucccaauuga

SEQ ID NO: 97815 - RNA, 32 nt, Human
ccacucagccuccuccugccugcucugaaccu

SEQ ID NO: 97816 - RNA, 32 nt, Human
ccacucagcucuucuccuccugugccaggggc

SEQ ID NO: 97817 - RNA, 32 nt, Human
ccacucaggaagcugaggcaggagaaucgcuu

SEQ ID NO: 97818 - RNA, 32 nt, Human
ccacucaggagaaggacaguggccacucaggu

SEQ ID NO: 97819 - RNA, 32 nt, Human
ccacucaggagacaugucccuaugcauagcag

SEQ ID NO: 97820 - RNA, 32 nt, Human
ccacucaggaggucgagguggcgggaugguuu

SEQ ID NO: 97821 - RNA, 32 nt, Human
ccacucaguuaaggaagauccugaagcaguuc

SEQ ID NO: 97822 - RNA, 32 nt, Human
ccacucaguuauuauugcuauuagaaaauaau

SEQ ID NO: 97823 - RNA, 24 nt, Human
ccacucaucuauggacucagagcu

SEQ ID NO: 97824 - RNA, 32 nt, Human
ccacucaugccccgucguccucccagacaaau

SEQ ID NO: 97825 - RNA, 32 nt, Human
ccacucaugccuguaaacccagggcuuuagaa

SEQ ID NO: 97826 - RNA, 32 nt, Human
ccacucauggccagacgcuuccggugcaggag

SEQ ID NO: 97827 - RNA, 26 nt, Human
ccacucauggccugcccugaggacuu

SEQ ID NO: 97828 - RNA, 32 nt, Human
ccacucauggucucuaaccacuugacaccaga

SEQ ID NO: 97829 - RNA, 32 nt, Human
ccagccuggccaacaugaugaaaccccguuuc

SEQ ID NO: 97830 - RNA, 32 nt, Human
ccagccuggccaacaugaugaaacccugucuc

SEQ ID NO: 97831 - RNA, 32 nt, Human
ccagccuggccaacaugaugaaacccuguucu

SEQ ID NO: 97832 - RNA, 32 nt, Human
ccagccuggccaacaugaugaaacccuugucu

SEQ ID NO: 97833 - RNA, 32 nt, Human
ccagccuggccaacaugaugaaaccuuaucuc

SEQ ID NO: 97834 - RNA, 32 nt, Human
ccagccuggccaacaugaugaaaccuugucuc

SEQ ID NO: 97835 - RNA, 32 nt, Human
ccagccuggccaacaugcugaaaccucgucuc

SEQ ID NO: 97836 - RNA, 23 nt, Human
ccagccuggccaacauggcgaaa

SEQ ID NO: 97837 - RNA, 32 nt, Human
ccagccuggccaacauggcgaaaccucaucuc

SEQ ID NO: 97838 - RNA, 32 nt, Human
ccagccuggccaacauggcgaaaccucgccuc

SEQ ID NO: 97839 - RNA, 32 nt, Human
ccagccuggccaacauggcgaaaccucuucuc

SEQ ID NO: 97840 - RNA, 23 nt, Human
ccagccuggccaacauggugaaa

SEQ ID NO: 97841 - RNA, 32 nt, Human
ccagccuggccaacauggugaaaccucaucuc

SEQ ID NO: 97842 - RNA, 32 nt, Human
ccagccuggccaacauggugaaaccuccgucu

SEQ ID NO: 97843 - RNA, 32 nt, Human
ccagccuggccaacauggugaaaccucgucuc

SEQ ID NO: 97844 - RNA, 32 nt, Human
ccagccuggccaacauggugaaaccucgucug

SEQ ID NO: 97845 - RNA, 32 nt, Human
ccagccuggccaacauggugaaaccucgucuu

SEQ ID NO: 97846 - RNA, 32 nt, Human
ccagccuggccaacauggugaaaccuggccuc

SEQ ID NO: 97847 - RNA, 32 nt, Human
ccagccuggccaacauggugaaaccuugucuc

SEQ ID NO: 97848 - RNA, 32 nt, Human
ccagccuggccaacauggugaaacuccgucuc

SEQ ID NO: 97849 - RNA, 32 nt, Human
ccagccuggccaacaugugaaaccccgucucc

SEQ ID NO: 97850 - RNA, 32 nt, Human
ccagccuggccaacguggugaaaccucgucua

SEQ ID NO: 97851 - RNA, 32 nt, Human
ccagccuggccaacguggugaaaccucgucug

SEQ ID NO: 97852 - RNA, 32 nt, Human
ccagccuggccaacuugaugaaaccccaucuc

SEQ ID NO: 97853 - RNA, 32 nt, Human
ccagccuggccaacuuggugaaaccuugucuc

SEQ ID NO: 97854 - RNA, 32 nt, Human
ccagccuggccaauauggugaaaccucgucuc

SEQ ID NO: 97855 - RNA, 32 nt, Human
ccagccuggccaaugugaugaaaccccgucuc

SEQ ID NO: 97856 - RNA, 22 nt, Human
ccagccuggccacagagcgaga

SEQ ID NO: 97857 - RNA, 19 nt, Human
ccagccuggccagacaaga

SEQ ID NO: 97858 - RNA, 32 nt, Human
ccagccuggccagcauggcgaaaccucgucuc

SEQ ID NO: 97859 - RNA, 20 nt, Human
ccagccuggccagcugcuca

SEQ ID NO: 97860 - RNA, 22 nt, Human
ccagccuggcccagggccggcu

SEQ ID NO: 97861 - RNA, 18 nt, Human
ccagccuggcccugagcu

SEQ ID NO: 97862 - RNA, 22 nt, Human
ccagccuggcgacaaagcgaga

SEQ ID NO: 97863 - RNA, 23 nt, Human
ccagccuggcgacaagagcgaga

SEQ ID NO: 97864 - RNA, 22 nt, Human
ccagccuggcgacagagcgaga

SEQ ID NO: 97865 - RNA, 32 nt, Human
ccagccuggcuaacauggugaaaccucaucuc

SEQ ID NO: 97866 - RNA, 32 nt, Human
ccagccuggcuaauauggugaaaccucgucuc

SEQ ID NO: 97867 - RNA, 32 nt, Human
ccagccuggcugacaccgugaaaccuugucuc

SEQ ID NO: 97868 - RNA, 23 nt, Human
ccagccuggcugacagagcgaga

SEQ ID NO: 97869 - RNA, 29 nt, Human
ccagccuggcugcuacugcccaccaggcc

SEQ ID NO: 97870 - RNA, 29 nt, Human
ccagccuggcugcugcugggcccugaaua

SEQ ID NO: 97871 - RNA, 24 nt, Human
ccagccugggaaacaagagugaaa

SEQ ID NO: 97872 - RNA, 23 nt, Human
ccagccugggagacagagcgaaa

SEQ ID NO: 97873 - RNA, 23 nt, Human
ccagccugggagacagagcgaga

SEQ ID NO: 97874 - RNA, 32 nt, Human
ccagccugggagacagagucuugcucugucuc

SEQ ID NO: 97875 - RNA, 23 nt, Human
ccagccugggagacagagugaga

SEQ ID NO: 97876 - RNA, 32 nt, Human
ccagccugggagacagagugagacccugucuc

SEQ ID NO: 97877 - RNA, 32 nt, Human
ccagccugggagacagagugagacuccgucuc

SEQ ID NO: 97878 - RNA, 32 nt, Human
ccagccugggagaggccaagggcugccuccua

SEQ ID NO: 97879 - RNA, 19 nt, Human
ccagccugggcaaaaagag

SEQ ID NO: 97880 - RNA, 32 nt, Human
ccagccugggcaaaagagugagacuccgucuc

SEQ ID NO: 97881 - RNA, 32 nt, Human
ccagccugggcaaaauagcaagaccuugccuc

SEQ ID NO: 97882 - RNA, 23 nt, Human
ccagccugggcaaaauagcgaga

SEQ ID NO: 97883 - RNA, 21 nt, Human
ccagccugggcaacaaaacga

SEQ ID NO: 97884 - RNA, 23 nt, Human
ccagccugggcaacaaaacgaga

SEQ ID NO: 97885 - RNA, 32 nt, Human
ccagccugggcaacaaaacgagacuucgucuc

SEQ ID NO: 97886 - RNA, 19 nt, Human
ccagccugggcaacaaagc

SEQ ID NO: 97887 - RNA, 32 nt, Human
ccagccugggcaacaaagcgagacuccaucuc

SEQ ID NO: 97888 - RNA, 23 nt, Human
ccagccugggcaacaaaguaaga

SEQ ID NO: 97889 - RNA, 23 nt, Human
ccagccugggcaacaaagugaga

SEQ ID NO: 97890 - RNA, 32 nt, Human
ccagccugggcaacaaagugagacccccaucu

SEQ ID NO: 97891 - RNA, 32 nt, Human
ccagccugggcaacaaagugagaccgagucuu

SEQ ID NO: 97892 - RNA, 32 nt, Human
ccagccugggcaacaaagugagacuccaucuc

SEQ ID NO: 97893 - RNA, 32 nt, Human
ccagccugggcaacaaagugagacucggucuc

SEQ ID NO: 97894 - RNA, 32 nt, Human
ccagccugggcaacaaagugagacucugccuc

SEQ ID NO: 97895 - RNA, 32 nt, Human
ccagccugggcaacaaagugagacucugucuc

SEQ ID NO: 97896 - RNA, 24 nt, Human
ccagccugggcaacaacagugaaa

SEQ ID NO: 97897 - RNA, 32 nt, Human
ccagccugggcaacaacagugaaacuccgucu

SEQ ID NO: 97898 - RNA, 32 nt, Human
ccagccugggcaacaagaacgaaacucugucu

SEQ ID NO: 97899 - RNA, 24 nt, Human
ccagccugggcaacaagaaugaaa

SEQ ID NO: 97900 - RNA, 32 nt, Human
ccagccugggcaacaagaaugaaacuccgucu

SEQ ID NO: 97901 - RNA, 19 nt, Human
ccagccugggcaacaagag

SEQ ID NO: 97902 - RNA, 24 nt, Human
ccagccugggcaacaagagaagaa

SEQ ID NO: 97903 - RNA, 32 nt, Human
ccagccugggcaacaagagaagaaacuccauc

SEQ ID NO: 97904 - RNA, 32 nt, Human
ccagccugggcaacaagagagaaacuccaucu

SEQ ID NO: 97905 - RNA, 24 nt, Human
ccagccugggcaacaagagagaag

SEQ ID NO: 97906 - RNA, 32 nt, Human
ccagccugggcaacaagagagaagguccuucu

SEQ ID NO: 97907 - RNA, 20 nt, Human
ccagccugggcaacaagagc

SEQ ID NO: 97908 - RNA, 32 nt, Human
ccagccugggcaacaagagcaaaacuucaucu

SEQ ID NO: 97909 - RNA, 32 nt, Human
ccagccugggcaacaagagcaagacucugucu

SEQ ID NO: 97910 - RNA, 22 nt, Human
ccagccugggcaacaagagcga

SEQ ID NO: 97911 - RNA, 24 nt, Human
ccagccugggcaacaagagcgaaa

SEQ ID NO: 97912 - RNA, 32 nt, Human
ccagccugggcaacaagagcgaaacucagucu

SEQ ID NO: 97913 - RNA, 32 nt, Human
ccagccugggcaacaagagcgaaacuccaucu

SEQ ID NO: 97914 - RNA, 32 nt, Human
ccagccugggcaacaagagcgaaacuccauuu

SEQ ID NO: 97915 - RNA, 32 nt, Human
ccagccugggcaacaagagcgaaacuccgucu

SEQ ID NO: 97916 - RNA, 32 nt, Human
ccagccugggcaacaagagcgaaacucuuguc

SEQ ID NO: 97917 - RNA, 23 nt, Human
ccagccugggcaacaagagcgag

SEQ ID NO: 97918 - RNA, 23 nt, Human
ccagccugggcaacaagaggaaa

SEQ ID NO: 97919 - RNA, 32 nt, Human
ccagccugggcaacaagaggaaaacccagucu

SEQ ID NO: 97920 - RNA, 22 nt, Human
ccagccugggcaacaagaggga

SEQ ID NO: 97921 - RNA, 24 nt, Human
ccagccugggcaacaagagggaaa

SEQ ID NO: 97922 - RNA, 32 nt, Human
ccagccugggcaacaagagggaaacuccgucu

SEQ ID NO: 97923 - RNA, 32 nt, Human
ccagccugggcaacaagagggaaacuccguuu

SEQ ID NO: 97924 - RNA, 20 nt, Human
ccagccugggcaacaagagu

SEQ ID NO: 97925 - RNA, 22 nt, Human
ccagccugggcaacaagaguaa

SEQ ID NO: 97926 - RNA, 24 nt, Human
ccagccugggcaacaagaguaaaa

SEQ ID NO: 97927 - RNA, 32 nt, Human
ccagccugggcaacaagaguaaaacuccaucu

SEQ ID NO: 97928 - RNA, 32 nt, Human
ccagccugggcaacaagaguaaaacuccgucu

SEQ ID NO: 97929 - RNA, 24 nt, Human
ccagccugggcaacaagaguaaga

SEQ ID NO: 97930 - RNA, 22 nt, Human
ccagccugggcaacaagaguga

SEQ ID NO: 97931 - RNA, 24 nt, Human
ccagccugggcaacaagagugaaa

SEQ ID NO: 97932 - RNA, 32 nt, Human
ccagccugggcaacaagagugaaacuccaucu

SEQ ID NO: 97933 - RNA, 32 nt, Human
ccagccugggcaacaagagugaaacuccgucu

SEQ ID NO: 97934 - RNA, 32 nt, Human
ccagccugggcaacaagagugaaacuccucug

SEQ ID NO: 97935 - RNA, 32 nt, Human
ccagccugggcaacaagagugaaacucuaucu

SEQ ID NO: 97936 - RNA, 32 nt, Human
ccagccugggcaacaagagugaaacucucucc

SEQ ID NO: 97937 - RNA, 32 nt, Human
ccagccugggcaacaagagugaaacucugccu

SEQ ID NO: 97938 - RNA, 32 nt, Human
ccagccugggcaacaagagugaaacucugucu

SEQ ID NO: 97939 - RNA, 32 nt, Human
ccagccugggcaacaagagugaaacugcaucu

SEQ ID NO: 97940 - RNA, 32 nt, Human
ccagccugggcaacaagagugaaacuuggucu

SEQ ID NO: 97941 - RNA, 32 nt, Human
ccagccugggcaacaagagugaaaugacgucu

SEQ ID NO: 97942 - RNA, 32 nt, Human
ccagccugggcaacaagagugaaccuccauca

SEQ ID NO: 97943 - RNA, 24 nt, Human
ccagccugggcaacaagagugaga

SEQ ID NO: 97944 - RNA, 32 nt, Human
ccagccugggcaacaagagugagacuccaucu

SEQ ID NO: 97945 - RNA, 32 nt, Human
ccagccugggcaacaagagugagacucccguc

SEQ ID NO: 97946 - RNA, 32 nt, Human
ccagccugggcaacaagagugagacuccgucu

SEQ ID NO: 97947 - RNA, 22 nt, Human
ccagccugggcaacaagagugg

SEQ ID NO: 97948 - RNA, 20 nt, Human
ccagccugggcaacaagcga

SEQ ID NO: 97949 - RNA, 22 nt, Human
ccagccugggcaacaagcgaaa

SEQ ID NO: 97950 - RNA, 32 nt, Human
ccagccugggcaacaagcgaaacucugucuca

SEQ ID NO: 97951 - RNA, 32 nt, Human
ccagccugggcaacaagcgagacuccgucuca

SEQ ID NO: 97952 - RNA, 20 nt, Human
ccagccugggcaacaagggc

SEQ ID NO: 97953 - RNA, 32 nt, Human
ccagccugggcaacaagugcaaaacucagucu

SEQ ID NO: 97954 - RNA, 24 nt, Human
ccagccugggcaacaagugcgaaa

SEQ ID NO: 97955 - RNA, 32 nt, Human
ccagccugggcaacaagugcgaaacuccaucu

SEQ ID NO: 97956 - RNA, 23 nt, Human
ccagccugggcaacacagagaga

SEQ ID NO: 97957 - RNA, 32 nt, Human
ccagccugggcaacacagaggacccucaccuc

SEQ ID NO: 97958 - RNA, 19 nt, Human
ccagccugggcaacacagc

SEQ ID NO: 97959 - RNA, 32 nt, Human
ccagccugggcaacacagcaagacccaucucu

SEQ ID NO: 97960 - RNA, 32 nt, Human
ccagccugggcaacacagcaagaccccauuuc

SEQ ID NO: 97961 - RNA, 21 nt, Human
ccagccugggcaacacagcga

SEQ ID NO: 97962 - RNA, 23 nt, Human
ccagccugggcaacacagcgaga

SEQ ID NO: 97963 - RNA, 32 nt, Human
ccagccugggcaacacagcgagaacuugucuc

SEQ ID NO: 97964 - RNA, 32 nt, Human
ccagccugggcaacacagcgagaccccaucuc

SEQ ID NO: 97965 - RNA, 32 nt, Human
ccagccugggcaacacagcgagacuccgucuc

SEQ ID NO: 97966 - RNA, 32 nt, Human
ccagccugggcaacacagcgagaucucuuggg

SEQ ID NO: 97967 - RNA, 22 nt, Human
ccagccugggcaacacaggaag

SEQ ID NO: 97968 - RNA, 32 nt, Human
ccagccugggcaacacaggaagaccccgucuc

SEQ ID NO: 97969 - RNA, 32 nt, Human
ccagccugggcaacacaggaugaccccaucuu

SEQ ID NO: 97970 - RNA, 23 nt, Human
ccagccugggcaacacagggaga

SEQ ID NO: 97971 - RNA, 32 nt, Human
ccagccugggcaacacagggagaccccgucuc

SEQ ID NO: 97972 - RNA, 32 nt, Human
ccagccugggcaacacagggagacgcucacuc

SEQ ID NO: 97973 - RNA, 32 nt, Human
ccagccugggcaacacagggagacuccaucuc

SEQ ID NO: 97974 - RNA, 32 nt, Human
ccagccugggcaacacagggaggcuaccucuc

SEQ ID NO: 97975 - RNA, 23 nt, Human
ccagccugggcaacacaguaaga

SEQ ID NO: 97976 - RNA, 21 nt, Human
ccagccugggcaacacaguga

SEQ ID NO: 97977 - RNA, 32 nt, Human
ccagccugggcaacacagugacaccugacucu

SEQ ID NO: 97978 - RNA, 23 nt, Human
ccagccugggcaacacagugaga

SEQ ID NO: 97979 - RNA, 32 nt, Human
ccagccugggcaacacagugagaacccucucu

SEQ ID NO: 97980 - RNA, 30 nt, Human
ccagccugggcaacacagugagacucuguc

SEQ ID NO: 97981 - RNA, 32 nt, Human
ccagccugggcaacacagugagacucugucuc

SEQ ID NO: 97982 - RNA, 32 nt, Human
ccagccugggcaacacagugagacuucauuuc

SEQ ID NO: 97983 - RNA, 22 nt, Human
ccagccugggcaacacgagcga

SEQ ID NO: 97984 - RNA, 24 nt, Human
ccagccugggcaacacgagcgaaa

SEQ ID NO: 97985 - RNA, 32 nt, Human
ccagccugggcaacacgagcgaaacuccgucu

SEQ ID NO: 97986 - RNA, 23 nt, Human
ccagccugggcaacacggugaaa

SEQ ID NO: 97987 - RNA, 32 nt, Human
ccagccugggcaacacggugaaaccccaucuc

SEQ ID NO: 97988 - RNA, 32 nt, Human
ccagccugggcaacacggugaaaccccgucuc

SEQ ID NO: 97989 - RNA, 18 nt, Human
ccagccugggcaacagaa

SEQ ID NO: 97990 - RNA, 23 nt, Human
ccagccugggcaacagaacaaga

SEQ ID NO: 97991 - RNA, 24 nt, Human
ccagccugggcaacagaacaagaa

SEQ ID NO: 97992 - RNA, 32 nt, Human
ccagccugggcaacagaacaagaacccaucuc

SEQ ID NO: 97993 - RNA, 23 nt, Human
ccagccugggcaacagaacagga

SEQ ID NO: 97994 - RNA, 21 nt, Human
ccagccugggcaacagaacga

SEQ ID NO: 97995 - RNA, 23 nt, Human
ccagccugggcaacagaacgaga

SEQ ID NO: 97996 - RNA, 32 nt, Human
ccagccugggcaacagaacgagauucugucuu

SEQ ID NO: 97997 - RNA, 22 nt, Human
ccagccugggcaacagaagaag

SEQ ID NO: 97998 - RNA, 32 nt, Human
ccagccugggcaacagaagaagaauccgucaa

SEQ ID NO: 97999 - RNA, 32 nt, Human
ccagccugggcaacagaagaagacuuugucac

SEQ ID NO: 98000 - RNA, 32 nt, Human
ccagccugggcaacagaaugagacccuuccgc

SEQ ID NO: 98001 - RNA, 18 nt, Human
ccagccugggcaacagag

SEQ ID NO: 98002 - RNA, 21 nt, Human
ccagccugggcaacagagaga

SEQ ID NO: 98003 - RNA, 23 nt, Human
ccagccugggcaacagagagaga

SEQ ID NO: 98004 - RNA, 32 nt, Human
ccagccugggcaacagagagagaccuugucuc

SEQ ID NO: 98005 - RNA, 32 nt, Human
ccagccugggcaacagagagcgacucucucaa

SEQ ID NO: 98006 - RNA, 19 nt, Human
ccagccugggcaacagagc

SEQ ID NO: 98007 - RNA, 32 nt, Human
ccagccugggcaacagagcaaaacuccaacuc

SEQ ID NO: 98008 - RNA, 31 nt, Human
ccagccugggcaacagagcaaaacuccgucu

SEQ ID NO: 98009 - RNA, 32 nt, Human
ccagccugggcaacagagcaaaacuuucagga

SEQ ID NO: 98010 - RNA, 23 nt, Human
ccagccugggcaacagagcaaga

SEQ ID NO: 98011 - RNA, 32 nt, Human
ccagccugggcaacagagcaagacccaucuca

SEQ ID NO: 98012 - RNA, 32 nt, Human
ccagccugggcaacagagcaagaccccauccu

SEQ ID NO: 98013 - RNA, 32 nt, Human
ccagccugggcaacagagcaagaccccaucuc

SEQ ID NO: 98014 - RNA, 32 nt, Human
ccagccugggcaacagagcaagaccucgucuc

SEQ ID NO: 98015 - RNA, 32 nt, Human
ccagccugggcaacagagcaagaccuugucuc

SEQ ID NO: 98016 - RNA, 32 nt, Human
ccagccugggcaacagagcaagacugccucaa

SEQ ID NO: 98017 - RNA, 32 nt, Human
ccagccugggcaacagagcaagacugucucaa

SEQ ID NO: 98018 - RNA, 32 nt, Human
ccagccugggcaacagagcaaggcucugucuc

SEQ ID NO: 98019 - RNA, 32 nt, Human
ccagccugggcaacagagcaaggcucuguuuu

SEQ ID NO: 98020 - RNA, 29 nt, Human
ccagccugggcaacagagccagacaucuc

SEQ ID NO: 98021 - RNA, 21 nt, Human
ccagccugggcaacagagcga

SEQ ID NO: 98022 - RNA, 32 nt, Human
ccagccugggcaacagagcgacacuccgucuc

SEQ ID NO: 98023 - RNA, 23 nt, Human
ccagccugggcaacagagcgaga

SEQ ID NO: 98024 - RNA, 32 nt, Human
ccagccugggcaacagagcgagacagucucaa

SEQ ID NO: 98025 - RNA, 32 nt, Human
ccagccugggcaacagagcgagaccaucucuu

SEQ ID NO: 98026 - RNA, 32 nt, Human
ccagccugggcaacagagcgagaccucuaucu

SEQ ID NO: 98027 - RNA, 32 nt, Human
ccagccugggcaacagagcgagacuacaucuc

SEQ ID NO: 98028 - RNA, 32 nt, Human
ccagccugggcaacagagcgagacucagucuc

SEQ ID NO: 98029 - RNA, 32 nt, Human
ccagccugggcaacagagcgagacuccaucuc

SEQ ID NO: 98030 - RNA, 32 nt, Human
ccagccugggcaacagagcgagacuccgccuc

SEQ ID NO: 98031 - RNA, 32 nt, Human
ccagccugggcaacagagcgagacuccgucuc

SEQ ID NO: 98032 - RNA, 32 nt, Human
ccagccugggcaacagagcgagacuucaucuc

SEQ ID NO: 98033 - RNA, 32 nt, Human
ccagccugggcaacagagcgagacuuugucuc

SEQ ID NO: 98034 - RNA, 32 nt, Human
ccagccugggcaacagagcgaggucccguuuc

SEQ ID NO: 98035 - RNA, 28 nt, Human
ccagccugggcaacagagcgugacucuc

SEQ ID NO: 98036 - RNA, 23 nt, Human
ccagccugggcaacagagggaga

SEQ ID NO: 98037 - RNA, 32 nt, Human
ccagccugggcaacagagggagacuccaucgc

SEQ ID NO: 98038 - RNA, 32 nt, Human
ccagccugggcaacagagggagacuccaucua

SEQ ID NO: 98039 - RNA, 32 nt, Human
ccagccugggcaacagagggagacuccaucuc

SEQ ID NO: 98040 - RNA, 32 nt, Human
ccagccugggcaacagagggagacuucaucuc

SEQ ID NO: 98041 - RNA, 19 nt, Human
ccagccugggcaacagagu

SEQ ID NO: 98042 - RNA, 23 nt, Human
ccagccugggcaacagaguaaaa

SEQ ID NO: 98043 - RNA, 32 nt, Human
ccagccugggcaacagaguaacucuccuucuc

SEQ ID NO: 98044 - RNA, 23 nt, Human
ccagccugggcaacagaguaaga

SEQ ID NO: 98045 - RNA, 32 nt, Human
ccagccugggcaacagaguaagaacugucuca

SEQ ID NO: 98046 - RNA, 32 nt, Human
ccagccugggcaacagaguaagacuccaucca

SEQ ID NO: 98047 - RNA, 32 nt, Human
ccagccugggcaacagaguaagacuccaucuu

SEQ ID NO: 98048 - RNA, 32 nt, Human
ccagccugggcaacagaguaagacuccgucuu

SEQ ID NO: 98049 - RNA, 32 nt, Human
ccagccugggcaacagaguaagauuccaucuc

SEQ ID NO: 98050 - RNA, 21 nt, Human
ccagccugggcaacagaguga

SEQ ID NO: 98051 - RNA, 23 nt, Human
ccagccugggcaacagagugaaa

SEQ ID NO: 98052 - RNA, 32 nt, Human
ccagccugggcaacagagugaaacucugucuc

SEQ ID NO: 98053 - RNA, 32 nt, Human
ccagccugggcaacagagugacacucugucuc

SEQ ID NO: 98054 - RNA, 23 nt, Human
ccagccugggcaacagagugaga

SEQ ID NO: 98055 - RNA, 32 nt, Human
ccagccugggcaacagagugagacccuaucuc

SEQ ID NO: 98056 - RNA, 32 nt, Human
ccagccugggcaacagagugagacccugccuc

SEQ ID NO: 98057 - RNA, 32 nt, Human
ccagccugggcaacagagugagacccugucuc

SEQ ID NO: 98058 - RNA, 32 nt, Human
ccagccugggcaacagagugagacccuguuuc

SEQ ID NO: 98059 - RNA, 32 nt, Human
ccagccugggcaacagagugagacgcugccuc

SEQ ID NO: 98060 - RNA, 32 nt, Human
ccagccugggcaacagagugagacuacgucuc

SEQ ID NO: 98061 - RNA, 32 nt, Human
ccagccugggcaacagagugagacuaucucaa

SEQ ID NO: 98062 - RNA, 32 nt, Human
ccagccugggcaacagagugagacuccaauuc

SEQ ID NO: 98063 - RNA, 32 nt, Human
ccagccugggcaacagagugagacuccaucuc

SEQ ID NO: 98064 - RNA, 32 nt, Human
ccagccugggcaacagagugagacucccucuc

SEQ ID NO: 98065 - RNA, 32 nt, Human
ccagccugggcaacagagugagacuccgucuc

SEQ ID NO: 98066 - RNA, 32 nt, Human
ccagccugggcaacagagugagacuccgucuu

SEQ ID NO: 98067 - RNA, 31 nt, Human
ccagccugggcaacagagugagacucuaucu

SEQ ID NO: 98068 - RNA, 32 nt, Human
ccagccugggcaacagagugagacucugcuuc

SEQ ID NO: 98069 - RNA, 32 nt, Human
ccagccugggcaacagagugagacucugucaa

SEQ ID NO: 98070 - RNA, 32 nt, Human
ccagccugggcaacagagugagacucugucuc

SEQ ID NO: 98071 - RNA, 32 nt, Human
ccagccugggcaacagagugagacucugucuu

SEQ ID NO: 98072 - RNA, 32 nt, Human
ccagccugggcaacagagugagacucuguuuc

SEQ ID NO: 98073 - RNA, 32 nt, Human
ccagccugggcaacagagugagacugucucaa

SEQ ID NO: 98074 - RNA, 32 nt, Human
ccagccugggcaacagagugagacuucgucuc

SEQ ID NO: 98075 - RNA, 32 nt, Human
ccagccugggcaacagagugagauccagucuc

SEQ ID NO: 98076 - RNA, 32 nt, Human
ccagccugggcaacagagugagauucugucuc

SEQ ID NO: 98077 - RNA, 32 nt, Human
ccagccugggcaacagaguggacuccaucgca

SEQ ID NO: 98078 - RNA, 32 nt, Human
ccagccugggcaacagagugggacuccaucuc

SEQ ID NO: 98079 - RNA, 22 nt, Human
ccagccugggcaacagaugaag

SEQ ID NO: 98080 - RNA, 32 nt, Human
ccagccugggcaacagcaagaccucaucucua

SEQ ID NO: 98081 - RNA, 32 nt, Human
ccagccugggcaacagcagcgaaacuccaucu

SEQ ID NO: 98082 - RNA, 21 nt, Human
ccagccugggcaacagcgaga

SEQ ID NO: 98083 - RNA, 23 nt, Human
ccagccugggcaacagcgugaga

SEQ ID NO: 98084 - RNA, 32 nt, Human
ccagccugggcaacagcgugagacuucaucuc

SEQ ID NO: 98085 - RNA, 24 nt, Human
ccagccugggcaacaggaguaaaa

SEQ ID NO: 98086 - RNA, 32 nt, Human
ccagccugggcaacagguaagacucugucuca

SEQ ID NO: 98087 - RNA, 22 nt, Human
ccagccugggcaacaggugaga

SEQ ID NO: 98088 - RNA, 32 nt, Human
ccagccugggcaacaggugagauucugucucc

SEQ ID NO: 98089 - RNA, 32 nt, Human
ccagccugggcaacagugacacucuuaucucc

SEQ ID NO: 98090 - RNA, 32 nt, Human
ccagccugggcaacagugagacucugcauaaa

SEQ ID NO: 98091 - RNA, 23 nt, Human
ccagccugggcaacagugugaga

SEQ ID NO: 98092 - RNA, 32 nt, Human
ccagccugggcaacagugugagaccuugucuc

SEQ ID NO: 98093 - RNA, 32 nt, Human
ccagccugggcaacauaacaagauccugucuc

SEQ ID NO: 98094 - RNA, 32 nt, Human
ccagccugggcaacauaauaagaccucauguc

SEQ ID NO: 98095 - RNA, 32 nt, Human
ccagccugggcaacauaaugagacccuguuuc

SEQ ID NO: 98096 - RNA, 32 nt, Human
ccagccugggcaacauaaugagaccucauguc

SEQ ID NO: 98097 - RNA, 23 nt, Human
ccagccugggcaacauacagaaa

SEQ ID NO: 98098 - RNA, 32 nt, Human
ccagccugggcaacauagaccucugucucuau

SEQ ID NO: 98099 - RNA, 23 nt, Human
ccagccugggcaacauagagaga

SEQ ID NO: 98100 - RNA, 32 nt, Human
ccagccugggcaacauagagagaccccaucuc

SEQ ID NO: 98101 - RNA, 32 nt, Human
ccagccugggcaacauagagagacccugucuc

SEQ ID NO: 98102 - RNA, 32 nt, Human
ccagccugggcaacauagagagaccucugucu

SEQ ID NO: 98103 - RNA, 19 nt, Human
ccagccugggcaacauagc

SEQ ID NO: 98104 - RNA, 32 nt, Human
ccagccugggcaacauagcaaaaccuaguccc

SEQ ID NO: 98105 - RNA, 32 nt, Human
ccagccugggcaacauagcaaaaccucaucuc

SEQ ID NO: 98106 - RNA, 32 nt, Human
ccagccugggcaacauagcaaaauccugucuc

SEQ ID NO: 98107 - RNA, 32 nt, Human
ccagccugggcaacauagcaaaaucucaucuc

SEQ ID NO: 98108 - RNA, 32 nt, Human
ccagccugggcaacauagcaagaccccaucuc

SEQ ID NO: 98109 - RNA, 32 nt, Human
ccagccugggcaacauagcaagaccccgucuc

SEQ ID NO: 98110 - RNA, 32 nt, Human
ccagccugggcaacauagcaagacuccaucuc

SEQ ID NO: 98111 - RNA, 32 nt, Human
ccagccugggcaacauagcaagaucccuuccc

SEQ ID NO: 98112 - RNA, 32 nt, Human
ccagccugggcaacauagcaagcuaugccucu

SEQ ID NO: 98113 - RNA, 32 nt, Human
ccagccugggcaacauagccagaccucgucuc

SEQ ID NO: 98114 - RNA, 23 nt, Human
ccagccugggcaacauagcgaga

SEQ ID NO: 98115 - RNA, 32 nt, Human
ccagccugggcaacauagcgagaccccaucuc

SEQ ID NO: 98116 - RNA, 32 nt, Human
ccagccugggcaacauagcgagacccccauug

SEQ ID NO: 98117 - RNA, 32 nt, Human
ccagccugggcaacauagcgagaccccuaucu

SEQ ID NO: 98118 - RNA, 32 nt, Human
ccagccugggcaacauagcgagaccucaucuc

SEQ ID NO: 98119 - RNA, 32 nt, Human
ccagccugggcaacauagcgagaccuuaucuc

SEQ ID NO: 98120 - RNA, 22 nt, Human
ccagccugggcaacauaggaag

SEQ ID NO: 98121 - RNA, 32 nt, Human
ccagccugggcaacauaggaagacuccgucuc

SEQ ID NO: 98122 - RNA, 23 nt, Human
ccagccugggcaacauagggaga

SEQ ID NO: 98123 - RNA, 32 nt, Human
ccagccugggcaacauagggagaccccaucuc

SEQ ID NO: 98124 - RNA, 32 nt, Human
ccagccugggcaacauagggagacccccaucu

SEQ ID NO: 98125 - RNA, 32 nt, Human
ccagccugggcaacauagggagacccugucuu

SEQ ID NO: 98126 - RNA, 32 nt, Human
ccagccugggcaacauagggaggccccgucuc

SEQ ID NO: 98127 - RNA, 32 nt, Human
ccagccugggcaacauagggggaucccaucuc

SEQ ID NO: 98128 - RNA, 23 nt, Human
ccagccugggcaacauaguaaga

SEQ ID NO: 98129 - RNA, 32 nt, Human
ccagccugggcaacauaguaagaccccaucuc

SEQ ID NO: 98130 - RNA, 32 nt, Human
ccagccugggcaacauaguaagaccucaucuc

SEQ ID NO: 98131 - RNA, 32 nt, Human
ccagccugggcaacauaguaagacgcugucuc

SEQ ID NO: 98132 - RNA, 32 nt, Human
ccagccugggcaacauaguaagacucagucuc

SEQ ID NO: 98133 - RNA, 21 nt, Human
ccagccugggcaacauaguga

SEQ ID NO: 98134 - RNA, 23 nt, Human
ccagccugggcaacauagugaaa

SEQ ID NO: 98135 - RNA, 32 nt, Human
ccagccugggcaacauagugaaaccgucucca

SEQ ID NO: 98136 - RNA, 23 nt, Human
ccagccugggcaacauagugaag

SEQ ID NO: 98137 - RNA, 32 nt, Human
ccagccugggcaacauagugaagccccaucuc

SEQ ID NO: 98138 - RNA, 23 nt, Human
ccagccugggcaacauagugaga

SEQ ID NO: 98139 - RNA, 32 nt, Human
ccagccugggcaacauagugagaaaaugucuc

SEQ ID NO: 98140 - RNA, 32 nt, Human
ccagccugggcaacauagugagaaccuuuuug

SEQ ID NO: 98141 - RNA, 32 nt, Human
ccagccugggcaacauagugagaaugcaucuc

SEQ ID NO: 98142 - RNA, 32 nt, Human
ccagccugggcaacauagugagacccaaucuc

SEQ ID NO: 98143 - RNA, 32 nt, Human
ccagccugggcaacauagugagaccccaucuc

SEQ ID NO: 98144 - RNA, 32 nt, Human
ccagccugggcaacauagugagacccccaucu

SEQ ID NO: 98145 - RNA, 32 nt, Human
ccagccugggcaacauagugagacccugccuc

SEQ ID NO: 98146 - RNA, 32 nt, Human
ccagccugggcaacauagugagacccuguauc

SEQ ID NO: 98147 - RNA, 32 nt, Human
ccagccugggcaacauagugagaccucaucuc

SEQ ID NO: 98148 - RNA, 32 nt, Human
ccagccugggcaacauagugagaccugccccc

SEQ ID NO: 98149 - RNA, 32 nt, Human
ccagccugggcaacauagugagaccuugucuc

SEQ ID NO: 98150 - RNA, 32 nt, Human
ccagccugggcaacauagugagacuccugucu

SEQ ID NO: 98151 - RNA, 32 nt, Human
ccagccugggcaacauagugagacucuguaca

SEQ ID NO: 98152 - RNA, 32 nt, Human
ccagccugggcaacauagugagacucuguuau

SEQ ID NO: 98153 - RNA, 32 nt, Human
ccagccugggcaacauagugagacucuugucu

SEQ ID NO: 98154 - RNA, 32 nt, Human
ccagccugggcaacauagugagacugucucua

SEQ ID NO: 98155 - RNA, 32 nt, Human
ccagccugggcaacauagugagacuucauuuc

SEQ ID NO: 98156 - RNA, 32 nt, Human
ccagccugggcaacauagugagaucccaucuc

SEQ ID NO: 98157 - RNA, 32 nt, Human
ccagccugggcaacauagugagauccugucuc

SEQ ID NO: 98158 - RNA, 32 nt, Human
ccagccugggcaacauagugaggccccugucu

SEQ ID NO: 98159 - RNA, 32 nt, Human
ccagccugggcaacauagugagugagaccuca

SEQ ID NO: 98160 - RNA, 32 nt, Human
ccagccugggcaacauagugauaccccaucuc

SEQ ID NO: 98161 - RNA, 32 nt, Human
ccagccugggcaacauagugauaccuugucuc

SEQ ID NO: 98162 - RNA, 32 nt, Human
ccagccugggcaacauagugggauccugucuc

SEQ ID NO: 98163 - RNA, 32 nt, Human
ccagccugggcaacauaugagaaacccgucuc

SEQ ID NO: 98164 - RNA, 32 nt, Human
ccagccugggcaacauaugggacaccccaccg

SEQ ID NO: 98165 - RNA, 32 nt, Human
ccagccugggcaacaucaggagauccuugucu

SEQ ID NO: 98166 - RNA, 32 nt, Human
ccagccugggcaacaucaugagacgucaucuc

SEQ ID NO: 98167 - RNA, 32 nt, Human
ccagccugggcaacaucgggagaccccaucuc

SEQ ID NO: 98168 - RNA, 32 nt, Human
ccagccugggcaacaugacaaaacugcaacuc

SEQ ID NO: 98169 - RNA, 24 nt, Human
ccagccugggcaacaugagugaaa

SEQ ID NO: 98170 - RNA, 32 nt, Human
ccagccugggcaacaugagugaaagucugacu

SEQ ID NO: 98171 - RNA, 32 nt, Human
ccagccugggcaacaugauaccgaaacuggca

SEQ ID NO: 98172 - RNA, 32 nt, Human
ccagccugggcaacaugaugaaaacuccgucu

SEQ ID NO: 98173 - RNA, 32 nt, Human
ccagccugggcaacaugaugugaaaacccauc

SEQ ID NO: 98174 - RNA, 32 nt, Human
ccagccugggcaacauggagaaaccccguuuc

SEQ ID NO: 98175 - RNA, 23 nt, Human
ccagccugggcaacauggagaga

SEQ ID NO: 98176 - RNA, 32 nt, Human
ccagccugggcaacauggcaaaaacccaccuc

SEQ ID NO: 98177 - RNA, 32 nt, Human
ccagccugggcaacauggcaaaacaccgucuc

SEQ ID NO: 98178 - RNA, 32 nt, Human
ccagccugggcaacauggcaaaaccccaucuc

SEQ ID NO: 98179 - RNA, 32 nt, Human
ccagccugggcaacauggcaaaaccccauuuc

SEQ ID NO: 98180 - RNA, 32 nt, Human
ccagccugggcaacauggcaaaacucagucug

SEQ ID NO: 98181 - RNA, 32 nt, Human
ccagccugggcaacauggcaagaccccaucua

SEQ ID NO: 98182 - RNA, 23 nt, Human
ccagccugggcaacauggcgaaa

SEQ ID NO: 98183 - RNA, 32 nt, Human
ccagccugggcaacauggcgaaaacccaucuc

SEQ ID NO: 98184 - RNA, 32 nt, Human
ccagccugggcaacauggcgaaaccccauuuc

SEQ ID NO: 98185 - RNA, 32 nt, Human
ccagccugggcaacauggcgaaacccugucuc

SEQ ID NO: 98186 - RNA, 23 nt, Human
ccagccugggcaacauggcgaga

SEQ ID NO: 98187 - RNA, 32 nt, Human
ccagccugggcaacauggcgagaccccaucuc

SEQ ID NO: 98188 - RNA, 32 nt, Human
ccagccugggcaacauggcgagauccugucuc

SEQ ID NO: 98189 - RNA, 32 nt, Human
ccagccugggcaacauggcgaggccucugucu

SEQ ID NO: 98190 - RNA, 32 nt, Human
ccagccugggcaacauggcuaaaccccgucuc

SEQ ID NO: 98191 - RNA, 23 nt, Human
ccagccugggcaacauggggaaa

SEQ ID NO: 98192 - RNA, 32 nt, Human
ccagccugggcaacauggggaaacuccaucuc

SEQ ID NO: 98193 - RNA, 23 nt, Human
ccagccugggcaacauggggaga

SEQ ID NO: 98194 - RNA, 32 nt, Human
ccagccugggcaacauggggagacccagucuc

SEQ ID NO: 98195 - RNA, 23 nt, Human
ccagccugggcaacaugguaaaa

SEQ ID NO: 98196 - RNA, 32 nt, Human
ccagccugggcaacaugguaaaacucugucuc

SEQ ID NO: 98197 - RNA, 23 nt, Human
ccagccugggcaacauggugaaa

SEQ ID NO: 98198 - RNA, 32 nt, Human
ccagccugggcaacauggugaaacccaguuuc

SEQ ID NO: 98199 - RNA, 32 nt, Human
ccagccugggcaacauggugaaaccccaucuc

SEQ ID NO: 98200 - RNA, 32 nt, Human
ccagccugggcaacauggugaaaccccguccc

SEQ ID NO: 98201 - RNA, 32 nt, Human
ccagccugggcaacauggugaaaccccgucuc

SEQ ID NO: 98202 - RNA, 32 nt, Human
ccagccugggcaacauggugaaacccuaucuc

SEQ ID NO: 98203 - RNA, 32 nt, Human
ccagccugggcaacauggugaaacccugucgg

SEQ ID NO: 98204 - RNA, 32 nt, Human
ccagccugggcaacauggugaaacccugucuc

SEQ ID NO: 98205 - RNA, 32 nt, Human
ccagccugggcaacauggugaaacccuguuuc

SEQ ID NO: 98206 - RNA, 32 nt, Human
ccagccugggcaacauggugaaaccucaucuc

SEQ ID NO: 98207 - RNA, 32 nt, Human
ccagccugggcaacauggugaaaucccauguc

SEQ ID NO: 98208 - RNA, 32 nt, Human
ccagccugggcaacauggugaaaucccgucac

SEQ ID NO: 98209 - RNA, 32 nt, Human
ccagccugggcaacauggugaaauccugucuc

SEQ ID NO: 98210 - RNA, 23 nt, Human
ccagccugggcaacauggugaag

SEQ ID NO: 98211 - RNA, 32 nt, Human
ccagccugggcaacauggugaagccccaucuc

SEQ ID NO: 98212 - RNA, 32 nt, Human
ccagccugggcaacauggugaagccucauauc

SEQ ID NO: 98213 - RNA, 23 nt, Human
ccagccugggcaacauggugaga

SEQ ID NO: 98214 - RNA, 32 nt, Human
ccagccugggcaacauggugagaccaauugac

SEQ ID NO: 98215 - RNA, 32 nt, Human
ccagccugggcaacauggugagaccccaucuc

SEQ ID NO: 98216 - RNA, 32 nt, Human
ccagccugggcaacauggugagaccccgucuc

SEQ ID NO: 98217 - RNA, 32 nt, Human
ccagccugggcaacauggugagauuucaucuc

SEQ ID NO: 98218 - RNA, 23 nt, Human
ccagccugggcaacauugggaga

SEQ ID NO: 98219 - RNA, 32 nt, Human
ccagccugggcaacauugggagacuccaucuc

SEQ ID NO: 98220 - RNA, 32 nt, Human
ccagccugggcaaccuaaugagaguuccucca

SEQ ID NO: 98221 - RNA, 32 nt, Human
ccagccugggcaacgaaaagugaaacucuguc

SEQ ID NO: 98222 - RNA, 24 nt, Human
ccagccugggcaacgagagggaaa

SEQ ID NO: 98223 - RNA, 24 nt, Human
ccagccugggcaacgagagugaaa

SEQ ID NO: 98224 - RNA, 32 nt, Human
ccagccugggcaacgagagugaaacuccgucc

SEQ ID NO: 98225 - RNA, 18 nt, Human
ccagccugggcaacgagc

SEQ ID NO: 98226 - RNA, 22 nt, Human
ccagccugggcaacgagcgaaa

SEQ ID NO: 98227 - RNA, 31 nt, Human
ccagccugggcaacgagcgaaacuacaucuc

SEQ ID NO: 98228 - RNA, 32 nt, Human
ccagccugggcaacgagcgaaacuccaucuca

SEQ ID NO: 98229 - RNA, 22 nt, Human
ccagccugggcaacgagugaaa

SEQ ID NO: 98230 - RNA, 32 nt, Human
ccagccugggcaacgagugaaacuccgucuca

SEQ ID NO: 98231 - RNA, 32 nt, Human
ccagccugggcaacgagugcaaaacucagucu

SEQ ID NO: 98232 - RNA, 19 nt, Human
ccagccugggcaacggagc

SEQ ID NO: 98233 - RNA, 23 nt, Human
ccagccugggcaacggagugaga

SEQ ID NO: 98234 - RNA, 32 nt, Human
ccagccugggcaacggagugagacuccaucuc

SEQ ID NO: 98235 - RNA, 32 nt, Human
ccagccugggcaacggagugagacucugucuc

SEQ ID NO: 98236 - RNA, 22 nt, Human
ccagccugggcaacgggcgaga

SEQ ID NO: 98237 - RNA, 32 nt, Human
ccagccugggcaacguagcaagaccuugccuc

SEQ ID NO: 98238 - RNA, 32 nt, Human
ccagccugggcaacguaguaaaaccucaucua

SEQ ID NO: 98239 - RNA, 32 nt, Human
ccagccugggcaacguagucagaccccaucuc

SEQ ID NO: 98240 - RNA, 32 nt, Human
ccagccugggcaacguauugagaccaugucua

SEQ ID NO: 98241 - RNA, 32 nt, Human
ccagccugggcaacgugacgaaaccccaucuc

SEQ ID NO: 98242 - RNA, 23 nt, Human
ccagccugggcaacguggcgaaa

SEQ ID NO: 98243 - RNA, 32 nt, Human
ccagccugggcaacguggugaaaccccaucuc

SEQ ID NO: 98244 - RNA, 32 nt, Human
ccagccugggcaacguggugaaacccugucuc

SEQ ID NO: 98245 - RNA, 32 nt, Human
ccagccugggcaacguggugagacccugucuc

SEQ ID NO: 98246 - RNA, 32 nt, Human
ccagccugggcaacuuagugaggccccgucuc

SEQ ID NO: 98247 - RNA, 32 nt, Human
ccagccugggcaagagaaugacacucugucaa

SEQ ID NO: 98248 - RNA, 32 nt, Human
ccagccugggcaagauagcaagaccuugccuc

SEQ ID NO: 98249 - RNA, 32 nt, Human
ccagccugggcaagauggcaagaccuuguuuc

SEQ ID NO: 98250 - RNA, 32 nt, Human
ccagccugggcaagauggugaaaccccaucuc

SEQ ID NO: 98251 - RNA, 20 nt, Human
ccagccugggcaauaagagc

SEQ ID NO: 98252 - RNA, 24 nt, Human
ccagccugggcaauaagagcgaaa

SEQ ID NO: 98253 - RNA, 32 nt, Human
ccagccugggcaauaagagcgaaacuccaucu

SEQ ID NO: 98254 - RNA, 24 nt, Human
ccagccugggcaauaagagugaaa

SEQ ID NO: 98255 - RNA, 32 nt, Human
ccagccugggcaauaagagugaaacucugucu

SEQ ID NO: 98256 - RNA, 23 nt, Human
ccagccugggcaauacagcgaga

SEQ ID NO: 98257 - RNA, 32 nt, Human
ccagccugggcaauacagcgagaacccaucgc

SEQ ID NO: 98258 - RNA, 32 nt, Human
ccagccugggcaauagagugagacuccgucuc

SEQ ID NO: 98259 - RNA, 32 nt, Human
ccagccugggcaauagagugagacuccguuuc

SEQ ID NO: 98260 - RNA, 32 nt, Human
ccagccugggcaauagagugagacucugucuc

SEQ ID NO: 98261 - RNA, 31 nt, Human
ccagccugggcaauagagugagacucuguuu

SEQ ID NO: 98262 - RNA, 32 nt, Human
ccagccugggcaauagagugagauuccgucuc

SEQ ID NO: 98263 - RNA, 32 nt, Human
ccagccugggcaauauagcaagaccccauccu

SEQ ID NO: 98264 - RNA, 32 nt, Human
ccagccugggcaauauagcaagaccccucacu

SEQ ID NO: 98265 - RNA, 32 nt, Human
ccagccugggcaauauagcgagacuucauuuc

SEQ ID NO: 98266 - RNA, 23 nt, Human
ccagccugggcaauauagggaaa

SEQ ID NO: 98267 - RNA, 32 nt, Human
ccagccugggcaauauagugagaccccaucuc

SEQ ID NO: 98268 - RNA, 32 nt, Human
ccagccugggcaauauagugagaccguaucac

SEQ ID NO: 98269 - RNA, 32 nt, Human
ccagccugggcaauauagugagaccucugucu

SEQ ID NO: 98270 - RNA, 32 nt, Human
ccagccugggcaauaucgugagaccccaucuc

SEQ ID NO: 98271 - RNA, 32 nt, Human
ccagccugggcaauauggugagacuccaucuc

SEQ ID NO: 98272 - RNA, 32 nt, Human
ccagccugggcaauggagugagacuccugucu

SEQ ID NO: 98273 - RNA, 32 nt, Human
ccagccugggcaaugugaugaaacucuguuac

SEQ ID NO: 98274 - RNA, 23 nt, Human
ccagccugggcaccagagcgaga

SEQ ID NO: 98275 - RNA, 32 nt, Human
ccagccugggcaccauggugaaaccucgucuu

SEQ ID NO: 98276 - RNA, 18 nt, Human
ccagccugggcagcaaga

SEQ ID NO: 98277 - RNA, 20 nt, Human
ccagccugggcagcaagagc

SEQ ID NO: 98278 - RNA, 24 nt, Human
ccagccugggcagcaagagugaaa

SEQ ID NO: 98279 - RNA, 19 nt, Human
ccagccugggcagcagagc

SEQ ID NO: 98280 - RNA, 23 nt, Human
ccagccugggcagcagagcgaga

SEQ ID NO: 98281 - RNA, 23 nt, Human
ccagccugggccacagugcaaga

SEQ ID NO: 98282 - RNA, 19 nt, Human
ccagccugggccagaugag

SEQ ID NO: 98283 - RNA, 32 nt, Human
ccagccugggcccuggcucggucgcacacuca

SEQ ID NO: 98284 - RNA, 21 nt, Human
ccagccugggcgacaaagcaa

SEQ ID NO: 98285 - RNA, 21 nt, Human
ccagccugggcgacaaagcga

SEQ ID NO: 98286 - RNA, 23 nt, Human
ccagccugggcgacaaagcgaga

SEQ ID NO: 98287 - RNA, 20 nt, Human
ccagccugggcgacaagagc

SEQ ID NO: 98288 - RNA, 32 nt, Human
ccagccugggcgacaagagcaagacucugucu

SEQ ID NO: 98289 - RNA, 24 nt, Human
ccagccugggcgacaagagcgaaa

SEQ ID NO: 98290 - RNA, 24 nt, Human
ccagccugggcgacaagagcgaga

SEQ ID NO: 98291 - RNA, 24 nt, Human
ccagccugggcgacaagagugaaa

SEQ ID NO: 98292 - RNA, 19 nt, Human
ccagccugggcgacacagc

SEQ ID NO: 98293 - RNA, 21 nt, Human
ccagccugggcgacacagcga

SEQ ID NO: 98294 - RNA, 23 nt, Human
ccagccugggcgacagaacgaga

SEQ ID NO: 98295 - RNA, 25 nt, Human
ccagccugggcgacagagaaccucu

SEQ ID NO: 98296 - RNA, 19 nt, Human
ccagccugggcgacagagc

SEQ ID NO: 98297 - RNA, 23 nt, Human
ccagccugggcgacagagccaga

SEQ ID NO: 98298 - RNA, 21 nt, Human
ccagccugggcgacagagcga

SEQ ID NO: 98299 - RNA, 23 nt, Human
ccagccugggcgacagagcgaaa

SEQ ID NO: 98300 - RNA, 23 nt, Human
ccagccugggcgacagagcgaga

SEQ ID NO: 98301 - RNA, 23 nt, Human
ccagccugggcgacagggugaga

SEQ ID NO: 98302 - RNA, 22 nt, Human
ccagccugggcgacgagugaaa

SEQ ID NO: 98303 - RNA, 23 nt, Human
ccagccugggcgacggagcgaga

SEQ ID NO: 98304 - RNA, 23 nt, Human
ccagccugggcgauggagcgaga

SEQ ID NO: 98305 - RNA, 18 nt, Human
ccagccugggcgccgaga

SEQ ID NO: 98306 - RNA, 20 nt, Human
ccagccugggcuacaagagc

SEQ ID NO: 98307 - RNA, 23 nt, Human
ccagccugggcuacagagcgaga

SEQ ID NO: 98308 - RNA, 24 nt, Human
ccagccuggggagacagagcgaga

SEQ ID NO: 98309 - RNA, 32 nt, Human
ccagccuggggagacagagcgagauucugugu

SEQ ID NO: 98310 - RNA, 32 nt, Human
ccagccuggggcucucagcaggaggacccuuu

SEQ ID NO: 98311 - RNA, 23 nt, Human
ccagccugggggaaagagugaaa

SEQ ID NO: 98312 - RNA, 23 nt, Human
ccagccugggggacagagcgaga

SEQ ID NO: 98313 - RNA, 19 nt, Human
ccagccugggggaggggga

SEQ ID NO: 98314 - RNA, 32 nt, Human
ccagccugggggcuggugaccacagcaccccc

SEQ ID NO: 98315 - RNA, 32 nt, Human
ccagccuggggucccuggaggacaggucacau

SEQ ID NO: 98316 - RNA, 23 nt, Human
ccagccuggguaacaaagugaga

SEQ ID NO: 98317 - RNA, 20 nt, Human
ccagccuggguaacaagagc

SEQ ID NO: 98318 - RNA, 23 nt, Human
ccagccuggguaacagagcgaga

SEQ ID NO: 98319 - RNA, 18 nt, Human
ccagccuggguccugcca

SEQ ID NO: 98320 - RNA, 32 nt, Human
ccagccugggugacaagagcaagacuccgugu

SEQ ID NO: 98321 - RNA, 24 nt, Human
ccagccugggugacaagagcgaaa

SEQ ID NO: 98322 - RNA, 24 nt, Human
ccagccugggugacaagagugaaa

SEQ ID NO: 98323 - RNA, 23 nt, Human
ccagccugggugacagaacgaga

SEQ ID NO: 98324 - RNA, 23 nt, Human
ccagccugggugacagaaugaaa

SEQ ID NO: 98325 - RNA, 32 nt, Human
ccagccugggugacagaaugaaacuccaucac

SEQ ID NO: 98326 - RNA, 23 nt, Human
ccagccugggugacagagcaaga

SEQ ID NO: 98327 - RNA, 21 nt, Human
ccagccugggugacagagcga

SEQ ID NO: 98328 - RNA, 23 nt, Human
ccagccugggugacagagcgaga

SEQ ID NO: 98329 - RNA, 23 nt, Human
ccagccugggugacagagggaaa

SEQ ID NO: 98330 - RNA, 23 nt, Human
ccagccugggugacagugugaga

SEQ ID NO: 98331 - RNA, 22 nt, Human
ccagccugggugacgagugaaa

SEQ ID NO: 98332 - RNA, 19 nt, Human
ccagccugggugacggagu

SEQ ID NO: 98333 - RNA, 23 nt, Human
ccagccugggugacugagcgaga

SEQ ID NO: 98334 - RNA, 24 nt, Human
ccagccugggugagaagagcgaaa

SEQ ID NO: 98335 - RNA, 32 nt, Human
ccagccugggugauaagagcaagacucuugcc

SEQ ID NO: 98336 - RNA, 24 nt, Human
ccagccugggugauaagagugaaa

SEQ ID NO: 98337 - RNA, 32 nt, Human
ccagccuggguggacagagcaagacuccgucu

SEQ ID NO: 98338 - RNA, 23 nt, Human
ccagccuggguggcagagcgaga

SEQ ID NO: 98339 - RNA, 23 nt, Human
ccagccugggugucagagcgaga

SEQ ID NO: 98340 - RNA, 23 nt, Human
ccagccuggguuacagagcgaga

SEQ ID NO: 98341 - RNA, 23 nt, Human
ccagccuggucaacauggugaaa

SEQ ID NO: 98342 - RNA, 32 nt, Human
ccagccuggucaacauggugaaaccuugucuc

SEQ ID NO: 98343 - RNA, 24 nt, Human
ccagccuggucgacaagagagaaa

SEQ ID NO: 98344 - RNA, 32 nt, Human
ccagccuggucucaaacuccccagcuaaagca

SEQ ID NO: 98345 - RNA, 22 nt, Human
ccagccuggugacagagcgaga

SEQ ID NO: 98346 - RNA, 32 nt, Human
ccagccugguggcagaggaagcagguggcacc

SEQ ID NO: 98347 - RNA, 32 nt, Human
ccagccugguguccuccuucaucccaggcugc

SEQ ID NO: 98348 - RNA, 22 nt, Human
ccagccugguuacagagcgaga

SEQ ID NO: 98349 - RNA, 32 nt, Human
ccagccugguugggugacuuugugggagccac

SEQ ID NO: 98350 - RNA, 21 nt, Human
ccagccugucacgucaugccu

SEQ ID NO: 98351 - RNA, 20 nt, Human
ccagccuguccaagggcaug

SEQ ID NO: 98352 - RNA, 21 nt, Human
ccagccuguccaugcacggcu

SEQ ID NO: 98353 - RNA, 32 nt, Human
ccagccugucccucauuacccaaggcaagggg

SEQ ID NO: 98354 - RNA, 24 nt, Human
ccagccugucguuagggcauggcu

SEQ ID NO: 98355 - RNA, 22 nt, Human
ccagccugugcaacaagcgaaa

SEQ ID NO: 98356 - RNA, 32 nt, Human
ccagccugugccagucugaccuggaggccgug

SEQ ID NO: 98357 - RNA, 24 nt, Human
ccagccugugcgacaagagcgaaa

SEQ ID NO: 98358 - RNA, 32 nt, Human
ccagccuguggcccccagccuccuggaaaaca

SEQ ID NO: 98359 - RNA, 23 nt, Human
ccagccuguuccagccagugccu

SEQ ID NO: 98360 - RNA, 21 nt, Human
ccagccuguucucucccaguc

SEQ ID NO: 98361 - RNA, 19 nt, Human
ccagccuuacuggguccuu

SEQ ID NO: 98362 - RNA, 31 nt, Human
ccagccuucaauaaauagcauuugaauuugc

SEQ ID NO: 98363 - RNA, 20 nt, Human
ccagccuuccacuuuuccca

SEQ ID NO: 98364 - RNA, 32 nt, Human
ccagccuucccaacaugccuccugcccugcua

SEQ ID NO: 98365 - RNA, 22 nt, Human
ccagccuucccaugccgggcca

SEQ ID NO: 98366 - RNA, 32 nt, Human
ccagccuuccccauaucuccugccucagcccc

SEQ ID NO: 98367 - RNA, 32 nt, Human
ccagccuuccgaguagcugggauuacagggau

SEQ ID NO: 98368 - RNA, 32 nt, Human
ccagccuuccuccucacucacccuccagccau

SEQ ID NO: 98369 - RNA, 23 nt, Human
ccagccuucguccuccuggcccg

SEQ ID NO: 98370 - RNA, 32 nt, Human
ccagccuucuacugcucuccuccaccucaacu

SEQ ID NO: 98371 - RNA, 22 nt, Human
ccagccuucugagagguggcug

SEQ ID NO: 98372 - RNA, 32 nt, Human
ccagccuucuugcugcuaucaacucccaagag

SEQ ID NO: 98373 - RNA, 32 nt, Human
ccagccuugaauuaggauuccauaggagagcu

SEQ ID NO: 98374 - RNA, 32 nt, Human
ccagccuugacacuccccuugcaaaccauccc

SEQ ID NO: 98375 - RNA, 32 nt, Human
ccagccuugcacuccaaggcugcgcaccgcca

SEQ ID NO: 98376 - RNA, 32 nt, Human
ccagccuugcagccaggugcaguggcucacac

SEQ ID NO: 98377 - RNA, 32 nt, Human
ccagccuugcagccuccagguccgguggggau

SEQ ID NO: 98378 - RNA, 32 nt, Human
ccagccuugccgccgccugccugcuccgccgc

SEQ ID NO: 98379 - RNA, 32 nt, Human
ccagccuugccuggcucucgccuucuugcucu

SEQ ID NO: 98380 - RNA, 32 nt, Human
ccagccuugcuguuaggcaccaugacuccaag

SEQ ID NO: 98381 - RNA, 32 nt, Human
ccagccuuggcaacauaaugagacacugucac

SEQ ID NO: 98382 - RNA, 32 nt, Human
ccagccuuggcaacauggugaaaccccaucuc

SEQ ID NO: 98383 - RNA, 24 nt, Human
ccagccuugggcaagaugccucag

SEQ ID NO: 98384 - RNA, 25 nt, Human
ccagccuugggcgacaaaaacgaaa

SEQ ID NO: 98385 - RNA, 32 nt, Human
ccagccuugguggggaccaagcagccuuuccc

SEQ ID NO: 98386 - RNA, 32 nt, Human
ccagccuuguccgcaaccucaggggccuggga

SEQ ID NO: 98387 - RNA, 32 nt, Human
ccagccuuuauugccacugugugccagucauu

SEQ ID NO: 98388 - RNA, 21 nt, Human
ccagccuuuccacggcgccca

SEQ ID NO: 98389 - RNA, 32 nt, Human
ccagccuuucccaauuagacuuccucuccuuc

SEQ ID NO: 98390 - RNA, 24 nt, Human
ccagccuuucccucccacccacuc

SEQ ID NO: 98391 - RNA, 22 nt, Human
ccagccuuuccguuggaauuca

SEQ ID NO: 98392 - RNA, 23 nt, Human
ccagccuuucgcccaggcgccca

SEQ ID NO: 98393 - RNA, 21 nt, Human
ccagccuuucggggccacuua

SEQ ID NO: 98394 - RNA, 26 nt, Human
ccagccuuucuccucuacguacugca

SEQ ID NO: 98395 - RNA, 32 nt, Human
ccagccuuucugugguaucugaugcaggaagg

SEQ ID NO: 98396 - RNA, 23 nt, Human
ccagccuuugcccgcuagacuca

SEQ ID NO: 98397 - RNA, 25 nt, Human
ccagccuuugcucccuccccgcugc

SEQ ID NO: 98398 - RNA, 32 nt, Human
ccagccuuugcuguagcacacacauauaucac

SEQ ID NO: 98399 - RNA, 32 nt, Human
ccagccuuugggccuccccagccagagcagcc

SEQ ID NO: 98400 - RNA, 32 nt, Human
ccagcgaaaccagcuucaucucccagagaaug

SEQ ID NO: 98401 - RNA, 32 nt, Human
ccagcgaaagaaaagagaagugacagaaacaa

SEQ ID NO: 98402 - RNA, 32 nt, Human
ccagcgaagccaucgcgcuccuugcggaggug

SEQ ID NO: 98403 - RNA, 32 nt, Human
ccagcgaauuuauauccuucaggaagcugguu

SEQ ID NO: 98404 - RNA, 19 nt, Human
ccagcgaccaggccuggag

SEQ ID NO: 98405 - RNA, 32 nt, Human
ccagcgaccucucugccucucuucuuccccuu

SEQ ID NO: 98406 - RNA, 32 nt, Human
ccagcgacugagagagccagaggcagagaggu

SEQ ID NO: 98407 - RNA, 32 nt, Human
ccagcgagacgggguuucauuauguuggccag

SEQ ID NO: 98408 - RNA, 32 nt, Human
ccagcgagccaccacagccaccagucccagaa

SEQ ID NO: 98409 - RNA, 32 nt, Human
ccagcgagcccacgagcccacagggaggaaug

SEQ ID NO: 98410 - RNA, 32 nt, Human
ccagcgaggaagcagcgcgcagcccgcggccc

SEQ ID NO: 98411 - RNA, 32 nt, Human
ccagcgaggccuuccuggaaggagugcugagc

SEQ ID NO: 98412 - RNA, 24 nt, Human
ccagcgaggggccaggccgggcca

SEQ ID NO: 98413 - RNA, 19 nt, Human
ccagcgaguaccccagcca

SEQ ID NO: 98414 - RNA, 19 nt, Human
ccagcgauggugcugccca

SEQ ID NO: 98415 - RNA, 21 nt, Human
ccagcgauuccaaacugcagc

SEQ ID NO: 98416 - RNA, 22 nt, Human
ccagcgcacaucgcuggcccca

SEQ ID NO: 98417 - RNA, 16 nt, Human
ccagcgcagggcucag

SEQ ID NO: 98418 - RNA, 32 nt, Human
ccagcgcagggugaagccugagagcccaaaug

SEQ ID NO: 98419 - RNA, 32 nt, Human
ccagcgcaggugugcgugggcagcccaggcag

SEQ ID NO: 98420 - RNA, 32 nt, Human
ccagcgcaggugugggacgggcggcggacuag

SEQ ID NO: 98421 - RNA, 18 nt, Human
ccagcgccacacauagca

SEQ ID NO: 98422 - RNA, 32 nt, Human
ccagcgccaccaggcuggaggcggagugggag

SEQ ID NO: 98423 - RNA, 16 nt, Human
ccagcgccacccagga

SEQ ID NO: 98424 - RNA, 32 nt, Human
ccagcgccaggccuggugccugccccaggagg

SEQ ID NO: 98425 - RNA, 32 nt, Human
ccagcgccaucuuucagaaggccucaucucca

SEQ ID NO: 98426 - RNA, 32 nt, Human
ccagcgccauguccagccagguggugggcauu

SEQ ID NO: 98427 - RNA, 32 nt, Human
ccagcgcccaggaguuggggauguccuacaaa

SEQ ID NO: 98428 - RNA, 32 nt, Human
ccagcgcccaucuccccuuccgugccccagag

SEQ ID NO: 98429 - RNA, 32 nt, Human
ccagcgccccgccuggaguggaugagccucuc

SEQ ID NO: 98430 - RNA, 32 nt, Human
ccagcgcccgccucgcccuccugcgccggucg

SEQ ID NO: 98431 - RNA, 32 nt, Human
ccagcgcccgggaggaggaugcagacgccgcg

SEQ ID NO: 98432 - RNA, 32 nt, Human
ccagcgcccuggaggaagaggaagaggaaccc

SEQ ID NO: 98433 - RNA, 32 nt, Human
ccagcgcccuggcaaaggcugacaacuggcug

SEQ ID NO: 98434 - RNA, 18 nt, Human
ccagcgccgccgccgccg

SEQ ID NO: 98435 - RNA, 23 nt, Human
ccagcgccgccgccgccgccgcc

SEQ ID NO: 98436 - RNA, 32 nt, Human
ccagcgccgcuccacccagcaggccugagccc

SEQ ID NO: 98437 - RNA, 32 nt, Human
ccagcgccuccccucaccgacuuuggccuuuu

SEQ ID NO: 98438 - RNA, 32 nt, Human
ccagcgccugcagaggcugagcagggaaaaag

SEQ ID NO: 98439 - RNA, 24 nt, Human
ccagcgccuuccuggagauagcug

SEQ ID NO: 98440 - RNA, 32 nt, Human
ccagcgcggauguuucugccacugcugggcuc

SEQ ID NO: 98441 - RNA, 32 nt, Human
ccagcgcggcccccgcgugccucccaggcucc

SEQ ID NO: 98442 - RNA, 22 nt, Human
ccagcgcgggcacggagccgcc

SEQ ID NO: 98443 - RNA, 31 nt, Human
ccagcgcgguuucagcauuuaauuuuaaggg

SEQ ID NO: 98444 - RNA, 32 nt, Human
ccagcgcguccuucugagcucagaccuugagc

SEQ ID NO: 98445 - RNA, 32 nt, Human
ccagcgcucagccugcgccauggguggucccg

SEQ ID NO: 98446 - RNA, 32 nt, Human
ccagcgcuccggagguggugggcgcgcgggca

SEQ ID NO: 98447 - RNA, 32 nt, Human
ccagcgcuccugccgccccucuugccccucag

SEQ ID NO: 98448 - RNA, 32 nt, Human
ccagcgcuccuggcgcccucuucucaucgcuu

SEQ ID NO: 98449 - RNA, 32 nt, Human
ccagcgcucugccucaccgcuucccuccugcc

SEQ ID NO: 98450 - RNA, 32 nt, Human
ccagcgcugagauuuggugguucugcaugugu

SEQ ID NO: 98451 - RNA, 32 nt, Human
ccagcgcugcagccccagccugagcagcagcc

SEQ ID NO: 98452 - RNA, 32 nt, Human
ccagcgcugccaccccacccagcgcugccagg

SEQ ID NO: 98453 - RNA, 32 nt, Human
ccagcgcugccucugcugccgggccuggacca

SEQ ID NO: 98454 - RNA, 23 nt, Human
ccagcgcuggcugccgccaucuc

SEQ ID NO: 98455 - RNA, 19 nt, Human
ccagcggaagcacagcuca

SEQ ID NO: 98456 - RNA, 32 nt, Human
ccagcggaagcacagcucagagcuggucugcc

SEQ ID NO: 98457 - RNA, 32 nt, Human
ccagcggagagggcccggcgcaggggaucugc

SEQ ID NO: 98458 - RNA, 32 nt, Human
ccagcggagaggggcggaagccgcaagggacc

SEQ ID NO: 98459 - RNA, 22 nt, Human
ccagcggagccagcugagcccg

SEQ ID NO: 98460 - RNA, 32 nt, Human
ccagcggagcgcugggugucagugagcagcga

SEQ ID NO: 98461 - RNA, 21 nt, Human
ccagcggagggcaccggcccg

SEQ ID NO: 98462 - RNA, 32 nt, Human
ccagcggaugcaacuucuauccucaguccagu

SEQ ID NO: 98463 - RNA, 22 nt, Human
ccagcggcaagcaccggucccg

SEQ ID NO: 98464 - RNA, 32 nt, Human
ccagcggcagcagggugagggagcagcacaga

SEQ ID NO: 98465 - RNA, 32 nt, Human
ccagcggcauggugacccagcucugccggugg

SEQ ID NO: 98466 - RNA, 32 nt, Human
ccagcggccacaggcucaaccugcacuuccua

SEQ ID NO: 98467 - RNA, 22 nt, Human
ccagcggccagagccucaguga

SEQ ID NO: 98468 - RNA, 32 nt, Human
ccagcggccccucccacacacacccacacacu

SEQ ID NO: 98469 - RNA, 32 nt, Human
ccagcggccugccgggaguugcagugaaccca

SEQ ID NO: 98470 - RNA, 16 nt, Human
ccagcggcggagccag

SEQ ID NO: 98471 - RNA, 21 nt, Human
ccagcggcucccccagcgcug

SEQ ID NO: 98472 - RNA, 32 nt, Human
ccagcggcucggggcuugcagggagggcggau

SEQ ID NO: 98473 - RNA, 32 nt, Human
ccagcggcucuuccuggacagugagagcaggg

SEQ ID NO: 98474 - RNA, 32 nt, Human
ccagcggcugugguugaccugccuuggggagc

SEQ ID NO: 98475 - RNA, 19 nt, Human
ccagcgggaggaggcgcgg

SEQ ID NO: 98476 - RNA, 21 nt, Human
ccagcgggccgggcacucgca

SEQ ID NO: 98477 - RNA, 31 nt, Human
ccagcgggcuugagcuggccugugucccucc

SEQ ID NO: 98478 - RNA, 32 nt, Human
ccagcggggacaccccagccacacagggaggc

SEQ ID NO: 98479 - RNA, 32 nt, Human
ccagcggggagaagagaggcggaacugcugug

SEQ ID NO: 98480 - RNA, 32 nt, Human
ccagcggggagcuguuucaagaguaccgguac

SEQ ID NO: 98481 - RNA, 29 nt, Human
ccagcggggaggacugcccaggagaccau

SEQ ID NO: 98482 - RNA, 32 nt, Human
ccagcggggauagaggcuucaaaagcuuugaa

SEQ ID NO: 98483 - RNA, 23 nt, Human
ccagcgggugggggauucugcug

SEQ ID NO: 98484 - RNA, 32 nt, Human
ccagcguccacaucguccucuggcaggagcuc

SEQ ID NO: 98485 - RNA, 32 nt, Human
ccagcguccauccagccccuguccucaccucu

SEQ ID NO: 98486 - RNA, 19 nt, Human
ccagcguccccuccuuccc

SEQ ID NO: 98487 - RNA, 20 nt, Human
ccagcguccccuccuuccca

SEQ ID NO: 98488 - RNA, 19 nt, Human
ccagcguccgccgccgccg

SEQ ID NO: 98489 - RNA, 32 nt, Human
ccagcgucgagagaagggacagcagugacauc

SEQ ID NO: 98490 - RNA, 20 nt, Human
ccagcgucgagcggcagcaa

SEQ ID NO: 98491 - RNA, 32 nt, Human
ccagcgucuagacuguagcaucuuccucugag

SEQ ID NO: 98492 - RNA, 32 nt, Human
ccagcgucucccagacuucucguacaguuaau

SEQ ID NO: 98493 - RNA, 21 nt, Human
ccagcgucuccccugcugcug

SEQ ID NO: 98494 - RNA, 23 nt, Human
ccagcgucuccccugcugcuguc

SEQ ID NO: 98495 - RNA, 18 nt, Human
ccagcgucuuccaucucu

SEQ ID NO: 98496 - RNA, 32 nt, Human
ccagcgugcaugacaguggagaggagggcgag

SEQ ID NO: 98497 - RNA, 20 nt, Human
ccagcgugccccucccucag

SEQ ID NO: 98498 - RNA, 22 nt, Human
ccagcgugcugggauuauaggc

SEQ ID NO: 98499 - RNA, 32 nt, Human
ccagcguggccaauucucugcugacugccaga

SEQ ID NO: 98500 - RNA, 32 nt, Human
ccagcguggcgcaguggcccugagcaguagug

SEQ ID NO: 98501 - RNA, 32 nt, Human
ccagcguggcggcugguguuggucagaugcac

SEQ ID NO: 98502 - RNA, 32 nt, Human
ccagcgugggcaacagagugagacuccaucuc

SEQ ID NO: 98503 - RNA, 32 nt, Human
ccagcgugggcaacuuagcgagacuccaucuc

SEQ ID NO: 98504 - RNA, 32 nt, Human
ccagcgugggcaccgggccgucucagccgugu

SEQ ID NO: 98505 - RNA, 32 nt, Human
ccagcgugguccuaggacaggaggagcuucgg

SEQ ID NO: 98506 - RNA, 32 nt, Human
ccagcguggugaagccucaucucugcugagaa

SEQ ID NO: 98507 - RNA, 32 nt, Human
ccagcguucccccuucaagagaaacacucauc

SEQ ID NO: 98508 - RNA, 32 nt, Human
ccagcguucccgcuccacaggucuccaggagu

SEQ ID NO: 98509 - RNA, 32 nt, Human
ccagcguucucacgccuguaaucccagcacuu

SEQ ID NO: 98510 - RNA, 32 nt, Human
ccagcuaaagcaguccuccagccucggccucc

SEQ ID NO: 98511 - RNA, 32 nt, Human
ccagcuaacaccuucauucaucccuaguucgg

SEQ ID NO: 98512 - RNA, 32 nt, Human
ccagcuaacguggcagaggaguugcgggucuc

SEQ ID NO: 98513 - RNA, 26 nt, Human
ccagcuaacucugaccugggagcccu

SEQ ID NO: 98514 - RNA, 32 nt, Human
ccagcuaagcaggagucuuuugugcuugagcc

SEQ ID NO: 98515 - RNA, 32 nt, Human
ccagcuaagcugguuggaguaggagcgauacc

SEQ ID NO: 98516 - RNA, 32 nt, Human
ccagcuaaggagaccuggacucuggguguggg

SEQ ID NO: 98517 - RNA, 32 nt, Human
ccagcuaauuuuuguauuuuuguagagauggg

SEQ ID NO: 98518 - RNA, 32 nt, Human
ccagcuaauuuuuguauuuuuguuggccaggc

SEQ ID NO: 98519 - RNA, 32 nt, Human
ccagcuacacucgcuucaaccuggacagccau

SEQ ID NO: 98520 - RNA, 32 nt, Human
ccagcuacagaugggcagacacaugcccucuc

SEQ ID NO: 98521 - RNA, 32 nt, Human
ccagcuacaguugggccagcuguggccuuagu

SEQ ID NO: 98522 - RNA, 21 nt, Human
ccagcuacccaggaaggcuga

SEQ ID NO: 98523 - RNA, 20 nt, Human
ccagcuacccaggaggcuga

SEQ ID NO: 98524 - RNA, 20 nt, Human
ccagcuacccgggaggcuga

SEQ ID NO: 98525 - RNA, 32 nt, Human
ccagcuaccucucccuuggcagcugguacucc

SEQ ID NO: 98526 - RNA, 32 nt, Human
ccagcuacuagggaggcaggaggaucacuuga

SEQ ID NO: 98527 - RNA, 20 nt, Human
ccagcuacuagggaggcuga

SEQ ID NO: 98528 - RNA, 32 nt, Human
ccagcuacuauggagguugaggugggaggauc

SEQ ID NO: 98529 - RNA, 20 nt, Human
ccagcuacucaagaggcuga

SEQ ID NO: 98530 - RNA, 20 nt, Human
ccagcuacucagaaggccga

SEQ ID NO: 98531 - RNA, 20 nt, Human
ccagcuacucagaaggcuga

SEQ ID NO: 98532 - RNA, 20 nt, Human
ccagcuacucagaagguuga

SEQ ID NO: 98533 - RNA, 20 nt, Human
ccagcuacucaggaagcuga

SEQ ID NO: 98534 - RNA, 21 nt, Human
ccagcuacucaggaaggcuga

SEQ ID NO: 98535 - RNA, 20 nt, Human
ccagcuacucaggagacuga

SEQ ID NO: 98536 - RNA, 20 nt, Human
ccagcuacucaggaggccga

SEQ ID NO: 98537 - RNA, 20 nt, Human
ccagcuacucaggaggcuga

SEQ ID NO: 98538 - RNA, 20 nt, Human
ccagcuacucaggagguuga

SEQ ID NO: 98539 - RNA, 32 nt, Human
ccagcuacucaggagucugaggcaggagaauc

SEQ ID NO: 98540 - RNA, 32 nt, Human
ccagcuacucaggagucugaggcaggagaaug

SEQ ID NO: 98541 - RNA, 32 nt, Human
ccagcuacucagggacuucucuugccuggagg

SEQ ID NO: 98542 - RNA, 20 nt, Human
ccagcuacucaguaggcuga

SEQ ID NO: 98543 - RNA, 32 nt, Human
ccagcuacucauaaggcugaggugggaggauc

SEQ ID NO: 98544 - RNA, 20 nt, Human
ccagcuacucgagaggcuga

SEQ ID NO: 98545 - RNA, 20 nt, Human
ccagcuacucggaaggcuga

SEQ ID NO: 98546 - RNA, 20 nt, Human
ccagcuacucgggaaacuga

SEQ ID NO: 98547 - RNA, 20 nt, Human
ccagcuacucgggaagcuga

SEQ ID NO: 98548 - RNA, 20 nt, Human
ccagcuacucgggagacuga

SEQ ID NO: 98549 - RNA, 23 nt, Human
ccagcuacucgggagcccaacgc

SEQ ID NO: 98550 - RNA, 18 nt, Human
ccagcuacucgggaggcu

SEQ ID NO: 98551 - RNA, 20 nt, Human
ccagcuacucgggaggcuga

SEQ ID NO: 98552 - RNA, 32 nt, Human
ccagcuacucgggaggcugaggccguaggauc

SEQ ID NO: 98553 - RNA, 32 nt, Human
ccagcuacucgggaggugaggcaggagaaugg

SEQ ID NO: 98554 - RNA, 20 nt, Human
ccagcuacucgguaggcuga

SEQ ID NO: 98555 - RNA, 32 nt, Human
ccagcuacugaggaggcugaggcaggagaauc

SEQ ID NO: 98556 - RNA, 32 nt, Human
ccagcuacugaggaggcugaggcaugagaauu

SEQ ID NO: 98557 - RNA, 32 nt, Human
ccagcuacugaggaggcugaggugggaggauu

SEQ ID NO: 98558 - RNA, 32 nt, Human
ccagcuacugcccagcucuuuaucccuuaguu

SEQ ID NO: 98559 - RNA, 18 nt, Human
ccagcuacuuccaccucu

SEQ ID NO: 98560 - RNA, 32 nt, Human
ccagcuacuugaggcugagaugggaggaugag

SEQ ID NO: 98561 - RNA, 20 nt, Human
ccagcuacuugggaggcuga

SEQ ID NO: 98562 - RNA, 32 nt, Human
ccagcuacuugggaggcugagguggagggauc

SEQ ID NO: 98563 - RNA, 32 nt, Human
ccagcuacuuuacuugggaggcugaggcagga

SEQ ID NO: 98564 - RNA, 32 nt, Human
ccagcuagccucugucccauccccuguuauuu

SEQ ID NO: 98565 - RNA, 32 nt, Human
ccagcuagcucucgccucacugaggccucccc

SEQ ID NO: 98566 - RNA, 32 nt, Human
ccagcuaggccaggggccugaccugggcacug

SEQ ID NO: 98567 - RNA, 32 nt, Human
ccagcuaguggaguggagacugcagagggaga

SEQ ID NO: 98568 - RNA, 32 nt, Human
ccagcuauaaucuccccugccuuccuuuaauc

SEQ ID NO: 98569 - RNA, 32 nt, Human
ccagcuaucccagaggucgaggcugcagugag

SEQ ID NO: 98570 - RNA, 32 nt, Human
ccagcuauucaggagcuguuguaggagagauu

SEQ ID NO: 98571 - RNA, 20 nt, Human
ccagcuauuugggaggcuga

SEQ ID NO: 98572 - RNA, 32 nt, Human
ccagcucaaacacaccaauaaagcuuuuguua

SEQ ID NO: 98573 - RNA, 32 nt, Human
ccagcucaaccugaacaauccccucccacucg

SEQ ID NO: 98574 - RNA, 32 nt, Human
ccagcucaagagcugcguuugaggcacaccug

SEQ ID NO: 98575 - RNA, 20 nt, Human
ccagcucaagcaauccuccc

SEQ ID NO: 98576 - RNA, 32 nt, Human
ccagcucaagcaauccucccaccucagccucc

SEQ ID NO: 98577 - RNA, 22 nt, Human
ccagcucaagucucucuccccc

SEQ ID NO: 98578 - RNA, 32 nt, Human
ccagcucaccgccugcacugccaugccuggag

SEQ ID NO: 98579 - RNA, 23 nt, Human
ccagcucaccucaggcccugcca

SEQ ID NO: 98580 - RNA, 32 nt, Human
ccagcucacuccagaagaacugagacacagca

SEQ ID NO: 98581 - RNA, 19 nt, Human
ccagcucacuccucugggc

SEQ ID NO: 98582 - RNA, 32 nt, Human
ccagcucacugcaaccuccgccuccuggguuc

SEQ ID NO: 98583 - RNA, 32 nt, Human
ccagcucagagcagugccagccccaccgcaac

SEQ ID NO: 98584 - RNA, 23 nt, Human
ccagcucagagcuccucccaccc

SEQ ID NO: 98585 - RNA, 32 nt, Human
ccagcucagaggaggaggaaggugaagaugaa

SEQ ID NO: 98586 - RNA, 32 nt, Human
ccagcucagagggagcaggggcccagccaggg

SEQ ID NO: 98587 - RNA, 24 nt, Human
ccagcucagcagugucucguuccc

SEQ ID NO: 98588 - RNA, 32 nt, Human
ccagcucagccaugcuggccugucugcagagg

SEQ ID NO: 98589 - RNA, 32 nt, Human
ccagcucagccccucccaugcacauuuggacg

SEQ ID NO: 98590 - RNA, 21 nt, Human
ccagcucagccugccucccca

SEQ ID NO: 98591 - RNA, 32 nt, Human
ccagcucagcgaugcccccaggucccugggag

SEQ ID NO: 98592 - RNA, 21 nt, Human
ccagcucagcuaccacuuccc

SEQ ID NO: 98593 - RNA, 19 nt, Human
ccagcucagcucugagcca

SEQ ID NO: 98594 - RNA, 21 nt, Human
ccagcucaggacucgauucug

SEQ ID NO: 98595 - RNA, 20 nt, Human
ccagcucaggcaacaagagc

SEQ ID NO: 98596 - RNA, 23 nt, Human
ccagcucaggcccccacugcacc

SEQ ID NO: 98597 - RNA, 24 nt, Human
ccagcucaggccccuuuccuuccc

SEQ ID NO: 98598 - RNA, 20 nt, Human
ccagcucagggagccauccc

SEQ ID NO: 98599 - RNA, 22 nt, Human
ccagcucagggcucuuuccucc

SEQ ID NO: 98600 - RNA, 19 nt, Human
ccagcucaggggcagcuca

SEQ ID NO: 98601 - RNA, 22 nt, Human
ccagcucagucuucccuccccc

SEQ ID NO: 98602 - RNA, 32 nt, Human
ccagcucagugccuguccaguggugacgucca

SEQ ID NO: 98603 - RNA, 23 nt, Human
ccagcucaguggcccccgccccc

SEQ ID NO: 98604 - RNA, 19 nt, Human
ccagcucauacuuuccuuc

SEQ ID NO: 98605 - RNA, 24 nt, Human
ccagcucaucagccucccuguccc

SEQ ID NO: 98606 - RNA, 24 nt, Human
ccagcucaucagugccuccuugcc

SEQ ID NO: 98607 - RNA, 32 nt, Human
ccagcucauccaguccuggcacucggacuuga

SEQ ID NO: 98608 - RNA, 22 nt, Human
ccagcucaucgagcuucuuccc

SEQ ID NO: 98609 - RNA, 32 nt, Human
ccagcucaucuuugauucagugaccaacauac

SEQ ID NO: 98610 - RNA, 32 nt, Human
ccagcucaugcugcugaccacugacucagcuc

SEQ ID NO: 98611 - RNA, 21 nt, Human
ccagcucaugucuuccccaca

SEQ ID NO: 98612 - RNA, 32 nt, Human
ccagcucauuacagccuccaccucccaguuuc

SEQ ID NO: 98613 - RNA, 32 nt, Human
ccagcuccaaccugaagaagcuucuggagacc

SEQ ID NO: 98614 - RNA, 32 nt, Human
ccagcuccaagaagucagcacaccugcauuuu

SEQ ID NO: 98615 - RNA, 23 nt, Human
ccagcuccaagagugccgggagg

SEQ ID NO: 98616 - RNA, 22 nt, Human
ccagcuccaccucugggguuca

SEQ ID NO: 98617 - RNA, 32 nt, Human
ccagcuccagaagggaagggaguggagcaggc

SEQ ID NO: 98618 - RNA, 32 nt, Human
ccagcuccagcaggaaggaccccacauccuuc

SEQ ID NO: 98619 - RNA, 32 nt, Human
ccagcuccagccagcaccccaucugcaccuga

SEQ ID NO: 98620 - RNA, 32 nt, Human
ccagcuccagcccugaggacagcucugauggg

SEQ ID NO: 98621 - RNA, 32 nt, Human
ccagcuccagcuaccagguuuuguaccgugcc

SEQ ID NO: 98622 - RNA, 19 nt, Human
ccagcuccaggcccugccc

SEQ ID NO: 98623 - RNA, 32 nt, Human
ccagcuccagugcuguggagcaugguuucugc

SEQ ID NO: 98624 - RNA, 32 nt, Human
ccagcucccaauaauggaggaggggaaaggga

SEQ ID NO: 98625 - RNA, 21 nt, Human
ccagcucccacaauuuuccca

SEQ ID NO: 98626 - RNA, 32 nt, Human
ccagcucccagccucuugcuuccugggcugag

SEQ ID NO: 98627 - RNA, 32 nt, Human
ccagcucccagccuggcaugagcuuggacagu

SEQ ID NO: 98628 - RNA, 22 nt, Human
ccagcucccagcucuucuuccc

SEQ ID NO: 98629 - RNA, 24 nt, Human
ccagcucccaggaccacaggcuca

SEQ ID NO: 98630 - RNA, 28 nt, Human
ccagcucccagugcugcuguccucugau

SEQ ID NO: 98631 - RNA, 32 nt, Human
ccagcuccccacccucugccuccagucaccau

SEQ ID NO: 98632 - RNA, 20 nt, Human
ccagcuccccuaguccaggc

SEQ ID NO: 98633 - RNA, 20 nt, Human
ccagcucccggguucggcuc

SEQ ID NO: 98634 - RNA, 21 nt, Human
ccagcucccguccuguggcuc

SEQ ID NO: 98635 - RNA, 23 nt, Human
ccagcucccguuagccaggacuu

SEQ ID NO: 98636 - RNA, 32 nt, Human
ccagcucccuccugccugaagauguuccacca

SEQ ID NO: 98637 - RNA, 32 nt, Human
ccagcucccucggggcccccagcuaccuaguu

SEQ ID NO: 98638 - RNA, 32 nt, Human
ccagcucccugccuccaagccuggugccacag

SEQ ID NO: 98639 - RNA, 19 nt, Human
ccagcucccugccuugcca

SEQ ID NO: 98640 - RNA, 23 nt, Human
ccagcucccugugcccccagggu

SEQ ID NO: 98641 - RNA, 32 nt, Human
ccagcuccgcagcagcuuuucaagaugcacua

SEQ ID NO: 98642 - RNA, 21 nt, Human
ccagcuccgcguccugugagg

SEQ ID NO: 98643 - RNA, 32 nt, Human
ccagcuccggguuuaagaguccuggcccggcc

SEQ ID NO: 98644 - RNA, 18 nt, Human
ccagcuccgucccaccca

SEQ ID NO: 98645 - RNA, 19 nt, Human
ccagcuccgucccacccag

SEQ ID NO: 98646 - RNA, 32 nt, Human
ccagcuccgugacccaggcuggaaugcaaugg

SEQ ID NO: 98647 - RNA, 32 nt, Human
ccagcuccuagaauuccucaggccagugacac

SEQ ID NO: 98648 - RNA, 17 nt, Human
ccagcuccuagccuccg

SEQ ID NO: 98649 - RNA, 18 nt, Human
ccagcuccucacauugga

SEQ ID NO: 98650 - RNA, 22 nt, Human
ccagcuccucagcauggccuca

SEQ ID NO: 98651 - RNA, 22 nt, Human
ccagcuccuccccuuccacuca

SEQ ID NO: 98652 - RNA, 23 nt, Human
ccagcuccucccugggugacucg

SEQ ID NO: 98653 - RNA, 23 nt, Human
ccagcuccuccugccugcacccg

SEQ ID NO: 98654 - RNA, 22 nt, Human
ccagcuccuccuugguguucuc

SEQ ID NO: 98655 - RNA, 32 nt, Human
ccagcuccucgagggccgugguugugaagaag

SEQ ID NO: 98656 - RNA, 22 nt, Human
ccagcuccucucuccgccguca

SEQ ID NO: 98657 - RNA, 23 nt, Human
ccagcuccucucugaagcgacuc

SEQ ID NO: 98658 - RNA, 20 nt, Human
ccagcuccucucugaagcuc

SEQ ID NO: 98659 - RNA, 22 nt, Human
ccagcuccucuuccugccucuc

SEQ ID NO: 98660 - RNA, 18 nt, Human
ccagcuccugcacucucg

SEQ ID NO: 98661 - RNA, 17 nt, Human
ccagcuccugccugcca

SEQ ID NO: 98662 - RNA, 32 nt, Human
ccagcuccugccuuagaaacaggcuuggccua

SEQ ID NO: 98663 - RNA, 18 nt, Human
ccagcuccugcgccuucg

SEQ ID NO: 98664 - RNA, 32 nt, Human
ccagcuccugcucuguccccucagguguccug

SEQ ID NO: 98665 - RNA, 18 nt, Human
ccagcuccugcugcuguc

SEQ ID NO: 98666 - RNA, 16 nt, Human
ccagcuccuggggucc

SEQ ID NO: 98667 - RNA, 17 nt, Human
ccagcuccugggguccc

SEQ ID NO: 98668 - RNA, 32 nt, Human
ccagcuccuguccugugccuucaccucuuuuu

SEQ ID NO: 98669 - RNA, 32 nt, Human
ccagcuccugugggccugagugcugcuguguu

SEQ ID NO: 98670 - RNA, 21 nt, Human
ccagcuccuucagccgcacca

SEQ ID NO: 98671 - RNA, 32 nt, Human
ccagcuccuucccagcccagccucuuggggcu

SEQ ID NO: 98672 - RNA, 21 nt, Human
ccagcuccuuccuuccuuccc

SEQ ID NO: 98673 - RNA, 32 nt, Human
ccagcuccuuggcugcagccaucccgcuuagc

SEQ ID NO: 98674 - RNA, 24 nt, Human
ccagcuccuuugugucugagcuca

SEQ ID NO: 98675 - RNA, 32 nt, Human
ccagcuccuuuuucacaguggccucacuacgc

SEQ ID NO: 98676 - RNA, 32 nt, Human
ccagcucgaacccacugcccucuggaggccug

SEQ ID NO: 98677 - RNA, 32 nt, Human
ccagcucgaaugcuugaucugccuggagccuu

SEQ ID NO: 98678 - RNA, 32 nt, Human
ccagcucgagacacccucgcucccccucacag

SEQ ID NO: 98679 - RNA, 32 nt, Human
ccagcucgagacugaugaguggaaucagcuuc

SEQ ID NO: 98680 - RNA, 22 nt, Human
ccagcucgcccucccccuaccc

SEQ ID NO: 98681 - RNA, 32 nt, Human
ccagcucgcccuggcccgcacagccaugagca

SEQ ID NO: 98682 - RNA, 32 nt, Human
ccagcucgcugcagccuccaccucccggacuc

SEQ ID NO: 98683 - RNA, 32 nt, Human
ccagcucgcuggccucgcgcugggcggcuggg

SEQ ID NO: 98684 - RNA, 32 nt, Human
ccagcucggagggucucagccuccccuggguu

SEQ ID NO: 98685 - RNA, 32 nt, Human
ccagcucggcccgcgggggagccccgggagcc

SEQ ID NO: 98686 - RNA, 23 nt, Human
ccagcucgggcaacaaagugaga

SEQ ID NO: 98687 - RNA, 23 nt, Human
ccagcucggggaacagagcgaga

SEQ ID NO: 98688 - RNA, 20 nt, Human
ccagcucggggccugugggg

SEQ ID NO: 98689 - RNA, 32 nt, Human
ccagcucgggugacaagagugagaccccgucu

SEQ ID NO: 98690 - RNA, 22 nt, Human
ccagcucggguuuccgggcuca

SEQ ID NO: 98691 - RNA, 32 nt, Human
ccagcucggucaccaaagcugucuggucccag

SEQ ID NO: 98692 - RNA, 32 nt, Human
ccagcucguuccccuccagccuggugcugggc

SEQ ID NO: 98693 - RNA, 18 nt, Human
ccagcucuagacugcaga

SEQ ID NO: 98694 - RNA, 20 nt, Human
ccagcucuagaggacaggua

SEQ ID NO: 98695 - RNA, 32 nt, Human
ccagcucuauuccaccaugacaaggggacuua

SEQ ID NO: 98696 - RNA, 32 nt, Human
ccagcucucacaccuacacccacgcacccccu

SEQ ID NO: 98697 - RNA, 32 nt, Human
ccagcucucagacccucuuccucccagguaaa

SEQ ID NO: 98698 - RNA, 32 nt, Human
ccagcucuccacccuccugguuccgcuggccg

SEQ ID NO: 98699 - RNA, 32 nt, Human
ccagcucuccucuaccagugggagaaacugcu

SEQ ID NO: 98700 - RNA, 22 nt, Human
ccagcucuccugggaucacuca

SEQ ID NO: 98701 - RNA, 32 nt, Human
ccagcucuccuucacagacaccucuccugucu

SEQ ID NO: 98702 - RNA, 32 nt, Human
ccagcucucuccccaucccgcuucuucccugg

SEQ ID NO: 98703 - RNA, 18 nt, Human
ccagcucucugccucuug

SEQ ID NO: 98704 - RNA, 19 nt, Human
ccagcucugcagggugggg

SEQ ID NO: 98705 - RNA, 32 nt, Human
ccagcucugcauuauccgaggucacagggccu

SEQ ID NO: 98706 - RNA, 32 nt, Human
ccagcucugcauuugacaaaugccaggaagag

SEQ ID NO: 98707 - RNA, 22 nt, Human
ccagcucugcccccugcugcug

SEQ ID NO: 98708 - RNA, 32 nt, Human
ccagcucugcccucaagguggggauggauggg

SEQ ID NO: 98709 - RNA, 32 nt, Human
ccagcucugccucugacucgcuguguacccuc

SEQ ID NO: 98710 - RNA, 31 nt, Human
ccagcucugccuuugaagcacuuguggccac

SEQ ID NO: 98711 - RNA, 32 nt, Human
ccagcucugcuguccuggcaagugucauugac

SEQ ID NO: 98712 - RNA, 32 nt, Human
ccagcucugggaguuuccagucugauggagga

SEQ ID NO: 98713 - RNA, 32 nt, Human
ccagcucuggucugugcagacucauggccacc

SEQ ID NO: 98714 - RNA, 32 nt, Human
ccagcucuguaaccaguccugucccauuuccu

SEQ ID NO: 98715 - RNA, 32 nt, Human
ccagcucugucacuggucgcugagcuuuugga

SEQ ID NO: 98716 - RNA, 23 nt, Human
ccagcucugucgcugacgggagg

SEQ ID NO: 98717 - RNA, 32 nt, Human
ccagcucugucuggugggugugcagggcaccg

SEQ ID NO: 98718 - RNA, 32 nt, Human
ccagcucuguucaccaccccaaagcacaucac

SEQ ID NO: 98719 - RNA, 21 nt, Human
ccagcucuucucugggagucu

SEQ ID NO: 98720 - RNA, 19 nt, Human
ccagcucuugaagggcuga

SEQ ID NO: 98721 - RNA, 32 nt, Human
ccagcucuuuaagugauccucguucugguggc

SEQ ID NO: 98722 - RNA, 32 nt, Human
ccagcucuuugguccaagagggggcugaguuu

SEQ ID NO: 98723 - RNA, 26 nt, Human
ccagcugaaaaacuagaccugugcca

SEQ ID NO: 98724 - RNA, 32 nt, Human
ccagcugaaacuuuuagguccugggaggaaug

SEQ ID NO: 98725 - RNA, 23 nt, Human
ccagcugaacagggaggagucug

SEQ ID NO: 98726 - RNA, 32 nt, Human
ccagcugaaggcaguggcaggggagcagguuc

SEQ ID NO: 98727 - RNA, 22 nt, Human
ccagcugaaggggauuguggug

SEQ ID NO: 98728 - RNA, 21 nt, Human
ccagcugacaauggacugcca

SEQ ID NO: 98729 - RNA, 32 nt, Human
ccagcugacaccacacugaggcagggaguugg

SEQ ID NO: 98730 - RNA, 32 nt, Human
ccagcugaccaacacggugaaaccccaucucu

SEQ ID NO: 98731 - RNA, 32 nt, Human
ccagcugacgcccucccugccucccagggcag

SEQ ID NO: 98732 - RNA, 32 nt, Human
ccagcugacucugggaggaagacugccucucc

SEQ ID NO: 98733 - RNA, 32 nt, Human
ccagcugacucuguggguuggucuuaaagcaa

SEQ ID NO: 98734 - RNA, 32 nt, Human
ccagcugagaagaguugagggaaagugcugcu

SEQ ID NO: 98735 - RNA, 32 nt, Human
ccagcugagagugugacccugucucuaaagaa

SEQ ID NO: 98736 - RNA, 22 nt, Human
ccagcugagccgauuugugcug

SEQ ID NO: 98737 - RNA, 32 nt, Human
ccagcugagccuccuuaccucccuucagccaa

SEQ ID NO: 98738 - RNA, 22 nt, Human
ccagcugaggaccaccgugcug

SEQ ID NO: 98739 - RNA, 32 nt, Human
ccagcugaggcagaggcugcaagggguggagg

SEQ ID NO: 98740 - RNA, 21 nt, Human
ccagcugaggccccaagugcc

SEQ ID NO: 98741 - RNA, 24 nt, Human
ccagcugaggccucagacuagcca

SEQ ID NO: 98742 - RNA, 32 nt, Human
ccagcugaucaugucagccucaugccccaggc

SEQ ID NO: 98743 - RNA, 32 nt, Human
ccagcugauggaauggaauggaagugacucag

SEQ ID NO: 98744 - RNA, 32 nt, Human
ccagcugauuuuuguauuuuuguucauuugcu

SEQ ID NO: 98745 - RNA, 32 nt, Human
ccagcugcaaacuuucuucaacuuuccuaaau

SEQ ID NO: 98746 - RNA, 32 nt, Human
ccagcugcaaaguguuuuguaccagugaauuu

SEQ ID NO: 98747 - RNA, 32 nt, Human
ccagcugcaacggcuccacuuugcaggcuugc

SEQ ID NO: 98748 - RNA, 19 nt, Human
ccagcugcagaccaugcca

SEQ ID NO: 98749 - RNA, 32 nt, Human
ccagcugcagagcuuguggaggccauggggcg

SEQ ID NO: 98750 - RNA, 32 nt, Human
ccagcugcagauaacucaaagccaucccuuuu

SEQ ID NO: 98751 - RNA, 32 nt, Human
ccagcugcagcaaggagguggggaaggagggc

SEQ ID NO: 98752 - RNA, 32 nt, Human
ccagcugcagcagguccugggccugcuucccu

SEQ ID NO: 98753 - RNA, 18 nt, Human
ccagcugcagccaaguuc

SEQ ID NO: 98754 - RNA, 32 nt, Human
ccagcugcagcccaggcaggagcagucgccuu

SEQ ID NO: 98755 - RNA, 32 nt, Human
ccagcugcagccgccuccggagcuucggagcg

SEQ ID NO: 98756 - RNA, 32 nt, Human
ccagcugcaguugugguaaucuugggaggcag

SEQ ID NO: 98757 - RNA, 24 nt, Human
ccagcugcaugcacuuacggcagg

SEQ ID NO: 98758 - RNA, 22 nt, Human
ccagcugcauggaagguggagg

SEQ ID NO: 98759 - RNA, 22 nt, Human
ccagcugcauucccacgggugg

SEQ ID NO: 98760 - RNA, 32 nt, Human
ccagcugccagccugagaagccugucuuuccc

SEQ ID NO: 98761 - RNA, 32 nt, Human
ccagcugccaucaggccccacccaggauggga

SEQ ID NO: 98762 - RNA, 32 nt, Human
ccagcugccccaggacccccggaagccccgcu

SEQ ID NO: 98763 - RNA, 22 nt, Human
ccagcugccccucccugccagc

SEQ ID NO: 98764 - RNA, 21 nt, Human
ccagcugccccuuucccuccu

SEQ ID NO: 98765 - RNA, 25 nt, Human
ccagcugcccgcccugugggcauuu

SEQ ID NO: 98766 - RNA, 32 nt, Human
ccagcugcccguuuccucccauggcccaguau

SEQ ID NO: 98767 - RNA, 31 nt, Human
ccagcugccgcaauuuccaugccaggauauu

SEQ ID NO: 98768 - RNA, 21 nt, Human
ccagcugccucccugaucccu

SEQ ID NO: 98769 - RNA, 22 nt, Human
ccagcugccuggagagggucuc

SEQ ID NO: 98770 - RNA, 32 nt, Human
ccagcugccuggucaguggcauagccagccaa

SEQ ID NO: 98771 - RNA, 32 nt, Human
ccagcugccuucucugcccugugcccacuccc

SEQ ID NO: 98772 - RNA, 32 nt, Human
ccagcugccuuuguuucauuucaccucagcac

SEQ ID NO: 98773 - RNA, 32 nt, Human
ccagcugcgccgcggcucacagcugacgaugg

SEQ ID NO: 98774 - RNA, 32 nt, Human
ccagcugcggaagccacagcugugucccacgu

SEQ ID NO: 98775 - RNA, 24 nt, Human
ccagcugcggucaggacuguggug

SEQ ID NO: 98776 - RNA, 20 nt, Human
ccagcugcgugggguacagg

SEQ ID NO: 98777 - RNA, 32 nt, Human
ccagcugcuccgagagaucaaaggacacaagu

SEQ ID NO: 98778 - RNA, 32 nt, Human
ccagcugcuccgaggacccaggaaaggcagga

SEQ ID NO: 98779 - RNA, 32 nt, Human
ccagcugcuccuccuccguucauuuucugccc

SEQ ID NO: 98780 - RNA, 32 nt, Human
ccagcugcucugggagaaaggaaagccgggga

SEQ ID NO: 98781 - RNA, 26 nt, Human
ccagcugcucuugucacugucucuga

SEQ ID NO: 98782 - RNA, 32 nt, Human
ccagcugcugagaaggccuugagggaaguaga

SEQ ID NO: 98783 - RNA, 32 nt, Human
ccagcugcugagcugcucacccuuuauccacu

SEQ ID NO: 98784 - RNA, 32 nt, Human
ccagcugcugcucuccucgacauggacccuga

SEQ ID NO: 98785 - RNA, 23 nt, Human
ccagcugcugcugaggugggagg

SEQ ID NO: 98786 - RNA, 18 nt, Human
ccagcugcuggcugcaga

SEQ ID NO: 98787 - RNA, 32 nt, Human
ccagcugcugucuucuggacaggcucugcuuc

SEQ ID NO: 98788 - RNA, 32 nt, Human
ccagcugcuguggauccucuuguugaccucau

SEQ ID NO: 98789 - RNA, 22 nt, Human
ccagcugcuucagcuucuccuc

SEQ ID NO: 98790 - RNA, 32 nt, Human
ccagcuggaagaggcgguggcggcgggucggg

SEQ ID NO: 98791 - RNA, 32 nt, Human
ccagcuggaagcauaaaacacagggagcuggu

SEQ ID NO: 98792 - RNA, 32 nt, Human
ccagcuggagccaagaagcacagagacacaga

SEQ ID NO: 98793 - RNA, 32 nt, Human
ccagcuggagccucuugagggagaugagaggc

SEQ ID NO: 98794 - RNA, 32 nt, Human
ccagcuggagguagcccaggaggcagugccgc

SEQ ID NO: 98795 - RNA, 18 nt, Human
ccagcuggagugcagugg

SEQ ID NO: 98796 - RNA, 22 nt, Human
ccagcuggcaguugagcugccu

SEQ ID NO: 98797 - RNA, 32 nt, Human
ccagcuggcaucuugacugcaacucaugagcg

SEQ ID NO: 98798 - RNA, 22 nt, Human
ccagcuggccacccuggccuca

SEQ ID NO: 98799 - RNA, 20 nt, Human
ccagcuggccagggcauggc

SEQ ID NO: 98800 - RNA, 32 nt, Human
ccagcuggcccaggauuucacagucgaaaagg

SEQ ID NO: 98801 - RNA, 32 nt, Human
ccagcuggcccuuggucuccucucuuuccucc

SEQ ID NO: 98802 - RNA, 32 nt, Human
ccagcuggccugcugcucugcacagcaccggc

SEQ ID NO: 98803 - RNA, 32 nt, Human
ccagcuggccuuccccagccugcaaggagccu

SEQ ID NO: 98804 - RNA, 20 nt, Human
ccagcuggcuccuggcccca

SEQ ID NO: 98805 - RNA, 32 nt, Human
ccagcuggcugcacucuagagggugcuuugua

SEQ ID NO: 98806 - RNA, 32 nt, Human
ccagcuggcugcagcacuuguagcaugcacau

SEQ ID NO: 98807 - RNA, 32 nt, Human
ccagcuggcugcaggucucucagggcuggcac

SEQ ID NO: 98808 - RNA, 32 nt, Human
ccagcugggaagcugcucaccaggccuagaac

SEQ ID NO: 98809 - RNA, 32 nt, Human
ccagcugggagaugaaugcaacucugcugccu

SEQ ID NO: 98810 - RNA, 32 nt, Human
ccagcugggaggagcuugccugccuggccaca

SEQ ID NO: 98811 - RNA, 32 nt, Human
ccagcugggaggaggggcuggggaggaucugc

SEQ ID NO: 98812 - RNA, 32 nt, Human
ccagcugggaggaucccuugagccuaggaguu

SEQ ID NO: 98813 - RNA, 32 nt, Human
ccagcugggagguuucuaggcagcagcaaaac

SEQ ID NO: 98814 - RNA, 32 nt, Human
ccagcugggauuacagguaugagccaccgcac

SEQ ID NO: 98815 - RNA, 32 nt, Human
ccagcugggcaacauggugaaaccccaucucc

SEQ ID NO: 98816 - RNA, 32 nt, Human
ccagcugggcagggccgguguggggcuggagc

SEQ ID NO: 98817 - RNA, 20 nt, Human
ccagcugggccauuuuucca

SEQ ID NO: 98818 - RNA, 32 nt, Human
ccagcugggcugucccaaauguuaccauuuga

SEQ ID NO: 98819 - RNA, 21 nt, Human
ccagcuggggccucuggggug

SEQ ID NO: 98820 - RNA, 22 nt, Human
ccagcugggugacagagugaga

SEQ ID NO: 98821 - RNA, 17 nt, Human
ccagcugggugcagugg

SEQ ID NO: 98822 - RNA, 27 nt, Human
ccagcugguccgaacaccagggcagca

SEQ ID NO: 98823 - RNA, 19 nt, Human
ccagcugguccuuuuccca

SEQ ID NO: 98824 - RNA, 32 nt, Human
ccagcuggucucaaaccccugggcucaagcaa

SEQ ID NO: 98825 - RNA, 32 nt, Human
ccagcuggucucaaacuccuaaccucaaguga

SEQ ID NO: 98826 - RNA, 32 nt, Human
ccagcuggucucaaacuccugaccucagguga

SEQ ID NO: 98827 - RNA, 32 nt, Human
ccagcuggucucaaacugcugggcuuauggga

SEQ ID NO: 98828 - RNA, 32 nt, Human
ccagcuggucucauacuccucaguucacgcau

SEQ ID NO: 98829 - RNA, 32 nt, Human
ccagcuggucuguauuauuggaaguugcaguu

SEQ ID NO: 98830 - RNA, 32 nt, Human
ccagcuggugcugacccacaaggaccuccucu

SEQ ID NO: 98831 - RNA, 31 nt, Human
ccagcuggugcuucuuuauauuuagaaauua

SEQ ID NO: 98832 - RNA, 22 nt, Human
ccagcuggugggaauucugcug

SEQ ID NO: 98833 - RNA, 28 nt, Human
ccagcugguggugcugcccuaucagaug

SEQ ID NO: 98834 - RNA, 32 nt, Human
ccagcugguguugcagagggaggucaacguga

SEQ ID NO: 98835 - RNA, 32 nt, Human
ccagcugguuccucucuggcgccuucugaacc

SEQ ID NO: 98836 - RNA, 32 nt, Human
ccagcuguaaauaggcuguggccagugccugg

SEQ ID NO: 98837 - RNA, 32 nt, Human
ccagcuguauuuggaaaagccaugucucacuc

SEQ ID NO: 98838 - RNA, 23 nt, Human
ccagcugucaggcaagcccagug

SEQ ID NO: 98839 - RNA, 32 nt, Human
ccagcugucauuguuccuuccccagaagcuaa

SEQ ID NO: 98840 - RNA, 17 nt, Human
ccagcuguccccacgcc

SEQ ID NO: 98841 - RNA, 32 nt, Human
ccagcuguccccucagcuaaggggcuuaguuu

SEQ ID NO: 98842 - RNA, 32 nt, Human
ccagcuguccucaucccugcccagcaggcugc

SEQ ID NO: 98843 - RNA, 18 nt, Human
ccagcuguccuggggcca

SEQ ID NO: 98844 - RNA, 32 nt, Human
ccagcugucuagcucccucccuucuucccagc

SEQ ID NO: 98845 - RNA, 32 nt, Human
ccagcugucugacacacaaauggucuuuucag

SEQ ID NO: 98846 - RNA, 20 nt, Human
ccagcugugaaauggggcca

SEQ ID NO: 98847 - RNA, 32 nt, Human
ccagcugugccauguucgagaccugggcuggc

SEQ ID NO: 98848 - RNA, 24 nt, Human
ccagcugugccccucccccagggg

SEQ ID NO: 98849 - RNA, 32 nt, Human
ccagcugugcuaugcacaccucagguugaaga

SEQ ID NO: 98850 - RNA, 24 nt, Human
ccagcugugcuucugggucaggug

SEQ ID NO: 98851 - RNA, 32 nt, Human
ccagcuguggaauuugggggugaaggguguga

SEQ ID NO: 98852 - RNA, 24 nt, Human
ccagcuguggagcgugccgggggg

SEQ ID NO: 98853 - RNA, 32 nt, Human
ccagcugugggaugucaaguaauuccagggac

SEQ ID NO: 98854 - RNA, 32 nt, Human
ccagcugugggccccagaaagccagccugccu

SEQ ID NO: 98855 - RNA, 32 nt, Human
ccagcugugggugagagcagggcacuguccag

SEQ ID NO: 98856 - RNA, 20 nt, Human
ccagcuguggugaugggagg

SEQ ID NO: 98857 - RNA, 19 nt, Human
ccagcuguguccuggguua

SEQ ID NO: 98858 - RNA, 22 nt, Human
ccagcuguguggacucaggggg

SEQ ID NO: 98859 - RNA, 32 nt, Human
ccagcuguuacccagcccggggcaggugcagc

SEQ ID NO: 98860 - RNA, 32 nt, Human
ccagcuguuaucugccagaucuucccaucuug

SEQ ID NO: 98861 - RNA, 16 nt, Human
ccagcuguucauacca

SEQ ID NO: 98862 - RNA, 19 nt, Human
ccagcuguuccccagguca

SEQ ID NO: 98863 - RNA, 32 nt, Human
ccagcuguuccugcgagggccaccuccucagg

SEQ ID NO: 98864 - RNA, 32 nt, Human
ccagcuguucucugucagcacacccaccucca

SEQ ID NO: 98865 - RNA, 32 nt, Human
ccagcuguugucucacacuuccuugaaguucc

SEQ ID NO: 98866 - RNA, 32 nt, Human
ccagcuguuuaacacuauccugggcaaauguu

SEQ ID NO: 98867 - RNA, 32 nt, Human
ccagcuguuuccaggaucuuccagcaugcugc

SEQ ID NO: 98868 - RNA, 32 nt, Human
ccagcuguuuuccuuugagcagucuccuuuua

SEQ ID NO: 98869 - RNA, 32 nt, Human
ccagcuguuuuugugcucacaagcucuagcga

SEQ ID NO: 98870 - RNA, 32 nt, Human
ccagcuuaaggagaucaagauauuaagaggua

SEQ ID NO: 98871 - RNA, 22 nt, Human
ccagcuuacugccuccccuccc

SEQ ID NO: 98872 - RNA, 32 nt, Human
ccagcuuacugccuccccucccccucacgccu

SEQ ID NO: 98873 - RNA, 32 nt, Human
ccagcuuauagugcuuugucauggcagcccag

SEQ ID NO: 98874 - RNA, 32 nt, Human
ccagcuuaucuccuccuccgccuguguaaaug

SEQ ID NO: 98875 - RNA, 32 nt, Human
ccagcuuaugccaggcccugggcugaguacug

SEQ ID NO: 98876 - RNA, 32 nt, Human
ccagcuuauugccaaagggaaaaaggauagcc

SEQ ID NO: 98877 - RNA, 32 nt, Human
ccagcuucaagaauguguuuucaugcccggcc

SEQ ID NO: 98878 - RNA, 32 nt, Human
ccagcuucaccuccuuuucuggacccgagggc

SEQ ID NO: 98879 - RNA, 27 nt, Human
ccagcuucagaaagcacauacagcauc

SEQ ID NO: 98880 - RNA, 32 nt, Human
ccagcuucagcccgggauccagcuccagcucc

SEQ ID NO: 98881 - RNA, 32 nt, Human
ccagcuucagcgaccaccaguccuuugcgguc

SEQ ID NO: 98882 - RNA, 32 nt, Human
ccagcuucauuccucagaguaaaccaaccuug

SEQ ID NO: 98883 - RNA, 32 nt, Human
ccagcuucauuuucucugccuuuugggagagg

SEQ ID NO: 98884 - RNA, 21 nt, Human
ccagcuuccacucagccacca

SEQ ID NO: 98885 - RNA, 21 nt, Human
ccagcuuccagcacaaccgca

SEQ ID NO: 98886 - RNA, 19 nt, Human
ccagcuuccagcccuccuc

SEQ ID NO: 98887 - RNA, 32 nt, Human
ccagcuuccaggggacugucacuguggacgcc

SEQ ID NO: 98888 - RNA, 21 nt, Human
ccagcuucccagggcgggagg

SEQ ID NO: 98889 - RNA, 20 nt, Human
ccagcuuccccgcccagcuu

SEQ ID NO: 98890 - RNA, 21 nt, Human
ccagcuuccccgucccgcccu

SEQ ID NO: 98891 - RNA, 18 nt, Human
ccagcuucccgacuccca

SEQ ID NO: 98892 - RNA, 32 nt, Human
ccagcuucccgaguagcugggauuacaggcgc

SEQ ID NO: 98893 - RNA, 22 nt, Human
ccagcuucccucugcaccccca

SEQ ID NO: 98894 - RNA, 18 nt, Human
ccagcuucccucugcugu

SEQ ID NO: 98895 - RNA, 23 nt, Human
ccagcuucccuuggucagcccca

SEQ ID NO: 98896 - RNA, 19 nt, Human
ccagcuucccuuugcccca

SEQ ID NO: 98897 - RNA, 32 nt, Human
ccagcuuccgccucccccauccugggcgcccc

SEQ ID NO: 98898 - RNA, 21 nt, Human
ccagcuuccggacuggccgca

SEQ ID NO: 98899 - RNA, 32 nt, Human
ccagcuuccuccaguggccuuccccagcaggc

SEQ ID NO: 98900 - RNA, 32 nt, Human
ccagcuuccuggagcccacccuuuaagccuug

SEQ ID NO: 98901 - RNA, 32 nt, Human
ccagcuuccugucccugugcucacugccccca

SEQ ID NO: 98902 - RNA, 32 nt, Human
ccagcuuccuucaggacccugcuucugaguga

SEQ ID NO: 98903 - RNA, 32 nt, Human
ccagcuucgcauccaucucccccaccccguaa

SEQ ID NO: 98904 - RNA, 32 nt, Human
ccagcuucgucuguucucaauuuggaaucaug

SEQ ID NO: 98905 - RNA, 22 nt, Human
ccagcuucucacuccaguuuca

SEQ ID NO: 98906 - RNA, 32 nt, Human
ccagcuucucaggagucugaggcaggagaauu

SEQ ID NO: 98907 - RNA, 18 nt, Human
ccagcuucuccuugggca

SEQ ID NO: 98908 - RNA, 22 nt, Human
ccagcuucuccuugggcagcca

SEQ ID NO: 98909 - RNA, 20 nt, Human
ccagcuucucgucggcccca

SEQ ID NO: 98910 - RNA, 32 nt, Human
ccagcuucucucagagucucccccucugcagc

SEQ ID NO: 98911 - RNA, 25 nt, Human
ccagcuucucucuccagggugcuua

SEQ ID NO: 98912 - RNA, 32 nt, Human
ccagcuucucucucccugucacacacuggacc

SEQ ID NO: 98913 - RNA, 32 nt, Human
ccagcuucucugcuucucagcugccaucucca

SEQ ID NO: 98914 - RNA, 22 nt, Human
ccagcuucugccuguacugcug

SEQ ID NO: 98915 - RNA, 18 nt, Human
ccagcuucuggcaacugc

SEQ ID NO: 98916 - RNA, 32 nt, Human
ccagcuucuucuccuggauccaguagaguuuc

SEQ ID NO: 98917 - RNA, 32 nt, Human
ccagcuucuugcucuugacccugcacuguaag

SEQ ID NO: 98918 - RNA, 32 nt, Human
ccagcuugaccaacauggagaaaccucguuuc

SEQ ID NO: 98919 - RNA, 21 nt, Human
ccagcuugagcaacagaggga

SEQ ID NO: 98920 - RNA, 32 nt, Human
ccagcuugagcaacauagugaaauccugucua

SEQ ID NO: 98921 - RNA, 32 nt, Human
ccagcuugauguccacuggacacuggcaacuu

SEQ ID NO: 98922 - RNA, 22 nt, Human
ccagcuugcuccccugcccuga

SEQ ID NO: 98923 - RNA, 19 nt, Human
ccagcuugcugacugcaga

SEQ ID NO: 98924 - RNA, 22 nt, Human
ccagcuugcugcugcccaaagc

SEQ ID NO: 98925 - RNA, 19 nt, Human
ccagcuuggagcagagacc

SEQ ID NO: 98926 - RNA, 22 nt, Human
ccagcuuggaggccugguccug

SEQ ID NO: 98927 - RNA, 18 nt, Human
ccagcuuggaucuuccua

SEQ ID NO: 98928 - RNA, 19 nt, Human
ccagcuuggauuucaccca

SEQ ID NO: 98929 - RNA, 32 nt, Human
ccagcuuggccaacauggugaaaccucaucuc

SEQ ID NO: 98930 - RNA, 32 nt, Human
ccagcuugggaccuccuugugagaggcucuga

SEQ ID NO: 98931 - RNA, 24 nt, Human
ccagcuugggagacaagagcgaaa

SEQ ID NO: 98932 - RNA, 23 nt, Human
ccagcuugggcaacaaagugaga

SEQ ID NO: 98933 - RNA, 32 nt, Human
ccagcuugggcaacaaagugagacuccaucac

SEQ ID NO: 98934 - RNA, 23 nt, Human
ccagcuugggcaacaauagcgaa

SEQ ID NO: 98935 - RNA, 32 nt, Human
ccagcuugggcaacaauagcgaaccuccaucu

SEQ ID NO: 98936 - RNA, 19 nt, Human
ccagcuugggcaacagagc

SEQ ID NO: 98937 - RNA, 23 nt, Human
ccagcuugggcaacagaguaaga

SEQ ID NO: 98938 - RNA, 23 nt, Human
ccagcuugggcaacagagugaga

SEQ ID NO: 98939 - RNA, 32 nt, Human
ccagcuugggcaacagagugagacuccaucuc

SEQ ID NO: 98940 - RNA, 23 nt, Human
ccagcuugggcaacagggcgaga

SEQ ID NO: 98941 - RNA, 32 nt, Human
ccagcuugggcaacagggcgagaccuuguuua

SEQ ID NO: 98942 - RNA, 19 nt, Human
ccagcuugggcaacauagc

SEQ ID NO: 98943 - RNA, 23 nt, Human
ccagcuugggcaacauagcaaga

SEQ ID NO: 98944 - RNA, 23 nt, Human
ccagcuugggcaacauagggaga

SEQ ID NO: 98945 - RNA, 22 nt, Human
ccagcuugggcaacauagugaa

SEQ ID NO: 98946 - RNA, 32 nt, Human
ccagcuugggcaacauagugaacccugucugu

SEQ ID NO: 98947 - RNA, 23 nt, Human
ccagcuugggcaacauagugaga

SEQ ID NO: 98948 - RNA, 32 nt, Human
ccagcuugggcaacauagugagacccugucuc

SEQ ID NO: 98949 - RNA, 20 nt, Human
ccagcuugggcaacauggag

SEQ ID NO: 98950 - RNA, 32 nt, Human
ccagcuugggcaacauggagaaaccccaucuu

SEQ ID NO: 98951 - RNA, 19 nt, Human
ccagcuugggcaacauggc

SEQ ID NO: 98952 - RNA, 32 nt, Human
ccagcuugggcaacauggcaaagccccaucuc

SEQ ID NO: 98953 - RNA, 32 nt, Human
ccagcuugggcaacauggcgaaaccccgucuc

SEQ ID NO: 98954 - RNA, 22 nt, Human
ccagcuugggcaacauggugaa

SEQ ID NO: 98955 - RNA, 32 nt, Human
ccagcuugggcaacauggugaaaccugucucu

SEQ ID NO: 98956 - RNA, 32 nt, Human
ccagcuugggcaacauggugaaacuucucuac

SEQ ID NO: 98957 - RNA, 18 nt, Human
ccagcuugggcaacgagc

SEQ ID NO: 98958 - RNA, 19 nt, Human
ccagcuugggcaacguagc

SEQ ID NO: 98959 - RNA, 23 nt, Human
ccagcuugggcaauguggugaaa

SEQ ID NO: 98960 - RNA, 19 nt, Human
ccagcuugggcaccagagc

SEQ ID NO: 98961 - RNA, 19 nt, Human
ccagcuugggcgacagagc

SEQ ID NO: 98962 - RNA, 23 nt, Human
ccagcuugggcgacagagcgaga

SEQ ID NO: 98963 - RNA, 26 nt, Human
ccagcuuggggcucacgccuguaauc

SEQ ID NO: 98964 - RNA, 19 nt, Human
ccagcuugggugacagagc

SEQ ID NO: 98965 - RNA, 32 nt, Human
ccagcuugggugacagagcaagagucugucaa

SEQ ID NO: 98966 - RNA, 23 nt, Human
ccagcuugggugacagagcgaga

SEQ ID NO: 98967 - RNA, 32 nt, Human
ccagcuuguccaccugaggaagaaaugcuuuu

SEQ ID NO: 98968 - RNA, 21 nt, Human
ccagcuugucccagccacucu

SEQ ID NO: 98969 - RNA, 24 nt, Human
ccagcuuguccccucgaacccucu

SEQ ID NO: 98970 - RNA, 23 nt, Human
ccagcuugugcaacaaagugaga

SEQ ID NO: 98971 - RNA, 32 nt, Human
ccagcuuuauucaccugacuguuuccagagac

SEQ ID NO: 98972 - RNA, 17 nt, Human
ccagcuuucaagggcga

SEQ ID NO: 98973 - RNA, 32 nt, Human
ccagcuuuccaucacccauaugguagggagga

SEQ ID NO: 98974 - RNA, 18 nt, Human
ccagcuuucccacuuuca

SEQ ID NO: 98975 - RNA, 32 nt, Human
ccagcuuucccacuuucagcaguccuuugcuc

SEQ ID NO: 98976 - RNA, 32 nt, Human
ccagcuuucccuccuggccagaaauguucagc

SEQ ID NO: 98977 - RNA, 32 nt, Human
ccagcuuucggcgccaaccacacagccagcaa

SEQ ID NO: 98978 - RNA, 32 nt, Human
ccagcuuucugccugucugccugccggcacug

SEQ ID NO: 98979 - RNA, 32 nt, Human
ccagcuuucuuucuguuagcauuuucugaugu

SEQ ID NO: 98980 - RNA, 32 nt, Human
ccagcuuugcagccccagucuugagcccccaa

SEQ ID NO: 98981 - RNA, 17 nt, Human
ccagcuuuggcugcaga

SEQ ID NO: 98982 - RNA, 32 nt, Human
ccagcuuugggcugaauggcagcacccacgcu

SEQ ID NO: 98983 - RNA, 32 nt, Human
ccagcuuuguuaaacuguccgugagacaagaa

SEQ ID NO: 98984 - RNA, 32 nt, Human
ccagcuuuuaacaaucuaacuaaugcccucuc

SEQ ID NO: 98985 - RNA, 32 nt, Human
ccagcuuuucauaagugguauguuuaauuggu

SEQ ID NO: 98986 - RNA, 32 nt, Human
ccagcuuuuccaagcaucauucaccaaagcau

SEQ ID NO: 98987 - RNA, 32 nt, Human
ccagcuuuucccucacacaccugccgacucgg

SEQ ID NO: 98988 - RNA, 21 nt, Human
ccagcuuuucugggggucuca

SEQ ID NO: 98989 - RNA, 32 nt, Human
ccagcuuuugcagccaaucagguagcuuaaug

SEQ ID NO: 98990 - RNA, 32 nt, Human
ccagcuuuuucucucaggguucugagucagag

SEQ ID NO: 98991 - RNA, 32 nt, Human
ccagcuuuuugagaaaggggaugugaugguga

SEQ ID NO: 98992 - RNA, 32 nt, Human
ccaggaaaaaccagacagacuuucacacuaaa

SEQ ID NO: 98993 - RNA, 32 nt, Human
ccaggaaaaagaaaccagaaaguauugaaaac

SEQ ID NO: 98994 - RNA, 18 nt, Human
ccaggaaaaggagcucua

SEQ ID NO: 98995 - RNA, 32 nt, Human
ccaggaaaagggaagaauuugcaccaagaagu

SEQ ID NO: 98996 - RNA, 32 nt, Human
ccaggaaacagccauguggguccuuucugugc

SEQ ID NO: 98997 - RNA, 32 nt, Human
ccaggaaagaagcagaagccuccuggccuuac

SEQ ID NO: 98998 - RNA, 26 nt, Human
ccaggaaagaggagaugcugauucug

SEQ ID NO: 98999 - RNA, 32 nt, Human
ccaggaaagcagcugcacucagacaaugccuu

SEQ ID NO: 99000 - RNA, 32 nt, Human
ccaggaaagcaggcgacggauguggauccuga

SEQ ID NO: 99001 - RNA, 32 nt, Human
ccaggaaagccaagguggaggcugagguggcu

SEQ ID NO: 99002 - RNA, 32 nt, Human
ccaggaaagccgaagcccccagaggagccccc

SEQ ID NO: 99003 - RNA, 21 nt, Human
ccaggaaaggagggggcucag

SEQ ID NO: 99004 - RNA, 32 nt, Human
ccaggaaagguguggcuggaagcacugaaccu

SEQ ID NO: 99005 - RNA, 24 nt, Human
ccaggaaauagagguugcagugag

SEQ ID NO: 99006 - RNA, 32 nt, Human
ccaggaaaugaucuuccacuugagcaaccuuu

SEQ ID NO: 99007 - RNA, 19 nt, Human
ccaggaaaugauuuucuca

SEQ ID NO: 99008 - RNA, 32 nt, Human
ccaggaaauuccaauacaucagugcaugugga

SEQ ID NO: 99009 - RNA, 24 nt, Human
ccaggaaauugaggcugcagugag

SEQ ID NO: 99010 - RNA, 24 nt, Human
ccaggaaauuggggcugcagugag

SEQ ID NO: 99011 - RNA, 32 nt, Human
ccaggaacacccucccagcaggggaugggaac

SEQ ID NO: 99012 - RNA, 32 nt, Human
ccaggaacagagaagagauuacaccagcggua

SEQ ID NO: 99013 - RNA, 32 nt, Human
ccaggaacauaauguggaugugacuuaugaac

SEQ ID NO: 99014 - RNA, 32 nt, Human
ccaggaaccccggaagagguagcucacgcgau

SEQ ID NO: 99015 - RNA, 32 nt, Human
ccaggaacccugugguucccaagaacaauuua

SEQ ID NO: 99016 - RNA, 32 nt, Human
ccaggaacccuugagguucuucuucacaaggc

SEQ ID NO: 99017 - RNA, 32 nt, Human
ccaggaaccuugccacaccugcaccugcgucc

SEQ ID NO: 99018 - RNA, 32 nt, Human
ccaggaaccuugccacaccugcaccugugucc

SEQ ID NO: 99019 - RNA, 32 nt, Human
ccaggaacggguagucugacacggugauuauc

SEQ ID NO: 99020 - RNA, 32 nt, Human
ccaggaacuaccccaugaucuucuauucucau

SEQ ID NO: 99021 - RNA, 31 nt, Human
ccaggaacucucagggauaccaaaaucugca

SEQ ID NO: 99022 - RNA, 32 nt, Human
ccaggaacugggaccaccaucuugcugaugga

SEQ ID NO: 99023 - RNA, 32 nt, Human
ccaggaacuugagugacauugaccucauggca

SEQ ID NO: 99024 - RNA, 32 nt, Human
ccaggaagaaugagguacauggacaacuggag

SEQ ID NO: 99025 - RNA, 32 nt, Human
ccaggaagaccaccugcuuuucugacacuguc

SEQ ID NO: 99026 - RNA, 32 nt, Human
ccaggaagacgaggcugcauccuggccccugc

SEQ ID NO: 99027 - RNA, 19 nt, Human
ccaggaagacuauggggua

SEQ ID NO: 99028 - RNA, 21 nt, Human
ccaggaagacuccgcaguggg

SEQ ID NO: 99029 - RNA, 32 nt, Human
ccaggaagacuuguugcagguaggugaugguu

SEQ ID NO: 99030 - RNA, 32 nt, Human
ccaggaagagagcugugaccagcagcgucccu

SEQ ID NO: 99031 - RNA, 24 nt, Human
ccaggaagaggagguugcagugag

SEQ ID NO: 99032 - RNA, 19 nt, Human
ccaggaagaucuggccucu

SEQ ID NO: 99033 - RNA, 28 nt, Human
ccaggaagcaagcggagguugcagugag

SEQ ID NO: 99034 - RNA, 32 nt, Human
ccaggaagcaagcggagguugcagugaguuga

SEQ ID NO: 99035 - RNA, 21 nt, Human
ccaggaagcagagguugcagu

SEQ ID NO: 99036 - RNA, 24 nt, Human
ccaggaagcagagguugcagugag

SEQ ID NO: 99037 - RNA, 23 nt, Human
ccaggaagcagagguugcgguga

SEQ ID NO: 99038 - RNA, 24 nt, Human
ccaggaagcagagguugcggugag

SEQ ID NO: 99039 - RNA, 24 nt, Human
ccaggaagcagcugagcccaagga

SEQ ID NO: 99040 - RNA, 23 nt, Human
ccaggaagccagcccgcacccca

SEQ ID NO: 99041 - RNA, 32 nt, Human
ccaggaagcccggcaggagaauucugccagau

SEQ ID NO: 99042 - RNA, 32 nt, Human
ccaggaagccuccuggucuucuagaauccugg

SEQ ID NO: 99043 - RNA, 24 nt, Human
ccaggaagcggaggcugcagugag

SEQ ID NO: 99044 - RNA, 24 nt, Human
ccaggaagcggagguugcaaugag

SEQ ID NO: 99045 - RNA, 24 nt, Human
ccaggaagcggagguugcagugag

SEQ ID NO: 99046 - RNA, 23 nt, Human
ccaggaagcgggguugcagugag

SEQ ID NO: 99047 - RNA, 32 nt, Human
ccaggaagcuacggagagaagcagccagcaug

SEQ ID NO: 99048 - RNA, 32 nt, Human
ccaggaaggaagagcagcagcagggugggaga

SEQ ID NO: 99049 - RNA, 17 nt, Human
ccaggaaggaagcuguu

SEQ ID NO: 99050 - RNA, 18 nt, Human
ccaggaaggagccuggga

SEQ ID NO: 99051 - RNA, 24 nt, Human
ccaggaaggcagagauugcaguga

SEQ ID NO: 99052 - RNA, 25 nt, Human
ccaggaaggcagagauugcagugag

SEQ ID NO: 99053 - RNA, 32 nt, Human
ccaggaaggcagagauugcagugagcugagau

SEQ ID NO: 99054 - RNA, 24 nt, Human
ccaggaaggcagagguugcacuga

SEQ ID NO: 99055 - RNA, 25 nt, Human
ccaggaaggcagagguugcacugag

SEQ ID NO: 99056 - RNA, 17 nt, Human
ccaggaaggcagcuguc

SEQ ID NO: 99057 - RNA, 32 nt, Human
ccaggaaggcucaggagcccuaccucccugcc

SEQ ID NO: 99058 - RNA, 21 nt, Human
ccaggaagggacccagccuca

SEQ ID NO: 99059 - RNA, 32 nt, Human
ccaggaaggggaggagagugagggccaagaac

SEQ ID NO: 99060 - RNA, 32 nt, Human
ccaggaaggggguccacccagcaaagaguggg

SEQ ID NO: 99061 - RNA, 21 nt, Human
ccaggaaggguaucugggaug

SEQ ID NO: 99062 - RNA, 32 nt, Human
ccaggaaggucuuacccccucuucuauuuauu

SEQ ID NO: 99063 - RNA, 32 nt, Human
ccaggaagguugagguugcagugagcuaugau

SEQ ID NO: 99064 - RNA, 23 nt, Human
ccaggaagucaaggcugcaguga

SEQ ID NO: 99065 - RNA, 24 nt, Human
ccaggaagucaaggcugcagugag

SEQ ID NO: 99066 - RNA, 32 nt, Human
ccaggaaguccuaagaaguggggcagauggca

SEQ ID NO: 99067 - RNA, 24 nt, Human
ccaggaaguggagacugcagugag

SEQ ID NO: 99068 - RNA, 24 nt, Human
ccaggaaguggagauugcagugag

SEQ ID NO: 99069 - RNA, 23 nt, Human
ccaggaaguggaggcugcaguga

SEQ ID NO: 99070 - RNA, 24 nt, Human
ccaggaaguggagguugcagugag

SEQ ID NO: 99071 - RNA, 24 nt, Human
ccaggaaguggcaguugcagugag

SEQ ID NO: 99072 - RNA, 32 nt, Human
ccaggaaguucugccuuuucuuuucuuucggu

SEQ ID NO: 99073 - RNA, 23 nt, Human
ccaggaaguugaggcugcaauga

SEQ ID NO: 99074 - RNA, 24 nt, Human
ccaggaaguugaggcugcagugag

SEQ ID NO: 99075 - RNA, 32 nt, Human
ccaggaaguugaguuuucaagaugccuuguug

SEQ ID NO: 99076 - RNA, 32 nt, Human
ccaggaaucucaggaugaaucagucuagaucg

SEQ ID NO: 99077 - RNA, 32 nt, Human
ccaggaaucugagcccagccugggcgacaaag

SEQ ID NO: 99078 - RNA, 18 nt, Human
ccaggaaucugcuuugga

SEQ ID NO: 99079 - RNA, 32 nt, Human
ccaggaauggguuuaaaaauguacauuuuacu

SEQ ID NO: 99080 - RNA, 32 nt, Human
ccaggaauguuugcaugaccuaccucaggagg

SEQ ID NO: 99081 - RNA, 32 nt, Human
ccaggaauguuuuugugccacugacuuuagau

SEQ ID NO: 99082 - RNA, 23 nt, Human
ccaggaauuagagguugcaguga

SEQ ID NO: 99083 - RNA, 24 nt, Human
ccaggaauuagagguugcagugag

SEQ ID NO: 99084 - RNA, 32 nt, Human
ccaggaauucaagaccagccugaguaacauga

SEQ ID NO: 99085 - RNA, 32 nt, Human
ccaggaauucaagaccagccugggcaacacag

SEQ ID NO: 99086 - RNA, 32 nt, Human
ccaggaauucaagaccagccugggcaacaugg

SEQ ID NO: 99087 - RNA, 32 nt, Human
ccaggaauucaagaccagccugggcaacucag

SEQ ID NO: 99088 - RNA, 32 nt, Human
ccaggaauucaaggccagccugggcaacauag

SEQ ID NO: 99089 - RNA, 32 nt, Human
ccaggaauucaaguccaaucugggcaacaugg

SEQ ID NO: 99090 - RNA, 32 nt, Human
ccaggaauucgaaaucagccuaggcaacauag

SEQ ID NO: 99091 - RNA, 32 nt, Human
ccaggaauucgagaccagccuaggugacauag

SEQ ID NO: 99092 - RNA, 32 nt, Human
ccaggaauucgagaccagccugggcaacauag

SEQ ID NO: 99093 - RNA, 32 nt, Human
ccaggaauucgagaccagccugggcaagaugg

SEQ ID NO: 99094 - RNA, 32 nt, Human
ccaggaauucgagaccagccugggcagcauag

SEQ ID NO: 99095 - RNA, 24 nt, Human
ccaggaauuggaggcugcagugag

SEQ ID NO: 99096 - RNA, 32 nt, Human
ccaggaauuuagaccuuuucccugcaccacuc

SEQ ID NO: 99097 - RNA, 32 nt, Human
ccaggaauuugaaaccagccugggcaaaaccc

SEQ ID NO: 99098 - RNA, 32 nt, Human
ccaggaauuugagaccagccugggcaacauag

SEQ ID NO: 99099 - RNA, 32 nt, Human
ccaggaauuugagaccagccugggcaacaugg

SEQ ID NO: 99100 - RNA, 24 nt, Human
ccaggaauuugagguuguagugag

SEQ ID NO: 99101 - RNA, 32 nt, Human
ccaggacaaaggcagagauaugccugccuggu

SEQ ID NO: 99102 - RNA, 32 nt, Human
ccaggacaauccagccucugcccuggaacugc

SEQ ID NO: 99103 - RNA, 32 nt, Human
ccaggacacagcccucucucucacagcagugu

SEQ ID NO: 99104 - RNA, 32 nt, Human
ccaggacacagccuugggagguccugaccaca

SEQ ID NO: 99105 - RNA, 32 nt, Human
ccaggacacaucacauacccacccuuacuucc

SEQ ID NO: 99106 - RNA, 32 nt, Human
ccaggacacccacccacccaaagagccaaaga

SEQ ID NO: 99107 - RNA, 32 nt, Human
ccaggacaccuggaagccgggaaauggauuca

SEQ ID NO: 99108 - RNA, 24 nt, Human
ccaggacacggagauugcagugag

SEQ ID NO: 99109 - RNA, 22 nt, Human
ccaggacacuggaaguucucca

SEQ ID NO: 99110 - RNA, 18 nt, Human
ccaggacacuggugugaa

SEQ ID NO: 99111 - RNA, 32 nt, Human
ccaggacagaagcggcugccagcucugaaucu

SEQ ID NO: 99112 - RNA, 32 nt, Human
ccaggacagagcaagggugacucucagcucag

SEQ ID NO: 99113 - RNA, 20 nt, Human
ccaggacagcugccaccucu

SEQ ID NO: 99114 - RNA, 32 nt, Human
ccaggacaggacauugugaccaugacccagcc

SEQ ID NO: 99115 - RNA, 32 nt, Human
ccaggacaggagcaacugucucagggaggaca

SEQ ID NO: 99116 - RNA, 32 nt, Human
ccaggacaggcaggagcaguggaauagcuacu

SEQ ID NO: 99117 - RNA, 32 nt, Human
ccaggacaggcauucaggcagagcaagcucca

SEQ ID NO: 99118 - RNA, 19 nt, Human
ccaggacaggcucucgaca

SEQ ID NO: 99119 - RNA, 22 nt, Human
ccaggacaggcucucgacaggg

SEQ ID NO: 99120 - RNA, 32 nt, Human
ccaggacaggugaacagggagggaccucccca

SEQ ID NO: 99121 - RNA, 19 nt, Human
ccaggacagucccccuccc

SEQ ID NO: 99122 - RNA, 32 nt, Human
ccaggacaguguggaggagaccuaccugggag

SEQ ID NO: 99123 - RNA, 25 nt, Human
ccaggacaguguuacuucuucugca

SEQ ID NO: 99124 - RNA, 32 nt, Human
ccaggacaucucuuuaaaggcuguaauguuaa

SEQ ID NO: 99125 - RNA, 32 nt, Human
ccaggacaugcugauugccacugucucuucac

SEQ ID NO: 99126 - RNA, 32 nt, Human
ccaggacaugcugcucccuugugugagugacc

SEQ ID NO: 99127 - RNA, 32 nt, Human
ccaggacauguggccuggcuagugcagcaugg

SEQ ID NO: 99128 - RNA, 19 nt, Human
ccaggaccaacuccugcuc

SEQ ID NO: 99129 - RNA, 32 nt, Human
ccaggaccacugcauuuaccagccugauacug

SEQ ID NO: 99130 - RNA, 32 nt, Human
ccaggaccagaggccaaggcugacaaugggac

SEQ ID NO: 99131 - RNA, 32 nt, Human
ccaggaccagccuguaccuugcuguggggcua

SEQ ID NO: 99132 - RNA, 21 nt, Human
ccaggaccagcgugcugcugc

SEQ ID NO: 99133 - RNA, 32 nt, Human
ccaggaccaucuuuacuuucuccacaaaagcc

SEQ ID NO: 99134 - RNA, 18 nt, Human
ccaggaccauggcugggg

SEQ ID NO: 99135 - RNA, 19 nt, Human
ccaggaccauggcugggga

SEQ ID NO: 99136 - RNA, 32 nt, Human
ccaggacccaauucuccacuugcucagggacu

SEQ ID NO: 99137 - RNA, 22 nt, Human
ccaggacccacagcccucccca

SEQ ID NO: 99138 - RNA, 32 nt, Human
ccaggacccacuggagccagccccacccuagg

SEQ ID NO: 99139 - RNA, 32 nt, Human
ccaggacccagaagcaccuccuuuguagacag

SEQ ID NO: 99140 - RNA, 32 nt, Human
ccaggacccagcucugggagugcagcuggaau

SEQ ID NO: 99141 - RNA, 23 nt, Human
ccaggacccaggaggccucccca

SEQ ID NO: 99142 - RNA, 32 nt, Human
ccaggacccaggaggugugauuccugaaggca

SEQ ID NO: 99143 - RNA, 32 nt, Human
ccaggacccaggcuguggaucacggggccugc

SEQ ID NO: 99144 - RNA, 20 nt, Human
ccaggacccaggucugcugc

SEQ ID NO: 99145 - RNA, 19 nt, Human
ccaggacccagucgcugcu

SEQ ID NO: 99146 - RNA, 22 nt, Human
ccaggacccccacaccacccca

SEQ ID NO: 99147 - RNA, 24 nt, Human
ccaggacccccaggcccccucccc

SEQ ID NO: 99148 - RNA, 22 nt, Human
ccaggaccccccggauucucca

SEQ ID NO: 99149 - RNA, 21 nt, Human
ccaggacccccgacgccgccu

SEQ ID NO: 99150 - RNA, 21 nt, Human
ccaggaccccuugcucugcuc

SEQ ID NO: 99151 - RNA, 19 nt, Human
ccaggacccuaagcugcuc

SEQ ID NO: 99152 - RNA, 32 nt, Human
ccaggacccucagacccacgggccaacaaugg

SEQ ID NO: 99153 - RNA, 32 nt, Human
ccaggacccuggcauaugauacaccagagcug

SEQ ID NO: 99154 - RNA, 32 nt, Human
ccaggacccuggggacagagagaugaacugcu

SEQ ID NO: 99155 - RNA, 20 nt, Human
ccaggaccgcaccgcugcuc

SEQ ID NO: 99156 - RNA, 32 nt, Human
ccaggaccggugggguacaaaggggcccaugc

SEQ ID NO: 99157 - RNA, 22 nt, Human
ccaggaccuaugcucccugcuc

SEQ ID NO: 99158 - RNA, 32 nt, Human
ccaggaccuccccucagguuguucucugauuc

SEQ ID NO: 99159 - RNA, 19 nt, Human
ccaggaccuccucucuggc

SEQ ID NO: 99160 - RNA, 20 nt, Human
ccaggaccuccugccagcuc

SEQ ID NO: 99161 - RNA, 32 nt, Human
ccaggaccucgcuuuccaucuguucuuguugc

SEQ ID NO: 99162 - RNA, 20 nt, Human
ccaggaccugccucuuccca

SEQ ID NO: 99163 - RNA, 32 nt, Human
ccaggaccugcugugugaaaucgaagacucgc

SEQ ID NO: 99164 - RNA, 20 nt, Human
ccaggaccuggagggggugc

SEQ ID NO: 99165 - RNA, 21 nt, Human
ccaggaccuggauugcuacuu

SEQ ID NO: 99166 - RNA, 21 nt, Human
ccaggaccugggagcugacuc

SEQ ID NO: 99167 - RNA, 22 nt, Human
ccaggaccuucguggagcugcu

SEQ ID NO: 99168 - RNA, 21 nt, Human
ccaggaccuugggggcaccca

SEQ ID NO: 99169 - RNA, 18 nt, Human
ccaggaccuugugggcug

SEQ ID NO: 99170 - RNA, 32 nt, Human
ccaggaccuuucucuuccuccuccuccaauuc

SEQ ID NO: 99171 - RNA, 22 nt, Human
ccaggacgacuggaccauggau

SEQ ID NO: 99172 - RNA, 21 nt, Human
ccaggacgagugacucuucca

SEQ ID NO: 99173 - RNA, 32 nt, Human
ccaggacgaucacacagagaugaauggcaucu

SEQ ID NO: 99174 - RNA, 24 nt, Human
ccaggacgcagagguugcggugag

SEQ ID NO: 99175 - RNA, 32 nt, Human
ccaggacgcuuccucaagcccagccuucuaca

SEQ ID NO: 99176 - RNA, 32 nt, Human
ccaggacggaggaggagguggugaaacaggaa

SEQ ID NO: 99177 - RNA, 32 nt, Human
ccaggacgugcugcucccuugugugagugacc

SEQ ID NO: 99178 - RNA, 22 nt, Human
ccaggacuacaaccaggacuca

SEQ ID NO: 99179 - RNA, 32 nt, Human
ccaggacuagaaccuuguguccuuugaauucu

SEQ ID NO: 99180 - RNA, 21 nt, Human
ccaggacuccaccuaagguca

SEQ ID NO: 99181 - RNA, 32 nt, Human
ccaggacuccacugcuaauucgggcccaucuu

SEQ ID NO: 99182 - RNA, 32 nt, Human
ccaggacuccagccugaaccaggugccuccaa

SEQ ID NO: 99183 - RNA, 32 nt, Human
ccaggacucccagaaccucuaagugcugcugu

SEQ ID NO: 99184 - RNA, 32 nt, Human
ccaggacucccagcucaucccuugccacauuu

SEQ ID NO: 99185 - RNA, 32 nt, Human
ccaggacucuccccaucuccagaggcccccac

SEQ ID NO: 99186 - RNA, 32 nt, Human
ccaggacucugucagcucugcugcccacaugc

SEQ ID NO: 99187 - RNA, 19 nt, Human
ccaggacugaagacaguug

SEQ ID NO: 99188 - RNA, 32 nt, Human
ccaggacugagaacagggagaggcgacccgac

SEQ ID NO: 99189 - RNA, 32 nt, Human
ccaggacugagacugggcucuguuuuccaagg

SEQ ID NO: 99190 - RNA, 24 nt, Human
ccaggacugccccuuccugggcca

SEQ ID NO: 99191 - RNA, 21 nt, Human
ccaggacugcccgggcgcagg

SEQ ID NO: 99192 - RNA, 32 nt, Human
ccaggacugccugggacucccuggcaacccag

SEQ ID NO: 99193 - RNA, 32 nt, Human
ccaggacugcucaggcggagagaucccugccc

SEQ ID NO: 99194 - RNA, 32 nt, Human
ccaggacugcucugagauuugagggaaacaug

SEQ ID NO: 99195 - RNA, 32 nt, Human
ccaggacugcuuguccgcuaucaucacuguuu

SEQ ID NO: 99196 - RNA, 32 nt, Human
ccaggacugggcaguugcaggaggcccugggg

SEQ ID NO: 99197 - RNA, 22 nt, Human
ccaggacuggggugacggcagg

SEQ ID NO: 99198 - RNA, 32 nt, Human
ccaggacuguccgcgggguugagggaaggggc

SEQ ID NO: 99199 - RNA, 32 nt, Human
ccaggacuguucagggaggagccccggucaga

SEQ ID NO: 99200 - RNA, 32 nt, Human
ccaggacuuagcgaggggccagagccaagcau

SEQ ID NO: 99201 - RNA, 32 nt, Human
ccaggacuucaagaccagccuaggcaacaugg

SEQ ID NO: 99202 - RNA, 21 nt, Human
ccaggacuucagggccacagg

SEQ ID NO: 99203 - RNA, 32 nt, Human
ccaggacuuccagacagaguaccagguuuuau

SEQ ID NO: 99204 - RNA, 24 nt, Human
ccaggacuucuuagcucaguauca

SEQ ID NO: 99205 - RNA, 25 nt, Human
ccaggacuugagggacccaguccca

SEQ ID NO: 99206 - RNA, 32 nt, Human
ccaggacuuugggugggucuucccagggagua

SEQ ID NO: 99207 - RNA, 32 nt, Human
ccaggagaaagccaaaaaggagcaagaaggca

SEQ ID NO: 99208 - RNA, 32 nt, Human
ccaggagaaagccauguucaguucgagcgcca

SEQ ID NO: 99209 - RNA, 32 nt, Human
ccaggagaacauccgcgaaggcuguuggaggu

SEQ ID NO: 99210 - RNA, 32 nt, Human
ccaggagaacugcuccauguuggcucagcaga

SEQ ID NO: 99211 - RNA, 17 nt, Human
ccaggagaagacauuug

SEQ ID NO: 99212 - RNA, 32 nt, Human
ccaggagaaucacuugaacccaggaggcagcu

SEQ ID NO: 99213 - RNA, 32 nt, Human
ccaggagacaaggcggccauggauuugcccuu

SEQ ID NO: 99214 - RNA, 24 nt, Human
ccaggagacagagguugcagugag

SEQ ID NO: 99215 - RNA, 24 nt, Human
ccaggagacagagguuguagugag

SEQ ID NO: 99216 - RNA, 24 nt, Human
ccaggagacagagguugugguggg

SEQ ID NO: 99217 - RNA, 22 nt, Human
ccaggagacagguugcagugag

SEQ ID NO: 99218 - RNA, 32 nt, Human
ccaggagaccaaaggcugcaggugucuucaca

SEQ ID NO: 99219 - RNA, 25 nt, Human
ccaggagaccagccugggcaacaua

SEQ ID NO: 99220 - RNA, 32 nt, Human
ccaggagacccuggcccugcccugugcccugg

SEQ ID NO: 99221 - RNA, 24 nt, Human
ccaggagacggaaguugcagugag

SEQ ID NO: 99222 - RNA, 24 nt, Human
ccaggagacggagcuugcagugag

SEQ ID NO: 99223 - RNA, 23 nt, Human
ccaggagacggagguugcaguga

SEQ ID NO: 99224 - RNA, 24 nt, Human
ccaggagacggagguugcagugag

SEQ ID NO: 99225 - RNA, 24 nt, Human
ccaggagacggagguugcggugag

SEQ ID NO: 99226 - RNA, 23 nt, Human
ccaggagacggagguuucaguga

SEQ ID NO: 99227 - RNA, 24 nt, Human
ccaggagacggugguugcagugag

SEQ ID NO: 99228 - RNA, 32 nt, Human
ccaggagacgugaggggaagccuggaucugug

SEQ ID NO: 99229 - RNA, 32 nt, Human
ccaggagagaacacggggagguuuguuugugu

SEQ ID NO: 99230 - RNA, 32 nt, Human
ccaggagagaccuucucuuaggacaguaaacu

SEQ ID NO: 99231 - RNA, 32 nt, Human
ccaggagagaugggauccccuggggaaccagg

SEQ ID NO: 99232 - RNA, 32 nt, Human
ccaggagagccccauucccagccccuggucuc

SEQ ID NO: 99233 - RNA, 32 nt, Human
ccaggagagcgccuucucucuccagccaucac

SEQ ID NO: 99234 - RNA, 32 nt, Human
ccaggagaggacacgggcaggagcccuggccc

SEQ ID NO: 99235 - RNA, 32 nt, Human
ccaggagaggcagagggaggcacagccccgac

SEQ ID NO: 99236 - RNA, 32 nt, Human
ccaggagaguagcugggccaggcaaggggagg

SEQ ID NO: 99237 - RNA, 32 nt, Human
ccaggagaguggagucucucacugcaugugac

SEQ ID NO: 99238 - RNA, 25 nt, Human
ccaggagaguggcggugcgcacggg

SEQ ID NO: 99239 - RNA, 32 nt, Human
ccaggagaguugagagggugggggacacagag

SEQ ID NO: 99240 - RNA, 32 nt, Human
ccaggagauaccgcgcccacacccaaucuugg

SEQ ID NO: 99241 - RNA, 24 nt, Human
ccaggagauagagguugcaaugag

SEQ ID NO: 99242 - RNA, 23 nt, Human
ccaggagaucaaggcugcagcga

SEQ ID NO: 99243 - RNA, 25 nt, Human
ccaggagaugcaggcuugcagugag

SEQ ID NO: 99244 - RNA, 32 nt, Human
ccaggagaugcaggcuugcagugagccaugau

SEQ ID NO: 99245 - RNA, 24 nt, Human
ccaggagauggaaguugcagugag

SEQ ID NO: 99246 - RNA, 32 nt, Human
ccaggagauggacuggcuggugcugggggagc

SEQ ID NO: 99247 - RNA, 24 nt, Human
ccaggagauggagguugcagugag

SEQ ID NO: 99248 - RNA, 24 nt, Human
ccaggagauggagguugcggugag

SEQ ID NO: 99249 - RNA, 18 nt, Human
ccaggagauggugcagga

SEQ ID NO: 99250 - RNA, 19 nt, Human
ccaggagaugugggcagga

SEQ ID NO: 99251 - RNA, 32 nt, Human
ccaggagauugagaccagccugggcaacauag

SEQ ID NO: 99252 - RNA, 24 nt, Human
ccaggagauugaggcugcagugag

SEQ ID NO: 99253 - RNA, 32 nt, Human
ccaggagcacauaccacaaacuaccacaaaua

SEQ ID NO: 99254 - RNA, 32 nt, Human
ccaggagcacauucuggggagcacacaccugc

SEQ ID NO: 99255 - RNA, 32 nt, Human
ccaggagcacccaggcuugggcagcaaucucu

SEQ ID NO: 99256 - RNA, 16 nt, Human
ccaggagcagagccag

SEQ ID NO: 99257 - RNA, 32 nt, Human
ccaggagcagaggccuccugccggcaaccagc

SEQ ID NO: 99258 - RNA, 32 nt, Human
ccaggagcagcagaggaggcugacaggcccug

SEQ ID NO: 99259 - RNA, 19 nt, Human
ccaggagcagcugcuguga

SEQ ID NO: 99260 - RNA, 32 nt, Human
ccaggagcaguggcucaugcccguaaucccag

SEQ ID NO: 99261 - RNA, 32 nt, Human
ccaggagccagcugcuagcuggaccccuccau

SEQ ID NO: 99262 - RNA, 32 nt, Human
ccaggagccaggggucagggaggaggcugagg

SEQ ID NO: 99263 - RNA, 32 nt, Human
ccaggagccauccuggaauuucugaccuugag

SEQ ID NO: 99264 - RNA, 32 nt, Human
ccaggagcccacaggaccuggagcucuggaag

SEQ ID NO: 99265 - RNA, 32 nt, Human
ccaggagcccaugcacgcccacugccugcccu

SEQ ID NO: 99266 - RNA, 32 nt, Human
ccaggagccccagaacagacauggaccuccuc

SEQ ID NO: 99267 - RNA, 32 nt, Human
ccaggagcccccagaggccaggacacgcccuc

SEQ ID NO: 99268 - RNA, 22 nt, Human
ccaggagccccccaggcugccu

SEQ ID NO: 99269 - RNA, 18 nt, Human
ccaggagcccugcugcuu

SEQ ID NO: 99270 - RNA, 32 nt, Human
ccaggagcccugcugcuuugcuuggugguagg

SEQ ID NO: 99271 - RNA, 32 nt, Human
ccaggagccggagcagcggcacugccugaacc

SEQ ID NO: 99272 - RNA, 18 nt, Human
ccaggagccggcugggag

SEQ ID NO: 99273 - RNA, 32 nt, Human
ccaggagccuccaggauggagauggagaccca

SEQ ID NO: 99274 - RNA, 32 nt, Human
ccaggagcggcggcucaugccuguaaucccag

SEQ ID NO: 99275 - RNA, 23 nt, Human
ccaggagcgggggcggcgggggg

SEQ ID NO: 99276 - RNA, 32 nt, Human
ccaggagcuaaguaaggcaggagagcugacuu

SEQ ID NO: 99277 - RNA, 32 nt, Human
ccaggagcuagccagccagcagagccaaaccu

SEQ ID NO: 99278 - RNA, 32 nt, Human
ccaggagcucaagaacagccugggcaaaauag

SEQ ID NO: 99279 - RNA, 32 nt, Human
ccaggagcucaagaccagccuggacaacaugg

SEQ ID NO: 99280 - RNA, 32 nt, Human
ccaggagcucaagagcagccugggcaauacag

SEQ ID NO: 99281 - RNA, 24 nt, Human
ccaggagcucaagauugcagugag

SEQ ID NO: 99282 - RNA, 32 nt, Human
ccaggagcucaagucccaccugggcaacauag

SEQ ID NO: 99283 - RNA, 32 nt, Human
ccaggagcuccuggugggcaucguuguggaga

SEQ ID NO: 99284 - RNA, 32 nt, Human
ccaggagcucuagaccaccacacccauccccg

SEQ ID NO: 99285 - RNA, 32 nt, Human
ccaggagcucuggagcccccagaggagauaag

SEQ ID NO: 99286 - RNA, 32 nt, Human
ccaggagcugccagaggugaaggagcaggaag

SEQ ID NO: 99287 - RNA, 32 nt, Human
ccaggagcugccgugccugugccuggagggcu

SEQ ID NO: 99288 - RNA, 32 nt, Human
ccaggagcuggagaucagccugggcaacacag

SEQ ID NO: 99289 - RNA, 32 nt, Human
ccaggagcuggcugaaagccacuuuguacaug

SEQ ID NO: 99290 - RNA, 18 nt, Human
ccaggagcugggcagugg

SEQ ID NO: 99291 - RNA, 32 nt, Human
ccaggagcugucugagaaaccaggaagaaacc

SEQ ID NO: 99292 - RNA, 32 nt, Human
ccaggagcugugggaggaaacgcccucaguaa

SEQ ID NO: 99293 - RNA, 32 nt, Human
ccaggagcuuaagaccagccugggcaacauaa

SEQ ID NO: 99294 - RNA, 19 nt, Human
ccaggagcuuccacucuca

SEQ ID NO: 99295 - RNA, 19 nt, Human
ccaggagcuuccccugcca

SEQ ID NO: 99296 - RNA, 32 nt, Human
ccaggaggaaaagcuccucuccccaccuccac

SEQ ID NO: 99297 - RNA, 32 nt, Human
ccaggaggaacacauguggugucuguauggcu

SEQ ID NO: 99298 - RNA, 32 nt, Human
ccaggaggaacaguaacucuuccuucgggugg

SEQ ID NO: 99299 - RNA, 32 nt, Human
ccaggaggaagagccuuugugcauuugacuga

SEQ ID NO: 99300 - RNA, 24 nt, Human
ccaggaggaagagguugcagugag

SEQ ID NO: 99301 - RNA, 30 nt, Human
ccaggaggaagccagggcaggguuccgcgg

SEQ ID NO: 99302 - RNA, 20 nt, Human
ccaggaggaagggagggcag

SEQ ID NO: 99303 - RNA, 19 nt, Human
ccaggaggacaggagcccc

SEQ ID NO: 99304 - RNA, 32 nt, Human
ccaggaggacccucauucccagccuggcuguc

SEQ ID NO: 99305 - RNA, 32 nt, Human
ccaggaggagaaacaggacuugggcgaggagg

SEQ ID NO: 99306 - RNA, 24 nt, Human
ccaggaggagaccagguugcagug

SEQ ID NO: 99307 - RNA, 32 nt, Human
ccaggaggagaccagguugcaguggcguaagg

SEQ ID NO: 99308 - RNA, 32 nt, Human
ccaggaggagacccuccccugccuucgaggcc

SEQ ID NO: 99309 - RNA, 32 nt, Human
ccaggaggagagaagaauuccagugagcagca

SEQ ID NO: 99310 - RNA, 18 nt, Human
ccaggaggagcugaggcu

SEQ ID NO: 99311 - RNA, 32 nt, Human
ccaggaggagcuguggucagaggaggagccgg

SEQ ID NO: 99312 - RNA, 32 nt, Human
ccaggaggaggaagaggaggcugguugguacc

SEQ ID NO: 99313 - RNA, 32 nt, Human
ccaggaggaggagaggaggaggggaggagaag

SEQ ID NO: 99314 - RNA, 24 nt, Human
ccaggaggaggagcuugcagugag

SEQ ID NO: 99315 - RNA, 32 nt, Human
ccaggaggaggaggaggaggaggaggagagcg

SEQ ID NO: 99316 - RNA, 24 nt, Human
ccaggaggaggaggcugcagugag

SEQ ID NO: 99317 - RNA, 24 nt, Human
ccaggaggaggaggucgcagugag

SEQ ID NO: 99318 - RNA, 23 nt, Human
ccaggaggaggagguugcaguga

SEQ ID NO: 99319 - RNA, 24 nt, Human
ccaggaggaggagguugcagugag

SEQ ID NO: 99320 - RNA, 32 nt, Human
ccaggaggagguggagaucgcagugagcugag

SEQ ID NO: 99321 - RNA, 32 nt, Human
ccaggaggagguuugagcugagcucaggcaca

SEQ ID NO: 99322 - RNA, 32 nt, Human
ccaggaggagugucaggaagugcaucagccug

SEQ ID NO: 99323 - RNA, 32 nt, Human
ccaggaggaugaaaggccccagcugggggcuc

SEQ ID NO: 99324 - RNA, 24 nt, Human
ccaggaggcaaaggcugcagugag

SEQ ID NO: 99325 - RNA, 24 nt, Human
ccaggaggcaaagguugcagugag

SEQ ID NO: 99326 - RNA, 24 nt, Human
ccaggaggcacagauugcagugag

SEQ ID NO: 99327 - RNA, 21 nt, Human
ccaggaggcacagcuaggggc

SEQ ID NO: 99328 - RNA, 24 nt, Human
ccaggaggcacagcuugcagugag

SEQ ID NO: 99329 - RNA, 24 nt, Human
ccaggaggcacaggcugcagugag

SEQ ID NO: 99330 - RNA, 24 nt, Human
ccaggaggcacaguuugcagugag

SEQ ID NO: 99331 - RNA, 24 nt, Human
ccaggaggcagaaguugcagugag

SEQ ID NO: 99332 - RNA, 24 nt, Human
ccaggaggcagagaucgcagugag

SEQ ID NO: 99333 - RNA, 24 nt, Human
ccaggaggcagagauggcagugag

SEQ ID NO: 99334 - RNA, 24 nt, Human
ccaggaggcagagauugcagucag

SEQ ID NO: 99335 - RNA, 24 nt, Human
ccaggaggcagagauugcagugag

SEQ ID NO: 99336 - RNA, 24 nt, Human
ccaggaggcagagauugcggugag

SEQ ID NO: 99337 - RNA, 23 nt, Human
ccaggaggcagagcuugcaguga

SEQ ID NO: 99338 - RNA, 24 nt, Human
ccaggaggcagagcuugcagugag

SEQ ID NO: 99339 - RNA, 24 nt, Human
ccaggaggcagagcuuguagugag

SEQ ID NO: 99340 - RNA, 24 nt, Human
ccaggaggcagaggcuacagugag

SEQ ID NO: 99341 - RNA, 24 nt, Human
ccaggaggcagaggcugcagugag

SEQ ID NO: 99342 - RNA, 24 nt, Human
ccaggaggcagaggcuguggugag

SEQ ID NO: 99343 - RNA, 32 nt, Human
ccaggaggcagaggguugcagugagccgagau

SEQ ID NO: 99344 - RNA, 24 nt, Human
ccaggaggcagaggucgcagugag

SEQ ID NO: 99345 - RNA, 21 nt, Human
ccaggaggcagagguuacagu

SEQ ID NO: 99346 - RNA, 24 nt, Human
ccaggaggcagagguuacagugag

SEQ ID NO: 99347 - RNA, 24 nt, Human
ccaggaggcagagguuccagugag

SEQ ID NO: 99348 - RNA, 23 nt, Human
ccaggaggcagagguugcaauga

SEQ ID NO: 99349 - RNA, 24 nt, Human
ccaggaggcagagguugcaaugag

SEQ ID NO: 99350 - RNA, 24 nt, Human
ccaggaggcagagguugcagcgag

SEQ ID NO: 99351 - RNA, 21 nt, Human
ccaggaggcagagguugcagu

SEQ ID NO: 99352 - RNA, 24 nt, Human
ccaggaggcagagguugcagucag

SEQ ID NO: 99353 - RNA, 23 nt, Human
ccaggaggcagagguugcaguga

SEQ ID NO: 99354 - RNA, 24 nt, Human
ccaggaggcagagguugcagugag

SEQ ID NO: 99355 - RNA, 24 nt, Human
ccaggaggcagagguugcaguggg

SEQ ID NO: 99356 - RNA, 24 nt, Human
ccaggaggcagagguugcaguuag

SEQ ID NO: 99357 - RNA, 24 nt, Human
ccaggaggcagagguugcauugag

SEQ ID NO: 99358 - RNA, 24 nt, Human
ccaggaggcagagguugcggugag

SEQ ID NO: 99359 - RNA, 24 nt, Human
ccaggaggcagagguugcguugag

SEQ ID NO: 99360 - RNA, 24 nt, Human
ccaggaggcagagguuggggugag

SEQ ID NO: 99361 - RNA, 27 nt, Human
ccaggaggcagagguuguugcagugag

SEQ ID NO: 99362 - RNA, 22 nt, Human
ccaggaggcagagugagccgag

SEQ ID NO: 99363 - RNA, 22 nt, Human
ccaggaggcagaguucccauga

SEQ ID NO: 99364 - RNA, 24 nt, Human
ccaggaggcagaguuugcagugag

SEQ ID NO: 99365 - RNA, 21 nt, Human
ccaggaggcagaugguaguga

SEQ ID NO: 99366 - RNA, 22 nt, Human
ccaggaggcagccacaggcgag

SEQ ID NO: 99367 - RNA, 32 nt, Human
ccaggaggcagccacaggcgagugccagcagu

SEQ ID NO: 99368 - RNA, 18 nt, Human
ccaggaggcagccgguga

SEQ ID NO: 99369 - RNA, 32 nt, Human
ccaggaggcagcugcugacagguuugcuacac

SEQ ID NO: 99370 - RNA, 24 nt, Human
ccaggaggcagcuguugcagugag

SEQ ID NO: 99371 - RNA, 23 nt, Human
ccaggaggcaggacaacacugag

SEQ ID NO: 99372 - RNA, 21 nt, Human
ccaggaggcaggagcagcggg

SEQ ID NO: 99373 - RNA, 17 nt, Human
ccaggaggcaggcagug

SEQ ID NO: 99374 - RNA, 32 nt, Human
ccaggaggcaggcaguggcuaugacagugagg

SEQ ID NO: 99375 - RNA, 24 nt, Human
ccaggaggcagugauugcagugag

SEQ ID NO: 99376 - RNA, 24 nt, Human
ccaggaggccaagucugcagugag

SEQ ID NO: 99377 - RNA, 32 nt, Human
ccaggaggccagggaaagcaucucuggcucac

SEQ ID NO: 99378 - RNA, 32 nt, Human
ccaggaggcccaguuaaagcggcucgagguga

SEQ ID NO: 99379 - RNA, 24 nt, Human
ccaggaggccccugcugcagagag

SEQ ID NO: 99380 - RNA, 32 nt, Human
ccaggaggccgagccccaggaggcggcggggg

SEQ ID NO: 99381 - RNA, 24 nt, Human
ccaggaggcgaagauugcagugag

SEQ ID NO: 99382 - RNA, 24 nt, Human
ccaggaggcgaagauugccgugag

SEQ ID NO: 99383 - RNA, 23 nt, Human
ccaggaggcgaagguugcaguga

SEQ ID NO: 99384 - RNA, 24 nt, Human
ccaggaggcgaagguugcagugag

SEQ ID NO: 99385 - RNA, 23 nt, Human
ccaggaggcgcaggcugcaguga

SEQ ID NO: 99386 - RNA, 24 nt, Human
ccaggaggcgcaggcugcagugag

SEQ ID NO: 99387 - RNA, 24 nt, Human
ccaggaggcggaaguugcagugag

SEQ ID NO: 99388 - RNA, 24 nt, Human
ccaggaggcggaccuuguagugag

SEQ ID NO: 99389 - RNA, 24 nt, Human
ccaggaggcggacguugcagugag

SEQ ID NO: 99390 - RNA, 24 nt, Human
ccaggaggcggagauugcagugag

SEQ ID NO: 99391 - RNA, 24 nt, Human
ccaggaggcggagcuggcagugag

SEQ ID NO: 99392 - RNA, 24 nt, Human
ccaggaggcggagcuuacagugag

SEQ ID NO: 99393 - RNA, 24 nt, Human
ccaggaggcggagcuugcagugag

SEQ ID NO: 99394 - RNA, 23 nt, Human
ccaggaggcggaggaggcuagug

SEQ ID NO: 99395 - RNA, 22 nt, Human
ccaggaggcggaggcugcagug

SEQ ID NO: 99396 - RNA, 23 nt, Human
ccaggaggcggaggcugcaguga

SEQ ID NO: 99397 - RNA, 24 nt, Human
ccaggaggcggaggcugcagugag

SEQ ID NO: 99398 - RNA, 24 nt, Human
ccaggaggcggagguagcagugag

SEQ ID NO: 99399 - RNA, 24 nt, Human
ccaggaggcggagguaguggugag

SEQ ID NO: 99400 - RNA, 24 nt, Human
ccaggaggcggagguuacagucag

SEQ ID NO: 99401 - RNA, 24 nt, Human
ccaggaggcggagguuacagugag

SEQ ID NO: 99402 - RNA, 24 nt, Human
ccaggaggcggagguuccagugag

SEQ ID NO: 99403 - RNA, 24 nt, Human
ccaggaggcggagguugcacugag

SEQ ID NO: 99404 - RNA, 24 nt, Human
ccaggaggcggagguugcagggag

SEQ ID NO: 99405 - RNA, 21 nt, Human
ccaggaggcggagguugcagu

SEQ ID NO: 99406 - RNA, 22 nt, Human
ccaggaggcggagguugcagug

SEQ ID NO: 99407 - RNA, 23 nt, Human
ccaggaggcggagguugcaguga

SEQ ID NO: 99408 - RNA, 24 nt, Human
ccaggaggcggagguugcagugag

SEQ ID NO: 99409 - RNA, 24 nt, Human
ccaggaggcggagguugccgugag

SEQ ID NO: 99410 - RNA, 23 nt, Human
ccaggaggcggagguugcgguga

SEQ ID NO: 99411 - RNA, 24 nt, Human
ccaggaggcggagguugcggugag

SEQ ID NO: 99412 - RNA, 24 nt, Human
ccaggaggcggagguuguagugag

SEQ ID NO: 99413 - RNA, 24 nt, Human
ccaggaggcggagguuguggugag

SEQ ID NO: 99414 - RNA, 21 nt, Human
ccaggaggcggaguggaagug

SEQ ID NO: 99415 - RNA, 24 nt, Human
ccaggaggcggugcuugcagggag

SEQ ID NO: 99416 - RNA, 24 nt, Human
ccaggaggcguagcuagcagugag

SEQ ID NO: 99417 - RNA, 32 nt, Human
ccaggaggcguuuggggguggggaaggcaccu

SEQ ID NO: 99418 - RNA, 32 nt, Human
ccaggaggcugaagcaggauaaucgcuugaac

SEQ ID NO: 99419 - RNA, 32 nt, Human
ccaggaggcugagacaggagaaucgcuugaac

SEQ ID NO: 99420 - RNA, 32 nt, Human
ccaggaggcugaggcaagagaaucacuugaac

SEQ ID NO: 99421 - RNA, 32 nt, Human
ccaggaggcugaggcaggagaaucacuugaac

SEQ ID NO: 99422 - RNA, 32 nt, Human
ccaggaggcugaggcaggagaaucgcuggaac

SEQ ID NO: 99423 - RNA, 32 nt, Human
ccaggaggcugaggcaggagaaucgcuugaac

SEQ ID NO: 99424 - RNA, 32 nt, Human
ccaggaggcugaggcaggagaauugcugaaac

SEQ ID NO: 99425 - RNA, 24 nt, Human
ccaggaggcugagguugcagugag

SEQ ID NO: 99426 - RNA, 32 nt, Human
ccaggaggcugauccuauagagacgucugguu

SEQ ID NO: 99427 - RNA, 24 nt, Human
ccaggaggcugcagcuaccacgag

SEQ ID NO: 99428 - RNA, 32 nt, Human
ccaggaggcugcagcuaccacgagggccucug

SEQ ID NO: 99429 - RNA, 32 nt, Human
ccaggaggcugcagcugcuuccccaaggccac

SEQ ID NO: 99430 - RNA, 32 nt, Human
ccaggaggcugccagccccuccucuuauuuaa

SEQ ID NO: 99431 - RNA, 32 nt, Human
ccaggaggcugggcggaggugggcaggaugug

SEQ ID NO: 99432 - RNA, 19 nt, Human
ccaggaggcuggggcacau

SEQ ID NO: 99433 - RNA, 32 nt, Human
ccaggaggcuuaguccagucugugcuccuggg

SEQ ID NO: 99434 - RNA, 32 nt, Human
ccaggagggaaugggccuggugccacucuguu

SEQ ID NO: 99435 - RNA, 32 nt, Human
ccaggagggaccacccucccugacuggccugg

SEQ ID NO: 99436 - RNA, 32 nt, Human
ccaggagggaccggaggugugacagauacugu

SEQ ID NO: 99437 - RNA, 32 nt, Human
ccaggagggaggcaggggaggggugcggcggu

SEQ ID NO: 99438 - RNA, 19 nt, Human
ccaggagggagugcagugg

SEQ ID NO: 99439 - RNA, 32 nt, Human
ccaggagggcacacccucccacugccccucuc

SEQ ID NO: 99440 - RNA, 32 nt, Human
ccaggagggcccugaccucccacugcccagga

SEQ ID NO: 99441 - RNA, 32 nt, Human
ccaggagggcucgagcuggacacuccuggcug

SEQ ID NO: 99442 - RNA, 32 nt, Human
ccaggaggggaacugagucacgcuggggcucu

SEQ ID NO: 99443 - RNA, 32 nt, Human
ccaggaggggaagggaucauggagagcccucu

SEQ ID NO: 99444 - RNA, 32 nt, Human
ccaggaggggaagugggacuucccaguggaga

SEQ ID NO: 99445 - RNA, 32 nt, Human
ccaggaggggagggaaggggaggcggggagag

SEQ ID NO: 99446 - RNA, 22 nt, Human
ccaggaggggaguggcagugag

SEQ ID NO: 99447 - RNA, 32 nt, Human
ccaggaggggcgaggaaggagggugcuggggg

SEQ ID NO: 99448 - RNA, 24 nt, Human
ccaggagggggagcuuggagcgag

SEQ ID NO: 99449 - RNA, 24 nt, Human
ccaggagggggaguuugcagugag

SEQ ID NO: 99450 - RNA, 32 nt, Human
ccaggagggguagaguuugaagagaagaucau

SEQ ID NO: 99451 - RNA, 32 nt, Human
ccaggagggugagggggagugaagaaggguga

SEQ ID NO: 99452 - RNA, 32 nt, Human
ccaggaggguguaaguucugaaugguuccuug

SEQ ID NO: 99453 - RNA, 24 nt, Human
ccaggagguagaggcugcagugag

SEQ ID NO: 99454 - RNA, 32 nt, Human
ccaggagguagguggagggcaaggccaccaga

SEQ ID NO: 99455 - RNA, 24 nt, Human
ccaggaggucaagccugcagcgag

SEQ ID NO: 99456 - RNA, 24 nt, Human
ccaggaggucaaggcugcagugag

SEQ ID NO: 99457 - RNA, 24 nt, Human
ccaggaggucaaggcuucagugag

SEQ ID NO: 99458 - RNA, 24 nt, Human
ccaggaggucaaggguacagugag

SEQ ID NO: 99459 - RNA, 24 nt, Human
ccaggaggucagggcugcagugag

SEQ ID NO: 99460 - RNA, 24 nt, Human
ccaggagguccaggccgcaaugag

SEQ ID NO: 99461 - RNA, 23 nt, Human
ccaggaggucgaggcugcaguga

SEQ ID NO: 99462 - RNA, 24 nt, Human
ccaggaggucgaggcugcagugag

SEQ ID NO: 99463 - RNA, 22 nt, Human
ccaggaggucgucugcagucag

SEQ ID NO: 99464 - RNA, 24 nt, Human
ccaggaggucuaggcugcagugag

SEQ ID NO: 99465 - RNA, 23 nt, Human
ccaggaggugaagguugcaguga

SEQ ID NO: 99466 - RNA, 24 nt, Human
ccaggaggugcagguugcagugag

SEQ ID NO: 99467 - RNA, 24 nt, Human
ccaggagguggaaacugcagagag

SEQ ID NO: 99468 - RNA, 32 nt, Human
ccaggagguggaccccagagugugaguggcac

SEQ ID NO: 99469 - RNA, 23 nt, Human
ccaggagguggacguugcaguga

SEQ ID NO: 99470 - RNA, 24 nt, Human
ccaggagguggagacugcagugag

SEQ ID NO: 99471 - RNA, 24 nt, Human
ccaggagguggagauugcagugag

SEQ ID NO: 99472 - RNA, 23 nt, Human
ccaggagguggagcuugcaguga

SEQ ID NO: 99473 - RNA, 24 nt, Human
ccaggagguggagcuugcagugag

SEQ ID NO: 99474 - RNA, 32 nt, Human
ccaggagguggaggaaggagcaggugcugccu

SEQ ID NO: 99475 - RNA, 23 nt, Human
ccaggagguggaggaugcaguga

SEQ ID NO: 99476 - RNA, 24 nt, Human
ccaggagguggaggcugcaaugag

SEQ ID NO: 99477 - RNA, 23 nt, Human
ccaggagguggaggcugcaguga

SEQ ID NO: 99478 - RNA, 24 nt, Human
ccaggagguggaggcugcagugag

SEQ ID NO: 99479 - RNA, 24 nt, Human
ccaggagguggaggcugcggugag

SEQ ID NO: 99480 - RNA, 24 nt, Human
ccaggagguggagguagcagugag

SEQ ID NO: 99481 - RNA, 24 nt, Human
ccaggagguggagguuacagugag

SEQ ID NO: 99482 - RNA, 24 nt, Human
ccaggagguggagguuccagugag

SEQ ID NO: 99483 - RNA, 24 nt, Human
ccaggagguggagguugaaaugag

SEQ ID NO: 99484 - RNA, 24 nt, Human
ccaggagguggagguugcaaugag

SEQ ID NO: 99485 - RNA, 24 nt, Human
ccaggagguggagguugcacugag

SEQ ID NO: 99486 - RNA, 20 nt, Human
ccaggagguggagguugcag

SEQ ID NO: 99487 - RNA, 23 nt, Human
ccaggagguggagguugcagcga

SEQ ID NO: 99488 - RNA, 24 nt, Human
ccaggagguggagguugcagcgag

SEQ ID NO: 99489 - RNA, 32 nt, Human
ccaggagguggagguugcagcgagccaagauc

SEQ ID NO: 99490 - RNA, 21 nt, Human
ccaggagguggagguugcagu

SEQ ID NO: 99491 - RNA, 23 nt, Human
ccaggagguggagguugcaguga

SEQ ID NO: 99492 - RNA, 24 nt, Human
ccaggagguggagguugcagugag

SEQ ID NO: 99493 - RNA, 24 nt, Human
ccaggagguggagguugcaguggg

SEQ ID NO: 99494 - RNA, 24 nt, Human
ccaggagguggagguugcaguuag

SEQ ID NO: 99495 - RNA, 23 nt, Human
ccaggagguggagguugcgguga

SEQ ID NO: 99496 - RNA, 24 nt, Human
ccaggagguggagguugcggugag

SEQ ID NO: 99497 - RNA, 24 nt, Human
ccaggagguggagguugcugugag

SEQ ID NO: 99498 - RNA, 24 nt, Human
ccaggagguggagguuguagugag

SEQ ID NO: 99499 - RNA, 24 nt, Human
ccaggagguggagguuucagcgag

SEQ ID NO: 99500 - RNA, 20 nt, Human
ccaggagguggaguugcagu

SEQ ID NO: 99501 - RNA, 23 nt, Human
ccaggagguggaguugcaguaag

SEQ ID NO: 99502 - RNA, 24 nt, Human
ccaggagguggaguuugcagugag

SEQ ID NO: 99503 - RNA, 24 nt, Human
ccaggagguggauguugcagugag

SEQ ID NO: 99504 - RNA, 32 nt, Human
ccaggagguggcugauuuuccuuugugccuuc

SEQ ID NO: 99505 - RNA, 24 nt, Human
ccaggagguggggguugcaccgag

SEQ ID NO: 99506 - RNA, 24 nt, Human
ccaggagguggugguugcagugag

SEQ ID NO: 99507 - RNA, 19 nt, Human
ccaggagguguugcaguga

SEQ ID NO: 99508 - RNA, 23 nt, Human
ccaggagguugaggcugcaguga

SEQ ID NO: 99509 - RNA, 24 nt, Human
ccaggagguugaggcugcagugag

SEQ ID NO: 99510 - RNA, 23 nt, Human
ccaggagguugagguugcaguga

SEQ ID NO: 99511 - RNA, 24 nt, Human
ccaggagguugagguugcagugag

SEQ ID NO: 99512 - RNA, 24 nt, Human
ccaggagguuguggauacagugag

SEQ ID NO: 99513 - RNA, 24 nt, Human
ccaggagguuguggcugcagugag

SEQ ID NO: 99514 - RNA, 18 nt, Human
ccaggaguacugcaggga

SEQ ID NO: 99515 - RNA, 32 nt, Human
ccaggaguaggaagaagggugggcuuccaagu

SEQ ID NO: 99516 - RNA, 32 nt, Human
ccaggaguaguggcugagcucugugaucgcug

SEQ ID NO: 99517 - RNA, 32 nt, Human
ccaggaguauaagagcagccugggcaaaauag

SEQ ID NO: 99518 - RNA, 23 nt, Human
ccaggaguauagguaugugccac

SEQ ID NO: 99519 - RNA, 21 nt, Human
ccaggaguaucuccucaggug

SEQ ID NO: 99520 - RNA, 24 nt, Human
ccaggagucaaaagcugcagugag

SEQ ID NO: 99521 - RNA, 24 nt, Human
ccaggagucagagguuucagugag

SEQ ID NO: 99522 - RNA, 32 nt, Human
ccaggagucccacuccaagccagcaagccgaa

SEQ ID NO: 99523 - RNA, 21 nt, Human
ccaggagucuaggccuuggua

SEQ ID NO: 99524 - RNA, 32 nt, Human
ccaggagucugagaccagccugggcaacauag

SEQ ID NO: 99525 - RNA, 32 nt, Human
ccaggagucugagaccagccugggcaacaugg

SEQ ID NO: 99526 - RNA, 32 nt, Human
ccaggagucugaggcacaagaaucacucgaac

SEQ ID NO: 99527 - RNA, 32 nt, Human
ccaggagucugcacucuucagucuuugcaggc

SEQ ID NO: 99528 - RNA, 18 nt, Human
ccaggagucuuggcauga

SEQ ID NO: 99529 - RNA, 32 nt, Human
ccaggagugagggcuggggagggaccuaacug

SEQ ID NO: 99530 - RNA, 32 nt, Human
ccaggagugccucagcccaucuguccggagag

SEQ ID NO: 99531 - RNA, 18 nt, Human
ccaggaguggacugcgga

SEQ ID NO: 99532 - RNA, 32 nt, Human
ccaggaguggccaggcccugcccgcccaccau

SEQ ID NO: 99533 - RNA, 32 nt, Human
ccaggaguggguggagaguggagugugcuggg

SEQ ID NO: 99534 - RNA, 32 nt, Human
ccaggaguggguggggagugggggugggggua

SEQ ID NO: 99535 - RNA, 32 nt, Human
ccaggagugguggcggguaccuguaaucccag

SEQ ID NO: 99536 - RNA, 24 nt, Human
ccaggaguuaagaggcugcaguga

SEQ ID NO: 99537 - RNA, 24 nt, Human
ccaggaguucaaagcugcagugag

SEQ ID NO: 99538 - RNA, 24 nt, Human
ccaggaguucaacgcugcagugag

SEQ ID NO: 99539 - RNA, 18 nt, Human
ccaggaguucaagagcag

SEQ ID NO: 99540 - RNA, 32 nt, Human
ccaggaguucaaggccagccugggcaacauag

SEQ ID NO: 99541 - RNA, 32 nt, Human
ccaggaguucaaggccagccugggcaacaugg

SEQ ID NO: 99542 - RNA, 24 nt, Human
ccaggaguucaagguggcagugag

SEQ ID NO: 99543 - RNA, 24 nt, Human
ccaggaguucaagucugcagugag

SEQ ID NO: 99544 - RNA, 24 nt, Human
ccaggaguucagggcugcagugag

SEQ ID NO: 99545 - RNA, 19 nt, Human
ccaggaguuccagaccagc

SEQ ID NO: 99546 - RNA, 21 nt, Human
ccaggaguucgaagcugcagg

SEQ ID NO: 99547 - RNA, 23 nt, Human
ccaggaguucgaggcugcaguga

SEQ ID NO: 99548 - RNA, 24 nt, Human
ccaggaguucgaggcugcagugag

SEQ ID NO: 99549 - RNA, 23 nt, Human
ccaggaguucgagguuacaguga

SEQ ID NO: 99550 - RNA, 24 nt, Human
ccaggaguucgggguuacagugag

SEQ ID NO: 99551 - RNA, 32 nt, Human
ccaggaguugaagaccagccugggcaacacag

SEQ ID NO: 99552 - RNA, 32 nt, Human
ccaggaguugaagaccagccugggcaacauag

SEQ ID NO: 99553 - RNA, 32 nt, Human
ccaggaguugcagaccagccuggguaacauag

SEQ ID NO: 99554 - RNA, 24 nt, Human
ccaggaguuggaggccgcagugag

SEQ ID NO: 99555 - RNA, 24 nt, Human
ccaggaguuggaggcuacagugag

SEQ ID NO: 99556 - RNA, 24 nt, Human
ccaggaguuuaaggcugcagugag

SEQ ID NO: 99557 - RNA, 32 nt, Human
ccaggaguuugaaaccagccugggcaacaugg

SEQ ID NO: 99558 - RNA, 32 nt, Human
ccaggaguuugaaaccagccuggguaacaugg

SEQ ID NO: 99559 - RNA, 24 nt, Human
ccaggaguuugaagcugcagugag

SEQ ID NO: 99560 - RNA, 32 nt, Human
ccaggaguuugacaccagccugggcaacauag

SEQ ID NO: 99561 - RNA, 32 nt, Human
ccaggaguuugacaccagccugggcaacaugg

SEQ ID NO: 99562 - RNA, 32 nt, Human
ccaggaguuugagaccagccuaggcaacacag

SEQ ID NO: 99563 - RNA, 32 nt, Human
ccaggaguuugagaccagccuaggcaacauag

SEQ ID NO: 99564 - RNA, 32 nt, Human
ccaggaguuugagaccagccugggcaaaacag

SEQ ID NO: 99565 - RNA, 32 nt, Human
ccaggaguuugagaccagccugggcaacaaag

SEQ ID NO: 99566 - RNA, 32 nt, Human
ccaggaguuugagaccagccugggcaacacaa

SEQ ID NO: 99567 - RNA, 32 nt, Human
ccaggaguuugagaccagccugggcaacacag

SEQ ID NO: 99568 - RNA, 32 nt, Human
ccaggaguuugagaccagccugggcaacauag

SEQ ID NO: 99569 - RNA, 32 nt, Human
ccaggaguuugagaccagccugggcaacauca

SEQ ID NO: 99570 - RNA, 32 nt, Human
ccaggaguuugagaccagccugggcaacaugg

SEQ ID NO: 99571 - RNA, 32 nt, Human
ccaggaguuugagaccagccugggcaacguag

SEQ ID NO: 99572 - RNA, 32 nt, Human
ccaggaguuugagaccagccugggcaauaugg

SEQ ID NO: 99573 - RNA, 32 nt, Human
ccaggaguuugagaccagccuggguaacauga

SEQ ID NO: 99574 - RNA, 20 nt, Human
ccaggaguuugagaccagcu

SEQ ID NO: 99575 - RNA, 32 nt, Human
ccaggaguuugagacuagccugggcaacaugg

SEQ ID NO: 99576 - RNA, 32 nt, Human
ccaggaguuugagacuagccugggcaacuugg

SEQ ID NO: 99577 - RNA, 32 nt, Human
ccaggaguuugaggccagccugggcaacauag

SEQ ID NO: 99578 - RNA, 24 nt, Human
ccaggaguuugaggcuacagugag

SEQ ID NO: 99579 - RNA, 24 nt, Human
ccaggaguuugaggcuauagugag

SEQ ID NO: 99580 - RNA, 23 nt, Human
ccaggaguuugaggcugcaguga

SEQ ID NO: 99581 - RNA, 24 nt, Human
ccaggaguuugaggcugcagugag

SEQ ID NO: 99582 - RNA, 24 nt, Human
ccaggaguuugaggcugcggugag

SEQ ID NO: 99583 - RNA, 23 nt, Human
ccaggaguuugagguuacaguga

SEQ ID NO: 99584 - RNA, 22 nt, Human
ccaggaguuugagguugcagug

SEQ ID NO: 99585 - RNA, 24 nt, Human
ccaggaguuugagguugcagugag

SEQ ID NO: 99586 - RNA, 32 nt, Human
ccaggaguuugcaggccagacugcaguggccu

SEQ ID NO: 99587 - RNA, 32 nt, Human
ccaggaguuugcgaccagccugggcagaauag

SEQ ID NO: 99588 - RNA, 32 nt, Human
ccaggaguuuguuaccagccugggcaacauag

SEQ ID NO: 99589 - RNA, 32 nt, Human
ccaggauaaaacucagauaccaaggauaaaug

SEQ ID NO: 99590 - RNA, 32 nt, Human
ccaggauagacagaagagcugccgaagaggug

SEQ ID NO: 99591 - RNA, 32 nt, Human
ccaggauaguugcacugagcacugugaggccc

SEQ ID NO: 99592 - RNA, 32 nt, Human
ccaggaucaagcaauucugacucagccuccca

SEQ ID NO: 99593 - RNA, 32 nt, Human
ccaggaucaccaggaagcuccagaggaucccc

SEQ ID NO: 99594 - RNA, 32 nt, Human
ccaggaucaccccaggugucucuucucacgug

SEQ ID NO: 99595 - RNA, 32 nt, Human
ccaggaucacucuacagccugccuccuggguu

SEQ ID NO: 99596 - RNA, 32 nt, Human
ccaggaucagagauggagucucgcucugucac

SEQ ID NO: 99597 - RNA, 22 nt, Human
ccaggaucagcgcccccugcca

SEQ ID NO: 99598 - RNA, 32 nt, Human
ccaggaucauucuuccccuccuccagcuguug

SEQ ID NO: 99599 - RNA, 32 nt, Human
ccaggaucauuucucuuucuucagggccagac

SEQ ID NO: 99600 - RNA, 32 nt, Human
ccaggauccagccucacuucuaggguauggga

SEQ ID NO: 99601 - RNA, 26 nt, Human
ccaggaucgcaacaguuaagcugccu

SEQ ID NO: 99602 - RNA, 32 nt, Human
ccaggaucugcugcgcucauggaggaugucag

SEQ ID NO: 99603 - RNA, 32 nt, Human
ccaggaucuuuaaauuuccauggaugcauaua

SEQ ID NO: 99604 - RNA, 32 nt, Human
ccaggaugaaaccaagagggggaugucagccu

SEQ ID NO: 99605 - RNA, 32 nt, Human
ccaggaugaaauucccccagaaacccaguccu

SEQ ID NO: 99606 - RNA, 32 nt, Human
ccaggaugaacaacguuuccagcugggaauua

SEQ ID NO: 99607 - RNA, 32 nt, Human
ccaggaugacaccuccauuucucuccaggaag

SEQ ID NO: 99608 - RNA, 24 nt, Human
ccaggaugauggcccuguggaugg

SEQ ID NO: 99609 - RNA, 32 nt, Human
ccaggaugcccacuucccuccacccccacacc

SEQ ID NO: 99610 - RNA, 21 nt, Human
ccaggaugcccgggccacagg

SEQ ID NO: 99611 - RNA, 30 nt, Human
ccaggaugccgaauaucaaaaucuucagcg

SEQ ID NO: 99612 - RNA, 32 nt, Human
ccaggaugccucucccccauccgcccccgcug

SEQ ID NO: 99613 - RNA, 32 nt, Human
ccaggaugccuggugccaugugcuugaugcug

SEQ ID NO: 99614 - RNA, 24 nt, Human
ccaggaugcggagguugcagugag

SEQ ID NO: 99615 - RNA, 24 nt, Human
ccaggauggagaggcgggucccag

SEQ ID NO: 99616 - RNA, 30 nt, Human
ccaggauggaggcuccagcccagaaggcug

SEQ ID NO: 99617 - RNA, 19 nt, Human
ccaggauggagugcaguga

SEQ ID NO: 99618 - RNA, 19 nt, Human
ccaggauggagugcagugg

SEQ ID NO: 99619 - RNA, 32 nt, Human
ccaggauggagugcaguggcaugaucucgacu

SEQ ID NO: 99620 - RNA, 32 nt, Human
ccaggauggagugcaguggcaugaucucggcu

SEQ ID NO: 99621 - RNA, 32 nt, Human
ccaggauggagugcaguggcuauucacagguu

SEQ ID NO: 99622 - RNA, 32 nt, Human
ccaggauggagugcaguggcucaaucucggcu

SEQ ID NO: 99623 - RNA, 21 nt, Human
ccaggauggagugcaguggug

SEQ ID NO: 99624 - RNA, 32 nt, Human
ccaggauggagugcagugguugaucauagcuc

SEQ ID NO: 99625 - RNA, 32 nt, Human
ccaggauggccaggccagagcugcagcugggg

SEQ ID NO: 99626 - RNA, 30 nt, Human
ccaggauggcugcagcuccuccaaguuacu

SEQ ID NO: 99627 - RNA, 30 nt, Human
ccaggaugggagcugcugggaggcaggacu

SEQ ID NO: 99628 - RNA, 32 nt, Human
ccaggaugggcugcagguugcagucagggcuu

SEQ ID NO: 99629 - RNA, 32 nt, Human
ccaggauggggaggcagagugggagcucacuc

SEQ ID NO: 99630 - RNA, 19 nt, Human
ccaggauggguaacuuuaa

SEQ ID NO: 99631 - RNA, 32 nt, Human
ccaggauggucucgauccccugaucucgugau

SEQ ID NO: 99632 - RNA, 32 nt, Human
ccaggauggucucgaucuccugaucucgugau

SEQ ID NO: 99633 - RNA, 32 nt, Human
ccaggauggucucgaucuucugaccucgugau

SEQ ID NO: 99634 - RNA, 32 nt, Human
ccaggaugguguccucugugaggacuugaacu

SEQ ID NO: 99635 - RNA, 32 nt, Human
ccaggaugucuaauacccugucccagugcccg

SEQ ID NO: 99636 - RNA, 18 nt, Human
ccaggaugucuuuuccca

SEQ ID NO: 99637 - RNA, 32 nt, Human
ccaggauguguuuccuuagauuuccuuuccua

SEQ ID NO: 99638 - RNA, 22 nt, Human
ccaggauuacaggcaugagcca

SEQ ID NO: 99639 - RNA, 21 nt, Human
ccaggauuacccgccagcuca

SEQ ID NO: 99640 - RNA, 22 nt, Human
ccaggauuauaggcaugagcca

SEQ ID NO: 99641 - RNA, 32 nt, Human
ccaggauucagaucugguuucagaaucgaagg

SEQ ID NO: 99642 - RNA, 22 nt, Human
ccaggauugcugcugcugcugc

SEQ ID NO: 99643 - RNA, 23 nt, Human
ccaggauuggggacagggacaga

SEQ ID NO: 99644 - RNA, 32 nt, Human
ccaggauugggguggguguuggagagggcuuu

SEQ ID NO: 99645 - RNA, 32 nt, Human
ccaggauuugaggaggagaagggaggaggugg

SEQ ID NO: 99646 - RNA, 32 nt, Human
ccaggauuugcacagaagcacaugcaccuacc

SEQ ID NO: 99647 - RNA, 32 nt, Human
ccaggcaaacuuccugcuacacaugcccugaa

SEQ ID NO: 99648 - RNA, 32 nt, Human
ccaggcaaagcggagcggagauccucaaacgg

SEQ ID NO: 99649 - RNA, 32 nt, Human
ccaggcaacacagcaggaggugagcagccagc

SEQ ID NO: 99650 - RNA, 21 nt, Human
ccaggcaacauaacaagaccc

SEQ ID NO: 99651 - RNA, 32 nt, Human
ccaggcaacauggcaaaaccccgucucuacaa

SEQ ID NO: 99652 - RNA, 20 nt, Human
ccaggcaacauggugaaacc

SEQ ID NO: 99653 - RNA, 32 nt, Human
ccaggcaacauggugaaaccccaucucuacaa

SEQ ID NO: 99654 - RNA, 29 nt, Human
ccaggcaacauggugaccccaucucuacc

SEQ ID NO: 99655 - RNA, 21 nt, Human
ccaggcaaccagcugcugccu

SEQ ID NO: 99656 - RNA, 32 nt, Human
ccaggcaacuaccacaccuuguuuggaguccg

SEQ ID NO: 99657 - RNA, 32 nt, Human
ccaggcaagccgcggcaagaacgcaaggggcg

SEQ ID NO: 99658 - RNA, 16 nt, Human
ccaggcaaggggccag

SEQ ID NO: 99659 - RNA, 32 nt, Human
ccaggcacaaucugagggucucagcccaccug

SEQ ID NO: 99660 - RNA, 20 nt, Human
ccaggcacaccgccuugagg

SEQ ID NO: 99661 - RNA, 32 nt, Human
ccaggcacaccucagucuucuugacccagagc

SEQ ID NO: 99662 - RNA, 32 nt, Human
ccaggcacagccccaggcuggcaaagggaggg

SEQ ID NO: 99663 - RNA, 32 nt, Human
ccaggcacagccgccuccggaaugcacaggcg

SEQ ID NO: 99664 - RNA, 24 nt, Human
ccaggcacaggaggacaacuaggg

SEQ ID NO: 99665 - RNA, 32 nt, Human
ccaggcacaguggcucauaccuguaaugccag

SEQ ID NO: 99666 - RNA, 32 nt, Human
ccaggcacaguggcucaugccuguaaucccaa

SEQ ID NO: 99667 - RNA, 32 nt, Human
ccaggcacaguggcucaugccuguaaucccag

SEQ ID NO: 99668 - RNA, 32 nt, Human
ccaggcacaguggcucaugccuguaauccuaa

SEQ ID NO: 99669 - RNA, 32 nt, Human
ccaggcacaguggcucaugccuguaaucuuau

SEQ ID NO: 99670 - RNA, 32 nt, Human
ccaggcacccuccagcgucaggugcggauccc

SEQ ID NO: 99671 - RNA, 32 nt, Human
ccaggcacccuguucugagacuucugaggcug

SEQ ID NO: 99672 - RNA, 16 nt, Human
ccaggcaccuccccuc

SEQ ID NO: 99673 - RNA, 32 nt, Human
ccaggcaccucccggcucacggggagcucaga

SEQ ID NO: 99674 - RNA, 32 nt, Human
ccaggcaccucgcugaacugcucucuuauuuu

SEQ ID NO: 99675 - RNA, 32 nt, Human
ccaggcaccucucuccccaugguguuuuccac

SEQ ID NO: 99676 - RNA, 32 nt, Human
ccaggcaccuuggcucaugccuguaauccuag

SEQ ID NO: 99677 - RNA, 32 nt, Human
ccaggcacgccuguaaucccagcacuuuggga

SEQ ID NO: 99678 - RNA, 32 nt, Human
ccaggcacgcuguccuggaaguugucugucuc

SEQ ID NO: 99679 - RNA, 32 nt, Human
ccaggcacggcggcucacgccuguaaucccag

SEQ ID NO: 99680 - RNA, 32 nt, Human
ccaggcacgggaggcccuggcucuggaggaga

SEQ ID NO: 99681 - RNA, 32 nt, Human
ccaggcacgggcugugugaaaggguuuaaaag

SEQ ID NO: 99682 - RNA, 23 nt, Human
ccaggcacgggggcaugggcaga

SEQ ID NO: 99683 - RNA, 32 nt, Human
ccaggcacggugcacuuucuccaccuccugca

SEQ ID NO: 99684 - RNA, 25 nt, Human
ccaggcacgucccggaccugugggg

SEQ ID NO: 99685 - RNA, 32 nt, Human
ccaggcacucacucaaacuugcucuucaacuc

SEQ ID NO: 99686 - RNA, 32 nt, Human
ccaggcacugaauccuaugaagcaggugccaa

SEQ ID NO: 99687 - RNA, 32 nt, Human
ccaggcacugcacagcaccuuggcugaugcug

SEQ ID NO: 99688 - RNA, 23 nt, Human
ccaggcacugcugaggggugcgg

SEQ ID NO: 99689 - RNA, 32 nt, Human
ccaggcacugcuggccuuucuccugcccggcc

SEQ ID NO: 99690 - RNA, 32 nt, Human
ccaggcacuggcagggaggguaagggcuggcu

SEQ ID NO: 99691 - RNA, 32 nt, Human
ccaggcacuggcaugaagaaagagucuuugua

SEQ ID NO: 99692 - RNA, 23 nt, Human
ccaggcacugggcccgugcagag

SEQ ID NO: 99693 - RNA, 32 nt, Human
ccaggcacugggugcugacaggggaaccauga

SEQ ID NO: 99694 - RNA, 32 nt, Human
ccaggcacuguggcucaugccuguaaucccag

SEQ ID NO: 99695 - RNA, 32 nt, Human
ccaggcagaaaggugcagagacccaucugacg

SEQ ID NO: 99696 - RNA, 32 nt, Human
ccaggcagaagagcaugcccuuugccguugca

SEQ ID NO: 99697 - RNA, 32 nt, Human
ccaggcagaaggaaacucaaagugauggggug

SEQ ID NO: 99698 - RNA, 32 nt, Human
ccaggcagagagcgaccagcaggcuccucagc

SEQ ID NO: 99699 - RNA, 32 nt, Human
ccaggcagagccugaggaagcugaagcagagg

SEQ ID NO: 99700 - RNA, 32 nt, Human
ccaggcagagcggcgcaggcagcugugagcuu

SEQ ID NO: 99701 - RNA, 32 nt, Human
ccaggcagaggaacagcaugugcacuggugca

SEQ ID NO: 99702 - RNA, 19 nt, Human
ccaggcagaggaggcacag

SEQ ID NO: 99703 - RNA, 21 nt, Human
ccaggcagagguugcagugag

SEQ ID NO: 99704 - RNA, 32 nt, Human
ccaggcagaucaggggcucuggggaaacugcu

SEQ ID NO: 99705 - RNA, 32 nt, Human
ccaggcagaucucaaacuucugaccucgugau

SEQ ID NO: 99706 - RNA, 32 nt, Human
ccaggcagcaaugggguuccugcagcugcugg

SEQ ID NO: 99707 - RNA, 32 nt, Human
ccaggcagcagagggacaagugaccucgugga

SEQ ID NO: 99708 - RNA, 22 nt, Human
ccaggcagcaguuagcccgccg

SEQ ID NO: 99709 - RNA, 18 nt, Human
ccaggcagccccauccca

SEQ ID NO: 99710 - RNA, 22 nt, Human
ccaggcagcccccucugcagag

SEQ ID NO: 99711 - RNA, 32 nt, Human
ccaggcagccuccucuuagagcuccugaauuc

SEQ ID NO: 99712 - RNA, 32 nt, Human
ccaggcagccuguccuccuccuccaggcagcc

SEQ ID NO: 99713 - RNA, 32 nt, Human
ccaggcagcuaagaagucuuaggcagcagccc

SEQ ID NO: 99714 - RNA, 32 nt, Human
ccaggcagcucauucacuaucugugauccacc

SEQ ID NO: 99715 - RNA, 20 nt, Human
ccaggcagcucuggagccag

SEQ ID NO: 99716 - RNA, 32 nt, Human
ccaggcagcugcaggagagugcugccaaguug

SEQ ID NO: 99717 - RNA, 30 nt, Human
ccaggcagcuugccacuugggagggcagaa

SEQ ID NO: 99718 - RNA, 32 nt, Human
ccaggcaggacccccaacccgcccagcccgcu

SEQ ID NO: 99719 - RNA, 32 nt, Human
ccaggcaggacgaacacuugagcccaggcguu

SEQ ID NO: 99720 - RNA, 32 nt, Human
ccaggcaggagaaaggacagcugccccucaaa

SEQ ID NO: 99721 - RNA, 32 nt, Human
ccaggcaggagaagguaccucucuugaaacga

SEQ ID NO: 99722 - RNA, 32 nt, Human
ccaggcaggaggaucacuugggcccaggaggu

SEQ ID NO: 99723 - RNA, 19 nt, Human
ccaggcaggagugcagugg

SEQ ID NO: 99724 - RNA, 32 nt, Human
ccaggcaggcaccugggcuuucuggaauccaa

SEQ ID NO: 99725 - RNA, 23 nt, Human
ccaggcaggcagaucacuugagg

SEQ ID NO: 99726 - RNA, 32 nt, Human
ccaggcaggcagaucacuugaggucaggaguu

SEQ ID NO: 99727 - RNA, 32 nt, Human
ccaggcaggccaagacuugaguuggcaacuca

SEQ ID NO: 99728 - RNA, 20 nt, Human
ccaggcaggccagggcccag

SEQ ID NO: 99729 - RNA, 30 nt, Human
ccaggcaggcgaggagaagcugugcuguga

SEQ ID NO: 99730 - RNA, 23 nt, Human
ccaggcaggcggaucacuugagg

SEQ ID NO: 99731 - RNA, 32 nt, Human
ccaggcaggcggaucacuugagguuaggaguu

SEQ ID NO: 99732 - RNA, 20 nt, Human
ccaggcagggaaggggccag

SEQ ID NO: 99733 - RNA, 32 nt, Human
ccaggcagggacacccucacaccaccagcccc

SEQ ID NO: 99734 - RNA, 32 nt, Human
ccaggcagggacccaauaaaccuuugugaaug

SEQ ID NO: 99735 - RNA, 32 nt, Human
ccaggcagggacucuuuuccacacgaugacac

SEQ ID NO: 99736 - RNA, 17 nt, Human
ccaggcagggaggccag

SEQ ID NO: 99737 - RNA, 22 nt, Human
ccaggcagggaguagggcuuag

SEQ ID NO: 99738 - RNA, 32 nt, Human
ccaggcaggggagcagaugagggaggagccuu

SEQ ID NO: 99739 - RNA, 32 nt, Human
ccaggcaggggguuccagaguggggugggccg

SEQ ID NO: 99740 - RNA, 32 nt, Human
ccaggcagguaacaccugucauccuggcuggu

SEQ ID NO: 99741 - RNA, 24 nt, Human
ccaggcaggucugugugggacaga

SEQ ID NO: 99742 - RNA, 23 nt, Human
ccaggcagguggaucucuugaga

SEQ ID NO: 99743 - RNA, 18 nt, Human
ccaggcagucagagcugg

SEQ ID NO: 99744 - RNA, 32 nt, Human
ccaggcagucaugggcccugaggccccuccug

SEQ ID NO: 99745 - RNA, 25 nt, Human
ccaggcagucggaacuuguagugag

SEQ ID NO: 99746 - RNA, 32 nt, Human
ccaggcagucugacccagagccugcacgcuug

SEQ ID NO: 99747 - RNA, 32 nt, Human
ccaggcagucuugggacuugaguuuguccggc

SEQ ID NO: 99748 - RNA, 32 nt, Human
ccaggcagucuugggacuugggucuguccugc

SEQ ID NO: 99749 - RNA, 19 nt, Human
ccaggcagugaggauucag

SEQ ID NO: 99750 - RNA, 20 nt, Human
ccaggcagugccaggaguca

SEQ ID NO: 99751 - RNA, 20 nt, Human
ccaggcagugcggaacucag

SEQ ID NO: 99752 - RNA, 24 nt, Human
ccaggcaguggagguugcagugag

SEQ ID NO: 99753 - RNA, 32 nt, Human
ccaggcaguggucaccccaugggacaggcaca

SEQ ID NO: 99754 - RNA, 32 nt, Human
ccaggcaguucugcguuugcaauggccuuguc

SEQ ID NO: 99755 - RNA, 32 nt, Human
ccaggcauagugacugaugccuguaaucccaa

SEQ ID NO: 99756 - RNA, 32 nt, Human
ccaggcauaguggcucuugccuguaaucccag

SEQ ID NO: 99757 - RNA, 32 nt, Human
ccaggcauaguggguuaucccuguaauuccag

SEQ ID NO: 99758 - RNA, 32 nt, Human
ccaggcauaguggugcaugccuguaaucccag

SEQ ID NO: 99759 - RNA, 32 nt, Human
ccaggcaucauggcucacaccuguaaucccag

SEQ ID NO: 99760 - RNA, 32 nt, Human
ccaggcaucccucccugcucuucugucggagc

SEQ ID NO: 99761 - RNA, 32 nt, Human
ccaggcaucccuccuaacuuuucuuugugcag

SEQ ID NO: 99762 - RNA, 32 nt, Human
ccaggcaucguggugggugccuguaaucccag

SEQ ID NO: 99763 - RNA, 32 nt, Human
ccaggcaugaucuuccccaucaggcugggcuc

SEQ ID NO: 99764 - RNA, 32 nt, Human
ccaggcaugauggcacacaccuguaaucucag

SEQ ID NO: 99765 - RNA, 32 nt, Human
ccaggcaugauggcacaugccuguaaucccag

SEQ ID NO: 99766 - RNA, 32 nt, Human
ccaggcaugauggcacaugccuguaaucucag

SEQ ID NO: 99767 - RNA, 32 nt, Human
ccaggcaugauguguggggcugucaacaaccu

SEQ ID NO: 99768 - RNA, 31 nt, Human
ccaggcaugccccgcuacgagcuggcuuuaa

SEQ ID NO: 99769 - RNA, 32 nt, Human
ccaggcaugcuggcuuaugacuguaaucccag

SEQ ID NO: 99770 - RNA, 32 nt, Human
ccaggcaugcuggugcacaccuguaaucccag

SEQ ID NO: 99771 - RNA, 32 nt, Human
ccaggcauggcucugugagauucuguggaaug

SEQ ID NO: 99772 - RNA, 32 nt, Human
ccaggcaugguagcucacgccuguaauccuag

SEQ ID NO: 99773 - RNA, 32 nt, Human
ccaggcauggugacgcaugccuguaaucccag

SEQ ID NO: 99774 - RNA, 32 nt, Human
ccaggcauggugacucaggccuguaaucccag

SEQ ID NO: 99775 - RNA, 32 nt, Human
ccaggcauggugacucauaccuguaaucccaa

SEQ ID NO: 99776 - RNA, 32 nt, Human
ccaggcauggugaugcacaccuguaaucccag

SEQ ID NO: 99777 - RNA, 32 nt, Human
ccaggcaugguggcaaacgccuguaaucccaa

SEQ ID NO: 99778 - RNA, 32 nt, Human
ccaggcaugguggcacacaccuguaaucguag

SEQ ID NO: 99779 - RNA, 32 nt, Human
ccaggcaugguggcacacgccuguaaucccag

SEQ ID NO: 99780 - RNA, 32 nt, Human
ccaggcaugguggcacaugccuguaaucccag

SEQ ID NO: 99781 - RNA, 32 nt, Human
ccaggcaugguggcacaugccuguaaucucag

SEQ ID NO: 99782 - RNA, 32 nt, Human
ccaggcaugguggcaccugccuguaaucccag

SEQ ID NO: 99783 - RNA, 32 nt, Human
ccaggcaugguggcacgcgccuguaaucccag

SEQ ID NO: 99784 - RNA, 32 nt, Human
ccaggcaugguggcacgugccuguaaucccag

SEQ ID NO: 99785 - RNA, 32 nt, Human
ccaggcaugguggcaggcaccuguaaucccag

SEQ ID NO: 99786 - RNA, 32 nt, Human
ccaggcaugguggcaggcgccuguaaucccag

SEQ ID NO: 99787 - RNA, 32 nt, Human
ccaggcaugguggccagcaccuguaaucccag

SEQ ID NO: 99788 - RNA, 32 nt, Human
ccaggcaugguggcccacgccuguaaucccag

SEQ ID NO: 99789 - RNA, 32 nt, Human
ccaggcaugguggcccaugccuguaaucccag

SEQ ID NO: 99790 - RNA, 32 nt, Human
ccaggcaugguggcgcaugccuguaaucccag

SEQ ID NO: 99791 - RNA, 32 nt, Human
ccaggcaugguggcgcaugccuguaaucucag

SEQ ID NO: 99792 - RNA, 32 nt, Human
ccaggcaugguggcggacaccuguaaucccug

SEQ ID NO: 99793 - RNA, 32 nt, Human
ccaggcaugguggcgggcaccuguaaucccag

SEQ ID NO: 99794 - RNA, 32 nt, Human
ccaggcaugguggcguaugccuguaaucccag

SEQ ID NO: 99795 - RNA, 32 nt, Human
ccaggcaugguggcucacaccuguaaccccca

SEQ ID NO: 99796 - RNA, 32 nt, Human
ccaggcaugguggcucacaccuguaauccaag

SEQ ID NO: 99797 - RNA, 32 nt, Human
ccaggcaugguggcucacaccuguaaucccag

SEQ ID NO: 99798 - RNA, 32 nt, Human
ccaggcaugguggcucacaccuguaauccuag

SEQ ID NO: 99799 - RNA, 32 nt, Human
ccaggcaugguggcucacaccuguaauuucag

SEQ ID NO: 99800 - RNA, 32 nt, Human
ccaggcaugguggcucacgccuguaaucccaa

SEQ ID NO: 99801 - RNA, 32 nt, Human
ccaggcaugguggcucacgccuguaaucccag

SEQ ID NO: 99802 - RNA, 32 nt, Human
ccaggcaugguggcucacgccuguaauccuag

SEQ ID NO: 99803 - RNA, 32 nt, Human
ccaggcaugguggcucacgccuguaauccugg

SEQ ID NO: 99804 - RNA, 32 nt, Human
ccaggcaugguggcucacgccuguaaucucag

SEQ ID NO: 99805 - RNA, 32 nt, Human
ccaggcaugguggcucauaccuguaaucccag

SEQ ID NO: 99806 - RNA, 32 nt, Human
ccaggcaugguggcucaugccuauaagcaccc

SEQ ID NO: 99807 - RNA, 32 nt, Human
ccaggcaugguggcucaugccuguaaacccag

SEQ ID NO: 99808 - RNA, 32 nt, Human
ccaggcaugguggcucaugccuguaaucccaa

SEQ ID NO: 99809 - RNA, 32 nt, Human
ccaggcaugguggcucaugccuguaaucccag

SEQ ID NO: 99810 - RNA, 32 nt, Human
ccaggcaugguggcucaugccuguaauuccag

SEQ ID NO: 99811 - RNA, 32 nt, Human
ccaggcaugguggcucaugccuguaauuccgg

SEQ ID NO: 99812 - RNA, 32 nt, Human
ccaggcaugguggcucaugccuguggucccag

SEQ ID NO: 99813 - RNA, 32 nt, Human
ccaggcaugguggcucaugcuuguaaaccuga

SEQ ID NO: 99814 - RNA, 32 nt, Human
ccaggcaugguggcuuacgccuguaaucccag

SEQ ID NO: 99815 - RNA, 32 nt, Human
ccaggcaugguggcuuacgccuguaauccuag

SEQ ID NO: 99816 - RNA, 32 nt, Human
ccaggcauggugggaggcaccuguaaucccag

SEQ ID NO: 99817 - RNA, 32 nt, Human
ccaggcauggugguagaugccuguaauuccag

SEQ ID NO: 99818 - RNA, 32 nt, Human
ccaggcaugguggugagccccuguaaucccag

SEQ ID NO: 99819 - RNA, 32 nt, Human
ccaggcaugguggugagugccuguaaucccag

SEQ ID NO: 99820 - RNA, 32 nt, Human
ccaggcaugguggugagugccuguaaucucag

SEQ ID NO: 99821 - RNA, 32 nt, Human
ccaggcaugguggugcaugccuguaaucccag

SEQ ID NO: 99822 - RNA, 32 nt, Human
ccaggcaugguggugcaugccuguaaucccug

SEQ ID NO: 99823 - RNA, 32 nt, Human
ccaggcaugguggugcgagccuguaauuccag

SEQ ID NO: 99824 - RNA, 32 nt, Human
ccaggcaugguggugggcaccuguaaucccag

SEQ ID NO: 99825 - RNA, 32 nt, Human
ccaggcauggugguggguaccuguaaucccag

SEQ ID NO: 99826 - RNA, 32 nt, Human
ccaggcaugguggugugcaccuguaaucccag

SEQ ID NO: 99827 - RNA, 32 nt, Human
ccaggcaugguggugugcgccuguaaucccag

SEQ ID NO: 99828 - RNA, 32 nt, Human
ccaggcauggugguucacaccuguaauccuag

SEQ ID NO: 99829 - RNA, 32 nt, Human
ccaggcauguuggugugcaccuguaaucccag

SEQ ID NO: 99830 - RNA, 32 nt, Human
ccaggcauuuccauacauccucugaaucuuaa

SEQ ID NO: 99831 - RNA, 32 nt, Human
ccaggcauuugagaccagccuggguaacauag

SEQ ID NO: 99832 - RNA, 19 nt, Human
ccaggccaaagaucccccc

SEQ ID NO: 99833 - RNA, 28 nt, Human
ccaggccaaagugcugcugauucccacu

SEQ ID NO: 99834 - RNA, 21 nt, Human
ccaggccaacauggugaaacc

SEQ ID NO: 99835 - RNA, 25 nt, Human
ccaggccaacauggugaaacccugu

SEQ ID NO: 99836 - RNA, 32 nt, Human
ccaggccaacuucuccccgcugucugaggaca

SEQ ID NO: 99837 - RNA, 32 nt, Human
ccaggccaagcccccgccucccacuugaagcc

SEQ ID NO: 99838 - RNA, 32 nt, Human
ccaggccaagggucgacugcagguuguuugag

SEQ ID NO: 99839 - RNA, 32 nt, Human
ccaggccacaagacaguagugaugcucugaaa

SEQ ID NO: 99840 - RNA, 32 nt, Human
ccaggccacaaggacagugugugcaauggcuu

SEQ ID NO: 99841 - RNA, 32 nt, Human
ccaggccacacagcugguaagcgccagagcca

SEQ ID NO: 99842 - RNA, 32 nt, Human
ccaggccacagugaguuaugggcaaagcuuuu

SEQ ID NO: 99843 - RNA, 20 nt, Human
ccaggccaccaacccagcca

SEQ ID NO: 99844 - RNA, 32 nt, Human
ccaggccaccaaggacggcaagaaggacaaga

SEQ ID NO: 99845 - RNA, 32 nt, Human
ccaggccaccuccucuguucugaggcugggcu

SEQ ID NO: 99846 - RNA, 19 nt, Human
ccaggccacgcgccagcca

SEQ ID NO: 99847 - RNA, 23 nt, Human
ccaggccacggcugagaucacca

SEQ ID NO: 99848 - RNA, 32 nt, Human
ccaggccacggugcuguggggccccgccgcuu

SEQ ID NO: 99849 - RNA, 32 nt, Human
ccaggccacuggcugcuggacuguuccucagg

SEQ ID NO: 99850 - RNA, 23 nt, Human
ccaggccacugggcccugagcca

SEQ ID NO: 99851 - RNA, 32 nt, Human
ccaggccagaaaccgcccaccugcaggugagg

SEQ ID NO: 99852 - RNA, 21 nt, Human
ccaggccagagaccccaggca

SEQ ID NO: 99853 - RNA, 32 nt, Human
ccaggccagagccuccaguggucuccaagccu

SEQ ID NO: 99854 - RNA, 21 nt, Human
ccaggccagagcuuguguccu

SEQ ID NO: 99855 - RNA, 32 nt, Human
ccaggccagaggcagcuuccagccugggggcu

SEQ ID NO: 99856 - RNA, 32 nt, Human
ccaggccagagggagugacagaggcagcccca

SEQ ID NO: 99857 - RNA, 19 nt, Human
ccaggccagagugcagugg

SEQ ID NO: 99858 - RNA, 20 nt, Human
ccaggccagagugcaguggc

SEQ ID NO: 99859 - RNA, 21 nt, Human
ccaggccagagugcaguggug

SEQ ID NO: 99860 - RNA, 28 nt, Human
ccaggccagagugcugccaguccucugc

SEQ ID NO: 99861 - RNA, 32 nt, Human
ccaggccagcaggcgggcuccuuuguacaguu

SEQ ID NO: 99862 - RNA, 32 nt, Human
ccaggccagcccagcccagagcacaggcucca

SEQ ID NO: 99863 - RNA, 32 nt, Human
ccaggccagccccagugacuccaggcuccaga

SEQ ID NO: 99864 - RNA, 32 nt, Human
ccaggccagcgcugcaaccuccuucggcuuug

SEQ ID NO: 99865 - RNA, 32 nt, Human
ccaggccagcucuccucccacaacagcuuccc

SEQ ID NO: 99866 - RNA, 32 nt, Human
ccaggccaggacugaggcaagccucaaggcac

SEQ ID NO: 99867 - RNA, 32 nt, Human
ccaggccaggagaugggggcgggggcagcugu

SEQ ID NO: 99868 - RNA, 32 nt, Human
ccaggccaggaggcagcuggcacagugcucac

SEQ ID NO: 99869 - RNA, 32 nt, Human
ccaggccaggaggggcccugcccaugcccaca

SEQ ID NO: 99870 - RNA, 32 nt, Human
ccaggccaggaguggagccaggucgccccaug

SEQ ID NO: 99871 - RNA, 32 nt, Human
ccaggccaggcagggagcagaugcagggacuc

SEQ ID NO: 99872 - RNA, 32 nt, Human
ccaggccaggcauggcucagugcagucccugg

SEQ ID NO: 99873 - RNA, 32 nt, Human
ccaggccaggcgcucuuccuccccagccucca

SEQ ID NO: 99874 - RNA, 21 nt, Human
ccaggccaggcguguguccug

SEQ ID NO: 99875 - RNA, 32 nt, Human
ccaggccagggcccuugauacaacaccaacag

SEQ ID NO: 99876 - RNA, 32 nt, Human
ccaggccaggggugcauggcagaggaaggugg

SEQ ID NO: 99877 - RNA, 32 nt, Human
ccaggccaggugaagauuagggccaggaagcc

SEQ ID NO: 99878 - RNA, 32 nt, Human
ccaggccagguggggaaagggacaccuuccgg

SEQ ID NO: 99879 - RNA, 32 nt, Human
ccaggccaguagauccguuuacacuuuugggu

SEQ ID NO: 99880 - RNA, 32 nt, Human
ccaggccaguguccaucagccuggugcuaauc

SEQ ID NO: 99881 - RNA, 32 nt, Human
ccaggccauauucacaagagaaauacuguagu

SEQ ID NO: 99882 - RNA, 32 nt, Human
ccaggccaucaacaaacuaacgacucugugug

SEQ ID NO: 99883 - RNA, 18 nt, Human
ccaggccaucagcaccac

SEQ ID NO: 99884 - RNA, 32 nt, Human
ccaggccaucaucuccccaccucuccuccccu

SEQ ID NO: 99885 - RNA, 32 nt, Human
ccaggccaucccucucgugucuguagccagug

SEQ ID NO: 99886 - RNA, 32 nt, Human
ccaggccaucggcauuccggagcccagggucc

SEQ ID NO: 99887 - RNA, 32 nt, Human
ccaggccaugcaacagccuccaccucagaaag

SEQ ID NO: 99888 - RNA, 32 nt, Human
ccaggccauggacugugaggucaacaacgguu

SEQ ID NO: 99889 - RNA, 32 nt, Human
ccaggccauggcacuccuauccugguuuuggu

SEQ ID NO: 99890 - RNA, 32 nt, Human
ccaggccauugucacuguuaguugaagaaaaa

SEQ ID NO: 99891 - RNA, 19 nt, Human
ccaggcccaacauguugug

SEQ ID NO: 99892 - RNA, 32 nt, Human
ccaggcccaccaggaagucaccaggacagucc

SEQ ID NO: 99893 - RNA, 32 nt, Human
ccaggcccagaacuucccccagucagccucuc

SEQ ID NO: 99894 - RNA, 32 nt, Human
ccaggcccagaacuuccucaagucggccuccc

SEQ ID NO: 99895 - RNA, 32 nt, Human
ccaggcccagaacuuccucaagucggccucuu

SEQ ID NO: 99896 - RNA, 32 nt, Human
ccaggcccagaacuuucuccagucagccucca

SEQ ID NO: 99897 - RNA, 32 nt, Human
ccaggcccagaacuuucuccagucagccucua

SEQ ID NO: 99898 - RNA, 32 nt, Human
ccaggcccagagagugugucucaggagaauuc

SEQ ID NO: 99899 - RNA, 20 nt, Human
ccaggcccagagccagggga

SEQ ID NO: 99900 - RNA, 32 nt, Human
ccaggcccagcagaacuggguaccacaaaccg

SEQ ID NO: 99901 - RNA, 28 nt, Human
ccaggcccagcaucugccucaccguggc

SEQ ID NO: 99902 - RNA, 32 nt, Human
ccaggcccagcauuuaucacauggacaugguc

SEQ ID NO: 99903 - RNA, 32 nt, Human
ccaggcccagccagggccgcgggaggcggggg

SEQ ID NO: 99904 - RNA, 32 nt, Human
ccaggcccagcuccuccugccucccagcggcc

SEQ ID NO: 99905 - RNA, 32 nt, Human
ccaggcccagcuccuccugccucccaguggcc

SEQ ID NO: 99906 - RNA, 32 nt, Human
ccaggcccagcucuuccugccucccaguggcc

SEQ ID NO: 99907 - RNA, 21 nt, Human
ccaggcccaggccccacccca

SEQ ID NO: 99908 - RNA, 32 nt, Human
ccaggcccaggggacucucuccacucuuuccu

SEQ ID NO: 99909 - RNA, 32 nt, Human
ccaggcccagugggggccagaggaucaggccc

SEQ ID NO: 99910 - RNA, 32 nt, Human
ccaggcccaguuaaugcuagucuuucauguga

SEQ ID NO: 99911 - RNA, 21 nt, Human
ccaggcccaugcccuccuggu

SEQ ID NO: 99912 - RNA, 32 nt, Human
ccaggccccacugacgccaggaggccugggug

SEQ ID NO: 99913 - RNA, 32 nt, Human
ccaggccccagagucccuuaucccuaugcccc

SEQ ID NO: 99914 - RNA, 32 nt, Human
ccaggccccagcccaggcaggugcugcugccu

SEQ ID NO: 99915 - RNA, 32 nt, Human
ccaggccccaggaccaggccuagggugugccu

SEQ ID NO: 99916 - RNA, 32 nt, Human
ccaggccccaggagccaggcccagccugcgcc

SEQ ID NO: 99917 - RNA, 32 nt, Human
ccaggccccauggagagaggcucagcccuagg

SEQ ID NO: 99918 - RNA, 22 nt, Human
ccaggccccauuccggcuccca

SEQ ID NO: 99919 - RNA, 32 nt, Human
ccaggcccccaacuccgcccagccucuccccg

SEQ ID NO: 99920 - RNA, 22 nt, Human
ccaggcccccagaucuggugcc

SEQ ID NO: 99921 - RNA, 19 nt, Human
ccaggccccccagcccagg

SEQ ID NO: 99922 - RNA, 32 nt, Human
ccaggcccccuccaccauggccagccggggug

SEQ ID NO: 99923 - RNA, 32 nt, Human
ccaggcccccugccugugccugccuugcaccc

SEQ ID NO: 99924 - RNA, 32 nt, Human
ccaggccccgagagggcgagaccagaggggac

SEQ ID NO: 99925 - RNA, 32 nt, Human
ccaggccccgguggguuugucugcacuuggug

SEQ ID NO: 99926 - RNA, 22 nt, Human
ccaggccccguccgcccgagcc

SEQ ID NO: 99927 - RNA, 32 nt, Human
ccaggccccuccaggacaauggauuucaucau

SEQ ID NO: 99928 - RNA, 32 nt, Human
ccaggccccuccuguccuccugcucugagccc

SEQ ID NO: 99929 - RNA, 23 nt, Human
ccaggccccuccuuccugaauca

SEQ ID NO: 99930 - RNA, 32 nt, Human
ccaggccccuccuuccugaaucaucagcugug

SEQ ID NO: 99931 - RNA, 20 nt, Human
ccaggccccugacaggaugc

SEQ ID NO: 99932 - RNA, 32 nt, Human
ccaggccccugccucucacagcagcacccuuu

SEQ ID NO: 99933 - RNA, 18 nt, Human
ccaggccccugggaggug

SEQ ID NO: 99934 - RNA, 32 nt, Human
ccaggccccuguguucagccucaggccuauag

SEQ ID NO: 99935 - RNA, 17 nt, Human
ccaggcccgccgcuccg

SEQ ID NO: 99936 - RNA, 21 nt, Human
ccaggcccggaaccugguguc

SEQ ID NO: 99937 - RNA, 32 nt, Human
ccaggcccuaagaccuccuccuccaggucagg

SEQ ID NO: 99938 - RNA, 21 nt, Human
ccaggcccuaagccagcguca

SEQ ID NO: 99939 - RNA, 22 nt, Human
ccaggcccuccacggcacccca

SEQ ID NO: 99940 - RNA, 32 nt, Human
ccaggcccuccagugggcugaugcugggaccc

SEQ ID NO: 99941 - RNA, 21 nt, Human
ccaggcccucccaccacccca

SEQ ID NO: 99942 - RNA, 21 nt, Human
ccaggcccuccgcaggcugcc

SEQ ID NO: 99943 - RNA, 32 nt, Human
ccaggcccuccuccuccugggcuugcccagag

SEQ ID NO: 99944 - RNA, 32 nt, Human
ccaggcccugcagggcuggucagggugucugg

SEQ ID NO: 99945 - RNA, 32 nt, Human
ccaggcccugcaguggggcugacuccagaucu

SEQ ID NO: 99946 - RNA, 32 nt, Human
ccaggcccugccccaucuccucugccaucuuc

SEQ ID NO: 99947 - RNA, 20 nt, Human
ccaggcccugcgucaggcag

SEQ ID NO: 99948 - RNA, 32 nt, Human
ccaggcccugcuccucugcuggggucggcccc

SEQ ID NO: 99949 - RNA, 32 nt, Human
ccaggcccugcucuccuguguagccucagaga

SEQ ID NO: 99950 - RNA, 32 nt, Human
ccaggcccugcucuuccucagcuguguggguc

SEQ ID NO: 99951 - RNA, 32 nt, Human
ccaggcccugcucuuccugcuugcuggcagag

SEQ ID NO: 99952 - RNA, 32 nt, Human
ccaggcccuggacuuccuccagucggccucuc

SEQ ID NO: 99953 - RNA, 32 nt, Human
ccaggcccuggcacagagggagcacucgauac

SEQ ID NO: 99954 - RNA, 19 nt, Human
ccaggcccuggcagcaacc

SEQ ID NO: 99955 - RNA, 32 nt, Human
ccaggcccuggcucugcagccagcacaacugg

SEQ ID NO: 99956 - RNA, 17 nt, Human
ccaggcccugggcucag

SEQ ID NO: 99957 - RNA, 32 nt, Human
ccaggcccugugcaaguguccucccccuuagg

SEQ ID NO: 99958 - RNA, 32 nt, Human
ccaggcccugugugccagaggccaggucucuc

SEQ ID NO: 99959 - RNA, 23 nt, Human
ccaggcccuucuuccuagcucug

SEQ ID NO: 99960 - RNA, 32 nt, Human
ccaggcccuugccuucauuuuuacagagguag

SEQ ID NO: 99961 - RNA, 32 nt, Human
ccaggccgaggaacccccagcccagggacuag

SEQ ID NO: 99962 - RNA, 32 nt, Human
ccaggccgcagagggagcaggaagaguugcug

SEQ ID NO: 99963 - RNA, 20 nt, Human
ccaggccgccguccaguggc

SEQ ID NO: 99964 - RNA, 21 nt, Human
ccaggccgcgguccccggagc

SEQ ID NO: 99965 - RNA, 18 nt, Human
ccaggccggagugcagug

SEQ ID NO: 99966 - RNA, 19 nt, Human
ccaggccggagugcagugg

SEQ ID NO: 99967 - RNA, 22 nt, Human
ccaggccggagugcaguggugu

SEQ ID NO: 99968 - RNA, 32 nt, Human
ccaggccggcaccaugcggccccugcucugcg

SEQ ID NO: 99969 - RNA, 23 nt, Human
ccaggccggcgaccaccaggggc

SEQ ID NO: 99970 - RNA, 22 nt, Human
ccaggccggcuuaccccaacua

SEQ ID NO: 99971 - RNA, 32 nt, Human
ccaggccggggagcgcgagggagcgaggcaca

SEQ ID NO: 99972 - RNA, 18 nt, Human
ccaggccggucccugggg

SEQ ID NO: 99973 - RNA, 32 nt, Human
ccaggccguucaauggggauccugcauuagga

SEQ ID NO: 99974 - RNA, 32 nt, Human
ccaggccuaagaggagagggaaccagggagaa

SEQ ID NO: 99975 - RNA, 32 nt, Human
ccaggccuagaacaccagaagucgguagaggg

SEQ ID NO: 99976 - RNA, 27 nt, Human
ccaggccucaccuguuuguuuaggcca

SEQ ID NO: 99977 - RNA, 19 nt, Human
ccaggccucagacugugaa

SEQ ID NO: 99978 - RNA, 32 nt, Human
ccaggccucagaggaggagaaaggccggagcc

SEQ ID NO: 99979 - RNA, 17 nt, Human
ccaggccucaggcuccc

SEQ ID NO: 99980 - RNA, 32 nt, Human
ccaggccuccacccccacccccguuugcuggg

SEQ ID NO: 99981 - RNA, 32 nt, Human
ccaggccuccaccuccagcccagguggcugac

SEQ ID NO: 99982 - RNA, 32 nt, Human
ccaggccucccgcuuggucuccacaggaggcu

SEQ ID NO: 99983 - RNA, 21 nt, Human
ccaggccuccuccccugagcc

SEQ ID NO: 99984 - RNA, 32 nt, Human
ccaggccuccuccuccugcaugugggggaagu

SEQ ID NO: 99985 - RNA, 32 nt, Human
ccaggccuccucuuccccaggcugccacccac

SEQ ID NO: 99986 - RNA, 32 nt, Human
ccaggccucgccagggugcggugcagagcaga

SEQ ID NO: 99987 - RNA, 22 nt, Human
ccaggccucggccuuccugagc

SEQ ID NO: 99988 - RNA, 32 nt, Human
ccaggccucucccaccaccaccuucccuccaa

SEQ ID NO: 99989 - RNA, 32 nt, Human
ccaggccucuccccaggcuugccaucagccuu

SEQ ID NO: 99990 - RNA, 20 nt, Human
ccaggccucuccccugcagg

SEQ ID NO: 99991 - RNA, 32 nt, Human
ccaggccucugacccaggcugcucugcggccc

SEQ ID NO: 99992 - RNA, 32 nt, Human
ccaggccugaaaaagauagacacagaagcacc

SEQ ID NO: 99993 - RNA, 32 nt, Human
ccaggccugacucuccucccacuugcauggac

SEQ ID NO: 99994 - RNA, 32 nt, Human
ccaggccugagccccaugccucccagcaacca

SEQ ID NO: 99995 - RNA, 32 nt, Human
ccaggccugagcggugggagggcucugcgggg

SEQ ID NO: 99996 - RNA, 32 nt, Human
ccaggccugagcugccccucccacugccuuuc

SEQ ID NO: 99997 - RNA, 32 nt, Human
ccaggccugcagccgcugccgccgccgccgcc

SEQ ID NO: 99998 - RNA, 32 nt, Human
ccaggccugcagcugggccagugcccaggagc

SEQ ID NO: 99999 - RNA, 32 nt, Human
ccaggccugcagggguggagggcagucccuca

SEQ ID NO: 100000 - RNA, 21 nt, Human
ccaggccugccccucaccuca

SEQ ID NO: 100001 - RNA, 32 nt, Human
ccaggccugcccugaaacuccagauccuggcu

SEQ ID NO: 100002 - RNA, 18 nt, Human
ccaggccugccggcccgg

SEQ ID NO: 100003 - RNA, 19 nt, Human
ccaggccugccgucuccag

SEQ ID NO: 100004 - RNA, 32 nt, Human
ccaggccugccugggccgcgccagcgccgcuc

SEQ ID NO: 100005 - RNA, 32 nt, Human
ccaggccugccuguucccauucuugcauggca

SEQ ID NO: 100006 - RNA, 21 nt, Human
ccaggccugcugugguucuga

SEQ ID NO: 100007 - RNA, 32 nt, Human
ccaggccuggcagagcuaagauucagacccag

SEQ ID NO: 100008 - RNA, 19 nt, Human
ccaggccugggaugcagug

SEQ ID NO: 100009 - RNA, 32 nt, Human
ccaggccugggcuggcagcccagggcuguuuc

SEQ ID NO: 100010 - RNA, 32 nt, Human
ccaggccuggggaggaagaggcuugggcugca

SEQ ID NO: 100011 - RNA, 32 nt, Human
ccaggccugggggccaccuaggaggacaagcu

SEQ ID NO: 100012 - RNA, 32 nt, Human
ccaggccugggugacagugcgagacccugucu

SEQ ID NO: 100013 - RNA, 32 nt, Human
ccaggccuggguuuguacuuccaccuccacca

SEQ ID NO: 100014 - RNA, 32 nt, Human
ccaggccugguggcacaugccuguaauccgag

SEQ ID NO: 100015 - RNA, 32 nt, Human
ccaggccugguggcucacgccuguaaucccag

SEQ ID NO: 100016 - RNA, 32 nt, Human
ccaggccuguaaucccaucacuuugggaggug

SEQ ID NO: 100017 - RNA, 32 nt, Human
ccaggccugucaagagggaggaaggggcccca

SEQ ID NO: 100018 - RNA, 24 nt, Human
ccaggccuuccuggggggcagcug

SEQ ID NO: 100019 - RNA, 32 nt, Human
ccaggccuuucaccugcucugccuugaaaugg

SEQ ID NO: 100020 - RNA, 24 nt, Human
ccaggccuuuggcagugggacaga

SEQ ID NO: 100021 - RNA, 32 nt, Human
ccaggcgaagccgccucugcccggacgcagcc

SEQ ID NO: 100022 - RNA, 32 nt, Human
ccaggcgacaccauuugccauccugcuucuaa

SEQ ID NO: 100023 - RNA, 18 nt, Human
ccaggcgacaggcaccac

SEQ ID NO: 100024 - RNA, 32 nt, Human
ccaggcgagagggcacccucccuuccuccccc

SEQ ID NO: 100025 - RNA, 19 nt, Human
ccaggcgaggcaacauggc

SEQ ID NO: 100026 - RNA, 32 nt, Human
ccaggcgaggccucuggaccuguguuccugug

SEQ ID NO: 100027 - RNA, 32 nt, Human
ccaggcgagggggacuuggggcuuccacgucc

SEQ ID NO: 100028 - RNA, 32 nt, Human
ccaggcgcaguggcucaagccuguaaucccag

SEQ ID NO: 100029 - RNA, 32 nt, Human
ccaggcgcaguggcucacaccuguaaucccaa

SEQ ID NO: 100030 - RNA, 32 nt, Human
ccaggcgcaguggcucacaccuguaaucccag

SEQ ID NO: 100031 - RNA, 32 nt, Human
ccaggcgcaguggcucacaccuguaauccuag

SEQ ID NO: 100032 - RNA, 32 nt, Human
ccaggcgcaguggcucacgccuguaaucccaa

SEQ ID NO: 100033 - RNA, 32 nt, Human
ccaggcgcaguggcucacgccuguaaucccag

SEQ ID NO: 100034 - RNA, 32 nt, Human
ccaggcgcaguggcucacgccuguaauuccag

SEQ ID NO: 100035 - RNA, 32 nt, Human
ccaggcgcaguggcucaugccuauaaucccag

SEQ ID NO: 100036 - RNA, 32 nt, Human
ccaggcgcaguggcucaugccuauaaucccgg

SEQ ID NO: 100037 - RNA, 32 nt, Human
ccaggcgcaguggcucaugccuguaaucccag

SEQ ID NO: 100038 - RNA, 32 nt, Human
ccaggcgcaguggcucaugccuguaaucguag

SEQ ID NO: 100039 - RNA, 32 nt, Human
ccaggcgcaguggcucaugccuguaauuccag

SEQ ID NO: 100040 - RNA, 32 nt, Human
ccaggcgcaguggcucaugccuguaauuucag

SEQ ID NO: 100041 - RNA, 32 nt, Human
ccaggcgcaguggcugaugccuguaaucccag

SEQ ID NO: 100042 - RNA, 32 nt, Human
ccaggcgcaguggcuuaugccuguaaucccag

SEQ ID NO: 100043 - RNA, 32 nt, Human
ccaggcgcauuggcucaugucuguaaucccag

SEQ ID NO: 100044 - RNA, 22 nt, Human
ccaggcgcccagcccugcggag

SEQ ID NO: 100045 - RNA, 32 nt, Human
ccaggcgcccuggcucacaccuguaaucccag

SEQ ID NO: 100046 - RNA, 19 nt, Human
ccaggcgccgccgccgccg

SEQ ID NO: 100047 - RNA, 18 nt, Human
ccaggcgccgccgcgccg

SEQ ID NO: 100048 - RNA, 32 nt, Human
ccaggcgccguggcucacgccuguaauccaac

SEQ ID NO: 100049 - RNA, 32 nt, Human
ccaggcgccguggcucacgccuguaaucccag

SEQ ID NO: 100050 - RNA, 18 nt, Human
ccaggcgcgcacugcaca

SEQ ID NO: 100051 - RNA, 32 nt, Human
ccaggcgcggcggcucacgccuguaauccuag

SEQ ID NO: 100052 - RNA, 32 nt, Human
ccaggcgcggcggcucacuccuguaaucccag

SEQ ID NO: 100053 - RNA, 32 nt, Human
ccaggcgcgguggcucacaccuguaauaaucc

SEQ ID NO: 100054 - RNA, 32 nt, Human
ccaggcgcgguggcucacaccuguaaucccag

SEQ ID NO: 100055 - RNA, 32 nt, Human
ccaggcgcgguggcucaccccuguaauccuag

SEQ ID NO: 100056 - RNA, 32 nt, Human
ccaggcgcgguggcucacgccuguaaucccaa

SEQ ID NO: 100057 - RNA, 32 nt, Human
ccaggcgcgguggcucacgccuguaaucccag

SEQ ID NO: 100058 - RNA, 32 nt, Human
ccaggcgcgguggcucacgccuguaauccuag

SEQ ID NO: 100059 - RNA, 32 nt, Human
ccaggcgcgguggcucacgccuguaauuccau

SEQ ID NO: 100060 - RNA, 32 nt, Human
ccaggcgcgguggcucacuccuguaaucccag

SEQ ID NO: 100061 - RNA, 32 nt, Human
ccaggcgcgguggcucaggccuguaaucccag

SEQ ID NO: 100062 - RNA, 32 nt, Human
ccaggcgcgguggcucaugccuguaaucccag

SEQ ID NO: 100063 - RNA, 32 nt, Human
ccaggcgcgguggcucaugccuguaauccuag

SEQ ID NO: 100064 - RNA, 32 nt, Human
ccaggcgcgguggcucaugcguguaaucccag

SEQ ID NO: 100065 - RNA, 32 nt, Human
ccaggcgcgguggcucgugccuguaaucccag

SEQ ID NO: 100066 - RNA, 32 nt, Human
ccaggcgcggugguucaugccuguaaucccag

SEQ ID NO: 100067 - RNA, 26 nt, Human
ccaggcgcucccucuuucuugaagag

SEQ ID NO: 100068 - RNA, 18 nt, Human
ccaggcgcuggacugcag

SEQ ID NO: 100069 - RNA, 32 nt, Human
ccaggcgcugggcacggugauggccaccacug

SEQ ID NO: 100070 - RNA, 32 nt, Human
ccaggcggaaggcuggagggugcuggggaagu

SEQ ID NO: 100071 - RNA, 20 nt, Human
ccaggcggacagugaggaca

SEQ ID NO: 100072 - RNA, 32 nt, Human
ccaggcggagcgggaggagcuggcagcggggc

SEQ ID NO: 100073 - RNA, 32 nt, Human
ccaggcggaggggcugcuuuucugcccuuccu

SEQ ID NO: 100074 - RNA, 18 nt, Human
ccaggcggaggugggaca

SEQ ID NO: 100075 - RNA, 32 nt, Human
ccaggcggauagcuugagcucagggggccaag

SEQ ID NO: 100076 - RNA, 24 nt, Human
ccaggcggcagagguugcagugag

SEQ ID NO: 100077 - RNA, 32 nt, Human
ccaggcggcagggcaucaugcccagcuggcau

SEQ ID NO: 100078 - RNA, 32 nt, Human
ccaggcggcauccuuuucuaugaaguguugac

SEQ ID NO: 100079 - RNA, 32 nt, Human
ccaggcggccacucaggccugcguggacugga

SEQ ID NO: 100080 - RNA, 18 nt, Human
ccaggcggcucccccagg

SEQ ID NO: 100081 - RNA, 18 nt, Human
ccaggcgggagggcccag

SEQ ID NO: 100082 - RNA, 19 nt, Human
ccaggcgggagugcagugg

SEQ ID NO: 100083 - RNA, 22 nt, Human
ccaggcgggcaaggggaccaga

SEQ ID NO: 100084 - RNA, 23 nt, Human
ccaggcgggcaguggagcuggcc

SEQ ID NO: 100085 - RNA, 32 nt, Human
ccaggcgggcggaucacuugaggucaggaauu

SEQ ID NO: 100086 - RNA, 23 nt, Human
ccaggcgggcggcacgccaacag

SEQ ID NO: 100087 - RNA, 32 nt, Human
ccaggcggguuucugucaggcccggggaggag

SEQ ID NO: 100088 - RNA, 32 nt, Human
ccaggcgguagcgggggcaguggugcuguugc

SEQ ID NO: 100089 - RNA, 32 nt, Human
ccaggcggucaccagcagauuugcccgcgcgu

SEQ ID NO: 100090 - RNA, 32 nt, Human
ccaggcggucuccucuacagacugccuuggcc

SEQ ID NO: 100091 - RNA, 32 nt, Human
ccaggcgguggaggugcggcagcugcugcuca

SEQ ID NO: 100092 - RNA, 32 nt, Human
ccaggcggugguggacgaugcccagcuggaca

SEQ ID NO: 100093 - RNA, 24 nt, Human
ccaggcgguugaggcugcagugag

SEQ ID NO: 100094 - RNA, 32 nt, Human
ccaggcgguugcggcggcgacagccauggccg

SEQ ID NO: 100095 - RNA, 32 nt, Human
ccaggcguaguggcuuacaccuguaaucccag

SEQ ID NO: 100096 - RNA, 32 nt, Human
ccaggcguaguggugcaugccuguaaucccag

SEQ ID NO: 100097 - RNA, 25 nt, Human
ccaggcgucacccagacucugcgga

SEQ ID NO: 100098 - RNA, 20 nt, Human
ccaggcguccggcugcuguc

SEQ ID NO: 100099 - RNA, 32 nt, Human
ccaggcgugauggcaggugccuguaauccuag

SEQ ID NO: 100100 - RNA, 32 nt, Human
ccaggcgugauggcucaugccugugaucccag

SEQ ID NO: 100101 - RNA, 32 nt, Human
ccaggcgugggcccgugucugucccugguugu

SEQ ID NO: 100102 - RNA, 32 nt, Human
ccaggcguggguggccuagaagaugaggggag

SEQ ID NO: 100103 - RNA, 32 nt, Human
ccaggcgugguagcucacgccuguaauuccag

SEQ ID NO: 100104 - RNA, 32 nt, Human
ccaggcguggugacucacaccuguaauuccag

SEQ ID NO: 100105 - RNA, 32 nt, Human
ccaggcguggugacucaugccuguaaucccag

SEQ ID NO: 100106 - RNA, 32 nt, Human
ccaggcguggugaugggcaccuguaaucucag

SEQ ID NO: 100107 - RNA, 32 nt, Human
ccaggcgugguggcacaugccuguaaucccag

SEQ ID NO: 100108 - RNA, 32 nt, Human
ccaggcgugguggcacgcgccuguaaucccag

SEQ ID NO: 100109 - RNA, 32 nt, Human
ccaggcgugguggcagaccccuguaaucccag

SEQ ID NO: 100110 - RNA, 32 nt, Human
ccaggcgugguggcaggcaccuguaaucccag

SEQ ID NO: 100111 - RNA, 32 nt, Human
ccaggcgugguggcagguaccuguaaucccag

SEQ ID NO: 100112 - RNA, 32 nt, Human
ccaggcgugguggcaggugccuguaaucccag

SEQ ID NO: 100113 - RNA, 32 nt, Human
ccaggcgugguggcaggugccuguaaucccgg

SEQ ID NO: 100114 - RNA, 32 nt, Human
ccaggcgugguggcaugcaccuguaaucccaa

SEQ ID NO: 100115 - RNA, 32 nt, Human
ccaggcgugguggcgcacaccuguaaucccag

SEQ ID NO: 100116 - RNA, 32 nt, Human
ccaggcgugguggcgcauaccuguaaucucug

SEQ ID NO: 100117 - RNA, 32 nt, Human
ccaggcgugguggcgcaugccuguaaucccag

SEQ ID NO: 100118 - RNA, 32 nt, Human
ccaggcgugguggcgcgcaccuguaaucccag

SEQ ID NO: 100119 - RNA, 32 nt, Human
ccaggcgugguggcgggcaccuguaaucccag

SEQ ID NO: 100120 - RNA, 32 nt, Human
ccaggcgugguggcgggcgccuguaaucacag

SEQ ID NO: 100121 - RNA, 32 nt, Human
ccaggcgugguggcgggcgccuguaauccaag

SEQ ID NO: 100122 - RNA, 32 nt, Human
ccaggcgugguggcgggcgccuguaaucccag

SEQ ID NO: 100123 - RNA, 32 nt, Human
ccaggcgugguggcgggugccuguaaucccag

SEQ ID NO: 100124 - RNA, 32 nt, Human
ccaggcgugguggcgggugccuguaaucccgg

SEQ ID NO: 100125 - RNA, 32 nt, Human
ccaggcgugguggcgugcgccuguaaucccag

SEQ ID NO: 100126 - RNA, 32 nt, Human
ccaggcgugguggcucacaccuguaaucccag

SEQ ID NO: 100127 - RNA, 32 nt, Human
ccaggcgugguggcucacgccuguaaucccaa

SEQ ID NO: 100128 - RNA, 32 nt, Human
ccaggcgugguggcucacgccuguaaucccag

SEQ ID NO: 100129 - RNA, 32 nt, Human
ccaggcgugguggcucacgccuguaaugccag

SEQ ID NO: 100130 - RNA, 32 nt, Human
ccaggcgugguggcucacuccuguaaucccac

SEQ ID NO: 100131 - RNA, 32 nt, Human
ccaggcgugguggcucacuccuguaaucccag

SEQ ID NO: 100132 - RNA, 32 nt, Human
ccaggcgugguggcucaugacuguaaucccag

SEQ ID NO: 100133 - RNA, 32 nt, Human
ccaggcgugguggcucaugccuauaaucccag

SEQ ID NO: 100134 - RNA, 32 nt, Human
ccaggcgugguggcucaugccugcggucccag

SEQ ID NO: 100135 - RNA, 32 nt, Human
ccaggcgugguggcucaugccuguaaucccag

SEQ ID NO: 100136 - RNA, 32 nt, Human
ccaggcgugguggcucaugccuguaaucccgg

SEQ ID NO: 100137 - RNA, 32 nt, Human
ccaggcgugguggcucaugccuguaaucgcag

SEQ ID NO: 100138 - RNA, 32 nt, Human
ccaggcgugguggcucaugccuguaaucucag

SEQ ID NO: 100139 - RNA, 32 nt, Human
ccaggcgugguggcucaugccuguaaucugag

SEQ ID NO: 100140 - RNA, 32 nt, Human
ccaggcgugguggcucaugccuguagucccag

SEQ ID NO: 100141 - RNA, 32 nt, Human
ccaggcgugguggcucaugcuuguaaucccag

SEQ ID NO: 100142 - RNA, 32 nt, Human
ccaggcgugguggcucaugcuuguggucccag

SEQ ID NO: 100143 - RNA, 32 nt, Human
ccaggcgugguggcucauguauguaauccuag

SEQ ID NO: 100144 - RNA, 32 nt, Human
ccaggcgugguggcuggcgccuguaaucccag

SEQ ID NO: 100145 - RNA, 32 nt, Human
ccaggcgugguggggcaugccuguaaucccag

SEQ ID NO: 100146 - RNA, 32 nt, Human
ccaggcguggugguacaugccuguaaucccag

SEQ ID NO: 100147 - RNA, 32 nt, Human
ccaggcgugguggugcaugccuguaauccagc

SEQ ID NO: 100148 - RNA, 32 nt, Human
ccaggcgugguggugcaugccuguaaucccag

SEQ ID NO: 100149 - RNA, 32 nt, Human
ccaggcgugguggugcaugccuguaauccuag

SEQ ID NO: 100150 - RNA, 32 nt, Human
ccaggcgugguggugggcaccuguaaucccag

SEQ ID NO: 100151 - RNA, 32 nt, Human
ccaggcgugguggugggugccuguaaucccag

SEQ ID NO: 100152 - RNA, 32 nt, Human
ccaggcgugguggugggugccuguaauuccag

SEQ ID NO: 100153 - RNA, 32 nt, Human
ccaggcgugguggugugcaccuguaaucccag

SEQ ID NO: 100154 - RNA, 32 nt, Human
ccaggcgugguggugugugccuguaaucccag

SEQ ID NO: 100155 - RNA, 32 nt, Human
ccaggcgugguggugugugccuguaauccuag

SEQ ID NO: 100156 - RNA, 32 nt, Human
ccaggcguggugguucacaccuguaaucccaa

SEQ ID NO: 100157 - RNA, 32 nt, Human
ccaggcguggugguucaggccuguaauuccag

SEQ ID NO: 100158 - RNA, 32 nt, Human
ccaggcguggugguucaugccuguaaucccaa

SEQ ID NO: 100159 - RNA, 32 nt, Human
ccaggcguggugguucaugccuguaaucccag

SEQ ID NO: 100160 - RNA, 32 nt, Human
ccaggcguggugucucacaccuguaaucccag

SEQ ID NO: 100161 - RNA, 32 nt, Human
ccaggcguguuggugugcaccuguaaucccag

SEQ ID NO: 100162 - RNA, 32 nt, Human
ccaggcguucaagaccagccugggcaacagaa

SEQ ID NO: 100163 - RNA, 32 nt, Human
ccaggcguuccuuucuuucugcccuaggaaag

SEQ ID NO: 100164 - RNA, 32 nt, Human
ccaggcuaaaauauccugucuggcagaguguu

SEQ ID NO: 100165 - RNA, 32 nt, Human
ccaggcuaaggcauacaguucuugacuuugga

SEQ ID NO: 100166 - RNA, 32 nt, Human
ccaggcuaauuagaggauguggcaggggcagu

SEQ ID NO: 100167 - RNA, 22 nt, Human
ccaggcuaccgccuccuggacc

SEQ ID NO: 100168 - RNA, 32 nt, Human
ccaggcuacgagcgggagggaggcgggagucg

SEQ ID NO: 100169 - RNA, 32 nt, Human
ccaggcuacgcuccugaccucuucccaggcag

SEQ ID NO: 100170 - RNA, 32 nt, Human
ccaggcuacugauguccuggguugcuccucuu

SEQ ID NO: 100171 - RNA, 32 nt, Human
ccaggcuacugccuccugauaauggcuucugc

SEQ ID NO: 100172 - RNA, 32 nt, Human
ccaggcuacuucuccccuccucuugccucccu

SEQ ID NO: 100173 - RNA, 20 nt, Human
ccaggcuagaguaccguggc

SEQ ID NO: 100174 - RNA, 20 nt, Human
ccaggcuagagugcaauggc

SEQ ID NO: 100175 - RNA, 19 nt, Human
ccaggcuagagugcagugg

SEQ ID NO: 100176 - RNA, 20 nt, Human
ccaggcuagagugcaguggc

SEQ ID NO: 100177 - RNA, 19 nt, Human
ccaggcuagagugcggugg

SEQ ID NO: 100178 - RNA, 32 nt, Human
ccaggcuagcacccucccuucagaugaccauu

SEQ ID NO: 100179 - RNA, 32 nt, Human
ccaggcuaggcaggggacagcggcugcccugg

SEQ ID NO: 100180 - RNA, 32 nt, Human
ccaggcuaguagggcugugaggaaugcauuaa

SEQ ID NO: 100181 - RNA, 20 nt, Human
ccaggcuagucucgaacucc

SEQ ID NO: 100182 - RNA, 32 nt, Human
ccaggcuagucucgaauuccugggcucaagug

SEQ ID NO: 100183 - RNA, 32 nt, Human
ccaggcuagugcaaagggcucuucacucggau

SEQ ID NO: 100184 - RNA, 20 nt, Human
ccaggcuaguuucaaacucc

SEQ ID NO: 100185 - RNA, 20 nt, Human
ccaggcuaguuucgaacucc

SEQ ID NO: 100186 - RNA, 32 nt, Human
ccaggcucaaaagaugcucccaccacagccuc

SEQ ID NO: 100187 - RNA, 32 nt, Human
ccaggcucaagaaauccucccaccucagccuc

SEQ ID NO: 100188 - RNA, 32 nt, Human
ccaggcucaagcaauccuaccaugucagccuu

SEQ ID NO: 100189 - RNA, 32 nt, Human
ccaggcucaagcaauccuugugccucagccuc

SEQ ID NO: 100190 - RNA, 32 nt, Human
ccaggcucaagcaauucuccuaccucagccuc

SEQ ID NO: 100191 - RNA, 32 nt, Human
ccaggcucaagcaauucuccugccucaaccuu

SEQ ID NO: 100192 - RNA, 32 nt, Human
ccaggcucaagcaauucuccugccucagccuc

SEQ ID NO: 100193 - RNA, 32 nt, Human
ccaggcucaagcaauucuuacgccucagccuc

SEQ ID NO: 100194 - RNA, 32 nt, Human
ccaggcucaagccaucuuuccaccucagccug

SEQ ID NO: 100195 - RNA, 32 nt, Human
ccaggcucaagcgauccucccaccucagcucc

SEQ ID NO: 100196 - RNA, 32 nt, Human
ccaggcucaagcgauccucccagcucagccug

SEQ ID NO: 100197 - RNA, 32 nt, Human
ccaggcucaagcgauccucccgccuuaacugc

SEQ ID NO: 100198 - RNA, 32 nt, Human
ccaggcucaagcgguccuucuaccucagccuc

SEQ ID NO: 100199 - RNA, 32 nt, Human
ccaggcucaagcuguccucccaccucagccuc

SEQ ID NO: 100200 - RNA, 32 nt, Human
ccaggcucaagugauccucccaccccagccuc

SEQ ID NO: 100201 - RNA, 32 nt, Human
ccaggcucaagugauccucccaccucagcccc

SEQ ID NO: 100202 - RNA, 32 nt, Human
ccaggcucaagugauccucccaccucagccuc

SEQ ID NO: 100203 - RNA, 32 nt, Human
ccaggcucaagugauccucccaccucagucuc

SEQ ID NO: 100204 - RNA, 32 nt, Human
ccaggcucaagugauccucccacuucagcuuc

SEQ ID NO: 100205 - RNA, 32 nt, Human
ccaggcucaagugauccuuccaccucagccuc

SEQ ID NO: 100206 - RNA, 21 nt, Human
ccaggcucacacagcagcuca

SEQ ID NO: 100207 - RNA, 32 nt, Human
ccaggcucacagaccaccccacccuacccugu

SEQ ID NO: 100208 - RNA, 22 nt, Human
ccaggcucacaggcugugccac

SEQ ID NO: 100209 - RNA, 32 nt, Human
ccaggcucacccaggcuggggucugaguguca

SEQ ID NO: 100210 - RNA, 21 nt, Human
ccaggcucacucacagaguca

SEQ ID NO: 100211 - RNA, 32 nt, Human
ccaggcucagauaauccuccugccucagacuc

SEQ ID NO: 100212 - RNA, 32 nt, Human
ccaggcucagcagcgugcuguggaaguggaag

SEQ ID NO: 100213 - RNA, 32 nt, Human
ccaggcucagcagggagcugcuggaugagaaa

SEQ ID NO: 100214 - RNA, 32 nt, Human
ccaggcucagccaggagcugccagaggugaag

SEQ ID NO: 100215 - RNA, 32 nt, Human
ccaggcucagcccaccccuccaccucucucuc

SEQ ID NO: 100216 - RNA, 32 nt, Human
ccaggcucaggugauccucccaccucagccuc

SEQ ID NO: 100217 - RNA, 32 nt, Human
ccaggcucauacuaaaaucccaaaaagugaaa

SEQ ID NO: 100218 - RNA, 32 nt, Human
ccaggcucaugugauccucccaccucagccuc

SEQ ID NO: 100219 - RNA, 32 nt, Human
ccaggcucauguggcccagcagucccugaaug

SEQ ID NO: 100220 - RNA, 32 nt, Human
ccaggcuccaacaagccccugagcagcaauuu

SEQ ID NO: 100221 - RNA, 32 nt, Human
ccaggcuccaagaguccacccuucccagcuca

SEQ ID NO: 100222 - RNA, 32 nt, Human
ccaggcuccacaucacgggaagugagauggau

SEQ ID NO: 100223 - RNA, 32 nt, Human
ccaggcuccagaagaaagacagcagcucaugg

SEQ ID NO: 100224 - RNA, 32 nt, Human
ccaggcuccagccgucgucuccgcgcucccgg

SEQ ID NO: 100225 - RNA, 32 nt, Human
ccaggcuccagccucagggcuggccuguuccc

SEQ ID NO: 100226 - RNA, 18 nt, Human
ccaggcucccaacccagg

SEQ ID NO: 100227 - RNA, 22 nt, Human
ccaggcuccccaaccccaccca

SEQ ID NO: 100228 - RNA, 21 nt, Human
ccaggcuccccaagcuucccu

SEQ ID NO: 100229 - RNA, 18 nt, Human
ccaggcuccccucucuca

SEQ ID NO: 100230 - RNA, 32 nt, Human
ccaggcuccgccauggggaaugugccauccgc

SEQ ID NO: 100231 - RNA, 32 nt, Human
ccaggcuccucugcaccugcaaaggaacagga

SEQ ID NO: 100232 - RNA, 32 nt, Human
ccaggcuccugauauccaucugggugagccag

SEQ ID NO: 100233 - RNA, 32 nt, Human
ccaggcuccugcugcagcuccugggccgcacu

SEQ ID NO: 100234 - RNA, 32 nt, Human
ccaggcuccuuuccuacauccuucccgcgccc

SEQ ID NO: 100235 - RNA, 32 nt, Human
ccaggcucgagcaauccucccacuucacccuc

SEQ ID NO: 100236 - RNA, 32 nt, Human
ccaggcucgauccucccaugucagccucccaa

SEQ ID NO: 100237 - RNA, 20 nt, Human
ccaggcucggacagcccccu

SEQ ID NO: 100238 - RNA, 19 nt, Human
ccaggcucggagcugcagg

SEQ ID NO: 100239 - RNA, 32 nt, Human
ccaggcucuacuccaucccauuggagucucuu

SEQ ID NO: 100240 - RNA, 32 nt, Human
ccaggcucucuccaccacgcugccucaggccc

SEQ ID NO: 100241 - RNA, 23 nt, Human
ccaggcucugacuuucagcauca

SEQ ID NO: 100242 - RNA, 32 nt, Human
ccaggcucugagccacugagcaccagcuggcc

SEQ ID NO: 100243 - RNA, 32 nt, Human
ccaggcucugaggagguguggaguagaggccc

SEQ ID NO: 100244 - RNA, 32 nt, Human
ccaggcucuggacuuccuccagucggccucuc

SEQ ID NO: 100245 - RNA, 32 nt, Human
ccaggcucuggagggcccucucuguugcagua

SEQ ID NO: 100246 - RNA, 32 nt, Human
ccaggcucugggaggcucccugagaugugcug

SEQ ID NO: 100247 - RNA, 22 nt, Human
ccaggcucugggcaaggcuccu

SEQ ID NO: 100248 - RNA, 32 nt, Human
ccaggcucugguuccccaccugucaggccugu

SEQ ID NO: 100249 - RNA, 23 nt, Human
ccaggcucugucuccucagcuca

SEQ ID NO: 100250 - RNA, 32 nt, Human
ccaggcucuuacuccagccggggcugccagcg

SEQ ID NO: 100251 - RNA, 32 nt, Human
ccaggcucuuucacggauuuaggcugagaaac

SEQ ID NO: 100252 - RNA, 32 nt, Human
ccaggcucuuucucccuuuuccucuucucacu

SEQ ID NO: 100253 - RNA, 24 nt, Human
ccaggcugaagaagaccugggcca

SEQ ID NO: 100254 - RNA, 32 nt, Human
ccaggcugaagcgauccucccaccucaaccuc

SEQ ID NO: 100255 - RNA, 32 nt, Human
ccaggcugaagugauucucccaucucaaccuc

SEQ ID NO: 100256 - RNA, 19 nt, Human
ccaggcugaagugcaguga

SEQ ID NO: 100257 - RNA, 19 nt, Human
ccaggcugaagugcagugg

SEQ ID NO: 100258 - RNA, 32 nt, Human
ccaggcugacacccucuccuggagagaggcuc

SEQ ID NO: 100259 - RNA, 32 nt, Human
ccaggcugaccuuuaugcucccagaaucauca

SEQ ID NO: 100260 - RNA, 32 nt, Human
ccaggcugacgugcaucccacccagacggugu

SEQ ID NO: 100261 - RNA, 31 nt, Human
ccaggcugacuucugucucugcaaagaggac

SEQ ID NO: 100262 - RNA, 32 nt, Human
ccaggcugagacgggaaaauugcuugaacuca

SEQ ID NO: 100263 - RNA, 32 nt, Human
ccaggcugaggaucacugaggaaggggaagug

SEQ ID NO: 100264 - RNA, 32 nt, Human
ccaggcugaggugggaagauugcuugaacuca

SEQ ID NO: 100265 - RNA, 18 nt, Human
ccaggcugagugcagugg

SEQ ID NO: 100266 - RNA, 32 nt, Human
ccaggcugaucucaaacuucugaccucaggug

SEQ ID NO: 100267 - RNA, 32 nt, Human
ccaggcugcaacauccaccucccagguucaag

SEQ ID NO: 100268 - RNA, 32 nt, Human
ccaggcugcacacccauuucagccaucaagaa

SEQ ID NO: 100269 - RNA, 32 nt, Human
ccaggcugcacucggucgggccuccacaggca

SEQ ID NO: 100270 - RNA, 32 nt, Human
ccaggcugcagccucaggcacuggcaggggcu

SEQ ID NO: 100271 - RNA, 32 nt, Human
ccaggcugcagcuucugugggacugccuuaag

SEQ ID NO: 100272 - RNA, 32 nt, Human
ccaggcugcaggaaaucugccuccaggagggg

SEQ ID NO: 100273 - RNA, 18 nt, Human
ccaggcugcagugcagug

SEQ ID NO: 100274 - RNA, 19 nt, Human
ccaggcugcagugcagugg

SEQ ID NO: 100275 - RNA, 23 nt, Human
ccaggcugccaaggcggcucccc

SEQ ID NO: 100276 - RNA, 32 nt, Human
ccaggcugccaggcuggaguggaguggcauga

SEQ ID NO: 100277 - RNA, 18 nt, Human
ccaggcugcccccagggu

SEQ ID NO: 100278 - RNA, 32 nt, Human
ccaggcugccgugcaccauccuggguguccuc

SEQ ID NO: 100279 - RNA, 32 nt, Human
ccaggcugcucaagagagacacuguggcagcu

SEQ ID NO: 100280 - RNA, 18 nt, Human
ccaggcugcuccaggggc

SEQ ID NO: 100281 - RNA, 32 nt, Human
ccaggcuggaagguggagcgagaaguggaugc

SEQ ID NO: 100282 - RNA, 21 nt, Human
ccaggcuggaaugcaauggug

SEQ ID NO: 100283 - RNA, 19 nt, Human
ccaggcuggaaugcaguag

SEQ ID NO: 100284 - RNA, 19 nt, Human
ccaggcuggaaugcagugg

SEQ ID NO: 100285 - RNA, 22 nt, Human
ccaggcuggaaugcaguggcgu

SEQ ID NO: 100286 - RNA, 32 nt, Human
ccaggcuggaaugcaguggugugaacugggcu

SEQ ID NO: 100287 - RNA, 32 nt, Human
ccaggcuggacaaaccaguuccuggguccccc

SEQ ID NO: 100288 - RNA, 32 nt, Human
ccaggcuggacuccagcacaguggcaugaucu

SEQ ID NO: 100289 - RNA, 19 nt, Human
ccaggcuggacugcagugg

SEQ ID NO: 100290 - RNA, 19 nt, Human
ccaggcuggagagcagugg

SEQ ID NO: 100291 - RNA, 19 nt, Human
ccaggcuggagcgcagugg

SEQ ID NO: 100292 - RNA, 19 nt, Human
ccaggcuggagggcagugg

SEQ ID NO: 100293 - RNA, 21 nt, Human
ccaggcuggagggcaguggug

SEQ ID NO: 100294 - RNA, 18 nt, Human
ccaggcuggaguacagug

SEQ ID NO: 100295 - RNA, 19 nt, Human
ccaggcuggaguacaguga

SEQ ID NO: 100296 - RNA, 21 nt, Human
ccaggcuggaguacagugaug

SEQ ID NO: 100297 - RNA, 19 nt, Human
ccaggcuggaguacagugg

SEQ ID NO: 100298 - RNA, 32 nt, Human
ccaggcuggaguauaguagugcagugguguga

SEQ ID NO: 100299 - RNA, 19 nt, Human
ccaggcuggaguccagugg

SEQ ID NO: 100300 - RNA, 19 nt, Human
ccaggcuggagugaagugg

SEQ ID NO: 100301 - RNA, 22 nt, Human
ccaggcuggagugaaguggugu

SEQ ID NO: 100302 - RNA, 32 nt, Human
ccaggcuggagugagugcaguggcgcaaucuc

SEQ ID NO: 100303 - RNA, 32 nt, Human
ccaggcuggagugcaacggugcagucucggcu

SEQ ID NO: 100304 - RNA, 18 nt, Human
ccaggcuggagugcaaug

SEQ ID NO: 100305 - RNA, 19 nt, Human
ccaggcuggagugcaauga

SEQ ID NO: 100306 - RNA, 19 nt, Human
ccaggcuggagugcaaugg

SEQ ID NO: 100307 - RNA, 22 nt, Human
ccaggcuggagugcaauggcgu

SEQ ID NO: 100308 - RNA, 32 nt, Human
ccaggcuggagugcaaugguguguugucggcu

SEQ ID NO: 100309 - RNA, 32 nt, Human
ccaggcuggagugcaaugugcaauggcacaau

SEQ ID NO: 100310 - RNA, 19 nt, Human
ccaggcuggagugcacugg

SEQ ID NO: 100311 - RNA, 19 nt, Human
ccaggcuggagugcagagg

SEQ ID NO: 100312 - RNA, 19 nt, Human
ccaggcuggagugcagcgg

SEQ ID NO: 100313 - RNA, 32 nt, Human
ccaggcuggagugcaggcuuggaguuuuauga

SEQ ID NO: 100314 - RNA, 18 nt, Human
ccaggcuggagugcaggg

SEQ ID NO: 100315 - RNA, 19 nt, Human
ccaggcuggagugcaguag

SEQ ID NO: 100316 - RNA, 32 nt, Human
ccaggcuggagugcaguagugcagucguggcu

SEQ ID NO: 100317 - RNA, 18 nt, Human
ccaggcuggagugcagug

SEQ ID NO: 100318 - RNA, 19 nt, Human
ccaggcuggagugcaguga

SEQ ID NO: 100319 - RNA, 19 nt, Human
ccaggcuggagugcagugg

SEQ ID NO: 100320 - RNA, 32 nt, Human
ccaggcuggagugcaguggagcaaucuugggu

SEQ ID NO: 100321 - RNA, 32 nt, Human
ccaggcuggagugcaguggagugaucucggcu

SEQ ID NO: 100322 - RNA, 32 nt, Human
ccaggcuggagugcaguggcaaaaucacaaua

SEQ ID NO: 100323 - RNA, 32 nt, Human
ccaggcuggagugcaguggcacaaccucggcu

SEQ ID NO: 100324 - RNA, 32 nt, Human
ccaggcuggagugcaguggcacaaccuuggcu

SEQ ID NO: 100325 - RNA, 32 nt, Human
ccaggcuggagugcaguggcacaaucaaagcu

SEQ ID NO: 100326 - RNA, 32 nt, Human
ccaggcuggagugcaguggcacaaucacaguu

SEQ ID NO: 100327 - RNA, 32 nt, Human
ccaggcuggagugcaguggcacaaucauggcu

SEQ ID NO: 100328 - RNA, 32 nt, Human
ccaggcuggagugcaguggcacaaucucagcu

SEQ ID NO: 100329 - RNA, 32 nt, Human
ccaggcuggagugcaguggcacaaucucaguu

SEQ ID NO: 100330 - RNA, 32 nt, Human
ccaggcuggagugcaguggcacaaucucgacu

SEQ ID NO: 100331 - RNA, 32 nt, Human
ccaggcuggagugcaguggcacaaucucggcu

SEQ ID NO: 100332 - RNA, 32 nt, Human
ccaggcuggagugcaguggcacaaucucugcu

SEQ ID NO: 100333 - RNA, 32 nt, Human
ccaggcuggagugcaguggcacaaucuugacu

SEQ ID NO: 100334 - RNA, 32 nt, Human
ccaggcuggagugcaguggcacaaucuuggcu

SEQ ID NO: 100335 - RNA, 32 nt, Human
ccaggcuggagugcaguggcacaaugacgacu

SEQ ID NO: 100336 - RNA, 32 nt, Human
ccaggcuggagugcaguggcacagucuuggau

SEQ ID NO: 100337 - RNA, 32 nt, Human
ccaggcuggagugcaguggcacaucucggcuc

SEQ ID NO: 100338 - RNA, 32 nt, Human
ccaggcuggagugcaguggcaccaccauggcu

SEQ ID NO: 100339 - RNA, 32 nt, Human
ccaggcuggagugcaguggcaccaucucagcu

SEQ ID NO: 100340 - RNA, 32 nt, Human
ccaggcuggagugcaguggcaccaucucaguu

SEQ ID NO: 100341 - RNA, 32 nt, Human
ccaggcuggagugcaguggcacgaucacagcu

SEQ ID NO: 100342 - RNA, 32 nt, Human
ccaggcuggagugcaguggcacgaucauggcu

SEQ ID NO: 100343 - RNA, 32 nt, Human
ccaggcuggagugcaguggcacgauccugguu

SEQ ID NO: 100344 - RNA, 32 nt, Human
ccaggcuggagugcaguggcacgaucucaacu

SEQ ID NO: 100345 - RNA, 32 nt, Human
ccaggcuggagugcaguggcacgaucucagcu

SEQ ID NO: 100346 - RNA, 32 nt, Human
ccaggcuggagugcaguggcacgaucugcaaa

SEQ ID NO: 100347 - RNA, 32 nt, Human
ccaggcuggagugcaguggcacgaucuuggcu

SEQ ID NO: 100348 - RNA, 32 nt, Human
ccaggcuggagugcaguggcacgaucuugguu

SEQ ID NO: 100349 - RNA, 32 nt, Human
ccaggcuggagugcaguggcacgauuauggcu

SEQ ID NO: 100350 - RNA, 32 nt, Human
ccaggcuggagugcaguggcacggucucagcu

SEQ ID NO: 100351 - RNA, 32 nt, Human
ccaggcuggagugcaguggcacuaucucggcu

SEQ ID NO: 100352 - RNA, 32 nt, Human
ccaggcuggagugcaguggcacuaucuuggcu

SEQ ID NO: 100353 - RNA, 32 nt, Human
ccaggcuggagugcaguggcagaguugcagcu

SEQ ID NO: 100354 - RNA, 32 nt, Human
ccaggcuggagugcaguggcaggaucucggcu

SEQ ID NO: 100355 - RNA, 32 nt, Human
ccaggcuggagugcaguggcauaaucauaccu

SEQ ID NO: 100356 - RNA, 32 nt, Human
ccaggcuggagugcaguggcaugaucacagcu

SEQ ID NO: 100357 - RNA, 32 nt, Human
ccaggcuggagugcaguggcaugaucauaacu

SEQ ID NO: 100358 - RNA, 32 nt, Human
ccaggcuggagugcaguggcaugaucauagcu

SEQ ID NO: 100359 - RNA, 32 nt, Human
ccaggcuggagugcaguggcaugaucucagcu

SEQ ID NO: 100360 - RNA, 32 nt, Human
ccaggcuggagugcaguggcaugaucucaguu

SEQ ID NO: 100361 - RNA, 32 nt, Human
ccaggcuggagugcaguggcaugaucucggcu

SEQ ID NO: 100362 - RNA, 32 nt, Human
ccaggcuggagugcaguggcaugaucuggucu

SEQ ID NO: 100363 - RNA, 32 nt, Human
ccaggcuggagugcaguggcaugaucuuagcu

SEQ ID NO: 100364 - RNA, 32 nt, Human
ccaggcuggagugcaguggcaugauuucggcu

SEQ ID NO: 100365 - RNA, 32 nt, Human
ccaggcuggagugcaguggcauuaucucggcu

SEQ ID NO: 100366 - RNA, 32 nt, Human
ccaggcuggagugcaguggccugaucucugcu

SEQ ID NO: 100367 - RNA, 32 nt, Human
ccaggcuggagugcaguggcgaaaucccugcu

SEQ ID NO: 100368 - RNA, 32 nt, Human
ccaggcuggagugcaguggcgcaaucucacug

SEQ ID NO: 100369 - RNA, 32 nt, Human
ccaggcuggagugcaguggcgcaaucuccacu

SEQ ID NO: 100370 - RNA, 32 nt, Human
ccaggcuggagugcaguggcgccaucucccag

SEQ ID NO: 100371 - RNA, 32 nt, Human
ccaggcuggagugcaguggcgcgaucucaucu

SEQ ID NO: 100372 - RNA, 32 nt, Human
ccaggcuggagugcaguggcgcgaucuugguu

SEQ ID NO: 100373 - RNA, 22 nt, Human
ccaggcuggagugcaguggcgu

SEQ ID NO: 100374 - RNA, 32 nt, Human
ccaggcuggagugcaguggcgugaucucaguu

SEQ ID NO: 100375 - RNA, 32 nt, Human
ccaggcuggagugcaguggcucaaugcaaccu

SEQ ID NO: 100376 - RNA, 32 nt, Human
ccaggcuggagugcaguggcucgaucucugcu

SEQ ID NO: 100377 - RNA, 32 nt, Human
ccaggcuggagugcaguggcuugaucuuggcu

SEQ ID NO: 100378 - RNA, 32 nt, Human
ccaggcuggagugcagugggaugaucuuggcu

SEQ ID NO: 100379 - RNA, 32 nt, Human
ccaggcuggagugcagugggugaucuuggcuc

SEQ ID NO: 100380 - RNA, 32 nt, Human
ccaggcuggagugcagugguacaagcacaguu

SEQ ID NO: 100381 - RNA, 32 nt, Human
ccaggcuggagugcagugguacaaucauggcu

SEQ ID NO: 100382 - RNA, 32 nt, Human
ccaggcuggagugcagugguacagucucagcu

SEQ ID NO: 100383 - RNA, 32 nt, Human
ccaggcuggagugcagugguacagucuuagcu

SEQ ID NO: 100384 - RNA, 32 nt, Human
ccaggcuggagugcagugguacgaucuuggcu

SEQ ID NO: 100385 - RNA, 32 nt, Human
ccaggcuggagugcagugguagaucaggguuc

SEQ ID NO: 100386 - RNA, 32 nt, Human
ccaggcuggagugcagugguaugaccauagcu

SEQ ID NO: 100387 - RNA, 32 nt, Human
ccaggcuggagugcagugguaugaucauggcu

SEQ ID NO: 100388 - RNA, 32 nt, Human
ccaggcuggagugcagugguaugaucucaccu

SEQ ID NO: 100389 - RNA, 32 nt, Human
ccaggcuggagugcagugguaugaucucagcu

SEQ ID NO: 100390 - RNA, 32 nt, Human
ccaggcuggagugcagugguaugaucuuggcu

SEQ ID NO: 100391 - RNA, 21 nt, Human
ccaggcuggagugcaguggug

SEQ ID NO: 100392 - RNA, 32 nt, Human
ccaggcuggagugcaguggugagaucugggcu

SEQ ID NO: 100393 - RNA, 32 nt, Human
ccaggcuggagugcaguggugagaucuggguu

SEQ ID NO: 100394 - RNA, 32 nt, Human
ccaggcuggagugcaguggugagauuuuggcu

SEQ ID NO: 100395 - RNA, 32 nt, Human
ccaggcuggagugcaguggugcaaucaugguu

SEQ ID NO: 100396 - RNA, 32 nt, Human
ccaggcuggagugcaguggugcaaucucaccu

SEQ ID NO: 100397 - RNA, 32 nt, Human
ccaggcuggagugcaguggugcaaucucaguu

SEQ ID NO: 100398 - RNA, 32 nt, Human
ccaggcuggagugcaguggugcaaucucgguu

SEQ ID NO: 100399 - RNA, 32 nt, Human
ccaggcuggagugcaguggugcaaucuuggug

SEQ ID NO: 100400 - RNA, 32 nt, Human
ccaggcuggagugcaguggugccaucaccacg

SEQ ID NO: 100401 - RNA, 32 nt, Human
ccaggcuggagugcaguggugcgaucauaggu

SEQ ID NO: 100402 - RNA, 32 nt, Human
ccaggcuggagugcaguggugcgaucuggguu

SEQ ID NO: 100403 - RNA, 32 nt, Human
ccaggcuggagugcagugguggcgaucuuggc

SEQ ID NO: 100404 - RNA, 22 nt, Human
ccaggcuggagugcaguggugu

SEQ ID NO: 100405 - RNA, 32 nt, Human
ccaggcuggagugcagugguguaaacauagcu

SEQ ID NO: 100406 - RNA, 32 nt, Human
ccaggcuggagugcagugguguaaucuuggcu

SEQ ID NO: 100407 - RNA, 32 nt, Human
ccaggcuggagugcaguggugucaucauagcu

SEQ ID NO: 100408 - RNA, 32 nt, Human
ccaggcuggagugcaguggugugagcucggcu

SEQ ID NO: 100409 - RNA, 32 nt, Human
ccaggcuggagugcaguggugugaucauagcc

SEQ ID NO: 100410 - RNA, 32 nt, Human
ccaggcuggagugcaguggugugauccuggcu

SEQ ID NO: 100411 - RNA, 32 nt, Human
ccaggcuggagugcaguggugugaucucggcu

SEQ ID NO: 100412 - RNA, 32 nt, Human
ccaggcuggagugcaguggugugaucucgucu

SEQ ID NO: 100413 - RNA, 32 nt, Human
ccaggcuggagugcaguggugugaucuuggcu

SEQ ID NO: 100414 - RNA, 32 nt, Human
ccaggcuggagugcaguggugugaucuugggu

SEQ ID NO: 100415 - RNA, 19 nt, Human
ccaggcuggagugcauugg

SEQ ID NO: 100416 - RNA, 19 nt, Human
ccaggcuggagugccgugg

SEQ ID NO: 100417 - RNA, 18 nt, Human
ccaggcuggagugcgaug

SEQ ID NO: 100418 - RNA, 19 nt, Human
ccaggcuggagugcggugg

SEQ ID NO: 100419 - RNA, 32 nt, Human
ccaggcuggagugcgguggacucuuuucuuuu

SEQ ID NO: 100420 - RNA, 32 nt, Human
ccaggcuggagugcgguggcacaaucucggcu

SEQ ID NO: 100421 - RNA, 32 nt, Human
ccaggcuggagugcgguggcaugaucucaguu

SEQ ID NO: 100422 - RNA, 32 nt, Human
ccaggcuggagugcgguggcaugaucucgguu

SEQ ID NO: 100423 - RNA, 32 nt, Human
ccaggcuggagugcgguggcuagucacaggug

SEQ ID NO: 100424 - RNA, 32 nt, Human
ccaggcuggagugcgguggcuauucacagaug

SEQ ID NO: 100425 - RNA, 32 nt, Human
ccaggcuggagugcggugguacaaucucggcu

SEQ ID NO: 100426 - RNA, 32 nt, Human
ccaggcuggagugcgguggugcgaucacgguu

SEQ ID NO: 100427 - RNA, 32 nt, Human
ccaggcuggagugcggugguggaaucauagcu

SEQ ID NO: 100428 - RNA, 19 nt, Human
ccaggcuggagugcugugg

SEQ ID NO: 100429 - RNA, 19 nt, Human
ccaggcuggaguggagugg

SEQ ID NO: 100430 - RNA, 32 nt, Human
ccaggcuggaguggugcaguggcacgaucuca

SEQ ID NO: 100431 - RNA, 18 nt, Human
ccaggcuggaguguagug

SEQ ID NO: 100432 - RNA, 19 nt, Human
ccaggcuggaguguaguga

SEQ ID NO: 100433 - RNA, 19 nt, Human
ccaggcuggaguguagugg

SEQ ID NO: 100434 - RNA, 32 nt, Human
ccaggcuggaguguaguggcacaaucucagcu

SEQ ID NO: 100435 - RNA, 32 nt, Human
ccaggcuggaguguaguggcaccaucuccacu

SEQ ID NO: 100436 - RNA, 32 nt, Human
ccaggcuggaguguaguggcaugaucucgacu

SEQ ID NO: 100437 - RNA, 32 nt, Human
ccaggcuggaguguaguggcaugaucucggcu

SEQ ID NO: 100438 - RNA, 32 nt, Human
ccaggcuggaguguaguggcaugaucugggcu

SEQ ID NO: 100439 - RNA, 32 nt, Human
ccaggcuggaguguaguggcgcaaucuuggau

SEQ ID NO: 100440 - RNA, 32 nt, Human
ccaggcuggaguguagugguaugaucauagcu

SEQ ID NO: 100441 - RNA, 32 nt, Human
ccaggcuggaguguaguggugugauccuggcu

SEQ ID NO: 100442 - RNA, 32 nt, Human
ccaugcaguaaauaguucaagcuuugugggcu

SEQ ID NO: 100443 - RNA, 32 nt, Human
ccaugcaguccucaucucccugggcuuccgcu

SEQ ID NO: 100444 - RNA, 32 nt, Human
ccaugcagucucgcauuugaugacaugcagca

SEQ ID NO: 100445 - RNA, 32 nt, Human
ccaugcagugggcccaagcaaggggccuauga

SEQ ID NO: 100446 - RNA, 32 nt, Human
ccaugcagugugugcuuuuguguauggaagca

SEQ ID NO: 100447 - RNA, 22 nt, Human
ccaugcauagagccacgggagg

SEQ ID NO: 100448 - RNA, 32 nt, Human
ccaugcaucccaagccuuugaccuucccgcua

SEQ ID NO: 100449 - RNA, 32 nt, Human
ccaugcaugacuccuugucacacacaugaucu

SEQ ID NO: 100450 - RNA, 17 nt, Human
ccaugcaugcacccaga

SEQ ID NO: 100451 - RNA, 32 nt, Human
ccaugcauggucgcugucuacccuggaaaugu

SEQ ID NO: 100452 - RNA, 32 nt, Human
ccaugcaugguggcacaugccuguaaucccag

SEQ ID NO: 100453 - RNA, 32 nt, Human
ccaugcaugguggcgggugccuguaaucccag

SEQ ID NO: 100454 - RNA, 32 nt, Human
ccaugcaugguggcucaugccuguagucccag

SEQ ID NO: 100455 - RNA, 32 nt, Human
ccaugcaugguggugcaugccuguaaucucag

SEQ ID NO: 100456 - RNA, 32 nt, Human
ccaugcauugucacucugccuccgggacccca

SEQ ID NO: 100457 - RNA, 32 nt, Human
ccaugcauuucugcuuccuuugccaaagccag

SEQ ID NO: 100458 - RNA, 32 nt, Human
ccaugccaaugcacuccagucugggcaacaga

SEQ ID NO: 100459 - RNA, 32 nt, Human
ccaugccacugcacuccagccugggcaacaaa

SEQ ID NO: 100460 - RNA, 32 nt, Human
ccaugccacugcacuccagccugggcaacaga

SEQ ID NO: 100461 - RNA, 27 nt, Human
ccaugccacugcacuccagccugggug

SEQ ID NO: 100462 - RNA, 32 nt, Human
ccaugccacugcacuccggccugggugacaaa

SEQ ID NO: 100463 - RNA, 32 nt, Human
ccaugccagcacuugaacugucugggguuuga

SEQ ID NO: 100464 - RNA, 32 nt, Human
ccaugccagcagcugcagaggaugugccgguc

SEQ ID NO: 100465 - RNA, 32 nt, Human
ccaugccaggagagaggcaggcagaccugggc

SEQ ID NO: 100466 - RNA, 32 nt, Human
ccaugccaguccuaugcucugcagccauaggg

SEQ ID NO: 100467 - RNA, 32 nt, Human
ccaugccauugcacuccagccugggcgacaga

SEQ ID NO: 100468 - RNA, 32 nt, Human
ccaugccauuggacuccagccugggcaaaaag

SEQ ID NO: 100469 - RNA, 23 nt, Human
ccaugcccaacuccucuucagga

SEQ ID NO: 100470 - RNA, 32 nt, Human
ccaugcccaagagaaagacugaaggggaugcu

SEQ ID NO: 100471 - RNA, 27 nt, Human
ccaugcccaagagaaaggcugaagggg

SEQ ID NO: 100472 - RNA, 32 nt, Human
ccaugcccacccuccccacgcugcagugggcu

SEQ ID NO: 100473 - RNA, 21 nt, Human
ccaugcccacggcacaggaua

SEQ ID NO: 100474 - RNA, 22 nt, Human
ccaugcccagccagaauggaug

SEQ ID NO: 100475 - RNA, 32 nt, Human
ccaugcccagcccuggagccaucacuacucac

SEQ ID NO: 100476 - RNA, 23 nt, Human
ccaugcccagccuggcugagccc

SEQ ID NO: 100477 - RNA, 21 nt, Human
ccaugcccagcuaauuuuuga

SEQ ID NO: 100478 - RNA, 18 nt, Human
ccaugcccagcugggccu

SEQ ID NO: 100479 - RNA, 32 nt, Human
ccaugcccaggguggccguggaagggacgguu

SEQ ID NO: 100480 - RNA, 32 nt, Human
ccaugccccacugcaggccugggcccccucag

SEQ ID NO: 100481 - RNA, 32 nt, Human
ccaugccccaggcugcagccucuguccccucc

SEQ ID NO: 100482 - RNA, 32 nt, Human
ccaugcccccacccuccccucacacacaaauu

SEQ ID NO: 100483 - RNA, 32 nt, Human
ccaugcccccuucgcuccuccucucaucauuu

SEQ ID NO: 100484 - RNA, 32 nt, Human
ccaugccccugcccuucgaccucaucuacacc

SEQ ID NO: 100485 - RNA, 32 nt, Human
ccaugccccuggcugcucuuauggagccgaga

SEQ ID NO: 100486 - RNA, 32 nt, Human
ccaugccccuuccuuccuucuccugggacugg

SEQ ID NO: 100487 - RNA, 32 nt, Human
ccaugcccgcugucccagcuccuugagacugg

SEQ ID NO: 100488 - RNA, 32 nt, Human
ccaugcccggccccacucacaccaaccuguga

SEQ ID NO: 100489 - RNA, 32 nt, Human
ccaugcccggcuaauuuaguuguauuuuuagu

SEQ ID NO: 100490 - RNA, 27 nt, Human
ccaugcccuacaacuucugccugccca

SEQ ID NO: 100491 - RNA, 32 nt, Human
ccaugcccucccccaacagucccucagcuuca

SEQ ID NO: 100492 - RNA, 32 nt, Human
ccaugcccugcacagcccgccugagguuugag

SEQ ID NO: 100493 - RNA, 32 nt, Human
ccaugcccuguaucuuucaggaccuguuuuag

SEQ ID NO: 100494 - RNA, 21 nt, Human
ccaugcccuuuucucaggaua

SEQ ID NO: 100495 - RNA, 32 nt, Human
ccaugccggcccgggugguccaugccugcggg

SEQ ID NO: 100496 - RNA, 32 nt, Human
ccaugccuaccaccaucaucacaucccccagc

SEQ ID NO: 100497 - RNA, 32 nt, Human
ccaugccuagaagccagaacaacuccauguua

SEQ ID NO: 100498 - RNA, 32 nt, Human
ccaugccuagaugaucaguccucugccacaua

SEQ ID NO: 100499 - RNA, 32 nt, Human
ccaugccuauaaucccagcacuuugggaggcu

SEQ ID NO: 100500 - RNA, 32 nt, Human
ccaugccuauaaucccggcuacucgggaggcu

SEQ ID NO: 100501 - RNA, 22 nt, Human
ccaugccucugcaggcauucca

SEQ ID NO: 100502 - RNA, 32 nt, Human
ccaugccucuguccagccaccugcugcccgcc

SEQ ID NO: 100503 - RNA, 32 nt, Human
ccaugccucuugaagcuuuuucugccuccuga

SEQ ID NO: 100504 - RNA, 32 nt, Human
ccaugccugcaaccuugcauccaucugggcua

SEQ ID NO: 100505 - RNA, 32 nt, Human
ccaugccugcagcaaugcucaugucuugagga

SEQ ID NO: 100506 - RNA, 32 nt, Human
ccaugccuggcugcagccagaggggccucagg

SEQ ID NO: 100507 - RNA, 27 nt, Human
ccaugccuggcuggcccugggggcugc

SEQ ID NO: 100508 - RNA, 32 nt, Human
ccaugccuggugacccaccauggacauacugg

SEQ ID NO: 100509 - RNA, 32 nt, Human
ccaugccuguaaucccagcacuuugggaggcu

SEQ ID NO: 100510 - RNA, 32 nt, Human
ccaugccuguaaucccagcacuuugggaggug

SEQ ID NO: 100511 - RNA, 32 nt, Human
ccaugccuguagucccagcuacucaggaggcu

SEQ ID NO: 100512 - RNA, 32 nt, Human
ccaugccuguagucccagcuguucgagaggcu

SEQ ID NO: 100513 - RNA, 27 nt, Human
ccaugccugugucagggacaggcacag

SEQ ID NO: 100514 - RNA, 32 nt, Human
ccaugccuguuaucccagcacuuggggaggcu

SEQ ID NO: 100515 - RNA, 32 nt, Human
ccaugccuguucuccuuccuugcuauggaauu

SEQ ID NO: 100516 - RNA, 32 nt, Human
ccaugccuucagaguuaggagugagaaugauc

SEQ ID NO: 100517 - RNA, 32 nt, Human
ccaugccuucauuccuacuuucugaaucaaca

SEQ ID NO: 100518 - RNA, 32 nt, Human
ccaugccuuccuggucccucugugcuucucuc

SEQ ID NO: 100519 - RNA, 32 nt, Human
ccaugccuucucucucccugcaaagaaaaauc

SEQ ID NO: 100520 - RNA, 32 nt, Human
ccaugccuuggugcugugccucaggcuccuuc

SEQ ID NO: 100521 - RNA, 27 nt, Human
ccaugcgacuguugccgugugcagcag

SEQ ID NO: 100522 - RNA, 32 nt, Human
ccaugcgagccagcgucucccuucucuccugg

SEQ ID NO: 100523 - RNA, 32 nt, Human
ccaugcgaguagcugggacuacagacaugcac

SEQ ID NO: 100524 - RNA, 32 nt, Human
ccaugcgcacccaggaggagcagaucaagacc

SEQ ID NO: 100525 - RNA, 21 nt, Human
ccaugcgccgccccgccgccg

SEQ ID NO: 100526 - RNA, 22 nt, Human
ccaugcgccucggggcuguaga

SEQ ID NO: 100527 - RNA, 32 nt, Human
ccaugcgcugcguuccuccuccagaucgaccc

SEQ ID NO: 100528 - RNA, 32 nt, Human
ccaugcggagccaagauggggaauggaacuga

SEQ ID NO: 100529 - RNA, 32 nt, Human
ccaugcggccagcccaggucugcaugcugagc

SEQ ID NO: 100530 - RNA, 32 nt, Human
ccaugcguaguggugcaugccuguaaucccag

SEQ ID NO: 100531 - RNA, 32 nt, Human
ccaugcguccgccugccugccugcgcuuccau

SEQ ID NO: 100532 - RNA, 32 nt, Human
ccaugcgugguggcucaggccuguaaucccag

SEQ ID NO: 100533 - RNA, 32 nt, Human
ccaugcuaaccuguaaucccagcuacuuggga

SEQ ID NO: 100534 - RNA, 32 nt, Human
ccaugcuacuaccaccaccaccaccaccccuu

SEQ ID NO: 100535 - RNA, 32 nt, Human
ccaugcuaggguccccaaagcacuggggcagg

SEQ ID NO: 100536 - RNA, 20 nt, Human
ccaugcucaaagugagucug

SEQ ID NO: 100537 - RNA, 32 nt, Human
ccaugcucagccuaugucaucugcacuguuga

SEQ ID NO: 100538 - RNA, 32 nt, Human
ccaugcucagcuugugagcuucuucccgggag

SEQ ID NO: 100539 - RNA, 32 nt, Human
ccaugcucaugaagccacagguccuacacccc

SEQ ID NO: 100540 - RNA, 32 nt, Human
ccaugcuccauccucccucucuuccaccuccc

SEQ ID NO: 100541 - RNA, 32 nt, Human
ccaugcuccccucugcugcccagagccccagg

SEQ ID NO: 100542 - RNA, 32 nt, Human
ccaugcuccucaccaguaaaucaagggccuga

SEQ ID NO: 100543 - RNA, 32 nt, Human
ccaugcuccucaccuguauuuuguaaucagaa

SEQ ID NO: 100544 - RNA, 32 nt, Human
ccaugcuccuuucugucagguuuaaauguagu

SEQ ID NO: 100545 - RNA, 32 nt, Human
ccaugcucuaaacugaacuugaccucaaucca

SEQ ID NO: 100546 - RNA, 32 nt, Human
ccaugcucuccucccucagccuugcuacccug

SEQ ID NO: 100547 - RNA, 32 nt, Human
ccaugcucucuggccuucugaggagugggcag

SEQ ID NO: 100548 - RNA, 32 nt, Human
ccaugcucugcccccugucucaugcacgagug

SEQ ID NO: 100549 - RNA, 32 nt, Human
ccaugcucugcccucagaccuggccaggugau

SEQ ID NO: 100550 - RNA, 32 nt, Human
ccaugcucugcugccucuaauucacagaaugc

SEQ ID NO: 100551 - RNA, 32 nt, Human
ccaugcucugcugucuccuggugaucauuucc

SEQ ID NO: 100552 - RNA, 32 nt, Human
ccaugcucuguguccaggcuugcuccuggcag

SEQ ID NO: 100553 - RNA, 32 nt, Human
ccaugcucuucuguacugucaugcccgucucu

SEQ ID NO: 100554 - RNA, 32 nt, Human
ccaugcugacugccugaaucucugcugaggcu

SEQ ID NO: 100555 - RNA, 32 nt, Human
ccaugcugagcauccuggaggaccuggagagc

SEQ ID NO: 100556 - RNA, 32 nt, Human
ccaugcugagggaaggggagcaguugccaaua

SEQ ID NO: 100557 - RNA, 32 nt, Human
ccaugcugcaaucacuguccugggcuuauggu

SEQ ID NO: 100558 - RNA, 23 nt, Human
ccaugcugcccuggcuugccagg

SEQ ID NO: 100559 - RNA, 32 nt, Human
ccaugcugcugggcagggaacugaggccagac

SEQ ID NO: 100560 - RNA, 27 nt, Human
ccaugcugcugugcccugagguuccca

SEQ ID NO: 100561 - RNA, 32 nt, Human
ccaugcuggaaggggaaaugaaggacaaaaau

SEQ ID NO: 100562 - RNA, 32 nt, Human
ccaugcuggaaguagccugaggcccucaccag

SEQ ID NO: 100563 - RNA, 32 nt, Human
ccaugcuggacuggcccuccagcagugcccac

SEQ ID NO: 100564 - RNA, 19 nt, Human
ccaugcuggagugcagugg

SEQ ID NO: 100565 - RNA, 32 nt, Human
ccaugcuggagugcaguggcaugaucucggcu

SEQ ID NO: 100566 - RNA, 22 nt, Human
ccaugcuggccagacuggucuc

SEQ ID NO: 100567 - RNA, 23 nt, Human
ccaugcuggccaggcuggucuca

SEQ ID NO: 100568 - RNA, 32 nt, Human
ccaugcugggagaggcggccagagccuggggc

SEQ ID NO: 100569 - RNA, 27 nt, Human
ccaugcugggcucucccugccuucugu

SEQ ID NO: 100570 - RNA, 32 nt, Human
ccaugcugggcucugugcccucugugucugug

SEQ ID NO: 100571 - RNA, 32 nt, Human
ccaugcugggcuggaguggcuguggggugucc

SEQ ID NO: 100572 - RNA, 22 nt, Human
ccaugcugggggugacgggagg

SEQ ID NO: 100573 - RNA, 32 nt, Human
ccaugcuggucaggauggucuccaacuccuga

SEQ ID NO: 100574 - RNA, 32 nt, Human
ccaugcugucaacuccugccuccaccuggggu

SEQ ID NO: 100575 - RNA, 32 nt, Human
ccaugcugucacccucaggaagcaucaugaca

SEQ ID NO: 100576 - RNA, 20 nt, Human
ccaugcuguccauccauucu

SEQ ID NO: 100577 - RNA, 32 nt, Human
ccaugcuguccccauucucuccuuucaccauc

SEQ ID NO: 100578 - RNA, 32 nt, Human
ccaugcugugcagcacuucuguccucagucaa

SEQ ID NO: 100579 - RNA, 32 nt, Human
ccaugcuguggacagugaggggaggagguccu

SEQ ID NO: 100580 - RNA, 32 nt, Human
ccaugcuucccccgccaaccagcuccugcugc

SEQ ID NO: 100581 - RNA, 32 nt, Human
ccaugcuucuaggaacugccugguuuucgagc

SEQ ID NO: 100582 - RNA, 32 nt, Human
ccaugcuucucaucuugugaaauggccaggau

SEQ ID NO: 100583 - RNA, 32 nt, Human
ccaugcuugacuaagguaccugguuuuagcca

SEQ ID NO: 100584 - RNA, 32 nt, Human
ccaugcuuguagucccagcuacucaggaggcu

SEQ ID NO: 100585 - RNA, 32 nt, Human
ccaugcuugugagaucuucccagccaagugga

SEQ ID NO: 100586 - RNA, 32 nt, Human
ccaugcuuguuuucucauucacuggcauggau

SEQ ID NO: 100587 - RNA, 32 nt, Human
ccaugcuuuaucccauagccugccuccugcag

SEQ ID NO: 100588 - RNA, 32 nt, Human
ccaugcuuucgcauuuggaauguggcucugcc

SEQ ID NO: 100589 - RNA, 32 nt, Human
ccaugcuuucuuuuccucuguugugguuuuca

SEQ ID NO: 100590 - RNA, 32 nt, Human
ccaugcuuugaaggcaggcuuuagcucccaga

SEQ ID NO: 100591 - RNA, 32 nt, Human
ccaugcuuugcucucaaggcuuggagagguau

SEQ ID NO: 100592 - RNA, 32 nt, Human
ccaugcuuugggcaugagaugcucagauggug

SEQ ID NO: 100593 - RNA, 22 nt, Human
ccauggaacuaaguacaguggc

SEQ ID NO: 100594 - RNA, 32 nt, Human
ccauggaagauggaugggcaagaguguacuuc

SEQ ID NO: 100595 - RNA, 32 nt, Human
ccauggaaucuucuccugugauaucugacucg

SEQ ID NO: 100596 - RNA, 31 nt, Human
ccauggaaugcugaaagaugggugacugggg

SEQ ID NO: 100597 - RNA, 32 nt, Human
ccauggaaugcuugaaaaaugugcaaaacagc

SEQ ID NO: 100598 - RNA, 32 nt, Human
ccauggaauucccuccugagugccccacuucu

SEQ ID NO: 100599 - RNA, 32 nt, Human
ccauggacacuucacccacccuccaggacccc

SEQ ID NO: 100600 - RNA, 32 nt, Human
ccauggacagaagaaggcagcagguggcagaa

SEQ ID NO: 100601 - RNA, 27 nt, Human
ccauggacaugcuucauccaucaucgg

SEQ ID NO: 100602 - RNA, 32 nt, Human
ccauggaccccaccuccucugcagccucacgg

SEQ ID NO: 100603 - RNA, 27 nt, Human
ccauggaccgcccagaugaggggccuc

SEQ ID NO: 100604 - RNA, 27 nt, Human
ccauggaccugcgcccugagcugccca

SEQ ID NO: 100605 - RNA, 32 nt, Human
ccauggacucacuuuuguaacaaacuccuacc

SEQ ID NO: 100606 - RNA, 27 nt, Human
ccauggacucggacgccagccuggugu

SEQ ID NO: 100607 - RNA, 32 nt, Human
ccauggacuggacaccuucacuccagcuggac

SEQ ID NO: 100608 - RNA, 32 nt, Human
ccauggagaacagcagcucacgauugcuuuga

SEQ ID NO: 100609 - RNA, 32 nt, Human
ccauggagacagcaacaguccccagccgcggg

SEQ ID NO: 100610 - RNA, 27 nt, Human
ccauggagaccagaccaacagcucuga

SEQ ID NO: 100611 - RNA, 30 nt, Human
ccauggagagcccagagggcacagguggcu

SEQ ID NO: 100612 - RNA, 32 nt, Human
ccauggagaggaacucuucugcacucugagcu

SEQ ID NO: 100613 - RNA, 32 nt, Human
ccauggagagugagaagcugccagagaagcag

SEQ ID NO: 100614 - RNA, 32 nt, Human
ccauggagcacugcaggcucuuuccccagacc

SEQ ID NO: 100615 - RNA, 32 nt, Human
ccauggagcagcaggcccagaggcccucuccc

SEQ ID NO: 100616 - RNA, 20 nt, Human
ccauggagccgccgcugccg

SEQ ID NO: 100617 - RNA, 32 nt, Human
ccauggagccucaggugcucccccucucaccu

SEQ ID NO: 100618 - RNA, 32 nt, Human
ccauggagccucauuuuguaggccaguugugu

SEQ ID NO: 100619 - RNA, 32 nt, Human
ccauggagcugaugaggccgagugucaggaag

SEQ ID NO: 100620 - RNA, 32 nt, Human
ccauggagcuugugggcaggaggcuggggaug

SEQ ID NO: 100621 - RNA, 32 nt, Human
ccauggaggaaggcucuguuccacauauauuu

SEQ ID NO: 100622 - RNA, 27 nt, Human
ccauggaggaggaggagggggcggugg

SEQ ID NO: 100623 - RNA, 32 nt, Human
ccauggaggcaggcucccccugccuuugaaau

SEQ ID NO: 100624 - RNA, 32 nt, Human
ccauggagggcugaggagcacuuuggcuugga

SEQ ID NO: 100625 - RNA, 32 nt, Human
ccauggaggggacuguguuucuuuaaggaugc

SEQ ID NO: 100626 - RNA, 32 nt, Human
ccauggaggucugggagagagagcagagggcg

SEQ ID NO: 100627 - RNA, 24 nt, Human
ccauggaguuugucaucuguaaua

SEQ ID NO: 100628 - RNA, 20 nt, Human
ccauggauacucgcccgugg

SEQ ID NO: 100629 - RNA, 27 nt, Human
ccauggauaggagaaguaugggugaaa

SEQ ID NO: 100630 - RNA, 32 nt, Human
ccauggauggaccagccuuccaugcagcaggg

SEQ ID NO: 100631 - RNA, 32 nt, Human
ccauggauggaugaauggacaaacaaaaugcg

SEQ ID NO: 100632 - RNA, 32 nt, Human
ccauggauguuacuggcuacuugagaaaaagg

SEQ ID NO: 100633 - RNA, 32 nt, Human
ccauggcaaccagcaucagcuuuuccugagau

SEQ ID NO: 100634 - RNA, 32 nt, Human
ccauggcacaggaucugaguugcagcucugca

SEQ ID NO: 100635 - RNA, 32 nt, Human
ccauggcacccagcuaauuuuguauuuuuagu

SEQ ID NO: 100636 - RNA, 32 nt, Human
ccauggcacccaggaucuggucucgguggucc

SEQ ID NO: 100637 - RNA, 26 nt, Human
ccauggcaccucuccacgggguccac

SEQ ID NO: 100638 - RNA, 32 nt, Human
ccauggcaccuugcuccgauagccccaggaaa

SEQ ID NO: 100639 - RNA, 32 nt, Human
ccauggcacucacuccagccugggcaacaaga

SEQ ID NO: 100640 - RNA, 32 nt, Human
ccauggcagacaccccaugucuuuguuacccc

SEQ ID NO: 100641 - RNA, 32 nt, Human
ccauggcagagggagagccuguggacaacagu

SEQ ID NO: 100642 - RNA, 32 nt, Human
ccauggcagccuugucuccacccaugacucac

SEQ ID NO: 100643 - RNA, 24 nt, Human
ccauggcagcucacacuuguaauc

SEQ ID NO: 100644 - RNA, 18 nt, Human
ccauggcagcugcaguga

SEQ ID NO: 100645 - RNA, 32 nt, Human
ccauggcaggaaauauccaagcuguugaaacu

SEQ ID NO: 100646 - RNA, 32 nt, Human
ccauggcaggccugccagagcuuggcugggga

SEQ ID NO: 100647 - RNA, 32 nt, Human
ccauggcagggugcuaguggugggcagaaugc

SEQ ID NO: 100648 - RNA, 32 nt, Human
ccauggcagguggaucaccugaggucgggauu

SEQ ID NO: 100649 - RNA, 32 nt, Human
ccauggcauggguggaauuagaguggaauaag

SEQ ID NO: 100650 - RNA, 32 nt, Human
ccauggcauugcucagcaacuacuucucccuu

SEQ ID NO: 100651 - RNA, 32 nt, Human
ccauggccaccaagcacugcaugugggacagg

SEQ ID NO: 100652 - RNA, 32 nt, Human
ccauggccagacaccccagucccuucaccacc

SEQ ID NO: 100653 - RNA, 32 nt, Human
ccauggccagcaggaagccacugaugagggga

SEQ ID NO: 100654 - RNA, 27 nt, Human
ccauggccagccaguucugccucccug

SEQ ID NO: 100655 - RNA, 27 nt, Human
ccauggccaucgcucaccuggccacgg

SEQ ID NO: 100656 - RNA, 18 nt, Human
ccauggccauggcagcgg

SEQ ID NO: 100657 - RNA, 32 nt, Human
ccauggcccacccaggccuggagcugggaugc

SEQ ID NO: 100658 - RNA, 18 nt, Human
ccauggcccaucuugguc

SEQ ID NO: 100659 - RNA, 32 nt, Human
ccauggccccucaugaagucuuccuguaagcu

SEQ ID NO: 100660 - RNA, 27 nt, Human
ccauggcccgggcuuugguccaguucu

SEQ ID NO: 100661 - RNA, 32 nt, Human
ccauggcccugagcgaguggagucugccaccc

SEQ ID NO: 100662 - RNA, 27 nt, Human
ccauggcccugccucugcugccgggca

SEQ ID NO: 100663 - RNA, 17 nt, Human
ccauggccgccgugccg

SEQ ID NO: 100664 - RNA, 32 nt, Human
ccauggccuaccaucccuucugacccuggcuu

SEQ ID NO: 100665 - RNA, 32 nt, Human
ccauggccuccaggcaggccgggcuggaccgc

SEQ ID NO: 100666 - RNA, 20 nt, Human
ccauggccugagcagggaga

SEQ ID NO: 100667 - RNA, 27 nt, Human
ccauggccugccugagccccucgcagc

SEQ ID NO: 100668 - RNA, 32 nt, Human
ccauggccugucacuacagccuagggauuuua

SEQ ID NO: 100669 - RNA, 27 nt, Human
ccauggcggaggcggcggcugcagcgg

SEQ ID NO: 100670 - RNA, 32 nt, Human
ccauggcgggcagaucaccugaggucaggagu

SEQ ID NO: 100671 - RNA, 32 nt, Human
ccauggcgggcugaguccugcccaugcccugg

SEQ ID NO: 100672 - RNA, 27 nt, Human
ccauggcuagcccagccgccuccucgg

SEQ ID NO: 100673 - RNA, 32 nt, Human
ccauggcuauccauccacccaccaagacccug

SEQ ID NO: 100674 - RNA, 32 nt, Human
ccauggcucauuugacaccuuuuuaaauauca

SEQ ID NO: 100675 - RNA, 32 nt, Human
ccauggcucccucuucccagaaucugcgggga

SEQ ID NO: 100676 - RNA, 32 nt, Human
ccauggcuccuuccuguacccguugcuggcag

SEQ ID NO: 100677 - RNA, 32 nt, Human
ccauggcucuguagacgccagcuccucagcac

SEQ ID NO: 100678 - RNA, 32 nt, Human
ccauggcucuuagccagaaaugucuugccucu

SEQ ID NO: 100679 - RNA, 32 nt, Human
ccauggcugagaggugugccucagcuuaaccc

SEQ ID NO: 100680 - RNA, 32 nt, Human
ccauggcugccuggcucucccgggaguggcac

SEQ ID NO: 100681 - RNA, 32 nt, Human
ccauggcuggagcuuugggaacagucuguccu

SEQ ID NO: 100682 - RNA, 32 nt, Human
ccauggcuggcaggccagagccccgugcugug

SEQ ID NO: 100683 - RNA, 32 nt, Human
ccauggcuggccaggauccugcgcugagcacg

SEQ ID NO: 100684 - RNA, 32 nt, Human
ccauggcugugguucagagagggugggcuggc

SEQ ID NO: 100685 - RNA, 32 nt, Human
ccauggcuuccuccucccuccugccgacuccu

SEQ ID NO: 100686 - RNA, 32 nt, Human
ccaugggaaagcugcaaccuuucuguuuuauu

SEQ ID NO: 100687 - RNA, 32 nt, Human
ccaugggaacaggagcucgaggcugcauccug

SEQ ID NO: 100688 - RNA, 32 nt, Human
ccaugggaaguuaggucacagucuuauaaaca

SEQ ID NO: 100689 - RNA, 32 nt, Human
ccaugggagagggcaggacaggggcugggcga

SEQ ID NO: 100690 - RNA, 32 nt, Human
ccaugggagcugguuagaaaugcagaauccua

SEQ ID NO: 100691 - RNA, 21 nt, Human
ccaugggaggagcagagccac

SEQ ID NO: 100692 - RNA, 32 nt, Human
ccaugggaggagcucuagggaggcugguggaa

SEQ ID NO: 100693 - RNA, 32 nt, Human
ccaugggaggcugaggcaggagaaucaguuga

SEQ ID NO: 100694 - RNA, 32 nt, Human
ccaugggauguuccugaugcagguguguauaa

SEQ ID NO: 100695 - RNA, 32 nt, Human
ccaugggcacaaggcgaagcugccugggugug

SEQ ID NO: 100696 - RNA, 32 nt, Human
ccaugggcacugaaggacugaauugguaggua

SEQ ID NO: 100697 - RNA, 32 nt, Human
ccaugggcagagaagaaaaugaccaggagugu

SEQ ID NO: 100698 - RNA, 32 nt, Human
ccaugggcaggaggccuuccugccaggccauc

SEQ ID NO: 100699 - RNA, 27 nt, Human
ccaugggcccaggaguucugcugcucc

SEQ ID NO: 100700 - RNA, 32 nt, Human
ccaugggcccgucugccggcucugccugugcu

SEQ ID NO: 100701 - RNA, 32 nt, Human
ccaugggccugccuccccagugaccugcgaaa

SEQ ID NO: 100702 - RNA, 27 nt, Human
ccaugggcgcuuccagcuccuccgcgc

SEQ ID NO: 100703 - RNA, 32 nt, Human
ccaugggcguccacaccugcugcuccagacaa

SEQ ID NO: 100704 - RNA, 32 nt, Human
ccaugggcucaaccucacccuccauccuuauu

SEQ ID NO: 100705 - RNA, 32 nt, Human
ccaugggcuccauuuggcaccugcugagccac

SEQ ID NO: 100706 - RNA, 24 nt, Human
ccaugggcugagcaggcugagcac

SEQ ID NO: 100707 - RNA, 27 nt, Human
ccaugggcugggaccugacggugaaga

SEQ ID NO: 100708 - RNA, 32 nt, Human
ccaugggcuucuugagacaccugcugaccucu

SEQ ID NO: 100709 - RNA, 32 nt, Human
ccaugggcuuucauuucugucacauuucauuu

SEQ ID NO: 100710 - RNA, 32 nt, Human
ccauggggaacuucuuccuuccugauguggaa

SEQ ID NO: 100711 - RNA, 32 nt, Human
ccauggggagcacuggauugcuuucccauuau

SEQ ID NO: 100712 - RNA, 32 nt, Human
ccauggggagccagggcucuggcggggugccc

SEQ ID NO: 100713 - RNA, 32 nt, Human
ccauggggccccuguccuccagccugaccagc

SEQ ID NO: 100714 - RNA, 19 nt, Human
ccauggggcccgcugggaa

SEQ ID NO: 100715 - RNA, 22 nt, Human
ccauggggcucuguuccccagg

SEQ ID NO: 100716 - RNA, 32 nt, Human
ccaugggggaaagagcauccggagugaagggg

SEQ ID NO: 100717 - RNA, 24 nt, Human
ccauggggguugaaguaugacaua

SEQ ID NO: 100718 - RNA, 32 nt, Human
ccaugggguccaggaagcagguguugcccagg

SEQ ID NO: 100719 - RNA, 27 nt, Human
ccauggggucgcgcagcucccacgccg

SEQ ID NO: 100720 - RNA, 32 nt, Human
ccauggguagacccucccccuggagggaagca

SEQ ID NO: 100721 - RNA, 32 nt, Human
ccauggguccggcagagggcagugaccggcac

SEQ ID NO: 100722 - RNA, 32 nt, Human
ccauggguccuuagcccugccucccaggaacc

SEQ ID NO: 100723 - RNA, 32 nt, Human
ccaugggugaacaagacacagccagacaaugu

SEQ ID NO: 100724 - RNA, 27 nt, Human
ccaugggugacuggggcuuccuggaga

SEQ ID NO: 100725 - RNA, 23 nt, Human
ccaugggugggggaaccuguguu

SEQ ID NO: 100726 - RNA, 24 nt, Human
ccaugggugggggcuguguguuag

SEQ ID NO: 100727 - RNA, 32 nt, Human
ccaugggugggucuaacuggcuuuuguggaga

SEQ ID NO: 100728 - RNA, 32 nt, Human
ccauggguucucuccuuccucugaacuucuuu

SEQ ID NO: 100729 - RNA, 32 nt, Human
ccaugguaccuucauacccaucugugggacaa

SEQ ID NO: 100730 - RNA, 32 nt, Human
ccaugguacugaugcuugcuggauuuagggag

SEQ ID NO: 100731 - RNA, 32 nt, Human
ccaugguacuucucaaacuuugugaaaaccug

SEQ ID NO: 100732 - RNA, 32 nt, Human
ccaugguaguugcugcucaugguucugucugu

SEQ ID NO: 100733 - RNA, 32 nt, Human
ccaugguauguaguggagcaucaggguaggcu

SEQ ID NO: 100734 - RNA, 32 nt, Human
ccauggucaaauggacagaaaaggccaguguu

SEQ ID NO: 100735 - RNA, 32 nt, Human
ccauggucacccuggacaaggagguaaccacc

SEQ ID NO: 100736 - RNA, 31 nt, Human
ccauggucacucacggagagggauggaggag

SEQ ID NO: 100737 - RNA, 32 nt, Human
ccauggucagggagguggcaggaggugcaaag

SEQ ID NO: 100738 - RNA, 32 nt, Human
ccauggucaggguuguuggaacaucugaccug

SEQ ID NO: 100739 - RNA, 32 nt, Human
ccauggucaugucauucugaggucacauaaca

SEQ ID NO: 100740 - RNA, 32 nt, Human
ccaugguccaaccuugaaggcuuaucaggagg

SEQ ID NO: 100741 - RNA, 32 nt, Human
ccauggucccccagcgugcaccaccuggcccg

SEQ ID NO: 100742 - RNA, 32 nt, Human
ccauggucccucacccugcccugccgacgagc

SEQ ID NO: 100743 - RNA, 32 nt, Human
ccaugguccucacuggccucagucucccugac

SEQ ID NO: 100744 - RNA, 32 nt, Human
ccaugguccugcucugggucagcugucaggga

SEQ ID NO: 100745 - RNA, 32 nt, Human
ccauggucuacgcacggcaucuggcugcucug

SEQ ID NO: 100746 - RNA, 32 nt, Human
ccauggucucccggcuggcaauguggugaagc

SEQ ID NO: 100747 - RNA, 32 nt, Human
ccauggucuggggcuugaggaagaugaguuug

SEQ ID NO: 100748 - RNA, 27 nt, Human
ccauggucuucacucaggccccggcug

SEQ ID NO: 100749 - RNA, 21 nt, Human
ccauggucuuucacccagcca

SEQ ID NO: 100750 - RNA, 32 nt, Human
ccauggugaaagaucacggggccaggccugca

SEQ ID NO: 100751 - RNA, 32 nt, Human
ccauggugacacacagcagcacugcagauagc

SEQ ID NO: 100752 - RNA, 21 nt, Human
ccauggugcacaccuguaguc

SEQ ID NO: 100753 - RNA, 32 nt, Human
ccauggugcaggcugcucagcugggccucaga

SEQ ID NO: 100754 - RNA, 24 nt, Human
ccaugguggcaggugcuuguaauc

SEQ ID NO: 100755 - RNA, 21 nt, Human
ccaugguggccgcagcuaauc

SEQ ID NO: 100756 - RNA, 24 nt, Human
ccaugguggcgggcgccuguaauc

SEQ ID NO: 100757 - RNA, 24 nt, Human
ccaugguggcucauaccuguacuc

SEQ ID NO: 100758 - RNA, 32 nt, Human
ccaugguggugagggacucaggagaauuguag

SEQ ID NO: 100759 - RNA, 32 nt, Human
ccauggugguucagaauagaugagcauagcau

SEQ ID NO: 100760 - RNA, 32 nt, Human
ccauggugucagacauccggaaagaagacggg

SEQ ID NO: 100761 - RNA, 32 nt, Human
ccaugguucugccucuguuuuacauagaaugu

SEQ ID NO: 100762 - RNA, 32 nt, Human
ccaugguugacugaggagucgggugaggccac

SEQ ID NO: 100763 - RNA, 32 nt, Human
ccaugguugccucaucagcaggaaggugcccu

SEQ ID NO: 100764 - RNA, 32 nt, Human
ccaugguuucagagggugcaagccccaaaccu

SEQ ID NO: 100765 - RNA, 32 nt, Human
ccauguaaaguagguggcagggcagagauguc

SEQ ID NO: 100766 - RNA, 32 nt, Human
ccauguaaguggcaagcagggcuggucucccu

SEQ ID NO: 100767 - RNA, 32 nt, Human
ccauguaauagggagaguugaacaugaauauu

SEQ ID NO: 100768 - RNA, 32 nt, Human
ccauguaccagcugaucgcagagcuggacugg

SEQ ID NO: 100769 - RNA, 32 nt, Human
ccauguaccuucugaaccaccugaaagguuga

SEQ ID NO: 100770 - RNA, 32 nt, Human
ccauguacugcacugcccuggucgaaugcucg

SEQ ID NO: 100771 - RNA, 32 nt, Human
ccauguacuuucccuguguacccuccauguac

SEQ ID NO: 100772 - RNA, 32 nt, Human
ccauguagacaagcccuggucaucucagcagc

SEQ ID NO: 100773 - RNA, 32 nt, Human
ccauguagcccaggcccgggggccaguccuca

SEQ ID NO: 100774 - RNA, 30 nt, Human
ccauguagccucuccaugaacugcagaagg

SEQ ID NO: 100775 - RNA, 32 nt, Human
ccauguagguguugagcuccugguuuucugug

SEQ ID NO: 100776 - RNA, 31 nt, Human
ccauguagguucucugggcuuuaguuuucug

SEQ ID NO: 100777 - RNA, 32 nt, Human
ccauguauccguaguacuugcugucuucauuu

SEQ ID NO: 100778 - RNA, 32 nt, Human
ccauguaucucaguaccccauggagcugggcu

SEQ ID NO: 100779 - RNA, 32 nt, Human
ccauguaugaggagggggaaauuuguauauua

SEQ ID NO: 100780 - RNA, 32 nt, Human
ccauguauucuaggccagguaggcaacacaga

SEQ ID NO: 100781 - RNA, 20 nt, Human
ccaugucaaggcugcaguga

SEQ ID NO: 100782 - RNA, 32 nt, Human
ccaugucaaggguucaagauuguuccugcuuu

SEQ ID NO: 100783 - RNA, 32 nt, Human
ccaugucacacggguauccagagcaaggcugg

SEQ ID NO: 100784 - RNA, 31 nt, Human
ccaugucacagcugugaagaucuggcacaag

SEQ ID NO: 100785 - RNA, 32 nt, Human
ccaugucacagcugugaagaucuggcacaaga

SEQ ID NO: 100786 - RNA, 32 nt, Human
ccaugucaccugccaaaguguucuugcugagg

SEQ ID NO: 100787 - RNA, 32 nt, Human
ccaugucacuacaagggguggggaagaaguua

SEQ ID NO: 100788 - RNA, 32 nt, Human
ccaugucacugucccugggccacccagugaaa

SEQ ID NO: 100789 - RNA, 32 nt, Human
ccaugucacuuuugggccuccuucccaugccu

SEQ ID NO: 100790 - RNA, 32 nt, Human
ccaugucagcaaccgcacucaucagaccaugc

SEQ ID NO: 100791 - RNA, 32 nt, Human
ccaugucagcaccacacacugcagcucuccaa

SEQ ID NO: 100792 - RNA, 32 nt, Human
ccaugucagguacugagcaaggccccagaucc

SEQ ID NO: 100793 - RNA, 32 nt, Human
ccauguccaagaggcuguagaaaggggagaau

SEQ ID NO: 100794 - RNA, 32 nt, Human
ccauguccaaggccuggaaacaugcuuggcuc

SEQ ID NO: 100795 - RNA, 27 nt, Human
ccauguccaagugcugugcucagucuc

SEQ ID NO: 100796 - RNA, 32 nt, Human
ccauguccacagugggcuccgaaaguugucuc

SEQ ID NO: 100797 - RNA, 32 nt, Human
ccauguccaguaaacaauuuagagcagguccu

SEQ ID NO: 100798 - RNA, 32 nt, Human
ccauguccagugcccugggucagggcuguggg

SEQ ID NO: 100799 - RNA, 19 nt, Human
ccauguccauccagcccuu

SEQ ID NO: 100800 - RNA, 32 nt, Human
ccaugucccagccuggccuguggcugcccucc

SEQ ID NO: 100801 - RNA, 21 nt, Human
ccauguccccagagggcucac

SEQ ID NO: 100802 - RNA, 32 nt, Human
ccaugucccggguuucuuucuucgagaguaua

SEQ ID NO: 100803 - RNA, 32 nt, Human
ccaugucccuccagggggaccccacagccugg

SEQ ID NO: 100804 - RNA, 32 nt, Human
ccaugucccucgugcugucucuugccuguccc

SEQ ID NO: 100805 - RNA, 22 nt, Human
ccaugucccuuucuccucuccc

SEQ ID NO: 100806 - RNA, 32 nt, Human
ccauguccugagucugcuucagucuggagcug

SEQ ID NO: 100807 - RNA, 32 nt, Human
ccauguccugcuuuauacggugagugacacaa

SEQ ID NO: 100808 - RNA, 19 nt, Human
ccauguccuggugcgcaca

SEQ ID NO: 100809 - RNA, 32 nt, Human
ccauguccuggugugaugagcaggaucagagu

SEQ ID NO: 100810 - RNA, 32 nt, Human
ccauguccuuggaccuagaggauuguccaccu

SEQ ID NO: 100811 - RNA, 32 nt, Human
ccauguccuuucucaccaugguguggcucuug

SEQ ID NO: 100812 - RNA, 32 nt, Human
ccaugucgcuuuugggccuccuucccaugccu

SEQ ID NO: 100813 - RNA, 23 nt, Human
ccaugucggccaggcuggucuca

SEQ ID NO: 100814 - RNA, 32 nt, Human
ccaugucuacuaaaaauacaaaauuagcuggg

SEQ ID NO: 100815 - RNA, 32 nt, Human
ccaugucuagcccaucauccugcuuggagcaa

SEQ ID NO: 100816 - RNA, 32 nt, Human
ccaugucuccacugcuucuacucuggguuggg

SEQ ID NO: 100817 - RNA, 32 nt, Human
ccaugucucuacuguagcuuccaggccguuuc

SEQ ID NO: 100818 - RNA, 27 nt, Human
ccaugucugccucauccucaggcggcu

SEQ ID NO: 100819 - RNA, 32 nt, Human
ccaugucugccucauccucaggcggcuccccc

SEQ ID NO: 100820 - RNA, 32 nt, Human
ccaugucugcugaugcuaucauagcucccaac

SEQ ID NO: 100821 - RNA, 32 nt, Human
ccaugucugcuuugggggcucgaguccagcca

SEQ ID NO: 100822 - RNA, 32 nt, Human
ccaugucuuggcugggauuacaggcaugagcc

SEQ ID NO: 100823 - RNA, 32 nt, Human
ccaugucuuuauuuucucaauaaagaaauuac

SEQ ID NO: 100824 - RNA, 32 nt, Human
ccaugugaacaccaccaccagugccacacaca

SEQ ID NO: 100825 - RNA, 32 nt, Human
ccaugugacaugguuucucccuauguuacgug

SEQ ID NO: 100826 - RNA, 32 nt, Human
ccaugugacuccccauccucccaugagggguc

SEQ ID NO: 100827 - RNA, 32 nt, Human
ccaugugacucuggcuuggccuaucuccuagg

SEQ ID NO: 100828 - RNA, 19 nt, Human
ccaugugagaaggauccac

SEQ ID NO: 100829 - RNA, 32 nt, Human
ccaugugaugaagcagagaugcggccucgucg

SEQ ID NO: 100830 - RNA, 32 nt, Human
ccaugugcaagucugugucuugucaguccaag

SEQ ID NO: 100831 - RNA, 18 nt, Human
ccaugugcacuccauccu

SEQ ID NO: 100832 - RNA, 32 nt, Human
ccaugugcagaagaugaaaaccggcucccuug

SEQ ID NO: 100833 - RNA, 32 nt, Human
ccaugugcagccaccaguccauugggcaggca

SEQ ID NO: 100834 - RNA, 32 nt, Human
ccaugugcagcccaggcccagugggggccaga

SEQ ID NO: 100835 - RNA, 32 nt, Human
ccaugugcaggugagaaguugggugaaaggac

SEQ ID NO: 100836 - RNA, 32 nt, Human
ccaugugcaugcucuuagagaccuugaauggu

SEQ ID NO: 100837 - RNA, 32 nt, Human
ccaugugccaucaucccccaagagccaucauc

SEQ ID NO: 100838 - RNA, 32 nt, Human
ccaugugcccugcuccugugugcaguuggggu

SEQ ID NO: 100839 - RNA, 32 nt, Human
ccaugugcucagaauucugagaggaauugcug

SEQ ID NO: 100840 - RNA, 20 nt, Human
ccaugugcucagccuggcca

SEQ ID NO: 100841 - RNA, 27 nt, Human
ccaugugcuccgggcuccuggagcucc

SEQ ID NO: 100842 - RNA, 32 nt, Human
ccaugugcugacugagcccaccuugcaaccug

SEQ ID NO: 100843 - RNA, 32 nt, Human
ccaugugcugagccacugugcuauacugacuc

SEQ ID NO: 100844 - RNA, 32 nt, Human
ccaugugcugcauccucugcccucagugugca

SEQ ID NO: 100845 - RNA, 23 nt, Human
ccaugugcugggauuacaggcgu

SEQ ID NO: 100846 - RNA, 32 nt, Human
ccaugugcuguugcugggauguuuguauuaaa

SEQ ID NO: 100847 - RNA, 32 nt, Human
ccauguggaacugcuggagugcaguggcauga

SEQ ID NO: 100848 - RNA, 32 nt, Human
ccauguggaaggaucacaucucagguuucuug

SEQ ID NO: 100849 - RNA, 17 nt, Human
ccauguggacaagggga

SEQ ID NO: 100850 - RNA, 32 nt, Human
ccauguggacagugguggaugaugugugugcu

SEQ ID NO: 100851 - RNA, 32 nt, Human
ccauguggaggaaggcuggagcuuguuccugc

SEQ ID NO: 100852 - RNA, 19 nt, Human
ccauguggccacaauccac

SEQ ID NO: 100853 - RNA, 22 nt, Human
ccauguggccuuagcugggccc

SEQ ID NO: 100854 - RNA, 32 nt, Human
ccauguggcucuaacagccucugcaguccgug

SEQ ID NO: 100855 - RNA, 20 nt, Human
ccaugugggaacccagccuc

SEQ ID NO: 100856 - RNA, 32 nt, Human
ccaugugggacaccuccaaggcuggccuccuc

SEQ ID NO: 100857 - RNA, 32 nt, Human
ccaugugggacccccuggugauucagcaugaa

SEQ ID NO: 100858 - RNA, 32 nt, Human
ccaugugggagcagaggugugaagagaauuua

SEQ ID NO: 100859 - RNA, 21 nt, Human
ccaugugggcaaagauuugaa

SEQ ID NO: 100860 - RNA, 20 nt, Human
ccaugugggcccaaccauca

SEQ ID NO: 100861 - RNA, 32 nt, Human
ccaugugggggcccugagcgccgccccagaag

SEQ ID NO: 100862 - RNA, 32 nt, Human
ccauguggucccaggccaggcugccugggaca

SEQ ID NO: 100863 - RNA, 32 nt, Human
ccauguggugcgcugcugcagugaccaguugc

SEQ ID NO: 100864 - RNA, 32 nt, Human
ccauguguaagcauuaugcauguauguaaaaa

SEQ ID NO: 100865 - RNA, 32 nt, Human
ccauguguacauagacucauugugcuguagau

SEQ ID NO: 100866 - RNA, 32 nt, Human
ccaugugucacugaggccuggauuugagcuuc

SEQ ID NO: 100867 - RNA, 32 nt, Human
ccaugugucuggcgggggauggguggacugua

SEQ ID NO: 100868 - RNA, 32 nt, Human
ccaugugucugucagcauaaggcaaaggcaga

SEQ ID NO: 100869 - RNA, 32 nt, Human
ccaugugucuuuuccccugcugccucacuccc

SEQ ID NO: 100870 - RNA, 29 nt, Human
ccaugugugcuguguguguccaggcacgg

SEQ ID NO: 100871 - RNA, 29 nt, Human
ccaugugugcuguguguguccugccugua

SEQ ID NO: 100872 - RNA, 32 nt, Human
ccauguguggugugugugccccugagaacuuc

SEQ ID NO: 100873 - RNA, 32 nt, Human
ccauguguggugugugugccccugagaacuuu

SEQ ID NO: 100874 - RNA, 22 nt, Human
ccauguguuggggggugggggg

SEQ ID NO: 100875 - RNA, 32 nt, Human
ccauguguuuuaaaaaggcaguagccuuugca

SEQ ID NO: 100876 - RNA, 23 nt, Human
ccauguuacccagccuggucuca

SEQ ID NO: 100877 - RNA, 23 nt, Human
ccauguuacccaggauggucuca

SEQ ID NO: 100878 - RNA, 23 nt, Human
ccauguuacccaggcuggucuca

SEQ ID NO: 100879 - RNA, 32 nt, Human
ccauguuacccucccuuccucacauuguuacg

SEQ ID NO: 100880 - RNA, 22 nt, Human
ccauguuaccuaggguggucuc

SEQ ID NO: 100881 - RNA, 23 nt, Human
ccauguuagccaggauggucuca

SEQ ID NO: 100882 - RNA, 23 nt, Human
ccauguuagccaggcugaccuca

SEQ ID NO: 100883 - RNA, 23 nt, Human
ccauguuagccaggcuggucuca

SEQ ID NO: 100884 - RNA, 32 nt, Human
ccauguuaucaucuguuucucguguccgccug

SEQ ID NO: 100885 - RNA, 32 nt, Human
ccauguuauuuuauuggggucuuuggggaaug

SEQ ID NO: 100886 - RNA, 32 nt, Human
ccauguucaagcaauucuccugccucagccuc

SEQ ID NO: 100887 - RNA, 32 nt, Human
ccauguuccagaggaauucggauaccacaaac

SEQ ID NO: 100888 - RNA, 32 nt, Human
ccauguuccguuugaucuuggcaauuuaaugc

SEQ ID NO: 100889 - RNA, 32 nt, Human
ccauguuccuaagcuuccaagaagguuuugga

SEQ ID NO: 100890 - RNA, 32 nt, Human
ccauguucucucccuuggcaaaaagcuggugg

SEQ ID NO: 100891 - RNA, 23 nt, Human
ccauguugaccaggauggucuca

SEQ ID NO: 100892 - RNA, 32 nt, Human
ccauguugacccucucucagaaggucagucca

SEQ ID NO: 100893 - RNA, 32 nt, Human
ccauguugcaggcccacagcugccuacagaac

SEQ ID NO: 100894 - RNA, 23 nt, Human
ccauguugccaagcuagucuaca

SEQ ID NO: 100895 - RNA, 20 nt, Human
ccauguugcccagaauuuca

SEQ ID NO: 100896 - RNA, 23 nt, Human
ccauguugcccagccuggucuca

SEQ ID NO: 100897 - RNA, 22 nt, Human
ccauguugcccaggagggucuc

SEQ ID NO: 100898 - RNA, 22 nt, Human
ccauguugcccaggauggucuc

SEQ ID NO: 100899 - RNA, 32 nt, Human
ccauguugcccaggcuaaucucaaauuccuga

SEQ ID NO: 100900 - RNA, 23 nt, Human
ccauguugcccaggcuagccuca

SEQ ID NO: 100901 - RNA, 32 nt, Human
ccauguugcccaggcuggaagugucuauguuu

SEQ ID NO: 100902 - RNA, 22 nt, Human
ccauguugcccaggcuggucuc

SEQ ID NO: 100903 - RNA, 23 nt, Human
ccauguugcccaggcuggucuca

SEQ ID NO: 100904 - RNA, 32 nt, Human
ccauguugcccaggcuggucucaaacuuguga

SEQ ID NO: 100905 - RNA, 32 nt, Human
ccauguugcccaggcuggucugaagcugcugg

SEQ ID NO: 100906 - RNA, 23 nt, Human
ccauguugcccaggcuggucuua

SEQ ID NO: 100907 - RNA, 23 nt, Human
ccauguugcccaggcugguguca

SEQ ID NO: 100908 - RNA, 32 nt, Human
ccauguugcccaggcuggugucaaacuccugg

SEQ ID NO: 100909 - RNA, 23 nt, Human
ccauguugcccaggcugguuuca

SEQ ID NO: 100910 - RNA, 23 nt, Human
ccauguugcccagucuguucuca

SEQ ID NO: 100911 - RNA, 23 nt, Human
ccauguugccccgguugcucuca

SEQ ID NO: 100912 - RNA, 32 nt, Human
ccauguugccucgucagacucuugguggcuuu

SEQ ID NO: 100913 - RNA, 18 nt, Human
ccauguugccuguucuca

SEQ ID NO: 100914 - RNA, 32 nt, Human
ccauguugcucacaccuucauauagcagugcc

SEQ ID NO: 100915 - RNA, 20 nt, Human
ccauguugcucaggcugguc

SEQ ID NO: 100916 - RNA, 23 nt, Human
ccauguugcucaggcuggucuca

SEQ ID NO: 100917 - RNA, 32 nt, Human
ccauguugcugcaaagacaugaucucauucuu

SEQ ID NO: 100918 - RNA, 23 nt, Human
ccauguugcuuaggcuggucuca

SEQ ID NO: 100919 - RNA, 32 nt, Human
ccauguuggaaagaggaacagggcuuggauug

SEQ ID NO: 100920 - RNA, 32 nt, Human
ccauguuggaccaauaccacacugcccuaguc

SEQ ID NO: 100921 - RNA, 23 nt, Human
ccauguuggccaagauggucuca

SEQ ID NO: 100922 - RNA, 23 nt, Human
ccauguuggccaagcuggucuca

SEQ ID NO: 100923 - RNA, 23 nt, Human
ccauguuggccacacuggucuca

SEQ ID NO: 100924 - RNA, 22 nt, Human
ccauguuggccagacuggucuc

SEQ ID NO: 100925 - RNA, 23 nt, Human
ccauguuggccagacuggucuca

SEQ ID NO: 100926 - RNA, 23 nt, Human
ccauguuggccaggauggucuca

SEQ ID NO: 100927 - RNA, 23 nt, Human
ccauguuggccaggccagucuca

SEQ ID NO: 100928 - RNA, 23 nt, Human
ccauguuggccaggcuagucuca

SEQ ID NO: 100929 - RNA, 23 nt, Human
ccauguuggccaggcugaucuca

SEQ ID NO: 100930 - RNA, 23 nt, Human
ccauguuggccaggcuggucuca

SEQ ID NO: 100931 - RNA, 32 nt, Human
ccauguuggccaggcuggucuccaacuccuga

SEQ ID NO: 100932 - RNA, 32 nt, Human
ccauguuggccaggcuggucuccaacuccugc

SEQ ID NO: 100933 - RNA, 32 nt, Human
ccauguuggccaggcuggucucgaaugccugg

SEQ ID NO: 100934 - RNA, 32 nt, Human
ccauguuggccaggcuggucucgaaugucuga

SEQ ID NO: 100935 - RNA, 32 nt, Human
ccauguuggccaggcuggucugagagagaacu

SEQ ID NO: 100936 - RNA, 23 nt, Human
ccauguuggccgggcuggucuca

SEQ ID NO: 100937 - RNA, 23 nt, Human
ccauguuggcuaggcuggucuca

SEQ ID NO: 100938 - RNA, 23 nt, Human
ccauguuggucagacuagucuca

SEQ ID NO: 100939 - RNA, 23 nt, Human
ccauguuggucaggauggucuca

SEQ ID NO: 100940 - RNA, 23 nt, Human
ccauguuggucaggcuagucuca

SEQ ID NO: 100941 - RNA, 23 nt, Human
ccauguuggucaggcuggucuca

SEQ ID NO: 100942 - RNA, 23 nt, Human
ccauguuggucgggcuggucuca

SEQ ID NO: 100943 - RNA, 23 nt, Human
ccauguugguuaggcuggucuca

SEQ ID NO: 100944 - RNA, 23 nt, Human
ccauguuguacaggcuggucuca

SEQ ID NO: 100945 - RNA, 23 nt, Human
ccauguuguccaggcuggucuca

SEQ ID NO: 100946 - RNA, 32 nt, Human
ccauguuuaaaaagaaggaauuuggacaaagg

SEQ ID NO: 100947 - RNA, 31 nt, Human
ccauguuuacugcuagaaaccaaagcuuugu

SEQ ID NO: 100948 - RNA, 32 nt, Human
ccauguuucagaagcauucaggcacugccagg

SEQ ID NO: 100949 - RNA, 22 nt, Human
ccauguuuccaggaggggccau

SEQ ID NO: 100950 - RNA, 32 nt, Human
ccauguuuccugggaaacccgaaaaagguugu

SEQ ID NO: 100951 - RNA, 32 nt, Human
ccauguuugagacucagaagaaugggccuuuc

SEQ ID NO: 100952 - RNA, 32 nt, Human
ccauguuugccaggcugguccugaaugccuga

SEQ ID NO: 100953 - RNA, 32 nt, Human
ccauguuuuauuuucuuguucuugucacuauu

SEQ ID NO: 100954 - RNA, 32 nt, Human
ccauguuuugcagaaacuggagaugugaauuu

SEQ ID NO: 100955 - RNA, 32 nt, Human
ccauguuuuggaugugugauguuuauauggga

SEQ ID NO: 100956 - RNA, 22 nt, Human
ccauuaaaaauaguacauuuua

SEQ ID NO: 100957 - RNA, 32 nt, Human
ccauuaaaaauauaaaaauuagcagggugugg

SEQ ID NO: 100958 - RNA, 32 nt, Human
ccauuaaaaggcaggcuggaaggccuuccugg

SEQ ID NO: 100959 - RNA, 32 nt, Human
ccauuaaaccaggacccugauccaucaauaug

SEQ ID NO: 100960 - RNA, 32 nt, Human
ccauuaaagaugaccuacagugcuguguaccc

SEQ ID NO: 100961 - RNA, 32 nt, Human
ccauuaaagcagccaggaaggacaggcuuucc

SEQ ID NO: 100962 - RNA, 32 nt, Human
ccauuaaagcgaggcaugaagcaaagagcuga

SEQ ID NO: 100963 - RNA, 19 nt, Human
ccauuaaauggucuuggca

SEQ ID NO: 100964 - RNA, 32 nt, Human
ccauuaacugccaaucaucaccucauuugcuu

SEQ ID NO: 100965 - RNA, 32 nt, Human
ccauuaagaaacagccucugcaucaguuugua

SEQ ID NO: 100966 - RNA, 21 nt, Human
ccauuaagaacucauuacugg

SEQ ID NO: 100967 - RNA, 32 nt, Human
ccauuaauuggguggaagauugggcaagaagu

SEQ ID NO: 100968 - RNA, 32 nt, Human
ccauuacaaaggaggcuuggccagggacucca

SEQ ID NO: 100969 - RNA, 32 nt, Human
ccauuacccaaaccacucugacagucuccucc

SEQ ID NO: 100970 - RNA, 32 nt, Human
ccauuacccaggagaaaucaagugauccucaa

SEQ ID NO: 100971 - RNA, 32 nt, Human
ccauuacccuaaaaguaauaacuuugaugcuu

SEQ ID NO: 100972 - RNA, 32 nt, Human
ccauuacccuaauuuuguuauuucaagaaugc

SEQ ID NO: 100973 - RNA, 32 nt, Human
ccauuaccgcuuaccuggaauauugcaaaagc

SEQ ID NO: 100974 - RNA, 32 nt, Human
ccauuaccucuuccugucccaccccugcagag

SEQ ID NO: 100975 - RNA, 32 nt, Human
ccauuaccuucugcuuucucuuuguccacuua

SEQ ID NO: 100976 - RNA, 32 nt, Human
ccauuacggagggcugccaggcuuccaggguc

SEQ ID NO: 100977 - RNA, 32 nt, Human
ccauuacggccgggggcccacagccauggcgg

SEQ ID NO: 100978 - RNA, 32 nt, Human
ccauuacuauucuugcuacauuaguccagcuu

SEQ ID NO: 100979 - RNA, 32 nt, Human
ccauuacuauucuugcuacauuaguucagcuu

SEQ ID NO: 100980 - RNA, 20 nt, Human
ccauuacuuugccucgcugg

SEQ ID NO: 100981 - RNA, 32 nt, Human
ccauuagaaagccaaggccuagaguggugggc

SEQ ID NO: 100982 - RNA, 32 nt, Human
ccauuagaauuuaaaagacauaagacuaaauu

SEQ ID NO: 100983 - RNA, 32 nt, Human
ccauuagauggaaggcagaggauacugcgacc

SEQ ID NO: 100984 - RNA, 32 nt, Human
ccauuagccaaggauagaagcugcagugguau

SEQ ID NO: 100985 - RNA, 32 nt, Human
ccauuagucaguguuacagcuguguuggggau

SEQ ID NO: 100986 - RNA, 32 nt, Human
ccauuagugggaaaaaguuggaggaugaagga

SEQ ID NO: 100987 - RNA, 32 nt, Human
ccauuauaucacucuguaugccuuugcauacc

SEQ ID NO: 100988 - RNA, 16 nt, Human
ccauuauccucaggug

SEQ ID NO: 100989 - RNA, 32 nt, Human
ccauuauccucuguuucucugcugcaccgacc

SEQ ID NO: 100990 - RNA, 32 nt, Human
ccauuaugaguguggggaaugcucacagacug

SEQ ID NO: 100991 - RNA, 32 nt, Human
ccauuaugcacagguugaauucugaguaaaca

SEQ ID NO: 100992 - RNA, 32 nt, Human
ccauuaugccaccuccaaaguggcugcccagc

SEQ ID NO: 100993 - RNA, 29 nt, Human
ccauuaugucugugugccuggaugucugu

SEQ ID NO: 100994 - RNA, 32 nt, Human
ccauuauuacuggugcaaaaugaguugauaac

SEQ ID NO: 100995 - RNA, 32 nt, Human
ccauuauuauccacccugagccaccauaauau

SEQ ID NO: 100996 - RNA, 20 nt, Human
ccauucaaaagaccaccaau

SEQ ID NO: 100997 - RNA, 32 nt, Human
ccauucaaaauugaagggccacuggugguccu

SEQ ID NO: 100998 - RNA, 32 nt, Human
ccauucaaagcuccuucuaccugggcagagcc

SEQ ID NO: 100999 - RNA, 32 nt, Human
ccauucaaagugagcuccuaagccaugggaga

SEQ ID NO: 101000 - RNA, 18 nt, Human
ccauucaaauggcacuuu

SEQ ID NO: 101001 - RNA, 32 nt, Human
ccauucaacaggacaggcagguuagggacacc

SEQ ID NO: 101002 - RNA, 32 nt, Human
ccauucaacuccccaccuccagccgggaccca

SEQ ID NO: 101003 - RNA, 32 nt, Human
ccauucaagaacaaaaccacagaugccauaca

SEQ ID NO: 101004 - RNA, 32 nt, Human
ccauucaagaccagauauucaaguucaagcca

SEQ ID NO: 101005 - RNA, 32 nt, Human
ccauucacacacaccggcacuuucauacccug

SEQ ID NO: 101006 - RNA, 32 nt, Human
ccauucacacucaugaauccacuccagaaguc

SEQ ID NO: 101007 - RNA, 32 nt, Human
ccauucacagcauucaucaccaacugacauag

SEQ ID NO: 101008 - RNA, 24 nt, Human
ccauucaccccaaaacuuguuuua

SEQ ID NO: 101009 - RNA, 32 nt, Human
ccauucaccuaacuggcuuuuccuucaugauu

SEQ ID NO: 101010 - RNA, 32 nt, Human
ccauucacuuccuuuaucucuccagucuuaag

SEQ ID NO: 101011 - RNA, 32 nt, Human
ccauucacuuuuagaaucuuguauuuaaguaa

SEQ ID NO: 101012 - RNA, 32 nt, Human
ccauucagaguuguucucccaucucugagcaa

SEQ ID NO: 101013 - RNA, 32 nt, Human
ccauucagccuacccuguauuugccauaaacu

SEQ ID NO: 101014 - RNA, 32 nt, Human
ccauucagccucugucucacaugcuuuauaaa

SEQ ID NO: 101015 - RNA, 32 nt, Human
ccauucaggaauaaacugagaguucugagaaa

SEQ ID NO: 101016 - RNA, 32 nt, Human
ccauucaggacauaggcacaggcaaagauuuc

SEQ ID NO: 101017 - RNA, 22 nt, Human
ccauucaggccugguggcagga

SEQ ID NO: 101018 - RNA, 32 nt, Human
ccauucagugacugauguugacuccugcauua

SEQ ID NO: 101019 - RNA, 18 nt, Human
ccauucauccacccaucc

SEQ ID NO: 101020 - RNA, 32 nt, Human
ccauucaucccaggaccacaaggguagcugua

SEQ ID NO: 101021 - RNA, 32 nt, Human
ccauucaucccuugcucucuuggaucugaacu

SEQ ID NO: 101022 - RNA, 32 nt, Human
ccauucauguaggaauaaaucaagugagcagu

SEQ ID NO: 101023 - RNA, 32 nt, Human
ccauucauguguuugcuggaggucacacaauu

SEQ ID NO: 101024 - RNA, 32 nt, Human
ccauucauuagcuguuccuuuuugucuguucu

SEQ ID NO: 101025 - RNA, 32 nt, Human
ccauuccaaucuggacagucucugugccccuc

SEQ ID NO: 101026 - RNA, 32 nt, Human
ccauuccacaccauuuguuucucugucucccc

SEQ ID NO: 101027 - RNA, 32 nt, Human
ccauuccacguugccacacaaggugcacaggc

SEQ ID NO: 101028 - RNA, 32 nt, Human
ccauuccacuuucccugccuccuuccuuaaau

SEQ ID NO: 101029 - RNA, 22 nt, Human
ccauuccagagaaagugauaga

SEQ ID NO: 101030 - RNA, 32 nt, Human
ccauuccagcggagacuuauguaggagggacc

SEQ ID NO: 101031 - RNA, 32 nt, Human
ccauuccauguguucugaauucagcucaucuc

SEQ ID NO: 101032 - RNA, 32 nt, Human
ccauucccagucacuuaccaaugcuuggacau

SEQ ID NO: 101033 - RNA, 32 nt, Human
ccauucccauuuucucagccucuucucugccu

SEQ ID NO: 101034 - RNA, 17 nt, Human
ccauuccccaggugccu

SEQ ID NO: 101035 - RNA, 32 nt, Human
ccauuccccucucccagcaccuugcagacuug

SEQ ID NO: 101036 - RNA, 32 nt, Human
ccauuccccuuuucccuccugugcucuguccc

SEQ ID NO: 101037 - RNA, 32 nt, Human
ccauucccgcaucgcucccucuccugccuuug

SEQ ID NO: 101038 - RNA, 32 nt, Human
ccauucccuagcacacuggccuugccaucuug

SEQ ID NO: 101039 - RNA, 32 nt, Human
ccauucccuaguaggccugccacagccuagau

SEQ ID NO: 101040 - RNA, 20 nt, Human
ccauucccucucuucuucca

SEQ ID NO: 101041 - RNA, 32 nt, Human
ccauucccugcucacucagccaccucccucuc

SEQ ID NO: 101042 - RNA, 32 nt, Human
ccauucccuucuuccuccucaucaccaucgcc

SEQ ID NO: 101043 - RNA, 32 nt, Human
ccauuccgcccccgccucaacgcccagcacag

SEQ ID NO: 101044 - RNA, 32 nt, Human
ccauuccguucccagcugcuccuggggaggcc

SEQ ID NO: 101045 - RNA, 32 nt, Human
ccauuccuacccacuuaggcuuuguagcaaga

SEQ ID NO: 101046 - RNA, 21 nt, Human
ccauuccucagcuucuucaca

SEQ ID NO: 101047 - RNA, 20 nt, Human
ccauuccuccagcugcaaga

SEQ ID NO: 101048 - RNA, 32 nt, Human
ccauuccuccuccccugggccucucucccuuu

SEQ ID NO: 101049 - RNA, 32 nt, Human
ccauuccucucaugugcagacaggguugagaa

SEQ ID NO: 101050 - RNA, 32 nt, Human
ccauuccucuguccucuucucuggccugccug

SEQ ID NO: 101051 - RNA, 32 nt, Human
ccauuccugcagcccuccagacuuccugcccu

SEQ ID NO: 101052 - RNA, 32 nt, Human
ccauuccugcauggaauuccaucucugaagcc

SEQ ID NO: 101053 - RNA, 32 nt, Human
ccauuccuggccccagccuggccagggauccc

SEQ ID NO: 101054 - RNA, 32 nt, Human
ccauuccugggcaguggugguuaggggcccuu

SEQ ID NO: 101055 - RNA, 32 nt, Human
ccauuccuuagcuauuuaucccuuuccugguu

SEQ ID NO: 101056 - RNA, 18 nt, Human
ccauuccuugucugccau

SEQ ID NO: 101057 - RNA, 23 nt, Human
ccauucgaagagagaaagaaaga

SEQ ID NO: 101058 - RNA, 32 nt, Human
ccauucgccuuuccucuucuuuccuggcccac

SEQ ID NO: 101059 - RNA, 32 nt, Human
ccauucuacauacuauggaauuucucccaguc

SEQ ID NO: 101060 - RNA, 32 nt, Human
ccauucuaccaaaacuacaaaaauuagccggg

SEQ ID NO: 101061 - RNA, 32 nt, Human
ccauucuagcugguuccauggaucagggagga

SEQ ID NO: 101062 - RNA, 32 nt, Human
ccauucuauagucaugaaccccuucagugcau

SEQ ID NO: 101063 - RNA, 32 nt, Human
ccauucucaaaaaccagacuccugggucuaau

SEQ ID NO: 101064 - RNA, 31 nt, Human
ccauucucaauaaacauuugcugaagaaaug

SEQ ID NO: 101065 - RNA, 32 nt, Human
ccauucucacacugcuauaaauaaauaccuga

SEQ ID NO: 101066 - RNA, 32 nt, Human
ccauucucaccaggcugcgggcgccuugcagg

SEQ ID NO: 101067 - RNA, 32 nt, Human
ccauucucacgauggggcuuaagucauugucc

SEQ ID NO: 101068 - RNA, 32 nt, Human
ccauucucagcuccaagcauuagguaaaccca

SEQ ID NO: 101069 - RNA, 32 nt, Human
ccauucucaugucagacugaaaggagggccug

SEQ ID NO: 101070 - RNA, 32 nt, Human
ccauucuccauguccccuucucccucuucuca

SEQ ID NO: 101071 - RNA, 32 nt, Human
ccauucucccacugcucacauuuccuucuggu

SEQ ID NO: 101072 - RNA, 32 nt, Human
ccauucucccuccaagaggggcccagcauugu

SEQ ID NO: 101073 - RNA, 32 nt, Human
ccauucucccucgggucuccccagaggggccg

SEQ ID NO: 101074 - RNA, 32 nt, Human
ccauucuccucccucagacuuccgaguggcug

SEQ ID NO: 101075 - RNA, 32 nt, Human
ccauucuccucuggccuccucuucuaugcuuu

SEQ ID NO: 101076 - RNA, 32 nt, Human
ccauucuccugccucaaccucccgaauggcug

SEQ ID NO: 101077 - RNA, 32 nt, Human
ccauucuccugccucacccucccgaguagcug

SEQ ID NO: 101078 - RNA, 32 nt, Human
ccauucuccugccucagccucacgaguagcug

SEQ ID NO: 101079 - RNA, 32 nt, Human
ccauucuccugccucagccucccauagcuggg

SEQ ID NO: 101080 - RNA, 32 nt, Human
ccauucuccugccucagccuccccaguagcug

SEQ ID NO: 101081 - RNA, 32 nt, Human
ccauucuccugccucagccucccgagcagcug

SEQ ID NO: 101082 - RNA, 32 nt, Human
ccauucuccugccucagccucccgaguagcug

SEQ ID NO: 101083 - RNA, 32 nt, Human
ccauucuccugccucagccucccgcauaggug

SEQ ID NO: 101084 - RNA, 32 nt, Human
ccauucuccugccucagccucccggguagcug

SEQ ID NO: 101085 - RNA, 32 nt, Human
ccauucuccugccucagccucccguguagcug

SEQ ID NO: 101086 - RNA, 32 nt, Human
ccauucuccugccucagccucccuaauagcug

SEQ ID NO: 101087 - RNA, 32 nt, Human
ccauucuccugccucagccuccucaguagcug

SEQ ID NO: 101088 - RNA, 32 nt, Human
ccauucuccugccucagccuccugaguagcug

SEQ ID NO: 101089 - RNA, 32 nt, Human
ccauucuccugccucagcguccugaguagcug

SEQ ID NO: 101090 - RNA, 32 nt, Human
ccauucuccugccucagucuccugaguagcug

SEQ ID NO: 101091 - RNA, 19 nt, Human
ccauucucuacccauccuu

SEQ ID NO: 101092 - RNA, 32 nt, Human
ccauucucuaccucccaugcagcaugaacaca

SEQ ID NO: 101093 - RNA, 32 nt, Human
ccauucucuccaucccuuccaucccaggcaau

SEQ ID NO: 101094 - RNA, 19 nt, Human
ccauucucuggacuucaga

SEQ ID NO: 101095 - RNA, 32 nt, Human
ccauucucuucugcacaauuuaccuuugugug

SEQ ID NO: 101096 - RNA, 32 nt, Human
ccauucucuuucucaggaauggcuguuaaaau

SEQ ID NO: 101097 - RNA, 32 nt, Human
ccauucugaacauguuuugucauucacaagua

SEQ ID NO: 101098 - RNA, 32 nt, Human
ccauucugagccuugaagggcaaggagggaaa

SEQ ID NO: 101099 - RNA, 18 nt, Human
ccauucugcacagucccu

SEQ ID NO: 101100 - RNA, 32 nt, Human
ccauucugcagcccugcuggcacagcucaagu

SEQ ID NO: 101101 - RNA, 32 nt, Human
ccauucugccaagagaggcucuucugggggcc

SEQ ID NO: 101102 - RNA, 32 nt, Human
ccauucugccaauuuaaaugcgacugugguau

SEQ ID NO: 101103 - RNA, 29 nt, Human
ccauucugccugugugugcuguggcuuug

SEQ ID NO: 101104 - RNA, 32 nt, Human
ccauucugccuuucugacauuuccuugggaau

SEQ ID NO: 101105 - RNA, 32 nt, Human
ccauucuggaaauguaucccauagaagcugau

SEQ ID NO: 101106 - RNA, 32 nt, Human
ccauucuggauacuuccagacauuuuccacua

SEQ ID NO: 101107 - RNA, 32 nt, Human
ccauucuggccuuggccugcagaagcuuucag

SEQ ID NO: 101108 - RNA, 32 nt, Human
ccauucugggcaacaagagcgaaacuccgucu

SEQ ID NO: 101109 - RNA, 32 nt, Human
ccauucugggucaggcccucccccuuugcagg

SEQ ID NO: 101110 - RNA, 32 nt, Human
ccauucuggucuuaagaccccaaacaaggguu

SEQ ID NO: 101111 - RNA, 32 nt, Human
ccauucugguuccuggcugccugccucuugca

SEQ ID NO: 101112 - RNA, 32 nt, Human
ccauucuguaccccuuccccagccugggccuu

SEQ ID NO: 101113 - RNA, 32 nt, Human
ccauucuguagguugucuuuucacauucuauu

SEQ ID NO: 101114 - RNA, 32 nt, Human
ccauucuguccgcucagauucuggguggggcc

SEQ ID NO: 101115 - RNA, 32 nt, Human
ccauucuguuacacuuuguauuuucuaacugg

SEQ ID NO: 101116 - RNA, 32 nt, Human
ccauucuguucuguucuguucuccuaauacca

SEQ ID NO: 101117 - RNA, 32 nt, Human
ccauucuguugcuugccuuuucacucagugag

SEQ ID NO: 101118 - RNA, 32 nt, Human
ccauucuucacucuuugaagcgagcagucagc

SEQ ID NO: 101119 - RNA, 32 nt, Human
ccauucuucccaggaccucagcgcagcccugg

SEQ ID NO: 101120 - RNA, 32 nt, Human
ccauucuucccuuucgcucccuucccuggaaa

SEQ ID NO: 101121 - RNA, 32 nt, Human
ccauucuuccuaccuccaucucugguuuguca

SEQ ID NO: 101122 - RNA, 32 nt, Human
ccauucuuccuggauggagcagguggaggugc

SEQ ID NO: 101123 - RNA, 32 nt, Human
ccauucuucucuuccccucucuucccuuuccu

SEQ ID NO: 101124 - RNA, 32 nt, Human
ccauucuucuggugcuacuccaugcagggguc

SEQ ID NO: 101125 - RNA, 32 nt, Human
ccauucuugaguuuugauaaaguaauucauac

SEQ ID NO: 101126 - RNA, 32 nt, Human
ccauucuugguggugagccuggacucugagcu

SEQ ID NO: 101127 - RNA, 19 nt, Human
ccauucuuugccuuccugg

SEQ ID NO: 101128 - RNA, 32 nt, Human
ccauucuuuuaucuuuauccugugaagguguu

SEQ ID NO: 101129 - RNA, 32 nt, Human
ccauucuuuucuucccccuccugaagcaagca

SEQ ID NO: 101130 - RNA, 32 nt, Human
ccauucuuuuucugaccuguacugggagauca

SEQ ID NO: 101131 - RNA, 32 nt, Human
ccauugaacaucuagauaaaauggguaugagu

SEQ ID NO: 101132 - RNA, 32 nt, Human
ccauugaacauguuguauaaauacaccaggug

SEQ ID NO: 101133 - RNA, 32 nt, Human
ccauugacauuugcacuuucaaacaugacaag

SEQ ID NO: 101134 - RNA, 32 nt, Human
ccauugaccuucaucccucuccuuuggaaggg

SEQ ID NO: 101135 - RNA, 32 nt, Human
ccauugacugacccccuccuccagcaauagca

SEQ ID NO: 101136 - RNA, 32 nt, Human
ccauugacugccaucucuagucuugcaguggg

SEQ ID NO: 101137 - RNA, 32 nt, Human
ccauugagaaacuagucgcucuucucaacacg

SEQ ID NO: 101138 - RNA, 32 nt, Human
ccauugagcccaggaguccagccugggcaaaa

SEQ ID NO: 101139 - RNA, 32 nt, Human
ccauugagcuucacagugucaggcuggacgcc

SEQ ID NO: 101140 - RNA, 32 nt, Human
ccauugaggcuggagaggagagguuuugagca

SEQ ID NO: 101141 - RNA, 32 nt, Human
ccauugaguagcugggaugacaggcacaugcc

SEQ ID NO: 101142 - RNA, 32 nt, Human
ccauugauaccuccuggcugggugaggcggcu

SEQ ID NO: 101143 - RNA, 32 nt, Human
ccauugcaaccaugauugaugcuacuguuggu

SEQ ID NO: 101144 - RNA, 19 nt, Human
ccauugcaaguccauccuu

SEQ ID NO: 101145 - RNA, 24 nt, Human
ccauugcaaguugcacccagauga

SEQ ID NO: 101146 - RNA, 32 nt, Human
ccauugcacugaggccguaucauuccuuaaga

SEQ ID NO: 101147 - RNA, 32 nt, Human
ccauugcacugcaccugggcaacaagagugaa

SEQ ID NO: 101148 - RNA, 32 nt, Human
ccauugcagccugguguuuuaccuccuucacu

SEQ ID NO: 101149 - RNA, 32 nt, Human
ccauugcagguggcucuuacagcucucuggug

SEQ ID NO: 101150 - RNA, 32 nt, Human
ccauugcauuugucaccuagucacuguauaua

SEQ ID NO: 101151 - RNA, 32 nt, Human
ccauugccaaaagguuuuacugucuuaaagcu

SEQ ID NO: 101152 - RNA, 32 nt, Human
ccauugccacccacagugcccggaauggcccu

SEQ ID NO: 101153 - RNA, 32 nt, Human
ccauugccacugacacccggcucucugugcuc

SEQ ID NO: 101154 - RNA, 19 nt, Human
ccauugccacugcuugcca

SEQ ID NO: 101155 - RNA, 20 nt, Human
ccauugccagggcacugcca

SEQ ID NO: 101156 - RNA, 32 nt, Human
ccauugccauggauugcugugccucucgcagc

SEQ ID NO: 101157 - RNA, 20 nt, Human
ccauugccauggggcugguc

SEQ ID NO: 101158 - RNA, 32 nt, Human
ccauugccauuugguguggauuuucuacugua

SEQ ID NO: 101159 - RNA, 32 nt, Human
ccauugcccaggagaaugaggagccucccugc

SEQ ID NO: 101160 - RNA, 32 nt, Human
ccauugcccaggcuggacugcagcagcgugau

SEQ ID NO: 101161 - RNA, 32 nt, Human
ccauugcccaggcuggaguacaauggugcgau

SEQ ID NO: 101162 - RNA, 32 nt, Human
ccauugcccaggcuggauuacaguggcgcaau

SEQ ID NO: 101163 - RNA, 32 nt, Human
ccauugccccaccauggcuggggaccggcucc

SEQ ID NO: 101164 - RNA, 32 nt, Human
ccauugccccuaggccaggccuggugagugac

SEQ ID NO: 101165 - RNA, 32 nt, Human
ccauugccggcaccuggugagauuccgucucu

SEQ ID NO: 101166 - RNA, 32 nt, Human
ccauugccgugcucuuugaaugcagacuucua

SEQ ID NO: 101167 - RNA, 32 nt, Human
ccauugccuccaccuccaccacagccugccca

SEQ ID NO: 101168 - RNA, 32 nt, Human
ccauugccuuaaauagccucucuccccauuua

SEQ ID NO: 101169 - RNA, 32 nt, Human
ccauugccuucccacuaugcagccagggaugc

SEQ ID NO: 101170 - RNA, 32 nt, Human
ccauugccuuucuuccccugacuacugggcuu

SEQ ID NO: 101171 - RNA, 32 nt, Human
ccauugcgcccaggcugguaugcagucauguu

SEQ ID NO: 101172 - RNA, 32 nt, Human
ccauugcgggguggggagggaggcgggguugg

SEQ ID NO: 101173 - RNA, 19 nt, Human
ccauugcucgccuuggcca

SEQ ID NO: 101174 - RNA, 32 nt, Human
ccauugcugcagcugcuccacagcccuuuuca

SEQ ID NO: 101175 - RNA, 32 nt, Human
ccauugcugcugccucugccucggagaagccc

SEQ ID NO: 101176 - RNA, 32 nt, Human
ccauugcuggaaaaauugagauggaaaacaaa

SEQ ID NO: 101177 - RNA, 32 nt, Human
ccauugcuuccuggacaggggauccaaaccau

SEQ ID NO: 101178 - RNA, 32 nt, Human
ccauugcuuguuuuucucagguuugucaaaga

SEQ ID NO: 101179 - RNA, 22 nt, Human
ccauuggaaaaacccucugugg

SEQ ID NO: 101180 - RNA, 32 nt, Human
ccauuggaccaacagaaaccucaauugcacca

SEQ ID NO: 101181 - RNA, 32 nt, Human
ccauuggagaaacugggcauuuuaccaaggau

SEQ ID NO: 101182 - RNA, 32 nt, Human
ccauuggagaugaccaguccuuucugggaccu

SEQ ID NO: 101183 - RNA, 32 nt, Human
ccauuggauguagagaaaagugccuuagaguu

SEQ ID NO: 101184 - RNA, 32 nt, Human
ccauuggcaaagccaaacccaagaagcaaucc

SEQ ID NO: 101185 - RNA, 32 nt, Human
ccauuggcaugggcucuggagcuguccagaag

SEQ ID NO: 101186 - RNA, 32 nt, Human
ccauuggccacugguggaggugcacuggaagg

SEQ ID NO: 101187 - RNA, 19 nt, Human
ccauuggccgcuccuccac

SEQ ID NO: 101188 - RNA, 20 nt, Human
ccauuggccucuccuugcca

SEQ ID NO: 101189 - RNA, 20 nt, Human
ccauuggcuaaccaggcucc

SEQ ID NO: 101190 - RNA, 32 nt, Human
ccauuggcucagauaacugggcucuggauguu

SEQ ID NO: 101191 - RNA, 32 nt, Human
ccauuggcugagacccaccagguccaguuuug

SEQ ID NO: 101192 - RNA, 32 nt, Human
ccauuggcugcccucugucacacacaggugug

SEQ ID NO: 101193 - RNA, 32 nt, Human
ccauuggcuucucagauguauuucaaggacua

SEQ ID NO: 101194 - RNA, 32 nt, Human
ccauugggagacauagauacauugcuuauaug

SEQ ID NO: 101195 - RNA, 32 nt, Human
ccauuggguaacagugguuaccagagaggcaa

SEQ ID NO: 101196 - RNA, 20 nt, Human
ccauugggugaguccuucaa

SEQ ID NO: 101197 - RNA, 32 nt, Human
ccauuggucaccagagcaacugcaugucuuca

SEQ ID NO: 101198 - RNA, 32 nt, Human
ccauuggugaugaugacuguaacuucuggcuu

SEQ ID NO: 101199 - RNA, 32 nt, Human
ccauugguucucuucccccagcacccugaaac

SEQ ID NO: 101200 - RNA, 32 nt, Human
ccauuguaaacccagagggcugcauuuugggu

SEQ ID NO: 101201 - RNA, 32 nt, Human
ccauuguagaagggacagggagucagaucccc

SEQ ID NO: 101202 - RNA, 32 nt, Human
ccauuguagaauguuuucacauacuugaauaa

SEQ ID NO: 101203 - RNA, 32 nt, Human
ccauuguauuuuaaaaucuuauuccuacuauu

SEQ ID NO: 101204 - RNA, 32 nt, Human
ccauuguccagaugggcacugcuguggagucu

SEQ ID NO: 101205 - RNA, 23 nt, Human
ccauugucccuugccuagccugg

SEQ ID NO: 101206 - RNA, 32 nt, Human
ccauuguccggcauccugcggaggcuuaauau

SEQ ID NO: 101207 - RNA, 32 nt, Human
ccauuguccuggcaccuccauuuccuuaguuu

SEQ ID NO: 101208 - RNA, 32 nt, Human
ccauugucgaauuagucuccagccucuaaaua

SEQ ID NO: 101209 - RNA, 32 nt, Human
ccauugucucagccucugccacuucccagacc

SEQ ID NO: 101210 - RNA, 31 nt, Human
ccauugugacuucucugauaaagcgucugau

SEQ ID NO: 101211 - RNA, 31 nt, Human
ccauugugcccacuuaugccugugucugccc

SEQ ID NO: 101212 - RNA, 32 nt, Human
ccauugugggguccccaggaaagggcaagggc

SEQ ID NO: 101213 - RNA, 32 nt, Human
ccauugugguguggcaggauggguuggugggg

SEQ ID NO: 101214 - RNA, 32 nt, Human
ccauugugugucugugucauguaaaaauguuu

SEQ ID NO: 101215 - RNA, 24 nt, Human
ccauuguuacaugaaagugauaga

SEQ ID NO: 101216 - RNA, 19 nt, Human
ccauuguuacaugggguga

SEQ ID NO: 101217 - RNA, 23 nt, Human
ccauuguuaccagaaguaaugga

SEQ ID NO: 101218 - RNA, 32 nt, Human
ccauuguuucuccuggguuaggccccggcuuc

SEQ ID NO: 101219 - RNA, 19 nt, Human
ccauuguuuuuaccauucc

SEQ ID NO: 101220 - RNA, 32 nt, Human
ccauuuaaaauuauaugaaugguuugggaucu

SEQ ID NO: 101221 - RNA, 32 nt, Human
ccauuuaacaagagaucccacucuccagcugc

SEQ ID NO: 101222 - RNA, 32 nt, Human
ccauuuacacaaaaacagaaaaguacccagau

SEQ ID NO: 101223 - RNA, 32 nt, Human
ccauuuacagcccucagcaaugugccuucuaa

SEQ ID NO: 101224 - RNA, 32 nt, Human
ccauuuacccuugaccccaguccacagugguc

SEQ ID NO: 101225 - RNA, 32 nt, Human
ccauuuagaaaacugaccagcacccagcaagc

SEQ ID NO: 101226 - RNA, 22 nt, Human
ccauuuagacagcagggcuuac

SEQ ID NO: 101227 - RNA, 32 nt, Human
ccauuuagagugagggagagagagugagagac

SEQ ID NO: 101228 - RNA, 32 nt, Human
ccauuuagaucucuggggccacugaugggaug

SEQ ID NO: 101229 - RNA, 32 nt, Human
ccauuuagcuguauuucccuuuacuuacagca

SEQ ID NO: 101230 - RNA, 32 nt, Human
ccauuuagggagacaaucaagcucuuaguuau

SEQ ID NO: 101231 - RNA, 32 nt, Human
ccauuuagguaucugaaaugcauuucagacuu

SEQ ID NO: 101232 - RNA, 32 nt, Human
ccauuuaguugugcuuuucuucauauacuuca

SEQ ID NO: 101233 - RNA, 32 nt, Human
ccauuuauauguuucaauaaagcacaacuccu

SEQ ID NO: 101234 - RNA, 32 nt, Human
ccauuuauccaagugcuuucauuuuuccagau

SEQ ID NO: 101235 - RNA, 32 nt, Human
ccauuuaucuuuuucacuuucuugccuguuuu

SEQ ID NO: 101236 - RNA, 32 nt, Human
ccauuuauuggugagaaaacaggcucaggguu

SEQ ID NO: 101237 - RNA, 32 nt, Human
ccauuucaaauccugcacucaggccugguggu

SEQ ID NO: 101238 - RNA, 32 nt, Human
ccauuucaauucucaaaagaaaaggcaaaacc

SEQ ID NO: 101239 - RNA, 32 nt, Human
ccauuucacccggaaaagaugacucugauuua

SEQ ID NO: 101240 - RNA, 32 nt, Human
ccauuucacucucaaacuucacuaaugaucac

SEQ ID NO: 101241 - RNA, 32 nt, Human
ccauuucagccugucugucucagggugcagcc

SEQ ID NO: 101242 - RNA, 32 nt, Human
ccauuucagccugugcucugccucgauuguug

SEQ ID NO: 101243 - RNA, 32 nt, Human
ccauuucagcugucuuuugauuaauguuuucg

SEQ ID NO: 101244 - RNA, 21 nt, Human
ccauuucaguguuugaaccua

SEQ ID NO: 101245 - RNA, 32 nt, Human
ccauuucaugcaaccagaaacuaguuaaaagc

SEQ ID NO: 101246 - RNA, 32 nt, Human
ccauuuccaagaggcuguagaaaggggagaau

SEQ ID NO: 101247 - RNA, 32 nt, Human
ccauuuccagaacucaaucccugcaaaugaau

SEQ ID NO: 101248 - RNA, 32 nt, Human
ccauuuccagauugcgccagcauuacaguaac

SEQ ID NO: 101249 - RNA, 32 nt, Human
ccauuuccagucaugaauucagaccaggaugu

SEQ ID NO: 101250 - RNA, 32 nt, Human
ccauuuccauccaugacagguacagcauccca

SEQ ID NO: 101251 - RNA, 32 nt, Human
ccauuuccauuuuacagacaaggaaaucaaga

SEQ ID NO: 101252 - RNA, 32 nt, Human
ccauuucccaacaaauuccucaucuccaucug

SEQ ID NO: 101253 - RNA, 21 nt, Human
ccauuucccaagcccagcaga

SEQ ID NO: 101254 - RNA, 32 nt, Human
ccauuucccagguuaugcucuuuucuuucuca

SEQ ID NO: 101255 - RNA, 32 nt, Human
ccauuucccaucucagcuucaagggagguguc

SEQ ID NO: 101256 - RNA, 32 nt, Human
ccauuucccaugagccaacugggaaacauggu

SEQ ID NO: 101257 - RNA, 32 nt, Human
ccauuuccccagcccaugagguugggauauua

SEQ ID NO: 101258 - RNA, 32 nt, Human
ccauuucccuccaacccccuaaugguuucuuu

SEQ ID NO: 101259 - RNA, 32 nt, Human
ccauuuccuaaaggaaaugcccccggggagga

SEQ ID NO: 101260 - RNA, 32 nt, Human
ccauuuccuccccucucuaccugcagugaguu

SEQ ID NO: 101261 - RNA, 32 nt, Human
ccauuuccugacugcacuggccuggcagucug

SEQ ID NO: 101262 - RNA, 32 nt, Human
ccauuuccuuucucaccuccuccuccacuccc

SEQ ID NO: 101263 - RNA, 32 nt, Human
ccauuuccuuucuccacauccaggucaggugg

SEQ ID NO: 101264 - RNA, 32 nt, Human
ccauuucgagugucaaguguauuuuuaacugu

SEQ ID NO: 101265 - RNA, 32 nt, Human
ccauuucgcgucuccccuuucccuccccagcc

SEQ ID NO: 101266 - RNA, 32 nt, Human
ccauuucgucaagugaccucucaucuucuaua

SEQ ID NO: 101267 - RNA, 32 nt, Human
ccauuucgugagccccaucuucacccaggccu

SEQ ID NO: 101268 - RNA, 32 nt, Human
ccauuucguucucccuuccuugcugacaaagc

SEQ ID NO: 101269 - RNA, 32 nt, Human
ccauuucuaauaguuggcaccauuauaagcua

SEQ ID NO: 101270 - RNA, 32 nt, Human
ccauuucuacaaaaauacaaaacuuagcuggg

SEQ ID NO: 101271 - RNA, 32 nt, Human
ccauuucuacuaaaaauacaaaauuagcuggg

SEQ ID NO: 101272 - RNA, 32 nt, Human
ccauuucuacucuuaaguuucucagcucccau

SEQ ID NO: 101273 - RNA, 32 nt, Human
ccauuucucaggugcaguacagcacguccacg

SEQ ID NO: 101274 - RNA, 22 nt, Human
ccauuucuccgucggcucggca

SEQ ID NO: 101275 - RNA, 32 nt, Human
ccauuucuccugggggagggguuuggggcugg

SEQ ID NO: 101276 - RNA, 32 nt, Human
ccauuucucucaccacuucuuugccagucuag

SEQ ID NO: 101277 - RNA, 32 nt, Human
ccauuucucuccucacacacagacucauauua

SEQ ID NO: 101278 - RNA, 32 nt, Human
ccauuucucucuucagccucaggccaaacaaa

SEQ ID NO: 101279 - RNA, 32 nt, Human
ccauuucucugugcccuuuugacagcuccagg

SEQ ID NO: 101280 - RNA, 32 nt, Human
ccauuucugcagccagugucuccugggugccu

SEQ ID NO: 101281 - RNA, 32 nt, Human
ccauuucugccacuuucccccuagagagccga

SEQ ID NO: 101282 - RNA, 32 nt, Human
ccauuucuggaaaaucuguaaagaggaaacag

SEQ ID NO: 101283 - RNA, 22 nt, Human
ccauuucuggccaaaacuacaa

SEQ ID NO: 101284 - RNA, 32 nt, Human
ccauuucugggcacguggcagcagucgcugau

SEQ ID NO: 101285 - RNA, 32 nt, Human
ccauuucuguggagggagggcagcuggccccc

SEQ ID NO: 101286 - RNA, 32 nt, Human
ccauuucuguguccuuaccccuggugaggucu

SEQ ID NO: 101287 - RNA, 22 nt, Human
ccauuucuguguguucccccaa

SEQ ID NO: 101288 - RNA, 32 nt, Human
ccauuucuucaauaucauuuuugaggcuuugg

SEQ ID NO: 101289 - RNA, 32 nt, Human
ccauuucuuuugucucucuguuucuguucuga

SEQ ID NO: 101290 - RNA, 19 nt, Human
ccauuugaaaucagaggaa

SEQ ID NO: 101291 - RNA, 32 nt, Human
ccauuugacuuugagcugcuguugaaguggug

SEQ ID NO: 101292 - RNA, 23 nt, Human
ccauuugauaauaaucuuauuca

SEQ ID NO: 101293 - RNA, 32 nt, Human
ccauuugcacagugggacagaugaguacaacu

SEQ ID NO: 101294 - RNA, 32 nt, Human
ccauuugccaauuuuccuacucucacacuggu

SEQ ID NO: 101295 - RNA, 22 nt, Human
ccauuugccccagcuggucuca

SEQ ID NO: 101296 - RNA, 32 nt, Human
ccauuugcccuccuccucagcuagggccacgc

SEQ ID NO: 101297 - RNA, 32 nt, Human
ccauuugccucuuccuuccuauuucccuuccg

SEQ ID NO: 101298 - RNA, 32 nt, Human
ccauuugccucuugagugggcagcccugggcu

SEQ ID NO: 101299 - RNA, 32 nt, Human
ccauuugccuuccuggaauccugcugcaucac

SEQ ID NO: 101300 - RNA, 32 nt, Human
ccauuugcuaucuccaacuuuccugccaccuu

SEQ ID NO: 101301 - RNA, 32 nt, Human
ccauuugcuucucugcugaccuugccaaguug

SEQ ID NO: 101302 - RNA, 32 nt, Human
ccauuuggaaaucuugagcucagcugugguuc

SEQ ID NO: 101303 - RNA, 32 nt, Human
ccauuuggaauucuuuccccaguaucugagcc

SEQ ID NO: 101304 - RNA, 32 nt, Human
ccauuuggagccaccucugcuucucagcccca

SEQ ID NO: 101305 - RNA, 32 nt, Human
ccauuuggagggaggaaguaagggaagaggag

SEQ ID NO: 101306 - RNA, 32 nt, Human
ccauuuggauggguguggagccagucuccaag

SEQ ID NO: 101307 - RNA, 32 nt, Human
ccauuuggcaaaacuuccuuggccacgagacu

SEQ ID NO: 101308 - RNA, 32 nt, Human
ccauuuggcaaugccaucaucuccugccuucc

SEQ ID NO: 101309 - RNA, 32 nt, Human
ccauuuggcuguuucucucuuguucucagaca

SEQ ID NO: 101310 - RNA, 32 nt, Human
ccauuugggaaacugagcuucuuucuucugca

SEQ ID NO: 101311 - RNA, 21 nt, Human
ccauuugggaacagagcaaga

SEQ ID NO: 101312 - RNA, 32 nt, Human
ccauuuggucaaauuggaagcccagggccagg

SEQ ID NO: 101313 - RNA, 32 nt, Human
ccauuuggugaguguuuugcuggaaauauuuc

SEQ ID NO: 101314 - RNA, 21 nt, Human
ccauuugguuaaugacauuaa

SEQ ID NO: 101315 - RNA, 32 nt, Human
ccauuugucuacagccugccagaucuggccug

SEQ ID NO: 101316 - RNA, 32 nt, Human
ccauuuguguguggcuagcuguuuccagccag

SEQ ID NO: 101317 - RNA, 32 nt, Human
ccauuuguucuugaacucugggaggcagaagu

SEQ ID NO: 101318 - RNA, 32 nt, Human
ccauuuguuuacugcuguaucuuaggcucaaa

SEQ ID NO: 101319 - RNA, 32 nt, Human
ccauuuguuuucaaggucaaggcuccaggcag

SEQ ID NO: 101320 - RNA, 32 nt, Human
ccauuuuagcaacaggcuaauaaaauuucaaa

SEQ ID NO: 101321 - RNA, 32 nt, Human
ccauuuuauuugggaguucucaucugggauug

SEQ ID NO: 101322 - RNA, 32 nt, Human
ccauuuucaagggcagggaaaagggaguaaaa

SEQ ID NO: 101323 - RNA, 32 nt, Human
ccauuuucacacugcuauaaggaacuaccuga

SEQ ID NO: 101324 - RNA, 32 nt, Human
ccauuuucagggacuagguacugacccccgcg

SEQ ID NO: 101325 - RNA, 32 nt, Human
ccauuuucauucuucuuuugugguccaauuag

SEQ ID NO: 101326 - RNA, 18 nt, Human
ccauuuuccaauccaucc

SEQ ID NO: 101327 - RNA, 19 nt, Human
ccauuuucccaucauccuu

SEQ ID NO: 101328 - RNA, 32 nt, Human
ccauuuuccccacuuugugaugggcuucucuc

SEQ ID NO: 101329 - RNA, 24 nt, Human
ccauuuucccccacuacugcagca

SEQ ID NO: 101330 - RNA, 32 nt, Human
ccauuuuccuggugcaggcucagcuuucccag

SEQ ID NO: 101331 - RNA, 32 nt, Human
ccauuuucucauaauaguagccuagucaacac

SEQ ID NO: 101332 - RNA, 23 nt, Human
ccauuuucuccggggcugugggg

SEQ ID NO: 101333 - RNA, 32 nt, Human
ccauuuucucucuugggagcaauggucacagu

SEQ ID NO: 101334 - RNA, 32 nt, Human
ccauuuucugaacaaaagagggccucuucuua

SEQ ID NO: 101335 - RNA, 32 nt, Human
ccauuuucugguucuguguccucugccugggc

SEQ ID NO: 101336 - RNA, 32 nt, Human
ccauuuucuuccugccaagccugaaucaaugu

SEQ ID NO: 101337 - RNA, 32 nt, Human
ccauuuucuugauggaacucuuccuagaguuu

SEQ ID NO: 101338 - RNA, 32 nt, Human
ccauuuugacuccuguggaugguuccagguaa

SEQ ID NO: 101339 - RNA, 32 nt, Human
ccauuuugagggugaauauggcuaggcacuuu

SEQ ID NO: 101340 - RNA, 32 nt, Human
ccauuuugauaaugcuauuuugauugagugaa

SEQ ID NO: 101341 - RNA, 32 nt, Human
ccauuuugccuuucugacauuuccuugggaau

SEQ ID NO: 101342 - RNA, 32 nt, Human
ccauuuuggggagcaguucuucaucugaaugg

SEQ ID NO: 101343 - RNA, 32 nt, Human
ccauuuugguaucuacuucuaaauacacucag

SEQ ID NO: 101344 - RNA, 32 nt, Human
ccauuuuguagccaggugugguggcucacacc

SEQ ID NO: 101345 - RNA, 32 nt, Human
ccauuuuuauuugccuuucuagauauuuuauu

SEQ ID NO: 101346 - RNA, 32 nt, Human
ccauuuuucucagggcccuccacuagagucag

SEQ ID NO: 101347 - RNA, 32 nt, Human
ccauuuuucucccaagaaaccugacucaauua

SEQ ID NO: 101348 - RNA, 32 nt, Human
ccauuuuucucuuucuccuccuggccuggccu

SEQ ID NO: 101349 - RNA, 32 nt, Human
ccauuuuugccucacuuaauuccagccuuuug

SEQ ID NO: 101350 - RNA, 32 nt, Human
ccauuuuuggguguuuucuaccacagauugau

SEQ ID NO: 101351 - RNA, 21 nt, Human
cccaaaaaagggaacacugug

SEQ ID NO: 101352 - RNA, 22 nt, Human
cccaaaaaccaggcugcagugg

SEQ ID NO: 101353 - RNA, 19 nt, Human
cccaaaaaccauuguuuua

SEQ ID NO: 101354 - RNA, 24 nt, Human
cccaaaaagcugggauuacuagca

SEQ ID NO: 101355 - RNA, 32 nt, Human
cccaaaaagguuugaacccaggucuuccaagu

SEQ ID NO: 101356 - RNA, 32 nt, Human
cccaaaaagugccagaagcaucguggcauuuc

SEQ ID NO: 101357 - RNA, 32 nt, Human
cccaaaaauauaauauagaacuaauugcuaac

SEQ ID NO: 101358 - RNA, 32 nt, Human
cccaaaaaugaaggaccucauuucuuauagcc

SEQ ID NO: 101359 - RNA, 32 nt, Human
cccaaaacacaaaucuagaauugcaaagccag

SEQ ID NO: 101360 - RNA, 32 nt, Human
cccaaaacacauuuaccagcauacuccaaacu

SEQ ID NO: 101361 - RNA, 32 nt, Human
cccaaaacagaagaaaggaaaagcaauuaacg

SEQ ID NO: 101362 - RNA, 32 nt, Human
cccaaaacagaagaaaggaaaggcaauuaacg

SEQ ID NO: 101363 - RNA, 32 nt, Human
cccaaaacagaguagaauagaauucauaugaa

SEQ ID NO: 101364 - RNA, 32 nt, Human
cccaaaacaguuauacagaugacgguacuggu

SEQ ID NO: 101365 - RNA, 32 nt, Human
cccaaaaccaaacgcagcaucuucccauccuc

SEQ ID NO: 101366 - RNA, 32 nt, Human
cccaaaacccuugaguaaacuagcugagccau

SEQ ID NO: 101367 - RNA, 32 nt, Human
cccaaaacuccuugacuagaacuaucuccuuu

SEQ ID NO: 101368 - RNA, 32 nt, Human
cccaaaacucuuccuguucugccugcagaguu

SEQ ID NO: 101369 - RNA, 32 nt, Human
cccaaaagaagaacccaggcugccggcgaucc

SEQ ID NO: 101370 - RNA, 32 nt, Human
cccaaaagacagucagccuuguccucaggccc

SEQ ID NO: 101371 - RNA, 22 nt, Human
cccaaaagcugggauuacaggc

SEQ ID NO: 101372 - RNA, 24 nt, Human
cccaaaaggcagacauugcaguga

SEQ ID NO: 101373 - RNA, 32 nt, Human
cccaaaaggcagacauugcagugagccaagau

SEQ ID NO: 101374 - RNA, 24 nt, Human
cccaaaaggcggagguugcaguga

SEQ ID NO: 101375 - RNA, 32 nt, Human
cccaaaaggcggagguugcagugagccaagau

SEQ ID NO: 101376 - RNA, 22 nt, Human
cccaaaaggcuucaggccagcu

SEQ ID NO: 101377 - RNA, 22 nt, Human
cccaaaagguggaggcugcagu

SEQ ID NO: 101378 - RNA, 24 nt, Human
cccaaaagguggaggcugcaguga

SEQ ID NO: 101379 - RNA, 22 nt, Human
cccaaaagugcuggauuacagg

SEQ ID NO: 101380 - RNA, 24 nt, Human
cccaaaaguuugaggcugcaguga

SEQ ID NO: 101381 - RNA, 24 nt, Human
cccaaaauauuggaaauacaggca

SEQ ID NO: 101382 - RNA, 23 nt, Human
cccaaaauccugggauuacaggc

SEQ ID NO: 101383 - RNA, 23 nt, Human
cccaaaaugcugggauuacaagc

SEQ ID NO: 101384 - RNA, 22 nt, Human
cccaaaaugcugggauuacagg

SEQ ID NO: 101385 - RNA, 23 nt, Human
cccaaaaugcugggauuacaggc

SEQ ID NO: 101386 - RNA, 24 nt, Human
cccaaaaugcugggauuacaggca

SEQ ID NO: 101387 - RNA, 24 nt, Human
cccaaaaugcugggauuacaugca

SEQ ID NO: 101388 - RNA, 24 nt, Human
cccaaaaugcuucgauugcaggca

SEQ ID NO: 101389 - RNA, 24 nt, Human
cccaaaaugcuuggauuacaggca

SEQ ID NO: 101390 - RNA, 32 nt, Human
cccaaaaugugccaagaauuucccagucccag

SEQ ID NO: 101391 - RNA, 32 nt, Human
cccaaaauguuccuugcuauguguucuucugu

SEQ ID NO: 101392 - RNA, 24 nt, Human
cccaaaauguugagauugcaggca

SEQ ID NO: 101393 - RNA, 24 nt, Human
cccaaaauguugcaauuacaggca

SEQ ID NO: 101394 - RNA, 24 nt, Human
cccaaaauucugggauuacaggca

SEQ ID NO: 101395 - RNA, 32 nt, Human
cccaaacaccaggguuuuuggaaccaucaccu

SEQ ID NO: 101396 - RNA, 23 nt, Human
cccaaacaccucauuguuucccc

SEQ ID NO: 101397 - RNA, 32 nt, Human
cccaaacacuagaugugugugugcacacacac

SEQ ID NO: 101398 - RNA, 32 nt, Human
cccaaacacuggcugcuggcauuccaccaagu

SEQ ID NO: 101399 - RNA, 32 nt, Human
cccaaacauaugcacauucacuuagcagaacc

SEQ ID NO: 101400 - RNA, 32 nt, Human
cccaaacaucaccuuucauucuggaccuacca

SEQ ID NO: 101401 - RNA, 32 nt, Human
cccaaaccaagugccuugagcugccugcucug

SEQ ID NO: 101402 - RNA, 19 nt, Human
cccaaaccacacccaggaa

SEQ ID NO: 101403 - RNA, 32 nt, Human
cccaaaccacgccucuugaccaggcugccucc

SEQ ID NO: 101404 - RNA, 19 nt, Human
cccaaaccagcccgaggag

SEQ ID NO: 101405 - RNA, 32 nt, Human
cccaaaccagcccucuguuagggguggucuuu

SEQ ID NO: 101406 - RNA, 32 nt, Human
cccaaaccagcccuugagucugucacacucuc

SEQ ID NO: 101407 - RNA, 32 nt, Human
cccaaaccauaccacacacauuaucauuguua

SEQ ID NO: 101408 - RNA, 24 nt, Human
cccaaaccauuaaauugucuuuaa

SEQ ID NO: 101409 - RNA, 32 nt, Human
cccaaacccaagaggcggagguugaguaagcu

SEQ ID NO: 101410 - RNA, 18 nt, Human
cccaaacccacacaccag

SEQ ID NO: 101411 - RNA, 23 nt, Human
cccaaacccagaagccugaggaa

SEQ ID NO: 101412 - RNA, 32 nt, Human
cccaaacccagcacuccagacucgagggaagc

SEQ ID NO: 101413 - RNA, 32 nt, Human
cccaaacccaggaggcagaaguugcaagguug

SEQ ID NO: 101414 - RNA, 32 nt, Human
cccaaacccaggccccaugcaaaggcacgugg

SEQ ID NO: 101415 - RNA, 21 nt, Human
cccaaaccccaaacuggggga

SEQ ID NO: 101416 - RNA, 21 nt, Human
cccaaacccccaucuguggaa

SEQ ID NO: 101417 - RNA, 32 nt, Human
cccaaacccccugcagcccaggccagucagac

SEQ ID NO: 101418 - RNA, 21 nt, Human
cccaaaccccucucacucccu

SEQ ID NO: 101419 - RNA, 32 nt, Human
cccaaacccgggcuauccuucacucugcaggg

SEQ ID NO: 101420 - RNA, 25 nt, Human
cccaaacccuggggcuggcuuagga

SEQ ID NO: 101421 - RNA, 21 nt, Human
cccaaaccggaguggcuggga

SEQ ID NO: 101422 - RNA, 32 nt, Human
cccaaaccuccccuuccuuucccccuccuccg

SEQ ID NO: 101423 - RNA, 17 nt, Human
cccaaaccucgccagag

SEQ ID NO: 101424 - RNA, 32 nt, Human
cccaaaccucucuccucucucuuuucuguguc

SEQ ID NO: 101425 - RNA, 20 nt, Human
cccaaaccugccccuccuca

SEQ ID NO: 101426 - RNA, 32 nt, Human
cccaaaccuuuuucccuucuuugucauuguua

SEQ ID NO: 101427 - RNA, 32 nt, Human
cccaaacggaaaaggcaaggaggaacacagcg

SEQ ID NO: 101428 - RNA, 32 nt, Human
cccaaacgggcugcccugccacuuugguacau

SEQ ID NO: 101429 - RNA, 32 nt, Human
cccaaacuccagaguaguucaggcugggugga

SEQ ID NO: 101430 - RNA, 23 nt, Human
cccaaacucccaggaccuggaga

SEQ ID NO: 101431 - RNA, 32 nt, Human
cccaaacucccaggaccuggagacaggauugu

SEQ ID NO: 101432 - RNA, 32 nt, Human
cccaaacuccugccugcccuccagacugucug

SEQ ID NO: 101433 - RNA, 32 nt, Human
cccaaacuccuggccuucugugguuucccuuu

SEQ ID NO: 101434 - RNA, 32 nt, Human
cccaaacucggagacuucuaagagccacacca

SEQ ID NO: 101435 - RNA, 32 nt, Human
cccaaacucucaccuuaugcuuagcucuccuc

SEQ ID NO: 101436 - RNA, 22 nt, Human
cccaaacucuggaggcaagaga

SEQ ID NO: 101437 - RNA, 32 nt, Human
cccaaacucuuauuucagcauuaacucaaaau

SEQ ID NO: 101438 - RNA, 23 nt, Human
cccaaacucuuccccaccucggg

SEQ ID NO: 101439 - RNA, 20 nt, Human
cccaaacucuuccccgggaa

SEQ ID NO: 101440 - RNA, 32 nt, Human
cccaaacugcaauaagccgccuuccaaggcca

SEQ ID NO: 101441 - RNA, 32 nt, Human
cccaaacugcucauuauccuguuaccccaccc

SEQ ID NO: 101442 - RNA, 21 nt, Human
cccaaacuggaagaagugaga

SEQ ID NO: 101443 - RNA, 24 nt, Human
cccaaacuggagggggcauggaga

SEQ ID NO: 101444 - RNA, 20 nt, Human
cccaaacuggagugcagugg

SEQ ID NO: 101445 - RNA, 24 nt, Human
cccaaacuggugagauuacaggca

SEQ ID NO: 101446 - RNA, 19 nt, Human
cccaaacuuaaccucugag

SEQ ID NO: 101447 - RNA, 32 nt, Human
cccaaacuuugccucccgcggcggcugccccu

SEQ ID NO: 101448 - RNA, 32 nt, Human
cccaaagaaaauagauccuccaugcaggaucu

SEQ ID NO: 101449 - RNA, 27 nt, Human
cccaaagaaccagccucucaccccagg

SEQ ID NO: 101450 - RNA, 32 nt, Human
cccaaagaaccugguagcgccuccuggggcag

SEQ ID NO: 101451 - RNA, 24 nt, Human
cccaaagaacugggauuacaggca

SEQ ID NO: 101452 - RNA, 23 nt, Human
cccaaagaacuggguacucaaca

SEQ ID NO: 101453 - RNA, 32 nt, Human
cccaaagaaggcgcagaacagcacguguucuc

SEQ ID NO: 101454 - RNA, 32 nt, Human
cccaaagacacacacccccuuggugaaagaga

SEQ ID NO: 101455 - RNA, 21 nt, Human
cccaaagacacuggccuccug

SEQ ID NO: 101456 - RNA, 32 nt, Human
cccaaagacccucugugcccagccucuuccuu

SEQ ID NO: 101457 - RNA, 32 nt, Human
cccaaagaccuccguugaacauucuguaugga

SEQ ID NO: 101458 - RNA, 24 nt, Human
cccaaagaccugcccaccuccugg

SEQ ID NO: 101459 - RNA, 32 nt, Human
cccaaagaccugcccaccuccugggcucuccc

SEQ ID NO: 101460 - RNA, 32 nt, Human
cccaaagacuccacaagaaaacucagcacuga

SEQ ID NO: 101461 - RNA, 32 nt, Human
cccaaagagcagagagaggggacgucgccugc

SEQ ID NO: 101462 - RNA, 32 nt, Human
cccaaagagcaucugcccauuucccaccuucc

SEQ ID NO: 101463 - RNA, 32 nt, Human
cccaaagagcucccucucaaggccaacuauag

SEQ ID NO: 101464 - RNA, 23 nt, Human
cccaaagagcugagauuacaggc

SEQ ID NO: 101465 - RNA, 23 nt, Human
cccaaagagcugggauuacaggc

SEQ ID NO: 101466 - RNA, 21 nt, Human
cccaaagaugguggcugcagu

SEQ ID NO: 101467 - RNA, 32 nt, Human
cccaaagauguucccuguaggucacggcacuc

SEQ ID NO: 101468 - RNA, 32 nt, Human
cccaaagcacaucaccacaaggucaguugcaa

SEQ ID NO: 101469 - RNA, 24 nt, Human
cccaaagcacugaaguuacaggua

SEQ ID NO: 101470 - RNA, 24 nt, Human
cccaaagcacugggauuacaagca

SEQ ID NO: 101471 - RNA, 23 nt, Human
cccaaagcacugggauuacaggc

SEQ ID NO: 101472 - RNA, 24 nt, Human
cccaaagcacugggauuacaggca

SEQ ID NO: 101473 - RNA, 32 nt, Human
cccaaagcagaggcucggccaugaacuuaccc

SEQ ID NO: 101474 - RNA, 32 nt, Human
cccaaagcagcagaaggcagggguuaaaucag

SEQ ID NO: 101475 - RNA, 32 nt, Human
cccaaagcagcaucuuccagcacuuuccaucg

SEQ ID NO: 101476 - RNA, 32 nt, Human
cccaaagcaguauccugauuagaggaacgauc

SEQ ID NO: 101477 - RNA, 23 nt, Human
cccaaagcagugguauuacaggc

SEQ ID NO: 101478 - RNA, 32 nt, Human
cccaaagccaagggcaacagaucaguaaagaa

SEQ ID NO: 101479 - RNA, 32 nt, Human
cccaaagccagccuccaucuuaggccuuugcc

SEQ ID NO: 101480 - RNA, 32 nt, Human
cccaaagcccagcccggcugaccaacauucaa

SEQ ID NO: 101481 - RNA, 24 nt, Human
cccaaagcccagggcggcgacugg

SEQ ID NO: 101482 - RNA, 25 nt, Human
cccaaagcccagggugcucauggaa

SEQ ID NO: 101483 - RNA, 21 nt, Human
cccaaagccccccagccucca

SEQ ID NO: 101484 - RNA, 22 nt, Human
cccaaagcccgggagcuuggca

SEQ ID NO: 101485 - RNA, 32 nt, Human
cccaaagccguuggucaccuguggguggggga

SEQ ID NO: 101486 - RNA, 22 nt, Human
cccaaagccuaggagcuuggca

SEQ ID NO: 101487 - RNA, 23 nt, Human
cccaaagcgauaggauuacaggc

SEQ ID NO: 101488 - RNA, 24 nt, Human
cccaaagcgcuaggauuacaagca

SEQ ID NO: 101489 - RNA, 21 nt, Human
cccaaagcgcuaggauuagag

SEQ ID NO: 101490 - RNA, 21 nt, Human
cccaaagcgcuaggauuccag

SEQ ID NO: 101491 - RNA, 23 nt, Human
cccaaagcgcugggauuacaggc

SEQ ID NO: 101492 - RNA, 32 nt, Human
cccaaagcguacccuggucaucuggaagagga

SEQ ID NO: 101493 - RNA, 24 nt, Human
cccaaagcguugggauuauaggca

SEQ ID NO: 101494 - RNA, 20 nt, Human
cccaaagcugucccuucuca

SEQ ID NO: 101495 - RNA, 22 nt, Human
cccaaaggaaaacccacugguu

SEQ ID NO: 101496 - RNA, 32 nt, Human
cccaaaggaaaauucauuuucuuugcauuauu

SEQ ID NO: 101497 - RNA, 32 nt, Human
cccaaaggaggaacucugccucucugcuucuu

SEQ ID NO: 101498 - RNA, 32 nt, Human
cccaaaggagguagaagauggggaagaugaga

SEQ ID NO: 101499 - RNA, 21 nt, Human
cccaaaggcacaagcuccugg

SEQ ID NO: 101500 - RNA, 24 nt, Human
cccaaaggcagcuccuggggacuc

SEQ ID NO: 101501 - RNA, 22 nt, Human
cccaaaggcagucuccgugguu

SEQ ID NO: 101502 - RNA, 32 nt, Human
cccaaaggcaugcagauggcugugcauguugg

SEQ ID NO: 101503 - RNA, 32 nt, Human
cccaaaggccuuucaucucaauaucugucaaa

SEQ ID NO: 101504 - RNA, 21 nt, Human
cccaaaggcucagccuggcca

SEQ ID NO: 101505 - RNA, 27 nt, Human
cccaaaggcucuuuucagagccacuua

SEQ ID NO: 101506 - RNA, 32 nt, Human
cccaaaggcugcagcauugccauaccauuccc

SEQ ID NO: 101507 - RNA, 22 nt, Human
cccaaaggcuggagcccugguu

SEQ ID NO: 101508 - RNA, 32 nt, Human
cccaaagggaaggugaguggggcaguggcagu

SEQ ID NO: 101509 - RNA, 22 nt, Human
cccaaagggcugagccuccugg

SEQ ID NO: 101510 - RNA, 32 nt, Human
cccaaagggcuggacccuccuaauccucuccu

SEQ ID NO: 101511 - RNA, 24 nt, Human
cccaaaggguugggauuaccggca

SEQ ID NO: 101512 - RNA, 32 nt, Human
cccaaaggugacacccucaccagucucauccu

SEQ ID NO: 101513 - RNA, 24 nt, Human
cccaaagguucaaggcuccaguga

SEQ ID NO: 101514 - RNA, 23 nt, Human
cccaaaguacugggacuacaggc

SEQ ID NO: 101515 - RNA, 20 nt, Human
cccaaaguacugggauuaca

SEQ ID NO: 101516 - RNA, 23 nt, Human
cccaaaguacugggauuacaggc

SEQ ID NO: 101517 - RNA, 24 nt, Human
cccaaaguacugggauuacaggca

SEQ ID NO: 101518 - RNA, 32 nt, Human
cccaaaguaggucaguagguugggguugcuga

SEQ ID NO: 101519 - RNA, 24 nt, Human
cccaaaguagugggauuucaggca

SEQ ID NO: 101520 - RNA, 23 nt, Human
cccaaaguauugggacuacaggc

SEQ ID NO: 101521 - RNA, 32 nt, Human
cccaaaguccucuacccccucacuuuuauggc

SEQ ID NO: 101522 - RNA, 22 nt, Human
cccaaaguccugggauuacagg

SEQ ID NO: 101523 - RNA, 23 nt, Human
cccaaaguccugggauuacaggc

SEQ ID NO: 101524 - RNA, 32 nt, Human
cccaaagucugucaguugauaaacaaaauauu

SEQ ID NO: 101525 - RNA, 32 nt, Human
cccaaagugagguuucuggggagaaugagggc

SEQ ID NO: 101526 - RNA, 24 nt, Human
cccaaagugaugggauuacaggca

SEQ ID NO: 101527 - RNA, 19 nt, Human
cccaaagugcacugaggaa

SEQ ID NO: 101528 - RNA, 24 nt, Human
cccaaagugcagggauuacaggca

SEQ ID NO: 101529 - RNA, 32 nt, Human
cccaaagugcagggauuacaggcacaagccac

SEQ ID NO: 101530 - RNA, 32 nt, Human
cccaaagugcagggauuacaggcaugagccac

SEQ ID NO: 101531 - RNA, 24 nt, Human
cccaaagugccaggauuacaggca

SEQ ID NO: 101532 - RNA, 26 nt, Human
cccaaagugccgccgggauuacaggc

SEQ ID NO: 101533 - RNA, 24 nt, Human
cccaaagugccgggaugacaggca

SEQ ID NO: 101534 - RNA, 23 nt, Human
cccaaagugccgggauuacaggc

SEQ ID NO: 101535 - RNA, 24 nt, Human
cccaaagugccgggauuacaggca

SEQ ID NO: 101536 - RNA, 22 nt, Human
cccaaagugcgggauuacaagc

SEQ ID NO: 101537 - RNA, 21 nt, Human
cccaaagugcuaggauaacag

SEQ ID NO: 101538 - RNA, 18 nt, Human
cccaaagugcuaggauua

SEQ ID NO: 101539 - RNA, 24 nt, Human
cccaaagugcuaggauuacacagc

SEQ ID NO: 101540 - RNA, 21 nt, Human
cccaaagugcuaggauuacag

SEQ ID NO: 101541 - RNA, 24 nt, Human
cccaaagugcuaggauuacagaca

SEQ ID NO: 101542 - RNA, 24 nt, Human
cccaaagugcuaggauuacagcgu

SEQ ID NO: 101543 - RNA, 22 nt, Human
cccaaagugcuaggauuacagg

SEQ ID NO: 101544 - RNA, 23 nt, Human
cccaaagugcuaggauuacaggc

SEQ ID NO: 101545 - RNA, 24 nt, Human
cccaaagugcuaggauuacaggca

SEQ ID NO: 101546 - RNA, 23 nt, Human
cccaaagugcuaggauuacaggu

SEQ ID NO: 101547 - RNA, 24 nt, Human
cccaaagugcuaggauuacaggua

SEQ ID NO: 101548 - RNA, 23 nt, Human
cccaaagugcuaggauuacgggu

SEQ ID NO: 101549 - RNA, 22 nt, Human
cccaaagugcuaggauuauagg

SEQ ID NO: 101550 - RNA, 23 nt, Human
cccaaagugcuaggauuauaggc

SEQ ID NO: 101551 - RNA, 24 nt, Human
cccaaagugcuaggauuauaggca

SEQ ID NO: 101552 - RNA, 21 nt, Human
cccaaagugcuaggauuccag

SEQ ID NO: 101553 - RNA, 23 nt, Human
cccaaagugcuaggauuccaggc

SEQ ID NO: 101554 - RNA, 24 nt, Human
cccaaagugcuaggguuacagaca

SEQ ID NO: 101555 - RNA, 24 nt, Human
cccaaagugcuaggguuacaggca

SEQ ID NO: 101556 - RNA, 24 nt, Human
cccaaagugcuagguuuacaggca

SEQ ID NO: 101557 - RNA, 21 nt, Human
cccaaagugcuaugauuacag

SEQ ID NO: 101558 - RNA, 24 nt, Human
cccaaagugcucaggauuacaggc

SEQ ID NO: 101559 - RNA, 24 nt, Human
cccaaagugcucggauuacagaca

SEQ ID NO: 101560 - RNA, 24 nt, Human
cccaaagugcugaaauuacaggca

SEQ ID NO: 101561 - RNA, 21 nt, Human
cccaaagugcugacauaggca

SEQ ID NO: 101562 - RNA, 23 nt, Human
cccaaagugcugacauuacaggc

SEQ ID NO: 101563 - RNA, 23 nt, Human
cccaaagugcugagauuacaagc

SEQ ID NO: 101564 - RNA, 21 nt, Human
cccaaagugcugagauuacag

SEQ ID NO: 101565 - RNA, 24 nt, Human
cccaaagugcugagauuacagaca

SEQ ID NO: 101566 - RNA, 22 nt, Human
cccaaagugcugagauuacagg

SEQ ID NO: 101567 - RNA, 23 nt, Human
cccaaagugcugagauuacaggc

SEQ ID NO: 101568 - RNA, 24 nt, Human
cccaaagugcugagauuacaggca

SEQ ID NO: 101569 - RNA, 24 nt, Human
cccaaagugcugagauuauaggca

SEQ ID NO: 101570 - RNA, 23 nt, Human
cccaaagugcugcaguuacaggc

SEQ ID NO: 101571 - RNA, 23 nt, Human
cccaaagugcugccauuacaggc

SEQ ID NO: 101572 - RNA, 24 nt, Human
cccaaagugcugcgauuacagaca

SEQ ID NO: 101573 - RNA, 23 nt, Human
cccaaagugcugcgauuacaggc

SEQ ID NO: 101574 - RNA, 24 nt, Human
cccaaagugcugcgauuacaggca

SEQ ID NO: 101575 - RNA, 32 nt, Human
cccaaagugcugcugggauuacaggcgugagc

SEQ ID NO: 101576 - RNA, 23 nt, Human
cccaaagugcuggaaccacaggc

SEQ ID NO: 101577 - RNA, 22 nt, Human
cccaaagugcuggaauuacagg

SEQ ID NO: 101578 - RNA, 23 nt, Human
cccaaagugcuggaauuacaggc

SEQ ID NO: 101579 - RNA, 24 nt, Human
cccaaagugcuggaauuacaggca

SEQ ID NO: 101580 - RNA, 24 nt, Human
cccaaagugcuggaauuacaguca

SEQ ID NO: 101581 - RNA, 24 nt, Human
cccaaagugcuggaauuacuggca

SEQ ID NO: 101582 - RNA, 22 nt, Human
cccaaagugcuggauuacaggc

SEQ ID NO: 101583 - RNA, 23 nt, Human
cccaaagugcuggauuacaggca

SEQ ID NO: 101584 - RNA, 24 nt, Human
cccaaagugcuggcacuacaggca

SEQ ID NO: 101585 - RNA, 22 nt, Human
cccaaagugcuggcauuacagg

SEQ ID NO: 101586 - RNA, 23 nt, Human
cccaaagugcuggcauuacaggc

SEQ ID NO: 101587 - RNA, 22 nt, Human
cccaaagugcugggaauacagg

SEQ ID NO: 101588 - RNA, 24 nt, Human
cccaaagugcugggaauacaggca

SEQ ID NO: 101589 - RNA, 24 nt, Human
cccaaagugcugggaauuacaggc

SEQ ID NO: 101590 - RNA, 22 nt, Human
cccaaagugcugggacuacagg

SEQ ID NO: 101591 - RNA, 23 nt, Human
cccaaagugcugggacuacaggc

SEQ ID NO: 101592 - RNA, 32 nt, Human
cccaaagugcugggacuacaggccugagcuac

SEQ ID NO: 101593 - RNA, 21 nt, Human
cccaaagugcugggaucacag

SEQ ID NO: 101594 - RNA, 23 nt, Human
cccaaagugcugggaucacaggc

SEQ ID NO: 101595 - RNA, 24 nt, Human
cccaaagugcugggaucacaggca

SEQ ID NO: 101596 - RNA, 24 nt, Human
cccaaagugcugggaugacaggca

SEQ ID NO: 101597 - RNA, 32 nt, Human
cccaaagugcugggauuaaggcgugagccacu

SEQ ID NO: 101598 - RNA, 20 nt, Human
cccaaagugcugggauuaca

SEQ ID NO: 101599 - RNA, 23 nt, Human
cccaaagugcugggauuacaagc

SEQ ID NO: 101600 - RNA, 24 nt, Human
cccaaagugcugggauuacaagca

SEQ ID NO: 101601 - RNA, 21 nt, Human
cccaaagugcugggauuacag

SEQ ID NO: 101602 - RNA, 24 nt, Human
cccaaagugcugggauuacagaca

SEQ ID NO: 101603 - RNA, 24 nt, Human
cccaaagugcugggauuacagcca

SEQ ID NO: 101604 - RNA, 22 nt, Human
cccaaagugcugggauuacagg

SEQ ID NO: 101605 - RNA, 23 nt, Human
cccaaagugcugggauuacaggc

SEQ ID NO: 101606 - RNA, 24 nt, Human
cccaaagugcugggauuacaggca

SEQ ID NO: 101607 - RNA, 24 nt, Human
cccaaagugcugggauuacaggua

SEQ ID NO: 101608 - RNA, 24 nt, Human
cccaaagugcugggauuacaguca

SEQ ID NO: 101609 - RNA, 32 nt, Human
cccaaagugcugggauuacaguugcgagccac

SEQ ID NO: 101610 - RNA, 24 nt, Human
cccaaagugcugggauuaccagca

SEQ ID NO: 101611 - RNA, 24 nt, Human
cccaaagugcugggauuaccggca

SEQ ID NO: 101612 - RNA, 22 nt, Human
cccaaagugcugggauuacggg

SEQ ID NO: 101613 - RNA, 24 nt, Human
cccaaagugcugggauuacgggca

SEQ ID NO: 101614 - RNA, 24 nt, Human
cccaaagugcugggauuacuggca

SEQ ID NO: 101615 - RNA, 24 nt, Human
cccaaagugcugggauuagaggca

SEQ ID NO: 101616 - RNA, 24 nt, Human
cccaaagugcugggauuauagaca

SEQ ID NO: 101617 - RNA, 24 nt, Human
cccaaagugcugggauuauaggca

SEQ ID NO: 101618 - RNA, 22 nt, Human
cccaaagugcugggauuccagg

SEQ ID NO: 101619 - RNA, 21 nt, Human
cccaaagugcugggauugcag

SEQ ID NO: 101620 - RNA, 22 nt, Human
cccaaagugcugggauugcagg

SEQ ID NO: 101621 - RNA, 24 nt, Human
cccaaagugcugggauugcaggca

SEQ ID NO: 101622 - RNA, 22 nt, Human
cccaaagugcugggauuguggg

SEQ ID NO: 101623 - RNA, 23 nt, Human
cccaaagugcugggcuuacaggc

SEQ ID NO: 101624 - RNA, 22 nt, Human
cccaaagugcugggguuacagg

SEQ ID NO: 101625 - RNA, 24 nt, Human
cccaaagugcugggguuacaguca

SEQ ID NO: 101626 - RNA, 22 nt, Human
cccaaagugcugggucugcagg

SEQ ID NO: 101627 - RNA, 24 nt, Human
cccaaagugcuggguuaacaggca

SEQ ID NO: 101628 - RNA, 21 nt, Human
cccaaagugcugguauuacag

SEQ ID NO: 101629 - RNA, 23 nt, Human
cccaaagugcugguauuacaggc

SEQ ID NO: 101630 - RNA, 24 nt, Human
cccaaagugcuguaauuacaggca

SEQ ID NO: 101631 - RNA, 23 nt, Human
cccaaagugcugugauuacaggc

SEQ ID NO: 101632 - RNA, 24 nt, Human
cccaaagugcugugcauacaggca

SEQ ID NO: 101633 - RNA, 24 nt, Human
cccaaagugcuguuacuacaggua

SEQ ID NO: 101634 - RNA, 24 nt, Human
cccaaagugcuuggauuacaggca

SEQ ID NO: 101635 - RNA, 21 nt, Human
cccaaaguggaagccaaguuc

SEQ ID NO: 101636 - RNA, 32 nt, Human
cccaaagugguauagaaaugcugguuuuucag

SEQ ID NO: 101637 - RNA, 23 nt, Human
cccaaaguggugggaucacaggc

SEQ ID NO: 101638 - RNA, 32 nt, Human
cccaaagugucugcuuucaagcaccacaccca

SEQ ID NO: 101639 - RNA, 24 nt, Human
cccaaaguguuagaauuacaagca

SEQ ID NO: 101640 - RNA, 23 nt, Human
cccaaaguguuaggauuacaggc

SEQ ID NO: 101641 - RNA, 24 nt, Human
cccaaaguguuaggauuacaggca

SEQ ID NO: 101642 - RNA, 32 nt, Human
cccaaaguguuaggauuacaggcaugagccac

SEQ ID NO: 101643 - RNA, 20 nt, Human
cccaaaguguucggauuaca

SEQ ID NO: 101644 - RNA, 24 nt, Human
cccaaaguguugagauuacaggca

SEQ ID NO: 101645 - RNA, 24 nt, Human
cccaaaguguugggauuacagaca

SEQ ID NO: 101646 - RNA, 22 nt, Human
cccaaaguguugggauuacagg

SEQ ID NO: 101647 - RNA, 23 nt, Human
cccaaaguguugggauuacaggc

SEQ ID NO: 101648 - RNA, 24 nt, Human
cccaaaguguugggauuacaggca

SEQ ID NO: 101649 - RNA, 24 nt, Human
cccaaaguguugggauuauaggca

SEQ ID NO: 101650 - RNA, 24 nt, Human
cccaaaguguugggauugcaggca

SEQ ID NO: 101651 - RNA, 24 nt, Human
cccaaaguucagggauuacaggca

SEQ ID NO: 101652 - RNA, 24 nt, Human
cccaaaguucugggaguacagaca

SEQ ID NO: 101653 - RNA, 24 nt, Human
cccaaaguucugggauuacaagua

SEQ ID NO: 101654 - RNA, 23 nt, Human
cccaaaguucugggauuacaggc

SEQ ID NO: 101655 - RNA, 24 nt, Human
cccaaaguucugggauuacaggca

SEQ ID NO: 101656 - RNA, 32 nt, Human
cccaaaguugcccaggcuggucucaaacucuc

SEQ ID NO: 101657 - RNA, 32 nt, Human
cccaaauaagaacagugaucuuauaaccucau

SEQ ID NO: 101658 - RNA, 32 nt, Human
cccaaauacugcacuuuuugcacagucuuagc

SEQ ID NO: 101659 - RNA, 32 nt, Human
cccaaauagaccccaucucuugcucaguugcu

SEQ ID NO: 101660 - RNA, 23 nt, Human
cccaaauagcuaggacuacaggc

SEQ ID NO: 101661 - RNA, 32 nt, Human
cccaaauaggaggaaaacacagccucccugag

SEQ ID NO: 101662 - RNA, 32 nt, Human
cccaaauaucuagauauuuucucuucaccgca

SEQ ID NO: 101663 - RNA, 32 nt, Human
cccaaauaugugcucaccagcagcaacaggcu

SEQ ID NO: 101664 - RNA, 21 nt, Human
cccaaaucaauaagaagguag

SEQ ID NO: 101665 - RNA, 32 nt, Human
cccaaauccauagcucuggacgugucccaggc

SEQ ID NO: 101666 - RNA, 32 nt, Human
cccaaauccauucaacaagggugcagccugcc

SEQ ID NO: 101667 - RNA, 32 nt, Human
cccaaaucccugggcccccucagucugggcaa

SEQ ID NO: 101668 - RNA, 32 nt, Human
cccaaaucuagggagagacuccugagccugag

SEQ ID NO: 101669 - RNA, 32 nt, Human
cccaaaucucaucugagugagucagcugaggg

SEQ ID NO: 101670 - RNA, 19 nt, Human
cccaaaucucccaaaggaa

SEQ ID NO: 101671 - RNA, 32 nt, Human
cccaaaucucucucccaguacaccaguuguuc

SEQ ID NO: 101672 - RNA, 32 nt, Human
cccaaaucuugggggagaaugaaggaaaccug

SEQ ID NO: 101673 - RNA, 32 nt, Human
cccaaaugacuccuccccuucguuggcccgcc

SEQ ID NO: 101674 - RNA, 32 nt, Human
cccaaaugagccacuuuccucuccaggugaag

SEQ ID NO: 101675 - RNA, 22 nt, Human
cccaaaugcaaaagccagagaa

SEQ ID NO: 101676 - RNA, 32 nt, Human
cccaaaugcuggcuggccuugugguccaaaua

SEQ ID NO: 101677 - RNA, 23 nt, Human
cccaaaugcugggauuacagaca

SEQ ID NO: 101678 - RNA, 32 nt, Human
cccaaauggaaaugggcagagcagagaccauc

SEQ ID NO: 101679 - RNA, 32 nt, Human
cccaaauggaaauguauucacacagggaguaa

SEQ ID NO: 101680 - RNA, 32 nt, Human
cccaaauggaguccacuuuagcacagggguuu

SEQ ID NO: 101681 - RNA, 32 nt, Human
cccaaaugggaaauuucucaggaagagacauu

SEQ ID NO: 101682 - RNA, 32 nt, Human
cccaaauguccauccacaguugaagcuacagu

SEQ ID NO: 101683 - RNA, 32 nt, Human
cccaaaugucugugcagugucagggcugcacc

SEQ ID NO: 101684 - RNA, 32 nt, Human
cccaaauguguaguguggucugggcaggcaga

SEQ ID NO: 101685 - RNA, 32 nt, Human
cccaaauucagccccacccacagagaagccuu

SEQ ID NO: 101686 - RNA, 24 nt, Human
cccaaauugccgggauuacaggca

SEQ ID NO: 101687 - RNA, 24 nt, Human
cccaaauugcugggauuacaggca

SEQ ID NO: 101688 - RNA, 32 nt, Human
cccaaauuuaaagaaguaugggaaaugagagg

SEQ ID NO: 101689 - RNA, 32 nt, Human
cccaaauuuggaguaaagaugggagaaaauaa

SEQ ID NO: 101690 - RNA, 32 nt, Human
cccaacaaaacaguaagggagcauuucaggga

SEQ ID NO: 101691 - RNA, 32 nt, Human
cccaacaaacuagaagucacacuggagagaaa

SEQ ID NO: 101692 - RNA, 32 nt, Human
cccaacaaccaccauccccauggcuucuuuua

SEQ ID NO: 101693 - RNA, 32 nt, Human
cccaacaaccguugccaccacgcccagaaacg

SEQ ID NO: 101694 - RNA, 32 nt, Human
cccaacaagcagcuggguuaggaaaaccaugg

SEQ ID NO: 101695 - RNA, 19 nt, Human
cccaacaaggggacaggac

SEQ ID NO: 101696 - RNA, 32 nt, Human
cccaacacaauccuugauuuuaccccugggaa

SEQ ID NO: 101697 - RNA, 23 nt, Human
cccaacacacgguccacagcuca

SEQ ID NO: 101698 - RNA, 32 nt, Human
cccaacacagaagauguagcaguuccugaaca

SEQ ID NO: 101699 - RNA, 32 nt, Human
cccaacacagcaagaaagcccacugaguccac

SEQ ID NO: 101700 - RNA, 32 nt, Human
cccaacacauacuguuuccaaaauuauuucua

SEQ ID NO: 101701 - RNA, 32 nt, Human
cccaacacccagguaauuuuuguauuuuuagu

SEQ ID NO: 101702 - RNA, 18 nt, Human
cccaacaccgccuuccca

SEQ ID NO: 101703 - RNA, 32 nt, Human
cccaacacuccccauucccaguugacucagcu

SEQ ID NO: 101704 - RNA, 32 nt, Human
cccaacacuguacccagcugguugggaggacc

SEQ ID NO: 101705 - RNA, 20 nt, Human
cccaacacuguccacacugc

SEQ ID NO: 101706 - RNA, 32 nt, Human
cccaacacuuagggagucaggagaaucacuug

SEQ ID NO: 101707 - RNA, 32 nt, Human
cccaacacuucaucauccaccaccuccuggag

SEQ ID NO: 101708 - RNA, 32 nt, Human
cccaacacuuuugcuuucuucuccaucucuga

SEQ ID NO: 101709 - RNA, 32 nt, Human
cccaacacuuuuuccauuucuucagagggaaa

SEQ ID NO: 101710 - RNA, 32 nt, Human
cccaacagaggaggccagugaggcagagacag

SEQ ID NO: 101711 - RNA, 24 nt, Human
cccaacagccagcccuucauccuc

SEQ ID NO: 101712 - RNA, 32 nt, Human
cccaacagcucauuuucccuaguccgccuucg

SEQ ID NO: 101713 - RNA, 19 nt, Human
cccaacagcuggacccuga

SEQ ID NO: 101714 - RNA, 22 nt, Human
cccaacagcuguuccuccccuc

SEQ ID NO: 101715 - RNA, 32 nt, Human
cccaacaggagaaagacaggcucuuuuucuuu

SEQ ID NO: 101716 - RNA, 17 nt, Human
cccaacagggccacugu

SEQ ID NO: 101717 - RNA, 32 nt, Human
cccaacagguucuagaaacacgcccuuguaca

SEQ ID NO: 101718 - RNA, 32 nt, Human
cccaacagugucgucagaggguccccagggca

SEQ ID NO: 101719 - RNA, 32 nt, Human
cccaacaguucuuccucuuucucuccaccaaa

SEQ ID NO: 101720 - RNA, 32 nt, Human
cccaacaguugcuguuccucaggccaaaguuc

SEQ ID NO: 101721 - RNA, 32 nt, Human
cccaacaguugguugucuugucuuccagggug

SEQ ID NO: 101722 - RNA, 32 nt, Human
cccaacaugauuuuggaaagauauaauuucuu

SEQ ID NO: 101723 - RNA, 32 nt, Human
cccaacaugccuuucagaaagaaaugacacaa

SEQ ID NO: 101724 - RNA, 20 nt, Human
cccaacauggccaccgggca

SEQ ID NO: 101725 - RNA, 32 nt, Human
cccaacauuacuaacaaugauacaguugcaug

SEQ ID NO: 101726 - RNA, 32 nt, Human
cccaacauucagcucagcugccucuuucuuga

SEQ ID NO: 101727 - RNA, 32 nt, Human
cccaaccaaaaccacaccauaggguuuucugc

SEQ ID NO: 101728 - RNA, 28 nt, Human
cccaaccaauaaaguaaccacuuucagc

SEQ ID NO: 101729 - RNA, 32 nt, Human
cccaaccaauaaaguaaccacuuucagcaaaa

SEQ ID NO: 101730 - RNA, 32 nt, Human
cccaaccacagugggagccagacugaauauag

SEQ ID NO: 101731 - RNA, 23 nt, Human
cccaaccaccaccuggucuccca

SEQ ID NO: 101732 - RNA, 21 nt, Human
cccaaccaccagcagcagcag

SEQ ID NO: 101733 - RNA, 18 nt, Human
cccaaccaccauccccuu

SEQ ID NO: 101734 - RNA, 32 nt, Human
cccaaccaccauuucugcuguguccuuaggau

SEQ ID NO: 101735 - RNA, 32 nt, Human
cccaaccaccuugcaccagucuucucauucuc

SEQ ID NO: 101736 - RNA, 23 nt, Human
cccaaccacuuguccacacagcu

SEQ ID NO: 101737 - RNA, 32 nt, Human
cccaaccagacagcucagguugugcaucugau

SEQ ID NO: 101738 - RNA, 24 nt, Human
cccaaccagcccagcuucuccuua

SEQ ID NO: 101739 - RNA, 22 nt, Human
cccaaccagccggaccucagca

SEQ ID NO: 101740 - RNA, 32 nt, Human
cccaaccaggaagucugaauuccaguaucugg

SEQ ID NO: 101741 - RNA, 32 nt, Human
cccaaccaggcaccucuuccuugauguuuggg

SEQ ID NO: 101742 - RNA, 32 nt, Human
cccaaccaugccaaaacauaccagagagcauu

SEQ ID NO: 101743 - RNA, 32 nt, Human
cccaacccaagugucagagaagcuggcaagag

SEQ ID NO: 101744 - RNA, 26 nt, Human
cccaacccaggcuagccagccuuuua

SEQ ID NO: 101745 - RNA, 32 nt, Human
cccaaccccagagcuucacuugcuccuucacu

SEQ ID NO: 101746 - RNA, 32 nt, Human
cccaaccccaggaaggaaggccuuggauggac

SEQ ID NO: 101747 - RNA, 32 nt, Human
cccaaccccaggcucggacuguggugccaagg

SEQ ID NO: 101748 - RNA, 32 nt, Human
cccaaccccagucccagccccaaccacguccc

SEQ ID NO: 101749 - RNA, 32 nt, Human
cccaaccccaucucagagcucagaggguacaa

SEQ ID NO: 101750 - RNA, 19 nt, Human
cccaaccccaucucugggc

SEQ ID NO: 101751 - RNA, 23 nt, Human
cccaaccccaucucugggcccag

SEQ ID NO: 101752 - RNA, 32 nt, Human
cccaaccccauugcuaacaacaugguacauuc

SEQ ID NO: 101753 - RNA, 21 nt, Human
cccaaccccauuuccucuccc

SEQ ID NO: 101754 - RNA, 21 nt, Human
cccaacccccagcccucaccc

SEQ ID NO: 101755 - RNA, 32 nt, Human
cccaacccccucgggccccaugggucaggggg

SEQ ID NO: 101756 - RNA, 32 nt, Human
cccaaccccucagagcagauucccagauuaac

SEQ ID NO: 101757 - RNA, 18 nt, Human
cccaaccccuccuuuccc

SEQ ID NO: 101758 - RNA, 32 nt, Human
cccaaccccugcccugggcugaggcauaugaa

SEQ ID NO: 101759 - RNA, 32 nt, Human
cccaaccccugcuccagccacgccaacccuuu

SEQ ID NO: 101760 - RNA, 32 nt, Human
cccaaccccuuuccucgcaccuccuuguccuc

SEQ ID NO: 101761 - RNA, 32 nt, Human
cccaacccgacugcccuaccagccugcacaug

SEQ ID NO: 101762 - RNA, 32 nt, Human
cccaacccucaccccacucugccucccuguca

SEQ ID NO: 101763 - RNA, 32 nt, Human
cccaacccucagccguuccuccaccucucagc

SEQ ID NO: 101764 - RNA, 32 nt, Human
cccaacccucauucugcagggccaccuggugu

SEQ ID NO: 101765 - RNA, 32 nt, Human
cccaacccuccaguaacccagcaggacgggga

SEQ ID NO: 101766 - RNA, 32 nt, Human
cccaacccugcgcgauggugacucugggcgcg

SEQ ID NO: 101767 - RNA, 21 nt, Human
cccaacccuggcacccagggu

SEQ ID NO: 101768 - RNA, 32 nt, Human
cccaacccuuccccacugcacacaccucagag

SEQ ID NO: 101769 - RNA, 32 nt, Human
cccaacccuucuuccagggucagggaggaaag

SEQ ID NO: 101770 - RNA, 32 nt, Human
cccaaccgaccagcaaccccaauuuuccagcc

SEQ ID NO: 101771 - RNA, 20 nt, Human
cccaaccgccgccuacccca

SEQ ID NO: 101772 - RNA, 32 nt, Human
cccaaccggucugccuuuaauuuuacccagga

SEQ ID NO: 101773 - RNA, 32 nt, Human
cccaaccuccccucguuuuugaccuuuguccc

SEQ ID NO: 101774 - RNA, 32 nt, Human
cccaaccuccuuggacugcaaacaaucuagga

SEQ ID NO: 101775 - RNA, 32 nt, Human
cccaaccucuacuacacacuuagugcuuucuc

SEQ ID NO: 101776 - RNA, 32 nt, Human
cccaaccucuacuguaaacuuucugguccgag

SEQ ID NO: 101777 - RNA, 24 nt, Human
cccaaccucuggguacccccgggu

SEQ ID NO: 101778 - RNA, 25 nt, Human
cccaaccugagagucuuuccccuuu

SEQ ID NO: 101779 - RNA, 20 nt, Human
cccaaccugccaggcuccca

SEQ ID NO: 101780 - RNA, 32 nt, Human
cccaaccugccucucaccagcucugugaccuu

SEQ ID NO: 101781 - RNA, 20 nt, Human
cccaaccuggagugcagugg

SEQ ID NO: 101782 - RNA, 32 nt, Human
cccaaccuggcuugacaggcuuggucucugca

SEQ ID NO: 101783 - RNA, 32 nt, Human
cccaaccugggcgacagagccagacucugucu

SEQ ID NO: 101784 - RNA, 25 nt, Human
cccaaccugucccacccccgugccc

SEQ ID NO: 101785 - RNA, 32 nt, Human
cccaaccuucccccuaccuccuggcccuuuuu

SEQ ID NO: 101786 - RNA, 31 nt, Human
cccaacgagcacuucugacaaugagaccaga

SEQ ID NO: 101787 - RNA, 32 nt, Human
cccaacgauggguaacgccagcuuuggcucca

SEQ ID NO: 101788 - RNA, 23 nt, Human
cccaacgccagcccuucauccuu

SEQ ID NO: 101789 - RNA, 19 nt, Human
cccaacgcccccugaggaa

SEQ ID NO: 101790 - RNA, 32 nt, Human
cccaacgcggucugguuuuccagccugggagu

SEQ ID NO: 101791 - RNA, 32 nt, Human
cccaacggagagcuagggagaaaggagacucc

SEQ ID NO: 101792 - RNA, 32 nt, Human
cccaacgggaaaggaaacgccccgggcaaagg

SEQ ID NO: 101793 - RNA, 32 nt, Human
cccaacgggaggauggcuucacagcagagcca

SEQ ID NO: 101794 - RNA, 32 nt, Human
cccaacgugauucuccccagcucugagucucu

SEQ ID NO: 101795 - RNA, 24 nt, Human
cccaacgugcugggauuacaggca

SEQ ID NO: 101796 - RNA, 32 nt, Human
cccaacguuuuccuuuccuucucccauaaaca

SEQ ID NO: 101797 - RNA, 32 nt, Human
cccaacuaaagugcuugaggcuaccucuaccu

SEQ ID NO: 101798 - RNA, 24 nt, Human
cccaacuaagcacuucccugagga

SEQ ID NO: 101799 - RNA, 21 nt, Human
cccaacuaagucccuucaucu

SEQ ID NO: 101800 - RNA, 24 nt, Human
cccaacuaagugggacuacaggca

SEQ ID NO: 101801 - RNA, 32 nt, Human
cccaacuacaucuucccugcuuacucucugcc

SEQ ID NO: 101802 - RNA, 20 nt, Human
cccaacuacguccagcgcug

SEQ ID NO: 101803 - RNA, 32 nt, Human
cccaacuagaggaagcaaggaggcagagacca

SEQ ID NO: 101804 - RNA, 19 nt, Human
cccaacuagaguguagugg

SEQ ID NO: 101805 - RNA, 23 nt, Human
cccaacucacaacaggcuggaug

SEQ ID NO: 101806 - RNA, 18 nt, Human
cccaacucacccaugagg

SEQ ID NO: 101807 - RNA, 32 nt, Human
cccaacucagacacaaagccacagacaauaug

SEQ ID NO: 101808 - RNA, 32 nt, Human
cccaacucaugcugucaggccauuuccaggcc

SEQ ID NO: 101809 - RNA, 32 nt, Human
cccaacucauucuuacugcacaguucacuuua

SEQ ID NO: 101810 - RNA, 32 nt, Human
cccaacucauuuaaaauaggaggaaucacuuu

SEQ ID NO: 101811 - RNA, 24 nt, Human
cccaacuccaaacaauucugauga

SEQ ID NO: 101812 - RNA, 17 nt, Human
cccaacuccagggaccu

SEQ ID NO: 101813 - RNA, 19 nt, Human
cccaacucccaaaagcuag

SEQ ID NO: 101814 - RNA, 32 nt, Human
cccaacucccuguucuggcuccugggugggga

SEQ ID NO: 101815 - RNA, 21 nt, Human
cccaacucccuucugcuuguc

SEQ ID NO: 101816 - RNA, 32 nt, Human
cccaacucucugagagaagcagaccagaaaga

SEQ ID NO: 101817 - RNA, 32 nt, Human
cccaacucugcagggcuucucucccugccacc

SEQ ID NO: 101818 - RNA, 32 nt, Human
cccaacucugccuuccuggaacuaggccugcg

SEQ ID NO: 101819 - RNA, 32 nt, Human
cccaacucuggcucugccaccugcugcuccug

SEQ ID NO: 101820 - RNA, 32 nt, Human
cccaacucuguggggcugagcaacauuuuuac

SEQ ID NO: 101821 - RNA, 27 nt, Human
cccaacugaaacaccagaagguuugga

SEQ ID NO: 101822 - RNA, 32 nt, Human
cccaacugaagcugcaucucaaagccgaagau

SEQ ID NO: 101823 - RNA, 19 nt, Human
cccaacugacccugaagaa

SEQ ID NO: 101824 - RNA, 19 nt, Human
cccaacugagcacaccauc

SEQ ID NO: 101825 - RNA, 32 nt, Human
cccaacugccggaaggugaaaguguucuguga

SEQ ID NO: 101826 - RNA, 17 nt, Human
cccaacugccugccuua

SEQ ID NO: 101827 - RNA, 32 nt, Human
cccaacugcugauuuuacagccccagggaaga

SEQ ID NO: 101828 - RNA, 32 nt, Human
cccaacugcugucugcucagguguagcccgcg

SEQ ID NO: 101829 - RNA, 23 nt, Human
cccaacuggaggguagguuagaa

SEQ ID NO: 101830 - RNA, 22 nt, Human
cccaacuggcuuuaaaauugaa

SEQ ID NO: 101831 - RNA, 32 nt, Human
cccaacuggggaagagauggcagagggucccc

SEQ ID NO: 101832 - RNA, 24 nt, Human
cccaacugggggcaaagguuugaa

SEQ ID NO: 101833 - RNA, 22 nt, Human
cccaacugggguugcgucugag

SEQ ID NO: 101834 - RNA, 18 nt, Human
cccaacugggugcagugg

SEQ ID NO: 101835 - RNA, 23 nt, Human
cccaacugguuuaaagcccugaa

SEQ ID NO: 101836 - RNA, 32 nt, Human
cccaacuguaccacgggcaugaggagcugaag

SEQ ID NO: 101837 - RNA, 32 nt, Human
cccaacugucucagguacauguuaguguuuaa

SEQ ID NO: 101838 - RNA, 24 nt, Human
cccaacuguguggaggcugaguga

SEQ ID NO: 101839 - RNA, 23 nt, Human
cccaacuuagagggugguugggg

SEQ ID NO: 101840 - RNA, 21 nt, Human
cccaacuuagauugccuucug

SEQ ID NO: 101841 - RNA, 23 nt, Human
cccaacuuagauugccuucuggg

SEQ ID NO: 101842 - RNA, 32 nt, Human
cccaacuuagccacgucuggccuguguccuug

SEQ ID NO: 101843 - RNA, 32 nt, Human
cccaacuucauggaggccagaagacuuuacuu

SEQ ID NO: 101844 - RNA, 32 nt, Human
cccaacuuccagggagacugaauuucuucugc

SEQ ID NO: 101845 - RNA, 32 nt, Human
cccaacuuccuugccacaagcuucccaggcuu

SEQ ID NO: 101846 - RNA, 32 nt, Human
cccaacuucuccccggcagcucugccucccua

SEQ ID NO: 101847 - RNA, 20 nt, Human
cccaacuugagacuacucug

SEQ ID NO: 101848 - RNA, 32 nt, Human
cccaacuugcagcugcccaccucacccucagc

SEQ ID NO: 101849 - RNA, 24 nt, Human
cccaacuugggaaacccucugggg

SEQ ID NO: 101850 - RNA, 24 nt, Human
cccaacuuggucccugcccuaggg

SEQ ID NO: 101851 - RNA, 32 nt, Human
cccaacuuuagcaacucucacucuacugaucc

SEQ ID NO: 101852 - RNA, 20 nt, Human
cccaacuuucccccuccuca

SEQ ID NO: 101853 - RNA, 32 nt, Human
cccaacuuucuuucccacucuucucugggacu

SEQ ID NO: 101854 - RNA, 32 nt, Human
cccaagaaaaagagagggcauggguugcggag

SEQ ID NO: 101855 - RNA, 25 nt, Human
cccaagaaaacacccauuuccucuu

SEQ ID NO: 101856 - RNA, 21 nt, Human
cccaagaaaauuuuuccucuu

SEQ ID NO: 101857 - RNA, 32 nt, Human
cccaagaaaccagggacuuacgcauuuggcca

SEQ ID NO: 101858 - RNA, 32 nt, Human
cccaagaaacguauacuuuaacaacaaaggaa

SEQ ID NO: 101859 - RNA, 32 nt, Human
cccaagaagagucccagccccacgccggcuac

SEQ ID NO: 101860 - RNA, 32 nt, Human
cccaagaagcgcgggucacaaggagagggguc

SEQ ID NO: 101861 - RNA, 32 nt, Human
cccaagaagcugaauuggggugcagugccgcc

SEQ ID NO: 101862 - RNA, 24 nt, Human
cccaagaagcugggauuacaggca

SEQ ID NO: 101863 - RNA, 18 nt, Human
cccaagaaggccaugagg

SEQ ID NO: 101864 - RNA, 32 nt, Human
cccaagaaguggagguugcagugagccaagau

SEQ ID NO: 101865 - RNA, 32 nt, Human
cccaagacacccccaacagauaccagcaugua

SEQ ID NO: 101866 - RNA, 32 nt, Human
cccaagacaccgcucagccaugaagaugcauu

SEQ ID NO: 101867 - RNA, 32 nt, Human
cccaagacaccuuucagccucuuuacaaccuc

SEQ ID NO: 101868 - RNA, 32 nt, Human
cccaagacagaaguacuuggaggagccagcug

SEQ ID NO: 101869 - RNA, 26 nt, Human
cccaagacauggggacuuugcaguga

SEQ ID NO: 101870 - RNA, 32 nt, Human
cccaagacauggggacuuugcagugagcaaug

SEQ ID NO: 101871 - RNA, 32 nt, Human
cccaagaccacagccagguaagggcggggcag

SEQ ID NO: 101872 - RNA, 32 nt, Human
cccaagacccgccaggcacaccugccagagug

SEQ ID NO: 101873 - RNA, 32 nt, Human
cccaagaccuggaggcucucuccagcugcuga

SEQ ID NO: 101874 - RNA, 32 nt, Human
cccaagacgggaacuccuccuuccugcuucag

SEQ ID NO: 101875 - RNA, 32 nt, Human
cccaagacuagugugcuuucugcuacacugcu

SEQ ID NO: 101876 - RNA, 32 nt, Human
cccaagacucaagagcuccugucucaccagug

SEQ ID NO: 101877 - RNA, 32 nt, Human
cccaagacugggugagagucuuggcagagccu

SEQ ID NO: 101878 - RNA, 21 nt, Human
cccaagagaaaccccucuggg

SEQ ID NO: 101879 - RNA, 32 nt, Human
cccaagagacaggcccagagccuaaaggcaag

SEQ ID NO: 101880 - RNA, 32 nt, Human
cccaagagacaguccugaugggcacaggcugc

SEQ ID NO: 101881 - RNA, 32 nt, Human
cccaagagagcagaaaagggauguaguugcca

SEQ ID NO: 101882 - RNA, 32 nt, Human
cccaagagaggaagcagagggaggcggaagcg

SEQ ID NO: 101883 - RNA, 32 nt, Human
cccaagagcccaugggucggggaguggguuug

SEQ ID NO: 101884 - RNA, 23 nt, Human
cccaagagcuccugggagcacca

SEQ ID NO: 101885 - RNA, 32 nt, Human
cccaagagcugcagcgaaguugcaggaugcaa

SEQ ID NO: 101886 - RNA, 32 nt, Human
cccaagaggagaaggaaugcgaaagaggauuu

SEQ ID NO: 101887 - RNA, 31 nt, Human
cccaagaggagcagagaaaacuggaagaaga

SEQ ID NO: 101888 - RNA, 21 nt, Human
cccaagaggcacuagcugggg

SEQ ID NO: 101889 - RNA, 24 nt, Human
cccaagaggcagaggaugcaauga

SEQ ID NO: 101890 - RNA, 24 nt, Human
cccaagaggcagaggucgcaguga

SEQ ID NO: 101891 - RNA, 21 nt, Human
cccaagaggcagagguugagu

SEQ ID NO: 101892 - RNA, 23 nt, Human
cccaagaggcagagguugaguaa

SEQ ID NO: 101893 - RNA, 21 nt, Human
cccaagaggcagagguugcag

SEQ ID NO: 101894 - RNA, 24 nt, Human
cccaagaggcagagguuguaauga

SEQ ID NO: 101895 - RNA, 24 nt, Human
cccaagaggcagaguuugcaguga

SEQ ID NO: 101896 - RNA, 32 nt, Human
cccaagaggcagaguuugcagugagcugagau

SEQ ID NO: 101897 - RNA, 24 nt, Human
cccaagaggcggagacugcaguga

SEQ ID NO: 101898 - RNA, 32 nt, Human
cccaagaggcggagguugaguaagcugagaac

SEQ ID NO: 101899 - RNA, 32 nt, Human
cccaagaggcggagguugcagugagccaagau

SEQ ID NO: 101900 - RNA, 23 nt, Human
cccaagaggcggagguuguggug

SEQ ID NO: 101901 - RNA, 24 nt, Human
cccaagaggcggagguugugguga

SEQ ID NO: 101902 - RNA, 32 nt, Human
cccaagaggcggagguuguggugagccgagau

SEQ ID NO: 101903 - RNA, 22 nt, Human
cccaagaggcuagccccagggu

SEQ ID NO: 101904 - RNA, 20 nt, Human
cccaagaggcuccugaggaa

SEQ ID NO: 101905 - RNA, 32 nt, Human
cccaagagggugcuucgagggugaggacuucu

SEQ ID NO: 101906 - RNA, 24 nt, Human
cccaagagguacuggaagagccag

SEQ ID NO: 101907 - RNA, 24 nt, Human
cccaagagguagagguugcaguga

SEQ ID NO: 101908 - RNA, 32 nt, Human
cccaagagguagagguugcagugagccaagau

SEQ ID NO: 101909 - RNA, 24 nt, Human
cccaagaggucaaggcuucaguga

SEQ ID NO: 101910 - RNA, 32 nt, Human
cccaagaggucaaggcuucagugagccaugau

SEQ ID NO: 101911 - RNA, 23 nt, Human
cccaagagguccaaggcugcagu

SEQ ID NO: 101912 - RNA, 25 nt, Human
cccaagagguccaaggcugcaguga

SEQ ID NO: 101913 - RNA, 32 nt, Human
cccaagagguccaaggcugcagugagccaugu

SEQ ID NO: 101914 - RNA, 32 nt, Human
cccaagagguccaggcugcagccugggugaca

SEQ ID NO: 101915 - RNA, 22 nt, Human
cccaagaggucgaggcugcagu

SEQ ID NO: 101916 - RNA, 24 nt, Human
cccaagaggucgaggcugcaguga

SEQ ID NO: 101917 - RNA, 32 nt, Human
cccaagaggucgaggcugcagugagccaagau

SEQ ID NO: 101918 - RNA, 32 nt, Human
cccaagaggugcaggcacugagccucucagga

SEQ ID NO: 101919 - RNA, 24 nt, Human
cccaagagguggagguuacaguga

SEQ ID NO: 101920 - RNA, 32 nt, Human
cccaagagguggagguuacagugagcagagau

SEQ ID NO: 101921 - RNA, 23 nt, Human
cccaagagguggagguugcggug

SEQ ID NO: 101922 - RNA, 24 nt, Human
cccaagagguggagguugcgguga

SEQ ID NO: 101923 - RNA, 24 nt, Human
cccaagagguugaggcugcaguga

SEQ ID NO: 101924 - RNA, 32 nt, Human
cccaagagguugaggcugcagugagccaugau

SEQ ID NO: 101925 - RNA, 23 nt, Human
cccaagaguaugcauucuuacca

SEQ ID NO: 101926 - RNA, 24 nt, Human
cccaagaguccaaggcugcaguga

SEQ ID NO: 101927 - RNA, 32 nt, Human
cccaagaguuagaacaguuggauacaggagaa

SEQ ID NO: 101928 - RNA, 24 nt, Human
cccaagaguucaaggcugcaguga

SEQ ID NO: 101929 - RNA, 23 nt, Human
cccaagaguugaggcuucaguga

SEQ ID NO: 101930 - RNA, 22 nt, Human
cccaagaguuggccucgcagga

SEQ ID NO: 101931 - RNA, 31 nt, Human
cccaagauggaggcuaaucacucugaacagc

SEQ ID NO: 101932 - RNA, 31 nt, Human
cccaagauggccaggaacugcucugagugca

SEQ ID NO: 101933 - RNA, 31 nt, Human
cccaagaugucgcagacggccauguccgaaa

SEQ ID NO: 101934 - RNA, 32 nt, Human
cccaagauguugauuuuuacuguguuuuauaa

SEQ ID NO: 101935 - RNA, 23 nt, Human
cccaagcaaacacagggugcuuc

SEQ ID NO: 101936 - RNA, 32 nt, Human
cccaagcaacaucucagcaucucuuaaaguug

SEQ ID NO: 101937 - RNA, 23 nt, Human
cccaagcaagccagugagcagcc

SEQ ID NO: 101938 - RNA, 32 nt, Human
cccaagcaauauagcaagaccuccaucucuac

SEQ ID NO: 101939 - RNA, 32 nt, Human
cccaagcacagcccugacuaggaugacagcag

SEQ ID NO: 101940 - RNA, 32 nt, Human
cccaagcacaugcacacauaaacacacacgua

SEQ ID NO: 101941 - RNA, 32 nt, Human
cccaagcaccggugcagccaggaccacccgcu

SEQ ID NO: 101942 - RNA, 24 nt, Human
cccaagcaccugggauuacaagca

SEQ ID NO: 101943 - RNA, 32 nt, Human
cccaagcaccuuggccuccucucagcucgccg

SEQ ID NO: 101944 - RNA, 32 nt, Human
cccaagcagacacaacagcagcacagaggucu

SEQ ID NO: 101945 - RNA, 23 nt, Human
cccaagcagacaccacgugcucc

SEQ ID NO: 101946 - RNA, 32 nt, Human
cccaagcagagcuggagagagauggccuaagg

SEQ ID NO: 101947 - RNA, 32 nt, Human
cccaagcagcaacgagcaacaaucggaaacca

SEQ ID NO: 101948 - RNA, 32 nt, Human
cccaagcagcauucagcacaccccaagggaca

SEQ ID NO: 101949 - RNA, 32 nt, Human
cccaagcagccgcggccgcaguggaggcuaga

SEQ ID NO: 101950 - RNA, 24 nt, Human
cccaagcagccguuccccgacucc

SEQ ID NO: 101951 - RNA, 32 nt, Human
cccaagcagcugggacuacagacaucugaaug

SEQ ID NO: 101952 - RNA, 32 nt, Human
cccaagcaguaggucugugcucucccugucuc

SEQ ID NO: 101953 - RNA, 32 nt, Human
cccaagccaagccaucgcaaccccugugacuu

SEQ ID NO: 101954 - RNA, 32 nt, Human
cccaagccaaugcagacacugaccucaagacc

SEQ ID NO: 101955 - RNA, 32 nt, Human
cccaagccacauugcaaccaccucuuuuucuc

SEQ ID NO: 101956 - RNA, 28 nt, Human
cccaagccacugcacuucggaggggcug

SEQ ID NO: 101957 - RNA, 20 nt, Human
cccaagccagagugcagugg

SEQ ID NO: 101958 - RNA, 22 nt, Human
cccaagccagagugcaguggug

SEQ ID NO: 101959 - RNA, 32 nt, Human
cccaagccagcaccuuugguaaauaaagcagc

SEQ ID NO: 101960 - RNA, 32 nt, Human
cccaagcccacacccacaggggcucacugccc

SEQ ID NO: 101961 - RNA, 32 nt, Human
cccaagcccaccaggccaggaugcaggcaucc

SEQ ID NO: 101962 - RNA, 32 nt, Human
cccaagcccagagcacagcaauaaggucggcc

SEQ ID NO: 101963 - RNA, 21 nt, Human
cccaagcccagcccugugccc

SEQ ID NO: 101964 - RNA, 32 nt, Human
cccaagcccagcccuguggugggugaauggga

SEQ ID NO: 101965 - RNA, 32 nt, Human
cccaagcccaggaagucaagaaugcacugagc

SEQ ID NO: 101966 - RNA, 32 nt, Human
cccaagcccaggaguccuagcugaggcugcac

SEQ ID NO: 101967 - RNA, 32 nt, Human
cccaagcccaggaguuugaggcugcagugagu

SEQ ID NO: 101968 - RNA, 23 nt, Human
cccaagcccaggcugacugcccc

SEQ ID NO: 101969 - RNA, 32 nt, Human
cccaagcccauaaaugggaagggagacauggg

SEQ ID NO: 101970 - RNA, 17 nt, Human
cccaagcccccaacgcc

SEQ ID NO: 101971 - RNA, 21 nt, Human
cccaagcccccuccacucccu

SEQ ID NO: 101972 - RNA, 21 nt, Human
cccaagccccucccucuggcc

SEQ ID NO: 101973 - RNA, 24 nt, Human
cccaagcccucucgacugccccua

SEQ ID NO: 101974 - RNA, 32 nt, Human
cccaagcccucugguacucagggagcuggcug

SEQ ID NO: 101975 - RNA, 19 nt, Human
cccaagcccugccugccuc

SEQ ID NO: 101976 - RNA, 19 nt, Human
cccaagcccuuccuccccu

SEQ ID NO: 101977 - RNA, 32 nt, Human
cccaagcccuuccuccccuccaucaagaucuu

SEQ ID NO: 101978 - RNA, 18 nt, Human
cccaagccucaggaugga

SEQ ID NO: 101979 - RNA, 32 nt, Human
cccaagccucuucuaaaaaccauguugaauga

SEQ ID NO: 101980 - RNA, 22 nt, Human
cccaagccugccccgcuaccca

SEQ ID NO: 101981 - RNA, 32 nt, Human
cccaagccugcugggucucccuucccaguauc

SEQ ID NO: 101982 - RNA, 32 nt, Human
cccaagccugugguuugccucaguuugggugg

SEQ ID NO: 101983 - RNA, 32 nt, Human
cccaagccuucaacagaagcugugcugccacg

SEQ ID NO: 101984 - RNA, 20 nt, Human
cccaagccuucuccuuuccc

SEQ ID NO: 101985 - RNA, 18 nt, Human
cccaagcgccaccugcua

SEQ ID NO: 101986 - RNA, 20 nt, Human
cccaagcgcccuggccccca

SEQ ID NO: 101987 - RNA, 22 nt, Human
cccaagcgcucccagccagcuu

SEQ ID NO: 101988 - RNA, 32 nt, Human
cccaagcggaggaggagaaaaaggaauaagaa

SEQ ID NO: 101989 - RNA, 32 nt, Human
cccaagcggccacccgggccucagggaccccu

SEQ ID NO: 101990 - RNA, 32 nt, Human
cccaagcggccucagaagucccagggagugga

SEQ ID NO: 101991 - RNA, 32 nt, Human
cccaagcggugucucucauccugacuggggau

SEQ ID NO: 101992 - RNA, 31 nt, Human
cccaagcgugagagagugacugacacuuggu

SEQ ID NO: 101993 - RNA, 32 nt, Human
cccaagcuaccccagggggcucagaggaagaa

SEQ ID NO: 101994 - RNA, 32 nt, Human
cccaagcuaccucuaccaacccucucucucca

SEQ ID NO: 101995 - RNA, 20 nt, Human
cccaagcuagagugcagugg

SEQ ID NO: 101996 - RNA, 32 nt, Human
cccaagcuaguuucaaacuccugggcucaagc

SEQ ID NO: 101997 - RNA, 19 nt, Human
cccaagcuccaggggucuu

SEQ ID NO: 101998 - RNA, 23 nt, Human
cccaagcuccccuccccaagcuc

SEQ ID NO: 101999 - RNA, 32 nt, Human
cccaagcuccucacgugccuccuccccacagu

SEQ ID NO: 102000 - RNA, 32 nt, Human
cccaagcucggaucacaugaaggagacagcag

SEQ ID NO: 102001 - RNA, 18 nt, Human
cccaagcucggggccaug

SEQ ID NO: 102002 - RNA, 20 nt, Human
cccaagcucucaggccagcu

SEQ ID NO: 102003 - RNA, 32 nt, Human
cccaagcugagaagcugagagcuggaggacaa

SEQ ID NO: 102004 - RNA, 32 nt, Human
cccaagcugcagagcccagggaagagcagcuc

SEQ ID NO: 102005 - RNA, 32 nt, Human
cccaagcugcaggccucaggcccagccaucuc

SEQ ID NO: 102006 - RNA, 32 nt, Human
cccaagcuggaguacaguagugcaaucucagc

SEQ ID NO: 102007 - RNA, 20 nt, Human
cccaagcuggaguccagugg

SEQ ID NO: 102008 - RNA, 19 nt, Human
cccaagcuggagugcaaug

SEQ ID NO: 102009 - RNA, 32 nt, Human
cccaagcuggagugcacuggcaugauauuggc

SEQ ID NO: 102010 - RNA, 19 nt, Human
cccaagcuggagugcagug

SEQ ID NO: 102011 - RNA, 20 nt, Human
cccaagcuggagugcaguga

SEQ ID NO: 102012 - RNA, 20 nt, Human
cccaagcuggagugcagugg

SEQ ID NO: 102013 - RNA, 21 nt, Human
cccaagcuggagugcaguggc

SEQ ID NO: 102014 - RNA, 22 nt, Human
cccaagcuggagugcaguggug

SEQ ID NO: 102015 - RNA, 32 nt, Human
cccaagcuggccacagaugccacuacuucugu

SEQ ID NO: 102016 - RNA, 32 nt, Human
cccaagcugggagucaagucaccugcagauuu

SEQ ID NO: 102017 - RNA, 32 nt, Human
cccaagcuggucuggaacuccugggcucaagc

SEQ ID NO: 102018 - RNA, 32 nt, Human
cccaagcuguccauuucugugauggguuuuga

SEQ ID NO: 102019 - RNA, 32 nt, Human
cccaagcuuaccaccugcacccggagagcugu

SEQ ID NO: 102020 - RNA, 32 nt, Human
cccaagcuucuacacagcaaagcugcuacacu

SEQ ID NO: 102021 - RNA, 32 nt, Human
cccaagcuugaauuuucauucugccauugacu

SEQ ID NO: 102022 - RNA, 32 nt, Human
cccaaggaaaccuaaucaguacagugggaaac

SEQ ID NO: 102023 - RNA, 20 nt, Human
cccaaggaaccccugguguc

SEQ ID NO: 102024 - RNA, 32 nt, Human
cccaaggaacugcucccaccucagcacgugga

SEQ ID NO: 102025 - RNA, 24 nt, Human
cccaaggaacuggaucacccaaca

SEQ ID NO: 102026 - RNA, 21 nt, Human
cccaaggaaggccacuccaca

SEQ ID NO: 102027 - RNA, 32 nt, Human
cccaaggaauacagaagugcucuuauuaccag

SEQ ID NO: 102028 - RNA, 32 nt, Human
cccaaggacaugggacaggcaaagugugagcc

SEQ ID NO: 102029 - RNA, 15 nt, Human
cccaaggaccaggug

SEQ ID NO: 102030 - RNA, 22 nt, Human
cccaaggacccagcccucgccu

SEQ ID NO: 102031 - RNA, 32 nt, Human
cccaaggacccgauuccugggcuaggaaagag

SEQ ID NO: 102032 - RNA, 19 nt, Human
cccaaggacccugccagcc

SEQ ID NO: 102033 - RNA, 24 nt, Human
cccaaggacuuggccauccccuca

SEQ ID NO: 102034 - RNA, 32 nt, Human
cccaaggagacacccagacccuuccagcacgg

SEQ ID NO: 102035 - RNA, 26 nt, Human
cccaaggagaggacagggcacagaga

SEQ ID NO: 102036 - RNA, 25 nt, Human
cccaaggagaggggagcagagccgg

SEQ ID NO: 102037 - RNA, 32 nt, Human
cccaaggagaggggagcagagccggaguuggg

SEQ ID NO: 102038 - RNA, 23 nt, Human
cccaaggagcagcagcggagcgu

SEQ ID NO: 102039 - RNA, 24 nt, Human
cccaaggagcugggauuacaggca

SEQ ID NO: 102040 - RNA, 32 nt, Human
cccaaggaggagagaagagaagggaagccccg

SEQ ID NO: 102041 - RNA, 32 nt, Human
cccaaggaggcuggacaagaggcucaggucag

SEQ ID NO: 102042 - RNA, 32 nt, Human
cccaaggaggguacacaacuagcaccauucuu

SEQ ID NO: 102043 - RNA, 25 nt, Human
cccaaggaggucaaggcuguaguga

SEQ ID NO: 102044 - RNA, 21 nt, Human
cccaaggagucuuggacugca

SEQ ID NO: 102045 - RNA, 32 nt, Human
cccaaggaucacugcacccagcccaaggucuu

SEQ ID NO: 102046 - RNA, 32 nt, Human
cccaaggaugucugccacaccucuccaagccc

SEQ ID NO: 102047 - RNA, 32 nt, Human
cccaaggcaggagguacaccagcuggacaaau

SEQ ID NO: 102048 - RNA, 32 nt, Human
cccaaggcauccucugugucuccuacuaggga

SEQ ID NO: 102049 - RNA, 32 nt, Human
cccaaggcaugcuguggagagacuucaccugc

SEQ ID NO: 102050 - RNA, 22 nt, Human
cccaaggccagcucccaucuca

SEQ ID NO: 102051 - RNA, 32 nt, Human
cccaaggccaggaguucaagaccagccuggcc

SEQ ID NO: 102052 - RNA, 21 nt, Human
cccaaggccaggugucucuaa

SEQ ID NO: 102053 - RNA, 22 nt, Human
cccaaggccagucggccuggga

SEQ ID NO: 102054 - RNA, 23 nt, Human
cccaaggccagucggccugggaa

SEQ ID NO: 102055 - RNA, 21 nt, Human
cccaaggcccgggcggcgggg

SEQ ID NO: 102056 - RNA, 32 nt, Human
cccaaggcccucagaagcagauuauuccuguu

SEQ ID NO: 102057 - RNA, 32 nt, Human
cccaaggccgcggccccgacgcugggcccggg

SEQ ID NO: 102058 - RNA, 32 nt, Human
cccaaggccugaaggguugagaacagacagcu

SEQ ID NO: 102059 - RNA, 32 nt, Human
cccaaggccugcagaagccuccuggccuggcu

SEQ ID NO: 102060 - RNA, 32 nt, Human
cccaaggccuugcccaguggcaggggaaaggg

SEQ ID NO: 102061 - RNA, 22 nt, Human
cccaaggcggagcuugcaguga

SEQ ID NO: 102062 - RNA, 19 nt, Human
cccaaggcggagugcagug

SEQ ID NO: 102063 - RNA, 23 nt, Human
cccaaggcuaaaggcagagccag

SEQ ID NO: 102064 - RNA, 32 nt, Human
cccaaggcucacugcagcgcgcuccugacccc

SEQ ID NO: 102065 - RNA, 32 nt, Human
cccaaggcuccccucacagccucuccuuugcu

SEQ ID NO: 102066 - RNA, 32 nt, Human
cccaaggcugccuccagccccagcaacccggc

SEQ ID NO: 102067 - RNA, 19 nt, Human
cccaaggcuggagugcagu

SEQ ID NO: 102068 - RNA, 20 nt, Human
cccaaggcuggagugcagug

SEQ ID NO: 102069 - RNA, 21 nt, Human
cccaaggcuggagugcagugg

SEQ ID NO: 102070 - RNA, 32 nt, Human
cccaaggcuggcaaccugccucccauugccca

SEQ ID NO: 102071 - RNA, 32 nt, Human
cccaaggcuggcacagacuugagcaugggccg

SEQ ID NO: 102072 - RNA, 32 nt, Human
cccaagggacacaccuucccuggcauaaaggg

SEQ ID NO: 102073 - RNA, 32 nt, Human
cccaagggacuccggggucagguggagcaggc

SEQ ID NO: 102074 - RNA, 32 nt, Human
cccaagggagcagagggaggagaggugagggc

SEQ ID NO: 102075 - RNA, 23 nt, Human
cccaagggagcggccacagccca

SEQ ID NO: 102076 - RNA, 32 nt, Human
cccaagggaggaagcagagggaggcagaagcg

SEQ ID NO: 102077 - RNA, 32 nt, Human
cccaagggagguccccacagagccagagugcc

SEQ ID NO: 102078 - RNA, 32 nt, Human
cccaagggcagguggagaguccagggaggcag

SEQ ID NO: 102079 - RNA, 20 nt, Human
cccaagggccacggcuggga

SEQ ID NO: 102080 - RNA, 32 nt, Human
cccaagggccacucuugcccuggagaucuugg

SEQ ID NO: 102081 - RNA, 32 nt, Human
cccaagggcccaggcuguggcugacacauaga

SEQ ID NO: 102082 - RNA, 32 nt, Human
cccaagggccccugggcugugcccagguaacu

SEQ ID NO: 102083 - RNA, 23 nt, Human
cccaagggcccugggggcagcca

SEQ ID NO: 102084 - RNA, 32 nt, Human
cccaagggccgcaaguggcgugucggccgguc

SEQ ID NO: 102085 - RNA, 32 nt, Human
cccaagggccuggccugagcugggaugauugg

SEQ ID NO: 102086 - RNA, 17 nt, Human
cccaagggcuccuaccc

SEQ ID NO: 102087 - RNA, 32 nt, Human
cccaagggcugacauggugugagugugugggu

SEQ ID NO: 102088 - RNA, 32 nt, Human
cccaaggggaugggcccaggaggcagcugggu

SEQ ID NO: 102089 - RNA, 32 nt, Human
cccaaggggccagaaauucccaaguuggucac

SEQ ID NO: 102090 - RNA, 22 nt, Human
cccaaggggccuccggcugggg

SEQ ID NO: 102091 - RNA, 20 nt, Human
cccaagggggaauuagggga

SEQ ID NO: 102092 - RNA, 32 nt, Human
cccaaggggucgggcuucaagccuugacuucu

SEQ ID NO: 102093 - RNA, 24 nt, Human
cccaagggguggggguugcaguga

SEQ ID NO: 102094 - RNA, 27 nt, Human
cccaagggucagcccucuugacuguca

SEQ ID NO: 102095 - RNA, 19 nt, Human
cccaagggucugaggccag

SEQ ID NO: 102096 - RNA, 32 nt, Human
cccaagggugaguggccaauggggagcuguuu

SEQ ID NO: 102097 - RNA, 32 nt, Human
cccaagggugcccuuugggucccgguucagac

SEQ ID NO: 102098 - RNA, 32 nt, Human
cccaagggugugugugacuacaaguacacacu

SEQ ID NO: 102099 - RNA, 32 nt, Human
cccaaggguuaaagccacccagcauucacgaa

SEQ ID NO: 102100 - RNA, 20 nt, Human
cccaagguagagugcagugg

SEQ ID NO: 102101 - RNA, 25 nt, Human
cccaaggucagaggaguggcccuca

SEQ ID NO: 102102 - RNA, 32 nt, Human
cccaaggucaucugauaauuucacagaugcug

SEQ ID NO: 102103 - RNA, 32 nt, Human
cccaaggucaugcccugaccacagcugcccuu

SEQ ID NO: 102104 - RNA, 32 nt, Human
cccaaggucauugagcuguugaguggacagcu

SEQ ID NO: 102105 - RNA, 32 nt, Human
cccaagguccacccugucuggccacaggcacc

SEQ ID NO: 102106 - RNA, 32 nt, Human
cccaagguccagggcaggcgacaggaacgagc

SEQ ID NO: 102107 - RNA, 22 nt, Human
cccaaggugaagguauggcaua

SEQ ID NO: 102108 - RNA, 32 nt, Human
cccaaggugagccagcccuggggacccagcuc

SEQ ID NO: 102109 - RNA, 32 nt, Human
cccaaggugccacccccuagcaccuugucagg

SEQ ID NO: 102110 - RNA, 24 nt, Human
cccaaggugcuaggauuacaggca

SEQ ID NO: 102111 - RNA, 23 nt, Human
cccaaggugcuggauuacaggca

SEQ ID NO: 102112 - RNA, 24 nt, Human
cccaaggugcugggauuacaggca

SEQ ID NO: 102113 - RNA, 32 nt, Human
cccaaggugcuguauuuuucuaccucauggag

SEQ ID NO: 102114 - RNA, 32 nt, Human
cccaaggugggacuuggagaauauuuugcuug

SEQ ID NO: 102115 - RNA, 26 nt, Human
cccaagguggggggcaggggcccuca

SEQ ID NO: 102116 - RNA, 32 nt, Human
cccaagguggucacucucugguaccgagcccc

SEQ ID NO: 102117 - RNA, 32 nt, Human
cccaagguucaagugauucuccugccucagcc

SEQ ID NO: 102118 - RNA, 21 nt, Human
cccaagguugaggccgaguuc

SEQ ID NO: 102119 - RNA, 32 nt, Human
cccaagguugcucaagaaacagaugugagagc

SEQ ID NO: 102120 - RNA, 24 nt, Human
cccaaguaacugggauuacaggca

SEQ ID NO: 102121 - RNA, 24 nt, Human
cccaaguagccaggauuacaggca

SEQ ID NO: 102122 - RNA, 24 nt, Human
cccaaguagccggaauuacaggca

SEQ ID NO: 102123 - RNA, 23 nt, Human
cccaaguagcuaggacuacaggc

SEQ ID NO: 102124 - RNA, 24 nt, Human
cccaaguagcuaggacugcaggca

SEQ ID NO: 102125 - RNA, 24 nt, Human
cccaaguagcuaggauuacagaca

SEQ ID NO: 102126 - RNA, 24 nt, Human
cccaaguagcugagacuacaggca

SEQ ID NO: 102127 - RNA, 24 nt, Human
cccaaguagcugagauuacaggca

SEQ ID NO: 102128 - RNA, 24 nt, Human
cccaaguagcuggaacuacaggca

SEQ ID NO: 102129 - RNA, 24 nt, Human
cccaaguagcuggaauuacaggca

SEQ ID NO: 102130 - RNA, 32 nt, Human
cccaaguagcuggaauuacagggacccgccac

SEQ ID NO: 102131 - RNA, 32 nt, Human
cccaaguagcugggaaaacaggccugugccac

SEQ ID NO: 102132 - RNA, 24 nt, Human
cccaaguagcugggacuacaggca

SEQ ID NO: 102133 - RNA, 32 nt, Human
cccaaguagcugggacuacaguagcugggcca

SEQ ID NO: 102134 - RNA, 32 nt, Human
cccaaguagcugggauuaaaggcacgugccac

SEQ ID NO: 102135 - RNA, 24 nt, Human
cccaaguagcugggauuacaggca

SEQ ID NO: 102136 - RNA, 32 nt, Human
cccaaguaggagagaaucauaggcaaaaguuu

SEQ ID NO: 102137 - RNA, 32 nt, Human
cccaaguaggagagggcugcugggaggcgaga

SEQ ID NO: 102138 - RNA, 24 nt, Human
cccaaguaggugggauuacaggca

SEQ ID NO: 102139 - RNA, 24 nt, Human
cccaaguaguugggauuacaggca

SEQ ID NO: 102140 - RNA, 24 nt, Human
cccaaguaucugggacuacaggca

SEQ ID NO: 102141 - RNA, 23 nt, Human
cccaagucaugcacccugugccc

SEQ ID NO: 102142 - RNA, 32 nt, Human
cccaaguccacagaugaggcccagggagcuuu

SEQ ID NO: 102143 - RNA, 32 nt, Human
cccaagucccacccucuucccaugucccaccc

SEQ ID NO: 102144 - RNA, 32 nt, Human
cccaagucccccacacucagugcagugaugag

SEQ ID NO: 102145 - RNA, 32 nt, Human
cccaagucccuucacaggguccccacccccac

SEQ ID NO: 102146 - RNA, 32 nt, Human
cccaaguccuccgagacggggagggagcgcgc

SEQ ID NO: 102147 - RNA, 32 nt, Human
cccaaguccuccugcuaggaaaagcuuuugca

SEQ ID NO: 102148 - RNA, 32 nt, Human
cccaaguccuggagcagcgagcagggaguccg

SEQ ID NO: 102149 - RNA, 32 nt, Human
cccaaguccuuacaacaaacucucauucuaag

SEQ ID NO: 102150 - RNA, 32 nt, Human
cccaagucucucgcucuggagcuguuuccuuc

SEQ ID NO: 102151 - RNA, 24 nt, Human
cccaagucugccucuuggcuccca

SEQ ID NO: 102152 - RNA, 32 nt, Human
cccaagucugcgaauccagggugcacgugguc

SEQ ID NO: 102153 - RNA, 32 nt, Human
cccaagucugcuggucacauuuggcagcaaaa

SEQ ID NO: 102154 - RNA, 32 nt, Human
cccaagugaacaaagagcuggagcagcuccag

SEQ ID NO: 102155 - RNA, 32 nt, Human
cccaagugaagaaaccaccaaaccaucaccag

SEQ ID NO: 102156 - RNA, 20 nt, Human
cccaagugacagauccaggg

SEQ ID NO: 102157 - RNA, 32 nt, Human
cccaagugagccaccagcacucauggggcagu

SEQ ID NO: 102158 - RNA, 32 nt, Human
cccaagugagccugaagcagauucgccccaga

SEQ ID NO: 102159 - RNA, 32 nt, Human
cccaagugauacucccaccucugccuuacaaa

SEQ ID NO: 102160 - RNA, 32 nt, Human
cccaagugccgucuuagccauucagugaaggg

SEQ ID NO: 102161 - RNA, 32 nt, Human
cccaagugccugcuuuugaugaugucuacaga

SEQ ID NO: 102162 - RNA, 32 nt, Human
cccaagugcugggauuacaggcguggccaccg

SEQ ID NO: 102163 - RNA, 23 nt, Human
cccaaguggacagggagccccug

SEQ ID NO: 102164 - RNA, 20 nt, Human
cccaaguggcccaggccagc

SEQ ID NO: 102165 - RNA, 32 nt, Human
cccaaguggcuaagacuuaacaaacaggcaca

SEQ ID NO: 102166 - RNA, 18 nt, Human
cccaagugggcagcagcu

SEQ ID NO: 102167 - RNA, 32 nt, Human
cccaagugggugaaucaccugaggucaggagu

SEQ ID NO: 102168 - RNA, 32 nt, Human
cccaaguguaacuccagcacugugagguuuca

SEQ ID NO: 102169 - RNA, 22 nt, Human
cccaagugucugggauuacagg

SEQ ID NO: 102170 - RNA, 24 nt, Human
cccaagugucugggauuacaggca

SEQ ID NO: 102171 - RNA, 16 nt, Human
cccaaguguggcccca

SEQ ID NO: 102172 - RNA, 32 nt, Human
cccaaguuaucuuucuguuccacacacaccuu

SEQ ID NO: 102173 - RNA, 32 nt, Human
cccaaguuccugcuguuaagaggugguaggag

SEQ ID NO: 102174 - RNA, 20 nt, Human
cccaaguuggagugcagugg

SEQ ID NO: 102175 - RNA, 21 nt, Human
cccaaguuggagugcaguggc

SEQ ID NO: 102176 - RNA, 32 nt, Human
cccaauacacuugagcaguugccugugaaugu

SEQ ID NO: 102177 - RNA, 32 nt, Human
cccaauacucgagaaguaaauggaugguacuu

SEQ ID NO: 102178 - RNA, 21 nt, Human
cccaauacuuucaggccugcu

SEQ ID NO: 102179 - RNA, 28 nt, Human
cccaauagacaugcugccucauucaaaa

SEQ ID NO: 102180 - RNA, 32 nt, Human
cccaauagcccaggcuggagugcaguggcaga

SEQ ID NO: 102181 - RNA, 32 nt, Human
cccaauagccgccgcccgcugccugcacucua

SEQ ID NO: 102182 - RNA, 20 nt, Human
cccaauaguagucucuguga

SEQ ID NO: 102183 - RNA, 32 nt, Human
cccaauauccucugcucacuguguuauaaucc

SEQ ID NO: 102184 - RNA, 32 nt, Human
cccaaucaaagaagccaugucauuuuacuuuu

SEQ ID NO: 102185 - RNA, 21 nt, Human
cccaaucacccucgcugccuu

SEQ ID NO: 102186 - RNA, 32 nt, Human
cccaaucccaggcuccacuccugggcuccauu

SEQ ID NO: 102187 - RNA, 32 nt, Human
cccaaucccuguccucuccucuccugccgcau

SEQ ID NO: 102188 - RNA, 32 nt, Human
cccaauccgggggcuccugggguguggugugu

SEQ ID NO: 102189 - RNA, 32 nt, Human
cccaauccuaguagcugggaguaucaggugag

SEQ ID NO: 102190 - RNA, 24 nt, Human
cccaauccuauuagguuucuuuga

SEQ ID NO: 102191 - RNA, 32 nt, Human
cccaauccucgccucccuucugcuccaccuuc

SEQ ID NO: 102192 - RNA, 32 nt, Human
cccaauccugaagaucuggacccgguuucuga

SEQ ID NO: 102193 - RNA, 32 nt, Human
cccaauccugaaugugccccuggaccuucugg

SEQ ID NO: 102194 - RNA, 32 nt, Human
cccaauccugcuucuuuccuuucccuuccaga

SEQ ID NO: 102195 - RNA, 32 nt, Human
cccaauccuugcgugugcuugcagucccaccc

SEQ ID NO: 102196 - RNA, 32 nt, Human
cccaauccuuguuucucucaaaccaagaccuc

SEQ ID NO: 102197 - RNA, 19 nt, Human
cccaaucucucuccacuga

SEQ ID NO: 102198 - RNA, 32 nt, Human
cccaaucugaaauucaaaaugcucuaaugagc

SEQ ID NO: 102199 - RNA, 26 nt, Human
cccaaucugcacacuccaggccucua

SEQ ID NO: 102200 - RNA, 32 nt, Human
cccaaucugccaggcuggacugugcuguuccu

SEQ ID NO: 102201 - RNA, 32 nt, Human
cccaaucugccugugcugcucuuucauacccu

SEQ ID NO: 102202 - RNA, 32 nt, Human
cccaaucuggagugcacuggcgcuaucuuggc

SEQ ID NO: 102203 - RNA, 20 nt, Human
cccaaucuuaacauuuuuga

SEQ ID NO: 102204 - RNA, 32 nt, Human
cccaaucuugugugggcacugaagggggacua

SEQ ID NO: 102205 - RNA, 32 nt, Human
cccaaugaaguuaagaaccacuaaagaagaaa

SEQ ID NO: 102206 - RNA, 32 nt, Human
cccaaugagagaaccugguuaccucagccuga

SEQ ID NO: 102207 - RNA, 32 nt, Human
cccaaugagguggcucaugccuguaaucccag

SEQ ID NO: 102208 - RNA, 32 nt, Human
cccaaugaugcuuuaaggaaguuaucauuguu

SEQ ID NO: 102209 - RNA, 32 nt, Human
cccaaugauucugucacuauaagcuucaagcc

SEQ ID NO: 102210 - RNA, 18 nt, Human
cccaaugcaaaaucgaug

SEQ ID NO: 102211 - RNA, 32 nt, Human
cccaaugcacacaaaacaacccuagaguguug

SEQ ID NO: 102212 - RNA, 32 nt, Human
cccaaugcacacacagacccaccgggggccac

SEQ ID NO: 102213 - RNA, 32 nt, Human
cccaaugcauauccaacaugugcucagggaau

SEQ ID NO: 102214 - RNA, 32 nt, Human
cccaaugcugcagagcagucaggcuggacacc

SEQ ID NO: 102215 - RNA, 32 nt, Human
cccaaugcugccccaaagccagagaagaaaga

SEQ ID NO: 102216 - RNA, 32 nt, Human
cccaaugcuuuguccaugauguccuuguuauu

SEQ ID NO: 102217 - RNA, 32 nt, Human
cccaauggaggggagguugcaggggagagcug

SEQ ID NO: 102218 - RNA, 32 nt, Human
cccaauggcuagagggcucugcuccaagucau

SEQ ID NO: 102219 - RNA, 32 nt, Human
cccaaugggacccgauuccuacacacagccuu

SEQ ID NO: 102220 - RNA, 32 nt, Human
cccaauggguagaacaaaaaguuguuaauacu

SEQ ID NO: 102221 - RNA, 32 nt, Human
cccaaugucaccuucacucacagucugaguuc

SEQ ID NO: 102222 - RNA, 32 nt, Human
cccaauguccucugcaccaucugggcuucagc

SEQ ID NO: 102223 - RNA, 32 nt, Human
cccaaugucuagggauagccucugugccacuu

SEQ ID NO: 102224 - RNA, 32 nt, Human
cccaaugugcaaagugaaaacacugggcuccc

SEQ ID NO: 102225 - RNA, 24 nt, Human
cccaaugugcugggauuacaggca

SEQ ID NO: 102226 - RNA, 32 nt, Human
cccaaugugugcagguuaugugcugcuguaga

SEQ ID NO: 102227 - RNA, 32 nt, Human
cccaauuaaagugccucauguguccccagagc

SEQ ID NO: 102228 - RNA, 21 nt, Human
cccaauucaaagcugcaguga

SEQ ID NO: 102229 - RNA, 32 nt, Human
cccaauucaacaaagacaaagaaaaauuaaua

SEQ ID NO: 102230 - RNA, 32 nt, Human
cccaauucaaugaucuauaacaacagagcaaa

SEQ ID NO: 102231 - RNA, 32 nt, Human
cccaauuccacauuucugaaagaaggaaacuc

SEQ ID NO: 102232 - RNA, 32 nt, Human
cccaauuccagagagaaacacaucacuagauu

SEQ ID NO: 102233 - RNA, 32 nt, Human
cccaauucccccauuauggaguaaccaguauu

SEQ ID NO: 102234 - RNA, 32 nt, Human
cccaauuccuuuagccucuccccaccugucca

SEQ ID NO: 102235 - RNA, 32 nt, Human
cccaauucguucucccuuucccccucucucca

SEQ ID NO: 102236 - RNA, 26 nt, Human
cccaauucucuccaaaccccagagaa

SEQ ID NO: 102237 - RNA, 32 nt, Human
cccaauucugcacacacccaggaaguucugcc

SEQ ID NO: 102238 - RNA, 32 nt, Human
cccaauucugcgcuuccuggguucugcugagu

SEQ ID NO: 102239 - RNA, 22 nt, Human
cccaauuggaacagcagcaugg

SEQ ID NO: 102240 - RNA, 32 nt, Human
cccaauuggagcaggguaggggaaggcaucag

SEQ ID NO: 102241 - RNA, 32 nt, Human
cccaauuuaacaacugguuuacauggugucau

SEQ ID NO: 102242 - RNA, 32 nt, Human
cccaauuuagcauaucuagacuaccuauuuga

SEQ ID NO: 102243 - RNA, 28 nt, Human
cccaauuucagacucccauuccugaaga

SEQ ID NO: 102244 - RNA, 32 nt, Human
cccaauuucaguauccuacuacccagaggaga

SEQ ID NO: 102245 - RNA, 21 nt, Human
cccaauuucugcuuccaaaga

SEQ ID NO: 102246 - RNA, 32 nt, Human
cccaauuuguaaacauauacauucauauucuc

SEQ ID NO: 102247 - RNA, 32 nt, Human
cccaauuugucccuccggccugggcggccccu

SEQ ID NO: 102248 - RNA, 24 nt, Human
cccaauuuucucacucccugaagg

SEQ ID NO: 102249 - RNA, 20 nt, Human
cccacaaaaggggagcuguc

SEQ ID NO: 102250 - RNA, 32 nt, Human
cccacaaagugcugggauuacaggugugagcc

SEQ ID NO: 102251 - RNA, 20 nt, Human
cccacaaauauaaauacagu

SEQ ID NO: 102252 - RNA, 17 nt, Human
cccacaacagccugcca

SEQ ID NO: 102253 - RNA, 32 nt, Human
cccacaaccaaaacaaccccuuuuaaaagagu

SEQ ID NO: 102254 - RNA, 32 nt, Human
cccacaaccacagcccuagaaagaaggaugaa

SEQ ID NO: 102255 - RNA, 32 nt, Human
cccacaaccaguaccaauguacauaguaauug

SEQ ID NO: 102256 - RNA, 32 nt, Human
cccacaacccagccggggaggacgccaggcug

SEQ ID NO: 102257 - RNA, 32 nt, Human
cccacaaccccaaccccagaggaaaagccccc

SEQ ID NO: 102258 - RNA, 21 nt, Human
cccacaacccccacccccagg

SEQ ID NO: 102259 - RNA, 23 nt, Human
cccacaaccccgcuucuguguga

SEQ ID NO: 102260 - RNA, 24 nt, Human
cccacaaccucucugagccucccu

SEQ ID NO: 102261 - RNA, 32 nt, Human
cccacaacuaggagagaaagggcagcucccuc

SEQ ID NO: 102262 - RNA, 32 nt, Human
cccacaagcagaguaggagaauacucuuuucu

SEQ ID NO: 102263 - RNA, 32 nt, Human
cccacaagcgugccuggaaaggagcugcaggu

SEQ ID NO: 102264 - RNA, 32 nt, Human
cccacaagcuguucuuagggcucacacucgcc

SEQ ID NO: 102265 - RNA, 32 nt, Human
cccacaaggaagggagagguacccugggucag

SEQ ID NO: 102266 - RNA, 23 nt, Human
cccacaaggaccuccucucuggc

SEQ ID NO: 102267 - RNA, 32 nt, Human
cccacaaggcccuguagugcugacuggaagau

SEQ ID NO: 102268 - RNA, 32 nt, Human
cccacaagggaagccagucuuaauaugaugga

SEQ ID NO: 102269 - RNA, 32 nt, Human
cccacaaggucacagcaggggagggagggaca

SEQ ID NO: 102270 - RNA, 32 nt, Human
cccacaaguccccaguagaguggaucuguagu

SEQ ID NO: 102271 - RNA, 32 nt, Human
cccacaaucacugcacucuccccaccaagagc

SEQ ID NO: 102272 - RNA, 22 nt, Human
cccacaaucucuggccuccagg

SEQ ID NO: 102273 - RNA, 19 nt, Human
cccacaaugaggcugugaa

SEQ ID NO: 102274 - RNA, 31 nt, Human
cccacaauggcagaagaaacuggacagagua

SEQ ID NO: 102275 - RNA, 32 nt, Human
cccacaauggcugccuuggagacuuuccacug

SEQ ID NO: 102276 - RNA, 32 nt, Human
cccacaauuuccuggguuccaccaagcagcga

SEQ ID NO: 102277 - RNA, 32 nt, Human
cccacacaaaacacgcacacagagccaggugc

SEQ ID NO: 102278 - RNA, 27 nt, Human
cccacacaacaacagccgacccucccc

SEQ ID NO: 102279 - RNA, 32 nt, Human
cccacacaaggaggaggaagaggaaaugguga

SEQ ID NO: 102280 - RNA, 32 nt, Human
cccacacaaucccuguacucugacccauagca

SEQ ID NO: 102281 - RNA, 23 nt, Human
cccacacacacuggccucucuca

SEQ ID NO: 102282 - RNA, 32 nt, Human
cccacacacauacacacauaugucauauauua

SEQ ID NO: 102283 - RNA, 32 nt, Human
cccacacacaugccuugaucauagcacuugcc

SEQ ID NO: 102284 - RNA, 20 nt, Human
cccacacaccagccuccuca

SEQ ID NO: 102285 - RNA, 22 nt, Human
cccacacacccacacgaugcca

SEQ ID NO: 102286 - RNA, 32 nt, Human
cccacacaccccacuccagcuccggagcaccc

SEQ ID NO: 102287 - RNA, 32 nt, Human
cccacacacccugccuagccaccccgccgcgg

SEQ ID NO: 102288 - RNA, 32 nt, Human
cccacacaccugcuccuucccugggcccagcu

SEQ ID NO: 102289 - RNA, 22 nt, Human
cccacacaccugcuucccccca

SEQ ID NO: 102290 - RNA, 24 nt, Human
cccacacacuuuccaucucugccu

SEQ ID NO: 102291 - RNA, 32 nt, Human
cccacacagcaacugguccacugcuuuacugu

SEQ ID NO: 102292 - RNA, 20 nt, Human
cccacacagcagccuccagg

SEQ ID NO: 102293 - RNA, 32 nt, Human
cccacacagcagcgagaggcgagaggaggcug

SEQ ID NO: 102294 - RNA, 32 nt, Human
cccacacagcuggucauccugcccucagagcc

SEQ ID NO: 102295 - RNA, 31 nt, Human
cccacacaggaugguccuuguaggagacagg

SEQ ID NO: 102296 - RNA, 32 nt, Human
cccacacaggcagaauaaaaggcuuaaaugug

SEQ ID NO: 102297 - RNA, 32 nt, Human
cccacacaggcaggcuggagaggaguggcaag

SEQ ID NO: 102298 - RNA, 32 nt, Human
cccacacagucacagucacacacacauaugua

SEQ ID NO: 102299 - RNA, 21 nt, Human
cccacacaugguccucacuca

SEQ ID NO: 102300 - RNA, 19 nt, Human
cccacaccaacccccaggg

SEQ ID NO: 102301 - RNA, 32 nt, Human
cccacaccacacaguuacacauucauaaacag

SEQ ID NO: 102302 - RNA, 32 nt, Human
cccacaccacagcccaccugugccccauuguu

SEQ ID NO: 102303 - RNA, 32 nt, Human
cccacaccacugcaggcagguggauagaagug

SEQ ID NO: 102304 - RNA, 32 nt, Human
cccacaccacugcccugcuccaucucccacca

SEQ ID NO: 102305 - RNA, 32 nt, Human
cccacaccagcucuccccuggccucaauaaaa

SEQ ID NO: 102306 - RNA, 19 nt, Human
cccacaccaggacccccag

SEQ ID NO: 102307 - RNA, 32 nt, Human
cccacaccaggcaacauaacaagacccccauc

SEQ ID NO: 102308 - RNA, 17 nt, Human
cccacaccagggaccag

SEQ ID NO: 102309 - RNA, 32 nt, Human
cccacaccagucaaguuggauuugaacccagc

SEQ ID NO: 102310 - RNA, 32 nt, Human
cccacaccaucaggauagcacagggaaacugu

SEQ ID NO: 102311 - RNA, 22 nt, Human
cccacaccaucaguggcccuca

SEQ ID NO: 102312 - RNA, 32 nt, Human
cccacaccaugaacagcacccccaggaaugcc

SEQ ID NO: 102313 - RNA, 32 nt, Human
cccacacccacuguccuguaaacuuuucucag

SEQ ID NO: 102314 - RNA, 32 nt, Human
cccacacccaggcugugggggacgggauggcc

SEQ ID NO: 102315 - RNA, 32 nt, Human
cccacaccccacccucccuucccuucauaccc

SEQ ID NO: 102316 - RNA, 17 nt, Human
cccacacccccauccca

SEQ ID NO: 102317 - RNA, 32 nt, Human
cccacaccccuccaaagccccaccuuuaaguc

SEQ ID NO: 102318 - RNA, 32 nt, Human
cccacaccccuccuugcuggaaugugucuggc

SEQ ID NO: 102319 - RNA, 24 nt, Human
cccacaccccucgcgguuccaggg

SEQ ID NO: 102320 - RNA, 21 nt, Human
cccacaccccugugcccccgg

SEQ ID NO: 102321 - RNA, 32 nt, Human
cccacacccucagcacugaccacugugauggg

SEQ ID NO: 102322 - RNA, 32 nt, Human
cccacacccuccucuuugaucucugaauccac

SEQ ID NO: 102323 - RNA, 21 nt, Human
cccacacccuccuucagugcc

SEQ ID NO: 102324 - RNA, 24 nt, Human
cccacacccuucccagagccaggg

SEQ ID NO: 102325 - RNA, 22 nt, Human
cccacaccgcugcacagagagg

SEQ ID NO: 102326 - RNA, 21 nt, Human
cccacaccgcuggcacacgag

SEQ ID NO: 102327 - RNA, 32 nt, Human
cccacaccuccaccaccagcccagcacucaac

SEQ ID NO: 102328 - RNA, 32 nt, Human
cccacaccuccaccuccccugagcccugugag

SEQ ID NO: 102329 - RNA, 32 nt, Human
cccacaccuccaggaacuccacucccagucuu

SEQ ID NO: 102330 - RNA, 19 nt, Human
cccacaccucccuccaggg

SEQ ID NO: 102331 - RNA, 32 nt, Human
cccacaccucccuuccagcaggccagugguua

SEQ ID NO: 102332 - RNA, 20 nt, Human
cccacaccuccucccaggaa

SEQ ID NO: 102333 - RNA, 22 nt, Human
cccacaccuccucuccccgggg

SEQ ID NO: 102334 - RNA, 32 nt, Human
cccacaccuccucuccccggggccuggaaucu

SEQ ID NO: 102335 - RNA, 32 nt, Human
cccacaccuccugccagcaccuugccuggccc

SEQ ID NO: 102336 - RNA, 23 nt, Human
cccacaccuccuguuugccaggg

SEQ ID NO: 102337 - RNA, 19 nt, Human
cccacaccucgccccacag

SEQ ID NO: 102338 - RNA, 18 nt, Human
cccacaccucucaccuca

SEQ ID NO: 102339 - RNA, 21 nt, Human
cccacaccucugaacucaggg

SEQ ID NO: 102340 - RNA, 24 nt, Human
cccacaccucugucucccccaggg

SEQ ID NO: 102341 - RNA, 32 nt, Human
cccacaccugccccagcaccagcgccaggagg

SEQ ID NO: 102342 - RNA, 19 nt, Human
cccacaccugccucaccca

SEQ ID NO: 102343 - RNA, 25 nt, Human
cccacaccuggcuuccacccucccc

SEQ ID NO: 102344 - RNA, 32 nt, Human
cccacaccuguaaucccagcacuuugggaggc

SEQ ID NO: 102345 - RNA, 32 nt, Human
cccacaccuguaaucucagcacuuuaggaggc

SEQ ID NO: 102346 - RNA, 32 nt, Human
cccacaccuucaccccuugcuucaagauucaa

SEQ ID NO: 102347 - RNA, 18 nt, Human
cccacaccuucccuuccc

SEQ ID NO: 102348 - RNA, 23 nt, Human
cccacaccuuggcagcucagggu

SEQ ID NO: 102349 - RNA, 32 nt, Human
cccacacgaacagcagagaggggcagcaggau

SEQ ID NO: 102350 - RNA, 32 nt, Human
cccacacggccacaccaccacaugcccaagug

SEQ ID NO: 102351 - RNA, 32 nt, Human
cccacacggcggcccucggcucccgggccccg

SEQ ID NO: 102352 - RNA, 23 nt, Human
cccacacgugagcucccuccuca

SEQ ID NO: 102353 - RNA, 23 nt, Human
cccacacgugcugcgucugcacg

SEQ ID NO: 102354 - RNA, 22 nt, Human
cccacacuaaggccacagccca

SEQ ID NO: 102355 - RNA, 32 nt, Human
cccacacucacauguacgaaguucucacccca

SEQ ID NO: 102356 - RNA, 32 nt, Human
cccacacucacugcacuggcagcgugcacugg

SEQ ID NO: 102357 - RNA, 21 nt, Human
cccacacucaggacagagcca

SEQ ID NO: 102358 - RNA, 26 nt, Human
cccacacuccuacaccuaacucaccu

SEQ ID NO: 102359 - RNA, 32 nt, Human
cccacacucucauggaaucagacagagauccu

SEQ ID NO: 102360 - RNA, 32 nt, Human
cccacacugaagaagccacuaccuccaccacc

SEQ ID NO: 102361 - RNA, 32 nt, Human
cccacacugccgcuccagccuuccuggcaggc

SEQ ID NO: 102362 - RNA, 32 nt, Human
cccacacugccucuguggccuggacuuugaaa

SEQ ID NO: 102363 - RNA, 16 nt, Human
cccacacugccuucca

SEQ ID NO: 102364 - RNA, 32 nt, Human
cccacacuuaaccuugucaauagguucuugaa

SEQ ID NO: 102365 - RNA, 32 nt, Human
cccacacuuaucucccccagggccacuccaaa

SEQ ID NO: 102366 - RNA, 22 nt, Human
cccacacuuccacuccaccuca

SEQ ID NO: 102367 - RNA, 32 nt, Human
cccacacuugacugggcuguggaggugggcau

SEQ ID NO: 102368 - RNA, 32 nt, Human
cccacacuugcccuuucucccucucuccagca

SEQ ID NO: 102369 - RNA, 32 nt, Human
cccacacuuguaaucccagcacuuugggaggc

SEQ ID NO: 102370 - RNA, 32 nt, Human
cccacagaaaggaggcagcacacagagaaaga

SEQ ID NO: 102371 - RNA, 32 nt, Human
cccacagaacuccugcaggaggcuggcagccc

SEQ ID NO: 102372 - RNA, 32 nt, Human
cccacagaaugagaggcucacccugcacagga

SEQ ID NO: 102373 - RNA, 32 nt, Human
cccacagacaacaguugcacagugccucaagc

SEQ ID NO: 102374 - RNA, 32 nt, Human
cccacagacagagcuguauuaaguaaccuguu

SEQ ID NO: 102375 - RNA, 19 nt, Human
cccacagacccaccucccc

SEQ ID NO: 102376 - RNA, 32 nt, Human
cccacagaccccggggagcgcagggaaaaggg

SEQ ID NO: 102377 - RNA, 32 nt, Human
cccacagaccugcucuggacacuugcucaugc

SEQ ID NO: 102378 - RNA, 21 nt, Human
cccacagacgcccaccacccc

SEQ ID NO: 102379 - RNA, 21 nt, Human
cccacagagaagcccauccag

SEQ ID NO: 102380 - RNA, 32 nt, Human
cccacagagacagaggggaacaaguagcauuu

SEQ ID NO: 102381 - RNA, 21 nt, Human
cccacagagcaauacacugaa

SEQ ID NO: 102382 - RNA, 32 nt, Human
cccacagagcauccuccucucaucugugacaa

SEQ ID NO: 102383 - RNA, 32 nt, Human
cccacagagcaucgcuccacugucucuccugc

SEQ ID NO: 102384 - RNA, 32 nt, Human
cccacagagccgcggcaccauggcaccugcug

SEQ ID NO: 102385 - RNA, 32 nt, Human
cccacagagcugccccagcagacgcuccgccc

SEQ ID NO: 102386 - RNA, 32 nt, Human
cccacagaggagcauauacugaaaagaaggca

SEQ ID NO: 102387 - RNA, 32 nt, Human
cccacagagggaggggaggggcugagcuguga

SEQ ID NO: 102388 - RNA, 23 nt, Human
cccacagagugccaucccugaga

SEQ ID NO: 102389 - RNA, 32 nt, Human
cccacagaugagucacuggagaacaaaacgug

SEQ ID NO: 102390 - RNA, 31 nt, Human
cccacagauggggaaagauggggaagggugu

SEQ ID NO: 102391 - RNA, 32 nt, Human
cccacagauggggaaagauggggaagggugug

SEQ ID NO: 102392 - RNA, 32 nt, Human
cccacagcaagcagugccugcuggcgcccccg

SEQ ID NO: 102393 - RNA, 32 nt, Human
cccacagcacagaaaaggucacaaccaccuac

SEQ ID NO: 102394 - RNA, 23 nt, Human
cccacagcacuaccucaccccga

SEQ ID NO: 102395 - RNA, 32 nt, Human
cccacagcacuagcgaggacccugcccugaag

SEQ ID NO: 102396 - RNA, 32 nt, Human
cccacagcacuccugacgaaagcugguccccu

SEQ ID NO: 102397 - RNA, 32 nt, Human
cccacagcagaggccuccccugucaaggcuuc

SEQ ID NO: 102398 - RNA, 20 nt, Human
cccacagcagcccaggacug

SEQ ID NO: 102399 - RNA, 32 nt, Human
cccacagcagcuuugcucagugauacccacau

SEQ ID NO: 102400 - RNA, 32 nt, Human
cccacagcaggaggaggcugugugaaaccugg

SEQ ID NO: 102401 - RNA, 32 nt, Human
cccacagcagugggugcugggguccugacuuu

SEQ ID NO: 102402 - RNA, 32 nt, Human
cccacagcaugagagacugcuggacuucaguc

SEQ ID NO: 102403 - RNA, 22 nt, Human
cccacagccaaccucccgggca

SEQ ID NO: 102404 - RNA, 32 nt, Human
cccacagccauggccauggcccagaaacucag

SEQ ID NO: 102405 - RNA, 21 nt, Human
cccacagcccagccagagaca

SEQ ID NO: 102406 - RNA, 32 nt, Human
cccacagccccagggagauacaucuggacucc

SEQ ID NO: 102407 - RNA, 23 nt, Human
cccacagccccgccgggacccga

SEQ ID NO: 102408 - RNA, 21 nt, Human
cccacagccccgcuguggucc

SEQ ID NO: 102409 - RNA, 32 nt, Human
cccacagcccgggccagagccaguguggggca

SEQ ID NO: 102410 - RNA, 22 nt, Human
cccacagccgcagcuguaaggc

SEQ ID NO: 102411 - RNA, 22 nt, Human
cccacagccggcaccccugggc

SEQ ID NO: 102412 - RNA, 24 nt, Human
cccacagccucuuccucccuuccc

SEQ ID NO: 102413 - RNA, 32 nt, Human
cccacagccuguaacucaguguuuuguacuuc

SEQ ID NO: 102414 - RNA, 32 nt, Human
cccacagccuguccgcagccuggugccgugaa

SEQ ID NO: 102415 - RNA, 20 nt, Human
cccacagcgccggagccccg

SEQ ID NO: 102416 - RNA, 21 nt, Human
cccacagcucagcccaugagg

SEQ ID NO: 102417 - RNA, 22 nt, Human
cccacagcugccgcgguggccc

SEQ ID NO: 102418 - RNA, 32 nt, Human
cccacagcugccuccauuuccuuaaggaaggg

SEQ ID NO: 102419 - RNA, 20 nt, Human
cccacagcugcugcucacuu

SEQ ID NO: 102420 - RNA, 32 nt, Human
cccacagcuggaaaguuccuccccuccagccc

SEQ ID NO: 102421 - RNA, 22 nt, Human
cccacagcuggacacccugaga

SEQ ID NO: 102422 - RNA, 32 nt, Human
cccacagcuggccucggccagguccgagggcc

SEQ ID NO: 102423 - RNA, 32 nt, Human
cccacagcugugccucacagaugccccgagaa

SEQ ID NO: 102424 - RNA, 32 nt, Human
cccacagcuguggcagagguuccucagugugg

SEQ ID NO: 102425 - RNA, 24 nt, Human
cccacagcuguggccacagugccc

SEQ ID NO: 102426 - RNA, 32 nt, Human
cccacagcugugggaggggcugcuacugcugc

SEQ ID NO: 102427 - RNA, 32 nt, Human
cccacagcuuagugaacagaagaaucugaguc

SEQ ID NO: 102428 - RNA, 32 nt, Human
cccacaggaaauucaagggcugaggggugagu

SEQ ID NO: 102429 - RNA, 32 nt, Human
cccacaggaagggggaaggaaggagggaauuu

SEQ ID NO: 102430 - RNA, 32 nt, Human
cccacaggagcacgugauugccucugcuuacg

SEQ ID NO: 102431 - RNA, 32 nt, Human
cccacaggauucaagccagcugccuuuggagg

SEQ ID NO: 102432 - RNA, 32 nt, Human
cccacaggccaccggcuccagcuuugaccugg

SEQ ID NO: 102433 - RNA, 23 nt, Human
cccacaggcggagguugcggugg

SEQ ID NO: 102434 - RNA, 32 nt, Human
cccacaggcucaccccuccugccggcugccag

SEQ ID NO: 102435 - RNA, 32 nt, Human
cccacaggcugcagggaccgggcucuggguaa

SEQ ID NO: 102436 - RNA, 32 nt, Human
cccacaggcugcagggcaggaaagguauuccu

SEQ ID NO: 102437 - RNA, 32 nt, Human
cccacagggaaggagcgcgcagcugccacaca

SEQ ID NO: 102438 - RNA, 32 nt, Human
cccacagggacaccuccacaucgccaaggugc

SEQ ID NO: 102439 - RNA, 32 nt, Human
cccacagggacccccaccccucccagccucac

SEQ ID NO: 102440 - RNA, 32 nt, Human
cccacagggacuuuuccagacacuccgagugc

SEQ ID NO: 102441 - RNA, 24 nt, Human
cccacagggcagaggucacaguga

SEQ ID NO: 102442 - RNA, 16 nt, Human
cccacagggccagaug

SEQ ID NO: 102443 - RNA, 28 nt, Human
cccacagggcccaccauggucuaugaga

SEQ ID NO: 102444 - RNA, 32 nt, Human
cccacagggcucuguccucuaguuuugagaca

SEQ ID NO: 102445 - RNA, 18 nt, Human
cccacaggggaagcuguc

SEQ ID NO: 102446 - RNA, 32 nt, Human
cccacagggucacgcaggacucggacacugcc

SEQ ID NO: 102447 - RNA, 32 nt, Human
cccacaggucagguggaggguggggcgugggc

SEQ ID NO: 102448 - RNA, 32 nt, Human
cccacagguggcagugggcagaggggaccccg

SEQ ID NO: 102449 - RNA, 32 nt, Human
cccacagguguguaggggcaacccaccccuac

SEQ ID NO: 102450 - RNA, 32 nt, Human
cccacagucauggucucuguagaaucugaaga

SEQ ID NO: 102451 - RNA, 32 nt, Human
cccacagucuugcaggucacaugcucuccuug

SEQ ID NO: 102452 - RNA, 32 nt, Human
cccacagugacuuuugcugggcauuuucccag

SEQ ID NO: 102453 - RNA, 32 nt, Human
cccacagugcauucagaaagcaugcugugugg

SEQ ID NO: 102454 - RNA, 32 nt, Human
cccacagugcuggccuccuguggggccacuau

SEQ ID NO: 102455 - RNA, 22 nt, Human
cccacagugcugggauuacagg

SEQ ID NO: 102456 - RNA, 24 nt, Human
cccacagugcugggauuacaggca

SEQ ID NO: 102457 - RNA, 21 nt, Human
cccacagugggguauucuuca

SEQ ID NO: 102458 - RNA, 23 nt, Human
cccacagugggugagagccguca

SEQ ID NO: 102459 - RNA, 32 nt, Human
cccacaguguguauuccuguccucuauguuag

SEQ ID NO: 102460 - RNA, 19 nt, Human
cccacaguugcacugcccc

SEQ ID NO: 102461 - RNA, 32 nt, Human
cccacaguuggcagaggugguugagggagcag

SEQ ID NO: 102462 - RNA, 32 nt, Human
cccacauacagacagaccuaccuauacauacg

SEQ ID NO: 102463 - RNA, 21 nt, Human
cccacauacgugaccccaggg

SEQ ID NO: 102464 - RNA, 18 nt, Human
cccacaucaccuccccac

SEQ ID NO: 102465 - RNA, 32 nt, Human
cccacaucaccuccccaccacccggccggggu

SEQ ID NO: 102466 - RNA, 32 nt, Human
cccacauccaaacauguaucucuaaugaaauu

SEQ ID NO: 102467 - RNA, 32 nt, Human
cccacauccagccugcaggccucucugcaguc

SEQ ID NO: 102468 - RNA, 24 nt, Human
cccacaucccagaaagcugagcca

SEQ ID NO: 102469 - RNA, 32 nt, Human
cccacaucccugcagccaccucccagcagagc

SEQ ID NO: 102470 - RNA, 23 nt, Human
cccacauccucagccccacacca

SEQ ID NO: 102471 - RNA, 32 nt, Human
cccacauccucccaaggcuccccucacagccu

SEQ ID NO: 102472 - RNA, 18 nt, Human
cccacauccuccuuuccc

SEQ ID NO: 102473 - RNA, 23 nt, Human
cccacauccuuaugacgcagcca

SEQ ID NO: 102474 - RNA, 32 nt, Human
cccacaucucccaggcugcuuaggagacagaa

SEQ ID NO: 102475 - RNA, 32 nt, Human
cccacaucuguaaucccagcacuuugggaggc

SEQ ID NO: 102476 - RNA, 32 nt, Human
cccacaugacugcccugccucugaccagucug

SEQ ID NO: 102477 - RNA, 23 nt, Human
cccacaugcagcuucacaagcca

SEQ ID NO: 102478 - RNA, 30 nt, Human
cccacaugcaucccuggcuggggucagccu

SEQ ID NO: 102479 - RNA, 32 nt, Human
cccacaugcaugcacacgcaugcacacaugug

SEQ ID NO: 102480 - RNA, 32 nt, Human
cccacaugcccaccuccucuggcaacaugggg

SEQ ID NO: 102481 - RNA, 32 nt, Human
cccacauggaaauguauccucaaaccguuuaa

SEQ ID NO: 102482 - RNA, 23 nt, Human
cccacauggaagacuugucuuca

SEQ ID NO: 102483 - RNA, 20 nt, Human
cccacauggacagccauucc

SEQ ID NO: 102484 - RNA, 32 nt, Human
cccacaugguccaacugacacacacguuuccc

SEQ ID NO: 102485 - RNA, 32 nt, Human
cccacauggugugggccuuugucugucccugu

SEQ ID NO: 102486 - RNA, 32 nt, Human
cccacaugguuuucaggcaacaauucucaauu

SEQ ID NO: 102487 - RNA, 32 nt, Human
cccacauuccagaaggguggucccagugaaca

SEQ ID NO: 102488 - RNA, 32 nt, Human
cccacauucuagaauucucccaacauuauuuu

SEQ ID NO: 102489 - RNA, 32 nt, Human
cccacauugccuccuuccccucccucucucau

SEQ ID NO: 102490 - RNA, 22 nt, Human
cccacauugcucuucccuuccc

SEQ ID NO: 102491 - RNA, 20 nt, Human
cccacauuggagugcagugg

SEQ ID NO: 102492 - RNA, 32 nt, Human
cccacauuguguccuguggggguggggucagc

SEQ ID NO: 102493 - RNA, 19 nt, Human
cccacauuuccaauggggu

SEQ ID NO: 102494 - RNA, 32 nt, Human
cccacauuuuccccucacccuccaaguccuaa

SEQ ID NO: 102495 - RNA, 32 nt, Human
cccacauuuuuagauggaaagagcaagaaaau

SEQ ID NO: 102496 - RNA, 32 nt, Human
cccaccaaaauguaaaacauguuuuaacuagg

SEQ ID NO: 102497 - RNA, 25 nt, Human
cccaccaacacucucccagcuccca

SEQ ID NO: 102498 - RNA, 32 nt, Human
cccaccaacagcugcaccugcgccuccaacug

SEQ ID NO: 102499 - RNA, 32 nt, Human
cccaccaaccaccaccuccuaaauccugacag

SEQ ID NO: 102500 - RNA, 32 nt, Human
cccaccaacccugcuccuauggcuccacccag

SEQ ID NO: 102501 - RNA, 24 nt, Human
cccaccaacguccugcccacgcuc

SEQ ID NO: 102502 - RNA, 32 nt, Human
cccaccaagaggguggaucacaccucaguggg

SEQ ID NO: 102503 - RNA, 32 nt, Human
cccaccaaggauggacgaagacccccuccaga

SEQ ID NO: 102504 - RNA, 19 nt, Human
cccaccaaggcccccuugg

SEQ ID NO: 102505 - RNA, 32 nt, Human
cccaccaagggcccugcgaccacagcagggau

SEQ ID NO: 102506 - RNA, 32 nt, Human
cccaccaagucaagcagagcugggugggcuga

SEQ ID NO: 102507 - RNA, 32 nt, Human
cccaccaaucacccucacucagccuuuucccu

SEQ ID NO: 102508 - RNA, 32 nt, Human
cccaccaaugcacaaauaauugugaacagcuu

SEQ ID NO: 102509 - RNA, 32 nt, Human
cccaccaauuccggacacauuuuggcgaccau

SEQ ID NO: 102510 - RNA, 18 nt, Human
cccaccacaaaaagagaa

SEQ ID NO: 102511 - RNA, 32 nt, Human
cccaccacacacacccuuccccacucccguga

SEQ ID NO: 102512 - RNA, 21 nt, Human
cccaccacacccugcccacuc

SEQ ID NO: 102513 - RNA, 32 nt, Human
cccaccacagagcaccagccagugccaacgcc

SEQ ID NO: 102514 - RNA, 32 nt, Human
cccaccacagggucuggaagugugugugacgc

SEQ ID NO: 102515 - RNA, 32 nt, Human
cccaccacaucgccccagaggcuuuuccagca

SEQ ID NO: 102516 - RNA, 32 nt, Human
cccaccaccaccacagcaacccagacagcuag

SEQ ID NO: 102517 - RNA, 32 nt, Human
cccaccaccaccacagcaccccagacagcuag

SEQ ID NO: 102518 - RNA, 32 nt, Human
cccaccaccacugucgucaguguaugccuggg

SEQ ID NO: 102519 - RNA, 21 nt, Human
cccaccaccagcauuuccucc

SEQ ID NO: 102520 - RNA, 32 nt, Human
cccaccaccagccucggugcucugccccaugc

SEQ ID NO: 102521 - RNA, 24 nt, Human
cccaccaccaucacugccaccugg

SEQ ID NO: 102522 - RNA, 32 nt, Human
cccaccaccaugagcuggaguggggaugacaa

SEQ ID NO: 102523 - RNA, 22 nt, Human
cccaccaccaugccccaugcuc

SEQ ID NO: 102524 - RNA, 32 nt, Human
cccaccaccauggugaaacccuaucucuacua

SEQ ID NO: 102525 - RNA, 22 nt, Human
cccaccaccauuccuuuccucc

SEQ ID NO: 102526 - RNA, 32 nt, Human
cccaccaccauuccuuuccucccuucccccug

SEQ ID NO: 102527 - RNA, 32 nt, Human
cccaccacccaccuaucaccccucacccauaa

SEQ ID NO: 102528 - RNA, 32 nt, Human
cccaccacccacucuccucugccucaguaagu

SEQ ID NO: 102529 - RNA, 32 nt, Human
cccaccacccacugcaccguggucucgggcuc

SEQ ID NO: 102530 - RNA, 32 nt, Human
cccaccaccccacuccgggcagcccagcgcca

SEQ ID NO: 102531 - RNA, 21 nt, Human
cccaccaccccugccccaccc

SEQ ID NO: 102532 - RNA, 32 nt, Human
cccaccaccccugggugcucaguuucuaccaa

SEQ ID NO: 102533 - RNA, 22 nt, Human
cccaccacccugcuggccccac

SEQ ID NO: 102534 - RNA, 20 nt, Human
cccaccaccuguccccaccc

SEQ ID NO: 102535 - RNA, 21 nt, Human
cccaccaccuucuccuuuccc

SEQ ID NO: 102536 - RNA, 32 nt, Human
cccaccacuacccuuguaaacuuccaggaaga

SEQ ID NO: 102537 - RNA, 21 nt, Human
cccaccacucgcugccuccca

SEQ ID NO: 102538 - RNA, 32 nt, Human
cccaccacucucaggaccacccugccaaggca

SEQ ID NO: 102539 - RNA, 32 nt, Human
cccaccacugcacuccagccuggaugacagag

SEQ ID NO: 102540 - RNA, 32 nt, Human
cccaccacugcacuccagccugggaagcagag

SEQ ID NO: 102541 - RNA, 32 nt, Human
cccaccacugcacuccagccugggcgacacag

SEQ ID NO: 102542 - RNA, 32 nt, Human
cccaccacugcacuccagccugggcgacagag

SEQ ID NO: 102543 - RNA, 32 nt, Human
cccaccacugcacuccagccugggugacagag

SEQ ID NO: 102544 - RNA, 21 nt, Human
cccaccacugccagcccagcg

SEQ ID NO: 102545 - RNA, 17 nt, Human
cccaccacugcuuguuc

SEQ ID NO: 102546 - RNA, 32 nt, Human
cccaccacugcuuguuccgagcucccccagcc

SEQ ID NO: 102547 - RNA, 32 nt, Human
cccaccagaaugucacaaucauucauugcucc

SEQ ID NO: 102548 - RNA, 32 nt, Human
cccaccagagagaacauucuagcugggugagc

SEQ ID NO: 102549 - RNA, 32 nt, Human
cccaccagagcugccauuugucuccagccccu

SEQ ID NO: 102550 - RNA, 32 nt, Human
cccaccagaggaugaggauccagcccuguccc

SEQ ID NO: 102551 - RNA, 32 nt, Human
cccaccagagggcagcaagcuccuuucacuuc

SEQ ID NO: 102552 - RNA, 32 nt, Human
cccaccagagucacuggugaccccagaaaaug

SEQ ID NO: 102553 - RNA, 32 nt, Human
cccaccagagugagcuggagcagaucugcacc

SEQ ID NO: 102554 - RNA, 32 nt, Human
cccaccagcaccagaggucacucuccacaucc

SEQ ID NO: 102555 - RNA, 32 nt, Human
cccaccagcaugauggccccagcugggggcag

SEQ ID NO: 102556 - RNA, 15 nt, Human
cccaccagcccacgc

SEQ ID NO: 102557 - RNA, 21 nt, Human
cccaccagcccuggccaacgu

SEQ ID NO: 102558 - RNA, 23 nt, Human
cccaccagccucucagagccucc

SEQ ID NO: 102559 - RNA, 17 nt, Human
cccaccagcuacagcag

SEQ ID NO: 102560 - RNA, 32 nt, Human
cccaccagcucguuccccuccagccuggugcu

SEQ ID NO: 102561 - RNA, 32 nt, Human
cccaccagcucuaggcccuggaccucggguca

SEQ ID NO: 102562 - RNA, 21 nt, Human
cccaccagcugccuguccagu

SEQ ID NO: 102563 - RNA, 19 nt, Human
cccaccagcugcucagcgc

SEQ ID NO: 102564 - RNA, 18 nt, Human
cccaccagcugcugcuac

SEQ ID NO: 102565 - RNA, 17 nt, Human
cccaccagcuucuguuc

SEQ ID NO: 102566 - RNA, 32 nt, Human
cccaccaggaaccugcuuuagugggggauagu

SEQ ID NO: 102567 - RNA, 32 nt, Human
cccaccaggaacuagagccccaaccacagcag

SEQ ID NO: 102568 - RNA, 32 nt, Human
cccaccaggagagagggcaaagggaugagccu

SEQ ID NO: 102569 - RNA, 21 nt, Human
cccaccaggccaagcccucug

SEQ ID NO: 102570 - RNA, 32 nt, Human
cccaccaggccuucuugggcagcagggaggca

SEQ ID NO: 102571 - RNA, 18 nt, Human
cccaccaggcuccgcagc

SEQ ID NO: 102572 - RNA, 32 nt, Human
cccaccagggagaugucuagaggcagacuccu

SEQ ID NO: 102573 - RNA, 32 nt, Human
cccaccagggucccgcucacaccaggcagccu

SEQ ID NO: 102574 - RNA, 32 nt, Human
cccaccaguuccacuaucaguaaugagcacca

SEQ ID NO: 102575 - RNA, 32 nt, Human
cccaccaguucugccuggcuuccuccaucccc

SEQ ID NO: 102576 - RNA, 32 nt, Human
cccaccauaccuccccuccacaucacugacac

SEQ ID NO: 102577 - RNA, 32 nt, Human
cccaccauauccacccucgcuccaucuuugaa

SEQ ID NO: 102578 - RNA, 32 nt, Human
cccaccauccauccuggugaaaccagaaaacu

SEQ ID NO: 102579 - RNA, 32 nt, Human
cccaccauccuggcaagagguggauccugggg

SEQ ID NO: 102580 - RNA, 32 nt, Human
cccaccaucuucagaucuguuccucuggagcu

SEQ ID NO: 102581 - RNA, 32 nt, Human
cccaccaucuucugaagugaacugaucugccc

SEQ ID NO: 102582 - RNA, 32 nt, Human
cccaccaugagaaaggggcacagaccuucugg

SEQ ID NO: 102583 - RNA, 21 nt, Human
cccaccaugaugcccccaugc

SEQ ID NO: 102584 - RNA, 18 nt, Human
cccaccaugcccccuaca

SEQ ID NO: 102585 - RNA, 31 nt, Human
cccaccaugccugcaacucccaacuuccucg

SEQ ID NO: 102586 - RNA, 32 nt, Human
cccaccaugccuuugucucucccacuucaucu

SEQ ID NO: 102587 - RNA, 32 nt, Human
cccaccaugcgcugcucaaccucucuccuucu

SEQ ID NO: 102588 - RNA, 32 nt, Human
cccaccauggccaggacaugugcaaugccagc

SEQ ID NO: 102589 - RNA, 31 nt, Human
cccaccauggcucucgggccugugccccuca

SEQ ID NO: 102590 - RNA, 32 nt, Human
cccaccaugugauuuccaacaccacugacaag

SEQ ID NO: 102591 - RNA, 32 nt, Human
cccaccauguuaaguguguccucugcugccaa

SEQ ID NO: 102592 - RNA, 21 nt, Human
cccaccauucaccucuguuca

SEQ ID NO: 102593 - RNA, 32 nt, Human
cccaccauugcacuccagccugggcaacagag

SEQ ID NO: 102594 - RNA, 32 nt, Human
cccaccauugcacuccaguccgggaaacaaga

SEQ ID NO: 102595 - RNA, 20 nt, Human
cccaccauugccccuccuca

SEQ ID NO: 102596 - RNA, 20 nt, Human
cccacccaaagagccaaaga

SEQ ID NO: 102597 - RNA, 32 nt, Human
cccacccaaauuuauacccauuccucccucau

SEQ ID NO: 102598 - RNA, 32 nt, Human
cccacccaacagccaccaagccugacagaagg

SEQ ID NO: 102599 - RNA, 32 nt, Human
cccacccaaccugucccugccugcucccagcc

SEQ ID NO: 102600 - RNA, 19 nt, Human
cccacccaagacccacuga

SEQ ID NO: 102601 - RNA, 32 nt, Human
cccacccaaggaagcccagcacagaccaucuc

SEQ ID NO: 102602 - RNA, 22 nt, Human
cccacccaagugcccccacuga

SEQ ID NO: 102603 - RNA, 32 nt, Human
cccacccaaugcccagcaccaagccuacccag

SEQ ID NO: 102604 - RNA, 32 nt, Human
cccacccacacacauacauacauacaccuggu

SEQ ID NO: 102605 - RNA, 32 nt, Human
cccacccacacguuguauauucagagagagag

SEQ ID NO: 102606 - RNA, 32 nt, Human
cccacccacacugacggcaucuucccaguucc

SEQ ID NO: 102607 - RNA, 32 nt, Human
cccacccacaggauuccucgagcugugagauu

SEQ ID NO: 102608 - RNA, 28 nt, Human
cccacccacagugcugcacuccuccugc

SEQ ID NO: 102609 - RNA, 32 nt, Human
cccacccacagugcugcacuccuccugccccu

SEQ ID NO: 102610 - RNA, 16 nt, Human
cccacccaccaccuca

SEQ ID NO: 102611 - RNA, 32 nt, Human
cccacccacccaggcuggagccauggauaaau

SEQ ID NO: 102612 - RNA, 32 nt, Human
cccacccaccccacaccugcagugccagcucc

SEQ ID NO: 102613 - RNA, 17 nt, Human
cccacccaccccacuga

SEQ ID NO: 102614 - RNA, 32 nt, Human
cccacccacccccucacccccuucuuuuuccg

SEQ ID NO: 102615 - RNA, 32 nt, Human
cccacccaccccucuccugccucggcagggac

SEQ ID NO: 102616 - RNA, 19 nt, Human
cccacccaccucucugccg

SEQ ID NO: 102617 - RNA, 32 nt, Human
cccacccaccuugccuccaggcucuuuccuuc

SEQ ID NO: 102618 - RNA, 32 nt, Human
cccacccacuccaggaacccagagccacauua

SEQ ID NO: 102619 - RNA, 32 nt, Human
cccacccacuccucaguguuuguggagucgag

SEQ ID NO: 102620 - RNA, 32 nt, Human
cccacccacugcagcccuagugccuuagcucc

SEQ ID NO: 102621 - RNA, 32 nt, Human
cccacccacugcagguuggggaagaagccuau

SEQ ID NO: 102622 - RNA, 32 nt, Human
cccacccacuggcuguuucuccguccucuccu

SEQ ID NO: 102623 - RNA, 32 nt, Human
cccacccacuuccuccccaccaccugugcccc

SEQ ID NO: 102624 - RNA, 32 nt, Human
cccacccagaagcgguucagcacacgggagga

SEQ ID NO: 102625 - RNA, 21 nt, Human
cccacccagaggaugcaggga

SEQ ID NO: 102626 - RNA, 32 nt, Human
cccacccagaggaugcagggaaagcacacugu

SEQ ID NO: 102627 - RNA, 32 nt, Human
cccacccagaugggggaaagcacaggugggcu

SEQ ID NO: 102628 - RNA, 32 nt, Human
cccacccagcacucucauugcugcuguugagu

SEQ ID NO: 102629 - RNA, 32 nt, Human
cccacccagcagaccaggagauagcuggggga

SEQ ID NO: 102630 - RNA, 22 nt, Human
cccacccagcccucccauacuc

SEQ ID NO: 102631 - RNA, 32 nt, Human
cccacccagccugcuccuccagcuggggagag

SEQ ID NO: 102632 - RNA, 32 nt, Human
cccacccagcuacuggggaggcugagucagga

SEQ ID NO: 102633 - RNA, 18 nt, Human
cccacccagcuccacuaa

SEQ ID NO: 102634 - RNA, 17 nt, Human
cccacccagcugggucc

SEQ ID NO: 102635 - RNA, 22 nt, Human
cccacccagggacaccccacgg

SEQ ID NO: 102636 - RNA, 25 nt, Human
cccacccagggccuuccacccucgg

SEQ ID NO: 102637 - RNA, 32 nt, Human
cccacccagucucugcuccaccuuucagccca

SEQ ID NO: 102638 - RNA, 16 nt, Human
cccacccagucugcca

SEQ ID NO: 102639 - RNA, 18 nt, Human
cccacccagugccugcca

SEQ ID NO: 102640 - RNA, 20 nt, Human
cccacccaguggcccccuug

SEQ ID NO: 102641 - RNA, 32 nt, Human
cccacccauaccacagcauccccuagagagag

SEQ ID NO: 102642 - RNA, 32 nt, Human
cccacccaugaccuacagacaguguugcccac

SEQ ID NO: 102643 - RNA, 32 nt, Human
cccacccaugaccugcagacaguguugcccac

SEQ ID NO: 102644 - RNA, 32 nt, Human
cccacccaugaccugccgacaguguugcccac

SEQ ID NO: 102645 - RNA, 32 nt, Human
cccacccauguuuucacuaucccuucugcagc

SEQ ID NO: 102646 - RNA, 32 nt, Human
cccaccccaaaguuugucugugguguuauagu

SEQ ID NO: 102647 - RNA, 22 nt, Human
cccaccccaacccaccccaugc

SEQ ID NO: 102648 - RNA, 23 nt, Human
cccaccccaaccuccccagacuc

SEQ ID NO: 102649 - RNA, 32 nt, Human
cccaccccaagcccuggcugcgacagcucugg

SEQ ID NO: 102650 - RNA, 32 nt, Human
cccaccccaagcuccacugggcggggaggaga

SEQ ID NO: 102651 - RNA, 32 nt, Human
cccaccccaaguccaagaacaaaugccagcca

SEQ ID NO: 102652 - RNA, 32 nt, Human
cccaccccaaguucuaaggucuuuucagagcg

SEQ ID NO: 102653 - RNA, 32 nt, Human
cccaccccaauccagaugugaucccccuguga

SEQ ID NO: 102654 - RNA, 32 nt, Human
cccaccccaaucccagggcagaaggacaugag

SEQ ID NO: 102655 - RNA, 32 nt, Human
cccaccccacacacacgcaacagcucuguacc

SEQ ID NO: 102656 - RNA, 32 nt, Human
cccaccccacacccuucacccucuguguccug

SEQ ID NO: 102657 - RNA, 32 nt, Human
cccaccccacacuuguuccagcucuuugaaau

SEQ ID NO: 102658 - RNA, 32 nt, Human
cccaccccacagacuccggccuguaaucagcu

SEQ ID NO: 102659 - RNA, 32 nt, Human
cccaccccacagcucggacugcucugggaggg

SEQ ID NO: 102660 - RNA, 20 nt, Human
cccaccccacauuggucauc

SEQ ID NO: 102661 - RNA, 21 nt, Human
cccaccccaccccaccccagg

SEQ ID NO: 102662 - RNA, 21 nt, Human
cccaccccaccccauccagug

SEQ ID NO: 102663 - RNA, 18 nt, Human
cccaccccacccccgggc

SEQ ID NO: 102664 - RNA, 32 nt, Human
cccaccccaccccuagaacugccauucccaag

SEQ ID NO: 102665 - RNA, 32 nt, Human
cccaccccaccccugaggcuugcccagccccc

SEQ ID NO: 102666 - RNA, 32 nt, Human
cccaccccacgccgaggugcacugaccaugag

SEQ ID NO: 102667 - RNA, 20 nt, Human
cccaccccacuguccuccaa

SEQ ID NO: 102668 - RNA, 32 nt, Human
cccaccccacuucuggccaguuggaguccagc

SEQ ID NO: 102669 - RNA, 32 nt, Human
cccaccccagaacaagccgacacacagggaga

SEQ ID NO: 102670 - RNA, 32 nt, Human
cccaccccagagccuggaguugcagaggcagc

SEQ ID NO: 102671 - RNA, 32 nt, Human
cccaccccagcacugcccaucuguaaaaucuu

SEQ ID NO: 102672 - RNA, 32 nt, Human
cccaccccagccacucaacuccugcuuguuuu

SEQ ID NO: 102673 - RNA, 32 nt, Human
cccaccccagcucagagggagcaggggcccag

SEQ ID NO: 102674 - RNA, 32 nt, Human
cccaccccaggccuauucaaagaaagacucca

SEQ ID NO: 102675 - RNA, 19 nt, Human
cccaccccaggccuugccc

SEQ ID NO: 102676 - RNA, 18 nt, Human
cccaccccaucuccccac

SEQ ID NO: 102677 - RNA, 32 nt, Human
cccaccccaucuuugcugccagcucucaggac

SEQ ID NO: 102678 - RNA, 32 nt, Human
cccaccccaucuuugcugggauucccaucaac

SEQ ID NO: 102679 - RNA, 32 nt, Human
cccaccccauucucugcuaccacauaucguag

SEQ ID NO: 102680 - RNA, 22 nt, Human
cccaccccauucugccaccaug

SEQ ID NO: 102681 - RNA, 32 nt, Human
cccaccccauuucucuccucacacacagacuc

SEQ ID NO: 102682 - RNA, 32 nt, Human
cccaccccauuuucuuguuucugguccauccg

SEQ ID NO: 102683 - RNA, 32 nt, Human
cccacccccaaaccaccgacucucauugccga

SEQ ID NO: 102684 - RNA, 32 nt, Human
cccacccccaacaggaauucuauaguaaggag

SEQ ID NO: 102685 - RNA, 32 nt, Human
cccacccccaacuuuauuugcaaugggauuuu

SEQ ID NO: 102686 - RNA, 22 nt, Human
cccacccccaagugcuccccac

SEQ ID NO: 102687 - RNA, 19 nt, Human
cccacccccacagcgcccu

SEQ ID NO: 102688 - RNA, 21 nt, Human
cccacccccaccacugcacca

SEQ ID NO: 102689 - RNA, 21 nt, Human
cccacccccaccauccuauua

SEQ ID NO: 102690 - RNA, 21 nt, Human
cccacccccacccaaaaguca

SEQ ID NO: 102691 - RNA, 20 nt, Human
cccacccccacccaagggcc

SEQ ID NO: 102692 - RNA, 32 nt, Human
cccacccccacccaccucuaucccagugucuc

SEQ ID NO: 102693 - RNA, 24 nt, Human
cccacccccacccaggcaggaagc

SEQ ID NO: 102694 - RNA, 21 nt, Human
cccacccccacccaucccuau

SEQ ID NO: 102695 - RNA, 32 nt, Human
cccacccccacccaucccuauaugugugugug

SEQ ID NO: 102696 - RNA, 24 nt, Human
cccacccccacccauccucagcua

SEQ ID NO: 102697 - RNA, 20 nt, Human
cccacccccaccccagugug

SEQ ID NO: 102698 - RNA, 17 nt, Human
cccacccccacccccac

SEQ ID NO: 102699 - RNA, 32 nt, Human
cccacccccacccccaccgggguguccaaagg

SEQ ID NO: 102700 - RNA, 18 nt, Human
cccacccccacccccauu

SEQ ID NO: 102701 - RNA, 19 nt, Human
cccacccccaccccccaca

SEQ ID NO: 102702 - RNA, 24 nt, Human
cccacccccacccccguggagaca

SEQ ID NO: 102703 - RNA, 21 nt, Human
cccacccccaccccggcucug

SEQ ID NO: 102704 - RNA, 17 nt, Human
cccacccccaccccuac

SEQ ID NO: 102705 - RNA, 20 nt, Human
cccacccccacccgccugcc

SEQ ID NO: 102706 - RNA, 19 nt, Human
cccacccccacccggaacc

SEQ ID NO: 102707 - RNA, 20 nt, Human
cccacccccacccuacagcc

SEQ ID NO: 102708 - RNA, 21 nt, Human
cccacccccaccguccagcca

SEQ ID NO: 102709 - RNA, 21 nt, Human
cccacccccaccuccgaguca

SEQ ID NO: 102710 - RNA, 24 nt, Human
cccacccccacuguacagagacca

SEQ ID NO: 102711 - RNA, 32 nt, Human
cccacccccacugucccucaugugccaugggc

SEQ ID NO: 102712 - RNA, 32 nt, Human
cccacccccagaggaggcggaagaggagcccg

SEQ ID NO: 102713 - RNA, 32 nt, Human
cccacccccagccugggggucugcgcuggggc

SEQ ID NO: 102714 - RNA, 21 nt, Human
cccacccccaggacugcugcu

SEQ ID NO: 102715 - RNA, 22 nt, Human
cccacccccaggccacagacca

SEQ ID NO: 102716 - RNA, 32 nt, Human
cccacccccaggcuggcaguagcacugcugag

SEQ ID NO: 102717 - RNA, 22 nt, Human
cccacccccauguccaccauga

SEQ ID NO: 102718 - RNA, 23 nt, Human
cccaccccccucccucucucuga

SEQ ID NO: 102719 - RNA, 21 nt, Human
cccaccccccuucccaccuga

SEQ ID NO: 102720 - RNA, 18 nt, Human
cccaccccccuuucccac

SEQ ID NO: 102721 - RNA, 21 nt, Human
cccacccccgaaacaaugcca

SEQ ID NO: 102722 - RNA, 32 nt, Human
cccacccccgagaggcggagagaaugugggag

SEQ ID NO: 102723 - RNA, 32 nt, Human
cccacccccgcacacgcacacgcacaucaugc

SEQ ID NO: 102724 - RNA, 20 nt, Human
cccacccccgcacccacuaa

SEQ ID NO: 102725 - RNA, 32 nt, Human
cccacccccgcacgccuguaaucccagcacuu

SEQ ID NO: 102726 - RNA, 24 nt, Human
cccacccccgccccgcccaugcuc

SEQ ID NO: 102727 - RNA, 22 nt, Human
cccacccccguguccaccguga

SEQ ID NO: 102728 - RNA, 22 nt, Human
cccacccccucagcagggccgg

SEQ ID NO: 102729 - RNA, 27 nt, Human
cccacccccucauuccucccucgccuu

SEQ ID NO: 102730 - RNA, 32 nt, Human
cccacccccuccagguccucagaguuugcaga

SEQ ID NO: 102731 - RNA, 32 nt, Human
cccacccccucccagcccccuccccucugcuc

SEQ ID NO: 102732 - RNA, 19 nt, Human
cccacccccuccccacuag

SEQ ID NO: 102733 - RNA, 23 nt, Human
cccacccccuccucaggcuccug

SEQ ID NO: 102734 - RNA, 32 nt, Human
cccacccccuccugcugacacucucacaguca

SEQ ID NO: 102735 - RNA, 32 nt, Human
cccacccccucggggcagaguuugcacaaagu

SEQ ID NO: 102736 - RNA, 32 nt, Human
cccacccccugccacccccucccugcugucag

SEQ ID NO: 102737 - RNA, 22 nt, Human
cccacccccugccccucgggca

SEQ ID NO: 102738 - RNA, 32 nt, Human
cccacccccugcccuuuguuaccaacaccagu

SEQ ID NO: 102739 - RNA, 32 nt, Human
cccacccccugccucuuuugguuguuguucuu

SEQ ID NO: 102740 - RNA, 18 nt, Human
cccacccccugccugcca

SEQ ID NO: 102741 - RNA, 20 nt, Human
cccacccccugcucccacua

SEQ ID NO: 102742 - RNA, 32 nt, Human
cccacccccuggaagaggaagggcccgggcau

SEQ ID NO: 102743 - RNA, 32 nt, Human
cccacccccuuuccuuccagccuuucugucau

SEQ ID NO: 102744 - RNA, 32 nt, Human
cccaccccgcccgggcccuccucggagggcgg

SEQ ID NO: 102745 - RNA, 23 nt, Human
cccaccccgggagggcagagcca

SEQ ID NO: 102746 - RNA, 17 nt, Human
cccaccccgggccgcgu

SEQ ID NO: 102747 - RNA, 23 nt, Human
cccaccccuaaagauguguccug

SEQ ID NO: 102748 - RNA, 21 nt, Human
cccaccccuaaccuggcuccu

SEQ ID NO: 102749 - RNA, 32 nt, Human
cccaccccuaucucccuucgcugacacucucu

SEQ ID NO: 102750 - RNA, 32 nt, Human
cccaccccuaucucccuuugcugacucucuuu

SEQ ID NO: 102751 - RNA, 32 nt, Human
cccaccccucacugcaaaagcaucuccuuaag

SEQ ID NO: 102752 - RNA, 32 nt, Human
cccaccccucauuccugucccaguccaacauc

SEQ ID NO: 102753 - RNA, 32 nt, Human
cccaccccuccaccgcuugccuucaacccauc

SEQ ID NO: 102754 - RNA, 32 nt, Human
cccaccccuccaccucucucucgauuucucuc

SEQ ID NO: 102755 - RNA, 32 nt, Human
cccaccccuccacuggccagccugggggugcc

SEQ ID NO: 102756 - RNA, 32 nt, Human
cccaccccuccagaacacggcucacgcuuacc

SEQ ID NO: 102757 - RNA, 32 nt, Human
cccaccccucccaucuccaccccacauggaag

SEQ ID NO: 102758 - RNA, 17 nt, Human
cccaccccuccccacuc

SEQ ID NO: 102759 - RNA, 32 nt, Human
cccaccccucccccaucuccucuuugaaagcc

SEQ ID NO: 102760 - RNA, 32 nt, Human
cccaccccucccccugucugccugcccucccc

SEQ ID NO: 102761 - RNA, 32 nt, Human
cccaccccuccccuccucaccuucccuccccc

SEQ ID NO: 102762 - RNA, 32 nt, Human
cccaccccuccccucucacgggcucuccccuc

SEQ ID NO: 102763 - RNA, 32 nt, Human
cccaccccuccccugauggucuuguucucuug

SEQ ID NO: 102764 - RNA, 32 nt, Human
cccaccccuccccugcgucuccuuguaaaguu

SEQ ID NO: 102765 - RNA, 32 nt, Human
cccaccccuccuggcccuggaagcagcuaggg

SEQ ID NO: 102766 - RNA, 32 nt, Human
cccaccccucugagccuuuucuccccagggua

SEQ ID NO: 102767 - RNA, 32 nt, Human
cccaccccucuuacuccagccucguguuguaa

SEQ ID NO: 102768 - RNA, 25 nt, Human
cccaccccugaaagacuggccccug

SEQ ID NO: 102769 - RNA, 32 nt, Human
cccaccccugacacaacucagauuaaagacag

SEQ ID NO: 102770 - RNA, 32 nt, Human
cccaccccugaugucugcuccagagacaaagg

SEQ ID NO: 102771 - RNA, 32 nt, Human
cccaccccugcagaggccugaagcugggccug

SEQ ID NO: 102772 - RNA, 32 nt, Human
cccaccccugcagggcagucuucugauggcuc

SEQ ID NO: 102773 - RNA, 20 nt, Human
cccaccccugccuccuccag

SEQ ID NO: 102774 - RNA, 17 nt, Human
cccaccccugccugcca

SEQ ID NO: 102775 - RNA, 32 nt, Human
cccaccccugcuacauuaaagacuucagacug

SEQ ID NO: 102776 - RNA, 32 nt, Human
cccaccccugcuccuccuuugucagugcgauc

SEQ ID NO: 102777 - RNA, 32 nt, Human
cccaccccugcucgccccuaucgcuccagcca

SEQ ID NO: 102778 - RNA, 23 nt, Human
cccaccccuggacggcagaggca

SEQ ID NO: 102779 - RNA, 25 nt, Human
cccaccccuggacugguggccccca

SEQ ID NO: 102780 - RNA, 32 nt, Human
cccaccccuucccagcagcccucugagccccc

SEQ ID NO: 102781 - RNA, 32 nt, Human
cccaccccuucccagccccagcccuggagaca

SEQ ID NO: 102782 - RNA, 32 nt, Human
cccaccccuucccccaaacuaccuuuggaaca

SEQ ID NO: 102783 - RNA, 18 nt, Human
cccaccccuucccuuccc

SEQ ID NO: 102784 - RNA, 32 nt, Human
cccaccccuugcccuuuccccaaaggaccuuu

SEQ ID NO: 102785 - RNA, 21 nt, Human
cccaccccuugccucuggcca

SEQ ID NO: 102786 - RNA, 17 nt, Human
cccaccccuuuccacua

SEQ ID NO: 102787 - RNA, 32 nt, Human
cccacccgaguaccuccagucacacuccccgc

SEQ ID NO: 102788 - RNA, 32 nt, Human
cccacccgcauccugaguggcgcugcagggcu

SEQ ID NO: 102789 - RNA, 32 nt, Human
cccacccgcccagcuccgccucgguggcaaac

SEQ ID NO: 102790 - RNA, 32 nt, Human
cccacccgcucagaccugguugccagcccaac

SEQ ID NO: 102791 - RNA, 17 nt, Human
cccacccgcucccacua

SEQ ID NO: 102792 - RNA, 18 nt, Human
cccacccgcucugcccca

SEQ ID NO: 102793 - RNA, 32 nt, Human
cccacccggcaggcgcaggccacccacacccg

SEQ ID NO: 102794 - RNA, 20 nt, Human
cccacccggccagccgcccu

SEQ ID NO: 102795 - RNA, 32 nt, Human
cccacccggcucccggugucuccucccggccg

SEQ ID NO: 102796 - RNA, 32 nt, Human
cccacccgggaaaugaaacuguugggcugggc

SEQ ID NO: 102797 - RNA, 25 nt, Human
cccacccgggagagcugauccccgg

SEQ ID NO: 102798 - RNA, 20 nt, Human
cccacccgggccacccccgg

SEQ ID NO: 102799 - RNA, 24 nt, Human
cccacccggucguggcccacccgg

SEQ ID NO: 102800 - RNA, 32 nt, Human
cccacccgugcugggcagagugcgugcacgcc

SEQ ID NO: 102801 - RNA, 32 nt, Human
cccacccuaaccacagcgccucuccagaccua

SEQ ID NO: 102802 - RNA, 32 nt, Human
cccacccuacagccccagguccuggcccaguc

SEQ ID NO: 102803 - RNA, 21 nt, Human
cccacccuaccaccagacaca

SEQ ID NO: 102804 - RNA, 32 nt, Human
cccacccuacccaguacccacgucaccccaag

SEQ ID NO: 102805 - RNA, 18 nt, Human
cccacccuaccccaccac

SEQ ID NO: 102806 - RNA, 32 nt, Human
cccacccuaccccacccuaccccaccacagca

SEQ ID NO: 102807 - RNA, 19 nt, Human
cccacccuaccccccgggc

SEQ ID NO: 102808 - RNA, 19 nt, Human
cccacccuacuccccacua

SEQ ID NO: 102809 - RNA, 19 nt, Human
cccacccuauccccucuaa

SEQ ID NO: 102810 - RNA, 32 nt, Human
cccacccucagccaaccaaguccuggugguuu

SEQ ID NO: 102811 - RNA, 32 nt, Human
cccacccucauggagccuccagucuagcugcc

SEQ ID NO: 102812 - RNA, 32 nt, Human
cccacccucauggagcuuauauucuagcaagg

SEQ ID NO: 102813 - RNA, 22 nt, Human
cccacccucauguccaccauga

SEQ ID NO: 102814 - RNA, 19 nt, Human
cccacccuccacacacuaa

SEQ ID NO: 102815 - RNA, 18 nt, Human
cccacccuccacccacua

SEQ ID NO: 102816 - RNA, 32 nt, Human
cccacccuccacccacuaccuccuccaacaaa

SEQ ID NO: 102817 - RNA, 32 nt, Human
cccacccuccaccccacccauuaaugacuuga

SEQ ID NO: 102818 - RNA, 32 nt, Human
cccacccuccaccugccccucuugccucuggc

SEQ ID NO: 102819 - RNA, 32 nt, Human
cccacccuccacugacugccauggggcccucc

SEQ ID NO: 102820 - RNA, 22 nt, Human
cccacccuccagcuuuuccuca

SEQ ID NO: 102821 - RNA, 32 nt, Human
cccacccucccacccacccgaccagcagagcu

SEQ ID NO: 102822 - RNA, 19 nt, Human
cccacccuccccaacccac

SEQ ID NO: 102823 - RNA, 20 nt, Human
cccacccuccccauccccac

SEQ ID NO: 102824 - RNA, 18 nt, Human
cccacccuccccaugccu

SEQ ID NO: 102825 - RNA, 18 nt, Human
cccacccuccccgcccca

SEQ ID NO: 102826 - RNA, 20 nt, Human
cccacccuccccucuccuga

SEQ ID NO: 102827 - RNA, 23 nt, Human
cccacccuccccugaacagaacc

SEQ ID NO: 102828 - RNA, 18 nt, Human
cccacccuccccuuccca

SEQ ID NO: 102829 - RNA, 18 nt, Human
cccacccucccgacccca

SEQ ID NO: 102830 - RNA, 18 nt, Human
cccacccucccuccccac

SEQ ID NO: 102831 - RNA, 21 nt, Human
cccacccucccuccccaccuc

SEQ ID NO: 102832 - RNA, 18 nt, Human
cccacccucccugcccau

SEQ ID NO: 102833 - RNA, 18 nt, Human
cccacccucccuucccac

SEQ ID NO: 102834 - RNA, 19 nt, Human
cccacccuccuacagcuag

SEQ ID NO: 102835 - RNA, 21 nt, Human
cccacccuccuccacccucua

SEQ ID NO: 102836 - RNA, 32 nt, Human
cccacccuccuccagggaucauccaccaucau

SEQ ID NO: 102837 - RNA, 19 nt, Human
cccacccuccucccaggcu

SEQ ID NO: 102838 - RNA, 32 nt, Human
cccacccuccugaccgcagcucccaggcccug

SEQ ID NO: 102839 - RNA, 18 nt, Human
cccacccuccugccccac

SEQ ID NO: 102840 - RNA, 18 nt, Human
cccacccuccugccccau

SEQ ID NO: 102841 - RNA, 18 nt, Human
cccacccuccuggccuca

SEQ ID NO: 102842 - RNA, 18 nt, Human
cccacccuccuucccuac

SEQ ID NO: 102843 - RNA, 21 nt, Human
cccacccucgcccugcuugcc

SEQ ID NO: 102844 - RNA, 19 nt, Human
cccacccucggcccugccc

SEQ ID NO: 102845 - RNA, 32 nt, Human
cccacccucuacagccuuccucaggccccugu

SEQ ID NO: 102846 - RNA, 32 nt, Human
cccacccucucucccucaccccucucucuggg

SEQ ID NO: 102847 - RNA, 32 nt, Human
cccacccucuggcccccaccuucuuggaggcg

SEQ ID NO: 102848 - RNA, 21 nt, Human
cccacccucuugcugcucgcc

SEQ ID NO: 102849 - RNA, 19 nt, Human
cccacccucuuuuuacuaa

SEQ ID NO: 102850 - RNA, 32 nt, Human
cccacccugacagcccaacaccaccuuccucc

SEQ ID NO: 102851 - RNA, 32 nt, Human
cccacccugaugccugcccuccaggauggcug

SEQ ID NO: 102852 - RNA, 32 nt, Human
cccacccugcagagaaggaagaaaggugaccg

SEQ ID NO: 102853 - RNA, 32 nt, Human
cccacccugcagcgcuccagcucuguugugua

SEQ ID NO: 102854 - RNA, 17 nt, Human
cccacccugcccacuaa

SEQ ID NO: 102855 - RNA, 32 nt, Human
cccacccugcccacucccaucccuucaacccc

SEQ ID NO: 102856 - RNA, 32 nt, Human
cccacccugccccucagucaugcagcucacau

SEQ ID NO: 102857 - RNA, 22 nt, Human
cccacccugcccuggcucucug

SEQ ID NO: 102858 - RNA, 20 nt, Human
cccacccugcuagccugccu

SEQ ID NO: 102859 - RNA, 32 nt, Human
cccacccugcugccacagcuuugcaugcugag

SEQ ID NO: 102860 - RNA, 32 nt, Human
cccacccugcuguggucauuugucaaaggggg

SEQ ID NO: 102861 - RNA, 22 nt, Human
cccacccuggcaugcccccuug

SEQ ID NO: 102862 - RNA, 32 nt, Human
cccacccugugcuaccucaucuucccgggagg

SEQ ID NO: 102863 - RNA, 32 nt, Human
cccacccuuaucucccuucacugacucucuuu

SEQ ID NO: 102864 - RNA, 18 nt, Human
cccacccuucacuugcuu

SEQ ID NO: 102865 - RNA, 32 nt, Human
cccacccuucccaaagauugggagguuccgcc

SEQ ID NO: 102866 - RNA, 32 nt, Human
cccacccuucgaccacugccucccucggccca

SEQ ID NO: 102867 - RNA, 32 nt, Human
cccacccuucuugcuguccccaacacaccuga

SEQ ID NO: 102868 - RNA, 16 nt, Human
cccacccuugccacua

SEQ ID NO: 102869 - RNA, 32 nt, Human
cccacccuugcucuccaauuaggcccacgugg

SEQ ID NO: 102870 - RNA, 32 nt, Human
cccacccuuguagagcaaaacucuucucucaa

SEQ ID NO: 102871 - RNA, 23 nt, Human
cccaccgacauuguccacccugg

SEQ ID NO: 102872 - RNA, 32 nt, Human
cccaccgcaaaguggcgguuuacuugaggcgg

SEQ ID NO: 102873 - RNA, 17 nt, Human
cccaccgcagcccucca

SEQ ID NO: 102874 - RNA, 32 nt, Human
cccaccgccccacugcaccaagacuguaauau

SEQ ID NO: 102875 - RNA, 24 nt, Human
cccaccgcccucccuccccagcuc

SEQ ID NO: 102876 - RNA, 18 nt, Human
cccaccgccggcccccgg

SEQ ID NO: 102877 - RNA, 32 nt, Human
cccaccgccucuucuccaucugagaaucacgg

SEQ ID NO: 102878 - RNA, 22 nt, Human
cccaccgcgcccucguucgccu

SEQ ID NO: 102879 - RNA, 21 nt, Human
cccaccgcgcgccucgccgcc

SEQ ID NO: 102880 - RNA, 17 nt, Human
cccaccgcucagcgccu

SEQ ID NO: 102881 - RNA, 20 nt, Human
cccaccgcucuucgcccgcc

SEQ ID NO: 102882 - RNA, 32 nt, Human
cccaccgcugugcaucgaaugagggaaguggc

SEQ ID NO: 102883 - RNA, 32 nt, Human
cccaccggacacacccucacuucgggaacagg

SEQ ID NO: 102884 - RNA, 32 nt, Human
cccaccgggguggggagagggacuuccagacu

SEQ ID NO: 102885 - RNA, 32 nt, Human
cccaccgucccucccuuuucuccucaaguccu

SEQ ID NO: 102886 - RNA, 32 nt, Human
cccaccgugccuggccuuuccuguuuaucuuu

SEQ ID NO: 102887 - RNA, 32 nt, Human
cccaccguuuucuuccccucagucucucccau

SEQ ID NO: 102888 - RNA, 24 nt, Human
cccaccuaaagauccucccccuaa

SEQ ID NO: 102889 - RNA, 32 nt, Human
cccaccuacccacauucuggccccuggcaauu

SEQ ID NO: 102890 - RNA, 32 nt, Human
cccaccuaccccuuccuuccucuuuaucucuc

SEQ ID NO: 102891 - RNA, 32 nt, Human
cccaccuaggccacgugugagcugcuccuguc

SEQ ID NO: 102892 - RNA, 32 nt, Human
cccaccuauccccauucucugccuguacugaa

SEQ ID NO: 102893 - RNA, 32 nt, Human
cccaccucaaaacuguuucggaugcuagaaau

SEQ ID NO: 102894 - RNA, 32 nt, Human
cccaccucaagugccuuauucucacagcaagc

SEQ ID NO: 102895 - RNA, 32 nt, Human
cccaccucacacccuucacucuccuuuuucug

SEQ ID NO: 102896 - RNA, 32 nt, Human
cccaccucacauaggacccggaagcagccuga

SEQ ID NO: 102897 - RNA, 32 nt, Human
cccaccucacccaggucucagcggcagugggc

SEQ ID NO: 102898 - RNA, 32 nt, Human
cccaccucacccauagguggcuacuaccuuac

SEQ ID NO: 102899 - RNA, 32 nt, Human
cccaccucaccuuuucauauuugguaaacugu

SEQ ID NO: 102900 - RNA, 24 nt, Human
cccaccucacuucccucccuuccc

SEQ ID NO: 102901 - RNA, 32 nt, Human
cccaccucagaguaaggacuacccagggguga

SEQ ID NO: 102902 - RNA, 30 nt, Human
cccaccucagcccccaugcucuugucaaac

SEQ ID NO: 102903 - RNA, 32 nt, Human
cccaccucagccuauugggcagcugggacuac

SEQ ID NO: 102904 - RNA, 32 nt, Human
cccaccucagcuucccaaaaugcugggauuac

SEQ ID NO: 102905 - RNA, 19 nt, Human
cccaccucaggcccugccc

SEQ ID NO: 102906 - RNA, 32 nt, Human
cccaccuccaacaauggggauuacaguuugac

SEQ ID NO: 102907 - RNA, 32 nt, Human
cccaccuccaccuugucacuccagguucuggu

SEQ ID NO: 102908 - RNA, 32 nt, Human
cccaccuccagacugacaacaaaaagaccuaa

SEQ ID NO: 102909 - RNA, 32 nt, Human
cccaccuccagccucaccaccaggccaggagg

SEQ ID NO: 102910 - RNA, 32 nt, Human
cccaccuccaggccucucccaccucaggcccu

SEQ ID NO: 102911 - RNA, 23 nt, Human
cccaccuccaugccuggcuccug

SEQ ID NO: 102912 - RNA, 32 nt, Human
cccaccucccacccuccuccucuucuccuuca

SEQ ID NO: 102913 - RNA, 23 nt, Human
cccaccucccagcccucuccuca

SEQ ID NO: 102914 - RNA, 32 nt, Human
cccaccucccaguguugagauuauagguaugu

SEQ ID NO: 102915 - RNA, 22 nt, Human
cccaccucccgagcuggcuggg

SEQ ID NO: 102916 - RNA, 32 nt, Human
cccaccucccugaccuaccccugcugcaccau

SEQ ID NO: 102917 - RNA, 17 nt, Human
cccaccucccugccagg

SEQ ID NO: 102918 - RNA, 17 nt, Human
cccaccuccgccugcca

SEQ ID NO: 102919 - RNA, 32 nt, Human
cccaccuccuacuccuggcucagaccuuugcu

SEQ ID NO: 102920 - RNA, 32 nt, Human
cccaccuccucccuucccagccccaaagaacu

SEQ ID NO: 102921 - RNA, 16 nt, Human
cccaccuccuccgggc

SEQ ID NO: 102922 - RNA, 32 nt, Human
cccaccuccucugccucaaggcuguccuggcu

SEQ ID NO: 102923 - RNA, 20 nt, Human
cccaccuccugcucccgggc

SEQ ID NO: 102924 - RNA, 20 nt, Human
cccaccuccuggcucccagg

SEQ ID NO: 102925 - RNA, 25 nt, Human
cccaccuccuggcucccaggacggg

SEQ ID NO: 102926 - RNA, 19 nt, Human
cccaccuccuuccccccac

SEQ ID NO: 102927 - RNA, 32 nt, Human
cccaccuccuugcucuccccagccugccaagc

SEQ ID NO: 102928 - RNA, 23 nt, Human
cccaccucgcgguccccaggacc

SEQ ID NO: 102929 - RNA, 32 nt, Human
cccaccucucaaggagucucaugccgcagggu

SEQ ID NO: 102930 - RNA, 22 nt, Human
cccaccucucauagcagagcca

SEQ ID NO: 102931 - RNA, 32 nt, Human
cccaccucucccggccucugcagccaccgucc

SEQ ID NO: 102932 - RNA, 32 nt, Human
cccaccucucccugggggucucagggagaacc

SEQ ID NO: 102933 - RNA, 32 nt, Human
cccaccucuccgccucuccaucaccagccuuc

SEQ ID NO: 102934 - RNA, 32 nt, Human
cccaccucucucaugcugaaucacauccaugg

SEQ ID NO: 102935 - RNA, 31 nt, Human
cccaccucucucucugguccuguucaucucu

SEQ ID NO: 102936 - RNA, 32 nt, Human
cccaccucucuuuucugucauucuccaacucu

SEQ ID NO: 102937 - RNA, 18 nt, Human
cccaccucugggccgggc

SEQ ID NO: 102938 - RNA, 32 nt, Human
cccaccucuucucuccccuacagggcccuugc

SEQ ID NO: 102939 - RNA, 21 nt, Human
cccaccucuucucuucugcuu

SEQ ID NO: 102940 - RNA, 32 nt, Human
cccaccucuugagagcccccagugccggagca

SEQ ID NO: 102941 - RNA, 19 nt, Human
cccaccucuugcccccuaa

SEQ ID NO: 102942 - RNA, 32 nt, Human
cccaccucuuucccaggcaccugggcccugcc

SEQ ID NO: 102943 - RNA, 32 nt, Human
cccaccugacugcaguggcugcugcuugcuug

SEQ ID NO: 102944 - RNA, 32 nt, Human
cccaccugagcccugacagcaccaaggcccuc

SEQ ID NO: 102945 - RNA, 32 nt, Human
cccaccugagccugacagaggagaagcagcgg

SEQ ID NO: 102946 - RNA, 32 nt, Human
cccaccugcaagcugggguggggaugaagccu

SEQ ID NO: 102947 - RNA, 32 nt, Human
cccaccugcaauuucccaccuccugcccaucc

SEQ ID NO: 102948 - RNA, 22 nt, Human
cccaccugccacccaggacggg

SEQ ID NO: 102949 - RNA, 32 nt, Human
cccaccugccccaaccuccaccccucucugug

SEQ ID NO: 102950 - RNA, 32 nt, Human
cccaccugccuguauaccccagacuugccucu

SEQ ID NO: 102951 - RNA, 32 nt, Human
cccaccugccuguaugacagagugagacccug

SEQ ID NO: 102952 - RNA, 32 nt, Human
cccaccugccuucacagguuuaucucccaggc

SEQ ID NO: 102953 - RNA, 22 nt, Human
cccaccugccuugcucuuggaa

SEQ ID NO: 102954 - RNA, 19 nt, Human
cccaccugccuuuccccac

SEQ ID NO: 102955 - RNA, 18 nt, Human
cccaccugcgucagcuca

SEQ ID NO: 102956 - RNA, 32 nt, Human
cccaccugcuacccucccuccuaggcaucuuc

SEQ ID NO: 102957 - RNA, 32 nt, Human
cccaccugcucaccaauuccacuuccugcccc

SEQ ID NO: 102958 - RNA, 32 nt, Human
cccaccugcuccuuuucuccugcagcauggag

SEQ ID NO: 102959 - RNA, 22 nt, Human
cccaccugcuggaccccagggu

SEQ ID NO: 102960 - RNA, 32 nt, Human
cccaccugcuggagugaaggggccaaggaggg

SEQ ID NO: 102961 - RNA, 32 nt, Human
cccaccuggaccaccugaccccucgggauucc

SEQ ID NO: 102962 - RNA, 32 nt, Human
cccaccuggacccugggcuauuggcugcuccc

SEQ ID NO: 102963 - RNA, 22 nt, Human
cccaccuggagcccuccccugc

SEQ ID NO: 102964 - RNA, 32 nt, Human
cccaccuggaggaggagguuggaggguugacc

SEQ ID NO: 102965 - RNA, 19 nt, Human
cccaccuggccuccacuug

SEQ ID NO: 102966 - RNA, 29 nt, Human
cccaccuggcugccaacaugauccccguc

SEQ ID NO: 102967 - RNA, 32 nt, Human
cccaccugggcaacaagaaggaaacucugucu

SEQ ID NO: 102968 - RNA, 32 nt, Human
cccaccugggcaacauaguaagaucuugucuc

SEQ ID NO: 102969 - RNA, 20 nt, Human
cccaccuggggccccauuaa

SEQ ID NO: 102970 - RNA, 32 nt, Human
cccaccugggugggacacagcaggugcuggac

SEQ ID NO: 102971 - RNA, 32 nt, Human
cccaccugguagacacggucacugugacagga

SEQ ID NO: 102972 - RNA, 32 nt, Human
cccaccuguagucccagcacuuugggaggcaa

SEQ ID NO: 102973 - RNA, 32 nt, Human
cccaccuguccaucuccauaaaaaucccuaaa

SEQ ID NO: 102974 - RNA, 32 nt, Human
cccaccuguccuaucaggugggccacacccug

SEQ ID NO: 102975 - RNA, 32 nt, Human
cccaccugucggucuuguccuggcucugccug

SEQ ID NO: 102976 - RNA, 25 nt, Human
cccaccugugaaucucaggccccca

SEQ ID NO: 102977 - RNA, 32 nt, Human
cccaccuguuacugcugggagucaagucagcu

SEQ ID NO: 102978 - RNA, 32 nt, Human
cccaccuguucuuuccuccccugccgaggugu

SEQ ID NO: 102979 - RNA, 31 nt, Human
cccaccuuacucaaggguguagguaagagau

SEQ ID NO: 102980 - RNA, 22 nt, Human
cccaccuuccagacccccuugg

SEQ ID NO: 102981 - RNA, 32 nt, Human
cccaccuuccaugagugcagcacacagguagu

SEQ ID NO: 102982 - RNA, 21 nt, Human
cccaccuuccccccaccugag

SEQ ID NO: 102983 - RNA, 32 nt, Human
cccaccuucccucuuuucuggaagccaaaguc

SEQ ID NO: 102984 - RNA, 32 nt, Human
cccaccuuccuccucacucucuaccucccugc

SEQ ID NO: 102985 - RNA, 32 nt, Human
cccaccuuccuuaccuccucuucccccauuaa

SEQ ID NO: 102986 - RNA, 32 nt, Human
cccaccuuccuuccaugguucccacccuccac

SEQ ID NO: 102987 - RNA, 25 nt, Human
cccaccuugaaaaucgcugcucuga

SEQ ID NO: 102988 - RNA, 32 nt, Human
cccaccuugccucuguccugcgcugggcucca

SEQ ID NO: 102989 - RNA, 18 nt, Human
cccaccuugccuggcucc

SEQ ID NO: 102990 - RNA, 20 nt, Human
cccaccuugccuggcuccca

SEQ ID NO: 102991 - RNA, 32 nt, Human
cccaccuugcugucugucucauugucuuucuc

SEQ ID NO: 102992 - RNA, 32 nt, Human
cccaccuugucagaggcuuccacccugcucac

SEQ ID NO: 102993 - RNA, 22 nt, Human
cccaccuuucuggacggaacca

SEQ ID NO: 102994 - RNA, 32 nt, Human
cccaccuuuucgggcugucccaugucuaucuc

SEQ ID NO: 102995 - RNA, 32 nt, Human
cccaccuuuuucuccccucuccgucuucuccc

SEQ ID NO: 102996 - RNA, 32 nt, Human
cccacgaacccccagccccgcacccuccccgu

SEQ ID NO: 102997 - RNA, 32 nt, Human
cccacgacacugcagccccacccagaugcccc

SEQ ID NO: 102998 - RNA, 32 nt, Human
cccacgacccagucaaauuugaugucccuuug

SEQ ID NO: 102999 - RNA, 23 nt, Human
cccacgaccgcagcagccucgcc

SEQ ID NO: 103000 - RNA, 32 nt, Human
cccacgaccggagugcuggcucucacagugaa

SEQ ID NO: 103001 - RNA, 32 nt, Human
cccacgagaagaacuaaaaauuacgcuggucc

SEQ ID NO: 103002 - RNA, 24 nt, Human
cccacgagauggaaguugcaguga

SEQ ID NO: 103003 - RNA, 18 nt, Human
cccacgaggaggaaccag

SEQ ID NO: 103004 - RNA, 21 nt, Human
cccacgaggcaggagucagga

SEQ ID NO: 103005 - RNA, 32 nt, Human
cccacgagggaguaugggagagagggacugcc

SEQ ID NO: 103006 - RNA, 18 nt, Human
cccacgaguacagaccag

SEQ ID NO: 103007 - RNA, 24 nt, Human
cccacgaguucaaggcugcaguga

SEQ ID NO: 103008 - RNA, 32 nt, Human
cccacgaguucaaggcugcagugagucgugau

SEQ ID NO: 103009 - RNA, 32 nt, Human
cccacgaucacccagcaggagucguggcagaa

SEQ ID NO: 103010 - RNA, 32 nt, Human
cccacgauguggggaaagauaggagagucuag

SEQ ID NO: 103011 - RNA, 32 nt, Human
cccacgauuggagagaauccugcuaagccagu

SEQ ID NO: 103012 - RNA, 32 nt, Human
cccacgcacaccucggccugaugagaggaugg

SEQ ID NO: 103013 - RNA, 32 nt, Human
cccacgcacaugcacaccacaacacacaacac

SEQ ID NO: 103014 - RNA, 32 nt, Human
cccacgcacccccucacacacuaugcucucuc

SEQ ID NO: 103015 - RNA, 32 nt, Human
cccacgcagagucacugcuggggaagggaugg

SEQ ID NO: 103016 - RNA, 20 nt, Human
cccacgcaggagugcagugg

SEQ ID NO: 103017 - RNA, 32 nt, Human
cccacgcauguggccgccagccccaggagccc

SEQ ID NO: 103018 - RNA, 21 nt, Human
cccacgcccacuagccugcca

SEQ ID NO: 103019 - RNA, 23 nt, Human
cccacgccccuccccagccccca

SEQ ID NO: 103020 - RNA, 20 nt, Human
cccacgcccggcgccgcccg

SEQ ID NO: 103021 - RNA, 32 nt, Human
cccacgcccugccugcucuuccaguccagcca

SEQ ID NO: 103022 - RNA, 32 nt, Human
cccacgccucagguguggcugccugugggacc

SEQ ID NO: 103023 - RNA, 21 nt, Human
cccacgccuccagcgccgccu

SEQ ID NO: 103024 - RNA, 32 nt, Human
cccacgccucuaaucccagcacuuugggaggc

SEQ ID NO: 103025 - RNA, 32 nt, Human
cccacgccuguaaucccagcacuuugggagac

SEQ ID NO: 103026 - RNA, 32 nt, Human
cccacgccuguaaucccagcacuuugggaggc

SEQ ID NO: 103027 - RNA, 32 nt, Human
cccacgccuguaaucccagcuacuuggaaggc

SEQ ID NO: 103028 - RNA, 32 nt, Human
cccacgccuguccuccccaucacuuuccuguc

SEQ ID NO: 103029 - RNA, 20 nt, Human
cccacgccuucucccuuccu

SEQ ID NO: 103030 - RNA, 32 nt, Human
cccacgccuuuccaugggauaauagggaccua

SEQ ID NO: 103031 - RNA, 32 nt, Human
cccacgcgcacacacuccugcccacgcccacg

SEQ ID NO: 103032 - RNA, 20 nt, Human
cccacgcgcagcccaggacc

SEQ ID NO: 103033 - RNA, 23 nt, Human
cccacgcgcccgcggcccgcgcg

SEQ ID NO: 103034 - RNA, 24 nt, Human
cccacgcgccucgcuugcugcgcg

SEQ ID NO: 103035 - RNA, 32 nt, Human
cccacgcgcugccccuuccuggccugacccca

SEQ ID NO: 103036 - RNA, 32 nt, Human
cccacgcggaggaaggaagagacgcaggcagg

SEQ ID NO: 103037 - RNA, 21 nt, Human
cccacgcguccgcccacgcgu

SEQ ID NO: 103038 - RNA, 32 nt, Human
cccacgcguccgcucccucucucccucccucc

SEQ ID NO: 103039 - RNA, 32 nt, Human
cccacgcguccgguggaaguggccguggggcg

SEQ ID NO: 103040 - RNA, 23 nt, Human
cccacgcgucgugucgccgggaa

SEQ ID NO: 103041 - RNA, 32 nt, Human
cccacgcuauggacccagauaggagggguuag

SEQ ID NO: 103042 - RNA, 32 nt, Human
cccacgcucaaacuguaugccugcuccagccu

SEQ ID NO: 103043 - RNA, 32 nt, Human
cccacgcuccuccaccacgaggcacugaccug

SEQ ID NO: 103044 - RNA, 32 nt, Human
cccacgcugccccaucuugccugcuguuccag

SEQ ID NO: 103045 - RNA, 20 nt, Human
cccacgcuggaaugcagugg

SEQ ID NO: 103046 - RNA, 32 nt, Human
cccagggcuguaaccuggugucugguagcccc

SEQ ID NO: 103047 - RNA, 32 nt, Human
cccagggcuguaacugccaggcucucuuugcc

SEQ ID NO: 103048 - RNA, 18 nt, Human
cccagggcugugcuggug

SEQ ID NO: 103049 - RNA, 21 nt, Human
cccagggcuuaggagggcugg

SEQ ID NO: 103050 - RNA, 32 nt, Human
cccagggcuucugcuugccucgcugauguugc

SEQ ID NO: 103051 - RNA, 28 nt, Human
cccagggcuuuccuucccucuccugcuu

SEQ ID NO: 103052 - RNA, 26 nt, Human
cccagggcuuuccuuucaccuccugc

SEQ ID NO: 103053 - RNA, 21 nt, Human
cccagggcuuucuuucugcuu

SEQ ID NO: 103054 - RNA, 32 nt, Human
cccagggcuuugcagccugcagaugccaccug

SEQ ID NO: 103055 - RNA, 27 nt, Human
cccagggcuuugcccuaccuucuguuu

SEQ ID NO: 103056 - RNA, 20 nt, Human
cccaggggaacaccccugcc

SEQ ID NO: 103057 - RNA, 19 nt, Human
cccaggggaacuggcagcg

SEQ ID NO: 103058 - RNA, 32 nt, Human
cccaggggaagaaaggagggcugugaggagau

SEQ ID NO: 103059 - RNA, 17 nt, Human
cccaggggaagacccag

SEQ ID NO: 103060 - RNA, 16 nt, Human
cccaggggaaggccag

SEQ ID NO: 103061 - RNA, 23 nt, Human
cccaggggaaugaucucugauga

SEQ ID NO: 103062 - RNA, 32 nt, Human
cccaggggacacuucccucagcaaagaguaga

SEQ ID NO: 103063 - RNA, 17 nt, Human
cccaggggaugagagcc

SEQ ID NO: 103064 - RNA, 17 nt, Human
cccaggggccaagucag

SEQ ID NO: 103065 - RNA, 19 nt, Human
cccaggggccaggggccag

SEQ ID NO: 103066 - RNA, 20 nt, Human
cccaggggcccacagccacg

SEQ ID NO: 103067 - RNA, 22 nt, Human
cccaggggcccggccuccaggg

SEQ ID NO: 103068 - RNA, 23 nt, Human
cccaggggcccucccggguccca

SEQ ID NO: 103069 - RNA, 32 nt, Human
cccaggggccgcacagacgaggcgugguccag

SEQ ID NO: 103070 - RNA, 17 nt, Human
cccaggggccgggccag

SEQ ID NO: 103071 - RNA, 32 nt, Human
cccaggggcgggcagagagggaaggagggagg

SEQ ID NO: 103072 - RNA, 20 nt, Human
cccaggggcugaggccagcu

SEQ ID NO: 103073 - RNA, 18 nt, Human
cccaggggcugcaugugg

SEQ ID NO: 103074 - RNA, 32 nt, Human
cccaggggcuguggacaaaccggcugggggac

SEQ ID NO: 103075 - RNA, 21 nt, Human
cccaggggcuuccgggcacag

SEQ ID NO: 103076 - RNA, 32 nt, Human
cccaggggcuuccuuuggacuggacugucccu

SEQ ID NO: 103077 - RNA, 32 nt, Human
cccagggggagggggagagagcaaggagaucg

SEQ ID NO: 103078 - RNA, 24 nt, Human
cccagggggcagagguugcaguga

SEQ ID NO: 103079 - RNA, 32 nt, Human
cccagggggcagagguugcagugagccgagau

SEQ ID NO: 103080 - RNA, 21 nt, Human
cccagggggccacuccugaga

SEQ ID NO: 103081 - RNA, 17 nt, Human
cccagggggccggccgg

SEQ ID NO: 103082 - RNA, 21 nt, Human
cccagggggcgacagaggcag

SEQ ID NO: 103083 - RNA, 32 nt, Human
cccagggggcggagcuuggaguaagccgagau

SEQ ID NO: 103084 - RNA, 23 nt, Human
cccagggggcggagguugcagug

SEQ ID NO: 103085 - RNA, 24 nt, Human
cccagggggcggagguugcaguga

SEQ ID NO: 103086 - RNA, 16 nt, Human
cccaggggggacgcca

SEQ ID NO: 103087 - RNA, 20 nt, Human
cccagggggucugccugaga

SEQ ID NO: 103088 - RNA, 21 nt, Human
cccagggggucugccugagaa

SEQ ID NO: 103089 - RNA, 32 nt, Human
cccaggggguuagaggaggggugaagauuggg

SEQ ID NO: 103090 - RNA, 18 nt, Human
cccaggggguugguccag

SEQ ID NO: 103091 - RNA, 32 nt, Human
cccagggguaugagggcaccagcuggguucuc

SEQ ID NO: 103092 - RNA, 21 nt, Human
cccaggggucccgcggguuuu

SEQ ID NO: 103093 - RNA, 23 nt, Human
cccaggggucuaauuacuugaga

SEQ ID NO: 103094 - RNA, 22 nt, Human
cccaggggucucccuggcuccc

SEQ ID NO: 103095 - RNA, 21 nt, Human
cccaggggugccuuggggaug

SEQ ID NO: 103096 - RNA, 23 nt, Human
cccagggguggaggcugcaauga

SEQ ID NO: 103097 - RNA, 32 nt, Human
cccaggggugggaaguuuucauuugcaggggg

SEQ ID NO: 103098 - RNA, 24 nt, Human
cccagggguucacagcugcaguga

SEQ ID NO: 103099 - RNA, 24 nt, Human
cccagggguugcaggcugcaguga

SEQ ID NO: 103100 - RNA, 24 nt, Human
cccagggguuugaagcuucaguga

SEQ ID NO: 103101 - RNA, 24 nt, Human
cccagggguuugaggcugcaguga

SEQ ID NO: 103102 - RNA, 24 nt, Human
cccagggguuugcggcugcaguga

SEQ ID NO: 103103 - RNA, 32 nt, Human
cccaggguaagugcccacgaaagcccagucca

SEQ ID NO: 103104 - RNA, 21 nt, Human
cccagggucacacagcagcuu

SEQ ID NO: 103105 - RNA, 32 nt, Human
cccagggucaccaggccagagccuccaguggu

SEQ ID NO: 103106 - RNA, 32 nt, Human
cccagggucaggcccuucagagccagggcuag

SEQ ID NO: 103107 - RNA, 21 nt, Human
cccaggguccaccuuuuacuu

SEQ ID NO: 103108 - RNA, 22 nt, Human
cccaggguccagauuucugcuu

SEQ ID NO: 103109 - RNA, 21 nt, Human
cccagggucccagccuggcca

SEQ ID NO: 103110 - RNA, 32 nt, Human
cccagggucccagccuggccaccagcuucccu

SEQ ID NO: 103111 - RNA, 22 nt, Human
cccagggucccagcuggcuggg

SEQ ID NO: 103112 - RNA, 22 nt, Human
cccaggguccccuccccagcuc

SEQ ID NO: 103113 - RNA, 28 nt, Human
cccaggguccuaccuccuccucuugcuu

SEQ ID NO: 103114 - RNA, 32 nt, Human
cccaggguccugugccuggaugggggugcagg

SEQ ID NO: 103115 - RNA, 21 nt, Human
cccagggucuaccuucugccu

SEQ ID NO: 103116 - RNA, 32 nt, Human
cccagggucucccauagacagccugggggcaa

SEQ ID NO: 103117 - RNA, 23 nt, Human
cccagggucuucccuaccucagg

SEQ ID NO: 103118 - RNA, 22 nt, Human
cccagggugagcagggcccuca

SEQ ID NO: 103119 - RNA, 32 nt, Human
cccagggugccuggcuggucccugccggcagc

SEQ ID NO: 103120 - RNA, 32 nt, Human
cccagggugcugcaguggcucacagagaugcc

SEQ ID NO: 103121 - RNA, 32 nt, Human
cccagggugcugcugccacccgccccagccag

SEQ ID NO: 103122 - RNA, 24 nt, Human
cccagggugcugggauuacaggca

SEQ ID NO: 103123 - RNA, 21 nt, Human
cccaggguggaauacaguggu

SEQ ID NO: 103124 - RNA, 23 nt, Human
cccaggguggaauacaguggugu

SEQ ID NO: 103125 - RNA, 19 nt, Human
cccaggguggagacagugg

SEQ ID NO: 103126 - RNA, 20 nt, Human
cccaggguggagugcagugg

SEQ ID NO: 103127 - RNA, 21 nt, Human
cccaggguggagugcaguggu

SEQ ID NO: 103128 - RNA, 32 nt, Human
cccaggguggcagagcuguggugcaggguugc

SEQ ID NO: 103129 - RNA, 32 nt, Human
cccaggguggcugccagcccacugccuccugc

SEQ ID NO: 103130 - RNA, 32 nt, Human
cccagggugggagcugggccgggcugggaugu

SEQ ID NO: 103131 - RNA, 32 nt, Human
cccagggugggguggggugggguggagggguc

SEQ ID NO: 103132 - RNA, 32 nt, Human
cccagggugggucaggcgugugcacuguggaa

SEQ ID NO: 103133 - RNA, 32 nt, Human
cccagggugggugggacugagcaggauggauu

SEQ ID NO: 103134 - RNA, 32 nt, Human
cccaggguggugagagagucccaugccacccg

SEQ ID NO: 103135 - RNA, 32 nt, Human
cccagggugugcagccacugacuuggggacug

SEQ ID NO: 103136 - RNA, 23 nt, Human
cccagggugugccagcccgucuc

SEQ ID NO: 103137 - RNA, 32 nt, Human
cccaggguuacagcaagagccacugaggugug

SEQ ID NO: 103138 - RNA, 32 nt, Human
cccaggguuagagugggcagggcagagccgcg

SEQ ID NO: 103139 - RNA, 32 nt, Human
cccaggguucggagcuugugaguggacggugc

SEQ ID NO: 103140 - RNA, 28 nt, Human
cccaggguucuaucuucuuuucuugccu

SEQ ID NO: 103141 - RNA, 22 nt, Human
cccaggguucuauucucugccu

SEQ ID NO: 103142 - RNA, 28 nt, Human
cccaggguucucuuuuaucugcuugccu

SEQ ID NO: 103143 - RNA, 29 nt, Human
cccaggguucuguuuccuccuuucugccu

SEQ ID NO: 103144 - RNA, 26 nt, Human
cccaggguucuuuccaucucuugucu

SEQ ID NO: 103145 - RNA, 28 nt, Human
cccaggguuuaccuucuaccucuuggcu

SEQ ID NO: 103146 - RNA, 28 nt, Human
cccaggguuuuaaauguaucucuugccu

SEQ ID NO: 103147 - RNA, 28 nt, Human
cccaggguuuuccccucuacucuugucu

SEQ ID NO: 103148 - RNA, 27 nt, Human
cccaggguuuugauucauuuucugccu

SEQ ID NO: 103149 - RNA, 27 nt, Human
cccaggguuuuguuucugccuccugcu

SEQ ID NO: 103150 - RNA, 29 nt, Human
cccaggguuuuguuuuuugacuucugccu

SEQ ID NO: 103151 - RNA, 21 nt, Human
cccagguaacuccucucucaa

SEQ ID NO: 103152 - RNA, 32 nt, Human
cccagguaaggcggaggcugcuggugugagga

SEQ ID NO: 103153 - RNA, 18 nt, Human
cccagguacugcagcggc

SEQ ID NO: 103154 - RNA, 32 nt, Human
cccagguagagacaagcuagaggcucugcgga

SEQ ID NO: 103155 - RNA, 24 nt, Human
cccagguagcugggacuacaggca

SEQ ID NO: 103156 - RNA, 22 nt, Human
cccagguagcugggauuacagg

SEQ ID NO: 103157 - RNA, 24 nt, Human
cccagguagcugggauuacaggca

SEQ ID NO: 103158 - RNA, 20 nt, Human
cccagguagggaaagcggaa

SEQ ID NO: 103159 - RNA, 32 nt, Human
cccagguagggaggggagaguaugaggagggu

SEQ ID NO: 103160 - RNA, 18 nt, Human
cccagguaguccaugcgg

SEQ ID NO: 103161 - RNA, 32 nt, Human
cccagguagucuggguuggaggaggcagagcc

SEQ ID NO: 103162 - RNA, 32 nt, Human
cccagguauccuaucccaaccuugccagcaug

SEQ ID NO: 103163 - RNA, 22 nt, Human
cccagguaugccgcagagccag

SEQ ID NO: 103164 - RNA, 32 nt, Human
cccagguaugcucccaccuccaccugccccac

SEQ ID NO: 103165 - RNA, 32 nt, Human
cccagguauucaagaccagccugggaaacgug

SEQ ID NO: 103166 - RNA, 18 nt, Human
cccaggucacacuguggc

SEQ ID NO: 103167 - RNA, 32 nt, Human
cccaggucacccaaccagcgaguggcagaacu

SEQ ID NO: 103168 - RNA, 18 nt, Human
cccaggucaguggucccc

SEQ ID NO: 103169 - RNA, 17 nt, Human
cccagguccagggccag

SEQ ID NO: 103170 - RNA, 23 nt, Human
cccagguccccaccugugggcca

SEQ ID NO: 103171 - RNA, 24 nt, Human
cccaggucccgaaagaugcaguga

SEQ ID NO: 103172 - RNA, 21 nt, Human
cccagguccugcugccucucu

SEQ ID NO: 103173 - RNA, 32 nt, Human
cccagguccuggcugccagcuuuccuccucug

SEQ ID NO: 103174 - RNA, 16 nt, Human
cccaggucgcagcagc

SEQ ID NO: 103175 - RNA, 24 nt, Human
cccaggucgcugggacuacaggca

SEQ ID NO: 103176 - RNA, 32 nt, Human
cccaggucggcggguguucccaggaagaggaa

SEQ ID NO: 103177 - RNA, 32 nt, Human
cccaggucguuuucccuuucagcugcaaugcc

SEQ ID NO: 103178 - RNA, 32 nt, Human
cccaggucuaaaguagcuacagaaaggggaau

SEQ ID NO: 103179 - RNA, 20 nt, Human
cccaggucuaccuguugcag

SEQ ID NO: 103180 - RNA, 32 nt, Human
cccaggucuaggcugagaaguccuuuuucuuc

SEQ ID NO: 103181 - RNA, 32 nt, Human
cccaggucuccugauuucaaguacaguucuug

SEQ ID NO: 103182 - RNA, 21 nt, Human
cccaggucugcggaggcacag

SEQ ID NO: 103183 - RNA, 32 nt, Human
cccaggucuuccugcugcugccagggagagca

SEQ ID NO: 103184 - RNA, 32 nt, Human
cccaggucuugagcucuuuuggcuccagaguu

SEQ ID NO: 103185 - RNA, 21 nt, Human
cccaggugaaaccccaucucu

SEQ ID NO: 103186 - RNA, 32 nt, Human
cccaggugacauggaaucuuggagcagccuug

SEQ ID NO: 103187 - RNA, 32 nt, Human
cccaggugacuuacauaugcagccaagguuga

SEQ ID NO: 103188 - RNA, 17 nt, Human
cccaggugacuugugca

SEQ ID NO: 103189 - RNA, 32 nt, Human
cccaggugagagaaggaagugaggccauagau

SEQ ID NO: 103190 - RNA, 32 nt, Human
cccaggugagaugugcaagaggcgugggcuug

SEQ ID NO: 103191 - RNA, 32 nt, Human
cccaggugagcagaucaccugaggucaggagu

SEQ ID NO: 103192 - RNA, 32 nt, Human
cccaggugaucugguuacagugcagugcugac

SEQ ID NO: 103193 - RNA, 32 nt, Human
cccaggugauucuaaugugcagcagaguuugg

SEQ ID NO: 103194 - RNA, 32 nt, Human
cccaggugcaacccccagcccaggaggagacu

SEQ ID NO: 103195 - RNA, 32 nt, Human
cccaggugcaagagacaggggaagagggauag

SEQ ID NO: 103196 - RNA, 17 nt, Human
cccaggugcagagcgag

SEQ ID NO: 103197 - RNA, 32 nt, Human
cccaggugcaggccaccaccuccgggucggca

SEQ ID NO: 103198 - RNA, 25 nt, Human
cccaggugccccaggugugcccagc

SEQ ID NO: 103199 - RNA, 19 nt, Human
cccaggugccgcuaccagc

SEQ ID NO: 103200 - RNA, 22 nt, Human
cccaggugccuccuucccaacu

SEQ ID NO: 103201 - RNA, 21 nt, Human
cccaggugccuucccccugcu

SEQ ID NO: 103202 - RNA, 22 nt, Human
cccaggugcuccuccagcagcu

SEQ ID NO: 103203 - RNA, 32 nt, Human
cccaggugcugaaggaacagguugcagcuacc

SEQ ID NO: 103204 - RNA, 32 nt, Human
cccaggugcugccccuucucuccuguuccucg

SEQ ID NO: 103205 - RNA, 21 nt, Human
cccaggugcugggggcacagc

SEQ ID NO: 103206 - RNA, 32 nt, Human
cccagguggaacacuggcauuuuguugacugu

SEQ ID NO: 103207 - RNA, 32 nt, Human
cccagguggacucaggagggaaccuggcccca

SEQ ID NO: 103208 - RNA, 21 nt, Human
cccagguggcagagccagcuu

SEQ ID NO: 103209 - RNA, 24 nt, Human
cccagguggcggagguugcaguga

SEQ ID NO: 103210 - RNA, 32 nt, Human
cccagguggcggagguugcagugagccgacau

SEQ ID NO: 103211 - RNA, 21 nt, Human
cccagguggcucugcagcagc

SEQ ID NO: 103212 - RNA, 24 nt, Human
cccagguggcugaaacuacaggca

SEQ ID NO: 103213 - RNA, 32 nt, Human
cccaggugggcagaucaccugaagucaggagu

SEQ ID NO: 103214 - RNA, 32 nt, Human
cccagguggggcgaucaccugagguuagaagu

SEQ ID NO: 103215 - RNA, 32 nt, Human
cccaggugguggaggugggguuggagcaggaa

SEQ ID NO: 103216 - RNA, 24 nt, Human
cccaggugguggagguugcaguga

SEQ ID NO: 103217 - RNA, 32 nt, Human
cccaggugucacaacccauccucccaggcugg

SEQ ID NO: 103218 - RNA, 16 nt, Human
cccagguguccugucc

SEQ ID NO: 103219 - RNA, 24 nt, Human
cccaggugucggagccugaccuga

SEQ ID NO: 103220 - RNA, 32 nt, Human
cccaggugugcccagcccugagagucucugag

SEQ ID NO: 103221 - RNA, 32 nt, Human
cccagguguggccaccagcaccgguuucugcc

SEQ ID NO: 103222 - RNA, 18 nt, Human
cccaggugugggggcucc

SEQ ID NO: 103223 - RNA, 32 nt, Human
cccagguguugcccccuaucuccuggggaggg

SEQ ID NO: 103224 - RNA, 20 nt, Human
cccagguuagagugcagugg

SEQ ID NO: 103225 - RNA, 20 nt, Human
cccagguuagaguguagugg

SEQ ID NO: 103226 - RNA, 32 nt, Human
cccagguucaagcauucuucugccucagccuc

SEQ ID NO: 103227 - RNA, 32 nt, Human
cccagguucaagcgauccuccugucucagccu

SEQ ID NO: 103228 - RNA, 32 nt, Human
cccagguucaagcgauuucgugccucagccuc

SEQ ID NO: 103229 - RNA, 32 nt, Human
cccagguucaagugauucuucuugccucagcc

SEQ ID NO: 103230 - RNA, 32 nt, Human
cccagguucacugcaaccguucagaggucccc

SEQ ID NO: 103231 - RNA, 17 nt, Human
cccagguucccccacua

SEQ ID NO: 103232 - RNA, 32 nt, Human
cccagguucccccacuaccucucccucagauc

SEQ ID NO: 103233 - RNA, 32 nt, Human
cccagguuccucuggugccugccguggcucaa

SEQ ID NO: 103234 - RNA, 22 nt, Human
cccagguucgaguucaguggug

SEQ ID NO: 103235 - RNA, 22 nt, Human
cccagguucuagagugcagugg

SEQ ID NO: 103236 - RNA, 21 nt, Human
cccagguugaggcuauaguga

SEQ ID NO: 103237 - RNA, 32 nt, Human
cccagguugauguuuuugggggccaaguagcg

SEQ ID NO: 103238 - RNA, 18 nt, Human
cccagguugccugggcca

SEQ ID NO: 103239 - RNA, 18 nt, Human
cccagguuggagugcagu

SEQ ID NO: 103240 - RNA, 19 nt, Human
cccagguuggagugcagug

SEQ ID NO: 103241 - RNA, 20 nt, Human
cccagguuggagugcagugg

SEQ ID NO: 103242 - RNA, 21 nt, Human
cccagguuggagugcaguggc

SEQ ID NO: 103243 - RNA, 23 nt, Human
cccagguuggagugcaguggcgu

SEQ ID NO: 103244 - RNA, 23 nt, Human
cccagguuggagugcaguggugu

SEQ ID NO: 103245 - RNA, 32 nt, Human
cccagguuucaguugugucugacagagcauua

SEQ ID NO: 103246 - RNA, 32 nt, Human
cccagguuuccucagucucuaacccuuuguuc

SEQ ID NO: 103247 - RNA, 32 nt, Human
cccagguuugcucuccccaaguuuggggucag

SEQ ID NO: 103248 - RNA, 24 nt, Human
cccagguuugguuccucccggggc

SEQ ID NO: 103249 - RNA, 32 nt, Human
cccaguaaaguaguauuuccacagcagacagu

SEQ ID NO: 103250 - RNA, 32 nt, Human
cccaguaaauaauaaccaaccaaccaaccaac

SEQ ID NO: 103251 - RNA, 32 nt, Human
cccaguaagaagaggaggaggccaggcaggca

SEQ ID NO: 103252 - RNA, 32 nt, Human
cccaguaagaauaagaaggaaggguugguuuu

SEQ ID NO: 103253 - RNA, 32 nt, Human
cccaguaagcuuccaugacccuuucuuggagg

SEQ ID NO: 103254 - RNA, 32 nt, Human
cccaguaagggaaaggaggaugggagaccccu

SEQ ID NO: 103255 - RNA, 32 nt, Human
cccaguacagcuuccuccucugacccuuuggc

SEQ ID NO: 103256 - RNA, 32 nt, Human
cccaguaccccacagggaccacuggaaggacu

SEQ ID NO: 103257 - RNA, 22 nt, Human
cccaguacccucagugccugcu

SEQ ID NO: 103258 - RNA, 22 nt, Human
cccaguagaggaagguugcagu

SEQ ID NO: 103259 - RNA, 32 nt, Human
cccaguagccgcgccucacccuaggccaggaa

SEQ ID NO: 103260 - RNA, 23 nt, Human
cccaguagcuaggauuacaggua

SEQ ID NO: 103261 - RNA, 23 nt, Human
cccaguagcugggauuacaggca

SEQ ID NO: 103262 - RNA, 32 nt, Human
cccaguagcugggauuacaguguuauaguuuu

SEQ ID NO: 103263 - RNA, 21 nt, Human
cccaguaggccacuguucuga

SEQ ID NO: 103264 - RNA, 24 nt, Human
cccaguaggcggaaguugcaguga

SEQ ID NO: 103265 - RNA, 32 nt, Human
cccaguaggcggaaguugcagugagcugaaau

SEQ ID NO: 103266 - RNA, 32 nt, Human
cccaguaggggcggccgggcagaggagccccu

SEQ ID NO: 103267 - RNA, 32 nt, Human
cccaguaggggcggcugggcagaggggccccu

SEQ ID NO: 103268 - RNA, 32 nt, Human
cccaguagguaucaggucuuucuaugcagcuc

SEQ ID NO: 103269 - RNA, 24 nt, Human
cccaguaggucgaggcugcaguga

SEQ ID NO: 103270 - RNA, 32 nt, Human
cccaguaggucgaggcugcagugagcugugau

SEQ ID NO: 103271 - RNA, 32 nt, Human
cccaguaguacugcggccaaggggacaguuag

SEQ ID NO: 103272 - RNA, 32 nt, Human
cccaguagucccugcguucuucauucaacccc

SEQ ID NO: 103273 - RNA, 32 nt, Human
cccaguaguugcuauauucuucauacaagcau

SEQ ID NO: 103274 - RNA, 32 nt, Human
cccaguaucuguugcugaucgagcugucaguc

SEQ ID NO: 103275 - RNA, 32 nt, Human
cccaguaugcucugugcuuuuggaacaauaug

SEQ ID NO: 103276 - RNA, 32 nt, Human
cccaguaugguggcucaugccuguaaucucag

SEQ ID NO: 103277 - RNA, 22 nt, Human
cccaguauugggauuacaggca

SEQ ID NO: 103278 - RNA, 32 nt, Human
cccagucaacuugcagaaauucucuuacacua

SEQ ID NO: 103279 - RNA, 32 nt, Human
cccagucaagugcacacauaaccauaacaauu

SEQ ID NO: 103280 - RNA, 32 nt, Human
cccagucacaacugccauuuccagucucugcu

SEQ ID NO: 103281 - RNA, 32 nt, Human
cccagucacagcccuuggauacagagggaaac

SEQ ID NO: 103282 - RNA, 31 nt, Human
cccagucacagcugggcuuccacaggucaga

SEQ ID NO: 103283 - RNA, 32 nt, Human
cccagucacauccugagcugcuccuggcugau

SEQ ID NO: 103284 - RNA, 16 nt, Human
cccagucacccacuug

SEQ ID NO: 103285 - RNA, 32 nt, Human
cccagucacuauacccugucuaugcccugugg

SEQ ID NO: 103286 - RNA, 18 nt, Human
cccagucagaacugugaa

SEQ ID NO: 103287 - RNA, 23 nt, Human
cccagucagacccuccccagcuc

SEQ ID NO: 103288 - RNA, 32 nt, Human
cccagucagccgcgggaaacgggccgcgacag

SEQ ID NO: 103289 - RNA, 25 nt, Human
cccagucaguacagaacccagagaa

SEQ ID NO: 103290 - RNA, 32 nt, Human
cccagucaucagcugcuaucauuuuccuucuu

SEQ ID NO: 103291 - RNA, 18 nt, Human
cccagucaugauccaguc

SEQ ID NO: 103292 - RNA, 32 nt, Human
cccagucauggagcuaagaagugagucagaga

SEQ ID NO: 103293 - RNA, 27 nt, Human
cccagucauuuugcugggauucuuuaa

SEQ ID NO: 103294 - RNA, 32 nt, Human
cccaguccacaccagagccccacgcggcugcc

SEQ ID NO: 103295 - RNA, 32 nt, Human
cccaguccagaaggagcaauggcaccugggca

SEQ ID NO: 103296 - RNA, 32 nt, Human
cccaguccagcucuuauauguagcacagggaa

SEQ ID NO: 103297 - RNA, 23 nt, Human
cccaguccaucuccaggccagcu

SEQ ID NO: 103298 - RNA, 19 nt, Human
cccagucccacacuguggc

SEQ ID NO: 103299 - RNA, 19 nt, Human
cccagucccagcucugccc

SEQ ID NO: 103300 - RNA, 18 nt, Human
cccaguccccacuccacg

SEQ ID NO: 103301 - RNA, 32 nt, Human
cccaguccccacugcuggcaguaaguccccag

SEQ ID NO: 103302 - RNA, 32 nt, Human
cccaguccccuccaucuaacauaauacaguaa

SEQ ID NO: 103303 - RNA, 32 nt, Human
cccaguccccuccuccagggaacccugcaccc

SEQ ID NO: 103304 - RNA, 22 nt, Human
cccagucccucccucuggucca

SEQ ID NO: 103305 - RNA, 32 nt, Human
cccagucccugccucuccaccugcacccugcu

SEQ ID NO: 103306 - RNA, 32 nt, Human
cccaguccucacccuuaacuucugccauggga

SEQ ID NO: 103307 - RNA, 32 nt, Human
cccaguccucauuugccuucccuaccucuucc

SEQ ID NO: 103308 - RNA, 20 nt, Human
cccaguccucccagcugcca

SEQ ID NO: 103309 - RNA, 32 nt, Human
cccaguccucuccuggcaccagcaccuuagaa

SEQ ID NO: 103310 - RNA, 32 nt, Human
cccaguccugguugggaucacacccacgggug

SEQ ID NO: 103311 - RNA, 22 nt, Human
cccaguccuguacgccaaggaa

SEQ ID NO: 103312 - RNA, 32 nt, Human
cccaguccuuaccucauggcugugaagcuacg

SEQ ID NO: 103313 - RNA, 32 nt, Human
cccaguccuucaccugcccugugucagugucu

SEQ ID NO: 103314 - RNA, 32 nt, Human
cccagucuaagcucugcuuaugccuaucuuga

SEQ ID NO: 103315 - RNA, 32 nt, Human
cccagucuacuuccccgauccugggcucccuc

SEQ ID NO: 103316 - RNA, 32 nt, Human
cccagucuagucuugaacuccugggcuacagu

SEQ ID NO: 103317 - RNA, 32 nt, Human
cccagucuccaggaucaacacagucaguuugg

SEQ ID NO: 103318 - RNA, 32 nt, Human
cccagucucccagguuugguugagggcucccc

SEQ ID NO: 103319 - RNA, 32 nt, Human
cccagucuccucgauuccccucgcucugagcc

SEQ ID NO: 103320 - RNA, 19 nt, Human
cccagucuggagugcagug

SEQ ID NO: 103321 - RNA, 20 nt, Human
cccagucuggagugcagugg

SEQ ID NO: 103322 - RNA, 21 nt, Human
cccagucuggagugcaguggc

SEQ ID NO: 103323 - RNA, 22 nt, Human
cccagucuggagugcaguggug

SEQ ID NO: 103324 - RNA, 23 nt, Human
cccagucuggagugcaguggugu

SEQ ID NO: 103325 - RNA, 20 nt, Human
cccagucuggaguucagugg

SEQ ID NO: 103326 - RNA, 32 nt, Human
cccagucuggcucccgagcucagacacagccc

SEQ ID NO: 103327 - RNA, 32 nt, Human
cccagucugguaggagagagugcugcagagcc

SEQ ID NO: 103328 - RNA, 32 nt, Human
cccagucuuccaaggauggaaguggauccagg

SEQ ID NO: 103329 - RNA, 32 nt, Human
cccagucuucuccauggugcugaagaugccag

SEQ ID NO: 103330 - RNA, 32 nt, Human
cccagucuucuccccaaagucaagcaagagac

SEQ ID NO: 103331 - RNA, 32 nt, Human
cccagucuugucucaaacuccugggcucaagc

SEQ ID NO: 103332 - RNA, 32 nt, Human
cccagucuuucccaucuuggaaucuuuccaga

SEQ ID NO: 103333 - RNA, 21 nt, Human
cccagucuuucccggccccca

SEQ ID NO: 103334 - RNA, 18 nt, Human
cccagugaaaaggauaaa

SEQ ID NO: 103335 - RNA, 19 nt, Human
cccagugaaggagagccag

SEQ ID NO: 103336 - RNA, 32 nt, Human
cccagugacuccaggcuccagacugcucccag

SEQ ID NO: 103337 - RNA, 32 nt, Human
cccagugagacagcaggugacaugacagcaag

SEQ ID NO: 103338 - RNA, 32 nt, Human
cccagugagccgggucccuuaggggagggaga

SEQ ID NO: 103339 - RNA, 32 nt, Human
cccagugaggagaauucaggugaucucugugg

SEQ ID NO: 103340 - RNA, 22 nt, Human
cccagugaggaugcugcaguga

SEQ ID NO: 103341 - RNA, 18 nt, Human
cccagugcaaaaaguaaa

SEQ ID NO: 103342 - RNA, 32 nt, Human
cccagugcaauccagagguggaagagauccua

SEQ ID NO: 103343 - RNA, 32 nt, Human
cccagugcaaugauaaacgggcagauaguuuc

SEQ ID NO: 103344 - RNA, 32 nt, Human
cccagugcacacaaguguagguaucauuuucu

SEQ ID NO: 103345 - RNA, 32 nt, Human
cccagugcacacuggaucaaaaugcugcuuuc

SEQ ID NO: 103346 - RNA, 31 nt, Human
cccagugcagccuggcaccuacccacccacc

SEQ ID NO: 103347 - RNA, 32 nt, Human
cccagugcagcugaagcauguacagugguuug

SEQ ID NO: 103348 - RNA, 32 nt, Human
cccagugcagcuuuugcaaaaugcagggaagg

SEQ ID NO: 103349 - RNA, 32 nt, Human
cccagugccacagucugcacugagcuuggcuc

SEQ ID NO: 103350 - RNA, 32 nt, Human
cccagugccaugaccuucucggagauccugga

SEQ ID NO: 103351 - RNA, 32 nt, Human
cccagugccaugagcccacacugcccgcccuc

SEQ ID NO: 103352 - RNA, 32 nt, Human
cccagugcccaggaguuggggauguccuacaa

SEQ ID NO: 103353 - RNA, 32 nt, Human
cccagugccccacaucuuucucugggagacac

SEQ ID NO: 103354 - RNA, 32 nt, Human
cccagugccccuagcugcugcugguagacuug

SEQ ID NO: 103355 - RNA, 32 nt, Human
cccagugcccgcugggcccagccuggggacag

SEQ ID NO: 103356 - RNA, 32 nt, Human
cccagugcccucuccccucagccucuccccug

SEQ ID NO: 103357 - RNA, 32 nt, Human
cccagugcccugcauuuaaucagcaccugaug

SEQ ID NO: 103358 - RNA, 32 nt, Human
cccagugcccugccaccuucguccucacugac

SEQ ID NO: 103359 - RNA, 20 nt, Human
cccagugccucaccuccugg

SEQ ID NO: 103360 - RNA, 32 nt, Human
cccagugccucugcucgugggucccuggacac

SEQ ID NO: 103361 - RNA, 19 nt, Human
cccagugcggacccuuccc

SEQ ID NO: 103362 - RNA, 32 nt, Human
cccagugcugcacucccacccugggcuccacu

SEQ ID NO: 103363 - RNA, 32 nt, Human
cccagugcuggaaggaaggagggccuuucuuc

SEQ ID NO: 103364 - RNA, 32 nt, Human
cccagugcugggacagggaaggaugggaagac

SEQ ID NO: 103365 - RNA, 32 nt, Human
cccagugcuguugcccuuuugaguauuuuugu

SEQ ID NO: 103366 - RNA, 32 nt, Human
cccagugcuuccaucuuugaaaguuugcaggu

SEQ ID NO: 103367 - RNA, 32 nt, Human
cccagugcuugacuucucggcccggaagagaa

SEQ ID NO: 103368 - RNA, 18 nt, Human
cccaguggaacccuguga

SEQ ID NO: 103369 - RNA, 32 nt, Human
cccaguggaaugagaaacuaaugaggaccuaa

SEQ ID NO: 103370 - RNA, 32 nt, Human
cccaguggacagugucauugugcccagagugc

SEQ ID NO: 103371 - RNA, 32 nt, Human
cccaguggagugacugcagacagaguagaugc

SEQ ID NO: 103372 - RNA, 15 nt, Human
cccaguggcagagcc

SEQ ID NO: 103373 - RNA, 32 nt, Human
cccaguggcaggcacagagaggggcucugaaa

SEQ ID NO: 103374 - RNA, 32 nt, Human
cccaguggcauugaaugagaaaaguccaccuu

SEQ ID NO: 103375 - RNA, 32 nt, Human
cccaguggccacucuucuggaaggggcuugga

SEQ ID NO: 103376 - RNA, 24 nt, Human
cccaguggccucuuucagcccagc

SEQ ID NO: 103377 - RNA, 32 nt, Human
cccaguggcuacacugaccacacccacgcagg

SEQ ID NO: 103378 - RNA, 32 nt, Human
cccaguggcucacgccuauaaucccagcacuu

SEQ ID NO: 103379 - RNA, 32 nt, Human
cccaguggcucacgccuguaaucccagcacuu

SEQ ID NO: 103380 - RNA, 32 nt, Human
cccaguggcucaugccuguaaucccaacacuu

SEQ ID NO: 103381 - RNA, 32 nt, Human
cccaguggcuguacuucacuacccagcaaagc

SEQ ID NO: 103382 - RNA, 32 nt, Human
cccagugggacccacagucacacagagcgccu

SEQ ID NO: 103383 - RNA, 32 nt, Human
cccagugggaccccgcacaacaucccucacca

SEQ ID NO: 103384 - RNA, 32 nt, Human
cccagugggagaagaggaaggugaaaaauccu

SEQ ID NO: 103385 - RNA, 32 nt, Human
cccagugggaguuccuuccagccccaggaccg

SEQ ID NO: 103386 - RNA, 18 nt, Human
cccagugggcagaggcau

SEQ ID NO: 103387 - RNA, 32 nt, Human
cccagugggcagggcaggagguggcagcggca

SEQ ID NO: 103388 - RNA, 19 nt, Human
cccagugggcauggagcca

SEQ ID NO: 103389 - RNA, 30 nt, Human
cccagugggcucuccuugcuccuguugcug

SEQ ID NO: 103390 - RNA, 32 nt, Human
cccaguggggaccuacuagaaaaaggaacugg

SEQ ID NO: 103391 - RNA, 32 nt, Human
cccagugggugaggaugggagggcaggguggg

SEQ ID NO: 103392 - RNA, 32 nt, Human
cccaguggguucacuccuuuucacaccugcug

SEQ ID NO: 103393 - RNA, 32 nt, Human
cccagugguggagugaggacaggggagggccg

SEQ ID NO: 103394 - RNA, 32 nt, Human
cccaguguagaggcucacaccuguaaucccag

SEQ ID NO: 103395 - RNA, 32 nt, Human
cccaguguauuuuuauuaugauuaaaaccaca

SEQ ID NO: 103396 - RNA, 32 nt, Human
cccagugucacccagggugagugcaaaauaaa

SEQ ID NO: 103397 - RNA, 32 nt, Human
cccagugucccccaaccuuccaccucacaccc

SEQ ID NO: 103398 - RNA, 22 nt, Human
cccaguguccccccagccccca

SEQ ID NO: 103399 - RNA, 21 nt, Human
cccagugucccugagcagcuu

SEQ ID NO: 103400 - RNA, 32 nt, Human
cccaguguccuccuccuucuccggccagaccc

SEQ ID NO: 103401 - RNA, 32 nt, Human
cccagugucucuucuagccccuccaacaguuc

SEQ ID NO: 103402 - RNA, 22 nt, Human
cccagugucugcccggcuccca

SEQ ID NO: 103403 - RNA, 32 nt, Human
cccagugucugugguuuccuucuuuguguucc

SEQ ID NO: 103404 - RNA, 32 nt, Human
cccagugucuucaguggaaacagagcacaggc

SEQ ID NO: 103405 - RNA, 32 nt, Human
cccagugugagaccccaaagacucuggagguc

SEQ ID NO: 103406 - RNA, 32 nt, Human
cccagugugcagccccugccagaugugggagg

SEQ ID NO: 103407 - RNA, 24 nt, Human
cccagugugccccacagcccuguc

SEQ ID NO: 103408 - RNA, 24 nt, Human
cccagugugcugggauuacaggca

SEQ ID NO: 103409 - RNA, 32 nt, Human
cccagugugguuugcauugucuccuuccacaa

SEQ ID NO: 103410 - RNA, 32 nt, Human
cccaguguuugcacacacacaaaaucuugacc

SEQ ID NO: 103411 - RNA, 32 nt, Human
cccaguuaaauaccuccucuaccuuuaccuaa

SEQ ID NO: 103412 - RNA, 32 nt, Human
cccaguuaaucagcaaccugacucaggccagu

SEQ ID NO: 103413 - RNA, 32 nt, Human
cccaguuacaauuauacuuucagcuaacauau

SEQ ID NO: 103414 - RNA, 32 nt, Human
cccaguuacauuuuaugcaucuguaagcuuuc

SEQ ID NO: 103415 - RNA, 32 nt, Human
cccaguuauuuugccucauuagacaucaagaa

SEQ ID NO: 103416 - RNA, 32 nt, Human
cccaguucaagcaauucuccugccucagccuc

SEQ ID NO: 103417 - RNA, 32 nt, Human
cccaguucaagcaauucuucugccucagccuc

SEQ ID NO: 103418 - RNA, 21 nt, Human
cccaguucaaggcugcaguga

SEQ ID NO: 103419 - RNA, 32 nt, Human
cccaguucaaugcuaugccauuaccaacucca

SEQ ID NO: 103420 - RNA, 32 nt, Human
cccaguucauuuccuaauccuuaaacuccggu

SEQ ID NO: 103421 - RNA, 32 nt, Human
cccaguuccacccacaaccacauggucaaggc

SEQ ID NO: 103422 - RNA, 32 nt, Human
cccaguucccacguguugaguguguuuccagu

SEQ ID NO: 103423 - RNA, 22 nt, Human
cccaguucccuggacagagcua

SEQ ID NO: 103424 - RNA, 19 nt, Human
cccaguuccgccgcugccg

SEQ ID NO: 103425 - RNA, 22 nt, Human
cccaguuccuucccgggcccca

SEQ ID NO: 103426 - RNA, 32 nt, Human
cccaguucuacccccucaugugcuucuucuga

SEQ ID NO: 103427 - RNA, 32 nt, Human
cccaguucucccccaucucccccucuccaucu

SEQ ID NO: 103428 - RNA, 32 nt, Human
cccaguucuccuccucagccuuuuccuccuca

SEQ ID NO: 103429 - RNA, 32 nt, Human
cccaguucugaaagcuuuauacaguugaauuu

SEQ ID NO: 103430 - RNA, 32 nt, Human
cccaguucuuccugaguauaugaauuugauuu

SEQ ID NO: 103431 - RNA, 32 nt, Human
cccaguugaaugcuucuuuuuccuucaauguu

SEQ ID NO: 103432 - RNA, 32 nt, Human
cccaguugacaguuuaaaagcacuuucacacc

SEQ ID NO: 103433 - RNA, 32 nt, Human
cccaguugagcagcagccucuaugcuuccacg

SEQ ID NO: 103434 - RNA, 32 nt, Human
cccaguugcccuuuaaguucuucuauuucaaa

SEQ ID NO: 103435 - RNA, 32 nt, Human
cccaguuggaaaccccauuugccauucaauua

SEQ ID NO: 103436 - RNA, 32 nt, Human
cccaguugucucagugcugaggaaccucauca

SEQ ID NO: 103437 - RNA, 32 nt, Human
cccaguuuauaccugugucacucucaauuuuu

SEQ ID NO: 103438 - RNA, 32 nt, Human
cccaguuucccuuuccccuccuccaggcagag

SEQ ID NO: 103439 - RNA, 22 nt, Human
cccaguuuccgcuaagacacaa

SEQ ID NO: 103440 - RNA, 32 nt, Human
cccaguuucgcgaaggcugucggcgcgccgcg

SEQ ID NO: 103441 - RNA, 32 nt, Human
cccaguuugcauucugcagguuuuccauuuua

SEQ ID NO: 103442 - RNA, 19 nt, Human
cccaguuuggagugcagug

SEQ ID NO: 103443 - RNA, 20 nt, Human
cccaguuuggagugcagugg

SEQ ID NO: 103444 - RNA, 22 nt, Human
cccaguuuggagugcaguggug

SEQ ID NO: 103445 - RNA, 32 nt, Human
cccaguuuggggacccagugggaccaggugcg

SEQ ID NO: 103446 - RNA, 32 nt, Human
cccaguuugguuuccaugggaaccugaguggc

SEQ ID NO: 103447 - RNA, 32 nt, Human
cccaguuuucauguggauggauuguaguucau

SEQ ID NO: 103448 - RNA, 32 nt, Human
cccaguuuucuccuccucacuaggcuguguuu

SEQ ID NO: 103449 - RNA, 32 nt, Human
cccaguuuucuccuccucacuagucuguggcu

SEQ ID NO: 103450 - RNA, 32 nt, Human
cccauaaaauacucaaguacugggauaggcaa

SEQ ID NO: 103451 - RNA, 32 nt, Human
cccauaaaugcauacacauacaugcacacaca

SEQ ID NO: 103452 - RNA, 32 nt, Human
cccauaacaaaaccacuguccaacacugguau

SEQ ID NO: 103453 - RNA, 23 nt, Human
cccauaacagguggccucagcca

SEQ ID NO: 103454 - RNA, 32 nt, Human
cccauaagcagcugugguggcagugagggagg

SEQ ID NO: 103455 - RNA, 24 nt, Human
cccauaaggcagagguugcaguga

SEQ ID NO: 103456 - RNA, 32 nt, Human
cccauaaggcagagguugcagugagcugagau

SEQ ID NO: 103457 - RNA, 32 nt, Human
cccauaaucccagcuacugaggagacuugagg

SEQ ID NO: 103458 - RNA, 32 nt, Human
cccauaauuaaaacaugaucacuuuuacacag

SEQ ID NO: 103459 - RNA, 32 nt, Human
cccauacaaauguuguaacaucuccccaguuu

SEQ ID NO: 103460 - RNA, 32 nt, Human
cccauacacagaaguauacgaaagcacacaaa

SEQ ID NO: 103461 - RNA, 32 nt, Human
cccauacacaugcauaagcccauccgccugcg

SEQ ID NO: 103462 - RNA, 23 nt, Human
cccauacacauuugaccugguca

SEQ ID NO: 103463 - RNA, 21 nt, Human
cccauacaugaagucuggcca

SEQ ID NO: 103464 - RNA, 32 nt, Human
cccauacccaccuggccucugcaccugagggu

SEQ ID NO: 103465 - RNA, 32 nt, Human
cccauacccaggcuggcuccuggggcgacgcc

SEQ ID NO: 103466 - RNA, 32 nt, Human
cccauaccccauucucuuuuucaucucggccc

SEQ ID NO: 103467 - RNA, 32 nt, Human
cccauacccccaccuccagccuguugacagua

SEQ ID NO: 103468 - RNA, 32 nt, Human
cccauacccuaccucacggcagucuccgcaga

SEQ ID NO: 103469 - RNA, 32 nt, Human
cccauacccuuuguccucccagccuggcaucc

SEQ ID NO: 103470 - RNA, 32 nt, Human
cccauaccuagcugcccuggcagacucccagg

SEQ ID NO: 103471 - RNA, 32 nt, Human
cccauaccuccacccuagcaccaaggcccuga

SEQ ID NO: 103472 - RNA, 32 nt, Human
cccauaccuccuccucuucugggcuccccacu

SEQ ID NO: 103473 - RNA, 32 nt, Human
cccauaccuuuccugguugugguuuuucaugc

SEQ ID NO: 103474 - RNA, 32 nt, Human
cccauagaaagcccgacauggugcuaguuucc

SEQ ID NO: 103475 - RNA, 32 nt, Human
cccauagacacagcagguucacuccagggaca

SEQ ID NO: 103476 - RNA, 32 nt, Human
cccauagagacagggucucacuauguggccca

SEQ ID NO: 103477 - RNA, 32 nt, Human
cccauagcagaggcaugagcuggacuucaugu

SEQ ID NO: 103478 - RNA, 32 nt, Human
cccauagccaugaggagccucggggcccugcu

SEQ ID NO: 103479 - RNA, 32 nt, Human
cccauagcuccuccucuucuggcugcccccaa

SEQ ID NO: 103480 - RNA, 32 nt, Human
cccauaggcccugaggcacacagcccagcccc

SEQ ID NO: 103481 - RNA, 32 nt, Human
cccauagggaaacagauggcuuccucaaauua

SEQ ID NO: 103482 - RNA, 32 nt, Human
cccauagggcuggcucacauccagucacuccc

SEQ ID NO: 103483 - RNA, 32 nt, Human
cccauagguucuccaaguucucaccuugaaac

SEQ ID NO: 103484 - RNA, 32 nt, Human
cccauaguacacaugucacaaauguucgcugg

SEQ ID NO: 103485 - RNA, 19 nt, Human
cccauagucagcagcagcu

SEQ ID NO: 103486 - RNA, 32 nt, Human
cccauagucccagcuacucaggaggcugaggu

SEQ ID NO: 103487 - RNA, 32 nt, Human
cccauagucccagcuauucaggaggcuaaggu

SEQ ID NO: 103488 - RNA, 32 nt, Human
cccauaguccuucacauauugcuacaccaccu

SEQ ID NO: 103489 - RNA, 32 nt, Human
cccauagugaagccuucuggaggagaagguga

SEQ ID NO: 103490 - RNA, 32 nt, Human
cccauagugcauaggaacaguaaagccagggu

SEQ ID NO: 103491 - RNA, 23 nt, Human
cccauagugcuagaauuacaggc

SEQ ID NO: 103492 - RNA, 32 nt, Human
cccauagugugggggaccugcagagaaccaug

SEQ ID NO: 103493 - RNA, 20 nt, Human
cccauauacucuucgaugua

SEQ ID NO: 103494 - RNA, 32 nt, Human
cccauaucuggguggagaaugggugaaaagua

SEQ ID NO: 103495 - RNA, 17 nt, Human
cccauauggagagccag

SEQ ID NO: 103496 - RNA, 29 nt, Human
cccauaugucuguguuuguuugagauuuu

SEQ ID NO: 103497 - RNA, 22 nt, Human
cccauauuucugcuuccccuca

SEQ ID NO: 103498 - RNA, 32 nt, Human
cccauauuuguccccuccuauguccuguuucu

SEQ ID NO: 103499 - RNA, 32 nt, Human
cccaucaaaccagcccaagccguggaacaggc

SEQ ID NO: 103500 - RNA, 32 nt, Human
cccaucaacagcucuucauuucuugaacuacc

SEQ ID NO: 103501 - RNA, 32 nt, Human
cccaucaacccccauuucccuaggguccugga

SEQ ID NO: 103502 - RNA, 25 nt, Human
cccaucacaagcccggggagggauc

SEQ ID NO: 103503 - RNA, 22 nt, Human
cccaucacaccccauuuccucc

SEQ ID NO: 103504 - RNA, 16 nt, Human
cccaucacacugaacu

SEQ ID NO: 103505 - RNA, 21 nt, Human
cccaucacacuguaccccucc

SEQ ID NO: 103506 - RNA, 32 nt, Human
cccaucacagaauuuucauagagcuggacuau

SEQ ID NO: 103507 - RNA, 32 nt, Human
cccaucacaggguugggcccagaucugguccc

SEQ ID NO: 103508 - RNA, 32 nt, Human
cccaucacaguguugcugucaucaggcaaaag

SEQ ID NO: 103509 - RNA, 32 nt, Human
cccaucacauccacuuucggucacucguuguu

SEQ ID NO: 103510 - RNA, 32 nt, Human
cccaucaccaggaacugucacuggggacgagu

SEQ ID NO: 103511 - RNA, 32 nt, Human
cccaucacccagccaccggauucuccauucac

SEQ ID NO: 103512 - RNA, 21 nt, Human
cccaucaccccaugauccuuc

SEQ ID NO: 103513 - RNA, 22 nt, Human
cccaucaccccccaacacacac

SEQ ID NO: 103514 - RNA, 18 nt, Human
cccaucaccccuucccca

SEQ ID NO: 103515 - RNA, 26 nt, Human
cccaucaccccuuccccauuuccucu

SEQ ID NO: 103516 - RNA, 32 nt, Human
cccaucacccgcuaagagggagggagggcucc

SEQ ID NO: 103517 - RNA, 19 nt, Human
cccaucaccgaacuucccc

SEQ ID NO: 103518 - RNA, 32 nt, Human
cccaucaccgccucagcucugagucuccccug

SEQ ID NO: 103519 - RNA, 32 nt, Human
cccaucaccucaacuccagccagggaggaaua

SEQ ID NO: 103520 - RNA, 21 nt, Human
cccaucaccucuaacauccuu

SEQ ID NO: 103521 - RNA, 24 nt, Human
cccaucaccucuacugucuccucc

SEQ ID NO: 103522 - RNA, 32 nt, Human
cccaucaccucucacagccaccuggaacccaa

SEQ ID NO: 103523 - RNA, 32 nt, Human
cccaucaccucugucuaaaggcccaaguccua

SEQ ID NO: 103524 - RNA, 24 nt, Human
cccaucaccuucaagaaagcuucc

SEQ ID NO: 103525 - RNA, 32 nt, Human
cccaucacuagagugcucugacccugggcuuu

SEQ ID NO: 103526 - RNA, 32 nt, Human
cccaucacucacugcccugucugaaauguggc

SEQ ID NO: 103527 - RNA, 16 nt, Human
cccaucacugccccca

SEQ ID NO: 103528 - RNA, 32 nt, Human
cccaucacugccucccugcucggccggucccu

SEQ ID NO: 103529 - RNA, 32 nt, Human
cccaucagaauugcuucucagcacuuugggua

SEQ ID NO: 103530 - RNA, 32 nt, Human
cccaucagcacuagagaagaccacuggugaca

SEQ ID NO: 103531 - RNA, 32 nt, Human
cccaucagccaagugauuggggcugaccagac

SEQ ID NO: 103532 - RNA, 32 nt, Human
cccaucagcccaaacccagagccuuuaucaca

SEQ ID NO: 103533 - RNA, 32 nt, Human
cccaucagccccgugcucucugacugaugcac

SEQ ID NO: 103534 - RNA, 32 nt, Human
cccaucagccucccaaguaggugggacuauag

SEQ ID NO: 103535 - RNA, 32 nt, Human
cccaucaggggcccuguagacgucgcuauuuu

SEQ ID NO: 103536 - RNA, 32 nt, Human
cccaucagggggcucccaaccccacacaccua

SEQ ID NO: 103537 - RNA, 32 nt, Human
cccaucaguagggcagcaucacugccuucccg

SEQ ID NO: 103538 - RNA, 21 nt, Human
cccaucagugacugccugcca

SEQ ID NO: 103539 - RNA, 32 nt, Human
cccaucaguugguuggaggccaccuuccaggg

SEQ ID NO: 103540 - RNA, 32 nt, Human
cccaucaguuugcaggagcaggggugcaggau

SEQ ID NO: 103541 - RNA, 32 nt, Human
cccaucaucacuggcggcaaggcccuggaccu

SEQ ID NO: 103542 - RNA, 32 nt, Human
cccaucaucccagcuacuugggaggcugaggc

SEQ ID NO: 103543 - RNA, 32 nt, Human
cccaucaugacaugguccccaggcuggccuga

SEQ ID NO: 103544 - RNA, 18 nt, Human
cccaucaugcccucacca

SEQ ID NO: 103545 - RNA, 16 nt, Human
cccaucaugucugcca

SEQ ID NO: 103546 - RNA, 32 nt, Human
cccaucauguggcugcugucacccuugaccag

SEQ ID NO: 103547 - RNA, 32 nt, Human
cccaucauuuacccaugggagcaucuguagga

SEQ ID NO: 103548 - RNA, 32 nt, Human
cccauccacagcugacccagccucugucuagg

SEQ ID NO: 103549 - RNA, 32 nt, Human
cccauccacagcuggugcucagcugcuugaag

SEQ ID NO: 103550 - RNA, 32 nt, Human
cccauccacugccacaggcugccugaugacca

SEQ ID NO: 103551 - RNA, 32 nt, Human
cccauccacuggccacccucacucccaggucc

SEQ ID NO: 103552 - RNA, 19 nt, Human
cccauccaggcccuggcca

SEQ ID NO: 103553 - RNA, 23 nt, Human
cccauccaggucggcaucagaga

SEQ ID NO: 103554 - RNA, 32 nt, Human
cccaucccaacugcaccagcacugccuccccc

SEQ ID NO: 103555 - RNA, 17 nt, Human
cccaucccacagcgcuc

SEQ ID NO: 103556 - RNA, 18 nt, Human
cccaucccagaccaugga

SEQ ID NO: 103557 - RNA, 32 nt, Human
cccaucccagcccucagcauugugccagagug

SEQ ID NO: 103558 - RNA, 32 nt, Human
cccaucccaggccgagcuggaaccaagggaag

SEQ ID NO: 103559 - RNA, 32 nt, Human
cccaucccagugccaggcugguuuccauggag

SEQ ID NO: 103560 - RNA, 32 nt, Human
cccaucccaucuccugcccucuccugaucuaa

SEQ ID NO: 103561 - RNA, 32 nt, Human
cccauccccaagauaucuuauuauguauaugc

SEQ ID NO: 103562 - RNA, 32 nt, Human
cccauccccacccagucucauguuggggaggg

SEQ ID NO: 103563 - RNA, 22 nt, Human
cccauccccacccccagcccca

SEQ ID NO: 103564 - RNA, 32 nt, Human
cccauccccacccgcucacaggcacacacugg

SEQ ID NO: 103565 - RNA, 23 nt, Human
cccaucccccagcccuggcuccu

SEQ ID NO: 103566 - RNA, 21 nt, Human
cccaucccccaggaggacugg

SEQ ID NO: 103567 - RNA, 32 nt, Human
cccaucccccgcgcgucuccccggcugcgggg

SEQ ID NO: 103568 - RNA, 23 nt, Human
cccaucccccuuccaugagccca

SEQ ID NO: 103569 - RNA, 32 nt, Human
cccauccccgggagaacucuaagaaggagcug

SEQ ID NO: 103570 - RNA, 21 nt, Human
cccauccccucuugucucuga

SEQ ID NO: 103571 - RNA, 32 nt, Human
cccauccccugcccucagcacacacaucugca

SEQ ID NO: 103572 - RNA, 32 nt, Human
cccauccccugcccuggcugcaaccaugaggg

SEQ ID NO: 103573 - RNA, 32 nt, Human
cccauccccugccucuaucccuggccaccugc

SEQ ID NO: 103574 - RNA, 22 nt, Human
cccauccccuggugggcuccug

SEQ ID NO: 103575 - RNA, 32 nt, Human
cccauccccuuuccaguacacacaccugaugc

SEQ ID NO: 103576 - RNA, 32 nt, Human
cccauccccuuuccuccccaccuuccccagac

SEQ ID NO: 103577 - RNA, 23 nt, Human
cccaucccuaaaaccugccuucu

SEQ ID NO: 103578 - RNA, 26 nt, Human
cccaucccuauccugccugaucccug

SEQ ID NO: 103579 - RNA, 32 nt, Human
cccaucccucagcaaacgcagcucuucccaag

SEQ ID NO: 103580 - RNA, 32 nt, Human
cccaucccugaacaaccagaccucuucauucc

SEQ ID NO: 103581 - RNA, 21 nt, Human
cccaucccugcacugcuccug

SEQ ID NO: 103582 - RNA, 17 nt, Human
cccaucccuggcgccag

SEQ ID NO: 103583 - RNA, 32 nt, Human
cccaucccugguggggcucccaccccacuucu

SEQ ID NO: 103584 - RNA, 21 nt, Human
cccaucccuuccucccuuacc

SEQ ID NO: 103585 - RNA, 32 nt, Human
cccauccgcaagccaggcugggccugggcaua

SEQ ID NO: 103586 - RNA, 32 nt, Human
cccauccgccugcgcccugccagucugaccag

SEQ ID NO: 103587 - RNA, 32 nt, Human
cccauccgucugucugucgcccuucucccggc

SEQ ID NO: 103588 - RNA, 23 nt, Human
cccauccuagagugcaguagugu

SEQ ID NO: 103589 - RNA, 32 nt, Human
cccauccuagccccagaagcuccaagcuucac

SEQ ID NO: 103590 - RNA, 20 nt, Human
cccauccuccagcccugccc

SEQ ID NO: 103591 - RNA, 32 nt, Human
cccauccuccagggcucaacacugugacaucu

SEQ ID NO: 103592 - RNA, 32 nt, Human
cccauccuccauccuauuuauaguggaagggc

SEQ ID NO: 103593 - RNA, 23 nt, Human
cccauccucucacacucaggcca

SEQ ID NO: 103594 - RNA, 20 nt, Human
cccauccucucgccaagcca

SEQ ID NO: 103595 - RNA, 32 nt, Human
cccauccucucucuccccuuggagcucuugcc

SEQ ID NO: 103596 - RNA, 21 nt, Human
cccauccucucucugaagcca

SEQ ID NO: 103597 - RNA, 32 nt, Human
cccauccucugacucugcagugccagcuugga

SEQ ID NO: 103598 - RNA, 32 nt, Human
cccauccucugccucccucccugcagucagag

SEQ ID NO: 103599 - RNA, 20 nt, Human
cccauccucugcguuucauu

SEQ ID NO: 103600 - RNA, 32 nt, Human
cccauccucuucuccccguacugccucaaccc

SEQ ID NO: 103601 - RNA, 21 nt, Human
cccauccugagacuggcuggg

SEQ ID NO: 103602 - RNA, 32 nt, Human
cccauccugagcucugucuccugccccuccug

SEQ ID NO: 103603 - RNA, 32 nt, Human
cccauccugauucucuucuucuaccucuaccc

SEQ ID NO: 103604 - RNA, 32 nt, Human
cccauccugccucacccaugggugcugcaccc

SEQ ID NO: 103605 - RNA, 32 nt, Human
cccauccugccugggcaucccuggugcugggg

SEQ ID NO: 103606 - RNA, 32 nt, Human
cccauccugcuguccgucugcucugugaguca

SEQ ID NO: 103607 - RNA, 32 nt, Human
cccauccugcuguccuucuguccuggauguuu

SEQ ID NO: 103608 - RNA, 32 nt, Human
cccauccuggaaaaucuuuguacagugggaag

SEQ ID NO: 103609 - RNA, 32 nt, Human
cccauccuggccccaaagaccccugagaggcc

SEQ ID NO: 103610 - RNA, 32 nt, Human
cccauccuggcucugucauuuacuuacagaaa

SEQ ID NO: 103611 - RNA, 24 nt, Human
cccauccugggugacagagugaga

SEQ ID NO: 103612 - RNA, 32 nt, Human
cccauccuucugcacggccccucggcacccag

SEQ ID NO: 103613 - RNA, 32 nt, Human
cccauccuucuuccucuccagagaugccaggg

SEQ ID NO: 103614 - RNA, 32 nt, Human
cccaucgccaaauucccugccugugccugcug

SEQ ID NO: 103615 - RNA, 32 nt, Human
cccaucgcuuaucucugccuccuuccuccucc

SEQ ID NO: 103616 - RNA, 32 nt, Human
cccaucggccacucugagcucgaggccuaaag

SEQ ID NO: 103617 - RNA, 32 nt, Human
cccaucguccuucugucccaggccuugccccc

SEQ ID NO: 103618 - RNA, 23 nt, Human
cccaucgucuccagagcuggaug

SEQ ID NO: 103619 - RNA, 32 nt, Human
cccaucgugggaggaggacaagaagggaagca

SEQ ID NO: 103620 - RNA, 32 nt, Human
cccaucguucccuacuccuccccaccacuuac

SEQ ID NO: 103621 - RNA, 32 nt, Human
cccaucuacaaauucagacucuugaggugaaa

SEQ ID NO: 103622 - RNA, 22 nt, Human
cccaucuacacgucccucccca

SEQ ID NO: 103623 - RNA, 32 nt, Human
cccaucuacaugcucaaccgaaucauacaguu

SEQ ID NO: 103624 - RNA, 32 nt, Human
cccaucuacuccugggacauuucaauaaaauu

SEQ ID NO: 103625 - RNA, 32 nt, Human
cccaucuacugaggcaggagaauugcuugacc

SEQ ID NO: 103626 - RNA, 32 nt, Human
cccaucuagcauccgucuucugggccugaagc

SEQ ID NO: 103627 - RNA, 32 nt, Human
cccaucuaggcugacagagcagggcuguuucu

SEQ ID NO: 103628 - RNA, 32 nt, Human
cccaucuaguaacaucucagaaauuucaucca

SEQ ID NO: 103629 - RNA, 31 nt, Human
cccaucucacucaagguucucugaggacauu

SEQ ID NO: 103630 - RNA, 32 nt, Human
cccaucucagcagcaccaggacugccugggac

SEQ ID NO: 103631 - RNA, 32 nt, Human
cccaucucaggaaaaaggagguuggcaacuaa

SEQ ID NO: 103632 - RNA, 32 nt, Human
cccaucucaguguggcuuuguuuuugcaauuu

SEQ ID NO: 103633 - RNA, 32 nt, Human
cccaucucauuguuugauccugggcgagucac

SEQ ID NO: 103634 - RNA, 32 nt, Human
cccaucuccaccccuccccugaaccccacucc

SEQ ID NO: 103635 - RNA, 32 nt, Human
cccaucuccagccccucccucuggguucccaa

SEQ ID NO: 103636 - RNA, 32 nt, Human
cccaucuccauuugggaugguggugguggaaa

SEQ ID NO: 103637 - RNA, 21 nt, Human
cccaucuccccagcgggcagg

SEQ ID NO: 103638 - RNA, 32 nt, Human
cccaucucccuucacaggaugacacccuccca

SEQ ID NO: 103639 - RNA, 18 nt, Human
cccaucuccuacaggacc

SEQ ID NO: 103640 - RNA, 25 nt, Human
cccaucuccucagcaccccaggacc

SEQ ID NO: 103641 - RNA, 32 nt, Human
cccaucuccucccauggccuucccuccccaca

SEQ ID NO: 103642 - RNA, 22 nt, Human
cccaucuccuccccaccccagg

SEQ ID NO: 103643 - RNA, 32 nt, Human
cccaucuccuccucuucccucuccuccucccc

SEQ ID NO: 103644 - RNA, 32 nt, Human
cccaucuccugcccucuccugaucuaacuccc

SEQ ID NO: 103645 - RNA, 20 nt, Human
cccaucuccuucccuccuca

SEQ ID NO: 103646 - RNA, 32 nt, Human
cccaucuccuucuggcccaucugccugcugcc

SEQ ID NO: 103647 - RNA, 32 nt, Human
cccaucucgaggggcggaggagagggagcgcc

SEQ ID NO: 103648 - RNA, 32 nt, Human
cccaucucuaagccccuuaaccugcagcuucg

SEQ ID NO: 103649 - RNA, 32 nt, Human
cccaucucuacaaaaauacaaaauuagccagg

SEQ ID NO: 103650 - RNA, 32 nt, Human
cccaucucuacuaaaaauaccaaaaauuagcc

SEQ ID NO: 103651 - RNA, 32 nt, Human
cccaucucuacuaaaauacaaaauuagccagg

SEQ ID NO: 103652 - RNA, 32 nt, Human
cccaucucuacuaaauacaaaaauuagcuggg

SEQ ID NO: 103653 - RNA, 23 nt, Human
cccaucucucacucuggcuccca

SEQ ID NO: 103654 - RNA, 32 nt, Human
cccaucucucagaguguugggauuacagccau

SEQ ID NO: 103655 - RNA, 21 nt, Human
cccaucucuccacgcaaucgg

SEQ ID NO: 103656 - RNA, 23 nt, Human
cccaucucuccagccagccacug

SEQ ID NO: 103657 - RNA, 32 nt, Human
cccaucucuguggccuugggccagccaccaaa

SEQ ID NO: 103658 - RNA, 32 nt, Human
cccaucugagccucccgaguagcuggggcuac

SEQ ID NO: 103659 - RNA, 32 nt, Human
cccaucugaggcaaucuugccucccaggggaa

SEQ ID NO: 103660 - RNA, 20 nt, Human
cccaucugcccacccacuaa

SEQ ID NO: 103661 - RNA, 32 nt, Human
cccaucugcccucugcagcccagggccgccgu

SEQ ID NO: 103662 - RNA, 32 nt, Human
cccaucugccucugcugcacacacaggcacca

SEQ ID NO: 103663 - RNA, 32 nt, Human
cccaucugccuuucuuucccccagcccccacc

SEQ ID NO: 103664 - RNA, 32 nt, Human
cccaucugcgcagugaacccugugcugagcac

SEQ ID NO: 103665 - RNA, 21 nt, Human
cccaucugcucacccaugccc

SEQ ID NO: 103666 - RNA, 19 nt, Human
cccaucugcugcccaggga

SEQ ID NO: 103667 - RNA, 32 nt, Human
cccaucugcuuggucucccagcauuuuucuuu

SEQ ID NO: 103668 - RNA, 32 nt, Human
cccaucuggaauggaguacagccuucuauuuu

SEQ ID NO: 103669 - RNA, 32 nt, Human
cccaucuggggccugagucccaacccuuuauu

SEQ ID NO: 103670 - RNA, 32 nt, Human
cccaucuggggucucuggaagucggugcccag

SEQ ID NO: 103671 - RNA, 32 nt, Human
cccaucuguaggagauuagugaggcaaggugc

SEQ ID NO: 103672 - RNA, 32 nt, Human
cccaucuguagucccagcuacuugggaggcug

SEQ ID NO: 103673 - RNA, 32 nt, Human
cccaucuguccuuccucacagcacccucagca

SEQ ID NO: 103674 - RNA, 32 nt, Human
cccaucugugaauuugggggagcuggagugau

SEQ ID NO: 103675 - RNA, 32 nt, Human
cccaucuguuucacugucuccauuccauaaau

SEQ ID NO: 103676 - RNA, 32 nt, Human
cccaucuguuucuccucgggugccagccagcu

SEQ ID NO: 103677 - RNA, 32 nt, Human
cccaucuucaaaugcuaauugccaguuccagu

SEQ ID NO: 103678 - RNA, 21 nt, Human
cccaucuucaaggcucagcga

SEQ ID NO: 103679 - RNA, 32 nt, Human
cccaucuucuagcagcuggcugugccucuggg

SEQ ID NO: 103680 - RNA, 19 nt, Human
cccaucuucucgggcuuca

SEQ ID NO: 103681 - RNA, 20 nt, Human
cccaucuucugacuuuuccu

SEQ ID NO: 103682 - RNA, 20 nt, Human
cccaucuucugcccgcuccu

SEQ ID NO: 103683 - RNA, 32 nt, Human
cccaucuucuucuuccuccuccgucuccuuuc

SEQ ID NO: 103684 - RNA, 24 nt, Human
cccaucuucuugaugagcuucacu

SEQ ID NO: 103685 - RNA, 18 nt, Human
cccaucuugccccuccuc

SEQ ID NO: 103686 - RNA, 32 nt, Human
cccaucuugcucccucucccaggccuuuaccc

SEQ ID NO: 103687 - RNA, 32 nt, Human
cccaucuugguaucuguuguauccuuuaucug

SEQ ID NO: 103688 - RNA, 32 nt, Human
cccaucuuuaggcugcaacagcauggcaaugc

SEQ ID NO: 103689 - RNA, 32 nt, Human
cccaucuuucaauucaauuaaauuuaaauagc

SEQ ID NO: 103690 - RNA, 32 nt, Human
cccaucuuuccaggaagucaggauggagucag

SEQ ID NO: 103691 - RNA, 32 nt, Human
cccaucuuugaguuaagaacauagguccuugc

SEQ ID NO: 103692 - RNA, 24 nt, Human
cccaucuuugggccgcagcccuga

SEQ ID NO: 103693 - RNA, 32 nt, Human
cccaugaaagagacccagugguuacugugcac

SEQ ID NO: 103694 - RNA, 32 nt, Human
cccaugaagaauugccuggaaagauguuuuca

SEQ ID NO: 103695 - RNA, 28 nt, Human
cccaugaagcacacacuggcucugcugg

SEQ ID NO: 103696 - RNA, 32 nt, Human
cccaugaaguaguguguucagacugugcacac

SEQ ID NO: 103697 - RNA, 23 nt, Human
cccaugaagucaggcugcaguga

SEQ ID NO: 103698 - RNA, 32 nt, Human
cccaugaauagcccacacagguaccggcucuc

SEQ ID NO: 103699 - RNA, 20 nt, Human
cccaugaauauccucucaca

SEQ ID NO: 103700 - RNA, 22 nt, Human
cccaugaauggaggcugcagga

SEQ ID NO: 103701 - RNA, 32 nt, Human
cccaugacaauguuguagugucccccaccccc

SEQ ID NO: 103702 - RNA, 32 nt, Human
cccaugacaccuaggcugucagucucucucau

SEQ ID NO: 103703 - RNA, 32 nt, Human
cccaugacccagucaaauuugauguccccucg

SEQ ID NO: 103704 - RNA, 32 nt, Human
cccaugacccagucaaauuugauguccccuug

SEQ ID NO: 103705 - RNA, 32 nt, Human
cccaugacccucugcugucucucccuguucag

SEQ ID NO: 103706 - RNA, 32 nt, Human
cccaugacccuucccaaaucugcuccagcagg

SEQ ID NO: 103707 - RNA, 32 nt, Human
cccaugacucacuucucuuguaaagaaagagu

SEQ ID NO: 103708 - RNA, 32 nt, Human
cccaugacugcccauguuucugaggcuucaga

SEQ ID NO: 103709 - RNA, 22 nt, Human
cccaugacuggugucugugagg

SEQ ID NO: 103710 - RNA, 32 nt, Human
cccaugagaacacacaugugcacagaaagucg

SEQ ID NO: 103711 - RNA, 32 nt, Human
cccaugagagaagggccucuguccuuagguag

SEQ ID NO: 103712 - RNA, 32 nt, Human
cccaugagaucaggcgccaucuguaaagucuc

SEQ ID NO: 103713 - RNA, 24 nt, Human
cccaugagauugaggcugcaguga

SEQ ID NO: 103714 - RNA, 32 nt, Human
cccaugagcaugagagaagaagcaaugcacgc

SEQ ID NO: 103715 - RNA, 32 nt, Human
cccaugagcccacagacagagcuguauuaagu

SEQ ID NO: 103716 - RNA, 32 nt, Human
cccaugagcugagggagagggagaggggaccc

SEQ ID NO: 103717 - RNA, 32 nt, Human
cccaugaggaagaagaggcuuugcacugcucu

SEQ ID NO: 103718 - RNA, 32 nt, Human
cccaugaggagaaaaaggaagacuggaauaau

SEQ ID NO: 103719 - RNA, 20 nt, Human
cccaugaggcaaugucagga

SEQ ID NO: 103720 - RNA, 24 nt, Human
cccaugaggcccagguuacaguga

SEQ ID NO: 103721 - RNA, 24 nt, Human
cccaugaggcggagguugcaguga

SEQ ID NO: 103722 - RNA, 32 nt, Human
cccaugaggcggagguugcagugagccgagau

SEQ ID NO: 103723 - RNA, 32 nt, Human
cccaugaggcucaugaagcagaggguauccca

SEQ ID NO: 103724 - RNA, 24 nt, Human
cccaugaggcuuguggccacagug

SEQ ID NO: 103725 - RNA, 22 nt, Human
cccaugagggcaaugguccuca

SEQ ID NO: 103726 - RNA, 24 nt, Human
cccaugagguggaaguugcaguga

SEQ ID NO: 103727 - RNA, 24 nt, Human
cccaugagguggagguugcgguga

SEQ ID NO: 103728 - RNA, 32 nt, Human
cccaugagucccugugcagaccagugggcaag

SEQ ID NO: 103729 - RNA, 32 nt, Human
cccaugaguucaaggcugcagugagucgugau

SEQ ID NO: 103730 - RNA, 32 nt, Human
cccaugauauggggugcaggaacucugggggc

SEQ ID NO: 103731 - RNA, 17 nt, Human
cccaugaugcagcagcu

SEQ ID NO: 103732 - RNA, 32 nt, Human
cccaugauuuaucagcugauuuuccaacuugg

SEQ ID NO: 103733 - RNA, 32 nt, Human
cccaugcaaaccugagugagcacaggauuugc

SEQ ID NO: 103734 - RNA, 32 nt, Human
cccaugcaaaguguccuguacggugagaagug

SEQ ID NO: 103735 - RNA, 32 nt, Human
cccaugcaagcagaggaccagggcuuuuucug

SEQ ID NO: 103736 - RNA, 32 nt, Human
cccaugcacgccugugcuuacacacaugcaca

SEQ ID NO: 103737 - RNA, 20 nt, Human
cccaugcacucgccgcgccg

SEQ ID NO: 103738 - RNA, 32 nt, Human
cccaugcagagcuggagguuggggugaugucu

SEQ ID NO: 103739 - RNA, 32 nt, Human
cccaugcagcuccagcccagccuucuacuuug

SEQ ID NO: 103740 - RNA, 31 nt, Human
cccaugcaguuuccccaggcaccuuugcuca

SEQ ID NO: 103741 - RNA, 32 nt, Human
cccaugcaucagcugcucccaccccucauccu

SEQ ID NO: 103742 - RNA, 32 nt, Human
cccaugcaugcugcugccucugggcagucgua

SEQ ID NO: 103743 - RNA, 32 nt, Human
cccaugccacccguccccuugugaccuccccc

SEQ ID NO: 103744 - RNA, 21 nt, Human
cccaugccacuccacacugcu

SEQ ID NO: 103745 - RNA, 32 nt, Human
cccaugccagcucuccccaagugcuccacuga

SEQ ID NO: 103746 - RNA, 19 nt, Human
cccaugccauccccgcaca

SEQ ID NO: 103747 - RNA, 20 nt, Human
cccaugcccaaccccugugg

SEQ ID NO: 103748 - RNA, 32 nt, Human
cccaugccccaaggagcccuucagagcccaca

SEQ ID NO: 103749 - RNA, 32 nt, Human
cccaugccccacugcaggccugggcccccuca

SEQ ID NO: 103750 - RNA, 17 nt, Human
cccaugccccuccucac

SEQ ID NO: 103751 - RNA, 19 nt, Human
cccaugccccuggccccca

SEQ ID NO: 103752 - RNA, 22 nt, Human
cccaugccccuggcccccaggg

SEQ ID NO: 103753 - RNA, 18 nt, Human
cccaugcccggcggcugg

SEQ ID NO: 103754 - RNA, 32 nt, Human
cccaugcccuucgccugcauugcccacugagu

SEQ ID NO: 103755 - RNA, 20 nt, Human
cccaugccgcucccuccuca

SEQ ID NO: 103756 - RNA, 32 nt, Human
cccaugccuauaaucccagcacuuugggaggc

SEQ ID NO: 103757 - RNA, 32 nt, Human
cccaugccucuaauccuagcauuuugggaggc

SEQ ID NO: 103758 - RNA, 32 nt, Human
cccaugccucuccagcccuccugcugcccacg

SEQ ID NO: 103759 - RNA, 32 nt, Human
cccaugccugccuggccugguagagaagaugg

SEQ ID NO: 103760 - RNA, 32 nt, Human
cccaugccugcuuuggaaaacauauuuucucu

SEQ ID NO: 103761 - RNA, 19 nt, Human
cccaugccugggggagaga

SEQ ID NO: 103762 - RNA, 32 nt, Human
cccaugccuguaaucccagcacuuugggaggc

SEQ ID NO: 103763 - RNA, 32 nt, Human
cccaugccuguaaucccagcacuuugggaggu

SEQ ID NO: 103764 - RNA, 32 nt, Human
cccaugccuguaaucucagcacucugggagac

SEQ ID NO: 103765 - RNA, 28 nt, Human
cccaugccugugcgucgcuccuggcuca

SEQ ID NO: 103766 - RNA, 32 nt, Human
cccaugccuuggugcggguccuggaggccucu

SEQ ID NO: 103767 - RNA, 32 nt, Human
cccaugcggccaagacuuaagauagcagacac

SEQ ID NO: 103768 - RNA, 32 nt, Human
cccaugcgugccgccugcuccucacuggagga

SEQ ID NO: 103769 - RNA, 22 nt, Human
cccaugcuagaugccccccaca

SEQ ID NO: 103770 - RNA, 32 nt, Human
cccaugcucucauucucagucauaugcccauu

SEQ ID NO: 103771 - RNA, 32 nt, Human
cccaugcucuggcugcuguccccagcuccccg

SEQ ID NO: 103772 - RNA, 24 nt, Human
cccaugcucuguguaccugcagca

SEQ ID NO: 103773 - RNA, 21 nt, Human
cccaugcugaggcugcagugg

SEQ ID NO: 103774 - RNA, 15 nt, Human
cccaugcugccucca

SEQ ID NO: 103775 - RNA, 32 nt, Human
cccaugcugccuucagggagacaggcagggag

SEQ ID NO: 103776 - RNA, 32 nt, Human
cccaugcugcuugucacauaucuggaguuuca

SEQ ID NO: 103777 - RNA, 31 nt, Human
cccaugcugcuuuucugaguguugauggggg

SEQ ID NO: 103778 - RNA, 21 nt, Human
cccaugcuggaguacgguggc

SEQ ID NO: 103779 - RNA, 19 nt, Human
cccaugcuggagugcaaug

SEQ ID NO: 103780 - RNA, 20 nt, Human
cccaugcuggagugcaaugg

SEQ ID NO: 103781 - RNA, 20 nt, Human
cccaugcuggagugcagugg

SEQ ID NO: 103782 - RNA, 20 nt, Human
cccaugcuggagugcauugg

SEQ ID NO: 103783 - RNA, 32 nt, Human
cccaugcugggcucugugcccucugugucugu

SEQ ID NO: 103784 - RNA, 32 nt, Human
cccaugcuggucucgaacuccugggcucaagc

SEQ ID NO: 103785 - RNA, 21 nt, Human
cccaugcuguccccaacagcu

SEQ ID NO: 103786 - RNA, 32 nt, Human
cccaugcuguguggucucugcaugucuccauu

SEQ ID NO: 103787 - RNA, 32 nt, Human
cccaugcuugagugcaaccucugcccacugug

SEQ ID NO: 103788 - RNA, 32 nt, Human
cccaugcuuuauauggugagguugggaaaaug

SEQ ID NO: 103789 - RNA, 32 nt, Human
cccauggaagaggaggaggaggagccgugaug

SEQ ID NO: 103790 - RNA, 32 nt, Human
cccauggaagggugggcugagaucgggaugac

SEQ ID NO: 103791 - RNA, 32 nt, Human
cccauggaagguugugcucagcugucgggucu

SEQ ID NO: 103792 - RNA, 32 nt, Human
cccauggacagaagauggaaggucagucgugg

SEQ ID NO: 103793 - RNA, 32 nt, Human
cccauggacuccuuucccuuucuucucugaaa

SEQ ID NO: 103794 - RNA, 32 nt, Human
cccauggagaaacacuggcauggauuugcacu

SEQ ID NO: 103795 - RNA, 32 nt, Human
cccauggagcacuguccucagagaugcgcagg

SEQ ID NO: 103796 - RNA, 32 nt, Human
cccauggagccccagcccccuuugggcccagg

SEQ ID NO: 103797 - RNA, 28 nt, Human
cccauggaggaggaggagggggcggugg

SEQ ID NO: 103798 - RNA, 24 nt, Human
cccauggauuggggccucccaggc

SEQ ID NO: 103799 - RNA, 32 nt, Human
cccauggcacugugagccugcaagggagcccc

SEQ ID NO: 103800 - RNA, 18 nt, Human
cccauggcccagcagcuu

SEQ ID NO: 103801 - RNA, 32 nt, Human
cccauggcccaggcuccaggaagugccuuggg

SEQ ID NO: 103802 - RNA, 32 nt, Human
cccauggccucaauaaacucucugcuuggugu

SEQ ID NO: 103803 - RNA, 32 nt, Human
cccauggccugcucugagcucccuucaauuuc

SEQ ID NO: 103804 - RNA, 22 nt, Human
cccauggcgaggagcauggaga

SEQ ID NO: 103805 - RNA, 32 nt, Human
cccauggcgaggaggaauggccagcaccccag

SEQ ID NO: 103806 - RNA, 21 nt, Human
cccauggcgccccucacucag

SEQ ID NO: 103807 - RNA, 32 nt, Human
cccauggcgggguggagacccggaaccagcag

SEQ ID NO: 103808 - RNA, 32 nt, Human
cccauggcugccucugaaggcagugucuauuu

SEQ ID NO: 103809 - RNA, 32 nt, Human
cccauggcuggcucccuugacauuuugggguu

SEQ ID NO: 103810 - RNA, 32 nt, Human
cccauggcuuacagcuucuacccggccccaag

SEQ ID NO: 103811 - RNA, 25 nt, Human
cccaugggaaccuccaccuccuacu

SEQ ID NO: 103812 - RNA, 18 nt, Human
cccaugggaaucccagca

SEQ ID NO: 103813 - RNA, 32 nt, Human
cccaugggacucagggucagcgugggaaggca

SEQ ID NO: 103814 - RNA, 32 nt, Human
cccaugggagcugguuagaaaugcagaauccu

SEQ ID NO: 103815 - RNA, 32 nt, Human
cccaugggaggaggaggaagaagaggaggagg

SEQ ID NO: 103816 - RNA, 32 nt, Human
cccaugggagggggcugcugcccaccagccau

SEQ ID NO: 103817 - RNA, 23 nt, Human
cccaugggaggugggucuggcca

SEQ ID NO: 103818 - RNA, 28 nt, Human
cccaugggaucaaaaagccucccagaca

SEQ ID NO: 103819 - RNA, 32 nt, Human
cccaugggcagagaagaaaaugaccaggagug

SEQ ID NO: 103820 - RNA, 23 nt, Human
cccaugggcccccgucccaggca

SEQ ID NO: 103821 - RNA, 20 nt, Human
cccaugggccuccacaagca

SEQ ID NO: 103822 - RNA, 17 nt, Human
cccaugggcgcagcagc

SEQ ID NO: 103823 - RNA, 32 nt, Human
cccaugggcgguucugggacauggaagcuggu

SEQ ID NO: 103824 - RNA, 32 nt, Human
cccaugggcuccugccccuuucaggccuacag

SEQ ID NO: 103825 - RNA, 21 nt, Human
cccaugggcuggcccaggacc

SEQ ID NO: 103826 - RNA, 32 nt, Human
cccauggggaaugucaacaggcaggggcagca

SEQ ID NO: 103827 - RNA, 32 nt, Human
cccauggggaccccucucccaucccagcagug

SEQ ID NO: 103828 - RNA, 32 nt, Human
cccauggggaggacgauggugaggagauccug

SEQ ID NO: 103829 - RNA, 32 nt, Human
cccauggggaggugaugguggggagaugaugg

SEQ ID NO: 103830 - RNA, 21 nt, Human
cccaugguccauccccugagg

SEQ ID NO: 103831 - RNA, 32 nt, Human
cccauggucccaggaacuagaggaugccuccu

SEQ ID NO: 103832 - RNA, 32 nt, Human
cccauggucuaagagggucuuuuugacuaagg

SEQ ID NO: 103833 - RNA, 32 nt, Human
cccaugguuacucaugaacugaggggauagcu

SEQ ID NO: 103834 - RNA, 32 nt, Human
cccaugguugacugaggagucgggugaggcca

SEQ ID NO: 103835 - RNA, 32 nt, Human
cccaugguuucaucccugaaacagggccucac

SEQ ID NO: 103836 - RNA, 32 nt, Human
cccauguaacaaaccugcacaugugggcuggg

SEQ ID NO: 103837 - RNA, 32 nt, Human
cccauguaaggagcugaguucuuaaagacuga

SEQ ID NO: 103838 - RNA, 32 nt, Human
cccauguacuccuguggcuuucucacauucgg

SEQ ID NO: 103839 - RNA, 32 nt, Human
cccauguagcugggaagugggaccugggggug

SEQ ID NO: 103840 - RNA, 32 nt, Human
cccauguagcuuccacacagcccuuccuuuca

SEQ ID NO: 103841 - RNA, 32 nt, Human
cccauguaugaugagaggaaacagugggaggu

SEQ ID NO: 103842 - RNA, 21 nt, Human
cccauguauggguugcaguga

SEQ ID NO: 103843 - RNA, 32 nt, Human
cccaugucacauuggcaccugauggcaucagc

SEQ ID NO: 103844 - RNA, 18 nt, Human
cccaugucacggcagcuu

SEQ ID NO: 103845 - RNA, 32 nt, Human
cccaugucagacccugagcuggugcucagcag

SEQ ID NO: 103846 - RNA, 32 nt, Human
cccauguccuggaagauggccaugccugcagc

SEQ ID NO: 103847 - RNA, 22 nt, Human
cccaugucucccccaccucagg

SEQ ID NO: 103848 - RNA, 32 nt, Human
cccaugucuccuagaacugccaugaagcugac

SEQ ID NO: 103849 - RNA, 19 nt, Human
cccaugucugagaggggug

SEQ ID NO: 103850 - RNA, 32 nt, Human
cccaugucugggcucccaggcagggaacccga

SEQ ID NO: 103851 - RNA, 32 nt, Human
cccaugucuucugcuguucuucacuucuggga

SEQ ID NO: 103852 - RNA, 32 nt, Human
cccaugugaagcugauguuugauuccaguuuc

SEQ ID NO: 103853 - RNA, 32 nt, Human
cccaugugacacugggugacaugguaaaagua

SEQ ID NO: 103854 - RNA, 32 nt, Human
cccaugugccuguacccuccccuggucuacau

SEQ ID NO: 103855 - RNA, 23 nt, Human
cccauguggucccaggccaggcu

SEQ ID NO: 103856 - RNA, 32 nt, Human
cccaugugucucuuucagagcuggccagaccg

SEQ ID NO: 103857 - RNA, 32 nt, Human
cccaugugugacuccagccugcccucagcaca

SEQ ID NO: 103858 - RNA, 32 nt, Human
cccaugugugcacauacacacaugcaccuaca

SEQ ID NO: 103859 - RNA, 32 nt, Human
cccaugugugccuguguccacaccaugacccu

SEQ ID NO: 103860 - RNA, 32 nt, Human
cccauguucacucuuuuccucucaguaguuug

SEQ ID NO: 103861 - RNA, 24 nt, Human
cccauguuccuagcaacccugaga

SEQ ID NO: 103862 - RNA, 32 nt, Human
cccauguucgccucaucuaaccccugccugca

SEQ ID NO: 103863 - RNA, 32 nt, Human
cccauguucugcccccagcccaaaggggacag

SEQ ID NO: 103864 - RNA, 32 nt, Human
cccauguugcagcacuucugggucguugcaau

SEQ ID NO: 103865 - RNA, 32 nt, Human
cccauguugucccugcugccucccucuggagu

SEQ ID NO: 103866 - RNA, 32 nt, Human
cccauguuuauugcagcacuguucacaacagc

SEQ ID NO: 103867 - RNA, 21 nt, Human
cccauguuuccaucuccuguc

SEQ ID NO: 103868 - RNA, 32 nt, Human
cccauuaaacuaccauugacagucuucacaga

SEQ ID NO: 103869 - RNA, 32 nt, Human
cccauuaaacugggugccuggugaggacacgg

SEQ ID NO: 103870 - RNA, 32 nt, Human
cccauuaaagcauuucaaagagugcuagauuc

SEQ ID NO: 103871 - RNA, 32 nt, Human
cccauuaagucaugguggcuccagccaauguc

SEQ ID NO: 103872 - RNA, 32 nt, Human
cccauuaauagggaacugguuagauaaauugu

SEQ ID NO: 103873 - RNA, 32 nt, Human
cccauuagcacccagauaauucuaucauguua

SEQ ID NO: 103874 - RNA, 32 nt, Human
cccauuagcucacaccuguaaucccagcacuu

SEQ ID NO: 103875 - RNA, 32 nt, Human
cccauuagcuggcagacccaggggaagaaagg

SEQ ID NO: 103876 - RNA, 18 nt, Human
cccauuaugcgcuguggc

SEQ ID NO: 103877 - RNA, 32 nt, Human
cccauuauucaggcugcacaacacagaaggaa

SEQ ID NO: 103878 - RNA, 32 nt, Human
cccauucacacagcaggacucuucucacauga

SEQ ID NO: 103879 - RNA, 31 nt, Human
cccauucacagcuagggacaagcagcagugc

SEQ ID NO: 103880 - RNA, 32 nt, Human
cccauucacaugccccuccuaacuccacaagc

SEQ ID NO: 103881 - RNA, 32 nt, Human
cccauucacuacacaagaaccccacaccuggc

SEQ ID NO: 103882 - RNA, 32 nt, Human
cccauucacugcagucaucugacucauuuuaa

SEQ ID NO: 103883 - RNA, 32 nt, Human
cccauucagacccaggcccccaaaagucgggu

SEQ ID NO: 103884 - RNA, 32 nt, Human
cccauucagagaggggcuuucuggccuugugc

SEQ ID NO: 103885 - RNA, 18 nt, Human
cccauucagccaugguca

SEQ ID NO: 103886 - RNA, 32 nt, Human
cccauucaggcugacugucaccgcagggaggc

SEQ ID NO: 103887 - RNA, 32 nt, Human
cccauucagggugggcugaagagccccugagc

SEQ ID NO: 103888 - RNA, 32 nt, Human
cccauucaguuuggagcucacaccuaagcugc

SEQ ID NO: 103889 - RNA, 19 nt, Human
cccauucauauagcauuca

SEQ ID NO: 103890 - RNA, 32 nt, Human
cccauucaucucaagugcuucagucuuugguu

SEQ ID NO: 103891 - RNA, 32 nt, Human
cccauuccaagcucccucuuccucccgguguu

SEQ ID NO: 103892 - RNA, 32 nt, Human
cccauuccaaggggccagcagcacuuuggccc

SEQ ID NO: 103893 - RNA, 32 nt, Human
cccauuccaagugcucugccagccccuguuca

SEQ ID NO: 103894 - RNA, 20 nt, Human
cccauuccacagcucugggc

SEQ ID NO: 103895 - RNA, 18 nt, Human
cccauuccagacugggaa

SEQ ID NO: 103896 - RNA, 32 nt, Human
cccauuccagcucucccauggagccccuccac

SEQ ID NO: 103897 - RNA, 32 nt, Human
cccauuccagugguggaggcgcuguggauggc

SEQ ID NO: 103898 - RNA, 32 nt, Human
cccauuccauccccaguccagccugggcaacc

SEQ ID NO: 103899 - RNA, 32 nt, Human
cccauucccagaaauuaccacccgcccaacag

SEQ ID NO: 103900 - RNA, 32 nt, Human
cccauucccaucuacugaaacagggucuccac

SEQ ID NO: 103901 - RNA, 20 nt, Human
cccauucccucccucuguca

SEQ ID NO: 103902 - RNA, 32 nt, Human
cccauuccuccacucuguaucuaugcaaagca

SEQ ID NO: 103903 - RNA, 32 nt, Human
cccauuccuccuguaccagcaccuccguuuuc

SEQ ID NO: 103904 - RNA, 32 nt, Human
cccauuccugcucuccucuuuccucuaaaccu

SEQ ID NO: 103905 - RNA, 23 nt, Human
cccauucuacgcgccugcccaca

SEQ ID NO: 103906 - RNA, 32 nt, Human
cccauucuacuuuuggucuccgcccacugauu

SEQ ID NO: 103907 - RNA, 32 nt, Human
cccauucuaugccccaaccaccaaggcuuucc

SEQ ID NO: 103908 - RNA, 32 nt, Human
cccauucucaacucuaauccaucccagcccuc

SEQ ID NO: 103909 - RNA, 32 nt, Human
cccauucuccaccgauacacaucaugugccag

SEQ ID NO: 103910 - RNA, 32 nt, Human
cccauucuccuagggcccauguaccccacgcc

SEQ ID NO: 103911 - RNA, 32 nt, Human
cccauucuccuucugcuucucuugcccucuuc

SEQ ID NO: 103912 - RNA, 32 nt, Human
cccauucucuuucucaggaauggcuguuaaaa

SEQ ID NO: 103913 - RNA, 32 nt, Human
cccauucugaagaaggguaggaaggggcgacc

SEQ ID NO: 103914 - RNA, 32 nt, Human
cccauucugcagcuucaccauccacgcgcuaa

SEQ ID NO: 103915 - RNA, 22 nt, Human
cccauucugcguaugaguccca

SEQ ID NO: 103916 - RNA, 32 nt, Human
cccauucugcuccccuagagaccucuuguaca

SEQ ID NO: 103917 - RNA, 20 nt, Human
cccauucuggagugcagugg

SEQ ID NO: 103918 - RNA, 23 nt, Human
cccauucuguaaucaacugagcu

SEQ ID NO: 103919 - RNA, 32 nt, Human
cccauucuguuuccagcccagaagaaaugcug

SEQ ID NO: 103920 - RNA, 32 nt, Human
cccauucuucacucugaagagagcggucagug

SEQ ID NO: 103921 - RNA, 21 nt, Human
cccauucuucccagcagccca

SEQ ID NO: 103922 - RNA, 32 nt, Human
cccauucuucccaggcucccagcuggugguga

SEQ ID NO: 103923 - RNA, 32 nt, Human
cccauucuuccuuacccugccuuugcccuuuc

SEQ ID NO: 103924 - RNA, 21 nt, Human
cccauucuugauugagucuca

SEQ ID NO: 103925 - RNA, 32 nt, Human
cccauugaacaacagcugcucauuucccccag

SEQ ID NO: 103926 - RNA, 32 nt, Human
cccauugaauucaccacugagaaggggguagg

SEQ ID NO: 103927 - RNA, 32 nt, Human
cccauugacauccucccccuacacucccucuc

SEQ ID NO: 103928 - RNA, 22 nt, Human
cccauugaccacucccuccuca

SEQ ID NO: 103929 - RNA, 32 nt, Human
cccauugagccagcaacucggauuuaggagcc

SEQ ID NO: 103930 - RNA, 21 nt, Human
cccauugaucaucccuucuca

SEQ ID NO: 103931 - RNA, 17 nt, Human
cccauugcagcuguggc

SEQ ID NO: 103932 - RNA, 20 nt, Human
cccauugccacugcuugcca

SEQ ID NO: 103933 - RNA, 32 nt, Human
cccauugccacuuauuuauucaucucaggaaa

SEQ ID NO: 103934 - RNA, 32 nt, Human
cccauugccagccuugcugucagauucaaaau

SEQ ID NO: 103935 - RNA, 32 nt, Human
cccauugcccaagagagagggcagggaacagg

SEQ ID NO: 103936 - RNA, 32 nt, Human
cccauugcccuuugcccuccagucuccccuuc

SEQ ID NO: 103937 - RNA, 32 nt, Human
cccauugcugggacugcccagggaggaggccu

SEQ ID NO: 103938 - RNA, 32 nt, Human
cccauugcuguuguccaacuauuuauugacuc

SEQ ID NO: 103939 - RNA, 32 nt, Human
cccauugcuucugcucuccucagaggucccgg

SEQ ID NO: 103940 - RNA, 26 nt, Human
cccauuggaaaaagggagaacgugua

SEQ ID NO: 103941 - RNA, 32 nt, Human
cccauuggaagucaaaugcauuuaauaccccu

SEQ ID NO: 103942 - RNA, 19 nt, Human
cccauuggccugucugcug

SEQ ID NO: 103943 - RNA, 32 nt, Human
cccauugggcaggccgcacgggggcgcggccc

SEQ ID NO: 103944 - RNA, 32 nt, Human
cccauugggcugggcagaugagauccuacuuu

SEQ ID NO: 103945 - RNA, 32 nt, Human
cccauuguagaggccagaaaagcugcccagug

SEQ ID NO: 103946 - RNA, 22 nt, Human
cccauugucccaacuacuuggg

SEQ ID NO: 103947 - RNA, 21 nt, Human
cccauugugccccaggccagc

SEQ ID NO: 103948 - RNA, 32 nt, Human
cccauuguggaaauucaucuugaaucccauug

SEQ ID NO: 103949 - RNA, 32 nt, Human
cccauugugugauguguucagaugcaucuggc

SEQ ID NO: 103950 - RNA, 32 nt, Human
cccauuguucucuucagaacccuaucugggag

SEQ ID NO: 103951 - RNA, 32 nt, Human
cccauuuacaggucuucucuccaacucuucac

SEQ ID NO: 103952 - RNA, 32 nt, Human
cccauuuagcaucuccaggcccugccaucgug

SEQ ID NO: 103953 - RNA, 32 nt, Human
cccauuucaaaagguaauguugccuggggcuu

SEQ ID NO: 103954 - RNA, 32 nt, Human
cccauuucacagagaaggagcagagaaauuaa

SEQ ID NO: 103955 - RNA, 32 nt, Human
cccauuucacuccugcaccaaccccacucuug

SEQ ID NO: 103956 - RNA, 32 nt, Human
cccauuuccucaaaagaugguggaggacuuag

SEQ ID NO: 103957 - RNA, 32 nt, Human
cccauuuccugccucguuucaguucaacuuuc

SEQ ID NO: 103958 - RNA, 32 nt, Human
cccauuuccuuuacaaacccccgcacaauuuc

SEQ ID NO: 103959 - RNA, 32 nt, Human
cccauuucuaauuucauugucuuucuucccac

SEQ ID NO: 103960 - RNA, 32 nt, Human
cccauuucuaucucccagcccagucacaaaaa

SEQ ID NO: 103961 - RNA, 32 nt, Human
cccauuucuuagcugcugaaaucagugcucuu

SEQ ID NO: 103962 - RNA, 32 nt, Human
cccauuugagauucuaaaugaauacucuuagu

SEQ ID NO: 103963 - RNA, 32 nt, Human
cccauuugcagccauggucacgagucauuucu

SEQ ID NO: 103964 - RNA, 32 nt, Human
cccauuugcugguucagcuaugauucaggcuu

SEQ ID NO: 103965 - RNA, 31 nt, Human
cccauuuggcacuucuuccuggaugcgcaug

SEQ ID NO: 103966 - RNA, 25 nt, Human
cccauuuggcccugggcucagggga

SEQ ID NO: 103967 - RNA, 32 nt, Human
cccauuuguagcugauagccauuuuucaaagg

SEQ ID NO: 103968 - RNA, 29 nt, Human
cccauuugucugugugccugccaggauuc

SEQ ID NO: 103969 - RNA, 32 nt, Human
cccauuugugcugguuuuugccucuuugacau

SEQ ID NO: 103970 - RNA, 32 nt, Human
cccauuuuaaggucugcagccuuaauucuacc

SEQ ID NO: 103971 - RNA, 21 nt, Human
cccauuuucagcgcccagggu

SEQ ID NO: 103972 - RNA, 32 nt, Human
cccauuuuccaugcacugugcuuauguguggu

SEQ ID NO: 103973 - RNA, 32 nt, Human
cccauuuucccucccuccuuuuuccuuuccau

SEQ ID NO: 103974 - RNA, 32 nt, Human
cccauuuucccuucgauauaugacuuuuucuc

SEQ ID NO: 103975 - RNA, 32 nt, Human
cccauuuuccucacuuucccugagucucaaga

SEQ ID NO: 103976 - RNA, 32 nt, Human
cccauuuucucagccucuucucugccuccaga

SEQ ID NO: 103977 - RNA, 32 nt, Human
cccauuuucucccauauuugccugaaaaauau

SEQ ID NO: 103978 - RNA, 32 nt, Human
cccauuuucugaagcuccagcacacagggccc

SEQ ID NO: 103979 - RNA, 32 nt, Human
cccauuuugccaagggcaaccagccauccagg

SEQ ID NO: 103980 - RNA, 32 nt, Human
cccauuuuggcaaggugcacagagaguccuca

SEQ ID NO: 103981 - RNA, 32 nt, Human
ccccaaaaauucaagaaaacuaacuuagaguu

SEQ ID NO: 103982 - RNA, 32 nt, Human
ccccaaaacaucaccagucccuacuacuugcu

SEQ ID NO: 103983 - RNA, 23 nt, Human
ccccaaaacuuacuggcacaaca

SEQ ID NO: 103984 - RNA, 32 nt, Human
ccccaaaaggcaucauggcugcccucagaucc

SEQ ID NO: 103985 - RNA, 32 nt, Human
ccccaaaaucacauggauuccccaaguggaaa

SEQ ID NO: 103986 - RNA, 32 nt, Human
ccccaaaaugcacuugccuauaagaaacacaa

SEQ ID NO: 103987 - RNA, 32 nt, Human
ccccaaacacagacuccugccugcccucugcc

SEQ ID NO: 103988 - RNA, 22 nt, Human
ccccaaaccagcccucgauccc

SEQ ID NO: 103989 - RNA, 32 nt, Human
ccccaaaccccagacacuccucuccuugccug

SEQ ID NO: 103990 - RNA, 32 nt, Human
ccccaaaccccagccccaacuccaggggcacc

SEQ ID NO: 103991 - RNA, 21 nt, Human
ccccaaaccugccccuccuca

SEQ ID NO: 103992 - RNA, 32 nt, Human
ccccaaaccuguuccccucugcuacuagccac

SEQ ID NO: 103993 - RNA, 21 nt, Human
ccccaaaccuuggaacuguca

SEQ ID NO: 103994 - RNA, 22 nt, Human
ccccaaacuaggcugugcccug

SEQ ID NO: 103995 - RNA, 32 nt, Human
ccccaaacuccuuuacugcagccugggcuccc

SEQ ID NO: 103996 - RNA, 21 nt, Human
ccccaaacugugcccugccuu

SEQ ID NO: 103997 - RNA, 25 nt, Human
ccccaaacuuauggacacugccuua

SEQ ID NO: 103998 - RNA, 32 nt, Human
ccccaaagacacuggccuccugcuccagcuuc

SEQ ID NO: 103999 - RNA, 32 nt, Human
ccccaaagagcccgucugcaccccagacccag

SEQ ID NO: 104000 - RNA, 22 nt, Human
ccccaaagaguuuucugugcaa

SEQ ID NO: 104001 - RNA, 32 nt, Human
ccccaaagaugagcgccaacagcagcagagug

SEQ ID NO: 104002 - RNA, 32 nt, Human
ccccaaagcucugaggccuaggagacugcgcu

SEQ ID NO: 104003 - RNA, 31 nt, Human
ccccaaaggcccucugggcccgucucaaagg

SEQ ID NO: 104004 - RNA, 32 nt, Human
ccccaaaggccuuacuugaugcuguagcacuc

SEQ ID NO: 104005 - RNA, 21 nt, Human
ccccaaaggcuuccugggcca

SEQ ID NO: 104006 - RNA, 32 nt, Human
ccccaaagggauccuuucucuaaggucucuga

SEQ ID NO: 104007 - RNA, 32 nt, Human
ccccaaaguaaagagaagcucuucucaguuug

SEQ ID NO: 104008 - RNA, 32 nt, Human
ccccaaagugccugccaaaccccagggccugg

SEQ ID NO: 104009 - RNA, 32 nt, Human
ccccaaaucuuaagcaccugcgccaguacagu

SEQ ID NO: 104010 - RNA, 32 nt, Human
ccccaaaucuuggcugggcacgguggcucacg

SEQ ID NO: 104011 - RNA, 21 nt, Human
ccccaaaugucacuucugcau

SEQ ID NO: 104012 - RNA, 23 nt, Human
ccccaaauuauuugccucccuua

SEQ ID NO: 104013 - RNA, 24 nt, Human
ccccaaauucagggccccacccuu

SEQ ID NO: 104014 - RNA, 32 nt, Human
ccccaacaacaucaagcacauuugucugugau

SEQ ID NO: 104015 - RNA, 32 nt, Human
ccccaacaaugccauucccacuugccccagag

SEQ ID NO: 104016 - RNA, 32 nt, Human
ccccaacaauggcuuuaagaagaaggacaagg

SEQ ID NO: 104017 - RNA, 22 nt, Human
ccccaacacaccaccugccuug

SEQ ID NO: 104018 - RNA, 32 nt, Human
ccccaacacaugcacauguguguacacaacug

SEQ ID NO: 104019 - RNA, 32 nt, Human
ccccaacaccagugccugaggcugagguuaga

SEQ ID NO: 104020 - RNA, 19 nt, Human
ccccaacacccccgugcuc

SEQ ID NO: 104021 - RNA, 20 nt, Human
ccccaacaccccgccugccu

SEQ ID NO: 104022 - RNA, 16 nt, Human
ccccaacacccuucca

SEQ ID NO: 104023 - RNA, 32 nt, Human
ccccaacagcacuuagguuuuccuguugagau

SEQ ID NO: 104024 - RNA, 32 nt, Human
ccccaacagccagcagcaguggcccucaucac

SEQ ID NO: 104025 - RNA, 32 nt, Human
ccccaacagcccccuucuccuccuuucccuuc

SEQ ID NO: 104026 - RNA, 32 nt, Human
ccccaacagcccuccugugccugcuucccugu

SEQ ID NO: 104027 - RNA, 32 nt, Human
ccccaacaggaucagacccagaggcagcuggu

SEQ ID NO: 104028 - RNA, 32 nt, Human
ccccaacauccaguagggucccuagcuccgcu

SEQ ID NO: 104029 - RNA, 32 nt, Human
ccccaacaucuuuguguucucacacacaggca

SEQ ID NO: 104030 - RNA, 32 nt, Human
ccccaacauuucacuccagccuggccccaguc

SEQ ID NO: 104031 - RNA, 32 nt, Human
ccccaaccacgguacucaucaccaccaccacu

SEQ ID NO: 104032 - RNA, 32 nt, Human
ccccaaccaggauguuggccuggggaggccac

SEQ ID NO: 104033 - RNA, 32 nt, Human
ccccaaccaucccaauagggugggggccugug

SEQ ID NO: 104034 - RNA, 32 nt, Human
ccccaaccaucuccugauauuugguagaguaa

SEQ ID NO: 104035 - RNA, 32 nt, Human
ccccaaccaucugccagagaacuccuaugcau

SEQ ID NO: 104036 - RNA, 32 nt, Human
ccccaaccaugcugcauguguaaagaaggauu

SEQ ID NO: 104037 - RNA, 32 nt, Human
ccccaaccccaagccugauccccaccggagac

SEQ ID NO: 104038 - RNA, 32 nt, Human
ccccaaccccaauaggggagggcagagggaag

SEQ ID NO: 104039 - RNA, 24 nt, Human
ccccaaccccacccaguugggacc

SEQ ID NO: 104040 - RNA, 32 nt, Human
ccccaacccccagcacccgggcucagggacca

SEQ ID NO: 104041 - RNA, 22 nt, Human
ccccaacccccagggcccagga

SEQ ID NO: 104042 - RNA, 32 nt, Human
ccccaacccccguccagaaucucccuuugcag

SEQ ID NO: 104043 - RNA, 32 nt, Human
ccccaaccccuccuuuucccaccggcagguga

SEQ ID NO: 104044 - RNA, 32 nt, Human
ccccaacccuuuccuuuccuccugcuugcgga

SEQ ID NO: 104045 - RNA, 32 nt, Human
ccccaaccgcugccauuucacacucacccucc

SEQ ID NO: 104046 - RNA, 32 nt, Human
ccccaaccuccaccccucucugugauauugac

SEQ ID NO: 104047 - RNA, 32 nt, Human
ccccaaccuccaggagcuaguggaggggugug

SEQ ID NO: 104048 - RNA, 32 nt, Human
ccccaaccuccgccuccuggguucaggcgauu

SEQ ID NO: 104049 - RNA, 32 nt, Human
ccccaaccugaccaccucauucuuaucuuucu

SEQ ID NO: 104050 - RNA, 22 nt, Human
ccccaaccugagagucuuuccc

SEQ ID NO: 104051 - RNA, 32 nt, Human
ccccaacgaugccaaucacgacaacuuuccag

SEQ ID NO: 104052 - RNA, 20 nt, Human
ccccaacucagccccagcgg

SEQ ID NO: 104053 - RNA, 32 nt, Human
ccccaacucagccgcagcguuccccagcuccc

SEQ ID NO: 104054 - RNA, 20 nt, Human
ccccaacuccaccccucaca

SEQ ID NO: 104055 - RNA, 32 nt, Human
ccccaacuccagcagcuggacucugggcccac

SEQ ID NO: 104056 - RNA, 32 nt, Human
ccccaacuccagcccauccuguuggugaccgu

SEQ ID NO: 104057 - RNA, 32 nt, Human
ccccaacuccaggaaagagcagucagagucca

SEQ ID NO: 104058 - RNA, 32 nt, Human
ccccaacucccuguucuggcuccugggugggg

SEQ ID NO: 104059 - RNA, 32 nt, Human
ccccaacucugccuuccuggaacuaggccugc

SEQ ID NO: 104060 - RNA, 32 nt, Human
ccccaacugaaacaccagaagguuuggaguga

SEQ ID NO: 104061 - RNA, 32 nt, Human
ccccaacugaauguguucugucacucagcuuu

SEQ ID NO: 104062 - RNA, 32 nt, Human
ccccaacugccaggaccuccaaacggauugga

SEQ ID NO: 104063 - RNA, 32 nt, Human
ccccaacugcucugcaucugccuggaugucug

SEQ ID NO: 104064 - RNA, 32 nt, Human
ccccaacugggacuuccgaggcaacuugaacu

SEQ ID NO: 104065 - RNA, 32 nt, Human
ccccaacugggagggggcagccgaggggagcu

SEQ ID NO: 104066 - RNA, 32 nt, Human
ccccaacuuagcaucccuucccuuccguuagg

SEQ ID NO: 104067 - RNA, 32 nt, Human
ccccaacuucauuugcuucucucaacaaccuc

SEQ ID NO: 104068 - RNA, 32 nt, Human
ccccaacuuccucauagccagaagucaaguua

SEQ ID NO: 104069 - RNA, 32 nt, Human
ccccaacuuucccucccuucuuuccauuuauu

SEQ ID NO: 104070 - RNA, 32 nt, Human
ccccaacuuuucuccccgccugcucccaucug

SEQ ID NO: 104071 - RNA, 25 nt, Human
ccccaagaaaggcaggauccugguc

SEQ ID NO: 104072 - RNA, 32 nt, Human
ccccaagaaugagcuuacaaaguggccuuucc

SEQ ID NO: 104073 - RNA, 20 nt, Human
ccccaagaccccacuggcca

SEQ ID NO: 104074 - RNA, 23 nt, Human
ccccaagaccccuagcccugccc

SEQ ID NO: 104075 - RNA, 32 nt, Human
ccccaagacugccaccagucuacacauacagc

SEQ ID NO: 104076 - RNA, 32 nt, Human
ccccaagagaaagauuuaaggaagcacagaaa

SEQ ID NO: 104077 - RNA, 32 nt, Human
ccccaagagcuauccggacucucuccaagacc

SEQ ID NO: 104078 - RNA, 32 nt, Human
ccccaagaggucuucugccuuuccuuuccccg

SEQ ID NO: 104079 - RNA, 32 nt, Human
ccccaagauccccugugcuaucaggaaagcau

SEQ ID NO: 104080 - RNA, 32 nt, Human
ccccaagaugccccuccccacccugaccgugc

SEQ ID NO: 104081 - RNA, 32 nt, Human
ccccaagauggccuggagaccacccagcccug

SEQ ID NO: 104082 - RNA, 21 nt, Human
ccccaagcaaucucugugcaa

SEQ ID NO: 104083 - RNA, 21 nt, Human
ccccaagcacggugugcccug

SEQ ID NO: 104084 - RNA, 32 nt, Human
ccccaagcacuaccacacauggucuccccacc

SEQ ID NO: 104085 - RNA, 32 nt, Human
ccccaagcagaggaggcugcaccucccucgcg

SEQ ID NO: 104086 - RNA, 17 nt, Human
ccccaagccagcaccuu

SEQ ID NO: 104087 - RNA, 32 nt, Human
ccccaagccagccugcccccugccccauuucc

SEQ ID NO: 104088 - RNA, 32 nt, Human
ccccaagccagcugcuggcugcagaagaaaag

SEQ ID NO: 104089 - RNA, 32 nt, Human
ccccaagccaggaugucccaagcuuggguccc

SEQ ID NO: 104090 - RNA, 32 nt, Human
ccccaagccaugggauuguccuuccuggggcc

SEQ ID NO: 104091 - RNA, 32 nt, Human
ccccaagcccaggaguuugaggcugcagugag

SEQ ID NO: 104092 - RNA, 32 nt, Human
ccccaagcccaggauuggggucuccagagucc

SEQ ID NO: 104093 - RNA, 23 nt, Human
ccccaagccccaggauccagguc

SEQ ID NO: 104094 - RNA, 32 nt, Human
ccccaagcccucaacugugagccacuccaaua

SEQ ID NO: 104095 - RNA, 32 nt, Human
ccccaagccgccggagccacacccccagccgc

SEQ ID NO: 104096 - RNA, 32 nt, Human
ccccaagccuccauuuccucagaagucaaaca

SEQ ID NO: 104097 - RNA, 32 nt, Human
ccccaagccugccucgcucccaguacggccgg

SEQ ID NO: 104098 - RNA, 19 nt, Human
ccccaagccuugugaccug

SEQ ID NO: 104099 - RNA, 32 nt, Human
ccccaagcuagugcguucucugccccucccug

SEQ ID NO: 104100 - RNA, 32 nt, Human
ccccaagcuauccuguuucagauaauaucaau

SEQ ID NO: 104101 - RNA, 32 nt, Human
ccccaagcucagaggugcucagagguacgaga

SEQ ID NO: 104102 - RNA, 32 nt, Human
ccccaagcuccccuccccaagcuccugaagac

SEQ ID NO: 104103 - RNA, 22 nt, Human
ccccaaggacacuuggcacagg

SEQ ID NO: 104104 - RNA, 32 nt, Human
ccccaaggacccuggggguggcccagagagga

SEQ ID NO: 104105 - RNA, 32 nt, Human
ccccaaggagccagcugaagccucccaauccc

SEQ ID NO: 104106 - RNA, 32 nt, Human
ccccaaggaugaggcuggacugaggcaaaggg

SEQ ID NO: 104107 - RNA, 32 nt, Human
ccccaaggcagagucggcugggcguggaccag

SEQ ID NO: 104108 - RNA, 32 nt, Human
ccccaaggccaucacaaagcaguggggcauga

SEQ ID NO: 104109 - RNA, 18 nt, Human
ccccaaggcccugggcca

SEQ ID NO: 104110 - RNA, 31 nt, Human
ccccaaggccucucucugccugaaauguuac

SEQ ID NO: 104111 - RNA, 20 nt, Human
ccccaaggcggagggcccug

SEQ ID NO: 104112 - RNA, 18 nt, Human
ccccaaggcucugggcca

SEQ ID NO: 104113 - RNA, 32 nt, Human
ccccaaggcugaugcauucccggugcagaaca

SEQ ID NO: 104114 - RNA, 22 nt, Human
ccccaaggcuggagugcagugg

SEQ ID NO: 104115 - RNA, 20 nt, Human
ccccaaggcuggcacagacu

SEQ ID NO: 104116 - RNA, 22 nt, Human
ccccaagggcucaucugugcaa

SEQ ID NO: 104117 - RNA, 32 nt, Human
ccccaagggcuggugcuugauagacccuccuc

SEQ ID NO: 104118 - RNA, 24 nt, Human
ccccaaggggagcagcccagggcc

SEQ ID NO: 104119 - RNA, 32 nt, Human
ccccaaggggcagagcuggcagagaggggccu

SEQ ID NO: 104120 - RNA, 32 nt, Human
ccccaaggggcaggaggaaugcaggagcagga

SEQ ID NO: 104121 - RNA, 32 nt, Human
ccccaaggggcagucuggaggggcauggccag

SEQ ID NO: 104122 - RNA, 32 nt, Human
ccccaaggggcucggaacucuaccucuucacc

SEQ ID NO: 104123 - RNA, 20 nt, Human
ccccaagggucagggccaug

SEQ ID NO: 104124 - RNA, 32 nt, Human
ccccaaggugaaguggagggugcuguggugag

SEQ ID NO: 104125 - RNA, 19 nt, Human
ccccaaggugaccuggcca

SEQ ID NO: 104126 - RNA, 32 nt, Human
ccccaaggugcaggagggcaggauccagcagc

SEQ ID NO: 104127 - RNA, 32 nt, Human
ccccaaggugugagcauugcagcgcagugugu

SEQ ID NO: 104128 - RNA, 32 nt, Human
ccccaagguucaaacugucucaagcugagaga

SEQ ID NO: 104129 - RNA, 32 nt, Human
ccccaaguccauuuucccuccugggaccagag

SEQ ID NO: 104130 - RNA, 32 nt, Human
ccccaaguccccaucgguaggagaaguccagc

SEQ ID NO: 104131 - RNA, 32 nt, Human
ccccaaguccuccuccgccuccuccucucugc

SEQ ID NO: 104132 - RNA, 32 nt, Human
ccccaaguccuggugucuccagccuggcucua

SEQ ID NO: 104133 - RNA, 21 nt, Human
ccccaagucucuucugugcaa

SEQ ID NO: 104134 - RNA, 32 nt, Human
ccccaagucuguuccgucagagcuucuggcug

SEQ ID NO: 104135 - RNA, 32 nt, Human
ccccaagucuugucaauaacuugcugugugga

SEQ ID NO: 104136 - RNA, 32 nt, Human
ccccaagugcagagugcagggaagcagauggg

SEQ ID NO: 104137 - RNA, 23 nt, Human
ccccaagugcuuagcccagggcc

SEQ ID NO: 104138 - RNA, 17 nt, Human
ccccaaguggucaccuc

SEQ ID NO: 104139 - RNA, 32 nt, Human
ccccaaguggugagcaagcaccaaccuccaga

SEQ ID NO: 104140 - RNA, 18 nt, Human
ccccaaguguugggccau

SEQ ID NO: 104141 - RNA, 32 nt, Human
ccccaaguguuucuugagcaucuggucugggg

SEQ ID NO: 104142 - RNA, 25 nt, Human
ccccaaguuccgccaggcccugccc

SEQ ID NO: 104143 - RNA, 32 nt, Human
ccccaaguucugauuuuuaauuucuauggaag

SEQ ID NO: 104144 - RNA, 18 nt, Human
ccccaauaaaacugccau

SEQ ID NO: 104145 - RNA, 32 nt, Human
ccccaauaauccagcgcugccucugcugccgg

SEQ ID NO: 104146 - RNA, 32 nt, Human
ccccaauagaaaacauggcaucccugaccucc

SEQ ID NO: 104147 - RNA, 32 nt, Human
ccccaauauaucauaccagcuuuuggagguag

SEQ ID NO: 104148 - RNA, 32 nt, Human
ccccaauauaugcacauuuauaagcauaugca

SEQ ID NO: 104149 - RNA, 32 nt, Human
ccccaaucaccagcugucugcuggguucuuuu

SEQ ID NO: 104150 - RNA, 32 nt, Human
ccccaaucaccucauccacaucaucuccaaag

SEQ ID NO: 104151 - RNA, 32 nt, Human
ccccaaucccuccaauaaaccugauucugcug

SEQ ID NO: 104152 - RNA, 32 nt, Human
ccccaaucucagaaauucaaauuuaagcaugg

SEQ ID NO: 104153 - RNA, 32 nt, Human
ccccaaucugcggcuucucccaccucacuggg

SEQ ID NO: 104154 - RNA, 32 nt, Human
ccccaaugcaccugcaggcaagguacccgaag

SEQ ID NO: 104155 - RNA, 32 nt, Human
ccccaaugcagacaaaauggccacagcaucua

SEQ ID NO: 104156 - RNA, 32 nt, Human
ccccaaugcauucauauuugccaagccauccc

SEQ ID NO: 104157 - RNA, 32 nt, Human
ccccaaugccuucuguccucuucccucugccc

SEQ ID NO: 104158 - RNA, 21 nt, Human
ccccaauggcuacucugcuca

SEQ ID NO: 104159 - RNA, 18 nt, Human
ccccaauguaucaacuca

SEQ ID NO: 104160 - RNA, 32 nt, Human
ccccaaugugcugggcacagaaugacaucauu

SEQ ID NO: 104161 - RNA, 32 nt, Human
ccccaaugugggcuuccaggaacuggagccug

SEQ ID NO: 104162 - RNA, 32 nt, Human
ccccaauucguucuguaaggagcaccaggacg

SEQ ID NO: 104163 - RNA, 32 nt, Human
ccccaauucuugaucucucccaccccaucccu

SEQ ID NO: 104164 - RNA, 32 nt, Human
ccccacaaacacacccugccucccccaguccu

SEQ ID NO: 104165 - RNA, 32 nt, Human
ccccacaaacugggugauagggcggacuuacc

SEQ ID NO: 104166 - RNA, 17 nt, Human
ccccacaaauguggaga

SEQ ID NO: 104167 - RNA, 32 nt, Human
ccccacaaccaccaccaccacaauaaacaagu

SEQ ID NO: 104168 - RNA, 32 nt, Human
ccccacaacuauacccccauccucuccaagau

SEQ ID NO: 104169 - RNA, 32 nt, Human
ccccacaagccugagccaaccugcugccugac

SEQ ID NO: 104170 - RNA, 32 nt, Human
ccccacaagcucuggcccugggcacccaccuc

SEQ ID NO: 104171 - RNA, 32 nt, Human
ccccacaaguagcugagacuacaggcacacac

SEQ ID NO: 104172 - RNA, 32 nt, Human
ccccacaaguugagagugucuuccccucauca

SEQ ID NO: 104173 - RNA, 32 nt, Human
ccccacaauggcagaggugguggcugaggugg

SEQ ID NO: 104174 - RNA, 32 nt, Human
ccccacacacacuggugcaggccacaccaguc

SEQ ID NO: 104175 - RNA, 32 nt, Human
ccccacacacaggccuucuguggggcugggca

SEQ ID NO: 104176 - RNA, 32 nt, Human
ccccacacacucacaaugacucuggcuggccc

SEQ ID NO: 104177 - RNA, 32 nt, Human
ccccacacauccugcacugcaaaaagauaaca

SEQ ID NO: 104178 - RNA, 32 nt, Human
ccccacacaugggaugggggaggcagagacug

SEQ ID NO: 104179 - RNA, 21 nt, Human
ccccacaccacugcaggcagg

SEQ ID NO: 104180 - RNA, 32 nt, Human
ccccacacccacccuccuggcucuuccuguuu

SEQ ID NO: 104181 - RNA, 18 nt, Human
ccccacacccccuccuca

SEQ ID NO: 104182 - RNA, 32 nt, Human
ccccacaccccuccuugcuggaaugugucugg

SEQ ID NO: 104183 - RNA, 20 nt, Human
ccccacacccucccucagcc

SEQ ID NO: 104184 - RNA, 17 nt, Human
ccccacaccucccucac

SEQ ID NO: 104185 - RNA, 32 nt, Human
ccccacaccugacacagagcaggcacucaaua

SEQ ID NO: 104186 - RNA, 18 nt, Human
ccccacacguuccucaca

SEQ ID NO: 104187 - RNA, 32 nt, Human
ccccacacuacugcgucuuuguuucuaucagu

SEQ ID NO: 104188 - RNA, 21 nt, Human
ccccacacucaaaggggcaug

SEQ ID NO: 104189 - RNA, 32 nt, Human
ccccacacucacugcacuggcagcgugcacug

SEQ ID NO: 104190 - RNA, 32 nt, Human
ccccacacucagcuccaaacgccuccucuccc

SEQ ID NO: 104191 - RNA, 32 nt, Human
ccccacacugagcugcaguggguggggagggu

SEQ ID NO: 104192 - RNA, 17 nt, Human
ccccacacugucacuca

SEQ ID NO: 104193 - RNA, 32 nt, Human
ccccacagaaaccaugggaaggacucugaccc

SEQ ID NO: 104194 - RNA, 32 nt, Human
ccccacagacacacacauugauccuccuccuc

SEQ ID NO: 104195 - RNA, 32 nt, Human
ccccacagacgcaaagugacugugcuggcauc

SEQ ID NO: 104196 - RNA, 32 nt, Human
ccccacagacuuuuaggcuggcccagauauuc

SEQ ID NO: 104197 - RNA, 32 nt, Human
ccccacagagaauggggaaggaaggcugcggg

SEQ ID NO: 104198 - RNA, 32 nt, Human
ccccacagagcugucugugggugccuucucaa

SEQ ID NO: 104199 - RNA, 32 nt, Human
ccccacagccaaggaggggucugcauggggag

SEQ ID NO: 104200 - RNA, 32 nt, Human
ccccacagccacccucccucuucagagagccc

SEQ ID NO: 104201 - RNA, 32 nt, Human
ccccacagccagcuaauuuuuguauuuuuagu

SEQ ID NO: 104202 - RNA, 32 nt, Human
ccccacagcccaguguucuccuugggggcagg

SEQ ID NO: 104203 - RNA, 19 nt, Human
ccccacagcccccuccuca

SEQ ID NO: 104204 - RNA, 32 nt, Human
ccccacagcccuccagcucaacccacaccagg

SEQ ID NO: 104205 - RNA, 32 nt, Human
ccccacagccggcgccgcgccaugcuccaccu

SEQ ID NO: 104206 - RNA, 31 nt, Human
ccccacagccucucugugcacuugcugucug

SEQ ID NO: 104207 - RNA, 32 nt, Human
ccccacagccugcccgcccccugcugcugcuc

SEQ ID NO: 104208 - RNA, 32 nt, Human
ccccacagcucuaucagugagcagaguaaaga

SEQ ID NO: 104209 - RNA, 32 nt, Human
ccccacagcugagugaagaagaggaggagacg

SEQ ID NO: 104210 - RNA, 32 nt, Human
ccccacagcugcgccggugacugaggggccgg

SEQ ID NO: 104211 - RNA, 24 nt, Human
ccccacaggagagccggcaggaca

SEQ ID NO: 104212 - RNA, 32 nt, Human
ccccacaggagccuucucugaagcaucuuugc

SEQ ID NO: 104213 - RNA, 32 nt, Human
ccccacaggagcuggcuggaggcuaugggugc

SEQ ID NO: 104214 - RNA, 19 nt, Human
ccccacaggccccgccucu

SEQ ID NO: 104215 - RNA, 21 nt, Human
ccccacaggcuggggacgggc

SEQ ID NO: 104216 - RNA, 32 nt, Human
ccccacagggagacuggccuccccagcacaug

SEQ ID NO: 104217 - RNA, 32 nt, Human
ccccacagguccuccaucaccccugguggcug

SEQ ID NO: 104218 - RNA, 16 nt, Human
ccccacaggugacaug

SEQ ID NO: 104219 - RNA, 32 nt, Human
ccccacaggugcugagaggggagggagacucu

SEQ ID NO: 104220 - RNA, 32 nt, Human
ccccacaggugcugagaggggagggagaguuu

SEQ ID NO: 104221 - RNA, 32 nt, Human
ccccacagucacauggccacacggucccggga

SEQ ID NO: 104222 - RNA, 32 nt, Human
ccccacagugaggaaaugugugaggcaccgca

SEQ ID NO: 104223 - RNA, 32 nt, Human
ccccacagugauuuuuguaacuucucuuucua

SEQ ID NO: 104224 - RNA, 32 nt, Human
ccccacaguuggcagaggugguugagggagca

SEQ ID NO: 104225 - RNA, 20 nt, Human
ccccacauacaccccucaca

SEQ ID NO: 104226 - RNA, 21 nt, Human
ccccacaucaaccauagccca

SEQ ID NO: 104227 - RNA, 32 nt, Human
ccccacaucacguaggccaggagccucagcgc

SEQ ID NO: 104228 - RNA, 21 nt, Human
ccccacaucagccauagccca

SEQ ID NO: 104229 - RNA, 20 nt, Human
ccccacaucccaccccauca

SEQ ID NO: 104230 - RNA, 23 nt, Human
ccccacaucccccucccugccca

SEQ ID NO: 104231 - RNA, 24 nt, Human
ccccacaucucccacccucagcca

SEQ ID NO: 104232 - RNA, 32 nt, Human
ccccacaucuuuucccuucuuguauauuaagg

SEQ ID NO: 104233 - RNA, 32 nt, Human
ccccacaugaggagaacaugcagacaguuaua

SEQ ID NO: 104234 - RNA, 22 nt, Human
ccccacaugccccacuaaacca

SEQ ID NO: 104235 - RNA, 32 nt, Human
ccccacaugcugggcccgccucagcuccuggc

SEQ ID NO: 104236 - RNA, 32 nt, Human
ccccacauggguccucauaaaggauuauucaa

SEQ ID NO: 104237 - RNA, 32 nt, Human
ccccacauggugcugaggcucccugcugcaau

SEQ ID NO: 104238 - RNA, 32 nt, Human
ccccacauucacugcugacuggcuucacugga

SEQ ID NO: 104239 - RNA, 32 nt, Human
ccccacauugcucuucccuucccuucaucccu

SEQ ID NO: 104240 - RNA, 32 nt, Human
ccccaccaaaaacacagugaaaggccugcuuu

SEQ ID NO: 104241 - RNA, 32 nt, Human
ccccaccaaggccaccaagcaggcuggcaagg

SEQ ID NO: 104242 - RNA, 32 nt, Human
ccccaccacaaacacagcacuucggcuccucu

SEQ ID NO: 104243 - RNA, 32 nt, Human
ccccaccacacaucccagcccaauccagguac

SEQ ID NO: 104244 - RNA, 32 nt, Human
ccccaccacaccgugacuccagcacuggagga

SEQ ID NO: 104245 - RNA, 32 nt, Human
ccccaccacacuuuccgcuuucacuuccucgc

SEQ ID NO: 104246 - RNA, 21 nt, Human
ccccaccacagcagaacagca

SEQ ID NO: 104247 - RNA, 32 nt, Human
ccccaccacauccugccauugcucacccuuuc

SEQ ID NO: 104248 - RNA, 32 nt, Human
ccccaccaccaccaccaccaccaacaccacca

SEQ ID NO: 104249 - RNA, 32 nt, Human
ccccaccaccaccaccaccaccaucagcacca

SEQ ID NO: 104250 - RNA, 32 nt, Human
ccccaccaccaccacccccaucacugcuuucu

SEQ ID NO: 104251 - RNA, 18 nt, Human
ccccaccacccacugcuu

SEQ ID NO: 104252 - RNA, 19 nt, Human
ccccaccaccccacuucag

SEQ ID NO: 104253 - RNA, 16 nt, Human
ccccaccaccuccuca

SEQ ID NO: 104254 - RNA, 32 nt, Human
ccccaccaccugugccccagagagcagggccu

SEQ ID NO: 104255 - RNA, 24 nt, Human
ccccaccacggcagagaauaggcu

SEQ ID NO: 104256 - RNA, 32 nt, Human
ccccaccacugcacuccagccuggaugacaga

SEQ ID NO: 104257 - RNA, 32 nt, Human
ccccaccagaaugggagccaggagucccagcc

SEQ ID NO: 104258 - RNA, 32 nt, Human
ccccaccagaaugucacaaucauucauugcuc

SEQ ID NO: 104259 - RNA, 23 nt, Human
ccccaccagcaaggggcuggggc

SEQ ID NO: 104260 - RNA, 32 nt, Human
ccccaccagccuggcccugggaacagcaggcu

SEQ ID NO: 104261 - RNA, 24 nt, Human
ccccaccagcgcucuucucgggcu

SEQ ID NO: 104262 - RNA, 32 nt, Human
ccccaccaggagggugagggggagugaagaag

SEQ ID NO: 104263 - RNA, 32 nt, Human
ccccaccaguccacagaggcccccaggagcac

SEQ ID NO: 104264 - RNA, 32 nt, Human
ccccaccagugaaugaaagucuugugacuagu

SEQ ID NO: 104265 - RNA, 24 nt, Human
ccccaccagugauggauaacagcu

SEQ ID NO: 104266 - RNA, 32 nt, Human
ccccaccagugcuguuuggccuaggaacugug

SEQ ID NO: 104267 - RNA, 32 nt, Human
ccccaccaucucugucuucaugagguucccug

SEQ ID NO: 104268 - RNA, 32 nt, Human
ccccaccaucuucuccaccaaccccaaccucc

SEQ ID NO: 104269 - RNA, 23 nt, Human
ccccaccauucacggauugggcu

SEQ ID NO: 104270 - RNA, 32 nt, Human
ccccaccauugcacuccaguccgggaaacaag

SEQ ID NO: 104271 - RNA, 32 nt, Human
ccccacccaaccacccaguccaggcuucccac

SEQ ID NO: 104272 - RNA, 22 nt, Human
ccccacccacacugcagguaga

SEQ ID NO: 104273 - RNA, 19 nt, Human
ccccacccacccccugccu

SEQ ID NO: 104274 - RNA, 32 nt, Human
ccccacccaccuuuccucccaccccacucccu

SEQ ID NO: 104275 - RNA, 32 nt, Human
ccccacccagaaccuuccgguuugcccuguau

SEQ ID NO: 104276 - RNA, 32 nt, Human
ccccacccagcucuccccugcgccccugucuu

SEQ ID NO: 104277 - RNA, 32 nt, Human
ccccacccagcuguucuaacccugcuauccac

SEQ ID NO: 104278 - RNA, 21 nt, Human
ccccacccaggggauggaggu

SEQ ID NO: 104279 - RNA, 32 nt, Human
ccccacccaucugaacacucauuacacuaaac

SEQ ID NO: 104280 - RNA, 32 nt, Human
ccccacccauuccccugccccuaggagcugga

SEQ ID NO: 104281 - RNA, 32 nt, Human
ccccacccauuucaccaccaccaugacaccgg

SEQ ID NO: 104282 - RNA, 20 nt, Human
ccccaccccaacacccugga

SEQ ID NO: 104283 - RNA, 21 nt, Human
ccccaccccaauuuccuagaa

SEQ ID NO: 104284 - RNA, 23 nt, Human
ccccaccccaccccauccagugu

SEQ ID NO: 104285 - RNA, 19 nt, Human
ccccaccccacccccgccc

SEQ ID NO: 104286 - RNA, 19 nt, Human
ccccaccccacccucugaa

SEQ ID NO: 104287 - RNA, 18 nt, Human
ccccaccccacccuuguc

SEQ ID NO: 104288 - RNA, 32 nt, Human
ccccaccccacgacaggcccaggugugugaug

SEQ ID NO: 104289 - RNA, 32 nt, Human
ccccaccccacggacguguugcagugauauca

SEQ ID NO: 104290 - RNA, 32 nt, Human
ccccaccccacuaucccacccuggugaccaau

SEQ ID NO: 104291 - RNA, 20 nt, Human
ccccaccccacuccacccca

SEQ ID NO: 104292 - RNA, 32 nt, Human
ccccaccccacugucgugguggccccagaucu

SEQ ID NO: 104293 - RNA, 32 nt, Human
ccccaccccacuuuuccuccugcuccagcaau

SEQ ID NO: 104294 - RNA, 20 nt, Human
ccccaccccagcuccgcucc

SEQ ID NO: 104295 - RNA, 32 nt, Human
ccccaccccagcugcccuugcuauugucugug

SEQ ID NO: 104296 - RNA, 18 nt, Human
ccccaccccaggccugcc

SEQ ID NO: 104297 - RNA, 32 nt, Human
ccccaccccaucauccaggccuugggccuucg

SEQ ID NO: 104298 - RNA, 32 nt, Human
ccccaccccauggcugacaaauauucccaguc

SEQ ID NO: 104299 - RNA, 21 nt, Human
ccccaccccauuccccugcau

SEQ ID NO: 104300 - RNA, 32 nt, Human
ccccacccccacaccaucuugcaccuguucca

SEQ ID NO: 104301 - RNA, 23 nt, Human
ccccacccccacacuuccacucc

SEQ ID NO: 104302 - RNA, 18 nt, Human
ccccacccccacccucca

SEQ ID NO: 104303 - RNA, 32 nt, Human
ccccacccccacucucaccccaaacagcccau

SEQ ID NO: 104304 - RNA, 19 nt, Human
ccccacccccagcacacca

SEQ ID NO: 104305 - RNA, 19 nt, Human
ccccacccccagccccaca

SEQ ID NO: 104306 - RNA, 21 nt, Human
ccccacccccauuccuucauu

SEQ ID NO: 104307 - RNA, 22 nt, Human
ccccaccccccacucucucuca

SEQ ID NO: 104308 - RNA, 17 nt, Human
ccccaccccccaucaca

SEQ ID NO: 104309 - RNA, 16 nt, Human
ccccacccccuccuca

SEQ ID NO: 104310 - RNA, 32 nt, Human
ccccacccccucggggcucacagucugguaga

SEQ ID NO: 104311 - RNA, 32 nt, Human
ccccacccccucucuuuuccauugaacaaaca

SEQ ID NO: 104312 - RNA, 32 nt, Human
ccccacccccuucagugcccaccaacauccca

SEQ ID NO: 104313 - RNA, 32 nt, Human
ccccacccccuuccucggucuccccuuucaau

SEQ ID NO: 104314 - RNA, 21 nt, Human
ccccaccccgggaucugguga

SEQ ID NO: 104315 - RNA, 22 nt, Human
ccccaccccgucccuggccauu

SEQ ID NO: 104316 - RNA, 32 nt, Human
ccccaccccuacagccugcacacaccugccug

SEQ ID NO: 104317 - RNA, 22 nt, Human
ccccaccccuccacuccacucc

SEQ ID NO: 104318 - RNA, 32 nt, Human
ccccaccccuccacuggccagccugggggugc

SEQ ID NO: 104319 - RNA, 32 nt, Human
ccccaccccuccagccgcaguuuuuggcuaca

SEQ ID NO: 104320 - RNA, 32 nt, Human
ccccaccccucgcaccccuuguguuuucccuc

SEQ ID NO: 104321 - RNA, 32 nt, Human
ccccaccccugccccagccucaggacugcagg

SEQ ID NO: 104322 - RNA, 32 nt, Human
ccccaccccugccucgcccccuacaggccucu

SEQ ID NO: 104323 - RNA, 32 nt, Human
ccccaccccugccuguguucugugcccugugu

SEQ ID NO: 104324 - RNA, 32 nt, Human
ccccaccccuggcucugaaucucccauguccu

SEQ ID NO: 104325 - RNA, 21 nt, Human
ccccaccccuguacccagcca

SEQ ID NO: 104326 - RNA, 32 nt, Human
ccccaccccuucccuaaaucuggaccuuggca

SEQ ID NO: 104327 - RNA, 32 nt, Human
ccccaccccuucucccccuucagccacuuccc

SEQ ID NO: 104328 - RNA, 21 nt, Human
ccccacccgcguacucccucc

SEQ ID NO: 104329 - RNA, 21 nt, Human
ccccacccgcuccagcgcccu

SEQ ID NO: 104330 - RNA, 32 nt, Human
ccccacccuaccucaccucuucucaggcaccc

SEQ ID NO: 104331 - RNA, 32 nt, Human
ccccacccuauucccagcauugcccgaaggac

SEQ ID NO: 104332 - RNA, 32 nt, Human
ccccacccucaucucuuccuuuauggguauuu

SEQ ID NO: 104333 - RNA, 32 nt, Human
ccccacccuccagaaugucuugguggcguccc

SEQ ID NO: 104334 - RNA, 32 nt, Human
ccccacccuccaggaaggguccuucacggccu

SEQ ID NO: 104335 - RNA, 32 nt, Human
ccccacccuccccacagagcucuuccucauuc

SEQ ID NO: 104336 - RNA, 32 nt, Human
ccccacccuccccagguucuccucuugcaugu

SEQ ID NO: 104337 - RNA, 32 nt, Human
ccccacccuccccaugccucucucuucucugc

SEQ ID NO: 104338 - RNA, 18 nt, Human
ccccacccuccccucaca

SEQ ID NO: 104339 - RNA, 32 nt, Human
ccccacccuccccuccccuccccuuccucccu

SEQ ID NO: 104340 - RNA, 32 nt, Human
ccccacccuccccuuaaacccucugccuuuga

SEQ ID NO: 104341 - RNA, 32 nt, Human
ccccacccuccccuucccagggcaauaaaaug

SEQ ID NO: 104342 - RNA, 32 nt, Human
ccccacccuccucauuaaaaacaaauacuucu

SEQ ID NO: 104343 - RNA, 32 nt, Human
ccccacccuccugccaagcugccucugggaag

SEQ ID NO: 104344 - RNA, 32 nt, Human
ccccacccucuacagccuuccucaggccccug

SEQ ID NO: 104345 - RNA, 32 nt, Human
ccccacccucuccaaaaccaaccccacccgcu

SEQ ID NO: 104346 - RNA, 32 nt, Human
ccccacccucugagagcuccucaggcuuagau

SEQ ID NO: 104347 - RNA, 32 nt, Human
ccccacccugcaacuccugguugagaugggcu

SEQ ID NO: 104348 - RNA, 20 nt, Human
ccccacccugcacuggucca

SEQ ID NO: 104349 - RNA, 32 nt, Human
ccccacccugccccacugcugucucaguacca

SEQ ID NO: 104350 - RNA, 32 nt, Human
ccccacccugccggcccugccuucuccaguau

SEQ ID NO: 104351 - RNA, 19 nt, Human
ccccacccugccucaccca

SEQ ID NO: 104352 - RNA, 32 nt, Human
ccccacccugcucccuucccagagggauugcu

SEQ ID NO: 104353 - RNA, 19 nt, Human
ccccacccuggccccgccc

SEQ ID NO: 104354 - RNA, 19 nt, Human
ccccacccuggcccugccc

SEQ ID NO: 104355 - RNA, 32 nt, Human
ccccacccugggaaagacgccuuuccccacuc

SEQ ID NO: 104356 - RNA, 32 nt, Human
ccccacccugggccacugccugcuccagagag

SEQ ID NO: 104357 - RNA, 32 nt, Human
ccccacccuggguggccaaggguccuccccca

SEQ ID NO: 104358 - RNA, 22 nt, Human
ccccacccuggugccugucaca

SEQ ID NO: 104359 - RNA, 32 nt, Human
ccccacccugucccaggcagcgccacuguccg

SEQ ID NO: 104360 - RNA, 32 nt, Human
ccccacccugucucuuucaucaaaccugaugg

SEQ ID NO: 104361 - RNA, 32 nt, Human
ccccacccugugccccuuuucaugguaccagg

SEQ ID NO: 104362 - RNA, 32 nt, Human
ccccacccuguugcugaccaaggugauuuuug

SEQ ID NO: 104363 - RNA, 32 nt, Human
ccccacccuuacucccuuaacuuccauguacu

SEQ ID NO: 104364 - RNA, 32 nt, Human
ccccacccuuccccuccuucucccuuuuuaua

SEQ ID NO: 104365 - RNA, 32 nt, Human
ccccacccuugccaccacacucgcccacuugc

SEQ ID NO: 104366 - RNA, 23 nt, Human
ccccacccuugucccuggccauu

SEQ ID NO: 104367 - RNA, 32 nt, Human
ccccacccuuucuccuccuccuuccucugagu

SEQ ID NO: 104368 - RNA, 23 nt, Human
ccccaccgaccaaaauggcggcu

SEQ ID NO: 104369 - RNA, 32 nt, Human
ccccaccgccagggggcaagcgcaggccgggc

SEQ ID NO: 104370 - RNA, 32 nt, Human
ccccaccgcccccaccaccacccccagcuccu

SEQ ID NO: 104371 - RNA, 32 nt, Human
ccccaccgccuccccuuucucucuggaaaguu

SEQ ID NO: 104372 - RNA, 18 nt, Human
ccccaccgcggcgcuccu

SEQ ID NO: 104373 - RNA, 32 nt, Human
ccccaccggcggcggagggagcuguggcgaug

SEQ ID NO: 104374 - RNA, 32 nt, Human
ccccaccgggccggcccugcccgccgccggac

SEQ ID NO: 104375 - RNA, 32 nt, Human
ccccaccgucgcgcuccuccaggcugggccug

SEQ ID NO: 104376 - RNA, 20 nt, Human
ccccaccuaaagauccuccc

SEQ ID NO: 104377 - RNA, 32 nt, Human
ccccaccuaggccacgugugagcugcuccugu

SEQ ID NO: 104378 - RNA, 32 nt, Human
ccccaccucacagcuacucaguggggcuggca

SEQ ID NO: 104379 - RNA, 32 nt, Human
ccccaccucagcccucuccugcauccuccugu

SEQ ID NO: 104380 - RNA, 32 nt, Human
ccccaccucaucuuccccuccuggcuggaggc

SEQ ID NO: 104381 - RNA, 32 nt, Human
ccccaccuccacccucaacccaucuuccuagu

SEQ ID NO: 104382 - RNA, 32 nt, Human
ccccaccuccacucugccauuccggcccaccu

SEQ ID NO: 104383 - RNA, 32 nt, Human
ccccaccuccaggucugucaaguggccuuugu

SEQ ID NO: 104384 - RNA, 32 nt, Human
ccccaccucccacccuacuccccacuauauuc

SEQ ID NO: 104385 - RNA, 18 nt, Human
ccccaccucccacugccu

SEQ ID NO: 104386 - RNA, 25 nt, Human
ccccaccuccgacagcaaacagcaa

SEQ ID NO: 104387 - RNA, 25 nt, Human
ccccaccuccucaggcugccugauc

SEQ ID NO: 104388 - RNA, 23 nt, Human
ccccaccuccuccaccccugccu

SEQ ID NO: 104389 - RNA, 32 nt, Human
ccccaccuccugucuuuucuccuugccuuccc

SEQ ID NO: 104390 - RNA, 32 nt, Human
ccccaccuccuuggguagugagcagugagcag

SEQ ID NO: 104391 - RNA, 20 nt, Human
ccccaccuccuugggucaug

SEQ ID NO: 104392 - RNA, 25 nt, Human
ccccaccucuaccagcaucugcuga

SEQ ID NO: 104393 - RNA, 32 nt, Human
ccccaccucucugugcagcugugugaccucag

SEQ ID NO: 104394 - RNA, 32 nt, Human
ccccaccucugcuguccuuuccagucacuucu

SEQ ID NO: 104395 - RNA, 28 nt, Human
ccccaccucugugcugccccauccaccu

SEQ ID NO: 104396 - RNA, 21 nt, Human
ccccaccucuguuccuccuca

SEQ ID NO: 104397 - RNA, 23 nt, Human
ccccaccucuucucagccuugca

SEQ ID NO: 104398 - RNA, 32 nt, Human
ccccaccugaaggguggaugugcuggaggggu

SEQ ID NO: 104399 - RNA, 32 nt, Human
ccccaccugagucuccacagagccccacgccu

SEQ ID NO: 104400 - RNA, 19 nt, Human
ccccaccugcaagcugggg

SEQ ID NO: 104401 - RNA, 32 nt, Human
ccccaccugcaggcauggauuaaugcugggcu

SEQ ID NO: 104402 - RNA, 32 nt, Human
ccccaccugccugggcggcuugccaccugaag

SEQ ID NO: 104403 - RNA, 32 nt, Human
ccccaccugccuggugcauugcugugugaauc

SEQ ID NO: 104404 - RNA, 32 nt, Human
ccccaccugcucggcccugccuucucggaucg

SEQ ID NO: 104405 - RNA, 31 nt, Human
ccccaccugcugccagggccuguuucucccu

SEQ ID NO: 104406 - RNA, 22 nt, Human
ccccaccugcuggugacggggc

SEQ ID NO: 104407 - RNA, 32 nt, Human
ccccaccugcugugguggcauuuguccagaug

SEQ ID NO: 104408 - RNA, 32 nt, Human
ccccaccuggcagcaccuagaccugagcucua

SEQ ID NO: 104409 - RNA, 21 nt, Human
ccccaccugggaauucgcugg

SEQ ID NO: 104410 - RNA, 32 nt, Human
ccccaccugggaggagacccugguuuucaugg

SEQ ID NO: 104411 - RNA, 32 nt, Human
ccccaccugggugggacacagcaggugcugga

SEQ ID NO: 104412 - RNA, 32 nt, Human
ccccaccuguugcuuaccuuuugagguaauuu

SEQ ID NO: 104413 - RNA, 32 nt, Human
ccccaccuucaagucucuccagugugugggga

SEQ ID NO: 104414 - RNA, 18 nt, Human
ccccaccuucccugccca

SEQ ID NO: 104415 - RNA, 32 nt, Human
ccccaccuuccucugugcccccauagcacugu

SEQ ID NO: 104416 - RNA, 32 nt, Human
ccccaccuugaggcggauggcugugacccuac

SEQ ID NO: 104417 - RNA, 22 nt, Human
ccccaccuugaucccaauccuu

SEQ ID NO: 104418 - RNA, 32 nt, Human
ccccaccuuugcaaaguuccagagggcugacc

SEQ ID NO: 104419 - RNA, 32 nt, Human
ccccaccuuuguguccuagagcucagcgucug

SEQ ID NO: 104420 - RNA, 32 nt, Human
ccccacgagauggaacagaccgaagugcugaa

SEQ ID NO: 104421 - RNA, 32 nt, Human
ccccacgagauggggaaauaccugggugcaga

SEQ ID NO: 104422 - RNA, 21 nt, Human
ccccacgagugugcguaggga

SEQ ID NO: 104423 - RNA, 32 nt, Human
ccccacgcaguggcucacaccuguaaucccag

SEQ ID NO: 104424 - RNA, 32 nt, Human
ccccacgccacacacaaccucuccacaugccu

SEQ ID NO: 104425 - RNA, 32 nt, Human
ccccacgccaccccgugccuccugccuccgcg

SEQ ID NO: 104426 - RNA, 32 nt, Human
ccccacgccaccgccucugccuccaggccgcc

SEQ ID NO: 104427 - RNA, 20 nt, Human
ccccacgcccacagcccccu

SEQ ID NO: 104428 - RNA, 32 nt, Human
ccccacgcccagcuaaguuuuguauuuuuagu

SEQ ID NO: 104429 - RNA, 21 nt, Human
ccccacgcccugucccuccuc

SEQ ID NO: 104430 - RNA, 32 nt, Human
ccccacgccuccugccaaggccgagccacaca

SEQ ID NO: 104431 - RNA, 21 nt, Human
ccccacgcgcagcccaggacc

SEQ ID NO: 104432 - RNA, 32 nt, Human
ccccacgcggagccagcgcugcagugaaagag

SEQ ID NO: 104433 - RNA, 32 nt, Human
ccccacgcuggcugcugugcagaugcuggacg

SEQ ID NO: 104434 - RNA, 26 nt, Human
ccccacggaagggcgugagcccugca

SEQ ID NO: 104435 - RNA, 32 nt, Human
ccccacggcacagcagaucaugcggcugcuuc

SEQ ID NO: 104436 - RNA, 32 nt, Human
ccccacggccagcgugggcacaggacugaccc

SEQ ID NO: 104437 - RNA, 18 nt, Human
ccccacggccccaccuuu

SEQ ID NO: 104438 - RNA, 21 nt, Human
ccccacggccccgcucugccc

SEQ ID NO: 104439 - RNA, 32 nt, Human
ccccacgggcuccugccugccugccagguuuu

SEQ ID NO: 104440 - RNA, 21 nt, Human
ccccacggggccucgggaccu

SEQ ID NO: 104441 - RNA, 32 nt, Human
ccccacgucgaccugucacaggccuggcugua

SEQ ID NO: 104442 - RNA, 32 nt, Human
ccccacgugggacacagggcuuggggaggaug

SEQ ID NO: 104443 - RNA, 32 nt, Human
ccccacguggggagguggaguuccggaauuau

SEQ ID NO: 104444 - RNA, 32 nt, Human
ccccacguuuaccaagcacacgcccugcagag

SEQ ID NO: 104445 - RNA, 32 nt, Human
ccccacuaaacccagcggagcggagccuggcg

SEQ ID NO: 104446 - RNA, 32 nt, Human
ccccacuacaagugauccucaggcagguaacc

SEQ ID NO: 104447 - RNA, 32 nt, Human
ccccacuacacuccagccuggucaacagagug

SEQ ID NO: 104448 - RNA, 32 nt, Human
ccccacuagagccuuccagccuucuggugugu

SEQ ID NO: 104449 - RNA, 32 nt, Human
ccccacucacugcagagcugcugccugccaau

SEQ ID NO: 104450 - RNA, 21 nt, Human
ccccacucacugccccaggga

SEQ ID NO: 104451 - RNA, 20 nt, Human
ccccacuccaagcccugucc

SEQ ID NO: 104452 - RNA, 32 nt, Human
ccccacuccaaguuuccuacccuucccaccca

SEQ ID NO: 104453 - RNA, 20 nt, Human
ccccacuccaccccacccca

SEQ ID NO: 104454 - RNA, 32 nt, Human
ccccacuccagccucagcggggccccagcgau

SEQ ID NO: 104455 - RNA, 32 nt, Human
ccccacuccagccuggggaccccacuucagaa

SEQ ID NO: 104456 - RNA, 32 nt, Human
ccccacuccagugcugcccacacucccagcug

SEQ ID NO: 104457 - RNA, 32 nt, Human
ccccacuccaugaaacugggccugcuguccug

SEQ ID NO: 104458 - RNA, 21 nt, Human
ccccacucccacaucucucac

SEQ ID NO: 104459 - RNA, 32 nt, Human
ccccacucccacgcugcccuccugccugcagc

SEQ ID NO: 104460 - RNA, 32 nt, Human
ccccacucccagcaagcagaagugauccucga

SEQ ID NO: 104461 - RNA, 32 nt, Human
ccccacuccccaaauacagaggucugcuuuga

SEQ ID NO: 104462 - RNA, 32 nt, Human
ccccacuccccacucucagccugggagacucc

SEQ ID NO: 104463 - RNA, 32 nt, Human
ccccacuccccuggcccuagagccugggcccc

SEQ ID NO: 104464 - RNA, 32 nt, Human
ccccacucccuaauccccuaccccugucuccc

SEQ ID NO: 104465 - RNA, 23 nt, Human
ccccacucccugccaccgucaca

SEQ ID NO: 104466 - RNA, 23 nt, Human
ccccacucccugccacugucaca

SEQ ID NO: 104467 - RNA, 32 nt, Human
ccccacuccgcugcccuggccuugagcaucca

SEQ ID NO: 104468 - RNA, 32 nt, Human
ccccacuccugccccgcccccuggcuggcuca

SEQ ID NO: 104469 - RNA, 18 nt, Human
ccccacucgccucucaca

SEQ ID NO: 104470 - RNA, 32 nt, Human
ccccacucucaggcuaggauggagaggcagau

SEQ ID NO: 104471 - RNA, 32 nt, Human
ccccacucucauuccccagguggcugacccag

SEQ ID NO: 104472 - RNA, 32 nt, Human
ccccacucuccacuuucugagccucagacaac

SEQ ID NO: 104473 - RNA, 23 nt, Human
ccccacucucccaagccaccccu

SEQ ID NO: 104474 - RNA, 32 nt, Human
ccccacucuccucugcccaguucucuguccuu

SEQ ID NO: 104475 - RNA, 32 nt, Human
ccccacucucgccaaccuaucggggcauagcc

SEQ ID NO: 104476 - RNA, 24 nt, Human
ccccacucucucacccaccagcuc

SEQ ID NO: 104477 - RNA, 32 nt, Human
ccccacucugcaagcacucccccaccaacggg

SEQ ID NO: 104478 - RNA, 32 nt, Human
ccccacucugccgugcucacacagacacaccc

SEQ ID NO: 104479 - RNA, 32 nt, Human
ccccacucugccucccugucaccucaggcuug

SEQ ID NO: 104480 - RNA, 32 nt, Human
ccccacucugccucuugcuccuccagggcagc

SEQ ID NO: 104481 - RNA, 32 nt, Human
ccccacucuggcccagcccccucugcacacag

SEQ ID NO: 104482 - RNA, 32 nt, Human
ccccacucuuguagcauggacacugcuagcug

SEQ ID NO: 104483 - RNA, 32 nt, Human
ccccacugaacggcaacugagacuggguaccu

SEQ ID NO: 104484 - RNA, 23 nt, Human
ccccacugaaggagauggaggcu

SEQ ID NO: 104485 - RNA, 20 nt, Human
ccccacugauccuugggacc

SEQ ID NO: 104486 - RNA, 32 nt, Human
ccccacugcacuccacccugggcaauggagua

SEQ ID NO: 104487 - RNA, 32 nt, Human
ccccacugcacuccagccugggcgacagaaca

SEQ ID NO: 104488 - RNA, 32 nt, Human
ccccacugcacuccagccugggcgacagaacg

SEQ ID NO: 104489 - RNA, 32 nt, Human
ccccacugcacuccagccugggugacagagcg

SEQ ID NO: 104490 - RNA, 32 nt, Human
ccccacugcacuccagccugggugacagaggg

SEQ ID NO: 104491 - RNA, 32 nt, Human
ccccacugcacuccagccuggugacuccgucu

SEQ ID NO: 104492 - RNA, 16 nt, Human
ccccacugcagcagaa

SEQ ID NO: 104493 - RNA, 32 nt, Human
ccccacugcauuccagccugggugacagagcg

SEQ ID NO: 104494 - RNA, 32 nt, Human
ccccacugccaaggguggggucucaggaguca

SEQ ID NO: 104495 - RNA, 25 nt, Human
ccccacugccaaguggggauggggc

SEQ ID NO: 104496 - RNA, 32 nt, Human
ccccacugccagcugccccuccugggagggcc

SEQ ID NO: 104497 - RNA, 32 nt, Human
ccccacugccauacugccccucccagggaaau

SEQ ID NO: 104498 - RNA, 32 nt, Human
ccccacugccccugcccugcccgcccguguca

SEQ ID NO: 104499 - RNA, 32 nt, Human
ccccacugcccuccagggccaggauucaggcc

SEQ ID NO: 104500 - RNA, 31 nt, Human
ccccacugccucugugugccccuuugcgucc

SEQ ID NO: 104501 - RNA, 16 nt, Human
ccccacugccuggcca

SEQ ID NO: 104502 - RNA, 32 nt, Human
ccccacugcggggaggugagggguggguuugg

SEQ ID NO: 104503 - RNA, 32 nt, Human
ccccacugcucagcacuuaggccggcagaauc

SEQ ID NO: 104504 - RNA, 32 nt, Human
ccccacugcugagcuggcccuuggggagaggu

SEQ ID NO: 104505 - RNA, 32 nt, Human
ccccacugcugcugcuaucaacgccagaauaa

SEQ ID NO: 104506 - RNA, 32 nt, Human
ccccacugcuuccaaacucugccuguguccca

SEQ ID NO: 104507 - RNA, 32 nt, Human
ccccacuggagguggagggugggaagagaagg

SEQ ID NO: 104508 - RNA, 32 nt, Human
ccccacuggaguggaggaguggucuggcuggu

SEQ ID NO: 104509 - RNA, 22 nt, Human
ccccacuggcaucucuguaaaa

SEQ ID NO: 104510 - RNA, 32 nt, Human
ccccacuggccacugccauccugcugccuucc

SEQ ID NO: 104511 - RNA, 32 nt, Human
ccccacuggccauuugagacacacacaggugg

SEQ ID NO: 104512 - RNA, 32 nt, Human
ccccacuggcugcuccagggccuccaccccca

SEQ ID NO: 104513 - RNA, 32 nt, Human
ccccacuggcuggaggaaguggggucuggccu

SEQ ID NO: 104514 - RNA, 32 nt, Human
ccccacugggaccaacccuggggaaggagcca

SEQ ID NO: 104515 - RNA, 32 nt, Human
ccccacuggggagggggugagguggaaugggg

SEQ ID NO: 104516 - RNA, 32 nt, Human
ccccacuguacagcagaucgugcagcugucuc

SEQ ID NO: 104517 - RNA, 32 nt, Human
ccccacuguccccagaaagcagcugcugugau

SEQ ID NO: 104518 - RNA, 32 nt, Human
ccccacuguccuccagccugggcaacagagag

SEQ ID NO: 104519 - RNA, 32 nt, Human
ccccacugucucuaaccacuccugggcuaagg

SEQ ID NO: 104520 - RNA, 32 nt, Human
ccccacugugccagauccaagagaagcccgcu

SEQ ID NO: 104521 - RNA, 31 nt, Human
ccccacugugcuccugggccugugaccccag

SEQ ID NO: 104522 - RNA, 32 nt, Human
ccccacugugcuguagccugggugacagugug

SEQ ID NO: 104523 - RNA, 32 nt, Human
ccccacuguggcugguaacaccccagguuucu

SEQ ID NO: 104524 - RNA, 32 nt, Human
ccccacuuaacaguaauuacuuuaaacguaaa

SEQ ID NO: 104525 - RNA, 32 nt, Human
ccccacuuaauaaugaauuuugugcuuaagua

SEQ ID NO: 104526 - RNA, 32 nt, Human
ccccacuucacuuucuucaaagccacauuuuu

SEQ ID NO: 104527 - RNA, 32 nt, Human
ccccacuuccaggcacucucagucucuuucaa

SEQ ID NO: 104528 - RNA, 32 nt, Human
ccccacuuccuccucuaccccaacacaugcag

SEQ ID NO: 104529 - RNA, 32 nt, Human
ccccacuuccuguugagaaggaauggcggcau

SEQ ID NO: 104530 - RNA, 32 nt, Human
ccccacuuccuuucuacccugccugugcacag

SEQ ID NO: 104531 - RNA, 32 nt, Human
ccccacuucucucaguuccuggcaugaggaga

SEQ ID NO: 104532 - RNA, 32 nt, Human
ccccacuucucucuccccauccccacccaguc

SEQ ID NO: 104533 - RNA, 18 nt, Human
ccccacuucugggucaug

SEQ ID NO: 104534 - RNA, 32 nt, Human
ccccacuugcaaugugaguccuaagagccaga

SEQ ID NO: 104535 - RNA, 32 nt, Human
ccccacuugccaccaucccccaucacccugcg

SEQ ID NO: 104536 - RNA, 22 nt, Human
ccccacuugcccuugguucuuu

SEQ ID NO: 104537 - RNA, 32 nt, Human
ccccacuuuccacaucugugcacucaagcuug

SEQ ID NO: 104538 - RNA, 32 nt, Human
ccccacuuuccuacaaaauggagggagccauc

SEQ ID NO: 104539 - RNA, 32 nt, Human
ccccacuuuucaucuguaaaauggucauaaca

SEQ ID NO: 104540 - RNA, 23 nt, Human
ccccagaaaaccucuuuguuuua

SEQ ID NO: 104541 - RNA, 32 nt, Human
ccccagaaaagcugcagccugcaggcaccagc

SEQ ID NO: 104542 - RNA, 32 nt, Human
ccccagaaaaggccacugggucacuagauccc

SEQ ID NO: 104543 - RNA, 24 nt, Human
ccccagaaacuccaaccccugccc

SEQ ID NO: 104544 - RNA, 25 nt, Human
ccccagaaaggccccccaucagccc

SEQ ID NO: 104545 - RNA, 22 nt, Human
ccccagaaagggugcaguggcc

SEQ ID NO: 104546 - RNA, 21 nt, Human
ccccagaaaucaguguuggcc

SEQ ID NO: 104547 - RNA, 32 nt, Human
ccccagaacaagccgacacacagggagacggg

SEQ ID NO: 104548 - RNA, 32 nt, Human
ccccagaaccacugcaaggacugcucgucccu

SEQ ID NO: 104549 - RNA, 32 nt, Human
ccccagaacuggagaguaagaaugagcggugu

SEQ ID NO: 104550 - RNA, 19 nt, Human
ccccagaacuggcugggcc

SEQ ID NO: 104551 - RNA, 32 nt, Human
ccccagaagagcaagcuggagaggcugggcag

SEQ ID NO: 104552 - RNA, 32 nt, Human
ccccagaagcaagagaguucaagugaaggaag

SEQ ID NO: 104553 - RNA, 32 nt, Human
ccccagaagcagcagcagccucagggaugagg

SEQ ID NO: 104554 - RNA, 32 nt, Human
ccccagaauggcuccacugggaguggaggaag

SEQ ID NO: 104555 - RNA, 21 nt, Human
ccccagaauucuucuaugcag

SEQ ID NO: 104556 - RNA, 32 nt, Human
ccccagacaagccuuugguggggaacagaacc

SEQ ID NO: 104557 - RNA, 32 nt, Human
ccccagacaccuugcucccucucccaaaucac

SEQ ID NO: 104558 - RNA, 32 nt, Human
ccccagacacuccucuccuugccugcaggcug

SEQ ID NO: 104559 - RNA, 32 nt, Human
ccccagacagagcuggcaacaaaagcagacug

SEQ ID NO: 104560 - RNA, 24 nt, Human
ccccagacaggaccaguugcccuc

SEQ ID NO: 104561 - RNA, 23 nt, Human
ccccagacaguaagauaaucuca

SEQ ID NO: 104562 - RNA, 22 nt, Human
ccccagacauuaaacucagacu

SEQ ID NO: 104563 - RNA, 32 nt, Human
ccccagaccacuggucuggggcagaagcccac

SEQ ID NO: 104564 - RNA, 20 nt, Human
ccccagacccagaauucuca

SEQ ID NO: 104565 - RNA, 32 nt, Human
ccccagacccuccccuguccaaacaggagauc

SEQ ID NO: 104566 - RNA, 22 nt, Human
ccccagacccugacccaggacc

SEQ ID NO: 104567 - RNA, 32 nt, Human
ccccagaccuaaaaauaaucucugauucauau

SEQ ID NO: 104568 - RNA, 22 nt, Human
ccccagacucagcaccauccag

SEQ ID NO: 104569 - RNA, 32 nt, Human
ccccagacuccaggccgccugcagccugcccc

SEQ ID NO: 104570 - RNA, 22 nt, Human
ccccagacuccugacugucucc

SEQ ID NO: 104571 - RNA, 32 nt, Human
ccccagacugagcucuccaggccaggugggaa

SEQ ID NO: 104572 - RNA, 32 nt, Human
ccccagacugcccaaaaacuugcccaccagac

SEQ ID NO: 104573 - RNA, 22 nt, Human
ccccagacuucacccccagccc

SEQ ID NO: 104574 - RNA, 32 nt, Human
ccccagagaaaggcagagggagaggggaccca

SEQ ID NO: 104575 - RNA, 22 nt, Human
ccccagagagacaaaagauaca

SEQ ID NO: 104576 - RNA, 32 nt, Human
ccccagagagagcaggagccacuguggcccca

SEQ ID NO: 104577 - RNA, 32 nt, Human
ccccagagagggcugggcuugacucaucucag

SEQ ID NO: 104578 - RNA, 22 nt, Human
ccccagagcaggccguacccug

SEQ ID NO: 104579 - RNA, 17 nt, Human
ccccagagcaugauaua

SEQ ID NO: 104580 - RNA, 18 nt, Human
ccccagagcccacgagga

SEQ ID NO: 104581 - RNA, 21 nt, Human
ccccagagcccaggcucggcc

SEQ ID NO: 104582 - RNA, 23 nt, Human
ccccagagcccccggcccaggcc

SEQ ID NO: 104583 - RNA, 32 nt, Human
ccccagagcccgaggccaggggacagggcucc

SEQ ID NO: 104584 - RNA, 19 nt, Human
ccccagagcccugggcuau

SEQ ID NO: 104585 - RNA, 19 nt, Human
ccccagagcuggcagcugu

SEQ ID NO: 104586 - RNA, 32 nt, Human
ccccagaggcagagguugcagugagcugagau

SEQ ID NO: 104587 - RNA, 32 nt, Human
ccccagaggcagguccuggccugcugcuuaga

SEQ ID NO: 104588 - RNA, 21 nt, Human
ccccagaggccacaccagucc

SEQ ID NO: 104589 - RNA, 32 nt, Human
ccccagaggccugcuuaggggucuggcugugg

SEQ ID NO: 104590 - RNA, 32 nt, Human
ccccagaggcggagguugcagugagccgagau

SEQ ID NO: 104591 - RNA, 18 nt, Human
ccccagagggagaccuca

SEQ ID NO: 104592 - RNA, 32 nt, Human
ccccagaggggcuggacucagguuaguuuggg

SEQ ID NO: 104593 - RNA, 32 nt, Human
ccccagagggugagacaucagugcugagaaua

SEQ ID NO: 104594 - RNA, 32 nt, Human
ccccagagguggagguugcagugagccgagau

SEQ ID NO: 104595 - RNA, 20 nt, Human
ccccagagguggauacuggg

SEQ ID NO: 104596 - RNA, 32 nt, Human
ccccagaguagcuggaauuacaggcacacacc

SEQ ID NO: 104597 - RNA, 32 nt, Human
ccccagaguagcugggauuacaggcauguacc

SEQ ID NO: 104598 - RNA, 24 nt, Human
ccccagagucaaauugucaggacc

SEQ ID NO: 104599 - RNA, 32 nt, Human
ccccagagucauucugcucugccucuuugggg

SEQ ID NO: 104600 - RNA, 32 nt, Human
ccccagaguggaggaguuagacuugccucgug

SEQ ID NO: 104601 - RNA, 32 nt, Human
ccccagauaccaugucaggauauuuuuagugu

SEQ ID NO: 104602 - RNA, 19 nt, Human
ccccagauaccuccacuug

SEQ ID NO: 104603 - RNA, 32 nt, Human
ccccagauacuaggaggaaagggacuuugggg

SEQ ID NO: 104604 - RNA, 32 nt, Human
ccccagauaucugagcauaacugggagcaccu

SEQ ID NO: 104605 - RNA, 32 nt, Human
ccccagauccagccugggguugggguaggauu

SEQ ID NO: 104606 - RNA, 20 nt, Human
ccccagaucccagccguggc

SEQ ID NO: 104607 - RNA, 20 nt, Human
ccccagaucuccuagcucug

SEQ ID NO: 104608 - RNA, 32 nt, Human
ccccagaugaagauggggaucacagugacaaa

SEQ ID NO: 104609 - RNA, 32 nt, Human
ccccagcaaacagucccuccccugacucccac

SEQ ID NO: 104610 - RNA, 32 nt, Human
ccccagcaaacagugaccaagccagaccucag

SEQ ID NO: 104611 - RNA, 24 nt, Human
ccccagcaaagccgcccucagcca

SEQ ID NO: 104612 - RNA, 32 nt, Human
ccccagcaacacagggagcaggaccaccagug

SEQ ID NO: 104613 - RNA, 18 nt, Human
ccccagcaagcccugcuc

SEQ ID NO: 104614 - RNA, 32 nt, Human
ccccagcaaggaggcaggaggggcgagggccc

SEQ ID NO: 104615 - RNA, 15 nt, Human
ccccagcaaggauaa

SEQ ID NO: 104616 - RNA, 32 nt, Human
ccccagcaaggcagccagcccagcgaguccag

SEQ ID NO: 104617 - RNA, 32 nt, Human
ccccagcaaucuucagucucucaccagggcca

SEQ ID NO: 104618 - RNA, 32 nt, Human
ccccagcacaacugguucccaggccuucggga

SEQ ID NO: 104619 - RNA, 32 nt, Human
ccccagcacacacacauacaacacagaucauu

SEQ ID NO: 104620 - RNA, 22 nt, Human
ccccagcacacagcccgggacc

SEQ ID NO: 104621 - RNA, 32 nt, Human
ccccagcacacccugcuguauguggccacagc

SEQ ID NO: 104622 - RNA, 32 nt, Human
ccccagcacagcccggccucuggccucacugg

SEQ ID NO: 104623 - RNA, 19 nt, Human
ccccagcacagccuggcca

SEQ ID NO: 104624 - RNA, 32 nt, Human
ccccagcacagccuggccaagaucgagcgcaa

SEQ ID NO: 104625 - RNA, 18 nt, Human
ccccagcaccagagcaca

SEQ ID NO: 104626 - RNA, 32 nt, Human
ccccagcaccucagugugggacuggguuugga

SEQ ID NO: 104627 - RNA, 32 nt, Human
ccccagcacggcugcuuugaaagguuuaucau

SEQ ID NO: 104628 - RNA, 32 nt, Human
ccccagcacugagcauggccuaagccccauag

SEQ ID NO: 104629 - RNA, 32 nt, Human
ccccagcacugcaggcagcggcgcaggaagcg

SEQ ID NO: 104630 - RNA, 32 nt, Human
ccccagcagagaaaauccucuucauagauuaa

SEQ ID NO: 104631 - RNA, 32 nt, Human
ccccagcagagagguuugcagucccaagcggu

SEQ ID NO: 104632 - RNA, 32 nt, Human
ccccagcagagggaggggaagcagcccaggga

SEQ ID NO: 104633 - RNA, 22 nt, Human
ccccagcagccaucuccuuccu

SEQ ID NO: 104634 - RNA, 32 nt, Human
ccccagcagcccccuccuccuggcugggaaga

SEQ ID NO: 104635 - RNA, 32 nt, Human
ccccagcagccugaauacugugcccucuugcu

SEQ ID NO: 104636 - RNA, 32 nt, Human
ccccagcagccugugcccuggccuggucuaca

SEQ ID NO: 104637 - RNA, 32 nt, Human
ccccagcagcuuucccagagaggcagaggggc

SEQ ID NO: 104638 - RNA, 32 nt, Human
ccccagcaggccgccucccaacucccaguggc

SEQ ID NO: 104639 - RNA, 32 nt, Human
ccccagcaggccugaauugcaguuccugugcc

SEQ ID NO: 104640 - RNA, 18 nt, Human
ccccagcagggauggggc

SEQ ID NO: 104641 - RNA, 32 nt, Human
ccccagcagguaaacuaacauuauggauuuuu

SEQ ID NO: 104642 - RNA, 22 nt, Human
ccccagcaguacaguccuuccu

SEQ ID NO: 104643 - RNA, 32 nt, Human
ccccagcagugcuugcaggugccugggcuggc

SEQ ID NO: 104644 - RNA, 32 nt, Human
ccccagcaguguggcccagagcaggggccgac

SEQ ID NO: 104645 - RNA, 32 nt, Human
ccccagcauccagcugagguccaaggucuuug

SEQ ID NO: 104646 - RNA, 24 nt, Human
ccccagcauggcagucccauccag

SEQ ID NO: 104647 - RNA, 22 nt, Human
ccccagcauuccagcucugccc

SEQ ID NO: 104648 - RNA, 32 nt, Human
ccccagcauuccagugcucuccaggcuuccuc

SEQ ID NO: 104649 - RNA, 32 nt, Human
ccccagcauucgcucuccuccucucacggaaa

SEQ ID NO: 104650 - RNA, 32 nt, Human
ccccagcauuucucacuccugcccuucuucca

SEQ ID NO: 104651 - RNA, 32 nt, Human
ccccagccaagaaaaauugcacauaguguaua

SEQ ID NO: 104652 - RNA, 32 nt, Human
ccccagccaccaccugccccgccucguccacg

SEQ ID NO: 104653 - RNA, 32 nt, Human
ccccagccaccugggaaaaggaagcacaaaaa

SEQ ID NO: 104654 - RNA, 32 nt, Human
ccccagccacgaguaugccacagggggcuuuc

SEQ ID NO: 104655 - RNA, 32 nt, Human
ccccagccacucccuccagcagccugguucac

SEQ ID NO: 104656 - RNA, 32 nt, Human
ccccagccacuuugccccagccgcuuugaccc

SEQ ID NO: 104657 - RNA, 32 nt, Human
ccccagccagaagacagggcacccgcggccuu

SEQ ID NO: 104658 - RNA, 18 nt, Human
ccccagccagauacggaa

SEQ ID NO: 104659 - RNA, 32 nt, Human
ccccagccagauguggccucagucacaggccu

SEQ ID NO: 104660 - RNA, 19 nt, Human
ccccagccagcagauccca

SEQ ID NO: 104661 - RNA, 32 nt, Human
ccccagccagcggaacaguuucuauuaccccc

SEQ ID NO: 104662 - RNA, 23 nt, Human
ccccagccagcuccucggcuggg

SEQ ID NO: 104663 - RNA, 23 nt, Human
ccccagccagcuggcccaggacc

SEQ ID NO: 104664 - RNA, 32 nt, Human
ccccagccaggauaugccuccccuggaggagc

SEQ ID NO: 104665 - RNA, 32 nt, Human
ccccagccaguauucccucagagccggcacga

SEQ ID NO: 104666 - RNA, 32 nt, Human
ccccagccaucacugcuggcagccugggcaaa

SEQ ID NO: 104667 - RNA, 32 nt, Human
ccccagccauccuugugccuucaccucugaug

SEQ ID NO: 104668 - RNA, 32 nt, Human
ccccagcccaagacgugggaggcugcuuccca

SEQ ID NO: 104669 - RNA, 19 nt, Human
ccccagcccaagagaugaa

SEQ ID NO: 104670 - RNA, 32 nt, Human
ccccagcccacagagccugaauuuguaagcaa

SEQ ID NO: 104671 - RNA, 32 nt, Human
ccccagcccacaugccacucaggaugaggguc

SEQ ID NO: 104672 - RNA, 24 nt, Human
ccccagcccagagagacgcugcuu

SEQ ID NO: 104673 - RNA, 32 nt, Human
ccccagcccagauccuggagggcuuugggcuu

SEQ ID NO: 104674 - RNA, 19 nt, Human
ccccagcccagccccgccc

SEQ ID NO: 104675 - RNA, 32 nt, Human
ccccagcccagccugccuguccuccagcuguc

SEQ ID NO: 104676 - RNA, 32 nt, Human
ccccagcccagccuggggugcacugacggaga

SEQ ID NO: 104677 - RNA, 21 nt, Human
ccccagcccagccuugccucg

SEQ ID NO: 104678 - RNA, 32 nt, Human
ccccagcccagcugccuccagaccccuaagca

SEQ ID NO: 104679 - RNA, 32 nt, Human
ccccagcccaggaggagacuugacucgccuga

SEQ ID NO: 104680 - RNA, 32 nt, Human
ccccagcccaggagguggcuggauugcagggc

SEQ ID NO: 104681 - RNA, 32 nt, Human
ccccagcccaggaguagucuuaccucugagga

SEQ ID NO: 104682 - RNA, 32 nt, Human
ccccagcccagguccuccucucacccgggcca

SEQ ID NO: 104683 - RNA, 22 nt, Human
ccccagcccaucccaucuggug

SEQ ID NO: 104684 - RNA, 32 nt, Human
ccccagccccaccccacauggagcucaggggg

SEQ ID NO: 104685 - RNA, 32 nt, Human
ccccagccccacccucugcccuucagccuacu

SEQ ID NO: 104686 - RNA, 32 nt, Human
ccccagccccacccugucugcuccuucccagu

SEQ ID NO: 104687 - RNA, 25 nt, Human
ccccagcccccaggaccccaggacc

SEQ ID NO: 104688 - RNA, 32 nt, Human
ccccagcccccucacccuccucccucucccuc

SEQ ID NO: 104689 - RNA, 23 nt, Human
ccccagcccccucccguugcccu

SEQ ID NO: 104690 - RNA, 32 nt, Human
ccccagcccccucuccucccagccucugccug

SEQ ID NO: 104691 - RNA, 32 nt, Human
ccccagccccgaggaggaggaggaggaggagg

SEQ ID NO: 104692 - RNA, 32 nt, Human
ccccagccccgcccuucuccccacaucccacc

SEQ ID NO: 104693 - RNA, 32 nt, Human
ccccagccccggcccccucucucccucccuuc

SEQ ID NO: 104694 - RNA, 32 nt, Human
ccccagcccgcccagcccggaggucccgcgug

SEQ ID NO: 104695 - RNA, 32 nt, Human
ccccagcccgccugccccagcccggccucagg

SEQ ID NO: 104696 - RNA, 19 nt, Human
ccccagcccgcugggccgc

SEQ ID NO: 104697 - RNA, 32 nt, Human
ccccagcccuacacagcagucuggccugagac

SEQ ID NO: 104698 - RNA, 32 nt, Human
ccccagcccuaucaccucaucucccgaaaggu

SEQ ID NO: 104699 - RNA, 32 nt, Human
ccccagcccucagagagacagcagaaagggag

SEQ ID NO: 104700 - RNA, 32 nt, Human
ccccagcccucaggauuccugaugcuccaagg

SEQ ID NO: 104701 - RNA, 21 nt, Human
ccccagcccucaggcccuccc

SEQ ID NO: 104702 - RNA, 32 nt, Human
ccccagcccucggcugccucuuaacuuugggu

SEQ ID NO: 104703 - RNA, 32 nt, Human
ccccagcccucuggguuggccugcugucagug

SEQ ID NO: 104704 - RNA, 32 nt, Human
ccccagcccugcgcaugggccugcugcuuguc

SEQ ID NO: 104705 - RNA, 23 nt, Human
ccccagcccuggaggugcccucg

SEQ ID NO: 104706 - RNA, 19 nt, Human
ccccagccgagcccagccu

SEQ ID NO: 104707 - RNA, 19 nt, Human
ccccagccgugccaucucu

SEQ ID NO: 104708 - RNA, 32 nt, Human
ccccagccuacaggaaccuucagaugauugga

SEQ ID NO: 104709 - RNA, 32 nt, Human
ccccagccuagcccugugagaccccaugggga

SEQ ID NO: 104710 - RNA, 32 nt, Human
ccccagccuaggaaagccaguuacauaaaagu

SEQ ID NO: 104711 - RNA, 32 nt, Human
ccccagccuaggcaagggugaccuuucuaaaa

SEQ ID NO: 104712 - RNA, 32 nt, Human
ccccagccuaucugauggcauggucccuggcc

SEQ ID NO: 104713 - RNA, 22 nt, Human
ccccagccucaaauccaggacc

SEQ ID NO: 104714 - RNA, 32 nt, Human
ccccagccucaacugauccucgcaucucagcc

SEQ ID NO: 104715 - RNA, 21 nt, Human
ccccagccucagaccccaccc

SEQ ID NO: 104716 - RNA, 32 nt, Human
ccccagccucauuccccauucugugucccaug

SEQ ID NO: 104717 - RNA, 32 nt, Human
ccccagccuccaccccggcuccccuggccugu

SEQ ID NO: 104718 - RNA, 32 nt, Human
ccccagccuccauccuugugcugguagccucu

SEQ ID NO: 104719 - RNA, 32 nt, Human
ccccagccuccccuagaaauucugugggggcg

SEQ ID NO: 104720 - RNA, 19 nt, Human
ccccagccucgccuuccca

SEQ ID NO: 104721 - RNA, 21 nt, Human
ccccagccucucuggggcaug

SEQ ID NO: 104722 - RNA, 32 nt, Human
ccccagccucugccacccuccaccuccucggu

SEQ ID NO: 104723 - RNA, 32 nt, Human
ccccagccucugcuucccuccucucuccagug

SEQ ID NO: 104724 - RNA, 32 nt, Human
ccccagccucuuccuaauccugugccacacac

SEQ ID NO: 104725 - RNA, 32 nt, Human
ccccagccucuuccugucuucagaaaagcagc

SEQ ID NO: 104726 - RNA, 32 nt, Human
ccccagccucuuuccaucauccuuccuccacc

SEQ ID NO: 104727 - RNA, 32 nt, Human
ccccagccucuuucugcuuucaugcucagcac

SEQ ID NO: 104728 - RNA, 32 nt, Human
ccccagccugcaggccagaagcaguguuacac

SEQ ID NO: 104729 - RNA, 32 nt, Human
ccccagccuggaccccuggggcucagauagag

SEQ ID NO: 104730 - RNA, 23 nt, Human
ccccagccuggccccaccagccc

SEQ ID NO: 104731 - RNA, 32 nt, Human
ccccagccuggcuccauuccugguugucacuc

SEQ ID NO: 104732 - RNA, 32 nt, Human
ccccagccugggaagaugucucacuguccacc

SEQ ID NO: 104733 - RNA, 20 nt, Human
ccccagccugggcaacagag

SEQ ID NO: 104734 - RNA, 20 nt, Human
ccccagccugggcgacagag

SEQ ID NO: 104735 - RNA, 32 nt, Human
ccccagccuguaguccuccucacuucaacccc

SEQ ID NO: 104736 - RNA, 32 nt, Human
ccccagccuucccaccccauaccucccucccg

SEQ ID NO: 104737 - RNA, 22 nt, Human
ccccagccuugaaccuaggacc

SEQ ID NO: 104738 - RNA, 32 nt, Human
ccccagccuuucuccucaggccuaagagaguc

SEQ ID NO: 104739 - RNA, 32 nt, Human
ccccagccuuucuucuccacugggucccacug

SEQ ID NO: 104740 - RNA, 19 nt, Human
ccccagccuuuuccuuuca

SEQ ID NO: 104741 - RNA, 20 nt, Human
ccccagcgcagccccgggca

SEQ ID NO: 104742 - RNA, 32 nt, Human
ccccagcgcagcugccucccgugcugucuguc

SEQ ID NO: 104743 - RNA, 32 nt, Human
ccccagcgcccucccuguccaguuccuugaag

SEQ ID NO: 104744 - RNA, 32 nt, Human
ccccagcgccuggugcugcagucuuaucuuca

SEQ ID NO: 104745 - RNA, 23 nt, Human
ccccagcgccuuucccccggggc

SEQ ID NO: 104746 - RNA, 17 nt, Human
ccccagcgcucuccacg

SEQ ID NO: 104747 - RNA, 32 nt, Human
ccccagcggaagcacagcucagagcuggucug

SEQ ID NO: 104748 - RNA, 19 nt, Human
ccccagcggcccccggccc

SEQ ID NO: 104749 - RNA, 23 nt, Human
ccccagcggccgccggcuccccc

SEQ ID NO: 104750 - RNA, 22 nt, Human
ccccagcggcucccucccuccu

SEQ ID NO: 104751 - RNA, 32 nt, Human
ccccagcggcucuguuuccuccuuccuuccuu

SEQ ID NO: 104752 - RNA, 32 nt, Human
ccccagcggcuuccccagccuccggaaguggg

SEQ ID NO: 104753 - RNA, 32 nt, Human
ccccagcgggguccgagcaggacggcuggaag

SEQ ID NO: 104754 - RNA, 32 nt, Human
ccccagcuaacacccauccacgcaccaccucc

SEQ ID NO: 104755 - RNA, 21 nt, Human
ccccagcuacaccaccagccc

SEQ ID NO: 104756 - RNA, 20 nt, Human
ccccagcuacagaauuccca

SEQ ID NO: 104757 - RNA, 32 nt, Human
ccccagcuaguaggugacagagcccagauuga

SEQ ID NO: 104758 - RNA, 22 nt, Human
ccccagcucacucauugcccuc

SEQ ID NO: 104759 - RNA, 32 nt, Human
ccccagcucacugcgccccuuuuccagcccgg

SEQ ID NO: 104760 - RNA, 21 nt, Human
ccccagcucagagccccgccc

SEQ ID NO: 104761 - RNA, 32 nt, Human
ccccagcucagcucugcugcaucccaggucau

SEQ ID NO: 104762 - RNA, 32 nt, Human
ccccagcucaucucccugguugcauggcccac

SEQ ID NO: 104763 - RNA, 32 nt, Human
ccccagcuccaauauguagcagucucucugga

SEQ ID NO: 104764 - RNA, 32 nt, Human
ccccagcuccagccccagcccaggugggccgc

SEQ ID NO: 104765 - RNA, 21 nt, Human
ccccagcuccaggaccugccc

SEQ ID NO: 104766 - RNA, 32 nt, Human
ccccagcuccaggacugagagccccaggaagc

SEQ ID NO: 104767 - RNA, 32 nt, Human
ccccagcucccaggaccacaggcucaggcagg

SEQ ID NO: 104768 - RNA, 32 nt, Human
ccccagcuccccucagugcugcugucagugua

SEQ ID NO: 104769 - RNA, 32 nt, Human
ccccagcuccgccuccccacacuccuccuugc

SEQ ID NO: 104770 - RNA, 24 nt, Human
ccccagcuccugcagggauggggu

SEQ ID NO: 104771 - RNA, 32 nt, Human
ccccagcuccuucugcaaggggccugcagaug

SEQ ID NO: 104772 - RNA, 32 nt, Human
ccccagcucucuucuggcuuucugagcaggaa

SEQ ID NO: 104773 - RNA, 32 nt, Human
ccccagcucugauuccuucaaggcccggccug

SEQ ID NO: 104774 - RNA, 32 nt, Human
ccccagcucugccugugccuuuaucccugaca

SEQ ID NO: 104775 - RNA, 32 nt, Human
ccccagcugaaccuccacaguccucuacacuc

SEQ ID NO: 104776 - RNA, 32 nt, Human
ccccagcugcagcuauccugacacagugcccu

SEQ ID NO: 104777 - RNA, 32 nt, Human
ccccagcugcauggaagguggaggacagaagc

SEQ ID NO: 104778 - RNA, 32 nt, Human
ccccagcugccuggcuggguccugaagcccuc

SEQ ID NO: 104779 - RNA, 20 nt, Human
ccccagcugcuccccucccu

SEQ ID NO: 104780 - RNA, 32 nt, Human
ccccagcugcuccccucccuccucugucccua

SEQ ID NO: 104781 - RNA, 19 nt, Human
ccccagcugcuccuccuca

SEQ ID NO: 104782 - RNA, 32 nt, Human
ccccagcugcuggcucgcgguucugagagugc

SEQ ID NO: 104783 - RNA, 32 nt, Human
ccccagcuggacuccccacccccuggcuuccc

SEQ ID NO: 104784 - RNA, 20 nt, Human
ccccagcuggagugcagugg

SEQ ID NO: 104785 - RNA, 32 nt, Human
ccccagcuggcaguugagcugccugagccaau

SEQ ID NO: 104786 - RNA, 32 nt, Human
ccccagcugggaagagggcgggaucgggcacu

SEQ ID NO: 104787 - RNA, 32 nt, Human
ccccagcugggcagggcuggaagccuuacgua

SEQ ID NO: 104788 - RNA, 21 nt, Human
ccccagcugggccugccccug

SEQ ID NO: 104789 - RNA, 32 nt, Human
ccccagcugggcugucccaaauguuaccauuu

SEQ ID NO: 104790 - RNA, 32 nt, Human
ccccagcugggugacagagugagacacugucu

SEQ ID NO: 104791 - RNA, 32 nt, Human
ccccagcuggucugcuuggauuuccuacagcc

SEQ ID NO: 104792 - RNA, 21 nt, Human
ccccagcugguucgggccgug

SEQ ID NO: 104793 - RNA, 32 nt, Human
ccccagcuguaaguguagacagugacuuguac

SEQ ID NO: 104794 - RNA, 32 nt, Human
ccccagcuguggguacagagaggucaagccca

SEQ ID NO: 104795 - RNA, 32 nt, Human
ccccagcuguguccagccugucugcagggaca

SEQ ID NO: 104796 - RNA, 32 nt, Human
ccccagcuguucuccagggcuuggggaaacag

SEQ ID NO: 104797 - RNA, 32 nt, Human
ccccagcuguugccuggcuuuccagaaacaga

SEQ ID NO: 104798 - RNA, 32 nt, Human
ccccagcuucccggcauuggaagaagggaccg

SEQ ID NO: 104799 - RNA, 32 nt, Human
ccccagcuuccugcccuccaccgggagucugc

SEQ ID NO: 104800 - RNA, 32 nt, Human
ccccagcuucugucugucucacugucuucccu

SEQ ID NO: 104801 - RNA, 20 nt, Human
ccccagcuugagugcagugg

SEQ ID NO: 104802 - RNA, 22 nt, Human
ccccagcuugcuggcugcccuc

SEQ ID NO: 104803 - RNA, 22 nt, Human
ccccagcuuggagagccuuucc

SEQ ID NO: 104804 - RNA, 26 nt, Human
ccccagcuuggccuccccaccagccc

SEQ ID NO: 104805 - RNA, 32 nt, Human
ccccagcuuggccuccccaccagcccgcugag

SEQ ID NO: 104806 - RNA, 32 nt, Human
ccccagcuuucuuucuguuagcauuuucugau

SEQ ID NO: 104807 - RNA, 32 nt, Human
ccccagcuuugcaaaguucuuccuguugggcu

SEQ ID NO: 104808 - RNA, 32 nt, Human
ccccagcuuuggcuaugagggccuugaguccc

SEQ ID NO: 104809 - RNA, 25 nt, Human
ccccagcuuuuccccagcucugccc

SEQ ID NO: 104810 - RNA, 20 nt, Human
ccccaggaaaacccaccucu

SEQ ID NO: 104811 - RNA, 32 nt, Human
ccccaggaaaacuguuuucauuuucacggcug

SEQ ID NO: 104812 - RNA, 32 nt, Human
ccccaggaaaugugaagacuggcagcuuucaa

SEQ ID NO: 104813 - RNA, 22 nt, Human
ccccaggaacguuucugaacaa

SEQ ID NO: 104814 - RNA, 32 nt, Human
ccccaggaacuccaauugugcugaagcugauu

SEQ ID NO: 104815 - RNA, 32 nt, Human
ccccaggaagaaaaugaugcagcucuggcucc

SEQ ID NO: 104816 - RNA, 20 nt, Human
ccccaggaagagucugucaa

SEQ ID NO: 104817 - RNA, 32 nt, Human
ccccaggaagcauccagggcagaggaagccac

SEQ ID NO: 104818 - RNA, 32 nt, Human
ccccaggaagccugagacgaaaguccuggggg

SEQ ID NO: 104819 - RNA, 19 nt, Human
ccccaggaagugggccaug

SEQ ID NO: 104820 - RNA, 21 nt, Human
ccccaggaaguuucugcgcag

SEQ ID NO: 104821 - RNA, 32 nt, Human
ccccaggaauauguguuuuccuuugucuuaau

SEQ ID NO: 104822 - RNA, 18 nt, Human
ccccaggacaagcugggg

SEQ ID NO: 104823 - RNA, 21 nt, Human
ccccaggacacccacccaccc

SEQ ID NO: 104824 - RNA, 24 nt, Human
ccccaggacacccagccugugccc

SEQ ID NO: 104825 - RNA, 32 nt, Human
ccccaggacagaagcagacagacacggcuccu

SEQ ID NO: 104826 - RNA, 22 nt, Human
ccccaggacagaugucuugcaa

SEQ ID NO: 104827 - RNA, 32 nt, Human
ccccaggacaggcccaagucagcccagcaugc

SEQ ID NO: 104828 - RNA, 32 nt, Human
ccccaggacaggucccuggaccagccuccugu

SEQ ID NO: 104829 - RNA, 32 nt, Human
ccccaggacccaggcuguggaucacggggccu

SEQ ID NO: 104830 - RNA, 32 nt, Human
ccccaggacccccacaccaccccagcucccug

SEQ ID NO: 104831 - RNA, 24 nt, Human
ccccaggaccccggugucccuccc

SEQ ID NO: 104832 - RNA, 21 nt, Human
ccccaggacucaccccagccc

SEQ ID NO: 104833 - RNA, 32 nt, Human
ccccaggacuccuagucgccggcuucagguca

SEQ ID NO: 104834 - RNA, 32 nt, Human
ccccaggacuccugggcccugcuucccugaac

SEQ ID NO: 104835 - RNA, 32 nt, Human
ccccaggacucugucuuuucuccaguuugagc

SEQ ID NO: 104836 - RNA, 19 nt, Human
ccccaggacuucuggguca

SEQ ID NO: 104837 - RNA, 18 nt, Human
ccccaggacuuugccaug

SEQ ID NO: 104838 - RNA, 32 nt, Human
ccccaggagaaaggacaacugcugccgaggca

SEQ ID NO: 104839 - RNA, 32 nt, Human
ccccaggagaggcagagagugagggaaagggc

SEQ ID NO: 104840 - RNA, 32 nt, Human
ccccaggagaggggagcuguguagugagggau

SEQ ID NO: 104841 - RNA, 32 nt, Human
ccccaggagaugcagaaggcaagugcagcuaa

SEQ ID NO: 104842 - RNA, 32 nt, Human
ccccaggagcaacauggggcccacccuagcgg

SEQ ID NO: 104843 - RNA, 32 nt, Human
ccccaggagcagaagagaguggggccugcccu

SEQ ID NO: 104844 - RNA, 32 nt, Human
ccccaggagccaagcccaccccuucuuugugu

SEQ ID NO: 104845 - RNA, 32 nt, Human
ccccaggagcccagagcagcgggagagggucc

SEQ ID NO: 104846 - RNA, 32 nt, Human
ccccaggagccccagugaaguucaccaaauca

SEQ ID NO: 104847 - RNA, 19 nt, Human
ccccaggagccccaguggc

SEQ ID NO: 104848 - RNA, 22 nt, Human
ccccaggagcccuuuuuguuca

SEQ ID NO: 104849 - RNA, 32 nt, Human
ccccaggaggaguaggaguugggcaggggaag

SEQ ID NO: 104850 - RNA, 32 nt, Human
ccccaggaggcagagguugaagugagccagga

SEQ ID NO: 104851 - RNA, 32 nt, Human
ccccaggaggcgaagauugcagugagcugaua

SEQ ID NO: 104852 - RNA, 32 nt, Human
ccccaggaggcuggugccagggagacaggccc

SEQ ID NO: 104853 - RNA, 32 nt, Human
ccccaggagggcccugccacgggccacuggcu

SEQ ID NO: 104854 - RNA, 19 nt, Human
ccccaggaggguuggcaug

SEQ ID NO: 104855 - RNA, 32 nt, Human
ccccaggaggucgaggcugcagugagccauga

SEQ ID NO: 104856 - RNA, 32 nt, Human
ccccaggagguggacauugcagugagccgaga

SEQ ID NO: 104857 - RNA, 32 nt, Human
ccccaggaggugggcaggcagcugagagcuug

SEQ ID NO: 104858 - RNA, 32 nt, Human
ccccaggagguggggguuguugugagccaaga

SEQ ID NO: 104859 - RNA, 32 nt, Human
ccccaggagguguugggggacacuccuccccu

SEQ ID NO: 104860 - RNA, 24 nt, Human
ccccaggagucuaaaauccagguc

SEQ ID NO: 104861 - RNA, 19 nt, Human
ccccaggauacucuggcaa

SEQ ID NO: 104862 - RNA, 32 nt, Human
ccccaggauucccagagagacgcugugauugg

SEQ ID NO: 104863 - RNA, 20 nt, Human
ccccaggauucucccggcgc

SEQ ID NO: 104864 - RNA, 32 nt, Human
ccccaggauuuagaucuuggcuacugucaugc

SEQ ID NO: 104865 - RNA, 32 nt, Human
ccccaggcaagaaggcagaguuucuccgcagg

SEQ ID NO: 104866 - RNA, 20 nt, Human
ccccaggcaccagacuuacc

SEQ ID NO: 104867 - RNA, 32 nt, Human
ccccaggcacgggggcccucucucuuccagag

SEQ ID NO: 104868 - RNA, 32 nt, Human
ccccaggcagccaccaguggaccuagccugga

SEQ ID NO: 104869 - RNA, 20 nt, Human
ccccaggcagccaugacaua

SEQ ID NO: 104870 - RNA, 22 nt, Human
ccccaggcagcuccgugcccug

SEQ ID NO: 104871 - RNA, 28 nt, Human
ccccaggcagcugcugccuccacuaucg

SEQ ID NO: 104872 - RNA, 32 nt, Human
ccccaggcaggagccaagcacagcaggagcuu

SEQ ID NO: 104873 - RNA, 32 nt, Human
ccccaggcagggaccucagcuuuguuaggagu

SEQ ID NO: 104874 - RNA, 25 nt, Human
ccccaggcagggcgugcccaggacc

SEQ ID NO: 104875 - RNA, 32 nt, Human
ccccaggcagucugugugugaggcauagcccc

SEQ ID NO: 104876 - RNA, 21 nt, Human
ccccaggcagugcugggccau

SEQ ID NO: 104877 - RNA, 32 nt, Human
ccccaggcauaaugugacccccaacaaaccca

SEQ ID NO: 104878 - RNA, 32 nt, Human
ccccaggcauggcaagcgccugccucuccccu

SEQ ID NO: 104879 - RNA, 24 nt, Human
ccccaggccaacagaacugcuggg

SEQ ID NO: 104880 - RNA, 32 nt, Human
ccccaggccacugucacucuuugugggagggg

SEQ ID NO: 104881 - RNA, 32 nt, Human
ccccaggccagccuggacacaucagggagcau

SEQ ID NO: 104882 - RNA, 21 nt, Human
ccccaggcccaccuccuggcc

SEQ ID NO: 104883 - RNA, 32 nt, Human
ccccaggcccagcacagggagcagggaguuuu

SEQ ID NO: 104884 - RNA, 32 nt, Human
ccccaggcccagccagggcugaggagcuguca

SEQ ID NO: 104885 - RNA, 18 nt, Human
ccccaggccccucucuca

SEQ ID NO: 104886 - RNA, 32 nt, Human
ccccaggccccuggcggguaccugagcugugc

SEQ ID NO: 104887 - RNA, 32 nt, Human
ccccaggcccugcuggccagagccacagaugc

SEQ ID NO: 104888 - RNA, 32 nt, Human
ccccaggcccugucuccccagcauccucccug

SEQ ID NO: 104889 - RNA, 20 nt, Human
ccccaggccgcucccggggc

SEQ ID NO: 104890 - RNA, 21 nt, Human
ccccaggccggagugcagugg

SEQ ID NO: 104891 - RNA, 32 nt, Human
ccccaggccucagucucccuucucccaugagg

SEQ ID NO: 104892 - RNA, 32 nt, Human
ccccaggccuccucccuguccuugugucccuc

SEQ ID NO: 104893 - RNA, 19 nt, Human
ccccaggccuccugggcca

SEQ ID NO: 104894 - RNA, 17 nt, Human
ccccaggccucuccuca

SEQ ID NO: 104895 - RNA, 21 nt, Human
ccccaggcgccgcgacuugcc

SEQ ID NO: 104896 - RNA, 32 nt, Human
ccccaggcucaggugauccucccaccucagcc

SEQ ID NO: 104897 - RNA, 32 nt, Human
ccccaggcuccaccagcuguuccccagugaug

SEQ ID NO: 104898 - RNA, 32 nt, Human
ccccaggcuccaugcugcugugcccugagguu

SEQ ID NO: 104899 - RNA, 32 nt, Human
ccccaggcucugaccuucuuucccaggaugag

SEQ ID NO: 104900 - RNA, 21 nt, Human
ccccaggcugagaaccugggg

SEQ ID NO: 104901 - RNA, 32 nt, Human
ccccaggcugaucuugaacuccugggcucaag

SEQ ID NO: 104902 - RNA, 32 nt, Human
ccccaggcugcaucggccugccuguguuuccc

SEQ ID NO: 104903 - RNA, 21 nt, Human
ccccaggcuggagugcaaugg

SEQ ID NO: 104904 - RNA, 21 nt, Human
ccccaggcuggagugcagugg

SEQ ID NO: 104905 - RNA, 32 nt, Human
ccccaggcuggucucgaacuccugggcucaag

SEQ ID NO: 104906 - RNA, 32 nt, Human
ccccaggcugucacccuccaccgagccacgca

SEQ ID NO: 104907 - RNA, 32 nt, Human
ccccaggcuguggugaggggccucacagauuu

SEQ ID NO: 104908 - RNA, 32 nt, Human
ccccaggcugugugcguccaggacgucgcccc

SEQ ID NO: 104909 - RNA, 32 nt, Human
ccccaggcuuccucuucuuguaguccaucucc

SEQ ID NO: 104910 - RNA, 27 nt, Human
ccccaggcuugacuccaccucggggcu

SEQ ID NO: 104911 - RNA, 22 nt, Human
ccccagggaagccgccugccuu

SEQ ID NO: 104912 - RNA, 32 nt, Human
ccccagggaauuguguuugucuucauuucagu

SEQ ID NO: 104913 - RNA, 20 nt, Human
ccccagggacuguccaggug

SEQ ID NO: 104914 - RNA, 32 nt, Human
ccccagggagagagaaaaagcugagacuccug

SEQ ID NO: 104915 - RNA, 20 nt, Human
ccccagggagcuuguugcca

SEQ ID NO: 104916 - RNA, 26 nt, Human
ccccagggaggcccuggccuccagug

SEQ ID NO: 104917 - RNA, 23 nt, Human
ccccagggaggugucuguuccca

SEQ ID NO: 104918 - RNA, 32 nt, Human
ccccagggaucucuucacauguggauugacau

SEQ ID NO: 104919 - RNA, 24 nt, Human
ccccagggaugaaacacccagaaa

SEQ ID NO: 104920 - RNA, 18 nt, Human
ccccagggauugcccgug

SEQ ID NO: 104921 - RNA, 32 nt, Human
ccccagggcaaggacagcucagcugcuggcag

SEQ ID NO: 104922 - RNA, 32 nt, Human
ccccagggcacugcagagucugggcagaggug

SEQ ID NO: 104923 - RNA, 32 nt, Human
ccccagggcaggaggauggugccuggacaacc

SEQ ID NO: 104924 - RNA, 32 nt, Human
ccccagggcaggcaggcugcagggagccaagu

SEQ ID NO: 104925 - RNA, 18 nt, Human
ccccagggcagggcuggg

SEQ ID NO: 104926 - RNA, 29 nt, Human
ccccagggcccaccucuuacuuccugccu

SEQ ID NO: 104927 - RNA, 31 nt, Human
ccccagggcccaggaacugucaucagagcag

SEQ ID NO: 104928 - RNA, 32 nt, Human
ccccagggcccaggaacugucaucagagcaga

SEQ ID NO: 104929 - RNA, 29 nt, Human
ccccagggccccaccccauccuccugccu

SEQ ID NO: 104930 - RNA, 18 nt, Human
ccccagggcccggcagug

SEQ ID NO: 104931 - RNA, 18 nt, Human
ccccagggcccuggccau

SEQ ID NO: 104932 - RNA, 16 nt, Human
ccccagggccgccgug

SEQ ID NO: 104933 - RNA, 17 nt, Human
ccccagggccgggcuug

SEQ ID NO: 104934 - RNA, 21 nt, Human
ccccagggccucuccgugcaa

SEQ ID NO: 104935 - RNA, 18 nt, Human
ccccagggccuggcacau

SEQ ID NO: 104936 - RNA, 32 nt, Human
ccccagggccugggacagccugccgcugccag

SEQ ID NO: 104937 - RNA, 28 nt, Human
ccccagggccuuuccuucaccuccugcc

SEQ ID NO: 104938 - RNA, 27 nt, Human
ccccagggcuccaacuccuccuugccu

SEQ ID NO: 104939 - RNA, 16 nt, Human
ccccagggcuccagug

SEQ ID NO: 104940 - RNA, 22 nt, Human
ccccagggcuccaucuccgccu

SEQ ID NO: 104941 - RNA, 18 nt, Human
ccccagggcucccggcua

SEQ ID NO: 104942 - RNA, 16 nt, Human
ccccagggcuccugug

SEQ ID NO: 104943 - RNA, 22 nt, Human
ccccagggcucgccuucugccu

SEQ ID NO: 104944 - RNA, 17 nt, Human
ccccagggcucuccaug

SEQ ID NO: 104945 - RNA, 29 nt, Human
ccccagggcucucccuccaccuccuggcu

SEQ ID NO: 104946 - RNA, 18 nt, Human
ccccagggcucugggcua

SEQ ID NO: 104947 - RNA, 18 nt, Human
ccccagggcucuggguca

SEQ ID NO: 104948 - RNA, 22 nt, Human
ccccagggcugaccaccagccu

SEQ ID NO: 104949 - RNA, 32 nt, Human
ccccagggcugagcuguguggugcaggccaaa

SEQ ID NO: 104950 - RNA, 18 nt, Human
ccccagggcugcagcugu

SEQ ID NO: 104951 - RNA, 16 nt, Human
ccccagggcugccaug

SEQ ID NO: 104952 - RNA, 18 nt, Human
ccccagggcugcggggcu

SEQ ID NO: 104953 - RNA, 16 nt, Human
ccccagggcugcugug

SEQ ID NO: 104954 - RNA, 20 nt, Human
ccccagggcuggggcugcca

SEQ ID NO: 104955 - RNA, 18 nt, Human
ccccagggcuucuggcua

SEQ ID NO: 104956 - RNA, 18 nt, Human
ccccagggcuuguggcca

SEQ ID NO: 104957 - RNA, 21 nt, Human
ccccagggcuuuccuguaccu

SEQ ID NO: 104958 - RNA, 27 nt, Human
ccccagggcuuuccuucaccuccugcc

SEQ ID NO: 104959 - RNA, 27 nt, Human
ccccagggcuuuccuuuccuccugcuu

SEQ ID NO: 104960 - RNA, 29 nt, Human
ccccagggcuuugucacuuccuucugccu

SEQ ID NO: 104961 - RNA, 32 nt, Human
ccccaggggaauggcagcagugagguagaugg

SEQ ID NO: 104962 - RNA, 32 nt, Human
ccccaggggacauuuggcaaugacuggaggag

SEQ ID NO: 104963 - RNA, 32 nt, Human
ccccaggggacugggugcaguggcucauaccu

SEQ ID NO: 104964 - RNA, 32 nt, Human
ccccaggggcacuguccuguguguucuggaaa

SEQ ID NO: 104965 - RNA, 32 nt, Human
ccccaggggcugagcugccaccagagguccug

SEQ ID NO: 104966 - RNA, 16 nt, Human
ccccaggggcugcaug

SEQ ID NO: 104967 - RNA, 32 nt, Human
ccccaggggcuggagucaccuggugccccuga

SEQ ID NO: 104968 - RNA, 23 nt, Human
ccccaggggcuucggcccagacc

SEQ ID NO: 104969 - RNA, 32 nt, Human
ccccagggguaugagggcaccagcuggguucu

SEQ ID NO: 104970 - RNA, 19 nt, Human
ccccagggguuggcccaug

SEQ ID NO: 104971 - RNA, 16 nt, Human
ccccaggguagccaug

SEQ ID NO: 104972 - RNA, 27 nt, Human
ccccagggucauggaggacccaggacc

SEQ ID NO: 104973 - RNA, 32 nt, Human
ccccaggguccaagggagaagccccagacccc

SEQ ID NO: 104974 - RNA, 23 nt, Human
ccccaggguccauacuucuguuu

SEQ ID NO: 104975 - RNA, 29 nt, Human
ccccaggguccuccuccgccuccucguuu

SEQ ID NO: 104976 - RNA, 29 nt, Human
ccccaggguccuccuuauacuuucugucu

SEQ ID NO: 104977 - RNA, 29 nt, Human
ccccagggucgcuuuccagccuuuuguuu

SEQ ID NO: 104978 - RNA, 22 nt, Human
ccccagggucuauuuucugccu

SEQ ID NO: 104979 - RNA, 29 nt, Human
ccccagggucuuauuuugcuugccugccu

SEQ ID NO: 104980 - RNA, 29 nt, Human
ccccagggucuucauuuuuccuccugucu

SEQ ID NO: 104981 - RNA, 29 nt, Human
ccccagggucuuuuucucaucucuugcuu

SEQ ID NO: 104982 - RNA, 32 nt, Human
ccccagggugacaguggcccagcugggacugg

SEQ ID NO: 104983 - RNA, 32 nt, Human
ccccaggguggagggggugggaaugggggaug

SEQ ID NO: 104984 - RNA, 17 nt, Human
ccccagggugggccgug

SEQ ID NO: 104985 - RNA, 18 nt, Human
ccccaggguggggcuaug

SEQ ID NO: 104986 - RNA, 17 nt, Human
ccccagggugguccaug

SEQ ID NO: 104987 - RNA, 29 nt, Human
ccccaggguuacauuucaaucuucugucu

SEQ ID NO: 104988 - RNA, 29 nt, Human
ccccaggguucaucaucugccuucugcuu

SEQ ID NO: 104989 - RNA, 22 nt, Human
ccccaggguucaucuucuguuu

SEQ ID NO: 104990 - RNA, 29 nt, Human
ccccaggguucuagucugucuuccugccu

SEQ ID NO: 104991 - RNA, 29 nt, Human
ccccaggguucuaucuccacuuugugccu

SEQ ID NO: 104992 - RNA, 29 nt, Human
ccccaggguucuaucuucuuuucuugccu

SEQ ID NO: 104993 - RNA, 29 nt, Human
ccccaggguucuccauuucacucuugcuu

SEQ ID NO: 104994 - RNA, 29 nt, Human
ccccaggguucuccauuuuccucuugucu

SEQ ID NO: 104995 - RNA, 29 nt, Human
ccccaggguucuccucugcuucuuugccu

SEQ ID NO: 104996 - RNA, 27 nt, Human
ccccaggguucuccuuugccuuuugcc

SEQ ID NO: 104997 - RNA, 32 nt, Human
ccccaggguugcugaggaagagcuugaugauc

SEQ ID NO: 104998 - RNA, 18 nt, Human
ccccaggguuuggccgug

SEQ ID NO: 104999 - RNA, 29 nt, Human
ccccaggguuuguucuucaucuccugucu

SEQ ID NO: 105000 - RNA, 29 nt, Human
ccccaggguuuuaaauguauuuccugcuu

SEQ ID NO: 105001 - RNA, 29 nt, Human
ccccaggguuuuacguccaucucuuguuu

SEQ ID NO: 105002 - RNA, 29 nt, Human
ccccaggguuuugaauuaucucacugucu

SEQ ID NO: 105003 - RNA, 28 nt, Human
ccccaggguuuuguccugccucuuguuu

SEQ ID NO: 105004 - RNA, 29 nt, Human
ccccaggguuuugugaccaguuucugucu

SEQ ID NO: 105005 - RNA, 32 nt, Human
ccccagguaaaaggugcuccuuugccuggguu

SEQ ID NO: 105006 - RNA, 32 nt, Human
ccccagguaauggcaugagauagcugguguua

SEQ ID NO: 105007 - RNA, 21 nt, Human
ccccagguacaccucccccug

SEQ ID NO: 105008 - RNA, 32 nt, Human
ccccagguagggaaagcggaagguagaaggcu

SEQ ID NO: 105009 - RNA, 22 nt, Human
ccccaggucaccucgggucccc

SEQ ID NO: 105010 - RNA, 32 nt, Human
ccccaggucaguccccagcccucuggguuggc

SEQ ID NO: 105011 - RNA, 23 nt, Human
ccccagguccuggcccagucccu

SEQ ID NO: 105012 - RNA, 32 nt, Human
ccccaggucucagccucccuguuggcugauac

SEQ ID NO: 105013 - RNA, 32 nt, Human
ccccaggugaaacuggaagugcaugaggcaga

SEQ ID NO: 105014 - RNA, 23 nt, Human
ccccaggugacggccugcccgca

SEQ ID NO: 105015 - RNA, 32 nt, Human
ccccaggugagacagcggucccaggggccuga

SEQ ID NO: 105016 - RNA, 22 nt, Human
ccccaggugauguuacuugcca

SEQ ID NO: 105017 - RNA, 21 nt, Human
ccccaggugcaagcagcaccc

SEQ ID NO: 105018 - RNA, 32 nt, Human
ccccaggugcaggccaccaccuccgggucggc

SEQ ID NO: 105019 - RNA, 32 nt, Human
ccccaggugccggcggcccgggccaagccauc

SEQ ID NO: 105020 - RNA, 18 nt, Human
ccccaggugcucagggcc

SEQ ID NO: 105021 - RNA, 32 nt, Human
ccccaggugcuguuugcucaggaggcugcugu

SEQ ID NO: 105022 - RNA, 24 nt, Human
ccccagguggcugacccagucccu

SEQ ID NO: 105023 - RNA, 32 nt, Human
ccccaggugggaggggcaggaagcagccggag

SEQ ID NO: 105024 - RNA, 32 nt, Human
ccccaggugguggagguugcagugagccaaga

SEQ ID NO: 105025 - RNA, 24 nt, Human
ccccaggugugcuucucccguagc

SEQ ID NO: 105026 - RNA, 32 nt, Human
ccccagguucaagugauucuccugccucagcc

SEQ ID NO: 105027 - RNA, 21 nt, Human
ccccagguucccuacacccug

SEQ ID NO: 105028 - RNA, 19 nt, Human
ccccagguuccuccaggcc

SEQ ID NO: 105029 - RNA, 19 nt, Human
ccccagguugccugggcca

SEQ ID NO: 105030 - RNA, 32 nt, Human
ccccagguuggagugcaguggcgugucuuggg

SEQ ID NO: 105031 - RNA, 32 nt, Human
ccccaguaggaggagagcaggcagagcuuguc

SEQ ID NO: 105032 - RNA, 32 nt, Human
ccccaguauacugaccauuccccagccacuuc

SEQ ID NO: 105033 - RNA, 32 nt, Human
ccccaguauuguagagcaagucuuguguuaaa

SEQ ID NO: 105034 - RNA, 32 nt, Human
ccccagucaagacucagggugucccgaagcug

SEQ ID NO: 105035 - RNA, 32 nt, Human
ccccagucaagccuucggaugccugcagcccu

SEQ ID NO: 105036 - RNA, 24 nt, Human
ccccagucacucgccccuuccuca

SEQ ID NO: 105037 - RNA, 32 nt, Human
ccccagucagaacugugaaacagggaaauuuu

SEQ ID NO: 105038 - RNA, 32 nt, Human
ccccaguccauuuaucaggaggugaucacaca

SEQ ID NO: 105039 - RNA, 32 nt, Human
ccccaguccccagagccccgacagaggggucc

SEQ ID NO: 105040 - RNA, 32 nt, Human
ccccaguccccugggcugcccuucccgggccu

SEQ ID NO: 105041 - RNA, 32 nt, Human
ccccagucccgagacuggguucaaguagaggg

SEQ ID NO: 105042 - RNA, 32 nt, Human
ccccagucccucccucuucaccuugcuccguc

SEQ ID NO: 105043 - RNA, 32 nt, Human
ccccagucccucuucccaccccucucuucuag

SEQ ID NO: 105044 - RNA, 16 nt, Human
ccccaguccgcucggc

SEQ ID NO: 105045 - RNA, 32 nt, Human
ccccagucgagcccuccucccuuccccugccc

SEQ ID NO: 105046 - RNA, 32 nt, Human
ccccagucuaacaccacaacuaauuucaccca

SEQ ID NO: 105047 - RNA, 32 nt, Human
ccccagucuauccccaaccccaaaucaagacc

SEQ ID NO: 105048 - RNA, 32 nt, Human
ccccagucucaacuuccaucaccucggcgcuc

SEQ ID NO: 105049 - RNA, 32 nt, Human
ccccagucucacuaguugccaggcuggucuca

SEQ ID NO: 105050 - RNA, 32 nt, Human
ccccagucucacuccauuccuuccccaccugg

SEQ ID NO: 105051 - RNA, 32 nt, Human
ccccagucucagaaauuaacaugguaugaaag

SEQ ID NO: 105052 - RNA, 32 nt, Human
ccccagucucccucccccucgcgccugggcag

SEQ ID NO: 105053 - RNA, 32 nt, Human
ccccagucuccucuccugaucuccuccaaucu

SEQ ID NO: 105054 - RNA, 32 nt, Human
ccccagucucgccugcacucuccuuuccuccc

SEQ ID NO: 105055 - RNA, 17 nt, Human
ccccagugaagaguaaa

SEQ ID NO: 105056 - RNA, 32 nt, Human
ccccagugacccagagcauggaaaggggguca

SEQ ID NO: 105057 - RNA, 32 nt, Human
ccccagugcagugccauccaccguggcuccgc

SEQ ID NO: 105058 - RNA, 32 nt, Human
ccccagugcccacagaacccagucccaugcca

SEQ ID NO: 105059 - RNA, 32 nt, Human
ccccagugcccgcugggcccagccuggggaca

SEQ ID NO: 105060 - RNA, 32 nt, Human
ccccagugccuacagacaaagcagaagcugcc

SEQ ID NO: 105061 - RNA, 23 nt, Human
ccccagugccucuccuggcccug

SEQ ID NO: 105062 - RNA, 32 nt, Human
ccccagugccugugccucugagcccgggucca

SEQ ID NO: 105063 - RNA, 32 nt, Human
ccccagugccuuccagcuuaugcauaugugag

SEQ ID NO: 105064 - RNA, 32 nt, Human
ccccagugcgcaggccagagugagugagccca

SEQ ID NO: 105065 - RNA, 32 nt, Human
ccccagugcuccaugccagcacuugaacuguc

SEQ ID NO: 105066 - RNA, 32 nt, Human
ccccagugcugcacucccacccugggcuccac

SEQ ID NO: 105067 - RNA, 32 nt, Human
ccccagugcuggaaggaaggagggccuuucuu

SEQ ID NO: 105068 - RNA, 32 nt, Human
ccccaguggauguccccugacccuccaccgca

SEQ ID NO: 105069 - RNA, 24 nt, Human
ccccaguggaugucuaaaaccaca

SEQ ID NO: 105070 - RNA, 32 nt, Human
ccccaguggcacagagcuaauccugccugggg

SEQ ID NO: 105071 - RNA, 32 nt, Human
ccccaguggcccugggcugggccuggccucua

SEQ ID NO: 105072 - RNA, 32 nt, Human
ccccaguggccuguuugccugccugaggaguu

SEQ ID NO: 105073 - RNA, 32 nt, Human
ccccaguggcugcagguagcuggacuuccugc

SEQ ID NO: 105074 - RNA, 19 nt, Human
ccccaguggcuucaccuca

SEQ ID NO: 105075 - RNA, 32 nt, Human
ccccagugggagaaaguucaaaggugauuaga

SEQ ID NO: 105076 - RNA, 32 nt, Human
ccccagugggagcacggcccagcuggauuuug

SEQ ID NO: 105077 - RNA, 32 nt, Human
ccccagugggcaagaccaaaguguggcgggga

SEQ ID NO: 105078 - RNA, 25 nt, Human
ccccagugguccagacaucugcuga

SEQ ID NO: 105079 - RNA, 32 nt, Human
ccccaguguccuccuccuucuccggccagacc

SEQ ID NO: 105080 - RNA, 32 nt, Human
ccccaguguccugacuucugucugccacauga

SEQ ID NO: 105081 - RNA, 32 nt, Human
ccccaguguccugcccugugcccagccccagc

SEQ ID NO: 105082 - RNA, 32 nt, Human
ccccagugucugguuucauucaucucagacuu

SEQ ID NO: 105083 - RNA, 19 nt, Human
ccccaguguggacuuggga

SEQ ID NO: 105084 - RNA, 32 nt, Human
ccccaguguggauacuaauaaaccucuuggag

SEQ ID NO: 105085 - RNA, 32 nt, Human
ccccaguguucagguguuucacaagaaagucu

SEQ ID NO: 105086 - RNA, 32 nt, Human
ccccaguguuggaggaggggcccagugggagg

SEQ ID NO: 105087 - RNA, 22 nt, Human
ccccaguguuggccccaggacc

SEQ ID NO: 105088 - RNA, 32 nt, Human
ccccaguucaaggaucuucacaccuggauuua

SEQ ID NO: 105089 - RNA, 32 nt, Human
ccccaguuccaucuguaguccuaaccaggagc

SEQ ID NO: 105090 - RNA, 32 nt, Human
ccccaguuccccaacccacucccuuccaacaa

SEQ ID NO: 105091 - RNA, 21 nt, Human
ccccaguucccuccucccucg

SEQ ID NO: 105092 - RNA, 21 nt, Human
ccccaguuccuagcacugccc

SEQ ID NO: 105093 - RNA, 18 nt, Human
ccccaguuccucuucugc

SEQ ID NO: 105094 - RNA, 32 nt, Human
ccccaguucucccccaucucccccucuccauc

SEQ ID NO: 105095 - RNA, 22 nt, Human
ccccaguucucccucccggggc

SEQ ID NO: 105096 - RNA, 32 nt, Human
ccccaguucugaaucaccuaccuucaccaucu

SEQ ID NO: 105097 - RNA, 32 nt, Human
ccccaguucuguccacaccccuucccuuuccu

SEQ ID NO: 105098 - RNA, 21 nt, Human
ccccaguucuucucugcccuc

SEQ ID NO: 105099 - RNA, 32 nt, Human
ccccaguugaaaaucacugugccuuuccagau

SEQ ID NO: 105100 - RNA, 32 nt, Human
ccccaguugcccaccccgccugccccuggaca

SEQ ID NO: 105101 - RNA, 32 nt, Human
ccccaguugucacugcagucugggcaacccca

SEQ ID NO: 105102 - RNA, 32 nt, Human
ccccaguugugugccuugaccucucucgcccc

SEQ ID NO: 105103 - RNA, 23 nt, Human
ccccaguuuaccguuccucccuc

SEQ ID NO: 105104 - RNA, 32 nt, Human
ccccaguuuagcccccugaccugcaggcugug

SEQ ID NO: 105105 - RNA, 32 nt, Human
ccccaguuuccaguuucccuugccagacaagc

SEQ ID NO: 105106 - RNA, 32 nt, Human
ccccaguuucccuccuccuuuucacuugaacu

SEQ ID NO: 105107 - RNA, 32 nt, Human
ccccaguuucugcccuggcagcuccuggccac

SEQ ID NO: 105108 - RNA, 32 nt, Human
ccccauacacagaaguauacgaaagcacacaa

SEQ ID NO: 105109 - RNA, 32 nt, Human
ccccauacccacagcccucuguccucaaauuu

SEQ ID NO: 105110 - RNA, 32 nt, Human
ccccauaccccacacacucaucagccugaagu

SEQ ID NO: 105111 - RNA, 32 nt, Human
ccccauaccccagcgcugaggguggguugggc

SEQ ID NO: 105112 - RNA, 32 nt, Human
ccccauacgcugcccucgcagccuggcggccu

SEQ ID NO: 105113 - RNA, 32 nt, Human
ccccauacuacugaauaaacuaguucugugcg

SEQ ID NO: 105114 - RNA, 19 nt, Human
ccccauacuagaauucaca

SEQ ID NO: 105115 - RNA, 32 nt, Human
ccccauacuagucgccgauauuuggaguucuu

SEQ ID NO: 105116 - RNA, 32 nt, Human
ccccauacuggcuuccaccuccugcggcccag

SEQ ID NO: 105117 - RNA, 23 nt, Human
ccccauagccccucuccaccuca

SEQ ID NO: 105118 - RNA, 23 nt, Human
ccccauagccucuggaacugugc

SEQ ID NO: 105119 - RNA, 32 nt, Human
ccccauaggcuuguuucucuccauugcuauua

SEQ ID NO: 105120 - RNA, 20 nt, Human
ccccauagggugcccagcga

SEQ ID NO: 105121 - RNA, 19 nt, Human
ccccauaugccccaacuca

SEQ ID NO: 105122 - RNA, 32 nt, Human
ccccaucaagcuaccaaugugucucuucacag

SEQ ID NO: 105123 - RNA, 17 nt, Human
ccccaucacauccacuu

SEQ ID NO: 105124 - RNA, 19 nt, Human
ccccaucaccacugccucc

SEQ ID NO: 105125 - RNA, 23 nt, Human
ccccaucacccuccccccaguca

SEQ ID NO: 105126 - RNA, 20 nt, Human
ccccaucacugcccccaccc

SEQ ID NO: 105127 - RNA, 22 nt, Human
ccccaucacugcucguucagcc

SEQ ID NO: 105128 - RNA, 23 nt, Human
ccccaucacuuaguucucaggca

SEQ ID NO: 105129 - RNA, 32 nt, Human
ccccaucagaguccacacaggccaggagugaa

SEQ ID NO: 105130 - RNA, 32 nt, Human
ccccaucagccccuggcagccaucauucuacu

SEQ ID NO: 105131 - RNA, 32 nt, Human
ccccaucagccugugcugcuaggucugggguc

SEQ ID NO: 105132 - RNA, 18 nt, Human
ccccaucaggucagcuca

SEQ ID NO: 105133 - RNA, 22 nt, Human
ccccaucaucacccagcacggg

SEQ ID NO: 105134 - RNA, 32 nt, Human
ccccaucauccaggccacgcaccagaaucuga

SEQ ID NO: 105135 - RNA, 32 nt, Human
ccccaucaucucacuccuuugccugcacugcc

SEQ ID NO: 105136 - RNA, 32 nt, Human
ccccaucaucucuccauuucuaccuccccauc

SEQ ID NO: 105137 - RNA, 32 nt, Human
ccccaucauucuaggaugauacagaaagaaaa

SEQ ID NO: 105138 - RNA, 19 nt, Human
ccccaucauucuccaccca

SEQ ID NO: 105139 - RNA, 32 nt, Human
ccccauccaagaagggcugggaggcgggcagc

SEQ ID NO: 105140 - RNA, 32 nt, Human
ccccaucccagguuguggaggcucgaggaagc

SEQ ID NO: 105141 - RNA, 32 nt, Human
ccccauccccacaguuuggaaguggccuuuuc

SEQ ID NO: 105142 - RNA, 20 nt, Human
ccccauccccacccucccca

SEQ ID NO: 105143 - RNA, 32 nt, Human
ccccauccccuccaccccacaccugaguucuu

SEQ ID NO: 105144 - RNA, 16 nt, Human
ccccauccccuccuca

SEQ ID NO: 105145 - RNA, 32 nt, Human
ccccauccccuccucaaagaaauucacaggca

SEQ ID NO: 105146 - RNA, 32 nt, Human
ccccaucccuaaucucugaucucugagcuggu

SEQ ID NO: 105147 - RNA, 32 nt, Human
ccccaucccugccacacugaugugucauuguc

SEQ ID NO: 105148 - RNA, 32 nt, Human
ccccaucccugccuccugccccugacgcccau

SEQ ID NO: 105149 - RNA, 18 nt, Human
ccccaucccugggucaug

SEQ ID NO: 105150 - RNA, 19 nt, Human
ccccaucccugugcaccug

SEQ ID NO: 105151 - RNA, 32 nt, Human
ccccauccgaaggucaccagcaucaaagacca

SEQ ID NO: 105152 - RNA, 32 nt, Human
ccccauccgcuuccuuugggacugccuuccuc

SEQ ID NO: 105153 - RNA, 32 nt, Human
ccccauccggaccucuugcacugggcugccuu

SEQ ID NO: 105154 - RNA, 32 nt, Human
ccccauccuaacccugguggugcagugagggu

SEQ ID NO: 105155 - RNA, 20 nt, Human
ccccauccuagaaccagaga

SEQ ID NO: 105156 - RNA, 32 nt, Human
ccccauccucaagggagcuggugggaaggagg

SEQ ID NO: 105157 - RNA, 32 nt, Human
ccccauccucaccaugucuucgacucaggaca

SEQ ID NO: 105158 - RNA, 32 nt, Human
ccccauccuccaccccgcccccaaaucgugac

SEQ ID NO: 105159 - RNA, 18 nt, Human
ccccauccucccuccuca

SEQ ID NO: 105160 - RNA, 32 nt, Human
ccccauccucccuguguucccugggccucagc

SEQ ID NO: 105161 - RNA, 32 nt, Human
ccccauccuccugguccuuuccugcuucugac

SEQ ID NO: 105162 - RNA, 19 nt, Human
ccccauccugccucaccca

SEQ ID NO: 105163 - RNA, 22 nt, Human
ccccauccuucacuccuccuca

SEQ ID NO: 105164 - RNA, 32 nt, Human
ccccauccuuucucucgccccuccuacccgca

SEQ ID NO: 105165 - RNA, 32 nt, Human
ccccaucgagaauauggcugccggccucuuug

SEQ ID NO: 105166 - RNA, 22 nt, Human
ccccaucgcccaaguccugccc

SEQ ID NO: 105167 - RNA, 32 nt, Human
ccccaucgccugcuccuaugcccagcccggcc

SEQ ID NO: 105168 - RNA, 32 nt, Human
ccccaucgggccgcugcccccaugcucgcgcu

SEQ ID NO: 105169 - RNA, 22 nt, Human
ccccaucuacggaguccacccc

SEQ ID NO: 105170 - RNA, 32 nt, Human
ccccaucucacaucacccucaggggccucuga

SEQ ID NO: 105171 - RNA, 32 nt, Human
ccccaucucaugggggagagacagccacggag

SEQ ID NO: 105172 - RNA, 32 nt, Human
ccccaucuccaccccaucauguuuacaggguu

SEQ ID NO: 105173 - RNA, 32 nt, Human
ccccaucuccacccucagaagucagccuggca

SEQ ID NO: 105174 - RNA, 32 nt, Human
ccccaucuccacccucuccccuguuccucugu

SEQ ID NO: 105175 - RNA, 32 nt, Human
ccccaucuccaccuccgcaugucauuucugaa

SEQ ID NO: 105176 - RNA, 32 nt, Human
ccccaucuccaucaugaacauggcagccccaa

SEQ ID NO: 105177 - RNA, 32 nt, Human
ccccaucuccauccucagcagaugacacugau

SEQ ID NO: 105178 - RNA, 18 nt, Human
ccccaucuccccgccauc

SEQ ID NO: 105179 - RNA, 32 nt, Human
ccccaucuccccucagcucggcucagcucggu

SEQ ID NO: 105180 - RNA, 32 nt, Human
ccccaucuccucuggugugggaguguggugga

SEQ ID NO: 105181 - RNA, 32 nt, Human
ccccaucuccuggacaccuggccauuguugug

SEQ ID NO: 105182 - RNA, 32 nt, Human
ccccaucucuacuaaaacaaaaauuagccagg

SEQ ID NO: 105183 - RNA, 16 nt, Human
ccccaucucugcugcu

SEQ ID NO: 105184 - RNA, 32 nt, Human
ccccaucugcaaacgcugggccccaugggagc

SEQ ID NO: 105185 - RNA, 32 nt, Human
ccccaucugcacugcugaccauguugaggacc

SEQ ID NO: 105186 - RNA, 32 nt, Human
ccccaucugcccagcacggccugcacugugcc

SEQ ID NO: 105187 - RNA, 32 nt, Human
ccccaucugccgucuugguucaucucaccaca

SEQ ID NO: 105188 - RNA, 32 nt, Human
ccccaucugccuggcguugugcgcagagcugg

SEQ ID NO: 105189 - RNA, 32 nt, Human
ccccaucugcuguggcuuuucaguuaaaauuu

SEQ ID NO: 105190 - RNA, 32 nt, Human
ccccaucuggguucaugaggccaccucuuugc

SEQ ID NO: 105191 - RNA, 19 nt, Human
ccccaucuguccuuccuca

SEQ ID NO: 105192 - RNA, 21 nt, Human
ccccaucugugccugcccuca

SEQ ID NO: 105193 - RNA, 32 nt, Human
ccccaucuguggaauggggucaauaccaccua

SEQ ID NO: 105194 - RNA, 32 nt, Human
ccccaucuuagagugugguguccaaacgugag

SEQ ID NO: 105195 - RNA, 32 nt, Human
ccccaucuucaaggaacucacagucaggaaga

SEQ ID NO: 105196 - RNA, 32 nt, Human
ccccaucuucugacuuuuccucgugugaccca

SEQ ID NO: 105197 - RNA, 32 nt, Human
ccccaucuuguccgucuccacucucaucccag

SEQ ID NO: 105198 - RNA, 18 nt, Human
ccccaucuuguucccuug

SEQ ID NO: 105199 - RNA, 32 nt, Human
ccccaucuuugugguuuuaucuacuuuugguc

SEQ ID NO: 105200 - RNA, 32 nt, Human
ccccaucuuugugugugccauggccuucccca

SEQ ID NO: 105201 - RNA, 22 nt, Human
ccccaucuuuucuuuccacuug

SEQ ID NO: 105202 - RNA, 32 nt, Human
ccccaugaccuuauccuuccucuccuuccuug

SEQ ID NO: 105203 - RNA, 18 nt, Human
ccccaugacuguccccca

SEQ ID NO: 105204 - RNA, 32 nt, Human
ccccaugagacucgauagugguggugaacaga

SEQ ID NO: 105205 - RNA, 32 nt, Human
ccccaugagcagagucuguccucugcucuucu

SEQ ID NO: 105206 - RNA, 32 nt, Human
ccccaugagcggagucuguccucugcucuucu

SEQ ID NO: 105207 - RNA, 29 nt, Human
ccccaugaggcuccuggcuuuccugaguc

SEQ ID NO: 105208 - RNA, 32 nt, Human
ccccaugcaaccacccuaucccugccaaguuu

SEQ ID NO: 105209 - RNA, 32 nt, Human
ccccaugcagagcuggagguuggggugauguc

SEQ ID NO: 105210 - RNA, 20 nt, Human
ccccaugcagcccuggggag

SEQ ID NO: 105211 - RNA, 18 nt, Human
ccccaugcagucaccuca

SEQ ID NO: 105212 - RNA, 32 nt, Human
ccccaugcagucaccucagcucugccugagaa

SEQ ID NO: 105213 - RNA, 32 nt, Human
ccccaugccaaucuccgucagcucuuucugug

SEQ ID NO: 105214 - RNA, 20 nt, Human
ccccaugccaauguccaggu

SEQ ID NO: 105215 - RNA, 32 nt, Human
ccccaugccacguuccacaguugccaccaccu

SEQ ID NO: 105216 - RNA, 21 nt, Human
ccccaugccagagccucuccc

SEQ ID NO: 105217 - RNA, 32 nt, Human
ccccaugcccacagcccuaugccaucaauggg

SEQ ID NO: 105218 - RNA, 32 nt, Human
ccccaugcccaccugccugacccuccacugcc

SEQ ID NO: 105219 - RNA, 32 nt, Human
ccccaugcccagcuaauuuuuguauuuuuagg

SEQ ID NO: 105220 - RNA, 32 nt, Human
ccccaugcccuccccagccucucccagcacaa

SEQ ID NO: 105221 - RNA, 32 nt, Human
ccccaugcccugcacagcccgccugagguuug

SEQ ID NO: 105222 - RNA, 32 nt, Human
ccccaugccuguccagccugggcagccaggcu

SEQ ID NO: 105223 - RNA, 32 nt, Human
ccccaugcggccaagacuuaagauagcagaca

SEQ ID NO: 105224 - RNA, 18 nt, Human
ccccaugcucccuucucu

SEQ ID NO: 105225 - RNA, 31 nt, Human
ccccaugcuccucucccaccuguguccuucu

SEQ ID NO: 105226 - RNA, 32 nt, Human
ccccaugcucggcuuccucacauucaggagcc

SEQ ID NO: 105227 - RNA, 23 nt, Human
ccccaugcucuccucccucagcc

SEQ ID NO: 105228 - RNA, 32 nt, Human
ccccaugcugaaccccuucaucugcagccuga

SEQ ID NO: 105229 - RNA, 32 nt, Human
ccccaugcuguuguccccaugcugccuauuuu

SEQ ID NO: 105230 - RNA, 32 nt, Human
ccccaugcuuugucucccuccugcugcuauug

SEQ ID NO: 105231 - RNA, 32 nt, Human
ccccauggaacagcccugcacgcccaggauga

SEQ ID NO: 105232 - RNA, 29 nt, Human
ccccauggaggaggaggagggggcggugg

SEQ ID NO: 105233 - RNA, 32 nt, Human
ccccauggauccucuggcugggaagccacuga

SEQ ID NO: 105234 - RNA, 32 nt, Human
ccccauggauccuuaaccuggcagcccguuuu

SEQ ID NO: 105235 - RNA, 32 nt, Human
ccccauggcagugcugccucuuguaggugcug

SEQ ID NO: 105236 - RNA, 32 nt, Human
ccccauggcauccacaccaagaggguguugug

SEQ ID NO: 105237 - RNA, 32 nt, Human
ccccauggcucaccaaaaugugcucaauacug

SEQ ID NO: 105238 - RNA, 32 nt, Human
ccccauggcucaccaaaaugugcucaauuuug

SEQ ID NO: 105239 - RNA, 18 nt, Human
ccccauggcugccucuga

SEQ ID NO: 105240 - RNA, 20 nt, Human
ccccauggcugcugugagcc

SEQ ID NO: 105241 - RNA, 32 nt, Human
ccccauggcuggccugggcuucucccuacccu

SEQ ID NO: 105242 - RNA, 18 nt, Human
ccccauggcuggcugcug

SEQ ID NO: 105243 - RNA, 21 nt, Human
ccccauggcuucucccggggc

SEQ ID NO: 105244 - RNA, 32 nt, Human
ccccaugggaggcacauuagcuaguggcaagu

SEQ ID NO: 105245 - RNA, 20 nt, Human
ccccaugggcuccugccccu

SEQ ID NO: 105246 - RNA, 32 nt, Human
ccccaugggcuggguacaggauauccuccuac

SEQ ID NO: 105247 - RNA, 18 nt, Human
ccccaugggcuguguccu

SEQ ID NO: 105248 - RNA, 32 nt, Human
ccccaugggguccuguguagccuuuggccacg

SEQ ID NO: 105249 - RNA, 32 nt, Human
ccccauggucaaggguguccugccugccuggg

SEQ ID NO: 105250 - RNA, 32 nt, Human
ccccauguaaccaccaaccaggucaaaucugg

SEQ ID NO: 105251 - RNA, 32 nt, Human
ccccauguagaaaagggaauguggggagggcg

SEQ ID NO: 105252 - RNA, 32 nt, Human
ccccauguagaaggugcaccuccugggagcag

SEQ ID NO: 105253 - RNA, 17 nt, Human
ccccaugucacccagaa

SEQ ID NO: 105254 - RNA, 32 nt, Human
ccccaugucauccaggcuggucuggaacuccu

SEQ ID NO: 105255 - RNA, 32 nt, Human
ccccaugucaugcccaacagaaaggucaagcu

SEQ ID NO: 105256 - RNA, 32 nt, Human
ccccauguccagcuaauuuuuauauuuucgcu

SEQ ID NO: 105257 - RNA, 32 nt, Human
ccccauguccagcuaauuuuuauauuuuuagu

SEQ ID NO: 105258 - RNA, 32 nt, Human
ccccaugucccgcaccaccauugccgccagca

SEQ ID NO: 105259 - RNA, 32 nt, Human
ccccaugugcaggacuccaagggcuuugcacu

SEQ ID NO: 105260 - RNA, 18 nt, Human
ccccaugugccuaacuca

SEQ ID NO: 105261 - RNA, 32 nt, Human
ccccaugugcugucacugacucuccuugggac

SEQ ID NO: 105262 - RNA, 32 nt, Human
ccccauguggaacccaaggaugcagcugcucu

SEQ ID NO: 105263 - RNA, 32 nt, Human
ccccauguguaaauguguccacacaaccacau

SEQ ID NO: 105264 - RNA, 22 nt, Human
ccccaugugugacccuugucau

SEQ ID NO: 105265 - RNA, 32 nt, Human
ccccaugugugaggaagcaggagucagccacc

SEQ ID NO: 105266 - RNA, 32 nt, Human
ccccauguuacaaaugaagaaacugaggcuca

SEQ ID NO: 105267 - RNA, 32 nt, Human
ccccauguucucucuugcaauggccuguucua

SEQ ID NO: 105268 - RNA, 23 nt, Human
ccccauguugcccuaacucugaa

SEQ ID NO: 105269 - RNA, 32 nt, Human
ccccauguuggccaggcuggucucaaacuccu

SEQ ID NO: 105270 - RNA, 32 nt, Human
ccccauguuggccaggcuggucucaaacucua

SEQ ID NO: 105271 - RNA, 32 nt, Human
ccccauguuggccaggcuggucucgaacuccu

SEQ ID NO: 105272 - RNA, 32 nt, Human
ccccauuaaaaaucaaggaauuaggggucggg

SEQ ID NO: 105273 - RNA, 32 nt, Human
ccccauuacccaaaauacaaaaacagagaacu

SEQ ID NO: 105274 - RNA, 20 nt, Human
ccccauuacuagcgaucugu

SEQ ID NO: 105275 - RNA, 18 nt, Human
ccccauuacugucaccca

SEQ ID NO: 105276 - RNA, 32 nt, Human
ccccauuagacaccugcuccuccaagccuggu

SEQ ID NO: 105277 - RNA, 24 nt, Human
ccccauuaggccaggaucugcuga

SEQ ID NO: 105278 - RNA, 32 nt, Human
ccccauuaggggagacagagagagugaaugga

SEQ ID NO: 105279 - RNA, 32 nt, Human
ccccauuagugcucucucugccuggaucccgg

SEQ ID NO: 105280 - RNA, 32 nt, Human
ccccauuauuuaagcauuugggggucucacuu

SEQ ID NO: 105281 - RNA, 32 nt, Human
ccccauucacacacaccggcacuuucauaccc

SEQ ID NO: 105282 - RNA, 32 nt, Human
ccccauucagucuugggaggugagagagccag

SEQ ID NO: 105283 - RNA, 32 nt, Human
ccccauuccacagccccagccccagccccugg

SEQ ID NO: 105284 - RNA, 32 nt, Human
ccccauuccaccacaucagggucuccacugug

SEQ ID NO: 105285 - RNA, 20 nt, Human
ccccauuccaggggcgccag

SEQ ID NO: 105286 - RNA, 23 nt, Human
ccccauucccaucacccccucca

SEQ ID NO: 105287 - RNA, 22 nt, Human
ccccauuccccaccugguccuc

SEQ ID NO: 105288 - RNA, 23 nt, Human
ccccauucccggccaacucucca

SEQ ID NO: 105289 - RNA, 21 nt, Human
ccccauucccucccucuguca

SEQ ID NO: 105290 - RNA, 32 nt, Human
ccccauuccuccuccucucugagggacuggag

SEQ ID NO: 105291 - RNA, 32 nt, Human
ccccauucuccaucuugggggcucagaucuug

SEQ ID NO: 105292 - RNA, 32 nt, Human
ccccauucuccucuggaaagccuucccgaucc

SEQ ID NO: 105293 - RNA, 32 nt, Human
ccccauucugaccccugacucuuccagccaga

SEQ ID NO: 105294 - RNA, 32 nt, Human
ccccauucugcuggcugagacaggagggguau

SEQ ID NO: 105295 - RNA, 23 nt, Human
ccccauucuggggccuggucccc

SEQ ID NO: 105296 - RNA, 19 nt, Human
ccccauucugucccccuca

SEQ ID NO: 105297 - RNA, 22 nt, Human
ccccauucuuacuuugucccag

SEQ ID NO: 105298 - RNA, 32 nt, Human
ccccauugaaguuugccgguccaaacugucca

SEQ ID NO: 105299 - RNA, 32 nt, Human
ccccauugcccaccuccacuucccauuggcuc

SEQ ID NO: 105300 - RNA, 32 nt, Human
ccccauugcccagcuuuugccugcacucuugc

SEQ ID NO: 105301 - RNA, 32 nt, Human
ccccauugcucuucuggaaggagagcucgcug

SEQ ID NO: 105302 - RNA, 32 nt, Human
ccccauuggccacugguggaggugcacuggaa

SEQ ID NO: 105303 - RNA, 32 nt, Human
ccccauugggagagagcagggcauccuggcau

SEQ ID NO: 105304 - RNA, 32 nt, Human
ccccauuggucaccagagcaacugcaugucuu

SEQ ID NO: 105305 - RNA, 32 nt, Human
ccccauuguacuccagccuggggaacaagaac

SEQ ID NO: 105306 - RNA, 32 nt, Human
ccccauuguccacuuugccucugcugcucugc

SEQ ID NO: 105307 - RNA, 32 nt, Human
ccccauuguccagaugggcacugcuguggagu

SEQ ID NO: 105308 - RNA, 32 nt, Human
ccccauuguccucaccaguacagcauguccug

SEQ ID NO: 105309 - RNA, 18 nt, Human
ccccauuguucugcugcc

SEQ ID NO: 105310 - RNA, 32 nt, Human
ccccauuucacuccagccugggcgacaagagu

SEQ ID NO: 105311 - RNA, 32 nt, Human
ccccauuuccccucaacucuccaggcuucagc

SEQ ID NO: 105312 - RNA, 32 nt, Human
ccccauuuccuagcggcccccaccuccccacu

SEQ ID NO: 105313 - RNA, 23 nt, Human
ccccauuuccuucaguaccaguc

SEQ ID NO: 105314 - RNA, 19 nt, Human
ccccauuucuccuagccug

SEQ ID NO: 105315 - RNA, 19 nt, Human
ccccauuucucuccucaca

SEQ ID NO: 105316 - RNA, 32 nt, Human
ccccauuucuuccccaccaaccccuccaaugc

SEQ ID NO: 105317 - RNA, 32 nt, Human
ccccauuucuuuugugguaucucccccuacca

SEQ ID NO: 105318 - RNA, 32 nt, Human
ccccauuuggacccuucucugcccuuacauuu

SEQ ID NO: 105319 - RNA, 32 nt, Human
ccccauuugguccccuggacugucuuuguuga

SEQ ID NO: 105320 - RNA, 23 nt, Human
ccccauuuguagcauggcaccag

SEQ ID NO: 105321 - RNA, 32 nt, Human
ccccauuuuccuguuucagcauguuauauucu

SEQ ID NO: 105322 - RNA, 32 nt, Human
ccccauuuugaugucccguacccuccaccccc

SEQ ID NO: 105323 - RNA, 22 nt, Human
ccccauuuuucacaugauacca

SEQ ID NO: 105324 - RNA, 32 nt, Human
ccccauuuuucucuuucuuguagaaggagaga

SEQ ID NO: 105325 - RNA, 32 nt, Human
cccccaaaaauacaaaaauuagcugggcgugg

SEQ ID NO: 105326 - RNA, 31 nt, Human
cccccaaaaguguccucuaguccagacuccc

SEQ ID NO: 105327 - RNA, 32 nt, Human
cccccaaacagucaugccaacugugaaggaau

SEQ ID NO: 105328 - RNA, 32 nt, Human
cccccaaacccccauucuguccuaccuuuaau

SEQ ID NO: 105329 - RNA, 22 nt, Human
cccccaaacuggagggggcaug

SEQ ID NO: 105330 - RNA, 32 nt, Human
cccccaaagggugguauuaaaagaggaaaaag

SEQ ID NO: 105331 - RNA, 32 nt, Human
cccccaaagugcugggauuaacgggugugagc

SEQ ID NO: 105332 - RNA, 32 nt, Human
cccccaaagugcugggauuacaggcaugagcc

SEQ ID NO: 105333 - RNA, 32 nt, Human
cccccaaagugcugggauuacaggcgugagcc

SEQ ID NO: 105334 - RNA, 32 nt, Human
cccccaaagugcugggauuacagguugcuaug

SEQ ID NO: 105335 - RNA, 32 nt, Human
cccccaaagugcugggauuccaggugugagcc

SEQ ID NO: 105336 - RNA, 32 nt, Human
cccccaaagugcugggauugugggcaugagcu

SEQ ID NO: 105337 - RNA, 32 nt, Human
cccccaaauagcccuggcccacacagaaaaac

SEQ ID NO: 105338 - RNA, 32 nt, Human
cccccaaaugaggaaauuaguauggaauggag

SEQ ID NO: 105339 - RNA, 32 nt, Human
cccccaaaugccuuaauuuuguggacuguuua

SEQ ID NO: 105340 - RNA, 32 nt, Human
cccccaaauugauguagggagaggagggcuuu

SEQ ID NO: 105341 - RNA, 32 nt, Human
cccccaaauugcugggauuacaggcgugagcc

SEQ ID NO: 105342 - RNA, 32 nt, Human
cccccaaauugcugggauuacaggcgugaguc

SEQ ID NO: 105343 - RNA, 25 nt, Human
cccccaacaacuccaggcccugccc

SEQ ID NO: 105344 - RNA, 23 nt, Human
cccccaacaagaacugcaucugg

SEQ ID NO: 105345 - RNA, 23 nt, Human
cccccaacacaccugccccgccu

SEQ ID NO: 105346 - RNA, 21 nt, Human
cccccaacaccaccaccaccc

SEQ ID NO: 105347 - RNA, 22 nt, Human
cccccaacaccaccccuugccc

SEQ ID NO: 105348 - RNA, 21 nt, Human
cccccaacaccccgccugccu

SEQ ID NO: 105349 - RNA, 21 nt, Human
cccccaacaccuccauugccu

SEQ ID NO: 105350 - RNA, 22 nt, Human
cccccaacacgguguccugcca

SEQ ID NO: 105351 - RNA, 24 nt, Human
cccccaacacuguccacacugccc

SEQ ID NO: 105352 - RNA, 23 nt, Human
cccccaacacuucuccugcccug

SEQ ID NO: 105353 - RNA, 23 nt, Human
cccccaacagcuggacccugacc

SEQ ID NO: 105354 - RNA, 32 nt, Human
cccccaaccacccaccagaggaguucuggucc

SEQ ID NO: 105355 - RNA, 32 nt, Human
cccccaaccagcugcccccagcucucccugcc

SEQ ID NO: 105356 - RNA, 22 nt, Human
cccccaaccagggcacccaccc

SEQ ID NO: 105357 - RNA, 32 nt, Human
cccccaacccagcgucaggcugggacacgcca

SEQ ID NO: 105358 - RNA, 32 nt, Human
cccccaaccccaagccugauccccaccggaga

SEQ ID NO: 105359 - RNA, 32 nt, Human
cccccaaccccagccgcucggaggccccaaag

SEQ ID NO: 105360 - RNA, 22 nt, Human
cccccaaccccauccccaccuc

SEQ ID NO: 105361 - RNA, 32 nt, Human
cccccaacccccagagcuuggagucugggccc

SEQ ID NO: 105362 - RNA, 19 nt, Human
cccccaacccccaucccca

SEQ ID NO: 105363 - RNA, 17 nt, Human
cccccaaccccuccuca

SEQ ID NO: 105364 - RNA, 32 nt, Human
cccccaaccccuggcccugcuuuuccucgugc

SEQ ID NO: 105365 - RNA, 32 nt, Human
cccccaaccccuucacaaaccccaacaccccu

SEQ ID NO: 105366 - RNA, 24 nt, Human
cccccaacccgggaaccccugccc

SEQ ID NO: 105367 - RNA, 32 nt, Human
cccccaacccuccaccagaguagguaggaugu

SEQ ID NO: 105368 - RNA, 21 nt, Human
cccccaaccgagccccgcgcc

SEQ ID NO: 105369 - RNA, 32 nt, Human
cccccaaccuaggaggaggaccagcccgguuc

SEQ ID NO: 105370 - RNA, 32 nt, Human
cccccaaccuccaggagcuaguggaggggugu

SEQ ID NO: 105371 - RNA, 23 nt, Human
cccccaaccucccacuccucccu

SEQ ID NO: 105372 - RNA, 22 nt, Human
cccccaacgccaggcccugccc

SEQ ID NO: 105373 - RNA, 32 nt, Human
cccccaacgugucuaggagagcuuucucccua

SEQ ID NO: 105374 - RNA, 32 nt, Human
cccccaacuagaccucacccuccuggauggac

SEQ ID NO: 105375 - RNA, 32 nt, Human
cccccaacucaggcccucucgcugccccuggc

SEQ ID NO: 105376 - RNA, 20 nt, Human
cccccaacucaggguccucc

SEQ ID NO: 105377 - RNA, 32 nt, Human
cccccaacucccaccccucugccaucacccag

SEQ ID NO: 105378 - RNA, 32 nt, Human
cccccaacucccagcccugccuguggcccguu

SEQ ID NO: 105379 - RNA, 20 nt, Human
cccccaacucugcgccccua

SEQ ID NO: 105380 - RNA, 32 nt, Human
cccccaacuggagugcagacaagagcacugau

SEQ ID NO: 105381 - RNA, 18 nt, Human
cccccaacuuuccucccu

SEQ ID NO: 105382 - RNA, 32 nt, Human
cccccaagaaacuaguaucucuggccuccugg

SEQ ID NO: 105383 - RNA, 32 nt, Human
cccccaagaaugcaggcucugccuggcacgca

SEQ ID NO: 105384 - RNA, 32 nt, Human
cccccaagacaagagacuggaggcagaguuga

SEQ ID NO: 105385 - RNA, 32 nt, Human
cccccaagcccgaggaggacagccuggggaug

SEQ ID NO: 105386 - RNA, 32 nt, Human
cccccaaggaauggguguguuuguagagagaa

SEQ ID NO: 105387 - RNA, 32 nt, Human
cccccaaggcggagcuugcagugagccgagau

SEQ ID NO: 105388 - RNA, 32 nt, Human
cccccaaggggcaggaggaaugcaggagcagg

SEQ ID NO: 105389 - RNA, 32 nt, Human
cccccaaggggcccugcccaccaccaccuucc

SEQ ID NO: 105390 - RNA, 24 nt, Human
cccccaaggucuacucccuccuca

SEQ ID NO: 105391 - RNA, 32 nt, Human
cccccaaguagcugagauuacaggugugugcc

SEQ ID NO: 105392 - RNA, 32 nt, Human
cccccaaguccccguggagguucuguauuuua

SEQ ID NO: 105393 - RNA, 32 nt, Human
cccccaagugccugccccuccccagaguauua

SEQ ID NO: 105394 - RNA, 32 nt, Human
cccccaaguguaacuccagcacugugagguuu

SEQ ID NO: 105395 - RNA, 32 nt, Human
cccccaagugucuccaggaacuggacguuggg

SEQ ID NO: 105396 - RNA, 32 nt, Human
cccccaaguguuuaauaacuggcauuaagcuu

SEQ ID NO: 105397 - RNA, 32 nt, Human
cccccaaguucaagaccaaaucuuccagcugc

SEQ ID NO: 105398 - RNA, 32 nt, Human
cccccaauaagcaugagggcugugcugaagag

SEQ ID NO: 105399 - RNA, 22 nt, Human
cccccaaucccccauagcucug

SEQ ID NO: 105400 - RNA, 32 nt, Human
cccccaaugccugcccaucccaccccagcauc

SEQ ID NO: 105401 - RNA, 22 nt, Human
cccccaauugggagcccugccc

SEQ ID NO: 105402 - RNA, 32 nt, Human
cccccacaaauacacuucuucuuuaggcauug

SEQ ID NO: 105403 - RNA, 24 nt, Human
cccccacaagccugagugcagugg

SEQ ID NO: 105404 - RNA, 32 nt, Human
cccccacaaguauguuuuugugucuuaagaua

SEQ ID NO: 105405 - RNA, 22 nt, Human
cccccacaaucagcucuugugg

SEQ ID NO: 105406 - RNA, 18 nt, Human
cccccacaccccucccca

SEQ ID NO: 105407 - RNA, 32 nt, Human
cccccacagaccugcacauuguugucacccac

SEQ ID NO: 105408 - RNA, 24 nt, Human
cccccacagagcucccaugacaua

SEQ ID NO: 105409 - RNA, 32 nt, Human
cccccacagccagagacauuuccugaagacau

SEQ ID NO: 105410 - RNA, 32 nt, Human
cccccacagccucuuccucccuucccuccccu

SEQ ID NO: 105411 - RNA, 32 nt, Human
cccccacagccugucugugucuguccucugca

SEQ ID NO: 105412 - RNA, 32 nt, Human
cccccacaggaaacuucgcagugugcaccagg

SEQ ID NO: 105413 - RNA, 23 nt, Human
cccccacagggacccccaccccu

SEQ ID NO: 105414 - RNA, 32 nt, Human
cccccacagugcugggauuacaggcgugagcc

SEQ ID NO: 105415 - RNA, 32 nt, Human
cccccacauagcugggacuacaggugcuuaca

SEQ ID NO: 105416 - RNA, 25 nt, Human
cccccacaucgcccccaacuucgga

SEQ ID NO: 105417 - RNA, 22 nt, Human
cccccacaucucuauguacaua

SEQ ID NO: 105418 - RNA, 20 nt, Human
cccccaccaaccaccaccuc

SEQ ID NO: 105419 - RNA, 32 nt, Human
cccccaccaaccagcccccagccacuguugcu

SEQ ID NO: 105420 - RNA, 19 nt, Human
cccccaccaaccccaccuc

SEQ ID NO: 105421 - RNA, 32 nt, Human
cccccaccaacgggugcaucacagccccucac

SEQ ID NO: 105422 - RNA, 28 nt, Human
cccccaccaagugcggacgcaucgagcu

SEQ ID NO: 105423 - RNA, 32 nt, Human
cccccaccaaguuucagggcccuggauuguuc

SEQ ID NO: 105424 - RNA, 32 nt, Human
cccccaccaccaggaccauguagggugcaguc

SEQ ID NO: 105425 - RNA, 32 nt, Human
cccccaccagcaccucagugggggauacugca

SEQ ID NO: 105426 - RNA, 32 nt, Human
cccccaccagccccagcagcugcuuuagaaac

SEQ ID NO: 105427 - RNA, 32 nt, Human
cccccaccagcccucucgcuucuaacacaggg

SEQ ID NO: 105428 - RNA, 32 nt, Human
cccccaccagcuccugugggccugagugcugc

SEQ ID NO: 105429 - RNA, 32 nt, Human
cccccaccagcucuccccacagggccccucag

SEQ ID NO: 105430 - RNA, 32 nt, Human
cccccaccaggggaaggaaggagggcacauua

SEQ ID NO: 105431 - RNA, 22 nt, Human
cccccaccaucuuggggaccua

SEQ ID NO: 105432 - RNA, 32 nt, Human
cccccaccaugccguggccccugcugcugcug

SEQ ID NO: 105433 - RNA, 32 nt, Human
cccccaccauucgauuugaucuaccucuaagc

SEQ ID NO: 105434 - RNA, 21 nt, Human
cccccacccaaaaucuuuccc

SEQ ID NO: 105435 - RNA, 32 nt, Human
cccccacccacuccaccagcacuggcacugag

SEQ ID NO: 105436 - RNA, 32 nt, Human
cccccacccagcugcccucagccuucagccuc

SEQ ID NO: 105437 - RNA, 32 nt, Human
cccccacccaggcugaguaucaucuccugggc

SEQ ID NO: 105438 - RNA, 32 nt, Human
cccccaccccacccucuuugucucagcguguu

SEQ ID NO: 105439 - RNA, 32 nt, Human
cccccaccccacggacguguugcagugauauc

SEQ ID NO: 105440 - RNA, 19 nt, Human
cccccaccccagagccugg

SEQ ID NO: 105441 - RNA, 21 nt, Human
cccccacccccacccaccucu

SEQ ID NO: 105442 - RNA, 32 nt, Human
cccccacccccaccccugcccuccauaggcau

SEQ ID NO: 105443 - RNA, 32 nt, Human
cccccacccccagaugaacccagaggagcuua

SEQ ID NO: 105444 - RNA, 32 nt, Human
cccccacccccagcuacccauaggggcugcag

SEQ ID NO: 105445 - RNA, 21 nt, Human
cccccaccccccgacguccuc

SEQ ID NO: 105446 - RNA, 23 nt, Human
cccccaccccccugcccuccuca

SEQ ID NO: 105447 - RNA, 32 nt, Human
cccccacccccuaacacuaucucuucuauccu

SEQ ID NO: 105448 - RNA, 32 nt, Human
cccccaccccgauuuagaccugugagugcugc

SEQ ID NO: 105449 - RNA, 22 nt, Human
cccccaccccgucuggggccug

SEQ ID NO: 105450 - RNA, 32 nt, Human
cccccaccccuccacuggccagccugggggug

SEQ ID NO: 105451 - RNA, 32 nt, Human
cccccaccccugacagcccccaccccauggcu

SEQ ID NO: 105452 - RNA, 32 nt, Human
cccccaccccuugagcaccauguucccccgcc

SEQ ID NO: 105453 - RNA, 19 nt, Human
cccccaccccuugcucuca

SEQ ID NO: 105454 - RNA, 18 nt, Human
cccccacccggcugccac

SEQ ID NO: 105455 - RNA, 22 nt, Human
cccccacccucaccccaucucu

SEQ ID NO: 105456 - RNA, 20 nt, Human
cccccacccuccagaggggu

SEQ ID NO: 105457 - RNA, 22 nt, Human
cccccacccugagcccgcagug

SEQ ID NO: 105458 - RNA, 32 nt, Human
cccccacccugcacuuuccuccaccucccacc

SEQ ID NO: 105459 - RNA, 32 nt, Human
cccccacccuggggaagcguugacuacugucc

SEQ ID NO: 105460 - RNA, 22 nt, Human
cccccacccuguucucuccuua

SEQ ID NO: 105461 - RNA, 25 nt, Human
cccccacccuucucacacucugccc

SEQ ID NO: 105462 - RNA, 32 nt, Human
cccccacccuuuccccgggccugcugugcugc

SEQ ID NO: 105463 - RNA, 20 nt, Human
cccccacccuuuuuuccuua

SEQ ID NO: 105464 - RNA, 32 nt, Human
cccccaccgcaaccuccaucucccggguucaa

SEQ ID NO: 105465 - RNA, 32 nt, Human
cccccaccgggccggcccugcccgccgccgga

SEQ ID NO: 105466 - RNA, 21 nt, Human
cccccaccguggugccccuca

SEQ ID NO: 105467 - RNA, 32 nt, Human
cccccaccucagcugggaccccaaaccuccuc

SEQ ID NO: 105468 - RNA, 32 nt, Human
cccccaccuccacccucaacccaucuuccuag

SEQ ID NO: 105469 - RNA, 21 nt, Human
cccccaccuccugcaauuaaa

SEQ ID NO: 105470 - RNA, 32 nt, Human
cccccaccucuccuggaccuagcaggcccuca

SEQ ID NO: 105471 - RNA, 32 nt, Human
cccccaccucuccugugguacuggggucccua

SEQ ID NO: 105472 - RNA, 24 nt, Human
cccccaccugaagucacugucucc

SEQ ID NO: 105473 - RNA, 32 nt, Human
cccccaccugaagucacugucuccccagcagu

SEQ ID NO: 105474 - RNA, 32 nt, Human
cccccaccugaccaaaugcuccuaaagccuuu

SEQ ID NO: 105475 - RNA, 32 nt, Human
cccccaccugccccaaccuccaccccucucug

SEQ ID NO: 105476 - RNA, 23 nt, Human
cccccaccuggaagugcaaggug

SEQ ID NO: 105477 - RNA, 20 nt, Human
cccccaccuggugguccuua

SEQ ID NO: 105478 - RNA, 18 nt, Human
cccccaccuguguuccuc

SEQ ID NO: 105479 - RNA, 23 nt, Human
cccccaccuuacccuuauuccuc

SEQ ID NO: 105480 - RNA, 22 nt, Human
cccccaccuucaccccuccccg

SEQ ID NO: 105481 - RNA, 19 nt, Human
cccccaccuucccugccca

SEQ ID NO: 105482 - RNA, 21 nt, Human
cccccaccuuggucccucuca

SEQ ID NO: 105483 - RNA, 20 nt, Human
cccccaccuugucacccuca

SEQ ID NO: 105484 - RNA, 32 nt, Human
cccccaccuuucaccagagaagaggacguugu

SEQ ID NO: 105485 - RNA, 23 nt, Human
cccccaccuuucgccccugccca

SEQ ID NO: 105486 - RNA, 32 nt, Human
cccccaccuuuuccuuuuccucuuagacuucu

SEQ ID NO: 105487 - RNA, 22 nt, Human
cccccaccuuuuggccucuuca

SEQ ID NO: 105488 - RNA, 24 nt, Human
cccccacgacuuccggccccgccc

SEQ ID NO: 105489 - RNA, 24 nt, Human
cccccacgcaggaccaacuaccuc

SEQ ID NO: 105490 - RNA, 32 nt, Human
cccccacgcucagcuaacguugcccucgcuca

SEQ ID NO: 105491 - RNA, 32 nt, Human
cccccacgcuucuggagguggggagggccucu

SEQ ID NO: 105492 - RNA, 32 nt, Human
cccccacggagcuuugugugagggaucucauc

SEQ ID NO: 105493 - RNA, 32 nt, Human
cccccacgggccugagccugagagcucagagg

SEQ ID NO: 105494 - RNA, 32 nt, Human
cccccacuaaacugagcugugaaauagaucau

SEQ ID NO: 105495 - RNA, 32 nt, Human
cccccacucacccucaccuucucccccgacag

SEQ ID NO: 105496 - RNA, 32 nt, Human
cccccacuccaguccacuccugaccccucucc

SEQ ID NO: 105497 - RNA, 32 nt, Human
cccccacuccagugguggaggugcagucgcug

SEQ ID NO: 105498 - RNA, 19 nt, Human
cccccacuccucugcugcu

SEQ ID NO: 105499 - RNA, 28 nt, Human
cccccacucgaugcugccucaucuuccu

SEQ ID NO: 105500 - RNA, 32 nt, Human
cccccacucucaccccaaacagcccauucuuc

SEQ ID NO: 105501 - RNA, 20 nt, Human
cccccacucuccuuuaggga

SEQ ID NO: 105502 - RNA, 32 nt, Human
cccccacugagaacuaugcaauggaguuucau

SEQ ID NO: 105503 - RNA, 32 nt, Human
cccccacugagacagccugagauauggccuca

SEQ ID NO: 105504 - RNA, 22 nt, Human
cccccacugcacccccucccca

SEQ ID NO: 105505 - RNA, 32 nt, Human
cccccacugcagcccccaccuuuguguccuag

SEQ ID NO: 105506 - RNA, 32 nt, Human
cccccacugcaggcuguggcuccaggggcccg

SEQ ID NO: 105507 - RNA, 19 nt, Human
cccccacugccacucagaa

SEQ ID NO: 105508 - RNA, 32 nt, Human
cccccacugccacuucucugauguguuccuca

SEQ ID NO: 105509 - RNA, 32 nt, Human
cccccacugcucaauggacacccccagcccag

SEQ ID NO: 105510 - RNA, 32 nt, Human
cccccacugcuuuuuauuuguacagcaucauu

SEQ ID NO: 105511 - RNA, 32 nt, Human
cccccacuggacugaccugguccacagggcac

SEQ ID NO: 105512 - RNA, 32 nt, Human
cccccacuggacugcuuccuccuuagccccac

SEQ ID NO: 105513 - RNA, 32 nt, Human
cccccacuggcugugggcucccuuccucccaa

SEQ ID NO: 105514 - RNA, 26 nt, Human
cccccacugggccugcuggccucccu

SEQ ID NO: 105515 - RNA, 32 nt, Human
cccccacugguucauuuaacccucugucucgg

SEQ ID NO: 105516 - RNA, 32 nt, Human
cccccacuguaaccugaccugaccuguggcgg

SEQ ID NO: 105517 - RNA, 19 nt, Human
cccccacugugccccuccu

SEQ ID NO: 105518 - RNA, 32 nt, Human
cccccacuuagcccuucucuccuugcagccua

SEQ ID NO: 105519 - RNA, 32 nt, Human
cccccacuucacccaccuuccccaccaucugu

SEQ ID NO: 105520 - RNA, 32 nt, Human
cccccacuuccaggcacucucagucucuuuca

SEQ ID NO: 105521 - RNA, 32 nt, Human
cccccacuuccccacaggugaaaguuuuucug

SEQ ID NO: 105522 - RNA, 32 nt, Human
cccccacuuuccccaucucaucacagauccag

SEQ ID NO: 105523 - RNA, 32 nt, Human
cccccacuuugccucaggcauuuucuacucag

SEQ ID NO: 105524 - RNA, 32 nt, Human
cccccagaaaggagagugaaacucuuauuugc

SEQ ID NO: 105525 - RNA, 32 nt, Human
cccccagaaaugucccuccucagaaacaggcu

SEQ ID NO: 105526 - RNA, 32 nt, Human
cccccagaaccagcucaccuggccagaguggg

SEQ ID NO: 105527 - RNA, 32 nt, Human
cccccagacaagagacagggagacuggagccc

SEQ ID NO: 105528 - RNA, 32 nt, Human
cccccagacagcccuaccugugccagagagcu

SEQ ID NO: 105529 - RNA, 32 nt, Human
cccccagacucggccuccucuccugggacucg

SEQ ID NO: 105530 - RNA, 32 nt, Human
cccccagacuggagggagaaagcccuacaaag

SEQ ID NO: 105531 - RNA, 32 nt, Human
cccccagacuuuacaugacacagcuuuaucac

SEQ ID NO: 105532 - RNA, 32 nt, Human
cccccagagcaacguggacuuugaccugaugc

SEQ ID NO: 105533 - RNA, 32 nt, Human
cccccagagcaucugccccagguacaccuccc

SEQ ID NO: 105534 - RNA, 32 nt, Human
cccccagaggccaggagcucugcccuugaccu

SEQ ID NO: 105535 - RNA, 32 nt, Human
cccccagaguagcugggauuacaggcauguac

SEQ ID NO: 105536 - RNA, 32 nt, Human
cccccagauguucuucccuggguguugauggc

SEQ ID NO: 105537 - RNA, 18 nt, Human
cccccagauugcccccuc

SEQ ID NO: 105538 - RNA, 32 nt, Human
cccccagcaaaagaucuacauucuugcucaaa

SEQ ID NO: 105539 - RNA, 32 nt, Human
cccccagcaacgccccuccaaaccuccagccu

SEQ ID NO: 105540 - RNA, 32 nt, Human
cccccagcaaggugccuggggagacuugagca

SEQ ID NO: 105541 - RNA, 32 nt, Human
cccccagcacacacacauacaacacagaucau

SEQ ID NO: 105542 - RNA, 32 nt, Human
cccccagcacacacagguuggaaaagaguuua

SEQ ID NO: 105543 - RNA, 32 nt, Human
cccccagcacauccaggaguaaggauuccgac

SEQ ID NO: 105544 - RNA, 19 nt, Human
cccccagcaccguguggca

SEQ ID NO: 105545 - RNA, 32 nt, Human
cccccagcacuguccccaccuugcuagggccc

SEQ ID NO: 105546 - RNA, 32 nt, Human
cccccagcacuucagaggcaggagccuuuggg

SEQ ID NO: 105547 - RNA, 32 nt, Human
cccccagcacuucuugaugacugugugcccca

SEQ ID NO: 105548 - RNA, 23 nt, Human
cccccagcagcgagaacauccca

SEQ ID NO: 105549 - RNA, 32 nt, Human
cccccagccagcgcuccagccaaagcggcggc

SEQ ID NO: 105550 - RNA, 32 nt, Human
cccccagccagguccccaccaggccugucucc

SEQ ID NO: 105551 - RNA, 32 nt, Human
cccccagccauuccuucuuuccuuccugccuu

SEQ ID NO: 105552 - RNA, 21 nt, Human
cccccagccauugcccucccu

SEQ ID NO: 105553 - RNA, 32 nt, Human
cccccagcccaggagcucgugccuuacaugcu

SEQ ID NO: 105554 - RNA, 32 nt, Human
cccccagcccccaccucugccuccaggucuca

SEQ ID NO: 105555 - RNA, 18 nt, Human
cccccagccccccuuccc

SEQ ID NO: 105556 - RNA, 22 nt, Human
cccccagcccgucacccggggc

SEQ ID NO: 105557 - RNA, 18 nt, Human
cccccagcccugcacccu

SEQ ID NO: 105558 - RNA, 18 nt, Human
cccccagcccugccccuu

SEQ ID NO: 105559 - RNA, 20 nt, Human
cccccagcccugucccugcc

SEQ ID NO: 105560 - RNA, 25 nt, Human
cccccagccgcccccaacccugccc

SEQ ID NO: 105561 - RNA, 32 nt, Human
cccccagccguccagaguaccaugaagaauua

SEQ ID NO: 105562 - RNA, 21 nt, Human
cccccagccucaccucugccc

SEQ ID NO: 105563 - RNA, 32 nt, Human
cccccagccuccagacccucuaaugcccucag

SEQ ID NO: 105564 - RNA, 22 nt, Human
cccccagccugcaagagaggca

SEQ ID NO: 105565 - RNA, 18 nt, Human
cccccagccugcagcccu

SEQ ID NO: 105566 - RNA, 32 nt, Human
cccccagccugcugcccccagcuuucuacaga

SEQ ID NO: 105567 - RNA, 32 nt, Human
cccccagccuggccagugcucuucccacccug

SEQ ID NO: 105568 - RNA, 19 nt, Human
cccccagccuggguccccu

SEQ ID NO: 105569 - RNA, 32 nt, Human
cccccagccuuagugggcucagcagggcccac

SEQ ID NO: 105570 - RNA, 32 nt, Human
cccccagccuugcccagcuuucaaaggacaaa

SEQ ID NO: 105571 - RNA, 31 nt, Human
cccccagcgacguucucagccagcgcucgca

SEQ ID NO: 105572 - RNA, 32 nt, Human
cccccagcgcuuguccugcuucacccuacccc

SEQ ID NO: 105573 - RNA, 20 nt, Human
cccccagcggcucccucccu

SEQ ID NO: 105574 - RNA, 19 nt, Human
cccccagcuaccagcuaag

SEQ ID NO: 105575 - RNA, 32 nt, Human
cccccagcuagaccucacccucuuggguagau

SEQ ID NO: 105576 - RNA, 21 nt, Human
cccccagcucaagcccugccc

SEQ ID NO: 105577 - RNA, 32 nt, Human
cccccagcucagggugaugccugcugccuuug

SEQ ID NO: 105578 - RNA, 18 nt, Human
cccccagcucgggaccug

SEQ ID NO: 105579 - RNA, 28 nt, Human
cccccagcucugacuccaggcccugucc

SEQ ID NO: 105580 - RNA, 25 nt, Human
cccccagcucugccgacacuugacc

SEQ ID NO: 105581 - RNA, 24 nt, Human
cccccagcuguggguacagagagg

SEQ ID NO: 105582 - RNA, 32 nt, Human
cccccagcugugguggacacagcugugcuucc

SEQ ID NO: 105583 - RNA, 32 nt, Human
cccccaggaagggggaaauggggcauuugggg

SEQ ID NO: 105584 - RNA, 32 nt, Human
cccccaggacaccaccucccacccacagaccu

SEQ ID NO: 105585 - RNA, 24 nt, Human
cccccaggacugagcccuagaggc

SEQ ID NO: 105586 - RNA, 32 nt, Human
cccccaggagacauaccaggaggccgaguggc

SEQ ID NO: 105587 - RNA, 32 nt, Human
cccccaggagagagcuacugacuuguuaucau

SEQ ID NO: 105588 - RNA, 32 nt, Human
cccccaggaggagaugaccagugccuuggcca

SEQ ID NO: 105589 - RNA, 32 nt, Human
cccccaggaggaggaggaggacgagggccuag

SEQ ID NO: 105590 - RNA, 32 nt, Human
cccccaggaggggcucgacccacccacccucc

SEQ ID NO: 105591 - RNA, 32 nt, Human
cccccaggaugucggaggagaucaucacgccg

SEQ ID NO: 105592 - RNA, 32 nt, Human
cccccaggcagccccuccacacccaccgagca

SEQ ID NO: 105593 - RNA, 18 nt, Human
cccccaggccaccugcuc

SEQ ID NO: 105594 - RNA, 32 nt, Human
cccccaggcuaggagaggaaccccucccagca

SEQ ID NO: 105595 - RNA, 22 nt, Human
cccccaggcugaagugcagcgg

SEQ ID NO: 105596 - RNA, 22 nt, Human
cccccaggcugaagugcagugg

SEQ ID NO: 105597 - RNA, 32 nt, Human
cccccaggcugcaguauuuugggcaggcgcug

SEQ ID NO: 105598 - RNA, 22 nt, Human
cccccaggcuggaguacagugg

SEQ ID NO: 105599 - RNA, 22 nt, Human
cccccaggcuggagugcagugg

SEQ ID NO: 105600 - RNA, 32 nt, Human
cccccaggcugggccugucacuggcauaggaa

SEQ ID NO: 105601 - RNA, 32 nt, Human
cccccaggcuucagcccugggcucugagggga

SEQ ID NO: 105602 - RNA, 21 nt, Human
cccccaggcuugagugcaaug

SEQ ID NO: 105603 - RNA, 32 nt, Human
cccccagggaacacugggcgaugccuggggac

SEQ ID NO: 105604 - RNA, 22 nt, Human
cccccagggaaggcucuggugg

SEQ ID NO: 105605 - RNA, 30 nt, Human
cccccagggagccacagacagguauagccc

SEQ ID NO: 105606 - RNA, 32 nt, Human
cccccagggagccacagacagguauagcccua

SEQ ID NO: 105607 - RNA, 32 nt, Human
cccccagggauugcgugaaagaaacaauuguu

SEQ ID NO: 105608 - RNA, 32 nt, Human
cccccagggcccuggccauccugugggcucug

SEQ ID NO: 105609 - RNA, 32 nt, Human
cccccagggcugggcacuccuccccuccccuc

SEQ ID NO: 105610 - RNA, 32 nt, Human
cccccagggcugggugcccaccaugccccuuc

SEQ ID NO: 105611 - RNA, 32 nt, Human
cccccagggcuucugcaggcuucagccaucca

SEQ ID NO: 105612 - RNA, 32 nt, Human
cccccaggggaacaccccugcccagcuacuuu

SEQ ID NO: 105613 - RNA, 23 nt, Human
cccccagguagcaggacacucca

SEQ ID NO: 105614 - RNA, 32 nt, Human
cccccagguccccucuugcuguuggcugcaca

SEQ ID NO: 105615 - RNA, 32 nt, Human
cccccaggugcugggggcacagccccucccca

SEQ ID NO: 105616 - RNA, 32 nt, Human
cccccaguaccucccuccccuccccuccagca

SEQ ID NO: 105617 - RNA, 25 nt, Human
cccccaguaucgaaucuaucagcuu

SEQ ID NO: 105618 - RNA, 32 nt, Human
cccccaguaugagcacagugccuggaccugaa

SEQ ID NO: 105619 - RNA, 32 nt, Human
cccccagucaggaggccccacaggaggggcac

SEQ ID NO: 105620 - RNA, 32 nt, Human
cccccaguccagaggcugggcccaggugggug

SEQ ID NO: 105621 - RNA, 32 nt, Human
cccccagucccucccucuucaccuugcuccgu

SEQ ID NO: 105622 - RNA, 32 nt, Human
cccccaguccgugucuccccuaccucccucag

SEQ ID NO: 105623 - RNA, 32 nt, Human
cccccaguccuccuccacuacaaccuccauga

SEQ ID NO: 105624 - RNA, 32 nt, Human
cccccaguccuuggcccugcuucccugugucu

SEQ ID NO: 105625 - RNA, 32 nt, Human
cccccagucgucagcuccuucccucauuuauu

SEQ ID NO: 105626 - RNA, 21 nt, Human
cccccagucuccagggacccu

SEQ ID NO: 105627 - RNA, 32 nt, Human
cccccagugcagacuucggggucuccacccca

SEQ ID NO: 105628 - RNA, 32 nt, Human
cccccagugcccuuccccuugggcuguguugg

SEQ ID NO: 105629 - RNA, 32 nt, Human
cccccagugcugcugcuaaccccacaccaccc

SEQ ID NO: 105630 - RNA, 32 nt, Human
cccccaguggaugucuaaaaccacagauaaua

SEQ ID NO: 105631 - RNA, 32 nt, Human
cccccaguggcauguccuccgaguggcagcgg

SEQ ID NO: 105632 - RNA, 32 nt, Human
cccccagugggagaggggguuggguuuucaau

SEQ ID NO: 105633 - RNA, 32 nt, Human
cccccagugggaugggacagggaggccacacg

SEQ ID NO: 105634 - RNA, 32 nt, Human
cccccagugggcagggcaggagguggcagcgg

SEQ ID NO: 105635 - RNA, 19 nt, Human
cccccaguucuccuccuca

SEQ ID NO: 105636 - RNA, 32 nt, Human
cccccaguugaggaguugagagagugcaggcu

SEQ ID NO: 105637 - RNA, 32 nt, Human
cccccauaaaacuguaagacaagccuccugua

SEQ ID NO: 105638 - RNA, 32 nt, Human
cccccauaaacccaaccuaagccuauggaauc

SEQ ID NO: 105639 - RNA, 32 nt, Human
cccccauacaaguauccagucauuguaacacu

SEQ ID NO: 105640 - RNA, 20 nt, Human
cccccauacagccugucucc

SEQ ID NO: 105641 - RNA, 32 nt, Human
cccccauacgcugcccucgcagccuggcggcc

SEQ ID NO: 105642 - RNA, 32 nt, Human
cccccauacuggcuuccaccuccugcggccca

SEQ ID NO: 105643 - RNA, 32 nt, Human
cccccauaguaaggggaggaaagggaagcacc

SEQ ID NO: 105644 - RNA, 32 nt, Human
cccccauaucugcgugcacuucccagagcauc

SEQ ID NO: 105645 - RNA, 19 nt, Human
cccccaucaaacauguugg

SEQ ID NO: 105646 - RNA, 32 nt, Human
cccccaucacacucggccacuagugggguccu

SEQ ID NO: 105647 - RNA, 19 nt, Human
cccccaucaccagcucucc

SEQ ID NO: 105648 - RNA, 32 nt, Human
cccccaucaccccagacccaugcaggaagagc

SEQ ID NO: 105649 - RNA, 22 nt, Human
cccgcagccgcuggacgcggga

SEQ ID NO: 105650 - RNA, 20 nt, Human
cccgcagccucgccccaucc

SEQ ID NO: 105651 - RNA, 32 nt, Human
cccgcagccugaagaagcugauagcggacccc

SEQ ID NO: 105652 - RNA, 32 nt, Human
cccgcagccugggccugugcucggcgccauga

SEQ ID NO: 105653 - RNA, 24 nt, Human
cccgcagcgccgccuccccgcccg

SEQ ID NO: 105654 - RNA, 17 nt, Human
cccgcagcuccggcgcc

SEQ ID NO: 105655 - RNA, 24 nt, Human
cccgcagcuccggcgccgcggcga

SEQ ID NO: 105656 - RNA, 20 nt, Human
cccgcagcucucccgcggcg

SEQ ID NO: 105657 - RNA, 22 nt, Human
cccgcagcugcugugcugcucu

SEQ ID NO: 105658 - RNA, 22 nt, Human
cccgcagcuuccucccccgacc

SEQ ID NO: 105659 - RNA, 32 nt, Human
cccgcaggaacugggcugggccucgugcgccc

SEQ ID NO: 105660 - RNA, 32 nt, Human
cccgcaggagagagucuuaccuccccuggccc

SEQ ID NO: 105661 - RNA, 32 nt, Human
cccgcaggaggaggaggaucggcggacugugg

SEQ ID NO: 105662 - RNA, 32 nt, Human
cccgcaggagggggccacaccacccacccagg

SEQ ID NO: 105663 - RNA, 24 nt, Human
cccgcaggccagcccuccaaccuc

SEQ ID NO: 105664 - RNA, 18 nt, Human
cccgcaggccgcccgccg

SEQ ID NO: 105665 - RNA, 32 nt, Human
cccgcagggaaccuggcucggggagggccucc

SEQ ID NO: 105666 - RNA, 32 nt, Human
cccgcagggagcaaggaugacagugcugcagc

SEQ ID NO: 105667 - RNA, 23 nt, Human
cccgcaggggcaucgccugccca

SEQ ID NO: 105668 - RNA, 32 nt, Human
cccgcagggggagggggagagggggaagccga

SEQ ID NO: 105669 - RNA, 24 nt, Human
cccgcagggguggagccugagcga

SEQ ID NO: 105670 - RNA, 32 nt, Human
cccgcagguaugaccuggccuccucgccucgg

SEQ ID NO: 105671 - RNA, 32 nt, Human
cccgcagguggaagcgcacccgggaggcgggc

SEQ ID NO: 105672 - RNA, 32 nt, Human
cccgcaggugggaggugugguugcaggugcgg

SEQ ID NO: 105673 - RNA, 32 nt, Human
cccgcagucagaaaggagacucugccucccuc

SEQ ID NO: 105674 - RNA, 24 nt, Human
cccgcagucgcccgcaaccggggc

SEQ ID NO: 105675 - RNA, 32 nt, Human
cccgcagucugauccccugugaagagccggac

SEQ ID NO: 105676 - RNA, 32 nt, Human
cccgcagugcccugccccagucagccuggcug

SEQ ID NO: 105677 - RNA, 24 nt, Human
cccgcagugcugggauuacaggca

SEQ ID NO: 105678 - RNA, 32 nt, Human
cccgcaguggaugcagcucacaugcugaggaa

SEQ ID NO: 105679 - RNA, 32 nt, Human
cccgcaguggcuuuugccccagaaaggggaaa

SEQ ID NO: 105680 - RNA, 18 nt, Human
cccgcaguggggaugcag

SEQ ID NO: 105681 - RNA, 32 nt, Human
cccgcaguuagaauuuuguuuggagcccucuu

SEQ ID NO: 105682 - RNA, 23 nt, Human
cccgcauacacacggccaugcac

SEQ ID NO: 105683 - RNA, 24 nt, Human
cccgcauauccagcuccucacuca

SEQ ID NO: 105684 - RNA, 32 nt, Human
cccgcaucaagcucugcccuuguuauccugcc

SEQ ID NO: 105685 - RNA, 22 nt, Human
cccgcauccggcaucccagcgg

SEQ ID NO: 105686 - RNA, 26 nt, Human
cccgcauggaccugagggugcaccga

SEQ ID NO: 105687 - RNA, 32 nt, Human
cccgcauggcuuucccaggccuggugauucug

SEQ ID NO: 105688 - RNA, 30 nt, Human
cccgcauguggcugccacgguucuccagca

SEQ ID NO: 105689 - RNA, 32 nt, Human
cccgcauguucccagcaggcaugcucuggaga

SEQ ID NO: 105690 - RNA, 32 nt, Human
cccgcauucuuccuccuucuucuggugcuaca

SEQ ID NO: 105691 - RNA, 32 nt, Human
cccgcauugguaacuccagucugacuguggga

SEQ ID NO: 105692 - RNA, 32 nt, Human
cccgcauugugaacaucucgucgccugugacg

SEQ ID NO: 105693 - RNA, 32 nt, Human
cccgccaaaacccacaucccagccucuggauc

SEQ ID NO: 105694 - RNA, 22 nt, Human
cccgccaaaccccaccccagcc

SEQ ID NO: 105695 - RNA, 22 nt, Human
cccgccaacccgcccacgagcc

SEQ ID NO: 105696 - RNA, 20 nt, Human
cccgccaaccgcccccgggc

SEQ ID NO: 105697 - RNA, 21 nt, Human
cccgccaagugcgcucaugcc

SEQ ID NO: 105698 - RNA, 32 nt, Human
cccgccacacuggcuuuaggaccuguugacac

SEQ ID NO: 105699 - RNA, 18 nt, Human
cccgccacagacacggag

SEQ ID NO: 105700 - RNA, 32 nt, Human
cccgccacagcaggcugggaucauagguguga

SEQ ID NO: 105701 - RNA, 32 nt, Human
cccgccacagcccuguccccuagggagaggcc

SEQ ID NO: 105702 - RNA, 32 nt, Human
cccgccacagccgcgccaugaccacccagcag

SEQ ID NO: 105703 - RNA, 32 nt, Human
cccgccacaucgcggcccuccagccuggccua

SEQ ID NO: 105704 - RNA, 32 nt, Human
cccgccaccacugcugggcugcgagcugggcc

SEQ ID NO: 105705 - RNA, 21 nt, Human
cccgccaccagcagucagcag

SEQ ID NO: 105706 - RNA, 32 nt, Human
cccgccaccaugugaauucaucagcucugcag

SEQ ID NO: 105707 - RNA, 19 nt, Human
cccgccaccgccgccgccg

SEQ ID NO: 105708 - RNA, 32 nt, Human
cccgccaccucaccgccuucggcgccagccuc

SEQ ID NO: 105709 - RNA, 32 nt, Human
cccgccaccuccccucuccucuucuccccuca

SEQ ID NO: 105710 - RNA, 32 nt, Human
cccgccaccugugccagcagcugaugccuccu

SEQ ID NO: 105711 - RNA, 32 nt, Human
cccgccacucacuccagccuggauaaaagagc

SEQ ID NO: 105712 - RNA, 32 nt, Human
cccgccacugcacgccagccugggcgacagag

SEQ ID NO: 105713 - RNA, 32 nt, Human
cccgccacugcacuccagacugggcgacagag

SEQ ID NO: 105714 - RNA, 30 nt, Human
cccgccacugcacuccagcacuccgcucuc

SEQ ID NO: 105715 - RNA, 32 nt, Human
cccgccacugcacuccagcccaggugacagag

SEQ ID NO: 105716 - RNA, 32 nt, Human
cccgccacugcacuccagccugggcaacagag

SEQ ID NO: 105717 - RNA, 32 nt, Human
cccgccacugcacuccagccugggcgacagag

SEQ ID NO: 105718 - RNA, 32 nt, Human
cccgccacugcacuccagccugggugacagag

SEQ ID NO: 105719 - RNA, 32 nt, Human
cccgccacugcacucuagccugggugacagau

SEQ ID NO: 105720 - RNA, 32 nt, Human
cccgccacuuuacuuucuccagcccugauacc

SEQ ID NO: 105721 - RNA, 32 nt, Human
cccgccagagugagguugggaagcagaguuaa

SEQ ID NO: 105722 - RNA, 32 nt, Human
cccgccagcccacgugccccagaagggccggc

SEQ ID NO: 105723 - RNA, 17 nt, Human
cccgccagccccucaca

SEQ ID NO: 105724 - RNA, 32 nt, Human
cccgccagccgaggcagcucgagcccaguccg

SEQ ID NO: 105725 - RNA, 32 nt, Human
cccgccagccugagcaugagaggaagagguca

SEQ ID NO: 105726 - RNA, 17 nt, Human
cccgccagccugccggg

SEQ ID NO: 105727 - RNA, 32 nt, Human
cccgccagcgcgccaccaugggcagucccggu

SEQ ID NO: 105728 - RNA, 32 nt, Human
cccgccagcuacucuggggguggcguggcaua

SEQ ID NO: 105729 - RNA, 32 nt, Human
cccgccagcugcucgcuuccucccgggcucac

SEQ ID NO: 105730 - RNA, 32 nt, Human
cccgccagcuucgcauccaucucccccacccc

SEQ ID NO: 105731 - RNA, 32 nt, Human
cccgccaggacucugcaggucacugcuagcuc

SEQ ID NO: 105732 - RNA, 32 nt, Human
cccgccaggccacgccccagccacuuugcucc

SEQ ID NO: 105733 - RNA, 32 nt, Human
cccgccaggccgcggcccaguggcgccggcgc

SEQ ID NO: 105734 - RNA, 32 nt, Human
cccgccaggccugcucaaugcauuggguuugg

SEQ ID NO: 105735 - RNA, 32 nt, Human
cccgccagggagguuucaugagcucaugucua

SEQ ID NO: 105736 - RNA, 32 nt, Human
cccgccagguucugcguuagaccugcaucuua

SEQ ID NO: 105737 - RNA, 32 nt, Human
cccgccauaugcugccugccucggcuuugagu

SEQ ID NO: 105738 - RNA, 32 nt, Human
cccgccaucacugcuggacaggagccaccccc

SEQ ID NO: 105739 - RNA, 32 nt, Human
cccgccaucaugucgcccaagcucuuccaccu

SEQ ID NO: 105740 - RNA, 32 nt, Human
cccgccauccucgcagagugggagaggcugca

SEQ ID NO: 105741 - RNA, 32 nt, Human
cccgccaugaggaugaaggccacaugggguau

SEQ ID NO: 105742 - RNA, 32 nt, Human
cccgccaugauacugucacagugccuagaaug

SEQ ID NO: 105743 - RNA, 31 nt, Human
cccgccaugggcgccccugccugcgcccucg

SEQ ID NO: 105744 - RNA, 32 nt, Human
cccgccauggucacccucaggaacccacccuc

SEQ ID NO: 105745 - RNA, 32 nt, Human
cccgccauucuguuuuuauaaguggcuacacu

SEQ ID NO: 105746 - RNA, 32 nt, Human
cccgccauugagaauaagguuccauugcguag

SEQ ID NO: 105747 - RNA, 19 nt, Human
cccgcccagaccccugggc

SEQ ID NO: 105748 - RNA, 22 nt, Human
cccgcccagacccgggcuccug

SEQ ID NO: 105749 - RNA, 32 nt, Human
cccgcccagagucauggcggcagcagccgcuc

SEQ ID NO: 105750 - RNA, 21 nt, Human
cccgcccagccacccacgcgg

SEQ ID NO: 105751 - RNA, 32 nt, Human
cccgcccagcucuccugccacuggccuuucag

SEQ ID NO: 105752 - RNA, 32 nt, Human
cccgcccagcugcaccugccagccuggcuucu

SEQ ID NO: 105753 - RNA, 32 nt, Human
cccgcccagcuuucccaggggcacagcucuag

SEQ ID NO: 105754 - RNA, 32 nt, Human
cccgcccaggcagggagcugcugugaguccag

SEQ ID NO: 105755 - RNA, 32 nt, Human
cccgcccagucucaaaccaugcagcugaguaa

SEQ ID NO: 105756 - RNA, 32 nt, Human
cccgcccauaauaacacuccagucuggggcuu

SEQ ID NO: 105757 - RNA, 32 nt, Human
cccgcccaucugccgugugucuugcccgccug

SEQ ID NO: 105758 - RNA, 18 nt, Human
cccgccccacgccugcca

SEQ ID NO: 105759 - RNA, 32 nt, Human
cccgccccagccuggcccagggugaaggaaga

SEQ ID NO: 105760 - RNA, 32 nt, Human
cccgccccagcgcagugccggccacacccaug

SEQ ID NO: 105761 - RNA, 32 nt, Human
cccgccccagcgcagugccggccacaccccaa

SEQ ID NO: 105762 - RNA, 32 nt, Human
cccgccccagguuugaaaaggcuuuucuggcg

SEQ ID NO: 105763 - RNA, 18 nt, Human
cccgcccccagccccaca

SEQ ID NO: 105764 - RNA, 25 nt, Human
cccgcccccagggggcgccccgggc

SEQ ID NO: 105765 - RNA, 24 nt, Human
cccgccccccacccugccccauga

SEQ ID NO: 105766 - RNA, 22 nt, Human
cccgccccccaggcucccccgg

SEQ ID NO: 105767 - RNA, 20 nt, Human
cccgcccccgccccccgggc

SEQ ID NO: 105768 - RNA, 16 nt, Human
cccgcccccgccgccg

SEQ ID NO: 105769 - RNA, 32 nt, Human
cccgcccccgcuccacccuggagcccaccccc

SEQ ID NO: 105770 - RNA, 32 nt, Human
cccgcccccgcuccagcuccagccggguccuc

SEQ ID NO: 105771 - RNA, 32 nt, Human
cccgcccccggauagggacccaggaggcccaa

SEQ ID NO: 105772 - RNA, 25 nt, Human
cccgcccccggccgcggccccgggc

SEQ ID NO: 105773 - RNA, 32 nt, Human
cccgcccccuccccaccaacauugccucuccu

SEQ ID NO: 105774 - RNA, 32 nt, Human
cccgcccccugccacccugcacugccccggcu

SEQ ID NO: 105775 - RNA, 32 nt, Human
cccgcccccugccuuucccucuccccuagaaa

SEQ ID NO: 105776 - RNA, 18 nt, Human
cccgccccgccgccgccg

SEQ ID NO: 105777 - RNA, 32 nt, Human
cccgccccgccuggccacugcgucuggcauuc

SEQ ID NO: 105778 - RNA, 16 nt, Human
cccgccccggcgcgag

SEQ ID NO: 105779 - RNA, 32 nt, Human
cccgccccuccaggaaggggaggaggcgaggg

SEQ ID NO: 105780 - RNA, 32 nt, Human
cccgccccuccccaucuguccccucucuccac

SEQ ID NO: 105781 - RNA, 24 nt, Human
cccgccccuccggcuagcucgcug

SEQ ID NO: 105782 - RNA, 32 nt, Human
cccgccccuccucccacccucguucagccugu

SEQ ID NO: 105783 - RNA, 32 nt, Human
cccgccccuccuccucccuuucccaccccucg

SEQ ID NO: 105784 - RNA, 32 nt, Human
cccgccccuccuggugcagguuucagcuguca

SEQ ID NO: 105785 - RNA, 32 nt, Human
cccgccccucgagcuccgccccuuuggccuag

SEQ ID NO: 105786 - RNA, 32 nt, Human
cccgccccucugaccccugccugugggcuggg

SEQ ID NO: 105787 - RNA, 26 nt, Human
cccgccccugccccgccccccugggc

SEQ ID NO: 105788 - RNA, 17 nt, Human
cccgccccugccugcca

SEQ ID NO: 105789 - RNA, 32 nt, Human
cccgccccugcuccauguccuuguguggcugc

SEQ ID NO: 105790 - RNA, 32 nt, Human
cccgccccugcucucuccccagauguguucug

SEQ ID NO: 105791 - RNA, 21 nt, Human
cccgccccuuccuggcuucug

SEQ ID NO: 105792 - RNA, 23 nt, Human
cccgcccgaggccgcgccccgcg

SEQ ID NO: 105793 - RNA, 32 nt, Human
cccgcccgcagcccugccacuggacacaggau

SEQ ID NO: 105794 - RNA, 17 nt, Human
cccgcccgccgccgccg

SEQ ID NO: 105795 - RNA, 17 nt, Human
cccgcccgccgccgcug

SEQ ID NO: 105796 - RNA, 18 nt, Human
cccgcccgccgccugccg

SEQ ID NO: 105797 - RNA, 18 nt, Human
cccgcccgccgggccgcg

SEQ ID NO: 105798 - RNA, 31 nt, Human
cccgcccgccucucucugcccgugucagucc

SEQ ID NO: 105799 - RNA, 25 nt, Human
cccgcccgccugccggcccgcccgg

SEQ ID NO: 105800 - RNA, 22 nt, Human
cccgcccgcggagcccacucgg

SEQ ID NO: 105801 - RNA, 22 nt, Human
cccgcccgcucgcccgcuccug

SEQ ID NO: 105802 - RNA, 23 nt, Human
cccgcccgcucgcgcuccccugg

SEQ ID NO: 105803 - RNA, 22 nt, Human
cccgcccggcagucaggcagcg

SEQ ID NO: 105804 - RNA, 20 nt, Human
cccgcccggccccgccgcgg

SEQ ID NO: 105805 - RNA, 21 nt, Human
cccgcccggccccugcccccu

SEQ ID NO: 105806 - RNA, 32 nt, Human
cccgcccggcccugcccugcccugcucccugc

SEQ ID NO: 105807 - RNA, 32 nt, Human
cccgcccggccuggcccggacgcugccaucuc

SEQ ID NO: 105808 - RNA, 17 nt, Human
cccgcccggcgccccga

SEQ ID NO: 105809 - RNA, 32 nt, Human
cccgcccggcgccgcagccccauggccccguc

SEQ ID NO: 105810 - RNA, 22 nt, Human
cccgcccggcgcgccccucggg

SEQ ID NO: 105811 - RNA, 22 nt, Human
cccgcccggggcccgcuaccgg

SEQ ID NO: 105812 - RNA, 22 nt, Human
cccgcccggggccgcgaccccg

SEQ ID NO: 105813 - RNA, 18 nt, Human
cccgcccggggcuccucc

SEQ ID NO: 105814 - RNA, 22 nt, Human
cccgcccgguccgcccccgcgg

SEQ ID NO: 105815 - RNA, 32 nt, Human
cccgcccgucuccucugucccugggcccggga

SEQ ID NO: 105816 - RNA, 32 nt, Human
cccgcccgucugccgucugucuugcccgccug

SEQ ID NO: 105817 - RNA, 22 nt, Human
cccgcccguuguccuggcaaca

SEQ ID NO: 105818 - RNA, 32 nt, Human
cccgcccuccucaccucgcucucccuccuccu

SEQ ID NO: 105819 - RNA, 32 nt, Human
cccgcccuccuggugagcgcugggcagggcuc

SEQ ID NO: 105820 - RNA, 32 nt, Human
cccgcccucgcccucacugcugacuccucuuc

SEQ ID NO: 105821 - RNA, 23 nt, Human
cccgcccucucaggcccaccuug

SEQ ID NO: 105822 - RNA, 32 nt, Human
cccgcccucugccuccucagccaugggaccuc

SEQ ID NO: 105823 - RNA, 32 nt, Human
cccgcccugaugcuaaggaaacccugacguau

SEQ ID NO: 105824 - RNA, 32 nt, Human
cccgcccugcagcuaucuccgcggcccacccg

SEQ ID NO: 105825 - RNA, 32 nt, Human
cccgcccugccccggccgcaucgcugccaagc

SEQ ID NO: 105826 - RNA, 32 nt, Human
cccgcccugccuggugcauuuccugucuccug

SEQ ID NO: 105827 - RNA, 19 nt, Human
cccgcccuggacccaacca

SEQ ID NO: 105828 - RNA, 32 nt, Human
cccgcccuggguguuucccugccuuguagcca

SEQ ID NO: 105829 - RNA, 32 nt, Human
cccgcccuuccuaaguuaucggccugcgagcc

SEQ ID NO: 105830 - RNA, 32 nt, Human
cccgcccuuuucucccuuugguccuuccccuc

SEQ ID NO: 105831 - RNA, 32 nt, Human
cccgccgacagaaacaucugcaaagauacagu

SEQ ID NO: 105832 - RNA, 32 nt, Human
cccgccgacuucuccccuuuccccagccucgu

SEQ ID NO: 105833 - RNA, 32 nt, Human
cccgccgagccggacagcgccugcugcaugga

SEQ ID NO: 105834 - RNA, 32 nt, Human
cccgccgaggggaugaggggagcaugggugcc

SEQ ID NO: 105835 - RNA, 18 nt, Human
cccgccgcagacacggga

SEQ ID NO: 105836 - RNA, 16 nt, Human
cccgccgcagcugccg

SEQ ID NO: 105837 - RNA, 22 nt, Human
cccgccgccacagccgccgccu

SEQ ID NO: 105838 - RNA, 21 nt, Human
cccgccgccccaacccagcgg

SEQ ID NO: 105839 - RNA, 19 nt, Human
cccgccgcccccgccgccg

SEQ ID NO: 105840 - RNA, 20 nt, Human
cccgccgcccgccgccgccg

SEQ ID NO: 105841 - RNA, 23 nt, Human
cccgccgcccuccaccccugccu

SEQ ID NO: 105842 - RNA, 32 nt, Human
cccgccgccgccgagacccaggcugaagcugg

SEQ ID NO: 105843 - RNA, 16 nt, Human
cccgccgccgccgccg

SEQ ID NO: 105844 - RNA, 18 nt, Human
cccgccgccgccgccgcc

SEQ ID NO: 105845 - RNA, 19 nt, Human
cccgccgccgccgccgccg

SEQ ID NO: 105846 - RNA, 19 nt, Human
cccgccgccgccgccgcug

SEQ ID NO: 105847 - RNA, 17 nt, Human
cccgccgccgccgcgcc

SEQ ID NO: 105848 - RNA, 19 nt, Human
cccgccgccgccgcugccg

SEQ ID NO: 105849 - RNA, 19 nt, Human
cccgccgccgccgucgccg

SEQ ID NO: 105850 - RNA, 32 nt, Human
cccgccgccgcuccagcgccgcgcagccaccg

SEQ ID NO: 105851 - RNA, 19 nt, Human
cccgccgccgcugccgccg

SEQ ID NO: 105852 - RNA, 19 nt, Human
cccgccgccuccgccgccg

SEQ ID NO: 105853 - RNA, 20 nt, Human
cccgccgccugccgccgccg

SEQ ID NO: 105854 - RNA, 32 nt, Human
cccgccgccuuuccucugagccuuccuacuag

SEQ ID NO: 105855 - RNA, 18 nt, Human
cccgccgcgccgccgccg

SEQ ID NO: 105856 - RNA, 32 nt, Human
cccgccgcgcggaggcccgggccacaccucac

SEQ ID NO: 105857 - RNA, 22 nt, Human
cccgccgcggcagccccagcca

SEQ ID NO: 105858 - RNA, 32 nt, Human
cccgccgcgggugcccuucggaaacgcgcuga

SEQ ID NO: 105859 - RNA, 19 nt, Human
cccgccgcugcagcagucc

SEQ ID NO: 105860 - RNA, 32 nt, Human
cccgccgcugccgccucugccugggucccuuc

SEQ ID NO: 105861 - RNA, 32 nt, Human
cccgccgcuuccccuucagccugggaccaggc

SEQ ID NO: 105862 - RNA, 22 nt, Human
cccgccggacccccagcggcag

SEQ ID NO: 105863 - RNA, 32 nt, Human
cccgccggccgucuccuuuggcucccugcagg

SEQ ID NO: 105864 - RNA, 19 nt, Human
cccgccggccuccauccaa

SEQ ID NO: 105865 - RNA, 32 nt, Human
cccgccggcgcagcacgagcccggaccacacc

SEQ ID NO: 105866 - RNA, 32 nt, Human
cccgccggcggccaccaugagcacaggccugc

SEQ ID NO: 105867 - RNA, 32 nt, Human
cccgccggcggcggaggcagcgagcgcgagag

SEQ ID NO: 105868 - RNA, 32 nt, Human
cccgccgggcgcucgggcugaaugggccgcca

SEQ ID NO: 105869 - RNA, 32 nt, Human
cccgccgggcggcuuucccccuuguacuggag

SEQ ID NO: 105870 - RNA, 19 nt, Human
cccgccgucgccgccgccg

SEQ ID NO: 105871 - RNA, 21 nt, Human
cccgccgugcccucaccccag

SEQ ID NO: 105872 - RNA, 32 nt, Human
cccgccucagcaucugguacagccgaccuagu

SEQ ID NO: 105873 - RNA, 32 nt, Human
cccgccucagcccagcccaggcagcggggugg

SEQ ID NO: 105874 - RNA, 32 nt, Human
cccgccucagcuucccaaagugcugggauuac

SEQ ID NO: 105875 - RNA, 32 nt, Human
cccgccucaggaaggaaugaaaggaaugccau

SEQ ID NO: 105876 - RNA, 19 nt, Human
cccgccuccagccuccagc

SEQ ID NO: 105877 - RNA, 32 nt, Human
cccgccuccagugcccuucuuuccaaaacagc

SEQ ID NO: 105878 - RNA, 19 nt, Human
cccgccuccauacccgggc

SEQ ID NO: 105879 - RNA, 32 nt, Human
cccgccuccauggccaggucccgggacugcug

SEQ ID NO: 105880 - RNA, 32 nt, Human
cccgccucccaaagugcugggauuacaggcgu

SEQ ID NO: 105881 - RNA, 19 nt, Human
cccgccuccccgcccgggc

SEQ ID NO: 105882 - RNA, 22 nt, Human
cccgccucccgccccccagggc

SEQ ID NO: 105883 - RNA, 19 nt, Human
cccgccucccgccccgcgc

SEQ ID NO: 105884 - RNA, 23 nt, Human
cccgccucccgccgccuccgggc

SEQ ID NO: 105885 - RNA, 31 nt, Human
cccgccucccucucugggcagauguguuacu

SEQ ID NO: 105886 - RNA, 32 nt, Human
cccgccucccugccuccagcccuggcugcaau

SEQ ID NO: 105887 - RNA, 25 nt, Human
cccgccuccgccaagggcccccugg

SEQ ID NO: 105888 - RNA, 20 nt, Human
cccgccuccggacccggggc

SEQ ID NO: 105889 - RNA, 17 nt, Human
cccgccuccggccgggu

SEQ ID NO: 105890 - RNA, 32 nt, Human
cccgccuccuagggaagggaagggagacgagc

SEQ ID NO: 105891 - RNA, 22 nt, Human
cccgccuccuccaccccugccu

SEQ ID NO: 105892 - RNA, 32 nt, Human
cccgccuccucccacugggacucccagcagag

SEQ ID NO: 105893 - RNA, 17 nt, Human
cccgccuccucccccgg

SEQ ID NO: 105894 - RNA, 18 nt, Human
cccgccuccuccccgggc

SEQ ID NO: 105895 - RNA, 32 nt, Human
cccgccuccugccucaacagccuguguggugg

SEQ ID NO: 105896 - RNA, 32 nt, Human
cccgccuccugguaggaggggguuuccgcuuc

SEQ ID NO: 105897 - RNA, 32 nt, Human
cccgccucuccccuccccaucagacccauccc

SEQ ID NO: 105898 - RNA, 32 nt, Human
cccgccucucggccaccucugcagccugccag

SEQ ID NO: 105899 - RNA, 17 nt, Human
cccgccucugccugcca

SEQ ID NO: 105900 - RNA, 22 nt, Human
cccgccucugcucccaccgagc

SEQ ID NO: 105901 - RNA, 32 nt, Human
cccgccucugucagucuuccugaccccuuccc

SEQ ID NO: 105902 - RNA, 18 nt, Human
cccgccucuguccccugg

SEQ ID NO: 105903 - RNA, 32 nt, Human
cccgccucuuccucccuuccuucuuuccuugc

SEQ ID NO: 105904 - RNA, 19 nt, Human
cccgccucuugccccaggc

SEQ ID NO: 105905 - RNA, 22 nt, Human
cccgccucuuucguccgcgggc

SEQ ID NO: 105906 - RNA, 30 nt, Human
cccgccugaagccaccggcuccaauugcca

SEQ ID NO: 105907 - RNA, 32 nt, Human
cccgccugaccugccuucauguggacccuuag

SEQ ID NO: 105908 - RNA, 32 nt, Human
cccgccugaccuuccucagucauuucugcaaa

SEQ ID NO: 105909 - RNA, 32 nt, Human
cccgccugagccugacagaggagaagcagcgg

SEQ ID NO: 105910 - RNA, 32 nt, Human
cccgccugaggugauccuugagcugggcuggg

SEQ ID NO: 105911 - RNA, 32 nt, Human
cccgccugccaguccuagcugcacagggcagc

SEQ ID NO: 105912 - RNA, 21 nt, Human
cccgccugcccccuucuagga

SEQ ID NO: 105913 - RNA, 32 nt, Human
cccgccugcuaagcugugugugcagugauggc

SEQ ID NO: 105914 - RNA, 32 nt, Human
cccgccugcugcuucucuaccuccccucccca

SEQ ID NO: 105915 - RNA, 32 nt, Human
cccgccuggccuggcccuccccaggcggcuca

SEQ ID NO: 105916 - RNA, 19 nt, Human
cccgccuggcgaccggggc

SEQ ID NO: 105917 - RNA, 32 nt, Human
cccgccuggcucuccccucuaaagcgcccggc

SEQ ID NO: 105918 - RNA, 29 nt, Human
cccgccuggcugcgucuuccucugcuaua

SEQ ID NO: 105919 - RNA, 32 nt, Human
cccgccuggugugggccuggucucagcagcgg

SEQ ID NO: 105920 - RNA, 32 nt, Human
cccgccuguaaucccagcuacucgggaggcug

SEQ ID NO: 105921 - RNA, 32 nt, Human
cccgccuguguguccccagagccauggagaga

SEQ ID NO: 105922 - RNA, 32 nt, Human
cccgccuguuccgucugcuccagacccugccc

SEQ ID NO: 105923 - RNA, 32 nt, Human
cccgccuuaucacccauuccagcucacccaga

SEQ ID NO: 105924 - RNA, 32 nt, Human
cccgccuucaccccgagcugggcaugggccug

SEQ ID NO: 105925 - RNA, 32 nt, Human
cccgccuucagguuguugagcaacugauggga

SEQ ID NO: 105926 - RNA, 32 nt, Human
cccgccuucgcuccuuccccucaggccguggc

SEQ ID NO: 105927 - RNA, 32 nt, Human
cccgccuucucuuccuccuccuccgucuucuu

SEQ ID NO: 105928 - RNA, 19 nt, Human
cccgccuugaccccugggc

SEQ ID NO: 105929 - RNA, 32 nt, Human
cccgccuugccagggcccuggcaucugucuca

SEQ ID NO: 105930 - RNA, 32 nt, Human
cccgccuuggcggcuuaagccugcugcuuugg

SEQ ID NO: 105931 - RNA, 32 nt, Human
cccgccuugggggcgggggucucugcagccug

SEQ ID NO: 105932 - RNA, 32 nt, Human
cccgccuuguggauccaccacaccccaccgag

SEQ ID NO: 105933 - RNA, 19 nt, Human
cccgccuuguuucucccca

SEQ ID NO: 105934 - RNA, 32 nt, Human
cccgccuuuugcccuccuccucccaguuucuc

SEQ ID NO: 105935 - RNA, 32 nt, Human
cccgcgaaaacaucugccucccaggagggugc

SEQ ID NO: 105936 - RNA, 32 nt, Human
cccgcgaagccccugcgcgcucagggacgcgg

SEQ ID NO: 105937 - RNA, 32 nt, Human
cccgcgaccucugcgcgcccucaggccgccuu

SEQ ID NO: 105938 - RNA, 24 nt, Human
cccgcgaggcggagacugcaguga

SEQ ID NO: 105939 - RNA, 32 nt, Human
cccgcgaggcggagacugcagugagccgagau

SEQ ID NO: 105940 - RNA, 23 nt, Human
cccgcgauccgauccgcuucugc

SEQ ID NO: 105941 - RNA, 32 nt, Human
cccgcgaugaguguuuugguggcagagguggg

SEQ ID NO: 105942 - RNA, 32 nt, Human
cccgcgcacacagcugcucucuacagaggcug

SEQ ID NO: 105943 - RNA, 25 nt, Human
cccgcgcaccgcgcucagcgcccac

SEQ ID NO: 105944 - RNA, 23 nt, Human
cccgcgcagacacguccugcacg

SEQ ID NO: 105945 - RNA, 32 nt, Human
cccgcgcagcaguuccaggaaggauguuaccu

SEQ ID NO: 105946 - RNA, 32 nt, Human
cccgcgcagccaccgagccucugcccagccaa

SEQ ID NO: 105947 - RNA, 32 nt, Human
cccgcgcagccugcccccuccuggacgugccc

SEQ ID NO: 105948 - RNA, 32 nt, Human
cccgcgcaggcgcgccccacgcccucgccccg

SEQ ID NO: 105949 - RNA, 32 nt, Human
cccgcgccacugcgccgcucccaggaacccug

SEQ ID NO: 105950 - RNA, 25 nt, Human
cccgcgccagaucggcugcuucucu

SEQ ID NO: 105951 - RNA, 23 nt, Human
cccgcgccagcaaccgggcccga

SEQ ID NO: 105952 - RNA, 32 nt, Human
cccgcgccaggcccucagucuuccugccgguu

SEQ ID NO: 105953 - RNA, 24 nt, Human
cccgcgccaguagugcuuucugcu

SEQ ID NO: 105954 - RNA, 24 nt, Human
cccgcgcccaacuuccgcuggccc

SEQ ID NO: 105955 - RNA, 18 nt, Human
cccgcgcccacccccuca

SEQ ID NO: 105956 - RNA, 21 nt, Human
cccgcgcccagccgggcccgg

SEQ ID NO: 105957 - RNA, 32 nt, Human
cccgcgcccaggagcaugaagggccuuuccgg

SEQ ID NO: 105958 - RNA, 32 nt, Human
cccgcgcccaggaguauggcugaggccuugcc

SEQ ID NO: 105959 - RNA, 21 nt, Human
cccgcgcccaggccgggccga

SEQ ID NO: 105960 - RNA, 32 nt, Human
cccgcgccccaaacuuugccucccgcggcggc

SEQ ID NO: 105961 - RNA, 18 nt, Human
cccgcgccccccuccuca

SEQ ID NO: 105962 - RNA, 21 nt, Human
cccgcgccccgauuccggccc

SEQ ID NO: 105963 - RNA, 17 nt, Human
cccgcgccccgccgccg

SEQ ID NO: 105964 - RNA, 19 nt, Human
cccgcgccccgccgcgccg

SEQ ID NO: 105965 - RNA, 32 nt, Human
cccgcgccccggacacagcgggacgcggccgg

SEQ ID NO: 105966 - RNA, 20 nt, Human
cccgcgccccuccccagccc

SEQ ID NO: 105967 - RNA, 31 nt, Human
cccgcgcccgccccuggacacuuguaaguuu

SEQ ID NO: 105968 - RNA, 19 nt, Human
cccgcgcccgccgccgccg

SEQ ID NO: 105969 - RNA, 21 nt, Human
cccgcgcccgcgggcccggcc

SEQ ID NO: 105970 - RNA, 21 nt, Human
cccgcgcccgcugcugcugcu

SEQ ID NO: 105971 - RNA, 32 nt, Human
cccgcgcccucaggacccugcgggucgcacgc

SEQ ID NO: 105972 - RNA, 32 nt, Human
cccgcgccgcagccccggccugggcgagagcg

SEQ ID NO: 105973 - RNA, 19 nt, Human
cccgcgccgccccgcgccg

SEQ ID NO: 105974 - RNA, 18 nt, Human
cccgcgccgccgcccccg

SEQ ID NO: 105975 - RNA, 16 nt, Human
cccgcgccgccgcccg

SEQ ID NO: 105976 - RNA, 17 nt, Human
cccgcgccgccgccgcc

SEQ ID NO: 105977 - RNA, 18 nt, Human
cccgcgccgccgccgccg

SEQ ID NO: 105978 - RNA, 17 nt, Human
cccgcgccgccgcggcc

SEQ ID NO: 105979 - RNA, 18 nt, Human
cccgcgccgccgcuuccg

SEQ ID NO: 105980 - RNA, 19 nt, Human
cccgcgccgcgccccugcu

SEQ ID NO: 105981 - RNA, 17 nt, Human
cccgcgccgcgccgccg

SEQ ID NO: 105982 - RNA, 19 nt, Human
cccgcgccgcgccgcgccg

SEQ ID NO: 105983 - RNA, 24 nt, Human
cccgcgccgcggagcccggcccga

SEQ ID NO: 105984 - RNA, 32 nt, Human
cccgcgccuccaucugcccccgcaggaaggga

SEQ ID NO: 105985 - RNA, 22 nt, Human
cccgcgccuccugcagacccga

SEQ ID NO: 105986 - RNA, 21 nt, Human
cccgcgccucggcuucgcgcu

SEQ ID NO: 105987 - RNA, 21 nt, Human
cccgcgccuucugccccugcu

SEQ ID NO: 105988 - RNA, 32 nt, Human
cccgcgccuuucucccugcggccccggcucgc

SEQ ID NO: 105989 - RNA, 32 nt, Human
cccgcgccuuucuucucgcgccuccuccgccc

SEQ ID NO: 105990 - RNA, 32 nt, Human
cccgcgccuuucuucuuuugccugcgcuguuc

SEQ ID NO: 105991 - RNA, 17 nt, Human
cccgcgcgcagcugccg

SEQ ID NO: 105992 - RNA, 18 nt, Human
cccgcgcgcccacccaca

SEQ ID NO: 105993 - RNA, 21 nt, Human
cccgcgcgcccccgccgcgcg

SEQ ID NO: 105994 - RNA, 24 nt, Human
cccgcgcgcccccgcuccugcagg

SEQ ID NO: 105995 - RNA, 18 nt, Human
cccgcgcgccccgcgccg

SEQ ID NO: 105996 - RNA, 21 nt, Human
cccgcgcgccccgcgccgccg

SEQ ID NO: 105997 - RNA, 21 nt, Human
cccgcgcgccugcccugcacg

SEQ ID NO: 105998 - RNA, 23 nt, Human
cccgcgcgccugggcggccgcac

SEQ ID NO: 105999 - RNA, 21 nt, Human
cccgcgcgcgcacacucgcac

SEQ ID NO: 106000 - RNA, 22 nt, Human
cccgcgcgcuccgcggcugcac

SEQ ID NO: 106001 - RNA, 32 nt, Human
cccgcgcggcgcaucccagccugggcgggacg

SEQ ID NO: 106002 - RNA, 21 nt, Human
cccgcgcggggccgcccgccg

SEQ ID NO: 106003 - RNA, 18 nt, Human
cccgcgcgucccuccuca

SEQ ID NO: 106004 - RNA, 22 nt, Human
cccgcgcgucuccgcccgcacg

SEQ ID NO: 106005 - RNA, 21 nt, Human
cccgcgcuccgugcuccugcu

SEQ ID NO: 106006 - RNA, 32 nt, Human
cccgcgcuccucuaggcugcaaagggggccuc

SEQ ID NO: 106007 - RNA, 32 nt, Human
cccgcgcucugcucccccucccggaggcgccg

SEQ ID NO: 106008 - RNA, 32 nt, Human
cccgcgcuggccaccccgccuccuuggcagcc

SEQ ID NO: 106009 - RNA, 26 nt, Human
cccgcgcuuuccccggcgccugcacg

SEQ ID NO: 106010 - RNA, 32 nt, Human
cccgcggaccaccacccggccgcacgggccgc

SEQ ID NO: 106011 - RNA, 19 nt, Human
cccgcggagccgccgcgcc

SEQ ID NO: 106012 - RNA, 32 nt, Human
cccgcggaggaggcacgcucucggcgcucacu

SEQ ID NO: 106013 - RNA, 20 nt, Human
cccgcggcaccgcgcugccg

SEQ ID NO: 106014 - RNA, 18 nt, Human
cccgcggcagccccgggc

SEQ ID NO: 106015 - RNA, 32 nt, Human
cccgcggcccggccggcaguugcaguguagac

SEQ ID NO: 106016 - RNA, 18 nt, Human
cccgcggccugccugcca

SEQ ID NO: 106017 - RNA, 32 nt, Human
cccgcggcgagggugucuauggagaggcggcg

SEQ ID NO: 106018 - RNA, 18 nt, Human
cccgcggcgcaggagcuu

SEQ ID NO: 106019 - RNA, 32 nt, Human
cccgcggcgccaugagccgcagccuggacucg

SEQ ID NO: 106020 - RNA, 22 nt, Human
cccgcggcgcgcggggaugggg

SEQ ID NO: 106021 - RNA, 15 nt, Human
cccgcggcgcugccg

SEQ ID NO: 106022 - RNA, 32 nt, Human
cccgcgggagcagcacggucaccauuccacgg

SEQ ID NO: 106023 - RNA, 32 nt, Human
cccgcggggaugaggagguugucagugauuga

SEQ ID NO: 106024 - RNA, 32 nt, Human
cccgcggggccgucccgccugcagagggccac

SEQ ID NO: 106025 - RNA, 32 nt, Human
cccgcggguggaggccgggguggcgccggccg

SEQ ID NO: 106026 - RNA, 32 nt, Human
cccgcggugcagcuccagccccgggaagcccc

SEQ ID NO: 106027 - RNA, 32 nt, Human
cccgcggugggcaucagaagaccugggugugg

SEQ ID NO: 106028 - RNA, 32 nt, Human
cccgcgguguguagaguccgccgccccggagc

SEQ ID NO: 106029 - RNA, 32 nt, Human
cccgcguacccggcgcagccagagccaccagc

SEQ ID NO: 106030 - RNA, 21 nt, Human
cccgcguaccggccgccgccg

SEQ ID NO: 106031 - RNA, 32 nt, Human
cccgcguagcuggagcagcccaggcccggcgg

SEQ ID NO: 106032 - RNA, 32 nt, Human
cccgcgucagaacuuagagggccaggcagggu

SEQ ID NO: 106033 - RNA, 24 nt, Human
cccgcguccaggagaaacucgcuc

SEQ ID NO: 106034 - RNA, 32 nt, Human
cccgcguccaggagaaacucgcuccaagugca

SEQ ID NO: 106035 - RNA, 22 nt, Human
cccgcguccccccagcgcgccc

SEQ ID NO: 106036 - RNA, 22 nt, Human
cccgcguccccgccggaccacu

SEQ ID NO: 106037 - RNA, 18 nt, Human
cccgcgucccggagugca

SEQ ID NO: 106038 - RNA, 32 nt, Human
cccgcguccugugcggauuucagggcugauac

SEQ ID NO: 106039 - RNA, 32 nt, Human
cccgcgucgcgcggaggucagggagccugagc

SEQ ID NO: 106040 - RNA, 32 nt, Human
cccgcgucgcggcagcaccugggcagccccgc

SEQ ID NO: 106041 - RNA, 22 nt, Human
cccgcgucucggcccggacggc

SEQ ID NO: 106042 - RNA, 32 nt, Human
cccgcgucuuccacgggcacagguguguggag

SEQ ID NO: 106043 - RNA, 32 nt, Human
cccgcgugccugcccaugccagcacuuccuua

SEQ ID NO: 106044 - RNA, 32 nt, Human
cccgcgugccuucgcccucuggcugcaaauaa

SEQ ID NO: 106045 - RNA, 23 nt, Human
cccgcguucuccuggcccugccc

SEQ ID NO: 106046 - RNA, 19 nt, Human
cccgcguuuagccgccaca

SEQ ID NO: 106047 - RNA, 32 nt, Human
cccgcuaacucccauuccuaccccugcuguua

SEQ ID NO: 106048 - RNA, 32 nt, Human
cccgcuaacucccauuccuaccucugcuguua

SEQ ID NO: 106049 - RNA, 32 nt, Human
cccgcuaauguggaggaaaugagggagauacg

SEQ ID NO: 106050 - RNA, 32 nt, Human
cccgcuaccguccuggccagcuaccgucagag

SEQ ID NO: 106051 - RNA, 32 nt, Human
cccgcuaccuuucccagccucugguaacccuc

SEQ ID NO: 106052 - RNA, 32 nt, Human
cccgcuacuggugcuauccagaauucccaucu

SEQ ID NO: 106053 - RNA, 32 nt, Human
cccgcuagcauguggccaggggugcagggugg

SEQ ID NO: 106054 - RNA, 32 nt, Human
cccgcuauaccuccccuuccuccugcaucucc

SEQ ID NO: 106055 - RNA, 32 nt, Human
cccgcuaugacaaugaccuggcaccaaugggc

SEQ ID NO: 106056 - RNA, 32 nt, Human
cccgcuauuagaguauggaggaagggguuuuc

SEQ ID NO: 106057 - RNA, 32 nt, Human
cccgcucaccuuccucaccccuccucugaccc

SEQ ID NO: 106058 - RNA, 32 nt, Human
cccgcucagcuggcggucugggcugcucuggg

SEQ ID NO: 106059 - RNA, 32 nt, Human
cccgcucaggagacucgcacuggguguagacu

SEQ ID NO: 106060 - RNA, 32 nt, Human
cccgcuccaacccucgguucuuccugcaauac

SEQ ID NO: 106061 - RNA, 32 nt, Human
cccgcuccagagcuuuaaggaaaaugaaguga

SEQ ID NO: 106062 - RNA, 19 nt, Human
cccgcuccagccgccgccg

SEQ ID NO: 106063 - RNA, 32 nt, Human
cccgcucccaggaggccagggcaggccugcgu

SEQ ID NO: 106064 - RNA, 32 nt, Human
cccgcucccaugggcucccucuuuccuccugc

SEQ ID NO: 106065 - RNA, 32 nt, Human
cccgcuccccacccuccccuccccuccccuuc

SEQ ID NO: 106066 - RNA, 32 nt, Human
cccgcucccccgacgcauguggcuccagcccg

SEQ ID NO: 106067 - RNA, 32 nt, Human
cccgcucccccucaacacacacauauauaaca

SEQ ID NO: 106068 - RNA, 19 nt, Human
cccgcuccccggggaccgg

SEQ ID NO: 106069 - RNA, 32 nt, Human
cccgcuccccuccagcaguggccgcccgcgcc

SEQ ID NO: 106070 - RNA, 32 nt, Human
cccgcuccccuccuuggaggugcagugaugau

SEQ ID NO: 106071 - RNA, 32 nt, Human
cccgcucccuagagcaggagaucuugaguggg

SEQ ID NO: 106072 - RNA, 32 nt, Human
cccgcucccucacugccacacagcaaguuccg

SEQ ID NO: 106073 - RNA, 32 nt, Human
cccgcucccucuggcccuucucuguuuaguag

SEQ ID NO: 106074 - RNA, 21 nt, Human
cccgcuccgggcucagugccc

SEQ ID NO: 106075 - RNA, 32 nt, Human
cccgcuccgugccccucucugcagccucuccu

SEQ ID NO: 106076 - RNA, 32 nt, Human
cccgcuccuccaccaucuaggcccugcuccuc

SEQ ID NO: 106077 - RNA, 32 nt, Human
cccgcuccugcugaaacaccucccaggggcuc

SEQ ID NO: 106078 - RNA, 32 nt, Human
cccgcucgcaccccucucccgcgcccgguucu

SEQ ID NO: 106079 - RNA, 28 nt, Human
cccgcucggagccagccagccgucccga

SEQ ID NO: 106080 - RNA, 32 nt, Human
cccgcucggucaccgccggcucgggcgcgcac

SEQ ID NO: 106081 - RNA, 32 nt, Human
cccgcucuaggacugcagcccagccccagcuu

SEQ ID NO: 106082 - RNA, 32 nt, Human
cccgcucuccagccaagguuccgggcugaggc

SEQ ID NO: 106083 - RNA, 32 nt, Human
cccgcucuccaggaaaggcacagcugaggcac

SEQ ID NO: 106084 - RNA, 32 nt, Human
cccgcucucccagggaggaggcuggaccgagg

SEQ ID NO: 106085 - RNA, 32 nt, Human
cccgcucucuacccucucacccuugcccucug

SEQ ID NO: 106086 - RNA, 32 nt, Human
cccgcucucugccucccucuccaacgcccgga

SEQ ID NO: 106087 - RNA, 32 nt, Human
cccgcucucugccucuggaggcuaaacccugu

SEQ ID NO: 106088 - RNA, 32 nt, Human
cccgcucugcagcuccaugccccugcccagug

SEQ ID NO: 106089 - RNA, 32 nt, Human
cccgcucugcaggccgcccuucugccagcugg

SEQ ID NO: 106090 - RNA, 32 nt, Human
cccgcucugggagcaagagaagccgaagcugc

SEQ ID NO: 106091 - RNA, 32 nt, Human
cccgcucuuucgccaccuuccccagccgccgg

SEQ ID NO: 106092 - RNA, 32 nt, Human
cccgcugacagauucucgguggcggcggcagc

SEQ ID NO: 106093 - RNA, 22 nt, Human
cccgcugacccagccccagcca

SEQ ID NO: 106094 - RNA, 32 nt, Human
cccgcugagcacuuccaugaaggcgaggcugu

SEQ ID NO: 106095 - RNA, 32 nt, Human
cccgcugagggcgcaggaccugagggaguccu

SEQ ID NO: 106096 - RNA, 32 nt, Human
cccgcugaguagcuggcacuuuaaggcaggug

SEQ ID NO: 106097 - RNA, 32 nt, Human
cccgcugauagcugcgcaacagccuggguucu

SEQ ID NO: 106098 - RNA, 19 nt, Human
cccgcugcagccgccgccg

SEQ ID NO: 106099 - RNA, 32 nt, Human
cccgcugccacaucuuccaagauacgggaaau

SEQ ID NO: 106100 - RNA, 19 nt, Human
cccgcugccaccucgccca

SEQ ID NO: 106101 - RNA, 32 nt, Human
cccgcugcccaggauugguaggcuccaccgcu

SEQ ID NO: 106102 - RNA, 32 nt, Human
cccgcugcccccagcgcucccugggugggugc

SEQ ID NO: 106103 - RNA, 19 nt, Human
cccgcugccgccgccgccg

SEQ ID NO: 106104 - RNA, 32 nt, Human
cccgcugccggcuccucaccucuuugggccuc

SEQ ID NO: 106105 - RNA, 19 nt, Human
cccgcugccgucgccgccg

SEQ ID NO: 106106 - RNA, 32 nt, Human
cccgcugccuccauuucucuagaucugugcuc

SEQ ID NO: 106107 - RNA, 32 nt, Human
cccgcugcgcccgcaucagucugggccuggcc

SEQ ID NO: 106108 - RNA, 23 nt, Human
cccgcugcgcucccucgcuccuu

SEQ ID NO: 106109 - RNA, 32 nt, Human
cccgcugcgggcucgguuuccacaggcgaaug

SEQ ID NO: 106110 - RNA, 32 nt, Human
cccgcugcuaaucuccccugggccccuccccg

SEQ ID NO: 106111 - RNA, 32 nt, Human
cccgcugcucacuuuccacccucucuccaccu

SEQ ID NO: 106112 - RNA, 19 nt, Human
cccgcugcugccgccgccg

SEQ ID NO: 106113 - RNA, 32 nt, Human
cccgcugcuggccgcucucuucucugccucuc

SEQ ID NO: 106114 - RNA, 32 nt, Human
cccgcugcuguugcugcugacuccaaggagca

SEQ ID NO: 106115 - RNA, 32 nt, Human
cccgcugcuguuucaguucucucuccagggug

SEQ ID NO: 106116 - RNA, 17 nt, Human
cccgcugcuuccaggua

SEQ ID NO: 106117 - RNA, 32 nt, Human
cccgcuggaccggccacucuccccagcccccu

SEQ ID NO: 106118 - RNA, 22 nt, Human
cccgcuggcagaugaccaggac

SEQ ID NO: 106119 - RNA, 32 nt, Human
cccgcuggcauccagcucccugcuccauggcc

SEQ ID NO: 106120 - RNA, 32 nt, Human
cccgcuggccccugggcccagccugggcaccg

SEQ ID NO: 106121 - RNA, 32 nt, Human
cccgcuggccgugucugugugugugcacgugu

SEQ ID NO: 106122 - RNA, 32 nt, Human
cccgcuggcugcagagcaucccugggagccaa

SEQ ID NO: 106123 - RNA, 32 nt, Human
cccgcugggucucaaaggcagugagaagagag

SEQ ID NO: 106124 - RNA, 32 nt, Human
cccgcuggucccaggcuggauugccguggcac

SEQ ID NO: 106125 - RNA, 31 nt, Human
cccgcuggucccucugggcaugcugugcucg

SEQ ID NO: 106126 - RNA, 32 nt, Human
cccgcugguccugaccaagaucgcggcugccg

SEQ ID NO: 106127 - RNA, 32 nt, Human
cccgcuggugacccucugcuucccucucucuu

SEQ ID NO: 106128 - RNA, 32 nt, Human
cccgcugugaucuugggcaagugacuuucucc

SEQ ID NO: 106129 - RNA, 32 nt, Human
cccgcuguggggcgcugcugcagccgcucuuc

SEQ ID NO: 106130 - RNA, 32 nt, Human
cccgcugugucccuuucucucuccuuagugcc

SEQ ID NO: 106131 - RNA, 18 nt, Human
cccgcuucccggcuccag

SEQ ID NO: 106132 - RNA, 32 nt, Human
cccgcuucggauuccagguguggcagugacuc

SEQ ID NO: 106133 - RNA, 32 nt, Human
cccgcuucugcucucuuuauggacuggucaga

SEQ ID NO: 106134 - RNA, 32 nt, Human
cccgcuucuuguugggccucaggcacugguua

SEQ ID NO: 106135 - RNA, 32 nt, Human
cccgcuuggacugcauggcucuccagcuggcc

SEQ ID NO: 106136 - RNA, 32 nt, Human
cccgcuugucccgugcccuugugacccuggcu

SEQ ID NO: 106137 - RNA, 32 nt, Human
cccgcuuguuuuuccuccucuccuuuuccugc

SEQ ID NO: 106138 - RNA, 32 nt, Human
cccgcuuucucagaagggaugcgcaggcucac

SEQ ID NO: 106139 - RNA, 32 nt, Human
cccgcuuucucccaggguuucuuaucagccag

SEQ ID NO: 106140 - RNA, 32 nt, Human
cccgcuuugcagacuucggggugcucugcacg

SEQ ID NO: 106141 - RNA, 32 nt, Human
cccgcuuuucacagacuggggaaauggacgcc

SEQ ID NO: 106142 - RNA, 32 nt, Human
cccggaacaaaguggaggaaugacagaggugu

SEQ ID NO: 106143 - RNA, 21 nt, Human
cccggaacacacccucucaca

SEQ ID NO: 106144 - RNA, 20 nt, Human
cccggaaccguuagguacug

SEQ ID NO: 106145 - RNA, 23 nt, Human
cccggaagccacccaacuucccu

SEQ ID NO: 106146 - RNA, 32 nt, Human
cccggaagccagucccucccccuagaccccgc

SEQ ID NO: 106147 - RNA, 32 nt, Human
cccggaagccccgcgggggaugcgccgagggc

SEQ ID NO: 106148 - RNA, 23 nt, Human
cccggaagcgaagguugcaguga

SEQ ID NO: 106149 - RNA, 24 nt, Human
cccggaaggcagagcuugcaguga

SEQ ID NO: 106150 - RNA, 32 nt, Human
cccggaaggcagagcuugcagugagccgagau

SEQ ID NO: 106151 - RNA, 24 nt, Human
cccggaaggcagagguugcaguga

SEQ ID NO: 106152 - RNA, 32 nt, Human
cccggaaggcagagguugcagugagccgagau

SEQ ID NO: 106153 - RNA, 31 nt, Human
cccggaaggcagagguugcagugagcugaga

SEQ ID NO: 106154 - RNA, 32 nt, Human
cccggaaggccgcggcggcgucccggcugcua

SEQ ID NO: 106155 - RNA, 24 nt, Human
cccggaaggcggagcuugcaguga

SEQ ID NO: 106156 - RNA, 32 nt, Human
cccggaaggcggagcuugcagugagccgagau

SEQ ID NO: 106157 - RNA, 23 nt, Human
cccggaaggcggagguugcagug

SEQ ID NO: 106158 - RNA, 24 nt, Human
cccggaaggcggagguugcaguga

SEQ ID NO: 106159 - RNA, 32 nt, Human
cccggaaggcggagguugcagugagccaagau

SEQ ID NO: 106160 - RNA, 31 nt, Human
cccggaaggcggagguugcagugagcugaga

SEQ ID NO: 106161 - RNA, 32 nt, Human
cccggaagggccugggcuggcuguggcccagu

SEQ ID NO: 106162 - RNA, 22 nt, Human
cccggaagggugagucuggacg

SEQ ID NO: 106163 - RNA, 24 nt, Human
cccggaagguggagguugcaguga

SEQ ID NO: 106164 - RNA, 32 nt, Human
cccggaagguggagguugcagugagccgagau

SEQ ID NO: 106165 - RNA, 27 nt, Human
cccggaagguggagguuguugcgguga

SEQ ID NO: 106166 - RNA, 24 nt, Human
cccggaagguggaguuugcaguga

SEQ ID NO: 106167 - RNA, 32 nt, Human
cccggaagguggaguuugcagugagccgagau

SEQ ID NO: 106168 - RNA, 32 nt, Human
cccggaauccacaccaccccacccuccuccug

SEQ ID NO: 106169 - RNA, 19 nt, Human
cccggaauuguacuuguca

SEQ ID NO: 106170 - RNA, 32 nt, Human
cccggacacaguacuccagauguugucugacc

SEQ ID NO: 106171 - RNA, 32 nt, Human
cccggacaccacagcucaaagacucaagccag

SEQ ID NO: 106172 - RNA, 26 nt, Human
cccggacacccucucagcuccugccc

SEQ ID NO: 106173 - RNA, 32 nt, Human
cccggacaccuggaagcugggaaaugaaguca

SEQ ID NO: 106174 - RNA, 32 nt, Human
cccggacacucaacagccuccaccucccuuuc

SEQ ID NO: 106175 - RNA, 32 nt, Human
cccggacagaggcuggagggcuggggcugcgu

SEQ ID NO: 106176 - RNA, 32 nt, Human
cccggacagccaggugacuaccaguccugggg

SEQ ID NO: 106177 - RNA, 32 nt, Human
cccggacccauccaagucaucugauugaagag

SEQ ID NO: 106178 - RNA, 32 nt, Human
cccggaccccuuguuacucaggaaccucaccu

SEQ ID NO: 106179 - RNA, 32 nt, Human
cccggaccugcucuccguugcgguuuggccuc

SEQ ID NO: 106180 - RNA, 32 nt, Human
cccggaccuggacguugccuccagagcaggca

SEQ ID NO: 106181 - RNA, 22 nt, Human
cccggacgccagcgccgcgccc

SEQ ID NO: 106182 - RNA, 32 nt, Human
cccggacgcccaggaccccauggcagugggaa

SEQ ID NO: 106183 - RNA, 24 nt, Human
cccggacgcccgagcgccccgccc

SEQ ID NO: 106184 - RNA, 32 nt, Human
cccggacgccugcuggccaggccccggucaug

SEQ ID NO: 106185 - RNA, 32 nt, Human
cccggacgcgcgagccugaggauucugcacaa

SEQ ID NO: 106186 - RNA, 32 nt, Human
cccggacucaagccccggacucaggcccccac

SEQ ID NO: 106187 - RNA, 28 nt, Human
cccggacucugcgccccgucccaugccc

SEQ ID NO: 106188 - RNA, 32 nt, Human
cccggacucuuuuuaaaugucucccccuaagu

SEQ ID NO: 106189 - RNA, 32 nt, Human
cccggacuggaggaggugaggucgagagccag

SEQ ID NO: 106190 - RNA, 32 nt, Human
cccggacugucuuuccuccacccgcccaugga

SEQ ID NO: 106191 - RNA, 32 nt, Human
cccggagaagguggagggagacgagaagccgc

SEQ ID NO: 106192 - RNA, 28 nt, Human
cccggagaccuggaggacagcagugcug

SEQ ID NO: 106193 - RNA, 32 nt, Human
cccggagacuccugccgucacgcccggggcuc

SEQ ID NO: 106194 - RNA, 32 nt, Human
cccggagagggggagccgcggggacgcagcga

SEQ ID NO: 106195 - RNA, 23 nt, Human
cccggagauggagguugcaguga

SEQ ID NO: 106196 - RNA, 32 nt, Human
cccggagcaagucccaugagucucagcugggg

SEQ ID NO: 106197 - RNA, 32 nt, Human
cccggagcacaaugggagugggcuggcggggu

SEQ ID NO: 106198 - RNA, 22 nt, Human
cccggagcaccaacuccguguc

SEQ ID NO: 106199 - RNA, 18 nt, Human
cccggagcacccuaggcg

SEQ ID NO: 106200 - RNA, 25 nt, Human
cccggagcagaagcagcagcagcag

SEQ ID NO: 106201 - RNA, 19 nt, Human
cccggagcagcccaggagc

SEQ ID NO: 106202 - RNA, 32 nt, Human
cccggagcagccuguuccugcacuccacccug

SEQ ID NO: 106203 - RNA, 32 nt, Human
cccggagcaggguggggaggugcaguggcacc

SEQ ID NO: 106204 - RNA, 32 nt, Human
cccggagccacagccgcagccccagccccggc

SEQ ID NO: 106205 - RNA, 32 nt, Human
cccggagccaucacccucacccacucuggugg

SEQ ID NO: 106206 - RNA, 23 nt, Human
cccggagcccaagcgcuccggcg

SEQ ID NO: 106207 - RNA, 32 nt, Human
cccggagcccaggaggggagggcgggccgccu

SEQ ID NO: 106208 - RNA, 23 nt, Human
cccggagcccccgcauaucagca

SEQ ID NO: 106209 - RNA, 24 nt, Human
cccggagcccccgcggacgccggc

SEQ ID NO: 106210 - RNA, 21 nt, Human
cccggagccccgaagacucgg

SEQ ID NO: 106211 - RNA, 23 nt, Human
cccggagccccgcagcucgggca

SEQ ID NO: 106212 - RNA, 20 nt, Human
cccggagcccggagcccggc

SEQ ID NO: 106213 - RNA, 32 nt, Human
cccggagcccggccguagaggcugcaaucgca

SEQ ID NO: 106214 - RNA, 18 nt, Human
cccggagccgccgcgccg

SEQ ID NO: 106215 - RNA, 32 nt, Human
cccggagccugagccacugacaggagaggaga

SEQ ID NO: 106216 - RNA, 32 nt, Human
cccggagccuguagaacuugaaucuagaggaa

SEQ ID NO: 106217 - RNA, 32 nt, Human
cccggagccuucaagcccugggucccugaggg

SEQ ID NO: 106218 - RNA, 32 nt, Human
cccggagcggaaaacugcucaaaccacaaaca

SEQ ID NO: 106219 - RNA, 18 nt, Human
cccggagcggcccuggcg

SEQ ID NO: 106220 - RNA, 32 nt, Human
cccggagcucaggcccuggugaggggcugggu

SEQ ID NO: 106221 - RNA, 32 nt, Human
cccggagcucgagcaugaugcccaggcagagg

SEQ ID NO: 106222 - RNA, 32 nt, Human
cccggagcugcaaacugcagagcccaggcaac

SEQ ID NO: 106223 - RNA, 32 nt, Human
cccggagcuuucuccauugucucugccuuuac

SEQ ID NO: 106224 - RNA, 32 nt, Human
cccggaggaaagcacggugcagaggaaacggu

SEQ ID NO: 106225 - RNA, 32 nt, Human
cccggaggaaaucugcagagggguuaggagug

SEQ ID NO: 106226 - RNA, 32 nt, Human
cccggaggaacaacaguggagaagcaggcggg

SEQ ID NO: 106227 - RNA, 32 nt, Human
cccggaggacaggagaaaaccacggacuggcu

SEQ ID NO: 106228 - RNA, 32 nt, Human
cccggaggagcggccugcgccgccgcgcgaga

SEQ ID NO: 106229 - RNA, 32 nt, Human
cccggaggaggaggaggaggaggaggaggagg

SEQ ID NO: 106230 - RNA, 18 nt, Human
cccggaggaggggggcag

SEQ ID NO: 106231 - RNA, 20 nt, Human
cccggaggcagagcuuguag

SEQ ID NO: 106232 - RNA, 23 nt, Human
cccggaggcagggguugcaguga

SEQ ID NO: 106233 - RNA, 22 nt, Human
cccggaggccacaugaguccca

SEQ ID NO: 106234 - RNA, 24 nt, Human
cccggaggcccccacccuggcgug

SEQ ID NO: 106235 - RNA, 32 nt, Human
cccggaggccuccauccuccccuagagggguc

SEQ ID NO: 106236 - RNA, 30 nt, Human
cccggaggccucuccgcuccugcacaggcc

SEQ ID NO: 106237 - RNA, 21 nt, Human
cccggaggccugcuccucggc

SEQ ID NO: 106238 - RNA, 23 nt, Human
cccggaggcggagguugcaguga

SEQ ID NO: 106239 - RNA, 21 nt, Human
cccggaggcggagguugcggu

SEQ ID NO: 106240 - RNA, 23 nt, Human
cccggaggcggagguugcgguaa

SEQ ID NO: 106241 - RNA, 19 nt, Human
cccggaggcggcggcgcag

SEQ ID NO: 106242 - RNA, 20 nt, Human
cccggaggcgggaggagcag

SEQ ID NO: 106243 - RNA, 19 nt, Human
cccggaggcgguggcgcag

SEQ ID NO: 106244 - RNA, 32 nt, Human
cccggaggcuuagggugcagccucccuggucu

SEQ ID NO: 106245 - RNA, 18 nt, Human
cccggagggagggggcca

SEQ ID NO: 106246 - RNA, 32 nt, Human
cccggagggggcuguacaaaaugcagacagaa

SEQ ID NO: 106247 - RNA, 24 nt, Human
cccggagggugcgauuccucggcc

SEQ ID NO: 106248 - RNA, 32 nt, Human
cccggagggugggaggagguugcaguauucug

SEQ ID NO: 106249 - RNA, 23 nt, Human
cccggaggucgaggcugcagugg

SEQ ID NO: 106250 - RNA, 24 nt, Human
cccggaggugaccugggcucuggg

SEQ ID NO: 106251 - RNA, 18 nt, Human
cccggagguggcagcagc

SEQ ID NO: 106252 - RNA, 21 nt, Human
cccggagucaggaggccgcag

SEQ ID NO: 106253 - RNA, 32 nt, Human
cccggaucaagaaacugcaggaagagaaaacu

SEQ ID NO: 106254 - RNA, 21 nt, Human
cccggaucauucacugugaua

SEQ ID NO: 106255 - RNA, 32 nt, Human
cccggaugaccagaggccccuugaaaaggagg

SEQ ID NO: 106256 - RNA, 32 nt, Human
cccggauucugagcucagugugguguuuggug

SEQ ID NO: 106257 - RNA, 18 nt, Human
cccggcaaggcuggccag

SEQ ID NO: 106258 - RNA, 19 nt, Human
cccggcaagugccuggggc

SEQ ID NO: 106259 - RNA, 32 nt, Human
cccggcacaggauggggcaggcucuggcacag

SEQ ID NO: 106260 - RNA, 21 nt, Human
cccggcacagugagcggagcg

SEQ ID NO: 106261 - RNA, 26 nt, Human
cccggcaccauggcuacuaccggggc

SEQ ID NO: 106262 - RNA, 32 nt, Human
cccggcaccaugucggagaaaagcguggaggc

SEQ ID NO: 106263 - RNA, 27 nt, Human
cccggcacccugcuccaucggcacugg

SEQ ID NO: 106264 - RNA, 32 nt, Human
cccggcaccucccccgccccugcccaccgccc

SEQ ID NO: 106265 - RNA, 32 nt, Human
cccggcacggcaagaggagcaagagcaaggac

SEQ ID NO: 106266 - RNA, 20 nt, Human
cccggcacggggaggcgcgg

SEQ ID NO: 106267 - RNA, 32 nt, Human
cccggcacugccacguuuuccaaggaaccugc

SEQ ID NO: 106268 - RNA, 32 nt, Human
cccggcacuggcaggggaaaagggcagacugg

SEQ ID NO: 106269 - RNA, 22 nt, Human
cccggcagaccccgcuggccgc

SEQ ID NO: 106270 - RNA, 18 nt, Human
cccggcagacgggugcag

SEQ ID NO: 106271 - RNA, 32 nt, Human
cccggcagaggaaggaucagagggucgcggcc

SEQ ID NO: 106272 - RNA, 32 nt, Human
cccggcagaugcuugcccaguaguucuggagg

SEQ ID NO: 106273 - RNA, 24 nt, Human
cccggcagcagcccccagcuccca

SEQ ID NO: 106274 - RNA, 32 nt, Human
cccggcagcccccauccaucugugucugucug

SEQ ID NO: 106275 - RNA, 32 nt, Human
cccggcagccgcugccccgggcucgacugggc

SEQ ID NO: 106276 - RNA, 32 nt, Human
cccggcagccuccccucgcucgcucuccucuu

SEQ ID NO: 106277 - RNA, 21 nt, Human
cccggcagcggcagcggcagc

SEQ ID NO: 106278 - RNA, 22 nt, Human
cccggcagcggcagcggcagcg

SEQ ID NO: 106279 - RNA, 32 nt, Human
cccggcagcugcagccccuuccagaugaagac

SEQ ID NO: 106280 - RNA, 20 nt, Human
cccggcaggaggaagcccag

SEQ ID NO: 106281 - RNA, 18 nt, Human
cccggcaggaggccgcgg

SEQ ID NO: 106282 - RNA, 32 nt, Human
cccggcaggagggagagggcacaccgccagcc

SEQ ID NO: 106283 - RNA, 32 nt, Human
cccggcaggcagagcuugcagugagccgagau

SEQ ID NO: 106284 - RNA, 24 nt, Human
cccggcaggcagagguugcaguga

SEQ ID NO: 106285 - RNA, 32 nt, Human
cccggcaggcagagguugcagugagccgagau

SEQ ID NO: 106286 - RNA, 17 nt, Human
cccggcaggcccaggcc

SEQ ID NO: 106287 - RNA, 23 nt, Human
cccggcaggcggagguugcagug

SEQ ID NO: 106288 - RNA, 24 nt, Human
cccggcaggcggagguugcaguga

SEQ ID NO: 106289 - RNA, 32 nt, Human
cccggcaggcggagguugcagugagcggagau

SEQ ID NO: 106290 - RNA, 32 nt, Human
cccggcagggaggcagggaggcugcagaguca

SEQ ID NO: 106291 - RNA, 19 nt, Human
cccggcagggcgugcgcag

SEQ ID NO: 106292 - RNA, 24 nt, Human
cccggcaggggugggaggcagcag

SEQ ID NO: 106293 - RNA, 21 nt, Human
cccggcagucucuggggcgca

SEQ ID NO: 106294 - RNA, 32 nt, Human
cccggcagugccuguagcaccgaggagcaaag

SEQ ID NO: 106295 - RNA, 32 nt, Human
cccggcaguggacucgcugauccugggccgca

SEQ ID NO: 106296 - RNA, 32 nt, Human
cccggcaucucaggcugcuucuggacagagca

SEQ ID NO: 106297 - RNA, 22 nt, Human
cccggcaugcauuuggcauugg

SEQ ID NO: 106298 - RNA, 32 nt, Human
cccggcaugguggcucacaccuguaaucccag

SEQ ID NO: 106299 - RNA, 32 nt, Human
cccggcaugguggcucaugccuguaaucccag

SEQ ID NO: 106300 - RNA, 32 nt, Human
cccggcauuauggggacagagagcagggggca

SEQ ID NO: 106301 - RNA, 32 nt, Human
cccggcauugacuggcauagguggugagcccg

SEQ ID NO: 106302 - RNA, 32 nt, Human
cccggccaacagcaacaccggaugccgggaga

SEQ ID NO: 106303 - RNA, 32 nt, Human
cccggccaacagcucacuagcuggcaagcagu

SEQ ID NO: 106304 - RNA, 24 nt, Human
cccggccaagcccagucacgagaa

SEQ ID NO: 106305 - RNA, 20 nt, Human
cccggccaaggacccaggcg

SEQ ID NO: 106306 - RNA, 23 nt, Human
cccggccaaggacccaggcgcug

SEQ ID NO: 106307 - RNA, 32 nt, Human
cccggccaaguauuuuuauauuucagaucaua

SEQ ID NO: 106308 - RNA, 32 nt, Human
cccggccaccacugcuggcuucagccccuuga

SEQ ID NO: 106309 - RNA, 16 nt, Human
cccggccaccgcugcc

SEQ ID NO: 106310 - RNA, 32 nt, Human
cccggccaccuccuguccaggucuccaucccc

SEQ ID NO: 106311 - RNA, 19 nt, Human
cccggccacggcgggcacu

SEQ ID NO: 106312 - RNA, 20 nt, Human
cccggccacggggggcgcug

SEQ ID NO: 106313 - RNA, 24 nt, Human
cccggccacuccaucaggcacuga

SEQ ID NO: 106314 - RNA, 20 nt, Human
cccggccacuccucugacac

SEQ ID NO: 106315 - RNA, 21 nt, Human
cccggccacucgggaggcuga

SEQ ID NO: 106316 - RNA, 32 nt, Human
cccggccacugcaggaugcccaccugggccac

SEQ ID NO: 106317 - RNA, 32 nt, Human
cccggccagcacuaugcccaucuuacuguucc

SEQ ID NO: 106318 - RNA, 32 nt, Human
cccggccagcaggaccuggccugcagauccca

SEQ ID NO: 106319 - RNA, 32 nt, Human
cccggccagugccucugcuuccggcucgaauu

SEQ ID NO: 106320 - RNA, 32 nt, Human
cccggccauaucccccaugcuuuccgggccuc

SEQ ID NO: 106321 - RNA, 32 nt, Human
cccggccaucauuccuuuuuacugcugacuaa

SEQ ID NO: 106322 - RNA, 32 nt, Human
cccggccauccagcggggcugccagagaaccc

SEQ ID NO: 106323 - RNA, 32 nt, Human
cccggccauggccaccaccagcaccacgggcu

SEQ ID NO: 106324 - RNA, 32 nt, Human
cccggccauucaaccacugcagccacugguua

SEQ ID NO: 106325 - RNA, 32 nt, Human
cccggcccaaccucgcccucucucaccagccu

SEQ ID NO: 106326 - RNA, 17 nt, Human
cccggcccaacuggaug

SEQ ID NO: 106327 - RNA, 32 nt, Human
cccggcccaagccaggcgcuagaagggcuggu

SEQ ID NO: 106328 - RNA, 22 nt, Human
cccggcccaaucuuugguccca

SEQ ID NO: 106329 - RNA, 23 nt, Human
cccggcccacaauuaauuuuaga

SEQ ID NO: 106330 - RNA, 32 nt, Human
cccggccccaaaccacaggggcucaggucgug

SEQ ID NO: 106331 - RNA, 23 nt, Human
cccggccccacuccuggcucuca

SEQ ID NO: 106332 - RNA, 24 nt, Human
cccggccccagccagccccgacgg

SEQ ID NO: 106333 - RNA, 32 nt, Human
cccggccccagccauggaagagcucacggcuu

SEQ ID NO: 106334 - RNA, 32 nt, Human
cccggccccagccucagcccugagcgucucgg

SEQ ID NO: 106335 - RNA, 22 nt, Human
cccggccccagcuucucugguc

SEQ ID NO: 106336 - RNA, 32 nt, Human
cccggccccagugcccuuucgcggccacaagc

SEQ ID NO: 106337 - RNA, 21 nt, Human
cccggcccccacccuguccag

SEQ ID NO: 106338 - RNA, 22 nt, Human
cccggcccccaggucgcagcag

SEQ ID NO: 106339 - RNA, 22 nt, Human
cccggcccccaugcagccccug

SEQ ID NO: 106340 - RNA, 22 nt, Human
cccggcccccgccaggccgcgu

SEQ ID NO: 106341 - RNA, 24 nt, Human
cccggcccccggccccgggcccag

SEQ ID NO: 106342 - RNA, 32 nt, Human
cccggcccccuccaacguccccagcauugccc

SEQ ID NO: 106343 - RNA, 20 nt, Human
cccggcccccugccacugcc

SEQ ID NO: 106344 - RNA, 32 nt, Human
cccggcccccuucaccccuucagccgagccca

SEQ ID NO: 106345 - RNA, 20 nt, Human
cccggccccgaagcuccgcc

SEQ ID NO: 106346 - RNA, 21 nt, Human
cccggccccgccgagccacag

SEQ ID NO: 106347 - RNA, 19 nt, Human
cccggccccggaggagccc

SEQ ID NO: 106348 - RNA, 21 nt, Human
cccggccccggccccagccag

SEQ ID NO: 106349 - RNA, 20 nt, Human
cccggccccggcugccagca

SEQ ID NO: 106350 - RNA, 21 nt, Human
cccggccccgggcucugagcg

SEQ ID NO: 106351 - RNA, 21 nt, Human
cccggccccguagagucccug

SEQ ID NO: 106352 - RNA, 25 nt, Human
cccggccccgugcggccacugcgga

SEQ ID NO: 106353 - RNA, 32 nt, Human
cccggccccuaccuccuaccaccagcuccucu

SEQ ID NO: 106354 - RNA, 21 nt, Human
cccggccccuagcaccgccgg

SEQ ID NO: 106355 - RNA, 32 nt, Human
cccggccccuccccucucccucccucuguccc

SEQ ID NO: 106356 - RNA, 24 nt, Human
cccggccccuccucagcagcgcag

SEQ ID NO: 106357 - RNA, 32 nt, Human
cccggccccucgggccucugcacagccucuuu

SEQ ID NO: 106358 - RNA, 28 nt, Human
cccggccccugagcugccuccuccagcc

SEQ ID NO: 106359 - RNA, 32 nt, Human
cccggccccugccccucccuccggguggaacu

SEQ ID NO: 106360 - RNA, 32 nt, Human
cccggccccugcccgggcuggaguugccacag

SEQ ID NO: 106361 - RNA, 32 nt, Human
cccggccccugccgcccugccacuaugucccg

SEQ ID NO: 106362 - RNA, 32 nt, Human
cccggccccugugcuggagauaccaagggcau

SEQ ID NO: 106363 - RNA, 21 nt, Human
cccggcccgacucuaucacaa

SEQ ID NO: 106364 - RNA, 18 nt, Human
cccggcccgcgcaggacc

SEQ ID NO: 106365 - RNA, 32 nt, Human
cccggcccggccacagcacaaaggaaagcgag

SEQ ID NO: 106366 - RNA, 32 nt, Human
cccggcccggcgccuucucucccuccgggggc

SEQ ID NO: 106367 - RNA, 20 nt, Human
cccggcccggcucggcccca

SEQ ID NO: 106368 - RNA, 32 nt, Human
cccggcccggcugaggccaucauggggaugcg

SEQ ID NO: 106369 - RNA, 32 nt, Human
cccggcccuaucuuacucuucucagcuucuca

SEQ ID NO: 106370 - RNA, 32 nt, Human
cccggcccucaagggacgcugucuggggccgg

SEQ ID NO: 106371 - RNA, 19 nt, Human
cccggcccucaccacugcc

SEQ ID NO: 106372 - RNA, 32 nt, Human
cccggcccuccagccagccuucugccggcccc

SEQ ID NO: 106373 - RNA, 21 nt, Human
cccggcccugcgccccgccga

SEQ ID NO: 106374 - RNA, 27 nt, Human
cccggcccugcuuuuauuuauuuugga

SEQ ID NO: 106375 - RNA, 32 nt, Human
cccggcccuggcccagccagcccagcccucga

SEQ ID NO: 106376 - RNA, 32 nt, Human
cccggcccuuccagauucgccugugagcgaug

SEQ ID NO: 106377 - RNA, 32 nt, Human
cccggcccuucccucacuuccauccaucucua

SEQ ID NO: 106378 - RNA, 32 nt, Human
cccggccgacagggcuggacggcucuaggcag

SEQ ID NO: 106379 - RNA, 23 nt, Human
cccggccgaccauccccgugccc

SEQ ID NO: 106380 - RNA, 32 nt, Human
cccggccgagcgggcagggagagccaguccug

SEQ ID NO: 106381 - RNA, 23 nt, Human
cccggccgccaaggcaggcuugg

SEQ ID NO: 106382 - RNA, 32 nt, Human
cccggccgccaggcgccucuacuccaggaugg

SEQ ID NO: 106383 - RNA, 32 nt, Human
cccggccgccccuccguucccagccugcccug

SEQ ID NO: 106384 - RNA, 32 nt, Human
cccggccgcccgcgcggggucucccccauggu

SEQ ID NO: 106385 - RNA, 17 nt, Human
cccggccgccgcuuccg

SEQ ID NO: 106386 - RNA, 19 nt, Human
cccggccgccggcccggca

SEQ ID NO: 106387 - RNA, 23 nt, Human
cccggccgccggccgggagcugg

SEQ ID NO: 106388 - RNA, 26 nt, Human
cccggccgcucagcccccgggcacug

SEQ ID NO: 106389 - RNA, 21 nt, Human
cccggccgcuccccgaggcgc

SEQ ID NO: 106390 - RNA, 22 nt, Human
cccggccgcuccgggccccugg

SEQ ID NO: 106391 - RNA, 22 nt, Human
cccggccgcugcaaggcucugg

SEQ ID NO: 106392 - RNA, 22 nt, Human
cccggccgggcgcaggggcugg

SEQ ID NO: 106393 - RNA, 32 nt, Human
cccggccggucucacccugggcucagcaugag

SEQ ID NO: 106394 - RNA, 17 nt, Human
cccggccgucgccgccg

SEQ ID NO: 106395 - RNA, 32 nt, Human
cccggccgucuucgcccccucucccccuccuu

SEQ ID NO: 106396 - RNA, 32 nt, Human
cccggccuaaccaggcuggagugcaguggugg

SEQ ID NO: 106397 - RNA, 32 nt, Human
cccggccuaaguagcugguuuuauaaggcggc

SEQ ID NO: 106398 - RNA, 24 nt, Human
cccggccuauuuauaauuuuuuga

SEQ ID NO: 106399 - RNA, 32 nt, Human
cccggccuccccucgcucugaggcucgggguc

SEQ ID NO: 106400 - RNA, 32 nt, Human
cccggccuccccucucauuuaugaugcccucu

SEQ ID NO: 106401 - RNA, 32 nt, Human
cccggccucccucccaccccuucuuauuuauu

SEQ ID NO: 106402 - RNA, 32 nt, Human
cccggccuccgcccucuccuccucuccuuucc

SEQ ID NO: 106403 - RNA, 17 nt, Human
cccggccuccgcugccg

SEQ ID NO: 106404 - RNA, 32 nt, Human
cccggccuccugaguaccugggauuauaggca

SEQ ID NO: 106405 - RNA, 17 nt, Human
cccggccucgccuggcg

SEQ ID NO: 106406 - RNA, 24 nt, Human
cccggccucggaugccacugccga

SEQ ID NO: 106407 - RNA, 32 nt, Human
cccggccucucucuucccagcugcagaugcca

SEQ ID NO: 106408 - RNA, 24 nt, Human
cccggccucugcccuggcaugguc

SEQ ID NO: 106409 - RNA, 32 nt, Human
cccggccucugccucuuguuaauuugaccaca

SEQ ID NO: 106410 - RNA, 32 nt, Human
cccggccugaacuaaggagcaguggcagaagg

SEQ ID NO: 106411 - RNA, 22 nt, Human
cccggccugacagaaucaagaa

SEQ ID NO: 106412 - RNA, 32 nt, Human
cccggccugcacccucuuucuugucucucagg

SEQ ID NO: 106413 - RNA, 17 nt, Human
cccggccugcagcaguu

SEQ ID NO: 106414 - RNA, 32 nt, Human
cccggccugcagcguccccgacgugcuccgcc

SEQ ID NO: 106415 - RNA, 32 nt, Human
cccggccugccccugucgccacguggacaguc

SEQ ID NO: 106416 - RNA, 32 nt, Human
cccggccugccugagcccugaugcugcuguca

SEQ ID NO: 106417 - RNA, 32 nt, Human
cccggccugccugggccugggccuugguucuc

SEQ ID NO: 106418 - RNA, 20 nt, Human
cccggccugcuccacuucua

SEQ ID NO: 106419 - RNA, 20 nt, Human
cccggccuggagugcagugg

SEQ ID NO: 106420 - RNA, 24 nt, Human
cccggccuggaugccagcuguguc

SEQ ID NO: 106421 - RNA, 22 nt, Human
cccggccugggucaucaggcac

SEQ ID NO: 106422 - RNA, 32 nt, Human
cccggccuggguggcgccagcaggcuuggaca

SEQ ID NO: 106423 - RNA, 32 nt, Human
cccggccuguuccccagcccugccuggaagcc

SEQ ID NO: 106424 - RNA, 32 nt, Human
cccggccuucucccgcuccugagggcuguggc

SEQ ID NO: 106425 - RNA, 32 nt, Human
cccggcgaccuccacccucaucacccugcugg

SEQ ID NO: 106426 - RNA, 19 nt, Human
cccggcgacgugggccgcg

SEQ ID NO: 106427 - RNA, 32 nt, Human
cccggcgaggacaagagcagggcggccgccuu

SEQ ID NO: 106428 - RNA, 32 nt, Human
cccggcgaggggcaagcgggggacccagccgg

SEQ ID NO: 106429 - RNA, 32 nt, Human
cccggcgcaccaccagcaccaccagccccagg

SEQ ID NO: 106430 - RNA, 19 nt, Human
cccggcgcagcagcagcag

SEQ ID NO: 106431 - RNA, 32 nt, Human
cccggcgcagcgggagcggcggggcgugccug

SEQ ID NO: 106432 - RNA, 20 nt, Human
cccggcgcagcuccggcagc

SEQ ID NO: 106433 - RNA, 20 nt, Human
cccggcgcaggcccggcagc

SEQ ID NO: 106434 - RNA, 32 nt, Human
cccggcgcaguggcucacaccuguaaucucag

SEQ ID NO: 106435 - RNA, 32 nt, Human
cccggcgcaguggcucaugccuguaaucccag

SEQ ID NO: 106436 - RNA, 23 nt, Human
cccggcgccaggagggggugcag

SEQ ID NO: 106437 - RNA, 22 nt, Human
cccggcgccccuaggacagcgu

SEQ ID NO: 106438 - RNA, 23 nt, Human
cccggcgccgccagcagcagcag

SEQ ID NO: 106439 - RNA, 25 nt, Human
cccggcgccgccagcagcagcagcg

SEQ ID NO: 106440 - RNA, 20 nt, Human
cccggcgccgcccgcucggc

SEQ ID NO: 106441 - RNA, 19 nt, Human
cccggcgccgccgccgccg

SEQ ID NO: 106442 - RNA, 23 nt, Human
cccggcgccuacgcagcagcggc

SEQ ID NO: 106443 - RNA, 23 nt, Human
cccggcgccuccguuagggcugg

SEQ ID NO: 106444 - RNA, 22 nt, Human
cccggcgccugcacgcggcgcg

SEQ ID NO: 106445 - RNA, 32 nt, Human
cccggcgccugggccuacccagcuucgggcuc

SEQ ID NO: 106446 - RNA, 32 nt, Human
cccggcgcgauggcucacgccuguaaucccag

SEQ ID NO: 106447 - RNA, 19 nt, Human
cccggcgcgccgggccaug

SEQ ID NO: 106448 - RNA, 18 nt, Human
cccggcgcggccucgggg

SEQ ID NO: 106449 - RNA, 32 nt, Human
cccggcgcgggaggaggagcgggagccagccc

SEQ ID NO: 106450 - RNA, 32 nt, Human
cccggcgcggugccucaugccuguaaucccag

SEQ ID NO: 106451 - RNA, 19 nt, Human
cccggcgcguggggugcag

SEQ ID NO: 106452 - RNA, 25 nt, Human
cccggcgcucuccuggcucccuucu

SEQ ID NO: 106453 - RNA, 32 nt, Human
cccggcgcugacuucgaggcccggcuauggac

SEQ ID NO: 106454 - RNA, 32 nt, Human
cccggcgcugugcucguccucccugcccaggg

SEQ ID NO: 106455 - RNA, 32 nt, Human
cccggcgcuuggaggcggaggagaagccauug

SEQ ID NO: 106456 - RNA, 24 nt, Human
cccggcggagcagcagcggccgcg

SEQ ID NO: 106457 - RNA, 32 nt, Human
cccggcggagcugagcgcccuggaagagcaga

SEQ ID NO: 106458 - RNA, 32 nt, Human
cccggcggaggugggagagagucaggcaggag

SEQ ID NO: 106459 - RNA, 32 nt, Human
cccggcggcaugagccgcagcgugcucgcccc

SEQ ID NO: 106460 - RNA, 32 nt, Human
cccggcggcccaggcacagaagggcagggcca

SEQ ID NO: 106461 - RNA, 32 nt, Human
cccggcggcgcgcuccagccgguguaggcgag

SEQ ID NO: 106462 - RNA, 23 nt, Human
cccggcggcuccggaguccggga

SEQ ID NO: 106463 - RNA, 23 nt, Human
cccggcggcugacagcagcagcg

SEQ ID NO: 106464 - RNA, 22 nt, Human
cccggcggcuuugugggcgcag

SEQ ID NO: 106465 - RNA, 22 nt, Human
cccggcgggcagagguugcagu

SEQ ID NO: 106466 - RNA, 24 nt, Human
cccggcgggcagagguugcaguaa

SEQ ID NO: 106467 - RNA, 20 nt, Human
cccggcgggcgcccccgggc

SEQ ID NO: 106468 - RNA, 22 nt, Human
cccggcgggcgggcucugggcg

SEQ ID NO: 106469 - RNA, 19 nt, Human
cccggcgggugggaggcgc

SEQ ID NO: 106470 - RNA, 22 nt, Human
cccggcggguugggaggggcag

SEQ ID NO: 106471 - RNA, 32 nt, Human
cccggcggugcuacccuccaccucccaccucc

SEQ ID NO: 106472 - RNA, 32 nt, Human
cccggcguacuggucgggcauggcggccaccu

SEQ ID NO: 106473 - RNA, 19 nt, Human
cccggcgucgugggccgcg

SEQ ID NO: 106474 - RNA, 32 nt, Human
cccggcgugcugguaauuccuacacuuguggg

SEQ ID NO: 106475 - RNA, 32 nt, Human
cccggcgugggcugccccagugccuuggaacc

SEQ ID NO: 106476 - RNA, 32 nt, Human
cccggcgugguggaucaugccuguaaucccag

SEQ ID NO: 106477 - RNA, 32 nt, Human
cccggcuaauuuuuguauuuuguauuuuuagu

SEQ ID NO: 106478 - RNA, 21 nt, Human
cccggcuacucgggaggcuga

SEQ ID NO: 106479 - RNA, 21 nt, Human
cccggcuacugcggguccugg

SEQ ID NO: 106480 - RNA, 21 nt, Human
cccggcuacuugggaggcuga

SEQ ID NO: 106481 - RNA, 22 nt, Human
cccggcuagucuccggcgcugg

SEQ ID NO: 106482 - RNA, 20 nt, Human
cccggcuaugggggcacuga

SEQ ID NO: 106483 - RNA, 32 nt, Human
cccggcucacugcaaccuccaccucccagguu

SEQ ID NO: 106484 - RNA, 32 nt, Human
cccggcucacugcaaccuccgccucccugguu

SEQ ID NO: 106485 - RNA, 32 nt, Human
cccggcucagccaggccaggauggcggggugg

SEQ ID NO: 106486 - RNA, 32 nt, Human
cccggcucaguguuggguuugcacuggugcac

SEQ ID NO: 106487 - RNA, 32 nt, Human
cccggcuccacuucuaggccauguuuugacuc

SEQ ID NO: 106488 - RNA, 16 nt, Human
cccggcuccagcauca

SEQ ID NO: 106489 - RNA, 20 nt, Human
cccggcucccccagccccca

SEQ ID NO: 106490 - RNA, 22 nt, Human
cccggcucccgccauccgccga

SEQ ID NO: 106491 - RNA, 32 nt, Human
cccggcuccugccugcgccucucccuccacac

SEQ ID NO: 106492 - RNA, 21 nt, Human
cccggcuccuggucaccuagg

SEQ ID NO: 106493 - RNA, 20 nt, Human
cccggcucgcccaccagccc

SEQ ID NO: 106494 - RNA, 32 nt, Human
cccggcucuccucccagcaucacaccagccau

SEQ ID NO: 106495 - RNA, 32 nt, Human
cccggcucuccucuccccuguccugcacccau

SEQ ID NO: 106496 - RNA, 32 nt, Human
cccggcucuggguucaagagcuugcugggcuu

SEQ ID NO: 106497 - RNA, 32 nt, Human
cccggcucuuagacuaaaaucaugcccaaguu

SEQ ID NO: 106498 - RNA, 19 nt, Human
cccggcugaagugcagugg

SEQ ID NO: 106499 - RNA, 28 nt, Human
cccggcugaauaaaccucuuccuucuuu

SEQ ID NO: 106500 - RNA, 32 nt, Human
cccggcugacccucugccccaguuggggcagg

SEQ ID NO: 106501 - RNA, 32 nt, Human
cccggcugagcgccccagcccgaaaggcaggg

SEQ ID NO: 106502 - RNA, 32 nt, Human
cccggcugcacucuagccgccgcgcccggagc

SEQ ID NO: 106503 - RNA, 32 nt, Human
cccggcugcacucuagccgccugggugugugg

SEQ ID NO: 106504 - RNA, 22 nt, Human
cccggcugcagauuacggagaa

SEQ ID NO: 106505 - RNA, 19 nt, Human
cccggcugcagcccaggcc

SEQ ID NO: 106506 - RNA, 17 nt, Human
cccggcugcagcugcac

SEQ ID NO: 106507 - RNA, 32 nt, Human
cccggcugcaggaagggaaggagccaaccccg

SEQ ID NO: 106508 - RNA, 32 nt, Human
cccggcugcccuggaagaccagucccagacac

SEQ ID NO: 106509 - RNA, 32 nt, Human
cccggcugccuuuuucaccucugacagagccc

SEQ ID NO: 106510 - RNA, 27 nt, Human
cccggcugcggcgcgcugcggcagggg

SEQ ID NO: 106511 - RNA, 17 nt, Human
cccggcugcugcccagg

SEQ ID NO: 106512 - RNA, 21 nt, Human
cccggcugcugcugggccugg

SEQ ID NO: 106513 - RNA, 19 nt, Human
cccggcuggagugcagugg

SEQ ID NO: 106514 - RNA, 21 nt, Human
cccggcuggcuggcucgcucu

SEQ ID NO: 106515 - RNA, 32 nt, Human
cccggcuggucaccagggauucaacugccucu

SEQ ID NO: 106516 - RNA, 32 nt, Human
cccggcugugugauccugggcaagaacuugac

SEQ ID NO: 106517 - RNA, 32 nt, Human
cccggcuguugacacuggacguguauccuccu

SEQ ID NO: 106518 - RNA, 32 nt, Human
cccggcuuagaggaccaggaauggguaaucac

SEQ ID NO: 106519 - RNA, 32 nt, Human
cccggcuucagccucaaguucugaggucagag

SEQ ID NO: 106520 - RNA, 32 nt, Human
cccggcuucuccgcaggcuuuccucuucccca

SEQ ID NO: 106521 - RNA, 16 nt, Human
cccggcuucuggacca

SEQ ID NO: 106522 - RNA, 32 nt, Human
cccggcuugccuguaaucccagcacuuuggga

SEQ ID NO: 106523 - RNA, 32 nt, Human
cccggcuugccuguggccaucuucccacucuc

SEQ ID NO: 106524 - RNA, 31 nt, Human
cccggcuuggcaaucucagcugugccggcgc

SEQ ID NO: 106525 - RNA, 32 nt, Human
cccggcuuggccccuuccacacccaacugggg

SEQ ID NO: 106526 - RNA, 32 nt, Human
cccggcuugucccagccccucuuuugcuucug

SEQ ID NO: 106527 - RNA, 32 nt, Human
cccggcuuugggccaggaaaggcuuccccagg

SEQ ID NO: 106528 - RNA, 32 nt, Human
cccggcuuuuggaggacauugucuccuggagc

SEQ ID NO: 106529 - RNA, 23 nt, Human
cccgggaaagguacagcccuguc

SEQ ID NO: 106530 - RNA, 18 nt, Human
cccgggaacaacaggugg

SEQ ID NO: 106531 - RNA, 32 nt, Human
cccgggaacccauggaaggagaagcgagguga

SEQ ID NO: 106532 - RNA, 19 nt, Human
cccgggaagaaccaugugg

SEQ ID NO: 106533 - RNA, 24 nt, Human
cccgggaagcagagguugcaguga

SEQ ID NO: 106534 - RNA, 32 nt, Human
cccgggaagcagagguugcagugacagagauc

SEQ ID NO: 106535 - RNA, 24 nt, Human
cccgggaagcagagguugcgguga

SEQ ID NO: 106536 - RNA, 24 nt, Human
cccgggaagcagagucugcaguga

SEQ ID NO: 106537 - RNA, 32 nt, Human
cccgggaagccgcggcgagcgcggggaggcga

SEQ ID NO: 106538 - RNA, 24 nt, Human
cccgggaagcggagcuugcaguga

SEQ ID NO: 106539 - RNA, 32 nt, Human
cccgggaagcggagcuugcagugagccgagau

SEQ ID NO: 106540 - RNA, 24 nt, Human
cccgggaagcggagguugcaggga

SEQ ID NO: 106541 - RNA, 32 nt, Human
cccgggaagcggagguugcagugagccaagau

SEQ ID NO: 106542 - RNA, 32 nt, Human
cccgggaagcggagguugcagugagccgagau

SEQ ID NO: 106543 - RNA, 32 nt, Human
cccgggaaggcggaaguugcagugagccgagu

SEQ ID NO: 106544 - RNA, 32 nt, Human
cccgggaaguggaggcuggaguaaaccaugau

SEQ ID NO: 106545 - RNA, 24 nt, Human
cccgggaaguggagguugcaguga

SEQ ID NO: 106546 - RNA, 32 nt, Human
cccgggaaguggagguugcagugagccaagau

SEQ ID NO: 106547 - RNA, 32 nt, Human
cccgggacagccagggcggcagggaggccccu

SEQ ID NO: 106548 - RNA, 32 nt, Human
cccgggaccccuggccggaaacugagccguuc

SEQ ID NO: 106549 - RNA, 32 nt, Human
cccgggaccucggcaggauggaagagaagcug

SEQ ID NO: 106550 - RNA, 32 nt, Human
cccgggaccucuuaauuacuaaccucaguacu

SEQ ID NO: 106551 - RNA, 32 nt, Human
cccgggaccugcugcugcuccagccaugucca

SEQ ID NO: 106552 - RNA, 32 nt, Human
cccgggacgaggaggaggaggaggaagagggg

SEQ ID NO: 106553 - RNA, 24 nt, Human
cccgggacgcagagguuacaguga

SEQ ID NO: 106554 - RNA, 24 nt, Human
cccgggacgcagggguugcaguga

SEQ ID NO: 106555 - RNA, 32 nt, Human
cccgggacgcagggguugcagugagcggagau

SEQ ID NO: 106556 - RNA, 32 nt, Human
cccgggacgcugggccaugagcuccgcggccc

SEQ ID NO: 106557 - RNA, 24 nt, Human
cccgggacucagccagccucgccu

SEQ ID NO: 106558 - RNA, 24 nt, Human
cccgggacuucaaugcugcaguga

SEQ ID NO: 106559 - RNA, 32 nt, Human
cccgggagacgaggagggcgggcagggaggug

SEQ ID NO: 106560 - RNA, 32 nt, Human
cccgggagacggagcuugcaguaagccgagau

SEQ ID NO: 106561 - RNA, 24 nt, Human
cccgggagacggagguugcaguga

SEQ ID NO: 106562 - RNA, 32 nt, Human
cccgggagacggagguugcagugagcugagau

SEQ ID NO: 106563 - RNA, 24 nt, Human
cccgggagacggcgcuugcaguga

SEQ ID NO: 106564 - RNA, 32 nt, Human
cccgggagacggcgcuugcagugagccgagau

SEQ ID NO: 106565 - RNA, 21 nt, Human
cccgggagacggcgggcauga

SEQ ID NO: 106566 - RNA, 25 nt, Human
cccgggagacgggagguugugguga

SEQ ID NO: 106567 - RNA, 22 nt, Human
cccgggagagaggacgaagcga

SEQ ID NO: 106568 - RNA, 32 nt, Human
cccgggagaggcugcugcagucccgggacagg

SEQ ID NO: 106569 - RNA, 24 nt, Human
cccgggagagggagguugcaguga

SEQ ID NO: 106570 - RNA, 32 nt, Human
cccgggagagugaagggccggggaggacaagg

SEQ ID NO: 106571 - RNA, 32 nt, Human
cccgggagauggcgcuugcagugagcugagau

SEQ ID NO: 106572 - RNA, 24 nt, Human
cccgggagauugaggcugcgguga

SEQ ID NO: 106573 - RNA, 23 nt, Human
cccgggagcagagacugcaguga

SEQ ID NO: 106574 - RNA, 32 nt, Human
cccgggagcaucaccgcuuucuggaccugucc

SEQ ID NO: 106575 - RNA, 32 nt, Human
cccgggagccaugguccgcuucggggacgagc

SEQ ID NO: 106576 - RNA, 23 nt, Human
cccgggagccgagcuugcagcga

SEQ ID NO: 106577 - RNA, 23 nt, Human
cccgggagccgggcuggcuagga

SEQ ID NO: 106578 - RNA, 32 nt, Human
cccgggagccuccucaggcucccucuauuaaa

SEQ ID NO: 106579 - RNA, 32 nt, Human
cccgggagccuugccgcacugccuugugggug

SEQ ID NO: 106580 - RNA, 22 nt, Human
cccgggagcgccagcugcguga

SEQ ID NO: 106581 - RNA, 32 nt, Human
cccgggagcgcgagcgggaggagcagagaccc

SEQ ID NO: 106582 - RNA, 23 nt, Human
cccgggagcggagcuugcaguga

SEQ ID NO: 106583 - RNA, 23 nt, Human
cccgggagcggagguugcaguga

SEQ ID NO: 106584 - RNA, 18 nt, Human
cccgggagcugcaggugg

SEQ ID NO: 106585 - RNA, 18 nt, Human
cccgggagcugggcccug

SEQ ID NO: 106586 - RNA, 32 nt, Human
cccgggaggaagagcuugcagugagccgagau

SEQ ID NO: 106587 - RNA, 24 nt, Human
cccgggaggaggagcuugcaguga

SEQ ID NO: 106588 - RNA, 32 nt, Human
cccgggaggaggagcuugcagugagccgagau

SEQ ID NO: 106589 - RNA, 32 nt, Human
cccgggaggaggaggaggagguugcagugagc

SEQ ID NO: 106590 - RNA, 32 nt, Human
cccgggaggaggaggcggcgagaauggcagcg

SEQ ID NO: 106591 - RNA, 24 nt, Human
cccgggaggcaaagguugcaguga

SEQ ID NO: 106592 - RNA, 32 nt, Human
cccgggaggcaaagguugcagugagcugagau

SEQ ID NO: 106593 - RNA, 22 nt, Human
cccgggaggcaaagguugcggu

SEQ ID NO: 106594 - RNA, 24 nt, Human
cccgggaggcaaagguugcgguaa

SEQ ID NO: 106595 - RNA, 24 nt, Human
cccgggaggcacagguuccagugg

SEQ ID NO: 106596 - RNA, 22 nt, Human
cccgggaggcagaaccaggcag

SEQ ID NO: 106597 - RNA, 24 nt, Human
cccgggaggcagaaccugcaguga

SEQ ID NO: 106598 - RNA, 24 nt, Human
cccgggaggcagaaguugcaguga

SEQ ID NO: 106599 - RNA, 32 nt, Human
cccgggaggcagaccuugcagugagccaagau

SEQ ID NO: 106600 - RNA, 24 nt, Human
cccgggaggcagacuuugcaguga

SEQ ID NO: 106601 - RNA, 32 nt, Human
cccgggaggcagacuuugcagugagcugagau

SEQ ID NO: 106602 - RNA, 22 nt, Human
cccgggaggcagagauugcagu

SEQ ID NO: 106603 - RNA, 24 nt, Human
cccgggaggcagagauugcaguaa

SEQ ID NO: 106604 - RNA, 32 nt, Human
cccgggaggcagagcuugcaguaagccgagag

SEQ ID NO: 106605 - RNA, 24 nt, Human
cccgggaggcagagcuugcaguga

SEQ ID NO: 106606 - RNA, 32 nt, Human
cccgggaggcagagcuugcagugagcagagau

SEQ ID NO: 106607 - RNA, 32 nt, Human
cccgggaggcagagcuugcagugagccaagau

SEQ ID NO: 106608 - RNA, 32 nt, Human
cccgggaggcagagcuugcagugagccgagau

SEQ ID NO: 106609 - RNA, 32 nt, Human
cccgggaggcagagcuugcagugagcugagau

SEQ ID NO: 106610 - RNA, 32 nt, Human
cccgggaggcagagcuugcagugagucgagau

SEQ ID NO: 106611 - RNA, 24 nt, Human
cccgggaggcagagcuugcgguga

SEQ ID NO: 106612 - RNA, 32 nt, Human
cccgggaggcagagcuugcggugagccgagau

SEQ ID NO: 106613 - RNA, 24 nt, Human
cccgggaggcagagcuugugguga

SEQ ID NO: 106614 - RNA, 20 nt, Human
cccgggaggcagaggcugca

SEQ ID NO: 106615 - RNA, 24 nt, Human
cccgggaggcagaggcugcaguga

SEQ ID NO: 106616 - RNA, 32 nt, Human
cccgggaggcagaggcugcagugagccgagau

SEQ ID NO: 106617 - RNA, 32 nt, Human
cccgggaggcagaggcugcagugagcugagau

SEQ ID NO: 106618 - RNA, 21 nt, Human
cccgggaggcagagggugcag

SEQ ID NO: 106619 - RNA, 22 nt, Human
cccgggaggcagagggugcagu

SEQ ID NO: 106620 - RNA, 24 nt, Human
cccgggaggcagagggugcaguaa

SEQ ID NO: 106621 - RNA, 24 nt, Human
cccgggaggcagagguagcaguga

SEQ ID NO: 106622 - RNA, 24 nt, Human
cccgggaggcagaggucaugguga

SEQ ID NO: 106623 - RNA, 24 nt, Human
cccgggaggcagagguggcuguga

SEQ ID NO: 106624 - RNA, 24 nt, Human
cccgggaggcagagguuacaguga

SEQ ID NO: 106625 - RNA, 24 nt, Human
cccgggaggcagagguuaucguga

SEQ ID NO: 106626 - RNA, 24 nt, Human
cccgggaggcagagguugaaguga

SEQ ID NO: 106627 - RNA, 24 nt, Human
cccgggaggcagagguugcacuga

SEQ ID NO: 106628 - RNA, 21 nt, Human
cccgggaggcagagguugcag

SEQ ID NO: 106629 - RNA, 23 nt, Human
cccgggaggcagagguugcagug

SEQ ID NO: 106630 - RNA, 24 nt, Human
cccgggaggcagagguugcaguga

SEQ ID NO: 106631 - RNA, 32 nt, Human
cccgggaggcagagguugcagugagccaagac

SEQ ID NO: 106632 - RNA, 32 nt, Human
cccgggaggcagagguugcagugagccaagau

SEQ ID NO: 106633 - RNA, 32 nt, Human
cccgggaggcagagguugcagugagccaugau

SEQ ID NO: 106634 - RNA, 32 nt, Human
cccgggaggcagagguugcagugagccgacau

SEQ ID NO: 106635 - RNA, 32 nt, Human
cccgggaggcagagguugcagugagccgagac

SEQ ID NO: 106636 - RNA, 32 nt, Human
cccgggaggcagagguugcagugagccgagau

SEQ ID NO: 106637 - RNA, 32 nt, Human
cccgggaggcagagguugcagugagccgugau

SEQ ID NO: 106638 - RNA, 32 nt, Human
cccgggaggcagagguugcagugagcugagac

SEQ ID NO: 106639 - RNA, 32 nt, Human
cccgggaggcagagguugcagugagcugagau

SEQ ID NO: 106640 - RNA, 32 nt, Human
cccgggaggcagagguugcagugagucgagau

SEQ ID NO: 106641 - RNA, 32 nt, Human
cccgggaggcagagguugcagugaguggagau

SEQ ID NO: 106642 - RNA, 28 nt, Human
cccgggaggcagagguugcaguguggug

SEQ ID NO: 106643 - RNA, 24 nt, Human
cccgggaggcagagguugcgguga

SEQ ID NO: 106644 - RNA, 22 nt, Human
cccgggaggcagagguugcugu

SEQ ID NO: 106645 - RNA, 24 nt, Human
cccgggaggcagagguugcuguaa

SEQ ID NO: 106646 - RNA, 24 nt, Human
cccgggaggcagagguuguaguga

SEQ ID NO: 106647 - RNA, 24 nt, Human
cccgggaggcagagguuguguuga

SEQ ID NO: 106648 - RNA, 24 nt, Human
cccgggaggcagagguuucaguga

SEQ ID NO: 106649 - RNA, 24 nt, Human
cccgggaggcagaguuugcaguga

SEQ ID NO: 106650 - RNA, 24 nt, Human
cccgggaggcagcaguugcaguga

SEQ ID NO: 106651 - RNA, 32 nt, Human
cccgggaggcagcaguugcagugagcugagau

SEQ ID NO: 106652 - RNA, 21 nt, Human
cccgggaggcagcuggggcag

SEQ ID NO: 106653 - RNA, 24 nt, Human
cccgggaggcagcuggggcagcag

SEQ ID NO: 106654 - RNA, 32 nt, Human
cccgggaggcaguggcugcagugagcugagau

SEQ ID NO: 106655 - RNA, 24 nt, Human
cccgggaggcauagcuugcaguga

SEQ ID NO: 106656 - RNA, 32 nt, Human
cccgggaggcauagcuugcagugagccgagau

SEQ ID NO: 106657 - RNA, 18 nt, Human
cccgggaggccgcggcca

SEQ ID NO: 106658 - RNA, 23 nt, Human
cccgggaggcggaacuugcagug

SEQ ID NO: 106659 - RNA, 24 nt, Human
cccgggaggcggaacuugcaguga

SEQ ID NO: 106660 - RNA, 32 nt, Human
cccgggaggcggaacuugcagugagccaagau

SEQ ID NO: 106661 - RNA, 23 nt, Human
cccgggaggcggaacuugcggug

SEQ ID NO: 106662 - RNA, 24 nt, Human
cccgggaggcggaacuugcgguga

SEQ ID NO: 106663 - RNA, 32 nt, Human
cccgggaggcggaacuugcggugagccgagau

SEQ ID NO: 106664 - RNA, 32 nt, Human
cccgggaggcggaaguuucagcgagccgagau

SEQ ID NO: 106665 - RNA, 32 nt, Human
cccgggaggcggagauugcagugagccaagau

SEQ ID NO: 106666 - RNA, 32 nt, Human
cccgggaggcggagauugcagugagcugagau

SEQ ID NO: 106667 - RNA, 23 nt, Human
cccgggaggcggagauugcggug

SEQ ID NO: 106668 - RNA, 24 nt, Human
cccgggaggcggagauugcgguga

SEQ ID NO: 106669 - RNA, 32 nt, Human
cccgggaggcggagauugcggugagccaagau

SEQ ID NO: 106670 - RNA, 32 nt, Human
cccgggaggcggagauugcggugagccgagau

SEQ ID NO: 106671 - RNA, 24 nt, Human
cccgggaggcggagcuuacaguga

SEQ ID NO: 106672 - RNA, 32 nt, Human
cccgggaggcggagcuuacagugagcugagau

SEQ ID NO: 106673 - RNA, 21 nt, Human
cccgggaggcggagcuugcag

SEQ ID NO: 106674 - RNA, 23 nt, Human
cccgggaggcggagcuugcagug

SEQ ID NO: 106675 - RNA, 24 nt, Human
cccgggaggcggagcuugcaguga

SEQ ID NO: 106676 - RNA, 32 nt, Human
cccgggaggcggagcuugcagugaaccgagau

SEQ ID NO: 106677 - RNA, 32 nt, Human
cccgggaggcggagcuugcagugagccaagau

SEQ ID NO: 106678 - RNA, 32 nt, Human
cccgggaggcggagcuugcagugagcccagau

SEQ ID NO: 106679 - RNA, 32 nt, Human
cccgggaggcggagcuugcagugagccgaaau

SEQ ID NO: 106680 - RNA, 32 nt, Human
cccgggaggcggagcuugcagugagccgagau

SEQ ID NO: 106681 - RNA, 32 nt, Human
cccgggaggcggagcuugcagugagccgaggu

SEQ ID NO: 106682 - RNA, 32 nt, Human
cccgggaggcggagcuugcagugagccuugau

SEQ ID NO: 106683 - RNA, 32 nt, Human
cccgggaggcggagcuugcagugagcggagau

SEQ ID NO: 106684 - RNA, 32 nt, Human
cccgggaggcggagcuugcagugagcugagau

SEQ ID NO: 106685 - RNA, 32 nt, Human
cccgggaggcggagcuugcggugggccgggau

SEQ ID NO: 106686 - RNA, 23 nt, Human
cccgggaggcggagcuuguagug

SEQ ID NO: 106687 - RNA, 24 nt, Human
cccgggaggcggagcuuguaguga

SEQ ID NO: 106688 - RNA, 32 nt, Human
cccgggaggcggagcuuguagugagccgagau

SEQ ID NO: 106689 - RNA, 24 nt, Human
cccgggaggcggagcuuucaguga

SEQ ID NO: 106690 - RNA, 24 nt, Human
cccgggaggcggaggcgcggggga

SEQ ID NO: 106691 - RNA, 20 nt, Human
cccgggaggcggaggcggga

SEQ ID NO: 106692 - RNA, 25 nt, Human
cccgggaggcggaggcgggaggcgg

SEQ ID NO: 106693 - RNA, 28 nt, Human
cccgggaggcggaggcgggaggcggcgg

SEQ ID NO: 106694 - RNA, 23 nt, Human
cccgggaggcggaggcugcagug

SEQ ID NO: 106695 - RNA, 24 nt, Human
cccgggaggcggaggcugcaguga

SEQ ID NO: 106696 - RNA, 32 nt, Human
cccgggaggcggaggcugcagugagccgagau

SEQ ID NO: 106697 - RNA, 32 nt, Human
cccgggaggcggaggcugcagugagucgagau

SEQ ID NO: 106698 - RNA, 32 nt, Human
cccgggaggcggaggcugcagugggccgggau

SEQ ID NO: 106699 - RNA, 24 nt, Human
cccgggaggcggagguuacaguga

SEQ ID NO: 106700 - RNA, 32 nt, Human
cccgggaggcggagguuacagugagccgagau

SEQ ID NO: 106701 - RNA, 32 nt, Human
cccgggaggcggagguuacagugagccuuuuc

SEQ ID NO: 106702 - RNA, 32 nt, Human
cccgggaggcggagguuacagugagcugagau

SEQ ID NO: 106703 - RNA, 24 nt, Human
cccgggaggcggagguuauggaga

SEQ ID NO: 106704 - RNA, 22 nt, Human
cccgggaggcggagguucaugg

SEQ ID NO: 106705 - RNA, 24 nt, Human
cccgggaggcggagguuccaguga

SEQ ID NO: 106706 - RNA, 32 nt, Human
cccgggaggcggagguuccagugagccgagau

SEQ ID NO: 106707 - RNA, 32 nt, Human
cccgggaggcggagguugagcaacuacacugc

SEQ ID NO: 106708 - RNA, 22 nt, Human
cccgggaggcggagguugcagu

SEQ ID NO: 106709 - RNA, 24 nt, Human
cccgggaggcggagguugcaguaa

SEQ ID NO: 106710 - RNA, 32 nt, Human
cccgggaggcggagguugcaguaagccgagac

SEQ ID NO: 106711 - RNA, 32 nt, Human
cccgggaggcggagguugcaguaagccgagau

SEQ ID NO: 106712 - RNA, 32 nt, Human
cccgggaggcggagguugcagucagccgagau

SEQ ID NO: 106713 - RNA, 23 nt, Human
cccgggaggcggagguugcagug

SEQ ID NO: 106714 - RNA, 24 nt, Human
cccgggaggcggagguugcaguga

SEQ ID NO: 106715 - RNA, 32 nt, Human
cccgggaggcggagguugcagugagccaagau

SEQ ID NO: 106716 - RNA, 32 nt, Human
cccgggaggcggagguugcagugagccgaaau

SEQ ID NO: 106717 - RNA, 32 nt, Human
cccgggaggcggagguugcagugagccgagau

SEQ ID NO: 106718 - RNA, 32 nt, Human
cccgggaggcggagguugcagugagccuggau

SEQ ID NO: 106719 - RNA, 32 nt, Human
cccgggaggcggagguugcagugagcuaagau

SEQ ID NO: 106720 - RNA, 32 nt, Human
cccgggaggcggagguugcagugagcugagau

SEQ ID NO: 106721 - RNA, 32 nt, Human
cccgggaggcggagguugcagugagguaagau

SEQ ID NO: 106722 - RNA, 32 nt, Human
cccgggaggcggagguugcagugagucaaggu

SEQ ID NO: 106723 - RNA, 32 nt, Human
cccgggaggcggagguugcaguuagccaagau

SEQ ID NO: 106724 - RNA, 23 nt, Human
cccgggaggcggagguugcauga

SEQ ID NO: 106725 - RNA, 32 nt, Human
cccgggaggcggagguugcaugagcugagauc

SEQ ID NO: 106726 - RNA, 23 nt, Human
cccgggaggcggagguugccgug

SEQ ID NO: 106727 - RNA, 24 nt, Human
cccgggaggcggagguugccguga

SEQ ID NO: 106728 - RNA, 32 nt, Human
cccgggaggcggagguugccgugagucgagau

SEQ ID NO: 106729 - RNA, 23 nt, Human
cccgggaggcggagguugcggug

SEQ ID NO: 106730 - RNA, 24 nt, Human
cccgggaggcggagguugcgguga

SEQ ID NO: 106731 - RNA, 32 nt, Human
cccgggaggcggagguugcggugagccaagau

SEQ ID NO: 106732 - RNA, 32 nt, Human
cccgggaggcggagguugcggugagccgagau

SEQ ID NO: 106733 - RNA, 23 nt, Human
cccgggaggcggagguuguagug

SEQ ID NO: 106734 - RNA, 24 nt, Human
cccgggaggcggagguuguaguga

SEQ ID NO: 106735 - RNA, 32 nt, Human
cccgggaggcggagguuguagugagccgagau

SEQ ID NO: 106736 - RNA, 23 nt, Human
cccgggaggcggagguuguggug

SEQ ID NO: 106737 - RNA, 24 nt, Human
cccgggaggcggagguugugguga

SEQ ID NO: 106738 - RNA, 32 nt, Human
cccgggaggcggagguuguggugagccaagau

SEQ ID NO: 106739 - RNA, 32 nt, Human
cccgggaggcggagguuguggugagccgagau

SEQ ID NO: 106740 - RNA, 32 nt, Human
cccgggaggcggagguuguggugagcugaaau

SEQ ID NO: 106741 - RNA, 32 nt, Human
cccgggaggcggagguuguggugagcugagau

SEQ ID NO: 106742 - RNA, 24 nt, Human
cccgggaggcggagguuucaguga

SEQ ID NO: 106743 - RNA, 32 nt, Human
cccgggaggcggagguuucagugagccgagau

SEQ ID NO: 106744 - RNA, 22 nt, Human
cccgggaggcggaguugcggug

SEQ ID NO: 106745 - RNA, 23 nt, Human
cccgggaggcggaguugcgguga

SEQ ID NO: 106746 - RNA, 32 nt, Human
cccgggaggcggaguugcggugagccgagauc

SEQ ID NO: 106747 - RNA, 24 nt, Human
cccgggaggcggaguuugcagaga

SEQ ID NO: 106748 - RNA, 23 nt, Human
cccgggaggcggaguuugcagug

SEQ ID NO: 106749 - RNA, 24 nt, Human
cccgggaggcggaguuugcaguga

SEQ ID NO: 106750 - RNA, 32 nt, Human
cccgggaggcggaguuugcagugagccaagau

SEQ ID NO: 106751 - RNA, 20 nt, Human
cccgggaggcggaguuuugc

SEQ ID NO: 106752 - RNA, 23 nt, Human
cccgggaggcggaguuuugccag

SEQ ID NO: 106753 - RNA, 32 nt, Human
cccgggaggcggaucuugcagugagcggagau

SEQ ID NO: 106754 - RNA, 32 nt, Human
cccgggaggcggaucuugcauugagccaagau

SEQ ID NO: 106755 - RNA, 32 nt, Human
cccgggaggcggauguugcggugagccgaaau

SEQ ID NO: 106756 - RNA, 22 nt, Human
cccgggaggcggcggccggaga

SEQ ID NO: 106757 - RNA, 23 nt, Human
cccgggaggcggcgguugcagug

SEQ ID NO: 106758 - RNA, 24 nt, Human
cccgggaggcggcgguugcaguga

SEQ ID NO: 106759 - RNA, 23 nt, Human
cccgggaggcgggggcggggcgg

SEQ ID NO: 106760 - RNA, 23 nt, Human
cccgggaggcggggguugcagug

SEQ ID NO: 106761 - RNA, 24 nt, Human
cccgggaggcggggguugcaguga

SEQ ID NO: 106762 - RNA, 24 nt, Human
cccgggaggcuaagguugcaguga

SEQ ID NO: 106763 - RNA, 32 nt, Human
cccgggaggcuaagguugcagugagccgagac

SEQ ID NO: 106764 - RNA, 24 nt, Human
cccgggaggcugagguugcaguga

SEQ ID NO: 106765 - RNA, 32 nt, Human
cccgggaggcugagguugcagugaguggagau

SEQ ID NO: 106766 - RNA, 18 nt, Human
cccgggagggaaacuguc

SEQ ID NO: 106767 - RNA, 24 nt, Human
cccgggagggagagguugcaguga

SEQ ID NO: 106768 - RNA, 32 nt, Human
cccgggagggagagguugcagugagccaagau

SEQ ID NO: 106769 - RNA, 32 nt, Human
cccgggaggggcuccagcaggaggccgugggu

SEQ ID NO: 106770 - RNA, 24 nt, Human
cccgggagguagaggcugcaaugg

SEQ ID NO: 106771 - RNA, 24 nt, Human
cccgggagguagagguugcaguga

SEQ ID NO: 106772 - RNA, 32 nt, Human
cccgggagguagagguugcagugagccgagau

SEQ ID NO: 106773 - RNA, 24 nt, Human
cccgggagguagaguuugcaguga

SEQ ID NO: 106774 - RNA, 24 nt, Human
cccgggaggucaagguugcaguga

SEQ ID NO: 106775 - RNA, 24 nt, Human
cccgggaggucgaggcugcuguga

SEQ ID NO: 106776 - RNA, 32 nt, Human
cccgggaggugcagguugcagugagccaagau

SEQ ID NO: 106777 - RNA, 32 nt, Human
cccgggagguggaacuugcagugagccgagau

SEQ ID NO: 106778 - RNA, 23 nt, Human
cccgggagguggagauugcagug

SEQ ID NO: 106779 - RNA, 24 nt, Human
cccgggagguggagauugcaguga

SEQ ID NO: 106780 - RNA, 32 nt, Human
cccgggagguggagauugcagugagcccagau

SEQ ID NO: 106781 - RNA, 32 nt, Human
cccgggagguggagauugcagugagcugagau

SEQ ID NO: 106782 - RNA, 24 nt, Human
cccgggagguggagcuuccaguga

SEQ ID NO: 106783 - RNA, 32 nt, Human
cccgggagguggagcuuccagugagccgagau

SEQ ID NO: 106784 - RNA, 24 nt, Human
cccgggagguggagcuugcaguga

SEQ ID NO: 106785 - RNA, 32 nt, Human
cccgggagguggagcuugcagugagccaagau

SEQ ID NO: 106786 - RNA, 32 nt, Human
cccgggagguggagcuugcagugagccgagau

SEQ ID NO: 106787 - RNA, 32 nt, Human
cccgggagguggagcuugcagugagcggagau

SEQ ID NO: 106788 - RNA, 32 nt, Human
cccgggagguggagcuugcagugagcugagau

SEQ ID NO: 106789 - RNA, 32 nt, Human
cccgggagguggagcuugcagugagcugggau

SEQ ID NO: 106790 - RNA, 24 nt, Human
cccgggagguggagcuugcagugg

SEQ ID NO: 106791 - RNA, 32 nt, Human
cccgggagguggagcuugcaguggguggagau

SEQ ID NO: 106792 - RNA, 24 nt, Human
cccgggagguggagcuugcgguga

SEQ ID NO: 106793 - RNA, 32 nt, Human
cccgggagguggagcuugcggugagcugagau

SEQ ID NO: 106794 - RNA, 32 nt, Human
cccgggagguggagcuuguagugaggcgagau

SEQ ID NO: 106795 - RNA, 24 nt, Human
cccgggagguggaggcugcaauga

SEQ ID NO: 106796 - RNA, 23 nt, Human
cccgggagguggaggcugcagug

SEQ ID NO: 106797 - RNA, 24 nt, Human
cccgggagguggaggcugcaguga

SEQ ID NO: 106798 - RNA, 32 nt, Human
cccgggagguggaggcugcagugagccgagau

SEQ ID NO: 106799 - RNA, 32 nt, Human
cccgggagguggaggcugcagugaguuaagau

SEQ ID NO: 106800 - RNA, 32 nt, Human
cccgggagguggaggcugcagugaguugugau

SEQ ID NO: 106801 - RNA, 23 nt, Human
cccgggagguggaggcugcggug

SEQ ID NO: 106802 - RNA, 24 nt, Human
cccgggagguggaggcugcgguga

SEQ ID NO: 106803 - RNA, 23 nt, Human
cccgggagguggaggucgcggug

SEQ ID NO: 106804 - RNA, 24 nt, Human
cccgggagguggaggucgcgguga

SEQ ID NO: 106805 - RNA, 32 nt, Human
cccgggagguggagguggagguugcagugagc

SEQ ID NO: 106806 - RNA, 32 nt, Human
cccgggagguggagguggcagugagccgagau

SEQ ID NO: 106807 - RNA, 24 nt, Human
cccgggagguggagguuacaguga

SEQ ID NO: 106808 - RNA, 32 nt, Human
cccgggagguggagguuacagugagccgagau

SEQ ID NO: 106809 - RNA, 32 nt, Human
cccgggagguggagguuacagugagcugagau

SEQ ID NO: 106810 - RNA, 21 nt, Human
cccgggagguggagguugcag

SEQ ID NO: 106811 - RNA, 24 nt, Human
cccgggagguggagguugcaggga

SEQ ID NO: 106812 - RNA, 22 nt, Human
cccgggagguggagguugcagu

SEQ ID NO: 106813 - RNA, 23 nt, Human
cccgggagguggagguugcagug

SEQ ID NO: 106814 - RNA, 24 nt, Human
cccgggagguggagguugcaguga

SEQ ID NO: 106815 - RNA, 32 nt, Human
cccgggagguggagguugcagugagccaagac

SEQ ID NO: 106816 - RNA, 32 nt, Human
cccgggagguggagguugcagugagccaagau

SEQ ID NO: 106817 - RNA, 32 nt, Human
cccgggagguggagguugcagugagcccagau

SEQ ID NO: 106818 - RNA, 32 nt, Human
cccgggagguggagguugcagugagccgagac

SEQ ID NO: 106819 - RNA, 32 nt, Human
cccgggagguggagguugcagugagccgagau

SEQ ID NO: 106820 - RNA, 32 nt, Human
cccgggagguggagguugcagugagcuaagau

SEQ ID NO: 106821 - RNA, 32 nt, Human
cccgggagguggagguugcagugagcugagau

SEQ ID NO: 106822 - RNA, 32 nt, Human
cccgggagguggagguugcagugagcugaggu

SEQ ID NO: 106823 - RNA, 32 nt, Human
cccgggagguggagguugcagugaggugagau

SEQ ID NO: 106824 - RNA, 32 nt, Human
cccgggagguggagguugcagugagucaagau

SEQ ID NO: 106825 - RNA, 24 nt, Human
cccgggagguggagguugccguga

SEQ ID NO: 106826 - RNA, 24 nt, Human
cccgggagguggagguugcgauga

SEQ ID NO: 106827 - RNA, 23 nt, Human
cccgggagguggagguugcggug

SEQ ID NO: 106828 - RNA, 24 nt, Human
cccgggagguggagguugcgguga

SEQ ID NO: 106829 - RNA, 24 nt, Human
cccgggagguggagguuguaguga

SEQ ID NO: 106830 - RNA, 24 nt, Human
cccgggagguggaguuuacgguga

SEQ ID NO: 106831 - RNA, 24 nt, Human
cccgggaggugggaguuguaguga

SEQ ID NO: 106832 - RNA, 32 nt, Human
cccgggagguguagguugcagugagccgagau

SEQ ID NO: 106833 - RNA, 24 nt, Human
cccgggagguugaggcugcagugg

SEQ ID NO: 106834 - RNA, 24 nt, Human
cccgggagucagaggcugcagaga

SEQ ID NO: 106835 - RNA, 23 nt, Human
cccgggaguggagcuugcaauga

SEQ ID NO: 106836 - RNA, 32 nt, Human
cccgggaguuggagguugcagugagccaagau

SEQ ID NO: 106837 - RNA, 24 nt, Human
cccgggaguuugaaguugcaguga

SEQ ID NO: 106838 - RNA, 25 nt, Human
cccgggaugagcucacgcccgcguc

SEQ ID NO: 106839 - RNA, 32 nt, Human
cccgggcaacagaguaagacccugccucaaga

SEQ ID NO: 106840 - RNA, 32 nt, Human
cccgggcaacagggacacuggcauuucuuugc

SEQ ID NO: 106841 - RNA, 32 nt, Human
cccgggcacugaggcccagggucagcuuggcu

SEQ ID NO: 106842 - RNA, 32 nt, Human
cccgggcacugcacagccugucugggggccag

SEQ ID NO: 106843 - RNA, 32 nt, Human
cccgggcacuucuccccaccucggccccgcgc

SEQ ID NO: 106844 - RNA, 24 nt, Human
cccgggcagaggaaauugcaguga

SEQ ID NO: 106845 - RNA, 21 nt, Human
cccgggcagccccgggccccu

SEQ ID NO: 106846 - RNA, 24 nt, Human
cccgggcagcggagguugcaguga

SEQ ID NO: 106847 - RNA, 32 nt, Human
cccgggcagcggagguugcagugagccgagau

SEQ ID NO: 106848 - RNA, 32 nt, Human
cccgggcaggccgcgguuuccuuuguggacgu

SEQ ID NO: 106849 - RNA, 32 nt, Human
cccgggcagggugggugcggagcggcucuggg

SEQ ID NO: 106850 - RNA, 32 nt, Human
cccgggcaguggccaguggccuuaagggagcc

SEQ ID NO: 106851 - RNA, 32 nt, Human
cccgggccaagacagauggacacugccaagag

SEQ ID NO: 106852 - RNA, 21 nt, Human
cccgggccaccacgcuuccua

SEQ ID NO: 106853 - RNA, 32 nt, Human
cccgggccaccugauccaacguccacuccaag

SEQ ID NO: 106854 - RNA, 24 nt, Human
cccgggccacggggacugcaguga

SEQ ID NO: 106855 - RNA, 32 nt, Human
cccgggccagagaagagcccgggagggccagg

SEQ ID NO: 106856 - RNA, 31 nt, Human
cccgggccagcgcucugacaugcagaaggug

SEQ ID NO: 106857 - RNA, 32 nt, Human
cccgggccagcggagggcaggagcggagcccc

SEQ ID NO: 106858 - RNA, 22 nt, Human
cccgggccagcugccccacccc

SEQ ID NO: 106859 - RNA, 32 nt, Human
cccgggccagggacucuguucaaacugcgccc

SEQ ID NO: 106860 - RNA, 32 nt, Human
cccgggccaggggcgggcgccgccauggguaa

SEQ ID NO: 106861 - RNA, 31 nt, Human
cccgggccaguguccaucauccaggugcuca

SEQ ID NO: 106862 - RNA, 32 nt, Human
cccgggccaguguccaucauccaggugcucag

SEQ ID NO: 106863 - RNA, 25 nt, Human
cccgggcccagacacagcccagguc

SEQ ID NO: 106864 - RNA, 25 nt, Human
cccgggcccaguuccagcccguguc

SEQ ID NO: 106865 - RNA, 18 nt, Human
cccgggcccccgcugccg

SEQ ID NO: 106866 - RNA, 16 nt, Human
cccgggccccgcgccg

SEQ ID NO: 106867 - RNA, 32 nt, Human
cccgggccccucggaaccuccagcuugguccg

SEQ ID NO: 106868 - RNA, 32 nt, Human
cccgggccccucugcugacgacaggagccccc

SEQ ID NO: 106869 - RNA, 22 nt, Human
cccgggccccugagccaugccc

SEQ ID NO: 106870 - RNA, 32 nt, Human
cccgggccccugugacaggggaaagggcucuc

SEQ ID NO: 106871 - RNA, 32 nt, Human
cccgggcccgagaggaggaggccggggcucuc

SEQ ID NO: 106872 - RNA, 21 nt, Human
cccgggcccgcagcggcaccg

SEQ ID NO: 106873 - RNA, 32 nt, Human
cccgggcccgggcugcacccccgcauccccaa

SEQ ID NO: 106874 - RNA, 26 nt, Human
cccgggcccgguggaggcugcaguga

SEQ ID NO: 106875 - RNA, 32 nt, Human
cccgggcccgguggaggcugcagugagacgag

SEQ ID NO: 106876 - RNA, 21 nt, Human
cccgggccgaggcccagccca

SEQ ID NO: 106877 - RNA, 24 nt, Human
cccgggccgccaccgcccauccca

SEQ ID NO: 106878 - RNA, 21 nt, Human
cccgggccgccaccgucaccu

SEQ ID NO: 106879 - RNA, 22 nt, Human
cccgggccgcccgcgcucccca

SEQ ID NO: 106880 - RNA, 18 nt, Human
cccgggccgccgccgcug

SEQ ID NO: 106881 - RNA, 23 nt, Human
cccgggccgcggccaacuucucu

SEQ ID NO: 106882 - RNA, 31 nt, Human
cccgggccguagucucccaggcucgagcaau

SEQ ID NO: 106883 - RNA, 32 nt, Human
cccgggccucaagcaguccccaccuccgagug

SEQ ID NO: 106884 - RNA, 32 nt, Human
cccgggccuccccagcccugccacucaccaua

SEQ ID NO: 106885 - RNA, 18 nt, Human
cccgggccuccccucguc

SEQ ID NO: 106886 - RNA, 32 nt, Human
cccgggccucccucccugucucucuggcucuc

SEQ ID NO: 106887 - RNA, 32 nt, Human
cccgggccuccuggccucucccuccaugggcu

SEQ ID NO: 106888 - RNA, 32 nt, Human
cccgggccugggaacugcuggcucuaagaacc

SEQ ID NO: 106889 - RNA, 32 nt, Human
cccgggccuugggguagcaccuccuucugcuu

SEQ ID NO: 106890 - RNA, 32 nt, Human
cccgggccuuucucuccugggcugucucuggu

SEQ ID NO: 106891 - RNA, 20 nt, Human
cccgggcgcaggauccaggc

SEQ ID NO: 106892 - RNA, 32 nt, Human
cccgggcgcaucuggcuuaucuggagaccugg

SEQ ID NO: 106893 - RNA, 32 nt, Human
cccgggcgccccucccccuucuccccgccccg

SEQ ID NO: 106894 - RNA, 18 nt, Human
cccgggcgcgggauccag

SEQ ID NO: 106895 - RNA, 32 nt, Human
cccgggcggcagggcaagcagcgcggccucgg

SEQ ID NO: 106896 - RNA, 18 nt, Human
cccgggcggcccaggucc

SEQ ID NO: 106897 - RNA, 24 nt, Human
cccgggcggcggaaguugcaguga

SEQ ID NO: 106898 - RNA, 24 nt, Human
cccgggcggcggagauugcaguga

SEQ ID NO: 106899 - RNA, 32 nt, Human
cccgggcggcggagauugcagugagccgaggu

SEQ ID NO: 106900 - RNA, 23 nt, Human
cccgggcggcggcagcaacagcg

SEQ ID NO: 106901 - RNA, 32 nt, Human
cccgggcggcggcagcaacagcggcggcggca

SEQ ID NO: 106902 - RNA, 32 nt, Human
cccgggcggcuucaccccacacccaggggcca

SEQ ID NO: 106903 - RNA, 24 nt, Human
cccgggcgguggagcuugcaguga

SEQ ID NO: 106904 - RNA, 32 nt, Human
cccgggcgguggagcuugcagugagccgagau

SEQ ID NO: 106905 - RNA, 24 nt, Human
cccgggcgguggagguuguaguga

SEQ ID NO: 106906 - RNA, 32 nt, Human
cccgggcuaccuggcugcucugggcagggugu

SEQ ID NO: 106907 - RNA, 32 nt, Human
cccgggcucaacugcaacaacacacuucccug

SEQ ID NO: 106908 - RNA, 32 nt, Human
cccgggcucacgccauucuuccaccucagccu

SEQ ID NO: 106909 - RNA, 32 nt, Human
cccgggcuccaccgugggucucagacgcccug

SEQ ID NO: 106910 - RNA, 32 nt, Human
cccgggcuccguggcuaccaugcugagaguga

SEQ ID NO: 106911 - RNA, 32 nt, Human
cccgggcucggggaccuuucgcacucggguca

SEQ ID NO: 106912 - RNA, 20 nt, Human
cccgggcucucagcgcccac

SEQ ID NO: 106913 - RNA, 32 nt, Human
cccgggcucuccugcccugcccuccugcccgc

SEQ ID NO: 106914 - RNA, 32 nt, Human
cccgggcugcccccgccagcucuggcuguuua

SEQ ID NO: 106915 - RNA, 32 nt, Human
cccgggcugccuggccgcggcggcaugggggc

SEQ ID NO: 106916 - RNA, 32 nt, Human
cccgggcugcgccccagcaccaugcucugcgc

SEQ ID NO: 106917 - RNA, 32 nt, Human
cccgggcugcguccacgcccugggcagguagg

SEQ ID NO: 106918 - RNA, 32 nt, Human
cccgggcuggaaggcagggcaucagcuaugga

SEQ ID NO: 106919 - RNA, 18 nt, Human
cccgggcuggagugcaau

SEQ ID NO: 106920 - RNA, 19 nt, Human
cccgggcuggagugcaaug

SEQ ID NO: 106921 - RNA, 20 nt, Human
cccgggcuggagugcaaugg

SEQ ID NO: 106922 - RNA, 20 nt, Human
cccgggcuggagugcagcgg

SEQ ID NO: 106923 - RNA, 18 nt, Human
cccgggcuggagugcagu

SEQ ID NO: 106924 - RNA, 19 nt, Human
cccgggcuggagugcagug

SEQ ID NO: 106925 - RNA, 20 nt, Human
cccgggcuggagugcagugg

SEQ ID NO: 106926 - RNA, 22 nt, Human
cccgggcuggagugcaguggug

SEQ ID NO: 106927 - RNA, 32 nt, Human
cccgggcugggaaagggcugagugucaacagg

SEQ ID NO: 106928 - RNA, 32 nt, Human
cccgggcugggcagggaccaugggcuguggcu

SEQ ID NO: 106929 - RNA, 32 nt, Human
cccgggcuggggcgcagagggagcccggagcc

SEQ ID NO: 106930 - RNA, 23 nt, Human
cccgggcugggggguagcagugg

SEQ ID NO: 106931 - RNA, 32 nt, Human
cccgggcuggucucaaacuccuggguucaagu

SEQ ID NO: 106932 - RNA, 32 nt, Human
cccgggcugugcaaagcuggccagggccuccc

SEQ ID NO: 106933 - RNA, 32 nt, Human
cccgggcugugcaaagcuggccagggccuccu

SEQ ID NO: 106934 - RNA, 32 nt, Human
cccgggcuuagugugagcaucuugccagccuc

SEQ ID NO: 106935 - RNA, 19 nt, Human
cccgggcuucgccccaccc

SEQ ID NO: 106936 - RNA, 32 nt, Human
cccgggcuuggcggcucuagccccagcgccaa

SEQ ID NO: 106937 - RNA, 32 nt, Human
cccggggaacugaagauuguccuggccgcgac

SEQ ID NO: 106938 - RNA, 32 nt, Human
cccggggaagggaagagcaggucaguacagag

SEQ ID NO: 106939 - RNA, 32 nt, Human
cccggggacacacacccaugacaugagccagc

SEQ ID NO: 106940 - RNA, 23 nt, Human
cccggggacggagguugcaguga

SEQ ID NO: 106941 - RNA, 32 nt, Human
cccggggacucgcauuccccgguucccccucc

SEQ ID NO: 106942 - RNA, 32 nt, Human
cccggggagagggggaggggagggccuccggg

SEQ ID NO: 106943 - RNA, 19 nt, Human
cccggggagcaggcggcug

SEQ ID NO: 106944 - RNA, 32 nt, Human
cccggggagccagcuggccugggguucggucc

SEQ ID NO: 106945 - RNA, 32 nt, Human
cccggggagccgcccucacacauuuuccagga

SEQ ID NO: 106946 - RNA, 32 nt, Human
cccggggagccgcgggagaggcggcggcgggg

SEQ ID NO: 106947 - RNA, 32 nt, Human
cccggggagcgugagcgaugcccagcugcacc

SEQ ID NO: 106948 - RNA, 32 nt, Human
cccggggagcuccaggagagaggggagcccag

SEQ ID NO: 106949 - RNA, 32 nt, Human
cccggggaggcaagauugagggcccgggagag

SEQ ID NO: 106950 - RNA, 32 nt, Human
cccggggaggcugcagcgcagagcagcggggc

SEQ ID NO: 106951 - RNA, 19 nt, Human
cccggggagggaggcgcgg

SEQ ID NO: 106952 - RNA, 32 nt, Human
cccggggaggggcagggccuggagcuucccac

SEQ ID NO: 106953 - RNA, 32 nt, Human
cccggggaggggccagaguuuucuaugaaucu

SEQ ID NO: 106954 - RNA, 32 nt, Human
cccggggaggggcugcagacagcagggggaga

SEQ ID NO: 106955 - RNA, 16 nt, Human
cccggggagggggcgc

SEQ ID NO: 106956 - RNA, 32 nt, Human
cccggggcaagaggagggagaaggcagggccg

SEQ ID NO: 106957 - RNA, 22 nt, Human
cccggggcacccuccuguccga

SEQ ID NO: 106958 - RNA, 32 nt, Human
cccggggcagaggcauaagcccacauaugcug

SEQ ID NO: 106959 - RNA, 32 nt, Human
cccggggcagcaccugccccgccuugcggagc

SEQ ID NO: 106960 - RNA, 32 nt, Human
cccggggcaggcggugguggcccagggcugcc

SEQ ID NO: 106961 - RNA, 32 nt, Human
cccggggcaguggugcccaggcugccugacau

SEQ ID NO: 106962 - RNA, 32 nt, Human
cccggggccaccucuacugacacccacaccug

SEQ ID NO: 106963 - RNA, 32 nt, Human
cccggggcccggagcggccggagcagcccggg

SEQ ID NO: 106964 - RNA, 17 nt, Human
cccggggcccuccugcu

SEQ ID NO: 106965 - RNA, 32 nt, Human
cccggggcccugcuuccucacacuggcggguu

SEQ ID NO: 106966 - RNA, 32 nt, Human
cccggggccgcagagcaguaccaguccguggc

SEQ ID NO: 106967 - RNA, 32 nt, Human
cccggggccuccagcgaggccugagaagggug

SEQ ID NO: 106968 - RNA, 23 nt, Human
cccggggcgccucgcggcacgga

SEQ ID NO: 106969 - RNA, 21 nt, Human
cccggggcucagcccaugccc

SEQ ID NO: 106970 - RNA, 19 nt, Human
cccggggcuggugggccuu

SEQ ID NO: 106971 - RNA, 32 nt, Human
cccgggggaagagacgggaagcucggcucugg

SEQ ID NO: 106972 - RNA, 23 nt, Human
cccgggggaccugccugcuccuu

SEQ ID NO: 106973 - RNA, 32 nt, Human
cccgggggagaccucuucacacccaaagaugc

SEQ ID NO: 106974 - RNA, 18 nt, Human
cccgggggaggggggcag

SEQ ID NO: 106975 - RNA, 32 nt, Human
cccgggggcacacaggcuccacacugccaccc

SEQ ID NO: 106976 - RNA, 19 nt, Human
cccgggggccccaccgccc

SEQ ID NO: 106977 - RNA, 18 nt, Human
cccgggggccccaccucg

SEQ ID NO: 106978 - RNA, 32 nt, Human
cccgggggccccaucggccugcagaggggacg

SEQ ID NO: 106979 - RNA, 20 nt, Human
cccgggggcgaggggcguag

SEQ ID NO: 106980 - RNA, 23 nt, Human
cccgggggcgcagagcccccguc

SEQ ID NO: 106981 - RNA, 18 nt, Human
cccgggggcggccugugg

SEQ ID NO: 106982 - RNA, 32 nt, Human
cccgggggcuccccacgugugauugaucuggg

SEQ ID NO: 106983 - RNA, 23 nt, Human
cccgggggcugagguugcuguga

SEQ ID NO: 106984 - RNA, 21 nt, Human
cccggggggcggagggaggug

SEQ ID NO: 106985 - RNA, 23 nt, Human
cccggggggcggagguugcagug

SEQ ID NO: 106986 - RNA, 24 nt, Human
cccggggggcggagguugcaguga

SEQ ID NO: 106987 - RNA, 24 nt, Human
cccgggggguggagccugcaguga

SEQ ID NO: 106988 - RNA, 20 nt, Human
cccggggguagggggcgcag

SEQ ID NO: 106989 - RNA, 32 nt, Human
cccgggguccugacacccaagagaagagaugg

SEQ ID NO: 106990 - RNA, 32 nt, Human
cccggggucucccacaggccugugaguugccu

SEQ ID NO: 106991 - RNA, 23 nt, Human
cccggguaaauggagguugcagu

SEQ ID NO: 106992 - RNA, 32 nt, Human
cccgggucaagcaauucuccugccucagcuuc

SEQ ID NO: 106993 - RNA, 32 nt, Human
cccgggucacccuggcaugaggagaugggccu

SEQ ID NO: 106994 - RNA, 32 nt, Human
cccgggucaggcuggggaggaacagaacuggg

SEQ ID NO: 106995 - RNA, 32 nt, Human
cccgggucaucuguaccucugccuccuuuccc

SEQ ID NO: 106996 - RNA, 20 nt, Human
cccgggucccugcagcgcuu

SEQ ID NO: 106997 - RNA, 32 nt, Human
cccggguccgaccucacaaccccacgcuguag

SEQ ID NO: 106998 - RNA, 32 nt, Human
cccggguccucacaccccuccuuggcccuucu

SEQ ID NO: 106999 - RNA, 32 nt, Human
cccggguccucccacugauuccuuugaccauc

SEQ ID NO: 107000 - RNA, 31 nt, Human
cccggguccucugugcagguuggaggauggu

SEQ ID NO: 107001 - RNA, 32 nt, Human
cccgggucgcguacuugcuuaggcaacugcaa

SEQ ID NO: 107002 - RNA, 25 nt, Human
cccgggucuuuacacaguccgcguc

SEQ ID NO: 107003 - RNA, 31 nt, Human
cccgggugaguguccaggcaugccagcggaa

SEQ ID NO: 107004 - RNA, 32 nt, Human
cccgggugauaguacagucaauauugucagua

SEQ ID NO: 107005 - RNA, 18 nt, Human
cccgggugcccggccccc

SEQ ID NO: 107006 - RNA, 32 nt, Human
cccgggugccgagcacugccuccgggcuuccc

SEQ ID NO: 107007 - RNA, 22 nt, Human
cccgggugcuccagcucugccc

SEQ ID NO: 107008 - RNA, 18 nt, Human
cccggguggcacgucccc

SEQ ID NO: 107009 - RNA, 24 nt, Human
cccggguggcagagguugcaguga

SEQ ID NO: 107010 - RNA, 32 nt, Human
cccggguggcaguggauugauguccaguucuu

SEQ ID NO: 107011 - RNA, 31 nt, Human
cccggguggccagcagcagccaacgcucccg

SEQ ID NO: 107012 - RNA, 24 nt, Human
cccggguggcggcgcuugcaguga

SEQ ID NO: 107013 - RNA, 32 nt, Human
cccggguggcggcgcuugcagugagcugagcu

SEQ ID NO: 107014 - RNA, 32 nt, Human
cccggguggcggcggcaacggcgguggugacg

SEQ ID NO: 107015 - RNA, 32 nt, Human
cccggguguagaugccuucccacccaccaggc

SEQ ID NO: 107016 - RNA, 32 nt, Human
cccgggugugaaaagccagggaaugaagcccg

SEQ ID NO: 107017 - RNA, 19 nt, Human
cccggguguggggugcccu

SEQ ID NO: 107018 - RNA, 32 nt, Human
cccggguguucugcaagcuggucaaaaagggg

SEQ ID NO: 107019 - RNA, 32 nt, Human
cccggguuuccgcuucccuccgggcgcgagaa

SEQ ID NO: 107020 - RNA, 32 nt, Human
cccgguaaaggcccccucugugaagagaaccc

SEQ ID NO: 107021 - RNA, 32 nt, Human
cccgguacaaguggcucaucaucaagaucgug

SEQ ID NO: 107022 - RNA, 32 nt, Human
cccgguaccucucuccccacuggccaggacuc

SEQ ID NO: 107023 - RNA, 19 nt, Human
cccgguacgagggggccca

SEQ ID NO: 107024 - RNA, 32 nt, Human
cccgguagaggcggagguugcagugagccgag

SEQ ID NO: 107025 - RNA, 32 nt, Human
cccgguaggcagagguugcagugagccgaggu

SEQ ID NO: 107026 - RNA, 32 nt, Human
cccgguaggcggagcuugcagugagcugagau

SEQ ID NO: 107027 - RNA, 32 nt, Human
cccgguagggggccugcagggagccagagggu

SEQ ID NO: 107028 - RNA, 24 nt, Human
cccgguagguggagguugcaguga

SEQ ID NO: 107029 - RNA, 32 nt, Human
cccgguagguggagguugcagugagccgagau

SEQ ID NO: 107030 - RNA, 32 nt, Human
cccggucaaccagcggagaguggggaacugcg

SEQ ID NO: 107031 - RNA, 32 nt, Human
cccggucaagucuacugccaccucucacucuc

SEQ ID NO: 107032 - RNA, 32 nt, Human
cccggucaccugccaggugaccacauggccag

SEQ ID NO: 107033 - RNA, 32 nt, Human
cccggucagccaaucugggugcugcugacgug

SEQ ID NO: 107034 - RNA, 32 nt, Human
cccggucagcucugcaucagguguuuucugag

SEQ ID NO: 107035 - RNA, 32 nt, Human
cccggucagcuggucuggcccuggacgugccu

SEQ ID NO: 107036 - RNA, 32 nt, Human
cccggucagggagccucugcugugcuggcuuc

SEQ ID NO: 107037 - RNA, 32 nt, Human
cccggucauccagaagccccgcggaacagaga

SEQ ID NO: 107038 - RNA, 32 nt, Human
cccggucaugcugcuguccagugagcagccgg

SEQ ID NO: 107039 - RNA, 32 nt, Human
cccggucccagcccaaacucaggcuggaggca

SEQ ID NO: 107040 - RNA, 32 nt, Human
cccggucccuggcagaaguauucaugcuuugg

SEQ ID NO: 107041 - RNA, 31 nt, Human
cccggucgcauucuuugacaugcagauugga

SEQ ID NO: 107042 - RNA, 24 nt, Human
cccggucgcucuccuccggcgguc

SEQ ID NO: 107043 - RNA, 32 nt, Human
cccggucggaggcggaaggaagugauauuuau

SEQ ID NO: 107044 - RNA, 32 nt, Human
cccggucgggagggaggaagguggcaagaugg

SEQ ID NO: 107045 - RNA, 21 nt, Human
cccggucgguuuccgccagga

SEQ ID NO: 107046 - RNA, 28 nt, Human
cccggucucaaguaggccucaucugccg

SEQ ID NO: 107047 - RNA, 32 nt, Human
cccggucucccagggccucacccgagugaugc

SEQ ID NO: 107048 - RNA, 32 nt, Human
cccggucugcuccuucagccuccuugcucaug

SEQ ID NO: 107049 - RNA, 32 nt, Human
cccggucugcuccuucagccuccuugcucuug

SEQ ID NO: 107050 - RNA, 32 nt, Human
cccggucuguucuguuccacucugaccaucgg

SEQ ID NO: 107051 - RNA, 32 nt, Human
cccggucuuccuccucguccugccgcaggcca

SEQ ID NO: 107052 - RNA, 32 nt, Human
cccggugaacagcagcaggaggagccgcuaga

SEQ ID NO: 107053 - RNA, 32 nt, Human
cccggugacauucuauuuccaggaaaauccgg

SEQ ID NO: 107054 - RNA, 32 nt, Human
cccggugaccugcuggagaagacaccugggag

SEQ ID NO: 107055 - RNA, 32 nt, Human
cccggugagaagcagagcgcgagagggagccc

SEQ ID NO: 107056 - RNA, 32 nt, Human
cccggugagauggaccauccugcccccguggg

SEQ ID NO: 107057 - RNA, 32 nt, Human
cccggugcagagaagaggguggagccuugccg

SEQ ID NO: 107058 - RNA, 32 nt, Human
cccggugcagcagcacaagcccggcacucaaa

SEQ ID NO: 107059 - RNA, 32 nt, Human
cccggugcagccucuaacuccugggcucaagc

SEQ ID NO: 107060 - RNA, 32 nt, Human
cccggugcaguggcucaugccuguaaucccaa

SEQ ID NO: 107061 - RNA, 32 nt, Human
cccggugccaugaacggagacgaugccuuugc

SEQ ID NO: 107062 - RNA, 32 nt, Human
cccggugccaugaacggagacgaugccuuugu

SEQ ID NO: 107063 - RNA, 19 nt, Human
cccggugcccguguguccg

SEQ ID NO: 107064 - RNA, 19 nt, Human
cccggugccugccucaccc

SEQ ID NO: 107065 - RNA, 32 nt, Human
cccggugccugggacgggcucagccgccaggg

SEQ ID NO: 107066 - RNA, 32 nt, Human
cccggugcggcugaggccccuuugggcagccc

SEQ ID NO: 107067 - RNA, 32 nt, Human
cccggugcgggugggagucagggcgcccggaa

SEQ ID NO: 107068 - RNA, 32 nt, Human
cccggugcgguggcucaugccuguaaucccag

SEQ ID NO: 107069 - RNA, 32 nt, Human
cccggugcuauacuugccuccucuccacggaa

SEQ ID NO: 107070 - RNA, 32 nt, Human
cccggugcucuucuguuucucagucuucgcgc

SEQ ID NO: 107071 - RNA, 18 nt, Human
cccggugcuuccuccaga

SEQ ID NO: 107072 - RNA, 32 nt, Human
cccgguggcucacgccuguaaucccagcacuu

SEQ ID NO: 107073 - RNA, 32 nt, Human
cccgguggcucacuccuguaaucccagcacuu

SEQ ID NO: 107074 - RNA, 20 nt, Human
cccgguggcucaguccugag

SEQ ID NO: 107075 - RNA, 32 nt, Human
cccgguggcucaugccuguaaucccagcacug

SEQ ID NO: 107076 - RNA, 32 nt, Human
cccgguggcucaugccuguaauccuggcacuu

SEQ ID NO: 107077 - RNA, 32 nt, Human
cccgguggcucccgccuguaaucccagaacuu

SEQ ID NO: 107078 - RNA, 32 nt, Human
cccggugggacccggcccccacccaugcaugg

SEQ ID NO: 107079 - RNA, 32 nt, Human
cccggugggcggcagaggagcucuggcccgca

SEQ ID NO: 107080 - RNA, 32 nt, Human
cccgguggugagagcacugagccauugugaau

SEQ ID NO: 107081 - RNA, 22 nt, Human
cccggugguggcagaacugccu

SEQ ID NO: 107082 - RNA, 32 nt, Human
cccggugguggugauguugggaagauguuucc

SEQ ID NO: 107083 - RNA, 32 nt, Human
cccgguguaugccaaguggcccccgggaggac

SEQ ID NO: 107084 - RNA, 32 nt, Human
cccggugugagcugcaggcugugcuccagauc

SEQ ID NO: 107085 - RNA, 32 nt, Human
cccggugugggacuacaggcagcucugccugu

SEQ ID NO: 107086 - RNA, 21 nt, Human
cccgguuacucgggaggcuga

SEQ ID NO: 107087 - RNA, 32 nt, Human
cccgguucaagaggagggaguacccggauggc

SEQ ID NO: 107088 - RNA, 32 nt, Human
cccgguucaagcaauucuccugccucagccuc

SEQ ID NO: 107089 - RNA, 32 nt, Human
cccgguucaagcaauucuccugccucagccug

SEQ ID NO: 107090 - RNA, 32 nt, Human
cccgguucaagccauucuucugccucagccuc

SEQ ID NO: 107091 - RNA, 32 nt, Human
cccgguucaggcaauucuccugccucagccuc

SEQ ID NO: 107092 - RNA, 32 nt, Human
cccgguucgcggcgaugccagccaccccagcg

SEQ ID NO: 107093 - RNA, 32 nt, Human
cccgguuggaacugggacugagcucgggcacg

SEQ ID NO: 107094 - RNA, 32 nt, Human
cccgguuugggcuguagggggcgggagagucu

SEQ ID NO: 107095 - RNA, 31 nt, Human
cccgguuuguuucucccugcucaggucuaga

SEQ ID NO: 107096 - RNA, 32 nt, Human
cccgguuuugaagccgcuucucugcccgaguu

SEQ ID NO: 107097 - RNA, 32 nt, Human
cccgguuuugacugguugaaaccggacauugg

SEQ ID NO: 107098 - RNA, 20 nt, Human
cccguaacccccuccugccu

SEQ ID NO: 107099 - RNA, 19 nt, Human
cccguaaucccagcacuuu

SEQ ID NO: 107100 - RNA, 22 nt, Human
cccguaaucccagcuacucagg

SEQ ID NO: 107101 - RNA, 32 nt, Human
cccguaaucccagcuacucaggaggcugagac

SEQ ID NO: 107102 - RNA, 32 nt, Human
cccguaaucccagcuacucaggaggcugaggc

SEQ ID NO: 107103 - RNA, 32 nt, Human
cccguaaucccagcuacucaggaggcugaggu

SEQ ID NO: 107104 - RNA, 32 nt, Human
cccguaaucccagcuacucagguggcugaggc

SEQ ID NO: 107105 - RNA, 32 nt, Human
cccguaaucccagcuacucgggaggcugaacc

SEQ ID NO: 107106 - RNA, 32 nt, Human
cccguaaucccagcuacucgggaggcugaggc

SEQ ID NO: 107107 - RNA, 32 nt, Human
cccguaaucccagcuacuugggaggcuaaggc

SEQ ID NO: 107108 - RNA, 32 nt, Human
cccguaaucccagcuagucaggaggcugaggc

SEQ ID NO: 107109 - RNA, 32 nt, Human
cccguaaugccagcuacuugggaggcuaaagu

SEQ ID NO: 107110 - RNA, 32 nt, Human
cccguaauuucugcacuuugggagacugaggu

SEQ ID NO: 107111 - RNA, 32 nt, Human
cccguacacucccugccaccacuagguuguaa

SEQ ID NO: 107112 - RNA, 21 nt, Human
cccguacagguagccccgccg

SEQ ID NO: 107113 - RNA, 22 nt, Human
cccguacucuccacacccuaga

SEQ ID NO: 107114 - RNA, 31 nt, Human
cccguagaacaaugcgacagucuuauccacg

SEQ ID NO: 107115 - RNA, 32 nt, Human
cccguagagacacucccaaggagacagccaug

SEQ ID NO: 107116 - RNA, 32 nt, Human
cccguagcacaggcggagugcagcggaggccc

SEQ ID NO: 107117 - RNA, 21 nt, Human
cccguagcacugcccacccca

SEQ ID NO: 107118 - RNA, 32 nt, Human
cccguagcauuucaagguaacuguccaucucc

SEQ ID NO: 107119 - RNA, 23 nt, Human
cccguagccaccaccacacugcu

SEQ ID NO: 107120 - RNA, 32 nt, Human
cccguaggagggugggucagaggauacagaag

SEQ ID NO: 107121 - RNA, 22 nt, Human
cccguagucccagcuacucagg

SEQ ID NO: 107122 - RNA, 32 nt, Human
cccguagucccagcuacucaggaggcugaggc

SEQ ID NO: 107123 - RNA, 23 nt, Human
cccguaguuccagcuacuuggga

SEQ ID NO: 107124 - RNA, 32 nt, Human
cccguaguuccagcuacuugggaggcugaagc

SEQ ID NO: 107125 - RNA, 32 nt, Human
cccguaguuccagcuacuugggaggcugaggc

SEQ ID NO: 107126 - RNA, 32 nt, Human
cccguauacagcucugccaucucugagggguu

SEQ ID NO: 107127 - RNA, 32 nt, Human
cccguauaugucuacacacagaugacaaauua

SEQ ID NO: 107128 - RNA, 22 nt, Human
cccguauucccagcuacucaga

SEQ ID NO: 107129 - RNA, 32 nt, Human
cccguauucccagcuacucagaggcugaggca

SEQ ID NO: 107130 - RNA, 32 nt, Human
cccguauuuucaucuuccauucuaacauuauc

SEQ ID NO: 107131 - RNA, 32 nt, Human
cccgucaagugcugccccugccugugucuggg

SEQ ID NO: 107132 - RNA, 32 nt, Human
cccgucacucacugugucugaucugucucacu

SEQ ID NO: 107133 - RNA, 32 nt, Human
cccgucacugaaaaauauaaaaauuagcugag

SEQ ID NO: 107134 - RNA, 32 nt, Human
cccgucagcccagcauccggcuuugcuuccau

SEQ ID NO: 107135 - RNA, 17 nt, Human
cccgucaggccacagcc

SEQ ID NO: 107136 - RNA, 32 nt, Human
cccgucaggcuccccggcccucuggcugccaa

SEQ ID NO: 107137 - RNA, 32 nt, Human
cccgucagugcucuccccgucguuugcccucu

SEQ ID NO: 107138 - RNA, 32 nt, Human
cccgucaguggccugaggagaugguuggauca

SEQ ID NO: 107139 - RNA, 32 nt, Human
cccgucauacuaccagcugagauggugguggg

SEQ ID NO: 107140 - RNA, 32 nt, Human
cccgucaucucagcuacucaggaggcugaggc

SEQ ID NO: 107141 - RNA, 32 nt, Human
cccguccacagcugaucccugggcccugcugc

SEQ ID NO: 107142 - RNA, 32 nt, Human
cccguccagaucuggagccccuguggagccac

SEQ ID NO: 107143 - RNA, 22 nt, Human
cccguccaggucuucacagagg

SEQ ID NO: 107144 - RNA, 32 nt, Human
cccguccauggcuggcuggguccccuucgcag

SEQ ID NO: 107145 - RNA, 32 nt, Human
cccgucccacagugcaagaccccgaggccacg

SEQ ID NO: 107146 - RNA, 32 nt, Human
cccgucccacggucccggcgucaccccuccgg

SEQ ID NO: 107147 - RNA, 32 nt, Human
cccgucccauggggaaagaggcugcggacuug

SEQ ID NO: 107148 - RNA, 32 nt, Human
cccguccccaggccacacagauucuccucaag

SEQ ID NO: 107149 - RNA, 21 nt, Human
cccguccccagucgggccucc

SEQ ID NO: 107150 - RNA, 24 nt, Human
cccguccccaucuggcagcuccug

SEQ ID NO: 107151 - RNA, 19 nt, Human
cccgucccccucuggcucc

SEQ ID NO: 107152 - RNA, 18 nt, Human
cccguccccucugcccuc

SEQ ID NO: 107153 - RNA, 32 nt, Human
cccguccccugccaugcccaaauacaagcugg

SEQ ID NO: 107154 - RNA, 32 nt, Human
cccguccccugccgcuccgguuccgauggcac

SEQ ID NO: 107155 - RNA, 21 nt, Human
cccgucccgcuccugcuccuu

SEQ ID NO: 107156 - RNA, 23 nt, Human
cccgucccggucccuggccccug

SEQ ID NO: 107157 - RNA, 20 nt, Human
cccgucccuccgacagcucc

SEQ ID NO: 107158 - RNA, 32 nt, Human
cccgucccugaggcuuggcaaaguaggagccc

SEQ ID NO: 107159 - RNA, 32 nt, Human
cccgucccugaugucacccccaccccaccagc

SEQ ID NO: 107160 - RNA, 32 nt, Human
cccgucccugcucugccacugugcuccagcac

SEQ ID NO: 107161 - RNA, 32 nt, Human
cccgucccugggagguugaguggaaucugcag

SEQ ID NO: 107162 - RNA, 32 nt, Human
cccgucccuuaucccugguauccacgguuccc

SEQ ID NO: 107163 - RNA, 21 nt, Human
cccgucccuucuccucuuccc

SEQ ID NO: 107164 - RNA, 22 nt, Human
cccguccgccucucgcucgccu

SEQ ID NO: 107165 - RNA, 21 nt, Human
cccguccuccgccggccccug

SEQ ID NO: 107166 - RNA, 32 nt, Human
cccguccucgccccuucucauuucccucacuc

SEQ ID NO: 107167 - RNA, 32 nt, Human
cccguccucguggagcuuagcaggcagcuggg

SEQ ID NO: 107168 - RNA, 32 nt, Human
cccguccucguuuccagcaucuuugccacccu

SEQ ID NO: 107169 - RNA, 24 nt, Human
cccguccugccuccucggccccug

SEQ ID NO: 107170 - RNA, 32 nt, Human
cccguccugccuggccgcaggugcccuggaug

SEQ ID NO: 107171 - RNA, 32 nt, Human
cccguccuggugcgggaccugugccccgcgcu

SEQ ID NO: 107172 - RNA, 32 nt, Human
cccguccuguauccaugagagugcaugucggu

SEQ ID NO: 107173 - RNA, 32 nt, Human
cccgucgaggucaucccuguacugggccuuac

SEQ ID NO: 107174 - RNA, 32 nt, Human
cccgucgcacaggcuggagugcaguggcaaag

SEQ ID NO: 107175 - RNA, 32 nt, Human
cccgucgcagagacucucaggcucucaaacag

SEQ ID NO: 107176 - RNA, 19 nt, Human
cccgucgccgccgccgccg

SEQ ID NO: 107177 - RNA, 32 nt, Human
cccgucgcgcugcugcugcggcgcuccaaguu

SEQ ID NO: 107178 - RNA, 21 nt, Human
cccgucuaaccacagcuccuu

SEQ ID NO: 107179 - RNA, 28 nt, Human
cccgucucaagugcuccucuuccuucca

SEQ ID NO: 107180 - RNA, 32 nt, Human
cccgucucagcccucguguugccauugccucu

SEQ ID NO: 107181 - RNA, 32 nt, Human
cccgucucauuuccucccaaguuccuucacug

SEQ ID NO: 107182 - RNA, 17 nt, Human
cccgucuccagccccug

SEQ ID NO: 107183 - RNA, 19 nt, Human
cccgucuccgagcugcucc

SEQ ID NO: 107184 - RNA, 32 nt, Human
cccgucuccuaaaaggccagcaggucccagga

SEQ ID NO: 107185 - RNA, 21 nt, Human
cccgucuccucuucccuuccc

SEQ ID NO: 107186 - RNA, 32 nt, Human
cccgucucuacuaacauacaaaauuagcuggg

SEQ ID NO: 107187 - RNA, 32 nt, Human
cccgucucuacugaaagugcagaaggauuggc

SEQ ID NO: 107188 - RNA, 32 nt, Human
cccgucucuccucuccccauucugugcccuac

SEQ ID NO: 107189 - RNA, 32 nt, Human
cccgucucuggaauguccacucccagagccug

SEQ ID NO: 107190 - RNA, 32 nt, Human
cccgucucuucuuuuucugucauuucaugcuu

SEQ ID NO: 107191 - RNA, 32 nt, Human
cccgucucuuucuaccuccucuuccagagaac

SEQ ID NO: 107192 - RNA, 32 nt, Human
cccgucugcgguccccaucgagcaucaagggg

SEQ ID NO: 107193 - RNA, 32 nt, Human
cccgucugcucccgcccugcccgugcacucuc

SEQ ID NO: 107194 - RNA, 32 nt, Human
cccgucuggugagcccaaucucugcuggucag

SEQ ID NO: 107195 - RNA, 32 nt, Human
cccgucugugcacucuuggcuccuggggagau

SEQ ID NO: 107196 - RNA, 32 nt, Human
cccgucuguuucucccacuguccuuggcucag

SEQ ID NO: 107197 - RNA, 20 nt, Human
cccgucuuccucaccgcccc

SEQ ID NO: 107198 - RNA, 32 nt, Human
cccgucuucucucccgcagcugccucagucgg

SEQ ID NO: 107199 - RNA, 32 nt, Human
cccgucuucuucuuccccacuuuucccuggag

SEQ ID NO: 107200 - RNA, 32 nt, Human
cccgucuugacacaccacugugcugagugcuu

SEQ ID NO: 107201 - RNA, 32 nt, Human
cccgucuugcaaggucuuccacuucagcacaa

SEQ ID NO: 107202 - RNA, 32 nt, Human
cccgugaaaugauguuguugcugcccacauac

SEQ ID NO: 107203 - RNA, 32 nt, Human
cccgugaacccagaccacccagugccauggcc

SEQ ID NO: 107204 - RNA, 24 nt, Human
cccgugaagucgaggcugcaguga

SEQ ID NO: 107205 - RNA, 32 nt, Human
cccgugacagaggaggggagggguggugccug

SEQ ID NO: 107206 - RNA, 32 nt, Human
cccgugaccagccagaagcacggagcgcaggg

SEQ ID NO: 107207 - RNA, 32 nt, Human
cccgugaccccucgcgcugccugcggccucgc

SEQ ID NO: 107208 - RNA, 32 nt, Human
cccgugacccuccagcaccagccggcugugcg

SEQ ID NO: 107209 - RNA, 32 nt, Human
cccgugacccuccagccccaugaccuguucau

SEQ ID NO: 107210 - RNA, 32 nt, Human
cccgugacggcgaccacugcucccgggccgug

SEQ ID NO: 107211 - RNA, 32 nt, Human
cccgugagccgaggcgggugauuuauuuggca

SEQ ID NO: 107212 - RNA, 32 nt, Human
cccgugagccugggggcaggugccaggcgaug

SEQ ID NO: 107213 - RNA, 19 nt, Human
cccgugaggacccaggacc

SEQ ID NO: 107214 - RNA, 24 nt, Human
cccgugaggcagagguugcaguga

SEQ ID NO: 107215 - RNA, 32 nt, Human
cccgugaggcagagguugcagugagccgagau

SEQ ID NO: 107216 - RNA, 32 nt, Human
cccgugaggcggagguuguagugagccaagau

SEQ ID NO: 107217 - RNA, 32 nt, Human
cccgugaggcugaggcuccucccacuggaccg

SEQ ID NO: 107218 - RNA, 32 nt, Human
cccgugaggcuggagucagccguggguugagc

SEQ ID NO: 107219 - RNA, 32 nt, Human
cccgugagugccucaacaacugagaugaacgu

SEQ ID NO: 107220 - RNA, 25 nt, Human
cccgugaucacccacgcugauuccu

SEQ ID NO: 107221 - RNA, 19 nt, Human
cccgugaucuccccucaca

SEQ ID NO: 107222 - RNA, 32 nt, Human
cccgugauuuggaacuuuccaaucccagagaa

SEQ ID NO: 107223 - RNA, 32 nt, Human
cccgugcacucgggggccucccucacaucccg

SEQ ID NO: 107224 - RNA, 32 nt, Human
cccgugcacuggagaggcuggggaggcagggg

SEQ ID NO: 107225 - RNA, 32 nt, Human
cccgugcauccaggcggccaagcacaaacugg

SEQ ID NO: 107226 - RNA, 32 nt, Human
cccgugcaucccugcccauggauucugcagga

SEQ ID NO: 107227 - RNA, 32 nt, Human
cccgugcccagccucuccaccgucacuguccg

SEQ ID NO: 107228 - RNA, 19 nt, Human
cccgugcccgccugcagug

SEQ ID NO: 107229 - RNA, 21 nt, Human
cccgugcccuacccccuccca

SEQ ID NO: 107230 - RNA, 20 nt, Human
cccgugccguuuauuucaga

SEQ ID NO: 107231 - RNA, 32 nt, Human
cccgugccugcaggggaaaguggucugcacau

SEQ ID NO: 107232 - RNA, 32 nt, Human
cccgugccugcgccaucuccaucagagcugca

SEQ ID NO: 107233 - RNA, 21 nt, Human
cccgugcgagccgcgcugccg

SEQ ID NO: 107234 - RNA, 32 nt, Human
cccgugcgcggccuacacgcuugggggacagc

SEQ ID NO: 107235 - RNA, 19 nt, Human
cccgugcucacaguagcuu

SEQ ID NO: 107236 - RNA, 23 nt, Human
cccgugcuccggacaccccgggc

SEQ ID NO: 107237 - RNA, 19 nt, Human
cccgugcucucaggcuagc

SEQ ID NO: 107238 - RNA, 32 nt, Human
cccgugcugcugcucugugccugcugucagag

SEQ ID NO: 107239 - RNA, 19 nt, Human
cccgugcugggcugcaugg

SEQ ID NO: 107240 - RNA, 32 nt, Human
cccguggaaagccacaaggacaaagggagcgg

SEQ ID NO: 107241 - RNA, 32 nt, Human
cccguggacccagccuuugucaguggcaggug

SEQ ID NO: 107242 - RNA, 32 nt, Human
cccguggacuggagcagagagaacucuacuuc

SEQ ID NO: 107243 - RNA, 32 nt, Human
cccguggagcccgccucuccagucccagccag

SEQ ID NO: 107244 - RNA, 32 nt, Human
cccguggaucacugaagauuccugcucuccug

SEQ ID NO: 107245 - RNA, 17 nt, Human
cccguggccgccgcgcc

SEQ ID NO: 107246 - RNA, 32 nt, Human
cccguggccugcaggccugcaggggaggcagc

SEQ ID NO: 107247 - RNA, 32 nt, Human
cccguggcucucucaggaguagauggugcuag

SEQ ID NO: 107248 - RNA, 32 nt, Human
cccgugggccaggcugcaccugugcuggggga

SEQ ID NO: 107249 - RNA, 32 nt, Human
cccguggggcugggccuccgccccugcaccag

SEQ ID NO: 107250 - RNA, 32 nt, Human
cccgugggguggagcauggugccccucacaag

SEQ ID NO: 107251 - RNA, 32 nt, Human
cccgugggguuccucccuucucuucacaguca

SEQ ID NO: 107252 - RNA, 32 nt, Human
cccgugggucccagcacuuccacacacucuga

SEQ ID NO: 107253 - RNA, 24 nt, Human
cccgugggugaccccucaccccag

SEQ ID NO: 107254 - RNA, 32 nt, Human
cccguggucaccacaauaaagagcccuccacc

SEQ ID NO: 107255 - RNA, 18 nt, Human
cccguggucacccccuca

SEQ ID NO: 107256 - RNA, 32 nt, Human
cccgugguguggccagccucuuugccggacgc

SEQ ID NO: 107257 - RNA, 32 nt, Human
cccguguacuccaccugccccaggagcuggag

SEQ ID NO: 107258 - RNA, 24 nt, Human
cccguguagcugggacuacaggca

SEQ ID NO: 107259 - RNA, 23 nt, Human
cccguguaggaugacugggccuc

SEQ ID NO: 107260 - RNA, 32 nt, Human
cccguguauaugcacccacaccaugugcccgu

SEQ ID NO: 107261 - RNA, 32 nt, Human
cccgugucaacuuucagugcuggccaaaaccu

SEQ ID NO: 107262 - RNA, 22 nt, Human
cccgugucaccuacuacuugga

SEQ ID NO: 107263 - RNA, 32 nt, Human
cccguguccagccugaguuccagccucacuga

SEQ ID NO: 107264 - RNA, 32 nt, Human
cccguguccucagagcaccacacacugagcac

SEQ ID NO: 107265 - RNA, 21 nt, Human
cccguguccugcagguauugg

SEQ ID NO: 107266 - RNA, 32 nt, Human
cccgugucugagggggugagggauacugaggc

SEQ ID NO: 107267 - RNA, 32 nt, Human
cccgugucuggaugcacagaugccauggccug

SEQ ID NO: 107268 - RNA, 31 nt, Human
cccgugugacuccucuggccugugucuaguu

SEQ ID NO: 107269 - RNA, 24 nt, Human
cccgugugagccagaaaccagggc

SEQ ID NO: 107270 - RNA, 32 nt, Human
cccgugugagccaggaaagggcuguguuuaug

SEQ ID NO: 107271 - RNA, 31 nt, Human
cccgugugcaggaucaauuguaggaggaaau

SEQ ID NO: 107272 - RNA, 32 nt, Human
cccgugugcccuggcccuggcuguggggcugg

SEQ ID NO: 107273 - RNA, 29 nt, Human
cccgugugucuguguguaugugugugggg

SEQ ID NO: 107274 - RNA, 32 nt, Human
cccguguguggcugaggauggcugagcagcag

SEQ ID NO: 107275 - RNA, 28 nt, Human
cccguguugggugcugccaucucuacua

SEQ ID NO: 107276 - RNA, 24 nt, Human
cccguguuuucugaccuccugccu

SEQ ID NO: 107277 - RNA, 32 nt, Human
cccguuacccgugaaagcuuugcuccacagcg

SEQ ID NO: 107278 - RNA, 32 nt, Human
cccguuagucccugaucccaaccuucucccuc

SEQ ID NO: 107279 - RNA, 32 nt, Human
cccguuauuauuuaagcuacugccaucaaccc

SEQ ID NO: 107280 - RNA, 32 nt, Human
cccguucacacugaggaacggagaccugugac

SEQ ID NO: 107281 - RNA, 32 nt, Human
cccguucaguugggagcuuauugugagauugg

SEQ ID NO: 107282 - RNA, 32 nt, Human
cccguucccacacaguggagggcgcagcaaac

SEQ ID NO: 107283 - RNA, 32 nt, Human
cccguucccacccccgccccaggcuggaaaac

SEQ ID NO: 107284 - RNA, 32 nt, Human
cccguucccagagaucuggggguccuucuuug

SEQ ID NO: 107285 - RNA, 32 nt, Human
cccguucccugcccuccucccuucccugggug

SEQ ID NO: 107286 - RNA, 32 nt, Human
cccguuccucaagggauuccuggcuggcuaug

SEQ ID NO: 107287 - RNA, 32 nt, Human
cccguucuacacugcccauguagacgauuuuc

SEQ ID NO: 107288 - RNA, 32 nt, Human
cccguucucauagcagcacuccuguuuaauca

SEQ ID NO: 107289 - RNA, 32 nt, Human
cccguugacgggcaaugcaucuuuccaaccug

SEQ ID NO: 107290 - RNA, 32 nt, Human
cccguugagaccagcaugaaggucgaagcuca

SEQ ID NO: 107291 - RNA, 32 nt, Human
cccguugaguccuuuugagggugauuugucuu

SEQ ID NO: 107292 - RNA, 32 nt, Human
cccguugcagagccagggacaugaugcaggcg

SEQ ID NO: 107293 - RNA, 32 nt, Human
cccguugcaggcgaguuccaagcacagagaac

SEQ ID NO: 107294 - RNA, 32 nt, Human
cccguugcuccuccuacuguuuaucacuugcc

SEQ ID NO: 107295 - RNA, 32 nt, Human
cccguuggaagacugagugcccggggcacggc

SEQ ID NO: 107296 - RNA, 31 nt, Human
cccguuggccuacuggaguguguaaggaacu

SEQ ID NO: 107297 - RNA, 32 nt, Human
cccguuggguagcuggggccaggcuucucucc

SEQ ID NO: 107298 - RNA, 32 nt, Human
cccguuuacagaaugcuacaagaauaauguac

SEQ ID NO: 107299 - RNA, 32 nt, Human
cccguuucugccacuugcuuccuggguaaaca

SEQ ID NO: 107300 - RNA, 32 nt, Human
cccguuucugcucuccucccuuuuguguuccu

SEQ ID NO: 107301 - RNA, 32 nt, Human
cccguuuuccagcauguguucuguuagauuuu

SEQ ID NO: 107302 - RNA, 32 nt, Human
cccguuuucggugccaucagugccccgucuac

SEQ ID NO: 107303 - RNA, 32 nt, Human
cccguuuucucagcauucagcccagggaaugu

SEQ ID NO: 107304 - RNA, 21 nt, Human
cccuaaaaaccauuccacuug

SEQ ID NO: 107305 - RNA, 32 nt, Human
cccuaaaaauaggaacaauuagccaggcaugg

SEQ ID NO: 107306 - RNA, 20 nt, Human
cccuaaaaauccccaaaaca

SEQ ID NO: 107307 - RNA, 32 nt, Human
cccuaaaaauggcucugucacugugaguggcu

SEQ ID NO: 107308 - RNA, 18 nt, Human
cccuaaaacauccauuug

SEQ ID NO: 107309 - RNA, 32 nt, Human
cccuaaaacgcacaccccgcuagccaugggca

SEQ ID NO: 107310 - RNA, 32 nt, Human
cccuaaaacugaggcacuaucccagagaucag

SEQ ID NO: 107311 - RNA, 32 nt, Human
cccuaaaaguuacaguuuggggagagggagug

SEQ ID NO: 107312 - RNA, 32 nt, Human
cccuaaaaugcgcguggaggcagcugggccuu

SEQ ID NO: 107313 - RNA, 32 nt, Human
cccuaaacacaaagcaucaguauuuauagcaa

SEQ ID NO: 107314 - RNA, 21 nt, Human
cccuaaaccccuccccaccuc

SEQ ID NO: 107315 - RNA, 32 nt, Human
cccuaaaccucauuuggauccuugggguauag

SEQ ID NO: 107316 - RNA, 32 nt, Human
cccuaaagcccucuuuuggcaggaagcggugg

SEQ ID NO: 107317 - RNA, 32 nt, Human
cccuaaaggcagagguugcagugagccgagau

SEQ ID NO: 107318 - RNA, 32 nt, Human
cccuaaauacuuucaugucucuauauucauuu

SEQ ID NO: 107319 - RNA, 32 nt, Human
cccuaaauaugcuggggucguaacccugagua

SEQ ID NO: 107320 - RNA, 32 nt, Human
cccuaaaucacuuugagccugggaaauaagcc

SEQ ID NO: 107321 - RNA, 32 nt, Human
cccuaaaucugccucuucugcaagcuacuugg

SEQ ID NO: 107322 - RNA, 21 nt, Human
cccuaaauggccagcagcuca

SEQ ID NO: 107323 - RNA, 32 nt, Human
cccuaaauuacaaaugagaaaauugaagcaca

SEQ ID NO: 107324 - RNA, 32 nt, Human
cccuaaauuccagagauucagcaacaaagagg

SEQ ID NO: 107325 - RNA, 18 nt, Human
cccuaaauuccugcugcc

SEQ ID NO: 107326 - RNA, 32 nt, Human
cccuaaauucuccuccucccccauuuugaugu

SEQ ID NO: 107327 - RNA, 32 nt, Human
cccuaacaccaucguuuccacucuucucagug

SEQ ID NO: 107328 - RNA, 32 nt, Human
cccuaacaggaaauuuggcaauggggucuggg

SEQ ID NO: 107329 - RNA, 32 nt, Human
cccuaacauaggauuucagagcacuccugcug

SEQ ID NO: 107330 - RNA, 32 nt, Human
cccuaacaucaccacacacaccccugucggca

SEQ ID NO: 107331 - RNA, 32 nt, Human
cccuaaccacaggaggcagggaagaaaaugug

SEQ ID NO: 107332 - RNA, 32 nt, Human
cccuaaccagggguaucucugagccugguggg

SEQ ID NO: 107333 - RNA, 32 nt, Human
cccuaacccuccacauacauuugccuaucaca

SEQ ID NO: 107334 - RNA, 19 nt, Human
cccuaaccgucucucccca

SEQ ID NO: 107335 - RNA, 22 nt, Human
cccuaaccugccucuggcccca

SEQ ID NO: 107336 - RNA, 32 nt, Human
cccuaaccuuuuccuuucugccauaauuaaca

SEQ ID NO: 107337 - RNA, 32 nt, Human
cccuaacucacugucugcggugcucauugcug

SEQ ID NO: 107338 - RNA, 32 nt, Human
cccuaacucccagcaccuuagaaugugacuau

SEQ ID NO: 107339 - RNA, 32 nt, Human
cccuaacucuaaugcuaaccccuaaaccaucc

SEQ ID NO: 107340 - RNA, 32 nt, Human
cccuaacuuaucugggaaggcuggggaaguag

SEQ ID NO: 107341 - RNA, 32 nt, Human
cccuaagacugugaccuccuggaaggcuggag

SEQ ID NO: 107342 - RNA, 32 nt, Human
cccuaagagaugggacuaggaccugagccugg

SEQ ID NO: 107343 - RNA, 32 nt, Human
cccuaagaggugaaagagaagccuggcucugu

SEQ ID NO: 107344 - RNA, 32 nt, Human
cccuaagaucagcuagacucucugccuuguuu

SEQ ID NO: 107345 - RNA, 32 nt, Human
cccuaagaucuccuugagucaggaaccugcaa

SEQ ID NO: 107346 - RNA, 25 nt, Human
cccuaagaucuucaccucucugccu

SEQ ID NO: 107347 - RNA, 32 nt, Human
cccuaagauguuuccagggcccucuggugccc

SEQ ID NO: 107348 - RNA, 32 nt, Human
cccuaagcaccaaccucuucaucuagaacaug

SEQ ID NO: 107349 - RNA, 32 nt, Human
cccuaagcagauagguagacagagguaaacau

SEQ ID NO: 107350 - RNA, 32 nt, Human
cccuaagcauuuuucaccuagcauuccucuuc

SEQ ID NO: 107351 - RNA, 32 nt, Human
cccuaagccacugggacgguggccagagaugc

SEQ ID NO: 107352 - RNA, 32 nt, Human
cccuaagccagcugcccccagagccacaguuc

SEQ ID NO: 107353 - RNA, 21 nt, Human
cccuaagccuuaagucuuuuu

SEQ ID NO: 107354 - RNA, 32 nt, Human
cccuaagcgguuuggaaucugcuuugcucuca

SEQ ID NO: 107355 - RNA, 32 nt, Human
cccuaagcgucacccaagcacacucacuuaaa

SEQ ID NO: 107356 - RNA, 32 nt, Human
cccuaagcugcucucccuuggaaccugcacag

SEQ ID NO: 107357 - RNA, 32 nt, Human
cccuaaggaacagcauuucucugcuccucagu

SEQ ID NO: 107358 - RNA, 32 nt, Human
cccuaaggaaucugaaaguauauuuuccuccc

SEQ ID NO: 107359 - RNA, 32 nt, Human
cccuaaggaguuguuuuucucacuuguuauua

SEQ ID NO: 107360 - RNA, 32 nt, Human
cccuaaggcagugucuccucagcugggcugcu

SEQ ID NO: 107361 - RNA, 32 nt, Human
cccuaaggggucuuugagggcauuuuaggagg

SEQ ID NO: 107362 - RNA, 32 nt, Human
cccuaaguauagaccucugcugcucaucagga

SEQ ID NO: 107363 - RNA, 32 nt, Human
cccuaagucacugaggcuggaguacaguggca

SEQ ID NO: 107364 - RNA, 32 nt, Human
cccuaagucucacuugcugcuacucucaauuu

SEQ ID NO: 107365 - RNA, 23 nt, Human
cccuaagucuccaauauugcagg

SEQ ID NO: 107366 - RNA, 32 nt, Human
cccuaagugacagcuguuacugccugggagag

SEQ ID NO: 107367 - RNA, 32 nt, Human
cccuaaguucaaggccucccuaccuuccccuu

SEQ ID NO: 107368 - RNA, 32 nt, Human
cccuaaguuguucucaggguuuggagaugaug

SEQ ID NO: 107369 - RNA, 32 nt, Human
cccuaauaaaaauacaaaaauuagcugggcau

SEQ ID NO: 107370 - RNA, 32 nt, Human
cccuaauagccucagucucugccuucaguucc

SEQ ID NO: 107371 - RNA, 32 nt, Human
cccuaauccaauaugacugguguccuuauaag

SEQ ID NO: 107372 - RNA, 32 nt, Human
cccuaaucucagaaugcuggaaugaugucugu

SEQ ID NO: 107373 - RNA, 32 nt, Human
cccuaaucuccucugcuuguguccacccacac

SEQ ID NO: 107374 - RNA, 22 nt, Human
cccuaaucugagaagucagccu

SEQ ID NO: 107375 - RNA, 32 nt, Human
cccuaaucugcagccccgccuuugccuacucc

SEQ ID NO: 107376 - RNA, 32 nt, Human
cccuaaucuggcugcauugauggccagauugu

SEQ ID NO: 107377 - RNA, 30 nt, Human
cccuaaugaaacugagugugaaugaggcuc

SEQ ID NO: 107378 - RNA, 32 nt, Human
cccuaaugaagggccuggagguugggguaucu

SEQ ID NO: 107379 - RNA, 32 nt, Human
cccuaaugcgcaggcuggcccugcccugguuu

SEQ ID NO: 107380 - RNA, 32 nt, Human
cccuaauucccugagcuguagauccucuggug

SEQ ID NO: 107381 - RNA, 32 nt, Human
cccuaauucuucuuccuuggucuggaagaaca

SEQ ID NO: 107382 - RNA, 32 nt, Human
cccuaauugauacaacuuuauggcaggguuuu

SEQ ID NO: 107383 - RNA, 32 nt, Human
cccuaauuucugagagaauaaugguuagagaa

SEQ ID NO: 107384 - RNA, 32 nt, Human
cccuacaaagcagaccagccuggggcagauau

SEQ ID NO: 107385 - RNA, 32 nt, Human
cccuacacacucucucugcucuucccaugcaa

SEQ ID NO: 107386 - RNA, 32 nt, Human
cccuacacacuugccauccccuacagcacaga

SEQ ID NO: 107387 - RNA, 32 nt, Human
cccuacaccaacaaagaggaauggcugcaaga

SEQ ID NO: 107388 - RNA, 32 nt, Human
cccuacaccacacccauacucagccccugcag

SEQ ID NO: 107389 - RNA, 19 nt, Human
cccuacaccccuccccugc

SEQ ID NO: 107390 - RNA, 32 nt, Human
cccuacacccucccccuccagggaaugcugag

SEQ ID NO: 107391 - RNA, 24 nt, Human
cccuacacgccgccccccauccuc

SEQ ID NO: 107392 - RNA, 32 nt, Human
cccuacagcagcccccuuccuccaucccucug

SEQ ID NO: 107393 - RNA, 32 nt, Human
cccuacagcaguucaggcugugugguucgcaa

SEQ ID NO: 107394 - RNA, 32 nt, Human
cccuacagccacaaccuccuuuacaguuuuua

SEQ ID NO: 107395 - RNA, 32 nt, Human
cccuacagccucacuuccccagccucaccuug

SEQ ID NO: 107396 - RNA, 32 nt, Human
cccuacagccugaagcaaaccagcagcccagc

SEQ ID NO: 107397 - RNA, 32 nt, Human
cccuacagccuggaagaaggaggguccugauu

SEQ ID NO: 107398 - RNA, 32 nt, Human
cccuacagcugucacuuccaaauguuccugua

SEQ ID NO: 107399 - RNA, 32 nt, Human
cccuacaggcuggcccugcaauggggcccuga

SEQ ID NO: 107400 - RNA, 32 nt, Human
cccuacagggugagacucagcucucaugcagg

SEQ ID NO: 107401 - RNA, 32 nt, Human
cccuacagugaauccuuaccaguguucagucc

SEQ ID NO: 107402 - RNA, 24 nt, Human
cccuacagugagcagcccacacag

SEQ ID NO: 107403 - RNA, 32 nt, Human
cccuacaguguucaaggucacagggucaaaau

SEQ ID NO: 107404 - RNA, 32 nt, Human
cccuacaguuugaacaauuauuuuaauccagc

SEQ ID NO: 107405 - RNA, 32 nt, Human
cccuacaucaggaaggagagcccccugcucaa

SEQ ID NO: 107406 - RNA, 32 nt, Human
cccuacauuuccuccugauuucccaagacucu

SEQ ID NO: 107407 - RNA, 32 nt, Human
cccuaccaaggaccaggaaaagcagcagcugc

SEQ ID NO: 107408 - RNA, 32 nt, Human
cccuaccaaugccccuuuaagugcugcagggg

SEQ ID NO: 107409 - RNA, 32 nt, Human
cccuaccacaaaccaggcuggaacccaagccc

SEQ ID NO: 107410 - RNA, 32 nt, Human
cccuaccacagccaggaggaaaaagcuaggcg

SEQ ID NO: 107411 - RNA, 32 nt, Human
cccuaccacccaggacacuggugugaaugaca

SEQ ID NO: 107412 - RNA, 32 nt, Human
cccuaccagcuccuccagcccugccgggcaca

SEQ ID NO: 107413 - RNA, 32 nt, Human
cccuaccaggcagguucuauggcaaugugggc

SEQ ID NO: 107414 - RNA, 32 nt, Human
cccuaccauauuuuacacauguauuuauaauc

SEQ ID NO: 107415 - RNA, 32 nt, Human
cccuaccaucuugccagcucugucuuuccagc

SEQ ID NO: 107416 - RNA, 32 nt, Human
cccuaccaugagagucagccguaggggacccc

SEQ ID NO: 107417 - RNA, 32 nt, Human
cccuaccccacgauaaucgugaccucacugcc

SEQ ID NO: 107418 - RNA, 18 nt, Human
cccuaccccuaucuacca

SEQ ID NO: 107419 - RNA, 32 nt, Human
cccuaccccugucuccccuucaaggacuucuc

SEQ ID NO: 107420 - RNA, 32 nt, Human
cccuacccuaagcuguagccugggugacugac

SEQ ID NO: 107421 - RNA, 32 nt, Human
cccuacccucagacaaggaacucucuccucuc

SEQ ID NO: 107422 - RNA, 32 nt, Human
cccuacccuccagcacuccaaggcaggacucg

SEQ ID NO: 107423 - RNA, 32 nt, Human
cccuacccuccaggagugggucuggucucauc

SEQ ID NO: 107424 - RNA, 32 nt, Human
cccuacccugcucuccaccccuccacccuaug

SEQ ID NO: 107425 - RNA, 32 nt, Human
cccuacccugggcccaugucugacccugggga

SEQ ID NO: 107426 - RNA, 32 nt, Human
cccuacccuguucuccccugaggccccguucc

SEQ ID NO: 107427 - RNA, 32 nt, Human
cccuacccuuccugccaagccagggacuaagc

SEQ ID NO: 107428 - RNA, 32 nt, Human
cccuaccgcugccauuugggcccuuuaauaaa

SEQ ID NO: 107429 - RNA, 32 nt, Human
cccuaccggcugggauuggccuccuggaagua

SEQ ID NO: 107430 - RNA, 32 nt, Human
cccuaccgguccggccucucuccaguccaucc

SEQ ID NO: 107431 - RNA, 21 nt, Human
cccuaccucacgccugcccca

SEQ ID NO: 107432 - RNA, 32 nt, Human
cccuaccuccagggcauagucagucugggcug

SEQ ID NO: 107433 - RNA, 32 nt, Human
cccuaccucccucccucccuacuuuccuugcu

SEQ ID NO: 107434 - RNA, 32 nt, Human
cccuaccugcaaccaccgcuugccaugguuuc

SEQ ID NO: 107435 - RNA, 32 nt, Human
cccuaccugcaaccucuuccaggcucccuuuu

SEQ ID NO: 107436 - RNA, 32 nt, Human
cccuaccugccuggcuaagacccguggccguc

SEQ ID NO: 107437 - RNA, 32 nt, Human
cccuaccuggagccucaccuccaaggaaauuc

SEQ ID NO: 107438 - RNA, 32 nt, Human
cccuaccuggccucccccuggccucugggccu

SEQ ID NO: 107439 - RNA, 32 nt, Human
cccuaccugggcucuggggaggcugugggccu

SEQ ID NO: 107440 - RNA, 32 nt, Human
cccuaccugucaguucuuguuucuggggagga

SEQ ID NO: 107441 - RNA, 32 nt, Human
cccuaccugucuacccuccuucggaccccuag

SEQ ID NO: 107442 - RNA, 32 nt, Human
cccuaccugugccugacccuacuucuuuugcu

SEQ ID NO: 107443 - RNA, 32 nt, Human
cccuaccuguucuccccuccaggccaccuguc

SEQ ID NO: 107444 - RNA, 32 nt, Human
cccuaccuugcuccauggauuaauuccuucug

SEQ ID NO: 107445 - RNA, 32 nt, Human
cccuacguugcgcugcucaucacagcccgggg

SEQ ID NO: 107446 - RNA, 32 nt, Human
cccuacuaaaaauacaaaaauuagguggacau

SEQ ID NO: 107447 - RNA, 32 nt, Human
cccuacuacccugaacacugccuccccaaaaa

SEQ ID NO: 107448 - RNA, 32 nt, Human
cccuacuacugaacuccaguuuugaucucgug

SEQ ID NO: 107449 - RNA, 32 nt, Human
cccuacuaguaaugcucacugcaguuuauuuu

SEQ ID NO: 107450 - RNA, 32 nt, Human
cccuacucacugguguagccauuauaggcagc

SEQ ID NO: 107451 - RNA, 32 nt, Human
cccuacucagccucuacugaugccucaggaag

SEQ ID NO: 107452 - RNA, 32 nt, Human
cccuacuccagccuggagcucccugagggagc

SEQ ID NO: 107453 - RNA, 25 nt, Human
cccuacuccccaguuuccuggcgau

SEQ ID NO: 107454 - RNA, 32 nt, Human
cccuacucccucccucuccugcacccccuccc

SEQ ID NO: 107455 - RNA, 32 nt, Human
cccuacucuacuggauucaaggccaguaaaug

SEQ ID NO: 107456 - RNA, 21 nt, Human
cccuacucuccaccuuugccu

SEQ ID NO: 107457 - RNA, 32 nt, Human
cccuacucuccuccccuuauucccgaggccca

SEQ ID NO: 107458 - RNA, 32 nt, Human
cccuacucuccucccuugcucccagcagcgga

SEQ ID NO: 107459 - RNA, 32 nt, Human
cccuacucugcagccuuucccaugcucugccc

SEQ ID NO: 107460 - RNA, 32 nt, Human
cccuacucuggcccuccuuaugucacugccuc

SEQ ID NO: 107461 - RNA, 32 nt, Human
cccuacucuguucuguaucacagggaagcuga

SEQ ID NO: 107462 - RNA, 32 nt, Human
cccuacugagagugcagggaacucagcaccgu

SEQ ID NO: 107463 - RNA, 21 nt, Human
cccuacugccaaggauggggc

SEQ ID NO: 107464 - RNA, 32 nt, Human
cccuacugcccaggcuggaauccaagaguggg

SEQ ID NO: 107465 - RNA, 32 nt, Human
cccuacugggagaaaugugugucggagcugca

SEQ ID NO: 107466 - RNA, 32 nt, Human
cccuacugggaggggcgggagggagguguugc

SEQ ID NO: 107467 - RNA, 32 nt, Human
cccuacuguucccacgcuuccucucucucgag

SEQ ID NO: 107468 - RNA, 32 nt, Human
cccuacuuccacugcuuuuuccugcauuuaag

SEQ ID NO: 107469 - RNA, 32 nt, Human
cccuacuucucccucugcauuccacuggcucu

SEQ ID NO: 107470 - RNA, 32 nt, Human
cccuacuuuaagaauuuaauugcucacuuauu

SEQ ID NO: 107471 - RNA, 21 nt, Human
cccuacuuuccucuccugcuu

SEQ ID NO: 107472 - RNA, 32 nt, Human
cccuacuuuuguucuucuauaggcccugggcu

SEQ ID NO: 107473 - RNA, 32 nt, Human
cccuacuuuuucuccgccaccugggccgugau

SEQ ID NO: 107474 - RNA, 32 nt, Human
cccuagaaacaacauacuugucccaugagcag

SEQ ID NO: 107475 - RNA, 23 nt, Human
cccuagaaagaggagugcuagcc

SEQ ID NO: 107476 - RNA, 24 nt, Human
cccuagaaagcugccuccguccag

SEQ ID NO: 107477 - RNA, 32 nt, Human
cccuagaacugccauucccaagaccucugucu

SEQ ID NO: 107478 - RNA, 32 nt, Human
cccuagaagaggagggagggauucuggguggg

SEQ ID NO: 107479 - RNA, 23 nt, Human
cccuagaagcaugaauugcuuca

SEQ ID NO: 107480 - RNA, 32 nt, Human
cccuagaagccaaaugcacugccuuucucugu

SEQ ID NO: 107481 - RNA, 20 nt, Human
cccuagaagccguggaguca

SEQ ID NO: 107482 - RNA, 26 nt, Human
cccuagaagguaaccaccuccuggcu

SEQ ID NO: 107483 - RNA, 28 nt, Human
cccuagaagugcucugccucauucccug

SEQ ID NO: 107484 - RNA, 32 nt, Human
cccuagaauggaaaccucagggccaagggcuc

SEQ ID NO: 107485 - RNA, 32 nt, Human
cccuagacaucuucucccucccuugccucaga

SEQ ID NO: 107486 - RNA, 32 nt, Human
cccuagacaucuucucccucccuugccucagg

SEQ ID NO: 107487 - RNA, 32 nt, Human
cccuagacccuccccaaggaugaccacacccg

SEQ ID NO: 107488 - RNA, 32 nt, Human
cccuagaccuaucuggggacaggcuggcucag

SEQ ID NO: 107489 - RNA, 32 nt, Human
cccuagaccuccauucacucuguuucucuucu

SEQ ID NO: 107490 - RNA, 32 nt, Human
cccuagacuccaaauguccucccagcucaccu

SEQ ID NO: 107491 - RNA, 32 nt, Human
cccuagagacucagaggacccaccugggccaa

SEQ ID NO: 107492 - RNA, 32 nt, Human
cccuagagagcauuaagcacagucucagccac

SEQ ID NO: 107493 - RNA, 32 nt, Human
cccuagagauggggucucgccguguugcacag

SEQ ID NO: 107494 - RNA, 25 nt, Human
cccuagagcggcgacagaagcucuu

SEQ ID NO: 107495 - RNA, 24 nt, Human
cccuagaggcggaguuugcaguga

SEQ ID NO: 107496 - RNA, 32 nt, Human
cccuagaggcggaguuugcagugagccgagau

SEQ ID NO: 107497 - RNA, 32 nt, Human
cccuagaggcugccugcgcaucuggagccugc

SEQ ID NO: 107498 - RNA, 21 nt, Human
cccuagagggcccacuagccc

SEQ ID NO: 107499 - RNA, 24 nt, Human
cccuagaggucgaggcugcaguga

SEQ ID NO: 107500 - RNA, 32 nt, Human
cccuagaggucgaggcugcagugagcuauguu

SEQ ID NO: 107501 - RNA, 24 nt, Human
cccuagagguugaggcugcaguga

SEQ ID NO: 107502 - RNA, 32 nt, Human
cccuagagguugaggcugcagugagcuauguu

SEQ ID NO: 107503 - RNA, 32 nt, Human
cccuagauacagcaguuuauacccacacaccu

SEQ ID NO: 107504 - RNA, 32 nt, Human
cccuagaugaaugagagugagcucuuuucuaa

SEQ ID NO: 107505 - RNA, 32 nt, Human
cccuagauuccuggcaaccuccccuccccuga

SEQ ID NO: 107506 - RNA, 17 nt, Human
cccuagcaaggguccuc

SEQ ID NO: 107507 - RNA, 32 nt, Human
cccuagcacacaguauacacagagccagggcu

SEQ ID NO: 107508 - RNA, 32 nt, Human
cccuagcacacccaugccuccaccucuaugaa

SEQ ID NO: 107509 - RNA, 32 nt, Human
cccuagcacccugcaggugaauauccaauguu

SEQ ID NO: 107510 - RNA, 32 nt, Human
cccuagcacgcgccccagccccagagcagggu

SEQ ID NO: 107511 - RNA, 32 nt, Human
cccuagcagggaccccagcgcccgagagacca

SEQ ID NO: 107512 - RNA, 32 nt, Human
cccuagccaagaaggagaagaaagagccuuga

SEQ ID NO: 107513 - RNA, 32 nt, Human
cccuagccaaugucuccuccccuucccccacc

SEQ ID NO: 107514 - RNA, 32 nt, Human
cccuagccacuggccccucccuguuucaugua

SEQ ID NO: 107515 - RNA, 32 nt, Human
cccuagccaugaaaggaaacaggggugcggcu

SEQ ID NO: 107516 - RNA, 32 nt, Human
cccuagccccuucccuccuccuggggccucca

SEQ ID NO: 107517 - RNA, 32 nt, Human
cccuagcccggcuguggcuccaccuccagcuc

SEQ ID NO: 107518 - RNA, 32 nt, Human
cccuagcccuaucuccuacauggcaggagcau

SEQ ID NO: 107519 - RNA, 32 nt, Human
cccuagcccucagugccuccccucaacuuucc

SEQ ID NO: 107520 - RNA, 22 nt, Human
cccuagcccuucucagcaggaa

SEQ ID NO: 107521 - RNA, 19 nt, Human
cccuagcccuuuagccuuu

SEQ ID NO: 107522 - RNA, 32 nt, Human
cccuagccucagauggcucugccaccagccag

SEQ ID NO: 107523 - RNA, 32 nt, Human
cccuagccuccaccauccccgcacaaagcggc

SEQ ID NO: 107524 - RNA, 32 nt, Human
cccuagccugccuccccugccucaccagcccu

SEQ ID NO: 107525 - RNA, 20 nt, Human
cccuagccugggcaacagag

SEQ ID NO: 107526 - RNA, 32 nt, Human
cccuagcgauccagcccuccccuggacccuag

SEQ ID NO: 107527 - RNA, 32 nt, Human
cccuagcgcuaucucccugccuccugccggcu

SEQ ID NO: 107528 - RNA, 32 nt, Human
cccuagcgcucccgcgcugcugcuccagccgc

SEQ ID NO: 107529 - RNA, 32 nt, Human
cccuagcuaccacugccuccaggcuacugccc

SEQ ID NO: 107530 - RNA, 32 nt, Human
cccuagcucaccuccuacuguaaagagaaugc

SEQ ID NO: 107531 - RNA, 32 nt, Human
cccuagcucacugcaaccuccaacugcugggc

SEQ ID NO: 107532 - RNA, 24 nt, Human
cccuagcucccaccgccaccgccg

SEQ ID NO: 107533 - RNA, 19 nt, Human
cccuagcucccuccacuug

SEQ ID NO: 107534 - RNA, 18 nt, Human
cccuagcucucccggggu

SEQ ID NO: 107535 - RNA, 32 nt, Human
cccuagcucuucuacuacggaggggaacugca

SEQ ID NO: 107536 - RNA, 32 nt, Human
cccuagcugcauuucaguggaccauggauaga

SEQ ID NO: 107537 - RNA, 32 nt, Human
cccuagcuuccguguuccuugccuugugaguu

SEQ ID NO: 107538 - RNA, 32 nt, Human
cccuaggaaaaugggcaccugccaccauccug

SEQ ID NO: 107539 - RNA, 32 nt, Human
cccuaggaaagcagccucucuccgcuguccca

SEQ ID NO: 107540 - RNA, 32 nt, Human
cccuaggaaggagccaggggccaugguggggg

SEQ ID NO: 107541 - RNA, 32 nt, Human
cccuaggaccauugaacacccacugccgggga

SEQ ID NO: 107542 - RNA, 32 nt, Human
cccuaggagaguucuuuggggugacuuucaag

SEQ ID NO: 107543 - RNA, 25 nt, Human
cccuaggagggccaggaacugcuga

SEQ ID NO: 107544 - RNA, 19 nt, Human
cccuaggagguauaauaua

SEQ ID NO: 107545 - RNA, 32 nt, Human
cccuaggauuuuccuucccugcccucaccugc

SEQ ID NO: 107546 - RNA, 32 nt, Human
cccuaggcaacaaccaucacccucccuccuua

SEQ ID NO: 107547 - RNA, 19 nt, Human
cccuaggccagcacagccu

SEQ ID NO: 107548 - RNA, 32 nt, Human
cccuaggccagccugggauaagagucccacag

SEQ ID NO: 107549 - RNA, 32 nt, Human
cccuaggccaggccuggugagugacagcagcc

SEQ ID NO: 107550 - RNA, 32 nt, Human
cccuaggccauggagaaaaccuuaaacaaacc

SEQ ID NO: 107551 - RNA, 32 nt, Human
cccuaggcccucauccuaccuaggacugaggc

SEQ ID NO: 107552 - RNA, 32 nt, Human
cccuaggcccuuuucagacuccugggcccuug

SEQ ID NO: 107553 - RNA, 32 nt, Human
cccuaggccgucacaccacacccuccauuucc

SEQ ID NO: 107554 - RNA, 32 nt, Human
cccuaggccuggcuccuucuguugacauggga

SEQ ID NO: 107555 - RNA, 32 nt, Human
cccuaggccuuccugaugcgcuugccugcucc

SEQ ID NO: 107556 - RNA, 32 nt, Human
cccuaggcuauacaagucucagucuaggggaa

SEQ ID NO: 107557 - RNA, 32 nt, Human
cccuaggcucaagcaauccuuccaccucaguc

SEQ ID NO: 107558 - RNA, 23 nt, Human
cccuaggcuuaccccuccugccu

SEQ ID NO: 107559 - RNA, 23 nt, Human
cccuagggaccgcggggcagccc

SEQ ID NO: 107560 - RNA, 29 nt, Human
cccuagggcauaaggauuaucauugcuaa

SEQ ID NO: 107561 - RNA, 27 nt, Human
cccuagggccaagcccacccaccagcc

SEQ ID NO: 107562 - RNA, 32 nt, Human
cccuagggccacucccaccugcaggacauuaa

SEQ ID NO: 107563 - RNA, 28 nt, Human
cccuagggcccaccccacccaccagccc

SEQ ID NO: 107564 - RNA, 27 nt, Human
cccuagggccccaccacucaccagccc

SEQ ID NO: 107565 - RNA, 21 nt, Human
cccuagggccccugccugccu

SEQ ID NO: 107566 - RNA, 29 nt, Human
cccuagggccucacucacccagccagccc

SEQ ID NO: 107567 - RNA, 32 nt, Human
cccuagggccuggguggcaggggguggguggc

SEQ ID NO: 107568 - RNA, 32 nt, Human
cccuagggcgacaggagccagcgggacgccgc

SEQ ID NO: 107569 - RNA, 22 nt, Human
cccuaggggcuccugccugccc

SEQ ID NO: 107570 - RNA, 32 nt, Human
cccuagggggagaagaagccgagagccuuuug

SEQ ID NO: 107571 - RNA, 32 nt, Human
cccuaggguaaucacuuugaucaacaugacga

SEQ ID NO: 107572 - RNA, 32 nt, Human
cccuagggugagaagaggcugagagagaaggg

SEQ ID NO: 107573 - RNA, 32 nt, Human
cccuaggugauuucucaagcuccuugggggac

SEQ ID NO: 107574 - RNA, 32 nt, Human
cccuaggugccuguaggcuaugguacuucuuc

SEQ ID NO: 107575 - RNA, 24 nt, Human
cccuagguuucugccuccucguuu

SEQ ID NO: 107576 - RNA, 32 nt, Human
cccuaguaaaaaugcaaaaauuagcugggugu

SEQ ID NO: 107577 - RNA, 32 nt, Human
cccuaguacaucuuacagcuuuccccuuccau

SEQ ID NO: 107578 - RNA, 24 nt, Human
cccuaguagcugggacuacaggca

SEQ ID NO: 107579 - RNA, 24 nt, Human
cccuaguagcugggauuacaggca

SEQ ID NO: 107580 - RNA, 31 nt, Human
cccuaguaucuucagcacaugcucacuguuc

SEQ ID NO: 107581 - RNA, 31 nt, Human
cccuaguaucuucagcacaugcucacuguuu

SEQ ID NO: 107582 - RNA, 29 nt, Human
cccuagucaacagcagaccagccuggcca

SEQ ID NO: 107583 - RNA, 32 nt, Human
cccuagucauagccugucauuugcuacuuuug

SEQ ID NO: 107584 - RNA, 32 nt, Human
cccuagucaugcggaacaacauagucuaaaaa

SEQ ID NO: 107585 - RNA, 32 nt, Human
cccuaguccuaggcgacuugaauaaaguggga

SEQ ID NO: 107586 - RNA, 32 nt, Human
cccuagugaggagcugaacuugcucaaucuaa

SEQ ID NO: 107587 - RNA, 32 nt, Human
cccuagugaggagcugaacuugcucagucuaa

SEQ ID NO: 107588 - RNA, 32 nt, Human
cccuagugaggggaggagagagaacccauccu

SEQ ID NO: 107589 - RNA, 32 nt, Human
cccuagugcccaaggcagggacccugggccug

SEQ ID NO: 107590 - RNA, 25 nt, Human
cccuagugcgagguuaaaaccuuca

SEQ ID NO: 107591 - RNA, 32 nt, Human
cccuaguuaguacucggacuccugugcuaauu

SEQ ID NO: 107592 - RNA, 32 nt, Human
cccuaguuccacugcacauggcccuccucccc

SEQ ID NO: 107593 - RNA, 32 nt, Human
cccuaguucccaaagggagcagggagauggga

SEQ ID NO: 107594 - RNA, 32 nt, Human
cccuaguucccucugcucagccaagcuuguua

SEQ ID NO: 107595 - RNA, 32 nt, Human
cccuaguugugggcaacacaugcagaauaauc

SEQ ID NO: 107596 - RNA, 32 nt, Human
cccuaguuugcuccugagcgcuucguuccucu

SEQ ID NO: 107597 - RNA, 32 nt, Human
cccuauaaaccugaccuccuuuaugguuaaua

SEQ ID NO: 107598 - RNA, 32 nt, Human
cccuauacagugcccugcccacccuuaucugc

SEQ ID NO: 107599 - RNA, 22 nt, Human
cccuauaccccuacacaggggc

SEQ ID NO: 107600 - RNA, 32 nt, Human
cccuauacccuaacucacuccaccccauuuuc

SEQ ID NO: 107601 - RNA, 18 nt, Human
cccuauagcagggccaug

SEQ ID NO: 107602 - RNA, 32 nt, Human
cccuauaucuugcauccggagcugcagccaug

SEQ ID NO: 107603 - RNA, 32 nt, Human
cccuaucaaaauaccauugucauuuuucacag

SEQ ID NO: 107604 - RNA, 32 nt, Human
cccuaucaguuagaacugcaggccaguuccaa

SEQ ID NO: 107605 - RNA, 32 nt, Human
cccuaucaugcccggugcccaggcuggggccg

SEQ ID NO: 107606 - RNA, 32 nt, Human
cccuaucccagagaccuugaugcuuggccucc

SEQ ID NO: 107607 - RNA, 32 nt, Human
cccuaucccugggaagccaugagaccucaaac

SEQ ID NO: 107608 - RNA, 22 nt, Human
cccuaucccuugcauccacuug

SEQ ID NO: 107609 - RNA, 32 nt, Human
cccuauccgccccucacuuacccuuaaacagg

SEQ ID NO: 107610 - RNA, 32 nt, Human
cccuauccugcuuccccacauuucuguuccuc

SEQ ID NO: 107611 - RNA, 17 nt, Human
cccuaucuccacucccu

SEQ ID NO: 107612 - RNA, 18 nt, Human
cccuaucuccacuccuug

SEQ ID NO: 107613 - RNA, 32 nt, Human
cccuaucucucuccccgcuccccagccucggg

SEQ ID NO: 107614 - RNA, 19 nt, Human
cccuaucuggauucuacuu

SEQ ID NO: 107615 - RNA, 32 nt, Human
cccuaucuggcaguccugcuuugcuacuugcu

SEQ ID NO: 107616 - RNA, 19 nt, Human
cccuaucuuagaacacuca

SEQ ID NO: 107617 - RNA, 19 nt, Human
cccuaucuuagugcaccug

SEQ ID NO: 107618 - RNA, 21 nt, Human
cccuaucuuccccuccaccug

SEQ ID NO: 107619 - RNA, 32 nt, Human
cccuaucuuguccuagcccaggccuccaugaa

SEQ ID NO: 107620 - RNA, 32 nt, Human
cccuaugaauacugguuaacauggacagugca

SEQ ID NO: 107621 - RNA, 32 nt, Human
cccuaugaauguaaagaguguggggaagcuuu

SEQ ID NO: 107622 - RNA, 32 nt, Human
cccuaugagggaggcagaaauggagggguccc

SEQ ID NO: 107623 - RNA, 32 nt, Human
cccuaugcugggaaagugaggauuugggauuu

SEQ ID NO: 107624 - RNA, 32 nt, Human
cccuaugcuuccggccuccugucccucaucca

SEQ ID NO: 107625 - RNA, 32 nt, Human
cccuauggaagcuuagucacaagaggcacuag

SEQ ID NO: 107626 - RNA, 32 nt, Human
cccuauggaggaacaacucuccagugccugga

SEQ ID NO: 107627 - RNA, 31 nt, Human
cccuauggcaaagucucugccaacacuccuc

SEQ ID NO: 107628 - RNA, 32 nt, Human
cccuaugggagcaagggcugaccugugacugu

SEQ ID NO: 107629 - RNA, 32 nt, Human
cccuaugggaggcagagcggcaaggacagggc

SEQ ID NO: 107630 - RNA, 32 nt, Human
cccuauggugcucagcccugagauccugcaca

SEQ ID NO: 107631 - RNA, 32 nt, Human
cccuauguaguuuuuaaaacacuggcaaugac

SEQ ID NO: 107632 - RNA, 32 nt, Human
cccuaugucaagugcuuuaucucuuuuggaga

SEQ ID NO: 107633 - RNA, 32 nt, Human
cccuaugucacccaggcuguggugcaguaagc

SEQ ID NO: 107634 - RNA, 32 nt, Human
cccuauguugcccaggcuggccucaaauuccu

SEQ ID NO: 107635 - RNA, 32 nt, Human
cccuauguugcccaggcuggucucaaacuccu

SEQ ID NO: 107636 - RNA, 32 nt, Human
cccuauguugcccaggcuggucuccaacaccu

SEQ ID NO: 107637 - RNA, 27 nt, Human
cccuauuacauacaucuuucaaugucc

SEQ ID NO: 107638 - RNA, 32 nt, Human
cccuauuacugcuaguaugcuacuucuuacau

SEQ ID NO: 107639 - RNA, 32 nt, Human
cccuauuagacuguaagccucucgagggugag

SEQ ID NO: 107640 - RNA, 32 nt, Human
cccuauucagaauuaaaccucacugcaaauuu

SEQ ID NO: 107641 - RNA, 32 nt, Human
cccuauucccagaggcagguggugcugacccu

SEQ ID NO: 107642 - RNA, 32 nt, Human
cccuauuccuaaggacuccugaugucaucuca

SEQ ID NO: 107643 - RNA, 18 nt, Human
cccuauuccucccacuaa

SEQ ID NO: 107644 - RNA, 32 nt, Human
cccuauuccuccuuuucccuccuuccucccac

SEQ ID NO: 107645 - RNA, 32 nt, Human
cccuauucucucuuuacgcuuaguuaucagcu

SEQ ID NO: 107646 - RNA, 32 nt, Human
cccuauugccaugaccuuccucacaucucuuu

SEQ ID NO: 107647 - RNA, 32 nt, Human
cccuauugcccaggcuggagugcaauggcgug

SEQ ID NO: 107648 - RNA, 32 nt, Human
cccuauugccuucugcagcuucaaguccguug

SEQ ID NO: 107649 - RNA, 32 nt, Human
cccuauuguccugccacaucucccucuccgag

SEQ ID NO: 107650 - RNA, 32 nt, Human
cccuauuuagccaaaggaaggaggucagggga

SEQ ID NO: 107651 - RNA, 24 nt, Human
cccuauuuccuucuccuccugucu

SEQ ID NO: 107652 - RNA, 32 nt, Human
cccuauuucuucucucacuagcagcuauacaa

SEQ ID NO: 107653 - RNA, 32 nt, Human
cccuauuugaagacgucuuuuguaaaagcuag

SEQ ID NO: 107654 - RNA, 32 nt, Human
cccuauuugcaaucauauucucccucugcuuc

SEQ ID NO: 107655 - RNA, 32 nt, Human
cccuauuuugcacaugagaaauccaaaauuca

SEQ ID NO: 107656 - RNA, 32 nt, Human
cccucaaacccauucccucuccaggagaccua

SEQ ID NO: 107657 - RNA, 24 nt, Human
cccucaaaccccagcccaggccgg

SEQ ID NO: 107658 - RNA, 32 nt, Human
cccucaaacuaacaccccacacugcuuuggga

SEQ ID NO: 107659 - RNA, 32 nt, Human
cccucaaagagggggugaaggaagggcaccug

SEQ ID NO: 107660 - RNA, 32 nt, Human
cccucaaaucacccucucccguagcccacccg

SEQ ID NO: 107661 - RNA, 32 nt, Human
cccucaaaucagaugccucuaaggacuuuccu

SEQ ID NO: 107662 - RNA, 27 nt, Human
cccucaaaucguccuuuaagucuuccu

SEQ ID NO: 107663 - RNA, 20 nt, Human
cccucaacaccacccucaca

SEQ ID NO: 107664 - RNA, 32 nt, Human
cccucaacaccacccucacacacuggcuccag

SEQ ID NO: 107665 - RNA, 32 nt, Human
cccucaaccauccugccaaugcccaggaacau

SEQ ID NO: 107666 - RNA, 32 nt, Human
cccucaaccuccugggcucaagcaauccuccu

SEQ ID NO: 107667 - RNA, 32 nt, Human
cccucaaccuccuggguucaagcaauccuccu

SEQ ID NO: 107668 - RNA, 32 nt, Human
cccucaaccuucaccaaacacuacccaugggg

SEQ ID NO: 107669 - RNA, 32 nt, Human
cccucaacucauuccaaccacauugauucagu

SEQ ID NO: 107670 - RNA, 19 nt, Human
cccucaacuuccugcugcu

SEQ ID NO: 107671 - RNA, 32 nt, Human
cccucaagaaugagacaggaagugcagaggaa

SEQ ID NO: 107672 - RNA, 32 nt, Human
cccucaagagcccacuguaugcuggggaaaug

SEQ ID NO: 107673 - RNA, 32 nt, Human
cccucaagagugugggugagacauauacagcc

SEQ ID NO: 107674 - RNA, 32 nt, Human
cccucaagcauccugauuuguucguucucucu

SEQ ID NO: 107675 - RNA, 32 nt, Human
cccucaagccagccacaguccccgccaggccg

SEQ ID NO: 107676 - RNA, 19 nt, Human
cccucaagccuucugcucc

SEQ ID NO: 107677 - RNA, 32 nt, Human
cccucaagcugcaguaaagcccaggacugaau

SEQ ID NO: 107678 - RNA, 32 nt, Human
cccucaaggacaggcuguagcccucauaccca

SEQ ID NO: 107679 - RNA, 18 nt, Human
cccucaaggcaagauaag

SEQ ID NO: 107680 - RNA, 20 nt, Human
cccucaaggccucugcugcc

SEQ ID NO: 107681 - RNA, 32 nt, Human
cccucaagggcugaggccgaggauggaugccc

SEQ ID NO: 107682 - RNA, 31 nt, Human
cccucaagugagagaagacuguucugaacac

SEQ ID NO: 107683 - RNA, 31 nt, Human
cccucaaguguaaccaucacaagauaaggcc

SEQ ID NO: 107684 - RNA, 32 nt, Human
cccucaaguuugcuaagcugcugguuuauuac

SEQ ID NO: 107685 - RNA, 22 nt, Human
cccucaauaaaaccccacgucu

SEQ ID NO: 107686 - RNA, 31 nt, Human
cccucaauaaauaaauauugaaugaaugaaa

SEQ ID NO: 107687 - RNA, 32 nt, Human
cccucaaucccagcuacucaagaggcugaggc

SEQ ID NO: 107688 - RNA, 32 nt, Human
cccucaaugccacccugaccccacggcuggag

SEQ ID NO: 107689 - RNA, 32 nt, Human
cccucaauguugcugaccucaucugaggggcu

SEQ ID NO: 107690 - RNA, 32 nt, Human
cccucaauguugcugaccucaucugggggcug

SEQ ID NO: 107691 - RNA, 32 nt, Human
cccucacaaaccggggcuuuggggaagccaug

SEQ ID NO: 107692 - RNA, 32 nt, Human
cccucacaaccugagcugcuugaggacaaggg

SEQ ID NO: 107693 - RNA, 32 nt, Human
cccucacacaccgccucagcccgcaccggcag

SEQ ID NO: 107694 - RNA, 32 nt, Human
cccucacacccacuccccgauaaggcaugcua

SEQ ID NO: 107695 - RNA, 32 nt, Human
cccucacaccgcugcuccucuggaccucuguc

SEQ ID NO: 107696 - RNA, 20 nt, Human
cccucacaccuccugcugcc

SEQ ID NO: 107697 - RNA, 32 nt, Human
cccucacagagcacgcagccuagaugcagaga

SEQ ID NO: 107698 - RNA, 32 nt, Human
cccucacagcccucagcucuacucccggucac

SEQ ID NO: 107699 - RNA, 32 nt, Human
cccucacagccuugcuucucucagccuagguu

SEQ ID NO: 107700 - RNA, 22 nt, Human
cccucacaggcuuggggguuuu

SEQ ID NO: 107701 - RNA, 32 nt, Human
cccucacagggaggggagcaggggagggaaag

SEQ ID NO: 107702 - RNA, 22 nt, Human
cccucacaucagggaaaaugac

SEQ ID NO: 107703 - RNA, 21 nt, Human
cccucacaucuuccaccagca

SEQ ID NO: 107704 - RNA, 32 nt, Human
cccucaccaacuugggaggcucagccucgucc

SEQ ID NO: 107705 - RNA, 32 nt, Human
cccucaccacaggagcgugagccacuucugca

SEQ ID NO: 107706 - RNA, 17 nt, Human
cccucaccacaguucug

SEQ ID NO: 107707 - RNA, 16 nt, Human
cccucaccacccagga

SEQ ID NO: 107708 - RNA, 16 nt, Human
cccucaccaccuccca

SEQ ID NO: 107709 - RNA, 19 nt, Human
cccucaccaccugcccggc

SEQ ID NO: 107710 - RNA, 32 nt, Human
cccucaccagccucaccccuguggugggcuuu

SEQ ID NO: 107711 - RNA, 32 nt, Human
cccucaccaggaugugaccuugggcagaugac

SEQ ID NO: 107712 - RNA, 32 nt, Human
cccucaccaguggaggcuggguagugcuggcc

SEQ ID NO: 107713 - RNA, 32 nt, Human
cccucacccacaucugccugaagagcuuuaaa

SEQ ID NO: 107714 - RNA, 19 nt, Human
cccucacccacucuggugg

SEQ ID NO: 107715 - RNA, 32 nt, Human
cccucacccaggcacugggcaagugaagaguu

SEQ ID NO: 107716 - RNA, 32 nt, Human
cccucacccaggcugcagugccaugcagacac

SEQ ID NO: 107717 - RNA, 20 nt, Human
cccucaccccaaccccagca

SEQ ID NO: 107718 - RNA, 19 nt, Human
cccucaccccagccaggca

SEQ ID NO: 107719 - RNA, 32 nt, Human
cccucaccccagccccuuccccuagacccacu

SEQ ID NO: 107720 - RNA, 21 nt, Human
cccucaccccauccuucccca

SEQ ID NO: 107721 - RNA, 22 nt, Human
cccucacccccacccccagggu

SEQ ID NO: 107722 - RNA, 18 nt, Human
cccucacccccacuggcc

SEQ ID NO: 107723 - RNA, 19 nt, Human
cccucaccccggccaaccc

SEQ ID NO: 107724 - RNA, 23 nt, Human
cccucaccccguugcucaauucc

SEQ ID NO: 107725 - RNA, 21 nt, Human
cccucaccccucaccauccuu

SEQ ID NO: 107726 - RNA, 19 nt, Human
cccucaccccuccaauccc

SEQ ID NO: 107727 - RNA, 17 nt, Human
cccucaccccucuccca

SEQ ID NO: 107728 - RNA, 17 nt, Human
cccucaccccugccuca

SEQ ID NO: 107729 - RNA, 20 nt, Human
cccucacccgucucgauccc

SEQ ID NO: 107730 - RNA, 32 nt, Human
cccucacccugagccccuuccuugcucugcac

SEQ ID NO: 107731 - RNA, 21 nt, Human
cccucacccugcccagccccu

SEQ ID NO: 107732 - RNA, 32 nt, Human
cccucaccgcaggcagcaguuugcauuuugaa

SEQ ID NO: 107733 - RNA, 16 nt, Human
cccucaccgccugcca

SEQ ID NO: 107734 - RNA, 32 nt, Human
cccucaccgcuauuuucaacauuuccucaauc

SEQ ID NO: 107735 - RNA, 17 nt, Human
cccucaccguccaggug

SEQ ID NO: 107736 - RNA, 19 nt, Human
cccucaccuaccccuccca

SEQ ID NO: 107737 - RNA, 32 nt, Human
cccucaccucaccugcuuucuucauggcaugu

SEQ ID NO: 107738 - RNA, 32 nt, Human
cccucaccuccacccccuccugucaccggccu

SEQ ID NO: 107739 - RNA, 32 nt, Human
cccucaccuccagggccugggacugcuccuuc

SEQ ID NO: 107740 - RNA, 25 nt, Human
cccucaccucuggccucucaucccu

SEQ ID NO: 107741 - RNA, 32 nt, Human
cccucaccugacuucaggguauggggagggag

SEQ ID NO: 107742 - RNA, 32 nt, Human
cccucaccugaugaucccaacacuucaucauc

SEQ ID NO: 107743 - RNA, 23 nt, Human
cccucaccugcauaccaaccccu

SEQ ID NO: 107744 - RNA, 21 nt, Human
cccucaccugccugggaccug

SEQ ID NO: 107745 - RNA, 19 nt, Human
cccucaccuuccuucugcc

SEQ ID NO: 107746 - RNA, 32 nt, Human
cccucaccuucucuccccaaugcacugggcug

SEQ ID NO: 107747 - RNA, 16 nt, Human
cccucaccuugcugcc

SEQ ID NO: 107748 - RNA, 32 nt, Human
cccucacgaaguccucaaguccuggccccucu

SEQ ID NO: 107749 - RNA, 32 nt, Human
cccucacguuucuuccccaaccccucagauuu

SEQ ID NO: 107750 - RNA, 32 nt, Human
cccucacucccagauccugcaggaggcgugag

SEQ ID NO: 107751 - RNA, 23 nt, Human
cccucacucccauuuccuagcaa

SEQ ID NO: 107752 - RNA, 32 nt, Human
cccucacuccuccccuccuucgcucgcucaac

SEQ ID NO: 107753 - RNA, 32 nt, Human
cccucacuccugccaugugccugcacucccag

SEQ ID NO: 107754 - RNA, 32 nt, Human
cccucacuccugccauuucuccccucucuucc

SEQ ID NO: 107755 - RNA, 32 nt, Human
cccucacuccugcccacgccucccagacccca

SEQ ID NO: 107756 - RNA, 32 nt, Human
cccucacuccuucuucugacccuuaaucuacc

SEQ ID NO: 107757 - RNA, 32 nt, Human
cccucacugaaaccagguggccggcuccucgg

SEQ ID NO: 107758 - RNA, 32 nt, Human
cccucacugaagaagcagauugccaagugcca

SEQ ID NO: 107759 - RNA, 32 nt, Human
cccucacugaaugccucaaugugaccaggggu

SEQ ID NO: 107760 - RNA, 32 nt, Human
cccucacugaccaggccccaagccacuaaggc

SEQ ID NO: 107761 - RNA, 32 nt, Human
cccucacugcagcugccagcacuuggucaguc

SEQ ID NO: 107762 - RNA, 16 nt, Human
cccucacugccuucca

SEQ ID NO: 107763 - RNA, 32 nt, Human
cccucacugcugucucugccuccuuucugcug

SEQ ID NO: 107764 - RNA, 32 nt, Human
cccucacuguccuccagcccaggaugggccag

SEQ ID NO: 107765 - RNA, 32 nt, Human
cccucacuguggcuagcuucugggcaaguccc

SEQ ID NO: 107766 - RNA, 32 nt, Human
cccucacuucccacuuuccuuuccuccaaugg

SEQ ID NO: 107767 - RNA, 32 nt, Human
cccucacuuccuuuagggcaaauaacacagca

SEQ ID NO: 107768 - RNA, 32 nt, Human
cccucacuucuuucaguuccucaaggacuccc

SEQ ID NO: 107769 - RNA, 32 nt, Human
cccucacuugccgcgucgcccucccaggcucu

SEQ ID NO: 107770 - RNA, 32 nt, Human
cccucacuuucuuccucucuccuuccuuuccu

SEQ ID NO: 107771 - RNA, 32 nt, Human
cccucagaagacacccagacacugggagugcu

SEQ ID NO: 107772 - RNA, 32 nt, Human
cccucagagaagacaggaggucgggaaggacc

SEQ ID NO: 107773 - RNA, 32 nt, Human
cccucagagcccaugguaacgaaccccuagaa

SEQ ID NO: 107774 - RNA, 32 nt, Human
cccucagagccccugaggggcccuggguaugg

SEQ ID NO: 107775 - RNA, 32 nt, Human
cccucagaggccauagaacagaaacggaaaac

SEQ ID NO: 107776 - RNA, 32 nt, Human
cccucagaucccuuggcucugccagaaucagu

SEQ ID NO: 107777 - RNA, 20 nt, Human
cccucagaugcaaugggaac

SEQ ID NO: 107778 - RNA, 22 nt, Human
cccucagcaaacaccaaagaau

SEQ ID NO: 107779 - RNA, 18 nt, Human
cccucagcaaagaguaga

SEQ ID NO: 107780 - RNA, 32 nt, Human
cccucagcaagaacagccugccugguggccuu

SEQ ID NO: 107781 - RNA, 32 nt, Human
cccucagcacacacaucugcacacacgcagcu

SEQ ID NO: 107782 - RNA, 32 nt, Human
cccucagcacagcucaggccucaggccugaca

SEQ ID NO: 107783 - RNA, 32 nt, Human
cccucagcacuaaccacauccacucucaaccc

SEQ ID NO: 107784 - RNA, 32 nt, Human
cccucagcacugggguggaggcggcaggaagg

SEQ ID NO: 107785 - RNA, 32 nt, Human
cccucagcagccgccuugcugcguggacagca

SEQ ID NO: 107786 - RNA, 19 nt, Human
cccucagcaggagcugggg

SEQ ID NO: 107787 - RNA, 32 nt, Human
cccucagcagggaugacucagcagggaugacu

SEQ ID NO: 107788 - RNA, 32 nt, Human
cccucagcagggauggcucagcagggaugacu

SEQ ID NO: 107789 - RNA, 19 nt, Human
cccucagcaguccugaccu

SEQ ID NO: 107790 - RNA, 32 nt, Human
cccucagcaucuucccgcugagaguggugggg

SEQ ID NO: 107791 - RNA, 22 nt, Human
cccucagcauuuggaggggaac

SEQ ID NO: 107792 - RNA, 32 nt, Human
cccucagccaagcacuuagaacugaguaaaug

SEQ ID NO: 107793 - RNA, 32 nt, Human
cccucagccacaauuuggcagaaggauggagu

SEQ ID NO: 107794 - RNA, 32 nt, Human
cccucagccagcccuguaaggccagcccaaca

SEQ ID NO: 107795 - RNA, 18 nt, Human
cccucagccagccugccu

SEQ ID NO: 107796 - RNA, 32 nt, Human
cccucagccagccugccugcccagcgaggccc

SEQ ID NO: 107797 - RNA, 32 nt, Human
cccucagccagcugccauuagcuuggcucuua

SEQ ID NO: 107798 - RNA, 32 nt, Human
cccucagccaggcaggguugcagcugagggcc

SEQ ID NO: 107799 - RNA, 21 nt, Human
cccucagcccacuccgcgccg

SEQ ID NO: 107800 - RNA, 16 nt, Human
cccucagcccccaggg

SEQ ID NO: 107801 - RNA, 18 nt, Human
cccucagcccccucgcuu

SEQ ID NO: 107802 - RNA, 22 nt, Human
cccucagccccuccggcguguc

SEQ ID NO: 107803 - RNA, 32 nt, Human
cccucagccccuccuguacaagauggucaagc

SEQ ID NO: 107804 - RNA, 32 nt, Human
cccucagccccuggcagugauccggaguuggc

SEQ ID NO: 107805 - RNA, 18 nt, Human
cccucagcccgcccuccc

SEQ ID NO: 107806 - RNA, 32 nt, Human
cccucagcccggcccuggccccuucccgaccc

SEQ ID NO: 107807 - RNA, 32 nt, Human
cccucagcccuccaccuccggcgggggcgagg

SEQ ID NO: 107808 - RNA, 22 nt, Human
cccucagccgacagucucagcc

SEQ ID NO: 107809 - RNA, 19 nt, Human
cccucagccgcucucugcc

SEQ ID NO: 107810 - RNA, 32 nt, Human
cccucagccgcucuuugcuccagaccugcccc

SEQ ID NO: 107811 - RNA, 32 nt, Human
cccucagccggugaacccucucucccaucacc

SEQ ID NO: 107812 - RNA, 32 nt, Human
cccucagccuccugaugcuguugcagggcagg

SEQ ID NO: 107813 - RNA, 17 nt, Human
cccucagccucuccuca

SEQ ID NO: 107814 - RNA, 32 nt, Human
cccucagccugcccgccucucccugcauccug

SEQ ID NO: 107815 - RNA, 32 nt, Human
cccucagccuggggcucccugagucagggcug

SEQ ID NO: 107816 - RNA, 17 nt, Human
cccucagcggaugauaa

SEQ ID NO: 107817 - RNA, 18 nt, Human
cccucagcguacccgccu

SEQ ID NO: 107818 - RNA, 17 nt, Human
cccucagcguccucccu

SEQ ID NO: 107819 - RNA, 32 nt, Human
cccucagcucacccuucagccuguuccuucuu

SEQ ID NO: 107820 - RNA, 32 nt, Human
cccucagcucccagcuccaccucugggguuca

SEQ ID NO: 107821 - RNA, 24 nt, Human
cccucagcucuccugcuuugugcc

SEQ ID NO: 107822 - RNA, 23 nt, Human
cccucagcucugccucugcagcc

SEQ ID NO: 107823 - RNA, 18 nt, Human
cccucagcuggcccugcc

SEQ ID NO: 107824 - RNA, 32 nt, Human
cccucagcuggucgccaccccugggccuuucc

SEQ ID NO: 107825 - RNA, 20 nt, Human
cccucagcuucucucugccu

SEQ ID NO: 107826 - RNA, 20 nt, Human
cccucagcuuggacaggaac

SEQ ID NO: 107827 - RNA, 32 nt, Human
cccucaggagcaccugaagcaaauauuuaucc

SEQ ID NO: 107828 - RNA, 32 nt, Human
cccucaggagccugggcugcgaggcuccauag

SEQ ID NO: 107829 - RNA, 21 nt, Human
cccucaggaguggcccgaacc

SEQ ID NO: 107830 - RNA, 32 nt, Human
cccucaggcaccuuuccuccccuggacaccca

SEQ ID NO: 107831 - RNA, 32 nt, Human
cccucaggccccagggcaggcaggcugcaggg

SEQ ID NO: 107832 - RNA, 32 nt, Human
cccucaggccuaugaaacacacaggguucuag

SEQ ID NO: 107833 - RNA, 32 nt, Human
cccucaggccuccuuuccuuguggcuccagga

SEQ ID NO: 107834 - RNA, 32 nt, Human
cccucaggccucucuucuuauccaaauaaaug

SEQ ID NO: 107835 - RNA, 32 nt, Human
cccucaggccugaugucagcaaagccaguaac

SEQ ID NO: 107836 - RNA, 32 nt, Human
cccucaggcguccaucugaugcaugggaccaa

SEQ ID NO: 107837 - RNA, 32 nt, Human
cccucaggcugaggcaggagggucacuugacc

SEQ ID NO: 107838 - RNA, 32 nt, Human
cccucaggcugcaggaaugguuagcaggagau

SEQ ID NO: 107839 - RNA, 32 nt, Human
cccucagggagaaaggagcaacacacugcccc

SEQ ID NO: 107840 - RNA, 32 nt, Human
cccucagggagacagacacagaccaagaauag

SEQ ID NO: 107841 - RNA, 19 nt, Human
cccucagggagccuggcca

SEQ ID NO: 107842 - RNA, 32 nt, Human
cccucagggcuccggagccauguggcccaacg

SEQ ID NO: 107843 - RNA, 32 nt, Human
cccucagggugcacuccagccaccucagugcu

SEQ ID NO: 107844 - RNA, 32 nt, Human
cccucaggucaguuguuuaaucucaagaccug

SEQ ID NO: 107845 - RNA, 32 nt, Human
cccucaggucccgucacaugucucaagggucc

SEQ ID NO: 107846 - RNA, 21 nt, Human
cccucagguuaccaagauaaa

SEQ ID NO: 107847 - RNA, 32 nt, Human
cccucagguugacaucacaacuccuuuguugg

SEQ ID NO: 107848 - RNA, 32 nt, Human
cccucaguaggugggaggggccagcugccucu

SEQ ID NO: 107849 - RNA, 32 nt, Human
cccucagucagcuaaucuccccaggccgacgc

SEQ ID NO: 107850 - RNA, 32 nt, Human
cccucagucauggagaaaacuuguauagaugc

SEQ ID NO: 107851 - RNA, 32 nt, Human
cccucaguccuccuuugcuccugcugcuucuc

SEQ ID NO: 107852 - RNA, 20 nt, Human
cccucaguccucucuuccuu

SEQ ID NO: 107853 - RNA, 32 nt, Human
cccucagucgcucaggcuggagugcaguggcg

SEQ ID NO: 107854 - RNA, 18 nt, Human
cccucagucucugcugcc

SEQ ID NO: 107855 - RNA, 32 nt, Human
cccucagucucuucccuuuaaaccuuucuuuu

SEQ ID NO: 107856 - RNA, 32 nt, Human
cccucaguggagccugcccaccucucagcccu

SEQ ID NO: 107857 - RNA, 32 nt, Human
cccucaguggccacaucaugcccacucccacu

SEQ ID NO: 107858 - RNA, 32 nt, Human
cccucagugucuaagccacuguuaguuggcuu

SEQ ID NO: 107859 - RNA, 17 nt, Human
cccucaguucagauaga

SEQ ID NO: 107860 - RNA, 24 nt, Human
cccucaguucccauaaaaccuuca

SEQ ID NO: 107861 - RNA, 32 nt, Human
cccucaguucuuucccaggagugcgguggcug

SEQ ID NO: 107862 - RNA, 23 nt, Human
cccucaguugccagggauggggc

SEQ ID NO: 107863 - RNA, 32 nt, Human
cccucaguuucuuucuagcucaucucacucug

SEQ ID NO: 107864 - RNA, 32 nt, Human
cccucauacaagggggagggugggguggggag

SEQ ID NO: 107865 - RNA, 32 nt, Human
cccucauaccccuuaucaucacugccuauucg

SEQ ID NO: 107866 - RNA, 32 nt, Human
cccucauagaugggggugggaguguggcuggu

SEQ ID NO: 107867 - RNA, 32 nt, Human
cccucauagcacaccagagaacucacacaggg

SEQ ID NO: 107868 - RNA, 20 nt, Human
cccucauaggcaaagaugaa

SEQ ID NO: 107869 - RNA, 23 nt, Human
cccucaucacccaccggcacuga

SEQ ID NO: 107870 - RNA, 23 nt, Human
cccucaucagagaaauccuggca

SEQ ID NO: 107871 - RNA, 32 nt, Human
cccucaucagagcccuccucuggccugucccc

SEQ ID NO: 107872 - RNA, 32 nt, Human
cccucaucaggaguuccagugcugcaugcgau

SEQ ID NO: 107873 - RNA, 17 nt, Human
cccucaucaucugugcc

SEQ ID NO: 107874 - RNA, 22 nt, Human
cccucauccaccgcccacucca

SEQ ID NO: 107875 - RNA, 32 nt, Human
cccucauccaugagagcucgaucccguaugaa

SEQ ID NO: 107876 - RNA, 32 nt, Human
cccucauccucaccaccucccccuuccagaaa

SEQ ID NO: 107877 - RNA, 17 nt, Human
cccucauccuccugccu

SEQ ID NO: 107878 - RNA, 21 nt, Human
cccucaucuagcacccgggca

SEQ ID NO: 107879 - RNA, 32 nt, Human
cccucaucuccucugccugugucugcgacccc

SEQ ID NO: 107880 - RNA, 19 nt, Human
cccucaucucugcgcugcc

SEQ ID NO: 107881 - RNA, 17 nt, Human
cccucaucucugcugcc

SEQ ID NO: 107882 - RNA, 32 nt, Human
cccucaucugcaggcgcucacaaccuaguuag

SEQ ID NO: 107883 - RNA, 32 nt, Human
cccucaucuggacuccagcgguggcuucuuga

SEQ ID NO: 107884 - RNA, 32 nt, Human
cccucaucuguaacaugccuugcuuaucuuuc

SEQ ID NO: 107885 - RNA, 32 nt, Human
cccucaugaaguauuauuauaauucaccauaa

SEQ ID NO: 107886 - RNA, 32 nt, Human
cccucaugaagucuuccuguaagcuugaggac

SEQ ID NO: 107887 - RNA, 32 nt, Human
cccucaugccaggccccugccucucacagcag

SEQ ID NO: 107888 - RNA, 32 nt, Human
cccucaugccuggagaaaccuucagcauggac

SEQ ID NO: 107889 - RNA, 32 nt, Human
cccucaugcuccugccuuccugagggccagag

SEQ ID NO: 107890 - RNA, 32 nt, Human
cccucauggcucuguccaccacgauggcugag

SEQ ID NO: 107891 - RNA, 32 nt, Human
cccucaugguccccacucuggcccagcccccu

SEQ ID NO: 107892 - RNA, 22 nt, Human
cccucauuaaaccauccaccug

SEQ ID NO: 107893 - RNA, 32 nt, Human
cccucauuacccucuggugucccuucaucugc

SEQ ID NO: 107894 - RNA, 31 nt, Human
cccucauucaauaaagaccagugaagaccaa

SEQ ID NO: 107895 - RNA, 32 nt, Human
cccucauucccggacccuuccaccccacuggg

SEQ ID NO: 107896 - RNA, 20 nt, Human
cccucauuccugccgcugcc

SEQ ID NO: 107897 - RNA, 32 nt, Human
cccucauugguuuuguucuuggucuccuaaua

SEQ ID NO: 107898 - RNA, 20 nt, Human
cccucauugucccucacuca

SEQ ID NO: 107899 - RNA, 32 nt, Human
cccucauugucuucccucucaagccccuuccu

SEQ ID NO: 107900 - RNA, 32 nt, Human
cccucauuuaucccucaacccccagcccacag

SEQ ID NO: 107901 - RNA, 32 nt, Human
cccucauuuccucuucuccuuacuaagguaaa

SEQ ID NO: 107902 - RNA, 32 nt, Human
cccucauuucucuuccuccucaccuccaccac

SEQ ID NO: 107903 - RNA, 32 nt, Human
cccucauuuucccucagaaccccacggcaagg

SEQ ID NO: 107904 - RNA, 32 nt, Human
cccuccaaaugccacccaccagagucacuggu

SEQ ID NO: 107905 - RNA, 22 nt, Human
cccuccaacauggcgccuggca

SEQ ID NO: 107906 - RNA, 32 nt, Human
cccuccaaccaccagcacugacuccugggcuc

SEQ ID NO: 107907 - RNA, 32 nt, Human
cccuccaacccccacccccaugcucuggaccu

SEQ ID NO: 107908 - RNA, 32 nt, Human
cccuccaacccccucccuauugaggugcaaua

SEQ ID NO: 107909 - RNA, 22 nt, Human
cccuccaaccucccugccagca

SEQ ID NO: 107910 - RNA, 18 nt, Human
cccuccaaccugacccug

SEQ ID NO: 107911 - RNA, 32 nt, Human
cccuccaagccuugccccauggaaagggcuac

SEQ ID NO: 107912 - RNA, 32 nt, Human
cccuccaaggccccaaagccucagagaaaggg

SEQ ID NO: 107913 - RNA, 32 nt, Human
cccuccaauacaucuuauagggcugcugggua

SEQ ID NO: 107914 - RNA, 32 nt, Human
cccuccacaagccauugauucauucauccagu

SEQ ID NO: 107915 - RNA, 32 nt, Human
cccuccacaaucaagacaccuugggacaagga

SEQ ID NO: 107916 - RNA, 32 nt, Human
cccuccacacagauucuggggacagagcuguu

SEQ ID NO: 107917 - RNA, 32 nt, Human
cccuccacaccaguggccucgugguuauaagc

SEQ ID NO: 107918 - RNA, 22 nt, Human
cccuccacaccccaaaaaagua

SEQ ID NO: 107919 - RNA, 32 nt, Human
cccuccacagccccugcuaucugccaucucca

SEQ ID NO: 107920 - RNA, 23 nt, Human
cccuccacaguaaggcugcuaca

SEQ ID NO: 107921 - RNA, 32 nt, Human
cccuccacaucccuagggcucugugauguagg

SEQ ID NO: 107922 - RNA, 32 nt, Human
cccuccaccacagccauccugucccucauugg

SEQ ID NO: 107923 - RNA, 18 nt, Human
cccuccaccacccccuca

SEQ ID NO: 107924 - RNA, 32 nt, Human
cccuccaccacugcgcccuucucccugaggag

SEQ ID NO: 107925 - RNA, 19 nt, Human
cccuccacccacccuucca

SEQ ID NO: 107926 - RNA, 32 nt, Human
cccuccacccaccguuucccugcagugcacgc

SEQ ID NO: 107927 - RNA, 32 nt, Human
cccuccaccccacauaguggguggaauccugc

SEQ ID NO: 107928 - RNA, 21 nt, Human
cccuccacccccuggcuccca

SEQ ID NO: 107929 - RNA, 32 nt, Human
cccuccacccucacccuccacccuuugcugcu

SEQ ID NO: 107930 - RNA, 32 nt, Human
cccuccaccucaccuccagcucaggggccgca

SEQ ID NO: 107931 - RNA, 20 nt, Human
cccuccaccuggccccuggg

SEQ ID NO: 107932 - RNA, 32 nt, Human
cccuccaccuggcuggagagauggcacaucau

SEQ ID NO: 107933 - RNA, 23 nt, Human
cccuccacgcaugaggcccugca

SEQ ID NO: 107934 - RNA, 18 nt, Human
cccuccacgcgcccgccc

SEQ ID NO: 107935 - RNA, 32 nt, Human
cccuccacggucaccuucaacgcccagacacu

SEQ ID NO: 107936 - RNA, 32 nt, Human
cccuccacuaccccauuuaaucuggccacagc

SEQ ID NO: 107937 - RNA, 32 nt, Human
cccuccacuagcucuagcccagccuggauucc

SEQ ID NO: 107938 - RNA, 18 nt, Human
cccuccacuccccucaca

SEQ ID NO: 107939 - RNA, 21 nt, Human
cccuccacuccccugcuuaau

SEQ ID NO: 107940 - RNA, 32 nt, Human
cccuccacuccucauccccacaaucuggcuua

SEQ ID NO: 107941 - RNA, 32 nt, Human
cccuccacucucuaccagauaacugaggaggg

SEQ ID NO: 107942 - RNA, 32 nt, Human
cccuccacucugaaggaggaacaggccugucu

SEQ ID NO: 107943 - RNA, 23 nt, Human
cccuccacuuccuccuccuguuu

SEQ ID NO: 107944 - RNA, 32 nt, Human
cccuccagaaaaucccugaucucuuaaaauuu

SEQ ID NO: 107945 - RNA, 32 nt, Human
cccuccagaaccccaaacccccaaagacugau

SEQ ID NO: 107946 - RNA, 32 nt, Human
cccuccagaagcugcaagagcuucuuagcagu

SEQ ID NO: 107947 - RNA, 32 nt, Human
cccuccagacaguaccacaggcaccuggagua

SEQ ID NO: 107948 - RNA, 32 nt, Human
cccuccagagaccgagagguugaugucacucc

SEQ ID NO: 107949 - RNA, 18 nt, Human
cccuccagaggaaggaug

SEQ ID NO: 107950 - RNA, 32 nt, Human
cccuccagcagcuccuucucauggccccuggg

SEQ ID NO: 107951 - RNA, 19 nt, Human
cccuccagccagucccauu

SEQ ID NO: 107952 - RNA, 32 nt, Human
cccuccagccauggaagaccuggaccagucuc

SEQ ID NO: 107953 - RNA, 32 nt, Human
cccuccagcccagcuccauucuuuggcauaac

SEQ ID NO: 107954 - RNA, 18 nt, Human
cccuccagcccccaaggg

SEQ ID NO: 107955 - RNA, 32 nt, Human
cccuccagccccgggggagauaaggucauggg

SEQ ID NO: 107956 - RNA, 32 nt, Human
cccuccagccggcgucgcucaggcugcggacc

SEQ ID NO: 107957 - RNA, 32 nt, Human
cccuccagccuaggugacagaaugagacucua

SEQ ID NO: 107958 - RNA, 30 nt, Human
cccuccagccucuccaagucgcugugaauu

SEQ ID NO: 107959 - RNA, 32 nt, Human
cccuccagccuggacaacagauugagacccug

SEQ ID NO: 107960 - RNA, 32 nt, Human
cccuccagccuggaugacagagugagaucucc

SEQ ID NO: 107961 - RNA, 32 nt, Human
cccuccagccugggcaacagagccagacaucu

SEQ ID NO: 107962 - RNA, 32 nt, Human
cccuccagccugggcaauagagcaagacucca

SEQ ID NO: 107963 - RNA, 32 nt, Human
cccuccagccugggcaauagagcaagaugcug

SEQ ID NO: 107964 - RNA, 32 nt, Human
cccuccagccugggcgacagaaccagacuccg

SEQ ID NO: 107965 - RNA, 32 nt, Human
cccuccagccugggcgacagaaugagacucca

SEQ ID NO: 107966 - RNA, 32 nt, Human
cccuccagccugggcgacagagcaagacucug

SEQ ID NO: 107967 - RNA, 32 nt, Human
cccuccagccugggcgacagagugagacuucu

SEQ ID NO: 107968 - RNA, 32 nt, Human
cccuccagccuggggagacagagcgagauucu

SEQ ID NO: 107969 - RNA, 32 nt, Human
cccuccagccugggugacagagcgagacucca

SEQ ID NO: 107970 - RNA, 32 nt, Human
cccuccagccugggugacagagugagacccug

SEQ ID NO: 107971 - RNA, 32 nt, Human
cccuccagccugggugacagagugagauucug

SEQ ID NO: 107972 - RNA, 32 nt, Human
cccuccagccuucuccacugaugccugcagcu

SEQ ID NO: 107973 - RNA, 31 nt, Human
cccuccagcgugucucccgagucuggccgca

SEQ ID NO: 107974 - RNA, 32 nt, Human
cccuccagcuagugguguggcugagcagacuc

SEQ ID NO: 107975 - RNA, 32 nt, Human
cccuccagcucuggcccucagcugcuugacag

SEQ ID NO: 107976 - RNA, 32 nt, Human
cccuccagcugguuuucccagcagccgaucug

SEQ ID NO: 107977 - RNA, 32 nt, Human
cccuccagcuucugcccugccugcugugugcg

SEQ ID NO: 107978 - RNA, 32 nt, Human
cccuccaggacacuucccugcccaggccaccu

SEQ ID NO: 107979 - RNA, 31 nt, Human
cccuccaggcacuucuaagcucuucuucuuc

SEQ ID NO: 107980 - RNA, 32 nt, Human
cccuccaggcagcguggccuguggcaccguga

SEQ ID NO: 107981 - RNA, 32 nt, Human
cccuccaggccuuggucuucaugguaaccacc

SEQ ID NO: 107982 - RNA, 32 nt, Human
cccuccagugcuggcagguggccucacccaca

SEQ ID NO: 107983 - RNA, 32 nt, Human
cccuccaguucugccacaggucugccgaugcc

SEQ ID NO: 107984 - RNA, 32 nt, Human
cccuccaguucugccuucauaguucucugccu

SEQ ID NO: 107985 - RNA, 20 nt, Human
cccuccaucagccccuccca

SEQ ID NO: 107986 - RNA, 32 nt, Human
cccuccauccaccccucuggcaccuggguugg

SEQ ID NO: 107987 - RNA, 32 nt, Human
cccuccaucccccaaugcuuguagaccuucca

SEQ ID NO: 107988 - RNA, 32 nt, Human
cccuccauccggcuccugucauccccuacacu

SEQ ID NO: 107989 - RNA, 32 nt, Human
cccuccaucucaccucacccgucucccaacca

SEQ ID NO: 107990 - RNA, 32 nt, Human
cccuccaucuucaagccagcagugaugcgcug

SEQ ID NO: 107991 - RNA, 32 nt, Human
cccuccaugaauuucugccacugccuucuaca

SEQ ID NO: 107992 - RNA, 32 nt, Human
cccuccaugacacacccccgauuccuggacaa

SEQ ID NO: 107993 - RNA, 32 nt, Human
cccuccaugcaucccacauacaagcacucccc

SEQ ID NO: 107994 - RNA, 32 nt, Human
cccuccauggugggucacuugaggucaggagu

SEQ ID NO: 107995 - RNA, 32 nt, Human
cccucccaaccacagcagccagagccaucuga

SEQ ID NO: 107996 - RNA, 32 nt, Human
cccucccaacuuggccucccacacguuccauu

SEQ ID NO: 107997 - RNA, 32 nt, Human
cccucccaagagucccauaucuaccugaccuc

SEQ ID NO: 107998 - RNA, 32 nt, Human
cccucccaagcagugaauuaauaaccagcagg

SEQ ID NO: 107999 - RNA, 20 nt, Human
cccucccaagcuggcugggg

SEQ ID NO: 108000 - RNA, 32 nt, Human
cccucccaaggcaccaguacucuaccaugggg

SEQ ID NO: 108001 - RNA, 32 nt, Human
cccucccaauccagucuacccucaaaggagcu

SEQ ID NO: 108002 - RNA, 17 nt, Human
cccucccacaacugagc

SEQ ID NO: 108003 - RNA, 21 nt, Human
cccucccaccccgucccagca

SEQ ID NO: 108004 - RNA, 17 nt, Human
cccucccaccccuccuc

SEQ ID NO: 108005 - RNA, 32 nt, Human
cccucccacccuugccccagccccugccuggu

SEQ ID NO: 108006 - RNA, 22 nt, Human
cccucccacccuugccccaguc

SEQ ID NO: 108007 - RNA, 21 nt, Human
cccucccaccucuucauccaa

SEQ ID NO: 108008 - RNA, 32 nt, Human
cccucccaccucuuccuccuccuagcucccca

SEQ ID NO: 108009 - RNA, 23 nt, Human
cccucccaccuguccccagauca

SEQ ID NO: 108010 - RNA, 20 nt, Human
cccucccacgccccccagcg

SEQ ID NO: 108011 - RNA, 32 nt, Human
cccucccacugccccucucugccucccacuga

SEQ ID NO: 108012 - RNA, 32 nt, Human
cccucccacuugaccugagaugcugggagggc

SEQ ID NO: 108013 - RNA, 32 nt, Human
cccucccagaugggggcagagagcaccgccca

SEQ ID NO: 108014 - RNA, 32 nt, Human
cccucccagcaauaaccaccucccuggaggcc

SEQ ID NO: 108015 - RNA, 32 nt, Human
cccucccagccccauauucacacacaucccag

SEQ ID NO: 108016 - RNA, 21 nt, Human
cccucccagcccccuccaucc

SEQ ID NO: 108017 - RNA, 21 nt, Human
cccucccagcccugcauccuc

SEQ ID NO: 108018 - RNA, 32 nt, Human
cccucccagcugacccagccuccugggccgcu

SEQ ID NO: 108019 - RNA, 32 nt, Human
cccucccaggccucucccucugccuuucuguu

SEQ ID NO: 108020 - RNA, 32 nt, Human
cccucccaggugugggacagaaggggcagagg

SEQ ID NO: 108021 - RNA, 32 nt, Human
cccucccagugaggccagcugcggugaagagg

SEQ ID NO: 108022 - RNA, 32 nt, Human
cccucccauacgccuuucaucccuccuucuag

SEQ ID NO: 108023 - RNA, 32 nt, Human
cccucccaugggggcacuugaguuuuggcaag

SEQ ID NO: 108024 - RNA, 32 nt, Human
cccucccauucaacuccccaccuccagccggg

SEQ ID NO: 108025 - RNA, 19 nt, Human
cccuccccaaacccaccca

SEQ ID NO: 108026 - RNA, 15 nt, Human
cccuccccaacgccu

SEQ ID NO: 108027 - RNA, 32 nt, Human
cccuccccaaguaggcaaggacugcacguuuc

SEQ ID NO: 108028 - RNA, 32 nt, Human
cccuccccacagacacacccuggguggauuga

SEQ ID NO: 108029 - RNA, 32 nt, Human
cccuccccacagaucccaucucaaaucauucu

SEQ ID NO: 108030 - RNA, 32 nt, Human
cccuccccacagccuuaggccaacacaaacug

SEQ ID NO: 108031 - RNA, 32 nt, Human
cccuccccaccaacuucucugccccagggacc

SEQ ID NO: 108032 - RNA, 23 nt, Human
cccuccccacccguucaccccca

SEQ ID NO: 108033 - RNA, 32 nt, Human
cccuccccaccgacccgccaccugccaccucu

SEQ ID NO: 108034 - RNA, 21 nt, Human
cccuccccaccuaccccuucc

SEQ ID NO: 108035 - RNA, 17 nt, Human
cccuccccacgaccccc

SEQ ID NO: 108036 - RNA, 32 nt, Human
cccuccccacgccagucgaccccacaccccac

SEQ ID NO: 108037 - RNA, 16 nt, Human
cccuccccacuggcca

SEQ ID NO: 108038 - RNA, 32 nt, Human
cccuccccagagcacugguugcaggggauuga

SEQ ID NO: 108039 - RNA, 32 nt, Human
cccuccccagaggaggcgggagggugggcucu

SEQ ID NO: 108040 - RNA, 32 nt, Human
cccuccccagcuccacucccuaccucaagaau

SEQ ID NO: 108041 - RNA, 32 nt, Human
cccuccccagcuccugcacuucuccccagagc

SEQ ID NO: 108042 - RNA, 32 nt, Human
cccuccccaggauggagccccaggaaaccagg

SEQ ID NO: 108043 - RNA, 16 nt, Human
cccuccccagucccau

SEQ ID NO: 108044 - RNA, 19 nt, Human
cccuccccaguccucccca

SEQ ID NO: 108045 - RNA, 32 nt, Human
cccuccccagugcaaaugcaugcuucuucuca

SEQ ID NO: 108046 - RNA, 32 nt, Human
cccuccccaucuccaugcccucuccuucugug

SEQ ID NO: 108047 - RNA, 32 nt, Human
cccuccccauuccccaggcccugggcccuccu

SEQ ID NO: 108048 - RNA, 32 nt, Human
cccucccccaaaaguuauaaaaccauuuuauc

SEQ ID NO: 108049 - RNA, 32 nt, Human
cccucccccaacacccccaaauucaagagugg

SEQ ID NO: 108050 - RNA, 32 nt, Human
cccucccccaccaucacuaucccuguacccuc

SEQ ID NO: 108051 - RNA, 32 nt, Human
cccucccccaccccgccucauucuuuaaucaa

SEQ ID NO: 108052 - RNA, 32 nt, Human
cccucccccacccugcccugcucaggguggga

SEQ ID NO: 108053 - RNA, 32 nt, Human
cccucccccacuccucuaagacaaaguagauu

SEQ ID NO: 108054 - RNA, 18 nt, Human
cccucccccagaccucca

SEQ ID NO: 108055 - RNA, 32 nt, Human
cccucccccagagggacuugacuuucuuucug

SEQ ID NO: 108056 - RNA, 19 nt, Human
cccucccccagcccaccca

SEQ ID NO: 108057 - RNA, 17 nt, Human
cccucccccagccccca

SEQ ID NO: 108058 - RNA, 32 nt, Human
cccucccccaggaacaugcacgcucacucugc

SEQ ID NO: 108059 - RNA, 32 nt, Human
cccucccccaggcugggagaaggggcuccugg

SEQ ID NO: 108060 - RNA, 17 nt, Human
cccucccccagggcccc

SEQ ID NO: 108061 - RNA, 32 nt, Human
cccucccccauccucucccacacacauuccag

SEQ ID NO: 108062 - RNA, 32 nt, Human
cccucccccauucuccagaucucccucugucu

SEQ ID NO: 108063 - RNA, 23 nt, Human
cccuccccccaccuuccacccca

SEQ ID NO: 108064 - RNA, 23 nt, Human
cccuccccccacuccaggccccc

SEQ ID NO: 108065 - RNA, 24 nt, Human
cccuccccccggcuccggccccca

SEQ ID NO: 108066 - RNA, 19 nt, Human
cccucccccgaccccacca

SEQ ID NO: 108067 - RNA, 16 nt, Human
cccucccccggccccc

SEQ ID NO: 108068 - RNA, 32 nt, Human
cccucccccugccccguucacaaugcagccug

SEQ ID NO: 108069 - RNA, 32 nt, Human
cccucccccugccccucaccuccccaggcuca

SEQ ID NO: 108070 - RNA, 32 nt, Human
cccucccccugccuugguuccccgagccaaga

SEQ ID NO: 108071 - RNA, 32 nt, Human
cccucccccugcuggggccucaguuuccccau

SEQ ID NO: 108072 - RNA, 32 nt, Human
cccucccccuggcuucuuucucuugggaaaac

SEQ ID NO: 108073 - RNA, 32 nt, Human
cccucccccuuuccuucucucccugauccuca

SEQ ID NO: 108074 - RNA, 18 nt, Human
cccuccccgcacagcccu

SEQ ID NO: 108075 - RNA, 32 nt, Human
cccuccccgcccccuucucuuuucacauacag

SEQ ID NO: 108076 - RNA, 32 nt, Human
cccuccccgcccggcccugcccugcccugcuc

SEQ ID NO: 108077 - RNA, 19 nt, Human
cccuccccgccugccugga

SEQ ID NO: 108078 - RNA, 32 nt, Human
cccuccccgcugccgccuccuccugggcuggg

SEQ ID NO: 108079 - RNA, 32 nt, Human
cccuccccggccagggcgcucgggagcgggga

SEQ ID NO: 108080 - RNA, 32 nt, Human
cccuccccggccucaguuuccccaaauauuua

SEQ ID NO: 108081 - RNA, 32 nt, Human
cccuccccuacuucucccuugcucccaaagcu

SEQ ID NO: 108082 - RNA, 32 nt, Human
cccuccccucaggcucugccuuggccuggccu

SEQ ID NO: 108083 - RNA, 32 nt, Human
cccuccccuccaggagcaggccuggugcagcc

SEQ ID NO: 108084 - RNA, 32 nt, Human
cccuccccuccaggcugauccugaggccugga

SEQ ID NO: 108085 - RNA, 32 nt, Human
cccuccccuccaggcuguuggcaggcgguggg

SEQ ID NO: 108086 - RNA, 32 nt, Human
cccuccccuccccaccccaucuauuaauauua

SEQ ID NO: 108087 - RNA, 32 nt, Human
cccuccccuccccaccucccccacugcgcguu

SEQ ID NO: 108088 - RNA, 32 nt, Human
cccuccccuccccacuccuccucucuucuucc

SEQ ID NO: 108089 - RNA, 32 nt, Human
cccuccccuccccagccuuuuccagaaaccau

SEQ ID NO: 108090 - RNA, 32 nt, Human
cccuccccuccccaugcucuccucccucagcc

SEQ ID NO: 108091 - RNA, 32 nt, Human
cccuccccucccccgccgccucgcagauagcu

SEQ ID NO: 108092 - RNA, 32 nt, Human
cccuccccucccccuccccaacucagauccgg

SEQ ID NO: 108093 - RNA, 32 nt, Human
cccuccccucccccucugccuuuuguacgcca

SEQ ID NO: 108094 - RNA, 32 nt, Human
cccuccccucccccuucccuucuggucggguc

SEQ ID NO: 108095 - RNA, 32 nt, Human
cccuccccuccccuaccagucuucccggcccc

SEQ ID NO: 108096 - RNA, 32 nt, Human
cccuccccuccccucccccguccugagcuccc

SEQ ID NO: 108097 - RNA, 32 nt, Human
cccuccccuccccuccccucccccgccccugu

SEQ ID NO: 108098 - RNA, 32 nt, Human
cccuccccuccccuccccucccccguccugag

SEQ ID NO: 108099 - RNA, 32 nt, Human
cccuccccuccccuccccuccccucccccgcc

SEQ ID NO: 108100 - RNA, 32 nt, Human
cccuccccuccccuccccuccccucccccguc

SEQ ID NO: 108101 - RNA, 32 nt, Human
cccuccccuccccuccccuccucuccugguau

SEQ ID NO: 108102 - RNA, 32 nt, Human
cccuccccuccccuccccuuccucccucccuc

SEQ ID NO: 108103 - RNA, 32 nt, Human
cccuccccuccccucccucgcgcugucauuca

SEQ ID NO: 108104 - RNA, 32 nt, Human
cccuccccuccccucccucuuuuuaguuuuaa

SEQ ID NO: 108105 - RNA, 32 nt, Human
cccuccccuccccucccuuccccuccacuccg

SEQ ID NO: 108106 - RNA, 32 nt, Human
cccuccccuccccucccuuccccuccggagcg

SEQ ID NO: 108107 - RNA, 32 nt, Human
cccuccccuccccucgcccgccuucgccgccc

SEQ ID NO: 108108 - RNA, 32 nt, Human
cccuccccuccccuuccccucaucuuccaggc

SEQ ID NO: 108109 - RNA, 32 nt, Human
cccuccccuccccuuccucccucccucccucc

SEQ ID NO: 108110 - RNA, 32 nt, Human
cccuccccuccccuuccuguccuuucacaaua

SEQ ID NO: 108111 - RNA, 32 nt, Human
cccuccccuccccuucuucuccaucuccauuc

SEQ ID NO: 108112 - RNA, 32 nt, Human
cccuccccucccuggggcagcagccaccaugu

SEQ ID NO: 108113 - RNA, 19 nt, Human
cccuccccuccuggcucug

SEQ ID NO: 108114 - RNA, 32 nt, Human
cccuccccucguuccagaccugccucauggug

SEQ ID NO: 108115 - RNA, 18 nt, Human
cccuccccucucuuccuc

SEQ ID NO: 108116 - RNA, 32 nt, Human
cccuccccugccaucccuccccggacuccggc

SEQ ID NO: 108117 - RNA, 32 nt, Human
cccuccccugcuccgaccuuugaguugucccg

SEQ ID NO: 108118 - RNA, 15 nt, Human
cccuccccugcugcu

SEQ ID NO: 108119 - RNA, 18 nt, Human
cccuccccuggcccagcc

SEQ ID NO: 108120 - RNA, 32 nt, Human
cccuccccugucaagccaguucuuuccucuuc

SEQ ID NO: 108121 - RNA, 32 nt, Human
cccuccccugucccucugugagagaaggagca

SEQ ID NO: 108122 - RNA, 32 nt, Human
cccuccccugugucugucuccaugaagccuga

SEQ ID NO: 108123 - RNA, 32 nt, Human
cccuccccuuccccucccccuccccaacucag

SEQ ID NO: 108124 - RNA, 22 nt, Human
cccuccccuuccccuccugccu

SEQ ID NO: 108125 - RNA, 32 nt, Human
cccuccccuuccccuccugccugcuuugcccc

SEQ ID NO: 108126 - RNA, 32 nt, Human
cccuccccuuccccucucgcaaacaugccucc

SEQ ID NO: 108127 - RNA, 32 nt, Human
cccuccccuucugcaauggagaguucuggcuc

SEQ ID NO: 108128 - RNA, 32 nt, Human
cccucccgcaguuggcccugugguguuccgaa

SEQ ID NO: 108129 - RNA, 32 nt, Human
cccucccgcccgcuuccucugcccacagcgcc

SEQ ID NO: 108130 - RNA, 32 nt, Human
cccucccgcuuccucccucccaucuucccacc

SEQ ID NO: 108131 - RNA, 32 nt, Human
cccucccggccuggccugcccuugcgcccggc

SEQ ID NO: 108132 - RNA, 32 nt, Human
cccucccgggguuggggacagagcaggugcag

SEQ ID NO: 108133 - RNA, 32 nt, Human
cccucccgucucggcuauuugcacugaugaua

SEQ ID NO: 108134 - RNA, 32 nt, Human
cccucccguucccuccucuucucucugggagg

SEQ ID NO: 108135 - RNA, 21 nt, Human
cccucccuaacagugaaaaga

SEQ ID NO: 108136 - RNA, 32 nt, Human
cccucccuacaaagcacugccucuacugggcg

SEQ ID NO: 108137 - RNA, 32 nt, Human
cccucccuaccuguaauuccagucuuugugca

SEQ ID NO: 108138 - RNA, 32 nt, Human
cccucccuagcccuuccagccugggacacaca

SEQ ID NO: 108139 - RNA, 32 nt, Human
cccucccucaaggaggucuggcuuuauccaua

SEQ ID NO: 108140 - RNA, 32 nt, Human
cccucccucaaggccuccuccaccuccaccuc

SEQ ID NO: 108141 - RNA, 32 nt, Human
cccucccucacuuccucccucucccccauccu

SEQ ID NO: 108142 - RNA, 32 nt, Human
cccucccuccacuccucucaacugccucagcg

SEQ ID NO: 108143 - RNA, 32 nt, Human
cccucccuccagccuaggucagagguggggac

SEQ ID NO: 108144 - RNA, 15 nt, Human
cccucccuccaggua

SEQ ID NO: 108145 - RNA, 32 nt, Human
cccucccucccaccuccccacacccauugagu

SEQ ID NO: 108146 - RNA, 32 nt, Human
cccucccucccccauccuccccaaaauagccu

SEQ ID NO: 108147 - RNA, 32 nt, Human
cccucccucccucccucccucccuuccuuucu

SEQ ID NO: 108148 - RNA, 32 nt, Human
cccucccucccucccucccuuccuuucuuccu

SEQ ID NO: 108149 - RNA, 32 nt, Human
cccucccucccucccucccuuucuuucuuucu

SEQ ID NO: 108150 - RNA, 32 nt, Human
cccucccuccuucucuccuuccuuccuuccuc

SEQ ID NO: 108151 - RNA, 32 nt, Human
cccucccuccuuucucccuuccuuccuuucuu

SEQ ID NO: 108152 - RNA, 32 nt, Human
cccucccucggcccgugguccccagcugguga

SEQ ID NO: 108153 - RNA, 32 nt, Human
cccucccucggcuuuacuccugcccagugacu

SEQ ID NO: 108154 - RNA, 32 nt, Human
cccucccucucccaucaccagccucaaggccu

SEQ ID NO: 108155 - RNA, 32 nt, Human
cccucccucuccccuuccuuucucucucuucc

SEQ ID NO: 108156 - RNA, 32 nt, Human
cccucccucugaccagcaaccaggacaguuug

SEQ ID NO: 108157 - RNA, 32 nt, Human
cccucccucugguuguucuguugaacuccuug

SEQ ID NO: 108158 - RNA, 32 nt, Human
cccucccucuucagagagcccccagccagcag

SEQ ID NO: 108159 - RNA, 32 nt, Human
cccucccucuuucugcccauuuccucccaccc

SEQ ID NO: 108160 - RNA, 32 nt, Human
cccucccucuuuguuuccuuccuuccuuauuu

SEQ ID NO: 108161 - RNA, 18 nt, Human
cccucccugcacccagcc

SEQ ID NO: 108162 - RNA, 32 nt, Human
cccucccugcagccacacgaggcccagcaacc

SEQ ID NO: 108163 - RNA, 32 nt, Human
cccucccugcagccuuaacauucucuuccccu

SEQ ID NO: 108164 - RNA, 32 nt, Human
cccucccugccacacuagcuucccagggcugc

SEQ ID NO: 108165 - RNA, 32 nt, Human
cccucccugccuccuccuuccugccugugaug

SEQ ID NO: 108166 - RNA, 32 nt, Human
cccucccugccucuuucuuucugcucccucau

SEQ ID NO: 108167 - RNA, 32 nt, Human
cccucccugccugccagcccuagacuuguugg

SEQ ID NO: 108168 - RNA, 32 nt, Human
cccucccugccuggaaaggccuccugugccag

SEQ ID NO: 108169 - RNA, 32 nt, Human
cccucccugccuggccgcgccucugcgaccag

SEQ ID NO: 108170 - RNA, 32 nt, Human
cccucccugccuggguucuccccagccgaacc

SEQ ID NO: 108171 - RNA, 32 nt, Human
cccucccugccugucccugguaacgccuccug

SEQ ID NO: 108172 - RNA, 32 nt, Human
cccucccugccugucuugucccucugccccuc

SEQ ID NO: 108173 - RNA, 32 nt, Human
cccucccugcucccagcucucucuccuggagu

SEQ ID NO: 108174 - RNA, 32 nt, Human
cccucccugcugcuggugcacagccacucccc

SEQ ID NO: 108175 - RNA, 32 nt, Human
cccucccugcuguccccucuugccccaacccc

SEQ ID NO: 108176 - RNA, 23 nt, Human
cccucccugcuucccaaaagcuc

SEQ ID NO: 108177 - RNA, 32 nt, Human
cccucccuggaagucacaggacaggaaugaca

SEQ ID NO: 108178 - RNA, 32 nt, Human
cccucccuggagccuccacugccucuggaauu

SEQ ID NO: 108179 - RNA, 32 nt, Human
cccucccuggaggcggcuggaccuagcgaggc

SEQ ID NO: 108180 - RNA, 32 nt, Human
cccucccuggaguguugaggggguuguaccug

SEQ ID NO: 108181 - RNA, 32 nt, Human
cccucccugggcacagcuccccaaacccaggc

SEQ ID NO: 108182 - RNA, 32 nt, Human
cccucccuggguaggagcagcuuugugucacu

SEQ ID NO: 108183 - RNA, 32 nt, Human
cccucccugucccagccagcaucaucucuuug

SEQ ID NO: 108184 - RNA, 32 nt, Human
cccucccugucucccccacuuccuggccaggg

SEQ ID NO: 108185 - RNA, 32 nt, Human
cccucccugugggcacaccaccugggcauuag

SEQ ID NO: 108186 - RNA, 32 nt, Human
cccucccuguucucccugcagggugccaagaa

SEQ ID NO: 108187 - RNA, 32 nt, Human
cccucccuguuucccuucccucccucccuccc

SEQ ID NO: 108188 - RNA, 32 nt, Human
cccucccuuagcaaacagguucaucuccagaa

SEQ ID NO: 108189 - RNA, 17 nt, Human
cccucccuucaccguga

SEQ ID NO: 108190 - RNA, 18 nt, Human
cccucccuucaccuugcu

SEQ ID NO: 108191 - RNA, 19 nt, Human
cccucccuucaccuugcuu

SEQ ID NO: 108192 - RNA, 32 nt, Human
cccucccuucaccuuuccucuccuggcgggcc

SEQ ID NO: 108193 - RNA, 32 nt, Human
cccucccuucaccuuuccucuccuggcggggu

SEQ ID NO: 108194 - RNA, 18 nt, Human
cccucccuucagcuuccu

SEQ ID NO: 108195 - RNA, 32 nt, Human
cccucccuuccagauuaaccaaaaccugcuaa

SEQ ID NO: 108196 - RNA, 32 nt, Human
cccucccuuccauccuccucuccaaagaacag

SEQ ID NO: 108197 - RNA, 21 nt, Human
cccucccuucccccuauccaa

SEQ ID NO: 108198 - RNA, 21 nt, Human
cccucccuucuaccuccucuu

SEQ ID NO: 108199 - RNA, 32 nt, Human
cccucccuugccuccugcucccaugggaaaca

SEQ ID NO: 108200 - RNA, 32 nt, Human
cccucccuugcucuccaccgugugaggacaca

SEQ ID NO: 108201 - RNA, 21 nt, Human
cccucccuuggcccccugggu

SEQ ID NO: 108202 - RNA, 32 nt, Human
cccuccgagacccagcccgagcgcagggaggg

SEQ ID NO: 108203 - RNA, 32 nt, Human
cccuccgagaggaggccagagggagaggagga

SEQ ID NO: 108204 - RNA, 32 nt, Human
cccuccgaguagcugggaccacagguguacga

SEQ ID NO: 108205 - RNA, 32 nt, Human
cccuccgaugcaugcucuucucucacauggag

SEQ ID NO: 108206 - RNA, 32 nt, Human
cccuccgccaccuuccccuccuccggcuuuuu

SEQ ID NO: 108207 - RNA, 32 nt, Human
cccuccgcccacucugcccccugggagcccuc

SEQ ID NO: 108208 - RNA, 32 nt, Human
cccuccgccccacucaggauguggauuucaau

SEQ ID NO: 108209 - RNA, 32 nt, Human
cccuccgccccacuccagccaguguggggagc

SEQ ID NO: 108210 - RNA, 22 nt, Human
cccuccgccccucagguucuuu

SEQ ID NO: 108211 - RNA, 32 nt, Human
cccuccgccccucgccccaaccccugggcgcc

SEQ ID NO: 108212 - RNA, 32 nt, Human
cccuccgcccuuuccucuccccaccuuccucu

SEQ ID NO: 108213 - RNA, 32 nt, Human
cccuccgccgccccuuccccagcccugccccc

SEQ ID NO: 108214 - RNA, 32 nt, Human
cccuccgccucucggguucaagcaauucuccu

SEQ ID NO: 108215 - RNA, 32 nt, Human
cccuccgccuucuccccucccgcuguccaugc

SEQ ID NO: 108216 - RNA, 32 nt, Human
cccuccgcgaggguggaggcggcggcugugug

SEQ ID NO: 108217 - RNA, 31 nt, Human
cccuccgcgaugucuccauccgaguaagaaa

SEQ ID NO: 108218 - RNA, 32 nt, Human
cccuccgcggaaggcguggcagggaggcaguc

SEQ ID NO: 108219 - RNA, 32 nt, Human
cccuccgcuccccuccccuauuucccggggug

SEQ ID NO: 108220 - RNA, 32 nt, Human
cccuccgcuccugggcgcgcucucauucauag

SEQ ID NO: 108221 - RNA, 32 nt, Human
cccuccgcuuccucuccuaggcgacgagaccc

SEQ ID NO: 108222 - RNA, 32 nt, Human
cccuccgcuucucaucccaaccucuuuuuccu

SEQ ID NO: 108223 - RNA, 22 nt, Human
cccuccgcuuucuccgcgccgg

SEQ ID NO: 108224 - RNA, 32 nt, Human
cccuccgcuuugucauugaucucuccauggug

SEQ ID NO: 108225 - RNA, 23 nt, Human
cccuccggacgggccucauccaa

SEQ ID NO: 108226 - RNA, 32 nt, Human
cccuccggagccggacgcuccgggaggcccgg

SEQ ID NO: 108227 - RNA, 19 nt, Human
cccuccggagcugcccccu

SEQ ID NO: 108228 - RNA, 32 nt, Human
cccuccggccacucucagccggugagugcucu

SEQ ID NO: 108229 - RNA, 32 nt, Human
cccuccgggaagcacagcaaagucccucauuc

SEQ ID NO: 108230 - RNA, 32 nt, Human
cccuccgguuaucaagcaaaaugucucuugug

SEQ ID NO: 108231 - RNA, 18 nt, Human
cccuccgucaccuccuca

SEQ ID NO: 108232 - RNA, 32 nt, Human
cccuccgucccacuccacuccaggcugccggc

SEQ ID NO: 108233 - RNA, 15 nt, Human
cccuccguccgcuug

SEQ ID NO: 108234 - RNA, 32 nt, Human
cccuccguccugcugaaaacccccauaagcca

SEQ ID NO: 108235 - RNA, 32 nt, Human
cccuccgucucucggguucaagcaauugucug

SEQ ID NO: 108236 - RNA, 32 nt, Human
cccuccgucuuuucccucuacucucauccuag

SEQ ID NO: 108237 - RNA, 32 nt, Human
cccuccguggaauuccugauagagucucaaua

SEQ ID NO: 108238 - RNA, 32 nt, Human
cccuccuaaacauucguacacacacaaacaca

SEQ ID NO: 108239 - RNA, 32 nt, Human
cccuccuacagcacuccaccuugggaccuguu

SEQ ID NO: 108240 - RNA, 32 nt, Human
cccuccuacagcuguaacuccccuccuguccu

SEQ ID NO: 108241 - RNA, 32 nt, Human
cccuccuaccacugcuuugacuguaccuguuu

SEQ ID NO: 108242 - RNA, 24 nt, Human
cccuccuacccccuccccauccag

SEQ ID NO: 108243 - RNA, 16 nt, Human
cccuccuaccccuccc

SEQ ID NO: 108244 - RNA, 17 nt, Human
cccuccuaccccuccca

SEQ ID NO: 108245 - RNA, 32 nt, Human
cccuccuaccugcuuacaauuuggaaaagugu

SEQ ID NO: 108246 - RNA, 32 nt, Human
cccuccuagugguucuccaccccguuguggcu

SEQ ID NO: 108247 - RNA, 32 nt, Human
cccuccuaguucugccccaggcucuucuuucc

SEQ ID NO: 108248 - RNA, 32 nt, Human
cccuccuaucaccuccccuccuugccuccugu

SEQ ID NO: 108249 - RNA, 32 nt, Human
cccuccuauggcccaaaucuucauuugccuuu

SEQ ID NO: 108250 - RNA, 32 nt, Human
cccuccucacuacccuauauaaaaaucauugg

SEQ ID NO: 108251 - RNA, 32 nt, Human
cccuccucacugccaugcuucuccugguggcc

SEQ ID NO: 108252 - RNA, 32 nt, Human
cccuccucagcauuauuugauacacugauugu

SEQ ID NO: 108253 - RNA, 32 nt, Human
cccuccucagcccucgacaugugccucgcaag

SEQ ID NO: 108254 - RNA, 32 nt, Human
cccuccuccacuccucccuuggucuggccuug

SEQ ID NO: 108255 - RNA, 19 nt, Human
cccuccuccagcccccucu

SEQ ID NO: 108256 - RNA, 32 nt, Human
cccuccuccagcuuccuggccucccagccacu

SEQ ID NO: 108257 - RNA, 23 nt, Human
cccuuucagccccauuaaagcuc

SEQ ID NO: 108258 - RNA, 32 nt, Human
cccuuucagcuuuucagaggcacgugugcugg

SEQ ID NO: 108259 - RNA, 32 nt, Human
cccuuucagucuggacugugagcugcugcugg

SEQ ID NO: 108260 - RNA, 32 nt, Human
cccuuucauccagcgggcacuucgggaagagc

SEQ ID NO: 108261 - RNA, 32 nt, Human
cccuuucaugcugucugugugguugcaugugu

SEQ ID NO: 108262 - RNA, 32 nt, Human
cccuuucauugggguguauacauaucagggga

SEQ ID NO: 108263 - RNA, 32 nt, Human
cccuuuccagccucugccccucaggggaaccc

SEQ ID NO: 108264 - RNA, 32 nt, Human
cccuuuccaucaccuucucucccaacagccua

SEQ ID NO: 108265 - RNA, 32 nt, Human
cccuuucccaggcgguagcgggggcggugguu

SEQ ID NO: 108266 - RNA, 32 nt, Human
cccuuucccaucucagggcagaggccacagga

SEQ ID NO: 108267 - RNA, 32 nt, Human
cccuuuccccacaccucccccugcugcugcug

SEQ ID NO: 108268 - RNA, 32 nt, Human
cccuuuccccauccucuaucuaucccuguuuc

SEQ ID NO: 108269 - RNA, 17 nt, Human
cccuuucccccuccuca

SEQ ID NO: 108270 - RNA, 32 nt, Human
cccuuuccccgcagcuuuaauaacuccuggcc

SEQ ID NO: 108271 - RNA, 21 nt, Human
cccuuuccccucagcuuacuu

SEQ ID NO: 108272 - RNA, 19 nt, Human
cccuuuccccuucagcugc

SEQ ID NO: 108273 - RNA, 32 nt, Human
cccuuucccguuacacaccacaccugcccagg

SEQ ID NO: 108274 - RNA, 19 nt, Human
cccuuucccuaauuaaggc

SEQ ID NO: 108275 - RNA, 32 nt, Human
cccuuucccucuaacccacaccaccuuucuac

SEQ ID NO: 108276 - RNA, 32 nt, Human
cccuuucccucucugcugagcauuuaaccauu

SEQ ID NO: 108277 - RNA, 32 nt, Human
cccuuucccugccagcaaaccccaccacccua

SEQ ID NO: 108278 - RNA, 32 nt, Human
cccuuucccuuccuccuccucuucuccucccu

SEQ ID NO: 108279 - RNA, 32 nt, Human
cccuuucccuuucuuccugacuagccccaagu

SEQ ID NO: 108280 - RNA, 32 nt, Human
cccuuuccgagucaaagaaaggggugacggac

SEQ ID NO: 108281 - RNA, 32 nt, Human
cccuuuccggaucugcugagccggacagcagu

SEQ ID NO: 108282 - RNA, 32 nt, Human
cccuuuccggccgguccccauggaggcgcugg

SEQ ID NO: 108283 - RNA, 32 nt, Human
cccuuuccucagccuccaccugcaggacagca

SEQ ID NO: 108284 - RNA, 32 nt, Human
cccuuuccuccagggcccagucuggcucccga

SEQ ID NO: 108285 - RNA, 32 nt, Human
cccuuuccuccccauucccacccucagccggg

SEQ ID NO: 108286 - RNA, 32 nt, Human
cccuuuccuccccucccugccucccuucuucc

SEQ ID NO: 108287 - RNA, 32 nt, Human
cccuuuccuccuggugcccugaaggcugcgau

SEQ ID NO: 108288 - RNA, 32 nt, Human
cccuuuccucgcaccuccuuguccucacccag

SEQ ID NO: 108289 - RNA, 32 nt, Human
cccuuuccucuuccuuucccuuccuucucuuu

SEQ ID NO: 108290 - RNA, 16 nt, Human
cccuuuccucuucugc

SEQ ID NO: 108291 - RNA, 17 nt, Human
cccuuuccucuucugcc

SEQ ID NO: 108292 - RNA, 32 nt, Human
cccuuuccucuugggauuguagauuguauugg

SEQ ID NO: 108293 - RNA, 32 nt, Human
cccuuuccuggaccggcugggcgugugaugcg

SEQ ID NO: 108294 - RNA, 32 nt, Human
cccuuuccuggacugcucucuccagaaacagc

SEQ ID NO: 108295 - RNA, 32 nt, Human
cccuuuccugggacccagacagcaggccggcc

SEQ ID NO: 108296 - RNA, 32 nt, Human
cccuuuccuucccuucgucuucccuaagcuaa

SEQ ID NO: 108297 - RNA, 32 nt, Human
cccuuuccuugagacuggaggguugagaccag

SEQ ID NO: 108298 - RNA, 18 nt, Human
cccuuucgccuccugucu

SEQ ID NO: 108299 - RNA, 32 nt, Human
cccuuucgucgguggggauggagaccuagagg

SEQ ID NO: 108300 - RNA, 32 nt, Human
cccuuucuaagaggaggaaaaauggaugcaag

SEQ ID NO: 108301 - RNA, 21 nt, Human
cccuuucuacccucacagcuc

SEQ ID NO: 108302 - RNA, 31 nt, Human
cccuuucucaauaaauucaucugcgguggag

SEQ ID NO: 108303 - RNA, 32 nt, Human
cccuuucuccaccugcuccuccuccucugacu

SEQ ID NO: 108304 - RNA, 32 nt, Human
cccuuucucccagcaggcgcuggacucugggg

SEQ ID NO: 108305 - RNA, 21 nt, Human
cccuuucucccaggccuucgg

SEQ ID NO: 108306 - RNA, 32 nt, Human
cccuuucucccaguggaggaaggugugcugug

SEQ ID NO: 108307 - RNA, 32 nt, Human
cccuuucuccccuuccaccugcugcgggcugg

SEQ ID NO: 108308 - RNA, 32 nt, Human
cccuuucucccgucaccuuucaugccagacaa

SEQ ID NO: 108309 - RNA, 21 nt, Human
cccuuucucccuccccgcuaa

SEQ ID NO: 108310 - RNA, 17 nt, Human
cccuuucucccuccuca

SEQ ID NO: 108311 - RNA, 32 nt, Human
cccuuucuccuccuccuuccucugaguugacc

SEQ ID NO: 108312 - RNA, 32 nt, Human
cccuuucuccuucuccccuccuucuuuuucag

SEQ ID NO: 108313 - RNA, 32 nt, Human
cccuuucucugcucccagccugccucaccagg

SEQ ID NO: 108314 - RNA, 32 nt, Human
cccuuucucuuuccucauugccuucucccuuc

SEQ ID NO: 108315 - RNA, 32 nt, Human
cccuuucucuuuccuuucuuuccuuccacaaa

SEQ ID NO: 108316 - RNA, 20 nt, Human
cccuuucugccaagaaggcc

SEQ ID NO: 108317 - RNA, 19 nt, Human
cccuuucugccccugcuga

SEQ ID NO: 108318 - RNA, 19 nt, Human
cccuuucugccuagagggc

SEQ ID NO: 108319 - RNA, 32 nt, Human
cccuuucugccuggucagccccguggccucug

SEQ ID NO: 108320 - RNA, 32 nt, Human
cccuuucugcucccucucuuuccaucuguuug

SEQ ID NO: 108321 - RNA, 32 nt, Human
cccuuucugugcaggagcagagccaggugggc

SEQ ID NO: 108322 - RNA, 32 nt, Human
cccuuucuguggcuggauggggagacagguca

SEQ ID NO: 108323 - RNA, 19 nt, Human
cccuuucuucccucagcca

SEQ ID NO: 108324 - RNA, 32 nt, Human
cccuuucuucccucagccaucugggguauauc

SEQ ID NO: 108325 - RNA, 32 nt, Human
cccuuucuugaggaccuuguguuccuggcagg

SEQ ID NO: 108326 - RNA, 32 nt, Human
cccuuucuuuacaccauccucucccauaagca

SEQ ID NO: 108327 - RNA, 20 nt, Human
cccuuucuuucccucccugc

SEQ ID NO: 108328 - RNA, 32 nt, Human
cccuuucuuuccuucucuccuccuuuauuuga

SEQ ID NO: 108329 - RNA, 32 nt, Human
cccuuugaaaacaccauauacacuugagguua

SEQ ID NO: 108330 - RNA, 32 nt, Human
cccuuugaaaagugccuggggaccugaagagc

SEQ ID NO: 108331 - RNA, 32 nt, Human
cccuuugaaaggagaaggaauuggagcagcuu

SEQ ID NO: 108332 - RNA, 32 nt, Human
cccuuugaggagcacuggaggaagcacacccu

SEQ ID NO: 108333 - RNA, 32 nt, Human
cccuuugagugacuccagcacaggcuaccuag

SEQ ID NO: 108334 - RNA, 32 nt, Human
cccuuugauguggguccccuguugauuauacg

SEQ ID NO: 108335 - RNA, 32 nt, Human
cccuuugcaagggguaacagaccgcuggaaaa

SEQ ID NO: 108336 - RNA, 32 nt, Human
cccuuugcacacagagcagcuacuucuaagcc

SEQ ID NO: 108337 - RNA, 32 nt, Human
cccuuugcacacaggggcuacagcgcauuuuc

SEQ ID NO: 108338 - RNA, 32 nt, Human
cccuuugcacuggcuguuuccucugccuggaa

SEQ ID NO: 108339 - RNA, 32 nt, Human
cccuuugcagaggcauaaauccgcaccacccu

SEQ ID NO: 108340 - RNA, 32 nt, Human
cccuuugcaggacuugcacacagggaggcugu

SEQ ID NO: 108341 - RNA, 32 nt, Human
cccuuugcagucccaguauauugugcgugcac

SEQ ID NO: 108342 - RNA, 32 nt, Human
cccuuugcaguguucuaauccccagagccccu

SEQ ID NO: 108343 - RNA, 32 nt, Human
cccuuugcauccagcucccagcucuucuuccc

SEQ ID NO: 108344 - RNA, 32 nt, Human
cccuuugcccaggaguuccuucugucccggcu

SEQ ID NO: 108345 - RNA, 18 nt, Human
cccuuugcccccagcuca

SEQ ID NO: 108346 - RNA, 32 nt, Human
cccuuugcccccuccccuccccugacacaugc

SEQ ID NO: 108347 - RNA, 32 nt, Human
cccuuugccuuuuagaacucagugccauccug

SEQ ID NO: 108348 - RNA, 32 nt, Human
cccuuugcuccuggugggagagggaggaguga

SEQ ID NO: 108349 - RNA, 32 nt, Human
cccuuugcucuucuuuucccuccuuaaaagaa

SEQ ID NO: 108350 - RNA, 24 nt, Human
cccuuugcugacagaacugcugga

SEQ ID NO: 108351 - RNA, 32 nt, Human
cccuuuggaaaagaguuggugaaaugcgcacg

SEQ ID NO: 108352 - RNA, 23 nt, Human
cccuuuggaaaucugucuucuuu

SEQ ID NO: 108353 - RNA, 32 nt, Human
cccuuuggaaccagaugucuuguuacagacac

SEQ ID NO: 108354 - RNA, 32 nt, Human
cccuuuggaaggccaaggcgggcagaucacuu

SEQ ID NO: 108355 - RNA, 32 nt, Human
cccuuuggaauagcaguguuccagugugugaa

SEQ ID NO: 108356 - RNA, 32 nt, Human
cccuuuggacauccugcugacacuugggcccc

SEQ ID NO: 108357 - RNA, 32 nt, Human
cccuuuggaccagucucccaagaggagagggg

SEQ ID NO: 108358 - RNA, 32 nt, Human
cccuuuggaggugacccaggagagaagggaug

SEQ ID NO: 108359 - RNA, 32 nt, Human
cccuuuggauccacguggucugcaaccuggug

SEQ ID NO: 108360 - RNA, 17 nt, Human
cccuuuggcccuccuca

SEQ ID NO: 108361 - RNA, 32 nt, Human
cccuuuggccucucccccuccuuccaucucuu

SEQ ID NO: 108362 - RNA, 32 nt, Human
cccuuuggccuuugcuggcuguguggcggcuc

SEQ ID NO: 108363 - RNA, 32 nt, Human
cccuuuggcguaagcuaugauugucguccaag

SEQ ID NO: 108364 - RNA, 32 nt, Human
cccuuuggcugucuggccccagccucugcacu

SEQ ID NO: 108365 - RNA, 32 nt, Human
cccuuuggcuuagugacuuugaggucccaaga

SEQ ID NO: 108366 - RNA, 32 nt, Human
cccuuugggaacuagggggcugcuggugggaa

SEQ ID NO: 108367 - RNA, 32 nt, Human
cccuuugggaggcccaggugggcagaucaccu

SEQ ID NO: 108368 - RNA, 32 nt, Human
cccuuugggaggccgaggcgggcggaucaccu

SEQ ID NO: 108369 - RNA, 32 nt, Human
cccuuugggaggccgaggugggcagaucacga

SEQ ID NO: 108370 - RNA, 32 nt, Human
cccuuugggaggccugagguagaggggagugg

SEQ ID NO: 108371 - RNA, 32 nt, Human
cccuuugggaggcugaggcgggaggaucgcuu

SEQ ID NO: 108372 - RNA, 32 nt, Human
cccuuugggaggcugaggcgggcagaucacca

SEQ ID NO: 108373 - RNA, 32 nt, Human
cccuuugggcaggggagcucggaggcucagga

SEQ ID NO: 108374 - RNA, 32 nt, Human
cccuuugggcugccuuuggaugucgauacagg

SEQ ID NO: 108375 - RNA, 32 nt, Human
cccuuugguauuucgauuagaagaagcugcaa

SEQ ID NO: 108376 - RNA, 32 nt, Human
cccuuugguguuugcucuucuacuuagaaaau

SEQ ID NO: 108377 - RNA, 32 nt, Human
cccuuugguguuuggucuucuacuuagaaaaa

SEQ ID NO: 108378 - RNA, 32 nt, Human
cccuuugguuuccgugucauccuuuuuggugu

SEQ ID NO: 108379 - RNA, 32 nt, Human
cccuuuguaaugcugcuccucuccacugccca

SEQ ID NO: 108380 - RNA, 21 nt, Human
cccuuuguacaugaccugcug

SEQ ID NO: 108381 - RNA, 32 nt, Human
cccuuuguauuuuugcaguuccucccuauacc

SEQ ID NO: 108382 - RNA, 32 nt, Human
cccuuugucacccaggccggagugcaguggca

SEQ ID NO: 108383 - RNA, 23 nt, Human
cccuuugucccccaggccuagga

SEQ ID NO: 108384 - RNA, 32 nt, Human
cccuuugucccugcacucagcccuguggcccc

SEQ ID NO: 108385 - RNA, 24 nt, Human
cccuuugucucccaggcuggagug

SEQ ID NO: 108386 - RNA, 32 nt, Human
cccuuuguggcccugaggacggcugggucuau

SEQ ID NO: 108387 - RNA, 32 nt, Human
cccuuuguuaccaguucuuccuccuuccucuu

SEQ ID NO: 108388 - RNA, 32 nt, Human
cccuuuguugcaggaaugugcgucgggcuagg

SEQ ID NO: 108389 - RNA, 32 nt, Human
cccuuuguugcccaggcuggucuccaacuccu

SEQ ID NO: 108390 - RNA, 32 nt, Human
cccuuuguuucugcuuucugcggugaucagag

SEQ ID NO: 108391 - RNA, 32 nt, Human
cccuuuuaacccaguguacuaggucaaucagg

SEQ ID NO: 108392 - RNA, 32 nt, Human
cccuuuuacaugcacacacuccucacacugcu

SEQ ID NO: 108393 - RNA, 32 nt, Human
cccuuuuaccuauggcaggagcagcugggaug

SEQ ID NO: 108394 - RNA, 32 nt, Human
cccuuuuaucaguauuccaagccugggaugau

SEQ ID NO: 108395 - RNA, 32 nt, Human
cccuuuuaugguagggcacuucaacuuuaaug

SEQ ID NO: 108396 - RNA, 32 nt, Human
cccuuuuauucccuuuuccucuuaaagagcug

SEQ ID NO: 108397 - RNA, 32 nt, Human
cccuuuucaugauuuuucauuaggugguucag

SEQ ID NO: 108398 - RNA, 32 nt, Human
cccuuuucauucuaccaacagaucugcacuuu

SEQ ID NO: 108399 - RNA, 22 nt, Human
cccuuuuccaacuucagcaaua

SEQ ID NO: 108400 - RNA, 23 nt, Human
cccuuuuccacaggccuagaaca

SEQ ID NO: 108401 - RNA, 17 nt, Human
cccuuuuccaccugugc

SEQ ID NO: 108402 - RNA, 23 nt, Human
cccuuuuccagaggcugggaaca

SEQ ID NO: 108403 - RNA, 32 nt, Human
cccuuuuccagauggggaaacugaggcccaga

SEQ ID NO: 108404 - RNA, 32 nt, Human
cccuuuuccagccucaauggccuggcagagcc

SEQ ID NO: 108405 - RNA, 32 nt, Human
cccuuuucccacccuccacccucagguaggcc

SEQ ID NO: 108406 - RNA, 32 nt, Human
cccuuuuccccagaccgauccuucccaacgua

SEQ ID NO: 108407 - RNA, 32 nt, Human
cccuuuuccccaucuucuucuuucagaucauu

SEQ ID NO: 108408 - RNA, 24 nt, Human
cccuuuucccccaguuuugggaca

SEQ ID NO: 108409 - RNA, 32 nt, Human
cccuuuucccccaguuuugggacacugugcuu

SEQ ID NO: 108410 - RNA, 32 nt, Human
cccuuuucccccauggucauggugucaccccc

SEQ ID NO: 108411 - RNA, 19 nt, Human
cccuuuucccucugcugcc

SEQ ID NO: 108412 - RNA, 17 nt, Human
cccuuuucccugcugcc

SEQ ID NO: 108413 - RNA, 22 nt, Human
cccuuuuccucccuuaggagca

SEQ ID NO: 108414 - RNA, 32 nt, Human
cccuuuucgcccaggcugaguacaguggugca

SEQ ID NO: 108415 - RNA, 32 nt, Human
cccuuuucggucugucuucauccugccuggcu

SEQ ID NO: 108416 - RNA, 32 nt, Human
cccuuuucgucccaggacgagcucuucagucc

SEQ ID NO: 108417 - RNA, 32 nt, Human
cccuuuucuccucuccccaauccaugcuucac

SEQ ID NO: 108418 - RNA, 32 nt, Human
cccuuuucuccucuccucuccugguccuguug

SEQ ID NO: 108419 - RNA, 32 nt, Human
cccuuuucucugagaagagccagcaguccaca

SEQ ID NO: 108420 - RNA, 32 nt, Human
cccuuuucugggcaccgccuucugcuaggggg

SEQ ID NO: 108421 - RNA, 32 nt, Human
cccuuuucuuguuugaaaacaguuauuuggug

SEQ ID NO: 108422 - RNA, 32 nt, Human
cccuuuucuuucucucauccuacauagcugcc

SEQ ID NO: 108423 - RNA, 32 nt, Human
cccuuuucuuuuuaccacccuaccuuuauugu

SEQ ID NO: 108424 - RNA, 22 nt, Human
cccuuuugagacagaagcucuu

SEQ ID NO: 108425 - RNA, 32 nt, Human
cccuuuugagauacuuuccugucuuuagcuca

SEQ ID NO: 108426 - RNA, 32 nt, Human
cccuuuugauugagccuccaccucugggauuu

SEQ ID NO: 108427 - RNA, 32 nt, Human
cccuuuugcuauacucacagucuuguuuuccc

SEQ ID NO: 108428 - RNA, 21 nt, Human
cccuuuuguuucucaguaaca

SEQ ID NO: 108429 - RNA, 32 nt, Human
cccuuuuuaacuuaaagaacagagccacaccg

SEQ ID NO: 108430 - RNA, 32 nt, Human
cccuuuuuaauuacauucacuacuucuaccac

SEQ ID NO: 108431 - RNA, 22 nt, Human
cccuuuuuacaguucugcaaca

SEQ ID NO: 108432 - RNA, 20 nt, Human
cccuuuuuaccauccauuca

SEQ ID NO: 108433 - RNA, 32 nt, Human
cccuuuuucaaggccccauccaccucccuccc

SEQ ID NO: 108434 - RNA, 32 nt, Human
cccuuuuucagucugauuuggggauuucaguu

SEQ ID NO: 108435 - RNA, 32 nt, Human
cccuuuuuccaaauugauaaggauuucugguu

SEQ ID NO: 108436 - RNA, 32 nt, Human
cccuuuuucccuuuuauuuucaugccuugauu

SEQ ID NO: 108437 - RNA, 32 nt, Human
cccuuuuucuccucacaaggaggugaggcugg

SEQ ID NO: 108438 - RNA, 32 nt, Human
cccuuuuugaaaccagggaggcugguguugcc

SEQ ID NO: 108439 - RNA, 32 nt, Human
cccuuuuugaguuugaaucauagccuugaugu

SEQ ID NO: 108440 - RNA, 32 nt, Human
cccuuuuugaugccccuucugccuuucucuca

SEQ ID NO: 108441 - RNA, 17 nt, Human
cccuuuuuguggcccca

SEQ ID NO: 108442 - RNA, 32 nt, Human
cccuuuuuguuccuuugccucuugccuguccc

SEQ ID NO: 108443 - RNA, 17 nt, Human
cccuuuuuuccacuggc

SEQ ID NO: 108444 - RNA, 22 nt, Human
cccuuuuuugucccauuagcaa

SEQ ID NO: 108445 - RNA, 25 nt, Human
ccgaaaaugcugggauuacaggcgu

SEQ ID NO: 108446 - RNA, 32 nt, Human
ccgaaacaauggaggauccaucagaggagaca

SEQ ID NO: 108447 - RNA, 32 nt, Human
ccgaaacagaggaggaggagggaggggagugc

SEQ ID NO: 108448 - RNA, 32 nt, Human
ccgaaaccagcggcagccgcacggccacuuga

SEQ ID NO: 108449 - RNA, 32 nt, Human
ccgaaacccuccugccaggaagaccagggccu

SEQ ID NO: 108450 - RNA, 21 nt, Human
ccgaaacccucuccuccgcca

SEQ ID NO: 108451 - RNA, 32 nt, Human
ccgaaaccugcaggcguucucucucuaaggag

SEQ ID NO: 108452 - RNA, 32 nt, Human
ccgaaacggcucuaggugcacuguccggcucc

SEQ ID NO: 108453 - RNA, 32 nt, Human
ccgaaacuccacccguucccacugcccugggc

SEQ ID NO: 108454 - RNA, 32 nt, Human
ccgaaagcacagaacguggcacguuggaggaa

SEQ ID NO: 108455 - RNA, 32 nt, Human
ccgaaagccaaaccagacucaccagaaauugc

SEQ ID NO: 108456 - RNA, 32 nt, Human
ccgaaagccgucucuucuaugcaauaacacaa

SEQ ID NO: 108457 - RNA, 32 nt, Human
ccgaaagccuagagaccgccacugugauucac

SEQ ID NO: 108458 - RNA, 32 nt, Human
ccgaaagcuacaccacagaugccagugguuca

SEQ ID NO: 108459 - RNA, 22 nt, Human
ccgaaaggaagaggaagaggca

SEQ ID NO: 108460 - RNA, 32 nt, Human
ccgaaagucauuucuuggaacacaaguggagu

SEQ ID NO: 108461 - RNA, 32 nt, Human
ccgaaagucugaaucucccaaggagggcacca

SEQ ID NO: 108462 - RNA, 32 nt, Human
ccgaaagugcugagauuacaguugcgagccac

SEQ ID NO: 108463 - RNA, 25 nt, Human
ccgaaagugcugggauuacaggcgu

SEQ ID NO: 108464 - RNA, 23 nt, Human
ccgaaaguggugggauuacaagc

SEQ ID NO: 108465 - RNA, 32 nt, Human
ccgaaauauccuggcgacucagagggcagguc

SEQ ID NO: 108466 - RNA, 32 nt, Human
ccgaaauccugggugugucaccaguguagagg

SEQ ID NO: 108467 - RNA, 32 nt, Human
ccgaaaugcauggcagauucauuugucagcca

SEQ ID NO: 108468 - RNA, 22 nt, Human
ccgaaaugcugggauuacaggc

SEQ ID NO: 108469 - RNA, 32 nt, Human
ccgaaaugcuuugggauuacgggugugagccg

SEQ ID NO: 108470 - RNA, 30 nt, Human
ccgaaaugggcaaguucaugaaaccuggga

SEQ ID NO: 108471 - RNA, 32 nt, Human
ccgaacaaggaagcucucccacccccagccuc

SEQ ID NO: 108472 - RNA, 32 nt, Human
ccgaacacugagaaauagugcacuccaagaaa

SEQ ID NO: 108473 - RNA, 32 nt, Human
ccgaacacugcagcugucugaccuuccaaaga

SEQ ID NO: 108474 - RNA, 32 nt, Human
ccgaacaggaagaggguacagcuuugugcagg

SEQ ID NO: 108475 - RNA, 32 nt, Human
ccgaacaucaaaauggaaagaguauucauacu

SEQ ID NO: 108476 - RNA, 32 nt, Human
ccgaacaucuuccuucuccaaagcugggaguc

SEQ ID NO: 108477 - RNA, 32 nt, Human
ccgaacauuuguguccuacuugcugacagcgc

SEQ ID NO: 108478 - RNA, 32 nt, Human
ccgaaccaaaaacugcaaagguggcaggaaga

SEQ ID NO: 108479 - RNA, 32 nt, Human
ccgaaccaggccgccucacagccaggaaauuu

SEQ ID NO: 108480 - RNA, 32 nt, Human
ccgaacccaggagucaaaagcugcagugagcu

SEQ ID NO: 108481 - RNA, 32 nt, Human
ccgaaccucccgucuguaaccugcaccugcag

SEQ ID NO: 108482 - RNA, 32 nt, Human
ccgaaccuucaucugcauguaugucuuugucu

SEQ ID NO: 108483 - RNA, 32 nt, Human
ccgaacgaagccgcggcccgggcacagccaug

SEQ ID NO: 108484 - RNA, 32 nt, Human
ccgaacuccagccaccacuuuccugugcauuu

SEQ ID NO: 108485 - RNA, 32 nt, Human
ccgaacugacaggacacagcaggcuggaguug

SEQ ID NO: 108486 - RNA, 32 nt, Human
ccgaacuugcaacauuccaccauugugauaug

SEQ ID NO: 108487 - RNA, 32 nt, Human
ccgaagaacgggccaggaaguccuccaauuuc

SEQ ID NO: 108488 - RNA, 32 nt, Human
ccgaagaagggcuaggaacacccuggagaggc

SEQ ID NO: 108489 - RNA, 32 nt, Human
ccgaagaaucuuagugacauuuagccaugggu

SEQ ID NO: 108490 - RNA, 32 nt, Human
ccgaagacagcggaucaucugaggucaggagu

SEQ ID NO: 108491 - RNA, 32 nt, Human
ccgaagacauaagucggugagacauggcugaa

SEQ ID NO: 108492 - RNA, 32 nt, Human
ccgaagagaggagagaccugggagugggagcu

SEQ ID NO: 108493 - RNA, 32 nt, Human
ccgaagaggaggcggaccaggagaagagcaaa

SEQ ID NO: 108494 - RNA, 32 nt, Human
ccgaagaggcagcuagggagagugggagguag

SEQ ID NO: 108495 - RNA, 32 nt, Human
ccgaagauuccugaggccagagcucugacagg

SEQ ID NO: 108496 - RNA, 32 nt, Human
ccgaagcacagcagcuaacacacaagcauauc

SEQ ID NO: 108497 - RNA, 32 nt, Human
ccgaagcagcugcagugggcagccaggggugg

SEQ ID NO: 108498 - RNA, 32 nt, Human
ccgaagcaggcagaucaccugaggucaggagu

SEQ ID NO: 108499 - RNA, 32 nt, Human
ccgaagcaggcggaucacuugaggucaggagu

SEQ ID NO: 108500 - RNA, 32 nt, Human
ccgaagcagguggaucaucugaggucgggaga

SEQ ID NO: 108501 - RNA, 32 nt, Human
ccgaagcaggugggucaccugaggucaggagu

SEQ ID NO: 108502 - RNA, 30 nt, Human
ccgaagccaacaacuagcuggucccugucg

SEQ ID NO: 108503 - RNA, 32 nt, Human
ccgaagcccaggcugaagaguuuaacuuuggg

SEQ ID NO: 108504 - RNA, 32 nt, Human
ccgaagcccugaggcgucgaggccgcccgagg

SEQ ID NO: 108505 - RNA, 18 nt, Human
ccgaagccgccccgagcu

SEQ ID NO: 108506 - RNA, 32 nt, Human
ccgaagccggaagaggcggaaaauggauucuc

SEQ ID NO: 108507 - RNA, 16 nt, Human
ccgaagccggcuguug

SEQ ID NO: 108508 - RNA, 32 nt, Human
ccgaagccuuaaauccuucugucuuccugacu

SEQ ID NO: 108509 - RNA, 32 nt, Human
ccgaagccuuggcuuuucacaugcaagggaca

SEQ ID NO: 108510 - RNA, 32 nt, Human
ccgaagcgaguggaucaccugaggucaggauu

SEQ ID NO: 108511 - RNA, 32 nt, Human
ccgaagcgggcggaucaccugaggucgggagu

SEQ ID NO: 108512 - RNA, 32 nt, Human
ccgaagcggguggaucaccugaggucaggagu

SEQ ID NO: 108513 - RNA, 32 nt, Human
ccgaagcuacaugccaaugauaggugcaaaga

SEQ ID NO: 108514 - RNA, 22 nt, Human
ccgaagcucuuucccgccgccu

SEQ ID NO: 108515 - RNA, 32 nt, Human
ccgaagcucuuuggaccuagcagguucggcgg

SEQ ID NO: 108516 - RNA, 32 nt, Human
ccgaagcugagacugacuacugugcauuagga

SEQ ID NO: 108517 - RNA, 32 nt, Human
ccgaagcugcggagcuugcugaggcaaggccg

SEQ ID NO: 108518 - RNA, 18 nt, Human
ccgaagcugcuucgggcc

SEQ ID NO: 108519 - RNA, 32 nt, Human
ccgaagcuguccacugccaccacucgggcagu

SEQ ID NO: 108520 - RNA, 32 nt, Human
ccgaaggcagggaacgcccuccccagucccgc

SEQ ID NO: 108521 - RNA, 32 nt, Human
ccgaaggcagggccuuccuaaguggcugagua

SEQ ID NO: 108522 - RNA, 32 nt, Human
ccgaaggccucaauaaacggagcuggcgcugc

SEQ ID NO: 108523 - RNA, 32 nt, Human
ccgaaggcggcccucuggcauucccuggccuc

SEQ ID NO: 108524 - RNA, 21 nt, Human
ccgaagggcucgcuccgcgcc

SEQ ID NO: 108525 - RNA, 32 nt, Human
ccgaagggugagaagagaagccaugccgggca

SEQ ID NO: 108526 - RNA, 32 nt, Human
ccgaagguccaggaguccaggacagcaggugc

SEQ ID NO: 108527 - RNA, 32 nt, Human
ccgaagguggcucuagcgcauccuuugucgcg

SEQ ID NO: 108528 - RNA, 24 nt, Human
ccgaaguagcugggauuacaggcg

SEQ ID NO: 108529 - RNA, 32 nt, Human
ccgaagucuuggccuccagcucccucuugccu

SEQ ID NO: 108530 - RNA, 24 nt, Human
ccgaagugcuaagauuacaggcgu

SEQ ID NO: 108531 - RNA, 20 nt, Human
ccgaagugcuaggauuacag

SEQ ID NO: 108532 - RNA, 24 nt, Human
ccgaagugcuaggauuacagacgu

SEQ ID NO: 108533 - RNA, 24 nt, Human
ccgaagugcuggaauuacaggcgu

SEQ ID NO: 108534 - RNA, 22 nt, Human
ccgaagugcugggauuacaggc

SEQ ID NO: 108535 - RNA, 22 nt, Human
ccgaagugcugggauugcaggc

SEQ ID NO: 108536 - RNA, 24 nt, Human
ccgaagugcuugaauuacaggcgu

SEQ ID NO: 108537 - RNA, 32 nt, Human
ccgaagugggcagaucaccugaggucaggagu

SEQ ID NO: 108538 - RNA, 32 nt, Human
ccgaagugggcagaucacuugaggucaagagu

SEQ ID NO: 108539 - RNA, 32 nt, Human
ccgaagugggcggaucacuugaggucagcagu

SEQ ID NO: 108540 - RNA, 32 nt, Human
ccgaaguggguggaucaccugagguccggagu

SEQ ID NO: 108541 - RNA, 32 nt, Human
ccgaaguggguggauuaccugaggucaggagc

SEQ ID NO: 108542 - RNA, 31 nt, Human
ccgaagugugagagacgauugucucauuggc

SEQ ID NO: 108543 - RNA, 32 nt, Human
ccgaaguguguagguauagucagccggugcag

SEQ ID NO: 108544 - RNA, 22 nt, Human
ccgaaguguugggauuacaggc

SEQ ID NO: 108545 - RNA, 32 nt, Human
ccgaaguguuucaaguggaucucaguaaagga

SEQ ID NO: 108546 - RNA, 32 nt, Human
ccgaaguguuucugaagucucaagaacugcca

SEQ ID NO: 108547 - RNA, 32 nt, Human
ccgaaguuauggcuccuuccucccucucucca

SEQ ID NO: 108548 - RNA, 32 nt, Human
ccgaaguugggguccugggaaaacuugggucc

SEQ ID NO: 108549 - RNA, 32 nt, Human
ccgaauacacuuugacuccccuucccuucccu

SEQ ID NO: 108550 - RNA, 23 nt, Human
ccgaauagcugggacuacaggcg

SEQ ID NO: 108551 - RNA, 23 nt, Human
ccgaauagcugggauuacaggcg

SEQ ID NO: 108552 - RNA, 32 nt, Human
ccgaauauacaguucaagaauuuugucugacu

SEQ ID NO: 108553 - RNA, 32 nt, Human
ccgaaucccugggaaaaauucuuuucccccag

SEQ ID NO: 108554 - RNA, 32 nt, Human
ccgaauccucccaguugaggcaguagcugugu

SEQ ID NO: 108555 - RNA, 32 nt, Human
ccgaaucugcauuuugacaggauccccaggua

SEQ ID NO: 108556 - RNA, 32 nt, Human
ccgaaugccaugagcugcagcgacccagccug

SEQ ID NO: 108557 - RNA, 32 nt, Human
ccgaauggagugagcccagcagggcaugcugg

SEQ ID NO: 108558 - RNA, 22 nt, Human
ccgaauggccggaaaauggagu

SEQ ID NO: 108559 - RNA, 32 nt, Human
ccgaaugggcagaucacuugaggucaggaguu

SEQ ID NO: 108560 - RNA, 20 nt, Human
ccgaauguggccgcccaggg

SEQ ID NO: 108561 - RNA, 32 nt, Human
ccgaauucagaggccucagguaugacgacauc

SEQ ID NO: 108562 - RNA, 22 nt, Human
ccgaauuccaaagaaaugggcu

SEQ ID NO: 108563 - RNA, 32 nt, Human
ccgaauucccuucacaucuucaacgccaucag

SEQ ID NO: 108564 - RNA, 32 nt, Human
ccgaauuugccaaagagauggaagagggugag

SEQ ID NO: 108565 - RNA, 32 nt, Human
ccgacaaacacaagcagaaacuucucaggauc

SEQ ID NO: 108566 - RNA, 32 nt, Human
ccgacaaacggucacauguccaucguuauggc

SEQ ID NO: 108567 - RNA, 32 nt, Human
ccgacaaccacugcccagcagccucugggacc

SEQ ID NO: 108568 - RNA, 32 nt, Human
ccgacaagccccucaagggcugaggccgagga

SEQ ID NO: 108569 - RNA, 32 nt, Human
ccgacacaauccaggcguguucagccugagcu

SEQ ID NO: 108570 - RNA, 32 nt, Human
ccgacacacaugcacgcacgcaccccucuuaa

SEQ ID NO: 108571 - RNA, 32 nt, Human
ccgacacacaugcuuuucuccaugacacgagg

SEQ ID NO: 108572 - RNA, 32 nt, Human
ccgacacguagcgccgcccuccugccuccgga

SEQ ID NO: 108573 - RNA, 21 nt, Human
ccgacagagcccggggcgcag

SEQ ID NO: 108574 - RNA, 32 nt, Human
ccgacagagcuggaaaugcauugcacuuugac

SEQ ID NO: 108575 - RNA, 32 nt, Human
ccgacagaggggaaggaauggaccugugagag

SEQ ID NO: 108576 - RNA, 32 nt, Human
ccgacagcauuaccucacccggccccaucugu

SEQ ID NO: 108577 - RNA, 32 nt, Human
ccgacagccuugcaggcugggcucagggacaa

SEQ ID NO: 108578 - RNA, 32 nt, Human
ccgacagcucugaagaugaauuuugauuggac

SEQ ID NO: 108579 - RNA, 32 nt, Human
ccgacagcuuccgcguguggccaucugucuuu

SEQ ID NO: 108580 - RNA, 32 nt, Human
ccgacagugccauccccaccuucaccucggag

SEQ ID NO: 108581 - RNA, 27 nt, Human
ccgacaucauuaccggguuuuccucuu

SEQ ID NO: 108582 - RNA, 32 nt, Human
ccgacaucccuaaaaguaccuccacccguucc

SEQ ID NO: 108583 - RNA, 32 nt, Human
ccgacaucugaacaccuacauuuccuuugcag

SEQ ID NO: 108584 - RNA, 20 nt, Human
ccgacauggcgaaacccugu

SEQ ID NO: 108585 - RNA, 32 nt, Human
ccgacaugggcaacaugacaagaccccaucuc

SEQ ID NO: 108586 - RNA, 20 nt, Human
ccgacauggugaaacccugu

SEQ ID NO: 108587 - RNA, 32 nt, Human
ccgacauguuuucuuuggccugggugguuuau

SEQ ID NO: 108588 - RNA, 32 nt, Human
ccgaccaaagccccagggggugcagaagacuc

SEQ ID NO: 108589 - RNA, 20 nt, Human
ccgaccaacauggugaaacc

SEQ ID NO: 108590 - RNA, 32 nt, Human
ccgaccaacauggugaaaccccaucuuuacug

SEQ ID NO: 108591 - RNA, 32 nt, Human
ccgaccacacaaacccagccuggggaggaacc

SEQ ID NO: 108592 - RNA, 32 nt, Human
ccgaccacagcccuccccacugugagccuucc

SEQ ID NO: 108593 - RNA, 32 nt, Human
ccgaccaccuggccuucucuucgcuucuugac

SEQ ID NO: 108594 - RNA, 32 nt, Human
ccgaccagccucacccagccucggcugaaugu

SEQ ID NO: 108595 - RNA, 32 nt, Human
ccgaccauccacccggugguuccuguuugucc

SEQ ID NO: 108596 - RNA, 28 nt, Human
ccgacccacacagcugucgcugcccuga

SEQ ID NO: 108597 - RNA, 32 nt, Human
ccgacccagagcugaguccgaggaccccaggc

SEQ ID NO: 108598 - RNA, 32 nt, Human
ccgacccagauggguggaucaccugaggucag

SEQ ID NO: 108599 - RNA, 32 nt, Human
ccgacccaguccguuaggaaagaagggaaacg

SEQ ID NO: 108600 - RNA, 32 nt, Human
ccgacccaguguuucgcggacugaggucuccg

SEQ ID NO: 108601 - RNA, 20 nt, Human
ccgacccaugcuggcuggga

SEQ ID NO: 108602 - RNA, 21 nt, Human
ccgacccaugcuggcugggaa

SEQ ID NO: 108603 - RNA, 32 nt, Human
ccgaccccacacacccugagggagcccuaccc

SEQ ID NO: 108604 - RNA, 32 nt, Human
ccgaccccaccccagucuccccacacggaccu

SEQ ID NO: 108605 - RNA, 32 nt, Human
ccgaccccagacccuggcuggccaggaugaag

SEQ ID NO: 108606 - RNA, 32 nt, Human
ccgacccccuacugcucggccgcggcugcccg

SEQ ID NO: 108607 - RNA, 32 nt, Human
ccgacccgcacacacacccacacugcugcccu

SEQ ID NO: 108608 - RNA, 26 nt, Human
ccgacccggguuaaaacucccaggga

SEQ ID NO: 108609 - RNA, 32 nt, Human
ccgacccguggcugggucggagcuccauguuc

SEQ ID NO: 108610 - RNA, 32 nt, Human
ccgacccuccugucauucacagucccauggca

SEQ ID NO: 108611 - RNA, 32 nt, Human
ccgacccugagugcagccugacccgcccucgc

SEQ ID NO: 108612 - RNA, 17 nt, Human
ccgacccugcccugggc

SEQ ID NO: 108613 - RNA, 32 nt, Human
ccgaccgcagcagcucaaggugccaucugccu

SEQ ID NO: 108614 - RNA, 28 nt, Human
ccgaccgcccgugcugccuccuuccggg

SEQ ID NO: 108615 - RNA, 32 nt, Human
ccgaccggcccaccccagggcguuccugaagg

SEQ ID NO: 108616 - RNA, 32 nt, Human
ccgaccggcccgcggcagccugcgccgcgcca

SEQ ID NO: 108617 - RNA, 32 nt, Human
ccgaccggucuccugacccagcaugcugcucu

SEQ ID NO: 108618 - RNA, 32 nt, Human
ccgaccuacagcccauacagaccugauuucug

SEQ ID NO: 108619 - RNA, 32 nt, Human
ccgaccuauaugucuauauguaaguggaguua

SEQ ID NO: 108620 - RNA, 22 nt, Human
ccgaccuaucccaguuguguga

SEQ ID NO: 108621 - RNA, 32 nt, Human
ccgaccucaaguagucugccugccucaaccuc

SEQ ID NO: 108622 - RNA, 32 nt, Human
ccgaccucaagugauccucccaccucacccuc

SEQ ID NO: 108623 - RNA, 32 nt, Human
ccgaccucagccuuccccuugcccagggcuca

SEQ ID NO: 108624 - RNA, 32 nt, Human
ccgaccucaggugauccacccaccucggccuc

SEQ ID NO: 108625 - RNA, 32 nt, Human
ccgaccucaggugauccgcccaccucagccuc

SEQ ID NO: 108626 - RNA, 32 nt, Human
ccgaccucaggugauccgcccaccucggccuc

SEQ ID NO: 108627 - RNA, 32 nt, Human
ccgaccucaggugaucugcccaccucggccuc

SEQ ID NO: 108628 - RNA, 32 nt, Human
ccgaccucauacaaacucaggccugcagaggc

SEQ ID NO: 108629 - RNA, 32 nt, Human
ccgaccucccaaagugcugggauuacaggcuu

SEQ ID NO: 108630 - RNA, 25 nt, Human
ccgaccucgugaucugcccaccuca

SEQ ID NO: 108631 - RNA, 32 nt, Human
ccgaccugggagacuucaggaaugacaaccua

SEQ ID NO: 108632 - RNA, 32 nt, Human
ccgaccugggcaaccuggaggagcccagggaa

SEQ ID NO: 108633 - RNA, 18 nt, Human
ccgaccuggggcugcaca

SEQ ID NO: 108634 - RNA, 32 nt, Human
ccgaccuguacacuuuccagaagccugaucuc

SEQ ID NO: 108635 - RNA, 32 nt, Human
ccgaccuguccccgccuccucucccucccucg

SEQ ID NO: 108636 - RNA, 32 nt, Human
ccgaccuguuguucacuuugcuggugagccag

SEQ ID NO: 108637 - RNA, 32 nt, Human
ccgaccuuaggugaugcacugugcccagccau

SEQ ID NO: 108638 - RNA, 32 nt, Human
ccgaccuuauugcugugcucugggcuuggggg

SEQ ID NO: 108639 - RNA, 24 nt, Human
ccgaccuugugauccacccaccuc

SEQ ID NO: 108640 - RNA, 32 nt, Human
ccgacgaaccccuacccuucccuagaccaugu

SEQ ID NO: 108641 - RNA, 32 nt, Human
ccgacgcaauggcagccuuugcaguggaaccu

SEQ ID NO: 108642 - RNA, 32 nt, Human
ccgacgcacagccccuccuggugcgcggcugg

SEQ ID NO: 108643 - RNA, 20 nt, Human
ccgacgcacgcccucgggcc

SEQ ID NO: 108644 - RNA, 32 nt, Human
ccgacgcagagcagcgcccuggccgggccaag

SEQ ID NO: 108645 - RNA, 32 nt, Human
ccgacgcccaggacccuggccugcagagacgc

SEQ ID NO: 108646 - RNA, 32 nt, Human
ccgacgccgcgggauggggacgcggcgcgggg

SEQ ID NO: 108647 - RNA, 18 nt, Human
ccgacgccggccugggcc

SEQ ID NO: 108648 - RNA, 32 nt, Human
ccgacgcggcggcggaggaggcugugaggagu

SEQ ID NO: 108649 - RNA, 32 nt, Human
ccgacgcuuccagacaaggcggaaaaggccuu

SEQ ID NO: 108650 - RNA, 32 nt, Human
ccgacggaaauagaauugaaggcauucuaaaa

SEQ ID NO: 108651 - RNA, 32 nt, Human
ccgacggagcagaagagagagcauggagcugg

SEQ ID NO: 108652 - RNA, 32 nt, Human
ccgacggccccuggauaggcggaaggagugga

SEQ ID NO: 108653 - RNA, 20 nt, Human
ccgacggggcagacacccug

SEQ ID NO: 108654 - RNA, 32 nt, Human
ccgacggggccgcggcaggcgcggcgagagcg

SEQ ID NO: 108655 - RNA, 20 nt, Human
ccgacgggggucccgggcca

SEQ ID NO: 108656 - RNA, 20 nt, Human
ccgacgguuucugguugccu

SEQ ID NO: 108657 - RNA, 32 nt, Human
ccgacguauuuuauucuuuucagugcuauugu

SEQ ID NO: 108658 - RNA, 32 nt, Human
ccgacguccacagggacccaggcaggguuggg

SEQ ID NO: 108659 - RNA, 21 nt, Human
ccgacgugaccguuguagccc

SEQ ID NO: 108660 - RNA, 32 nt, Human
ccgacgugcagccuggcagugcagugagcugu

SEQ ID NO: 108661 - RNA, 32 nt, Human
ccgacuagaguggaagcucagcaaagaacgga

SEQ ID NO: 108662 - RNA, 32 nt, Human
ccgacuagccaagaagggagaccucagaagac

SEQ ID NO: 108663 - RNA, 32 nt, Human
ccgacuaucguugcugguaagccugggcuugc

SEQ ID NO: 108664 - RNA, 32 nt, Human
ccgacuccaggguggugacauuuagagcuagu

SEQ ID NO: 108665 - RNA, 32 nt, Human
ccgacucccagcucugucuuguuccuugucuu

SEQ ID NO: 108666 - RNA, 32 nt, Human
ccgacucccaggagcucaagccaagcccagag

SEQ ID NO: 108667 - RNA, 32 nt, Human
ccgacucccucccuagugcuccuuccucaccc

SEQ ID NO: 108668 - RNA, 32 nt, Human
ccgacuccgacacggcuccaccauggaggagg

SEQ ID NO: 108669 - RNA, 32 nt, Human
ccgacuccgggaccugcuggacauugccaacg

SEQ ID NO: 108670 - RNA, 19 nt, Human
ccgacuccucccugagcca

SEQ ID NO: 108671 - RNA, 32 nt, Human
ccgacuccuuccucccccuucccucccccuuu

SEQ ID NO: 108672 - RNA, 32 nt, Human
ccgacucgcgagugaggaaaagaaggaaaggg

SEQ ID NO: 108673 - RNA, 32 nt, Human
ccgacucggcaccaucaccccgcucaccacuu

SEQ ID NO: 108674 - RNA, 32 nt, Human
ccgacucugccccagcccuggggauucauccu

SEQ ID NO: 108675 - RNA, 32 nt, Human
ccgacucuggagcccaggcuguugcuuuccag

SEQ ID NO: 108676 - RNA, 32 nt, Human
ccgacucugggcaacagagcaagacucugucu

SEQ ID NO: 108677 - RNA, 32 nt, Human
ccgacucuugccuggggacccauucuaugccu

SEQ ID NO: 108678 - RNA, 20 nt, Human
ccgacucuugcucugaguua

SEQ ID NO: 108679 - RNA, 32 nt, Human
ccgacugcaucucugggcaagcggcgcuuugc

SEQ ID NO: 108680 - RNA, 32 nt, Human
ccgacugccaaaguaaccaucauccauauggg

SEQ ID NO: 108681 - RNA, 32 nt, Human
ccgacugcuaugccgagcaggugguggcucgu

SEQ ID NO: 108682 - RNA, 32 nt, Human
ccgacuggagccuggagguucacaguggauuu

SEQ ID NO: 108683 - RNA, 21 nt, Human
ccgacuggccuggccacacug

SEQ ID NO: 108684 - RNA, 31 nt, Human
ccgacuggcuucuguagaugccaaagggcuc

SEQ ID NO: 108685 - RNA, 32 nt, Human
ccgacugggaaaugcagagcucagagagacag

SEQ ID NO: 108686 - RNA, 32 nt, Human
ccgacugggcagcuccuuuccuucccugacgc

SEQ ID NO: 108687 - RNA, 32 nt, Human
ccgacugugcugcucgcgaaggucccacagcc

SEQ ID NO: 108688 - RNA, 31 nt, Human
ccgacuuccuuccccuccccugugucugucu

SEQ ID NO: 108689 - RNA, 32 nt, Human
ccgacuucuccuccccuacccuugccgcccgu

SEQ ID NO: 108690 - RNA, 20 nt, Human
ccgacuuuuggccugagcca

SEQ ID NO: 108691 - RNA, 32 nt, Human
ccgagaaacugggcgucucucccaggaccaca

SEQ ID NO: 108692 - RNA, 32 nt, Human
ccgagaagaaggaggaagcagggguggcggcu

SEQ ID NO: 108693 - RNA, 32 nt, Human
ccgagaagagagagcucugggccuucuuccug

SEQ ID NO: 108694 - RNA, 32 nt, Human
ccgagaaggaggaggaggagagaggaaagagc

SEQ ID NO: 108695 - RNA, 24 nt, Human
ccgagaagggacggucaucugcuc

SEQ ID NO: 108696 - RNA, 32 nt, Human
ccgagaagggagugcggagaggcgccggucgc

SEQ ID NO: 108697 - RNA, 32 nt, Human
ccgagaaggggagggagggcagaggaggggga

SEQ ID NO: 108698 - RNA, 32 nt, Human
ccgagaaggggagggggcgccgccgccgcugc

SEQ ID NO: 108699 - RNA, 32 nt, Human
ccgagaaggggguggucauccccaggcuagcc

SEQ ID NO: 108700 - RNA, 32 nt, Human
ccgagaagucuguuccuuaucacguguguaag

SEQ ID NO: 108701 - RNA, 32 nt, Human
ccgagaaugccacugcacuacagccugggcga

SEQ ID NO: 108702 - RNA, 32 nt, Human
ccgagacacaggcacgggucccugccacgucc

SEQ ID NO: 108703 - RNA, 32 nt, Human
ccgagacacugaggcaggguagagagcgcuug

SEQ ID NO: 108704 - RNA, 32 nt, Human
ccgagacacugccaccuccacauagcucuccc

SEQ ID NO: 108705 - RNA, 32 nt, Human
ccgagacagccugagcccuggcccugcugcuu

SEQ ID NO: 108706 - RNA, 32 nt, Human
ccgagacaggcagaucacaaggucaggaguuu

SEQ ID NO: 108707 - RNA, 32 nt, Human
ccgagacaggcagaucacgaggucaacagauu

SEQ ID NO: 108708 - RNA, 32 nt, Human
ccgagacaggcagaucgcgaggucaggagauc

SEQ ID NO: 108709 - RNA, 32 nt, Human
ccgagacaggcggaucaccugaggucgggagu

SEQ ID NO: 108710 - RNA, 32 nt, Human
ccgagacagguggaucaccugaggucaggagu

SEQ ID NO: 108711 - RNA, 32 nt, Human
ccgagacauauagaauugggaacugauacaug

SEQ ID NO: 108712 - RNA, 32 nt, Human
ccgagaccagccugggcaacauagugagaccc

SEQ ID NO: 108713 - RNA, 32 nt, Human
ccgagaccagccuggggagccggugacugagu

SEQ ID NO: 108714 - RNA, 32 nt, Human
ccgagaccaucugcccagccucacugaggcuc

SEQ ID NO: 108715 - RNA, 21 nt, Human
ccgagacccagccccacgcug

SEQ ID NO: 108716 - RNA, 18 nt, Human
ccgagaccccggccccca

SEQ ID NO: 108717 - RNA, 32 nt, Human
ccgagaccucgaggguccgcuguggggagagg

SEQ ID NO: 108718 - RNA, 20 nt, Human
ccgagaccugggacugcaga

SEQ ID NO: 108719 - RNA, 32 nt, Human
ccgagacgggaggaucaguugaggucaggagu

SEQ ID NO: 108720 - RNA, 32 nt, Human
ccgagacgggcacaucauuugaggucaggagu

SEQ ID NO: 108721 - RNA, 32 nt, Human
ccgagacgggcagaucacuugaggucaggaga

SEQ ID NO: 108722 - RNA, 32 nt, Human
ccgagacgggcggaucaccugaggucaggagu

SEQ ID NO: 108723 - RNA, 32 nt, Human
ccgagacggguggaucaccugaggucaagagu

SEQ ID NO: 108724 - RNA, 32 nt, Human
ccgagacggguggaucaccugaggucaggggu

SEQ ID NO: 108725 - RNA, 32 nt, Human
ccgagacucacugaguugcgggggccuuggag

SEQ ID NO: 108726 - RNA, 32 nt, Human
ccgagacuccuuggguccuccccgcccucccu

SEQ ID NO: 108727 - RNA, 32 nt, Human
ccgagacugugcuccagccugggcgacagagc

SEQ ID NO: 108728 - RNA, 32 nt, Human
ccgagagaagaaaagcagguggaaggagagga

SEQ ID NO: 108729 - RNA, 24 nt, Human
ccgagagacggagguugcagugag

SEQ ID NO: 108730 - RNA, 32 nt, Human
ccgagagaucaaaggacacaaguguuacagaa

SEQ ID NO: 108731 - RNA, 32 nt, Human
ccgagagcagccacugccacucagucugacag

SEQ ID NO: 108732 - RNA, 32 nt, Human
ccgagagcagggggaacacauccaggcagcug

SEQ ID NO: 108733 - RNA, 32 nt, Human
ccgagagccccagaagucggcggggaaguuuc

SEQ ID NO: 108734 - RNA, 32 nt, Human
ccgagagcuauggacagcauugccaguaacac

SEQ ID NO: 108735 - RNA, 32 nt, Human
ccgagagcugugggaagagcugugggaucccc

SEQ ID NO: 108736 - RNA, 32 nt, Human
ccgagaggacugccuugcucaccuguccccuc

SEQ ID NO: 108737 - RNA, 21 nt, Human
ccgagaggagaagcgcagcgc

SEQ ID NO: 108738 - RNA, 19 nt, Human
ccgagaggagcagcagcgg

SEQ ID NO: 108739 - RNA, 22 nt, Human
ccgagaggagcccucuaccuug

SEQ ID NO: 108740 - RNA, 23 nt, Human
ccgagaggccaguugaucugcuc

SEQ ID NO: 108741 - RNA, 24 nt, Human
ccgagaggcggaaguugcagugag

SEQ ID NO: 108742 - RNA, 23 nt, Human
ccgagaggcggagagaauguggg

SEQ ID NO: 108743 - RNA, 24 nt, Human
ccgagaggcggagguggcagugag

SEQ ID NO: 108744 - RNA, 22 nt, Human
ccgagaggcggagguugcagug

SEQ ID NO: 108745 - RNA, 24 nt, Human
ccgagaggcggagguugcagugag

SEQ ID NO: 108746 - RNA, 32 nt, Human
ccgagagggcgccugcuccugagacacaggcc

SEQ ID NO: 108747 - RNA, 23 nt, Human
ccgagagggcuggagugcagugg

SEQ ID NO: 108748 - RNA, 32 nt, Human
ccgagagggcuggagugcaguggcgugaucug

SEQ ID NO: 108749 - RNA, 32 nt, Human
ccgagaggugccgaaggaaccggcgggccgcu

SEQ ID NO: 108750 - RNA, 24 nt, Human
ccgagagguggagguugaagugag

SEQ ID NO: 108751 - RNA, 32 nt, Human
ccgagaguccucagugaaaggauuccgcggca

SEQ ID NO: 108752 - RNA, 32 nt, Human
ccgagagugcgccacuucacuccagccugggc

SEQ ID NO: 108753 - RNA, 32 nt, Human
ccgagaguggcagagaccuguauaugugaccu

SEQ ID NO: 108754 - RNA, 32 nt, Human
ccgagaucacaccaccacuccagccugggcga

SEQ ID NO: 108755 - RNA, 32 nt, Human
ccgagaucauccuggcuaacacggugaaaccc

SEQ ID NO: 108756 - RNA, 32 nt, Human
ccgagaucaugccacugcacugggcaacagag

SEQ ID NO: 108757 - RNA, 32 nt, Human
ccgagaucaugccauuacuccagccuggguga

SEQ ID NO: 108758 - RNA, 32 nt, Human
ccgagaucaugccauuguacuucaccugggca

SEQ ID NO: 108759 - RNA, 32 nt, Human
ccgagaucccgccacucacuccagccuggaua

SEQ ID NO: 108760 - RNA, 32 nt, Human
ccgagauccgccacugcacuccagccugggug

SEQ ID NO: 108761 - RNA, 32 nt, Human
ccgagaucgcgccacuacuccagccuggguga

SEQ ID NO: 108762 - RNA, 32 nt, Human
ccgagaucgugccacuugccuaggcgagugag

SEQ ID NO: 108763 - RNA, 32 nt, Human
ccgagaucugccacugcacuccagccuggcga

SEQ ID NO: 108764 - RNA, 32 nt, Human
ccgagaugaaaaccuccagccagcccagcgcu

SEQ ID NO: 108765 - RNA, 32 nt, Human
ccgagaugaccucguccucaguguggcccugc

SEQ ID NO: 108766 - RNA, 32 nt, Human
ccgagaugacugcccaggaccuggugagccua

SEQ ID NO: 108767 - RNA, 30 nt, Human
ccgagaugagcagcagcugcucagggcuga

SEQ ID NO: 108768 - RNA, 32 nt, Human
ccgagauggacccugggcucggcguccuccgg

SEQ ID NO: 108769 - RNA, 32 nt, Human
ccgagauggcuggaucaucugaggucaggagu

SEQ ID NO: 108770 - RNA, 32 nt, Human
ccgagauggguggaucaccugaggucaggagu

SEQ ID NO: 108771 - RNA, 32 nt, Human
ccgagauggguggaucaucugaggucaggagu

SEQ ID NO: 108772 - RNA, 32 nt, Human
ccgagauugccacugcacuccagccugggcaa

SEQ ID NO: 108773 - RNA, 32 nt, Human
ccgagauuggccauugcacuccagccugggug

SEQ ID NO: 108774 - RNA, 32 nt, Human
ccgagauugugcacuccagccuggguaacaga

SEQ ID NO: 108775 - RNA, 32 nt, Human
ccgagauugugcauugcacuccagccugagca

SEQ ID NO: 108776 - RNA, 32 nt, Human
ccgagauugugccacugaacuccaaccugcac

SEQ ID NO: 108777 - RNA, 32 nt, Human
ccgagauuuucugagcucuccccaaucaccag

SEQ ID NO: 108778 - RNA, 21 nt, Human
ccgagcaaaugcaaggucuag

SEQ ID NO: 108779 - RNA, 21 nt, Human
ccgagcaaaugccaggucuag

SEQ ID NO: 108780 - RNA, 32 nt, Human
ccgagcaagaaaaguggaucucagggaggacu

SEQ ID NO: 108781 - RNA, 32 nt, Human
ccgagcaagaagcagcucccagagagaaagaa

SEQ ID NO: 108782 - RNA, 32 nt, Human
ccgagcaagauuccucccucccucccuccuag

SEQ ID NO: 108783 - RNA, 22 nt, Human
ccgagcaagcgggcccggggcu

SEQ ID NO: 108784 - RNA, 32 nt, Human
ccgagcaagggucgucggcauccaggccugug

SEQ ID NO: 108785 - RNA, 32 nt, Human
ccgagcacagccgugccucgguccgccacggc

SEQ ID NO: 108786 - RNA, 32 nt, Human
ccgagcacaggcgauccucccgccucagccuc

SEQ ID NO: 108787 - RNA, 32 nt, Human
ccgagcacaguggcucaugccuguaaucccag

SEQ ID NO: 108788 - RNA, 19 nt, Human
ccgagcaccagacugcaga

SEQ ID NO: 108789 - RNA, 32 nt, Human
ccgagcagacggaguacacggagcagcggccc

SEQ ID NO: 108790 - RNA, 23 nt, Human
ccgagcagcgcaggauccagguu

SEQ ID NO: 108791 - RNA, 32 nt, Human
ccgagcagcuggcccggcugggcccggggcgc

SEQ ID NO: 108792 - RNA, 23 nt, Human
ccgagcaggagccgugggaccgg

SEQ ID NO: 108793 - RNA, 32 nt, Human
ccgagcaggaggaggaggaagccggagcugcc

SEQ ID NO: 108794 - RNA, 32 nt, Human
ccgagcaggccuggccgcgcucuccccgcuuc

SEQ ID NO: 108795 - RNA, 29 nt, Human
ccgagcaggcuccugccaucccccauggg

SEQ ID NO: 108796 - RNA, 32 nt, Human
ccgagcaggcuccuugcaaagacagcagcgug

SEQ ID NO: 108797 - RNA, 32 nt, Human
ccgagcaguucugguuccuccuggccauccgc

SEQ ID NO: 108798 - RNA, 32 nt, Human
ccgagcauaguggcacaugccuguaaucccag

SEQ ID NO: 108799 - RNA, 32 nt, Human
ccgagcaugguggcgggcaccuguaaucccag

SEQ ID NO: 108800 - RNA, 32 nt, Human
ccgagcaugguggcucaugccuguaaucccac

SEQ ID NO: 108801 - RNA, 32 nt, Human
ccgagccaaguggaucacuugaggucaggagu

SEQ ID NO: 108802 - RNA, 20 nt, Human
ccgagccacccaccagaccg

SEQ ID NO: 108803 - RNA, 21 nt, Human
ccgagccacucgccgccgcgc

SEQ ID NO: 108804 - RNA, 32 nt, Human
ccgagccacuguacuccagccuaggugacaaa

SEQ ID NO: 108805 - RNA, 32 nt, Human
ccgagccagcaagaggaaggggugcugugagg

SEQ ID NO: 108806 - RNA, 32 nt, Human
ccgagccagcccagagaggagcaugucuuccu

SEQ ID NO: 108807 - RNA, 22 nt, Human
ccgagccagccgugcgccgcgc

SEQ ID NO: 108808 - RNA, 20 nt, Human
ccgagccagcgaaccccagc

SEQ ID NO: 108809 - RNA, 25 nt, Human
ccgagccagcgagccagcgagccgc

SEQ ID NO: 108810 - RNA, 32 nt, Human
ccgagccaugagcugcuacaucaaaagucugc

SEQ ID NO: 108811 - RNA, 22 nt, Human
ccgagcccacucgagccgcagc

SEQ ID NO: 108812 - RNA, 32 nt, Human
ccgagcccagaggccugggccugcacugccug

SEQ ID NO: 108813 - RNA, 32 nt, Human
ccgagcccagcacggcaagggugcaggggcug

SEQ ID NO: 108814 - RNA, 32 nt, Human
ccgagcccaucaaccuggacagcugucuccgu

SEQ ID NO: 108815 - RNA, 32 nt, Human
ccgagccccacacccacaucacccaugugcau

SEQ ID NO: 108816 - RNA, 32 nt, Human
ccgagccccagagggaucuccaugaaugucag

SEQ ID NO: 108817 - RNA, 32 nt, Human
ccgagccccagcccggccgccauggacgacaa

SEQ ID NO: 108818 - RNA, 32 nt, Human
ccgagccccuggcaaccacuaaucuauuucuc

SEQ ID NO: 108819 - RNA, 32 nt, Human
ccgagccccuggcugcaaaagcagagguugcc

SEQ ID NO: 108820 - RNA, 21 nt, Human
ccgagcccgagccgcagccgc

SEQ ID NO: 108821 - RNA, 17 nt, Human
ccgagcccuccacacca

SEQ ID NO: 108822 - RNA, 20 nt, Human
ccgagcccugcucacugccu

SEQ ID NO: 108823 - RNA, 32 nt, Human
ccgagcccugcuccuugugggcgcucacacug

SEQ ID NO: 108824 - RNA, 22 nt, Human
ccgagcccuugacaccacgccc

SEQ ID NO: 108825 - RNA, 19 nt, Human
ccgagcccuugccccugcc

SEQ ID NO: 108826 - RNA, 32 nt, Human
ccgagccgcaggggcgcucugaaggggccugg

SEQ ID NO: 108827 - RNA, 32 nt, Human
ccgagccgcaggucugcugggccuggcacugc

SEQ ID NO: 108828 - RNA, 32 nt, Human
ccgagccgcugcccucaaaacggagggggcac

SEQ ID NO: 108829 - RNA, 32 nt, Human
ccgagccggagccggagccacagcggggaggg

SEQ ID NO: 108830 - RNA, 32 nt, Human
ccgagccggccgagcgagcagcgcggcagcac

SEQ ID NO: 108831 - RNA, 20 nt, Human
ccgagccggcggggagccgg

SEQ ID NO: 108832 - RNA, 32 nt, Human
ccgagccgggcggaucaccuguggucaggagu

SEQ ID NO: 108833 - RNA, 23 nt, Human
ccgagccuaggcaacaagaguga

SEQ ID NO: 108834 - RNA, 31 nt, Human
ccgagccucaguuucugacugcagaagagcc

SEQ ID NO: 108835 - RNA, 32 nt, Human
ccgagccucuacuguauaccaggggcuaacuc

SEQ ID NO: 108836 - RNA, 21 nt, Human
ccgagccugagccgcaaucgc

SEQ ID NO: 108837 - RNA, 32 nt, Human
ccgagccugcagccgagcuccgcugccggccc

SEQ ID NO: 108838 - RNA, 32 nt, Human
ccgagccugccuguguccuacagaugcacacu

SEQ ID NO: 108839 - RNA, 32 nt, Human
ccgagccugguggugcgugccuguaaucccag

SEQ ID NO: 108840 - RNA, 22 nt, Human
ccgagccuguuagacgcagcgc

SEQ ID NO: 108841 - RNA, 32 nt, Human
ccgagccuguuccagauagacucucucucuuu

SEQ ID NO: 108842 - RNA, 20 nt, Human
ccgagccuuugcagagaggc

SEQ ID NO: 108843 - RNA, 32 nt, Human
ccgagcgagccgcggggcccgcgcagccccgg

SEQ ID NO: 108844 - RNA, 32 nt, Human
ccgagcgcaguggcucacgccuguaaucccag

SEQ ID NO: 108845 - RNA, 23 nt, Human
ccgagcgccccggagccgcaggc

SEQ ID NO: 108846 - RNA, 19 nt, Human
ccgagcgccgccgccgccg

SEQ ID NO: 108847 - RNA, 18 nt, Human
ccgagcgccgcuccggcu

SEQ ID NO: 108848 - RNA, 32 nt, Human
ccgagcgcgauggcucauaccuguaaucccag

SEQ ID NO: 108849 - RNA, 32 nt, Human
ccgagcgcggagccaugggccgggcuggcacc

SEQ ID NO: 108850 - RNA, 32 nt, Human
ccgagcggaggagcgagagggacgcgagcaag

SEQ ID NO: 108851 - RNA, 32 nt, Human
ccgagcggaggcggagucggcgccgagaacau

SEQ ID NO: 108852 - RNA, 18 nt, Human
ccgagcggccaccgagcc

SEQ ID NO: 108853 - RNA, 18 nt, Human
ccgagcggcccacggcca

SEQ ID NO: 108854 - RNA, 20 nt, Human
ccgagcggccgccgcugccg

SEQ ID NO: 108855 - RNA, 32 nt, Human
ccgagcggggagcaaggccugcggggaggcgc

SEQ ID NO: 108856 - RNA, 20 nt, Human
ccgagcggggucccgagcua

SEQ ID NO: 108857 - RNA, 19 nt, Human
ccgagcgugaguccaggcu

SEQ ID NO: 108858 - RNA, 32 nt, Human
ccgagcgugauggcucaccccuguaaucccag

SEQ ID NO: 108859 - RNA, 32 nt, Human
ccgagcgugaugguggaugccuguaauccuag

SEQ ID NO: 108860 - RNA, 32 nt, Human
ccgagcgugguggcucacaccuguaaucccag

SEQ ID NO: 108861 - RNA, 32 nt, Human
ccgagcgugguggcucacgccuguaaucccaa

SEQ ID NO: 108862 - RNA, 32 nt, Human
ccgagcuacaaagcaugggaaaaagagacucu

SEQ ID NO: 108863 - RNA, 32 nt, Human
ccgagcuauuuucuugcuguggccucuggugc

SEQ ID NO: 108864 - RNA, 32 nt, Human
ccgagcucagggguuugagaccagccugggca

SEQ ID NO: 108865 - RNA, 32 nt, Human
ccgagcucaguggauguuugaacuugcuccag

SEQ ID NO: 108866 - RNA, 19 nt, Human
ccgagcuccugaagccggg

SEQ ID NO: 108867 - RNA, 32 nt, Human
ccgagcucguguauccuggggcucccuucauc

SEQ ID NO: 108868 - RNA, 19 nt, Human
ccgagcugcaagccugccu

SEQ ID NO: 108869 - RNA, 22 nt, Human
ccgagcugccacggccgccucc

SEQ ID NO: 108870 - RNA, 32 nt, Human
ccgagcugcgggaguacugccucccaggcccu

SEQ ID NO: 108871 - RNA, 32 nt, Human
ccgagcugcuggugcugacccugagcgccgag

SEQ ID NO: 108872 - RNA, 32 nt, Human
ccgagcuggguugccccacugugcuuguaucu

SEQ ID NO: 108873 - RNA, 32 nt, Human
ccgaggaacugggcgcuugcagugcguugcac

SEQ ID NO: 108874 - RNA, 32 nt, Human
ccgaggaagaggaggaagaugaagaccaggac

SEQ ID NO: 108875 - RNA, 32 nt, Human
ccgaggaaggaguucaaguccagccuggacgg

SEQ ID NO: 108876 - RNA, 19 nt, Human
ccgaggaaggaugcgguga

SEQ ID NO: 108877 - RNA, 20 nt, Human
ccgaggaaguucccagcaga

SEQ ID NO: 108878 - RNA, 32 nt, Human
ccgaggaauaggggaggguuaauaagacucca

SEQ ID NO: 108879 - RNA, 32 nt, Human
ccgaggacagccaggacccaggggaagacaca

SEQ ID NO: 108880 - RNA, 23 nt, Human
ccgaggaccgccaccucuuccca

SEQ ID NO: 108881 - RNA, 32 nt, Human
ccgaggaccggcugccccgccuggaggagauc

SEQ ID NO: 108882 - RNA, 32 nt, Human
ccgaggacgggacccgcugagcucugggugag

SEQ ID NO: 108883 - RNA, 21 nt, Human
ccgaggacguggcugcucuga

SEQ ID NO: 108884 - RNA, 32 nt, Human
ccgaggagacaagagaaagaugaagaucauca

SEQ ID NO: 108885 - RNA, 32 nt, Human
ccgaggagaccacgcuccuggagcucugcugu

SEQ ID NO: 108886 - RNA, 32 nt, Human
ccgaggagaccaggaacccugcuucagcagcc

SEQ ID NO: 108887 - RNA, 32 nt, Human
ccgaggagagggugucuggugccugaaugaca

SEQ ID NO: 108888 - RNA, 32 nt, Human
ccgaggagcccaaagcccuacccucaccauuc

SEQ ID NO: 108889 - RNA, 32 nt, Human
ccgaggagcccgccaacccgaccaugaacuca

SEQ ID NO: 108890 - RNA, 22 nt, Human
ccgaggagcugggauuacaggc

SEQ ID NO: 108891 - RNA, 32 nt, Human
ccgaggagcugugguccagccugcgcggcggg

SEQ ID NO: 108892 - RNA, 32 nt, Human
ccgaggaggaagggaaggggcucugugugccc

SEQ ID NO: 108893 - RNA, 32 nt, Human
ccgaggaggaaggggcuccgugcacuugcagg

SEQ ID NO: 108894 - RNA, 32 nt, Human
ccgaggaggaggaggaggaggaggacgcgggc

SEQ ID NO: 108895 - RNA, 32 nt, Human
ccgaggaggaggaggaggaggaggaggaggcg

SEQ ID NO: 108896 - RNA, 32 nt, Human
ccgaggaggaggaggaugaggaguaugccgag

SEQ ID NO: 108897 - RNA, 32 nt, Human
ccgaggaggcagagcuugcagugagccaagau

SEQ ID NO: 108898 - RNA, 32 nt, Human
ccgaggaggccauggagccaggggaaucauug

SEQ ID NO: 108899 - RNA, 32 nt, Human
ccgaggaggcccacgcccaccaugguccccug

SEQ ID NO: 108900 - RNA, 32 nt, Human
ccgaggaggcgaagguugcagugagccgagau

SEQ ID NO: 108901 - RNA, 32 nt, Human
ccgaggagggaggaucaccugaggucaggagu

SEQ ID NO: 108902 - RNA, 32 nt, Human
ccgaggagggcagaucaacugaggucaggagu

SEQ ID NO: 108903 - RNA, 24 nt, Human
ccgaggagggcagaucacuugaga

SEQ ID NO: 108904 - RNA, 32 nt, Human
ccgaggagggcagaucacuugaggucaggagu

SEQ ID NO: 108905 - RNA, 32 nt, Human
ccgaggagggcagaucaucugaggucaggagu

SEQ ID NO: 108906 - RNA, 32 nt, Human
ccgaggagggccgaucaccugaggucaggagu

SEQ ID NO: 108907 - RNA, 32 nt, Human
ccgaggagguggcagugcaagacacugccggg

SEQ ID NO: 108908 - RNA, 32 nt, Human
ccgaggaucccaggaggaaggauggggcaaga

SEQ ID NO: 108909 - RNA, 21 nt, Human
ccgaggaugcccagccucccc

SEQ ID NO: 108910 - RNA, 32 nt, Human
ccgaggauuuuccagcccuuccuuuucuuucu

SEQ ID NO: 108911 - RNA, 32 nt, Human
ccgaggcacagcccagcugggcuaggccggug

SEQ ID NO: 108912 - RNA, 32 nt, Human
ccgaggcacagcccagcuggggcuaggcccgg

SEQ ID NO: 108913 - RNA, 32 nt, Human
ccgaggcaccacuguuucuugccuggaguugu

SEQ ID NO: 108914 - RNA, 32 nt, Human
ccgaggcaccugcugguucucccauccauggc

SEQ ID NO: 108915 - RNA, 32 nt, Human
ccgaggcacuguggcccagcaggugacugguu

SEQ ID NO: 108916 - RNA, 32 nt, Human
ccgaggcagacagaucaccugaggucaggagu

SEQ ID NO: 108917 - RNA, 32 nt, Human
ccgaggcagacggaucacuugaggucaggagu

SEQ ID NO: 108918 - RNA, 32 nt, Human
ccgaggcagcagagccgaggagagcaggucca

SEQ ID NO: 108919 - RNA, 32 nt, Human
ccgaggcagcgggcagacgagcagggggcggg

SEQ ID NO: 108920 - RNA, 32 nt, Human
ccgaggcaggaagaucauugagcucaggaguu

SEQ ID NO: 108921 - RNA, 32 nt, Human
ccgaggcaggaggaucaccugaggucaggagu

SEQ ID NO: 108922 - RNA, 32 nt, Human
ccgaggcaggaggaucacuugaggucaagagu

SEQ ID NO: 108923 - RNA, 32 nt, Human
ccgaggcaggaggaucacuugaggucaggagu

SEQ ID NO: 108924 - RNA, 32 nt, Human
ccgaggcaggcagaucacaaggucaagagauc

SEQ ID NO: 108925 - RNA, 32 nt, Human
ccgaggcaggcagaucacaaggucaggaguuc

SEQ ID NO: 108926 - RNA, 32 nt, Human
ccgaggcaggcagaucaccugaggucaagagu

SEQ ID NO: 108927 - RNA, 32 nt, Human
ccgaggcaggcagaucaccugaggucagaagu

SEQ ID NO: 108928 - RNA, 32 nt, Human
ccgaggcaggcagaucaccugaggucaggagu

SEQ ID NO: 108929 - RNA, 32 nt, Human
ccgaggcaggcagaucaccugaggucgggagu

SEQ ID NO: 108930 - RNA, 32 nt, Human
ccgaggcaggcagaucacgaggucaggagauc

SEQ ID NO: 108931 - RNA, 32 nt, Human
ccgaggcaggcagaucacgaggucaggagguc

SEQ ID NO: 108932 - RNA, 32 nt, Human
ccgaggcaggcagaucacuugaggucaggagu

SEQ ID NO: 108933 - RNA, 32 nt, Human
ccgaggcaggcagaucgcuugaggucaggagu

SEQ ID NO: 108934 - RNA, 32 nt, Human
ccgaggcaggcaggucacuugaggucaggagu

SEQ ID NO: 108935 - RNA, 32 nt, Human
ccgaggcaggccaaucaccugaggucacaagu

SEQ ID NO: 108936 - RNA, 32 nt, Human
ccgaggcaggcggaucacaugaggucaggagu

SEQ ID NO: 108937 - RNA, 32 nt, Human
ccgaggcaggcggaucaccugaaaucaggagu

SEQ ID NO: 108938 - RNA, 32 nt, Human
ccgaggcaggcggaucaccugaggucaggagu

SEQ ID NO: 108939 - RNA, 32 nt, Human
ccgaggcaggcggaucaccugaggucgggagu

SEQ ID NO: 108940 - RNA, 32 nt, Human
ccgaggcaggcggaucaccugaggugaggagu

SEQ ID NO: 108941 - RNA, 32 nt, Human
ccgaggcaggcggaucaccugagguugggagu

SEQ ID NO: 108942 - RNA, 24 nt, Human
ccgaggcaggcggaucacuuaaga

SEQ ID NO: 108943 - RNA, 32 nt, Human
ccgaggcaggcggaucacuugaggucagcagu

SEQ ID NO: 108944 - RNA, 32 nt, Human
ccgaggcaggcggaucacuugaggucaggagu

SEQ ID NO: 108945 - RNA, 32 nt, Human
ccgaggcaggcggauuaccugaggucaggagu

SEQ ID NO: 108946 - RNA, 32 nt, Human
ccgaggcaggcggauugccugaggucaggagu

SEQ ID NO: 108947 - RNA, 32 nt, Human
ccgaggcagggggaucaccugaggucucgagu

SEQ ID NO: 108948 - RNA, 32 nt, Human
ccgaggcagggugcgacccaggacccaggacg

SEQ ID NO: 108949 - RNA, 32 nt, Human
ccgaggcagguacaucaccugaggucaagagu

SEQ ID NO: 108950 - RNA, 24 nt, Human
ccgaggcagguggaacacuugaga

SEQ ID NO: 108951 - RNA, 18 nt, Human
ccgaggcagguggaucac

SEQ ID NO: 108952 - RNA, 32 nt, Human
ccgaggcagguggaucaccugacgucaguagu

SEQ ID NO: 108953 - RNA, 24 nt, Human
ccgaggcagguggaucaccugaga

SEQ ID NO: 108954 - RNA, 32 nt, Human
ccgaggcagguggaucaccugagaucaggagu

SEQ ID NO: 108955 - RNA, 32 nt, Human
ccgaggcagguggaucaccugaggucagaagu

SEQ ID NO: 108956 - RNA, 32 nt, Human
ccgaggcagguggaucaccugaggucaggagu

SEQ ID NO: 108957 - RNA, 32 nt, Human
ccgaggcagguggaucaccugaggucaggggc

SEQ ID NO: 108958 - RNA, 32 nt, Human
ccgaggcagguggaucaccugaggucaguuca

SEQ ID NO: 108959 - RNA, 32 nt, Human
ccgaggcagguggaucaccugagguccggagu

SEQ ID NO: 108960 - RNA, 32 nt, Human
ccgaggcagguggaucaccugaggucgggagu

SEQ ID NO: 108961 - RNA, 32 nt, Human
ccgaggcagguggaucaccugggucgggaguu

SEQ ID NO: 108962 - RNA, 32 nt, Human
ccgaggcagguggaucacgugaggucaggagu

SEQ ID NO: 108963 - RNA, 24 nt, Human
ccgaggcagguggaucacuugaga

SEQ ID NO: 108964 - RNA, 32 nt, Human
ccgaggcagguggaucacuugaggucaggagu

SEQ ID NO: 108965 - RNA, 32 nt, Human
ccgaggcagguggaucauuugaggucaggagu

SEQ ID NO: 108966 - RNA, 32 nt, Human
ccgaggcagguggauugccugaggucaggagu

SEQ ID NO: 108967 - RNA, 32 nt, Human
ccgaggcagguugaucaccugaggucaggagu

SEQ ID NO: 108968 - RNA, 32 nt, Human
ccgaggcagugggaagagaugcggccccugga

SEQ ID NO: 108969 - RNA, 32 nt, Human
ccgaggcaguuggaucaccugagguuaggagu

SEQ ID NO: 108970 - RNA, 32 nt, Human
ccgaggcaugagccaccacgccaagcccaggc

SEQ ID NO: 108971 - RNA, 32 nt, Human
ccgaggcaugcggaucacuugaggucaggagu

SEQ ID NO: 108972 - RNA, 32 nt, Human
ccgaggcauguggaucaccugaggucaggagu

SEQ ID NO: 108973 - RNA, 32 nt, Human
ccgaggccagagccaugggcgagaccaagauc

SEQ ID NO: 108974 - RNA, 32 nt, Human
ccgaggccagcaccugggugaaguugcgucau

SEQ ID NO: 108975 - RNA, 18 nt, Human
ccgaggccagcccugccu

SEQ ID NO: 108976 - RNA, 32 nt, Human
ccgaggccagcuggcugcaggugcagggcuau

SEQ ID NO: 108977 - RNA, 22 nt, Human
ccgaggccaggcauccgccgcc

SEQ ID NO: 108978 - RNA, 32 nt, Human
ccgaggccaguggaucaccugaggucaggagu

SEQ ID NO: 108979 - RNA, 32 nt, Human
ccgaggccccagcuucauccagcuucaaccaa

SEQ ID NO: 108980 - RNA, 32 nt, Human
ccgaggcccccgagccccaaggccaacagaga

SEQ ID NO: 108981 - RNA, 32 nt, Human
ccgaggccccugggagacccuggggaggugaa

SEQ ID NO: 108982 - RNA, 32 nt, Human
ccgaggcccgagggagagggaagagcgccggg

SEQ ID NO: 108983 - RNA, 32 nt, Human
ccgaggcccuccgcccugacccuccugcugcc

SEQ ID NO: 108984 - RNA, 22 nt, Human
ccgaggcccugagaaccccagg

SEQ ID NO: 108985 - RNA, 32 nt, Human
ccgaggcccugagccaccucugcugccgccug

SEQ ID NO: 108986 - RNA, 21 nt, Human
ccgaggccgccgccuccgccu

SEQ ID NO: 108987 - RNA, 32 nt, Human
ccgaggccgccgcggccguggcggcggagccc

SEQ ID NO: 108988 - RNA, 32 nt, Human
ccgaggccgcggagcucgcggaggcaaggccg

SEQ ID NO: 108989 - RNA, 23 nt, Human
ccgaggccgcugcgcccccgccu

SEQ ID NO: 108990 - RNA, 32 nt, Human
ccgaggccggcagaucaccugagaucagaagu

SEQ ID NO: 108991 - RNA, 32 nt, Human
ccgaggccggcgcaucaucugaggucaggagu

SEQ ID NO: 108992 - RNA, 32 nt, Human
ccgaggccggcggaugaccugaggucaggagu

SEQ ID NO: 108993 - RNA, 32 nt, Human
ccgaggccgguggaucacuugaggucagaagu

SEQ ID NO: 108994 - RNA, 32 nt, Human
ccgaggccugggaugagccaggacagcgggaa

SEQ ID NO: 108995 - RNA, 32 nt, Human
ccgaggcgagcagaucaccugagguccggauu

SEQ ID NO: 108996 - RNA, 32 nt, Human
ccgaggcgccuggaucaccugaggucaggagu

SEQ ID NO: 108997 - RNA, 32 nt, Human
ccgaggcgcgaggaggugaggcuggagcgcgg

SEQ ID NO: 108998 - RNA, 32 nt, Human
ccgaggcgcggcggcggcuggagcagcgcggu

SEQ ID NO: 108999 - RNA, 32 nt, Human
ccgaggcgcggcucggacuccagcauggcgac

SEQ ID NO: 109000 - RNA, 32 nt, Human
ccgaggcggauggaucaccugaggucgggaau

SEQ ID NO: 109001 - RNA, 32 nt, Human
ccgaggcgggaagaucacuugaggucaggagu

SEQ ID NO: 109002 - RNA, 32 nt, Human
ccgaggcgggaggaucaccugagguuaggagu

SEQ ID NO: 109003 - RNA, 32 nt, Human
ccgaggcgggcaaaucaccugaggucaggagc

SEQ ID NO: 109004 - RNA, 32 nt, Human
ccgaggcgggcagaucaccugaagucaggagu

SEQ ID NO: 109005 - RNA, 32 nt, Human
ccgaggcgggcagaucaccugaggucacgagu

SEQ ID NO: 109006 - RNA, 32 nt, Human
ccgaggcgggcagaucaccugaggucaggagu

SEQ ID NO: 109007 - RNA, 32 nt, Human
ccgaggcgggcagaucaccugaggucgggagu

SEQ ID NO: 109008 - RNA, 24 nt, Human
ccgaggcgggcagaucacuugaga

SEQ ID NO: 109009 - RNA, 32 nt, Human
ccgaggcgggcagaucacuugaggucaggagu

SEQ ID NO: 109010 - RNA, 32 nt, Human
ccgaggcgggcggaucaacugaggucgggagu

SEQ ID NO: 109011 - RNA, 32 nt, Human
ccgaggcgggcggaucaccugagaucaggagu

SEQ ID NO: 109012 - RNA, 32 nt, Human
ccgaggcgggcggaucaccugagaucugagga

SEQ ID NO: 109013 - RNA, 32 nt, Human
ccgaggcgggcggaucaccugaggucagaagu

SEQ ID NO: 109014 - RNA, 32 nt, Human
ccgaggcgggcggaucaccugaggucagcagu

SEQ ID NO: 109015 - RNA, 32 nt, Human
ccgaggcgggcggaucaccugaggucaggagu

SEQ ID NO: 109016 - RNA, 32 nt, Human
ccgaggcgggcggaucaccugagguggggagu

SEQ ID NO: 109017 - RNA, 32 nt, Human
ccgaggcgggcggaucaccugagguugggagu

SEQ ID NO: 109018 - RNA, 32 nt, Human
ccgaggcgggcggaucaccugaguucaggagu

SEQ ID NO: 109019 - RNA, 32 nt, Human
ccgaggcgggcggaucacuugaggucaggagu

SEQ ID NO: 109020 - RNA, 32 nt, Human
ccgaggcgggcggaucgccugaggucaggagc

SEQ ID NO: 109021 - RNA, 32 nt, Human
ccgaggcgggcggaucgcuugaggucaggagu

SEQ ID NO: 109022 - RNA, 32 nt, Human
ccgaggcgggcggaugaccugaggucaggagu

SEQ ID NO: 109023 - RNA, 32 nt, Human
ccgaggcgggcugaucgcuugaggucaggagu

SEQ ID NO: 109024 - RNA, 32 nt, Human
ccgaggcggggagaucaccugaggucaggagu

SEQ ID NO: 109025 - RNA, 32 nt, Human
ccgaggcggguagaucaccugagguuaggagu

SEQ ID NO: 109026 - RNA, 32 nt, Human
ccgaggcgggugaucacuugaggucaguaguu

SEQ ID NO: 109027 - RNA, 32 nt, Human
ccgaggcggguggaacacuugaggucaggggu

SEQ ID NO: 109028 - RNA, 32 nt, Human
ccgaggcggguggaccaccugaggucaggagu

SEQ ID NO: 109029 - RNA, 32 nt, Human
ccgaggcggguggaucacaugaggucaguagu

SEQ ID NO: 109030 - RNA, 32 nt, Human
ccgaggcggguggaucaccugaggacaggagu

SEQ ID NO: 109031 - RNA, 32 nt, Human
ccgaggcggguggaucaccugaggccaggagu

SEQ ID NO: 109032 - RNA, 32 nt, Human
ccgaggcggguggaucaccugaggucaggaau

SEQ ID NO: 109033 - RNA, 32 nt, Human
ccgaggcggguggaucaccugaggucaggagu

SEQ ID NO: 109034 - RNA, 32 nt, Human
ccgaggcggguggaucaccugaggucaguucg

SEQ ID NO: 109035 - RNA, 32 nt, Human
ccgaggcggguggaucaccugagguuaggagu

SEQ ID NO: 109036 - RNA, 24 nt, Human
ccgaggcggguggaucacuugaga

SEQ ID NO: 109037 - RNA, 32 nt, Human
ccgaggcggguggaucacuugaggucaggagc

SEQ ID NO: 109038 - RNA, 32 nt, Human
ccgaggcggguggaucacuugaggucaggagu

SEQ ID NO: 109039 - RNA, 32 nt, Human
ccgaggcggguggaucagcugaggucaggagu

SEQ ID NO: 109040 - RNA, 32 nt, Human
ccgaggcggguggaucauuugaggucaggagu

SEQ ID NO: 109041 - RNA, 32 nt, Human
ccgaggcggguggcucaccugaggucgggagu

SEQ ID NO: 109042 - RNA, 32 nt, Human
ccgaggcgggugggucaccugaggucaggagu

SEQ ID NO: 109043 - RNA, 32 nt, Human
ccgaggcggguggguuacuugaggucaggagu

SEQ ID NO: 109044 - RNA, 32 nt, Human
ccgaggcggguguaucaccugaggucaggagu

SEQ ID NO: 109045 - RNA, 32 nt, Human
ccgaggcggguguaucaccugaggucgggagu

SEQ ID NO: 109046 - RNA, 32 nt, Human
ccgaggcggucaccggagcuuaagccccgccg

SEQ ID NO: 109047 - RNA, 32 nt, Human
ccgaggcgucucagagagagccuggacagccg

SEQ ID NO: 109048 - RNA, 32 nt, Human
ccgaggcguguggaucaccugagaucgggagu

SEQ ID NO: 109049 - RNA, 21 nt, Human
ccgaggcuagaguacaguggc

SEQ ID NO: 109050 - RNA, 32 nt, Human
ccgaggcucgccccaaacggauuugcgugaaa

SEQ ID NO: 109051 - RNA, 32 nt, Human
ccgaggcugaaggaccugcuucccaggacccg

SEQ ID NO: 109052 - RNA, 19 nt, Human
ccgaggcugacccaggccc

SEQ ID NO: 109053 - RNA, 32 nt, Human
ccgaggcugagaaaccagggaggauagaggag

SEQ ID NO: 109054 - RNA, 32 nt, Human
ccgaggcugagcugagccuuuuccaggggcag

SEQ ID NO: 109055 - RNA, 32 nt, Human
ccgaggcugaggcauaaguggcaggauuucgg

SEQ ID NO: 109056 - RNA, 32 nt, Human
ccgaggcugcaccggcagaggcugcggggcgg

SEQ ID NO: 109057 - RNA, 32 nt, Human
ccgaggcugccaccucagcugccugucuguga

SEQ ID NO: 109058 - RNA, 32 nt, Human
ccgaggcugccccaggccggagcccagauacc

SEQ ID NO: 109059 - RNA, 19 nt, Human
ccgaggcuggagugcaaug

SEQ ID NO: 109060 - RNA, 19 nt, Human
ccgaggcuggagugcagug

SEQ ID NO: 109061 - RNA, 20 nt, Human
ccgaggcuggagugcagugg

SEQ ID NO: 109062 - RNA, 26 nt, Human
ccgaggcuggucuuugaggcugcaga

SEQ ID NO: 109063 - RNA, 19 nt, Human
ccgaggcuguccugggcca

SEQ ID NO: 109064 - RNA, 18 nt, Human
ccgaggcuguucugagcc

SEQ ID NO: 109065 - RNA, 32 nt, Human
ccgaggcuuccuggucuaagaguugcuggcaa

SEQ ID NO: 109066 - RNA, 32 nt, Human
ccgaggcuuccuggucuagaguugcuggcaag

SEQ ID NO: 109067 - RNA, 32 nt, Human
ccgagggacgccaugcggggaggcaggggcgc

SEQ ID NO: 109068 - RNA, 32 nt, Human
ccgagggagccacagcggguucuugaggaagg

SEQ ID NO: 109069 - RNA, 32 nt, Human
ccgagggagccacggccccgugaaccacgcug

SEQ ID NO: 109070 - RNA, 32 nt, Human
ccgagggagggaggguggggaagcgagggaaa

SEQ ID NO: 109071 - RNA, 32 nt, Human
ccgagggccacagccggacaggggguagcccc

SEQ ID NO: 109072 - RNA, 20 nt, Human
ccgagggcccaacacuggcc

SEQ ID NO: 109073 - RNA, 32 nt, Human
ccgagggcccagguccccaucaugcccucacc

SEQ ID NO: 109074 - RNA, 19 nt, Human
ccgagggcccggcccuguc

SEQ ID NO: 109075 - RNA, 32 nt, Human
ccgagggccgucucucccagccgaacacagcc

SEQ ID NO: 109076 - RNA, 32 nt, Human
ccgagggccuuggcugggucccagaaauuccc

SEQ ID NO: 109077 - RNA, 32 nt, Human
ccgagggcgccugcuccgugggccacgagggc

SEQ ID NO: 109078 - RNA, 32 nt, Human
ccgagggcgcugcgaccuccucccggaguuua

SEQ ID NO: 109079 - RNA, 32 nt, Human
ccgagggcgggggagagcgcgccgcugcuccc

SEQ ID NO: 109080 - RNA, 32 nt, Human
ccgaggggaguggaucacuugaggucaggagu

SEQ ID NO: 109081 - RNA, 22 nt, Human
ccgaggggauagaucacuugag

SEQ ID NO: 109082 - RNA, 32 nt, Human
ccgaggggcaggccuggcugcgcagggcgcgg

SEQ ID NO: 109083 - RNA, 32 nt, Human
ccgaggggcaguuucuggaggcugggggcacu

SEQ ID NO: 109084 - RNA, 32 nt, Human
ccgaggggcccgguccugccugucagcuccag

SEQ ID NO: 109085 - RNA, 32 nt, Human
ccgagggggaagaagcaugggcugaggugcua

SEQ ID NO: 109086 - RNA, 32 nt, Human
ccgagggggagugcugggggucucagcuggcu

SEQ ID NO: 109087 - RNA, 32 nt, Human
ccgaggggguggggguugcagugagccaagau

SEQ ID NO: 109088 - RNA, 32 nt, Human
ccgagggguuaugauggugagguggagcccaa

SEQ ID NO: 109089 - RNA, 32 nt, Human
ccgagggugggccucccaugccccaccguagc

SEQ ID NO: 109090 - RNA, 32 nt, Human
ccgaggguucgcccgcccuugguuuuccuuac

SEQ ID NO: 109091 - RNA, 32 nt, Human
ccgagguaaauggaugaccugaggucaagagu

SEQ ID NO: 109092 - RNA, 25 nt, Human
ccgagguagcugggacuacaggcgu

SEQ ID NO: 109093 - RNA, 32 nt, Human
ccgagguaggcggaucaccugaggucggaagu

SEQ ID NO: 109094 - RNA, 32 nt, Human
ccgagguaggcggaucaccugagguuaggagu

SEQ ID NO: 109095 - RNA, 32 nt, Human
ccgagguagguggaucgccugaggucagaagu

SEQ ID NO: 109096 - RNA, 32 nt, Human
ccgagguaucccagaggugacagaacuugauc

SEQ ID NO: 109097 - RNA, 32 nt, Human
ccgaggucaggaauucaacaccagccuggcca

SEQ ID NO: 109098 - RNA, 32 nt, Human
ccgaggucaggaauucgagaccagccugacca

SEQ ID NO: 109099 - RNA, 32 nt, Human
ccgaggucaggaguucaagaccagccuggcca

SEQ ID NO: 109100 - RNA, 32 nt, Human
ccgaggucaggaguucgagaccagccuggcca

SEQ ID NO: 109101 - RNA, 32 nt, Human
ccgaggucaggaguucgagaccagcuuggcca

SEQ ID NO: 109102 - RNA, 32 nt, Human
ccgaggucaggaguugaagaccagccuggcca

SEQ ID NO: 109103 - RNA, 32 nt, Human
ccgaggucgcgcugccuguguucuccgagggc

SEQ ID NO: 109104 - RNA, 32 nt, Human
ccgaggucucagacuccuggguaggggugggg

SEQ ID NO: 109105 - RNA, 19 nt, Human
ccgaggucugcagcgacuu

SEQ ID NO: 109106 - RNA, 32 nt, Human
ccgaggugagcagaucaccugagguuaggagu

SEQ ID NO: 109107 - RNA, 32 nt, Human
ccgaggugagcggaucaccugaggucaggagu

SEQ ID NO: 109108 - RNA, 32 nt, Human
ccgaggugaguggaucaccugaggucaggaau

SEQ ID NO: 109109 - RNA, 32 nt, Human
ccgaggugcauggaucacuugaggucaggagu

SEQ ID NO: 109110 - RNA, 32 nt, Human
ccgaggugcccagggaggcugagugggccacg

SEQ ID NO: 109111 - RNA, 32 nt, Human
ccgagguggauagaucacuugaggucaggagu

SEQ ID NO: 109112 - RNA, 32 nt, Human
ccgagguggauggaucaccugaggucaggagu

SEQ ID NO: 109113 - RNA, 32 nt, Human
ccgagguggccagaucaccugaggucaggagu

SEQ ID NO: 109114 - RNA, 32 nt, Human
ccgagguggccuggguggaggcuaugguggga

SEQ ID NO: 109115 - RNA, 32 nt, Human
ccgagguggcugggagguggcuccucaaacag

SEQ ID NO: 109116 - RNA, 32 nt, Human
ccgaggugggaagaucacuugaggucaggagu

SEQ ID NO: 109117 - RNA, 32 nt, Human
ccgaggugggaagauuguucaagagcagucug

SEQ ID NO: 109118 - RNA, 32 nt, Human
ccgaggugggacuggccucuccccgugugugu

SEQ ID NO: 109119 - RNA, 32 nt, Human
ccgaggugggaggaucaccugaggucaggagu

SEQ ID NO: 109120 - RNA, 32 nt, Human
ccgaggugggaggcaugggaaacagugcagug

SEQ ID NO: 109121 - RNA, 32 nt, Human
ccgaggugggcagaucaccugaggccaggagu

SEQ ID NO: 109122 - RNA, 32 nt, Human
ccgaggugggcagaucaccugaggucagcagu

SEQ ID NO: 109123 - RNA, 32 nt, Human
ccgaggugggcagaucaccugaggucaggagu

SEQ ID NO: 109124 - RNA, 32 nt, Human
ccgaggugggcagaucaccugaggucgggagu

SEQ ID NO: 109125 - RNA, 32 nt, Human
ccgaggugggcagaucacgagaucaggagauc

SEQ ID NO: 109126 - RNA, 24 nt, Human
ccgaggugggcagaucacuugaga

SEQ ID NO: 109127 - RNA, 32 nt, Human
ccgaggugggcagaucacuugaggucaggagu

SEQ ID NO: 109128 - RNA, 32 nt, Human
ccgaggugggcagaucagcugaggucaggaga

SEQ ID NO: 109129 - RNA, 32 nt, Human
ccgaggugggcagaucgccugaggucaggagu

SEQ ID NO: 109130 - RNA, 32 nt, Human
ccgaggugggcggaucaccugaagucaggagu

SEQ ID NO: 109131 - RNA, 32 nt, Human
ccgaggugggcggaucaccugaggucagaguu

SEQ ID NO: 109132 - RNA, 32 nt, Human
ccgaggugggcggaucaccugaggucagcagu

SEQ ID NO: 109133 - RNA, 32 nt, Human
ccgaggugggcggaucaccugaggucaggagu

SEQ ID NO: 109134 - RNA, 32 nt, Human
ccgaggugggcggaucaccugaggucaguuug

SEQ ID NO: 109135 - RNA, 32 nt, Human
ccgaggugggcggaucaccugaggucgggagu

SEQ ID NO: 109136 - RNA, 32 nt, Human
ccgaggugggcggaucacuugaggucaggagu

SEQ ID NO: 109137 - RNA, 32 nt, Human
ccgaggugggcggauccccugagguugggagu

SEQ ID NO: 109138 - RNA, 32 nt, Human
ccgaggugggcgggucaguugaggucaggagu

SEQ ID NO: 109139 - RNA, 32 nt, Human
ccgagguggggcaggcggagguugcaguaagc

SEQ ID NO: 109140 - RNA, 32 nt, Human
ccgaggugggucgacuaccugaggucaggagu

SEQ ID NO: 109141 - RNA, 32 nt, Human
ccgaggugggucgacuaccugagguuaggagu

SEQ ID NO: 109142 - RNA, 32 nt, Human
ccgaggugggugaaucacaugaggucaggagu

SEQ ID NO: 109143 - RNA, 32 nt, Human
ccgaggugggugaaucaccugaggucaggagu

SEQ ID NO: 109144 - RNA, 24 nt, Human
ccgagguggguggaccaccugaga

SEQ ID NO: 109145 - RNA, 32 nt, Human
ccgagguggguggaccaccugagguuaggacu

SEQ ID NO: 109146 - RNA, 31 nt, Human
ccgagguggguggaucacaagguugggagau

SEQ ID NO: 109147 - RNA, 32 nt, Human
ccgagguggguggaucaccugaagucaggagu

SEQ ID NO: 109148 - RNA, 32 nt, Human
ccgagguggguggaucaccugagaucaggagu

SEQ ID NO: 109149 - RNA, 32 nt, Human
ccgagguggguggaucaccugaggccaggagu

SEQ ID NO: 109150 - RNA, 32 nt, Human
ccgagguggguggaucaccugaggucagaugu

SEQ ID NO: 109151 - RNA, 32 nt, Human
ccgagguggguggaucaccugaggucaggagu

SEQ ID NO: 109152 - RNA, 32 nt, Human
ccgagguggguggaucaccugagguugggagu

SEQ ID NO: 109153 - RNA, 32 nt, Human
ccgagguggguggaucacuugaggucaggagu

SEQ ID NO: 109154 - RNA, 32 nt, Human
ccgagguggguggaucaguugaggucaggagu

SEQ ID NO: 109155 - RNA, 32 nt, Human
ccgagguggguggaucaucugaggucaggagu

SEQ ID NO: 109156 - RNA, 24 nt, Human
ccgagguggguggaucgccugaga

SEQ ID NO: 109157 - RNA, 32 nt, Human
ccgagguggguggauggaucaccugacguaga

SEQ ID NO: 109158 - RNA, 32 nt, Human
ccgaggugguuggauuaccugagguuaggagu

SEQ ID NO: 109159 - RNA, 32 nt, Human
ccgagguuguucucugcuguacugcaaguuug

SEQ ID NO: 109160 - RNA, 32 nt, Human
ccgaguaccuaggagaggacaagacuucugcu

SEQ ID NO: 109161 - RNA, 22 nt, Human
ccgaguaccugggauuacaggc

SEQ ID NO: 109162 - RNA, 32 nt, Human
ccgaguacuguguuuauucucucuccaggaaa

SEQ ID NO: 109163 - RNA, 24 nt, Human
ccgaguagcgaggacuacaggcgu

SEQ ID NO: 109164 - RNA, 22 nt, Human
ccgaguagcggggauuacaggc

SEQ ID NO: 109165 - RNA, 32 nt, Human
ccgaguagcuaaagcugagauuacaggcaugc

SEQ ID NO: 109166 - RNA, 24 nt, Human
ccgaguagcuaggauuacagaugu

SEQ ID NO: 109167 - RNA, 22 nt, Human
ccgaguagcuaggauuacaggc

SEQ ID NO: 109168 - RNA, 23 nt, Human
ccgaguagcuaggauuacaggcg

SEQ ID NO: 109169 - RNA, 22 nt, Human
ccgaguagcucagauuacaggc

SEQ ID NO: 109170 - RNA, 23 nt, Human
ccgaguagcugagauuacaggcg

SEQ ID NO: 109171 - RNA, 23 nt, Human
ccgaguagcugagauuacaggug

SEQ ID NO: 109172 - RNA, 22 nt, Human
ccgaguagcugagauuauaggc

SEQ ID NO: 109173 - RNA, 24 nt, Human
ccgaguagcugagauuauaggcgu

SEQ ID NO: 109174 - RNA, 32 nt, Human
ccgaguagcuggaacuacaggcgcccgccaug

SEQ ID NO: 109175 - RNA, 22 nt, Human
ccgaguagcuggaauuacaggc

SEQ ID NO: 109176 - RNA, 23 nt, Human
ccgaguagcuggaauuacaggug

SEQ ID NO: 109177 - RNA, 22 nt, Human
ccgaguagcuggcauuacaggc

SEQ ID NO: 109178 - RNA, 23 nt, Human
ccgaguagcuggcauuacaggcg

SEQ ID NO: 109179 - RNA, 32 nt, Human
ccgaguagcugggaccacaggcgcccccacca

SEQ ID NO: 109180 - RNA, 24 nt, Human
ccgaguagcugggaccacaggugu

SEQ ID NO: 109181 - RNA, 23 nt, Human
ccgaguagcugggacuacaggcg

SEQ ID NO: 109182 - RNA, 24 nt, Human
ccgaguagcugggacuacaggcgu

SEQ ID NO: 109183 - RNA, 23 nt, Human
ccgaguagcugggacuacaggug

SEQ ID NO: 109184 - RNA, 24 nt, Human
ccgaguagcugggacuacaggugu

SEQ ID NO: 109185 - RNA, 23 nt, Human
ccgaguagcugggacuauaggcg

SEQ ID NO: 109186 - RNA, 32 nt, Human
ccgaguagcugggagugcaggugcacaccgcc

SEQ ID NO: 109187 - RNA, 21 nt, Human
ccgaguagcugggaucgcagg

SEQ ID NO: 109188 - RNA, 23 nt, Human
ccgaguagcugggaucgcaggcg

SEQ ID NO: 109189 - RNA, 23 nt, Human
ccgaguagcugggauuacaagug

SEQ ID NO: 109190 - RNA, 20 nt, Human
ccgaguagcugggauuacag

SEQ ID NO: 109191 - RNA, 24 nt, Human
ccgaguagcugggauuacagaugu

SEQ ID NO: 109192 - RNA, 21 nt, Human
ccgaguagcugggauuacagg

SEQ ID NO: 109193 - RNA, 22 nt, Human
ccgaguagcugggauuacaggc

SEQ ID NO: 109194 - RNA, 23 nt, Human
ccgaguagcugggauuacaggcg

SEQ ID NO: 109195 - RNA, 24 nt, Human
ccgaguagcugggauuacaggcgu

SEQ ID NO: 109196 - RNA, 22 nt, Human
ccgaguagcugggauuacaggu

SEQ ID NO: 109197 - RNA, 23 nt, Human
ccgaguagcugggauuacaggug

SEQ ID NO: 109198 - RNA, 24 nt, Human
ccgaguagcugggauuacaggugu

SEQ ID NO: 109199 - RNA, 23 nt, Human
ccgaguagcugggauuacgggcg

SEQ ID NO: 109200 - RNA, 23 nt, Human
ccgaguagcugggauuagaggcg

SEQ ID NO: 109201 - RNA, 24 nt, Human
ccgaguagcugggauuagaggcgu

SEQ ID NO: 109202 - RNA, 22 nt, Human
ccgaguagcugggauuauaggc

SEQ ID NO: 109203 - RNA, 23 nt, Human
ccgaguagcugggauuauaggcg

SEQ ID NO: 109204 - RNA, 23 nt, Human
ccgaguagcugggauuccaggcg

SEQ ID NO: 109205 - RNA, 21 nt, Human
ccgaguagcugggauugcagg

SEQ ID NO: 109206 - RNA, 22 nt, Human
ccgaguagcugggauugcaggc

SEQ ID NO: 109207 - RNA, 23 nt, Human
ccgaguagcugggauugcaggcg

SEQ ID NO: 109208 - RNA, 24 nt, Human
ccgaguagcugggauugcaggcgu

SEQ ID NO: 109209 - RNA, 22 nt, Human
ccgaguagcugggguuacaggc

SEQ ID NO: 109210 - RNA, 24 nt, Human
ccgaguagcugggguuacaggcgu

SEQ ID NO: 109211 - RNA, 30 nt, Human
ccgaguagcuucuccauggagccugcccag

SEQ ID NO: 109212 - RNA, 32 nt, Human
ccgaguaguugggauuacaggugacugccacc

SEQ ID NO: 109213 - RNA, 32 nt, Human
ccgagucaccauuuccggcucagaccucgacc

SEQ ID NO: 109214 - RNA, 32 nt, Human
ccgagucacgccacugcacuccagccugggug

SEQ ID NO: 109215 - RNA, 32 nt, Human
ccgagucagaucugcacuagcaaccagaacua

SEQ ID NO: 109216 - RNA, 32 nt, Human
ccgagucagguggaucaccugaggucaggagu

SEQ ID NO: 109217 - RNA, 32 nt, Human
ccgagucaggugggucaccugaggucagcagu

SEQ ID NO: 109218 - RNA, 32 nt, Human
ccgaguccaaggacuugcucaaguggcagcgg

SEQ ID NO: 109219 - RNA, 23 nt, Human
ccgaguccagagagccgcggcgc

SEQ ID NO: 109220 - RNA, 32 nt, Human
ccgagucccaccuaaagaagcggucuggccac

SEQ ID NO: 109221 - RNA, 32 nt, Human
ccgaguccccacuccggagucgccgcugccgc

SEQ ID NO: 109222 - RNA, 32 nt, Human
ccgagucccgggagcgcggugggggcagcggg

SEQ ID NO: 109223 - RNA, 32 nt, Human
ccgagucccucuagcaucucccagaagguguc

SEQ ID NO: 109224 - RNA, 32 nt, Human
ccgaguccuucuugggggaaauagcagagccc

SEQ ID NO: 109225 - RNA, 32 nt, Human
ccgagucggaggggguggcagugagcggcggc

SEQ ID NO: 109226 - RNA, 32 nt, Human
ccgagucggguggaucaccugaggucagcagu

SEQ ID NO: 109227 - RNA, 19 nt, Human
ccgagucuccauccaccuu

SEQ ID NO: 109228 - RNA, 23 nt, Human
ccgagucucguuuccucucaguc

SEQ ID NO: 109229 - RNA, 32 nt, Human
ccgagucuguauacucagggugcucugggugg

SEQ ID NO: 109230 - RNA, 32 nt, Human
ccgagugagcugguuuaauacucugagaauga

SEQ ID NO: 109231 - RNA, 32 nt, Human
ccgagugagugccaucgucaccuacgugagcu

SEQ ID NO: 109232 - RNA, 25 nt, Human
ccgagugauggcggcuccccaggga

SEQ ID NO: 109233 - RNA, 32 nt, Human
ccgagugcaccacugcacuccagccugggcaa

SEQ ID NO: 109234 - RNA, 32 nt, Human
ccgagugcaggcccuuaccacugacauuucac

SEQ ID NO: 109235 - RNA, 32 nt, Human
ccgagugcaguggcucacgccuguaaucccag

SEQ ID NO: 109236 - RNA, 19 nt, Human
ccgagugccgcccgggcca

SEQ ID NO: 109237 - RNA, 21 nt, Human
ccgagugccuggauuacaggc

SEQ ID NO: 109238 - RNA, 32 nt, Human
ccgagugcgguggcaggcgccuguaaucccag

SEQ ID NO: 109239 - RNA, 32 nt, Human
ccgagugcgguggcucacaccuguaaucccag

SEQ ID NO: 109240 - RNA, 32 nt, Human
ccgagugcgguggcucacaccuguaauccuag

SEQ ID NO: 109241 - RNA, 32 nt, Human
ccgagugcuccuuccucaucuaccucagugag

SEQ ID NO: 109242 - RNA, 23 nt, Human
ccgagugcugggauuaaagacgu

SEQ ID NO: 109243 - RNA, 32 nt, Human
ccgaguggagugggaaaggcauuuugauuugc

SEQ ID NO: 109244 - RNA, 32 nt, Human
ccgaguggccagaagccgggagcugacaaacc

SEQ ID NO: 109245 - RNA, 32 nt, Human
ccgaguggcuggcaucaccacgcccagcuaau

SEQ ID NO: 109246 - RNA, 23 nt, Human
ccgaguggcugggauuacaggcg

SEQ ID NO: 109247 - RNA, 24 nt, Human
ccgaguggcugggauuauaggcgu

SEQ ID NO: 109248 - RNA, 32 nt, Human
ccgagugggaggauugccugagccuaggaguu

SEQ ID NO: 109249 - RNA, 32 nt, Human
ccgaguggggcugagcgcgccggcggcggcgg

SEQ ID NO: 109250 - RNA, 32 nt, Human
ccgaguguacucuccaguucaccuucugugcu

SEQ ID NO: 109251 - RNA, 32 nt, Human
ccgagugugcagcugccgccacugccgggaag

SEQ ID NO: 109252 - RNA, 32 nt, Human
ccgagugugguggcucaugccuguaaucucag

SEQ ID NO: 109253 - RNA, 32 nt, Human
ccgagugugguggcuuaugccuguaaucccug

SEQ ID NO: 109254 - RNA, 32 nt, Human
ccgaguguugcaggcacuccagccuggcgaca

SEQ ID NO: 109255 - RNA, 32 nt, Human
ccgaguuaaaccaaugcaauaugaguaaaaca

SEQ ID NO: 109256 - RNA, 32 nt, Human
ccgaguucaagcaauucuccugccucagccuc

SEQ ID NO: 109257 - RNA, 32 nt, Human
ccgaguucaagcaauucuccugccucagcucu

SEQ ID NO: 109258 - RNA, 32 nt, Human
ccgaguucaagugauuuuccugccuuggccuc

SEQ ID NO: 109259 - RNA, 32 nt, Human
ccgaguucaaucgauucuccugccucaugccu

SEQ ID NO: 109260 - RNA, 32 nt, Human
ccgaguucccggacauuccccuuguccaauca

SEQ ID NO: 109261 - RNA, 32 nt, Human
ccgaguugagacaaauuacgaccacuggaagc

SEQ ID NO: 109262 - RNA, 32 nt, Human
ccgaguugcacuaaccauccugggcuuccugu

SEQ ID NO: 109263 - RNA, 22 nt, Human
ccgaguugcugggaugacaggc

SEQ ID NO: 109264 - RNA, 32 nt, Human
ccgaguuggaggcaucuguccacccauguggu

SEQ ID NO: 109265 - RNA, 32 nt, Human
ccgaguugucucugugguuucuaugcagcccu

SEQ ID NO: 109266 - RNA, 32 nt, Human
ccgaguuuaggagaagagagugagaggagcaa

SEQ ID NO: 109267 - RNA, 32 nt, Human
ccgaguuugcagggugcugagcuguauggucc

SEQ ID NO: 109268 - RNA, 23 nt, Human
ccgauaaccaaagagaugcugca

SEQ ID NO: 109269 - RNA, 32 nt, Human
ccgauacacggcaucaucccaucucuaauuuc

SEQ ID NO: 109270 - RNA, 32 nt, Human
ccgauaccaguuucagaauacugugaaucuga

SEQ ID NO: 109271 - RNA, 32 nt, Human
ccgauagucccagcuacuugagaggcugagcc

SEQ ID NO: 109272 - RNA, 32 nt, Human
ccgaucaaaaggccauggguaggaggcuugca

SEQ ID NO: 109273 - RNA, 32 nt, Human
ccgaucaaagagacagauccacacugcugccg

SEQ ID NO: 109274 - RNA, 32 nt, Human
ccgaucaguuaaggagcugugcaauaaccuuc

SEQ ID NO: 109275 - RNA, 32 nt, Human
ccgaucauaagaaauuuagaaaagccauccaa

SEQ ID NO: 109276 - RNA, 32 nt, Human
ccgaucauugauuugcauccccauggcauuug

SEQ ID NO: 109277 - RNA, 32 nt, Human
ccgaucccuccacccucuaccgagaucugccu

SEQ ID NO: 109278 - RNA, 32 nt, Human
ccgauccuuggacaccuccucugucugccauu

SEQ ID NO: 109279 - RNA, 32 nt, Human
ccgauccuuuguccuuuuuaguuuuaagacaa

SEQ ID NO: 109280 - RNA, 32 nt, Human
ccgaucuggaaaggaaagagaccuguaucuug

SEQ ID NO: 109281 - RNA, 29 nt, Human
ccgaucuggcugcaucagcauccugguug

SEQ ID NO: 109282 - RNA, 32 nt, Human
ccgaucuggcugugcaaaggcauuucaaagaa

SEQ ID NO: 109283 - RNA, 32 nt, Human
ccgaucuuacugcaaucucuagcguccucuuu

SEQ ID NO: 109284 - RNA, 32 nt, Human
ccgaugacccccagcauugaaauggacucuga

SEQ ID NO: 109285 - RNA, 32 nt, Human
ccgaugacugcucccucgaccucucucuucuc

SEQ ID NO: 109286 - RNA, 32 nt, Human
ccgaugacuggguggucgggagggagacccag

SEQ ID NO: 109287 - RNA, 32 nt, Human
ccgaugacuuugcccacucucuucgcaguggg

SEQ ID NO: 109288 - RNA, 32 nt, Human
ccgaugagguaaugcggcucugccauuggucu

SEQ ID NO: 109289 - RNA, 32 nt, Human
ccgaugccauuucuuuuccucauaaagaugcu

SEQ ID NO: 109290 - RNA, 21 nt, Human
ccgaugccccagcccugcacg

SEQ ID NO: 109291 - RNA, 21 nt, Human
ccgaugcccguccccgggcca

SEQ ID NO: 109292 - RNA, 32 nt, Human
ccgaugcccuugcucccccucuucccacccca

SEQ ID NO: 109293 - RNA, 32 nt, Human
ccgaugccucccuugaggguuugagagcccgc

SEQ ID NO: 109294 - RNA, 32 nt, Human
ccgaugccugggaggaccagaagccaacagca

SEQ ID NO: 109295 - RNA, 24 nt, Human
ccgaugccuuggcagugccagcca

SEQ ID NO: 109296 - RNA, 19 nt, Human
ccgaugcgcgccgcugccg

SEQ ID NO: 109297 - RNA, 32 nt, Human
ccgaugcggcgagcgagcuggggagggggcuu

SEQ ID NO: 109298 - RNA, 32 nt, Human
ccgaugcugcuagugaagcagcugcuaggaaa

SEQ ID NO: 109299 - RNA, 32 nt, Human
ccgaugcuggcagugguuccuaccucuguugg

SEQ ID NO: 109300 - RNA, 32 nt, Human
ccgauggaggagggaggagacucccugaacuc

SEQ ID NO: 109301 - RNA, 32 nt, Human
ccgauggcagcucacguucugccuugucagcu

SEQ ID NO: 109302 - RNA, 21 nt, Human
ccgauggcaggugccuagggg

SEQ ID NO: 109303 - RNA, 32 nt, Human
ccgauggccccacccucaccagccugggcagc

SEQ ID NO: 109304 - RNA, 32 nt, Human
ccgauggcggccccucauuggccaagggcacu

SEQ ID NO: 109305 - RNA, 32 nt, Human
ccgauggcucacugugaccuccgccucucggg

SEQ ID NO: 109306 - RNA, 32 nt, Human
ccgauggcuggaggaugggcagaggggacucc

SEQ ID NO: 109307 - RNA, 32 nt, Human
ccgaugggauucccguccaagcuaucucgagc

SEQ ID NO: 109308 - RNA, 32 nt, Human
ccgauggggaaagggugagauuuacaucccca

SEQ ID NO: 109309 - RNA, 32 nt, Human
ccgauggggaggcagcccccgcaguggacagc

SEQ ID NO: 109310 - RNA, 32 nt, Human
ccgauggggucacggccccucuccccacccca

SEQ ID NO: 109311 - RNA, 28 nt, Human
ccgaugggucccgcgggggucgcggcga

SEQ ID NO: 109312 - RNA, 32 nt, Human
ccgaugucaaccacagcagcuucaauuuaaau

SEQ ID NO: 109313 - RNA, 32 nt, Human
ccgaugucucuucccucugaggccaguagcag

SEQ ID NO: 109314 - RNA, 32 nt, Human
ccgauguggaccucuacuuuccaggcuagucc

SEQ ID NO: 109315 - RNA, 32 nt, Human
ccgauguggguggaucaccugagguuaggagu

SEQ ID NO: 109316 - RNA, 32 nt, Human
ccgauguggguggaucacuugaggucaggagu

SEQ ID NO: 109317 - RNA, 31 nt, Human
ccgauguggguggggugaggagagaggcagc

SEQ ID NO: 109318 - RNA, 32 nt, Human
ccgauguugaagggguggacagcaggcgggug

SEQ ID NO: 109319 - RNA, 23 nt, Human
ccgauuagcugggacuacaggcg

SEQ ID NO: 109320 - RNA, 24 nt, Human
ccgauuagcugggaucacaggugu

SEQ ID NO: 109321 - RNA, 32 nt, Human
ccgauuaggaaacugagguucugagguuuaag

SEQ ID NO: 109322 - RNA, 19 nt, Human
ccgauuccagcacccacca

SEQ ID NO: 109323 - RNA, 32 nt, Human
ccgauuccgggagcuugggagcccugcgucag

SEQ ID NO: 109324 - RNA, 32 nt, Human
ccgauucguuuaacacaccuuucuggacagag

SEQ ID NO: 109325 - RNA, 32 nt, Human
ccgauucugaguagugggaugaagucucaugc

SEQ ID NO: 109326 - RNA, 32 nt, Human
ccgauucugcaacccucacuuccuaagcacag

SEQ ID NO: 109327 - RNA, 32 nt, Human
ccgauucugugccuggccuauuaaucuuucuc

SEQ ID NO: 109328 - RNA, 32 nt, Human
ccgauugcaauuugcaaccuccgcugccgucg

SEQ ID NO: 109329 - RNA, 32 nt, Human
ccgauugcaccacugcacuccagccugggcaa

SEQ ID NO: 109330 - RNA, 32 nt, Human
ccgauugggaggugguagaagcacugaaugaa

SEQ ID NO: 109331 - RNA, 32 nt, Human
ccgauuguccaccauguggccuagagcucugg

SEQ ID NO: 109332 - RNA, 32 nt, Human
ccgauuuacuucuguuaagugaugcuuuucua

SEQ ID NO: 109333 - RNA, 32 nt, Human
ccgauuucucccggaaccucugcucagccugg

SEQ ID NO: 109334 - RNA, 32 nt, Human
ccgauuugugcugcucucagcagccaccgggg

SEQ ID NO: 109335 - RNA, 32 nt, Human
ccgauuuugcucugucuccucaguuaaguguu

SEQ ID NO: 109336 - RNA, 32 nt, Human
ccgcaaaaugucagccuccaccuccucgcacc

SEQ ID NO: 109337 - RNA, 32 nt, Human
ccgcaaagcgaagauccgcccgccgguucccc

SEQ ID NO: 109338 - RNA, 32 nt, Human
ccgcaaaugcugcugccccagcucuacacugc

SEQ ID NO: 109339 - RNA, 19 nt, Human
ccgcaacaagcgggccgcc

SEQ ID NO: 109340 - RNA, 22 nt, Human
ccgcaacacugccguccuccuu

SEQ ID NO: 109341 - RNA, 32 nt, Human
ccgcaaccaaccagcaacacccaucaccuagu

SEQ ID NO: 109342 - RNA, 32 nt, Human
ccgcaacccagagacgugccagcuguucacca

SEQ ID NO: 109343 - RNA, 23 nt, Human
ccgcaaccucgccuucagccugg

SEQ ID NO: 109344 - RNA, 22 nt, Human
ccgcaacugcacuccagccugg

SEQ ID NO: 109345 - RNA, 18 nt, Human
ccgcaacugcccugauca

SEQ ID NO: 109346 - RNA, 32 nt, Human
ccgcaacuugccaaacccugaucuaagagcua

SEQ ID NO: 109347 - RNA, 25 nt, Human
ccgcaagagggacagagcccgggag

SEQ ID NO: 109348 - RNA, 22 nt, Human
ccgcaagcacccgaggcuccug

SEQ ID NO: 109349 - RNA, 32 nt, Human
ccgcaagcccacccucuucaccucaugcuguc

SEQ ID NO: 109350 - RNA, 21 nt, Human
ccgcaagccccccagccuccc

SEQ ID NO: 109351 - RNA, 32 nt, Human
ccgcaagccgccugccuccacccugcucucca

SEQ ID NO: 109352 - RNA, 32 nt, Human
ccgcaagccucaaauuuuugugcucagaugau

SEQ ID NO: 109353 - RNA, 32 nt, Human
ccgcaagcgcaugaccuaccagaagcuggcgc

SEQ ID NO: 109354 - RNA, 32 nt, Human
ccgcaagcuguugccgcgcggucucacuaccc

SEQ ID NO: 109355 - RNA, 19 nt, Human
ccgcaaggccucagugccc

SEQ ID NO: 109356 - RNA, 32 nt, Human
ccgcaagguggaggagcugcgguggcaggagg

SEQ ID NO: 109357 - RNA, 32 nt, Human
ccgcaaugaagagcuucuuacagugaaagcaa

SEQ ID NO: 109358 - RNA, 23 nt, Human
ccgcaauggcacugacccgggag

SEQ ID NO: 109359 - RNA, 32 nt, Human
ccgcaaugggcagaggguggguggaccccugc

SEQ ID NO: 109360 - RNA, 23 nt, Human
ccgcaauguacucuuuccucuaa

SEQ ID NO: 109361 - RNA, 32 nt, Human
ccgcaaugucagcucaccgccaccuccgcccc

SEQ ID NO: 109362 - RNA, 30 nt, Human
ccgcaauguggcugaggaagggagccaaaa

SEQ ID NO: 109363 - RNA, 32 nt, Human
ccgcaauuaacaacaggaaacaaucugaacag

SEQ ID NO: 109364 - RNA, 32 nt, Human
ccgcaauuccagucugugcaucaugaugauaa

SEQ ID NO: 109365 - RNA, 32 nt, Human
ccgcaauuucccucucucugccggugucugcu

SEQ ID NO: 109366 - RNA, 32 nt, Human
ccgcacaaccuacagccaccgccgcccggccg

SEQ ID NO: 109367 - RNA, 32 nt, Human
ccgcacacacacauuaacacacuugagccauc

SEQ ID NO: 109368 - RNA, 32 nt, Human
ccgcacacaccaugccuccugucucaacacug

SEQ ID NO: 109369 - RNA, 20 nt, Human
ccgcacacagcccugaguca

SEQ ID NO: 109370 - RNA, 32 nt, Human
ccgcacaccagcgccacccaggaaaggcggag

SEQ ID NO: 109371 - RNA, 32 nt, Human
ccgcacacccacucaggaguuggggcccagcu

SEQ ID NO: 109372 - RNA, 22 nt, Human
ccgcacacccuugucccgggcc

SEQ ID NO: 109373 - RNA, 32 nt, Human
ccgcacacucuggaaagaagagagaagugaag

SEQ ID NO: 109374 - RNA, 32 nt, Human
ccgcacagaaaugcugcagaguauauaaaacu

SEQ ID NO: 109375 - RNA, 32 nt, Human
ccgcacagaccucacuaguugugcacaaauaa

SEQ ID NO: 109376 - RNA, 32 nt, Human
ccgcacagcaggagcgaagggaagaggggaga

SEQ ID NO: 109377 - RNA, 32 nt, Human
ccgcacagccggucagaacugugugacucacu

SEQ ID NO: 109378 - RNA, 31 nt, Human
ccgcacagccucucuugggugcuuguuuguu

SEQ ID NO: 109379 - RNA, 32 nt, Human
ccgcacagccuggguagcguguggaagauccg

SEQ ID NO: 109380 - RNA, 32 nt, Human
ccgcacaggaacacgccagucccccuuucucc

SEQ ID NO: 109381 - RNA, 21 nt, Human
ccgcacaggcccuauucucuc

SEQ ID NO: 109382 - RNA, 21 nt, Human
ccgcacaggcggggggcguag

SEQ ID NO: 109383 - RNA, 32 nt, Human
ccgcacagugcgccccagccccagcagggcgc

SEQ ID NO: 109384 - RNA, 32 nt, Human
ccgcacaguggcccuggcugugacaggaagga

SEQ ID NO: 109385 - RNA, 32 nt, Human
ccgcacaucccggggcaaagaccuaagacacu

SEQ ID NO: 109386 - RNA, 32 nt, Human
ccgcacauuccacucccauucucccuccaaga

SEQ ID NO: 109387 - RNA, 32 nt, Human
ccgcaccaccugcugugugccagccugagacg

SEQ ID NO: 109388 - RNA, 32 nt, Human
ccgcaccacugcacuccagccugggcgacaga

SEQ ID NO: 109389 - RNA, 32 nt, Human
ccgcaccacugcacuccagccugggugacaga

SEQ ID NO: 109390 - RNA, 32 nt, Human
ccgcaccagccccgcgccuacccggccgcccc

SEQ ID NO: 109391 - RNA, 32 nt, Human
ccgcaccaugagccacgggcccagcccccggc

SEQ ID NO: 109392 - RNA, 32 nt, Human
ccgcacccaaaccacuggagguccugaucgau

SEQ ID NO: 109393 - RNA, 32 nt, Human
ccgcacccagcccagagaagaguuuagugacu

SEQ ID NO: 109394 - RNA, 32 nt, Human
ccgcacccaucuuugaagauagccaguguccc

SEQ ID NO: 109395 - RNA, 32 nt, Human
ccgcaccccacacagccuugcuccaaggagaa

SEQ ID NO: 109396 - RNA, 32 nt, Human
ccgcaccccacuuggaaccauaugcaaaggau

SEQ ID NO: 109397 - RNA, 32 nt, Human
ccgcaccccaggcuggggcagcgagggcgugg

SEQ ID NO: 109398 - RNA, 32 nt, Human
ccgcaccccucagccagcagcgccucugcccu

SEQ ID NO: 109399 - RNA, 32 nt, Human
ccgcacccgaggcagcagcugcgcagccucau

SEQ ID NO: 109400 - RNA, 21 nt, Human
ccgcacccgaggcucagccug

SEQ ID NO: 109401 - RNA, 22 nt, Human
ccgcacccggacugcugcuccc

SEQ ID NO: 109402 - RNA, 32 nt, Human
ccgcacccggcgcaccaccagcaccaccagcc

SEQ ID NO: 109403 - RNA, 32 nt, Human
ccgcaccgaggcgagcaggagcagggaacagg

SEQ ID NO: 109404 - RNA, 20 nt, Human
ccgcaccgccagcccgggag

SEQ ID NO: 109405 - RNA, 32 nt, Human
ccgcaccgccuauuccagccuuuggagauccg

SEQ ID NO: 109406 - RNA, 20 nt, Human
ccgcaccgcgaccugggcca

SEQ ID NO: 109407 - RNA, 32 nt, Human
ccgcaccgugagccacugcacccgacccccuc

SEQ ID NO: 109408 - RNA, 32 nt, Human
ccgcaccucccaagcucauccugcugcccucc

SEQ ID NO: 109409 - RNA, 32 nt, Human
ccgcaccuccuauccuggccacugggccuaua

SEQ ID NO: 109410 - RNA, 32 nt, Human
ccgcaccugcagccccgcaccugccgcuugca

SEQ ID NO: 109411 - RNA, 21 nt, Human
ccgcaccugcauggacugccc

SEQ ID NO: 109412 - RNA, 32 nt, Human
ccgcaccugugcugcacugcccggaggccugc

SEQ ID NO: 109413 - RNA, 32 nt, Human
ccgcaccuguggucccagcuacccgggaggcu

SEQ ID NO: 109414 - RNA, 32 nt, Human
ccgcaccuugcucucccucgggcugcugguug

SEQ ID NO: 109415 - RNA, 32 nt, Human
ccgcacgcagagccccgggagcgacggcgcca

SEQ ID NO: 109416 - RNA, 22 nt, Human
ccgcacgcccgaucccggguca

SEQ ID NO: 109417 - RNA, 32 nt, Human
ccgcacgccucuucccacaccugucagcuucg

SEQ ID NO: 109418 - RNA, 32 nt, Human
ccgcacgccuguaaucccagcacuuggggagg

SEQ ID NO: 109419 - RNA, 32 nt, Human
ccgcacggccgggccucacaggcugcccuccu

SEQ ID NO: 109420 - RNA, 18 nt, Human
ccgcacguguccuggguc

SEQ ID NO: 109421 - RNA, 32 nt, Human
ccgcacuauauaauucgcacacauuaauuagg

SEQ ID NO: 109422 - RNA, 32 nt, Human
ccgcacuauugucccuucuuccucacugcacc

SEQ ID NO: 109423 - RNA, 20 nt, Human
ccgcacucaacuggcagcug

SEQ ID NO: 109424 - RNA, 32 nt, Human
ccgcacuccagccucucgcugccaggguuugc

SEQ ID NO: 109425 - RNA, 32 nt, Human
ccgcacuccagccugagcaacagagugagauc

SEQ ID NO: 109426 - RNA, 32 nt, Human
ccgcacuccagccugggcaacagagcgagacu

SEQ ID NO: 109427 - RNA, 32 nt, Human
ccgcacuccagccugggcaacagagugagacu

SEQ ID NO: 109428 - RNA, 32 nt, Human
ccgcacuccagccugggcgacagagcgagacu

SEQ ID NO: 109429 - RNA, 32 nt, Human
ccgcacuccagccugggugacagagcgagacu

SEQ ID NO: 109430 - RNA, 32 nt, Human
ccgcacuccgaguuucuccuccucacagauag

SEQ ID NO: 109431 - RNA, 20 nt, Human
ccgcacugaguaccuggaga

SEQ ID NO: 109432 - RNA, 23 nt, Human
ccgcacugcagcuccgcccgccg

SEQ ID NO: 109433 - RNA, 32 nt, Human
ccgcacugcagucuccagccugagccaugggc

SEQ ID NO: 109434 - RNA, 32 nt, Human
ccgcacuuugggaggccgaggccggcggauga

SEQ ID NO: 109435 - RNA, 32 nt, Human
ccgcagaagaggaggaggauuuuguugaggag

SEQ ID NO: 109436 - RNA, 32 nt, Human
ccgcagaagggcagcggugcacugugaugccu

SEQ ID NO: 109437 - RNA, 32 nt, Human
ccgcagaccuuucugucaugcugggaaguauc

SEQ ID NO: 109438 - RNA, 23 nt, Human
ccgcagacugagccacagccugg

SEQ ID NO: 109439 - RNA, 32 nt, Human
ccgcagagagggcuggagagagucugcucucc

SEQ ID NO: 109440 - RNA, 32 nt, Human
ccgcagagauuuuguuuaugggcaguuucuca

SEQ ID NO: 109441 - RNA, 32 nt, Human
ccgcagagccugacgcucagccccaggccagc

SEQ ID NO: 109442 - RNA, 32 nt, Human
ccgcagagucacugcauucccucccagccuuu

SEQ ID NO: 109443 - RNA, 18 nt, Human
ccgcagcaaauccaccca

SEQ ID NO: 109444 - RNA, 32 nt, Human
ccgcagcaaucuccacagccuccugggucuca

SEQ ID NO: 109445 - RNA, 22 nt, Human
ccgcagcaccaagggcuugcug

SEQ ID NO: 109446 - RNA, 20 nt, Human
ccgcagcagcagccaggugc

SEQ ID NO: 109447 - RNA, 23 nt, Human
ccgcagcagcgcgcuaugcgcug

SEQ ID NO: 109448 - RNA, 32 nt, Human
ccgcagcagcuuuucaagaugcacuaugccug

SEQ ID NO: 109449 - RNA, 24 nt, Human
ccgcagcagggacgucgguuugcu

SEQ ID NO: 109450 - RNA, 20 nt, Human
ccgcagccacuguagcugag

SEQ ID NO: 109451 - RNA, 20 nt, Human
ccgcagccaggagccgcugc

SEQ ID NO: 109452 - RNA, 24 nt, Human
ccgcagccaggcagcgccugggag

SEQ ID NO: 109453 - RNA, 21 nt, Human
ccgcagccagugccgaccgca

SEQ ID NO: 109454 - RNA, 21 nt, Human
ccgcagccaucagcccuggag

SEQ ID NO: 109455 - RNA, 21 nt, Human
ccgcagccauccgcacgggag

SEQ ID NO: 109456 - RNA, 32 nt, Human
ccgcagcccacacagccucugcagcccaagac

SEQ ID NO: 109457 - RNA, 32 nt, Human
ccgcagcccacacagccucugcagcccaaggc

SEQ ID NO: 109458 - RNA, 20 nt, Human
ccgcagcccagcaacucgca

SEQ ID NO: 109459 - RNA, 32 nt, Human
ccgcagcccagccugggcgacagagcgagacu

SEQ ID NO: 109460 - RNA, 32 nt, Human
ccgcagcccaggcucgacuccaacaacacacu

SEQ ID NO: 109461 - RNA, 32 nt, Human
ccgcagcccagugcccucugcccgcggcggug

SEQ ID NO: 109462 - RNA, 19 nt, Human
ccgcagccccgggccucga

SEQ ID NO: 109463 - RNA, 20 nt, Human
ccgcagccccugcagcgccg

SEQ ID NO: 109464 - RNA, 23 nt, Human
ccgcagcccgaccccggccgcca

SEQ ID NO: 109465 - RNA, 19 nt, Human
ccgcagcccgcagccgcca

SEQ ID NO: 109466 - RNA, 17 nt, Human
ccgcagccgccccgacu

SEQ ID NO: 109467 - RNA, 21 nt, Human
ccgcagccgcccguuccggga

SEQ ID NO: 109468 - RNA, 19 nt, Human
ccgcagccgccgccugggg

SEQ ID NO: 109469 - RNA, 20 nt, Human
ccgcagccgccgcgcccggg

SEQ ID NO: 109470 - RNA, 22 nt, Human
ccgcagccgccgcuacugggag

SEQ ID NO: 109471 - RNA, 22 nt, Human
ccgcagccgccggagccgggag

SEQ ID NO: 109472 - RNA, 23 nt, Human
ccgcagccgccgggagccgcgag

SEQ ID NO: 109473 - RNA, 32 nt, Human
ccgcagccgccuggcccagccugggcacguuc

SEQ ID NO: 109474 - RNA, 32 nt, Human
ccgcagccgcgugucagcagguggaugggaug

SEQ ID NO: 109475 - RNA, 20 nt, Human
ccgcagccgcucccuccggg

SEQ ID NO: 109476 - RNA, 23 nt, Human
ccgcagccgcugcggggccgcga

SEQ ID NO: 109477 - RNA, 22 nt, Human
ccgcagccgcuggacgcgggag

SEQ ID NO: 109478 - RNA, 21 nt, Human
ccgcagccgcugugggcaggg

SEQ ID NO: 109479 - RNA, 19 nt, Human
ccgcagccggcccgagcca

SEQ ID NO: 109480 - RNA, 22 nt, Human
ccgcagccggcgcagccaggag

SEQ ID NO: 109481 - RNA, 23 nt, Human
ccgcagccggggggacgcgggag

SEQ ID NO: 109482 - RNA, 32 nt, Human
ccgcagccgucgccgcuucuccaccucggccc

SEQ ID NO: 109483 - RNA, 32 nt, Human
ccgcagccucaaacuccccagcucgggugauu

SEQ ID NO: 109484 - RNA, 32 nt, Human
ccgcagccuccaggagccccacacagggcugg

SEQ ID NO: 109485 - RNA, 32 nt, Human
ccgcagccuccgccuccuggggucaggcuguu

SEQ ID NO: 109486 - RNA, 32 nt, Human
ccgcagccucuggagagagcugacggcagaug

SEQ ID NO: 109487 - RNA, 19 nt, Human
ccgcagccugcucugagcu

SEQ ID NO: 109488 - RNA, 32 nt, Human
ccgcagccugggaaccuucucccucguacagc

SEQ ID NO: 109489 - RNA, 32 nt, Human
ccgcagcgacaggcacaaagucacgggguaau

SEQ ID NO: 109490 - RNA, 19 nt, Human
ccgcagcgacgccccggcc

SEQ ID NO: 109491 - RNA, 32 nt, Human
ccgcagcgagggacaauaauaucucaggaugu

SEQ ID NO: 109492 - RNA, 32 nt, Human
ccgcagcgcgacucgggagccccgggccacag

SEQ ID NO: 109493 - RNA, 28 nt, Human
ccgcagcgcgaggcugccucaucaacgg

SEQ ID NO: 109494 - RNA, 22 nt, Human
ccgcagcgcuugcccugcgcca

SEQ ID NO: 109495 - RNA, 32 nt, Human
ccgcagcgggcugaggcacuuucgggcaacac

SEQ ID NO: 109496 - RNA, 32 nt, Human
ccgcagcgucggggcuggagcgauggcggcga

SEQ ID NO: 109497 - RNA, 32 nt, Human
ccgcagcuccacccccucccgucccagccccc

SEQ ID NO: 109498 - RNA, 32 nt, Human
ccgcagcuccauuuucuuauugcgcugcuacc

SEQ ID NO: 109499 - RNA, 32 nt, Human
ccgcagcugccgcccccgccucuuuggagucu

SEQ ID NO: 109500 - RNA, 32 nt, Human
ccgcagcugcugucugcagagccugcucggau

SEQ ID NO: 109501 - RNA, 32 nt, Human
ccgcagcugcugugcugcucugugccaucggc

SEQ ID NO: 109502 - RNA, 32 nt, Human
ccgcagcugcuuguggcggauuccucaccaag

SEQ ID NO: 109503 - RNA, 32 nt, Human
ccgcagcuguguggagagacacccggggccug

SEQ ID NO: 109504 - RNA, 32 nt, Human
ccgcagcuguuggggaagaggagcugccuccu

SEQ ID NO: 109505 - RNA, 32 nt, Human
ccgcagcuucagccuccgccgccuccucagcc

SEQ ID NO: 109506 - RNA, 23 nt, Human
ccgcaggaagcuggcugccccca

SEQ ID NO: 109507 - RNA, 32 nt, Human
ccgcaggaauguaacgccguugaggagaagug

SEQ ID NO: 109508 - RNA, 32 nt, Human
ccgcaggacugcugugggucuugacacugcuu

SEQ ID NO: 109509 - RNA, 32 nt, Human
ccgcaggaggguggguggagcagguggacugg

SEQ ID NO: 109510 - RNA, 21 nt, Human
ccgcaggaucacccagcuugg

SEQ ID NO: 109511 - RNA, 31 nt, Human
ccgcaggcaaggucucccacugcagggcuug

SEQ ID NO: 109512 - RNA, 32 nt, Human
ccgcaggcagcaguuugcauuuugaaagguua

SEQ ID NO: 109513 - RNA, 20 nt, Human
ccgcaggcagccucgaguca

SEQ ID NO: 109514 - RNA, 32 nt, Human
ccgcaggcaguuaccaguacggcuggcuacaa

SEQ ID NO: 109515 - RNA, 32 nt, Human
ccgcaggcaugucuguacacugggugggcacc

SEQ ID NO: 109516 - RNA, 32 nt, Human
ccgcaggcccucaaguugcugucugguugucg

SEQ ID NO: 109517 - RNA, 32 nt, Human
ccgcaggccguuuccaccgaggaaaaggaauc

SEQ ID NO: 109518 - RNA, 32 nt, Human
ccgcaggccuccgcucuccuguccucggcccc

SEQ ID NO: 109519 - RNA, 19 nt, Human
ccgcaggccuccuguccac

SEQ ID NO: 109520 - RNA, 32 nt, Human
ccgcaggccugggaauuuccgucccccaccaa

SEQ ID NO: 109521 - RNA, 32 nt, Human
ccgcaggcgaaagcacguuccagccaccagga

SEQ ID NO: 109522 - RNA, 19 nt, Human
ccgcaggcgcaggcccggg

SEQ ID NO: 109523 - RNA, 32 nt, Human
ccgcaggcuagccuggcaacaaaacuggggua

SEQ ID NO: 109524 - RNA, 32 nt, Human
ccgcagggaagggaggagagauaccugcugcu

SEQ ID NO: 109525 - RNA, 32 nt, Human
ccgcagggaggcagggauggcaaggcgugaag

SEQ ID NO: 109526 - RNA, 32 nt, Human
ccgcagggaggcggcggcagcugcggcggggc

SEQ ID NO: 109527 - RNA, 32 nt, Human
ccgcagggaguuguucugcuucugcuuuaccu

SEQ ID NO: 109528 - RNA, 32 nt, Human
ccgcagggcaaguaagcggcugacggcggaaa

SEQ ID NO: 109529 - RNA, 32 nt, Human
ccgcagggccagcagccccgcccacacggaag

SEQ ID NO: 109530 - RNA, 32 nt, Human
ccgcagggcccaccuuggacccuggugaccuc

SEQ ID NO: 109531 - RNA, 18 nt, Human
ccgcagggccccgggcca

SEQ ID NO: 109532 - RNA, 32 nt, Human
ccgcagggccggcugccccaggagagcccuga

SEQ ID NO: 109533 - RNA, 20 nt, Human
ccgcaggggccccuccucca

SEQ ID NO: 109534 - RNA, 32 nt, Human
ccgcagggugggcugcagggaggucugacuua

SEQ ID NO: 109535 - RNA, 32 nt, Human
ccgcaggugccugcaggaguccuggggccagc

SEQ ID NO: 109536 - RNA, 32 nt, Human
ccgcaggugggaggugugguugcaggugcggg

SEQ ID NO: 109537 - RNA, 32 nt, Human
ccgcaggugggcagcuagcugcagcgacuacc

SEQ ID NO: 109538 - RNA, 32 nt, Human
ccgcagguggugagcggcuggggagggccagg

SEQ ID NO: 109539 - RNA, 32 nt, Human
ccgcagguugcuuucccacccugggcaaugca

SEQ ID NO: 109540 - RNA, 32 nt, Human
ccgcaguaacagacacaguauuuaauugcaca

SEQ ID NO: 109541 - RNA, 32 nt, Human
ccgcaguaauaucuucccucugaugcuggaaa

SEQ ID NO: 109542 - RNA, 32 nt, Human
ccgcaguaccggggcuggagcggagugaagcu

SEQ ID NO: 109543 - RNA, 32 nt, Human
ccgcagucagccucggagacagccugguuccc

SEQ ID NO: 109544 - RNA, 32 nt, Human
ccgcaguccagccugggcgacagagcgagacu

SEQ ID NO: 109545 - RNA, 32 nt, Human
ccgcaguccgggaggcgggggucggcagccgg

SEQ ID NO: 109546 - RNA, 32 nt, Human
ccgcagucucacucugaauaaaggacaguuug

SEQ ID NO: 109547 - RNA, 32 nt, Human
ccgcagucuucaccucuccacacucacuuuuu

SEQ ID NO: 109548 - RNA, 22 nt, Human
ccgcagugccugcccugaucca

SEQ ID NO: 109549 - RNA, 32 nt, Human
ccgcagugcucugcaagauccugcucugcagc

SEQ ID NO: 109550 - RNA, 22 nt, Human
ccgcagugcugggauuacaggc

SEQ ID NO: 109551 - RNA, 23 nt, Human
ccgcaguggccuggaucuaucug

SEQ ID NO: 109552 - RNA, 29 nt, Human
ccgcagugucugugucccugggcacccga

SEQ ID NO: 109553 - RNA, 32 nt, Human
ccgcaguucagugauggggagccguguuuggc

SEQ ID NO: 109554 - RNA, 20 nt, Human
ccgcaguuuguuucgggcca

SEQ ID NO: 109555 - RNA, 32 nt, Human
ccgcauacccuccacagugcuugagacauaau

SEQ ID NO: 109556 - RNA, 32 nt, Human
ccgcaucacaccauggcucugaagagaaucca

SEQ ID NO: 109557 - RNA, 32 nt, Human
ccgcaucacccaaccaaccagccgaguuccuc

SEQ ID NO: 109558 - RNA, 22 nt, Human
ccgcaucagcgaguucagaguc

SEQ ID NO: 109559 - RNA, 32 nt, Human
ccgcaucagucugggccuggcccagggucccc

SEQ ID NO: 109560 - RNA, 32 nt, Human
ccgcauccccuucauugcagcuccuucaaagg

SEQ ID NO: 109561 - RNA, 32 nt, Human
ccgcauccuccacauccuuccauggcucugaa

SEQ ID NO: 109562 - RNA, 20 nt, Human
ccgcauccugccccacccca

SEQ ID NO: 109563 - RNA, 20 nt, Human
ccgcauccuuccccgggcca

SEQ ID NO: 109564 - RNA, 32 nt, Human
ccgcaucgcuuguuuccaccuccugggccggg

SEQ ID NO: 109565 - RNA, 32 nt, Human
ccgcaucuacuaaaauacaaaaauuagccggg

SEQ ID NO: 109566 - RNA, 32 nt, Human
ccgcaucucacagcuaugcaaaaagcuaguca

SEQ ID NO: 109567 - RNA, 32 nt, Human
ccgcaucuccaggacuccuggccuggacuucu

SEQ ID NO: 109568 - RNA, 32 nt, Human
ccgcaucuccugggugcccccuuggcuuugcc

SEQ ID NO: 109569 - RNA, 32 nt, Human
ccgcaugauucccaacuuucugccacacuuaa

SEQ ID NO: 109570 - RNA, 32 nt, Human
ccgcaugcacucugggaggugcagcccuaagg

SEQ ID NO: 109571 - RNA, 32 nt, Human
ccgcaugccuguaaucccagcuacuugggugg

SEQ ID NO: 109572 - RNA, 32 nt, Human
ccgcaugccuguagucccagcuacucgggagg

SEQ ID NO: 109573 - RNA, 32 nt, Human
ccgcauggagcgcggcgucagcgcggacagcu

SEQ ID NO: 109574 - RNA, 32 nt, Human
ccgcauggccaggaacuggccucugccuacgg

SEQ ID NO: 109575 - RNA, 29 nt, Human
ccgcauggcuuccgcagucugggggagug

SEQ ID NO: 109576 - RNA, 23 nt, Human
ccgcauggguccaugcuagggag

SEQ ID NO: 109577 - RNA, 29 nt, Human
ccgcaugucacucaccuucaggcggccca

SEQ ID NO: 109578 - RNA, 32 nt, Human
ccgcaugucacucaccuucaggcggcccaaga

SEQ ID NO: 109579 - RNA, 32 nt, Human
ccgcauguggaagagugggaggaagcagaggg

SEQ ID NO: 109580 - RNA, 32 nt, Human
ccgcauucagugcaccugccucagcuaccuaa

SEQ ID NO: 109581 - RNA, 32 nt, Human
ccgcauucaguuuucacauuaucugcaagcug

SEQ ID NO: 109582 - RNA, 32 nt, Human
ccgcauuccguccacagcaccacggagaggac

SEQ ID NO: 109583 - RNA, 21 nt, Human
ccgcauucucccguccucccu

SEQ ID NO: 109584 - RNA, 32 nt, Human
ccgcauugguaacuccagucugacugugggac

SEQ ID NO: 109585 - RNA, 18 nt, Human
ccgccaaacgcccugcga

SEQ ID NO: 109586 - RNA, 22 nt, Human
ccgccaaagcgcgccccgaguc

SEQ ID NO: 109587 - RNA, 32 nt, Human
ccgccaacccccugccccaggagcgggccuga

SEQ ID NO: 109588 - RNA, 32 nt, Human
ccgccaaccucacguuuucuuagucugaggcc

SEQ ID NO: 109589 - RNA, 32 nt, Human
ccgccaagcccaggcugcuggagccaggcacc

SEQ ID NO: 109590 - RNA, 32 nt, Human
ccgccaagcgguucccgcccucgcccagcgcc

SEQ ID NO: 109591 - RNA, 23 nt, Human
ccgccaaggagcuuuccggguca

SEQ ID NO: 109592 - RNA, 21 nt, Human
ccgccaaggcucagcugcagu

SEQ ID NO: 109593 - RNA, 19 nt, Human
ccgccaagugggcccagcc

SEQ ID NO: 109594 - RNA, 32 nt, Human
ccgccacaaccaacaccaaagcaggaaaacca

SEQ ID NO: 109595 - RNA, 32 nt, Human
ccgccacacacggcuaauuuuguauuuuuagu

SEQ ID NO: 109596 - RNA, 32 nt, Human
ccgccacacccagcuaauuuuguauuuuuagu

SEQ ID NO: 109597 - RNA, 32 nt, Human
ccgccacaccgcgcucuuccucccgggacugu

SEQ ID NO: 109598 - RNA, 32 nt, Human
ccgccacacgcucacacacaaaccugcucacg

SEQ ID NO: 109599 - RNA, 32 nt, Human
ccgccacagagcaggcuucaucugcucugcca

SEQ ID NO: 109600 - RNA, 32 nt, Human
ccgccacagccuucggacagacauauaggaua

SEQ ID NO: 109601 - RNA, 32 nt, Human
ccgccacagcugucggccuccaugccugagac

SEQ ID NO: 109602 - RNA, 19 nt, Human
ccgccacaggcccccuuca

SEQ ID NO: 109603 - RNA, 20 nt, Human
ccgccacaggccucgggcca

SEQ ID NO: 109604 - RNA, 21 nt, Human
ccgccacaguagcuguaacug

SEQ ID NO: 109605 - RNA, 32 nt, Human
ccgccacaucgcggcccuccagccuggccuaa

SEQ ID NO: 109606 - RNA, 32 nt, Human
ccgccacaucugcagugccgcacacagacagg

SEQ ID NO: 109607 - RNA, 32 nt, Human
ccgccacaugcacuccuccaccgcugagaguu

SEQ ID NO: 109608 - RNA, 32 nt, Human
ccgccaccaccgcugccgcagccuggcugggg

SEQ ID NO: 109609 - RNA, 32 nt, Human
ccgccaccaugcugcccccugggacugcgacc

SEQ ID NO: 109610 - RNA, 21 nt, Human
ccgccacccaagacagagcca

SEQ ID NO: 109611 - RNA, 32 nt, Human
ccgccacccccucccccugucucccucucuga

SEQ ID NO: 109612 - RNA, 32 nt, Human
ccgccaccgccgccaccgccuccugggacucg

SEQ ID NO: 109613 - RNA, 17 nt, Human
ccgccaccgccgcugca

SEQ ID NO: 109614 - RNA, 18 nt, Human
ccgccaccgccucggcca

SEQ ID NO: 109615 - RNA, 32 nt, Human
ccgccaccgccugucugagcugcugcgcuguc

SEQ ID NO: 109616 - RNA, 18 nt, Human
ccgccaccggcgccucca

SEQ ID NO: 109617 - RNA, 32 nt, Human
ccgccaccguggaggcagggggcaagaaacuc

SEQ ID NO: 109618 - RNA, 32 nt, Human
ccgccaccuccccucuccucuucuccccucac

SEQ ID NO: 109619 - RNA, 32 nt, Human
ccgccaccuccgccucuucagucuccuggucu

SEQ ID NO: 109620 - RNA, 32 nt, Human
ccgccacucacuccagccuggauaaaagagca

SEQ ID NO: 109621 - RNA, 17 nt, Human
ccgccacucuccgggcu

SEQ ID NO: 109622 - RNA, 22 nt, Human
ccgccacucugccaccagcucc

SEQ ID NO: 109623 - RNA, 32 nt, Human
ccgccacugcacuccagacugggcgacagagu

SEQ ID NO: 109624 - RNA, 32 nt, Human
ccgccacugcacuccagcccaggugacagagc

SEQ ID NO: 109625 - RNA, 32 nt, Human
ccgccacugcacuccagccugggcaacagagc

SEQ ID NO: 109626 - RNA, 32 nt, Human
ccgccacugcacuccagccugggcgacagagc

SEQ ID NO: 109627 - RNA, 32 nt, Human
ccgccacugcacuccagccugggugacagagu

SEQ ID NO: 109628 - RNA, 32 nt, Human
ccgccacugcacucuagccugggugacagaua

SEQ ID NO: 109629 - RNA, 32 nt, Human
ccgccacugcagaggcgaaagccagugcuuug

SEQ ID NO: 109630 - RNA, 32 nt, Human
ccgccagagagagcaggagcaagacugagggc

SEQ ID NO: 109631 - RNA, 32 nt, Human
ccgccagaggacaaggaagugggggccgcugg

SEQ ID NO: 109632 - RNA, 32 nt, Human
ccgccagaggccacugcaccugggcuaggggu

SEQ ID NO: 109633 - RNA, 32 nt, Human
ccgccagaugacggaggcucucgccagacccu

SEQ ID NO: 109634 - RNA, 32 nt, Human
ccgccagaugcccagccuacagccucucaggg

SEQ ID NO: 109635 - RNA, 23 nt, Human
ccgccagauugcuuagugccuga

SEQ ID NO: 109636 - RNA, 19 nt, Human
ccgccagcacgcccuggcc

SEQ ID NO: 109637 - RNA, 20 nt, Human
ccgccagcagccgccgagcu

SEQ ID NO: 109638 - RNA, 32 nt, Human
ccgccagccagccagcgccuucauccuggggc

SEQ ID NO: 109639 - RNA, 32 nt, Human
ccgccagccaggagcaggcccagcaagcucug

SEQ ID NO: 109640 - RNA, 32 nt, Human
ccgccagccugucccgcgccauggccccgcgc

SEQ ID NO: 109641 - RNA, 21 nt, Human
ccgccagccugugcuggguca

SEQ ID NO: 109642 - RNA, 18 nt, Human
ccgccagcggcuccgagc

SEQ ID NO: 109643 - RNA, 23 nt, Human
ccgccagcucgcccuccgagcca

SEQ ID NO: 109644 - RNA, 32 nt, Human
ccgccagcugcaucagaucccuccagggccuc

SEQ ID NO: 109645 - RNA, 20 nt, Human
ccgccagcuugucccagcca

SEQ ID NO: 109646 - RNA, 32 nt, Human
ccgccaggaaggcagcugucugcugcugaguc

SEQ ID NO: 109647 - RNA, 32 nt, Human
ccgccaggagccacugcucucccccuugcccu

SEQ ID NO: 109648 - RNA, 22 nt, Human
ccgccaggauuugcagagagca

SEQ ID NO: 109649 - RNA, 32 nt, Human
ccgccaggccagugccccagcccagggugcuc

SEQ ID NO: 109650 - RNA, 18 nt, Human
ccgccaggccccgggcca

SEQ ID NO: 109651 - RNA, 32 nt, Human
ccgccaggcucccaugucaucgaugccugugc

SEQ ID NO: 109652 - RNA, 32 nt, Human
ccgccaggcugcaggcgucgggccugggccgu

SEQ ID NO: 109653 - RNA, 32 nt, Human
ccgccagggaaagaggggagcggggucuagaa

SEQ ID NO: 109654 - RNA, 32 nt, Human
ccgccagggcaaaggagcugagcagccauccc

SEQ ID NO: 109655 - RNA, 32 nt, Human
ccgccaggggaugaggaagugggggccgcugg

SEQ ID NO: 109656 - RNA, 32 nt, Human
ccgccaggggugagagggaggaaaccgggccg

SEQ ID NO: 109657 - RNA, 32 nt, Human
ccgccaguacccccuccagccccacaccuggg

SEQ ID NO: 109658 - RNA, 32 nt, Human
ccgccagucagggcucuccccuuccccucccu

SEQ ID NO: 109659 - RNA, 21 nt, Human
ccgccaguccccgccccgacu

SEQ ID NO: 109660 - RNA, 23 nt, Human
ccgccaguccgcgcgcccgggcc

SEQ ID NO: 109661 - RNA, 17 nt, Human
ccgccagucuccgagcc

SEQ ID NO: 109662 - RNA, 32 nt, Human
ccgccagucucucaaauuucagaggaggcugu

SEQ ID NO: 109663 - RNA, 23 nt, Human
ccgccagucugcccagcugcagu

SEQ ID NO: 109664 - RNA, 32 nt, Human
ccgccaguuccugcaagagcagaagccaggca

SEQ ID NO: 109665 - RNA, 32 nt, Human
ccgccaguuccuggggcacacccagagguccc

SEQ ID NO: 109666 - RNA, 19 nt, Human
ccgccaguugcacgccugc

SEQ ID NO: 109667 - RNA, 32 nt, Human
ccgccauccagaaagcagcagccgucauacug

SEQ ID NO: 109668 - RNA, 32 nt, Human
ccgccauccagggcggggaagggagcggaccc

SEQ ID NO: 109669 - RNA, 32 nt, Human
ccgccaucccccgaccccucugaucuccgauc

SEQ ID NO: 109670 - RNA, 32 nt, Human
ccgccaucgcucgucucuuccucucuccugcc

SEQ ID NO: 109671 - RNA, 17 nt, Human
ccgccaucgucccggcu

SEQ ID NO: 109672 - RNA, 32 nt, Human
ccgccaucgucccggcugaagugcaguggcac

SEQ ID NO: 109673 - RNA, 32 nt, Human
ccgccaucucccgccucauacaccagcaaccu

SEQ ID NO: 109674 - RNA, 32 nt, Human
ccgccaucucggcuucuucccaccagcgaagg

SEQ ID NO: 109675 - RNA, 18 nt, Human
ccgccaugcccugagcca

SEQ ID NO: 109676 - RNA, 16 nt, Human
ccgccaugcccuggcc

SEQ ID NO: 109677 - RNA, 30 nt, Human
ccgccaugccgcccuccaucucagcuuucc

SEQ ID NO: 109678 - RNA, 30 nt, Human
ccgccaugccguuccuggagcuggacacga

SEQ ID NO: 109679 - RNA, 19 nt, Human
ccgccauggguccgagcca

SEQ ID NO: 109680 - RNA, 32 nt, Human
ccgccauguaaccagauagggcuguguccagg

SEQ ID NO: 109681 - RNA, 32 nt, Human
ccgccauguaaguuaccaugccugucuccucc

SEQ ID NO: 109682 - RNA, 32 nt, Human
ccgccauuagagggaggcagagagggaucguu

SEQ ID NO: 109683 - RNA, 32 nt, Human
ccgccauuggagucgacgccuccucagugcgu

SEQ ID NO: 109684 - RNA, 23 nt, Human
ccgcccaaacuggagugcagugg

SEQ ID NO: 109685 - RNA, 32 nt, Human
ccgcccaaaguguugggauuacaggcaugagc

SEQ ID NO: 109686 - RNA, 32 nt, Human
ccgcccaaauccaucacacaugaguuggaaug

SEQ ID NO: 109687 - RNA, 32 nt, Human
ccgcccaacguuugccucccagccugacuccc

SEQ ID NO: 109688 - RNA, 32 nt, Human
ccgcccaauauggugaaaccccgucucuccug

SEQ ID NO: 109689 - RNA, 21 nt, Human
ccgcccaauggacuccugcca

SEQ ID NO: 109690 - RNA, 32 nt, Human
ccgcccacaccugaagcccacagcguccaccc

SEQ ID NO: 109691 - RNA, 32 nt, Human
ccgcccacagcacacguucuccggacaggagg

SEQ ID NO: 109692 - RNA, 32 nt, Human
ccgcccacagcccauuuugaggaagaggugau

SEQ ID NO: 109693 - RNA, 32 nt, Human
ccgcccaccauggcugaggaggaagaggggac

SEQ ID NO: 109694 - RNA, 32 nt, Human
ccgcccaccauggcuuccgaggagcuguacga

SEQ ID NO: 109695 - RNA, 19 nt, Human
ccgcccaccgccccggcca

SEQ ID NO: 109696 - RNA, 18 nt, Human
ccgcccaccgccccggcu

SEQ ID NO: 109697 - RNA, 32 nt, Human
ccgcccacgagcugcccagucccucugcuugc

SEQ ID NO: 109698 - RNA, 20 nt, Human
ccgcccacgccccuccuucc

SEQ ID NO: 109699 - RNA, 18 nt, Human
ccgcccacgcuccggguc

SEQ ID NO: 109700 - RNA, 32 nt, Human
ccgcccacgucagggagagaugugagcauccc

SEQ ID NO: 109701 - RNA, 22 nt, Human
ccgcccacucagccccgggaca

SEQ ID NO: 109702 - RNA, 20 nt, Human
ccgcccacuccacccugcca

SEQ ID NO: 109703 - RNA, 21 nt, Human
ccgcccacugaaccucugcca

SEQ ID NO: 109704 - RNA, 32 nt, Human
ccgcccacugccgcuggcccugggcaggucua

SEQ ID NO: 109705 - RNA, 32 nt, Human
ccgcccagacuggccagccccacagcccacgu

SEQ ID NO: 109706 - RNA, 32 nt, Human
ccgcccagacuggcucagcccaggccaccaac

SEQ ID NO: 109707 - RNA, 32 nt, Human
ccgcccagagcagcaccgacuccgcgcacgag

SEQ ID NO: 109708 - RNA, 32 nt, Human
ccgcccagagccccagcgcgccgaggauguga

SEQ ID NO: 109709 - RNA, 17 nt, Human
ccgcccagccccgagcc

SEQ ID NO: 109710 - RNA, 32 nt, Human
ccgcccagccccgggggcagggaaagccuaaa

SEQ ID NO: 109711 - RNA, 32 nt, Human
ccgcccagccccuugacuccagccucgaccgc

SEQ ID NO: 109712 - RNA, 32 nt, Human
ccgcccagcccgcagcccccucccucuguucc

SEQ ID NO: 109713 - RNA, 19 nt, Human
ccgcccagccgcucugacu

SEQ ID NO: 109714 - RNA, 32 nt, Human
ccgcccagcugcaccugccagccuggcuucug

SEQ ID NO: 109715 - RNA, 32 nt, Human
ccgcccaggagggugccuuccucggggguagg

SEQ ID NO: 109716 - RNA, 32 nt, Human
ccgcccaggcagcggaauagagugcagugcuu

SEQ ID NO: 109717 - RNA, 21 nt, Human
ccgcccaggccagcacugcca

SEQ ID NO: 109718 - RNA, 20 nt, Human
ccgcccaggcccuguaggga

SEQ ID NO: 109719 - RNA, 32 nt, Human
ccgcccaggcgggagugcaguggcaguggcau

SEQ ID NO: 109720 - RNA, 23 nt, Human
ccgcccaggcuagagugcagugg

SEQ ID NO: 109721 - RNA, 32 nt, Human
ccgcccaggcuggacugcagugacacaaucuc

SEQ ID NO: 109722 - RNA, 32 nt, Human
ccgcccaggcuggagugcagugccaugaucac

SEQ ID NO: 109723 - RNA, 23 nt, Human
ccgcccaggcuggagugcagugg

SEQ ID NO: 109724 - RNA, 32 nt, Human
ccgcccaggcuggagugcaguggcgcgaucuc

SEQ ID NO: 109725 - RNA, 21 nt, Human
ccgcccaguccagcugugcuc

SEQ ID NO: 109726 - RNA, 19 nt, Human
ccgcccagugcgcccugcc

SEQ ID NO: 109727 - RNA, 32 nt, Human
ccgcccagugcucucacuauccaccucaacac

SEQ ID NO: 109728 - RNA, 32 nt, Human
ccgcccauaauaacacuccagucuggggcuuu

SEQ ID NO: 109729 - RNA, 32 nt, Human
ccgcccaucccaggacuccagaugccaggagc

SEQ ID NO: 109730 - RNA, 32 nt, Human
ccgcccaugcuggauaggaccugggaugcugc

SEQ ID NO: 109731 - RNA, 32 nt, Human
ccgcccauguggcuacuggaggucacguuccc

SEQ ID NO: 109732 - RNA, 32 nt, Human
ccgcccauuccuggcccucccgcugcaucuca

SEQ ID NO: 109733 - RNA, 22 nt, Human
ccgccccaacccuguccacccu

SEQ ID NO: 109734 - RNA, 21 nt, Human
ccgccccaaccuuccuucccu

SEQ ID NO: 109735 - RNA, 23 nt, Human
ccgccccaagcccugccccuccu

SEQ ID NO: 109736 - RNA, 20 nt, Human
ccgccccacacuugcucuga

SEQ ID NO: 109737 - RNA, 32 nt, Human
ccgccccacagugcccugcaguugccaggcuc

SEQ ID NO: 109738 - RNA, 32 nt, Human
ccgccccaccaugggcaacagcgcgagccgca

SEQ ID NO: 109739 - RNA, 32 nt, Human
ccgccccacccagaugggggaaagcacaggug

SEQ ID NO: 109740 - RNA, 20 nt, Human
ccgccccacccccuccuccc

SEQ ID NO: 109741 - RNA, 21 nt, Human
ccgccccacccggcccacugg

SEQ ID NO: 109742 - RNA, 25 nt, Human
ccgccccaccggaccucguccuccc

SEQ ID NO: 109743 - RNA, 22 nt, Human
ccgccccaccuccucccucccu

SEQ ID NO: 109744 - RNA, 32 nt, Human
ccgccccaccuugccagacuuagcugaccagc

SEQ ID NO: 109745 - RNA, 32 nt, Human
ccgccccacucccuccuaaccuagagauuguu

SEQ ID NO: 109746 - RNA, 32 nt, Human
ccgccccagaggcaggagacugaccgcucagu

SEQ ID NO: 109747 - RNA, 32 nt, Human
ccgccccagcacuuuuggcucuguugcgcgug

SEQ ID NO: 109748 - RNA, 18 nt, Human
ccgccccagccccgaguc

SEQ ID NO: 109749 - RNA, 23 nt, Human
ccgccccagccccgagucccgcc

SEQ ID NO: 109750 - RNA, 21 nt, Human
ccgccccagccccgccuuccc

SEQ ID NO: 109751 - RNA, 18 nt, Human
ccgccccagccccggguc

SEQ ID NO: 109752 - RNA, 21 nt, Human
ccgccccagccccgggucccc

SEQ ID NO: 109753 - RNA, 32 nt, Human
ccgccccagccccugacacacacucggacccc

SEQ ID NO: 109754 - RNA, 23 nt, Human
ccgccccagcccgcugggccgcc

SEQ ID NO: 109755 - RNA, 23 nt, Human
ccgccccagcccucagucacccc

SEQ ID NO: 109756 - RNA, 19 nt, Human
ccgccccagccuaccuucc

SEQ ID NO: 109757 - RNA, 19 nt, Human
ccgccccagccucugagcc

SEQ ID NO: 109758 - RNA, 22 nt, Human
ccgccccagccucugagccccu

SEQ ID NO: 109759 - RNA, 23 nt, Human
ccgccccagccugauuccugccu

SEQ ID NO: 109760 - RNA, 24 nt, Human
ccgccccagccugccguggggccc

SEQ ID NO: 109761 - RNA, 32 nt, Human
ccgccccaggcagaggugggggauauccggga

SEQ ID NO: 109762 - RNA, 21 nt, Human
ccgccccaggugcccgccccu

SEQ ID NO: 109763 - RNA, 32 nt, Human
ccgccccauaucacugcaacaccuacaaguuu

SEQ ID NO: 109764 - RNA, 20 nt, Human
ccgccccauucugucccccu

SEQ ID NO: 109765 - RNA, 20 nt, Human
ccgccccauuuuggccuccc

SEQ ID NO: 109766 - RNA, 32 nt, Human
ccgcccccaaccacagcagagacuagcagcgg

SEQ ID NO: 109767 - RNA, 20 nt, Human
ccgcccccaccgacgccgcc

SEQ ID NO: 109768 - RNA, 32 nt, Human
ccgcccccagccccagccccgccgggccccgc

SEQ ID NO: 109769 - RNA, 22 nt, Human
ccgcccccaggcccgcaguguc

SEQ ID NO: 109770 - RNA, 32 nt, Human
ccgcccccaggguuguuaaagccagacugcga

SEQ ID NO: 109771 - RNA, 18 nt, Human
ccgccccccagagccagg

SEQ ID NO: 109772 - RNA, 22 nt, Human
ccgccccccaucaugucugcca

SEQ ID NO: 109773 - RNA, 20 nt, Human
ccgccccccggcuguccucc

SEQ ID NO: 109774 - RNA, 21 nt, Human
ccgccccccucccaggcccca

SEQ ID NO: 109775 - RNA, 32 nt, Human
ccgcccccgacccgagcucuuucgucugccug

SEQ ID NO: 109776 - RNA, 20 nt, Human
ccgcccccgccccccgggcc

SEQ ID NO: 109777 - RNA, 32 nt, Human
ccgcccccgcuccagcuccagccggguccucg

SEQ ID NO: 109778 - RNA, 23 nt, Human
ccgcccccggcccgccgccuccc

SEQ ID NO: 109779 - RNA, 32 nt, Human
ccgcccccggccgggucuccacuucuuggccg

SEQ ID NO: 109780 - RNA, 20 nt, Human
ccgcccccggccugcccccc

SEQ ID NO: 109781 - RNA, 26 nt, Human
ccgcccccgggccccgcuguccuccc

SEQ ID NO: 109782 - RNA, 32 nt, Human
ccgcccccuccagggggcucugcucccacccc

SEQ ID NO: 109783 - RNA, 27 nt, Human
ccgcccccuccccuccacguucuuccu

SEQ ID NO: 109784 - RNA, 32 nt, Human
ccgcccccuccccucccccgccgccucgcaga

SEQ ID NO: 109785 - RNA, 32 nt, Human
ccgcccccuccccuccccgccucgcgcugcuc

SEQ ID NO: 109786 - RNA, 22 nt, Human
ccgcccccuccccuucccucca

SEQ ID NO: 109787 - RNA, 32 nt, Human
ccgcccccuccccuucuccgucugucccaaga

SEQ ID NO: 109788 - RNA, 22 nt, Human
ccgcccccucccgccagcucca

SEQ ID NO: 109789 - RNA, 24 nt, Human
ccgcccccucccuccgaacugcca

SEQ ID NO: 109790 - RNA, 21 nt, Human
ccgcccccucccucgcucgcc

SEQ ID NO: 109791 - RNA, 28 nt, Human
ccgcccccuccuccccaccauccucccu

SEQ ID NO: 109792 - RNA, 17 nt, Human
ccgcccccuggccccca

SEQ ID NO: 109793 - RNA, 32 nt, Human
ccgcccccugggcuggagggcugugugugguc

SEQ ID NO: 109794 - RNA, 20 nt, Human
ccgcccccuuccuggccugc

SEQ ID NO: 109795 - RNA, 22 nt, Human
ccgccccgaagcagccuccuga

SEQ ID NO: 109796 - RNA, 32 nt, Human
ccgccccgacaccagcucuccagccugcucgu

SEQ ID NO: 109797 - RNA, 20 nt, Human
ccgccccgagcagaaaggca

SEQ ID NO: 109798 - RNA, 32 nt, Human
ccgccccgagcagaaaggcauugacguuugua

SEQ ID NO: 109799 - RNA, 32 nt, Human
ccgccccgaggaugaguggugauguccucuag

SEQ ID NO: 109800 - RNA, 21 nt, Human
ccgccccgcacgcgcccuccc

SEQ ID NO: 109801 - RNA, 19 nt, Human
ccgccccgcacgcucgcuc

SEQ ID NO: 109802 - RNA, 17 nt, Human
ccgccccgccccgagcc

SEQ ID NO: 109803 - RNA, 17 nt, Human
ccgccccgcccugcccc

SEQ ID NO: 109804 - RNA, 21 nt, Human
ccgccccgcccugcccccucc

SEQ ID NO: 109805 - RNA, 16 nt, Human
ccgccccgcccuggcc

SEQ ID NO: 109806 - RNA, 18 nt, Human
ccgccccgcccugggcca

SEQ ID NO: 109807 - RNA, 32 nt, Human
ccgccccgccucuccaaaaagcuacaccgacg

SEQ ID NO: 109808 - RNA, 18 nt, Human
ccgccccgcgccccgggc

SEQ ID NO: 109809 - RNA, 22 nt, Human
ccgccccgcgccgccccgcccu

SEQ ID NO: 109810 - RNA, 20 nt, Human
ccgccccgcgcggcccuccc

SEQ ID NO: 109811 - RNA, 32 nt, Human
ccgccccgcucgggggcugagccggcagugcc

SEQ ID NO: 109812 - RNA, 32 nt, Human
ccgccccgcugaggccugucugcagaauccac

SEQ ID NO: 109813 - RNA, 20 nt, Human
ccgccccgcugcccccuccc

SEQ ID NO: 109814 - RNA, 19 nt, Human
ccgccccggcuccgggcca

SEQ ID NO: 109815 - RNA, 32 nt, Human
ccgccccggggaagaagagacagggguggggu

SEQ ID NO: 109816 - RNA, 32 nt, Human
ccgccccggggaggcaggcuggcagguggaca

SEQ ID NO: 109817 - RNA, 32 nt, Human
ccgccccguaucucuuuucacccuucucccac

SEQ ID NO: 109818 - RNA, 32 nt, Human
ccgccccuaugaccaacaugagcuggagcuuc

SEQ ID NO: 109819 - RNA, 32 nt, Human
ccgccccucacagauugccgcagggcaggggc

SEQ ID NO: 109820 - RNA, 32 nt, Human
ccgccccucaggcccagccucuggcaagaggu

SEQ ID NO: 109821 - RNA, 32 nt, Human
ccgccccuccacccccuccaacucugcuccuc

SEQ ID NO: 109822 - RNA, 22 nt, Human
ccgccccuccccacccugcccu

SEQ ID NO: 109823 - RNA, 18 nt, Human
ccgccccucccuugggcc

SEQ ID NO: 109824 - RNA, 26 nt, Human
ccgccccuccgucgccgcugccuccu

SEQ ID NO: 109825 - RNA, 32 nt, Human
ccgccccuccucaccgaaaagcagaaagcccg

SEQ ID NO: 109826 - RNA, 21 nt, Human
ccgccccuccuccagucuacu

SEQ ID NO: 109827 - RNA, 22 nt, Human
ccgccccuccucccggcacucc

SEQ ID NO: 109828 - RNA, 22 nt, Human
ccgccccuccucccugcucucu

SEQ ID NO: 109829 - RNA, 18 nt, Human
ccgccccuccuccgggcc

SEQ ID NO: 109830 - RNA, 32 nt, Human
ccgccccugagugcucauguaccauuuagcuu

SEQ ID NO: 109831 - RNA, 32 nt, Human
ccgccccugcagcugcucccuggguggccccg

SEQ ID NO: 109832 - RNA, 32 nt, Human
ccgccccugccaccccugccgcccgguuccca

SEQ ID NO: 109833 - RNA, 20 nt, Human
ccgccccugccacugggcca

SEQ ID NO: 109834 - RNA, 32 nt, Human
ccgccccugccugcccgccugccgguggcugu

SEQ ID NO: 109835 - RNA, 32 nt, Human
ccgccccugccuggaaacugcugguggggaaa

SEQ ID NO: 109836 - RNA, 32 nt, Human
ccgccccugccugugcucugccucgggccauc

SEQ ID NO: 109837 - RNA, 32 nt, Human
ccgccccugcuccccucuccgacccuuugagc

SEQ ID NO: 109838 - RNA, 32 nt, Human
ccgccccugcuggccuuggugcuaaggaagug

SEQ ID NO: 109839 - RNA, 32 nt, Human
ccgccccuuagugcuuuuuguuuucuaaccuc

SEQ ID NO: 109840 - RNA, 21 nt, Human
ccgccccuucccggccccccu

SEQ ID NO: 109841 - RNA, 19 nt, Human
ccgccccuucccugagcca

SEQ ID NO: 109842 - RNA, 32 nt, Human
ccgccccuugagccugggauccagccucagcg

SEQ ID NO: 109843 - RNA, 21 nt, Human
ccgccccuuuccugcccgccc

SEQ ID NO: 109844 - RNA, 32 nt, Human
ccgccccuuugggcggagaggggaccucacca

SEQ ID NO: 109845 - RNA, 32 nt, Human
ccgcccgcagcugaagcacaucccgcagcccg

SEQ ID NO: 109846 - RNA, 19 nt, Human
ccgcccgcaggucccgggc

SEQ ID NO: 109847 - RNA, 32 nt, Human
ccgcccgcccagccccucgaccccuguagccc

SEQ ID NO: 109848 - RNA, 19 nt, Human
ccgcccgccgccgccgccg

SEQ ID NO: 109849 - RNA, 32 nt, Human
ccgcccgccgccgccucuggugacccgggccc

SEQ ID NO: 109850 - RNA, 32 nt, Human
ccgcccgccggccuggcccggccgggcggggc

SEQ ID NO: 109851 - RNA, 32 nt, Human
ccgcccgccucagucucccaaagugcgaggau

SEQ ID NO: 109852 - RNA, 32 nt, Human
ccgcccgccucugccucccaaaaugcugggau

SEQ ID NO: 109853 - RNA, 32 nt, Human
ccgcccgccugccucuuccgccccgcggguuu

SEQ ID NO: 109854 - RNA, 21 nt, Human
ccgcccgccuugucccgcguc

SEQ ID NO: 109855 - RNA, 22 nt, Human
ccgcccgcgccccaggcccuug

SEQ ID NO: 109856 - RNA, 17 nt, Human
ccgcccgcgcccccucc

SEQ ID NO: 109857 - RNA, 18 nt, Human
ccgcccgcgccccgacca

SEQ ID NO: 109858 - RNA, 17 nt, Human
ccgcccgcgccccggcu

SEQ ID NO: 109859 - RNA, 21 nt, Human
ccgcccgcgccgccgccgccg

SEQ ID NO: 109860 - RNA, 18 nt, Human
ccgcccgcgcggggucuc

SEQ ID NO: 109861 - RNA, 19 nt, Human
ccgcccgcgcucgcuccuc

SEQ ID NO: 109862 - RNA, 20 nt, Human
ccgcccgcggccccgagucg

SEQ ID NO: 109863 - RNA, 32 nt, Human
ccgcccgcucagaaagcgcgggaaaggcacgc

SEQ ID NO: 109864 - RNA, 32 nt, Human
ccgcccgcuccccuccccucccccuccccggg

SEQ ID NO: 109865 - RNA, 25 nt, Human
ccgcccgcucgccgccuuccucccu

SEQ ID NO: 109866 - RNA, 32 nt, Human
ccgcccgcucgccgccuuccucccucugccuu

SEQ ID NO: 109867 - RNA, 32 nt, Human
ccgcccgcugaggagauggaugaggacgggcu

SEQ ID NO: 109868 - RNA, 18 nt, Human
ccgcccgcugccuugggu

SEQ ID NO: 109869 - RNA, 20 nt, Human
ccgcccgcugucccgguuca

SEQ ID NO: 109870 - RNA, 19 nt, Human
ccgcccgcuuguccugacc

SEQ ID NO: 109871 - RNA, 19 nt, Human
ccgcccggagcccgccugg

SEQ ID NO: 109872 - RNA, 32 nt, Human
ccgcccggaggaagaaggaaggcgcgggccgg

SEQ ID NO: 109873 - RNA, 20 nt, Human
ccgcccggccgcuccgggcc

SEQ ID NO: 109874 - RNA, 24 nt, Human
ccgcccggcgaugucccugagcca

SEQ ID NO: 109875 - RNA, 19 nt, Human
ccgcccggcucccugggcc

SEQ ID NO: 109876 - RNA, 19 nt, Human
ccgcccggcugaggaggug

SEQ ID NO: 109877 - RNA, 32 nt, Human
ccgcccgggcccagaggagcugggagccgggc

SEQ ID NO: 109878 - RNA, 32 nt, Human
ccgcccgggccgcggcgggcuguggucacagg

SEQ ID NO: 109879 - RNA, 20 nt, Human
ccgcccguccgccccgggcc

SEQ ID NO: 109880 - RNA, 32 nt, Human
ccgcccgucgaccccacuuccaugucuggcgg

SEQ ID NO: 109881 - RNA, 17 nt, Human
ccgcccgugccccgacc

SEQ ID NO: 109882 - RNA, 32 nt, Human
ccgcccguucccucccggacauggaggacgug

SEQ ID NO: 109883 - RNA, 32 nt, Human
ccgcccucagccauggcccgcucaccuaccac

SEQ ID NO: 109884 - RNA, 20 nt, Human
ccgcccucaggcuccgggcu

SEQ ID NO: 109885 - RNA, 21 nt, Human
ccgcccucagucgcugggcca

SEQ ID NO: 109886 - RNA, 22 nt, Human
ccgcccuccagcugcccucccu

SEQ ID NO: 109887 - RNA, 32 nt, Human
ccgcccuccaucucucuccaugccaaaauggc

SEQ ID NO: 109888 - RNA, 21 nt, Human
ccgcccucccaagugcagcug

SEQ ID NO: 109889 - RNA, 16 nt, Human
ccgcccuccccacuaa

SEQ ID NO: 109890 - RNA, 17 nt, Human
ccgcccuccccccgagu

SEQ ID NO: 109891 - RNA, 32 nt, Human
ccgcccuccccgcucuccuuccugggcgagcu

SEQ ID NO: 109892 - RNA, 20 nt, Human
ccgcccucccgcugcgucuc

SEQ ID NO: 109893 - RNA, 32 nt, Human
ccgcccucccggcuggagagcucaggugcugg

SEQ ID NO: 109894 - RNA, 21 nt, Human
ccgcccucccuccgcggggau

SEQ ID NO: 109895 - RNA, 32 nt, Human
ccgcccucccuucuuuccuuccuuccuucccu

SEQ ID NO: 109896 - RNA, 23 nt, Human
ccgcccuccuccgcuccgggcca

SEQ ID NO: 109897 - RNA, 32 nt, Human
ccgcccuccugggaacgcggcccuccccucgc

SEQ ID NO: 109898 - RNA, 32 nt, Human
ccgcccuccuugcugucacaggugcagccugu

SEQ ID NO: 109899 - RNA, 32 nt, Human
ccgcccucgccugccgggcgcuugccucggug

SEQ ID NO: 109900 - RNA, 23 nt, Human
ccgcccucggccgccccgacgcc

SEQ ID NO: 109901 - RNA, 32 nt, Human
ccgcccucggcuccugcacucgccgagcggcg

SEQ ID NO: 109902 - RNA, 32 nt, Human
ccgcccucucaccucggguuguggcuuagguu

SEQ ID NO: 109903 - RNA, 23 nt, Human
ccgcccucucccacccucuccuc

SEQ ID NO: 109904 - RNA, 32 nt, Human
ccgcccucucccacccucuccuccccuugcgc

SEQ ID NO: 109905 - RNA, 19 nt, Human
ccgcccucugcuccgggcu

SEQ ID NO: 109906 - RNA, 24 nt, Human
ccgcccucuuuuguccucuuccca

SEQ ID NO: 109907 - RNA, 32 nt, Human
ccgcccugacauccuggacaugccuagccugc

SEQ ID NO: 109908 - RNA, 32 nt, Human
ccgcccugaccaggauagggcgggugggaagg

SEQ ID NO: 109909 - RNA, 32 nt, Human
ccgcccugaggccgucguguggcuggagugcu

SEQ ID NO: 109910 - RNA, 32 nt, Human
ccgcccugaucugacuaucccacaucauacac

SEQ ID NO: 109911 - RNA, 32 nt, Human
ccgcccugcacgcccccgccacguggaugagc

SEQ ID NO: 109912 - RNA, 32 nt, Human
ccgcccugcacugcugucugggcggguccggg

SEQ ID NO: 109913 - RNA, 32 nt, Human
ccgcccugcugcaggcggaggugcuggaucug

SEQ ID NO: 109914 - RNA, 22 nt, Human
ccgcccugcuucacugcccccu

SEQ ID NO: 109915 - RNA, 32 nt, Human
ccgcccuggaccgagggaaccuuaagucagaa

SEQ ID NO: 109916 - RNA, 32 nt, Human
ccgcccuggagugagggaagcccaguggaagg

SEQ ID NO: 109917 - RNA, 32 nt, Human
ccgcccugggcuggacuggaggugggcaugcc

SEQ ID NO: 109918 - RNA, 20 nt, Human
ccgcccugggcuggcuggga

SEQ ID NO: 109919 - RNA, 32 nt, Human
ccgcccuggucuccuggaacuggugggccgca

SEQ ID NO: 109920 - RNA, 32 nt, Human
ccgcccuggugcaaagucccacgcggcgaaga

SEQ ID NO: 109921 - RNA, 32 nt, Human
ccgcccugguggacuccucccgcuggaggcgg

SEQ ID NO: 109922 - RNA, 32 nt, Human
ccgcccuuccagcugaggacaggcuggcgccu

SEQ ID NO: 109923 - RNA, 19 nt, Human
ccgcccuucccgguuccug

SEQ ID NO: 109924 - RNA, 32 nt, Human
ccgcccuucuccccacaucccacccuuacccc

SEQ ID NO: 109925 - RNA, 32 nt, Human
ccgcccuuucagggacuguuaucugcagcuua

SEQ ID NO: 109926 - RNA, 32 nt, Human
ccgcccuuucuccucaugcacccggccucguc

SEQ ID NO: 109927 - RNA, 32 nt, Human
ccgccgacacccaccccagcacugcaggcagc

SEQ ID NO: 109928 - RNA, 17 nt, Human
ccgccgacgccucagcc

SEQ ID NO: 109929 - RNA, 31 nt, Human
ccgccgagagccccucugccugugucgugug

SEQ ID NO: 109930 - RNA, 20 nt, Human
ccgccgagcccccggggcca

SEQ ID NO: 109931 - RNA, 32 nt, Human
ccgccgagcccgggguggaggagggagccagg

SEQ ID NO: 109932 - RNA, 32 nt, Human
ccgccgagccugggcgcagagagccgggagga

SEQ ID NO: 109933 - RNA, 22 nt, Human
ccgccgaggcccacccgggcca

SEQ ID NO: 109934 - RNA, 19 nt, Human
ccgccgaggcgccgagccg

SEQ ID NO: 109935 - RNA, 20 nt, Human
ccgccgaggcucgcuggguc

SEQ ID NO: 109936 - RNA, 18 nt, Human
ccgccgaguccccugggc

SEQ ID NO: 109937 - RNA, 20 nt, Human
ccgccgcacccaggacggag

SEQ ID NO: 109938 - RNA, 19 nt, Human
ccgccgcaccccaagaugg

SEQ ID NO: 109939 - RNA, 25 nt, Human
ccgccgcacgcugcagccgcggcug

SEQ ID NO: 109940 - RNA, 23 nt, Human
ccgccgcacuccugccccgaagg

SEQ ID NO: 109941 - RNA, 19 nt, Human
ccgccgcagcagcagcagc

SEQ ID NO: 109942 - RNA, 22 nt, Human
ccgccgcagccaggagccgcug

SEQ ID NO: 109943 - RNA, 19 nt, Human
ccgccgcagccgccgcagc

SEQ ID NO: 109944 - RNA, 32 nt, Human
ccgccgcagccgccgcagcagcagcagccgcc

SEQ ID NO: 109945 - RNA, 21 nt, Human
ccgccgcagccgccgccgcug

SEQ ID NO: 109946 - RNA, 19 nt, Human
ccgccgcagccgcugccgc

SEQ ID NO: 109947 - RNA, 22 nt, Human
ccgccgcagccuccgccgcagc

SEQ ID NO: 109948 - RNA, 22 nt, Human
ccgccgcagccucgccgcgcug

SEQ ID NO: 109949 - RNA, 21 nt, Human
ccgccgcagccuugcuggagc

SEQ ID NO: 109950 - RNA, 18 nt, Human
ccgccgcagcgucggguc

SEQ ID NO: 109951 - RNA, 21 nt, Human
ccgccgcagcugccuggcagc

SEQ ID NO: 109952 - RNA, 32 nt, Human
ccgccgcagcuggugaaugacggugccaugac

SEQ ID NO: 109953 - RNA, 22 nt, Human
ccgccgcaguccucgccgcagu

SEQ ID NO: 109954 - RNA, 20 nt, Human
ccgccgcagucgcccgggcc

SEQ ID NO: 109955 - RNA, 26 nt, Human
ccgccgcaguucucgagcuccagcug

SEQ ID NO: 109956 - RNA, 24 nt, Human
ccgccgcaucccgacucugggcca

SEQ ID NO: 109957 - RNA, 27 nt, Human
ccgccgccaaagcagccgccgccagca

SEQ ID NO: 109958 - RNA, 32 nt, Human
ccgccgccaaagcucgccaacauggcggaccu

SEQ ID NO: 109959 - RNA, 32 nt, Human
ccgccgccacauccucugagaagauggcugug

SEQ ID NO: 109960 - RNA, 24 nt, Human
ccgccgccaccaacgccaacaaca

SEQ ID NO: 109961 - RNA, 18 nt, Human
ccgccgccaccaccauca

SEQ ID NO: 109962 - RNA, 32 nt, Human
ccgccgccaccaggaaggcggaggacgcagga

SEQ ID NO: 109963 - RNA, 20 nt, Human
ccgccgccaccgccccggcu

SEQ ID NO: 109964 - RNA, 24 nt, Human
ccgccgccaccgccgccgccgcca

SEQ ID NO: 109965 - RNA, 32 nt, Human
ccgccgccaccgccuccugggacucggaacgc

SEQ ID NO: 109966 - RNA, 18 nt, Human
ccgccgccacuaccgggg

SEQ ID NO: 109967 - RNA, 21 nt, Human
ccgccgccacugccuugguua

SEQ ID NO: 109968 - RNA, 32 nt, Human
ccgccgccagcccaggcgcaggcagggcgcag

SEQ ID NO: 109969 - RNA, 32 nt, Human
ccgccgccagccgccgcgaccgccgcggcugc

SEQ ID NO: 109970 - RNA, 19 nt, Human
ccgccgccagcucccgggc

SEQ ID NO: 109971 - RNA, 17 nt, Human
ccgccgccaggccggca

SEQ ID NO: 109972 - RNA, 20 nt, Human
ccgccgccagugaccgagcc

SEQ ID NO: 109973 - RNA, 32 nt, Human
ccgccgccaugcagcccuccagccuucugccg

SEQ ID NO: 109974 - RNA, 32 nt, Human
ccgccgccauugccgcucucucggugagcgca

SEQ ID NO: 109975 - RNA, 18 nt, Human
ccgccgcccacccgagcc

SEQ ID NO: 109976 - RNA, 32 nt, Human
ccgccgcccacccucugcuagacacagccaag

SEQ ID NO: 109977 - RNA, 32 nt, Human
ccgccgcccagccccuccuugcacuacuccac

SEQ ID NO: 109978 - RNA, 32 nt, Human
ccgccgcccagccggugaucgcucuccggccg

SEQ ID NO: 109979 - RNA, 32 nt, Human
ccgccgcccccgagggacgagugacagcggcc

SEQ ID NO: 109980 - RNA, 19 nt, Human
ccgccgcccccucaccagc

SEQ ID NO: 109981 - RNA, 21 nt, Human
ccgccgccccgcgucccggcc

SEQ ID NO: 109982 - RNA, 32 nt, Human
ccgccgccccgcucccugcuuugcuacacaaa

SEQ ID NO: 109983 - RNA, 20 nt, Human
ccgccgccccggcgccagca

SEQ ID NO: 109984 - RNA, 32 nt, Human
ccgccgcccgaaccaccaugacccacuucaac

SEQ ID NO: 109985 - RNA, 20 nt, Human
ccgccgcccgaccccgaguc

SEQ ID NO: 109986 - RNA, 20 nt, Human
ccgccgcccgacucugggcc

SEQ ID NO: 109987 - RNA, 20 nt, Human
ccgccgcccgagcccgagcc

SEQ ID NO: 109988 - RNA, 32 nt, Human
ccgccgcccgaugggcugggccguggagcguc

SEQ ID NO: 109989 - RNA, 19 nt, Human
ccgccgcccgccccgaccc

SEQ ID NO: 109990 - RNA, 22 nt, Human
ccgccgcccgccgcccgggcca

SEQ ID NO: 109991 - RNA, 19 nt, Human
ccgccgcccgccgccgccg

SEQ ID NO: 109992 - RNA, 16 nt, Human
ccgccgcccgccggcc

SEQ ID NO: 109993 - RNA, 18 nt, Human
ccgccgcccgccucggcc

SEQ ID NO: 109994 - RNA, 19 nt, Human
ccgccgcccgcgccgcgcu

SEQ ID NO: 109995 - RNA, 20 nt, Human
ccgccgcccggaccugggcu

SEQ ID NO: 109996 - RNA, 21 nt, Human
ccgccgcccggcauccugagc

SEQ ID NO: 109997 - RNA, 20 nt, Human
ccgccgcccggcucccggcu

SEQ ID NO: 109998 - RNA, 21 nt, Human
ccgccgcccguguucuccugg

SEQ ID NO: 109999 - RNA, 32 nt, Human
ccgccgcccucucaugcagaagccugagcuca

SEQ ID NO: 110000 - RNA, 32 nt, Human
ccgccgcccugcugcugacccagccuguuuua

SEQ ID NO: 110001 - RNA, 19 nt, Human
ccgccgccgagcccgggcc

SEQ ID NO: 110002 - RNA, 17 nt, Human
ccgccgccgccacccgc

SEQ ID NO: 110003 - RNA, 25 nt, Human
ccgccgccgccaccgccgccgccau

SEQ ID NO: 110004 - RNA, 32 nt, Human
ccgccgccgccaggaaccccggccgggagcga

SEQ ID NO: 110005 - RNA, 32 nt, Human
ccgccgccgccauggccaccacggugaccugc

SEQ ID NO: 110006 - RNA, 19 nt, Human
ccgccgccgcccgccgccg

SEQ ID NO: 110007 - RNA, 19 nt, Human
ccgccgccgcccgccggca

SEQ ID NO: 110008 - RNA, 18 nt, Human
ccgccgccgcccgccuca

SEQ ID NO: 110009 - RNA, 19 nt, Human
ccgccgccgccgccaccac

SEQ ID NO: 110010 - RNA, 32 nt, Human
ccgccgccgccgccaccgcccuccaggcuccg

SEQ ID NO: 110011 - RNA, 18 nt, Human
ccgccgccgccgcccgca

SEQ ID NO: 110012 - RNA, 19 nt, Human
ccgccgccgccgcccgccg

SEQ ID NO: 110013 - RNA, 18 nt, Human
ccgccgccgccgccgcca

SEQ ID NO: 110014 - RNA, 19 nt, Human
ccgccgccgccgccgccac

SEQ ID NO: 110015 - RNA, 18 nt, Human
ccgccgccgccgccgccg

SEQ ID NO: 110016 - RNA, 19 nt, Human
ccgccgccgccgccgccgc

SEQ ID NO: 110017 - RNA, 32 nt, Human
ccgccgccgccgccgccgccucccggaggucc

SEQ ID NO: 110018 - RNA, 32 nt, Human
ccgccgccgccgccgccuccagccgggccgcc

SEQ ID NO: 110019 - RNA, 19 nt, Human
ccgccgccgccgccgcgcg

SEQ ID NO: 110020 - RNA, 18 nt, Human
ccgccgccgccgccgcug

SEQ ID NO: 110021 - RNA, 19 nt, Human
ccgccgccgccgccggccg

SEQ ID NO: 110022 - RNA, 19 nt, Human
ccgccgccgccgccgggcc

SEQ ID NO: 110023 - RNA, 18 nt, Human
ccgccgccgccgccgucg

SEQ ID NO: 110024 - RNA, 22 nt, Human
ccgccgccgccgcgcaacagca

SEQ ID NO: 110025 - RNA, 18 nt, Human
ccgccgccgccgcugccg

SEQ ID NO: 110026 - RNA, 19 nt, Human
ccgccgccgccgucgccgc

SEQ ID NO: 110027 - RNA, 32 nt, Human
ccgccgccgccuccgccuuggagcucggggug

SEQ ID NO: 110028 - RNA, 17 nt, Human
ccgccgccgccucggcc

SEQ ID NO: 110029 - RNA, 18 nt, Human
ccgccgccgccucggguc

SEQ ID NO: 110030 - RNA, 19 nt, Human
ccgccgccgcgcccugagc

SEQ ID NO: 110031 - RNA, 32 nt, Human
ccgccgccgcgcgucgcggaggcacgugugga

SEQ ID NO: 110032 - RNA, 32 nt, Human
ccgccgccgcggcccggcagacugccucuguc

SEQ ID NO: 110033 - RNA, 21 nt, Human
ccgccgccgcguccacccuca

SEQ ID NO: 110034 - RNA, 18 nt, Human
ccgccgccgcgucgagcc

SEQ ID NO: 110035 - RNA, 32 nt, Human
ccgccgccgcuccgccagaccugcugccaucu

SEQ ID NO: 110036 - RNA, 18 nt, Human
ccgccgccgcugcagcca

SEQ ID NO: 110037 - RNA, 18 nt, Human
ccgccgccgcugccgccg

SEQ ID NO: 110038 - RNA, 20 nt, Human
ccgccgccgcugccugaguc

SEQ ID NO: 110039 - RNA, 18 nt, Human
ccgccgccgcuggagcua

SEQ ID NO: 110040 - RNA, 22 nt, Human
ccgccgccggagccuccgagcc

SEQ ID NO: 110041 - RNA, 22 nt, Human
ccgccgccggccccagcccgca

SEQ ID NO: 110042 - RNA, 18 nt, Human
ccgccgccggcuccggcc

SEQ ID NO: 110043 - RNA, 21 nt, Human
ccgccgccgggaccccgaguc

SEQ ID NO: 110044 - RNA, 22 nt, Human
ccgccgccgggccccgcgggcc

SEQ ID NO: 110045 - RNA, 18 nt, Human
ccgccgccgggccccggg

SEQ ID NO: 110046 - RNA, 18 nt, Human
ccgccgccgggccgggcc

SEQ ID NO: 110047 - RNA, 21 nt, Human
ccgccgccgguggcccgggcc

SEQ ID NO: 110048 - RNA, 18 nt, Human
ccgccgccgucgccgccg

SEQ ID NO: 110049 - RNA, 18 nt, Human
ccgccgccguucucgcug

SEQ ID NO: 110050 - RNA, 19 nt, Human
ccgccgccuaagcugcagc

SEQ ID NO: 110051 - RNA, 32 nt, Human
ccgccgccuaagcugcagccgccggagccgca

SEQ ID NO: 110052 - RNA, 32 nt, Human
ccgccgccuagacuacuagccugggcugcuug

SEQ ID NO: 110053 - RNA, 32 nt, Human
ccgccgccucacugcagccagcgugguccuag

SEQ ID NO: 110054 - RNA, 32 nt, Human
ccgccgccucagccacagucccacccgggggc

SEQ ID NO: 110055 - RNA, 32 nt, Human
ccgccgccuccaagccccugagguuuccgggg

SEQ ID NO: 110056 - RNA, 32 nt, Human
ccgccgccuccaggagcacgcagauggugcag

SEQ ID NO: 110057 - RNA, 32 nt, Human
ccgccgccuccccuccgguccccucuuucccc

SEQ ID NO: 110058 - RNA, 17 nt, Human
ccgccgccucccggguc

SEQ ID NO: 110059 - RNA, 17 nt, Human
ccgccgccucccugggc

SEQ ID NO: 110060 - RNA, 18 nt, Human
ccgccgccucccugggcc

SEQ ID NO: 110061 - RNA, 32 nt, Human
ccgccgccuccuccuccucagccggcggcggc

SEQ ID NO: 110062 - RNA, 32 nt, Human
ccgccgccuccuccuccuccuucucggcuucc

SEQ ID NO: 110063 - RNA, 32 nt, Human
ccgccgccuccuccuucuccuccuucucggcu

SEQ ID NO: 110064 - RNA, 20 nt, Human
ccgccgccuccugcccugca

SEQ ID NO: 110065 - RNA, 32 nt, Human
ccgccgccuccugccuggcucuggguccccga

SEQ ID NO: 110066 - RNA, 32 nt, Human
ccgccgccuccuuuuccucauccugcgaacgg

SEQ ID NO: 110067 - RNA, 21 nt, Human
ccgccgccucgacgcccugca

SEQ ID NO: 110068 - RNA, 21 nt, Human
ccgccgccucgccucgccugg

SEQ ID NO: 110069 - RNA, 18 nt, Human
ccgccgccucgucgggcc

SEQ ID NO: 110070 - RNA, 32 nt, Human
ccgccgccucucucaacaccggcgcuuagcgc

SEQ ID NO: 110071 - RNA, 19 nt, Human
ccgccgccugccugggccg

SEQ ID NO: 110072 - RNA, 21 nt, Human
ccgccgccugucacccgggcc

SEQ ID NO: 110073 - RNA, 18 nt, Human
ccgccgccuguuuccuca

SEQ ID NO: 110074 - RNA, 32 nt, Human
ccgccgccuucccucagucagcguugcccacu

SEQ ID NO: 110075 - RNA, 21 nt, Human
ccgccgccuucgccuccgggc

SEQ ID NO: 110076 - RNA, 32 nt, Human
ccgccgccuugccgcccugccacccugccgcc

SEQ ID NO: 110077 - RNA, 21 nt, Human
ccgccgccuuuccucugagcc

SEQ ID NO: 110078 - RNA, 18 nt, Human
ccgccgcgaaccugggcc

SEQ ID NO: 110079 - RNA, 20 nt, Human
ccgccgcgagggccccgagc

SEQ ID NO: 110080 - RNA, 32 nt, Human
ccgccgcgcaacuaccuccucccuucacccgg

SEQ ID NO: 110081 - RNA, 19 nt, Human
ccgccgcgcaguccgggcc

SEQ ID NO: 110082 - RNA, 21 nt, Human
ccgccgcgcccgcucccgacc

SEQ ID NO: 110083 - RNA, 32 nt, Human
ccgccgcgccgcccggcagccucggcagguag

SEQ ID NO: 110084 - RNA, 18 nt, Human
ccgccgcgccgccgggcc

SEQ ID NO: 110085 - RNA, 18 nt, Human
ccgccgcgccuuccuccc

SEQ ID NO: 110086 - RNA, 21 nt, Human
ccgccgcgcguccccggagcc

SEQ ID NO: 110087 - RNA, 17 nt, Human
ccgccgcgcuccugggu

SEQ ID NO: 110088 - RNA, 32 nt, Human
ccgccgcgcugcugggggcugggcaggggcag

SEQ ID NO: 110089 - RNA, 19 nt, Human
ccgccgcggagcuccgagc

SEQ ID NO: 110090 - RNA, 19 nt, Human
ccgccgcggcagccccagc

SEQ ID NO: 110091 - RNA, 20 nt, Human
ccgccgcggcagcucgaguc

SEQ ID NO: 110092 - RNA, 20 nt, Human
ccgccgcggccccucagguc

SEQ ID NO: 110093 - RNA, 17 nt, Human
ccgccgcggcccgggcc

SEQ ID NO: 110094 - RNA, 31 nt, Human
ccgccgcggcuucagcaccagcgcccggaca

SEQ ID NO: 110095 - RNA, 19 nt, Human
ccgccgcgggcgcugggcc

SEQ ID NO: 110096 - RNA, 32 nt, Human
ccgccgcggggcgaggucgccgccauggcccg

SEQ ID NO: 110097 - RNA, 32 nt, Human
ccgccgcgggggaagccugggagccagaucgg

SEQ ID NO: 110098 - RNA, 20 nt, Human
ccgccgcgggucgcucgggc

SEQ ID NO: 110099 - RNA, 20 nt, Human
ccgccgcgucgcucccgggc

SEQ ID NO: 110100 - RNA, 19 nt, Human
ccgccgcgucgcucgggcc

SEQ ID NO: 110101 - RNA, 20 nt, Human
ccgccgcuacaguccgggcc

SEQ ID NO: 110102 - RNA, 32 nt, Human
ccgccgcuaccuucaccaccuccugcuguggg

SEQ ID NO: 110103 - RNA, 22 nt, Human
ccgccgcuagccggcucgggcc

SEQ ID NO: 110104 - RNA, 18 nt, Human
ccgccgcuagcgcgcgcc

SEQ ID NO: 110105 - RNA, 17 nt, Human
ccgccgcuaggucggcc

SEQ ID NO: 110106 - RNA, 20 nt, Human
ccgccgcucaaagaugaguc

SEQ ID NO: 110107 - RNA, 21 nt, Human
ccgccgcucagcgccccggcu

SEQ ID NO: 110108 - RNA, 22 nt, Human
ccgccgcucagcuuccccgggc

SEQ ID NO: 110109 - RNA, 32 nt, Human
ccgccgcucaucugucucugcagccaccgcug

SEQ ID NO: 110110 - RNA, 20 nt, Human
ccgccgcucccacugacgcu

SEQ ID NO: 110111 - RNA, 16 nt, Human
ccgccgcucccaggcc

SEQ ID NO: 110112 - RNA, 20 nt, Human
ccgccgcucccggcagggcc

SEQ ID NO: 110113 - RNA, 18 nt, Human
ccgccgcucccgggggcc

SEQ ID NO: 110114 - RNA, 19 nt, Human
ccgccgcuccgacgggcca

SEQ ID NO: 110115 - RNA, 18 nt, Human
ccgccgcuccgcagggcu

SEQ ID NO: 110116 - RNA, 20 nt, Human
ccgccgcuccgccacgacca

SEQ ID NO: 110117 - RNA, 18 nt, Human
ccgccgcuccgccgacua

SEQ ID NO: 110118 - RNA, 19 nt, Human
ccgccgcuccgcuccgauc

SEQ ID NO: 110119 - RNA, 32 nt, Human
ccgccgcuccucggauggugacggggcccugc

SEQ ID NO: 110120 - RNA, 20 nt, Human
ccgccgcuccugcccgggcc

SEQ ID NO: 110121 - RNA, 20 nt, Human
ccgccgcucgccccgucggc

SEQ ID NO: 110122 - RNA, 20 nt, Human
ccgccgcucgcccgcgcgcc

SEQ ID NO: 110123 - RNA, 18 nt, Human
ccgccgcucgccgccucc

SEQ ID NO: 110124 - RNA, 18 nt, Human
ccgccgcucgccggagcc

SEQ ID NO: 110125 - RNA, 18 nt, Human
ccgccgcucgccgggaca

SEQ ID NO: 110126 - RNA, 21 nt, Human
ccgccgcucgcgccucgggcu

SEQ ID NO: 110127 - RNA, 19 nt, Human
ccgccgcucgcguccucgc

SEQ ID NO: 110128 - RNA, 17 nt, Human
ccgccgcucgcugcuca

SEQ ID NO: 110129 - RNA, 17 nt, Human
ccgccgcucgggcugcc

SEQ ID NO: 110130 - RNA, 19 nt, Human
ccgccgcucgucgccuccc

SEQ ID NO: 110131 - RNA, 19 nt, Human
ccgccgcucuacucagcca

SEQ ID NO: 110132 - RNA, 20 nt, Human
ccgccgcucucccgggguca

SEQ ID NO: 110133 - RNA, 19 nt, Human
ccgccgcucucgggggccg

SEQ ID NO: 110134 - RNA, 21 nt, Human
ccgccgcucucucccgggcca

SEQ ID NO: 110135 - RNA, 19 nt, Human
ccgccgcucugaagcggcc

SEQ ID NO: 110136 - RNA, 18 nt, Human
ccgccgcucugcgggagu

SEQ ID NO: 110137 - RNA, 19 nt, Human
ccgccgcugacccugggcc

SEQ ID NO: 110138 - RNA, 18 nt, Human
ccgccgcugaccgaggcg

SEQ ID NO: 110139 - RNA, 18 nt, Human
ccgccgcugagacgggcc

SEQ ID NO: 110140 - RNA, 20 nt, Human
ccgccgcugcagcuugggcc

SEQ ID NO: 110141 - RNA, 20 nt, Human
ccgccgcugcaggauagcua

SEQ ID NO: 110142 - RNA, 32 nt, Human
ccgccgcugccaccaucuccucugugccaacu

SEQ ID NO: 110143 - RNA, 19 nt, Human
ccgccgcugccagcugacc

SEQ ID NO: 110144 - RNA, 20 nt, Human
ccgccgcugccccccagcca

SEQ ID NO: 110145 - RNA, 19 nt, Human
ccgccgcugcccucgggcc

SEQ ID NO: 110146 - RNA, 19 nt, Human
ccgccgcugcccuuggguc

SEQ ID NO: 110147 - RNA, 20 nt, Human
ccgccgcugccgccccggcu

SEQ ID NO: 110148 - RNA, 18 nt, Human
ccgccgcugccgccgccg

SEQ ID NO: 110149 - RNA, 19 nt, Human
ccgccgcugccgccgccgc

SEQ ID NO: 110150 - RNA, 22 nt, Human
ccgccgcugccgccguccuccc

SEQ ID NO: 110151 - RNA, 21 nt, Human
ccgccgcugccgccuccgagc

SEQ ID NO: 110152 - RNA, 19 nt, Human
ccgccgcugccguugggcu

SEQ ID NO: 110153 - RNA, 20 nt, Human
ccgccgcugccuccgcgcca

SEQ ID NO: 110154 - RNA, 19 nt, Human
ccgccgcugccucugggcc

SEQ ID NO: 110155 - RNA, 32 nt, Human
ccgccgcugccuggcccgcgccguccggccga

SEQ ID NO: 110156 - RNA, 17 nt, Human
ccgccgcugccugugcu

SEQ ID NO: 110157 - RNA, 19 nt, Human
ccgccgcugcgccgggccg

SEQ ID NO: 110158 - RNA, 19 nt, Human
ccgccgcugcgccucgggc

SEQ ID NO: 110159 - RNA, 16 nt, Human
ccgccgcugcggagcc

SEQ ID NO: 110160 - RNA, 16 nt, Human
ccgccgcugcggggcc

SEQ ID NO: 110161 - RNA, 20 nt, Human
ccgccgcugcugccccagcu

SEQ ID NO: 110162 - RNA, 18 nt, Human
ccgccgcugcuggaguca

SEQ ID NO: 110163 - RNA, 18 nt, Human
ccgccgcuggaccugguc

SEQ ID NO: 110164 - RNA, 21 nt, Human
ccgccgcugggaccccuggcc

SEQ ID NO: 110165 - RNA, 18 nt, Human
ccgccgcuggguccgacc

SEQ ID NO: 110166 - RNA, 19 nt, Human
ccgccgcugucaguagcca

SEQ ID NO: 110167 - RNA, 22 nt, Human
ccgccgcugucgccgucgaguc

SEQ ID NO: 110168 - RNA, 18 nt, Human
ccgccgcuguugcagcca

SEQ ID NO: 110169 - RNA, 20 nt, Human
ccgccgcuucacccaggcca

SEQ ID NO: 110170 - RNA, 18 nt, Human
ccgccgcuuccagaggcg

SEQ ID NO: 110171 - RNA, 18 nt, Human
ccgccgcuucucggcgcu

SEQ ID NO: 110172 - RNA, 21 nt, Human
ccgccgcuugccgcugccgcc

SEQ ID NO: 110173 - RNA, 18 nt, Human
ccgccgcuugggccggcu

SEQ ID NO: 110174 - RNA, 20 nt, Human
ccgccgcuugugcugcagcc

SEQ ID NO: 110175 - RNA, 20 nt, Human
ccgccgcuuguugucgcgcc

SEQ ID NO: 110176 - RNA, 18 nt, Human
ccgccgcuuguuuugguu

SEQ ID NO: 110177 - RNA, 21 nt, Human
ccgccggacagcccgguccgc

SEQ ID NO: 110178 - RNA, 17 nt, Human
ccgccggaccccgagcu

SEQ ID NO: 110179 - RNA, 32 nt, Human
ccgccggacccggaggcucacagggaacaaga

SEQ ID NO: 110180 - RNA, 21 nt, Human
ccgccggagacacugcuccca

SEQ ID NO: 110181 - RNA, 32 nt, Human
ccgccggagagggaggcccgagcgcaggagcc

SEQ ID NO: 110182 - RNA, 21 nt, Human
ccgccggagcuucuccgggcc

SEQ ID NO: 110183 - RNA, 32 nt, Human
ccgccggcauuuucccaucugccuuuucucug

SEQ ID NO: 110184 - RNA, 17 nt, Human
ccgccggcccccgagcu

SEQ ID NO: 110185 - RNA, 19 nt, Human
ccgccggcccgccgcccgc

SEQ ID NO: 110186 - RNA, 21 nt, Human
ccgccggccgcucccuagggg

SEQ ID NO: 110187 - RNA, 32 nt, Human
ccgccggccggagccgcagccucugccgcagc

SEQ ID NO: 110188 - RNA, 32 nt, Human
ccgccggccgggaggcgaaggaugcaggcggc

SEQ ID NO: 110189 - RNA, 32 nt, Human
ccgccggcgaaaggagggggcccuggagggaa

SEQ ID NO: 110190 - RNA, 20 nt, Human
ccgccggcgccgcccggguc

SEQ ID NO: 110191 - RNA, 18 nt, Human
ccgccggcgccuccagcu

SEQ ID NO: 110192 - RNA, 17 nt, Human
ccgccggcgccucggcc

SEQ ID NO: 110193 - RNA, 32 nt, Human
ccgccggcgcucaaccacgcugugcugcgcgc

SEQ ID NO: 110194 - RNA, 18 nt, Human
ccgccggcggcccgggcu

SEQ ID NO: 110195 - RNA, 16 nt, Human
ccgccggcucccgggu

SEQ ID NO: 110196 - RNA, 32 nt, Human
ccgccggcucgucacuuuaggcucccuccaga

SEQ ID NO: 110197 - RNA, 32 nt, Human
ccgccggcugccccagcccugcgugaaggcgc

SEQ ID NO: 110198 - RNA, 19 nt, Human
ccgccggcugcuccgcgcu

SEQ ID NO: 110199 - RNA, 20 nt, Human
ccgccgggacgccccgcgcc

SEQ ID NO: 110200 - RNA, 19 nt, Human
ccgccgggagccccggguc

SEQ ID NO: 110201 - RNA, 32 nt, Human
ccgccgggaggcugcuguacgacauguuugug

SEQ ID NO: 110202 - RNA, 18 nt, Human
ccgccgggagggagccag

SEQ ID NO: 110203 - RNA, 20 nt, Human
ccgccgggagggagccagau

SEQ ID NO: 110204 - RNA, 18 nt, Human
ccgccgggaucccgggcc

SEQ ID NO: 110205 - RNA, 32 nt, Human
ccgccgggcauuuaacacccaccuggacuuca

SEQ ID NO: 110206 - RNA, 20 nt, Human
ccgccgggcccugcgggcca

SEQ ID NO: 110207 - RNA, 19 nt, Human
ccgccgggccugcugagcc

SEQ ID NO: 110208 - RNA, 20 nt, Human
ccgccgggcgagccggagcc

SEQ ID NO: 110209 - RNA, 20 nt, Human
ccgccgggcgcccccggguc

SEQ ID NO: 110210 - RNA, 32 nt, Human
ccgccgggcggcuuucccccuuguacuggaga

SEQ ID NO: 110211 - RNA, 19 nt, Human
ccgccgggcugcuccgagc

SEQ ID NO: 110212 - RNA, 19 nt, Human
ccgccggggcagccgagcu

SEQ ID NO: 110213 - RNA, 17 nt, Human
ccgccggggccccgagc

SEQ ID NO: 110214 - RNA, 21 nt, Human
ccgccggggcgcccucagcuc

SEQ ID NO: 110215 - RNA, 20 nt, Human
ccgccggggcuuucccgggc

SEQ ID NO: 110216 - RNA, 23 nt, Human
ccgccgggggacggcccgggcca

SEQ ID NO: 110217 - RNA, 32 nt, Human
ccgccggguuacaccugcuccuuccuggacgc

SEQ ID NO: 110218 - RNA, 22 nt, Human
ccgccggucccgguccugagcu

SEQ ID NO: 110219 - RNA, 17 nt, Human
ccgccgguuucugagcc

SEQ ID NO: 110220 - RNA, 19 nt, Human
ccgccguaccgccucggcu

SEQ ID NO: 110221 - RNA, 22 nt, Human
ccgccguagccgccuccgagcc

SEQ ID NO: 110222 - RNA, 18 nt, Human
ccgccguagccgggacca

SEQ ID NO: 110223 - RNA, 18 nt, Human
ccgccguccgcgccagcc

SEQ ID NO: 110224 - RNA, 32 nt, Human
ccgccgucgccaucuguuucccuucccucccc

SEQ ID NO: 110225 - RNA, 22 nt, Human
ccgccgucgccgcccgcccgca

SEQ ID NO: 110226 - RNA, 18 nt, Human
ccgccgucgccgccgccg

SEQ ID NO: 110227 - RNA, 20 nt, Human
ccgccgucgguccccgagcc

SEQ ID NO: 110228 - RNA, 32 nt, Human
ccgccgucuccuccucuugcccgcgcaggcac

SEQ ID NO: 110229 - RNA, 22 nt, Human
ccgccgucucugucccgguuca

SEQ ID NO: 110230 - RNA, 32 nt, Human
ccgccgugacugguuuucuguccccaagaacg

SEQ ID NO: 110231 - RNA, 32 nt, Human
ccgccgugcauccggcgggcucagggagcgag

SEQ ID NO: 110232 - RNA, 19 nt, Human
ccgccguggagcccugggc

SEQ ID NO: 110233 - RNA, 32 nt, Human
ccgccguggagggcagagccaccccacaucag

SEQ ID NO: 110234 - RNA, 18 nt, Human
ccgccguuacccgaucca

SEQ ID NO: 110235 - RNA, 21 nt, Human
ccgccguucgcgcucugacca

SEQ ID NO: 110236 - RNA, 18 nt, Human
ccgccguuggcggcggcc

SEQ ID NO: 110237 - RNA, 19 nt, Human
ccgccguuucacccagcca

SEQ ID NO: 110238 - RNA, 20 nt, Human
ccgccguuuccugcgagcca

SEQ ID NO: 110239 - RNA, 18 nt, Human
ccgccguuuucaugacca

SEQ ID NO: 110240 - RNA, 32 nt, Human
ccgccuauaccacagagcacagccuggacauu

SEQ ID NO: 110241 - RNA, 32 nt, Human
ccgccuaucaucugcauuugccuuacucaggu

SEQ ID NO: 110242 - RNA, 32 nt, Human
ccgccuaucugccugccggccugguggggagc

SEQ ID NO: 110243 - RNA, 22 nt, Human
ccgccucaacaccgugcucccu

SEQ ID NO: 110244 - RNA, 32 nt, Human
ccgccucacccccucgggucuccucacucccu

SEQ ID NO: 110245 - RNA, 32 nt, Human
ccgccucaccccggcuggagucaugugggccg

SEQ ID NO: 110246 - RNA, 32 nt, Human
ccgccucacgcugaaguuccuggccgugcugc

SEQ ID NO: 110247 - RNA, 18 nt, Human
ccgccucacuccugggcc

SEQ ID NO: 110248 - RNA, 19 nt, Human
ccgccucacugagcucugg

SEQ ID NO: 110249 - RNA, 32 nt, Human
ccgccucagagccgacuuucgaagggggauug

SEQ ID NO: 110250 - RNA, 32 nt, Human
ccgccucaguagcugggauuacaggugcccac

SEQ ID NO: 110251 - RNA, 32 nt, Human
ccgccuccaaccccucgcccagucccagcagc

SEQ ID NO: 110252 - RNA, 32 nt, Human
ccgccuccaaguagcugggacuacaggcgugc

SEQ ID NO: 110253 - RNA, 24 nt, Human
ccgccuccaccugaaaagcuccuu

SEQ ID NO: 110254 - RNA, 32 nt, Human
ccgccuccacugcaacaucuucuccuacgacu

SEQ ID NO: 110255 - RNA, 21 nt, Human
ccgccuccccgcccucucuca

SEQ ID NO: 110256 - RNA, 19 nt, Human
ccgccucccgccccgggcu

SEQ ID NO: 110257 - RNA, 19 nt, Human
ccgccucccgcuccgggcc

SEQ ID NO: 110258 - RNA, 24 nt, Human
ccgccucccuccuccaggacagag

SEQ ID NO: 110259 - RNA, 32 nt, Human
ccgccucccugccuccagcccuggcugcaaug

SEQ ID NO: 110260 - RNA, 32 nt, Human
ccgccucccuggacaguucccugcugcagagu

SEQ ID NO: 110261 - RNA, 32 nt, Human
ccgccucccuuucuucccauccacauacuccu

SEQ ID NO: 110262 - RNA, 32 nt, Human
ccgccuccgagcgacuuccgggagccgggcgg

SEQ ID NO: 110263 - RNA, 22 nt, Human
ccgccuccgccacgcgccuccu

SEQ ID NO: 110264 - RNA, 21 nt, Human
ccgccuccgcccccuggguca

SEQ ID NO: 110265 - RNA, 32 nt, Human
ccgccuccgccuucuggagagccucuggguuc

SEQ ID NO: 110266 - RNA, 21 nt, Human
ccgccuccgggccgccgagcc

SEQ ID NO: 110267 - RNA, 32 nt, Human
ccgccuccggggagcccaaccagccgaacgcc

SEQ ID NO: 110268 - RNA, 18 nt, Human
ccgccuccuacgcaggag

SEQ ID NO: 110269 - RNA, 32 nt, Human
ccgccuccuagggaagggaagggagacgagca

SEQ ID NO: 110270 - RNA, 28 nt, Human
ccgccuccuaggucuuggcaaagaggca

SEQ ID NO: 110271 - RNA, 32 nt, Human
ccgccuccucaccacugugccucaaguuccuc

SEQ ID NO: 110272 - RNA, 32 nt, Human
ccgccuccucauucauccucgugcaccauagg

SEQ ID NO: 110273 - RNA, 32 nt, Human
ccgccuccuccacccccugcccugccaggccc

SEQ ID NO: 110274 - RNA, 32 nt, Human
ccgccuccuccccuccuccuucucgucuucag

SEQ ID NO: 110275 - RNA, 18 nt, Human
ccgccuccucccucggcc

SEQ ID NO: 110276 - RNA, 32 nt, Human
ccgccuccuccuccucagccggcggcggcccg

SEQ ID NO: 110277 - RNA, 32 nt, Human
ccgccuccuccuccuccuucucggcuuccucc

SEQ ID NO: 110278 - RNA, 32 nt, Human
ccgccuccuccuccugcuuugaccugaugcag

SEQ ID NO: 110279 - RNA, 32 nt, Human
ccgccuccuucccagccgcgcggcuuccucca

SEQ ID NO: 110280 - RNA, 18 nt, Human
ccgccucgcccccgggcc

SEQ ID NO: 110281 - RNA, 23 nt, Human
ccgccucgcccgggcaccgagca

SEQ ID NO: 110282 - RNA, 19 nt, Human
ccgccucgccgcuucgggc

SEQ ID NO: 110283 - RNA, 19 nt, Human
ccgccucggcuuugaggcg

SEQ ID NO: 110284 - RNA, 32 nt, Human
ccgccucuacgaccucuccagcuucgugcggc

SEQ ID NO: 110285 - RNA, 20 nt, Human
ccgccucuagaaugcucuga

SEQ ID NO: 110286 - RNA, 32 nt, Human
ccgccucucacucacagccucccuuccuucuu

SEQ ID NO: 110287 - RNA, 22 nt, Human
ccgccucucagugucccgggcu

SEQ ID NO: 110288 - RNA, 22 nt, Human
ccgccucucauuucuugaguca

SEQ ID NO: 110289 - RNA, 32 nt, Human
ccgccucuccaccuucuccccgccaggcacag

SEQ ID NO: 110290 - RNA, 32 nt, Human
ccgccucuccaucgucuugggcccuugcucaa

SEQ ID NO: 110291 - RNA, 32 nt, Human
ccgccucucccaucgcgagacacugaagaccc

SEQ ID NO: 110292 - RNA, 32 nt, Human
ccgccucuccucuuggaggacagggcagccug

SEQ ID NO: 110293 - RNA, 18 nt, Human
ccgccucuccuucgggcu

SEQ ID NO: 110294 - RNA, 21 nt, Human
ccgccucucgcuguccucucu

SEQ ID NO: 110295 - RNA, 22 nt, Human
ccgccucucuccaccgccuccu

SEQ ID NO: 110296 - RNA, 32 nt, Human
ccgccucucucccugccucccucucucucuuc

SEQ ID NO: 110297 - RNA, 32 nt, Human
ccgccucucuggaagguguuguaggccauuca

SEQ ID NO: 110298 - RNA, 32 nt, Human
ccgccucugcaagccuagccuucaggacuccg

SEQ ID NO: 110299 - RNA, 32 nt, Human
ccgccucugcaaucccaugccuugugaggccg

SEQ ID NO: 110300 - RNA, 32 nt, Human
ccgccucugcacuccagccugggugacaagag

SEQ ID NO: 110301 - RNA, 22 nt, Human
ccgccucugccaauccccgccg

SEQ ID NO: 110302 - RNA, 23 nt, Human
ccgccucugccccacugcuuccu

SEQ ID NO: 110303 - RNA, 32 nt, Human
ccgccucugccccacugcuuccugccuggagc

SEQ ID NO: 110304 - RNA, 32 nt, Human
ccgccucugccccugugaacacccaucugcag

SEQ ID NO: 110305 - RNA, 17 nt, Human
ccgccucugccucggcc

SEQ ID NO: 110306 - RNA, 32 nt, Human
ccgccucugccuggccacaucgauguuguguc

SEQ ID NO: 110307 - RNA, 32 nt, Human
ccgccucugcucccaccgagcccuccagcccc

SEQ ID NO: 110308 - RNA, 32 nt, Human
ccgccucuggcguagcaggagcaugcgcuucc

SEQ ID NO: 110309 - RNA, 32 nt, Human
ccgccucugggaacuuccugggagaaacagug

SEQ ID NO: 110310 - RNA, 22 nt, Human
ccgccucugggcucucugagcc

SEQ ID NO: 110311 - RNA, 32 nt, Human
ccgccucuuccucccuuccuucuuuccuugcu

SEQ ID NO: 110312 - RNA, 32 nt, Human
ccgccugaaagccacaaugagaaugaugcaca

SEQ ID NO: 110313 - RNA, 32 nt, Human
ccgccugaaaucugacuccaccugccaagagu

SEQ ID NO: 110314 - RNA, 32 nt, Human
ccgccugacagaaaccacggccacauuugguu

SEQ ID NO: 110315 - RNA, 17 nt, Human
ccgccugacccugggcc

SEQ ID NO: 110316 - RNA, 32 nt, Human
ccgccugaccucaagcuggcugcagagcgagg

SEQ ID NO: 110317 - RNA, 32 nt, Human
ccgccugagccaggaggaagcagcggcgaggu

SEQ ID NO: 110318 - RNA, 22 nt, Human
ccgccugagcccgcagcacagg

SEQ ID NO: 110319 - RNA, 32 nt, Human
ccgccugaggccagccugccagaagcugaccu

SEQ ID NO: 110320 - RNA, 32 nt, Human
ccgccugaggugauccuugagcugggcugggc

SEQ ID NO: 110321 - RNA, 32 nt, Human
ccgccugaguagcugcacuauaggcaccacca

SEQ ID NO: 110322 - RNA, 32 nt, Human
ccgccugauggaggcuggagaacggauggaac

SEQ ID NO: 110323 - RNA, 32 nt, Human
ccgccugcaacaaacauuccugccagcaggug

SEQ ID NO: 110324 - RNA, 32 nt, Human
ccgccugcacacagagcccaguuaauucuccg

SEQ ID NO: 110325 - RNA, 21 nt, Human
ccgccugcagagacccgggcc

SEQ ID NO: 110326 - RNA, 32 nt, Human
ccgccugcagagccggaagccacccaaccucu

SEQ ID NO: 110327 - RNA, 32 nt, Human
ccgccugcagaucugggauccagccugcucuc

SEQ ID NO: 110328 - RNA, 32 nt, Human
ccgccugcaugcugggaaaguccugcaacugu

SEQ ID NO: 110329 - RNA, 32 nt, Human
ccgccugccagcccaccccagccuggggagag

SEQ ID NO: 110330 - RNA, 32 nt, Human
ccgccugcccaagaacugcagcugcacaucgc

SEQ ID NO: 110331 - RNA, 32 nt, Human
ccgccugcccccucuuccuaugcagcuuuaau

SEQ ID NO: 110332 - RNA, 32 nt, Human
ccgccugccccgccacgcuccugggccaacuc

SEQ ID NO: 110333 - RNA, 32 nt, Human
ccgccugccccuccuucuccagccucuucucc

SEQ ID NO: 110334 - RNA, 32 nt, Human
ccgccugccuucagccuuccaugagcuucacc

SEQ ID NO: 110335 - RNA, 32 nt, Human
ccgccugccuuggccuggcaaaaugcugggau

SEQ ID NO: 110336 - RNA, 32 nt, Human
ccgccugcgagccccucucugccuucagaccu

SEQ ID NO: 110337 - RNA, 32 nt, Human
ccgccugcgaggcggaggcaggaugaagauga

SEQ ID NO: 110338 - RNA, 19 nt, Human
ccgccugcgcccugggaca

SEQ ID NO: 110339 - RNA, 17 nt, Human
ccgccugcgccucggcc

SEQ ID NO: 110340 - RNA, 18 nt, Human
ccgccugcgucccggcua

SEQ ID NO: 110341 - RNA, 20 nt, Human
ccgccugcucccucggguca

SEQ ID NO: 110342 - RNA, 17 nt, Human
ccgccugcucgcggguc

SEQ ID NO: 110343 - RNA, 23 nt, Human
ccgccugcugccaggcccaggag

SEQ ID NO: 110344 - RNA, 19 nt, Human
ccgccugcugcuccgaccc

SEQ ID NO: 110345 - RNA, 32 nt, Human
ccgccugcuguugcuccuccaucuccagaucg

SEQ ID NO: 110346 - RNA, 32 nt, Human
ccgccugcuuccccuccagcuccugggcucug

SEQ ID NO: 110347 - RNA, 32 nt, Human
ccgccuggagcagcaugggggucagaccccug

SEQ ID NO: 110348 - RNA, 32 nt, Human
ccgccuggaggcacaggccaugaggggcucuc

SEQ ID NO: 110349 - RNA, 32 nt, Human
ccgccuggauccuccugccugucagccuguca

SEQ ID NO: 110350 - RNA, 31 nt, Human
ccgccuggcacucagccuugccagagauugg

SEQ ID NO: 110351 - RNA, 32 nt, Human
ccgccuggcaggcagaaggagcugcaguccua

SEQ ID NO: 110352 - RNA, 23 nt, Human
ccgccuggcaguguccuggggca

SEQ ID NO: 110353 - RNA, 32 nt, Human
ccgccuggccaacauggugaaaccccgucucu

SEQ ID NO: 110354 - RNA, 32 nt, Human
ccgccuggcccugggcuccaggagagcccacc

SEQ ID NO: 110355 - RNA, 32 nt, Human
ccgccuggccgaguggccgccaugcuccugcc

SEQ ID NO: 110356 - RNA, 32 nt, Human
ccgccuggccuguggcaggccauucccagcgu

SEQ ID NO: 110357 - RNA, 32 nt, Human
ccgccuggcgcuggcccugggccugggccugu

SEQ ID NO: 110358 - RNA, 32 nt, Human
ccgccuggcugagauggggugggcagggcaga

SEQ ID NO: 110359 - RNA, 32 nt, Human
ccgccuggcugcaguccuucccgauggcaccc

SEQ ID NO: 110360 - RNA, 32 nt, Human
ccgccugggaccccuccgccccgacccgggcc

SEQ ID NO: 110361 - RNA, 32 nt, Human
ccgccugggacgugaggcgcaggugugcucgg

SEQ ID NO: 110362 - RNA, 32 nt, Human
ccgccugggagaagaguuuuuggaaguaggcg

SEQ ID NO: 110363 - RNA, 32 nt, Human
ccgccuggguuggggacagagagcagagaggc

SEQ ID NO: 110364 - RNA, 32 nt, Human
ccgccuggucccaucuucugcccgcuccucca

SEQ ID NO: 110365 - RNA, 31 nt, Human
ccgccuggugccuucuggccuguggccuccc

SEQ ID NO: 110366 - RNA, 27 nt, Human
ccgccugucaauaaauguugaaaaguc

SEQ ID NO: 110367 - RNA, 32 nt, Human
ccgccugucacugcagcugccccugcccugug

SEQ ID NO: 110368 - RNA, 32 nt, Human
ccgccuguccugcccuugcucagaccacccaa

SEQ ID NO: 110369 - RNA, 32 nt, Human
ccgccugugagcugcugaccgugggccacguu

SEQ ID NO: 110370 - RNA, 32 nt, Human
ccgccugugggauguggcaagagcgaaguguc

SEQ ID NO: 110371 - RNA, 32 nt, Human
ccgccuguggugugcacgugugcucugggcuc

SEQ ID NO: 110372 - RNA, 19 nt, Human
ccgccuguugcccugacca

SEQ ID NO: 110373 - RNA, 32 nt, Human
ccgccuguuuuuccagcaaaccacgcuaacua

SEQ ID NO: 110374 - RNA, 32 nt, Human
ccgccuuacacacaccccagguguccaugggg

SEQ ID NO: 110375 - RNA, 17 nt, Human
ccgccuuacucugagcc

SEQ ID NO: 110376 - RNA, 32 nt, Human
ccgccuuagauucucauggcuaccuccucuga

SEQ ID NO: 110377 - RNA, 18 nt, Human
ccgccuucaccccgagcu

SEQ ID NO: 110378 - RNA, 32 nt, Human
ccgccuucaccccucugcucuuccgcaucacc

SEQ ID NO: 110379 - RNA, 32 nt, Human
ccgccuucagccacguguccucgcuuauagag

SEQ ID NO: 110380 - RNA, 32 nt, Human
ccgccuucagguuccuccuaggcgcucagagg

SEQ ID NO: 110381 - RNA, 18 nt, Human
ccgccuucauccccggcc

SEQ ID NO: 110382 - RNA, 32 nt, Human
ccgccuucccauccacacugccuuuaguggua

SEQ ID NO: 110383 - RNA, 22 nt, Human
ccgccuuccccacccccugccu

SEQ ID NO: 110384 - RNA, 32 nt, Human
ccgccuucccugcaccaugcucauagaggaug

SEQ ID NO: 110385 - RNA, 22 nt, Human
ccgccuuccgccgcucugagcc

SEQ ID NO: 110386 - RNA, 32 nt, Human
ccgccuucggcccgggccucccgggauggccg

SEQ ID NO: 110387 - RNA, 26 nt, Human
ccgccuucggcgccugcugccucccu

SEQ ID NO: 110388 - RNA, 18 nt, Human
ccgccuucuccaggcccu

SEQ ID NO: 110389 - RNA, 22 nt, Human
ccgccuucuccaggcgcagcug

SEQ ID NO: 110390 - RNA, 32 nt, Human
ccgccuucuccgguccccuccucggagucauu

SEQ ID NO: 110391 - RNA, 32 nt, Human
ccgccuucugcccccgagcccccagccagccu

SEQ ID NO: 110392 - RNA, 32 nt, Human
ccgccuucuggcccaagagcuccgcugccgcu

SEQ ID NO: 110393 - RNA, 32 nt, Human
ccgccuugagucuggccaaggaggugauuaaa

SEQ ID NO: 110394 - RNA, 32 nt, Human
ccgccuugcucccaguuccauccuggccaaua

SEQ ID NO: 110395 - RNA, 32 nt, Human
ccgccuuggccuuccaaaaugcugcgauuaua

SEQ ID NO: 110396 - RNA, 22 nt, Human
ccgccuugugaccaucuguccc

SEQ ID NO: 110397 - RNA, 32 nt, Human
ccgccuuguuucuccccagaggccucucaauc

SEQ ID NO: 110398 - RNA, 32 nt, Human
ccgccuuuaccccagcuucuucauacacaugc

SEQ ID NO: 110399 - RNA, 32 nt, Human
ccgccuuugccuccacaaacugccacugcuua

SEQ ID NO: 110400 - RNA, 22 nt, Human
ccgccuuugcgcucucggguca

SEQ ID NO: 110401 - RNA, 32 nt, Human
ccgccuuuuccucuccccuggaucugacacuc

SEQ ID NO: 110402 - RNA, 32 nt, Human
ccgcgaacacugcuugucgccugggcaaccgg

SEQ ID NO: 110403 - RNA, 32 nt, Human
ccgcgaagcuuuuucucuucaggacaacacug

SEQ ID NO: 110404 - RNA, 32 nt, Human
ccgcgacacggcgggacccgccagcuucagcg

SEQ ID NO: 110405 - RNA, 32 nt, Human
ccgcgacaguccugcauguguugaugccaccu

SEQ ID NO: 110406 - RNA, 32 nt, Human
ccgcgacccacacaccuuuggccucaucgcug

SEQ ID NO: 110407 - RNA, 32 nt, Human
ccgcgacccagaggaggaagaggaggagaagg

SEQ ID NO: 110408 - RNA, 19 nt, Human
ccgcgaccugccccgagcc

SEQ ID NO: 110409 - RNA, 32 nt, Human
ccgcgacgcaggagcugcugcugcaguugcag

SEQ ID NO: 110410 - RNA, 19 nt, Human
ccgcgacggcccgcccggg

SEQ ID NO: 110411 - RNA, 32 nt, Human
ccgcgagagagggagagagcgagcgagcaaca

SEQ ID NO: 110412 - RNA, 32 nt, Human
ccgcgagagggaagaagcaggaggucucagca

SEQ ID NO: 110413 - RNA, 21 nt, Human
ccgcgagcacauugcagcccc

SEQ ID NO: 110414 - RNA, 32 nt, Human
ccgcgagccagccucgguucccgcggcccgcc

SEQ ID NO: 110415 - RNA, 32 nt, Human
ccgcgagcccagggaugggagcacgcggggga

SEQ ID NO: 110416 - RNA, 19 nt, Human
ccgcgagcggccucgggga

SEQ ID NO: 110417 - RNA, 32 nt, Human
ccgcgagcugggcuuuaacagagaugugugcu

SEQ ID NO: 110418 - RNA, 32 nt, Human
ccgcgaggacagcggcaccgcccacaccccgc

SEQ ID NO: 110419 - RNA, 32 nt, Human
ccgcgaggacgaggcggcgccgccgggcugug

SEQ ID NO: 110420 - RNA, 32 nt, Human
ccgcgaggccaagaugcugauuuggaagauaa

SEQ ID NO: 110421 - RNA, 32 nt, Human
ccgcgaggccaucgcuucacuggaggggucga

SEQ ID NO: 110422 - RNA, 21 nt, Human
ccgcgaggcccgccuuggcca

SEQ ID NO: 110423 - RNA, 24 nt, Human
ccgcgaggcggagacugcagugag

SEQ ID NO: 110424 - RNA, 32 nt, Human
ccgcgagggucugaggcgcggcugccccgggg

SEQ ID NO: 110425 - RNA, 32 nt, Human
ccgcgagggucugcggcuucauucuugaagac

SEQ ID NO: 110426 - RNA, 32 nt, Human
ccgcgaggucugggacaagugaagagagguuu

SEQ ID NO: 110427 - RNA, 32 nt, Human
ccgcgagugggcacgucucugaaugugagguc

SEQ ID NO: 110428 - RNA, 23 nt, Human
ccgcgaucgcccacucgggcgcc

SEQ ID NO: 110429 - RNA, 30 nt, Human
ccgcgauggagagagaaaaggaacaguucc

SEQ ID NO: 110430 - RNA, 30 nt, Human
ccgcgauguaccgcuaccuggccaaagcgc

SEQ ID NO: 110431 - RNA, 30 nt, Human
ccgcgauguucagcuggcuggguacggacg

SEQ ID NO: 110432 - RNA, 32 nt, Human
ccgcgauucugcagcuccgucucccaucccug

SEQ ID NO: 110433 - RNA, 32 nt, Human
ccgcgcaaggggcccuguuuccggggagacug

SEQ ID NO: 110434 - RNA, 32 nt, Human
ccgcgcaccaugggcuccauucucagccgccg

SEQ ID NO: 110435 - RNA, 32 nt, Human
ccgcgcacccacccugaccccucccucagcug

SEQ ID NO: 110436 - RNA, 32 nt, Human
ccgcgcaccccgaggcccgugugggcgguggg

SEQ ID NO: 110437 - RNA, 32 nt, Human
ccgcgcaccugugccuuaaucuucccuccccu

SEQ ID NO: 110438 - RNA, 17 nt, Human
ccgcgcacgcuccggcc

SEQ ID NO: 110439 - RNA, 22 nt, Human
ccgcgcagaccuggggccgccc

SEQ ID NO: 110440 - RNA, 17 nt, Human
ccgcgcagccccgagcu

SEQ ID NO: 110441 - RNA, 17 nt, Human
ccgcgcagccccgggcu

SEQ ID NO: 110442 - RNA, 18 nt, Human
ccgcgcagcccggcccga

SEQ ID NO: 110443 - RNA, 18 nt, Human
ccgcgcagcccucugcca

SEQ ID NO: 110444 - RNA, 20 nt, Human
ccgcgcagccgccgccgccg

SEQ ID NO: 110445 - RNA, 32 nt, Human
ccgcgcagccgggucccagccuuguccugauu

SEQ ID NO: 110446 - RNA, 18 nt, Human
ccgcgcagcgccccggcc

SEQ ID NO: 110447 - RNA, 23 nt, Human
ccgcgcagggccaccucccuggg

SEQ ID NO: 110448 - RNA, 32 nt, Human
ccgcgcagggccguggggcugagccacgcucu

SEQ ID NO: 110449 - RNA, 18 nt, Human
ccgcgcaguccccgggcu

SEQ ID NO: 110450 - RNA, 17 nt, Human
ccgcgcagucccgggcc

SEQ ID NO: 110451 - RNA, 31 nt, Human
ccgcgccacagcuaugacccugagcacugag

SEQ ID NO: 110452 - RNA, 22 nt, Human
ccgcgccacaggacccucgccg

SEQ ID NO: 110453 - RNA, 32 nt, Human
ccgcgccacugcacuccagccugggcaacaag

SEQ ID NO: 110454 - RNA, 32 nt, Human
ccgcgccacugcacuccagccugggcaacaga

SEQ ID NO: 110455 - RNA, 32 nt, Human
ccgcgccagcuugggagcccuggaguucuggc

SEQ ID NO: 110456 - RNA, 32 nt, Human
ccgcgcccagcagaggcguacuacccagcucu

SEQ ID NO: 110457 - RNA, 19 nt, Human
ccgcgcccaggggccccga

SEQ ID NO: 110458 - RNA, 32 nt, Human
ccgcgcccaucccccgccccagccccugacac

SEQ ID NO: 110459 - RNA, 20 nt, Human
ccgcgccccagccccgggcc

SEQ ID NO: 110460 - RNA, 32 nt, Human
ccgcgcccccaucgccccuccugcgcuagcgg

SEQ ID NO: 110461 - RNA, 19 nt, Human
ccgcgccccgaccccgccg

SEQ ID NO: 110462 - RNA, 20 nt, Human
ccgcgccccgcaccccgccg

SEQ ID NO: 110463 - RNA, 19 nt, Human
ccgcgccccgccaccccga

SEQ ID NO: 110464 - RNA, 20 nt, Human
ccgcgccccgccgcugagcc

SEQ ID NO: 110465 - RNA, 23 nt, Human
ccgcgccccuccagcccucgccg

SEQ ID NO: 110466 - RNA, 20 nt, Human
ccgcgccccugccccugccu

SEQ ID NO: 110467 - RNA, 32 nt, Human
ccgcgcccgcagccuccgccucccggauggac

SEQ ID NO: 110468 - RNA, 19 nt, Human
ccgcgcccgcccuacugcc

SEQ ID NO: 110469 - RNA, 32 nt, Human
ccgcgcccgccgcccgcugccugcgccgccgg

SEQ ID NO: 110470 - RNA, 18 nt, Human
ccgcgcccggcccgcccg

SEQ ID NO: 110471 - RNA, 21 nt, Human
ccgcgcccggcgccgggcgcc

SEQ ID NO: 110472 - RNA, 32 nt, Human
ccgcgcccggcgcuccccuuuguccgcgggcc

SEQ ID NO: 110473 - RNA, 32 nt, Human
ccgcgcccuccccgccccacuuucccuucuuc

SEQ ID NO: 110474 - RNA, 32 nt, Human
ccgcgcccuccccucuccuuucucccucucag

SEQ ID NO: 110475 - RNA, 32 nt, Human
ccgcgcccugccccgucucucccuugcacuuc

SEQ ID NO: 110476 - RNA, 21 nt, Human
ccgcgccgcaagggggcuccg

SEQ ID NO: 110477 - RNA, 32 nt, Human
ccgcgccgccacucccaugccugcugcuggga

SEQ ID NO: 110478 - RNA, 18 nt, Human
ccgcgccgccccgcgccg

SEQ ID NO: 110479 - RNA, 23 nt, Human
ccgcgccgcccgggcucccgccg

SEQ ID NO: 110480 - RNA, 20 nt, Human
ccgcgccgccgcccccgcug

SEQ ID NO: 110481 - RNA, 18 nt, Human
ccgcgccgccgccgccac

SEQ ID NO: 110482 - RNA, 20 nt, Human
ccgcgccgccgccgccgccg

SEQ ID NO: 110483 - RNA, 19 nt, Human
ccgcgccgccggccccgcc

SEQ ID NO: 110484 - RNA, 16 nt, Human
ccgcgccgccugggcu

SEQ ID NO: 110485 - RNA, 32 nt, Human
ccgcgccgcgccgccugaaccugggcgggggc

SEQ ID NO: 110486 - RNA, 32 nt, Human
ccgcgccgcugccucugccccggccgcccccg

SEQ ID NO: 110487 - RNA, 32 nt, Human
ccgcgccgggcccuuucugacgcccagccccc

SEQ ID NO: 110488 - RNA, 32 nt, Human
ccgcgccuacccuucccgccucccucucagag

SEQ ID NO: 110489 - RNA, 32 nt, Human
ccgcgccuacuuccugucccacugccacaaag

SEQ ID NO: 110490 - RNA, 18 nt, Human
ccgcgccuccccgggcca

SEQ ID NO: 110491 - RNA, 19 nt, Human
ccgcgccucccuugccuca

SEQ ID NO: 110492 - RNA, 19 nt, Human
ccgcgccuccgccucggcc

SEQ ID NO: 110493 - RNA, 32 nt, Human
ccgcgccucugaggcgcagcaugugaagcgga

SEQ ID NO: 110494 - RNA, 22 nt, Human
ccgcgccugcacuuagccccgc

SEQ ID NO: 110495 - RNA, 32 nt, Human
ccgcgccuggcuucuuggaaagagcaggaagg

SEQ ID NO: 110496 - RNA, 23 nt, Human
ccgcgcgaaaagccggggcgccu

SEQ ID NO: 110497 - RNA, 32 nt, Human
ccgcgcgacagaaagcugugccgccaccaccg

SEQ ID NO: 110498 - RNA, 32 nt, Human
ccgcgcgagccugucgccgcuaugccuccgcg

SEQ ID NO: 110499 - RNA, 32 nt, Human
ccgcgcgaggagccaggaugguccugguccac

SEQ ID NO: 110500 - RNA, 24 nt, Human
ccgcgcgaggccacggccacgccg

SEQ ID NO: 110501 - RNA, 21 nt, Human
ccgcgcgaggcggcccgggcc

SEQ ID NO: 110502 - RNA, 32 nt, Human
ccgcgcgaggguggggaccagcugcgcacgag

SEQ ID NO: 110503 - RNA, 25 nt, Human
ccgcgcgcaccgccuccgcgcgccu

SEQ ID NO: 110504 - RNA, 22 nt, Human
ccgcgcgcaccggcccugagcu

SEQ ID NO: 110505 - RNA, 21 nt, Human
ccgcgcgccaugcuccgggcc

SEQ ID NO: 110506 - RNA, 22 nt, Human
ccgcgcgccaugcuccgggccc

SEQ ID NO: 110507 - RNA, 21 nt, Human
ccgcgcgcccaggcggggccu

SEQ ID NO: 110508 - RNA, 19 nt, Human
ccgcgcgccccgccgcucg

SEQ ID NO: 110509 - RNA, 18 nt, Human
ccgcgcgcccgcccgccg

SEQ ID NO: 110510 - RNA, 23 nt, Human
ccgcgcgcccggagcaggagccu

SEQ ID NO: 110511 - RNA, 22 nt, Human
ccgcgcgccgccaccgccgccg

SEQ ID NO: 110512 - RNA, 19 nt, Human
ccgcgcgccgccgccgcug

SEQ ID NO: 110513 - RNA, 22 nt, Human
ccgcgcgccgccgccgcugccg

SEQ ID NO: 110514 - RNA, 19 nt, Human
ccgcgcgccgccgcugccg

SEQ ID NO: 110515 - RNA, 22 nt, Human
ccgcgcgccgccgcugccgccg

SEQ ID NO: 110516 - RNA, 22 nt, Human
ccgcgcgccggggcgggggccu

SEQ ID NO: 110517 - RNA, 20 nt, Human
ccgcgcgccgguccggcgcc

SEQ ID NO: 110518 - RNA, 18 nt, Human
ccgcgcgccucccugccg

SEQ ID NO: 110519 - RNA, 19 nt, Human
ccgcgcgccuccgagcgcc

SEQ ID NO: 110520 - RNA, 21 nt, Human
ccgcgcgccuccgcggaugcc

SEQ ID NO: 110521 - RNA, 20 nt, Human
ccgcgcgcgcccauugggcc

SEQ ID NO: 110522 - RNA, 19 nt, Human
ccgcgcgcgccucgaggcc

SEQ ID NO: 110523 - RNA, 24 nt, Human
ccgcgcgcggcccgccgagcgccu

SEQ ID NO: 110524 - RNA, 19 nt, Human
ccgcgcggaaggagcugga

SEQ ID NO: 110525 - RNA, 32 nt, Human
ccgcgcggauccggggaaugcgugagaggaga

SEQ ID NO: 110526 - RNA, 26 nt, Human
ccgcgcggcaugaggaauuuaucugg

SEQ ID NO: 110527 - RNA, 17 nt, Human
ccgcgcggccacggcca

SEQ ID NO: 110528 - RNA, 19 nt, Human
ccgcgcggccccgccgccg

SEQ ID NO: 110529 - RNA, 16 nt, Human
ccgcgcggccccgggu

SEQ ID NO: 110530 - RNA, 32 nt, Human
ccgcgcggcgcaucccagccugggcgggacgc

SEQ ID NO: 110531 - RNA, 19 nt, Human
ccgcgcggcgccucgagcu

SEQ ID NO: 110532 - RNA, 23 nt, Human
ccgcgcggcucccagccccgccg

SEQ ID NO: 110533 - RNA, 26 nt, Human
ccgcgcggcugaggaaauuuauuugg

SEQ ID NO: 110534 - RNA, 32 nt, Human
ccgcgcggcugcagcaugccucacaggaagaa

SEQ ID NO: 110535 - RNA, 23 nt, Human
ccgcgcggcugccggcccaagag

SEQ ID NO: 110536 - RNA, 22 nt, Human
ccgcgcggcugcggcccaggag

SEQ ID NO: 110537 - RNA, 27 nt, Human
ccgcgcggcuuaggaaaauuauuugga

SEQ ID NO: 110538 - RNA, 32 nt, Human
ccgcgcgggccgcggcgagcgcgaugccggcg

SEQ ID NO: 110539 - RNA, 20 nt, Human
ccgcgcggggcagccccccg

SEQ ID NO: 110540 - RNA, 24 nt, Human
ccgcgcggggcagccccccgggga

SEQ ID NO: 110541 - RNA, 20 nt, Human
ccgcgcggggcuccgaggcg

SEQ ID NO: 110542 - RNA, 32 nt, Human
ccgcgcgggggcgggagccagguggccucggc

SEQ ID NO: 110543 - RNA, 32 nt, Human
ccgcgcggguccgggagccaggcacgggaccc

SEQ ID NO: 110544 - RNA, 19 nt, Human
ccgcgcgggugaagccgga

SEQ ID NO: 110545 - RNA, 18 nt, Human
ccgcgcggguuccgggcc

SEQ ID NO: 110546 - RNA, 32 nt, Human
ccgcgcggugcagcgcagucucaggccgcggg

SEQ ID NO: 110547 - RNA, 32 nt, Human
ccgcgcguccgcacuccucggcccucgggcgg

SEQ ID NO: 110548 - RNA, 32 nt, Human
ccgcgcgugccuggcucggagcuccgcugcgg

SEQ ID NO: 110549 - RNA, 22 nt, Human
ccgcgcguguuccccgggcgcc

SEQ ID NO: 110550 - RNA, 32 nt, Human
ccgcgcucaggaggucaagaccagccugggca

SEQ ID NO: 110551 - RNA, 32 nt, Human
ccgcgcuccacguuuugcaggcugccaccgug

SEQ ID NO: 110552 - RNA, 32 nt, Human
ccgcgcuccagccucaccaggcuccccggcuc

SEQ ID NO: 110553 - RNA, 32 nt, Human
ccgcgcuccagccucgcucuccgccgcccgca

SEQ ID NO: 110554 - RNA, 32 nt, Human
ccgcgcuccagccugggugacagagcgagacc

SEQ ID NO: 110555 - RNA, 32 nt, Human
ccgcgcucccaggagaguggaggcugcaggaa

SEQ ID NO: 110556 - RNA, 32 nt, Human
ccgcgcucccaucccccaccuucccgggccgg

SEQ ID NO: 110557 - RNA, 18 nt, Human
ccgcgcuccgccccggcc

SEQ ID NO: 110558 - RNA, 19 nt, Human
ccgcgcucgccccgggcua

SEQ ID NO: 110559 - RNA, 20 nt, Human
ccgcgcucucaccccgggcu

SEQ ID NO: 110560 - RNA, 32 nt, Human
ccgcgcucucacugcagccugugcccaacccc

SEQ ID NO: 110561 - RNA, 32 nt, Human
ccgcgcucugcgggcugggaggcccgggccag

SEQ ID NO: 110562 - RNA, 32 nt, Human
ccgcgcucugugggccucugagggcggcaugc

SEQ ID NO: 110563 - RNA, 25 nt, Human
ccgcgcugagagcccagccccgccg

SEQ ID NO: 110564 - RNA, 19 nt, Human
ccgcgcugcagggaacagc

SEQ ID NO: 110565 - RNA, 18 nt, Human
ccgcgcugccacccgccg

SEQ ID NO: 110566 - RNA, 21 nt, Human
ccgcgcugccauucccggccg

SEQ ID NO: 110567 - RNA, 32 nt, Human
ccgcgcugcccaggccauggacugugagguca

SEQ ID NO: 110568 - RNA, 23 nt, Human
ccgcgcugccccacgccgcgccg

SEQ ID NO: 110569 - RNA, 32 nt, Human
ccgcgcugccccugcccugccucuguccuggc

SEQ ID NO: 110570 - RNA, 31 nt, Human
ccgcgcugccucucggguguccugggucggu

SEQ ID NO: 110571 - RNA, 22 nt, Human
ccgcgcugcguucccgaccccu

SEQ ID NO: 110572 - RNA, 20 nt, Human
ccgcgcugcugggucccgcc

SEQ ID NO: 110573 - RNA, 23 nt, Human
ccgcgcugcuguuagacacuccg

SEQ ID NO: 110574 - RNA, 19 nt, Human
ccgcgcuggccaccccgcc

SEQ ID NO: 110575 - RNA, 18 nt, Human
ccgcgcuggcgccccccg

SEQ ID NO: 110576 - RNA, 20 nt, Human
ccgcgcuggggagcccaccg

SEQ ID NO: 110577 - RNA, 32 nt, Human
ccgcgcuucagccucagcuucggccucagccc

SEQ ID NO: 110578 - RNA, 18 nt, Human
ccgcgcuucgcuucagcu

SEQ ID NO: 110579 - RNA, 32 nt, Human
ccgcgcuucuggagcacuggccaaggcgggcc

SEQ ID NO: 110580 - RNA, 32 nt, Human
ccgcggaaaaggagggggagcggcuggucagc

SEQ ID NO: 110581 - RNA, 32 nt, Human
ccgcggaagccgcggugucggcgccauggcgg

SEQ ID NO: 110582 - RNA, 19 nt, Human
ccgcggaccaccgcuuccu

SEQ ID NO: 110583 - RNA, 32 nt, Human
ccgcggaccccgagcacgcgccugacagcccc

SEQ ID NO: 110584 - RNA, 24 nt, Human
ccgcggacccgccuucugcccuca

SEQ ID NO: 110585 - RNA, 32 nt, Human
ccgcggacccugagcgcaagagccaagccgcc

SEQ ID NO: 110586 - RNA, 32 nt, Human
ccgcggaccgguggagccugggugacggcgcc

SEQ ID NO: 110587 - RNA, 21 nt, Human
ccgcggaccucgcaugcuccc

SEQ ID NO: 110588 - RNA, 21 nt, Human
ccgcggaccuggcaguucuca

SEQ ID NO: 110589 - RNA, 21 nt, Human
ccgcggacuugcccugaguua

SEQ ID NO: 110590 - RNA, 24 nt, Human
ccgcggacuuggcugcugcuccca

SEQ ID NO: 110591 - RNA, 32 nt, Human
ccgcggagaugaagaauuugcagggagccucc

SEQ ID NO: 110592 - RNA, 32 nt, Human
ccgcggagcagggagagaaaaagcagguaggg

SEQ ID NO: 110593 - RNA, 32 nt, Human
ccgcggagccagcacgaacgagcccagcaccg

SEQ ID NO: 110594 - RNA, 32 nt, Human
ccgcggagcccggucacagucacugcagcaga

SEQ ID NO: 110595 - RNA, 32 nt, Human
ccgcggagcgugccuaaggugaaagggcugcc

SEQ ID NO: 110596 - RNA, 32 nt, Human
ccgcggagcugaagagggaggaaggggcggcu

SEQ ID NO: 110597 - RNA, 32 nt, Human
ccgcggaggaggaggaaggggaggagggcgag

SEQ ID NO: 110598 - RNA, 32 nt, Human
ccgcggaggagguggaggaggcggcggcggcg

SEQ ID NO: 110599 - RNA, 32 nt, Human
ccgcggaggcuggagccgcaauggugcugaug

SEQ ID NO: 110600 - RNA, 32 nt, Human
ccgcggaguuacgggaaaguugguccgaguuc

SEQ ID NO: 110601 - RNA, 23 nt, Human
ccgcggcaaggaguuuauuuaga

SEQ ID NO: 110602 - RNA, 19 nt, Human
ccgcggcaccgcuccgacc

SEQ ID NO: 110603 - RNA, 18 nt, Human
ccgcggcagccccgggcu

SEQ ID NO: 110604 - RNA, 24 nt, Human
ccgcggcaggaaaauguauuugga

SEQ ID NO: 110605 - RNA, 32 nt, Human
ccgcggcaggagaaacagccgaggacacccug

SEQ ID NO: 110606 - RNA, 32 nt, Human
ccgcggccacauccgcucaauuuuccagacuc

SEQ ID NO: 110607 - RNA, 17 nt, Human
ccgcggccagccccgcc

SEQ ID NO: 110608 - RNA, 21 nt, Human
ccgcggccaggaauuuauuug

SEQ ID NO: 110609 - RNA, 32 nt, Human
ccgcggccccagcagcccugugcccucguugg

SEQ ID NO: 110610 - RNA, 32 nt, Human
ccgcggcccggccggcaguugcaguguagaca

SEQ ID NO: 110611 - RNA, 32 nt, Human
ccgcggcccuuuccaccucuuuucacuuuggg

SEQ ID NO: 110612 - RNA, 32 nt, Human
ccgcggccgaccauagagaugcggcucccgcc

SEQ ID NO: 110613 - RNA, 18 nt, Human
ccgcggccgccgccgccg

SEQ ID NO: 110614 - RNA, 18 nt, Human
ccgcggccgccgcugcug

SEQ ID NO: 110615 - RNA, 32 nt, Human
ccgcggccgccuccuccuccccggcucccgcc

SEQ ID NO: 110616 - RNA, 22 nt, Human
ccgcggccggagacacacgccg

SEQ ID NO: 110617 - RNA, 32 nt, Human
ccgcggccggccuggcuucacuggcgcccuuu

SEQ ID NO: 110618 - RNA, 32 nt, Human
ccgcggccuagacucaagucuggguuucagcu

SEQ ID NO: 110619 - RNA, 32 nt, Human
ccgcggccuccaggagucucauggaagggacg

SEQ ID NO: 110620 - RNA, 18 nt, Human
ccgcggccuccccgaguc

SEQ ID NO: 110621 - RNA, 32 nt, Human
ccgcggccuccuccuccuccccguucccuuca

SEQ ID NO: 110622 - RNA, 32 nt, Human
ccgcggccuggaccccuggaccgcuuugcgca

SEQ ID NO: 110623 - RNA, 32 nt, Human
ccgcggcgacaccuccgcgggcacucacccag

SEQ ID NO: 110624 - RNA, 32 nt, Human
ccgcggcgacuugccgucucuccauuccacug

SEQ ID NO: 110625 - RNA, 32 nt, Human
ccgcggcgagccgggccgagcagugagggccc

SEQ ID NO: 110626 - RNA, 21 nt, Human
ccgcggcgccgccuccucccu

SEQ ID NO: 110627 - RNA, 32 nt, Human
ccgcggcggagccagaggcugcaggaagagcc

SEQ ID NO: 110628 - RNA, 20 nt, Human
ccgcggcggagcccgaguua

SEQ ID NO: 110629 - RNA, 32 nt, Human
ccgcggcggcaccaugaguccccgcucgugcc

SEQ ID NO: 110630 - RNA, 32 nt, Human
ccgcggcggccgucucucccacccgcagcagc

SEQ ID NO: 110631 - RNA, 32 nt, Human
ccgcggcggccuggggaaguguuuggauugug

SEQ ID NO: 110632 - RNA, 19 nt, Human
ccgcggcggcgucccggcu

SEQ ID NO: 110633 - RNA, 32 nt, Human
ccgcggcgggcaggccaggacugucagugccc

SEQ ID NO: 110634 - RNA, 32 nt, Human
ccgcggcggggcagccgcaggagcccuggcug

SEQ ID NO: 110635 - RNA, 23 nt, Human
ccgcggcguccguccguccuucc

SEQ ID NO: 110636 - RNA, 32 nt, Human
ccgcggcgucuucuccacccaccugcgcuggg

SEQ ID NO: 110637 - RNA, 24 nt, Human
ccgcggcuccccagccccaggccg

SEQ ID NO: 110638 - RNA, 21 nt, Human
ccgcggcuccgaacucggugg

SEQ ID NO: 110639 - RNA, 22 nt, Human
ccgcggcuccgccgcccagccg

SEQ ID NO: 110640 - RNA, 23 nt, Human
ccgcggcuccggagcccucgccg

SEQ ID NO: 110641 - RNA, 22 nt, Human
ccgcggcuccuccagcacacug

SEQ ID NO: 110642 - RNA, 32 nt, Human
ccgcggcucgaggacuccgcuuccuucccucc

SEQ ID NO: 110643 - RNA, 19 nt, Human
ccgcggcugcgggcuucug

SEQ ID NO: 110644 - RNA, 18 nt, Human
ccgcggcugcucggggcc

SEQ ID NO: 110645 - RNA, 32 nt, Human
ccgcggcugcugaggcggaggcugaggcagug

SEQ ID NO: 110646 - RNA, 32 nt, Human
ccgcggcugcugcugcgcaggcccagugcugc

SEQ ID NO: 110647 - RNA, 17 nt, Human
ccgcggcugucccgguc

SEQ ID NO: 110648 - RNA, 32 nt, Human
ccgcggcugucgggguccugcagccucaauag

SEQ ID NO: 110649 - RNA, 17 nt, Human
ccgcggcuguuccgggc

SEQ ID NO: 110650 - RNA, 32 nt, Human
ccgcgggacagcuucuguccaaucauguugag

SEQ ID NO: 110651 - RNA, 23 nt, Human
ccgcgggacuguaggcccggggg

SEQ ID NO: 110652 - RNA, 32 nt, Human
ccgcgggagcagcuacugggcugggcugcgga

SEQ ID NO: 110653 - RNA, 32 nt, Human
ccgcgggagccgcggccaccaggaggccccgc

SEQ ID NO: 110654 - RNA, 32 nt, Human
ccgcgggagccuggcccgccgugcagagcagu

SEQ ID NO: 110655 - RNA, 20 nt, Human
ccgcgggagcugcuccggcc

SEQ ID NO: 110656 - RNA, 19 nt, Human
ccgcgggagguggcccuca

SEQ ID NO: 110657 - RNA, 20 nt, Human
ccgcgggcagccaccgagcc

SEQ ID NO: 110658 - RNA, 32 nt, Human
ccgcgggccagcacugguaccuagccggggcc

SEQ ID NO: 110659 - RNA, 32 nt, Human
ccgcgggcccggccgagcaggagcagcucccg

SEQ ID NO: 110660 - RNA, 24 nt, Human
ccgcgggccgccgcgggccuccug

SEQ ID NO: 110661 - RNA, 20 nt, Human
ccgcgggccggagcccgggu

SEQ ID NO: 110662 - RNA, 19 nt, Human
ccgcgggccggccugggcc

SEQ ID NO: 110663 - RNA, 32 nt, Human
ccgcgggcggcggcggagcugggcagguggau

SEQ ID NO: 110664 - RNA, 21 nt, Human
ccgcgggcucgcccgggcgcc

SEQ ID NO: 110665 - RNA, 32 nt, Human
ccgcggggagagaggaggagagaaguggccag

SEQ ID NO: 110666 - RNA, 32 nt, Human
ccgcggggagccaagcccccugggccggaaau

SEQ ID NO: 110667 - RNA, 32 nt, Human
ccgcggggaggaagagggaaaaggaagaugga

SEQ ID NO: 110668 - RNA, 32 nt, Human
ccgcggggaggcugguccuggagcccaucccc

SEQ ID NO: 110669 - RNA, 32 nt, Human
ccgcggggagggcacaacagcugcuaccugaa

SEQ ID NO: 110670 - RNA, 32 nt, Human
ccgcggggaugaggagguugucagugauugaa

SEQ ID NO: 110671 - RNA, 21 nt, Human
ccgcggggcaguucgggaacc

SEQ ID NO: 110672 - RNA, 19 nt, Human
ccgcggggccgcuccggcc

SEQ ID NO: 110673 - RNA, 32 nt, Human
ccgcgggggccaagccccuggcuucuuacugc

SEQ ID NO: 110674 - RNA, 32 nt, Human
ccgcggggguuagaggucaccaugcugagggu

SEQ ID NO: 110675 - RNA, 32 nt, Human
ccgcggguggggaaaucuggagcucagccgag

SEQ ID NO: 110676 - RNA, 32 nt, Human
ccgcgguagcaacguggggcucaucugccucu

SEQ ID NO: 110677 - RNA, 32 nt, Human
ccgcgguagggugggaacccaagcgggagagc

SEQ ID NO: 110678 - RNA, 23 nt, Human
ccgcgguagguaauuuauuugga

SEQ ID NO: 110679 - RNA, 32 nt, Human
ccgcgguaugcagcaggcugccggcuucaguc

SEQ ID NO: 110680 - RNA, 18 nt, Human
ccgcggucgccccgacca

SEQ ID NO: 110681 - RNA, 32 nt, Human
ccgcggucuccggccucuccacccucagcccc

SEQ ID NO: 110682 - RNA, 32 nt, Human
ccgcggugacccuucucucaugacccugcggu

SEQ ID NO: 110683 - RNA, 32 nt, Human
ccgcggugcaagagcccagcccaggggcgcug

SEQ ID NO: 110684 - RNA, 32 nt, Human
ccgcggugcccagcucuccagccuggggauuc

SEQ ID NO: 110685 - RNA, 32 nt, Human
ccgcggugccuggccuccccucccagacugca

SEQ ID NO: 110686 - RNA, 32 nt, Human
ccgcggugggacuccggagcagcguacaccgc

SEQ ID NO: 110687 - RNA, 21 nt, Human
ccgcggugggagugggcgcag

SEQ ID NO: 110688 - RNA, 32 nt, Human
ccgcggugggcauggggcagggccggagccgc

SEQ ID NO: 110689 - RNA, 32 nt, Human
ccgcgguggguggaucaccugaggucaggagu

SEQ ID NO: 110690 - RNA, 20 nt, Human
ccgcgguuccuccccgagcc

SEQ ID NO: 110691 - RNA, 32 nt, Human
ccgcgucagaacugaagagaggaaggggagga

SEQ ID NO: 110692 - RNA, 32 nt, Human
ccgcguccccuccaguccgcuccgggcagcug

SEQ ID NO: 110693 - RNA, 19 nt, Human
ccgcguccgccuccgggcc

SEQ ID NO: 110694 - RNA, 32 nt, Human
ccgcguccuacgcaggcucugccacagggguu

SEQ ID NO: 110695 - RNA, 23 nt, Human
ccgcguccucgcugccccgggcc

SEQ ID NO: 110696 - RNA, 32 nt, Human
ccgcgucgaccugcaguggauuuccuuccugu

SEQ ID NO: 110697 - RNA, 24 nt, Human
ccgcgucgccccgucggguacuga

SEQ ID NO: 110698 - RNA, 32 nt, Human
ccgcgucgccgcccuggcggggacggugcagc

SEQ ID NO: 110699 - RNA, 32 nt, Human
ccgcgucucccaggacgcaugaagguggcacc

SEQ ID NO: 110700 - RNA, 32 nt, Human
ccgcgucuccuucccucuccccaaagccugga

SEQ ID NO: 110701 - RNA, 32 nt, Human
ccgcgucucugggcuuuugcucugucaggcug

SEQ ID NO: 110702 - RNA, 32 nt, Human
ccgcgucuguaagggccugccugcugcucucg

SEQ ID NO: 110703 - RNA, 32 nt, Human
ccgcgugagccgcagcccuggggccagcagga

SEQ ID NO: 110704 - RNA, 22 nt, Human
ccgcgugccgcgccccggccgc

SEQ ID NO: 110705 - RNA, 32 nt, Human
ccgcgugccuguaaucccagcuacuugggagg

SEQ ID NO: 110706 - RNA, 32 nt, Human
ccgcgugcgccuacgccuucugcuccaguugc

SEQ ID NO: 110707 - RNA, 32 nt, Human
ccgcgugcgguggcucacgccuguaaucccag

SEQ ID NO: 110708 - RNA, 32 nt, Human
ccgcgugcuccuguucagcccugccgaggugg

SEQ ID NO: 110709 - RNA, 21 nt, Human
ccgcguggagcgcccugacua

SEQ ID NO: 110710 - RNA, 18 nt, Human
ccgcguggcgccucggcc

SEQ ID NO: 110711 - RNA, 32 nt, Human
ccgcgugggaccccaauagaacucagcccuuc

SEQ ID NO: 110712 - RNA, 32 nt, Human
ccgcgugggagcaccugcugagcccagccaga

SEQ ID NO: 110713 - RNA, 32 nt, Human
ccgcgugggaggacgaugggucagcgcggaaa

SEQ ID NO: 110714 - RNA, 32 nt, Human
ccgcgugguaucucccgagggcugcuuggacc

SEQ ID NO: 110715 - RNA, 23 nt, Human
ccgcguggugccauccccagggg

SEQ ID NO: 110716 - RNA, 32 nt, Human
ccgcguuaucccaaaggugggauuacgccugu

SEQ ID NO: 110717 - RNA, 32 nt, Human
ccgcguuccagccucacaccccacggugcugu

SEQ ID NO: 110718 - RNA, 32 nt, Human
ccgcguucccguccucuuccgcuuggccccag

SEQ ID NO: 110719 - RNA, 32 nt, Human
ccgcuaaaaaugcaaaaauuagccaggcgugg

SEQ ID NO: 110720 - RNA, 32 nt, Human
ccgcuaaggaacauggcgaagguggagcaggu

SEQ ID NO: 110721 - RNA, 32 nt, Human
ccgcuacaccacuccucuagaacucgguggua

SEQ ID NO: 110722 - RNA, 32 nt, Human
ccgcuacacccagggaggcgcuggagcgugug

SEQ ID NO: 110723 - RNA, 32 nt, Human
ccgcuacacuaccugggcugggcccugcaggg

SEQ ID NO: 110724 - RNA, 32 nt, Human
ccgcuacagacccagccuugcacuccaaggcu

SEQ ID NO: 110725 - RNA, 23 nt, Human
ccgcuaccccaacagucuggaca

SEQ ID NO: 110726 - RNA, 22 nt, Human
ccgcuaccgccgcaccugggcu

SEQ ID NO: 110727 - RNA, 32 nt, Human
ccgcuaccucgcuccuccucccacccaauccc

SEQ ID NO: 110728 - RNA, 32 nt, Human
ccgcuaccuucaccaccuccugcugugggugg

SEQ ID NO: 110729 - RNA, 32 nt, Human
ccgcuaccuuucucccucuccuucccuucauc

SEQ ID NO: 110730 - RNA, 32 nt, Human
ccgcuacgggaaggcaugccagccugggcgau

SEQ ID NO: 110731 - RNA, 32 nt, Human
ccgcuacugccuggccccuugcugacucaggc

SEQ ID NO: 110732 - RNA, 32 nt, Human
ccgcuacugcgcaaagaugguggaggaggaga

SEQ ID NO: 110733 - RNA, 18 nt, Human
ccgcuacuuagguacugg

SEQ ID NO: 110734 - RNA, 32 nt, Human
ccgcuagaaaguacagaaggaacuuuggaugu

SEQ ID NO: 110735 - RNA, 32 nt, Human
ccgcuagagcuaggagaaaaaugcagacgcga

SEQ ID NO: 110736 - RNA, 32 nt, Human
ccgcuagcauguggccaggggugcaggguggc

SEQ ID NO: 110737 - RNA, 19 nt, Human
ccgcuagccucccugagcu

SEQ ID NO: 110738 - RNA, 32 nt, Human
ccgcuaggcuuucaccccagccgccgguccug

SEQ ID NO: 110739 - RNA, 32 nt, Human
ccgcuaguauguuggaaguuauuuggauuguu

SEQ ID NO: 110740 - RNA, 32 nt, Human
ccgcuauaccuccccuuccuccugcaucuccc

SEQ ID NO: 110741 - RNA, 32 nt, Human
ccgcuaugugccaggaucuguccacagaggcc

SEQ ID NO: 110742 - RNA, 32 nt, Human
ccgcucacugcaacauccgccucccggacuca

SEQ ID NO: 110743 - RNA, 32 nt, Human
ccgcucacugcaaccuccaccuccuggcuuca

SEQ ID NO: 110744 - RNA, 32 nt, Human
ccgcucacugcaaccuccgccucccagguuca

SEQ ID NO: 110745 - RNA, 32 nt, Human
ccgcucacugcaaccucugccucccgguucaa

SEQ ID NO: 110746 - RNA, 32 nt, Human
ccgcucacugcaaccucugcuucccggguuca

SEQ ID NO: 110747 - RNA, 32 nt, Human
ccgcucacugcaagcacugccucccuccgggg

SEQ ID NO: 110748 - RNA, 32 nt, Human
ccgcucacugcaagcuccgccucccggguuca

SEQ ID NO: 110749 - RNA, 32 nt, Human
ccgcucacugcaagcucugccuccugggcuca

SEQ ID NO: 110750 - RNA, 32 nt, Human
ccgcucagagacagaggaaggccaaggcgcuc

SEQ ID NO: 110751 - RNA, 32 nt, Human
ccgcucaggccccacucgacccucucgggccu

SEQ ID NO: 110752 - RNA, 19 nt, Human
ccgcucagggccccgguca

SEQ ID NO: 110753 - RNA, 32 nt, Human
ccgcucagggggagcaggaggacagcuggccg

SEQ ID NO: 110754 - RNA, 32 nt, Human
ccgcucagugcauuccuuuuucauacacugau

SEQ ID NO: 110755 - RNA, 32 nt, Human
ccgcuccagcccggccaugagcgcggccgcau

SEQ ID NO: 110756 - RNA, 19 nt, Human
ccgcuccagccgcccgcgg

SEQ ID NO: 110757 - RNA, 32 nt, Human
ccgcuccagcuacucaggaggcugaggcagga

SEQ ID NO: 110758 - RNA, 32 nt, Human
ccgcuccagcuccagccccacccggccggucc

SEQ ID NO: 110759 - RNA, 32 nt, Human
ccgcuccagguggcgggcggcuggagcgaggg

SEQ ID NO: 110760 - RNA, 32 nt, Human
ccgcuccaguucucaucaucucccaggcagaa

SEQ ID NO: 110761 - RNA, 32 nt, Human
ccgcuccauccccuccuccuccuuaggaugca

SEQ ID NO: 110762 - RNA, 32 nt, Human
ccgcucccaccuagaggccaggaaagggggag

SEQ ID NO: 110763 - RNA, 32 nt, Human
ccgcucccaggagagugagggugacgcaauug

SEQ ID NO: 110764 - RNA, 31 nt, Human
ccgcucccccucucugugcccugguccccuu

SEQ ID NO: 110765 - RNA, 32 nt, Human
ccgcuccccuuucccaucaccccuuccccauu

SEQ ID NO: 110766 - RNA, 32 nt, Human
ccgcucccgccucgcgcaugugcauuggcuga

SEQ ID NO: 110767 - RNA, 32 nt, Human
ccgcucccgcgcguuguuguccugccuuaccg

SEQ ID NO: 110768 - RNA, 18 nt, Human
ccgcucccgcuggucauc

SEQ ID NO: 110769 - RNA, 32 nt, Human
ccgcucccucaagcucuggauggcugcagugu

SEQ ID NO: 110770 - RNA, 18 nt, Human
ccgcucccuccccacuaa

SEQ ID NO: 110771 - RNA, 32 nt, Human
ccgcucccuccccuccucccuugcucacccca

SEQ ID NO: 110772 - RNA, 32 nt, Human
ccgcucccucuccaggcaaccccacccaccag

SEQ ID NO: 110773 - RNA, 32 nt, Human
ccgcucccugcagaggaugcucguuuugcaga

SEQ ID NO: 110774 - RNA, 32 nt, Human
ccgcucccugccaccagggcugaagaugcgag

SEQ ID NO: 110775 - RNA, 20 nt, Human
ccgcucccugccccgaggca

SEQ ID NO: 110776 - RNA, 32 nt, Human
ccgcucccuucccagccucgcuccucuuuccu

SEQ ID NO: 110777 - RNA, 19 nt, Human
ccgcuccgcagccccgggc

SEQ ID NO: 110778 - RNA, 32 nt, Human
ccgcuccgcccccucccucucccuugagaagc

SEQ ID NO: 110779 - RNA, 18 nt, Human
ccgcuccgccccgggaca

SEQ ID NO: 110780 - RNA, 32 nt, Human
ccgcuccgccgcgcuccagccucgcucuccgc

SEQ ID NO: 110781 - RNA, 32 nt, Human
ccgcuccgccuugccaggagucugcagaacca

SEQ ID NO: 110782 - RNA, 32 nt, Human
ccgcuccgggagcugcucaucagccgcaacuu

SEQ ID NO: 110783 - RNA, 32 nt, Human
ccgcuccuccacccagugcuucugcccaugcc

SEQ ID NO: 110784 - RNA, 32 nt, Human
ccgcuccuccgggggaaugaaagcuacugguu

SEQ ID NO: 110785 - RNA, 32 nt, Human
ccgcuccucuagucgcccuccgcuggccccgc

SEQ ID NO: 110786 - RNA, 20 nt, Human
ccgcuccugcccaggccuca

SEQ ID NO: 110787 - RNA, 32 nt, Human
ccgcuccugccugcgcccgcagcugaccuucu

SEQ ID NO: 110788 - RNA, 32 nt, Human
ccgcuccugccuggucugggcuguguguggcg

SEQ ID NO: 110789 - RNA, 21 nt, Human
ccgcuccugcugcugcucuga

SEQ ID NO: 110790 - RNA, 32 nt, Human
ccgcuccuguuggagcccccauacgcccgagc

SEQ ID NO: 110791 - RNA, 32 nt, Human
ccgcucgagcccagccucucccugccaaagcc

SEQ ID NO: 110792 - RNA, 22 nt, Human
ccgcucgcaccgcacucugacc

SEQ ID NO: 110793 - RNA, 32 nt, Human
ccgcucgcagcaaccucugccucccagguuca

SEQ ID NO: 110794 - RNA, 32 nt, Human
ccgcucgcccuccagguucugccacuugcugg

SEQ ID NO: 110795 - RNA, 32 nt, Human
ccgcucgccgccuuccucccucugccuuccuu

SEQ ID NO: 110796 - RNA, 21 nt, Human
ccgcucgcgcggccucgaguc

SEQ ID NO: 110797 - RNA, 23 nt, Human
ccgcucgcggugccucuggguca

SEQ ID NO: 110798 - RNA, 32 nt, Human
ccgcucgcuacaaccuccaccucccagcugcc

SEQ ID NO: 110799 - RNA, 32 nt, Human
ccgcucgcuccgccccgcgaagccccugcgcg

SEQ ID NO: 110800 - RNA, 32 nt, Human
ccgcucgcugcaaccaccaucuccuggguuca

SEQ ID NO: 110801 - RNA, 19 nt, Human
ccgcucggcgcuccgggcu

SEQ ID NO: 110802 - RNA, 32 nt, Human
ccgcucggcugcgcugcggcucaggcccccgc

SEQ ID NO: 110803 - RNA, 32 nt, Human
ccgcucgggaggcugaggcaggagaauugcuu

SEQ ID NO: 110804 - RNA, 18 nt, Human
ccgcucgggccccgagcc

SEQ ID NO: 110805 - RNA, 32 nt, Human
ccgcucgggggaagcccagugggauuugcauc

SEQ ID NO: 110806 - RNA, 32 nt, Human
ccgcucgggugaagcccagugggauuugcauc

SEQ ID NO: 110807 - RNA, 17 nt, Human
ccgcucucacccgggcc

SEQ ID NO: 110808 - RNA, 32 nt, Human
ccgcucuccacggcacccccacugcaggcugu

SEQ ID NO: 110809 - RNA, 32 nt, Human
ccgcucuccagccaagguuccgggcugaggca

SEQ ID NO: 110810 - RNA, 32 nt, Human
ccgcucuccuccccggcacaggcagggggucu

SEQ ID NO: 110811 - RNA, 32 nt, Human
ccgcucucucaggcccucagggucaaggccuu

SEQ ID NO: 110812 - RNA, 32 nt, Human
ccgcucucuggcccuaagugcugagcugccgg

SEQ ID NO: 110813 - RNA, 32 nt, Human
ccgcucugaaacagacagaggcuggaacuuug

SEQ ID NO: 110814 - RNA, 32 nt, Human
ccgcucugauguugcuagaccuccucagcacu

SEQ ID NO: 110815 - RNA, 32 nt, Human
ccgcucugcucgcgcccugccgcugcgccgcc

SEQ ID NO: 110816 - RNA, 32 nt, Human
ccgcucuggaaaggaagagaaauggaagugag

SEQ ID NO: 110817 - RNA, 32 nt, Human
ccgcucuggacuagcaguggcuccccagggcc

SEQ ID NO: 110818 - RNA, 32 nt, Human
ccgcucuggcucgaggguggucugagcacuuc

SEQ ID NO: 110819 - RNA, 32 nt, Human
ccgcucugggcgagccuccuccccagccccca

SEQ ID NO: 110820 - RNA, 21 nt, Human
ccgcucuguaucccccuggug

SEQ ID NO: 110821 - RNA, 32 nt, Human
ccgcucugugacacagucuaccugucugcaaa

SEQ ID NO: 110822 - RNA, 32 nt, Human
ccgcucuguuugcuuuugccccgcucuggcuu

SEQ ID NO: 110823 - RNA, 32 nt, Human
ccgcucuuccaaguggacggcagaccugggag

SEQ ID NO: 110824 - RNA, 32 nt, Human
ccgcucuuccaggacggccucugugcugcugg

SEQ ID NO: 110825 - RNA, 20 nt, Human
ccgcucuucucucccgagcc

SEQ ID NO: 110826 - RNA, 32 nt, Human
ccgcucuuugcaucuugucuugcccacagcug

SEQ ID NO: 110827 - RNA, 32 nt, Human
ccgcugaaccgucagcuggcuguggugugggc

SEQ ID NO: 110828 - RNA, 32 nt, Human
ccgcugacaaggcgcuccagccccagagccag

SEQ ID NO: 110829 - RNA, 32 nt, Human
ccgcugagaggguggcgacgucggggccaugg

SEQ ID NO: 110830 - RNA, 32 nt, Human
ccgcugagccacaguccuccuaggcaaugccu

SEQ ID NO: 110831 - RNA, 20 nt, Human
ccgcugagcgcccccgagcc

SEQ ID NO: 110832 - RNA, 18 nt, Human
ccgcugagcgcccgagcc

SEQ ID NO: 110833 - RNA, 32 nt, Human
ccgcugaggaagagucuccucugaggggagag

SEQ ID NO: 110834 - RNA, 32 nt, Human
ccgcugaggccgcggcgcccgccagccugucc

SEQ ID NO: 110835 - RNA, 32 nt, Human
ccgcugaggggcugagggaagggggucaaagg

SEQ ID NO: 110836 - RNA, 32 nt, Human
ccgcugaggugccagaagcagcgaggagcuuc

SEQ ID NO: 110837 - RNA, 32 nt, Human
ccgcugagucugcacccaggagaccagagagc

SEQ ID NO: 110838 - RNA, 32 nt, Human
ccgcugaguggguuauugaugaucucaagagu

SEQ ID NO: 110839 - RNA, 32 nt, Human
ccgcugauagcugcgcaacagccuggguucuu

SEQ ID NO: 110840 - RNA, 32 nt, Human
ccgcugaucuuugcuucaguccuugaaucacc

SEQ ID NO: 110841 - RNA, 20 nt, Human
ccgcugcaaguacaggugga

SEQ ID NO: 110842 - RNA, 18 nt, Human
ccgcugcaccuccgggcc

SEQ ID NO: 110843 - RNA, 23 nt, Human
ccgcugcacggggccacuaggac

SEQ ID NO: 110844 - RNA, 23 nt, Human
ccgcugcacuccagccugggcca

SEQ ID NO: 110845 - RNA, 22 nt, Human
ccgcugcacucgcccucuccuc

SEQ ID NO: 110846 - RNA, 32 nt, Human
ccgcugcacuguaggagccccuuucugggcug

SEQ ID NO: 110847 - RNA, 32 nt, Human
ccgcugcagagccgagcgaaucccgagcccgg

SEQ ID NO: 110848 - RNA, 32 nt, Human
ccgcugcagcccacagcaacccacaggccgag

SEQ ID NO: 110849 - RNA, 32 nt, Human
ccgcugcagccgccuccuccuccaggcaaaca

SEQ ID NO: 110850 - RNA, 32 nt, Human
ccgcugcagccgccuccuccuccaggugcuga

SEQ ID NO: 110851 - RNA, 31 nt, Human
ccgcugcagccgcggcugcggcggcggccgc

SEQ ID NO: 110852 - RNA, 32 nt, Human
ccgcugcagccgucgcugucuccucccagacc

SEQ ID NO: 110853 - RNA, 23 nt, Human
ccgcugcaggccccugucgagcu

SEQ ID NO: 110854 - RNA, 32 nt, Human
ccgcugcaggguggcaucuuaggguaggggaa

SEQ ID NO: 110855 - RNA, 23 nt, Human
ccgcugccacacugcccugagcc

SEQ ID NO: 110856 - RNA, 32 nt, Human
ccgcugccacaucuuccaagauacgggaaauc

SEQ ID NO: 110857 - RNA, 22 nt, Human
ccgcugccaccucgcccagcca

SEQ ID NO: 110858 - RNA, 22 nt, Human
ccgcugccacugcuccugagcc

SEQ ID NO: 110859 - RNA, 19 nt, Human
ccgcugccagccuugagcc

SEQ ID NO: 110860 - RNA, 19 nt, Human
ccgcugccagucccgggcc

SEQ ID NO: 110861 - RNA, 32 nt, Human
ccgcugcccacacagcaguuuggcgucagucu

SEQ ID NO: 110862 - RNA, 20 nt, Human
ccgcugcccacgucccgggc

SEQ ID NO: 110863 - RNA, 32 nt, Human
ccgcugcccaggagccaggucugaacuucugu

SEQ ID NO: 110864 - RNA, 22 nt, Human
ccgcugcccagguccccgagcu

SEQ ID NO: 110865 - RNA, 32 nt, Human
ccgcugccccagcuacagagacggccgaaaug

SEQ ID NO: 110866 - RNA, 32 nt, Human
ccgcugcccccauuccuucuccauacaugguu

SEQ ID NO: 110867 - RNA, 18 nt, Human
ccgcugccccccaaggaa

SEQ ID NO: 110868 - RNA, 17 nt, Human
ccgcugccccccggguc

SEQ ID NO: 110869 - RNA, 17 nt, Human
ccgcugccccugggcca

SEQ ID NO: 110870 - RNA, 19 nt, Human
ccgcugcccgcccugggcc

SEQ ID NO: 110871 - RNA, 20 nt, Human
ccgcugcccgcccugggcca

SEQ ID NO: 110872 - RNA, 19 nt, Human
ccgcugcccgcccuggguc

SEQ ID NO: 110873 - RNA, 22 nt, Human
ccgcugcccucagcuccgaguc

SEQ ID NO: 110874 - RNA, 32 nt, Human
ccgcugcccucgggggcauggcgcggccguga

SEQ ID NO: 110875 - RNA, 21 nt, Human
ccgcugcccucugcccugggc

SEQ ID NO: 110876 - RNA, 20 nt, Human
ccgcugcccuggccuugagc

SEQ ID NO: 110877 - RNA, 32 nt, Human
ccgcugccgcagccuggcuggggagggggcca

SEQ ID NO: 110878 - RNA, 23 nt, Human
ccgcugccgccaccgccgugccg

SEQ ID NO: 110879 - RNA, 19 nt, Human
ccgcugccgcccugaguca

SEQ ID NO: 110880 - RNA, 18 nt, Human
ccgcugccgccgccgccg

SEQ ID NO: 110881 - RNA, 23 nt, Human
ccgcugccgccgccgcuaccgcc

SEQ ID NO: 110882 - RNA, 17 nt, Human
ccgcugccgccucagcu

SEQ ID NO: 110883 - RNA, 17 nt, Human
ccgcugccgcugcagcc

SEQ ID NO: 110884 - RNA, 32 nt, Human
ccgcugccgguggcagguguugcaccgcgugg

SEQ ID NO: 110885 - RNA, 32 nt, Human
ccgcugccucagccucugccucccagccucuu

SEQ ID NO: 110886 - RNA, 32 nt, Human
ccgcugccuccagggagggcuggacggcgagc

SEQ ID NO: 110887 - RNA, 32 nt, Human
ccgcugccucccccaucuccccgccaucugca

SEQ ID NO: 110888 - RNA, 17 nt, Human
ccgcugccuccugggcc

SEQ ID NO: 110889 - RNA, 20 nt, Human
ccgcugccucugccccggcc

SEQ ID NO: 110890 - RNA, 32 nt, Human
ccgcugccucugggcccucccagcacacgcau

SEQ ID NO: 110891 - RNA, 18 nt, Human
ccgcugccugaagcccgg

SEQ ID NO: 110892 - RNA, 23 nt, Human
ccgcugccugcacggcgaugaga

SEQ ID NO: 110893 - RNA, 32 nt, Human
ccgcugccugcaggaagacgcccggucccggg

SEQ ID NO: 110894 - RNA, 18 nt, Human
ccgcugccugcccugacc

SEQ ID NO: 110895 - RNA, 32 nt, Human
ccguucaggagcagaauuuucccacuguaaaa

SEQ ID NO: 110896 - RNA, 32 nt, Human
ccguucaucucugaaacccagcauccuuuuca

SEQ ID NO: 110897 - RNA, 19 nt, Human
ccguucaugagcacagugu

SEQ ID NO: 110898 - RNA, 32 nt, Human
ccguucaugccuguaaucccaacauuuuggga

SEQ ID NO: 110899 - RNA, 19 nt, Human
ccguuccaaaacccacuca

SEQ ID NO: 110900 - RNA, 32 nt, Human
ccguuccaacagcauucacugccaguucuaau

SEQ ID NO: 110901 - RNA, 32 nt, Human
ccguucccacagcaccuggcacacagcaggag

SEQ ID NO: 110902 - RNA, 32 nt, Human
ccguucccagaggcuccuccugcggugcuccc

SEQ ID NO: 110903 - RNA, 32 nt, Human
ccguuccccuccccgcucuucuuccaacuccu

SEQ ID NO: 110904 - RNA, 32 nt, Human
ccguuccccugcacuccucuucucccagccca

SEQ ID NO: 110905 - RNA, 32 nt, Human
ccguucccuccagccccuugcugguuaucuua

SEQ ID NO: 110906 - RNA, 18 nt, Human
ccguucccugagcucagu

SEQ ID NO: 110907 - RNA, 32 nt, Human
ccguucccugcucccguccuguugacucugcc

SEQ ID NO: 110908 - RNA, 21 nt, Human
ccguucccugcucuggcccgc

SEQ ID NO: 110909 - RNA, 31 nt, Human
ccguuccgccucucugugggccucucuccag

SEQ ID NO: 110910 - RNA, 32 nt, Human
ccguuccuccacccgcuccucuuguggccaga

SEQ ID NO: 110911 - RNA, 32 nt, Human
ccguuccuccacucaucuguuucuccgguucu

SEQ ID NO: 110912 - RNA, 32 nt, Human
ccguuccugccuggagagaagcuuccagacca

SEQ ID NO: 110913 - RNA, 22 nt, Human
ccguuccuucaaagcaaauguc

SEQ ID NO: 110914 - RNA, 32 nt, Human
ccguucgagggucagaggagccuggaugcuaa

SEQ ID NO: 110915 - RNA, 32 nt, Human
ccguucggcccaggcuaaguuagcccucacca

SEQ ID NO: 110916 - RNA, 19 nt, Human
ccguucucagcccugagcc

SEQ ID NO: 110917 - RNA, 32 nt, Human
ccguucuccugccucagccuccccaguagcug

SEQ ID NO: 110918 - RNA, 18 nt, Human
ccguucucgcucccggcc

SEQ ID NO: 110919 - RNA, 32 nt, Human
ccguucucucagggacucucagggcagcuccu

SEQ ID NO: 110920 - RNA, 22 nt, Human
ccguucugaggcgccccgagcu

SEQ ID NO: 110921 - RNA, 32 nt, Human
ccguucugcccgaggaugaagaauaugagacu

SEQ ID NO: 110922 - RNA, 32 nt, Human
ccguucuuccaccuccuccucuuccucagaca

SEQ ID NO: 110923 - RNA, 32 nt, Human
ccguugaacaguuugcuggucuugccuggcag

SEQ ID NO: 110924 - RNA, 32 nt, Human
  misc_feature (28)..(28): n is a, c, g or u
ccguugaagcuaauauucaguucuguanaguu

SEQ ID NO: 110925 - RNA, 32 nt, Human
ccguugaaugcaagcucucuucugccuucuca

SEQ ID NO: 110926 - RNA, 32 nt, Human
ccguugaccagauaaauagaacuaucugcauu

SEQ ID NO: 110927 - RNA, 32 nt, Human
ccguugaccccaaagccucagggcuuaugucc

SEQ ID NO: 110928 - RNA, 32 nt, Human
ccguugaggagaagugggaacggagggaaggg

SEQ ID NO: 110929 - RNA, 23 nt, Human
ccguugcaggaggucuugagcca

SEQ ID NO: 110930 - RNA, 32 nt, Human
ccguugccacuuuaccacccgccugauccugg

SEQ ID NO: 110931 - RNA, 32 nt, Human
ccguugcccacugcaaguucucuccaggugca

SEQ ID NO: 110932 - RNA, 32 nt, Human
ccguugcccaggacacuggcuggccuuccuuc

SEQ ID NO: 110933 - RNA, 32 nt, Human
ccguugcccaggcuggagggcagugacgugau

SEQ ID NO: 110934 - RNA, 32 nt, Human
ccguugcccaggcuggaguacaauggugcgau

SEQ ID NO: 110935 - RNA, 32 nt, Human
ccguugcccaggcuggagugcgguggcaugau

SEQ ID NO: 110936 - RNA, 32 nt, Human
ccguugcccagguuggagugcaguggcccauc

SEQ ID NO: 110937 - RNA, 32 nt, Human
ccguugcccugagcugcagccucggccccagg

SEQ ID NO: 110938 - RNA, 21 nt, Human
ccguugccgcgcgccugagcc

SEQ ID NO: 110939 - RNA, 32 nt, Human
ccguugccuaggaaggguugggccgcagguuu

SEQ ID NO: 110940 - RNA, 32 nt, Human
ccguugccuguuguucgguugugugacuaauu

SEQ ID NO: 110941 - RNA, 32 nt, Human
ccguugccuuucucugguacuggugucuuacc

SEQ ID NO: 110942 - RNA, 21 nt, Human
ccguugcgcuugcucccgggc

SEQ ID NO: 110943 - RNA, 32 nt, Human
ccguugcguucugcauccaguccuugcugcuc

SEQ ID NO: 110944 - RNA, 32 nt, Human
ccguugcuaagcugucaacauaccaagcuguu

SEQ ID NO: 110945 - RNA, 20 nt, Human
ccguugcuaaugccaggcca

SEQ ID NO: 110946 - RNA, 32 nt, Human
ccguugcugccgucaccgccuccugggucguc

SEQ ID NO: 110947 - RNA, 19 nt, Human
ccguugcuugaccccgggc

SEQ ID NO: 110948 - RNA, 20 nt, Human
ccguugcuuguucugcagcc

SEQ ID NO: 110949 - RNA, 32 nt, Human
ccguugcuuguucugcagcccugucuacuugg

SEQ ID NO: 110950 - RNA, 32 nt, Human
ccguuggagguggcugcggcagcugauguggc

SEQ ID NO: 110951 - RNA, 19 nt, Human
ccguuggcagcagcagcag

SEQ ID NO: 110952 - RNA, 32 nt, Human
ccguuggccauccuggcccucccaggagaagc

SEQ ID NO: 110953 - RNA, 18 nt, Human
ccguuggcucccugagcu

SEQ ID NO: 110954 - RNA, 32 nt, Human
ccguugggagccugagacucaaacauggcagc

SEQ ID NO: 110955 - RNA, 32 nt, Human
ccguugggcccaggcuuccuccccuccaaggu

SEQ ID NO: 110956 - RNA, 32 nt, Human
ccguuggugggagagacaaaaagagggagagu

SEQ ID NO: 110957 - RNA, 32 nt, Human
ccguuguaccaaguggagcaggugguugcggg

SEQ ID NO: 110958 - RNA, 32 nt, Human
ccguugucacugcccccgccucuucagcaaga

SEQ ID NO: 110959 - RNA, 32 nt, Human
ccguugucccagcucaggauggacccucagaa

SEQ ID NO: 110960 - RNA, 32 nt, Human
ccguuguggggaggggcaguguuagagcaggg

SEQ ID NO: 110961 - RNA, 32 nt, Human
ccguuguuuuaccuuccuauuucccaaacagu

SEQ ID NO: 110962 - RNA, 23 nt, Human
ccguuuaaacauuucguccuccu

SEQ ID NO: 110963 - RNA, 32 nt, Human
ccguuuaugaggaaaacugagcaggguggcaa

SEQ ID NO: 110964 - RNA, 32 nt, Human
ccguuucagcacauccauucuguccaucucca

SEQ ID NO: 110965 - RNA, 32 nt, Human
ccguuuccagugagcagaugucuugcuuggaa

SEQ ID NO: 110966 - RNA, 32 nt, Human
ccguuucccacuccucuucaaccgucagcgac

SEQ ID NO: 110967 - RNA, 32 nt, Human
ccguuuccuugggaacuggagugcaguaugag

SEQ ID NO: 110968 - RNA, 32 nt, Human
ccguuucuacucaccuccgccuccaggaagac

SEQ ID NO: 110969 - RNA, 32 nt, Human
ccguuucuaugagagauugaugaacuuuguuu

SEQ ID NO: 110970 - RNA, 32 nt, Human
ccguuucucuccccaucuuggcugcuguccug

SEQ ID NO: 110971 - RNA, 32 nt, Human
ccguuucuuaggugugagaggggcuguggcuu

SEQ ID NO: 110972 - RNA, 31 nt, Human
ccguuugcaaggucucccaauuguggcgggg

SEQ ID NO: 110973 - RNA, 32 nt, Human
ccguuugcaguggcucaagccuguaaugucag

SEQ ID NO: 110974 - RNA, 23 nt, Human
ccguuugccuguccacacccccu

SEQ ID NO: 110975 - RNA, 18 nt, Human
ccguuuggcugcuuagca

SEQ ID NO: 110976 - RNA, 32 nt, Human
ccguuugucgccaggcuggagugcaguggugc

SEQ ID NO: 110977 - RNA, 32 nt, Human
ccguuuucaacacuugugccuugggguguuca

SEQ ID NO: 110978 - RNA, 32 nt, Human
ccguuuucacacugcuauaaagaacuucccug

SEQ ID NO: 110979 - RNA, 32 nt, Human
ccguuuucucacagcccucuggcuuuuccacc

SEQ ID NO: 110980 - RNA, 32 nt, Human
ccguuuucucacuguuggacucuaccucacug

SEQ ID NO: 110981 - RNA, 32 nt, Human
ccguuuucuuccugcaugauccugggcccucc

SEQ ID NO: 110982 - RNA, 32 nt, Human
ccguuuucuuccugccaagccugaaucaaugu

SEQ ID NO: 110983 - RNA, 32 nt, Human
ccguuuucuugccuuuuccagguuggaggaug

SEQ ID NO: 110984 - RNA, 32 nt, Human
ccguuuugcaccaguugccugcagguuggaug

SEQ ID NO: 110985 - RNA, 32 nt, Human
ccguuuuggaaccugcgucuggggcuccaguc

SEQ ID NO: 110986 - RNA, 32 nt, Human
ccguuuuggugccacacugggguggggauggg

SEQ ID NO: 110987 - RNA, 32 nt, Human
ccguuuuucuccuuuccuuucauuccaaaaag

SEQ ID NO: 110988 - RNA, 32 nt, Human
ccuaaaaacagcucuccucuuccacgacaaac

SEQ ID NO: 110989 - RNA, 32 nt, Human
ccuaaaaaccaauuuacaaucugacugucucu

SEQ ID NO: 110990 - RNA, 32 nt, Human
ccuaaaaacuugaggaaggaagaugauagaac

SEQ ID NO: 110991 - RNA, 31 nt, Human
ccuaaaaagagacccuggggcuggguguggu

SEQ ID NO: 110992 - RNA, 32 nt, Human
ccuaaaaagccaccaccacuagugaaacaacc

SEQ ID NO: 110993 - RNA, 23 nt, Human
ccuaaaaaugguuucuuucuccu

SEQ ID NO: 110994 - RNA, 32 nt, Human
ccuaaaacaacagauguacgacuugcauaccu

SEQ ID NO: 110995 - RNA, 32 nt, Human
ccuaaaacugagguggggauggggagagccuu

SEQ ID NO: 110996 - RNA, 32 nt, Human
ccuaaaacugagguggggauggggagaggcuu

SEQ ID NO: 110997 - RNA, 32 nt, Human
ccuaaaagacaauuuuccuuggaacacauaag

SEQ ID NO: 110998 - RNA, 32 nt, Human
ccuaaaauaagggaagagaguugcuucuacuc

SEQ ID NO: 110999 - RNA, 32 nt, Human
ccuaaaaucccagcuacucgggagacuaggca

SEQ ID NO: 111000 - RNA, 32 nt, Human
ccuaaaaucccagcuacuugagagacugaggc

SEQ ID NO: 111001 - RNA, 32 nt, Human
ccuaaaauguacaauguaacuuguucagucca

SEQ ID NO: 111002 - RNA, 32 nt, Human
ccuaaaauguuaacugggcaugguggcucaug

SEQ ID NO: 111003 - RNA, 32 nt, Human
ccuaaaauuccuuccaguucaaaggcagauaa

SEQ ID NO: 111004 - RNA, 32 nt, Human
ccuaaacaaccgagcaagacaagccacuccga

SEQ ID NO: 111005 - RNA, 32 nt, Human
ccuaaacacagcauggcaacucaucuacucac

SEQ ID NO: 111006 - RNA, 32 nt, Human
ccuaaacacagcugccuccaaggaccgcugcc

SEQ ID NO: 111007 - RNA, 32 nt, Human
ccuaaacacccacccaaugggagaggcugaua

SEQ ID NO: 111008 - RNA, 23 nt, Human
ccuaaacaggguggggggcgcgg

SEQ ID NO: 111009 - RNA, 32 nt, Human
ccuaaacaggugugaauauauguaaguugaaa

SEQ ID NO: 111010 - RNA, 32 nt, Human
ccuaaaccaaaaacugaaagugaaaguccaga

SEQ ID NO: 111011 - RNA, 32 nt, Human
ccuaaaccagccugggcaacauagugauaccu

SEQ ID NO: 111012 - RNA, 18 nt, Human
ccuaaacccucugugaaa

SEQ ID NO: 111013 - RNA, 32 nt, Human
ccuaaaccggaagaggaugacaccggccaugg

SEQ ID NO: 111014 - RNA, 32 nt, Human
ccuaaaccuacugccacuuaggugcaugcaag

SEQ ID NO: 111015 - RNA, 32 nt, Human
ccuaaacggugacucucauucuuuaacaggau

SEQ ID NO: 111016 - RNA, 32 nt, Human
ccuaaacuacgguaaugagaucagccccuuaa

SEQ ID NO: 111017 - RNA, 32 nt, Human
ccuaaacuagcgggcaccacagaccagcugca

SEQ ID NO: 111018 - RNA, 32 nt, Human
ccuaaacuaggguuugcacagcccccuuucug

SEQ ID NO: 111019 - RNA, 32 nt, Human
ccuaaacucucaucuccuguggcccaacaugg

SEQ ID NO: 111020 - RNA, 32 nt, Human
ccuaaacugagcugaauguuuguuucagugcc

SEQ ID NO: 111021 - RNA, 15 nt, Human
ccuaaacugauccua

SEQ ID NO: 111022 - RNA, 32 nt, Human
ccuaaacuggugcucacaccuuacucaacauu

SEQ ID NO: 111023 - RNA, 32 nt, Human
ccuaaacugugccauuuauaagaucucugaca

SEQ ID NO: 111024 - RNA, 32 nt, Human
ccuaaacugugccauuugaacagucacuucca

SEQ ID NO: 111025 - RNA, 32 nt, Human
ccuaaacuuaucugggaaggcuggggaaguag

SEQ ID NO: 111026 - RNA, 32 nt, Human
ccuaaacuugcacucugcuccaucucagccaa

SEQ ID NO: 111027 - RNA, 32 nt, Human
ccuaaacuuuauuauugcacacugccugaaca

SEQ ID NO: 111028 - RNA, 32 nt, Human
ccuaaagaagcuucucucaccaaauaaugaaa

SEQ ID NO: 111029 - RNA, 32 nt, Human
ccuaaagagggagccuguggguucucagagag

SEQ ID NO: 111030 - RNA, 32 nt, Human
ccuaaagauaaauaauaucaaaauagugucau

SEQ ID NO: 111031 - RNA, 32 nt, Human
ccuaaagaucccuggcauuggccagggauccu

SEQ ID NO: 111032 - RNA, 18 nt, Human
ccuaaagcaggaggccag

SEQ ID NO: 111033 - RNA, 32 nt, Human
ccuaaagccagcauuuccucagucucccuuug

SEQ ID NO: 111034 - RNA, 32 nt, Human
ccuaaagccuccaugcuggagagaccaugugg

SEQ ID NO: 111035 - RNA, 19 nt, Human
ccuaaaggaagcccucugg

SEQ ID NO: 111036 - RNA, 18 nt, Human
ccuaaaggagaacauggg

SEQ ID NO: 111037 - RNA, 23 nt, Human
ccuaaaggaggcauuucuucccc

SEQ ID NO: 111038 - RNA, 32 nt, Human
ccuaaaggagucaguggggaacuccacgcgca

SEQ ID NO: 111039 - RNA, 32 nt, Human
ccuaaaggauccucuggaagcuguauuucuug

SEQ ID NO: 111040 - RNA, 32 nt, Human
ccuaaaggccacacccuccccacgcacuuccc

SEQ ID NO: 111041 - RNA, 32 nt, Human
ccuaaaggcugcaggcugccaggugugcuugg

SEQ ID NO: 111042 - RNA, 32 nt, Human
ccuaaaggguugaaguacaaucaagcuacaca

SEQ ID NO: 111043 - RNA, 23 nt, Human
ccuaaagucccagcuacuuggga

SEQ ID NO: 111044 - RNA, 32 nt, Human
ccuaaagucccagcuacuugggagguugaggc

SEQ ID NO: 111045 - RNA, 24 nt, Human
ccuaaagugcuaggauuacaggca

SEQ ID NO: 111046 - RNA, 24 nt, Human
ccuaaagugcugggauuacaggca

SEQ ID NO: 111047 - RNA, 32 nt, Human
ccuaaaguuuacuucauugucuugaggcuucc

SEQ ID NO: 111048 - RNA, 32 nt, Human
ccuaaauagaggguaaagugagccuagccagg

SEQ ID NO: 111049 - RNA, 32 nt, Human
ccuaaaucacaauauggccuugguaugguuuu

SEQ ID NO: 111050 - RNA, 32 nt, Human
ccuaaaucauuucccaaucuauucuaauuacc

SEQ ID NO: 111051 - RNA, 32 nt, Human
ccuaaaucauuuccccucccucccucccuccc

SEQ ID NO: 111052 - RNA, 32 nt, Human
ccuaaaucucccccacugacuguuucuccccg

SEQ ID NO: 111053 - RNA, 32 nt, Human
ccuaaaugcgaagccgggugacccuggacuuc

SEQ ID NO: 111054 - RNA, 32 nt, Human
ccuaaaugcuacuguuccaaagagcaacuuga

SEQ ID NO: 111055 - RNA, 32 nt, Human
ccuaaaugcuccuccagcaucuguuucucccu

SEQ ID NO: 111056 - RNA, 30 nt, Human
ccuaaauggcucucuggacaaugugcauga

SEQ ID NO: 111057 - RNA, 32 nt, Human
ccuaaauguggacaucaugaagcaucaaagca

SEQ ID NO: 111058 - RNA, 32 nt, Human
ccuaaauguuagcuucuccauccucaccacau

SEQ ID NO: 111059 - RNA, 32 nt, Human
ccuaaauguuggaagcacaaaaugguugugau

SEQ ID NO: 111060 - RNA, 32 nt, Human
ccuaaauuaaggcuuaaagaaugagcauggcc

SEQ ID NO: 111061 - RNA, 32 nt, Human
ccuaaauucagucagacauuuuggauuaagaa

SEQ ID NO: 111062 - RNA, 32 nt, Human
ccuaaauuccaggaaucuuccccaaaucccag

SEQ ID NO: 111063 - RNA, 32 nt, Human
ccuaaauuuucaggacccuagaggagggcuuu

SEQ ID NO: 111064 - RNA, 32 nt, Human
ccuaacacccacccucucccccuucagccaug

SEQ ID NO: 111065 - RNA, 19 nt, Human
ccuaacacugggcugcaga

SEQ ID NO: 111066 - RNA, 32 nt, Human
ccuaacagacacaaauccuuccucaaucaaua

SEQ ID NO: 111067 - RNA, 32 nt, Human
ccuaacagcaacaacaaagacagacuuuccgu

SEQ ID NO: 111068 - RNA, 32 nt, Human
ccuaacagccucccucuccuccuccuucccca

SEQ ID NO: 111069 - RNA, 30 nt, Human
ccuaacagccucucggugcugaugugaaau

SEQ ID NO: 111070 - RNA, 32 nt, Human
ccuaacagcucuguucccuccugcuuugguuu

SEQ ID NO: 111071 - RNA, 24 nt, Human
ccuaacagggcuggagguccaggc

SEQ ID NO: 111072 - RNA, 32 nt, Human
ccuaacaguugcagauaugagcuguauaauug

SEQ ID NO: 111073 - RNA, 23 nt, Human
ccuaacaguuuuuuaguggauuc

SEQ ID NO: 111074 - RNA, 32 nt, Human
ccuaacauaugcauuggucaagguugcagcaa

SEQ ID NO: 111075 - RNA, 23 nt, Human
ccuaacauccaggaaacaaauga

SEQ ID NO: 111076 - RNA, 32 nt, Human
ccuaacauccaguaauggggaccuggaaccug

SEQ ID NO: 111077 - RNA, 32 nt, Human
ccuaacauggaguuaacuggaauagcaguaca

SEQ ID NO: 111078 - RNA, 31 nt, Human
ccuaaccagagagaggggcgugggagggaga

SEQ ID NO: 111079 - RNA, 32 nt, Human
ccuaaccagccacugcagcccuccagcucugg

SEQ ID NO: 111080 - RNA, 32 nt, Human
ccuaaccagcuauuggugggaaugacggaacu

SEQ ID NO: 111081 - RNA, 32 nt, Human
ccuaaccaggaucaggcaggagggcagggaug

SEQ ID NO: 111082 - RNA, 32 nt, Human
ccuaacccuacccagccugcugccucagcaca

SEQ ID NO: 111083 - RNA, 32 nt, Human
ccuaacccuacccucacuuucguccccgcucu

SEQ ID NO: 111084 - RNA, 32 nt, Human
ccuaacccugguguaguuucuuucaagaguga

SEQ ID NO: 111085 - RNA, 32 nt, Human
ccuaacccuucccaccaggguagcuuugggca

SEQ ID NO: 111086 - RNA, 32 nt, Human
ccuaacccuucccacucugucaccuucucgau

SEQ ID NO: 111087 - RNA, 32 nt, Human
ccuaaccuaagcugcuuccuggaaagcuucau

SEQ ID NO: 111088 - RNA, 23 nt, Human
ccuaaccucaaagggucguggug

SEQ ID NO: 111089 - RNA, 21 nt, Human
ccuaaccugggagacggaaga

SEQ ID NO: 111090 - RNA, 32 nt, Human
ccuaacguauccccuguugucuugcuucuucu

SEQ ID NO: 111091 - RNA, 32 nt, Human
ccuaacguucuucuugaauaacuaauacagug

SEQ ID NO: 111092 - RNA, 32 nt, Human
ccuaacuacagggagugcuggggaagugugau

SEQ ID NO: 111093 - RNA, 32 nt, Human
ccuaacucagcuuuauuugacauggaaccuaa

SEQ ID NO: 111094 - RNA, 32 nt, Human
ccuaacuccaaagccugcguucucaucccagu

SEQ ID NO: 111095 - RNA, 32 nt, Human
ccuaacugcaugcagauguggaaaggggcuga

SEQ ID NO: 111096 - RNA, 32 nt, Human
ccuaacugcggcggaaacgugggagccgcgcg

SEQ ID NO: 111097 - RNA, 32 nt, Human
ccuaacugcuuagcccagccugacugaucccc

SEQ ID NO: 111098 - RNA, 32 nt, Human
ccuaacuuaauagguagaaagacugaaaaccu

SEQ ID NO: 111099 - RNA, 32 nt, Human
ccuaacuuucgggcagccucagggggcccccg

SEQ ID NO: 111100 - RNA, 20 nt, Human
ccuaagaaacuucugccucc

SEQ ID NO: 111101 - RNA, 32 nt, Human
ccuaagaaaugccagaacaaccaccuuauuuc

SEQ ID NO: 111102 - RNA, 32 nt, Human
ccuaagaacagguuugcagcuacccucucuga

SEQ ID NO: 111103 - RNA, 32 nt, Human
ccuaagaagucacaugaacauauuucacauuu

SEQ ID NO: 111104 - RNA, 21 nt, Human
ccuaagaaguucaucccuccu

SEQ ID NO: 111105 - RNA, 32 nt, Human
ccuaagaccacuccugaauugucuccucuccc

SEQ ID NO: 111106 - RNA, 17 nt, Human
ccuaagacugucacuca

SEQ ID NO: 111107 - RNA, 32 nt, Human
ccuaagacuucucuuuugcacaucuagugagg

SEQ ID NO: 111108 - RNA, 32 nt, Human
ccuaagagccuucaugcacaccccugaaccac

SEQ ID NO: 111109 - RNA, 32 nt, Human
ccuaagaggaagagaaggagagccaggcaugg

SEQ ID NO: 111110 - RNA, 32 nt, Human
ccuaagaggcagcauggugugguagaaagaac

SEQ ID NO: 111111 - RNA, 32 nt, Human
ccuaagaggcgacuuccucuccagccuucucu

SEQ ID NO: 111112 - RNA, 32 nt, Human
ccuaagaguggaggaggaggaggagccuugcu

SEQ ID NO: 111113 - RNA, 32 nt, Human
ccuaagaguggcugccccugcuugggacauua

SEQ ID NO: 111114 - RNA, 32 nt, Human
ccuaagaguuaccacuuccguagccuauaaca

SEQ ID NO: 111115 - RNA, 32 nt, Human
ccuaagauauugagacaggcuggaguccagag

SEQ ID NO: 111116 - RNA, 32 nt, Human
ccuaagaucagcuagacucucugccuuguuuc

SEQ ID NO: 111117 - RNA, 32 nt, Human
ccuaagaucuucaccucucugccucccuacug

SEQ ID NO: 111118 - RNA, 32 nt, Human
ccuaagaugggcaguuuguucuuaaggccaug

SEQ ID NO: 111119 - RNA, 32 nt, Human
ccuaagcagggugggggcagagccaugacauu

SEQ ID NO: 111120 - RNA, 32 nt, Human
ccuaagcagucgcggcugcagugaacaagauc

SEQ ID NO: 111121 - RNA, 32 nt, Human
ccuaagcaugcuuuauuuuuccuugaaagcua

SEQ ID NO: 111122 - RNA, 32 nt, Human
ccuaagccagccucucccuccugacagugccc

SEQ ID NO: 111123 - RNA, 32 nt, Human
ccuaagccccaggaggucgaggcugcagugag

SEQ ID NO: 111124 - RNA, 32 nt, Human
ccuaagccccauccuuuguucuccugcuauga

SEQ ID NO: 111125 - RNA, 32 nt, Human
ccuaagccccaucguagcacaguauuacaugu

SEQ ID NO: 111126 - RNA, 32 nt, Human
ccuaagccccuggcugggcgugguggcgagca

SEQ ID NO: 111127 - RNA, 32 nt, Human
ccuaagcccuaaggagcuccucagcuugaaau

SEQ ID NO: 111128 - RNA, 32 nt, Human
ccuaagcccugacagcauguuucauuucaaca

SEQ ID NO: 111129 - RNA, 32 nt, Human
ccuaagcccugcgaggucuuguggaaccgaca

SEQ ID NO: 111130 - RNA, 32 nt, Human
ccuaagccucuucuccaugugugcacacaggg

SEQ ID NO: 111131 - RNA, 32 nt, Human
ccuaagccuggcccuauccacagggucccugg

SEQ ID NO: 111132 - RNA, 32 nt, Human
ccuaagcgucaucgucauugccauagcaucau

SEQ ID NO: 111133 - RNA, 32 nt, Human
ccuaagcuaucucucaugguuccuauguuuuu

SEQ ID NO: 111134 - RNA, 32 nt, Human
ccuaagcuccgacacuugcuccagaaauagcu

SEQ ID NO: 111135 - RNA, 32 nt, Human
ccuaagcuccuucuuucauucugccauuccuc

SEQ ID NO: 111136 - RNA, 32 nt, Human
ccuaagcucugaccgcuaggcuuucaccccag

SEQ ID NO: 111137 - RNA, 32 nt, Human
ccuaagcugcgccuccugucauuucccugcug

SEQ ID NO: 111138 - RNA, 20 nt, Human
ccuaagcuggagugcagugg

SEQ ID NO: 111139 - RNA, 32 nt, Human
ccuaagcuggucucaaacuccugggcucaagc

SEQ ID NO: 111140 - RNA, 32 nt, Human
ccuaagcuucugauauauaaacauacccgugu

SEQ ID NO: 111141 - RNA, 32 nt, Human
ccuaaggaacuaaauaucauauaguuaauguu

SEQ ID NO: 111142 - RNA, 32 nt, Human
ccuaaggaagaugauuccucugcuaguaccuc

SEQ ID NO: 111143 - RNA, 31 nt, Human
ccuaaggacaaaggaacucuccauuuagaaa

SEQ ID NO: 111144 - RNA, 32 nt, Human
ccuaaggacgagccccagacuggaggagaggu

SEQ ID NO: 111145 - RNA, 32 nt, Human
ccuaaggacuccugccagaccacacagcccac

SEQ ID NO: 111146 - RNA, 18 nt, Human
ccuaaggagggggcgggg

SEQ ID NO: 111147 - RNA, 32 nt, Human
ccuaaggauggagcccaaaauugcagagcagu

SEQ ID NO: 111148 - RNA, 32 nt, Human
ccuaaggcauguugggauagggucagaugcac

SEQ ID NO: 111149 - RNA, 32 nt, Human
ccuaaggcccuccacaguugcauugaaaaugu

SEQ ID NO: 111150 - RNA, 25 nt, Human
ccuaagggaccacacccuuccuccu

SEQ ID NO: 111151 - RNA, 32 nt, Human
ccuaagggacugugagacugagagggcucacg

SEQ ID NO: 111152 - RNA, 32 nt, Human
ccuaagggagagaucaaguugagacagagaag

SEQ ID NO: 111153 - RNA, 27 nt, Human
ccuaagggcaggagcaagccccucaca

SEQ ID NO: 111154 - RNA, 32 nt, Human
ccuaaggggccccagccaaggagcugagcgag

SEQ ID NO: 111155 - RNA, 32 nt, Human
ccuaaggguaagagggaggccacugaggucuc

SEQ ID NO: 111156 - RNA, 32 nt, Human
ccuaaggucaccaagaauaucagggcugugga

SEQ ID NO: 111157 - RNA, 20 nt, Human
ccuaaggucacccccuuccc

SEQ ID NO: 111158 - RNA, 32 nt, Human
ccuaagguccuccucagcuucuagaccuagaa

SEQ ID NO: 111159 - RNA, 32 nt, Human
ccuaaggugaagccacacuagggugaagccuc

SEQ ID NO: 111160 - RNA, 32 nt, Human
ccuaaguaacacuuugggaggcuggggcgaga

SEQ ID NO: 111161 - RNA, 23 nt, Human
ccuaaguagcugggauuacaggc

SEQ ID NO: 111162 - RNA, 24 nt, Human
ccuaaguagcugggauuacaggcg

SEQ ID NO: 111163 - RNA, 32 nt, Human
ccuaaguagcugguuuuauaaggcggccagga

SEQ ID NO: 111164 - RNA, 32 nt, Human
ccuaaguaucaacuuagccguacuuugaacuc

SEQ ID NO: 111165 - RNA, 32 nt, Human
ccuaaguauguggagcucugcuuuggcacugc

SEQ ID NO: 111166 - RNA, 23 nt, Human
ccuaagucacaaaaugagggaag

SEQ ID NO: 111167 - RNA, 32 nt, Human
ccuaagucacugaggcuggaguacaguggcau

SEQ ID NO: 111168 - RNA, 32 nt, Human
ccuaaguccacacauagccccuggcucuggca

SEQ ID NO: 111169 - RNA, 32 nt, Human
ccuaaguccagaccccaugagcucucagccag

SEQ ID NO: 111170 - RNA, 32 nt, Human
ccuaaguccuucaucauaccacugcccuccaa

SEQ ID NO: 111171 - RNA, 32 nt, Human
ccuaagucuucuuccuccugugcugaccucag

SEQ ID NO: 111172 - RNA, 18 nt, Human
ccuaagugauguucacag

SEQ ID NO: 111173 - RNA, 21 nt, Human
ccuaagugcugggauuauagg

SEQ ID NO: 111174 - RNA, 21 nt, Human
ccuaagugcugggauugcagg

SEQ ID NO: 111175 - RNA, 24 nt, Human
ccuaagugcugggauugcaggcgu

SEQ ID NO: 111176 - RNA, 32 nt, Human
ccuaagugggcugggagccaggcagggccagg

SEQ ID NO: 111177 - RNA, 32 nt, Human
ccuaaguggguggaucacgugaggucaagagu

SEQ ID NO: 111178 - RNA, 32 nt, Human
ccuaagugguuaugaagcaaaugcauuuaugg

SEQ ID NO: 111179 - RNA, 32 nt, Human
ccuaaguuccucacuccuucuguggucaaugu

SEQ ID NO: 111180 - RNA, 22 nt, Human
ccuaaguugcugggauuacagg

SEQ ID NO: 111181 - RNA, 32 nt, Human
ccuaauaagaagcaugcuaaagccacagcagc

SEQ ID NO: 111182 - RNA, 32 nt, Human
ccuaauaagccuuuuggaugcuaaucuggauu

SEQ ID NO: 111183 - RNA, 32 nt, Human
ccuaauaaucauuggauucugagagcugugca

SEQ ID NO: 111184 - RNA, 32 nt, Human
ccuaauacaaauauuucugauaagacuacaaa

SEQ ID NO: 111185 - RNA, 32 nt, Human
ccuaauacagaauuguagagcuggagaguacc

SEQ ID NO: 111186 - RNA, 32 nt, Human
ccuaauacagcuuccauccugucacuuuugau

SEQ ID NO: 111187 - RNA, 32 nt, Human
ccuaauacccacccuuccucacgaccucauuu

SEQ ID NO: 111188 - RNA, 32 nt, Human
ccuaauaggaaggcagaucucagcgauaaaca

SEQ ID NO: 111189 - RNA, 32 nt, Human
ccuaauaggugaugcagauaauagccuacuuc

SEQ ID NO: 111190 - RNA, 32 nt, Human
ccuaauauuuugaggagcucuguuuugaggac

SEQ ID NO: 111191 - RNA, 32 nt, Human
ccuaaucacccguuuaacaagcagaaauuaaa

SEQ ID NO: 111192 - RNA, 32 nt, Human
ccuaaucacggaucugcugccucccagcuguc

SEQ ID NO: 111193 - RNA, 22 nt, Human
ccuaaucacuccaacccugccc

SEQ ID NO: 111194 - RNA, 19 nt, Human
ccuaaucaggaggggacag

SEQ ID NO: 111195 - RNA, 18 nt, Human
ccuaauccaccugggaca

SEQ ID NO: 111196 - RNA, 32 nt, Human
ccuaauccccucccaaaggccccacuucccca

SEQ ID NO: 111197 - RNA, 32 nt, Human
ccuaaucccugagagccugcccacuguccaga

SEQ ID NO: 111198 - RNA, 32 nt, Human
ccuaaucuacauauuuguauauuucuaaggua

SEQ ID NO: 111199 - RNA, 32 nt, Human
ccuaaucugaaauccaaaaugcucuaaaauuc

SEQ ID NO: 111200 - RNA, 32 nt, Human
ccuaaucugauacuggagucuaaauacaugcu

SEQ ID NO: 111201 - RNA, 32 nt, Human
ccuaaucugguucuacuaccauaauguauaug

SEQ ID NO: 111202 - RNA, 32 nt, Human
ccuaaucuuagccacuuauccccagugacuac

SEQ ID NO: 111203 - RNA, 32 nt, Human
ccuaaugaaggagccaggcuugcacacagaca

SEQ ID NO: 111204 - RNA, 32 nt, Human
ccuaaugaccugaugggggcugcucugauccc

SEQ ID NO: 111205 - RNA, 32 nt, Human
ccuaaugauacagauuuuggacccuaucccag

SEQ ID NO: 111206 - RNA, 32 nt, Human
ccuaaugaucccucgcagagcucagacuaagu

SEQ ID NO: 111207 - RNA, 29 nt, Human
ccuaaugaugacgcuuguccccagagcca

SEQ ID NO: 111208 - RNA, 32 nt, Human
ccuaaugcaucacugugacaaaagccacacgc

SEQ ID NO: 111209 - RNA, 32 nt, Human
ccuaaugcuaguuucauucauccaucaggguu

SEQ ID NO: 111210 - RNA, 32 nt, Human
ccuaaugcucagaacauggaugagaugauaaa

SEQ ID NO: 111211 - RNA, 18 nt, Human
ccuaaugcucucccuccc

SEQ ID NO: 111212 - RNA, 32 nt, Human
ccuaauggcucugccacuuacuagcugguuug

SEQ ID NO: 111213 - RNA, 24 nt, Human
ccuaaugggagcaaaagguuugaa

SEQ ID NO: 111214 - RNA, 20 nt, Human
ccuaaugucuccuccuuccc

SEQ ID NO: 111215 - RNA, 32 nt, Human
ccuaaugugccuggaaaccauggguagcuacc

SEQ ID NO: 111216 - RNA, 32 nt, Human
ccuaauuaauaccuagauaagacuucauuuga

SEQ ID NO: 111217 - RNA, 32 nt, Human
ccuaauucaaagauggcucaugugugagggca

SEQ ID NO: 111218 - RNA, 32 nt, Human
ccuaauucaucucuccagcaaaggacacaucu

SEQ ID NO: 111219 - RNA, 32 nt, Human
ccuaauuccucuuccuucuccaaaccacaggg

SEQ ID NO: 111220 - RNA, 32 nt, Human
ccuaauucgcaaccacacagaauuucauggcu

SEQ ID NO: 111221 - RNA, 32 nt, Human
ccuaauucuaugacaguguacauauaugaaaa

SEQ ID NO: 111222 - RNA, 32 nt, Human
ccuaauucuuguagaugcauuaguguugaacc

SEQ ID NO: 111223 - RNA, 32 nt, Human
ccuaauucuuugaaggcaaccagugcaaaggc

SEQ ID NO: 111224 - RNA, 32 nt, Human
ccuaauuucaaaacaucaccuugccacccuga

SEQ ID NO: 111225 - RNA, 32 nt, Human
ccuaauuucccuucuugcauccuuccuauaac

SEQ ID NO: 111226 - RNA, 32 nt, Human
ccuaauuucuguauuuuuaguagagauggggu

SEQ ID NO: 111227 - RNA, 32 nt, Human
ccuaauuuuacaucuucagcaucauugcauua

SEQ ID NO: 111228 - RNA, 32 nt, Human
ccuaauuuucauuguuaaaacuccuuucagac

SEQ ID NO: 111229 - RNA, 32 nt, Human
ccuaauuuuccagagaagccuauuuuuauauu

SEQ ID NO: 111230 - RNA, 32 nt, Human
ccuaauuuuccccuucuguauaaugggaguuc

SEQ ID NO: 111231 - RNA, 32 nt, Human
ccuacaaaaaguacaaaaauuagccgggugug

SEQ ID NO: 111232 - RNA, 20 nt, Human
ccuacaaaagaauuccagca

SEQ ID NO: 111233 - RNA, 23 nt, Human
ccuacaacacuaaauaaaauggu

SEQ ID NO: 111234 - RNA, 32 nt, Human
ccuacaaccugcccgucccccugcugcaggga

SEQ ID NO: 111235 - RNA, 32 nt, Human
ccuacaagaaugcucuuugucuuccacagcca

SEQ ID NO: 111236 - RNA, 22 nt, Human
ccuacaagacgcugcccagcca

SEQ ID NO: 111237 - RNA, 32 nt, Human
ccuacaagagcagccuguggcaucuuugccuu

SEQ ID NO: 111238 - RNA, 32 nt, Human
ccuacaagagccuucauccaggagcauccaca

SEQ ID NO: 111239 - RNA, 32 nt, Human
ccuacaagaguugugguuuuccaucugauccu

SEQ ID NO: 111240 - RNA, 32 nt, Human
ccuacaagcaccuaucauugggcuugucacac

SEQ ID NO: 111241 - RNA, 32 nt, Human
ccuacaagcugcaugcugcauacacaagucau

SEQ ID NO: 111242 - RNA, 22 nt, Human
ccuacaaggcccaucgccacca

SEQ ID NO: 111243 - RNA, 32 nt, Human
ccuacaaguuugagaagguaagaaaagaugaa

SEQ ID NO: 111244 - RNA, 32 nt, Human
ccuacaaucucagcccacaaguccucuccacc

SEQ ID NO: 111245 - RNA, 31 nt, Human
ccuacaauggccacugcucagcuuucucacu

SEQ ID NO: 111246 - RNA, 32 nt, Human
ccuacaauguacugacaguucuuacaguugag

SEQ ID NO: 111247 - RNA, 32 nt, Human
ccuacacaaauacaaaauaauuggggaagggc

SEQ ID NO: 111248 - RNA, 32 nt, Human
ccuacacacaugcacacacguguacaccacaa

SEQ ID NO: 111249 - RNA, 32 nt, Human
ccuacacauuccagacauuuuccuuuuugagc

SEQ ID NO: 111250 - RNA, 32 nt, Human
ccuacaccaagagaugcagucagcaucuuaaa

SEQ ID NO: 111251 - RNA, 27 nt, Human
ccuacaccaaucagaagcucagugccc

SEQ ID NO: 111252 - RNA, 32 nt, Human
ccuacaccagagagccauuuugguauuuugcc

SEQ ID NO: 111253 - RNA, 32 nt, Human
ccuacaccagagagcuauuuugguauuuugcc

SEQ ID NO: 111254 - RNA, 17 nt, Human
ccuacaccauccauuug

SEQ ID NO: 111255 - RNA, 32 nt, Human
ccuacacccaaaggcucccauggagagcucag

SEQ ID NO: 111256 - RNA, 32 nt, Human
ccuacacccaggcuggugccucaggccucccc

SEQ ID NO: 111257 - RNA, 17 nt, Human
ccuacacccggcgccag

SEQ ID NO: 111258 - RNA, 32 nt, Human
ccuacacccugaggucuauucacugcauccca

SEQ ID NO: 111259 - RNA, 32 nt, Human
ccuacaccgcccaggccagaguaggguggagc

SEQ ID NO: 111260 - RNA, 32 nt, Human
ccuacaccuccaccuccuuccccuucucccuc

SEQ ID NO: 111261 - RNA, 22 nt, Human
ccuacaccucuucucccuucuc

SEQ ID NO: 111262 - RNA, 32 nt, Human
ccuacacgaucucauuucuuccuuaccacauc

SEQ ID NO: 111263 - RNA, 32 nt, Human
ccuacacuacugauacaaaugguguuaacugg

SEQ ID NO: 111264 - RNA, 21 nt, Human
ccuacacuccuccccaccuca

SEQ ID NO: 111265 - RNA, 32 nt, Human
ccuacacucuagacgaggcuuauccaacccac

SEQ ID NO: 111266 - RNA, 32 nt, Human
ccuacacuggaaggagcgcucucacuguggaa

SEQ ID NO: 111267 - RNA, 32 nt, Human
ccuacacuuccacuccauagguaaauaaacug

SEQ ID NO: 111268 - RNA, 26 nt, Human
ccuacagaguagcugggaauacaagu

SEQ ID NO: 111269 - RNA, 32 nt, Human
ccuacagagucagaggaggccugagauuucga

SEQ ID NO: 111270 - RNA, 32 nt, Human
ccuacagcaacuuggaaugaguaagaagcagu

SEQ ID NO: 111271 - RNA, 32 nt, Human
ccuacagcaaucggucaguugugggagugcuu

SEQ ID NO: 111272 - RNA, 32 nt, Human
ccuacagcacagauuaugcccugcccacuuca

SEQ ID NO: 111273 - RNA, 32 nt, Human
ccuacagcagagccagagcuccgggcccgggc

SEQ ID NO: 111274 - RNA, 21 nt, Human
ccuacagcagaggccaugcag

SEQ ID NO: 111275 - RNA, 32 nt, Human
ccuacagcagggaaguugacucauccaagcau

SEQ ID NO: 111276 - RNA, 23 nt, Human
ccuacagcagggucagcaagaca

SEQ ID NO: 111277 - RNA, 32 nt, Human
ccuacagcaucagguacacagcuucuccuagc

SEQ ID NO: 111278 - RNA, 32 nt, Human
ccuacagcccacccccucccacagcccaccuc

SEQ ID NO: 111279 - RNA, 32 nt, Human
ccuacagccuacagggggcagggcuuucagca

SEQ ID NO: 111280 - RNA, 32 nt, Human
ccuacagccucaggaaggaggugguggcauag

SEQ ID NO: 111281 - RNA, 32 nt, Human
ccuacagccuggacagggucucugcuguacug

SEQ ID NO: 111282 - RNA, 32 nt, Human
ccuacagccuucuuuccugugugucuguuaac

SEQ ID NO: 111283 - RNA, 32 nt, Human
ccuacagcucuuucucagcguuggaguggaga

SEQ ID NO: 111284 - RNA, 25 nt, Human
ccuacagcuuuccccugccaucccu

SEQ ID NO: 111285 - RNA, 31 nt, Human
ccuacaggacuucucuuuagucagggcaugc

SEQ ID NO: 111286 - RNA, 32 nt, Human
ccuacaggaggaagaauggcugcaggguggcu

SEQ ID NO: 111287 - RNA, 32 nt, Human
ccuacaggagugaagccaccacacagauggaa

SEQ ID NO: 111288 - RNA, 32 nt, Human
ccuacaggcaaaguguccuggcauuuaaaacc

SEQ ID NO: 111289 - RNA, 32 nt, Human
ccuacaggccagaaagaucaaccucugugaag

SEQ ID NO: 111290 - RNA, 32 nt, Human
ccuacaggcuggcccugcaauggggcccugag

SEQ ID NO: 111291 - RNA, 32 nt, Human
ccuacagggcugggccucuucugccucuuaag

SEQ ID NO: 111292 - RNA, 32 nt, Human
ccuacaggguucaccaggauguaagaggagag

SEQ ID NO: 111293 - RNA, 32 nt, Human
ccuacagugcucucccucccugggcagauugg

SEQ ID NO: 111294 - RNA, 32 nt, Human
ccuacaguggagcugggcacagcaacuggauc

SEQ ID NO: 111295 - RNA, 21 nt, Human
ccuacaguuccaagagacaga

SEQ ID NO: 111296 - RNA, 32 nt, Human
ccuacaguuugagaggagagccuccagcuguc

SEQ ID NO: 111297 - RNA, 32 nt, Human
ccuacauagauuuccauuucucucuucagccu

SEQ ID NO: 111298 - RNA, 32 nt, Human
ccuacauaguuaccuuuugaucuuaaggaacu

SEQ ID NO: 111299 - RNA, 32 nt, Human
ccuacauccauggcugucacauggcaucagug

SEQ ID NO: 111300 - RNA, 21 nt, Human
ccuacauccuaccugccuccc

SEQ ID NO: 111301 - RNA, 32 nt, Human
ccuacauccucagccccucugccaccaccuua

SEQ ID NO: 111302 - RNA, 20 nt, Human
ccuacauccuccuccuuccc

SEQ ID NO: 111303 - RNA, 32 nt, Human
ccuacauccugggcuccugaagaagcugucuu

SEQ ID NO: 111304 - RNA, 32 nt, Human
ccuacaucuccccucagccucuccucacuaug

SEQ ID NO: 111305 - RNA, 32 nt, Human
ccuacaucuguuuugcugaaucuccuaguaaa

SEQ ID NO: 111306 - RNA, 32 nt, Human
ccuacaucuuucucccaugcuggacgcugccu

SEQ ID NO: 111307 - RNA, 32 nt, Human
ccuacaucuuugucccgugcgggaugcuuccu

SEQ ID NO: 111308 - RNA, 32 nt, Human
ccuacaugcccccucccuucacagggguacag

SEQ ID NO: 111309 - RNA, 32 nt, Human
ccuacaugccuguagcccuuucucacuccauc

SEQ ID NO: 111310 - RNA, 32 nt, Human
ccuacauuacacacacucagguugagucauuc

SEQ ID NO: 111311 - RNA, 32 nt, Human
ccuacauugagcuccaaucugcucgggguggg

SEQ ID NO: 111312 - RNA, 20 nt, Human
ccuacauugugugccaggua

SEQ ID NO: 111313 - RNA, 32 nt, Human
ccuacauuuaaauauuauucucuuucauugua

SEQ ID NO: 111314 - RNA, 19 nt, Human
ccuacauuuccguggcucc

SEQ ID NO: 111315 - RNA, 32 nt, Human
ccuacauuuggcauugcagccuagccaaaaag

SEQ ID NO: 111316 - RNA, 32 nt, Human
ccuacauuuuuccuuccucccuuccuucccuu

SEQ ID NO: 111317 - RNA, 21 nt, Human
ccuaccaaaauaccugggaua

SEQ ID NO: 111318 - RNA, 32 nt, Human
ccuaccaaagugcugggauuacaggcgugaac

SEQ ID NO: 111319 - RNA, 32 nt, Human
ccuaccaaagugcugggauuacaggcgugagc

SEQ ID NO: 111320 - RNA, 31 nt, Human
ccuaccaacaacauacagggaagagauacag

SEQ ID NO: 111321 - RNA, 32 nt, Human
ccuaccaaguagcugggauuacaggagugcac

SEQ ID NO: 111322 - RNA, 32 nt, Human
ccuaccaaguagcugggauuacaggugugugg

SEQ ID NO: 111323 - RNA, 32 nt, Human
ccuaccacacgcagaucagcacuugcuaaucu

SEQ ID NO: 111324 - RNA, 24 nt, Human
ccuaccacaggauuguucuguuua

SEQ ID NO: 111325 - RNA, 32 nt, Human
ccuaccacaggugagagacagauugaaagaca

SEQ ID NO: 111326 - RNA, 32 nt, Human
ccuaccacccaccuuauugccuuuccuuugag

SEQ ID NO: 111327 - RNA, 22 nt, Human
ccuaccacccucccugcuccuu

SEQ ID NO: 111328 - RNA, 32 nt, Human
ccuaccaccgcuugcuggagguugaggacgcc

SEQ ID NO: 111329 - RNA, 20 nt, Human
ccuaccaccgggcuccuuca

SEQ ID NO: 111330 - RNA, 18 nt, Human
ccuaccaccuucuaguca

SEQ ID NO: 111331 - RNA, 20 nt, Human
ccuaccacguacccuccuca

SEQ ID NO: 111332 - RNA, 20 nt, Human
ccuaccacuaacucugcuca

SEQ ID NO: 111333 - RNA, 18 nt, Human
ccuaccacucgcguguuc

SEQ ID NO: 111334 - RNA, 32 nt, Human
ccuaccacugcacuucagccuaggugacauag

SEQ ID NO: 111335 - RNA, 19 nt, Human
ccuaccacugcuccuguuc

SEQ ID NO: 111336 - RNA, 19 nt, Human
ccuaccacugucuucuuca

SEQ ID NO: 111337 - RNA, 32 nt, Human
ccuaccacuuugccaaucaugucuaacagaug

SEQ ID NO: 111338 - RNA, 32 nt, Human
ccuaccagaccggagaggggagaagucauguu

SEQ ID NO: 111339 - RNA, 21 nt, Human
ccuaccagcuggcugcccuga

SEQ ID NO: 111340 - RNA, 32 nt, Human
ccuaccaggagaaagcaguaggcuuccuuucu

SEQ ID NO: 111341 - RNA, 32 nt, Human
ccuaccaggcuugguggagccacagcagaccu

SEQ ID NO: 111342 - RNA, 32 nt, Human
ccuaccauagcaccugugagacccacaguuuc

SEQ ID NO: 111343 - RNA, 32 nt, Human
ccuaccaucuccccaucuucacccaacuccca

SEQ ID NO: 111344 - RNA, 31 nt, Human
ccuaccaugagagucagccguaggggacccc

SEQ ID NO: 111345 - RNA, 32 nt, Human
ccuaccaugccauuuaacaagagaucccacuc

SEQ ID NO: 111346 - RNA, 18 nt, Human
ccuaccauuuucugcgca

SEQ ID NO: 111347 - RNA, 32 nt, Human
ccuacccaaccccacaccaccaggcucccugc

SEQ ID NO: 111348 - RNA, 32 nt, Human
ccuacccaacccuggaaaguuugcagaagugg

SEQ ID NO: 111349 - RNA, 32 nt, Human
ccuacccacaugcacucgugugagacaaggcc

SEQ ID NO: 111350 - RNA, 22 nt, Human
ccuacccacauuucuaauucag

SEQ ID NO: 111351 - RNA, 18 nt, Human
ccuacccacccacccaca

SEQ ID NO: 111352 - RNA, 19 nt, Human
ccuacccacccacuccaca

SEQ ID NO: 111353 - RNA, 32 nt, Human
ccuacccaccucgcccuugaaggaugggccug

SEQ ID NO: 111354 - RNA, 23 nt, Human
ccuacccaccugcaaggucccag

SEQ ID NO: 111355 - RNA, 32 nt, Human
ccuacccacguuccagccucuaggugagucag

SEQ ID NO: 111356 - RNA, 32 nt, Human
ccuacccacucauauaacauaccucaggucua

SEQ ID NO: 111357 - RNA, 32 nt, Human
ccuacccagcacagcaaaugguuguaguaauu

SEQ ID NO: 111358 - RNA, 32 nt, Human
ccuacccaggaagaaccugaagaucuggacug

SEQ ID NO: 111359 - RNA, 32 nt, Human
ccuacccaggcagagaguggggcacaggcagg

SEQ ID NO: 111360 - RNA, 23 nt, Human
ccuacccagggaggaugcagaga

SEQ ID NO: 111361 - RNA, 32 nt, Human
ccuacccaucaucuguugguguuuuugguuuu

SEQ ID NO: 111362 - RNA, 32 nt, Human
ccuacccauugaucauuucaagaaaccucugu

SEQ ID NO: 111363 - RNA, 32 nt, Human
ccuaccccaucccucugguguggccguggcag

SEQ ID NO: 111364 - RNA, 21 nt, Human
ccuacccccgccuuccugcca

SEQ ID NO: 111365 - RNA, 32 nt, Human
ccuacccccuacucuggggcuugggggucaac

SEQ ID NO: 111366 - RNA, 32 nt, Human
ccuaccccgcugggugugcacacacuccucuc

SEQ ID NO: 111367 - RNA, 32 nt, Human
ccuaccccgucugccagcaucuaguuucccuc

SEQ ID NO: 111368 - RNA, 32 nt, Human
ccuaccccucagugccugcucucauccaaaua

SEQ ID NO: 111369 - RNA, 32 nt, Human
ccuaccccucugugaggagcugugggaagugu

SEQ ID NO: 111370 - RNA, 32 nt, Human
ccuaccccuguccuugcugacuuguguugcau

SEQ ID NO: 111371 - RNA, 32 nt, Human
ccuaccccuuccagauccuccuggccgggcag

SEQ ID NO: 111372 - RNA, 32 nt, Human
ccuaccccuucccuguucugccucuuuaacuc

SEQ ID NO: 111373 - RNA, 32 nt, Human
ccuaccccuuggaaaugucugcuguuauuucu

SEQ ID NO: 111374 - RNA, 32 nt, Human
ccuaccccuugugcacccgcagccugguaagu

SEQ ID NO: 111375 - RNA, 32 nt, Human
ccuacccgaggacaagccuguucuccauuucu

SEQ ID NO: 111376 - RNA, 20 nt, Human
ccuacccgccccucccuccc

SEQ ID NO: 111377 - RNA, 17 nt, Human
ccuacccgccgcugccg

SEQ ID NO: 111378 - RNA, 32 nt, Human
ccuacccguacgcauacauacauauguguaua

SEQ ID NO: 111379 - RNA, 32 nt, Human
ccuacccucacuaacuccuccuggggccccac

SEQ ID NO: 111380 - RNA, 32 nt, Human
ccuacccuccacaggcacagguccccagauga

SEQ ID NO: 111381 - RNA, 32 nt, Human
ccuacccucucaccaucuuucuuggccucucu

SEQ ID NO: 111382 - RNA, 18 nt, Human
ccuacccucucucugccu

SEQ ID NO: 111383 - RNA, 32 nt, Human
ccuacccucugcacccucaagaaacccccagu

SEQ ID NO: 111384 - RNA, 32 nt, Human
ccuacccugaaguuaugcuuuccuucugugcu

SEQ ID NO: 111385 - RNA, 32 nt, Human
ccuacccugccugucuucuguugaugcugcuu

SEQ ID NO: 111386 - RNA, 23 nt, Human
ccuacccugcgcccaguccuucc

SEQ ID NO: 111387 - RNA, 32 nt, Human
ccuacccuggacugaagggucugcccaucccc

SEQ ID NO: 111388 - RNA, 32 nt, Human
ccuacccuggggacugugaugaggaagggccc

SEQ ID NO: 111389 - RNA, 32 nt, Human
ccuacccugugcaugguccuggggcagcaagg

SEQ ID NO: 111390 - RNA, 32 nt, Human
ccuacccuucaaggacauauaauccagagcua

SEQ ID NO: 111391 - RNA, 32 nt, Human
ccuacccuuccagggaccccuauccugauccc

SEQ ID NO: 111392 - RNA, 21 nt, Human
ccuacccuuuuguaccucuga

SEQ ID NO: 111393 - RNA, 32 nt, Human
ccuaccgaguagcugggacuacaggcacgcgc

SEQ ID NO: 111394 - RNA, 32 nt, Human
ccuaccgccgcuugcuggagguugaggacgcc

SEQ ID NO: 111395 - RNA, 32 nt, Human
ccuaccgggaggaaugaauaacuccagacacg

SEQ ID NO: 111396 - RNA, 32 nt, Human
ccuaccggggcugaggccaugcugggagcccc

SEQ ID NO: 111397 - RNA, 32 nt, Human
ccuaccuacccacccacccacacccacagcca

SEQ ID NO: 111398 - RNA, 32 nt, Human
ccuaccuacugcccccauucauccuggcuuuc

SEQ ID NO: 111399 - RNA, 20 nt, Human
ccuaccuaggagcaggggga

SEQ ID NO: 111400 - RNA, 32 nt, Human
ccuaccuaggcaacauggugaaaccuugucuc

SEQ ID NO: 111401 - RNA, 32 nt, Human
ccuaccuauacauacgugcacacacacauaca

SEQ ID NO: 111402 - RNA, 19 nt, Human
ccuaccucaccucuucuca

SEQ ID NO: 111403 - RNA, 32 nt, Human
ccuaccucaccuuacucaaugguguagguaaa

SEQ ID NO: 111404 - RNA, 18 nt, Human
ccuaccucacgccugccc

SEQ ID NO: 111405 - RNA, 19 nt, Human
ccuaccucaggcccugcuc

SEQ ID NO: 111406 - RNA, 32 nt, Human
ccuaccucaggucugagagucugggugugugg

SEQ ID NO: 111407 - RNA, 32 nt, Human
ccuaccucccacugcacugccgguuucccugg

SEQ ID NO: 111408 - RNA, 20 nt, Human
ccuaccucccuccucagggg

SEQ ID NO: 111409 - RNA, 32 nt, Human
ccuaccucucugcugugucuucaugucccuga

SEQ ID NO: 111410 - RNA, 32 nt, Human
ccuaccucuggcccucgcuuuaccggaguagg

SEQ ID NO: 111411 - RNA, 32 nt, Human
ccuaccugaccaccaucaccaagcagaucacg

SEQ ID NO: 111412 - RNA, 32 nt, Human
ccuaccugagccaccguccuagccaagcgagc

SEQ ID NO: 111413 - RNA, 32 nt, Human
ccuaccugcaacuuauacaccuggcuuugggg

SEQ ID NO: 111414 - RNA, 32 nt, Human
ccuaccugccaccaccucaccuucauccucag

SEQ ID NO: 111415 - RNA, 30 nt, Human
ccuaccugccucuccgagcuccucaauucu

SEQ ID NO: 111416 - RNA, 22 nt, Human
ccuaccugccugaguccuggag

SEQ ID NO: 111417 - RNA, 32 nt, Human
ccuaccugcugcugggucccuuguagcacagg

SEQ ID NO: 111418 - RNA, 32 nt, Human
ccuaccuggaagucccccugagcuccagggcc

SEQ ID NO: 111419 - RNA, 32 nt, Human
ccuaccuggccauggccaacggagugaucccg

SEQ ID NO: 111420 - RNA, 32 nt, Human
ccuaccuggucccaucugccucuuuucucucc

SEQ ID NO: 111421 - RNA, 32 nt, Human
ccuaccugugccagagagcuagaaagaagguc

SEQ ID NO: 111422 - RNA, 32 nt, Human
ccuaccuuccacccuccccauuuggagucugc

SEQ ID NO: 111423 - RNA, 20 nt, Human
ccuaccuuccacuccugccu

SEQ ID NO: 111424 - RNA, 32 nt, Human
ccuaccuucucugcccacaccuccugccagca

SEQ ID NO: 111425 - RNA, 32 nt, Human
ccuacgauccuagcuacucaggaggcugaagu

SEQ ID NO: 111426 - RNA, 32 nt, Human
ccuacgaugaacuaugagaaacucagucgugc

SEQ ID NO: 111427 - RNA, 32 nt, Human
ccuacgaugaaugccuaagaggguauugacau

SEQ ID NO: 111428 - RNA, 32 nt, Human
ccuacgcccaccuaguggccagucccagagcc

SEQ ID NO: 111429 - RNA, 32 nt, Human
ccuacgcccggcaggccuccagccaggagugc

SEQ ID NO: 111430 - RNA, 32 nt, Human
ccuacgccgccccggcuccuccggacggggcg

SEQ ID NO: 111431 - RNA, 32 nt, Human
ccuacgccuaagaggaacacagcagcuguucc

SEQ ID NO: 111432 - RNA, 32 nt, Human
ccuacgcgcagcugguguuccagaccugcgac

SEQ ID NO: 111433 - RNA, 32 nt, Human
ccuacgcugccaggaggcccaggcugggagag

SEQ ID NO: 111434 - RNA, 20 nt, Human
ccuacgcuggagugcagugg

SEQ ID NO: 111435 - RNA, 22 nt, Human
ccuacggaaggggcuuaaugca

SEQ ID NO: 111436 - RNA, 32 nt, Human
ccuacggccgacucuggguucccuucaggugu

SEQ ID NO: 111437 - RNA, 32 nt, Human
ccuacggcuacacugggccuagguguggcagu

SEQ ID NO: 111438 - RNA, 32 nt, Human
ccuacggcugccgccagucucaugcccaggug

SEQ ID NO: 111439 - RNA, 32 nt, Human
ccuacgggcuguagauggagcuguccggcccc

SEQ ID NO: 111440 - RNA, 32 nt, Human
ccuacggguuucaucucucaccagaagaaaug

SEQ ID NO: 111441 - RNA, 32 nt, Human
ccuacgguauccagggaacagaaagcaggaug

SEQ ID NO: 111442 - RNA, 32 nt, Human
ccuacgucugcagggaggaugaguagucauua

SEQ ID NO: 111443 - RNA, 32 nt, Human
ccuacgugcccacuggcacacacacgugcuca

SEQ ID NO: 111444 - RNA, 32 nt, Human
ccuacgugcgcagggcccuccaccgccacuau

SEQ ID NO: 111445 - RNA, 21 nt, Human
ccuacguuuccaccuccuccc

SEQ ID NO: 111446 - RNA, 32 nt, Human
ccuacguuucuguauacagcuguguugcuuuu

SEQ ID NO: 111447 - RNA, 32 nt, Human
ccuacuaaaaauaacaaaauuagccgggcgug

SEQ ID NO: 111448 - RNA, 32 nt, Human
ccuacuaaaaauacaaaauuagccagguaugg

SEQ ID NO: 111449 - RNA, 32 nt, Human
ccuacuaaaaauacaaaguuagccaggcauag

SEQ ID NO: 111450 - RNA, 32 nt, Human
ccuacuaaaaauacaaaguuagccaggcaugg

SEQ ID NO: 111451 - RNA, 32 nt, Human
ccuacuaaagacaguguccucugugaucucag

SEQ ID NO: 111452 - RNA, 32 nt, Human
ccuacuaaagugcugggauuacaggcgugagc

SEQ ID NO: 111453 - RNA, 32 nt, Human
ccuacuaaccaucccccugccugcugccucag

SEQ ID NO: 111454 - RNA, 32 nt, Human
ccuacuacaaguccccauugcugugguccccg

SEQ ID NO: 111455 - RNA, 32 nt, Human
ccuacuacuaucucccacucuagauaaagcca

SEQ ID NO: 111456 - RNA, 32 nt, Human
ccuacuacugaacuccaguuuugaucucguga

SEQ ID NO: 111457 - RNA, 19 nt, Human
ccuacuacugcucugucca

SEQ ID NO: 111458 - RNA, 32 nt, Human
ccuacuacugugccccucccuccuggaggcag

SEQ ID NO: 111459 - RNA, 23 nt, Human
ccuacuaggaaaacaaaacaucu

SEQ ID NO: 111460 - RNA, 32 nt, Human
ccuacuaggaagagagugggcugcagaugaau

SEQ ID NO: 111461 - RNA, 22 nt, Human
ccuacuagguaccaaguacucu

SEQ ID NO: 111462 - RNA, 32 nt, Human
ccuacuaucuguguucccuuagauacuccugu

SEQ ID NO: 111463 - RNA, 32 nt, Human
ccuacucacaggcuccaugagcagaugaagua

SEQ ID NO: 111464 - RNA, 32 nt, Human
ccuacucacauacccacuuagcaaaaccaaag

SEQ ID NO: 111465 - RNA, 32 nt, Human
ccuacucagacuguugcacucuaaaccuaggg

SEQ ID NO: 111466 - RNA, 21 nt, Human
ccuacucauaugaaaacuuug

SEQ ID NO: 111467 - RNA, 32 nt, Human
ccuacucaucgcacuaauuuacacucacaaca

SEQ ID NO: 111468 - RNA, 32 nt, Human
ccuacucauucaaccaauagcccuggccguac

SEQ ID NO: 111469 - RNA, 32 nt, Human
ccuacucccagaagaggagggaagcacaggug

SEQ ID NO: 111470 - RNA, 32 nt, Human
ccuacuccccaguucaggcuucagagagcccc

SEQ ID NO: 111471 - RNA, 32 nt, Human
ccuacuccccugggcaucuucuggcuugacug

SEQ ID NO: 111472 - RNA, 32 nt, Human
ccuacucccugaauccggguccucauugugaa

SEQ ID NO: 111473 - RNA, 32 nt, Human
ccuacuccgagggcuccuccugccuggugaag

SEQ ID NO: 111474 - RNA, 32 nt, Human
ccuacuccucagcagggacccagcacagcaau

SEQ ID NO: 111475 - RNA, 21 nt, Human
ccuacuccucccuccucguca

SEQ ID NO: 111476 - RNA, 32 nt, Human
ccuacuccuccuccuccucucccggcggcggc

SEQ ID NO: 111477 - RNA, 18 nt, Human
ccuacuccugccaggcug

SEQ ID NO: 111478 - RNA, 32 nt, Human
ccuacuccuuauuuacgacacaauaaaauaac

SEQ ID NO: 111479 - RNA, 32 nt, Human
ccuacuccuugcaggugacauuugcucugaac

SEQ ID NO: 111480 - RNA, 32 nt, Human
ccuacucuacaaucaaggaagaaggacaucuc

SEQ ID NO: 111481 - RNA, 32 nt, Human
ccuacucuaggaagaggaagguauggcgagcc

SEQ ID NO: 111482 - RNA, 32 nt, Human
ccuacucuauucagauauucuccagauuccua

SEQ ID NO: 111483 - RNA, 32 nt, Human
ccuacucucagccucacgugacucucgggcag

SEQ ID NO: 111484 - RNA, 32 nt, Human
ccuacucucagcugccuaucuucugccuuuca

SEQ ID NO: 111485 - RNA, 32 nt, Human
ccuacucucccucauggcgucucccccaccuu

SEQ ID NO: 111486 - RNA, 32 nt, Human
ccuacucugccucuuccuccauacuagguugg

SEQ ID NO: 111487 - RNA, 32 nt, Human
ccuacucugcuccccucucacacaucugggag

SEQ ID NO: 111488 - RNA, 32 nt, Human
ccuacucugggcagguggaggcuuauccaaca

SEQ ID NO: 111489 - RNA, 32 nt, Human
ccuacucuucuguaaggaggauaggaaguauu

SEQ ID NO: 111490 - RNA, 32 nt, Human
ccuacucuucuuucucccugcccccuggaggg

SEQ ID NO: 111491 - RNA, 32 nt, Human
ccuacucuuggccuugaaccuaccucuggguu

SEQ ID NO: 111492 - RNA, 32 nt, Human
ccuacugaaaugcaguugaggccgggugcggu

SEQ ID NO: 111493 - RNA, 32 nt, Human
ccuacugacaaccccuccccagccuugccccu

SEQ ID NO: 111494 - RNA, 32 nt, Human
ccuacugacaugcccauuucuccaguuuucuu

SEQ ID NO: 111495 - RNA, 32 nt, Human
ccuacugaccuggcuggugacagaacaugcag

SEQ ID NO: 111496 - RNA, 32 nt, Human
ccuacugaguguaccacugccuucccuucuag

SEQ ID NO: 111497 - RNA, 22 nt, Human
ccuacugauugcugccuucucu

SEQ ID NO: 111498 - RNA, 32 nt, Human
ccuacugcaaaaagauuguccaaaaugccuaa

SEQ ID NO: 111499 - RNA, 25 nt, Human
ccuacugcaaaagcaagggcuggca

SEQ ID NO: 111500 - RNA, 23 nt, Human
ccuacugcacuuucccccuuccc

SEQ ID NO: 111501 - RNA, 21 nt, Human
ccuacugcaggucaaauccug

SEQ ID NO: 111502 - RNA, 24 nt, Human
ccuacugcaguuccagccaaccug

SEQ ID NO: 111503 - RNA, 21 nt, Human
ccuacugcaguuuccuaccug

SEQ ID NO: 111504 - RNA, 32 nt, Human
ccuacugcauaccuaggcuauaugggagagcc

SEQ ID NO: 111505 - RNA, 32 nt, Human
ccuacugccaggagguggaggaaggagcaggu

SEQ ID NO: 111506 - RNA, 22 nt, Human
ccuacugccucagcccccaggg

SEQ ID NO: 111507 - RNA, 32 nt, Human
ccuacugccugagaugguuccagaggcggucu

SEQ ID NO: 111508 - RNA, 32 nt, Human
ccuacugccugaugcaggugccauugccauua

SEQ ID NO: 111509 - RNA, 32 nt, Human
ccuacugcucccagcaaccucuacauccagga

SEQ ID NO: 111510 - RNA, 21 nt, Human
ccuacugcucucuccuuuccc

SEQ ID NO: 111511 - RNA, 32 nt, Human
ccuacugcucuuccucucucccucucuuaggg

SEQ ID NO: 111512 - RNA, 32 nt, Human
ccuacugcugugaacccuggggccugacugcu

SEQ ID NO: 111513 - RNA, 32 nt, Human
ccuacugcuucuuuucuuguucuuuauucuca

SEQ ID NO: 111514 - RNA, 18 nt, Human
ccuacuggaaacggggca

SEQ ID NO: 111515 - RNA, 32 nt, Human
ccuacuggaguuggaggucucacagcagcacc

SEQ ID NO: 111516 - RNA, 32 nt, Human
ccuacuggaucccgggagccugggcuggggcc

SEQ ID NO: 111517 - RNA, 32 nt, Human
ccuacugggccagcugagguacaggcaggggc

SEQ ID NO: 111518 - RNA, 32 nt, Human
ccuacuggguagcugggacuacaggggugcac

SEQ ID NO: 111519 - RNA, 32 nt, Human
ccuacuguaauccucagaggccacuuuaucau

SEQ ID NO: 111520 - RNA, 32 nt, Human
ccuacuguagccucagcaucuugcuaggaggc

SEQ ID NO: 111521 - RNA, 32 nt, Human
ccuacugucaguuucugaaacuucugacuggc

SEQ ID NO: 111522 - RNA, 32 nt, Human
ccuacugucuggagaagagaaagaaaauuugc

SEQ ID NO: 111523 - RNA, 32 nt, Human
ccuacugugugccacacaccauaucaggugcu

SEQ ID NO: 111524 - RNA, 32 nt, Human
ccuacuguguguggguugucucggccacugag

SEQ ID NO: 111525 - RNA, 32 nt, Human
ccuacuuacauacaugaacuauuccuuuuaau

SEQ ID NO: 111526 - RNA, 32 nt, Human
ccuacuucauugacagcaccagccaagugaau

SEQ ID NO: 111527 - RNA, 32 nt, Human
ccuacuucccuaggaagcccuggcuaccuuuc

SEQ ID NO: 111528 - RNA, 32 nt, Human
ccuacuuccucccauuccauaacuucugcucg

SEQ ID NO: 111529 - RNA, 23 nt, Human
ccuacuuccucugccaccucuga

SEQ ID NO: 111530 - RNA, 32 nt, Human
ccuacuuccucuucagauuccuucacccuauu

SEQ ID NO: 111531 - RNA, 23 nt, Human
ccuacuuccugccaagcauucca

SEQ ID NO: 111532 - RNA, 32 nt, Human
ccuacuucuccaccaucccuagcaugccagcc

SEQ ID NO: 111533 - RNA, 32 nt, Human
ccuacuucugcuguagccugggaccagaccug

SEQ ID NO: 111534 - RNA, 32 nt, Human
ccuacuugcccacccuuccuugcugguucaga

SEQ ID NO: 111535 - RNA, 32 nt, Human
ccuacuugccuaggcucuaauuagucagcaau

SEQ ID NO: 111536 - RNA, 32 nt, Human
ccuacuugggcccugcagcccagccuguguug

SEQ ID NO: 111537 - RNA, 32 nt, Human
ccuacuuguccagguggagugagucugaggac

SEQ ID NO: 111538 - RNA, 32 nt, Human
ccuacuuuaugacgcccucuucccucuugaug

SEQ ID NO: 111539 - RNA, 32 nt, Human
ccuacuuuauucaccaauaucccaguaacaug

SEQ ID NO: 111540 - RNA, 22 nt, Human
ccuacuuuccucccucccuccc

SEQ ID NO: 111541 - RNA, 32 nt, Human
ccuacuuuccucuccugcuuucugccugugac

SEQ ID NO: 111542 - RNA, 32 nt, Human
ccuacuuuccuugcuuccuuccuuccucucuu

SEQ ID NO: 111543 - RNA, 32 nt, Human
ccuacuuugaucaccauuucucuccaggcuuu

SEQ ID NO: 111544 - RNA, 32 nt, Human
ccuacuuugcaaguuggugcccccaggaaccu

SEQ ID NO: 111545 - RNA, 32 nt, Human
ccuacuuugcaggcaguccuuccagaugguuc

SEQ ID NO: 111546 - RNA, 32 nt, Human
ccuacuuuuagaguguaguucaacucauuugu

SEQ ID NO: 111547 - RNA, 32 nt, Human
ccuacuuuugccauugacuucuucccaagauu

SEQ ID NO: 111548 - RNA, 32 nt, Human
ccuacuuuugcugguauacugugaacucguau

SEQ ID NO: 111549 - RNA, 16 nt, Human
ccuagaaaaagauaaa

SEQ ID NO: 111550 - RNA, 32 nt, Human
ccuagaaaagcagaaacagcugugccugggaa

SEQ ID NO: 111551 - RNA, 32 nt, Human
ccuagaaaccugcccuucucuggcaggguuag

SEQ ID NO: 111552 - RNA, 32 nt, Human
ccuagaaacugaggggcuauggugcuaagcag

SEQ ID NO: 111553 - RNA, 32 nt, Human
ccuagaaauccuagcaacagauuucucugguu

SEQ ID NO: 111554 - RNA, 32 nt, Human
ccuagaaccccaauucagccuccugggcaccc

SEQ ID NO: 111555 - RNA, 32 nt, Human
ccuagaagagucaggaagggaaagccagaagg

SEQ ID NO: 111556 - RNA, 32 nt, Human
ccuagaagcagggacucaucugugcugucugu

SEQ ID NO: 111557 - RNA, 32 nt, Human
ccuagaagcauuuaugauuuauuugaagccac

SEQ ID NO: 111558 - RNA, 32 nt, Human
ccuagaagcgugaauguauaggauaccugacu

SEQ ID NO: 111559 - RNA, 24 nt, Human
ccuagaagguggagguugcaguga

SEQ ID NO: 111560 - RNA, 32 nt, Human
ccuagaagguggagguugcagugagcggagau

SEQ ID NO: 111561 - RNA, 32 nt, Human
ccuagaaguacacccccgucuuauuaaggagc

SEQ ID NO: 111562 - RNA, 32 nt, Human
ccuagaagucuucucaagcugacuuccuaccu

SEQ ID NO: 111563 - RNA, 32 nt, Human
ccuagaauaaagacuacauuucccagucuccu

SEQ ID NO: 111564 - RNA, 32 nt, Human
ccuagaaucccagcuacucggaaggccaaggc

SEQ ID NO: 111565 - RNA, 32 nt, Human
ccuagaaucugaaauuccaguaucauuuguaa

SEQ ID NO: 111566 - RNA, 21 nt, Human
ccuagaauuucccugcuccuu

SEQ ID NO: 111567 - RNA, 28 nt, Human
ccuagacaacagagcaagacccuauguc

SEQ ID NO: 111568 - RNA, 32 nt, Human
ccuagacaccucaguucauugugguccuugcg

SEQ ID NO: 111569 - RNA, 32 nt, Human
ccuagacagcuguggagggaagaccucguggg

SEQ ID NO: 111570 - RNA, 32 nt, Human
ccuagacagugcaguccugcuugggggagccu

SEQ ID NO: 111571 - RNA, 16 nt, Human
ccuagacaucuaccca

SEQ ID NO: 111572 - RNA, 32 nt, Human
ccuagacaucuucucccucccuugccucagau

SEQ ID NO: 111573 - RNA, 32 nt, Human
ccuagacauggaggagaaggacuacagugagg

SEQ ID NO: 111574 - RNA, 21 nt, Human
ccuagacauugccuucacucc

SEQ ID NO: 111575 - RNA, 19 nt, Human
ccuagaccacccugcccca

SEQ ID NO: 111576 - RNA, 32 nt, Human
ccuagaccauucuccccuccagggagcccacc

SEQ ID NO: 111577 - RNA, 32 nt, Human
ccuagaccccaugccagccauuguaagaguuc

SEQ ID NO: 111578 - RNA, 32 nt, Human
ccuagaccuaauuuuuccuugaucccacugau

SEQ ID NO: 111579 - RNA, 32 nt, Human
ccuagaccuaguuaggaaguaucauuuuaagc

SEQ ID NO: 111580 - RNA, 32 nt, Human
ccuagaccucuguuaccagcagugcuaccucu

SEQ ID NO: 111581 - RNA, 32 nt, Human
ccuagaccuugccuccccuccucuccugccca

SEQ ID NO: 111582 - RNA, 32 nt, Human
ccuagacgggacccgcucccaccuuuacuuac

SEQ ID NO: 111583 - RNA, 32 nt, Human
ccuagacucugugucacucucaacacacacag

SEQ ID NO: 111584 - RNA, 19 nt, Human
ccuagacuggagugcaaug

SEQ ID NO: 111585 - RNA, 23 nt, Human
ccuagacuggagugcaauggcgu

SEQ ID NO: 111586 - RNA, 32 nt, Human
ccuagacugggagcucagguacucuuuuaguc

SEQ ID NO: 111587 - RNA, 32 nt, Human
ccuagacuguauccaggagguggaagugaauu

SEQ ID NO: 111588 - RNA, 22 nt, Human
ccuagacuucuagugccucuga

SEQ ID NO: 111589 - RNA, 32 nt, Human
ccuagacuuuggggguggcucucuuguaauua

SEQ ID NO: 111590 - RNA, 32 nt, Human
ccuagagaaagccagcaaagaaugaaggcaac

SEQ ID NO: 111591 - RNA, 32 nt, Human
ccuagagacaugcucccugcccucuccacagu

SEQ ID NO: 111592 - RNA, 32 nt, Human
ccuagagacgcugacaaaggagcggaggagca

SEQ ID NO: 111593 - RNA, 32 nt, Human
ccuagagagagggugagaugacuggggugguc

SEQ ID NO: 111594 - RNA, 20 nt, Human
ccuagagagagugaggugca

SEQ ID NO: 111595 - RNA, 32 nt, Human
ccuagagauagaggagacagauccucucuccu

SEQ ID NO: 111596 - RNA, 32 nt, Human
ccuagagauggcagaaucaggagcaaguuucu

SEQ ID NO: 111597 - RNA, 32 nt, Human
ccuagagaugggaagugacuugcucaagguca

SEQ ID NO: 111598 - RNA, 32 nt, Human
ccuagagccagggcugacaugaccucgaugcu

SEQ ID NO: 111599 - RNA, 32 nt, Human
ccuagagccccagcagcacccagccaaaccca

SEQ ID NO: 111600 - RNA, 22 nt, Human
ccuagagccccgcuuucccucc

SEQ ID NO: 111601 - RNA, 32 nt, Human
ccuagagccuacaguucagaacuaucuuguug

SEQ ID NO: 111602 - RNA, 32 nt, Human
ccuagagccuccagggggaacuggaggaugcg

SEQ ID NO: 111603 - RNA, 32 nt, Human
ccuagagccucgguaugcuuucccucaaccga

SEQ ID NO: 111604 - RNA, 32 nt, Human
ccuagagcuagcaguucccauucaggcaaaca

SEQ ID NO: 111605 - RNA, 32 nt, Human
ccuagagcuccucugccugaauccugcccccu

SEQ ID NO: 111606 - RNA, 32 nt, Human
ccuagagcugaggagugaggggucagggcuca

SEQ ID NO: 111607 - RNA, 32 nt, Human
ccuagagcugagugccuggggguccagaagcu

SEQ ID NO: 111608 - RNA, 32 nt, Human
ccuagagcuuucugacagggagucugaagcgu

SEQ ID NO: 111609 - RNA, 20 nt, Human
ccuagaggacaagagcuugg

SEQ ID NO: 111610 - RNA, 18 nt, Human
ccuagaggagggggccgg

SEQ ID NO: 111611 - RNA, 32 nt, Human
ccuagaggaugagccacaaaauaccucuauga

SEQ ID NO: 111612 - RNA, 32 nt, Human
ccuagaggcagauauuuugccccauggcuauu

SEQ ID NO: 111613 - RNA, 32 nt, Human
ccuagaggcccagccucuguggcgcugugauc

SEQ ID NO: 111614 - RNA, 32 nt, Human
ccuagaggccgaggagcucacagcuaugggcu

SEQ ID NO: 111615 - RNA, 23 nt, Human
ccuagaggcggaguuugcaguga

SEQ ID NO: 111616 - RNA, 22 nt, Human
ccuagaggcuccagcucuggca

SEQ ID NO: 111617 - RNA, 32 nt, Human
ccuagagggcccuuuccugcuucucugaaagc

SEQ ID NO: 111618 - RNA, 32 nt, Human
ccuagaggggucagggcugagcccagccucca

SEQ ID NO: 111619 - RNA, 32 nt, Human
ccuagaggguuaagggaacaacagagaugggg

SEQ ID NO: 111620 - RNA, 32 nt, Human
ccuagaggugaauuucguuggggaagagggag

SEQ ID NO: 111621 - RNA, 32 nt, Human
ccuagaguagugcucucguugaugaagcacau

SEQ ID NO: 111622 - RNA, 32 nt, Human
ccuagaguagugcuuggugcaugauaguaggc

SEQ ID NO: 111623 - RNA, 32 nt, Human
ccuagaguccuccugaggagucggggcuugcc

SEQ ID NO: 111624 - RNA, 32 nt, Human
ccuagaguugggguuccucagcucaggugcag

SEQ ID NO: 111625 - RNA, 25 nt, Human
ccuagauagagcucauuuuacucca

SEQ ID NO: 111626 - RNA, 21 nt, Human
ccuagauauggagggggccag

SEQ ID NO: 111627 - RNA, 32 nt, Human
ccuagaucacuggugugauaaaccccauuuca

SEQ ID NO: 111628 - RNA, 32 nt, Human
ccuagaucccuccaaaugccacccaccagagu

SEQ ID NO: 111629 - RNA, 32 nt, Human
ccuagauccuucagguccccacccucagcugu

SEQ ID NO: 111630 - RNA, 32 nt, Human
ccuagaucuccccucucuccacccuccccaca

SEQ ID NO: 111631 - RNA, 32 nt, Human
ccuagaucuccgggaggcccugguuaaaggag

SEQ ID NO: 111632 - RNA, 20 nt, Human
ccuagaugacuagggugcug

SEQ ID NO: 111633 - RNA, 32 nt, Human
ccuagaugagucaggauaacagagagauacca

SEQ ID NO: 111634 - RNA, 32 nt, Human
ccuagaugugaagugggacauagucuuccauu

SEQ ID NO: 111635 - RNA, 32 nt, Human
ccuagauuccaccugagucaauuguguccaga

SEQ ID NO: 111636 - RNA, 32 nt, Human
ccuagauuccuggcaaccuccccuccccugac

SEQ ID NO: 111637 - RNA, 32 nt, Human
ccuagauugcagcugcguggccaggugcucac

SEQ ID NO: 111638 - RNA, 23 nt, Human
ccuagcaagcuaccuucuguuca

SEQ ID NO: 111639 - RNA, 32 nt, Human
ccuagcaaucagucagggcugcagugagccau

SEQ ID NO: 111640 - RNA, 32 nt, Human
ccuagcacaggcuggcaguugguacugaauug

SEQ ID NO: 111641 - RNA, 32 nt, Human
ccuagcaccaugucugguacaguguagaugcu

SEQ ID NO: 111642 - RNA, 32 nt, Human
ccuagcaccaugucugguacaguguaggugcu

SEQ ID NO: 111643 - RNA, 32 nt, Human
ccuagcagaaggcauugaggugagggaucauu

SEQ ID NO: 111644 - RNA, 22 nt, Human
ccuagcagccucuccucgggca

SEQ ID NO: 111645 - RNA, 32 nt, Human
ccuagcagccuggauagugagcuaaacaaacc

SEQ ID NO: 111646 - RNA, 32 nt, Human
ccuagcagcucaugccuguaaucuccagcacu

SEQ ID NO: 111647 - RNA, 32 nt, Human
ccuagcagcucuguccuuaacacacagcaggu

SEQ ID NO: 111648 - RNA, 32 nt, Human
ccuagcaguggagcaguaccagcugggacagg

SEQ ID NO: 111649 - RNA, 32 nt, Human
ccuagcaucaccgaggacguggcugcucugac

SEQ ID NO: 111650 - RNA, 32 nt, Human
ccuagcaucucagugccccaacccucugccca

SEQ ID NO: 111651 - RNA, 32 nt, Human
ccuagcauggcgggucaacccuguaauuccag

SEQ ID NO: 111652 - RNA, 32 nt, Human
ccuagcaugguggcgcauaccuguagucccag

SEQ ID NO: 111653 - RNA, 32 nt, Human
ccuagccaaaggaccaggagagggggcagccc

SEQ ID NO: 111654 - RNA, 19 nt, Human
ccuagccaacauggugaaa

SEQ ID NO: 111655 - RNA, 32 nt, Human
ccuagccacagcuguuguauucugcucuucuu

SEQ ID NO: 111656 - RNA, 32 nt, Human
ccuagccagcauauacuagaaggugcugaggg

SEQ ID NO: 111657 - RNA, 32 nt, Human
ccuagccaggagagacugcagggacucacuca

SEQ ID NO: 111658 - RNA, 32 nt, Human
ccuagccagggucuguucuuguggaccagagc

SEQ ID NO: 111659 - RNA, 32 nt, Human
ccuagccagucccccacucucucccucuguag

SEQ ID NO: 111660 - RNA, 32 nt, Human
ccuagccauccccucacuauucccgacccaaa

SEQ ID NO: 111661 - RNA, 22 nt, Human
ccuagcccaagccugucuuucc

SEQ ID NO: 111662 - RNA, 32 nt, Human
ccuagcccagccccagucacugucagggucgg

SEQ ID NO: 111663 - RNA, 32 nt, Human
ccuagcccaggccuccaugaaggagaaccugg

SEQ ID NO: 111664 - RNA, 32 nt, Human
ccuagccccacccucucugcucccugugacuu

SEQ ID NO: 111665 - RNA, 32 nt, Human
ccuagccccauccaccauugccagucagcgcc

SEQ ID NO: 111666 - RNA, 25 nt, Human
ccuagccccaucuccaggagccccu

SEQ ID NO: 111667 - RNA, 32 nt, Human
ccuagccccugcccgccugccugccaccucuc

SEQ ID NO: 111668 - RNA, 32 nt, Human
ccuagccccugcugucaugaaggggccaggca

SEQ ID NO: 111669 - RNA, 32 nt, Human
ccuagccccuggcagacauagcugcuucagug

SEQ ID NO: 111670 - RNA, 32 nt, Human
ccuagccccuugguaugugcucuggcucuggu

SEQ ID NO: 111671 - RNA, 32 nt, Human
ccuagcccuacugcccaccccaccccaaccca

SEQ ID NO: 111672 - RNA, 32 nt, Human
ccuagccgccagggugacagaaggcagaacug

SEQ ID NO: 111673 - RNA, 17 nt, Human
ccuagccggggggcgca

SEQ ID NO: 111674 - RNA, 24 nt, Human
ccuagccucacccccuugcucuca

SEQ ID NO: 111675 - RNA, 32 nt, Human
ccuagccucagcuguauccuauugcugaaaac

SEQ ID NO: 111676 - RNA, 32 nt, Human
ccuagccuccacccuggccuggggccccacuc

SEQ ID NO: 111677 - RNA, 32 nt, Human
ccuagccuccuauaggcccaggaagagggcag

SEQ ID NO: 111678 - RNA, 32 nt, Human
ccuagccuccucuccagcacuuggagagggag

SEQ ID NO: 111679 - RNA, 32 nt, Human
ccuagccucucaucucuucacccucuucccug

SEQ ID NO: 111680 - RNA, 32 nt, Human
ccuagccucuguaaacucugcagcauacuaau

SEQ ID NO: 111681 - RNA, 32 nt, Human
ccuagccuggaauggacuggccuggggaaggc

SEQ ID NO: 111682 - RNA, 32 nt, Human
ccuagccugggcaacagagcaagacaccgucu

SEQ ID NO: 111683 - RNA, 24 nt, Human
ccuagccugggugacagagcaaga

SEQ ID NO: 111684 - RNA, 32 nt, Human
ccuagccugggugacagagcaagacuccaucu

SEQ ID NO: 111685 - RNA, 32 nt, Human
ccuagccuuccagggagaaagaggccccugca

SEQ ID NO: 111686 - RNA, 32 nt, Human
ccuagccuugagcaccuuccacauagcaauga

SEQ ID NO: 111687 - RNA, 32 nt, Human
ccuagcgcggcccaaccuuuacuccagagauc

SEQ ID NO: 111688 - RNA, 32 nt, Human
ccuagcgcuaucucccugccuccugccggcuc

SEQ ID NO: 111689 - RNA, 18 nt, Human
ccuagcggcugucaccuc

SEQ ID NO: 111690 - RNA, 32 nt, Human
ccuagcguggcuugcugccuuugguaagaaca

SEQ ID NO: 111691 - RNA, 18 nt, Human
ccuagcuaaaaagauaaa

SEQ ID NO: 111692 - RNA, 32 nt, Human
ccuagcuacugaggaggcugacggaggaggau

SEQ ID NO: 111693 - RNA, 32 nt, Human
ccuagcucagcagcccaaggacgauggugagg

SEQ ID NO: 111694 - RNA, 32 nt, Human
ccuagcucagccacucccagacuccugaccca

SEQ ID NO: 111695 - RNA, 32 nt, Human
ccuagcucauagauucucuguggggagaguga

SEQ ID NO: 111696 - RNA, 32 nt, Human
ccuagcuccagccucuuccugggccagccagg

SEQ ID NO: 111697 - RNA, 32 nt, Human
ccuagcuccccugccccugcagccuggagggc

SEQ ID NO: 111698 - RNA, 32 nt, Human
ccuagcucccggguauuggggcugaggcucug

SEQ ID NO: 111699 - RNA, 23 nt, Human
ccuagcuccuggccccugccagg

SEQ ID NO: 111700 - RNA, 32 nt, Human
ccuagcucguaaaauguucucauuccaugaca

SEQ ID NO: 111701 - RNA, 32 nt, Human
ccuagcucugcuauuuaccagccagguggccu

SEQ ID NO: 111702 - RNA, 32 nt, Human
ccuagcugaccccuucaccucucccccucccu

SEQ ID NO: 111703 - RNA, 32 nt, Human
ccuagcugcccacuuuucaguguuacgaagcc

SEQ ID NO: 111704 - RNA, 32 nt, Human
ccuagcugccugcaccugcccuucagggagau

SEQ ID NO: 111705 - RNA, 32 nt, Human
ccuagcugcugccucccaauggccuuuguagg

SEQ ID NO: 111706 - RNA, 15 nt, Human
ccuagcugcuuggga

SEQ ID NO: 111707 - RNA, 17 nt, Human
ccuagcuggauugcaga

SEQ ID NO: 111708 - RNA, 32 nt, Human
ccuagcuguccacauuucacuaucugaagagc

SEQ ID NO: 111709 - RNA, 32 nt, Human
ccuagcugucucaucccuugcccuggagagac

SEQ ID NO: 111710 - RNA, 32 nt, Human
ccuagcugugagugccuuuuggucuggaaagu

SEQ ID NO: 111711 - RNA, 32 nt, Human
ccuagcugugugaucuugacaggcacuggacg

SEQ ID NO: 111712 - RNA, 32 nt, Human
ccuagcuugcuccccacugugccuuuguuaga

SEQ ID NO: 111713 - RNA, 32 nt, Human
ccuagcuuggguggcagagcaagacucuauca

SEQ ID NO: 111714 - RNA, 23 nt, Human
ccuagcuugucccaagcuucccu

SEQ ID NO: 111715 - RNA, 32 nt, Human
ccuagcuuguuccuuaacccuuuuggaugacu

SEQ ID NO: 111716 - RNA, 32 nt, Human
ccuagcuuucucaaugaauacacacauauuuu

SEQ ID NO: 111717 - RNA, 32 nt, Human
ccuagcuuuggaugugcuuucugccauaaaga

SEQ ID NO: 111718 - RNA, 15 nt, Human
ccuaggaaaguuguc

SEQ ID NO: 111719 - RNA, 32 nt, Human
ccuaggaaggaugaggaugacaggcacuauuu

SEQ ID NO: 111720 - RNA, 32 nt, Human
ccuaggaaguagggagaaaugaaggaagggca

SEQ ID NO: 111721 - RNA, 18 nt, Human
ccuaggaauaaccggugg

SEQ ID NO: 111722 - RNA, 32 nt, Human
ccuaggaauucaagaccagccuagguaacaua

SEQ ID NO: 111723 - RNA, 32 nt, Human
ccuaggaauucaggaagaaaugggauuauaaa

SEQ ID NO: 111724 - RNA, 32 nt, Human
ccuaggacaauuauuuguuacauaauccgacc

SEQ ID NO: 111725 - RNA, 32 nt, Human
ccuaggacagccugagaguaacuggaccuggu

SEQ ID NO: 111726 - RNA, 32 nt, Human
ccuaggaccacgcaggagguggugggcucgca

SEQ ID NO: 111727 - RNA, 32 nt, Human
ccuaggacguugaggcugcagugagcuguguu

SEQ ID NO: 111728 - RNA, 32 nt, Human
ccuaggacuggcuagucaugugaccucggguu

SEQ ID NO: 111729 - RNA, 18 nt, Human
ccuaggagagaagcuguc

SEQ ID NO: 111730 - RNA, 32 nt, Human
ccuaggagagugaacagguagauuuagacguu

SEQ ID NO: 111731 - RNA, 32 nt, Human
ccuaggagcagcugcaauugcaccugagggac

SEQ ID NO: 111732 - RNA, 32 nt, Human
ccuaggagcccuggacucaggcuggcagaggg

SEQ ID NO: 111733 - RNA, 32 nt, Human
ccuaggagccugggaccaggagccagaaaguu

SEQ ID NO: 111734 - RNA, 32 nt, Human
ccuaggaggcagaaguugcagugagcagagau

SEQ ID NO: 111735 - RNA, 24 nt, Human
ccuaggaggcagagguugcaguga

SEQ ID NO: 111736 - RNA, 32 nt, Human
ccuaggaggcagagguugcagugagccaaguu

SEQ ID NO: 111737 - RNA, 32 nt, Human
ccuaggaggcagaguuugcagugagcugagau

SEQ ID NO: 111738 - RNA, 32 nt, Human
ccuaggaggcccaggcuggagugagguggcac

SEQ ID NO: 111739 - RNA, 23 nt, Human
ccuaggaggcggacguugcagug

SEQ ID NO: 111740 - RNA, 24 nt, Human
ccuaggaggcggacguugcaguga

SEQ ID NO: 111741 - RNA, 23 nt, Human
ccuaggaggcggagcuugcagug

SEQ ID NO: 111742 - RNA, 24 nt, Human
ccuaggaggcggagcuugcaguga

SEQ ID NO: 111743 - RNA, 23 nt, Human
ccuaggaggcggagguugcagug

SEQ ID NO: 111744 - RNA, 24 nt, Human
ccuaggaggcggagguugcaguga

SEQ ID NO: 111745 - RNA, 32 nt, Human
ccuaggaggcggagguugcagugagccaagau

SEQ ID NO: 111746 - RNA, 32 nt, Human
ccuaggaggcggagguugcagugagucaagau

SEQ ID NO: 111747 - RNA, 32 nt, Human
ccuaggaggcucagaggcaguggugugggagc

SEQ ID NO: 111748 - RNA, 32 nt, Human
ccuaggaggcugagauugcagugagccgaaau

SEQ ID NO: 111749 - RNA, 32 nt, Human
ccuaggaggggaagguugcagugagccgagau

SEQ ID NO: 111750 - RNA, 24 nt, Human
ccuaggaggucaaggcugcaguga

SEQ ID NO: 111751 - RNA, 32 nt, Human
ccuaggaggucgaggcugcagugagccaagau

SEQ ID NO: 111752 - RNA, 32 nt, Human
ccuaggagguggagguugcagugagccgagau

SEQ ID NO: 111753 - RNA, 32 nt, Human
ccuaggagguggagguugcagugagcugagau

SEQ ID NO: 111754 - RNA, 32 nt, Human
ccuaggagguucuggaggguucauucuuggac

SEQ ID NO: 111755 - RNA, 32 nt, Human
ccuaggagguugaggcugcagugagcuaugau

SEQ ID NO: 111756 - RNA, 32 nt, Human
ccuaggagguugaggcugcagugagcugugau

SEQ ID NO: 111757 - RNA, 32 nt, Human
ccuaggaugcccagggcugggugcagccagcu

SEQ ID NO: 111758 - RNA, 22 nt, Human
ccuaggcaacaaccaucacccu

SEQ ID NO: 111759 - RNA, 32 nt, Human
ccuaggcaacaagagugaaacuccgucuuaaa

SEQ ID NO: 111760 - RNA, 22 nt, Human
ccuaggcaacacagggagaccc

SEQ ID NO: 111761 - RNA, 32 nt, Human
ccuaggcaacacagggagacccgugucgacaa

SEQ ID NO: 111762 - RNA, 23 nt, Human
ccuaggcaacacagugaaacccu

SEQ ID NO: 111763 - RNA, 32 nt, Human
ccuaggcaacacagugaaacccugucucuaca

SEQ ID NO: 111764 - RNA, 23 nt, Human
ccuaggcaacacagugaggccuu

SEQ ID NO: 111765 - RNA, 32 nt, Human
ccuaggcaacacggcaagacccugucuccaca

SEQ ID NO: 111766 - RNA, 28 nt, Human
ccuaggcaacagagcaagacuccgucuc

SEQ ID NO: 111767 - RNA, 32 nt, Human
ccuaggcaacagagcaagacucugucucaaaa

SEQ ID NO: 111768 - RNA, 23 nt, Human
ccuaggcaacagagcgagacccu

SEQ ID NO: 111769 - RNA, 24 nt, Human
ccuaggcaacauagcaagaccuca

SEQ ID NO: 111770 - RNA, 23 nt, Human
ccuaggcaacauagcaagguccc

SEQ ID NO: 111771 - RNA, 23 nt, Human
ccuaggcaacauagcgagacccu

SEQ ID NO: 111772 - RNA, 32 nt, Human
ccuaggcaacauagcgagacccugucucuaca

SEQ ID NO: 111773 - RNA, 22 nt, Human
ccuaggcaacauagggagaccc

SEQ ID NO: 111774 - RNA, 22 nt, Human
ccuaggcaacauaguaagaccu

SEQ ID NO: 111775 - RNA, 23 nt, Human
ccuaggcaacauagugagacccu

SEQ ID NO: 111776 - RNA, 32 nt, Human
ccuaggcaacauagugagacccugucucuacu

SEQ ID NO: 111777 - RNA, 22 nt, Human
ccuaggcaacauggagaaaccc

SEQ ID NO: 111778 - RNA, 23 nt, Human
ccuaggcaacauggagaaacccu

SEQ ID NO: 111779 - RNA, 22 nt, Human
ccuaggcaacauggcaaaaccc

SEQ ID NO: 111780 - RNA, 23 nt, Human
ccuaggcaacauggcgaaacccu

SEQ ID NO: 111781 - RNA, 23 nt, Human
ccuaggcaacauggugaaacccu

SEQ ID NO: 111782 - RNA, 23 nt, Human
ccuaggcaacauggugaaaccuu

SEQ ID NO: 111783 - RNA, 32 nt, Human
ccuaggcaaguggaucaccugaggucgggagu

SEQ ID NO: 111784 - RNA, 32 nt, Human
ccuaggcaccuccccgcucucccugucacgcu

SEQ ID NO: 111785 - RNA, 32 nt, Human
ccuaggcacugagguagcuuaacucuaggcac

SEQ ID NO: 111786 - RNA, 32 nt, Human
ccuaggcacuguccccucccacagccuccuuc

SEQ ID NO: 111787 - RNA, 32 nt, Human
ccuaggcagagcugcugauuguggggcuggga

SEQ ID NO: 111788 - RNA, 32 nt, Human
ccuaggcagccccugaggaggagggcugaaua

SEQ ID NO: 111789 - RNA, 32 nt, Human
ccuaggcaggcagaucaccugaggucaggagu

SEQ ID NO: 111790 - RNA, 20 nt, Human
ccuaggcaggggaugcacag

SEQ ID NO: 111791 - RNA, 32 nt, Human
ccuaggcauagggaaagugcagaauauugccg

SEQ ID NO: 111792 - RNA, 20 nt, Human
ccuaggccagagugcagugg

SEQ ID NO: 111793 - RNA, 32 nt, Human
ccuaggccagccagccuaucccucucuccccu

SEQ ID NO: 111794 - RNA, 32 nt, Human
ccuaggccaugguuucuaaucuuauggcuagu

SEQ ID NO: 111795 - RNA, 32 nt, Human
ccuaggcccaggaugaggaggagcuuggcucc

SEQ ID NO: 111796 - RNA, 32 nt, Human
ccuaggcccgggccaccauggcgcugccucca

SEQ ID NO: 111797 - RNA, 32 nt, Human
ccuaggcccuggggagcccaguccacugagca

SEQ ID NO: 111798 - RNA, 32 nt, Human
ccuaggcccuuuucagacuccugggcccuugg

SEQ ID NO: 111799 - RNA, 32 nt, Human
ccuaggccggucuugaacuccugggcucaagu

SEQ ID NO: 111800 - RNA, 32 nt, Human
ccuaggccucaagggacuuauaguuuauuuuu

SEQ ID NO: 111801 - RNA, 32 nt, Human
ccuaggcgaagauccggacucuggguguuuug

SEQ ID NO: 111802 - RNA, 20 nt, Human
ccuaggcgcgguucagguca

SEQ ID NO: 111803 - RNA, 32 nt, Human
ccuaggcggacggaucaccugaggucaggagu

SEQ ID NO: 111804 - RNA, 19 nt, Human
ccuaggcggaguacagugg

SEQ ID NO: 111805 - RNA, 32 nt, Human
ccuaggcggcaggcccaggaauggcuggguag

SEQ ID NO: 111806 - RNA, 32 nt, Human
ccuaggcgggcagaucaccugaggucaggagu

SEQ ID NO: 111807 - RNA, 32 nt, Human
ccuaggcgggcguaucaugaagucaggaguuc

SEQ ID NO: 111808 - RNA, 32 nt, Human
ccuaggcggguggaucaccugaggucaggagu

SEQ ID NO: 111809 - RNA, 32 nt, Human
ccuaggcguauguguauacacgcacagauauu

SEQ ID NO: 111810 - RNA, 31 nt, Human
ccuaggcgugggggcagauggguggacagcu

SEQ ID NO: 111811 - RNA, 32 nt, Human
ccuaggcuaagcaauccucccaccuuagccuc

SEQ ID NO: 111812 - RNA, 22 nt, Human
ccuaggcuagagggcagugaug

SEQ ID NO: 111813 - RNA, 32 nt, Human
ccuaggcucacugcaaccucagccuccugggc

SEQ ID NO: 111814 - RNA, 32 nt, Human
ccuaggcuccaauuaaaugauggccuccggau

SEQ ID NO: 111815 - RNA, 32 nt, Human
ccuaggcuccaccccauccaguucaugagaau

SEQ ID NO: 111816 - RNA, 32 nt, Human
ccuaggcucccauccuuuccaucaagaccuuc

SEQ ID NO: 111817 - RNA, 32 nt, Human
ccuaggcuccgugcaggaaugggugaaggccc

SEQ ID NO: 111818 - RNA, 32 nt, Human
ccuaggcugacuggauuugagaacaaauaccc

SEQ ID NO: 111819 - RNA, 19 nt, Human
ccuaggcugagugcagugg

SEQ ID NO: 111820 - RNA, 32 nt, Human
ccuaggcugaucucccucuccuggacucacau

SEQ ID NO: 111821 - RNA, 20 nt, Human
ccuaggcugcagugcagugg

SEQ ID NO: 111822 - RNA, 20 nt, Human
ccuaggcuggaaugcagugg

SEQ ID NO: 111823 - RNA, 22 nt, Human
ccuaggcuggaaugcaguggug

SEQ ID NO: 111824 - RNA, 20 nt, Human
ccuaggcuggaguacagugg

SEQ ID NO: 111825 - RNA, 20 nt, Human
ccuaggcuggagugaagugg

SEQ ID NO: 111826 - RNA, 19 nt, Human
ccuaggcuggagugcaaug

SEQ ID NO: 111827 - RNA, 20 nt, Human
ccuaggcuggagugcaaugg

SEQ ID NO: 111828 - RNA, 20 nt, Human
ccuaggcuggagugcagcgg

SEQ ID NO: 111829 - RNA, 18 nt, Human
ccuaggcuggagugcagu

SEQ ID NO: 111830 - RNA, 19 nt, Human
ccuaggcuggagugcagug

SEQ ID NO: 111831 - RNA, 20 nt, Human
ccuaggcuggagugcaguga

SEQ ID NO: 111832 - RNA, 20 nt, Human
ccuaggcuggagugcagugg

SEQ ID NO: 111833 - RNA, 22 nt, Human
ccuaggcuggagugcaguggug

SEQ ID NO: 111834 - RNA, 21 nt, Human
ccuaggcuggaguugcagugg

SEQ ID NO: 111835 - RNA, 32 nt, Human
ccuaggcuggaguuuacagagacacugcacag

SEQ ID NO: 111836 - RNA, 32 nt, Human
ccuaggcuggucucgaacuccugggcuuaaau

SEQ ID NO: 111837 - RNA, 32 nt, Human
ccuaggcuggucuugaacuccugggcucaagc

SEQ ID NO: 111838 - RNA, 32 nt, Human
ccuaggcuguggggaggggaggagaacugcuc

SEQ ID NO: 111839 - RNA, 32 nt, Human
ccuaggcuugucuggaacuccugggcucaagg

SEQ ID NO: 111840 - RNA, 22 nt, Human
ccuagggaaagagaaagaaaga

SEQ ID NO: 111841 - RNA, 32 nt, Human
ccuagggaacacugaggcaggaaaagcagggc

SEQ ID NO: 111842 - RNA, 19 nt, Human
ccuagggaacagacauugg

SEQ ID NO: 111843 - RNA, 18 nt, Human
ccuagggaagcccaucca

SEQ ID NO: 111844 - RNA, 32 nt, Human
ccuagggaaggugaggcgagguggggaguugg

SEQ ID NO: 111845 - RNA, 32 nt, Human
ccuagggaagugguucugucuccucacaggcu

SEQ ID NO: 111846 - RNA, 32 nt, Human
ccuagggaaugagguugauugggagcgcuuuc

SEQ ID NO: 111847 - RNA, 22 nt, Human
ccuagggaccagaaggagccag

SEQ ID NO: 111848 - RNA, 25 nt, Human
ccuagggaggcagagguuguaguga

SEQ ID NO: 111849 - RNA, 32 nt, Human
ccuagggaggcagagguuguagugagccaaga

SEQ ID NO: 111850 - RNA, 26 nt, Human
ccuagggagggcggggguugugguga

SEQ ID NO: 111851 - RNA, 32 nt, Human
ccuagggaggucgaggccacagugagcugaga

SEQ ID NO: 111852 - RNA, 32 nt, Human
ccuagggagucacacaguccccagggaaacuu

SEQ ID NO: 111853 - RNA, 27 nt, Human
ccuagggcacugggcuuccugucccca

SEQ ID NO: 111854 - RNA, 32 nt, Human
ccuagggcagccucugucugugugguuaaugu

SEQ ID NO: 111855 - RNA, 32 nt, Human
ccuagggccaaguguugccugccaccaaucag

SEQ ID NO: 111856 - RNA, 19 nt, Human
ccuagggccgcugcugccg

SEQ ID NO: 111857 - RNA, 32 nt, Human
ccuagggccgcugcugccgacagccauggagg

SEQ ID NO: 111858 - RNA, 21 nt, Human
ccuagggccuggcacacugca

SEQ ID NO: 111859 - RNA, 32 nt, Human
ccuagggccugugggugaaacacuccugugcc

SEQ ID NO: 111860 - RNA, 32 nt, Human
ccuagggcgggaggcgacauggagacaggggc

SEQ ID NO: 111861 - RNA, 27 nt, Human
ccuagggcgugaaacuuccuguuccca

SEQ ID NO: 111862 - RNA, 32 nt, Human
ccuagggcucccaacugaccucaggccucuga

SEQ ID NO: 111863 - RNA, 32 nt, Human
ccuagggcuggaagguuuagcagcagccuggu

SEQ ID NO: 111864 - RNA, 32 nt, Human
ccuagggcuuggucccccucuucugaggcccu

SEQ ID NO: 111865 - RNA, 32 nt, Human
ccuaggggaagaggagaagaggguaagggggc

SEQ ID NO: 111866 - RNA, 19 nt, Human
ccuaggggaagggggugca

SEQ ID NO: 111867 - RNA, 23 nt, Human
ccuaggggaaugagggggcucag

SEQ ID NO: 111868 - RNA, 26 nt, Human
ccuaggggacaggagccaggcuacug

SEQ ID NO: 111869 - RNA, 31 nt, Human
ccuaggggagaagagucuucacugggguucg

SEQ ID NO: 111870 - RNA, 22 nt, Human
ccuaggggagucccuguuccca

SEQ ID NO: 111871 - RNA, 32 nt, Human
ccuaggggcuccugccugcccaagcggcugag

SEQ ID NO: 111872 - RNA, 32 nt, Human
ccuaggggcugagaggugagcagcaggggagc

SEQ ID NO: 111873 - RNA, 32 nt, Human
ccuagggggagguggugauguugggaguggga

SEQ ID NO: 111874 - RNA, 21 nt, Human
ccuagggggcagagggugcag

SEQ ID NO: 111875 - RNA, 32 nt, Human
ccuagggguucgcuggcugagcacacaugauc

SEQ ID NO: 111876 - RNA, 18 nt, Human
ccuagggucccuccugcc

SEQ ID NO: 111877 - RNA, 32 nt, Human
ccuagggugaagccgggaggaaaaugaagagu

SEQ ID NO: 111878 - RNA, 32 nt, Human
ccuagggugaugaguucaccucucugggcauc

SEQ ID NO: 111879 - RNA, 32 nt, Human
ccuaggguucucguucucccagcuccagccuu

SEQ ID NO: 111880 - RNA, 32 nt, Human
ccuagguaacauagugagacccugucucauua

SEQ ID NO: 111881 - RNA, 32 nt, Human
ccuagguacacauguacaugcacuacaguuua

SEQ ID NO: 111882 - RNA, 32 nt, Human
ccuagguagcuaaagguugcaugaaggcccug

SEQ ID NO: 111883 - RNA, 32 nt, Human
ccuagguaggggaggauggugccuggagcaga

SEQ ID NO: 111884 - RNA, 32 nt, Human
ccuaggucacagccugcugggcugggucgcgu

SEQ ID NO: 111885 - RNA, 32 nt, Human
ccuagguccccagauggggagacugaggccgu

SEQ ID NO: 111886 - RNA, 32 nt, Human
ccuaggucucucuauuucuugaagaagagagc

SEQ ID NO: 111887 - RNA, 23 nt, Human
ccuaggucucuggcugcccauga

SEQ ID NO: 111888 - RNA, 32 nt, Human
ccuaggucugcugauuccuguccuggugagcu

SEQ ID NO: 111889 - RNA, 32 nt, Human
ccuaggugacagagggaaacuccaucuccagg

SEQ ID NO: 111890 - RNA, 22 nt, Human
ccuaggugagugggacacugca

SEQ ID NO: 111891 - RNA, 32 nt, Human
ccuaggugauggguugacaggagcagcaaacc

SEQ ID NO: 111892 - RNA, 32 nt, Human
ccuaggugauuuucacauuuuuaguuccucag

SEQ ID NO: 111893 - RNA, 32 nt, Human
ccuagguggaaaggaaagcaagucugcaguuc

SEQ ID NO: 111894 - RNA, 32 nt, Human
ccuagguggacaccagcucccgauaggaggca

SEQ ID NO: 111895 - RNA, 32 nt, Human
ccuagguggccaaggcuuccugcauugcuucc

SEQ ID NO: 111896 - RNA, 32 nt, Human
ccuaggugggagccaccacuccugccugcccc

SEQ ID NO: 111897 - RNA, 32 nt, Human
ccuaggugggcggaucacuugaggucaggagu

SEQ ID NO: 111898 - RNA, 32 nt, Human
ccuaggugggcggauugcuugaggucaggagu

SEQ ID NO: 111899 - RNA, 32 nt, Human
ccuaggugggcuaagguucugcucucagagcu

SEQ ID NO: 111900 - RNA, 24 nt, Human
ccuagguguugggauuacaggcgu

SEQ ID NO: 111901 - RNA, 32 nt, Human
ccuagguucaagugauucuacucucucagccu

SEQ ID NO: 111902 - RNA, 20 nt, Human
ccuagguuggagugcagugg

SEQ ID NO: 111903 - RNA, 23 nt, Human
ccuagguuggagugcaguggugu

SEQ ID NO: 111904 - RNA, 32 nt, Human
ccuagguugggugggagagggaagcaaugagg

SEQ ID NO: 111905 - RNA, 32 nt, Human
ccuaguaagcaucuacuucaggccaacaaggu

SEQ ID NO: 111906 - RNA, 32 nt, Human
ccuaguaauguuccagcuuuaccccagccuua

SEQ ID NO: 111907 - RNA, 32 nt, Human
ccuaguacggugccaugcuuugaagcuggacu

SEQ ID NO: 111908 - RNA, 32 nt, Human
ccuaguacugacaccauaugguuuaaaaccag

SEQ ID NO: 111909 - RNA, 32 nt, Human
ccuaguagaagcucacuugccaccucucaggg

SEQ ID NO: 111910 - RNA, 22 nt, Human
ccuaguagcuggcauuacaggc

SEQ ID NO: 111911 - RNA, 23 nt, Human
ccuaguagcugggacuacaggcg

SEQ ID NO: 111912 - RNA, 23 nt, Human
ccuaguagcugggacuacaggug

SEQ ID NO: 111913 - RNA, 23 nt, Human
ccuaguagcugggaugacaggcg

SEQ ID NO: 111914 - RNA, 22 nt, Human
ccuaguagcugggauuacaggc

SEQ ID NO: 111915 - RNA, 23 nt, Human
ccuaguagcugggauuacaggcg

SEQ ID NO: 111916 - RNA, 23 nt, Human
ccuaguagcugggauuacaggug

SEQ ID NO: 111917 - RNA, 23 nt, Human
ccuaguagcugggauuauaggcg

SEQ ID NO: 111918 - RNA, 22 nt, Human
ccuaguagcugggauugcaggc

SEQ ID NO: 111919 - RNA, 31 nt, Human
ccuaguaggcacuccuuugcuuccccacacu

SEQ ID NO: 111920 - RNA, 24 nt, Human
ccuaguaggcagagguugcaguga

SEQ ID NO: 111921 - RNA, 22 nt, Human
ccuaguaguugggauuacaggc

SEQ ID NO: 111922 - RNA, 32 nt, Human
ccuaguauacccacugcauccuacuccuaccu

SEQ ID NO: 111923 - RNA, 32 nt, Human
ccuagucaacagcagaccagccuggccaaugc

SEQ ID NO: 111924 - RNA, 32 nt, Human
ccuagucaaugccaccuaaauguauucacaaa

SEQ ID NO: 111925 - RNA, 20 nt, Human
ccuagucagcccacaccccu

SEQ ID NO: 111926 - RNA, 32 nt, Human
ccuaguccaacuuggggugggcaaggcaguca

SEQ ID NO: 111927 - RNA, 32 nt, Human
ccuaguccaggguccaccuacuccaggggguc

SEQ ID NO: 111928 - RNA, 21 nt, Human
ccuagucccgggcuggcggga

SEQ ID NO: 111929 - RNA, 32 nt, Human
ccuagucccugcccaagcuucucccccagcca

SEQ ID NO: 111930 - RNA, 32 nt, Human
ccuaguccucucauuccucccacccuccgaga

SEQ ID NO: 111931 - RNA, 32 nt, Human
ccuaguccucuuccugugcuucuuuuugaaag

SEQ ID NO: 111932 - RNA, 32 nt, Human
ccuaguccugaauuccuuucagaagcuccggc

SEQ ID NO: 111933 - RNA, 32 nt, Human
ccuaguccugagcgugucugugugcgagugga

SEQ ID NO: 111934 - RNA, 32 nt, Human
ccuaguccuugcaaauccaaaagucuggggga

SEQ ID NO: 111935 - RNA, 32 nt, Human
ccuaguccuuucucuguggagugggcugcaaa

SEQ ID NO: 111936 - RNA, 32 nt, Human
ccuaguccuuuuaaugcuguguguucuguuaa

SEQ ID NO: 111937 - RNA, 32 nt, Human
ccuagucuaggaggcacagaauucucauucug

SEQ ID NO: 111938 - RNA, 32 nt, Human
ccuagucucaaggacuugggcagcuucuggaa

SEQ ID NO: 111939 - RNA, 32 nt, Human
ccuagucugggcgacagagccagacuccaucu

SEQ ID NO: 111940 - RNA, 32 nt, Human
ccuagucuguaacucuuucugaggagcuguua

SEQ ID NO: 111941 - RNA, 17 nt, Human
ccuagucuuggcacugg

SEQ ID NO: 111942 - RNA, 32 nt, Human
ccuagugaaagccaaguggccuggagucuggg

SEQ ID NO: 111943 - RNA, 19 nt, Human
ccuagugaauaacaugagg

SEQ ID NO: 111944 - RNA, 32 nt, Human
ccuagugagggacuguguugacugacgagccg

SEQ ID NO: 111945 - RNA, 32 nt, Human
ccuagugagggcaggagagaggaggacgcaca

SEQ ID NO: 111946 - RNA, 32 nt, Human
ccuagugagggcugcaagaccauccugcccgg

SEQ ID NO: 111947 - RNA, 32 nt, Human
ccuagugaugaauuaggugggguccuuggcuc

SEQ ID NO: 111948 - RNA, 32 nt, Human
ccuagugcaggacuuuucucuguauguuuuca

SEQ ID NO: 111949 - RNA, 32 nt, Human
ccuagugccagccccucacacgccuucauccu

SEQ ID NO: 111950 - RNA, 32 nt, Human
ccuagugccuuagcuccaugcccggcugcagc

SEQ ID NO: 111951 - RNA, 32 nt, Human
ccuagugcucaugccccagaaaaggccacugg

SEQ ID NO: 111952 - RNA, 32 nt, Human
ccuagugcucccuucacuauccugugccuucc

SEQ ID NO: 111953 - RNA, 32 nt, Human
ccuaguggagcuaugagaagagaaccacuguc

SEQ ID NO: 111954 - RNA, 32 nt, Human
ccuaguggagcuaugagacaaaggccaccauc

SEQ ID NO: 111955 - RNA, 32 nt, Human
ccuaguggagcugagagaagagggucacuguc

SEQ ID NO: 111956 - RNA, 32 nt, Human
ccuaguggaggaggcucuucagucuccugauu

SEQ ID NO: 111957 - RNA, 32 nt, Human
ccuaguggcgcaugccuguaaucccagcugcu

SEQ ID NO: 111958 - RNA, 23 nt, Human
ccuaguggcugggauuacaggcg

SEQ ID NO: 111959 - RNA, 32 nt, Human
ccuagugggaaugacccccugagcaugcagag

SEQ ID NO: 111960 - RNA, 32 nt, Human
ccuagugggagagagugggggagaggaagaga

SEQ ID NO: 111961 - RNA, 32 nt, Human
ccuagugggccaggcugaccgcagagucucca

SEQ ID NO: 111962 - RNA, 32 nt, Human
ccuagugggcuucucaacuuuugauccucagc

SEQ ID NO: 111963 - RNA, 32 nt, Human
ccuagugggggaaagcccuuagucuuguacag

SEQ ID NO: 111964 - RNA, 32 nt, Human
ccuaguguugcugugaccuggugacagaaaug

SEQ ID NO: 111965 - RNA, 32 nt, Human
ccuaguuaaacucauuucacuucuccugggag

SEQ ID NO: 111966 - RNA, 32 nt, Human
ccuaguuaagaaaagaggagauaauguucguc

SEQ ID NO: 111967 - RNA, 32 nt, Human
ccuaguuaucagugucuuacugugaagaaaau

SEQ ID NO: 111968 - RNA, 32 nt, Human
ccuaguucaagcgauuuuccuaccucagccuc

SEQ ID NO: 111969 - RNA, 28 nt, Human
ccuaguucagugucugccucaugggaag

SEQ ID NO: 111970 - RNA, 32 nt, Human
ccuaguucccauauuuaagaccagucuuuguc

SEQ ID NO: 111971 - RNA, 23 nt, Human
ccuaguuccgauuagacuaagga

SEQ ID NO: 111972 - RNA, 32 nt, Human
ccuaguucuccaaauucacuucugccuuccuc

SEQ ID NO: 111973 - RNA, 32 nt, Human
ccuaguugcacuaaccauccugggcuuccugu

SEQ ID NO: 111974 - RNA, 19 nt, Human
ccuaguuuccauggcuccg

SEQ ID NO: 111975 - RNA, 32 nt, Human
ccuaguuuucuuuccuccuuuccuccucugac

SEQ ID NO: 111976 - RNA, 31 nt, Human
ccuaguuuugaugaauaaacaugggaaagcc

SEQ ID NO: 111977 - RNA, 32 nt, Human
ccuaguuuugaugaauaaacaugggaaagcca

SEQ ID NO: 111978 - RNA, 32 nt, Human
ccuauaaaagugcacauacgcaacuguguucu

SEQ ID NO: 111979 - RNA, 32 nt, Human
ccuauaaacccagcuacucaggaggcuugagg

SEQ ID NO: 111980 - RNA, 32 nt, Human
ccuauaaacccuccugcaacagaucauauugc

SEQ ID NO: 111981 - RNA, 32 nt, Human
ccuauaaccaacacucaacuacaaauaggcug

SEQ ID NO: 111982 - RNA, 32 nt, Human
ccuauaaccccagcacuuugggaggccaaggc

SEQ ID NO: 111983 - RNA, 32 nt, Human
ccuauaaccccagcuauuugggaggcugaggc

SEQ ID NO: 111984 - RNA, 32 nt, Human
ccuauaaccccagcucccuaggagaccaaggc

SEQ ID NO: 111985 - RNA, 32 nt, Human
ccuauaagaggaauuucuuuuccuucauucau

SEQ ID NO: 111986 - RNA, 32 nt, Human
ccuauaaggaagagagaagcugucuguacuuu

SEQ ID NO: 111987 - RNA, 32 nt, Human
ccuauaauacaaauacacaauccuccaagaau

SEQ ID NO: 111988 - RNA, 32 nt, Human
ccuauaauaccagcuacuccggaggcugaggc

SEQ ID NO: 111989 - RNA, 22 nt, Human
ccuauaaucccaacuacuuggg

SEQ ID NO: 111990 - RNA, 23 nt, Human
ccuauaaucccaacuacuuggga

SEQ ID NO: 111991 - RNA, 23 nt, Human
ccuauaaucccagcaauuuggga

SEQ ID NO: 111992 - RNA, 22 nt, Human
ccuauaaucccagcaccuuggg

SEQ ID NO: 111993 - RNA, 19 nt, Human
ccuauaaucccagcacuuu

SEQ ID NO: 111994 - RNA, 22 nt, Human
ccuauaaucccagcacuuuggg

SEQ ID NO: 111995 - RNA, 22 nt, Human
ccuauaaucccagcuacauggg

SEQ ID NO: 111996 - RNA, 23 nt, Human
ccuauaaucccagcuacauggga

SEQ ID NO: 111997 - RNA, 32 nt, Human
ccuauaaucccagcuacaugggaggcugaggc

SEQ ID NO: 111998 - RNA, 32 nt, Human
ccuauaaucccagcuacucagaaggccgaggu

SEQ ID NO: 111999 - RNA, 32 nt, Human
ccuauaaucccagcuacucaggaggcagaggc

SEQ ID NO: 112000 - RNA, 32 nt, Human
ccuauaaucccagcuacucaggaggcugaagc

SEQ ID NO: 112001 - RNA, 32 nt, Human
ccuauaaucccagcuacucaggaggcugaggc

SEQ ID NO: 112002 - RNA, 32 nt, Human
ccuauaaucccagcuacucaggagucugaggc

SEQ ID NO: 112003 - RNA, 32 nt, Human
ccuauaaucccagcuacuccagaggcugaggc

SEQ ID NO: 112004 - RNA, 32 nt, Human
ccuauaaucccagcuacucgagugccugaggc

SEQ ID NO: 112005 - RNA, 32 nt, Human
ccuauaaucccagcuacucgggaggcuaaggc

SEQ ID NO: 112006 - RNA, 32 nt, Human
ccuauaaucccagcuacucgggaggcugagac

SEQ ID NO: 112007 - RNA, 32 nt, Human
ccuauaaucccagcuacucgggaggcugaggc

SEQ ID NO: 112008 - RNA, 32 nt, Human
ccuauaaucccagcuacuggggaggcugaggc

SEQ ID NO: 112009 - RNA, 32 nt, Human
ccuauaaucccagcuacuuaggaggcugaggc

SEQ ID NO: 112010 - RNA, 22 nt, Human
ccuauaaucccagcuacuuggg

SEQ ID NO: 112011 - RNA, 23 nt, Human
ccuauaaucccagcuacuuggga

SEQ ID NO: 112012 - RNA, 32 nt, Human
ccuauaaucccagcuacuugggaggccaaggc

SEQ ID NO: 112013 - RNA, 32 nt, Human
ccuauaaucccagcuacuugggaggcuaagac

SEQ ID NO: 112014 - RNA, 32 nt, Human
ccuauaaucccagcuacuugggaggcuaaggc

SEQ ID NO: 112015 - RNA, 32 nt, Human
ccuauaaucccagcuacuugggaggcugaagc

SEQ ID NO: 112016 - RNA, 32 nt, Human
ccuauaaucccagcuacuugggaggcugaggc

SEQ ID NO: 112017 - RNA, 32 nt, Human
ccuauaaucccagcuauucuggaggcugaggc

SEQ ID NO: 112018 - RNA, 32 nt, Human
ccuauaaucccagcuauuugggaggcugaggc

SEQ ID NO: 112019 - RNA, 32 nt, Human
ccuauaaucccagguacucaggaggcugaggc

SEQ ID NO: 112020 - RNA, 22 nt, Human
ccuauaaucccaguuacucggg

SEQ ID NO: 112021 - RNA, 32 nt, Human
ccuauaauccuagcuacucagguggcggaggu

SEQ ID NO: 112022 - RNA, 22 nt, Human
ccuauaaucucagcuacucagg

SEQ ID NO: 112023 - RNA, 32 nt, Human
ccuauaaucucagcuacucaggaggcugaggc

SEQ ID NO: 112024 - RNA, 32 nt, Human
ccuauaaucucagcuacuugggaggcugaggc

SEQ ID NO: 112025 - RNA, 32 nt, Human
ccuauaaugaugucugauauuuaaauaggaaa

SEQ ID NO: 112026 - RNA, 32 nt, Human
ccuauaauuccagcuacucaggaggcugaggc

SEQ ID NO: 112027 - RNA, 32 nt, Human
ccuauaauuccagcuacucgggaggccgaggc

SEQ ID NO: 112028 - RNA, 32 nt, Human
ccuauaauuccagcuacuugagaggcugagau

SEQ ID NO: 112029 - RNA, 24 nt, Human
ccuauacaagucugacuucugcau

SEQ ID NO: 112030 - RNA, 32 nt, Human
ccuauacaaucaggcaaguacuggcuucacuu

SEQ ID NO: 112031 - RNA, 32 nt, Human
ccuauacacguggggcagagccagcagaggcc

SEQ ID NO: 112032 - RNA, 32 nt, Human
ccuauacagagacauaaccacacacacucaga

SEQ ID NO: 112033 - RNA, 18 nt, Human
ccuauacauuucuguuca

SEQ ID NO: 112034 - RNA, 32 nt, Human
ccuauaccaguauuuucuaguuuaaaggagga

SEQ ID NO: 112035 - RNA, 32 nt, Human
ccuauagccccagcuacucaggaagcuagagc

SEQ ID NO: 112036 - RNA, 32 nt, Human
ccuauagccccagcuacuugggaggcugaggu

SEQ ID NO: 112037 - RNA, 32 nt, Human
ccuauagccccagcuauucaggagacugaggc

SEQ ID NO: 112038 - RNA, 32 nt, Human
ccuauagccugauuuaugucacugccaauuuc

SEQ ID NO: 112039 - RNA, 32 nt, Human
ccuauagcuccagcuacucaggaggcugaggc

SEQ ID NO: 112040 - RNA, 32 nt, Human
ccuauagcuguaauuugugcauuuucauugcu

SEQ ID NO: 112041 - RNA, 32 nt, Human
ccuauagguggcagucccuggagaagugguca

SEQ ID NO: 112042 - RNA, 32 nt, Human
ccuauagguugcauacuaacuuaagcauucau

SEQ ID NO: 112043 - RNA, 32 nt, Human
ccuauagucccaccuacucaggaggcugaggc

SEQ ID NO: 112044 - RNA, 23 nt, Human
ccuauagucccagcacucugaga

SEQ ID NO: 112045 - RNA, 22 nt, Human
ccuauagucccagcacuuuggg

SEQ ID NO: 112046 - RNA, 23 nt, Human
ccuauagucccagcacuuuggga

SEQ ID NO: 112047 - RNA, 32 nt, Human
ccuauagucccagcuacacaggaggcugaggc

SEQ ID NO: 112048 - RNA, 32 nt, Human
ccuauagucccagcuacaugggaggcuaaggu

SEQ ID NO: 112049 - RNA, 22 nt, Human
ccuauagucccagcuacucaga

SEQ ID NO: 112050 - RNA, 32 nt, Human
ccuauagucccagcuacucagaagccugaggc

SEQ ID NO: 112051 - RNA, 23 nt, Human
ccuauagucccagcuacucagga

SEQ ID NO: 112052 - RNA, 32 nt, Human
ccuauagucccagcuacucaggaagcugagac

SEQ ID NO: 112053 - RNA, 32 nt, Human
ccuauagucccagcuacucaggaggccgaggc

SEQ ID NO: 112054 - RNA, 32 nt, Human
ccuauagucccagcuacucaggaggcugaggc

SEQ ID NO: 112055 - RNA, 32 nt, Human
ccuauagucccagcuacucaggaggcugaggu

SEQ ID NO: 112056 - RNA, 22 nt, Human
ccuauagucccagcuacucgga

SEQ ID NO: 112057 - RNA, 32 nt, Human
ccuauagucccagcuacucggaaggcugaagc

SEQ ID NO: 112058 - RNA, 22 nt, Human
ccuauagucccagcuacucggg

SEQ ID NO: 112059 - RNA, 23 nt, Human
ccuauagucccagcuacucggga

SEQ ID NO: 112060 - RNA, 32 nt, Human
ccuauagucccagcuacucgggaggcuaaggc

SEQ ID NO: 112061 - RNA, 32 nt, Human
ccuauagucccagcuacucgggaggcugaggc

SEQ ID NO: 112062 - RNA, 32 nt, Human
ccuauagucccagcuacucgggaggcugaggu

SEQ ID NO: 112063 - RNA, 32 nt, Human
ccuauagucccagcuacucgggagucugaaac

SEQ ID NO: 112064 - RNA, 32 nt, Human
ccuauagucccagcuacucuggaggcugaggc

SEQ ID NO: 112065 - RNA, 22 nt, Human
ccuauagucccagcuacuuggg

SEQ ID NO: 112066 - RNA, 23 nt, Human
ccuauagucccagcuacuuggga

SEQ ID NO: 112067 - RNA, 32 nt, Human
ccuauagucccagcuacuugggaggcugaggc

SEQ ID NO: 112068 - RNA, 32 nt, Human
ccuauagucccagcuacuugggaggcugcagc

SEQ ID NO: 112069 - RNA, 32 nt, Human
ccuauagucccagcuacuugggagguugaggu

SEQ ID NO: 112070 - RNA, 32 nt, Human
ccuauagucccagcuacuugggggccugaggc

SEQ ID NO: 112071 - RNA, 32 nt, Human
ccuauagucccagcuauucaggaggcugaggu

SEQ ID NO: 112072 - RNA, 32 nt, Human
ccuauagucccagcugcucaggaggcugaggc

SEQ ID NO: 112073 - RNA, 23 nt, Human
ccuauagucccagugacuuggga

SEQ ID NO: 112074 - RNA, 32 nt, Human
ccuauaguccuccagaacuuagaaaugccugu

SEQ ID NO: 112075 - RNA, 22 nt, Human
ccuauagucgcagcuacuuggg

SEQ ID NO: 112076 - RNA, 23 nt, Human
ccuauagucgcagcuacuuggga

SEQ ID NO: 112077 - RNA, 32 nt, Human
ccuauagucgcagcuacuugggaggcuggggc

SEQ ID NO: 112078 - RNA, 22 nt, Human
ccuauagucucagcuacucaga

SEQ ID NO: 112079 - RNA, 32 nt, Human
ccuauagucucagcuacucagaggcugaggca

SEQ ID NO: 112080 - RNA, 32 nt, Human
ccuauaguuccaguuacucaggaggcugaggu

SEQ ID NO: 112081 - RNA, 32 nt, Human
ccuauaucauguuccuguauccugccuguguu

SEQ ID NO: 112082 - RNA, 32 nt, Human
ccuauaucuccccauuuccucuccuuccccac

SEQ ID NO: 112083 - RNA, 32 nt, Human
ccuauaucugagagaccugugugaacuauuga

SEQ ID NO: 112084 - RNA, 32 nt, Human
ccuauaugggagaaaguuggguuaaaucaaaa

SEQ ID NO: 112085 - RNA, 32 nt, Human
ccuauauucauuacaacguccucccagcuuuc

SEQ ID NO: 112086 - RNA, 32 nt, Human
ccuauauuuaucugagugcugucuaaaacugu

SEQ ID NO: 112087 - RNA, 32 nt, Human
ccuaucaaagccucccggaggccaccgugcug

SEQ ID NO: 112088 - RNA, 32 nt, Human
ccuaucaaaguguugggauuacaggcuugagc

SEQ ID NO: 112089 - RNA, 32 nt, Human
ccuaucaaccuuucauguuuuacccuguuaaa

SEQ ID NO: 112090 - RNA, 32 nt, Human
ccuaucaacuuucugccccuccuucaaggccc

SEQ ID NO: 112091 - RNA, 32 nt, Human
ccuaucaauugggcugaugaugucaguguucc

SEQ ID NO: 112092 - RNA, 19 nt, Human
ccuaucacacucccucaca

SEQ ID NO: 112093 - RNA, 18 nt, Human
ccuaucacacucuucuca

SEQ ID NO: 112094 - RNA, 32 nt, Human
ccuaucacugagacucggcuugaguggcugcu

SEQ ID NO: 112095 - RNA, 32 nt, Human
ccuaucacuugucaagguagggagaggucaga

SEQ ID NO: 112096 - RNA, 32 nt, Human
ccuaucagaaguuucucagcucccaaggcucu

SEQ ID NO: 112097 - RNA, 32 nt, Human
ccuaucagauuuuauugcuccaacuuauaugg

SEQ ID NO: 112098 - RNA, 32 nt, Human
ccuaucagcacagggaucucagcucuggccug

SEQ ID NO: 112099 - RNA, 32 nt, Human
ccuaucagcagcugaccugugagaaggaggcg

SEQ ID NO: 112100 - RNA, 32 nt, Human
ccuaucagcccugccugccaggagaacagaac

SEQ ID NO: 112101 - RNA, 32 nt, Human
ccuaucagcuuuguuucgccugaucucaaguu

SEQ ID NO: 112102 - RNA, 32 nt, Human
ccuaucagggcagcucucaggauugucauuuu

SEQ ID NO: 112103 - RNA, 32 nt, Human
ccuaucagucaguagagagagauguccagaaa

SEQ ID NO: 112104 - RNA, 32 nt, Human
ccuaucagugauugccauuagacuguugaaua

SEQ ID NO: 112105 - RNA, 32 nt, Human
ccuaucauaauggucuuagucauuucacacaa

SEQ ID NO: 112106 - RNA, 21 nt, Human
ccuaucaugcuuccccuuccc

SEQ ID NO: 112107 - RNA, 32 nt, Human
ccuaucauggcaugcaagaaagcacaaugccu

SEQ ID NO: 112108 - RNA, 32 nt, Human
ccuauccagaaugcaucucuucugcuucccau

SEQ ID NO: 112109 - RNA, 32 nt, Human
ccuauccauaaaaugaagguagccaggccugc

SEQ ID NO: 112110 - RNA, 32 nt, Human
ccuauccaucauuaaaagguuuauuaucagug

SEQ ID NO: 112111 - RNA, 32 nt, Human
ccuaucccaaguaauuauuuacacguuucgcg

SEQ ID NO: 112112 - RNA, 28 nt, Human
ccuaucccaagugugauccuucauccca

SEQ ID NO: 112113 - RNA, 32 nt, Human
ccuaucccaaguuuuaugacaguuuuaauuga

SEQ ID NO: 112114 - RNA, 20 nt, Human
ccuaucccagagcgaugcug

SEQ ID NO: 112115 - RNA, 22 nt, Human
ccuaucccaguugaaccagcug

SEQ ID NO: 112116 - RNA, 22 nt, Human
ccuaucccauacccguccuucc

SEQ ID NO: 112117 - RNA, 32 nt, Human
ccuaucccccucaagcccccacaggagucacc

SEQ ID NO: 112118 - RNA, 32 nt, Human
ccuauccccucccuugcuccugaggccaaagc

SEQ ID NO: 112119 - RNA, 32 nt, Human
ccuaucccgacuaucguugcugguaagccugg

SEQ ID NO: 112120 - RNA, 32 nt, Human
ccuaucccugugccaggcaccaugaagcagga

SEQ ID NO: 112121 - RNA, 32 nt, Human
ccuauccugcacccucugcuaugucugugaug

SEQ ID NO: 112122 - RNA, 32 nt, Human
ccuauccugggaccuccacacuccugguucuc

SEQ ID NO: 112123 - RNA, 32 nt, Human
ccuauccugggcugcucaauguucccaggccc

SEQ ID NO: 112124 - RNA, 21 nt, Human
ccuaucgccaccugccagcca

SEQ ID NO: 112125 - RNA, 32 nt, Human
ccuaucgccccugucacucaggaaauuaccag

SEQ ID NO: 112126 - RNA, 21 nt, Human
ccuaucuaccauugccacuug

SEQ ID NO: 112127 - RNA, 20 nt, Human
ccuaucucaccugcccagcc

SEQ ID NO: 112128 - RNA, 22 nt, Human
ccuaucuccaagagacagagga

SEQ ID NO: 112129 - RNA, 18 nt, Human
ccuaucuccccuccuccc

SEQ ID NO: 112130 - RNA, 32 nt, Human
ccuaucuccccuccuccccuuuucuuuccuuc

SEQ ID NO: 112131 - RNA, 32 nt, Human
ccuaucuccuggggagggugaggcagggcagg

SEQ ID NO: 112132 - RNA, 25 nt, Human
ccuaucuccuucccaccccuacaca

SEQ ID NO: 112133 - RNA, 19 nt, Human
ccuaucucuucccucauca

SEQ ID NO: 112134 - RNA, 32 nt, Human
ccuaucugacccaucugcucccaccgaaguua

SEQ ID NO: 112135 - RNA, 32 nt, Human
ccuaucugaguuuccagccuguugcccugugg

SEQ ID NO: 112136 - RNA, 19 nt, Human
ccuaucugaucagacuuug

SEQ ID NO: 112137 - RNA, 32 nt, Human
ccuaucuggaguuuggccuuguuaaccuagua

SEQ ID NO: 112138 - RNA, 21 nt, Human
ccuaucuucagcccccucaaa

SEQ ID NO: 112139 - RNA, 20 nt, Human
ccuaucuucuccauucuaga

SEQ ID NO: 112140 - RNA, 32 nt, Human
ccuaucuucucccugcuuccucuccaucucau

SEQ ID NO: 112141 - RNA, 32 nt, Human
ccuaucuucuuaacuccaccuccgucugguuc

SEQ ID NO: 112142 - RNA, 32 nt, Human
ccuaucuucuuccucaaaaucuggugaccaag

SEQ ID NO: 112143 - RNA, 20 nt, Human
ccuaucuucuuuuucaugua

SEQ ID NO: 112144 - RNA, 25 nt, Human
ccuaucuugcccaccccaccagccc

SEQ ID NO: 112145 - RNA, 32 nt, Human
ccuaucuuggugcugauagcucucuaagggua

SEQ ID NO: 112146 - RNA, 32 nt, Human
ccuaucuuucuuucucuucuuccuuucuuuuc

SEQ ID NO: 112147 - RNA, 32 nt, Human
ccuaugaaaccauacacaucucauugaguaag

SEQ ID NO: 112148 - RNA, 28 nt, Human
ccuaugaaccuacagaaggugagcccag

SEQ ID NO: 112149 - RNA, 32 nt, Human
ccuaugacaaguuuauagagugaaagguaucu

SEQ ID NO: 112150 - RNA, 32 nt, Human
ccuaugacucggcucugccucccaguccgcac

SEQ ID NO: 112151 - RNA, 32 nt, Human
ccuaugagaagccacugcuuugggggcgccgg

SEQ ID NO: 112152 - RNA, 32 nt, Human
ccuaugaggaagauggaccuggacagacaguc

SEQ ID NO: 112153 - RNA, 32 nt, Human
ccuaugagugacuacaaaaaggauuagacuga

SEQ ID NO: 112154 - RNA, 32 nt, Human
ccuaugaguucaagaccagccuaggcaaugua

SEQ ID NO: 112155 - RNA, 32 nt, Human
ccuaugaucccagcuacuggggaggcugaggc

SEQ ID NO: 112156 - RNA, 32 nt, Human
ccuaugaucuggggaggugggaagaggaugag

SEQ ID NO: 112157 - RNA, 32 nt, Human
ccuaugauuuagcuggcaggccagguuuucuc

SEQ ID NO: 112158 - RNA, 32 nt, Human
ccuaugcauguaagcauuauuucccaaaccaa

SEQ ID NO: 112159 - RNA, 32 nt, Human
ccuaugccagccugggccugucuccaccggca

SEQ ID NO: 112160 - RNA, 32 nt, Human
ccuaugcccacggagcuaagagacaggaacac

SEQ ID NO: 112161 - RNA, 32 nt, Human
ccuaugcccagucuuuuugucuuggacuuauu

SEQ ID NO: 112162 - RNA, 32 nt, Human
ccuaugccccuggauggugacggcggauuggc

SEQ ID NO: 112163 - RNA, 32 nt, Human
ccuaugcccgggagcggcggcggcggcggcgg

SEQ ID NO: 112164 - RNA, 32 nt, Human
ccuaugcccuggaggugagggcagcucucuug

SEQ ID NO: 112165 - RNA, 32 nt, Human
ccuaugccucuaccccuccuccuuacccuacu

SEQ ID NO: 112166 - RNA, 32 nt, Human
ccuaugccuucccaugagucagucauuagagg

SEQ ID NO: 112167 - RNA, 32 nt, Human
ccuaugcuacacagucccugggggugaggauu

SEQ ID NO: 112168 - RNA, 32 nt, Human
ccuaugcugggaaagugaggauuugggauuuc

SEQ ID NO: 112169 - RNA, 32 nt, Human
ccuaugcuucaccuucagcuccugggaguucc

SEQ ID NO: 112170 - RNA, 32 nt, Human
ccuauggagcccugcccacagccccuggucau

SEQ ID NO: 112171 - RNA, 32 nt, Human
ccuauggagccuagaagaaaccuucacuugca

SEQ ID NO: 112172 - RNA, 32 nt, Human
ccuauggaggggcugugggccaggcugcucag

SEQ ID NO: 112173 - RNA, 28 nt, Human
ccuauggcaccaccaccgccuccuccac

SEQ ID NO: 112174 - RNA, 32 nt, Human
ccuauggcucaggccgaggcucaggcccaucu

SEQ ID NO: 112175 - RNA, 32 nt, Human
ccuauggcugaccguggcccagccucugcaac

SEQ ID NO: 112176 - RNA, 32 nt, Human
ccuaugggaggcagagcggcaaggacagggcu

SEQ ID NO: 112177 - RNA, 31 nt, Human
ccuaugggggagcugccucacguucucugac

SEQ ID NO: 112178 - RNA, 32 nt, Human
ccuaugguagcaauucugugcugguauaaauc

SEQ ID NO: 112179 - RNA, 32 nt, Human
ccuaugguauccuauaugggauagccuauugc

SEQ ID NO: 112180 - RNA, 32 nt, Human
ccuauggucaacaucugggcugugaugggcag

SEQ ID NO: 112181 - RNA, 20 nt, Human
ccuauggucacccccacuaa

SEQ ID NO: 112182 - RNA, 23 nt, Human
ccuauggucccagcuacucaaca

SEQ ID NO: 112183 - RNA, 32 nt, Human
ccuauggucccagcuacucaacaggcugaggu

SEQ ID NO: 112184 - RNA, 32 nt, Human
ccuaugguuauucaaaugguagagccaaaaau

SEQ ID NO: 112185 - RNA, 23 nt, Human
ccuaugguuccagcuacucagga

SEQ ID NO: 112186 - RNA, 32 nt, Human
ccuaugguuccagcuacucaggaggcugaggu

SEQ ID NO: 112187 - RNA, 32 nt, Human
ccuaugguuuuucugugucaaugugauuuaug

SEQ ID NO: 112188 - RNA, 32 nt, Human
ccuauguaauaggauauauccuaaguggggau

SEQ ID NO: 112189 - RNA, 32 nt, Human
ccuauguagcaucuaucuacccaucuaucuau

SEQ ID NO: 112190 - RNA, 32 nt, Human
ccuauguaguccgugcugacagcugcuccuag

SEQ ID NO: 112191 - RNA, 32 nt, Human
ccuaugucacccaggcuguggugcaguaagcc

SEQ ID NO: 112192 - RNA, 32 nt, Human
ccuaugucaccgaggcuacagugcagugguuc

SEQ ID NO: 112193 - RNA, 32 nt, Human
ccuauguccaaauuuucagccaccacagaccu

SEQ ID NO: 112194 - RNA, 23 nt, Human
ccuaugucuccccuuccucacca

SEQ ID NO: 112195 - RNA, 32 nt, Human
ccuaugugcaccacacauuccagugugcugag

SEQ ID NO: 112196 - RNA, 32 nt, Human
ccuaugugcagucacuccucucauuucuaaaa

SEQ ID NO: 112197 - RNA, 32 nt, Human
ccuaugugccagagguacugugcagugcugga

SEQ ID NO: 112198 - RNA, 32 nt, Human
ccuauguggcaaaaggucagccuugggguugg

SEQ ID NO: 112199 - RNA, 18 nt, Human
ccuauguggcccacagua

SEQ ID NO: 112200 - RNA, 32 nt, Human
ccuaugugggcuuccuggagcagaagcagcaa

SEQ ID NO: 112201 - RNA, 32 nt, Human
ccuauguggucuccaccauauucacacaccac

SEQ ID NO: 112202 - RNA, 23 nt, Human
ccuauguuuccagcuacuuggga

SEQ ID NO: 112203 - RNA, 32 nt, Human
ccuauguuuggcugcuagaacaugguuaccau

SEQ ID NO: 112204 - RNA, 32 nt, Human
ccuauuacggccugagucuggaugugucgggg

SEQ ID NO: 112205 - RNA, 22 nt, Human
ccuauuaguuggaggcugcagu

SEQ ID NO: 112206 - RNA, 32 nt, Human
ccuauuauacaggugaagacaccaagaguaga

SEQ ID NO: 112207 - RNA, 32 nt, Human
ccuauuaucccagcuacucgggaggccaaggc

SEQ ID NO: 112208 - RNA, 32 nt, Human
ccuauucaaccaucuugcccaccuacaagaca

SEQ ID NO: 112209 - RNA, 32 nt, Human
ccuauucaagacguccuggaaaacuacauuua

SEQ ID NO: 112210 - RNA, 32 nt, Human
ccuauucacuuccgagauucagacauagccau

SEQ ID NO: 112211 - RNA, 32 nt, Human
ccuauucagcagagaugcagcucugggaauga

SEQ ID NO: 112212 - RNA, 32 nt, Human
ccuauucaguggugcucucccacccaggggcc

SEQ ID NO: 112213 - RNA, 21 nt, Human
ccuauuccagaaaauaaauga

SEQ ID NO: 112214 - RNA, 32 nt, Human
ccuauucccuuuccuggucaccuucauggucc

SEQ ID NO: 112215 - RNA, 32 nt, Human
ccuauuccuaccccaucuauucucuguuggcu

SEQ ID NO: 112216 - RNA, 32 nt, Human
ccuauuccuaucucccccuuccgucucuguug

SEQ ID NO: 112217 - RNA, 32 nt, Human
ccuauuccucuccuccuccuccuccugggucc

SEQ ID NO: 112218 - RNA, 32 nt, Human
ccuauuccugaacuauaacaccugccaccacu

SEQ ID NO: 112219 - RNA, 32 nt, Human
ccuauucucauccauuccugcaaagaagaugc

SEQ ID NO: 112220 - RNA, 32 nt, Human
ccuauucugccacauuugccacccucugagcc

SEQ ID NO: 112221 - RNA, 32 nt, Human
ccuauucugguucauucagcacuuuuuggugg

SEQ ID NO: 112222 - RNA, 20 nt, Human
ccuauugcaacuucuguuca

SEQ ID NO: 112223 - RNA, 32 nt, Human
ccuauugccaucauucccuugucccugcucua

SEQ ID NO: 112224 - RNA, 32 nt, Human
ccuauugccaugaccuuccucacaucucuuua

SEQ ID NO: 112225 - RNA, 32 nt, Human
ccuauugcuccuaggcugcaaaccuguauagc

SEQ ID NO: 112226 - RNA, 32 nt, Human
ccuauugcuuaucuuggguuaaauuugagagu

SEQ ID NO: 112227 - RNA, 32 nt, Human
ccuauuggaagcagcagaaggccaugccaaag

SEQ ID NO: 112228 - RNA, 25 nt, Human
ccuauuggaaucccaauggcuccug

SEQ ID NO: 112229 - RNA, 32 nt, Human
ccuauugggcagcugggacuacaggcaugcau

SEQ ID NO: 112230 - RNA, 32 nt, Human
ccuauuguacuuauagguaaaccuugcaaaua

SEQ ID NO: 112231 - RNA, 32 nt, Human
ccuauugugccucuggcugcuguaugugugcg

SEQ ID NO: 112232 - RNA, 32 nt, Human
ccuauuguucuucuuggcauccuucuuaugcu

SEQ ID NO: 112233 - RNA, 20 nt, Human
ccuauuguuucauagaccca

SEQ ID NO: 112234 - RNA, 32 nt, Human
ccuauuuaggacgagauugaagacugacccuu

SEQ ID NO: 112235 - RNA, 32 nt, Human
ccuauuuauucccacaaaauguuggcauugcu

SEQ ID NO: 112236 - RNA, 32 nt, Human
ccuauuucacuaccaaaagaauuccuguucac

SEQ ID NO: 112237 - RNA, 32 nt, Human
ccuauuuccaggguuggucuuccugagaaggg

SEQ ID NO: 112238 - RNA, 32 nt, Human
ccuauuuccucaccuguuuacagugaaucaga

SEQ ID NO: 112239 - RNA, 32 nt, Human
ccuauuucuaucuccacuuugugccuggagag

SEQ ID NO: 112240 - RNA, 32 nt, Human
ccuauuucucccugucagguugcacagaugca

SEQ ID NO: 112241 - RNA, 32 nt, Human
ccuauuucucucacucugaccucucucucuua

SEQ ID NO: 112242 - RNA, 32 nt, Human
ccuauuucugguuauauaauugcucuccaauu

SEQ ID NO: 112243 - RNA, 30 nt, Human
ccuauuugccucuccuuucucucuguccug

SEQ ID NO: 112244 - RNA, 24 nt, Human
ccuauuugcugccgcugccauucu

SEQ ID NO: 112245 - RNA, 32 nt, Human
ccuauuuggaauuggaggcaaugaguggcaag

SEQ ID NO: 112246 - RNA, 32 nt, Human
ccuauuugugcaacgggaaagguguuuauggu

SEQ ID NO: 112247 - RNA, 32 nt, Human
ccuauuuucucccuccaccucuccucuccuuc

SEQ ID NO: 112248 - RNA, 32 nt, Human
ccuauuuugaaugcagaaaacagggucuggga

SEQ ID NO: 112249 - RNA, 24 nt, Human
ccuauuuugucccaaaccuacaca

SEQ ID NO: 112250 - RNA, 32 nt, Human
ccuauuuuucuuucuucuucuucuacaacugg

SEQ ID NO: 112251 - RNA, 32 nt, Human
ccuauuuuuguagugaccuguuuaugagaugc

SEQ ID NO: 112252 - RNA, 32 nt, Human
ccuauuuuuguggggagaagagggccugauua

SEQ ID NO: 112253 - RNA, 32 nt, Human
ccucaaaaagugcggaggaaguagcuggacag

SEQ ID NO: 112254 - RNA, 32 nt, Human
ccucaaaaauagaacaagagcacuccauccau

SEQ ID NO: 112255 - RNA, 32 nt, Human
ccucaaaacuccaagcccucggugcuugcuuu

SEQ ID NO: 112256 - RNA, 32 nt, Human
ccucaaaacugccacaccacagucucaccaac

SEQ ID NO: 112257 - RNA, 32 nt, Human
ccucaaaagaugauugcauucuaacuuuugug

SEQ ID NO: 112258 - RNA, 32 nt, Human
ccucaaaauggaggcagcgggggcggcggcgu

SEQ ID NO: 112259 - RNA, 32 nt, Human
ccucaaacacacuguuuccacccucuucuuga

SEQ ID NO: 112260 - RNA, 32 nt, Human
ccucaaacacuggccugugagcccuuuccaag

SEQ ID NO: 112261 - RNA, 32 nt, Human
ccucaaacagccgcugucucaucagugcccgg

SEQ ID NO: 112262 - RNA, 32 nt, Human
ccucaaacccaguuuggcccagccugguuggg

SEQ ID NO: 112263 - RNA, 32 nt, Human
ccucaaacccccagaaagugggaugggccugu

SEQ ID NO: 112264 - RNA, 32 nt, Human
ccucaaaccucacccugaccuccugcugccua

SEQ ID NO: 112265 - RNA, 32 nt, Human
ccucaaacuccuccuccucagccguggcaucc

SEQ ID NO: 112266 - RNA, 32 nt, Human
ccucaaacugacacaagaccuacagagaaaac

SEQ ID NO: 112267 - RNA, 32 nt, Human
ccucaaacuuggcgaacuuggagggagcuugu

SEQ ID NO: 112268 - RNA, 19 nt, Human
ccucaaagaaauccuccaa

SEQ ID NO: 112269 - RNA, 21 nt, Human
ccucaaagaagaguuaccuca

SEQ ID NO: 112270 - RNA, 32 nt, Human
ccucaaagcauccaccaugguggauggacuga

SEQ ID NO: 112271 - RNA, 32 nt, Human
ccucaaagccucucuuccuucucccucgcuuc

SEQ ID NO: 112272 - RNA, 32 nt, Human
ccucaaagcuccccaacuuccaccuccgcaga

SEQ ID NO: 112273 - RNA, 26 nt, Human
ccucaaagcuuauccagaaccuuccc

SEQ ID NO: 112274 - RNA, 32 nt, Human
ccucaaaggcaagcccugaccucagucacacg

SEQ ID NO: 112275 - RNA, 31 nt, Human
ccucaaaggcacuuaauuugauuuuuauuuu

SEQ ID NO: 112276 - RNA, 32 nt, Human
ccucaaagggccugggaaggugaggcaggcca

SEQ ID NO: 112277 - RNA, 32 nt, Human
ccucaaaguaaguuaggguaagaaaagauaau

SEQ ID NO: 112278 - RNA, 32 nt, Human
ccucaaaugacccacccaccucagccucccaa

SEQ ID NO: 112279 - RNA, 32 nt, Human
ccucaaauuccagaaguggaggcuccagccuc

SEQ ID NO: 112280 - RNA, 32 nt, Human
ccucaacaaaacugacaagcaaugaaguaaga

SEQ ID NO: 112281 - RNA, 19 nt, Human
ccucaacaaaggccauuuc

SEQ ID NO: 112282 - RNA, 18 nt, Human
ccucaacagaaugcauug

SEQ ID NO: 112283 - RNA, 32 nt, Human
ccucaacagacaccuccagcacagcuucacca

SEQ ID NO: 112284 - RNA, 22 nt, Human
ccucaacagauugccugcuccu

SEQ ID NO: 112285 - RNA, 32 nt, Human
ccucaacagccugugccucuggucuaccuuug

SEQ ID NO: 112286 - RNA, 32 nt, Human
ccucaacagggguccagggugcagugaacuca

SEQ ID NO: 112287 - RNA, 32 nt, Human
ccucaacaucacaggagaccucauccaccugg

SEQ ID NO: 112288 - RNA, 32 nt, Human
ccucaacaucugguaccagcacuccgcggcgg

SEQ ID NO: 112289 - RNA, 32 nt, Human
ccucaacauggagaaaccccaucucuacuaaa

SEQ ID NO: 112290 - RNA, 32 nt, Human
ccucaacauggagaaaccccgucucuacuaaa

SEQ ID NO: 112291 - RNA, 32 nt, Human
ccucaaccacaacuucugaccucccagggugu

SEQ ID NO: 112292 - RNA, 32 nt, Human
ccucaaccagcuacucaggaggcugggcagga

SEQ ID NO: 112293 - RNA, 32 nt, Human
ccucaacccacugcuggccagcuucuucagca

SEQ ID NO: 112294 - RNA, 19 nt, Human
ccucaaccccagcuucuga

SEQ ID NO: 112295 - RNA, 32 nt, Human
ccucaacccccugcuguagccuggugaagacc

SEQ ID NO: 112296 - RNA, 32 nt, Human
ccucaacccugacugcagauaagaaucacuug

SEQ ID NO: 112297 - RNA, 32 nt, Human
ccucaaccucauccucuccacagcugccucuu

SEQ ID NO: 112298 - RNA, 32 nt, Human
ccucaaccuccacccugucccauggcccaagg

SEQ ID NO: 112299 - RNA, 32 nt, Human
ccucaaccucccaggcuccaagcaguccuuuc

SEQ ID NO: 112300 - RNA, 32 nt, Human
ccucaaccucuucuccccacaaccccaacccc

SEQ ID NO: 112301 - RNA, 32 nt, Human
ccucaaccuguugcccuuucccaugagcuggc

SEQ ID NO: 112302 - RNA, 20 nt, Human
ccucaaccuucuggguucaa

SEQ ID NO: 112303 - RNA, 32 nt, Human
ccucaacgcccccauuccucugcucggcucug

SEQ ID NO: 112304 - RNA, 24 nt, Human
ccucaacuaacccagcagcagcgg

SEQ ID NO: 112305 - RNA, 32 nt, Human
ccucaacucaaaggaaaacacagagcauacca

SEQ ID NO: 112306 - RNA, 32 nt, Human
ccucaacucacugcaaccuccgcucccgguuu

SEQ ID NO: 112307 - RNA, 32 nt, Human
ccucaacucauucugucaccaguagaauucag

SEQ ID NO: 112308 - RNA, 20 nt, Human
ccucaacucccagcagcagu

SEQ ID NO: 112309 - RNA, 32 nt, Human
ccucaacucuacuggucccaauuggcccauac

SEQ ID NO: 112310 - RNA, 32 nt, Human
ccucaacugauccucgcaucucagccuccuga

SEQ ID NO: 112311 - RNA, 32 nt, Human
ccucaacugcuggcucuucuucccuuuguauu

SEQ ID NO: 112312 - RNA, 32 nt, Human
ccucaacuggaccuaggggaagaaggagauau

SEQ ID NO: 112313 - RNA, 17 nt, Human
ccucaacugucacccca

SEQ ID NO: 112314 - RNA, 32 nt, Human
ccucaacuucugccaccucucccugggcaaua

SEQ ID NO: 112315 - RNA, 32 nt, Human
ccucaagaaauggagaagcaucaugugccaag

SEQ ID NO: 112316 - RNA, 32 nt, Human
ccucaagaacaucgaucugaaggauucauaag

SEQ ID NO: 112317 - RNA, 32 nt, Human
ccucaagaaugagacaggaagugcaaaggaaa

SEQ ID NO: 112318 - RNA, 32 nt, Human
ccucaagaaugagacaggaagugcagaggaaa

SEQ ID NO: 112319 - RNA, 32 nt, Human
ccucaagacaccugggcagacacugcaagaug

SEQ ID NO: 112320 - RNA, 25 nt, Human
ccucaagacacggucacagaucaga

SEQ ID NO: 112321 - RNA, 32 nt, Human
ccucaagacccugcuuaauccuaacaauuuuc

SEQ ID NO: 112322 - RNA, 23 nt, Human
ccucaagacuaagggcuacagua

SEQ ID NO: 112323 - RNA, 17 nt, Human
ccucaagacucaccuca

SEQ ID NO: 112324 - RNA, 32 nt, Human
ccucaagacucucugaaugcugcuccacuguc

SEQ ID NO: 112325 - RNA, 32 nt, Human
ccucaagauccagugcaagugaagcagccagu

SEQ ID NO: 112326 - RNA, 32 nt, Human
ccucaagcaacccuccugccucagucuugcaa

SEQ ID NO: 112327 - RNA, 32 nt, Human
ccucaagcaaggaagcagagcacuguguaacc

SEQ ID NO: 112328 - RNA, 32 nt, Human
ccucaagcaauauuuuugauacagcaaguguc

SEQ ID NO: 112329 - RNA, 23 nt, Human
ccucaagcaauccacccaccuca

SEQ ID NO: 112330 - RNA, 23 nt, Human
ccucaagcaauccucccaccuca

SEQ ID NO: 112331 - RNA, 23 nt, Human
ccucaagcaauccuccugccuca

SEQ ID NO: 112332 - RNA, 23 nt, Human
ccucaagcaccacgcccuccagg

SEQ ID NO: 112333 - RNA, 23 nt, Human
ccucaagcagaccuacagcaagu

SEQ ID NO: 112334 - RNA, 20 nt, Human
ccucaagcaggaggcagcaa

SEQ ID NO: 112335 - RNA, 32 nt, Human
ccucaagcaucccucccagcuugaagugucaa

SEQ ID NO: 112336 - RNA, 32 nt, Human
ccucaagccaauuuccagaaccugccaccagg

SEQ ID NO: 112337 - RNA, 32 nt, Human
ccucaagcccuuaaaaucacuuuagaaacucu

SEQ ID NO: 112338 - RNA, 22 nt, Human
ccucaagccuggucugcuccuu

SEQ ID NO: 112339 - RNA, 23 nt, Human
ccucaagcgauccucccaccuca

SEQ ID NO: 112340 - RNA, 32 nt, Human
ccucaagcgauccucccaucucagccucccaa

SEQ ID NO: 112341 - RNA, 32 nt, Human
ccucaagcgauccucucaucucagccuccuga

SEQ ID NO: 112342 - RNA, 32 nt, Human
ccucaagcuccagggcagccuggccgagcagc

SEQ ID NO: 112343 - RNA, 32 nt, Human
ccucaagcugaacaagauuaaauuccuuauuu

SEQ ID NO: 112344 - RNA, 32 nt, Human
ccucaagcugccugugcaccccaguagcaccc

SEQ ID NO: 112345 - RNA, 32 nt, Human
ccucaagcugccugugcaccccaguagcacuc

SEQ ID NO: 112346 - RNA, 32 nt, Human
ccucaagcuggguuuuggaaagagcaugccua

SEQ ID NO: 112347 - RNA, 24 nt, Human
ccucaagcuucgcagcagcggcgg

SEQ ID NO: 112348 - RNA, 32 nt, Human
ccucaaggaaauucccugaccucucaauccuc

SEQ ID NO: 112349 - RNA, 32 nt, Human
ccucaaggagccucugcgacucggugucuaga

SEQ ID NO: 112350 - RNA, 32 nt, Human
ccucaaggauccucuuucugaccaucaagccu

SEQ ID NO: 112351 - RNA, 19 nt, Human
ccucaaggaucugucacgg

SEQ ID NO: 112352 - RNA, 32 nt, Human
ccucaaggauguaauucuagcccagggaagaa

SEQ ID NO: 112353 - RNA, 32 nt, Human
ccucaaggcacugaagcuggaggacucugucc

SEQ ID NO: 112354 - RNA, 32 nt, Human
ccucaaggcagauccgaaagccuaguaguuag

SEQ ID NO: 112355 - RNA, 32 nt, Human
ccucaaggcaguccccucccauccccauuccc

SEQ ID NO: 112356 - RNA, 32 nt, Human
ccucaaggccaugguggauaagcacaaggaga

SEQ ID NO: 112357 - RNA, 32 nt, Human
ccucaaggcucugaccuggaccccuguccccu

SEQ ID NO: 112358 - RNA, 32 nt, Human
ccucaaggcuggguguggaggcucacaccugu

SEQ ID NO: 112359 - RNA, 32 nt, Human
ccucaagggagccagcccugcccacgccuuga

SEQ ID NO: 112360 - RNA, 32 nt, Human
ccucaagggauaugagggaggagccaguuugc

SEQ ID NO: 112361 - RNA, 32 nt, Human
ccucaagggauuccuggcuggcuauguggugg

SEQ ID NO: 112362 - RNA, 32 nt, Human
ccucaagggcagauauuggacacuccuuauuu

SEQ ID NO: 112363 - RNA, 32 nt, Human
ccucaaggggagaaaaagucaagcaaugcuuc

SEQ ID NO: 112364 - RNA, 32 nt, Human
ccucaaguacuuccaggaccaccgcaacagag

SEQ ID NO: 112365 - RNA, 31 nt, Human
ccucaaguacuuuucuuuuggcagguacuug

SEQ ID NO: 112366 - RNA, 26 nt, Human
ccucaagucauuagcaucagcugcug

SEQ ID NO: 112367 - RNA, 32 nt, Human
ccucaagucugcgccccguccccagccagacc

SEQ ID NO: 112368 - RNA, 32 nt, Human
ccucaagugagcuggcucaggguggggcuguc

SEQ ID NO: 112369 - RNA, 23 nt, Human
ccucaagugauccacccaccuca

SEQ ID NO: 112370 - RNA, 32 nt, Human
ccucaagugauccacccaucucagccucccaa

SEQ ID NO: 112371 - RNA, 32 nt, Human
ccucaagugauccaccugucucagccuuccca

SEQ ID NO: 112372 - RNA, 23 nt, Human
ccucaagugauccucccaccuca

SEQ ID NO: 112373 - RNA, 23 nt, Human
ccucaagugauccuccugucuca

SEQ ID NO: 112374 - RNA, 23 nt, Human
ccucaagugauccucuugccuca

SEQ ID NO: 112375 - RNA, 23 nt, Human
ccucaagugaucugcccaccuca

SEQ ID NO: 112376 - RNA, 32 nt, Human
ccucaagugccacccucuacugacccucccag

SEQ ID NO: 112377 - RNA, 32 nt, Human
ccucaagugggaacugguggagggggcgcuag

SEQ ID NO: 112378 - RNA, 32 nt, Human
ccucaaguguuuggacaccugcuuuauucuuu

SEQ ID NO: 112379 - RNA, 32 nt, Human
ccucaaguuagcaucucuccuggguuuuagua

SEQ ID NO: 112380 - RNA, 32 nt, Human
ccucaaguuccagugcagagauccuacuucuc

SEQ ID NO: 112381 - RNA, 32 nt, Human
ccucaaguucuuggaccaguuugcagagugaa

SEQ ID NO: 112382 - RNA, 32 nt, Human
ccucaaguugcuacgguucagugagagaggca

SEQ ID NO: 112383 - RNA, 32 nt, Human
ccucaauaacacagccauuauugccacuugcu

SEQ ID NO: 112384 - RNA, 32 nt, Human
ccucaauaaugugaauggauuagugcuaggag

SEQ ID NO: 112385 - RNA, 32 nt, Human
ccucaaucaagugccuuuaaauagagcugcac

SEQ ID NO: 112386 - RNA, 32 nt, Human
ccucaaucacccaggccuaagcaauccuccca

SEQ ID NO: 112387 - RNA, 32 nt, Human
ccucaauccacagucuccaacaacaguuaaaa

SEQ ID NO: 112388 - RNA, 32 nt, Human
ccucaauccaggcuggaguugguuuauccuug

SEQ ID NO: 112389 - RNA, 23 nt, Human
ccucaauccccuucuccucgcca

SEQ ID NO: 112390 - RNA, 23 nt, Human
ccucaauccgggggacuuccaca

SEQ ID NO: 112391 - RNA, 32 nt, Human
ccucaauccucccacccaccaggcuggggcac

SEQ ID NO: 112392 - RNA, 32 nt, Human
ccucaauccuucaauaaaauguuuccagagcc

SEQ ID NO: 112393 - RNA, 32 nt, Human
ccucaauccuucccuuuucuucccaacuucua

SEQ ID NO: 112394 - RNA, 32 nt, Human
ccucaaugugccaggcucuuccucccaugaca

SEQ ID NO: 112395 - RNA, 17 nt, Human
ccucaaugugucaccuc

SEQ ID NO: 112396 - RNA, 30 nt, Human
ccucaaugugugcugaggugggcccugcuc

SEQ ID NO: 112397 - RNA, 32 nt, Human
ccucaauuauuuucuccuuucaacucuguuga

SEQ ID NO: 112398 - RNA, 32 nt, Human
ccucaauugccugccuguauuaauuuuaguuu

SEQ ID NO: 112399 - RNA, 32 nt, Human
ccucaauuuccuggugaauguggagaaaaaua

SEQ ID NO: 112400 - RNA, 32 nt, Human
ccucacaaaaggauucuuucaacuucuuuauu

SEQ ID NO: 112401 - RNA, 21 nt, Human
ccucacaaaccucaggauuga

SEQ ID NO: 112402 - RNA, 32 nt, Human
ccucacaaaggagagagggaagaaaagaucuu

SEQ ID NO: 112403 - RNA, 32 nt, Human
ccucacaaagugcuaggauuacaggcaugagc

SEQ ID NO: 112404 - RNA, 32 nt, Human
ccucacaaagugcugggauuacaggcaugaac

SEQ ID NO: 112405 - RNA, 32 nt, Human
ccucacaaagugcugggauuacaggcgugagc

SEQ ID NO: 112406 - RNA, 32 nt, Human
ccucacaaagugcugggauuacagguguaagc

SEQ ID NO: 112407 - RNA, 32 nt, Human
ccucacaaagugcugggauuauaggcaagagc

SEQ ID NO: 112408 - RNA, 32 nt, Human
ccucacaaaguguugagacuacaggcaugagc

SEQ ID NO: 112409 - RNA, 19 nt, Human
ccucacaacagucaccuca

SEQ ID NO: 112410 - RNA, 32 nt, Human
ccucacaaccaaaaggggaaagaauccugagu

SEQ ID NO: 112411 - RNA, 32 nt, Human
ccucacaaccaccuaaucaggcugaggugucu

SEQ ID NO: 112412 - RNA, 32 nt, Human
ccucacaacccccagccucagcuucccugaca

SEQ ID NO: 112413 - RNA, 24 nt, Human
ccucacaagagcaucagccuucua

SEQ ID NO: 112414 - RNA, 32 nt, Human
ccucacaagccgcagcggcuggugcccgggcu

SEQ ID NO: 112415 - RNA, 22 nt, Human
ccucacaagggcucucaaagua

SEQ ID NO: 112416 - RNA, 32 nt, Human
ccucacaaguagcuggaauuacaagcaugcac

SEQ ID NO: 112417 - RNA, 32 nt, Human
ccucacaaguagcugggauuacaggugcccgc

SEQ ID NO: 112418 - RNA, 32 nt, Human
ccucacaauaaaccagaccagaaggauguccc

SEQ ID NO: 112419 - RNA, 32 nt, Human
ccucacaauucagacugaggguugagacaaaa

SEQ ID NO: 112420 - RNA, 32 nt, Human
ccucacaccagccagacccaggaagagaaacu

SEQ ID NO: 112421 - RNA, 32 nt, Human
ccucacacccuugggcccucagcucuggugca

SEQ ID NO: 112422 - RNA, 32 nt, Human
ccucacaccugacagaugcacggcccaagggg

SEQ ID NO: 112423 - RNA, 20 nt, Human
ccucacaccugccucugguu

SEQ ID NO: 112424 - RNA, 32 nt, Human
ccucacaccugcuggacaucaggcuggggaga

SEQ ID NO: 112425 - RNA, 32 nt, Human
ccucacaccuggccuccucuggcuucagcuuc

SEQ ID NO: 112426 - RNA, 32 nt, Human
ccucacaccuguaaucucagcacuuugggugg

SEQ ID NO: 112427 - RNA, 32 nt, Human
ccucacaccuguaauuccagcacuuugggagg

SEQ ID NO: 112428 - RNA, 32 nt, Human
ccucacaccuuguucucuucugcucuagacag

SEQ ID NO: 112429 - RNA, 32 nt, Human
ccucacacgcagccacuucuucaagagcugcc

SEQ ID NO: 112430 - RNA, 32 nt, Human
ccucacacucauucucaacccccugacaaaac

SEQ ID NO: 112431 - RNA, 19 nt, Human
ccucacacucugguaccag

SEQ ID NO: 112432 - RNA, 32 nt, Human
ccucacacuguaggacucacacaugacuccaa

SEQ ID NO: 112433 - RNA, 22 nt, Human
ccucacacuuuuggaaccaugc

SEQ ID NO: 112434 - RNA, 32 nt, Human
ccucacagaaugcacacucuguaccacuggau

SEQ ID NO: 112435 - RNA, 32 nt, Human
ccucacagacugccugagcucuucuguaagcu

SEQ ID NO: 112436 - RNA, 32 nt, Human
ccucacagaggaagaaccgaggugggggcuug

SEQ ID NO: 112437 - RNA, 32 nt, Human
ccucacagauagugaaaacaggcuauugcucu

SEQ ID NO: 112438 - RNA, 32 nt, Human
ccucacagcaagcacagcucucuuucaggcuu

SEQ ID NO: 112439 - RNA, 23 nt, Human
ccucacagcagccgcggcacagg

SEQ ID NO: 112440 - RNA, 32 nt, Human
ccucacagcaggagacagggaaacugaguccc

SEQ ID NO: 112441 - RNA, 32 nt, Human
ccucacagccagcacgacccccagaaagaggc

SEQ ID NO: 112442 - RNA, 32 nt, Human
ccucacagccuagucacaguccugggcagugc

SEQ ID NO: 112443 - RNA, 32 nt, Human
ccucacagccuugccccuccccaaggcuggca

SEQ ID NO: 112444 - RNA, 32 nt, Human
ccucacagcggacucuccacacccagcucuug

SEQ ID NO: 112445 - RNA, 32 nt, Human
ccucacagcuacucaguggggcuggcaucaag

SEQ ID NO: 112446 - RNA, 32 nt, Human
ccucacagcugcagggccaggugcauggcccc

SEQ ID NO: 112447 - RNA, 32 nt, Human
ccucacagcuggccugcccucuugccaggaua

SEQ ID NO: 112448 - RNA, 32 nt, Human
ccucacaggagaaggacagcucuuccccaccc

SEQ ID NO: 112449 - RNA, 32 nt, Human
ccucacaggagccaccaccagccaccucucag

SEQ ID NO: 112450 - RNA, 32 nt, Human
ccucacaggccugcccugcagcuggaagacuc

SEQ ID NO: 112451 - RNA, 32 nt, Human
ccucacaggcggugcacguugcagucgguucu

SEQ ID NO: 112452 - RNA, 15 nt, Human
ccucacaggcuugug

SEQ ID NO: 112453 - RNA, 20 nt, Human
ccucacagggaggggagcag

SEQ ID NO: 112454 - RNA, 32 nt, Human
ccucacagggcugcaacaaccaguacucaugg

SEQ ID NO: 112455 - RNA, 23 nt, Human
ccucacaggggccuuucucacca

SEQ ID NO: 112456 - RNA, 25 nt, Human
ccucacagucacgccgcagcaugga

SEQ ID NO: 112457 - RNA, 32 nt, Human
ccucacagucugccccugucagggcucggucc

SEQ ID NO: 112458 - RNA, 32 nt, Human
ccucacagucuguagccaucugauauccuagg

SEQ ID NO: 112459 - RNA, 21 nt, Human
ccucacagugggcucuccagg

SEQ ID NO: 112460 - RNA, 32 nt, Human
ccucacauagacacucagacacccucacaaac

SEQ ID NO: 112461 - RNA, 32 nt, Human
ccucacaucugcugcuggccucggugggcucu

SEQ ID NO: 112462 - RNA, 32 nt, Human
ccucacaucuguaaucccaacacuuugggagg

SEQ ID NO: 112463 - RNA, 32 nt, Human
ccucacaucuguaaucccagcacuuugggagg

SEQ ID NO: 112464 - RNA, 32 nt, Human
ccucacauuucccacuugagguugaggcguac

SEQ ID NO: 112465 - RNA, 23 nt, Human
ccucaccaaccuucccauacaca

SEQ ID NO: 112466 - RNA, 23 nt, Human
ccucaccacacugaccacccuca

SEQ ID NO: 112467 - RNA, 32 nt, Human
ccucaccacaucuacacauacuccggcaucug

SEQ ID NO: 112468 - RNA, 21 nt, Human
ccucaccacuagcccacccug

SEQ ID NO: 112469 - RNA, 32 nt, Human
ccucaccagcacugucuuuugugugacucaug

SEQ ID NO: 112470 - RNA, 32 nt, Human
ccucaccagcucccagaguucccaucuccauc

SEQ ID NO: 112471 - RNA, 32 nt, Human
ccucaccaggguggcaggagaggcagagccuc

SEQ ID NO: 112472 - RNA, 32 nt, Human
ccucaccauagccuccuuccuccugggggcac

SEQ ID NO: 112473 - RNA, 32 nt, Human
ccucaccaucauccucccuuccucaucaucau

SEQ ID NO: 112474 - RNA, 32 nt, Human
ccucaccaucaucgugggcgucauguucuucg

SEQ ID NO: 112475 - RNA, 32 nt, Human
ccucaccauccacauuugucaucgucuauugg

SEQ ID NO: 112476 - RNA, 32 nt, Human
ccucaccauccagcugcaggcugagcaagaga

SEQ ID NO: 112477 - RNA, 32 nt, Human
ccucaccaugucuucucacaagacuuucagga

SEQ ID NO: 112478 - RNA, 32 nt, Human
ccucacccaagaagacuggaaagagacauauc

SEQ ID NO: 112479 - RNA, 28 nt, Human
ccucacccaaguggcggcaucuuacggc

SEQ ID NO: 112480 - RNA, 32 nt, Human
ccucacccacaagcaggcugugcagugccuga

SEQ ID NO: 112481 - RNA, 32 nt, Human
ccucacccacacacugggcgugaggagucuuu

SEQ ID NO: 112482 - RNA, 32 nt, Human
ccucacccacagauuguauuuaugucuauaua

SEQ ID NO: 112483 - RNA, 32 nt, Human
ccucacccacagccugcugggcccaccaccug

SEQ ID NO: 112484 - RNA, 32 nt, Human
ccucacccaccaacuguucccaugggggucug

SEQ ID NO: 112485 - RNA, 32 nt, Human
ccucacccagccaauccgaggcugcuucgcac

SEQ ID NO: 112486 - RNA, 32 nt, Human
ccucacccagcucugucaccuccugacugaac

SEQ ID NO: 112487 - RNA, 32 nt, Human
ccucacccaugggacuguagugcaauuaaacc

SEQ ID NO: 112488 - RNA, 18 nt, Human
ccucaccccacgcgggaa

SEQ ID NO: 112489 - RNA, 32 nt, Human
ccucaccccagcccuccaccucucggggacug

SEQ ID NO: 112490 - RNA, 32 nt, Human
ccucaccccagcugccugcugcuucugacgga

SEQ ID NO: 112491 - RNA, 20 nt, Human
ccucaccccaggacccuagg

SEQ ID NO: 112492 - RNA, 23 nt, Human
ccucacccccaugccuguccucc

SEQ ID NO: 112493 - RNA, 32 nt, Human
ccucaccccucaccauccuuccucaggacuug

SEQ ID NO: 112494 - RNA, 32 nt, Human
ccucaccccucagauugugccucugccagccu

SEQ ID NO: 112495 - RNA, 21 nt, Human
ccucaccccucuggagggccg

SEQ ID NO: 112496 - RNA, 32 nt, Human
ccucaccccugccacagacucugcacaccacu

SEQ ID NO: 112497 - RNA, 32 nt, Human
ccucaccccugccucacccuggucuaaggcac

SEQ ID NO: 112498 - RNA, 32 nt, Human
ccucaccccuguaaucccagcacuuugggugg

SEQ ID NO: 112499 - RNA, 32 nt, Human
ccucaccccuguugcccugccuucuucaaagg

SEQ ID NO: 112500 - RNA, 32 nt, Human
ccucaccccuuucccuuccucucuauuuauaa

SEQ ID NO: 112501 - RNA, 32 nt, Human
ccucacccucagccgucccaaggagugcccag

SEQ ID NO: 112502 - RNA, 32 nt, Human
ccucacccuccaggcugcugugagagugucaa

SEQ ID NO: 112503 - RNA, 32 nt, Human
ccucacccuccccgcgcuuccucuccgccccu

SEQ ID NO: 112504 - RNA, 32 nt, Human
ccucacccuggagggcccugggcccuggggaa

SEQ ID NO: 112505 - RNA, 32 nt, Human
ccucacccuggcuggggguccagcacaggcug

SEQ ID NO: 112506 - RNA, 32 nt, Human
ccucacccuuauccaggacccaacaacagaag

SEQ ID NO: 112507 - RNA, 32 nt, Human
ccucacccuucuggagcacggggccuggguga

SEQ ID NO: 112508 - RNA, 32 nt, Human
ccucaccgcaggcagcaguuugcauuuugaaa

SEQ ID NO: 112509 - RNA, 32 nt, Human
ccucaccgccucccaccgccacugaccgaccg

SEQ ID NO: 112510 - RNA, 32 nt, Human
ccucaccgcgaccuggcugagcuucagucauu

SEQ ID NO: 112511 - RNA, 20 nt, Human
ccucaccgcgcgccaccucu

SEQ ID NO: 112512 - RNA, 32 nt, Human
ccucaccgcgggcgcucuagccccgggcgggu

SEQ ID NO: 112513 - RNA, 21 nt, Human
ccucaccgcucagccagggug

SEQ ID NO: 112514 - RNA, 32 nt, Human
ccucaccggaaggcaugggguggcguguagac

SEQ ID NO: 112515 - RNA, 32 nt, Human
ccucaccucacaccugcucccugcugcugagc

SEQ ID NO: 112516 - RNA, 32 nt, Human
ccucaccucacagcauggagagaggagaccaa

SEQ ID NO: 112517 - RNA, 19 nt, Human
ccucaccucaggaccccag

SEQ ID NO: 112518 - RNA, 32 nt, Human
ccucaccuccacccccuccugucaccggccuu

SEQ ID NO: 112519 - RNA, 32 nt, Human
ccucaccuccacgcuaccacagaagagcgaaa

SEQ ID NO: 112520 - RNA, 32 nt, Human
ccucaccuccauccugucuacuaauccacagu

SEQ ID NO: 112521 - RNA, 32 nt, Human
ccucaccuccccaggcucaccuugccaugcca

SEQ ID NO: 112522 - RNA, 32 nt, Human
ccucaccuccccuucccucuugcccagggaac

SEQ ID NO: 112523 - RNA, 16 nt, Human
ccucaccuccucccca

SEQ ID NO: 112524 - RNA, 32 nt, Human
ccucaccucggacaugguggugggggaaggac

SEQ ID NO: 112525 - RNA, 19 nt, Human
ccucaccucucccucccca

SEQ ID NO: 112526 - RNA, 18 nt, Human
ccucaccucucucacccc

SEQ ID NO: 112527 - RNA, 32 nt, Human
ccucaccucugccucccucgcuccuccaacag

SEQ ID NO: 112528 - RNA, 21 nt, Human
ccucaccucuggcaccucuga

SEQ ID NO: 112529 - RNA, 32 nt, Human
ccucaccugcaacccaugugguucucagacuu

SEQ ID NO: 112530 - RNA, 32 nt, Human
ccucaccugcagcugcgccuccuugcaccugc

SEQ ID NO: 112531 - RNA, 32 nt, Human
ccucaccugccagacaacacccccuccuuccu

SEQ ID NO: 112532 - RNA, 32 nt, Human
ccucaccugccugccugucucccuccucuguc

SEQ ID NO: 112533 - RNA, 32 nt, Human
ccucaccugccuggccaaauucccucugggca

SEQ ID NO: 112534 - RNA, 32 nt, Human
ccucaccugcggugcccagcugcccaggcuga

SEQ ID NO: 112535 - RNA, 32 nt, Human
ccucaccugcucagaagucaggcugcaccugg

SEQ ID NO: 112536 - RNA, 32 nt, Human
ccucaccugcucccccugucucuuuggucuug

SEQ ID NO: 112537 - RNA, 17 nt, Human
ccucaccugcugcugcc

SEQ ID NO: 112538 - RNA, 23 nt, Human
ccucaccuggagcagcacagcag

SEQ ID NO: 112539 - RNA, 32 nt, Human
ccucaccugggaaguccaagaggucagggaac

SEQ ID NO: 112540 - RNA, 32 nt, Human
ccucaccuggugcccugaccucagccuccucc

SEQ ID NO: 112541 - RNA, 32 nt, Human
ccucaccuguaauccaaguacuuugggaggcc

SEQ ID NO: 112542 - RNA, 32 nt, Human
ccucaccuguguucucuucccucucucccaau

SEQ ID NO: 112543 - RNA, 32 nt, Human
ccucaccuucauccucaccaugcccugcuauc

SEQ ID NO: 112544 - RNA, 32 nt, Human
ccucaccuuccagcgccaggagcugcugcggc

SEQ ID NO: 112545 - RNA, 32 nt, Human
ccucaccuucccuguggucuucuucaagcaga

SEQ ID NO: 112546 - RNA, 32 nt, Human
ccucaccuuuacucccagacaugggagggaga

SEQ ID NO: 112547 - RNA, 32 nt, Human
ccucacgaggagcugggauugcaggcgcccgc

SEQ ID NO: 112548 - RNA, 32 nt, Human
ccucacgaggcaggagcccaugauucaugccc

SEQ ID NO: 112549 - RNA, 32 nt, Human
ccucacgaggcugagguggaaggaucaaguga

SEQ ID NO: 112550 - RNA, 32 nt, Human
ccucacgaguagcuggaauuacaggcaggcgc

SEQ ID NO: 112551 - RNA, 32 nt, Human
ccucacgaguagcugggacuacaggcaugcac

SEQ ID NO: 112552 - RNA, 32 nt, Human
ccucacgaguagcugggacuacaggcgccugc

SEQ ID NO: 112553 - RNA, 32 nt, Human
ccucacgaguagcugggauuacaggcaugcgc

SEQ ID NO: 112554 - RNA, 22 nt, Human
ccucacgcacccgcggcgcagg

SEQ ID NO: 112555 - RNA, 32 nt, Human
ccucacgcauuugaucacagacuguagaguuu

SEQ ID NO: 112556 - RNA, 32 nt, Human
ccucacgcccucucuuccucucagccuuccgc

SEQ ID NO: 112557 - RNA, 19 nt, Human
ccucacgccgccgccaccg

SEQ ID NO: 112558 - RNA, 32 nt, Human
ccucacgccuguaaucccagcacuuugggagg

SEQ ID NO: 112559 - RNA, 19 nt, Human
ccucacgccugucauccca

SEQ ID NO: 112560 - RNA, 32 nt, Human
ccucacgccugucaucccagcacuuugggagg

SEQ ID NO: 112561 - RNA, 32 nt, Human
ccucacgcuggagcuggagugcgagguucuua

SEQ ID NO: 112562 - RNA, 32 nt, Human
ccucacggcauggccucugccuuccccagagc

SEQ ID NO: 112563 - RNA, 32 nt, Human
ccucacggcugaagacggggacacagucauug

SEQ ID NO: 112564 - RNA, 32 nt, Human
ccucacggggugggguggggccuccaagagug

SEQ ID NO: 112565 - RNA, 32 nt, Human
ccucacgguccugggccugccugcucuggcca

SEQ ID NO: 112566 - RNA, 32 nt, Human
ccucacggugaccucuuucggcccaacucaug

SEQ ID NO: 112567 - RNA, 32 nt, Human
ccucacggugcuccagcuccacacaccguacu

SEQ ID NO: 112568 - RNA, 32 nt, Human
ccucacguccuuaacugugcucucccuccuuu

SEQ ID NO: 112569 - RNA, 32 nt, Human
ccucacgugcccgcaggccuggggaaggugga

SEQ ID NO: 112570 - RNA, 23 nt, Human
ccucacgugcugcugccuucucu

SEQ ID NO: 112571 - RNA, 32 nt, Human
ccucacgugcugcugccuucucugccucccac

SEQ ID NO: 112572 - RNA, 32 nt, Human
ccucacguggcugaggccaccgcugggacugc

SEQ ID NO: 112573 - RNA, 32 nt, Human
ccucacguuaacguacacacacaaacacacgc

SEQ ID NO: 112574 - RNA, 32 nt, Human
ccucacguuccugguccaggcuguccagcugc

SEQ ID NO: 112575 - RNA, 32 nt, Human
ccucacuacaaccccugccuccuggguuuuag

SEQ ID NO: 112576 - RNA, 32 nt, Human
ccucacuacccacaugcugaucuauuggggaa

SEQ ID NO: 112577 - RNA, 32 nt, Human
ccucacucaagggauccaaggcugccucuucc

SEQ ID NO: 112578 - RNA, 28 nt, Human
ccucacucacccagccagcccuucaggu

SEQ ID NO: 112579 - RNA, 22 nt, Human
ccucacucaccccacccucccc

SEQ ID NO: 112580 - RNA, 32 nt, Human
ccucacucaccucaucccagucacaucucugu

SEQ ID NO: 112581 - RNA, 32 nt, Human
ccucacucacugcaacuggaucuucagccucc

SEQ ID NO: 112582 - RNA, 32 nt, Human
ccucacucacuggcuuugugcuucucuucccg

SEQ ID NO: 112583 - RNA, 32 nt, Human
ccucacucagcagucuggguagggcccuuuga

SEQ ID NO: 112584 - RNA, 32 nt, Human
ccucacucagcccaggcaggugucucuaucag

SEQ ID NO: 112585 - RNA, 25 nt, Human
ccucacucagccuuuucccuccagg

SEQ ID NO: 112586 - RNA, 32 nt, Human
ccucacuccagccugggcaacauagugagacc

SEQ ID NO: 112587 - RNA, 32 nt, Human
ccucacuccagccugggugacagcguaagacu

SEQ ID NO: 112588 - RNA, 32 nt, Human
ccucacucccuuuucuuaccaucccagaaaau

SEQ ID NO: 112589 - RNA, 32 nt, Human
ccucacuccgccugccggcugggaaacuaggg

SEQ ID NO: 112590 - RNA, 32 nt, Human
ccucacucucaugcaggcuuuccucuuguguu

SEQ ID NO: 112591 - RNA, 32 nt, Human
ccucacucucucucuugcuccugcuuuugcug

SEQ ID NO: 112592 - RNA, 32 nt, Human
ccucacucuggccuugcugcuucucuccagcu

SEQ ID NO: 112593 - RNA, 32 nt, Human
ccucacucuggguccgaggccugggaugagcc

SEQ ID NO: 112594 - RNA, 32 nt, Human
ccucacucugucuccauuggccuacuuguuca

SEQ ID NO: 112595 - RNA, 19 nt, Human
ccucacucuucuccaggcc

SEQ ID NO: 112596 - RNA, 32 nt, Human
ccucacucuuucuccugaagccuugugaagaa

SEQ ID NO: 112597 - RNA, 32 nt, Human
ccucacugaaacauggcuguguuugcagccug

SEQ ID NO: 112598 - RNA, 32 nt, Human
ccucacugaaaccagguggccggcuccucgga

SEQ ID NO: 112599 - RNA, 32 nt, Human
ccucacugacaccccugccugccuuugucaga

SEQ ID NO: 112600 - RNA, 32 nt, Human
ccucacugacaguucuuuuucucugaauucuc

SEQ ID NO: 112601 - RNA, 32 nt, Human
ccucacugaccuuggaggaugccuguggccuu

SEQ ID NO: 112602 - RNA, 20 nt, Human
ccucacugagcccagcggga

SEQ ID NO: 112603 - RNA, 32 nt, Human
ccucacugaggcaccccacuuccagugaagaa

SEQ ID NO: 112604 - RNA, 32 nt, Human
ccucacugcaaccuccaccuccuagguucaag

SEQ ID NO: 112605 - RNA, 32 nt, Human
ccucacugcaaccuccgccuccuggguucaag

SEQ ID NO: 112606 - RNA, 32 nt, Human
ccucacugcaacuugcgccucccggguucaag

SEQ ID NO: 112607 - RNA, 32 nt, Human
ccucacugcacgcuagccugggcaacagauug

SEQ ID NO: 112608 - RNA, 32 nt, Human
ccucacugcagccucaaucuuagcugggucua

SEQ ID NO: 112609 - RNA, 32 nt, Human
ccucacugcagccucggcuuccugggcucagg

SEQ ID NO: 112610 - RNA, 32 nt, Human
ccucacugcagcuucaacuuccugggcucaag

SEQ ID NO: 112611 - RNA, 32 nt, Human
ccucacugcauacucuuuaauaguaccaggca

SEQ ID NO: 112612 - RNA, 32 nt, Human
ccucacugcauuccagccugggcaacagagaa

SEQ ID NO: 112613 - RNA, 32 nt, Human
ccucacugccaaguggagacuggggcgugugc

SEQ ID NO: 112614 - RNA, 18 nt, Human
ccucacugccacccagag

SEQ ID NO: 112615 - RNA, 18 nt, Human
ccucacugccauggcaca

SEQ ID NO: 112616 - RNA, 32 nt, Human
ccucacugcggccucaaacuccugggcucaag

SEQ ID NO: 112617 - RNA, 18 nt, Human
ccucacugcugaaucccu

SEQ ID NO: 112618 - RNA, 32 nt, Human
ccucacugcugccucaacuuccugggcucaag

SEQ ID NO: 112619 - RNA, 32 nt, Human
ccucacuggcacugcugacccaucccagaaac

SEQ ID NO: 112620 - RNA, 21 nt, Human
ccucacuggcauccccaaaca

SEQ ID NO: 112621 - RNA, 32 nt, Human
ccucacuggccuggccuugugggggcuccaga

SEQ ID NO: 112622 - RNA, 24 nt, Human
ccucacugggagcuuccccauccu

SEQ ID NO: 112623 - RNA, 32 nt, Human
ccucacugggaugucagaagacauucaaggaa

SEQ ID NO: 112624 - RNA, 32 nt, Human
ccucacuggugaaacccaggauguagauagag

SEQ ID NO: 112625 - RNA, 32 nt, Human
ccucacugugguaaaugccacacaccuuuaag

SEQ ID NO: 112626 - RNA, 32 nt, Human
ccucacuuagaaaaggcauacaggaggccggg

SEQ ID NO: 112627 - RNA, 32 nt, Human
ccucacuuccaaugcugccuugaucucugucu

SEQ ID NO: 112628 - RNA, 20 nt, Human
ccucacuuccucccucuccc

SEQ ID NO: 112629 - RNA, 32 nt, Human
ccucacuuccucccucucccccauccuuccau

SEQ ID NO: 112630 - RNA, 32 nt, Human
ccucacuuccuccugguggucccguugucucu

SEQ ID NO: 112631 - RNA, 32 nt, Human
ccucacuucuagaucucagccauucuaacuca

SEQ ID NO: 112632 - RNA, 32 nt, Human
ccucacuucugccccgacuuguggcucggacc

SEQ ID NO: 112633 - RNA, 32 nt, Human
ccucacuugccgcgucgcccucccaggcucuc

SEQ ID NO: 112634 - RNA, 32 nt, Human
ccucacuugcucaaaaacaacuaccuggagaa

SEQ ID NO: 112635 - RNA, 32 nt, Human
ccucacuugucaacaagaaccuucuggaagag

SEQ ID NO: 112636 - RNA, 32 nt, Human
ccucacuuuaagucucucccagucacauuguu

SEQ ID NO: 112637 - RNA, 32 nt, Human
ccucacuuuccaccacugucagccuggaaaga

SEQ ID NO: 112638 - RNA, 32 nt, Human
ccucacuuuccccucacccaucccuuuaaagu

SEQ ID NO: 112639 - RNA, 32 nt, Human
ccucacuuuccuguccccuccuaggcucuccc

SEQ ID NO: 112640 - RNA, 32 nt, Human
ccucagaaaccagagccaugagaccuaccaua

SEQ ID NO: 112641 - RNA, 32 nt, Human
ccucagaaaggcugguggcaucaggaagcccc

SEQ ID NO: 112642 - RNA, 32 nt, Human
ccucagaacucugccauguugccucgucagac

SEQ ID NO: 112643 - RNA, 19 nt, Human
ccucagaacuggucuauuu

SEQ ID NO: 112644 - RNA, 22 nt, Human
ccucagaagcccagaccugggg

SEQ ID NO: 112645 - RNA, 31 nt, Human
ccucagaaggcacuccugucacuggagauac

SEQ ID NO: 112646 - RNA, 32 nt, Human
ccucagaaggcagaggaagccuugaggugggg

SEQ ID NO: 112647 - RNA, 27 nt, Human
ccucagaagugguaccaucgccuucca

SEQ ID NO: 112648 - RNA, 32 nt, Human
ccucagaaugaacuggauugugguguucacaa

SEQ ID NO: 112649 - RNA, 32 nt, Human
ccucagacacccgggccuucucagccuucucc

SEQ ID NO: 112650 - RNA, 20 nt, Human
ccucagacacgggcccuggg

SEQ ID NO: 112651 - RNA, 32 nt, Human
ccucagacagcagcuguccccugugguggugu

SEQ ID NO: 112652 - RNA, 32 nt, Human
ccucagacaggucccugaaggagucugaggcu

SEQ ID NO: 112653 - RNA, 22 nt, Human
ccucagacaguaaccaugggga

SEQ ID NO: 112654 - RNA, 32 nt, Human
ccucagacaucuuuucccucccucucucuuuc

SEQ ID NO: 112655 - RNA, 32 nt, Human
ccucagacauucuguuucaucucccauucauc

SEQ ID NO: 112656 - RNA, 32 nt, Human
ccucagaccauccuugcugucccuucacccuc

SEQ ID NO: 112657 - RNA, 32 nt, Human
ccucagacccuccucuggccccggccuugccc

SEQ ID NO: 112658 - RNA, 20 nt, Human
ccucagaccugagaaccugg

SEQ ID NO: 112659 - RNA, 22 nt, Human
ccucagaccuuggagcccaagg

SEQ ID NO: 112660 - RNA, 32 nt, Human
ccucagacucucccaaucccugauuuuuacau

SEQ ID NO: 112661 - RNA, 32 nt, Human
ccucagacugggcuccacacucuugggcuuca

SEQ ID NO: 112662 - RNA, 32 nt, Human
ccucagacuuaaagcagcucagagccaaacac

SEQ ID NO: 112663 - RNA, 32 nt, Human
ccucagagaagaggugguuuagagcaaggaaa

SEQ ID NO: 112664 - RNA, 32 nt, Human
ccucagagaauuagguaacuuguucaaaaugg

SEQ ID NO: 112665 - RNA, 32 nt, Human
ccucagagacccacuucucucuuuugcaugga

SEQ ID NO: 112666 - RNA, 32 nt, Human
ccucagagacuuagaucuuccaccucacuccc

SEQ ID NO: 112667 - RNA, 32 nt, Human
ccucagagagcccucuggauggccgccucucc

SEQ ID NO: 112668 - RNA, 32 nt, Human
ccucagagauuuuggccuagauuugcaaaaug

SEQ ID NO: 112669 - RNA, 32 nt, Human
ccucagagcaggcucagacucugggucccucg

SEQ ID NO: 112670 - RNA, 32 nt, Human
ccucagagcaucuuacccuaagccacagaggu

SEQ ID NO: 112671 - RNA, 25 nt, Human
ccucagagccaaggcagacagacuc

SEQ ID NO: 112672 - RNA, 24 nt, Human
ccucagagccagcuucuccucuca

SEQ ID NO: 112673 - RNA, 32 nt, Human
ccucagagcccaggccucaguggucauuaaga

SEQ ID NO: 112674 - RNA, 26 nt, Human
ccucagagcccucugggcuuccucca

SEQ ID NO: 112675 - RNA, 32 nt, Human
ccucagagcccugcucuuugccuggaugguuc

SEQ ID NO: 112676 - RNA, 32 nt, Human
ccucagagcuccagggagcacaggaggugugc

SEQ ID NO: 112677 - RNA, 20 nt, Human
ccucagagcuguccagcagc

SEQ ID NO: 112678 - RNA, 25 nt, Human
ccucagaggagcucuacccugcucc

SEQ ID NO: 112679 - RNA, 32 nt, Human
ccucagaggaggaggaggaggaggcagcuccg

SEQ ID NO: 112680 - RNA, 24 nt, Human
ccucagaggcagagguugcaauga

SEQ ID NO: 112681 - RNA, 32 nt, Human
ccucagaguuggagugccuggcucucuggugg

SEQ ID NO: 112682 - RNA, 32 nt, Human
ccucagauauccugcuggaugacauuguccuu

SEQ ID NO: 112683 - RNA, 32 nt, Human
ccucagaucagccugcgacugcaagauucuua

SEQ ID NO: 112684 - RNA, 32 nt, Human
ccucagaucaggaauaccagauaaaugacguu

SEQ ID NO: 112685 - RNA, 22 nt, Human
ccucagaucaggugcaccuggg

SEQ ID NO: 112686 - RNA, 32 nt, Human
ccucagaucugccucccaagacccagcuccug

SEQ ID NO: 112687 - RNA, 17 nt, Human
ccucagaugcuucacuu

SEQ ID NO: 112688 - RNA, 32 nt, Human
ccucagauggggagggacagggucggccugua

SEQ ID NO: 112689 - RNA, 23 nt, Human
ccucagauuacaaacagcagugg

SEQ ID NO: 112690 - RNA, 32 nt, Human
ccucagauucacugcagcucuccucuuaauau

SEQ ID NO: 112691 - RNA, 32 nt, Human
ccucagauuccauuugguccucuccuuccugg

SEQ ID NO: 112692 - RNA, 32 nt, Human
ccucagauuucucaggagaccagaacugaucu

SEQ ID NO: 112693 - RNA, 32 nt, Human
ccucagcaaaaacaacaaaacuagaagcaccc

SEQ ID NO: 112694 - RNA, 32 nt, Human
ccucagcaagggugcaaagggggaagaacuag

SEQ ID NO: 112695 - RNA, 32 nt, Human
ccucagcaauacagagagacccuaucucuaca

SEQ ID NO: 112696 - RNA, 32 nt, Human
ccucagcaccacccuccaucccugcccaacca

SEQ ID NO: 112697 - RNA, 18 nt, Human
ccucagcaccugcugcau

SEQ ID NO: 112698 - RNA, 32 nt, Human
ccucagcagaagaguggcagcugagagagagg

SEQ ID NO: 112699 - RNA, 32 nt, Human
ccucagcagagccgcuuccuggugcuacgcag

SEQ ID NO: 112700 - RNA, 32 nt, Human
ccucagcagauccugaagaucuucguggacaa

SEQ ID NO: 112701 - RNA, 32 nt, Human
ccucagcagccuguggcugccucccucaccuc

SEQ ID NO: 112702 - RNA, 32 nt, Human
ccucagcagcuucucccugucuuccucuccuc

SEQ ID NO: 112703 - RNA, 32 nt, Human
ccucagcaggaccugggcuggccucuccaccu

SEQ ID NO: 112704 - RNA, 20 nt, Human
ccucagcaggcccccagggc

SEQ ID NO: 112705 - RNA, 32 nt, Human
ccucagcagggacccagcacagcaauccgguu

SEQ ID NO: 112706 - RNA, 32 nt, Human
ccucagcagugugguucugugucuacuuccau

SEQ ID NO: 112707 - RNA, 32 nt, Human
ccucagcaucacagccgcagcucuguucagcg

SEQ ID NO: 112708 - RNA, 21 nt, Human
ccucagcauucccugucccuu

SEQ ID NO: 112709 - RNA, 19 nt, Human
ccucagccaaacacagagc

SEQ ID NO: 112710 - RNA, 32 nt, Human
ccucagccaagugcuuuggcccggugcuuccc

SEQ ID NO: 112711 - RNA, 18 nt, Human
ccucagccacacggcaca

SEQ ID NO: 112712 - RNA, 32 nt, Human
ccucagccaccugcccgccacauccucugccu

SEQ ID NO: 112713 - RNA, 32 nt, Human
ccucagccacucaacaugaagacaacgaggau

SEQ ID NO: 112714 - RNA, 32 nt, Human
ccucagccacuucuagcacaaccagaggccca

SEQ ID NO: 112715 - RNA, 32 nt, Human
ccucagccagccugccugcccagcgaggcccc

SEQ ID NO: 112716 - RNA, 32 nt, Human
ccucagccaggcaggguugcagcugagggcca

SEQ ID NO: 112717 - RNA, 32 nt, Human
ccucagccagucgcuaugcagcacuuucggac

SEQ ID NO: 112718 - RNA, 23 nt, Human
ccucagccaguucauccagguca

SEQ ID NO: 112719 - RNA, 19 nt, Human
ccucagccaucccagggca

SEQ ID NO: 112720 - RNA, 25 nt, Human
ccucagccauuccuguccagcccug

SEQ ID NO: 112721 - RNA, 19 nt, Human
ccucagcccagcccaggca

SEQ ID NO: 112722 - RNA, 21 nt, Human
ccucagcccaggucagcuguu

SEQ ID NO: 112723 - RNA, 23 nt, Human
ccucagcccaugcccagcuguca

SEQ ID NO: 112724 - RNA, 32 nt, Human
ccucagccccagcucugccaucuuggagccag

SEQ ID NO: 112725 - RNA, 26 nt, Human
ccucagccccaguuuucuccuccuca

SEQ ID NO: 112726 - RNA, 22 nt, Human
ccucagccccggcagcuagugg

SEQ ID NO: 112727 - RNA, 19 nt, Human
ccucagccccucgcccuga

SEQ ID NO: 112728 - RNA, 22 nt, Human
ccucagccccucgcccugagca

SEQ ID NO: 112729 - RNA, 32 nt, Human
ccucagcccgcccuccccuuuggccuucccag

SEQ ID NO: 112730 - RNA, 32 nt, Human
ccucagcccgggcugugccagcccucccagcc

SEQ ID NO: 112731 - RNA, 32 nt, Human
ccucagcccgggguggcugagauauggcccug

SEQ ID NO: 112732 - RNA, 32 nt, Human
ccucagcccugggaagacacauucccuucccu

SEQ ID NO: 112733 - RNA, 32 nt, Human
ccucagcccugugacuggaaugugugccccac

SEQ ID NO: 112734 - RNA, 20 nt, Human
ccucagcccuucucccugca

SEQ ID NO: 112735 - RNA, 31 nt, Human
ccucagccgacagucucagccccaccgaccc

SEQ ID NO: 112736 - RNA, 32 nt, Human
ccucagccucagaggagcucuacccugcuccc

SEQ ID NO: 112737 - RNA, 24 nt, Human
ccucagccucagaguccagcugcc

SEQ ID NO: 112738 - RNA, 32 nt, Human
ccucagccucagaguccagcugcccggacucc

SEQ ID NO: 112739 - RNA, 32 nt, Human
ccucagccucagggcugagauucaggcucagg

SEQ ID NO: 112740 - RNA, 32 nt, Human
ccucagccuccaggcuucagucuucccaacuu

SEQ ID NO: 112741 - RNA, 32 nt, Human
ccucagccucccaaggcugggauuacagguau

SEQ ID NO: 112742 - RNA, 32 nt, Human
ccucagccucccagugcugggauuauaggugu

SEQ ID NO: 112743 - RNA, 32 nt, Human
ccucagccuccuaagggcugggauuacaggaa

SEQ ID NO: 112744 - RNA, 32 nt, Human
ccucagccuccuaagugggauuacaggcaccu

SEQ ID NO: 112745 - RNA, 32 nt, Human
ccucagccuccugaacagcugggaccacaggu

SEQ ID NO: 112746 - RNA, 32 nt, Human
ccucagccucucacccccuccuccucagggca

SEQ ID NO: 112747 - RNA, 32 nt, Human
ccucagccucuccucacuauggccccagugcc

SEQ ID NO: 112748 - RNA, 32 nt, Human
ccucagccucugauccucacacaugcucugau

SEQ ID NO: 112749 - RNA, 32 nt, Human
ccucagccugcucuucucucugguggcuccac

SEQ ID NO: 112750 - RNA, 32 nt, Human
ccucagccuggagugagcacagccuggacccu

SEQ ID NO: 112751 - RNA, 23 nt, Human
ccucagccugggagcuacugcca

SEQ ID NO: 112752 - RNA, 32 nt, Human
ccucagccugggcucccaggacaggacaggau

SEQ ID NO: 112753 - RNA, 32 nt, Human
ccucagccuggggagcugaaggggagacgcgu

SEQ ID NO: 112754 - RNA, 26 nt, Human
ccucagccuguucucucuccuuguca

SEQ ID NO: 112755 - RNA, 20 nt, Human
ccucagccuucccugcugcc

SEQ ID NO: 112756 - RNA, 32 nt, Human
ccucagccuuucucucgccugccuucugagcu

SEQ ID NO: 112757 - RNA, 21 nt, Human
ccucagcgagagcagcagcag

SEQ ID NO: 112758 - RNA, 32 nt, Human
ccucagcgcaccugcaugcacacacaccaccu

SEQ ID NO: 112759 - RNA, 32 nt, Human
ccucagcgcagcccuggcccaggaaggcagga

SEQ ID NO: 112760 - RNA, 24 nt, Human
ccucagcgcccguagcuucggcgg

SEQ ID NO: 112761 - RNA, 32 nt, Human
ccucagcgccgccgacaccaagcccggcacua

SEQ ID NO: 112762 - RNA, 32 nt, Human
ccucagcggcaggccagugaggcguuuuccua

SEQ ID NO: 112763 - RNA, 32 nt, Human
ccucagcgggggaggaagagaagggagguagc

SEQ ID NO: 112764 - RNA, 32 nt, Human
ccucagcgguucuggcugccagccugggcagc

SEQ ID NO: 112765 - RNA, 21 nt, Human
ccucagcgucagcucagcugg

SEQ ID NO: 112766 - RNA, 21 nt, Human
ccucagcguggucacaggggc

SEQ ID NO: 112767 - RNA, 32 nt, Human
ccucagcuacagaaagcccagagacagaaagu

SEQ ID NO: 112768 - RNA, 32 nt, Human
ccucagcuacccuggaucuuugcccaccucuu

SEQ ID NO: 112769 - RNA, 19 nt, Human
ccucagcuaccgccgcugc

SEQ ID NO: 112770 - RNA, 17 nt, Human
ccucagcuaccugcuca

SEQ ID NO: 112771 - RNA, 24 nt, Human
ccucagcuaccuggaggcagugaa

SEQ ID NO: 112772 - RNA, 32 nt, Human
ccucagcuacucaggagaauugcuugaaccug

SEQ ID NO: 112773 - RNA, 32 nt, Human
ccucagcuaucuuguuauccuacccucaggga

SEQ ID NO: 112774 - RNA, 32 nt, Human
ccucagcucacugaaaccucugccucccgggu

SEQ ID NO: 112775 - RNA, 32 nt, Human
ccucagcucacugcaaccucugccucccgggu

SEQ ID NO: 112776 - RNA, 32 nt, Human
ccucagcucacugcacccucugugucccggau

SEQ ID NO: 112777 - RNA, 32 nt, Human
ccucagcucacugcagccuccaccuccugggu

SEQ ID NO: 112778 - RNA, 32 nt, Human
ccucagcucacugcgaccuccaccuccugggu

SEQ ID NO: 112779 - RNA, 21 nt, Human
ccucagcucagcagaggcugu

SEQ ID NO: 112780 - RNA, 22 nt, Human
ccucagcucaggauagcugcug

SEQ ID NO: 112781 - RNA, 32 nt, Human
ccucagcuccaccaccucccucacccuccccg

SEQ ID NO: 112782 - RNA, 32 nt, Human
ccucagcuccacuuuugaggcugcaguccauu

SEQ ID NO: 112783 - RNA, 32 nt, Human
ccucagcucccagcuccaccucugggguucag

SEQ ID NO: 112784 - RNA, 23 nt, Human
ccucagcucccgcaacacccugg

SEQ ID NO: 112785 - RNA, 20 nt, Human
ccucagcucccucagcuccu

SEQ ID NO: 112786 - RNA, 21 nt, Human
ccucagcucccugcccagcca

SEQ ID NO: 112787 - RNA, 32 nt, Human
ccucagcuccucauccaugccaccucacaggg

SEQ ID NO: 112788 - RNA, 21 nt, Human
ccucagcuccucucacugcug

SEQ ID NO: 112789 - RNA, 20 nt, Human
ccucagcucucacagcagug

SEQ ID NO: 112790 - RNA, 32 nt, Human
ccucagcucugccucugcagcccacugccugc

SEQ ID NO: 112791 - RNA, 20 nt, Human
ccucagcucuggacagcugu

SEQ ID NO: 112792 - RNA, 32 nt, Human
ccucagcucuguacacaugauaugcaacaaag

SEQ ID NO: 112793 - RNA, 26 nt, Human
ccucagcucuguggaggagcagcagu

SEQ ID NO: 112794 - RNA, 32 nt, Human
ccucagcucuucuccuggaaugacuggcuucc

SEQ ID NO: 112795 - RNA, 32 nt, Human
ccucagcucuuuccuucccaccuuuccuggcc

SEQ ID NO: 112796 - RNA, 20 nt, Human
ccucagcugaacccacagug

SEQ ID NO: 112797 - RNA, 32 nt, Human
ccucagcugaacccacagugagcccagggcag

SEQ ID NO: 112798 - RNA, 19 nt, Human
ccucagcugagccaccugc

SEQ ID NO: 112799 - RNA, 24 nt, Human
ccucagcugccacugcaacagugg

SEQ ID NO: 112800 - RNA, 22 nt, Human
ccucagcugccuccccagcucu

SEQ ID NO: 112801 - RNA, 32 nt, Human
ccucagcugccuccuccaggcaucuuccuggc

SEQ ID NO: 112802 - RNA, 32 nt, Human
ccucagcugccugucugggccucccuggcuuc

SEQ ID NO: 112803 - RNA, 32 nt, Human
ccucagcugcuggcauuuccuucugcuguuug

SEQ ID NO: 112804 - RNA, 20 nt, Human
ccucagcuggagggcugcag

SEQ ID NO: 112805 - RNA, 32 nt, Human
ccucagcugggaacauuggggaggauggaauc

SEQ ID NO: 112806 - RNA, 21 nt, Human
ccucagcugggaugaggagug

SEQ ID NO: 112807 - RNA, 32 nt, Human
ccucagcugugagaugcaaggggcgccuugca

SEQ ID NO: 112808 - RNA, 32 nt, Human
ccucagcuucacagaacaaagccagguacucu

SEQ ID NO: 112809 - RNA, 20 nt, Human
ccucagcuucagagucagcc

SEQ ID NO: 112810 - RNA, 23 nt, Human
ccucagcuucagccuccgcgcca

SEQ ID NO: 112811 - RNA, 32 nt, Human
ccucagcuucaggcaccaccacugaccuggga

SEQ ID NO: 112812 - RNA, 32 nt, Human
ccucagcuuccaggacccagagggaggcaggc

SEQ ID NO: 112813 - RNA, 21 nt, Human
ccucagcuuccccagcagcug

SEQ ID NO: 112814 - RNA, 32 nt, Human
ccucagcuucgagccgaggugcagugagcugg

SEQ ID NO: 112815 - RNA, 32 nt, Human
ccucagcuucuccuggugggggugcuuugccu

SEQ ID NO: 112816 - RNA, 25 nt, Human
ccucagcuugguucccagccugcug

SEQ ID NO: 112817 - RNA, 24 nt, Human
ccucagcuuugcagcagcagcagu

SEQ ID NO: 112818 - RNA, 32 nt, Human
ccucaggaaaagcuccagcuagcauguuuuuc

SEQ ID NO: 112819 - RNA, 32 nt, Human
ccucaggaagcuuggcuucccucccaugggaa

SEQ ID NO: 112820 - RNA, 32 nt, Human
ccucaggaagugcugggauuacaggcguguga

SEQ ID NO: 112821 - RNA, 21 nt, Human
ccucaggacaccucccagcca

SEQ ID NO: 112822 - RNA, 32 nt, Human
ccucaggacccaaacccagacacuucauagga

SEQ ID NO: 112823 - RNA, 32 nt, Human
ccucaggaccugggguugguuggacucugccc

SEQ ID NO: 112824 - RNA, 32 nt, Human
ccucaggacgcuggaugccagcucccagcccc

SEQ ID NO: 112825 - RNA, 32 nt, Human
ccucaggacucgacucucucucccugccauca

SEQ ID NO: 112826 - RNA, 20 nt, Human
ccucaggacugcagcacuga

SEQ ID NO: 112827 - RNA, 32 nt, Human
ccucaggagaagcaggcagggugcaggccauu

SEQ ID NO: 112828 - RNA, 32 nt, Human
ccucaggagcaguguggaggaagaugagggcc

SEQ ID NO: 112829 - RNA, 32 nt, Human
ccucaggagcaguugggugaggagcaccagaa

SEQ ID NO: 112830 - RNA, 20 nt, Human
ccucaggagcuucccccucc

SEQ ID NO: 112831 - RNA, 32 nt, Human
ccucaggagcuucccccucccccuuugccuau

SEQ ID NO: 112832 - RNA, 32 nt, Human
ccucaggaggcggagguugcagugagccgaga

SEQ ID NO: 112833 - RNA, 19 nt, Human
ccucaggaggcucugggca

SEQ ID NO: 112834 - RNA, 32 nt, Human
ccucaggaggcugaggcaggagaaucacuuga

SEQ ID NO: 112835 - RNA, 32 nt, Human
ccucaggaggcugaggcaggagaaucgcuuga

SEQ ID NO: 112836 - RNA, 32 nt, Human
ccucaggagguugaggcugcagugagcuguga

SEQ ID NO: 112837 - RNA, 32 nt, Human
ccucaggaguauucuucuacaccagcugcugu

SEQ ID NO: 112838 - RNA, 32 nt, Human
ccucaggaucccacccuccaucccgucugccc

SEQ ID NO: 112839 - RNA, 32 nt, Human
ccucaggaugcaggagccuccuccucagaccc

SEQ ID NO: 112840 - RNA, 32 nt, Human
ccucaggcaaccaguugcuauaccuuagcugu

SEQ ID NO: 112841 - RNA, 32 nt, Human
ccucaggcaagccacguguccucugagccuca

SEQ ID NO: 112842 - RNA, 32 nt, Human
ccucaggcacagaacauccucucccucuucug

SEQ ID NO: 112843 - RNA, 32 nt, Human
ccucaggcaccugcacuuacaggccuugcuca

SEQ ID NO: 112844 - RNA, 32 nt, Human
ccucaggcagaggcugaguccgcacaucaccu

SEQ ID NO: 112845 - RNA, 32 nt, Human
ccucaggcagcaaaccaagauggaguaugagu

SEQ ID NO: 112846 - RNA, 32 nt, Human
ccucaggcaguguggcuccagaugucaggagg

SEQ ID NO: 112847 - RNA, 32 nt, Human
ccucaggcauuuucuacucagcugugaccuua

SEQ ID NO: 112848 - RNA, 32 nt, Human
ccucaggccauacucuccuuuaccauacuauu

SEQ ID NO: 112849 - RNA, 24 nt, Human
ccucaggcccacccaagcgccggg

SEQ ID NO: 112850 - RNA, 24 nt, Human
ccucaggcccaccgcauccaagaa

SEQ ID NO: 112851 - RNA, 32 nt, Human
ccucaggcccccacccuccacuccuccccacg

SEQ ID NO: 112852 - RNA, 32 nt, Human
ccucaggccccgaggucaggguuugagggaug

SEQ ID NO: 112853 - RNA, 32 nt, Human
ccucaggccccucucuggcugcagagcccucu

SEQ ID NO: 112854 - RNA, 22 nt, Human
ccucaggcccuaguccagagga

SEQ ID NO: 112855 - RNA, 32 nt, Human
ccucaggcccuucucuggcugcagagccgucu

SEQ ID NO: 112856 - RNA, 32 nt, Human
ccucaggccugggccccagagcucagggcacc

SEQ ID NO: 112857 - RNA, 32 nt, Human
ccucaggccuugggcaaaauugcuucgcucug

SEQ ID NO: 112858 - RNA, 25 nt, Human
ccucaggcucucuccccugcucucc

SEQ ID NO: 112859 - RNA, 32 nt, Human
ccucaggcucucuccccugcucucccaccucu

SEQ ID NO: 112860 - RNA, 32 nt, Human
ccucaggcugccucucugccuguuacugcugc

SEQ ID NO: 112861 - RNA, 32 nt, Human
ccucaggcugcucucaccguggccuguccacg

SEQ ID NO: 112862 - RNA, 26 nt, Human
ccucaggcuggcugccccuguuccuu

SEQ ID NO: 112863 - RNA, 32 nt, Human
ccucaggcuucuguuccauuccuuaauugucu

SEQ ID NO: 112864 - RNA, 32 nt, Human
ccucaggcuuucucccucagucuuggcuucuc

SEQ ID NO: 112865 - RNA, 32 nt, Human
ccucagggaacagcagagagcaguuggcucuu

SEQ ID NO: 112866 - RNA, 18 nt, Human
ccucagggaagcuggggc

SEQ ID NO: 112867 - RNA, 32 nt, Human
ccucagggaaugagagaaagugauggcaauca

SEQ ID NO: 112868 - RNA, 20 nt, Human
ccucagggacacacaaggac

SEQ ID NO: 112869 - RNA, 20 nt, Human
ccucagggacauugcccaca

SEQ ID NO: 112870 - RNA, 32 nt, Human
ccucagggagacagacacagaccaagaauagc

SEQ ID NO: 112871 - RNA, 32 nt, Human
ccucagggagcgcggcccugcugccaccuuga

SEQ ID NO: 112872 - RNA, 32 nt, Human
ccucagggcaccauuuuuaaucccagaacaca

SEQ ID NO: 112873 - RNA, 32 nt, Human
ccucagggcccaggccugaguggugcugcuca

SEQ ID NO: 112874 - RNA, 32 nt, Human
ccucagggccgaaggggaggugguguacauag

SEQ ID NO: 112875 - RNA, 32 nt, Human
ccucagggccuccauugagcagcuggggcugg

SEQ ID NO: 112876 - RNA, 21 nt, Human
ccucagggccucuagagccug

SEQ ID NO: 112877 - RNA, 32 nt, Human
ccucaggggagcggggaggcagcugcuggccg

SEQ ID NO: 112878 - RNA, 21 nt, Human
ccucaggggaguuccgcgcug

SEQ ID NO: 112879 - RNA, 32 nt, Human
ccucaggggcugcggcccuggucccgcgggac

SEQ ID NO: 112880 - RNA, 32 nt, Human
ccucaggggucaggaaaaagcagcacagcuuu

SEQ ID NO: 112881 - RNA, 32 nt, Human
ccucaggggucugagcuccagcuccuuugggc

SEQ ID NO: 112882 - RNA, 20 nt, Human
ccucaggguacaucacgggg

SEQ ID NO: 112883 - RNA, 23 nt, Human
ccucagggucccaagcucccuca

SEQ ID NO: 112884 - RNA, 32 nt, Human
ccucagggucggacuucauuuuguacuguggg

SEQ ID NO: 112885 - RNA, 19 nt, Human
ccucagggugaccucuggu

SEQ ID NO: 112886 - RNA, 32 nt, Human
ccucagggugagcagagggcacugggcugggg

SEQ ID NO: 112887 - RNA, 32 nt, Human
ccucagggugcacacaggauggcaggaggcau

SEQ ID NO: 112888 - RNA, 32 nt, Human
ccucagguaaaauuuaggacccugcuagcugu

SEQ ID NO: 112889 - RNA, 32 nt, Human
ccucagguaauccacccgccucagccucccga

SEQ ID NO: 112890 - RNA, 23 nt, Human
ccucagguaauccgcccaccuca

SEQ ID NO: 112891 - RNA, 23 nt, Human
ccucagguaauccucccaccuca

SEQ ID NO: 112892 - RNA, 32 nt, Human
ccucagguauugaagguggggcccaguaggga

SEQ ID NO: 112893 - RNA, 32 nt, Human
ccucaggucagccucuccagggccaacuccua

SEQ ID NO: 112894 - RNA, 32 nt, Human
ccucaggucugggcugagaugugugcagaggg

SEQ ID NO: 112895 - RNA, 32 nt, Human
ccucaggugagcccgggauggcuaucugaaau

SEQ ID NO: 112896 - RNA, 23 nt, Human
ccucaggugauccacccaccuca

SEQ ID NO: 112897 - RNA, 19 nt, Human
ccucaggugauccacccgc

SEQ ID NO: 112898 - RNA, 23 nt, Human
ccucaggugauccacccgccuca

SEQ ID NO: 112899 - RNA, 19 nt, Human
ccucaggugauccccccac

SEQ ID NO: 112900 - RNA, 23 nt, Human
ccucaggugauccgcccaccuca

SEQ ID NO: 112901 - RNA, 22 nt, Human
ccucaggugauccucccaccuc

SEQ ID NO: 112902 - RNA, 23 nt, Human
ccucaggugauuuaucagggaga

SEQ ID NO: 112903 - RNA, 18 nt, Human
ccucaggugccacggcca

SEQ ID NO: 112904 - RNA, 32 nt, Human
ccucaggugcgaggagcuggagcccaggccag

SEQ ID NO: 112905 - RNA, 32 nt, Human
ccucagguggccagaaggccgaguuguguaau

SEQ ID NO: 112906 - RNA, 18 nt, Human
ccucaggugucaaaguaa

SEQ ID NO: 112907 - RNA, 32 nt, Human
ccucaggugucugcccaccucuaccucccaaa

SEQ ID NO: 112908 - RNA, 32 nt, Human
ccucagguucccaagacuucaguccuggucug

SEQ ID NO: 112909 - RNA, 18 nt, Human
ccucagguucccacauca

SEQ ID NO: 112910 - RNA, 32 nt, Human
ccucagguugacucuguacaucugaauaguga

SEQ ID NO: 112911 - RNA, 32 nt, Human
ccucagguugugacucacugagcgccacuugu

SEQ ID NO: 112912 - RNA, 32 nt, Human
ccucaguaaaagucuucucccaacucagccug

SEQ ID NO: 112913 - RNA, 32 nt, Human
ccucaguaacugcucccccuucuccauauaag

SEQ ID NO: 112914 - RNA, 32 nt, Human
ccucaguacuguacaagggaagcuuuuccucu

SEQ ID NO: 112915 - RNA, 32 nt, Human
ccucaguagaagaacguggcauggaaggagcc

SEQ ID NO: 112916 - RNA, 32 nt, Human
ccucaguagagccggcccugcucacuaccgcg

SEQ ID NO: 112917 - RNA, 32 nt, Human
ccucaguagcugaugaacuaacaggagauaaa

SEQ ID NO: 112918 - RNA, 32 nt, Human
ccucaguaggcugaggugagaggaucacuuga

SEQ ID NO: 112919 - RNA, 32 nt, Human
ccucaguagugggagcaccaggcccuuugcca

SEQ ID NO: 112920 - RNA, 32 nt, Human
ccucagucacacacccccaaccccaggcagcc

SEQ ID NO: 112921 - RNA, 32 nt, Human
ccucagucagaaccuuugcuccagaaauuuuc

SEQ ID NO: 112922 - RNA, 20 nt, Human
ccucagucagcuggcaggga

SEQ ID NO: 112923 - RNA, 32 nt, Human
ccucaguccaccaacagaacuaugccaguugg

SEQ ID NO: 112924 - RNA, 27 nt, Human
ccucaguccaguaccuccuugcuccuu

SEQ ID NO: 112925 - RNA, 32 nt, Human
ccucagucccccaggcuccugcacgggcucug

SEQ ID NO: 112926 - RNA, 23 nt, Human
ccucagucccucucucaccuccc

SEQ ID NO: 112927 - RNA, 22 nt, Human
ccucaguccucucuuccuuccc

SEQ ID NO: 112928 - RNA, 32 nt, Human
ccucaguccuugugcagcaccaggaagaaacc

SEQ ID NO: 112929 - RNA, 32 nt, Human
ccucagucgcucaggcuggagugcaguggcgc

SEQ ID NO: 112930 - RNA, 32 nt, Human
ccucagucggccugcgcuccucagccuggcgg

SEQ ID NO: 112931 - RNA, 32 nt, Human
ccucagucucccaggccugggacaggcagaac

SEQ ID NO: 112932 - RNA, 32 nt, Human
ccucagucucccugucugugguuccagaggga

SEQ ID NO: 112933 - RNA, 23 nt, Human
ccucagucucccuuugggaccug

SEQ ID NO: 112934 - RNA, 32 nt, Human
ccucagucuccuccccaucacccuccucaggc

SEQ ID NO: 112935 - RNA, 32 nt, Human
ccucagucuccucuccccacauuguguccugu

SEQ ID NO: 112936 - RNA, 32 nt, Human
ccucagucucugcugccuccuccuuucuugag

SEQ ID NO: 112937 - RNA, 32 nt, Human
ccucagucugcagcucuuuucuccaccgcgcg

SEQ ID NO: 112938 - RNA, 32 nt, Human
ccucagucugccugccaagaacucaaguguaa

SEQ ID NO: 112939 - RNA, 32 nt, Human
ccucagugacaccucagacacgggcccugggc

SEQ ID NO: 112940 - RNA, 32 nt, Human
ccucagugacaucaaagccuggccuaauuguu

SEQ ID NO: 112941 - RNA, 32 nt, Human
ccucagugacaucucagggcacccagacucug

SEQ ID NO: 112942 - RNA, 32 nt, Human
ccucagugaccuggaucugaccucacaccauc

SEQ ID NO: 112943 - RNA, 21 nt, Human
ccucagugacugacagaggau

SEQ ID NO: 112944 - RNA, 21 nt, Human
ccucagugacugccacccugg

SEQ ID NO: 112945 - RNA, 20 nt, Human
ccucagugaggagggcugga

SEQ ID NO: 112946 - RNA, 32 nt, Human
ccucagugcaggaccaguggaugaaaggcaag

SEQ ID NO: 112947 - RNA, 20 nt, Human
ccucagugccaguccugccu

SEQ ID NO: 112948 - RNA, 24 nt, Human
ccucagugcccguuuggccugcug

SEQ ID NO: 112949 - RNA, 32 nt, Human
ccucagugccgagcuggcugguggcaguggug

SEQ ID NO: 112950 - RNA, 32 nt, Human
ccucagugccuguccauaacugugaaguauua

SEQ ID NO: 112951 - RNA, 32 nt, Human
ccucagugcucagcuggagguggagagaaauc

SEQ ID NO: 112952 - RNA, 32 nt, Human
ccucagugcugauuuugcagaugaagagacua

SEQ ID NO: 112953 - RNA, 32 nt, Human
ccucaguggaaggugaugggggccggugcugu

SEQ ID NO: 112954 - RNA, 32 nt, Human
ccucaguggagaccccaaggagcugcagcuga

SEQ ID NO: 112955 - RNA, 32 nt, Human
ccucaguggcuucccgauguugccugcuggca

SEQ ID NO: 112956 - RNA, 23 nt, Human
ccucagugggagcgggacaggga

SEQ ID NO: 112957 - RNA, 32 nt, Human
ccucaguguucauuccuguuaccugcauaucu

SEQ ID NO: 112958 - RNA, 23 nt, Human
ccucaguuacauaaaauaaauga

SEQ ID NO: 112959 - RNA, 32 nt, Human
ccucaguuaccuggggaagaguaaaggcaaga

SEQ ID NO: 112960 - RNA, 32 nt, Human
ccucaguucaguuucuaggcaggaagccuaga

SEQ ID NO: 112961 - RNA, 32 nt, Human
ccucaguuccacugccuuccucucccucuccu

SEQ ID NO: 112962 - RNA, 32 nt, Human
ccucaguucccuuuggccucccccuuuaccca

SEQ ID NO: 112963 - RNA, 32 nt, Human
ccucaguucucccagguuguuccucaaaguca

SEQ ID NO: 112964 - RNA, 32 nt, Human
ccucaguugauccaccugccucagccucccaa

SEQ ID NO: 112965 - RNA, 32 nt, Human
ccucaguugauccaccugccucagccucugca

SEQ ID NO: 112966 - RNA, 32 nt, Human
ccucaguugcccaggccucuaucugcauggag

SEQ ID NO: 112967 - RNA, 32 nt, Human
ccucaguuggauaacauuagauccaaagugca

SEQ ID NO: 112968 - RNA, 32 nt, Human
ccucaguugggagcuuccaaagccgggugauc

SEQ ID NO: 112969 - RNA, 32 nt, Human
ccucaguuuccccauuuguauaaugggaagcc

SEQ ID NO: 112970 - RNA, 32 nt, Human
ccucaguuucccccaucuccucugccagaggc

SEQ ID NO: 112971 - RNA, 32 nt, Human
ccucaguuuccccucaugaucuggccucugcc

SEQ ID NO: 112972 - RNA, 32 nt, Human
ccucaguuucccuaucucgaacauggaacuca

SEQ ID NO: 112973 - RNA, 32 nt, Human
ccucaguuucucccucuucuaaaagaggauga

SEQ ID NO: 112974 - RNA, 32 nt, Human
ccucaguuucuccucaacaggccugggggcag

SEQ ID NO: 112975 - RNA, 32 nt, Human
ccucaguuucuuguccaccgcuucacuggcaa

SEQ ID NO: 112976 - RNA, 32 nt, Human
ccucauaaacauuugaguuuuguugaaaagau

SEQ ID NO: 112977 - RNA, 32 nt, Human
ccucauaacaccuagaccauccuagaauuccu

SEQ ID NO: 112978 - RNA, 32 nt, Human
ccucauacaguacguguccuguuuuuaaaaua

SEQ ID NO: 112979 - RNA, 32 nt, Human
ccucauacccgugcccucacagagccaugccc

SEQ ID NO: 112980 - RNA, 32 nt, Human
ccucauacgcagcucaucuuaaaccaauagaa

SEQ ID NO: 112981 - RNA, 32 nt, Human
ccucauacucuucuguuuuccauuccacauga

SEQ ID NO: 112982 - RNA, 20 nt, Human
ccucauagauuagccauugu

SEQ ID NO: 112983 - RNA, 32 nt, Human
ccucauagccaaugaacaggacaggaaucuga

SEQ ID NO: 112984 - RNA, 32 nt, Human
ccucauagcuucacagccuugcccucagccuc

SEQ ID NO: 112985 - RNA, 22 nt, Human
ccucauaggaggucagcaccuu

SEQ ID NO: 112986 - RNA, 18 nt, Human
ccucauaguccuguugga

SEQ ID NO: 112987 - RNA, 32 nt, Human
ccucauaucucagcagagaagccagugguggc

SEQ ID NO: 112988 - RNA, 32 nt, Human
ccucauauggcccagugucaaguugugcuugu

SEQ ID NO: 112989 - RNA, 32 nt, Human
ccucaucaaauccucaccuaagcuuucagugu

SEQ ID NO: 112990 - RNA, 32 nt, Human
ccucaucaccuuuugugcagacaggcagguua

SEQ ID NO: 112991 - RNA, 19 nt, Human
ccucaucacugucaccuua

SEQ ID NO: 112992 - RNA, 32 nt, Human
ccucaucacuguccaugcaccaugcagccaua

SEQ ID NO: 112993 - RNA, 32 nt, Human
ccucaucagaacucugcccuuccuucuguucu

SEQ ID NO: 112994 - RNA, 32 nt, Human
ccucaucagcaaggugggaugcagcccccggc

SEQ ID NO: 112995 - RNA, 32 nt, Human
ccucaucaucuucuccaacugacaccuaguua

SEQ ID NO: 112996 - RNA, 32 nt, Human
ccucaucaugaaaacugggaggccgggcaugg

SEQ ID NO: 112997 - RNA, 32 nt, Human
ccucauccaagaaacacccucacagcgacguc

SEQ ID NO: 112998 - RNA, 32 nt, Human
ccucauccaagcucuccuaccucugcccagcc

SEQ ID NO: 112999 - RNA, 32 nt, Human
ccucauccaccaggcaauagacaggagagagg

SEQ ID NO: 113000 - RNA, 32 nt, Human
ccucauccaccccuccccaucuggaccauaau

SEQ ID NO: 113001 - RNA, 18 nt, Human
ccucauccaccucuucca

SEQ ID NO: 113002 - RNA, 32 nt, Human
ccucauccagcagaaauucacgguaguauggu

SEQ ID NO: 113003 - RNA, 32 nt, Human
ccucauccagggagggaggcagcugcugggga

SEQ ID NO: 113004 - RNA, 20 nt, Human
ccucaucccaacucaacuac

SEQ ID NO: 113005 - RNA, 32 nt, Human
ccucauccccuucacccuccugcccccucucc

SEQ ID NO: 113006 - RNA, 32 nt, Human
ccucaucccgagaggagaggaagaggaggaag

SEQ ID NO: 113007 - RNA, 23 nt, Human
ccucaucccuagcuccaaucccu

SEQ ID NO: 113008 - RNA, 32 nt, Human
ccucaucccuagcuccaaucccuuccccacgu

SEQ ID NO: 113009 - RNA, 32 nt, Human
ccucaucccugacugcagcuugacucugggcc

SEQ ID NO: 113010 - RNA, 22 nt, Human
ccucaucccugcacugguucca

SEQ ID NO: 113011 - RNA, 32 nt, Human
ccucauccuaccucccugaccagcucuggcuu

SEQ ID NO: 113012 - RNA, 32 nt, Human
ccucauccuccaggcucuggcgggaaggagca

SEQ ID NO: 113013 - RNA, 32 nt, Human
ccucauccucccccagcccuugaauagguugg

SEQ ID NO: 113014 - RNA, 32 nt, Human
ccucauccuccccuagcuuagcugucucagag

SEQ ID NO: 113015 - RNA, 32 nt, Human
ccucauccuccuaaccauugagccaaugcauu

SEQ ID NO: 113016 - RNA, 32 nt, Human
ccucauccucuuccucugauaaagccccuacc

SEQ ID NO: 113017 - RNA, 32 nt, Human
ccucauccugaaggcucgguggcagagcucgu

SEQ ID NO: 113018 - RNA, 32 nt, Human
ccucauccugacucccccugcuuuggccaugg

SEQ ID NO: 113019 - RNA, 32 nt, Human
ccucauccuggcucagccuggugauggagaag

SEQ ID NO: 113020 - RNA, 32 nt, Human
ccucauccugggugggcuucaggcuggggcug

SEQ ID NO: 113021 - RNA, 32 nt, Human
ccucauccugguuugcauuuuacccucggaug

SEQ ID NO: 113022 - RNA, 32 nt, Human
ccucauccuucugccaaggcagcuuuccuuuc

SEQ ID NO: 113023 - RNA, 32 nt, Human
ccucauccuuuugccuuuguuauuucugcucg

SEQ ID NO: 113024 - RNA, 32 nt, Human
ccucaucgggccucuggggcaggaagcuuguc

SEQ ID NO: 113025 - RNA, 32 nt, Human
ccucaucgggcugaagcgggaggacaacaaga

SEQ ID NO: 113026 - RNA, 32 nt, Human
ccucaucuagcaccuucucuaccucccagggu

SEQ ID NO: 113027 - RNA, 32 nt, Human
ccucaucucaaaggguccucaaagcucugacg

SEQ ID NO: 113028 - RNA, 32 nt, Human
ccucaucucacacccuuucccucucccugugu

SEQ ID NO: 113029 - RNA, 32 nt, Human
ccucaucucacugcaucccccaucacccccua

SEQ ID NO: 113030 - RNA, 32 nt, Human
ccucaucucauuuggcuguguaaagaaauggg

SEQ ID NO: 113031 - RNA, 32 nt, Human
ccucaucuccaagucaccuccaguacaagaug

SEQ ID NO: 113032 - RNA, 32 nt, Human
ccucaucuccacccccgccacagccuacacgc

SEQ ID NO: 113033 - RNA, 32 nt, Human
ccucaucuccacccucccccauaucuguuugc

SEQ ID NO: 113034 - RNA, 32 nt, Human
ccucaucuccauccucauccucuuccuucaca

SEQ ID NO: 113035 - RNA, 32 nt, Human
ccucaucucccccagcccacuuguuuuccccc

SEQ ID NO: 113036 - RNA, 32 nt, Human
ccucaucucugccugccuucccucuugccugg

SEQ ID NO: 113037 - RNA, 32 nt, Human
ccucaucugaaagccuuucugccuuccuuccu

SEQ ID NO: 113038 - RNA, 32 nt, Human
ccucaucugccuggggccucaccugcuggagu

SEQ ID NO: 113039 - RNA, 32 nt, Human
ccucaucugggcaggcgcagagcugaugaaau

SEQ ID NO: 113040 - RNA, 32 nt, Human
ccucaucugugcgcggcagucuggaccuagaa

SEQ ID NO: 113041 - RNA, 32 nt, Human
ccucaucuuccccagcccuccccaccugcuca

SEQ ID NO: 113042 - RNA, 32 nt, Human
ccucaucuuccuucucagccuugguuccugau

SEQ ID NO: 113043 - RNA, 32 nt, Human
ccucaucuuuucuguggcaaucuugcaucugu

SEQ ID NO: 113044 - RNA, 32 nt, Human
ccucaugaauagcugggauuacaggugcccac

SEQ ID NO: 113045 - RNA, 32 nt, Human
ccucaugagccugucgugcaggccaggucauu

SEQ ID NO: 113046 - RNA, 32 nt, Human
ccucaugaguagcugggacuacagaugcgugc

SEQ ID NO: 113047 - RNA, 32 nt, Human
ccucaugaguagcugggacuacaggcaccacu

SEQ ID NO: 113048 - RNA, 32 nt, Human
ccucaugaguagcugggauuacagguauguac

SEQ ID NO: 113049 - RNA, 32 nt, Human
ccucaugauaauugacccucuggaucaccaga

SEQ ID NO: 113050 - RNA, 32 nt, Human
ccucaugauggcuuuuauccuccugggacacu

SEQ ID NO: 113051 - RNA, 32 nt, Human
ccucaugcaagggugcguguacacauacacac

SEQ ID NO: 113052 - RNA, 32 nt, Human
ccucaugcaugucccagccccugggcccuagc

SEQ ID NO: 113053 - RNA, 32 nt, Human
ccucaugccauggucuuugcuaggccucuugc

SEQ ID NO: 113054 - RNA, 20 nt, Human
ccucaugccccaggcuggag

SEQ ID NO: 113055 - RNA, 32 nt, Human
ccucaugccccaggcuggagcagcucuccuag

SEQ ID NO: 113056 - RNA, 32 nt, Human
ccucaugcccucuuccuccucuuuccuggaag

SEQ ID NO: 113057 - RNA, 21 nt, Human
ccucaugccgcucccaucucu

SEQ ID NO: 113058 - RNA, 32 nt, Human
ccucaugccuauaaucccagcacuuuggaagg

SEQ ID NO: 113059 - RNA, 32 nt, Human
ccucaugccuauaaucccagcacuuugggagg

SEQ ID NO: 113060 - RNA, 32 nt, Human
ccucaugccugcaauccuagcacuuugggagg

SEQ ID NO: 113061 - RNA, 32 nt, Human
ccucaugccuguaaucccagcacuuucggagg

SEQ ID NO: 113062 - RNA, 32 nt, Human
ccucaugccuguaaucccagcacuuugggagg

SEQ ID NO: 113063 - RNA, 32 nt, Human
ccucaugccuguaauccuagcaccuugggagg

SEQ ID NO: 113064 - RNA, 32 nt, Human
ccucaugccuguaauuccagcacuuugggagg

SEQ ID NO: 113065 - RNA, 32 nt, Human
ccucaugccuguaucccagcacuuugggaggc

SEQ ID NO: 113066 - RNA, 32 nt, Human
ccucaugccuuuccuucccuuucucuggggau

SEQ ID NO: 113067 - RNA, 32 nt, Human
ccucaugcucagaccucucccaccccaaaccc

SEQ ID NO: 113068 - RNA, 32 nt, Human
ccucaugcucaggaguuggcaguuguagcuuc

SEQ ID NO: 113069 - RNA, 32 nt, Human
ccucaugcuguggagaaagucagacucaacug

SEQ ID NO: 113070 - RNA, 32 nt, Human
ccucaugcuguuccaccuccccucagacuagc

SEQ ID NO: 113071 - RNA, 32 nt, Human
ccucaugcuguuccaccuccccucagacuauc

SEQ ID NO: 113072 - RNA, 32 nt, Human
ccucaugcuucacuuagccaugguggacccag

SEQ ID NO: 113073 - RNA, 32 nt, Human
ccucauggacucaggauccuccuggagcagca

SEQ ID NO: 113074 - RNA, 32 nt, Human
ccucauggagaaacuugugaggcuguuacaca

SEQ ID NO: 113075 - RNA, 32 nt, Human
ccucauggagguuucaccugcagcuuucaguc

SEQ ID NO: 113076 - RNA, 22 nt, Human
ccucauggauugccacagcuca

SEQ ID NO: 113077 - RNA, 24 nt, Human
ccucauggcgcugcugccaucuuu

SEQ ID NO: 113078 - RNA, 32 nt, Human
ccucaugggcaucgggcggcgccccuucaacc

SEQ ID NO: 113079 - RNA, 32 nt, Human
ccucauguaauccacccaccucagccucccaa

SEQ ID NO: 113080 - RNA, 32 nt, Human
ccucauguacauugcugaccugggccccggca

SEQ ID NO: 113081 - RNA, 32 nt, Human
ccucaugucuucaugacgucaucacugcccca

SEQ ID NO: 113082 - RNA, 32 nt, Human
ccucaugugaacugaaagaaguugcucgcuuc

SEQ ID NO: 113083 - RNA, 22 nt, Human
ccucaugugaaggaggcagggg

SEQ ID NO: 113084 - RNA, 32 nt, Human
ccucaugugcccgaucggacagugccauccau

SEQ ID NO: 113085 - RNA, 32 nt, Human
ccucaugugucacaugugaaccugacggacau

SEQ ID NO: 113086 - RNA, 32 nt, Human
ccucauguucagucuucaggauaucacaccac

SEQ ID NO: 113087 - RNA, 32 nt, Human
ccucauguuccauggggcugugcagugcaaug

SEQ ID NO: 113088 - RNA, 32 nt, Human
ccucauguuccuccugcucugccucaagcacc

SEQ ID NO: 113089 - RNA, 32 nt, Human
ccucauguucucuucccaggccuuuggagggg

SEQ ID NO: 113090 - RNA, 21 nt, Human
ccucauguucuggaacugugc

SEQ ID NO: 113091 - RNA, 32 nt, Human
ccucauuaauguccaagucacagggagccuca

SEQ ID NO: 113092 - RNA, 32 nt, Human
ccucauucaccgguugaugccucccagaaaaa

SEQ ID NO: 113093 - RNA, 32 nt, Human
ccucauucagcagccuaggcauggugcuuuuu

SEQ ID NO: 113094 - RNA, 32 nt, Human
ccucauucaguauuucuaucaagaaagagaug

SEQ ID NO: 113095 - RNA, 22 nt, Human
ccucauucauccauuuuucuua

SEQ ID NO: 113096 - RNA, 32 nt, Human
ccucauuccaccacuuacuagucucaguaccc

SEQ ID NO: 113097 - RNA, 32 nt, Human
ccucauucccagccuggcuguccacagaagcc

SEQ ID NO: 113098 - RNA, 32 nt, Human
ccucauucccugacucuuagccccagacucuu

SEQ ID NO: 113099 - RNA, 32 nt, Human
ccucauucccuuccaucucccuccccucugcc

SEQ ID NO: 113100 - RNA, 32 nt, Human
ccucauuccuacucugaauugucacacuuuuc

SEQ ID NO: 113101 - RNA, 20 nt, Human
ccucauuccugccgcugccg

SEQ ID NO: 113102 - RNA, 22 nt, Human
ccucauucuagccauuuuucca

SEQ ID NO: 113103 - RNA, 32 nt, Human
ccucauucuaggccuccuuaaagagaaggauc

SEQ ID NO: 113104 - RNA, 32 nt, Human
ccucauucucauugaaaaggaguuggcagaac

SEQ ID NO: 113105 - RNA, 32 nt, Human
ccucauucuccaagcucaucaacaggucucag

SEQ ID NO: 113106 - RNA, 32 nt, Human
ccucauucucuuuaccaguauccuggcaaugg

SEQ ID NO: 113107 - RNA, 32 nt, Human
ccucauucugcaggacagggccagcugucucc

SEQ ID NO: 113108 - RNA, 32 nt, Human
ccucauucugguaaaccagcagccuccagcau

SEQ ID NO: 113109 - RNA, 32 nt, Human
ccucauucugucucuguucccugcuuuggcca

SEQ ID NO: 113110 - RNA, 32 nt, Human
ccucauucuucuacauccuccccauuucugua

SEQ ID NO: 113111 - RNA, 32 nt, Human
ccucauugagcagcuggaggucuggacuccgg

SEQ ID NO: 113112 - RNA, 32 nt, Human
ccucauugagccacugggaagcuaugguugag

SEQ ID NO: 113113 - RNA, 32 nt, Human
ccucauugcagccucagacuccuggguucaag

SEQ ID NO: 113114 - RNA, 32 nt, Human
ccucauugcuaccacagacuugcacugaagcc

SEQ ID NO: 113115 - RNA, 32 nt, Human
ccucauuggcggcgccuggugcaagaaguugc

SEQ ID NO: 113116 - RNA, 32 nt, Human
ccucauuggucuugagcacuugcucccuggcu

SEQ ID NO: 113117 - RNA, 32 nt, Human
ccucauugugaaaugcaugccauacgaaauuu

SEQ ID NO: 113118 - RNA, 32 nt, Human
ccucauuguuucccccacgucucccucuauac

SEQ ID NO: 113119 - RNA, 32 nt, Human
ccucauuuauguuuguaguuggaaagcaaagc

SEQ ID NO: 113120 - RNA, 32 nt, Human
ccucauuucauccucacagccaccucaggaaa

SEQ ID NO: 113121 - RNA, 22 nt, Human
ccucauuucucagcuucugcau

SEQ ID NO: 113122 - RNA, 32 nt, Human
ccucauuucucagcuucugcauuuccuucccu

SEQ ID NO: 113123 - RNA, 32 nt, Human
ccucauuucucuuccuccucaccuccaccacc

SEQ ID NO: 113124 - RNA, 32 nt, Human
ccucauuugacaaaucagagcuguaauucacu

SEQ ID NO: 113125 - RNA, 32 nt, Human
ccucauuugauccccauuuacucacaccaugc

SEQ ID NO: 113126 - RNA, 32 nt, Human
ccucauuuuccagaugcaccagcuccuauuaa

SEQ ID NO: 113127 - RNA, 32 nt, Human
ccucauuuucuuucuguuccuucccgcucucg

SEQ ID NO: 113128 - RNA, 32 nt, Human
ccuccaaaacacaagggaggauuuuggguggc

SEQ ID NO: 113129 - RNA, 22 nt, Human
ccuccaaaagacccauccuggg

SEQ ID NO: 113130 - RNA, 32 nt, Human
ccuccaaaagugcugggauuacaggcaugagc

SEQ ID NO: 113131 - RNA, 32 nt, Human
ccuccaaaagugcugggauuacaggugucagc

SEQ ID NO: 113132 - RNA, 32 nt, Human
ccuccaaaagugcugggauuacuagcacgaau

SEQ ID NO: 113133 - RNA, 32 nt, Human
ccuccaaaaugcugggauuacaggcguaagcc

SEQ ID NO: 113134 - RNA, 32 nt, Human
ccuccaaaccaaauacagcaccuacugugaag

SEQ ID NO: 113135 - RNA, 32 nt, Human
ccuccaaaccauccagcagcaccaacaggcug

SEQ ID NO: 113136 - RNA, 32 nt, Human
ccuccaaaccuccagccucccugucuccagcu

SEQ ID NO: 113137 - RNA, 24 nt, Human
ccuccaaacucaagccuggguggg

SEQ ID NO: 113138 - RNA, 32 nt, Human
ccuccaaacuggaaggcuucaaaggugagggg

SEQ ID NO: 113139 - RNA, 32 nt, Human
ccuccaaagaagagcaugggagaggugggagg

SEQ ID NO: 113140 - RNA, 32 nt, Human
ccuccaaagcagccuagaagcugaggggcugu

SEQ ID NO: 113141 - RNA, 22 nt, Human
ccuccaaagcccauccuugggg

SEQ ID NO: 113142 - RNA, 32 nt, Human
ccuccaaaguacuaggguuacaggcaugagcc

SEQ ID NO: 113143 - RNA, 32 nt, Human
ccuccaaaguagcugggauuacaggcacccac

SEQ ID NO: 113144 - RNA, 32 nt, Human
ccuccaaaguagcugggauuacaggcaugcgc

SEQ ID NO: 113145 - RNA, 32 nt, Human
ccuccaaaguagcugggauuacagguuugcac

SEQ ID NO: 113146 - RNA, 32 nt, Human
ccuccaaaguagcugggauugcaggugccugc

SEQ ID NO: 113147 - RNA, 32 nt, Human
ccuccaaagugcugggauuacaggcaugagcc

SEQ ID NO: 113148 - RNA, 32 nt, Human
ccuccaaagugcugggauuacaggcccgagcc

SEQ ID NO: 113149 - RNA, 32 nt, Human
ccuccaaagugcugggauuacaggugugagcu

SEQ ID NO: 113150 - RNA, 32 nt, Human
ccuccaaagugcugggauugcaggcaugagcc

SEQ ID NO: 113151 - RNA, 32 nt, Human
ccuccaaagugcugugauuacaggugugagcc

SEQ ID NO: 113152 - RNA, 32 nt, Human
ccuccaaaguguugggauuacaggcaaugagc

SEQ ID NO: 113153 - RNA, 32 nt, Human
ccuccaaauguccuuucucagaggggccagcu

SEQ ID NO: 113154 - RNA, 32 nt, Human
ccuccaacaccaagcacagcagccuggggcug

SEQ ID NO: 113155 - RNA, 24 nt, Human
ccuccaacccagagccccagugag

SEQ ID NO: 113156 - RNA, 32 nt, Human
ccuccaacccucaaucagagcuacuuacagcc

SEQ ID NO: 113157 - RNA, 32 nt, Human
ccuccaacucccagguucaagugagucucgug

SEQ ID NO: 113158 - RNA, 32 nt, Human
ccuccaacucugagccuuccagagcuucagcc

SEQ ID NO: 113159 - RNA, 32 nt, Human
ccuccaacuggucggccggccugcuggcaugg

SEQ ID NO: 113160 - RNA, 17 nt, Human
ccuccaagaucaucuca

SEQ ID NO: 113161 - RNA, 32 nt, Human
ccuccaagaucuucccuugggcuuuucagcag

SEQ ID NO: 113162 - RNA, 32 nt, Human
ccuccaagccauccccucccaccaccagcucu

SEQ ID NO: 113163 - RNA, 32 nt, Human
ccuccaagcccaggaagccucaguuggccaaa

SEQ ID NO: 113164 - RNA, 32 nt, Human
ccuccaagccuauaccagcuguguacagcgcc

SEQ ID NO: 113165 - RNA, 32 nt, Human
ccuccaagcucagcugggcugaaugaacgcug

SEQ ID NO: 113166 - RNA, 32 nt, Human
ccuccaagcuuuggaccuugacuucugcaaaa

SEQ ID NO: 113167 - RNA, 32 nt, Human
ccuccaagcuuuggguuggagcuguuccauug

SEQ ID NO: 113168 - RNA, 21 nt, Human
ccuccaaggaagucccaggag

SEQ ID NO: 113169 - RNA, 32 nt, Human
ccuccaaggagaagccugaaagagagaaaacu

SEQ ID NO: 113170 - RNA, 32 nt, Human
ccuccaaggcaggcuucccuuuacagaggagg

SEQ ID NO: 113171 - RNA, 32 nt, Human
ccuccaaggccuucugucuaagcccaaaguuc

SEQ ID NO: 113172 - RNA, 32 nt, Human
ccuccaaggcuggagugcagugacgcgaucuc

SEQ ID NO: 113173 - RNA, 32 nt, Human
ccuccaagguagaauuugcaagagugacagug

SEQ ID NO: 113174 - RNA, 22 nt, Human
ccuccaaguggagccccaggag

SEQ ID NO: 113175 - RNA, 32 nt, Human
ccuccaauccggacucuuccucucacaucacc

SEQ ID NO: 113176 - RNA, 32 nt, Human
ccuccaauccugcuggcuucagccuggagaag

SEQ ID NO: 113177 - RNA, 32 nt, Human
ccuccaauccuugagaaccccaccccagagcc

SEQ ID NO: 113178 - RNA, 20 nt, Human
ccuccaaucuaucauucccu

SEQ ID NO: 113179 - RNA, 32 nt, Human
ccuccaaucugcacuuugauuugcuuccuaac

SEQ ID NO: 113180 - RNA, 32 nt, Human
ccuccaaugaggcagagguugcagugagcuga

SEQ ID NO: 113181 - RNA, 32 nt, Human
ccuccaaugggacucaaggacuugaccuccag

SEQ ID NO: 113182 - RNA, 21 nt, Human
ccuccaaugucuaauuuucuu

SEQ ID NO: 113183 - RNA, 32 nt, Human
ccuccaauuuccuuuggucuuuccaggagauu

SEQ ID NO: 113184 - RNA, 32 nt, Human
ccuccacaagugcugggauuacaggugugagc

SEQ ID NO: 113185 - RNA, 32 nt, Human
ccuccacacagcagacacggaccuauggacua

SEQ ID NO: 113186 - RNA, 31 nt, Human
ccuccacacagcuaaggauacaagcaacaga

SEQ ID NO: 113187 - RNA, 32 nt, Human
ccuccacacaucucccuaagucagaguggcug

SEQ ID NO: 113188 - RNA, 19 nt, Human
ccuccacaccucucugcug

SEQ ID NO: 113189 - RNA, 32 nt, Human
ccuccacaccucucugcugccagcacauucau

SEQ ID NO: 113190 - RNA, 17 nt, Human
ccuccacacucaccuca

SEQ ID NO: 113191 - RNA, 21 nt, Human
ccuccacacuucagcucugca

SEQ ID NO: 113192 - RNA, 32 nt, Human
ccuccacaggcaguggcaggcaccuccuccuc

SEQ ID NO: 113193 - RNA, 32 nt, Human
ccuccacaguccucuacacucuuccaggagca

SEQ ID NO: 113194 - RNA, 28 nt, Human
ccuccacaguuccccguggaacugugca

SEQ ID NO: 113195 - RNA, 22 nt, Human
ccuccacauggaggucccagga

SEQ ID NO: 113196 - RNA, 20 nt, Human
ccuccacauucccuuaagga

SEQ ID NO: 113197 - RNA, 22 nt, Human
ccuccacauucuugccacagca

SEQ ID NO: 113198 - RNA, 20 nt, Human
ccuccacauuuuucagugca

SEQ ID NO: 113199 - RNA, 32 nt, Human
ccuccaccaccacuggccaccaggcuggcgca

SEQ ID NO: 113200 - RNA, 19 nt, Human
ccuccaccacccccucaaa

SEQ ID NO: 113201 - RNA, 32 nt, Human
ccuccaccacccucccccagguugaggcacua

SEQ ID NO: 113202 - RNA, 32 nt, Human
ccuccaccaccugcagcuucucagccaaugcu

SEQ ID NO: 113203 - RNA, 32 nt, Human
ccuccaccagcauuucuccucuggucacaucu

SEQ ID NO: 113204 - RNA, 32 nt, Human
ccuccaccccacccuccaccucaauccccucc

SEQ ID NO: 113205 - RNA, 32 nt, Human
ccuccaccccacgaggacggggguggaaggcc

SEQ ID NO: 113206 - RNA, 32 nt, Human
ccuccacccccauccagcacccuucagcugug

SEQ ID NO: 113207 - RNA, 32 nt, Human
ccuccaccccucucuuuauaggccuaguuaac

SEQ ID NO: 113208 - RNA, 32 nt, Human
ccuccaccccuucagguaauaauccuccugcu

SEQ ID NO: 113209 - RNA, 32 nt, Human
ccuccaccccuuucuuucuuucucucucugau

SEQ ID NO: 113210 - RNA, 19 nt, Human
ccuccacccuuugcugcug

SEQ ID NO: 113211 - RNA, 32 nt, Human
ccuccaccggcccuugcaggggcacagagagc

SEQ ID NO: 113212 - RNA, 21 nt, Human
ccuccaccucaggccccagcc

SEQ ID NO: 113213 - RNA, 32 nt, Human
ccuccaccuccacagcucaagagcaagaugau

SEQ ID NO: 113214 - RNA, 32 nt, Human
ccuccaccuccaccacagccugcccagcuuuc

SEQ ID NO: 113215 - RNA, 32 nt, Human
ccuccaccuccaccgccaccuccaccuccggc

SEQ ID NO: 113216 - RNA, 32 nt, Human
ccuccaccuccaccucccccugccacagaggg

SEQ ID NO: 113217 - RNA, 32 nt, Human
ccuccaccuccaccucucuucccagagacccu

SEQ ID NO: 113218 - RNA, 32 nt, Human
ccuccaccuccagggcacagacagggggagcu

SEQ ID NO: 113219 - RNA, 32 nt, Human
ccuccaccuccaggguucagaguagcugggac

SEQ ID NO: 113220 - RNA, 19 nt, Human
ccuccaccuccccucguca

SEQ ID NO: 113221 - RNA, 32 nt, Human
ccuccaccucccgccagcauucccaugccgga

SEQ ID NO: 113222 - RNA, 32 nt, Human
ccuccaccuccugggucaagccauucugcuuc

SEQ ID NO: 113223 - RNA, 32 nt, Human
ccuccaccuccuggguucaagcgcuucuccag

SEQ ID NO: 113224 - RNA, 24 nt, Human
ccuccaccuccuugcaggcuuguu

SEQ ID NO: 113225 - RNA, 32 nt, Human
ccuccaccucuaccaucuccucuuucuccacc

SEQ ID NO: 113226 - RNA, 32 nt, Human
ccuccaccucuagcccagacacccccauuucu

SEQ ID NO: 113227 - RNA, 20 nt, Human
ccuccaccugcccauaguca

SEQ ID NO: 113228 - RNA, 32 nt, Human
ccuccaccugcgccucccuugucugaacuucc

SEQ ID NO: 113229 - RNA, 32 nt, Human
ccuccaccuuccugguucaagcgauucugccu

SEQ ID NO: 113230 - RNA, 32 nt, Human
ccuccaccuuccugguucaagggauucuccug

SEQ ID NO: 113231 - RNA, 32 nt, Human
ccuccaccuuuagcccugcucuggcuucugca

SEQ ID NO: 113232 - RNA, 32 nt, Human
ccuccaccuuugcccaauuucagauauuugag

SEQ ID NO: 113233 - RNA, 32 nt, Human
ccuccacgaagcccuccucaggcacaucgagg

SEQ ID NO: 113234 - RNA, 32 nt, Human
ccuccacgccuccaaucccccaccuccacccc

SEQ ID NO: 113235 - RNA, 32 nt, Human
ccuccacgcuaucccucugcagccugggcccu

SEQ ID NO: 113236 - RNA, 32 nt, Human
ccuccacgcugaggccuuugcuggacagguga

SEQ ID NO: 113237 - RNA, 32 nt, Human
ccuccacgcuuacagccacacacacagucaca

SEQ ID NO: 113238 - RNA, 31 nt, Human
ccuccacgcuugcugaauaccaagcugcagg

SEQ ID NO: 113239 - RNA, 32 nt, Human
ccuccacggccuggaccucggcugcaguaaag

SEQ ID NO: 113240 - RNA, 32 nt, Human
ccuccacguccggcuaauuuuguauuuuuagu

SEQ ID NO: 113241 - RNA, 19 nt, Human
ccuccacuacuccaccuca

SEQ ID NO: 113242 - RNA, 32 nt, Human
ccuccacuauaauguugagcagaacagugagg

SEQ ID NO: 113243 - RNA, 19 nt, Human
ccuccacuaugugggucuu

SEQ ID NO: 113244 - RNA, 32 nt, Human
ccuccacucacugcaggaaucccuucuacaau

SEQ ID NO: 113245 - RNA, 22 nt, Human
ccuccacucagcucccagcugc

SEQ ID NO: 113246 - RNA, 32 nt, Human
ccuccacucaggcuggggcucccugaggaugg

SEQ ID NO: 113247 - RNA, 32 nt, Human
ccuccacuccacccucuucugggauggcuggc

SEQ ID NO: 113248 - RNA, 32 nt, Human
ccuccacucccagugccccacaagggcguacg

SEQ ID NO: 113249 - RNA, 32 nt, Human
ccuccacuccccucugacccucaggcuuuccc

SEQ ID NO: 113250 - RNA, 32 nt, Human
ccuccacucccucccucccuuccuuccugcug

SEQ ID NO: 113251 - RNA, 32 nt, Human
ccuccacuccugccagcucauuuccuucaauu

SEQ ID NO: 113252 - RNA, 21 nt, Human
ccuccacucggcagccugcuc

SEQ ID NO: 113253 - RNA, 32 nt, Human
ccuccacucuauagcccagcugcugcuggagu

SEQ ID NO: 113254 - RNA, 32 nt, Human
ccuccacucuccucuuccagggcccccaaccc

SEQ ID NO: 113255 - RNA, 32 nt, Human
ccuccacucugggaacagcucacacccccaaa

SEQ ID NO: 113256 - RNA, 22 nt, Human
ccuccacucugguaaagcugca

SEQ ID NO: 113257 - RNA, 32 nt, Human
ccuccacugcaacaucuucuccuacgacuacu

SEQ ID NO: 113258 - RNA, 32 nt, Human
ccuccacugcacugcaacccugcuuucaaacc

SEQ ID NO: 113259 - RNA, 32 nt, Human
ccuccacugccucucgcccuguaucugucaac

SEQ ID NO: 113260 - RNA, 32 nt, Human
ccuccacugccugcaccacccaccuccagagu

SEQ ID NO: 113261 - RNA, 32 nt, Human
ccuccacugccuggcucagcgggccggagcug

SEQ ID NO: 113262 - RNA, 22 nt, Human
ccuccacuuauuuaggccucau

SEQ ID NO: 113263 - RNA, 32 nt, Human
ccuccacuucccaacccagaacuuggaaagac

SEQ ID NO: 113264 - RNA, 32 nt, Human
ccuccacuucccgcucagguuacagaccccag

SEQ ID NO: 113265 - RNA, 32 nt, Human
ccuccacuuccuccugccaccugcugcugcug

SEQ ID NO: 113266 - RNA, 23 nt, Human
ccuccacuuccugcccucuguuc

SEQ ID NO: 113267 - RNA, 32 nt, Human
ccuccacuucuucagcaccacacacacgcaca

SEQ ID NO: 113268 - RNA, 32 nt, Human
ccuccacuugcuuccuccuccuucccuccgcu

SEQ ID NO: 113269 - RNA, 21 nt, Human
ccuccacuuggcgggccccgu

SEQ ID NO: 113270 - RNA, 23 nt, Human
ccuccacuugugucagcuugcau

SEQ ID NO: 113271 - RNA, 21 nt, Human
ccuccagaaaaacggaucaca

SEQ ID NO: 113272 - RNA, 21 nt, Human
ccuccagaaaggacugggcau

SEQ ID NO: 113273 - RNA, 21 nt, Human
ccuccagaaaggagagacgca

SEQ ID NO: 113274 - RNA, 21 nt, Human
ccuccagaaggccccagagag

SEQ ID NO: 113275 - RNA, 32 nt, Human
ccuccagaauagcugggauuacaggcguacac

SEQ ID NO: 113276 - RNA, 32 nt, Human
ccuccagacagagucccuucucacuuauagag

SEQ ID NO: 113277 - RNA, 32 nt, Human
ccuccagaccacaggacugcagccuggggcuu

SEQ ID NO: 113278 - RNA, 32 nt, Human
ccuccagaccauucaggacacagggaaaucag

SEQ ID NO: 113279 - RNA, 32 nt, Human
ccuccagacccccuccccuccugugucccuug

SEQ ID NO: 113280 - RNA, 32 nt, Human
ccuccagaccuuccucugacccuugcugaacu

SEQ ID NO: 113281 - RNA, 32 nt, Human
ccuccagacguagccauuuccugacaucaaga

SEQ ID NO: 113282 - RNA, 32 nt, Human
ccuccagacucagcagagugaggggguaaagc

SEQ ID NO: 113283 - RNA, 32 nt, Human
ccuccagacucuaacuuuauagaucaucucuu

SEQ ID NO: 113284 - RNA, 23 nt, Human
ccuccagacugccacccucaaag

SEQ ID NO: 113285 - RNA, 32 nt, Human
ccuccagagaaaaagcccagcggaagaggacu

SEQ ID NO: 113286 - RNA, 21 nt, Human
ccuccagagaagacuggcaca

SEQ ID NO: 113287 - RNA, 32 nt, Human
ccuccagagacacaccguuccacuuacaguau

SEQ ID NO: 113288 - RNA, 32 nt, Human
ccuccagagaccaccccacccccacauuccuu

SEQ ID NO: 113289 - RNA, 23 nt, Human
ccuccagagauggccccagggag

SEQ ID NO: 113290 - RNA, 32 nt, Human
ccuccagagauuaaacauggugcaauggcacc

SEQ ID NO: 113291 - RNA, 20 nt, Human
ccuccagagcaacacuggcc

SEQ ID NO: 113292 - RNA, 32 nt, Human
ccuccagagcagcugggauuacagcagcuuca

SEQ ID NO: 113293 - RNA, 32 nt, Human
ccuccagagcuagugucaacugugucuggguu

SEQ ID NO: 113294 - RNA, 32 nt, Human
ccuccagaguaacagggauuacaggcauacuc

SEQ ID NO: 113295 - RNA, 32 nt, Human
ccuccagaguagcuaggacuacaggcagugug

SEQ ID NO: 113296 - RNA, 32 nt, Human
ccuccagaguagcucagauuacaguguuuucu

SEQ ID NO: 113297 - RNA, 23 nt, Human
ccuccagaguagcuggaaauaca

SEQ ID NO: 113298 - RNA, 32 nt, Human
ccuccagaguagcuggaaauacagugccaccc

SEQ ID NO: 113299 - RNA, 32 nt, Human
ccuccagaguagcuggaacuacaggugcccgc

SEQ ID NO: 113300 - RNA, 32 nt, Human
ccuccagaguagcuggaauuacaggcacauga

SEQ ID NO: 113301 - RNA, 32 nt, Human
ccuccagaguagcugggaccgcaggcacuugc

SEQ ID NO: 113302 - RNA, 32 nt, Human
ccuccagaguagcugggacuacaggcacacac

SEQ ID NO: 113303 - RNA, 32 nt, Human
ccuccagaguagcugggacuacaggcacccgc

SEQ ID NO: 113304 - RNA, 32 nt, Human
ccuccagaguagcugggacuacaggcauguga

SEQ ID NO: 113305 - RNA, 32 nt, Human
ccuccagaguagcugggacuacaggugcccac

SEQ ID NO: 113306 - RNA, 32 nt, Human
ccuccagaguagcugggacuacaggugcccgc

SEQ ID NO: 113307 - RNA, 32 nt, Human
ccuccagaguagcugggacugcgggcgcccca

SEQ ID NO: 113308 - RNA, 32 nt, Human
ccuccagaguagcugggauuacaggcaccuac

SEQ ID NO: 113309 - RNA, 32 nt, Human
ccuccagaguagcugggauuacaggcaccuga

SEQ ID NO: 113310 - RNA, 32 nt, Human
ccuccagaguagcugggauuacaggcacgcac

SEQ ID NO: 113311 - RNA, 32 nt, Human
ccuccagaguagcugggauuacaggcacgugc

SEQ ID NO: 113312 - RNA, 32 nt, Human
ccuccagaguagcugggauuacaggcaugcgc

SEQ ID NO: 113313 - RNA, 32 nt, Human
ccuccagaguagcugggauuacaggcgcccgc

SEQ ID NO: 113314 - RNA, 32 nt, Human
ccuccagaguagcugggauuuuaggugugcac

SEQ ID NO: 113315 - RNA, 32 nt, Human
ccuccagaguaucugggauuacauaugucggc

SEQ ID NO: 113316 - RNA, 32 nt, Human
ccuccagaugcagaggcuggggagucucucaa

SEQ ID NO: 113317 - RNA, 21 nt, Human
ccuccagaugcuguuaccuca

SEQ ID NO: 113318 - RNA, 26 nt, Human
ccuccagaugugccugcagccuaguc

SEQ ID NO: 113319 - RNA, 23 nt, Human
ccuccagauuccggcuucuacau

SEQ ID NO: 113320 - RNA, 32 nt, Human
ccuccagauucugcugcuuuccaguucucugu

SEQ ID NO: 113321 - RNA, 32 nt, Human
ccuccagcaaguguucccagcaaccagcucca

SEQ ID NO: 113322 - RNA, 21 nt, Human
ccuccagcacaaucccagcga

SEQ ID NO: 113323 - RNA, 32 nt, Human
ccuccagcacacacacauaagcacugaaauca

SEQ ID NO: 113324 - RNA, 32 nt, Human
ccuccagcacagagacgugccaggcgguguug

SEQ ID NO: 113325 - RNA, 31 nt, Human
ccuccagcacguguaccaaagcauguggaag

SEQ ID NO: 113326 - RNA, 32 nt, Human
ccuccagcagaaggcucuggcccagugguccu

SEQ ID NO: 113327 - RNA, 19 nt, Human
ccuccagcagcaaacagca

SEQ ID NO: 113328 - RNA, 19 nt, Human
ccuccagcagccaugcaug

SEQ ID NO: 113329 - RNA, 32 nt, Human
ccuccagcagccgccccgauaugccccggcac

SEQ ID NO: 113330 - RNA, 32 nt, Human
ccuccagcaggaggacagagugcccuggggca

SEQ ID NO: 113331 - RNA, 32 nt, Human
ccuccagcagggaaaaugcagcagggaugccc

SEQ ID NO: 113332 - RNA, 17 nt, Human
ccuccagcagggggcgc

SEQ ID NO: 113333 - RNA, 32 nt, Human
ccuccagcauuaacaucaacacagaccuuaag

SEQ ID NO: 113334 - RNA, 32 nt, Human
ccuccagccacaaguucccuguccuuaucagc

SEQ ID NO: 113335 - RNA, 32 nt, Human
ccuccagccacagcaguccacagcagcagggu

SEQ ID NO: 113336 - RNA, 32 nt, Human
ccuccagccacaguccagcccaaccacugcca

SEQ ID NO: 113337 - RNA, 32 nt, Human
ccuccagccagccuucugccggccccgccgcg

SEQ ID NO: 113338 - RNA, 32 nt, Human
ccuccagcccacaaggacuccagccugcuggc

SEQ ID NO: 113339 - RNA, 32 nt, Human
ccuccagccccagggcccugaccugcgcaccu

SEQ ID NO: 113340 - RNA, 32 nt, Human
ccuccagccccugcccguuucucuccaugagu

SEQ ID NO: 113341 - RNA, 32 nt, Human
ccuccagcccuggcaggcccucagccagcuuc

SEQ ID NO: 113342 - RNA, 21 nt, Human
ccuccagccucccacuuggua

SEQ ID NO: 113343 - RNA, 19 nt, Human
ccuccagccucccugcuuc

SEQ ID NO: 113344 - RNA, 17 nt, Human
ccuccagccugaacaga

SEQ ID NO: 113345 - RNA, 20 nt, Human
ccuccagccuggacaacaga

SEQ ID NO: 113346 - RNA, 21 nt, Human
ccuccagccugggcaauagag

SEQ ID NO: 113347 - RNA, 21 nt, Human
ccuccagccugggcgacagag

SEQ ID NO: 113348 - RNA, 22 nt, Human
ccuccagccugggcgacagagu

SEQ ID NO: 113349 - RNA, 32 nt, Human
ccuccagccuggggagacagagcgagauucug

SEQ ID NO: 113350 - RNA, 26 nt, Human
ccuccagccugggugacagagugaga

SEQ ID NO: 113351 - RNA, 32 nt, Human
ccuccagcuaugcagggauucucauuaaagag

SEQ ID NO: 113352 - RNA, 20 nt, Human
ccuccagcucacuggagaca

SEQ ID NO: 113353 - RNA, 32 nt, Human
ccuccagcucauggugucuggggccugcggcu

SEQ ID NO: 113354 - RNA, 21 nt, Human
ccuccagcucccccugggacc

SEQ ID NO: 113355 - RNA, 32 nt, Human
ccuccagcuccgccaaguaggugggauccacu

SEQ ID NO: 113356 - RNA, 23 nt, Human
ccuccagcuccuccgcucugccc

SEQ ID NO: 113357 - RNA, 32 nt, Human
ccuccagcucuauccauguugcugcaaaugac

SEQ ID NO: 113358 - RNA, 21 nt, Human
ccuccagcucucucuggggcc

SEQ ID NO: 113359 - RNA, 32 nt, Human
ccuccagcucugcagcaguugucuccuaaugu

SEQ ID NO: 113360 - RNA, 32 nt, Human
ccuccagcucuucuuuuaggggagaaacugcc

SEQ ID NO: 113361 - RNA, 26 nt, Human
ccuccagcucuuucuggaccugagcc

SEQ ID NO: 113362 - RNA, 32 nt, Human
ccuccagcugacugggacucaggcugcgugcc

SEQ ID NO: 113363 - RNA, 31 nt, Human
ccuccagcugagagagggaaccagccugccu

SEQ ID NO: 113364 - RNA, 32 nt, Human
ccuccagcugccgcaauuuccaugccaggaua

SEQ ID NO: 113365 - RNA, 32 nt, Human
ccuccagcuggcuggggccaccgugcggggug

SEQ ID NO: 113366 - RNA, 32 nt, Human
ccuccagcuggggagagaggggacucuccgga

SEQ ID NO: 113367 - RNA, 32 nt, Human
ccuccagcuuccagacuuuucuguccugucuc

SEQ ID NO: 113368 - RNA, 19 nt, Human
ccuccagcuucuccucuca

SEQ ID NO: 113369 - RNA, 32 nt, Human
ccuccagcuucugcuugaauuccuucaaggau

SEQ ID NO: 113370 - RNA, 32 nt, Human
ccuccagcuuuccuguauuucuucccaagagc

SEQ ID NO: 113371 - RNA, 20 nt, Human
ccuccaggaaauugccagug

SEQ ID NO: 113372 - RNA, 22 nt, Human
ccuccaggaaccuccacaucuc

SEQ ID NO: 113373 - RNA, 18 nt, Human
ccuccaggaacuccacuc

SEQ ID NO: 113374 - RNA, 32 nt, Human
ccuccaggaagaugcugacauccaggugggag

SEQ ID NO: 113375 - RNA, 32 nt, Human
ccuccaggaaggacuccucucccuguggcucc

SEQ ID NO: 113376 - RNA, 32 nt, Human
ccuccaggaaggaguugaccuggagaagcugg

SEQ ID NO: 113377 - RNA, 22 nt, Human
ccuccaggaaggucacaaagug

SEQ ID NO: 113378 - RNA, 32 nt, Human
ccuccaggaccagccaugguguggaggucuca

SEQ ID NO: 113379 - RNA, 21 nt, Human
ccuccaggaccccagcaagug

SEQ ID NO: 113380 - RNA, 21 nt, Human
ccuccaggaccgcugcgggug

SEQ ID NO: 113381 - RNA, 21 nt, Human
ccuccaggaccugcccgugug

SEQ ID NO: 113382 - RNA, 32 nt, Human
ccuccaggacucugagccuucugccucguaug

SEQ ID NO: 113383 - RNA, 20 nt, Human
ccuccaggacugccacagag

SEQ ID NO: 113384 - RNA, 32 nt, Human
ccuccaggacuguccugcugugccucugaagc

SEQ ID NO: 113385 - RNA, 18 nt, Human
ccuccaggagagggggca

SEQ ID NO: 113386 - RNA, 20 nt, Human
ccuccaggagcacucgcuca

SEQ ID NO: 113387 - RNA, 32 nt, Human
ccuccaggagcggggcccugcacaccauggcc

SEQ ID NO: 113388 - RNA, 20 nt, Human
ccuccaggaggcacggaaug

SEQ ID NO: 113389 - RNA, 32 nt, Human
ccuccaggagucucuggugcagcuggggugga

SEQ ID NO: 113390 - RNA, 20 nt, Human
ccuccaggaugcacagagug

SEQ ID NO: 113391 - RNA, 32 nt, Human
ccuccaggcacacacccgcuucuggacgucgg

SEQ ID NO: 113392 - RNA, 32 nt, Human
ccuccaggcagccacagccuggaaaagcacuc

SEQ ID NO: 113393 - RNA, 24 nt, Human
ccuccaggcagccucuggggcccg

SEQ ID NO: 113394 - RNA, 18 nt, Human
ccuccaggcaucaucuca

SEQ ID NO: 113395 - RNA, 32 nt, Human
ccuccaggccaggggagcaggagaugcucagc

SEQ ID NO: 113396 - RNA, 29 nt, Human
ccuccaggccuacacaggcugcccuggca

SEQ ID NO: 113397 - RNA, 22 nt, Human
ccuccaggccucucccaccuca

SEQ ID NO: 113398 - RNA, 32 nt, Human
ccuccaggcugacuuggggacaguggcuaugg

SEQ ID NO: 113399 - RNA, 32 nt, Human
ccuccagggaaagagcugggaggcaggaaugg

SEQ ID NO: 113400 - RNA, 32 nt, Human
ccuccagggaccccaccacacccucccagcug

SEQ ID NO: 113401 - RNA, 32 nt, Human
ccuccagggcccgggcuaagggcacagaacua

SEQ ID NO: 113402 - RNA, 32 nt, Human
ccuccagggcuccacuccccuuccuuuucuug

SEQ ID NO: 113403 - RNA, 32 nt, Human
ccuccagggcucgguauucuuccuucgggaag

SEQ ID NO: 113404 - RNA, 32 nt, Human
ccuccagggcugggccugcucugccugccacu

SEQ ID NO: 113405 - RNA, 32 nt, Human
ccuccagggcugggcgcaguggcucacuccug

SEQ ID NO: 113406 - RNA, 32 nt, Human
ccuccagggcuggggcuggcgccuccuccagc

SEQ ID NO: 113407 - RNA, 32 nt, Human
ccuccaggggcaccuccagccaggcuccaggg

SEQ ID NO: 113408 - RNA, 32 nt, Human
ccuccagggggagcugggguugcagggcaaca

SEQ ID NO: 113409 - RNA, 26 nt, Human
ccuccaggguagagaugcaccgaaug

SEQ ID NO: 113410 - RNA, 19 nt, Human
ccuccagguccacggagug

SEQ ID NO: 113411 - RNA, 21 nt, Human
ccuccaggugcacaagcucca

SEQ ID NO: 113412 - RNA, 32 nt, Human
ccuccaggugcacucccugccugccuccugca

SEQ ID NO: 113413 - RNA, 32 nt, Human
ccuccagguggaggcgggcugaugcugggugu

SEQ ID NO: 113414 - RNA, 32 nt, Human
ccuccaguagagacagaggggcaguguuugca

SEQ ID NO: 113415 - RNA, 32 nt, Human
ccuccagucaagucuucagauaauugcaacuu

SEQ ID NO: 113416 - RNA, 32 nt, Human
ccuccaguccaggccaaaucucagccugcccu

SEQ ID NO: 113417 - RNA, 22 nt, Human
ccuccagucccagcuacuaaga

SEQ ID NO: 113418 - RNA, 32 nt, Human
ccuccaguccccauggauuggaaauguucccc

SEQ ID NO: 113419 - RNA, 32 nt, Human
ccuccaguccugucucaucuccugggagaggc

SEQ ID NO: 113420 - RNA, 32 nt, Human
ccuccagucuccccuucagaaacaucucugcu

SEQ ID NO: 113421 - RNA, 32 nt, Human
ccuccagucuuucucuugcagcauccugacca

SEQ ID NO: 113422 - RNA, 32 nt, Human
ccuccaguuaucuagccaggaggucccaagag

SEQ ID NO: 113423 - RNA, 32 nt, Human
ccuccaguuccuccucuucgucccucagcguc

SEQ ID NO: 113424 - RNA, 32 nt, Human
ccuccaguuccuuggcaguucucccccaaacc

SEQ ID NO: 113425 - RNA, 32 nt, Human
ccuccauaagcuccuacucugcugcaguugag

SEQ ID NO: 113426 - RNA, 32 nt, Human
ccuccauaccuguucuugcccaugcagggcua

SEQ ID NO: 113427 - RNA, 32 nt, Human
ccuccauaggacacaggaggcaaguaugcggc

SEQ ID NO: 113428 - RNA, 32 nt, Human
ccuccaucagggguagcgagguugcaggagcu

SEQ ID NO: 113429 - RNA, 31 nt, Human
ccuccaucauuucagauuaccaaagcugucu

SEQ ID NO: 113430 - RNA, 20 nt, Human
ccuccaucccagcccacugg

SEQ ID NO: 113431 - RNA, 22 nt, Human
ccuccaucccauccccauggug

SEQ ID NO: 113432 - RNA, 16 nt, Human
ccuccauccccuccca

SEQ ID NO: 113433 - RNA, 32 nt, Human
ccuccaucccugucccccaucuuggugcugaa

SEQ ID NO: 113434 - RNA, 32 nt, Human
ccuccauccugcuggacuucaagccuugggac

SEQ ID NO: 113435 - RNA, 32 nt, Human
ccuccauccugcuuaccaccucccuggguacu

SEQ ID NO: 113436 - RNA, 32 nt, Human
ccuccaucguuuucucuuuucuccucuugauc

SEQ ID NO: 113437 - RNA, 32 nt, Human
ccuccaucuccccucauucacgcccccucagc

SEQ ID NO: 113438 - RNA, 32 nt, Human
ccuccaucuccggcuccugggcuugggaggcc

SEQ ID NO: 113439 - RNA, 25 nt, Human
ccuccaucuccucguccagcugguc

SEQ ID NO: 113440 - RNA, 19 nt, Human
ccuccaucucucccuuccc

SEQ ID NO: 113441 - RNA, 32 nt, Human
ccuccaucucugaggguaugggggccagaugg

SEQ ID NO: 113442 - RNA, 32 nt, Human
ccucuacacugcagaagaagcaaaacuccuuu

SEQ ID NO: 113443 - RNA, 32 nt, Human
ccucuacacuuaguuauugauaaacuucuuaa

SEQ ID NO: 113444 - RNA, 19 nt, Human
ccucuacagcauuuucuua

SEQ ID NO: 113445 - RNA, 31 nt, Human
ccucuacaggcccagccucuaccucacagug

SEQ ID NO: 113446 - RNA, 32 nt, Human
ccucuacaggcccagcuccugccuugcagugg

SEQ ID NO: 113447 - RNA, 31 nt, Human
ccucuacaggcccggccucuaccucacagug

SEQ ID NO: 113448 - RNA, 32 nt, Human
ccucuacaguuuggaggugauggugcagcagu

SEQ ID NO: 113449 - RNA, 32 nt, Human
ccucuacaucuucaccaagaucucgggauccu

SEQ ID NO: 113450 - RNA, 32 nt, Human
ccucuaccaagcugagacccccauccccagcu

SEQ ID NO: 113451 - RNA, 32 nt, Human
ccucuaccaccacccuguacccuagccugcac

SEQ ID NO: 113452 - RNA, 32 nt, Human
ccucuaccaccuugaaccuccuucccaaaaca

SEQ ID NO: 113453 - RNA, 32 nt, Human
ccucuaccauuuucuccuuccucccuucccuu

SEQ ID NO: 113454 - RNA, 17 nt, Human
ccucuacccaucuucuu

SEQ ID NO: 113455 - RNA, 32 nt, Human
ccucuacccugagccccuggcaacuacugauu

SEQ ID NO: 113456 - RNA, 32 nt, Human
ccucuaccucacagugggcucuccaggcccac

SEQ ID NO: 113457 - RNA, 32 nt, Human
ccucuaccucacugccaccacuccugcuuuua

SEQ ID NO: 113458 - RNA, 32 nt, Human
ccucuaccuccaccaucaccaucacuacucaa

SEQ ID NO: 113459 - RNA, 32 nt, Human
ccucuaccucccagccaccugccuugccuccc

SEQ ID NO: 113460 - RNA, 32 nt, Human
ccucuaccucccagguucaagugagucucaug

SEQ ID NO: 113461 - RNA, 32 nt, Human
ccucuaccuccuggauucaagcgguuuuccug

SEQ ID NO: 113462 - RNA, 32 nt, Human
ccucuaccugccucucacauggagauugugua

SEQ ID NO: 113463 - RNA, 32 nt, Human
ccucuaccuggauggauggucuuugggcaggg

SEQ ID NO: 113464 - RNA, 32 nt, Human
ccucuaccuugcugugccucucuggcuuuagc

SEQ ID NO: 113465 - RNA, 32 nt, Human
ccucuacgggcagaguccggcauccccucccc

SEQ ID NO: 113466 - RNA, 32 nt, Human
ccucuacgggcccagcuccugccuugcaaugg

SEQ ID NO: 113467 - RNA, 32 nt, Human
ccucuacgucucaugcagaaaaucagcaaauc

SEQ ID NO: 113468 - RNA, 23 nt, Human
ccucuacuauagucaucuuagga

SEQ ID NO: 113469 - RNA, 32 nt, Human
ccucuacucccuggcccuguaggcuguguuau

SEQ ID NO: 113470 - RNA, 32 nt, Human
ccucuacuccuuggccaugauguugcugacca

SEQ ID NO: 113471 - RNA, 20 nt, Human
ccucuacucucauccuagga

SEQ ID NO: 113472 - RNA, 18 nt, Human
ccucuacucuccaccuca

SEQ ID NO: 113473 - RNA, 32 nt, Human
ccucuacugcccaucuccccugcucaacuucu

SEQ ID NO: 113474 - RNA, 32 nt, Human
ccucuacugcccuggcugcagucagugcccag

SEQ ID NO: 113475 - RNA, 32 nt, Human
ccucuacugcucccucccucucuugccucuua

SEQ ID NO: 113476 - RNA, 32 nt, Human
ccucuacuguggguagugaaccuagguggaca

SEQ ID NO: 113477 - RNA, 21 nt, Human
ccucuacuugggaucucagga

SEQ ID NO: 113478 - RNA, 32 nt, Human
ccucuacuuuccugcugaaaugacauugguuu

SEQ ID NO: 113479 - RNA, 32 nt, Human
ccucuacuuuucucccuuuucccuccuguggc

SEQ ID NO: 113480 - RNA, 32 nt, Human
ccucuagaaagcaacugaggccaggugcggug

SEQ ID NO: 113481 - RNA, 32 nt, Human
ccucuagaagccucugcgcugcaaagguuugu

SEQ ID NO: 113482 - RNA, 32 nt, Human
ccucuagaagguuccagagacagugaaacugc

SEQ ID NO: 113483 - RNA, 32 nt, Human
ccucuagaccuccgcucccaguaaacacccuc

SEQ ID NO: 113484 - RNA, 32 nt, Human
ccucuagagcacugucucacuacuucuagaaa

SEQ ID NO: 113485 - RNA, 32 nt, Human
ccucuagaggacagauggccaggccugugcac

SEQ ID NO: 113486 - RNA, 32 nt, Human
ccucuagaguagcugggauuacaggcgcaugc

SEQ ID NO: 113487 - RNA, 32 nt, Human
ccucuagcagcuuccuguagguggcgaucucg

SEQ ID NO: 113488 - RNA, 32 nt, Human
ccucuagccccagcuacucaggcugggguggg

SEQ ID NO: 113489 - RNA, 32 nt, Human
ccucuagcucccaaccccacagccucuccaag

SEQ ID NO: 113490 - RNA, 32 nt, Human
ccucuagcugugggggugagggucccaugugg

SEQ ID NO: 113491 - RNA, 32 nt, Human
ccucuaggaagaaaggagguggaagggaaaug

SEQ ID NO: 113492 - RNA, 32 nt, Human
ccucuaggagacaaaacuacccccacugacaa

SEQ ID NO: 113493 - RNA, 32 nt, Human
ccucuaggagagcuggcucugcagugggggag

SEQ ID NO: 113494 - RNA, 32 nt, Human
ccucuaggagaugagaccuaccuuccaguugu

SEQ ID NO: 113495 - RNA, 18 nt, Human
ccucuaggcagggugcug

SEQ ID NO: 113496 - RNA, 32 nt, Human
ccucuaggcccaggcgcccgccugacacaugu

SEQ ID NO: 113497 - RNA, 23 nt, Human
ccucuagguccaggccccaggag

SEQ ID NO: 113498 - RNA, 32 nt, Human
ccucuagguggcuggggagaugucaggggaaa

SEQ ID NO: 113499 - RNA, 32 nt, Human
ccucuaguccacccucuccaguggucacucuu

SEQ ID NO: 113500 - RNA, 32 nt, Human
ccucuagucccagcuacccgggaggcugaggc

SEQ ID NO: 113501 - RNA, 23 nt, Human
ccucuagucccagcuacuuggga

SEQ ID NO: 113502 - RNA, 32 nt, Human
ccucuagucccagcuacuugggaggcugaagu

SEQ ID NO: 113503 - RNA, 32 nt, Human
ccucuagucccagcuacuugggaggcugaggu

SEQ ID NO: 113504 - RNA, 32 nt, Human
ccucuagucccagcuacuugggaggcuuaguc

SEQ ID NO: 113505 - RNA, 32 nt, Human
ccucuaguccuagcuacucgggaggcugaggc

SEQ ID NO: 113506 - RNA, 32 nt, Human
ccucuagugugggcaagggacaugaagccuga

SEQ ID NO: 113507 - RNA, 32 nt, Human
ccucuaguuccagcuacucgggagucugaggc

SEQ ID NO: 113508 - RNA, 32 nt, Human
ccucuaguugacuuuucucuuagccugaaugu

SEQ ID NO: 113509 - RNA, 32 nt, Human
ccucuauaacccccagagacaggcuggggcag

SEQ ID NO: 113510 - RNA, 32 nt, Human
ccucuauaagauaauucuucuccaucaucuuu

SEQ ID NO: 113511 - RNA, 32 nt, Human
ccucuauacccugguaggcuuccucuucagca

SEQ ID NO: 113512 - RNA, 32 nt, Human
ccucuauaugcuguuaauucaaaggcacucag

SEQ ID NO: 113513 - RNA, 32 nt, Human
ccucuauauguacaaucucucucccccucauu

SEQ ID NO: 113514 - RNA, 20 nt, Human
ccucuaucacaugcuugcca

SEQ ID NO: 113515 - RNA, 23 nt, Human
ccucuaucacaugguucuugaga

SEQ ID NO: 113516 - RNA, 32 nt, Human
ccucuaucacuucaaaacuccagcuugcccaa

SEQ ID NO: 113517 - RNA, 32 nt, Human
ccucuaucagggacagugugggugccacaggu

SEQ ID NO: 113518 - RNA, 32 nt, Human
ccucuauccucauuugucccuuccuccuagcg

SEQ ID NO: 113519 - RNA, 19 nt, Human
ccucuaucucuggcuccug

SEQ ID NO: 113520 - RNA, 32 nt, Human
ccucuaucugcagguccccagccuggguaaag

SEQ ID NO: 113521 - RNA, 21 nt, Human
ccucuaucuucucucuggcca

SEQ ID NO: 113522 - RNA, 32 nt, Human
ccucuaucuucucugcugucacacuggaaggc

SEQ ID NO: 113523 - RNA, 32 nt, Human
ccucuaugcccaccccugacacuucaccauuu

SEQ ID NO: 113524 - RNA, 32 nt, Human
ccucuaugucccacugucucucuccuucucuc

SEQ ID NO: 113525 - RNA, 32 nt, Human
ccucuaugugccaggcucuguguuggguacuu

SEQ ID NO: 113526 - RNA, 32 nt, Human
ccucuauucaccccuucucaauccucacaaaa

SEQ ID NO: 113527 - RNA, 21 nt, Human
ccucuauucuauuggcacuga

SEQ ID NO: 113528 - RNA, 32 nt, Human
ccucuauucucaccucccuugugaucauaaua

SEQ ID NO: 113529 - RNA, 32 nt, Human
ccucuauugacccgagugucucccucugcuuc

SEQ ID NO: 113530 - RNA, 32 nt, Human
ccucuauugcccaggcuggagugcaguggugu

SEQ ID NO: 113531 - RNA, 32 nt, Human
ccucuauuuccaaagccauuuaccucaaagga

SEQ ID NO: 113532 - RNA, 32 nt, Human
ccucuauuugggccuggagcagggaugggauu

SEQ ID NO: 113533 - RNA, 32 nt, Human
ccucucaaacauucuucugucaauuccacaca

SEQ ID NO: 113534 - RNA, 22 nt, Human
ccucucaaacuuccauuucuca

SEQ ID NO: 113535 - RNA, 32 nt, Human
ccucucaaagagcugggauuacaggcaugagu

SEQ ID NO: 113536 - RNA, 32 nt, Human
ccucucaaagugcugggauuacaagcaugagc

SEQ ID NO: 113537 - RNA, 32 nt, Human
ccucucaaagugcugggauuacaggcaugagc

SEQ ID NO: 113538 - RNA, 32 nt, Human
ccucucaaagugcugggauuacaggccugagc

SEQ ID NO: 113539 - RNA, 32 nt, Human
ccucucaaagugcugggauuacaggcgugagc

SEQ ID NO: 113540 - RNA, 32 nt, Human
ccucucaaagugcugggauuacaggcgugagg

SEQ ID NO: 113541 - RNA, 32 nt, Human
ccucucaaagugcugggauuacaggcgugagu

SEQ ID NO: 113542 - RNA, 32 nt, Human
ccucucaaagugcugggauuacaggcgugggc

SEQ ID NO: 113543 - RNA, 32 nt, Human
ccucucaaagugcugggauuacaggcuuacgc

SEQ ID NO: 113544 - RNA, 32 nt, Human
ccucucaaagugcugggauuacaggugugagc

SEQ ID NO: 113545 - RNA, 32 nt, Human
ccucucaaagugcugggauuacaggugugcca

SEQ ID NO: 113546 - RNA, 32 nt, Human
ccucucaaagugcugggauuacgggcaugagc

SEQ ID NO: 113547 - RNA, 32 nt, Human
ccucucaaagugcugggauuacgggcgugagc

SEQ ID NO: 113548 - RNA, 32 nt, Human
ccucucaaagugcugggauuauaggcaugaac

SEQ ID NO: 113549 - RNA, 32 nt, Human
ccucucaaagugcugggauuauaggcgugagc

SEQ ID NO: 113550 - RNA, 32 nt, Human
ccucucaaagugcugggauuauaggcuugagc

SEQ ID NO: 113551 - RNA, 32 nt, Human
ccucucaaaguguugggauuacaggcgugagc

SEQ ID NO: 113552 - RNA, 32 nt, Human
ccucucaaauagcugggacuacaggcagcaaa

SEQ ID NO: 113553 - RNA, 20 nt, Human
ccucucaacccauuuucuua

SEQ ID NO: 113554 - RNA, 32 nt, Human
ccucucaaccuacagacccagugagcccuagg

SEQ ID NO: 113555 - RNA, 32 nt, Human
ccucucaagcggggccacagggccaaggugug

SEQ ID NO: 113556 - RNA, 32 nt, Human
ccucucaaggcagaggaggaguuugguggguu

SEQ ID NO: 113557 - RNA, 32 nt, Human
ccucucaaguaacugggauuacaggcaugcgc

SEQ ID NO: 113558 - RNA, 32 nt, Human
ccucucaaguagcugggacuacaggcaugugc

SEQ ID NO: 113559 - RNA, 32 nt, Human
ccucucaaguagcugggacuacaggcgcccac

SEQ ID NO: 113560 - RNA, 32 nt, Human
ccucucaaguagcugggauuacaagcaccagc

SEQ ID NO: 113561 - RNA, 32 nt, Human
ccucucaaguagcugggauuacaagcaugcgc

SEQ ID NO: 113562 - RNA, 32 nt, Human
ccucucaaguagcugggauuacaggcgcccgc

SEQ ID NO: 113563 - RNA, 32 nt, Human
ccucucaaguagcugggauuacagggcaccug

SEQ ID NO: 113564 - RNA, 32 nt, Human
ccucucaaguagcugggauuacagggcuucag

SEQ ID NO: 113565 - RNA, 32 nt, Human
ccucucaaugucugaacugcucuggcugggca

SEQ ID NO: 113566 - RNA, 21 nt, Human
ccucucacaaauaugcuucuu

SEQ ID NO: 113567 - RNA, 32 nt, Human
ccucucacaccagcugcacucccguggcugcc

SEQ ID NO: 113568 - RNA, 21 nt, Human
ccucucacagauagaggucuu

SEQ ID NO: 113569 - RNA, 32 nt, Human
ccucucacagccucuguaucucugcaggccau

SEQ ID NO: 113570 - RNA, 24 nt, Human
ccucucacaggggcagggccgcuu

SEQ ID NO: 113571 - RNA, 32 nt, Human
ccucucacagucaguccucccacccgagugac

SEQ ID NO: 113572 - RNA, 32 nt, Human
ccucucacaugcagcacccgggccagcucccu

SEQ ID NO: 113573 - RNA, 32 nt, Human
ccucucaccacauugcccuccugggcaccccc

SEQ ID NO: 113574 - RNA, 32 nt, Human
ccucucacccccacccucuccccugccaggcu

SEQ ID NO: 113575 - RNA, 20 nt, Human
ccucucaccccucccuuccc

SEQ ID NO: 113576 - RNA, 32 nt, Human
ccucucacccuccacccuccaggagaccccag

SEQ ID NO: 113577 - RNA, 32 nt, Human
ccucucacgccacccccgcccccaccgggcug

SEQ ID NO: 113578 - RNA, 25 nt, Human
ccucucacgcuccacucugcagcuu

SEQ ID NO: 113579 - RNA, 32 nt, Human
ccucucacuccuucauuguccuaagagaacaa

SEQ ID NO: 113580 - RNA, 32 nt, Human
ccucucacucucaucuccugugcucaguguga

SEQ ID NO: 113581 - RNA, 18 nt, Human
ccucucacucugugugcu

SEQ ID NO: 113582 - RNA, 32 nt, Human
ccucucacugcccaaagaggcuuacuuuucuu

SEQ ID NO: 113583 - RNA, 32 nt, Human
ccucucagaaaaacuugccugguuugagggua

SEQ ID NO: 113584 - RNA, 32 nt, Human
ccucucagaagaggguggaagaugaaaugaaa

SEQ ID NO: 113585 - RNA, 32 nt, Human
ccucucagaccaguacgguggccgacgggagu

SEQ ID NO: 113586 - RNA, 32 nt, Human
ccucucagacuaagcacuaaaaagcaaagcaa

SEQ ID NO: 113587 - RNA, 32 nt, Human
ccucucagagauguucaugcaggcucccuagg

SEQ ID NO: 113588 - RNA, 32 nt, Human
ccucucagaggaggaggagcuggagacaggag

SEQ ID NO: 113589 - RNA, 32 nt, Human
ccucucagaggcagcaugagcugagaggguga

SEQ ID NO: 113590 - RNA, 32 nt, Human
ccucucagagugcugggaucacaggcgugagc

SEQ ID NO: 113591 - RNA, 32 nt, Human
ccucucagagugcugggauuauaggugugcgc

SEQ ID NO: 113592 - RNA, 32 nt, Human
ccucucagaguucuagaauuacaggcaugagc

SEQ ID NO: 113593 - RNA, 32 nt, Human
ccucucagcagaaacacacagucacauucgaa

SEQ ID NO: 113594 - RNA, 27 nt, Human
ccucucagcaggcggaggcucacagcu

SEQ ID NO: 113595 - RNA, 32 nt, Human
ccucucagcccuggcccucugccugcuccuca

SEQ ID NO: 113596 - RNA, 24 nt, Human
ccucucagccugccucugcagcuu

SEQ ID NO: 113597 - RNA, 32 nt, Human
ccucucagccuucucccuccccagggccacuu

SEQ ID NO: 113598 - RNA, 32 nt, Human
ccucucaggagaagacggaagcuggaguugga

SEQ ID NO: 113599 - RNA, 32 nt, Human
ccucucaggagaagccagaggcccuggccaaa

SEQ ID NO: 113600 - RNA, 32 nt, Human
ccucucaggauugcagaacaacacaucuccua

SEQ ID NO: 113601 - RNA, 32 nt, Human
ccucucaggcucgugauccuccugccucaacc

SEQ ID NO: 113602 - RNA, 16 nt, Human
ccucucagggcacugg

SEQ ID NO: 113603 - RNA, 32 nt, Human
ccucucagggccugggaaggguguggccagug

SEQ ID NO: 113604 - RNA, 32 nt, Human
ccucucagguucugccugugaagcagcucaaa

SEQ ID NO: 113605 - RNA, 32 nt, Human
ccucucagucaccaagucaccucccucugaaa

SEQ ID NO: 113606 - RNA, 32 nt, Human
ccucucaguccagccuggaggugugcucugag

SEQ ID NO: 113607 - RNA, 32 nt, Human
ccucucagugcccuccagccccgcgaccaugu

SEQ ID NO: 113608 - RNA, 32 nt, Human
ccucucaguucucucccuuccucucuccuuau

SEQ ID NO: 113609 - RNA, 32 nt, Human
ccucucauacaucaagccccagaggaggcggc

SEQ ID NO: 113610 - RNA, 32 nt, Human
ccucucaucccccuguggaauguugggucuca

SEQ ID NO: 113611 - RNA, 32 nt, Human
ccucucauccccuuauccuucucccucgacau

SEQ ID NO: 113612 - RNA, 32 nt, Human
ccucucaucccuagcuccucugguuuaauguc

SEQ ID NO: 113613 - RNA, 32 nt, Human
ccucucaucccucggcaccucuuguuuuccuu

SEQ ID NO: 113614 - RNA, 19 nt, Human
ccucucaugaucacuggua

SEQ ID NO: 113615 - RNA, 32 nt, Human
ccucucaugggauggacccugccaaccuggcc

SEQ ID NO: 113616 - RNA, 32 nt, Human
ccucucauugccugagguugggcccgaacacg

SEQ ID NO: 113617 - RNA, 32 nt, Human
ccucuccaaacagccaugcccuccaaaugcua

SEQ ID NO: 113618 - RNA, 32 nt, Human
ccucuccaaagaccagcuuuuccccagccagg

SEQ ID NO: 113619 - RNA, 32 nt, Human
ccucuccaacaugacauccuccugcuguguca

SEQ ID NO: 113620 - RNA, 32 nt, Human
ccucuccaagcccugaacuuacuccaguuggc

SEQ ID NO: 113621 - RNA, 32 nt, Human
ccucuccaagugcugggauuacaggcaucagc

SEQ ID NO: 113622 - RNA, 20 nt, Human
ccucuccaaucccacaccau

SEQ ID NO: 113623 - RNA, 32 nt, Human
ccucuccaaugcccagccccagaucuggcgga

SEQ ID NO: 113624 - RNA, 32 nt, Human
ccucuccaaugccucagccacagagucaccuc

SEQ ID NO: 113625 - RNA, 32 nt, Human
ccucuccacacauuccauuuacagaguaugag

SEQ ID NO: 113626 - RNA, 32 nt, Human
ccucuccacagaagcagcuggaagagaacucg

SEQ ID NO: 113627 - RNA, 32 nt, Human
ccucuccacagugugagacuucaaggggaagu

SEQ ID NO: 113628 - RNA, 32 nt, Human
ccucuccaccaccacucacaguagccuugcug

SEQ ID NO: 113629 - RNA, 32 nt, Human
ccucuccaccauccuccagucguugcccucau

SEQ ID NO: 113630 - RNA, 32 nt, Human
ccucuccaccaugggcugcaguauagacagac

SEQ ID NO: 113631 - RNA, 32 nt, Human
ccucuccaccugcuggugagaggugcaaagag

SEQ ID NO: 113632 - RNA, 18 nt, Human
ccucuccacguggccugc

SEQ ID NO: 113633 - RNA, 32 nt, Human
ccucuccacuagcugcccuggucuccaccauu

SEQ ID NO: 113634 - RNA, 32 nt, Human
ccucuccacugcagcagcuuagcaaggacugg

SEQ ID NO: 113635 - RNA, 32 nt, Human
ccucuccacugccuccuccaccccuguauuuc

SEQ ID NO: 113636 - RNA, 32 nt, Human
ccucuccagaagcagagcaugaccugggugac

SEQ ID NO: 113637 - RNA, 32 nt, Human
ccucuccagacccugggcugcggcugaggcgc

SEQ ID NO: 113638 - RNA, 23 nt, Human
ccucuccagacuccaccucccca

SEQ ID NO: 113639 - RNA, 32 nt, Human
ccucuccagacuuccauuucuucacaaggaug

SEQ ID NO: 113640 - RNA, 32 nt, Human
ccucuccagcaacccucagcucaggcuagacu

SEQ ID NO: 113641 - RNA, 20 nt, Human
ccucuccagcacacagcaca

SEQ ID NO: 113642 - RNA, 32 nt, Human
ccucuccagcacuccgugguucucucagcccc

SEQ ID NO: 113643 - RNA, 32 nt, Human
ccucuccagcacuucucucuucaagcggcgac

SEQ ID NO: 113644 - RNA, 32 nt, Human
ccucuccagcaggcuagcucaggcuuauucac

SEQ ID NO: 113645 - RNA, 32 nt, Human
ccucuccagccaccccaagagguucucgcaac

SEQ ID NO: 113646 - RNA, 32 nt, Human
ccucuccagccuguuugagugcuccacccgga

SEQ ID NO: 113647 - RNA, 32 nt, Human
ccucuccaggcccaucucuugccucacagugg

SEQ ID NO: 113648 - RNA, 20 nt, Human
ccucuccagggaguccagga

SEQ ID NO: 113649 - RNA, 32 nt, Human
ccucuccagggcccccucucuguuggagcuga

SEQ ID NO: 113650 - RNA, 32 nt, Human
ccucuccagggcccuggcugggccaguccugu

SEQ ID NO: 113651 - RNA, 21 nt, Human
ccucuccaggugcucccacca

SEQ ID NO: 113652 - RNA, 32 nt, Human
ccucuccaguagcuggaacuacaggcaugcau

SEQ ID NO: 113653 - RNA, 32 nt, Human
ccucuccaguagcugggauuacaggugugcac

SEQ ID NO: 113654 - RNA, 32 nt, Human
ccucuccaguagcugggauuacaggugugugc

SEQ ID NO: 113655 - RNA, 22 nt, Human
ccucuccagugagccuccuuca

SEQ ID NO: 113656 - RNA, 32 nt, Human
ccucuccaguggugaagacccagccugcugag

SEQ ID NO: 113657 - RNA, 32 nt, Human
ccucuccauagaggagaggaaaagguauaggc

SEQ ID NO: 113658 - RNA, 32 nt, Human
ccucuccauagaggagaggaaaagguguaggc

SEQ ID NO: 113659 - RNA, 32 nt, Human
ccucuccauccuggggccaggacucuuaugcc

SEQ ID NO: 113660 - RNA, 25 nt, Human
ccucuccaucuggucaacugcggga

SEQ ID NO: 113661 - RNA, 23 nt, Human
ccucuccaucuucagcuucuuca

SEQ ID NO: 113662 - RNA, 32 nt, Human
ccucuccaugcuguggcccuggugauggcaga

SEQ ID NO: 113663 - RNA, 19 nt, Human
ccucuccauucuccccuca

SEQ ID NO: 113664 - RNA, 32 nt, Human
ccucuccauuuuucucuuucuccuccuggccu

SEQ ID NO: 113665 - RNA, 32 nt, Human
ccucucccaagaggagcagagaaaacuggaag

SEQ ID NO: 113666 - RNA, 32 nt, Human
ccucucccaagccaggucaaggagguuugggg

SEQ ID NO: 113667 - RNA, 32 nt, Human
ccucucccacccaaggagaacguuugguacaa

SEQ ID NO: 113668 - RNA, 32 nt, Human
ccucucccacgcugccccguacuggaccccug

SEQ ID NO: 113669 - RNA, 22 nt, Human
ccucucccacgugguccaguca

SEQ ID NO: 113670 - RNA, 32 nt, Human
ccucucccacucagcccuacaggaagcagcag

SEQ ID NO: 113671 - RNA, 32 nt, Human
ccucucccacugcacccuggguugggugcaca

SEQ ID NO: 113672 - RNA, 32 nt, Human
ccucucccacuuucucuucccucuacucacua

SEQ ID NO: 113673 - RNA, 32 nt, Human
ccucucccagaacucgguccuggggaaugcuc

SEQ ID NO: 113674 - RNA, 32 nt, Human
ccucucccagcccacuggguggggaagcagcu

SEQ ID NO: 113675 - RNA, 32 nt, Human
ccucucccagcucucccgagucugugacuaca

SEQ ID NO: 113676 - RNA, 32 nt, Human
ccucucccagcuguuaaauuaguacuucuuca

SEQ ID NO: 113677 - RNA, 32 nt, Human
ccucucccaucgcgagacacugaagacccuca

SEQ ID NO: 113678 - RNA, 32 nt, Human
ccucucccauuccuggccccagccuggccagg

SEQ ID NO: 113679 - RNA, 32 nt, Human
ccucuccccaaaauauucccaucuuguccuag

SEQ ID NO: 113680 - RNA, 32 nt, Human
ccucuccccaacacggacucuauuuccccaca

SEQ ID NO: 113681 - RNA, 19 nt, Human
ccucuccccaauuucauua

SEQ ID NO: 113682 - RNA, 32 nt, Human
ccucuccccacauguaucccucggucugaauu

SEQ ID NO: 113683 - RNA, 32 nt, Human
ccucuccccagaaaacuugucucuacucaucu

SEQ ID NO: 113684 - RNA, 32 nt, Human
ccucuccccagcccaggagaggcugcggagcc

SEQ ID NO: 113685 - RNA, 32 nt, Human
ccucuccccagccucagcugcuguccgccuga

SEQ ID NO: 113686 - RNA, 19 nt, Human
ccucuccccagccucgccu

SEQ ID NO: 113687 - RNA, 32 nt, Human
ccucuccccagccugggaagaugucucacugu

SEQ ID NO: 113688 - RNA, 32 nt, Human
ccucuccccauucgguguggugcagugugaaa

SEQ ID NO: 113689 - RNA, 24 nt, Human
ccucucccccaggaggcuccuuga

SEQ ID NO: 113690 - RNA, 18 nt, Human
ccucucccccagucccau

SEQ ID NO: 113691 - RNA, 32 nt, Human
ccucucccccuccuuccaucucuucucucucu

SEQ ID NO: 113692 - RNA, 32 nt, Human
ccucucccccuuccucucucccuucccuucca

SEQ ID NO: 113693 - RNA, 32 nt, Human
ccucuccccguucaacagccgggcagcggcag

SEQ ID NO: 113694 - RNA, 32 nt, Human
ccucuccccuaguacacuucugagaugccagg

SEQ ID NO: 113695 - RNA, 32 nt, Human
ccucuccccuccacuuucauuuuagcaugaga

SEQ ID NO: 113696 - RNA, 32 nt, Human
ccucuccccuccccucuccuccgcccccggcc

SEQ ID NO: 113697 - RNA, 32 nt, Human
ccucuccccuccuuuuccuuccuuccuuccuu

SEQ ID NO: 113698 - RNA, 32 nt, Human
ccucuccccugccccucaaccugccuuagcug

SEQ ID NO: 113699 - RNA, 32 nt, Human
ccucuccccugccucaagcccugcccccagcu

SEQ ID NO: 113700 - RNA, 32 nt, Human
ccucuccccugccugcccuggugacaucaggu

SEQ ID NO: 113701 - RNA, 32 nt, Human
ccucuccccuggggcaucccuuugccuuggca

SEQ ID NO: 113702 - RNA, 32 nt, Human
ccucuccccuggugaagacccagggaacccag

SEQ ID NO: 113703 - RNA, 32 nt, Human
ccucuccccuuguaggugacacaugcucugcc

SEQ ID NO: 113704 - RNA, 32 nt, Human
ccucucccgaaggagaucucuuucucuuuaau

SEQ ID NO: 113705 - RNA, 32 nt, Human
ccucucccgacauuggugcugaagacgcaggg

SEQ ID NO: 113706 - RNA, 22 nt, Human
ccucucccgcugccagcacagg

SEQ ID NO: 113707 - RNA, 32 nt, Human
ccucucccgcugcucaccugugucagggcuag

SEQ ID NO: 113708 - RNA, 32 nt, Human
ccucucccggggcggaggugaggaccuccuug

SEQ ID NO: 113709 - RNA, 32 nt, Human
ccucucccgugagucccgcuguccuguacgcg

SEQ ID NO: 113710 - RNA, 32 nt, Human
ccucucccgugccucugcuuucuccagcagcu

SEQ ID NO: 113711 - RNA, 32 nt, Human
ccucucccuccaccucucccugcccccagcgc

SEQ ID NO: 113712 - RNA, 32 nt, Human
ccucucccucccccucucccucccaucccuuu

SEQ ID NO: 113713 - RNA, 32 nt, Human
ccucucccuccccucuccucuccuccccuugc

SEQ ID NO: 113714 - RNA, 22 nt, Human
ccucucccuccuccauuccucu

SEQ ID NO: 113715 - RNA, 18 nt, Human
ccucucccucucccuccc

SEQ ID NO: 113716 - RNA, 19 nt, Human
ccucucccucucugccuga

SEQ ID NO: 113717 - RNA, 20 nt, Human
ccucucccucuucuuccucu

SEQ ID NO: 113718 - RNA, 32 nt, Human
ccucucccugauggcacacaaggagccuccuu

SEQ ID NO: 113719 - RNA, 32 nt, Human
ccucucccugcacucccuccuggagcucugug

SEQ ID NO: 113720 - RNA, 32 nt, Human
ccucucccugcagcuuucacugcucuugccua

SEQ ID NO: 113721 - RNA, 32 nt, Human
ccucucccugcccagcccucccuuccuuccuc

SEQ ID NO: 113722 - RNA, 32 nt, Human
ccucucccugcgcccagccucuccccagcaug

SEQ ID NO: 113723 - RNA, 15 nt, Human
ccucucccugcugcc

SEQ ID NO: 113724 - RNA, 32 nt, Human
ccucucccugggaacgggcugaccacaacaca

SEQ ID NO: 113725 - RNA, 32 nt, Human
ccucucccuguaucaugucagcacauaguagg

SEQ ID NO: 113726 - RNA, 18 nt, Human
ccucucccuguuggcugg

SEQ ID NO: 113727 - RNA, 17 nt, Human
ccucucccuucaccuca

SEQ ID NO: 113728 - RNA, 18 nt, Human
ccucucccuucccuuccc

SEQ ID NO: 113729 - RNA, 19 nt, Human
ccucucccuucuccuuccc

SEQ ID NO: 113730 - RNA, 32 nt, Human
ccucuccgcacaccugcccugggccuugacug

SEQ ID NO: 113731 - RNA, 21 nt, Human
ccucuccgccccgugguuccu

SEQ ID NO: 113732 - RNA, 21 nt, Human
ccucuccgccgggacgcggga

SEQ ID NO: 113733 - RNA, 21 nt, Human
ccucuccgcgaagcgcagcac

SEQ ID NO: 113734 - RNA, 23 nt, Human
ccucuccgcgggcggagcccugg

SEQ ID NO: 113735 - RNA, 21 nt, Human
ccucuccgcuucgccgcuccg

SEQ ID NO: 113736 - RNA, 32 nt, Human
ccucuccggccccgccuucccuucccuccgcc

SEQ ID NO: 113737 - RNA, 27 nt, Human
ccucuccgggaacuuccccugcuccuu

SEQ ID NO: 113738 - RNA, 32 nt, Human
ccucuccgucuucuccccuccuucuuccccac

SEQ ID NO: 113739 - RNA, 32 nt, Human
ccucuccuaagcugccuguucgcgcgagaguu

SEQ ID NO: 113740 - RNA, 22 nt, Human
ccucuccuacauccauuucuuc

SEQ ID NO: 113741 - RNA, 19 nt, Human
ccucuccuacauuuucuug

SEQ ID NO: 113742 - RNA, 32 nt, Human
ccucuccuacauuuucuugcuguugcuaauuc

SEQ ID NO: 113743 - RNA, 32 nt, Human
ccucuccuaccagggggaccuggaccuggagc

SEQ ID NO: 113744 - RNA, 32 nt, Human
ccucuccuacuuggcccagcugcuuggaggac

SEQ ID NO: 113745 - RNA, 21 nt, Human
ccucuccuagccacagacaga

SEQ ID NO: 113746 - RNA, 32 nt, Human
ccucuccuaugggacuaguucaucucagccag

SEQ ID NO: 113747 - RNA, 32 nt, Human
ccucuccucaccccaccaacuuccucagcacc

SEQ ID NO: 113748 - RNA, 32 nt, Human
ccucuccuccacccagaccaagugccugagga

SEQ ID NO: 113749 - RNA, 32 nt, Human
ccucuccuccacugcccccgccucccaccacc

SEQ ID NO: 113750 - RNA, 32 nt, Human
ccucuccuccccuggggcacagagauauauua

SEQ ID NO: 113751 - RNA, 32 nt, Human
ccucuccucccuccuccacaccuugagugaug

SEQ ID NO: 113752 - RNA, 32 nt, Human
ccucuccucccucugucccucuccuugccccc

SEQ ID NO: 113753 - RNA, 32 nt, Human
ccucuccuccgcugucaugccugcuuccgcuu

SEQ ID NO: 113754 - RNA, 32 nt, Human
ccucuccuccuccagcccccagccuacucucc

SEQ ID NO: 113755 - RNA, 19 nt, Human
ccucuccuccucccuuccc

SEQ ID NO: 113756 - RNA, 32 nt, Human
ccucuccuccuccuccuccucuuccuccuccu

SEQ ID NO: 113757 - RNA, 20 nt, Human
ccucuccuccuccuuccucu

SEQ ID NO: 113758 - RNA, 32 nt, Human
ccucuccuccuuccugucuccucucucucccu

SEQ ID NO: 113759 - RNA, 32 nt, Human
ccucuccucgcccugcucccccaaaccggcgu

SEQ ID NO: 113760 - RNA, 20 nt, Human
ccucuccucucagcucugcc

SEQ ID NO: 113761 - RNA, 32 nt, Human
ccucuccucucccacagcccuuauugccagug

SEQ ID NO: 113762 - RNA, 18 nt, Human
ccucuccucucuuccucu

SEQ ID NO: 113763 - RNA, 32 nt, Human
ccucuccucucuuccucucuucucucuuccuc

SEQ ID NO: 113764 - RNA, 16 nt, Human
ccucuccucugcugcc

SEQ ID NO: 113765 - RNA, 32 nt, Human
ccucuccucuggcugcuacaacuuccccuuuc

SEQ ID NO: 113766 - RNA, 32 nt, Human
ccucuccugacgccuccgccgcccgggucaug

SEQ ID NO: 113767 - RNA, 32 nt, Human
ccucuccugauccgccggcagcaacgagccau

SEQ ID NO: 113768 - RNA, 32 nt, Human
ccucuccugcagcuccagcuuugugcucugcc

SEQ ID NO: 113769 - RNA, 32 nt, Human
ccucuccugcagcucccgcgucgcugggagga

SEQ ID NO: 113770 - RNA, 32 nt, Human
ccucuccugcauuccugacaacaaccaacagc

SEQ ID NO: 113771 - RNA, 32 nt, Human
ccucuccugcauuuuccuccaucuccagguac

SEQ ID NO: 113772 - RNA, 18 nt, Human
ccucuccugccacccaga

SEQ ID NO: 113773 - RNA, 32 nt, Human
ccucuccugccacccuuauaccuguucagccu

SEQ ID NO: 113774 - RNA, 32 nt, Human
ccucuccugccagacagcccacgaccgggucg

SEQ ID NO: 113775 - RNA, 32 nt, Human
ccucuccugcccaggggcuagagagcagucuc

SEQ ID NO: 113776 - RNA, 32 nt, Human
ccucuccugcccugccuuccucuuccccaagg

SEQ ID NO: 113777 - RNA, 32 nt, Human
ccucuccugccucccuucccacuuccuccaug

SEQ ID NO: 113778 - RNA, 32 nt, Human
ccucuccugccucugcugagcuccccuccacg

SEQ ID NO: 113779 - RNA, 32 nt, Human
ccucuccugccucuggauguuuccuuggagcc

SEQ ID NO: 113780 - RNA, 32 nt, Human
ccucuccugccuggacagcucugcuggucucc

SEQ ID NO: 113781 - RNA, 32 nt, Human
ccucuccugccuggacggcucugcuggucucc

SEQ ID NO: 113782 - RNA, 32 nt, Human
ccucuccuggacauggcaaugaugaguuuuua

SEQ ID NO: 113783 - RNA, 32 nt, Human
ccucuccuggcagcuucucaggucucccuaau

SEQ ID NO: 113784 - RNA, 32 nt, Human
ccucuccuguccacagccagggguuaggucug

SEQ ID NO: 113785 - RNA, 32 nt, Human
ccucuccuucaaggaggguucccgcagcuggg

SEQ ID NO: 113786 - RNA, 32 nt, Human
ccucuccuugcacccauaccucuuuguaccgc

SEQ ID NO: 113787 - RNA, 32 nt, Human
ccucuccuugccagcuucuccccaggccagag

SEQ ID NO: 113788 - RNA, 32 nt, Human
ccucuccuugcugcugucuggacauggguguu

SEQ ID NO: 113789 - RNA, 32 nt, Human
ccucuccuuuuccuccuuuuuaccuucuggcc

SEQ ID NO: 113790 - RNA, 32 nt, Human
ccucuccuuuucuuccuccucuuccaacuccu

SEQ ID NO: 113791 - RNA, 31 nt, Human
ccucucgacccuccugggccuuguuccgcuc

SEQ ID NO: 113792 - RNA, 32 nt, Human
ccucucgacggccucuccaggugcaaaacuuc

SEQ ID NO: 113793 - RNA, 32 nt, Human
ccucucgagcagcuggaauuacaggcacgugc

SEQ ID NO: 113794 - RNA, 32 nt, Human
ccucucgagcagcugggauuacagguaugcgc

SEQ ID NO: 113795 - RNA, 32 nt, Human
ccucucgaguagaugggauuauaggcaugugc

SEQ ID NO: 113796 - RNA, 32 nt, Human
ccucucgaguagcuaggacuacaggcacaugc

SEQ ID NO: 113797 - RNA, 32 nt, Human
ccucucgaguagcuaggauuacaggcaugcac

SEQ ID NO: 113798 - RNA, 32 nt, Human
ccucucgaguagcugcgacuacaggugcccac

SEQ ID NO: 113799 - RNA, 32 nt, Human
ccucucgaguagcuggaauuacaggucuggca

SEQ ID NO: 113800 - RNA, 32 nt, Human
ccucucgaguagcugggacuacaggcgugagc

SEQ ID NO: 113801 - RNA, 32 nt, Human
ccucucgaguagcugggacuacaggcgugcgc

SEQ ID NO: 113802 - RNA, 32 nt, Human
ccucucgaguagcugggaguacagaugcacac

SEQ ID NO: 113803 - RNA, 32 nt, Human
ccucucgaguagcugggauuacaggcaccugc

SEQ ID NO: 113804 - RNA, 32 nt, Human
ccucucgaguagcugggauuacaggcaugcac

SEQ ID NO: 113805 - RNA, 32 nt, Human
ccucucgaguagcugggauuacaggcaugcgc

SEQ ID NO: 113806 - RNA, 32 nt, Human
ccucucgaguagcugggauuacaggcgcaugc

SEQ ID NO: 113807 - RNA, 32 nt, Human
ccucucgaguagcugggauuauaggcguccgc

SEQ ID NO: 113808 - RNA, 32 nt, Human
ccucucgaguagcuggggcuacagcuaugcgc

SEQ ID NO: 113809 - RNA, 32 nt, Human
ccucucgaguggcugggauuacaggcauccgc

SEQ ID NO: 113810 - RNA, 32 nt, Human
ccucucgcagccgccgcagucgcugcgccccg

SEQ ID NO: 113811 - RNA, 32 nt, Human
ccucucgccaggcuggaguguaguggcacaau

SEQ ID NO: 113812 - RNA, 32 nt, Human
ccucucgcccaggcuggagugcagugguguca

SEQ ID NO: 113813 - RNA, 32 nt, Human
ccucucgccgccgccuccacagccugggccuc

SEQ ID NO: 113814 - RNA, 32 nt, Human
ccucucgcugagacacacauacacucacacau

SEQ ID NO: 113815 - RNA, 32 nt, Human
ccucucggcggccucuccaggugcaaaacuuc

SEQ ID NO: 113816 - RNA, 32 nt, Human
ccucucgggcagcuggaauuacaggcaugcgc

SEQ ID NO: 113817 - RNA, 32 nt, Human
ccucucgggccggcucuccaucuugucgcccg

SEQ ID NO: 113818 - RNA, 32 nt, Human
ccucucgggccuccaguggcccaggggagguu

SEQ ID NO: 113819 - RNA, 23 nt, Human
ccucucggugccacuggcucuca

SEQ ID NO: 113820 - RNA, 32 nt, Human
ccucucguggccucaacgggcccagccccugc

SEQ ID NO: 113821 - RNA, 32 nt, Human
ccucucuacaaacaauacaaaaauuagccagg

SEQ ID NO: 113822 - RNA, 20 nt, Human
ccucucuacaccccagggca

SEQ ID NO: 113823 - RNA, 31 nt, Human
ccucucuacagcuaggagccaauggcagaag

SEQ ID NO: 113824 - RNA, 32 nt, Human
ccucucuaccacccucacuccaugaccuguga

SEQ ID NO: 113825 - RNA, 32 nt, Human
ccucucuacuaaaaauacaaaaauuagcuagg

SEQ ID NO: 113826 - RNA, 32 nt, Human
ccucucuacuaaaaauacaaaaauuagcuggg

SEQ ID NO: 113827 - RNA, 32 nt, Human
ccucucuacuaaaaauacaaaaauuugccagg

SEQ ID NO: 113828 - RNA, 32 nt, Human
ccucucuacuaaaaauauaaaaauuagccaag

SEQ ID NO: 113829 - RNA, 32 nt, Human
ccucucuacuaaaaaugcaaaaauuaguccgg

SEQ ID NO: 113830 - RNA, 32 nt, Human
ccucucuacuaaaacuacaaaaauuaacuggg

SEQ ID NO: 113831 - RNA, 32 nt, Human
ccucucuacuaaaguacaaaaguuagcugguc

SEQ ID NO: 113832 - RNA, 21 nt, Human
ccucucuacucagcccaguca

SEQ ID NO: 113833 - RNA, 32 nt, Human
ccucucuacuccugugcuguagcaccuucacu

SEQ ID NO: 113834 - RNA, 32 nt, Human
ccucucuaguagcugagauuacaggcaugcac

SEQ ID NO: 113835 - RNA, 32 nt, Human
ccucucuaguagcuggggcuccaggcaugaau

SEQ ID NO: 113836 - RNA, 31 nt, Human
ccucucucacacaaggaggaacuugggugaa

SEQ ID NO: 113837 - RNA, 32 nt, Human
ccucucucaccagggcucccugaggccugcug

SEQ ID NO: 113838 - RNA, 24 nt, Human
ccucucucaccuccaccccaucca

SEQ ID NO: 113839 - RNA, 32 nt, Human
ccucucucagcauccccucuagcuccuuacac

SEQ ID NO: 113840 - RNA, 32 nt, Human
ccucucucaguuacugcaguuuauagaauaau

SEQ ID NO: 113841 - RNA, 32 nt, Human
ccucucucauagagauuuuaagagcacagcaa

SEQ ID NO: 113842 - RNA, 18 nt, Human
ccucucucauccgcccca

SEQ ID NO: 113843 - RNA, 32 nt, Human
ccucucucauuucccuucuccuucucccucag

SEQ ID NO: 113844 - RNA, 22 nt, Human
ccucucucauuuggggugacug

SEQ ID NO: 113845 - RNA, 32 nt, Human
ccucucuccaacaaauggaguagcaucccccu

SEQ ID NO: 113846 - RNA, 32 nt, Human
ccucucuccacacccagccccugcuccugccc

SEQ ID NO: 113847 - RNA, 32 nt, Human
ccucucuccagcccuggaguccugagcaauga

SEQ ID NO: 113848 - RNA, 19 nt, Human
ccucucuccccacuggcca

SEQ ID NO: 113849 - RNA, 28 nt, Human
ccucucuccccagcugccuccuccucuu

SEQ ID NO: 113850 - RNA, 32 nt, Human
ccucucucccuccaaagaagagcaugggagag

SEQ ID NO: 113851 - RNA, 32 nt, Human
ccucucucccucucccucucccucucugucuc

SEQ ID NO: 113852 - RNA, 32 nt, Human
ccucucucccugccucacaucucccuuccacc

SEQ ID NO: 113853 - RNA, 23 nt, Human
ccucucucccuuucuccucuccc

SEQ ID NO: 113854 - RNA, 32 nt, Human
ccucucuccgagcuuucacccuggugagacug

SEQ ID NO: 113855 - RNA, 32 nt, Human
ccucucuccgucaucccuaucuccccugggcu

SEQ ID NO: 113856 - RNA, 32 nt, Human
ccucucuccuacuuuggcugacucuucaagaa

SEQ ID NO: 113857 - RNA, 32 nt, Human
ccucucuccucagggcgccucuccaguccacg

SEQ ID NO: 113858 - RNA, 32 nt, Human
ccucucuccuccccuccuuccucucuccuccc

SEQ ID NO: 113859 - RNA, 32 nt, Human
ccucucuccuccccuccuuccucucuccucuc

SEQ ID NO: 113860 - RNA, 32 nt, Human
ccucucuccuccgcccacagggguucgugggc

SEQ ID NO: 113861 - RNA, 32 nt, Human
ccucucuccuccugaacucucucaucugcagu

SEQ ID NO: 113862 - RNA, 32 nt, Human
ccucucuccucuccgcuucucucccccucugu

SEQ ID NO: 113863 - RNA, 32 nt, Human
ccucucuccuguuucccuucccuuccacugcc

SEQ ID NO: 113864 - RNA, 32 nt, Human
ccucucuccuugacuccaaaggccagccuggg

SEQ ID NO: 113865 - RNA, 32 nt, Human
ccucucuccuuuccuuccucauccccaccugg

SEQ ID NO: 113866 - RNA, 32 nt, Human
ccucucucgguccugaugcagcaccucgcaag

SEQ ID NO: 113867 - RNA, 32 nt, Human
ccucucucuaauuagcuuucccaguauacuuc

SEQ ID NO: 113868 - RNA, 19 nt, Human
ccucucucucaauuuucuu

SEQ ID NO: 113869 - RNA, 32 nt, Human
ccucucucucaccuacuuccuccuccuccucc

SEQ ID NO: 113870 - RNA, 32 nt, Human
ccucucucucccucucucuuuacccuccccag

SEQ ID NO: 113871 - RNA, 32 nt, Human
ccucucucuccuccuauuuuacuugaggcugc

SEQ ID NO: 113872 - RNA, 32 nt, Human
ccucucucuccuccuccuccuccgccgccgga

SEQ ID NO: 113873 - RNA, 32 nt, Human
ccucucucucuuccucuuucuucauucagauc

SEQ ID NO: 113874 - RNA, 32 nt, Human
ccucucucucuuucuuucuuucuuucuuucuu

SEQ ID NO: 113875 - RNA, 28 nt, Human
ccucucucugaguuccucugggcugccg

SEQ ID NO: 113876 - RNA, 23 nt, Human
ccucucucugcaucugagcucug

SEQ ID NO: 113877 - RNA, 23 nt, Human
ccucucucugccuaaggguggug

SEQ ID NO: 113878 - RNA, 22 nt, Human
ccucucucugccucuuuucucc

SEQ ID NO: 113879 - RNA, 23 nt, Human
ccucucucugcuggcugagccug

SEQ ID NO: 113880 - RNA, 22 nt, Human
ccucucucuggccuggggugcu

SEQ ID NO: 113881 - RNA, 23 nt, Human
ccucucucugggcccaggggcug

SEQ ID NO: 113882 - RNA, 32 nt, Human
ccucucucuuccagagcccagaaagcuccucu

SEQ ID NO: 113883 - RNA, 25 nt, Human
ccucucucuuggggcgcccacccgg

SEQ ID NO: 113884 - RNA, 21 nt, Human
ccucucucuuucucuccuccc

SEQ ID NO: 113885 - RNA, 32 nt, Human
ccucucucuuucucucuuuucucccucuccua

SEQ ID NO: 113886 - RNA, 32 nt, Human
ccucucucuuuugcccugcucuccacaccaga

SEQ ID NO: 113887 - RNA, 32 nt, Human
ccucucugaaccucagcuucucauccacaaaa

SEQ ID NO: 113888 - RNA, 21 nt, Human
ccucucugaagcccuuccuga

SEQ ID NO: 113889 - RNA, 32 nt, Human
ccucucugaaucucaaacaaguugauaaugga

SEQ ID NO: 113890 - RNA, 32 nt, Human
ccucucugaccugcaccugugugggagccggg

SEQ ID NO: 113891 - RNA, 32 nt, Human
ccucucugaccuguguacauucacaaaccaca

SEQ ID NO: 113892 - RNA, 21 nt, Human
ccucucugacuucucuuccuc

SEQ ID NO: 113893 - RNA, 32 nt, Human
ccucucugagcccuggcuccagcuuuucugag

SEQ ID NO: 113894 - RNA, 32 nt, Human
ccucucugaggcggaggaugcgggagcgcauc

SEQ ID NO: 113895 - RNA, 32 nt, Human
ccucucugcagcagucccccaucccagccaca

SEQ ID NO: 113896 - RNA, 32 nt, Human
ccucucugcagguguucaccacaguauuggag

SEQ ID NO: 113897 - RNA, 32 nt, Human
ccucucugcccaccucugcuuccucuaggaac

SEQ ID NO: 113898 - RNA, 22 nt, Human
ccucucugcccucccucccuuu

SEQ ID NO: 113899 - RNA, 32 nt, Human
ccucucugcccuuccaagccuguaaccucgga

SEQ ID NO: 113900 - RNA, 32 nt, Human
ccucucugccuccagccccaccuuccccggga

SEQ ID NO: 113901 - RNA, 20 nt, Human
ccucucugccucucuucuuc

SEQ ID NO: 113902 - RNA, 31 nt, Human
ccucucugccucuggcuuuaugucucuuuca

SEQ ID NO: 113903 - RNA, 32 nt, Human
ccucucugccugcuccugucucucccuggggu

SEQ ID NO: 113904 - RNA, 32 nt, Human
ccucucugccuugccuugcccucugccuuugg

SEQ ID NO: 113905 - RNA, 32 nt, Human
ccucucugcuaaaaauacaaaauuagccgagc

SEQ ID NO: 113906 - RNA, 32 nt, Human
ccucucugcucgcugcauugugguguucucuu

SEQ ID NO: 113907 - RNA, 32 nt, Human
ccucucugcucugacccuucucaggcccgccu

SEQ ID NO: 113908 - RNA, 32 nt, Human
ccucucugcugaccagcucuucaucaagaguc

SEQ ID NO: 113909 - RNA, 32 nt, Human
ccucucugcuuagagcugccaggaggagcuac

SEQ ID NO: 113910 - RNA, 32 nt, Human
ccucucugcuuuucaagcauuuccuugaguca

SEQ ID NO: 113911 - RNA, 32 nt, Human
ccucucuggaagagaaaggaagagccagcagu

SEQ ID NO: 113912 - RNA, 32 nt, Human
ccucucuggagucuucacaggggccugagcua

SEQ ID NO: 113913 - RNA, 32 nt, Human
ccucucuggcccaagcuggagugcaguggcac

SEQ ID NO: 113914 - RNA, 32 nt, Human
ccucucuggccccauccaggcaaccaaauaaa

SEQ ID NO: 113915 - RNA, 24 nt, Human
ccucucuggcuuauagucucuuca

SEQ ID NO: 113916 - RNA, 32 nt, Human
ccucucugggcacccuucugcccacaccaguu

SEQ ID NO: 113917 - RNA, 32 nt, Human
ccucucugggcuggaggugggggugggggcag

SEQ ID NO: 113918 - RNA, 32 nt, Human
ccucucuggggucgaugaagaggugaagugac

SEQ ID NO: 113919 - RNA, 20 nt, Human
ccucucugucccaccuugca

SEQ ID NO: 113920 - RNA, 25 nt, Human
ccucucuguccccacacacugggcc

SEQ ID NO: 113921 - RNA, 20 nt, Human
ccucucugucccucaccuca

SEQ ID NO: 113922 - RNA, 18 nt, Human
ccucucuguccuccccuc

SEQ ID NO: 113923 - RNA, 22 nt, Human
ccucucugucugacuucugcau

SEQ ID NO: 113924 - RNA, 32 nt, Human
ccucucugucugacuucugcaucuccuuccag

SEQ ID NO: 113925 - RNA, 32 nt, Human
ccucucugugccuucauuuccaccucucuaaa

SEQ ID NO: 113926 - RNA, 32 nt, Human
ccucucugugugaaaaguucucggucaugaac

SEQ ID NO: 113927 - RNA, 32 nt, Human
ccucucuucacagauguggggccgaggcucag

SEQ ID NO: 113928 - RNA, 22 nt, Human
ccucucuucacccauucauuca

SEQ ID NO: 113929 - RNA, 32 nt, Human
ccucucuucauaauuaucaauagccccaagcu

SEQ ID NO: 113930 - RNA, 32 nt, Human
ccucucuucccaaaucaucaccgccaugggcc

SEQ ID NO: 113931 - RNA, 32 nt, Human
ccucucuuccucacucccuucccccagucagu

SEQ ID NO: 113932 - RNA, 32 nt, Human
ccucucuuccuccccucugcacuuuguuuacu

SEQ ID NO: 113933 - RNA, 32 nt, Human
ccucucuuccuucacaccuuccucugaauccc

SEQ ID NO: 113934 - RNA, 22 nt, Human
ccucucuuccuucuccucuuca

SEQ ID NO: 113935 - RNA, 32 nt, Human
ccucucuucucauuauuguguccuuugcuuua

SEQ ID NO: 113936 - RNA, 32 nt, Human
ccucucuucuccagccucucccuuucacucuu

SEQ ID NO: 113937 - RNA, 32 nt, Human
ccucucuucuugcacuguccccaaacuugcug

SEQ ID NO: 113938 - RNA, 19 nt, Human
ccucucuugcccucccuca

SEQ ID NO: 113939 - RNA, 20 nt, Human
ccucucuugccgcccgcacc

SEQ ID NO: 113940 - RNA, 19 nt, Human
ccucucuuggcccccgggg

SEQ ID NO: 113941 - RNA, 32 nt, Human
ccucucuugguuucuuuggcucugccuuuguc

SEQ ID NO: 113942 - RNA, 32 nt, Human
ccucucuuguccaaggcuggaguguaguagug

SEQ ID NO: 113943 - RNA, 32 nt, Human
ccucucuuucccucuucuccccagccuccucc

SEQ ID NO: 113944 - RNA, 19 nt, Human
ccucucuuuuuucuccucu

SEQ ID NO: 113945 - RNA, 32 nt, Human
ccucugaaaguacugggauuacaagcauaagc

SEQ ID NO: 113946 - RNA, 32 nt, Human
ccucugaaagugcugggaucacagacaugagc

SEQ ID NO: 113947 - RNA, 32 nt, Human
ccucugaaagugcugggauuacaggcgugaga

SEQ ID NO: 113948 - RNA, 32 nt, Human
ccucugaaauugcugggauuacaggcaugagc

SEQ ID NO: 113949 - RNA, 32 nt, Human
ccucugaacccccuuuccccacaccucccccu

SEQ ID NO: 113950 - RNA, 21 nt, Human
ccucugaaccugucaggagga

SEQ ID NO: 113951 - RNA, 32 nt, Human
ccucugaagauggacucggccccacauacaca

SEQ ID NO: 113952 - RNA, 32 nt, Human
ccucugaagccacagccagagcuguauguugc

SEQ ID NO: 113953 - RNA, 32 nt, Human
ccucugaagcgcccuccugggcccugcuguca

SEQ ID NO: 113954 - RNA, 32 nt, Human
ccucugaaguagcugggacuacaggcguuauc

SEQ ID NO: 113955 - RNA, 32 nt, Human
ccucugaaguagcugggauuacaggcaugugu

SEQ ID NO: 113956 - RNA, 19 nt, Human
ccucugaaguuaacugaug

SEQ ID NO: 113957 - RNA, 21 nt, Human
ccucugaaugucuuggcucca

SEQ ID NO: 113958 - RNA, 23 nt, Human
ccucugaauguugguucuuacca

SEQ ID NO: 113959 - RNA, 21 nt, Human
ccucugaauuuaauucuuuca

SEQ ID NO: 113960 - RNA, 21 nt, Human
ccucugaauuuguauuuuuuc

SEQ ID NO: 113961 - RNA, 22 nt, Human
ccucugacagcagcagcagcag

SEQ ID NO: 113962 - RNA, 26 nt, Human
ccucugacauugaggccuggggcuua

SEQ ID NO: 113963 - RNA, 32 nt, Human
ccucugacauuuuggaaaugauacacuacugg

SEQ ID NO: 113964 - RNA, 32 nt, Human
ccucugaccagaucugaauuuggcucucagag

SEQ ID NO: 113965 - RNA, 32 nt, Human
ccucugaccagggacauccugaguuugguggc

SEQ ID NO: 113966 - RNA, 20 nt, Human
ccucugacccaauuuucuua

SEQ ID NO: 113967 - RNA, 32 nt, Human
ccucugacccacugagccugguggcagcgugc

SEQ ID NO: 113968 - RNA, 20 nt, Human
ccucugacccaucauguuua

SEQ ID NO: 113969 - RNA, 17 nt, Human
ccucugacccaugcuua

SEQ ID NO: 113970 - RNA, 32 nt, Human
ccucugaccccagcuucucucugauucccaca

SEQ ID NO: 113971 - RNA, 23 nt, Human
ccucugaccccucaccugugcca

SEQ ID NO: 113972 - RNA, 20 nt, Human
ccucugacccguuauucuua

SEQ ID NO: 113973 - RNA, 22 nt, Human
ccucugacccuagcucuuuccu

SEQ ID NO: 113974 - RNA, 32 nt, Human
ccucugacccucccccugccuuccucuugccu

SEQ ID NO: 113975 - RNA, 24 nt, Human
ccucugaccucaggccggcuguga

SEQ ID NO: 113976 - RNA, 20 nt, Human
ccucugaccuuucaguuuuc

SEQ ID NO: 113977 - RNA, 17 nt, Human
ccucugacgccgcucuu

SEQ ID NO: 113978 - RNA, 32 nt, Human
ccucugacguccaagccuuguuccugugcugc

SEQ ID NO: 113979 - RNA, 32 nt, Human
ccucugacucacuguguugguuuaucuuuagg

SEQ ID NO: 113980 - RNA, 18 nt, Human
ccucugacuccaacuucu

SEQ ID NO: 113981 - RNA, 17 nt, Human
ccucugacuccacuucu

SEQ ID NO: 113982 - RNA, 32 nt, Human
ccucugacucccuaacuccaucagaccucuac

SEQ ID NO: 113983 - RNA, 15 nt, Human
ccucugacuuauucu

SEQ ID NO: 113984 - RNA, 32 nt, Human
ccucugacuucacugccgcagcucuuuccaca

SEQ ID NO: 113985 - RNA, 19 nt, Human
ccucugacuucucuuucuu

SEQ ID NO: 113986 - RNA, 32 nt, Human
ccucugacuuuguaaacaaagccagagagccg

SEQ ID NO: 113987 - RNA, 19 nt, Human
ccucugacuuuuuuacuua

SEQ ID NO: 113988 - RNA, 32 nt, Human
ccucugagaacugccugucaccaucagcucag

SEQ ID NO: 113989 - RNA, 32 nt, Human
ccucugagaacuggcgcuuuguucaucauuug

SEQ ID NO: 113990 - RNA, 32 nt, Human
ccucugagaauaggagaaaugaagcaacaguu

SEQ ID NO: 113991 - RNA, 32 nt, Human
ccucugagagccucuuuggggugagcagccuu

SEQ ID NO: 113992 - RNA, 32 nt, Human
ccucugagaggggagaguccagugaguccagg

SEQ ID NO: 113993 - RNA, 24 nt, Human
ccucugagcagagagcagcagcag

SEQ ID NO: 113994 - RNA, 22 nt, Human
ccucugagcccaagcaaagcca

SEQ ID NO: 113995 - RNA, 32 nt, Human
ccucugagcccaagcuaagccaucauaucccc

SEQ ID NO: 113996 - RNA, 32 nt, Human
ccucugagccccaggcccggcccagcccgccu

SEQ ID NO: 113997 - RNA, 32 nt, Human
ccucugagccucuucugcuccugcacaaccug

SEQ ID NO: 113998 - RNA, 32 nt, Human
ccucugagcuccagcguuggcucuuacuccca

SEQ ID NO: 113999 - RNA, 32 nt, Human
ccucugagcugaggccccacaccagaguaggg

SEQ ID NO: 114000 - RNA, 32 nt, Human
ccucugagcuguuccuucuugaccggcacaca

SEQ ID NO: 114001 - RNA, 21 nt, Human
ccucugaggaaccuccuucca

SEQ ID NO: 114002 - RNA, 32 nt, Human
ccucugaggcagauggggcaggcggcccaggc

SEQ ID NO: 114003 - RNA, 21 nt, Human
ccucugaggccccggggccug

SEQ ID NO: 114004 - RNA, 32 nt, Human
ccucugaguacagcaauaaaauaaccugggca

SEQ ID NO: 114005 - RNA, 32 nt, Human
ccucugaguagcugggauuacaggcacacacc

SEQ ID NO: 114006 - RNA, 32 nt, Human
ccucugaguggggagagguugggcagugagug

SEQ ID NO: 114007 - RNA, 32 nt, Human
ccucugaguucuaacaaaauggugcuuugagg

SEQ ID NO: 114008 - RNA, 20 nt, Human
ccucugauaaacaauuuucu

SEQ ID NO: 114009 - RNA, 32 nt, Human
ccucugauccacccuccgcucugccugccaug

SEQ ID NO: 114010 - RNA, 18 nt, Human
ccucugauccuuuuguua

SEQ ID NO: 114011 - RNA, 32 nt, Human
ccucugaucucagggcuggcuuugggcaucuc

SEQ ID NO: 114012 - RNA, 32 nt, Human
ccucugaugaacucacacaugccucagugccu

SEQ ID NO: 114013 - RNA, 32 nt, Human
ccucugaugaaugacuguccccagcagauggc

SEQ ID NO: 114014 - RNA, 32 nt, Human
ccucugaugccaccgggcccucucuccuucua

SEQ ID NO: 114015 - RNA, 32 nt, Human
ccucugaugccugguccucccaauuucagacu

SEQ ID NO: 114016 - RNA, 32 nt, Human
ccucugaugccuguugaggagccucuaggaca

SEQ ID NO: 114017 - RNA, 32 nt, Human
ccucugaugccuucccuccacggcccaggucu

SEQ ID NO: 114018 - RNA, 19 nt, Human
ccucugauucacuuugcca

SEQ ID NO: 114019 - RNA, 22 nt, Human
ccucugauugcaccacugcacu

SEQ ID NO: 114020 - RNA, 32 nt, Human
ccucugauugcaccacugcacuccaggcuggg

SEQ ID NO: 114021 - RNA, 17 nt, Human
ccucugauugcauucuu

SEQ ID NO: 114022 - RNA, 21 nt, Human
ccucugauuuugguuuucuug

SEQ ID NO: 114023 - RNA, 32 nt, Human
ccucugcaaccacacagggauauuucugcuau

SEQ ID NO: 114024 - RNA, 32 nt, Human
ccucugcaacucggaacucugacccagggcgg

SEQ ID NO: 114025 - RNA, 32 nt, Human
ccucugcacaaaugugacggcagcagcugaag

SEQ ID NO: 114026 - RNA, 32 nt, Human
ccucugcacaugcuaccuacaucagcccagcc

SEQ ID NO: 114027 - RNA, 32 nt, Human
ccucugcaccaugacuaccugcagccgccagu

SEQ ID NO: 114028 - RNA, 24 nt, Human
ccucugcaccccagcccgcagcca

SEQ ID NO: 114029 - RNA, 23 nt, Human
ccucugcaccugcaugagaaccc

SEQ ID NO: 114030 - RNA, 32 nt, Human
ccucugcacgugcacacaccugcacaccccug

SEQ ID NO: 114031 - RNA, 32 nt, Human
ccucugcacucccagccuccuggccccuucug

SEQ ID NO: 114032 - RNA, 32 nt, Human
ccucugcagaagccucauagggcccggcgcgg

SEQ ID NO: 114033 - RNA, 32 nt, Human
ccucugcagaccccuccagacgccagaacucc

SEQ ID NO: 114034 - RNA, 19 nt, Human
ccucugcagagggggccca

SEQ ID NO: 114035 - RNA, 32 nt, Human
ccucugcagccugcccugccuucccccggaug

SEQ ID NO: 114036 - RNA, 32 nt, Human
ccucugcagccugucaucccugucugugacca

SEQ ID NO: 114037 - RNA, 32 nt, Human
ccucugcagcugccucaguuuccccagggacc

SEQ ID NO: 114038 - RNA, 32 nt, Human
ccucugcagggugguccagccuaggugacagg

SEQ ID NO: 114039 - RNA, 32 nt, Human
ccucugcagugcagauacugucagaaagagca

SEQ ID NO: 114040 - RNA, 32 nt, Human
ccucugcaucucugccuacaagggccucccug

SEQ ID NO: 114041 - RNA, 32 nt, Human
ccucugcauggaaucuugccccggacuccuga

SEQ ID NO: 114042 - RNA, 32 nt, Human
ccucugcauugccccucuucucccucuccaaa

SEQ ID NO: 114043 - RNA, 32 nt, Human
ccucugcauuuccagccccagcaucuugcugg

SEQ ID NO: 114044 - RNA, 32 nt, Human
ccucugcauuuucccaucacauagaagacuuu

SEQ ID NO: 114045 - RNA, 32 nt, Human
ccucugccaacaccggaacaagccgacgcuuc

SEQ ID NO: 114046 - RNA, 32 nt, Human
ccucugccaagccugugugcgaugcccuuggu

SEQ ID NO: 114047 - RNA, 32 nt, Human
ccucugccaagcuuugucuuuggggcuugcug

SEQ ID NO: 114048 - RNA, 32 nt, Human
ccucugccaaucaaaauagauagaauaugaua

SEQ ID NO: 114049 - RNA, 32 nt, Human
ccucugccacaucagcuuucuuuaggagcccu

SEQ ID NO: 114050 - RNA, 32 nt, Human
ccucugccagaagaaagcuuagcagccagcgc

SEQ ID NO: 114051 - RNA, 32 nt, Human
ccucugccagaggcucccucucaugauguuug

SEQ ID NO: 114052 - RNA, 32 nt, Human
ccucugccaggcuccacaagaggucaggacag

SEQ ID NO: 114053 - RNA, 32 nt, Human
ccucugccagugaccaaucccucuuaaaaagc

SEQ ID NO: 114054 - RNA, 32 nt, Human
ccucugccagugucucaggacagcagaguggg

SEQ ID NO: 114055 - RNA, 32 nt, Human
ccucugccauucaugagaacugugaggacucu

SEQ ID NO: 114056 - RNA, 32 nt, Human
ccucugcccaccucuucucuucugcuuccaua

SEQ ID NO: 114057 - RNA, 32 nt, Human
ccucugcccagccagcccugagcucccccacc

SEQ ID NO: 114058 - RNA, 32 nt, Human
ccucugcccagccggggcagcugcugcacugg

SEQ ID NO: 114059 - RNA, 32 nt, Human
ccucugcccagccugucuacaccgugugagcu

SEQ ID NO: 114060 - RNA, 32 nt, Human
ccucugcccagcuccugcuguaauuagcucca

SEQ ID NO: 114061 - RNA, 32 nt, Human
ccucugcccaggagcaugggcaucagcuaccu

SEQ ID NO: 114062 - RNA, 22 nt, Human
ccucugcccaggagcugugggg

SEQ ID NO: 114063 - RNA, 20 nt, Human
ccucugcccagggaccccug

SEQ ID NO: 114064 - RNA, 32 nt, Human
ccucugccccaccaugauccagccucugccuc

SEQ ID NO: 114065 - RNA, 31 nt, Human
ccucugccccacucugggcuuuucagauacu

SEQ ID NO: 114066 - RNA, 32 nt, Human
ccucugccccacugccagccugagugggcaag

SEQ ID NO: 114067 - RNA, 32 nt, Human
ccucugccccagauagguggugccaguggcuu

SEQ ID NO: 114068 - RNA, 32 nt, Human
ccucugccccagguccaugcugggcagaauca

SEQ ID NO: 114069 - RNA, 21 nt, Human
ccucugcccccagcugcuccu

SEQ ID NO: 114070 - RNA, 16 nt, Human
ccucugcccccaggua

SEQ ID NO: 114071 - RNA, 32 nt, Human
ccucugcccccuggcccugggcucugugcuag

SEQ ID NO: 114072 - RNA, 32 nt, Human
ccucugccccgcccccuccagccccaucucug

SEQ ID NO: 114073 - RNA, 23 nt, Human
ccucugccccgcgcccaccccgg

SEQ ID NO: 114074 - RNA, 32 nt, Human
ccucugccccucccccuggcuucuuucucuug

SEQ ID NO: 114075 - RNA, 32 nt, Human
ccucugccccucuuccccuaccccuguccuuc

SEQ ID NO: 114076 - RNA, 32 nt, Human
ccucugccccuggccuuugaggcaaaggccag

SEQ ID NO: 114077 - RNA, 32 nt, Human
ccucugccccuggguggcugguggcugggccu

SEQ ID NO: 114078 - RNA, 32 nt, Human
ccucugccccuguccagugccuggugguccag

SEQ ID NO: 114079 - RNA, 32 nt, Human
ccucugcccuccaccucuaccacuccagcauc

SEQ ID NO: 114080 - RNA, 32 nt, Human
ccucugcccuccuucugucuccuggguggucu

SEQ ID NO: 114081 - RNA, 32 nt, Human
ccucugcccuccuuuuugguuuccuugguggu

SEQ ID NO: 114082 - RNA, 32 nt, Human
ccucugcccucggggcagcccacacaaaaggg

SEQ ID NO: 114083 - RNA, 20 nt, Human
ccucugcccucucccuuccc

SEQ ID NO: 114084 - RNA, 32 nt, Human
ccucugcccugagagcgcguccggugcgggcg

SEQ ID NO: 114085 - RNA, 32 nt, Human
ccucugcccugcccaccagccugugauuugau

SEQ ID NO: 114086 - RNA, 32 nt, Human
ccucugcccugcccuccagccugggacaauaa

SEQ ID NO: 114087 - RNA, 32 nt, Human
ccucugcccugccucccucucagaacgaugcc

SEQ ID NO: 114088 - RNA, 19 nt, Human
ccucugcccugcuggccug

SEQ ID NO: 114089 - RNA, 32 nt, Human
ccucugcccuucaaucugucgccugugguccc

SEQ ID NO: 114090 - RNA, 16 nt, Human
ccucugcccuugggga

SEQ ID NO: 114091 - RNA, 32 nt, Human
ccucugcccuuuccucccgccuuccaugagug

SEQ ID NO: 114092 - RNA, 32 nt, Human
ccucugccgagccugcaucacugugagcaaca

SEQ ID NO: 114093 - RNA, 20 nt, Human
ccucugccgcagcacugagg

SEQ ID NO: 114094 - RNA, 32 nt, Human
ccucugccgcccucuucucugccacgcaggac

SEQ ID NO: 114095 - RNA, 32 nt, Human
ccucugccgcuccuccacaucuugccgcugcc

SEQ ID NO: 114096 - RNA, 22 nt, Human
ccucugccggcucuggcucucc

SEQ ID NO: 114097 - RNA, 32 nt, Human
ccucugccucacaacauggcaaguacaguacu

SEQ ID NO: 114098 - RNA, 32 nt, Human
ccucugccucacagcagacucuucacacccag

SEQ ID NO: 114099 - RNA, 17 nt, Human
ccucugccucccagguc

SEQ ID NO: 114100 - RNA, 32 nt, Human
ccucugccucccuggggcagagcuguuuccca

SEQ ID NO: 114101 - RNA, 19 nt, Human
ccucugccucuaagcgcug

SEQ ID NO: 114102 - RNA, 32 nt, Human
ccucugccucugccucacccugcuggcuccug

SEQ ID NO: 114103 - RNA, 17 nt, Human
ccucugccugccaggua

SEQ ID NO: 114104 - RNA, 32 nt, Human
ccucugccugcucugccgccgaggcccgggga

SEQ ID NO: 114105 - RNA, 32 nt, Human
ccucugccugggaaucuucuuuccuccccucc

SEQ ID NO: 114106 - RNA, 32 nt, Human
ccucugccugggaguggcucuguguggaccag

SEQ ID NO: 114107 - RNA, 32 nt, Human
ccucugccugucucccccaccgggcugggagc

SEQ ID NO: 114108 - RNA, 32 nt, Human
ccucugccuguucuuggaccucuggcugcaga

SEQ ID NO: 114109 - RNA, 32 nt, Human
ccucugccuguuguugaggaggacugagcaca

SEQ ID NO: 114110 - RNA, 32 nt, Human
ccucugccuguuuuguucugucaccuuaaaag

SEQ ID NO: 114111 - RNA, 32 nt, Human
ccucugccuuggagcuccagagagagggagcc

SEQ ID NO: 114112 - RNA, 32 nt, Human
ccucugccuuucugguuucucucccucuccaa

SEQ ID NO: 114113 - RNA, 32 nt, Human
ccucugccuuugagcuucuccucugcuccaac

SEQ ID NO: 114114 - RNA, 32 nt, Human
ccucugcgagugguuucuugugcacuggcacc

SEQ ID NO: 114115 - RNA, 32 nt, Human
ccucugcgcuccgcgccauggccggccucaac

SEQ ID NO: 114116 - RNA, 20 nt, Human
ccucugcggacucugcagcu

SEQ ID NO: 114117 - RNA, 32 nt, Human
ccucugcgggacugucuguuugcagagggugc

SEQ ID NO: 114118 - RNA, 32 nt, Human
ccucugcggguggaucaccugaggucaggagu

SEQ ID NO: 114119 - RNA, 32 nt, Human
ccucugcgucuccgccuucccugggccgcacu

SEQ ID NO: 114120 - RNA, 32 nt, Human
ccucugcguucccaagcugugcguucuggacc

SEQ ID NO: 114121 - RNA, 32 nt, Human
ccucugcuaucucucacaccucucccagacua

SEQ ID NO: 114122 - RNA, 32 nt, Human
ccucugcucagcuccccucugcccccucuuuc

SEQ ID NO: 114123 - RNA, 32 nt, Human
ccucugcucauuccacaaaaccagagcaggca

SEQ ID NO: 114124 - RNA, 23 nt, Human
ccucugcuccaccccuccugugu

SEQ ID NO: 114125 - RNA, 32 nt, Human
ccucugcuccaccccuccugugugucagagcu

SEQ ID NO: 114126 - RNA, 32 nt, Human
ccucugcuccacccuccauuccuccuccccug

SEQ ID NO: 114127 - RNA, 32 nt, Human
ccucugcuccccagugcuaccucucucuuccc

SEQ ID NO: 114128 - RNA, 32 nt, Human
ccucugcuccgacgccguuccccaccaguuag

SEQ ID NO: 114129 - RNA, 17 nt, Human
ccucugcuccggcacgg

SEQ ID NO: 114130 - RNA, 32 nt, Human
ccucugcuccugcugcaaaagcagaaaccaug

SEQ ID NO: 114131 - RNA, 32 nt, Human
ccucugcuccugcuucucagcucuuccaccgu

SEQ ID NO: 114132 - RNA, 32 nt, Human
ccucugcuccugucugugucuugcgucugugg

SEQ ID NO: 114133 - RNA, 32 nt, Human
ccucugcucguggcgugggaaaggagguguga

SEQ ID NO: 114134 - RNA, 32 nt, Human
ccucugcucuauaucuauucccuuccagccag

SEQ ID NO: 114135 - RNA, 32 nt, Human
ccucugcucugauuacugcucugccuuccauu

SEQ ID NO: 114136 - RNA, 32 nt, Human
ccucugcucugccucugccccucuucucccug

SEQ ID NO: 114137 - RNA, 32 nt, Human
ccucugcucugccuucccaucugcggggcuaa

SEQ ID NO: 114138 - RNA, 32 nt, Human
ccucugcucuguccucccucuuccacugucuc

SEQ ID NO: 114139 - RNA, 32 nt, Human
ccucugcucuguggcuccauucaggcuuuuuc

SEQ ID NO: 114140 - RNA, 32 nt, Human
ccucugcugacaaccucugccgcaaacuggag

SEQ ID NO: 114141 - RNA, 19 nt, Human
ccucugcugacaagcuggg

SEQ ID NO: 114142 - RNA, 32 nt, Human
ccucugcugcagcuacugauaucuggccccug

SEQ ID NO: 114143 - RNA, 32 nt, Human
ccucugcugccagaaccuuggggaugugccua

SEQ ID NO: 114144 - RNA, 32 nt, Human
ccucugcugccagcccuuccucacuuuuggaa

SEQ ID NO: 114145 - RNA, 17 nt, Human
ccucugcugcccagugg

SEQ ID NO: 114146 - RNA, 32 nt, Human
ccucugcugcccccuuccccagcccuuagcac

SEQ ID NO: 114147 - RNA, 32 nt, Human
ccucugcugcccucuucucugcuaugcgggac

SEQ ID NO: 114148 - RNA, 18 nt, Human
ccucugcugccugcuggg

SEQ ID NO: 114149 - RNA, 32 nt, Human
ccucugcugcucccaggccuucuuccuauuca

SEQ ID NO: 114150 - RNA, 32 nt, Human
ccucugcugcugccuuggcuuccuccuaaugc

SEQ ID NO: 114151 - RNA, 32 nt, Human
ccucugcugcugcugccaccgcugauuccauc

SEQ ID NO: 114152 - RNA, 32 nt, Human
ccucugcugcugucccucccccuuguccuuuc

SEQ ID NO: 114153 - RNA, 32 nt, Human
ccucugcugcugucccucccccuugucuuucc

SEQ ID NO: 114154 - RNA, 32 nt, Human
ccucugcugcuugugcgcaugcgugcggccgc

SEQ ID NO: 114155 - RNA, 22 nt, Human
ccucugcuggaaggggcagcag

SEQ ID NO: 114156 - RNA, 32 nt, Human
ccucugcuggagccaccaguucccgcaagccc

SEQ ID NO: 114157 - RNA, 29 nt, Human
ccucugcuggcuuccucauccccugucca

SEQ ID NO: 114158 - RNA, 16 nt, Human
ccucugcugggccgug

SEQ ID NO: 114159 - RNA, 32 nt, Human
ccucugcugucaucagcugaugcauuguuuuu

SEQ ID NO: 114160 - RNA, 20 nt, Human
ccucugcuguguuuuucuug

SEQ ID NO: 114161 - RNA, 32 nt, Human
ccucugcuucuacuccuucuuccugggcaagg

SEQ ID NO: 114162 - RNA, 32 nt, Human
ccucugcuucuuaagcuuuccugcugcucgcu

SEQ ID NO: 114163 - RNA, 32 nt, Human
ccucugcuucuugcuuugcccaccuccacucu

SEQ ID NO: 114164 - RNA, 32 nt, Human
ccucugcuuggcauccccuugcuggacagugg

SEQ ID NO: 114165 - RNA, 32 nt, Human
ccucugcuuguccuaguucugaccuauagcau

SEQ ID NO: 114166 - RNA, 32 nt, Human
ccucugcuuucccuuuuccauuugaaagaaag

SEQ ID NO: 114167 - RNA, 32 nt, Human
ccucuggaaagaaacaugugaguaagugagag

SEQ ID NO: 114168 - RNA, 21 nt, Human
ccucuggaaagacagcacagg

SEQ ID NO: 114169 - RNA, 23 nt, Human
ccucuggaacagcugggcauggg

SEQ ID NO: 114170 - RNA, 32 nt, Human
ccucuggaagaguugggauuauggaugcaugg

SEQ ID NO: 114171 - RNA, 32 nt, Human
ccucuggaauggccuacccaacccgagaagaa

SEQ ID NO: 114172 - RNA, 26 nt, Human
ccucuggacaguguuauugguacaga

SEQ ID NO: 114173 - RNA, 24 nt, Human
ccucuggacauucacccagccagg

SEQ ID NO: 114174 - RNA, 32 nt, Human
ccucuggaccaucagauuaccaaugaagagga

SEQ ID NO: 114175 - RNA, 22 nt, Human
ccucuggaccgcgaggcacagg

SEQ ID NO: 114176 - RNA, 32 nt, Human
ccucuggacggacaguggggacauuguggguu

SEQ ID NO: 114177 - RNA, 32 nt, Human
ccucuggacuugccuuuccuucucuucuccgc

SEQ ID NO: 114178 - RNA, 32 nt, Human
ccucuggagagaacccagccaggcgcggugcc

SEQ ID NO: 114179 - RNA, 32 nt, Human
ccucuggagagauggaaguggacuagucuuaa

SEQ ID NO: 114180 - RNA, 32 nt, Human
ccucuggagcaacuauacugccucaggaugug

SEQ ID NO: 114181 - RNA, 32 nt, Human
ccucuggagcuggaacccagcuuacauuuugu

SEQ ID NO: 114182 - RNA, 32 nt, Human
ccucuggaggccugggcugagacagugcucuu

SEQ ID NO: 114183 - RNA, 20 nt, Human
ccucuggaggggcagcgcag

SEQ ID NO: 114184 - RNA, 32 nt, Human
ccucuggaggggcagcgcagccucccaccaag

SEQ ID NO: 114185 - RNA, 20 nt, Human
ccucuggagggggcagaaga

SEQ ID NO: 114186 - RNA, 32 nt, Human
ccucuggaguagcuggaacuacaggcuaaauu

SEQ ID NO: 114187 - RNA, 32 nt, Human
ccucuggaguagcugggacuacagacaugcac

SEQ ID NO: 114188 - RNA, 32 nt, Human
ccucuggaguagcugggacuacaggcgugugc

SEQ ID NO: 114189 - RNA, 32 nt, Human
ccucuggaguagcugggacuacaggugcccac

SEQ ID NO: 114190 - RNA, 32 nt, Human
ccucuggaguagcugggauuacagaugggacc

SEQ ID NO: 114191 - RNA, 32 nt, Human
ccucuggaguagcugggauuacaggcacgcgc

SEQ ID NO: 114192 - RNA, 32 nt, Human
ccucuggaguagcugggauuacaggugcgcac

SEQ ID NO: 114193 - RNA, 32 nt, Human
ccucuggaguagcugggccuacagugugugcu

SEQ ID NO: 114194 - RNA, 32 nt, Human
ccucuggagugcuacccuucucuuguaaccuu

SEQ ID NO: 114195 - RNA, 32 nt, Human
ccucuggaguuuccuucaucugccccacaccc

SEQ ID NO: 114196 - RNA, 22 nt, Human
ccucuggaucaaaguaggcagg

SEQ ID NO: 114197 - RNA, 21 nt, Human
ccucuggaucuaauuaccuua

SEQ ID NO: 114198 - RNA, 32 nt, Human
ccucuggauggaaacuuccaucuuacuugguu

SEQ ID NO: 114199 - RNA, 19 nt, Human
ccucuggauucuuuucuua

SEQ ID NO: 114200 - RNA, 32 nt, Human
ccucuggauugcacacuggccuacagaccugg

SEQ ID NO: 114201 - RNA, 32 nt, Human
ccucuggcagcagcggggagaaugggagugcg

SEQ ID NO: 114202 - RNA, 32 nt, Human
ccucuggcaugcugguagacuagggccauccu

SEQ ID NO: 114203 - RNA, 32 nt, Human
ccucuggcauucacuccagccagccaucccuu

SEQ ID NO: 114204 - RNA, 17 nt, Human
ccucuggccacccagga

SEQ ID NO: 114205 - RNA, 21 nt, Human
ccucuggccccaccaggagaa

SEQ ID NO: 114206 - RNA, 32 nt, Human
ccucuggcccugccagcugccugcgucguugg

SEQ ID NO: 114207 - RNA, 20 nt, Human
ccucuggcccugggaacagg

SEQ ID NO: 114208 - RNA, 23 nt, Human
ccucuggcccuuccaggauggaa

SEQ ID NO: 114209 - RNA, 22 nt, Human
ccucuggcccuuccuucuggaa

SEQ ID NO: 114210 - RNA, 32 nt, Human
ccucuggccguguucccuccccggcucagagc

SEQ ID NO: 114211 - RNA, 21 nt, Human
ccucuggccuccucucagggc

SEQ ID NO: 114212 - RNA, 32 nt, Human
ccucuggccuggcugaguucacagcccagucu

SEQ ID NO: 114213 - RNA, 32 nt, Human
ccucuggccuuggagaaagcuguaaaucuugu

SEQ ID NO: 114214 - RNA, 32 nt, Human
ccucuggcgaggacucucaggauguagggacu

SEQ ID NO: 114215 - RNA, 22 nt, Human
ccucuggcuaccuagggaccug

SEQ ID NO: 114216 - RNA, 32 nt, Human
ccucuggcuaggacaggguggaaaggguggcg

SEQ ID NO: 114217 - RNA, 21 nt, Human
ccucuggcucaccuucaggca

SEQ ID NO: 114218 - RNA, 24 nt, Human
ccucuggcuccagcauggggccug

SEQ ID NO: 114219 - RNA, 32 nt, Human
ccucuggcuccaggaaccuccaaggaggagac

SEQ ID NO: 114220 - RNA, 19 nt, Human
ccucuggcuccccugcucc

SEQ ID NO: 114221 - RNA, 23 nt, Human
ccucuggcuccugcgagggcuug

SEQ ID NO: 114222 - RNA, 25 nt, Human
ccucuggcugaggcaguagcauaga

SEQ ID NO: 114223 - RNA, 20 nt, Human
ccucuggcugguggcaccuu

SEQ ID NO: 114224 - RNA, 20 nt, Human
ccucuggcuuaauucuuuua

SEQ ID NO: 114225 - RNA, 32 nt, Human
ccucuggcuuccaggccaggugugagggacau

SEQ ID NO: 114226 - RNA, 26 nt, Human
ccucuggcuucccauaguggggccug

SEQ ID NO: 114227 - RNA, 32 nt, Human
ccucuggcuuuccuggaacacagaugucgaga

SEQ ID NO: 114228 - RNA, 32 nt, Human
ccucugggaagggcaggcaggagcuggcuauu

SEQ ID NO: 114229 - RNA, 23 nt, Human
ccucugggaccaccacuucuuca

SEQ ID NO: 114230 - RNA, 32 nt, Human
ccucugggacccuauacggacuccgccacuug

SEQ ID NO: 114231 - RNA, 32 nt, Human
ccucugggaccuuccgcggcccucucugcaca

SEQ ID NO: 114232 - RNA, 32 nt, Human
ccucugggagcaucaacaccaacauggcacag

SEQ ID NO: 114233 - RNA, 32 nt, Human
ccucugggaggcaggagaccccaaaggacacc

SEQ ID NO: 114234 - RNA, 32 nt, Human
ccucugggagggcugugcugcuaguggguacc

SEQ ID NO: 114235 - RNA, 32 nt, Human
ccucugggagggggucccccugccuggccucg

SEQ ID NO: 114236 - RNA, 32 nt, Human
ccucugggauuccaccuugcuaucucugcucu

SEQ ID NO: 114237 - RNA, 32 nt, Human
ccucugggauugucacaggaagcgcugccaug

SEQ ID NO: 114238 - RNA, 32 nt, Human
ccucugggcaagagcacccacugugaaguccu

SEQ ID NO: 114239 - RNA, 24 nt, Human
ccucugggcacaccucaugccagg

SEQ ID NO: 114240 - RNA, 20 nt, Human
ccucugggcacccccucaaa

SEQ ID NO: 114241 - RNA, 24 nt, Human
ccucugggcacgccucaugccagg

SEQ ID NO: 114242 - RNA, 21 nt, Human
ccucugggcagagcagcagga

SEQ ID NO: 114243 - RNA, 24 nt, Human
ccucugggcagcacccagccuaga

SEQ ID NO: 114244 - RNA, 32 nt, Human
ccucugggcaugcagcagcaguagccuaaggg

SEQ ID NO: 114245 - RNA, 23 nt, Human
ccucugggcaugcugugcucgga

SEQ ID NO: 114246 - RNA, 21 nt, Human
ccucugggcauguggcucaga

SEQ ID NO: 114247 - RNA, 17 nt, Human
ccucugggcauuuucuu

SEQ ID NO: 114248 - RNA, 32 nt, Human
ccucugggccaaugcauuuccaaaggaugccu

SEQ ID NO: 114249 - RNA, 32 nt, Human
ccucugggccagcuguggaagcugcugcacuu

SEQ ID NO: 114250 - RNA, 21 nt, Human
ccucugggcccagcaggcagg

SEQ ID NO: 114251 - RNA, 32 nt, Human
ccucugggcccugccgcauuucuugagacuua

SEQ ID NO: 114252 - RNA, 23 nt, Human
ccucugggccgcgacugcgcagg

SEQ ID NO: 114253 - RNA, 32 nt, Human
ccucugggccuuuccgccuccucaccacugug

SEQ ID NO: 114254 - RNA, 22 nt, Human
ccucugggcgcuuggacauaga

SEQ ID NO: 114255 - RNA, 25 nt, Human
ccucugggcggccccggggcgcggg

SEQ ID NO: 114256 - RNA, 32 nt, Human
ccucuggggaaagagcacaggaacugaguugc

SEQ ID NO: 114257 - RNA, 32 nt, Human
ccucuggggacgggacacagggaagcccgaag

SEQ ID NO: 114258 - RNA, 24 nt, Human
ccucuggggagcuccgcggcggga

SEQ ID NO: 114259 - RNA, 32 nt, Human
ccucuggggaugagcaaggccuuccaggacag

SEQ ID NO: 114260 - RNA, 32 nt, Human
ccucuggggcaggggugguggagagauggaag

SEQ ID NO: 114261 - RNA, 20 nt, Human
ccucuggggcccuuuucuua

SEQ ID NO: 114262 - RNA, 32 nt, Human
ccucuggggcuguugaagucaccuuguguguu

SEQ ID NO: 114263 - RNA, 21 nt, Human
ccucugggggcagggcacaga

SEQ ID NO: 114264 - RNA, 32 nt, Human
ccucuggggugaggcuauuccagcgagcuggg

SEQ ID NO: 114265 - RNA, 32 nt, Human
ccucuggggugcagaaaccucuugccuccaga

SEQ ID NO: 114266 - RNA, 22 nt, Human
ccucuggggugggguggggggc

SEQ ID NO: 114267 - RNA, 32 nt, Human
ccucugggguggguucgccaggagggcacguu

SEQ ID NO: 114268 - RNA, 32 nt, Human
ccucugggucaugaguaccacccugccugccu

SEQ ID NO: 114269 - RNA, 21 nt, Human
ccucuggguccugcuggcugc

SEQ ID NO: 114270 - RNA, 23 nt, Human
ccucugggugccaggccgggcca

SEQ ID NO: 114271 - RNA, 32 nt, Human
ccucugguaaacauuccuccagccuccccucc

SEQ ID NO: 114272 - RNA, 32 nt, Human
ccucugguccugcuguuuccuccagucucacu

SEQ ID NO: 114273 - RNA, 22 nt, Human
ccucuggucucggggccaggaa

SEQ ID NO: 114274 - RNA, 32 nt, Human
ccucuggucucuuuuccucucuuccaaugccc

SEQ ID NO: 114275 - RNA, 32 nt, Human
ccucuggucugcaggccugcagguacagugcu

SEQ ID NO: 114276 - RNA, 32 nt, Human
ccucuggugcacauggcuuccuccccggcggu

SEQ ID NO: 114277 - RNA, 32 nt, Human
ccucugguggccaggugcauggccaccacugc

SEQ ID NO: 114278 - RNA, 31 nt, Human
ccucugguggccucugggccugcugcaugua

SEQ ID NO: 114279 - RNA, 32 nt, Human
ccucugguguagcugggaccacagaugcucca

SEQ ID NO: 114280 - RNA, 32 nt, Human
ccucugguguccacccuccaacccccacaagu

SEQ ID NO: 114281 - RNA, 32 nt, Human
ccucugguguguggugaggggcuuucucuucc

SEQ ID NO: 114282 - RNA, 32 nt, Human
ccucugguucaccauucagcaccagcugaaga

SEQ ID NO: 114283 - RNA, 32 nt, Human
ccucugguuccugccaccaccaccuccccagg

SEQ ID NO: 114284 - RNA, 32 nt, Human
ccucugguugacugagaauacugaguaagaua

SEQ ID NO: 114285 - RNA, 32 nt, Human
ccucuguaaccagcaagucuauuggugccauu

SEQ ID NO: 114286 - RNA, 32 nt, Human
ccucuguaagccuguuucuucucugaaaucac

SEQ ID NO: 114287 - RNA, 32 nt, Human
ccucuguaaguuggccacacuuggggagugag

SEQ ID NO: 114288 - RNA, 32 nt, Human
ccucuguacugcacugcaucaggagucaggag

SEQ ID NO: 114289 - RNA, 32 nt, Human
ccucuguagacuguugagacugaguuccuguu

SEQ ID NO: 114290 - RNA, 32 nt, Human
ccucuguaguguggccuggugcuggggugaag

SEQ ID NO: 114291 - RNA, 32 nt, Human
ccucuguauacaauugagggcagucuagcccu

SEQ ID NO: 114292 - RNA, 32 nt, Human
ccucuguaucaucucaggagguuucaggggcc

SEQ ID NO: 114293 - RNA, 32 nt, Human
ccucuguauucugcaggagcuuuuccugcugg

SEQ ID NO: 114294 - RNA, 32 nt, Human
ccucugucaaccaggcuggagugcagugacuc

SEQ ID NO: 114295 - RNA, 32 nt, Human
ccucugucaacccccugucgcuuugguguugg

SEQ ID NO: 114296 - RNA, 32 nt, Human
ccucugucaacccuuauuccacugccuuauuu

SEQ ID NO: 114297 - RNA, 32 nt, Human
ccucugucaccaaggcuggagugcauuggugc

SEQ ID NO: 114298 - RNA, 22 nt, Human
ccucugucaccaggcuggagug

SEQ ID NO: 114299 - RNA, 32 nt, Human
ccucugucaccaggcuggagugcaguggugcg

SEQ ID NO: 114300 - RNA, 32 nt, Human
ccucugucacccaggcuagaggguggugauau

SEQ ID NO: 114301 - RNA, 32 nt, Human
ccucugucacccaggcuggagugcagugguga

SEQ ID NO: 114302 - RNA, 32 nt, Human
ccucugucacccgagcuggagugcaguggugc

SEQ ID NO: 114303 - RNA, 32 nt, Human
ccucugucaccuaggcuggagugcaguggcac

SEQ ID NO: 114304 - RNA, 23 nt, Human
ccucugucagcacccagcacgga

SEQ ID NO: 114305 - RNA, 32 nt, Human
ccucugucauauggcuccucugucaccagccc

SEQ ID NO: 114306 - RNA, 32 nt, Human
ccucugucauccaggcuggagugcaguggugc

SEQ ID NO: 114307 - RNA, 32 nt, Human
ccucugucauguguccuugucccuaggcuaca

SEQ ID NO: 114308 - RNA, 32 nt, Human
ccucugucauuuucucucuuucuucgucuuuc

SEQ ID NO: 114309 - RNA, 32 nt, Human
ccucuguccacaccuccagagcaccaagucca

SEQ ID NO: 114310 - RNA, 32 nt, Human
ccucuguccacauucuucuuggauuuguauaa

SEQ ID NO: 114311 - RNA, 32 nt, Human
ccucuguccaugucccugccucaguuuaccuc

SEQ ID NO: 114312 - RNA, 23 nt, Human
ccucugucccccaggcuggagug

SEQ ID NO: 114313 - RNA, 32 nt, Human
ccucugucccccaggcuggagugcaguggugc

SEQ ID NO: 114314 - RNA, 20 nt, Human
ccucuguccccucugcagug

SEQ ID NO: 114315 - RNA, 23 nt, Human
ccucugucccguggaacugugca

SEQ ID NO: 114316 - RNA, 20 nt, Human
ccucuguccucugcccguca

SEQ ID NO: 114317 - RNA, 32 nt, Human
ccucugucgccaaaguuggagugcaguggcgc

SEQ ID NO: 114318 - RNA, 23 nt, Human
ccucugucgcccaggcuagagua

SEQ ID NO: 114319 - RNA, 32 nt, Human
ccucugucgcccaggcuagaguauaguggugu

SEQ ID NO: 114320 - RNA, 32 nt, Human
ccucugucgcccaggcuagagugcaauggcgu

SEQ ID NO: 114321 - RNA, 23 nt, Human
ccucugucgcccaggcuggagug

SEQ ID NO: 114322 - RNA, 32 nt, Human
ccucugucgcccaggcuggagugcaauggcgc

SEQ ID NO: 114323 - RNA, 32 nt, Human
ccucugucgcccaggcuggagugcaguggcga

SEQ ID NO: 114324 - RNA, 32 nt, Human
ccucugucguccaggcuggagugcaguggcac

SEQ ID NO: 114325 - RNA, 23 nt, Human
ccucugucuaaccagccccagca

SEQ ID NO: 114326 - RNA, 32 nt, Human
ccucugucuccaggcauucgggggccugaggu

SEQ ID NO: 114327 - RNA, 18 nt, Human
ccucugucucccuccugc

SEQ ID NO: 114328 - RNA, 32 nt, Human
ccucugucuccuaagcuggagugcaguggcau

SEQ ID NO: 114329 - RNA, 32 nt, Human
ccucugucucugcuuaucaccucucuugcgua

SEQ ID NO: 114330 - RNA, 32 nt, Human
ccucugucucuuccuuuuacccucucuugucu

SEQ ID NO: 114331 - RNA, 32 nt, Human
ccucugucucuuuauuucaccuugccaagaca

SEQ ID NO: 114332 - RNA, 32 nt, Human
ccucugucugaggauggggaggggccagugag

SEQ ID NO: 114333 - RNA, 32 nt, Human
ccucugucugcagcugcugcugccuggaccua

SEQ ID NO: 114334 - RNA, 32 nt, Human
ccucugucugggggcaggcucagcaucugccc

SEQ ID NO: 114335 - RNA, 32 nt, Human
ccucugucuuuuccuuuucuuuuucuuuccuu

SEQ ID NO: 114336 - RNA, 22 nt, Human
ccucugugaagguggcuggagc

SEQ ID NO: 114337 - RNA, 23 nt, Human
ccucugugacuuaauuuuucuua

SEQ ID NO: 114338 - RNA, 32 nt, Human
ccucugugauccucagucucugccauucagau

SEQ ID NO: 114339 - RNA, 32 nt, Human
ccucugugcaccugcagucucuuuccacuggc

SEQ ID NO: 114340 - RNA, 32 nt, Human
ccucugugccaagcaguaucccuguucagccc

SEQ ID NO: 114341 - RNA, 32 nt, Human
ccucugugccagcagugagacugugacagcaa

SEQ ID NO: 114342 - RNA, 32 nt, Human
ccucugugccuugcugcuccugaggcccaagg

SEQ ID NO: 114343 - RNA, 32 nt, Human
ccucugugccuugguggggcuuggggacucag

SEQ ID NO: 114344 - RNA, 26 nt, Human
ccucugugcuccacacugcggccagg

SEQ ID NO: 114345 - RNA, 32 nt, Human
ccucugugcucccuccugccugcaugcaaccu

SEQ ID NO: 114346 - RNA, 32 nt, Human
ccucugugcuuuuucgcuuuccuaagcuccug

SEQ ID NO: 114347 - RNA, 26 nt, Human
ccucuguggacuccuuaguucuucca

SEQ ID NO: 114348 - RNA, 32 nt, Human
ccucuguggauugauauuuacauaucaaugug

SEQ ID NO: 114349 - RNA, 23 nt, Human
ccucuguggccauuguagccaga

SEQ ID NO: 114350 - RNA, 32 nt, Human
ccucuguggcccaggcugaagagcaguagugu

SEQ ID NO: 114351 - RNA, 32 nt, Human
ccucuguggcuaggaggcucaaaggacuguga

SEQ ID NO: 114352 - RNA, 32 nt, Human
ccucuguggcugcucugccuccucccacucac

SEQ ID NO: 114353 - RNA, 32 nt, Human
ccucuguggggugaggaaugggucuugugaaa

SEQ ID NO: 114354 - RNA, 32 nt, Human
ccucuguguaugccugggauccuuccaagcac

SEQ ID NO: 114355 - RNA, 32 nt, Human
ccucuguguccuggagccacgcccuccggcuc

SEQ ID NO: 114356 - RNA, 32 nt, Human
ccucuguuacuuguugagucucuugucuucac

SEQ ID NO: 114357 - RNA, 32 nt, Human
ccucuguucagggcugacacaagccccacagg

SEQ ID NO: 114358 - RNA, 32 nt, Human
ccucuguuccaggccuacauuuguauuuccuc

SEQ ID NO: 114359 - RNA, 32 nt, Human
ccucuguucccaagggcagagcagaaagcggc

SEQ ID NO: 114360 - RNA, 32 nt, Human
ccucuguucccgggucccucaggcggccaccc

SEQ ID NO: 114361 - RNA, 32 nt, Human
ccucuguucccucccuggaaugugucuauuaa

SEQ ID NO: 114362 - RNA, 32 nt, Human
ccucuguucuuucaacuccuuugaggcucaaa

SEQ ID NO: 114363 - RNA, 23 nt, Human
ccucuguugaaauugucacccca

SEQ ID NO: 114364 - RNA, 32 nt, Human
ccucuguugccaggcuagagugcaguggcaug

SEQ ID NO: 114365 - RNA, 32 nt, Human
ccucuguugccaggcuggaaugccguggcgca

SEQ ID NO: 114366 - RNA, 23 nt, Human
ccucuguugcccaggcuggagug

SEQ ID NO: 114367 - RNA, 32 nt, Human
ccucuguugcccaggcuggagugcagaggugc

SEQ ID NO: 114368 - RNA, 32 nt, Human
ccucuguugcccaggcuggagugcaguggugc

SEQ ID NO: 114369 - RNA, 32 nt, Human
ccucuguuggcuguuguccucucaucuucauc

SEQ ID NO: 114370 - RNA, 32 nt, Human
ccucuguuguccaagcuagagugcagugauac

SEQ ID NO: 114371 - RNA, 32 nt, Human
ccucuguuguccaaggcuggaguguaguagug

SEQ ID NO: 114372 - RNA, 32 nt, Human
ccucuguuucuuucuuucuuccuuucauuuuu

SEQ ID NO: 114373 - RNA, 20 nt, Human
ccucuguuuuuaauuuucuu

SEQ ID NO: 114374 - RNA, 32 nt, Human
ccucuuaaagugcugggauuacaggcgugagc

SEQ ID NO: 114375 - RNA, 32 nt, Human
ccucuuaaaguguugggauuauagguaugaac

SEQ ID NO: 114376 - RNA, 32 nt, Human
ccucuuaaauccuccaaucucaguacccagug

SEQ ID NO: 114377 - RNA, 32 nt, Human
ccucuuaaugccuuugcuagugcaguguauuu

SEQ ID NO: 114378 - RNA, 32 nt, Human
ccucuuacagaaguuuccuuuucaccacuuga

SEQ ID NO: 114379 - RNA, 32 nt, Human
ccucuuacagaauaaacuauuguuaaauagga

SEQ ID NO: 114380 - RNA, 32 nt, Human
ccucuuacauuaucaaaugauuuaggauggag

SEQ ID NO: 114381 - RNA, 32 nt, Human
ccucuuaccaccgucauggcagucccagguug

SEQ ID NO: 114382 - RNA, 32 nt, Human
ccucuuacguagcugggauuacaggcaugagc

SEQ ID NO: 114383 - RNA, 32 nt, Human
ccucuuacuggcaguggcuagagggaugagac

SEQ ID NO: 114384 - RNA, 32 nt, Human
ccucuuagcagcccuccccaggaaaagugucc

SEQ ID NO: 114385 - RNA, 18 nt, Human
ccucuuagccuccaucca

SEQ ID NO: 114386 - RNA, 32 nt, Human
ccucuuagcgcggcgggggcugcucugggcgc

SEQ ID NO: 114387 - RNA, 31 nt, Human
ccucuuaggggucugccucaugacacuaaaa

SEQ ID NO: 114388 - RNA, 32 nt, Human
ccucuuagugugaacgagauugccaggcccuu

SEQ ID NO: 114389 - RNA, 32 nt, Human
ccucuuauuaaauaugauuuucccaguaaaaa

SEQ ID NO: 114390 - RNA, 31 nt, Human
ccucuuauuguggaaaccuguugagaucaca

SEQ ID NO: 114391 - RNA, 32 nt, Human
ccucuucaaaaaggaagggauaguggaaaacu

SEQ ID NO: 114392 - RNA, 32 nt, Human
ccucuucaacuugcucucuuucccacuccuag

SEQ ID NO: 114393 - RNA, 32 nt, Human
ccucuucaagagucugcugggauuccacuguc

SEQ ID NO: 114394 - RNA, 32 nt, Human
ccucuucaauccaucuuaccacacaauauuuc

SEQ ID NO: 114395 - RNA, 32 nt, Human
ccucuucacaacaguaucaacacuggcuucuc

SEQ ID NO: 114396 - RNA, 22 nt, Human
ccucuucaccccccacucacca

SEQ ID NO: 114397 - RNA, 32 nt, Human
ccucuucacucugcucucaggagaccuggcua

SEQ ID NO: 114398 - RNA, 18 nt, Human
ccucuucacugucaccca

SEQ ID NO: 114399 - RNA, 32 nt, Human
ccucuucagaacuugucaggcauggcucagag

SEQ ID NO: 114400 - RNA, 18 nt, Human
ccucuucagccaccagcc

SEQ ID NO: 114401 - RNA, 32 nt, Human
ccucuucaguguuuuccuccagucccgggagc

SEQ ID NO: 114402 - RNA, 32 nt, Human
ccucuucauacuuccuggucucagccuugcug

SEQ ID NO: 114403 - RNA, 32 nt, Human
ccucuucauaggaaccaggaggacaaaaccac

SEQ ID NO: 114404 - RNA, 32 nt, Human
ccucuucaucugcaccuguaauaguuucaguu

SEQ ID NO: 114405 - RNA, 32 nt, Human
ccucuucauuggacuggcgggcucaggcgcgg

SEQ ID NO: 114406 - RNA, 32 nt, Human
ccucuuccacaccuucccagcaucacagucag

SEQ ID NO: 114407 - RNA, 18 nt, Human
ccucuuccacccacccca

SEQ ID NO: 114408 - RNA, 32 nt, Human
ccucuuccacugugaucuccuccagggcuuuc

SEQ ID NO: 114409 - RNA, 32 nt, Human
ccucuuccagcaggggaccuggggcuguccuc

SEQ ID NO: 114410 - RNA, 32 nt, Human
ccucuuccaggaguuccggcagcgauacgaga

SEQ ID NO: 114411 - RNA, 32 nt, Human
ccucuuccaggcucccuuuuccagccuucccc

SEQ ID NO: 114412 - RNA, 32 nt, Human
ccucuucccaacucccuucucaacauggggag

SEQ ID NO: 114413 - RNA, 32 nt, Human
ccucuucccaggcuggucugacaugcagcuua

SEQ ID NO: 114414 - RNA, 32 nt, Human
ccucuucccagugcuugcgaccagccucauuc

SEQ ID NO: 114415 - RNA, 21 nt, Human
ccucuuccccagcuccucuga

SEQ ID NO: 114416 - RNA, 32 nt, Human
ccucuucccccaggaagccuucccugcccacc

SEQ ID NO: 114417 - RNA, 32 nt, Human
ccucuucccuaucuccccuccuccccuuuucu

SEQ ID NO: 114418 - RNA, 32 nt, Human
ccucuucccuccuggcguccccggcugcccuc

SEQ ID NO: 114419 - RNA, 20 nt, Human
ccucuucccucucccugccc

SEQ ID NO: 114420 - RNA, 32 nt, Human
ccucuucccugccuccccauuccccuggcugc

SEQ ID NO: 114421 - RNA, 32 nt, Human
ccucuucccugccucugcuccuugggagcggg

SEQ ID NO: 114422 - RNA, 32 nt, Human
ccucuucccugccucugucuugagcccaggcc

SEQ ID NO: 114423 - RNA, 32 nt, Human
ccucuucccuuuccccucagcuuacuuacucc

SEQ ID NO: 114424 - RNA, 32 nt, Human
ccucuuccgggcagaaacaauaaaaccacuug

SEQ ID NO: 114425 - RNA, 32 nt, Human
ccucuuccucacccucauccuuugggaggcug

SEQ ID NO: 114426 - RNA, 32 nt, Human
ccucuuccucauuccauugccccaggucuuuu

SEQ ID NO: 114427 - RNA, 32 nt, Human
ccucuuccuccaagccccgcccccucugcccc

SEQ ID NO: 114428 - RNA, 32 nt, Human
ccucuuccuccacgucucaccccaccccaccc

SEQ ID NO: 114429 - RNA, 32 nt, Human
ccucuuccuccccucccgacucucugcuccuu

SEQ ID NO: 114430 - RNA, 32 nt, Human
ccucuuccuccccucucucuuccucucccuga

SEQ ID NO: 114431 - RNA, 32 nt, Human
ccucuuccuccuccuccuccaccuccggcuuu

SEQ ID NO: 114432 - RNA, 32 nt, Human
ccucuuccuccuccuccuccucucuaggcacc

SEQ ID NO: 114433 - RNA, 32 nt, Human
ccucuuccuccuccuccuccuuggcauccgcc

SEQ ID NO: 114434 - RNA, 32 nt, Human
ccucuuccuccuccuccucuuccucauccuca

SEQ ID NO: 114435 - RNA, 32 nt, Human
ccucuuccuccuccucuucaauucucccggug

SEQ ID NO: 114436 - RNA, 32 nt, Human
ccucuuccuccuccucuuccucuucgucuucc

SEQ ID NO: 114437 - RNA, 32 nt, Human
ccucuuccuccuuccuccuuccuccugcuccu

SEQ ID NO: 114438 - RNA, 32 nt, Human
ccucuuccuggcaacaguuaggcuuuugagag

SEQ ID NO: 114439 - RNA, 32 nt, Human
ccucuuccuggcccaccuccucuuccucgugg

SEQ ID NO: 114440 - RNA, 32 nt, Human
ccucuuccuguuccuguugacaugucguuguu

SEQ ID NO: 114441 - RNA, 32 nt, Human
ccucuuccuucccagccugccugcaugcaugu

SEQ ID NO: 114442 - RNA, 32 nt, Human
ccucuuccuucuccuccuccauccccagaaca

SEQ ID NO: 114443 - RNA, 32 nt, Human
ccucuuccuugcccuccaaccugguggcauag

SEQ ID NO: 114444 - RNA, 22 nt, Human
ccucuucgccagcucccagguc

SEQ ID NO: 114445 - RNA, 32 nt, Human
ccucuucgcucucuuccuccugcuccaaccau

SEQ ID NO: 114446 - RNA, 32 nt, Human
ccucuucggcguuguccugcucugccgcaucc

SEQ ID NO: 114447 - RNA, 32 nt, Human
ccucuucgucccuuuucccucucacacagaag

SEQ ID NO: 114448 - RNA, 32 nt, Human
ccucuucguccuccucuccugccucaccauca

SEQ ID NO: 114449 - RNA, 32 nt, Human
ccucuucuacccuggccucucuuccaaagccu

SEQ ID NO: 114450 - RNA, 32 nt, Human
ccucuucuacuauggcaggagauguggugugc

SEQ ID NO: 114451 - RNA, 32 nt, Human
ccucuucuaggcaguguggaagggaaaugugg

SEQ ID NO: 114452 - RNA, 32 nt, Human
ccucuucuauuuaaugcagacccggcccagag

SEQ ID NO: 114453 - RNA, 32 nt, Human
ccucuucucagacaggcuguucucagagugca

SEQ ID NO: 114454 - RNA, 32 nt, Human
ccucuucuccaccugcaccacaucccuagucc

SEQ ID NO: 114455 - RNA, 32 nt, Human
ccucuucuccaucccugagacaucacagaauc

SEQ ID NO: 114456 - RNA, 32 nt, Human
ccucuucucccagaggauccuggagcugcagg

SEQ ID NO: 114457 - RNA, 32 nt, Human
ccucuucucccaugccuuccucccugcugugg

SEQ ID NO: 114458 - RNA, 32 nt, Human
ccucuucuccccuccuccuccugccgggccgg

SEQ ID NO: 114459 - RNA, 32 nt, Human
ccucuucuccucucgcuucccugccgggcagg

SEQ ID NO: 114460 - RNA, 32 nt, Human
ccucuucucggccgucuccaucgcugccuucu

SEQ ID NO: 114461 - RNA, 32 nt, Human
ccucuucucuccccgcucuccuuccccuuuca

SEQ ID NO: 114462 - RNA, 32 nt, Human
ccucuucucucccuuacuuuccaagcaaguua

SEQ ID NO: 114463 - RNA, 32 nt, Human
ccucuucucucccuucaagccccacacuucac

SEQ ID NO: 114464 - RNA, 32 nt, Human
ccucuucucucccuucggcuucucucuuucgg

SEQ ID NO: 114465 - RNA, 32 nt, Human
ccucuucucucuguuaagggagagaagucacu

SEQ ID NO: 114466 - RNA, 32 nt, Human
ccucuucugcagccucaccucuaccugccccc

SEQ ID NO: 114467 - RNA, 32 nt, Human
ccucuucugcgcgcacaaccuaggcaguaauc

SEQ ID NO: 114468 - RNA, 32 nt, Human
ccucuucugcgugccccucuucugucucauag

SEQ ID NO: 114469 - RNA, 32 nt, Human
ccucuucugcuccugcacaaccugccucuucg

SEQ ID NO: 114470 - RNA, 32 nt, Human
ccucuucuggaaaaucuagcaaggagauuuau

SEQ ID NO: 114471 - RNA, 32 nt, Human
ccucuucuggacccagccuggucugcacugca

SEQ ID NO: 114472 - RNA, 32 nt, Human
ccucuucugggccucugcuccccugggaccuc

SEQ ID NO: 114473 - RNA, 32 nt, Human
ccucuucugggcucaagauggacaacaagaag

SEQ ID NO: 114474 - RNA, 32 nt, Human
ccucuucuggucuuuccucuucuguuuaugga

SEQ ID NO: 114475 - RNA, 17 nt, Human
ccucuucugucaucuca

SEQ ID NO: 114476 - RNA, 22 nt, Human
ccucuucuguccccuccccucu

SEQ ID NO: 114477 - RNA, 32 nt, Human
ccucuucuuagccugugauuuugccuugggac

SEQ ID NO: 114478 - RNA, 32 nt, Human
ccucuucuuccuccucuuccuccuccucuugu

SEQ ID NO: 114479 - RNA, 32 nt, Human
ccucuucuuccucuucuuuucacaggugcuua

SEQ ID NO: 114480 - RNA, 32 nt, Human
ccucuucuucuuuuucauccuucugucucuuu

SEQ ID NO: 114481 - RNA, 32 nt, Human
ccucuucuugcaccuucuccugccucuccaca

SEQ ID NO: 114482 - RNA, 20 nt, Human
ccucuugaaacccuucccca

SEQ ID NO: 114483 - RNA, 32 nt, Human
ccucuugaacaauuccagacauucauagugga

SEQ ID NO: 114484 - RNA, 32 nt, Human
ccucuugaauagcugggauuacaggcgcccgc

SEQ ID NO: 114485 - RNA, 26 nt, Human
ccucuugaccauuuguaauuuuuuca

SEQ ID NO: 114486 - RNA, 32 nt, Human
ccucuugaggagaaaagcaauaaugaauaaaa

SEQ ID NO: 114487 - RNA, 32 nt, Human
ccucuugaggguggacagggagaaagaugaug

SEQ ID NO: 114488 - RNA, 32 nt, Human
ccucuugaguagcuaggauuaccagugcacac

SEQ ID NO: 114489 - RNA, 32 nt, Human
ccucuugaguagcuagguacaggcaccugcca

SEQ ID NO: 114490 - RNA, 32 nt, Human
ccucuugaguagcugggacuacaggcgcacac

SEQ ID NO: 114491 - RNA, 32 nt, Human
ccucuugaguagcugggacuacaggugcccgc

SEQ ID NO: 114492 - RNA, 32 nt, Human
ccucuugaguagcugggauuacaggaacgcgc

SEQ ID NO: 114493 - RNA, 32 nt, Human
ccucuugaguagcugggauuacaggcaugcgc

SEQ ID NO: 114494 - RNA, 32 nt, Human
ccucuugaguagcugggauuacaggcgcccac

SEQ ID NO: 114495 - RNA, 32 nt, Human
ccucuugaguagcuugguuuauaggcgcaugc

SEQ ID NO: 114496 - RNA, 32 nt, Human
ccucuugaguggcugggauugcaggcgcccgc

SEQ ID NO: 114497 - RNA, 32 nt, Human
ccucuugaguggcugggauugcgggcacaugc

SEQ ID NO: 114498 - RNA, 23 nt, Human
ccucuugaguuccucugcaguuu

SEQ ID NO: 114499 - RNA, 32 nt, Human
ccucuugauucuuggcuugccucuccuccaau

SEQ ID NO: 114500 - RNA, 16 nt, Human
ccucuugcacccagaa

SEQ ID NO: 114501 - RNA, 32 nt, Human
ccucuugcaguggaaacuuugugcaaagaaua

SEQ ID NO: 114502 - RNA, 32 nt, Human
ccucuugcauuuuaaaguggaggguuugucuc

SEQ ID NO: 114503 - RNA, 32 nt, Human
ccucuugccacuuuuaaaauuauccuucaggc

SEQ ID NO: 114504 - RNA, 32 nt, Human
ccucuugccaggaaugcccauggaucauguga

SEQ ID NO: 114505 - RNA, 32 nt, Human
ccucuugccaugaucagacaugcagcugccua

SEQ ID NO: 114506 - RNA, 26 nt, Human
ccucuugcccagucccaggcagagua

SEQ ID NO: 114507 - RNA, 23 nt, Human
ccucuugcccucacacucuggua

SEQ ID NO: 114508 - RNA, 32 nt, Human
ccucuugcccugagccucacagcuacucuucu

SEQ ID NO: 114509 - RNA, 32 nt, Human
ccucuugccucaccauggccuccucugaccag

SEQ ID NO: 114510 - RNA, 32 nt, Human
ccucuugccuccagauuuggguggagccucug

SEQ ID NO: 114511 - RNA, 18 nt, Human
ccucuugccuuggagcca

SEQ ID NO: 114512 - RNA, 23 nt, Human
ccucuugccuuuuccccauaaca

SEQ ID NO: 114513 - RNA, 32 nt, Human
ccucuugcuaccuccaccuccaccgccaccuc

SEQ ID NO: 114514 - RNA, 32 nt, Human
ccucuugcuagcucccugucacuggagcacgc

SEQ ID NO: 114515 - RNA, 32 nt, Human
ccucuugcuccuuccugcuaggacagcagggc

SEQ ID NO: 114516 - RNA, 20 nt, Human
ccucuugcugcucgcccugc

SEQ ID NO: 114517 - RNA, 32 nt, Human
ccucuugcuggcaauggggugggaggaguacc

SEQ ID NO: 114518 - RNA, 32 nt, Human
ccucuugcuguuggcugcacaucaggaaggcu

SEQ ID NO: 114519 - RNA, 32 nt, Human
ccucuugcuucgaucagaacagcuuuacuuua

SEQ ID NO: 114520 - RNA, 32 nt, Human
ccucuuggaaggacagaucugccgggcugcua

SEQ ID NO: 114521 - RNA, 25 nt, Human
ccucuuggcaaugaaauuugcagcu

SEQ ID NO: 114522 - RNA, 32 nt, Human
ccucuuggcaucucagaugcacuggccucucc

SEQ ID NO: 114523 - RNA, 18 nt, Human
ccucuuggccucugcagc

SEQ ID NO: 114524 - RNA, 22 nt, Human
ccucuuggccucugucccagcu

SEQ ID NO: 114525 - RNA, 22 nt, Human
ccucuuggcucucucugcacuu

SEQ ID NO: 114526 - RNA, 32 nt, Human
ccucuugggcugcucccucgugcacagcgcag

SEQ ID NO: 114527 - RNA, 32 nt, Human
ccucuuggggaaaggugccuuguugugaugaa

SEQ ID NO: 114528 - RNA, 20 nt, Human
ccucuugggggccuggagcu

SEQ ID NO: 114529 - RNA, 32 nt, Human
ccucuugguacccagggugaguugguggagaa

SEQ ID NO: 114530 - RNA, 32 nt, Human
ccucuugucaggacaacugccugcugcuaggg

SEQ ID NO: 114531 - RNA, 15 nt, Human
ccucuuguccaggug

SEQ ID NO: 114532 - RNA, 32 nt, Human
ccucuuguccuccucagccucggugccuugga

SEQ ID NO: 114533 - RNA, 32 nt, Human
ccucuuguccuccuuuguuugccaucagcaag

SEQ ID NO: 114534 - RNA, 32 nt, Human
ccucuugucuccccacucccucccucuuuguu

SEQ ID NO: 114535 - RNA, 32 nt, Human
ccucuugucugugcuucagcccugcacaaaag

SEQ ID NO: 114536 - RNA, 32 nt, Human
ccucuuguggccaggccuuccuuugcuggagg

SEQ ID NO: 114537 - RNA, 24 nt, Human
ccucuuguuacccaggcuggagug

SEQ ID NO: 114538 - RNA, 32 nt, Human
ccucuuguuacccaggcuggagugcaguggcg

SEQ ID NO: 114539 - RNA, 23 nt, Human
ccucuuguuccagccucuuggaa

SEQ ID NO: 114540 - RNA, 21 nt, Human
ccucuuguugcccaggcugga

SEQ ID NO: 114541 - RNA, 32 nt, Human
ccucuuguugcccaggcuggaaauggcgcgau

SEQ ID NO: 114542 - RNA, 24 nt, Human
ccucuuguugcccaggcuggagug

SEQ ID NO: 114543 - RNA, 32 nt, Human
ccucuuguugcccaggcuggagugcaacggug

SEQ ID NO: 114544 - RNA, 32 nt, Human
ccucuuguugcccaggcuggagugcaauggcg

SEQ ID NO: 114545 - RNA, 32 nt, Human
ccucuuguugcccgggcuggagugcaauggcg

SEQ ID NO: 114546 - RNA, 22 nt, Human
ccucuuguugccugcacucauu

SEQ ID NO: 114547 - RNA, 27 nt, Human
ccucuuguuggagacaggcauacuccu

SEQ ID NO: 114548 - RNA, 32 nt, Human
ccucuuuacaggcaucuuuauccggaauucag

SEQ ID NO: 114549 - RNA, 32 nt, Human
ccucuuuacuccaagcacugggggaaacccag

SEQ ID NO: 114550 - RNA, 32 nt, Human
ccucuuuauguuacugugcugaucaggacaaa

SEQ ID NO: 114551 - RNA, 32 nt, Human
ccucuuuauugcugucaaagaugaggacccug

SEQ ID NO: 114552 - RNA, 32 nt, Human
ccucuuuauuuuugcugaguccugcagccagg

SEQ ID NO: 114553 - RNA, 31 nt, Human
ccucuuucaauaaacccccauugaaacagca

SEQ ID NO: 114554 - RNA, 32 nt, Human
ccucuuucagggguguguacagugcauugaug

SEQ ID NO: 114555 - RNA, 32 nt, Human
ccucuuucaguucugacagaaaauaauuuauu

SEQ ID NO: 114556 - RNA, 32 nt, Human
ccucuuucauuuucuaugcauuucgauuugac

SEQ ID NO: 114557 - RNA, 32 nt, Human
ccucuuuccaguaccucuuugcugugggacug

SEQ ID NO: 114558 - RNA, 32 nt, Human
ccucuuuccaucauccuuccuccaccuguggg

SEQ ID NO: 114559 - RNA, 32 nt, Human
ccucuuucccacauagccaucaucuugugugu

SEQ ID NO: 114560 - RNA, 32 nt, Human
ccucuuucccagcuuucuugcuugccuucugu

SEQ ID NO: 114561 - RNA, 32 nt, Human
ccucuuuccccagcuucugucugucucacugu

SEQ ID NO: 114562 - RNA, 32 nt, Human
ccucuuucccugggauugacucugaguggaau

SEQ ID NO: 114563 - RNA, 32 nt, Human
ccucuuuccucugcugcuuuccuuccuucugu

SEQ ID NO: 114564 - RNA, 32 nt, Human
ccucuuuccucuuccugguuuccuuaccugcc

SEQ ID NO: 114565 - RNA, 32 nt, Human
ccucuuuccuuuccuuugaccuaauggagcua

SEQ ID NO: 114566 - RNA, 21 nt, Human
ccucuuucgccgccgccgccg

SEQ ID NO: 114567 - RNA, 32 nt, Human
ccucuuucucaccuacccccugccgcacagcc

SEQ ID NO: 114568 - RNA, 32 nt, Human
ccucuuucucacuagagacucaaugacagaag

SEQ ID NO: 114569 - RNA, 32 nt, Human
ccucuuucuccaccaccucgggccccgguguc

SEQ ID NO: 114570 - RNA, 32 nt, Human
ccucuuucuccucccucuccuccucucaccuu

SEQ ID NO: 114571 - RNA, 32 nt, Human
ccucuuucuccuccuucucccgcggcuucugc

SEQ ID NO: 114572 - RNA, 16 nt, Human
ccucuuucuccuuggc

SEQ ID NO: 114573 - RNA, 24 nt, Human
ccucuuucugccacuugugcgcug

SEQ ID NO: 114574 - RNA, 32 nt, Human
ccucuuucuggccugugcaccucucucuggcu

SEQ ID NO: 114575 - RNA, 32 nt, Human
ccucuuucuucauaguccucaggcuuugguua

SEQ ID NO: 114576 - RNA, 32 nt, Human
ccucuuucuugccucugaaauguggcuaggug

SEQ ID NO: 114577 - RNA, 32 nt, Human
ccucuuucuuugcagaccgaacagugaaaagc

SEQ ID NO: 114578 - RNA, 32 nt, Human
ccucuuucuuuucaacuuuuugcccuuccuuu

SEQ ID NO: 114579 - RNA, 32 nt, Human
ccucuuugagaggagcugcuugugaaccaggc

SEQ ID NO: 114580 - RNA, 29 nt, Human
ccucuuugagugcuaucagcccucuagac

SEQ ID NO: 114581 - RNA, 32 nt, Human
ccucuuugauauuccugguuccugucuuacug

SEQ ID NO: 114582 - RNA, 32 nt, Human
ccucuuugcccagcuucuccccugcccuauuc

SEQ ID NO: 114583 - RNA, 32 nt, Human
ccucuuugccuaggcuagaguacaaaugguac

SEQ ID NO: 114584 - RNA, 32 nt, Human
ccucuuugcguggaaucagaccucuuuugcag

SEQ ID NO: 114585 - RNA, 32 nt, Human
ccucuuugcugaccuggaggugaucuguguau

SEQ ID NO: 114586 - RNA, 32 nt, Human
ccucuuugcuguuuucuuccuccucuauaaaa

SEQ ID NO: 114587 - RNA, 22 nt, Human
ccucuuuggaaagcagcagugg

SEQ ID NO: 114588 - RNA, 32 nt, Human
ccucuuuggaaucuucuucaucuuggcugccc

SEQ ID NO: 114589 - RNA, 32 nt, Human
ccucuuuggaccccaauucggccuuaagaugc

SEQ ID NO: 114590 - RNA, 32 nt, Human
ccucuuuggauccauugccccugagcucccag

SEQ ID NO: 114591 - RNA, 32 nt, Human
ccucuuuggaugugguucaccaaccaacauag

SEQ ID NO: 114592 - RNA, 32 nt, Human
ccucuuugggcacugguggauguaggcaccuc

SEQ ID NO: 114593 - RNA, 32 nt, Human
ccucuuuucauaccugaguacucuccugagcc

SEQ ID NO: 114594 - RNA, 32 nt, Human
ccucuuuucccccuucucucucccucucccuc

SEQ ID NO: 114595 - RNA, 16 nt, Human
ccucuuuuccccugga

SEQ ID NO: 114596 - RNA, 32 nt, Human
ccucuuuuccucaacguguucuuucccggguu

SEQ ID NO: 114597 - RNA, 32 nt, Human
ccucuuuugccaggcuggaugcugucgucucu

SEQ ID NO: 114598 - RNA, 32 nt, Human
ccucuuuugcuuguaauaacgcagaucccagc

SEQ ID NO: 114599 - RNA, 32 nt, Human
ccucuuuuguccaccagcccagccugacuccu

SEQ ID NO: 114600 - RNA, 32 nt, Human
ccucuuuuucaucagguuuguuaauagaguua

SEQ ID NO: 114601 - RNA, 18 nt, Human
ccucuuuuucuauggaga

SEQ ID NO: 114602 - RNA, 32 nt, Human
ccucuuuuucuuucuuccaccacuccccaccc

SEQ ID NO: 114603 - RNA, 32 nt, Human
ccucuuuuugacaguaaacuucugccuauggc

SEQ ID NO: 114604 - RNA, 20 nt, Human
ccucuuuuuucccuaaggga

SEQ ID NO: 114605 - RNA, 32 nt, Human
ccugaaaaacugaucaaaaauaaacuaguuuc

SEQ ID NO: 114606 - RNA, 32 nt, Human
ccugaaaacccaugaacgcuggggcuggggaa

SEQ ID NO: 114607 - RNA, 31 nt, Human
ccugaaaagagacuugguuuggggaccccac

SEQ ID NO: 114608 - RNA, 32 nt, Human
ccugaaaagcuugucuacugaagaauuacucc

SEQ ID NO: 114609 - RNA, 32 nt, Human
ccugaaaagucuccuggacgccugugaggcuc

SEQ ID NO: 114610 - RNA, 32 nt, Human
ccugaaaaucuccaucagagcaaggcagccag

SEQ ID NO: 114611 - RNA, 21 nt, Human
ccugaaaaugaguaaaauagu

SEQ ID NO: 114612 - RNA, 32 nt, Human
ccugaaaaugccacuuucaugcaguuuguuug

SEQ ID NO: 114613 - RNA, 21 nt, Human
ccugaaaauguuuuucugcca

SEQ ID NO: 114614 - RNA, 32 nt, Human
ccugaaacacacacaaacacacacaugucgau

SEQ ID NO: 114615 - RNA, 32 nt, Human
ccugaaacacugaccgacccuccuggggucug

SEQ ID NO: 114616 - RNA, 32 nt, Human
ccugaaacagagcaugcuuuccagaaagucac

SEQ ID NO: 114617 - RNA, 20 nt, Human
ccugaaacaggaauggggca

SEQ ID NO: 114618 - RNA, 32 nt, Human
ccugaaaccaacaaaagccucaagagccaaga

SEQ ID NO: 114619 - RNA, 32 nt, Human
ccugaaacccagggccagagacaaggacaacu

SEQ ID NO: 114620 - RNA, 32 nt, Human
ccugaaaccccagcuacuugggaggcugaggc

SEQ ID NO: 114621 - RNA, 32 nt, Human
ccugaaacccucccucuuuucccuucaggcau

SEQ ID NO: 114622 - RNA, 32 nt, Human
ccugaaacucuuaugcuggaguccuaguccca

SEQ ID NO: 114623 - RNA, 32 nt, Human
ccugaaacugguuuuaagugcuuuccuucucc

SEQ ID NO: 114624 - RNA, 32 nt, Human
ccugaaagacuggccccuggcuccccgccccu

SEQ ID NO: 114625 - RNA, 32 nt, Human
ccugaaagagagcaagaacauguggaucuuug

SEQ ID NO: 114626 - RNA, 32 nt, Human
ccugaaagcauggucagagguacccacguggc

SEQ ID NO: 114627 - RNA, 32 nt, Human
ccugaaagccaagggugcccagggguguggug

SEQ ID NO: 114628 - RNA, 32 nt, Human
ccugaaagcuuuguuucagagcuuuguauugg

SEQ ID NO: 114629 - RNA, 32 nt, Human
ccugaaaggaaaauagaauaugaucaauuccu

SEQ ID NO: 114630 - RNA, 32 nt, Human
ccugaaaggaggcucacuugaauccagcucag

SEQ ID NO: 114631 - RNA, 32 nt, Human
ccugaaagggccuggggcugagcucagccugu

SEQ ID NO: 114632 - RNA, 23 nt, Human
ccugaaagucgagguugcaguga

SEQ ID NO: 114633 - RNA, 21 nt, Human
ccugaaaguggugauacuaca

SEQ ID NO: 114634 - RNA, 31 nt, Human
ccugaaaguguccagcagcuaccucagugac

SEQ ID NO: 114635 - RNA, 32 nt, Human
ccugaaaguugagcaggggagcuguagaagaa

SEQ ID NO: 114636 - RNA, 22 nt, Human
ccugaaauaaacacuggugcca

SEQ ID NO: 114637 - RNA, 32 nt, Human
ccugaaaucaagagcauggcuugaguguguga

SEQ ID NO: 114638 - RNA, 32 nt, Human
ccugaaaucccagcuacucaagaggcugaggc

SEQ ID NO: 114639 - RNA, 23 nt, Human
ccugaaaucccagcuacugaaga

SEQ ID NO: 114640 - RNA, 32 nt, Human
ccugaaaucccagcuacugaagaggcugaggu

SEQ ID NO: 114641 - RNA, 32 nt, Human
ccugaaaucccagcuacuugggaggcugaggc

SEQ ID NO: 114642 - RNA, 32 nt, Human
ccugaaaucccagcuaucaggaggcugaggca

SEQ ID NO: 114643 - RNA, 32 nt, Human
ccugaaaucccagguacucaggaggcugaggc

SEQ ID NO: 114644 - RNA, 32 nt, Human
ccugaaaucugaaacacuugugguuccaagca

SEQ ID NO: 114645 - RNA, 32 nt, Human
ccugaaauuccaccuuucauccccuauggaug

SEQ ID NO: 114646 - RNA, 32 nt, Human
ccugaacaacauaacaagacccugucuguaaa

SEQ ID NO: 114647 - RNA, 32 nt, Human
ccugaacaacaucacugugguuacucauccau

SEQ ID NO: 114648 - RNA, 32 nt, Human
ccugaacaaccagcagcgauacccagguacaa

SEQ ID NO: 114649 - RNA, 32 nt, Human
ccugaacaccacugcccccuucacugucugug

SEQ ID NO: 114650 - RNA, 32 nt, Human
ccugaacacucugcuccagccaagguggugag

SEQ ID NO: 114651 - RNA, 32 nt, Human
ccugaacaucccuccuuucaggcugcagaagg

SEQ ID NO: 114652 - RNA, 19 nt, Human
ccugaacauucccaccuca

SEQ ID NO: 114653 - RNA, 32 nt, Human
ccugaacauugggcgguuuucuuaauuugaag

SEQ ID NO: 114654 - RNA, 32 nt, Human
ccugaaccaaaccuaauuguccuggucuuaag

SEQ ID NO: 114655 - RNA, 32 nt, Human
ccugaaccacucuuugcugggccuccgcaagg

SEQ ID NO: 114656 - RNA, 32 nt, Human
ccugaaccacuguggccuucucagccuacagc

SEQ ID NO: 114657 - RNA, 23 nt, Human
ccugaaccagagugugcccugcc

SEQ ID NO: 114658 - RNA, 32 nt, Human
ccugaaccagagugugcccugccccucaugcu

SEQ ID NO: 114659 - RNA, 32 nt, Human
ccugaaccaguucuuucuugagacagacuaua

SEQ ID NO: 114660 - RNA, 32 nt, Human
ccugaacccaggaagaggagguugcagugagc

SEQ ID NO: 114661 - RNA, 32 nt, Human
ccugaacccaggaggcagagguugcaguaagc

SEQ ID NO: 114662 - RNA, 32 nt, Human
ccugaacccaggaggcagagguugcagugagc

SEQ ID NO: 114663 - RNA, 32 nt, Human
ccugaacccaggaggcagagguugcggugagu

SEQ ID NO: 114664 - RNA, 32 nt, Human
ccugaacccaggaggcggagcuugcagugagc

SEQ ID NO: 114665 - RNA, 32 nt, Human
ccugaacccaggaggcggagguugcagggagg

SEQ ID NO: 114666 - RNA, 32 nt, Human
ccugaacccaggaggcggagguugcagugagc

SEQ ID NO: 114667 - RNA, 32 nt, Human
ccugaacccaggagguggagguugcagugagc

SEQ ID NO: 114668 - RNA, 32 nt, Human
ccugaaccccagaggcagagguugcagugagc

SEQ ID NO: 114669 - RNA, 32 nt, Human
ccugaaccccagagguggagguugcagugagc

SEQ ID NO: 114670 - RNA, 22 nt, Human
ccugaacccccaggcuggagua

SEQ ID NO: 114671 - RNA, 32 nt, Human
ccugaacccccaggcuggaguacaguggcagg

SEQ ID NO: 114672 - RNA, 32 nt, Human
ccugaaccccggccuccacccugggggaggcc

SEQ ID NO: 114673 - RNA, 20 nt, Human
ccugaaccccucuccugguc

SEQ ID NO: 114674 - RNA, 24 nt, Human
ccugaaccccucucugcaacuccu

SEQ ID NO: 114675 - RNA, 32 nt, Human
ccugaaccccucugacacuuggaaacugaaua

SEQ ID NO: 114676 - RNA, 24 nt, Human
ccugaaccccucuugccacugccu

SEQ ID NO: 114677 - RNA, 32 nt, Human
ccugaacccggcaggcagagcuugcagugagc

SEQ ID NO: 114678 - RNA, 32 nt, Human
ccugaacccgggaggcaaagguuuuagugagc

SEQ ID NO: 114679 - RNA, 32 nt, Human
ccugaacccgggaggcagagcuugcaguaagc

SEQ ID NO: 114680 - RNA, 32 nt, Human
ccugaacccgggaggcagagcuugcagugagc

SEQ ID NO: 114681 - RNA, 32 nt, Human
ccugaacccgggaggcagaggcugcagugagc

SEQ ID NO: 114682 - RNA, 32 nt, Human
ccugaacccgggaggcagagguugcagugagc

SEQ ID NO: 114683 - RNA, 32 nt, Human
ccugaacccgggaggcggagcuugcagugagc

SEQ ID NO: 114684 - RNA, 32 nt, Human
ccugaacccgggaggcggagguugcagugagc

SEQ ID NO: 114685 - RNA, 32 nt, Human
ccugaacccgggaggcuaagguugcagugagc

SEQ ID NO: 114686 - RNA, 32 nt, Human
ccugaacccgggagguggagguugcagugagc

SEQ ID NO: 114687 - RNA, 32 nt, Human
ccugaacccgggcgguggagguuguagugagc

SEQ ID NO: 114688 - RNA, 32 nt, Human
ccugaacccgugaggcagagguugcagugagc

SEQ ID NO: 114689 - RNA, 32 nt, Human
ccugaacccugccucccgcgcccgcccugcuc

SEQ ID NO: 114690 - RNA, 32 nt, Human
ccugaaccuaggagguggaggcugcagcgagc

SEQ ID NO: 114691 - RNA, 32 nt, Human
ccugaaccucagaggcagagguugcaaugaag

SEQ ID NO: 114692 - RNA, 32 nt, Human
ccugaaccuccgcaaaacccccaaaccuggag

SEQ ID NO: 114693 - RNA, 32 nt, Human
ccugaaccugagaggcggagguugcagugagc

SEQ ID NO: 114694 - RNA, 32 nt, Human
ccugaaccugccgccuccgugccuggggcggc

SEQ ID NO: 114695 - RNA, 32 nt, Human
ccugaaccugggaaccaugaagcuggaagcac

SEQ ID NO: 114696 - RNA, 32 nt, Human
ccugaaccugggaaucggagguugcagggcca

SEQ ID NO: 114697 - RNA, 32 nt, Human
ccugaaccugggagacagaugaggagacuggc

SEQ ID NO: 114698 - RNA, 32 nt, Human
ccugaaccugggaggcagagguugcaaugagc

SEQ ID NO: 114699 - RNA, 32 nt, Human
ccugaaccugggaggcagagguugcaguaagc

SEQ ID NO: 114700 - RNA, 32 nt, Human
ccugaaccugggaggcggagguugcagugagc

SEQ ID NO: 114701 - RNA, 32 nt, Human
ccugaaccugggagguggagauugcagugagc

SEQ ID NO: 114702 - RNA, 32 nt, Human
ccugaaccuucucuucugcacauggagacuuu

SEQ ID NO: 114703 - RNA, 32 nt, Human
ccugaacgaccugcuccagggaggcuuuagcc

SEQ ID NO: 114704 - RNA, 32 nt, Human
ccugaacggagagagggagugaacugugcaaa

SEQ ID NO: 114705 - RNA, 32 nt, Human
ccugaacgggcgacugugucuugacuaccuuu

SEQ ID NO: 114706 - RNA, 32 nt, Human
ccugaacggugcuucuugcccccucugccugg

SEQ ID NO: 114707 - RNA, 32 nt, Human
ccugaacuaccguccugccuaggccuggcucc

SEQ ID NO: 114708 - RNA, 31 nt, Human
ccugaacucaauaacuguuugaaaauuagug

SEQ ID NO: 114709 - RNA, 32 nt, Human
ccugaacucaggaggcggagguugcggugagc

SEQ ID NO: 114710 - RNA, 16 nt, Human
ccugaacuccaccucu

SEQ ID NO: 114711 - RNA, 22 nt, Human
ccugaacuccccagcccccuca

SEQ ID NO: 114712 - RNA, 32 nt, Human
ccugaacucucuggaccucagguuuccaucug

SEQ ID NO: 114713 - RNA, 32 nt, Human
ccugaacucugacuuuuacugccauucacuuu

SEQ ID NO: 114714 - RNA, 32 nt, Human
ccugaacucuugagacaacucucuccagcaau

SEQ ID NO: 114715 - RNA, 32 nt, Human
ccugaacucuuuacuggguuaccagguucaua

SEQ ID NO: 114716 - RNA, 24 nt, Human
ccugaacugaggagaugaccaggg

SEQ ID NO: 114717 - RNA, 32 nt, Human
ccugaacugaguccacagaacuccacucggaa

SEQ ID NO: 114718 - RNA, 32 nt, Human
ccugaacugcccccagcacuuccgagccccga

SEQ ID NO: 114719 - RNA, 32 nt, Human
ccugaacugcuggcggucugccacugccugau

SEQ ID NO: 114720 - RNA, 32 nt, Human
ccugaacuuguugcgacagagggacucacugg

SEQ ID NO: 114721 - RNA, 32 nt, Human
ccugaacuuuucuuucuuccaucaugcucuga

SEQ ID NO: 114722 - RNA, 32 nt, Human
ccugaagaaaagaaguuuuagugaagauggaa

SEQ ID NO: 114723 - RNA, 22 nt, Human
ccugaagaaaccacagguucca

SEQ ID NO: 114724 - RNA, 32 nt, Human
ccugaagaaagccucugaugggccuagaacag

SEQ ID NO: 114725 - RNA, 24 nt, Human
ccugaagaaucaucccaggugcca

SEQ ID NO: 114726 - RNA, 21 nt, Human
ccugaagaaugcuguucuuuc

SEQ ID NO: 114727 - RNA, 19 nt, Human
ccugaagacaccccugccc

SEQ ID NO: 114728 - RNA, 32 nt, Human
ccugaagacauauagaggcagaaggacaggaa

SEQ ID NO: 114729 - RNA, 23 nt, Human
ccugaagacccccacaugugcca

SEQ ID NO: 114730 - RNA, 32 nt, Human
ccugaagacuccaagaaaaugagugugcagau

SEQ ID NO: 114731 - RNA, 32 nt, Human
ccugaagacugaggcccugcagcuaccaggug

SEQ ID NO: 114732 - RNA, 22 nt, Human
ccugaagagacagugagugcca

SEQ ID NO: 114733 - RNA, 32 nt, Human
ccugaagagaccacuugcccacccuccugccc

SEQ ID NO: 114734 - RNA, 21 nt, Human
ccugaagagagcgucaggcca

SEQ ID NO: 114735 - RNA, 32 nt, Human
ccugaagagauugaaaaagaagagcaggcugc

SEQ ID NO: 114736 - RNA, 19 nt, Human
ccugaagaggcaggguaca

SEQ ID NO: 114737 - RNA, 23 nt, Human
ccugaagaggccauaugcuggca

SEQ ID NO: 114738 - RNA, 19 nt, Human
ccugaagaggccccgugcc

SEQ ID NO: 114739 - RNA, 21 nt, Human
ccugaagaggcccuuuugugc

SEQ ID NO: 114740 - RNA, 32 nt, Human
ccugaagaguacugaagauuuagaagggacug

SEQ ID NO: 114741 - RNA, 32 nt, Human
ccugaagauaaauauguguuggacaagcauag

SEQ ID NO: 114742 - RNA, 21 nt, Human
ccugaagaucaggcagggugc

SEQ ID NO: 114743 - RNA, 23 nt, Human
ccugaagaucaggcagggugcca

SEQ ID NO: 114744 - RNA, 32 nt, Human
ccugaagaugccggagcucccggcugagcaac

SEQ ID NO: 114745 - RNA, 32 nt, Human
ccugaagauggaacacugguccccuucacugg

SEQ ID NO: 114746 - RNA, 32 nt, Human
ccugaagauggcagaggagagcagcuguacca

SEQ ID NO: 114747 - RNA, 32 nt, Human
ccugaagcaaacauggaucaagaaacuguagg

SEQ ID NO: 114748 - RNA, 32 nt, Human
ccugaagcacuggcuccagccuuagggaaggu

SEQ ID NO: 114749 - RNA, 32 nt, Human
ccugaagcagauccuguauuugcuggagaaau

SEQ ID NO: 114750 - RNA, 20 nt, Human
ccugaagcaggcccacagug

SEQ ID NO: 114751 - RNA, 32 nt, Human
ccugaagccagccucucugccaagucacucag

SEQ ID NO: 114752 - RNA, 21 nt, Human
ccugaagccagccuucuucca

SEQ ID NO: 114753 - RNA, 32 nt, Human
ccugaagccagcugcccuaugggccugccggg

SEQ ID NO: 114754 - RNA, 32 nt, Human
ccugaagcccaagaggacacggcgggcacagu

SEQ ID NO: 114755 - RNA, 32 nt, Human
ccugaagcccagagaaguaaaggcacuugccc

SEQ ID NO: 114756 - RNA, 32 nt, Human
ccugaagcccaggaggaggaagaggaggcugg

SEQ ID NO: 114757 - RNA, 32 nt, Human
ccugaagcccccuucccugccugccugcugac

SEQ ID NO: 114758 - RNA, 32 nt, Human
ccugaagccgagaaauggaacucuuaacauuc

SEQ ID NO: 114759 - RNA, 32 nt, Human
ccugaagccuugauauuucuucauggcugccg

SEQ ID NO: 114760 - RNA, 20 nt, Human
ccugaagcgcagccccugug

SEQ ID NO: 114761 - RNA, 32 nt, Human
ccugaagcuauuccucucccggcggagguggc

SEQ ID NO: 114762 - RNA, 32 nt, Human
ccugaagcuccccucuuccucucuuccuccag

SEQ ID NO: 114763 - RNA, 32 nt, Human
ccugaagcucuuccauuggucaucauggaguu

SEQ ID NO: 114764 - RNA, 20 nt, Human
ccugaagcugcaguccacag

SEQ ID NO: 114765 - RNA, 32 nt, Human
ccugaagcugugucuguggagcugcggccacu

SEQ ID NO: 114766 - RNA, 32 nt, Human
ccugaagcuucagaacuagggaaacugauggu

SEQ ID NO: 114767 - RNA, 32 nt, Human
ccugaagcuuccaggguagcagcuggugggac

SEQ ID NO: 114768 - RNA, 18 nt, Human
ccugaaggagacagacug

SEQ ID NO: 114769 - RNA, 32 nt, Human
ccugaaggcaacgugacccaggagaacuuugu

SEQ ID NO: 114770 - RNA, 32 nt, Human
ccugaaggcaagggagagcaggcugcacagcu

SEQ ID NO: 114771 - RNA, 32 nt, Human
ccugaaggccaagcuugucacugugaaugagg

SEQ ID NO: 114772 - RNA, 32 nt, Human
ccugaaggcccagcagcaggccaaggcugugc

SEQ ID NO: 114773 - RNA, 32 nt, Human
ccugaagggaaggcaaaggcagaggaauuugg

SEQ ID NO: 114774 - RNA, 32 nt, Human
ccugaagggcugggaugcguuuuucuuggugu

SEQ ID NO: 114775 - RNA, 17 nt, Human
ccugaagggguccacag

SEQ ID NO: 114776 - RNA, 32 nt, Human
ccugaagggugaggagguggaaggagccgggu

SEQ ID NO: 114777 - RNA, 32 nt, Human
ccugaaggucugggucucaggacagugauguu

SEQ ID NO: 114778 - RNA, 32 nt, Human
ccugaaguagaucauaagacugucauguaaga

SEQ ID NO: 114779 - RNA, 32 nt, Human
ccugaaguaugugcaggagcugccucuggaag

SEQ ID NO: 114780 - RNA, 32 nt, Human
ccugaagucccagcuacucaggaggcugaggc

SEQ ID NO: 114781 - RNA, 32 nt, Human
ccugaaguccuggccccugugucauagcccca

SEQ ID NO: 114782 - RNA, 23 nt, Human
ccugaagucggagaagagccccu

SEQ ID NO: 114783 - RNA, 32 nt, Human
ccugaagucugcagucugccacacagaagaca

SEQ ID NO: 114784 - RNA, 32 nt, Human
ccugaagugagugagaggcacaugaagagaag

SEQ ID NO: 114785 - RNA, 24 nt, Human
ccugaagugcugggauuacaggca

SEQ ID NO: 114786 - RNA, 32 nt, Human
ccugaaguguuuauggggagauccuaguggcu

SEQ ID NO: 114787 - RNA, 32 nt, Human
ccugaaguuuuuagcaaggaagcuuccugucu

SEQ ID NO: 114788 - RNA, 32 nt, Human
ccugaauauauacuuguuugucauaguuuccu

SEQ ID NO: 114789 - RNA, 32 nt, Human
ccugaauaucuucucugcucacuuccaccauc

SEQ ID NO: 114790 - RNA, 32 nt, Human
ccugaaucauuucuuauaccuucugacagccc

SEQ ID NO: 114791 - RNA, 32 nt, Human
ccugaauccaggaguucgaagccagccugggc

SEQ ID NO: 114792 - RNA, 32 nt, Human
ccugaauccccucuuggacuccuggcuugcuu

SEQ ID NO: 114793 - RNA, 32 nt, Human
ccugaaucccugggggagacagaaggggcagg

SEQ ID NO: 114794 - RNA, 22 nt, Human
ccugaauccucucuuccuuccc

SEQ ID NO: 114795 - RNA, 32 nt, Human
ccugaaucucuaggauuuugucacuuggaguc

SEQ ID NO: 114796 - RNA, 32 nt, Human
ccugaaucucugcugaggcugccugccugccg

SEQ ID NO: 114797 - RNA, 32 nt, Human
ccugaaucuucuacugaacaucuugcuaugua

SEQ ID NO: 114798 - RNA, 32 nt, Human
ccugaaugaaaguggcgcgccgccccugacgu

SEQ ID NO: 114799 - RNA, 32 nt, Human
ccugaaugagccacagaagcgggacuguggca

SEQ ID NO: 114800 - RNA, 19 nt, Human
ccugaaugaugucacagug

SEQ ID NO: 114801 - RNA, 19 nt, Human
ccugaaugcacuccacagu

SEQ ID NO: 114802 - RNA, 32 nt, Human
ccugaaugccaucacccuccccagggcucugc

SEQ ID NO: 114803 - RNA, 32 nt, Human
ccugaauggucugucauugucugccuuuaaaa

SEQ ID NO: 114804 - RNA, 32 nt, Human
ccugaauguaauucuagcugagugcaaucuag

SEQ ID NO: 114805 - RNA, 32 nt, Human
ccugaauugcagccacacuuggccuucuagaa

SEQ ID NO: 114806 - RNA, 32 nt, Human
ccugaauuggaaaggaaaagaggcccaagugc

SEQ ID NO: 114807 - RNA, 32 nt, Human
ccugaauuuguacaagccacaggaagcuagau

SEQ ID NO: 114808 - RNA, 19 nt, Human
ccugacaaacaacaggugg

SEQ ID NO: 114809 - RNA, 32 nt, Human
ccugacaaagcccccaguuuccuguggcaggu

SEQ ID NO: 114810 - RNA, 32 nt, Human
ccugacaagaaguugauacaagaaaaggaaag

SEQ ID NO: 114811 - RNA, 22 nt, Human
ccugacaaggugcugccgcucg

SEQ ID NO: 114812 - RNA, 32 nt, Human
ccugacaaucuccuuggagucaaagcuccagg

SEQ ID NO: 114813 - RNA, 32 nt, Human
ccugacaauuccagcacucuacgacugauaug

SEQ ID NO: 114814 - RNA, 32 nt, Human
ccugacacaagaaguucuuguucuucaggaga

SEQ ID NO: 114815 - RNA, 32 nt, Human
ccugacacaagucccuguaucugaagucuagc

SEQ ID NO: 114816 - RNA, 23 nt, Human
ccugacacaaucccuacagggug

SEQ ID NO: 114817 - RNA, 32 nt, Human
ccugacacaaugguagcucugaagggagggga

SEQ ID NO: 114818 - RNA, 32 nt, Human
ccugacacacagauaccucacucaucccucca

SEQ ID NO: 114819 - RNA, 32 nt, Human
ccugacacagccccagaccccacaaagccuuc

SEQ ID NO: 114820 - RNA, 32 nt, Human
ccugacaccaaggacagcacuugucaucaucc

SEQ ID NO: 114821 - RNA, 32 nt, Human
ccugacacccaaggcuggauguuugugcuccg

SEQ ID NO: 114822 - RNA, 32 nt, Human
ccugacacccaccaggcggcccccuucggagc

SEQ ID NO: 114823 - RNA, 32 nt, Human
ccugacacccacccagauaaucuuuucaauau

SEQ ID NO: 114824 - RNA, 23 nt, Human
ccugacacccaguacaccggccg

SEQ ID NO: 114825 - RNA, 17 nt, Human
ccugacaccccaccucu

SEQ ID NO: 114826 - RNA, 22 nt, Human
ccugacacccuucuccccuucc

SEQ ID NO: 114827 - RNA, 32 nt, Human
ccugacacccuucuccccuuccugguagaccu

SEQ ID NO: 114828 - RNA, 32 nt, Human
ccugacaccgaccucaaccccaacaagacccu

SEQ ID NO: 114829 - RNA, 32 nt, Human
ccugacaccucugcacucccuugggcagagau

SEQ ID NO: 114830 - RNA, 21 nt, Human
ccugacaccuggaacugugca

SEQ ID NO: 114831 - RNA, 32 nt, Human
ccugacacucaggaaggcccaggcugggcagg

SEQ ID NO: 114832 - RNA, 32 nt, Human
ccugacacugagaaugaacaguaucacaggga

SEQ ID NO: 114833 - RNA, 32 nt, Human
ccugacacugcacgugggcguaguggggagca

SEQ ID NO: 114834 - RNA, 32 nt, Human
ccugacacugcacugagcacuuuaugagcuug

SEQ ID NO: 114835 - RNA, 32 nt, Human
ccugacacuguccccacacaaauagcuggcuu

SEQ ID NO: 114836 - RNA, 32 nt, Human
ccugacagaagcacaaggaacaguuugauaca

SEQ ID NO: 114837 - RNA, 32 nt, Human
ccugacagaauacuucuccucuuccucaccuu

SEQ ID NO: 114838 - RNA, 32 nt, Human
ccugacagagcaccugcuguuuuuaugaagcc

SEQ ID NO: 114839 - RNA, 21 nt, Human
ccugacagaggagcuuacacu

SEQ ID NO: 114840 - RNA, 32 nt, Human
ccugacagcaccugaggccccaugcacgggga

SEQ ID NO: 114841 - RNA, 32 nt, Human
ccugacagcccgggccucucccuccaguaguu

SEQ ID NO: 114842 - RNA, 32 nt, Human
ccugacagccuggcgacguggcgaagaugcac

SEQ ID NO: 114843 - RNA, 32 nt, Human
ccugacagccuggcuagcacaggaggacaugc

SEQ ID NO: 114844 - RNA, 32 nt, Human
ccugacagcugagaaguggcacagaccugcuu

SEQ ID NO: 114845 - RNA, 32 nt, Human
ccugacaggaacaugcuacugaaguuuauuuu

SEQ ID NO: 114846 - RNA, 24 nt, Human
ccugacaggacaaccuaggggcag

SEQ ID NO: 114847 - RNA, 18 nt, Human
ccugacaggaggggucgu

SEQ ID NO: 114848 - RNA, 32 nt, Human
ccugacaggcagcagaggguguggagaccucu

SEQ ID NO: 114849 - RNA, 21 nt, Human
ccugacaggccacaggagcag

SEQ ID NO: 114850 - RNA, 23 nt, Human
ccugacagggcuaggaggacagc

SEQ ID NO: 114851 - RNA, 21 nt, Human
ccugacagucagcacuuggca

SEQ ID NO: 114852 - RNA, 32 nt, Human
ccugacagugaugggacagggaggcuucagug

SEQ ID NO: 114853 - RNA, 32 nt, Human
ccugacagugcucgcugagaacucucaccagg

SEQ ID NO: 114854 - RNA, 21 nt, Human
ccugacaguucaucuuccuuu

SEQ ID NO: 114855 - RNA, 32 nt, Human
ccugacaucacugagaucugaggagcccuaca

SEQ ID NO: 114856 - RNA, 32 nt, Human
ccugacauccagcgacagagacggaagggguc

SEQ ID NO: 114857 - RNA, 18 nt, Human
ccugacaugcguggcaug

SEQ ID NO: 114858 - RNA, 32 nt, Human
ccugacaugucaggaaagcccuaaacugaaug

SEQ ID NO: 114859 - RNA, 32 nt, Human
ccugacauguguuuguauggggcaggcagggu

SEQ ID NO: 114860 - RNA, 32 nt, Human
ccugaccaaaaauaacagcaagcugagcacgc

SEQ ID NO: 114861 - RNA, 32 nt, Human
ccugaccaaauaaauggagaaagcuuccagaa

SEQ ID NO: 114862 - RNA, 19 nt, Human
ccugaccaacauggugaaa

SEQ ID NO: 114863 - RNA, 32 nt, Human
ccugaccaacauggugaaauauacaaaaauac

SEQ ID NO: 114864 - RNA, 32 nt, Human
ccugaccaacauggugagacccugucucuacu

SEQ ID NO: 114865 - RNA, 32 nt, Human
ccugaccaacucggacgccugggaagccuggu

SEQ ID NO: 114866 - RNA, 24 nt, Human
ccugaccaauauggugaaacccca

SEQ ID NO: 114867 - RNA, 21 nt, Human
ccugaccaauauggugaaagc

SEQ ID NO: 114868 - RNA, 32 nt, Human
ccugaccaaucacuguggccaggaggaugaua

SEQ ID NO: 114869 - RNA, 32 nt, Human
ccugaccacaaaggacuacauggagauguaca

SEQ ID NO: 114870 - RNA, 20 nt, Human
ccugaccacacgcccccaca

SEQ ID NO: 114871 - RNA, 32 nt, Human
ccugaccacauugccauaucugaaauggcugg

SEQ ID NO: 114872 - RNA, 32 nt, Human
ccugaccacccuccaucagcagucuccccucc

SEQ ID NO: 114873 - RNA, 17 nt, Human
ccugaccaccgcugccg

SEQ ID NO: 114874 - RNA, 32 nt, Human
ccugaccaccucugguucuccagcuccggucc

SEQ ID NO: 114875 - RNA, 20 nt, Human
ccugaccagagugacacugc

SEQ ID NO: 114876 - RNA, 32 nt, Human
ccugaccagcacuccugggcacucuggaagca

SEQ ID NO: 114877 - RNA, 32 nt, Human
ccugaccagccuggcccacccugcuccaccca

SEQ ID NO: 114878 - RNA, 32 nt, Human
ccugaccaucuucuccucccagggccacagcu

SEQ ID NO: 114879 - RNA, 32 nt, Human
ccugaccaugaagacggcggaggccaggagac

SEQ ID NO: 114880 - RNA, 32 nt, Human
ccugaccaugaggaguacagcagaaggugcuc

SEQ ID NO: 114881 - RNA, 32 nt, Human
ccugaccauggcccaacagcaaacaaaugaug

SEQ ID NO: 114882 - RNA, 21 nt, Human
ccugacccagaggaagccucu

SEQ ID NO: 114883 - RNA, 32 nt, Human
ccugacccagcauccucugccuucuaggaagu

SEQ ID NO: 114884 - RNA, 32 nt, Human
ccugacccagccaguccagcucugccuugccg

SEQ ID NO: 114885 - RNA, 21 nt, Human
ccugacccaggcucugugagg

SEQ ID NO: 114886 - RNA, 32 nt, Human
ccugaccccaauccccaaccucccaggacugu

SEQ ID NO: 114887 - RNA, 32 nt, Human
ccugaccccacacacucucugccaugcacaca

SEQ ID NO: 114888 - RNA, 28 nt, Human
ccugaccccagugcugcucuaagcaccg

SEQ ID NO: 114889 - RNA, 20 nt, Human
ccugaccccccucccuuccc

SEQ ID NO: 114890 - RNA, 32 nt, Human
ccugaccccucagcaagaacagccugccuggu

SEQ ID NO: 114891 - RNA, 32 nt, Human
ccugaccccucaugcucucuggcugggccagu

SEQ ID NO: 114892 - RNA, 22 nt, Human
ccugaccccuccccgcggggua

SEQ ID NO: 114893 - RNA, 32 nt, Human
ccugaccccugagagcugccccgugcugccuu

SEQ ID NO: 114894 - RNA, 32 nt, Human
ccugaccccugcccugggccuuaacacacauc

SEQ ID NO: 114895 - RNA, 32 nt, Human
ccugaccccuggguucugaggcugccaggguc

SEQ ID NO: 114896 - RNA, 18 nt, Human
ccugacccgcaaugggca

SEQ ID NO: 114897 - RNA, 32 nt, Human
ccugacccucaagugaucugcccaccuuggcc

SEQ ID NO: 114898 - RNA, 32 nt, Human
ccugacccucagucuccauucucccuccuacc

SEQ ID NO: 114899 - RNA, 32 nt, Human
ccugacccucaugauccacccaccucggccuc

SEQ ID NO: 114900 - RNA, 32 nt, Human
ccugacccucccacucccaucuccuuaccucu

SEQ ID NO: 114901 - RNA, 23 nt, Human
ccugacccucggccagcagggug

SEQ ID NO: 114902 - RNA, 32 nt, Human
ccugacccuuuagaaucauccccagccagacg

SEQ ID NO: 114903 - RNA, 32 nt, Human
ccugaccgacccgggccgcaucccugagcaag

SEQ ID NO: 114904 - RNA, 32 nt, Human
ccugaccgcccagcuccgccaggauuugcaga

SEQ ID NO: 114905 - RNA, 32 nt, Human
ccugaccgcuugaagccagaaguggccccucu

SEQ ID NO: 114906 - RNA, 32 nt, Human
ccugaccggggacuuccaggcauccccuggca

SEQ ID NO: 114907 - RNA, 32 nt, Human
ccugaccgugugcccagaucugugccaggcac

SEQ ID NO: 114908 - RNA, 32 nt, Human
ccugaccuaccuggccccugagcucuggagca

SEQ ID NO: 114909 - RNA, 18 nt, Human
ccugaccuagccauggca

SEQ ID NO: 114910 - RNA, 18 nt, Human
ccugaccuaggcuaggca

SEQ ID NO: 114911 - RNA, 18 nt, Human
ccugaccuaggugaucca

SEQ ID NO: 114912 - RNA, 32 nt, Human
ccugaccucaagaagcucagagucuaguacug

SEQ ID NO: 114913 - RNA, 32 nt, Human
ccugaccucaagcccauguggagagggccaac

SEQ ID NO: 114914 - RNA, 32 nt, Human
ccugaccucaagugauauguucaccucagccu

SEQ ID NO: 114915 - RNA, 19 nt, Human
ccugaccucacgcuggggc

SEQ ID NO: 114916 - RNA, 32 nt, Human
ccugaccucacugccugccuccucuaccccag

SEQ ID NO: 114917 - RNA, 18 nt, Human
ccugaccucagaggugca

SEQ ID NO: 114918 - RNA, 32 nt, Human
ccugaccucagcucagcuuuuguagauccuua

SEQ ID NO: 114919 - RNA, 18 nt, Human
ccugaccucaggugaucc

SEQ ID NO: 114920 - RNA, 19 nt, Human
ccugaccucaggugaucca

SEQ ID NO: 114921 - RNA, 22 nt, Human
ccugaccucaucuuccaccuca

SEQ ID NO: 114922 - RNA, 32 nt, Human
ccugaccuccacugacaucuacgacccgcccu

SEQ ID NO: 114923 - RNA, 32 nt, Human
ccugaccuccccgcggggagggugggugccgu

SEQ ID NO: 114924 - RNA, 32 nt, Human
ccugaccuccuugcuuuugcuugcagagccgc

SEQ ID NO: 114925 - RNA, 32 nt, Human
ccugaccucgugauuugccugccugggccucc

SEQ ID NO: 114926 - RNA, 32 nt, Human
ccugaccucguggaucugcccaccucggccuc

SEQ ID NO: 114927 - RNA, 32 nt, Human
ccugaccucucaccugcgccaggcugguacau

SEQ ID NO: 114928 - RNA, 32 nt, Human
ccugaccucucagaccaaacugauuccaggga

SEQ ID NO: 114929 - RNA, 19 nt, Human
ccugaccucuugcagggca

SEQ ID NO: 114930 - RNA, 18 nt, Human
ccugaccugagcuggggc

SEQ ID NO: 114931 - RNA, 32 nt, Human
ccugaccugaugaccagcucugugugaaacuc

SEQ ID NO: 114932 - RNA, 32 nt, Human
ccugaccugcaccagguggcaccaaggguccu

SEQ ID NO: 114933 - RNA, 32 nt, Human
ccugaccugcagcuuacacggccgugcugacu

SEQ ID NO: 114934 - RNA, 19 nt, Human
ccugaccugcaugcgggca

SEQ ID NO: 114935 - RNA, 32 nt, Human
ccugaccugccuggcuuccuuagcuugccccu

SEQ ID NO: 114936 - RNA, 32 nt, Human
ccugaccugccugggucucccugucucuccag

SEQ ID NO: 114937 - RNA, 32 nt, Human
ccugaccugcucccugcuccgugucuguccua

SEQ ID NO: 114938 - RNA, 19 nt, Human
ccugaccuggagaggggca

SEQ ID NO: 114939 - RNA, 32 nt, Human
ccugaccuggcugcugcucuugcuucagagcc

SEQ ID NO: 114940 - RNA, 32 nt, Human
ccugaccugguaagcugccacacaccuggcag

SEQ ID NO: 114941 - RNA, 32 nt, Human
ccugaccugucugcaccugugugacagccccu

SEQ ID NO: 114942 - RNA, 19 nt, Human
ccugaccuuagguucggca

SEQ ID NO: 114943 - RNA, 32 nt, Human
ccugaccuucacaccugcuccccagagaagcc

SEQ ID NO: 114944 - RNA, 18 nt, Human
ccugaccuucacgaaggg

SEQ ID NO: 114945 - RNA, 32 nt, Human
ccugaccuuccaggggccgaggugcugcuguc

SEQ ID NO: 114946 - RNA, 32 nt, Human
ccugaccuuccucuauccccugcccauccucc

SEQ ID NO: 114947 - RNA, 18 nt, Human
ccugaccuugagcccuca

SEQ ID NO: 114948 - RNA, 32 nt, Human
ccugaccuugucugacccuugugccucuaaac

SEQ ID NO: 114949 - RNA, 32 nt, Human
ccugacgagggcacucugagauagcacugcuc

SEQ ID NO: 114950 - RNA, 20 nt, Human
ccugacgagggugggcgcgg

SEQ ID NO: 114951 - RNA, 32 nt, Human
ccugacgagggugggcgcggagggagcagccg

SEQ ID NO: 114952 - RNA, 32 nt, Human
ccugacgggcccugucuucagguucuagaaac

SEQ ID NO: 114953 - RNA, 19 nt, Human
ccugacgucaggugaucca

SEQ ID NO: 114954 - RNA, 32 nt, Human
ccugacguuggccuuuucacuacaggcacccg

SEQ ID NO: 114955 - RNA, 32 nt, Human
ccugacuaaggccucagacuagggcgggaggg

SEQ ID NO: 114956 - RNA, 32 nt, Human
ccugacuagaccccacccugagguccugcauu

SEQ ID NO: 114957 - RNA, 32 nt, Human
ccugacuaugaauucaacguguggacccgacc

SEQ ID NO: 114958 - RNA, 32 nt, Human
ccugacuauggcccaacagcaaacaaaugaug

SEQ ID NO: 114959 - RNA, 21 nt, Human
ccugacucaaccuggcuacug

SEQ ID NO: 114960 - RNA, 32 nt, Human
ccugacucaccauacauuaagaaaaaucagga

SEQ ID NO: 114961 - RNA, 32 nt, Human
ccugacucacugcucuuugcuguugccugagg

SEQ ID NO: 114962 - RNA, 32 nt, Human
ccugacucacuguuuucccuuccacagucccc

SEQ ID NO: 114963 - RNA, 32 nt, Human
ccugacucagcugaaccuggauccugugcaua

SEQ ID NO: 114964 - RNA, 32 nt, Human
ccugacucagugaaggaagcuguugggauaca

SEQ ID NO: 114965 - RNA, 32 nt, Human
ccugacucauacccuucuugcuucagacucca

SEQ ID NO: 114966 - RNA, 32 nt, Human
ccugacucaucgggggcuccgggucacaugcg

SEQ ID NO: 114967 - RNA, 32 nt, Human
ccugacuccaaagccugugcucuuaaccacua

SEQ ID NO: 114968 - RNA, 32 nt, Human
ccugacuccaucucccugcaccagccuugcaa

SEQ ID NO: 114969 - RNA, 32 nt, Human
ccugacuccaugggaccccaaagaagcagaug

SEQ ID NO: 114970 - RNA, 32 nt, Human
ccugacucggccugccccagccucugcuucac

SEQ ID NO: 114971 - RNA, 32 nt, Human
ccugacucucaccucugugcccccagcuuccg

SEQ ID NO: 114972 - RNA, 32 nt, Human
ccugacucucccugaauagcaucugaagucuu

SEQ ID NO: 114973 - RNA, 32 nt, Human
ccugacucuccucucuugccugacucuagaca

SEQ ID NO: 114974 - RNA, 32 nt, Human
ccugacucuccugaauuacuagaaugucagca

SEQ ID NO: 114975 - RNA, 32 nt, Human
ccugacucucuccugauggugggcccucugug

SEQ ID NO: 114976 - RNA, 32 nt, Human
ccugacucuuccagccuccauguccagaccua

SEQ ID NO: 114977 - RNA, 32 nt, Human
ccugacucuuccccauaaucacugaccagccu

SEQ ID NO: 114978 - RNA, 32 nt, Human
ccugacucuucugucucuugaggucccuugaa

SEQ ID NO: 114979 - RNA, 32 nt, Human
ccugacugaagagagccuguggccauguaaaa

SEQ ID NO: 114980 - RNA, 32 nt, Human
ccugacugcaaaccucuggccuggaaccgauu

SEQ ID NO: 114981 - RNA, 32 nt, Human
ccugacugcacuccagccuggguggcaaagca

SEQ ID NO: 114982 - RNA, 20 nt, Human
ccugacugcaggaggcacag

SEQ ID NO: 114983 - RNA, 21 nt, Human
ccugacugccaccucggggcu

SEQ ID NO: 114984 - RNA, 31 nt, Human
ccugacugccucuuggguugucaaaacccaa

SEQ ID NO: 114985 - RNA, 22 nt, Human
ccugacugcuguccccuaccca

SEQ ID NO: 114986 - RNA, 32 nt, Human
ccugacugcuuucuccaacuguucacagcaaa

SEQ ID NO: 114987 - RNA, 32 nt, Human
ccugacuggagcaccuucuaaaucuaagauuc

SEQ ID NO: 114988 - RNA, 32 nt, Human
ccugacuggccaaacccuugcuuuccugggcc

SEQ ID NO: 114989 - RNA, 22 nt, Human
ccugacugggaguccccugcca

SEQ ID NO: 114990 - RNA, 32 nt, Human
ccugacugggggugagggagaaggaggagaga

SEQ ID NO: 114991 - RNA, 32 nt, Human
ccugacuguaccauuuauaaacagcuucacuu

SEQ ID NO: 114992 - RNA, 32 nt, Human
ccugacuguccuaugggcuucuccagugucca

SEQ ID NO: 114993 - RNA, 32 nt, Human
ccugacugugagagaagcccugcuggauggug

SEQ ID NO: 114994 - RNA, 32 nt, Human
ccugacuguggaaaauaagucgcuguuugguu

SEQ ID NO: 114995 - RNA, 32 nt, Human
ccugacuguguucagugccuuggagcagaaag

SEQ ID NO: 114996 - RNA, 32 nt, Human
ccugacuuaagaguuuucaagaugucaaacuu

SEQ ID NO: 114997 - RNA, 32 nt, Human
ccugacuuagaagaagugggugguggcagccu

SEQ ID NO: 114998 - RNA, 19 nt, Human
ccugacuucaggcuuuccu

SEQ ID NO: 114999 - RNA, 32 nt, Human
ccugacuucauccucccuucucuguccacacc

SEQ ID NO: 115000 - RNA, 32 nt, Human
ccugacuuccaaaaucagugccuuuggauuca

SEQ ID NO: 115001 - RNA, 16 nt, Human
ccugacuuccaccucu

SEQ ID NO: 115002 - RNA, 32 nt, Human
ccugacuucucccagccucgagaauugauaac

SEQ ID NO: 115003 - RNA, 32 nt, Human
ccugacuugaacucugggugacccugggcacc

SEQ ID NO: 115004 - RNA, 32 nt, Human
ccugacuugggcuagugggcagaggaaugccu

SEQ ID NO: 115005 - RNA, 24 nt, Human
ccugacuugugauccgccugccuc

SEQ ID NO: 115006 - RNA, 32 nt, Human
ccugacuuguucuccccuuccuugggaagggc

SEQ ID NO: 115007 - RNA, 32 nt, Human
ccugacuuuaccccuuucaagccugggguugu

SEQ ID NO: 115008 - RNA, 32 nt, Human
ccugacuuucuagccauuaauaaagagaacug

SEQ ID NO: 115009 - RNA, 20 nt, Human
ccugagaaaaauaaaaucag

SEQ ID NO: 115010 - RNA, 21 nt, Human
ccugagaaacaguucagcagu

SEQ ID NO: 115011 - RNA, 23 nt, Human
ccugagaaagggaggagagacag

SEQ ID NO: 115012 - RNA, 18 nt, Human
ccugagaacaauggugug

SEQ ID NO: 115013 - RNA, 21 nt, Human
ccugagaacacaaacauuugg

SEQ ID NO: 115014 - RNA, 32 nt, Human
ccugagaacagcuuuagucauggaauacuggg

SEQ ID NO: 115015 - RNA, 32 nt, Human
ccugagaaccugcuggugugggauggugcugc

SEQ ID NO: 115016 - RNA, 32 nt, Human
ccugagaaccuuccaaaaacccgcccgaauuc

SEQ ID NO: 115017 - RNA, 19 nt, Human
ccugagaacuaauauguua

SEQ ID NO: 115018 - RNA, 32 nt, Human
ccugagaacucuccaccugcaggaugagccgg

SEQ ID NO: 115019 - RNA, 32 nt, Human
ccugagaacuggccuccagccgguguccucau

SEQ ID NO: 115020 - RNA, 22 nt, Human
ccugagaagaccaagauaucag

SEQ ID NO: 115021 - RNA, 32 nt, Human
ccugagaagccagacuuccacuguggaagagc

SEQ ID NO: 115022 - RNA, 24 nt, Human
ccugagaagcccgugagaaacgug

SEQ ID NO: 115023 - RNA, 20 nt, Human
ccugagaagggcaggaucag

SEQ ID NO: 115024 - RNA, 32 nt, Human
ccugagaagggccugauuugcagcaucaugau

SEQ ID NO: 115025 - RNA, 32 nt, Human
ccugagaagggccugggcuacaacccugggca

SEQ ID NO: 115026 - RNA, 21 nt, Human
ccugagaaggggauggaugag

SEQ ID NO: 115027 - RNA, 22 nt, Human
ccugagaagggggacaaagcag

SEQ ID NO: 115028 - RNA, 24 nt, Human
ccugagaaguggagguugugguga

SEQ ID NO: 115029 - RNA, 23 nt, Human
ccugagaaucccagcuacucaga

SEQ ID NO: 115030 - RNA, 32 nt, Human
ccugagaauggagaaggagaagcuacaaagug

SEQ ID NO: 115031 - RNA, 32 nt, Human
ccugagaaugucccguuuucgaggcugcagua

SEQ ID NO: 115032 - RNA, 18 nt, Human
ccugagaauguuucugca

SEQ ID NO: 115033 - RNA, 32 nt, Human
ccugagaauuacaaugaauaauaauuugcuuu

SEQ ID NO: 115034 - RNA, 32 nt, Human
ccugagacacucaccucucugccucgcaguug

SEQ ID NO: 115035 - RNA, 32 nt, Human
ccugagacagaggcagcagugauacccaccug

SEQ ID NO: 115036 - RNA, 32 nt, Human
ccugagacauacgcucgugacacugccccacc

SEQ ID NO: 115037 - RNA, 32 nt, Human
ccugagaccaccgacauccucagguuccugac

SEQ ID NO: 115038 - RNA, 32 nt, Human
ccugagaccagcuugggcaacaugguggagcc

SEQ ID NO: 115039 - RNA, 32 nt, Human
ccugagaccaggagguugaggcugcagugagc

SEQ ID NO: 115040 - RNA, 21 nt, Human
ccugagacccagccacugccu

SEQ ID NO: 115041 - RNA, 32 nt, Human
ccugagacccagccaggcugggccuagcucca

SEQ ID NO: 115042 - RNA, 32 nt, Human
ccugagaccccacccugcccccaaacuggcua

SEQ ID NO: 115043 - RNA, 32 nt, Human
ccugagacccuugugcuaagucaagaggcuca

SEQ ID NO: 115044 - RNA, 32 nt, Human
ccugagacucgcuugaacccagggggcggagc

SEQ ID NO: 115045 - RNA, 32 nt, Human
ccugagacuuaauguaaccacuuaauguaauc

SEQ ID NO: 115046 - RNA, 32 nt, Human
ccugagagaccagugagcucacugugacccau

SEQ ID NO: 115047 - RNA, 32 nt, Human
ccugagagagcaccuucuuaucacagaaagug

SEQ ID NO: 115048 - RNA, 32 nt, Human
ccugagagagcugagggacaugaagaggagau

SEQ ID NO: 115049 - RNA, 32 nt, Human
ccugagagaggaggggaggaagcuugauacug

SEQ ID NO: 115050 - RNA, 32 nt, Human
ccugagagagugaggacaggcugcgggaggag

SEQ ID NO: 115051 - RNA, 22 nt, Human
ccugagagaucaucuucacuuu

SEQ ID NO: 115052 - RNA, 32 nt, Human
ccugagagcagcagaucucagccagaugcugc

SEQ ID NO: 115053 - RNA, 23 nt, Human
ccugagagcugggacuacaggcg

SEQ ID NO: 115054 - RNA, 32 nt, Human
ccugagagcuggucugcguuucccaggcgcgg

SEQ ID NO: 115055 - RNA, 32 nt, Human
ccugagaggcaccagccccaauccuguccgug

SEQ ID NO: 115056 - RNA, 24 nt, Human
ccugagaggcagagguuacaguga

SEQ ID NO: 115057 - RNA, 24 nt, Human
ccugagaggcagagguugcaguga

SEQ ID NO: 115058 - RNA, 32 nt, Human
ccugagaggcagagguugcagugagccaagau

SEQ ID NO: 115059 - RNA, 32 nt, Human
ccugagaggcagagguugcagugagccgagag

SEQ ID NO: 115060 - RNA, 32 nt, Human
ccugagaggcagagguugcagugagccgaggu

SEQ ID NO: 115061 - RNA, 23 nt, Human
ccugagaggcggagguugcagug

SEQ ID NO: 115062 - RNA, 24 nt, Human
ccugagaggcggagguugcaguga

SEQ ID NO: 115063 - RNA, 32 nt, Human
ccugagaggcggagguugcagugagccaaaau

SEQ ID NO: 115064 - RNA, 32 nt, Human
ccugagaggcggagguugcagugagccaagau

SEQ ID NO: 115065 - RNA, 32 nt, Human
ccugagaggcggagguugcagugagccgagau

SEQ ID NO: 115066 - RNA, 32 nt, Human
ccugagaggcucccuuccccaguccugccaga

SEQ ID NO: 115067 - RNA, 32 nt, Human
ccugagaggcuggaggcguuggugcugaaggc

SEQ ID NO: 115068 - RNA, 32 nt, Human
ccugagaggggcugcuggcugaauuagguuag

SEQ ID NO: 115069 - RNA, 23 nt, Human
ccugagaggugagguugcaguga

SEQ ID NO: 115070 - RNA, 24 nt, Human
ccugagagguggagguuacaguga

SEQ ID NO: 115071 - RNA, 22 nt, Human
ccugagagguggagguugcagu

SEQ ID NO: 115072 - RNA, 23 nt, Human
ccugagagguggagguugcagug

SEQ ID NO: 115073 - RNA, 24 nt, Human
ccugagagguggagguugcaguga

SEQ ID NO: 115074 - RNA, 32 nt, Human
ccugagagguggagguugcagugagccgagau

SEQ ID NO: 115075 - RNA, 24 nt, Human
ccugagagguggagguuucaguga

SEQ ID NO: 115076 - RNA, 32 nt, Human
ccugagagguggagguuucagugagccgagau

SEQ ID NO: 115077 - RNA, 31 nt, Human
ccugagagguguuuaggcacagcagagggga

SEQ ID NO: 115078 - RNA, 32 nt, Human
ccugagagguugccuuuccuuuuccucuccca

SEQ ID NO: 115079 - RNA, 32 nt, Human
ccugagaguaagcagaccuggguuggaagguc

SEQ ID NO: 115080 - RNA, 32 nt, Human
ccugagaguccccucccuucucccacacucgu

SEQ ID NO: 115081 - RNA, 22 nt, Human
ccugagaguccccugggucuaa

SEQ ID NO: 115082 - RNA, 32 nt, Human
ccugagaguguguguugguggcugugcgcacg

SEQ ID NO: 115083 - RNA, 32 nt, Human
ccugagauaagaaacauaguuuuauacauuau

SEQ ID NO: 115084 - RNA, 32 nt, Human
ccugagaucacgucuccuacugugucgucauu

SEQ ID NO: 115085 - RNA, 32 nt, Human
ccugagauccugggucgugaccagccuggcuu

SEQ ID NO: 115086 - RNA, 32 nt, Human
ccugagaucugcacagucagaaggacggcagg

SEQ ID NO: 115087 - RNA, 32 nt, Human
ccugagaucuggguuuaacgaucugggcuuug

SEQ ID NO: 115088 - RNA, 32 nt, Human
ccugagaucuugguagaggaggccccuccugc

SEQ ID NO: 115089 - RNA, 25 nt, Human
ccugagaugaggauuuaaggaucag

SEQ ID NO: 115090 - RNA, 32 nt, Human
ccugagaugauaccugaccaccacuucuggga

SEQ ID NO: 115091 - RNA, 32 nt, Human
ccugagaugaugccuucuuugauauucucuua

SEQ ID NO: 115092 - RNA, 32 nt, Human
ccugagaugcaaacuggaguucugguaccaga

SEQ ID NO: 115093 - RNA, 32 nt, Human
ccugagaugcaaccucaagucuuaggaaaaga

SEQ ID NO: 115094 - RNA, 32 nt, Human
ccugagcaaauucccucaaagugaacucuugu

SEQ ID NO: 115095 - RNA, 32 nt, Human
ccugagcaacacagcaagaccuugucucuacg

SEQ ID NO: 115096 - RNA, 32 nt, Human
ccugagcaacagagugagacccugucucuuaa

SEQ ID NO: 115097 - RNA, 32 nt, Human
ccugagcaacauaacaagacccugucucaaau

SEQ ID NO: 115098 - RNA, 31 nt, Human
ccugagcaacauaaugagacccugucucuac

SEQ ID NO: 115099 - RNA, 32 nt, Human
ccugagcaacauagugagacccugucucaaac

SEQ ID NO: 115100 - RNA, 32 nt, Human
ccugagcaacauagugagacccugucucaaua

SEQ ID NO: 115101 - RNA, 32 nt, Human
ccugagcaacaucucgggaguccucuagcagg

SEQ ID NO: 115102 - RNA, 32 nt, Human
ccugagcaagaaugugcuguggcagagggggu

SEQ ID NO: 115103 - RNA, 32 nt, Human
ccugagcaagucagaaguuacucucaucaguc

SEQ ID NO: 115104 - RNA, 32 nt, Human
ccugagcaagucccggcccugcccucagcgag

SEQ ID NO: 115105 - RNA, 32 nt, Human
ccugagcaauugagcaucugugccucaggacu

SEQ ID NO: 115106 - RNA, 32 nt, Human
ccugagcacaggaguuggaggcugcaguaagc

SEQ ID NO: 115107 - RNA, 32 nt, Human
ccugagcacauggugcccaacuguagcccuuc

SEQ ID NO: 115108 - RNA, 32 nt, Human
ccugagcaccaaagucgcagggccaguugcag

SEQ ID NO: 115109 - RNA, 21 nt, Human
ccugagcaccuaucgcgggga

SEQ ID NO: 115110 - RNA, 32 nt, Human
ccugagcaccucccagccccugccccucaugc

SEQ ID NO: 115111 - RNA, 23 nt, Human
ccugagcaccuuucuccccuccc

SEQ ID NO: 115112 - RNA, 32 nt, Human
ccugagcacuacggacagggaggcaggugcca

SEQ ID NO: 115113 - RNA, 32 nt, Human
ccugagcacucaccaggugagaugucuagggu

SEQ ID NO: 115114 - RNA, 32 nt, Human
ccugagcagaaaacaggaagaaccaggcucgg

SEQ ID NO: 115115 - RNA, 18 nt, Human
ccugagcagagcaugugg

SEQ ID NO: 115116 - RNA, 21 nt, Human
ccugagcagaggcgggugugg

SEQ ID NO: 115117 - RNA, 24 nt, Human
ccugagcagccucucaccacugcc

SEQ ID NO: 115118 - RNA, 23 nt, Human
ccugagcagcucagagucaggaa

SEQ ID NO: 115119 - RNA, 32 nt, Human
ccugagcagcuggccccagcugugaucaucca

SEQ ID NO: 115120 - RNA, 32 nt, Human
ccugagcaggaagacuccuuccccacuucugu

SEQ ID NO: 115121 - RNA, 32 nt, Human
ccugagcaggcaaggagcucuugcauuugcug

SEQ ID NO: 115122 - RNA, 23 nt, Human
ccugagcaggcacccacuucccu

SEQ ID NO: 115123 - RNA, 19 nt, Human
ccugagcaggugggcgugg

SEQ ID NO: 115124 - RNA, 32 nt, Human
ccugagcauaagaacugggauugcaggcguga

SEQ ID NO: 115125 - RNA, 32 nt, Human
ccugagcaucucuccuuccucucccagaucgu

SEQ ID NO: 115126 - RNA, 32 nt, Human
ccugagcaugggaggcagagguugcagugagc

SEQ ID NO: 115127 - RNA, 32 nt, Human
ccugagccaaguucucuggcacuugcuggaca

SEQ ID NO: 115128 - RNA, 22 nt, Human
ccugagccaccgcgcccagcca

SEQ ID NO: 115129 - RNA, 32 nt, Human
ccugagccaccucagggauacaggguccccca

SEQ ID NO: 115130 - RNA, 32 nt, Human
ccugagccaccugaaacucagcauaucuacga

SEQ ID NO: 115131 - RNA, 32 nt, Human
ccugagccacucacagcacgaccagagaacag

SEQ ID NO: 115132 - RNA, 32 nt, Human
ccugagccacugccaacauuucccuucuucca

SEQ ID NO: 115133 - RNA, 19 nt, Human
ccugagccaggacaugugg

SEQ ID NO: 115134 - RNA, 32 nt, Human
ccugagccagggucacccuuguggggccugga

SEQ ID NO: 115135 - RNA, 32 nt, Human
ccugagccauuugaggaggaccaggcauccaa

SEQ ID NO: 115136 - RNA, 32 nt, Human
ccugagcccacaaggacauuccugccugggga

SEQ ID NO: 115137 - RNA, 26 nt, Human
ccugagcccaccgugccuggccuuuc

SEQ ID NO: 115138 - RNA, 32 nt, Human
ccugagcccagccugggggccagagcacccca

SEQ ID NO: 115139 - RNA, 32 nt, Human
ccugagcccaggaagcagagauuccagugagu

SEQ ID NO: 115140 - RNA, 32 nt, Human
ccugagcccaggagcagaggacccaguuguua

SEQ ID NO: 115141 - RNA, 32 nt, Human
ccugagcccaggagcucaagauugcagugagc

SEQ ID NO: 115142 - RNA, 32 nt, Human
ccugagcccaggagcugagucaccuccuccac

SEQ ID NO: 115143 - RNA, 32 nt, Human
ccugagcccaggaggucaagacugcagugagc

SEQ ID NO: 115144 - RNA, 32 nt, Human
ccugagcccaggaggucaaggcuacagugagc

SEQ ID NO: 115145 - RNA, 32 nt, Human
ccugagcccaggagguggaaacugcagagagu

SEQ ID NO: 115146 - RNA, 32 nt, Human
ccugagcccaggagguggaggcugcagugagc

SEQ ID NO: 115147 - RNA, 32 nt, Human
ccugagcccaggagguggagguugcacugagc

SEQ ID NO: 115148 - RNA, 32 nt, Human
ccugagcccaggagguggagguugcagugagc

SEQ ID NO: 115149 - RNA, 32 nt, Human
ccugagcccaggaguucaagaccagcuugugc

SEQ ID NO: 115150 - RNA, 32 nt, Human
ccugagcccaggaguucgagaccagccugggc

SEQ ID NO: 115151 - RNA, 32 nt, Human
ccugagcccaggaguuugagaccagucuaagc

SEQ ID NO: 115152 - RNA, 32 nt, Human
ccugagcccaggaguuugagacuacaguagcu

SEQ ID NO: 115153 - RNA, 32 nt, Human
ccugagcccaggaguuugaggguggagugagc

SEQ ID NO: 115154 - RNA, 32 nt, Human
ccugagcccaggaguuuggaccagccugggca

SEQ ID NO: 115155 - RNA, 32 nt, Human
ccugagcccagggaaguugaggcugcugugag

SEQ ID NO: 115156 - RNA, 32 nt, Human
ccugagcccagggaggucaaggcugcagugag

SEQ ID NO: 115157 - RNA, 30 nt, Human
ccugagcccaugagaucagaaagacacagg

SEQ ID NO: 115158 - RNA, 32 nt, Human
ccugagccccacagcaagucugccaugggccg

SEQ ID NO: 115159 - RNA, 20 nt, Human
ccugagccccaccuccucca

SEQ ID NO: 115160 - RNA, 23 nt, Human
ccugagccccagggaccccucac

SEQ ID NO: 115161 - RNA, 32 nt, Human
ccugagccccaggucucuucagucugggcaca

SEQ ID NO: 115162 - RNA, 21 nt, Human
ccugagccccccucccuuccc

SEQ ID NO: 115163 - RNA, 32 nt, Human
ccugagcccccugaguucccaaagggagggug

SEQ ID NO: 115164 - RNA, 32 nt, Human
ccugagccccucaucugaucccccucucuuuc

SEQ ID NO: 115165 - RNA, 32 nt, Human
ccugagccccucucugcugccagacacccccu

SEQ ID NO: 115166 - RNA, 32 nt, Human
ccugagccccuugguugacccugcacucgucc

SEQ ID NO: 115167 - RNA, 32 nt, Human
ccugagcccgggcucaucagccgccuuccugg

SEQ ID NO: 115168 - RNA, 18 nt, Human
ccugagcccucccaggga

SEQ ID NO: 115169 - RNA, 32 nt, Human
ccugagcccucccagggacccuccacgaccag

SEQ ID NO: 115170 - RNA, 20 nt, Human
ccugagcccucuucucucca

SEQ ID NO: 115171 - RNA, 32 nt, Human
ccugagcccugccuaugcucaaagccagcagg

SEQ ID NO: 115172 - RNA, 32 nt, Human
ccugagcccugccucggcugccucaggggaga

SEQ ID NO: 115173 - RNA, 32 nt, Human
ccugagcccugcggaaccucggcgcucggccc

SEQ ID NO: 115174 - RNA, 32 nt, Human
ccugagcccuggaggcugggccugcccacucc

SEQ ID NO: 115175 - RNA, 32 nt, Human
ccugagcccuguccaagguucccucuugucag

SEQ ID NO: 115176 - RNA, 19 nt, Human
ccugagcccuucccuuccc

SEQ ID NO: 115177 - RNA, 18 nt, Human
ccugagccgccgccgccg

SEQ ID NO: 115178 - RNA, 20 nt, Human
ccugagccgccucauggcca

SEQ ID NO: 115179 - RNA, 32 nt, Human
ccugagccgggaaccaucucccaggaccuugc

SEQ ID NO: 115180 - RNA, 32 nt, Human
ccugagccuaggaguuuaaaccagccugggca

SEQ ID NO: 115181 - RNA, 32 nt, Human
ccugagccuauagagcccccaggagacuggga

SEQ ID NO: 115182 - RNA, 32 nt, Human
ccugagccuauuuauucucuagcuugcuuuaa

SEQ ID NO: 115183 - RNA, 32 nt, Human
ccugagccucacugccaccuaggcagggugau

SEQ ID NO: 115184 - RNA, 32 nt, Human
ccugagccucagaaaagagagaacagggagag

SEQ ID NO: 115185 - RNA, 32 nt, Human
ccugagccuccccaaaggcagcuccuggggac

SEQ ID NO: 115186 - RNA, 32 nt, Human
ccugagccuccucugcugagccagcccgugcg

SEQ ID NO: 115187 - RNA, 20 nt, Human
ccugagccucgagcugcucu

SEQ ID NO: 115188 - RNA, 32 nt, Human
ccugagccucucucccugugucucuguauccc

SEQ ID NO: 115189 - RNA, 32 nt, Human
ccugagccucugaaagugaacuccccgaccag

SEQ ID NO: 115190 - RNA, 32 nt, Human
ccugagccugcucucugaucagcuggaucccc

SEQ ID NO: 115191 - RNA, 32 nt, Human
ccugagccuggagauguagaggcugcaaugag

SEQ ID NO: 115192 - RNA, 32 nt, Human
ccugagccuggagauguagaggcugcagugag

SEQ ID NO: 115193 - RNA, 32 nt, Human
ccugagccuggccaggacucaggcuguuccug

SEQ ID NO: 115194 - RNA, 32 nt, Human
ccugagccugggaaguggaaguugcagugagc

SEQ ID NO: 115195 - RNA, 32 nt, Human
ccugagccugggaaguggagguugcaguaggc

SEQ ID NO: 115196 - RNA, 32 nt, Human
ccugagccugggaggucgaggcugcagcgagc

SEQ ID NO: 115197 - RNA, 32 nt, Human
ccugagccugguaggcugaggcugcagugagc

SEQ ID NO: 115198 - RNA, 32 nt, Human
ccugagccuguggcugcccucuccccagccug

SEQ ID NO: 115199 - RNA, 32 nt, Human
ccugagccuuaggugagacugcagccucugcu

SEQ ID NO: 115200 - RNA, 32 nt, Human
ccugagccuucccacuuuauccuucacaaaca

SEQ ID NO: 115201 - RNA, 32 nt, Human
ccugagccuuucucccaaguuccagagccucu

SEQ ID NO: 115202 - RNA, 32 nt, Human
ccugagcgccgcucccucucaggaugaaggug

SEQ ID NO: 115203 - RNA, 21 nt, Human
ccugagcgucccaguacacug

SEQ ID NO: 115204 - RNA, 28 nt, Human
ccugagcuacagagcaagacucugccuc

SEQ ID NO: 115205 - RNA, 19 nt, Human
ccugagcuacugcuucuaa

SEQ ID NO: 115206 - RNA, 32 nt, Human
ccugagcuaggaguggagaaucagggccaagu

SEQ ID NO: 115207 - RNA, 19 nt, Human
ccugagcuagggggugugg

SEQ ID NO: 115208 - RNA, 20 nt, Human
ccugagcuaucagccuucca

SEQ ID NO: 115209 - RNA, 32 nt, Human
ccugagcucaagaggccgagguugcagugagc

SEQ ID NO: 115210 - RNA, 32 nt, Human
ccugagcucaagagguugaggcugcagugagc

SEQ ID NO: 115211 - RNA, 32 nt, Human
ccugagcucaaggagaugcaggcugcaguggg

SEQ ID NO: 115212 - RNA, 32 nt, Human
ccugagcucaggaguccaagaccagccugggc

SEQ ID NO: 115213 - RNA, 32 nt, Human
ccugagcucaggaguuugagaccagccugucu

SEQ ID NO: 115214 - RNA, 32 nt, Human
ccugagcuccacccuccccucuucuugcggca

SEQ ID NO: 115215 - RNA, 32 nt, Human
ccugagcuccaguccugaguuugcuacuuacu

SEQ ID NO: 115216 - RNA, 18 nt, Human
ccugagcuccauucuucc

SEQ ID NO: 115217 - RNA, 32 nt, Human
ccugagcuccugcuucgcgccugcugcucugc
